United States Patent 8,969,254 (OLIGONUCLEOTIDE ARRAY FOR TISSUE TYPING) - sequence listing, part 16

SEQ ID NO: 361941 - DNA, 26 bp, Artificial Sequence
  Description of Artificial Sequence: Synthetic oligonucleotide
cgaggccggttctcacacagtccaga

SEQ ID NO: 361942 - DNA, 39 bp, Artificial Sequence; identical to SEQ ID NO: 235577
  Description of Artificial Sequence: Synthetic oligonucleotide

SEQ ID NO: 361943 - DNA, 26 bp, Artificial Sequence
  Description of Artificial Sequence: Synthetic oligonucleotide
gaggccggttctcacacagtccagag

SEQ ID NO: 361944 - DNA, 38 bp, Artificial Sequence; identical to SEQ ID NO: 235578
  Description of Artificial Sequence: Synthetic oligonucleotide

SEQ ID NO: 361945 - DNA, 27 bp, Artificial Sequence
  Description of Artificial Sequence: Synthetic oligonucleotide
aggccggttctcacacagtccagagga

SEQ ID NO: 361946 - DNA, 37 bp, Artificial Sequence; identical to SEQ ID NO: 235579
  Description of Artificial Sequence: Synthetic oligonucleotide

SEQ ID NO: 361947 - DNA, 27 bp, Artificial Sequence
  Description of Artificial Sequence: Synthetic oligonucleotide
ggccggttctcacacagtccagaggat

SEQ ID NO: 361948 - DNA, 37 bp, Artificial Sequence; identical to SEQ ID NO: 235580
  Description of Artificial Sequence: Synthetic oligonucleotide

SEQ ID NO: 361949 - DNA, 27 bp, Artificial Sequence
  Description of Artificial Sequence: Synthetic oligonucleotide
gccggttctcacacagtccagaggatg

SEQ ID NO: 361950 - DNA, 36 bp, Artificial Sequence; identical to SEQ ID NO: 235581
  Description of Artificial Sequence: Synthetic oligonucleotide

SEQ ID NO: 361951 - DNA, 30 bp, Artificial Sequence
  Description of Artificial Sequence: Synthetic oligonucleotide
ccggttctcacacagtccagaggatgtatg

SEQ ID NO: 361952 - DNA, 35 bp, Artificial Sequence; identical to SEQ ID NO: 235582
  Description of Artificial Sequence: Synthetic oligonucleotide

SEQ ID NO: 361953 - DNA, 30 bp, Artificial Sequence
  Description of Artificial Sequence: Synthetic oligonucleotide
cggttctcacacagtccagaggatgtatgg

SEQ ID NO: 361954 - DNA, 36 bp, Artificial Sequence; identical to SEQ ID NO: 235583
  Description of Artificial Sequence: Synthetic oligonucleotide

SEQ ID NO: 361955 - DNA, 30 bp, Artificial Sequence
  Description of Artificial Sequence: Synthetic oligonucleotide
ggttctcacacagtccagaggatgtatggc

SEQ ID NO: 361956 - DNA, 35 bp, Artificial Sequence; identical to SEQ ID NO: 235584
  Description of Artificial Sequence: Synthetic oligonucleotide

SEQ ID NO: 361957 - DNA, 31 bp, Artificial Sequence
  Description of Artificial Sequence: Synthetic oligonucleotide
gttctcacacagtccagaggatgtatggctg

SEQ ID NO: 361958 - DNA, 34 bp, Artificial Sequence; identical to SEQ ID NO: 235585
  Description of Artificial Sequence: Synthetic oligonucleotide

SEQ ID NO: 361959 - DNA, 31 bp, Artificial Sequence
  Description of Artificial Sequence: Synthetic oligonucleotide
ttctcacacagtccagaggatgtatggctgc

SEQ ID NO: 361960 - DNA, 35 bp, Artificial Sequence; identical to SEQ ID NO: 235586
  Description of Artificial Sequence: Synthetic oligonucleotide

SEQ ID NO: 361961 - DNA, 30 bp, Artificial Sequence
  Description of Artificial Sequence: Synthetic oligonucleotide
tctcacacagtccagaggatgtatggctgc

SEQ ID NO: 361962 - DNA, 34 bp, Artificial Sequence; identical to SEQ ID NO: 235587
  Description of Artificial Sequence: Synthetic oligonucleotide

SEQ ID NO: 361963 - DNA, 29 bp, Artificial Sequence
  Description of Artificial Sequence: Synthetic oligonucleotide
ctcacacagtccagaggatgtatggctgc

SEQ ID NO: 361964 - DNA, 33 bp, Artificial Sequence; identical to SEQ ID NO: 235588
  Description of Artificial Sequence: Synthetic oligonucleotide

SEQ ID NO: 361965 - DNA, 29 bp, Artificial Sequence
  Description of Artificial Sequence: Synthetic oligonucleotide
tcacacagtccagaggatgtatggctgcg

SEQ ID NO: 361966 - DNA, 34 bp, Artificial Sequence; identical to SEQ ID NO: 235589
  Description of Artificial Sequence: Synthetic oligonucleotide

SEQ ID NO: 361967 - DNA, 28 bp, Artificial Sequence
  Description of Artificial Sequence: Synthetic oligonucleotide
cacacagtccagaggatgtatggctgcg

SEQ ID NO: 361968 - DNA, 33 bp, Artificial Sequence; identical to SEQ ID NO: 235590
  Description of Artificial Sequence: Synthetic oligonucleotide

SEQ ID NO: 361969 - DNA, 29 bp, Artificial Sequence
  Description of Artificial Sequence: Synthetic oligonucleotide
acacagtccagaggatgtatggctgcgac

SEQ ID NO: 361970 - DNA, 32 bp, Artificial Sequence; identical to SEQ ID NO: 235591
  Description of Artificial Sequence: Synthetic oligonucleotide

SEQ ID NO: 361971 - DNA, 28 bp, Artificial Sequence
  Description of Artificial Sequence: Synthetic oligonucleotide
cacagtccagaggatgtatggctgcgac

SEQ ID NO: 361972 - DNA, 33 bp, Artificial Sequence; identical to SEQ ID NO: 235592
  Description of Artificial Sequence: Synthetic oligonucleotide

SEQ ID NO: 361973 - DNA, 28 bp, Artificial Sequence
  Description of Artificial Sequence: Synthetic oligonucleotide
acagtccagaggatgtatggctgcgacg

SEQ ID NO: 361974 - DNA, 32 bp, Artificial Sequence; identical to SEQ ID NO: 235593
  Description of Artificial Sequence: Synthetic oligonucleotide

SEQ ID NO: 361975 - DNA, 27 bp, Artificial Sequence
  Description of Artificial Sequence: Synthetic oligonucleotide
cagtccagaggatgtatggctgcgacg

SEQ ID NO: 361976 - DNA, 31 bp, Artificial Sequence; identical to SEQ ID NO: 235594
  Description of Artificial Sequence: Synthetic oligonucleotide

SEQ ID NO: 361977 - DNA, 28 bp, Artificial Sequence
  Description of Artificial Sequence: Synthetic oligonucleotide
agtccagaggatgtatggctgcgacgtg

SEQ ID NO: 361978 - DNA, 30 bp, Artificial Sequence; identical to SEQ ID NO: 235595
  Description of Artificial Sequence: Synthetic oligonucleotide

SEQ ID NO: 361979 - DNA, 32 bp, Artificial Sequence
  Description of Artificial Sequence: Synthetic oligonucleotide
caaggattacatcgccctgaaagaggacctac

SEQ ID NO: 361980 - DNA, 29 bp, Artificial Sequence
  Description of Artificial Sequence: Synthetic oligonucleotide
ccatgatccagcgttccaaccagactcag

SEQ ID NO: 361981 - DNA, 32 bp, Artificial Sequence
  Description of Artificial Sequence: Synthetic oligonucleotide
aaggattacatcgccctgaaagaggacctacg

SEQ ID NO: 361982 - DNA, 29 bp, Artificial Sequence
  Description of Artificial Sequence: Synthetic oligonucleotide
catgatccagcgttccaaccagactcagg

SEQ ID NO: 361983 - DNA, 31 bp, Artificial Sequence
  Description of Artificial Sequence: Synthetic oligonucleotide
aggattacatcgccctgaaagaggacctacg

SEQ ID NO: 361984 - DNA, 29 bp, Artificial Sequence
  Description of Artificial Sequence: Synthetic oligonucleotide
atgatccagcgttccaaccagactcaggc

SEQ ID NO: 361985 - DNA, 30 bp, Artificial Sequence
  Description of Artificial Sequence: Synthetic oligonucleotide
ggattacatcgccctgaaagaggacctacg

SEQ ID NO: 361986 - DNA, 28 bp, Artificial Sequence
  Description of Artificial Sequence: Synthetic oligonucleotide
tgatccagcgttccaaccagactcaggc

SEQ ID NO: 361987 - DNA, 30 bp, Artificial Sequence
  Description of Artificial Sequence: Synthetic oligonucleotide
gattacatcgccctgaaagaggacctacgc

SEQ ID NO: 361988 - DNA, 27 bp, Artificial Sequence
  Description of Artificial Sequence: Synthetic oligonucleotide
gatccagcgttccaaccagactcaggc

SEQ ID NO: 361989 - DNA, 31 bp, Artificial Sequence
  Description of Artificial Sequence: Synthetic oligonucleotide
attacatcgccctgaaagaggacctacgctc

SEQ ID NO: 361990 - DNA, 27 bp, Artificial Sequence
  Description of Artificial Sequence: Synthetic oligonucleotide
atccagcgttccaaccagactcaggcg

SEQ ID NO: 361991 - DNA, 30 bp, Artificial Sequence
  Description of Artificial Sequence: Synthetic oligonucleotide
ttacatcgccctgaaagaggacctacgctc

SEQ ID NO: 361992 - DNA, 27 bp, Artificial Sequence
  Description of Artificial Sequence: Synthetic oligonucleotide
tccagcgttccaaccagactcaggcga

SEQ ID NO: 361993 - DNA, 29 bp, Artificial Sequence
  Description of Artificial Sequence: Synthetic oligonucleotide
tacatcgccctgaaagaggacctacgctc

SEQ ID NO: 361994 - DNA, 26 bp, Artificial Sequence
  Description of Artificial Sequence: Synthetic oligonucleotide
ccagcgttccaaccagactcaggcga

SEQ ID NO: 361995 - DNA, 28 bp, Artificial Sequence
  Description of Artificial Sequence: Synthetic oligonucleotide
acatcgccctgaaagaggacctacgctc

SEQ ID NO: 361996 - DNA, 26 bp, Artificial Sequence
  Description of Artificial Sequence: Synthetic oligonucleotide
cagcgttccaaccagactcaggcgac

SEQ ID NO: 361997 - DNA, 27 bp, Artificial Sequence
  Description of Artificial Sequence: Synthetic oligonucleotide
catcgccctgaaagaggacctacgctc

SEQ ID NO: 361998 - DNA, 27 bp, Artificial Sequence
  Description of Artificial Sequence: Synthetic oligonucleotide
agcgttccaaccagactcaggcgacca

SEQ ID NO: 361999 - DNA, 29 bp, Artificial Sequence
  Description of Artificial Sequence: Synthetic oligonucleotide
atcgccctgaaagaggacctacgctcttg

SEQ ID NO: 362000 - DNA, 27 bp, Artificial Sequence
  Description of Artificial Sequence: Synthetic oligonucleotide
gcgttccaaccagactcaggcgaccaa

SEQ ID NO: 362001 - DNA, 28 bp, Artificial Sequence
  Description of Artificial Sequence: Synthetic oligonucleotide
tcgccctgaaagaggacctacgctcttg

SEQ ID NO: 362002 - DNA, 27 bp, Artificial Sequence
  Description of Artificial Sequence: Synthetic oligonucleotide
cgttccaaccagactcaggcgaccaac

SEQ ID NO: 362003 - DNA, 27 bp, Artificial Sequence
  Description of Artificial Sequence: Synthetic oligonucleotide
cgccctgaaagaggacctacgctcttg

SEQ ID NO: 362004 - DNA, 27 bp, Artificial Sequence
  Description of Artificial Sequence: Synthetic oligonucleotide
gttccaaccagactcaggcgaccaacg

SEQ ID NO: 362005 - DNA, 27 bp, Artificial Sequence
  Description of Artificial Sequence: Synthetic oligonucleotide
gccctgaaagaggacctacgctcttgg

SEQ ID NO: 362006 - DNA, 29 bp, Artificial Sequence
  Description of Artificial Sequence: Synthetic oligonucleotide
ttccaaccagactcaggcgaccaacgatc

SEQ ID NO: 362007 - DNA, 28 bp, Artificial Sequence
  Description of Artificial Sequence: Synthetic oligonucleotide
ccctgaaagaggacctacgctcttggac

SEQ ID NO: 362008 - DNA, 28 bp, Artificial Sequence
  Description of Artificial Sequence: Synthetic oligonucleotide
tccaaccagactcaggcgaccaacgatc

SEQ ID NO: 362009 - DNA, 28 bp, Artificial Sequence
  Description of Artificial Sequence: Synthetic oligonucleotide
cctgaaagaggacctacgctcttggacc

SEQ ID NO: 362010 - DNA, 27 bp, Artificial Sequence
  Description of Artificial Sequence: Synthetic oligonucleotide
ccaaccagactcaggcgaccaacgatc

SEQ ID NO: 362011 - DNA, 28 bp, Artificial Sequence
  Description of Artificial Sequence: Synthetic oligonucleotide
ctgaaagaggacctacgctcttggaccg

SEQ ID NO: 362012 - DNA, 27 bp, Artificial Sequence
  Description of Artificial Sequence: Synthetic oligonucleotide
caaccagactcaggcgaccaacgatcg

SEQ ID NO: 362013 - DNA, 28 bp, Artificial Sequence
  Description of Artificial Sequence: Synthetic oligonucleotide
tgaaagaggacctacgctcttggaccgc

SEQ ID NO: 362014 - DNA, 27 bp, Artificial Sequence
  Description of Artificial Sequence: Synthetic oligonucleotide
aaccagactcaggcgaccaacgatcgc

SEQ ID NO: 362015 - DNA, 27 bp, Artificial Sequence
  Description of Artificial Sequence: Synthetic oligonucleotide
gaaagaggacctacgctcttggaccgc

SEQ ID NO: 362016 - DNA, 26 bp, Artificial Sequence
  Description of Artificial Sequence: Synthetic oligonucleotide
accagactcaggcgaccaacgatcgc

SEQ ID NO: 362017 - DNA, 27 bp, Artificial Sequence
  Description of Artificial Sequence: Synthetic oligonucleotide
aaagaggacctacgctcttggaccgcg

SEQ ID NO: 362018 - DNA, 25 bp, Artificial Sequence
  Description of Artificial Sequence: Synthetic oligonucleotide
ccagactcaggcgaccaacgatcgc

SEQ ID NO: 362019 - DNA, 26 bp, Artificial Sequence
  Description of Artificial Sequence: Synthetic oligonucleotide
aagaggacctacgctcttggaccgcg

SEQ ID NO: 362020 - DNA, 25 bp, Artificial Sequence
  Description of Artificial Sequence: Synthetic oligonucleotide
cagactcaggcgaccaacgatcgcc

SEQ ID NO: 362021 - DNA, 25 bp, Artificial Sequence
  Description of Artificial Sequence: Synthetic oligonucleotide
agaggacctacgctcttggaccgcg

SEQ ID NO: 362022 - DNA, 26 bp, Artificial Sequence
  Description of Artificial Sequence: Synthetic oligonucleotide
agactcaggcgaccaacgatcgccct

SEQ ID NO: 362023 - DNA, 24 bp, Artificial Sequence
  Description of Artificial Sequence: Synthetic oligonucleotide
gaggacctacgctcttggaccgcg

SEQ ID NO: 362024 - DNA, 25 bp, Artificial Sequence
  Description of Artificial Sequence: Synthetic oligonucleotide
gactcaggcgaccaacgatcgccct

SEQ ID NO: 362025 - DNA, 24 bp, Artificial Sequence
  Description of Artificial Sequence: Synthetic oligonucleotide
aggacctacgctcttggaccgcgg

SEQ ID NO: 362026 - DNA, 26 bp, Artificial Sequence
  Description of Artificial Sequence: Synthetic oligonucleotide
actcaggcgaccaacgatcgccctga

SEQ ID NO: 362027 - DNA, 23 bp, Artificial Sequence
  Description of Artificial Sequence: Synthetic oligonucleotide
ggacctacgctcttggaccgcgg

SEQ ID NO: 362028 - DNA, 25 bp, Artificial Sequence
  Description of Artificial Sequence: Synthetic oligonucleotide
ctcaggcgaccaacgatcgccctga

SEQ ID NO: 362029 - DNA, 23 bp, Artificial Sequence
  Description of Artificial Sequence: Synthetic oligonucleotide
gacctacgctcttggaccgcggc

SEQ ID NO: 362030 - DNA, 25 bp, Artificial Sequence
  Description of Artificial Sequence: Synthetic oligonucleotide
tcaggcgaccaacgatcgccctgag

SEQ ID NO: 362031 - DNA, 23 bp, Artificial Sequence
  Description of Artificial Sequence: Synthetic oligonucleotide
acctacgctcttggaccgcggcg

SEQ ID NO: 362032 - DNA, 24 bp, Artificial Sequence
  Description of Artificial Sequence: Synthetic oligonucleotide
caggcgaccaacgatcgccctgag

SEQ ID NO: 362033 - DNA, 22 bp, Artificial Sequence
  Description of Artificial Sequence: Synthetic oligonucleotide
cctacgctcttggaccgcggcg

SEQ ID NO: 362034 - DNA, 25 bp, Artificial Sequence
  Description of Artificial Sequence: Synthetic oligonucleotide
aggcgaccaacgatcgccctgaggt

SEQ ID NO: 362035 - DNA, 23 bp, Artificial Sequence
  Description of Artificial Sequence: Synthetic oligonucleotide
ctacgctcttggaccgcggcgga

SEQ ID NO: 362036 - DNA, 24 bp, Artificial Sequence
  Description of Artificial Sequence: Synthetic oligonucleotide
ggcgaccaacgatcgccctgaggt

SEQ ID NO: 362037 - DNA, 25 bp, Artificial Sequence
  Description of Artificial Sequence: Synthetic oligonucleotide
tacgctcttggaccgcggcggacat

SEQ ID NO: 362038 - DNA, 24 bp, Artificial Sequence
  Description of Artificial Sequence: Synthetic oligonucleotide
gcgaccaacgatcgccctgaggtc

SEQ ID NO: 362039 - DNA, 24 bp, Artificial Sequence
  Description of Artificial Sequence: Synthetic oligonucleotide
acgctcttggaccgcggcggacat

SEQ ID NO: 362040 - DNA, 25 bp, Artificial Sequence
  Description of Artificial Sequence: Synthetic oligonucleotide
cgaccaacgatcgccctgaggtcga

SEQ ID NO: 362041 - DNA, 25 bp, Artificial Sequence
  Description of Artificial Sequence: Synthetic oligonucleotide
gccgtggatagagcaggagggtcca

SEQ ID NO: 362042 - DNA, 27 bp, Artificial Sequence
  Description of Artificial Sequence: Synthetic oligonucleotide
gaccaacgatcgccctgaggtcgacaa

SEQ ID NO: 362043 - DNA, 26 bp, Artificial Sequence
  Description of Artificial Sequence: Synthetic oligonucleotide
ccgtggatagagcaggagggtccaga

SEQ ID NO: 362044 - DNA, 27 bp, Artificial Sequence
  Description of Artificial Sequence: Synthetic oligonucleotide
accaacgatcgccctgaggtcgacaag

SEQ ID NO: 362045 - DNA, 27 bp, Artificial Sequence
  Description of Artificial Sequence: Synthetic oligonucleotide
cgtggatagagcaggagggtccagagt

SEQ ID NO: 362046 - DNA, 27 bp, Artificial Sequence
  Description of Artificial Sequence: Synthetic oligonucleotide
ccaacgatcgccctgaggtcgacaagt

SEQ ID NO: 362047 - DNA, 30 bp, Artificial Sequence
  Description of Artificial Sequence: Synthetic oligonucleotide
gtggatagagcaggagggtccagagtattg

SEQ ID NO: 362048 - DNA, 28 bp, Artificial Sequence
  Description of Artificial Sequence: Synthetic oligonucleotide
caacgatcgccctgaggtcgacaagttc

SEQ ID NO: 362049 - DNA, 30 bp, Artificial Sequence
  Description of Artificial Sequence: Synthetic oligonucleotide
tggatagagcaggagggtccagagtattgg

SEQ ID NO: 362050 - DNA, 30 bp, Artificial Sequence; identical to SEQ ID NO: 235631
  Description of Artificial Sequence: Synthetic oligonucleotide

SEQ ID NO: 362051 - DNA, 29 bp, Artificial Sequence
  Description of Artificial Sequence: Synthetic oligonucleotide
ggatagagcaggagggtccagagtattgg

SEQ ID NO: 362052 - DNA, 29 bp, Artificial Sequence
  Description of Artificial Sequence: Synthetic oligonucleotide
acgatcgccctgaggtcgacaagttcatc

SEQ ID NO: 362053 - DNA, 29 bp, Artificial Sequence
  Description of Artificial Sequence: Synthetic oligonucleotide
gatagagcaggagggtccagagtattggg

SEQ ID NO: 362054 - DNA, 28 bp, Artificial Sequence
  Description of Artificial Sequence: Synthetic oligonucleotide
cgatcgccctgaggtcgacaagttcatc

SEQ ID NO: 362055 - DNA, 30 bp, Artificial Sequence
  Description of Artificial Sequence: Synthetic oligonucleotide
atagagcaggagggtccagagtattgggac

SEQ ID NO: 362056 - DNA, 28 bp, Artificial Sequence
  Description of Artificial Sequence: Synthetic oligonucleotide
gatcgccctgaggtcgacaagttcatcc

SEQ ID NO: 362057 - DNA, 29 bp, Artificial Sequence
  Description of Artificial Sequence: Synthetic oligonucleotide
tagagcaggagggtccagagtattgggac

SEQ ID NO: 362058 - DNA, 28 bp, Artificial Sequence
  Description of Artificial Sequence: Synthetic oligonucleotide
atcgccctgaggtcgacaagttcatccc

SEQ ID NO: 362059 - DNA, 28 bp, Artificial Sequence
  Description of Artificial Sequence: Synthetic oligonucleotide
agagcaggagggtccagagtattgggac

SEQ ID NO: 362060 - DNA, 27 bp, Artificial Sequence
  Description of Artificial Sequence: Synthetic oligonucleotide
tcgccctgaggtcgacaagttcatccc

SEQ ID NO: 362061 - DNA, 27 bp, Artificial Sequence
  Description of Artificial Sequence: Synthetic oligonucleotide
gagcaggagggtccagagtattgggac

SEQ ID NO: 362062 - DNA, 27 bp, Artificial Sequence
  Description of Artificial Sequence: Synthetic oligonucleotide
cgccctgaggtcgacaagttcatccca

SEQ ID NO: 362063 - DNA, 27 bp, Artificial Sequence
  Description of Artificial Sequence: Synthetic oligonucleotide
agcaggagggtccagagtattgggacg

SEQ ID NO: 362064 - DNA, 27 bp, Artificial Sequence
  Description of Artificial Sequence: Synthetic oligonucleotide
gccctgaggtcgacaagttcatcccac

SEQ ID NO: 362065 - DNA, 26 bp, Artificial Sequence
  Description of Artificial Sequence: Synthetic oligonucleotide
gcaggagggtccagagtattgggacg

SEQ ID NO: 362066 - DNA, 27 bp, Artificial Sequence
  Description of Artificial Sequence: Synthetic oligonucleotide
ccctgaggtcgacaagttcatcccacc

SEQ ID NO: 362067 - DNA, 26 bp, Artificial Sequence
  Description of Artificial Sequence: Synthetic oligonucleotide
caggagggtccagagtattgggacgg

SEQ ID NO: 362068 - DNA, 28 bp, Artificial Sequence
  Description of Artificial Sequence: Synthetic oligonucleotide
cctgaggtcgacaagttcatcccaccag

SEQ ID NO: 362069 - DNA, 26 bp, Artificial Sequence
  Description of Artificial Sequence: Synthetic oligonucleotide
aggagggtccagagtattgggacggg

SEQ ID NO: 362070 - DNA, 29 bp, Artificial Sequence
  Description of Artificial Sequence: Synthetic oligonucleotide
ctgaggtcgacaagttcatcccaccagag

SEQ ID NO: 362071 - DNA, 25 bp, Artificial Sequence
  Description of Artificial Sequence: Synthetic oligonucleotide
ggagggtccagagtattgggacggg

SEQ ID NO: 362072 - DNA, 29 bp, Artificial Sequence
  Description of Artificial Sequence: Synthetic oligonucleotide
tgaggtcgacaagttcatcccaccagagc

SEQ ID NO: 362073 - DNA, 26 bp, Artificial Sequence
  Description of Artificial Sequence: Synthetic oligonucleotide
gagggtccagagtattgggacgggga

SEQ ID NO: 362074 - DNA, 28 bp, Artificial Sequence
  Description of Artificial Sequence: Synthetic oligonucleotide
gaggtcgacaagttcatcccaccagagc

SEQ ID NO: 362075 - DNA, 27 bp, Artificial Sequence
  Description of Artificial Sequence: Synthetic oligonucleotide
agggtccagagtattgggacggggaga

SEQ ID NO: 362076 - DNA, 29 bp, Artificial Sequence
  Description of Artificial Sequence: Synthetic oligonucleotide
aggtcgacaagttcatcccaccagagctc

SEQ ID NO: 362077 - DNA, 26 bp, Artificial Sequence
  Description of Artificial Sequence: Synthetic oligonucleotide
gggtccagagtattgggacggggaga

SEQ ID NO: 362078 - DNA, 28 bp, Artificial Sequence
  Description of Artificial Sequence: Synthetic oligonucleotide
ggtcgacaagttcatcccaccagagctc

SEQ ID NO: 362079 - DNA, 27 bp, Artificial Sequence
  Description of Artificial Sequence: Synthetic oligonucleotide
ggtccagagtattgggacggggagaca

SEQ ID NO: 362080 - DNA, 30 bp, Artificial Sequence; identical to SEQ ID NO: 235646
  Description of Artificial Sequence: Synthetic oligonucleotide

SEQ ID NO: 362081 - DNA, 27 bp, Artificial Sequence
  Description of Artificial Sequence: Synthetic oligonucleotide
gtccagagtattgggacggggagacac

SEQ ID NO: 362082 - DNA, 30 bp, Artificial Sequence; identical to SEQ ID NO: 235647
  Description of Artificial Sequence: Synthetic oligonucleotide

SEQ ID NO: 362083 - DNA, 27 bp, Artificial Sequence
  Description of Artificial Sequence: Synthetic oligonucleotide
tccagagtattgggacggggagacacg

SEQ ID NO: 362084 - DNA, 29 bp, Artificial Sequence
  Description of Artificial Sequence: Synthetic oligonucleotide
cgacaagttcatcccaccagagctcaacg

SEQ ID NO: 362085 - DNA, 26 bp, Artificial Sequence
  Description of Artificial Sequence: Synthetic oligonucleotide
ccagagtattgggacggggagacacg

SEQ ID NO: 362086 - DNA, 30 bp, Artificial Sequence; identical to SEQ ID NO: 235649
  Description of Artificial Sequence: Synthetic oligonucleotide

SEQ ID NO: 362087 - DNA, 27 bp, Artificial Sequence
  Description of Artificial Sequence: Synthetic oligonucleotide
cagagtattgggacggggagacacgga

SEQ ID NO: 362088 - DNA, 31 bp, Artificial Sequence; identical to SEQ ID NO: 235650
  Description of Artificial Sequence: Synthetic oligonucleotide

SEQ ID NO: 362089 - DNA, 29 bp, Artificial Sequence
  Description of Artificial Sequence: Synthetic oligonucleotide
agagtattgggacggggagacacggaaag

SEQ ID NO: 362090 - DNA, 30 bp, Artificial Sequence; identical to SEQ ID NO: 235651
  Description of Artificial Sequence: Synthetic oligonucleotide

SEQ ID NO: 362091 - DNA, 22 bp, Artificial Sequence
  Description of Artificial Sequence: Synthetic oligonucleotide
ttcgacagcgacgccgcgagcc

SEQ ID NO: 362092 - DNA, 30 bp, Artificial Sequence; identical to SEQ ID NO: 235652
  Description of Artificial Sequence: Synthetic oligonucleotide

SEQ ID NO: 362093 - DNA, 21 bp, Artificial Sequence
  Description of Artificial Sequence: Synthetic oligonucleotide
tcgacagcgacgccgcgagcc

SEQ ID NO: 362094 - DNA, 29 bp, Artificial Sequence
  Description of Artificial Sequence: Synthetic oligonucleotide
agttcatcccaccagagctcaacgtgacg

SEQ ID NO: 362095 - DNA, 20 bp, Artificial Sequence
  Description of Artificial Sequence: Synthetic oligonucleotide
cgacagcgacgccgcgagcc

SEQ ID NO: 362096 - DNA, 28 bp, Artificial Sequence
  Description of Artificial Sequence: Synthetic oligonucleotide
gttcatcccaccagagctcaacgtgacg

SEQ ID NO: 362097 - DNA, 20 bp, Artificial Sequence
  Description of Artificial Sequence: Synthetic oligonucleotide
gacagcgacgccgcgagccg

SEQ ID NO: 362098 - DNA, 29 bp, Artificial Sequence
  Description of Artificial Sequence: Synthetic oligonucleotide
ttcatcccaccagagctcaacgtgacgtg

SEQ ID NO: 362099 - DNA, 21 bp, Artificial Sequence
  Description of Artificial Sequence: Synthetic oligonucleotide
acagcgacgccgcgagccgga

SEQ ID NO: 362100 - DNA, 28 bp, Artificial Sequence
  Description of Artificial Sequence: Synthetic oligonucleotide
tcatcccaccagagctcaacgtgacgtg

SEQ ID NO: 362101 - DNA, 20 bp, Artificial Sequence
  Description of Artificial Sequence: Synthetic oligonucleotide
cagcgacgccgcgagccgga

SEQ ID NO: 362102 - DNA, 27 bp, Artificial Sequence
  Description of Artificial Sequence: Synthetic oligonucleotide
catcccaccagagctcaacgtgacgtg

SEQ ID NO: 362103 - DNA, 20 bp, Artificial Sequence
  Description of Artificial Sequence: Synthetic oligonucleotide
agcgacgccgcgagccggag

SEQ ID NO: 362104 - DNA, 27 bp, Artificial Sequence
  Description of Artificial Sequence: Synthetic oligonucleotide
atcccaccagagctcaacgtgacgtgg

SEQ ID NO: 362105 - DNA, 20 bp, Artificial Sequence
  Description of Artificial Sequence: Synthetic oligonucleotide
gcgacgccgcgagccggagt

SEQ ID NO: 362106 - DNA, 26 bp, Artificial Sequence
  Description of Artificial Sequence: Synthetic oligonucleotide
tcccaccagagctcaacgtgacgtgg

SEQ ID NO: 362107 - DNA, 21 bp, Artificial Sequence
  Description of Artificial Sequence: Synthetic oligonucleotide
cgacgccgcgagccggaggat

SEQ ID NO: 362108 - DNA, 25 bp, Artificial Sequence
  Description of Artificial Sequence: Synthetic oligonucleotide
cccaccagagctcaacgtgacgtgg

SEQ ID NO: 362109 - DNA, 21 bp, Artificial Sequence
  Description of Artificial Sequence: Synthetic oligonucleotide
gacgccgcgagccggaggatg

SEQ ID NO: 362110 - DNA, 26 bp, Artificial Sequence
  Description of Artificial Sequence: Synthetic oligonucleotide
ccaccagagctcaacgtgacgtggct

SEQ ID NO: 362111 - DNA, 22 bp, Artificial Sequence
  Description of Artificial Sequence: Synthetic oligonucleotide
acgccgcgagccggaggatgga

SEQ ID NO: 362112 - DNA, 27 bp, Artificial Sequence
  Description of Artificial Sequence: Synthetic oligonucleotide
caccagagctcaacgtgacgtggctga

SEQ ID NO: 362113 - DNA, 21 bp, Artificial Sequence
  Description of Artificial Sequence: Synthetic oligonucleotide
cgccgcgagccggaggatgga

SEQ ID NO: 362114 - DNA, 27 bp, Artificial Sequence
  Description of Artificial Sequence: Synthetic oligonucleotide
accagagctcaacgtgacgtggctgag

SEQ ID NO: 362115 - DNA, 21 bp, Artificial Sequence
  Description of Artificial Sequence: Synthetic oligonucleotide
gccgcgagccggaggatggag

SEQ ID NO: 362116 - DNA, 26 bp, Artificial Sequence
  Description of Artificial Sequence: Synthetic oligonucleotide
ccagagctcaacgtgacgtggctgag

SEQ ID NO: 362117 - DNA, 21 bp, Artificial Sequence
  Description of Artificial Sequence: Synthetic oligonucleotide
ccgcgagccggaggatggagc

SEQ ID NO: 362118 - DNA, 27 bp, Artificial Sequence
  Description of Artificial Sequence: Synthetic oligonucleotide
cagagctcaacgtgacgtggctgagca

SEQ ID NO: 362119 - DNA, 21 bp, Artificial Sequence
  Description of Artificial Sequence: Synthetic oligonucleotide
cgcgagccggaggatggagcc

SEQ ID NO: 362120 - DNA, 28 bp, Artificial Sequence
  Description of Artificial Sequence: Synthetic oligonucleotide
agagctcaacgtgacgtggctgagcaac

SEQ ID NO: 362121 - DNA, 21 bp, Artificial Sequence
  Description of Artificial Sequence: Synthetic oligonucleotide
gcgagccggaggatggagccg

SEQ ID NO: 362122 - DNA, 27 bp, Artificial Sequence
  Description of Artificial Sequence: Synthetic oligonucleotide
gagctcaacgtgacgtggctgagcaac

SEQ ID NO: 362123 - DNA, 21 bp, Artificial Sequence
  Description of Artificial Sequence: Synthetic oligonucleotide
cgagccggaggatggagccgc

SEQ ID NO: 362124 - DNA, 27 bp, Artificial Sequence
  Description of Artificial Sequence: Synthetic oligonucleotide
agctcaacgtgacgtggctgagcaacg

SEQ ID NO: 362125 - DNA, 21 bp, Artificial Sequence
  Description of Artificial Sequence: Synthetic oligonucleotide
gagccggaggatggagccgcg

SEQ ID NO: 362126 - DNA, 26 bp, Artificial Sequence
  Description of Artificial Sequence: Synthetic oligonucleotide
gctcaacgtgacgtggctgagcaacg

SEQ ID NO: 362127 - DNA, 21 bp, Artificial Sequence
  Description of Artificial Sequence: Synthetic oligonucleotide
agccggaggatggagccgcgg

SEQ ID NO: 362128 - DNA, 26 bp, Artificial Sequence
  Description of Artificial Sequence: Synthetic oligonucleotide
ctcaacgtgacgtggctgagcaacgg

SEQ ID NO: 362129 - DNA, 20 bp, Artificial Sequence
  Description of Artificial Sequence: Synthetic oligonucleotide
gccggaggatggagccgcgg

SEQ ID NO: 362130 - DNA, 26 bp, Artificial Sequence
  Description of Artificial Sequence: Synthetic oligonucleotide
tcaacgtgacgtggctgagcaacggg

SEQ ID NO: 362131 - DNA, 20 bp, Artificial Sequence
  Description of Artificial Sequence: Synthetic oligonucleotide
ccggaggatggagccgcggg

SEQ ID NO: 362132 - DNA, 25 bp, Artificial Sequence
  Description of Artificial Sequence: Synthetic oligonucleotide
caacgtgacgtggctgagcaacggg

SEQ ID NO: 362133 - DNA, 20 bp, Artificial Sequence
  Description of Artificial Sequence: Synthetic oligonucleotide
cggaggatggagccgcgggc

SEQ ID NO: 362134 - DNA, 26 bp, Artificial Sequence
  Description of Artificial Sequence: Synthetic oligonucleotide
aacgtgacgtggctgagcaacggggt

SEQ ID NO: 362135 - DNA, 20 bp, Artificial Sequence
  Description of Artificial Sequence: Synthetic oligonucleotide
ggaggatggagccgcgggcg

SEQ ID NO: 362136 - DNA, 25 bp, Artificial Sequence
  Description of Artificial Sequence: Synthetic oligonucleotide
acgtgacgtggctgagcaacggggt

SEQ ID NO: 362137 - DNA, 25 bp, Artificial Sequence
  Description of Artificial Sequence: Synthetic oligonucleotide
agagcgaggccggttctcacaccct

SEQ ID NO: 362138 - DNA, 24 bp, Artificial Sequence
  Description of Artificial Sequence: Synthetic oligonucleotide
cgtgacgtggctgagcaacggggt

SEQ ID NO: 362139 - DNA, 24 bp, Artificial Sequence
  Description of Artificial Sequence: Synthetic oligonucleotide
gagcgaggccggttctcacaccct

SEQ ID NO: 362140 - DNA, 24 bp, Artificial Sequence
  Description of Artificial Sequence: Synthetic oligonucleotide
gtgacgtggctgagcaacggggtg

SEQ ID NO: 362141 - DNA, 24 bp, Artificial Sequence
  Description of Artificial Sequence: Synthetic oligonucleotide
agcgaggccggttctcacaccctc

SEQ ID NO: 362142 - DNA, 25 bp, Artificial Sequence
  Description of Artificial Sequence: Synthetic oligonucleotide
tgacgtggctgagcaacggggtgct

SEQ ID NO: 362143 - DNA, 23 bp, Artificial Sequence
  Description of Artificial Sequence: Synthetic oligonucleotide
gcgaggccggttctcacaccctc

SEQ ID NO: 362144 - DNA, 24 bp, Artificial Sequence
  Description of Artificial Sequence: Synthetic oligonucleotide
gacgtggctgagcaacggggtgct

SEQ ID NO: 362145 - DNA, 24 bp, Artificial Sequence
  Description of Artificial Sequence: Synthetic oligonucleotide
cgaggccggttctcacaccctcca

SEQ ID NO: 362146 - DNA, 24 bp, Artificial Sequence
  Description of Artificial Sequence: Synthetic oligonucleotide
acgtggctgagcaacggggtgctg

SEQ ID NO: 362147 - DNA, 25 bp, Artificial Sequence
  Description of Artificial Sequence: Synthetic oligonucleotide
gaggccggttctcacaccctccaga

SEQ ID NO: 362148 - DNA, 23 bp, Artificial Sequence
  Description of Artificial Sequence: Synthetic oligonucleotide
cgtggctgagcaacggggtgctg

SEQ ID NO: 362149 - DNA, 25 bp, Artificial Sequence
  Description of Artificial Sequence: Synthetic oligonucleotide
aggccggttctcacaccctccagag

SEQ ID NO: 362150 - DNA, 24 bp, Artificial Sequence
  Description of Artificial Sequence: Synthetic oligonucleotide
gtggctgagcaacggggtgctggt

SEQ ID NO: 362151 - DNA, 24 bp, Artificial Sequence
  Description of Artificial Sequence: Synthetic oligonucleotide
ggccggttctcacaccctccagag

SEQ ID NO: 362152 - DNA, 25 bp, Artificial Sequence
  Description of Artificial Sequence: Synthetic oligonucleotide
tggctgagcaacggggtgctggtca

SEQ ID NO: 362153 - DNA, 26 bp, Artificial Sequence
  Description of Artificial Sequence: Synthetic oligonucleotide
gccggttctcacaccctccagaggat

SEQ ID NO: 362154 - DNA, 24 bp, Artificial Sequence
  Description of Artificial Sequence: Synthetic oligonucleotide
ggctgagcaacggggtgctggtca

SEQ ID NO: 362155 - DNA, 27 bp, Artificial Sequence
  Description of Artificial Sequence: Synthetic oligonucleotide
ccggttctcacaccctccagaggatgt

SEQ ID NO: 362156 - DNA, 25 bp, Artificial Sequence
  Description of Artificial Sequence: Synthetic oligonucleotide
gctgagcaacggggtgctggtcaca

SEQ ID NO: 362157 - DNA, 29 bp, Artificial Sequence
  Description of Artificial Sequence: Synthetic oligonucleotide
cggttctcacaccctccagaggatgtatg

SEQ ID NO: 362158 - DNA, 26 bp, Artificial Sequence
  Description of Artificial Sequence: Synthetic oligonucleotide
ctgagcaacggggtgctggtcacaga

SEQ ID NO: 362159 - DNA, 29 bp, Artificial Sequence
  Description of Artificial Sequence: Synthetic oligonucleotide
ggttctcacaccctccagaggatgtatgg

SEQ ID NO: 362160 - DNA, 26 bp, Artificial Sequence
  Description of Artificial Sequence: Synthetic oligonucleotide
tgagcaacggggtgctggtcacagag

SEQ ID NO: 362161 - DNA, 29 bp, Artificial Sequence
  Description of Artificial Sequence: Synthetic oligonucleotide
gttctcacaccctccagaggatgtatggc

SEQ ID NO: 362162 - DNA, 25 bp, Artificial Sequence
  Description of Artificial Sequence: Synthetic oligonucleotide
gagcaacggggtgctggtcacagag

SEQ ID NO: 362163 - DNA, 30 bp, Artificial Sequence; identical to SEQ ID NO: 4850
  Description of Artificial Sequence: Synthetic oligonucleotide

SEQ ID NO: 362164 - DNA, 25 bp, Artificial Sequence
  Description of Artificial Sequence: Synthetic oligonucleotide
agcaacggggtgctggtcacagagg

SEQ ID NO: 362165 - DNA, 29 bp, Artificial Sequence
  Description of Artificial Sequence: Synthetic oligonucleotide
tctcacaccctccagaggatgtatggctg

SEQ ID NO: 362166 - DNA, 24 bp, Artificial Sequence
  Description of Artificial Sequence: Synthetic oligonucleotide
gcaacggggtgctggtcacagagg

SEQ ID NO: 362167 - DNA, 28 bp, Artificial Sequence
  Description of Artificial Sequence: Synthetic oligonucleotide
ctcacaccctccagaggatgtatggctg

SEQ ID NO: 362168 - DNA, 25 bp, Artificial Sequence
  Description of Artificial Sequence: Synthetic oligonucleotide
caacggggtgctggtcacagagggt

SEQ ID NO: 362169 - DNA, 28 bp, Artificial Sequence
  Description of Artificial Sequence: Synthetic oligonucleotide
tcacaccctccagaggatgtatggctgc

SEQ ID NO: 362170 - DNA, 26 bp, Artificial Sequence
  Description of Artificial Sequence: Synthetic oligonucleotide
aacggggtgctggtcacagagggtgt

SEQ ID NO: 362171 - DNA, 27 bp, Artificial Sequence
  Description of Artificial Sequence: Synthetic oligonucleotide
cacaccctccagaggatgtatggctgc

SEQ ID NO: 362172 - DNA, 25 bp, Artificial Sequence
  Description of Artificial Sequence: Synthetic oligonucleotide
acggggtgctggtcacagagggtgt

SEQ ID NO: 362173 - DNA, 27 bp, Artificial Sequence
  Description of Artificial Sequence: Synthetic oligonucleotide
acaccctccagaggatgtatggctgcg

SEQ ID NO: 362174 - DNA, 24 bp, Artificial Sequence
  Description of Artificial Sequence: Synthetic oligonucleotide
cggggtgctggtcacagagggtgt

SEQ ID NO: 362175 - DNA, 27 bp, Artificial Sequence
  Description of Artificial Sequence: Synthetic oligonucleotide
caccctccagaggatgtatggctgcga

SEQ ID NO: 362176 - DNA, 24 bp, Artificial Sequence
  Description of Artificial Sequence: Synthetic oligonucleotide
ggggtgctggtcacagagggtgtc

SEQ ID NO: 362177 - DNA, 27 bp, Artificial Sequence
  Description of Artificial Sequence: Synthetic oligonucleotide
accctccagaggatgtatggctgcgac

SEQ ID NO: 362178 - DNA, 24 bp, Artificial Sequence
  Description of Artificial Sequence: Synthetic oligonucleotide
gggtgctggtcacagagggtgtcc

SEQ ID NO: 362179 - DNA, 26 bp, Artificial Sequence
  Description of Artificial Sequence: Synthetic oligonucleotide
ccctccagaggatgtatggctgcgac

SEQ ID NO: 362180 - DNA, 25 bp, Artificial Sequence
  Description of Artificial Sequence: Synthetic oligonucleotide
ggtgctggtcacagagggtgtccct

SEQ ID NO: 362181 - DNA, 27 bp, Artificial Sequence
  Description of Artificial Sequence: Synthetic oligonucleotide
cctccagaggatgtatggctgcgacgt

SEQ ID NO: 362182 - DNA, 26 bp, Artificial Sequence
  Description of Artificial Sequence: Synthetic oligonucleotide
gtgctggtcacagagggtgtccctga

SEQ ID NO: 362183 - DNA, 27 bp, Artificial Sequence
  Description of Artificial Sequence: Synthetic oligonucleotide
ctccagaggatgtatggctgcgacgtg

SEQ ID NO: 362184 - DNA, 27 bp, Artificial Sequence
  Description of Artificial Sequence: Synthetic oligonucleotide
tgctggtcacagagggtgtccctgaga

SEQ ID NO: 362185 - DNA, 23 bp, Artificial Sequence
  Description of Artificial Sequence: Synthetic oligonucleotide
tggggtcggactggcgcttcctg

SEQ ID NO: 362186 - DNA, 26 bp, Artificial Sequence
  Description of Artificial Sequence: Synthetic oligonucleotide
gctggtcacagagggtgtccctgaga

SEQ ID NO: 362187 - DNA, 22 bp, Artificial Sequence
  Description of Artificial Sequence: Synthetic oligonucleotide
ggggtcggactggcgcttcctg

SEQ ID NO: 362188 - DNA, 26 bp, Artificial Sequence
  Description of Artificial Sequence: Synthetic oligonucleotide
ctggtcacagagggtgtccctgagag

SEQ ID NO: 362189 - DNA, 22 bp, Artificial Sequence
  Description of Artificial Sequence: Synthetic oligonucleotide
gggtcggactggcgcttcctgc

SEQ ID NO: 362190 - DNA, 26 bp, Artificial Sequence
  Description of Artificial Sequence: Synthetic oligonucleotide
tggtcacagagggtgtccctgagagc

SEQ ID NO: 362191 - DNA, 22 bp, Artificial Sequence
  Description of Artificial Sequence: Synthetic oligonucleotide
ggtcggactggcgcttcctgcg

SEQ ID NO: 362192 - DNA, 25 bp, Artificial Sequence
  Description of Artificial Sequence: Synthetic oligonucleotide
ggtcacagagggtgtccctgagagc

SEQ ID NO: 362193 - DNA, 22 bp, Artificial Sequence
  Description of Artificial Sequence: Synthetic oligonucleotide
gtcggactggcgcttcctgcgc

SEQ ID NO: 362194 - DNA, 26 bp, Artificial Sequence
  Description of Artificial Sequence: Synthetic oligonucleotide
gtcacagagggtgtccctgagagcca

SEQ ID NO: 362195 - DNA, 22 bp, Artificial Sequence
  Description of Artificial Sequence: Synthetic oligonucleotide
tcggactggcgcttcctgcgcg

SEQ ID NO: 362196 - DNA, 27 bp, Artificial Sequence
  Description of Artificial Sequence: Synthetic oligonucleotide
tcacagagggtgtccctgagagccact

SEQ ID NO: 362197 - DNA, 21 bp, Artificial Sequence
  Description of Artificial Sequence: Synthetic oligonucleotide
cggactggcgcttcctgcgcg

SEQ ID NO: 362198 - DNA, 27 bp, Artificial Sequence
  Description of Artificial Sequence: Synthetic oligonucleotide
cacagagggtgtccctgagagccactt

SEQ ID NO: 362199 - DNA, 21 bp, Artificial Sequence
  Description of Artificial Sequence: Synthetic oligonucleotide
ggactggcgcttcctgcgcgg

SEQ ID NO: 362200 - DNA, 27 bp, Artificial Sequence
  Description of Artificial Sequence: Synthetic oligonucleotide
acagagggtgtccctgagagccacttc

SEQ ID NO: 362201 - DNA, 23 bp, Artificial Sequence
  Description of Artificial Sequence: Synthetic oligonucleotide
gactggcgcttcctgcgcgggta

SEQ ID NO: 362202 - DNA, 26 bp, Artificial Sequence
  Description of Artificial Sequence: Synthetic oligonucleotide
cagagggtgtccctgagagccacttc

SEQ ID NO: 362203 - DNA, 23 bp, Artificial Sequence
  Description of Artificial Sequence: Synthetic oligonucleotide
actggcgcttcctgcgcgggtac

SEQ ID NO: 362204 - DNA, 27 bp, Artificial Sequence
  Description of Artificial Sequence: Synthetic oligonucleotide
agagggtgtccctgagagccacttcct

SEQ ID NO: 362205 - DNA, 22 bp, Artificial Sequence
  Description of Artificial Sequence: Synthetic oligonucleotide
ctggcgcttcctgcgcgggtac

SEQ ID NO: 362206 - DNA, 26 bp, Artificial Sequence
  Description of Artificial Sequence: Synthetic oligonucleotide
gagggtgtccctgagagccacttcct

SEQ ID NO: 362207 - DNA, 23 bp, Artificial Sequence
  Description of Artificial Sequence: Synthetic oligonucleotide
tggcgcttcctgcgcgggtacca

SEQ ID NO: 362208 - DNA, 26 bp, Artificial Sequence
  Description of Artificial Sequence: Synthetic oligonucleotide
agggtgtccctgagagccacttcctg

SEQ ID NO: 362209 - DNA, 22 bp, Artificial Sequence
  Description of Artificial Sequence: Synthetic oligonucleotide
ggcgcttcctgcgcgggtacca

SEQ ID NO: 362210 - DNA, 25 bp, Artificial Sequence
  Description of Artificial Sequence: Synthetic oligonucleotide
gggtgtccctgagagccacttcctg

SEQ ID NO: 362211 - DNA, 22 bp, Artificial Sequence
  Description of Artificial Sequence: Synthetic oligonucleotide
gcgcttcctgcgcgggtaccac

SEQ ID NO: 362212 - DNA, 25 bp, Artificial Sequence
  Description of Artificial Sequence: Synthetic oligonucleotide
ggtgtccctgagagccacttcctgc

SEQ ID NO: 362213 - DNA, 23 bp, Artificial Sequence
  Description of Artificial Sequence: Synthetic oligonucleotide
cgcttcctgcgcgggtaccacca

SEQ ID NO: 362214 - DNA, 25 bp, Artificial Sequence
  Description of Artificial Sequence: Synthetic oligonucleotide
gtgtccctgagagccacttcctgcc

SEQ ID NO: 362215 - DNA, 25 bp, Artificial Sequence
  Description of Artificial Sequence: Synthetic oligonucleotide
gcttcctgcgcgggtaccaccagta

SEQ ID NO: 362216 - DNA, 26 bp, Artificial Sequence
  Description of Artificial Sequence: Synthetic oligonucleotide
tgtccctgagagccacttcctgccga

SEQ ID NO: 362217 - DNA, 25 bp, Artificial Sequence
  Description of Artificial Sequence: Synthetic oligonucleotide
cttcctgcgcgggtaccaccagtac

SEQ ID NO: 362218 - DNA, 25 bp, Artificial Sequence
  Description of Artificial Sequence: Synthetic oligonucleotide
gtccctgagagccacttcctgccga

SEQ ID NO: 362219 - DNA, 25 bp, Artificial Sequence
  Description of Artificial Sequence: Synthetic oligonucleotide
ttcctgcgcgggtaccaccagtacg

SEQ ID NO: 362220 - DNA, 27 bp, Artificial Sequence
  Description of Artificial Sequence: Synthetic oligonucleotide
tccctgagagccacttcctgccgagaa

SEQ ID NO: 362221 - DNA, 24 bp, Artificial Sequence
  Description of Artificial Sequence: Synthetic oligonucleotide
tcctgcgcgggtaccaccagtacg

SEQ ID NO: 362222 - DNA, 26 bp, Artificial Sequence
  Description of Artificial Sequence: Synthetic oligonucleotide
ccctgagagccacttcctgccgagaa

SEQ ID NO: 362223 - DNA, 23 bp, Artificial Sequence
  Description of Artificial Sequence: Synthetic oligonucleotide
cctgcgcgggtaccaccagtacg

SEQ ID NO: 362224 - DNA, 27 bp, Artificial Sequence
  Description of Artificial Sequence: Synthetic oligonucleotide
cctgagagccacttcctgccgagaaca

SEQ ID NO: 362225 - DNA, 23 bp, Artificial Sequence
  Description of Artificial Sequence: Synthetic oligonucleotide
ctgcgcgggtaccaccagtacgc

SEQ ID NO: 362226 - DNA, 27 bp, Artificial Sequence
  Description of Artificial Sequence: Synthetic oligonucleotide
ctgagagccacttcctgccgagaacag

SEQ ID NO: 362227 - DNA, 25 bp, Artificial Sequence
  Description of Artificial Sequence: Synthetic oligonucleotide
tgcgcgggtaccaccagtacgccta

SEQ ID NO: 362228 - DNA, 31 bp, Artificial Sequence; identical to SEQ ID NO: 235720
  Description of Artificial Sequence: Synthetic oligonucleotide

SEQ ID NO: 362229 - DNA, 24 bp, Artificial Sequence
  Description of Artificial Sequence: Synthetic oligonucleotide
gcgcgggtaccaccagtacgccta

SEQ ID NO: 362230 - DNA, 30 bp, Artificial Sequence; identical to SEQ ID NO: 235721
  Description of Artificial Sequence: Synthetic oligonucleotide

SEQ ID NO: 362231 - DNA, 22 bp, Artificial Sequence
  Description of Artificial Sequence: Synthetic oligonucleotide
gcggcccatgtggcggagcagt

SEQ ID NO: 362232 - DNA, 31 bp, Artificial Sequence; identical to SEQ ID NO: 235722
  Description of Artificial Sequence: Synthetic oligonucleotide

SEQ ID NO: 362233 - DNA, 22 bp, Artificial Sequence
  Description of Artificial Sequence: Synthetic oligonucleotide
cggcccatgtggcggagcagtg

SEQ ID NO: 362234 - DNA, 30 bp, Artificial Sequence; identical to SEQ ID NO: 235723
  Description of Artificial Sequence: Synthetic oligonucleotide

SEQ ID NO: 362235 - DNA, 23 bp, Artificial Sequence
  Description of Artificial Sequence: Synthetic oligonucleotide
ggcccatgtggcggagcagtgga

SEQ ID NO: 362236 - DNA, 30 bp, Artificial Sequence; identical to SEQ ID NO: 235724
  Description of Artificial Sequence: Synthetic oligonucleotide

SEQ ID NO: 362237 - DNA, 24 bp, Artificial Sequence
  Description of Artificial Sequence: Synthetic oligonucleotide
gcccatgtggcggagcagtggaga

SEQ ID NO: 362238 - DNA, 29 bp, Artificial Sequence
  Description of Artificial Sequence: Synthetic oligonucleotide
gccacttcctgccgagaacagataacagc

SEQ ID NO: 362239 - DNA, 24 bp, Artificial Sequence
  Description of Artificial Sequence: Synthetic oligonucleotide
cccatgtggcggagcagtggagag

SEQ ID NO: 362240 - DNA, 31 bp, Artificial Sequence; identical to SEQ ID NO: 235726
  Description of Artificial Sequence: Synthetic oligonucleotide

SEQ ID NO: 362241 - DNA, 24 bp, Artificial Sequence
  Description of Artificial Sequence: Synthetic oligonucleotide
ccatgtggcggagcagtggagagc

SEQ ID NO: 362242 - DNA, 31 bp, Artificial Sequence; identical to SEQ ID NO: 235727
  Description of Artificial Sequence: Synthetic oligonucleotide

SEQ ID NO: 362243 - DNA, 26 bp, Artificial Sequence
  Description of Artificial Sequence: Synthetic oligonucleotide
catgtggcggagcagtggagagccta

SEQ ID NO: 362244 - DNA, 32 bp, Artificial Sequence; identical to SEQ ID NO: 235728
  Description of Artificial Sequence: Synthetic oligonucleotide

SEQ ID NO: 362245 - DNA, 26 bp, Artificial Sequence
  Description of Artificial Sequence: Synthetic oligonucleotide
atgtggcggagcagtggagagcctac

SEQ ID NO: 362246 - DNA, 31 bp, Artificial Sequence; identical to SEQ ID NO: 235729
  Description of Artificial Sequence: Synthetic oligonucleotide

SEQ ID NO: 362247 - DNA, 25 bp, Artificial Sequence
  Description of Artificial Sequence: Synthetic oligonucleotide
tgtggcggagcagtggagagcctac

SEQ ID NO: 362248 - DNA, 33 bp, Artificial Sequence; identical to SEQ ID NO: 235730
  Description of Artificial Sequence: Synthetic oligonucleotide

SEQ ID NO: 362249 - DNA, 24 bp, Artificial Sequence
  Description of Artificial Sequence: Synthetic oligonucleotide
gtggcggagcagtggagagcctac

SEQ ID NO: 362250 - DNA, 32 bp, Artificial Sequence; identical to SEQ ID NO: 235731
  Description of Artificial Sequence: Synthetic oligonucleotide

SEQ ID NO: 362251 - DNA, 25 bp, Artificial Sequence
  Description of Artificial Sequence: Synthetic oligonucleotide
tggcggagcagtggagagcctacct

SEQ ID NO: 362252 - DNA, 31 bp, Artificial Sequence; identical to SEQ ID NO: 235732
  Description of Artificial Sequence: Synthetic oligonucleotide

SEQ ID NO: 362253 - DNA, 24 bp, Artificial Sequence
  Description of Artificial Sequence: Synthetic oligonucleotide
ggcggagcagtggagagcctacct

SEQ ID NO: 362254 - DNA, 33 bp, Artificial Sequence; identical to SEQ ID NO: 235733
  Description of Artificial Sequence: Synthetic oligonucleotide

SEQ ID NO: 362255 - DNA, 24 bp, Artificial Sequence
  Description of Artificial Sequence: Synthetic oligonucleotide
gcggagcagtggagagcctacctg

SEQ ID NO: 362256 - DNA, 33 bp, Artificial Sequence; identical to SEQ ID NO: 235734
  Description of Artificial Sequence: Synthetic oligonucleotide

SEQ ID NO: 362257 - DNA, 25 bp, Artificial Sequence
  Description of Artificial Sequence: Synthetic oligonucleotide
cggagcagtggagagcctacctgga

SEQ ID NO: 362258 - DNA, 32 bp, Artificial Sequence; identical to SEQ ID NO: 235735
  Description of Artificial Sequence: Synthetic oligonucleotide

SEQ ID NO: 362259 - DNA, 25 bp, Artificial Sequence
  Description of Artificial Sequence: Synthetic oligonucleotide
ggagcagtggagagcctacctggag

SEQ ID NO: 362260 - DNA, 36 bp, Artificial Sequence; identical to SEQ ID NO: 235736
  Description of Artificial Sequence: Synthetic oligonucleotide

SEQ ID NO: 362261 - DNA, 25 bp, Artificial Sequence
  Description of Artificial Sequence: Synthetic oligonucleotide
gagcagtggagagcctacctggagg

SEQ ID NO: 362262 - DNA, 36 bp, Artificial Sequence; identical to SEQ ID NO: 235737
  Description of Artificial Sequence: Synthetic oligonucleotide

SEQ ID NO: 362263 - DNA, 25 bp, Artificial Sequence
  Description of Artificial Sequence: Synthetic oligonucleotide
agcagtggagagcctacctggaggg

SEQ ID NO: 362264 - DNA, 37 bp, Artificial Sequence; identical to SEQ ID NO: 235738
  Description of Artificial Sequence: Synthetic oligonucleotide

SEQ ID NO: 362265 - DNA, 24 bp, Artificial Sequence
  Description of Artificial Sequence: Synthetic oligonucleotide
gcagtggagagcctacctggaggg

SEQ ID NO: 362266 - DNA, 38 bp, Artificial Sequence; identical to SEQ ID NO: 235739
  Description of Artificial Sequence: Synthetic oligonucleotide

SEQ ID NO: 362267 - DNA, 25 bp, Artificial Sequence
  Description of Artificial Sequence: Synthetic oligonucleotide
cagtggagagcctacctggagggca

SEQ ID NO: 362268 - DNA, 37 bp, Artificial Sequence; identical to SEQ ID NO: 235740
  Description of Artificial Sequence: Synthetic oligonucleotide

SEQ ID NO: 362269 - DNA, 25 bp, Artificial Sequence
  Description of Artificial Sequence: Synthetic oligonucleotide
agtggagagcctacctggagggcac

SEQ ID NO: 362270 - DNA, 37 bp, Artificial Sequence; identical to SEQ ID NO: 235741
  Description of Artificial Sequence: Synthetic oligonucleotide

SEQ ID NO: 362271 - DNA, 24 bp, Artificial Sequence
  Description of Artificial Sequence: Synthetic oligonucleotide
gtggagagcctacctggagggcac

SEQ ID NO: 362272 - DNA, 36 bp, Artificial Sequence; identical to SEQ ID NO: 235742
  Description of Artificial Sequence: Synthetic oligonucleotide

SEQ ID NO: 362273 - DNA, 25 bp, Artificial Sequence
  Description of Artificial Sequence: Synthetic oligonucleotide
tggagagcctacctggagggcacgt

SEQ ID NO: 362274 - DNA, 35 bp, Artificial Sequence; identical to SEQ ID NO: 235743
  Description of Artificial Sequence: Synthetic oligonucleotide

SEQ ID NO: 362275 - DNA, 24 bp, Artificial Sequence
  Description of Artificial Sequence: Synthetic oligonucleotide
ggagagcctacctggagggcacgt

SEQ ID NO: 362276 - DNA, 38 bp, Artificial Sequence; identical to SEQ ID NO: 235744
  Description of Artificial Sequence: Synthetic oligonucleotide

SEQ ID NO: 362277 - DNA, 28 bp, Artificial Sequence
  Description of Artificial Sequence: Synthetic oligonucleotide
ctcagaccaccaagcacaagtgggagac

SEQ ID NO: 362278 - DNA, 37 bp, Artificial Sequence; identical to SEQ ID NO: 235745
  Description of Artificial Sequence: Synthetic oligonucleotide

SEQ ID NO: 362279 - DNA, 28 bp, Artificial Sequence
  Description of Artificial Sequence: Synthetic oligonucleotide
tcagaccaccaagcacaagtgggagacg

SEQ ID NO: 362280 - DNA, 38 bp, Artificial Sequence; identical to SEQ ID NO: 235746
  Description of Artificial Sequence: Synthetic oligonucleotide

SEQ ID NO: 362281 - DNA, 27 bp, Artificial Sequence
  Description of Artificial Sequence: Synthetic oligonucleotide
cagaccaccaagcacaagtgggagacg

SEQ ID NO: 362282 - DNA, 37 bp, Artificial Sequence; identical to SEQ ID NO: 235747
  Description of Artificial Sequence: Synthetic oligonucleotide

SEQ ID NO: 362283 - DNA, 27 bp, Artificial Sequence
  Description of Artificial Sequence: Synthetic oligonucleotide
agaccaccaagcacaagtgggagacgg

SEQ ID NO: 362284 - DNA, 36 bp, Artificial Sequence; identical to SEQ ID NO: 235748
  Description of Artificial Sequence: Synthetic oligonucleotide

SEQ ID NO: 362285 - DNA, 26 bp, Artificial Sequence
  Description of Artificial Sequence: Synthetic oligonucleotide
gaccaccaagcacaagtgggagacgg

SEQ ID NO: 362286 - DNA, 35 bp, Artificial Sequence; identical to SEQ ID NO: 235749
  Description of Artificial Sequence: Synthetic oligonucleotide

SEQ ID NO: 362287 - DNA, 26 bp, Artificial Sequence
  Description of Artificial Sequence: Synthetic oligonucleotide
accaccaagcacaagtgggagacggc

SEQ ID NO: 362288 - DNA, 34 bp, Artificial Sequence; identical to SEQ ID NO: 235750
  Description of Artificial Sequence: Synthetic oligonucleotide

SEQ ID NO: 362289 - DNA, 25 bp, Artificial Sequence
  Description of Artificial Sequence: Synthetic oligonucleotide
ccaccaagcacaagtgggagacggc

SEQ ID NO: 362290 - DNA, 34 bp, Artificial Sequence; identical to SEQ ID NO: 235751
  Description of Artificial Sequence: Synthetic oligonucleotide

SEQ ID NO: 362291 - DNA, 25 bp, Artificial Sequence
  Description of Artificial Sequence: Synthetic oligonucleotide
caccaagcacaagtgggagacggcc

SEQ ID NO: 362292 - DNA, 33 bp, Artificial Sequence; identical to SEQ ID NO: 235752
  Description of Artificial Sequence: Synthetic oligonucleotide

SEQ ID NO: 362293 - DNA, 27 bp, Artificial Sequence
  Description of Artificial Sequence: Synthetic oligonucleotide
accaagcacaagtgggagacggcccat

SEQ ID NO: 362294 - DNA, 33 bp, Artificial Sequence; identical to SEQ ID NO: 235753
  Description of Artificial Sequence: Synthetic oligonucleotide

SEQ ID NO: 362295 - DNA, 26 bp, Artificial Sequence
  Description of Artificial Sequence: Synthetic oligonucleotide
ccaagcacaagtgggagacggcccat

SEQ ID NO: 362296 - DNA, 33 bp, Artificial Sequence; identical to SEQ ID NO: 235754
  Description of Artificial Sequence: Synthetic oligonucleotide

SEQ ID NO: 362297 - DNA, 27 bp, Artificial Sequence
  Description of Artificial Sequence: Synthetic oligonucleotide
caagcacaagtgggagacggcccatga

SEQ ID NO: 362298 - DNA, 32 bp, Artificial Sequence; identical to SEQ ID NO: 235755
  Description of Artificial Sequence: Synthetic oligonucleotide

SEQ ID NO: 362299 - DNA, 27 bp, Artificial Sequence
  Description of Artificial Sequence: Synthetic oligonucleotide
aagcacaagtgggagacggcccatgag

SEQ ID NO: 362300 - DNA, 31 bp, Artificial Sequence; identical to SEQ ID NO: 235756
  Description of Artificial Sequence: Synthetic oligonucleotide

SEQ ID NO: 362301 - DNA, 26 bp, Artificial Sequence
  Description of Artificial Sequence: Synthetic oligonucleotide
agcacaagtgggagacggcccatgag

SEQ ID NO: 362302 - DNA, 32 bp, Artificial Sequence; identical to SEQ ID NO: 235757
  Description of Artificial Sequence: Synthetic oligonucleotide

SEQ ID NO: 362303 - DNA, 25 bp, Artificial Sequence
  Description of Artificial Sequence: Synthetic oligonucleotide
gcacaagtgggagacggcccatgag

SEQ ID NO: 362304 - DNA, 33 bp, Artificial Sequence; identical to SEQ ID NO: 235758
  Description of Artificial Sequence: Synthetic oligonucleotide

SEQ ID NO: 362305 - DNA, 25 bp, Artificial Sequence
  Description of Artificial Sequence: Synthetic oligonucleotide
cacaagtgggagacggcccatgagg

SEQ ID NO: 362306 - DNA, 32 bp, Artificial Sequence; identical to SEQ ID NO: 235759
  Description of Artificial Sequence: Synthetic oligonucleotide

SEQ ID NO: 362307 - DNA, 25 bp, Artificial Sequence
  Description of Artificial Sequence: Synthetic oligonucleotide
acaagtgggagacggcccatgaggc

SEQ ID NO: 362308 - DNA, 32 bp, Artificial Sequence; identical to SEQ ID NO: 235760
  Description of Artificial Sequence: Synthetic oligonucleotide

SEQ ID NO: 362309 - DNA, 24 bp, Artificial Sequence
  Description of Artificial Sequence: Synthetic oligonucleotide
caagtgggagacggcccatgaggc

SEQ ID NO: 362310 - DNA, 31 bp, Artificial Sequence; identical to SEQ ID NO: 235761
  Description of Artificial Sequence: Synthetic oligonucleotide

SEQ ID NO: 362311 - DNA, 24 bp, Artificial Sequence
  Description of Artificial Sequence: Synthetic oligonucleotide
aagtgggagacggcccatgaggcg

SEQ ID NO: 362312 - DNA, 30 bp, Artificial Sequence; identical to SEQ ID NO: 235762
  Description of Artificial Sequence: Synthetic oligonucleotide

SEQ ID NO: 362313 - DNA, 23 bp, Artificial Sequence
  Description of Artificial Sequence: Synthetic oligonucleotide
agtgggagacggcccatgaggcg

SEQ ID NO: 362314 - DNA, 31 bp, Artificial Sequence; identical to SEQ ID NO: 235763
  Description of Artificial Sequence: Synthetic oligonucleotide

SEQ ID NO: 362315 - DNA, 22 bp, Artificial Sequence
  Description of Artificial Sequence: Synthetic oligonucleotide
gtgggagacggcccatgaggcg

SEQ ID NO: 362316 - DNA, 30 bp, Artificial Sequence; identical to SEQ ID NO: 235764
  Description of Artificial Sequence: Synthetic oligonucleotide

SEQ ID NO: 362317 - DNA, 23 bp, Artificial Sequence
  Description of Artificial Sequence: Synthetic oligonucleotide
tgggagacggcccatgaggcgga

SEQ ID NO: 362318 - DNA, 29 bp, Artificial Sequence
  Description of Artificial Sequence: Synthetic oligonucleotide
ccaatacctgaccattgtgccctgagcag

SEQ ID NO: 362319 - DNA, 22 bp, Artificial Sequence
  Description of Artificial Sequence: Synthetic oligonucleotide
gggagacggcccatgaggcgga

SEQ ID NO: 362320 - DNA, 30 bp, Artificial Sequence; identical to SEQ ID NO: 235766
  Description of Artificial Sequence: Synthetic oligonucleotide

SEQ ID NO: 362321 - DNA, 22 bp, Artificial Sequence
  Description of Artificial Sequence: Synthetic oligonucleotide
ggagacggcccatgaggcggag

SEQ ID NO: 362322 - DNA, 30 bp, Artificial Sequence; identical to SEQ ID NO: 235767
  Description of Artificial Sequence: Synthetic oligonucleotide

SEQ ID NO: 362323 - DNA, 23 bp, Artificial Sequence
  Description of Artificial Sequence: Synthetic oligonucleotide
gagacggcccatgaggcggagca

SEQ ID NO: 362324 - DNA, 29 bp, Artificial Sequence
  Description of Artificial Sequence: Synthetic oligonucleotide
atacctgaccattgtgccctgagcagagg

SEQ ID NO: 362325 - DNA, 24 bp, Artificial Sequence
  Description of Artificial Sequence: Synthetic oligonucleotide
agacggcccatgaggcggagcagt

SEQ ID NO: 362326 - DNA, 28 bp, Artificial Sequence
  Description of Artificial Sequence: Synthetic oligonucleotide
tacctgaccattgtgccctgagcagagg

SEQ ID NO: 362327 - DNA, 23 bp, Artificial Sequence
  Description of Artificial Sequence: Synthetic oligonucleotide
gacggcccatgaggcggagcagt

SEQ ID NO: 362328 - DNA, 27 bp, Artificial Sequence
  Description of Artificial Sequence: Synthetic oligonucleotide
acctgaccattgtgccctgagcagagg

SEQ ID NO: 362329 - DNA, 23 bp, Artificial Sequence
  Description of Artificial Sequence: Synthetic oligonucleotide
acggcccatgaggcggagcagtg

SEQ ID NO: 362330 - DNA, 27 bp, Artificial Sequence
  Description of Artificial Sequence: Synthetic oligonucleotide
cctgaccattgtgccctgagcagagga

SEQ ID NO: 362331 - DNA, 22 bp, Artificial Sequence
  Description of Artificial Sequence: Synthetic oligonucleotide
cggcccatgaggcggagcagtg

SEQ ID NO: 362332 - DNA, 27 bp, Artificial Sequence
  Description of Artificial Sequence: Synthetic oligonucleotide
ctgaccattgtgccctgagcagaggag

SEQ ID NO: 362333 - DNA, 23 bp, Artificial Sequence
  Description of Artificial Sequence: Synthetic oligonucleotide
ggcccatgaggcggagcagtgga

SEQ ID NO: 362334 - DNA, 29 bp, Artificial Sequence
  Description of Artificial Sequence: Synthetic oligonucleotide
tgaccattgtgccctgagcagaggagttc

SEQ ID NO: 362335 - DNA, 24 bp, Artificial Sequence
  Description of Artificial Sequence: Synthetic oligonucleotide
gcccatgaggcggagcagtggaga

SEQ ID NO: 362336 - DNA, 28 bp, Artificial Sequence
  Description of Artificial Sequence: Synthetic oligonucleotide
gaccattgtgccctgagcagaggagttc

SEQ ID NO: 362337 - DNA, 24 bp, Artificial Sequence
  Description of Artificial Sequence: Synthetic oligonucleotide
cccatgaggcggagcagtggagag

SEQ ID NO: 362338 - DNA, 31 bp, Artificial Sequence; identical to SEQ ID NO: 235775
  Description of Artificial Sequence: Synthetic oligonucleotide

SEQ ID NO: 362339 - DNA, 24 bp, Artificial Sequence
  Description of Artificial Sequence: Synthetic oligonucleotide
ccatgaggcggagcagtggagagc

SEQ ID NO: 362340 - DNA, 30 bp, Artificial Sequence; identical to SEQ ID NO: 235776
  Description of Artificial Sequence: Synthetic oligonucleotide

SEQ ID NO: 362341 - DNA, 26 bp, Artificial Sequence
  Description of Artificial Sequence: Synthetic oligonucleotide
catgaggcggagcagtggagagccta

SEQ ID NO: 362342 - DNA, 31 bp, Artificial Sequence; identical to SEQ ID NO: 235777
  Description of Artificial Sequence: Synthetic oligonucleotide

SEQ ID NO: 362343 - DNA, 26 bp, Artificial Sequence
  Description of Artificial Sequence: Synthetic oligonucleotide
atgaggcggagcagtggagagcctac

SEQ ID NO: 362344 - DNA, 32 bp, Artificial Sequence; identical to SEQ ID NO: 235778
  Description of Artificial Sequence: Synthetic oligonucleotide

SEQ ID NO: 362345 - DNA, 25 bp, Artificial Sequence
  Description of Artificial Sequence: Synthetic oligonucleotide
tgaggcggagcagtggagagcctac

SEQ ID NO: 362346 - DNA, 31 bp, Artificial Sequence; identical to SEQ ID NO: 235779
  Description of Artificial Sequence: Synthetic oligonucleotide

SEQ ID NO: 362347 - DNA, 24 bp, Artificial Sequence
  Description of Artificial Sequence: Synthetic oligonucleotide
gaggcggagcagtggagagcctac

SEQ ID NO: 362348 - DNA, 30 bp, Artificial Sequence; identical to SEQ ID NO: 235780
  Description of Artificial Sequence: Synthetic oligonucleotide

SEQ ID NO: 362349 - DNA, 25 bp, Artificial Sequence
  Description of Artificial Sequence: Synthetic oligonucleotide
aggcggagcagtggagagcctacct

SEQ ID NO: 362350 - DNA, 29 bp, Artificial Sequence
  Description of Artificial Sequence: Synthetic oligonucleotide
gtgccctgagcagaggagttctatgacag

SEQ ID NO: 362351 - DNA, 32 bp, Artificial Sequence; identical to SEQ ID NO: 4944
  Description of Artificial Sequence: Synthetic oligonucleotide

SEQ ID NO: 362352 - DNA, 29 bp, Artificial Sequence
  Description of Artificial Sequence: Synthetic oligonucleotide
tgccctgagcagaggagttctatgacagc

SEQ ID NO: 362353 - DNA, 33 bp, Artificial Sequence; identical to SEQ ID NO: 4945
  Description of Artificial Sequence: Synthetic oligonucleotide

SEQ ID NO: 362354 - DNA, 28 bp, Artificial Sequence
  Description of Artificial Sequence: Synthetic oligonucleotide
gccctgagcagaggagttctatgacagc

SEQ ID NO: 362355 - DNA, 32 bp, Artificial Sequence; identical to SEQ ID NO: 4946
  Description of Artificial Sequence: Synthetic oligonucleotide

SEQ ID NO: 362356 - DNA, 29 bp, Artificial Sequence
  Description of Artificial Sequence: Synthetic oligonucleotide
ccctgagcagaggagttctatgacagcag

SEQ ID NO: 362357 - DNA, 31 bp, Artificial Sequence; identical to SEQ ID NO: 4947
  Description of Artificial Sequence: Synthetic oligonucleotide

SEQ ID NO: 362358 - DNA, 29 bp, Artificial Sequence
  Description of Artificial Sequence: Synthetic oligonucleotide
cctgagcagaggagttctatgacagcagg

SEQ ID NO: 362359 - DNA, 31 bp, Artificial Sequence; identical to SEQ ID NO: 4948
  Description of Artificial Sequence: Synthetic oligonucleotide

SEQ ID NO: 362360 - DNA, 29 bp, Artificial Sequence
  Description of Artificial Sequence: Synthetic oligonucleotide
ctgagcagaggagttctatgacagcaggg

SEQ ID NO: 362361 - DNA, 32 bp, Artificial Sequence; identical to SEQ ID NO: 4949
  Description of Artificial Sequence: Synthetic oligonucleotide

SEQ ID NO: 362362 - DNA, 30 bp, Artificial Sequence; identical to SEQ ID NO: 235787
  Description of Artificial Sequence: Synthetic oligonucleotide

SEQ ID NO: 362363 - DNA, 31 bp, Artificial Sequence; identical to SEQ ID NO: 4950
  Description of Artificial Sequence: Synthetic oligonucleotide

SEQ ID NO: 362364 - DNA, 29 bp, Artificial Sequence
  Description of Artificial Sequence: Synthetic oligonucleotide
gagcagaggagttctatgacagcagggtg

SEQ ID NO: 362365 - DNA, 31 bp, Artificial Sequence; identical to SEQ ID NO: 4951
  Description of Artificial Sequence: Synthetic oligonucleotide

SEQ ID NO: 362366 - DNA, 29 bp, Artificial Sequence
  Description of Artificial Sequence: Synthetic oligonucleotide
agcagaggagttctatgacagcagggtgg

SEQ ID NO: 362367 - DNA, 32 bp, Artificial Sequence; identical to SEQ ID NO: 4952
  Description of Artificial Sequence: Synthetic oligonucleotide

SEQ ID NO: 362368 - DNA, 28 bp, Artificial Sequence
  Description of Artificial Sequence: Synthetic oligonucleotide
gcagaggagttctatgacagcagggtgg

SEQ ID NO: 362369 - DNA, 32 bp, Artificial Sequence; identical to SEQ ID NO: 4953
  Description of Artificial Sequence: Synthetic oligonucleotide

SEQ ID NO: 362370 - DNA, 29 bp, Artificial Sequence
  Description of Artificial Sequence: Synthetic oligonucleotide
cagaggagttctatgacagcagggtggtg

SEQ ID NO: 362371 - DNA, 32 bp, Artificial Sequence; identical to SEQ ID NO: 4954
  Description of Artificial Sequence: Synthetic oligonucleotide

SEQ ID NO: 362372 - DNA, 29 bp, Artificial Sequence
  Description of Artificial Sequence: Synthetic oligonucleotide
agaggagttctatgacagcagggtggtgc

SEQ ID NO: 362373 - DNA, 31 bp, Artificial Sequence; identical to SEQ ID NO: 4955
  Description of Artificial Sequence: Synthetic oligonucleotide

SEQ ID NO: 362374 - DNA, 28 bp, Artificial Sequence
  Description of Artificial Sequence: Synthetic oligonucleotide
gaggagttctatgacagcagggtggtgc

SEQ ID NO: 362375 - DNA, 30 bp, Artificial Sequence; identical to SEQ ID NO: 4956
  Description of Artificial Sequence: Synthetic oligonucleotide

SEQ ID NO: 362376 - DNA, 29 bp, Artificial Sequence
  Description of Artificial Sequence: Synthetic oligonucleotide
aggagttctatgacagcagggtggtgcac

SEQ ID NO: 362377 - DNA, 30 bp, Artificial Sequence; identical to SEQ ID NO: 4957
  Description of Artificial Sequence: Synthetic oligonucleotide

SEQ ID NO: 362378 - DNA, 28 bp, Artificial Sequence
  Description of Artificial Sequence: Synthetic oligonucleotide
ggagttctatgacagcagggtggtgcac

SEQ ID NO: 362379 - DNA, 31 bp, Artificial Sequence; identical to SEQ ID NO: 4958
  Description of Artificial Sequence: Synthetic oligonucleotide

SEQ ID NO: 362380 - DNA, 29 bp, Artificial Sequence
  Description of Artificial Sequence: Synthetic oligonucleotide
gagttctatgacagcagggtggtgcactg

SEQ ID NO: 362381 - DNA, 30 bp, Artificial Sequence; identical to SEQ ID NO: 4959
  Description of Artificial Sequence: Synthetic oligonucleotide

SEQ ID NO: 362382 - DNA, 29 bp, Artificial Sequence
  Description of Artificial Sequence: Synthetic oligonucleotide
agttctatgacagcagggtggtgcactgg

SEQ ID NO: 362383 - DNA, 29 bp, Artificial Sequence
  Description of Artificial Sequence: Synthetic oligonucleotide
tacatcgccctaaaagaggacctgcgctc

SEQ ID NO: 362384 - DNA, 28 bp, Artificial Sequence
  Description of Artificial Sequence: Synthetic oligonucleotide
gttctatgacagcagggtggtgcactgg

SEQ ID NO: 362385 - DNA, 28 bp, Artificial Sequence
  Description of Artificial Sequence: Synthetic oligonucleotide
acatcgccctaaaagaggacctgcgctc

SEQ ID NO: 362386 - DNA, 28 bp, Artificial Sequence
  Description of Artificial Sequence: Synthetic oligonucleotide
ttctatgacagcagggtggtgcactggg

SEQ ID NO: 362387 - DNA, 27 bp, Artificial Sequence
  Description of Artificial Sequence: Synthetic oligonucleotide
catcgccctaaaagaggacctgcgctc

SEQ ID NO: 362388 - DNA, 27 bp, Artificial Sequence
  Description of Artificial Sequence: Synthetic oligonucleotide
tctatgacagcagggtggtgcactggg

SEQ ID NO: 362389 - DNA, 29 bp, Artificial Sequence
  Description of Artificial Sequence: Synthetic oligonucleotide
atcgccctaaaagaggacctgcgctcttg

SEQ ID NO: 362390 - DNA, 26 bp, Artificial Sequence
  Description of Artificial Sequence: Synthetic oligonucleotide
ctatgacagcagggtggtgcactggg

SEQ ID NO: 362391 - DNA, 28 bp, Artificial Sequence
  Description of Artificial Sequence: Synthetic oligonucleotide
tcgccctaaaagaggacctgcgctcttg

SEQ ID NO: 362392 - DNA, 26 bp, Artificial Sequence
  Description of Artificial Sequence: Synthetic oligonucleotide
tatgacagcagggtggtgcactgggg

SEQ ID NO: 362393 - DNA, 27 bp, Artificial Sequence
  Description of Artificial Sequence: Synthetic oligonucleotide
cgccctaaaagaggacctgcgctcttg

SEQ ID NO: 362394 - DNA, 25 bp, Artificial Sequence
  Description of Artificial Sequence: Synthetic oligonucleotide
atgacagcagggtggtgcactgggg

SEQ ID NO: 362395 - DNA, 27 bp, Artificial Sequence
  Description of Artificial Sequence: Synthetic oligonucleotide
gccctaaaagaggacctgcgctcttgg

SEQ ID NO: 362396 - DNA, 24 bp, Artificial Sequence
  Description of Artificial Sequence: Synthetic oligonucleotide
tgacagcagggtggtgcactgggg

SEQ ID NO: 362397 - DNA, 28 bp, Artificial Sequence
  Description of Artificial Sequence: Synthetic oligonucleotide
ccctaaaagaggacctgcgctcttggac

SEQ ID NO: 362398 - DNA, 23 bp, Artificial Sequence
  Description of Artificial Sequence: Synthetic oligonucleotide
gacagcagggtggtgcactgggg

SEQ ID NO: 362399 - DNA, 28 bp, Artificial Sequence
  Description of Artificial Sequence: Synthetic oligonucleotide
cctaaaagaggacctgcgctcttggacc

SEQ ID NO: 362400 - DNA, 25 bp, Artificial Sequence
  Description of Artificial Sequence: Synthetic oligonucleotide
acagcagggtggtgcactgggggtt

SEQ ID NO: 362401 - DNA, 28 bp, Artificial Sequence
  Description of Artificial Sequence: Synthetic oligonucleotide
ctaaaagaggacctgcgctcttggaccg

SEQ ID NO: 362402 - DNA, 24 bp, Artificial Sequence
  Description of Artificial Sequence: Synthetic oligonucleotide
cagcagggtggtgcactgggggtt

SEQ ID NO: 362403 - DNA, 28 bp, Artificial Sequence
  Description of Artificial Sequence: Synthetic oligonucleotide
taaaagaggacctgcgctcttggaccgc

SEQ ID NO: 362404 - DNA, 24 bp, Artificial Sequence
  Description of Artificial Sequence: Synthetic oligonucleotide
agcagggtggtgcactgggggttg

SEQ ID NO: 362405 - DNA, 27 bp, Artificial Sequence
  Description of Artificial Sequence: Synthetic oligonucleotide
aaaagaggacctgcgctcttggaccgc

SEQ ID NO: 362406 - DNA, 23 bp, Artificial Sequence
  Description of Artificial Sequence: Synthetic oligonucleotide
gcagggtggtgcactgggggttg

SEQ ID NO: 362407 - DNA, 24 bp, Artificial Sequence
  Description of Artificial Sequence: Synthetic oligonucleotide
ggaaggagacgctgcagcgcactg

SEQ ID NO: 362408 - DNA, 24 bp, Artificial Sequence
  Description of Artificial Sequence: Synthetic oligonucleotide
cagggtggtgcactgggggttgga

SEQ ID NO: 362409 - DNA, 26 bp, Artificial Sequence
  Description of Artificial Sequence: Synthetic oligonucleotide
gaggccggttctcacaccgtccagat

SEQ ID NO: 362410 - DNA, 24 bp, Artificial Sequence
  Description of Artificial Sequence: Synthetic oligonucleotide
agggtggtgcactgggggttggac

SEQ ID NO: 362411 - DNA, 27 bp, Artificial Sequence
  Description of Artificial Sequence: Synthetic oligonucleotide
aggccggttctcacaccgtccagatga

SEQ ID NO: 362412 - DNA, 23 bp, Artificial Sequence
  Description of Artificial Sequence: Synthetic oligonucleotide
gggtggtgcactgggggttggac

SEQ ID NO: 362413 - DNA, 27 bp, Artificial Sequence
  Description of Artificial Sequence: Synthetic oligonucleotide
ggccggttctcacaccgtccagatgat

SEQ ID NO: 362414 - DNA, 24 bp, Artificial Sequence
  Description of Artificial Sequence: Synthetic oligonucleotide
ggtggtgcactgggggttggacca

SEQ ID NO: 362415 - DNA, 27 bp, Artificial Sequence
  Description of Artificial Sequence: Synthetic oligonucleotide
gccggttctcacaccgtccagatgatg

SEQ ID NO: 362416 - DNA, 24 bp, Artificial Sequence
  Description of Artificial Sequence: Synthetic oligonucleotide
gtggtgcactgggggttggaccag

SEQ ID NO: 362417 - DNA, 30 bp, Artificial Sequence; identical to SEQ ID NO: 4976
  Description of Artificial Sequence: Synthetic oligonucleotide

SEQ ID NO: 362418 - DNA, 24 bp, Artificial Sequence
  Description of Artificial Sequence: Synthetic oligonucleotide
tggtgcactgggggttggaccagg

SEQ ID NO: 362419 - DNA, 30 bp, Artificial Sequence; identical to SEQ ID NO: 4977
  Description of Artificial Sequence: Synthetic oligonucleotide

SEQ ID NO: 362420 - DNA, 23 bp, Artificial Sequence
  Description of Artificial Sequence: Synthetic oligonucleotide
ggtgcactgggggttggaccagg

SEQ ID NO: 362421 - DNA, 30 bp, Artificial Sequence; identical to SEQ ID NO: 4978
  Description of Artificial Sequence: Synthetic oligonucleotide

SEQ ID NO: 362422 - DNA, 23 bp, Artificial Sequence
  Description of Artificial Sequence: Synthetic oligonucleotide
gtgcactgggggttggaccaggc

SEQ ID NO: 362423 - DNA, 31 bp, Artificial Sequence; identical to SEQ ID NO: 4979
  Description of Artificial Sequence: Synthetic oligonucleotide

SEQ ID NO: 362424 - DNA, 23 bp, Artificial Sequence
  Description of Artificial Sequence: Synthetic oligonucleotide
tgcactgggggttggaccaggcg

SEQ ID NO: 362425 - DNA, 31 bp, Artificial Sequence; identical to SEQ ID NO: 4980
  Description of Artificial Sequence: Synthetic oligonucleotide

SEQ ID NO: 362426 - DNA, 22 bp, Artificial Sequence
  Description of Artificial Sequence: Synthetic oligonucleotide
gcactgggggttggaccaggcg

SEQ ID NO: 362427 - DNA, 30 bp, Artificial Sequence; identical to SEQ ID NO: 4981
  Description of Artificial Sequence: Synthetic oligonucleotide

SEQ ID NO: 362428 - DNA, 23 bp, Artificial Sequence
  Description of Artificial Sequence: Synthetic oligonucleotide
cactgggggttggaccaggcgct

SEQ ID NO: 362429 - DNA, 29 bp, Artificial Sequence
  Description of Artificial Sequence: Synthetic oligonucleotide
ctcacaccgtccagatgatgtatggctgc

SEQ ID NO: 362430 - DNA, 23 bp, Artificial Sequence
  Description of Artificial Sequence: Synthetic oligonucleotide
actgggggttggaccaggcgctc

SEQ ID NO: 362431 - DNA, 29 bp, Artificial Sequence
  Description of Artificial Sequence: Synthetic oligonucleotide
tcacaccgtccagatgatgtatggctgcg

SEQ ID NO: 362432 - DNA, 22 bp, Artificial Sequence
  Description of Artificial Sequence: Synthetic oligonucleotide
ctgggggttggaccaggcgctc

SEQ ID NO: 362433 - DNA, 28 bp, Artificial Sequence
  Description of Artificial Sequence: Synthetic oligonucleotide
cacaccgtccagatgatgtatggctgcg

SEQ ID NO: 362434 - DNA, 23 bp, Artificial Sequence
  Description of Artificial Sequence: Synthetic oligonucleotide
tgggggttggaccaggcgctcct

SEQ ID NO: 362435 - DNA, 29 bp, Artificial Sequence
  Description of Artificial Sequence: Synthetic oligonucleotide
acaccgtccagatgatgtatggctgcgac

SEQ ID NO: 362436 - DNA, 22 bp, Artificial Sequence
  Description of Artificial Sequence: Synthetic oligonucleotide
gggggttggaccaggcgctcct

SEQ ID NO: 362437 - DNA, 28 bp, Artificial Sequence
  Description of Artificial Sequence: Synthetic oligonucleotide
caccgtccagatgatgtatggctgcgac

SEQ ID NO: 362438 - DNA, 24 bp, Artificial Sequence
  Description of Artificial Sequence: Synthetic oligonucleotide
ggggttggaccaggcgctcctcat

SEQ ID NO: 362439 - DNA, 28 bp, Artificial Sequence
  Description of Artificial Sequence: Synthetic oligonucleotide
accgtccagatgatgtatggctgcgacg

SEQ ID NO: 362440 - DNA, 24 bp, Artificial Sequence
  Description of Artificial Sequence: Synthetic oligonucleotide
gggttggaccaggcgctcctcatg

SEQ ID NO: 362441 - DNA, 27 bp, Artificial Sequence
  Description of Artificial Sequence: Synthetic oligonucleotide
ccgtccagatgatgtatggctgcgacg

SEQ ID NO: 362442 - DNA, 25 bp, Artificial Sequence
  Description of Artificial Sequence: Synthetic oligonucleotide
ggttggaccaggcgctcctcatgca

SEQ ID NO: 362443 - DNA, 28 bp, Artificial Sequence
  Description of Artificial Sequence: Synthetic oligonucleotide
cgtccagatgatgtatggctgcgacgtg

SEQ ID NO: 362444 - DNA, 26 bp, Artificial Sequence
  Description of Artificial Sequence: Synthetic oligonucleotide
gttggaccaggcgctcctcatgcact

SEQ ID NO: 362445 - DNA, 28 bp, Artificial Sequence
  Description of Artificial Sequence: Synthetic oligonucleotide
gtccagatgatgtatggctgcgacgtgg

SEQ ID NO: 362446 - DNA, 26 bp, Artificial Sequence
  Description of Artificial Sequence: Synthetic oligonucleotide
ttggaccaggcgctcctcatgcactg

SEQ ID NO: 362447 - DNA, 28 bp, Artificial Sequence
  Description of Artificial Sequence: Synthetic oligonucleotide
agatgatgtatggctgcgacgtggggtc

SEQ ID NO: 362448 - DNA, 25 bp, Artificial Sequence
  Description of Artificial Sequence: Synthetic oligonucleotide
tggaccaggcgctcctcatgcactg

SEQ ID NO: 362449 - DNA, 27 bp, Artificial Sequence
  Description of Artificial Sequence: Synthetic oligonucleotide
gatgatgtatggctgcgacgtggggtc

SEQ ID NO: 362450 - DNA, 24 bp, Artificial Sequence
  Description of Artificial Sequence: Synthetic oligonucleotide
ggaccaggcgctcctcatgcactg

SEQ ID NO: 362451 - DNA, 27 bp, Artificial Sequence
  Description of Artificial Sequence: Synthetic oligonucleotide
atgatgtatggctgcgacgtggggtcg

SEQ ID NO: 362452 - DNA, 24 bp, Artificial Sequence
  Description of Artificial Sequence: Synthetic oligonucleotide
gaccaggcgctcctcatgcactgg

SEQ ID NO: 362453 - DNA, 26 bp, Artificial Sequence
  Description of Artificial Sequence: Synthetic oligonucleotide
tgatgtatggctgcgacgtggggtcg

SEQ ID NO: 362454 - DNA, 25 bp, Artificial Sequence
  Description of Artificial Sequence: Synthetic oligonucleotide
accaggcgctcctcatgcactggga

SEQ ID NO: 362455 - DNA, 30 bp, Artificial Sequence; identical to SEQ ID NO: 4995
  Description of Artificial Sequence: Synthetic oligonucleotide

SEQ ID NO: 362456 - DNA, 24 bp, Artificial Sequence
  Description of Artificial Sequence: Synthetic oligonucleotide
ccaggcgctcctcatgcactggga

SEQ ID NO: 362457 - DNA, 31 bp, Artificial Sequence; identical to SEQ ID NO: 4996
  Description of Artificial Sequence: Synthetic oligonucleotide

SEQ ID NO: 362458 - DNA, 24 bp, Artificial Sequence
  Description of Artificial Sequence: Synthetic oligonucleotide
caggcgctcctcatgcactgggac

SEQ ID NO: 362459 - DNA, 31 bp, Artificial Sequence; identical to SEQ ID NO: 4997
  Description of Artificial Sequence: Synthetic oligonucleotide

SEQ ID NO: 362460 - DNA, 24 bp, Artificial Sequence
  Description of Artificial Sequence: Synthetic oligonucleotide
aggcgctcctcatgcactgggacg

SEQ ID NO: 362461 - DNA, 32 bp, Artificial Sequence; identical to SEQ ID NO: 4998
  Description of Artificial Sequence: Synthetic oligonucleotide

SEQ ID NO: 362462 - DNA, 23 bp, Artificial Sequence
  Description of Artificial Sequence: Synthetic oligonucleotide
ggcgctcctcatgcactgggacg

SEQ ID NO: 362463 - DNA, 32 bp, Artificial Sequence; identical to SEQ ID NO: 4999
  Description of Artificial Sequence: Synthetic oligonucleotide

SEQ ID NO: 362464 - DNA, 23 bp, Artificial Sequence
  Description of Artificial Sequence: Synthetic oligonucleotide
gcgctcctcatgcactgggacgc

SEQ ID NO: 362465 - DNA, 32 bp, Artificial Sequence; identical to SEQ ID NO: 5000
  Description of Artificial Sequence: Synthetic oligonucleotide

SEQ ID NO: 362466 - DNA, 23 bp, Artificial Sequence
  Description of Artificial Sequence: Synthetic oligonucleotide
cgctcctcatgcactgggacgcc

SEQ ID NO: 362467 - DNA, 33 bp, Artificial Sequence; identical to SEQ ID NO: 5001
  Description of Artificial Sequence: Synthetic oligonucleotide

SEQ ID NO: 362468 - DNA, 25 bp, Artificial Sequence
  Description of Artificial Sequence: Synthetic oligonucleotide
gctcctcatgcactgggacgcccaa

SEQ ID NO: 362469 - DNA, 32 bp, Artificial Sequence; identical to SEQ ID NO: 5002
  Description of Artificial Sequence: Synthetic oligonucleotide

SEQ ID NO: 362470 - DNA, 26 bp, Artificial Sequence
  Description of Artificial Sequence: Synthetic oligonucleotide
ctcctcatgcactgggacgcccaaga

SEQ ID NO: 362471 - DNA, 33 bp, Artificial Sequence; identical to SEQ ID NO: 5003
  Description of Artificial Sequence: Synthetic oligonucleotide

SEQ ID NO: 362472 - DNA, 26 bp, Artificial Sequence
  Description of Artificial Sequence: Synthetic oligonucleotide
tcctcatgcactgggacgcccaagag

SEQ ID NO: 362473 - DNA, 32 bp, Artificial Sequence; identical to SEQ ID NO: 2613
  Description of Artificial Sequence: Synthetic oligonucleotide

SEQ ID NO: 362474 - DNA, 25 bp, Artificial Sequence
  Description of Artificial Sequence: Synthetic oligonucleotide
cctcatgcactgggacgcccaagag

SEQ ID NO: 362475 - DNA, 32 bp, Artificial Sequence; identical to SEQ ID NO: 2614
  Description of Artificial Sequence: Synthetic oligonucleotide

SEQ ID NO: 362476 - DNA, 25 bp, Artificial Sequence
  Description of Artificial Sequence: Synthetic oligonucleotide
ctcatgcactgggacgcccaagagg

SEQ ID NO: 362477 - DNA, 31 bp, Artificial Sequence; identical to SEQ ID NO: 2615
  Description of Artificial Sequence: Synthetic oligonucleotide

SEQ ID NO: 362478 - DNA, 27 bp, Artificial Sequence
  Description of Artificial Sequence: Synthetic oligonucleotide
tcatgcactgggacgcccaagaggcaa

SEQ ID NO: 362479 - DNA, 31 bp, Artificial Sequence; identical to SEQ ID NO: 2616
  Description of Artificial Sequence: Synthetic oligonucleotide

SEQ ID NO: 362480 - DNA, 27 bp, Artificial Sequence
  Description of Artificial Sequence: Synthetic oligonucleotide
catgcactgggacgcccaagaggcaat

SEQ ID NO: 362481 - DNA, 30 bp, Artificial Sequence; identical to SEQ ID NO: 2617
  Description of Artificial Sequence: Synthetic oligonucleotide

SEQ ID NO: 362482 - DNA, 27 bp, Artificial Sequence
  Description of Artificial Sequence: Synthetic oligonucleotide
atgcactgggacgcccaagaggcaatc

SEQ ID NO: 362483 - DNA, 30 bp, Artificial Sequence; identical to SEQ ID NO: 2618
  Description of Artificial Sequence: Synthetic oligonucleotide

SEQ ID NO: 362484 - DNA, 26 bp, Artificial Sequence
  Description of Artificial Sequence: Synthetic oligonucleotide
tgcactgggacgcccaagaggcaatc

SEQ ID NO: 362485 - DNA, 30 bp, Artificial Sequence; identical to SEQ ID NO: 2619
  Description of Artificial Sequence: Synthetic oligonucleotide

SEQ ID NO: 362486 - DNA, 25 bp, Artificial Sequence
  Description of Artificial Sequence: Synthetic oligonucleotide
gcactgggacgcccaagaggcaatc

SEQ ID NO: 362487 - DNA, 29 bp, Artificial Sequence
  Description of Artificial Sequence: Synthetic oligonucleotide
tgaggtatttctacacctccgtgtcccgg

SEQ ID NO: 362488 - DNA, 26 bp, Artificial Sequence
  Description of Artificial Sequence: Synthetic oligonucleotide
cactgggacgcccaagaggcaatcca

SEQ ID NO: 362489 - DNA, 28 bp, Artificial Sequence
  Description of Artificial Sequence: Synthetic oligonucleotide
gaggtatttctacacctccgtgtcccgg

SEQ ID NO: 362490 - DNA, 27 bp, Artificial Sequence
  Description of Artificial Sequence: Synthetic oligonucleotide
actgggacgcccaagaggcaatccaga

SEQ ID NO: 362491 - DNA, 28 bp, Artificial Sequence
  Description of Artificial Sequence: Synthetic oligonucleotide
aggtatttctacacctccgtgtcccggc

SEQ ID NO: 362492 - DNA, 27 bp, Artificial Sequence
  Description of Artificial Sequence: Synthetic oligonucleotide
ctgggacgcccaagaggcaatccagaa

SEQ ID NO: 362493 - DNA, 27 bp, Artificial Sequence
  Description of Artificial Sequence: Synthetic oligonucleotide
ggtatttctacacctccgtgtcccggc

SEQ ID NO: 362494 - DNA, 27 bp, Artificial Sequence
  Description of Artificial Sequence: Synthetic oligonucleotide
tgggacgcccaagaggcaatccagaag

SEQ ID NO: 362495 - DNA, 27 bp, Artificial Sequence
  Description of Artificial Sequence: Synthetic oligonucleotide
gtatttctacacctccgtgtcccggcc

SEQ ID NO: 362496 - DNA, 26 bp, Artificial Sequence
  Description of Artificial Sequence: Synthetic oligonucleotide
gggacgcccaagaggcaatccagaag

SEQ ID NO: 362497 - DNA, 27 bp, Artificial Sequence
  Description of Artificial Sequence: Synthetic oligonucleotide
tatttctacacctccgtgtcccggccc

SEQ ID NO: 362498 - DNA, 26 bp, Artificial Sequence
  Description of Artificial Sequence: Synthetic oligonucleotide
ggacgcccaagaggcaatccagaagc

SEQ ID NO: 362499 - DNA, 26 bp, Artificial Sequence
  Description of Artificial Sequence: Synthetic oligonucleotide
atttctacacctccgtgtcccggccc

SEQ ID NO: 362500 - DNA, 27 bp, Artificial Sequence
  Description of Artificial Sequence: Synthetic oligonucleotide
gacgcccaagaggcaatccagaagcct

SEQ ID NO: 362501 - DNA, 25 bp, Artificial Sequence
  Description of Artificial Sequence: Synthetic oligonucleotide
tttctacacctccgtgtcccggccc

SEQ ID NO: 362502 - DNA, 27 bp, Artificial Sequence
  Description of Artificial Sequence: Synthetic oligonucleotide
acgcccaagaggcaatccagaagcctg

SEQ ID NO: 362503 - DNA, 24 bp, Artificial Sequence
  Description of Artificial Sequence: Synthetic oligonucleotide
ttctacacctccgtgtcccggccc

SEQ ID NO: 362504 - DNA, 27 bp, Artificial Sequence
  Description of Artificial Sequence: Synthetic oligonucleotide
cgcccaagaggcaatccagaagcctga

SEQ ID NO: 362505 - DNA, 23 bp, Artificial Sequence
  Description of Artificial Sequence: Synthetic oligonucleotide
tctacacctccgtgtcccggccc

SEQ ID NO: 362506 - DNA, 27 bp, Artificial Sequence
  Description of Artificial Sequence: Synthetic oligonucleotide
gcccaagaggcaatccagaagcctgag

SEQ ID NO: 362507 - DNA, 22 bp, Artificial Sequence
  Description of Artificial Sequence: Synthetic oligonucleotide
ctacacctccgtgtcccggccc

SEQ ID NO: 362508 - DNA, 28 bp, Artificial Sequence
  Description of Artificial Sequence: Synthetic oligonucleotide
cccaagaggcaatccagaagcctgagac

SEQ ID NO: 362509 - DNA, 22 bp, Artificial Sequence
  Description of Artificial Sequence: Synthetic oligonucleotide
tacacctccgtgtcccggcccg

SEQ ID NO: 362510 - DNA, 30 bp, Artificial Sequence; identical to SEQ ID NO: 235861
  Description of Artificial Sequence: Synthetic oligonucleotide

SEQ ID NO: 362511 - DNA, 21 bp, Artificial Sequence
  Description of Artificial Sequence: Synthetic oligonucleotide
acacctccgtgtcccggcccg

SEQ ID NO: 362512 - DNA, 30 bp, Artificial Sequence; identical to SEQ ID NO: 235862
  Description of Artificial Sequence: Synthetic oligonucleotide

SEQ ID NO: 362513 - DNA, 20 bp, Artificial Sequence
  Description of Artificial Sequence: Synthetic oligonucleotide
cacctccgtgtcccggcccg

SEQ ID NO: 362514 - DNA, 30 bp, Artificial Sequence; identical to SEQ ID NO: 235863
  Description of Artificial Sequence: Synthetic oligonucleotide

SEQ ID NO: 362515 - DNA, 20 bp, Artificial Sequence
  Description of Artificial Sequence: Synthetic oligonucleotide
acctccgtgtcccggcccgg

SEQ ID NO: 362516 - DNA, 29 bp, Artificial Sequence
  Description of Artificial Sequence: Synthetic oligonucleotide
agaggcaatccagaagcctgagactacgg

SEQ ID NO: 362517 - DNA, 20 bp, Artificial Sequence
  Description of Artificial Sequence: Synthetic oligonucleotide
cctccgtgtcccggcccggt

SEQ ID NO: 362518 - DNA, 28 bp, Artificial Sequence
  Description of Artificial Sequence: Synthetic oligonucleotide
gaggcaatccagaagcctgagactacgg

SEQ ID NO: 362519 - DNA, 20 bp, Artificial Sequence
  Description of Artificial Sequence: Synthetic oligonucleotide
ctccgtgtcccggcccggct

SEQ ID NO: 362520 - DNA, 29 bp, Artificial Sequence
  Description of Artificial Sequence: Synthetic oligonucleotide
aggcaatccagaagcctgagactacggag

SEQ ID NO: 362521 - DNA, 27 bp, Artificial Sequence
  Description of Artificial Sequence: Synthetic oligonucleotide
gtggagtggctccgcagatacctggaa

SEQ ID NO: 362522 - DNA, 28 bp, Artificial Sequence
  Description of Artificial Sequence: Synthetic oligonucleotide
ggcaatccagaagcctgagactacggag

SEQ ID NO: 362523 - DNA, 29 bp, Artificial Sequence
  Description of Artificial Sequence: Synthetic oligonucleotide
tggagtggctccgcagatacctggaaaac

SEQ ID NO: 362524 - DNA, 29 bp, Artificial Sequence
  Description of Artificial Sequence: Synthetic oligonucleotide
gcaatccagaagcctgagactacggagac

SEQ ID NO: 362525 - DNA, 28 bp, Artificial Sequence
  Description of Artificial Sequence: Synthetic oligonucleotide
ggagtggctccgcagatacctggaaaac

SEQ ID NO: 362526 - DNA, 30 bp, Artificial Sequence; identical to SEQ ID NO: 235869
  Description of Artificial Sequence: Synthetic oligonucleotide

SEQ ID NO: 362527 - DNA, 28 bp, Artificial Sequence
  Description of Artificial Sequence: Synthetic oligonucleotide
gagtggctccgcagatacctggaaaacg

SEQ ID NO: 362528 - DNA, 31 bp, Artificial Sequence; identical to SEQ ID NO: 235870
  Description of Artificial Sequence: Synthetic oligonucleotide

SEQ ID NO: 362529 - DNA, 28 bp, Artificial Sequence
  Description of Artificial Sequence: Synthetic oligonucleotide
agtggctccgcagatacctggaaaacgg

SEQ ID NO: 362530 - DNA, 30 bp, Artificial Sequence; identical to SEQ ID NO: 235871
  Description of Artificial Sequence: Synthetic oligonucleotide

SEQ ID NO: 362531 - DNA, 27 bp, Artificial Sequence
  Description of Artificial Sequence: Synthetic oligonucleotide
gtggctccgcagatacctggaaaacgg

SEQ ID NO: 362532 - DNA, 29 bp, Artificial Sequence
  Description of Artificial Sequence: Synthetic oligonucleotide
tccagaagcctgagactacggagactctg

SEQ ID NO: 362533 - DNA, 27 bp, Artificial Sequence
  Description of Artificial Sequence: Synthetic oligonucleotide
tggctccgcagatacctggaaaacggg

SEQ ID NO: 362534 - DNA, 28 bp, Artificial Sequence
  Description of Artificial Sequence: Synthetic oligonucleotide
ccagaagcctgagactacggagactctg

SEQ ID NO: 362535 - DNA, 27 bp, Artificial Sequence
  Description of Artificial Sequence: Synthetic oligonucleotide
ggctccgcagatacctggaaaacggga

SEQ ID NO: 362536 - DNA, 28 bp, Artificial Sequence
  Description of Artificial Sequence: Synthetic oligonucleotide
cagaagcctgagactacggagactctgc

SEQ ID NO: 362537 - DNA, 28 bp, Artificial Sequence
  Description of Artificial Sequence: Synthetic oligonucleotide
gctccgcagatacctggaaaacgggaag

SEQ ID NO: 362538 - DNA, 29 bp, Artificial Sequence
  Description of Artificial Sequence: Synthetic oligonucleotide
agaagcctgagactacggagactctgctc

SEQ ID NO: 362539 - DNA, 28 bp, Artificial Sequence
  Description of Artificial Sequence: Synthetic oligonucleotide
ctccgcagatacctggaaaacgggaagg

SEQ ID NO: 362540 - DNA, 28 bp, Artificial Sequence
  Description of Artificial Sequence: Synthetic oligonucleotide
gaagcctgagactacggagactctgctc

SEQ ID NO: 362541 - DNA, 29 bp, Artificial Sequence
  Description of Artificial Sequence: Synthetic oligonucleotide
tccgcagatacctggaaaacgggaaggag

SEQ ID NO: 362542 - DNA, 29 bp, Artificial Sequence
  Description of Artificial Sequence: Synthetic oligonucleotide
aagcctgagactacggagactctgctctg

SEQ ID NO: 362543 - DNA, 28 bp, Artificial Sequence
  Description of Artificial Sequence: Synthetic oligonucleotide
ccgcagatacctggaaaacgggaaggag

SEQ ID NO: 362544 - DNA, 28 bp, Artificial Sequence
  Description of Artificial Sequence: Synthetic oligonucleotide
agcctgagactacggagactctgctctg

SEQ ID NO: 362545 - DNA, 29 bp, Artificial Sequence
  Description of Artificial Sequence: Synthetic oligonucleotide
cgcagatacctggaaaacgggaaggagac

SEQ ID NO: 362546 - DNA, 27 bp, Artificial Sequence
  Description of Artificial Sequence: Synthetic oligonucleotide
gcctgagactacggagactctgctctg

SEQ ID NO: 362547 - DNA, 29 bp, Artificial Sequence
  Description of Artificial Sequence: Synthetic oligonucleotide
gcagatacctggaaaacgggaaggagacg

SEQ ID NO: 362548 - DNA, 28 bp, Artificial Sequence
  Description of Artificial Sequence: Synthetic oligonucleotide
cctgagactacggagactctgctctgtg

SEQ ID NO: 362549 - DNA, 29 bp, Artificial Sequence
  Description of Artificial Sequence: Synthetic oligonucleotide
cagatacctggaaaacgggaaggagacgc

SEQ ID NO: 362550 - DNA, 28 bp, Artificial Sequence
  Description of Artificial Sequence: Synthetic oligonucleotide
ctgagactacggagactctgctctgtgg

SEQ ID NO: 362551 - DNA, 30 bp, Artificial Sequence; identical to SEQ ID NO: 5019
  Description of Artificial Sequence: Synthetic oligonucleotide

SEQ ID NO: 362552 - DNA, 28 bp, Artificial Sequence
  Description of Artificial Sequence: Synthetic oligonucleotide
tgagactacggagactctgctctgtggc

SEQ ID NO: 362553 - DNA, 29 bp, Artificial Sequence
  Description of Artificial Sequence: Synthetic oligonucleotide
gatacctggaaaacgggaaggagacgctg

SEQ ID NO: 362554 - DNA, 27 bp, Artificial Sequence
  Description of Artificial Sequence: Synthetic oligonucleotide
gagactacggagactctgctctgtggc

SEQ ID NO: 362555 - DNA, 29 bp, Artificial Sequence
  Description of Artificial Sequence: Synthetic oligonucleotide
atacctggaaaacgggaaggagacgctgc

SEQ ID NO: 362556 - DNA, 27 bp, Artificial Sequence
  Description of Artificial Sequence: Synthetic oligonucleotide
agactacggagactctgctctgtggcc

SEQ ID NO: 362557 - DNA, 28 bp, Artificial Sequence
  Description of Artificial Sequence: Synthetic oligonucleotide
tacctggaaaacgggaaggagacgctgc

SEQ ID NO: 362558 - DNA, 27 bp, Artificial Sequence
  Description of Artificial Sequence: Synthetic oligonucleotide
gactacggagactctgctctgtggcct

SEQ ID NO: 362559 - DNA, 27 bp, Artificial Sequence
  Description of Artificial Sequence: Synthetic oligonucleotide
acctggaaaacgggaaggagacgctgc

SEQ ID NO: 362560 - DNA, 27 bp, Artificial Sequence
  Description of Artificial Sequence: Synthetic oligonucleotide
actacggagactctgctctgtggcctg

SEQ ID NO: 362561 - DNA, 27 bp, Artificial Sequence
  Description of Artificial Sequence: Synthetic oligonucleotide
cctggaaaacgggaaggagacgctgca

SEQ ID NO: 362562 - DNA, 26 bp, Artificial Sequence
  Description of Artificial Sequence: Synthetic oligonucleotide
ctacggagactctgctctgtggcctg

SEQ ID NO: 362563 - DNA, 27 bp, Artificial Sequence
  Description of Artificial Sequence: Synthetic oligonucleotide
ctggaaaacgggaaggagacgctgcag

SEQ ID NO: 362564 - DNA, 26 bp, Artificial Sequence
  Description of Artificial Sequence: Synthetic oligonucleotide
tacggagactctgctctgtggcctgg

SEQ ID NO: 362565 - DNA, 27 bp, Artificial Sequence
  Description of Artificial Sequence: Synthetic oligonucleotide
tggaaaacgggaaggagacgctgcagc

SEQ ID NO: 362566 - DNA, 25 bp, Artificial Sequence
  Description of Artificial Sequence: Synthetic oligonucleotide
acggagactctgctctgtggcctgg

SEQ ID NO: 362567 - DNA, 26 bp, Artificial Sequence
  Description of Artificial Sequence: Synthetic oligonucleotide
ggaaaacgggaaggagacgctgcagc

SEQ ID NO: 362568 - DNA, 24 bp, Artificial Sequence
  Description of Artificial Sequence: Synthetic oligonucleotide
cggagactctgctctgtggcctgg

SEQ ID NO: 362569 - DNA, 26 bp, Artificial Sequence
  Description of Artificial Sequence: Synthetic oligonucleotide
gaaaacgggaaggagacgctgcagcg

SEQ ID NO: 362570 - DNA, 24 bp, Artificial Sequence
  Description of Artificial Sequence: Synthetic oligonucleotide
ggagactctgctctgtggcctggg

SEQ ID NO: 362571 - DNA, 27 bp, Artificial Sequence
  Description of Artificial Sequence: Synthetic oligonucleotide
aaaacgggaaggagacgctgcagcgca

SEQ ID NO: 362572 - DNA, 24 bp, Artificial Sequence
  Description of Artificial Sequence: Synthetic oligonucleotide
gagactctgctctgtggcctgggc

SEQ ID NO: 362573 - DNA, 26 bp, Artificial Sequence
  Description of Artificial Sequence: Synthetic oligonucleotide
aaacgggaaggagacgctgcagcgca

SEQ ID NO: 362574 - DNA, 25 bp, Artificial Sequence
  Description of Artificial Sequence: Synthetic oligonucleotide
agactctgctctgtggcctgggcct

SEQ ID NO: 362575 - DNA, 20 bp, Artificial Sequence
  Description of Artificial Sequence: Synthetic oligonucleotide
ccggcccggccgcggtgatt

SEQ ID NO: 362576 - DNA, 24 bp, Artificial Sequence
  Description of Artificial Sequence: Synthetic oligonucleotide
gactctgctctgtggcctgggcct

SEQ ID NO: 362577 - DNA, 20 bp, Artificial Sequence
  Description of Artificial Sequence: Synthetic oligonucleotide
cggcccggccgcggtgagtt

SEQ ID NO: 362578 - DNA, 24 bp, Artificial Sequence
  Description of Artificial Sequence: Synthetic oligonucleotide
actctgctctgtggcctgggcctc

SEQ ID NO: 362579 - DNA, 20 bp, Artificial Sequence
  Description of Artificial Sequence: Synthetic oligonucleotide
ggcccggccgcggtgagctt

SEQ ID NO: 362580 - DNA, 23 bp, Artificial Sequence
  Description of Artificial Sequence: Synthetic oligonucleotide
ctctgctctgtggcctgggcctc

SEQ ID NO: 362581 - DNA, 20 bp, Artificial Sequence
  Description of Artificial Sequence: Synthetic oligonucleotide
gcccggccgcggtgagcctt

SEQ ID NO: 362582 - DNA, 24 bp, Artificial Sequence
  Description of Artificial Sequence: Synthetic oligonucleotide
tctgctctgtggcctgggcctcgt

SEQ ID NO: 362583 - DNA, 20 bp, Artificial Sequence
  Description of Artificial Sequence: Synthetic oligonucleotide
cccggccgcggtgagccctt

SEQ ID NO: 362584 - DNA, 23 bp, Artificial Sequence
  Description of Artificial Sequence: Synthetic oligonucleotide
ctgctctgtggcctgggcctcgt

SEQ ID NO: 362585 - DNA, 20 bp, Artificial Sequence
  Description of Artificial Sequence: Synthetic oligonucleotide
ccggccgcggtgagcccctt

SEQ ID NO: 362586 - DNA, 23 bp, Artificial Sequence
  Description of Artificial Sequence: Synthetic oligonucleotide
tgctctgtggcctgggcctcgtg

SEQ ID NO: 362587 - DNA, 20 bp, Artificial Sequence
  Description of Artificial Sequence: Synthetic oligonucleotide
cggccgcggtgagccccgtt

SEQ ID NO: 362588 - DNA, 22 bp, Artificial Sequence
  Description of Artificial Sequence: Synthetic oligonucleotide
gctctgtggcctgggcctcgtg

SEQ ID NO: 362589 - DNA, 20 bp, Artificial Sequence
  Description of Artificial Sequence: Synthetic oligonucleotide
ggccgcggtgagccccgctt

SEQ ID NO: 362590 - DNA, 23 bp, Artificial Sequence
  Description of Artificial Sequence: Synthetic oligonucleotide
ctctgtggcctgggcctcgtgct

SEQ ID NO: 362591 - DNA, 22 bp, Artificial Sequence
  Description of Artificial Sequence: Synthetic oligonucleotide
gccgcggtgagccccgcttcat

SEQ ID NO: 362592 - DNA, 23 bp, Artificial Sequence
  Description of Artificial Sequence: Synthetic oligonucleotide
tctgtggcctgggcctcgtgctg

SEQ ID NO: 362593 - DNA, 22 bp, Artificial Sequence
  Description of Artificial Sequence: Synthetic oligonucleotide
ccgcggtgagccccgcttcatc

SEQ ID NO: 362594 - DNA, 22 bp, Artificial Sequence
  Description of Artificial Sequence: Synthetic oligonucleotide
ctgtggcctgggcctcgtgctg

SEQ ID NO: 362595 - DNA, 22 bp, Artificial Sequence
  Description of Artificial Sequence: Synthetic oligonucleotide
cgcggtgagccccgcttcatcg

SEQ ID NO: 362596 - DNA, 22 bp, Artificial Sequence
  Description of Artificial Sequence: Synthetic oligonucleotide
tgtggcctgggcctcgtgctgg

SEQ ID NO: 362597 - DNA, 23 bp, Artificial Sequence
  Description of Artificial Sequence: Synthetic oligonucleotide
gcggtgagccccgcttcatcgca

SEQ ID NO: 362598 - DNA, 21 bp, Artificial Sequence
  Description of Artificial Sequence: Synthetic oligonucleotide
gtggcctgggcctcgtgctgg

SEQ ID NO: 362599 - DNA, 24 bp, Artificial Sequence
  Description of Artificial Sequence: Synthetic oligonucleotide
cggtgagccccgcttcatcgcagt

SEQ ID NO: 362600 - DNA, 21 bp, Artificial Sequence
  Description of Artificial Sequence: Synthetic oligonucleotide
tggcctgggcctcgtgctggg

SEQ ID NO: 362601 - DNA, 24 bp, Artificial Sequence
  Description of Artificial Sequence: Synthetic oligonucleotide
ggtgagccccgcttcatcgcagtg

SEQ ID NO: 362602 - DNA, 20 bp, Artificial Sequence
  Description of Artificial Sequence: Synthetic oligonucleotide
ggcctgggcctcgtgctggg

SEQ ID NO: 362603 - DNA, 24 bp, Artificial Sequence
  Description of Artificial Sequence: Synthetic oligonucleotide
gtgagccccgcttcatcgcagtgg

SEQ ID NO: 362604 - DNA, 20 bp, Artificial Sequence
  Description of Artificial Sequence: Synthetic oligonucleotide
gcctgggcctcgtgctgggc

SEQ ID NO: 362605 - DNA, 24 bp, Artificial Sequence
  Description of Artificial Sequence: Synthetic oligonucleotide
tgagccccgcttcatcgcagtggg

SEQ ID NO: 362606 - DNA, 22 bp, Artificial Sequence
  Description of Artificial Sequence: Synthetic oligonucleotide
cctgggcctcgtgctgggcgta

SEQ ID NO: 362607 - DNA, 26 bp, Artificial Sequence
  Description of Artificial Sequence: Synthetic oligonucleotide
atcgccctgaaagaggacctgcgctc

SEQ ID NO: 362608 - DNA, 23 bp, Artificial Sequence
  Description of Artificial Sequence: Synthetic oligonucleotide
ctgggcctcgtgctgggcgtagt

SEQ ID NO: 362609 - DNA, 25 bp, Artificial Sequence
  Description of Artificial Sequence: Synthetic oligonucleotide
tcgccctgaaagaggacctgcgctc

SEQ ID NO: 362610 - DNA, 23 bp, Artificial Sequence
  Description of Artificial Sequence: Synthetic oligonucleotide
tgggcctcgtgctgggcgtagtg

SEQ ID NO: 362611 - DNA, 24 bp, Artificial Sequence
  Description of Artificial Sequence: Synthetic oligonucleotide
cgccctgaaagaggacctgcgctc

SEQ ID NO: 362612 - DNA, 22 bp, Artificial Sequence
  Description of Artificial Sequence: Synthetic oligonucleotide
gggcctcgtgctgggcgtagtg

SEQ ID NO: 362613 - DNA, 25 bp, Artificial Sequence
  Description of Artificial Sequence: Synthetic oligonucleotide
gccctgaaagaggacctgcgctcct

SEQ ID NO: 362614 - DNA, 22 bp, Artificial Sequence
  Description of Artificial Sequence: Synthetic oligonucleotide
ggcctcgtgctgggcgtagtgg

SEQ ID NO: 362615 - DNA, 25 bp, Artificial Sequence
  Description of Artificial Sequence: Synthetic oligonucleotide
ccctgaaagaggacctgcgctcctg

SEQ ID NO: 362616 - DNA, 22 bp, Artificial Sequence
  Description of Artificial Sequence: Synthetic oligonucleotide
gcctcgtgctgggcgtagtggg

SEQ ID NO: 362617 - DNA, 26 bp, Artificial Sequence
  Description of Artificial Sequence: Synthetic oligonucleotide
cctgaaagaggacctgcgctcctgga

SEQ ID NO: 362618 - DNA, 24 bp, Artificial Sequence
  Description of Artificial Sequence: Synthetic oligonucleotide
cctcgtgctgggcgtagtgggcaa

SEQ ID NO: 362619 - DNA, 26 bp, Artificial Sequence
  Description of Artificial Sequence: Synthetic oligonucleotide
ctgaaagaggacctgcgctcctggac

SEQ ID NO: 362620 - DNA, 26 bp, Artificial Sequence
  Description of Artificial Sequence: Synthetic oligonucleotide
ctcgtgctgggcgtagtgggcaacat

SEQ ID NO: 362621 - DNA, 26 bp, Artificial Sequence
  Description of Artificial Sequence: Synthetic oligonucleotide
tgaaagaggacctgcgctcctggacc

SEQ ID NO: 362622 - DNA, 26 bp, Artificial Sequence
  Description of Artificial Sequence: Synthetic oligonucleotide
tcgtgctgggcgtagtgggcaacatc

SEQ ID NO: 362623 - DNA, 25 bp, Artificial Sequence
  Description of Artificial Sequence: Synthetic oligonucleotide
gaaagaggacctgcgctcctggacc

SEQ ID NO: 362624 - DNA, 25 bp, Artificial Sequence
  Description of Artificial Sequence: Synthetic oligonucleotide
cgtgctgggcgtagtgggcaacatc

SEQ ID NO: 362625 - DNA, 25 bp, Artificial Sequence
  Description of Artificial Sequence: Synthetic oligonucleotide
aaagaggacctgcgctcctggaccg

SEQ ID NO: 362626 - DNA, 26 bp, Artificial Sequence
  Description of Artificial Sequence: Synthetic oligonucleotide
gtgctgggcgtagtgggcaacatcgt

SEQ ID NO: 362627 - DNA, 24 bp, Artificial Sequence
  Description of Artificial Sequence: Synthetic oligonucleotide
aagaggacctgcgctcctggaccg

SEQ ID NO: 362628 - DNA, 26 bp, Artificial Sequence
  Description of Artificial Sequence: Synthetic oligonucleotide
tgctgggcgtagtgggcaacatcgtg

SEQ ID NO: 362629 - DNA, 23 bp, Artificial Sequence
  Description of Artificial Sequence: Synthetic oligonucleotide
agaggacctgcgctcctggaccg

SEQ ID NO: 362630 - DNA, 25 bp, Artificial Sequence
  Description of Artificial Sequence: Synthetic oligonucleotide
gctgggcgtagtgggcaacatcgtg

SEQ ID NO: 362631 - DNA, 32 bp, Artificial Sequence; identical to SEQ ID NO: 5058
  Description of Artificial Sequence: Synthetic oligonucleotide

SEQ ID NO: 362632 - DNA, 25 bp, Artificial Sequence
  Description of Artificial Sequence: Synthetic oligonucleotide
ctgggcgtagtgggcaacatcgtgg

SEQ ID NO: 362633 - DNA, 32 bp, Artificial Sequence; identical to SEQ ID NO: 5059
  Description of Artificial Sequence: Synthetic oligonucleotide

SEQ ID NO: 362634 - DNA, 25 bp, Artificial Sequence
  Description of Artificial Sequence: Synthetic oligonucleotide
tgggcgtagtgggcaacatcgtggg

SEQ ID NO: 362635 - DNA, 33 bp, Artificial Sequence; identical to SEQ ID NO: 5060
  Description of Artificial Sequence: Synthetic oligonucleotide

SEQ ID NO: 362636 - DNA, 24 bp, Artificial Sequence
  Description of Artificial Sequence: Synthetic oligonucleotide
gggcgtagtgggcaacatcgtggg

SEQ ID NO: 362637 - DNA, 32 bp, Artificial Sequence; identical to SEQ ID NO: 5061
  Description of Artificial Sequence: Synthetic oligonucleotide

SEQ ID NO: 362638 - DNA, 25 bp, Artificial Sequence
  Description of Artificial Sequence: Synthetic oligonucleotide
ggcgtagtgggcaacatcgtgggga

SEQ ID NO: 362639 - DNA, 33 bp, Artificial Sequence; identical to SEQ ID NO: 5062
  Description of Artificial Sequence: Synthetic oligonucleotide

SEQ ID NO: 362640 - DNA, 25 bp, Artificial Sequence
  Description of Artificial Sequence: Synthetic oligonucleotide
gcgtagtgggcaacatcgtggggac

SEQ ID NO: 362641 - DNA, 33 bp, Artificial Sequence; identical to SEQ ID NO: 5063
  Description of Artificial Sequence: Synthetic oligonucleotide

SEQ ID NO: 362642 - DNA, 25 bp, Artificial Sequence
  Description of Artificial Sequence: Synthetic oligonucleotide
cgtagtgggcaacatcgtggggacc

SEQ ID NO: 362643 - DNA, 33 bp, Artificial Sequence; identical to SEQ ID NO: 5064
  Description of Artificial Sequence: Synthetic oligonucleotide

SEQ ID NO: 362644 - DNA, 26 bp, Artificial Sequence
  Description of Artificial Sequence: Synthetic oligonucleotide
gtagtgggcaacatcgtggggaccgt

SEQ ID NO: 362645 - DNA, 32 bp, Artificial Sequence; identical to SEQ ID NO: 5065
  Description of Artificial Sequence: Synthetic oligonucleotide

SEQ ID NO: 362646 - DNA, 26 bp, Artificial Sequence
  Description of Artificial Sequence: Synthetic oligonucleotide
tagtgggcaacatcgtggggaccgtc

SEQ ID NO: 362647 - DNA, 32 bp, Artificial Sequence; identical to SEQ ID NO: 5066
  Description of Artificial Sequence: Synthetic oligonucleotide

SEQ ID NO: 362648 - DNA, 25 bp, Artificial Sequence
  Description of Artificial Sequence: Synthetic oligonucleotide
agtgggcaacatcgtggggaccgtc

SEQ ID NO: 362649 - DNA, 31 bp, Artificial Sequence; identical to SEQ ID NO: 5067
  Description of Artificial Sequence: Synthetic oligonucleotide

SEQ ID NO: 362650 - DNA, 24 bp, Artificial Sequence
  Description of Artificial Sequence: Synthetic oligonucleotide
gtgggcaacatcgtggggaccgtc

SEQ ID NO: 362651 - DNA, 31 bp, Artificial Sequence; identical to SEQ ID NO: 5068
  Description of Artificial Sequence: Synthetic oligonucleotide

SEQ ID NO: 362652 - DNA, 25 bp, Artificial Sequence
  Description of Artificial Sequence: Synthetic oligonucleotide
tgggcaacatcgtggggaccgtcct

SEQ ID NO: 362653 - DNA, 31 bp, Artificial Sequence; identical to SEQ ID NO: 5069
  Description of Artificial Sequence: Synthetic oligonucleotide

SEQ ID NO: 362654 - DNA, 24 bp, Artificial Sequence
  Description of Artificial Sequence: Synthetic oligonucleotide
gggcaacatcgtggggaccgtcct

SEQ ID NO: 362655 - DNA, 30 bp, Artificial Sequence; identical to SEQ ID NO: 5070
  Description of Artificial Sequence: Synthetic oligonucleotide

SEQ ID NO: 362656 - DNA, 26 bp, Artificial Sequence
  Description of Artificial Sequence: Synthetic oligonucleotide
ggcaacatcgtggggaccgtcctctt

SEQ ID NO: 362657 - DNA, 29 bp, Artificial Sequence
  Description of Artificial Sequence: Synthetic oligonucleotide
gaggtatttctacacttccgtgtcccggc

SEQ ID NO: 362658 - DNA, 27 bp, Artificial Sequence
  Description of Artificial Sequence: Synthetic oligonucleotide
gcaacatcgtggggaccgtcctcttca

SEQ ID NO: 362659 - DNA, 29 bp, Artificial Sequence
  Description of Artificial Sequence: Synthetic oligonucleotide
aggtatttctacacttccgtgtcccggcc

SEQ ID NO: 362660 - DNA, 31 bp, Artificial Sequence; identical to SEQ ID NO: 235936
  Description of Artificial Sequence: Synthetic oligonucleotide

SEQ ID NO: 362661 - DNA, 28 bp, Artificial Sequence
  Description of Artificial Sequence: Synthetic oligonucleotide
ggtatttctacacttccgtgtcccggcc

SEQ ID NO: 362662 - DNA, 32 bp, Artificial Sequence; identical to SEQ ID NO: 235937
  Description of Artificial Sequence: Synthetic oligonucleotide

SEQ ID NO: 362663 - DNA, 28 bp, Artificial Sequence
  Description of Artificial Sequence: Synthetic oligonucleotide
gtatttctacacttccgtgtcccggccc

SEQ ID NO: 362664 - DNA, 31 bp, Artificial Sequence; identical to SEQ ID NO: 235938
  Description of Artificial Sequence: Synthetic oligonucleotide

SEQ ID NO: 362665 - DNA, 28 bp, Artificial Sequence
  Description of Artificial Sequence: Synthetic oligonucleotide
tatttctacacttccgtgtcccggcccg

SEQ ID NO: 362666 - DNA, 30 bp, Artificial Sequence; identical to SEQ ID NO: 235939
  Description of Artificial Sequence: Synthetic oligonucleotide

SEQ ID NO: 362667 - DNA, 27 bp, Artificial Sequence
  Description of Artificial Sequence: Synthetic oligonucleotide
atttctacacttccgtgtcccggcccg

SEQ ID NO: 362668 - DNA, 31 bp, Artificial Sequence; identical to SEQ ID NO: 235940
  Description of Artificial Sequence: Synthetic oligonucleotide

SEQ ID NO: 362669 - DNA, 26 bp, Artificial Sequence
  Description of Artificial Sequence: Synthetic oligonucleotide
tttctacacttccgtgtcccggcccg

SEQ ID NO: 362670 - DNA, 30 bp, Artificial Sequence; identical to SEQ ID NO: 235941
  Description of Artificial Sequence: Synthetic oligonucleotide

SEQ ID NO: 362671 - DNA, 25 bp, Artificial Sequence
  Description of Artificial Sequence: Synthetic oligonucleotide
ttctacacttccgtgtcccggcccg

SEQ ID NO: 362672 - DNA, 29 bp, Artificial Sequence
  Description of Artificial Sequence: Synthetic oligonucleotide
cgtggggaccgtcctcttcataaagtgtc

SEQ ID NO: 362673 - DNA, 24 bp, Artificial Sequence
  Description of Artificial Sequence: Synthetic oligonucleotide
tctacacttccgtgtcccggcccg

SEQ ID NO: 362674 - DNA, 30 bp, Artificial Sequence; identical to SEQ ID NO: 235943
  Description of Artificial Sequence: Synthetic oligonucleotide

SEQ ID NO: 362675 - DNA, 23 bp, Artificial Sequence
  Description of Artificial Sequence: Synthetic oligonucleotide
ctacacttccgtgtcccggcccg

SEQ ID NO: 362676 - DNA, 30 bp, Artificial Sequence; identical to SEQ ID NO: 235944
  Description of Artificial Sequence: Synthetic oligonucleotide

SEQ ID NO: 362677 - DNA, 23 bp, Artificial Sequence
  Description of Artificial Sequence: Synthetic oligonucleotide
tacacttccgtgtcccggcccgg

SEQ ID NO: 362678 - DNA, 29 bp, Artificial Sequence
  Description of Artificial Sequence: Synthetic oligonucleotide
ggggaccgtcctcttcataaagtgtctgc

SEQ ID NO: 362679 - DNA, 22 bp, Artificial Sequence
  Description of Artificial Sequence: Synthetic oligonucleotide
acacttccgtgtcccggcccgg

SEQ ID NO: 362680 - DNA, 29 bp, Artificial Sequence
  Description of Artificial Sequence: Synthetic oligonucleotide
gggaccgtcctcttcataaagtgtctgcg

SEQ ID NO: 362681 - DNA, 21 bp, Artificial Sequence
  Description of Artificial Sequence: Synthetic oligonucleotide
cacttccgtgtcccggcccgg

SEQ ID NO: 362682 - DNA, 31 bp, Artificial Sequence; identical to SEQ ID NO: 235947
  Description of Artificial Sequence: Synthetic oligonucleotide

SEQ ID NO: 362683 - DNA, 21 bp, Artificial Sequence
  Description of Artificial Sequence: Synthetic oligonucleotide
acttccgtgtcccggcccggc

SEQ ID NO: 362684 - DNA, 32 bp, Artificial Sequence; identical to SEQ ID NO: 235948
  Description of Artificial Sequence: Synthetic oligonucleotide

SEQ ID NO: 362685 - DNA, 20 bp, Artificial Sequence
  Description of Artificial Sequence: Synthetic oligonucleotide
cttccgtgtcccggcccggc

SEQ ID NO: 362686 - DNA, 32 bp, Artificial Sequence; identical to SEQ ID NO: 235949
  Description of Artificial Sequence: Synthetic oligonucleotide

SEQ ID NO: 362687 - DNA, 20 bp, Artificial Sequence
  Description of Artificial Sequence: Synthetic oligonucleotide
ttccgtgtcccggcccggcc

SEQ ID NO: 362688 - DNA, 31 bp, Artificial Sequence; identical to SEQ ID NO: 235950
  Description of Artificial Sequence: Synthetic oligonucleotide

SEQ ID NO: 362689 - DNA, 25 bp, Artificial Sequence
  Description of Artificial Sequence: Synthetic oligonucleotide
accgcggcagacatggcagctcaga

SEQ ID NO: 362690 - DNA, 31 bp, Artificial Sequence; identical to SEQ ID NO: 235951
  Description of Artificial Sequence: Synthetic oligonucleotide

SEQ ID NO: 362691 - DNA, 24 bp, Artificial Sequence
  Description of Artificial Sequence: Synthetic oligonucleotide
ccgcggcagacatggcagctcaga

SEQ ID NO: 362692 - DNA, 31 bp, Artificial Sequence; identical to SEQ ID NO: 235952
  Description of Artificial Sequence: Synthetic oligonucleotide

SEQ ID NO: 362693 - DNA, 24 bp, Artificial Sequence
  Description of Artificial Sequence: Synthetic oligonucleotide
cgcggcagacatggcagctcagac

SEQ ID NO: 362694 - DNA, 33 bp, Artificial Sequence; identical to SEQ ID NO: 235953
  Description of Artificial Sequence: Synthetic oligonucleotide

SEQ ID NO: 362695 - DNA, 25 bp, Artificial Sequence
  Description of Artificial Sequence: Synthetic oligonucleotide
gcggcagacatggcagctcagacca

SEQ ID NO: 362696 - DNA, 32 bp, Artificial Sequence; identical to SEQ ID NO: 235954
  Description of Artificial Sequence: Synthetic oligonucleotide

SEQ ID NO: 362697 - DNA, 25 bp, Artificial Sequence
  Description of Artificial Sequence: Synthetic oligonucleotide
cggcagacatggcagctcagaccac

SEQ ID NO: 362698 - DNA, 33 bp, Artificial Sequence; identical to SEQ ID NO: 235955
  Description of Artificial Sequence: Synthetic oligonucleotide

SEQ ID NO: 362699 - DNA, 27 bp, Artificial Sequence
  Description of Artificial Sequence: Synthetic oligonucleotide
ggcagacatggcagctcagaccaccaa

SEQ ID NO: 362700 - DNA, 33 bp, Artificial Sequence; identical to SEQ ID NO: 235956
  Description of Artificial Sequence: Synthetic oligonucleotide

SEQ ID NO: 362701 - DNA, 27 bp, Artificial Sequence
  Description of Artificial Sequence: Synthetic oligonucleotide
gcagacatggcagctcagaccaccaag

SEQ ID NO: 362702 - DNA, 32 bp, Artificial Sequence; identical to SEQ ID NO: 235957
  Description of Artificial Sequence: Synthetic oligonucleotide

SEQ ID NO: 362703 - DNA, 27 bp, Artificial Sequence
  Description of Artificial Sequence: Synthetic oligonucleotide
cagacatggcagctcagaccaccaagc

SEQ ID NO: 362704 - DNA, 32 bp, Artificial Sequence; identical to SEQ ID NO: 235958
  Description of Artificial Sequence: Synthetic oligonucleotide

SEQ ID NO: 362705 - DNA, 28 bp, Artificial Sequence
  Description of Artificial Sequence: Synthetic oligonucleotide
agacatggcagctcagaccaccaagcac

SEQ ID NO: 362706 - DNA, 31 bp, Artificial Sequence; identical to SEQ ID NO: 235959
  Description of Artificial Sequence: Synthetic oligonucleotide

SEQ ID NO: 362707 - DNA, 24 bp, Artificial Sequence
  Description of Artificial Sequence: Synthetic oligonucleotide
gtggggtcggactggcgcttcctt

SEQ ID NO: 362708 - DNA, 30 bp, Artificial Sequence; identical to SEQ ID NO: 235960
  Description of Artificial Sequence: Synthetic oligonucleotide

SEQ ID NO: 362709 - DNA, 24 bp, Artificial Sequence
  Description of Artificial Sequence: Synthetic oligonucleotide
tggggtcggactggcgcttccttc

SEQ ID NO: 362710 - DNA, 30 bp, Artificial Sequence; identical to SEQ ID NO: 235961
  Description of Artificial Sequence: Synthetic oligonucleotide

SEQ ID NO: 362711 - DNA, 23 bp, Artificial Sequence
  Description of Artificial Sequence: Synthetic oligonucleotide
ggggtcggactggcgcttccttc

SEQ ID NO: 362712 - DNA, 29 bp, Artificial Sequence
  Description of Artificial Sequence: Synthetic oligonucleotide
taaagtgtctgcgttcaggccatgacgcc

SEQ ID NO: 362713 - DNA, 23 bp, Artificial Sequence
  Description of Artificial Sequence: Synthetic oligonucleotide
gggtcggactggcgcttccttcg

SEQ ID NO: 362714 - DNA, 28 bp, Artificial Sequence
  Description of Artificial Sequence: Synthetic oligonucleotide
aaagtgtctgcgttcaggccatgacgcc

SEQ ID NO: 362715 - DNA, 23 bp, Artificial Sequence
  Description of Artificial Sequence: Synthetic oligonucleotide
ggtcggactggcgcttccttcgc

SEQ ID NO: 362716 - DNA, 27 bp, Artificial Sequence
  Description of Artificial Sequence: Synthetic oligonucleotide
aagtgtctgcgttcaggccatgacgcc

SEQ ID NO: 362717 - DNA, 23 bp, Artificial Sequence
  Description of Artificial Sequence: Synthetic oligonucleotide
gtcggactggcgcttccttcgcg

SEQ ID NO: 362718 - DNA, 26 bp, Artificial Sequence
  Description of Artificial Sequence: Synthetic oligonucleotide
agtgtctgcgttcaggccatgacgcc

SEQ ID NO: 362719 - DNA, 23 bp, Artificial Sequence
  Description of Artificial Sequence: Synthetic oligonucleotide
tcggactggcgcttccttcgcgg

SEQ ID NO: 362720 - DNA, 25 bp, Artificial Sequence
  Description of Artificial Sequence: Synthetic oligonucleotide
gtgtctgcgttcaggccatgacgcc

SEQ ID NO: 362721 - DNA, 22 bp, Artificial Sequence
  Description of Artificial Sequence: Synthetic oligonucleotide
cggactggcgcttccttcgcgg

SEQ ID NO: 362722 - DNA, 25 bp, Artificial Sequence
  Description of Artificial Sequence: Synthetic oligonucleotide
tgtctgcgttcaggccatgacgccc

SEQ ID NO: 362723 - DNA, 24 bp, Artificial Sequence
  Description of Artificial Sequence: Synthetic oligonucleotide
ggactggcgcttccttcgcgggta

SEQ ID NO: 362724 - DNA, 24 bp, Artificial Sequence
  Description of Artificial Sequence: Synthetic oligonucleotide
gtctgcgttcaggccatgacgccc

SEQ ID NO: 362725 - DNA, 24 bp, Artificial Sequence
  Description of Artificial Sequence: Synthetic oligonucleotide
gactggcgcttccttcgcgggtac

SEQ ID NO: 362726 - DNA, 24 bp, Artificial Sequence
  Description of Artificial Sequence: Synthetic oligonucleotide
tctgcgttcaggccatgacgcccg

SEQ ID NO: 362727 - DNA, 25 bp, Artificial Sequence
  Description of Artificial Sequence: Synthetic oligonucleotide
actggcgcttccttcgcgggtacca

SEQ ID NO: 362728 - DNA, 23 bp, Artificial Sequence
  Description of Artificial Sequence: Synthetic oligonucleotide
ctgcgttcaggccatgacgcccg

SEQ ID NO: 362729 - DNA, 24 bp, Artificial Sequence
  Description of Artificial Sequence: Synthetic oligonucleotide
ctggcgcttccttcgcgggtacca

SEQ ID NO: 362730 - DNA, 23 bp, Artificial Sequence
  Description of Artificial Sequence: Synthetic oligonucleotide
tgcgttcaggccatgacgcccgg

SEQ ID NO: 362731 - DNA, 24 bp, Artificial Sequence
  Description of Artificial Sequence: Synthetic oligonucleotide
tggcgcttccttcgcgggtaccac

SEQ ID NO: 362732 - DNA, 22 bp, Artificial Sequence
  Description of Artificial Sequence: Synthetic oligonucleotide
gcgttcaggccatgacgcccgg

SEQ ID NO: 362733 - DNA, 23 bp, Artificial Sequence
  Description of Artificial Sequence: Synthetic oligonucleotide
ggcgcttccttcgcgggtaccac

SEQ ID NO: 362734 - DNA, 22 bp, Artificial Sequence
  Description of Artificial Sequence: Synthetic oligonucleotide
cgttcaggccatgacgcccggg

SEQ ID NO: 362735 - DNA, 24 bp, Artificial Sequence
  Description of Artificial Sequence: Synthetic oligonucleotide
gcgcttccttcgcgggtaccacca

SEQ ID NO: 362736 - DNA, 22 bp, Artificial Sequence
  Description of Artificial Sequence: Synthetic oligonucleotide
gttcaggccatgacgcccgggc

SEQ ID NO: 362737 - DNA, 26 bp, Artificial Sequence
  Description of Artificial Sequence: Synthetic oligonucleotide
cgcttccttcgcgggtaccaccagta

SEQ ID NO: 362738 - DNA, 22 bp, Artificial Sequence
  Description of Artificial Sequence: Synthetic oligonucleotide
ttcaggccatgacgcccgggcc

SEQ ID NO: 362739 - DNA, 26 bp, Artificial Sequence
  Description of Artificial Sequence: Synthetic oligonucleotide
gcttccttcgcgggtaccaccagtac

SEQ ID NO: 362740 - DNA, 21 bp, Artificial Sequence
  Description of Artificial Sequence: Synthetic oligonucleotide
tcaggccatgacgcccgggcc

SEQ ID NO: 362741 - DNA, 26 bp, Artificial Sequence
  Description of Artificial Sequence: Synthetic oligonucleotide
cttccttcgcgggtaccaccagtacg

SEQ ID NO: 362742 - DNA, 20 bp, Artificial Sequence
  Description of Artificial Sequence: Synthetic oligonucleotide
caggccatgacgcccgggcc

SEQ ID NO: 362743 - DNA, 26 bp, Artificial Sequence
  Description of Artificial Sequence: Synthetic oligonucleotide
ttccttcgcgggtaccaccagtacgc

SEQ ID NO: 362744 - DNA, 21 bp, Artificial Sequence
  Description of Artificial Sequence: Synthetic oligonucleotide
aggccatgacgcccgggccct

SEQ ID NO: 362745 - DNA, 25 bp, Artificial Sequence
  Description of Artificial Sequence: Synthetic oligonucleotide
tccttcgcgggtaccaccagtacgc

SEQ ID NO: 362746 - DNA, 20 bp, Artificial Sequence
  Description of Artificial Sequence: Synthetic oligonucleotide
ggccatgacgcccgggccct

SEQ ID NO: 362747 - DNA, 24 bp, Artificial Sequence
  Description of Artificial Sequence: Synthetic oligonucleotide
ccttcgcgggtaccaccagtacgc

SEQ ID NO: 362748 - DNA, 20 bp, Artificial Sequence
  Description of Artificial Sequence: Synthetic oligonucleotide
gccatgacgcccgggccctg

SEQ ID NO: 362749 - DNA, 26 bp, Artificial Sequence
  Description of Artificial Sequence: Synthetic oligonucleotide
cttcgcgggtaccaccagtacgccta

SEQ ID NO: 362750 - DNA, 20 bp, Artificial Sequence
  Description of Artificial Sequence: Synthetic oligonucleotide
ccatgacgcccgggccctgg

SEQ ID NO: 362751 - DNA, 26 bp, Artificial Sequence
  Description of Artificial Sequence: Synthetic oligonucleotide
ttcgcgggtaccaccagtacgcctac

SEQ ID NO: 362752 - DNA, 20 bp, Artificial Sequence
  Description of Artificial Sequence: Synthetic oligonucleotide
catgacgcccgggccctggg

SEQ ID NO: 362753 - DNA, 25 bp, Artificial Sequence
  Description of Artificial Sequence: Synthetic oligonucleotide
tcgcgggtaccaccagtacgcctac

SEQ ID NO: 362754 - DNA, 21 bp, Artificial Sequence
  Description of Artificial Sequence: Synthetic oligonucleotide
atgacgcccgggccctgggga

SEQ ID NO: 362755 - DNA, 31 bp, Artificial Sequence; identical to SEQ ID NO: 2608
  Description of Artificial Sequence: Synthetic oligonucleotide

SEQ ID NO: 362756 - DNA, 20 bp, Artificial Sequence
  Description of Artificial Sequence: Synthetic oligonucleotide
tgacgcccgggccctgggga

SEQ ID NO: 362757 - DNA, 31 bp, Artificial Sequence; identical to SEQ ID NO: 2609
  Description of Artificial Sequence: Synthetic oligonucleotide

SEQ ID NO: 362758 - DNA, 20 bp, Artificial Sequence
  Description of Artificial Sequence: Synthetic oligonucleotide
gacgcccgggccctggggat

SEQ ID NO: 362759 - DNA, 31 bp, Artificial Sequence; identical to SEQ ID NO: 2610
  Description of Artificial Sequence: Synthetic oligonucleotide

SEQ ID NO: 362760 - DNA, 20 bp, Artificial Sequence
  Description of Artificial Sequence: Synthetic oligonucleotide
acgcccgggccctggggact

SEQ ID NO: 362761 - DNA, 30 bp, Artificial Sequence; identical to SEQ ID NO: 2611
  Description of Artificial Sequence: Synthetic oligonucleotide

SEQ ID NO: 362762 - DNA, 20 bp, Artificial Sequence
  Description of Artificial Sequence: Synthetic oligonucleotide
cgcccgggccctggggactt

SEQ ID NO: 362763 - DNA, 31 bp, Artificial Sequence; identical to SEQ ID NO: 2612
  Description of Artificial Sequence: Synthetic oligonucleotide

SEQ ID NO: 362764 - DNA, 20 bp, Artificial Sequence
  Description of Artificial Sequence: Synthetic oligonucleotide
gcccgggccctggggacctt

SEQ ID NO: 362765 - DNA, 27 bp, Artificial Sequence
  Description of Artificial Sequence: Synthetic oligonucleotide
cggttctcacaccgtccagaggatgtg

SEQ ID NO: 362766 - DNA, 20 bp, Artificial Sequence
  Description of Artificial Sequence: Synthetic oligonucleotide
cccgggccctggggaccctt

SEQ ID NO: 362767 - DNA, 28 bp, Artificial Sequence
  Description of Artificial Sequence: Synthetic oligonucleotide
ggttctcacaccgtccagaggatgtgtg

SEQ ID NO: 362768 - DNA, 20 bp, Artificial Sequence
  Description of Artificial Sequence: Synthetic oligonucleotide
ccgggccctggggaccctct

SEQ ID NO: 362769 - DNA, 28 bp, Artificial Sequence
  Description of Artificial Sequence: Synthetic oligonucleotide
gttctcacaccgtccagaggatgtgtgg

SEQ ID NO: 362770 - DNA, 21 bp, Artificial Sequence
  Description of Artificial Sequence: Synthetic oligonucleotide
cgggccctggggaccctctga

SEQ ID NO: 362771 - DNA, 28 bp, Artificial Sequence
  Description of Artificial Sequence: Synthetic oligonucleotide
ttctcacaccgtccagaggatgtgtggc

SEQ ID NO: 362772 - DNA, 28 bp, Artificial Sequence
  Description of Artificial Sequence: Synthetic oligonucleotide
atgatggttgtgcaggtttgtgcggccc

SEQ ID NO: 362773 - DNA, 27 bp, Artificial Sequence
  Description of Artificial Sequence: Synthetic oligonucleotide
tctcacaccgtccagaggatgtgtggc

SEQ ID NO: 362774 - DNA, 27 bp, Artificial Sequence
  Description of Artificial Sequence: Synthetic oligonucleotide
tgatggttgtgcaggtttgtgcggccc

SEQ ID NO: 362775 - DNA, 27 bp, Artificial Sequence
  Description of Artificial Sequence: Synthetic oligonucleotide
ctcacaccgtccagaggatgtgtggct

SEQ ID NO: 362776 - DNA, 26 bp, Artificial Sequence
  Description of Artificial Sequence: Synthetic oligonucleotide
gatggttgtgcaggtttgtgcggccc

SEQ ID NO: 362777 - DNA, 27 bp, Artificial Sequence
  Description of Artificial Sequence: Synthetic oligonucleotide
tcacaccgtccagaggatgtgtggctg

SEQ ID NO: 362778 - DNA, 26 bp, Artificial Sequence
  Description of Artificial Sequence: Synthetic oligonucleotide
atggttgtgcaggtttgtgcggcccc

SEQ ID NO: 362779 - DNA, 26 bp, Artificial Sequence
  Description of Artificial Sequence: Synthetic oligonucleotide
cacaccgtccagaggatgtgtggctg

SEQ ID NO: 362780 - DNA, 25 bp, Artificial Sequence
  Description of Artificial Sequence: Synthetic oligonucleotide
tggttgtgcaggtttgtgcggcccc

SEQ ID NO: 362781 - DNA, 26 bp, Artificial Sequence
  Description of Artificial Sequence: Synthetic oligonucleotide
acaccgtccagaggatgtgtggctgc

SEQ ID NO: 362782 - DNA, 24 bp, Artificial Sequence
  Description of Artificial Sequence: Synthetic oligonucleotide
ggttgtgcaggtttgtgcggcccc

SEQ ID NO: 362783 - DNA, 25 bp, Artificial Sequence
  Description of Artificial Sequence: Synthetic oligonucleotide
caccgtccagaggatgtgtggctgc

SEQ ID NO: 362784 - DNA, 24 bp, Artificial Sequence
  Description of Artificial Sequence: Synthetic oligonucleotide
gttgtgcaggtttgtgcggccccg

SEQ ID NO: 362785 - DNA, 26 bp, Artificial Sequence
  Description of Artificial Sequence: Synthetic oligonucleotide
accgtccagaggatgtgtggctgcga

SEQ ID NO: 362786 - DNA, 24 bp, Artificial Sequence
  Description of Artificial Sequence: Synthetic oligonucleotide
ttgtgcaggtttgtgcggccccgc

SEQ ID NO: 362787 - DNA, 25 bp, Artificial Sequence
  Description of Artificial Sequence: Synthetic oligonucleotide
ccgtccagaggatgtgtggctgcga

SEQ ID NO: 362788 - DNA, 23 bp, Artificial Sequence
  Description of Artificial Sequence: Synthetic oligonucleotide
tgtgcaggtttgtgcggccccgc

SEQ ID NO: 362789 - DNA, 25 bp, Artificial Sequence
  Description of Artificial Sequence: Synthetic oligonucleotide
cgtccagaggatgtgtggctgcgac

SEQ ID NO: 362790 - DNA, 22 bp, Artificial Sequence
  Description of Artificial Sequence: Synthetic oligonucleotide
gtgcaggtttgtgcggccccgc

SEQ ID NO: 362791 - DNA, 26 bp, Artificial Sequence
  Description of Artificial Sequence: Synthetic oligonucleotide
gtccagaggatgtgtggctgcgacgt

SEQ ID NO: 362792 - DNA, 22 bp, Artificial Sequence
  Description of Artificial Sequence: Synthetic oligonucleotide
tgcaggtttgtgcggccccgcg

SEQ ID NO: 362793 - DNA, 26 bp, Artificial Sequence
  Description of Artificial Sequence: Synthetic oligonucleotide
tccagaggatgtgtggctgcgacgtg

SEQ ID NO: 362794 - DNA, 21 bp, Artificial Sequence
  Description of Artificial Sequence: Synthetic oligonucleotide
gcaggtttgtgcggccccgcg

SEQ ID NO: 362795 - DNA, 25 bp, Artificial Sequence
  Description of Artificial Sequence: Synthetic oligonucleotide
ccagaggatgtgtggctgcgacgtg

SEQ ID NO: 362796 - DNA, 22 bp, Artificial Sequence
  Description of Artificial Sequence: Synthetic oligonucleotide
caggtttgtgcggccccgcgga

SEQ ID NO: 362797 - DNA, 25 bp, Artificial Sequence
  Description of Artificial Sequence: Synthetic oligonucleotide
cagaggatgtgtggctgcgacgtgg

SEQ ID NO: 362798 - DNA, 23 bp, Artificial Sequence
  Description of Artificial Sequence: Synthetic oligonucleotide
aggtttgtgcggccccgcggaca

SEQ ID NO: 362799 - DNA, 25 bp, Artificial Sequence
  Description of Artificial Sequence: Synthetic oligonucleotide
agaggatgtgtggctgcgacgtggg

SEQ ID NO: 362800 - DNA, 22 bp, Artificial Sequence
  Description of Artificial Sequence: Synthetic oligonucleotide
ggtttgtgcggccccgcggaca

SEQ ID NO: 362801 - DNA, 24 bp, Artificial Sequence
  Description of Artificial Sequence: Synthetic oligonucleotide
gaggatgtgtggctgcgacgtggg

SEQ ID NO: 362802 - DNA, 23 bp, Artificial Sequence
  Description of Artificial Sequence: Synthetic oligonucleotide
gtttgtgcggccccgcggacagt

SEQ ID NO: 362803 - DNA, 25 bp, Artificial Sequence
  Description of Artificial Sequence: Synthetic oligonucleotide
aggatgtgtggctgcgacgtggggt

SEQ ID NO: 362804 - DNA, 23 bp, Artificial Sequence
  Description of Artificial Sequence: Synthetic oligonucleotide
tttgtgcggccccgcggacagtg

SEQ ID NO: 362805 - DNA, 24 bp, Artificial Sequence
  Description of Artificial Sequence: Synthetic oligonucleotide
ggatgtgtggctgcgacgtggggt

SEQ ID NO: 362806 - DNA, 22 bp, Artificial Sequence
  Description of Artificial Sequence: Synthetic oligonucleotide
ttgtgcggccccgcggacagtg

SEQ ID NO: 362807 - DNA, 24 bp, Artificial Sequence
  Description of Artificial Sequence: Synthetic oligonucleotide
gatgtgtggctgcgacgtggggtc

SEQ ID NO: 362808 - DNA, 21 bp, Artificial Sequence
  Description of Artificial Sequence: Synthetic oligonucleotide
tgtgcggccccgcggacagtg

SEQ ID NO: 362809 - DNA, 24 bp, Artificial Sequence
  Description of Artificial Sequence: Synthetic oligonucleotide
atgtgtggctgcgacgtggggtcg

SEQ ID NO: 362810 - DNA, 20 bp, Artificial Sequence
  Description of Artificial Sequence: Synthetic oligonucleotide
gtgcggccccgcggacagtg

SEQ ID NO: 362811 - DNA, 23 bp, Artificial Sequence
  Description of Artificial Sequence: Synthetic oligonucleotide
tgtgtggctgcgacgtggggtcg

SEQ ID NO: 362812 - DNA, 20 bp, Artificial Sequence
  Description of Artificial Sequence: Synthetic oligonucleotide
tgcggccccgcggacagtgc

SEQ ID NO: 362813 - DNA, 22 bp, Artificial Sequence
  Description of Artificial Sequence: Synthetic oligonucleotide
gtgtggctgcgacgtggggtcg

SEQ ID NO: 362814 - DNA, 20 bp, Artificial Sequence
  Description of Artificial Sequence: Synthetic oligonucleotide
gcggccccgcggacagtgct

SEQ ID NO: 362815 - DNA, 23 bp, Artificial Sequence
  Description of Artificial Sequence: Synthetic oligonucleotide
tgtggctgcgacgtggggtcgga

SEQ ID NO: 362816 - DNA, 20 bp, Artificial Sequence
  Description of Artificial Sequence: Synthetic oligonucleotide
cggccccgcggacagtgcct

SEQ ID NO: 362817 - DNA, 22 bp, Artificial Sequence
  Description of Artificial Sequence: Synthetic oligonucleotide
gtggctgcgacgtggggtcgga

SEQ ID NO: 362818 - DNA, 21 bp, Artificial Sequence
  Description of Artificial Sequence: Synthetic oligonucleotide
ggccccgcggacagtgcctct

SEQ ID NO: 362819 - DNA, 28 bp, Artificial Sequence
  Description of Artificial Sequence: Synthetic oligonucleotide
gagtattgggacggggagacacggaatg

SEQ ID NO: 362820 - DNA, 22 bp, Artificial Sequence
  Description of Artificial Sequence: Synthetic oligonucleotide
gccccgcggacagtgcctctga

SEQ ID NO: 362821 - DNA, 29 bp, Artificial Sequence
  Description of Artificial Sequence: Synthetic oligonucleotide
agtattgggacggggagacacggaatgtg

SEQ ID NO: 362822 - DNA, 22 bp, Artificial Sequence
  Description of Artificial Sequence: Synthetic oligonucleotide
ccccgcggacagtgcctctgac

SEQ ID NO: 362823 - DNA, 28 bp, Artificial Sequence
  Description of Artificial Sequence: Synthetic oligonucleotide
gtattgggacggggagacacggaatgtg

SEQ ID NO: 362824 - DNA, 22 bp, Artificial Sequence
  Description of Artificial Sequence: Synthetic oligonucleotide
cccgcggacagtgcctctgacg

SEQ ID NO: 362825 - DNA, 30 bp, Artificial Sequence; identical to SEQ ID NO: 5164
  Description of Artificial Sequence: Synthetic oligonucleotide

SEQ ID NO: 362826 - DNA, 22 bp, Artificial Sequence
  Description of Artificial Sequence: Synthetic oligonucleotide
ccgcggacagtgcctctgacgg

SEQ ID NO: 362827 - DNA, 29 bp, Artificial Sequence
  Description of Artificial Sequence: Synthetic oligonucleotide
attgggacggggagacacggaatgtgaag

SEQ ID NO: 362828 - DNA, 22 bp, Artificial Sequence
  Description of Artificial Sequence: Synthetic oligonucleotide
cgcggacagtgcctctgacggg

SEQ ID NO: 362829 - DNA, 28 bp, Artificial Sequence
  Description of Artificial Sequence: Synthetic oligonucleotide
ttgggacggggagacacggaatgtgaag

SEQ ID NO: 362830 - DNA, 25 bp, Artificial Sequence
  Description of Artificial Sequence: Synthetic oligonucleotide
gcggacagtgcctctgacggggtta

SEQ ID NO: 362831 - DNA, 27 bp, Artificial Sequence
  Description of Artificial Sequence: Synthetic oligonucleotide
tgggacggggagacacggaatgtgaag

SEQ ID NO: 362832 - DNA, 26 bp, Artificial Sequence
  Description of Artificial Sequence: Synthetic oligonucleotide
cggacagtgcctctgacggggttact

SEQ ID NO: 362833 - DNA, 26 bp, Artificial Sequence
  Description of Artificial Sequence: Synthetic oligonucleotide
gggacggggagacacggaatgtgaag

SEQ ID NO: 362834 - DNA, 27 bp, Artificial Sequence
  Description of Artificial Sequence: Synthetic oligonucleotide
ggacagtgcctctgacggggttactga

SEQ ID NO: 362835 - DNA, 26 bp, Artificial Sequence
  Description of Artificial Sequence: Synthetic oligonucleotide
ggacggggagacacggaatgtgaagg

SEQ ID NO: 362836 - DNA, 28 bp, Artificial Sequence
  Description of Artificial Sequence: Synthetic oligonucleotide
gacagtgcctctgacggggttactgatg

SEQ ID NO: 362837 - DNA, 26 bp, Artificial Sequence
  Description of Artificial Sequence: Synthetic oligonucleotide
gacggggagacacggaatgtgaaggc

SEQ ID NO: 362838 - DNA, 29 bp, Artificial Sequence
  Description of Artificial Sequence: Synthetic oligonucleotide
acagtgcctctgacggggttactgatgtg

SEQ ID NO: 362839 - DNA, 26 bp, Artificial Sequence
  Description of Artificial Sequence: Synthetic oligonucleotide
acggggagacacggaatgtgaaggcc

SEQ ID NO: 362840 - DNA, 28 bp, Artificial Sequence
  Description of Artificial Sequence: Synthetic oligonucleotide
cagtgcctctgacggggttactgatgtg

SEQ ID NO: 362841 - DNA, 25 bp, Artificial Sequence
  Description of Artificial Sequence: Synthetic oligonucleotide
cggggagacacggaatgtgaaggcc

SEQ ID NO: 362842 - DNA, 28 bp, Artificial Sequence
  Description of Artificial Sequence: Synthetic oligonucleotide
agtgcctctgacggggttactgatgtgc

SEQ ID NO: 362843 - DNA, 26 bp, Artificial Sequence
  Description of Artificial Sequence: Synthetic oligonucleotide
ggggagacacggaatgtgaaggccca

SEQ ID NO: 362844 - DNA, 27 bp, Artificial Sequence
  Description of Artificial Sequence: Synthetic oligonucleotide
gtgcctctgacggggttactgatgtgc

SEQ ID NO: 362845 - DNA, 27 bp, Artificial Sequence
  Description of Artificial Sequence: Synthetic oligonucleotide
gggagacacggaatgtgaaggcccact

SEQ ID NO: 362846 - DNA, 28 bp, Artificial Sequence
  Description of Artificial Sequence: Synthetic oligonucleotide
tgcctctgacggggttactgatgtgctg

SEQ ID NO: 362847 - DNA, 27 bp, Artificial Sequence
  Description of Artificial Sequence: Synthetic oligonucleotide
ggagacacggaatgtgaaggcccactc

SEQ ID NO: 362848 - DNA, 27 bp, Artificial Sequence
  Description of Artificial Sequence: Synthetic oligonucleotide
gcctctgacggggttactgatgtgctg

SEQ ID NO: 362849 - DNA, 28 bp, Artificial Sequence
  Description of Artificial Sequence: Synthetic oligonucleotide
gagacacggaatgtgaaggcccactcac

SEQ ID NO: 362850 - DNA, 27 bp, Artificial Sequence
  Description of Artificial Sequence: Synthetic oligonucleotide
cctctgacggggttactgatgtgctgc

SEQ ID NO: 362851 - DNA, 29 bp, Artificial Sequence
  Description of Artificial Sequence: Synthetic oligonucleotide
agacacggaatgtgaaggcccactcacag

SEQ ID NO: 362852 - DNA, 28 bp, Artificial Sequence
  Description of Artificial Sequence: Synthetic oligonucleotide
ctctgacggggttactgatgtgctgctc

SEQ ID NO: 362853 - DNA, 28 bp, Artificial Sequence
  Description of Artificial Sequence: Synthetic oligonucleotide
gacacggaatgtgaaggcccactcacag

SEQ ID NO: 362854 - DNA, 29 bp, Artificial Sequence
  Description of Artificial Sequence: Synthetic oligonucleotide
tctgacggggttactgatgtgctgctctc

SEQ ID NO: 362855 - DNA, 29 bp, Artificial Sequence
  Description of Artificial Sequence: Synthetic oligonucleotide
acacggaatgtgaaggcccactcacagac

SEQ ID NO: 362856 - DNA, 28 bp, Artificial Sequence
  Description of Artificial Sequence: Synthetic oligonucleotide
ctgacggggttactgatgtgctgctctc

SEQ ID NO: 362857 - DNA, 28 bp, Artificial Sequence
  Description of Artificial Sequence: Synthetic oligonucleotide
cacggaatgtgaaggcccactcacagac

SEQ ID NO: 362858 - DNA, 30 bp, Artificial Sequence; identical to SEQ ID NO: 236035
  Description of Artificial Sequence: Synthetic oligonucleotide

SEQ ID NO: 362859 - DNA, 29 bp, Artificial Sequence
  Description of Artificial Sequence: Synthetic oligonucleotide
acggaatgtgaaggcccactcacagactc

SEQ ID NO: 362860 - DNA, 29 bp, Artificial Sequence
  Description of Artificial Sequence: Synthetic oligonucleotide
gacggggttactgatgtgctgctctcatc

SEQ ID NO: 362861 - DNA, 28 bp, Artificial Sequence
  Description of Artificial Sequence: Synthetic oligonucleotide
cggaatgtgaaggcccactcacagactc

SEQ ID NO: 362862 - DNA, 30 bp, Artificial Sequence; identical to SEQ ID NO: 236037
  Description of Artificial Sequence: Synthetic oligonucleotide

SEQ ID NO: 362863 - DNA, 29 bp, Artificial Sequence
  Description of Artificial Sequence: Synthetic oligonucleotide
ggaatgtgaaggcccactcacagactcac

SEQ ID NO: 362864 - DNA, 29 bp, Artificial Sequence
  Description of Artificial Sequence: Synthetic oligonucleotide
cggggttactgatgtgctgctctcatctg

SEQ ID NO: 362865 - DNA, 29 bp, Artificial Sequence
  Description of Artificial Sequence: Synthetic oligonucleotide
gaatgtgaaggcccactcacagactcacc

SEQ ID NO: 362866 - DNA, 30 bp, Artificial Sequence; identical to SEQ ID NO: 236039
  Description of Artificial Sequence: Synthetic oligonucleotide

SEQ ID NO: 362867 - DNA, 29 bp, Artificial Sequence
  Description of Artificial Sequence: Synthetic oligonucleotide
aatgtgaaggcccactcacagactcaccg

SEQ ID NO: 362868 - DNA, 30 bp, Artificial Sequence; identical to SEQ ID NO: 236040
  Description of Artificial Sequence: Synthetic oligonucleotide

SEQ ID NO: 362869 - DNA, 28 bp, Artificial Sequence
  Description of Artificial Sequence: Synthetic oligonucleotide
atgtgaaggcccactcacagactcaccg

SEQ ID NO: 362870 - DNA, 31 bp, Artificial Sequence; identical to SEQ ID NO: 236041
  Description of Artificial Sequence: Synthetic oligonucleotide

SEQ ID NO: 362871 - DNA, 27 bp, Artificial Sequence
  Description of Artificial Sequence: Synthetic oligonucleotide
tgtgaaggcccactcacagactcaccg

SEQ ID NO: 362872 - DNA, 31 bp, Artificial Sequence; identical to SEQ ID NO: 236042
  Description of Artificial Sequence: Synthetic oligonucleotide

SEQ ID NO: 362873 - DNA, 25 bp, Artificial Sequence
  Description of Artificial Sequence: Synthetic oligonucleotide
ggagctcgtggagaccaggcctgaa

SEQ ID NO: 362874 - DNA, 32 bp, Artificial Sequence; identical to SEQ ID NO: 236043
  Description of Artificial Sequence: Synthetic oligonucleotide

SEQ ID NO: 362875 - DNA, 25 bp, Artificial Sequence
  Description of Artificial Sequence: Synthetic oligonucleotide
gagctcgtggagaccaggcctgaag

SEQ ID NO: 362876 - DNA, 31 bp, Artificial Sequence; identical to SEQ ID NO: 236044
  Description of Artificial Sequence: Synthetic oligonucleotide

SEQ ID NO: 362877 - DNA, 25 bp, Artificial Sequence
  Description of Artificial Sequence: Synthetic oligonucleotide
agctcgtggagaccaggcctgaagg

SEQ ID NO: 362878 - DNA, 30 bp, Artificial Sequence; identical to SEQ ID NO: 236045
  Description of Artificial Sequence: Synthetic oligonucleotide

SEQ ID NO: 362879 - DNA, 24 bp, Artificial Sequence
  Description of Artificial Sequence: Synthetic oligonucleotide
gctcgtggagaccaggcctgaagg

SEQ ID NO: 362880 - DNA, 29 bp, Artificial Sequence
  Description of Artificial Sequence: Synthetic oligonucleotide
ctgatgtgctgctctcatctgtggaccag

SEQ ID NO: 362881 - DNA, 24 bp, Artificial Sequence
  Description of Artificial Sequence: Synthetic oligonucleotide
ctcgtggagaccaggcctgaaggg

SEQ ID NO: 362882 - DNA, 29 bp, Artificial Sequence
  Description of Artificial Sequence: Synthetic oligonucleotide
tgatgtgctgctctcatctgtggaccagg

SEQ ID NO: 362883 - DNA, 26 bp, Artificial Sequence
  Description of Artificial Sequence: Synthetic oligonucleotide
tcgtggagaccaggcctgaaggggat

SEQ ID NO: 362884 - DNA, 28 bp, Artificial Sequence
  Description of Artificial Sequence: Synthetic oligonucleotide
gatgtgctgctctcatctgtggaccagg

SEQ ID NO: 362885 - DNA, 25 bp, Artificial Sequence
  Description of Artificial Sequence: Synthetic oligonucleotide
cgtggagaccaggcctgaaggggat

SEQ ID NO: 362886 - DNA, 28 bp, Artificial Sequence
  Description of Artificial Sequence: Synthetic oligonucleotide
atgtgctgctctcatctgtggaccaggg

SEQ ID NO: 362887 - DNA, 25 bp, Artificial Sequence
  Description of Artificial Sequence: Synthetic oligonucleotide
gtggagaccaggcctgaaggggatg

SEQ ID NO: 362888 - DNA, 27 bp, Artificial Sequence
  Description of Artificial Sequence: Synthetic oligonucleotide
tgtgctgctctcatctgtggaccaggg

SEQ ID NO: 362889 - DNA, 27 bp, Artificial Sequence
  Description of Artificial Sequence: Synthetic oligonucleotide
tggagaccaggcctgaaggggatggaa

SEQ ID NO: 362890 - DNA, 26 bp, Artificial Sequence
  Description of Artificial Sequence: Synthetic oligonucleotide
gtgctgctctcatctgtggaccaggg

SEQ ID NO: 362891 - DNA, 26 bp, Artificial Sequence
  Description of Artificial Sequence: Synthetic oligonucleotide
ggagaccaggcctgaaggggatggaa

SEQ ID NO: 362892 - DNA, 27 bp, Artificial Sequence
  Description of Artificial Sequence: Synthetic oligonucleotide
tgctgctctcatctgtggaccagggca

SEQ ID NO: 362893 - DNA, 26 bp, Artificial Sequence
  Description of Artificial Sequence: Synthetic oligonucleotide
gagaccaggcctgaaggggatggaac

SEQ ID NO: 362894 - DNA, 26 bp, Artificial Sequence
  Description of Artificial Sequence: Synthetic oligonucleotide
gctgctctcatctgtggaccagggca

SEQ ID NO: 362895 - DNA, 27 bp, Artificial Sequence
  Description of Artificial Sequence: Synthetic oligonucleotide
agaccaggcctgaaggggatggaacct

SEQ ID NO: 362896 - DNA, 26 bp, Artificial Sequence
  Description of Artificial Sequence: Synthetic oligonucleotide
ctgctctcatctgtggaccagggcag

SEQ ID NO: 362897 - DNA, 27 bp, Artificial Sequence
  Description of Artificial Sequence: Synthetic oligonucleotide
gaccaggcctgaaggggatggaacctt

SEQ ID NO: 362898 - DNA, 26 bp, Artificial Sequence
  Description of Artificial Sequence: Synthetic oligonucleotide
tgctctcatctgtggaccagggcagc

SEQ ID NO: 362899 - DNA, 27 bp, Artificial Sequence
  Description of Artificial Sequence: Synthetic oligonucleotide
accaggcctgaaggggatggaaccttc

SEQ ID NO: 362900 - DNA, 25 bp, Artificial Sequence
  Description of Artificial Sequence: Synthetic oligonucleotide
gctctcatctgtggaccagggcagc

SEQ ID NO: 362901 - DNA, 26 bp, Artificial Sequence
  Description of Artificial Sequence: Synthetic oligonucleotide
ccaggcctgaaggggatggaaccttc

SEQ ID NO: 362902 - DNA, 25 bp, Artificial Sequence
  Description of Artificial Sequence: Synthetic oligonucleotide
ctctcatctgtggaccagggcagcg

SEQ ID NO: 362903 - DNA, 27 bp, Artificial Sequence
  Description of Artificial Sequence: Synthetic oligonucleotide
caggcctgaaggggatggaaccttcca

SEQ ID NO: 362904 - DNA, 25 bp, Artificial Sequence
  Description of Artificial Sequence: Synthetic oligonucleotide
tctcatctgtggaccagggcagcgc

SEQ ID NO: 362905 - DNA, 27 bp, Artificial Sequence
  Description of Artificial Sequence: Synthetic oligonucleotide
aggcctgaaggggatggaaccttccag

SEQ ID NO: 362906 - DNA, 24 bp, Artificial Sequence
  Description of Artificial Sequence: Synthetic oligonucleotide
ctcatctgtggaccagggcagcgc

SEQ ID NO: 362907 - DNA, 27 bp, Artificial Sequence
  Description of Artificial Sequence: Synthetic oligonucleotide
ggcctgaaggggatggaaccttccaga

SEQ ID NO: 362908 - DNA, 25 bp, Artificial Sequence
  Description of Artificial Sequence: Synthetic oligonucleotide
tcatctgtggaccagggcagcgcca

SEQ ID NO: 362909 - DNA, 28 bp, Artificial Sequence
  Description of Artificial Sequence: Synthetic oligonucleotide
gcctgaaggggatggaaccttccagaag

SEQ ID NO: 362910 - DNA, 24 bp, Artificial Sequence
  Description of Artificial Sequence: Synthetic oligonucleotide
catctgtggaccagggcagcgcca

SEQ ID NO: 362911 - DNA, 29 bp, Artificial Sequence
  Description of Artificial Sequence: Synthetic oligonucleotide
cctgaaggggatggaaccttccagaagtg

SEQ ID NO: 362912 - DNA, 25 bp, Artificial Sequence
  Description of Artificial Sequence: Synthetic oligonucleotide
atctgtggaccagggcagcgccact

SEQ ID NO: 362913 - DNA, 29 bp, Artificial Sequence
  Description of Artificial Sequence: Synthetic oligonucleotide
ctgaaggggatggaaccttccagaagtgg

SEQ ID NO: 362914 - DNA, 24 bp, Artificial Sequence
  Description of Artificial Sequence: Synthetic oligonucleotide
tctgtggaccagggcagcgccact

SEQ ID NO: 362915 - DNA, 29 bp, Artificial Sequence
  Description of Artificial Sequence: Synthetic oligonucleotide
tgaaggggatggaaccttccagaagtggg

SEQ ID NO: 362916 - DNA, 23 bp, Artificial Sequence
  Description of Artificial Sequence: Synthetic oligonucleotide
ctgtggaccagggcagcgccact

SEQ ID NO: 362917 - DNA, 28 bp, Artificial Sequence
  Description of Artificial Sequence: Synthetic oligonucleotide
gaaggggatggaaccttccagaagtggg

SEQ ID NO: 362918 - DNA, 23 bp, Artificial Sequence
  Description of Artificial Sequence: Synthetic oligonucleotide
tgtggaccagggcagcgccactc

SEQ ID NO: 362919 - DNA, 28 bp, Artificial Sequence
  Description of Artificial Sequence: Synthetic oligonucleotide
aaggggatggaaccttccagaagtgggc

SEQ ID NO: 362920 - DNA, 22 bp, Artificial Sequence
  Description of Artificial Sequence: Synthetic oligonucleotide
gtggaccagggcagcgccactc

SEQ ID NO: 362921 - DNA, 29 bp, Artificial Sequence
  Description of Artificial Sequence: Synthetic oligonucleotide
cggttctcacaccgtccagaggatgtttg

SEQ ID NO: 362922 - DNA, 23 bp, Artificial Sequence
  Description of Artificial Sequence: Synthetic oligonucleotide
tggaccagggcagcgccactcca

SEQ ID NO: 362923 - DNA, 29 bp, Artificial Sequence
  Description of Artificial Sequence: Synthetic oligonucleotide
ggttctcacaccgtccagaggatgtttgg

SEQ ID NO: 362924 - DNA, 22 bp, Artificial Sequence
  Description of Artificial Sequence: Synthetic oligonucleotide
ggaccagggcagcgccactcca

SEQ ID NO: 362925 - DNA, 29 bp, Artificial Sequence
  Description of Artificial Sequence: Synthetic oligonucleotide
gttctcacaccgtccagaggatgtttggc

SEQ ID NO: 362926 - DNA, 23 bp, Artificial Sequence
  Description of Artificial Sequence: Synthetic oligonucleotide
gaccagggcagcgccactccaca

SEQ ID NO: 362927 - DNA, 30 bp, Artificial Sequence; identical to SEQ ID NO: 5209
  Description of Artificial Sequence: Synthetic oligonucleotide

SEQ ID NO: 362928 - DNA, 27 bp, Artificial Sequence
  Description of Artificial Sequence: Synthetic oligonucleotide
accagggcagcgccactccacagaatt

SEQ ID NO: 362929 - DNA, 29 bp, Artificial Sequence
  Description of Artificial Sequence: Synthetic oligonucleotide
tctcacaccgtccagaggatgtttggctg

SEQ ID NO: 362930 - DNA, 27 bp, Artificial Sequence
  Description of Artificial Sequence: Synthetic oligonucleotide
ccagggcagcgccactccacagaatta

SEQ ID NO: 362931 - DNA, 28 bp, Artificial Sequence
  Description of Artificial Sequence: Synthetic oligonucleotide
ctcacaccgtccagaggatgtttggctg

SEQ ID NO: 362932 - DNA, 27 bp, Artificial Sequence
  Description of Artificial Sequence: Synthetic oligonucleotide
cagggcagcgccactccacagaattac

SEQ ID NO: 362933 - DNA, 28 bp, Artificial Sequence
  Description of Artificial Sequence: Synthetic oligonucleotide
tcacaccgtccagaggatgtttggctgc

SEQ ID NO: 362934 - DNA, 27 bp, Artificial Sequence
  Description of Artificial Sequence: Synthetic oligonucleotide
agggcagcgccactccacagaattacc

SEQ ID NO: 362935 - DNA, 27 bp, Artificial Sequence
  Description of Artificial Sequence: Synthetic oligonucleotide
cacaccgtccagaggatgtttggctgc

SEQ ID NO: 362936 - DNA, 27 bp, Artificial Sequence
  Description of Artificial Sequence: Synthetic oligonucleotide
gggcagcgccactccacagaattacca

SEQ ID NO: 362937 - DNA, 27 bp, Artificial Sequence
  Description of Artificial Sequence: Synthetic oligonucleotide
acaccgtccagaggatgtttggctgcg

SEQ ID NO: 362938 - DNA, 30 bp, Artificial Sequence; identical to SEQ ID NO: 236075
  Description of Artificial Sequence: Synthetic oligonucleotide

SEQ ID NO: 362939 - DNA, 27 bp, Artificial Sequence
  Description of Artificial Sequence: Synthetic oligonucleotide
caccgtccagaggatgtttggctgcga

SEQ ID NO: 362940 - DNA, 30 bp, Artificial Sequence; identical to SEQ ID NO: 236076
  Description of Artificial Sequence: Synthetic oligonucleotide

SEQ ID NO: 362941 - DNA, 27 bp, Artificial Sequence
  Description of Artificial Sequence: Synthetic oligonucleotide
accgtccagaggatgtttggctgcgac

SEQ ID NO: 362942 - DNA, 31 bp, Artificial Sequence; identical to SEQ ID NO: 236077
  Description of Artificial Sequence: Synthetic oligonucleotide

SEQ ID NO: 362943 - DNA, 26 bp, Artificial Sequence
  Description of Artificial Sequence: Synthetic oligonucleotide
ccgtccagaggatgtttggctgcgac

SEQ ID NO: 362944 - DNA, 31 bp, Artificial Sequence; identical to SEQ ID NO: 236078
  Description of Artificial Sequence: Synthetic oligonucleotide

SEQ ID NO: 362945 - DNA, 27 bp, Artificial Sequence
  Description of Artificial Sequence: Synthetic oligonucleotide
cgtccagaggatgtttggctgcgacgt

SEQ ID NO: 362946 - DNA, 30 bp, Artificial Sequence; identical to SEQ ID NO: 236079
  Description of Artificial Sequence: Synthetic oligonucleotide

SEQ ID NO: 362947 - DNA, 27 bp, Artificial Sequence
  Description of Artificial Sequence: Synthetic oligonucleotide
gtccagaggatgtttggctgcgacgtg

SEQ ID NO: 362948 - DNA, 30 bp, Artificial Sequence; identical to SEQ ID NO: 236080
  Description of Artificial Sequence: Synthetic oligonucleotide

SEQ ID NO: 362949 - DNA, 27 bp, Artificial Sequence
  Description of Artificial Sequence: Synthetic oligonucleotide
tccagaggatgtttggctgcgacgtgg

SEQ ID NO: 362950 - DNA, 30 bp, Artificial Sequence; identical to SEQ ID NO: 236081
  Description of Artificial Sequence: Synthetic oligonucleotide

SEQ ID NO: 362951 - DNA, 26 bp, Artificial Sequence
  Description of Artificial Sequence: Synthetic oligonucleotide
ccagaggatgtttggctgcgacgtgg

SEQ ID NO: 362952 - DNA, 30 bp, Artificial Sequence; identical to SEQ ID NO: 236082
  Description of Artificial Sequence: Synthetic oligonucleotide

SEQ ID NO: 362953 - DNA, 26 bp, Artificial Sequence
  Description of Artificial Sequence: Synthetic oligonucleotide
cagaggatgtttggctgcgacgtggg

SEQ ID NO: 362954 - DNA, 30 bp, Artificial Sequence; identical to SEQ ID NO: 236083
  Description of Artificial Sequence: Synthetic oligonucleotide

SEQ ID NO: 362955 - DNA, 27 bp, Artificial Sequence
  Description of Artificial Sequence: Synthetic oligonucleotide
agaggatgtttggctgcgacgtggggt

SEQ ID NO: 362956 - DNA, 30 bp, Artificial Sequence; identical to SEQ ID NO: 236084
  Description of Artificial Sequence: Synthetic oligonucleotide

SEQ ID NO: 362957 - DNA, 26 bp, Artificial Sequence
  Description of Artificial Sequence: Synthetic oligonucleotide
gaggatgtttggctgcgacgtggggt

SEQ ID NO: 362958 - DNA, 29 bp, Artificial Sequence
  Description of Artificial Sequence: Synthetic oligonucleotide
ctccacagaattaccatttccagggcggc

SEQ ID NO: 362959 - DNA, 26 bp, Artificial Sequence
  Description of Artificial Sequence: Synthetic oligonucleotide
aggatgtttggctgcgacgtggggtc

SEQ ID NO: 362960 - DNA, 30 bp, Artificial Sequence; identical to SEQ ID NO: 236086
  Description of Artificial Sequence: Synthetic oligonucleotide

SEQ ID NO: 362961 - DNA, 25 bp, Artificial Sequence
  Description of Artificial Sequence: Synthetic oligonucleotide
ggatgtttggctgcgacgtggggtc

SEQ ID NO: 362962 - DNA, 29 bp, Artificial Sequence
  Description of Artificial Sequence: Synthetic oligonucleotide
ccacagaattaccatttccagggcggcag

SEQ ID NO: 362963 - DNA, 25 bp, Artificial Sequence
  Description of Artificial Sequence: Synthetic oligonucleotide
gatgtttggctgcgacgtggggtcg

SEQ ID NO: 362964 - DNA, 29 bp, Artificial Sequence
  Description of Artificial Sequence: Synthetic oligonucleotide
cacagaattaccatttccagggcggcagg

SEQ ID NO: 362965 - DNA, 26 bp, Artificial Sequence
  Description of Artificial Sequence: Synthetic oligonucleotide
atgtttggctgcgacgtggggtcgga

SEQ ID NO: 362966 - DNA, 32 bp, Artificial Sequence; identical to SEQ ID NO: 236089
  Description of Artificial Sequence: Synthetic oligonucleotide

SEQ ID NO: 362967 - DNA, 25 bp, Artificial Sequence
  Description of Artificial Sequence: Synthetic oligonucleotide
tgtttggctgcgacgtggggtcgga

SEQ ID NO: 362968 - DNA, 31 bp, Artificial Sequence; identical to SEQ ID NO: 236090
  Description of Artificial Sequence: Synthetic oligonucleotide

SEQ ID NO: 362969 - DNA, 24 bp, Artificial Sequence
  Description of Artificial Sequence: Synthetic oligonucleotide
gtttggctgcgacgtggggtcgga

SEQ ID NO: 362970 - DNA, 31 bp, Artificial Sequence; identical to SEQ ID NO: 236091
  Description of Artificial Sequence: Synthetic oligonucleotide

SEQ ID NO: 362971 - DNA, 24 bp, Artificial Sequence
  Description of Artificial Sequence: Synthetic oligonucleotide
tttggctgcgacgtggggtcggac

SEQ ID NO: 362972 - DNA, 30 bp, Artificial Sequence; identical to SEQ ID NO: 236092
  Description of Artificial Sequence: Synthetic oligonucleotide

SEQ ID NO: 362973 - DNA, 23 bp, Artificial Sequence
  Description of Artificial Sequence: Synthetic oligonucleotide
ttggctgcgacgtggggtcggac

SEQ ID NO: 362974 - DNA, 32 bp, Artificial Sequence; identical to SEQ ID NO: 236093
  Description of Artificial Sequence: Synthetic oligonucleotide

SEQ ID NO: 362975 - DNA, 22 bp, Artificial Sequence
  Description of Artificial Sequence: Synthetic oligonucleotide
tggctgcgacgtggggtcggac

SEQ ID NO: 362976 - DNA, 31 bp, Artificial Sequence; identical to SEQ ID NO: 236094
  Description of Artificial Sequence: Synthetic oligonucleotide

SEQ ID NO: 362977 - DNA, 21 bp, Artificial Sequence
  Description of Artificial Sequence: Synthetic oligonucleotide
ggctgcgacgtggggtcggac

SEQ ID NO: 362978 - DNA, 30 bp, Artificial Sequence; identical to SEQ ID NO: 236095
  Description of Artificial Sequence: Synthetic oligonucleotide

SEQ ID NO: 362979 - DNA, 21 bp, Artificial Sequence
  Description of Artificial Sequence: Synthetic oligonucleotide
gctgcgacgtggggtcggacg

SEQ ID NO: 362980 - DNA, 29 bp, Artificial Sequence
  Description of Artificial Sequence: Synthetic oligonucleotide
taccatttccagggcggcaggaaagctac

SEQ ID NO: 362981 - DNA, 21 bp, Artificial Sequence
  Description of Artificial Sequence: Synthetic oligonucleotide
ctgcgacgtggggtcggacgg

SEQ ID NO: 362982 - DNA, 28 bp, Artificial Sequence
  Description of Artificial Sequence: Synthetic oligonucleotide
accatttccagggcggcaggaaagctac

SEQ ID NO: 362983 - DNA, 21 bp, Artificial Sequence
  Description of Artificial Sequence: Synthetic oligonucleotide
tgcgacgtggggtcggacggg

SEQ ID NO: 362984 - DNA, 27 bp, Artificial Sequence
  Description of Artificial Sequence: Synthetic oligonucleotide
ccatttccagggcggcaggaaagctac

SEQ ID NO: 362985 - DNA, 20 bp, Artificial Sequence
  Description of Artificial Sequence: Synthetic oligonucleotide
gcgacgtggggtcggacggg

SEQ ID NO: 362986 - DNA, 27 bp, Artificial Sequence
  Description of Artificial Sequence: Synthetic oligonucleotide
catttccagggcggcaggaaagctacg

SEQ ID NO: 362987 - DNA, 20 bp, Artificial Sequence
  Description of Artificial Sequence: Synthetic oligonucleotide
cgacgtggggtcggacgggc

SEQ ID NO: 362988 - DNA, 27 bp, Artificial Sequence
  Description of Artificial Sequence: Synthetic oligonucleotide
atttccagggcggcaggaaagctacgc

SEQ ID NO: 362989 - DNA, 20 bp, Artificial Sequence
  Description of Artificial Sequence: Synthetic oligonucleotide
gacgtggggtcggacgggcg

SEQ ID NO: 362990 - DNA, 26 bp, Artificial Sequence
  Description of Artificial Sequence: Synthetic oligonucleotide
tttccagggcggcaggaaagctacgc

SEQ ID NO: 362991 - DNA, 22 bp, Artificial Sequence
  Description of Artificial Sequence: Synthetic oligonucleotide
acgtggggtcggacgggcgctt

SEQ ID NO: 362992 - DNA, 25 bp, Artificial Sequence
  Description of Artificial Sequence: Synthetic oligonucleotide
ttccagggcggcaggaaagctacgc

SEQ ID NO: 362993 - DNA, 21 bp, Artificial Sequence
  Description of Artificial Sequence: Synthetic oligonucleotide
cgtggggtcggacgggcgctt

SEQ ID NO: 362994 - DNA, 24 bp, Artificial Sequence
  Description of Artificial Sequence: Synthetic oligonucleotide
tccagggcggcaggaaagctacgc

SEQ ID NO: 362995 - DNA, 21 bp, Artificial Sequence
  Description of Artificial Sequence: Synthetic oligonucleotide
gtggggtcggacgggcgcttc

SEQ ID NO: 362996 - DNA, 23 bp, Artificial Sequence
  Description of Artificial Sequence: Synthetic oligonucleotide
ccagggcggcaggaaagctacgc

SEQ ID NO: 362997 - DNA, 22 bp, Artificial Sequence
  Description of Artificial Sequence: Synthetic oligonucleotide
tggggtcggacgggcgcttcct

SEQ ID NO: 362998 - DNA, 27 bp, Artificial Sequence
  Description of Artificial Sequence: Synthetic oligonucleotide
cagggcggcaggaaagctacgcgtata

SEQ ID NO: 362999 - DNA, 21 bp, Artificial Sequence
  Description of Artificial Sequence: Synthetic oligonucleotide
ggggtcggacgggcgcttcct

SEQ ID NO: 363000 - DNA, 29 bp, Artificial Sequence
  Description of Artificial Sequence: Synthetic oligonucleotide
agggcggcaggaaagctacgcgtataatg

SEQ ID NO: 363001 - DNA, 21 bp, Artificial Sequence
  Description of Artificial Sequence: Synthetic oligonucleotide
gggtcggacgggcgcttcctc

SEQ ID NO: 363002 - DNA, 28 bp, Artificial Sequence
  Description of Artificial Sequence: Synthetic oligonucleotide
gggcggcaggaaagctacgcgtataatg

SEQ ID NO: 363003 - DNA, 21 bp, Artificial Sequence
  Description of Artificial Sequence: Synthetic oligonucleotide
ggtcggacgggcgcttcctcc

SEQ ID NO: 363004 - DNA, 28 bp, Artificial Sequence
  Description of Artificial Sequence: Synthetic oligonucleotide
ggcggcaggaaagctacgcgtataatgg

SEQ ID NO: 363005 - DNA, 21 bp, Artificial Sequence
  Description of Artificial Sequence: Synthetic oligonucleotide
gtcggacgggcgcttcctccg

SEQ ID NO: 363006 - DNA, 28 bp, Artificial Sequence
  Description of Artificial Sequence: Synthetic oligonucleotide
gcggcaggaaagctacgcgtataatggg

SEQ ID NO: 363007 - DNA, 21 bp, Artificial Sequence
  Description of Artificial Sequence: Synthetic oligonucleotide
tcggacgggcgcttcctccgc

SEQ ID NO: 363008 - DNA, 29 bp, Artificial Sequence
  Description of Artificial Sequence: Synthetic oligonucleotide
cggcaggaaagctacgcgtataatgggac

SEQ ID NO: 363009 - DNA, 31 bp, Artificial Sequence; identical to SEQ ID NO: 5456
  Description of Artificial Sequence: Synthetic oligonucleotide

SEQ ID NO: 363010 - DNA, 30 bp, Artificial Sequence; identical to SEQ ID NO: 236111
  Description of Artificial Sequence: Synthetic oligonucleotide

SEQ ID NO: 363011 - DNA, 30 bp, Artificial Sequence; identical to SEQ ID NO: 5457
  Description of Artificial Sequence: Synthetic oligonucleotide

SEQ ID NO: 363012 - DNA, 31 bp, Artificial Sequence; identical to SEQ ID NO: 236112
  Description of Artificial Sequence: Synthetic oligonucleotide

SEQ ID NO: 363013 - DNA, 31 bp, Artificial Sequence; identical to SEQ ID NO: 5458
  Description of Artificial Sequence: Synthetic oligonucleotide

SEQ ID NO: 363014 - DNA, 31 bp, Artificial Sequence; identical to SEQ ID NO: 236113
  Description of Artificial Sequence: Synthetic oligonucleotide

SEQ ID NO: 363015 - DNA, 30 bp, Artificial Sequence; identical to SEQ ID NO: 5459
  Description of Artificial Sequence: Synthetic oligonucleotide

SEQ ID NO: 363016 - DNA, 31 bp, Artificial Sequence; identical to SEQ ID NO: 236114
  Description of Artificial Sequence: Synthetic oligonucleotide

SEQ ID NO: 363017 - DNA, 30 bp, Artificial Sequence; identical to SEQ ID NO: 5460
  Description of Artificial Sequence: Synthetic oligonucleotide

SEQ ID NO: 363018 - DNA, 30 bp, Artificial Sequence; identical to SEQ ID NO: 236115
  Description of Artificial Sequence: Synthetic oligonucleotide

SEQ ID NO: 363019 - DNA, 30 bp, Artificial Sequence; identical to SEQ ID NO: 5461
  Description of Artificial Sequence: Synthetic oligonucleotide

SEQ ID NO: 363020 - DNA, 30 bp, Artificial Sequence; identical to SEQ ID NO: 236116
  Description of Artificial Sequence: Synthetic oligonucleotide

SEQ ID NO: 363021 - DNA, 31 bp, Artificial Sequence; identical to SEQ ID NO: 5462
  Description of Artificial Sequence: Synthetic oligonucleotide

SEQ ID NO: 363022 - DNA, 32 bp, Artificial Sequence; identical to SEQ ID NO: 236117
  Description of Artificial Sequence: Synthetic oligonucleotide

SEQ ID NO: 363023 - DNA, 30 bp, Artificial Sequence; identical to SEQ ID NO: 5463
  Description of Artificial Sequence: Synthetic oligonucleotide

SEQ ID NO: 363024 - DNA, 31 bp, Artificial Sequence; identical to SEQ ID NO: 236118
  Description of Artificial Sequence: Synthetic oligonucleotide

SEQ ID NO: 363025 - DNA, 29 bp, Artificial Sequence
  Description of Artificial Sequence: Synthetic oligonucleotide
agtgaaggcccactcacagattgaccgag

SEQ ID NO: 363026 - DNA, 30 bp, Artificial Sequence; identical to SEQ ID NO: 236119
  Description of Artificial Sequence: Synthetic oligonucleotide

SEQ ID NO: 363027 - DNA, 28 bp, Artificial Sequence
  Description of Artificial Sequence: Synthetic oligonucleotide
gtgaaggcccactcacagattgaccgag

SEQ ID NO: 363028 - DNA, 29 bp, Artificial Sequence
  Description of Artificial Sequence: Synthetic oligonucleotide
gctacgcgtataatgggactcagcgcttc

SEQ ID NO: 363029 - DNA, 29 bp, Artificial Sequence
  Description of Artificial Sequence: Synthetic oligonucleotide
tgaaggcccactcacagattgaccgagtg

SEQ ID NO: 363030 - DNA, 29 bp, Artificial Sequence
  Description of Artificial Sequence: Synthetic oligonucleotide
ctacgcgtataatgggactcagcgcttcg

SEQ ID NO: 363031 - DNA, 28 bp, Artificial Sequence
  Description of Artificial Sequence: Synthetic oligonucleotide
gaaggcccactcacagattgaccgagtg

SEQ ID NO: 363032 - DNA, 30 bp, Artificial Sequence; identical to SEQ ID NO: 236122
  Description of Artificial Sequence: Synthetic oligonucleotide

SEQ ID NO: 363033 - DNA, 28 bp, Artificial Sequence
  Description of Artificial Sequence: Synthetic oligonucleotide
aaggcccactcacagattgaccgagtgg

SEQ ID NO: 363034 - DNA, 29 bp, Artificial Sequence
  Description of Artificial Sequence: Synthetic oligonucleotide
acgcgtataatgggactcagcgcttcgtg

SEQ ID NO: 363035 - DNA, 27 bp, Artificial Sequence
  Description of Artificial Sequence: Synthetic oligonucleotide
aggcccactcacagattgaccgagtgg

SEQ ID NO: 363036 - DNA, 28 bp, Artificial Sequence
  Description of Artificial Sequence: Synthetic oligonucleotide
cgcgtataatgggactcagcgcttcgtg

SEQ ID NO: 363037 - DNA, 27 bp, Artificial Sequence
  Description of Artificial Sequence: Synthetic oligonucleotide
ggcccactcacagattgaccgagtgga

SEQ ID NO: 363038 - DNA, 28 bp, Artificial Sequence
  Description of Artificial Sequence: Synthetic oligonucleotide
gcgtataatgggactcagcgcttcgtgg

SEQ ID NO: 363039 - DNA, 27 bp, Artificial Sequence
  Description of Artificial Sequence: Synthetic oligonucleotide
gcccactcacagattgaccgagtggac

SEQ ID NO: 363040 - DNA, 29 bp, Artificial Sequence
  Description of Artificial Sequence: Synthetic oligonucleotide
cgtataatgggactcagcgcttcgtggag

SEQ ID NO: 363041 - DNA, 27 bp, Artificial Sequence
  Description of Artificial Sequence: Synthetic oligonucleotide
cccactcacagattgaccgagtggacc

SEQ ID NO: 363042 - DNA, 30 bp, Artificial Sequence; identical to SEQ ID NO: 236127
  Description of Artificial Sequence: Synthetic oligonucleotide

SEQ ID NO: 363043 - DNA, 28 bp, Artificial Sequence
  Description of Artificial Sequence: Synthetic oligonucleotide
ccactcacagattgaccgagtggacctg

SEQ ID NO: 363044 - DNA, 33 bp, Artificial Sequence; identical to SEQ ID NO: 236128
  Description of Artificial Sequence: Synthetic oligonucleotide

SEQ ID NO: 363045 - DNA, 28 bp, Artificial Sequence
  Description of Artificial Sequence: Synthetic oligonucleotide
cactcacagattgaccgagtggacctgg

SEQ ID NO: 363046 - DNA, 32 bp, Artificial Sequence; identical to SEQ ID NO: 236129
  Description of Artificial Sequence: Synthetic oligonucleotide

SEQ ID NO: 363047 - DNA, 28 bp, Artificial Sequence
  Description of Artificial Sequence: Synthetic oligonucleotide
actcacagattgaccgagtggacctggg

SEQ ID NO: 363048 - DNA, 31 bp, Artificial Sequence; identical to SEQ ID NO: 236130
  Description of Artificial Sequence: Synthetic oligonucleotide

SEQ ID NO: 363049 - DNA, 27 bp, Artificial Sequence
  Description of Artificial Sequence: Synthetic oligonucleotide
ctcacagattgaccgagtggacctggg

SEQ ID NO: 363050 - DNA, 30 bp, Artificial Sequence; identical to SEQ ID NO: 236131
  Description of Artificial Sequence: Synthetic oligonucleotide

SEQ ID NO: 363051 - DNA, 27 bp, Artificial Sequence
  Description of Artificial Sequence: Synthetic oligonucleotide
tcacagattgaccgagtggacctgggg

SEQ ID NO: 363052 - DNA, 29 bp, Artificial Sequence
  Description of Artificial Sequence: Synthetic oligonucleotide
atgggactcagcgcttcgtggagagattc

SEQ ID NO: 363053 - DNA, 27 bp, Artificial Sequence
  Description of Artificial Sequence: Synthetic oligonucleotide
cacagattgaccgagtggacctgggga

SEQ ID NO: 363054 - DNA, 28 bp, Artificial Sequence
  Description of Artificial Sequence: Synthetic oligonucleotide
tgggactcagcgcttcgtggagagattc

SEQ ID NO: 363055 - DNA, 27 bp, Artificial Sequence
  Description of Artificial Sequence: Synthetic oligonucleotide
acagattgaccgagtggacctggggac

SEQ ID NO: 363056 - DNA, 27 bp, Artificial Sequence
  Description of Artificial Sequence: Synthetic oligonucleotide
gggactcagcgcttcgtggagagattc

SEQ ID NO: 363057 - DNA, 26 bp, Artificial Sequence
  Description of Artificial Sequence: Synthetic oligonucleotide
cagattgaccgagtggacctggggac

SEQ ID NO: 363058 - DNA, 29 bp, Artificial Sequence
  Description of Artificial Sequence: Synthetic oligonucleotide
ggactcagcgcttcgtggagagattcatc

SEQ ID NO: 363059 - DNA, 26 bp, Artificial Sequence
  Description of Artificial Sequence: Synthetic oligonucleotide
agattgaccgagtggacctggggacc

SEQ ID NO: 363060 - DNA, 31 bp, Artificial Sequence; identical to SEQ ID NO: 236136
  Description of Artificial Sequence: Synthetic oligonucleotide

SEQ ID NO: 363061 - DNA, 25 bp, Artificial Sequence
  Description of Artificial Sequence: Synthetic oligonucleotide
gattgaccgagtggacctggggacc

SEQ ID NO: 363062 - DNA, 33 bp, Artificial Sequence; identical to SEQ ID NO: 236137
  Description of Artificial Sequence: Synthetic oligonucleotide

SEQ ID NO: 363063 - DNA, 26 bp, Artificial Sequence
  Description of Artificial Sequence: Synthetic oligonucleotide
attgaccgagtggacctggggaccct

SEQ ID NO: 363064 - DNA, 32 bp, Artificial Sequence; identical to SEQ ID NO: 236138
  Description of Artificial Sequence: Synthetic oligonucleotide

SEQ ID NO: 363065 - DNA, 25 bp, Artificial Sequence
  Description of Artificial Sequence: Synthetic oligonucleotide
ttgaccgagtggacctggggaccct

SEQ ID NO: 363066 - DNA, 32 bp, Artificial Sequence; identical to SEQ ID NO: 236139
  Description of Artificial Sequence: Synthetic oligonucleotide

SEQ ID NO: 363067 - DNA, 24 bp, Artificial Sequence
  Description of Artificial Sequence: Synthetic oligonucleotide
tgaccgagtggacctggggaccct

SEQ ID NO: 363068 - DNA, 31 bp, Artificial Sequence; identical to SEQ ID NO: 236140
  Description of Artificial Sequence: Synthetic oligonucleotide

SEQ ID NO: 363069 - DNA, 23 bp, Artificial Sequence
  Description of Artificial Sequence: Synthetic oligonucleotide
gaccgagtggacctggggaccct

SEQ ID NO: 363070 - DNA, 31 bp, Artificial Sequence; identical to SEQ ID NO: 236141
  Description of Artificial Sequence: Synthetic oligonucleotide

SEQ ID NO: 363071 - DNA, 26 bp, Artificial Sequence
  Description of Artificial Sequence: Synthetic oligonucleotide
aggagggtccggagtattgggacgga

SEQ ID NO: 363072 - DNA, 30 bp, Artificial Sequence; identical to SEQ ID NO: 236142
  Description of Artificial Sequence: Synthetic oligonucleotide

SEQ ID NO: 363073 - DNA, 25 bp, Artificial Sequence
  Description of Artificial Sequence: Synthetic oligonucleotide
ggagggtccggagtattgggacgga

SEQ ID NO: 363074 - DNA, 30 bp, Artificial Sequence; identical to SEQ ID NO: 236143
  Description of Artificial Sequence: Synthetic oligonucleotide

SEQ ID NO: 363075 - DNA, 26 bp, Artificial Sequence
  Description of Artificial Sequence: Synthetic oligonucleotide
gagggtccggagtattgggacggaga

SEQ ID NO: 363076 - DNA, 31 bp, Artificial Sequence; identical to SEQ ID NO: 236144
  Description of Artificial Sequence: Synthetic oligonucleotide

SEQ ID NO: 363077 - DNA, 27 bp, Artificial Sequence
  Description of Artificial Sequence: Synthetic oligonucleotide
agggtccggagtattgggacggagaga

SEQ ID NO: 363078 - DNA, 31 bp, Artificial Sequence; identical to SEQ ID NO: 236145
  Description of Artificial Sequence: Synthetic oligonucleotide

SEQ ID NO: 363079 - DNA, 26 bp, Artificial Sequence
  Description of Artificial Sequence: Synthetic oligonucleotide
gggtccggagtattgggacggagaga

SEQ ID NO: 363080 - DNA, 32 bp, Artificial Sequence; identical to SEQ ID NO: 236146
  Description of Artificial Sequence: Synthetic oligonucleotide

SEQ ID NO: 363081 - DNA, 27 bp, Artificial Sequence
  Description of Artificial Sequence: Synthetic oligonucleotide
ggtccggagtattgggacggagagaca

SEQ ID NO: 363082 - DNA, 31 bp, Artificial Sequence; identical to SEQ ID NO: 236147
  Description of Artificial Sequence: Synthetic oligonucleotide

SEQ ID NO: 363083 - DNA, 27 bp, Artificial Sequence
  Description of Artificial Sequence: Synthetic oligonucleotide
gtccggagtattgggacggagagacac

SEQ ID NO: 363084 - DNA, 30 bp, Artificial Sequence; identical to SEQ ID NO: 236148
  Description of Artificial Sequence: Synthetic oligonucleotide

SEQ ID NO: 363085 - DNA, 27 bp, Artificial Sequence
  Description of Artificial Sequence: Synthetic oligonucleotide
tccggagtattgggacggagagacacg

SEQ ID NO: 363086 - DNA, 32 bp, Artificial Sequence; identical to SEQ ID NO: 236149
  Description of Artificial Sequence: Synthetic oligonucleotide

SEQ ID NO: 363087 - DNA, 26 bp, Artificial Sequence
  Description of Artificial Sequence: Synthetic oligonucleotide
ccggagtattgggacggagagacacg

SEQ ID NO: 363088 - DNA, 32 bp, Artificial Sequence; identical to SEQ ID NO: 236150
  Description of Artificial Sequence: Synthetic oligonucleotide

SEQ ID NO: 363089 - DNA, 27 bp, Artificial Sequence
  Description of Artificial Sequence: Synthetic oligonucleotide
cggagtattgggacggagagacacgga

SEQ ID NO: 363090 - DNA, 31 bp, Artificial Sequence; identical to SEQ ID NO: 236151
  Description of Artificial Sequence: Synthetic oligonucleotide

SEQ ID NO: 363091 - DNA, 29 bp, Artificial Sequence
  Description of Artificial Sequence: Synthetic oligonucleotide
ggagtattgggacggagagacacggaaag

SEQ ID NO: 363092 - DNA, 32 bp, Artificial Sequence; identical to SEQ ID NO: 236152
  Description of Artificial Sequence: Synthetic oligonucleotide

SEQ ID NO: 363093 - DNA, 30 bp, Artificial Sequence
  Description of Artificial Sequence: Synthetic oligonucleotide
gagtattgggacggagagacacggaaagtg

SEQ ID NO: 363094 - DNA, 32 bp, Artificial Sequence; identical to SEQ ID NO: 236153
  Description of Artificial Sequence: Synthetic oligonucleotide

SEQ ID NO: 363095 - DNA, 32 bp, Artificial Sequence
  Description of Artificial Sequence: Synthetic oligonucleotide
agtattgggacggagagacacggaaagtgaag

SEQ ID NO: 363096 - DNA, 31 bp, Artificial Sequence; identical to SEQ ID NO: 236154
  Description of Artificial Sequence: Synthetic oligonucleotide

SEQ ID NO: 363097 - DNA, 31 bp, Artificial Sequence
  Description of Artificial Sequence: Synthetic oligonucleotide
gtattgggacggagagacacggaaagtgaag

SEQ ID NO: 363098 - DNA, 31 bp, Artificial Sequence; identical to SEQ ID NO: 236155
  Description of Artificial Sequence: Synthetic oligonucleotide

SEQ ID NO: 363099 - DNA, 31 bp, Artificial Sequence
  Description of Artificial Sequence: Synthetic oligonucleotide
tattgggacggagagacacggaaagtgaagg

SEQ ID NO: 363100 - DNA, 30 bp, Artificial Sequence; identical to SEQ ID NO: 236156
  Description of Artificial Sequence: Synthetic oligonucleotide

SEQ ID NO: 363101 - DNA, 30 bp, Artificial Sequence
  Description of Artificial Sequence: Synthetic oligonucleotide
attgggacggagagacacggaaagtgaagg

SEQ ID NO: 363102 - DNA, 30 bp, Artificial Sequence; identical to SEQ ID NO: 236157
  Description of Artificial Sequence: Synthetic oligonucleotide

SEQ ID NO: 363103 - DNA, 29 bp, Artificial Sequence
  Description of Artificial Sequence: Synthetic oligonucleotide
ttgggacggagagacacggaaagtgaagg

SEQ ID NO: 363104 - DNA, 29 bp, Artificial Sequence
  Description of Artificial Sequence: Synthetic oligonucleotide
ttcatctacaacgggaggacttcgtgcgc

SEQ ID NO: 363105 - DNA, 28 bp, Artificial Sequence
  Description of Artificial Sequence: Synthetic oligonucleotide
tgggacggagagacacggaaagtgaagg

SEQ ID NO: 363106 - DNA, 28 bp, Artificial Sequence
  Description of Artificial Sequence: Synthetic oligonucleotide
tcatctacaacgggaggacttcgtgcgc

SEQ ID NO: 363107 - DNA, 27 bp, Artificial Sequence
  Description of Artificial Sequence: Synthetic oligonucleotide
gggacggagagacacggaaagtgaagg

SEQ ID NO: 363108 - DNA, 27 bp, Artificial Sequence
  Description of Artificial Sequence: Synthetic oligonucleotide
catctacaacgggaggacttcgtgcgc

SEQ ID NO: 363109 - DNA, 27 bp, Artificial Sequence
  Description of Artificial Sequence: Synthetic oligonucleotide
ggacggagagacacggaaagtgaaggc

SEQ ID NO: 363110 - DNA, 29 bp, Artificial Sequence
  Description of Artificial Sequence: Synthetic oligonucleotide
atctacaacgggaggacttcgtgcgctac

SEQ ID NO: 363111 - DNA, 27 bp, Artificial Sequence
  Description of Artificial Sequence: Synthetic oligonucleotide
gacggagagacacggaaagtgaaggcc

SEQ ID NO: 363112 - DNA, 28 bp, Artificial Sequence
  Description of Artificial Sequence: Synthetic oligonucleotide
tctacaacgggaggacttcgtgcgctac

SEQ ID NO: 363113 - DNA, 27 bp, Artificial Sequence
  Description of Artificial Sequence: Synthetic oligonucleotide
acggagagacacggaaagtgaaggccc

SEQ ID NO: 363114 - DNA, 27 bp, Artificial Sequence
  Description of Artificial Sequence: Synthetic oligonucleotide
ctacaacgggaggacttcgtgcgctac

SEQ ID NO: 363115 - DNA, 27 bp, Artificial Sequence
  Description of Artificial Sequence: Synthetic oligonucleotide
cggagagacacggaaagtgaaggccca

SEQ ID NO: 363116 - DNA, 27 bp, Artificial Sequence
  Description of Artificial Sequence: Synthetic oligonucleotide
tacaacgggaggacttcgtgcgctacg

SEQ ID NO: 363117 - DNA, 27 bp, Artificial Sequence
  Description of Artificial Sequence: Synthetic oligonucleotide
ggagagacacggaaagtgaaggcccac

SEQ ID NO: 363118 - DNA, 27 bp, Artificial Sequence
  Description of Artificial Sequence: Synthetic oligonucleotide
acaacgggaggacttcgtgcgctacga

SEQ ID NO: 363119 - DNA, 28 bp, Artificial Sequence
  Description of Artificial Sequence: Synthetic oligonucleotide
gagagacacggaaagtgaaggcccactc

SEQ ID NO: 363120 - DNA, 26 bp, Artificial Sequence
  Description of Artificial Sequence: Synthetic oligonucleotide
caacgggaggacttcgtgcgctacga

SEQ ID NO: 363121 - DNA, 29 bp, Artificial Sequence
  Description of Artificial Sequence: Synthetic oligonucleotide
agagacacggaaagtgaaggcccactcac

SEQ ID NO: 363122 - DNA, 27 bp, Artificial Sequence
  Description of Artificial Sequence: Synthetic oligonucleotide
aacgggaggacttcgtgcgctacgaca

SEQ ID NO: 363123 - DNA, 22 bp, Artificial Sequence
  Description of Artificial Sequence: Synthetic oligonucleotide
cggcccatgtggcggagcagca

SEQ ID NO: 363124 - DNA, 26 bp, Artificial Sequence
  Description of Artificial Sequence: Synthetic oligonucleotide
acgggaggacttcgtgcgctacgaca

SEQ ID NO: 363125 - DNA, 23 bp, Artificial Sequence
  Description of Artificial Sequence: Synthetic oligonucleotide
ggcccatgtggcggagcagcaga

SEQ ID NO: 363126 - DNA, 25 bp, Artificial Sequence
  Description of Artificial Sequence: Synthetic oligonucleotide
cgggaggacttcgtgcgctacgaca

SEQ ID NO: 363127 - DNA, 24 bp, Artificial Sequence
  Description of Artificial Sequence: Synthetic oligonucleotide
gcccatgtggcggagcagcagaga

SEQ ID NO: 363128 - DNA, 25 bp, Artificial Sequence
  Description of Artificial Sequence: Synthetic oligonucleotide
gggaggacttcgtgcgctacgacag

SEQ ID NO: 363129 - DNA, 24 bp, Artificial Sequence
  Description of Artificial Sequence: Synthetic oligonucleotide
cccatgtggcggagcagcagagag

SEQ ID NO: 363130 - DNA, 25 bp, Artificial Sequence
  Description of Artificial Sequence: Synthetic oligonucleotide
ggaggacttcgtgcgctacgacagc

SEQ ID NO: 363131 - DNA, 24 bp, Artificial Sequence
  Description of Artificial Sequence: Synthetic oligonucleotide
ccatgtggcggagcagcagagagc

SEQ ID NO: 363132 - DNA, 26 bp, Artificial Sequence
  Description of Artificial Sequence: Synthetic oligonucleotide
gaggacttcgtgcgctacgacagcga

SEQ ID NO: 363133 - DNA, 26 bp, Artificial Sequence
  Description of Artificial Sequence: Synthetic oligonucleotide
catgtggcggagcagcagagagccta

SEQ ID NO: 363134 - DNA, 26 bp, Artificial Sequence
  Description of Artificial Sequence: Synthetic oligonucleotide
aggacttcgtgcgctacgacagcgag

SEQ ID NO: 363135 - DNA, 26 bp, Artificial Sequence
  Description of Artificial Sequence: Synthetic oligonucleotide
atgtggcggagcagcagagagcctac

SEQ ID NO: 363136 - DNA, 25 bp, Artificial Sequence
  Description of Artificial Sequence: Synthetic oligonucleotide
ggacttcgtgcgctacgacagcgag

SEQ ID NO: 363137 - DNA, 25 bp, Artificial Sequence
  Description of Artificial Sequence: Synthetic oligonucleotide
tgtggcggagcagcagagagcctac

SEQ ID NO: 363138 - DNA, 26 bp, Artificial Sequence
  Description of Artificial Sequence: Synthetic oligonucleotide
gacttcgtgcgctacgacagcgaggt

SEQ ID NO: 363139 - DNA, 24 bp, Artificial Sequence
  Description of Artificial Sequence: Synthetic oligonucleotide
gtggcggagcagcagagagcctac

SEQ ID NO: 363140 - DNA, 26 bp, Artificial Sequence
  Description of Artificial Sequence: Synthetic oligonucleotide
acttcgtgcgctacgacagcgaggtg

SEQ ID NO: 363141 - DNA, 25 bp, Artificial Sequence
  Description of Artificial Sequence: Synthetic oligonucleotide
tggcggagcagcagagagcctacct

SEQ ID NO: 363142 - DNA, 25 bp, Artificial Sequence
  Description of Artificial Sequence: Synthetic oligonucleotide
cttcgtgcgctacgacagcgaggtg

SEQ ID NO: 363143 - DNA, 24 bp, Artificial Sequence
  Description of Artificial Sequence: Synthetic oligonucleotide
ggcggagcagcagagagcctacct

SEQ ID NO: 363144 - DNA, 25 bp, Artificial Sequence
  Description of Artificial Sequence: Synthetic oligonucleotide
ttcgtgcgctacgacagcgaggtgg

SEQ ID NO: 363145 - DNA, 24 bp, Artificial Sequence
  Description of Artificial Sequence: Synthetic oligonucleotide
gcggagcagcagagagcctacctg

SEQ ID NO: 363146 - DNA, 24 bp, Artificial Sequence
  Description of Artificial Sequence: Synthetic oligonucleotide
tcgtgcgctacgacagcgaggtgg

SEQ ID NO: 363147 - DNA, 25 bp, Artificial Sequence
  Description of Artificial Sequence: Synthetic oligonucleotide
cggagcagcagagagcctacctgga

SEQ ID NO: 363148 - DNA, 23 bp, Artificial Sequence
  Description of Artificial Sequence: Synthetic oligonucleotide
cgtgcgctacgacagcgaggtgg

SEQ ID NO: 363149 - DNA, 25 bp, Artificial Sequence
  Description of Artificial Sequence: Synthetic oligonucleotide
ggagcagcagagagcctacctggag

SEQ ID NO: 363150 - DNA, 23 bp, Artificial Sequence
  Description of Artificial Sequence: Synthetic oligonucleotide
gtgcgctacgacagcgaggtggg

SEQ ID NO: 363151 - DNA, 25 bp, Artificial Sequence
  Description of Artificial Sequence: Synthetic oligonucleotide
gagcagcagagagcctacctggagg

SEQ ID NO: 363152 - DNA, 23 bp, Artificial Sequence
  Description of Artificial Sequence: Synthetic oligonucleotide
tgcgctacgacagcgaggtgggg

SEQ ID NO: 363153 - DNA, 25 bp, Artificial Sequence
  Description of Artificial Sequence: Synthetic oligonucleotide
agcagcagagagcctacctggaggg

SEQ ID NO: 363154 - DNA, 22 bp, Artificial Sequence
  Description of Artificial Sequence: Synthetic oligonucleotide
gcgctacgacagcgaggtgggg

SEQ ID NO: 363155 - DNA, 24 bp, Artificial Sequence
  Description of Artificial Sequence: Synthetic oligonucleotide
gcagcagagagcctacctggaggg

SEQ ID NO: 363156 - DNA, 23 bp, Artificial Sequence
  Description of Artificial Sequence: Synthetic oligonucleotide
cgctacgacagcgaggtggggga

SEQ ID NO: 363157 - DNA, 25 bp, Artificial Sequence
  Description of Artificial Sequence: Synthetic oligonucleotide
cagcagagagcctacctggagggca

SEQ ID NO: 363158 - DNA, 25 bp, Artificial Sequence
  Description of Artificial Sequence: Synthetic oligonucleotide
gctacgacagcgaggtgggggagat

SEQ ID NO: 363159 - DNA, 25 bp, Artificial Sequence
  Description of Artificial Sequence: Synthetic oligonucleotide
agcagagagcctacctggagggcac

SEQ ID NO: 363160 - DNA, 25 bp, Artificial Sequence
  Description of Artificial Sequence: Synthetic oligonucleotide
ctacgacagcgaggtgggggagatc

SEQ ID NO: 363161 - DNA, 24 bp, Artificial Sequence
  Description of Artificial Sequence: Synthetic oligonucleotide
gcagagagcctacctggagggcac

SEQ ID NO: 363162 - DNA, 25 bp, Artificial Sequence
  Description of Artificial Sequence: Synthetic oligonucleotide
tacgacagcgaggtgggggagatcc

SEQ ID NO: 363163 - DNA, 25 bp, Artificial Sequence
  Description of Artificial Sequence: Synthetic oligonucleotide
cagagagcctacctggagggcacgt

SEQ ID NO: 363164 - DNA, 24 bp, Artificial Sequence
  Description of Artificial Sequence: Synthetic oligonucleotide
acgacagcgaggtgggggagatcc

SEQ ID NO: 363165 - DNA, 25 bp, Artificial Sequence
  Description of Artificial Sequence: Synthetic oligonucleotide
agagagcctacctggagggcacgtg

SEQ ID NO: 363166 - DNA, 23 bp, Artificial Sequence
  Description of Artificial Sequence: Synthetic oligonucleotide
cgacagcgaggtgggggagatcc

SEQ ID NO: 363167 - DNA, 26 bp, Artificial Sequence
  Description of Artificial Sequence: Synthetic oligonucleotide
aagcacaagtgggaggcggcccatga

SEQ ID NO: 363168 - DNA, 23 bp, Artificial Sequence
  Description of Artificial Sequence: Synthetic oligonucleotide
gacagcgaggtgggggagatccg

SEQ ID NO: 363169 - DNA, 25 bp, Artificial Sequence
  Description of Artificial Sequence: Synthetic oligonucleotide
agcacaagtgggaggcggcccatga

SEQ ID NO: 363170 - DNA, 23 bp, Artificial Sequence
  Description of Artificial Sequence: Synthetic oligonucleotide
acagcgaggtgggggagatccgg

SEQ ID NO: 363171 - DNA, 24 bp, Artificial Sequence
  Description of Artificial Sequence: Synthetic oligonucleotide
gcacaagtgggaggcggcccatga

SEQ ID NO: 363172 - DNA, 22 bp, Artificial Sequence
  Description of Artificial Sequence: Synthetic oligonucleotide
cagcgaggtgggggagatccgg

SEQ ID NO: 363173 - DNA, 24 bp, Artificial Sequence
  Description of Artificial Sequence: Synthetic oligonucleotide
cacaagtgggaggcggcccatgag

SEQ ID NO: 363174 - DNA, 22 bp, Artificial Sequence
  Description of Artificial Sequence: Synthetic oligonucleotide
agcgaggtgggggagatccggg

SEQ ID NO: 363175 - DNA, 24 bp, Artificial Sequence
  Description of Artificial Sequence: Synthetic oligonucleotide
acaagtgggaggcggcccatgagg

SEQ ID NO: 363176 - DNA, 21 bp, Artificial Sequence
  Description of Artificial Sequence: Synthetic oligonucleotide
gcgaggtgggggagatccggg

SEQ ID NO: 363177 - DNA, 23 bp, Artificial Sequence
  Description of Artificial Sequence: Synthetic oligonucleotide
caagtgggaggcggcccatgagg

SEQ ID NO: 363178 - DNA, 21 bp, Artificial Sequence
  Description of Artificial Sequence: Synthetic oligonucleotide
cgaggtgggggagatccgggc

SEQ ID NO: 363179 - DNA, 23 bp, Artificial Sequence
  Description of Artificial Sequence: Synthetic oligonucleotide
aagtgggaggcggcccatgaggc

SEQ ID NO: 363180 - DNA, 21 bp, Artificial Sequence
  Description of Artificial Sequence: Synthetic oligonucleotide
gaggtgggggagatccgggcg

SEQ ID NO: 363181 - DNA, 22 bp, Artificial Sequence
  Description of Artificial Sequence: Synthetic oligonucleotide
agtgggaggcggcccatgaggc

SEQ ID NO: 363182 - DNA, 22 bp, Artificial Sequence
  Description of Artificial Sequence: Synthetic oligonucleotide
aggtgggggagatccgggcgga

SEQ ID NO: 363183 - DNA, 21 bp, Artificial Sequence
  Description of Artificial Sequence: Synthetic oligonucleotide
gtgggaggcggcccatgaggc

SEQ ID NO: 363184 - DNA, 21 bp, Artificial Sequence
  Description of Artificial Sequence: Synthetic oligonucleotide
ggtgggggagatccgggcgga

SEQ ID NO: 363185 - DNA, 21 bp, Artificial Sequence
  Description of Artificial Sequence: Synthetic oligonucleotide
tgggaggcggcccatgaggcg

SEQ ID NO: 363186 - DNA, 22 bp, Artificial Sequence
  Description of Artificial Sequence: Synthetic oligonucleotide
gtgggggagatccgggcggaga

SEQ ID NO: 363187 - DNA, 20 bp, Artificial Sequence
  Description of Artificial Sequence: Synthetic oligonucleotide
gggaggcggcccatgaggcg

SEQ ID NO: 363188 - DNA, 22 bp, Artificial Sequence
  Description of Artificial Sequence: Synthetic oligonucleotide
tgggggagatccgggcggagac

SEQ ID NO: 363189 - DNA, 21 bp, Artificial Sequence
  Description of Artificial Sequence: Synthetic oligonucleotide
ggaggcggcccatgaggcgga

SEQ ID NO: 363190 - DNA, 21 bp, Artificial Sequence
  Description of Artificial Sequence: Synthetic oligonucleotide
gggggagatccgggcggagac

SEQ ID NO: 363191 - DNA, 21 bp, Artificial Sequence
  Description of Artificial Sequence: Synthetic oligonucleotide
gaggcggcccatgaggcggag

SEQ ID NO: 363192 - DNA, 21 bp, Artificial Sequence
  Description of Artificial Sequence: Synthetic oligonucleotide
ggggagatccgggcggagacg

SEQ ID NO: 363193 - DNA, 22 bp, Artificial Sequence
  Description of Artificial Sequence: Synthetic oligonucleotide
aggcggcccatgaggcggagca

SEQ ID NO: 363194 - DNA, 22 bp, Artificial Sequence
  Description of Artificial Sequence: Synthetic oligonucleotide
gggagatccgggcggagacgga

SEQ ID NO: 363195 - DNA, 21 bp, Artificial Sequence
  Description of Artificial Sequence: Synthetic oligonucleotide
ggcggcccatgaggcggagca

SEQ ID NO: 363196 - DNA, 22 bp, Artificial Sequence
  Description of Artificial Sequence: Synthetic oligonucleotide
ggagatccgggcggagacggag

SEQ ID NO: 363197 - DNA, 21 bp, Artificial Sequence
  Description of Artificial Sequence: Synthetic oligonucleotide
gcggcccatgaggcggagcag

SEQ ID NO: 363198 - DNA, 23 bp, Artificial Sequence
  Description of Artificial Sequence: Synthetic oligonucleotide
gagatccgggcggagacggagct

SEQ ID NO: 363199 - DNA, 22 bp, Artificial Sequence
  Description of Artificial Sequence: Synthetic oligonucleotide
cggcccatgaggcggagcagca

SEQ ID NO: 363200 - DNA, 23 bp, Artificial Sequence
  Description of Artificial Sequence: Synthetic oligonucleotide
agatccgggcggagacggagctg

SEQ ID NO: 363201 - DNA, 23 bp, Artificial Sequence
  Description of Artificial Sequence: Synthetic oligonucleotide
ggcccatgaggcggagcagcaga

SEQ ID NO: 363202 - DNA, 22 bp, Artificial Sequence
  Description of Artificial Sequence: Synthetic oligonucleotide
gatccgggcggagacggagctg

SEQ ID NO: 363203 - DNA, 24 bp, Artificial Sequence
  Description of Artificial Sequence: Synthetic oligonucleotide
gcccatgaggcggagcagcagaga

SEQ ID NO: 363204 - DNA, 22 bp, Artificial Sequence
  Description of Artificial Sequence: Synthetic oligonucleotide
atccgggcggagacggagctgg

SEQ ID NO: 363205 - DNA, 24 bp, Artificial Sequence
  Description of Artificial Sequence: Synthetic oligonucleotide
cccatgaggcggagcagcagagag

SEQ ID NO: 363206 - DNA, 21 bp, Artificial Sequence
  Description of Artificial Sequence: Synthetic oligonucleotide
tccgggcggagacggagctgg

SEQ ID NO: 363207 - DNA, 24 bp, Artificial Sequence
  Description of Artificial Sequence: Synthetic oligonucleotide
ccatgaggcggagcagcagagagc

SEQ ID NO: 363208 - DNA, 20 bp, Artificial Sequence
  Description of Artificial Sequence: Synthetic oligonucleotide
ccgggcggagacggagctgg

SEQ ID NO: 363209 - DNA, 26 bp, Artificial Sequence
  Description of Artificial Sequence: Synthetic oligonucleotide
catgaggcggagcagcagagagccta

SEQ ID NO: 363210 - DNA, 20 bp, Artificial Sequence
  Description of Artificial Sequence: Synthetic oligonucleotide
cgggcggagacggagctggg

SEQ ID NO: 363211 - DNA, 26 bp, Artificial Sequence
  Description of Artificial Sequence: Synthetic oligonucleotide
atgaggcggagcagcagagagcctac

SEQ ID NO: 363212 - DNA, 20 bp, Artificial Sequence
  Description of Artificial Sequence: Synthetic oligonucleotide
gggcggagacggagctgggc

SEQ ID NO: 363213 - DNA, 25 bp, Artificial Sequence
  Description of Artificial Sequence: Synthetic oligonucleotide
tgaggcggagcagcagagagcctac

SEQ ID NO: 363214 - DNA, 20 bp, Artificial Sequence
  Description of Artificial Sequence: Synthetic oligonucleotide
ggcggagacggagctgggcg

SEQ ID NO: 363215 - DNA, 24 bp, Artificial Sequence
  Description of Artificial Sequence: Synthetic oligonucleotide
gaggcggagcagcagagagcctac

SEQ ID NO: 363216 - DNA, 20 bp, Artificial Sequence
  Description of Artificial Sequence: Synthetic oligonucleotide
gcggagacggagctgggcgg

SEQ ID NO: 363217 - DNA, 25 bp, Artificial Sequence
  Description of Artificial Sequence: Synthetic oligonucleotide
aggcggagcagcagagagcctacct

SEQ ID NO: 363218 - DNA, 20 bp, Artificial Sequence
  Description of Artificial Sequence: Synthetic oligonucleotide
cggagacggagctgggcggc

SEQ ID NO: 363219 - DNA, 26 bp, Artificial Sequence
  Description of Artificial Sequence: Synthetic oligonucleotide
agcagttgagagcctacctggagggc

SEQ ID NO: 363220 - DNA, 21 bp, Artificial Sequence
  Description of Artificial Sequence: Synthetic oligonucleotide
ggagacggagctgggcggcct

SEQ ID NO: 363221 - DNA, 25 bp, Artificial Sequence
  Description of Artificial Sequence: Synthetic oligonucleotide
gcagttgagagcctacctggagggc

SEQ ID NO: 363222 - DNA, 22 bp, Artificial Sequence
  Description of Artificial Sequence: Synthetic oligonucleotide
gagacggagctgggcggcctca

SEQ ID NO: 363223 - DNA, 26 bp, Artificial Sequence
  Description of Artificial Sequence: Synthetic oligonucleotide
cagttgagagcctacctggagggcga

SEQ ID NO: 363224 - DNA, 22 bp, Artificial Sequence
  Description of Artificial Sequence: Synthetic oligonucleotide
agacggagctgggcggcctcag

SEQ ID NO: 363225 - DNA, 27 bp, Artificial Sequence
  Description of Artificial Sequence: Synthetic oligonucleotide
agttgagagcctacctggagggcgagt

SEQ ID NO: 363226 - DNA, 21 bp, Artificial Sequence
  Description of Artificial Sequence: Synthetic oligonucleotide
gacggagctgggcggcctcag

SEQ ID NO: 363227 - DNA, 26 bp, Artificial Sequence
  Description of Artificial Sequence: Synthetic oligonucleotide
gttgagagcctacctggagggcgagt

SEQ ID NO: 363228 - DNA, 21 bp, Artificial Sequence
  Description of Artificial Sequence: Synthetic oligonucleotide
acggagctgggcggcctcagg

SEQ ID NO: 363229 - DNA, 26 bp, Artificial Sequence
  Description of Artificial Sequence: Synthetic oligonucleotide
ttgagagcctacctggagggcgagtg

SEQ ID NO: 363230 - DNA, 20 bp, Artificial Sequence
  Description of Artificial Sequence: Synthetic oligonucleotide
cggagctgggcggcctcagg

SEQ ID NO: 363231 - DNA, 25 bp, Artificial Sequence
  Description of Artificial Sequence: Synthetic oligonucleotide
tgagagcctacctggagggcgagtg

SEQ ID NO: 363232 - DNA, 20 bp, Artificial Sequence
  Description of Artificial Sequence: Synthetic oligonucleotide
ggagctgggcggcctcaggc

SEQ ID NO: 363233 - DNA, 24 bp, Artificial Sequence
  Description of Artificial Sequence: Synthetic oligonucleotide
gagagcctacctggagggcgagtg

SEQ ID NO: 363234 - DNA, 20 bp, Artificial Sequence
  Description of Artificial Sequence: Synthetic oligonucleotide
gagctgggcggcctcaggcg

SEQ ID NO: 363235 - DNA, 24 bp, Artificial Sequence
  Description of Artificial Sequence: Synthetic oligonucleotide
agagcctacctggagggcgagtgc

SEQ ID NO: 363236 - DNA, 21 bp, Artificial Sequence
  Description of Artificial Sequence: Synthetic oligonucleotide
agctgggcggcctcaggcgga

SEQ ID NO: 363237 - DNA, 23 bp, Artificial Sequence
  Description of Artificial Sequence: Synthetic oligonucleotide
gagcctacctggagggcgagtgc

SEQ ID NO: 363238 - DNA, 20 bp, Artificial Sequence
  Description of Artificial Sequence: Synthetic oligonucleotide
gctgggcggcctcaggcgga

SEQ ID NO: 363239 - DNA, 24 bp, Artificial Sequence
  Description of Artificial Sequence: Synthetic oligonucleotide
agcctacctggagggcgagtgcgt

SEQ ID NO: 363240 - DNA, 22 bp, Artificial Sequence
  Description of Artificial Sequence: Synthetic oligonucleotide
ctgggcggcctcaggcggagtt

SEQ ID NO: 363241 - DNA, 23 bp, Artificial Sequence
  Description of Artificial Sequence: Synthetic oligonucleotide
gcctacctggagggcgagtgcgt

SEQ ID NO: 363242 - DNA, 23 bp, Artificial Sequence
  Description of Artificial Sequence: Synthetic oligonucleotide
tgggcggcctcaggcggagttct

SEQ ID NO: 363243 - DNA, 23 bp, Artificial Sequence
  Description of Artificial Sequence: Synthetic oligonucleotide
cctacctggagggcgagtgcgtg

SEQ ID NO: 363244 - DNA, 22 bp, Artificial Sequence
  Description of Artificial Sequence: Synthetic oligonucleotide
gggcggcctcaggcggagttct

SEQ ID NO: 363245 - DNA, 24 bp, Artificial Sequence
  Description of Artificial Sequence: Synthetic oligonucleotide
ctacctggagggcgagtgcgtgga

SEQ ID NO: 363246 - DNA, 22 bp, Artificial Sequence
  Description of Artificial Sequence: Synthetic oligonucleotide
ggcggcctcaggcggagttctg

SEQ ID NO: 363247 - DNA, 25 bp, Artificial Sequence
  Description of Artificial Sequence: Synthetic oligonucleotide
tacctggagggcgagtgcgtggagt

SEQ ID NO: 363248 - DNA, 24 bp, Artificial Sequence
  Description of Artificial Sequence: Synthetic oligonucleotide
gcggcctcaggcggagttctggaa

SEQ ID NO: 363249 - DNA, 24 bp, Artificial Sequence
  Description of Artificial Sequence: Synthetic oligonucleotide
acctggagggcgagtgcgtggagt

SEQ ID NO: 363250 - DNA, 25 bp, Artificial Sequence
  Description of Artificial Sequence: Synthetic oligonucleotide
cggcctcaggcggagttctggaaca

SEQ ID NO: 363251 - DNA, 23 bp, Artificial Sequence
  Description of Artificial Sequence: Synthetic oligonucleotide
cctggagggcgagtgcgtggagt

SEQ ID NO: 363252 - DNA, 25 bp, Artificial Sequence
  Description of Artificial Sequence: Synthetic oligonucleotide
ggcctcaggcggagttctggaacag

SEQ ID NO: 363253 - DNA, 23 bp, Artificial Sequence
  Description of Artificial Sequence: Synthetic oligonucleotide
ctggagggcgagtgcgtggagtg

SEQ ID NO: 363254 - DNA, 25 bp, Artificial Sequence
  Description of Artificial Sequence: Synthetic oligonucleotide
gcctcaggcggagttctggaacagg

SEQ ID NO: 363255 - DNA, 23 bp, Artificial Sequence
  Description of Artificial Sequence: Synthetic oligonucleotide
tggagggcgagtgcgtggagtgg

SEQ ID NO: 363256 - DNA, 26 bp, Artificial Sequence
  Description of Artificial Sequence: Synthetic oligonucleotide
cctcaggcggagttctggaacaggca

SEQ ID NO: 363257 - DNA, 22 bp, Artificial Sequence
  Description of Artificial Sequence: Synthetic oligonucleotide
ggagggcgagtgcgtggagtgg

SEQ ID NO: 363258 - DNA, 27 bp, Artificial Sequence
  Description of Artificial Sequence: Synthetic oligonucleotide
ctcaggcggagttctggaacaggcaga

SEQ ID NO: 363259 - DNA, 23 bp, Artificial Sequence
  Description of Artificial Sequence: Synthetic oligonucleotide
gagggcgagtgcgtggagtggct

SEQ ID NO: 363260 - DNA, 28 bp, Artificial Sequence
  Description of Artificial Sequence: Synthetic oligonucleotide
tcaggcggagttctggaacaggcagaag

SEQ ID NO: 363261 - DNA, 23 bp, Artificial Sequence
  Description of Artificial Sequence: Synthetic oligonucleotide
agggcgagtgcgtggagtggctc

SEQ ID NO: 363262 - DNA, 27 bp, Artificial Sequence
  Description of Artificial Sequence: Synthetic oligonucleotide
caggcggagttctggaacaggcagaag

SEQ ID NO: 363263 - DNA, 22 bp, Artificial Sequence
  Description of Artificial Sequence: Synthetic oligonucleotide
gggcgagtgcgtggagtggctc

SEQ ID NO: 363264 - DNA, 27 bp, Artificial Sequence
  Description of Artificial Sequence: Synthetic oligonucleotide
aggcggagttctggaacaggcagaagg

SEQ ID NO: 363265 - DNA, 22 bp, Artificial Sequence
  Description of Artificial Sequence: Synthetic oligonucleotide
ggcgagtgcgtggagtggctcc

SEQ ID NO: 363266 - DNA, 27 bp, Artificial Sequence
  Description of Artificial Sequence: Synthetic oligonucleotide
ggcggagttctggaacaggcagaagga

SEQ ID NO: 363267 - DNA, 22 bp, Artificial Sequence
  Description of Artificial Sequence: Synthetic oligonucleotide
gcgagtgcgtggagtggctccg

SEQ ID NO: 363268 - DNA, 27 bp, Artificial Sequence
  Description of Artificial Sequence: Synthetic oligonucleotide
gcggagttctggaacaggcagaaggag

SEQ ID NO: 363269 - DNA, 23 bp, Artificial Sequence
  Description of Artificial Sequence: Synthetic oligonucleotide
cgagtgcgtggagtggctccgca

SEQ ID NO: 363270 - DNA, 29 bp, Artificial Sequence
  Description of Artificial Sequence: Synthetic oligonucleotide
cggagttctggaacaggcagaaggagatc

SEQ ID NO: 363271 - DNA, 26 bp, Artificial Sequence
  Description of Artificial Sequence: Synthetic oligonucleotide
gagtgcgtggagtggctccgcagata

SEQ ID NO: 363272 - DNA, 29 bp, Artificial Sequence
  Description of Artificial Sequence: Synthetic oligonucleotide
ggagttctggaacaggcagaaggagatcc

SEQ ID NO: 363273 - DNA, 26 bp, Artificial Sequence
  Description of Artificial Sequence: Synthetic oligonucleotide
agtgcgtggagtggctccgcagatac

SEQ ID NO: 363274 - DNA, 30 bp, Artificial Sequence; identical to SEQ ID NO: 236243
  Description of Artificial Sequence: Synthetic oligonucleotide

SEQ ID NO: 363275 - DNA, 24 bp, Artificial Sequence
  Description of Artificial Sequence: Synthetic oligonucleotide
atggccgtcatggctccccgaacc

SEQ ID NO: 363276 - DNA, 30 bp, Artificial Sequence; identical to SEQ ID NO: 236244
  Description of Artificial Sequence: Synthetic oligonucleotide

SEQ ID NO: 363277 - DNA, 23 bp, Artificial Sequence
  Description of Artificial Sequence: Synthetic oligonucleotide
tggccgtcatggctccccgaacc

SEQ ID NO: 363278 - DNA, 29 bp, Artificial Sequence
  Description of Artificial Sequence: Synthetic oligonucleotide
gttctggaacaggcagaaggagatcctgg

SEQ ID NO: 363279 - DNA, 22 bp, Artificial Sequence
  Description of Artificial Sequence: Synthetic oligonucleotide
ggccgtcatggctccccgaacc

SEQ ID NO: 363280 - DNA, 30 bp, Artificial Sequence; identical to SEQ ID NO: 236246
  Description of Artificial Sequence: Synthetic oligonucleotide

SEQ ID NO: 363281 - DNA, 23 bp, Artificial Sequence
  Description of Artificial Sequence: Synthetic oligonucleotide
gccgtcatggctccccgaaccct

SEQ ID NO: 363282 - DNA, 29 bp, Artificial Sequence
  Description of Artificial Sequence: Synthetic oligonucleotide
tctggaacaggcagaaggagatcctggag

SEQ ID NO: 363283 - DNA, 23 bp, Artificial Sequence
  Description of Artificial Sequence: Synthetic oligonucleotide
ccgtcatggctccccgaaccctc

SEQ ID NO: 363284 - DNA, 28 bp, Artificial Sequence
  Description of Artificial Sequence: Synthetic oligonucleotide
ctggaacaggcagaaggagatcctggag

SEQ ID NO: 363285 - DNA, 24 bp, Artificial Sequence
  Description of Artificial Sequence: Synthetic oligonucleotide
cgtcatggctccccgaaccctcgt

SEQ ID NO: 363286 - DNA, 28 bp, Artificial Sequence
  Description of Artificial Sequence: Synthetic oligonucleotide
tggaacaggcagaaggagatcctggagg

SEQ ID NO: 363287 - DNA, 24 bp, Artificial Sequence
  Description of Artificial Sequence: Synthetic oligonucleotide
gtcatggctccccgaaccctcgtc

SEQ ID NO: 363288 - DNA, 27 bp, Artificial Sequence
  Description of Artificial Sequence: Synthetic oligonucleotide
ggaacaggcagaaggagatcctggagg

SEQ ID NO: 363289 - DNA, 25 bp, Artificial Sequence
  Description of Artificial Sequence: Synthetic oligonucleotide
tcatggctccccgaaccctcgtcct

SEQ ID NO: 363290 - DNA, 28 bp, Artificial Sequence
  Description of Artificial Sequence: Synthetic oligonucleotide
gaacaggcagaaggagatcctggaggtg

SEQ ID NO: 363291 - DNA, 24 bp, Artificial Sequence
  Description of Artificial Sequence: Synthetic oligonucleotide
catggctccccgaaccctcgtcct

SEQ ID NO: 363292 - DNA, 28 bp, Artificial Sequence
  Description of Artificial Sequence: Synthetic oligonucleotide
aacaggcagaaggagatcctggaggtgg

SEQ ID NO: 363293 - DNA, 24 bp, Artificial Sequence
  Description of Artificial Sequence: Synthetic oligonucleotide
atggctccccgaaccctcgtcctg

SEQ ID NO: 363294 - DNA, 27 bp, Artificial Sequence
  Description of Artificial Sequence: Synthetic oligonucleotide
acaggcagaaggagatcctggaggtgg

SEQ ID NO: 363295 - DNA, 23 bp, Artificial Sequence
  Description of Artificial Sequence: Synthetic oligonucleotide
tggctccccgaaccctcgtcctg

SEQ ID NO: 363296 - DNA, 27 bp, Artificial Sequence
  Description of Artificial Sequence: Synthetic oligonucleotide
caggcagaaggagatcctggaggtgga

SEQ ID NO: 363297 - DNA, 22 bp, Artificial Sequence
  Description of Artificial Sequence: Synthetic oligonucleotide
ggctccccgaaccctcgtcctg

SEQ ID NO: 363298 - DNA, 27 bp, Artificial Sequence
  Description of Artificial Sequence: Synthetic oligonucleotide
aggcagaaggagatcctggaggtggag

SEQ ID NO: 363299 - DNA, 24 bp, Artificial Sequence
  Description of Artificial Sequence: Synthetic oligonucleotide
gctccccgaaccctcgtcctgcta

SEQ ID NO: 363300 - DNA, 26 bp, Artificial Sequence
  Description of Artificial Sequence: Synthetic oligonucleotide
ggcagaaggagatcctggaggtggag

SEQ ID NO: 363301 - DNA, 25 bp, Artificial Sequence
  Description of Artificial Sequence: Synthetic oligonucleotide
ctccccgaaccctcgtcctgctact

SEQ ID NO: 363302 - DNA, 26 bp, Artificial Sequence
  Description of Artificial Sequence: Synthetic oligonucleotide
gcagaaggagatcctggaggtggagc

SEQ ID NO: 363303 - DNA, 26 bp, Artificial Sequence
  Description of Artificial Sequence: Synthetic oligonucleotide
tccccgaaccctcgtcctgctactct

SEQ ID NO: 363304 - DNA, 26 bp, Artificial Sequence
  Description of Artificial Sequence: Synthetic oligonucleotide
cagaaggagatcctggaggtggagcg

SEQ ID NO: 363305 - DNA, 26 bp, Artificial Sequence
  Description of Artificial Sequence: Synthetic oligonucleotide
gaggccggttctcacaccctccagat

SEQ ID NO: 363306 - DNA, 26 bp, Artificial Sequence
  Description of Artificial Sequence: Synthetic oligonucleotide
agaaggagatcctggaggtggagcgg

SEQ ID NO: 363307 - DNA, 27 bp, Artificial Sequence
  Description of Artificial Sequence: Synthetic oligonucleotide
aggccggttctcacaccctccagatga

SEQ ID NO: 363308 - DNA, 25 bp, Artificial Sequence
  Description of Artificial Sequence: Synthetic oligonucleotide
gaaggagatcctggaggtggagcgg

SEQ ID NO: 363309 - DNA, 27 bp, Artificial Sequence
  Description of Artificial Sequence: Synthetic oligonucleotide
ggccggttctcacaccctccagatgat

SEQ ID NO: 363310 - DNA, 25 bp, Artificial Sequence
  Description of Artificial Sequence: Synthetic oligonucleotide
aaggagatcctggaggtggagcggg

SEQ ID NO: 363311 - DNA, 27 bp, Artificial Sequence
  Description of Artificial Sequence: Synthetic oligonucleotide
gccggttctcacaccctccagatgatg

SEQ ID NO: 363312 - DNA, 24 bp, Artificial Sequence
  Description of Artificial Sequence: Synthetic oligonucleotide
aggagatcctggaggtggagcggg

SEQ ID NO: 363313 - DNA, 30 bp, Artificial Sequence; identical to SEQ ID NO: 5399
  Description of Artificial Sequence: Synthetic oligonucleotide

SEQ ID NO: 363314 - DNA, 23 bp, Artificial Sequence
  Description of Artificial Sequence: Synthetic oligonucleotide
ggagatcctggaggtggagcggg

SEQ ID NO: 363315 - DNA, 30 bp, Artificial Sequence; identical to SEQ ID NO: 5400
  Description of Artificial Sequence: Synthetic oligonucleotide

SEQ ID NO: 363316 - DNA, 23 bp, Artificial Sequence
  Description of Artificial Sequence: Synthetic oligonucleotide
gagatcctggaggtggagcgggc

SEQ ID NO: 363317 - DNA, 30 bp, Artificial Sequence; identical to SEQ ID NO: 5401
  Description of Artificial Sequence: Synthetic oligonucleotide

SEQ ID NO: 363318 - DNA, 24 bp, Artificial Sequence
  Description of Artificial Sequence: Synthetic oligonucleotide
agatcctggaggtggagcgggcgt

SEQ ID NO: 363319 - DNA, 31 bp, Artificial Sequence; identical to SEQ ID NO: 5402
  Description of Artificial Sequence: Synthetic oligonucleotide

SEQ ID NO: 363320 - DNA, 23 bp, Artificial Sequence
  Description of Artificial Sequence: Synthetic oligonucleotide
gatcctggaggtggagcgggcgt

SEQ ID NO: 363321 - DNA, 31 bp, Artificial Sequence; identical to SEQ ID NO: 5403
  Description of Artificial Sequence: Synthetic oligonucleotide

SEQ ID NO: 363322 - DNA, 23 bp, Artificial Sequence
  Description of Artificial Sequence: Synthetic oligonucleotide
atcctggaggtggagcgggcgtg

SEQ ID NO: 363323 - DNA, 30 bp, Artificial Sequence; identical to SEQ ID NO: 5404
  Description of Artificial Sequence: Synthetic oligonucleotide

SEQ ID NO: 363324 - DNA, 22 bp, Artificial Sequence
  Description of Artificial Sequence: Synthetic oligonucleotide
tcctggaggtggagcgggcgtg

SEQ ID NO: 363325 - DNA, 29 bp, Artificial Sequence
  Description of Artificial Sequence: Synthetic oligonucleotide
ctcacaccctccagatgatgtttggctgc

SEQ ID NO: 363326 - DNA, 21 bp, Artificial Sequence
  Description of Artificial Sequence: Synthetic oligonucleotide
cctggaggtggagcgggcgtg

SEQ ID NO: 363327 - DNA, 29 bp, Artificial Sequence
  Description of Artificial Sequence: Synthetic oligonucleotide
tcacaccctccagatgatgtttggctgcg

SEQ ID NO: 363328 - DNA, 21 bp, Artificial Sequence
  Description of Artificial Sequence: Synthetic oligonucleotide
ctggaggtggagcgggcgtgc

SEQ ID NO: 363329 - DNA, 28 bp, Artificial Sequence
  Description of Artificial Sequence: Synthetic oligonucleotide
cacaccctccagatgatgtttggctgcg

SEQ ID NO: 363330 - DNA, 21 bp, Artificial Sequence
  Description of Artificial Sequence: Synthetic oligonucleotide
tggaggtggagcgggcgtgcc

SEQ ID NO: 363331 - DNA, 29 bp, Artificial Sequence
  Description of Artificial Sequence: Synthetic oligonucleotide
acaccctccagatgatgtttggctgcgac

SEQ ID NO: 363332 - DNA, 20 bp, Artificial Sequence
  Description of Artificial Sequence: Synthetic oligonucleotide
ggaggtggagcgggcgtgcc

SEQ ID NO: 363333 - DNA, 28 bp, Artificial Sequence
  Description of Artificial Sequence: Synthetic oligonucleotide
caccctccagatgatgtttggctgcgac

SEQ ID NO: 363334 - DNA, 20 bp, Artificial Sequence
  Description of Artificial Sequence: Synthetic oligonucleotide
gaggtggagcgggcgtgccg

SEQ ID NO: 363335 - DNA, 28 bp, Artificial Sequence
  Description of Artificial Sequence: Synthetic oligonucleotide
accctccagatgatgtttggctgcgacg

SEQ ID NO: 363336 - DNA, 21 bp, Artificial Sequence
  Description of Artificial Sequence: Synthetic oligonucleotide
aggtggagcgggcgtgccgga

SEQ ID NO: 363337 - DNA, 27 bp, Artificial Sequence
  Description of Artificial Sequence: Synthetic oligonucleotide
ccctccagatgatgtttggctgcgacg

SEQ ID NO: 363338 - DNA, 20 bp, Artificial Sequence
  Description of Artificial Sequence: Synthetic oligonucleotide
ggtggagcgggcgtgccgga

SEQ ID NO: 363339 - DNA, 28 bp, Artificial Sequence
  Description of Artificial Sequence: Synthetic oligonucleotide
cctccagatgatgtttggctgcgacgtg

SEQ ID NO: 363340 - DNA, 21 bp, Artificial Sequence
  Description of Artificial Sequence: Synthetic oligonucleotide
gtggagcgggcgtgccggact

SEQ ID NO: 363341 - DNA, 28 bp, Artificial Sequence
  Description of Artificial Sequence: Synthetic oligonucleotide
ctccagatgatgtttggctgcgacgtgg

SEQ ID NO: 363342 - DNA, 21 bp, Artificial Sequence
  Description of Artificial Sequence: Synthetic oligonucleotide
tggagcgggcgtgccggactg

SEQ ID NO: 363343 - DNA, 28 bp, Artificial Sequence
  Description of Artificial Sequence: Synthetic oligonucleotide
tccagatgatgtttggctgcgacgtggg

SEQ ID NO: 363344 - DNA, 20 bp, Artificial Sequence
  Description of Artificial Sequence: Synthetic oligonucleotide
ggagcgggcgtgccggactg

SEQ ID NO: 363345 - DNA, 27 bp, Artificial Sequence
  Description of Artificial Sequence: Synthetic oligonucleotide
ccagatgatgtttggctgcgacgtggg

SEQ ID NO: 363346 - DNA, 24 bp, Artificial Sequence
  Description of Artificial Sequence: Synthetic oligonucleotide
gagcgggcgtgccggactggatat

SEQ ID NO: 363347 - DNA, 27 bp, Artificial Sequence
  Description of Artificial Sequence: Synthetic oligonucleotide
cagatgatgtttggctgcgacgtgggg

SEQ ID NO: 363348 - DNA, 24 bp, Artificial Sequence
  Description of Artificial Sequence: Synthetic oligonucleotide
agcgggcgtgccggactggatatg

SEQ ID NO: 363349 - DNA, 28 bp, Artificial Sequence
  Description of Artificial Sequence: Synthetic oligonucleotide
agatgatgtttggctgcgacgtggggtc

SEQ ID NO: 363350 - DNA, 23 bp, Artificial Sequence
  Description of Artificial Sequence: Synthetic oligonucleotide
gcgggcgtgccggactggatatg

SEQ ID NO: 363351 - DNA, 27 bp, Artificial Sequence
  Description of Artificial Sequence: Synthetic oligonucleotide
gatgatgtttggctgcgacgtggggtc

SEQ ID NO: 363352 - DNA, 24 bp, Artificial Sequence
  Description of Artificial Sequence: Synthetic oligonucleotide
cgggcgtgccggactggatatgca

SEQ ID NO: 363353 - DNA, 27 bp, Artificial Sequence
  Description of Artificial Sequence: Synthetic oligonucleotide
atgatgtttggctgcgacgtggggtcg

SEQ ID NO: 363354 - DNA, 25 bp, Artificial Sequence
  Description of Artificial Sequence: Synthetic oligonucleotide
gggcgtgccggactggatatgcaca

SEQ ID NO: 363355 - DNA, 26 bp, Artificial Sequence
  Description of Artificial Sequence: Synthetic oligonucleotide
tgatgtttggctgcgacgtggggtcg

SEQ ID NO: 363356 - DNA, 26 bp, Artificial Sequence
  Description of Artificial Sequence: Synthetic oligonucleotide
ggcgtgccggactggatatgcacaca

SEQ ID NO: 363357 - DNA, 25 bp, Artificial Sequence
  Description of Artificial Sequence: Synthetic oligonucleotide
tttggctgcgacgtggggtcggact

SEQ ID NO: 363358 - DNA, 27 bp, Artificial Sequence
  Description of Artificial Sequence: Synthetic oligonucleotide
gcgtgccggactggatatgcacacaca

SEQ ID NO: 363359 - DNA, 24 bp, Artificial Sequence
  Description of Artificial Sequence: Synthetic oligonucleotide
ttggctgcgacgtggggtcggact

SEQ ID NO: 363360 - DNA, 28 bp, Artificial Sequence
  Description of Artificial Sequence: Synthetic oligonucleotide
cgtgccggactggatatgcacacacaac

SEQ ID NO: 363361 - DNA, 25 bp, Artificial Sequence
  Description of Artificial Sequence: Synthetic oligonucleotide
atcaccaagcgcaagtgggaggcgg

SEQ ID NO: 363362 - DNA, 30 bp, Artificial Sequence; identical to SEQ ID NO: 236287
  Description of Artificial Sequence: Synthetic oligonucleotide

SEQ ID NO: 363363 - DNA, 24 bp, Artificial Sequence
  Description of Artificial Sequence: Synthetic oligonucleotide
tcaccaagcgcaagtgggaggcgg

SEQ ID NO: 363364 - DNA, 30 bp, Artificial Sequence; identical to SEQ ID NO: 236288
  Description of Artificial Sequence: Synthetic oligonucleotide

SEQ ID NO: 363365 - DNA, 23 bp, Artificial Sequence
  Description of Artificial Sequence: Synthetic oligonucleotide
caccaagcgcaagtgggaggcgg

SEQ ID NO: 363366 - DNA, 29 bp, Artificial Sequence
  Description of Artificial Sequence: Synthetic oligonucleotide
gccggactggatatgcacacacaactagg

SEQ ID NO: 363367 - DNA, 23 bp, Artificial Sequence
  Description of Artificial Sequence: Synthetic oligonucleotide
accaagcgcaagtgggaggcggc

SEQ ID NO: 363368 - DNA, 30 bp, Artificial Sequence; identical to SEQ ID NO: 236290
  Description of Artificial Sequence: Synthetic oligonucleotide

SEQ ID NO: 363369 - DNA, 22 bp, Artificial Sequence
  Description of Artificial Sequence: Synthetic oligonucleotide
ccaagcgcaagtgggaggcggc

SEQ ID NO: 363370 - DNA, 30 bp, Artificial Sequence; identical to SEQ ID NO: 236291
  Description of Artificial Sequence: Synthetic oligonucleotide

SEQ ID NO: 363371 - DNA, 22 bp, Artificial Sequence
  Description of Artificial Sequence: Synthetic oligonucleotide
caagcgcaagtgggaggcggcc

SEQ ID NO: 363372 - DNA, 31 bp, Artificial Sequence; identical to SEQ ID NO: 236292
  Description of Artificial Sequence: Synthetic oligonucleotide

SEQ ID NO: 363373 - DNA, 24 bp, Artificial Sequence
  Description of Artificial Sequence: Synthetic oligonucleotide
aagcgcaagtgggaggcggcccat

SEQ ID NO: 363374 - DNA, 31 bp, Artificial Sequence; identical to SEQ ID NO: 236293
  Description of Artificial Sequence: Synthetic oligonucleotide

SEQ ID NO: 363375 - DNA, 23 bp, Artificial Sequence
  Description of Artificial Sequence: Synthetic oligonucleotide
agcgcaagtgggaggcggcccat

SEQ ID NO: 363376 - DNA, 32 bp, Artificial Sequence; identical to SEQ ID NO: 236294
  Description of Artificial Sequence: Synthetic oligonucleotide

SEQ ID NO: 363377 - DNA, 22 bp, Artificial Sequence
  Description of Artificial Sequence: Synthetic oligonucleotide
gcgcaagtgggaggcggcccat

SEQ ID NO: 363378 - DNA, 31 bp, Artificial Sequence; identical to SEQ ID NO: 236295
  Description of Artificial Sequence: Synthetic oligonucleotide

SEQ ID NO: 363379 - DNA, 23 bp, Artificial Sequence
  Description of Artificial Sequence: Synthetic oligonucleotide
cgcaagtgggaggcggcccatgt

SEQ ID NO: 363380 - DNA, 31 bp, Artificial Sequence; identical to SEQ ID NO: 236296
  Description of Artificial Sequence: Synthetic oligonucleotide

SEQ ID NO: 363381 - DNA, 23 bp, Artificial Sequence
  Description of Artificial Sequence: Synthetic oligonucleotide
gcaagtgggaggcggcccatgtg

SEQ ID NO: 363382 - DNA, 30 bp, Artificial Sequence; identical to SEQ ID NO: 236297
  Description of Artificial Sequence: Synthetic oligonucleotide

SEQ ID NO: 363383 - DNA, 24 bp, Artificial Sequence
  Description of Artificial Sequence: Synthetic oligonucleotide
tacctggagggcacgtgcgtggac

SEQ ID NO: 363384 - DNA, 31 bp, Artificial Sequence; identical to SEQ ID NO: 236298
  Description of Artificial Sequence: Synthetic oligonucleotide

SEQ ID NO: 363385 - DNA, 23 bp, Artificial Sequence
  Description of Artificial Sequence: Synthetic oligonucleotide
acctggagggcacgtgcgtggac

SEQ ID NO: 363386 - DNA, 31 bp, Artificial Sequence; identical to SEQ ID NO: 236299
  Description of Artificial Sequence: Synthetic oligonucleotide

SEQ ID NO: 363387 - DNA, 22 bp, Artificial Sequence
  Description of Artificial Sequence: Synthetic oligonucleotide
cctggagggcacgtgcgtggac

SEQ ID NO: 363388 - DNA, 30 bp, Artificial Sequence; identical to SEQ ID NO: 236300
  Description of Artificial Sequence: Synthetic oligonucleotide

SEQ ID NO: 363389 - DNA, 22 bp, Artificial Sequence
  Description of Artificial Sequence: Synthetic oligonucleotide
ctggagggcacgtgcgtggacg

SEQ ID NO: 363390 - DNA, 29 bp, Artificial Sequence
  Description of Artificial Sequence: Synthetic oligonucleotide
atgcacacacaactaggagctggaccagg

SEQ ID NO: 363391 - DNA, 22 bp, Artificial Sequence
  Description of Artificial Sequence: Synthetic oligonucleotide
tggagggcacgtgcgtggacgg

SEQ ID NO: 363392 - DNA, 28 bp, Artificial Sequence
  Description of Artificial Sequence: Synthetic oligonucleotide
tgcacacacaactaggagctggaccagg

SEQ ID NO: 363393 - DNA, 21 bp, Artificial Sequence
  Description of Artificial Sequence: Synthetic oligonucleotide
ggagggcacgtgcgtggacgg

SEQ ID NO: 363394 - DNA, 27 bp, Artificial Sequence
  Description of Artificial Sequence: Synthetic oligonucleotide
gcacacacaactaggagctggaccagg

SEQ ID NO: 363395 - DNA, 21 bp, Artificial Sequence
  Description of Artificial Sequence: Synthetic oligonucleotide
gagggcacgtgcgtggacggg

SEQ ID NO: 363396 - DNA, 27 bp, Artificial Sequence
  Description of Artificial Sequence: Synthetic oligonucleotide
cacacacaactaggagctggaccaggc

SEQ ID NO: 363397 - DNA, 22 bp, Artificial Sequence
  Description of Artificial Sequence: Synthetic oligonucleotide
agggcacgtgcgtggacgggct

SEQ ID NO: 363398 - DNA, 27 bp, Artificial Sequence
  Description of Artificial Sequence: Synthetic oligonucleotide
acacacaactaggagctggaccaggcc

SEQ ID NO: 363399 - DNA, 21 bp, Artificial Sequence
  Description of Artificial Sequence: Synthetic oligonucleotide
gggcacgtgcgtggacgggct

SEQ ID NO: 363400 - DNA, 26 bp, Artificial Sequence
  Description of Artificial Sequence: Synthetic oligonucleotide
cacacaactaggagctggaccaggcc

SEQ ID NO: 363401 - DNA, 21 bp, Artificial Sequence
  Description of Artificial Sequence: Synthetic oligonucleotide
ggcacgtgcgtggacgggctc

SEQ ID NO: 363402 - DNA, 27 bp, Artificial Sequence
  Description of Artificial Sequence: Synthetic oligonucleotide
acacaactaggagctggaccaggccgt

SEQ ID NO: 363403 - DNA, 21 bp, Artificial Sequence
  Description of Artificial Sequence: Synthetic oligonucleotide
gcacgtgcgtggacgggctcc

SEQ ID NO: 363404 - DNA, 26 bp, Artificial Sequence
  Description of Artificial Sequence: Synthetic oligonucleotide
cacaactaggagctggaccaggccgt

SEQ ID NO: 363405 - DNA, 21 bp, Artificial Sequence
  Description of Artificial Sequence: Synthetic oligonucleotide
cacgtgcgtggacgggctccg

SEQ ID NO: 363406 - DNA, 27 bp, Artificial Sequence
  Description of Artificial Sequence: Synthetic oligonucleotide
acaactaggagctggaccaggccgtga

SEQ ID NO: 363407 - DNA, 22 bp, Artificial Sequence
  Description of Artificial Sequence: Synthetic oligonucleotide
acgtgcgtggacgggctccgca

SEQ ID NO: 363408 - DNA, 26 bp, Artificial Sequence
  Description of Artificial Sequence: Synthetic oligonucleotide
caactaggagctggaccaggccgtga

SEQ ID NO: 363409 - DNA, 21 bp, Artificial Sequence
  Description of Artificial Sequence: Synthetic oligonucleotide
cgtgcgtggacgggctccgca

SEQ ID NO: 363410 - DNA, 26 bp, Artificial Sequence
  Description of Artificial Sequence: Synthetic oligonucleotide
aactaggagctggaccaggccgtgag

SEQ ID NO: 363411 - DNA, 27 bp, Artificial Sequence
  Description of Artificial Sequence: Synthetic oligonucleotide
gagtattgggacggggagacacggaac

SEQ ID NO: 363412 - DNA, 25 bp, Artificial Sequence
  Description of Artificial Sequence: Synthetic oligonucleotide
actaggagctggaccaggccgtgag

SEQ ID NO: 363413 - DNA, 27 bp, Artificial Sequence
  Description of Artificial Sequence: Synthetic oligonucleotide
agtattgggacggggagacacggaacg

SEQ ID NO: 363414 - DNA, 24 bp, Artificial Sequence
  Description of Artificial Sequence: Synthetic oligonucleotide
ctaggagctggaccaggccgtgag

SEQ ID NO: 363415 - DNA, 27 bp, Artificial Sequence
  Description of Artificial Sequence: Synthetic oligonucleotide
gtattgggacggggagacacggaacgt

SEQ ID NO: 363416 - DNA, 24 bp, Artificial Sequence
  Description of Artificial Sequence: Synthetic oligonucleotide
taggagctggaccaggccgtgagc

SEQ ID NO: 363417 - DNA, 27 bp, Artificial Sequence
  Description of Artificial Sequence: Synthetic oligonucleotide
tattgggacggggagacacggaacgtg

SEQ ID NO: 363418 - DNA, 23 bp, Artificial Sequence
  Description of Artificial Sequence: Synthetic oligonucleotide
aggagctggaccaggccgtgagc

SEQ ID NO: 363419 - DNA, 27 bp, Artificial Sequence
  Description of Artificial Sequence: Synthetic oligonucleotide
attgggacggggagacacggaacgtga

SEQ ID NO: 363420 - DNA, 22 bp, Artificial Sequence
  Description of Artificial Sequence: Synthetic oligonucleotide
ggagctggaccaggccgtgagc

SEQ ID NO: 363421 - DNA, 27 bp, Artificial Sequence
  Description of Artificial Sequence: Synthetic oligonucleotide
ttgggacggggagacacggaacgtgaa

SEQ ID NO: 363422 - DNA, 23 bp, Artificial Sequence
  Description of Artificial Sequence: Synthetic oligonucleotide
gagctggaccaggccgtgagcct

SEQ ID NO: 363423 - DNA, 26 bp, Artificial Sequence
  Description of Artificial Sequence: Synthetic oligonucleotide
tgggacggggagacacggaacgtgaa

SEQ ID NO: 363424 - DNA, 23 bp, Artificial Sequence
  Description of Artificial Sequence: Synthetic oligonucleotide
agctggaccaggccgtgagcctg

SEQ ID NO: 363425 - DNA, 25 bp, Artificial Sequence
  Description of Artificial Sequence: Synthetic oligonucleotide
gggacggggagacacggaacgtgaa

SEQ ID NO: 363426 - DNA, 22 bp, Artificial Sequence
  Description of Artificial Sequence: Synthetic oligonucleotide
gctggaccaggccgtgagcctg

SEQ ID NO: 363427 - DNA, 25 bp, Artificial Sequence
  Description of Artificial Sequence: Synthetic oligonucleotide
ggacggggagacacggaacgtgaag

SEQ ID NO: 363428 - DNA, 23 bp, Artificial Sequence
  Description of Artificial Sequence: Synthetic oligonucleotide
ctggaccaggccgtgagcctgca

SEQ ID NO: 363429 - DNA, 25 bp, Artificial Sequence
  Description of Artificial Sequence: Synthetic oligonucleotide
gacggggagacacggaacgtgaagg

SEQ ID NO: 363430 - DNA, 23 bp, Artificial Sequence
  Description of Artificial Sequence: Synthetic oligonucleotide
tggaccaggccgtgagcctgcag

SEQ ID NO: 363431 - DNA, 25 bp, Artificial Sequence
  Description of Artificial Sequence: Synthetic oligonucleotide
acggggagacacggaacgtgaaggc

SEQ ID NO: 363432 - DNA, 22 bp, Artificial Sequence
  Description of Artificial Sequence: Synthetic oligonucleotide
ggaccaggccgtgagcctgcag

SEQ ID NO: 363433 - DNA, 24 bp, Artificial Sequence
  Description of Artificial Sequence: Synthetic oligonucleotide
cggggagacacggaacgtgaaggc

SEQ ID NO: 363434 - DNA, 22 bp, Artificial Sequence
  Description of Artificial Sequence: Synthetic oligonucleotide
gaccaggccgtgagcctgcagc

SEQ ID NO: 363435 - DNA, 24 bp, Artificial Sequence
  Description of Artificial Sequence: Synthetic oligonucleotide
ggggagacacggaacgtgaaggcc

SEQ ID NO: 363436 - DNA, 22 bp, Artificial Sequence
  Description of Artificial Sequence: Synthetic oligonucleotide
accaggccgtgagcctgcagcg

SEQ ID NO: 363437 - DNA, 25 bp, Artificial Sequence
  Description of Artificial Sequence: Synthetic oligonucleotide
gggagacacggaacgtgaaggccca

SEQ ID NO: 363438 - DNA, 21 bp, Artificial Sequence
  Description of Artificial Sequence: Synthetic oligonucleotide
ccaggccgtgagcctgcagcg

SEQ ID NO: 363439 - DNA, 26 bp, Artificial Sequence
  Description of Artificial Sequence: Synthetic oligonucleotide
ggagacacggaacgtgaaggcccact

SEQ ID NO: 363440 - DNA, 21 bp, Artificial Sequence
  Description of Artificial Sequence: Synthetic oligonucleotide
caggccgtgagcctgcagcgc

SEQ ID NO: 363441 - DNA, 27 bp, Artificial Sequence
  Description of Artificial Sequence: Synthetic oligonucleotide
gagacacggaacgtgaaggcccactca

SEQ ID NO: 363442 - DNA, 22 bp, Artificial Sequence
  Description of Artificial Sequence: Synthetic oligonucleotide
aggccgtgagcctgcagcgcga

SEQ ID NO: 363443 - DNA, 27 bp, Artificial Sequence
  Description of Artificial Sequence: Synthetic oligonucleotide
agacacggaacgtgaaggcccactcac

SEQ ID NO: 363444 - DNA, 21 bp, Artificial Sequence
  Description of Artificial Sequence: Synthetic oligonucleotide
ggccgtgagcctgcagcgcga

SEQ ID NO: 363445 - DNA, 27 bp, Artificial Sequence
  Description of Artificial Sequence: Synthetic oligonucleotide
gacacggaacgtgaaggcccactcaca

SEQ ID NO: 363446 - DNA, 22 bp, Artificial Sequence
  Description of Artificial Sequence: Synthetic oligonucleotide
gccgtgagcctgcagcgcgagt

SEQ ID NO: 363447 - DNA, 27 bp, Artificial Sequence
  Description of Artificial Sequence: Synthetic oligonucleotide
acacggaacgtgaaggcccactcacag

SEQ ID NO: 363448 - DNA, 22 bp, Artificial Sequence
  Description of Artificial Sequence: Synthetic oligonucleotide
ccgtgagcctgcagcgcgagtc

SEQ ID NO: 363449 - DNA, 27 bp, Artificial Sequence
  Description of Artificial Sequence: Synthetic oligonucleotide
cacggaacgtgaaggcccactcacaga

SEQ ID NO: 363450 - DNA, 23 bp, Artificial Sequence
  Description of Artificial Sequence: Synthetic oligonucleotide
cgtgagcctgcagcgcgagtcca

SEQ ID NO: 363451 - DNA, 27 bp, Artificial Sequence
  Description of Artificial Sequence: Synthetic oligonucleotide
acggaacgtgaaggcccactcacagac

SEQ ID NO: 363452 - DNA, 23 bp, Artificial Sequence
  Description of Artificial Sequence: Synthetic oligonucleotide
gtgagcctgcagcgcgagtccag

SEQ ID NO: 363453 - DNA, 27 bp, Artificial Sequence
  Description of Artificial Sequence: Synthetic oligonucleotide
cggaacgtgaaggcccactcacagact

SEQ ID NO: 363454 - DNA, 23 bp, Artificial Sequence
  Description of Artificial Sequence: Synthetic oligonucleotide
tgagcctgcagcgcgagtccagg

SEQ ID NO: 363455 - DNA, 27 bp, Artificial Sequence
  Description of Artificial Sequence: Synthetic oligonucleotide
ggaacgtgaaggcccactcacagactc

SEQ ID NO: 363456 - DNA, 22 bp, Artificial Sequence
  Description of Artificial Sequence: Synthetic oligonucleotide
gagcctgcagcgcgagtccagg

SEQ ID NO: 363457 - DNA, 28 bp, Artificial Sequence
  Description of Artificial Sequence: Synthetic oligonucleotide
gaacgtgaaggcccactcacagactcac

SEQ ID NO: 363458 - DNA, 25 bp, Artificial Sequence
  Description of Artificial Sequence: Synthetic oligonucleotide
agcctgcagcgcgagtccaggctaa

SEQ ID NO: 363459 - DNA, 28 bp, Artificial Sequence
  Description of Artificial Sequence: Synthetic oligonucleotide
aacgtgaaggcccactcacagactcacc

SEQ ID NO: 363460 - DNA, 24 bp, Artificial Sequence
  Description of Artificial Sequence: Synthetic oligonucleotide
gcctgcagcgcgagtccaggctaa

SEQ ID NO: 363461 - DNA, 27 bp, Artificial Sequence
  Description of Artificial Sequence: Synthetic oligonucleotide
acgtgaaggcccactcacagactcacc

SEQ ID NO: 363462 - DNA, 24 bp, Artificial Sequence
  Description of Artificial Sequence: Synthetic oligonucleotide
cctgcagcgcgagtccaggctaag

SEQ ID NO: 363463 - DNA, 26 bp, Artificial Sequence
  Description of Artificial Sequence: Synthetic oligonucleotide
cgtgaaggcccactcacagactcacc

SEQ ID NO: 363464 - DNA, 25 bp, Artificial Sequence
  Description of Artificial Sequence: Synthetic oligonucleotide
ctgcagcgcgagtccaggctaaggt

SEQ ID NO: 363465 - DNA, 27 bp, Artificial Sequence
  Description of Artificial Sequence: Synthetic oligonucleotide
gcttcatcgcagtgggctacgtggaca

SEQ ID NO: 363466 - DNA, 27 bp, Artificial Sequence
  Description of Artificial Sequence: Synthetic oligonucleotide
tgcagcgcgagtccaggctaaggtgat

SEQ ID NO: 363467 - DNA, 28 bp, Artificial Sequence
  Description of Artificial Sequence: Synthetic oligonucleotide
cttcatcgcagtgggctacgtggacaac

SEQ ID NO: 363468 - DNA, 26 bp, Artificial Sequence
  Description of Artificial Sequence: Synthetic oligonucleotide
gcagcgcgagtccaggctaaggtgat

SEQ ID NO: 363469 - DNA, 29 bp, Artificial Sequence
  Description of Artificial Sequence: Synthetic oligonucleotide
ttcatcgcagtgggctacgtggacaacac

SEQ ID NO: 363470 - DNA, 26 bp, Artificial Sequence
  Description of Artificial Sequence: Synthetic oligonucleotide
cagcgcgagtccaggctaaggtgatc

SEQ ID NO: 363471 - DNA, 28 bp, Artificial Sequence
  Description of Artificial Sequence: Synthetic oligonucleotide
tcatcgcagtgggctacgtggacaacac

SEQ ID NO: 363472 - DNA, 27 bp, Artificial Sequence
  Description of Artificial Sequence: Synthetic oligonucleotide
agcgcgagtccaggctaaggtgatcgt

SEQ ID NO: 363473 - DNA, 27 bp, Artificial Sequence
  Description of Artificial Sequence: Synthetic oligonucleotide
catcgcagtgggctacgtggacaacac

SEQ ID NO: 363474 - DNA, 27 bp, Artificial Sequence
  Description of Artificial Sequence: Synthetic oligonucleotide
gcgcgagtccaggctaaggtgatcgtt

SEQ ID NO: 363475 - DNA, 27 bp, Artificial Sequence
  Description of Artificial Sequence: Synthetic oligonucleotide
atcgcagtgggctacgtggacaacacg

SEQ ID NO: 363476 - DNA, 28 bp, Artificial Sequence
  Description of Artificial Sequence: Synthetic oligonucleotide
cgcgagtccaggctaaggtgatcgtttc

SEQ ID NO: 363477 - DNA, 26 bp, Artificial Sequence
  Description of Artificial Sequence: Synthetic oligonucleotide
tcgcagtgggctacgtggacaacacg

SEQ ID NO: 363478 - DNA, 28 bp, Artificial Sequence
  Description of Artificial Sequence: Synthetic oligonucleotide
gcgagtccaggctaaggtgatcgtttcc

SEQ ID NO: 363479 - DNA, 25 bp, Artificial Sequence
  Description of Artificial Sequence: Synthetic oligonucleotide
cgcagtgggctacgtggacaacacg

SEQ ID NO: 363480 - DNA, 28 bp, Artificial Sequence
  Description of Artificial Sequence: Synthetic oligonucleotide
cgagtccaggctaaggtgatcgtttccc

SEQ ID NO: 363481 - DNA, 26 bp, Artificial Sequence
  Description of Artificial Sequence: Synthetic oligonucleotide
gcagtgggctacgtggacaacacgca

SEQ ID NO: 363482 - DNA, 28 bp, Artificial Sequence
  Description of Artificial Sequence: Synthetic oligonucleotide
gagtccaggctaaggtgatcgtttcccc

SEQ ID NO: 363483 - DNA, 27 bp, Artificial Sequence
  Description of Artificial Sequence: Synthetic oligonucleotide
cagtgggctacgtggacaacacgcagt

SEQ ID NO: 363484 - DNA, 28 bp, Artificial Sequence
  Description of Artificial Sequence: Synthetic oligonucleotide
agtccaggctaaggtgatcgtttccccg

SEQ ID NO: 363485 - DNA, 28 bp, Artificial Sequence
  Description of Artificial Sequence: Synthetic oligonucleotide
agtgggctacgtggacaacacgcagttc

SEQ ID NO: 363486 - DNA, 27 bp, Artificial Sequence
  Description of Artificial Sequence: Synthetic oligonucleotide
gtccaggctaaggtgatcgtttccccg

SEQ ID NO: 363487 - DNA, 27 bp, Artificial Sequence
  Description of Artificial Sequence: Synthetic oligonucleotide
gtgggctacgtggacaacacgcagttc

SEQ ID NO: 363488 - DNA, 28 bp, Artificial Sequence
  Description of Artificial Sequence: Synthetic oligonucleotide
tccaggctaaggtgatcgtttccccgtc

SEQ ID NO: 363489 - DNA, 27 bp, Artificial Sequence
  Description of Artificial Sequence: Synthetic oligonucleotide
tgggctacgtggacaacacgcagttcg

SEQ ID NO: 363490 - DNA, 27 bp, Artificial Sequence
  Description of Artificial Sequence: Synthetic oligonucleotide
ccaggctaaggtgatcgtttccccgtc

SEQ ID NO: 363491 - DNA, 27 bp, Artificial Sequence
  Description of Artificial Sequence: Synthetic oligonucleotide
gggctacgtggacaacacgcagttcgt

SEQ ID NO: 363492 - DNA, 27 bp, Artificial Sequence
  Description of Artificial Sequence: Synthetic oligonucleotide
caggctaaggtgatcgtttccccgtcc

SEQ ID NO: 363493 - DNA, 27 bp, Artificial Sequence
  Description of Artificial Sequence: Synthetic oligonucleotide
ggctacgtggacaacacgcagttcgtg

SEQ ID NO: 363494 - DNA, 29 bp, Artificial Sequence
  Description of Artificial Sequence: Synthetic oligonucleotide
aggctaaggtgatcgtttccccgtccaag

SEQ ID NO: 363495 - DNA, 27 bp, Artificial Sequence
  Description of Artificial Sequence: Synthetic oligonucleotide
gctacgtggacaacacgcagttcgtgc

SEQ ID NO: 363496 - DNA, 28 bp, Artificial Sequence
  Description of Artificial Sequence: Synthetic oligonucleotide
ggctaaggtgatcgtttccccgtccaag

SEQ ID NO: 363497 - DNA, 27 bp, Artificial Sequence
  Description of Artificial Sequence: Synthetic oligonucleotide
ctacgtggacaacacgcagttcgtgcg

SEQ ID NO: 363498 - DNA, 30 bp, Artificial Sequence; identical to SEQ ID NO: 236355
  Description of Artificial Sequence: Synthetic oligonucleotide

SEQ ID NO: 363499 - DNA, 27 bp, Artificial Sequence
  Description of Artificial Sequence: Synthetic oligonucleotide
tacgtggacaacacgcagttcgtgcgg

SEQ ID NO: 363500 - DNA, 30 bp, Artificial Sequence; identical to SEQ ID NO: 236356
  Description of Artificial Sequence: Synthetic oligonucleotide

SEQ ID NO: 363501 - DNA, 27 bp, Artificial Sequence
  Description of Artificial Sequence: Synthetic oligonucleotide
acgtggacaacacgcagttcgtgcggt

SEQ ID NO: 363502 - DNA, 30 bp, Artificial Sequence; identical to SEQ ID NO: 236357
  Description of Artificial Sequence: Synthetic oligonucleotide

SEQ ID NO: 363503 - DNA, 27 bp, Artificial Sequence
  Description of Artificial Sequence: Synthetic oligonucleotide
cgtggacaacacgcagttcgtgcggtt

SEQ ID NO: 363504 - DNA, 29 bp, Artificial Sequence
  Description of Artificial Sequence: Synthetic oligonucleotide
aaggtgatcgtttccccgtccaagaagcg

SEQ ID NO: 363505 - DNA, 27 bp, Artificial Sequence
  Description of Artificial Sequence: Synthetic oligonucleotide
gtggacaacacgcagttcgtgcggttc

SEQ ID NO: 363506 - DNA, 28 bp, Artificial Sequence
  Description of Artificial Sequence: Synthetic oligonucleotide
aggtgatcgtttccccgtccaagaagcg

SEQ ID NO: 363507 - DNA, 27 bp, Artificial Sequence
  Description of Artificial Sequence: Synthetic oligonucleotide
tggacaacacgcagttcgtgcggttcg

SEQ ID NO: 363508 - DNA, 27 bp, Artificial Sequence
  Description of Artificial Sequence: Synthetic oligonucleotide
ggtgatcgtttccccgtccaagaagcg

SEQ ID NO: 363509 - DNA, 27 bp, Artificial Sequence
  Description of Artificial Sequence: Synthetic oligonucleotide
ggacaacacgcagttcgtgcggttcga

SEQ ID NO: 363510 - DNA, 27 bp, Artificial Sequence
  Description of Artificial Sequence: Synthetic oligonucleotide
gtgatcgtttccccgtccaagaagcgg

SEQ ID NO: 363511 - DNA, 27 bp, Artificial Sequence
  Description of Artificial Sequence: Synthetic oligonucleotide
gacaacacgcagttcgtgcggttcgac

SEQ ID NO: 363512 - DNA, 27 bp, Artificial Sequence
  Description of Artificial Sequence: Synthetic oligonucleotide
tgatcgtttccccgtccaagaagcggc

SEQ ID NO: 363513 - DNA, 28 bp, Artificial Sequence
  Description of Artificial Sequence: Synthetic oligonucleotide
acaacacgcagttcgtgcggttcgacag

SEQ ID NO: 363514 - DNA, 26 bp, Artificial Sequence
  Description of Artificial Sequence: Synthetic oligonucleotide
gatcgtttccccgtccaagaagcggc

SEQ ID NO: 363515 - DNA, 27 bp, Artificial Sequence
  Description of Artificial Sequence: Synthetic oligonucleotide
caacacgcagttcgtgcggttcgacag

SEQ ID NO: 363516 - DNA, 26 bp, Artificial Sequence
  Description of Artificial Sequence: Synthetic oligonucleotide
atcgtttccccgtccaagaagcggcc

SEQ ID NO: 363517 - DNA, 27 bp, Artificial Sequence
  Description of Artificial Sequence: Synthetic oligonucleotide
aacacgcagttcgtgcggttcgacagc

SEQ ID NO: 363518 - DNA, 25 bp, Artificial Sequence
  Description of Artificial Sequence: Synthetic oligonucleotide
tcgtttccccgtccaagaagcggcc

SEQ ID NO: 363519 - DNA, 27 bp, Artificial Sequence
  Description of Artificial Sequence: Synthetic oligonucleotide
cgtggatagagcaggagggtccggaat

SEQ ID NO: 363520 - DNA, 24 bp, Artificial Sequence
  Description of Artificial Sequence: Synthetic oligonucleotide
cgtttccccgtccaagaagcggcc

SEQ ID NO: 363521 - DNA, 30 bp, Artificial Sequence; identical to SEQ ID NO: 8389
  Description of Artificial Sequence: Synthetic oligonucleotide

SEQ ID NO: 363522 - DNA, 24 bp, Artificial Sequence
  Description of Artificial Sequence: Synthetic oligonucleotide
gtttccccgtccaagaagcggccc

SEQ ID NO: 363523 - DNA, 30 bp, Artificial Sequence; identical to SEQ ID NO: 8390
  Description of Artificial Sequence: Synthetic oligonucleotide

SEQ ID NO: 363524 - DNA, 25 bp, Artificial Sequence
  Description of Artificial Sequence: Synthetic oligonucleotide
tttccccgtccaagaagcggcccct

SEQ ID NO: 363525 - DNA, 29 bp, Artificial Sequence
  Description of Artificial Sequence: Synthetic oligonucleotide
ggatagagcaggagggtccggaatattgg

SEQ ID NO: 363526 - DNA, 24 bp, Artificial Sequence
  Description of Artificial Sequence: Synthetic oligonucleotide
ttccccgtccaagaagcggcccct

SEQ ID NO: 363527 - DNA, 29 bp, Artificial Sequence
  Description of Artificial Sequence: Synthetic oligonucleotide
gatagagcaggagggtccggaatattggg

SEQ ID NO: 363528 - DNA, 23 bp, Artificial Sequence
  Description of Artificial Sequence: Synthetic oligonucleotide
tccccgtccaagaagcggcccct

SEQ ID NO: 363529 - DNA, 30 bp, Artificial Sequence; identical to SEQ ID NO: 8393
  Description of Artificial Sequence: Synthetic oligonucleotide

SEQ ID NO: 363530 - DNA, 22 bp, Artificial Sequence
  Description of Artificial Sequence: Synthetic oligonucleotide
ccccgtccaagaagcggcccct

SEQ ID NO: 363531 - DNA, 29 bp, Artificial Sequence
  Description of Artificial Sequence: Synthetic oligonucleotide
tagagcaggagggtccggaatattgggac

SEQ ID NO: 363532 - DNA, 22 bp, Artificial Sequence
  Description of Artificial Sequence: Synthetic oligonucleotide
cccgtccaagaagcggcccctg

SEQ ID NO: 363533 - DNA, 28 bp, Artificial Sequence
  Description of Artificial Sequence: Synthetic oligonucleotide
agagcaggagggtccggaatattgggac

SEQ ID NO: 363534 - DNA, 23 bp, Artificial Sequence
  Description of Artificial Sequence: Synthetic oligonucleotide
ccgtccaagaagcggcccctgct

SEQ ID NO: 363535 - DNA, 27 bp, Artificial Sequence
  Description of Artificial Sequence: Synthetic oligonucleotide
gagcaggagggtccggaatattgggac

SEQ ID NO: 363536 - DNA, 23 bp, Artificial Sequence
  Description of Artificial Sequence: Synthetic oligonucleotide
cgtccaagaagcggcccctgctg

SEQ ID NO: 363537 - DNA, 27 bp, Artificial Sequence
  Description of Artificial Sequence: Synthetic oligonucleotide
agcaggagggtccggaatattgggacg

SEQ ID NO: 363538 - DNA, 24 bp, Artificial Sequence
  Description of Artificial Sequence: Synthetic oligonucleotide
gtccaagaagcggcccctgctgca

SEQ ID NO: 363539 - DNA, 26 bp, Artificial Sequence
  Description of Artificial Sequence: Synthetic oligonucleotide
gcaggagggtccggaatattgggacg

SEQ ID NO: 363540 - DNA, 24 bp, Artificial Sequence
  Description of Artificial Sequence: Synthetic oligonucleotide
tccaagaagcggcccctgctgcac

SEQ ID NO: 363541 - DNA, 26 bp, Artificial Sequence
  Description of Artificial Sequence: Synthetic oligonucleotide
caggagggtccggaatattgggacgg

SEQ ID NO: 363542 - DNA, 23 bp, Artificial Sequence
  Description of Artificial Sequence: Synthetic oligonucleotide
ccaagaagcggcccctgctgcac

SEQ ID NO: 363543 - DNA, 26 bp, Artificial Sequence
  Description of Artificial Sequence: Synthetic oligonucleotide
aggagggtccggaatattgggacggg

SEQ ID NO: 363544 - DNA, 24 bp, Artificial Sequence
  Description of Artificial Sequence: Synthetic oligonucleotide
caagaagcggcccctgctgcacca

SEQ ID NO: 363545 - DNA, 25 bp, Artificial Sequence
  Description of Artificial Sequence: Synthetic oligonucleotide
ggagggtccggaatattgggacggg

SEQ ID NO: 363546 - DNA, 26 bp, Artificial Sequence
  Description of Artificial Sequence: Synthetic oligonucleotide
aagaagcggcccctgctgcaccacaa

SEQ ID NO: 363547 - DNA, 26 bp, Artificial Sequence
  Description of Artificial Sequence: Synthetic oligonucleotide
gagggtccggaatattgggacgggga

SEQ ID NO: 363548 - DNA, 25 bp, Artificial Sequence
  Description of Artificial Sequence: Synthetic oligonucleotide
agaagcggcccctgctgcaccacaa

SEQ ID NO: 363549 - DNA, 27 bp, Artificial Sequence
  Description of Artificial Sequence: Synthetic oligonucleotide
agggtccggaatattgggacggggaga

SEQ ID NO: 363550 - DNA, 24 bp, Artificial Sequence
  Description of Artificial Sequence: Synthetic oligonucleotide
gaagcggcccctgctgcaccacaa

SEQ ID NO: 363551 - DNA, 26 bp, Artificial Sequence
  Description of Artificial Sequence: Synthetic oligonucleotide
gggtccggaatattgggacggggaga

SEQ ID NO: 363552 - DNA, 25 bp, Artificial Sequence
  Description of Artificial Sequence: Synthetic oligonucleotide
aagcggcccctgctgcaccacaact

SEQ ID NO: 363553 - DNA, 27 bp, Artificial Sequence
  Description of Artificial Sequence: Synthetic oligonucleotide
ggtccggaatattgggacggggagaca

SEQ ID NO: 363554 - DNA, 24 bp, Artificial Sequence
  Description of Artificial Sequence: Synthetic oligonucleotide
agcggcccctgctgcaccacaact

SEQ ID NO: 363555 - DNA, 27 bp, Artificial Sequence
  Description of Artificial Sequence: Synthetic oligonucleotide
gtccggaatattgggacggggagacac

SEQ ID NO: 363556 - DNA, 23 bp, Artificial Sequence
  Description of Artificial Sequence: Synthetic oligonucleotide
gcggcccctgctgcaccacaact

SEQ ID NO: 363557 - DNA, 27 bp, Artificial Sequence
  Description of Artificial Sequence: Synthetic oligonucleotide
tccggaatattgggacggggagacacg

SEQ ID NO: 363558 - DNA, 23 bp, Artificial Sequence
  Description of Artificial Sequence: Synthetic oligonucleotide
cggcccctgctgcaccacaactg

SEQ ID NO: 363559 - DNA, 26 bp, Artificial Sequence
  Description of Artificial Sequence: Synthetic oligonucleotide
ccggaatattgggacggggagacacg

SEQ ID NO: 363560 - DNA, 25 bp, Artificial Sequence
  Description of Artificial Sequence: Synthetic oligonucleotide
ggcccctgctgcaccacaactgctt

SEQ ID NO: 363561 - DNA, 27 bp, Artificial Sequence
  Description of Artificial Sequence: Synthetic oligonucleotide
cggaatattgggacggggagacacgga

SEQ ID NO: 363562 - DNA, 26 bp, Artificial Sequence
  Description of Artificial Sequence: Synthetic oligonucleotide
gcccctgctgcaccacaactgcttgt

SEQ ID NO: 363563 - DNA, 29 bp, Artificial Sequence
  Description of Artificial Sequence: Synthetic oligonucleotide
ggaatattgggacggggagacacggaaag

SEQ ID NO: 363564 - DNA, 27 bp, Artificial Sequence
  Description of Artificial Sequence: Synthetic oligonucleotide
cccctgctgcaccacaactgcttgtca

SEQ ID NO: 363565 - DNA, 30 bp, Artificial Sequence; identical to SEQ ID NO: 8411
  Description of Artificial Sequence: Synthetic oligonucleotide

SEQ ID NO: 363566 - DNA, 27 bp, Artificial Sequence
  Description of Artificial Sequence: Synthetic oligonucleotide
ccctgctgcaccacaactgcttgtcag

SEQ ID NO: 363567 - DNA, 32 bp, Artificial Sequence; identical to SEQ ID NO: 8412
  Description of Artificial Sequence: Synthetic oligonucleotide

SEQ ID NO: 363568 - DNA, 27 bp, Artificial Sequence
  Description of Artificial Sequence: Synthetic oligonucleotide
cctgctgcaccacaactgcttgtcagc

SEQ ID NO: 363569 - DNA, 31 bp, Artificial Sequence; identical to SEQ ID NO: 8413
  Description of Artificial Sequence: Synthetic oligonucleotide

SEQ ID NO: 363570 - DNA, 27 bp, Artificial Sequence
  Description of Artificial Sequence: Synthetic oligonucleotide
ctgctgcaccacaactgcttgtcagcc

SEQ ID NO: 363571 - DNA, 29 bp, Artificial Sequence
  Description of Artificial Sequence: Synthetic oligonucleotide
cctacgacggcaaggattacatcgccttg

SEQ ID NO: 363572 - DNA, 28 bp, Artificial Sequence
  Description of Artificial Sequence: Synthetic oligonucleotide
tgctgcaccacaactgcttgtcagccac

SEQ ID NO: 363573 - DNA, 31 bp, Artificial Sequence; identical to SEQ ID NO: 6530
  Description of Artificial Sequence: Synthetic oligonucleotide

SEQ ID NO: 363574 - DNA, 27 bp, Artificial Sequence
  Description of Artificial Sequence: Synthetic oligonucleotide
gctgcaccacaactgcttgtcagccac

SEQ ID NO: 363575 - DNA, 31 bp, Artificial Sequence; identical to SEQ ID NO: 6531
  Description of Artificial Sequence: Synthetic oligonucleotide

SEQ ID NO: 363576 - DNA, 27 bp, Artificial Sequence
  Description of Artificial Sequence: Synthetic oligonucleotide
ctgcaccacaactgcttgtcagccacg

SEQ ID NO: 363577 - DNA, 30 bp, Artificial Sequence; identical to SEQ ID NO: 6532
  Description of Artificial Sequence: Synthetic oligonucleotide

SEQ ID NO: 363578 - DNA, 28 bp, Artificial Sequence
  Description of Artificial Sequence: Synthetic oligonucleotide
tgcaccacaactgcttgtcagccacgtg

SEQ ID NO: 363579 - DNA, 29 bp, Artificial Sequence
  Description of Artificial Sequence: Synthetic oligonucleotide
cgacggcaaggattacatcgccttgaacg

SEQ ID NO: 363580 - DNA, 27 bp, Artificial Sequence
  Description of Artificial Sequence: Synthetic oligonucleotide
gcaccacaactgcttgtcagccacgtg

SEQ ID NO: 363581 - DNA, 30 bp, Artificial Sequence; identical to SEQ ID NO: 6534
  Description of Artificial Sequence: Synthetic oligonucleotide

SEQ ID NO: 363582 - DNA, 28 bp, Artificial Sequence
  Description of Artificial Sequence: Synthetic oligonucleotide
caccacaactgcttgtcagccacgtgag

SEQ ID NO: 363583 - DNA, 30 bp, Artificial Sequence; identical to SEQ ID NO: 6535
  Description of Artificial Sequence: Synthetic oligonucleotide

SEQ ID NO: 363584 - DNA, 29 bp, Artificial Sequence
  Description of Artificial Sequence: Synthetic oligonucleotide
accacaactgcttgtcagccacgtgagag

SEQ ID NO: 363585 - DNA, 29 bp, Artificial Sequence
  Description of Artificial Sequence: Synthetic oligonucleotide
cggcaaggattacatcgccttgaacgagg

SEQ ID NO: 363586 - DNA, 28 bp, Artificial Sequence
  Description of Artificial Sequence: Synthetic oligonucleotide
ccacaactgcttgtcagccacgtgagag

SEQ ID NO: 363587 - DNA, 30 bp, Artificial Sequence; identical to SEQ ID NO: 6537
  Description of Artificial Sequence: Synthetic oligonucleotide

SEQ ID NO: 363588 - DNA, 32 bp, Artificial Sequence; identical to SEQ ID NO: 236400
  Description of Artificial Sequence: Synthetic oligonucleotide

SEQ ID NO: 363589 - DNA, 30 bp, Artificial Sequence; identical to SEQ ID NO: 6538
  Description of Artificial Sequence: Synthetic oligonucleotide

SEQ ID NO: 363590 - DNA, 34 bp, Artificial Sequence; identical to SEQ ID NO: 236401
  Description of Artificial Sequence: Synthetic oligonucleotide

SEQ ID NO: 363591 - DNA, 31 bp, Artificial Sequence; identical to SEQ ID NO: 6539
  Description of Artificial Sequence: Synthetic oligonucleotide

SEQ ID NO: 363592 - DNA, 33 bp, Artificial Sequence; identical to SEQ ID NO: 236402
  Description of Artificial Sequence: Synthetic oligonucleotide

SEQ ID NO: 363593 - DNA, 31 bp, Artificial Sequence; identical to SEQ ID NO: 6540
  Description of Artificial Sequence: Synthetic oligonucleotide

SEQ ID NO: 363594 - DNA, 33 bp, Artificial Sequence; identical to SEQ ID NO: 236403
  Description of Artificial Sequence: Synthetic oligonucleotide

SEQ ID NO: 363595 - DNA, 30 bp, Artificial Sequence; identical to SEQ ID NO: 6541
  Description of Artificial Sequence: Synthetic oligonucleotide

SEQ ID NO: 363596 - DNA, 32 bp, Artificial Sequence; identical to SEQ ID NO: 236404
  Description of Artificial Sequence: Synthetic oligonucleotide

SEQ ID NO: 363597 - DNA, 29 bp, Artificial Sequence
  Description of Artificial Sequence: Synthetic oligonucleotide
ggattacatcgccttgaacgaggacctgc

SEQ ID NO: 363598 - DNA, 31 bp, Artificial Sequence; identical to SEQ ID NO: 236405
  Description of Artificial Sequence: Synthetic oligonucleotide

SEQ ID NO: 363599 - DNA, 29 bp, Artificial Sequence
  Description of Artificial Sequence: Synthetic oligonucleotide
gattacatcgccttgaacgaggacctgcg

SEQ ID NO: 363600 - DNA, 31 bp, Artificial Sequence; identical to SEQ ID NO: 236406
  Description of Artificial Sequence: Synthetic oligonucleotide

SEQ ID NO: 363601 - DNA, 29 bp, Artificial Sequence
  Description of Artificial Sequence: Synthetic oligonucleotide
attacatcgccttgaacgaggacctgcgc

SEQ ID NO: 363602 - DNA, 30 bp, Artificial Sequence; identical to SEQ ID NO: 236407
  Description of Artificial Sequence: Synthetic oligonucleotide

SEQ ID NO: 363603 - DNA, 28 bp, Artificial Sequence
  Description of Artificial Sequence: Synthetic oligonucleotide
ttacatcgccttgaacgaggacctgcgc

SEQ ID NO: 363604 - DNA, 31 bp, Artificial Sequence; identical to SEQ ID NO: 236408
  Description of Artificial Sequence: Synthetic oligonucleotide

SEQ ID NO: 363605 - DNA, 27 bp, Artificial Sequence
  Description of Artificial Sequence: Synthetic oligonucleotide
tacatcgccttgaacgaggacctgcgc

SEQ ID NO: 363606 - DNA, 31 bp, Artificial Sequence; identical to SEQ ID NO: 236409
  Description of Artificial Sequence: Synthetic oligonucleotide

SEQ ID NO: 363607 - DNA, 27 bp, Artificial Sequence
  Description of Artificial Sequence: Synthetic oligonucleotide
acatcgccttgaacgaggacctgcgct

SEQ ID NO: 363608 - DNA, 30 bp, Artificial Sequence; identical to SEQ ID NO: 236410
  Description of Artificial Sequence: Synthetic oligonucleotide

SEQ ID NO: 363609 - DNA, 26 bp, Artificial Sequence
  Description of Artificial Sequence: Synthetic oligonucleotide
catcgccttgaacgaggacctgcgct

SEQ ID NO: 363610 - DNA, 29 bp, Artificial Sequence
  Description of Artificial Sequence: Synthetic oligonucleotide
gtcagccacgtgagagatttctagccagg

SEQ ID NO: 363611 - DNA, 27 bp, Artificial Sequence
  Description of Artificial Sequence: Synthetic oligonucleotide
atcgccttgaacgaggacctgcgctct

SEQ ID NO: 363612 - DNA, 29 bp, Artificial Sequence
  Description of Artificial Sequence: Synthetic oligonucleotide
tcagccacgtgagagatttctagccaggc

SEQ ID NO: 363613 - DNA, 27 bp, Artificial Sequence
  Description of Artificial Sequence: Synthetic oligonucleotide
tcgccttgaacgaggacctgcgctctt

SEQ ID NO: 363614 - DNA, 28 bp, Artificial Sequence
  Description of Artificial Sequence: Synthetic oligonucleotide
cagccacgtgagagatttctagccaggc

SEQ ID NO: 363615 - DNA, 26 bp, Artificial Sequence
  Description of Artificial Sequence: Synthetic oligonucleotide
cgccttgaacgaggacctgcgctctt

SEQ ID NO: 363616 - DNA, 29 bp, Artificial Sequence
  Description of Artificial Sequence: Synthetic oligonucleotide
agccacgtgagagatttctagccaggcag

SEQ ID NO: 363617 - DNA, 26 bp, Artificial Sequence
  Description of Artificial Sequence: Synthetic oligonucleotide
gccttgaacgaggacctgcgctcttg

SEQ ID NO: 363618 - DNA, 28 bp, Artificial Sequence
  Description of Artificial Sequence: Synthetic oligonucleotide
gccacgtgagagatttctagccaggcag

SEQ ID NO: 363619 - DNA, 27 bp, Artificial Sequence
  Description of Artificial Sequence: Synthetic oligonucleotide
ccttgaacgaggacctgcgctcttgga

SEQ ID NO: 363620 - DNA, 28 bp, Artificial Sequence
  Description of Artificial Sequence: Synthetic oligonucleotide
ccacgtgagagatttctagccaggcagc

SEQ ID NO: 363621 - DNA, 27 bp, Artificial Sequence
  Description of Artificial Sequence: Synthetic oligonucleotide
cttgaacgaggacctgcgctcttggac

SEQ ID NO: 363622 - DNA, 31 bp, Artificial Sequence; identical to SEQ ID NO: 236417
  Description of Artificial Sequence: Synthetic oligonucleotide

SEQ ID NO: 363623 - DNA, 27 bp, Artificial Sequence
  Description of Artificial Sequence: Synthetic oligonucleotide
ttgaacgaggacctgcgctcttggacc

SEQ ID NO: 363624 - DNA, 33 bp, Artificial Sequence; identical to SEQ ID NO: 236418
  Description of Artificial Sequence: Synthetic oligonucleotide

SEQ ID NO: 363625 - DNA, 27 bp, Artificial Sequence
  Description of Artificial Sequence: Synthetic oligonucleotide
caagcacaagtgggagacggcccatgt

SEQ ID NO: 363626 - DNA, 32 bp, Artificial Sequence; identical to SEQ ID NO: 236419
  Description of Artificial Sequence: Synthetic oligonucleotide

SEQ ID NO: 363627 - DNA, 27 bp, Artificial Sequence
  Description of Artificial Sequence: Synthetic oligonucleotide
aagcacaagtgggagacggcccatgtg

SEQ ID NO: 363628 - DNA, 33 bp, Artificial Sequence; identical to SEQ ID NO: 236420
  Description of Artificial Sequence: Synthetic oligonucleotide

SEQ ID NO: 363629 - DNA, 26 bp, Artificial Sequence
  Description of Artificial Sequence: Synthetic oligonucleotide
agcacaagtgggagacggcccatgtg

SEQ ID NO: 363630 - DNA, 33 bp, Artificial Sequence; identical to SEQ ID NO: 236421
  Description of Artificial Sequence: Synthetic oligonucleotide

SEQ ID NO: 363631 - DNA, 25 bp, Artificial Sequence
  Description of Artificial Sequence: Synthetic oligonucleotide
gcacaagtgggagacggcccatgtg

SEQ ID NO: 363632 - DNA, 32 bp, Artificial Sequence; identical to SEQ ID NO: 236422
  Description of Artificial Sequence: Synthetic oligonucleotide

SEQ ID NO: 363633 - DNA, 25 bp, Artificial Sequence
  Description of Artificial Sequence: Synthetic oligonucleotide
cacaagtgggagacggcccatgtgg

SEQ ID NO: 363634 - DNA, 32 bp, Artificial Sequence; identical to SEQ ID NO: 236423
  Description of Artificial Sequence: Synthetic oligonucleotide

SEQ ID NO: 363635 - DNA, 25 bp, Artificial Sequence
  Description of Artificial Sequence: Synthetic oligonucleotide
acaagtgggagacggcccatgtggc

SEQ ID NO: 363636 - DNA, 31 bp, Artificial Sequence; identical to SEQ ID NO: 236424
  Description of Artificial Sequence: Synthetic oligonucleotide

SEQ ID NO: 363637 - DNA, 24 bp, Artificial Sequence
  Description of Artificial Sequence: Synthetic oligonucleotide
caagtgggagacggcccatgtggc

SEQ ID NO: 363638 - DNA, 33 bp, Artificial Sequence; identical to SEQ ID NO: 236425
  Description of Artificial Sequence: Synthetic oligonucleotide

SEQ ID NO: 363639 - DNA, 24 bp, Artificial Sequence
  Description of Artificial Sequence: Synthetic oligonucleotide
aagtgggagacggcccatgtggcg

SEQ ID NO: 363640 - DNA, 32 bp, Artificial Sequence; identical to SEQ ID NO: 236426
  Description of Artificial Sequence: Synthetic oligonucleotide

SEQ ID NO: 363641 - DNA, 23 bp, Artificial Sequence
  Description of Artificial Sequence: Synthetic oligonucleotide
agtgggagacggcccatgtggcg

SEQ ID NO: 363642 - DNA, 32 bp, Artificial Sequence; identical to SEQ ID NO: 236427
  Description of Artificial Sequence: Synthetic oligonucleotide

SEQ ID NO: 363643 - DNA, 22 bp, Artificial Sequence
  Description of Artificial Sequence: Synthetic oligonucleotide
gtgggagacggcccatgtggcg

SEQ ID NO: 363644 - DNA, 31 bp, Artificial Sequence; identical to SEQ ID NO: 236428
  Description of Artificial Sequence: Synthetic oligonucleotide

SEQ ID NO: 363645 - DNA, 23 bp, Artificial Sequence
  Description of Artificial Sequence: Synthetic oligonucleotide
tgggagacggcccatgtggcgga

SEQ ID NO: 363646 - DNA, 30 bp, Artificial Sequence; identical to SEQ ID NO: 236429
  Description of Artificial Sequence: Synthetic oligonucleotide

SEQ ID NO: 363647 - DNA, 22 bp, Artificial Sequence
  Description of Artificial Sequence: Synthetic oligonucleotide
gggagacggcccatgtggcgga

SEQ ID NO: 363648 - DNA, 29 bp, Artificial Sequence
  Description of Artificial Sequence: Synthetic oligonucleotide
tctagccaggcagctttcaagtcccatgg

SEQ ID NO: 363649 - DNA, 22 bp, Artificial Sequence
  Description of Artificial Sequence: Synthetic oligonucleotide
ggagacggcccatgtggcggag

SEQ ID NO: 363650 - DNA, 28 bp, Artificial Sequence
  Description of Artificial Sequence: Synthetic oligonucleotide
ctagccaggcagctttcaagtcccatgg

SEQ ID NO: 363651 - DNA, 23 bp, Artificial Sequence
  Description of Artificial Sequence: Synthetic oligonucleotide
gagacggcccatgtggcggagca

SEQ ID NO: 363652 - DNA, 30 bp, Artificial Sequence; identical to SEQ ID NO: 236432
  Description of Artificial Sequence: Synthetic oligonucleotide

SEQ ID NO: 363653 - DNA, 25 bp, Artificial Sequence
  Description of Artificial Sequence: Synthetic oligonucleotide
agacggcccatgtggcggagcagtt

SEQ ID NO: 363654 - DNA, 29 bp, Artificial Sequence
  Description of Artificial Sequence: Synthetic oligonucleotide
agccaggcagctttcaagtcccatggttc

SEQ ID NO: 363655 - DNA, 24 bp, Artificial Sequence
  Description of Artificial Sequence: Synthetic oligonucleotide
gacggcccatgtggcggagcagtt

SEQ ID NO: 363656 - DNA, 28 bp, Artificial Sequence
  Description of Artificial Sequence: Synthetic oligonucleotide
gccaggcagctttcaagtcccatggttc

SEQ ID NO: 363657 - DNA, 25 bp, Artificial Sequence
  Description of Artificial Sequence: Synthetic oligonucleotide
acggcccatgtggcggagcagttga

SEQ ID NO: 363658 - DNA, 28 bp, Artificial Sequence
  Description of Artificial Sequence: Synthetic oligonucleotide
ccaggcagctttcaagtcccatggttcc

SEQ ID NO: 363659 - DNA, 23 bp, Artificial Sequence
  Description of Artificial Sequence: Synthetic oligonucleotide
gcggcccatgaggcggagcagtt

SEQ ID NO: 363660 - DNA, 32 bp, Artificial Sequence; identical to SEQ ID NO: 236436
  Description of Artificial Sequence: Synthetic oligonucleotide

SEQ ID NO: 363661 - DNA, 24 bp, Artificial Sequence
  Description of Artificial Sequence: Synthetic oligonucleotide
cggcccatgaggcggagcagttga

SEQ ID NO: 363662 - DNA, 32 bp, Artificial Sequence; identical to SEQ ID NO: 236437
  Description of Artificial Sequence: Synthetic oligonucleotide

SEQ ID NO: 363663 - DNA, 25 bp, Artificial Sequence
  Description of Artificial Sequence: Synthetic oligonucleotide
ggcccatgaggcggagcagttgaga

SEQ ID NO: 363664 - DNA, 31 bp, Artificial Sequence; identical to SEQ ID NO: 236438
  Description of Artificial Sequence: Synthetic oligonucleotide

SEQ ID NO: 363665 - DNA, 25 bp, Artificial Sequence
  Description of Artificial Sequence: Synthetic oligonucleotide
gcccatgaggcggagcagttgagag

SEQ ID NO: 363666 - DNA, 32 bp, Artificial Sequence; identical to SEQ ID NO: 236439
  Description of Artificial Sequence: Synthetic oligonucleotide

SEQ ID NO: 363667 - DNA, 25 bp, Artificial Sequence
  Description of Artificial Sequence: Synthetic oligonucleotide
cccatgaggcggagcagttgagagc

SEQ ID NO: 363668 - DNA, 33 bp, Artificial Sequence; identical to SEQ ID NO: 236440
  Description of Artificial Sequence: Synthetic oligonucleotide

SEQ ID NO: 363669 - DNA, 27 bp, Artificial Sequence
  Description of Artificial Sequence: Synthetic oligonucleotide
ccatgaggcggagcagttgagagccta

SEQ ID NO: 363670 - DNA, 33 bp, Artificial Sequence; identical to SEQ ID NO: 236441
  Description of Artificial Sequence: Synthetic oligonucleotide

SEQ ID NO: 363671 - DNA, 27 bp, Artificial Sequence
  Description of Artificial Sequence: Synthetic oligonucleotide
catgaggcggagcagttgagagcctac

SEQ ID NO: 363672 - DNA, 32 bp, Artificial Sequence; identical to SEQ ID NO: 236442
  Description of Artificial Sequence: Synthetic oligonucleotide

SEQ ID NO: 363673 - DNA, 27 bp, Artificial Sequence
  Description of Artificial Sequence: Synthetic oligonucleotide
atgaggcggagcagttgagagcctacc

SEQ ID NO: 363674 - DNA, 33 bp, Artificial Sequence; identical to SEQ ID NO: 236443
  Description of Artificial Sequence: Synthetic oligonucleotide

SEQ ID NO: 363675 - DNA, 27 bp, Artificial Sequence
  Description of Artificial Sequence: Synthetic oligonucleotide
tgaggcggagcagttgagagcctacct

SEQ ID NO: 363676 - DNA, 33 bp, Artificial Sequence; identical to SEQ ID NO: 236444
  Description of Artificial Sequence: Synthetic oligonucleotide

SEQ ID NO: 363677 - DNA, 26 bp, Artificial Sequence
  Description of Artificial Sequence: Synthetic oligonucleotide
gaggcggagcagttgagagcctacct

SEQ ID NO: 363678 - DNA, 32 bp, Artificial Sequence; identical to SEQ ID NO: 236445
  Description of Artificial Sequence: Synthetic oligonucleotide

SEQ ID NO: 363679 - DNA, 26 bp, Artificial Sequence
  Description of Artificial Sequence: Synthetic oligonucleotide
aggcggagcagttgagagcctacctg

SEQ ID NO: 363680 - DNA, 31 bp, Artificial Sequence; identical to SEQ ID NO: 236446
  Description of Artificial Sequence: Synthetic oligonucleotide

SEQ ID NO: 363681 - DNA, 25 bp, Artificial Sequence
  Description of Artificial Sequence: Synthetic oligonucleotide
aagcacaagtgggaggcggcccatg

SEQ ID NO: 363682 - DNA, 30 bp, Artificial Sequence; identical to SEQ ID NO: 236447
  Description of Artificial Sequence: Synthetic oligonucleotide

SEQ ID NO: 363683 - DNA, 24 bp, Artificial Sequence
  Description of Artificial Sequence: Synthetic oligonucleotide
agcacaagtgggaggcggcccatg

SEQ ID NO: 363684 - DNA, 33 bp, Artificial Sequence; identical to SEQ ID NO: 236448
  Description of Artificial Sequence: Synthetic oligonucleotide

SEQ ID NO: 363685 - DNA, 23 bp, Artificial Sequence
  Description of Artificial Sequence: Synthetic oligonucleotide
gcacaagtgggaggcggcccatg

SEQ ID NO: 363686 - DNA, 32 bp, Artificial Sequence; identical to SEQ ID NO: 236449
  Description of Artificial Sequence: Synthetic oligonucleotide

SEQ ID NO: 363687 - DNA, 23 bp, Artificial Sequence
  Description of Artificial Sequence: Synthetic oligonucleotide
cacaagtgggaggcggcccatgc

SEQ ID NO: 363688 - DNA, 31 bp, Artificial Sequence; identical to SEQ ID NO: 236450
  Description of Artificial Sequence: Synthetic oligonucleotide

SEQ ID NO: 363689 - DNA, 23 bp, Artificial Sequence
  Description of Artificial Sequence: Synthetic oligonucleotide
acaagtgggaggcggcccatgcg

SEQ ID NO: 363690 - DNA, 32 bp, Artificial Sequence; identical to SEQ ID NO: 236451
  Description of Artificial Sequence: Synthetic oligonucleotide

SEQ ID NO: 363691 - DNA, 22 bp, Artificial Sequence
  Description of Artificial Sequence: Synthetic oligonucleotide
caagtgggaggcggcccatgcg

SEQ ID NO: 363692 - DNA, 31 bp, Artificial Sequence; identical to SEQ ID NO: 236452
  Description of Artificial Sequence: Synthetic oligonucleotide

SEQ ID NO: 363693 - DNA, 22 bp, Artificial Sequence
  Description of Artificial Sequence: Synthetic oligonucleotide
aagtgggaggcggcccatgcgg

SEQ ID NO: 363694 - DNA, 31 bp, Artificial Sequence; identical to SEQ ID NO: 236453
  Description of Artificial Sequence: Synthetic oligonucleotide

SEQ ID NO: 363695 - DNA, 21 bp, Artificial Sequence
  Description of Artificial Sequence: Synthetic oligonucleotide
agtgggaggcggcccatgcgg

SEQ ID NO: 363696 - DNA, 32 bp, Artificial Sequence; identical to SEQ ID NO: 236454
  Description of Artificial Sequence: Synthetic oligonucleotide

SEQ ID NO: 363697 - DNA, 20 bp, Artificial Sequence
  Description of Artificial Sequence: Synthetic oligonucleotide
gtgggaggcggcccatgcgg

SEQ ID NO: 363698 - DNA, 32 bp, Artificial Sequence; identical to SEQ ID NO: 236455
  Description of Artificial Sequence: Synthetic oligonucleotide

SEQ ID NO: 363699 - DNA, 20 bp, Artificial Sequence
  Description of Artificial Sequence: Synthetic oligonucleotide
tgggaggcggcccatgcggc

SEQ ID NO: 363700 - DNA, 31 bp, Artificial Sequence; identical to SEQ ID NO: 236456
  Description of Artificial Sequence: Synthetic oligonucleotide

SEQ ID NO: 363701 - DNA, 20 bp, Artificial Sequence
  Description of Artificial Sequence: Synthetic oligonucleotide
gggaggcggcccatgcggct

SEQ ID NO: 363702 - DNA, 30 bp, Artificial Sequence; identical to SEQ ID NO: 236457
  Description of Artificial Sequence: Synthetic oligonucleotide

SEQ ID NO: 363703 - DNA, 20 bp, Artificial Sequence
  Description of Artificial Sequence: Synthetic oligonucleotide
ggaggcggcccatgcggcgt

SEQ ID NO: 363704 - DNA, 30 bp, Artificial Sequence; identical to SEQ ID NO: 236458
  Description of Artificial Sequence: Synthetic oligonucleotide

SEQ ID NO: 363705 - DNA, 20 bp, Artificial Sequence
  Description of Artificial Sequence: Synthetic oligonucleotide
gaggcggcccatgcggcgga

SEQ ID NO: 363706 - DNA, 30 bp, Artificial Sequence; identical to SEQ ID NO: 236459
  Description of Artificial Sequence: Synthetic oligonucleotide

SEQ ID NO: 363707 - DNA, 20 bp, Artificial Sequence
  Description of Artificial Sequence: Synthetic oligonucleotide
aggcggcccatgcggcggag

SEQ ID NO: 363708 - DNA, 29 bp, Artificial Sequence
  Description of Artificial Sequence: Synthetic oligonucleotide
tcctaatggacagcaggaaacaggtgggg

SEQ ID NO: 363709 - DNA, 20 bp, Artificial Sequence
  Description of Artificial Sequence: Synthetic oligonucleotide
ggcggcccatgcggcggagt

SEQ ID NO: 363710 - DNA, 28 bp, Artificial Sequence
  Description of Artificial Sequence: Synthetic oligonucleotide
cctaatggacagcaggaaacaggtgggg

SEQ ID NO: 363711 - DNA, 20 bp, Artificial Sequence
  Description of Artificial Sequence: Synthetic oligonucleotide
gcggcccatgcggcggagca

SEQ ID NO: 363712 - DNA, 29 bp, Artificial Sequence
  Description of Artificial Sequence: Synthetic oligonucleotide
ctaatggacagcaggaaacaggtggggtc

SEQ ID NO: 363713 - DNA, 20 bp, Artificial Sequence
  Description of Artificial Sequence: Synthetic oligonucleotide
cggcccatgcggcggagcag

SEQ ID NO: 363714 - DNA, 29 bp, Artificial Sequence
  Description of Artificial Sequence: Synthetic oligonucleotide
taatggacagcaggaaacaggtggggtcg

SEQ ID NO: 363715 - DNA, 21 bp, Artificial Sequence
  Description of Artificial Sequence: Synthetic oligonucleotide
ggcccatgcggcggagcagca

SEQ ID NO: 363716 - DNA, 28 bp, Artificial Sequence
  Description of Artificial Sequence: Synthetic oligonucleotide
aatggacagcaggaaacaggtggggtcg

SEQ ID NO: 363717 - DNA, 22 bp, Artificial Sequence
  Description of Artificial Sequence: Synthetic oligonucleotide
gcccatgcggcggagcagcaga

SEQ ID NO: 363718 - DNA, 27 bp, Artificial Sequence
  Description of Artificial Sequence: Synthetic oligonucleotide
atggacagcaggaaacaggtggggtcg

SEQ ID NO: 363719 - DNA, 23 bp, Artificial Sequence
  Description of Artificial Sequence: Synthetic oligonucleotide
cccatgcggcggagcagcagaga

SEQ ID NO: 363720 - DNA, 27 bp, Artificial Sequence
  Description of Artificial Sequence: Synthetic oligonucleotide
tggacagcaggaaacaggtggggtcgt

SEQ ID NO: 363721 - DNA, 23 bp, Artificial Sequence
  Description of Artificial Sequence: Synthetic oligonucleotide
ccatgcggcggagcagcagagag

SEQ ID NO: 363722 - DNA, 26 bp, Artificial Sequence
  Description of Artificial Sequence: Synthetic oligonucleotide
ggacagcaggaaacaggtggggtcgt

SEQ ID NO: 363723 - DNA, 23 bp, Artificial Sequence
  Description of Artificial Sequence: Synthetic oligonucleotide
catgcggcggagcagcagagagc

SEQ ID NO: 363724 - DNA, 27 bp, Artificial Sequence
  Description of Artificial Sequence: Synthetic oligonucleotide
gacagcaggaaacaggtggggtcgtct

SEQ ID NO: 363725 - DNA, 25 bp, Artificial Sequence
  Description of Artificial Sequence: Synthetic oligonucleotide
atgcggcggagcagcagagagccta

SEQ ID NO: 363726 - DNA, 27 bp, Artificial Sequence
  Description of Artificial Sequence: Synthetic oligonucleotide
acagcaggaaacaggtggggtcgtctc

SEQ ID NO: 363727 - DNA, 24 bp, Artificial Sequence
  Description of Artificial Sequence: Synthetic oligonucleotide
tgcggcggagcagcagagagccta

SEQ ID NO: 363728 - DNA, 26 bp, Artificial Sequence
  Description of Artificial Sequence: Synthetic oligonucleotide
cagcaggaaacaggtggggtcgtctc

SEQ ID NO: 363729 - DNA, 23 bp, Artificial Sequence
  Description of Artificial Sequence: Synthetic oligonucleotide
gcggcggagcagcagagagccta

SEQ ID NO: 363730 - DNA, 27 bp, Artificial Sequence
  Description of Artificial Sequence: Synthetic oligonucleotide
agcaggaaacaggtggggtcgtctcca

SEQ ID NO: 363731 - DNA, 23 bp, Artificial Sequence
  Description of Artificial Sequence: Synthetic oligonucleotide
cggcggagcagcagagagcctac

SEQ ID NO: 363732 - DNA, 26 bp, Artificial Sequence
  Description of Artificial Sequence: Synthetic oligonucleotide
gcaggaaacaggtggggtcgtctcca

SEQ ID NO: 363733 - DNA, 23 bp, Artificial Sequence
  Description of Artificial Sequence: Synthetic oligonucleotide
ccagacctgggcgggctctcagt

SEQ ID NO: 363734 - DNA, 26 bp, Artificial Sequence
  Description of Artificial Sequence: Synthetic oligonucleotide
caggaaacaggtggggtcgtctccac

SEQ ID NO: 363735 - DNA, 23 bp, Artificial Sequence
  Description of Artificial Sequence: Synthetic oligonucleotide
cagacctgggcgggctctcagtc

SEQ ID NO: 363736 - DNA, 27 bp, Artificial Sequence
  Description of Artificial Sequence: Synthetic oligonucleotide
aggaaacaggtggggtcgtctccacca

SEQ ID NO: 363737 - DNA, 25 bp, Artificial Sequence
  Description of Artificial Sequence: Synthetic oligonucleotide
agacctgggcgggctctcagtccat

SEQ ID NO: 363738 - DNA, 27 bp, Artificial Sequence
  Description of Artificial Sequence: Synthetic oligonucleotide
ggaaacaggtggggtcgtctccaccaa

SEQ ID NO: 363739 - DNA, 24 bp, Artificial Sequence
  Description of Artificial Sequence: Synthetic oligonucleotide
gacctgggcgggctctcagtccat

SEQ ID NO: 363740 - DNA, 27 bp, Artificial Sequence
  Description of Artificial Sequence: Synthetic oligonucleotide
gaaacaggtggggtcgtctccaccaac

SEQ ID NO: 363741 - DNA, 25 bp, Artificial Sequence
  Description of Artificial Sequence: Synthetic oligonucleotide
acctgggcgggctctcagtccatga

SEQ ID NO: 363742 - DNA, 27 bp, Artificial Sequence
  Description of Artificial Sequence: Synthetic oligonucleotide
aaacaggtggggtcgtctccaccaacg

SEQ ID NO: 363743 - DNA, 24 bp, Artificial Sequence
  Description of Artificial Sequence: Synthetic oligonucleotide
cctgggcgggctctcagtccatga

SEQ ID NO: 363744 - DNA, 27 bp, Artificial Sequence
  Description of Artificial Sequence: Synthetic oligonucleotide
aacaggtggggtcgtctccaccaacgt

SEQ ID NO: 363745 - DNA, 24 bp, Artificial Sequence
  Description of Artificial Sequence: Synthetic oligonucleotide
ctgggcgggctctcagtccatgag

SEQ ID NO: 363746 - DNA, 26 bp, Artificial Sequence
  Description of Artificial Sequence: Synthetic oligonucleotide
acaggtggggtcgtctccaccaacgt

SEQ ID NO: 363747 - DNA, 27 bp, Artificial Sequence
  Description of Artificial Sequence: Synthetic oligonucleotide
tgggcgggctctcagtccatgaggtat

SEQ ID NO: 363748 - DNA, 25 bp, Artificial Sequence
  Description of Artificial Sequence: Synthetic oligonucleotide
caggtggggtcgtctccaccaacgt

SEQ ID NO: 363749 - DNA, 27 bp, Artificial Sequence
  Description of Artificial Sequence: Synthetic oligonucleotide
gggcgggctctcagtccatgaggtatt

SEQ ID NO: 363750 - DNA, 27 bp, Artificial Sequence
  Description of Artificial Sequence: Synthetic oligonucleotide
aggtggggtcgtctccaccaacgtgat

SEQ ID NO: 363751 - DNA, 28 bp, Artificial Sequence
  Description of Artificial Sequence: Synthetic oligonucleotide
ggcgggctctcagtccatgaggtatttc

SEQ ID NO: 363752 - DNA, 26 bp, Artificial Sequence
  Description of Artificial Sequence: Synthetic oligonucleotide
ggtggggtcgtctccaccaacgtgat

SEQ ID NO: 363753 - DNA, 30 bp, Artificial Sequence; identical to SEQ ID NO: 9313
  Description of Artificial Sequence: Synthetic oligonucleotide

SEQ ID NO: 363754 - DNA, 26 bp, Artificial Sequence
  Description of Artificial Sequence: Synthetic oligonucleotide
gtggggtcgtctccaccaacgtgatc

SEQ ID NO: 363755 - DNA, 31 bp, Artificial Sequence; identical to SEQ ID NO: 9314
  Description of Artificial Sequence: Synthetic oligonucleotide

SEQ ID NO: 363756 - DNA, 26 bp, Artificial Sequence
  Description of Artificial Sequence: Synthetic oligonucleotide
tggggtcgtctccaccaacgtgatcc

SEQ ID NO: 363757 - DNA, 33 bp, Artificial Sequence; identical to SEQ ID NO: 9315
  Description of Artificial Sequence: Synthetic oligonucleotide

SEQ ID NO: 363758 - DNA, 25 bp, Artificial Sequence
  Description of Artificial Sequence: Synthetic oligonucleotide
ggggtcgtctccaccaacgtgatcc

SEQ ID NO: 363759 - DNA, 33 bp, Artificial Sequence; identical to SEQ ID NO: 9316
  Description of Artificial Sequence: Synthetic oligonucleotide

SEQ ID NO: 363760 - DNA, 27 bp, Artificial Sequence
  Description of Artificial Sequence: Synthetic oligonucleotide
gggtcgtctccaccaacgtgatccgta

SEQ ID NO: 363761 - DNA, 33 bp, Artificial Sequence; identical to SEQ ID NO: 9317
  Description of Artificial Sequence: Synthetic oligonucleotide

SEQ ID NO: 363762 - DNA, 29 bp, Artificial Sequence
  Description of Artificial Sequence: Synthetic oligonucleotide
ggtcgtctccaccaacgtgatccgtattg

SEQ ID NO: 363763 - DNA, 34 bp, Artificial Sequence; identical to SEQ ID NO: 9318
  Description of Artificial Sequence: Synthetic oligonucleotide

SEQ ID NO: 363764 - DNA, 29 bp, Artificial Sequence
  Description of Artificial Sequence: Synthetic oligonucleotide
gtcgtctccaccaacgtgatccgtattgg

SEQ ID NO: 363765 - DNA, 35 bp, Artificial Sequence; identical to SEQ ID NO: 9319
  Description of Artificial Sequence: Synthetic oligonucleotide

SEQ ID NO: 363766 - DNA, 30 bp, Artificial Sequence; identical to SEQ ID NO: 236489
  Description of Artificial Sequence: Synthetic oligonucleotide

SEQ ID NO: 363767 - DNA, 34 bp, Artificial Sequence; identical to SEQ ID NO: 9320
  Description of Artificial Sequence: Synthetic oligonucleotide

SEQ ID NO: 363768 - DNA, 29 bp, Artificial Sequence
  Description of Artificial Sequence: Synthetic oligonucleotide
cgtctccaccaacgtgatccgtattggag

SEQ ID NO: 363769 - DNA, 34 bp, Artificial Sequence; identical to SEQ ID NO: 9321
  Description of Artificial Sequence: Synthetic oligonucleotide

SEQ ID NO: 363770 - DNA, 30 bp, Artificial Sequence; identical to SEQ ID NO: 236491
  Description of Artificial Sequence: Synthetic oligonucleotide

SEQ ID NO: 363771 - DNA, 33 bp, Artificial Sequence; identical to SEQ ID NO: 9322
  Description of Artificial Sequence: Synthetic oligonucleotide

SEQ ID NO: 363772 - DNA, 31 bp, Artificial Sequence; identical to SEQ ID NO: 236492
  Description of Artificial Sequence: Synthetic oligonucleotide

SEQ ID NO: 363773 - DNA, 33 bp, Artificial Sequence; identical to SEQ ID NO: 9323
  Description of Artificial Sequence: Synthetic oligonucleotide

SEQ ID NO: 363774 - DNA, 30 bp, Artificial Sequence; identical to SEQ ID NO: 236493
  Description of Artificial Sequence: Synthetic oligonucleotide

SEQ ID NO: 363775 - DNA, 32 bp, Artificial Sequence; identical to SEQ ID NO: 9324
  Description of Artificial Sequence: Synthetic oligonucleotide

SEQ ID NO: 363776 - DNA, 31 bp, Artificial Sequence; identical to SEQ ID NO: 236494
  Description of Artificial Sequence: Synthetic oligonucleotide

SEQ ID NO: 363777 - DNA, 27 bp, Artificial Sequence
  Description of Artificial Sequence: Synthetic oligonucleotide
gggagacacggaaagtgaaggcccagt

SEQ ID NO: 363778 - DNA, 30 bp, Artificial Sequence; identical to SEQ ID NO: 236495
  Description of Artificial Sequence: Synthetic oligonucleotide

SEQ ID NO: 363779 - DNA, 27 bp, Artificial Sequence
  Description of Artificial Sequence: Synthetic oligonucleotide
ggagacacggaaagtgaaggcccagtc

SEQ ID NO: 363780 - DNA, 30 bp, Artificial Sequence; identical to SEQ ID NO: 236496
  Description of Artificial Sequence: Synthetic oligonucleotide

SEQ ID NO: 363781 - DNA, 28 bp, Artificial Sequence
  Description of Artificial Sequence: Synthetic oligonucleotide
gagacacggaaagtgaaggcccagtcac

SEQ ID NO: 363782 - DNA, 32 bp, Artificial Sequence; identical to SEQ ID NO: 236497
  Description of Artificial Sequence: Synthetic oligonucleotide

SEQ ID NO: 363783 - DNA, 29 bp, Artificial Sequence
  Description of Artificial Sequence: Synthetic oligonucleotide
agacacggaaagtgaaggcccagtcacag

SEQ ID NO: 363784 - DNA, 31 bp, Artificial Sequence; identical to SEQ ID NO: 236498
  Description of Artificial Sequence: Synthetic oligonucleotide

SEQ ID NO: 363785 - DNA, 28 bp, Artificial Sequence
  Description of Artificial Sequence: Synthetic oligonucleotide
gacacggaaagtgaaggcccagtcacag

SEQ ID NO: 363786 - DNA, 31 bp, Artificial Sequence; identical to SEQ ID NO: 236499
  Description of Artificial Sequence: Synthetic oligonucleotide

SEQ ID NO: 363787 - DNA, 29 bp, Artificial Sequence
  Description of Artificial Sequence: Synthetic oligonucleotide
acacggaaagtgaaggcccagtcacagac

SEQ ID NO: 363788 - DNA, 32 bp, Artificial Sequence; identical to SEQ ID NO: 236500
  Description of Artificial Sequence: Synthetic oligonucleotide

SEQ ID NO: 363789 - DNA, 28 bp, Artificial Sequence
  Description of Artificial Sequence: Synthetic oligonucleotide
cacggaaagtgaaggcccagtcacagac

SEQ ID NO: 363790 - DNA, 31 bp, Artificial Sequence; identical to SEQ ID NO: 236501
  Description of Artificial Sequence: Synthetic oligonucleotide

SEQ ID NO: 363791 - DNA, 29 bp, Artificial Sequence
  Description of Artificial Sequence: Synthetic oligonucleotide
acggaaagtgaaggcccagtcacagactc

SEQ ID NO: 363792 - DNA, 30 bp, Artificial Sequence; identical to SEQ ID NO: 236502
  Description of Artificial Sequence: Synthetic oligonucleotide

SEQ ID NO: 363793 - DNA, 28 bp, Artificial Sequence
  Description of Artificial Sequence: Synthetic oligonucleotide
cggaaagtgaaggcccagtcacagactc

SEQ ID NO: 363794 - DNA, 32 bp, Artificial Sequence; identical to SEQ ID NO: 236503
  Description of Artificial Sequence: Synthetic oligonucleotide

SEQ ID NO: 363795 - DNA, 29 bp, Artificial Sequence
  Description of Artificial Sequence: Synthetic oligonucleotide
ggaaagtgaaggcccagtcacagactcac

SEQ ID NO: 363796 - DNA, 32 bp, Artificial Sequence; identical to SEQ ID NO: 236504
  Description of Artificial Sequence: Synthetic oligonucleotide

SEQ ID NO: 363797 - DNA, 29 bp, Artificial Sequence
  Description of Artificial Sequence: Synthetic oligonucleotide
gaaagtgaaggcccagtcacagactcacc

SEQ ID NO: 363798 - DNA, 31 bp, Artificial Sequence; identical to SEQ ID NO: 236505
  Description of Artificial Sequence: Synthetic oligonucleotide

SEQ ID NO: 363799 - DNA, 29 bp, Artificial Sequence
  Description of Artificial Sequence: Synthetic oligonucleotide
aaagtgaaggcccagtcacagactcaccg

SEQ ID NO: 363800 - DNA, 32 bp, Artificial Sequence; identical to SEQ ID NO: 236506
  Description of Artificial Sequence: Synthetic oligonucleotide

SEQ ID NO: 363801 - DNA, 28 bp, Artificial Sequence
  Description of Artificial Sequence: Synthetic oligonucleotide
aagtgaaggcccagtcacagactcaccg

SEQ ID NO: 363802 - DNA, 31 bp, Artificial Sequence; identical to SEQ ID NO: 236507
  Description of Artificial Sequence: Synthetic oligonucleotide

SEQ ID NO: 363803 - DNA, 27 bp, Artificial Sequence
  Description of Artificial Sequence: Synthetic oligonucleotide
agtgaaggcccagtcacagactcaccg

SEQ ID NO: 363804 - DNA, 30 bp, Artificial Sequence; identical to SEQ ID NO: 236508
  Description of Artificial Sequence: Synthetic oligonucleotide

SEQ ID NO: 363805 - DNA, 27 bp, Artificial Sequence
  Description of Artificial Sequence: Synthetic oligonucleotide
gtgaaggcccagtcacagactcaccga

SEQ ID NO: 363806 - DNA, 30 bp, Artificial Sequence; identical to SEQ ID NO: 236509
  Description of Artificial Sequence: Synthetic oligonucleotide

SEQ ID NO: 363807 - DNA, 27 bp, Artificial Sequence
  Description of Artificial Sequence: Synthetic oligonucleotide
tgaaggcccagtcacagactcaccgag

SEQ ID NO: 363808 - DNA, 31 bp, Artificial Sequence; identical to SEQ ID NO: 236510
  Description of Artificial Sequence: Synthetic oligonucleotide

SEQ ID NO: 363809 - DNA, 27 bp, Artificial Sequence
  Description of Artificial Sequence: Synthetic oligonucleotide
gaaggcccagtcacagactcaccgagt

SEQ ID NO: 363810 - DNA, 33 bp, Artificial Sequence; identical to SEQ ID NO: 236511
  Description of Artificial Sequence: Synthetic oligonucleotide

SEQ ID NO: 363811 - DNA, 27 bp, Artificial Sequence
  Description of Artificial Sequence: Synthetic oligonucleotide
aaggcccagtcacagactcaccgagtg

SEQ ID NO: 363812 - DNA, 32 bp, Artificial Sequence; identical to SEQ ID NO: 236512
  Description of Artificial Sequence: Synthetic oligonucleotide

SEQ ID NO: 363813 - DNA, 26 bp, Artificial Sequence
  Description of Artificial Sequence: Synthetic oligonucleotide
aggcccagtcacagactcaccgagtg

SEQ ID NO: 363814 - DNA, 31 bp, Artificial Sequence; identical to SEQ ID NO: 236513
  Description of Artificial Sequence: Synthetic oligonucleotide

SEQ ID NO: 363815 - DNA, 25 bp, Artificial Sequence
  Description of Artificial Sequence: Synthetic oligonucleotide
ggcccagtcacagactcaccgagtg

SEQ ID NO: 363816 - DNA, 30 bp, Artificial Sequence; identical to SEQ ID NO: 236514
  Description of Artificial Sequence: Synthetic oligonucleotide

SEQ ID NO: 363817 - DNA, 26 bp, Artificial Sequence
  Description of Artificial Sequence: Synthetic oligonucleotide
gcccagtcacagactcaccgagtgga

SEQ ID NO: 363818 - DNA, 29 bp, Artificial Sequence
  Description of Artificial Sequence: Synthetic oligonucleotide
ggagactgaccttccagttcctggtgaag

SEQ ID NO: 363819 - DNA, 26 bp, Artificial Sequence
  Description of Artificial Sequence: Synthetic oligonucleotide
cccagtcacagactcaccgagtggac

SEQ ID NO: 363820 - DNA, 29 bp, Artificial Sequence
  Description of Artificial Sequence: Synthetic oligonucleotide
gagactgaccttccagttcctggtgaagc

SEQ ID NO: 363821 - DNA, 27 bp, Artificial Sequence
  Description of Artificial Sequence: Synthetic oligonucleotide
ccagtcacagactcaccgagtggacct

SEQ ID NO: 363822 - DNA, 30 bp, Artificial Sequence; identical to SEQ ID NO: 236517
  Description of Artificial Sequence: Synthetic oligonucleotide

SEQ ID NO: 363823 - DNA, 27 bp, Artificial Sequence
  Description of Artificial Sequence: Synthetic oligonucleotide
cagtcacagactcaccgagtggacctg

SEQ ID NO: 363824 - DNA, 29 bp, Artificial Sequence
  Description of Artificial Sequence: Synthetic oligonucleotide
gactgaccttccagttcctggtgaagctg

SEQ ID NO: 363825 - DNA, 27 bp, Artificial Sequence
  Description of Artificial Sequence: Synthetic oligonucleotide
agtcacagactcaccgagtggacctgg

SEQ ID NO: 363826 - DNA, 29 bp, Artificial Sequence
  Description of Artificial Sequence: Synthetic oligonucleotide
actgaccttccagttcctggtgaagctgg

SEQ ID NO: 363827 - DNA, 26 bp, Artificial Sequence
  Description of Artificial Sequence: Synthetic oligonucleotide
gtcacagactcaccgagtggacctgg

SEQ ID NO: 363828 - DNA, 28 bp, Artificial Sequence
  Description of Artificial Sequence: Synthetic oligonucleotide
ctgaccttccagttcctggtgaagctgg

SEQ ID NO: 363829 - DNA, 23 bp, Artificial Sequence
  Description of Artificial Sequence: Synthetic oligonucleotide
agacggcccatgaggcggagcag

SEQ ID NO: 363830 - DNA, 32 bp, Artificial Sequence; identical to SEQ ID NO: 236521
  Description of Artificial Sequence: Synthetic oligonucleotide

SEQ ID NO: 363831 - DNA, 22 bp, Artificial Sequence
  Description of Artificial Sequence: Synthetic oligonucleotide
gacggcccatgaggcggagcag

SEQ ID NO: 363832 - DNA, 31 bp, Artificial Sequence; identical to SEQ ID NO: 236522
  Description of Artificial Sequence: Synthetic oligonucleotide

SEQ ID NO: 363833 - DNA, 23 bp, Artificial Sequence
  Description of Artificial Sequence: Synthetic oligonucleotide
acggcccatgaggcggagcagca

SEQ ID NO: 363834 - DNA, 32 bp, Artificial Sequence; identical to SEQ ID NO: 236523
  Description of Artificial Sequence: Synthetic oligonucleotide

SEQ ID NO: 363835 - DNA, 24 bp, Artificial Sequence
  Description of Artificial Sequence: Synthetic oligonucleotide
cagcagagagcctacctggagggc

SEQ ID NO: 363836 - DNA, 31 bp, Artificial Sequence; identical to SEQ ID NO: 236524
  Description of Artificial Sequence: Synthetic oligonucleotide

SEQ ID NO: 363837 - DNA, 24 bp, Artificial Sequence
  Description of Artificial Sequence: Synthetic oligonucleotide
agcagagagcctacctggagggcc

SEQ ID NO: 363838 - DNA, 31 bp, Artificial Sequence; identical to SEQ ID NO: 236525
  Description of Artificial Sequence: Synthetic oligonucleotide

SEQ ID NO: 363839 - DNA, 23 bp, Artificial Sequence
  Description of Artificial Sequence: Synthetic oligonucleotide
gcagagagcctacctggagggcc

SEQ ID NO: 363840 - DNA, 31 bp, Artificial Sequence; identical to SEQ ID NO: 236526
  Description of Artificial Sequence: Synthetic oligonucleotide

SEQ ID NO: 363841 - DNA, 23 bp, Artificial Sequence
  Description of Artificial Sequence: Synthetic oligonucleotide
cagagagcctacctggagggccg

SEQ ID NO: 363842 - DNA, 30 bp, Artificial Sequence; identical to SEQ ID NO: 236527
  Description of Artificial Sequence: Synthetic oligonucleotide

SEQ ID NO: 363843 - DNA, 24 bp, Artificial Sequence
  Description of Artificial Sequence: Synthetic oligonucleotide
agagagcctacctggagggccggt

SEQ ID NO: 363844 - DNA, 29 bp, Artificial Sequence
  Description of Artificial Sequence: Synthetic oligonucleotide
ccagttcctggtgaagctggaaatcaccc

SEQ ID NO: 363845 - DNA, 23 bp, Artificial Sequence
  Description of Artificial Sequence: Synthetic oligonucleotide
gagagcctacctggagggccggt

SEQ ID NO: 363846 - DNA, 29 bp, Artificial Sequence
  Description of Artificial Sequence: Synthetic oligonucleotide
cagttcctggtgaagctggaaatcacccc

SEQ ID NO: 363847 - DNA, 23 bp, Artificial Sequence
  Description of Artificial Sequence: Synthetic oligonucleotide
agagcctacctggagggccggtg

SEQ ID NO: 363848 - DNA, 29 bp, Artificial Sequence
  Description of Artificial Sequence: Synthetic oligonucleotide
agttcctggtgaagctggaaatcaccccc

SEQ ID NO: 363849 - DNA, 22 bp, Artificial Sequence
  Description of Artificial Sequence: Synthetic oligonucleotide
gagcctacctggagggccggtg

SEQ ID NO: 363850 - DNA, 28 bp, Artificial Sequence
  Description of Artificial Sequence: Synthetic oligonucleotide
gttcctggtgaagctggaaatcaccccc

SEQ ID NO: 363851 - DNA, 22 bp, Artificial Sequence
  Description of Artificial Sequence: Synthetic oligonucleotide
agcctacctggagggccggtgc

SEQ ID NO: 363852 - DNA, 28 bp, Artificial Sequence
  Description of Artificial Sequence: Synthetic oligonucleotide
ttcctggtgaagctggaaatcacccccc

SEQ ID NO: 363853 - DNA, 21 bp, Artificial Sequence
  Description of Artificial Sequence: Synthetic oligonucleotide
gcctacctggagggccggtgc

SEQ ID NO: 363854 - DNA, 27 bp, Artificial Sequence
  Description of Artificial Sequence: Synthetic oligonucleotide
tcctggtgaagctggaaatcacccccc

SEQ ID NO: 363855 - DNA, 22 bp, Artificial Sequence
  Description of Artificial Sequence: Synthetic oligonucleotide
cctacctggagggccggtgcgt

SEQ ID NO: 363856 - DNA, 27 bp, Artificial Sequence
  Description of Artificial Sequence: Synthetic oligonucleotide
cctggtgaagctggaaatcacccccca

SEQ ID NO: 363857 - DNA, 22 bp, Artificial Sequence
  Description of Artificial Sequence: Synthetic oligonucleotide
ctggagggccggtgcgtggagt

SEQ ID NO: 363858 - DNA, 27 bp, Artificial Sequence
  Description of Artificial Sequence: Synthetic oligonucleotide
ctggtgaagctggaaatcaccccccag

SEQ ID NO: 363859 - DNA, 22 bp, Artificial Sequence
  Description of Artificial Sequence: Synthetic oligonucleotide
tggagggccggtgcgtggagtg

SEQ ID NO: 363860 - DNA, 27 bp, Artificial Sequence
  Description of Artificial Sequence: Synthetic oligonucleotide
tggtgaagctggaaatcaccccccagg

SEQ ID NO: 363861 - DNA, 21 bp, Artificial Sequence
  Description of Artificial Sequence: Synthetic oligonucleotide
ggagggccggtgcgtggagtg

SEQ ID NO: 363862 - DNA, 27 bp, Artificial Sequence
  Description of Artificial Sequence: Synthetic oligonucleotide
ggtgaagctggaaatcaccccccagga

SEQ ID NO: 363863 - DNA, 21 bp, Artificial Sequence
  Description of Artificial Sequence: Synthetic oligonucleotide
gagggccggtgcgtggagtgg

SEQ ID NO: 363864 - DNA, 27 bp, Artificial Sequence
  Description of Artificial Sequence: Synthetic oligonucleotide
gtgaagctggaaatcaccccccaggag

SEQ ID NO: 363865 - DNA, 22 bp, Artificial Sequence
  Description of Artificial Sequence: Synthetic oligonucleotide
agggccggtgcgtggagtggct

SEQ ID NO: 363866 - DNA, 27 bp, Artificial Sequence
  Description of Artificial Sequence: Synthetic oligonucleotide
tgaagctggaaatcaccccccaggagg

SEQ ID NO: 363867 - DNA, 21 bp, Artificial Sequence
  Description of Artificial Sequence: Synthetic oligonucleotide
gggccggtgcgtggagtggct

SEQ ID NO: 363868 - DNA, 26 bp, Artificial Sequence
  Description of Artificial Sequence: Synthetic oligonucleotide
gaagctggaaatcaccccccaggagg

SEQ ID NO: 363869 - DNA, 21 bp, Artificial Sequence
  Description of Artificial Sequence: Synthetic oligonucleotide
ggccggtgcgtggagtggctc

SEQ ID NO: 363870 - DNA, 27 bp, Artificial Sequence
  Description of Artificial Sequence: Synthetic oligonucleotide
aagctggaaatcaccccccaggaggga

SEQ ID NO: 363871 - DNA, 21 bp, Artificial Sequence
  Description of Artificial Sequence: Synthetic oligonucleotide
gccggtgcgtggagtggctcc

SEQ ID NO: 363872 - DNA, 26 bp, Artificial Sequence
  Description of Artificial Sequence: Synthetic oligonucleotide
agctggaaatcaccccccaggaggga

SEQ ID NO: 363873 - DNA, 21 bp, Artificial Sequence
  Description of Artificial Sequence: Synthetic oligonucleotide
ccggtgcgtggagtggctccg

SEQ ID NO: 363874 - DNA, 25 bp, Artificial Sequence
  Description of Artificial Sequence: Synthetic oligonucleotide
gctggaaatcaccccccaggaggga

SEQ ID NO: 363875 - DNA, 22 bp, Artificial Sequence
  Description of Artificial Sequence: Synthetic oligonucleotide
cggtgcgtggagtggctccgca

SEQ ID NO: 363876 - DNA, 26 bp, Artificial Sequence
  Description of Artificial Sequence: Synthetic oligonucleotide
ctggaaatcaccccccaggagggaga

SEQ ID NO: 363877 - DNA, 25 bp, Artificial Sequence
  Description of Artificial Sequence: Synthetic oligonucleotide
ggtgcgtggagtggctccgcagata

SEQ ID NO: 363878 - DNA, 26 bp, Artificial Sequence
  Description of Artificial Sequence: Synthetic oligonucleotide
tggaaatcaccccccaggagggagac

SEQ ID NO: 363879 - DNA, 22 bp, Artificial Sequence
  Description of Artificial Sequence: Synthetic oligonucleotide
cgcggggagccccgcttcatct

SEQ ID NO: 363880 - DNA, 25 bp, Artificial Sequence
  Description of Artificial Sequence: Synthetic oligonucleotide
ggaaatcaccccccaggagggagac

SEQ ID NO: 363881 - DNA, 23 bp, Artificial Sequence
  Description of Artificial Sequence: Synthetic oligonucleotide
gcggggagccccgcttcatctca

SEQ ID NO: 363882 - DNA, 26 bp, Artificial Sequence
  Description of Artificial Sequence: Synthetic oligonucleotide
gaaatcaccccccaggagggagacga

SEQ ID NO: 363883 - DNA, 24 bp, Artificial Sequence
  Description of Artificial Sequence: Synthetic oligonucleotide
cggggagccccgcttcatctcagt

SEQ ID NO: 363884 - DNA, 27 bp, Artificial Sequence
  Description of Artificial Sequence: Synthetic oligonucleotide
aaatcaccccccaggagggagacgact

SEQ ID NO: 363885 - DNA, 24 bp, Artificial Sequence
  Description of Artificial Sequence: Synthetic oligonucleotide
ggggagccccgcttcatctcagtg

SEQ ID NO: 363886 - DNA, 27 bp, Artificial Sequence
  Description of Artificial Sequence: Synthetic oligonucleotide
aatcaccccccaggagggagacgacta

SEQ ID NO: 363887 - DNA, 24 bp, Artificial Sequence
  Description of Artificial Sequence: Synthetic oligonucleotide
gggagccccgcttcatctcagtgg

SEQ ID NO: 363888 - DNA, 26 bp, Artificial Sequence
  Description of Artificial Sequence: Synthetic oligonucleotide
atcaccccccaggagggagacgacta

SEQ ID NO: 363889 - DNA, 24 bp, Artificial Sequence
  Description of Artificial Sequence: Synthetic oligonucleotide
ggagccccgcttcatctcagtggg

SEQ ID NO: 363890 - DNA, 25 bp, Artificial Sequence
  Description of Artificial Sequence: Synthetic oligonucleotide
tcaccccccaggagggagacgacta

SEQ ID NO: 363891 - DNA, 26 bp, Artificial Sequence
  Description of Artificial Sequence: Synthetic oligonucleotide
gagccccgcttcatctcagtgggcta

SEQ ID NO: 363892 - DNA, 24 bp, Artificial Sequence
  Description of Artificial Sequence: Synthetic oligonucleotide
caccccccaggagggagacgacta

SEQ ID NO: 363893 - DNA, 26 bp, Artificial Sequence
  Description of Artificial Sequence: Synthetic oligonucleotide
agccccgcttcatctcagtgggctac

SEQ ID NO: 363894 - DNA, 26 bp, Artificial Sequence
  Description of Artificial Sequence: Synthetic oligonucleotide
accccccaggagggagacgactacat

SEQ ID NO: 363895 - DNA, 25 bp, Artificial Sequence
  Description of Artificial Sequence: Synthetic oligonucleotide
gccccgcttcatctcagtgggctac

SEQ ID NO: 363896 - DNA, 25 bp, Artificial Sequence
  Description of Artificial Sequence: Synthetic oligonucleotide
ccccccaggagggagacgactacat

SEQ ID NO: 363897 - DNA, 26 bp, Artificial Sequence
  Description of Artificial Sequence: Synthetic oligonucleotide
ccccgcttcatctcagtgggctacgt

SEQ ID NO: 363898 - DNA, 26 bp, Artificial Sequence
  Description of Artificial Sequence: Synthetic oligonucleotide
cccccaggagggagacgactacatct

SEQ ID NO: 363899 - DNA, 26 bp, Artificial Sequence
  Description of Artificial Sequence: Synthetic oligonucleotide
cccgcttcatctcagtgggctacgtg

SEQ ID NO: 363900 - DNA, 26 bp, Artificial Sequence
  Description of Artificial Sequence: Synthetic oligonucleotide
ccccaggagggagacgactacatctg

SEQ ID NO: 363901 - DNA, 27 bp, Artificial Sequence
  Description of Artificial Sequence: Synthetic oligonucleotide
ccgcttcatctcagtgggctacgtgga

SEQ ID NO: 363902 - DNA, 27 bp, Artificial Sequence
  Description of Artificial Sequence: Synthetic oligonucleotide
cccaggagggagacgactacatctgca

SEQ ID NO: 363903 - DNA, 27 bp, Artificial Sequence
  Description of Artificial Sequence: Synthetic oligonucleotide
cgcttcatctcagtgggctacgtggac

SEQ ID NO: 363904 - DNA, 28 bp, Artificial Sequence
  Description of Artificial Sequence: Synthetic oligonucleotide
ccaggagggagacgactacatctgcaag

SEQ ID NO: 363905 - DNA, 27 bp, Artificial Sequence
  Description of Artificial Sequence: Synthetic oligonucleotide
gcttcatctcagtgggctacgtggacg

SEQ ID NO: 363906 - DNA, 29 bp, Artificial Sequence
  Description of Artificial Sequence: Synthetic oligonucleotide
caggagggagacgactacatctgcaagtg

SEQ ID NO: 363907 - DNA, 28 bp, Artificial Sequence
  Description of Artificial Sequence: Synthetic oligonucleotide
cttcatctcagtgggctacgtggacgac

SEQ ID NO: 363908 - DNA, 29 bp, Artificial Sequence
  Description of Artificial Sequence: Synthetic oligonucleotide
aggagggagacgactacatctgcaagtgg

SEQ ID NO: 363909 - DNA, 29 bp, Artificial Sequence
  Description of Artificial Sequence: Synthetic oligonucleotide
ttcatctcagtgggctacgtggacgacac

SEQ ID NO: 363910 - DNA, 28 bp, Artificial Sequence
  Description of Artificial Sequence: Synthetic oligonucleotide
ggagggagacgactacatctgcaagtgg

SEQ ID NO: 363911 - DNA, 28 bp, Artificial Sequence
  Description of Artificial Sequence: Synthetic oligonucleotide
tcatctcagtgggctacgtggacgacac

SEQ ID NO: 363912 - DNA, 29 bp, Artificial Sequence
  Description of Artificial Sequence: Synthetic oligonucleotide
gagggagacgactacatctgcaagtggag

SEQ ID NO: 363913 - DNA, 27 bp, Artificial Sequence
  Description of Artificial Sequence: Synthetic oligonucleotide
catctcagtgggctacgtggacgacac

SEQ ID NO: 363914 - DNA, 29 bp, Artificial Sequence
  Description of Artificial Sequence: Synthetic oligonucleotide
agggagacgactacatctgcaagtggagg

SEQ ID NO: 363915 - DNA, 27 bp, Artificial Sequence
  Description of Artificial Sequence: Synthetic oligonucleotide
atctcagtgggctacgtggacgacacg

SEQ ID NO: 363916 - DNA, 28 bp, Artificial Sequence
  Description of Artificial Sequence: Synthetic oligonucleotide
gggagacgactacatctgcaagtggagg

SEQ ID NO: 363917 - DNA, 26 bp, Artificial Sequence
  Description of Artificial Sequence: Synthetic oligonucleotide
tctcagtgggctacgtggacgacacg

SEQ ID NO: 363918 - DNA, 29 bp, Artificial Sequence
  Description of Artificial Sequence: Synthetic oligonucleotide
ggagacgactacatctgcaagtggaggac

SEQ ID NO: 363919 - DNA, 25 bp, Artificial Sequence
  Description of Artificial Sequence: Synthetic oligonucleotide
ctcagtgggctacgtggacgacacg

SEQ ID NO: 363920 - DNA, 30 bp, Artificial Sequence; identical to SEQ ID NO: 236566
  Description of Artificial Sequence: Synthetic oligonucleotide

SEQ ID NO: 363921 - DNA, 26 bp, Artificial Sequence
  Description of Artificial Sequence: Synthetic oligonucleotide
tcagtgggctacgtggacgacacgca

SEQ ID NO: 363922 - DNA, 30 bp, Artificial Sequence; identical to SEQ ID NO: 236567
  Description of Artificial Sequence: Synthetic oligonucleotide

SEQ ID NO: 363923 - DNA, 26 bp, Artificial Sequence
  Description of Artificial Sequence: Synthetic oligonucleotide
caggagggtccggagtattgggacca

SEQ ID NO: 363924 - DNA, 29 bp, Artificial Sequence
  Description of Artificial Sequence: Synthetic oligonucleotide
gacgactacatctgcaagtggaggacacc

SEQ ID NO: 363925 - DNA, 26 bp, Artificial Sequence
  Description of Artificial Sequence: Synthetic oligonucleotide
aggagggtccggagtattgggaccag

SEQ ID NO: 363926 - DNA, 30 bp, Artificial Sequence; identical to SEQ ID NO: 236569
  Description of Artificial Sequence: Synthetic oligonucleotide

SEQ ID NO: 363927 - DNA, 25 bp, Artificial Sequence
  Description of Artificial Sequence: Synthetic oligonucleotide
ggagggtccggagtattgggaccag

SEQ ID NO: 363928 - DNA, 29 bp, Artificial Sequence
  Description of Artificial Sequence: Synthetic oligonucleotide
cgactacatctgcaagtggaggacaccag

SEQ ID NO: 363929 - DNA, 26 bp, Artificial Sequence
  Description of Artificial Sequence: Synthetic oligonucleotide
gagggtccggagtattgggaccagga

SEQ ID NO: 363930 - DNA, 29 bp, Artificial Sequence
  Description of Artificial Sequence: Synthetic oligonucleotide
gactacatctgcaagtggaggacaccagc

SEQ ID NO: 363931 - DNA, 27 bp, Artificial Sequence
  Description of Artificial Sequence: Synthetic oligonucleotide
agggtccggagtattgggaccaggaga

SEQ ID NO: 363932 - DNA, 29 bp, Artificial Sequence
  Description of Artificial Sequence: Synthetic oligonucleotide
actacatctgcaagtggaggacaccagcc

SEQ ID NO: 363933 - DNA, 26 bp, Artificial Sequence
  Description of Artificial Sequence: Synthetic oligonucleotide
gggtccggagtattgggaccaggaga

SEQ ID NO: 363934 - DNA, 28 bp, Artificial Sequence
  Description of Artificial Sequence: Synthetic oligonucleotide
ctacatctgcaagtggaggacaccagcc

SEQ ID NO: 363935 - DNA, 27 bp, Artificial Sequence
  Description of Artificial Sequence: Synthetic oligonucleotide
ggtccggagtattgggaccaggagaca

SEQ ID NO: 363936 - DNA, 29 bp, Artificial Sequence
  Description of Artificial Sequence: Synthetic oligonucleotide
tacatctgcaagtggaggacaccagccag

SEQ ID NO: 363937 - DNA, 27 bp, Artificial Sequence
  Description of Artificial Sequence: Synthetic oligonucleotide
gtccggagtattgggaccaggagacac

SEQ ID NO: 363938 - DNA, 28 bp, Artificial Sequence
  Description of Artificial Sequence: Synthetic oligonucleotide
acatctgcaagtggaggacaccagccag

SEQ ID NO: 363939 - DNA, 27 bp, Artificial Sequence
  Description of Artificial Sequence: Synthetic oligonucleotide
tccggagtattgggaccaggagacacg

SEQ ID NO: 363940 - DNA, 27 bp, Artificial Sequence
  Description of Artificial Sequence: Synthetic oligonucleotide
catctgcaagtggaggacaccagccag

SEQ ID NO: 363941 - DNA, 29 bp, Artificial Sequence
  Description of Artificial Sequence: Synthetic oligonucleotide
ggagtattgggaccaggagacacggaaag

SEQ ID NO: 363942 - DNA, 27 bp, Artificial Sequence
  Description of Artificial Sequence: Synthetic oligonucleotide
atctgcaagtggaggacaccagccagg

SEQ ID NO: 363943 - DNA, 30 bp, Artificial Sequence; identical to SEQ ID NO: 9518
  Description of Artificial Sequence: Synthetic oligonucleotide

SEQ ID NO: 363944 - DNA, 27 bp, Artificial Sequence
  Description of Artificial Sequence: Synthetic oligonucleotide
tctgcaagtggaggacaccagccagga

SEQ ID NO: 363945 - DNA, 32 bp, Artificial Sequence; identical to SEQ ID NO: 9519
  Description of Artificial Sequence: Synthetic oligonucleotide

SEQ ID NO: 363946 - DNA, 26 bp, Artificial Sequence
  Description of Artificial Sequence: Synthetic oligonucleotide
ctgcaagtggaggacaccagccagga

SEQ ID NO: 363947 - DNA, 31 bp, Artificial Sequence; identical to SEQ ID NO: 9520
  Description of Artificial Sequence: Synthetic oligonucleotide

SEQ ID NO: 363948 - DNA, 27 bp, Artificial Sequence
  Description of Artificial Sequence: Synthetic oligonucleotide
tgcaagtggaggacaccagccaggaca

SEQ ID NO: 363949 - DNA, 31 bp, Artificial Sequence; identical to SEQ ID NO: 9521
  Description of Artificial Sequence: Synthetic oligonucleotide

SEQ ID NO: 363950 - DNA, 26 bp, Artificial Sequence
  Description of Artificial Sequence: Synthetic oligonucleotide
gcaagtggaggacaccagccaggaca

SEQ ID NO: 363951 - DNA, 30 bp, Artificial Sequence; identical to SEQ ID NO: 9522
  Description of Artificial Sequence: Synthetic oligonucleotide

SEQ ID NO: 363952 - DNA, 27 bp, Artificial Sequence
  Description of Artificial Sequence: Synthetic oligonucleotide
caagtggaggacaccagccaggacagt

SEQ ID NO: 363953 - DNA, 29 bp, Artificial Sequence
  Description of Artificial Sequence: Synthetic oligonucleotide
ttgggaccaggagacacggaaagtgaagg

SEQ ID NO: 363954 - DNA, 27 bp, Artificial Sequence
  Description of Artificial Sequence: Synthetic oligonucleotide
aagtggaggacaccagccaggacagtc

SEQ ID NO: 363955 - DNA, 28 bp, Artificial Sequence
  Description of Artificial Sequence: Synthetic oligonucleotide
tgggaccaggagacacggaaagtgaagg

SEQ ID NO: 363956 - DNA, 26 bp, Artificial Sequence
  Description of Artificial Sequence: Synthetic oligonucleotide
agtggaggacaccagccaggacagtc

SEQ ID NO: 363957 - DNA, 27 bp, Artificial Sequence
  Description of Artificial Sequence: Synthetic oligonucleotide
gggaccaggagacacggaaagtgaagg

SEQ ID NO: 363958 - DNA, 25 bp, Artificial Sequence
  Description of Artificial Sequence: Synthetic oligonucleotide
gtggaggacaccagccaggacagtc

SEQ ID NO: 363959 - DNA, 27 bp, Artificial Sequence
  Description of Artificial Sequence: Synthetic oligonucleotide
ggaccaggagacacggaaagtgaaggc

SEQ ID NO: 363960 - DNA, 26 bp, Artificial Sequence
  Description of Artificial Sequence: Synthetic oligonucleotide
tggaggacaccagccaggacagtcca

SEQ ID NO: 363961 - DNA, 27 bp, Artificial Sequence
  Description of Artificial Sequence: Synthetic oligonucleotide
gaccaggagacacggaaagtgaaggcc

SEQ ID NO: 363962 - DNA, 25 bp, Artificial Sequence
  Description of Artificial Sequence: Synthetic oligonucleotide
ggaggacaccagccaggacagtcca

SEQ ID NO: 363963 - DNA, 27 bp, Artificial Sequence
  Description of Artificial Sequence: Synthetic oligonucleotide
accaggagacacggaaagtgaaggccc

SEQ ID NO: 363964 - DNA, 26 bp, Artificial Sequence
  Description of Artificial Sequence: Synthetic oligonucleotide
gaggacaccagccaggacagtccagt

SEQ ID NO: 363965 - DNA, 27 bp, Artificial Sequence
  Description of Artificial Sequence: Synthetic oligonucleotide
ccaggagacacggaaagtgaaggccca

SEQ ID NO: 363966 - DNA, 27 bp, Artificial Sequence
  Description of Artificial Sequence: Synthetic oligonucleotide
aggacaccagccaggacagtccagtca

SEQ ID NO: 363967 - DNA, 27 bp, Artificial Sequence
  Description of Artificial Sequence: Synthetic oligonucleotide
caggagacacggaaagtgaaggcccac

SEQ ID NO: 363968 - DNA, 26 bp, Artificial Sequence
  Description of Artificial Sequence: Synthetic oligonucleotide
ggacaccagccaggacagtccagtca

SEQ ID NO: 363969 - DNA, 28 bp, Artificial Sequence
  Description of Artificial Sequence: Synthetic oligonucleotide
aggagacacggaaagtgaaggcccactc

SEQ ID NO: 363970 - DNA, 26 bp, Artificial Sequence
  Description of Artificial Sequence: Synthetic oligonucleotide
gacaccagccaggacagtccagtcac

SEQ ID NO: 363971 - DNA, 21 bp, Artificial Sequence
  Description of Artificial Sequence: Synthetic oligonucleotide
cggcccatgtggcggagcagc

SEQ ID NO: 363972 - DNA, 26 bp, Artificial Sequence
  Description of Artificial Sequence: Synthetic oligonucleotide
acaccagccaggacagtccagtcacc

SEQ ID NO: 363973 - DNA, 21 bp, Artificial Sequence
  Description of Artificial Sequence: Synthetic oligonucleotide
ggcccatgtggcggagcagcg

SEQ ID NO: 363974 - DNA, 25 bp, Artificial Sequence
  Description of Artificial Sequence: Synthetic oligonucleotide
caccagccaggacagtccagtcacc

SEQ ID NO: 363975 - DNA, 22 bp, Artificial Sequence
  Description of Artificial Sequence: Synthetic oligonucleotide
gcccatgtggcggagcagcgga

SEQ ID NO: 363976 - DNA, 26 bp, Artificial Sequence
  Description of Artificial Sequence: Synthetic oligonucleotide
accagccaggacagtccagtcaccgt

SEQ ID NO: 363977 - DNA, 23 bp, Artificial Sequence
  Description of Artificial Sequence: Synthetic oligonucleotide
cccatgtggcggagcagcggaga

SEQ ID NO: 363978 - DNA, 25 bp, Artificial Sequence
  Description of Artificial Sequence: Synthetic oligonucleotide
ccagccaggacagtccagtcaccgt

SEQ ID NO: 363979 - DNA, 23 bp, Artificial Sequence
  Description of Artificial Sequence: Synthetic oligonucleotide
ccatgtggcggagcagcggagag

SEQ ID NO: 363980 - DNA, 25 bp, Artificial Sequence
  Description of Artificial Sequence: Synthetic oligonucleotide
cagccaggacagtccagtcaccgtg

SEQ ID NO: 363981 - DNA, 23 bp, Artificial Sequence
  Description of Artificial Sequence: Synthetic oligonucleotide
catgtggcggagcagcggagagc

SEQ ID NO: 363982 - DNA, 26 bp, Artificial Sequence
  Description of Artificial Sequence: Synthetic oligonucleotide
agccaggacagtccagtcaccgtgca

SEQ ID NO: 363983 - DNA, 25 bp, Artificial Sequence
  Description of Artificial Sequence: Synthetic oligonucleotide
atgtggcggagcagcggagagccta

SEQ ID NO: 363984 - DNA, 25 bp, Artificial Sequence
  Description of Artificial Sequence: Synthetic oligonucleotide
gccaggacagtccagtcaccgtgca

SEQ ID NO: 363985 - DNA, 24 bp, Artificial Sequence
  Description of Artificial Sequence: Synthetic oligonucleotide
tgtggcggagcagcggagagccta

SEQ ID NO: 363986 - DNA, 26 bp, Artificial Sequence
  Description of Artificial Sequence: Synthetic oligonucleotide
ccaggacagtccagtcaccgtgcagt

SEQ ID NO: 363987 - DNA, 23 bp, Artificial Sequence
  Description of Artificial Sequence: Synthetic oligonucleotide
gtggcggagcagcggagagccta

SEQ ID NO: 363988 - DNA, 26 bp, Artificial Sequence
  Description of Artificial Sequence: Synthetic oligonucleotide
caggacagtccagtcaccgtgcagtg

SEQ ID NO: 363989 - DNA, 23 bp, Artificial Sequence
  Description of Artificial Sequence: Synthetic oligonucleotide
tggcggagcagcggagagcctac

SEQ ID NO: 363990 - DNA, 27 bp, Artificial Sequence
  Description of Artificial Sequence: Synthetic oligonucleotide
aggacagtccagtcaccgtgcagtgga

SEQ ID NO: 363991 - DNA, 22 bp, Artificial Sequence
  Description of Artificial Sequence: Synthetic oligonucleotide
ggcggagcagcggagagcctac

SEQ ID NO: 363992 - DNA, 27 bp, Artificial Sequence
  Description of Artificial Sequence: Synthetic oligonucleotide
ggacagtccagtcaccgtgcagtggaa

SEQ ID NO: 363993 - DNA, 23 bp, Artificial Sequence
  Description of Artificial Sequence: Synthetic oligonucleotide
gcggagcagcggagagcctacct

SEQ ID NO: 363994 - DNA, 27 bp, Artificial Sequence
  Description of Artificial Sequence: Synthetic oligonucleotide
gacagtccagtcaccgtgcagtggaag

SEQ ID NO: 363995 - DNA, 23 bp, Artificial Sequence
  Description of Artificial Sequence: Synthetic oligonucleotide
cggagcagcggagagcctacctg

SEQ ID NO: 363996 - DNA, 27 bp, Artificial Sequence
  Description of Artificial Sequence: Synthetic oligonucleotide
acagtccagtcaccgtgcagtggaagg

SEQ ID NO: 363997 - DNA, 24 bp, Artificial Sequence
  Description of Artificial Sequence: Synthetic oligonucleotide
ggagcagcggagagcctacctgga

SEQ ID NO: 363998 - DNA, 26 bp, Artificial Sequence
  Description of Artificial Sequence: Synthetic oligonucleotide
cagtccagtcaccgtgcagtggaagg

SEQ ID NO: 363999 - DNA, 24 bp, Artificial Sequence
  Description of Artificial Sequence: Synthetic oligonucleotide
gagcagcggagagcctacctggag

SEQ ID NO: 364000 - DNA, 27 bp, Artificial Sequence
  Description of Artificial Sequence: Synthetic oligonucleotide
agtccagtcaccgtgcagtggaaggga

SEQ ID NO: 364001 - DNA, 24 bp, Artificial Sequence
  Description of Artificial Sequence: Synthetic oligonucleotide
agcagcggagagcctacctggagg

SEQ ID NO: 364002 - DNA, 26 bp, Artificial Sequence
  Description of Artificial Sequence: Synthetic oligonucleotide
gtccagtcaccgtgcagtggaaggga

SEQ ID NO: 364003 - DNA, 23 bp, Artificial Sequence
  Description of Artificial Sequence: Synthetic oligonucleotide
gcagcggagagcctacctggagg

SEQ ID NO: 364004 - DNA, 27 bp, Artificial Sequence
  Description of Artificial Sequence: Synthetic oligonucleotide
tccagtcaccgtgcagtggaagggaca

SEQ ID NO: 364005 - DNA, 23 bp, Artificial Sequence
  Description of Artificial Sequence: Synthetic oligonucleotide
cagcggagagcctacctggaggg

SEQ ID NO: 364006 - DNA, 26 bp, Artificial Sequence
  Description of Artificial Sequence: Synthetic oligonucleotide
ccagtcaccgtgcagtggaagggaca

SEQ ID NO: 364007 - DNA, 24 bp, Artificial Sequence
  Description of Artificial Sequence: Synthetic oligonucleotide
agcggagagcctacctggagggca

SEQ ID NO: 364008 - DNA, 27 bp, Artificial Sequence
  Description of Artificial Sequence: Synthetic oligonucleotide
cagtcaccgtgcagtggaagggacagt

SEQ ID NO: 364009 - DNA, 23 bp, Artificial Sequence
  Description of Artificial Sequence: Synthetic oligonucleotide
gcggagagcctacctggagggca

SEQ ID NO: 364010 - DNA, 27 bp, Artificial Sequence
  Description of Artificial Sequence: Synthetic oligonucleotide
agtcaccgtgcagtggaagggacagtc

SEQ ID NO: 364011 - DNA, 23 bp, Artificial Sequence
  Description of Artificial Sequence: Synthetic oligonucleotide
cggagagcctacctggagggcac

SEQ ID NO: 364012 - DNA, 27 bp, Artificial Sequence
  Description of Artificial Sequence: Synthetic oligonucleotide
gtcaccgtgcagtggaagggacagtct

SEQ ID NO: 364013 - DNA, 23 bp, Artificial Sequence
  Description of Artificial Sequence: Synthetic oligonucleotide
caagcacaagtgggaggcggccc

SEQ ID NO: 364014 - DNA, 27 bp, Artificial Sequence
  Description of Artificial Sequence: Synthetic oligonucleotide
tcaccgtgcagtggaagggacagtctg

SEQ ID NO: 364015 - DNA, 24 bp, Artificial Sequence
  Description of Artificial Sequence: Synthetic oligonucleotide
aagcacaagtgggaggcggcccgt

SEQ ID NO: 364016 - DNA, 27 bp, Artificial Sequence
  Description of Artificial Sequence: Synthetic oligonucleotide
caccgtgcagtggaagggacagtctga

SEQ ID NO: 364017 - DNA, 23 bp, Artificial Sequence
  Description of Artificial Sequence: Synthetic oligonucleotide
agcacaagtgggaggcggcccgt

SEQ ID NO: 364018 - DNA, 28 bp, Artificial Sequence
  Description of Artificial Sequence: Synthetic oligonucleotide
accgtgcagtggaagggacagtctgatc

SEQ ID NO: 364019 - DNA, 22 bp, Artificial Sequence
  Description of Artificial Sequence: Synthetic oligonucleotide
gcacaagtgggaggcggcccgt

SEQ ID NO: 364020 - DNA, 27 bp, Artificial Sequence
  Description of Artificial Sequence: Synthetic oligonucleotide
ccgtgcagtggaagggacagtctgatc

SEQ ID NO: 364021 - DNA, 23 bp, Artificial Sequence
  Description of Artificial Sequence: Synthetic oligonucleotide
cacaagtgggaggcggcccgtgt

SEQ ID NO: 364022 - DNA, 28 bp, Artificial Sequence
  Description of Artificial Sequence: Synthetic oligonucleotide
cgtgcagtggaagggacagtctgatctg

SEQ ID NO: 364023 - DNA, 23 bp, Artificial Sequence
  Description of Artificial Sequence: Synthetic oligonucleotide
acaagtgggaggcggcccgtgtg

SEQ ID NO: 364024 - DNA, 28 bp, Artificial Sequence
  Description of Artificial Sequence: Synthetic oligonucleotide
gtgcagtggaagggacagtctgatctgc

SEQ ID NO: 364025 - DNA, 22 bp, Artificial Sequence
  Description of Artificial Sequence: Synthetic oligonucleotide
caagtgggaggcggcccgtgtg

SEQ ID NO: 364026 - DNA, 28 bp, Artificial Sequence
  Description of Artificial Sequence: Synthetic oligonucleotide
tgcagtggaagggacagtctgatctgcc

SEQ ID NO: 364027 - DNA, 22 bp, Artificial Sequence
  Description of Artificial Sequence: Synthetic oligonucleotide
aagtgggaggcggcccgtgtgg

SEQ ID NO: 364028 - DNA, 27 bp, Artificial Sequence
  Description of Artificial Sequence: Synthetic oligonucleotide
gcagtggaagggacagtctgatctgcc

SEQ ID NO: 364029 - DNA, 21 bp, Artificial Sequence
  Description of Artificial Sequence: Synthetic oligonucleotide
agtgggaggcggcccgtgtgg

SEQ ID NO: 364030 - DNA, 27 bp, Artificial Sequence
  Description of Artificial Sequence: Synthetic oligonucleotide
cagtggaagggacagtctgatctgccc

SEQ ID NO: 364031 - DNA, 20 bp, Artificial Sequence
  Description of Artificial Sequence: Synthetic oligonucleotide
gtgggaggcggcccgtgtgg

SEQ ID NO: 364032 - DNA, 27 bp, Artificial Sequence
  Description of Artificial Sequence: Synthetic oligonucleotide
agtggaagggacagtctgatctgcccg

SEQ ID NO: 364033 - DNA, 20 bp, Artificial Sequence
  Description of Artificial Sequence: Synthetic oligonucleotide
tgggaggcggcccgtgtggc

SEQ ID NO: 364034 - DNA, 26 bp, Artificial Sequence
  Description of Artificial Sequence: Synthetic oligonucleotide
gtggaagggacagtctgatctgcccg

SEQ ID NO: 364035 - DNA, 20 bp, Artificial Sequence
  Description of Artificial Sequence: Synthetic oligonucleotide
gggaggcggcccgtgtggct

SEQ ID NO: 364036 - DNA, 27 bp, Artificial Sequence
  Description of Artificial Sequence: Synthetic oligonucleotide
tggaagggacagtctgatctgcccggt

SEQ ID NO: 364037 - DNA, 20 bp, Artificial Sequence
  Description of Artificial Sequence: Synthetic oligonucleotide
ggaggcggcccgtgtggcgt

SEQ ID NO: 364038 - DNA, 26 bp, Artificial Sequence
  Description of Artificial Sequence: Synthetic oligonucleotide
ggaagggacagtctgatctgcccggt

SEQ ID NO: 364039 - DNA, 20 bp, Artificial Sequence
  Description of Artificial Sequence: Synthetic oligonucleotide
gaggcggcccgtgtggcgga

SEQ ID NO: 364040 - DNA, 27 bp, Artificial Sequence
  Description of Artificial Sequence: Synthetic oligonucleotide
gaagggacagtctgatctgcccggtgt

SEQ ID NO: 364041 - DNA, 20 bp, Artificial Sequence
  Description of Artificial Sequence: Synthetic oligonucleotide
aggcggcccgtgtggcggag

SEQ ID NO: 364042 - DNA, 29 bp, Artificial Sequence
  Description of Artificial Sequence: Synthetic oligonucleotide
aagggacagtctgatctgcccggtgtaag

SEQ ID NO: 364043 - DNA, 20 bp, Artificial Sequence
  Description of Artificial Sequence: Synthetic oligonucleotide
ggcggcccgtgtggcggagt

SEQ ID NO: 364044 - DNA, 28 bp, Artificial Sequence
  Description of Artificial Sequence: Synthetic oligonucleotide
agggacagtctgatctgcccggtgtaag

SEQ ID NO: 364045 - DNA, 20 bp, Artificial Sequence
  Description of Artificial Sequence: Synthetic oligonucleotide
gcggcccgtgtggcggagca

SEQ ID NO: 364046 - DNA, 27 bp, Artificial Sequence
  Description of Artificial Sequence: Synthetic oligonucleotide
gggacagtctgatctgcccggtgtaag

SEQ ID NO: 364047 - DNA, 22 bp, Artificial Sequence
  Description of Artificial Sequence: Synthetic oligonucleotide
cggcccgtgtggcggagcagtt

SEQ ID NO: 364048 - DNA, 28 bp, Artificial Sequence
  Description of Artificial Sequence: Synthetic oligonucleotide
ggacagtctgatctgcccggtgtaagac

SEQ ID NO: 364049 - DNA, 23 bp, Artificial Sequence
  Description of Artificial Sequence: Synthetic oligonucleotide
ggcccgtgtggcggagcagttga

SEQ ID NO: 364050 - DNA, 31 bp, Artificial Sequence; identical to SEQ ID NO: 236631
  Description of Artificial Sequence: Synthetic oligonucleotide

SEQ ID NO: 364051 - DNA, 24 bp, Artificial Sequence
  Description of Artificial Sequence: Synthetic oligonucleotide
gcccgtgtggcggagcagttgaga

SEQ ID NO: 364052 - DNA, 32 bp, Artificial Sequence; identical to SEQ ID NO: 236632
  Description of Artificial Sequence: Synthetic oligonucleotide

SEQ ID NO: 364053 - DNA, 24 bp, Artificial Sequence
  Description of Artificial Sequence: Synthetic oligonucleotide
cccgtgtggcggagcagttgagag

SEQ ID NO: 364054 - DNA, 31 bp, Artificial Sequence; identical to SEQ ID NO: 236633
  Description of Artificial Sequence: Synthetic oligonucleotide

SEQ ID NO: 364055 - DNA, 24 bp, Artificial Sequence
  Description of Artificial Sequence: Synthetic oligonucleotide
ccgtgtggcggagcagttgagagc

SEQ ID NO: 364056 - DNA, 31 bp, Artificial Sequence; identical to SEQ ID NO: 236634
  Description of Artificial Sequence: Synthetic oligonucleotide

SEQ ID NO: 364057 - DNA, 26 bp, Artificial Sequence
  Description of Artificial Sequence: Synthetic oligonucleotide
cgtgtggcggagcagttgagagccta

SEQ ID NO: 364058 - DNA, 30 bp, Artificial Sequence; identical to SEQ ID NO: 236635
  Description of Artificial Sequence: Synthetic oligonucleotide

SEQ ID NO: 364059 - DNA, 26 bp, Artificial Sequence
  Description of Artificial Sequence: Synthetic oligonucleotide
gtgtggcggagcagttgagagcctac

SEQ ID NO: 364060 - DNA, 30 bp, Artificial Sequence; identical to SEQ ID NO: 236636
  Description of Artificial Sequence: Synthetic oligonucleotide

SEQ ID NO: 364061 - DNA, 24 bp, Artificial Sequence
  Description of Artificial Sequence: Synthetic oligonucleotide
aggaggggccggagtattgggacc

SEQ ID NO: 364062 - DNA, 29 bp, Artificial Sequence
  Description of Artificial Sequence: Synthetic oligonucleotide
ctgatctgcccggtgtaagacatagacgg

SEQ ID NO: 364063 - DNA, 23 bp, Artificial Sequence
  Description of Artificial Sequence: Synthetic oligonucleotide
ggaggggccggagtattgggacc

SEQ ID NO: 364064 - DNA, 29 bp, Artificial Sequence
  Description of Artificial Sequence: Synthetic oligonucleotide
tgatctgcccggtgtaagacatagacggg

SEQ ID NO: 364065 - DNA, 23 bp, Artificial Sequence
  Description of Artificial Sequence: Synthetic oligonucleotide
gaggggccggagtattgggaccg

SEQ ID NO: 364066 - DNA, 28 bp, Artificial Sequence
  Description of Artificial Sequence: Synthetic oligonucleotide
gatctgcccggtgtaagacatagacggg

SEQ ID NO: 364067 - DNA, 25 bp, Artificial Sequence
  Description of Artificial Sequence: Synthetic oligonucleotide
aggggccggagtattgggaccggaa

SEQ ID NO: 364068 - DNA, 29 bp, Artificial Sequence
  Description of Artificial Sequence: Synthetic oligonucleotide
atctgcccggtgtaagacatagacgggag

SEQ ID NO: 364069 - DNA, 24 bp, Artificial Sequence
  Description of Artificial Sequence: Synthetic oligonucleotide
ggggccggagtattgggaccggaa

SEQ ID NO: 364070 - DNA, 28 bp, Artificial Sequence
  Description of Artificial Sequence: Synthetic oligonucleotide
tctgcccggtgtaagacatagacgggag

SEQ ID NO: 364071 - DNA, 25 bp, Artificial Sequence
  Description of Artificial Sequence: Synthetic oligonucleotide
gggccggagtattgggaccggaaca

SEQ ID NO: 364072 - DNA, 27 bp, Artificial Sequence
  Description of Artificial Sequence: Synthetic oligonucleotide
ctgcccggtgtaagacatagacgggag

SEQ ID NO: 364073 - DNA, 26 bp, Artificial Sequence
  Description of Artificial Sequence: Synthetic oligonucleotide
ggccggagtattgggaccggaacaca

SEQ ID NO: 364074 - DNA, 27 bp, Artificial Sequence
  Description of Artificial Sequence: Synthetic oligonucleotide
tgcccggtgtaagacatagacgggagc

SEQ ID NO: 364075 - DNA, 26 bp, Artificial Sequence
  Description of Artificial Sequence: Synthetic oligonucleotide
gccggagtattgggaccggaacacac

SEQ ID NO: 364076 - DNA, 27 bp, Artificial Sequence
  Description of Artificial Sequence: Synthetic oligonucleotide
gcccggtgtaagacatagacgggagca

SEQ ID NO: 364077 - DNA, 26 bp, Artificial Sequence
  Description of Artificial Sequence: Synthetic oligonucleotide
ccggagtattgggaccggaacacacg

SEQ ID NO: 364078 - DNA, 27 bp, Artificial Sequence
  Description of Artificial Sequence: Synthetic oligonucleotide
cccggtgtaagacatagacgggagcag

SEQ ID NO: 364079 - DNA, 27 bp, Artificial Sequence
  Description of Artificial Sequence: Synthetic oligonucleotide
cggagtattgggaccggaacacacgga

SEQ ID NO: 364080 - DNA, 27 bp, Artificial Sequence
  Description of Artificial Sequence: Synthetic oligonucleotide
ccggtgtaagacatagacgggagcagg

SEQ ID NO: 364081 - DNA, 29 bp, Artificial Sequence
  Description of Artificial Sequence: Synthetic oligonucleotide
ggagtattgggaccggaacacacggaatg

SEQ ID NO: 364082 - DNA, 27 bp, Artificial Sequence
  Description of Artificial Sequence: Synthetic oligonucleotide
cggtgtaagacatagacgggagcaggg

SEQ ID NO: 364083 - DNA, 30 bp, Artificial Sequence; identical to SEQ ID NO: 2829
  Description of Artificial Sequence: Synthetic oligonucleotide

SEQ ID NO: 364084 - DNA, 27 bp, Artificial Sequence
  Description of Artificial Sequence: Synthetic oligonucleotide
ggtgtaagacatagacgggagcagggg

SEQ ID NO: 364085 - DNA, 32 bp, Artificial Sequence; identical to SEQ ID NO: 2830
  Description of Artificial Sequence: Synthetic oligonucleotide

SEQ ID NO: 364086 - DNA, 27 bp, Artificial Sequence
  Description of Artificial Sequence: Synthetic oligonucleotide
gtgtaagacatagacgggagcaggggg

SEQ ID NO: 364087 - DNA, 31 bp, Artificial Sequence; identical to SEQ ID NO: 2831
  Description of Artificial Sequence: Synthetic oligonucleotide

SEQ ID NO: 364088 - DNA, 27 bp, Artificial Sequence
  Description of Artificial Sequence: Synthetic oligonucleotide
tgtaagacatagacgggagcagggggc

SEQ ID NO: 364089 - DNA, 31 bp, Artificial Sequence; identical to SEQ ID NO: 2832
  Description of Artificial Sequence: Synthetic oligonucleotide

SEQ ID NO: 364090 - DNA, 27 bp, Artificial Sequence
  Description of Artificial Sequence: Synthetic oligonucleotide
gtaagacatagacgggagcagggggct

SEQ ID NO: 364091 - DNA, 30 bp, Artificial Sequence; identical to SEQ ID NO: 2833
  Description of Artificial Sequence: Synthetic oligonucleotide

SEQ ID NO: 364092 - DNA, 28 bp, Artificial Sequence
  Description of Artificial Sequence: Synthetic oligonucleotide
taagacatagacgggagcagggggcttg

SEQ ID NO: 364093 - DNA, 29 bp, Artificial Sequence
  Description of Artificial Sequence: Synthetic oligonucleotide
ttgggaccggaacacacggaatgtgaagg

SEQ ID NO: 364094 - DNA, 27 bp, Artificial Sequence
  Description of Artificial Sequence: Synthetic oligonucleotide
aagacatagacgggagcagggggcttg

SEQ ID NO: 364095 - DNA, 28 bp, Artificial Sequence
  Description of Artificial Sequence: Synthetic oligonucleotide
tgggaccggaacacacggaatgtgaagg

SEQ ID NO: 364096 - DNA, 26 bp, Artificial Sequence
  Description of Artificial Sequence: Synthetic oligonucleotide
agacatagacgggagcagggggcttg

SEQ ID NO: 364097 - DNA, 27 bp, Artificial Sequence
  Description of Artificial Sequence: Synthetic oligonucleotide
gggaccggaacacacggaatgtgaagg

SEQ ID NO: 364098 - DNA, 25 bp, Artificial Sequence
  Description of Artificial Sequence: Synthetic oligonucleotide
gacatagacgggagcagggggcttg

SEQ ID NO: 364099 - DNA, 27 bp, Artificial Sequence
  Description of Artificial Sequence: Synthetic oligonucleotide
ggaccggaacacacggaatgtgaaggc

SEQ ID NO: 364100 - DNA, 26 bp, Artificial Sequence
  Description of Artificial Sequence: Synthetic oligonucleotide
acatagacgggagcagggggcttggt

SEQ ID NO: 364101 - DNA, 27 bp, Artificial Sequence
  Description of Artificial Sequence: Synthetic oligonucleotide
gaccggaacacacggaatgtgaaggcc

SEQ ID NO: 364102 - DNA, 25 bp, Artificial Sequence
  Description of Artificial Sequence: Synthetic oligonucleotide
catagacgggagcagggggcttggt

SEQ ID NO: 364103 - DNA, 27 bp, Artificial Sequence
  Description of Artificial Sequence: Synthetic oligonucleotide
accggaacacacggaatgtgaaggccc

SEQ ID NO: 364104 - DNA, 25 bp, Artificial Sequence
  Description of Artificial Sequence: Synthetic oligonucleotide
atagacgggagcagggggcttggtg

SEQ ID NO: 364105 - DNA, 27 bp, Artificial Sequence
  Description of Artificial Sequence: Synthetic oligonucleotide
ccggaacacacggaatgtgaaggccca

SEQ ID NO: 364106 - DNA, 24 bp, Artificial Sequence
  Description of Artificial Sequence: Synthetic oligonucleotide
tagacgggagcagggggcttggtg

SEQ ID NO: 364107 - DNA, 27 bp, Artificial Sequence
  Description of Artificial Sequence: Synthetic oligonucleotide
cggaacacacggaatgtgaaggcccac

SEQ ID NO: 364108 - DNA, 23 bp, Artificial Sequence
  Description of Artificial Sequence: Synthetic oligonucleotide
agacgggagcagggggcttggtg

SEQ ID NO: 364109 - DNA, 28 bp, Artificial Sequence
  Description of Artificial Sequence: Synthetic oligonucleotide
ggaacacacggaatgtgaaggcccactc

SEQ ID NO: 364110 - DNA, 22 bp, Artificial Sequence
  Description of Artificial Sequence: Synthetic oligonucleotide
gacgggagcagggggcttggtg

SEQ ID NO: 364111 - DNA, 29 bp, Artificial Sequence
  Description of Artificial Sequence: Synthetic oligonucleotide
gaacacacggaatgtgaaggcccactcac

SEQ ID NO: 364112 - DNA, 23 bp, Artificial Sequence
  Description of Artificial Sequence: Synthetic oligonucleotide
acgggagcagggggcttggtgct

SEQ ID NO: 364113 - DNA, 30 bp, Artificial Sequence; identical to SEQ ID NO: 2844
  Description of Artificial Sequence: Synthetic oligonucleotide

SEQ ID NO: 364114 - DNA, 22 bp, Artificial Sequence
  Description of Artificial Sequence: Synthetic oligonucleotide
cgggagcagggggcttggtgct

SEQ ID NO: 364115 - DNA, 29 bp, Artificial Sequence
  Description of Artificial Sequence: Synthetic oligonucleotide
acacacggaatgtgaaggcccactcacag

SEQ ID NO: 364116 - DNA, 22 bp, Artificial Sequence
  Description of Artificial Sequence: Synthetic oligonucleotide
gggagcagggggcttggtgctg

SEQ ID NO: 364117 - DNA, 28 bp, Artificial Sequence
  Description of Artificial Sequence: Synthetic oligonucleotide
cacacggaatgtgaaggcccactcacag

SEQ ID NO: 364118 - DNA, 22 bp, Artificial Sequence
  Description of Artificial Sequence: Synthetic oligonucleotide
ggagcagggggcttggtgctgg

SEQ ID NO: 364119 - DNA, 25 bp, Artificial Sequence
  Description of Artificial Sequence: Synthetic oligonucleotide
gcttcctccgcgggtaccaccagtt

SEQ ID NO: 364120 - DNA, 22 bp, Artificial Sequence
  Description of Artificial Sequence: Synthetic oligonucleotide
gagcagggggcttggtgctggg

SEQ ID NO: 364121 - DNA, 25 bp, Artificial Sequence
  Description of Artificial Sequence: Synthetic oligonucleotide
cttcctccgcgggtaccaccagttc

SEQ ID NO: 364122 - DNA, 22 bp, Artificial Sequence
  Description of Artificial Sequence: Synthetic oligonucleotide
agcagggggcttggtgctgggg

SEQ ID NO: 364123 - DNA, 25 bp, Artificial Sequence
  Description of Artificial Sequence: Synthetic oligonucleotide
ttcctccgcgggtaccaccagttcg

SEQ ID NO: 364124 - DNA, 21 bp, Artificial Sequence
  Description of Artificial Sequence: Synthetic oligonucleotide
gcagggggcttggtgctgggg

SEQ ID NO: 364125 - DNA, 24 bp, Artificial Sequence
  Description of Artificial Sequence: Synthetic oligonucleotide
tcctccgcgggtaccaccagttcg

SEQ ID NO: 364126 - DNA, 22 bp, Artificial Sequence
  Description of Artificial Sequence: Synthetic oligonucleotide
cagggggcttggtgctggggca

SEQ ID NO: 364127 - DNA, 23 bp, Artificial Sequence
  Description of Artificial Sequence: Synthetic oligonucleotide
cctccgcgggtaccaccagttcg

SEQ ID NO: 364128 - DNA, 24 bp, Artificial Sequence
  Description of Artificial Sequence: Synthetic oligonucleotide
agggggcttggtgctggggcacat

SEQ ID NO: 364129 - DNA, 23 bp, Artificial Sequence
  Description of Artificial Sequence: Synthetic oligonucleotide
ctccgcgggtaccaccagttcgc

SEQ ID NO: 364130 - DNA, 23 bp, Artificial Sequence
  Description of Artificial Sequence: Synthetic oligonucleotide
gggggcttggtgctggggcacat

SEQ ID NO: 364131 - DNA, 25 bp, Artificial Sequence
  Description of Artificial Sequence: Synthetic oligonucleotide
tccgcgggtaccaccagttcgccta

SEQ ID NO: 364132 - DNA, 25 bp, Artificial Sequence
  Description of Artificial Sequence: Synthetic oligonucleotide
ggggcttggtgctggggcacatcat

SEQ ID NO: 364133 - DNA, 24 bp, Artificial Sequence
  Description of Artificial Sequence: Synthetic oligonucleotide
ccgcgggtaccaccagttcgccta

SEQ ID NO: 364134 - DNA, 26 bp, Artificial Sequence
  Description of Artificial Sequence: Synthetic oligonucleotide
gggcttggtgctggggcacatcatct

SEQ ID NO: 364135 - DNA, 24 bp, Artificial Sequence
  Description of Artificial Sequence: Synthetic oligonucleotide
cgcgggtaccaccagttcgcctac

SEQ ID NO: 364136 - DNA, 26 bp, Artificial Sequence
  Description of Artificial Sequence: Synthetic oligonucleotide
ggcttggtgctggggcacatcatctg

SEQ ID NO: 364137 - DNA, 25 bp, Artificial Sequence
  Description of Artificial Sequence: Synthetic oligonucleotide
gcgggtaccaccagttcgcctacga

SEQ ID NO: 364138 - DNA, 26 bp, Artificial Sequence
  Description of Artificial Sequence: Synthetic oligonucleotide
gcttggtgctggggcacatcatctgg

SEQ ID NO: 364139 - DNA, 25 bp, Artificial Sequence
  Description of Artificial Sequence: Synthetic oligonucleotide
cgggtaccaccagttcgcctacgac

SEQ ID NO: 364140 - DNA, 27 bp, Artificial Sequence
  Description of Artificial Sequence: Synthetic oligonucleotide
cttggtgctggggcacatcatctggga

SEQ ID NO: 364141 - DNA, 25 bp, Artificial Sequence
  Description of Artificial Sequence: Synthetic oligonucleotide
gggtaccaccagttcgcctacgacg

SEQ ID NO: 364142 - DNA, 27 bp, Artificial Sequence
  Description of Artificial Sequence: Synthetic oligonucleotide
ttggtgctggggcacatcatctgggag

SEQ ID NO: 364143 - DNA, 25 bp, Artificial Sequence
  Description of Artificial Sequence: Synthetic oligonucleotide
ggtaccaccagttcgcctacgacgg

SEQ ID NO: 364144 - DNA, 27 bp, Artificial Sequence
  Description of Artificial Sequence: Synthetic oligonucleotide
tggtgctggggcacatcatctgggagt

SEQ ID NO: 364145 - DNA, 27 bp, Artificial Sequence
  Description of Artificial Sequence: Synthetic oligonucleotide
gtaccaccagttcgcctacgacggcaa

SEQ ID NO: 364146 - DNA, 26 bp, Artificial Sequence
  Description of Artificial Sequence: Synthetic oligonucleotide
ggtgctggggcacatcatctgggagt

SEQ ID NO: 364147 - DNA, 27 bp, Artificial Sequence
  Description of Artificial Sequence: Synthetic oligonucleotide
taccaccagttcgcctacgacggcaag

SEQ ID NO: 364148 - DNA, 26 bp, Artificial Sequence
  Description of Artificial Sequence: Synthetic oligonucleotide
gtgctggggcacatcatctgggagtg

SEQ ID NO: 364149 - DNA, 26 bp, Artificial Sequence
  Description of Artificial Sequence: Synthetic oligonucleotide
accaccagttcgcctacgacggcaag

SEQ ID NO: 364150 - DNA, 26 bp, Artificial Sequence
  Description of Artificial Sequence: Synthetic oligonucleotide
tgctggggcacatcatctgggagtgg

SEQ ID NO: 364151 - DNA, 25 bp, Artificial Sequence
  Description of Artificial Sequence: Synthetic oligonucleotide
ccaccagttcgcctacgacggcaag

SEQ ID NO: 364152 - DNA, 25 bp, Artificial Sequence
  Description of Artificial Sequence: Synthetic oligonucleotide
gctggggcacatcatctgggagtgg

SEQ ID NO: 364153 - DNA, 27 bp, Artificial Sequence
  Description of Artificial Sequence: Synthetic oligonucleotide
caccagttcgcctacgacggcaaggat

SEQ ID NO: 364154 - DNA, 25 bp, Artificial Sequence
  Description of Artificial Sequence: Synthetic oligonucleotide
ctggggcacatcatctgggagtggg

SEQ ID NO: 364155 - DNA, 29 bp, Artificial Sequence
  Description of Artificial Sequence: Synthetic oligonucleotide
accagttcgcctacgacggcaaggattac

SEQ ID NO: 364156 - DNA, 27 bp, Artificial Sequence
  Description of Artificial Sequence: Synthetic oligonucleotide
tggggcacatcatctgggagtgggctt

SEQ ID NO: 364157 - DNA, 28 bp, Artificial Sequence
  Description of Artificial Sequence: Synthetic oligonucleotide
ccagttcgcctacgacggcaaggattac

SEQ ID NO: 364158 - DNA, 26 bp, Artificial Sequence
  Description of Artificial Sequence: Synthetic oligonucleotide
ggggcacatcatctgggagtgggctt

SEQ ID NO: 364159 - DNA, 30 bp, Artificial Sequence; identical to SEQ ID NO: 8971
  Description of Artificial Sequence: Synthetic oligonucleotide

SEQ ID NO: 364160 - DNA, 27 bp, Artificial Sequence
  Description of Artificial Sequence: Synthetic oligonucleotide
gggcacatcatctgggagtgggcttct

SEQ ID NO: 364161 - DNA, 30 bp, Artificial Sequence; identical to SEQ ID NO: 8972
  Description of Artificial Sequence: Synthetic oligonucleotide

SEQ ID NO: 364162 - DNA, 28 bp, Artificial Sequence
  Description of Artificial Sequence: Synthetic oligonucleotide
ggcacatcatctgggagtgggcttcttc

SEQ ID NO: 364163 - DNA, 29 bp, Artificial Sequence
  Description of Artificial Sequence: Synthetic oligonucleotide
gttcgcctacgacggcaaggattacatcg

SEQ ID NO: 364164 - DNA, 30 bp, Artificial Sequence; identical to SEQ ID NO: 236688
  Description of Artificial Sequence: Synthetic oligonucleotide

SEQ ID NO: 364165 - DNA, 29 bp, Artificial Sequence
  Description of Artificial Sequence: Synthetic oligonucleotide
ttcgcctacgacggcaaggattacatcgc

SEQ ID NO: 364166 - DNA, 30 bp, Artificial Sequence; identical to SEQ ID NO: 236689
  Description of Artificial Sequence: Synthetic oligonucleotide

SEQ ID NO: 364167 - DNA, 28 bp, Artificial Sequence
  Description of Artificial Sequence: Synthetic oligonucleotide
tcgcctacgacggcaaggattacatcgc

SEQ ID NO: 364168 - DNA, 31 bp, Artificial Sequence; identical to SEQ ID NO: 236690
  Description of Artificial Sequence: Synthetic oligonucleotide

SEQ ID NO: 364169 - DNA, 24 bp, Artificial Sequence
  Description of Artificial Sequence: Synthetic oligonucleotide
ggactggcgcttcctccgcggata

SEQ ID NO: 364170 - DNA, 30 bp, Artificial Sequence; identical to SEQ ID NO: 236691
  Description of Artificial Sequence: Synthetic oligonucleotide

SEQ ID NO: 364171 - DNA, 24 bp, Artificial Sequence
  Description of Artificial Sequence: Synthetic oligonucleotide
gactggcgcttcctccgcggatac

SEQ ID NO: 364172 - DNA, 31 bp, Artificial Sequence; identical to SEQ ID NO: 236692
  Description of Artificial Sequence: Synthetic oligonucleotide

SEQ ID NO: 364173 - DNA, 25 bp, Artificial Sequence
  Description of Artificial Sequence: Synthetic oligonucleotide
actggcgcttcctccgcggatacca

SEQ ID NO: 364174 - DNA, 30 bp, Artificial Sequence; identical to SEQ ID NO: 236693
  Description of Artificial Sequence: Synthetic oligonucleotide

SEQ ID NO: 364175 - DNA, 24 bp, Artificial Sequence
  Description of Artificial Sequence: Synthetic oligonucleotide
ctggcgcttcctccgcggatacca

SEQ ID NO: 364176 - DNA, 29 bp, Artificial Sequence
  Description of Artificial Sequence: Synthetic oligonucleotide
catctgggagtgggcttcttcatgctcag

SEQ ID NO: 364177 - DNA, 24 bp, Artificial Sequence
  Description of Artificial Sequence: Synthetic oligonucleotide
tggcgcttcctccgcggataccac

SEQ ID NO: 364178 - DNA, 29 bp, Artificial Sequence
  Description of Artificial Sequence: Synthetic oligonucleotide
atctgggagtgggcttcttcatgctcagg

SEQ ID NO: 364179 - DNA, 23 bp, Artificial Sequence
  Description of Artificial Sequence: Synthetic oligonucleotide
ggcgcttcctccgcggataccac

SEQ ID NO: 364180 - DNA, 28 bp, Artificial Sequence
  Description of Artificial Sequence: Synthetic oligonucleotide
tctgggagtgggcttcttcatgctcagg

SEQ ID NO: 364181 - DNA, 24 bp, Artificial Sequence
  Description of Artificial Sequence: Synthetic oligonucleotide
gcgcttcctccgcggataccacca

SEQ ID NO: 364182 - DNA, 27 bp, Artificial Sequence
  Description of Artificial Sequence: Synthetic oligonucleotide
ctgggagtgggcttcttcatgctcagg

SEQ ID NO: 364183 - DNA, 26 bp, Artificial Sequence
  Description of Artificial Sequence: Synthetic oligonucleotide
cgcttcctccgcggataccaccagtt

SEQ ID NO: 364184 - DNA, 28 bp, Artificial Sequence
  Description of Artificial Sequence: Synthetic oligonucleotide
tgggagtgggcttcttcatgctcaggag

SEQ ID NO: 364185 - DNA, 26 bp, Artificial Sequence
  Description of Artificial Sequence: Synthetic oligonucleotide
gcttcctccgcggataccaccagttc

SEQ ID NO: 364186 - DNA, 27 bp, Artificial Sequence
  Description of Artificial Sequence: Synthetic oligonucleotide
gggagtgggcttcttcatgctcaggag

SEQ ID NO: 364187 - DNA, 26 bp, Artificial Sequence
  Description of Artificial Sequence: Synthetic oligonucleotide
cttcctccgcggataccaccagttcg

SEQ ID NO: 364188 - DNA, 27 bp, Artificial Sequence
  Description of Artificial Sequence: Synthetic oligonucleotide
ggagtgggcttcttcatgctcaggagg

SEQ ID NO: 364189 - DNA, 26 bp, Artificial Sequence
  Description of Artificial Sequence: Synthetic oligonucleotide
ttcctccgcggataccaccagttcgc

SEQ ID NO: 364190 - DNA, 28 bp, Artificial Sequence
  Description of Artificial Sequence: Synthetic oligonucleotide
gagtgggcttcttcatgctcaggaggag

SEQ ID NO: 364191 - DNA, 25 bp, Artificial Sequence
  Description of Artificial Sequence: Synthetic oligonucleotide
tcctccgcggataccaccagttcgc

SEQ ID NO: 364192 - DNA, 28 bp, Artificial Sequence
  Description of Artificial Sequence: Synthetic oligonucleotide
agtgggcttcttcatgctcaggaggagg

SEQ ID NO: 364193 - DNA, 24 bp, Artificial Sequence
  Description of Artificial Sequence: Synthetic oligonucleotide
cctccgcggataccaccagttcgc

SEQ ID NO: 364194 - DNA, 27 bp, Artificial Sequence
  Description of Artificial Sequence: Synthetic oligonucleotide
gtgggcttcttcatgctcaggaggagg

SEQ ID NO: 364195 - DNA, 26 bp, Artificial Sequence
  Description of Artificial Sequence: Synthetic oligonucleotide
ctccgcggataccaccagttcgccta

SEQ ID NO: 364196 - DNA, 29 bp, Artificial Sequence
  Description of Artificial Sequence: Synthetic oligonucleotide
tgggcttcttcatgctcaggaggaggaag

SEQ ID NO: 364197 - DNA, 26 bp, Artificial Sequence
  Description of Artificial Sequence: Synthetic oligonucleotide
tccgcggataccaccagttcgcctac

SEQ ID NO: 364198 - DNA, 28 bp, Artificial Sequence
  Description of Artificial Sequence: Synthetic oligonucleotide
gggcttcttcatgctcaggaggaggaag

SEQ ID NO: 364199 - DNA, 25 bp, Artificial Sequence
  Description of Artificial Sequence: Synthetic oligonucleotide
ccgcggataccaccagttcgcctac

SEQ ID NO: 364200 - DNA, 31 bp, Artificial Sequence; identical to SEQ ID NO: 236706
  Description of Artificial Sequence: Synthetic oligonucleotide

SEQ ID NO: 364201 - DNA, 26 bp, Artificial Sequence
  Description of Artificial Sequence: Synthetic oligonucleotide
cgcggataccaccagttcgcctacga

SEQ ID NO: 364202 - DNA, 33 bp, Artificial Sequence; identical to SEQ ID NO: 236707
  Description of Artificial Sequence: Synthetic oligonucleotide

SEQ ID NO: 364203 - DNA, 26 bp, Artificial Sequence
  Description of Artificial Sequence: Synthetic oligonucleotide
gcggataccaccagttcgcctacgac

SEQ ID NO: 364204 - DNA, 35 bp, Artificial Sequence; identical to SEQ ID NO: 236708
  Description of Artificial Sequence: Synthetic oligonucleotide

SEQ ID NO: 364205 - DNA, 26 bp, Artificial Sequence
  Description of Artificial Sequence: Synthetic oligonucleotide
cggataccaccagttcgcctacgacg

SEQ ID NO: 364206 - DNA, 35 bp, Artificial Sequence; identical to SEQ ID NO: 236709
  Description of Artificial Sequence: Synthetic oligonucleotide

SEQ ID NO: 364207 - DNA, 26 bp, Artificial Sequence
  Description of Artificial Sequence: Synthetic oligonucleotide
ggataccaccagttcgcctacgacgg

SEQ ID NO: 364208 - DNA, 34 bp, Artificial Sequence; identical to SEQ ID NO: 236710
  Description of Artificial Sequence: Synthetic oligonucleotide

SEQ ID NO: 364209 - DNA, 27 bp, Artificial Sequence
  Description of Artificial Sequence: Synthetic oligonucleotide
gataccaccagttcgcctacgacggca

SEQ ID NO: 364210 - DNA, 33 bp, Artificial Sequence; identical to SEQ ID NO: 236711
  Description of Artificial Sequence: Synthetic oligonucleotide

SEQ ID NO: 364211 - DNA, 28 bp, Artificial Sequence
  Description of Artificial Sequence: Synthetic oligonucleotide
ataccaccagttcgcctacgacggcaag

SEQ ID NO: 364212 - DNA, 34 bp, Artificial Sequence; identical to SEQ ID NO: 236712
  Description of Artificial Sequence: Synthetic oligonucleotide

SEQ ID NO: 364213 - DNA, 24 bp, Artificial Sequence
  Description of Artificial Sequence: Synthetic oligonucleotide
tggggtcggactggcgcttcctct

SEQ ID NO: 364214 - DNA, 33 bp, Artificial Sequence; identical to SEQ ID NO: 236713
  Description of Artificial Sequence: Synthetic oligonucleotide

SEQ ID NO: 364215 - DNA, 23 bp, Artificial Sequence
  Description of Artificial Sequence: Synthetic oligonucleotide
ggggtcggactggcgcttcctct

SEQ ID NO: 364216 - DNA, 32 bp, Artificial Sequence; identical to SEQ ID NO: 236714
  Description of Artificial Sequence: Synthetic oligonucleotide

SEQ ID NO: 364217 - DNA, 23 bp, Artificial Sequence
  Description of Artificial Sequence: Synthetic oligonucleotide
gggtcggactggcgcttcctctg

SEQ ID NO: 364218 - DNA, 32 bp, Artificial Sequence; identical to SEQ ID NO: 236715
  Description of Artificial Sequence: Synthetic oligonucleotide

SEQ ID NO: 364219 - DNA, 23 bp, Artificial Sequence
  Description of Artificial Sequence: Synthetic oligonucleotide
ggtcggactggcgcttcctctgc

SEQ ID NO: 364220 - DNA, 31 bp, Artificial Sequence; identical to SEQ ID NO: 236716
  Description of Artificial Sequence: Synthetic oligonucleotide

SEQ ID NO: 364221 - DNA, 23 bp, Artificial Sequence
  Description of Artificial Sequence: Synthetic oligonucleotide
gtcggactggcgcttcctctgcg

SEQ ID NO: 364222 - DNA, 30 bp, Artificial Sequence; identical to SEQ ID NO: 236717
  Description of Artificial Sequence: Synthetic oligonucleotide

SEQ ID NO: 364223 - DNA, 23 bp, Artificial Sequence
  Description of Artificial Sequence: Synthetic oligonucleotide
tcggactggcgcttcctctgcgg

SEQ ID NO: 364224 - DNA, 32 bp, Artificial Sequence; identical to SEQ ID NO: 236718
  Description of Artificial Sequence: Synthetic oligonucleotide

SEQ ID NO: 364225 - DNA, 22 bp, Artificial Sequence
  Description of Artificial Sequence: Synthetic oligonucleotide
cggactggcgcttcctctgcgg

SEQ ID NO: 364226 - DNA, 33 bp, Artificial Sequence; identical to SEQ ID NO: 236719
  Description of Artificial Sequence: Synthetic oligonucleotide

SEQ ID NO: 364227 - DNA, 24 bp, Artificial Sequence
  Description of Artificial Sequence: Synthetic oligonucleotide
ggactggcgcttcctctgcgggta

SEQ ID NO: 364228 - DNA, 32 bp, Artificial Sequence; identical to SEQ ID NO: 236720
  Description of Artificial Sequence: Synthetic oligonucleotide

SEQ ID NO: 364229 - DNA, 24 bp, Artificial Sequence
  Description of Artificial Sequence: Synthetic oligonucleotide
gactggcgcttcctctgcgggtac

SEQ ID NO: 364230 - DNA, 32 bp, Artificial Sequence; identical to SEQ ID NO: 236721
  Description of Artificial Sequence: Synthetic oligonucleotide

SEQ ID NO: 364231 - DNA, 25 bp, Artificial Sequence
  Description of Artificial Sequence: Synthetic oligonucleotide
actggcgcttcctctgcgggtacca

SEQ ID NO: 364232 - DNA, 31 bp, Artificial Sequence; identical to SEQ ID NO: 236722
  Description of Artificial Sequence: Synthetic oligonucleotide

SEQ ID NO: 364233 - DNA, 24 bp, Artificial Sequence
  Description of Artificial Sequence: Synthetic oligonucleotide
ctggcgcttcctctgcgggtacca

SEQ ID NO: 364234 - DNA, 24 bp, Artificial Sequence
  Description of Artificial Sequence: Synthetic oligonucleotide
tggcgcttcctctgcgggtaccac

SEQ ID NO: 364235 - DNA, 23 bp, Artificial Sequence
  Description of Artificial Sequence: Synthetic oligonucleotide
ggcgcttcctctgcgggtaccac

SEQ ID NO: 364236 - DNA, 24 bp, Artificial Sequence
  Description of Artificial Sequence: Synthetic oligonucleotide
gcgcttcctctgcgggtaccacca

SEQ ID NO: 364237 - DNA, 26 bp, Artificial Sequence
  Description of Artificial Sequence: Synthetic oligonucleotide
cgcttcctctgcgggtaccaccagta

SEQ ID NO: 364238 - DNA, 26 bp, Artificial Sequence
  Description of Artificial Sequence: Synthetic oligonucleotide
gcttcctctgcgggtaccaccagtac

SEQ ID NO: 364239 - DNA, 26 bp, Artificial Sequence
  Description of Artificial Sequence: Synthetic oligonucleotide
cttcctctgcgggtaccaccagtacg

SEQ ID NO: 364240 - DNA, 26 bp, Artificial Sequence
  Description of Artificial Sequence: Synthetic oligonucleotide
ttcctctgcgggtaccaccagtacgc

SEQ ID NO: 364241 - DNA, 25 bp, Artificial Sequence
  Description of Artificial Sequence: Synthetic oligonucleotide
tcctctgcgggtaccaccagtacgc

SEQ ID NO: 364242 - DNA, 24 bp, Artificial Sequence
  Description of Artificial Sequence: Synthetic oligonucleotide
cctctgcgggtaccaccagtacgc

SEQ ID NO: 364243 - DNA, 26 bp, Artificial Sequence
  Description of Artificial Sequence: Synthetic oligonucleotide
ctctgcgggtaccaccagtacgccta

SEQ ID NO: 364244 - DNA, 26 bp, Artificial Sequence
  Description of Artificial Sequence: Synthetic oligonucleotide
tctgcgggtaccaccagtacgcctac

SEQ ID NO: 364245 - DNA, 25 bp, Artificial Sequence
  Description of Artificial Sequence: Synthetic oligonucleotide
ctgcgggtaccaccagtacgcctac

SEQ ID NO: 364246 - DNA, 26 bp, Artificial Sequence
  Description of Artificial Sequence: Synthetic oligonucleotide
tgcgggtaccaccagtacgcctacga

SEQ ID NO: 364247 - DNA, 28 bp, Artificial Sequence
  Description of Artificial Sequence: Synthetic oligonucleotide
agtggctccgcagatacctggagaacag

SEQ ID NO: 364248 - DNA, 27 bp, Artificial Sequence
  Description of Artificial Sequence: Synthetic oligonucleotide
gtggctccgcagatacctggagaacag

SEQ ID NO: 364249 - DNA, 27 bp, Artificial Sequence
  Description of Artificial Sequence: Synthetic oligonucleotide
tggctccgcagatacctggagaacagg

SEQ ID NO: 364250 - DNA, 27 bp, Artificial Sequence
  Description of Artificial Sequence: Synthetic oligonucleotide
ggctccgcagatacctggagaacagga

SEQ ID NO: 364251 - DNA, 28 bp, Artificial Sequence
  Description of Artificial Sequence: Synthetic oligonucleotide
gctccgcagatacctggagaacaggaag

SEQ ID NO: 364252 - DNA, 28 bp, Artificial Sequence
  Description of Artificial Sequence: Synthetic oligonucleotide
ctccgcagatacctggagaacaggaagg

SEQ ID NO: 364253 - DNA, 29 bp, Artificial Sequence
  Description of Artificial Sequence: Synthetic oligonucleotide
tccgcagatacctggagaacaggaaggag

SEQ ID NO: 364254 - DNA, 28 bp, Artificial Sequence
  Description of Artificial Sequence: Synthetic oligonucleotide
ccgcagatacctggagaacaggaaggag

SEQ ID NO: 364255 - DNA, 29 bp, Artificial Sequence
  Description of Artificial Sequence: Synthetic oligonucleotide
cgcagatacctggagaacaggaaggagac

SEQ ID NO: 364256 - DNA, 29 bp, Artificial Sequence
  Description of Artificial Sequence: Synthetic oligonucleotide
gcagatacctggagaacaggaaggagacg

SEQ ID NO: 364257 - DNA, 29 bp, Artificial Sequence
  Description of Artificial Sequence: Synthetic oligonucleotide
cagatacctggagaacaggaaggagacgc

SEQ ID NO: 364258 - DNA, 30 bp, Artificial Sequence; identical to SEQ ID NO: 10059
  Description of Artificial Sequence: Synthetic oligonucleotide

SEQ ID NO: 364259 - DNA, 29 bp, Artificial Sequence
  Description of Artificial Sequence: Synthetic oligonucleotide
gatacctggagaacaggaaggagacgctg

SEQ ID NO: 364260 - DNA, 29 bp, Artificial Sequence
  Description of Artificial Sequence: Synthetic oligonucleotide
atacctggagaacaggaaggagacgctgc

SEQ ID NO: 364261 - DNA, 28 bp, Artificial Sequence
  Description of Artificial Sequence: Synthetic oligonucleotide
tacctggagaacaggaaggagacgctgc

SEQ ID NO: 364262 - DNA, 27 bp, Artificial Sequence
  Description of Artificial Sequence: Synthetic oligonucleotide
acctggagaacaggaaggagacgctgc

SEQ ID NO: 364263 - DNA, 27 bp, Artificial Sequence
  Description of Artificial Sequence: Synthetic oligonucleotide
cctggagaacaggaaggagacgctgca

SEQ ID NO: 364264 - DNA, 27 bp, Artificial Sequence
  Description of Artificial Sequence: Synthetic oligonucleotide
ctggagaacaggaaggagacgctgcag

SEQ ID NO: 364265 - DNA, 27 bp, Artificial Sequence
  Description of Artificial Sequence: Synthetic oligonucleotide
tggagaacaggaaggagacgctgcagc

SEQ ID NO: 364266 - DNA, 26 bp, Artificial Sequence
  Description of Artificial Sequence: Synthetic oligonucleotide
ggagaacaggaaggagacgctgcagc

SEQ ID NO: 364267 - DNA, 26 bp, Artificial Sequence
  Description of Artificial Sequence: Synthetic oligonucleotide
gagaacaggaaggagacgctgcagcg

SEQ ID NO: 364268 - DNA, 27 bp, Artificial Sequence
  Description of Artificial Sequence: Synthetic oligonucleotide
agaacaggaaggagacgctgcagcgca

SEQ ID NO: 364269 - DNA, 26 bp, Artificial Sequence
  Description of Artificial Sequence: Synthetic oligonucleotide
gaacaggaaggagacgctgcagcgca

SEQ ID NO: 364270 - DNA, 26 bp, Artificial Sequence
  Description of Artificial Sequence: Synthetic oligonucleotide
aacaggaaggagacgctgcagcgcac

SEQ ID NO: 364271 - DNA, 25 bp, Artificial Sequence
  Description of Artificial Sequence: Synthetic oligonucleotide
acaggaaggagacgctgcagcgcac

SEQ ID NO: 364272 - DNA, 24 bp, Artificial Sequence
  Description of Artificial Sequence: Synthetic oligonucleotide
caggaaggagacgctgcagcgcac

SEQ ID NO: 364273 - DNA, 24 bp, Artificial Sequence
  Description of Artificial Sequence: Synthetic oligonucleotide
aggaaggagacgctgcagcgcacg

SEQ ID NO: 364274 - DNA, 27 bp, Artificial Sequence
  Description of Artificial Sequence: Synthetic oligonucleotide
agtggctccgcagatacctggagaacc

SEQ ID NO: 364275 - DNA, 26 bp, Artificial Sequence
  Description of Artificial Sequence: Synthetic oligonucleotide
gtggctccgcagatacctggagaacc

SEQ ID NO: 364276 - DNA, 26 bp, Artificial Sequence
  Description of Artificial Sequence: Synthetic oligonucleotide
tggctccgcagatacctggagaaccg

SEQ ID NO: 364277 - DNA, 25 bp, Artificial Sequence
  Description of Artificial Sequence: Synthetic oligonucleotide
ggctccgcagatacctggagaaccg

SEQ ID NO: 364278 - DNA, 27 bp, Artificial Sequence
  Description of Artificial Sequence: Synthetic oligonucleotide
gctccgcagatacctggagaaccggaa

SEQ ID NO: 364279 - DNA, 27 bp, Artificial Sequence
  Description of Artificial Sequence: Synthetic oligonucleotide
ctccgcagatacctggagaaccggaag

SEQ ID NO: 364280 - DNA, 27 bp, Artificial Sequence
  Description of Artificial Sequence: Synthetic oligonucleotide
tccgcagatacctggagaaccggaagg

SEQ ID NO: 364281 - DNA, 27 bp, Artificial Sequence
  Description of Artificial Sequence: Synthetic oligonucleotide
ccgcagatacctggagaaccggaagga

SEQ ID NO: 364282 - DNA, 27 bp, Artificial Sequence
  Description of Artificial Sequence: Synthetic oligonucleotide
cgcagatacctggagaaccggaaggag

SEQ ID NO: 364283 - DNA, 28 bp, Artificial Sequence
  Description of Artificial Sequence: Synthetic oligonucleotide
gcagatacctggagaaccggaaggagac

SEQ ID NO: 364284 - DNA, 28 bp, Artificial Sequence
  Description of Artificial Sequence: Synthetic oligonucleotide
cagatacctggagaaccggaaggagacg

SEQ ID NO: 364285 - DNA, 28 bp, Artificial Sequence
  Description of Artificial Sequence: Synthetic oligonucleotide
agatacctggagaaccggaaggagacgc

SEQ ID NO: 364286 - DNA, 27 bp, Artificial Sequence
  Description of Artificial Sequence: Synthetic oligonucleotide
gatacctggagaaccggaaggagacgc

SEQ ID NO: 364287 - DNA, 28 bp, Artificial Sequence
  Description of Artificial Sequence: Synthetic oligonucleotide
atacctggagaaccggaaggagacgctg

SEQ ID NO: 364288 - DNA, 27 bp, Artificial Sequence
  Description of Artificial Sequence: Synthetic oligonucleotide
tacctggagaaccggaaggagacgctg

SEQ ID NO: 364289 - DNA, 26 bp, Artificial Sequence
  Description of Artificial Sequence: Synthetic oligonucleotide
acctggagaaccggaaggagacgctg

SEQ ID NO: 364290 - DNA, 25 bp, Artificial Sequence
  Description of Artificial Sequence: Synthetic oligonucleotide
cctggagaaccggaaggagacgctg

SEQ ID NO: 364291 - DNA, 26 bp, Artificial Sequence
  Description of Artificial Sequence: Synthetic oligonucleotide
ctggagaaccggaaggagacgctgca

SEQ ID NO: 364292 - DNA, 26 bp, Artificial Sequence
  Description of Artificial Sequence: Synthetic oligonucleotide
tggagaaccggaaggagacgctgcag

SEQ ID NO: 364293 - DNA, 25 bp, Artificial Sequence
  Description of Artificial Sequence: Synthetic oligonucleotide
ggagaaccggaaggagacgctgcag

SEQ ID NO: 364294 - DNA, 25 bp, Artificial Sequence
  Description of Artificial Sequence: Synthetic oligonucleotide
gagaaccggaaggagacgctgcagc

SEQ ID NO: 364295 - DNA, 25 bp, Artificial Sequence
  Description of Artificial Sequence: Synthetic oligonucleotide
agaaccggaaggagacgctgcagcg

SEQ ID NO: 364296 - DNA, 24 bp, Artificial Sequence
  Description of Artificial Sequence: Synthetic oligonucleotide
gaaccggaaggagacgctgcagcg

SEQ ID NO: 364297 - DNA, 25 bp, Artificial Sequence
  Description of Artificial Sequence: Synthetic oligonucleotide
aaccggaaggagacgctgcagcgca

SEQ ID NO: 364298 - DNA, 24 bp, Artificial Sequence
  Description of Artificial Sequence: Synthetic oligonucleotide
accggaaggagacgctgcagcgca

SEQ ID NO: 364299 - DNA, 23 bp, Artificial Sequence
  Description of Artificial Sequence: Synthetic oligonucleotide
ccggaaggagacgctgcagcgca

SEQ ID NO: 364300 - DNA, 23 bp, Artificial Sequence
  Description of Artificial Sequence: Synthetic oligonucleotide
cggaaggagacgctgcagcgcac

SEQ ID NO: 364301 - DNA, 22 bp, Artificial Sequence
  Description of Artificial Sequence: Synthetic oligonucleotide
ggccccaggcgtggctctcaga

SEQ ID NO: 364302 - DNA, 23 bp, Artificial Sequence
  Description of Artificial Sequence: Synthetic oligonucleotide
gccccaggcgtggctctcagagt

SEQ ID NO: 364303 - DNA, 24 bp, Artificial Sequence
  Description of Artificial Sequence: Synthetic oligonucleotide
ccccaggcgtggctctcagagtct

SEQ ID NO: 364304 - DNA, 25 bp, Artificial Sequence
  Description of Artificial Sequence: Synthetic oligonucleotide
cccaggcgtggctctcagagtctca

SEQ ID NO: 364305 - DNA, 25 bp, Artificial Sequence
  Description of Artificial Sequence: Synthetic oligonucleotide
ccaggcgtggctctcagagtctcag

SEQ ID NO: 364306 - DNA, 25 bp, Artificial Sequence
  Description of Artificial Sequence: Synthetic oligonucleotide
caggcgtggctctcagagtctcagg

SEQ ID NO: 364307 - DNA, 25 bp, Artificial Sequence
  Description of Artificial Sequence: Synthetic oligonucleotide
aggcgtggctctcagagtctcaggc

SEQ ID NO: 364308 - DNA, 24 bp, Artificial Sequence
  Description of Artificial Sequence: Synthetic oligonucleotide
ggcgtggctctcagagtctcaggc

SEQ ID NO: 364309 - DNA, 24 bp, Artificial Sequence
  Description of Artificial Sequence: Synthetic oligonucleotide
gcgtggctctcagagtctcaggcc

SEQ ID NO: 364310 - DNA, 24 bp, Artificial Sequence
  Description of Artificial Sequence: Synthetic oligonucleotide
cgtggctctcagagtctcaggccc

SEQ ID NO: 364311 - DNA, 24 bp, Artificial Sequence
  Description of Artificial Sequence: Synthetic oligonucleotide
gtggctctcagagtctcaggcccc

SEQ ID NO: 364312 - DNA, 26 bp, Artificial Sequence
  Description of Artificial Sequence: Synthetic oligonucleotide
tggctctcagagtctcaggccccgaa

SEQ ID NO: 364313 - DNA, 25 bp, Artificial Sequence
  Description of Artificial Sequence: Synthetic oligonucleotide
ggctctcagagtctcaggccccgaa

SEQ ID NO: 364314 - DNA, 25 bp, Artificial Sequence
  Description of Artificial Sequence: Synthetic oligonucleotide
gctctcagagtctcaggccccgaag

SEQ ID NO: 364315 - DNA, 25 bp, Artificial Sequence
  Description of Artificial Sequence: Synthetic oligonucleotide
ctctcagagtctcaggccccgaagg

SEQ ID NO: 364316 - DNA, 25 bp, Artificial Sequence
  Description of Artificial Sequence: Synthetic oligonucleotide
tctcagagtctcaggccccgaaggc

SEQ ID NO: 364317 - DNA, 24 bp, Artificial Sequence
  Description of Artificial Sequence: Synthetic oligonucleotide
ctcagagtctcaggccccgaaggc

SEQ ID NO: 364318 - DNA, 24 bp, Artificial Sequence
  Description of Artificial Sequence: Synthetic oligonucleotide
tcagagtctcaggccccgaaggcg

SEQ ID NO: 364319 - DNA, 23 bp, Artificial Sequence
  Description of Artificial Sequence: Synthetic oligonucleotide
cagagtctcaggccccgaaggcg

SEQ ID NO: 364320 - DNA, 24 bp, Artificial Sequence
  Description of Artificial Sequence: Synthetic oligonucleotide
agagtctcaggccccgaaggcggt

SEQ ID NO: 364321 - DNA, 23 bp, Artificial Sequence
  Description of Artificial Sequence: Synthetic oligonucleotide
gagtctcaggccccgaaggcggt

SEQ ID NO: 364322 - DNA, 26 bp, Artificial Sequence
  Description of Artificial Sequence: Synthetic oligonucleotide
agtctcaggccccgaaggcggtgtat

SEQ ID NO: 364323 - DNA, 28 bp, Artificial Sequence
  Description of Artificial Sequence: Synthetic oligonucleotide
agtgtcgtcgcggtcgctgttctaaagc

SEQ ID NO: 364324 - DNA, 27 bp, Artificial Sequence
  Description of Artificial Sequence: Synthetic oligonucleotide
gtgtcgtcgcggtcgctgttctaaagc

SEQ ID NO: 364325 - DNA, 27 bp, Artificial Sequence
  Description of Artificial Sequence: Synthetic oligonucleotide
tgtcgtcgcggtcgctgttctaaagcc

SEQ ID NO: 364326 - DNA, 26 bp, Artificial Sequence
  Description of Artificial Sequence: Synthetic oligonucleotide
gtcgtcgcggtcgctgttctaaagcc

SEQ ID NO: 364327 - DNA, 26 bp, Artificial Sequence
  Description of Artificial Sequence: Synthetic oligonucleotide
tcgtcgcggtcgctgttctaaagccc

SEQ ID NO: 364328 - DNA, 25 bp, Artificial Sequence
  Description of Artificial Sequence: Synthetic oligonucleotide
cgtcgcggtcgctgttctaaagccc

SEQ ID NO: 364329 - DNA, 25 bp, Artificial Sequence
  Description of Artificial Sequence: Synthetic oligonucleotide
gtcgcggtcgctgttctaaagcccg

SEQ ID NO: 364330 - DNA, 26 bp, Artificial Sequence
  Description of Artificial Sequence: Synthetic oligonucleotide
tcgcggtcgctgttctaaagcccgca

SEQ ID NO: 364331 - DNA, 25 bp, Artificial Sequence
  Description of Artificial Sequence: Synthetic oligonucleotide
cgcggtcgctgttctaaagcccgca

SEQ ID NO: 364332 - DNA, 25 bp, Artificial Sequence
  Description of Artificial Sequence: Synthetic oligonucleotide
gcggtcgctgttctaaagcccgcac

SEQ ID NO: 364333 - DNA, 25 bp, Artificial Sequence
  Description of Artificial Sequence: Synthetic oligonucleotide
cggtcgctgttctaaagcccgcacg

SEQ ID NO: 364334 - DNA, 26 bp, Artificial Sequence
  Description of Artificial Sequence: Synthetic oligonucleotide
ggtcgctgttctaaagcccgcacgca

SEQ ID NO: 364335 - DNA, 26 bp, Artificial Sequence
  Description of Artificial Sequence: Synthetic oligonucleotide
gtcgctgttctaaagcccgcacgcac

SEQ ID NO: 364336 - DNA, 26 bp, Artificial Sequence
  Description of Artificial Sequence: Synthetic oligonucleotide
tcgctgttctaaagcccgcacgcacc

SEQ ID NO: 364337 - DNA, 25 bp, Artificial Sequence
  Description of Artificial Sequence: Synthetic oligonucleotide
cgctgttctaaagcccgcacgcacc

SEQ ID NO: 364338 - DNA, 26 bp, Artificial Sequence
  Description of Artificial Sequence: Synthetic oligonucleotide
gctgttctaaagcccgcacgcaccca

SEQ ID NO: 364339 - DNA, 26 bp, Artificial Sequence
  Description of Artificial Sequence: Synthetic oligonucleotide
ctgttctaaagcccgcacgcacccac

SEQ ID NO: 364340 - DNA, 26 bp, Artificial Sequence
  Description of Artificial Sequence: Synthetic oligonucleotide
tgttctaaagcccgcacgcacccacc

SEQ ID NO: 364341 - DNA, 25 bp, Artificial Sequence
  Description of Artificial Sequence: Synthetic oligonucleotide
gttctaaagcccgcacgcacccacc

SEQ ID NO: 364342 - DNA, 25 bp, Artificial Sequence
  Description of Artificial Sequence: Synthetic oligonucleotide
ttctaaagcccgcacgcacccaccg

SEQ ID NO: 364343 - DNA, 24 bp, Artificial Sequence
  Description of Artificial Sequence: Synthetic oligonucleotide
tctaaagcccgcacgcacccaccg

SEQ ID NO: 364344 - DNA, 23 bp, Artificial Sequence
  Description of Artificial Sequence: Synthetic oligonucleotide
ctaaagcccgcacgcacccaccg

SEQ ID NO: 364345 - DNA, 23 bp, Artificial Sequence
  Description of Artificial Sequence: Synthetic oligonucleotide
taaagcccgcacgcacccaccgg

SEQ ID NO: 364346 - DNA, 22 bp, Artificial Sequence
  Description of Artificial Sequence: Synthetic oligonucleotide
aaagcccgcacgcacccaccgg

SEQ ID NO: 364347 - DNA, 21 bp, Artificial Sequence
  Description of Artificial Sequence: Synthetic oligonucleotide
aagcccgcacgcacccaccgg

SEQ ID NO: 364348 - DNA, 20 bp, Artificial Sequence
  Description of Artificial Sequence: Synthetic oligonucleotide
agcccgcacgcacccaccgg

SEQ ID NO: 364349 - DNA, 20 bp, Artificial Sequence
  Description of Artificial Sequence: Synthetic oligonucleotide
gcccgcacgcacccaccggt

SEQ ID NO: 364350 - DNA, 20 bp, Artificial Sequence
  Description of Artificial Sequence: Synthetic oligonucleotide
cccgcacgcacccaccggga

SEQ ID NO: 364351 - DNA, 29 bp, Artificial Sequence
  Description of Artificial Sequence: Synthetic oligonucleotide
ggagtattgggaccaggagacacggaatg

SEQ ID NO: 364352 - DNA, 30 bp, Artificial Sequence; identical to SEQ ID NO: 1679
  Description of Artificial Sequence: Synthetic oligonucleotide

SEQ ID NO: 364353 - DNA, 32 bp, Artificial Sequence; identical to SEQ ID NO: 1680
  Description of Artificial Sequence: Synthetic oligonucleotide

SEQ ID NO: 364354 - DNA, 31 bp, Artificial Sequence; identical to SEQ ID NO: 1681
  Description of Artificial Sequence: Synthetic oligonucleotide

SEQ ID NO: 364355 - DNA, 31 bp, Artificial Sequence; identical to SEQ ID NO: 1682
  Description of Artificial Sequence: Synthetic oligonucleotide

SEQ ID NO: 364356 - DNA, 30 bp, Artificial Sequence; identical to SEQ ID NO: 1683
  Description of Artificial Sequence: Synthetic oligonucleotide

SEQ ID NO: 364357 - DNA, 29 bp, Artificial Sequence
  Description of Artificial Sequence: Synthetic oligonucleotide
ttgggaccaggagacacggaatgtgaagg

SEQ ID NO: 364358 - DNA, 28 bp, Artificial Sequence
  Description of Artificial Sequence: Synthetic oligonucleotide
tgggaccaggagacacggaatgtgaagg

SEQ ID NO: 364359 - DNA, 27 bp, Artificial Sequence
  Description of Artificial Sequence: Synthetic oligonucleotide
gggaccaggagacacggaatgtgaagg

SEQ ID NO: 364360 - DNA, 27 bp, Artificial Sequence
  Description of Artificial Sequence: Synthetic oligonucleotide
ggaccaggagacacggaatgtgaaggc

SEQ ID NO: 364361 - DNA, 27 bp, Artificial Sequence
  Description of Artificial Sequence: Synthetic oligonucleotide
gaccaggagacacggaatgtgaaggcc

SEQ ID NO: 364362 - DNA, 27 bp, Artificial Sequence
  Description of Artificial Sequence: Synthetic oligonucleotide
accaggagacacggaatgtgaaggccc

SEQ ID NO: 364363 - DNA, 27 bp, Artificial Sequence
  Description of Artificial Sequence: Synthetic oligonucleotide
ccaggagacacggaatgtgaaggccca

SEQ ID NO: 364364 - DNA, 27 bp, Artificial Sequence
  Description of Artificial Sequence: Synthetic oligonucleotide
caggagacacggaatgtgaaggcccag

SEQ ID NO: 364365 - DNA, 28 bp, Artificial Sequence
  Description of Artificial Sequence: Synthetic oligonucleotide
aggagacacggaatgtgaaggcccagtc

SEQ ID NO: 364366 - DNA, 27 bp, Artificial Sequence
  Description of Artificial Sequence: Synthetic oligonucleotide
ggagacacggaatgtgaaggcccagtc

SEQ ID NO: 364367 - DNA, 28 bp, Artificial Sequence
  Description of Artificial Sequence: Synthetic oligonucleotide
gagacacggaatgtgaaggcccagtcac

SEQ ID NO: 364368 - DNA, 29 bp, Artificial Sequence
  Description of Artificial Sequence: Synthetic oligonucleotide
agacacggaatgtgaaggcccagtcacag

SEQ ID NO: 364369 - DNA, 28 bp, Artificial Sequence
  Description of Artificial Sequence: Synthetic oligonucleotide
gacacggaatgtgaaggcccagtcacag

SEQ ID NO: 364370 - DNA, 29 bp, Artificial Sequence
  Description of Artificial Sequence: Synthetic oligonucleotide
acacggaatgtgaaggcccagtcacagac

SEQ ID NO: 364371 - DNA, 28 bp, Artificial Sequence
  Description of Artificial Sequence: Synthetic oligonucleotide
cacggaatgtgaaggcccagtcacagac

SEQ ID NO: 364372 - DNA, 29 bp, Artificial Sequence
  Description of Artificial Sequence: Synthetic oligonucleotide
acggaatgtgaaggcccagtcacagactg

SEQ ID NO: 364373 - DNA, 28 bp, Artificial Sequence
  Description of Artificial Sequence: Synthetic oligonucleotide
cggaatgtgaaggcccagtcacagactg

SEQ ID NO: 364374 - DNA, 29 bp, Artificial Sequence
  Description of Artificial Sequence: Synthetic oligonucleotide
ggaatgtgaaggcccagtcacagactgac

SEQ ID NO: 364375 - DNA, 29 bp, Artificial Sequence
  Description of Artificial Sequence: Synthetic oligonucleotide
gaatgtgaaggcccagtcacagactgacc

SEQ ID NO: 364376 - DNA, 29 bp, Artificial Sequence
  Description of Artificial Sequence: Synthetic oligonucleotide
aatgtgaaggcccagtcacagactgaccg

SEQ ID NO: 364377 - DNA, 28 bp, Artificial Sequence
  Description of Artificial Sequence: Synthetic oligonucleotide
atgtgaaggcccagtcacagactgaccg

SEQ ID NO: 364378 - DNA, 27 bp, Artificial Sequence
  Description of Artificial Sequence: Synthetic oligonucleotide
tgtgaaggcccagtcacagactgaccg

SEQ ID NO: 364379 - DNA, 27 bp, Artificial Sequence
  Description of Artificial Sequence: Synthetic oligonucleotide
gtgaaggcccagtcacagactgaccga

SEQ ID NO: 364380 - DNA, 27 bp, Artificial Sequence
  Description of Artificial Sequence: Synthetic oligonucleotide
tgaaggcccagtcacagactgaccgag

SEQ ID NO: 364381 - DNA, 27 bp, Artificial Sequence
  Description of Artificial Sequence: Synthetic oligonucleotide
gaaggcccagtcacagactgaccgagt

SEQ ID NO: 364382 - DNA, 27 bp, Artificial Sequence
  Description of Artificial Sequence: Synthetic oligonucleotide
aaggcccagtcacagactgaccgagtg

SEQ ID NO: 364383 - DNA, 26 bp, Artificial Sequence
  Description of Artificial Sequence: Synthetic oligonucleotide
aggcccagtcacagactgaccgagtg

SEQ ID NO: 364384 - DNA, 25 bp, Artificial Sequence
  Description of Artificial Sequence: Synthetic oligonucleotide
ggcccagtcacagactgaccgagtg

SEQ ID NO: 364385 - DNA, 26 bp, Artificial Sequence
  Description of Artificial Sequence: Synthetic oligonucleotide
gcccagtcacagactgaccgagtgga

SEQ ID NO: 364386 - DNA, 26 bp, Artificial Sequence
  Description of Artificial Sequence: Synthetic oligonucleotide
cccagtcacagactgaccgagtggac

SEQ ID NO: 364387 - DNA, 27 bp, Artificial Sequence
  Description of Artificial Sequence: Synthetic oligonucleotide
ccagtcacagactgaccgagtggacct

SEQ ID NO: 364388 - DNA, 27 bp, Artificial Sequence
  Description of Artificial Sequence: Synthetic oligonucleotide
cagtcacagactgaccgagtggacctg

SEQ ID NO: 364389 - DNA, 27 bp, Artificial Sequence
  Description of Artificial Sequence: Synthetic oligonucleotide
agtcacagactgaccgagtggacctgg

SEQ ID NO: 364390 - DNA, 26 bp, Artificial Sequence
  Description of Artificial Sequence: Synthetic oligonucleotide
gtcacagactgaccgagtggacctgg

SEQ ID NO: 364391 - DNA, 26 bp, Artificial Sequence
  Description of Artificial Sequence: Synthetic oligonucleotide
tcacagactgaccgagtggacctggg

SEQ ID NO: 364392 - DNA, 25 bp, Artificial Sequence
  Description of Artificial Sequence: Synthetic oligonucleotide
cacagactgaccgagtggacctggg

SEQ ID NO: 364393 - DNA, 26 bp, Artificial Sequence
  Description of Artificial Sequence: Synthetic oligonucleotide
acagactgaccgagtggacctgggga

SEQ ID NO: 364394 - DNA, 25 bp, Artificial Sequence
  Description of Artificial Sequence: Synthetic oligonucleotide
cagactgaccgagtggacctgggga

SEQ ID NO: 364395 - DNA, 25 bp, Artificial Sequence
  Description of Artificial Sequence: Synthetic oligonucleotide
agactgaccgagtggacctggggac

SEQ ID NO: 364396 - DNA, 24 bp, Artificial Sequence
  Description of Artificial Sequence: Synthetic oligonucleotide
gactgaccgagtggacctggggac

SEQ ID NO: 364397 - DNA, 24 bp, Artificial Sequence
  Description of Artificial Sequence: Synthetic oligonucleotide
actgaccgagtggacctggggacc

SEQ ID NO: 364398 - DNA, 23 bp, Artificial Sequence
  Description of Artificial Sequence: Synthetic oligonucleotide
ctgaccgagtggacctggggacc

SEQ ID NO: 364399 - DNA, 26 bp, Artificial Sequence
  Description of Artificial Sequence: Synthetic oligonucleotide
cagagcgaggccggttctcacaccat

SEQ ID NO: 364400 - DNA, 26 bp, Artificial Sequence
  Description of Artificial Sequence: Synthetic oligonucleotide
agagcgaggccggttctcacaccatc

SEQ ID NO: 364401 - DNA, 25 bp, Artificial Sequence
  Description of Artificial Sequence: Synthetic oligonucleotide
gagcgaggccggttctcacaccatc

SEQ ID NO: 364402 - DNA, 26 bp, Artificial Sequence
  Description of Artificial Sequence: Synthetic oligonucleotide
agcgaggccggttctcacaccatcca

SEQ ID NO: 364403 - DNA, 25 bp, Artificial Sequence
  Description of Artificial Sequence: Synthetic oligonucleotide
gcgaggccggttctcacaccatcca

SEQ ID NO: 364404 - DNA, 27 bp, Artificial Sequence
  Description of Artificial Sequence: Synthetic oligonucleotide
cgaggccggttctcacaccatccagat

SEQ ID NO: 364405 - DNA, 30 bp, Artificial Sequence; identical to SEQ ID NO: 1755
  Description of Artificial Sequence: Synthetic oligonucleotide

SEQ ID NO: 364406 - DNA, 33 bp, Artificial Sequence; identical to SEQ ID NO: 1756
  Description of Artificial Sequence: Synthetic oligonucleotide

SEQ ID NO: 364407 - DNA, 32 bp, Artificial Sequence; identical to SEQ ID NO: 1757
  Description of Artificial Sequence: Synthetic oligonucleotide

SEQ ID NO: 364408 - DNA, 32 bp, Artificial Sequence; identical to SEQ ID NO: 1758
  Description of Artificial Sequence: Synthetic oligonucleotide

SEQ ID NO: 364409 - DNA, 32 bp, Artificial Sequence; identical to SEQ ID NO: 1759
  Description of Artificial Sequence: Synthetic oligonucleotide

SEQ ID NO: 364410 - DNA, 29 bp, Artificial Sequence
  Description of Artificial Sequence: Synthetic oligonucleotide
cagataatgtatggctgcgacgtggggtc

SEQ ID NO: 364411 - DNA, 29 bp, Artificial Sequence
  Description of Artificial Sequence: Synthetic oligonucleotide
agataatgtatggctgcgacgtggggtcg

SEQ ID NO: 364412 - DNA, 28 bp, Artificial Sequence
  Description of Artificial Sequence: Synthetic oligonucleotide
gataatgtatggctgcgacgtggggtcg

SEQ ID NO: 364413 - DNA, 28 bp, Artificial Sequence
  Description of Artificial Sequence: Synthetic oligonucleotide
ataatgtatggctgcgacgtggggtcgg

SEQ ID NO: 364414 - DNA, 27 bp, Artificial Sequence
  Description of Artificial Sequence: Synthetic oligonucleotide
taatgtatggctgcgacgtggggtcgg

SEQ ID NO: 364415 - DNA, 27 bp, Artificial Sequence
  Description of Artificial Sequence: Synthetic oligonucleotide
aatgtatggctgcgacgtggggtcgga

SEQ ID NO: 364416 - DNA, 24 bp, Artificial Sequence
  Description of Artificial Sequence: Synthetic oligonucleotide
tatggctgcgacgtggggtcggac

SEQ ID NO: 364417 - DNA, 23 bp, Artificial Sequence
  Description of Artificial Sequence: Synthetic oligonucleotide
atggctgcgacgtggggtcggac

SEQ ID NO: 364418 - DNA, 23 bp, Artificial Sequence
  Description of Artificial Sequence: Synthetic oligonucleotide
cgcaagtgggaggcggcccatga

SEQ ID NO: 364419 - DNA, 23 bp, Artificial Sequence
  Description of Artificial Sequence: Synthetic oligonucleotide
gcaagtgggaggcggcccatgag

SEQ ID NO: 364420 - DNA, 27 bp, Artificial Sequence
  Description of Artificial Sequence: Synthetic oligonucleotide
gcggagcagttgagagcctacctggat

SEQ ID NO: 364421 - DNA, 27 bp, Artificial Sequence
  Description of Artificial Sequence: Synthetic oligonucleotide
cggagcagttgagagcctacctggatg

SEQ ID NO: 364422 - DNA, 27 bp, Artificial Sequence
  Description of Artificial Sequence: Synthetic oligonucleotide
ggagcagttgagagcctacctggatgg

SEQ ID NO: 364423 - DNA, 27 bp, Artificial Sequence
  Description of Artificial Sequence: Synthetic oligonucleotide
gagcagttgagagcctacctggatggc

SEQ ID NO: 364424 - DNA, 28 bp, Artificial Sequence
  Description of Artificial Sequence: Synthetic oligonucleotide
agcagttgagagcctacctggatggcac

SEQ ID NO: 364425 - DNA, 27 bp, Artificial Sequence
  Description of Artificial Sequence: Synthetic oligonucleotide
gcagttgagagcctacctggatggcac

SEQ ID NO: 364426 - DNA, 27 bp, Artificial Sequence
  Description of Artificial Sequence: Synthetic oligonucleotide
cagttgagagcctacctggatggcacg

SEQ ID NO: 364427 - DNA, 28 bp, Artificial Sequence
  Description of Artificial Sequence: Synthetic oligonucleotide
agttgagagcctacctggatggcacgtg

SEQ ID NO: 364428 - DNA, 27 bp, Artificial Sequence
  Description of Artificial Sequence: Synthetic oligonucleotide
gttgagagcctacctggatggcacgtg

SEQ ID NO: 364429 - DNA, 27 bp, Artificial Sequence
  Description of Artificial Sequence: Synthetic oligonucleotide
ttgagagcctacctggatggcacgtgc

SEQ ID NO: 364430 - DNA, 26 bp, Artificial Sequence
  Description of Artificial Sequence: Synthetic oligonucleotide
tgagagcctacctggatggcacgtgc

SEQ ID NO: 364431 - DNA, 25 bp, Artificial Sequence
  Description of Artificial Sequence: Synthetic oligonucleotide
gagagcctacctggatggcacgtgc

SEQ ID NO: 364432 - DNA, 26 bp, Artificial Sequence
  Description of Artificial Sequence: Synthetic oligonucleotide
agagcctacctggatggcacgtgcgt

SEQ ID NO: 364433 - DNA, 25 bp, Artificial Sequence
  Description of Artificial Sequence: Synthetic oligonucleotide
gagcctacctggatggcacgtgcgt

SEQ ID NO: 364434 - DNA, 25 bp, Artificial Sequence
  Description of Artificial Sequence: Synthetic oligonucleotide
agcctacctggatggcacgtgcgtg

SEQ ID NO: 364435 - DNA, 24 bp, Artificial Sequence
  Description of Artificial Sequence: Synthetic oligonucleotide
gcctacctggatggcacgtgcgtg

SEQ ID NO: 364436 - DNA, 25 bp, Artificial Sequence
  Description of Artificial Sequence: Synthetic oligonucleotide
cctacctggatggcacgtgcgtgga

SEQ ID NO: 364437 - DNA, 26 bp, Artificial Sequence
  Description of Artificial Sequence: Synthetic oligonucleotide
ctacctggatggcacgtgcgtggagt

SEQ ID NO: 364438 - DNA, 26 bp, Artificial Sequence
  Description of Artificial Sequence: Synthetic oligonucleotide
tacctggatggcacgtgcgtggagtg

SEQ ID NO: 364439 - DNA, 25 bp, Artificial Sequence
  Description of Artificial Sequence: Synthetic oligonucleotide
acctggatggcacgtgcgtggagtg

SEQ ID NO: 364440 - DNA, 24 bp, Artificial Sequence
  Description of Artificial Sequence: Synthetic oligonucleotide
cctggatggcacgtgcgtggagtg

SEQ ID NO: 364441 - DNA, 24 bp, Artificial Sequence
  Description of Artificial Sequence: Synthetic oligonucleotide
ctggatggcacgtgcgtggagtgg

SEQ ID NO: 364442 - DNA, 25 bp, Artificial Sequence
  Description of Artificial Sequence: Synthetic oligonucleotide
tggatggcacgtgcgtggagtggct

SEQ ID NO: 364443 - DNA, 24 bp, Artificial Sequence
  Description of Artificial Sequence: Synthetic oligonucleotide
ggatggcacgtgcgtggagtggct

SEQ ID NO: 364444 - DNA, 24 bp, Artificial Sequence
  Description of Artificial Sequence: Synthetic oligonucleotide
gatggcacgtgcgtggagtggctc

SEQ ID NO: 364445 - DNA, 24 bp, Artificial Sequence
  Description of Artificial Sequence: Synthetic oligonucleotide
atggcacgtgcgtggagtggctcc

SEQ ID NO: 364446 - DNA, 23 bp, Artificial Sequence
  Description of Artificial Sequence: Synthetic oligonucleotide
tggcacgtgcgtggagtggctcc

SEQ ID NO: 364447 - DNA, 26 bp, Artificial Sequence
  Description of Artificial Sequence: Synthetic oligonucleotide
gacagtgcccagggctctgatgtgtc

SEQ ID NO: 364448 - DNA, 26 bp, Artificial Sequence
  Description of Artificial Sequence: Synthetic oligonucleotide
acagtgcccagggctctgatgtgtcc

SEQ ID NO: 364449 - DNA, 25 bp, Artificial Sequence
  Description of Artificial Sequence: Synthetic oligonucleotide
cagtgcccagggctctgatgtgtcc

SEQ ID NO: 364450 - DNA, 26 bp, Artificial Sequence
  Description of Artificial Sequence: Synthetic oligonucleotide
agtgcccagggctctgatgtgtccct

SEQ ID NO: 364451 - DNA, 25 bp, Artificial Sequence
  Description of Artificial Sequence: Synthetic oligonucleotide
gtgcccagggctctgatgtgtccct

SEQ ID NO: 364452 - DNA, 26 bp, Artificial Sequence
  Description of Artificial Sequence: Synthetic oligonucleotide
tgcccagggctctgatgtgtccctca

SEQ ID NO: 364453 - DNA, 25 bp, Artificial Sequence
  Description of Artificial Sequence: Synthetic oligonucleotide
gcccagggctctgatgtgtccctca

SEQ ID NO: 364454 - DNA, 26 bp, Artificial Sequence
  Description of Artificial Sequence: Synthetic oligonucleotide
cccagggctctgatgtgtccctcaca

SEQ ID NO: 364455 - DNA, 26 bp, Artificial Sequence
  Description of Artificial Sequence: Synthetic oligonucleotide
ccagggctctgatgtgtccctcacag

SEQ ID NO: 364456 - DNA, 27 bp, Artificial Sequence
  Description of Artificial Sequence: Synthetic oligonucleotide
cagggctctgatgtgtccctcacagct

SEQ ID NO: 364457 - DNA, 28 bp, Artificial Sequence
  Description of Artificial Sequence: Synthetic oligonucleotide
agggctctgatgtgtccctcacagcttg

SEQ ID NO: 364458 - DNA, 27 bp, Artificial Sequence
  Description of Artificial Sequence: Synthetic oligonucleotide
gggctctgatgtgtccctcacagcttg

SEQ ID NO: 364459 - DNA, 31 bp, Artificial Sequence; identical to SEQ ID NO: 10498
  Description of Artificial Sequence: Synthetic oligonucleotide

SEQ ID NO: 364460 - DNA, 32 bp, Artificial Sequence; identical to SEQ ID NO: 10499
  Description of Artificial Sequence: Synthetic oligonucleotide

SEQ ID NO: 364461 - DNA, 33 bp, Artificial Sequence; identical to SEQ ID NO: 10500
  Description of Artificial Sequence: Synthetic oligonucleotide

SEQ ID NO: 364462 - DNA, 22 bp, Artificial Sequence
  Description of Artificial Sequence: Synthetic oligonucleotide
cggcccatgaggcggagcagct

SEQ ID NO: 364463 - DNA, 23 bp, Artificial Sequence
  Description of Artificial Sequence: Synthetic oligonucleotide
ggcccatgaggcggagcagctga

SEQ ID NO: 364464 - DNA, 24 bp, Artificial Sequence
  Description of Artificial Sequence: Synthetic oligonucleotide
gcccatgaggcggagcagctgaga

SEQ ID NO: 364465 - DNA, 24 bp, Artificial Sequence
  Description of Artificial Sequence: Synthetic oligonucleotide
cccatgaggcggagcagctgagag

SEQ ID NO: 364466 - DNA, 24 bp, Artificial Sequence
  Description of Artificial Sequence: Synthetic oligonucleotide
ccatgaggcggagcagctgagagc

SEQ ID NO: 364467 - DNA, 26 bp, Artificial Sequence
  Description of Artificial Sequence: Synthetic oligonucleotide
catgaggcggagcagctgagagccta

SEQ ID NO: 364468 - DNA, 26 bp, Artificial Sequence
  Description of Artificial Sequence: Synthetic oligonucleotide
atgaggcggagcagctgagagcctac

SEQ ID NO: 364469 - DNA, 25 bp, Artificial Sequence
  Description of Artificial Sequence: Synthetic oligonucleotide
tgaggcggagcagctgagagcctac

SEQ ID NO: 364470 - DNA, 24 bp, Artificial Sequence
  Description of Artificial Sequence: Synthetic oligonucleotide
gaggcggagcagctgagagcctac

SEQ ID NO: 364471 - DNA, 25 bp, Artificial Sequence
  Description of Artificial Sequence: Synthetic oligonucleotide
aggcggagcagctgagagcctacct

SEQ ID NO: 364472 - DNA, 26 bp, Artificial Sequence
  Description of Artificial Sequence: Synthetic oligonucleotide
cggagcagctgagagcctacctggat

SEQ ID NO: 364473 - DNA, 26 bp, Artificial Sequence
  Description of Artificial Sequence: Synthetic oligonucleotide
ggagcagctgagagcctacctggatg

SEQ ID NO: 364474 - DNA, 26 bp, Artificial Sequence
  Description of Artificial Sequence: Synthetic oligonucleotide
gagcagctgagagcctacctggatgg

SEQ ID NO: 364475 - DNA, 27 bp, Artificial Sequence
  Description of Artificial Sequence: Synthetic oligonucleotide
agcagctgagagcctacctggatggca

SEQ ID NO: 364476 - DNA, 26 bp, Artificial Sequence
  Description of Artificial Sequence: Synthetic oligonucleotide
gcagctgagagcctacctggatggca

SEQ ID NO: 364477 - DNA, 26 bp, Artificial Sequence
  Description of Artificial Sequence: Synthetic oligonucleotide
cagctgagagcctacctggatggcac

SEQ ID NO: 364478 - DNA, 27 bp, Artificial Sequence
  Description of Artificial Sequence: Synthetic oligonucleotide
agctgagagcctacctggatggcacgt

SEQ ID NO: 364479 - DNA, 26 bp, Artificial Sequence
  Description of Artificial Sequence: Synthetic oligonucleotide
gctgagagcctacctggatggcacgt

SEQ ID NO: 364480 - DNA, 26 bp, Artificial Sequence
  Description of Artificial Sequence: Synthetic oligonucleotide
ctgagagcctacctggatggcacgtg

SEQ ID NO: 364481 - DNA, 27 bp, Artificial Sequence
  Description of Artificial Sequence: Synthetic oligonucleotide
aggggccggagtattgggaccaggaaa

SEQ ID NO: 364482 - DNA, 26 bp, Artificial Sequence
  Description of Artificial Sequence: Synthetic oligonucleotide
ggggccggagtattgggaccaggaaa

SEQ ID NO: 364483 - DNA, 27 bp, Artificial Sequence
  Description of Artificial Sequence: Synthetic oligonucleotide
gggccggagtattgggaccaggaaaca

SEQ ID NO: 364484 - DNA, 27 bp, Artificial Sequence
  Description of Artificial Sequence: Synthetic oligonucleotide
ggccggagtattgggaccaggaaacac

SEQ ID NO: 364485 - DNA, 27 bp, Artificial Sequence
  Description of Artificial Sequence: Synthetic oligonucleotide
gccggagtattgggaccaggaaacacg

SEQ ID NO: 364486 - DNA, 27 bp, Artificial Sequence
  Description of Artificial Sequence: Synthetic oligonucleotide
ccggagtattgggaccaggaaacacgg

SEQ ID NO: 364487 - DNA, 30 bp, Artificial Sequence; identical to SEQ ID NO: 10604
  Description of Artificial Sequence: Synthetic oligonucleotide

SEQ ID NO: 364488 - DNA, 31 bp, Artificial Sequence; identical to SEQ ID NO: 10605
  Description of Artificial Sequence: Synthetic oligonucleotide

SEQ ID NO: 364489 - DNA, 33 bp, Artificial Sequence; identical to SEQ ID NO: 10606
  Description of Artificial Sequence: Synthetic oligonucleotide

SEQ ID NO: 364490 - DNA, 33 bp, Artificial Sequence; identical to SEQ ID NO: 10607
  Description of Artificial Sequence: Synthetic oligonucleotide

SEQ ID NO: 364491 - DNA, 32 bp, Artificial Sequence; identical to SEQ ID NO: 10608
  Description of Artificial Sequence: Synthetic oligonucleotide

SEQ ID NO: 364492 - DNA, 32 bp, Artificial Sequence; identical to SEQ ID NO: 10609
  Description of Artificial Sequence: Synthetic oligonucleotide

SEQ ID NO: 364493 - DNA, 31 bp, Artificial Sequence; identical to SEQ ID NO: 10610
  Description of Artificial Sequence: Synthetic oligonucleotide

SEQ ID NO: 364494 - DNA, 30 bp, Artificial Sequence; identical to SEQ ID NO: 10611
  Description of Artificial Sequence: Synthetic oligonucleotide

SEQ ID NO: 364495 - DNA, 29 bp, Artificial Sequence
  Description of Artificial Sequence: Synthetic oligonucleotide
tgggaccaggaaacacggaatgtgaaggc

SEQ ID NO: 364496 - DNA, 28 bp, Artificial Sequence
  Description of Artificial Sequence: Synthetic oligonucleotide
gggaccaggaaacacggaatgtgaaggc

SEQ ID NO: 364497 - DNA, 28 bp, Artificial Sequence
  Description of Artificial Sequence: Synthetic oligonucleotide
ggaccaggaaacacggaatgtgaaggcc

SEQ ID NO: 364498 - DNA, 28 bp, Artificial Sequence
  Description of Artificial Sequence: Synthetic oligonucleotide
gaccaggaaacacggaatgtgaaggccc

SEQ ID NO: 364499 - DNA, 29 bp, Artificial Sequence
  Description of Artificial Sequence: Synthetic oligonucleotide
accaggaaacacggaatgtgaaggcccag

SEQ ID NO: 364500 - DNA, 28 bp, Artificial Sequence
  Description of Artificial Sequence: Synthetic oligonucleotide
ccaggaaacacggaatgtgaaggcccag

SEQ ID NO: 364501 - DNA, 29 bp, Artificial Sequence
  Description of Artificial Sequence: Synthetic oligonucleotide
caggaaacacggaatgtgaaggcccagtc

SEQ ID NO: 364502 - DNA, 30 bp, Artificial Sequence; identical to SEQ ID NO: 10619
  Description of Artificial Sequence: Synthetic oligonucleotide

SEQ ID NO: 364503 - DNA, 29 bp, Artificial Sequence
  Description of Artificial Sequence: Synthetic oligonucleotide
ggaaacacggaatgtgaaggcccagtcac

SEQ ID NO: 364504 - DNA, 30 bp, Artificial Sequence; identical to SEQ ID NO: 10621
  Description of Artificial Sequence: Synthetic oligonucleotide

SEQ ID NO: 364505 - DNA, 31 bp, Artificial Sequence; identical to SEQ ID NO: 10622
  Description of Artificial Sequence: Synthetic oligonucleotide

SEQ ID NO: 364506 - DNA, 30 bp, Artificial Sequence; identical to SEQ ID NO: 10623
  Description of Artificial Sequence: Synthetic oligonucleotide

SEQ ID NO: 364507 - DNA, 27 bp, Artificial Sequence
  Description of Artificial Sequence: Synthetic oligonucleotide
ggaccctgcgcggctactacaaccaaa

SEQ ID NO: 364508 - DNA, 27 bp, Artificial Sequence
  Description of Artificial Sequence: Synthetic oligonucleotide
gaccctgcgcggctactacaaccaaag

SEQ ID NO: 364509 - DNA, 27 bp, Artificial Sequence
  Description of Artificial Sequence: Synthetic oligonucleotide
accctgcgcggctactacaaccaaagc

SEQ ID NO: 364510 - DNA, 26 bp, Artificial Sequence
  Description of Artificial Sequence: Synthetic oligonucleotide
ccctgcgcggctactacaaccaaagc

SEQ ID NO: 364511 - DNA, 27 bp, Artificial Sequence
  Description of Artificial Sequence: Synthetic oligonucleotide
cctgcgcggctactacaaccaaagcga

SEQ ID NO: 364512 - DNA, 27 bp, Artificial Sequence
  Description of Artificial Sequence: Synthetic oligonucleotide
ctgcgcggctactacaaccaaagcgag

SEQ ID NO: 364513 - DNA, 27 bp, Artificial Sequence
  Description of Artificial Sequence: Synthetic oligonucleotide
tgcgcggctactacaaccaaagcgagg

SEQ ID NO: 364514 - DNA, 26 bp, Artificial Sequence
  Description of Artificial Sequence: Synthetic oligonucleotide
gcgcggctactacaaccaaagcgagg

SEQ ID NO: 364515 - DNA, 26 bp, Artificial Sequence
  Description of Artificial Sequence: Synthetic oligonucleotide
cgcggctactacaaccaaagcgaggc

SEQ ID NO: 364516 - DNA, 26 bp, Artificial Sequence
  Description of Artificial Sequence: Synthetic oligonucleotide
gcggctactacaaccaaagcgaggcc

SEQ ID NO: 364517 - DNA, 26 bp, Artificial Sequence
  Description of Artificial Sequence: Synthetic oligonucleotide
cggctactacaaccaaagcgaggccg

SEQ ID NO: 364518 - DNA, 27 bp, Artificial Sequence
  Description of Artificial Sequence: Synthetic oligonucleotide
ggctactacaaccaaagcgaggccggt

SEQ ID NO: 364519 - DNA, 28 bp, Artificial Sequence
  Description of Artificial Sequence: Synthetic oligonucleotide
gctactacaaccaaagcgaggccggttc

SEQ ID NO: 364520 - DNA, 29 bp, Artificial Sequence
  Description of Artificial Sequence: Synthetic oligonucleotide
ctactacaaccaaagcgaggccggttctc

SEQ ID NO: 364521 - DNA, 30 bp, Artificial Sequence; identical to SEQ ID NO: 10638
  Description of Artificial Sequence: Synthetic oligonucleotide

SEQ ID NO: 364522 - DNA, 29 bp, Artificial Sequence
  Description of Artificial Sequence: Synthetic oligonucleotide
actacaaccaaagcgaggccggttctcac

SEQ ID NO: 364523 - DNA, 28 bp, Artificial Sequence
  Description of Artificial Sequence: Synthetic oligonucleotide
ctacaaccaaagcgaggccggttctcac

SEQ ID NO: 364524 - DNA, 29 bp, Artificial Sequence
  Description of Artificial Sequence: Synthetic oligonucleotide
tacaaccaaagcgaggccggttctcacac

SEQ ID NO: 364525 - DNA, 28 bp, Artificial Sequence
  Description of Artificial Sequence: Synthetic oligonucleotide
acaaccaaagcgaggccggttctcacac

SEQ ID NO: 364526 - DNA, 27 bp, Artificial Sequence
  Description of Artificial Sequence: Synthetic oligonucleotide
caaccaaagcgaggccggttctcacac

SEQ ID NO: 364527 - DNA, 27 bp, Artificial Sequence
  Description of Artificial Sequence: Synthetic oligonucleotide
aaccaaagcgaggccggttctcacacc

SEQ ID NO: 364528 - DNA, 27 bp, Artificial Sequence
  Description of Artificial Sequence: Synthetic oligonucleotide
accaaagcgaggccggttctcacacca

SEQ ID NO: 364529 - DNA, 27 bp, Artificial Sequence
  Description of Artificial Sequence: Synthetic oligonucleotide
ccaaagcgaggccggttctcacaccat

SEQ ID NO: 364530 - DNA, 27 bp, Artificial Sequence
  Description of Artificial Sequence: Synthetic oligonucleotide
caaagcgaggccggttctcacaccatc

SEQ ID NO: 364531 - DNA, 27 bp, Artificial Sequence
  Description of Artificial Sequence: Synthetic oligonucleotide
aaagcgaggccggttctcacaccatcc

SEQ ID NO: 364532 - DNA, 27 bp, Artificial Sequence
  Description of Artificial Sequence: Synthetic oligonucleotide
aagcgaggccggttctcacaccatcca

SEQ ID NO: 364533 - DNA, 27 bp, Artificial Sequence
  Description of Artificial Sequence: Synthetic oligonucleotide
cagagcgaggccggttctcacaccatt

SEQ ID NO: 364534 - DNA, 27 bp, Artificial Sequence
  Description of Artificial Sequence: Synthetic oligonucleotide
agagcgaggccggttctcacaccattc

SEQ ID NO: 364535 - DNA, 27 bp, Artificial Sequence
  Description of Artificial Sequence: Synthetic oligonucleotide
gagcgaggccggttctcacaccattca

SEQ ID NO: 364536 - DNA, 27 bp, Artificial Sequence
  Description of Artificial Sequence: Synthetic oligonucleotide
agcgaggccggttctcacaccattcag

SEQ ID NO: 364537 - DNA, 27 bp, Artificial Sequence
  Description of Artificial Sequence: Synthetic oligonucleotide
gcgaggccggttctcacaccattcaga

SEQ ID NO: 364538 - DNA, 31 bp, Artificial Sequence; identical to SEQ ID NO: 10655
  Description of Artificial Sequence: Synthetic oligonucleotide

SEQ ID NO: 364539 - DNA, 34 bp, Artificial Sequence; identical to SEQ ID NO: 10656
  Description of Artificial Sequence: Synthetic oligonucleotide

SEQ ID NO: 364540 - DNA, 34 bp, Artificial Sequence; identical to SEQ ID NO: 10657
  Description of Artificial Sequence: Synthetic oligonucleotide

SEQ ID NO: 364541 - DNA, 33 bp, Artificial Sequence; identical to SEQ ID NO: 10658
  Description of Artificial Sequence: Synthetic oligonucleotide

SEQ ID NO: 364542 - DNA, 33 bp, Artificial Sequence; identical to SEQ ID NO: 10659
  Description of Artificial Sequence: Synthetic oligonucleotide

SEQ ID NO: 364543 - DNA, 34 bp, Artificial Sequence; identical to SEQ ID NO: 10660
  Description of Artificial Sequence: Synthetic oligonucleotide

SEQ ID NO: 364544 - DNA, 34 bp, Artificial Sequence; identical to SEQ ID NO: 10661
  Description of Artificial Sequence: Synthetic oligonucleotide

SEQ ID NO: 364545 - DNA, 34 bp, Artificial Sequence; identical to SEQ ID NO: 10662
  Description of Artificial Sequence: Synthetic oligonucleotide

SEQ ID NO: 364546 - DNA, 35 bp, Artificial Sequence; identical to SEQ ID NO: 10663
  Description of Artificial Sequence: Synthetic oligonucleotide

SEQ ID NO: 364547 - DNA, 35 bp, Artificial Sequence; identical to SEQ ID NO: 10664
  Description of Artificial Sequence: Synthetic oligonucleotide

SEQ ID NO: 364548 - DNA, 34 bp, Artificial Sequence; identical to SEQ ID NO: 10665
  Description of Artificial Sequence: Synthetic oligonucleotide

SEQ ID NO: 364549 - DNA, 33 bp, Artificial Sequence; identical to SEQ ID NO: 10666
  Description of Artificial Sequence: Synthetic oligonucleotide

SEQ ID NO: 364550 - DNA, 34 bp, Artificial Sequence; identical to SEQ ID NO: 10667
  Description of Artificial Sequence: Synthetic oligonucleotide

SEQ ID NO: 364551 - DNA, 33 bp, Artificial Sequence; identical to SEQ ID NO: 10668
  Description of Artificial Sequence: Synthetic oligonucleotide

SEQ ID NO: 364552 - DNA, 33 bp, Artificial Sequence; identical to SEQ ID NO: 10669
  Description of Artificial Sequence: Synthetic oligonucleotide

SEQ ID NO: 364553 - DNA, 32 bp, Artificial Sequence; identical to SEQ ID NO: 10670
  Description of Artificial Sequence: Synthetic oligonucleotide

SEQ ID NO: 364554 - DNA, 32 bp, Artificial Sequence; identical to SEQ ID NO: 10671
  Description of Artificial Sequence: Synthetic oligonucleotide

SEQ ID NO: 364555 - DNA, 31 bp, Artificial Sequence; identical to SEQ ID NO: 10672
  Description of Artificial Sequence: Synthetic oligonucleotide

SEQ ID NO: 364556 - DNA, 31 bp, Artificial Sequence; identical to SEQ ID NO: 10673
  Description of Artificial Sequence: Synthetic oligonucleotide

SEQ ID NO: 364557 - DNA, 32 bp, Artificial Sequence; identical to SEQ ID NO: 10674
  Description of Artificial Sequence: Synthetic oligonucleotide

SEQ ID NO: 364558 - DNA, 31 bp, Artificial Sequence; identical to SEQ ID NO: 10675
  Description of Artificial Sequence: Synthetic oligonucleotide

SEQ ID NO: 364559 - DNA, 30 bp, Artificial Sequence; identical to SEQ ID NO: 10676
  Description of Artificial Sequence: Synthetic oligonucleotide

SEQ ID NO: 364560 - DNA, 25 bp, Artificial Sequence
  Description of Artificial Sequence: Synthetic oligonucleotide
aaggagacgctgcagcgcacggatc

SEQ ID NO: 364561 - DNA, 24 bp, Artificial Sequence
  Description of Artificial Sequence: Synthetic oligonucleotide
aggagacgctgcagcgcacggatc

SEQ ID NO: 364562 - DNA, 23 bp, Artificial Sequence
  Description of Artificial Sequence: Synthetic oligonucleotide
ggagacgctgcagcgcacggatc

SEQ ID NO: 364563 - DNA, 23 bp, Artificial Sequence
  Description of Artificial Sequence: Synthetic oligonucleotide
gagacgctgcagcgcacggatcc

SEQ ID NO: 364564 - DNA, 23 bp, Artificial Sequence
  Description of Artificial Sequence: Synthetic oligonucleotide
agacgctgcagcgcacggatccc

SEQ ID NO: 364565 - DNA, 22 bp, Artificial Sequence
  Description of Artificial Sequence: Synthetic oligonucleotide
gacgctgcagcgcacggatccc

SEQ ID NO: 364566 - DNA, 22 bp, Artificial Sequence
  Description of Artificial Sequence: Synthetic oligonucleotide
acgctgcagcgcacggatcccc

SEQ ID NO: 364567 - DNA, 21 bp, Artificial Sequence
  Description of Artificial Sequence: Synthetic oligonucleotide
cgctgcagcgcacggatcccc

SEQ ID NO: 364568 - DNA, 21 bp, Artificial Sequence
  Description of Artificial Sequence: Synthetic oligonucleotide
gctgcagcgcacggatccccc

SEQ ID NO: 364569 - DNA, 23 bp, Artificial Sequence
  Description of Artificial Sequence: Synthetic oligonucleotide
ctgcagcgcacggatccccccaa

SEQ ID NO: 364570 - DNA, 24 bp, Artificial Sequence
  Description of Artificial Sequence: Synthetic oligonucleotide
tgcagcgcacggatccccccaaga

SEQ ID NO: 364571 - DNA, 23 bp, Artificial Sequence
  Description of Artificial Sequence: Synthetic oligonucleotide
gcagcgcacggatccccccaaga

SEQ ID NO: 364572 - DNA, 24 bp, Artificial Sequence
  Description of Artificial Sequence: Synthetic oligonucleotide
cagcgcacggatccccccaagaca

SEQ ID NO: 364573 - DNA, 27 bp, Artificial Sequence
  Description of Artificial Sequence: Synthetic oligonucleotide
agcgcacggatccccccaagacacata

SEQ ID NO: 364574 - DNA, 27 bp, Artificial Sequence
  Description of Artificial Sequence: Synthetic oligonucleotide
gcgcacggatccccccaagacacatat

SEQ ID NO: 364575 - DNA, 27 bp, Artificial Sequence
  Description of Artificial Sequence: Synthetic oligonucleotide
cgcacggatccccccaagacacatatg

SEQ ID NO: 364576 - DNA, 28 bp, Artificial Sequence
  Description of Artificial Sequence: Synthetic oligonucleotide
gcacggatccccccaagacacatatgac

SEQ ID NO: 364577 - DNA, 28 bp, Artificial Sequence
  Description of Artificial Sequence: Synthetic oligonucleotide
cacggatccccccaagacacatatgacc

SEQ ID NO: 364578 - DNA, 28 bp, Artificial Sequence
  Description of Artificial Sequence: Synthetic oligonucleotide
acggatccccccaagacacatatgaccc

SEQ ID NO: 364579 - DNA, 27 bp, Artificial Sequence
  Description of Artificial Sequence: Synthetic oligonucleotide
cggatccccccaagacacatatgaccc

SEQ ID NO: 364580 - DNA, 28 bp, Artificial Sequence
  Description of Artificial Sequence: Synthetic oligonucleotide
ggatccccccaagacacatatgacccac

SEQ ID NO: 364581 - DNA, 28 bp, Artificial Sequence
  Description of Artificial Sequence: Synthetic oligonucleotide
gatccccccaagacacatatgacccacc

SEQ ID NO: 364582 - DNA, 29 bp, Artificial Sequence
  Description of Artificial Sequence: Synthetic oligonucleotide
atccccccaagacacatatgacccaccac

SEQ ID NO: 364583 - DNA, 28 bp, Artificial Sequence
  Description of Artificial Sequence: Synthetic oligonucleotide
tccccccaagacacatatgacccaccac

SEQ ID NO: 364584 - DNA, 28 bp, Artificial Sequence
  Description of Artificial Sequence: Synthetic oligonucleotide
aaggcccagtcacagactgaccgagtag

SEQ ID NO: 364585 - DNA, 27 bp, Artificial Sequence
  Description of Artificial Sequence: Synthetic oligonucleotide
aggcccagtcacagactgaccgagtag

SEQ ID NO: 364586 - DNA, 27 bp, Artificial Sequence
  Description of Artificial Sequence: Synthetic oligonucleotide
ggcccagtcacagactgaccgagtaga

SEQ ID NO: 364587 - DNA, 27 bp, Artificial Sequence
  Description of Artificial Sequence: Synthetic oligonucleotide
gcccagtcacagactgaccgagtagac

SEQ ID NO: 364588 - DNA, 27 bp, Artificial Sequence
  Description of Artificial Sequence: Synthetic oligonucleotide
cccagtcacagactgaccgagtagacc

SEQ ID NO: 364589 - DNA, 28 bp, Artificial Sequence
  Description of Artificial Sequence: Synthetic oligonucleotide
ccagtcacagactgaccgagtagacctg

SEQ ID NO: 364590 - DNA, 28 bp, Artificial Sequence
  Description of Artificial Sequence: Synthetic oligonucleotide
cagtcacagactgaccgagtagacctgg

SEQ ID NO: 364591 - DNA, 28 bp, Artificial Sequence
  Description of Artificial Sequence: Synthetic oligonucleotide
agtcacagactgaccgagtagacctggg

SEQ ID NO: 364592 - DNA, 27 bp, Artificial Sequence
  Description of Artificial Sequence: Synthetic oligonucleotide
gtcacagactgaccgagtagacctggg

SEQ ID NO: 364593 - DNA, 27 bp, Artificial Sequence
  Description of Artificial Sequence: Synthetic oligonucleotide
tcacagactgaccgagtagacctgggg

SEQ ID NO: 364594 - DNA, 27 bp, Artificial Sequence
  Description of Artificial Sequence: Synthetic oligonucleotide
cacagactgaccgagtagacctgggga

SEQ ID NO: 364595 - DNA, 27 bp, Artificial Sequence
  Description of Artificial Sequence: Synthetic oligonucleotide
acagactgaccgagtagacctggggac

SEQ ID NO: 364596 - DNA, 26 bp, Artificial Sequence
  Description of Artificial Sequence: Synthetic oligonucleotide
cagactgaccgagtagacctggggac

SEQ ID NO: 364597 - DNA, 26 bp, Artificial Sequence
  Description of Artificial Sequence: Synthetic oligonucleotide
agactgaccgagtagacctggggacc

SEQ ID NO: 364598 - DNA, 25 bp, Artificial Sequence
  Description of Artificial Sequence: Synthetic oligonucleotide
gactgaccgagtagacctggggacc

SEQ ID NO: 364599 - DNA, 26 bp, Artificial Sequence
  Description of Artificial Sequence: Synthetic oligonucleotide
actgaccgagtagacctggggaccct

SEQ ID NO: 364600 - DNA, 25 bp, Artificial Sequence
  Description of Artificial Sequence: Synthetic oligonucleotide
ctgaccgagtagacctggggaccct

SEQ ID NO: 364601 - DNA, 25 bp, Artificial Sequence
  Description of Artificial Sequence: Synthetic oligonucleotide
tgaccgagtagacctggggaccctg

SEQ ID NO: 364602 - DNA, 24 bp, Artificial Sequence
  Description of Artificial Sequence: Synthetic oligonucleotide
gaccgagtagacctggggaccctg

SEQ ID NO: 364603 - DNA, 24 bp, Artificial Sequence
  Description of Artificial Sequence: Synthetic oligonucleotide
accgagtagacctggggaccctgc

SEQ ID NO: 364604 - DNA, 23 bp, Artificial Sequence
  Description of Artificial Sequence: Synthetic oligonucleotide
ccgagtagacctggggaccctgc

SEQ ID NO: 364605 - DNA, 23 bp, Artificial Sequence
  Description of Artificial Sequence: Synthetic oligonucleotide
cgagtagacctggggaccctgcg

SEQ ID NO: 364606 - DNA, 23 bp, Artificial Sequence
  Description of Artificial Sequence: Synthetic oligonucleotide
gagtagacctggggaccctgcgc

SEQ ID NO: 364607 - DNA, 23 bp, Artificial Sequence
  Description of Artificial Sequence: Synthetic oligonucleotide
agtagacctggggaccctgcgcg

SEQ ID NO: 364608 - DNA, 22 bp, Artificial Sequence
  Description of Artificial Sequence: Synthetic oligonucleotide
gtagacctggggaccctgcgcg

SEQ ID NO: 364609 - DNA, 22 bp, Artificial Sequence
  Description of Artificial Sequence: Synthetic oligonucleotide
tagacctggggaccctgcgcgg

SEQ ID NO: 364610 - DNA, 21 bp, Artificial Sequence
  Description of Artificial Sequence: Synthetic oligonucleotide
agacctggggaccctgcgcgg

SEQ ID NO: 364611 - DNA, 22 bp, Artificial Sequence
  Description of Artificial Sequence: Synthetic oligonucleotide
gcggagagccccgcttcatcgc

SEQ ID NO: 364612 - DNA, 22 bp, Artificial Sequence
  Description of Artificial Sequence: Synthetic oligonucleotide
cggagagccccgcttcatcgcc

SEQ ID NO: 364613 - DNA, 23 bp, Artificial Sequence
  Description of Artificial Sequence: Synthetic oligonucleotide
ggagagccccgcttcatcgccgt

SEQ ID NO: 364614 - DNA, 23 bp, Artificial Sequence
  Description of Artificial Sequence: Synthetic oligonucleotide
gagagccccgcttcatcgccgtg

SEQ ID NO: 364615 - DNA, 23 bp, Artificial Sequence
  Description of Artificial Sequence: Synthetic oligonucleotide
agagccccgcttcatcgccgtgg

SEQ ID NO: 364616 - DNA, 33 bp, Artificial Sequence; identical to SEQ ID NO: 10733
  Description of Artificial Sequence: Synthetic oligonucleotide

SEQ ID NO: 364617 - DNA, 33 bp, Artificial Sequence; identical to SEQ ID NO: 10734
  Description of Artificial Sequence: Synthetic oligonucleotide

SEQ ID NO: 364618 - DNA, 32 bp, Artificial Sequence; identical to SEQ ID NO: 10735
  Description of Artificial Sequence: Synthetic oligonucleotide

SEQ ID NO: 364619 - DNA, 32 bp, Artificial Sequence; identical to SEQ ID NO: 10736
  Description of Artificial Sequence: Synthetic oligonucleotide

SEQ ID NO: 364620 - DNA, 31 bp, Artificial Sequence; identical to SEQ ID NO: 10737
  Description of Artificial Sequence: Synthetic oligonucleotide

SEQ ID NO: 364621 - DNA, 30 bp, Artificial Sequence; identical to SEQ ID NO: 10738
  Description of Artificial Sequence: Synthetic oligonucleotide

SEQ ID NO: 364622 - DNA, 29 bp, Artificial Sequence
  Description of Artificial Sequence: Synthetic oligonucleotide
tgggaccaggagacacggaatgtaaaggc

SEQ ID NO: 364623 - DNA, 28 bp, Artificial Sequence
  Description of Artificial Sequence: Synthetic oligonucleotide
gggaccaggagacacggaatgtaaaggc

SEQ ID NO: 364624 - DNA, 28 bp, Artificial Sequence
  Description of Artificial Sequence: Synthetic oligonucleotide
ggaccaggagacacggaatgtaaaggcc

SEQ ID NO: 364625 - DNA, 28 bp, Artificial Sequence
  Description of Artificial Sequence: Synthetic oligonucleotide
gaccaggagacacggaatgtaaaggccc

SEQ ID NO: 364626 - DNA, 29 bp, Artificial Sequence
  Description of Artificial Sequence: Synthetic oligonucleotide
accaggagacacggaatgtaaaggcccag

SEQ ID NO: 364627 - DNA, 28 bp, Artificial Sequence
  Description of Artificial Sequence: Synthetic oligonucleotide
ccaggagacacggaatgtaaaggcccag

SEQ ID NO: 364628 - DNA, 29 bp, Artificial Sequence
  Description of Artificial Sequence: Synthetic oligonucleotide
caggagacacggaatgtaaaggcccagtc

SEQ ID NO: 364629 - DNA, 30 bp, Artificial Sequence; identical to SEQ ID NO: 10746
  Description of Artificial Sequence: Synthetic oligonucleotide

SEQ ID NO: 364630 - DNA, 29 bp, Artificial Sequence
  Description of Artificial Sequence: Synthetic oligonucleotide
ggagacacggaatgtaaaggcccagtcac

SEQ ID NO: 364631 - DNA, 30 bp, Artificial Sequence; identical to SEQ ID NO: 10748
  Description of Artificial Sequence: Synthetic oligonucleotide

SEQ ID NO: 364632 - DNA, 31 bp, Artificial Sequence; identical to SEQ ID NO: 10749
  Description of Artificial Sequence: Synthetic oligonucleotide

SEQ ID NO: 364633 - DNA, 30 bp, Artificial Sequence; identical to SEQ ID NO: 10750
  Description of Artificial Sequence: Synthetic oligonucleotide

SEQ ID NO: 364634 - DNA, 31 bp, Artificial Sequence; identical to SEQ ID NO: 10751
  Description of Artificial Sequence: Synthetic oligonucleotide

SEQ ID NO: 364635 - DNA, 30 bp, Artificial Sequence; identical to SEQ ID NO: 10752
  Description of Artificial Sequence: Synthetic oligonucleotide

SEQ ID NO: 364636 - DNA, 31 bp, Artificial Sequence; identical to SEQ ID NO: 10753
  Description of Artificial Sequence: Synthetic oligonucleotide

SEQ ID NO: 364637 - DNA, 30 bp, Artificial Sequence; identical to SEQ ID NO: 10754
  Description of Artificial Sequence: Synthetic oligonucleotide

SEQ ID NO: 364638 - DNA, 30 bp, Artificial Sequence; identical to SEQ ID NO: 10755
  Description of Artificial Sequence: Synthetic oligonucleotide

SEQ ID NO: 364639 - DNA, 30 bp, Artificial Sequence; identical to SEQ ID NO: 10756
  Description of Artificial Sequence: Synthetic oligonucleotide

SEQ ID NO: 364640 - DNA, 31 bp, Artificial Sequence; identical to SEQ ID NO: 10757
  Description of Artificial Sequence: Synthetic oligonucleotide

SEQ ID NO: 364641 - DNA, 30 bp, Artificial Sequence; identical to SEQ ID NO: 10758
  Description of Artificial Sequence: Synthetic oligonucleotide

SEQ ID NO: 364642 - DNA, 29 bp, Artificial Sequence
  Description of Artificial Sequence: Synthetic oligonucleotide
tgtaaaggcccagtcacagactgaccgag

SEQ ID NO: 364643 - DNA, 28 bp, Artificial Sequence
  Description of Artificial Sequence: Synthetic oligonucleotide
gtaaaggcccagtcacagactgaccgag

SEQ ID NO: 364644 - DNA, 29 bp, Artificial Sequence
  Description of Artificial Sequence: Synthetic oligonucleotide
taaaggcccagtcacagactgaccgagtg

SEQ ID NO: 364645 - DNA, 28 bp, Artificial Sequence
  Description of Artificial Sequence: Synthetic oligonucleotide
aaaggcccagtcacagactgaccgagtg

SEQ ID NO: 364646 - DNA, 23 bp, Artificial Sequence
  Description of Artificial Sequence: Synthetic oligonucleotide
accgagtggacctggggaccctc

SEQ ID NO: 364647 - DNA, 22 bp, Artificial Sequence
  Description of Artificial Sequence: Synthetic oligonucleotide
ccgagtggacctggggaccctc

SEQ ID NO: 364648 - DNA, 22 bp, Artificial Sequence
  Description of Artificial Sequence: Synthetic oligonucleotide
cgagtggacctggggaccctcc

SEQ ID NO: 364649 - DNA, 22 bp, Artificial Sequence
  Description of Artificial Sequence: Synthetic oligonucleotide
gagtggacctggggaccctccg

SEQ ID NO: 364650 - DNA, 22 bp, Artificial Sequence
  Description of Artificial Sequence: Synthetic oligonucleotide
agtggacctggggaccctccgc

SEQ ID NO: 364651 - DNA, 21 bp, Artificial Sequence
  Description of Artificial Sequence: Synthetic oligonucleotide
gtggacctggggaccctccgc

SEQ ID NO: 364652 - DNA, 21 bp, Artificial Sequence
  Description of Artificial Sequence: Synthetic oligonucleotide
tggacctggggaccctccgcg

SEQ ID NO: 364653 - DNA, 20 bp, Artificial Sequence
  Description of Artificial Sequence: Synthetic oligonucleotide
ggacctggggaccctccgcg

SEQ ID NO: 364654 - DNA, 20 bp, Artificial Sequence
  Description of Artificial Sequence: Synthetic oligonucleotide
gacctggggaccctccgcgg

SEQ ID NO: 364655 - DNA, 22 bp, Artificial Sequence
  Description of Artificial Sequence: Synthetic oligonucleotide
acctggggaccctccgcggcta

SEQ ID NO: 364656 - DNA, 21 bp, Artificial Sequence
  Description of Artificial Sequence: Synthetic oligonucleotide
cctggggaccctccgcggcta

SEQ ID NO: 364657 - DNA, 23 bp, Artificial Sequence
  Description of Artificial Sequence: Synthetic oligonucleotide
ctggggaccctccgcggctacta

SEQ ID NO: 364658 - DNA, 25 bp, Artificial Sequence
  Description of Artificial Sequence: Synthetic oligonucleotide
tggggaccctccgcggctactacaa

SEQ ID NO: 364659 - DNA, 24 bp, Artificial Sequence
  Description of Artificial Sequence: Synthetic oligonucleotide
ggggaccctccgcggctactacaa

SEQ ID NO: 364660 - DNA, 24 bp, Artificial Sequence
  Description of Artificial Sequence: Synthetic oligonucleotide
gggaccctccgcggctactacaac

SEQ ID NO: 364661 - DNA, 25 bp, Artificial Sequence
  Description of Artificial Sequence: Synthetic oligonucleotide
ggaccctccgcggctactacaacca

SEQ ID NO: 364662 - DNA, 26 bp, Artificial Sequence
  Description of Artificial Sequence: Synthetic oligonucleotide
gaccctccgcggctactacaaccaga

SEQ ID NO: 364663 - DNA, 26 bp, Artificial Sequence
  Description of Artificial Sequence: Synthetic oligonucleotide
accctccgcggctactacaaccagag

SEQ ID NO: 364664 - DNA, 25 bp, Artificial Sequence
  Description of Artificial Sequence: Synthetic oligonucleotide
ccctccgcggctactacaaccagag

SEQ ID NO: 364665 - DNA, 25 bp, Artificial Sequence
  Description of Artificial Sequence: Synthetic oligonucleotide
cctccgcggctactacaaccagagc

SEQ ID NO: 364666 - DNA, 26 bp, Artificial Sequence
  Description of Artificial Sequence: Synthetic oligonucleotide
ctccgcggctactacaaccagagcga

SEQ ID NO: 364667 - DNA, 26 bp, Artificial Sequence
  Description of Artificial Sequence: Synthetic oligonucleotide
tccgcggctactacaaccagagcgag

SEQ ID NO: 364668 - DNA, 25 bp, Artificial Sequence
  Description of Artificial Sequence: Synthetic oligonucleotide
ccgcggctactacaaccagagcgag

SEQ ID NO: 364669 - DNA, 28 bp, Artificial Sequence
  Description of Artificial Sequence: Synthetic oligonucleotide
gagtggctccgcagatacctggagaatg

SEQ ID NO: 364670 - DNA, 28 bp, Artificial Sequence
  Description of Artificial Sequence: Synthetic oligonucleotide
agtggctccgcagatacctggagaatgg

SEQ ID NO: 364671 - DNA, 27 bp, Artificial Sequence
  Description of Artificial Sequence: Synthetic oligonucleotide
gtggctccgcagatacctggagaatgg

SEQ ID NO: 364672 - DNA, 27 bp, Artificial Sequence
  Description of Artificial Sequence: Synthetic oligonucleotide
tggctccgcagatacctggagaatggg

SEQ ID NO: 364673 - DNA, 27 bp, Artificial Sequence
  Description of Artificial Sequence: Synthetic oligonucleotide
ggctccgcagatacctggagaatggga

SEQ ID NO: 364674 - DNA, 28 bp, Artificial Sequence
  Description of Artificial Sequence: Synthetic oligonucleotide
gctccgcagatacctggagaatgggaag

SEQ ID NO: 364675 - DNA, 28 bp, Artificial Sequence
  Description of Artificial Sequence: Synthetic oligonucleotide
ctccgcagatacctggagaatgggaagg

SEQ ID NO: 364676 - DNA, 29 bp, Artificial Sequence
  Description of Artificial Sequence: Synthetic oligonucleotide
tccgcagatacctggagaatgggaaggag

SEQ ID NO: 364677 - DNA, 28 bp, Artificial Sequence
  Description of Artificial Sequence: Synthetic oligonucleotide
ccgcagatacctggagaatgggaaggag

SEQ ID NO: 364678 - DNA, 29 bp, Artificial Sequence
  Description of Artificial Sequence: Synthetic oligonucleotide
cgcagatacctggagaatgggaaggagac

SEQ ID NO: 364679 - DNA, 29 bp, Artificial Sequence
  Description of Artificial Sequence: Synthetic oligonucleotide
gcagatacctggagaatgggaaggagacg

SEQ ID NO: 364680 - DNA, 29 bp, Artificial Sequence
  Description of Artificial Sequence: Synthetic oligonucleotide
cagatacctggagaatgggaaggagacgc

SEQ ID NO: 364681 - DNA, 30 bp, Artificial Sequence; identical to SEQ ID NO: 10798
  Description of Artificial Sequence: Synthetic oligonucleotide

SEQ ID NO: 364682 - DNA, 29 bp, Artificial Sequence
  Description of Artificial Sequence: Synthetic oligonucleotide
gatacctggagaatgggaaggagacgctg

SEQ ID NO: 364683 - DNA, 29 bp, Artificial Sequence
  Description of Artificial Sequence: Synthetic oligonucleotide
atacctggagaatgggaaggagacgctgc

SEQ ID NO: 364684 - DNA, 28 bp, Artificial Sequence
  Description of Artificial Sequence: Synthetic oligonucleotide
tacctggagaatgggaaggagacgctgc

SEQ ID NO: 364685 - DNA, 27 bp, Artificial Sequence
  Description of Artificial Sequence: Synthetic oligonucleotide
acctggagaatgggaaggagacgctgc

SEQ ID NO: 364686 - DNA, 27 bp, Artificial Sequence
  Description of Artificial Sequence: Synthetic oligonucleotide
cctggagaatgggaaggagacgctgca

SEQ ID NO: 364687 - DNA, 27 bp, Artificial Sequence
  Description of Artificial Sequence: Synthetic oligonucleotide
ctggagaatgggaaggagacgctgcag

SEQ ID NO: 364688 - DNA, 27 bp, Artificial Sequence
  Description of Artificial Sequence: Synthetic oligonucleotide
tggagaatgggaaggagacgctgcagc

SEQ ID NO: 364689 - DNA, 26 bp, Artificial Sequence
  Description of Artificial Sequence: Synthetic oligonucleotide
ggagaatgggaaggagacgctgcagc

SEQ ID NO: 364690 - DNA, 26 bp, Artificial Sequence
  Description of Artificial Sequence: Synthetic oligonucleotide
gagaatgggaaggagacgctgcagcg

SEQ ID NO: 364691 - DNA, 27 bp, Artificial Sequence
  Description of Artificial Sequence: Synthetic oligonucleotide
agaatgggaaggagacgctgcagcgca

SEQ ID NO: 364692 - DNA, 26 bp, Artificial Sequence
  Description of Artificial Sequence: Synthetic oligonucleotide
gaatgggaaggagacgctgcagcgca

SEQ ID NO: 364693 - DNA, 26 bp, Artificial Sequence
  Description of Artificial Sequence: Synthetic oligonucleotide
aatgggaaggagacgctgcagcgcac

SEQ ID NO: 364694 - DNA, 25 bp, Artificial Sequence
  Description of Artificial Sequence: Synthetic oligonucleotide
atgggaaggagacgctgcagcgcac

SEQ ID NO: 364695 - DNA, 24 bp, Artificial Sequence
  Description of Artificial Sequence: Synthetic oligonucleotide
tgggaaggagacgctgcagcgcac

SEQ ID NO: 364696 - DNA, 24 bp, Artificial Sequence
  Description of Artificial Sequence: Synthetic oligonucleotide
aagtgggaggcggcccatgaggca

SEQ ID NO: 364697 - DNA, 23 bp, Artificial Sequence
  Description of Artificial Sequence: Synthetic oligonucleotide
agtgggaggcggcccatgaggca

SEQ ID NO: 364698 - DNA, 22 bp, Artificial Sequence
  Description of Artificial Sequence: Synthetic oligonucleotide
gtgggaggcggcccatgaggca

SEQ ID NO: 364699 - DNA, 23 bp, Artificial Sequence
  Description of Artificial Sequence: Synthetic oligonucleotide
tgggaggcggcccatgaggcaga

SEQ ID NO: 364700 - DNA, 22 bp, Artificial Sequence
  Description of Artificial Sequence: Synthetic oligonucleotide
gggaggcggcccatgaggcaga

SEQ ID NO: 364701 - DNA, 22 bp, Artificial Sequence
  Description of Artificial Sequence: Synthetic oligonucleotide
ggaggcggcccatgaggcagag

SEQ ID NO: 364702 - DNA, 23 bp, Artificial Sequence
  Description of Artificial Sequence: Synthetic oligonucleotide
gaggcggcccatgaggcagagca

SEQ ID NO: 364703 - DNA, 25 bp, Artificial Sequence
  Description of Artificial Sequence: Synthetic oligonucleotide
aggcggcccatgaggcagagcagtt

SEQ ID NO: 364704 - DNA, 24 bp, Artificial Sequence
  Description of Artificial Sequence: Synthetic oligonucleotide
ggcggcccatgaggcagagcagtt

SEQ ID NO: 364705 - DNA, 25 bp, Artificial Sequence
  Description of Artificial Sequence: Synthetic oligonucleotide
gcggcccatgaggcagagcagttga

SEQ ID NO: 364706 - DNA, 26 bp, Artificial Sequence
  Description of Artificial Sequence: Synthetic oligonucleotide
cggcccatgaggcagagcagttgaga

SEQ ID NO: 364707 - DNA, 26 bp, Artificial Sequence
  Description of Artificial Sequence: Synthetic oligonucleotide
ggcccatgaggcagagcagttgagag

SEQ ID NO: 364708 - DNA, 26 bp, Artificial Sequence
  Description of Artificial Sequence: Synthetic oligonucleotide
gcccatgaggcagagcagttgagagc

SEQ ID NO: 364709 - DNA, 27 bp, Artificial Sequence
  Description of Artificial Sequence: Synthetic oligonucleotide
cccatgaggcagagcagttgagagcct

SEQ ID NO: 364710 - DNA, 28 bp, Artificial Sequence
  Description of Artificial Sequence: Synthetic oligonucleotide
ccatgaggcagagcagttgagagcctac

SEQ ID NO: 364711 - DNA, 28 bp, Artificial Sequence
  Description of Artificial Sequence: Synthetic oligonucleotide
catgaggcagagcagttgagagcctacc

SEQ ID NO: 364712 - DNA, 29 bp, Artificial Sequence
  Description of Artificial Sequence: Synthetic oligonucleotide
atgaggcagagcagttgagagcctacctg

SEQ ID NO: 364713 - DNA, 28 bp, Artificial Sequence
  Description of Artificial Sequence: Synthetic oligonucleotide
tgaggcagagcagttgagagcctacctg

SEQ ID NO: 364714 - DNA, 27 bp, Artificial Sequence
  Description of Artificial Sequence: Synthetic oligonucleotide
gaggcagagcagttgagagcctacctg

SEQ ID NO: 364715 - DNA, 27 bp, Artificial Sequence
  Description of Artificial Sequence: Synthetic oligonucleotide
aggcagagcagttgagagcctacctgg

SEQ ID NO: 364716 - DNA, 27 bp, Artificial Sequence
  Description of Artificial Sequence: Synthetic oligonucleotide
ggcagagcagttgagagcctacctgga

SEQ ID NO: 364717 - DNA, 28 bp, Artificial Sequence
  Description of Artificial Sequence: Synthetic oligonucleotide
gcagagcagttgagagcctacctggatg

SEQ ID NO: 364718 - DNA, 28 bp, Artificial Sequence
  Description of Artificial Sequence: Synthetic oligonucleotide
cagagcagttgagagcctacctggatgg

SEQ ID NO: 364719 - DNA, 28 bp, Artificial Sequence
  Description of Artificial Sequence: Synthetic oligonucleotide
agagcagttgagagcctacctggatggc

SEQ ID NO: 364720 - DNA, 27 bp, Artificial Sequence
  Description of Artificial Sequence: Synthetic oligonucleotide
ccggagtattgggaccaggagacacga

SEQ ID NO: 364721 - DNA, 30 bp, Artificial Sequence; identical to SEQ ID NO: 10838
  Description of Artificial Sequence: Synthetic oligonucleotide

SEQ ID NO: 364722 - DNA, 31 bp, Artificial Sequence; identical to SEQ ID NO: 10839
  Description of Artificial Sequence: Synthetic oligonucleotide

SEQ ID NO: 364723 - DNA, 33 bp, Artificial Sequence; identical to SEQ ID NO: 10840
  Description of Artificial Sequence: Synthetic oligonucleotide

SEQ ID NO: 364724 - DNA, 33 bp, Artificial Sequence; identical to SEQ ID NO: 10841
  Description of Artificial Sequence: Synthetic oligonucleotide

SEQ ID NO: 364725 - DNA, 32 bp, Artificial Sequence; identical to SEQ ID NO: 10842
  Description of Artificial Sequence: Synthetic oligonucleotide

SEQ ID NO: 364726 - DNA, 32 bp, Artificial Sequence; identical to SEQ ID NO: 10843
  Description of Artificial Sequence: Synthetic oligonucleotide

SEQ ID NO: 364727 - DNA, 31 bp, Artificial Sequence; identical to SEQ ID NO: 10844
  Description of Artificial Sequence: Synthetic oligonucleotide

SEQ ID NO: 364728 - DNA, 30 bp, Artificial Sequence; identical to SEQ ID NO: 10845
  Description of Artificial Sequence: Synthetic oligonucleotide

SEQ ID NO: 364729 - DNA, 29 bp, Artificial Sequence
  Description of Artificial Sequence: Synthetic oligonucleotide
tgggaccaggagacacgaaatgtgaaggc

SEQ ID NO: 364730 - DNA, 28 bp, Artificial Sequence
  Description of Artificial Sequence: Synthetic oligonucleotide
gggaccaggagacacgaaatgtgaaggc

SEQ ID NO: 364731 - DNA, 28 bp, Artificial Sequence
  Description of Artificial Sequence: Synthetic oligonucleotide
ggaccaggagacacgaaatgtgaaggcc

SEQ ID NO: 364732 - DNA, 28 bp, Artificial Sequence
  Description of Artificial Sequence: Synthetic oligonucleotide
gaccaggagacacgaaatgtgaaggccc

SEQ ID NO: 364733 - DNA, 29 bp, Artificial Sequence
  Description of Artificial Sequence: Synthetic oligonucleotide
accaggagacacgaaatgtgaaggcccag

SEQ ID NO: 364734 - DNA, 28 bp, Artificial Sequence
  Description of Artificial Sequence: Synthetic oligonucleotide
ccaggagacacgaaatgtgaaggcccag

SEQ ID NO: 364735 - DNA, 29 bp, Artificial Sequence
  Description of Artificial Sequence: Synthetic oligonucleotide
caggagacacgaaatgtgaaggcccagtc

SEQ ID NO: 364736 - DNA, 30 bp, Artificial Sequence; identical to SEQ ID NO: 10853
  Description of Artificial Sequence: Synthetic oligonucleotide

SEQ ID NO: 364737 - DNA, 29 bp, Artificial Sequence
  Description of Artificial Sequence: Synthetic oligonucleotide
ggagacacgaaatgtgaaggcccagtcac

SEQ ID NO: 364738 - DNA, 30 bp, Artificial Sequence; identical to SEQ ID NO: 10855
  Description of Artificial Sequence: Synthetic oligonucleotide

SEQ ID NO: 364739 - DNA, 31 bp, Artificial Sequence; identical to SEQ ID NO: 10856
  Description of Artificial Sequence: Synthetic oligonucleotide

SEQ ID NO: 364740 - DNA, 30 bp, Artificial Sequence; identical to SEQ ID NO: 10857
  Description of Artificial Sequence: Synthetic oligonucleotide

SEQ ID NO: 364741 - DNA, 31 bp, Artificial Sequence; identical to SEQ ID NO: 10858
  Description of Artificial Sequence: Synthetic oligonucleotide

SEQ ID NO: 364742 - DNA, 30 bp, Artificial Sequence; identical to SEQ ID NO: 10859
  Description of Artificial Sequence: Synthetic oligonucleotide

SEQ ID NO: 364743 - DNA, 31 bp, Artificial Sequence; identical to SEQ ID NO: 10860
  Description of Artificial Sequence: Synthetic oligonucleotide

SEQ ID NO: 364744 - DNA, 30 bp, Artificial Sequence; identical to SEQ ID NO: 10861
  Description of Artificial Sequence: Synthetic oligonucleotide

SEQ ID NO: 364745 - DNA, 30 bp, Artificial Sequence; identical to SEQ ID NO: 10862
  Description of Artificial Sequence: Synthetic oligonucleotide

SEQ ID NO: 364746 - DNA, 30 bp, Artificial Sequence; identical to SEQ ID NO: 10863
  Description of Artificial Sequence: Synthetic oligonucleotide

SEQ ID NO: 364747 - DNA, 21 bp, Artificial Sequence
  Description of Artificial Sequence: Synthetic oligonucleotide
ctggaccgcggcggacatggc

SEQ ID NO: 364748 - DNA, 30 bp, Artificial Sequence; identical to SEQ ID NO: 10874
  Description of Artificial Sequence: Synthetic oligonucleotide

SEQ ID NO: 364749 - DNA, 29 bp, Artificial Sequence
  Description of Artificial Sequence: Synthetic oligonucleotide
gataatgtatggctgcgacgtggggtctg

SEQ ID NO: 364750 - DNA, 30 bp, Artificial Sequence; identical to SEQ ID NO: 10876
  Description of Artificial Sequence: Synthetic oligonucleotide

SEQ ID NO: 364751 - DNA, 29 bp, Artificial Sequence
  Description of Artificial Sequence: Synthetic oligonucleotide
taatgtatggctgcgacgtggggtctgac

SEQ ID NO: 364752 - DNA, 28 bp, Artificial Sequence
  Description of Artificial Sequence: Synthetic oligonucleotide
aatgtatggctgcgacgtggggtctgac

SEQ ID NO: 364753 - DNA, 27 bp, Artificial Sequence
  Description of Artificial Sequence: Synthetic oligonucleotide
atgtatggctgcgacgtggggtctgac

SEQ ID NO: 364754 - DNA, 26 bp, Artificial Sequence
  Description of Artificial Sequence: Synthetic oligonucleotide
tgtatggctgcgacgtggggtctgac

SEQ ID NO: 364755 - DNA, 25 bp, Artificial Sequence
  Description of Artificial Sequence: Synthetic oligonucleotide
gtatggctgcgacgtggggtctgac

SEQ ID NO: 364756 - DNA, 25 bp, Artificial Sequence
  Description of Artificial Sequence: Synthetic oligonucleotide
tatggctgcgacgtggggtctgacg

SEQ ID NO: 364757 - DNA, 24 bp, Artificial Sequence
  Description of Artificial Sequence: Synthetic oligonucleotide
atggctgcgacgtggggtctgacg

SEQ ID NO: 364758 - DNA, 23 bp, Artificial Sequence
  Description of Artificial Sequence: Synthetic oligonucleotide
tggctgcgacgtggggtctgacg

SEQ ID NO: 364759 - DNA, 22 bp, Artificial Sequence
  Description of Artificial Sequence: Synthetic oligonucleotide
ggctgcgacgtggggtctgacg

SEQ ID NO: 364760 - DNA, 22 bp, Artificial Sequence
  Description of Artificial Sequence: Synthetic oligonucleotide
gctgcgacgtggggtctgacgg

SEQ ID NO: 364761 - DNA, 22 bp, Artificial Sequence
  Description of Artificial Sequence: Synthetic oligonucleotide
ctgcgacgtggggtctgacggg

SEQ ID NO: 364762 - DNA, 22 bp, Artificial Sequence
  Description of Artificial Sequence: Synthetic oligonucleotide
tgcgacgtggggtctgacgggc

SEQ ID NO: 364763 - DNA, 21 bp, Artificial Sequence
  Description of Artificial Sequence: Synthetic oligonucleotide
gcgacgtggggtctgacgggc

SEQ ID NO: 364764 - DNA, 21 bp, Artificial Sequence
  Description of Artificial Sequence: Synthetic oligonucleotide
cgacgtggggtctgacgggcg

SEQ ID NO: 364765 - DNA, 23 bp, Artificial Sequence
  Description of Artificial Sequence: Synthetic oligonucleotide
gacgtggggtctgacgggcgctt

SEQ ID NO: 364766 - DNA, 23 bp, Artificial Sequence
  Description of Artificial Sequence: Synthetic oligonucleotide
acgtggggtctgacgggcgcttc

SEQ ID NO: 364767 - DNA, 22 bp, Artificial Sequence
  Description of Artificial Sequence: Synthetic oligonucleotide
cgtggggtctgacgggcgcttc

SEQ ID NO: 364768 - DNA, 23 bp, Artificial Sequence
  Description of Artificial Sequence: Synthetic oligonucleotide
gtggggtctgacgggcgcttcct

SEQ ID NO: 364769 - DNA, 23 bp, Artificial Sequence
  Description of Artificial Sequence: Synthetic oligonucleotide
tggggtctgacgggcgcttcctc

SEQ ID NO: 364770 - DNA, 22 bp, Artificial Sequence
  Description of Artificial Sequence: Synthetic oligonucleotide
ggggtctgacgggcgcttcctc

SEQ ID NO: 364771 - DNA, 22 bp, Artificial Sequence
  Description of Artificial Sequence: Synthetic oligonucleotide
gggtctgacgggcgcttcctcc

SEQ ID NO: 364772 - DNA, 22 bp, Artificial Sequence
  Description of Artificial Sequence: Synthetic oligonucleotide
ggtctgacgggcgcttcctccg

SEQ ID NO: 364773 - DNA, 22 bp, Artificial Sequence
  Description of Artificial Sequence: Synthetic oligonucleotide
gtctgacgggcgcttcctccgc

SEQ ID NO: 364774 - DNA, 22 bp, Artificial Sequence
  Description of Artificial Sequence: Synthetic oligonucleotide
tctgacgggcgcttcctccgcg

SEQ ID NO: 364775 - DNA, 21 bp, Artificial Sequence
  Description of Artificial Sequence: Synthetic oligonucleotide
ctgacgggcgcttcctccgcg

SEQ ID NO: 364776 - DNA, 21 bp, Artificial Sequence
  Description of Artificial Sequence: Synthetic oligonucleotide
tgacgggcgcttcctccgcgg

SEQ ID NO: 364777 - DNA, 23 bp, Artificial Sequence
  Description of Artificial Sequence: Synthetic oligonucleotide
cgcgggtaccggcaggacgctta

SEQ ID NO: 364778 - DNA, 23 bp, Artificial Sequence
  Description of Artificial Sequence: Synthetic oligonucleotide
gcgggtaccggcaggacgcttac

SEQ ID NO: 364779 - DNA, 24 bp, Artificial Sequence
  Description of Artificial Sequence: Synthetic oligonucleotide
cgggtaccggcaggacgcttacga

SEQ ID NO: 364780 - DNA, 24 bp, Artificial Sequence
  Description of Artificial Sequence: Synthetic oligonucleotide
gggtaccggcaggacgcttacgac

SEQ ID NO: 364781 - DNA, 24 bp, Artificial Sequence
  Description of Artificial Sequence: Synthetic oligonucleotide
ggtaccggcaggacgcttacgacg

SEQ ID NO: 364782 - DNA, 24 bp, Artificial Sequence
  Description of Artificial Sequence: Synthetic oligonucleotide
gtaccggcaggacgcttacgacgg

SEQ ID NO: 364783 - DNA, 26 bp, Artificial Sequence
  Description of Artificial Sequence: Synthetic oligonucleotide
taccggcaggacgcttacgacggcaa

SEQ ID NO: 364784 - DNA, 25 bp, Artificial Sequence
  Description of Artificial Sequence: Synthetic oligonucleotide
accggcaggacgcttacgacggcaa

SEQ ID NO: 364785 - DNA, 24 bp, Artificial Sequence
  Description of Artificial Sequence: Synthetic oligonucleotide
ccggcaggacgcttacgacggcaa

SEQ ID NO: 364786 - DNA, 24 bp, Artificial Sequence
  Description of Artificial Sequence: Synthetic oligonucleotide
cggcaggacgcttacgacggcaag

SEQ ID NO: 364787 - DNA, 27 bp, Artificial Sequence
  Description of Artificial Sequence: Synthetic oligonucleotide
ggcaggacgcttacgacggcaaggatt

SEQ ID NO: 364788 - DNA, 28 bp, Artificial Sequence
  Description of Artificial Sequence: Synthetic oligonucleotide
gcaggacgcttacgacggcaaggattac

SEQ ID NO: 364789 - DNA, 30 bp, Artificial Sequence; identical to SEQ ID NO: 6174
  Description of Artificial Sequence: Synthetic oligonucleotide

SEQ ID NO: 364790 - DNA, 30 bp, Artificial Sequence; identical to SEQ ID NO: 6175
  Description of Artificial Sequence: Synthetic oligonucleotide

SEQ ID NO: 364791 - DNA, 29 bp, Artificial Sequence
  Description of Artificial Sequence: Synthetic oligonucleotide
ggacgcttacgacggcaaggattacatcg

SEQ ID NO: 364792 - DNA, 29 bp, Artificial Sequence
  Description of Artificial Sequence: Synthetic oligonucleotide
gacgcttacgacggcaaggattacatcgc

SEQ ID NO: 364793 - DNA, 29 bp, Artificial Sequence
  Description of Artificial Sequence: Synthetic oligonucleotide
acgcttacgacggcaaggattacatcgcc

SEQ ID NO: 364794 - DNA, 28 bp, Artificial Sequence
  Description of Artificial Sequence: Synthetic oligonucleotide
cgcttacgacggcaaggattacatcgcc

SEQ ID NO: 364795 - DNA, 28 bp, Artificial Sequence
  Description of Artificial Sequence: Synthetic oligonucleotide
gcttacgacggcaaggattacatcgccc

SEQ ID NO: 364796 - DNA, 29 bp, Artificial Sequence
  Description of Artificial Sequence: Synthetic oligonucleotide
cttacgacggcaaggattacatcgccctg

SEQ ID NO: 364797 - DNA, 31 bp, Artificial Sequence; identical to SEQ ID NO: 6182
  Description of Artificial Sequence: Synthetic oligonucleotide

SEQ ID NO: 364798 - DNA, 32 bp, Artificial Sequence
  Description of Artificial Sequence: Synthetic oligonucleotide
atccagataatgtatggctgcgacgtgggatc

SEQ ID NO: 364799 - DNA, 31 bp, Artificial Sequence
  Description of Artificial Sequence: Synthetic oligonucleotide
tccagataatgtatggctgcgacgtgggatc

SEQ ID NO: 364800 - DNA, 30 bp, Artificial Sequence
  Description of Artificial Sequence: Synthetic oligonucleotide
ccagataatgtatggctgcgacgtgggatc

SEQ ID NO: 364801 - DNA, 30 bp, Artificial Sequence
  Description of Artificial Sequence: Synthetic oligonucleotide
cagataatgtatggctgcgacgtgggatcg

SEQ ID NO: 364802 - DNA, 30 bp, Artificial Sequence
  Description of Artificial Sequence: Synthetic oligonucleotide
agataatgtatggctgcgacgtgggatcgg

SEQ ID NO: 364803 - DNA, 29 bp, Artificial Sequence
  Description of Artificial Sequence: Synthetic oligonucleotide
gataatgtatggctgcgacgtgggatcgg

SEQ ID NO: 364804 - DNA, 30 bp, Artificial Sequence
  Description of Artificial Sequence: Synthetic oligonucleotide
ataatgtatggctgcgacgtgggatcggac

SEQ ID NO: 364805 - DNA, 29 bp, Artificial Sequence
  Description of Artificial Sequence: Synthetic oligonucleotide
taatgtatggctgcgacgtgggatcggac

SEQ ID NO: 364806 - DNA, 28 bp, Artificial Sequence
  Description of Artificial Sequence: Synthetic oligonucleotide
aatgtatggctgcgacgtgggatcggac

SEQ ID NO: 364807 - DNA, 26 bp, Artificial Sequence
  Description of Artificial Sequence: Synthetic oligonucleotide
tgtatggctgcgacgtgggatcggac

SEQ ID NO: 364808 - DNA, 25 bp, Artificial Sequence
  Description of Artificial Sequence: Synthetic oligonucleotide
gtatggctgcgacgtgggatcggac

SEQ ID NO: 364809 - DNA, 25 bp, Artificial Sequence
  Description of Artificial Sequence: Synthetic oligonucleotide
tatggctgcgacgtgggatcggacg

SEQ ID NO: 364810 - DNA, 24 bp, Artificial Sequence
  Description of Artificial Sequence: Synthetic oligonucleotide
atggctgcgacgtgggatcggacg

SEQ ID NO: 364811 - DNA, 23 bp, Artificial Sequence
  Description of Artificial Sequence: Synthetic oligonucleotide
tggctgcgacgtgggatcggacg

SEQ ID NO: 364812 - DNA, 22 bp, Artificial Sequence
  Description of Artificial Sequence: Synthetic oligonucleotide
ggctgcgacgtgggatcggacg

SEQ ID NO: 364813 - DNA, 22 bp, Artificial Sequence
  Description of Artificial Sequence: Synthetic oligonucleotide
gctgcgacgtgggatcggacgg

SEQ ID NO: 364814 - DNA, 22 bp, Artificial Sequence
  Description of Artificial Sequence: Synthetic oligonucleotide
ctgcgacgtgggatcggacggg

SEQ ID NO: 364815 - DNA, 22 bp, Artificial Sequence
  Description of Artificial Sequence: Synthetic oligonucleotide
tgcgacgtgggatcggacgggc

SEQ ID NO: 364816 - DNA, 21 bp, Artificial Sequence
  Description of Artificial Sequence: Synthetic oligonucleotide
gcgacgtgggatcggacgggc

SEQ ID NO: 364817 - DNA, 21 bp, Artificial Sequence
  Description of Artificial Sequence: Synthetic oligonucleotide
cgacgtgggatcggacgggcg

SEQ ID NO: 364818 - DNA, 23 bp, Artificial Sequence
  Description of Artificial Sequence: Synthetic oligonucleotide
gacgtgggatcggacgggcgctt

SEQ ID NO: 364819 - DNA, 23 bp, Artificial Sequence
  Description of Artificial Sequence: Synthetic oligonucleotide
acgtgggatcggacgggcgcttc

SEQ ID NO: 364820 - DNA, 22 bp, Artificial Sequence
  Description of Artificial Sequence: Synthetic oligonucleotide
cgtgggatcggacgggcgcttc

SEQ ID NO: 364821 - DNA, 23 bp, Artificial Sequence
  Description of Artificial Sequence: Synthetic oligonucleotide
gtgggatcggacgggcgcttcct

SEQ ID NO: 364822 - DNA, 23 bp, Artificial Sequence
  Description of Artificial Sequence: Synthetic oligonucleotide
tgggatcggacgggcgcttcctc

SEQ ID NO: 364823 - DNA, 22 bp, Artificial Sequence
  Description of Artificial Sequence: Synthetic oligonucleotide
gggatcggacgggcgcttcctc

SEQ ID NO: 364824 - DNA, 22 bp, Artificial Sequence
  Description of Artificial Sequence: Synthetic oligonucleotide
ggatcggacgggcgcttcctcc

SEQ ID NO: 364825 - DNA, 22 bp, Artificial Sequence
  Description of Artificial Sequence: Synthetic oligonucleotide
gatcggacgggcgcttcctccg

SEQ ID NO: 364826 - DNA, 22 bp, Artificial Sequence
  Description of Artificial Sequence: Synthetic oligonucleotide
atcggacgggcgcttcctccgc

SEQ ID NO: 364827 - DNA, 25 bp, Artificial Sequence
  Description of Artificial Sequence: Synthetic oligonucleotide
acctggggaccctgcgcggctatta

SEQ ID NO: 364828 - DNA, 24 bp, Artificial Sequence
  Description of Artificial Sequence: Synthetic oligonucleotide
cctggggaccctgcgcggctatta

SEQ ID NO: 364829 - DNA, 26 bp, Artificial Sequence
  Description of Artificial Sequence: Synthetic oligonucleotide
ctggggaccctgcgcggctattacaa

SEQ ID NO: 364830 - DNA, 26 bp, Artificial Sequence
  Description of Artificial Sequence: Synthetic oligonucleotide
tggggaccctgcgcggctattacaac

SEQ ID NO: 364831 - DNA, 25 bp, Artificial Sequence
  Description of Artificial Sequence: Synthetic oligonucleotide
ggggaccctgcgcggctattacaac

SEQ ID NO: 364832 - DNA, 26 bp, Artificial Sequence
  Description of Artificial Sequence: Synthetic oligonucleotide
gggaccctgcgcggctattacaacca

SEQ ID NO: 364833 - DNA, 27 bp, Artificial Sequence
  Description of Artificial Sequence: Synthetic oligonucleotide
ggaccctgcgcggctattacaaccaga

SEQ ID NO: 364834 - DNA, 27 bp, Artificial Sequence
  Description of Artificial Sequence: Synthetic oligonucleotide
gaccctgcgcggctattacaaccagag

SEQ ID NO: 364835 - DNA, 27 bp, Artificial Sequence
  Description of Artificial Sequence: Synthetic oligonucleotide
accctgcgcggctattacaaccagagc

SEQ ID NO: 364836 - DNA, 26 bp, Artificial Sequence
  Description of Artificial Sequence: Synthetic oligonucleotide
ccctgcgcggctattacaaccagagc

SEQ ID NO: 364837 - DNA, 27 bp, Artificial Sequence
  Description of Artificial Sequence: Synthetic oligonucleotide
cctgcgcggctattacaaccagagcga

SEQ ID NO: 364838 - DNA, 27 bp, Artificial Sequence
  Description of Artificial Sequence: Synthetic oligonucleotide
ctgcgcggctattacaaccagagcgag

SEQ ID NO: 364839 - DNA, 27 bp, Artificial Sequence
  Description of Artificial Sequence: Synthetic oligonucleotide
tgcgcggctattacaaccagagcgagg

SEQ ID NO: 364840 - DNA, 26 bp, Artificial Sequence
  Description of Artificial Sequence: Synthetic oligonucleotide
gcgcggctattacaaccagagcgagg

SEQ ID NO: 364841 - DNA, 26 bp, Artificial Sequence
  Description of Artificial Sequence: Synthetic oligonucleotide
cgcggctattacaaccagagcgaggc

SEQ ID NO: 364842 - DNA, 26 bp, Artificial Sequence
  Description of Artificial Sequence: Synthetic oligonucleotide
gcggctattacaaccagagcgaggcc

SEQ ID NO: 364843 - DNA, 26 bp, Artificial Sequence
  Description of Artificial Sequence: Synthetic oligonucleotide
cggctattacaaccagagcgaggccg

SEQ ID NO: 364844 - DNA, 27 bp, Artificial Sequence
  Description of Artificial Sequence: Synthetic oligonucleotide
ggctattacaaccagagcgaggccggt

SEQ ID NO: 364845 - DNA, 28 bp, Artificial Sequence
  Description of Artificial Sequence: Synthetic oligonucleotide
gctattacaaccagagcgaggccggttc

SEQ ID NO: 364846 - DNA, 29 bp, Artificial Sequence
  Description of Artificial Sequence: Synthetic oligonucleotide
ctattacaaccagagcgaggccggttctc

SEQ ID NO: 364847 - DNA, 30 bp, Artificial Sequence
  Description of Artificial Sequence: Synthetic oligonucleotide
tattacaaccagagcgaggccggttctcac

SEQ ID NO: 364848 - DNA, 29 bp, Artificial Sequence
  Description of Artificial Sequence: Synthetic oligonucleotide
attacaaccagagcgaggccggttctcac

SEQ ID NO: 364849 - DNA, 28 bp, Artificial Sequence
  Description of Artificial Sequence: Synthetic oligonucleotide
ttacaaccagagcgaggccggttctcac

SEQ ID NO: 364850 - DNA, 25 bp, Artificial Sequence
  Description of Artificial Sequence: Synthetic oligonucleotide
tgaccgagtggacctggggacccta

SEQ ID NO: 364851 - DNA, 24 bp, Artificial Sequence
  Description of Artificial Sequence: Synthetic oligonucleotide
gaccgagtggacctggggacccta

SEQ ID NO: 364852 - DNA, 24 bp, Artificial Sequence
  Description of Artificial Sequence: Synthetic oligonucleotide
accgagtggacctggggaccctac

SEQ ID NO: 364853 - DNA, 23 bp, Artificial Sequence
  Description of Artificial Sequence: Synthetic oligonucleotide
ccgagtggacctggggaccctac

SEQ ID NO: 364854 - DNA, 23 bp, Artificial Sequence
  Description of Artificial Sequence: Synthetic oligonucleotide
cgagtggacctggggaccctacg

SEQ ID NO: 364855 - DNA, 23 bp, Artificial Sequence
  Description of Artificial Sequence: Synthetic oligonucleotide
gagtggacctggggaccctacgc

SEQ ID NO: 364856 - DNA, 23 bp, Artificial Sequence
  Description of Artificial Sequence: Synthetic oligonucleotide
agtggacctggggaccctacgcg

SEQ ID NO: 364857 - DNA, 22 bp, Artificial Sequence
  Description of Artificial Sequence: Synthetic oligonucleotide
gtggacctggggaccctacgcg

SEQ ID NO: 364858 - DNA, 22 bp, Artificial Sequence
  Description of Artificial Sequence: Synthetic oligonucleotide
tggacctggggaccctacgcgg

SEQ ID NO: 364859 - DNA, 21 bp, Artificial Sequence
  Description of Artificial Sequence: Synthetic oligonucleotide
ggacctggggaccctacgcgg

SEQ ID NO: 364860 - DNA, 23 bp, Artificial Sequence
  Description of Artificial Sequence: Synthetic oligonucleotide
gacctggggaccctacgcggcta

SEQ ID NO: 364861 - DNA, 25 bp, Artificial Sequence
  Description of Artificial Sequence: Synthetic oligonucleotide
acctggggaccctacgcggctacta

SEQ ID NO: 364862 - DNA, 24 bp, Artificial Sequence
  Description of Artificial Sequence: Synthetic oligonucleotide
cctggggaccctacgcggctacta

SEQ ID NO: 364863 - DNA, 26 bp, Artificial Sequence
  Description of Artificial Sequence: Synthetic oligonucleotide
ctggggaccctacgcggctactacaa

SEQ ID NO: 364864 - DNA, 26 bp, Artificial Sequence
  Description of Artificial Sequence: Synthetic oligonucleotide
tggggaccctacgcggctactacaac

SEQ ID NO: 364865 - DNA, 25 bp, Artificial Sequence
  Description of Artificial Sequence: Synthetic oligonucleotide
ggggaccctacgcggctactacaac

SEQ ID NO: 364866 - DNA, 26 bp, Artificial Sequence
  Description of Artificial Sequence: Synthetic oligonucleotide
gggaccctacgcggctactacaacca

SEQ ID NO: 364867 - DNA, 27 bp, Artificial Sequence
  Description of Artificial Sequence: Synthetic oligonucleotide
ggaccctacgcggctactacaaccaga

SEQ ID NO: 364868 - DNA, 27 bp, Artificial Sequence
  Description of Artificial Sequence: Synthetic oligonucleotide
gaccctacgcggctactacaaccagag

SEQ ID NO: 364869 - DNA, 27 bp, Artificial Sequence
  Description of Artificial Sequence: Synthetic oligonucleotide
accctacgcggctactacaaccagagc

SEQ ID NO: 364870 - DNA, 26 bp, Artificial Sequence
  Description of Artificial Sequence: Synthetic oligonucleotide
ccctacgcggctactacaaccagagc

SEQ ID NO: 364871 - DNA, 27 bp, Artificial Sequence
  Description of Artificial Sequence: Synthetic oligonucleotide
cctacgcggctactacaaccagagcga

SEQ ID NO: 364872 - DNA, 27 bp, Artificial Sequence
  Description of Artificial Sequence: Synthetic oligonucleotide
ctacgcggctactacaaccagagcgag

SEQ ID NO: 364873 - DNA, 27 bp, Artificial Sequence
  Description of Artificial Sequence: Synthetic oligonucleotide
tacgcggctactacaaccagagcgagg

SEQ ID NO: 364874 - DNA, 26 bp, Artificial Sequence
  Description of Artificial Sequence: Synthetic oligonucleotide
acgcggctactacaaccagagcgagg

SEQ ID NO: 364875 - DNA, 28 bp, Artificial Sequence
  Description of Artificial Sequence: Synthetic oligonucleotide
acggaatgtgaaggcccagtcacagacc

SEQ ID NO: 364876 - DNA, 27 bp, Artificial Sequence
  Description of Artificial Sequence: Synthetic oligonucleotide
cggaatgtgaaggcccagtcacagacc

SEQ ID NO: 364877 - DNA, 27 bp, Artificial Sequence
  Description of Artificial Sequence: Synthetic oligonucleotide
ggaatgtgaaggcccagtcacagaccg

SEQ ID NO: 364878 - DNA, 28 bp, Artificial Sequence
  Description of Artificial Sequence: Synthetic oligonucleotide
gaatgtgaaggcccagtcacagaccgac

SEQ ID NO: 364879 - DNA, 28 bp, Artificial Sequence
  Description of Artificial Sequence: Synthetic oligonucleotide
aatgtgaaggcccagtcacagaccgacc

SEQ ID NO: 364880 - DNA, 27 bp, Artificial Sequence
  Description of Artificial Sequence: Synthetic oligonucleotide
atgtgaaggcccagtcacagaccgacc

SEQ ID NO: 364881 - DNA, 26 bp, Artificial Sequence
  Description of Artificial Sequence: Synthetic oligonucleotide
tgtgaaggcccagtcacagaccgacc

SEQ ID NO: 364882 - DNA, 25 bp, Artificial Sequence
  Description of Artificial Sequence: Synthetic oligonucleotide
gtgaaggcccagtcacagaccgacc

SEQ ID NO: 364883 - DNA, 26 bp, Artificial Sequence
  Description of Artificial Sequence: Synthetic oligonucleotide
tgaaggcccagtcacagaccgaccga

SEQ ID NO: 364884 - DNA, 25 bp, Artificial Sequence
  Description of Artificial Sequence: Synthetic oligonucleotide
gaaggcccagtcacagaccgaccga

SEQ ID NO: 364885 - DNA, 26 bp, Artificial Sequence
  Description of Artificial Sequence: Synthetic oligonucleotide
aaggcccagtcacagaccgaccgagt

SEQ ID NO: 364886 - DNA, 25 bp, Artificial Sequence
  Description of Artificial Sequence: Synthetic oligonucleotide
aggcccagtcacagaccgaccgagt

SEQ ID NO: 364887 - DNA, 24 bp, Artificial Sequence
  Description of Artificial Sequence: Synthetic oligonucleotide
ggcccagtcacagaccgaccgagt

SEQ ID NO: 364888 - DNA, 24 bp, Artificial Sequence
  Description of Artificial Sequence: Synthetic oligonucleotide
gcccagtcacagaccgaccgagtg

SEQ ID NO: 364889 - DNA, 25 bp, Artificial Sequence
  Description of Artificial Sequence: Synthetic oligonucleotide
cccagtcacagaccgaccgagtgga

SEQ ID NO: 364890 - DNA, 25 bp, Artificial Sequence
  Description of Artificial Sequence: Synthetic oligonucleotide
ccagtcacagaccgaccgagtggac

SEQ ID NO: 364891 - DNA, 26 bp, Artificial Sequence
  Description of Artificial Sequence: Synthetic oligonucleotide
cagtcacagaccgaccgagtggacct

SEQ ID NO: 364892 - DNA, 26 bp, Artificial Sequence
  Description of Artificial Sequence: Synthetic oligonucleotide
agtcacagaccgaccgagtggacctg

SEQ ID NO: 364893 - DNA, 25 bp, Artificial Sequence
  Description of Artificial Sequence: Synthetic oligonucleotide
gtcacagaccgaccgagtggacctg

SEQ ID NO: 364894 - DNA, 25 bp, Artificial Sequence
  Description of Artificial Sequence: Synthetic oligonucleotide
tcacagaccgaccgagtggacctgg

SEQ ID NO: 364895 - DNA, 24 bp, Artificial Sequence
  Description of Artificial Sequence: Synthetic oligonucleotide
cacagaccgaccgagtggacctgg

SEQ ID NO: 364896 - DNA, 24 bp, Artificial Sequence
  Description of Artificial Sequence: Synthetic oligonucleotide
acagaccgaccgagtggacctggg

SEQ ID NO: 364897 - DNA, 23 bp, Artificial Sequence
  Description of Artificial Sequence: Synthetic oligonucleotide
cagaccgaccgagtggacctggg

SEQ ID NO: 364898 - DNA, 24 bp, Artificial Sequence
  Description of Artificial Sequence: Synthetic oligonucleotide
agaccgaccgagtggacctgggga

SEQ ID NO: 364899 - DNA, 23 bp, Artificial Sequence
  Description of Artificial Sequence: Synthetic oligonucleotide
gaccgaccgagtggacctgggga

SEQ ID NO: 364900 - DNA, 23 bp, Artificial Sequence
  Description of Artificial Sequence: Synthetic oligonucleotide
accgaccgagtggacctggggac

SEQ ID NO: 364901 - DNA, 22 bp, Artificial Sequence
  Description of Artificial Sequence: Synthetic oligonucleotide
ccgaccgagtggacctggggac

SEQ ID NO: 364902 - DNA, 22 bp, Artificial Sequence
  Description of Artificial Sequence: Synthetic oligonucleotide
cgaccgagtggacctggggacc

SEQ ID NO: 364903 - DNA, 27 bp, Artificial Sequence
  Description of Artificial Sequence: Synthetic oligonucleotide
gctacgtggacgacacgcagttcgtga

SEQ ID NO: 364904 - DNA, 27 bp, Artificial Sequence
  Description of Artificial Sequence: Synthetic oligonucleotide
ctacgtggacgacacgcagttcgtgag

SEQ ID NO: 364905 - DNA, 27 bp, Artificial Sequence
  Description of Artificial Sequence: Synthetic oligonucleotide
tacgtggacgacacgcagttcgtgagg

SEQ ID NO: 364906 - DNA, 27 bp, Artificial Sequence
  Description of Artificial Sequence: Synthetic oligonucleotide
acgtggacgacacgcagttcgtgaggt

SEQ ID NO: 364907 - DNA, 27 bp, Artificial Sequence
  Description of Artificial Sequence: Synthetic oligonucleotide
cgtggacgacacgcagttcgtgaggtt

SEQ ID NO: 364908 - DNA, 27 bp, Artificial Sequence
  Description of Artificial Sequence: Synthetic oligonucleotide
gtggacgacacgcagttcgtgaggttc

SEQ ID NO: 364909 - DNA, 27 bp, Artificial Sequence
  Description of Artificial Sequence: Synthetic oligonucleotide
tggacgacacgcagttcgtgaggttcg

SEQ ID NO: 364910 - DNA, 27 bp, Artificial Sequence
  Description of Artificial Sequence: Synthetic oligonucleotide
ggacgacacgcagttcgtgaggttcga

SEQ ID NO: 364911 - DNA, 27 bp, Artificial Sequence
  Description of Artificial Sequence: Synthetic oligonucleotide
gacgacacgcagttcgtgaggttcgac

SEQ ID NO: 364912 - DNA, 28 bp, Artificial Sequence
  Description of Artificial Sequence: Synthetic oligonucleotide
acgacacgcagttcgtgaggttcgacag

SEQ ID NO: 364913 - DNA, 27 bp, Artificial Sequence
  Description of Artificial Sequence: Synthetic oligonucleotide
cgacacgcagttcgtgaggttcgacag

SEQ ID NO: 364914 - DNA, 27 bp, Artificial Sequence
  Description of Artificial Sequence: Synthetic oligonucleotide
gacacgcagttcgtgaggttcgacagc

SEQ ID NO: 364915 - DNA, 27 bp, Artificial Sequence
  Description of Artificial Sequence: Synthetic oligonucleotide
acacgcagttcgtgaggttcgacagcg

SEQ ID NO: 364916 - DNA, 27 bp, Artificial Sequence
  Description of Artificial Sequence: Synthetic oligonucleotide
cacgcagttcgtgaggttcgacagcga

SEQ ID NO: 364917 - DNA, 27 bp, Artificial Sequence
  Description of Artificial Sequence: Synthetic oligonucleotide
acgcagttcgtgaggttcgacagcgac

SEQ ID NO: 364918 - DNA, 26 bp, Artificial Sequence
  Description of Artificial Sequence: Synthetic oligonucleotide
cgcagttcgtgaggttcgacagcgac

SEQ ID NO: 364919 - DNA, 26 bp, Artificial Sequence
  Description of Artificial Sequence: Synthetic oligonucleotide
gcagttcgtgaggttcgacagcgacg

SEQ ID NO: 364920 - DNA, 26 bp, Artificial Sequence
  Description of Artificial Sequence: Synthetic oligonucleotide
cagttcgtgaggttcgacagcgacgc

SEQ ID NO: 364921 - DNA, 26 bp, Artificial Sequence
  Description of Artificial Sequence: Synthetic oligonucleotide
agttcgtgaggttcgacagcgacgcc

SEQ ID NO: 364922 - DNA, 25 bp, Artificial Sequence
  Description of Artificial Sequence: Synthetic oligonucleotide
gttcgtgaggttcgacagcgacgcc

SEQ ID NO: 364923 - DNA, 25 bp, Artificial Sequence
  Description of Artificial Sequence: Synthetic oligonucleotide
ttcgtgaggttcgacagcgacgccg

SEQ ID NO: 364924 - DNA, 24 bp, Artificial Sequence
  Description of Artificial Sequence: Synthetic oligonucleotide
tcgtgaggttcgacagcgacgccg

SEQ ID NO: 364925 - DNA, 23 bp, Artificial Sequence
  Description of Artificial Sequence: Synthetic oligonucleotide
cgtgaggttcgacagcgacgccg

SEQ ID NO: 364926 - DNA, 23 bp, Artificial Sequence
  Description of Artificial Sequence: Synthetic oligonucleotide
gtgaggttcgacagcgacgccgc

SEQ ID NO: 364927 - DNA, 24 bp, Artificial Sequence
  Description of Artificial Sequence: Synthetic oligonucleotide
tgaggttcgacagcgacgccgcga

SEQ ID NO: 364928 - DNA, 23 bp, Artificial Sequence
  Description of Artificial Sequence: Synthetic oligonucleotide
gaggttcgacagcgacgccgcga

SEQ ID NO: 364929 - DNA, 23 bp, Artificial Sequence
  Description of Artificial Sequence: Synthetic oligonucleotide
aggttcgacagcgacgccgcgag

SEQ ID NO: 364930 - DNA, 23 bp, Artificial Sequence
  Description of Artificial Sequence: Synthetic oligonucleotide
ccgcgagccagaggatggagcca

SEQ ID NO: 364931 - DNA, 23 bp, Artificial Sequence
  Description of Artificial Sequence: Synthetic oligonucleotide
cgcgagccagaggatggagccac

SEQ ID NO: 364932 - DNA, 23 bp, Artificial Sequence
  Description of Artificial Sequence: Synthetic oligonucleotide
gcgagccagaggatggagccacg

SEQ ID NO: 364933 - DNA, 23 bp, Artificial Sequence
  Description of Artificial Sequence: Synthetic oligonucleotide
cgagccagaggatggagccacgg

SEQ ID NO: 364934 - DNA, 23 bp, Artificial Sequence
  Description of Artificial Sequence: Synthetic oligonucleotide
gagccagaggatggagccacggg

SEQ ID NO: 364935 - DNA, 23 bp, Artificial Sequence
  Description of Artificial Sequence: Synthetic oligonucleotide
agccagaggatggagccacgggc

SEQ ID NO: 364936 - DNA, 22 bp, Artificial Sequence
  Description of Artificial Sequence: Synthetic oligonucleotide
gccagaggatggagccacgggc

SEQ ID NO: 364937 - DNA, 22 bp, Artificial Sequence
  Description of Artificial Sequence: Synthetic oligonucleotide
ccagaggatggagccacgggcg

SEQ ID NO: 364938 - DNA, 22 bp, Artificial Sequence
  Description of Artificial Sequence: Synthetic oligonucleotide
cagaggatggagccacgggcgc

SEQ ID NO: 364939 - DNA, 22 bp, Artificial Sequence
  Description of Artificial Sequence: Synthetic oligonucleotide
agaggatggagccacgggcgcc

SEQ ID NO: 364940 - DNA, 21 bp, Artificial Sequence
  Description of Artificial Sequence: Synthetic oligonucleotide
gaggatggagccacgggcgcc

SEQ ID NO: 364941 - DNA, 22 bp, Artificial Sequence
  Description of Artificial Sequence: Synthetic oligonucleotide
aggatggagccacgggcgccgt

SEQ ID NO: 364942 - DNA, 21 bp, Artificial Sequence
  Description of Artificial Sequence: Synthetic oligonucleotide
ggatggagccacgggcgccgt

SEQ ID NO: 364943 - DNA, 21 bp, Artificial Sequence
  Description of Artificial Sequence: Synthetic oligonucleotide
gatggagccacgggcgccgtg

SEQ ID NO: 364944 - DNA, 24 bp, Artificial Sequence
  Description of Artificial Sequence: Synthetic oligonucleotide
atggagccacgggcgccgtggata

SEQ ID NO: 364945 - DNA, 23 bp, Artificial Sequence
  Description of Artificial Sequence: Synthetic oligonucleotide
tggagccacgggcgccgtggata

SEQ ID NO: 364946 - DNA, 22 bp, Artificial Sequence
  Description of Artificial Sequence: Synthetic oligonucleotide
ggagccacgggcgccgtggata

SEQ ID NO: 364947 - DNA, 23 bp, Artificial Sequence
  Description of Artificial Sequence: Synthetic oligonucleotide
gagccacgggcgccgtggataga

SEQ ID NO: 364948 - DNA, 23 bp, Artificial Sequence
  Description of Artificial Sequence: Synthetic oligonucleotide
agccacgggcgccgtggatagag

SEQ ID NO: 364949 - DNA, 22 bp, Artificial Sequence
  Description of Artificial Sequence: Synthetic oligonucleotide
gccacgggcgccgtggatagag

SEQ ID NO: 364950 - DNA, 23 bp, Artificial Sequence
  Description of Artificial Sequence: Synthetic oligonucleotide
ccacgggcgccgtggatagagca

SEQ ID NO: 364951 - DNA, 23 bp, Artificial Sequence
  Description of Artificial Sequence: Synthetic oligonucleotide
cacgggcgccgtggatagagcag

SEQ ID NO: 364952 - DNA, 24 bp, Artificial Sequence
  Description of Artificial Sequence: Synthetic oligonucleotide
acgggcgccgtggatagagcagga

SEQ ID NO: 364953 - DNA, 27 bp, Artificial Sequence
  Description of Artificial Sequence: Synthetic oligonucleotide
ggcggacatggcggctcagatcacaaa

SEQ ID NO: 364954 - DNA, 27 bp, Artificial Sequence
  Description of Artificial Sequence: Synthetic oligonucleotide
gcggacatggcggctcagatcacaaag

SEQ ID NO: 364955 - DNA, 27 bp, Artificial Sequence
  Description of Artificial Sequence: Synthetic oligonucleotide
cggacatggcggctcagatcacaaagc

SEQ ID NO: 364956 - DNA, 27 bp, Artificial Sequence
  Description of Artificial Sequence: Synthetic oligonucleotide
ggacatggcggctcagatcacaaagcg

SEQ ID NO: 364957 - DNA, 27 bp, Artificial Sequence
  Description of Artificial Sequence: Synthetic oligonucleotide
gacatggcggctcagatcacaaagcgc

SEQ ID NO: 364958 - DNA, 29 bp, Artificial Sequence
  Description of Artificial Sequence: Synthetic oligonucleotide
acatggcggctcagatcacaaagcgcaag

SEQ ID NO: 364959 - DNA, 28 bp, Artificial Sequence
  Description of Artificial Sequence: Synthetic oligonucleotide
catggcggctcagatcacaaagcgcaag

SEQ ID NO: 364960 - DNA, 29 bp, Artificial Sequence
  Description of Artificial Sequence: Synthetic oligonucleotide
atggcggctcagatcacaaagcgcaagtg

SEQ ID NO: 364961 - DNA, 28 bp, Artificial Sequence
  Description of Artificial Sequence: Synthetic oligonucleotide
tggcggctcagatcacaaagcgcaagtg

SEQ ID NO: 364962 - DNA, 27 bp, Artificial Sequence
  Description of Artificial Sequence: Synthetic oligonucleotide
ggcggctcagatcacaaagcgcaagtg

SEQ ID NO: 364963 - DNA, 27 bp, Artificial Sequence
  Description of Artificial Sequence: Synthetic oligonucleotide
gcggctcagatcacaaagcgcaagtgg

SEQ ID NO: 364964 - DNA, 27 bp, Artificial Sequence
  Description of Artificial Sequence: Synthetic oligonucleotide
cggctcagatcacaaagcgcaagtggg

SEQ ID NO: 364965 - DNA, 28 bp, Artificial Sequence
  Description of Artificial Sequence: Synthetic oligonucleotide
ggctcagatcacaaagcgcaagtgggag

SEQ ID NO: 364966 - DNA, 28 bp, Artificial Sequence
  Description of Artificial Sequence: Synthetic oligonucleotide
gctcagatcacaaagcgcaagtgggagg

SEQ ID NO: 364967 - DNA, 28 bp, Artificial Sequence
  Description of Artificial Sequence: Synthetic oligonucleotide
ctcagatcacaaagcgcaagtgggaggc

SEQ ID NO: 364968 - DNA, 28 bp, Artificial Sequence
  Description of Artificial Sequence: Synthetic oligonucleotide
tcagatcacaaagcgcaagtgggaggcg

SEQ ID NO: 364969 - DNA, 27 bp, Artificial Sequence
  Description of Artificial Sequence: Synthetic oligonucleotide
cagatcacaaagcgcaagtgggaggcg

SEQ ID NO: 364970 - DNA, 27 bp, Artificial Sequence
  Description of Artificial Sequence: Synthetic oligonucleotide
agatcacaaagcgcaagtgggaggcgg

SEQ ID NO: 364971 - DNA, 26 bp, Artificial Sequence
  Description of Artificial Sequence: Synthetic oligonucleotide
gatcacaaagcgcaagtgggaggcgg

SEQ ID NO: 364972 - DNA, 26 bp, Artificial Sequence
  Description of Artificial Sequence: Synthetic oligonucleotide
atcacaaagcgcaagtgggaggcggc

SEQ ID NO: 364973 - DNA, 25 bp, Artificial Sequence
  Description of Artificial Sequence: Synthetic oligonucleotide
tcacaaagcgcaagtgggaggcggc

SEQ ID NO: 364974 - DNA, 24 bp, Artificial Sequence
  Description of Artificial Sequence: Synthetic oligonucleotide
cacaaagcgcaagtgggaggcggc

SEQ ID NO: 364975 - DNA, 24 bp, Artificial Sequence
  Description of Artificial Sequence: Synthetic oligonucleotide
acaaagcgcaagtgggaggcggcc

SEQ ID NO: 364976 - DNA, 23 bp, Artificial Sequence
  Description of Artificial Sequence: Synthetic oligonucleotide
caaagcgcaagtgggaggcggcc

SEQ ID NO: 364977 - DNA, 25 bp, Artificial Sequence
  Description of Artificial Sequence: Synthetic oligonucleotide
aaagcgcaagtgggaggcggcccat

SEQ ID NO: 364978 - DNA, 31 bp, Artificial Sequence
  Description of Artificial Sequence: Synthetic oligonucleotide
tggtgccttctggagaggagcagagatatac

SEQ ID NO: 364979 - DNA, 30 bp, Artificial Sequence
  Description of Artificial Sequence: Synthetic oligonucleotide
ggtgccttctggagaggagcagagatatac

SEQ ID NO: 364980 - DNA, 30 bp, Artificial Sequence
  Description of Artificial Sequence: Synthetic oligonucleotide
gtgccttctggagaggagcagagatatacc

SEQ ID NO: 364981 - DNA, 31 bp, Artificial Sequence
  Description of Artificial Sequence: Synthetic oligonucleotide
tgccttctggagaggagcagagatatacctg

SEQ ID NO: 364982 - DNA, 30 bp, Artificial Sequence
  Description of Artificial Sequence: Synthetic oligonucleotide
gccttctggagaggagcagagatatacctg

SEQ ID NO: 364983 - DNA, 30 bp, Artificial Sequence
  Description of Artificial Sequence: Synthetic oligonucleotide
ccttctggagaggagcagagatatacctgc

SEQ ID NO: 364984 - DNA, 30 bp, Artificial Sequence
  Description of Artificial Sequence: Synthetic oligonucleotide
cttctggagaggagcagagatatacctgcc

SEQ ID NO: 364985 - DNA, 32 bp, Artificial Sequence
  Description of Artificial Sequence: Synthetic oligonucleotide
ttctggagaggagcagagatatacctgccatg

SEQ ID NO: 364986 - DNA, 31 bp, Artificial Sequence
  Description of Artificial Sequence: Synthetic oligonucleotide
tctggagaggagcagagatatacctgccatg

SEQ ID NO: 364987 - DNA, 30 bp, Artificial Sequence
  Description of Artificial Sequence: Synthetic oligonucleotide
ctggagaggagcagagatatacctgccatg

SEQ ID NO: 364988 - DNA, 31 bp, Artificial Sequence
  Description of Artificial Sequence: Synthetic oligonucleotide
tggagaggagcagagatatacctgccatgtg

SEQ ID NO: 364989 - DNA, 30 bp, Artificial Sequence
  Description of Artificial Sequence: Synthetic oligonucleotide
ggagaggagcagagatatacctgccatgtg

SEQ ID NO: 364990 - DNA, 30 bp, Artificial Sequence
  Description of Artificial Sequence: Synthetic oligonucleotide
gagaggagcagagatatacctgccatgtgc

SEQ ID NO: 364991 - DNA, 31 bp, Artificial Sequence
  Description of Artificial Sequence: Synthetic oligonucleotide
agaggagcagagatatacctgccatgtgcag

SEQ ID NO: 364992 - DNA, 30 bp, Artificial Sequence
  Description of Artificial Sequence: Synthetic oligonucleotide
gaggagcagagatatacctgccatgtgcag

SEQ ID NO: 364993 - DNA, 30 bp, Artificial Sequence
  Description of Artificial Sequence: Synthetic oligonucleotide
aggagcagagatatacctgccatgtgcagc

SEQ ID NO: 364994 - DNA, 29 bp, Artificial Sequence
  Description of Artificial Sequence: Synthetic oligonucleotide
ggagcagagatatacctgccatgtgcagc

SEQ ID NO: 364995 - DNA, 31 bp, Artificial Sequence
  Description of Artificial Sequence: Synthetic oligonucleotide
gagcagagatatacctgccatgtgcagcatg

SEQ ID NO: 364996 - DNA, 32 bp, Artificial Sequence
  Description of Artificial Sequence: Synthetic oligonucleotide
agcagagatatacctgccatgtgcagcatgag

SEQ ID NO: 364997 - DNA, 31 bp, Artificial Sequence
  Description of Artificial Sequence: Synthetic oligonucleotide
gcagagatatacctgccatgtgcagcatgag

SEQ ID NO: 364998 - DNA, 31 bp, Artificial Sequence
  Description of Artificial Sequence: Synthetic oligonucleotide
cagagatatacctgccatgtgcagcatgagg

SEQ ID NO: 364999 - DNA, 31 bp, Artificial Sequence
  Description of Artificial Sequence: Synthetic oligonucleotide
agagatatacctgccatgtgcagcatgaggg

SEQ ID NO: 365000 - DNA, 30 bp, Artificial Sequence
  Description of Artificial Sequence: Synthetic oligonucleotide
gagatatacctgccatgtgcagcatgaggg

SEQ ID NO: 365001 - DNA, 31 bp, Artificial Sequence
  Description of Artificial Sequence: Synthetic oligonucleotide
agatatacctgccatgtgcagcatgagggtc

SEQ ID NO: 365002 - DNA, 30 bp, Artificial Sequence
  Description of Artificial Sequence: Synthetic oligonucleotide
gatatacctgccatgtgcagcatgagggtc

SEQ ID NO: 365003 - DNA, 31 bp, Artificial Sequence
  Description of Artificial Sequence: Synthetic oligonucleotide
atatacctgccatgtgcagcatgagggtctg

SEQ ID NO: 365004 - DNA, 30 bp, Artificial Sequence
  Description of Artificial Sequence: Synthetic oligonucleotide
tatacctgccatgtgcagcatgagggtctg

SEQ ID NO: 365005 - DNA, 29 bp, Artificial Sequence
  Description of Artificial Sequence: Synthetic oligonucleotide
atacctgccatgtgcagcatgagggtctg

SEQ ID NO: 365006 - DNA, 28 bp, Artificial Sequence
  Description of Artificial Sequence: Synthetic oligonucleotide
tacctgccatgtgcagcatgagggtctg

SEQ ID NO: 365007 - DNA, 22 bp, Artificial Sequence
  Description of Artificial Sequence: Synthetic oligonucleotide
gcggggagccccgtttcatcgc

SEQ ID NO: 365008 - DNA, 22 bp, Artificial Sequence
  Description of Artificial Sequence: Synthetic oligonucleotide
cggggagccccgtttcatcgcc

SEQ ID NO: 365009 - DNA, 23 bp, Artificial Sequence
  Description of Artificial Sequence: Synthetic oligonucleotide
ggggagccccgtttcatcgccgt

SEQ ID NO: 365010 - DNA, 23 bp, Artificial Sequence
  Description of Artificial Sequence: Synthetic oligonucleotide
gggagccccgtttcatcgccgtg

SEQ ID NO: 365011 - DNA, 23 bp, Artificial Sequence
  Description of Artificial Sequence: Synthetic oligonucleotide
ggagccccgtttcatcgccgtgg

SEQ ID NO: 365012 - DNA, 23 bp, Artificial Sequence
  Description of Artificial Sequence: Synthetic oligonucleotide
gagccccgtttcatcgccgtggg

SEQ ID NO: 365013 - DNA, 25 bp, Artificial Sequence
  Description of Artificial Sequence: Synthetic oligonucleotide
agccccgtttcatcgccgtgggcta

SEQ ID NO: 365014 - DNA, 24 bp, Artificial Sequence
  Description of Artificial Sequence: Synthetic oligonucleotide
gccccgtttcatcgccgtgggcta

SEQ ID NO: 365015 - DNA, 24 bp, Artificial Sequence
  Description of Artificial Sequence: Synthetic oligonucleotide
ccccgtttcatcgccgtgggctac

SEQ ID NO: 365016 - DNA, 25 bp, Artificial Sequence
  Description of Artificial Sequence: Synthetic oligonucleotide
cccgtttcatcgccgtgggctacgt

SEQ ID NO: 365017 - DNA, 25 bp, Artificial Sequence
  Description of Artificial Sequence: Synthetic oligonucleotide
ccgtttcatcgccgtgggctacgtg

SEQ ID NO: 365018 - DNA, 26 bp, Artificial Sequence
  Description of Artificial Sequence: Synthetic oligonucleotide
cgtttcatcgccgtgggctacgtgga

SEQ ID NO: 365019 - DNA, 26 bp, Artificial Sequence
  Description of Artificial Sequence: Synthetic oligonucleotide
gtttcatcgccgtgggctacgtggac

SEQ ID NO: 365020 - DNA, 27 bp, Artificial Sequence
  Description of Artificial Sequence: Synthetic oligonucleotide
tttcatcgccgtgggctacgtggacga

SEQ ID NO: 365021 - DNA, 24 bp, Artificial Sequence
  Description of Artificial Sequence: Synthetic oligonucleotide
ccgtggatagagcaggaggggcca

SEQ ID NO: 365022 - DNA, 25 bp, Artificial Sequence
  Description of Artificial Sequence: Synthetic oligonucleotide
cgtggatagagcaggaggggccaga

SEQ ID NO: 365023 - DNA, 27 bp, Artificial Sequence
  Description of Artificial Sequence: Synthetic oligonucleotide
gtggatagagcaggaggggccagagta

SEQ ID NO: 365024 - DNA, 29 bp, Artificial Sequence
  Description of Artificial Sequence: Synthetic oligonucleotide
tggatagagcaggaggggccagagtattg

SEQ ID NO: 365025 - DNA, 28 bp, Artificial Sequence
  Description of Artificial Sequence: Synthetic oligonucleotide
ggatagagcaggaggggccagagtattg

SEQ ID NO: 365026 - DNA, 28 bp, Artificial Sequence
  Description of Artificial Sequence: Synthetic oligonucleotide
gatagagcaggaggggccagagtattgg

SEQ ID NO: 365027 - DNA, 28 bp, Artificial Sequence
  Description of Artificial Sequence: Synthetic oligonucleotide
atagagcaggaggggccagagtattggg

SEQ ID NO: 365028 - DNA, 27 bp, Artificial Sequence
  Description of Artificial Sequence: Synthetic oligonucleotide
tagagcaggaggggccagagtattggg

SEQ ID NO: 365029 - DNA, 27 bp, Artificial Sequence
  Description of Artificial Sequence: Synthetic oligonucleotide
agagcaggaggggccagagtattggga

SEQ ID NO: 365030 - DNA, 26 bp, Artificial Sequence
  Description of Artificial Sequence: Synthetic oligonucleotide
gagcaggaggggccagagtattggga

SEQ ID NO: 365031 - DNA, 26 bp, Artificial Sequence
  Description of Artificial Sequence: Synthetic oligonucleotide
agcaggaggggccagagtattgggac

SEQ ID NO: 365032 - DNA, 25 bp, Artificial Sequence
  Description of Artificial Sequence: Synthetic oligonucleotide
gcaggaggggccagagtattgggac

SEQ ID NO: 365033 - DNA, 26 bp, Artificial Sequence
  Description of Artificial Sequence: Synthetic oligonucleotide
caggaggggccagagtattgggacca

SEQ ID NO: 365034 - DNA, 26 bp, Artificial Sequence
  Description of Artificial Sequence: Synthetic oligonucleotide
aggaggggccagagtattgggaccag

SEQ ID NO: 365035 - DNA, 25 bp, Artificial Sequence
  Description of Artificial Sequence: Synthetic oligonucleotide
ggaggggccagagtattgggaccag

SEQ ID NO: 365036 - DNA, 26 bp, Artificial Sequence
  Description of Artificial Sequence: Synthetic oligonucleotide
gaggggccagagtattgggaccagga

SEQ ID NO: 365037 - DNA, 27 bp, Artificial Sequence
  Description of Artificial Sequence: Synthetic oligonucleotide
aggggccagagtattgggaccaggaga

SEQ ID NO: 365038 - DNA, 26 bp, Artificial Sequence
  Description of Artificial Sequence: Synthetic oligonucleotide
ggggccagagtattgggaccaggaga

SEQ ID NO: 365039 - DNA, 27 bp, Artificial Sequence
  Description of Artificial Sequence: Synthetic oligonucleotide
gggccagagtattgggaccaggagaca

SEQ ID NO: 365040 - DNA, 27 bp, Artificial Sequence
  Description of Artificial Sequence: Synthetic oligonucleotide
ggccagagtattgggaccaggagacac

SEQ ID NO: 365041 - DNA, 27 bp, Artificial Sequence
  Description of Artificial Sequence: Synthetic oligonucleotide
gccagagtattgggaccaggagacacg

SEQ ID NO: 365042 - DNA, 27 bp, Artificial Sequence
  Description of Artificial Sequence: Synthetic oligonucleotide
ccagagtattgggaccaggagacacgg

SEQ ID NO: 365043 - DNA, 30 bp, Artificial Sequence; identical to SEQ ID NO: 18411
  Description of Artificial Sequence: Synthetic oligonucleotide

SEQ ID NO: 365044 - DNA, 31 bp, Artificial Sequence; identical to SEQ ID NO: 18412
  Description of Artificial Sequence: Synthetic oligonucleotide

SEQ ID NO: 365045 - DNA, 29 bp, Artificial Sequence
  Description of Artificial Sequence: Synthetic oligonucleotide
cagttgagagcctacctggatggcacttg

SEQ ID NO: 365046 - DNA, 29 bp, Artificial Sequence
  Description of Artificial Sequence: Synthetic oligonucleotide
agttgagagcctacctggatggcacttgc

SEQ ID NO: 365047 - DNA, 28 bp, Artificial Sequence
  Description of Artificial Sequence: Synthetic oligonucleotide
gttgagagcctacctggatggcacttgc

SEQ ID NO: 365048 - DNA, 28 bp, Artificial Sequence
  Description of Artificial Sequence: Synthetic oligonucleotide
ttgagagcctacctggatggcacttgcg

SEQ ID NO: 365049 - DNA, 27 bp, Artificial Sequence
  Description of Artificial Sequence: Synthetic oligonucleotide
tgagagcctacctggatggcacttgcg

SEQ ID NO: 365050 - DNA, 27 bp, Artificial Sequence
  Description of Artificial Sequence: Synthetic oligonucleotide
gagagcctacctggatggcacttgcgt

SEQ ID NO: 365051 - DNA, 27 bp, Artificial Sequence
  Description of Artificial Sequence: Synthetic oligonucleotide
agagcctacctggatggcacttgcgtg

SEQ ID NO: 365052 - DNA, 26 bp, Artificial Sequence
  Description of Artificial Sequence: Synthetic oligonucleotide
gagcctacctggatggcacttgcgtg

SEQ ID NO: 365053 - DNA, 27 bp, Artificial Sequence
  Description of Artificial Sequence: Synthetic oligonucleotide
agcctacctggatggcacttgcgtgga

SEQ ID NO: 365054 - DNA, 26 bp, Artificial Sequence
  Description of Artificial Sequence: Synthetic oligonucleotide
gcctacctggatggcacttgcgtgga

SEQ ID NO: 365055 - DNA, 27 bp, Artificial Sequence
  Description of Artificial Sequence: Synthetic oligonucleotide
cctacctggatggcacttgcgtggagt

SEQ ID NO: 365056 - DNA, 27 bp, Artificial Sequence
  Description of Artificial Sequence: Synthetic oligonucleotide
ctacctggatggcacttgcgtggagtg

SEQ ID NO: 365057 - DNA, 27 bp, Artificial Sequence
  Description of Artificial Sequence: Synthetic oligonucleotide
tacctggatggcacttgcgtggagtgg

SEQ ID NO: 365058 - DNA, 26 bp, Artificial Sequence
  Description of Artificial Sequence: Synthetic oligonucleotide
acctggatggcacttgcgtggagtgg

SEQ ID NO: 365059 - DNA, 25 bp, Artificial Sequence
  Description of Artificial Sequence: Synthetic oligonucleotide
cctggatggcacttgcgtggagtgg

SEQ ID NO: 365060 - DNA, 26 bp, Artificial Sequence
  Description of Artificial Sequence: Synthetic oligonucleotide
ctggatggcacttgcgtggagtggct

SEQ ID NO: 365061 - DNA, 26 bp, Artificial Sequence
  Description of Artificial Sequence: Synthetic oligonucleotide
tggatggcacttgcgtggagtggctc

SEQ ID NO: 365062 - DNA, 25 bp, Artificial Sequence
  Description of Artificial Sequence: Synthetic oligonucleotide
ggatggcacttgcgtggagtggctc

SEQ ID NO: 365063 - DNA, 25 bp, Artificial Sequence
  Description of Artificial Sequence: Synthetic oligonucleotide
gatggcacttgcgtggagtggctcc

SEQ ID NO: 365064 - DNA, 25 bp, Artificial Sequence
  Description of Artificial Sequence: Synthetic oligonucleotide
atggcacttgcgtggagtggctccg

SEQ ID NO: 365065 - DNA, 24 bp, Artificial Sequence
  Description of Artificial Sequence: Synthetic oligonucleotide
tggcacttgcgtggagtggctccg

SEQ ID NO: 365066 - DNA, 23 bp, Artificial Sequence
  Description of Artificial Sequence: Synthetic oligonucleotide
ggcacttgcgtggagtggctccg

SEQ ID NO: 365067 - DNA, 24 bp, Artificial Sequence
  Description of Artificial Sequence: Synthetic oligonucleotide
gcacttgcgtggagtggctccgca

SEQ ID NO: 365068 - DNA, 27 bp, Artificial Sequence
  Description of Artificial Sequence: Synthetic oligonucleotide
cacttgcgtggagtggctccgcagata

SEQ ID NO: 365069 - DNA, 27 bp, Artificial Sequence
  Description of Artificial Sequence: Synthetic oligonucleotide
acttgcgtggagtggctccgcagatac

SEQ ID NO: 365070 - DNA, 26 bp, Artificial Sequence
  Description of Artificial Sequence: Synthetic oligonucleotide
cttgcgtggagtggctccgcagatac

SEQ ID NO: 365071 - DNA, 27 bp, Artificial Sequence
  Description of Artificial Sequence: Synthetic oligonucleotide
ttgcgtggagtggctccgcagatacct

SEQ ID NO: 365072 - DNA, 27 bp, Artificial Sequence
  Description of Artificial Sequence: Synthetic oligonucleotide
ctggagaacgggaaggagacgctgcaa

SEQ ID NO: 365073 - DNA, 27 bp, Artificial Sequence
  Description of Artificial Sequence: Synthetic oligonucleotide
tggagaacgggaaggagacgctgcaac

SEQ ID NO: 365074 - DNA, 26 bp, Artificial Sequence
  Description of Artificial Sequence: Synthetic oligonucleotide
ggagaacgggaaggagacgctgcaac

SEQ ID NO: 365075 - DNA, 26 bp, Artificial Sequence
  Description of Artificial Sequence: Synthetic oligonucleotide
gagaacgggaaggagacgctgcaacg

SEQ ID NO: 365076 - DNA, 27 bp, Artificial Sequence
  Description of Artificial Sequence: Synthetic oligonucleotide
agaacgggaaggagacgctgcaacgca

SEQ ID NO: 365077 - DNA, 26 bp, Artificial Sequence
  Description of Artificial Sequence: Synthetic oligonucleotide
gaacgggaaggagacgctgcaacgca

SEQ ID NO: 365078 - DNA, 26 bp, Artificial Sequence
  Description of Artificial Sequence: Synthetic oligonucleotide
aacgggaaggagacgctgcaacgcac

SEQ ID NO: 365079 - DNA, 25 bp, Artificial Sequence
  Description of Artificial Sequence: Synthetic oligonucleotide
acgggaaggagacgctgcaacgcac

SEQ ID NO: 365080 - DNA, 24 bp, Artificial Sequence
  Description of Artificial Sequence: Synthetic oligonucleotide
cgggaaggagacgctgcaacgcac

SEQ ID NO: 365081 - DNA, 24 bp, Artificial Sequence
  Description of Artificial Sequence: Synthetic oligonucleotide
gggaaggagacgctgcaacgcacg

SEQ ID NO: 365082 - DNA, 24 bp, Artificial Sequence
  Description of Artificial Sequence: Synthetic oligonucleotide
ggaaggagacgctgcaacgcacgg

SEQ ID NO: 365083 - DNA, 26 bp, Artificial Sequence
  Description of Artificial Sequence: Synthetic oligonucleotide
cggagcagcagagagcctacctggat

SEQ ID NO: 365084 - DNA, 26 bp, Artificial Sequence
  Description of Artificial Sequence: Synthetic oligonucleotide
ggagcagcagagagcctacctggatg

SEQ ID NO: 365085 - DNA, 26 bp, Artificial Sequence
  Description of Artificial Sequence: Synthetic oligonucleotide
gagcagcagagagcctacctggatgg

SEQ ID NO: 365086 - DNA, 27 bp, Artificial Sequence
  Description of Artificial Sequence: Synthetic oligonucleotide
agcagcagagagcctacctggatggca

SEQ ID NO: 365087 - DNA, 26 bp, Artificial Sequence
  Description of Artificial Sequence: Synthetic oligonucleotide
gcagcagagagcctacctggatggca

SEQ ID NO: 365088 - DNA, 26 bp, Artificial Sequence
  Description of Artificial Sequence: Synthetic oligonucleotide
cagcagagagcctacctggatggcac

SEQ ID NO: 365089 - DNA, 27 bp, Artificial Sequence
  Description of Artificial Sequence: Synthetic oligonucleotide
agcagagagcctacctggatggcacgt

SEQ ID NO: 365090 - DNA, 26 bp, Artificial Sequence
  Description of Artificial Sequence: Synthetic oligonucleotide
gcagagagcctacctggatggcacgt

SEQ ID NO: 365091 - DNA, 26 bp, Artificial Sequence
  Description of Artificial Sequence: Synthetic oligonucleotide
cagagagcctacctggatggcacgtg

SEQ ID NO: 365092 - DNA, 26 bp, Artificial Sequence
  Description of Artificial Sequence: Synthetic oligonucleotide
agagagcctacctggatggcacgtgc

SEQ ID NO: 365093 - DNA, 23 bp, Artificial Sequence
  Description of Artificial Sequence: Synthetic oligonucleotide
ggttcgacagcgacgccgcgagt

SEQ ID NO: 365094 - DNA, 24 bp, Artificial Sequence
  Description of Artificial Sequence: Synthetic oligonucleotide
gttcgacagcgacgccgcgagtca

SEQ ID NO: 365095 - DNA, 25 bp, Artificial Sequence
  Description of Artificial Sequence: Synthetic oligonucleotide
ttcgacagcgacgccgcgagtcaga

SEQ ID NO: 365096 - DNA, 24 bp, Artificial Sequence
  Description of Artificial Sequence: Synthetic oligonucleotide
tcgacagcgacgccgcgagtcaga

SEQ ID NO: 365097 - DNA, 23 bp, Artificial Sequence
  Description of Artificial Sequence: Synthetic oligonucleotide
cgacagcgacgccgcgagtcaga

SEQ ID NO: 365098 - DNA, 23 bp, Artificial Sequence
  Description of Artificial Sequence: Synthetic oligonucleotide
gacagcgacgccgcgagtcagag

SEQ ID NO: 365099 - DNA, 25 bp, Artificial Sequence
  Description of Artificial Sequence: Synthetic oligonucleotide
acagcgacgccgcgagtcagaggat

SEQ ID NO: 365100 - DNA, 24 bp, Artificial Sequence
  Description of Artificial Sequence: Synthetic oligonucleotide
cagcgacgccgcgagtcagaggat

SEQ ID NO: 365101 - DNA, 24 bp, Artificial Sequence
  Description of Artificial Sequence: Synthetic oligonucleotide
agcgacgccgcgagtcagaggatg

SEQ ID NO: 365102 - DNA, 23 bp, Artificial Sequence
  Description of Artificial Sequence: Synthetic oligonucleotide
gcgacgccgcgagtcagaggatg

SEQ ID NO: 365103 - DNA, 24 bp, Artificial Sequence
  Description of Artificial Sequence: Synthetic oligonucleotide
cgacgccgcgagtcagaggatgga

SEQ ID NO: 365104 - DNA, 24 bp, Artificial Sequence
  Description of Artificial Sequence: Synthetic oligonucleotide
gacgccgcgagtcagaggatggag

SEQ ID NO: 365105 - DNA, 24 bp, Artificial Sequence
  Description of Artificial Sequence: Synthetic oligonucleotide
acgccgcgagtcagaggatggagc

SEQ ID NO: 365106 - DNA, 23 bp, Artificial Sequence
  Description of Artificial Sequence: Synthetic oligonucleotide
cgccgcgagtcagaggatggagc

SEQ ID NO: 365107 - DNA, 23 bp, Artificial Sequence
  Description of Artificial Sequence: Synthetic oligonucleotide
gccgcgagtcagaggatggagcc

SEQ ID NO: 365108 - DNA, 23 bp, Artificial Sequence
  Description of Artificial Sequence: Synthetic oligonucleotide
ccgcgagtcagaggatggagccg

SEQ ID NO: 365109 - DNA, 23 bp, Artificial Sequence
  Description of Artificial Sequence: Synthetic oligonucleotide
cgcgagtcagaggatggagccgc

SEQ ID NO: 365110 - DNA, 23 bp, Artificial Sequence
  Description of Artificial Sequence: Synthetic oligonucleotide
gcgagtcagaggatggagccgcg

SEQ ID NO: 365111 - DNA, 23 bp, Artificial Sequence
  Description of Artificial Sequence: Synthetic oligonucleotide
cgagtcagaggatggagccgcgg

SEQ ID NO: 365112 - DNA, 23 bp, Artificial Sequence
  Description of Artificial Sequence: Synthetic oligonucleotide
gagtcagaggatggagccgcggg

SEQ ID NO: 365113 - DNA, 23 bp, Artificial Sequence
  Description of Artificial Sequence: Synthetic oligonucleotide
agtcagaggatggagccgcgggc

SEQ ID NO: 365114 - DNA, 22 bp, Artificial Sequence
  Description of Artificial Sequence: Synthetic oligonucleotide
gtcagaggatggagccgcgggc

SEQ ID NO: 365115 - DNA, 22 bp, Artificial Sequence
  Description of Artificial Sequence: Synthetic oligonucleotide
tcagaggatggagccgcgggcg

SEQ ID NO: 365116 - DNA, 27 bp, Artificial Sequence
  Description of Artificial Sequence: Synthetic oligonucleotide
caggagacacggaatgtgaaggcccac

SEQ ID NO: 365117 - DNA, 28 bp, Artificial Sequence
  Description of Artificial Sequence: Synthetic oligonucleotide
aggagacacggaatgtgaaggcccactc

SEQ ID NO: 365118 - DNA, 29 bp, Artificial Sequence
  Description of Artificial Sequence: Synthetic oligonucleotide
acggaatgtgaaggcccactcacagactg

SEQ ID NO: 365119 - DNA, 28 bp, Artificial Sequence
  Description of Artificial Sequence: Synthetic oligonucleotide
cggaatgtgaaggcccactcacagactg

SEQ ID NO: 365120 - DNA, 29 bp, Artificial Sequence
  Description of Artificial Sequence: Synthetic oligonucleotide
ggaatgtgaaggcccactcacagactgac

SEQ ID NO: 365121 - DNA, 29 bp, Artificial Sequence
  Description of Artificial Sequence: Synthetic oligonucleotide
gaatgtgaaggcccactcacagactgacc

SEQ ID NO: 365122 - DNA, 29 bp, Artificial Sequence
  Description of Artificial Sequence: Synthetic oligonucleotide
aatgtgaaggcccactcacagactgaccg

SEQ ID NO: 365123 - DNA, 28 bp, Artificial Sequence
  Description of Artificial Sequence: Synthetic oligonucleotide
atgtgaaggcccactcacagactgaccg

SEQ ID NO: 365124 - DNA, 27 bp, Artificial Sequence
  Description of Artificial Sequence: Synthetic oligonucleotide
tgtgaaggcccactcacagactgaccg

SEQ ID NO: 365125 - DNA, 27 bp, Artificial Sequence
  Description of Artificial Sequence: Synthetic oligonucleotide
gtgaaggcccactcacagactgaccga

SEQ ID NO: 365126 - DNA, 27 bp, Artificial Sequence
  Description of Artificial Sequence: Synthetic oligonucleotide
gaaggcccactcacagactgaccgagt

SEQ ID NO: 365127 - DNA, 27 bp, Artificial Sequence
  Description of Artificial Sequence: Synthetic oligonucleotide
aaggcccactcacagactgaccgagtg

SEQ ID NO: 365128 - DNA, 26 bp, Artificial Sequence
  Description of Artificial Sequence: Synthetic oligonucleotide
aggcccactcacagactgaccgagtg

SEQ ID NO: 365129 - DNA, 25 bp, Artificial Sequence
  Description of Artificial Sequence: Synthetic oligonucleotide
ggcccactcacagactgaccgagtg

SEQ ID NO: 365130 - DNA, 26 bp, Artificial Sequence
  Description of Artificial Sequence: Synthetic oligonucleotide
gcccactcacagactgaccgagtgga

SEQ ID NO: 365131 - DNA, 26 bp, Artificial Sequence
  Description of Artificial Sequence: Synthetic oligonucleotide
cccactcacagactgaccgagtggac

SEQ ID NO: 365132 - DNA, 27 bp, Artificial Sequence
  Description of Artificial Sequence: Synthetic oligonucleotide
ccactcacagactgaccgagtggacct

SEQ ID NO: 365133 - DNA, 27 bp, Artificial Sequence
  Description of Artificial Sequence: Synthetic oligonucleotide
cactcacagactgaccgagtggacctg

SEQ ID NO: 365134 - DNA, 27 bp, Artificial Sequence
  Description of Artificial Sequence: Synthetic oligonucleotide
actcacagactgaccgagtggacctgg

SEQ ID NO: 365135 - DNA, 26 bp, Artificial Sequence
  Description of Artificial Sequence: Synthetic oligonucleotide
ctcacagactgaccgagtggacctgg

SEQ ID NO: 365136 - DNA, 26 bp, Artificial Sequence
  Description of Artificial Sequence: Synthetic oligonucleotide
caagagcagaggggtcagggcgaagt

SEQ ID NO: 365137 - DNA, 26 bp, Artificial Sequence
  Description of Artificial Sequence: Synthetic oligonucleotide
aagagcagaggggtcagggcgaagtc

SEQ ID NO: 365138 - DNA, 25 bp, Artificial Sequence
  Description of Artificial Sequence: Synthetic oligonucleotide
agagcagaggggtcagggcgaagtc

SEQ ID NO: 365139 - DNA, 32 bp, Artificial Sequence
  Description of Artificial Sequence: Synthetic oligonucleotide
tcgggtttccagagaagccaatcagtgtcttc

SEQ ID NO: 365140 - DNA, 31 bp, Artificial Sequence
  Description of Artificial Sequence: Synthetic oligonucleotide
cgggtttccagagaagccaatcagtgtcttc

SEQ ID NO: 365141 - DNA, 31 bp, Artificial Sequence
  Description of Artificial Sequence: Synthetic oligonucleotide
gggtttccagagaagccaatcagtgtcttcg

SEQ ID NO: 365142 - DNA, 31 bp, Artificial Sequence
  Description of Artificial Sequence: Synthetic oligonucleotide
ggtttccagagaagccaatcagtgtcttcgc

SEQ ID NO: 365143 - DNA, 31 bp, Artificial Sequence
  Description of Artificial Sequence: Synthetic oligonucleotide
gtttccagagaagccaatcagtgtcttcgcg

SEQ ID NO: 365144 - DNA, 31 bp, Artificial Sequence
  Description of Artificial Sequence: Synthetic oligonucleotide
tttccagagaagccaatcagtgtcttcgcgg

SEQ ID NO: 365145 - DNA, 30 bp, Artificial Sequence
  Description of Artificial Sequence: Synthetic oligonucleotide
ttccagagaagccaatcagtgtcttcgcgg

SEQ ID NO: 365146 - DNA, 29 bp, Artificial Sequence
  Description of Artificial Sequence: Synthetic oligonucleotide
tccagagaagccaatcagtgtcttcgcgg

SEQ ID NO: 365147 - DNA, 28 bp, Artificial Sequence
  Description of Artificial Sequence: Synthetic oligonucleotide
ccagagaagccaatcagtgtcttcgcgg

SEQ ID NO: 365148 - DNA, 29 bp, Artificial Sequence
  Description of Artificial Sequence: Synthetic oligonucleotide
cagagaagccaatcagtgtcttcgcggtc

SEQ ID NO: 365149 - DNA, 29 bp, Artificial Sequence
  Description of Artificial Sequence: Synthetic oligonucleotide
agagaagccaatcagtgtcttcgcggtcg

SEQ ID NO: 365150 - DNA, 28 bp, Artificial Sequence
  Description of Artificial Sequence: Synthetic oligonucleotide
gagaagccaatcagtgtcttcgcggtcg

SEQ ID NO: 365151 - DNA, 28 bp, Artificial Sequence
  Description of Artificial Sequence: Synthetic oligonucleotide
agaagccaatcagtgtcttcgcggtcgc

SEQ ID NO: 365152 - DNA, 27 bp, Artificial Sequence
  Description of Artificial Sequence: Synthetic oligonucleotide
gaagccaatcagtgtcttcgcggtcgc

SEQ ID NO: 365153 - DNA, 28 bp, Artificial Sequence
  Description of Artificial Sequence: Synthetic oligonucleotide
aagccaatcagtgtcttcgcggtcgctc

SEQ ID NO: 365154 - DNA, 27 bp, Artificial Sequence
  Description of Artificial Sequence: Synthetic oligonucleotide
agccaatcagtgtcttcgcggtcgctc

SEQ ID NO: 365155 - DNA, 27 bp, Artificial Sequence
  Description of Artificial Sequence: Synthetic oligonucleotide
gccaatcagtgtcttcgcggtcgctct

SEQ ID NO: 365156 - DNA, 28 bp, Artificial Sequence
  Description of Artificial Sequence: Synthetic oligonucleotide
ccaatcagtgtcttcgcggtcgctcttc

SEQ ID NO: 365157 - DNA, 32 bp, Artificial Sequence
  Description of Artificial Sequence: Synthetic oligonucleotide
caatcagtgtcttcgcggtcgctcttctaaag

SEQ ID NO: 365158 - DNA, 33 bp, Artificial Sequence
  Description of Artificial Sequence: Synthetic oligonucleotide
aatcagtgtcttcgcggtcgctcttctaaagtc

SEQ ID NO: 365159 - DNA, 32 bp, Artificial Sequence
  Description of Artificial Sequence: Synthetic oligonucleotide
atcagtgtcttcgcggtcgctcttctaaagtc

SEQ ID NO: 365160 - DNA, 31 bp, Artificial Sequence
  Description of Artificial Sequence: Synthetic oligonucleotide
tcagtgtcttcgcggtcgctcttctaaagtc

SEQ ID NO: 365161 - DNA, 30 bp, Artificial Sequence
  Description of Artificial Sequence: Synthetic oligonucleotide
cagtgtcttcgcggtcgctcttctaaagtc

SEQ ID NO: 365162 - DNA, 30 bp, Artificial Sequence
  Description of Artificial Sequence: Synthetic oligonucleotide
agtgtcttcgcggtcgctcttctaaagtcc

SEQ ID NO: 365163 - DNA, 29 bp, Artificial Sequence
  Description of Artificial Sequence: Synthetic oligonucleotide
gtgtcttcgcggtcgctcttctaaagtcc

SEQ ID NO: 365164 - DNA, 29 bp, Artificial Sequence
  Description of Artificial Sequence: Synthetic oligonucleotide
tgtcttcgcggtcgctcttctaaagtccg

SEQ ID NO: 365165 - DNA, 28 bp, Artificial Sequence
  Description of Artificial Sequence: Synthetic oligonucleotide
gtcttcgcggtcgctcttctaaagtccg

SEQ ID NO: 365166 - DNA, 28 bp, Artificial Sequence
  Description of Artificial Sequence: Synthetic oligonucleotide
tcttcgcggtcgctcttctaaagtccgc

SEQ ID NO: 365167 - DNA, 27 bp, Artificial Sequence
  Description of Artificial Sequence: Synthetic oligonucleotide
cttcgcggtcgctcttctaaagtccgc

SEQ ID NO: 365168 - DNA, 28 bp, Artificial Sequence
  Description of Artificial Sequence: Synthetic oligonucleotide
ttcgcggtcgctcttctaaagtccgcac

SEQ ID NO: 365169 - DNA, 27 bp, Artificial Sequence
  Description of Artificial Sequence: Synthetic oligonucleotide
tcgcggtcgctcttctaaagtccgcac

SEQ ID NO: 365170 - DNA, 26 bp, Artificial Sequence
  Description of Artificial Sequence: Synthetic oligonucleotide
cgcggtcgctcttctaaagtccgcac

SEQ ID NO: 365171 - DNA, 26 bp, Artificial Sequence
  Description of Artificial Sequence: Synthetic oligonucleotide
gcggtcgctcttctaaagtccgcacg

SEQ ID NO: 365172 - DNA, 27 bp, Artificial Sequence
  Description of Artificial Sequence: Synthetic oligonucleotide
cggtcgctcttctaaagtccgcacgca

SEQ ID NO: 365173 - DNA, 27 bp, Artificial Sequence
  Description of Artificial Sequence: Synthetic oligonucleotide
ggtcgctcttctaaagtccgcacgcac

SEQ ID NO: 365174 - DNA, 27 bp, Artificial Sequence
  Description of Artificial Sequence: Synthetic oligonucleotide
gtcgctcttctaaagtccgcacgcacc

SEQ ID NO: 365175 - DNA, 27 bp, Artificial Sequence
  Description of Artificial Sequence: Synthetic oligonucleotide
tcgctcttctaaagtccgcacgcaccc

SEQ ID NO: 365176 - DNA, 27 bp, Artificial Sequence
  Description of Artificial Sequence: Synthetic oligonucleotide
cgctcttctaaagtccgcacgcaccca

SEQ ID NO: 365177 - DNA, 27 bp, Artificial Sequence
  Description of Artificial Sequence: Synthetic oligonucleotide
gctcttctaaagtccgcacgcacccac

SEQ ID NO: 365178 - DNA, 27 bp, Artificial Sequence
  Description of Artificial Sequence: Synthetic oligonucleotide
ctcttctaaagtccgcacgcacccacc

SEQ ID NO: 365179 - DNA, 27 bp, Artificial Sequence
  Description of Artificial Sequence: Synthetic oligonucleotide
tcttctaaagtccgcacgcacccaccg

SEQ ID NO: 365180 - DNA, 26 bp, Artificial Sequence
  Description of Artificial Sequence: Synthetic oligonucleotide
cttctaaagtccgcacgcacccaccg

SEQ ID NO: 365181 - DNA, 26 bp, Artificial Sequence
  Description of Artificial Sequence: Synthetic oligonucleotide
accgggactcagattctccccagacc

SEQ ID NO: 365182 - DNA, 25 bp, Artificial Sequence
  Description of Artificial Sequence: Synthetic oligonucleotide
ccgggactcagattctccccagacc

SEQ ID NO: 365183 - DNA, 25 bp, Artificial Sequence
  Description of Artificial Sequence: Synthetic oligonucleotide
cgggactcagattctccccagaccc

SEQ ID NO: 365184 - DNA, 25 bp, Artificial Sequence
  Description of Artificial Sequence: Synthetic oligonucleotide
gggactcagattctccccagacccc

SEQ ID NO: 365185 - DNA, 26 bp, Artificial Sequence
  Description of Artificial Sequence: Synthetic oligonucleotide
ggactcagattctccccagaccccga

SEQ ID NO: 365186 - DNA, 26 bp, Artificial Sequence
  Description of Artificial Sequence: Synthetic oligonucleotide
gactcagattctccccagaccccgag

SEQ ID NO: 365187 - DNA, 27 bp, Artificial Sequence
  Description of Artificial Sequence: Synthetic oligonucleotide
actcagattctccccagaccccgagga

SEQ ID NO: 365188 - DNA, 27 bp, Artificial Sequence
  Description of Artificial Sequence: Synthetic oligonucleotide
ctcagattctccccagaccccgaggat

SEQ ID NO: 365189 - DNA, 27 bp, Artificial Sequence
  Description of Artificial Sequence: Synthetic oligonucleotide
tcagattctccccagaccccgaggatg

SEQ ID NO: 365190 - DNA, 26 bp, Artificial Sequence
  Description of Artificial Sequence: Synthetic oligonucleotide
cagattctccccagaccccgaggatg

SEQ ID NO: 365191 - DNA, 26 bp, Artificial Sequence
  Description of Artificial Sequence: Synthetic oligonucleotide
agattctccccagaccccgaggatgg

SEQ ID NO: 365192 - DNA, 25 bp, Artificial Sequence
  Description of Artificial Sequence: Synthetic oligonucleotide
gattctccccagaccccgaggatgg

SEQ ID NO: 365193 - DNA, 25 bp, Artificial Sequence
  Description of Artificial Sequence: Synthetic oligonucleotide
attctccccagaccccgaggatggc

SEQ ID NO: 365194 - DNA, 24 bp, Artificial Sequence
  Description of Artificial Sequence: Synthetic oligonucleotide
ttctccccagaccccgaggatggc

SEQ ID NO: 365195 - DNA, 23 bp, Artificial Sequence
  Description of Artificial Sequence: Synthetic oligonucleotide
tctccccagaccccgaggatggc

SEQ ID NO: 365196 - DNA, 22 bp, Artificial Sequence
  Description of Artificial Sequence: Synthetic oligonucleotide
ctccccagaccccgaggatggc

SEQ ID NO: 365197 - DNA, 22 bp, Artificial Sequence
  Description of Artificial Sequence: Synthetic oligonucleotide
tccccagaccccgaggatggcc

SEQ ID NO: 365198 - DNA, 21 bp, Artificial Sequence
  Description of Artificial Sequence: Synthetic oligonucleotide
ccccagaccccgaggatggcc

SEQ ID NO: 365199 - DNA, 22 bp, Artificial Sequence
  Description of Artificial Sequence: Synthetic oligonucleotide
cccagaccccgaggatggccgt

SEQ ID NO: 365200 - DNA, 24 bp, Artificial Sequence
  Description of Artificial Sequence: Synthetic oligonucleotide
ccagaccccgaggatggccgtcat

SEQ ID NO: 365201 - DNA, 24 bp, Artificial Sequence
  Description of Artificial Sequence: Synthetic oligonucleotide
cagaccccgaggatggccgtcatg

SEQ ID NO: 365202 - DNA, 24 bp, Artificial Sequence
  Description of Artificial Sequence: Synthetic oligonucleotide
agaccccgaggatggccgtcatgg

SEQ ID NO: 365203 - DNA, 23 bp, Artificial Sequence
  Description of Artificial Sequence: Synthetic oligonucleotide
gaccccgaggatggccgtcatgg

SEQ ID NO: 365204 - DNA, 23 bp, Artificial Sequence
  Description of Artificial Sequence: Synthetic oligonucleotide
accccgaggatggccgtcatggc

SEQ ID NO: 365205 - DNA, 22 bp, Artificial Sequence
  Description of Artificial Sequence: Synthetic oligonucleotide
ccccgaggatggccgtcatggc

SEQ ID NO: 365206 - DNA, 22 bp, Artificial Sequence
  Description of Artificial Sequence: Synthetic oligonucleotide
cccgaggatggccgtcatggcg

SEQ ID NO: 365207 - DNA, 29 bp, Artificial Sequence
  Description of Artificial Sequence: Synthetic oligonucleotide
cgggctcccactccatgaggtatttctac

SEQ ID NO: 365208 - DNA, 30 bp, Artificial Sequence; identical to SEQ ID NO: 11033
  Description of Artificial Sequence: Synthetic oligonucleotide

SEQ ID NO: 365209 - DNA, 30 bp, Artificial Sequence; identical to SEQ ID NO: 11034
  Description of Artificial Sequence: Synthetic oligonucleotide

SEQ ID NO: 365210 - DNA, 22 bp, Artificial Sequence
  Description of Artificial Sequence: Synthetic oligonucleotide
cgcaagtgggaggcggcccatg

SEQ ID NO: 365211 - DNA, 22 bp, Artificial Sequence
  Description of Artificial Sequence: Synthetic oligonucleotide
gcaagtgggaggcggcccatgc

SEQ ID NO: 365212 - DNA, 23 bp, Artificial Sequence
  Description of Artificial Sequence: Synthetic oligonucleotide
gagtggacctggggaccctgcgt

SEQ ID NO: 365213 - DNA, 23 bp, Artificial Sequence
  Description of Artificial Sequence: Synthetic oligonucleotide
agtggacctggggaccctgcgtg

SEQ ID NO: 365214 - DNA, 22 bp, Artificial Sequence
  Description of Artificial Sequence: Synthetic oligonucleotide
gtggacctggggaccctgcgtg

SEQ ID NO: 365215 - DNA, 22 bp, Artificial Sequence
  Description of Artificial Sequence: Synthetic oligonucleotide
tggacctggggaccctgcgtgg

SEQ ID NO: 365216 - DNA, 21 bp, Artificial Sequence
  Description of Artificial Sequence: Synthetic oligonucleotide
ggacctggggaccctgcgtgg

SEQ ID NO: 365217 - DNA, 23 bp, Artificial Sequence
  Description of Artificial Sequence: Synthetic oligonucleotide
gacctggggaccctgcgtggcta

SEQ ID NO: 365218 - DNA, 25 bp, Artificial Sequence
  Description of Artificial Sequence: Synthetic oligonucleotide
acctggggaccctgcgtggctacta

SEQ ID NO: 365219 - DNA, 24 bp, Artificial Sequence
  Description of Artificial Sequence: Synthetic oligonucleotide
cctggggaccctgcgtggctacta

SEQ ID NO: 365220 - DNA, 26 bp, Artificial Sequence
  Description of Artificial Sequence: Synthetic oligonucleotide
ctggggaccctgcgtggctactacaa

SEQ ID NO: 365221 - DNA, 26 bp, Artificial Sequence
  Description of Artificial Sequence: Synthetic oligonucleotide
tggggaccctgcgtggctactacaac

SEQ ID NO: 365222 - DNA, 25 bp, Artificial Sequence
  Description of Artificial Sequence: Synthetic oligonucleotide
ggggaccctgcgtggctactacaac

SEQ ID NO: 365223 - DNA, 26 bp, Artificial Sequence
  Description of Artificial Sequence: Synthetic oligonucleotide
gggaccctgcgtggctactacaacca

SEQ ID NO: 365224 - DNA, 27 bp, Artificial Sequence
  Description of Artificial Sequence: Synthetic oligonucleotide
ggaccctgcgtggctactacaaccaga

SEQ ID NO: 365225 - DNA, 27 bp, Artificial Sequence
  Description of Artificial Sequence: Synthetic oligonucleotide
gaccctgcgtggctactacaaccagag

SEQ ID NO: 365226 - DNA, 27 bp, Artificial Sequence
  Description of Artificial Sequence: Synthetic oligonucleotide
accctgcgtggctactacaaccagagc

SEQ ID NO: 365227 - DNA, 26 bp, Artificial Sequence
  Description of Artificial Sequence: Synthetic oligonucleotide
ccctgcgtggctactacaaccagagc

SEQ ID NO: 365228 - DNA, 27 bp, Artificial Sequence
  Description of Artificial Sequence: Synthetic oligonucleotide
cctgcgtggctactacaaccagagcga

SEQ ID NO: 365229 - DNA, 27 bp, Artificial Sequence
  Description of Artificial Sequence: Synthetic oligonucleotide
ctgcgtggctactacaaccagagcgag

SEQ ID NO: 365230 - DNA, 27 bp, Artificial Sequence
  Description of Artificial Sequence: Synthetic oligonucleotide
tgcgtggctactacaaccagagcgagg

SEQ ID NO: 365231 - DNA, 27 bp, Artificial Sequence
  Description of Artificial Sequence: Synthetic oligonucleotide
gcgtggctactacaaccagagcgagga

SEQ ID NO: 365232 - DNA, 27 bp, Artificial Sequence
  Description of Artificial Sequence: Synthetic oligonucleotide
cgtggctactacaaccagagcgaggac

SEQ ID NO: 365233 - DNA, 27 bp, Artificial Sequence
  Description of Artificial Sequence: Synthetic oligonucleotide
gtggctactacaaccagagcgaggacg

SEQ ID NO: 365234 - DNA, 27 bp, Artificial Sequence
  Description of Artificial Sequence: Synthetic oligonucleotide
tggctactacaaccagagcgaggacgg

SEQ ID NO: 365235 - DNA, 32 bp, Artificial Sequence; identical to SEQ ID NO: 12249
  Description of Artificial Sequence: Synthetic oligonucleotide

SEQ ID NO: 365236 - DNA, 31 bp, Artificial Sequence; identical to SEQ ID NO: 12250
  Description of Artificial Sequence: Synthetic oligonucleotide

SEQ ID NO: 365237 - DNA, 30 bp, Artificial Sequence; identical to SEQ ID NO: 12251
  Description of Artificial Sequence: Synthetic oligonucleotide

SEQ ID NO: 365238 - DNA, 30 bp, Artificial Sequence; identical to SEQ ID NO: 12252
  Description of Artificial Sequence: Synthetic oligonucleotide

SEQ ID NO: 365239 - DNA, 29 bp, Artificial Sequence
  Description of Artificial Sequence: Synthetic oligonucleotide
acaaccagagcgaggacggttctcatacc

SEQ ID NO: 365240 - DNA, 28 bp, Artificial Sequence
  Description of Artificial Sequence: Synthetic oligonucleotide
caaccagagcgaggacggttctcatacc

SEQ ID NO: 365241 - DNA, 30 bp, Artificial Sequence; identical to SEQ ID NO: 12255
  Description of Artificial Sequence: Synthetic oligonucleotide

SEQ ID NO: 365242 - DNA, 29 bp, Artificial Sequence
  Description of Artificial Sequence: Synthetic oligonucleotide
accagagcgaggacggttctcataccatc

SEQ ID NO: 365243 - DNA, 28 bp, Artificial Sequence
  Description of Artificial Sequence: Synthetic oligonucleotide
ccagagcgaggacggttctcataccatc

SEQ ID NO: 365244 - DNA, 28 bp, Artificial Sequence
  Description of Artificial Sequence: Synthetic oligonucleotide
cagagcgaggacggttctcataccatcc

SEQ ID NO: 365245 - DNA, 29 bp, Artificial Sequence
  Description of Artificial Sequence: Synthetic oligonucleotide
agagcgaggacggttctcataccatccag

SEQ ID NO: 365246 - DNA, 28 bp, Artificial Sequence
  Description of Artificial Sequence: Synthetic oligonucleotide
gagcgaggacggttctcataccatccag

SEQ ID NO: 365247 - DNA, 33 bp, Artificial Sequence; identical to SEQ ID NO: 12261
  Description of Artificial Sequence: Synthetic oligonucleotide

SEQ ID NO: 365248 - DNA, 32 bp, Artificial Sequence; identical to SEQ ID NO: 12262
  Description of Artificial Sequence: Synthetic oligonucleotide

SEQ ID NO: 365249 - DNA, 35 bp, Artificial Sequence; identical to SEQ ID NO: 12263
  Description of Artificial Sequence: Synthetic oligonucleotide

SEQ ID NO: 365250 - DNA, 35 bp, Artificial Sequence; identical to SEQ ID NO: 12264
  Description of Artificial Sequence: Synthetic oligonucleotide

SEQ ID NO: 365251 - DNA, 35 bp, Artificial Sequence; identical to SEQ ID NO: 12265
  Description of Artificial Sequence: Synthetic oligonucleotide

SEQ ID NO: 365252 - DNA, 34 bp, Artificial Sequence; identical to SEQ ID NO: 12266
  Description of Artificial Sequence: Synthetic oligonucleotide

SEQ ID NO: 365253 - DNA, 35 bp, Artificial Sequence; identical to SEQ ID NO: 12267
  Description of Artificial Sequence: Synthetic oligonucleotide

SEQ ID NO: 365254 - DNA, 35 bp, Artificial Sequence; identical to SEQ ID NO: 12268
  Description of Artificial Sequence: Synthetic oligonucleotide

SEQ ID NO: 365255 - DNA, 34 bp, Artificial Sequence; identical to SEQ ID NO: 12269
  Description of Artificial Sequence: Synthetic oligonucleotide

SEQ ID NO: 365256 - DNA, 34 bp, Artificial Sequence; identical to SEQ ID NO: 12270
  Description of Artificial Sequence: Synthetic oligonucleotide

SEQ ID NO: 365257 - DNA, 35 bp, Artificial Sequence; identical to SEQ ID NO: 12271
  Description of Artificial Sequence: Synthetic oligonucleotide

SEQ ID NO: 365258 - DNA, 35 bp, Artificial Sequence; identical to SEQ ID NO: 12272
  Description of Artificial Sequence: Synthetic oligonucleotide

SEQ ID NO: 365259 - DNA, 34 bp, Artificial Sequence; identical to SEQ ID NO: 12273
  Description of Artificial Sequence: Synthetic oligonucleotide

SEQ ID NO: 365260 - DNA, 33 bp, Artificial Sequence; identical to SEQ ID NO: 12274
  Description of Artificial Sequence: Synthetic oligonucleotide

SEQ ID NO: 365261 - DNA, 34 bp, Artificial Sequence; identical to SEQ ID NO: 12275
  Description of Artificial Sequence: Synthetic oligonucleotide

SEQ ID NO: 365262 - DNA, 33 bp, Artificial Sequence; identical to SEQ ID NO: 12276
  Description of Artificial Sequence: Synthetic oligonucleotide

SEQ ID NO: 365263 - DNA, 33 bp, Artificial Sequence; identical to SEQ ID NO: 12277
  Description of Artificial Sequence: Synthetic oligonucleotide

SEQ ID NO: 365264 - DNA, 32 bp, Artificial Sequence; identical to SEQ ID NO: 12278
  Description of Artificial Sequence: Synthetic oligonucleotide

SEQ ID NO: 365265 - DNA, 23 bp, Artificial Sequence
  Description of Artificial Sequence: Synthetic oligonucleotide
agggccggtgcgtggagtggctt

SEQ ID NO: 365266 - DNA, 22 bp, Artificial Sequence
  Description of Artificial Sequence: Synthetic oligonucleotide
gggccggtgcgtggagtggctt

SEQ ID NO: 365267 - DNA, 22 bp, Artificial Sequence
  Description of Artificial Sequence: Synthetic oligonucleotide
ggccggtgcgtggagtggcttc

SEQ ID NO: 365268 - DNA, 22 bp, Artificial Sequence
  Description of Artificial Sequence: Synthetic oligonucleotide
gccggtgcgtggagtggcttcg

SEQ ID NO: 365269 - DNA, 23 bp, Artificial Sequence
  Description of Artificial Sequence: Synthetic oligonucleotide
ccggtgcgtggagtggcttcgca

SEQ ID NO: 365270 - DNA, 26 bp, Artificial Sequence
  Description of Artificial Sequence: Synthetic oligonucleotide
cggtgcgtggagtggcttcgcagata

SEQ ID NO: 365271 - DNA, 26 bp, Artificial Sequence
  Description of Artificial Sequence: Synthetic oligonucleotide
ggtgcgtggagtggcttcgcagatac

SEQ ID NO: 365272 - DNA, 27 bp, Artificial Sequence
  Description of Artificial Sequence: Synthetic oligonucleotide
gtgcgtggagtggcttcgcagatacct

SEQ ID NO: 365273 - DNA, 27 bp, Artificial Sequence
  Description of Artificial Sequence: Synthetic oligonucleotide
tgcgtggagtggcttcgcagatacctg

SEQ ID NO: 365274 - DNA, 26 bp, Artificial Sequence
  Description of Artificial Sequence: Synthetic oligonucleotide
gcgtggagtggcttcgcagatacctg

SEQ ID NO: 365275 - DNA, 27 bp, Artificial Sequence
  Description of Artificial Sequence: Synthetic oligonucleotide
cgtggagtggcttcgcagatacctgga

SEQ ID NO: 365276 - DNA, 27 bp, Artificial Sequence
  Description of Artificial Sequence: Synthetic oligonucleotide
gtggagtggcttcgcagatacctggag

SEQ ID NO: 365277 - DNA, 29 bp, Artificial Sequence
  Description of Artificial Sequence: Synthetic oligonucleotide
tggagtggcttcgcagatacctggagaac

SEQ ID NO: 365278 - DNA, 28 bp, Artificial Sequence
  Description of Artificial Sequence: Synthetic oligonucleotide
ggagtggcttcgcagatacctggagaac

SEQ ID NO: 365279 - DNA, 28 bp, Artificial Sequence
  Description of Artificial Sequence: Synthetic oligonucleotide
gagtggcttcgcagatacctggagaacg

SEQ ID NO: 365280 - DNA, 28 bp, Artificial Sequence
  Description of Artificial Sequence: Synthetic oligonucleotide
agtggcttcgcagatacctggagaacgg

SEQ ID NO: 365281 - DNA, 27 bp, Artificial Sequence
  Description of Artificial Sequence: Synthetic oligonucleotide
gtggcttcgcagatacctggagaacgg

SEQ ID NO: 365282 - DNA, 27 bp, Artificial Sequence
  Description of Artificial Sequence: Synthetic oligonucleotide
tggcttcgcagatacctggagaacggg

SEQ ID NO: 365283 - DNA, 27 bp, Artificial Sequence
  Description of Artificial Sequence: Synthetic oligonucleotide
ggcttcgcagatacctggagaacggga

SEQ ID NO: 365284 - DNA, 28 bp, Artificial Sequence
  Description of Artificial Sequence: Synthetic oligonucleotide
gcttcgcagatacctggagaacgggaag

SEQ ID NO: 365285 - DNA, 28 bp, Artificial Sequence
  Description of Artificial Sequence: Synthetic oligonucleotide
cttcgcagatacctggagaacgggaagg

SEQ ID NO: 365286 - DNA, 29 bp, Artificial Sequence
  Description of Artificial Sequence: Synthetic oligonucleotide
ttcgcagatacctggagaacgggaaggag

SEQ ID NO: 365287 - DNA, 28 bp, Artificial Sequence
  Description of Artificial Sequence: Synthetic oligonucleotide
tcgcagatacctggagaacgggaaggag

SEQ ID NO: 365288 - DNA, 20 bp, Artificial Sequence
  Description of Artificial Sequence: Synthetic oligonucleotide
ggccgcggggagccccgatt

SEQ ID NO: 365289 - DNA, 22 bp, Artificial Sequence
  Description of Artificial Sequence: Synthetic oligonucleotide
gccgcggggagccccgattcat

SEQ ID NO: 365290 - DNA, 22 bp, Artificial Sequence
  Description of Artificial Sequence: Synthetic oligonucleotide
ccgcggggagccccgattcatc

SEQ ID NO: 365291 - DNA, 22 bp, Artificial Sequence
  Description of Artificial Sequence: Synthetic oligonucleotide
cgcggggagccccgattcatcg

SEQ ID NO: 365292 - DNA, 22 bp, Artificial Sequence
  Description of Artificial Sequence: Synthetic oligonucleotide
gcggggagccccgattcatcgc

SEQ ID NO: 365293 - DNA, 22 bp, Artificial Sequence
  Description of Artificial Sequence: Synthetic oligonucleotide
cggggagccccgattcatcgcc

SEQ ID NO: 365294 - DNA, 23 bp, Artificial Sequence
  Description of Artificial Sequence: Synthetic oligonucleotide
ggggagccccgattcatcgccgt

SEQ ID NO: 365295 - DNA, 23 bp, Artificial Sequence
  Description of Artificial Sequence: Synthetic oligonucleotide
gggagccccgattcatcgccgtg

SEQ ID NO: 365296 - DNA, 23 bp, Artificial Sequence
  Description of Artificial Sequence: Synthetic oligonucleotide
ggagccccgattcatcgccgtgg

SEQ ID NO: 365297 - DNA, 23 bp, Artificial Sequence
  Description of Artificial Sequence: Synthetic oligonucleotide
gagccccgattcatcgccgtggg

SEQ ID NO: 365298 - DNA, 25 bp, Artificial Sequence
  Description of Artificial Sequence: Synthetic oligonucleotide
agccccgattcatcgccgtgggcta

SEQ ID NO: 365299 - DNA, 24 bp, Artificial Sequence
  Description of Artificial Sequence: Synthetic oligonucleotide
gccccgattcatcgccgtgggcta

SEQ ID NO: 365300 - DNA, 24 bp, Artificial Sequence
  Description of Artificial Sequence: Synthetic oligonucleotide
ccccgattcatcgccgtgggctac

SEQ ID NO: 365301 - DNA, 25 bp, Artificial Sequence
  Description of Artificial Sequence: Synthetic oligonucleotide
cccgattcatcgccgtgggctacgt

SEQ ID NO: 365302 - DNA, 25 bp, Artificial Sequence
  Description of Artificial Sequence: Synthetic oligonucleotide
ccgattcatcgccgtgggctacgtg

SEQ ID NO: 365303 - DNA, 26 bp, Artificial Sequence
  Description of Artificial Sequence: Synthetic oligonucleotide
cgattcatcgccgtgggctacgtgga

SEQ ID NO: 365304 - DNA, 26 bp, Artificial Sequence
  Description of Artificial Sequence: Synthetic oligonucleotide
gattcatcgccgtgggctacgtggac

SEQ ID NO: 365305 - DNA, 27 bp, Artificial Sequence
  Description of Artificial Sequence: Synthetic oligonucleotide
attcatcgccgtgggctacgtggacga

SEQ ID NO: 365306 - DNA, 31 bp, Artificial Sequence; identical to SEQ ID NO: 12347
  Description of Artificial Sequence: Synthetic oligonucleotide

SEQ ID NO: 365307 - DNA, 30 bp, Artificial Sequence; identical to SEQ ID NO: 12348
  Description of Artificial Sequence: Synthetic oligonucleotide

SEQ ID NO: 365308 - DNA, 30 bp, Artificial Sequence; identical to SEQ ID NO: 12349
  Description of Artificial Sequence: Synthetic oligonucleotide

SEQ ID NO: 365309 - DNA, 29 bp, Artificial Sequence
  Description of Artificial Sequence: Synthetic oligonucleotide
tggcagctcagatcaccaagcgcaaatgg

SEQ ID NO: 365310 - DNA, 28 bp, Artificial Sequence
  Description of Artificial Sequence: Synthetic oligonucleotide
ggcagctcagatcaccaagcgcaaatgg

SEQ ID NO: 365311 - DNA, 28 bp, Artificial Sequence
  Description of Artificial Sequence: Synthetic oligonucleotide
gcagctcagatcaccaagcgcaaatggg

SEQ ID NO: 365312 - DNA, 29 bp, Artificial Sequence
  Description of Artificial Sequence: Synthetic oligonucleotide
cagctcagatcaccaagcgcaaatgggag

SEQ ID NO: 365313 - DNA, 29 bp, Artificial Sequence
  Description of Artificial Sequence: Synthetic oligonucleotide
agctcagatcaccaagcgcaaatgggagg

SEQ ID NO: 365314 - DNA, 28 bp, Artificial Sequence
  Description of Artificial Sequence: Synthetic oligonucleotide
gctcagatcaccaagcgcaaatgggagg

SEQ ID NO: 365315 - DNA, 28 bp, Artificial Sequence
  Description of Artificial Sequence: Synthetic oligonucleotide
ctcagatcaccaagcgcaaatgggaggc

SEQ ID NO: 365316 - DNA, 28 bp, Artificial Sequence
  Description of Artificial Sequence: Synthetic oligonucleotide
tcagatcaccaagcgcaaatgggaggcg

SEQ ID NO: 365317 - DNA, 27 bp, Artificial Sequence
  Description of Artificial Sequence: Synthetic oligonucleotide
cagatcaccaagcgcaaatgggaggcg

SEQ ID NO: 365318 - DNA, 27 bp, Artificial Sequence
  Description of Artificial Sequence: Synthetic oligonucleotide
agatcaccaagcgcaaatgggaggcgg

SEQ ID NO: 365319 - DNA, 26 bp, Artificial Sequence
  Description of Artificial Sequence: Synthetic oligonucleotide
gatcaccaagcgcaaatgggaggcgg

SEQ ID NO: 365320 - DNA, 26 bp, Artificial Sequence
  Description of Artificial Sequence: Synthetic oligonucleotide
atcaccaagcgcaaatgggaggcggc

SEQ ID NO: 365321 - DNA, 25 bp, Artificial Sequence
  Description of Artificial Sequence: Synthetic oligonucleotide
tcaccaagcgcaaatgggaggcggc

SEQ ID NO: 365322 - DNA, 24 bp, Artificial Sequence
  Description of Artificial Sequence: Synthetic oligonucleotide
caccaagcgcaaatgggaggcggc

SEQ ID NO: 365323 - DNA, 24 bp, Artificial Sequence
  Description of Artificial Sequence: Synthetic oligonucleotide
accaagcgcaaatgggaggcggcc

SEQ ID NO: 365324 - DNA, 23 bp, Artificial Sequence
  Description of Artificial Sequence: Synthetic oligonucleotide
ccaagcgcaaatgggaggcggcc

SEQ ID NO: 365325 - DNA, 25 bp, Artificial Sequence
  Description of Artificial Sequence: Synthetic oligonucleotide
caagcgcaaatgggaggcggcccat

SEQ ID NO: 365326 - DNA, 25 bp, Artificial Sequence
  Description of Artificial Sequence: Synthetic oligonucleotide
aagcgcaaatgggaggcggcccatg

SEQ ID NO: 365327 - DNA, 24 bp, Artificial Sequence
  Description of Artificial Sequence: Synthetic oligonucleotide
agcgcaaatgggaggcggcccatg

SEQ ID NO: 365328 - DNA, 23 bp, Artificial Sequence
  Description of Artificial Sequence: Synthetic oligonucleotide
gcgcaaatgggaggcggcccatg

SEQ ID NO: 365329 - DNA, 23 bp, Artificial Sequence
  Description of Artificial Sequence: Synthetic oligonucleotide
cgcaaatgggaggcggcccatgc

SEQ ID NO: 365330 - DNA, 23 bp, Artificial Sequence
  Description of Artificial Sequence: Synthetic oligonucleotide
gcaaatgggaggcggcccatgcg

SEQ ID NO: 365331 - DNA, 23 bp, Artificial Sequence
  Description of Artificial Sequence: Synthetic oligonucleotide
caaatgggaggcggcccatgcgg

SEQ ID NO: 365332 - DNA, 23 bp, Artificial Sequence
  Description of Artificial Sequence: Synthetic oligonucleotide
aaatgggaggcggcccatgcggc

SEQ ID NO: 365333 - DNA, 22 bp, Artificial Sequence
  Description of Artificial Sequence: Synthetic oligonucleotide
aatgggaggcggcccatgcggc

SEQ ID NO: 365334 - DNA, 21 bp, Artificial Sequence
  Description of Artificial Sequence: Synthetic oligonucleotide
atgggaggcggcccatgcggc

SEQ ID NO: 365335 - DNA, 27 bp, Artificial Sequence
  Description of Artificial Sequence: Synthetic oligonucleotide
tacatcgccctgaacgaggacctgcgt

SEQ ID NO: 365336 - DNA, 27 bp, Artificial Sequence
  Description of Artificial Sequence: Synthetic oligonucleotide
acatcgccctgaacgaggacctgcgtt

SEQ ID NO: 365337 - DNA, 26 bp, Artificial Sequence
  Description of Artificial Sequence: Synthetic oligonucleotide
catcgccctgaacgaggacctgcgtt

SEQ ID NO: 365338 - DNA, 27 bp, Artificial Sequence
  Description of Artificial Sequence: Synthetic oligonucleotide
atcgccctgaacgaggacctgcgttct

SEQ ID NO: 365339 - DNA, 27 bp, Artificial Sequence
  Description of Artificial Sequence: Synthetic oligonucleotide
tcgccctgaacgaggacctgcgttctt

SEQ ID NO: 365340 - DNA, 26 bp, Artificial Sequence
  Description of Artificial Sequence: Synthetic oligonucleotide
cgccctgaacgaggacctgcgttctt

SEQ ID NO: 365341 - DNA, 26 bp, Artificial Sequence
  Description of Artificial Sequence: Synthetic oligonucleotide
gccctgaacgaggacctgcgttcttg

SEQ ID NO: 365342 - DNA, 27 bp, Artificial Sequence
  Description of Artificial Sequence: Synthetic oligonucleotide
ccctgaacgaggacctgcgttcttgga

SEQ ID NO: 365343 - DNA, 27 bp, Artificial Sequence
  Description of Artificial Sequence: Synthetic oligonucleotide
cctgaacgaggacctgcgttcttggac

SEQ ID NO: 365344 - DNA, 27 bp, Artificial Sequence
  Description of Artificial Sequence: Synthetic oligonucleotide
ctgaacgaggacctgcgttcttggacc

SEQ ID NO: 365345 - DNA, 27 bp, Artificial Sequence
  Description of Artificial Sequence: Synthetic oligonucleotide
tgaacgaggacctgcgttcttggaccg

SEQ ID NO: 365346 - DNA, 26 bp, Artificial Sequence
  Description of Artificial Sequence: Synthetic oligonucleotide
gaacgaggacctgcgttcttggaccg

SEQ ID NO: 365347 - DNA, 26 bp, Artificial Sequence
  Description of Artificial Sequence: Synthetic oligonucleotide
aacgaggacctgcgttcttggaccgc

SEQ ID NO: 365348 - DNA, 25 bp, Artificial Sequence
  Description of Artificial Sequence: Synthetic oligonucleotide
acgaggacctgcgttcttggaccgc

SEQ ID NO: 365349 - DNA, 24 bp, Artificial Sequence
  Description of Artificial Sequence: Synthetic oligonucleotide
cgaggacctgcgttcttggaccgc

SEQ ID NO: 365350 - DNA, 24 bp, Artificial Sequence
  Description of Artificial Sequence: Synthetic oligonucleotide
gaggacctgcgttcttggaccgcg

SEQ ID NO: 365351 - DNA, 24 bp, Artificial Sequence
  Description of Artificial Sequence: Synthetic oligonucleotide
aggacctgcgttcttggaccgcgg

SEQ ID NO: 365352 - DNA, 23 bp, Artificial Sequence
  Description of Artificial Sequence: Synthetic oligonucleotide
ggacctgcgttcttggaccgcgg

SEQ ID NO: 365353 - DNA, 23 bp, Artificial Sequence
  Description of Artificial Sequence: Synthetic oligonucleotide
gacctgcgttcttggaccgcggc

SEQ ID NO: 365354 - DNA, 23 bp, Artificial Sequence
  Description of Artificial Sequence: Synthetic oligonucleotide
acctgcgttcttggaccgcggcg

SEQ ID NO: 365355 - DNA, 22 bp, Artificial Sequence
  Description of Artificial Sequence: Synthetic oligonucleotide
cctgcgttcttggaccgcggcg

SEQ ID NO: 365356 - DNA, 23 bp, Artificial Sequence
  Description of Artificial Sequence: Synthetic oligonucleotide
ctgcgttcttggaccgcggcgga

SEQ ID NO: 365357 - DNA, 25 bp, Artificial Sequence
  Description of Artificial Sequence: Synthetic oligonucleotide
tgcgttcttggaccgcggcggacat

SEQ ID NO: 365358 - DNA, 24 bp, Artificial Sequence
  Description of Artificial Sequence: Synthetic oligonucleotide
gcgttcttggaccgcggcggacat

SEQ ID NO: 365359 - DNA, 24 bp, Artificial Sequence
  Description of Artificial Sequence: Synthetic oligonucleotide
cgttcttggaccgcggcggacatg

SEQ ID NO: 365360 - DNA, 24 bp, Artificial Sequence
  Description of Artificial Sequence: Synthetic oligonucleotide
gttcttggaccgcggcggacatgg

SEQ ID NO: 365361 - DNA, 25 bp, Artificial Sequence
  Description of Artificial Sequence: Synthetic oligonucleotide
ttcttggaccgcggcggacatggca

SEQ ID NO: 365362 - DNA, 23 bp, Artificial Sequence
  Description of Artificial Sequence: Synthetic oligonucleotide
gcaagtgggaggcggcccatgca

SEQ ID NO: 365363 - DNA, 23 bp, Artificial Sequence
  Description of Artificial Sequence: Synthetic oligonucleotide
caagtgggaggcggcccatgcag

SEQ ID NO: 365364 - DNA, 23 bp, Artificial Sequence
  Description of Artificial Sequence: Synthetic oligonucleotide
aagtgggaggcggcccatgcagc

SEQ ID NO: 365365 - DNA, 22 bp, Artificial Sequence
  Description of Artificial Sequence: Synthetic oligonucleotide
agtgggaggcggcccatgcagc

SEQ ID NO: 365366 - DNA, 21 bp, Artificial Sequence
  Description of Artificial Sequence: Synthetic oligonucleotide
gtgggaggcggcccatgcagc

SEQ ID NO: 365367 - DNA, 21 bp, Artificial Sequence
  Description of Artificial Sequence: Synthetic oligonucleotide
tgggaggcggcccatgcagcg

SEQ ID NO: 365368 - DNA, 20 bp, Artificial Sequence
  Description of Artificial Sequence: Synthetic oligonucleotide
gggaggcggcccatgcagcg

SEQ ID NO: 365369 - DNA, 21 bp, Artificial Sequence
  Description of Artificial Sequence: Synthetic oligonucleotide
ggaggcggcccatgcagcgga

SEQ ID NO: 365370 - DNA, 21 bp, Artificial Sequence
  Description of Artificial Sequence: Synthetic oligonucleotide
gaggcggcccatgcagcggag

SEQ ID NO: 365371 - DNA, 22 bp, Artificial Sequence
  Description of Artificial Sequence: Synthetic oligonucleotide
aggcggcccatgcagcggagca

SEQ ID NO: 365372 - DNA, 21 bp, Artificial Sequence
  Description of Artificial Sequence: Synthetic oligonucleotide
ggcggcccatgcagcggagca

SEQ ID NO: 365373 - DNA, 21 bp, Artificial Sequence
  Description of Artificial Sequence: Synthetic oligonucleotide
gcggcccatgcagcggagcag

SEQ ID NO: 365374 - DNA, 22 bp, Artificial Sequence
  Description of Artificial Sequence: Synthetic oligonucleotide
cggcccatgcagcggagcagca

SEQ ID NO: 365375 - DNA, 23 bp, Artificial Sequence
  Description of Artificial Sequence: Synthetic oligonucleotide
ggcccatgcagcggagcagcaga

SEQ ID NO: 365376 - DNA, 24 bp, Artificial Sequence
  Description of Artificial Sequence: Synthetic oligonucleotide
gcccatgcagcggagcagcagaga

SEQ ID NO: 365377 - DNA, 24 bp, Artificial Sequence
  Description of Artificial Sequence: Synthetic oligonucleotide
cccatgcagcggagcagcagagag

SEQ ID NO: 365378 - DNA, 24 bp, Artificial Sequence
  Description of Artificial Sequence: Synthetic oligonucleotide
ccatgcagcggagcagcagagagc

SEQ ID NO: 365379 - DNA, 26 bp, Artificial Sequence
  Description of Artificial Sequence: Synthetic oligonucleotide
catgcagcggagcagcagagagccta

SEQ ID NO: 365380 - DNA, 26 bp, Artificial Sequence
  Description of Artificial Sequence: Synthetic oligonucleotide
atgcagcggagcagcagagagcctac

SEQ ID NO: 365381 - DNA, 25 bp, Artificial Sequence
  Description of Artificial Sequence: Synthetic oligonucleotide
tgcagcggagcagcagagagcctac

SEQ ID NO: 365382 - DNA, 24 bp, Artificial Sequence
  Description of Artificial Sequence: Synthetic oligonucleotide
gcagcggagcagcagagagcctac

SEQ ID NO: 365383 - DNA, 25 bp, Artificial Sequence
  Description of Artificial Sequence: Synthetic oligonucleotide
cagcggagcagcagagagcctacct

SEQ ID NO: 365384 - DNA, 25 bp, Artificial Sequence
  Description of Artificial Sequence: Synthetic oligonucleotide
agcggagcagcagagagcctacctg

SEQ ID NO: 365385 - DNA, 26 bp, Artificial Sequence
  Description of Artificial Sequence: Synthetic oligonucleotide
tgaacgaggacctgcgctcttggacg

SEQ ID NO: 365386 - DNA, 25 bp, Artificial Sequence
  Description of Artificial Sequence: Synthetic oligonucleotide
gaacgaggacctgcgctcttggacg

SEQ ID NO: 365387 - DNA, 25 bp, Artificial Sequence
  Description of Artificial Sequence: Synthetic oligonucleotide
aacgaggacctgcgctcttggacgg

SEQ ID NO: 365388 - DNA, 24 bp, Artificial Sequence
  Description of Artificial Sequence: Synthetic oligonucleotide
acgaggacctgcgctcttggacgg

SEQ ID NO: 365389 - DNA, 23 bp, Artificial Sequence
  Description of Artificial Sequence: Synthetic oligonucleotide
cgaggacctgcgctcttggacgg

SEQ ID NO: 365390 - DNA, 23 bp, Artificial Sequence
  Description of Artificial Sequence: Synthetic oligonucleotide
gaggacctgcgctcttggacggc

SEQ ID NO: 365391 - DNA, 23 bp, Artificial Sequence
  Description of Artificial Sequence: Synthetic oligonucleotide
aggacctgcgctcttggacggcg

SEQ ID NO: 365392 - DNA, 22 bp, Artificial Sequence
  Description of Artificial Sequence: Synthetic oligonucleotide
ggacctgcgctcttggacggcg

SEQ ID NO: 365393 - DNA, 22 bp, Artificial Sequence
  Description of Artificial Sequence: Synthetic oligonucleotide
gacctgcgctcttggacggcgg

SEQ ID NO: 365394 - DNA, 22 bp, Artificial Sequence
  Description of Artificial Sequence: Synthetic oligonucleotide
acctgcgctcttggacggcggc

SEQ ID NO: 365395 - DNA, 21 bp, Artificial Sequence
  Description of Artificial Sequence: Synthetic oligonucleotide
cctgcgctcttggacggcggc

SEQ ID NO: 365396 - DNA, 21 bp, Artificial Sequence
  Description of Artificial Sequence: Synthetic oligonucleotide
ctgcgctcttggacggcggcg

SEQ ID NO: 365397 - DNA, 22 bp, Artificial Sequence
  Description of Artificial Sequence: Synthetic oligonucleotide
tgcgctcttggacggcggcgga

SEQ ID NO: 365398 - DNA, 21 bp, Artificial Sequence
  Description of Artificial Sequence: Synthetic oligonucleotide
gcgctcttggacggcggcgga

SEQ ID NO: 365399 - DNA, 23 bp, Artificial Sequence
  Description of Artificial Sequence: Synthetic oligonucleotide
cgctcttggacggcggcggacat

SEQ ID NO: 365400 - DNA, 23 bp, Artificial Sequence
  Description of Artificial Sequence: Synthetic oligonucleotide
gctcttggacggcggcggacatg

SEQ ID NO: 365401 - DNA, 23 bp, Artificial Sequence
  Description of Artificial Sequence: Synthetic oligonucleotide
ctcttggacggcggcggacatgg

SEQ ID NO: 365402 - DNA, 24 bp, Artificial Sequence
  Description of Artificial Sequence: Synthetic oligonucleotide
tcttggacggcggcggacatggca

SEQ ID NO: 365403 - DNA, 23 bp, Artificial Sequence
  Description of Artificial Sequence: Synthetic oligonucleotide
cttggacggcggcggacatggca

SEQ ID NO: 365404 - DNA, 23 bp, Artificial Sequence
  Description of Artificial Sequence: Synthetic oligonucleotide
ttggacggcggcggacatggcag

SEQ ID NO: 365405 - DNA, 22 bp, Artificial Sequence
  Description of Artificial Sequence: Synthetic oligonucleotide
tggacggcggcggacatggcag

SEQ ID NO: 365406 - DNA, 21 bp, Artificial Sequence
  Description of Artificial Sequence: Synthetic oligonucleotide
ggacggcggcggacatggcag

SEQ ID NO: 365407 - DNA, 22 bp, Artificial Sequence
  Description of Artificial Sequence: Synthetic oligonucleotide
gacggcggcggacatggcagct

SEQ ID NO: 365408 - DNA, 23 bp, Artificial Sequence
  Description of Artificial Sequence: Synthetic oligonucleotide
acggcggcggacatggcagctca

SEQ ID NO: 365409 - DNA, 22 bp, Artificial Sequence
  Description of Artificial Sequence: Synthetic oligonucleotide
cggcggcggacatggcagctca

SEQ ID NO: 365410 - DNA, 24 bp, Artificial Sequence
  Description of Artificial Sequence: Synthetic oligonucleotide
ggcggcggacatggcagctcagat

SEQ ID NO: 365411 - DNA, 23 bp, Artificial Sequence
  Description of Artificial Sequence: Synthetic oligonucleotide
gcgggtaccggcaggacgcctat

SEQ ID NO: 365412 - DNA, 24 bp, Artificial Sequence
  Description of Artificial Sequence: Synthetic oligonucleotide
cgggtaccggcaggacgcctatga

SEQ ID NO: 365413 - DNA, 24 bp, Artificial Sequence
  Description of Artificial Sequence: Synthetic oligonucleotide
gggtaccggcaggacgcctatgac

SEQ ID NO: 365414 - DNA, 24 bp, Artificial Sequence
  Description of Artificial Sequence: Synthetic oligonucleotide
ggtaccggcaggacgcctatgacg

SEQ ID NO: 365415 - DNA, 24 bp, Artificial Sequence
  Description of Artificial Sequence: Synthetic oligonucleotide
gtaccggcaggacgcctatgacgg

SEQ ID NO: 365416 - DNA, 26 bp, Artificial Sequence
  Description of Artificial Sequence: Synthetic oligonucleotide
taccggcaggacgcctatgacggcaa

SEQ ID NO: 365417 - DNA, 25 bp, Artificial Sequence
  Description of Artificial Sequence: Synthetic oligonucleotide
accggcaggacgcctatgacggcaa

SEQ ID NO: 365418 - DNA, 24 bp, Artificial Sequence
  Description of Artificial Sequence: Synthetic oligonucleotide
ccggcaggacgcctatgacggcaa

SEQ ID NO: 365419 - DNA, 24 bp, Artificial Sequence
  Description of Artificial Sequence: Synthetic oligonucleotide
cggcaggacgcctatgacggcaag

SEQ ID NO: 365420 - DNA, 27 bp, Artificial Sequence
  Description of Artificial Sequence: Synthetic oligonucleotide
ggcaggacgcctatgacggcaaggatt

SEQ ID NO: 365421 - DNA, 28 bp, Artificial Sequence
  Description of Artificial Sequence: Synthetic oligonucleotide
gcaggacgcctatgacggcaaggattac

SEQ ID NO: 365422 - DNA, 30 bp, Artificial Sequence; identical to SEQ ID NO: 12463
  Description of Artificial Sequence: Synthetic oligonucleotide

SEQ ID NO: 365423 - DNA, 30 bp, Artificial Sequence; identical to SEQ ID NO: 12464
  Description of Artificial Sequence: Synthetic oligonucleotide

SEQ ID NO: 365424 - DNA, 29 bp, Artificial Sequence
  Description of Artificial Sequence: Synthetic oligonucleotide
ggacgcctatgacggcaaggattacatcg

SEQ ID NO: 365425 - DNA, 29 bp, Artificial Sequence
  Description of Artificial Sequence: Synthetic oligonucleotide
gacgcctatgacggcaaggattacatcgc

SEQ ID NO: 365426 - DNA, 29 bp, Artificial Sequence
  Description of Artificial Sequence: Synthetic oligonucleotide
acgcctatgacggcaaggattacatcgcc

SEQ ID NO: 365427 - DNA, 28 bp, Artificial Sequence
  Description of Artificial Sequence: Synthetic oligonucleotide
cgcctatgacggcaaggattacatcgcc

SEQ ID NO: 365428 - DNA, 28 bp, Artificial Sequence
  Description of Artificial Sequence: Synthetic oligonucleotide
gcctatgacggcaaggattacatcgccc

SEQ ID NO: 365429 - DNA, 29 bp, Artificial Sequence
  Description of Artificial Sequence: Synthetic oligonucleotide
cctatgacggcaaggattacatcgccctg

SEQ ID NO: 365430 - DNA, 31 bp, Artificial Sequence; identical to SEQ ID NO: 12471
  Description of Artificial Sequence: Synthetic oligonucleotide

SEQ ID NO: 365431 - DNA, 31 bp, Artificial Sequence; identical to SEQ ID NO: 12472
  Description of Artificial Sequence: Synthetic oligonucleotide

SEQ ID NO: 365432 - DNA, 30 bp, Artificial Sequence; identical to SEQ ID NO: 12473
  Description of Artificial Sequence: Synthetic oligonucleotide

SEQ ID NO: 365433 - DNA, 29 bp, Artificial Sequence
  Description of Artificial Sequence: Synthetic oligonucleotide
tgacggcaaggattacatcgccctgaacg

SEQ ID NO: 365434 - DNA, 25 bp, Artificial Sequence
  Description of Artificial Sequence: Synthetic oligonucleotide
tacctggagggccggtgcgtggaat

SEQ ID NO: 365435 - DNA, 24 bp, Artificial Sequence
  Description of Artificial Sequence: Synthetic oligonucleotide
acctggagggccggtgcgtggaat

SEQ ID NO: 365436 - DNA, 23 bp, Artificial Sequence
  Description of Artificial Sequence: Synthetic oligonucleotide
cctggagggccggtgcgtggaat

SEQ ID NO: 365437 - DNA, 23 bp, Artificial Sequence
  Description of Artificial Sequence: Synthetic oligonucleotide
ctggagggccggtgcgtggaatg

SEQ ID NO: 365438 - DNA, 23 bp, Artificial Sequence
  Description of Artificial Sequence: Synthetic oligonucleotide
tggagggccggtgcgtggaatgg

SEQ ID NO: 365439 - DNA, 22 bp, Artificial Sequence
  Description of Artificial Sequence: Synthetic oligonucleotide
ggagggccggtgcgtggaatgg

SEQ ID NO: 365440 - DNA, 23 bp, Artificial Sequence
  Description of Artificial Sequence: Synthetic oligonucleotide
gagggccggtgcgtggaatggct

SEQ ID NO: 365441 - DNA, 23 bp, Artificial Sequence
  Description of Artificial Sequence: Synthetic oligonucleotide
agggccggtgcgtggaatggctc

SEQ ID NO: 365442 - DNA, 22 bp, Artificial Sequence
  Description of Artificial Sequence: Synthetic oligonucleotide
gggccggtgcgtggaatggctc

SEQ ID NO: 365443 - DNA, 22 bp, Artificial Sequence
  Description of Artificial Sequence: Synthetic oligonucleotide
ggccggtgcgtggaatggctcc

SEQ ID NO: 365444 - DNA, 22 bp, Artificial Sequence
  Description of Artificial Sequence: Synthetic oligonucleotide
gccggtgcgtggaatggctccg

SEQ ID NO: 365445 - DNA, 23 bp, Artificial Sequence
  Description of Artificial Sequence: Synthetic oligonucleotide
ccggtgcgtggaatggctccgca

SEQ ID NO: 365446 - DNA, 26 bp, Artificial Sequence
  Description of Artificial Sequence: Synthetic oligonucleotide
cggtgcgtggaatggctccgcagata

SEQ ID NO: 365447 - DNA, 26 bp, Artificial Sequence
  Description of Artificial Sequence: Synthetic oligonucleotide
ggtgcgtggaatggctccgcagatac

SEQ ID NO: 365448 - DNA, 27 bp, Artificial Sequence
  Description of Artificial Sequence: Synthetic oligonucleotide
gtgcgtggaatggctccgcagatacct

SEQ ID NO: 365449 - DNA, 27 bp, Artificial Sequence
  Description of Artificial Sequence: Synthetic oligonucleotide
tgcgtggaatggctccgcagatacctg

SEQ ID NO: 365450 - DNA, 26 bp, Artificial Sequence
  Description of Artificial Sequence: Synthetic oligonucleotide
gcgtggaatggctccgcagatacctg

SEQ ID NO: 365451 - DNA, 27 bp, Artificial Sequence
  Description of Artificial Sequence: Synthetic oligonucleotide
cgtggaatggctccgcagatacctgga

SEQ ID NO: 365452 - DNA, 27 bp, Artificial Sequence
  Description of Artificial Sequence: Synthetic oligonucleotide
gtggaatggctccgcagatacctggag

SEQ ID NO: 365453 - DNA, 29 bp, Artificial Sequence
  Description of Artificial Sequence: Synthetic oligonucleotide
tggaatggctccgcagatacctggagaac

SEQ ID NO: 365454 - DNA, 28 bp, Artificial Sequence
  Description of Artificial Sequence: Synthetic oligonucleotide
ggaatggctccgcagatacctggagaac

SEQ ID NO: 365455 - DNA, 28 bp, Artificial Sequence
  Description of Artificial Sequence: Synthetic oligonucleotide
gaatggctccgcagatacctggagaacg

SEQ ID NO: 365456 - DNA, 28 bp, Artificial Sequence
  Description of Artificial Sequence: Synthetic oligonucleotide
aatggctccgcagatacctggagaacgg

SEQ ID NO: 365457 - DNA, 27 bp, Artificial Sequence
  Description of Artificial Sequence: Synthetic oligonucleotide
atggctccgcagatacctggagaacgg

SEQ ID NO: 365458 - DNA, 25 bp, Artificial Sequence
  Description of Artificial Sequence: Synthetic oligonucleotide
ttcgacagcgacgccgcgagccaaa

SEQ ID NO: 365459 - DNA, 24 bp, Artificial Sequence
  Description of Artificial Sequence: Synthetic oligonucleotide
tcgacagcgacgccgcgagccaaa

SEQ ID NO: 365460 - DNA, 23 bp, Artificial Sequence
  Description of Artificial Sequence: Synthetic oligonucleotide
cgacagcgacgccgcgagccaaa

SEQ ID NO: 365461 - DNA, 23 bp, Artificial Sequence
  Description of Artificial Sequence: Synthetic oligonucleotide
gacagcgacgccgcgagccaaag

SEQ ID NO: 365462 - DNA, 25 bp, Artificial Sequence
  Description of Artificial Sequence: Synthetic oligonucleotide
acagcgacgccgcgagccaaaggat

SEQ ID NO: 365463 - DNA, 24 bp, Artificial Sequence
  Description of Artificial Sequence: Synthetic oligonucleotide
cagcgacgccgcgagccaaaggat

SEQ ID NO: 365464 - DNA, 24 bp, Artificial Sequence
  Description of Artificial Sequence: Synthetic oligonucleotide
agcgacgccgcgagccaaaggatg

SEQ ID NO: 365465 - DNA, 23 bp, Artificial Sequence
  Description of Artificial Sequence: Synthetic oligonucleotide
gcgacgccgcgagccaaaggatg

SEQ ID NO: 365466 - DNA, 24 bp, Artificial Sequence
  Description of Artificial Sequence: Synthetic oligonucleotide
cgacgccgcgagccaaaggatgga

SEQ ID NO: 365467 - DNA, 24 bp, Artificial Sequence
  Description of Artificial Sequence: Synthetic oligonucleotide
gacgccgcgagccaaaggatggag

SEQ ID NO: 365468 - DNA, 24 bp, Artificial Sequence
  Description of Artificial Sequence: Synthetic oligonucleotide
acgccgcgagccaaaggatggagc

SEQ ID NO: 365469 - DNA, 23 bp, Artificial Sequence
  Description of Artificial Sequence: Synthetic oligonucleotide
cgccgcgagccaaaggatggagc

SEQ ID NO: 365470 - DNA, 23 bp, Artificial Sequence
  Description of Artificial Sequence: Synthetic oligonucleotide
gccgcgagccaaaggatggagcc

SEQ ID NO: 365471 - DNA, 23 bp, Artificial Sequence
  Description of Artificial Sequence: Synthetic oligonucleotide
ccgcgagccaaaggatggagccg

SEQ ID NO: 365472 - DNA, 23 bp, Artificial Sequence
  Description of Artificial Sequence: Synthetic oligonucleotide
cgcgagccaaaggatggagccgc

SEQ ID NO: 365473 - DNA, 23 bp, Artificial Sequence
  Description of Artificial Sequence: Synthetic oligonucleotide
gcgagccaaaggatggagccgcg

SEQ ID NO: 365474 - DNA, 23 bp, Artificial Sequence
  Description of Artificial Sequence: Synthetic oligonucleotide
cgagccaaaggatggagccgcgg

SEQ ID NO: 365475 - DNA, 23 bp, Artificial Sequence
  Description of Artificial Sequence: Synthetic oligonucleotide
gagccaaaggatggagccgcggg

SEQ ID NO: 365476 - DNA, 23 bp, Artificial Sequence
  Description of Artificial Sequence: Synthetic oligonucleotide
agccaaaggatggagccgcgggc

SEQ ID NO: 365477 - DNA, 22 bp, Artificial Sequence
  Description of Artificial Sequence: Synthetic oligonucleotide
gccaaaggatggagccgcgggc

SEQ ID NO: 365478 - DNA, 22 bp, Artificial Sequence
  Description of Artificial Sequence: Synthetic oligonucleotide
ccaaaggatggagccgcgggcg

SEQ ID NO: 365479 - DNA, 22 bp, Artificial Sequence
  Description of Artificial Sequence: Synthetic oligonucleotide
caaaggatggagccgcgggcgc

SEQ ID NO: 365480 - DNA, 22 bp, Artificial Sequence
  Description of Artificial Sequence: Synthetic oligonucleotide
aaaggatggagccgcgggcgcc

SEQ ID NO: 365481 - DNA, 21 bp, Artificial Sequence
  Description of Artificial Sequence: Synthetic oligonucleotide
aaggatggagccgcgggcgcc

SEQ ID NO: 365482 - DNA, 26 bp, Artificial Sequence
  Description of Artificial Sequence: Synthetic oligonucleotide
tggggaccctgcgcggctactacaat

SEQ ID NO: 365483 - DNA, 25 bp, Artificial Sequence
  Description of Artificial Sequence: Synthetic oligonucleotide
ggggaccctgcgcggctactacaat

SEQ ID NO: 365484 - DNA, 26 bp, Artificial Sequence
  Description of Artificial Sequence: Synthetic oligonucleotide
gggaccctgcgcggctactacaatca

SEQ ID NO: 365485 - DNA, 27 bp, Artificial Sequence
  Description of Artificial Sequence: Synthetic oligonucleotide
ggaccctgcgcggctactacaatcaga

SEQ ID NO: 365486 - DNA, 27 bp, Artificial Sequence
  Description of Artificial Sequence: Synthetic oligonucleotide
gaccctgcgcggctactacaatcagag

SEQ ID NO: 365487 - DNA, 27 bp, Artificial Sequence
  Description of Artificial Sequence: Synthetic oligonucleotide
accctgcgcggctactacaatcagagc

SEQ ID NO: 365488 - DNA, 26 bp, Artificial Sequence
  Description of Artificial Sequence: Synthetic oligonucleotide
ccctgcgcggctactacaatcagagc

SEQ ID NO: 365489 - DNA, 27 bp, Artificial Sequence
  Description of Artificial Sequence: Synthetic oligonucleotide
cctgcgcggctactacaatcagagcga

SEQ ID NO: 365490 - DNA, 27 bp, Artificial Sequence
  Description of Artificial Sequence: Synthetic oligonucleotide
ctgcgcggctactacaatcagagcgag

SEQ ID NO: 365491 - DNA, 27 bp, Artificial Sequence
  Description of Artificial Sequence: Synthetic oligonucleotide
tgcgcggctactacaatcagagcgagg

SEQ ID NO: 365492 - DNA, 27 bp, Artificial Sequence
  Description of Artificial Sequence: Synthetic oligonucleotide
gcgcggctactacaatcagagcgagga

SEQ ID NO: 365493 - DNA, 27 bp, Artificial Sequence
  Description of Artificial Sequence: Synthetic oligonucleotide
cgcggctactacaatcagagcgaggac

SEQ ID NO: 365494 - DNA, 27 bp, Artificial Sequence
  Description of Artificial Sequence: Synthetic oligonucleotide
gcggctactacaatcagagcgaggacg

SEQ ID NO: 365495 - DNA, 27 bp, Artificial Sequence
  Description of Artificial Sequence: Synthetic oligonucleotide
cggctactacaatcagagcgaggacgg

SEQ ID NO: 365496 - DNA, 29 bp, Artificial Sequence
  Description of Artificial Sequence: Synthetic oligonucleotide
ggctactacaatcagagcgaggacggttc

SEQ ID NO: 365497 - DNA, 30 bp, Artificial Sequence; identical to SEQ ID NO: 12538
  Description of Artificial Sequence: Synthetic oligonucleotide

SEQ ID NO: 365498 - DNA, 31 bp, Artificial Sequence; identical to SEQ ID NO: 12539
  Description of Artificial Sequence: Synthetic oligonucleotide

SEQ ID NO: 365499 - DNA, 32 bp, Artificial Sequence; identical to SEQ ID NO: 12540
  Description of Artificial Sequence: Synthetic oligonucleotide

SEQ ID NO: 365500 - DNA, 31 bp, Artificial Sequence; identical to SEQ ID NO: 12541
  Description of Artificial Sequence: Synthetic oligonucleotide

SEQ ID NO: 365501 - DNA, 30 bp, Artificial Sequence; identical to SEQ ID NO: 12542
  Description of Artificial Sequence: Synthetic oligonucleotide

SEQ ID NO: 365502 - DNA, 30 bp, Artificial Sequence; identical to SEQ ID NO: 12543
  Description of Artificial Sequence: Synthetic oligonucleotide

SEQ ID NO: 365503 - DNA, 29 bp, Artificial Sequence
  Description of Artificial Sequence: Synthetic oligonucleotide
acaatcagagcgaggacggttctcacacc

SEQ ID NO: 365504 - DNA, 28 bp, Artificial Sequence
  Description of Artificial Sequence: Synthetic oligonucleotide
caatcagagcgaggacggttctcacacc

SEQ ID NO: 365505 - DNA, 30 bp, Artificial Sequence; identical to SEQ ID NO: 12546
  Description of Artificial Sequence: Synthetic oligonucleotide

SEQ ID NO: 365506 - DNA, 29 bp, Artificial Sequence
  Description of Artificial Sequence: Synthetic oligonucleotide
atcagagcgaggacggttctcacaccatc

SEQ ID NO: 365507 - DNA, 28 bp, Artificial Sequence
  Description of Artificial Sequence: Synthetic oligonucleotide
tcagagcgaggacggttctcacaccatc

SEQ ID NO: 365508 - DNA, 35 bp, Artificial Sequence; identical to SEQ ID NO: 12549
  Description of Artificial Sequence: Synthetic oligonucleotide

SEQ ID NO: 365509 - DNA, 34 bp, Artificial Sequence; identical to SEQ ID NO: 12550
  Description of Artificial Sequence: Synthetic oligonucleotide

SEQ ID NO: 365510 - DNA, 33 bp, Artificial Sequence; identical to SEQ ID NO: 12551
  Description of Artificial Sequence: Synthetic oligonucleotide

SEQ ID NO: 365511 - DNA, 34 bp, Artificial Sequence; identical to SEQ ID NO: 12552
  Description of Artificial Sequence: Synthetic oligonucleotide

SEQ ID NO: 365512 - DNA, 33 bp, Artificial Sequence; identical to SEQ ID NO: 12553
  Description of Artificial Sequence: Synthetic oligonucleotide

SEQ ID NO: 365513 - DNA, 33 bp, Artificial Sequence; identical to SEQ ID NO: 12554
  Description of Artificial Sequence: Synthetic oligonucleotide

SEQ ID NO: 365514 - DNA, 32 bp, Artificial Sequence; identical to SEQ ID NO: 12555
  Description of Artificial Sequence: Synthetic oligonucleotide

SEQ ID NO: 365515 - DNA, 32 bp, Artificial Sequence; identical to SEQ ID NO: 12556
  Description of Artificial Sequence: Synthetic oligonucleotide

SEQ ID NO: 365516 - DNA, 31 bp, Artificial Sequence; identical to SEQ ID NO: 12557
  Description of Artificial Sequence: Synthetic oligonucleotide

SEQ ID NO: 365517 - DNA, 31 bp, Artificial Sequence; identical to SEQ ID NO: 12558
  Description of Artificial Sequence: Synthetic oligonucleotide

SEQ ID NO: 365518 - DNA, 31 bp, Artificial Sequence; identical to SEQ ID NO: 12559
  Description of Artificial Sequence: Synthetic oligonucleotide

SEQ ID NO: 365519 - DNA, 30 bp, Artificial Sequence; identical to SEQ ID NO: 12560
  Description of Artificial Sequence: Synthetic oligonucleotide

SEQ ID NO: 365520 - DNA, 29 bp, Artificial Sequence
  Description of Artificial Sequence: Synthetic oligonucleotide
ccagataatgtatggctgcgatgtggggc

SEQ ID NO: 365521 - DNA, 29 bp, Artificial Sequence
  Description of Artificial Sequence: Synthetic oligonucleotide
cagataatgtatggctgcgatgtggggcc

SEQ ID NO: 365522 - DNA, 29 bp, Artificial Sequence
  Description of Artificial Sequence: Synthetic oligonucleotide
agataatgtatggctgcgatgtggggccg

SEQ ID NO: 365523 - DNA, 28 bp, Artificial Sequence
  Description of Artificial Sequence: Synthetic oligonucleotide
gataatgtatggctgcgatgtggggccg

SEQ ID NO: 365524 - DNA, 28 bp, Artificial Sequence
  Description of Artificial Sequence: Synthetic oligonucleotide
ataatgtatggctgcgatgtggggccgg

SEQ ID NO: 365525 - DNA, 27 bp, Artificial Sequence
  Description of Artificial Sequence: Synthetic oligonucleotide
taatgtatggctgcgatgtggggccgg

SEQ ID NO: 365526 - DNA, 27 bp, Artificial Sequence
  Description of Artificial Sequence: Synthetic oligonucleotide
aatgtatggctgcgatgtggggccgga

SEQ ID NO: 365527 - DNA, 26 bp, Artificial Sequence
  Description of Artificial Sequence: Synthetic oligonucleotide
atgtatggctgcgatgtggggccgga

SEQ ID NO: 365528 - DNA, 25 bp, Artificial Sequence
  Description of Artificial Sequence: Synthetic oligonucleotide
tgtatggctgcgatgtggggccgga

SEQ ID NO: 365529 - DNA, 24 bp, Artificial Sequence
  Description of Artificial Sequence: Synthetic oligonucleotide
gtatggctgcgatgtggggccgga

SEQ ID NO: 365530 - DNA, 24 bp, Artificial Sequence
  Description of Artificial Sequence: Synthetic oligonucleotide
tatggctgcgatgtggggccggac

SEQ ID NO: 365531 - DNA, 23 bp, Artificial Sequence
  Description of Artificial Sequence: Synthetic oligonucleotide
atggctgcgatgtggggccggac

SEQ ID NO: 365532 - DNA, 22 bp, Artificial Sequence
  Description of Artificial Sequence: Synthetic oligonucleotide
tggctgcgatgtggggccggac

SEQ ID NO: 365533 - DNA, 21 bp, Artificial Sequence
  Description of Artificial Sequence: Synthetic oligonucleotide
ggctgcgatgtggggccggac

SEQ ID NO: 365534 - DNA, 21 bp, Artificial Sequence
  Description of Artificial Sequence: Synthetic oligonucleotide
gctgcgatgtggggccggacg

SEQ ID NO: 365535 - DNA, 21 bp, Artificial Sequence
  Description of Artificial Sequence: Synthetic oligonucleotide
ctgcgatgtggggccggacgg

SEQ ID NO: 365536 - DNA, 21 bp, Artificial Sequence
  Description of Artificial Sequence: Synthetic oligonucleotide
tgcgatgtggggccggacggg

SEQ ID NO: 365537 - DNA, 20 bp, Artificial Sequence
  Description of Artificial Sequence: Synthetic oligonucleotide
gcgatgtggggccggacggg

SEQ ID NO: 365538 - DNA, 20 bp, Artificial Sequence
  Description of Artificial Sequence: Synthetic oligonucleotide
cgatgtggggccggacgggc

SEQ ID NO: 365539 - DNA, 20 bp, Artificial Sequence
  Description of Artificial Sequence: Synthetic oligonucleotide
gatgtggggccggacgggcg

SEQ ID NO: 365540 - DNA, 22 bp, Artificial Sequence
  Description of Artificial Sequence: Synthetic oligonucleotide
atgtggggccggacgggcgctt

SEQ ID NO: 365541 - DNA, 21 bp, Artificial Sequence
  Description of Artificial Sequence: Synthetic oligonucleotide
tgtggggccggacgggcgctt

SEQ ID NO: 365542 - DNA, 24 bp, Artificial Sequence
  Description of Artificial Sequence: Synthetic oligonucleotide
agagagcctacctggagggccgct

SEQ ID NO: 365543 - DNA, 23 bp, Artificial Sequence
  Description of Artificial Sequence: Synthetic oligonucleotide
gagagcctacctggagggccgct

SEQ ID NO: 365544 - DNA, 23 bp, Artificial Sequence
  Description of Artificial Sequence: Synthetic oligonucleotide
agagcctacctggagggccgctg

SEQ ID NO: 365545 - DNA, 22 bp, Artificial Sequence
  Description of Artificial Sequence: Synthetic oligonucleotide
gagcctacctggagggccgctg

SEQ ID NO: 365546 - DNA, 22 bp, Artificial Sequence
  Description of Artificial Sequence: Synthetic oligonucleotide
agcctacctggagggccgctgc

SEQ ID NO: 365547 - DNA, 21 bp, Artificial Sequence
  Description of Artificial Sequence: Synthetic oligonucleotide
gcctacctggagggccgctgc

SEQ ID NO: 365548 - DNA, 22 bp, Artificial Sequence
  Description of Artificial Sequence: Synthetic oligonucleotide
cctacctggagggccgctgcgt

SEQ ID NO: 365549 - DNA, 22 bp, Artificial Sequence
  Description of Artificial Sequence: Synthetic oligonucleotide
ctacctggagggccgctgcgtg

SEQ ID NO: 365550 - DNA, 23 bp, Artificial Sequence
  Description of Artificial Sequence: Synthetic oligonucleotide
tacctggagggccgctgcgtgga

SEQ ID NO: 365551 - DNA, 22 bp, Artificial Sequence
  Description of Artificial Sequence: Synthetic oligonucleotide
acctggagggccgctgcgtgga

SEQ ID NO: 365552 - DNA, 21 bp, Artificial Sequence
  Description of Artificial Sequence: Synthetic oligonucleotide
cctggagggccgctgcgtgga

SEQ ID NO: 365553 - DNA, 22 bp, Artificial Sequence
  Description of Artificial Sequence: Synthetic oligonucleotide
ctggagggccgctgcgtggagt

SEQ ID NO: 365554 - DNA, 22 bp, Artificial Sequence
  Description of Artificial Sequence: Synthetic oligonucleotide
tggagggccgctgcgtggagtg

SEQ ID NO: 365555 - DNA, 21 bp, Artificial Sequence
  Description of Artificial Sequence: Synthetic oligonucleotide
ggagggccgctgcgtggagtg

SEQ ID NO: 365556 - DNA, 21 bp, Artificial Sequence
  Description of Artificial Sequence: Synthetic oligonucleotide
gagggccgctgcgtggagtgg

SEQ ID NO: 365557 - DNA, 22 bp, Artificial Sequence
  Description of Artificial Sequence: Synthetic oligonucleotide
agggccgctgcgtggagtggct

SEQ ID NO: 365558 - DNA, 21 bp, Artificial Sequence
  Description of Artificial Sequence: Synthetic oligonucleotide
gggccgctgcgtggagtggct

SEQ ID NO: 365559 - DNA, 21 bp, Artificial Sequence
  Description of Artificial Sequence: Synthetic oligonucleotide
ggccgctgcgtggagtggctc

SEQ ID NO: 365560 - DNA, 21 bp, Artificial Sequence
  Description of Artificial Sequence: Synthetic oligonucleotide
gccgctgcgtggagtggctcc

SEQ ID NO: 365561 - DNA, 21 bp, Artificial Sequence
  Description of Artificial Sequence: Synthetic oligonucleotide
ccgctgcgtggagtggctccg

SEQ ID NO: 365562 - DNA, 22 bp, Artificial Sequence
  Description of Artificial Sequence: Synthetic oligonucleotide
cgctgcgtggagtggctccgca

SEQ ID NO: 365563 - DNA, 25 bp, Artificial Sequence
  Description of Artificial Sequence: Synthetic oligonucleotide
gctgcgtggagtggctccgcagata

SEQ ID NO: 365564 - DNA, 25 bp, Artificial Sequence
  Description of Artificial Sequence: Synthetic oligonucleotide
ctgcgtggagtggctccgcagatac

SEQ ID NO: 365565 - DNA, 27 bp, Artificial Sequence
  Description of Artificial Sequence: Synthetic oligonucleotide
cgtgggctacgtggacgacacgcaatt

SEQ ID NO: 365566 - DNA, 27 bp, Artificial Sequence
  Description of Artificial Sequence: Synthetic oligonucleotide
gtgggctacgtggacgacacgcaattc

SEQ ID NO: 365567 - DNA, 27 bp, Artificial Sequence
  Description of Artificial Sequence: Synthetic oligonucleotide
tgggctacgtggacgacacgcaattcg

SEQ ID NO: 365568 - DNA, 27 bp, Artificial Sequence
  Description of Artificial Sequence: Synthetic oligonucleotide
gggctacgtggacgacacgcaattcgt

SEQ ID NO: 365569 - DNA, 27 bp, Artificial Sequence
  Description of Artificial Sequence: Synthetic oligonucleotide
ggctacgtggacgacacgcaattcgtg

SEQ ID NO: 365570 - DNA, 27 bp, Artificial Sequence
  Description of Artificial Sequence: Synthetic oligonucleotide
gctacgtggacgacacgcaattcgtgc

SEQ ID NO: 365571 - DNA, 27 bp, Artificial Sequence
  Description of Artificial Sequence: Synthetic oligonucleotide
ctacgtggacgacacgcaattcgtgcg

SEQ ID NO: 365572 - DNA, 27 bp, Artificial Sequence
  Description of Artificial Sequence: Synthetic oligonucleotide
tacgtggacgacacgcaattcgtgcgg

SEQ ID NO: 365573 - DNA, 27 bp, Artificial Sequence
  Description of Artificial Sequence: Synthetic oligonucleotide
acgtggacgacacgcaattcgtgcggt

SEQ ID NO: 365574 - DNA, 27 bp, Artificial Sequence
  Description of Artificial Sequence: Synthetic oligonucleotide
cgtggacgacacgcaattcgtgcggtt

SEQ ID NO: 365575 - DNA, 27 bp, Artificial Sequence
  Description of Artificial Sequence: Synthetic oligonucleotide
gtggacgacacgcaattcgtgcggttc

SEQ ID NO: 365576 - DNA, 27 bp, Artificial Sequence
  Description of Artificial Sequence: Synthetic oligonucleotide
tggacgacacgcaattcgtgcggttcg

SEQ ID NO: 365577 - DNA, 27 bp, Artificial Sequence
  Description of Artificial Sequence: Synthetic oligonucleotide
ggacgacacgcaattcgtgcggttcga

SEQ ID NO: 365578 - DNA, 27 bp, Artificial Sequence
  Description of Artificial Sequence: Synthetic oligonucleotide
gacgacacgcaattcgtgcggttcgac

SEQ ID NO: 365579 - DNA, 28 bp, Artificial Sequence
  Description of Artificial Sequence: Synthetic oligonucleotide
acgacacgcaattcgtgcggttcgacag

SEQ ID NO: 365580 - DNA, 27 bp, Artificial Sequence
  Description of Artificial Sequence: Synthetic oligonucleotide
cgacacgcaattcgtgcggttcgacag

SEQ ID NO: 365581 - DNA, 27 bp, Artificial Sequence
  Description of Artificial Sequence: Synthetic oligonucleotide
gacacgcaattcgtgcggttcgacagc

SEQ ID NO: 365582 - DNA, 27 bp, Artificial Sequence
  Description of Artificial Sequence: Synthetic oligonucleotide
acacgcaattcgtgcggttcgacagcg

SEQ ID NO: 365583 - DNA, 27 bp, Artificial Sequence
  Description of Artificial Sequence: Synthetic oligonucleotide
cacgcaattcgtgcggttcgacagcga

SEQ ID NO: 365584 - DNA, 27 bp, Artificial Sequence
  Description of Artificial Sequence: Synthetic oligonucleotide
acgcaattcgtgcggttcgacagcgac

SEQ ID NO: 365585 - DNA, 26 bp, Artificial Sequence
  Description of Artificial Sequence: Synthetic oligonucleotide
cgcaattcgtgcggttcgacagcgac

SEQ ID NO: 365586 - DNA, 26 bp, Artificial Sequence
  Description of Artificial Sequence: Synthetic oligonucleotide
gcaattcgtgcggttcgacagcgacg

SEQ ID NO: 365587 - DNA, 26 bp, Artificial Sequence
  Description of Artificial Sequence: Synthetic oligonucleotide
caattcgtgcggttcgacagcgacgc

SEQ ID NO: 365588 - DNA, 26 bp, Artificial Sequence
  Description of Artificial Sequence: Synthetic oligonucleotide
aattcgtgcggttcgacagcgacgcc

SEQ ID NO: 365589 - DNA, 25 bp, Artificial Sequence
  Description of Artificial Sequence: Synthetic oligonucleotide
attcgtgcggttcgacagcgacgcc

SEQ ID NO: 365590 - DNA, 23 bp, Artificial Sequence
  Description of Artificial Sequence: Synthetic oligonucleotide
ccgcgagccagaggatggagcct

SEQ ID NO: 365591 - DNA, 23 bp, Artificial Sequence
  Description of Artificial Sequence: Synthetic oligonucleotide
cgcgagccagaggatggagcctc

SEQ ID NO: 365592 - DNA, 23 bp, Artificial Sequence
  Description of Artificial Sequence: Synthetic oligonucleotide
gcgagccagaggatggagcctcg

SEQ ID NO: 365593 - DNA, 23 bp, Artificial Sequence
  Description of Artificial Sequence: Synthetic oligonucleotide
cgagccagaggatggagcctcgg

SEQ ID NO: 365594 - DNA, 23 bp, Artificial Sequence
  Description of Artificial Sequence: Synthetic oligonucleotide
gagccagaggatggagcctcggg

SEQ ID NO: 365595 - DNA, 23 bp, Artificial Sequence
  Description of Artificial Sequence: Synthetic oligonucleotide
agccagaggatggagcctcgggc

SEQ ID NO: 365596 - DNA, 22 bp, Artificial Sequence
  Description of Artificial Sequence: Synthetic oligonucleotide
gccagaggatggagcctcgggc

SEQ ID NO: 365597 - DNA, 22 bp, Artificial Sequence
  Description of Artificial Sequence: Synthetic oligonucleotide
ccagaggatggagcctcgggcg

SEQ ID NO: 365598 - DNA, 22 bp, Artificial Sequence
  Description of Artificial Sequence: Synthetic oligonucleotide
cagaggatggagcctcgggcgc

SEQ ID NO: 365599 - DNA, 22 bp, Artificial Sequence
  Description of Artificial Sequence: Synthetic oligonucleotide
agaggatggagcctcgggcgcc

SEQ ID NO: 365600 - DNA, 21 bp, Artificial Sequence
  Description of Artificial Sequence: Synthetic oligonucleotide
gaggatggagcctcgggcgcc

SEQ ID NO: 365601 - DNA, 22 bp, Artificial Sequence
  Description of Artificial Sequence: Synthetic oligonucleotide
aggatggagcctcgggcgccgt

SEQ ID NO: 365602 - DNA, 21 bp, Artificial Sequence
  Description of Artificial Sequence: Synthetic oligonucleotide
ggatggagcctcgggcgccgt

SEQ ID NO: 365603 - DNA, 21 bp, Artificial Sequence
  Description of Artificial Sequence: Synthetic oligonucleotide
gatggagcctcgggcgccgtg

SEQ ID NO: 365604 - DNA, 24 bp, Artificial Sequence
  Description of Artificial Sequence: Synthetic oligonucleotide
atggagcctcgggcgccgtggata

SEQ ID NO: 365605 - DNA, 23 bp, Artificial Sequence
  Description of Artificial Sequence: Synthetic oligonucleotide
tggagcctcgggcgccgtggata

SEQ ID NO: 365606 - DNA, 22 bp, Artificial Sequence
  Description of Artificial Sequence: Synthetic oligonucleotide
ggagcctcgggcgccgtggata

SEQ ID NO: 365607 - DNA, 23 bp, Artificial Sequence
  Description of Artificial Sequence: Synthetic oligonucleotide
gagcctcgggcgccgtggataga

SEQ ID NO: 365608 - DNA, 23 bp, Artificial Sequence
  Description of Artificial Sequence: Synthetic oligonucleotide
agcctcgggcgccgtggatagag

SEQ ID NO: 365609 - DNA, 22 bp, Artificial Sequence
  Description of Artificial Sequence: Synthetic oligonucleotide
gcctcgggcgccgtggatagag

SEQ ID NO: 365610 - DNA, 23 bp, Artificial Sequence
  Description of Artificial Sequence: Synthetic oligonucleotide
cctcgggcgccgtggatagagca

SEQ ID NO: 365611 - DNA, 23 bp, Artificial Sequence
  Description of Artificial Sequence: Synthetic oligonucleotide
ctcgggcgccgtggatagagcag

SEQ ID NO: 365612 - DNA, 24 bp, Artificial Sequence
  Description of Artificial Sequence: Synthetic oligonucleotide
tcgggcgccgtggatagagcagga

SEQ ID NO: 365613 - DNA, 23 bp, Artificial Sequence
  Description of Artificial Sequence: Synthetic oligonucleotide
agccgcgggcgccgtggatagaa

SEQ ID NO: 365614 - DNA, 22 bp, Artificial Sequence
  Description of Artificial Sequence: Synthetic oligonucleotide
gccgcgggcgccgtggatagaa

SEQ ID NO: 365615 - DNA, 23 bp, Artificial Sequence
  Description of Artificial Sequence: Synthetic oligonucleotide
ccgcgggcgccgtggatagaaca

SEQ ID NO: 365616 - DNA, 23 bp, Artificial Sequence
  Description of Artificial Sequence: Synthetic oligonucleotide
cgcgggcgccgtggatagaacag

SEQ ID NO: 365617 - DNA, 24 bp, Artificial Sequence
  Description of Artificial Sequence: Synthetic oligonucleotide
gcgggcgccgtggatagaacagga

SEQ ID NO: 365618 - DNA, 24 bp, Artificial Sequence
  Description of Artificial Sequence: Synthetic oligonucleotide
cgggcgccgtggatagaacaggag

SEQ ID NO: 365619 - DNA, 24 bp, Artificial Sequence
  Description of Artificial Sequence: Synthetic oligonucleotide
gggcgccgtggatagaacaggagg

SEQ ID NO: 365620 - DNA, 24 bp, Artificial Sequence
  Description of Artificial Sequence: Synthetic oligonucleotide
ggcgccgtggatagaacaggaggg

SEQ ID NO: 365621 - DNA, 24 bp, Artificial Sequence
  Description of Artificial Sequence: Synthetic oligonucleotide
gcgccgtggatagaacaggagggg

SEQ ID NO: 365622 - DNA, 24 bp, Artificial Sequence
  Description of Artificial Sequence: Synthetic oligonucleotide
cgccgtggatagaacaggaggggc

SEQ ID NO: 365623 - DNA, 24 bp, Artificial Sequence
  Description of Artificial Sequence: Synthetic oligonucleotide
gccgtggatagaacaggaggggcc

SEQ ID NO: 365624 - DNA, 24 bp, Artificial Sequence
  Description of Artificial Sequence: Synthetic oligonucleotide
ccgtggatagaacaggaggggccg

SEQ ID NO: 365625 - DNA, 25 bp, Artificial Sequence
  Description of Artificial Sequence: Synthetic oligonucleotide
cgtggatagaacaggaggggccgga

SEQ ID NO: 365626 - DNA, 27 bp, Artificial Sequence
  Description of Artificial Sequence: Synthetic oligonucleotide
gtggatagaacaggaggggccggagta

SEQ ID NO: 365627 - DNA, 29 bp, Artificial Sequence
  Description of Artificial Sequence: Synthetic oligonucleotide
tggatagaacaggaggggccggagtattg

SEQ ID NO: 365628 - DNA, 28 bp, Artificial Sequence
  Description of Artificial Sequence: Synthetic oligonucleotide
ggatagaacaggaggggccggagtattg

SEQ ID NO: 365629 - DNA, 28 bp, Artificial Sequence
  Description of Artificial Sequence: Synthetic oligonucleotide
gatagaacaggaggggccggagtattgg

SEQ ID NO: 365630 - DNA, 28 bp, Artificial Sequence
  Description of Artificial Sequence: Synthetic oligonucleotide
atagaacaggaggggccggagtattggg

SEQ ID NO: 365631 - DNA, 27 bp, Artificial Sequence
  Description of Artificial Sequence: Synthetic oligonucleotide
tagaacaggaggggccggagtattggg

SEQ ID NO: 365632 - DNA, 27 bp, Artificial Sequence
  Description of Artificial Sequence: Synthetic oligonucleotide
agaacaggaggggccggagtattggga

SEQ ID NO: 365633 - DNA, 26 bp, Artificial Sequence
  Description of Artificial Sequence: Synthetic oligonucleotide
gaacaggaggggccggagtattggga

SEQ ID NO: 365634 - DNA, 26 bp, Artificial Sequence
  Description of Artificial Sequence: Synthetic oligonucleotide
aacaggaggggccggagtattgggac

SEQ ID NO: 365635 - DNA, 25 bp, Artificial Sequence
  Description of Artificial Sequence: Synthetic oligonucleotide
acaggaggggccggagtattgggac

SEQ ID NO: 365636 - DNA, 26 bp, Artificial Sequence
  Description of Artificial Sequence: Synthetic oligonucleotide
tggatagagcaggaggggccggagta

SEQ ID NO: 365637 - DNA, 25 bp, Artificial Sequence
  Description of Artificial Sequence: Synthetic oligonucleotide
ggatagagcaggaggggccggagta

SEQ ID NO: 365638 - DNA, 26 bp, Artificial Sequence
  Description of Artificial Sequence: Synthetic oligonucleotide
gatagagcaggaggggccggagtact

SEQ ID NO: 365639 - DNA, 26 bp, Artificial Sequence
  Description of Artificial Sequence: Synthetic oligonucleotide
atagagcaggaggggccggagtactg

SEQ ID NO: 365640 - DNA, 25 bp, Artificial Sequence
  Description of Artificial Sequence: Synthetic oligonucleotide
tagagcaggaggggccggagtactg

SEQ ID NO: 365641 - DNA, 24 bp, Artificial Sequence
  Description of Artificial Sequence: Synthetic oligonucleotide
agagcaggaggggccggagtactg

SEQ ID NO: 365642 - DNA, 23 bp, Artificial Sequence
  Description of Artificial Sequence: Synthetic oligonucleotide
gagcaggaggggccggagtactg

SEQ ID NO: 365643 - DNA, 23 bp, Artificial Sequence
  Description of Artificial Sequence: Synthetic oligonucleotide
agcaggaggggccggagtactgg

SEQ ID NO: 365644 - DNA, 22 bp, Artificial Sequence
  Description of Artificial Sequence: Synthetic oligonucleotide
gcaggaggggccggagtactgg

SEQ ID NO: 365645 - DNA, 23 bp, Artificial Sequence
  Description of Artificial Sequence: Synthetic oligonucleotide
caggaggggccggagtactggga

SEQ ID NO: 365646 - DNA, 23 bp, Artificial Sequence
  Description of Artificial Sequence: Synthetic oligonucleotide
aggaggggccggagtactgggac

SEQ ID NO: 365647 - DNA, 22 bp, Artificial Sequence
  Description of Artificial Sequence: Synthetic oligonucleotide
ggaggggccggagtactgggac

SEQ ID NO: 365648 - DNA, 23 bp, Artificial Sequence
  Description of Artificial Sequence: Synthetic oligonucleotide
gaggggccggagtactgggacca

SEQ ID NO: 365649 - DNA, 23 bp, Artificial Sequence
  Description of Artificial Sequence: Synthetic oligonucleotide
aggggccggagtactgggaccag

SEQ ID NO: 365650 - DNA, 22 bp, Artificial Sequence
  Description of Artificial Sequence: Synthetic oligonucleotide
ggggccggagtactgggaccag

SEQ ID NO: 365651 - DNA, 23 bp, Artificial Sequence
  Description of Artificial Sequence: Synthetic oligonucleotide
gggccggagtactgggaccagga

SEQ ID NO: 365652 - DNA, 24 bp, Artificial Sequence
  Description of Artificial Sequence: Synthetic oligonucleotide
ggccggagtactgggaccaggaga

SEQ ID NO: 365653 - DNA, 25 bp, Artificial Sequence
  Description of Artificial Sequence: Synthetic oligonucleotide
gccggagtactgggaccaggagaca

SEQ ID NO: 365654 - DNA, 25 bp, Artificial Sequence
  Description of Artificial Sequence: Synthetic oligonucleotide
ccggagtactgggaccaggagacac

SEQ ID NO: 365655 - DNA, 25 bp, Artificial Sequence
  Description of Artificial Sequence: Synthetic oligonucleotide
cggagtactgggaccaggagacacg

SEQ ID NO: 365656 - DNA, 27 bp, Artificial Sequence
  Description of Artificial Sequence: Synthetic oligonucleotide
ggagtactgggaccaggagacacggaa

SEQ ID NO: 365657 - DNA, 28 bp, Artificial Sequence
  Description of Artificial Sequence: Synthetic oligonucleotide
gagtactgggaccaggagacacggaatg

SEQ ID NO: 365658 - DNA, 29 bp, Artificial Sequence
  Description of Artificial Sequence: Synthetic oligonucleotide
agtactgggaccaggagacacggaatgtg

SEQ ID NO: 365659 - DNA, 28 bp, Artificial Sequence
  Description of Artificial Sequence: Synthetic oligonucleotide
gtactgggaccaggagacacggaatgtg

SEQ ID NO: 365660 - DNA, 30 bp, Artificial Sequence
  Description of Artificial Sequence: Synthetic oligonucleotide
tactgggaccaggagacacggaatgtgaag

SEQ ID NO: 365661 - DNA, 29 bp, Artificial Sequence
  Description of Artificial Sequence: Synthetic oligonucleotide
actgggaccaggagacacggaatgtgaag

SEQ ID NO: 365662 - DNA, 28 bp, Artificial Sequence
  Description of Artificial Sequence: Synthetic oligonucleotide
ctgggaccaggagacacggaatgtgaag

SEQ ID NO: 365663 - DNA, 30 bp, Artificial Sequence
  Description of Artificial Sequence: Synthetic oligonucleotide
cggaatattgggaccaggagacacggaatg

SEQ ID NO: 365664 - DNA, 31 bp, Artificial Sequence
  Description of Artificial Sequence: Synthetic oligonucleotide
ggaatattgggaccaggagacacggaatgtg

SEQ ID NO: 365665 - DNA, 33 bp, Artificial Sequence
  Description of Artificial Sequence: Synthetic oligonucleotide
gaatattgggaccaggagacacggaatgtgaag

SEQ ID NO: 365666 - DNA, 33 bp, Artificial Sequence
  Description of Artificial Sequence: Synthetic oligonucleotide
aatattgggaccaggagacacggaatgtgaagg

SEQ ID NO: 365667 - DNA, 32 bp, Artificial Sequence
  Description of Artificial Sequence: Synthetic oligonucleotide
atattgggaccaggagacacggaatgtgaagg

SEQ ID NO: 365668 - DNA, 28 bp, Artificial Sequence
  Description of Artificial Sequence: Synthetic oligonucleotide
ctactacaaccagagcgaggacggttcc

SEQ ID NO: 365669 - DNA, 28 bp, Artificial Sequence
  Description of Artificial Sequence: Synthetic oligonucleotide
tactacaaccagagcgaggacggttccc

SEQ ID NO: 365670 - DNA, 27 bp, Artificial Sequence
  Description of Artificial Sequence: Synthetic oligonucleotide
actacaaccagagcgaggacggttccc

SEQ ID NO: 365671 - DNA, 27 bp, Artificial Sequence
  Description of Artificial Sequence: Synthetic oligonucleotide
ctacaaccagagcgaggacggttccca

SEQ ID NO: 365672 - DNA, 27 bp, Artificial Sequence
  Description of Artificial Sequence: Synthetic oligonucleotide
tacaaccagagcgaggacggttcccac

SEQ ID NO: 365673 - DNA, 27 bp, Artificial Sequence
  Description of Artificial Sequence: Synthetic oligonucleotide
acaaccagagcgaggacggttcccaca

SEQ ID NO: 365674 - DNA, 26 bp, Artificial Sequence
  Description of Artificial Sequence: Synthetic oligonucleotide
caaccagagcgaggacggttcccaca

SEQ ID NO: 365675 - DNA, 26 bp, Artificial Sequence
  Description of Artificial Sequence: Synthetic oligonucleotide
aaccagagcgaggacggttcccacac

SEQ ID NO: 365676 - DNA, 25 bp, Artificial Sequence
  Description of Artificial Sequence: Synthetic oligonucleotide
accagagcgaggacggttcccacac

SEQ ID NO: 365677 - DNA, 24 bp, Artificial Sequence
  Description of Artificial Sequence: Synthetic oligonucleotide
ccagagcgaggacggttcccacac

SEQ ID NO: 365678 - DNA, 26 bp, Artificial Sequence
  Description of Artificial Sequence: Synthetic oligonucleotide
cagagcgaggacggttcccacaccat

SEQ ID NO: 365679 - DNA, 26 bp, Artificial Sequence
  Description of Artificial Sequence: Synthetic oligonucleotide
agagcgaggacggttcccacaccatc

SEQ ID NO: 365680 - DNA, 25 bp, Artificial Sequence
  Description of Artificial Sequence: Synthetic oligonucleotide
gagcgaggacggttcccacaccatc

SEQ ID NO: 365681 - DNA, 26 bp, Artificial Sequence
  Description of Artificial Sequence: Synthetic oligonucleotide
agcgaggacggttcccacaccatcca

SEQ ID NO: 365682 - DNA, 25 bp, Artificial Sequence
  Description of Artificial Sequence: Synthetic oligonucleotide
gcgaggacggttcccacaccatcca

SEQ ID NO: 365683 - DNA, 27 bp, Artificial Sequence
  Description of Artificial Sequence: Synthetic oligonucleotide
cgaggacggttcccacaccatccagat

SEQ ID NO: 365684 - DNA, 30 bp, Artificial Sequence
  Description of Artificial Sequence: Synthetic oligonucleotide
gaggacggttcccacaccatccagataatg

SEQ ID NO: 365685 - DNA, 33 bp, Artificial Sequence
  Description of Artificial Sequence: Synthetic oligonucleotide
aggacggttcccacaccatccagataatgtatg

SEQ ID NO: 365686 - DNA, 32 bp, Artificial Sequence
  Description of Artificial Sequence: Synthetic oligonucleotide
ggacggttcccacaccatccagataatgtatg

SEQ ID NO: 365687 - DNA, 32 bp, Artificial Sequence
  Description of Artificial Sequence: Synthetic oligonucleotide
gacggttcccacaccatccagataatgtatgg

SEQ ID NO: 365688 - DNA, 32 bp, Artificial Sequence
  Description of Artificial Sequence: Synthetic oligonucleotide
acggttcccacaccatccagataatgtatggc

SEQ ID NO: 365689 - DNA, 31 bp, Artificial Sequence
  Description of Artificial Sequence: Synthetic oligonucleotide
cggttcccacaccatccagataatgtatggc

SEQ ID NO: 365690 - DNA, 32 bp, Artificial Sequence
  Description of Artificial Sequence: Synthetic oligonucleotide
ggttcccacaccatccagataatgtatggctg

SEQ ID NO: 365691 - DNA, 32 bp, Artificial Sequence
  Description of Artificial Sequence: Synthetic oligonucleotide
gttcccacaccatccagataatgtatggctgc

SEQ ID NO: 365692 - DNA, 32 bp, Artificial Sequence
  Description of Artificial Sequence: Synthetic oligonucleotide
ttcccacaccatccagataatgtatggctgcg

SEQ ID NO: 365693 - DNA, 31 bp, Artificial Sequence
  Description of Artificial Sequence: Synthetic oligonucleotide
tcccacaccatccagataatgtatggctgcg

SEQ ID NO: 365694 - DNA, 30 bp, Artificial Sequence
  Description of Artificial Sequence: Synthetic oligonucleotide
cccacaccatccagataatgtatggctgcg

SEQ ID NO: 365695 - DNA, 31 bp, Artificial Sequence
  Description of Artificial Sequence: Synthetic oligonucleotide
ccacaccatccagataatgtatggctgcgac

SEQ ID NO: 365696 - DNA, 27 bp, Artificial Sequence
  Description of Artificial Sequence: Synthetic oligonucleotide
acgcagttcgtgcggttcgacagcgat

SEQ ID NO: 365697 - DNA, 26 bp, Artificial Sequence
  Description of Artificial Sequence: Synthetic oligonucleotide
cgcagttcgtgcggttcgacagcgat

SEQ ID NO: 365698 - DNA, 26 bp, Artificial Sequence
  Description of Artificial Sequence: Synthetic oligonucleotide
gcagttcgtgcggttcgacagcgatg

SEQ ID NO: 365699 - DNA, 26 bp, Artificial Sequence
  Description of Artificial Sequence: Synthetic oligonucleotide
cagttcgtgcggttcgacagcgatgc

SEQ ID NO: 365700 - DNA, 26 bp, Artificial Sequence
  Description of Artificial Sequence: Synthetic oligonucleotide
agttcgtgcggttcgacagcgatgcc

SEQ ID NO: 365701 - DNA, 25 bp, Artificial Sequence
  Description of Artificial Sequence: Synthetic oligonucleotide
gttcgtgcggttcgacagcgatgcc

SEQ ID NO: 365702 - DNA, 25 bp, Artificial Sequence
  Description of Artificial Sequence: Synthetic oligonucleotide
ttcgtgcggttcgacagcgatgccg

SEQ ID NO: 365703 - DNA, 24 bp, Artificial Sequence
  Description of Artificial Sequence: Synthetic oligonucleotide
tcgtgcggttcgacagcgatgccg

SEQ ID NO: 365704 - DNA, 23 bp, Artificial Sequence
  Description of Artificial Sequence: Synthetic oligonucleotide
cgtgcggttcgacagcgatgccg

SEQ ID NO: 365705 - DNA, 23 bp, Artificial Sequence
  Description of Artificial Sequence: Synthetic oligonucleotide
gtgcggttcgacagcgatgccgc

SEQ ID NO: 365706 - DNA, 24 bp, Artificial Sequence
  Description of Artificial Sequence: Synthetic oligonucleotide
tgcggttcgacagcgatgccgcga

SEQ ID NO: 365707 - DNA, 23 bp, Artificial Sequence
  Description of Artificial Sequence: Synthetic oligonucleotide
gcggttcgacagcgatgccgcga

SEQ ID NO: 365708 - DNA, 23 bp, Artificial Sequence
  Description of Artificial Sequence: Synthetic oligonucleotide
cggttcgacagcgatgccgcgag

SEQ ID NO: 365709 - DNA, 23 bp, Artificial Sequence
  Description of Artificial Sequence: Synthetic oligonucleotide
ggttcgacagcgatgccgcgagc

SEQ ID NO: 365710 - DNA, 24 bp, Artificial Sequence
  Description of Artificial Sequence: Synthetic oligonucleotide
gttcgacagcgatgccgcgagcca

SEQ ID NO: 365711 - DNA, 25 bp, Artificial Sequence
  Description of Artificial Sequence: Synthetic oligonucleotide
ttcgacagcgatgccgcgagccaga

SEQ ID NO: 365712 - DNA, 24 bp, Artificial Sequence
  Description of Artificial Sequence: Synthetic oligonucleotide
tcgacagcgatgccgcgagccaga

SEQ ID NO: 365713 - DNA, 23 bp, Artificial Sequence
  Description of Artificial Sequence: Synthetic oligonucleotide
cgacagcgatgccgcgagccaga

SEQ ID NO: 365714 - DNA, 23 bp, Artificial Sequence
  Description of Artificial Sequence: Synthetic oligonucleotide
gacagcgatgccgcgagccagag

SEQ ID NO: 365715 - DNA, 25 bp, Artificial Sequence
  Description of Artificial Sequence: Synthetic oligonucleotide
acagcgatgccgcgagccagaggat

SEQ ID NO: 365716 - DNA, 24 bp, Artificial Sequence
  Description of Artificial Sequence: Synthetic oligonucleotide
cagcgatgccgcgagccagaggat

SEQ ID NO: 365717 - DNA, 24 bp, Artificial Sequence
  Description of Artificial Sequence: Synthetic oligonucleotide
agcgatgccgcgagccagaggatg

SEQ ID NO: 365718 - DNA, 23 bp, Artificial Sequence
  Description of Artificial Sequence: Synthetic oligonucleotide
gcgatgccgcgagccagaggatg

SEQ ID NO: 365719 - DNA, 24 bp, Artificial Sequence
  Description of Artificial Sequence: Synthetic oligonucleotide
cgatgccgcgagccagaggatgga

SEQ ID NO: 365720 - DNA, 24 bp, Artificial Sequence
  Description of Artificial Sequence: Synthetic oligonucleotide
gatgccgcgagccagaggatggag

SEQ ID NO: 365721 - DNA, 24 bp, Artificial Sequence
  Description of Artificial Sequence: Synthetic oligonucleotide
atgccgcgagccagaggatggagc

SEQ ID NO: 365722 - DNA, 23 bp, Artificial Sequence
  Description of Artificial Sequence: Synthetic oligonucleotide
tgccgcgagccagaggatggagc

SEQ ID NO: 365723 - DNA, 20 bp, Artificial Sequence
  Description of Artificial Sequence: Synthetic oligonucleotide
ccggcccggccgcgggaatt

SEQ ID NO: 365724 - DNA, 20 bp, Artificial Sequence
  Description of Artificial Sequence: Synthetic oligonucleotide
cggcccggccgcgggaagtt

SEQ ID NO: 365725 - DNA, 20 bp, Artificial Sequence
  Description of Artificial Sequence: Synthetic oligonucleotide
ggcccggccgcgggaagctt

SEQ ID NO: 365726 - DNA, 20 bp, Artificial Sequence
  Description of Artificial Sequence: Synthetic oligonucleotide
gcccggccgcgggaagcctt

SEQ ID NO: 365727 - DNA, 20 bp, Artificial Sequence
  Description of Artificial Sequence: Synthetic oligonucleotide
cccggccgcgggaagccctt

SEQ ID NO: 365728 - DNA, 20 bp, Artificial Sequence
  Description of Artificial Sequence: Synthetic oligonucleotide
ccggccgcgggaagcccctt

SEQ ID NO: 365729 - DNA, 20 bp, Artificial Sequence
  Description of Artificial Sequence: Synthetic oligonucleotide
cggccgcgggaagccccgtt

SEQ ID NO: 365730 - DNA, 20 bp, Artificial Sequence
  Description of Artificial Sequence: Synthetic oligonucleotide
ggccgcgggaagccccgctt

SEQ ID NO: 365731 - DNA, 22 bp, Artificial Sequence
  Description of Artificial Sequence: Synthetic oligonucleotide
gccgcgggaagccccgcttcat

SEQ ID NO: 365732 - DNA, 22 bp, Artificial Sequence
  Description of Artificial Sequence: Synthetic oligonucleotide
ccgcgggaagccccgcttcatc

SEQ ID NO: 365733 - DNA, 22 bp, Artificial Sequence
  Description of Artificial Sequence: Synthetic oligonucleotide
cgcgggaagccccgcttcatcg

SEQ ID NO: 365734 - DNA, 22 bp, Artificial Sequence
  Description of Artificial Sequence: Synthetic oligonucleotide
gcgggaagccccgcttcatcgc

SEQ ID NO: 365735 - DNA, 22 bp, Artificial Sequence
  Description of Artificial Sequence: Synthetic oligonucleotide
cgggaagccccgcttcatcgcc

SEQ ID NO: 365736 - DNA, 23 bp, Artificial Sequence
  Description of Artificial Sequence: Synthetic oligonucleotide
gggaagccccgcttcatcgccgt

SEQ ID NO: 365737 - DNA, 23 bp, Artificial Sequence
  Description of Artificial Sequence: Synthetic oligonucleotide
ggaagccccgcttcatcgccgtg

SEQ ID NO: 365738 - DNA, 23 bp, Artificial Sequence
  Description of Artificial Sequence: Synthetic oligonucleotide
gaagccccgcttcatcgccgtgg

SEQ ID NO: 365739 - DNA, 23 bp, Artificial Sequence
  Description of Artificial Sequence: Synthetic oligonucleotide
aagccccgcttcatcgccgtggg

SEQ ID NO: 365740 - DNA, 30 bp, Artificial Sequence; identical to SEQ ID NO: 12648
  Description of Artificial Sequence: Synthetic oligonucleotide

SEQ ID NO: 365741 - DNA, 31 bp, Artificial Sequence; identical to SEQ ID NO: 12649
  Description of Artificial Sequence: Synthetic oligonucleotide

SEQ ID NO: 365742 - DNA, 30 bp, Artificial Sequence; identical to SEQ ID NO: 12650
  Description of Artificial Sequence: Synthetic oligonucleotide

SEQ ID NO: 365743 - DNA, 29 bp, Artificial Sequence
  Description of Artificial Sequence: Synthetic oligonucleotide
tgtgaaggcccagtcacagactgacagag

SEQ ID NO: 365744 - DNA, 28 bp, Artificial Sequence
  Description of Artificial Sequence: Synthetic oligonucleotide
gtgaaggcccagtcacagactgacagag

SEQ ID NO: 365745 - DNA, 29 bp, Artificial Sequence
  Description of Artificial Sequence: Synthetic oligonucleotide
tgaaggcccagtcacagactgacagagtg

SEQ ID NO: 365746 - DNA, 28 bp, Artificial Sequence
  Description of Artificial Sequence: Synthetic oligonucleotide
gaaggcccagtcacagactgacagagtg

SEQ ID NO: 365747 - DNA, 28 bp, Artificial Sequence
  Description of Artificial Sequence: Synthetic oligonucleotide
aaggcccagtcacagactgacagagtgg

SEQ ID NO: 365748 - DNA, 27 bp, Artificial Sequence
  Description of Artificial Sequence: Synthetic oligonucleotide
aggcccagtcacagactgacagagtgg

SEQ ID NO: 365749 - DNA, 27 bp, Artificial Sequence
  Description of Artificial Sequence: Synthetic oligonucleotide
ggcccagtcacagactgacagagtgga

SEQ ID NO: 365750 - DNA, 27 bp, Artificial Sequence
  Description of Artificial Sequence: Synthetic oligonucleotide
gcccagtcacagactgacagagtggac

SEQ ID NO: 365751 - DNA, 27 bp, Artificial Sequence
  Description of Artificial Sequence: Synthetic oligonucleotide
cccagtcacagactgacagagtggacc

SEQ ID NO: 365752 - DNA, 28 bp, Artificial Sequence
  Description of Artificial Sequence: Synthetic oligonucleotide
ccagtcacagactgacagagtggacctg

SEQ ID NO: 365753 - DNA, 28 bp, Artificial Sequence
  Description of Artificial Sequence: Synthetic oligonucleotide
cagtcacagactgacagagtggacctgg

SEQ ID NO: 365754 - DNA, 28 bp, Artificial Sequence
  Description of Artificial Sequence: Synthetic oligonucleotide
agtcacagactgacagagtggacctggg

SEQ ID NO: 365755 - DNA, 27 bp, Artificial Sequence
  Description of Artificial Sequence: Synthetic oligonucleotide
gtcacagactgacagagtggacctggg

SEQ ID NO: 365756 - DNA, 27 bp, Artificial Sequence
  Description of Artificial Sequence: Synthetic oligonucleotide
tcacagactgacagagtggacctgggg

SEQ ID NO: 365757 - DNA, 27 bp, Artificial Sequence
  Description of Artificial Sequence: Synthetic oligonucleotide
cacagactgacagagtggacctgggga

SEQ ID NO: 365758 - DNA, 27 bp, Artificial Sequence
  Description of Artificial Sequence: Synthetic oligonucleotide
acagactgacagagtggacctggggac

SEQ ID NO: 365759 - DNA, 26 bp, Artificial Sequence
  Description of Artificial Sequence: Synthetic oligonucleotide
cagactgacagagtggacctggggac

SEQ ID NO: 365760 - DNA, 26 bp, Artificial Sequence
  Description of Artificial Sequence: Synthetic oligonucleotide
agactgacagagtggacctggggacc

SEQ ID NO: 365761 - DNA, 25 bp, Artificial Sequence
  Description of Artificial Sequence: Synthetic oligonucleotide
gactgacagagtggacctggggacc

SEQ ID NO: 365762 - DNA, 26 bp, Artificial Sequence
  Description of Artificial Sequence: Synthetic oligonucleotide
actgacagagtggacctggggaccct

SEQ ID NO: 365763 - DNA, 25 bp, Artificial Sequence
  Description of Artificial Sequence: Synthetic oligonucleotide
ctgacagagtggacctggggaccct

SEQ ID NO: 365764 - DNA, 25 bp, Artificial Sequence
  Description of Artificial Sequence: Synthetic oligonucleotide
tgacagagtggacctggggaccctg

SEQ ID NO: 365765 - DNA, 24 bp, Artificial Sequence
  Description of Artificial Sequence: Synthetic oligonucleotide
gacagagtggacctggggaccctg

SEQ ID NO: 365766 - DNA, 24 bp, Artificial Sequence
  Description of Artificial Sequence: Synthetic oligonucleotide
acagagtggacctggggaccctgc

SEQ ID NO: 365767 - DNA, 23 bp, Artificial Sequence
  Description of Artificial Sequence: Synthetic oligonucleotide
cagagtggacctggggaccctgc

SEQ ID NO: 365768 - DNA, 23 bp, Artificial Sequence
  Description of Artificial Sequence: Synthetic oligonucleotide
agagtggacctggggaccctgcg

SEQ ID NO: 365769 - DNA, 27 bp, Artificial Sequence
  Description of Artificial Sequence: Synthetic oligonucleotide
caccccatctctgaccatgaggccact

SEQ ID NO: 365770 - DNA, 27 bp, Artificial Sequence
  Description of Artificial Sequence: Synthetic oligonucleotide
accccatctctgaccatgaggccactc

SEQ ID NO: 365771 - DNA, 27 bp, Artificial Sequence
  Description of Artificial Sequence: Synthetic oligonucleotide
ccccatctctgaccatgaggccactct

SEQ ID NO: 365772 - DNA, 27 bp, Artificial Sequence
  Description of Artificial Sequence: Synthetic oligonucleotide
cccatctctgaccatgaggccactctg

SEQ ID NO: 365773 - DNA, 28 bp, Artificial Sequence
  Description of Artificial Sequence: Synthetic oligonucleotide
ccatctctgaccatgaggccactctgag

SEQ ID NO: 365774 - DNA, 28 bp, Artificial Sequence
  Description of Artificial Sequence: Synthetic oligonucleotide
catctctgaccatgaggccactctgagg

SEQ ID NO: 365775 - DNA, 29 bp, Artificial Sequence
  Description of Artificial Sequence: Synthetic oligonucleotide
atctctgaccatgaggccactctgaggtg

SEQ ID NO: 365776 - DNA, 28 bp, Artificial Sequence
  Description of Artificial Sequence: Synthetic oligonucleotide
tctctgaccatgaggccactctgaggtg

SEQ ID NO: 365777 - DNA, 27 bp, Artificial Sequence
  Description of Artificial Sequence: Synthetic oligonucleotide
ctctgaccatgaggccactctgaggtg

SEQ ID NO: 365778 - DNA, 27 bp, Artificial Sequence
  Description of Artificial Sequence: Synthetic oligonucleotide
tctgaccatgaggccactctgaggtgc

SEQ ID NO: 365779 - DNA, 27 bp, Artificial Sequence
  Description of Artificial Sequence: Synthetic oligonucleotide
ctgaccatgaggccactctgaggtgct

SEQ ID NO: 365780 - DNA, 27 bp, Artificial Sequence
  Description of Artificial Sequence: Synthetic oligonucleotide
tgaccatgaggccactctgaggtgctg

SEQ ID NO: 365781 - DNA, 26 bp, Artificial Sequence
  Description of Artificial Sequence: Synthetic oligonucleotide
gaccatgaggccactctgaggtgctg

SEQ ID NO: 365782 - DNA, 26 bp, Artificial Sequence
  Description of Artificial Sequence: Synthetic oligonucleotide
accatgaggccactctgaggtgctgg

SEQ ID NO: 365783 - DNA, 25 bp, Artificial Sequence
  Description of Artificial Sequence: Synthetic oligonucleotide
ccatgaggccactctgaggtgctgg

SEQ ID NO: 365784 - DNA, 25 bp, Artificial Sequence
  Description of Artificial Sequence: Synthetic oligonucleotide
catgaggccactctgaggtgctggg

SEQ ID NO: 365785 - DNA, 25 bp, Artificial Sequence
  Description of Artificial Sequence: Synthetic oligonucleotide
atgaggccactctgaggtgctgggc

SEQ ID NO: 365786 - DNA, 24 bp, Artificial Sequence
  Description of Artificial Sequence: Synthetic oligonucleotide
tgaggccactctgaggtgctgggc

SEQ ID NO: 365787 - DNA, 23 bp, Artificial Sequence
  Description of Artificial Sequence: Synthetic oligonucleotide
gaggccactctgaggtgctgggc

SEQ ID NO: 365788 - DNA, 23 bp, Artificial Sequence
  Description of Artificial Sequence: Synthetic oligonucleotide
aggccactctgaggtgctgggcc

SEQ ID NO: 365789 - DNA, 22 bp, Artificial Sequence
  Description of Artificial Sequence: Synthetic oligonucleotide
ggccactctgaggtgctgggcc

SEQ ID NO: 365790 - DNA, 23 bp, Artificial Sequence
  Description of Artificial Sequence: Synthetic oligonucleotide
ccactctgaggtgctgggccctg

SEQ ID NO: 365791 - DNA, 23 bp, Artificial Sequence
  Description of Artificial Sequence: Synthetic oligonucleotide
cactctgaggtgctgggccctgg

SEQ ID NO: 365792 - DNA, 23 bp, Artificial Sequence
  Description of Artificial Sequence: Synthetic oligonucleotide
actctgaggtgctgggccctggg

SEQ ID NO: 365793 - DNA, 22 bp, Artificial Sequence
  Description of Artificial Sequence: Synthetic oligonucleotide
ctctgaggtgctgggccctggg

SEQ ID NO: 365794 - DNA, 24 bp, Artificial Sequence
  Description of Artificial Sequence: Synthetic oligonucleotide
tctgaggtgctgggccctgggctt

SEQ ID NO: 365795 - DNA, 22 bp, Artificial Sequence
  Description of Artificial Sequence: Synthetic oligonucleotide
aagcgcaagtgggaggcggccc

SEQ ID NO: 365796 - DNA, 21 bp, Artificial Sequence
  Description of Artificial Sequence: Synthetic oligonucleotide
agcgcaagtgggaggcggccc

SEQ ID NO: 365797 - DNA, 20 bp, Artificial Sequence
  Description of Artificial Sequence: Synthetic oligonucleotide
gcgcaagtgggaggcggccc

SEQ ID NO: 365798 - DNA, 21 bp, Artificial Sequence
  Description of Artificial Sequence: Synthetic oligonucleotide
cgcaagtgggaggcggcccgt

SEQ ID NO: 365799 - DNA, 22 bp, Artificial Sequence
  Description of Artificial Sequence: Synthetic oligonucleotide
gcaagtgggaggcggcccgtga

SEQ ID NO: 365800 - DNA, 22 bp, Artificial Sequence
  Description of Artificial Sequence: Synthetic oligonucleotide
caagtgggaggcggcccgtgag

SEQ ID NO: 365801 - DNA, 22 bp, Artificial Sequence
  Description of Artificial Sequence: Synthetic oligonucleotide
aagtgggaggcggcccgtgagg

SEQ ID NO: 365802 - DNA, 21 bp, Artificial Sequence
  Description of Artificial Sequence: Synthetic oligonucleotide
agtgggaggcggcccgtgagg

SEQ ID NO: 365803 - DNA, 20 bp, Artificial Sequence
  Description of Artificial Sequence: Synthetic oligonucleotide
gtgggaggcggcccgtgagg

SEQ ID NO: 365804 - DNA, 20 bp, Artificial Sequence
  Description of Artificial Sequence: Synthetic oligonucleotide
tgggaggcggcccgtgaggc

SEQ ID NO: 365805 - DNA, 20 bp, Artificial Sequence
  Description of Artificial Sequence: Synthetic oligonucleotide
gggaggcggcccgtgaggct

SEQ ID NO: 365806 - DNA, 20 bp, Artificial Sequence
  Description of Artificial Sequence: Synthetic oligonucleotide
ggaggcggcccgtgaggcgt

SEQ ID NO: 365807 - DNA, 20 bp, Artificial Sequence
  Description of Artificial Sequence: Synthetic oligonucleotide
gaggcggcccgtgaggcgga

SEQ ID NO: 365808 - DNA, 20 bp, Artificial Sequence
  Description of Artificial Sequence: Synthetic oligonucleotide
aggcggcccgtgaggcggag

SEQ ID NO: 365809 - DNA, 20 bp, Artificial Sequence
  Description of Artificial Sequence: Synthetic oligonucleotide
ggcggcccgtgaggcggagt

SEQ ID NO: 365810 - DNA, 20 bp, Artificial Sequence
  Description of Artificial Sequence: Synthetic oligonucleotide
gcggcccgtgaggcggagca

SEQ ID NO: 365811 - DNA, 20 bp, Artificial Sequence
  Description of Artificial Sequence: Synthetic oligonucleotide
cggcccgtgaggcggagcag

SEQ ID NO: 365812 - DNA, 21 bp, Artificial Sequence
  Description of Artificial Sequence: Synthetic oligonucleotide
ggcccgtgaggcggagcagca

SEQ ID NO: 365813 - DNA, 22 bp, Artificial Sequence
  Description of Artificial Sequence: Synthetic oligonucleotide
gcccgtgaggcggagcagcaga

SEQ ID NO: 365814 - DNA, 23 bp, Artificial Sequence
  Description of Artificial Sequence: Synthetic oligonucleotide
cccgtgaggcggagcagcagaga

SEQ ID NO: 365815 - DNA, 23 bp, Artificial Sequence
  Description of Artificial Sequence: Synthetic oligonucleotide
ccgtgaggcggagcagcagagag

SEQ ID NO: 365816 - DNA, 23 bp, Artificial Sequence
  Description of Artificial Sequence: Synthetic oligonucleotide
cgtgaggcggagcagcagagagc

SEQ ID NO: 365817 - DNA, 25 bp, Artificial Sequence
  Description of Artificial Sequence: Synthetic oligonucleotide
gtgaggcggagcagcagagagccta

SEQ ID NO: 365818 - DNA, 25 bp, Artificial Sequence
  Description of Artificial Sequence: Synthetic oligonucleotide
ggcggacatggcagctcagatcacc

SEQ ID NO: 365819 - DNA, 26 bp, Artificial Sequence
  Description of Artificial Sequence: Synthetic oligonucleotide
gcggacatggcagctcagatcaccga

SEQ ID NO: 365820 - DNA, 26 bp, Artificial Sequence
  Description of Artificial Sequence: Synthetic oligonucleotide
cggacatggcagctcagatcaccgag

SEQ ID NO: 365821 - DNA, 26 bp, Artificial Sequence
  Description of Artificial Sequence: Synthetic oligonucleotide
ggacatggcagctcagatcaccgagc

SEQ ID NO: 365822 - DNA, 26 bp, Artificial Sequence
  Description of Artificial Sequence: Synthetic oligonucleotide
gacatggcagctcagatcaccgagcg

SEQ ID NO: 365823 - DNA, 27 bp, Artificial Sequence
  Description of Artificial Sequence: Synthetic oligonucleotide
acatggcagctcagatcaccgagcgca

SEQ ID NO: 365824 - DNA, 27 bp, Artificial Sequence
  Description of Artificial Sequence: Synthetic oligonucleotide
catggcagctcagatcaccgagcgcaa

SEQ ID NO: 365825 - DNA, 27 bp, Artificial Sequence
  Description of Artificial Sequence: Synthetic oligonucleotide
atggcagctcagatcaccgagcgcaag

SEQ ID NO: 365826 - DNA, 27 bp, Artificial Sequence
  Description of Artificial Sequence: Synthetic oligonucleotide
tggcagctcagatcaccgagcgcaagt

SEQ ID NO: 365827 - DNA, 26 bp, Artificial Sequence
  Description of Artificial Sequence: Synthetic oligonucleotide
ggcagctcagatcaccgagcgcaagt

SEQ ID NO: 365828 - DNA, 26 bp, Artificial Sequence
  Description of Artificial Sequence: Synthetic oligonucleotide
gcagctcagatcaccgagcgcaagtg

SEQ ID NO: 365829 - DNA, 26 bp, Artificial Sequence
  Description of Artificial Sequence: Synthetic oligonucleotide
cagctcagatcaccgagcgcaagtgg

SEQ ID NO: 365830 - DNA, 27 bp, Artificial Sequence
  Description of Artificial Sequence: Synthetic oligonucleotide
agctcagatcaccgagcgcaagtggga

SEQ ID NO: 365831 - DNA, 26 bp, Artificial Sequence
  Description of Artificial Sequence: Synthetic oligonucleotide
gctcagatcaccgagcgcaagtggga

SEQ ID NO: 365832 - DNA, 26 bp, Artificial Sequence
  Description of Artificial Sequence: Synthetic oligonucleotide
ctcagatcaccgagcgcaagtgggag

SEQ ID NO: 365833 - DNA, 26 bp, Artificial Sequence
  Description of Artificial Sequence: Synthetic oligonucleotide
tcagatcaccgagcgcaagtgggagg

SEQ ID NO: 365834 - DNA, 25 bp, Artificial Sequence
  Description of Artificial Sequence: Synthetic oligonucleotide
cagatcaccgagcgcaagtgggagg

SEQ ID NO: 365835 - DNA, 25 bp, Artificial Sequence
  Description of Artificial Sequence: Synthetic oligonucleotide
agatcaccgagcgcaagtgggaggc

SEQ ID NO: 365836 - DNA, 24 bp, Artificial Sequence
  Description of Artificial Sequence: Synthetic oligonucleotide
gatcaccgagcgcaagtgggaggc

SEQ ID NO: 365837 - DNA, 24 bp, Artificial Sequence
  Description of Artificial Sequence: Synthetic oligonucleotide
atcaccgagcgcaagtgggaggcg

SEQ ID NO: 365838 - DNA, 23 bp, Artificial Sequence
  Description of Artificial Sequence: Synthetic oligonucleotide
tcaccgagcgcaagtgggaggcg

SEQ ID NO: 365839 - DNA, 22 bp, Artificial Sequence
  Description of Artificial Sequence: Synthetic oligonucleotide
caccgagcgcaagtgggaggcg

SEQ ID NO: 365840 - DNA, 22 bp, Artificial Sequence
  Description of Artificial Sequence: Synthetic oligonucleotide
accgagcgcaagtgggaggcgg

SEQ ID NO: 365841 - DNA, 21 bp, Artificial Sequence
  Description of Artificial Sequence: Synthetic oligonucleotide
ccgagcgcaagtgggaggcgg

SEQ ID NO: 365842 - DNA, 21 bp, Artificial Sequence
  Description of Artificial Sequence: Synthetic oligonucleotide
cgagcgcaagtgggaggcggc

SEQ ID NO: 365843 - DNA, 21 bp, Artificial Sequence
  Description of Artificial Sequence: Synthetic oligonucleotide
gagcgcaagtgggaggcggcc

SEQ ID NO: 365844 - DNA, 35 bp, Artificial Sequence; identical to SEQ ID NO: 12747
  Description of Artificial Sequence: Synthetic oligonucleotide

SEQ ID NO: 365845 - DNA, 34 bp, Artificial Sequence; identical to SEQ ID NO: 12748
  Description of Artificial Sequence: Synthetic oligonucleotide

SEQ ID NO: 365846 - DNA, 35 bp, Artificial Sequence; identical to SEQ ID NO: 12749
  Description of Artificial Sequence: Synthetic oligonucleotide

SEQ ID NO: 365847 - DNA, 36 bp, Artificial Sequence; identical to SEQ ID NO: 12750
  Description of Artificial Sequence: Synthetic oligonucleotide

SEQ ID NO: 365848 - DNA, 35 bp, Artificial Sequence; identical to SEQ ID NO: 12751
  Description of Artificial Sequence: Synthetic oligonucleotide

SEQ ID NO: 365849 - DNA, 34 bp, Artificial Sequence; identical to SEQ ID NO: 12752
  Description of Artificial Sequence: Synthetic oligonucleotide

SEQ ID NO: 365850 - DNA, 34 bp, Artificial Sequence; identical to SEQ ID NO: 12753
  Description of Artificial Sequence: Synthetic oligonucleotide

SEQ ID NO: 365851 - DNA, 33 bp, Artificial Sequence; identical to SEQ ID NO: 12754
  Description of Artificial Sequence: Synthetic oligonucleotide

SEQ ID NO: 365852 - DNA, 33 bp, Artificial Sequence; identical to SEQ ID NO: 12755
  Description of Artificial Sequence: Synthetic oligonucleotide

SEQ ID NO: 365853 - DNA, 34 bp, Artificial Sequence; identical to SEQ ID NO: 12756
  Description of Artificial Sequence: Synthetic oligonucleotide

SEQ ID NO: 365854 - DNA, 33 bp, Artificial Sequence; identical to SEQ ID NO: 12757
  Description of Artificial Sequence: Synthetic oligonucleotide

SEQ ID NO: 365855 - DNA, 33 bp, Artificial Sequence; identical to SEQ ID NO: 12758
  Description of Artificial Sequence: Synthetic oligonucleotide

SEQ ID NO: 365856 - DNA, 32 bp, Artificial Sequence; identical to SEQ ID NO: 12759
  Description of Artificial Sequence: Synthetic oligonucleotide

SEQ ID NO: 365857 - DNA, 34 bp, Artificial Sequence; identical to SEQ ID NO: 12760
  Description of Artificial Sequence: Synthetic oligonucleotide

SEQ ID NO: 365858 - DNA, 33 bp, Artificial Sequence; identical to SEQ ID NO: 12761
  Description of Artificial Sequence: Synthetic oligonucleotide

SEQ ID NO: 365859 - DNA, 32 bp, Artificial Sequence; identical to SEQ ID NO: 12762
  Description of Artificial Sequence: Synthetic oligonucleotide

SEQ ID NO: 365860 - DNA, 31 bp, Artificial Sequence; identical to SEQ ID NO: 12763
  Description of Artificial Sequence: Synthetic oligonucleotide

SEQ ID NO: 365861 - DNA, 31 bp, Artificial Sequence; identical to SEQ ID NO: 12764
  Description of Artificial Sequence: Synthetic oligonucleotide

SEQ ID NO: 365862 - DNA, 30 bp, Artificial Sequence; identical to SEQ ID NO: 12765
  Description of Artificial Sequence: Synthetic oligonucleotide

SEQ ID NO: 365863 - DNA, 29 bp, Artificial Sequence
  Description of Artificial Sequence: Synthetic oligonucleotide
aaggagggagttactctcaggctgcaagc

SEQ ID NO: 365864 - DNA, 28 bp, Artificial Sequence
  Description of Artificial Sequence: Synthetic oligonucleotide
aggagggagttactctcaggctgcaagc

SEQ ID NO: 365865 - DNA, 27 bp, Artificial Sequence
  Description of Artificial Sequence: Synthetic oligonucleotide
ggagggagttactctcaggctgcaagc

SEQ ID NO: 365866 - DNA, 28 bp, Artificial Sequence
  Description of Artificial Sequence: Synthetic oligonucleotide
gagggagttactctcaggctgcaagcag

SEQ ID NO: 365867 - DNA, 29 bp, Artificial Sequence
  Description of Artificial Sequence: Synthetic oligonucleotide
agggagttactctcaggctgcaagcagtg

SEQ ID NO: 365868 - DNA, 28 bp, Artificial Sequence
  Description of Artificial Sequence: Synthetic oligonucleotide
gggagttactctcaggctgcaagcagtg

SEQ ID NO: 365869 - DNA, 29 bp, Artificial Sequence
  Description of Artificial Sequence: Synthetic oligonucleotide
ggagttactctcaggctgcaagcagtgac

SEQ ID NO: 365870 - DNA, 30 bp, Artificial Sequence; identical to SEQ ID NO: 12773
  Description of Artificial Sequence: Synthetic oligonucleotide

SEQ ID NO: 365871 - DNA, 31 bp, Artificial Sequence; identical to SEQ ID NO: 12774
  Description of Artificial Sequence: Synthetic oligonucleotide

SEQ ID NO: 365872 - DNA, 30 bp, Artificial Sequence; identical to SEQ ID NO: 12775
  Description of Artificial Sequence: Synthetic oligonucleotide

SEQ ID NO: 365873 - DNA, 30 bp, Artificial Sequence; identical to SEQ ID NO: 12776
  Description of Artificial Sequence: Synthetic oligonucleotide

SEQ ID NO: 365874 - DNA, 29 bp, Artificial Sequence
  Description of Artificial Sequence: Synthetic oligonucleotide
acggaatgtgaaggcccagtcacagactc

SEQ ID NO: 365875 - DNA, 28 bp, Artificial Sequence
  Description of Artificial Sequence: Synthetic oligonucleotide
cggaatgtgaaggcccagtcacagactc

SEQ ID NO: 365876 - DNA, 29 bp, Artificial Sequence
  Description of Artificial Sequence: Synthetic oligonucleotide
ggaatgtgaaggcccagtcacagactcac

SEQ ID NO: 365877 - DNA, 29 bp, Artificial Sequence
  Description of Artificial Sequence: Synthetic oligonucleotide
gaatgtgaaggcccagtcacagactcacc

SEQ ID NO: 365878 - DNA, 29 bp, Artificial Sequence
  Description of Artificial Sequence: Synthetic oligonucleotide
aatgtgaaggcccagtcacagactcaccg

SEQ ID NO: 365879 - DNA, 28 bp, Artificial Sequence
  Description of Artificial Sequence: Synthetic oligonucleotide
atgtgaaggcccagtcacagactcaccg

SEQ ID NO: 365880 - DNA, 27 bp, Artificial Sequence
  Description of Artificial Sequence: Synthetic oligonucleotide
tgtgaaggcccagtcacagactcaccg

SEQ ID NO: 365881 - DNA, 27 bp, Artificial Sequence
  Description of Artificial Sequence: Synthetic oligonucleotide
cggaacacacggaatgtgaaggcccag

SEQ ID NO: 365882 - DNA, 28 bp, Artificial Sequence
  Description of Artificial Sequence: Synthetic oligonucleotide
ggaacacacggaatgtgaaggcccagtc

SEQ ID NO: 365883 - DNA, 29 bp, Artificial Sequence
  Description of Artificial Sequence: Synthetic oligonucleotide
gaacacacggaatgtgaaggcccagtcac

SEQ ID NO: 365884 - DNA, 30 bp, Artificial Sequence; identical to SEQ ID NO: 11145
  Description of Artificial Sequence: Synthetic oligonucleotide

SEQ ID NO: 365885 - DNA, 29 bp, Artificial Sequence
  Description of Artificial Sequence: Synthetic oligonucleotide
acacacggaatgtgaaggcccagtcacag

SEQ ID NO: 365886 - DNA, 28 bp, Artificial Sequence
  Description of Artificial Sequence: Synthetic oligonucleotide
cacacggaatgtgaaggcccagtcacag

SEQ ID NO: 365887 - DNA, 26 bp, Artificial Sequence
  Description of Artificial Sequence: Synthetic oligonucleotide
ggcggacatggcagctcagatcacca

SEQ ID NO: 365888 - DNA, 26 bp, Artificial Sequence
  Description of Artificial Sequence: Synthetic oligonucleotide
gcggacatggcagctcagatcaccag

SEQ ID NO: 365889 - DNA, 26 bp, Artificial Sequence
  Description of Artificial Sequence: Synthetic oligonucleotide
cggacatggcagctcagatcaccagg

SEQ ID NO: 365890 - DNA, 26 bp, Artificial Sequence
  Description of Artificial Sequence: Synthetic oligonucleotide
ggacatggcagctcagatcaccaggc

SEQ ID NO: 365891 - DNA, 26 bp, Artificial Sequence
  Description of Artificial Sequence: Synthetic oligonucleotide
gacatggcagctcagatcaccaggcg

SEQ ID NO: 365892 - DNA, 27 bp, Artificial Sequence
  Description of Artificial Sequence: Synthetic oligonucleotide
acatggcagctcagatcaccaggcgca

SEQ ID NO: 365893 - DNA, 27 bp, Artificial Sequence
  Description of Artificial Sequence: Synthetic oligonucleotide
catggcagctcagatcaccaggcgcaa

SEQ ID NO: 365894 - DNA, 27 bp, Artificial Sequence
  Description of Artificial Sequence: Synthetic oligonucleotide
atggcagctcagatcaccaggcgcaag

SEQ ID NO: 365895 - DNA, 27 bp, Artificial Sequence
  Description of Artificial Sequence: Synthetic oligonucleotide
tggcagctcagatcaccaggcgcaagt

SEQ ID NO: 365896 - DNA, 26 bp, Artificial Sequence
  Description of Artificial Sequence: Synthetic oligonucleotide
ggcagctcagatcaccaggcgcaagt

SEQ ID NO: 365897 - DNA, 26 bp, Artificial Sequence
  Description of Artificial Sequence: Synthetic oligonucleotide
gcagctcagatcaccaggcgcaagtg

SEQ ID NO: 365898 - DNA, 26 bp, Artificial Sequence
  Description of Artificial Sequence: Synthetic oligonucleotide
cagctcagatcaccaggcgcaagtgg

SEQ ID NO: 365899 - DNA, 27 bp, Artificial Sequence
  Description of Artificial Sequence: Synthetic oligonucleotide
agctcagatcaccaggcgcaagtggga

SEQ ID NO: 365900 - DNA, 26 bp, Artificial Sequence
  Description of Artificial Sequence: Synthetic oligonucleotide
gctcagatcaccaggcgcaagtggga

SEQ ID NO: 365901 - DNA, 26 bp, Artificial Sequence
  Description of Artificial Sequence: Synthetic oligonucleotide
ctcagatcaccaggcgcaagtgggag

SEQ ID NO: 365902 - DNA, 26 bp, Artificial Sequence
  Description of Artificial Sequence: Synthetic oligonucleotide
tcagatcaccaggcgcaagtgggagg

SEQ ID NO: 365903 - DNA, 25 bp, Artificial Sequence
  Description of Artificial Sequence: Synthetic oligonucleotide
cagatcaccaggcgcaagtgggagg

SEQ ID NO: 365904 - DNA, 25 bp, Artificial Sequence
  Description of Artificial Sequence: Synthetic oligonucleotide
agatcaccaggcgcaagtgggaggc

SEQ ID NO: 365905 - DNA, 24 bp, Artificial Sequence
  Description of Artificial Sequence: Synthetic oligonucleotide
gatcaccaggcgcaagtgggaggc

SEQ ID NO: 365906 - DNA, 24 bp, Artificial Sequence
  Description of Artificial Sequence: Synthetic oligonucleotide
atcaccaggcgcaagtgggaggcg

SEQ ID NO: 365907 - DNA, 23 bp, Artificial Sequence
  Description of Artificial Sequence: Synthetic oligonucleotide
tcaccaggcgcaagtgggaggcg

SEQ ID NO: 365908 - DNA, 22 bp, Artificial Sequence
  Description of Artificial Sequence: Synthetic oligonucleotide
caccaggcgcaagtgggaggcg

SEQ ID NO: 365909 - DNA, 22 bp, Artificial Sequence
  Description of Artificial Sequence: Synthetic oligonucleotide
accaggcgcaagtgggaggcgg

SEQ ID NO: 365910 - DNA, 21 bp, Artificial Sequence
  Description of Artificial Sequence: Synthetic oligonucleotide
ccaggcgcaagtgggaggcgg

SEQ ID NO: 365911 - DNA, 21 bp, Artificial Sequence
  Description of Artificial Sequence: Synthetic oligonucleotide
caggcgcaagtgggaggcggc

SEQ ID NO: 365912 - DNA, 21 bp, Artificial Sequence
  Description of Artificial Sequence: Synthetic oligonucleotide
aggcgcaagtgggaggcggcc

SEQ ID NO: 365913 - DNA, 20 bp, Artificial Sequence
  Description of Artificial Sequence: Synthetic oligonucleotide
ggcgcaagtgggaggcggcc

SEQ ID NO: 365914 - DNA, 23 bp, Artificial Sequence
  Description of Artificial Sequence: Synthetic oligonucleotide
ctcgtcctgctactctcgggggc

SEQ ID NO: 365915 - DNA, 23 bp, Artificial Sequence
  Description of Artificial Sequence: Synthetic oligonucleotide
tcgtcctgctactctcgggggcc

SEQ ID NO: 365916 - DNA, 22 bp, Artificial Sequence
  Description of Artificial Sequence: Synthetic oligonucleotide
cgtcctgctactctcgggggcc

SEQ ID NO: 365917 - DNA, 23 bp, Artificial Sequence
  Description of Artificial Sequence: Synthetic oligonucleotide
gtcctgctactctcgggggccct

SEQ ID NO: 365918 - DNA, 23 bp, Artificial Sequence
  Description of Artificial Sequence: Synthetic oligonucleotide
tggccctgacccagacctgggca

SEQ ID NO: 365919 - DNA, 22 bp, Artificial Sequence
  Description of Artificial Sequence: Synthetic oligonucleotide
ggccctgacccagacctgggca

SEQ ID NO: 365920 - DNA, 22 bp, Artificial Sequence
  Description of Artificial Sequence: Synthetic oligonucleotide
gccctgacccagacctgggcag

SEQ ID NO: 365921 - DNA, 22 bp, Artificial Sequence
  Description of Artificial Sequence: Synthetic oligonucleotide
ccctgacccagacctgggcagg

SEQ ID NO: 365922 - DNA, 23 bp, Artificial Sequence
  Description of Artificial Sequence: Synthetic oligonucleotide
cctgacccagacctgggcaggct

SEQ ID NO: 365923 - DNA, 23 bp, Artificial Sequence
  Description of Artificial Sequence: Synthetic oligonucleotide
ctgacccagacctgggcaggctc

SEQ ID NO: 365924 - DNA, 23 bp, Artificial Sequence
  Description of Artificial Sequence: Synthetic oligonucleotide
tgacccagacctgggcaggctcc

SEQ ID NO: 365925 - DNA, 22 bp, Artificial Sequence
  Description of Artificial Sequence: Synthetic oligonucleotide
gacccagacctgggcaggctcc

SEQ ID NO: 365926 - DNA, 23 bp, Artificial Sequence
  Description of Artificial Sequence: Synthetic oligonucleotide
acccagacctgggcaggctccca

SEQ ID NO: 365927 - DNA, 22 bp, Artificial Sequence
  Description of Artificial Sequence: Synthetic oligonucleotide
cccagacctgggcaggctccca

SEQ ID NO: 365928 - DNA, 23 bp, Artificial Sequence
  Description of Artificial Sequence: Synthetic oligonucleotide
ccagacctgggcaggctcccact

SEQ ID NO: 365929 - DNA, 23 bp, Artificial Sequence
  Description of Artificial Sequence: Synthetic oligonucleotide
cagacctgggcaggctcccactc

SEQ ID NO: 365930 - DNA, 25 bp, Artificial Sequence
  Description of Artificial Sequence: Synthetic oligonucleotide
agacctgggcaggctcccactccat

SEQ ID NO: 365931 - DNA, 24 bp, Artificial Sequence
  Description of Artificial Sequence: Synthetic oligonucleotide
gacctgggcaggctcccactccat

SEQ ID NO: 365932 - DNA, 25 bp, Artificial Sequence
  Description of Artificial Sequence: Synthetic oligonucleotide
acctgggcaggctcccactccatga

SEQ ID NO: 365933 - DNA, 24 bp, Artificial Sequence
  Description of Artificial Sequence: Synthetic oligonucleotide
cctgggcaggctcccactccatga

SEQ ID NO: 365934 - DNA, 24 bp, Artificial Sequence
  Description of Artificial Sequence: Synthetic oligonucleotide
ctgggcaggctcccactccatgag

SEQ ID NO: 365935 - DNA, 27 bp, Artificial Sequence
  Description of Artificial Sequence: Synthetic oligonucleotide
tgggcaggctcccactccatgaggtat

SEQ ID NO: 365936 - DNA, 27 bp, Artificial Sequence
  Description of Artificial Sequence: Synthetic oligonucleotide
gggcaggctcccactccatgaggtatt

SEQ ID NO: 365937 - DNA, 28 bp, Artificial Sequence
  Description of Artificial Sequence: Synthetic oligonucleotide
ggcaggctcccactccatgaggtatttc

SEQ ID NO: 365938 - DNA, 29 bp, Artificial Sequence
  Description of Artificial Sequence: Synthetic oligonucleotide
gcaggctcccactccatgaggtatttctc

SEQ ID NO: 365939 - DNA, 29 bp, Artificial Sequence
  Description of Artificial Sequence: Synthetic oligonucleotide
caggctcccactccatgaggtatttctcc

SEQ ID NO: 365940 - DNA, 30 bp, Artificial Sequence; identical to SEQ ID NO: 13562
  Description of Artificial Sequence: Synthetic oligonucleotide

SEQ ID NO: 365941 - DNA, 25 bp, Artificial Sequence
  Description of Artificial Sequence: Synthetic oligonucleotide
aggaggggccggagtattgggacga

SEQ ID NO: 365942 - DNA, 24 bp, Artificial Sequence
  Description of Artificial Sequence: Synthetic oligonucleotide
ggaggggccggagtattgggacga

SEQ ID NO: 365943 - DNA, 24 bp, Artificial Sequence
  Description of Artificial Sequence: Synthetic oligonucleotide
gaggggccggagtattgggacgag

SEQ ID NO: 365944 - DNA, 25 bp, Artificial Sequence
  Description of Artificial Sequence: Synthetic oligonucleotide
aggggccggagtattgggacgagga

SEQ ID NO: 365945 - DNA, 24 bp, Artificial Sequence
  Description of Artificial Sequence: Synthetic oligonucleotide
ggggccggagtattgggacgagga

SEQ ID NO: 365946 - DNA, 25 bp, Artificial Sequence
  Description of Artificial Sequence: Synthetic oligonucleotide
gggccggagtattgggacgaggaga

SEQ ID NO: 365947 - DNA, 26 bp, Artificial Sequence
  Description of Artificial Sequence: Synthetic oligonucleotide
ggccggagtattgggacgaggagaca

SEQ ID NO: 365948 - DNA, 26 bp, Artificial Sequence
  Description of Artificial Sequence: Synthetic oligonucleotide
gccggagtattgggacgaggagacag

SEQ ID NO: 365949 - DNA, 26 bp, Artificial Sequence
  Description of Artificial Sequence: Synthetic oligonucleotide
ccggagtattgggacgaggagacagg

SEQ ID NO: 365950 - DNA, 27 bp, Artificial Sequence
  Description of Artificial Sequence: Synthetic oligonucleotide
cggagtattgggacgaggagacaggga

SEQ ID NO: 365951 - DNA, 29 bp, Artificial Sequence
  Description of Artificial Sequence: Synthetic oligonucleotide
ggagtattgggacgaggagacagggaaag

SEQ ID NO: 365952 - DNA, 30 bp, Artificial Sequence; identical to SEQ ID NO: 5988
  Description of Artificial Sequence: Synthetic oligonucleotide

SEQ ID NO: 365953 - DNA, 32 bp, Artificial Sequence; identical to SEQ ID NO: 5989
  Description of Artificial Sequence: Synthetic oligonucleotide

SEQ ID NO: 365954 - DNA, 31 bp, Artificial Sequence; identical to SEQ ID NO: 5990
  Description of Artificial Sequence: Synthetic oligonucleotide

SEQ ID NO: 365955 - DNA, 31 bp, Artificial Sequence; identical to SEQ ID NO: 5991
  Description of Artificial Sequence: Synthetic oligonucleotide

SEQ ID NO: 365956 - DNA, 30 bp, Artificial Sequence; identical to SEQ ID NO: 5992
  Description of Artificial Sequence: Synthetic oligonucleotide

SEQ ID NO: 365957 - DNA, 29 bp, Artificial Sequence
  Description of Artificial Sequence: Synthetic oligonucleotide
ttgggacgaggagacagggaaagtgaagg

SEQ ID NO: 365958 - DNA, 28 bp, Artificial Sequence
  Description of Artificial Sequence: Synthetic oligonucleotide
tgggacgaggagacagggaaagtgaagg

SEQ ID NO: 365959 - DNA, 27 bp, Artificial Sequence
  Description of Artificial Sequence: Synthetic oligonucleotide
gggacgaggagacagggaaagtgaagg

SEQ ID NO: 365960 - DNA, 27 bp, Artificial Sequence
  Description of Artificial Sequence: Synthetic oligonucleotide
ggacgaggagacagggaaagtgaaggc

SEQ ID NO: 365961 - DNA, 27 bp, Artificial Sequence
  Description of Artificial Sequence: Synthetic oligonucleotide
gacgaggagacagggaaagtgaaggcc

SEQ ID NO: 365962 - DNA, 27 bp, Artificial Sequence
  Description of Artificial Sequence: Synthetic oligonucleotide
acgaggagacagggaaagtgaaggccc

SEQ ID NO: 365963 - DNA, 27 bp, Artificial Sequence
  Description of Artificial Sequence: Synthetic oligonucleotide
cgaggagacagggaaagtgaaggccca

SEQ ID NO: 365964 - DNA, 27 bp, Artificial Sequence
  Description of Artificial Sequence: Synthetic oligonucleotide
gaggagacagggaaagtgaaggcccac

SEQ ID NO: 365965 - DNA, 28 bp, Artificial Sequence
  Description of Artificial Sequence: Synthetic oligonucleotide
aggagacagggaaagtgaaggcccactc

SEQ ID NO: 365966 - DNA, 27 bp, Artificial Sequence
  Description of Artificial Sequence: Synthetic oligonucleotide
ggagacagggaaagtgaaggcccactc

SEQ ID NO: 365967 - DNA, 28 bp, Artificial Sequence
  Description of Artificial Sequence: Synthetic oligonucleotide
gagacagggaaagtgaaggcccactcac

SEQ ID NO: 365968 - DNA, 29 bp, Artificial Sequence
  Description of Artificial Sequence: Synthetic oligonucleotide
agacagggaaagtgaaggcccactcacag

SEQ ID NO: 365969 - DNA, 28 bp, Artificial Sequence
  Description of Artificial Sequence: Synthetic oligonucleotide
gacagggaaagtgaaggcccactcacag

SEQ ID NO: 365970 - DNA, 29 bp, Artificial Sequence
  Description of Artificial Sequence: Synthetic oligonucleotide
acagggaaagtgaaggcccactcacagac

SEQ ID NO: 365971 - DNA, 28 bp, Artificial Sequence
  Description of Artificial Sequence: Synthetic oligonucleotide
cagggaaagtgaaggcccactcacagac

SEQ ID NO: 365972 - DNA, 29 bp, Artificial Sequence
  Description of Artificial Sequence: Synthetic oligonucleotide
agggaaagtgaaggcccactcacagactg

SEQ ID NO: 365973 - DNA, 28 bp, Artificial Sequence
  Description of Artificial Sequence: Synthetic oligonucleotide
gggaaagtgaaggcccactcacagactg

SEQ ID NO: 365974 - DNA, 29 bp, Artificial Sequence
  Description of Artificial Sequence: Synthetic oligonucleotide
ggaaagtgaaggcccactcacagactgac

SEQ ID NO: 365975 - DNA, 29 bp, Artificial Sequence
  Description of Artificial Sequence: Synthetic oligonucleotide
gaaagtgaaggcccactcacagactgacc

SEQ ID NO: 365976 - DNA, 29 bp, Artificial Sequence
  Description of Artificial Sequence: Synthetic oligonucleotide
aaagtgaaggcccactcacagactgaccg

SEQ ID NO: 365977 - DNA, 28 bp, Artificial Sequence
  Description of Artificial Sequence: Synthetic oligonucleotide
aagtgaaggcccactcacagactgaccg

SEQ ID NO: 365978 - DNA, 27 bp, Artificial Sequence
  Description of Artificial Sequence: Synthetic oligonucleotide
agtgaaggcccactcacagactgaccg

SEQ ID NO: 365979 - DNA, 27 bp, Artificial Sequence
  Description of Artificial Sequence: Synthetic oligonucleotide
gaaggcccactcacagactgaccgaga

SEQ ID NO: 365980 - DNA, 27 bp, Artificial Sequence
  Description of Artificial Sequence: Synthetic oligonucleotide
aaggcccactcacagactgaccgagag

SEQ ID NO: 365981 - DNA, 27 bp, Artificial Sequence
  Description of Artificial Sequence: Synthetic oligonucleotide
aggcccactcacagactgaccgagaga

SEQ ID NO: 365982 - DNA, 27 bp, Artificial Sequence
  Description of Artificial Sequence: Synthetic oligonucleotide
ggcccactcacagactgaccgagagaa

SEQ ID NO: 365983 - DNA, 27 bp, Artificial Sequence
  Description of Artificial Sequence: Synthetic oligonucleotide
gcccactcacagactgaccgagagaac

SEQ ID NO: 365984 - DNA, 27 bp, Artificial Sequence
  Description of Artificial Sequence: Synthetic oligonucleotide
cccactcacagactgaccgagagaacc

SEQ ID NO: 365985 - DNA, 28 bp, Artificial Sequence
  Description of Artificial Sequence: Synthetic oligonucleotide
ccactcacagactgaccgagagaacctg

SEQ ID NO: 365986 - DNA, 28 bp, Artificial Sequence
  Description of Artificial Sequence: Synthetic oligonucleotide
cactcacagactgaccgagagaacctgc

SEQ ID NO: 365987 - DNA, 28 bp, Artificial Sequence
  Description of Artificial Sequence: Synthetic oligonucleotide
actcacagactgaccgagagaacctgcg

SEQ ID NO: 365988 - DNA, 27 bp, Artificial Sequence
  Description of Artificial Sequence: Synthetic oligonucleotide
ctcacagactgaccgagagaacctgcg

SEQ ID NO: 365989 - DNA, 27 bp, Artificial Sequence
  Description of Artificial Sequence: Synthetic oligonucleotide
tcacagactgaccgagagaacctgcgg

SEQ ID NO: 365990 - DNA, 27 bp, Artificial Sequence
  Description of Artificial Sequence: Synthetic oligonucleotide
cacagactgaccgagagaacctgcgga

SEQ ID NO: 365991 - DNA, 28 bp, Artificial Sequence
  Description of Artificial Sequence: Synthetic oligonucleotide
acagactgaccgagagaacctgcggatc

SEQ ID NO: 365992 - DNA, 27 bp, Artificial Sequence
  Description of Artificial Sequence: Synthetic oligonucleotide
cagactgaccgagagaacctgcggatc

SEQ ID NO: 365993 - DNA, 27 bp, Artificial Sequence
  Description of Artificial Sequence: Synthetic oligonucleotide
agactgaccgagagaacctgcggatcg

SEQ ID NO: 365994 - DNA, 26 bp, Artificial Sequence
  Description of Artificial Sequence: Synthetic oligonucleotide
gactgaccgagagaacctgcggatcg

SEQ ID NO: 365995 - DNA, 26 bp, Artificial Sequence
  Description of Artificial Sequence: Synthetic oligonucleotide
actgaccgagagaacctgcggatcgc

SEQ ID NO: 365996 - DNA, 25 bp, Artificial Sequence
  Description of Artificial Sequence: Synthetic oligonucleotide
ctgaccgagagaacctgcggatcgc

SEQ ID NO: 365997 - DNA, 25 bp, Artificial Sequence
  Description of Artificial Sequence: Synthetic oligonucleotide
tgaccgagagaacctgcggatcgcg

SEQ ID NO: 365998 - DNA, 24 bp, Artificial Sequence
  Description of Artificial Sequence: Synthetic oligonucleotide
gaccgagagaacctgcggatcgcg

SEQ ID NO: 365999 - DNA, 25 bp, Artificial Sequence
  Description of Artificial Sequence: Synthetic oligonucleotide
accgagagaacctgcggatcgcgct

SEQ ID NO: 366000 - DNA, 24 bp, Artificial Sequence
  Description of Artificial Sequence: Synthetic oligonucleotide
ccgagagaacctgcggatcgcgct

SEQ ID NO: 366001 - DNA, 24 bp, Artificial Sequence
  Description of Artificial Sequence: Synthetic oligonucleotide
cgagagaacctgcggatcgcgctc

SEQ ID NO: 366002 - DNA, 24 bp, Artificial Sequence
  Description of Artificial Sequence: Synthetic oligonucleotide
gagagaacctgcggatcgcgctcc

SEQ ID NO: 366003 - DNA, 24 bp, Artificial Sequence
  Description of Artificial Sequence: Synthetic oligonucleotide
agagaacctgcggatcgcgctccg

SEQ ID NO: 366004 - DNA, 23 bp, Artificial Sequence
  Description of Artificial Sequence: Synthetic oligonucleotide
gagaacctgcggatcgcgctccg

SEQ ID NO: 366005 - DNA, 25 bp, Artificial Sequence
  Description of Artificial Sequence: Synthetic oligonucleotide
agaacctgcggatcgcgctccgcta

SEQ ID NO: 366006 - DNA, 24 bp, Artificial Sequence
  Description of Artificial Sequence: Synthetic oligonucleotide
gaacctgcggatcgcgctccgcta

SEQ ID NO: 366007 - DNA, 26 bp, Artificial Sequence
  Description of Artificial Sequence: Synthetic oligonucleotide
aacctgcggatcgcgctccgctacta

SEQ ID NO: 366008 - DNA, 25 bp, Artificial Sequence
  Description of Artificial Sequence: Synthetic oligonucleotide
acctgcggatcgcgctccgctacta

SEQ ID NO: 366009 - DNA, 24 bp, Artificial Sequence
  Description of Artificial Sequence: Synthetic oligonucleotide
cctgcggatcgcgctccgctacta

SEQ ID NO: 366010 - DNA, 26 bp, Artificial Sequence
  Description of Artificial Sequence: Synthetic oligonucleotide
ctgcggatcgcgctccgctactacaa

SEQ ID NO: 366011 - DNA, 26 bp, Artificial Sequence
  Description of Artificial Sequence: Synthetic oligonucleotide
tgcggatcgcgctccgctactacaac

SEQ ID NO: 366012 - DNA, 25 bp, Artificial Sequence
  Description of Artificial Sequence: Synthetic oligonucleotide
gcggatcgcgctccgctactacaac

SEQ ID NO: 366013 - DNA, 26 bp, Artificial Sequence
  Description of Artificial Sequence: Synthetic oligonucleotide
cggatcgcgctccgctactacaacca

SEQ ID NO: 366014 - DNA, 27 bp, Artificial Sequence
  Description of Artificial Sequence: Synthetic oligonucleotide
ggatcgcgctccgctactacaaccaga

SEQ ID NO: 366015 - DNA, 27 bp, Artificial Sequence
  Description of Artificial Sequence: Synthetic oligonucleotide
gatcgcgctccgctactacaaccagag

SEQ ID NO: 366016 - DNA, 27 bp, Artificial Sequence
  Description of Artificial Sequence: Synthetic oligonucleotide
atcgcgctccgctactacaaccagagc

SEQ ID NO: 366017 - DNA, 26 bp, Artificial Sequence
  Description of Artificial Sequence: Synthetic oligonucleotide
tcgcgctccgctactacaaccagagc

SEQ ID NO: 366018 - DNA, 25 bp, Artificial Sequence
  Description of Artificial Sequence: Synthetic oligonucleotide
cgcgctccgctactacaaccagagc

SEQ ID NO: 366019 - DNA, 26 bp, Artificial Sequence
  Description of Artificial Sequence: Synthetic oligonucleotide
gcgctccgctactacaaccagagcga

SEQ ID NO: 366020 - DNA, 26 bp, Artificial Sequence
  Description of Artificial Sequence: Synthetic oligonucleotide
cgctccgctactacaaccagagcgag

SEQ ID NO: 366021 - DNA, 26 bp, Artificial Sequence
  Description of Artificial Sequence: Synthetic oligonucleotide
gctccgctactacaaccagagcgagg

SEQ ID NO: 366022 - DNA, 26 bp, Artificial Sequence
  Description of Artificial Sequence: Synthetic oligonucleotide
ctccgctactacaaccagagcgaggc

SEQ ID NO: 366023 - DNA, 26 bp, Artificial Sequence
  Description of Artificial Sequence: Synthetic oligonucleotide
tccgctactacaaccagagcgaggcc

SEQ ID NO: 366024 - DNA, 25 bp, Artificial Sequence
  Description of Artificial Sequence: Synthetic oligonucleotide
ccgctactacaaccagagcgaggcc

SEQ ID NO: 366025 - DNA, 25 bp, Artificial Sequence
  Description of Artificial Sequence: Synthetic oligonucleotide
cgctactacaaccagagcgaggccg

SEQ ID NO: 366026 - DNA, 24 bp, Artificial Sequence
  Description of Artificial Sequence: Synthetic oligonucleotide
gcggacatggcggctcagatcacc

SEQ ID NO: 366027 - DNA, 25 bp, Artificial Sequence
  Description of Artificial Sequence: Synthetic oligonucleotide
cggacatggcggctcagatcaccca

SEQ ID NO: 366028 - DNA, 25 bp, Artificial Sequence
  Description of Artificial Sequence: Synthetic oligonucleotide
ggacatggcggctcagatcacccag

SEQ ID NO: 366029 - DNA, 25 bp, Artificial Sequence
  Description of Artificial Sequence: Synthetic oligonucleotide
gacatggcggctcagatcacccagc

SEQ ID NO: 366030 - DNA, 25 bp, Artificial Sequence
  Description of Artificial Sequence: Synthetic oligonucleotide
acatggcggctcagatcacccagcg

SEQ ID NO: 366031 - DNA, 24 bp, Artificial Sequence
  Description of Artificial Sequence: Synthetic oligonucleotide
catggcggctcagatcacccagcg

SEQ ID NO: 366032 - DNA, 26 bp, Artificial Sequence
  Description of Artificial Sequence: Synthetic oligonucleotide
atggcggctcagatcacccagcgcaa

SEQ ID NO: 366033 - DNA, 25 bp, Artificial Sequence
  Description of Artificial Sequence: Synthetic oligonucleotide
tggcggctcagatcacccagcgcaa

SEQ ID NO: 366034 - DNA, 24 bp, Artificial Sequence
  Description of Artificial Sequence: Synthetic oligonucleotide
ggcggctcagatcacccagcgcaa

SEQ ID NO: 366035 - DNA, 25 bp, Artificial Sequence
  Description of Artificial Sequence: Synthetic oligonucleotide
gcggctcagatcacccagcgcaagt

SEQ ID NO: 366036 - DNA, 25 bp, Artificial Sequence
  Description of Artificial Sequence: Synthetic oligonucleotide
cggctcagatcacccagcgcaagtg

SEQ ID NO: 366037 - DNA, 25 bp, Artificial Sequence
  Description of Artificial Sequence: Synthetic oligonucleotide
ggctcagatcacccagcgcaagtgg

SEQ ID NO: 366038 - DNA, 26 bp, Artificial Sequence
  Description of Artificial Sequence: Synthetic oligonucleotide
gctcagatcacccagcgcaagtggga

SEQ ID NO: 366039 - DNA, 26 bp, Artificial Sequence
  Description of Artificial Sequence: Synthetic oligonucleotide
ctcagatcacccagcgcaagtgggag

SEQ ID NO: 366040 - DNA, 26 bp, Artificial Sequence
  Description of Artificial Sequence: Synthetic oligonucleotide
tcagatcacccagcgcaagtgggagg

SEQ ID NO: 366041 - DNA, 25 bp, Artificial Sequence
  Description of Artificial Sequence: Synthetic oligonucleotide
cagatcacccagcgcaagtgggagg

SEQ ID NO: 366042 - DNA, 25 bp, Artificial Sequence
  Description of Artificial Sequence: Synthetic oligonucleotide
agatcacccagcgcaagtgggaggc

SEQ ID NO: 366043 - DNA, 24 bp, Artificial Sequence
  Description of Artificial Sequence: Synthetic oligonucleotide
gatcacccagcgcaagtgggaggc

SEQ ID NO: 366044 - DNA, 24 bp, Artificial Sequence
  Description of Artificial Sequence: Synthetic oligonucleotide
atcacccagcgcaagtgggaggcg

SEQ ID NO: 366045 - DNA, 23 bp, Artificial Sequence
  Description of Artificial Sequence: Synthetic oligonucleotide
tcacccagcgcaagtgggaggcg

SEQ ID NO: 366046 - DNA, 22 bp, Artificial Sequence
  Description of Artificial Sequence: Synthetic oligonucleotide
cacccagcgcaagtgggaggcg

SEQ ID NO: 366047 - DNA, 22 bp, Artificial Sequence
  Description of Artificial Sequence: Synthetic oligonucleotide
acccagcgcaagtgggaggcgg

SEQ ID NO: 366048 - DNA, 21 bp, Artificial Sequence
  Description of Artificial Sequence: Synthetic oligonucleotide
cccagcgcaagtgggaggcgg

SEQ ID NO: 366049 - DNA, 21 bp, Artificial Sequence
  Description of Artificial Sequence: Synthetic oligonucleotide
ccagcgcaagtgggaggcggc

SEQ ID NO: 366050 - DNA, 21 bp, Artificial Sequence
  Description of Artificial Sequence: Synthetic oligonucleotide
cagcgcaagtgggaggcggcc

SEQ ID NO: 366051 - DNA, 22 bp, Artificial Sequence
  Description of Artificial Sequence: Synthetic oligonucleotide
gcaagtgggaggcggcccgtgt

SEQ ID NO: 366052 - DNA, 30 bp, Artificial Sequence; identical to SEQ ID NO: 13563
  Description of Artificial Sequence: Synthetic oligonucleotide

SEQ ID NO: 366053 - DNA, 30 bp, Artificial Sequence; identical to SEQ ID NO: 13564
  Description of Artificial Sequence: Synthetic oligonucleotide

SEQ ID NO: 366054 - DNA, 29 bp, Artificial Sequence
  Description of Artificial Sequence: Synthetic oligonucleotide
tctctgaccatgaggccactctgagatgc

SEQ ID NO: 366055 - DNA, 28 bp, Artificial Sequence
  Description of Artificial Sequence: Synthetic oligonucleotide
ctctgaccatgaggccactctgagatgc

SEQ ID NO: 366056 - DNA, 29 bp, Artificial Sequence
  Description of Artificial Sequence: Synthetic oligonucleotide
tctgaccatgaggccactctgagatgctg

SEQ ID NO: 366057 - DNA, 28 bp, Artificial Sequence
  Description of Artificial Sequence: Synthetic oligonucleotide
ctgaccatgaggccactctgagatgctg

SEQ ID NO: 366058 - DNA, 28 bp, Artificial Sequence
  Description of Artificial Sequence: Synthetic oligonucleotide
tgaccatgaggccactctgagatgctgg

SEQ ID NO: 366059 - DNA, 27 bp, Artificial Sequence
  Description of Artificial Sequence: Synthetic oligonucleotide
gaccatgaggccactctgagatgctgg

SEQ ID NO: 366060 - DNA, 27 bp, Artificial Sequence
  Description of Artificial Sequence: Synthetic oligonucleotide
accatgaggccactctgagatgctggg

SEQ ID NO: 366061 - DNA, 26 bp, Artificial Sequence
  Description of Artificial Sequence: Synthetic oligonucleotide
ccatgaggccactctgagatgctggg

SEQ ID NO: 366062 - DNA, 26 bp, Artificial Sequence
  Description of Artificial Sequence: Synthetic oligonucleotide
catgaggccactctgagatgctgggc

SEQ ID NO: 366063 - DNA, 26 bp, Artificial Sequence
  Description of Artificial Sequence: Synthetic oligonucleotide
atgaggccactctgagatgctgggcc

SEQ ID NO: 366064 - DNA, 25 bp, Artificial Sequence
  Description of Artificial Sequence: Synthetic oligonucleotide
tgaggccactctgagatgctgggcc

SEQ ID NO: 366065 - DNA, 24 bp, Artificial Sequence
  Description of Artificial Sequence: Synthetic oligonucleotide
gaggccactctgagatgctgggcc

SEQ ID NO: 366066 - DNA, 25 bp, Artificial Sequence
  Description of Artificial Sequence: Synthetic oligonucleotide
aggccactctgagatgctgggccct

SEQ ID NO: 366067 - DNA, 24 bp, Artificial Sequence
  Description of Artificial Sequence: Synthetic oligonucleotide
ggccactctgagatgctgggccct

SEQ ID NO: 366068 - DNA, 24 bp, Artificial Sequence
  Description of Artificial Sequence: Synthetic oligonucleotide
gccactctgagatgctgggccctg

SEQ ID NO: 366069 - DNA, 24 bp, Artificial Sequence
  Description of Artificial Sequence: Synthetic oligonucleotide
ccactctgagatgctgggccctgg

SEQ ID NO: 366070 - DNA, 24 bp, Artificial Sequence
  Description of Artificial Sequence: Synthetic oligonucleotide
cactctgagatgctgggccctggg

SEQ ID NO: 366071 - DNA, 26 bp, Artificial Sequence
  Description of Artificial Sequence: Synthetic oligonucleotide
actctgagatgctgggccctgggctt

SEQ ID NO: 366072 - DNA, 25 bp, Artificial Sequence
  Description of Artificial Sequence: Synthetic oligonucleotide
ctctgagatgctgggccctgggctt

SEQ ID NO: 366073 - DNA, 27 bp, Artificial Sequence
  Description of Artificial Sequence: Synthetic oligonucleotide
tctgagatgctgggccctgggcttcta

SEQ ID NO: 366074 - DNA, 26 bp, Artificial Sequence
  Description of Artificial Sequence: Synthetic oligonucleotide
ctgagatgctgggccctgggcttcta

SEQ ID NO: 366075 - DNA, 26 bp, Artificial Sequence
  Description of Artificial Sequence: Synthetic oligonucleotide
tgagatgctgggccctgggcttctac

SEQ ID NO: 366076 - DNA, 25 bp, Artificial Sequence
  Description of Artificial Sequence: Synthetic oligonucleotide
gagatgctgggccctgggcttctac

SEQ ID NO: 366077 - DNA, 25 bp, Artificial Sequence
  Description of Artificial Sequence: Synthetic oligonucleotide
agatgctgggccctgggcttctacc

SEQ ID NO: 366078 - DNA, 24 bp, Artificial Sequence
  Description of Artificial Sequence: Synthetic oligonucleotide
gatgctgggccctgggcttctacc

SEQ ID NO: 366079 - DNA, 25 bp, Artificial Sequence
  Description of Artificial Sequence: Synthetic oligonucleotide
atgctgggccctgggcttctaccct

SEQ ID NO: 366080 - DNA, 26 bp, Artificial Sequence
  Description of Artificial Sequence: Synthetic oligonucleotide
aggaccagacccaggacacggagctt

SEQ ID NO: 366081 - DNA, 25 bp, Artificial Sequence
  Description of Artificial Sequence: Synthetic oligonucleotide
ggaccagacccaggacacggagctt

SEQ ID NO: 366082 - DNA, 26 bp, Artificial Sequence
  Description of Artificial Sequence: Synthetic oligonucleotide
gaccagacccaggacacggagcttgt

SEQ ID NO: 366083 - DNA, 26 bp, Artificial Sequence
  Description of Artificial Sequence: Synthetic oligonucleotide
accagacccaggacacggagcttgtg

SEQ ID NO: 366084 - DNA, 25 bp, Artificial Sequence
  Description of Artificial Sequence: Synthetic oligonucleotide
ccagacccaggacacggagcttgtg

SEQ ID NO: 366085 - DNA, 26 bp, Artificial Sequence
  Description of Artificial Sequence: Synthetic oligonucleotide
cagacccaggacacggagcttgtgga

SEQ ID NO: 366086 - DNA, 27 bp, Artificial Sequence
  Description of Artificial Sequence: Synthetic oligonucleotide
agacccaggacacggagcttgtggaga

SEQ ID NO: 366087 - DNA, 26 bp, Artificial Sequence
  Description of Artificial Sequence: Synthetic oligonucleotide
gacccaggacacggagcttgtggaga

SEQ ID NO: 366088 - DNA, 26 bp, Artificial Sequence
  Description of Artificial Sequence: Synthetic oligonucleotide
acccaggacacggagcttgtggagac

SEQ ID NO: 366089 - DNA, 25 bp, Artificial Sequence
  Description of Artificial Sequence: Synthetic oligonucleotide
cccaggacacggagcttgtggagac

SEQ ID NO: 366090 - DNA, 26 bp, Artificial Sequence
  Description of Artificial Sequence: Synthetic oligonucleotide
ccaggacacggagcttgtggagacca

SEQ ID NO: 366091 - DNA, 26 bp, Artificial Sequence
  Description of Artificial Sequence: Synthetic oligonucleotide
caggacacggagcttgtggagaccag

SEQ ID NO: 366092 - DNA, 26 bp, Artificial Sequence
  Description of Artificial Sequence: Synthetic oligonucleotide
aggacacggagcttgtggagaccagg

SEQ ID NO: 366093 - DNA, 25 bp, Artificial Sequence
  Description of Artificial Sequence: Synthetic oligonucleotide
ggacacggagcttgtggagaccagg

SEQ ID NO: 366094 - DNA, 25 bp, Artificial Sequence
  Description of Artificial Sequence: Synthetic oligonucleotide
gacacggagcttgtggagaccaggc

SEQ ID NO: 366095 - DNA, 26 bp, Artificial Sequence
  Description of Artificial Sequence: Synthetic oligonucleotide
acacggagcttgtggagaccaggcct

SEQ ID NO: 366096 - DNA, 25 bp, Artificial Sequence
  Description of Artificial Sequence: Synthetic oligonucleotide
cacggagcttgtggagaccaggcct

SEQ ID NO: 366097 - DNA, 25 bp, Artificial Sequence
  Description of Artificial Sequence: Synthetic oligonucleotide
acggagcttgtggagaccaggcctg

SEQ ID NO: 366098 - DNA, 24 bp, Artificial Sequence
  Description of Artificial Sequence: Synthetic oligonucleotide
cggagcttgtggagaccaggcctg

SEQ ID NO: 366099 - DNA, 25 bp, Artificial Sequence
  Description of Artificial Sequence: Synthetic oligonucleotide
ggagcttgtggagaccaggcctgca

SEQ ID NO: 366100 - DNA, 25 bp, Artificial Sequence
  Description of Artificial Sequence: Synthetic oligonucleotide
gagcttgtggagaccaggcctgcag

SEQ ID NO: 366101 - DNA, 25 bp, Artificial Sequence
  Description of Artificial Sequence: Synthetic oligonucleotide
agcttgtggagaccaggcctgcagg

SEQ ID NO: 366102 - DNA, 24 bp, Artificial Sequence
  Description of Artificial Sequence: Synthetic oligonucleotide
gcttgtggagaccaggcctgcagg

SEQ ID NO: 366103 - DNA, 24 bp, Artificial Sequence
  Description of Artificial Sequence: Synthetic oligonucleotide
cttgtggagaccaggcctgcaggg

SEQ ID NO: 366104 - DNA, 26 bp, Artificial Sequence
  Description of Artificial Sequence: Synthetic oligonucleotide
ttgtggagaccaggcctgcaggggat

SEQ ID NO: 366105 - DNA, 25 bp, Artificial Sequence
  Description of Artificial Sequence: Synthetic oligonucleotide
tgtggagaccaggcctgcaggggat

SEQ ID NO: 366106 - DNA, 27 bp, Artificial Sequence
  Description of Artificial Sequence: Synthetic oligonucleotide
ggggatggaaccttccagaagtgggca

SEQ ID NO: 366107 - DNA, 27 bp, Artificial Sequence
  Description of Artificial Sequence: Synthetic oligonucleotide
gggatggaaccttccagaagtgggcag

SEQ ID NO: 366108 - DNA, 27 bp, Artificial Sequence
  Description of Artificial Sequence: Synthetic oligonucleotide
ggatggaaccttccagaagtgggcagc

SEQ ID NO: 366109 - DNA, 28 bp, Artificial Sequence
  Description of Artificial Sequence: Synthetic oligonucleotide
gatggaaccttccagaagtgggcagctg

SEQ ID NO: 366110 - DNA, 29 bp, Artificial Sequence
  Description of Artificial Sequence: Synthetic oligonucleotide
atggaaccttccagaagtgggcagctgtg

SEQ ID NO: 366111 - DNA, 28 bp, Artificial Sequence
  Description of Artificial Sequence: Synthetic oligonucleotide
tggaaccttccagaagtgggcagctgtg

SEQ ID NO: 366112 - DNA, 27 bp, Artificial Sequence
  Description of Artificial Sequence: Synthetic oligonucleotide
ggaaccttccagaagtgggcagctgtg

SEQ ID NO: 366113 - DNA, 27 bp, Artificial Sequence
  Description of Artificial Sequence: Synthetic oligonucleotide
gaaccttccagaagtgggcagctgtgg

SEQ ID NO: 366114 - DNA, 28 bp, Artificial Sequence
  Description of Artificial Sequence: Synthetic oligonucleotide
aaccttccagaagtgggcagctgtggtg

SEQ ID NO: 366115 - DNA, 27 bp, Artificial Sequence
  Description of Artificial Sequence: Synthetic oligonucleotide
accttccagaagtgggcagctgtggtg

SEQ ID NO: 366116 - DNA, 26 bp, Artificial Sequence
  Description of Artificial Sequence: Synthetic oligonucleotide
ccttccagaagtgggcagctgtggtg

SEQ ID NO: 366117 - DNA, 27 bp, Artificial Sequence
  Description of Artificial Sequence: Synthetic oligonucleotide
cttccagaagtgggcagctgtggtggt

SEQ ID NO: 366118 - DNA, 28 bp, Artificial Sequence
  Description of Artificial Sequence: Synthetic oligonucleotide
ttccagaagtgggcagctgtggtggtac

SEQ ID NO: 366119 - DNA, 27 bp, Artificial Sequence
  Description of Artificial Sequence: Synthetic oligonucleotide
tccagaagtgggcagctgtggtggtac

SEQ ID NO: 366120 - DNA, 26 bp, Artificial Sequence
  Description of Artificial Sequence: Synthetic oligonucleotide
ccagaagtgggcagctgtggtggtac

SEQ ID NO: 366121 - DNA, 27 bp, Artificial Sequence
  Description of Artificial Sequence: Synthetic oligonucleotide
cagaagtgggcagctgtggtggtacct

SEQ ID NO: 366122 - DNA, 28 bp, Artificial Sequence
  Description of Artificial Sequence: Synthetic oligonucleotide
agaagtgggcagctgtggtggtaccttc

SEQ ID NO: 366123 - DNA, 27 bp, Artificial Sequence
  Description of Artificial Sequence: Synthetic oligonucleotide
gaagtgggcagctgtggtggtaccttc

SEQ ID NO: 366124 - DNA, 28 bp, Artificial Sequence
  Description of Artificial Sequence: Synthetic oligonucleotide
aagtgggcagctgtggtggtaccttctg

SEQ ID NO: 366125 - DNA, 27 bp, Artificial Sequence
  Description of Artificial Sequence: Synthetic oligonucleotide
agtgggcagctgtggtggtaccttctg

SEQ ID NO: 366126 - DNA, 26 bp, Artificial Sequence
  Description of Artificial Sequence: Synthetic oligonucleotide
gtgggcagctgtggtggtaccttctg

SEQ ID NO: 366127 - DNA, 27 bp, Artificial Sequence
  Description of Artificial Sequence: Synthetic oligonucleotide
tgggcagctgtggtggtaccttctgga

SEQ ID NO: 366128 - DNA, 26 bp, Artificial Sequence
  Description of Artificial Sequence: Synthetic oligonucleotide
gggcagctgtggtggtaccttctgga

SEQ ID NO: 366129 - DNA, 27 bp, Artificial Sequence
  Description of Artificial Sequence: Synthetic oligonucleotide
ggcagctgtggtggtaccttctggaga

SEQ ID NO: 366130 - DNA, 27 bp, Artificial Sequence
  Description of Artificial Sequence: Synthetic oligonucleotide
gcagctgtggtggtaccttctggagag

SEQ ID NO: 366131 - DNA, 27 bp, Artificial Sequence
  Description of Artificial Sequence: Synthetic oligonucleotide
cagctgtggtggtaccttctggagagg

SEQ ID NO: 366132 - DNA, 28 bp, Artificial Sequence
  Description of Artificial Sequence: Synthetic oligonucleotide
agctgtggtggtaccttctggagaggag

SEQ ID NO: 366133 - DNA, 27 bp, Artificial Sequence
  Description of Artificial Sequence: Synthetic oligonucleotide
gctgtggtggtaccttctggagaggag

SEQ ID NO: 366134 - DNA, 27 bp, Artificial Sequence
  Description of Artificial Sequence: Synthetic oligonucleotide
ctgtggtggtaccttctggagaggagc

SEQ ID NO: 366135 - DNA, 28 bp, Artificial Sequence
  Description of Artificial Sequence: Synthetic oligonucleotide
tgtggtggtaccttctggagaggagcag

SEQ ID NO: 366136 - DNA, 27 bp, Artificial Sequence
  Description of Artificial Sequence: Synthetic oligonucleotide
gtggtggtaccttctggagaggagcag

SEQ ID NO: 366137 - DNA, 28 bp, Artificial Sequence
  Description of Artificial Sequence: Synthetic oligonucleotide
tggtggtaccttctggagaggagcagag

SEQ ID NO: 366138 - DNA, 27 bp, Artificial Sequence
  Description of Artificial Sequence: Synthetic oligonucleotide
ggtggtaccttctggagaggagcagag

SEQ ID NO: 366139 - DNA, 30 bp, Artificial Sequence; identical to SEQ ID NO: 13624
  Description of Artificial Sequence: Synthetic oligonucleotide

SEQ ID NO: 366140 - DNA, 31 bp, Artificial Sequence; identical to SEQ ID NO: 13625
  Description of Artificial Sequence: Synthetic oligonucleotide

SEQ ID NO: 366141 - DNA, 30 bp, Artificial Sequence; identical to SEQ ID NO: 13626
  Description of Artificial Sequence: Synthetic oligonucleotide

SEQ ID NO: 366142 - DNA, 30 bp, Artificial Sequence; identical to SEQ ID NO: 13627
  Description of Artificial Sequence: Synthetic oligonucleotide

SEQ ID NO: 366143 - DNA, 31 bp, Artificial Sequence; identical to SEQ ID NO: 13628
  Description of Artificial Sequence: Synthetic oligonucleotide

SEQ ID NO: 366144 - DNA, 30 bp, Artificial Sequence; identical to SEQ ID NO: 13629
  Description of Artificial Sequence: Synthetic oligonucleotide

SEQ ID NO: 366145 - DNA, 25 bp, Artificial Sequence
  Description of Artificial Sequence: Synthetic oligonucleotide
cccctcaccctgagatgggagccat

SEQ ID NO: 366146 - DNA, 27 bp, Artificial Sequence
  Description of Artificial Sequence: Synthetic oligonucleotide
ccctcaccctgagatgggagccatctt

SEQ ID NO: 366147 - DNA, 27 bp, Artificial Sequence
  Description of Artificial Sequence: Synthetic oligonucleotide
cctcaccctgagatgggagccatcttc

SEQ ID NO: 366148 - DNA, 27 bp, Artificial Sequence
  Description of Artificial Sequence: Synthetic oligonucleotide
ctcaccctgagatgggagccatcttcc

SEQ ID NO: 366149 - DNA, 27 bp, Artificial Sequence
  Description of Artificial Sequence: Synthetic oligonucleotide
tcaccctgagatgggagccatcttccc

SEQ ID NO: 366150 - DNA, 27 bp, Artificial Sequence
  Description of Artificial Sequence: Synthetic oligonucleotide
caccctgagatgggagccatcttccca

SEQ ID NO: 366151 - DNA, 27 bp, Artificial Sequence
  Description of Artificial Sequence: Synthetic oligonucleotide
accctgagatgggagccatcttcccag

SEQ ID NO: 366152 - DNA, 26 bp, Artificial Sequence
  Description of Artificial Sequence: Synthetic oligonucleotide
ccctgagatgggagccatcttcccag

SEQ ID NO: 366153 - DNA, 26 bp, Artificial Sequence
  Description of Artificial Sequence: Synthetic oligonucleotide
cctgagatgggagccatcttcccagc

SEQ ID NO: 366154 - DNA, 26 bp, Artificial Sequence
  Description of Artificial Sequence: Synthetic oligonucleotide
ctgagatgggagccatcttcccagcc

SEQ ID NO: 366155 - DNA, 27 bp, Artificial Sequence
  Description of Artificial Sequence: Synthetic oligonucleotide
tgagatgggagccatcttcccagccca

SEQ ID NO: 366156 - DNA, 26 bp, Artificial Sequence
  Description of Artificial Sequence: Synthetic oligonucleotide
gagatgggagccatcttcccagccca

SEQ ID NO: 366157 - DNA, 26 bp, Artificial Sequence
  Description of Artificial Sequence: Synthetic oligonucleotide
agatgggagccatcttcccagcccac

SEQ ID NO: 366158 - DNA, 25 bp, Artificial Sequence
  Description of Artificial Sequence: Synthetic oligonucleotide
gatgggagccatcttcccagcccac

SEQ ID NO: 366159 - DNA, 25 bp, Artificial Sequence
  Description of Artificial Sequence: Synthetic oligonucleotide
atgggagccatcttcccagcccacc

SEQ ID NO: 366160 - DNA, 24 bp, Artificial Sequence
  Description of Artificial Sequence: Synthetic oligonucleotide
tgggagccatcttcccagcccacc

SEQ ID NO: 366161 - DNA, 23 bp, Artificial Sequence
  Description of Artificial Sequence: Synthetic oligonucleotide
gggagccatcttcccagcccacc

SEQ ID NO: 366162 - DNA, 24 bp, Artificial Sequence
  Description of Artificial Sequence: Synthetic oligonucleotide
ggagccatcttcccagcccaccgt

SEQ ID NO: 366163 - DNA, 24 bp, Artificial Sequence
  Description of Artificial Sequence: Synthetic oligonucleotide
gagccatcttcccagcccaccgtc

SEQ ID NO: 366164 - DNA, 25 bp, Artificial Sequence
  Description of Artificial Sequence: Synthetic oligonucleotide
agccatcttcccagcccaccgtcca

SEQ ID NO: 366165 - DNA, 24 bp, Artificial Sequence
  Description of Artificial Sequence: Synthetic oligonucleotide
gccatcttcccagcccaccgtcca

SEQ ID NO: 366166 - DNA, 26 bp, Artificial Sequence
  Description of Artificial Sequence: Synthetic oligonucleotide
ccatcttcccagcccaccgtccacat

SEQ ID NO: 366167 - DNA, 26 bp, Artificial Sequence
  Description of Artificial Sequence: Synthetic oligonucleotide
catcttcccagcccaccgtccacatc

SEQ ID NO: 366168 - DNA, 27 bp, Artificial Sequence
  Description of Artificial Sequence: Synthetic oligonucleotide
atcttcccagcccaccgtccacatcgt

SEQ ID NO: 366169 - DNA, 26 bp, Artificial Sequence
  Description of Artificial Sequence: Synthetic oligonucleotide
tcttcccagcccaccgtccacatcgt

SEQ ID NO: 366170 - DNA, 25 bp, Artificial Sequence
  Description of Artificial Sequence: Synthetic oligonucleotide
cttcccagcccaccgtccacatcgt

SEQ ID NO: 366171 - DNA, 25 bp, Artificial Sequence
  Description of Artificial Sequence: Synthetic oligonucleotide
ttcccagcccaccgtccacatcgtg

SEQ ID NO: 366172 - DNA, 24 bp, Artificial Sequence
  Description of Artificial Sequence: Synthetic oligonucleotide
tcccagcccaccgtccacatcgtg

SEQ ID NO: 366173 - DNA, 23 bp, Artificial Sequence
  Description of Artificial Sequence: Synthetic oligonucleotide
cccagcccaccgtccacatcgtg

SEQ ID NO: 366174 - DNA, 23 bp, Artificial Sequence
  Description of Artificial Sequence: Synthetic oligonucleotide
ccagcccaccgtccacatcgtgg

SEQ ID NO: 366175 - DNA, 23 bp, Artificial Sequence
  Description of Artificial Sequence: Synthetic oligonucleotide
cagcccaccgtccacatcgtggg

SEQ ID NO: 366176 - DNA, 25 bp, Artificial Sequence
  Description of Artificial Sequence: Synthetic oligonucleotide
agcccaccgtccacatcgtgggcat

SEQ ID NO: 366177 - DNA, 24 bp, Artificial Sequence
  Description of Artificial Sequence: Synthetic oligonucleotide
gcccaccgtccacatcgtgggcat

SEQ ID NO: 366178 - DNA, 27 bp, Artificial Sequence
  Description of Artificial Sequence: Synthetic oligonucleotide
cccaccgtccacatcgtgggcatcatt

SEQ ID NO: 366179 - DNA, 27 bp, Artificial Sequence
  Description of Artificial Sequence: Synthetic oligonucleotide
ccaccgtccacatcgtgggcatcattg

SEQ ID NO: 366180 - DNA, 27 bp, Artificial Sequence
  Description of Artificial Sequence: Synthetic oligonucleotide
caccgtccacatcgtgggcatcattgc

SEQ ID NO: 366181 - DNA, 28 bp, Artificial Sequence
  Description of Artificial Sequence: Synthetic oligonucleotide
accgtccacatcgtgggcatcattgctg

SEQ ID NO: 366182 - DNA, 27 bp, Artificial Sequence
  Description of Artificial Sequence: Synthetic oligonucleotide
ccgtccacatcgtgggcatcattgctg

SEQ ID NO: 366183 - DNA, 27 bp, Artificial Sequence
  Description of Artificial Sequence: Synthetic oligonucleotide
cgtccacatcgtgggcatcattgctgg

SEQ ID NO: 366184 - DNA, 27 bp, Artificial Sequence
  Description of Artificial Sequence: Synthetic oligonucleotide
gtccacatcgtgggcatcattgctggc

SEQ ID NO: 366185 - DNA, 27 bp, Artificial Sequence
  Description of Artificial Sequence: Synthetic oligonucleotide
tccacatcgtgggcatcattgctggcc

SEQ ID NO: 366186 - DNA, 27 bp, Artificial Sequence
  Description of Artificial Sequence: Synthetic oligonucleotide
ccacatcgtgggcatcattgctggcct

SEQ ID NO: 366187 - DNA, 27 bp, Artificial Sequence
  Description of Artificial Sequence: Synthetic oligonucleotide
cacatcgtgggcatcattgctggcctg

SEQ ID NO: 366188 - DNA, 27 bp, Artificial Sequence
  Description of Artificial Sequence: Synthetic oligonucleotide
acatcgtgggcatcattgctggcctgg

SEQ ID NO: 366189 - DNA, 27 bp, Artificial Sequence
  Description of Artificial Sequence: Synthetic oligonucleotide
gtcgctgctgtgatgtggaggaggaac

SEQ ID NO: 366190 - DNA, 28 bp, Artificial Sequence
  Description of Artificial Sequence: Synthetic oligonucleotide
tcgctgctgtgatgtggaggaggaacag

SEQ ID NO: 366191 - DNA, 27 bp, Artificial Sequence
  Description of Artificial Sequence: Synthetic oligonucleotide
cgctgctgtgatgtggaggaggaacag

SEQ ID NO: 366192 - DNA, 27 bp, Artificial Sequence
  Description of Artificial Sequence: Synthetic oligonucleotide
gctgctgtgatgtggaggaggaacagc

SEQ ID NO: 366193 - DNA, 28 bp, Artificial Sequence
  Description of Artificial Sequence: Synthetic oligonucleotide
ctgctgtgatgtggaggaggaacagctc

SEQ ID NO: 366194 - DNA, 29 bp, Artificial Sequence
  Description of Artificial Sequence: Synthetic oligonucleotide
tgctgtgatgtggaggaggaacagctcag

SEQ ID NO: 366195 - DNA, 28 bp, Artificial Sequence
  Description of Artificial Sequence: Synthetic oligonucleotide
gctgtgatgtggaggaggaacagctcag

SEQ ID NO: 366196 - DNA, 31 bp, Artificial Sequence; identical to SEQ ID NO: 13681
  Description of Artificial Sequence: Synthetic oligonucleotide

SEQ ID NO: 366197 - DNA, 35 bp, Artificial Sequence; identical to SEQ ID NO: 13682
  Description of Artificial Sequence: Synthetic oligonucleotide

SEQ ID NO: 366198 - DNA, 34 bp, Artificial Sequence; identical to SEQ ID NO: 13683
  Description of Artificial Sequence: Synthetic oligonucleotide

SEQ ID NO: 366199 - DNA, 34 bp, Artificial Sequence; identical to SEQ ID NO: 13684
  Description of Artificial Sequence: Synthetic oligonucleotide

SEQ ID NO: 366200 - DNA, 33 bp, Artificial Sequence; identical to SEQ ID NO: 13685
  Description of Artificial Sequence: Synthetic oligonucleotide

SEQ ID NO: 366201 - DNA, 34 bp, Artificial Sequence; identical to SEQ ID NO: 13686
  Description of Artificial Sequence: Synthetic oligonucleotide

SEQ ID NO: 366202 - DNA, 33 bp, Artificial Sequence; identical to SEQ ID NO: 13687
  Description of Artificial Sequence: Synthetic oligonucleotide

SEQ ID NO: 366203 - DNA, 32 bp, Artificial Sequence; identical to SEQ ID NO: 13688
  Description of Artificial Sequence: Synthetic oligonucleotide

SEQ ID NO: 366204 - DNA, 32 bp, Artificial Sequence; identical to SEQ ID NO: 13689
  Description of Artificial Sequence: Synthetic oligonucleotide

SEQ ID NO: 366205 - DNA, 31 bp, Artificial Sequence; identical to SEQ ID NO: 13690
  Description of Artificial Sequence: Synthetic oligonucleotide

SEQ ID NO: 366206 - DNA, 31 bp, Artificial Sequence; identical to SEQ ID NO: 13691
  Description of Artificial Sequence: Synthetic oligonucleotide

SEQ ID NO: 366207 - DNA, 32 bp, Artificial Sequence; identical to SEQ ID NO: 13692
  Description of Artificial Sequence: Synthetic oligonucleotide

SEQ ID NO: 366208 - DNA, 31 bp, Artificial Sequence; identical to SEQ ID NO: 13693
  Description of Artificial Sequence: Synthetic oligonucleotide

SEQ ID NO: 366209 - DNA, 31 bp, Artificial Sequence; identical to SEQ ID NO: 13694
  Description of Artificial Sequence: Synthetic oligonucleotide

SEQ ID NO: 366210 - DNA, 33 bp, Artificial Sequence; identical to SEQ ID NO: 13695
  Description of Artificial Sequence: Synthetic oligonucleotide

SEQ ID NO: 366211 - DNA, 32 bp, Artificial Sequence; identical to SEQ ID NO: 13696
  Description of Artificial Sequence: Synthetic oligonucleotide

SEQ ID NO: 366212 - DNA, 33 bp, Artificial Sequence; identical to SEQ ID NO: 13697
  Description of Artificial Sequence: Synthetic oligonucleotide

SEQ ID NO: 366213 - DNA, 34 bp, Artificial Sequence; identical to SEQ ID NO: 13698
  Description of Artificial Sequence: Synthetic oligonucleotide

SEQ ID NO: 366214 - DNA, 33 bp, Artificial Sequence; identical to SEQ ID NO: 13699
  Description of Artificial Sequence: Synthetic oligonucleotide

SEQ ID NO: 366215 - DNA, 32 bp, Artificial Sequence; identical to SEQ ID NO: 13700
  Description of Artificial Sequence: Synthetic oligonucleotide

SEQ ID NO: 366216 - DNA, 32 bp, Artificial Sequence; identical to SEQ ID NO: 13701
  Description of Artificial Sequence: Synthetic oligonucleotide

SEQ ID NO: 366217 - DNA, 32 bp, Artificial Sequence; identical to SEQ ID NO: 13702
  Description of Artificial Sequence: Synthetic oligonucleotide

SEQ ID NO: 366218 - DNA, 33 bp, Artificial Sequence; identical to SEQ ID NO: 13703
  Description of Artificial Sequence: Synthetic oligonucleotide

SEQ ID NO: 366219 - DNA, 32 bp, Artificial Sequence; identical to SEQ ID NO: 13704
  Description of Artificial Sequence: Synthetic oligonucleotide

SEQ ID NO: 366220 - DNA, 33 bp, Artificial Sequence; identical to SEQ ID NO: 13705
  Description of Artificial Sequence: Synthetic oligonucleotide

SEQ ID NO: 366221 - DNA, 33 bp, Artificial Sequence; identical to SEQ ID NO: 13706
  Description of Artificial Sequence: Synthetic oligonucleotide

SEQ ID NO: 366222 - DNA, 33 bp, Artificial Sequence; identical to SEQ ID NO: 13707
  Description of Artificial Sequence: Synthetic oligonucleotide

SEQ ID NO: 366223 - DNA, 32 bp, Artificial Sequence; identical to SEQ ID NO: 13708
  Description of Artificial Sequence: Synthetic oligonucleotide

SEQ ID NO: 366224 - DNA, 29 bp, Artificial Sequence
  Description of Artificial Sequence: Synthetic oligonucleotide
cactcacagactgaccgagagaacctgag

SEQ ID NO: 366225 - DNA, 29 bp, Artificial Sequence
  Description of Artificial Sequence: Synthetic oligonucleotide
actcacagactgaccgagagaacctgagg

SEQ ID NO: 366226 - DNA, 28 bp, Artificial Sequence
  Description of Artificial Sequence: Synthetic oligonucleotide
ctcacagactgaccgagagaacctgagg

SEQ ID NO: 366227 - DNA, 30 bp, Artificial Sequence
  Description of Artificial Sequence: Synthetic oligonucleotide
tcacagactgaccgagagaacctgaggatc

SEQ ID NO: 366228 - DNA, 29 bp, Artificial Sequence
  Description of Artificial Sequence: Synthetic oligonucleotide
cacagactgaccgagagaacctgaggatc

SEQ ID NO: 366229 - DNA, 29 bp, Artificial Sequence
  Description of Artificial Sequence: Synthetic oligonucleotide
acagactgaccgagagaacctgaggatcg

SEQ ID NO: 366230 - DNA, 28 bp, Artificial Sequence
  Description of Artificial Sequence: Synthetic oligonucleotide
cagactgaccgagagaacctgaggatcg

SEQ ID NO: 366231 - DNA, 28 bp, Artificial Sequence
  Description of Artificial Sequence: Synthetic oligonucleotide
agactgaccgagagaacctgaggatcgc

SEQ ID NO: 366232 - DNA, 27 bp, Artificial Sequence
  Description of Artificial Sequence: Synthetic oligonucleotide
gactgaccgagagaacctgaggatcgc

SEQ ID NO: 366233 - DNA, 27 bp, Artificial Sequence
  Description of Artificial Sequence: Synthetic oligonucleotide
actgaccgagagaacctgaggatcgcg

SEQ ID NO: 366234 - DNA, 26 bp, Artificial Sequence
  Description of Artificial Sequence: Synthetic oligonucleotide
ctgaccgagagaacctgaggatcgcg

SEQ ID NO: 366235 - DNA, 27 bp, Artificial Sequence
  Description of Artificial Sequence: Synthetic oligonucleotide
tgaccgagagaacctgaggatcgcgct

SEQ ID NO: 366236 - DNA, 26 bp, Artificial Sequence
  Description of Artificial Sequence: Synthetic oligonucleotide
gaccgagagaacctgaggatcgcgct

SEQ ID NO: 366237 - DNA, 26 bp, Artificial Sequence
  Description of Artificial Sequence: Synthetic oligonucleotide
accgagagaacctgaggatcgcgctc

SEQ ID NO: 366238 - DNA, 25 bp, Artificial Sequence
  Description of Artificial Sequence: Synthetic oligonucleotide
ccgagagaacctgaggatcgcgctc

SEQ ID NO: 366239 - DNA, 25 bp, Artificial Sequence
  Description of Artificial Sequence: Synthetic oligonucleotide
cgagagaacctgaggatcgcgctcc

SEQ ID NO: 366240 - DNA, 25 bp, Artificial Sequence
  Description of Artificial Sequence: Synthetic oligonucleotide
gagagaacctgaggatcgcgctccg

SEQ ID NO: 366241 - DNA, 27 bp, Artificial Sequence
  Description of Artificial Sequence: Synthetic oligonucleotide
agagaacctgaggatcgcgctccgcta

SEQ ID NO: 366242 - DNA, 26 bp, Artificial Sequence
  Description of Artificial Sequence: Synthetic oligonucleotide
gagaacctgaggatcgcgctccgcta

SEQ ID NO: 366243 - DNA, 27 bp, Artificial Sequence
  Description of Artificial Sequence: Synthetic oligonucleotide
agaacctgaggatcgcgctccgctact

SEQ ID NO: 366244 - DNA, 27 bp, Artificial Sequence
  Description of Artificial Sequence: Synthetic oligonucleotide
gaacctgaggatcgcgctccgctacta

SEQ ID NO: 366245 - DNA, 27 bp, Artificial Sequence
  Description of Artificial Sequence: Synthetic oligonucleotide
aacctgaggatcgcgctccgctactac

SEQ ID NO: 366246 - DNA, 27 bp, Artificial Sequence
  Description of Artificial Sequence: Synthetic oligonucleotide
acctgaggatcgcgctccgctactaca

SEQ ID NO: 366247 - DNA, 27 bp, Artificial Sequence
  Description of Artificial Sequence: Synthetic oligonucleotide
cctgaggatcgcgctccgctactacaa

SEQ ID NO: 366248 - DNA, 27 bp, Artificial Sequence
  Description of Artificial Sequence: Synthetic oligonucleotide
ctgaggatcgcgctccgctactacaac

SEQ ID NO: 366249 - DNA, 27 bp, Artificial Sequence
  Description of Artificial Sequence: Synthetic oligonucleotide
tgaggatcgcgctccgctactacaacc

SEQ ID NO: 366250 - DNA, 27 bp, Artificial Sequence
  Description of Artificial Sequence: Synthetic oligonucleotide
gaggatcgcgctccgctactacaacca

SEQ ID NO: 366251 - DNA, 27 bp, Artificial Sequence
  Description of Artificial Sequence: Synthetic oligonucleotide
aggatcgcgctccgctactacaaccag

SEQ ID NO: 366252 - DNA, 27 bp, Artificial Sequence
  Description of Artificial Sequence: Synthetic oligonucleotide
cagttgagagcctacctggagggcaca

SEQ ID NO: 366253 - DNA, 28 bp, Artificial Sequence
  Description of Artificial Sequence: Synthetic oligonucleotide
agttgagagcctacctggagggcacatg

SEQ ID NO: 366254 - DNA, 27 bp, Artificial Sequence
  Description of Artificial Sequence: Synthetic oligonucleotide
gttgagagcctacctggagggcacatg

SEQ ID NO: 366255 - DNA, 27 bp, Artificial Sequence
  Description of Artificial Sequence: Synthetic oligonucleotide
ttgagagcctacctggagggcacatgc

SEQ ID NO: 366256 - DNA, 26 bp, Artificial Sequence
  Description of Artificial Sequence: Synthetic oligonucleotide
tgagagcctacctggagggcacatgc

SEQ ID NO: 366257 - DNA, 25 bp, Artificial Sequence
  Description of Artificial Sequence: Synthetic oligonucleotide
gagagcctacctggagggcacatgc

SEQ ID NO: 366258 - DNA, 26 bp, Artificial Sequence
  Description of Artificial Sequence: Synthetic oligonucleotide
agagcctacctggagggcacatgcgt

SEQ ID NO: 366259 - DNA, 25 bp, Artificial Sequence
  Description of Artificial Sequence: Synthetic oligonucleotide
gagcctacctggagggcacatgcgt

SEQ ID NO: 366260 - DNA, 25 bp, Artificial Sequence
  Description of Artificial Sequence: Synthetic oligonucleotide
agcctacctggagggcacatgcgtg

SEQ ID NO: 366261 - DNA, 24 bp, Artificial Sequence
  Description of Artificial Sequence: Synthetic oligonucleotide
gcctacctggagggcacatgcgtg

SEQ ID NO: 366262 - DNA, 25 bp, Artificial Sequence
  Description of Artificial Sequence: Synthetic oligonucleotide
cctacctggagggcacatgcgtgga

SEQ ID NO: 366263 - DNA, 25 bp, Artificial Sequence
  Description of Artificial Sequence: Synthetic oligonucleotide
ctacctggagggcacatgcgtggac

SEQ ID NO: 366264 - DNA, 25 bp, Artificial Sequence
  Description of Artificial Sequence: Synthetic oligonucleotide
tacctggagggcacatgcgtggacg

SEQ ID NO: 366265 - DNA, 24 bp, Artificial Sequence
  Description of Artificial Sequence: Synthetic oligonucleotide
acctggagggcacatgcgtggacg

SEQ ID NO: 366266 - DNA, 23 bp, Artificial Sequence
  Description of Artificial Sequence: Synthetic oligonucleotide
cctggagggcacatgcgtggacg

SEQ ID NO: 366267 - DNA, 23 bp, Artificial Sequence
  Description of Artificial Sequence: Synthetic oligonucleotide
ctggagggcacatgcgtggacgg

SEQ ID NO: 366268 - DNA, 23 bp, Artificial Sequence
  Description of Artificial Sequence: Synthetic oligonucleotide
tggagggcacatgcgtggacggg

SEQ ID NO: 366269 - DNA, 22 bp, Artificial Sequence
  Description of Artificial Sequence: Synthetic oligonucleotide
ggagggcacatgcgtggacggg

SEQ ID NO: 366270 - DNA, 23 bp, Artificial Sequence
  Description of Artificial Sequence: Synthetic oligonucleotide
gagggcacatgcgtggacgggct

SEQ ID NO: 366271 - DNA, 23 bp, Artificial Sequence
  Description of Artificial Sequence: Synthetic oligonucleotide
agggcacatgcgtggacgggctc

SEQ ID NO: 366272 - DNA, 22 bp, Artificial Sequence
  Description of Artificial Sequence: Synthetic oligonucleotide
gggcacatgcgtggacgggctc

SEQ ID NO: 366273 - DNA, 22 bp, Artificial Sequence
  Description of Artificial Sequence: Synthetic oligonucleotide
ggcacatgcgtggacgggctcc

SEQ ID NO: 366274 - DNA, 22 bp, Artificial Sequence
  Description of Artificial Sequence: Synthetic oligonucleotide
gcacatgcgtggacgggctccg

SEQ ID NO: 366275 - DNA, 23 bp, Artificial Sequence
  Description of Artificial Sequence: Synthetic oligonucleotide
cacatgcgtggacgggctccgca

SEQ ID NO: 366276 - DNA, 26 bp, Artificial Sequence
  Description of Artificial Sequence: Synthetic oligonucleotide
acatgcgtggacgggctccgcagata

SEQ ID NO: 366277 - DNA, 25 bp, Artificial Sequence
  Description of Artificial Sequence: Synthetic oligonucleotide
catgcgtggacgggctccgcagata

SEQ ID NO: 366278 - DNA, 25 bp, Artificial Sequence
  Description of Artificial Sequence: Synthetic oligonucleotide
atgcgtggacgggctccgcagatac

SEQ ID NO: 366279 - DNA, 28 bp, Artificial Sequence
  Description of Artificial Sequence: Synthetic oligonucleotide
atacacctgccatgtgcagcatgagggg

SEQ ID NO: 366280 - DNA, 27 bp, Artificial Sequence
  Description of Artificial Sequence: Synthetic oligonucleotide
tacacctgccatgtgcagcatgagggg

SEQ ID NO: 366281 - DNA, 26 bp, Artificial Sequence
  Description of Artificial Sequence: Synthetic oligonucleotide
acacctgccatgtgcagcatgagggg

SEQ ID NO: 366282 - DNA, 25 bp, Artificial Sequence
  Description of Artificial Sequence: Synthetic oligonucleotide
cacctgccatgtgcagcatgagggg

SEQ ID NO: 366283 - DNA, 26 bp, Artificial Sequence
  Description of Artificial Sequence: Synthetic oligonucleotide
acctgccatgtgcagcatgaggggct

SEQ ID NO: 366284 - DNA, 25 bp, Artificial Sequence
  Description of Artificial Sequence: Synthetic oligonucleotide
cctgccatgtgcagcatgaggggct

SEQ ID NO: 366285 - DNA, 25 bp, Artificial Sequence
  Description of Artificial Sequence: Synthetic oligonucleotide
ctgccatgtgcagcatgaggggctg

SEQ ID NO: 366286 - DNA, 25 bp, Artificial Sequence
  Description of Artificial Sequence: Synthetic oligonucleotide
tgccatgtgcagcatgaggggctgc

SEQ ID NO: 366287 - DNA, 24 bp, Artificial Sequence
  Description of Artificial Sequence: Synthetic oligonucleotide
gccatgtgcagcatgaggggctgc

SEQ ID NO: 366288 - DNA, 24 bp, Artificial Sequence
  Description of Artificial Sequence: Synthetic oligonucleotide
ccatgtgcagcatgaggggctgcc

SEQ ID NO: 366289 - DNA, 26 bp, Artificial Sequence
  Description of Artificial Sequence: Synthetic oligonucleotide
catgtgcagcatgaggggctgcccaa

SEQ ID NO: 366290 - DNA, 26 bp, Artificial Sequence
  Description of Artificial Sequence: Synthetic oligonucleotide
atgtgcagcatgaggggctgcccaag

SEQ ID NO: 366291 - DNA, 25 bp, Artificial Sequence
  Description of Artificial Sequence: Synthetic oligonucleotide
tgtgcagcatgaggggctgcccaag

SEQ ID NO: 366292 - DNA, 24 bp, Artificial Sequence
  Description of Artificial Sequence: Synthetic oligonucleotide
gtgcagcatgaggggctgcccaag

SEQ ID NO: 366293 - DNA, 24 bp, Artificial Sequence
  Description of Artificial Sequence: Synthetic oligonucleotide
tgcagcatgaggggctgcccaagc

SEQ ID NO: 366294 - DNA, 23 bp, Artificial Sequence
  Description of Artificial Sequence: Synthetic oligonucleotide
gcagcatgaggggctgcccaagc

SEQ ID NO: 366295 - DNA, 23 bp, Artificial Sequence
  Description of Artificial Sequence: Synthetic oligonucleotide
cagcatgaggggctgcccaagcc

SEQ ID NO: 366296 - DNA, 23 bp, Artificial Sequence
  Description of Artificial Sequence: Synthetic oligonucleotide
agcatgaggggctgcccaagccc

SEQ ID NO: 366297 - DNA, 22 bp, Artificial Sequence
  Description of Artificial Sequence: Synthetic oligonucleotide
gcatgaggggctgcccaagccc

SEQ ID NO: 366298 - DNA, 23 bp, Artificial Sequence
  Description of Artificial Sequence: Synthetic oligonucleotide
catgaggggctgcccaagcccct

SEQ ID NO: 366299 - DNA, 24 bp, Artificial Sequence
  Description of Artificial Sequence: Synthetic oligonucleotide
atgaggggctgcccaagcccctca

SEQ ID NO: 366300 - DNA, 23 bp, Artificial Sequence
  Description of Artificial Sequence: Synthetic oligonucleotide
tgaggggctgcccaagcccctca

SEQ ID NO: 366301 - DNA, 22 bp, Artificial Sequence
  Description of Artificial Sequence: Synthetic oligonucleotide
gaggggctgcccaagcccctca

SEQ ID NO: 366302 - DNA, 22 bp, Artificial Sequence
  Description of Artificial Sequence: Synthetic oligonucleotide
aggggctgcccaagcccctcac

SEQ ID NO: 366303 - DNA, 21 bp, Artificial Sequence
  Description of Artificial Sequence: Synthetic oligonucleotide
ggggctgcccaagcccctcac

SEQ ID NO: 366304 - DNA, 21 bp, Artificial Sequence
  Description of Artificial Sequence: Synthetic oligonucleotide
gggctgcccaagcccctcacc

SEQ ID NO: 366305 - DNA, 22 bp, Artificial Sequence
  Description of Artificial Sequence: Synthetic oligonucleotide
ggctgcccaagcccctcaccct

SEQ ID NO: 366306 - DNA, 23 bp, Artificial Sequence
  Description of Artificial Sequence: Synthetic oligonucleotide
gctgcccaagcccctcaccctga

SEQ ID NO: 366307 - DNA, 21 bp, Artificial Sequence
  Description of Artificial Sequence: Synthetic oligonucleotide
ctgcgctcttggaccgcggcc

SEQ ID NO: 366308 - DNA, 22 bp, Artificial Sequence
  Description of Artificial Sequence: Synthetic oligonucleotide
tgcgctcttggaccgcggccga

SEQ ID NO: 366309 - DNA, 21 bp, Artificial Sequence
  Description of Artificial Sequence: Synthetic oligonucleotide
gcgctcttggaccgcggccga

SEQ ID NO: 366310 - DNA, 23 bp, Artificial Sequence
  Description of Artificial Sequence: Synthetic oligonucleotide
cgctcttggaccgcggccgacat

SEQ ID NO: 366311 - DNA, 23 bp, Artificial Sequence
  Description of Artificial Sequence: Synthetic oligonucleotide
gctcttggaccgcggccgacatg

SEQ ID NO: 366312 - DNA, 23 bp, Artificial Sequence
  Description of Artificial Sequence: Synthetic oligonucleotide
ctcttggaccgcggccgacatgg

SEQ ID NO: 366313 - DNA, 23 bp, Artificial Sequence
  Description of Artificial Sequence: Synthetic oligonucleotide
tcttggaccgcggccgacatggc

SEQ ID NO: 366314 - DNA, 22 bp, Artificial Sequence
  Description of Artificial Sequence: Synthetic oligonucleotide
cttggaccgcggccgacatggc

SEQ ID NO: 366315 - DNA, 22 bp, Artificial Sequence
  Description of Artificial Sequence: Synthetic oligonucleotide
ttggaccgcggccgacatggcg

SEQ ID NO: 366316 - DNA, 21 bp, Artificial Sequence
  Description of Artificial Sequence: Synthetic oligonucleotide
tggaccgcggccgacatggcg

SEQ ID NO: 366317 - DNA, 20 bp, Artificial Sequence
  Description of Artificial Sequence: Synthetic oligonucleotide
ggaccgcggccgacatggcg

SEQ ID NO: 366318 - DNA, 20 bp, Artificial Sequence
  Description of Artificial Sequence: Synthetic oligonucleotide
gaccgcggccgacatggcgg

SEQ ID NO: 366319 - DNA, 21 bp, Artificial Sequence
  Description of Artificial Sequence: Synthetic oligonucleotide
accgcggccgacatggcggct

SEQ ID NO: 366320 - DNA, 20 bp, Artificial Sequence
  Description of Artificial Sequence: Synthetic oligonucleotide
ccgcggccgacatggcggct

SEQ ID NO: 366321 - DNA, 21 bp, Artificial Sequence
  Description of Artificial Sequence: Synthetic oligonucleotide
cgcggccgacatggcggctca

SEQ ID NO: 366322 - DNA, 23 bp, Artificial Sequence
  Description of Artificial Sequence: Synthetic oligonucleotide
gcggccgacatggcggctcagat

SEQ ID NO: 366323 - DNA, 24 bp, Artificial Sequence
  Description of Artificial Sequence: Synthetic oligonucleotide
cggccgacatggcggctcagatca

SEQ ID NO: 366324 - DNA, 24 bp, Artificial Sequence
  Description of Artificial Sequence: Synthetic oligonucleotide
ggccgacatggcggctcagatcac

SEQ ID NO: 366325 - DNA, 24 bp, Artificial Sequence
  Description of Artificial Sequence: Synthetic oligonucleotide
gccgacatggcggctcagatcacc

SEQ ID NO: 366326 - DNA, 25 bp, Artificial Sequence
  Description of Artificial Sequence: Synthetic oligonucleotide
ccgacatggcggctcagatcaccca

SEQ ID NO: 366327 - DNA, 25 bp, Artificial Sequence
  Description of Artificial Sequence: Synthetic oligonucleotide
cgacatggcggctcagatcacccag

SEQ ID NO: 366328 - DNA, 32 bp, Artificial Sequence
  Description of Artificial Sequence: Synthetic oligonucleotide
gctcccactccatgagatatttctccacatcc

SEQ ID NO: 366329 - DNA, 32 bp, Artificial Sequence
  Description of Artificial Sequence: Synthetic oligonucleotide
ctcccactccatgagatatttctccacatccg

SEQ ID NO: 366330 - DNA, 33 bp, Artificial Sequence
  Description of Artificial Sequence: Synthetic oligonucleotide
tcccactccatgagatatttctccacatccgtg

SEQ ID NO: 366331 - DNA, 32 bp, Artificial Sequence
  Description of Artificial Sequence: Synthetic oligonucleotide
cccactccatgagatatttctccacatccgtg

SEQ ID NO: 366332 - DNA, 33 bp, Artificial Sequence
  Description of Artificial Sequence: Synthetic oligonucleotide
ccactccatgagatatttctccacatccgtgtc

SEQ ID NO: 366333 - DNA, 33 bp, Artificial Sequence
  Description of Artificial Sequence: Synthetic oligonucleotide
cactccatgagatatttctccacatccgtgtcc

SEQ ID NO: 366334 - DNA, 33 bp, Artificial Sequence
  Description of Artificial Sequence: Synthetic oligonucleotide
actccatgagatatttctccacatccgtgtccc

SEQ ID NO: 366335 - DNA, 32 bp, Artificial Sequence
  Description of Artificial Sequence: Synthetic oligonucleotide
ctccatgagatatttctccacatccgtgtccc

SEQ ID NO: 366336 - DNA, 32 bp, Artificial Sequence
  Description of Artificial Sequence: Synthetic oligonucleotide
tccatgagatatttctccacatccgtgtcccg

SEQ ID NO: 366337 - DNA, 31 bp, Artificial Sequence
  Description of Artificial Sequence: Synthetic oligonucleotide
ccatgagatatttctccacatccgtgtcccg

SEQ ID NO: 366338 - DNA, 31 bp, Artificial Sequence
  Description of Artificial Sequence: Synthetic oligonucleotide
catgagatatttctccacatccgtgtcccgg

SEQ ID NO: 366339 - DNA, 31 bp, Artificial Sequence
  Description of Artificial Sequence: Synthetic oligonucleotide
atgagatatttctccacatccgtgtcccggc

SEQ ID NO: 366340 - DNA, 30 bp, Artificial Sequence
  Description of Artificial Sequence: Synthetic oligonucleotide
tgagatatttctccacatccgtgtcccggc

SEQ ID NO: 366341 - DNA, 29 bp, Artificial Sequence
  Description of Artificial Sequence: Synthetic oligonucleotide
gagatatttctccacatccgtgtcccggc

SEQ ID NO: 366342 - DNA, 29 bp, Artificial Sequence
  Description of Artificial Sequence: Synthetic oligonucleotide
agatatttctccacatccgtgtcccggcc

SEQ ID NO: 366343 - DNA, 28 bp, Artificial Sequence
  Description of Artificial Sequence: Synthetic oligonucleotide
gatatttctccacatccgtgtcccggcc

SEQ ID NO: 366344 - DNA, 28 bp, Artificial Sequence
  Description of Artificial Sequence: Synthetic oligonucleotide
atatttctccacatccgtgtcccggccc

SEQ ID NO: 366345 - DNA, 21 bp, Artificial Sequence
  Description of Artificial Sequence: Synthetic oligonucleotide
cggcccgtgtggcggagcagt

SEQ ID NO: 366346 - DNA, 21 bp, Artificial Sequence
  Description of Artificial Sequence: Synthetic oligonucleotide
ggcccgtgtggcggagcagtg

SEQ ID NO: 366347 - DNA, 22 bp, Artificial Sequence
  Description of Artificial Sequence: Synthetic oligonucleotide
gcccgtgtggcggagcagtgga

SEQ ID NO: 366348 - DNA, 23 bp, Artificial Sequence
  Description of Artificial Sequence: Synthetic oligonucleotide
cccgtgtggcggagcagtggaga

SEQ ID NO: 366349 - DNA, 23 bp, Artificial Sequence
  Description of Artificial Sequence: Synthetic oligonucleotide
ccgtgtggcggagcagtggagag

SEQ ID NO: 366350 - DNA, 23 bp, Artificial Sequence
  Description of Artificial Sequence: Synthetic oligonucleotide
cgtgtggcggagcagtggagagc

SEQ ID NO: 366351 - DNA, 25 bp, Artificial Sequence
  Description of Artificial Sequence: Synthetic oligonucleotide
gtgtggcggagcagtggagagccta

SEQ ID NO: 366352 - DNA, 28 bp, Artificial Sequence
  Description of Artificial Sequence: Synthetic oligonucleotide
gctcccactccatgaggtgtttctccac

SEQ ID NO: 366353 - DNA, 30 bp, Artificial Sequence; identical to SEQ ID NO: 13717
  Description of Artificial Sequence: Synthetic oligonucleotide

SEQ ID NO: 366354 - DNA, 30 bp, Artificial Sequence; identical to SEQ ID NO: 13718
  Description of Artificial Sequence: Synthetic oligonucleotide

SEQ ID NO: 366355 - DNA, 29 bp, Artificial Sequence
  Description of Artificial Sequence: Synthetic oligonucleotide
cccactccatgaggtgtttctccacatcc

SEQ ID NO: 366356 - DNA, 29 bp, Artificial Sequence
  Description of Artificial Sequence: Synthetic oligonucleotide
ccactccatgaggtgtttctccacatccg

SEQ ID NO: 366357 - DNA, 30 bp, Artificial Sequence; identical to SEQ ID NO: 13721
  Description of Artificial Sequence: Synthetic oligonucleotide

SEQ ID NO: 366358 - DNA, 31 bp, Artificial Sequence; identical to SEQ ID NO: 13722
  Description of Artificial Sequence: Synthetic oligonucleotide

SEQ ID NO: 366359 - DNA, 30 bp, Artificial Sequence; identical to SEQ ID NO: 13723
  Description of Artificial Sequence: Synthetic oligonucleotide

SEQ ID NO: 366360 - DNA, 30 bp, Artificial Sequence; identical to SEQ ID NO: 13724
  Description of Artificial Sequence: Synthetic oligonucleotide

SEQ ID NO: 366361 - DNA, 29 bp, Artificial Sequence
  Description of Artificial Sequence: Synthetic oligonucleotide
ccatgaggtgtttctccacatccgtgtcc

SEQ ID NO: 366362 - DNA, 29 bp, Artificial Sequence
  Description of Artificial Sequence: Synthetic oligonucleotide
catgaggtgtttctccacatccgtgtccc

SEQ ID NO: 366363 - DNA, 29 bp, Artificial Sequence
  Description of Artificial Sequence: Synthetic oligonucleotide
atgaggtgtttctccacatccgtgtcccg

SEQ ID NO: 366364 - DNA, 28 bp, Artificial Sequence
  Description of Artificial Sequence: Synthetic oligonucleotide
tgaggtgtttctccacatccgtgtcccg

SEQ ID NO: 366365 - DNA, 27 bp, Artificial Sequence
  Description of Artificial Sequence: Synthetic oligonucleotide
gaggtgtttctccacatccgtgtcccg

SEQ ID NO: 366366 - DNA, 27 bp, Artificial Sequence
  Description of Artificial Sequence: Synthetic oligonucleotide
aggtgtttctccacatccgtgtcccgg

SEQ ID NO: 366367 - DNA, 26 bp, Artificial Sequence
  Description of Artificial Sequence: Synthetic oligonucleotide
ggtgtttctccacatccgtgtcccgg

SEQ ID NO: 366368 - DNA, 26 bp, Artificial Sequence
  Description of Artificial Sequence: Synthetic oligonucleotide
gtgtttctccacatccgtgtcccggc

SEQ ID NO: 366369 - DNA, 26 bp, Artificial Sequence
  Description of Artificial Sequence: Synthetic oligonucleotide
tgtttctccacatccgtgtcccggcc

SEQ ID NO: 366370 - DNA, 25 bp, Artificial Sequence
  Description of Artificial Sequence: Synthetic oligonucleotide
gtttctccacatccgtgtcccggcc

SEQ ID NO: 366371 - DNA, 24 bp, Artificial Sequence
  Description of Artificial Sequence: Synthetic oligonucleotide
agccatcttcccagcccaccgtcc

SEQ ID NO: 366372 - DNA, 23 bp, Artificial Sequence
  Description of Artificial Sequence: Synthetic oligonucleotide
gccatcttcccagcccaccgtcc

SEQ ID NO: 366373 - DNA, 23 bp, Artificial Sequence
  Description of Artificial Sequence: Synthetic oligonucleotide
ccatcttcccagcccaccgtccc

SEQ ID NO: 366374 - DNA, 25 bp, Artificial Sequence
  Description of Artificial Sequence: Synthetic oligonucleotide
catcttcccagcccaccgtccccat

SEQ ID NO: 366375 - DNA, 25 bp, Artificial Sequence
  Description of Artificial Sequence: Synthetic oligonucleotide
atcttcccagcccaccgtccccatc

SEQ ID NO: 366376 - DNA, 24 bp, Artificial Sequence
  Description of Artificial Sequence: Synthetic oligonucleotide
tcttcccagcccaccgtccccatc

SEQ ID NO: 366377 - DNA, 23 bp, Artificial Sequence
  Description of Artificial Sequence: Synthetic oligonucleotide
cttcccagcccaccgtccccatc

SEQ ID NO: 366378 - DNA, 24 bp, Artificial Sequence
  Description of Artificial Sequence: Synthetic oligonucleotide
ttcccagcccaccgtccccatcgt

SEQ ID NO: 366379 - DNA, 23 bp, Artificial Sequence
  Description of Artificial Sequence: Synthetic oligonucleotide
tcccagcccaccgtccccatcgt

SEQ ID NO: 366380 - DNA, 22 bp, Artificial Sequence
  Description of Artificial Sequence: Synthetic oligonucleotide
cccagcccaccgtccccatcgt

SEQ ID NO: 366381 - DNA, 22 bp, Artificial Sequence
  Description of Artificial Sequence: Synthetic oligonucleotide
ccagcccaccgtccccatcgtg

SEQ ID NO: 366382 - DNA, 22 bp, Artificial Sequence
  Description of Artificial Sequence: Synthetic oligonucleotide
cagcccaccgtccccatcgtgg

SEQ ID NO: 366383 - DNA, 22 bp, Artificial Sequence
  Description of Artificial Sequence: Synthetic oligonucleotide
agcccaccgtccccatcgtggg

SEQ ID NO: 366384 - DNA, 21 bp, Artificial Sequence
  Description of Artificial Sequence: Synthetic oligonucleotide
gcccaccgtccccatcgtggg

SEQ ID NO: 366385 - DNA, 23 bp, Artificial Sequence
  Description of Artificial Sequence: Synthetic oligonucleotide
cccaccgtccccatcgtgggcat

SEQ ID NO: 366386 - DNA, 26 bp, Artificial Sequence
  Description of Artificial Sequence: Synthetic oligonucleotide
ccaccgtccccatcgtgggcatcatt

SEQ ID NO: 366387 - DNA, 26 bp, Artificial Sequence
  Description of Artificial Sequence: Synthetic oligonucleotide
caccgtccccatcgtgggcatcattg

SEQ ID NO: 366388 - DNA, 27 bp, Artificial Sequence
  Description of Artificial Sequence: Synthetic oligonucleotide
accgtccccatcgtgggcatcattgct

SEQ ID NO: 366389 - DNA, 26 bp, Artificial Sequence
  Description of Artificial Sequence: Synthetic oligonucleotide
ccgtccccatcgtgggcatcattgct

SEQ ID NO: 366390 - DNA, 26 bp, Artificial Sequence
  Description of Artificial Sequence: Synthetic oligonucleotide
cgtccccatcgtgggcatcattgctg

SEQ ID NO: 366391 - DNA, 26 bp, Artificial Sequence
  Description of Artificial Sequence: Synthetic oligonucleotide
gtccccatcgtgggcatcattgctgg

SEQ ID NO: 366392 - DNA, 26 bp, Artificial Sequence
  Description of Artificial Sequence: Synthetic oligonucleotide
gcttcctccgcgggtaccaccagtat

SEQ ID NO: 366393 - DNA, 26 bp, Artificial Sequence
  Description of Artificial Sequence: Synthetic oligonucleotide
cttcctccgcgggtaccaccagtatg

SEQ ID NO: 366394 - DNA, 26 bp, Artificial Sequence
  Description of Artificial Sequence: Synthetic oligonucleotide
ttcctccgcgggtaccaccagtatgc

SEQ ID NO: 366395 - DNA, 25 bp, Artificial Sequence
  Description of Artificial Sequence: Synthetic oligonucleotide
tcctccgcgggtaccaccagtatgc

SEQ ID NO: 366396 - DNA, 24 bp, Artificial Sequence
  Description of Artificial Sequence: Synthetic oligonucleotide
cctccgcgggtaccaccagtatgc

SEQ ID NO: 366397 - DNA, 26 bp, Artificial Sequence
  Description of Artificial Sequence: Synthetic oligonucleotide
ctccgcgggtaccaccagtatgccta

SEQ ID NO: 366398 - DNA, 26 bp, Artificial Sequence
  Description of Artificial Sequence: Synthetic oligonucleotide
tccgcgggtaccaccagtatgcctac

SEQ ID NO: 366399 - DNA, 25 bp, Artificial Sequence
  Description of Artificial Sequence: Synthetic oligonucleotide
ccgcgggtaccaccagtatgcctac

SEQ ID NO: 366400 - DNA, 26 bp, Artificial Sequence
  Description of Artificial Sequence: Synthetic oligonucleotide
cgcgggtaccaccagtatgcctacga

SEQ ID NO: 366401 - DNA, 26 bp, Artificial Sequence
  Description of Artificial Sequence: Synthetic oligonucleotide
gcgggtaccaccagtatgcctacgac

SEQ ID NO: 366402 - DNA, 26 bp, Artificial Sequence
  Description of Artificial Sequence: Synthetic oligonucleotide
cgggtaccaccagtatgcctacgacg

SEQ ID NO: 366403 - DNA, 26 bp, Artificial Sequence
  Description of Artificial Sequence: Synthetic oligonucleotide
gggtaccaccagtatgcctacgacgg

SEQ ID NO: 366404 - DNA, 27 bp, Artificial Sequence
  Description of Artificial Sequence: Synthetic oligonucleotide
ggtaccaccagtatgcctacgacggca

SEQ ID NO: 366405 - DNA, 28 bp, Artificial Sequence
  Description of Artificial Sequence: Synthetic oligonucleotide
gtaccaccagtatgcctacgacggcaag

SEQ ID NO: 366406 - DNA, 28 bp, Artificial Sequence
  Description of Artificial Sequence: Synthetic oligonucleotide
taccaccagtatgcctacgacggcaagg

SEQ ID NO: 366407 - DNA, 27 bp, Artificial Sequence
  Description of Artificial Sequence: Synthetic oligonucleotide
accaccagtatgcctacgacggcaagg

SEQ ID NO: 366408 - DNA, 27 bp, Artificial Sequence
  Description of Artificial Sequence: Synthetic oligonucleotide
ccaccagtatgcctacgacggcaagga

SEQ ID NO: 366409 - DNA, 30 bp, Artificial Sequence; identical to SEQ ID NO: 14088
  Description of Artificial Sequence: Synthetic oligonucleotide

SEQ ID NO: 366410 - DNA, 32 bp, Artificial Sequence; identical to SEQ ID NO: 14089
  Description of Artificial Sequence: Synthetic oligonucleotide

SEQ ID NO: 366411 - DNA, 31 bp, Artificial Sequence; identical to SEQ ID NO: 14090
  Description of Artificial Sequence: Synthetic oligonucleotide

SEQ ID NO: 366412 - DNA, 31 bp, Artificial Sequence; identical to SEQ ID NO: 5342
  Description of Artificial Sequence: Synthetic oligonucleotide

SEQ ID NO: 366413 - DNA, 31 bp, Artificial Sequence; identical to SEQ ID NO: 5343
  Description of Artificial Sequence: Synthetic oligonucleotide

SEQ ID NO: 366414 - DNA, 30 bp, Artificial Sequence; identical to SEQ ID NO: 5344
  Description of Artificial Sequence: Synthetic oligonucleotide

SEQ ID NO: 366415 - DNA, 30 bp, Artificial Sequence; identical to SEQ ID NO: 5345
  Description of Artificial Sequence: Synthetic oligonucleotide

SEQ ID NO: 366416 - DNA, 29 bp, Artificial Sequence
  Description of Artificial Sequence: Synthetic oligonucleotide
atgcctacgacggcaaggattacatcgcc

SEQ ID NO: 366417 - DNA, 28 bp, Artificial Sequence
  Description of Artificial Sequence: Synthetic oligonucleotide
tgcctacgacggcaaggattacatcgcc

SEQ ID NO: 366418 - DNA, 32 bp, Artificial Sequence; identical to SEQ ID NO: 14091
  Description of Artificial Sequence: Synthetic oligonucleotide

SEQ ID NO: 366419 - DNA, 32 bp, Artificial Sequence; identical to SEQ ID NO: 14092
  Description of Artificial Sequence: Synthetic oligonucleotide

SEQ ID NO: 366420 - DNA, 32 bp, Artificial Sequence; identical to SEQ ID NO: 14093
  Description of Artificial Sequence: Synthetic oligonucleotide

SEQ ID NO: 366421 - DNA, 31 bp, Artificial Sequence; identical to SEQ ID NO: 14094
  Description of Artificial Sequence: Synthetic oligonucleotide

SEQ ID NO: 366422 - DNA, 30 bp, Artificial Sequence; identical to SEQ ID NO: 14095
  Description of Artificial Sequence: Synthetic oligonucleotide

SEQ ID NO: 366423 - DNA, 31 bp, Artificial Sequence; identical to SEQ ID NO: 14096
  Description of Artificial Sequence: Synthetic oligonucleotide

SEQ ID NO: 366424 - DNA, 30 bp, Artificial Sequence; identical to SEQ ID NO: 14097
  Description of Artificial Sequence: Synthetic oligonucleotide

SEQ ID NO: 366425 - DNA, 30 bp, Artificial Sequence; identical to SEQ ID NO: 14098
  Description of Artificial Sequence: Synthetic oligonucleotide

SEQ ID NO: 366426 - DNA, 29 bp, Artificial Sequence
  Description of Artificial Sequence: Synthetic oligonucleotide
caccctccagatgatgtttggttgcgacg

SEQ ID NO: 366427 - DNA, 30 bp, Artificial Sequence; identical to SEQ ID NO: 14100
  Description of Artificial Sequence: Synthetic oligonucleotide

SEQ ID NO: 366428 - DNA, 29 bp, Artificial Sequence
  Description of Artificial Sequence: Synthetic oligonucleotide
ccctccagatgatgtttggttgcgacgtg

SEQ ID NO: 366429 - DNA, 29 bp, Artificial Sequence
  Description of Artificial Sequence: Synthetic oligonucleotide
cctccagatgatgtttggttgcgacgtgg

SEQ ID NO: 366430 - DNA, 29 bp, Artificial Sequence
  Description of Artificial Sequence: Synthetic oligonucleotide
ctccagatgatgtttggttgcgacgtggg

SEQ ID NO: 366431 - DNA, 29 bp, Artificial Sequence
  Description of Artificial Sequence: Synthetic oligonucleotide
tccagatgatgtttggttgcgacgtgggg

SEQ ID NO: 366432 - DNA, 28 bp, Artificial Sequence
  Description of Artificial Sequence: Synthetic oligonucleotide
ccagatgatgtttggttgcgacgtgggg

SEQ ID NO: 366433 - DNA, 29 bp, Artificial Sequence
  Description of Artificial Sequence: Synthetic oligonucleotide
cagatgatgtttggttgcgacgtggggtc

SEQ ID NO: 366434 - DNA, 29 bp, Artificial Sequence
  Description of Artificial Sequence: Synthetic oligonucleotide
agatgatgtttggttgcgacgtggggtcg

SEQ ID NO: 366435 - DNA, 28 bp, Artificial Sequence
  Description of Artificial Sequence: Synthetic oligonucleotide
gatgatgtttggttgcgacgtggggtcg

SEQ ID NO: 366436 - DNA, 28 bp, Artificial Sequence
  Description of Artificial Sequence: Synthetic oligonucleotide
atgatgtttggttgcgacgtggggtcgg

SEQ ID NO: 366437 - DNA, 27 bp, Artificial Sequence
  Description of Artificial Sequence: Synthetic oligonucleotide
tgatgtttggttgcgacgtggggtcgg

SEQ ID NO: 366438 - DNA, 27 bp, Artificial Sequence
  Description of Artificial Sequence: Synthetic oligonucleotide
gatgtttggttgcgacgtggggtcgga

SEQ ID NO: 366439 - DNA, 27 bp, Artificial Sequence
  Description of Artificial Sequence: Synthetic oligonucleotide
atgtttggttgcgacgtggggtcggac

SEQ ID NO: 366440 - DNA, 26 bp, Artificial Sequence
  Description of Artificial Sequence: Synthetic oligonucleotide
tgtttggttgcgacgtggggtcggac

SEQ ID NO: 366441 - DNA, 25 bp, Artificial Sequence
  Description of Artificial Sequence: Synthetic oligonucleotide
gtttggttgcgacgtggggtcggac

SEQ ID NO: 366442 - DNA, 25 bp, Artificial Sequence
  Description of Artificial Sequence: Synthetic oligonucleotide
tttggttgcgacgtggggtcggacg

SEQ ID NO: 366443 - DNA, 24 bp, Artificial Sequence
  Description of Artificial Sequence: Synthetic oligonucleotide
ttggttgcgacgtggggtcggacg

SEQ ID NO: 366444 - DNA, 23 bp, Artificial Sequence
  Description of Artificial Sequence: Synthetic oligonucleotide
tggttgcgacgtggggtcggacg

SEQ ID NO: 366445 - DNA, 22 bp, Artificial Sequence
  Description of Artificial Sequence: Synthetic oligonucleotide
ggttgcgacgtggggtcggacg

SEQ ID NO: 366446 - DNA, 22 bp, Artificial Sequence
  Description of Artificial Sequence: Synthetic oligonucleotide
gttgcgacgtggggtcggacgg

SEQ ID NO: 366447 - DNA, 22 bp, Artificial Sequence
  Description of Artificial Sequence: Synthetic oligonucleotide
ttgcgacgtggggtcggacggg

SEQ ID NO: 366448 - DNA, 26 bp, Artificial Sequence
  Description of Artificial Sequence: Synthetic oligonucleotide
gtgaaggcccactcacagactgaccg

SEQ ID NO: 366449 - DNA, 26 bp, Artificial Sequence
  Description of Artificial Sequence: Synthetic oligonucleotide
tgaaggcccactcacagactgaccgc

SEQ ID NO: 366450 - DNA, 25 bp, Artificial Sequence
  Description of Artificial Sequence: Synthetic oligonucleotide
gaaggcccactcacagactgaccgc

SEQ ID NO: 366451 - DNA, 26 bp, Artificial Sequence
  Description of Artificial Sequence: Synthetic oligonucleotide
aaggcccactcacagactgaccgcga

SEQ ID NO: 366452 - DNA, 25 bp, Artificial Sequence
  Description of Artificial Sequence: Synthetic oligonucleotide
aggcccactcacagactgaccgcga

SEQ ID NO: 366453 - DNA, 24 bp, Artificial Sequence
  Description of Artificial Sequence: Synthetic oligonucleotide
ggcccactcacagactgaccgcga

SEQ ID NO: 366454 - DNA, 26 bp, Artificial Sequence
  Description of Artificial Sequence: Synthetic oligonucleotide
gcccactcacagactgaccgcgagaa

SEQ ID NO: 366455 - DNA, 26 bp, Artificial Sequence
  Description of Artificial Sequence: Synthetic oligonucleotide
cccactcacagactgaccgcgagaac

SEQ ID NO: 366456 - DNA, 27 bp, Artificial Sequence
  Description of Artificial Sequence: Synthetic oligonucleotide
ccactcacagactgaccgcgagaacct

SEQ ID NO: 366457 - DNA, 27 bp, Artificial Sequence
  Description of Artificial Sequence: Synthetic oligonucleotide
cactcacagactgaccgcgagaacctg

SEQ ID NO: 366458 - DNA, 27 bp, Artificial Sequence
  Description of Artificial Sequence: Synthetic oligonucleotide
actcacagactgaccgcgagaacctgc

SEQ ID NO: 366459 - DNA, 26 bp, Artificial Sequence
  Description of Artificial Sequence: Synthetic oligonucleotide
ctcacagactgaccgcgagaacctgc

SEQ ID NO: 366460 - DNA, 26 bp, Artificial Sequence
  Description of Artificial Sequence: Synthetic oligonucleotide
tcacagactgaccgcgagaacctgcg

SEQ ID NO: 366461 - DNA, 25 bp, Artificial Sequence
  Description of Artificial Sequence: Synthetic oligonucleotide
cacagactgaccgcgagaacctgcg

SEQ ID NO: 366462 - DNA, 27 bp, Artificial Sequence
  Description of Artificial Sequence: Synthetic oligonucleotide
acagactgaccgcgagaacctgcggat

SEQ ID NO: 366463 - DNA, 26 bp, Artificial Sequence
  Description of Artificial Sequence: Synthetic oligonucleotide
cagactgaccgcgagaacctgcggat

SEQ ID NO: 366464 - DNA, 26 bp, Artificial Sequence
  Description of Artificial Sequence: Synthetic oligonucleotide
agactgaccgcgagaacctgcggatc

SEQ ID NO: 366465 - DNA, 25 bp, Artificial Sequence
  Description of Artificial Sequence: Synthetic oligonucleotide
gactgaccgcgagaacctgcggatc

SEQ ID NO: 366466 - DNA, 25 bp, Artificial Sequence
  Description of Artificial Sequence: Synthetic oligonucleotide
actgaccgcgagaacctgcggatcg

SEQ ID NO: 366467 - DNA, 24 bp, Artificial Sequence
  Description of Artificial Sequence: Synthetic oligonucleotide
ctgaccgcgagaacctgcggatcg

SEQ ID NO: 366468 - DNA, 24 bp, Artificial Sequence
  Description of Artificial Sequence: Synthetic oligonucleotide
tgaccgcgagaacctgcggatcgc

SEQ ID NO: 366469 - DNA, 23 bp, Artificial Sequence
  Description of Artificial Sequence: Synthetic oligonucleotide
gaccgcgagaacctgcggatcgc

SEQ ID NO: 366470 - DNA, 23 bp, Artificial Sequence
  Description of Artificial Sequence: Synthetic oligonucleotide
accgcgagaacctgcggatcgcg

SEQ ID NO: 366471 - DNA, 22 bp, Artificial Sequence
  Description of Artificial Sequence: Synthetic oligonucleotide
ccgcgagaacctgcggatcgcg

SEQ ID NO: 366472 - DNA, 23 bp, Artificial Sequence
  Description of Artificial Sequence: Synthetic oligonucleotide
cgcgagaacctgcggatcgcgct

SEQ ID NO: 366473 - DNA, 23 bp, Artificial Sequence
  Description of Artificial Sequence: Synthetic oligonucleotide
gcgagaacctgcggatcgcgctc

SEQ ID NO: 366474 - DNA, 23 bp, Artificial Sequence
  Description of Artificial Sequence: Synthetic oligonucleotide
cgagaacctgcggatcgcgctcc

SEQ ID NO: 366475 - DNA, 23 bp, Artificial Sequence
  Description of Artificial Sequence: Synthetic oligonucleotide
aagcgcaagtgggaggcggccca

SEQ ID NO: 366476 - DNA, 22 bp, Artificial Sequence
  Description of Artificial Sequence: Synthetic oligonucleotide
agcgcaagtgggaggcggccca

SEQ ID NO: 366477 - DNA, 21 bp, Artificial Sequence
  Description of Artificial Sequence: Synthetic oligonucleotide
gcgcaagtgggaggcggccca

SEQ ID NO: 366478 - DNA, 21 bp, Artificial Sequence
  Description of Artificial Sequence: Synthetic oligonucleotide
cgcaagtgggaggcggcccac

SEQ ID NO: 366479 - DNA, 22 bp, Artificial Sequence
  Description of Artificial Sequence: Synthetic oligonucleotide
gcaagtgggaggcggcccacgt

SEQ ID NO: 366480 - DNA, 22 bp, Artificial Sequence
  Description of Artificial Sequence: Synthetic oligonucleotide
caagtgggaggcggcccacgtg

SEQ ID NO: 366481 - DNA, 22 bp, Artificial Sequence
  Description of Artificial Sequence: Synthetic oligonucleotide
aagtgggaggcggcccacgtgg

SEQ ID NO: 366482 - DNA, 21 bp, Artificial Sequence
  Description of Artificial Sequence: Synthetic oligonucleotide
agtgggaggcggcccacgtgg

SEQ ID NO: 366483 - DNA, 20 bp, Artificial Sequence
  Description of Artificial Sequence: Synthetic oligonucleotide
gtgggaggcggcccacgtgg

SEQ ID NO: 366484 - DNA, 20 bp, Artificial Sequence
  Description of Artificial Sequence: Synthetic oligonucleotide
tgggaggcggcccacgtggc

SEQ ID NO: 366485 - DNA, 20 bp, Artificial Sequence
  Description of Artificial Sequence: Synthetic oligonucleotide
gggaggcggcccacgtggct

SEQ ID NO: 366486 - DNA, 20 bp, Artificial Sequence
  Description of Artificial Sequence: Synthetic oligonucleotide
ggaggcggcccacgtggcgt

SEQ ID NO: 366487 - DNA, 20 bp, Artificial Sequence
  Description of Artificial Sequence: Synthetic oligonucleotide
gaggcggcccacgtggcgga

SEQ ID NO: 366488 - DNA, 20 bp, Artificial Sequence
  Description of Artificial Sequence: Synthetic oligonucleotide
aggcggcccacgtggcggag

SEQ ID NO: 366489 - DNA, 20 bp, Artificial Sequence
  Description of Artificial Sequence: Synthetic oligonucleotide
ggcggcccacgtggcggagt

SEQ ID NO: 366490 - DNA, 20 bp, Artificial Sequence
  Description of Artificial Sequence: Synthetic oligonucleotide
gcggcccacgtggcggagca

SEQ ID NO: 366491 - DNA, 20 bp, Artificial Sequence
  Description of Artificial Sequence: Synthetic oligonucleotide
cggcccacgtggcggagcag

SEQ ID NO: 366492 - DNA, 21 bp, Artificial Sequence
  Description of Artificial Sequence: Synthetic oligonucleotide
ggcccacgtggcggagcagca

SEQ ID NO: 366493 - DNA, 22 bp, Artificial Sequence
  Description of Artificial Sequence: Synthetic oligonucleotide
gcccacgtggcggagcagcaga

SEQ ID NO: 366494 - DNA, 23 bp, Artificial Sequence
  Description of Artificial Sequence: Synthetic oligonucleotide
cccacgtggcggagcagcagaga

SEQ ID NO: 366495 - DNA, 23 bp, Artificial Sequence
  Description of Artificial Sequence: Synthetic oligonucleotide
ccacgtggcggagcagcagagag

SEQ ID NO: 366496 - DNA, 23 bp, Artificial Sequence
  Description of Artificial Sequence: Synthetic oligonucleotide
cacgtggcggagcagcagagagc

SEQ ID NO: 366497 - DNA, 25 bp, Artificial Sequence
  Description of Artificial Sequence: Synthetic oligonucleotide
acgtggcggagcagcagagagccta

SEQ ID NO: 366498 - DNA, 24 bp, Artificial Sequence
  Description of Artificial Sequence: Synthetic oligonucleotide
cgtggcggagcagcagagagccta

SEQ ID NO: 366499 - DNA, 24 bp, Artificial Sequence
  Description of Artificial Sequence: Synthetic oligonucleotide
aagtgggaggcggcccatgtggca

SEQ ID NO: 366500 - DNA, 23 bp, Artificial Sequence
  Description of Artificial Sequence: Synthetic oligonucleotide
agtgggaggcggcccatgtggca

SEQ ID NO: 366501 - DNA, 22 bp, Artificial Sequence
  Description of Artificial Sequence: Synthetic oligonucleotide
gtgggaggcggcccatgtggca

SEQ ID NO: 366502 - DNA, 23 bp, Artificial Sequence
  Description of Artificial Sequence: Synthetic oligonucleotide
tgggaggcggcccatgtggcaga

SEQ ID NO: 366503 - DNA, 22 bp, Artificial Sequence
  Description of Artificial Sequence: Synthetic oligonucleotide
gggaggcggcccatgtggcaga

SEQ ID NO: 366504 - DNA, 22 bp, Artificial Sequence
  Description of Artificial Sequence: Synthetic oligonucleotide
ggaggcggcccatgtggcagag

SEQ ID NO: 366505 - DNA, 23 bp, Artificial Sequence
  Description of Artificial Sequence: Synthetic oligonucleotide
gaggcggcccatgtggcagagca

SEQ ID NO: 366506 - DNA, 23 bp, Artificial Sequence
  Description of Artificial Sequence: Synthetic oligonucleotide
aggcggcccatgtggcagagcag

SEQ ID NO: 366507 - DNA, 22 bp, Artificial Sequence
  Description of Artificial Sequence: Synthetic oligonucleotide
ggcggcccatgtggcagagcag

SEQ ID NO: 366508 - DNA, 23 bp, Artificial Sequence
  Description of Artificial Sequence: Synthetic oligonucleotide
gcggcccatgtggcagagcagca

SEQ ID NO: 366509 - DNA, 24 bp, Artificial Sequence
  Description of Artificial Sequence: Synthetic oligonucleotide
cggcccatgtggcagagcagcaga

SEQ ID NO: 366510 - DNA, 25 bp, Artificial Sequence
  Description of Artificial Sequence: Synthetic oligonucleotide
ggcccatgtggcagagcagcagaga

SEQ ID NO: 366511 - DNA, 25 bp, Artificial Sequence
  Description of Artificial Sequence: Synthetic oligonucleotide
gcccatgtggcagagcagcagagag

SEQ ID NO: 366512 - DNA, 25 bp, Artificial Sequence
  Description of Artificial Sequence: Synthetic oligonucleotide
cccatgtggcagagcagcagagagc

SEQ ID NO: 366513 - DNA, 27 bp, Artificial Sequence
  Description of Artificial Sequence: Synthetic oligonucleotide
ccatgtggcagagcagcagagagccta

SEQ ID NO: 366514 - DNA, 27 bp, Artificial Sequence
  Description of Artificial Sequence: Synthetic oligonucleotide
catgtggcagagcagcagagagcctac

SEQ ID NO: 366515 - DNA, 27 bp, Artificial Sequence
  Description of Artificial Sequence: Synthetic oligonucleotide
atgtggcagagcagcagagagcctacc

SEQ ID NO: 366516 - DNA, 27 bp, Artificial Sequence
  Description of Artificial Sequence: Synthetic oligonucleotide
tgtggcagagcagcagagagcctacct

SEQ ID NO: 366517 - DNA, 26 bp, Artificial Sequence
  Description of Artificial Sequence: Synthetic oligonucleotide
gtggcagagcagcagagagcctacct

SEQ ID NO: 366518 - DNA, 26 bp, Artificial Sequence
  Description of Artificial Sequence: Synthetic oligonucleotide
tggcagagcagcagagagcctacctg

SEQ ID NO: 366519 - DNA, 25 bp, Artificial Sequence
  Description of Artificial Sequence: Synthetic oligonucleotide
ggcagagcagcagagagcctacctg

SEQ ID NO: 366520 - DNA, 26 bp, Artificial Sequence
  Description of Artificial Sequence: Synthetic oligonucleotide
gcagagcagcagagagcctacctgga

SEQ ID NO: 366521 - DNA, 26 bp, Artificial Sequence
  Description of Artificial Sequence: Synthetic oligonucleotide
cagagcagcagagagcctacctggag

SEQ ID NO: 366522 - DNA, 26 bp, Artificial Sequence
  Description of Artificial Sequence: Synthetic oligonucleotide
agagcagcagagagcctacctggagg

SEQ ID NO: 366523 - DNA, 22 bp, Artificial Sequence
  Description of Artificial Sequence: Synthetic oligonucleotide
ctgcgacgtggggtcggacgga

SEQ ID NO: 366524 - DNA, 22 bp, Artificial Sequence
  Description of Artificial Sequence: Synthetic oligonucleotide
tgcgacgtggggtcggacggac

SEQ ID NO: 366525 - DNA, 21 bp, Artificial Sequence
  Description of Artificial Sequence: Synthetic oligonucleotide
gcgacgtggggtcggacggac

SEQ ID NO: 366526 - DNA, 21 bp, Artificial Sequence
  Description of Artificial Sequence: Synthetic oligonucleotide
cgacgtggggtcggacggacg

SEQ ID NO: 366527 - DNA, 23 bp, Artificial Sequence
  Description of Artificial Sequence: Synthetic oligonucleotide
gacgtggggtcggacggacgctt

SEQ ID NO: 366528 - DNA, 23 bp, Artificial Sequence
  Description of Artificial Sequence: Synthetic oligonucleotide
acgtggggtcggacggacgcttc

SEQ ID NO: 366529 - DNA, 22 bp, Artificial Sequence
  Description of Artificial Sequence: Synthetic oligonucleotide
cgtggggtcggacggacgcttc

SEQ ID NO: 366530 - DNA, 23 bp, Artificial Sequence
  Description of Artificial Sequence: Synthetic oligonucleotide
gtggggtcggacggacgcttcct

SEQ ID NO: 366531 - DNA, 23 bp, Artificial Sequence
  Description of Artificial Sequence: Synthetic oligonucleotide
tggggtcggacggacgcttcctc

SEQ ID NO: 366532 - DNA, 22 bp, Artificial Sequence
  Description of Artificial Sequence: Synthetic oligonucleotide
ggggtcggacggacgcttcctc

SEQ ID NO: 366533 - DNA, 22 bp, Artificial Sequence
  Description of Artificial Sequence: Synthetic oligonucleotide
gggtcggacggacgcttcctcc

SEQ ID NO: 366534 - DNA, 22 bp, Artificial Sequence
  Description of Artificial Sequence: Synthetic oligonucleotide
ggtcggacggacgcttcctccg

SEQ ID NO: 366535 - DNA, 22 bp, Artificial Sequence
  Description of Artificial Sequence: Synthetic oligonucleotide
gtcggacggacgcttcctccgc

SEQ ID NO: 366536 - DNA, 22 bp, Artificial Sequence
  Description of Artificial Sequence: Synthetic oligonucleotide
tcggacggacgcttcctccgcg

SEQ ID NO: 366537 - DNA, 23 bp, Artificial Sequence
  Description of Artificial Sequence: Synthetic oligonucleotide
ggacgcttcctccgcgggtacca

SEQ ID NO: 366538 - DNA, 23 bp, Artificial Sequence
  Description of Artificial Sequence: Synthetic oligonucleotide
gacgcttcctccgcgggtaccac

SEQ ID NO: 366539 - DNA, 24 bp, Artificial Sequence
  Description of Artificial Sequence: Synthetic oligonucleotide
acgcttcctccgcgggtaccacca

SEQ ID NO: 366540 - DNA, 28 bp, Artificial Sequence
  Description of Artificial Sequence: Synthetic oligonucleotide
gcccactcacagactgaccgagagaatc

SEQ ID NO: 366541 - DNA, 29 bp, Artificial Sequence
  Description of Artificial Sequence: Synthetic oligonucleotide
cccactcacagactgaccgagagaatctg

SEQ ID NO: 366542 - DNA, 29 bp, Artificial Sequence
  Description of Artificial Sequence: Synthetic oligonucleotide
ccactcacagactgaccgagagaatctgc

SEQ ID NO: 366543 - DNA, 29 bp, Artificial Sequence
  Description of Artificial Sequence: Synthetic oligonucleotide
cactcacagactgaccgagagaatctgcg

SEQ ID NO: 366544 - DNA, 29 bp, Artificial Sequence
  Description of Artificial Sequence: Synthetic oligonucleotide
actcacagactgaccgagagaatctgcgg

SEQ ID NO: 366545 - DNA, 28 bp, Artificial Sequence
  Description of Artificial Sequence: Synthetic oligonucleotide
ctcacagactgaccgagagaatctgcgg

SEQ ID NO: 366546 - DNA, 30 bp, Artificial Sequence; identical to SEQ ID NO: 14224
  Description of Artificial Sequence: Synthetic oligonucleotide

SEQ ID NO: 366547 - DNA, 29 bp, Artificial Sequence
  Description of Artificial Sequence: Synthetic oligonucleotide
cacagactgaccgagagaatctgcggatc

SEQ ID NO: 366548 - DNA, 29 bp, Artificial Sequence
  Description of Artificial Sequence: Synthetic oligonucleotide
acagactgaccgagagaatctgcggatcg

SEQ ID NO: 366549 - DNA, 28 bp, Artificial Sequence
  Description of Artificial Sequence: Synthetic oligonucleotide
cagactgaccgagagaatctgcggatcg

SEQ ID NO: 366550 - DNA, 28 bp, Artificial Sequence
  Description of Artificial Sequence: Synthetic oligonucleotide
agactgaccgagagaatctgcggatcgc

SEQ ID NO: 366551 - DNA, 27 bp, Artificial Sequence
  Description of Artificial Sequence: Synthetic oligonucleotide
gactgaccgagagaatctgcggatcgc

SEQ ID NO: 366552 - DNA, 27 bp, Artificial Sequence
  Description of Artificial Sequence: Synthetic oligonucleotide
actgaccgagagaatctgcggatcgcg

SEQ ID NO: 366553 - DNA, 26 bp, Artificial Sequence
  Description of Artificial Sequence: Synthetic oligonucleotide
ctgaccgagagaatctgcggatcgcg

SEQ ID NO: 366554 - DNA, 27 bp, Artificial Sequence
  Description of Artificial Sequence: Synthetic oligonucleotide
tgaccgagagaatctgcggatcgcgct

SEQ ID NO: 366555 - DNA, 26 bp, Artificial Sequence
  Description of Artificial Sequence: Synthetic oligonucleotide
gaccgagagaatctgcggatcgcgct

SEQ ID NO: 366556 - DNA, 26 bp, Artificial Sequence
  Description of Artificial Sequence: Synthetic oligonucleotide
accgagagaatctgcggatcgcgctc

SEQ ID NO: 366557 - DNA, 25 bp, Artificial Sequence
  Description of Artificial Sequence: Synthetic oligonucleotide
ccgagagaatctgcggatcgcgctc

SEQ ID NO: 366558 - DNA, 25 bp, Artificial Sequence
  Description of Artificial Sequence: Synthetic oligonucleotide
cgagagaatctgcggatcgcgctcc

SEQ ID NO: 366559 - DNA, 25 bp, Artificial Sequence
  Description of Artificial Sequence: Synthetic oligonucleotide
gagagaatctgcggatcgcgctccg

SEQ ID NO: 366560 - DNA, 27 bp, Artificial Sequence
  Description of Artificial Sequence: Synthetic oligonucleotide
agagaatctgcggatcgcgctccgcta

SEQ ID NO: 366561 - DNA, 26 bp, Artificial Sequence
  Description of Artificial Sequence: Synthetic oligonucleotide
gagaatctgcggatcgcgctccgcta

SEQ ID NO: 366562 - DNA, 27 bp, Artificial Sequence
  Description of Artificial Sequence: Synthetic oligonucleotide
agaatctgcggatcgcgctccgctact

SEQ ID NO: 366563 - DNA, 27 bp, Artificial Sequence
  Description of Artificial Sequence: Synthetic oligonucleotide
gaatctgcggatcgcgctccgctacta

SEQ ID NO: 366564 - DNA, 27 bp, Artificial Sequence
  Description of Artificial Sequence: Synthetic oligonucleotide
aatctgcggatcgcgctccgctactac

SEQ ID NO: 366565 - DNA, 27 bp, Artificial Sequence
  Description of Artificial Sequence: Synthetic oligonucleotide
atctgcggatcgcgctccgctactaca

SEQ ID NO: 366566 - DNA, 27 bp, Artificial Sequence
  Description of Artificial Sequence: Synthetic oligonucleotide
tctgcggatcgcgctccgctactacaa

SEQ ID NO: 366567 - DNA, 28 bp, Artificial Sequence
  Description of Artificial Sequence: Synthetic oligonucleotide
gacccccccaagacacatatgacccatc

SEQ ID NO: 366568 - DNA, 29 bp, Artificial Sequence
  Description of Artificial Sequence: Synthetic oligonucleotide
acccccccaagacacatatgacccatcac

SEQ ID NO: 366569 - DNA, 28 bp, Artificial Sequence
  Description of Artificial Sequence: Synthetic oligonucleotide
cccccccaagacacatatgacccatcac

SEQ ID NO: 366570 - DNA, 28 bp, Artificial Sequence
  Description of Artificial Sequence: Synthetic oligonucleotide
ccccccaagacacatatgacccatcacc

SEQ ID NO: 366571 - DNA, 28 bp, Artificial Sequence
  Description of Artificial Sequence: Synthetic oligonucleotide
cccccaagacacatatgacccatcaccc

SEQ ID NO: 366572 - DNA, 28 bp, Artificial Sequence
  Description of Artificial Sequence: Synthetic oligonucleotide
ccccaagacacatatgacccatcacccc

SEQ ID NO: 366573 - DNA, 30 bp, Artificial Sequence; identical to SEQ ID NO: 14251
  Description of Artificial Sequence: Synthetic oligonucleotide

SEQ ID NO: 366574 - DNA, 31 bp, Artificial Sequence; identical to SEQ ID NO: 14252
  Description of Artificial Sequence: Synthetic oligonucleotide

SEQ ID NO: 366575 - DNA, 32 bp, Artificial Sequence; identical to SEQ ID NO: 14253
  Description of Artificial Sequence: Synthetic oligonucleotide

SEQ ID NO: 366576 - DNA, 33 bp, Artificial Sequence; identical to SEQ ID NO: 14254
  Description of Artificial Sequence: Synthetic oligonucleotide

SEQ ID NO: 366577 - DNA, 32 bp, Artificial Sequence; identical to SEQ ID NO: 14255
  Description of Artificial Sequence: Synthetic oligonucleotide

SEQ ID NO: 366578 - DNA, 31 bp, Artificial Sequence; identical to SEQ ID NO: 14256
  Description of Artificial Sequence: Synthetic oligonucleotide

SEQ ID NO: 366579 - DNA, 31 bp, Artificial Sequence; identical to SEQ ID NO: 14257
  Description of Artificial Sequence: Synthetic oligonucleotide

SEQ ID NO: 366580 - DNA, 30 bp, Artificial Sequence; identical to SEQ ID NO: 14258
  Description of Artificial Sequence: Synthetic oligonucleotide

SEQ ID NO: 366581 - DNA, 32 bp, Artificial Sequence; identical to SEQ ID NO: 14259
  Description of Artificial Sequence: Synthetic oligonucleotide

SEQ ID NO: 366582 - DNA, 31 bp, Artificial Sequence; identical to SEQ ID NO: 14260
  Description of Artificial Sequence: Synthetic oligonucleotide

SEQ ID NO: 366583 - DNA, 32 bp, Artificial Sequence; identical to SEQ ID NO: 14261
  Description of Artificial Sequence: Synthetic oligonucleotide

SEQ ID NO: 366584 - DNA, 31 bp, Artificial Sequence; identical to SEQ ID NO: 14262
  Description of Artificial Sequence: Synthetic oligonucleotide

SEQ ID NO: 366585 - DNA, 30 bp, Artificial Sequence; identical to SEQ ID NO: 14263
  Description of Artificial Sequence: Synthetic oligonucleotide

SEQ ID NO: 366586 - DNA, 29 bp, Artificial Sequence
  Description of Artificial Sequence: Synthetic oligonucleotide
tgacccatcaccccatctctgaccatgag

SEQ ID NO: 366587 - DNA, 28 bp, Artificial Sequence
  Description of Artificial Sequence: Synthetic oligonucleotide
gacccatcaccccatctctgaccatgag

SEQ ID NO: 366588 - DNA, 28 bp, Artificial Sequence
  Description of Artificial Sequence: Synthetic oligonucleotide
acccatcaccccatctctgaccatgagg

SEQ ID NO: 366589 - DNA, 27 bp, Artificial Sequence
  Description of Artificial Sequence: Synthetic oligonucleotide
cccatcaccccatctctgaccatgagg

SEQ ID NO: 366590 - DNA, 27 bp, Artificial Sequence
  Description of Artificial Sequence: Synthetic oligonucleotide
ccatcaccccatctctgaccatgaggc

SEQ ID NO: 366591 - DNA, 27 bp, Artificial Sequence
  Description of Artificial Sequence: Synthetic oligonucleotide
catcaccccatctctgaccatgaggcc

SEQ ID NO: 366592 - DNA, 28 bp, Artificial Sequence
  Description of Artificial Sequence: Synthetic oligonucleotide
atcaccccatctctgaccatgaggccac

SEQ ID NO: 366593 - DNA, 27 bp, Artificial Sequence
  Description of Artificial Sequence: Synthetic oligonucleotide
tcaccccatctctgaccatgaggccac

SEQ ID NO: 366594 - DNA, 26 bp, Artificial Sequence
  Description of Artificial Sequence: Synthetic oligonucleotide
agcaggaggggccggagtattgggat

SEQ ID NO: 366595 - DNA, 25 bp, Artificial Sequence
  Description of Artificial Sequence: Synthetic oligonucleotide
gcaggaggggccggagtattgggat

SEQ ID NO: 366596 - DNA, 26 bp, Artificial Sequence
  Description of Artificial Sequence: Synthetic oligonucleotide
caggaggggccggagtattgggatga

SEQ ID NO: 366597 - DNA, 26 bp, Artificial Sequence
  Description of Artificial Sequence: Synthetic oligonucleotide
aggaggggccggagtattgggatgag

SEQ ID NO: 366598 - DNA, 25 bp, Artificial Sequence
  Description of Artificial Sequence: Synthetic oligonucleotide
ggaggggccggagtattgggatgag

SEQ ID NO: 366599 - DNA, 26 bp, Artificial Sequence
  Description of Artificial Sequence: Synthetic oligonucleotide
gaggggccggagtattgggatgagga

SEQ ID NO: 366600 - DNA, 27 bp, Artificial Sequence
  Description of Artificial Sequence: Synthetic oligonucleotide
aggggccggagtattgggatgaggaga

SEQ ID NO: 366601 - DNA, 26 bp, Artificial Sequence
  Description of Artificial Sequence: Synthetic oligonucleotide
ggggccggagtattgggatgaggaga

SEQ ID NO: 366602 - DNA, 27 bp, Artificial Sequence
  Description of Artificial Sequence: Synthetic oligonucleotide
gggccggagtattgggatgaggagaca

SEQ ID NO: 366603 - DNA, 27 bp, Artificial Sequence
  Description of Artificial Sequence: Synthetic oligonucleotide
ggccggagtattgggatgaggagacag

SEQ ID NO: 366604 - DNA, 27 bp, Artificial Sequence
  Description of Artificial Sequence: Synthetic oligonucleotide
gccggagtattgggatgaggagacagg

SEQ ID NO: 366605 - DNA, 27 bp, Artificial Sequence
  Description of Artificial Sequence: Synthetic oligonucleotide
ccggagtattgggatgaggagacaggg

SEQ ID NO: 366606 - DNA, 30 bp, Artificial Sequence; identical to SEQ ID NO: 14284
  Description of Artificial Sequence: Synthetic oligonucleotide

SEQ ID NO: 366607 - DNA, 31 bp, Artificial Sequence; identical to SEQ ID NO: 14285
  Description of Artificial Sequence: Synthetic oligonucleotide

SEQ ID NO: 366608 - DNA, 33 bp, Artificial Sequence; identical to SEQ ID NO: 14286
  Description of Artificial Sequence: Synthetic oligonucleotide

SEQ ID NO: 366609 - DNA, 33 bp, Artificial Sequence; identical to SEQ ID NO: 14287
  Description of Artificial Sequence: Synthetic oligonucleotide

SEQ ID NO: 366610 - DNA, 32 bp, Artificial Sequence; identical to SEQ ID NO: 14288
  Description of Artificial Sequence: Synthetic oligonucleotide

SEQ ID NO: 366611 - DNA, 32 bp, Artificial Sequence; identical to SEQ ID NO: 14289
  Description of Artificial Sequence: Synthetic oligonucleotide

SEQ ID NO: 366612 - DNA, 31 bp, Artificial Sequence; identical to SEQ ID NO: 14290
  Description of Artificial Sequence: Synthetic oligonucleotide

SEQ ID NO: 366613 - DNA, 30 bp, Artificial Sequence; identical to SEQ ID NO: 14291
  Description of Artificial Sequence: Synthetic oligonucleotide

SEQ ID NO: 366614 - DNA, 29 bp, Artificial Sequence
  Description of Artificial Sequence: Synthetic oligonucleotide
tgggatgaggagacagggaaagtgaaggc

SEQ ID NO: 366615 - DNA, 28 bp, Artificial Sequence
  Description of Artificial Sequence: Synthetic oligonucleotide
gggatgaggagacagggaaagtgaaggc

SEQ ID NO: 366616 - DNA, 28 bp, Artificial Sequence
  Description of Artificial Sequence: Synthetic oligonucleotide
ggatgaggagacagggaaagtgaaggcc

SEQ ID NO: 366617 - DNA, 28 bp, Artificial Sequence
  Description of Artificial Sequence: Synthetic oligonucleotide
gatgaggagacagggaaagtgaaggccc

SEQ ID NO: 366618 - DNA, 29 bp, Artificial Sequence
  Description of Artificial Sequence: Synthetic oligonucleotide
atgaggagacagggaaagtgaaggcccac

SEQ ID NO: 366619 - DNA, 28 bp, Artificial Sequence
  Description of Artificial Sequence: Synthetic oligonucleotide
tgaggagacagggaaagtgaaggcccac

SEQ ID NO: 366620 - DNA, 23 bp, Artificial Sequence
  Description of Artificial Sequence: Synthetic oligonucleotide
gcccatgtggcggagcagcagag

SEQ ID NO: 366621 - DNA, 23 bp, Artificial Sequence
  Description of Artificial Sequence: Synthetic oligonucleotide
cccatgtggcggagcagcagagg

SEQ ID NO: 366622 - DNA, 23 bp, Artificial Sequence
  Description of Artificial Sequence: Synthetic oligonucleotide
ccatgtggcggagcagcagaggg

SEQ ID NO: 366623 - DNA, 23 bp, Artificial Sequence
  Description of Artificial Sequence: Synthetic oligonucleotide
catgtggcggagcagcagagggc

SEQ ID NO: 366624 - DNA, 25 bp, Artificial Sequence
  Description of Artificial Sequence: Synthetic oligonucleotide
atgtggcggagcagcagagggccta

SEQ ID NO: 366625 - DNA, 24 bp, Artificial Sequence
  Description of Artificial Sequence: Synthetic oligonucleotide
tgtggcggagcagcagagggccta

SEQ ID NO: 366626 - DNA, 23 bp, Artificial Sequence
  Description of Artificial Sequence: Synthetic oligonucleotide
gtggcggagcagcagagggccta

SEQ ID NO: 366627 - DNA, 23 bp, Artificial Sequence
  Description of Artificial Sequence: Synthetic oligonucleotide
tggcggagcagcagagggcctac

SEQ ID NO: 366628 - DNA, 22 bp, Artificial Sequence
  Description of Artificial Sequence: Synthetic oligonucleotide
ggcggagcagcagagggcctac

SEQ ID NO: 366629 - DNA, 23 bp, Artificial Sequence
  Description of Artificial Sequence: Synthetic oligonucleotide
gcggagcagcagagggcctacct

SEQ ID NO: 366630 - DNA, 23 bp, Artificial Sequence
  Description of Artificial Sequence: Synthetic oligonucleotide
cggagcagcagagggcctacctg

SEQ ID NO: 366631 - DNA, 24 bp, Artificial Sequence
  Description of Artificial Sequence: Synthetic oligonucleotide
ggagcagcagagggcctacctgga

SEQ ID NO: 366632 - DNA, 24 bp, Artificial Sequence
  Description of Artificial Sequence: Synthetic oligonucleotide
gagcagcagagggcctacctggag

SEQ ID NO: 366633 - DNA, 24 bp, Artificial Sequence
  Description of Artificial Sequence: Synthetic oligonucleotide
agcagcagagggcctacctggagg

SEQ ID NO: 366634 - DNA, 23 bp, Artificial Sequence
  Description of Artificial Sequence: Synthetic oligonucleotide
gcagcagagggcctacctggagg

SEQ ID NO: 366635 - DNA, 23 bp, Artificial Sequence
  Description of Artificial Sequence: Synthetic oligonucleotide
cagcagagggcctacctggaggg

SEQ ID NO: 366636 - DNA, 24 bp, Artificial Sequence
  Description of Artificial Sequence: Synthetic oligonucleotide
agcagagggcctacctggagggca

SEQ ID NO: 366637 - DNA, 23 bp, Artificial Sequence
  Description of Artificial Sequence: Synthetic oligonucleotide
gcagagggcctacctggagggca

SEQ ID NO: 366638 - DNA, 23 bp, Artificial Sequence
  Description of Artificial Sequence: Synthetic oligonucleotide
cagagggcctacctggagggcac

SEQ ID NO: 366639 - DNA, 24 bp, Artificial Sequence
  Description of Artificial Sequence: Synthetic oligonucleotide
agagggcctacctggagggcacgt

SEQ ID NO: 366640 - DNA, 23 bp, Artificial Sequence
  Description of Artificial Sequence: Synthetic oligonucleotide
gagggcctacctggagggcacgt

SEQ ID NO: 366641 - DNA, 23 bp, Artificial Sequence
  Description of Artificial Sequence: Synthetic oligonucleotide
agggcctacctggagggcacgtg

SEQ ID NO: 366642 - DNA, 22 bp, Artificial Sequence
  Description of Artificial Sequence: Synthetic oligonucleotide
gggcctacctggagggcacgtg

SEQ ID NO: 366643 - DNA, 22 bp, Artificial Sequence
  Description of Artificial Sequence: Synthetic oligonucleotide
ggcctacctggagggcacgtgc

SEQ ID NO: 366644 - DNA, 25 bp, Artificial Sequence
  Description of Artificial Sequence: Synthetic oligonucleotide
ggccggagtattgggacgaggagac

SEQ ID NO: 366645 - DNA, 25 bp, Artificial Sequence
  Description of Artificial Sequence: Synthetic oligonucleotide
gccggagtattgggacgaggagacg

SEQ ID NO: 366646 - DNA, 25 bp, Artificial Sequence
  Description of Artificial Sequence: Synthetic oligonucleotide
ccggagtattgggacgaggagacgg

SEQ ID NO: 366647 - DNA, 25 bp, Artificial Sequence
  Description of Artificial Sequence: Synthetic oligonucleotide
cggagtattgggacgaggagacggg

SEQ ID NO: 366648 - DNA, 27 bp, Artificial Sequence
  Description of Artificial Sequence: Synthetic oligonucleotide
ggagtattgggacgaggagacggggaa

SEQ ID NO: 366649 - DNA, 28 bp, Artificial Sequence
  Description of Artificial Sequence: Synthetic oligonucleotide
gagtattgggacgaggagacggggaaag

SEQ ID NO: 366650 - DNA, 29 bp, Artificial Sequence
  Description of Artificial Sequence: Synthetic oligonucleotide
agtattgggacgaggagacggggaaagtg

SEQ ID NO: 366651 - DNA, 28 bp, Artificial Sequence
  Description of Artificial Sequence: Synthetic oligonucleotide
gtattgggacgaggagacggggaaagtg

SEQ ID NO: 366652 - DNA, 30 bp, Artificial Sequence; identical to SEQ ID NO: 14330
  Description of Artificial Sequence: Synthetic oligonucleotide

SEQ ID NO: 366653 - DNA, 29 bp, Artificial Sequence
  Description of Artificial Sequence: Synthetic oligonucleotide
attgggacgaggagacggggaaagtgaag

SEQ ID NO: 366654 - DNA, 28 bp, Artificial Sequence
  Description of Artificial Sequence: Synthetic oligonucleotide
ttgggacgaggagacggggaaagtgaag

SEQ ID NO: 366655 - DNA, 27 bp, Artificial Sequence
  Description of Artificial Sequence: Synthetic oligonucleotide
tgggacgaggagacggggaaagtgaag

SEQ ID NO: 366656 - DNA, 26 bp, Artificial Sequence
  Description of Artificial Sequence: Synthetic oligonucleotide
gggacgaggagacggggaaagtgaag

SEQ ID NO: 366657 - DNA, 26 bp, Artificial Sequence
  Description of Artificial Sequence: Synthetic oligonucleotide
ggacgaggagacggggaaagtgaagg

SEQ ID NO: 366658 - DNA, 26 bp, Artificial Sequence
  Description of Artificial Sequence: Synthetic oligonucleotide
gacgaggagacggggaaagtgaaggc

SEQ ID NO: 366659 - DNA, 26 bp, Artificial Sequence
  Description of Artificial Sequence: Synthetic oligonucleotide
acgaggagacggggaaagtgaaggcc

SEQ ID NO: 366660 - DNA, 25 bp, Artificial Sequence
  Description of Artificial Sequence: Synthetic oligonucleotide
cgaggagacggggaaagtgaaggcc

SEQ ID NO: 366661 - DNA, 26 bp, Artificial Sequence
  Description of Artificial Sequence: Synthetic oligonucleotide
gaggagacggggaaagtgaaggccca

SEQ ID NO: 366662 - DNA, 27 bp, Artificial Sequence
  Description of Artificial Sequence: Synthetic oligonucleotide
aggagacggggaaagtgaaggcccact

SEQ ID NO: 366663 - DNA, 26 bp, Artificial Sequence
  Description of Artificial Sequence: Synthetic oligonucleotide
ggagacggggaaagtgaaggcccact

SEQ ID NO: 366664 - DNA, 27 bp, Artificial Sequence
  Description of Artificial Sequence: Synthetic oligonucleotide
gagacggggaaagtgaaggcccactca

SEQ ID NO: 366665 - DNA, 27 bp, Artificial Sequence
  Description of Artificial Sequence: Synthetic oligonucleotide
agacggggaaagtgaaggcccactcac

SEQ ID NO: 366666 - DNA, 27 bp, Artificial Sequence
  Description of Artificial Sequence: Synthetic oligonucleotide
gacggggaaagtgaaggcccactcaca

SEQ ID NO: 366667 - DNA, 27 bp, Artificial Sequence
  Description of Artificial Sequence: Synthetic oligonucleotide
acggggaaagtgaaggcccactcacag

SEQ ID NO: 366668 - DNA, 27 bp, Artificial Sequence
  Description of Artificial Sequence: Synthetic oligonucleotide
cggggaaagtgaaggcccactcacaga

SEQ ID NO: 366669 - DNA, 27 bp, Artificial Sequence
  Description of Artificial Sequence: Synthetic oligonucleotide
ggggaaagtgaaggcccactcacagac

SEQ ID NO: 366670 - DNA, 23 bp, Artificial Sequence
  Description of Artificial Sequence: Synthetic oligonucleotide
cgtggatagagcaggaggggccc

SEQ ID NO: 366671 - DNA, 24 bp, Artificial Sequence
  Description of Artificial Sequence: Synthetic oligonucleotide
gtggatagagcaggaggggcccga

SEQ ID NO: 366672 - DNA, 27 bp, Artificial Sequence
  Description of Artificial Sequence: Synthetic oligonucleotide
tggatagagcaggaggggcccgagtat

SEQ ID NO: 366673 - DNA, 27 bp, Artificial Sequence
  Description of Artificial Sequence: Synthetic oligonucleotide
ggatagagcaggaggggcccgagtatt

SEQ ID NO: 366674 - DNA, 27 bp, Artificial Sequence
  Description of Artificial Sequence: Synthetic oligonucleotide
gatagagcaggaggggcccgagtattg

SEQ ID NO: 366675 - DNA, 27 bp, Artificial Sequence
  Description of Artificial Sequence: Synthetic oligonucleotide
atagagcaggaggggcccgagtattgg

SEQ ID NO: 366676 - DNA, 26 bp, Artificial Sequence
  Description of Artificial Sequence: Synthetic oligonucleotide
tagagcaggaggggcccgagtattgg

SEQ ID NO: 366677 - DNA, 25 bp, Artificial Sequence
  Description of Artificial Sequence: Synthetic oligonucleotide
agagcaggaggggcccgagtattgg

SEQ ID NO: 366678 - DNA, 24 bp, Artificial Sequence
  Description of Artificial Sequence: Synthetic oligonucleotide
gagcaggaggggcccgagtattgg

SEQ ID NO: 366679 - DNA, 25 bp, Artificial Sequence
  Description of Artificial Sequence: Synthetic oligonucleotide
agcaggaggggcccgagtattggga

SEQ ID NO: 366680 - DNA, 24 bp, Artificial Sequence
  Description of Artificial Sequence: Synthetic oligonucleotide
gcaggaggggcccgagtattggga

SEQ ID NO: 366681 - DNA, 24 bp, Artificial Sequence
  Description of Artificial Sequence: Synthetic oligonucleotide
caggaggggcccgagtattgggac

SEQ ID NO: 366682 - DNA, 25 bp, Artificial Sequence
  Description of Artificial Sequence: Synthetic oligonucleotide
aggaggggcccgagtattgggacga

SEQ ID NO: 366683 - DNA, 24 bp, Artificial Sequence
  Description of Artificial Sequence: Synthetic oligonucleotide
ggaggggcccgagtattgggacga

SEQ ID NO: 366684 - DNA, 24 bp, Artificial Sequence
  Description of Artificial Sequence: Synthetic oligonucleotide
gaggggcccgagtattgggacgag

SEQ ID NO: 366685 - DNA, 25 bp, Artificial Sequence
  Description of Artificial Sequence: Synthetic oligonucleotide
aggggcccgagtattgggacgagga

SEQ ID NO: 366686 - DNA, 24 bp, Artificial Sequence
  Description of Artificial Sequence: Synthetic oligonucleotide
ggggcccgagtattgggacgagga

SEQ ID NO: 366687 - DNA, 25 bp, Artificial Sequence
  Description of Artificial Sequence: Synthetic oligonucleotide
gggcccgagtattgggacgaggaga

SEQ ID NO: 366688 - DNA, 26 bp, Artificial Sequence
  Description of Artificial Sequence: Synthetic oligonucleotide
ggcccgagtattgggacgaggagaca

SEQ ID NO: 366689 - DNA, 26 bp, Artificial Sequence
  Description of Artificial Sequence: Synthetic oligonucleotide
gcccgagtattgggacgaggagacag

SEQ ID NO: 366690 - DNA, 26 bp, Artificial Sequence
  Description of Artificial Sequence: Synthetic oligonucleotide
cccgagtattgggacgaggagacagg

SEQ ID NO: 366691 - DNA, 27 bp, Artificial Sequence
  Description of Artificial Sequence: Synthetic oligonucleotide
ccgagtattgggacgaggagacaggga

SEQ ID NO: 366692 - DNA, 29 bp, Artificial Sequence
  Description of Artificial Sequence: Synthetic oligonucleotide
cgagtattgggacgaggagacagggaaag

SEQ ID NO: 366693 - DNA, 22 bp, Artificial Sequence
  Description of Artificial Sequence: Synthetic oligonucleotide
gacagcgacgccgccagccaga

SEQ ID NO: 366694 - DNA, 22 bp, Artificial Sequence
  Description of Artificial Sequence: Synthetic oligonucleotide
acagcgacgccgccagccagag

SEQ ID NO: 366695 - DNA, 21 bp, Artificial Sequence
  Description of Artificial Sequence: Synthetic oligonucleotide
cagcgacgccgccagccagag

SEQ ID NO: 366696 - DNA, 23 bp, Artificial Sequence
  Description of Artificial Sequence: Synthetic oligonucleotide
agcgacgccgccagccagaggat

SEQ ID NO: 366697 - DNA, 22 bp, Artificial Sequence
  Description of Artificial Sequence: Synthetic oligonucleotide
gcgacgccgccagccagaggat

SEQ ID NO: 366698 - DNA, 22 bp, Artificial Sequence
  Description of Artificial Sequence: Synthetic oligonucleotide
cgacgccgccagccagaggatg

SEQ ID NO: 366699 - DNA, 23 bp, Artificial Sequence
  Description of Artificial Sequence: Synthetic oligonucleotide
gacgccgccagccagaggatgga

SEQ ID NO: 366700 - DNA, 23 bp, Artificial Sequence
  Description of Artificial Sequence: Synthetic oligonucleotide
acgccgccagccagaggatggag

SEQ ID NO: 366701 - DNA, 22 bp, Artificial Sequence
  Description of Artificial Sequence: Synthetic oligonucleotide
cgccgccagccagaggatggag

SEQ ID NO: 366702 - DNA, 22 bp, Artificial Sequence
  Description of Artificial Sequence: Synthetic oligonucleotide
gccgccagccagaggatggagc

SEQ ID NO: 366703 - DNA, 22 bp, Artificial Sequence
  Description of Artificial Sequence: Synthetic oligonucleotide
ccgccagccagaggatggagcc

SEQ ID NO: 366704 - DNA, 22 bp, Artificial Sequence
  Description of Artificial Sequence: Synthetic oligonucleotide
cgccagccagaggatggagccg

SEQ ID NO: 366705 - DNA, 22 bp, Artificial Sequence
  Description of Artificial Sequence: Synthetic oligonucleotide
gccagccagaggatggagccgc

SEQ ID NO: 366706 - DNA, 22 bp, Artificial Sequence
  Description of Artificial Sequence: Synthetic oligonucleotide
ccagccagaggatggagccgcg

SEQ ID NO: 366707 - DNA, 22 bp, Artificial Sequence
  Description of Artificial Sequence: Synthetic oligonucleotide
cagccagaggatggagccgcgg

SEQ ID NO: 366708 - DNA, 25 bp, Artificial Sequence
  Description of Artificial Sequence: Synthetic oligonucleotide
gcggcggacatggcggctcagataa

SEQ ID NO: 366709 - DNA, 25 bp, Artificial Sequence
  Description of Artificial Sequence: Synthetic oligonucleotide
cggcggacatggcggctcagataac

SEQ ID NO: 366710 - DNA, 27 bp, Artificial Sequence
  Description of Artificial Sequence: Synthetic oligonucleotide
ggcggacatggcggctcagataaccaa

SEQ ID NO: 366711 - DNA, 27 bp, Artificial Sequence
  Description of Artificial Sequence: Synthetic oligonucleotide
gcggacatggcggctcagataaccaag

SEQ ID NO: 366712 - DNA, 27 bp, Artificial Sequence
  Description of Artificial Sequence: Synthetic oligonucleotide
cggacatggcggctcagataaccaagc

SEQ ID NO: 366713 - DNA, 27 bp, Artificial Sequence
  Description of Artificial Sequence: Synthetic oligonucleotide
ggacatggcggctcagataaccaagcg

SEQ ID NO: 366714 - DNA, 27 bp, Artificial Sequence
  Description of Artificial Sequence: Synthetic oligonucleotide
gacatggcggctcagataaccaagcgc

SEQ ID NO: 366715 - DNA, 29 bp, Artificial Sequence
  Description of Artificial Sequence: Synthetic oligonucleotide
acatggcggctcagataaccaagcgcaag

SEQ ID NO: 366716 - DNA, 28 bp, Artificial Sequence
  Description of Artificial Sequence: Synthetic oligonucleotide
catggcggctcagataaccaagcgcaag

SEQ ID NO: 366717 - DNA, 29 bp, Artificial Sequence
  Description of Artificial Sequence: Synthetic oligonucleotide
atggcggctcagataaccaagcgcaagtg

SEQ ID NO: 366718 - DNA, 28 bp, Artificial Sequence
  Description of Artificial Sequence: Synthetic oligonucleotide
tggcggctcagataaccaagcgcaagtg

SEQ ID NO: 366719 - DNA, 27 bp, Artificial Sequence
  Description of Artificial Sequence: Synthetic oligonucleotide
ggcggctcagataaccaagcgcaagtg

SEQ ID NO: 366720 - DNA, 27 bp, Artificial Sequence
  Description of Artificial Sequence: Synthetic oligonucleotide
gcggctcagataaccaagcgcaagtgg

SEQ ID NO: 366721 - DNA, 27 bp, Artificial Sequence
  Description of Artificial Sequence: Synthetic oligonucleotide
cggctcagataaccaagcgcaagtggg

SEQ ID NO: 366722 - DNA, 28 bp, Artificial Sequence
  Description of Artificial Sequence: Synthetic oligonucleotide
ggctcagataaccaagcgcaagtgggag

SEQ ID NO: 366723 - DNA, 28 bp, Artificial Sequence
  Description of Artificial Sequence: Synthetic oligonucleotide
gctcagataaccaagcgcaagtgggagg

SEQ ID NO: 366724 - DNA, 28 bp, Artificial Sequence
  Description of Artificial Sequence: Synthetic oligonucleotide
ctcagataaccaagcgcaagtgggaggc

SEQ ID NO: 366725 - DNA, 28 bp, Artificial Sequence
  Description of Artificial Sequence: Synthetic oligonucleotide
tcagataaccaagcgcaagtgggaggcg

SEQ ID NO: 366726 - DNA, 27 bp, Artificial Sequence
  Description of Artificial Sequence: Synthetic oligonucleotide
cagataaccaagcgcaagtgggaggcg

SEQ ID NO: 366727 - DNA, 27 bp, Artificial Sequence
  Description of Artificial Sequence: Synthetic oligonucleotide
agataaccaagcgcaagtgggaggcgg

SEQ ID NO: 366728 - DNA, 26 bp, Artificial Sequence
  Description of Artificial Sequence: Synthetic oligonucleotide
gataaccaagcgcaagtgggaggcgg

SEQ ID NO: 366729 - DNA, 26 bp, Artificial Sequence
  Description of Artificial Sequence: Synthetic oligonucleotide
ataaccaagcgcaagtgggaggcggc

SEQ ID NO: 366730 - DNA, 25 bp, Artificial Sequence
  Description of Artificial Sequence: Synthetic oligonucleotide
taaccaagcgcaagtgggaggcggc

SEQ ID NO: 366731 - DNA, 24 bp, Artificial Sequence
  Description of Artificial Sequence: Synthetic oligonucleotide
aaccaagcgcaagtgggaggcggc

SEQ ID NO: 366732 - DNA, 25 bp, Artificial Sequence
  Description of Artificial Sequence: Synthetic oligonucleotide
ttcgacagcgacgctgcgagccaga

SEQ ID NO: 366733 - DNA, 24 bp, Artificial Sequence
  Description of Artificial Sequence: Synthetic oligonucleotide
tcgacagcgacgctgcgagccaga

SEQ ID NO: 366734 - DNA, 23 bp, Artificial Sequence
  Description of Artificial Sequence: Synthetic oligonucleotide
cgacagcgacgctgcgagccaga

SEQ ID NO: 366735 - DNA, 23 bp, Artificial Sequence
  Description of Artificial Sequence: Synthetic oligonucleotide
gacagcgacgctgcgagccagag

SEQ ID NO: 366736 - DNA, 25 bp, Artificial Sequence
  Description of Artificial Sequence: Synthetic oligonucleotide
acagcgacgctgcgagccagaggat

SEQ ID NO: 366737 - DNA, 24 bp, Artificial Sequence
  Description of Artificial Sequence: Synthetic oligonucleotide
cagcgacgctgcgagccagaggat

SEQ ID NO: 366738 - DNA, 24 bp, Artificial Sequence
  Description of Artificial Sequence: Synthetic oligonucleotide
agcgacgctgcgagccagaggatg

SEQ ID NO: 366739 - DNA, 23 bp, Artificial Sequence
  Description of Artificial Sequence: Synthetic oligonucleotide
gcgacgctgcgagccagaggatg

SEQ ID NO: 366740 - DNA, 24 bp, Artificial Sequence
  Description of Artificial Sequence: Synthetic oligonucleotide
cgacgctgcgagccagaggatgga

SEQ ID NO: 366741 - DNA, 24 bp, Artificial Sequence
  Description of Artificial Sequence: Synthetic oligonucleotide
gacgctgcgagccagaggatggag

SEQ ID NO: 366742 - DNA, 24 bp, Artificial Sequence
  Description of Artificial Sequence: Synthetic oligonucleotide
acgctgcgagccagaggatggagc

SEQ ID NO: 366743 - DNA, 23 bp, Artificial Sequence
  Description of Artificial Sequence: Synthetic oligonucleotide
cgctgcgagccagaggatggagc

SEQ ID NO: 366744 - DNA, 23 bp, Artificial Sequence
  Description of Artificial Sequence: Synthetic oligonucleotide
gctgcgagccagaggatggagcc

SEQ ID NO: 366745 - DNA, 23 bp, Artificial Sequence
  Description of Artificial Sequence: Synthetic oligonucleotide
ctgcgagccagaggatggagccg

SEQ ID NO: 366746 - DNA, 23 bp, Artificial Sequence
  Description of Artificial Sequence: Synthetic oligonucleotide
tgcgagccagaggatggagccgc

SEQ ID NO: 366747 - DNA, 29 bp, Artificial Sequence
  Description of Artificial Sequence: Synthetic oligonucleotide
gaggagacagggaaagtgaaggcccattc

SEQ ID NO: 366748 - DNA, 30 bp, Artificial Sequence; identical to SEQ ID NO: 14438
  Description of Artificial Sequence: Synthetic oligonucleotide

SEQ ID NO: 366749 - DNA, 29 bp, Artificial Sequence
  Description of Artificial Sequence: Synthetic oligonucleotide
ggagacagggaaagtgaaggcccattcac

SEQ ID NO: 366750 - DNA, 30 bp, Artificial Sequence; identical to SEQ ID NO: 14440
  Description of Artificial Sequence: Synthetic oligonucleotide

SEQ ID NO: 366751 - DNA, 31 bp, Artificial Sequence; identical to SEQ ID NO: 14441
  Description of Artificial Sequence: Synthetic oligonucleotide

SEQ ID NO: 366752 - DNA, 30 bp, Artificial Sequence; identical to SEQ ID NO: 14442
  Description of Artificial Sequence: Synthetic oligonucleotide

SEQ ID NO: 366753 - DNA, 31 bp, Artificial Sequence; identical to SEQ ID NO: 14443
  Description of Artificial Sequence: Synthetic oligonucleotide

SEQ ID NO: 366754 - DNA, 30 bp, Artificial Sequence; identical to SEQ ID NO: 14444
  Description of Artificial Sequence: Synthetic oligonucleotide

SEQ ID NO: 366755 - DNA, 31 bp, Artificial Sequence; identical to SEQ ID NO: 14445
  Description of Artificial Sequence: Synthetic oligonucleotide

SEQ ID NO: 366756 - DNA, 30 bp, Artificial Sequence; identical to SEQ ID NO: 14446
  Description of Artificial Sequence: Synthetic oligonucleotide

SEQ ID NO: 366757 - DNA, 30 bp, Artificial Sequence; identical to SEQ ID NO: 14447
  Description of Artificial Sequence: Synthetic oligonucleotide

SEQ ID NO: 366758 - DNA, 30 bp, Artificial Sequence; identical to SEQ ID NO: 14448
  Description of Artificial Sequence: Synthetic oligonucleotide

SEQ ID NO: 366759 - DNA, 31 bp, Artificial Sequence; identical to SEQ ID NO: 14449
  Description of Artificial Sequence: Synthetic oligonucleotide

SEQ ID NO: 366760 - DNA, 30 bp, Artificial Sequence; identical to SEQ ID NO: 14450
  Description of Artificial Sequence: Synthetic oligonucleotide

SEQ ID NO: 366761 - DNA, 29 bp, Artificial Sequence
  Description of Artificial Sequence: Synthetic oligonucleotide
agtgaaggcccattcacagactgaccgag

SEQ ID NO: 366762 - DNA, 28 bp, Artificial Sequence
  Description of Artificial Sequence: Synthetic oligonucleotide
gtgaaggcccattcacagactgaccgag

SEQ ID NO: 366763 - DNA, 29 bp, Artificial Sequence
  Description of Artificial Sequence: Synthetic oligonucleotide
tgaaggcccattcacagactgaccgagag

SEQ ID NO: 366764 - DNA, 28 bp, Artificial Sequence
  Description of Artificial Sequence: Synthetic oligonucleotide
gaaggcccattcacagactgaccgagag

SEQ ID NO: 366765 - DNA, 30 bp, Artificial Sequence; identical to SEQ ID NO: 14455
  Description of Artificial Sequence: Synthetic oligonucleotide

SEQ ID NO: 366766 - DNA, 29 bp, Artificial Sequence
  Description of Artificial Sequence: Synthetic oligonucleotide
aggcccattcacagactgaccgagagaac

SEQ ID NO: 366767 - DNA, 28 bp, Artificial Sequence
  Description of Artificial Sequence: Synthetic oligonucleotide
ggcccattcacagactgaccgagagaac

SEQ ID NO: 366768 - DNA, 28 bp, Artificial Sequence
  Description of Artificial Sequence: Synthetic oligonucleotide
gcccattcacagactgaccgagagaacc

SEQ ID NO: 366769 - DNA, 29 bp, Artificial Sequence
  Description of Artificial Sequence: Synthetic oligonucleotide
cccattcacagactgaccgagagaacctg

SEQ ID NO: 366770 - DNA, 29 bp, Artificial Sequence
  Description of Artificial Sequence: Synthetic oligonucleotide
ccattcacagactgaccgagagaacctgc

SEQ ID NO: 366771 - DNA, 29 bp, Artificial Sequence
  Description of Artificial Sequence: Synthetic oligonucleotide
cattcacagactgaccgagagaacctgcg

SEQ ID NO: 366772 - DNA, 29 bp, Artificial Sequence
  Description of Artificial Sequence: Synthetic oligonucleotide
attcacagactgaccgagagaacctgcgg

SEQ ID NO: 366773 - DNA, 28 bp, Artificial Sequence
  Description of Artificial Sequence: Synthetic oligonucleotide
ttcacagactgaccgagagaacctgcgg

SEQ ID NO: 366774 - DNA, 27 bp, Artificial Sequence
  Description of Artificial Sequence: Synthetic oligonucleotide
agcagagagcctacctggagggcacat

SEQ ID NO: 366775 - DNA, 26 bp, Artificial Sequence
  Description of Artificial Sequence: Synthetic oligonucleotide
gcagagagcctacctggagggcacat

SEQ ID NO: 366776 - DNA, 26 bp, Artificial Sequence
  Description of Artificial Sequence: Synthetic oligonucleotide
cagagagcctacctggagggcacatg

SEQ ID NO: 366777 - DNA, 26 bp, Artificial Sequence
  Description of Artificial Sequence: Synthetic oligonucleotide
agagagcctacctggagggcacatgc

SEQ ID NO: 366778 - DNA, 24 bp, Artificial Sequence
  Description of Artificial Sequence: Synthetic oligonucleotide
agcgccgtggatagagcaggaggg

SEQ ID NO: 366779 - DNA, 23 bp, Artificial Sequence
  Description of Artificial Sequence: Synthetic oligonucleotide
tcttggaccgccgcggacatggc

SEQ ID NO: 366780 - DNA, 22 bp, Artificial Sequence
  Description of Artificial Sequence: Synthetic oligonucleotide
cttggaccgccgcggacatggc

SEQ ID NO: 366781 - DNA, 22 bp, Artificial Sequence
  Description of Artificial Sequence: Synthetic oligonucleotide
ttggaccgccgcggacatggcg

SEQ ID NO: 366782 - DNA, 21 bp, Artificial Sequence
  Description of Artificial Sequence: Synthetic oligonucleotide
tggaccgccgcggacatggcg

SEQ ID NO: 366783 - DNA, 20 bp, Artificial Sequence
  Description of Artificial Sequence: Synthetic oligonucleotide
ggaccgccgcggacatggcg

SEQ ID NO: 366784 - DNA, 20 bp, Artificial Sequence
  Description of Artificial Sequence: Synthetic oligonucleotide
gaccgccgcggacatggcgg

SEQ ID NO: 366785 - DNA, 21 bp, Artificial Sequence
  Description of Artificial Sequence: Synthetic oligonucleotide
accgccgcggacatggcggct

SEQ ID NO: 366786 - DNA, 20 bp, Artificial Sequence
  Description of Artificial Sequence: Synthetic oligonucleotide
ccgccgcggacatggcggct

SEQ ID NO: 366787 - DNA, 21 bp, Artificial Sequence
  Description of Artificial Sequence: Synthetic oligonucleotide
cgccgcggacatggcggctca

SEQ ID NO: 366788 - DNA, 23 bp, Artificial Sequence
  Description of Artificial Sequence: Synthetic oligonucleotide
gccgcggacatggcggctcagat

SEQ ID NO: 366789 - DNA, 24 bp, Artificial Sequence
  Description of Artificial Sequence: Synthetic oligonucleotide
ccgcggacatggcggctcagatca

SEQ ID NO: 366790 - DNA, 24 bp, Artificial Sequence
  Description of Artificial Sequence: Synthetic oligonucleotide
cgcggacatggcggctcagatcac

SEQ ID NO: 366791 - DNA, 28 bp, Artificial Sequence
  Description of Artificial Sequence: Synthetic oligonucleotide
ggagtattgggacgaggagacagggaag

SEQ ID NO: 366792 - DNA, 28 bp, Artificial Sequence
  Description of Artificial Sequence: Synthetic oligonucleotide
gagtattgggacgaggagacagggaagg

SEQ ID NO: 366793 - DNA, 29 bp, Artificial Sequence
  Description of Artificial Sequence: Synthetic oligonucleotide
agtattgggacgaggagacagggaaggtg

SEQ ID NO: 366794 - DNA, 28 bp, Artificial Sequence
  Description of Artificial Sequence: Synthetic oligonucleotide
gtattgggacgaggagacagggaaggtg

SEQ ID NO: 366795 - DNA, 30 bp, Artificial Sequence; identical to SEQ ID NO: 14507
  Description of Artificial Sequence: Synthetic oligonucleotide

SEQ ID NO: 366796 - DNA, 29 bp, Artificial Sequence
  Description of Artificial Sequence: Synthetic oligonucleotide
attgggacgaggagacagggaaggtgaag

SEQ ID NO: 366797 - DNA, 28 bp, Artificial Sequence
  Description of Artificial Sequence: Synthetic oligonucleotide
ttgggacgaggagacagggaaggtgaag

SEQ ID NO: 366798 - DNA, 27 bp, Artificial Sequence
  Description of Artificial Sequence: Synthetic oligonucleotide
tgggacgaggagacagggaaggtgaag

SEQ ID NO: 366799 - DNA, 26 bp, Artificial Sequence
  Description of Artificial Sequence: Synthetic oligonucleotide
gggacgaggagacagggaaggtgaag

SEQ ID NO: 366800 - DNA, 26 bp, Artificial Sequence
  Description of Artificial Sequence: Synthetic oligonucleotide
ggacgaggagacagggaaggtgaagg

SEQ ID NO: 366801 - DNA, 26 bp, Artificial Sequence
  Description of Artificial Sequence: Synthetic oligonucleotide
gacgaggagacagggaaggtgaaggc

SEQ ID NO: 366802 - DNA, 26 bp, Artificial Sequence
  Description of Artificial Sequence: Synthetic oligonucleotide
acgaggagacagggaaggtgaaggcc

SEQ ID NO: 366803 - DNA, 25 bp, Artificial Sequence
  Description of Artificial Sequence: Synthetic oligonucleotide
cgaggagacagggaaggtgaaggcc

SEQ ID NO: 366804 - DNA, 26 bp, Artificial Sequence
  Description of Artificial Sequence: Synthetic oligonucleotide
gaggagacagggaaggtgaaggccca

SEQ ID NO: 366805 - DNA, 27 bp, Artificial Sequence
  Description of Artificial Sequence: Synthetic oligonucleotide
aggagacagggaaggtgaaggcccact

SEQ ID NO: 366806 - DNA, 26 bp, Artificial Sequence
  Description of Artificial Sequence: Synthetic oligonucleotide
ggagacagggaaggtgaaggcccact

SEQ ID NO: 366807 - DNA, 27 bp, Artificial Sequence
  Description of Artificial Sequence: Synthetic oligonucleotide
gagacagggaaggtgaaggcccactca

SEQ ID NO: 366808 - DNA, 27 bp, Artificial Sequence
  Description of Artificial Sequence: Synthetic oligonucleotide
agacagggaaggtgaaggcccactcac

SEQ ID NO: 366809 - DNA, 27 bp, Artificial Sequence
  Description of Artificial Sequence: Synthetic oligonucleotide
gacagggaaggtgaaggcccactcaca

SEQ ID NO: 366810 - DNA, 27 bp, Artificial Sequence
  Description of Artificial Sequence: Synthetic oligonucleotide
acagggaaggtgaaggcccactcacag

SEQ ID NO: 366811 - DNA, 27 bp, Artificial Sequence
  Description of Artificial Sequence: Synthetic oligonucleotide
cagggaaggtgaaggcccactcacaga

SEQ ID NO: 366812 - DNA, 27 bp, Artificial Sequence
  Description of Artificial Sequence: Synthetic oligonucleotide
agggaaggtgaaggcccactcacagac

SEQ ID NO: 366813 - DNA, 27 bp, Artificial Sequence
  Description of Artificial Sequence: Synthetic oligonucleotide
gggaaggtgaaggcccactcacagact

SEQ ID NO: 366814 - DNA, 27 bp, Artificial Sequence
  Description of Artificial Sequence: Synthetic oligonucleotide
ggaaggtgaaggcccactcacagactg

SEQ ID NO: 366815 - DNA, 28 bp, Artificial Sequence
  Description of Artificial Sequence: Synthetic oligonucleotide
gaaggtgaaggcccactcacagactgac

SEQ ID NO: 366816 - DNA, 28 bp, Artificial Sequence
  Description of Artificial Sequence: Synthetic oligonucleotide
aaggtgaaggcccactcacagactgacc

SEQ ID NO: 366817 - DNA, 27 bp, Artificial Sequence
  Description of Artificial Sequence: Synthetic oligonucleotide
aggtgaaggcccactcacagactgacc

SEQ ID NO: 366818 - DNA, 26 bp, Artificial Sequence
  Description of Artificial Sequence: Synthetic oligonucleotide
ggtgaaggcccactcacagactgacc

SEQ ID NO: 366819 - DNA, 24 bp, Artificial Sequence
  Description of Artificial Sequence: Synthetic oligonucleotide
gacgccgcgagccagaggatggaa

SEQ ID NO: 366820 - DNA, 24 bp, Artificial Sequence
  Description of Artificial Sequence: Synthetic oligonucleotide
acgccgcgagccagaggatggaac

SEQ ID NO: 366821 - DNA, 23 bp, Artificial Sequence
  Description of Artificial Sequence: Synthetic oligonucleotide
cgccgcgagccagaggatggaac

SEQ ID NO: 366822 - DNA, 23 bp, Artificial Sequence
  Description of Artificial Sequence: Synthetic oligonucleotide
gccgcgagccagaggatggaacc

SEQ ID NO: 366823 - DNA, 23 bp, Artificial Sequence
  Description of Artificial Sequence: Synthetic oligonucleotide
ccgcgagccagaggatggaaccg

SEQ ID NO: 366824 - DNA, 23 bp, Artificial Sequence
  Description of Artificial Sequence: Synthetic oligonucleotide
cgcgagccagaggatggaaccgc

SEQ ID NO: 366825 - DNA, 23 bp, Artificial Sequence
  Description of Artificial Sequence: Synthetic oligonucleotide
gcgagccagaggatggaaccgcg

SEQ ID NO: 366826 - DNA, 23 bp, Artificial Sequence
  Description of Artificial Sequence: Synthetic oligonucleotide
cgagccagaggatggaaccgcgg

SEQ ID NO: 366827 - DNA, 23 bp, Artificial Sequence
  Description of Artificial Sequence: Synthetic oligonucleotide
gagccagaggatggaaccgcggg

SEQ ID NO: 366828 - DNA, 23 bp, Artificial Sequence
  Description of Artificial Sequence: Synthetic oligonucleotide
agccagaggatggaaccgcgggc

SEQ ID NO: 366829 - DNA, 22 bp, Artificial Sequence
  Description of Artificial Sequence: Synthetic oligonucleotide
gccagaggatggaaccgcgggc

SEQ ID NO: 366830 - DNA, 22 bp, Artificial Sequence
  Description of Artificial Sequence: Synthetic oligonucleotide
ccagaggatggaaccgcgggcg

SEQ ID NO: 366831 - DNA, 22 bp, Artificial Sequence
  Description of Artificial Sequence: Synthetic oligonucleotide
cagaggatggaaccgcgggcgc

SEQ ID NO: 366832 - DNA, 22 bp, Artificial Sequence
  Description of Artificial Sequence: Synthetic oligonucleotide
agaggatggaaccgcgggcgcc

SEQ ID NO: 366833 - DNA, 21 bp, Artificial Sequence
  Description of Artificial Sequence: Synthetic oligonucleotide
gaggatggaaccgcgggcgcc

SEQ ID NO: 366834 - DNA, 22 bp, Artificial Sequence
  Description of Artificial Sequence: Synthetic oligonucleotide
aggatggaaccgcgggcgccgt

SEQ ID NO: 366835 - DNA, 21 bp, Artificial Sequence
  Description of Artificial Sequence: Synthetic oligonucleotide
ggatggaaccgcgggcgccgt

SEQ ID NO: 366836 - DNA, 21 bp, Artificial Sequence
  Description of Artificial Sequence: Synthetic oligonucleotide
gatggaaccgcgggcgccgtg

SEQ ID NO: 366837 - DNA, 24 bp, Artificial Sequence
  Description of Artificial Sequence: Synthetic oligonucleotide
atggaaccgcgggcgccgtggata

SEQ ID NO: 366838 - DNA, 23 bp, Artificial Sequence
  Description of Artificial Sequence: Synthetic oligonucleotide
tggaaccgcgggcgccgtggata

SEQ ID NO: 366839 - DNA, 22 bp, Artificial Sequence
  Description of Artificial Sequence: Synthetic oligonucleotide
ggaaccgcgggcgccgtggata

SEQ ID NO: 366840 - DNA, 23 bp, Artificial Sequence
  Description of Artificial Sequence: Synthetic oligonucleotide
gaaccgcgggcgccgtggataga

SEQ ID NO: 366841 - DNA, 23 bp, Artificial Sequence
  Description of Artificial Sequence: Synthetic oligonucleotide
aaccgcgggcgccgtggatagag

SEQ ID NO: 366842 - DNA, 22 bp, Artificial Sequence
  Description of Artificial Sequence: Synthetic oligonucleotide
accgcgggcgccgtggatagag

SEQ ID NO: 366843 - DNA, 29 bp, Artificial Sequence
  Description of Artificial Sequence: Synthetic oligonucleotide
cagatgatgtttggctgcgacgtgggatc

SEQ ID NO: 366844 - DNA, 29 bp, Artificial Sequence
  Description of Artificial Sequence: Synthetic oligonucleotide
agatgatgtttggctgcgacgtgggatcg

SEQ ID NO: 366845 - DNA, 28 bp, Artificial Sequence
  Description of Artificial Sequence: Synthetic oligonucleotide
gatgatgtttggctgcgacgtgggatcg

SEQ ID NO: 366846 - DNA, 28 bp, Artificial Sequence
  Description of Artificial Sequence: Synthetic oligonucleotide
atgatgtttggctgcgacgtgggatcgg

SEQ ID NO: 366847 - DNA, 27 bp, Artificial Sequence
  Description of Artificial Sequence: Synthetic oligonucleotide
tgatgtttggctgcgacgtgggatcgg

SEQ ID NO: 366848 - DNA, 27 bp, Artificial Sequence
  Description of Artificial Sequence: Synthetic oligonucleotide
gatgtttggctgcgacgtgggatcgga

SEQ ID NO: 366849 - DNA, 27 bp, Artificial Sequence
  Description of Artificial Sequence: Synthetic oligonucleotide
atgtttggctgcgacgtgggatcggac

SEQ ID NO: 366850 - DNA, 26 bp, Artificial Sequence
  Description of Artificial Sequence: Synthetic oligonucleotide
tgtttggctgcgacgtgggatcggac

SEQ ID NO: 366851 - DNA, 25 bp, Artificial Sequence
  Description of Artificial Sequence: Synthetic oligonucleotide
gtttggctgcgacgtgggatcggac

SEQ ID NO: 366852 - DNA, 25 bp, Artificial Sequence
  Description of Artificial Sequence: Synthetic oligonucleotide
tttggctgcgacgtgggatcggacg

SEQ ID NO: 366853 - DNA, 24 bp, Artificial Sequence
  Description of Artificial Sequence: Synthetic oligonucleotide
ttggctgcgacgtgggatcggacg

SEQ ID NO: 366854 - DNA, 28 bp, Artificial Sequence
  Description of Artificial Sequence: Synthetic oligonucleotide
ctgaaagaggacctgcgctcttggactg

SEQ ID NO: 366855 - DNA, 28 bp, Artificial Sequence
  Description of Artificial Sequence: Synthetic oligonucleotide
tgaaagaggacctgcgctcttggactgc

SEQ ID NO: 366856 - DNA, 27 bp, Artificial Sequence
  Description of Artificial Sequence: Synthetic oligonucleotide
gaaagaggacctgcgctcttggactgc

SEQ ID NO: 366857 - DNA, 27 bp, Artificial Sequence
  Description of Artificial Sequence: Synthetic oligonucleotide
aaagaggacctgcgctcttggactgcg

SEQ ID NO: 366858 - DNA, 26 bp, Artificial Sequence
  Description of Artificial Sequence: Synthetic oligonucleotide
aagaggacctgcgctcttggactgcg

SEQ ID NO: 366859 - DNA, 25 bp, Artificial Sequence
  Description of Artificial Sequence: Synthetic oligonucleotide
agaggacctgcgctcttggactgcg

SEQ ID NO: 366860 - DNA, 24 bp, Artificial Sequence
  Description of Artificial Sequence: Synthetic oligonucleotide
gaggacctgcgctcttggactgcg

SEQ ID NO: 366861 - DNA, 24 bp, Artificial Sequence
  Description of Artificial Sequence: Synthetic oligonucleotide
aggacctgcgctcttggactgcgg

SEQ ID NO: 366862 - DNA, 23 bp, Artificial Sequence
  Description of Artificial Sequence: Synthetic oligonucleotide
ggacctgcgctcttggactgcgg

SEQ ID NO: 366863 - DNA, 23 bp, Artificial Sequence
  Description of Artificial Sequence: Synthetic oligonucleotide
gacctgcgctcttggactgcggc

SEQ ID NO: 366864 - DNA, 23 bp, Artificial Sequence
  Description of Artificial Sequence: Synthetic oligonucleotide
acctgcgctcttggactgcggcg

SEQ ID NO: 366865 - DNA, 22 bp, Artificial Sequence
  Description of Artificial Sequence: Synthetic oligonucleotide
cctgcgctcttggactgcggcg

SEQ ID NO: 366866 - DNA, 23 bp, Artificial Sequence
  Description of Artificial Sequence: Synthetic oligonucleotide
ctgcgctcttggactgcggcgga

SEQ ID NO: 366867 - DNA, 25 bp, Artificial Sequence
  Description of Artificial Sequence: Synthetic oligonucleotide
tgcgctcttggactgcggcggacat

SEQ ID NO: 366868 - DNA, 24 bp, Artificial Sequence
  Description of Artificial Sequence: Synthetic oligonucleotide
gcgctcttggactgcggcggacat

SEQ ID NO: 366869 - DNA, 24 bp, Artificial Sequence
  Description of Artificial Sequence: Synthetic oligonucleotide
cgctcttggactgcggcggacatg

SEQ ID NO: 366870 - DNA, 24 bp, Artificial Sequence
  Description of Artificial Sequence: Synthetic oligonucleotide
gctcttggactgcggcggacatgg

SEQ ID NO: 366871 - DNA, 24 bp, Artificial Sequence
  Description of Artificial Sequence: Synthetic oligonucleotide
ctcttggactgcggcggacatggc

SEQ ID NO: 366872 - DNA, 24 bp, Artificial Sequence
  Description of Artificial Sequence: Synthetic oligonucleotide
tcttggactgcggcggacatggcg

SEQ ID NO: 366873 - DNA, 23 bp, Artificial Sequence
  Description of Artificial Sequence: Synthetic oligonucleotide
cttggactgcggcggacatggcg

SEQ ID NO: 366874 - DNA, 23 bp, Artificial Sequence
  Description of Artificial Sequence: Synthetic oligonucleotide
ttggactgcggcggacatggcgg

SEQ ID NO: 366875 - DNA, 22 bp, Artificial Sequence
  Description of Artificial Sequence: Synthetic oligonucleotide
tggactgcggcggacatggcgg

SEQ ID NO: 366876 - DNA, 21 bp, Artificial Sequence
  Description of Artificial Sequence: Synthetic oligonucleotide
ggactgcggcggacatggcgg

SEQ ID NO: 366877 - DNA, 22 bp, Artificial Sequence
  Description of Artificial Sequence: Synthetic oligonucleotide
gactgcggcggacatggcggct

SEQ ID NO: 366878 - DNA, 23 bp, Artificial Sequence
  Description of Artificial Sequence: Synthetic oligonucleotide
actgcggcggacatggcggctca

SEQ ID NO: 366879 - DNA, 22 bp, Artificial Sequence
  Description of Artificial Sequence: Synthetic oligonucleotide
ctgcggcggacatggcggctca

SEQ ID NO: 366880 - DNA, 24 bp, Artificial Sequence
  Description of Artificial Sequence: Synthetic oligonucleotide
tgcggcggacatggcggctcagat

SEQ ID NO: 366881 - DNA, 27 bp, Artificial Sequence
  Description of Artificial Sequence: Synthetic oligonucleotide
acccaggacacggagcttgtggagact

SEQ ID NO: 366882 - DNA, 27 bp, Artificial Sequence
  Description of Artificial Sequence: Synthetic oligonucleotide
cccaggacacggagcttgtggagacta

SEQ ID NO: 366883 - DNA, 27 bp, Artificial Sequence
  Description of Artificial Sequence: Synthetic oligonucleotide
ccaggacacggagcttgtggagactag

SEQ ID NO: 366884 - DNA, 27 bp, Artificial Sequence
  Description of Artificial Sequence: Synthetic oligonucleotide
caggacacggagcttgtggagactagg

SEQ ID NO: 366885 - DNA, 27 bp, Artificial Sequence
  Description of Artificial Sequence: Synthetic oligonucleotide
aggacacggagcttgtggagactaggc

SEQ ID NO: 366886 - DNA, 26 bp, Artificial Sequence
  Description of Artificial Sequence: Synthetic oligonucleotide
ggacacggagcttgtggagactaggc

SEQ ID NO: 366887 - DNA, 27 bp, Artificial Sequence
  Description of Artificial Sequence: Synthetic oligonucleotide
gacacggagcttgtggagactaggcct

SEQ ID NO: 366888 - DNA, 27 bp, Artificial Sequence
  Description of Artificial Sequence: Synthetic oligonucleotide
acacggagcttgtggagactaggcctg

SEQ ID NO: 366889 - DNA, 26 bp, Artificial Sequence
  Description of Artificial Sequence: Synthetic oligonucleotide
cacggagcttgtggagactaggcctg

SEQ ID NO: 366890 - DNA, 27 bp, Artificial Sequence
  Description of Artificial Sequence: Synthetic oligonucleotide
acggagcttgtggagactaggcctgca

SEQ ID NO: 366891 - DNA, 26 bp, Artificial Sequence
  Description of Artificial Sequence: Synthetic oligonucleotide
cggagcttgtggagactaggcctgca

SEQ ID NO: 366892 - DNA, 26 bp, Artificial Sequence
  Description of Artificial Sequence: Synthetic oligonucleotide
ggagcttgtggagactaggcctgcag

SEQ ID NO: 366893 - DNA, 26 bp, Artificial Sequence
  Description of Artificial Sequence: Synthetic oligonucleotide
gagcttgtggagactaggcctgcagg

SEQ ID NO: 366894 - DNA, 26 bp, Artificial Sequence
  Description of Artificial Sequence: Synthetic oligonucleotide
agcttgtggagactaggcctgcaggg

SEQ ID NO: 366895 - DNA, 25 bp, Artificial Sequence
  Description of Artificial Sequence: Synthetic oligonucleotide
gcttgtggagactaggcctgcaggg

SEQ ID NO: 366896 - DNA, 27 bp, Artificial Sequence
  Description of Artificial Sequence: Synthetic oligonucleotide
cttgtggagactaggcctgcaggggat

SEQ ID NO: 366897 - DNA, 27 bp, Artificial Sequence
  Description of Artificial Sequence: Synthetic oligonucleotide
ttgtggagactaggcctgcaggggatg

SEQ ID NO: 366898 - DNA, 26 bp, Artificial Sequence
  Description of Artificial Sequence: Synthetic oligonucleotide
tgtggagactaggcctgcaggggatg

SEQ ID NO: 366899 - DNA, 25 bp, Artificial Sequence
  Description of Artificial Sequence: Synthetic oligonucleotide
gtggagactaggcctgcaggggatg

SEQ ID NO: 366900 - DNA, 27 bp, Artificial Sequence
  Description of Artificial Sequence: Synthetic oligonucleotide
tggagactaggcctgcaggggatggaa

SEQ ID NO: 366901 - DNA, 26 bp, Artificial Sequence
  Description of Artificial Sequence: Synthetic oligonucleotide
ggagactaggcctgcaggggatggaa

SEQ ID NO: 366902 - DNA, 26 bp, Artificial Sequence
  Description of Artificial Sequence: Synthetic oligonucleotide
gagactaggcctgcaggggatggaac

SEQ ID NO: 366903 - DNA, 27 bp, Artificial Sequence
  Description of Artificial Sequence: Synthetic oligonucleotide
agactaggcctgcaggggatggaacct

SEQ ID NO: 366904 - DNA, 27 bp, Artificial Sequence
  Description of Artificial Sequence: Synthetic oligonucleotide
gactaggcctgcaggggatggaacctt

SEQ ID NO: 366905 - DNA, 27 bp, Artificial Sequence
  Description of Artificial Sequence: Synthetic oligonucleotide
actaggcctgcaggggatggaaccttc

SEQ ID NO: 366906 - DNA, 26 bp, Artificial Sequence
  Description of Artificial Sequence: Synthetic oligonucleotide
ctaggcctgcaggggatggaaccttc

SEQ ID NO: 366907 - DNA, 27 bp, Artificial Sequence
  Description of Artificial Sequence: Synthetic oligonucleotide
taggcctgcaggggatggaaccttcca

SEQ ID NO: 366908 - DNA, 26 bp, Artificial Sequence
  Description of Artificial Sequence: Synthetic oligonucleotide
caggaggggccagagtattgggacga

SEQ ID NO: 366909 - DNA, 26 bp, Artificial Sequence
  Description of Artificial Sequence: Synthetic oligonucleotide
aggaggggccagagtattgggacgag

SEQ ID NO: 366910 - DNA, 25 bp, Artificial Sequence
  Description of Artificial Sequence: Synthetic oligonucleotide
ggaggggccagagtattgggacgag

SEQ ID NO: 366911 - DNA, 26 bp, Artificial Sequence
  Description of Artificial Sequence: Synthetic oligonucleotide
gaggggccagagtattgggacgagga

SEQ ID NO: 366912 - DNA, 27 bp, Artificial Sequence
  Description of Artificial Sequence: Synthetic oligonucleotide
aggggccagagtattgggacgaggaga

SEQ ID NO: 366913 - DNA, 26 bp, Artificial Sequence
  Description of Artificial Sequence: Synthetic oligonucleotide
ggggccagagtattgggacgaggaga

SEQ ID NO: 366914 - DNA, 27 bp, Artificial Sequence
  Description of Artificial Sequence: Synthetic oligonucleotide
gggccagagtattgggacgaggagaca

SEQ ID NO: 366915 - DNA, 27 bp, Artificial Sequence
  Description of Artificial Sequence: Synthetic oligonucleotide
ggccagagtattgggacgaggagacag

SEQ ID NO: 366916 - DNA, 27 bp, Artificial Sequence
  Description of Artificial Sequence: Synthetic oligonucleotide
gccagagtattgggacgaggagacagg

SEQ ID NO: 366917 - DNA, 27 bp, Artificial Sequence
  Description of Artificial Sequence: Synthetic oligonucleotide
ccagagtattgggacgaggagacaggg

SEQ ID NO: 366918 - DNA, 30 bp, Artificial Sequence; identical to SEQ ID NO: 14658
  Description of Artificial Sequence: Synthetic oligonucleotide

SEQ ID NO: 366919 - DNA, 31 bp, Artificial Sequence; identical to SEQ ID NO: 14659
  Description of Artificial Sequence: Synthetic oligonucleotide

SEQ ID NO: 366920 - DNA, 27 bp, Artificial Sequence
  Description of Artificial Sequence: Synthetic oligonucleotide
aacctgcggatcgcgctccgctactat

SEQ ID NO: 366921 - DNA, 27 bp, Artificial Sequence
  Description of Artificial Sequence: Synthetic oligonucleotide
acctgcggatcgcgctccgctactata

SEQ ID NO: 366922 - DNA, 27 bp, Artificial Sequence
  Description of Artificial Sequence: Synthetic oligonucleotide
cctgcggatcgcgctccgctactataa

SEQ ID NO: 366923 - DNA, 27 bp, Artificial Sequence
  Description of Artificial Sequence: Synthetic oligonucleotide
ctgcggatcgcgctccgctactataac

SEQ ID NO: 366924 - DNA, 27 bp, Artificial Sequence
  Description of Artificial Sequence: Synthetic oligonucleotide
tgcggatcgcgctccgctactataacc

SEQ ID NO: 366925 - DNA, 27 bp, Artificial Sequence
  Description of Artificial Sequence: Synthetic oligonucleotide
gcggatcgcgctccgctactataacca

SEQ ID NO: 366926 - DNA, 27 bp, Artificial Sequence
  Description of Artificial Sequence: Synthetic oligonucleotide
cggatcgcgctccgctactataaccag

SEQ ID NO: 366927 - DNA, 28 bp, Artificial Sequence
  Description of Artificial Sequence: Synthetic oligonucleotide
ggatcgcgctccgctactataaccagag

SEQ ID NO: 366928 - DNA, 28 bp, Artificial Sequence
  Description of Artificial Sequence: Synthetic oligonucleotide
gatcgcgctccgctactataaccagagc

SEQ ID NO: 366929 - DNA, 28 bp, Artificial Sequence
  Description of Artificial Sequence: Synthetic oligonucleotide
atcgcgctccgctactataaccagagcg

SEQ ID NO: 366930 - DNA, 27 bp, Artificial Sequence
  Description of Artificial Sequence: Synthetic oligonucleotide
tcgcgctccgctactataaccagagcg

SEQ ID NO: 366931 - DNA, 27 bp, Artificial Sequence
  Description of Artificial Sequence: Synthetic oligonucleotide
cgcgctccgctactataaccagagcga

SEQ ID NO: 366932 - DNA, 27 bp, Artificial Sequence
  Description of Artificial Sequence: Synthetic oligonucleotide
gcgctccgctactataaccagagcgag

SEQ ID NO: 366933 - DNA, 27 bp, Artificial Sequence
  Description of Artificial Sequence: Synthetic oligonucleotide
cgctccgctactataaccagagcgagg

SEQ ID NO: 366934 - DNA, 27 bp, Artificial Sequence
  Description of Artificial Sequence: Synthetic oligonucleotide
gctccgctactataaccagagcgaggc

SEQ ID NO: 366935 - DNA, 27 bp, Artificial Sequence
  Description of Artificial Sequence: Synthetic oligonucleotide
ctccgctactataaccagagcgaggcc

SEQ ID NO: 366936 - DNA, 27 bp, Artificial Sequence
  Description of Artificial Sequence: Synthetic oligonucleotide
tccgctactataaccagagcgaggccg

SEQ ID NO: 366937 - DNA, 26 bp, Artificial Sequence
  Description of Artificial Sequence: Synthetic oligonucleotide
ccgctactataaccagagcgaggccg

SEQ ID NO: 366938 - DNA, 27 bp, Artificial Sequence
  Description of Artificial Sequence: Synthetic oligonucleotide
cgctactataaccagagcgaggccggt

SEQ ID NO: 366939 - DNA, 28 bp, Artificial Sequence
  Description of Artificial Sequence: Synthetic oligonucleotide
gctactataaccagagcgaggccggttc

SEQ ID NO: 366940 - DNA, 29 bp, Artificial Sequence
  Description of Artificial Sequence: Synthetic oligonucleotide
ctactataaccagagcgaggccggttctc

SEQ ID NO: 366941 - DNA, 30 bp, Artificial Sequence; identical to SEQ ID NO: 14681
  Description of Artificial Sequence: Synthetic oligonucleotide

SEQ ID NO: 366942 - DNA, 29 bp, Artificial Sequence
  Description of Artificial Sequence: Synthetic oligonucleotide
actataaccagagcgaggccggttctcac

SEQ ID NO: 366943 - DNA, 28 bp, Artificial Sequence
  Description of Artificial Sequence: Synthetic oligonucleotide
ctataaccagagcgaggccggttctcac

SEQ ID NO: 366944 - DNA, 29 bp, Artificial Sequence
  Description of Artificial Sequence: Synthetic oligonucleotide
tataaccagagcgaggccggttctcacac

SEQ ID NO: 366945 - DNA, 28 bp, Artificial Sequence
  Description of Artificial Sequence: Synthetic oligonucleotide
ataaccagagcgaggccggttctcacac

SEQ ID NO: 366946 - DNA, 27 bp, Artificial Sequence
  Description of Artificial Sequence: Synthetic oligonucleotide
taaccagagcgaggccggttctcacac

SEQ ID NO: 366947 - DNA, 29 bp, Artificial Sequence
  Description of Artificial Sequence: Synthetic oligonucleotide
cgcagatacctggagaacgggaaggaaac

SEQ ID NO: 366948 - DNA, 29 bp, Artificial Sequence
  Description of Artificial Sequence: Synthetic oligonucleotide
gcagatacctggagaacgggaaggaaacg

SEQ ID NO: 366949 - DNA, 29 bp, Artificial Sequence
  Description of Artificial Sequence: Synthetic oligonucleotide
cagatacctggagaacgggaaggaaacgc

SEQ ID NO: 366950 - DNA, 30 bp, Artificial Sequence; identical to SEQ ID NO: 14690
  Description of Artificial Sequence: Synthetic oligonucleotide

SEQ ID NO: 366951 - DNA, 29 bp, Artificial Sequence
  Description of Artificial Sequence: Synthetic oligonucleotide
gatacctggagaacgggaaggaaacgctg

SEQ ID NO: 366952 - DNA, 29 bp, Artificial Sequence
  Description of Artificial Sequence: Synthetic oligonucleotide
atacctggagaacgggaaggaaacgctgc

SEQ ID NO: 366953 - DNA, 28 bp, Artificial Sequence
  Description of Artificial Sequence: Synthetic oligonucleotide
tacctggagaacgggaaggaaacgctgc

SEQ ID NO: 366954 - DNA, 27 bp, Artificial Sequence
  Description of Artificial Sequence: Synthetic oligonucleotide
acctggagaacgggaaggaaacgctgc

SEQ ID NO: 366955 - DNA, 27 bp, Artificial Sequence
  Description of Artificial Sequence: Synthetic oligonucleotide
cctggagaacgggaaggaaacgctgca

SEQ ID NO: 366956 - DNA, 27 bp, Artificial Sequence
  Description of Artificial Sequence: Synthetic oligonucleotide
ctggagaacgggaaggaaacgctgcag

SEQ ID NO: 366957 - DNA, 27 bp, Artificial Sequence
  Description of Artificial Sequence: Synthetic oligonucleotide
tggagaacgggaaggaaacgctgcagc

SEQ ID NO: 366958 - DNA, 26 bp, Artificial Sequence
  Description of Artificial Sequence: Synthetic oligonucleotide
ggagaacgggaaggaaacgctgcagc

SEQ ID NO: 366959 - DNA, 26 bp, Artificial Sequence
  Description of Artificial Sequence: Synthetic oligonucleotide
gagaacgggaaggaaacgctgcagcg

SEQ ID NO: 366960 - DNA, 27 bp, Artificial Sequence
  Description of Artificial Sequence: Synthetic oligonucleotide
agaacgggaaggaaacgctgcagcgca

SEQ ID NO: 366961 - DNA, 26 bp, Artificial Sequence
  Description of Artificial Sequence: Synthetic oligonucleotide
gaacgggaaggaaacgctgcagcgca

SEQ ID NO: 366962 - DNA, 26 bp, Artificial Sequence
  Description of Artificial Sequence: Synthetic oligonucleotide
aacgggaaggaaacgctgcagcgcac

SEQ ID NO: 366963 - DNA, 25 bp, Artificial Sequence
  Description of Artificial Sequence: Synthetic oligonucleotide
acgggaaggaaacgctgcagcgcac

SEQ ID NO: 366964 - DNA, 24 bp, Artificial Sequence
  Description of Artificial Sequence: Synthetic oligonucleotide
cgggaaggaaacgctgcagcgcac

SEQ ID NO: 366965 - DNA, 24 bp, Artificial Sequence
  Description of Artificial Sequence: Synthetic oligonucleotide
gggaaggaaacgctgcagcgcacg

SEQ ID NO: 366966 - DNA, 25 bp, Artificial Sequence
  Description of Artificial Sequence: Synthetic oligonucleotide
ggaaggaaacgctgcagcgcacgga

SEQ ID NO: 366967 - DNA, 25 bp, Artificial Sequence
  Description of Artificial Sequence: Synthetic oligonucleotide
gaaggaaacgctgcagcgcacggac

SEQ ID NO: 366968 - DNA, 25 bp, Artificial Sequence
  Description of Artificial Sequence: Synthetic oligonucleotide
aaggaaacgctgcagcgcacggacc

SEQ ID NO: 366969 - DNA, 24 bp, Artificial Sequence
  Description of Artificial Sequence: Synthetic oligonucleotide
aggaaacgctgcagcgcacggacc

SEQ ID NO: 366970 - DNA, 23 bp, Artificial Sequence
  Description of Artificial Sequence: Synthetic oligonucleotide
ggaaacgctgcagcgcacggacc

SEQ ID NO: 366971 - DNA, 23 bp, Artificial Sequence
  Description of Artificial Sequence: Synthetic oligonucleotide
gaaacgctgcagcgcacggaccc

SEQ ID NO: 366972 - DNA, 23 bp, Artificial Sequence
  Description of Artificial Sequence: Synthetic oligonucleotide
aaacgctgcagcgcacggacccc

SEQ ID NO: 366973 - DNA, 22 bp, Artificial Sequence
  Description of Artificial Sequence: Synthetic oligonucleotide
aacgctgcagcgcacggacccc

SEQ ID NO: 366974 - DNA, 24 bp, Artificial Sequence
  Description of Artificial Sequence: Synthetic oligonucleotide
ctcttggaccgcagcggacatggc

SEQ ID NO: 366975 - DNA, 24 bp, Artificial Sequence
  Description of Artificial Sequence: Synthetic oligonucleotide
tcttggaccgcagcggacatggcg

SEQ ID NO: 366976 - DNA, 23 bp, Artificial Sequence
  Description of Artificial Sequence: Synthetic oligonucleotide
cttggaccgcagcggacatggcg

SEQ ID NO: 366977 - DNA, 23 bp, Artificial Sequence
  Description of Artificial Sequence: Synthetic oligonucleotide
ttggaccgcagcggacatggcgg

SEQ ID NO: 366978 - DNA, 22 bp, Artificial Sequence
  Description of Artificial Sequence: Synthetic oligonucleotide
tggaccgcagcggacatggcgg

SEQ ID NO: 366979 - DNA, 21 bp, Artificial Sequence
  Description of Artificial Sequence: Synthetic oligonucleotide
ggaccgcagcggacatggcgg

SEQ ID NO: 366980 - DNA, 22 bp, Artificial Sequence
  Description of Artificial Sequence: Synthetic oligonucleotide
gaccgcagcggacatggcggct

SEQ ID NO: 366981 - DNA, 23 bp, Artificial Sequence
  Description of Artificial Sequence: Synthetic oligonucleotide
accgcagcggacatggcggctca

SEQ ID NO: 366982 - DNA, 22 bp, Artificial Sequence
  Description of Artificial Sequence: Synthetic oligonucleotide
ccgcagcggacatggcggctca

SEQ ID NO: 366983 - DNA, 24 bp, Artificial Sequence
  Description of Artificial Sequence: Synthetic oligonucleotide
cgcagcggacatggcggctcagat

SEQ ID NO: 366984 - DNA, 25 bp, Artificial Sequence
  Description of Artificial Sequence: Synthetic oligonucleotide
gcagcggacatggcggctcagatca

SEQ ID NO: 366985 - DNA, 25 bp, Artificial Sequence
  Description of Artificial Sequence: Synthetic oligonucleotide
cagcggacatggcggctcagatcac

SEQ ID NO: 366986 - DNA, 27 bp, Artificial Sequence
  Description of Artificial Sequence: Synthetic oligonucleotide
agcggacatggcggctcagatcaccaa

SEQ ID NO: 366987 - DNA, 23 bp, Artificial Sequence
  Description of Artificial Sequence: Synthetic oligonucleotide
cgcgggcgccgtggatagagcaa

SEQ ID NO: 366988 - DNA, 24 bp, Artificial Sequence
  Description of Artificial Sequence: Synthetic oligonucleotide
gcgggcgccgtggatagagcaaga

SEQ ID NO: 366989 - DNA, 24 bp, Artificial Sequence
  Description of Artificial Sequence: Synthetic oligonucleotide
cgggcgccgtggatagagcaagag

SEQ ID NO: 366990 - DNA, 24 bp, Artificial Sequence
  Description of Artificial Sequence: Synthetic oligonucleotide
gggcgccgtggatagagcaagagg

SEQ ID NO: 366991 - DNA, 24 bp, Artificial Sequence
  Description of Artificial Sequence: Synthetic oligonucleotide
ggcgccgtggatagagcaagaggg

SEQ ID NO: 366992 - DNA, 24 bp, Artificial Sequence
  Description of Artificial Sequence: Synthetic oligonucleotide
gcgccgtggatagagcaagagggg

SEQ ID NO: 366993 - DNA, 24 bp, Artificial Sequence
  Description of Artificial Sequence: Synthetic oligonucleotide
cgccgtggatagagcaagaggggc

SEQ ID NO: 366994 - DNA, 24 bp, Artificial Sequence
  Description of Artificial Sequence: Synthetic oligonucleotide
gccgtggatagagcaagaggggcc

SEQ ID NO: 366995 - DNA, 24 bp, Artificial Sequence
  Description of Artificial Sequence: Synthetic oligonucleotide
ccgtggatagagcaagaggggccg

SEQ ID NO: 366996 - DNA, 25 bp, Artificial Sequence
  Description of Artificial Sequence: Synthetic oligonucleotide
cgtggatagagcaagaggggccgga

SEQ ID NO: 366997 - DNA, 27 bp, Artificial Sequence
  Description of Artificial Sequence: Synthetic oligonucleotide
gtggatagagcaagaggggccggagta

SEQ ID NO: 366998 - DNA, 29 bp, Artificial Sequence
  Description of Artificial Sequence: Synthetic oligonucleotide
tggatagagcaagaggggccggagtattg

SEQ ID NO: 366999 - DNA, 28 bp, Artificial Sequence
  Description of Artificial Sequence: Synthetic oligonucleotide
ggatagagcaagaggggccggagtattg

SEQ ID NO: 367000 - DNA, 28 bp, Artificial Sequence
  Description of Artificial Sequence: Synthetic oligonucleotide
gatagagcaagaggggccggagtattgg

SEQ ID NO: 367001 - DNA, 28 bp, Artificial Sequence
  Description of Artificial Sequence: Synthetic oligonucleotide
atagagcaagaggggccggagtattggg

SEQ ID NO: 367002 - DNA, 27 bp, Artificial Sequence
  Description of Artificial Sequence: Synthetic oligonucleotide
tagagcaagaggggccggagtattggg

SEQ ID NO: 367003 - DNA, 27 bp, Artificial Sequence
  Description of Artificial Sequence: Synthetic oligonucleotide
agagcaagaggggccggagtattggga

SEQ ID NO: 367004 - DNA, 26 bp, Artificial Sequence
  Description of Artificial Sequence: Synthetic oligonucleotide
gagcaagaggggccggagtattggga

SEQ ID NO: 367005 - DNA, 26 bp, Artificial Sequence
  Description of Artificial Sequence: Synthetic oligonucleotide
agcaagaggggccggagtattgggac

SEQ ID NO: 367006 - DNA, 25 bp, Artificial Sequence
  Description of Artificial Sequence: Synthetic oligonucleotide
gcaagaggggccggagtattgggac

SEQ ID NO: 367007 - DNA, 26 bp, Artificial Sequence
  Description of Artificial Sequence: Synthetic oligonucleotide
caagaggggccggagtattgggacga

SEQ ID NO: 367008 - DNA, 26 bp, Artificial Sequence
  Description of Artificial Sequence: Synthetic oligonucleotide
aagaggggccggagtattgggacgag

SEQ ID NO: 367009 - DNA, 25 bp, Artificial Sequence
  Description of Artificial Sequence: Synthetic oligonucleotide
agaggggccggagtattgggacgag

SEQ ID NO: 367010 - DNA, 25 bp, Artificial Sequence
  Description of Artificial Sequence: Synthetic oligonucleotide
tgcgctcttggaccgcggcggatat

SEQ ID NO: 367011 - DNA, 24 bp, Artificial Sequence
  Description of Artificial Sequence: Synthetic oligonucleotide
gcgctcttggaccgcggcggatat

SEQ ID NO: 367012 - DNA, 24 bp, Artificial Sequence
  Description of Artificial Sequence: Synthetic oligonucleotide
cgctcttggaccgcggcggatatg

SEQ ID NO: 367013 - DNA, 24 bp, Artificial Sequence
  Description of Artificial Sequence: Synthetic oligonucleotide
gctcttggaccgcggcggatatgg

SEQ ID NO: 367014 - DNA, 24 bp, Artificial Sequence
  Description of Artificial Sequence: Synthetic oligonucleotide
ctcttggaccgcggcggatatggc

SEQ ID NO: 367015 - DNA, 24 bp, Artificial Sequence
  Description of Artificial Sequence: Synthetic oligonucleotide
tcttggaccgcggcggatatggcg

SEQ ID NO: 367016 - DNA, 23 bp, Artificial Sequence
  Description of Artificial Sequence: Synthetic oligonucleotide
cttggaccgcggcggatatggcg

SEQ ID NO: 367017 - DNA, 23 bp, Artificial Sequence
  Description of Artificial Sequence: Synthetic oligonucleotide
ttggaccgcggcggatatggcgg

SEQ ID NO: 367018 - DNA, 22 bp, Artificial Sequence
  Description of Artificial Sequence: Synthetic oligonucleotide
tggaccgcggcggatatggcgg

SEQ ID NO: 367019 - DNA, 21 bp, Artificial Sequence
  Description of Artificial Sequence: Synthetic oligonucleotide
ggaccgcggcggatatggcgg

SEQ ID NO: 367020 - DNA, 22 bp, Artificial Sequence
  Description of Artificial Sequence: Synthetic oligonucleotide
gaccgcggcggatatggcggct

SEQ ID NO: 367021 - DNA, 23 bp, Artificial Sequence
  Description of Artificial Sequence: Synthetic oligonucleotide
accgcggcggatatggcggctca

SEQ ID NO: 367022 - DNA, 22 bp, Artificial Sequence
  Description of Artificial Sequence: Synthetic oligonucleotide
ccgcggcggatatggcggctca

SEQ ID NO: 367023 - DNA, 24 bp, Artificial Sequence
  Description of Artificial Sequence: Synthetic oligonucleotide
cgcggcggatatggcggctcagat

SEQ ID NO: 367024 - DNA, 25 bp, Artificial Sequence
  Description of Artificial Sequence: Synthetic oligonucleotide
gcggcggatatggcggctcagatca

SEQ ID NO: 367025 - DNA, 25 bp, Artificial Sequence
  Description of Artificial Sequence: Synthetic oligonucleotide
cggcggatatggcggctcagatcac

SEQ ID NO: 367026 - DNA, 27 bp, Artificial Sequence
  Description of Artificial Sequence: Synthetic oligonucleotide
ggcggatatggcggctcagatcaccaa

SEQ ID NO: 367027 - DNA, 27 bp, Artificial Sequence
  Description of Artificial Sequence: Synthetic oligonucleotide
gcggatatggcggctcagatcaccaag

SEQ ID NO: 367028 - DNA, 27 bp, Artificial Sequence
  Description of Artificial Sequence: Synthetic oligonucleotide
cggatatggcggctcagatcaccaagc

SEQ ID NO: 367029 - DNA, 27 bp, Artificial Sequence
  Description of Artificial Sequence: Synthetic oligonucleotide
ggatatggcggctcagatcaccaagcg

SEQ ID NO: 367030 - DNA, 27 bp, Artificial Sequence
  Description of Artificial Sequence: Synthetic oligonucleotide
gatatggcggctcagatcaccaagcgc

SEQ ID NO: 367031 - DNA, 29 bp, Artificial Sequence
  Description of Artificial Sequence: Synthetic oligonucleotide
atatggcggctcagatcaccaagcgcaag

SEQ ID NO: 367032 - DNA, 28 bp, Artificial Sequence
  Description of Artificial Sequence: Synthetic oligonucleotide
tatggcggctcagatcaccaagcgcaag

SEQ ID NO: 367033 - DNA, 22 bp, Artificial Sequence
  Description of Artificial Sequence: Synthetic oligonucleotide
ggagccgtcttcccagcccacc

SEQ ID NO: 367034 - DNA, 23 bp, Artificial Sequence
  Description of Artificial Sequence: Synthetic oligonucleotide
gagccgtcttcccagcccaccgt

SEQ ID NO: 367035 - DNA, 23 bp, Artificial Sequence
  Description of Artificial Sequence: Synthetic oligonucleotide
agccgtcttcccagcccaccgtc

SEQ ID NO: 367036 - DNA, 22 bp, Artificial Sequence
  Description of Artificial Sequence: Synthetic oligonucleotide
gccgtcttcccagcccaccgtc

SEQ ID NO: 367037 - DNA, 22 bp, Artificial Sequence
  Description of Artificial Sequence: Synthetic oligonucleotide
ccgtcttcccagcccaccgtcc

SEQ ID NO: 367038 - DNA, 22 bp, Artificial Sequence
  Description of Artificial Sequence: Synthetic oligonucleotide
cgtcttcccagcccaccgtccc

SEQ ID NO: 367039 - DNA, 24 bp, Artificial Sequence
  Description of Artificial Sequence: Synthetic oligonucleotide
gtcttcccagcccaccgtccccat

SEQ ID NO: 367040 - DNA, 27 bp, Artificial Sequence
  Description of Artificial Sequence: Synthetic oligonucleotide
gacacgcagttcgtgcggttcgacagt

SEQ ID NO: 367041 - DNA, 27 bp, Artificial Sequence
  Description of Artificial Sequence: Synthetic oligonucleotide
acacgcagttcgtgcggttcgacagtg

SEQ ID NO: 367042 - DNA, 27 bp, Artificial Sequence
  Description of Artificial Sequence: Synthetic oligonucleotide
cacgcagttcgtgcggttcgacagtga

SEQ ID NO: 367043 - DNA, 27 bp, Artificial Sequence
  Description of Artificial Sequence: Synthetic oligonucleotide
acgcagttcgtgcggttcgacagtgac

SEQ ID NO: 367044 - DNA, 26 bp, Artificial Sequence
  Description of Artificial Sequence: Synthetic oligonucleotide
cgcagttcgtgcggttcgacagtgac

SEQ ID NO: 367045 - DNA, 26 bp, Artificial Sequence
  Description of Artificial Sequence: Synthetic oligonucleotide
gcagttcgtgcggttcgacagtgacg

SEQ ID NO: 367046 - DNA, 26 bp, Artificial Sequence
  Description of Artificial Sequence: Synthetic oligonucleotide
cagttcgtgcggttcgacagtgacgc

SEQ ID NO: 367047 - DNA, 26 bp, Artificial Sequence
  Description of Artificial Sequence: Synthetic oligonucleotide
agttcgtgcggttcgacagtgacgcc

SEQ ID NO: 367048 - DNA, 25 bp, Artificial Sequence
  Description of Artificial Sequence: Synthetic oligonucleotide
gttcgtgcggttcgacagtgacgcc

SEQ ID NO: 367049 - DNA, 25 bp, Artificial Sequence
  Description of Artificial Sequence: Synthetic oligonucleotide
ttcgtgcggttcgacagtgacgccg

SEQ ID NO: 367050 - DNA, 24 bp, Artificial Sequence
  Description of Artificial Sequence: Synthetic oligonucleotide
tcgtgcggttcgacagtgacgccg

SEQ ID NO: 367051 - DNA, 23 bp, Artificial Sequence
  Description of Artificial Sequence: Synthetic oligonucleotide
cgtgcggttcgacagtgacgccg

SEQ ID NO: 367052 - DNA, 23 bp, Artificial Sequence
  Description of Artificial Sequence: Synthetic oligonucleotide
gtgcggttcgacagtgacgccgc

SEQ ID NO: 367053 - DNA, 24 bp, Artificial Sequence
  Description of Artificial Sequence: Synthetic oligonucleotide
tgcggttcgacagtgacgccgcga

SEQ ID NO: 367054 - DNA, 23 bp, Artificial Sequence
  Description of Artificial Sequence: Synthetic oligonucleotide
gcggttcgacagtgacgccgcga

SEQ ID NO: 367055 - DNA, 23 bp, Artificial Sequence
  Description of Artificial Sequence: Synthetic oligonucleotide
cggttcgacagtgacgccgcgag

SEQ ID NO: 367056 - DNA, 23 bp, Artificial Sequence
  Description of Artificial Sequence: Synthetic oligonucleotide
ggttcgacagtgacgccgcgagc

SEQ ID NO: 367057 - DNA, 24 bp, Artificial Sequence
  Description of Artificial Sequence: Synthetic oligonucleotide
gttcgacagtgacgccgcgagcca

SEQ ID NO: 367058 - DNA, 25 bp, Artificial Sequence
  Description of Artificial Sequence: Synthetic oligonucleotide
ttcgacagtgacgccgcgagccaga

SEQ ID NO: 367059 - DNA, 24 bp, Artificial Sequence
  Description of Artificial Sequence: Synthetic oligonucleotide
tcgacagtgacgccgcgagccaga

SEQ ID NO: 367060 - DNA, 23 bp, Artificial Sequence
  Description of Artificial Sequence: Synthetic oligonucleotide
cgacagtgacgccgcgagccaga

SEQ ID NO: 367061 - DNA, 23 bp, Artificial Sequence
  Description of Artificial Sequence: Synthetic oligonucleotide
gacagtgacgccgcgagccagag

SEQ ID NO: 367062 - DNA, 25 bp, Artificial Sequence
  Description of Artificial Sequence: Synthetic oligonucleotide
acagtgacgccgcgagccagaggat

SEQ ID NO: 367063 - DNA, 24 bp, Artificial Sequence
  Description of Artificial Sequence: Synthetic oligonucleotide
cagtgacgccgcgagccagaggat

SEQ ID NO: 367064 - DNA, 24 bp, Artificial Sequence
  Description of Artificial Sequence: Synthetic oligonucleotide
agtgacgccgcgagccagaggatg

SEQ ID NO: 367065 - DNA, 23 bp, Artificial Sequence
  Description of Artificial Sequence: Synthetic oligonucleotide
gtgacgccgcgagccagaggatg

SEQ ID NO: 367066 - DNA, 24 bp, Artificial Sequence
  Description of Artificial Sequence: Synthetic oligonucleotide
tgacgccgcgagccagaggatgga

SEQ ID NO: 367067 - DNA, 26 bp, Artificial Sequence
  Description of Artificial Sequence: Synthetic oligonucleotide
gccctgggcttctaccctgcggaaat

SEQ ID NO: 367068 - DNA, 27 bp, Artificial Sequence
  Description of Artificial Sequence: Synthetic oligonucleotide
ccctgggcttctaccctgcggaaatca

SEQ ID NO: 367069 - DNA, 27 bp, Artificial Sequence
  Description of Artificial Sequence: Synthetic oligonucleotide
cctgggcttctaccctgcggaaatcac

SEQ ID NO: 367070 - DNA, 28 bp, Artificial Sequence
  Description of Artificial Sequence: Synthetic oligonucleotide
ctgggcttctaccctgcggaaatcacac

SEQ ID NO: 367071 - DNA, 29 bp, Artificial Sequence
  Description of Artificial Sequence: Synthetic oligonucleotide
tgggcttctaccctgcggaaatcacactg

SEQ ID NO: 367072 - DNA, 28 bp, Artificial Sequence
  Description of Artificial Sequence: Synthetic oligonucleotide
gggcttctaccctgcggaaatcacactg

SEQ ID NO: 367073 - DNA, 29 bp, Artificial Sequence
  Description of Artificial Sequence: Synthetic oligonucleotide
ggcttctaccctgcggaaatcacactgac

SEQ ID NO: 367074 - DNA, 29 bp, Artificial Sequence
  Description of Artificial Sequence: Synthetic oligonucleotide
gcttctaccctgcggaaatcacactgacc

SEQ ID NO: 367075 - DNA, 30 bp, Artificial Sequence; identical to SEQ ID NO: 20606
  Description of Artificial Sequence: Synthetic oligonucleotide

SEQ ID NO: 367076 - DNA, 30 bp, Artificial Sequence; identical to SEQ ID NO: 20607
  Description of Artificial Sequence: Synthetic oligonucleotide

SEQ ID NO: 367077 - DNA, 29 bp, Artificial Sequence
  Description of Artificial Sequence: Synthetic oligonucleotide
tctaccctgcggaaatcacactgacctgg

SEQ ID NO: 367078 - DNA, 28 bp, Artificial Sequence
  Description of Artificial Sequence: Synthetic oligonucleotide
ctaccctgcggaaatcacactgacctgg

SEQ ID NO: 367079 - DNA, 28 bp, Artificial Sequence
  Description of Artificial Sequence: Synthetic oligonucleotide
taccctgcggaaatcacactgacctggc

SEQ ID NO: 367080 - DNA, 27 bp, Artificial Sequence
  Description of Artificial Sequence: Synthetic oligonucleotide
accctgcggaaatcacactgacctggc

SEQ ID NO: 367081 - DNA, 27 bp, Artificial Sequence
  Description of Artificial Sequence: Synthetic oligonucleotide
ccctgcggaaatcacactgacctggca

SEQ ID NO: 367082 - DNA, 27 bp, Artificial Sequence
  Description of Artificial Sequence: Synthetic oligonucleotide
cctgcggaaatcacactgacctggcag

SEQ ID NO: 367083 - DNA, 27 bp, Artificial Sequence
  Description of Artificial Sequence: Synthetic oligonucleotide
ctgcggaaatcacactgacctggcagc

SEQ ID NO: 367084 - DNA, 27 bp, Artificial Sequence
  Description of Artificial Sequence: Synthetic oligonucleotide
tgcggaaatcacactgacctggcagcg

SEQ ID NO: 367085 - DNA, 26 bp, Artificial Sequence
  Description of Artificial Sequence: Synthetic oligonucleotide
gcggaaatcacactgacctggcagcg

SEQ ID NO: 367086 - DNA, 26 bp, Artificial Sequence
  Description of Artificial Sequence: Synthetic oligonucleotide
cggaaatcacactgacctggcagcgg

SEQ ID NO: 367087 - DNA, 27 bp, Artificial Sequence
  Description of Artificial Sequence: Synthetic oligonucleotide
ggaaatcacactgacctggcagcggga

SEQ ID NO: 367088 - DNA, 28 bp, Artificial Sequence
  Description of Artificial Sequence: Synthetic oligonucleotide
gaaatcacactgacctggcagcgggatg

SEQ ID NO: 367089 - DNA, 28 bp, Artificial Sequence
  Description of Artificial Sequence: Synthetic oligonucleotide
aaatcacactgacctggcagcgggatgg

SEQ ID NO: 367090 - DNA, 27 bp, Artificial Sequence
  Description of Artificial Sequence: Synthetic oligonucleotide
aatcacactgacctggcagcgggatgg

SEQ ID NO: 367091 - DNA, 24 bp, Artificial Sequence
  Description of Artificial Sequence: Synthetic oligonucleotide
ggagcttgtggagaccaggcctgc

SEQ ID NO: 367092 - DNA, 24 bp, Artificial Sequence
  Description of Artificial Sequence: Synthetic oligonucleotide
gagcttgtggagaccaggcctgcc

SEQ ID NO: 367093 - DNA, 24 bp, Artificial Sequence
  Description of Artificial Sequence: Synthetic oligonucleotide
agcttgtggagaccaggcctgccg

SEQ ID NO: 367094 - DNA, 23 bp, Artificial Sequence
  Description of Artificial Sequence: Synthetic oligonucleotide
gcttgtggagaccaggcctgccg

SEQ ID NO: 367095 - DNA, 23 bp, Artificial Sequence
  Description of Artificial Sequence: Synthetic oligonucleotide
cttgtggagaccaggcctgccgg

SEQ ID NO: 367096 - DNA, 23 bp, Artificial Sequence
  Description of Artificial Sequence: Synthetic oligonucleotide
ttgtggagaccaggcctgccggg

SEQ ID NO: 367097 - DNA, 22 bp, Artificial Sequence
  Description of Artificial Sequence: Synthetic oligonucleotide
tgtggagaccaggcctgccggg

SEQ ID NO: 367098 - DNA, 21 bp, Artificial Sequence
  Description of Artificial Sequence: Synthetic oligonucleotide
gtggagaccaggcctgccggg

SEQ ID NO: 367099 - DNA, 23 bp, Artificial Sequence
  Description of Artificial Sequence: Synthetic oligonucleotide
tggagaccaggcctgccggggat

SEQ ID NO: 367100 - DNA, 22 bp, Artificial Sequence
  Description of Artificial Sequence: Synthetic oligonucleotide
ggagaccaggcctgccggggat

SEQ ID NO: 367101 - DNA, 22 bp, Artificial Sequence
  Description of Artificial Sequence: Synthetic oligonucleotide
gagaccaggcctgccggggatg

SEQ ID NO: 367102 - DNA, 24 bp, Artificial Sequence
  Description of Artificial Sequence: Synthetic oligonucleotide
agaccaggcctgccggggatggaa

SEQ ID NO: 367103 - DNA, 23 bp, Artificial Sequence
  Description of Artificial Sequence: Synthetic oligonucleotide
gaccaggcctgccggggatggaa

SEQ ID NO: 367104 - DNA, 23 bp, Artificial Sequence
  Description of Artificial Sequence: Synthetic oligonucleotide
accaggcctgccggggatggaac

SEQ ID NO: 367105 - DNA, 22 bp, Artificial Sequence
  Description of Artificial Sequence: Synthetic oligonucleotide
ccaggcctgccggggatggaac

SEQ ID NO: 367106 - DNA, 24 bp, Artificial Sequence
  Description of Artificial Sequence: Synthetic oligonucleotide
caggcctgccggggatggaacctt

SEQ ID NO: 367107 - DNA, 24 bp, Artificial Sequence
  Description of Artificial Sequence: Synthetic oligonucleotide
aggcctgccggggatggaaccttc

SEQ ID NO: 367108 - DNA, 23 bp, Artificial Sequence
  Description of Artificial Sequence: Synthetic oligonucleotide
ggcctgccggggatggaaccttc

SEQ ID NO: 367109 - DNA, 24 bp, Artificial Sequence
  Description of Artificial Sequence: Synthetic oligonucleotide
gcctgccggggatggaaccttcca

SEQ ID NO: 367110 - DNA, 26 bp, Artificial Sequence
  Description of Artificial Sequence: Synthetic oligonucleotide
cctgccggggatggaaccttccagaa

SEQ ID NO: 367111 - DNA, 27 bp, Artificial Sequence
  Description of Artificial Sequence: Synthetic oligonucleotide
ctgccggggatggaaccttccagaagt

SEQ ID NO: 367112 - DNA, 27 bp, Artificial Sequence
  Description of Artificial Sequence: Synthetic oligonucleotide
tgccggggatggaaccttccagaagtg

SEQ ID NO: 367113 - DNA, 26 bp, Artificial Sequence
  Description of Artificial Sequence: Synthetic oligonucleotide
gccggggatggaaccttccagaagtg

SEQ ID NO: 367114 - DNA, 26 bp, Artificial Sequence
  Description of Artificial Sequence: Synthetic oligonucleotide
ccggggatggaaccttccagaagtgg

SEQ ID NO: 367115 - DNA, 26 bp, Artificial Sequence
  Description of Artificial Sequence: Synthetic oligonucleotide
cggggatggaaccttccagaagtggg

SEQ ID NO: 367116 - DNA, 21 bp, Artificial Sequence
  Description of Artificial Sequence: Synthetic oligonucleotide
tgggaggcggcccatgtggcc

SEQ ID NO: 367117 - DNA, 20 bp, Artificial Sequence
  Description of Artificial Sequence: Synthetic oligonucleotide
gggaggcggcccatgtggcc

SEQ ID NO: 367118 - DNA, 21 bp, Artificial Sequence
  Description of Artificial Sequence: Synthetic oligonucleotide
ggaggcggcccatgtggccga

SEQ ID NO: 367119 - DNA, 21 bp, Artificial Sequence
  Description of Artificial Sequence: Synthetic oligonucleotide
gaggcggcccatgtggccgag

SEQ ID NO: 367120 - DNA, 22 bp, Artificial Sequence
  Description of Artificial Sequence: Synthetic oligonucleotide
aggcggcccatgtggccgagca

SEQ ID NO: 367121 - DNA, 21 bp, Artificial Sequence
  Description of Artificial Sequence: Synthetic oligonucleotide
ggcggcccatgtggccgagca

SEQ ID NO: 367122 - DNA, 21 bp, Artificial Sequence
  Description of Artificial Sequence: Synthetic oligonucleotide
gcggcccatgtggccgagcag

SEQ ID NO: 367123 - DNA, 22 bp, Artificial Sequence
  Description of Artificial Sequence: Synthetic oligonucleotide
cggcccatgtggccgagcagca

SEQ ID NO: 367124 - DNA, 23 bp, Artificial Sequence
  Description of Artificial Sequence: Synthetic oligonucleotide
ggcccatgtggccgagcagcaga

SEQ ID NO: 367125 - DNA, 24 bp, Artificial Sequence
  Description of Artificial Sequence: Synthetic oligonucleotide
gcccatgtggccgagcagcagaga

SEQ ID NO: 367126 - DNA, 24 bp, Artificial Sequence
  Description of Artificial Sequence: Synthetic oligonucleotide
cccatgtggccgagcagcagagag

SEQ ID NO: 367127 - DNA, 24 bp, Artificial Sequence
  Description of Artificial Sequence: Synthetic oligonucleotide
ccatgtggccgagcagcagagagc

SEQ ID NO: 367128 - DNA, 26 bp, Artificial Sequence
  Description of Artificial Sequence: Synthetic oligonucleotide
catgtggccgagcagcagagagccta

SEQ ID NO: 367129 - DNA, 26 bp, Artificial Sequence
  Description of Artificial Sequence: Synthetic oligonucleotide
atgtggccgagcagcagagagcctac

SEQ ID NO: 367130 - DNA, 25 bp, Artificial Sequence
  Description of Artificial Sequence: Synthetic oligonucleotide
tgtggccgagcagcagagagcctac

SEQ ID NO: 367131 - DNA, 24 bp, Artificial Sequence
  Description of Artificial Sequence: Synthetic oligonucleotide
gtggccgagcagcagagagcctac

SEQ ID NO: 367132 - DNA, 25 bp, Artificial Sequence
  Description of Artificial Sequence: Synthetic oligonucleotide
tggccgagcagcagagagcctacct

SEQ ID NO: 367133 - DNA, 24 bp, Artificial Sequence
  Description of Artificial Sequence: Synthetic oligonucleotide
ggccgagcagcagagagcctacct

SEQ ID NO: 367134 - DNA, 24 bp, Artificial Sequence
  Description of Artificial Sequence: Synthetic oligonucleotide
gccgagcagcagagagcctacctg

SEQ ID NO: 367135 - DNA, 25 bp, Artificial Sequence
  Description of Artificial Sequence: Synthetic oligonucleotide
ccgagcagcagagagcctacctgga

SEQ ID NO: 367136 - DNA, 25 bp, Artificial Sequence
  Description of Artificial Sequence: Synthetic oligonucleotide
cgagcagcagagagcctacctggag

SEQ ID NO: 367137 - DNA, 23 bp, Artificial Sequence
  Description of Artificial Sequence: Synthetic oligonucleotide
gaggggccggagtactgggacga

SEQ ID NO: 367138 - DNA, 23 bp, Artificial Sequence
  Description of Artificial Sequence: Synthetic oligonucleotide
aggggccggagtactgggacgag

SEQ ID NO: 367139 - DNA, 22 bp, Artificial Sequence
  Description of Artificial Sequence: Synthetic oligonucleotide
ggggccggagtactgggacgag

SEQ ID NO: 367140 - DNA, 23 bp, Artificial Sequence
  Description of Artificial Sequence: Synthetic oligonucleotide
gggccggagtactgggacgagga

SEQ ID NO: 367141 - DNA, 24 bp, Artificial Sequence
  Description of Artificial Sequence: Synthetic oligonucleotide
ggccggagtactgggacgaggaga

SEQ ID NO: 367142 - DNA, 25 bp, Artificial Sequence
  Description of Artificial Sequence: Synthetic oligonucleotide
gccggagtactgggacgaggagaca

SEQ ID NO: 367143 - DNA, 25 bp, Artificial Sequence
  Description of Artificial Sequence: Synthetic oligonucleotide
ccggagtactgggacgaggagacag

SEQ ID NO: 367144 - DNA, 25 bp, Artificial Sequence
  Description of Artificial Sequence: Synthetic oligonucleotide
cggagtactgggacgaggagacagg

SEQ ID NO: 367145 - DNA, 27 bp, Artificial Sequence
  Description of Artificial Sequence: Synthetic oligonucleotide
ggagtactgggacgaggagacagggaa

SEQ ID NO: 367146 - DNA, 28 bp, Artificial Sequence
  Description of Artificial Sequence: Synthetic oligonucleotide
gagtactgggacgaggagacagggaaag

SEQ ID NO: 367147 - DNA, 29 bp, Artificial Sequence
  Description of Artificial Sequence: Synthetic oligonucleotide
agtactgggacgaggagacagggaaagtg

SEQ ID NO: 367148 - DNA, 28 bp, Artificial Sequence
  Description of Artificial Sequence: Synthetic oligonucleotide
gtactgggacgaggagacagggaaagtg

SEQ ID NO: 367149 - DNA, 30 bp, Artificial Sequence
  Description of Artificial Sequence: Synthetic oligonucleotide
tactgggacgaggagacagggaaagtgaag

SEQ ID NO: 367150 - DNA, 29 bp, Artificial Sequence
  Description of Artificial Sequence: Synthetic oligonucleotide
actgggacgaggagacagggaaagtgaag

SEQ ID NO: 367151 - DNA, 28 bp, Artificial Sequence
  Description of Artificial Sequence: Synthetic oligonucleotide
ctgggacgaggagacagggaaagtgaag

SEQ ID NO: 367152 - DNA, 26 bp, Artificial Sequence
  Description of Artificial Sequence: Synthetic oligonucleotide
aggaggggccggagtattgggacgaa

SEQ ID NO: 367153 - DNA, 25 bp, Artificial Sequence
  Description of Artificial Sequence: Synthetic oligonucleotide
ggaggggccggagtattgggacgaa

SEQ ID NO: 367154 - DNA, 26 bp, Artificial Sequence
  Description of Artificial Sequence: Synthetic oligonucleotide
gaggggccggagtattgggacgaaga

SEQ ID NO: 367155 - DNA, 27 bp, Artificial Sequence
  Description of Artificial Sequence: Synthetic oligonucleotide
aggggccggagtattgggacgaagaga

SEQ ID NO: 367156 - DNA, 26 bp, Artificial Sequence
  Description of Artificial Sequence: Synthetic oligonucleotide
ggggccggagtattgggacgaagaga

SEQ ID NO: 367157 - DNA, 27 bp, Artificial Sequence
  Description of Artificial Sequence: Synthetic oligonucleotide
gggccggagtattgggacgaagagaca

SEQ ID NO: 367158 - DNA, 27 bp, Artificial Sequence
  Description of Artificial Sequence: Synthetic oligonucleotide
ggccggagtattgggacgaagagacag

SEQ ID NO: 367159 - DNA, 27 bp, Artificial Sequence
  Description of Artificial Sequence: Synthetic oligonucleotide
gccggagtattgggacgaagagacagg

SEQ ID NO: 367160 - DNA, 27 bp, Artificial Sequence
  Description of Artificial Sequence: Synthetic oligonucleotide
ccggagtattgggacgaagagacaggg

SEQ ID NO: 367161 - DNA, 30 bp, Artificial Sequence
  Description of Artificial Sequence: Synthetic oligonucleotide
cggagtattgggacgaagagacagggaaag

SEQ ID NO: 367162 - DNA, 31 bp, Artificial Sequence
  Description of Artificial Sequence: Synthetic oligonucleotide
ggagtattgggacgaagagacagggaaagtg

SEQ ID NO: 367163 - DNA, 33 bp, Artificial Sequence
  Description of Artificial Sequence: Synthetic oligonucleotide
gagtattgggacgaagagacagggaaagtgaag

SEQ ID NO: 367164 - DNA, 33 bp, Artificial Sequence
  Description of Artificial Sequence: Synthetic oligonucleotide
agtattgggacgaagagacagggaaagtgaagg

SEQ ID NO: 367165 - DNA, 32 bp, Artificial Sequence
  Description of Artificial Sequence: Synthetic oligonucleotide
gtattgggacgaagagacagggaaagtgaagg

SEQ ID NO: 367166 - DNA, 32 bp, Artificial Sequence
  Description of Artificial Sequence: Synthetic oligonucleotide
tattgggacgaagagacagggaaagtgaaggc

SEQ ID NO: 367167 - DNA, 31 bp, Artificial Sequence
  Description of Artificial Sequence: Synthetic oligonucleotide
attgggacgaagagacagggaaagtgaaggc

SEQ ID NO: 367168 - DNA, 30 bp, Artificial Sequence
  Description of Artificial Sequence: Synthetic oligonucleotide
ttgggacgaagagacagggaaagtgaaggc

SEQ ID NO: 367169 - DNA, 29 bp, Artificial Sequence
  Description of Artificial Sequence: Synthetic oligonucleotide
tgggacgaagagacagggaaagtgaaggc

SEQ ID NO: 367170 - DNA, 28 bp, Artificial Sequence
  Description of Artificial Sequence: Synthetic oligonucleotide
gggacgaagagacagggaaagtgaaggc

SEQ ID NO: 367171 - DNA, 28 bp, Artificial Sequence
  Description of Artificial Sequence: Synthetic oligonucleotide
ggacgaagagacagggaaagtgaaggcc

SEQ ID NO: 367172 - DNA, 28 bp, Artificial Sequence
  Description of Artificial Sequence: Synthetic oligonucleotide
gacgaagagacagggaaagtgaaggccc

SEQ ID NO: 367173 - DNA, 29 bp, Artificial Sequence
  Description of Artificial Sequence: Synthetic oligonucleotide
acgaagagacagggaaagtgaaggcccac

SEQ ID NO: 367174 - DNA, 28 bp, Artificial Sequence
  Description of Artificial Sequence: Synthetic oligonucleotide
cgaagagacagggaaagtgaaggcccac

SEQ ID NO: 367175 - DNA, 29 bp, Artificial Sequence
  Description of Artificial Sequence: Synthetic oligonucleotide
gaagagacagggaaagtgaaggcccactc

SEQ ID NO: 367176 - DNA, 30 bp, Artificial Sequence
  Description of Artificial Sequence: Synthetic oligonucleotide
aagagacagggaaagtgaaggcccactcac

SEQ ID NO: 367177 - DNA, 29 bp, Artificial Sequence
  Description of Artificial Sequence: Synthetic oligonucleotide
agagacagggaaagtgaaggcccactcac

SEQ ID NO: 367178 - DNA, 26 bp, Artificial Sequence
  Description of Artificial Sequence: Synthetic oligonucleotide
gcgggtaccaccagtacgcctacgat

SEQ ID NO: 367179 - DNA, 26 bp, Artificial Sequence
  Description of Artificial Sequence: Synthetic oligonucleotide
cgggtaccaccagtacgcctacgatg

SEQ ID NO: 367180 - DNA, 26 bp, Artificial Sequence
  Description of Artificial Sequence: Synthetic oligonucleotide
gggtaccaccagtacgcctacgatgg

SEQ ID NO: 367181 - DNA, 27 bp, Artificial Sequence
  Description of Artificial Sequence: Synthetic oligonucleotide
ggtaccaccagtacgcctacgatggca

SEQ ID NO: 367182 - DNA, 28 bp, Artificial Sequence
  Description of Artificial Sequence: Synthetic oligonucleotide
gtaccaccagtacgcctacgatggcaag

SEQ ID NO: 367183 - DNA, 28 bp, Artificial Sequence
  Description of Artificial Sequence: Synthetic oligonucleotide
taccaccagtacgcctacgatggcaagg

SEQ ID NO: 367184 - DNA, 27 bp, Artificial Sequence
  Description of Artificial Sequence: Synthetic oligonucleotide
accaccagtacgcctacgatggcaagg

SEQ ID NO: 367185 - DNA, 27 bp, Artificial Sequence
  Description of Artificial Sequence: Synthetic oligonucleotide
ccaccagtacgcctacgatggcaagga

SEQ ID NO: 367186 - DNA, 30 bp, Artificial Sequence
  Description of Artificial Sequence: Synthetic oligonucleotide
caccagtacgcctacgatggcaaggattac

SEQ ID NO: 367187 - DNA, 32 bp, Artificial Sequence
  Description of Artificial Sequence: Synthetic oligonucleotide
accagtacgcctacgatggcaaggattacatc

SEQ ID NO: 367188 - DNA, 31 bp, Artificial Sequence
  Description of Artificial Sequence: Synthetic oligonucleotide
ccagtacgcctacgatggcaaggattacatc

SEQ ID NO: 367189 - DNA, 31 bp, Artificial Sequence
  Description of Artificial Sequence: Synthetic oligonucleotide
cagtacgcctacgatggcaaggattacatcg

SEQ ID NO: 367190 - DNA, 31 bp, Artificial Sequence
  Description of Artificial Sequence: Synthetic oligonucleotide
agtacgcctacgatggcaaggattacatcgc

SEQ ID NO: 367191 - DNA, 30 bp, Artificial Sequence
  Description of Artificial Sequence: Synthetic oligonucleotide
gtacgcctacgatggcaaggattacatcgc

SEQ ID NO: 367192 - DNA, 30 bp, Artificial Sequence
  Description of Artificial Sequence: Synthetic oligonucleotide
tacgcctacgatggcaaggattacatcgcc

SEQ ID NO: 367193 - DNA, 29 bp, Artificial Sequence
  Description of Artificial Sequence: Synthetic oligonucleotide
acgcctacgatggcaaggattacatcgcc

SEQ ID NO: 367194 - DNA, 28 bp, Artificial Sequence
  Description of Artificial Sequence: Synthetic oligonucleotide
cgcctacgatggcaaggattacatcgcc

SEQ ID NO: 367195 - DNA, 28 bp, Artificial Sequence
  Description of Artificial Sequence: Synthetic oligonucleotide
gcctacgatggcaaggattacatcgccc

SEQ ID NO: 367196 - DNA, 29 bp, Artificial Sequence
  Description of Artificial Sequence: Synthetic oligonucleotide
cctacgatggcaaggattacatcgccctg

SEQ ID NO: 367197 - DNA, 32 bp, Artificial Sequence
  Description of Artificial Sequence: Synthetic oligonucleotide
ctacgatggcaaggattacatcgccctgaaag

SEQ ID NO: 367198 - DNA, 33 bp, Artificial Sequence
  Description of Artificial Sequence: Synthetic oligonucleotide
tacgatggcaaggattacatcgccctgaaagag

SEQ ID NO: 367199 - DNA, 32 bp, Artificial Sequence
  Description of Artificial Sequence: Synthetic oligonucleotide
acgatggcaaggattacatcgccctgaaagag

SEQ ID NO: 367200 - DNA, 31 bp, Artificial Sequence
  Description of Artificial Sequence: Synthetic oligonucleotide
cgatggcaaggattacatcgccctgaaagag

SEQ ID NO: 367201 - DNA, 31 bp, Artificial Sequence
  Description of Artificial Sequence: Synthetic oligonucleotide
gatggcaaggattacatcgccctgaaagagg

SEQ ID NO: 367202 - DNA, 32 bp, Artificial Sequence
  Description of Artificial Sequence: Synthetic oligonucleotide
atggcaaggattacatcgccctgaaagaggac

SEQ ID NO: 367203 - DNA, 31 bp, Artificial Sequence
  Description of Artificial Sequence: Synthetic oligonucleotide
tggcaaggattacatcgccctgaaagaggac

SEQ ID NO: 367204 - DNA, 21 bp, Artificial Sequence
  Description of Artificial Sequence: Synthetic oligonucleotide
gggtcggacgggcgcttcctg

SEQ ID NO: 367205 - DNA, 21 bp, Artificial Sequence
  Description of Artificial Sequence: Synthetic oligonucleotide
ggtcggacgggcgcttcctgc

SEQ ID NO: 367206 - DNA, 21 bp, Artificial Sequence
  Description of Artificial Sequence: Synthetic oligonucleotide
gtcggacgggcgcttcctgcg

SEQ ID NO: 367207 - DNA, 21 bp, Artificial Sequence
  Description of Artificial Sequence: Synthetic oligonucleotide
tcggacgggcgcttcctgcgc

SEQ ID NO: 367208 - DNA, 20 bp, Artificial Sequence
  Description of Artificial Sequence: Synthetic oligonucleotide
cggacgggcgcttcctgcgc

SEQ ID NO: 367209 - DNA, 20 bp, Artificial Sequence
  Description of Artificial Sequence: Synthetic oligonucleotide
ggacgggcgcttcctgcgcg

SEQ ID NO: 367210 - DNA, 20 bp, Artificial Sequence
  Description of Artificial Sequence: Synthetic oligonucleotide
gacgggcgcttcctgcgcgg

SEQ ID NO: 367211 - DNA, 22 bp, Artificial Sequence
  Description of Artificial Sequence: Synthetic oligonucleotide
acgggcgcttcctgcgcgggta

SEQ ID NO: 367212 - DNA, 21 bp, Artificial Sequence
  Description of Artificial Sequence: Synthetic oligonucleotide
cgggcgcttcctgcgcgggta

SEQ ID NO: 367213 - DNA, 21 bp, Artificial Sequence
  Description of Artificial Sequence: Synthetic oligonucleotide
gggcgcttcctgcgcgggtac

SEQ ID NO: 367214 - DNA, 27 bp, Artificial Sequence
  Description of Artificial Sequence: Synthetic oligonucleotide
gaggagacagggaaagtgaaggcccag

SEQ ID NO: 367215 - DNA, 28 bp, Artificial Sequence
  Description of Artificial Sequence: Synthetic oligonucleotide
aggagacagggaaagtgaaggcccagtc

SEQ ID NO: 367216 - DNA, 27 bp, Artificial Sequence
  Description of Artificial Sequence: Synthetic oligonucleotide
ggagacagggaaagtgaaggcccagtc

SEQ ID NO: 367217 - DNA, 28 bp, Artificial Sequence
  Description of Artificial Sequence: Synthetic oligonucleotide
gagacagggaaagtgaaggcccagtcac

SEQ ID NO: 367218 - DNA, 29 bp, Artificial Sequence
  Description of Artificial Sequence: Synthetic oligonucleotide
agacagggaaagtgaaggcccagtcacag

SEQ ID NO: 367219 - DNA, 28 bp, Artificial Sequence
  Description of Artificial Sequence: Synthetic oligonucleotide
gacagggaaagtgaaggcccagtcacag

SEQ ID NO: 367220 - DNA, 29 bp, Artificial Sequence
  Description of Artificial Sequence: Synthetic oligonucleotide
acagggaaagtgaaggcccagtcacagac

SEQ ID NO: 367221 - DNA, 28 bp, Artificial Sequence
  Description of Artificial Sequence: Synthetic oligonucleotide
cagggaaagtgaaggcccagtcacagac

SEQ ID NO: 367222 - DNA, 29 bp, Artificial Sequence
  Description of Artificial Sequence: Synthetic oligonucleotide
agggaaagtgaaggcccagtcacagactg

SEQ ID NO: 367223 - DNA, 28 bp, Artificial Sequence
  Description of Artificial Sequence: Synthetic oligonucleotide
gggaaagtgaaggcccagtcacagactg

SEQ ID NO: 367224 - DNA, 29 bp, Artificial Sequence
  Description of Artificial Sequence: Synthetic oligonucleotide
ggaaagtgaaggcccagtcacagactgac

SEQ ID NO: 367225 - DNA, 29 bp, Artificial Sequence
  Description of Artificial Sequence: Synthetic oligonucleotide
gaaagtgaaggcccagtcacagactgacc

SEQ ID NO: 367226 - DNA, 29 bp, Artificial Sequence
  Description of Artificial Sequence: Synthetic oligonucleotide
aaagtgaaggcccagtcacagactgaccg

SEQ ID NO: 367227 - DNA, 28 bp, Artificial Sequence
  Description of Artificial Sequence: Synthetic oligonucleotide
aagtgaaggcccagtcacagactgaccg

SEQ ID NO: 367228 - DNA, 27 bp, Artificial Sequence
  Description of Artificial Sequence: Synthetic oligonucleotide
agtgaaggcccagtcacagactgaccg

SEQ ID NO: 367229 - DNA, 27 bp, Artificial Sequence
  Description of Artificial Sequence: Synthetic oligonucleotide
gaaggcccagtcacagactgaccgaga

SEQ ID NO: 367230 - DNA, 27 bp, Artificial Sequence
  Description of Artificial Sequence: Synthetic oligonucleotide
aaggcccagtcacagactgaccgagag

SEQ ID NO: 367231 - DNA, 27 bp, Artificial Sequence
  Description of Artificial Sequence: Synthetic oligonucleotide
aggcccagtcacagactgaccgagaga

SEQ ID NO: 367232 - DNA, 27 bp, Artificial Sequence
  Description of Artificial Sequence: Synthetic oligonucleotide
ggcccagtcacagactgaccgagagaa

SEQ ID NO: 367233 - DNA, 27 bp, Artificial Sequence
  Description of Artificial Sequence: Synthetic oligonucleotide
gcccagtcacagactgaccgagagaac

SEQ ID NO: 367234 - DNA, 27 bp, Artificial Sequence
  Description of Artificial Sequence: Synthetic oligonucleotide
cccagtcacagactgaccgagagaacc

SEQ ID NO: 367235 - DNA, 28 bp, Artificial Sequence
  Description of Artificial Sequence: Synthetic oligonucleotide
ccagtcacagactgaccgagagaacctg

SEQ ID NO: 367236 - DNA, 28 bp, Artificial Sequence
  Description of Artificial Sequence: Synthetic oligonucleotide
cagtcacagactgaccgagagaacctgc

SEQ ID NO: 367237 - DNA, 28 bp, Artificial Sequence
  Description of Artificial Sequence: Synthetic oligonucleotide
agtcacagactgaccgagagaacctgcg

SEQ ID NO: 367238 - DNA, 27 bp, Artificial Sequence
  Description of Artificial Sequence: Synthetic oligonucleotide
gtcacagactgaccgagagaacctgcg

SEQ ID NO: 367239 - DNA, 25 bp, Artificial Sequence
  Description of Artificial Sequence: Synthetic oligonucleotide
acccagacctgggcaggctcccaat

SEQ ID NO: 367240 - DNA, 24 bp, Artificial Sequence
  Description of Artificial Sequence: Synthetic oligonucleotide
cccagacctgggcaggctcccaat

SEQ ID NO: 367241 - DNA, 24 bp, Artificial Sequence
  Description of Artificial Sequence: Synthetic oligonucleotide
ccagacctgggcaggctcccaatc

SEQ ID NO: 367242 - DNA, 26 bp, Artificial Sequence
  Description of Artificial Sequence: Synthetic oligonucleotide
cagacctgggcaggctcccaatccat

SEQ ID NO: 367243 - DNA, 27 bp, Artificial Sequence
  Description of Artificial Sequence: Synthetic oligonucleotide
agacctgggcaggctcccaatccatga

SEQ ID NO: 367244 - DNA, 26 bp, Artificial Sequence
  Description of Artificial Sequence: Synthetic oligonucleotide
gacctgggcaggctcccaatccatga

SEQ ID NO: 367245 - DNA, 26 bp, Artificial Sequence
  Description of Artificial Sequence: Synthetic oligonucleotide
acctgggcaggctcccaatccatgag

SEQ ID NO: 367246 - DNA, 25 bp, Artificial Sequence
  Description of Artificial Sequence: Synthetic oligonucleotide
cctgggcaggctcccaatccatgag

SEQ ID NO: 367247 - DNA, 27 bp, Artificial Sequence
  Description of Artificial Sequence: Synthetic oligonucleotide
ctgggcaggctcccaatccatgaggta

SEQ ID NO: 367248 - DNA, 30 bp, Artificial Sequence; identical to SEQ ID NO: 14766
  Description of Artificial Sequence: Synthetic oligonucleotide

SEQ ID NO: 367249 - DNA, 29 bp, Artificial Sequence
  Description of Artificial Sequence: Synthetic oligonucleotide
gggcaggctcccaatccatgaggtatttc

SEQ ID NO: 367250 - DNA, 30 bp, Artificial Sequence; identical to SEQ ID NO: 14768
  Description of Artificial Sequence: Synthetic oligonucleotide

SEQ ID NO: 367251 - DNA, 30 bp, Artificial Sequence; identical to SEQ ID NO: 14769
  Description of Artificial Sequence: Synthetic oligonucleotide

SEQ ID NO: 367252 - DNA, 31 bp, Artificial Sequence; identical to SEQ ID NO: 14770
  Description of Artificial Sequence: Synthetic oligonucleotide

SEQ ID NO: 367253 - DNA, 33 bp, Artificial Sequence; identical to SEQ ID NO: 14771
  Description of Artificial Sequence: Synthetic oligonucleotide

SEQ ID NO: 367254 - DNA, 32 bp, Artificial Sequence; identical to SEQ ID NO: 14772
  Description of Artificial Sequence: Synthetic oligonucleotide

SEQ ID NO: 367255 - DNA, 32 bp, Artificial Sequence; identical to SEQ ID NO: 14773
  Description of Artificial Sequence: Synthetic oligonucleotide

SEQ ID NO: 367256 - DNA, 32 bp, Artificial Sequence; identical to SEQ ID NO: 14774
  Description of Artificial Sequence: Synthetic oligonucleotide

SEQ ID NO: 367257 - DNA, 33 bp, Artificial Sequence; identical to SEQ ID NO: 14775
  Description of Artificial Sequence: Synthetic oligonucleotide

SEQ ID NO: 367258 - DNA, 32 bp, Artificial Sequence; identical to SEQ ID NO: 14776
  Description of Artificial Sequence: Synthetic oligonucleotide

SEQ ID NO: 367259 - DNA, 33 bp, Artificial Sequence; identical to SEQ ID NO: 14777
  Description of Artificial Sequence: Synthetic oligonucleotide

SEQ ID NO: 367260 - DNA, 33 bp, Artificial Sequence; identical to SEQ ID NO: 14778
  Description of Artificial Sequence: Synthetic oligonucleotide

SEQ ID NO: 367261 - DNA, 33 bp, Artificial Sequence; identical to SEQ ID NO: 14779
  Description of Artificial Sequence: Synthetic oligonucleotide

SEQ ID NO: 367262 - DNA, 32 bp, Artificial Sequence; identical to SEQ ID NO: 14780
  Description of Artificial Sequence: Synthetic oligonucleotide

SEQ ID NO: 367263 - DNA, 29 bp, Artificial Sequence
  Description of Artificial Sequence: Synthetic oligonucleotide
acggaaagtgaaggcccactcacagactg

SEQ ID NO: 367264 - DNA, 28 bp, Artificial Sequence
  Description of Artificial Sequence: Synthetic oligonucleotide
cggaaagtgaaggcccactcacagactg

SEQ ID NO: 367265 - DNA, 25 bp, Artificial Sequence
  Description of Artificial Sequence: Synthetic oligonucleotide
cccatgtggcggagcagtggagagt

SEQ ID NO: 367266 - DNA, 27 bp, Artificial Sequence
  Description of Artificial Sequence: Synthetic oligonucleotide
ccatgtggcggagcagtggagagtcta

SEQ ID NO: 367267 - DNA, 27 bp, Artificial Sequence
  Description of Artificial Sequence: Synthetic oligonucleotide
catgtggcggagcagtggagagtctac

SEQ ID NO: 367268 - DNA, 27 bp, Artificial Sequence
  Description of Artificial Sequence: Synthetic oligonucleotide
atgtggcggagcagtggagagtctacc

SEQ ID NO: 367269 - DNA, 27 bp, Artificial Sequence
  Description of Artificial Sequence: Synthetic oligonucleotide
tgtggcggagcagtggagagtctacct

SEQ ID NO: 367270 - DNA, 26 bp, Artificial Sequence
  Description of Artificial Sequence: Synthetic oligonucleotide
gtggcggagcagtggagagtctacct

SEQ ID NO: 367271 - DNA, 26 bp, Artificial Sequence
  Description of Artificial Sequence: Synthetic oligonucleotide
tggcggagcagtggagagtctacctg

SEQ ID NO: 367272 - DNA, 25 bp, Artificial Sequence
  Description of Artificial Sequence: Synthetic oligonucleotide
ggcggagcagtggagagtctacctg

SEQ ID NO: 367273 - DNA, 26 bp, Artificial Sequence
  Description of Artificial Sequence: Synthetic oligonucleotide
gcggagcagtggagagtctacctgga

SEQ ID NO: 367274 - DNA, 26 bp, Artificial Sequence
  Description of Artificial Sequence: Synthetic oligonucleotide
cggagcagtggagagtctacctggag

SEQ ID NO: 367275 - DNA, 26 bp, Artificial Sequence
  Description of Artificial Sequence: Synthetic oligonucleotide
ggagcagtggagagtctacctggagg

SEQ ID NO: 367276 - DNA, 26 bp, Artificial Sequence
  Description of Artificial Sequence: Synthetic oligonucleotide
gagcagtggagagtctacctggaggg

SEQ ID NO: 367277 - DNA, 27 bp, Artificial Sequence
  Description of Artificial Sequence: Synthetic oligonucleotide
agcagtggagagtctacctggagggca

SEQ ID NO: 367278 - DNA, 26 bp, Artificial Sequence
  Description of Artificial Sequence: Synthetic oligonucleotide
gcagtggagagtctacctggagggca

SEQ ID NO: 367279 - DNA, 26 bp, Artificial Sequence
  Description of Artificial Sequence: Synthetic oligonucleotide
cagtggagagtctacctggagggcac

SEQ ID NO: 367280 - DNA, 27 bp, Artificial Sequence
  Description of Artificial Sequence: Synthetic oligonucleotide
agtggagagtctacctggagggcacgt

SEQ ID NO: 367281 - DNA, 26 bp, Artificial Sequence
  Description of Artificial Sequence: Synthetic oligonucleotide
gtggagagtctacctggagggcacgt

SEQ ID NO: 367282 - DNA, 26 bp, Artificial Sequence
  Description of Artificial Sequence: Synthetic oligonucleotide
tggagagtctacctggagggcacgtg

SEQ ID NO: 367283 - DNA, 25 bp, Artificial Sequence
  Description of Artificial Sequence: Synthetic oligonucleotide
ggagagtctacctggagggcacgtg

SEQ ID NO: 367284 - DNA, 25 bp, Artificial Sequence
  Description of Artificial Sequence: Synthetic oligonucleotide
gagagtctacctggagggcacgtgc

SEQ ID NO: 367285 - DNA, 26 bp, Artificial Sequence
  Description of Artificial Sequence: Synthetic oligonucleotide
agagtctacctggagggcacgtgcgt

SEQ ID NO: 367286 - DNA, 25 bp, Artificial Sequence
  Description of Artificial Sequence: Synthetic oligonucleotide
gagtctacctggagggcacgtgcgt

SEQ ID NO: 367287 - DNA, 25 bp, Artificial Sequence
  Description of Artificial Sequence: Synthetic oligonucleotide
agtctacctggagggcacgtgcgtg

SEQ ID NO: 367288 - DNA, 24 bp, Artificial Sequence
  Description of Artificial Sequence: Synthetic oligonucleotide
gtctacctggagggcacgtgcgtg

SEQ ID NO: 367289 - DNA, 25 bp, Artificial Sequence
  Description of Artificial Sequence: Synthetic oligonucleotide
tctacctggagggcacgtgcgtgga

SEQ ID NO: 367290 - DNA, 25 bp, Artificial Sequence
  Description of Artificial Sequence: Synthetic oligonucleotide
tacctggagggcacgtgcgtggact

SEQ ID NO: 367291 - DNA, 24 bp, Artificial Sequence
  Description of Artificial Sequence: Synthetic oligonucleotide
acctggagggcacgtgcgtggact

SEQ ID NO: 367292 - DNA, 23 bp, Artificial Sequence
  Description of Artificial Sequence: Synthetic oligonucleotide
cctggagggcacgtgcgtggact

SEQ ID NO: 367293 - DNA, 23 bp, Artificial Sequence
  Description of Artificial Sequence: Synthetic oligonucleotide
ctggagggcacgtgcgtggactg

SEQ ID NO: 367294 - DNA, 23 bp, Artificial Sequence
  Description of Artificial Sequence: Synthetic oligonucleotide
tggagggcacgtgcgtggactgg

SEQ ID NO: 367295 - DNA, 22 bp, Artificial Sequence
  Description of Artificial Sequence: Synthetic oligonucleotide
ggagggcacgtgcgtggactgg

SEQ ID NO: 367296 - DNA, 23 bp, Artificial Sequence
  Description of Artificial Sequence: Synthetic oligonucleotide
gagggcacgtgcgtggactggct

SEQ ID NO: 367297 - DNA, 23 bp, Artificial Sequence
  Description of Artificial Sequence: Synthetic oligonucleotide
agggcacgtgcgtggactggctc

SEQ ID NO: 367298 - DNA, 22 bp, Artificial Sequence
  Description of Artificial Sequence: Synthetic oligonucleotide
gggcacgtgcgtggactggctc

SEQ ID NO: 367299 - DNA, 22 bp, Artificial Sequence
  Description of Artificial Sequence: Synthetic oligonucleotide
ggcacgtgcgtggactggctcc

SEQ ID NO: 367300 - DNA, 22 bp, Artificial Sequence
  Description of Artificial Sequence: Synthetic oligonucleotide
gcacgtgcgtggactggctccg

SEQ ID NO: 367301 - DNA, 23 bp, Artificial Sequence
  Description of Artificial Sequence: Synthetic oligonucleotide
cacgtgcgtggactggctccgca

SEQ ID NO: 367302 - DNA, 26 bp, Artificial Sequence
  Description of Artificial Sequence: Synthetic oligonucleotide
acgtgcgtggactggctccgcagata

SEQ ID NO: 367303 - DNA, 25 bp, Artificial Sequence
  Description of Artificial Sequence: Synthetic oligonucleotide
cgtgcgtggactggctccgcagata

SEQ ID NO: 367304 - DNA, 25 bp, Artificial Sequence
  Description of Artificial Sequence: Synthetic oligonucleotide
gtgcgtggactggctccgcagatac

SEQ ID NO: 367305 - DNA, 26 bp, Artificial Sequence
  Description of Artificial Sequence: Synthetic oligonucleotide
tgcgtggactggctccgcagatacct

SEQ ID NO: 367306 - DNA, 25 bp, Artificial Sequence
  Description of Artificial Sequence: Synthetic oligonucleotide
gcgtggactggctccgcagatacct

SEQ ID NO: 367307 - DNA, 25 bp, Artificial Sequence
  Description of Artificial Sequence: Synthetic oligonucleotide
cgtggactggctccgcagatacctg

SEQ ID NO: 367308 - DNA, 26 bp, Artificial Sequence
  Description of Artificial Sequence: Synthetic oligonucleotide
gtggactggctccgcagatacctgga

SEQ ID NO: 367309 - DNA, 27 bp, Artificial Sequence
  Description of Artificial Sequence: Synthetic oligonucleotide
tggactggctccgcagatacctggaga

SEQ ID NO: 367310 - DNA, 27 bp, Artificial Sequence
  Description of Artificial Sequence: Synthetic oligonucleotide
ggactggctccgcagatacctggagaa

SEQ ID NO: 367311 - DNA, 27 bp, Artificial Sequence
  Description of Artificial Sequence: Synthetic oligonucleotide
gactggctccgcagatacctggagaac

SEQ ID NO: 367312 - DNA, 27 bp, Artificial Sequence
  Description of Artificial Sequence: Synthetic oligonucleotide
actggctccgcagatacctggagaacg

SEQ ID NO: 367313 - DNA, 26 bp, Artificial Sequence
  Description of Artificial Sequence: Synthetic oligonucleotide
ctggctccgcagatacctggagaacg

SEQ ID NO: 367314 - DNA, 22 bp, Artificial Sequence
  Description of Artificial Sequence: Synthetic oligonucleotide
ggtcggacgggcgcttcctcca

SEQ ID NO: 367315 - DNA, 22 bp, Artificial Sequence
  Description of Artificial Sequence: Synthetic oligonucleotide
gtcggacgggcgcttcctccac

SEQ ID NO: 367316 - DNA, 22 bp, Artificial Sequence
  Description of Artificial Sequence: Synthetic oligonucleotide
tcggacgggcgcttcctccacg

SEQ ID NO: 367317 - DNA, 21 bp, Artificial Sequence
  Description of Artificial Sequence: Synthetic oligonucleotide
cggacgggcgcttcctccacg

SEQ ID NO: 367318 - DNA, 21 bp, Artificial Sequence
  Description of Artificial Sequence: Synthetic oligonucleotide
ggacgggcgcttcctccacgg

SEQ ID NO: 367319 - DNA, 23 bp, Artificial Sequence
  Description of Artificial Sequence: Synthetic oligonucleotide
gacgggcgcttcctccacgggta

SEQ ID NO: 367320 - DNA, 23 bp, Artificial Sequence
  Description of Artificial Sequence: Synthetic oligonucleotide
acgggcgcttcctccacgggtac

SEQ ID NO: 367321 - DNA, 22 bp, Artificial Sequence
  Description of Artificial Sequence: Synthetic oligonucleotide
cgggcgcttcctccacgggtac

SEQ ID NO: 367322 - DNA, 23 bp, Artificial Sequence
  Description of Artificial Sequence: Synthetic oligonucleotide
gggcgcttcctccacgggtacca

SEQ ID NO: 367323 - DNA, 23 bp, Artificial Sequence
  Description of Artificial Sequence: Synthetic oligonucleotide
ggcgcttcctccacgggtaccac

SEQ ID NO: 367324 - DNA, 24 bp, Artificial Sequence
  Description of Artificial Sequence: Synthetic oligonucleotide
gcgcttcctccacgggtaccacca

SEQ ID NO: 367325 - DNA, 26 bp, Artificial Sequence
  Description of Artificial Sequence: Synthetic oligonucleotide
cgcttcctccacgggtaccaccagta

SEQ ID NO: 367326 - DNA, 26 bp, Artificial Sequence
  Description of Artificial Sequence: Synthetic oligonucleotide
gcttcctccacgggtaccaccagtac

SEQ ID NO: 367327 - DNA, 26 bp, Artificial Sequence
  Description of Artificial Sequence: Synthetic oligonucleotide
cttcctccacgggtaccaccagtacg

SEQ ID NO: 367328 - DNA, 26 bp, Artificial Sequence
  Description of Artificial Sequence: Synthetic oligonucleotide
ttcctccacgggtaccaccagtacgc

SEQ ID NO: 367329 - DNA, 25 bp, Artificial Sequence
  Description of Artificial Sequence: Synthetic oligonucleotide
tcctccacgggtaccaccagtacgc

SEQ ID NO: 367330 - DNA, 24 bp, Artificial Sequence
  Description of Artificial Sequence: Synthetic oligonucleotide
cctccacgggtaccaccagtacgc

SEQ ID NO: 367331 - DNA, 26 bp, Artificial Sequence
  Description of Artificial Sequence: Synthetic oligonucleotide
ctccacgggtaccaccagtacgccta

SEQ ID NO: 367332 - DNA, 26 bp, Artificial Sequence
  Description of Artificial Sequence: Synthetic oligonucleotide
tccacgggtaccaccagtacgcctac

SEQ ID NO: 367333 - DNA, 25 bp, Artificial Sequence
  Description of Artificial Sequence: Synthetic oligonucleotide
ccacgggtaccaccagtacgcctac

SEQ ID NO: 367334 - DNA, 26 bp, Artificial Sequence
  Description of Artificial Sequence: Synthetic oligonucleotide
cacgggtaccaccagtacgcctacga

SEQ ID NO: 367335 - DNA, 26 bp, Artificial Sequence
  Description of Artificial Sequence: Synthetic oligonucleotide
acgggtaccaccagtacgcctacgac

SEQ ID NO: 367336 - DNA, 29 bp, Artificial Sequence
  Description of Artificial Sequence: Synthetic oligonucleotide
agggaaagtgaaggcccactcacagactc

SEQ ID NO: 367337 - DNA, 28 bp, Artificial Sequence
  Description of Artificial Sequence: Synthetic oligonucleotide
gggaaagtgaaggcccactcacagactc

SEQ ID NO: 367338 - DNA, 26 bp, Artificial Sequence
  Description of Artificial Sequence: Synthetic oligonucleotide
gccggagtattgggacgaggagacac

SEQ ID NO: 367339 - DNA, 26 bp, Artificial Sequence
  Description of Artificial Sequence: Synthetic oligonucleotide
ccggagtattgggacgaggagacacg

SEQ ID NO: 367340 - DNA, 27 bp, Artificial Sequence
  Description of Artificial Sequence: Synthetic oligonucleotide
cggagtattgggacgaggagacacgga

SEQ ID NO: 367341 - DNA, 29 bp, Artificial Sequence
  Description of Artificial Sequence: Synthetic oligonucleotide
ggagtattgggacgaggagacacggaaag

SEQ ID NO: 367342 - DNA, 30 bp, Artificial Sequence; identical to SEQ ID NO: 10365
  Description of Artificial Sequence: Synthetic oligonucleotide

SEQ ID NO: 367343 - DNA, 32 bp, Artificial Sequence; identical to SEQ ID NO: 10366
  Description of Artificial Sequence: Synthetic oligonucleotide

SEQ ID NO: 367344 - DNA, 31 bp, Artificial Sequence; identical to SEQ ID NO: 10367
  Description of Artificial Sequence: Synthetic oligonucleotide

SEQ ID NO: 367345 - DNA, 31 bp, Artificial Sequence; identical to SEQ ID NO: 10368
  Description of Artificial Sequence: Synthetic oligonucleotide

SEQ ID NO: 367346 - DNA, 30 bp, Artificial Sequence; identical to SEQ ID NO: 10369
  Description of Artificial Sequence: Synthetic oligonucleotide

SEQ ID NO: 367347 - DNA, 29 bp, Artificial Sequence
  Description of Artificial Sequence: Synthetic oligonucleotide
ttgggacgaggagacacggaaagtgaagg

SEQ ID NO: 367348 - DNA, 28 bp, Artificial Sequence
  Description of Artificial Sequence: Synthetic oligonucleotide
tgggacgaggagacacggaaagtgaagg

SEQ ID NO: 367349 - DNA, 27 bp, Artificial Sequence
  Description of Artificial Sequence: Synthetic oligonucleotide
gggacgaggagacacggaaagtgaagg

SEQ ID NO: 367350 - DNA, 27 bp, Artificial Sequence
  Description of Artificial Sequence: Synthetic oligonucleotide
ggacgaggagacacggaaagtgaaggc

SEQ ID NO: 367351 - DNA, 27 bp, Artificial Sequence
  Description of Artificial Sequence: Synthetic oligonucleotide
gacgaggagacacggaaagtgaaggcc

SEQ ID NO: 367352 - DNA, 27 bp, Artificial Sequence
  Description of Artificial Sequence: Synthetic oligonucleotide
acgaggagacacggaaagtgaaggccc

SEQ ID NO: 367353 - DNA, 27 bp, Artificial Sequence
  Description of Artificial Sequence: Synthetic oligonucleotide
cgaggagacacggaaagtgaaggccca

SEQ ID NO: 367354 - DNA, 27 bp, Artificial Sequence
  Description of Artificial Sequence: Synthetic oligonucleotide
gaggagacacggaaagtgaaggcccac

SEQ ID NO: 367355 - DNA, 25 bp, Artificial Sequence
  Description of Artificial Sequence: Synthetic oligonucleotide
aggggccggagtattgggacgagca

SEQ ID NO: 367356 - DNA, 24 bp, Artificial Sequence
  Description of Artificial Sequence: Synthetic oligonucleotide
ggggccggagtattgggacgagca

SEQ ID NO: 367357 - DNA, 25 bp, Artificial Sequence
  Description of Artificial Sequence: Synthetic oligonucleotide
gggccggagtattgggacgagcaga

SEQ ID NO: 367358 - DNA, 26 bp, Artificial Sequence
  Description of Artificial Sequence: Synthetic oligonucleotide
ggccggagtattgggacgagcagaca

SEQ ID NO: 367359 - DNA, 26 bp, Artificial Sequence
  Description of Artificial Sequence: Synthetic oligonucleotide
gccggagtattgggacgagcagacag

SEQ ID NO: 367360 - DNA, 26 bp, Artificial Sequence
  Description of Artificial Sequence: Synthetic oligonucleotide
ccggagtattgggacgagcagacagg

SEQ ID NO: 367361 - DNA, 27 bp, Artificial Sequence
  Description of Artificial Sequence: Synthetic oligonucleotide
cggagtattgggacgagcagacaggga

SEQ ID NO: 367362 - DNA, 29 bp, Artificial Sequence
  Description of Artificial Sequence: Synthetic oligonucleotide
ggagtattgggacgagcagacagggaaag

SEQ ID NO: 367363 - DNA, 30 bp, Artificial Sequence; identical to SEQ ID NO: 15722
  Description of Artificial Sequence: Synthetic oligonucleotide

SEQ ID NO: 367364 - DNA, 32 bp, Artificial Sequence; identical to SEQ ID NO: 15723
  Description of Artificial Sequence: Synthetic oligonucleotide

SEQ ID NO: 367365 - DNA, 31 bp, Artificial Sequence; identical to SEQ ID NO: 15724
  Description of Artificial Sequence: Synthetic oligonucleotide

SEQ ID NO: 367366 - DNA, 31 bp, Artificial Sequence; identical to SEQ ID NO: 15725
  Description of Artificial Sequence: Synthetic oligonucleotide

SEQ ID NO: 367367 - DNA, 30 bp, Artificial Sequence; identical to SEQ ID NO: 15726
  Description of Artificial Sequence: Synthetic oligonucleotide

SEQ ID NO: 367368 - DNA, 29 bp, Artificial Sequence
  Description of Artificial Sequence: Synthetic oligonucleotide
ttgggacgagcagacagggaaagtgaagg

SEQ ID NO: 367369 - DNA, 28 bp, Artificial Sequence
  Description of Artificial Sequence: Synthetic oligonucleotide
tgggacgagcagacagggaaagtgaagg

SEQ ID NO: 367370 - DNA, 27 bp, Artificial Sequence
  Description of Artificial Sequence: Synthetic oligonucleotide
gggacgagcagacagggaaagtgaagg

SEQ ID NO: 367371 - DNA, 27 bp, Artificial Sequence
  Description of Artificial Sequence: Synthetic oligonucleotide
ggacgagcagacagggaaagtgaaggc

SEQ ID NO: 367372 - DNA, 27 bp, Artificial Sequence
  Description of Artificial Sequence: Synthetic oligonucleotide
gacgagcagacagggaaagtgaaggcc

SEQ ID NO: 367373 - DNA, 27 bp, Artificial Sequence
  Description of Artificial Sequence: Synthetic oligonucleotide
acgagcagacagggaaagtgaaggccc

SEQ ID NO: 367374 - DNA, 27 bp, Artificial Sequence
  Description of Artificial Sequence: Synthetic oligonucleotide
cgagcagacagggaaagtgaaggccca

SEQ ID NO: 367375 - DNA, 27 bp, Artificial Sequence
  Description of Artificial Sequence: Synthetic oligonucleotide
gagcagacagggaaagtgaaggcccac

SEQ ID NO: 367376 - DNA, 28 bp, Artificial Sequence
  Description of Artificial Sequence: Synthetic oligonucleotide
agcagacagggaaagtgaaggcccactc

SEQ ID NO: 367377 - DNA, 27 bp, Artificial Sequence
  Description of Artificial Sequence: Synthetic oligonucleotide
gcagacagggaaagtgaaggcccactc

SEQ ID NO: 367378 - DNA, 28 bp, Artificial Sequence
  Description of Artificial Sequence: Synthetic oligonucleotide
cagacagggaaagtgaaggcccactcac

SEQ ID NO: 367379 - DNA, 23 bp, Artificial Sequence
  Description of Artificial Sequence: Synthetic oligonucleotide
cgcgagccagaggatggagccgt

SEQ ID NO: 367380 - DNA, 23 bp, Artificial Sequence
  Description of Artificial Sequence: Synthetic oligonucleotide
gcgagccagaggatggagccgtg

SEQ ID NO: 367381 - DNA, 23 bp, Artificial Sequence
  Description of Artificial Sequence: Synthetic oligonucleotide
cgagccagaggatggagccgtgg

SEQ ID NO: 367382 - DNA, 23 bp, Artificial Sequence
  Description of Artificial Sequence: Synthetic oligonucleotide
gagccagaggatggagccgtggg

SEQ ID NO: 367383 - DNA, 23 bp, Artificial Sequence
  Description of Artificial Sequence: Synthetic oligonucleotide
agccagaggatggagccgtgggc

SEQ ID NO: 367384 - DNA, 22 bp, Artificial Sequence
  Description of Artificial Sequence: Synthetic oligonucleotide
gccagaggatggagccgtgggc

SEQ ID NO: 367385 - DNA, 22 bp, Artificial Sequence
  Description of Artificial Sequence: Synthetic oligonucleotide
ccagaggatggagccgtgggcg

SEQ ID NO: 367386 - DNA, 22 bp, Artificial Sequence
  Description of Artificial Sequence: Synthetic oligonucleotide
cagaggatggagccgtgggcgc

SEQ ID NO: 367387 - DNA, 22 bp, Artificial Sequence
  Description of Artificial Sequence: Synthetic oligonucleotide
agaggatggagccgtgggcgcc

SEQ ID NO: 367388 - DNA, 21 bp, Artificial Sequence
  Description of Artificial Sequence: Synthetic oligonucleotide
gaggatggagccgtgggcgcc

SEQ ID NO: 367389 - DNA, 22 bp, Artificial Sequence
  Description of Artificial Sequence: Synthetic oligonucleotide
aggatggagccgtgggcgccgt

SEQ ID NO: 367390 - DNA, 21 bp, Artificial Sequence
  Description of Artificial Sequence: Synthetic oligonucleotide
ggatggagccgtgggcgccgt

SEQ ID NO: 367391 - DNA, 21 bp, Artificial Sequence
  Description of Artificial Sequence: Synthetic oligonucleotide
gatggagccgtgggcgccgtg

SEQ ID NO: 367392 - DNA, 24 bp, Artificial Sequence
  Description of Artificial Sequence: Synthetic oligonucleotide
atggagccgtgggcgccgtggata

SEQ ID NO: 367393 - DNA, 23 bp, Artificial Sequence
  Description of Artificial Sequence: Synthetic oligonucleotide
tggagccgtgggcgccgtggata

SEQ ID NO: 367394 - DNA, 22 bp, Artificial Sequence
  Description of Artificial Sequence: Synthetic oligonucleotide
ggagccgtgggcgccgtggata

SEQ ID NO: 367395 - DNA, 23 bp, Artificial Sequence
  Description of Artificial Sequence: Synthetic oligonucleotide
gagccgtgggcgccgtggataga

SEQ ID NO: 367396 - DNA, 23 bp, Artificial Sequence
  Description of Artificial Sequence: Synthetic oligonucleotide
agccgtgggcgccgtggatagag

SEQ ID NO: 367397 - DNA, 22 bp, Artificial Sequence
  Description of Artificial Sequence: Synthetic oligonucleotide
gccgtgggcgccgtggatagag

SEQ ID NO: 367398 - DNA, 23 bp, Artificial Sequence
  Description of Artificial Sequence: Synthetic oligonucleotide
ccgtgggcgccgtggatagagca

SEQ ID NO: 367399 - DNA, 23 bp, Artificial Sequence
  Description of Artificial Sequence: Synthetic oligonucleotide
cgtgggcgccgtggatagagcag

SEQ ID NO: 367400 - DNA, 24 bp, Artificial Sequence
  Description of Artificial Sequence: Synthetic oligonucleotide
gtgggcgccgtggatagagcagga

SEQ ID NO: 367401 - DNA, 24 bp, Artificial Sequence
  Description of Artificial Sequence: Synthetic oligonucleotide
tgggcgccgtggatagagcaggag

SEQ ID NO: 367402 - DNA, 27 bp, Artificial Sequence
  Description of Artificial Sequence: Synthetic oligonucleotide
gaggccggttctcacaccctccagata

SEQ ID NO: 367403 - DNA, 29 bp, Artificial Sequence
  Description of Artificial Sequence: Synthetic oligonucleotide
aggccggttctcacaccctccagataatg

SEQ ID NO: 367404 - DNA, 28 bp, Artificial Sequence
  Description of Artificial Sequence: Synthetic oligonucleotide
ggccggttctcacaccctccagataatg

SEQ ID NO: 367405 - DNA, 31 bp, Artificial Sequence; identical to SEQ ID NO: 16004
  Description of Artificial Sequence: Synthetic oligonucleotide

SEQ ID NO: 367406 - DNA, 31 bp, Artificial Sequence; identical to SEQ ID NO: 16005
  Description of Artificial Sequence: Synthetic oligonucleotide

SEQ ID NO: 367407 - DNA, 31 bp, Artificial Sequence; identical to SEQ ID NO: 16006
  Description of Artificial Sequence: Synthetic oligonucleotide

SEQ ID NO: 367408 - DNA, 32 bp, Artificial Sequence; identical to SEQ ID NO: 16007
  Description of Artificial Sequence: Synthetic oligonucleotide

SEQ ID NO: 367409 - DNA, 32 bp, Artificial Sequence; identical to SEQ ID NO: 16008
  Description of Artificial Sequence: Synthetic oligonucleotide

SEQ ID NO: 367410 - DNA, 32 bp, Artificial Sequence; identical to SEQ ID NO: 16009
  Description of Artificial Sequence: Synthetic oligonucleotide

SEQ ID NO: 367411 - DNA, 31 bp, Artificial Sequence; identical to SEQ ID NO: 16010
  Description of Artificial Sequence: Synthetic oligonucleotide

SEQ ID NO: 367412 - DNA, 30 bp, Artificial Sequence; identical to SEQ ID NO: 16011
  Description of Artificial Sequence: Synthetic oligonucleotide

SEQ ID NO: 367413 - DNA, 31 bp, Artificial Sequence; identical to SEQ ID NO: 16012
  Description of Artificial Sequence: Synthetic oligonucleotide

SEQ ID NO: 367414 - DNA, 30 bp, Artificial Sequence; identical to SEQ ID NO: 16013
  Description of Artificial Sequence: Synthetic oligonucleotide

SEQ ID NO: 367415 - DNA, 30 bp, Artificial Sequence; identical to SEQ ID NO: 16014
  Description of Artificial Sequence: Synthetic oligonucleotide

SEQ ID NO: 367416 - DNA, 29 bp, Artificial Sequence
  Description of Artificial Sequence: Synthetic oligonucleotide
caccctccagataatgtatggctgcgacg

SEQ ID NO: 367417 - DNA, 30 bp, Artificial Sequence; identical to SEQ ID NO: 16016
  Description of Artificial Sequence: Synthetic oligonucleotide

SEQ ID NO: 367418 - DNA, 29 bp, Artificial Sequence
  Description of Artificial Sequence: Synthetic oligonucleotide
ccctccagataatgtatggctgcgacgtg

SEQ ID NO: 367419 - DNA, 29 bp, Artificial Sequence
  Description of Artificial Sequence: Synthetic oligonucleotide
cctccagataatgtatggctgcgacgtgg

SEQ ID NO: 367420 - DNA, 29 bp, Artificial Sequence
  Description of Artificial Sequence: Synthetic oligonucleotide
ctccagataatgtatggctgcgacgtggg

SEQ ID NO: 367421 - DNA, 22 bp, Artificial Sequence
  Description of Artificial Sequence: Synthetic oligonucleotide
agaggatggagccgcgggcgct

SEQ ID NO: 367422 - DNA, 21 bp, Artificial Sequence
  Description of Artificial Sequence: Synthetic oligonucleotide
gaggatggagccgcgggcgct

SEQ ID NO: 367423 - DNA, 22 bp, Artificial Sequence
  Description of Artificial Sequence: Synthetic oligonucleotide
aggatggagccgcgggcgctgt

SEQ ID NO: 367424 - DNA, 21 bp, Artificial Sequence
  Description of Artificial Sequence: Synthetic oligonucleotide
ggatggagccgcgggcgctgt

SEQ ID NO: 367425 - DNA, 21 bp, Artificial Sequence
  Description of Artificial Sequence: Synthetic oligonucleotide
gatggagccgcgggcgctgtg

SEQ ID NO: 367426 - DNA, 24 bp, Artificial Sequence
  Description of Artificial Sequence: Synthetic oligonucleotide
atggagccgcgggcgctgtggata

SEQ ID NO: 367427 - DNA, 23 bp, Artificial Sequence
  Description of Artificial Sequence: Synthetic oligonucleotide
tggagccgcgggcgctgtggata

SEQ ID NO: 367428 - DNA, 22 bp, Artificial Sequence
  Description of Artificial Sequence: Synthetic oligonucleotide
ggagccgcgggcgctgtggata

SEQ ID NO: 367429 - DNA, 23 bp, Artificial Sequence
  Description of Artificial Sequence: Synthetic oligonucleotide
gagccgcgggcgctgtggataga

SEQ ID NO: 367430 - DNA, 23 bp, Artificial Sequence
  Description of Artificial Sequence: Synthetic oligonucleotide
agccgcgggcgctgtggatagag

SEQ ID NO: 367431 - DNA, 22 bp, Artificial Sequence
  Description of Artificial Sequence: Synthetic oligonucleotide
gccgcgggcgctgtggatagag

SEQ ID NO: 367432 - DNA, 23 bp, Artificial Sequence
  Description of Artificial Sequence: Synthetic oligonucleotide
ccgcgggcgctgtggatagagca

SEQ ID NO: 367433 - DNA, 23 bp, Artificial Sequence
  Description of Artificial Sequence: Synthetic oligonucleotide
cgcgggcgctgtggatagagcag

SEQ ID NO: 367434 - DNA, 24 bp, Artificial Sequence
  Description of Artificial Sequence: Synthetic oligonucleotide
gcgggcgctgtggatagagcagga

SEQ ID NO: 367435 - DNA, 24 bp, Artificial Sequence
  Description of Artificial Sequence: Synthetic oligonucleotide
cgggcgctgtggatagagcaggag

SEQ ID NO: 367436 - DNA, 24 bp, Artificial Sequence
  Description of Artificial Sequence: Synthetic oligonucleotide
gggcgctgtggatagagcaggagg

SEQ ID NO: 367437 - DNA, 24 bp, Artificial Sequence
  Description of Artificial Sequence: Synthetic oligonucleotide
ggcgctgtggatagagcaggaggg

SEQ ID NO: 367438 - DNA, 24 bp, Artificial Sequence
  Description of Artificial Sequence: Synthetic oligonucleotide
gcgctgtggatagagcaggagggg

SEQ ID NO: 367439 - DNA, 24 bp, Artificial Sequence
  Description of Artificial Sequence: Synthetic oligonucleotide
cgctgtggatagagcaggaggggc

SEQ ID NO: 367440 - DNA, 24 bp, Artificial Sequence
  Description of Artificial Sequence: Synthetic oligonucleotide
gctgtggatagagcaggaggggcc

SEQ ID NO: 367441 - DNA, 24 bp, Artificial Sequence
  Description of Artificial Sequence: Synthetic oligonucleotide
ctgtggatagagcaggaggggccg

SEQ ID NO: 367442 - DNA, 25 bp, Artificial Sequence
  Description of Artificial Sequence: Synthetic oligonucleotide
tgtggatagagcaggaggggccgga

SEQ ID NO: 367443 - DNA, 26 bp, Artificial Sequence
  Description of Artificial Sequence: Synthetic oligonucleotide
ggcccactcacagactgaccgagaga

SEQ ID NO: 367444 - DNA, 26 bp, Artificial Sequence
  Description of Artificial Sequence: Synthetic oligonucleotide
gcccactcacagactgaccgagagag

SEQ ID NO: 367445 - DNA, 26 bp, Artificial Sequence
  Description of Artificial Sequence: Synthetic oligonucleotide
cccactcacagactgaccgagagagc

SEQ ID NO: 367446 - DNA, 27 bp, Artificial Sequence
  Description of Artificial Sequence: Synthetic oligonucleotide
ccactcacagactgaccgagagagcct

SEQ ID NO: 367447 - DNA, 27 bp, Artificial Sequence
  Description of Artificial Sequence: Synthetic oligonucleotide
cactcacagactgaccgagagagcctg

SEQ ID NO: 367448 - DNA, 27 bp, Artificial Sequence
  Description of Artificial Sequence: Synthetic oligonucleotide
actcacagactgaccgagagagcctgc

SEQ ID NO: 367449 - DNA, 26 bp, Artificial Sequence
  Description of Artificial Sequence: Synthetic oligonucleotide
ctcacagactgaccgagagagcctgc

SEQ ID NO: 367450 - DNA, 26 bp, Artificial Sequence
  Description of Artificial Sequence: Synthetic oligonucleotide
tcacagactgaccgagagagcctgcg

SEQ ID NO: 367451 - DNA, 25 bp, Artificial Sequence
  Description of Artificial Sequence: Synthetic oligonucleotide
cacagactgaccgagagagcctgcg

SEQ ID NO: 367452 - DNA, 27 bp, Artificial Sequence
  Description of Artificial Sequence: Synthetic oligonucleotide
acagactgaccgagagagcctgcggat

SEQ ID NO: 367453 - DNA, 26 bp, Artificial Sequence
  Description of Artificial Sequence: Synthetic oligonucleotide
cagactgaccgagagagcctgcggat

SEQ ID NO: 367454 - DNA, 26 bp, Artificial Sequence
  Description of Artificial Sequence: Synthetic oligonucleotide
agactgaccgagagagcctgcggatc

SEQ ID NO: 367455 - DNA, 25 bp, Artificial Sequence
  Description of Artificial Sequence: Synthetic oligonucleotide
gactgaccgagagagcctgcggatc

SEQ ID NO: 367456 - DNA, 25 bp, Artificial Sequence
  Description of Artificial Sequence: Synthetic oligonucleotide
actgaccgagagagcctgcggatcg

SEQ ID NO: 367457 - DNA, 24 bp, Artificial Sequence
  Description of Artificial Sequence: Synthetic oligonucleotide
ctgaccgagagagcctgcggatcg

SEQ ID NO: 367458 - DNA, 24 bp, Artificial Sequence
  Description of Artificial Sequence: Synthetic oligonucleotide
tgaccgagagagcctgcggatcgc

SEQ ID NO: 367459 - DNA, 23 bp, Artificial Sequence
  Description of Artificial Sequence: Synthetic oligonucleotide
gaccgagagagcctgcggatcgc

SEQ ID NO: 367460 - DNA, 23 bp, Artificial Sequence
  Description of Artificial Sequence: Synthetic oligonucleotide
accgagagagcctgcggatcgcg

SEQ ID NO: 367461 - DNA, 22 bp, Artificial Sequence
  Description of Artificial Sequence: Synthetic oligonucleotide
ccgagagagcctgcggatcgcg

SEQ ID NO: 367462 - DNA, 23 bp, Artificial Sequence
  Description of Artificial Sequence: Synthetic oligonucleotide
cgagagagcctgcggatcgcgct

SEQ ID NO: 367463 - DNA, 23 bp, Artificial Sequence
  Description of Artificial Sequence: Synthetic oligonucleotide
gagagagcctgcggatcgcgctc

SEQ ID NO: 367464 - DNA, 23 bp, Artificial Sequence
  Description of Artificial Sequence: Synthetic oligonucleotide
agagagcctgcggatcgcgctcc

SEQ ID NO: 367465 - DNA, 22 bp, Artificial Sequence
  Description of Artificial Sequence: Synthetic oligonucleotide
gagagcctgcggatcgcgctcc

SEQ ID NO: 367466 - DNA, 22 bp, Artificial Sequence
  Description of Artificial Sequence: Synthetic oligonucleotide
agagcctgcggatcgcgctccg

SEQ ID NO: 367467 - DNA, 21 bp, Artificial Sequence
  Description of Artificial Sequence: Synthetic oligonucleotide
gagcctgcggatcgcgctccg

SEQ ID NO: 367468 - DNA, 23 bp, Artificial Sequence
  Description of Artificial Sequence: Synthetic oligonucleotide
agcctgcggatcgcgctccgcta

SEQ ID NO: 367469 - DNA, 22 bp, Artificial Sequence
  Description of Artificial Sequence: Synthetic oligonucleotide
gcctgcggatcgcgctccgcta

SEQ ID NO: 367470 - DNA, 27 bp, Artificial Sequence
  Description of Artificial Sequence: Synthetic oligonucleotide
gctccgctactacaaccagagcgagga

SEQ ID NO: 367471 - DNA, 27 bp, Artificial Sequence
  Description of Artificial Sequence: Synthetic oligonucleotide
ctccgctactacaaccagagcgaggac

SEQ ID NO: 367472 - DNA, 27 bp, Artificial Sequence
  Description of Artificial Sequence: Synthetic oligonucleotide
tccgctactacaaccagagcgaggacg

SEQ ID NO: 367473 - DNA, 26 bp, Artificial Sequence
  Description of Artificial Sequence: Synthetic oligonucleotide
ccgctactacaaccagagcgaggacg

SEQ ID NO: 367474 - DNA, 27 bp, Artificial Sequence
  Description of Artificial Sequence: Synthetic oligonucleotide
cgctactacaaccagagcgaggacggt

SEQ ID NO: 367475 - DNA, 27 bp, Artificial Sequence
  Description of Artificial Sequence: Synthetic oligonucleotide
cgaggacggttctcacaccatccagag

SEQ ID NO: 367476 - DNA, 27 bp, Artificial Sequence
  Description of Artificial Sequence: Synthetic oligonucleotide
gaggacggttctcacaccatccagagg

SEQ ID NO: 367477 - DNA, 29 bp, Artificial Sequence
  Description of Artificial Sequence: Synthetic oligonucleotide
aggacggttctcacaccatccagaggatg

SEQ ID NO: 367478 - DNA, 28 bp, Artificial Sequence
  Description of Artificial Sequence: Synthetic oligonucleotide
ggacggttctcacaccatccagaggatg

SEQ ID NO: 367479 - DNA, 31 bp, Artificial Sequence; identical to SEQ ID NO: 16693
  Description of Artificial Sequence: Synthetic oligonucleotide

SEQ ID NO: 367480 - DNA, 31 bp, Artificial Sequence; identical to SEQ ID NO: 16694
  Description of Artificial Sequence: Synthetic oligonucleotide

SEQ ID NO: 367481 - DNA, 30 bp, Artificial Sequence; identical to SEQ ID NO: 5796
  Description of Artificial Sequence: Synthetic oligonucleotide

SEQ ID NO: 367482 - DNA, 30 bp, Artificial Sequence; identical to SEQ ID NO: 5797
  Description of Artificial Sequence: Synthetic oligonucleotide

SEQ ID NO: 367483 - DNA, 31 bp, Artificial Sequence; identical to SEQ ID NO: 5798
  Description of Artificial Sequence: Synthetic oligonucleotide

SEQ ID NO: 367484 - DNA, 31 bp, Artificial Sequence; identical to SEQ ID NO: 5799
  Description of Artificial Sequence: Synthetic oligonucleotide

SEQ ID NO: 367485 - DNA, 30 bp, Artificial Sequence; identical to SEQ ID NO: 5800
  Description of Artificial Sequence: Synthetic oligonucleotide

SEQ ID NO: 367486 - DNA, 29 bp, Artificial Sequence
  Description of Artificial Sequence: Synthetic oligonucleotide
ctcacaccatccagaggatgtatggctgc

SEQ ID NO: 367487 - DNA, 29 bp, Artificial Sequence
  Description of Artificial Sequence: Synthetic oligonucleotide
tcacaccatccagaggatgtatggctgcg

SEQ ID NO: 367488 - DNA, 28 bp, Artificial Sequence
  Description of Artificial Sequence: Synthetic oligonucleotide
cacaccatccagaggatgtatggctgcg

SEQ ID NO: 367489 - DNA, 29 bp, Artificial Sequence
  Description of Artificial Sequence: Synthetic oligonucleotide
acaccatccagaggatgtatggctgcgac

SEQ ID NO: 367490 - DNA, 28 bp, Artificial Sequence
  Description of Artificial Sequence: Synthetic oligonucleotide
caccatccagaggatgtatggctgcgac

SEQ ID NO: 367491 - DNA, 28 bp, Artificial Sequence
  Description of Artificial Sequence: Synthetic oligonucleotide
accatccagaggatgtatggctgcgacg

SEQ ID NO: 367492 - DNA, 27 bp, Artificial Sequence
  Description of Artificial Sequence: Synthetic oligonucleotide
ccatccagaggatgtatggctgcgacg

SEQ ID NO: 367493 - DNA, 28 bp, Artificial Sequence
  Description of Artificial Sequence: Synthetic oligonucleotide
catccagaggatgtatggctgcgacgtg

SEQ ID NO: 367494 - DNA, 28 bp, Artificial Sequence
  Description of Artificial Sequence: Synthetic oligonucleotide
atccagaggatgtatggctgcgacgtgg

SEQ ID NO: 367495 - DNA, 26 bp, Artificial Sequence
  Description of Artificial Sequence: Synthetic oligonucleotide
agaggatgtatggctgcgacgtgggg

SEQ ID NO: 367496 - DNA, 25 bp, Artificial Sequence
  Description of Artificial Sequence: Synthetic oligonucleotide
gaggatgtatggctgcgacgtgggg

SEQ ID NO: 367497 - DNA, 25 bp, Artificial Sequence
  Description of Artificial Sequence: Synthetic oligonucleotide
aggatgtatggctgcgacgtggggc

SEQ ID NO: 367498 - DNA, 24 bp, Artificial Sequence
  Description of Artificial Sequence: Synthetic oligonucleotide
ggatgtatggctgcgacgtggggc

SEQ ID NO: 367499 - DNA, 22 bp, Artificial Sequence
  Description of Artificial Sequence: Synthetic oligonucleotide
gcgcttcctccgcgggtaccag

SEQ ID NO: 367500 - DNA, 23 bp, Artificial Sequence
  Description of Artificial Sequence: Synthetic oligonucleotide
cgcttcctccgcgggtaccagca

SEQ ID NO: 367501 - DNA, 23 bp, Artificial Sequence
  Description of Artificial Sequence: Synthetic oligonucleotide
gcttcctccgcgggtaccagcag

SEQ ID NO: 367502 - DNA, 24 bp, Artificial Sequence
  Description of Artificial Sequence: Synthetic oligonucleotide
cttcctccgcgggtaccagcagga

SEQ ID NO: 367503 - DNA, 24 bp, Artificial Sequence
  Description of Artificial Sequence: Synthetic oligonucleotide
ttcctccgcgggtaccagcaggac

SEQ ID NO: 367504 - DNA, 23 bp, Artificial Sequence
  Description of Artificial Sequence: Synthetic oligonucleotide
tcctccgcgggtaccagcaggac

SEQ ID NO: 367505 - DNA, 22 bp, Artificial Sequence
  Description of Artificial Sequence: Synthetic oligonucleotide
cctccgcgggtaccagcaggac

SEQ ID NO: 367506 - DNA, 22 bp, Artificial Sequence
  Description of Artificial Sequence: Synthetic oligonucleotide
ctccgcgggtaccagcaggacg

SEQ ID NO: 367507 - DNA, 25 bp, Artificial Sequence
  Description of Artificial Sequence: Synthetic oligonucleotide
tccgcgggtaccagcaggacgctta

SEQ ID NO: 367508 - DNA, 24 bp, Artificial Sequence
  Description of Artificial Sequence: Synthetic oligonucleotide
ccgcgggtaccagcaggacgctta

SEQ ID NO: 367509 - DNA, 24 bp, Artificial Sequence
  Description of Artificial Sequence: Synthetic oligonucleotide
cgcgggtaccagcaggacgcttac

SEQ ID NO: 367510 - DNA, 25 bp, Artificial Sequence
  Description of Artificial Sequence: Synthetic oligonucleotide
gcgggtaccagcaggacgcttacga

SEQ ID NO: 367511 - DNA, 25 bp, Artificial Sequence
  Description of Artificial Sequence: Synthetic oligonucleotide
cgggtaccagcaggacgcttacgac

SEQ ID NO: 367512 - DNA, 25 bp, Artificial Sequence
  Description of Artificial Sequence: Synthetic oligonucleotide
gggtaccagcaggacgcttacgacg

SEQ ID NO: 367513 - DNA, 25 bp, Artificial Sequence
  Description of Artificial Sequence: Synthetic oligonucleotide
ggtaccagcaggacgcttacgacgg

SEQ ID NO: 367514 - DNA, 27 bp, Artificial Sequence
  Description of Artificial Sequence: Synthetic oligonucleotide
gtaccagcaggacgcttacgacggcaa

SEQ ID NO: 367515 - DNA, 27 bp, Artificial Sequence
  Description of Artificial Sequence: Synthetic oligonucleotide
taccagcaggacgcttacgacggcaag

SEQ ID NO: 367516 - DNA, 26 bp, Artificial Sequence
  Description of Artificial Sequence: Synthetic oligonucleotide
accagcaggacgcttacgacggcaag

SEQ ID NO: 367517 - DNA, 25 bp, Artificial Sequence
  Description of Artificial Sequence: Synthetic oligonucleotide
ccagcaggacgcttacgacggcaag

SEQ ID NO: 367518 - DNA, 27 bp, Artificial Sequence
  Description of Artificial Sequence: Synthetic oligonucleotide
cagcaggacgcttacgacggcaaggat

SEQ ID NO: 367519 - DNA, 29 bp, Artificial Sequence
  Description of Artificial Sequence: Synthetic oligonucleotide
agcaggacgcttacgacggcaaggattac

SEQ ID NO: 367520 - DNA, 27 bp, Artificial Sequence
  Description of Artificial Sequence: Synthetic oligonucleotide
ctcagatcacccagcgcaagtgggaga

SEQ ID NO: 367521 - DNA, 27 bp, Artificial Sequence
  Description of Artificial Sequence: Synthetic oligonucleotide
tcagatcacccagcgcaagtgggagac

SEQ ID NO: 367522 - DNA, 26 bp, Artificial Sequence
  Description of Artificial Sequence: Synthetic oligonucleotide
cagatcacccagcgcaagtgggagac

SEQ ID NO: 367523 - DNA, 26 bp, Artificial Sequence
  Description of Artificial Sequence: Synthetic oligonucleotide
agatcacccagcgcaagtgggagacg

SEQ ID NO: 367524 - DNA, 25 bp, Artificial Sequence
  Description of Artificial Sequence: Synthetic oligonucleotide
gatcacccagcgcaagtgggagacg

SEQ ID NO: 367525 - DNA, 25 bp, Artificial Sequence
  Description of Artificial Sequence: Synthetic oligonucleotide
atcacccagcgcaagtgggagacgg

SEQ ID NO: 367526 - DNA, 24 bp, Artificial Sequence
  Description of Artificial Sequence: Synthetic oligonucleotide
tcacccagcgcaagtgggagacgg

SEQ ID NO: 367527 - DNA, 23 bp, Artificial Sequence
  Description of Artificial Sequence: Synthetic oligonucleotide
cacccagcgcaagtgggagacgg

SEQ ID NO: 367528 - DNA, 23 bp, Artificial Sequence
  Description of Artificial Sequence: Synthetic oligonucleotide
acccagcgcaagtgggagacggc

SEQ ID NO: 367529 - DNA, 22 bp, Artificial Sequence
  Description of Artificial Sequence: Synthetic oligonucleotide
cccagcgcaagtgggagacggc

SEQ ID NO: 367530 - DNA, 22 bp, Artificial Sequence
  Description of Artificial Sequence: Synthetic oligonucleotide
ccagcgcaagtgggagacggcc

SEQ ID NO: 367531 - DNA, 24 bp, Artificial Sequence
  Description of Artificial Sequence: Synthetic oligonucleotide
cagcgcaagtgggagacggcccat

SEQ ID NO: 367532 - DNA, 25 bp, Artificial Sequence
  Description of Artificial Sequence: Synthetic oligonucleotide
agcgcaagtgggagacggcccatga

SEQ ID NO: 367533 - DNA, 24 bp, Artificial Sequence
  Description of Artificial Sequence: Synthetic oligonucleotide
gcgcaagtgggagacggcccatga

SEQ ID NO: 367534 - DNA, 24 bp, Artificial Sequence
  Description of Artificial Sequence: Synthetic oligonucleotide
cgcaagtgggagacggcccatgag

SEQ ID NO: 367535 - DNA, 24 bp, Artificial Sequence
  Description of Artificial Sequence: Synthetic oligonucleotide
gcaagtgggagacggcccatgagg

SEQ ID NO: 367536 - DNA, 24 bp, Artificial Sequence
  Description of Artificial Sequence: Synthetic oligonucleotide
cagtggagagcctacctggagggc

SEQ ID NO: 367537 - DNA, 24 bp, Artificial Sequence
  Description of Artificial Sequence: Synthetic oligonucleotide
agtggagagcctacctggagggcc

SEQ ID NO: 367538 - DNA, 23 bp, Artificial Sequence
  Description of Artificial Sequence: Synthetic oligonucleotide
gtggagagcctacctggagggcc

SEQ ID NO: 367539 - DNA, 23 bp, Artificial Sequence
  Description of Artificial Sequence: Synthetic oligonucleotide
tggagagcctacctggagggccg

SEQ ID NO: 367540 - DNA, 22 bp, Artificial Sequence
  Description of Artificial Sequence: Synthetic oligonucleotide
ggagagcctacctggagggccg

SEQ ID NO: 367541 - DNA, 22 bp, Artificial Sequence
  Description of Artificial Sequence: Synthetic oligonucleotide
tgcagcgcacggacgcccccaa

SEQ ID NO: 367542 - DNA, 21 bp, Artificial Sequence
  Description of Artificial Sequence: Synthetic oligonucleotide
gcagcgcacggacgcccccaa

SEQ ID NO: 367543 - DNA, 22 bp, Artificial Sequence
  Description of Artificial Sequence: Synthetic oligonucleotide
cagcgcacggacgcccccaaga

SEQ ID NO: 367544 - DNA, 22 bp, Artificial Sequence
  Description of Artificial Sequence: Synthetic oligonucleotide
agcgcacggacgcccccaagac

SEQ ID NO: 367545 - DNA, 21 bp, Artificial Sequence
  Description of Artificial Sequence: Synthetic oligonucleotide
gcgcacggacgcccccaagac

SEQ ID NO: 367546 - DNA, 21 bp, Artificial Sequence
  Description of Artificial Sequence: Synthetic oligonucleotide
cgcacggacgcccccaagacg

SEQ ID NO: 367547 - DNA, 25 bp, Artificial Sequence
  Description of Artificial Sequence: Synthetic oligonucleotide
gcacggacgcccccaagacgcatat

SEQ ID NO: 367548 - DNA, 26 bp, Artificial Sequence
  Description of Artificial Sequence: Synthetic oligonucleotide
cacggacgcccccaagacgcatatga

SEQ ID NO: 367549 - DNA, 27 bp, Artificial Sequence
  Description of Artificial Sequence: Synthetic oligonucleotide
acggacgcccccaagacgcatatgact

SEQ ID NO: 367550 - DNA, 26 bp, Artificial Sequence
  Description of Artificial Sequence: Synthetic oligonucleotide
cggacgcccccaagacgcatatgact

SEQ ID NO: 367551 - DNA, 27 bp, Artificial Sequence
  Description of Artificial Sequence: Synthetic oligonucleotide
ggacgcccccaagacgcatatgactca

SEQ ID NO: 367552 - DNA, 27 bp, Artificial Sequence
  Description of Artificial Sequence: Synthetic oligonucleotide
gacgcccccaagacgcatatgactcac

SEQ ID NO: 367553 - DNA, 27 bp, Artificial Sequence
  Description of Artificial Sequence: Synthetic oligonucleotide
acgcccccaagacgcatatgactcacc

SEQ ID NO: 367554 - DNA, 27 bp, Artificial Sequence
  Description of Artificial Sequence: Synthetic oligonucleotide
cgcccccaagacgcatatgactcacca

SEQ ID NO: 367555 - DNA, 27 bp, Artificial Sequence
  Description of Artificial Sequence: Synthetic oligonucleotide
gcccccaagacgcatatgactcaccac

SEQ ID NO: 367556 - DNA, 27 bp, Artificial Sequence
  Description of Artificial Sequence: Synthetic oligonucleotide
cccccaagacgcatatgactcaccacg

SEQ ID NO: 367557 - DNA, 27 bp, Artificial Sequence
  Description of Artificial Sequence: Synthetic oligonucleotide
ccccaagacgcatatgactcaccacgc

SEQ ID NO: 367558 - DNA, 28 bp, Artificial Sequence
  Description of Artificial Sequence: Synthetic oligonucleotide
cccaagacgcatatgactcaccacgctg

SEQ ID NO: 367559 - DNA, 29 bp, Artificial Sequence
  Description of Artificial Sequence: Synthetic oligonucleotide
ccaagacgcatatgactcaccacgctgtc

SEQ ID NO: 367560 - DNA, 30 bp, Artificial Sequence; identical to SEQ ID NO: 6238
  Description of Artificial Sequence: Synthetic oligonucleotide

SEQ ID NO: 367561 - DNA, 31 bp, Artificial Sequence; identical to SEQ ID NO: 6239
  Description of Artificial Sequence: Synthetic oligonucleotide

SEQ ID NO: 367562 - DNA, 30 bp, Artificial Sequence; identical to SEQ ID NO: 6240
  Description of Artificial Sequence: Synthetic oligonucleotide

SEQ ID NO: 367563 - DNA, 29 bp, Artificial Sequence
  Description of Artificial Sequence: Synthetic oligonucleotide
gacgcatatgactcaccacgctgtctctg

SEQ ID NO: 367564 - DNA, 32 bp, Artificial Sequence; identical to SEQ ID NO: 6242
  Description of Artificial Sequence: Synthetic oligonucleotide

SEQ ID NO: 367565 - DNA, 31 bp, Artificial Sequence; identical to SEQ ID NO: 6243
  Description of Artificial Sequence: Synthetic oligonucleotide

SEQ ID NO: 367566 - DNA, 30 bp, Artificial Sequence; identical to SEQ ID NO: 6244
  Description of Artificial Sequence: Synthetic oligonucleotide

SEQ ID NO: 367567 - DNA, 29 bp, Artificial Sequence
  Description of Artificial Sequence: Synthetic oligonucleotide
tgactcaccacgctgtctctgaccatgag

SEQ ID NO: 367568 - DNA, 28 bp, Artificial Sequence
  Description of Artificial Sequence: Synthetic oligonucleotide
gactcaccacgctgtctctgaccatgag

SEQ ID NO: 367569 - DNA, 28 bp, Artificial Sequence
  Description of Artificial Sequence: Synthetic oligonucleotide
actcaccacgctgtctctgaccatgagg

SEQ ID NO: 367570 - DNA, 27 bp, Artificial Sequence
  Description of Artificial Sequence: Synthetic oligonucleotide
ctcaccacgctgtctctgaccatgagg

SEQ ID NO: 367571 - DNA, 27 bp, Artificial Sequence
  Description of Artificial Sequence: Synthetic oligonucleotide
tcaccacgctgtctctgaccatgaggc

SEQ ID NO: 367572 - DNA, 26 bp, Artificial Sequence
  Description of Artificial Sequence: Synthetic oligonucleotide
caccacgctgtctctgaccatgaggc

SEQ ID NO: 367573 - DNA, 27 bp, Artificial Sequence
  Description of Artificial Sequence: Synthetic oligonucleotide
accacgctgtctctgaccatgaggcca

SEQ ID NO: 367574 - DNA, 26 bp, Artificial Sequence
  Description of Artificial Sequence: Synthetic oligonucleotide
ccacgctgtctctgaccatgaggcca

SEQ ID NO: 367575 - DNA, 26 bp, Artificial Sequence
  Description of Artificial Sequence: Synthetic oligonucleotide
cacgctgtctctgaccatgaggccac

SEQ ID NO: 367576 - DNA, 26 bp, Artificial Sequence
  Description of Artificial Sequence: Synthetic oligonucleotide
acgctgtctctgaccatgaggccacc

SEQ ID NO: 367577 - DNA, 25 bp, Artificial Sequence
  Description of Artificial Sequence: Synthetic oligonucleotide
cgctgtctctgaccatgaggccacc

SEQ ID NO: 367578 - DNA, 26 bp, Artificial Sequence
  Description of Artificial Sequence: Synthetic oligonucleotide
gctgtctctgaccatgaggccaccct

SEQ ID NO: 367579 - DNA, 27 bp, Artificial Sequence
  Description of Artificial Sequence: Synthetic oligonucleotide
ctgtctctgaccatgaggccaccctga

SEQ ID NO: 367580 - DNA, 27 bp, Artificial Sequence
  Description of Artificial Sequence: Synthetic oligonucleotide
tgtctctgaccatgaggccaccctgag

SEQ ID NO: 367581 - DNA, 26 bp, Artificial Sequence
  Description of Artificial Sequence: Synthetic oligonucleotide
gtctctgaccatgaggccaccctgag

SEQ ID NO: 367582 - DNA, 23 bp, Artificial Sequence
  Description of Artificial Sequence: Synthetic oligonucleotide
gagaccaggcctgcaggggatgg

SEQ ID NO: 367583 - DNA, 24 bp, Artificial Sequence
  Description of Artificial Sequence: Synthetic oligonucleotide
agaccaggcctgcaggggatggga

SEQ ID NO: 367584 - DNA, 23 bp, Artificial Sequence
  Description of Artificial Sequence: Synthetic oligonucleotide
gaccaggcctgcaggggatggga

SEQ ID NO: 367585 - DNA, 23 bp, Artificial Sequence
  Description of Artificial Sequence: Synthetic oligonucleotide
accaggcctgcaggggatgggac

SEQ ID NO: 367586 - DNA, 22 bp, Artificial Sequence
  Description of Artificial Sequence: Synthetic oligonucleotide
ccaggcctgcaggggatgggac

SEQ ID NO: 367587 - DNA, 24 bp, Artificial Sequence
  Description of Artificial Sequence: Synthetic oligonucleotide
caggcctgcaggggatgggacctt

SEQ ID NO: 367588 - DNA, 24 bp, Artificial Sequence
  Description of Artificial Sequence: Synthetic oligonucleotide
aggcctgcaggggatgggaccttc

SEQ ID NO: 367589 - DNA, 23 bp, Artificial Sequence
  Description of Artificial Sequence: Synthetic oligonucleotide
ggcctgcaggggatgggaccttc

SEQ ID NO: 367590 - DNA, 24 bp, Artificial Sequence
  Description of Artificial Sequence: Synthetic oligonucleotide
gcctgcaggggatgggaccttcca

SEQ ID NO: 367591 - DNA, 26 bp, Artificial Sequence
  Description of Artificial Sequence: Synthetic oligonucleotide
cctgcaggggatgggaccttccagaa

SEQ ID NO: 367592 - DNA, 27 bp, Artificial Sequence
  Description of Artificial Sequence: Synthetic oligonucleotide
ctgcaggggatgggaccttccagaagt

SEQ ID NO: 367593 - DNA, 27 bp, Artificial Sequence
  Description of Artificial Sequence: Synthetic oligonucleotide
tgcaggggatgggaccttccagaagtg

SEQ ID NO: 367594 - DNA, 26 bp, Artificial Sequence
  Description of Artificial Sequence: Synthetic oligonucleotide
gcaggggatgggaccttccagaagtg

SEQ ID NO: 367595 - DNA, 26 bp, Artificial Sequence
  Description of Artificial Sequence: Synthetic oligonucleotide
caggggatgggaccttccagaagtgg

SEQ ID NO: 367596 - DNA, 26 bp, Artificial Sequence
  Description of Artificial Sequence: Synthetic oligonucleotide
aggggatgggaccttccagaagtggg

SEQ ID NO: 367597 - DNA, 25 bp, Artificial Sequence
  Description of Artificial Sequence: Synthetic oligonucleotide
ggggatgggaccttccagaagtggg

SEQ ID NO: 367598 - DNA, 25 bp, Artificial Sequence
  Description of Artificial Sequence: Synthetic oligonucleotide
gggatgggaccttccagaagtgggc

SEQ ID NO: 367599 - DNA, 26 bp, Artificial Sequence
  Description of Artificial Sequence: Synthetic oligonucleotide
ggatgggaccttccagaagtgggcgt

SEQ ID NO: 367600 - DNA, 27 bp, Artificial Sequence
  Description of Artificial Sequence: Synthetic oligonucleotide
gatgggaccttccagaagtgggcgtct

SEQ ID NO: 367601 - DNA, 27 bp, Artificial Sequence
  Description of Artificial Sequence: Synthetic oligonucleotide
atgggaccttccagaagtgggcgtctg

SEQ ID NO: 367602 - DNA, 27 bp, Artificial Sequence
  Description of Artificial Sequence: Synthetic oligonucleotide
tgggaccttccagaagtgggcgtctgt

SEQ ID NO: 367603 - DNA, 26 bp, Artificial Sequence
  Description of Artificial Sequence: Synthetic oligonucleotide
gggaccttccagaagtgggcgtctgt

SEQ ID NO: 367604 - DNA, 26 bp, Artificial Sequence
  Description of Artificial Sequence: Synthetic oligonucleotide
ggaccttccagaagtgggcgtctgtg

SEQ ID NO: 367605 - DNA, 27 bp, Artificial Sequence
  Description of Artificial Sequence: Synthetic oligonucleotide
gaccttccagaagtgggcgtctgtggt

SEQ ID NO: 367606 - DNA, 27 bp, Artificial Sequence
  Description of Artificial Sequence: Synthetic oligonucleotide
accttccagaagtgggcgtctgtggtg

SEQ ID NO: 367607 - DNA, 26 bp, Artificial Sequence
  Description of Artificial Sequence: Synthetic oligonucleotide
ccttccagaagtgggcgtctgtggtg

SEQ ID NO: 367608 - DNA, 27 bp, Artificial Sequence
  Description of Artificial Sequence: Synthetic oligonucleotide
cttccagaagtgggcgtctgtggtggt

SEQ ID NO: 367609 - DNA, 27 bp, Artificial Sequence
  Description of Artificial Sequence: Synthetic oligonucleotide
ttccagaagtgggcgtctgtggtggtg

SEQ ID NO: 367610 - DNA, 26 bp, Artificial Sequence
  Description of Artificial Sequence: Synthetic oligonucleotide
tccagaagtgggcgtctgtggtggtg

SEQ ID NO: 367611 - DNA, 25 bp, Artificial Sequence
  Description of Artificial Sequence: Synthetic oligonucleotide
ccagaagtgggcgtctgtggtggtg

SEQ ID NO: 367612 - DNA, 25 bp, Artificial Sequence
  Description of Artificial Sequence: Synthetic oligonucleotide
cagaagtgggcgtctgtggtggtgc

SEQ ID NO: 367613 - DNA, 27 bp, Artificial Sequence
  Description of Artificial Sequence: Synthetic oligonucleotide
agaagtgggcgtctgtggtggtgcctt

SEQ ID NO: 367614 - DNA, 26 bp, Artificial Sequence
  Description of Artificial Sequence: Synthetic oligonucleotide
gaagtgggcgtctgtggtggtgcctt

SEQ ID NO: 367615 - DNA, 27 bp, Artificial Sequence
  Description of Artificial Sequence: Synthetic oligonucleotide
aagtgggcgtctgtggtggtgccttct

SEQ ID NO: 367616 - DNA, 26 bp, Artificial Sequence
  Description of Artificial Sequence: Synthetic oligonucleotide
agtgggcgtctgtggtggtgccttct

SEQ ID NO: 367617 - DNA, 25 bp, Artificial Sequence
  Description of Artificial Sequence: Synthetic oligonucleotide
gtgggcgtctgtggtggtgccttct

SEQ ID NO: 367618 - DNA, 25 bp, Artificial Sequence
  Description of Artificial Sequence: Synthetic oligonucleotide
tgggcgtctgtggtggtgccttctg

SEQ ID NO: 367619 - DNA, 24 bp, Artificial Sequence
  Description of Artificial Sequence: Synthetic oligonucleotide
gggcgtctgtggtggtgccttctg

SEQ ID NO: 367620 - DNA, 25 bp, Artificial Sequence
  Description of Artificial Sequence: Synthetic oligonucleotide
ggcgtctgtggtggtgccttctgga

SEQ ID NO: 367621 - DNA, 26 bp, Artificial Sequence
  Description of Artificial Sequence: Synthetic oligonucleotide
gcgtctgtggtggtgccttctggaca

SEQ ID NO: 367622 - DNA, 26 bp, Artificial Sequence
  Description of Artificial Sequence: Synthetic oligonucleotide
cgtctgtggtggtgccttctggacag

SEQ ID NO: 367623 - DNA, 27 bp, Artificial Sequence
  Description of Artificial Sequence: Synthetic oligonucleotide
gtctgtggtggtgccttctggacagga

SEQ ID NO: 367624 - DNA, 27 bp, Artificial Sequence
  Description of Artificial Sequence: Synthetic oligonucleotide
tctgtggtggtgccttctggacaggag

SEQ ID NO: 367625 - DNA, 29 bp, Artificial Sequence
  Description of Artificial Sequence: Synthetic oligonucleotide
tggcctggttctctttggagctgtgatcg

SEQ ID NO: 367626 - DNA, 28 bp, Artificial Sequence
  Description of Artificial Sequence: Synthetic oligonucleotide
ggcctggttctctttggagctgtgatcg

SEQ ID NO: 367627 - DNA, 28 bp, Artificial Sequence
  Description of Artificial Sequence: Synthetic oligonucleotide
gcctggttctctttggagctgtgatcgc

SEQ ID NO: 367628 - DNA, 29 bp, Artificial Sequence
  Description of Artificial Sequence: Synthetic oligonucleotide
cctggttctctttggagctgtgatcgctg

SEQ ID NO: 367629 - DNA, 29 bp, Artificial Sequence
  Description of Artificial Sequence: Synthetic oligonucleotide
ctggttctctttggagctgtgatcgctgg

SEQ ID NO: 367630 - DNA, 30 bp, Artificial Sequence; identical to SEQ ID NO: 16700
  Description of Artificial Sequence: Synthetic oligonucleotide

SEQ ID NO: 367631 - DNA, 29 bp, Artificial Sequence
  Description of Artificial Sequence: Synthetic oligonucleotide
ggttctctttggagctgtgatcgctggag

SEQ ID NO: 367632 - DNA, 29 bp, Artificial Sequence
  Description of Artificial Sequence: Synthetic oligonucleotide
gttctctttggagctgtgatcgctggagc

SEQ ID NO: 367633 - DNA, 30 bp, Artificial Sequence; identical to SEQ ID NO: 16703
  Description of Artificial Sequence: Synthetic oligonucleotide

SEQ ID NO: 367634 - DNA, 29 bp, Artificial Sequence
  Description of Artificial Sequence: Synthetic oligonucleotide
tctctttggagctgtgatcgctggagctg

SEQ ID NO: 367635 - DNA, 28 bp, Artificial Sequence
  Description of Artificial Sequence: Synthetic oligonucleotide
ctctttggagctgtgatcgctggagctg

SEQ ID NO: 367636 - DNA, 29 bp, Artificial Sequence
  Description of Artificial Sequence: Synthetic oligonucleotide
tctttggagctgtgatcgctggagctgtg

SEQ ID NO: 367637 - DNA, 28 bp, Artificial Sequence
  Description of Artificial Sequence: Synthetic oligonucleotide
ctttggagctgtgatcgctggagctgtg

SEQ ID NO: 367638 - DNA, 28 bp, Artificial Sequence
  Description of Artificial Sequence: Synthetic oligonucleotide
tttggagctgtgatcgctggagctgtgg

SEQ ID NO: 367639 - DNA, 27 bp, Artificial Sequence
  Description of Artificial Sequence: Synthetic oligonucleotide
ttggagctgtgatcgctggagctgtgg

SEQ ID NO: 367640 - DNA, 27 bp, Artificial Sequence
  Description of Artificial Sequence: Synthetic oligonucleotide
tggagctgtgatcgctggagctgtggt

SEQ ID NO: 367641 - DNA, 26 bp, Artificial Sequence
  Description of Artificial Sequence: Synthetic oligonucleotide
ggagctgtgatcgctggagctgtggt

SEQ ID NO: 367642 - DNA, 26 bp, Artificial Sequence
  Description of Artificial Sequence: Synthetic oligonucleotide
gagctgtgatcgctggagctgtggtc

SEQ ID NO: 367643 - DNA, 26 bp, Artificial Sequence
  Description of Artificial Sequence: Synthetic oligonucleotide
agctgtgatcgctggagctgtggtcg

SEQ ID NO: 367644 - DNA, 25 bp, Artificial Sequence
  Description of Artificial Sequence: Synthetic oligonucleotide
gctgtgatcgctggagctgtggtcg

SEQ ID NO: 367645 - DNA, 26 bp, Artificial Sequence
  Description of Artificial Sequence: Synthetic oligonucleotide
ctgtgatcgctggagctgtggtcgct

SEQ ID NO: 367646 - DNA, 26 bp, Artificial Sequence
  Description of Artificial Sequence: Synthetic oligonucleotide
tgtgatcgctggagctgtggtcgctg

SEQ ID NO: 367647 - DNA, 25 bp, Artificial Sequence
  Description of Artificial Sequence: Synthetic oligonucleotide
gtgatcgctggagctgtggtcgctg

SEQ ID NO: 367648 - DNA, 26 bp, Artificial Sequence
  Description of Artificial Sequence: Synthetic oligonucleotide
tgatcgctggagctgtggtcgctgct

SEQ ID NO: 367649 - DNA, 25 bp, Artificial Sequence
  Description of Artificial Sequence: Synthetic oligonucleotide
gatcgctggagctgtggtcgctgct

SEQ ID NO: 367650 - DNA, 26 bp, Artificial Sequence
  Description of Artificial Sequence: Synthetic oligonucleotide
atcgctggagctgtggtcgctgctgt

SEQ ID NO: 367651 - DNA, 25 bp, Artificial Sequence
  Description of Artificial Sequence: Synthetic oligonucleotide
tcgctggagctgtggtcgctgctgt

SEQ ID NO: 367652 - DNA, 24 bp, Artificial Sequence
  Description of Artificial Sequence: Synthetic oligonucleotide
cgctggagctgtggtcgctgctgt

SEQ ID NO: 367653 - DNA, 26 bp, Artificial Sequence
  Description of Artificial Sequence: Synthetic oligonucleotide
gctggagctgtggtcgctgctgtgat

SEQ ID NO: 367654 - DNA, 27 bp, Artificial Sequence
  Description of Artificial Sequence: Synthetic oligonucleotide
gcagtgacagtgcccagggctctgata

SEQ ID NO: 367655 - DNA, 28 bp, Artificial Sequence
  Description of Artificial Sequence: Synthetic oligonucleotide
cagtgacagtgcccagggctctgatatg

SEQ ID NO: 367656 - DNA, 29 bp, Artificial Sequence
  Description of Artificial Sequence: Synthetic oligonucleotide
agtgacagtgcccagggctctgatatgtc

SEQ ID NO: 367657 - DNA, 28 bp, Artificial Sequence
  Description of Artificial Sequence: Synthetic oligonucleotide
gtgacagtgcccagggctctgatatgtc

SEQ ID NO: 367658 - DNA, 29 bp, Artificial Sequence
  Description of Artificial Sequence: Synthetic oligonucleotide
tgacagtgcccagggctctgatatgtctc

SEQ ID NO: 367659 - DNA, 28 bp, Artificial Sequence
  Description of Artificial Sequence: Synthetic oligonucleotide
gacagtgcccagggctctgatatgtctc

SEQ ID NO: 367660 - DNA, 29 bp, Artificial Sequence
  Description of Artificial Sequence: Synthetic oligonucleotide
acagtgcccagggctctgatatgtctctc

SEQ ID NO: 367661 - DNA, 28 bp, Artificial Sequence
  Description of Artificial Sequence: Synthetic oligonucleotide
cagtgcccagggctctgatatgtctctc

SEQ ID NO: 367662 - DNA, 29 bp, Artificial Sequence
  Description of Artificial Sequence: Synthetic oligonucleotide
agtgcccagggctctgatatgtctctcac

SEQ ID NO: 367663 - DNA, 28 bp, Artificial Sequence
  Description of Artificial Sequence: Synthetic oligonucleotide
gtgcccagggctctgatatgtctctcac

SEQ ID NO: 367664 - DNA, 29 bp, Artificial Sequence
  Description of Artificial Sequence: Synthetic oligonucleotide
tgcccagggctctgatatgtctctcacag

SEQ ID NO: 367665 - DNA, 28 bp, Artificial Sequence
  Description of Artificial Sequence: Synthetic oligonucleotide
gcccagggctctgatatgtctctcacag

SEQ ID NO: 367666 - DNA, 28 bp, Artificial Sequence
  Description of Artificial Sequence: Synthetic oligonucleotide
cccagggctctgatatgtctctcacagc

SEQ ID NO: 367667 - DNA, 30 bp, Artificial Sequence; identical to SEQ ID NO: 9906
  Description of Artificial Sequence: Synthetic oligonucleotide

SEQ ID NO: 367668 - DNA, 34 bp, Artificial Sequence; identical to SEQ ID NO: 9907
  Description of Artificial Sequence: Synthetic oligonucleotide

SEQ ID NO: 367669 - DNA, 35 bp, Artificial Sequence; identical to SEQ ID NO: 9908
  Description of Artificial Sequence: Synthetic oligonucleotide

SEQ ID NO: 367670 - DNA, 34 bp, Artificial Sequence; identical to SEQ ID NO: 9909
  Description of Artificial Sequence: Synthetic oligonucleotide

SEQ ID NO: 367671 - DNA, 35 bp, Artificial Sequence; identical to SEQ ID NO: 9910
  Description of Artificial Sequence: Synthetic oligonucleotide

SEQ ID NO: 367672 - DNA, 26 bp, Artificial Sequence
  Description of Artificial Sequence: Synthetic oligonucleotide
tgaaggcccactcacagactgaccgg

SEQ ID NO: 367673 - DNA, 25 bp, Artificial Sequence
  Description of Artificial Sequence: Synthetic oligonucleotide
gaaggcccactcacagactgaccgg

SEQ ID NO: 367674 - DNA, 26 bp, Artificial Sequence
  Description of Artificial Sequence: Synthetic oligonucleotide
aaggcccactcacagactgaccggga

SEQ ID NO: 367675 - DNA, 25 bp, Artificial Sequence
  Description of Artificial Sequence: Synthetic oligonucleotide
aggcccactcacagactgaccggga

SEQ ID NO: 367676 - DNA, 24 bp, Artificial Sequence
  Description of Artificial Sequence: Synthetic oligonucleotide
ggcccactcacagactgaccggga

SEQ ID NO: 367677 - DNA, 25 bp, Artificial Sequence
  Description of Artificial Sequence: Synthetic oligonucleotide
gcccactcacagactgaccgggaga

SEQ ID NO: 367678 - DNA, 25 bp, Artificial Sequence
  Description of Artificial Sequence: Synthetic oligonucleotide
cccactcacagactgaccgggagag

SEQ ID NO: 367679 - DNA, 25 bp, Artificial Sequence
  Description of Artificial Sequence: Synthetic oligonucleotide
ccactcacagactgaccgggagagc

SEQ ID NO: 367680 - DNA, 26 bp, Artificial Sequence
  Description of Artificial Sequence: Synthetic oligonucleotide
cactcacagactgaccgggagagcct

SEQ ID NO: 367681 - DNA, 26 bp, Artificial Sequence
  Description of Artificial Sequence: Synthetic oligonucleotide
actcacagactgaccgggagagcctg

SEQ ID NO: 367682 - DNA, 25 bp, Artificial Sequence
  Description of Artificial Sequence: Synthetic oligonucleotide
ctcacagactgaccgggagagcctg

SEQ ID NO: 367683 - DNA, 25 bp, Artificial Sequence
  Description of Artificial Sequence: Synthetic oligonucleotide
tcacagactgaccgggagagcctgc

SEQ ID NO: 367684 - DNA, 24 bp, Artificial Sequence
  Description of Artificial Sequence: Synthetic oligonucleotide
cacagactgaccgggagagcctgc

SEQ ID NO: 367685 - DNA, 24 bp, Artificial Sequence
  Description of Artificial Sequence: Synthetic oligonucleotide
acagactgaccgggagagcctgcg

SEQ ID NO: 367686 - DNA, 23 bp, Artificial Sequence
  Description of Artificial Sequence: Synthetic oligonucleotide
cagactgaccgggagagcctgcg

SEQ ID NO: 367687 - DNA, 25 bp, Artificial Sequence
  Description of Artificial Sequence: Synthetic oligonucleotide
agactgaccgggagagcctgcggat

SEQ ID NO: 367688 - DNA, 24 bp, Artificial Sequence
  Description of Artificial Sequence: Synthetic oligonucleotide
gactgaccgggagagcctgcggat

SEQ ID NO: 367689 - DNA, 24 bp, Artificial Sequence
  Description of Artificial Sequence: Synthetic oligonucleotide
actgaccgggagagcctgcggatc

SEQ ID NO: 367690 - DNA, 23 bp, Artificial Sequence
  Description of Artificial Sequence: Synthetic oligonucleotide
ctgaccgggagagcctgcggatc

SEQ ID NO: 367691 - DNA, 23 bp, Artificial Sequence
  Description of Artificial Sequence: Synthetic oligonucleotide
tgaccgggagagcctgcggatcg

SEQ ID NO: 367692 - DNA, 22 bp, Artificial Sequence
  Description of Artificial Sequence: Synthetic oligonucleotide
gaccgggagagcctgcggatcg

SEQ ID NO: 367693 - DNA, 22 bp, Artificial Sequence
  Description of Artificial Sequence: Synthetic oligonucleotide
accgggagagcctgcggatcgc

SEQ ID NO: 367694 - DNA, 21 bp, Artificial Sequence
  Description of Artificial Sequence: Synthetic oligonucleotide
ccgggagagcctgcggatcgc

SEQ ID NO: 367695 - DNA, 21 bp, Artificial Sequence
  Description of Artificial Sequence: Synthetic oligonucleotide
cgggagagcctgcggatcgcg

SEQ ID NO: 367696 - DNA, 22 bp, Artificial Sequence
  Description of Artificial Sequence: Synthetic oligonucleotide
gggagagcctgcggatcgcgct

SEQ ID NO: 367697 - DNA, 22 bp, Artificial Sequence
  Description of Artificial Sequence: Synthetic oligonucleotide
ggagagcctgcggatcgcgctc

SEQ ID NO: 367698 - DNA, 29 bp, Artificial Sequence
  Description of Artificial Sequence: Synthetic oligonucleotide
cagatacctggagaacgggaaggagactc

SEQ ID NO: 367699 - DNA, 30 bp, Artificial Sequence
  Description of Artificial Sequence: Synthetic oligonucleotide
agatacctggagaacgggaaggagactctg

SEQ ID NO: 367700 - DNA, 29 bp, Artificial Sequence
  Description of Artificial Sequence: Synthetic oligonucleotide
gatacctggagaacgggaaggagactctg

SEQ ID NO: 367701 - DNA, 29 bp, Artificial Sequence
  Description of Artificial Sequence: Synthetic oligonucleotide
atacctggagaacgggaaggagactctgc

SEQ ID NO: 367702 - DNA, 28 bp, Artificial Sequence
  Description of Artificial Sequence: Synthetic oligonucleotide
tacctggagaacgggaaggagactctgc

SEQ ID NO: 367703 - DNA, 27 bp, Artificial Sequence
  Description of Artificial Sequence: Synthetic oligonucleotide
acctggagaacgggaaggagactctgc

SEQ ID NO: 367704 - DNA, 27 bp, Artificial Sequence
  Description of Artificial Sequence: Synthetic oligonucleotide
cctggagaacgggaaggagactctgca

SEQ ID NO: 367705 - DNA, 27 bp, Artificial Sequence
  Description of Artificial Sequence: Synthetic oligonucleotide
ctggagaacgggaaggagactctgcag

SEQ ID NO: 367706 - DNA, 27 bp, Artificial Sequence
  Description of Artificial Sequence: Synthetic oligonucleotide
tggagaacgggaaggagactctgcagc

SEQ ID NO: 367707 - DNA, 26 bp, Artificial Sequence
  Description of Artificial Sequence: Synthetic oligonucleotide
ggagaacgggaaggagactctgcagc

SEQ ID NO: 367708 - DNA, 26 bp, Artificial Sequence
  Description of Artificial Sequence: Synthetic oligonucleotide
gagaacgggaaggagactctgcagcg

SEQ ID NO: 367709 - DNA, 27 bp, Artificial Sequence
  Description of Artificial Sequence: Synthetic oligonucleotide
agaacgggaaggagactctgcagcgca

SEQ ID NO: 367710 - DNA, 26 bp, Artificial Sequence
  Description of Artificial Sequence: Synthetic oligonucleotide
gaacgggaaggagactctgcagcgca

SEQ ID NO: 367711 - DNA, 26 bp, Artificial Sequence
  Description of Artificial Sequence: Synthetic oligonucleotide
aacgggaaggagactctgcagcgcac

SEQ ID NO: 367712 - DNA, 25 bp, Artificial Sequence
  Description of Artificial Sequence: Synthetic oligonucleotide
acgggaaggagactctgcagcgcac

SEQ ID NO: 367713 - DNA, 24 bp, Artificial Sequence
  Description of Artificial Sequence: Synthetic oligonucleotide
cgggaaggagactctgcagcgcac

SEQ ID NO: 367714 - DNA, 24 bp, Artificial Sequence
  Description of Artificial Sequence: Synthetic oligonucleotide
gggaaggagactctgcagcgcacg

SEQ ID NO: 367715 - DNA, 24 bp, Artificial Sequence
  Description of Artificial Sequence: Synthetic oligonucleotide
ggaaggagactctgcagcgcacgg

SEQ ID NO: 367716 - DNA, 32 bp, Artificial Sequence
  Description of Artificial Sequence: Synthetic oligonucleotide
ctcccactccatgaggtatttctacacctctg

SEQ ID NO: 367717 - DNA, 33 bp, Artificial Sequence
  Description of Artificial Sequence: Synthetic oligonucleotide
tcccactccatgaggtatttctacacctctgtg

SEQ ID NO: 367718 - DNA, 32 bp, Artificial Sequence
  Description of Artificial Sequence: Synthetic oligonucleotide
cccactccatgaggtatttctacacctctgtg

SEQ ID NO: 367719 - DNA, 33 bp, Artificial Sequence
  Description of Artificial Sequence: Synthetic oligonucleotide
ccactccatgaggtatttctacacctctgtgtc

SEQ ID NO: 367720 - DNA, 33 bp, Artificial Sequence
  Description of Artificial Sequence: Synthetic oligonucleotide
cactccatgaggtatttctacacctctgtgtcc

SEQ ID NO: 367721 - DNA, 33 bp, Artificial Sequence
  Description of Artificial Sequence: Synthetic oligonucleotide
actccatgaggtatttctacacctctgtgtccc

SEQ ID NO: 367722 - DNA, 32 bp, Artificial Sequence
  Description of Artificial Sequence: Synthetic oligonucleotide
ctccatgaggtatttctacacctctgtgtccc

SEQ ID NO: 367723 - DNA, 32 bp, Artificial Sequence
  Description of Artificial Sequence: Synthetic oligonucleotide
tccatgaggtatttctacacctctgtgtcccg

SEQ ID NO: 367724 - DNA, 31 bp, Artificial Sequence
  Description of Artificial Sequence: Synthetic oligonucleotide
ccatgaggtatttctacacctctgtgtcccg

SEQ ID NO: 367725 - DNA, 31 bp, Artificial Sequence
  Description of Artificial Sequence: Synthetic oligonucleotide
catgaggtatttctacacctctgtgtcccgg

SEQ ID NO: 367726 - DNA, 31 bp, Artificial Sequence
  Description of Artificial Sequence: Synthetic oligonucleotide
atgaggtatttctacacctctgtgtcccggc

SEQ ID NO: 367727 - DNA, 30 bp, Artificial Sequence
  Description of Artificial Sequence: Synthetic oligonucleotide
tgaggtatttctacacctctgtgtcccggc

SEQ ID NO: 367728 - DNA, 29 bp, Artificial Sequence
  Description of Artificial Sequence: Synthetic oligonucleotide
gaggtatttctacacctctgtgtcccggc

SEQ ID NO: 367729 - DNA, 29 bp, Artificial Sequence
  Description of Artificial Sequence: Synthetic oligonucleotide
aggtatttctacacctctgtgtcccggcc

SEQ ID NO: 367730 - DNA, 28 bp, Artificial Sequence
  Description of Artificial Sequence: Synthetic oligonucleotide
ggtatttctacacctctgtgtcccggcc

SEQ ID NO: 367731 - DNA, 28 bp, Artificial Sequence
  Description of Artificial Sequence: Synthetic oligonucleotide
gtatttctacacctctgtgtcccggccc

SEQ ID NO: 367732 - DNA, 28 bp, Artificial Sequence
  Description of Artificial Sequence: Synthetic oligonucleotide
tatttctacacctctgtgtcccggcccg

SEQ ID NO: 367733 - DNA, 27 bp, Artificial Sequence
  Description of Artificial Sequence: Synthetic oligonucleotide
atttctacacctctgtgtcccggcccg

SEQ ID NO: 367734 - DNA, 26 bp, Artificial Sequence
  Description of Artificial Sequence: Synthetic oligonucleotide
tttctacacctctgtgtcccggcccg

SEQ ID NO: 367735 - DNA, 25 bp, Artificial Sequence
  Description of Artificial Sequence: Synthetic oligonucleotide
ttctacacctctgtgtcccggcccg

SEQ ID NO: 367736 - DNA, 24 bp, Artificial Sequence
  Description of Artificial Sequence: Synthetic oligonucleotide
tctacacctctgtgtcccggcccg

SEQ ID NO: 367737 - DNA, 23 bp, Artificial Sequence
  Description of Artificial Sequence: Synthetic oligonucleotide
ctacacctctgtgtcccggcccg

SEQ ID NO: 367738 - DNA, 23 bp, Artificial Sequence
  Description of Artificial Sequence: Synthetic oligonucleotide
tacacctctgtgtcccggcccgg

SEQ ID NO: 367739 - DNA, 22 bp, Artificial Sequence
  Description of Artificial Sequence: Synthetic oligonucleotide
acacctctgtgtcccggcccgg

SEQ ID NO: 367740 - DNA, 21 bp, Artificial Sequence
  Description of Artificial Sequence: Synthetic oligonucleotide
cacctctgtgtcccggcccgg

SEQ ID NO: 367741 - DNA, 21 bp, Artificial Sequence
  Description of Artificial Sequence: Synthetic oligonucleotide
acctctgtgtcccggcccggc

SEQ ID NO: 367742 - DNA, 20 bp, Artificial Sequence
  Description of Artificial Sequence: Synthetic oligonucleotide
cctctgtgtcccggcccggc

SEQ ID NO: 367743 - DNA, 20 bp, Artificial Sequence
  Description of Artificial Sequence: Synthetic oligonucleotide
ctctgtgtcccggcccggcc

SEQ ID NO: 367744 - DNA, 26 bp, Artificial Sequence
  Description of Artificial Sequence: Synthetic oligonucleotide
ggcccagtcacagactgaccgagaga

SEQ ID NO: 367745 - DNA, 26 bp, Artificial Sequence
  Description of Artificial Sequence: Synthetic oligonucleotide
gcccagtcacagactgaccgagagag

SEQ ID NO: 367746 - DNA, 26 bp, Artificial Sequence
  Description of Artificial Sequence: Synthetic oligonucleotide
cccagtcacagactgaccgagagagc

SEQ ID NO: 367747 - DNA, 27 bp, Artificial Sequence
  Description of Artificial Sequence: Synthetic oligonucleotide
ccagtcacagactgaccgagagagcct

SEQ ID NO: 367748 - DNA, 27 bp, Artificial Sequence
  Description of Artificial Sequence: Synthetic oligonucleotide
cagtcacagactgaccgagagagcctg

SEQ ID NO: 367749 - DNA, 27 bp, Artificial Sequence
  Description of Artificial Sequence: Synthetic oligonucleotide
agtcacagactgaccgagagagcctgc

SEQ ID NO: 367750 - DNA, 26 bp, Artificial Sequence
  Description of Artificial Sequence: Synthetic oligonucleotide
gtcacagactgaccgagagagcctgc

SEQ ID NO: 367751 - DNA, 26 bp, Artificial Sequence
  Description of Artificial Sequence: Synthetic oligonucleotide
ggtctcaggccccgaaggcggtatat

SEQ ID NO: 367752 - DNA, 26 bp, Artificial Sequence
  Description of Artificial Sequence: Synthetic oligonucleotide
gtctcaggccccgaaggcggtatatg

SEQ ID NO: 367753 - DNA, 27 bp, Artificial Sequence
  Description of Artificial Sequence: Synthetic oligonucleotide
tctcaggccccgaaggcggtatatgga

SEQ ID NO: 367754 - DNA, 27 bp, Artificial Sequence
  Description of Artificial Sequence: Synthetic oligonucleotide
ctcaggccccgaaggcggtatatggat

SEQ ID NO: 367755 - DNA, 28 bp, Artificial Sequence
  Description of Artificial Sequence: Synthetic oligonucleotide
tcaggccccgaaggcggtatatggattg

SEQ ID NO: 367756 - DNA, 27 bp, Artificial Sequence
  Description of Artificial Sequence: Synthetic oligonucleotide
caggccccgaaggcggtatatggattg

SEQ ID NO: 367757 - DNA, 27 bp, Artificial Sequence
  Description of Artificial Sequence: Synthetic oligonucleotide
aggccccgaaggcggtatatggattgg

SEQ ID NO: 367758 - DNA, 26 bp, Artificial Sequence
  Description of Artificial Sequence: Synthetic oligonucleotide
ggccccgaaggcggtatatggattgg

SEQ ID NO: 367759 - DNA, 26 bp, Artificial Sequence
  Description of Artificial Sequence: Synthetic oligonucleotide
gccccgaaggcggtatatggattggg

SEQ ID NO: 367760 - DNA, 27 bp, Artificial Sequence
  Description of Artificial Sequence: Synthetic oligonucleotide
ccccgaaggcggtatatggattgggga

SEQ ID NO: 367761 - DNA, 27 bp, Artificial Sequence
  Description of Artificial Sequence: Synthetic oligonucleotide
cccgaaggcggtatatggattggggag

SEQ ID NO: 367762 - DNA, 28 bp, Artificial Sequence
  Description of Artificial Sequence: Synthetic oligonucleotide
ccgaaggcggtatatggattggggagtc

SEQ ID NO: 367763 - DNA, 28 bp, Artificial Sequence
  Description of Artificial Sequence: Synthetic oligonucleotide
cgaaggcggtatatggattggggagtcc

SEQ ID NO: 367764 - DNA, 28 bp, Artificial Sequence
  Description of Artificial Sequence: Synthetic oligonucleotide
gaaggcggtatatggattggggagtccc

SEQ ID NO: 367765 - DNA, 29 bp, Artificial Sequence
  Description of Artificial Sequence: Synthetic oligonucleotide
aaggcggtatatggattggggagtcccag

SEQ ID NO: 367766 - DNA, 28 bp, Artificial Sequence
  Description of Artificial Sequence: Synthetic oligonucleotide
aggcggtatatggattggggagtcccag

SEQ ID NO: 367767 - DNA, 27 bp, Artificial Sequence
  Description of Artificial Sequence: Synthetic oligonucleotide
ggcggtatatggattggggagtcccag

SEQ ID NO: 367768 - DNA, 27 bp, Artificial Sequence
  Description of Artificial Sequence: Synthetic oligonucleotide
gcggtatatggattggggagtcccagc

SEQ ID NO: 367769 - DNA, 27 bp, Artificial Sequence
  Description of Artificial Sequence: Synthetic oligonucleotide
cggtatatggattggggagtcccagcc

SEQ ID NO: 367770 - DNA, 29 bp, Artificial Sequence
  Description of Artificial Sequence: Synthetic oligonucleotide
ggtatatggattggggagtcccagccttg

SEQ ID NO: 367771 - DNA, 29 bp, Artificial Sequence
  Description of Artificial Sequence: Synthetic oligonucleotide
gtatatggattggggagtcccagccttgg

SEQ ID NO: 367772 - DNA, 29 bp, Artificial Sequence
  Description of Artificial Sequence: Synthetic oligonucleotide
tatatggattggggagtcccagccttggg

SEQ ID NO: 367773 - DNA, 28 bp, Artificial Sequence
  Description of Artificial Sequence: Synthetic oligonucleotide
atatggattggggagtcccagccttggg

SEQ ID NO: 367774 - DNA, 25 bp, Artificial Sequence
  Description of Artificial Sequence: Synthetic oligonucleotide
aaggcccactcacagactgaccgcg

SEQ ID NO: 367775 - DNA, 24 bp, Artificial Sequence
  Description of Artificial Sequence: Synthetic oligonucleotide
aggcccactcacagactgaccgcg

SEQ ID NO: 367776 - DNA, 23 bp, Artificial Sequence
  Description of Artificial Sequence: Synthetic oligonucleotide
ggcccactcacagactgaccgcg

SEQ ID NO: 367777 - DNA, 23 bp, Artificial Sequence
  Description of Artificial Sequence: Synthetic oligonucleotide
gcccactcacagactgaccgcgc

SEQ ID NO: 367778 - DNA, 25 bp, Artificial Sequence
  Description of Artificial Sequence: Synthetic oligonucleotide
cccactcacagactgaccgcgcgaa

SEQ ID NO: 367779 - DNA, 25 bp, Artificial Sequence
  Description of Artificial Sequence: Synthetic oligonucleotide
ccactcacagactgaccgcgcgaac

SEQ ID NO: 367780 - DNA, 26 bp, Artificial Sequence
  Description of Artificial Sequence: Synthetic oligonucleotide
cactcacagactgaccgcgcgaacct

SEQ ID NO: 367781 - DNA, 26 bp, Artificial Sequence
  Description of Artificial Sequence: Synthetic oligonucleotide
actcacagactgaccgcgcgaacctg

SEQ ID NO: 367782 - DNA, 25 bp, Artificial Sequence
  Description of Artificial Sequence: Synthetic oligonucleotide
ctcacagactgaccgcgcgaacctg

SEQ ID NO: 367783 - DNA, 25 bp, Artificial Sequence
  Description of Artificial Sequence: Synthetic oligonucleotide
tcacagactgaccgcgcgaacctgg

SEQ ID NO: 367784 - DNA, 24 bp, Artificial Sequence
  Description of Artificial Sequence: Synthetic oligonucleotide
cacagactgaccgcgcgaacctgg

SEQ ID NO: 367785 - DNA, 24 bp, Artificial Sequence
  Description of Artificial Sequence: Synthetic oligonucleotide
acagactgaccgcgcgaacctggg

SEQ ID NO: 367786 - DNA, 23 bp, Artificial Sequence
  Description of Artificial Sequence: Synthetic oligonucleotide
cagactgaccgcgcgaacctggg

SEQ ID NO: 367787 - DNA, 24 bp, Artificial Sequence
  Description of Artificial Sequence: Synthetic oligonucleotide
agactgaccgcgcgaacctgggga

SEQ ID NO: 367788 - DNA, 23 bp, Artificial Sequence
  Description of Artificial Sequence: Synthetic oligonucleotide
gactgaccgcgcgaacctgggga

SEQ ID NO: 367789 - DNA, 23 bp, Artificial Sequence
  Description of Artificial Sequence: Synthetic oligonucleotide
actgaccgcgcgaacctggggac

SEQ ID NO: 367790 - DNA, 22 bp, Artificial Sequence
  Description of Artificial Sequence: Synthetic oligonucleotide
ctgaccgcgcgaacctggggac

SEQ ID NO: 367791 - DNA, 22 bp, Artificial Sequence
  Description of Artificial Sequence: Synthetic oligonucleotide
tgaccgcgcgaacctggggacc

SEQ ID NO: 367792 - DNA, 21 bp, Artificial Sequence
  Description of Artificial Sequence: Synthetic oligonucleotide
gaccgcgcgaacctggggacc

SEQ ID NO: 367793 - DNA, 22 bp, Artificial Sequence
  Description of Artificial Sequence: Synthetic oligonucleotide
accgcgcgaacctggggaccct

SEQ ID NO: 367794 - DNA, 21 bp, Artificial Sequence
  Description of Artificial Sequence: Synthetic oligonucleotide
ccgcgcgaacctggggaccct

SEQ ID NO: 367795 - DNA, 21 bp, Artificial Sequence
  Description of Artificial Sequence: Synthetic oligonucleotide
cgcgcgaacctggggaccctg

SEQ ID NO: 367796 - DNA, 21 bp, Artificial Sequence
  Description of Artificial Sequence: Synthetic oligonucleotide
gcgcgaacctggggaccctgc

SEQ ID NO: 367797 - DNA, 21 bp, Artificial Sequence
  Description of Artificial Sequence: Synthetic oligonucleotide
cgcgaacctggggaccctgcg

SEQ ID NO: 367798 - DNA, 23 bp, Artificial Sequence
  Description of Artificial Sequence: Synthetic oligonucleotide
ctgcagcgcactgacgcccccaa

SEQ ID NO: 367799 - DNA, 24 bp, Artificial Sequence
  Description of Artificial Sequence: Synthetic oligonucleotide
tgcagcgcactgacgcccccaaga

SEQ ID NO: 367800 - DNA, 23 bp, Artificial Sequence
  Description of Artificial Sequence: Synthetic oligonucleotide
gcagcgcactgacgcccccaaga

SEQ ID NO: 367801 - DNA, 23 bp, Artificial Sequence
  Description of Artificial Sequence: Synthetic oligonucleotide
cagcgcactgacgcccccaagac

SEQ ID NO: 367802 - DNA, 23 bp, Artificial Sequence
  Description of Artificial Sequence: Synthetic oligonucleotide
agcgcactgacgcccccaagacg

SEQ ID NO: 367803 - DNA, 22 bp, Artificial Sequence
  Description of Artificial Sequence: Synthetic oligonucleotide
gcgcactgacgcccccaagacg

SEQ ID NO: 367804 - DNA, 26 bp, Artificial Sequence
  Description of Artificial Sequence: Synthetic oligonucleotide
cgcactgacgcccccaagacgcatat

SEQ ID NO: 367805 - DNA, 27 bp, Artificial Sequence
  Description of Artificial Sequence: Synthetic oligonucleotide
gcactgacgcccccaagacgcatatga

SEQ ID NO: 367806 - DNA, 27 bp, Artificial Sequence
  Description of Artificial Sequence: Synthetic oligonucleotide
cactgacgcccccaagacgcatatgac

SEQ ID NO: 367807 - DNA, 28 bp, Artificial Sequence
  Description of Artificial Sequence: Synthetic oligonucleotide
actgacgcccccaagacgcatatgactc

SEQ ID NO: 367808 - DNA, 27 bp, Artificial Sequence
  Description of Artificial Sequence: Synthetic oligonucleotide
ctgacgcccccaagacgcatatgactc

SEQ ID NO: 367809 - DNA, 28 bp, Artificial Sequence
  Description of Artificial Sequence: Synthetic oligonucleotide
tgacgcccccaagacgcatatgactcac

SEQ ID NO: 367810 - DNA, 27 bp, Artificial Sequence
  Description of Artificial Sequence: Synthetic oligonucleotide
ctgcgcggctactacaaccagagcgaa

SEQ ID NO: 367811 - DNA, 27 bp, Artificial Sequence
  Description of Artificial Sequence: Synthetic oligonucleotide
tgcgcggctactacaaccagagcgaag

SEQ ID NO: 367812 - DNA, 27 bp, Artificial Sequence
  Description of Artificial Sequence: Synthetic oligonucleotide
gcgcggctactacaaccagagcgaaga

SEQ ID NO: 367813 - DNA, 27 bp, Artificial Sequence
  Description of Artificial Sequence: Synthetic oligonucleotide
cgcggctactacaaccagagcgaagac

SEQ ID NO: 367814 - DNA, 27 bp, Artificial Sequence
  Description of Artificial Sequence: Synthetic oligonucleotide
gcggctactacaaccagagcgaagacg

SEQ ID NO: 367815 - DNA, 27 bp, Artificial Sequence
  Description of Artificial Sequence: Synthetic oligonucleotide
cggctactacaaccagagcgaagacgg

SEQ ID NO: 367816 - DNA, 29 bp, Artificial Sequence
  Description of Artificial Sequence: Synthetic oligonucleotide
ggctactacaaccagagcgaagacggttc

SEQ ID NO: 367817 - DNA, 30 bp, Artificial Sequence; identical to SEQ ID NO: 16917
  Description of Artificial Sequence: Synthetic oligonucleotide

SEQ ID NO: 367818 - DNA, 31 bp, Artificial Sequence; identical to SEQ ID NO: 16918
  Description of Artificial Sequence: Synthetic oligonucleotide

SEQ ID NO: 367819 - DNA, 32 bp, Artificial Sequence; identical to SEQ ID NO: 16919
  Description of Artificial Sequence: Synthetic oligonucleotide

SEQ ID NO: 367820 - DNA, 31 bp, Artificial Sequence; identical to SEQ ID NO: 16920
  Description of Artificial Sequence: Synthetic oligonucleotide

SEQ ID NO: 367821 - DNA, 30 bp, Artificial Sequence; identical to SEQ ID NO: 16921
  Description of Artificial Sequence: Synthetic oligonucleotide

SEQ ID NO: 367822 - DNA, 30 bp, Artificial Sequence; identical to SEQ ID NO: 16922
  Description of Artificial Sequence: Synthetic oligonucleotide

SEQ ID NO: 367823 - DNA, 29 bp, Artificial Sequence
  Description of Artificial Sequence: Synthetic oligonucleotide
acaaccagagcgaagacggttctcacacc

SEQ ID NO: 367824 - DNA, 28 bp, Artificial Sequence
  Description of Artificial Sequence: Synthetic oligonucleotide
caaccagagcgaagacggttctcacacc

SEQ ID NO: 367825 - DNA, 30 bp, Artificial Sequence; identical to SEQ ID NO: 16925
  Description of Artificial Sequence: Synthetic oligonucleotide

SEQ ID NO: 367826 - DNA, 29 bp, Artificial Sequence
  Description of Artificial Sequence: Synthetic oligonucleotide
accagagcgaagacggttctcacaccatc

SEQ ID NO: 367827 - DNA, 28 bp, Artificial Sequence
  Description of Artificial Sequence: Synthetic oligonucleotide
ccagagcgaagacggttctcacaccatc

SEQ ID NO: 367828 - DNA, 28 bp, Artificial Sequence
  Description of Artificial Sequence: Synthetic oligonucleotide
cagagcgaagacggttctcacaccatcc

SEQ ID NO: 367829 - DNA, 29 bp, Artificial Sequence
  Description of Artificial Sequence: Synthetic oligonucleotide
agagcgaagacggttctcacaccatccag

SEQ ID NO: 367830 - DNA, 28 bp, Artificial Sequence
  Description of Artificial Sequence: Synthetic oligonucleotide
gagcgaagacggttctcacaccatccag

SEQ ID NO: 367831 - DNA, 29 bp, Artificial Sequence
  Description of Artificial Sequence: Synthetic oligonucleotide
agcgaagacggttctcacaccatccagag

SEQ ID NO: 367832 - DNA, 28 bp, Artificial Sequence
  Description of Artificial Sequence: Synthetic oligonucleotide
gcgaagacggttctcacaccatccagag

SEQ ID NO: 367833 - DNA, 28 bp, Artificial Sequence
  Description of Artificial Sequence: Synthetic oligonucleotide
cgaagacggttctcacaccatccagagg

SEQ ID NO: 367834 - DNA, 30 bp, Artificial Sequence; identical to SEQ ID NO: 16934
  Description of Artificial Sequence: Synthetic oligonucleotide

SEQ ID NO: 367835 - DNA, 33 bp, Artificial Sequence; identical to SEQ ID NO: 16935
  Description of Artificial Sequence: Synthetic oligonucleotide

SEQ ID NO: 367836 - DNA, 32 bp, Artificial Sequence; identical to SEQ ID NO: 16936
  Description of Artificial Sequence: Synthetic oligonucleotide

SEQ ID NO: 367837 - DNA, 23 bp, Artificial Sequence
  Description of Artificial Sequence: Synthetic oligonucleotide
gcccatgaggcggagcagtggag

SEQ ID NO: 367838 - DNA, 23 bp, Artificial Sequence
  Description of Artificial Sequence: Synthetic oligonucleotide
cccatgaggcggagcagtggagg

SEQ ID NO: 367839 - DNA, 23 bp, Artificial Sequence
  Description of Artificial Sequence: Synthetic oligonucleotide
ccatgaggcggagcagtggaggg

SEQ ID NO: 367840 - DNA, 23 bp, Artificial Sequence
  Description of Artificial Sequence: Synthetic oligonucleotide
catgaggcggagcagtggagggc

SEQ ID NO: 367841 - DNA, 25 bp, Artificial Sequence
  Description of Artificial Sequence: Synthetic oligonucleotide
atgaggcggagcagtggagggccta

SEQ ID NO: 367842 - DNA, 24 bp, Artificial Sequence
  Description of Artificial Sequence: Synthetic oligonucleotide
tgaggcggagcagtggagggccta

SEQ ID NO: 367843 - DNA, 23 bp, Artificial Sequence
  Description of Artificial Sequence: Synthetic oligonucleotide
gaggcggagcagtggagggccta

SEQ ID NO: 367844 - DNA, 23 bp, Artificial Sequence
  Description of Artificial Sequence: Synthetic oligonucleotide
aggcggagcagtggagggcctac

SEQ ID NO: 367845 - DNA, 22 bp, Artificial Sequence
  Description of Artificial Sequence: Synthetic oligonucleotide
ggcggagcagtggagggcctac

SEQ ID NO: 367846 - DNA, 23 bp, Artificial Sequence
  Description of Artificial Sequence: Synthetic oligonucleotide
gcggagcagtggagggcctacct

SEQ ID NO: 367847 - DNA, 23 bp, Artificial Sequence
  Description of Artificial Sequence: Synthetic oligonucleotide
cggagcagtggagggcctacctg

SEQ ID NO: 367848 - DNA, 24 bp, Artificial Sequence
  Description of Artificial Sequence: Synthetic oligonucleotide
ggagcagtggagggcctacctgga

SEQ ID NO: 367849 - DNA, 24 bp, Artificial Sequence
  Description of Artificial Sequence: Synthetic oligonucleotide
gagcagtggagggcctacctggag

SEQ ID NO: 367850 - DNA, 24 bp, Artificial Sequence
  Description of Artificial Sequence: Synthetic oligonucleotide
agcagtggagggcctacctggagg

SEQ ID NO: 367851 - DNA, 23 bp, Artificial Sequence
  Description of Artificial Sequence: Synthetic oligonucleotide
gcagtggagggcctacctggagg

SEQ ID NO: 367852 - DNA, 23 bp, Artificial Sequence
  Description of Artificial Sequence: Synthetic oligonucleotide
cagtggagggcctacctggaggg

SEQ ID NO: 367853 - DNA, 23 bp, Artificial Sequence
  Description of Artificial Sequence: Synthetic oligonucleotide
agtggagggcctacctggagggc

SEQ ID NO: 367854 - DNA, 22 bp, Artificial Sequence
  Description of Artificial Sequence: Synthetic oligonucleotide
gtggagggcctacctggagggc

SEQ ID NO: 367855 - DNA, 22 bp, Artificial Sequence
  Description of Artificial Sequence: Synthetic oligonucleotide
tggagggcctacctggagggcc

SEQ ID NO: 367856 - DNA, 21 bp, Artificial Sequence
  Description of Artificial Sequence: Synthetic oligonucleotide
ggagggcctacctggagggcc

SEQ ID NO: 367857 - DNA, 21 bp, Artificial Sequence
  Description of Artificial Sequence: Synthetic oligonucleotide
gagggcctacctggagggccg

SEQ ID NO: 367858 - DNA, 22 bp, Artificial Sequence
  Description of Artificial Sequence: Synthetic oligonucleotide
agggcctacctggagggccggt

SEQ ID NO: 367859 - DNA, 21 bp, Artificial Sequence
  Description of Artificial Sequence: Synthetic oligonucleotide
gggcctacctggagggccggt

SEQ ID NO: 367860 - DNA, 21 bp, Artificial Sequence
  Description of Artificial Sequence: Synthetic oligonucleotide
ggcctacctggagggccggtg

SEQ ID NO: 367861 - DNA, 27 bp, Artificial Sequence
  Description of Artificial Sequence: Synthetic oligonucleotide
atgaggcggagcagtggagagcctact

SEQ ID NO: 367862 - DNA, 27 bp, Artificial Sequence
  Description of Artificial Sequence: Synthetic oligonucleotide
tgaggcggagcagtggagagcctactt

SEQ ID NO: 367863 - DNA, 26 bp, Artificial Sequence
  Description of Artificial Sequence: Synthetic oligonucleotide
gaggcggagcagtggagagcctactt

SEQ ID NO: 367864 - DNA, 26 bp, Artificial Sequence
  Description of Artificial Sequence: Synthetic oligonucleotide
aggcggagcagtggagagcctacttg

SEQ ID NO: 367865 - DNA, 25 bp, Artificial Sequence
  Description of Artificial Sequence: Synthetic oligonucleotide
ggcggagcagtggagagcctacttg

SEQ ID NO: 367866 - DNA, 26 bp, Artificial Sequence
  Description of Artificial Sequence: Synthetic oligonucleotide
gcggagcagtggagagcctacttgga

SEQ ID NO: 367867 - DNA, 26 bp, Artificial Sequence
  Description of Artificial Sequence: Synthetic oligonucleotide
cggagcagtggagagcctacttggag

SEQ ID NO: 367868 - DNA, 26 bp, Artificial Sequence
  Description of Artificial Sequence: Synthetic oligonucleotide
ggagcagtggagagcctacttggagg

SEQ ID NO: 367869 - DNA, 26 bp, Artificial Sequence
  Description of Artificial Sequence: Synthetic oligonucleotide
gagcagtggagagcctacttggaggg

SEQ ID NO: 367870 - DNA, 26 bp, Artificial Sequence
  Description of Artificial Sequence: Synthetic oligonucleotide
agcagtggagagcctacttggagggc

SEQ ID NO: 367871 - DNA, 25 bp, Artificial Sequence
  Description of Artificial Sequence: Synthetic oligonucleotide
gcagtggagagcctacttggagggc

SEQ ID NO: 367872 - DNA, 25 bp, Artificial Sequence
  Description of Artificial Sequence: Synthetic oligonucleotide
cagtggagagcctacttggagggcc

SEQ ID NO: 367873 - DNA, 25 bp, Artificial Sequence
  Description of Artificial Sequence: Synthetic oligonucleotide
agtggagagcctacttggagggccg

SEQ ID NO: 367874 - DNA, 24 bp, Artificial Sequence
  Description of Artificial Sequence: Synthetic oligonucleotide
gtggagagcctacttggagggccg

SEQ ID NO: 367875 - DNA, 25 bp, Artificial Sequence
  Description of Artificial Sequence: Synthetic oligonucleotide
tggagagcctacttggagggccggt

SEQ ID NO: 367876 - DNA, 24 bp, Artificial Sequence
  Description of Artificial Sequence: Synthetic oligonucleotide
ggagagcctacttggagggccggt

SEQ ID NO: 367877 - DNA, 24 bp, Artificial Sequence
  Description of Artificial Sequence: Synthetic oligonucleotide
gagagcctacttggagggccggtg

SEQ ID NO: 367878 - DNA, 24 bp, Artificial Sequence
  Description of Artificial Sequence: Synthetic oligonucleotide
agagcctacttggagggccggtgc

SEQ ID NO: 367879 - DNA, 23 bp, Artificial Sequence
  Description of Artificial Sequence: Synthetic oligonucleotide
gagcctacttggagggccggtgc

SEQ ID NO: 367880 - DNA, 24 bp, Artificial Sequence
  Description of Artificial Sequence: Synthetic oligonucleotide
agcctacttggagggccggtgcgt

SEQ ID NO: 367881 - DNA, 23 bp, Artificial Sequence
  Description of Artificial Sequence: Synthetic oligonucleotide
gcctacttggagggccggtgcgt

SEQ ID NO: 367882 - DNA, 23 bp, Artificial Sequence
  Description of Artificial Sequence: Synthetic oligonucleotide
cctacttggagggccggtgcgtg

SEQ ID NO: 367883 - DNA, 24 bp, Artificial Sequence
  Description of Artificial Sequence: Synthetic oligonucleotide
ctacttggagggccggtgcgtgga

SEQ ID NO: 367884 - DNA, 25 bp, Artificial Sequence
  Description of Artificial Sequence: Synthetic oligonucleotide
tacttggagggccggtgcgtggagt

SEQ ID NO: 367885 - DNA, 24 bp, Artificial Sequence
  Description of Artificial Sequence: Synthetic oligonucleotide
acttggagggccggtgcgtggagt

SEQ ID NO: 367886 - DNA, 23 bp, Artificial Sequence
  Description of Artificial Sequence: Synthetic oligonucleotide
cttggagggccggtgcgtggagt

SEQ ID NO: 367887 - DNA, 23 bp, Artificial Sequence
  Description of Artificial Sequence: Synthetic oligonucleotide
ttggagggccggtgcgtggagtg

SEQ ID NO: 367888 - DNA, 28 bp, Artificial Sequence
  Description of Artificial Sequence: Synthetic oligonucleotide
gcccccaagacgcatatgactcaccatg

SEQ ID NO: 367889 - DNA, 28 bp, Artificial Sequence
  Description of Artificial Sequence: Synthetic oligonucleotide
cccccaagacgcatatgactcaccatgc

SEQ ID NO: 367890 - DNA, 29 bp, Artificial Sequence
  Description of Artificial Sequence: Synthetic oligonucleotide
ccccaagacgcatatgactcaccatgctg

SEQ ID NO: 367891 - DNA, 30 bp, Artificial Sequence; identical to SEQ ID NO: 16991
  Description of Artificial Sequence: Synthetic oligonucleotide

SEQ ID NO: 367892 - DNA, 31 bp, Artificial Sequence; identical to SEQ ID NO: 16992
  Description of Artificial Sequence: Synthetic oligonucleotide

SEQ ID NO: 367893 - DNA, 32 bp, Artificial Sequence; identical to SEQ ID NO: 16993
  Description of Artificial Sequence: Synthetic oligonucleotide

SEQ ID NO: 367894 - DNA, 33 bp, Artificial Sequence; identical to SEQ ID NO: 16994
  Description of Artificial Sequence: Synthetic oligonucleotide

SEQ ID NO: 367895 - DNA, 32 bp, Artificial Sequence; identical to SEQ ID NO: 16995
  Description of Artificial Sequence: Synthetic oligonucleotide

SEQ ID NO: 367896 - DNA, 31 bp, Artificial Sequence; identical to SEQ ID NO: 16996
  Description of Artificial Sequence: Synthetic oligonucleotide

SEQ ID NO: 367897 - DNA, 31 bp, Artificial Sequence; identical to SEQ ID NO: 16997
  Description of Artificial Sequence: Synthetic oligonucleotide

SEQ ID NO: 367898 - DNA, 30 bp, Artificial Sequence; identical to SEQ ID NO: 16998
  Description of Artificial Sequence: Synthetic oligonucleotide

SEQ ID NO: 367899 - DNA, 32 bp, Artificial Sequence; identical to SEQ ID NO: 16999
  Description of Artificial Sequence: Synthetic oligonucleotide

SEQ ID NO: 367900 - DNA, 33 bp, Artificial Sequence; identical to SEQ ID NO: 17000
  Description of Artificial Sequence: Synthetic oligonucleotide

SEQ ID NO: 367901 - DNA, 33 bp, Artificial Sequence; identical to SEQ ID NO: 17001
  Description of Artificial Sequence: Synthetic oligonucleotide

SEQ ID NO: 367902 - DNA, 32 bp, Artificial Sequence; identical to SEQ ID NO: 17002
  Description of Artificial Sequence: Synthetic oligonucleotide

SEQ ID NO: 367903 - DNA, 31 bp, Artificial Sequence; identical to SEQ ID NO: 17003
  Description of Artificial Sequence: Synthetic oligonucleotide

SEQ ID NO: 367904 - DNA, 30 bp, Artificial Sequence; identical to SEQ ID NO: 17004
  Description of Artificial Sequence: Synthetic oligonucleotide

SEQ ID NO: 367905 - DNA, 29 bp, Artificial Sequence
  Description of Artificial Sequence: Synthetic oligonucleotide
gactcaccatgctgtctctgaccatgagg

SEQ ID NO: 367906 - DNA, 29 bp, Artificial Sequence
  Description of Artificial Sequence: Synthetic oligonucleotide
actcaccatgctgtctctgaccatgaggc

SEQ ID NO: 367907 - DNA, 28 bp, Artificial Sequence
  Description of Artificial Sequence: Synthetic oligonucleotide
ctcaccatgctgtctctgaccatgaggc

SEQ ID NO: 367908 - DNA, 28 bp, Artificial Sequence
  Description of Artificial Sequence: Synthetic oligonucleotide
tcaccatgctgtctctgaccatgaggcc

SEQ ID NO: 367909 - DNA, 27 bp, Artificial Sequence
  Description of Artificial Sequence: Synthetic oligonucleotide
caccatgctgtctctgaccatgaggcc

SEQ ID NO: 367910 - DNA, 28 bp, Artificial Sequence
  Description of Artificial Sequence: Synthetic oligonucleotide
accatgctgtctctgaccatgaggccac

SEQ ID NO: 367911 - DNA, 27 bp, Artificial Sequence
  Description of Artificial Sequence: Synthetic oligonucleotide
ccatgctgtctctgaccatgaggccac

SEQ ID NO: 367912 - DNA, 27 bp, Artificial Sequence
  Description of Artificial Sequence: Synthetic oligonucleotide
catgctgtctctgaccatgaggccacc

SEQ ID NO: 367913 - DNA, 27 bp, Artificial Sequence
  Description of Artificial Sequence: Synthetic oligonucleotide
atgctgtctctgaccatgaggccaccc

SEQ ID NO: 367914 - DNA, 27 bp, Artificial Sequence
  Description of Artificial Sequence: Synthetic oligonucleotide
tgctgtctctgaccatgaggccaccct

SEQ ID NO: 367915 - DNA, 27 bp, Artificial Sequence
  Description of Artificial Sequence: Synthetic oligonucleotide
accctgcgcggctactacaaccagagt

SEQ ID NO: 367916 - DNA, 26 bp, Artificial Sequence
  Description of Artificial Sequence: Synthetic oligonucleotide
ccctgcgcggctactacaaccagagt

SEQ ID NO: 367917 - DNA, 27 bp, Artificial Sequence
  Description of Artificial Sequence: Synthetic oligonucleotide
cctgcgcggctactacaaccagagtga

SEQ ID NO: 367918 - DNA, 27 bp, Artificial Sequence
  Description of Artificial Sequence: Synthetic oligonucleotide
ctgcgcggctactacaaccagagtgag

SEQ ID NO: 367919 - DNA, 27 bp, Artificial Sequence
  Description of Artificial Sequence: Synthetic oligonucleotide
tgcgcggctactacaaccagagtgagg

SEQ ID NO: 367920 - DNA, 27 bp, Artificial Sequence
  Description of Artificial Sequence: Synthetic oligonucleotide
gcgcggctactacaaccagagtgagga

SEQ ID NO: 367921 - DNA, 27 bp, Artificial Sequence
  Description of Artificial Sequence: Synthetic oligonucleotide
cgcggctactacaaccagagtgaggac

SEQ ID NO: 367922 - DNA, 27 bp, Artificial Sequence
  Description of Artificial Sequence: Synthetic oligonucleotide
gcggctactacaaccagagtgaggacg

SEQ ID NO: 367923 - DNA, 27 bp, Artificial Sequence
  Description of Artificial Sequence: Synthetic oligonucleotide
cggctactacaaccagagtgaggacgg

SEQ ID NO: 367924 - DNA, 29 bp, Artificial Sequence
  Description of Artificial Sequence: Synthetic oligonucleotide
ggctactacaaccagagtgaggacggttc

SEQ ID NO: 367925 - DNA, 30 bp, Artificial Sequence; identical to SEQ ID NO: 17025
  Description of Artificial Sequence: Synthetic oligonucleotide

SEQ ID NO: 367926 - DNA, 31 bp, Artificial Sequence; identical to SEQ ID NO: 17026
  Description of Artificial Sequence: Synthetic oligonucleotide

SEQ ID NO: 367927 - DNA, 32 bp, Artificial Sequence; identical to SEQ ID NO: 17027
  Description of Artificial Sequence: Synthetic oligonucleotide

SEQ ID NO: 367928 - DNA, 31 bp, Artificial Sequence; identical to SEQ ID NO: 17028
  Description of Artificial Sequence: Synthetic oligonucleotide

SEQ ID NO: 367929 - DNA, 30 bp, Artificial Sequence; identical to SEQ ID NO: 17029
  Description of Artificial Sequence: Synthetic oligonucleotide

SEQ ID NO: 367930 - DNA, 30 bp, Artificial Sequence; identical to SEQ ID NO: 17030
  Description of Artificial Sequence: Synthetic oligonucleotide

SEQ ID NO: 367931 - DNA, 29 bp, Artificial Sequence
  Description of Artificial Sequence: Synthetic oligonucleotide
acaaccagagtgaggacggttctcacacc

SEQ ID NO: 367932 - DNA, 28 bp, Artificial Sequence
  Description of Artificial Sequence: Synthetic oligonucleotide
caaccagagtgaggacggttctcacacc

SEQ ID NO: 367933 - DNA, 30 bp, Artificial Sequence; identical to SEQ ID NO: 17033
  Description of Artificial Sequence: Synthetic oligonucleotide

SEQ ID NO: 367934 - DNA, 29 bp, Artificial Sequence
  Description of Artificial Sequence: Synthetic oligonucleotide
accagagtgaggacggttctcacaccatc

SEQ ID NO: 367935 - DNA, 28 bp, Artificial Sequence
  Description of Artificial Sequence: Synthetic oligonucleotide
ccagagtgaggacggttctcacaccatc

SEQ ID NO: 367936 - DNA, 28 bp, Artificial Sequence
  Description of Artificial Sequence: Synthetic oligonucleotide
cagagtgaggacggttctcacaccatcc

SEQ ID NO: 367937 - DNA, 29 bp, Artificial Sequence
  Description of Artificial Sequence: Synthetic oligonucleotide
agagtgaggacggttctcacaccatccag

SEQ ID NO: 367938 - DNA, 28 bp, Artificial Sequence
  Description of Artificial Sequence: Synthetic oligonucleotide
gagtgaggacggttctcacaccatccag

SEQ ID NO: 367939 - DNA, 29 bp, Artificial Sequence
  Description of Artificial Sequence: Synthetic oligonucleotide
agtgaggacggttctcacaccatccagag

SEQ ID NO: 367940 - DNA, 28 bp, Artificial Sequence
  Description of Artificial Sequence: Synthetic oligonucleotide
gtgaggacggttctcacaccatccagag

SEQ ID NO: 367941 - DNA, 28 bp, Artificial Sequence
  Description of Artificial Sequence: Synthetic oligonucleotide
tgaggacggttctcacaccatccagagg

SEQ ID NO: 367942 - DNA, 28 bp, Artificial Sequence
  Description of Artificial Sequence: Synthetic oligonucleotide
tatttctacacctccgtgtcccggcctg

SEQ ID NO: 367943 - DNA, 27 bp, Artificial Sequence
  Description of Artificial Sequence: Synthetic oligonucleotide
atttctacacctccgtgtcccggcctg

SEQ ID NO: 367944 - DNA, 26 bp, Artificial Sequence
  Description of Artificial Sequence: Synthetic oligonucleotide
tttctacacctccgtgtcccggcctg

SEQ ID NO: 367945 - DNA, 25 bp, Artificial Sequence
  Description of Artificial Sequence: Synthetic oligonucleotide
ttctacacctccgtgtcccggcctg

SEQ ID NO: 367946 - DNA, 24 bp, Artificial Sequence
  Description of Artificial Sequence: Synthetic oligonucleotide
tctacacctccgtgtcccggcctg

SEQ ID NO: 367947 - DNA, 23 bp, Artificial Sequence
  Description of Artificial Sequence: Synthetic oligonucleotide
ctacacctccgtgtcccggcctg

SEQ ID NO: 367948 - DNA, 23 bp, Artificial Sequence
  Description of Artificial Sequence: Synthetic oligonucleotide
tacacctccgtgtcccggcctgg

SEQ ID NO: 367949 - DNA, 22 bp, Artificial Sequence
  Description of Artificial Sequence: Synthetic oligonucleotide
acacctccgtgtcccggcctgg

SEQ ID NO: 367950 - DNA, 21 bp, Artificial Sequence
  Description of Artificial Sequence: Synthetic oligonucleotide
cacctccgtgtcccggcctgg

SEQ ID NO: 367951 - DNA, 21 bp, Artificial Sequence
  Description of Artificial Sequence: Synthetic oligonucleotide
acctccgtgtcccggcctggc

SEQ ID NO: 367952 - DNA, 20 bp, Artificial Sequence
  Description of Artificial Sequence: Synthetic oligonucleotide
cctccgtgtcccggcctggc

SEQ ID NO: 367953 - DNA, 20 bp, Artificial Sequence
  Description of Artificial Sequence: Synthetic oligonucleotide
ctccgtgtcccggcctggcc

SEQ ID NO: 367954 - DNA, 32 bp, Artificial Sequence; identical to SEQ ID NO: 17054
  Description of Artificial Sequence: Synthetic oligonucleotide

SEQ ID NO: 367955 - DNA, 31 bp, Artificial Sequence; identical to SEQ ID NO: 17055
  Description of Artificial Sequence: Synthetic oligonucleotide

SEQ ID NO: 367956 - DNA, 30 bp, Artificial Sequence; identical to SEQ ID NO: 17056
  Description of Artificial Sequence: Synthetic oligonucleotide

SEQ ID NO: 367957 - DNA, 31 bp, Artificial Sequence; identical to SEQ ID NO: 17057
  Description of Artificial Sequence: Synthetic oligonucleotide

SEQ ID NO: 367958 - DNA, 30 bp, Artificial Sequence; identical to SEQ ID NO: 17058
  Description of Artificial Sequence: Synthetic oligonucleotide

SEQ ID NO: 367959 - DNA, 31 bp, Artificial Sequence; identical to SEQ ID NO: 17059
  Description of Artificial Sequence: Synthetic oligonucleotide

SEQ ID NO: 367960 - DNA, 30 bp, Artificial Sequence; identical to SEQ ID NO: 17060
  Description of Artificial Sequence: Synthetic oligonucleotide

SEQ ID NO: 367961 - DNA, 30 bp, Artificial Sequence; identical to SEQ ID NO: 17061
  Description of Artificial Sequence: Synthetic oligonucleotide

SEQ ID NO: 367962 - DNA, 30 bp, Artificial Sequence; identical to SEQ ID NO: 17062
  Description of Artificial Sequence: Synthetic oligonucleotide

SEQ ID NO: 367963 - DNA, 31 bp, Artificial Sequence; identical to SEQ ID NO: 17063
  Description of Artificial Sequence: Synthetic oligonucleotide

SEQ ID NO: 367964 - DNA, 30 bp, Artificial Sequence; identical to SEQ ID NO: 17064
  Description of Artificial Sequence: Synthetic oligonucleotide

SEQ ID NO: 367965 - DNA, 29 bp, Artificial Sequence
  Description of Artificial Sequence: Synthetic oligonucleotide
tgtgaaggcccactcacaaactgaccgag

SEQ ID NO: 367966 - DNA, 28 bp, Artificial Sequence
  Description of Artificial Sequence: Synthetic oligonucleotide
gtgaaggcccactcacaaactgaccgag

SEQ ID NO: 367967 - DNA, 28 bp, Artificial Sequence
  Description of Artificial Sequence: Synthetic oligonucleotide
tgaaggcccactcacaaactgaccgagc

SEQ ID NO: 367968 - DNA, 27 bp, Artificial Sequence
  Description of Artificial Sequence: Synthetic oligonucleotide
gaaggcccactcacaaactgaccgagc

SEQ ID NO: 367969 - DNA, 27 bp, Artificial Sequence
  Description of Artificial Sequence: Synthetic oligonucleotide
aaggcccactcacaaactgaccgagcg

SEQ ID NO: 367970 - DNA, 27 bp, Artificial Sequence
  Description of Artificial Sequence: Synthetic oligonucleotide
aggcccactcacaaactgaccgagcga

SEQ ID NO: 367971 - DNA, 27 bp, Artificial Sequence
  Description of Artificial Sequence: Synthetic oligonucleotide
ggcccactcacaaactgaccgagcgaa

SEQ ID NO: 367972 - DNA, 27 bp, Artificial Sequence
  Description of Artificial Sequence: Synthetic oligonucleotide
gcccactcacaaactgaccgagcgaac

SEQ ID NO: 367973 - DNA, 27 bp, Artificial Sequence
  Description of Artificial Sequence: Synthetic oligonucleotide
cccactcacaaactgaccgagcgaacc

SEQ ID NO: 367974 - DNA, 28 bp, Artificial Sequence
  Description of Artificial Sequence: Synthetic oligonucleotide
ccactcacaaactgaccgagcgaacctg

SEQ ID NO: 367975 - DNA, 28 bp, Artificial Sequence
  Description of Artificial Sequence: Synthetic oligonucleotide
cactcacaaactgaccgagcgaacctgg

SEQ ID NO: 367976 - DNA, 28 bp, Artificial Sequence
  Description of Artificial Sequence: Synthetic oligonucleotide
actcacaaactgaccgagcgaacctggg

SEQ ID NO: 367977 - DNA, 27 bp, Artificial Sequence
  Description of Artificial Sequence: Synthetic oligonucleotide
ctcacaaactgaccgagcgaacctggg

SEQ ID NO: 367978 - DNA, 27 bp, Artificial Sequence
  Description of Artificial Sequence: Synthetic oligonucleotide
tcacaaactgaccgagcgaacctgggg

SEQ ID NO: 367979 - DNA, 27 bp, Artificial Sequence
  Description of Artificial Sequence: Synthetic oligonucleotide
cacaaactgaccgagcgaacctgggga

SEQ ID NO: 367980 - DNA, 27 bp, Artificial Sequence
  Description of Artificial Sequence: Synthetic oligonucleotide
acaaactgaccgagcgaacctggggac

SEQ ID NO: 367981 - DNA, 26 bp, Artificial Sequence
  Description of Artificial Sequence: Synthetic oligonucleotide
caaactgaccgagcgaacctggggac

SEQ ID NO: 367982 - DNA, 26 bp, Artificial Sequence
  Description of Artificial Sequence: Synthetic oligonucleotide
aaactgaccgagcgaacctggggacc

SEQ ID NO: 367983 - DNA, 25 bp, Artificial Sequence
  Description of Artificial Sequence: Synthetic oligonucleotide
aactgaccgagcgaacctggggacc

SEQ ID NO: 367984 - DNA, 24 bp, Artificial Sequence
  Description of Artificial Sequence: Synthetic oligonucleotide
gcggacatggcggctcagatcacg

SEQ ID NO: 367985 - DNA, 25 bp, Artificial Sequence
  Description of Artificial Sequence: Synthetic oligonucleotide
cggacatggcggctcagatcacgca

SEQ ID NO: 367986 - DNA, 25 bp, Artificial Sequence
  Description of Artificial Sequence: Synthetic oligonucleotide
ggacatggcggctcagatcacgcag

SEQ ID NO: 367987 - DNA, 25 bp, Artificial Sequence
  Description of Artificial Sequence: Synthetic oligonucleotide
gacatggcggctcagatcacgcagc

SEQ ID NO: 367988 - DNA, 25 bp, Artificial Sequence
  Description of Artificial Sequence: Synthetic oligonucleotide
acatggcggctcagatcacgcagcg

SEQ ID NO: 367989 - DNA, 24 bp, Artificial Sequence
  Description of Artificial Sequence: Synthetic oligonucleotide
catggcggctcagatcacgcagcg

SEQ ID NO: 367990 - DNA, 26 bp, Artificial Sequence
  Description of Artificial Sequence: Synthetic oligonucleotide
atggcggctcagatcacgcagcgcaa

SEQ ID NO: 367991 - DNA, 25 bp, Artificial Sequence
  Description of Artificial Sequence: Synthetic oligonucleotide
tggcggctcagatcacgcagcgcaa

SEQ ID NO: 367992 - DNA, 24 bp, Artificial Sequence
  Description of Artificial Sequence: Synthetic oligonucleotide
ggcggctcagatcacgcagcgcaa

SEQ ID NO: 367993 - DNA, 25 bp, Artificial Sequence
  Description of Artificial Sequence: Synthetic oligonucleotide
gcggctcagatcacgcagcgcaagt

SEQ ID NO: 367994 - DNA, 25 bp, Artificial Sequence
  Description of Artificial Sequence: Synthetic oligonucleotide
cggctcagatcacgcagcgcaagtg

SEQ ID NO: 367995 - DNA, 25 bp, Artificial Sequence
  Description of Artificial Sequence: Synthetic oligonucleotide
ggctcagatcacgcagcgcaagtgg

SEQ ID NO: 367996 - DNA, 26 bp, Artificial Sequence
  Description of Artificial Sequence: Synthetic oligonucleotide
gctcagatcacgcagcgcaagtggga

SEQ ID NO: 367997 - DNA, 27 bp, Artificial Sequence
  Description of Artificial Sequence: Synthetic oligonucleotide
ctcagatcacgcagcgcaagtgggaga

SEQ ID NO: 367998 - DNA, 27 bp, Artificial Sequence
  Description of Artificial Sequence: Synthetic oligonucleotide
tcagatcacgcagcgcaagtgggagac

SEQ ID NO: 367999 - DNA, 26 bp, Artificial Sequence
  Description of Artificial Sequence: Synthetic oligonucleotide
cagatcacgcagcgcaagtgggagac

SEQ ID NO: 368000 - DNA, 26 bp, Artificial Sequence
  Description of Artificial Sequence: Synthetic oligonucleotide
agatcacgcagcgcaagtgggagacg

SEQ ID NO: 368001 - DNA, 25 bp, Artificial Sequence
  Description of Artificial Sequence: Synthetic oligonucleotide
gatcacgcagcgcaagtgggagacg

SEQ ID NO: 368002 - DNA, 25 bp, Artificial Sequence
  Description of Artificial Sequence: Synthetic oligonucleotide
atcacgcagcgcaagtgggagacgg

SEQ ID NO: 368003 - DNA, 24 bp, Artificial Sequence
  Description of Artificial Sequence: Synthetic oligonucleotide
tcacgcagcgcaagtgggagacgg

SEQ ID NO: 368004 - DNA, 23 bp, Artificial Sequence
  Description of Artificial Sequence: Synthetic oligonucleotide
cacgcagcgcaagtgggagacgg

SEQ ID NO: 368005 - DNA, 23 bp, Artificial Sequence
  Description of Artificial Sequence: Synthetic oligonucleotide
acgcagcgcaagtgggagacggc

SEQ ID NO: 368006 - DNA, 22 bp, Artificial Sequence
  Description of Artificial Sequence: Synthetic oligonucleotide
cgcagcgcaagtgggagacggc

SEQ ID NO: 368007 - DNA, 22 bp, Artificial Sequence
  Description of Artificial Sequence: Synthetic oligonucleotide
gcagcgcaagtgggagacggcc

SEQ ID NO: 368008 - DNA, 22 bp, Artificial Sequence
  Description of Artificial Sequence: Synthetic oligonucleotide
ccagcgcaagtgggagacggcg

SEQ ID NO: 368009 - DNA, 24 bp, Artificial Sequence
  Description of Artificial Sequence: Synthetic oligonucleotide
cagcgcaagtgggagacggcgcat

SEQ ID NO: 368010 - DNA, 25 bp, Artificial Sequence
  Description of Artificial Sequence: Synthetic oligonucleotide
agcgcaagtgggagacggcgcatga

SEQ ID NO: 368011 - DNA, 24 bp, Artificial Sequence
  Description of Artificial Sequence: Synthetic oligonucleotide
gcgcaagtgggagacggcgcatga

SEQ ID NO: 368012 - DNA, 24 bp, Artificial Sequence
  Description of Artificial Sequence: Synthetic oligonucleotide
cgcaagtgggagacggcgcatgag

SEQ ID NO: 368013 - DNA, 24 bp, Artificial Sequence
  Description of Artificial Sequence: Synthetic oligonucleotide
gcaagtgggagacggcgcatgagg

SEQ ID NO: 368014 - DNA, 24 bp, Artificial Sequence
  Description of Artificial Sequence: Synthetic oligonucleotide
caagtgggagacggcgcatgaggc

SEQ ID NO: 368015 - DNA, 24 bp, Artificial Sequence
  Description of Artificial Sequence: Synthetic oligonucleotide
aagtgggagacggcgcatgaggcg

SEQ ID NO: 368016 - DNA, 23 bp, Artificial Sequence
  Description of Artificial Sequence: Synthetic oligonucleotide
agtgggagacggcgcatgaggcg

SEQ ID NO: 368017 - DNA, 22 bp, Artificial Sequence
  Description of Artificial Sequence: Synthetic oligonucleotide
gtgggagacggcgcatgaggcg

SEQ ID NO: 368018 - DNA, 23 bp, Artificial Sequence
  Description of Artificial Sequence: Synthetic oligonucleotide
tgggagacggcgcatgaggcgga

SEQ ID NO: 368019 - DNA, 22 bp, Artificial Sequence
  Description of Artificial Sequence: Synthetic oligonucleotide
gggagacggcgcatgaggcgga

SEQ ID NO: 368020 - DNA, 22 bp, Artificial Sequence
  Description of Artificial Sequence: Synthetic oligonucleotide
ggagacggcgcatgaggcggag

SEQ ID NO: 368021 - DNA, 23 bp, Artificial Sequence
  Description of Artificial Sequence: Synthetic oligonucleotide
gagacggcgcatgaggcggagca

SEQ ID NO: 368022 - DNA, 24 bp, Artificial Sequence
  Description of Artificial Sequence: Synthetic oligonucleotide
agacggcgcatgaggcggagcagt

SEQ ID NO: 368023 - DNA, 23 bp, Artificial Sequence
  Description of Artificial Sequence: Synthetic oligonucleotide
gacggcgcatgaggcggagcagt

SEQ ID NO: 368024 - DNA, 23 bp, Artificial Sequence
  Description of Artificial Sequence: Synthetic oligonucleotide
acggcgcatgaggcggagcagtg

SEQ ID NO: 368025 - DNA, 22 bp, Artificial Sequence
  Description of Artificial Sequence: Synthetic oligonucleotide
cggcgcatgaggcggagcagtg

SEQ ID NO: 368026 - DNA, 23 bp, Artificial Sequence
  Description of Artificial Sequence: Synthetic oligonucleotide
ggcgcatgaggcggagcagtgga

SEQ ID NO: 368027 - DNA, 24 bp, Artificial Sequence
  Description of Artificial Sequence: Synthetic oligonucleotide
gcgcatgaggcggagcagtggaga

SEQ ID NO: 368028 - DNA, 24 bp, Artificial Sequence
  Description of Artificial Sequence: Synthetic oligonucleotide
cgcatgaggcggagcagtggagag

SEQ ID NO: 368029 - DNA, 24 bp, Artificial Sequence
  Description of Artificial Sequence: Synthetic oligonucleotide
gcatgaggcggagcagtggagagc

SEQ ID NO: 368030 - DNA, 25 bp, Artificial Sequence
  Description of Artificial Sequence: Synthetic oligonucleotide
caagaggggccggagtattgggacc

SEQ ID NO: 368031 - DNA, 25 bp, Artificial Sequence
  Description of Artificial Sequence: Synthetic oligonucleotide
aagaggggccggagtattgggaccg

SEQ ID NO: 368032 - DNA, 24 bp, Artificial Sequence
  Description of Artificial Sequence: Synthetic oligonucleotide
agaggggccggagtattgggaccg

SEQ ID NO: 368033 - DNA, 26 bp, Artificial Sequence
  Description of Artificial Sequence: Synthetic oligonucleotide
gcggacatggcagctcagatcaccca

SEQ ID NO: 368034 - DNA, 26 bp, Artificial Sequence
  Description of Artificial Sequence: Synthetic oligonucleotide
cggacatggcagctcagatcacccag

SEQ ID NO: 368035 - DNA, 26 bp, Artificial Sequence
  Description of Artificial Sequence: Synthetic oligonucleotide
ggacatggcagctcagatcacccagc

SEQ ID NO: 368036 - DNA, 26 bp, Artificial Sequence
  Description of Artificial Sequence: Synthetic oligonucleotide
gacatggcagctcagatcacccagcg

SEQ ID NO: 368037 - DNA, 27 bp, Artificial Sequence
  Description of Artificial Sequence: Synthetic oligonucleotide
acatggcagctcagatcacccagcgca

SEQ ID NO: 368038 - DNA, 27 bp, Artificial Sequence
  Description of Artificial Sequence: Synthetic oligonucleotide
catggcagctcagatcacccagcgcaa

SEQ ID NO: 368039 - DNA, 27 bp, Artificial Sequence
  Description of Artificial Sequence: Synthetic oligonucleotide
atggcagctcagatcacccagcgcaag

SEQ ID NO: 368040 - DNA, 27 bp, Artificial Sequence
  Description of Artificial Sequence: Synthetic oligonucleotide
tggcagctcagatcacccagcgcaagt

SEQ ID NO: 368041 - DNA, 26 bp, Artificial Sequence
  Description of Artificial Sequence: Synthetic oligonucleotide
ggcagctcagatcacccagcgcaagt

SEQ ID NO: 368042 - DNA, 26 bp, Artificial Sequence
  Description of Artificial Sequence: Synthetic oligonucleotide
gcagctcagatcacccagcgcaagtg

SEQ ID NO: 368043 - DNA, 26 bp, Artificial Sequence
  Description of Artificial Sequence: Synthetic oligonucleotide
cagctcagatcacccagcgcaagtgg

SEQ ID NO: 368044 - DNA, 27 bp, Artificial Sequence
  Description of Artificial Sequence: Synthetic oligonucleotide
agctcagatcacccagcgcaagtggga

SEQ ID NO: 368045 - DNA, 24 bp, Artificial Sequence
  Description of Artificial Sequence: Synthetic oligonucleotide
ggcgccatggatagagcaggaggg

SEQ ID NO: 368046 - DNA, 24 bp, Artificial Sequence
  Description of Artificial Sequence: Synthetic oligonucleotide
gcgccatggatagagcaggagggg

SEQ ID NO: 368047 - DNA, 24 bp, Artificial Sequence
  Description of Artificial Sequence: Synthetic oligonucleotide
cgccatggatagagcaggaggggc

SEQ ID NO: 368048 - DNA, 24 bp, Artificial Sequence
  Description of Artificial Sequence: Synthetic oligonucleotide
gccatggatagagcaggaggggcc

SEQ ID NO: 368049 - DNA, 24 bp, Artificial Sequence
  Description of Artificial Sequence: Synthetic oligonucleotide
ccatggatagagcaggaggggccg

SEQ ID NO: 368050 - DNA, 25 bp, Artificial Sequence
  Description of Artificial Sequence: Synthetic oligonucleotide
catggatagagcaggaggggccgga

SEQ ID NO: 368051 - DNA, 27 bp, Artificial Sequence
  Description of Artificial Sequence: Synthetic oligonucleotide
atggatagagcaggaggggccggagta

SEQ ID NO: 368052 - DNA, 24 bp, Artificial Sequence
  Description of Artificial Sequence: Synthetic oligonucleotide
ttcgtgcggttcgacagcgacgcg

SEQ ID NO: 368053 - DNA, 23 bp, Artificial Sequence
  Description of Artificial Sequence: Synthetic oligonucleotide
tcgtgcggttcgacagcgacgcg

SEQ ID NO: 368054 - DNA, 22 bp, Artificial Sequence
  Description of Artificial Sequence: Synthetic oligonucleotide
cgtgcggttcgacagcgacgcg

SEQ ID NO: 368055 - DNA, 22 bp, Artificial Sequence
  Description of Artificial Sequence: Synthetic oligonucleotide
gtgcggttcgacagcgacgcgg

SEQ ID NO: 368056 - DNA, 22 bp, Artificial Sequence
  Description of Artificial Sequence: Synthetic oligonucleotide
tgcggttcgacagcgacgcggc

SEQ ID NO: 368057 - DNA, 21 bp, Artificial Sequence
  Description of Artificial Sequence: Synthetic oligonucleotide
gcggttcgacagcgacgcggc

SEQ ID NO: 368058 - DNA, 22 bp, Artificial Sequence
  Description of Artificial Sequence: Synthetic oligonucleotide
cggttcgacagcgacgcggcga

SEQ ID NO: 368059 - DNA, 22 bp, Artificial Sequence
  Description of Artificial Sequence: Synthetic oligonucleotide
ggttcgacagcgacgcggcgag

SEQ ID NO: 368060 - DNA, 22 bp, Artificial Sequence
  Description of Artificial Sequence: Synthetic oligonucleotide
gttcgacagcgacgcggcgagc

SEQ ID NO: 368061 - DNA, 23 bp, Artificial Sequence
  Description of Artificial Sequence: Synthetic oligonucleotide
ttcgacagcgacgcggcgagcca

SEQ ID NO: 368062 - DNA, 22 bp, Artificial Sequence
  Description of Artificial Sequence: Synthetic oligonucleotide
tcgacagcgacgcggcgagcca

SEQ ID NO: 368063 - DNA, 21 bp, Artificial Sequence
  Description of Artificial Sequence: Synthetic oligonucleotide
cgacagcgacgcggcgagcca

SEQ ID NO: 368064 - DNA, 22 bp, Artificial Sequence
  Description of Artificial Sequence: Synthetic oligonucleotide
gacagcgacgcggcgagccaga

SEQ ID NO: 368065 - DNA, 22 bp, Artificial Sequence
  Description of Artificial Sequence: Synthetic oligonucleotide
acagcgacgcggcgagccagag

SEQ ID NO: 368066 - DNA, 21 bp, Artificial Sequence
  Description of Artificial Sequence: Synthetic oligonucleotide
cagcgacgcggcgagccagag

SEQ ID NO: 368067 - DNA, 23 bp, Artificial Sequence
  Description of Artificial Sequence: Synthetic oligonucleotide
agcgacgcggcgagccagaggat

SEQ ID NO: 368068 - DNA, 22 bp, Artificial Sequence
  Description of Artificial Sequence: Synthetic oligonucleotide
gcgacgcggcgagccagaggat

SEQ ID NO: 368069 - DNA, 22 bp, Artificial Sequence
  Description of Artificial Sequence: Synthetic oligonucleotide
cgacgcggcgagccagaggatg

SEQ ID NO: 368070 - DNA, 23 bp, Artificial Sequence
  Description of Artificial Sequence: Synthetic oligonucleotide
gacgcggcgagccagaggatgga

SEQ ID NO: 368071 - DNA, 23 bp, Artificial Sequence
  Description of Artificial Sequence: Synthetic oligonucleotide
acgcggcgagccagaggatggag

SEQ ID NO: 368072 - DNA, 22 bp, Artificial Sequence
  Description of Artificial Sequence: Synthetic oligonucleotide
cgcggcgagccagaggatggag

SEQ ID NO: 368073 - DNA, 22 bp, Artificial Sequence
  Description of Artificial Sequence: Synthetic oligonucleotide
gcggcgagccagaggatggagc

SEQ ID NO: 368074 - DNA, 22 bp, Artificial Sequence
  Description of Artificial Sequence: Synthetic oligonucleotide
cggcgagccagaggatggagcc

SEQ ID NO: 368075 - DNA, 22 bp, Artificial Sequence
  Description of Artificial Sequence: Synthetic oligonucleotide
ggcgagccagaggatggagccg

SEQ ID NO: 368076 - DNA, 25 bp, Artificial Sequence
  Description of Artificial Sequence: Synthetic oligonucleotide
agtggagagcctacctggagggcag

SEQ ID NO: 368077 - DNA, 24 bp, Artificial Sequence
  Description of Artificial Sequence: Synthetic oligonucleotide
gtggagagcctacctggagggcag

SEQ ID NO: 368078 - DNA, 25 bp, Artificial Sequence
  Description of Artificial Sequence: Synthetic oligonucleotide
tggagagcctacctggagggcaggt

SEQ ID NO: 368079 - DNA, 24 bp, Artificial Sequence
  Description of Artificial Sequence: Synthetic oligonucleotide
ggagagcctacctggagggcaggt

SEQ ID NO: 368080 - DNA, 24 bp, Artificial Sequence
  Description of Artificial Sequence: Synthetic oligonucleotide
gagagcctacctggagggcaggtg

SEQ ID NO: 368081 - DNA, 24 bp, Artificial Sequence
  Description of Artificial Sequence: Synthetic oligonucleotide
agagcctacctggagggcaggtgc

SEQ ID NO: 368082 - DNA, 23 bp, Artificial Sequence
  Description of Artificial Sequence: Synthetic oligonucleotide
gagcctacctggagggcaggtgc

SEQ ID NO: 368083 - DNA, 24 bp, Artificial Sequence
  Description of Artificial Sequence: Synthetic oligonucleotide
agcctacctggagggcaggtgcgt

SEQ ID NO: 368084 - DNA, 23 bp, Artificial Sequence
  Description of Artificial Sequence: Synthetic oligonucleotide
gcctacctggagggcaggtgcgt

SEQ ID NO: 368085 - DNA, 23 bp, Artificial Sequence
  Description of Artificial Sequence: Synthetic oligonucleotide
cctacctggagggcaggtgcgtg

SEQ ID NO: 368086 - DNA, 24 bp, Artificial Sequence
  Description of Artificial Sequence: Synthetic oligonucleotide
ctacctggagggcaggtgcgtgga

SEQ ID NO: 368087 - DNA, 25 bp, Artificial Sequence
  Description of Artificial Sequence: Synthetic oligonucleotide
tacctggagggcaggtgcgtggagt

SEQ ID NO: 368088 - DNA, 24 bp, Artificial Sequence
  Description of Artificial Sequence: Synthetic oligonucleotide
acctggagggcaggtgcgtggagt

SEQ ID NO: 368089 - DNA, 23 bp, Artificial Sequence
  Description of Artificial Sequence: Synthetic oligonucleotide
cctggagggcaggtgcgtggagt

SEQ ID NO: 368090 - DNA, 23 bp, Artificial Sequence
  Description of Artificial Sequence: Synthetic oligonucleotide
ctggagggcaggtgcgtggagtg

SEQ ID NO: 368091 - DNA, 23 bp, Artificial Sequence
  Description of Artificial Sequence: Synthetic oligonucleotide
tggagggcaggtgcgtggagtgg

SEQ ID NO: 368092 - DNA, 22 bp, Artificial Sequence
  Description of Artificial Sequence: Synthetic oligonucleotide
ggagggcaggtgcgtggagtgg

SEQ ID NO: 368093 - DNA, 23 bp, Artificial Sequence
  Description of Artificial Sequence: Synthetic oligonucleotide
gagggcaggtgcgtggagtggct

SEQ ID NO: 368094 - DNA, 23 bp, Artificial Sequence
  Description of Artificial Sequence: Synthetic oligonucleotide
agggcaggtgcgtggagtggctc

SEQ ID NO: 368095 - DNA, 22 bp, Artificial Sequence
  Description of Artificial Sequence: Synthetic oligonucleotide
gggcaggtgcgtggagtggctc

SEQ ID NO: 368096 - DNA, 22 bp, Artificial Sequence
  Description of Artificial Sequence: Synthetic oligonucleotide
ggcaggtgcgtggagtggctcc

SEQ ID NO: 368097 - DNA, 22 bp, Artificial Sequence
  Description of Artificial Sequence: Synthetic oligonucleotide
gcaggtgcgtggagtggctccg

SEQ ID NO: 368098 - DNA, 23 bp, Artificial Sequence
  Description of Artificial Sequence: Synthetic oligonucleotide
caggtgcgtggagtggctccgca

SEQ ID NO: 368099 - DNA, 26 bp, Artificial Sequence
  Description of Artificial Sequence: Synthetic oligonucleotide
aggtgcgtggagtggctccgcagata

SEQ ID NO: 368100 - DNA, 27 bp, Artificial Sequence
  Description of Artificial Sequence: Synthetic oligonucleotide
gaccggaacacacggaatgtgaaggcg

SEQ ID NO: 368101 - DNA, 27 bp, Artificial Sequence
  Description of Artificial Sequence: Synthetic oligonucleotide
accggaacacacggaatgtgaaggcgc

SEQ ID NO: 368102 - DNA, 27 bp, Artificial Sequence
  Description of Artificial Sequence: Synthetic oligonucleotide
ccggaacacacggaatgtgaaggcgca

SEQ ID NO: 368103 - DNA, 27 bp, Artificial Sequence
  Description of Artificial Sequence: Synthetic oligonucleotide
cggaacacacggaatgtgaaggcgcac

SEQ ID NO: 368104 - DNA, 28 bp, Artificial Sequence
  Description of Artificial Sequence: Synthetic oligonucleotide
ggaacacacggaatgtgaaggcgcactc

SEQ ID NO: 368105 - DNA, 29 bp, Artificial Sequence
  Description of Artificial Sequence: Synthetic oligonucleotide
gaacacacggaatgtgaaggcgcactcac

SEQ ID NO: 368106 - DNA, 30 bp, Artificial Sequence
  Description of Artificial Sequence: Synthetic oligonucleotide
aacacacggaatgtgaaggcgcactcacag

SEQ ID NO: 368107 - DNA, 29 bp, Artificial Sequence
  Description of Artificial Sequence: Synthetic oligonucleotide
acacacggaatgtgaaggcgcactcacag

SEQ ID NO: 368108 - DNA, 28 bp, Artificial Sequence
  Description of Artificial Sequence: Synthetic oligonucleotide
cacacggaatgtgaaggcgcactcacag

SEQ ID NO: 368109 - DNA, 29 bp, Artificial Sequence
  Description of Artificial Sequence: Synthetic oligonucleotide
acacggaatgtgaaggcgcactcacagac

SEQ ID NO: 368110 - DNA, 28 bp, Artificial Sequence
  Description of Artificial Sequence: Synthetic oligonucleotide
cacggaatgtgaaggcgcactcacagac

SEQ ID NO: 368111 - DNA, 29 bp, Artificial Sequence
  Description of Artificial Sequence: Synthetic oligonucleotide
acggaatgtgaaggcgcactcacagactg

SEQ ID NO: 368112 - DNA, 28 bp, Artificial Sequence
  Description of Artificial Sequence: Synthetic oligonucleotide
cggaatgtgaaggcgcactcacagactg

SEQ ID NO: 368113 - DNA, 29 bp, Artificial Sequence
  Description of Artificial Sequence: Synthetic oligonucleotide
ggaatgtgaaggcgcactcacagactgac

SEQ ID NO: 368114 - DNA, 29 bp, Artificial Sequence
  Description of Artificial Sequence: Synthetic oligonucleotide
gaatgtgaaggcgcactcacagactgacc

SEQ ID NO: 368115 - DNA, 29 bp, Artificial Sequence
  Description of Artificial Sequence: Synthetic oligonucleotide
aatgtgaaggcgcactcacagactgaccg

SEQ ID NO: 368116 - DNA, 28 bp, Artificial Sequence
  Description of Artificial Sequence: Synthetic oligonucleotide
atgtgaaggcgcactcacagactgaccg

SEQ ID NO: 368117 - DNA, 27 bp, Artificial Sequence
  Description of Artificial Sequence: Synthetic oligonucleotide
tgtgaaggcgcactcacagactgaccg

SEQ ID NO: 368118 - DNA, 27 bp, Artificial Sequence
  Description of Artificial Sequence: Synthetic oligonucleotide
gtgaaggcgcactcacagactgaccga

SEQ ID NO: 368119 - DNA, 27 bp, Artificial Sequence
  Description of Artificial Sequence: Synthetic oligonucleotide
tgaaggcgcactcacagactgaccgag

SEQ ID NO: 368120 - DNA, 26 bp, Artificial Sequence
  Description of Artificial Sequence: Synthetic oligonucleotide
gaaggcgcactcacagactgaccgag

SEQ ID NO: 368121 - DNA, 26 bp, Artificial Sequence
  Description of Artificial Sequence: Synthetic oligonucleotide
aaggcgcactcacagactgaccgagc

SEQ ID NO: 368122 - DNA, 25 bp, Artificial Sequence
  Description of Artificial Sequence: Synthetic oligonucleotide
aggcgcactcacagactgaccgagc

SEQ ID NO: 368123 - DNA, 24 bp, Artificial Sequence
  Description of Artificial Sequence: Synthetic oligonucleotide
ggcgcactcacagactgaccgagc

SEQ ID NO: 368124 - DNA, 26 bp, Artificial Sequence
  Description of Artificial Sequence: Synthetic oligonucleotide
gcgcactcacagactgaccgagcgaa

SEQ ID NO: 368125 - DNA, 26 bp, Artificial Sequence
  Description of Artificial Sequence: Synthetic oligonucleotide
cgcactcacagactgaccgagcgaac

SEQ ID NO: 368126 - DNA, 27 bp, Artificial Sequence
  Description of Artificial Sequence: Synthetic oligonucleotide
gcactcacagactgaccgagcgaacct

SEQ ID NO: 368127 - DNA, 25 bp, Artificial Sequence
  Description of Artificial Sequence: Synthetic oligonucleotide
gcttcctccgcgggtaccagcagaa

SEQ ID NO: 368128 - DNA, 25 bp, Artificial Sequence
  Description of Artificial Sequence: Synthetic oligonucleotide
cttcctccgcgggtaccagcagaac

SEQ ID NO: 368129 - DNA, 25 bp, Artificial Sequence
  Description of Artificial Sequence: Synthetic oligonucleotide
ttcctccgcgggtaccagcagaacg

SEQ ID NO: 368130 - DNA, 24 bp, Artificial Sequence
  Description of Artificial Sequence: Synthetic oligonucleotide
tcctccgcgggtaccagcagaacg

SEQ ID NO: 368131 - DNA, 23 bp, Artificial Sequence
  Description of Artificial Sequence: Synthetic oligonucleotide
cctccgcgggtaccagcagaacg

SEQ ID NO: 368132 - DNA, 26 bp, Artificial Sequence
  Description of Artificial Sequence: Synthetic oligonucleotide
ctccgcgggtaccagcagaacgctta

SEQ ID NO: 368133 - DNA, 26 bp, Artificial Sequence
  Description of Artificial Sequence: Synthetic oligonucleotide
tccgcgggtaccagcagaacgcttac

SEQ ID NO: 368134 - DNA, 25 bp, Artificial Sequence
  Description of Artificial Sequence: Synthetic oligonucleotide
ccgcgggtaccagcagaacgcttac

SEQ ID NO: 368135 - DNA, 26 bp, Artificial Sequence
  Description of Artificial Sequence: Synthetic oligonucleotide
cgcgggtaccagcagaacgcttacga

SEQ ID NO: 368136 - DNA, 26 bp, Artificial Sequence
  Description of Artificial Sequence: Synthetic oligonucleotide
gcgggtaccagcagaacgcttacgac

SEQ ID NO: 368137 - DNA, 26 bp, Artificial Sequence
  Description of Artificial Sequence: Synthetic oligonucleotide
cgggtaccagcagaacgcttacgacg

SEQ ID NO: 368138 - DNA, 26 bp, Artificial Sequence
  Description of Artificial Sequence: Synthetic oligonucleotide
gggtaccagcagaacgcttacgacgg

SEQ ID NO: 368139 - DNA, 27 bp, Artificial Sequence
  Description of Artificial Sequence: Synthetic oligonucleotide
ggtaccagcagaacgcttacgacggca

SEQ ID NO: 368140 - DNA, 28 bp, Artificial Sequence
  Description of Artificial Sequence: Synthetic oligonucleotide
gtaccagcagaacgcttacgacggcaag

SEQ ID NO: 368141 - DNA, 28 bp, Artificial Sequence
  Description of Artificial Sequence: Synthetic oligonucleotide
taccagcagaacgcttacgacggcaagg

SEQ ID NO: 368142 - DNA, 27 bp, Artificial Sequence
  Description of Artificial Sequence: Synthetic oligonucleotide
accagcagaacgcttacgacggcaagg

SEQ ID NO: 368143 - DNA, 27 bp, Artificial Sequence
  Description of Artificial Sequence: Synthetic oligonucleotide
ccagcagaacgcttacgacggcaagga

SEQ ID NO: 368144 - DNA, 30 bp, Artificial Sequence; identical to SEQ ID NO: 17170
  Description of Artificial Sequence: Synthetic oligonucleotide

SEQ ID NO: 368145 - DNA, 32 bp, Artificial Sequence; identical to SEQ ID NO: 17171
  Description of Artificial Sequence: Synthetic oligonucleotide

SEQ ID NO: 368146 - DNA, 31 bp, Artificial Sequence; identical to SEQ ID NO: 17172
  Description of Artificial Sequence: Synthetic oligonucleotide

SEQ ID NO: 368147 - DNA, 31 bp, Artificial Sequence; identical to SEQ ID NO: 17173
  Description of Artificial Sequence: Synthetic oligonucleotide

SEQ ID NO: 368148 - DNA, 31 bp, Artificial Sequence; identical to SEQ ID NO: 17174
  Description of Artificial Sequence: Synthetic oligonucleotide

SEQ ID NO: 368149 - DNA, 30 bp, Artificial Sequence; identical to SEQ ID NO: 17175
  Description of Artificial Sequence: Synthetic oligonucleotide

SEQ ID NO: 368150 - DNA, 30 bp, Artificial Sequence; identical to SEQ ID NO: 17176
  Description of Artificial Sequence: Synthetic oligonucleotide

SEQ ID NO: 368151 - DNA, 31 bp, Artificial Sequence; identical to SEQ ID NO: 17177
  Description of Artificial Sequence: Synthetic oligonucleotide

SEQ ID NO: 368152 - DNA, 28 bp, Artificial Sequence
  Description of Artificial Sequence: Synthetic oligonucleotide
cactcacagactgaccgagagaacctgg

SEQ ID NO: 368153 - DNA, 28 bp, Artificial Sequence
  Description of Artificial Sequence: Synthetic oligonucleotide
actcacagactgaccgagagaacctggg

SEQ ID NO: 368154 - DNA, 27 bp, Artificial Sequence
  Description of Artificial Sequence: Synthetic oligonucleotide
ctcacagactgaccgagagaacctggg

SEQ ID NO: 368155 - DNA, 27 bp, Artificial Sequence
  Description of Artificial Sequence: Synthetic oligonucleotide
tcacagactgaccgagagaacctgggg

SEQ ID NO: 368156 - DNA, 27 bp, Artificial Sequence
  Description of Artificial Sequence: Synthetic oligonucleotide
cacagactgaccgagagaacctgggga

SEQ ID NO: 368157 - DNA, 27 bp, Artificial Sequence
  Description of Artificial Sequence: Synthetic oligonucleotide
acagactgaccgagagaacctggggac

SEQ ID NO: 368158 - DNA, 26 bp, Artificial Sequence
  Description of Artificial Sequence: Synthetic oligonucleotide
cagactgaccgagagaacctggggac

SEQ ID NO: 368159 - DNA, 26 bp, Artificial Sequence
  Description of Artificial Sequence: Synthetic oligonucleotide
agactgaccgagagaacctggggacc

SEQ ID NO: 368160 - DNA, 25 bp, Artificial Sequence
  Description of Artificial Sequence: Synthetic oligonucleotide
gactgaccgagagaacctggggacc

SEQ ID NO: 368161 - DNA, 26 bp, Artificial Sequence
  Description of Artificial Sequence: Synthetic oligonucleotide
actgaccgagagaacctggggaccct

SEQ ID NO: 368162 - DNA, 25 bp, Artificial Sequence
  Description of Artificial Sequence: Synthetic oligonucleotide
ctgaccgagagaacctggggaccct

SEQ ID NO: 368163 - DNA, 25 bp, Artificial Sequence
  Description of Artificial Sequence: Synthetic oligonucleotide
tgaccgagagaacctggggaccctg

SEQ ID NO: 368164 - DNA, 24 bp, Artificial Sequence
  Description of Artificial Sequence: Synthetic oligonucleotide
gaccgagagaacctggggaccctg

SEQ ID NO: 368165 - DNA, 24 bp, Artificial Sequence
  Description of Artificial Sequence: Synthetic oligonucleotide
accgagagaacctggggaccctgc

SEQ ID NO: 368166 - DNA, 23 bp, Artificial Sequence
  Description of Artificial Sequence: Synthetic oligonucleotide
ccgagagaacctggggaccctgc

SEQ ID NO: 368167 - DNA, 23 bp, Artificial Sequence
  Description of Artificial Sequence: Synthetic oligonucleotide
cgagagaacctggggaccctgcg

SEQ ID NO: 368168 - DNA, 23 bp, Artificial Sequence
  Description of Artificial Sequence: Synthetic oligonucleotide
gagagaacctggggaccctgcgc

SEQ ID NO: 368169 - DNA, 23 bp, Artificial Sequence
  Description of Artificial Sequence: Synthetic oligonucleotide
agagaacctggggaccctgcgcg

SEQ ID NO: 368170 - DNA, 22 bp, Artificial Sequence
  Description of Artificial Sequence: Synthetic oligonucleotide
gagaacctggggaccctgcgcg

SEQ ID NO: 368171 - DNA, 22 bp, Artificial Sequence
  Description of Artificial Sequence: Synthetic oligonucleotide
agaacctggggaccctgcgcgg

SEQ ID NO: 368172 - DNA, 32 bp, Artificial Sequence; identical to SEQ ID NO: 17219
  Description of Artificial Sequence: Synthetic oligonucleotide

SEQ ID NO: 368173 - DNA, 25 bp, Artificial Sequence
  Description of Artificial Sequence: Synthetic oligonucleotide
agcgcaagtgggagacggcccatgt

SEQ ID NO: 368174 - DNA, 24 bp, Artificial Sequence
  Description of Artificial Sequence: Synthetic oligonucleotide
gcgcaagtgggagacggcccatgt

SEQ ID NO: 368175 - DNA, 24 bp, Artificial Sequence
  Description of Artificial Sequence: Synthetic oligonucleotide
cgcaagtgggagacggcccatgtg

SEQ ID NO: 368176 - DNA, 24 bp, Artificial Sequence
  Description of Artificial Sequence: Synthetic oligonucleotide
gcaagtgggagacggcccatgtgg

SEQ ID NO: 368177 - DNA, 24 bp, Artificial Sequence
  Description of Artificial Sequence: Synthetic oligonucleotide
agacggcccatgtggcggagcagt

SEQ ID NO: 368178 - DNA, 23 bp, Artificial Sequence
  Description of Artificial Sequence: Synthetic oligonucleotide
gacggcccatgtggcggagcagt

SEQ ID NO: 368179 - DNA, 23 bp, Artificial Sequence
  Description of Artificial Sequence: Synthetic oligonucleotide
acggcccatgtggcggagcagtg

SEQ ID NO: 368180 - DNA, 30 bp, Artificial Sequence
  Description of Artificial Sequence: Synthetic oligonucleotide
cccaactccgcagtttcttttctccctctg

SEQ ID NO: 368181 - DNA, 30 bp, Artificial Sequence
  Description of Artificial Sequence: Synthetic oligonucleotide
ccaactccgcagtttcttttctccctctgc

SEQ ID NO: 368182 - DNA, 30 bp, Artificial Sequence
  Description of Artificial Sequence: Synthetic oligonucleotide
caactccgcagtttcttttctccctctgcc

SEQ ID NO: 368183 - DNA, 32 bp, Artificial Sequence
  Description of Artificial Sequence: Synthetic oligonucleotide
aactccgcagtttcttttctccctctgccaac

SEQ ID NO: 368184 - DNA, 31 bp, Artificial Sequence
  Description of Artificial Sequence: Synthetic oligonucleotide
actccgcagtttcttttctccctctgccaac

SEQ ID NO: 368185 - DNA, 30 bp, Artificial Sequence
  Description of Artificial Sequence: Synthetic oligonucleotide
ctccgcagtttcttttctccctctgccaac

SEQ ID NO: 368186 - DNA, 30 bp, Artificial Sequence
  Description of Artificial Sequence: Synthetic oligonucleotide
tccgcagtttcttttctccctctgccaacc

SEQ ID NO: 368187 - DNA, 29 bp, Artificial Sequence
  Description of Artificial Sequence: Synthetic oligonucleotide
ccgcagtttcttttctccctctgccaacc

SEQ ID NO: 368188 - DNA, 32 bp, Artificial Sequence
  Description of Artificial Sequence: Synthetic oligonucleotide
cgcagtttcttttctccctctgccaacctatg

SEQ ID NO: 368189 - DNA, 34 bp, Artificial Sequence
  Description of Artificial Sequence: Synthetic oligonucleotide
gcagtttcttttctccctctgccaacctatgtag

SEQ ID NO: 368190 - DNA, 34 bp, Artificial Sequence
  Description of Artificial Sequence: Synthetic oligonucleotide
cagtttcttttctccctctgccaacctatgtagg

SEQ ID NO: 368191 - DNA, 34 bp, Artificial Sequence
  Description of Artificial Sequence: Synthetic oligonucleotide
agtttcttttctccctctgccaacctatgtaggg

SEQ ID NO: 368192 - DNA, 33 bp, Artificial Sequence
  Description of Artificial Sequence: Synthetic oligonucleotide
gtttcttttctccctctgccaacctatgtaggg

SEQ ID NO: 368193 - DNA, 34 bp, Artificial Sequence
  Description of Artificial Sequence: Synthetic oligonucleotide
tttcttttctccctctgccaacctatgtagggtc

SEQ ID NO: 368194 - DNA, 33 bp, Artificial Sequence
  Description of Artificial Sequence: Synthetic oligonucleotide
ttcttttctccctctgccaacctatgtagggtc

SEQ ID NO: 368195 - DNA, 32 bp, Artificial Sequence
  Description of Artificial Sequence: Synthetic oligonucleotide
tcttttctccctctgccaacctatgtagggtc

SEQ ID NO: 368196 - DNA, 31 bp, Artificial Sequence
  Description of Artificial Sequence: Synthetic oligonucleotide
cttttctccctctgccaacctatgtagggtc

SEQ ID NO: 368197 - DNA, 31 bp, Artificial Sequence
  Description of Artificial Sequence: Synthetic oligonucleotide
ttttctccctctgccaacctatgtagggtcc

SEQ ID NO: 368198 - DNA, 30 bp, Artificial Sequence
  Description of Artificial Sequence: Synthetic oligonucleotide
tttctccctctgccaacctatgtagggtcc

SEQ ID NO: 368199 - DNA, 29 bp, Artificial Sequence
  Description of Artificial Sequence: Synthetic oligonucleotide
ttctccctctgccaacctatgtagggtcc

SEQ ID NO: 368200 - DNA, 28 bp, Artificial Sequence
  Description of Artificial Sequence: Synthetic oligonucleotide
tctccctctgccaacctatgtagggtcc

SEQ ID NO: 368201 - DNA, 27 bp, Artificial Sequence
  Description of Artificial Sequence: Synthetic oligonucleotide
ctccctctgccaacctatgtagggtcc

SEQ ID NO: 368202 - DNA, 29 bp, Artificial Sequence
  Description of Artificial Sequence: Synthetic oligonucleotide
tccctctgccaacctatgtagggtccttc

SEQ ID NO: 368203 - DNA, 28 bp, Artificial Sequence
  Description of Artificial Sequence: Synthetic oligonucleotide
ccctctgccaacctatgtagggtccttc

SEQ ID NO: 368204 - DNA, 30 bp, Artificial Sequence
  Description of Artificial Sequence: Synthetic oligonucleotide
cctctgccaacctatgtagggtccttcttc

SEQ ID NO: 368205 - DNA, 30 bp, Artificial Sequence
  Description of Artificial Sequence: Synthetic oligonucleotide
ctctgccaacctatgtagggtccttcttcc

SEQ ID NO: 368206 - DNA, 31 bp, Artificial Sequence
  Description of Artificial Sequence: Synthetic oligonucleotide
tctgccaacctatgtagggtccttcttcctg

SEQ ID NO: 368207 - DNA, 30 bp, Artificial Sequence
  Description of Artificial Sequence: Synthetic oligonucleotide
ctgccaacctatgtagggtccttcttcctg

SEQ ID NO: 368208 - DNA, 30 bp, Artificial Sequence
  Description of Artificial Sequence: Synthetic oligonucleotide
tgccaacctatgtagggtccttcttcctgg

SEQ ID NO: 368209 - DNA, 29 bp, Artificial Sequence
  Description of Artificial Sequence: Synthetic oligonucleotide
gccaacctatgtagggtccttcttcctgg

SEQ ID NO: 368210 - DNA, 26 bp, Artificial Sequence
  Description of Artificial Sequence: Synthetic oligonucleotide
ccccgaaccctcctcctgctactctt

SEQ ID NO: 368211 - DNA, 26 bp, Artificial Sequence
  Description of Artificial Sequence: Synthetic oligonucleotide
cccgaaccctcctcctgctactcttg

SEQ ID NO: 368212 - DNA, 26 bp, Artificial Sequence
  Description of Artificial Sequence: Synthetic oligonucleotide
ccgaaccctcctcctgctactcttgg

SEQ ID NO: 368213 - DNA, 26 bp, Artificial Sequence
  Description of Artificial Sequence: Synthetic oligonucleotide
cgaaccctcctcctgctactcttggg

SEQ ID NO: 368214 - DNA, 26 bp, Artificial Sequence
  Description of Artificial Sequence: Synthetic oligonucleotide
gaaccctcctcctgctactcttgggg

SEQ ID NO: 368215 - DNA, 26 bp, Artificial Sequence
  Description of Artificial Sequence: Synthetic oligonucleotide
aaccctcctcctgctactcttggggg

SEQ ID NO: 368216 - DNA, 25 bp, Artificial Sequence
  Description of Artificial Sequence: Synthetic oligonucleotide
accctcctcctgctactcttggggg

SEQ ID NO: 368217 - DNA, 24 bp, Artificial Sequence
  Description of Artificial Sequence: Synthetic oligonucleotide
ccctcctcctgctactcttggggg

SEQ ID NO: 368218 - DNA, 24 bp, Artificial Sequence
  Description of Artificial Sequence: Synthetic oligonucleotide
cctcctcctgctactcttgggggc

SEQ ID NO: 368219 - DNA, 24 bp, Artificial Sequence
  Description of Artificial Sequence: Synthetic oligonucleotide
ctcctcctgctactcttgggggcc

SEQ ID NO: 368220 - DNA, 25 bp, Artificial Sequence
  Description of Artificial Sequence: Synthetic oligonucleotide
tcctcctgctactcttgggggccct

SEQ ID NO: 368221 - DNA, 24 bp, Artificial Sequence
  Description of Artificial Sequence: Synthetic oligonucleotide
cctcctgctactcttgggggccct

SEQ ID NO: 368222 - DNA, 24 bp, Artificial Sequence
  Description of Artificial Sequence: Synthetic oligonucleotide
ctcctgctactcttgggggccctg

SEQ ID NO: 368223 - DNA, 24 bp, Artificial Sequence
  Description of Artificial Sequence: Synthetic oligonucleotide
tcctgctactcttgggggccctgg

SEQ ID NO: 368224 - DNA, 23 bp, Artificial Sequence
  Description of Artificial Sequence: Synthetic oligonucleotide
cctgctactcttgggggccctgg

SEQ ID NO: 368225 - DNA, 23 bp, Artificial Sequence
  Description of Artificial Sequence: Synthetic oligonucleotide
ctgctactcttgggggccctggc

SEQ ID NO: 368226 - DNA, 23 bp, Artificial Sequence
  Description of Artificial Sequence: Synthetic oligonucleotide
tgctactcttgggggccctggcc

SEQ ID NO: 368227 - DNA, 22 bp, Artificial Sequence
  Description of Artificial Sequence: Synthetic oligonucleotide
gctactcttgggggccctggcc

SEQ ID NO: 368228 - DNA, 23 bp, Artificial Sequence
  Description of Artificial Sequence: Synthetic oligonucleotide
ctactcttgggggccctggccct

SEQ ID NO: 368229 - DNA, 24 bp, Artificial Sequence
  Description of Artificial Sequence: Synthetic oligonucleotide
tactcttgggggccctggccctga

SEQ ID NO: 368230 - DNA, 23 bp, Artificial Sequence
  Description of Artificial Sequence: Synthetic oligonucleotide
actcttgggggccctggccctga

SEQ ID NO: 368231 - DNA, 22 bp, Artificial Sequence
  Description of Artificial Sequence: Synthetic oligonucleotide
ctcttgggggccctggccctga

SEQ ID NO: 368232 - DNA, 22 bp, Artificial Sequence
  Description of Artificial Sequence: Synthetic oligonucleotide
tcttgggggccctggccctgac

SEQ ID NO: 368233 - DNA, 21 bp, Artificial Sequence
  Description of Artificial Sequence: Synthetic oligonucleotide
cttgggggccctggccctgac

SEQ ID NO: 368234 - DNA, 21 bp, Artificial Sequence
  Description of Artificial Sequence: Synthetic oligonucleotide
ttgggggccctggccctgacc

SEQ ID NO: 368235 - DNA, 20 bp, Artificial Sequence
  Description of Artificial Sequence: Synthetic oligonucleotide
tgggggccctggccctgacc

SEQ ID NO: 368236 - DNA, 28 bp, Artificial Sequence
  Description of Artificial Sequence: Synthetic oligonucleotide
cgggctcccactccatgaggtatttcac

SEQ ID NO: 368237 - DNA, 28 bp, Artificial Sequence
  Description of Artificial Sequence: Synthetic oligonucleotide
gggctcccactccatgaggtatttcacc

SEQ ID NO: 368238 - DNA, 29 bp, Artificial Sequence
  Description of Artificial Sequence: Synthetic oligonucleotide
ggctcccactccatgaggtatttcaccac

SEQ ID NO: 368239 - DNA, 31 bp, Artificial Sequence; identical to SEQ ID NO: 13132
  Description of Artificial Sequence: Synthetic oligonucleotide

SEQ ID NO: 368240 - DNA, 31 bp, Artificial Sequence; identical to SEQ ID NO: 13133
  Description of Artificial Sequence: Synthetic oligonucleotide

SEQ ID NO: 368241 - DNA, 31 bp, Artificial Sequence; identical to SEQ ID NO: 13134
  Description of Artificial Sequence: Synthetic oligonucleotide

SEQ ID NO: 368242 - DNA, 30 bp, Artificial Sequence; identical to SEQ ID NO: 13135
  Description of Artificial Sequence: Synthetic oligonucleotide

SEQ ID NO: 368243 - DNA, 31 bp, Artificial Sequence; identical to SEQ ID NO: 13136
  Description of Artificial Sequence: Synthetic oligonucleotide

SEQ ID NO: 368244 - DNA, 32 bp, Artificial Sequence; identical to SEQ ID NO: 8706
  Description of Artificial Sequence: Synthetic oligonucleotide

SEQ ID NO: 368245 - DNA, 32 bp, Artificial Sequence; identical to SEQ ID NO: 8707
  Description of Artificial Sequence: Synthetic oligonucleotide

SEQ ID NO: 368246 - DNA, 31 bp, Artificial Sequence; identical to SEQ ID NO: 8708
  Description of Artificial Sequence: Synthetic oligonucleotide

SEQ ID NO: 368247 - DNA, 31 bp, Artificial Sequence; identical to SEQ ID NO: 8709
  Description of Artificial Sequence: Synthetic oligonucleotide

SEQ ID NO: 368248 - DNA, 30 bp, Artificial Sequence; identical to SEQ ID NO: 8710
  Description of Artificial Sequence: Synthetic oligonucleotide

SEQ ID NO: 368249 - DNA, 30 bp, Artificial Sequence; identical to SEQ ID NO: 8711
  Description of Artificial Sequence: Synthetic oligonucleotide

SEQ ID NO: 368250 - DNA, 30 bp, Artificial Sequence; identical to SEQ ID NO: 8712
  Description of Artificial Sequence: Synthetic oligonucleotide

SEQ ID NO: 368251 - DNA, 29 bp, Artificial Sequence
  Description of Artificial Sequence: Synthetic oligonucleotide
tgaggtatttcaccacatccgtgtcccgg

SEQ ID NO: 368252 - DNA, 28 bp, Artificial Sequence
  Description of Artificial Sequence: Synthetic oligonucleotide
gaggtatttcaccacatccgtgtcccgg

SEQ ID NO: 368253 - DNA, 28 bp, Artificial Sequence
  Description of Artificial Sequence: Synthetic oligonucleotide
aggtatttcaccacatccgtgtcccggc

SEQ ID NO: 368254 - DNA, 27 bp, Artificial Sequence
  Description of Artificial Sequence: Synthetic oligonucleotide
ggtatttcaccacatccgtgtcccggc

SEQ ID NO: 368255 - DNA, 27 bp, Artificial Sequence
  Description of Artificial Sequence: Synthetic oligonucleotide
gtatttcaccacatccgtgtcccggcc

SEQ ID NO: 368256 - DNA, 27 bp, Artificial Sequence
  Description of Artificial Sequence: Synthetic oligonucleotide
tatttcaccacatccgtgtcccggccc

SEQ ID NO: 368257 - DNA, 26 bp, Artificial Sequence
  Description of Artificial Sequence: Synthetic oligonucleotide
atttcaccacatccgtgtcccggccc

SEQ ID NO: 368258 - DNA, 25 bp, Artificial Sequence
  Description of Artificial Sequence: Synthetic oligonucleotide
tttcaccacatccgtgtcccggccc

SEQ ID NO: 368259 - DNA, 24 bp, Artificial Sequence
  Description of Artificial Sequence: Synthetic oligonucleotide
ttcaccacatccgtgtcccggccc

SEQ ID NO: 368260 - DNA, 23 bp, Artificial Sequence
  Description of Artificial Sequence: Synthetic oligonucleotide
tcaccacatccgtgtcccggccc

SEQ ID NO: 368261 - DNA, 22 bp, Artificial Sequence
  Description of Artificial Sequence: Synthetic oligonucleotide
caccacatccgtgtcccggccc

SEQ ID NO: 368262 - DNA, 22 bp, Artificial Sequence
  Description of Artificial Sequence: Synthetic oligonucleotide
accacatccgtgtcccggcccg

SEQ ID NO: 368263 - DNA, 27 bp, Artificial Sequence
  Description of Artificial Sequence: Synthetic oligonucleotide
gtggacgacacgcagttcgtgcggttt

SEQ ID NO: 368264 - DNA, 27 bp, Artificial Sequence
  Description of Artificial Sequence: Synthetic oligonucleotide
tggacgacacgcagttcgtgcggtttg

SEQ ID NO: 368265 - DNA, 27 bp, Artificial Sequence
  Description of Artificial Sequence: Synthetic oligonucleotide
ggacgacacgcagttcgtgcggtttga

SEQ ID NO: 368266 - DNA, 27 bp, Artificial Sequence
  Description of Artificial Sequence: Synthetic oligonucleotide
gacgacacgcagttcgtgcggtttgac

SEQ ID NO: 368267 - DNA, 28 bp, Artificial Sequence
  Description of Artificial Sequence: Synthetic oligonucleotide
acgacacgcagttcgtgcggtttgacag

SEQ ID NO: 368268 - DNA, 27 bp, Artificial Sequence
  Description of Artificial Sequence: Synthetic oligonucleotide
cgacacgcagttcgtgcggtttgacag

SEQ ID NO: 368269 - DNA, 27 bp, Artificial Sequence
  Description of Artificial Sequence: Synthetic oligonucleotide
gacacgcagttcgtgcggtttgacagc

SEQ ID NO: 368270 - DNA, 27 bp, Artificial Sequence
  Description of Artificial Sequence: Synthetic oligonucleotide
acacgcagttcgtgcggtttgacagcg

SEQ ID NO: 368271 - DNA, 27 bp, Artificial Sequence
  Description of Artificial Sequence: Synthetic oligonucleotide
cacgcagttcgtgcggtttgacagcga

SEQ ID NO: 368272 - DNA, 27 bp, Artificial Sequence
  Description of Artificial Sequence: Synthetic oligonucleotide
acgcagttcgtgcggtttgacagcgac

SEQ ID NO: 368273 - DNA, 26 bp, Artificial Sequence
  Description of Artificial Sequence: Synthetic oligonucleotide
cgcagttcgtgcggtttgacagcgac

SEQ ID NO: 368274 - DNA, 26 bp, Artificial Sequence
  Description of Artificial Sequence: Synthetic oligonucleotide
gcagttcgtgcggtttgacagcgacg

SEQ ID NO: 368275 - DNA, 26 bp, Artificial Sequence
  Description of Artificial Sequence: Synthetic oligonucleotide
cagttcgtgcggtttgacagcgacgc

SEQ ID NO: 368276 - DNA, 26 bp, Artificial Sequence
  Description of Artificial Sequence: Synthetic oligonucleotide
agttcgtgcggtttgacagcgacgcc

SEQ ID NO: 368277 - DNA, 25 bp, Artificial Sequence
  Description of Artificial Sequence: Synthetic oligonucleotide
gttcgtgcggtttgacagcgacgcc

SEQ ID NO: 368278 - DNA, 25 bp, Artificial Sequence
  Description of Artificial Sequence: Synthetic oligonucleotide
ttcgtgcggtttgacagcgacgccg

SEQ ID NO: 368279 - DNA, 24 bp, Artificial Sequence
  Description of Artificial Sequence: Synthetic oligonucleotide
tcgtgcggtttgacagcgacgccg

SEQ ID NO: 368280 - DNA, 23 bp, Artificial Sequence
  Description of Artificial Sequence: Synthetic oligonucleotide
cgtgcggtttgacagcgacgccg

SEQ ID NO: 368281 - DNA, 23 bp, Artificial Sequence
  Description of Artificial Sequence: Synthetic oligonucleotide
gtgcggtttgacagcgacgccgc

SEQ ID NO: 368282 - DNA, 24 bp, Artificial Sequence
  Description of Artificial Sequence: Synthetic oligonucleotide
tgcggtttgacagcgacgccgcga

SEQ ID NO: 368283 - DNA, 23 bp, Artificial Sequence
  Description of Artificial Sequence: Synthetic oligonucleotide
gcggtttgacagcgacgccgcga

SEQ ID NO: 368284 - DNA, 23 bp, Artificial Sequence
  Description of Artificial Sequence: Synthetic oligonucleotide
cggtttgacagcgacgccgcgag

SEQ ID NO: 368285 - DNA, 23 bp, Artificial Sequence
  Description of Artificial Sequence: Synthetic oligonucleotide
ggtttgacagcgacgccgcgagc

SEQ ID NO: 368286 - DNA, 24 bp, Artificial Sequence
  Description of Artificial Sequence: Synthetic oligonucleotide
gtttgacagcgacgccgcgagcca

SEQ ID NO: 368287 - DNA, 25 bp, Artificial Sequence
  Description of Artificial Sequence: Synthetic oligonucleotide
tttgacagcgacgccgcgagccaga

SEQ ID NO: 368288 - DNA, 24 bp, Artificial Sequence
  Description of Artificial Sequence: Synthetic oligonucleotide
ttgacagcgacgccgcgagccaga

SEQ ID NO: 368289 - DNA, 23 bp, Artificial Sequence
  Description of Artificial Sequence: Synthetic oligonucleotide
tgacagcgacgccgcgagccaga

SEQ ID NO: 368290 - DNA, 22 bp, Artificial Sequence
  Description of Artificial Sequence: Synthetic oligonucleotide
ccagaggatggagccgcgggca

SEQ ID NO: 368291 - DNA, 22 bp, Artificial Sequence
  Description of Artificial Sequence: Synthetic oligonucleotide
cagaggatggagccgcgggcac

SEQ ID NO: 368292 - DNA, 22 bp, Artificial Sequence
  Description of Artificial Sequence: Synthetic oligonucleotide
agaggatggagccgcgggcacc

SEQ ID NO: 368293 - DNA, 21 bp, Artificial Sequence
  Description of Artificial Sequence: Synthetic oligonucleotide
gaggatggagccgcgggcacc

SEQ ID NO: 368294 - DNA, 22 bp, Artificial Sequence
  Description of Artificial Sequence: Synthetic oligonucleotide
aggatggagccgcgggcaccgt

SEQ ID NO: 368295 - DNA, 21 bp, Artificial Sequence
  Description of Artificial Sequence: Synthetic oligonucleotide
ggatggagccgcgggcaccgt

SEQ ID NO: 368296 - DNA, 21 bp, Artificial Sequence
  Description of Artificial Sequence: Synthetic oligonucleotide
gatggagccgcgggcaccgtg

SEQ ID NO: 368297 - DNA, 24 bp, Artificial Sequence
  Description of Artificial Sequence: Synthetic oligonucleotide
atggagccgcgggcaccgtggata

SEQ ID NO: 368298 - DNA, 23 bp, Artificial Sequence
  Description of Artificial Sequence: Synthetic oligonucleotide
tggagccgcgggcaccgtggata

SEQ ID NO: 368299 - DNA, 22 bp, Artificial Sequence
  Description of Artificial Sequence: Synthetic oligonucleotide
ggagccgcgggcaccgtggata

SEQ ID NO: 368300 - DNA, 23 bp, Artificial Sequence
  Description of Artificial Sequence: Synthetic oligonucleotide
gagccgcgggcaccgtggataga

SEQ ID NO: 368301 - DNA, 23 bp, Artificial Sequence
  Description of Artificial Sequence: Synthetic oligonucleotide
agccgcgggcaccgtggatagag

SEQ ID NO: 368302 - DNA, 22 bp, Artificial Sequence
  Description of Artificial Sequence: Synthetic oligonucleotide
gccgcgggcaccgtggatagag

SEQ ID NO: 368303 - DNA, 23 bp, Artificial Sequence
  Description of Artificial Sequence: Synthetic oligonucleotide
ccgcgggcaccgtggatagagca

SEQ ID NO: 368304 - DNA, 23 bp, Artificial Sequence
  Description of Artificial Sequence: Synthetic oligonucleotide
cgcgggcaccgtggatagagcag

SEQ ID NO: 368305 - DNA, 24 bp, Artificial Sequence
  Description of Artificial Sequence: Synthetic oligonucleotide
gcgggcaccgtggatagagcagga

SEQ ID NO: 368306 - DNA, 24 bp, Artificial Sequence
  Description of Artificial Sequence: Synthetic oligonucleotide
cgggcaccgtggatagagcaggag

SEQ ID NO: 368307 - DNA, 24 bp, Artificial Sequence
  Description of Artificial Sequence: Synthetic oligonucleotide
gggcaccgtggatagagcaggagg

SEQ ID NO: 368308 - DNA, 24 bp, Artificial Sequence
  Description of Artificial Sequence: Synthetic oligonucleotide
ggcaccgtggatagagcaggaggg

SEQ ID NO: 368309 - DNA, 24 bp, Artificial Sequence
  Description of Artificial Sequence: Synthetic oligonucleotide
gcaccgtggatagagcaggagggg

SEQ ID NO: 368310 - DNA, 24 bp, Artificial Sequence
  Description of Artificial Sequence: Synthetic oligonucleotide
caccgtggatagagcaggaggggc

SEQ ID NO: 368311 - DNA, 24 bp, Artificial Sequence
  Description of Artificial Sequence: Synthetic oligonucleotide
accgtggatagagcaggaggggcc

SEQ ID NO: 368312 - DNA, 25 bp, Artificial Sequence
  Description of Artificial Sequence: Synthetic oligonucleotide
aggaggggccggagtattgggacct

SEQ ID NO: 368313 - DNA, 24 bp, Artificial Sequence
  Description of Artificial Sequence: Synthetic oligonucleotide
ggaggggccggagtattgggacct

SEQ ID NO: 368314 - DNA, 24 bp, Artificial Sequence
  Description of Artificial Sequence: Synthetic oligonucleotide
gaggggccggagtattgggacctg

SEQ ID NO: 368315 - DNA, 25 bp, Artificial Sequence
  Description of Artificial Sequence: Synthetic oligonucleotide
aggggccggagtattgggacctgca

SEQ ID NO: 368316 - DNA, 24 bp, Artificial Sequence
  Description of Artificial Sequence: Synthetic oligonucleotide
ggggccggagtattgggacctgca

SEQ ID NO: 368317 - DNA, 25 bp, Artificial Sequence
  Description of Artificial Sequence: Synthetic oligonucleotide
gggccggagtattgggacctgcaga

SEQ ID NO: 368318 - DNA, 26 bp, Artificial Sequence
  Description of Artificial Sequence: Synthetic oligonucleotide
ggccggagtattgggacctgcagaca

SEQ ID NO: 368319 - DNA, 26 bp, Artificial Sequence
  Description of Artificial Sequence: Synthetic oligonucleotide
gccggagtattgggacctgcagacac

SEQ ID NO: 368320 - DNA, 26 bp, Artificial Sequence
  Description of Artificial Sequence: Synthetic oligonucleotide
ccggagtattgggacctgcagacacg

SEQ ID NO: 368321 - DNA, 27 bp, Artificial Sequence
  Description of Artificial Sequence: Synthetic oligonucleotide
cggagtattgggacctgcagacacgga

SEQ ID NO: 368322 - DNA, 29 bp, Artificial Sequence
  Description of Artificial Sequence: Synthetic oligonucleotide
ggagtattgggacctgcagacacggaatg

SEQ ID NO: 368323 - DNA, 30 bp, Artificial Sequence; identical to SEQ ID NO: 12836
  Description of Artificial Sequence: Synthetic oligonucleotide

SEQ ID NO: 368324 - DNA, 32 bp, Artificial Sequence; identical to SEQ ID NO: 12837
  Description of Artificial Sequence: Synthetic oligonucleotide

SEQ ID NO: 368325 - DNA, 31 bp, Artificial Sequence; identical to SEQ ID NO: 12838
  Description of Artificial Sequence: Synthetic oligonucleotide

SEQ ID NO: 368326 - DNA, 31 bp, Artificial Sequence; identical to SEQ ID NO: 12839
  Description of Artificial Sequence: Synthetic oligonucleotide

SEQ ID NO: 368327 - DNA, 30 bp, Artificial Sequence; identical to SEQ ID NO: 12840
  Description of Artificial Sequence: Synthetic oligonucleotide

SEQ ID NO: 368328 - DNA, 29 bp, Artificial Sequence
  Description of Artificial Sequence: Synthetic oligonucleotide
ttgggacctgcagacacggaatgtgaagg

SEQ ID NO: 368329 - DNA, 28 bp, Artificial Sequence
  Description of Artificial Sequence: Synthetic oligonucleotide
tgggacctgcagacacggaatgtgaagg

SEQ ID NO: 368330 - DNA, 27 bp, Artificial Sequence
  Description of Artificial Sequence: Synthetic oligonucleotide
gggacctgcagacacggaatgtgaagg

SEQ ID NO: 368331 - DNA, 27 bp, Artificial Sequence
  Description of Artificial Sequence: Synthetic oligonucleotide
ggacctgcagacacggaatgtgaaggc

SEQ ID NO: 368332 - DNA, 27 bp, Artificial Sequence
  Description of Artificial Sequence: Synthetic oligonucleotide
gacctgcagacacggaatgtgaaggcc

SEQ ID NO: 368333 - DNA, 27 bp, Artificial Sequence
  Description of Artificial Sequence: Synthetic oligonucleotide
acctgcagacacggaatgtgaaggccc

SEQ ID NO: 368334 - DNA, 27 bp, Artificial Sequence
  Description of Artificial Sequence: Synthetic oligonucleotide
cctgcagacacggaatgtgaaggccca

SEQ ID NO: 368335 - DNA, 27 bp, Artificial Sequence
  Description of Artificial Sequence: Synthetic oligonucleotide
ctgcagacacggaatgtgaaggcccag

SEQ ID NO: 368336 - DNA, 28 bp, Artificial Sequence
  Description of Artificial Sequence: Synthetic oligonucleotide
tgcagacacggaatgtgaaggcccagtc

SEQ ID NO: 368337 - DNA, 27 bp, Artificial Sequence
  Description of Artificial Sequence: Synthetic oligonucleotide
gcagacacggaatgtgaaggcccagtc

SEQ ID NO: 368338 - DNA, 28 bp, Artificial Sequence
  Description of Artificial Sequence: Synthetic oligonucleotide
cagacacggaatgtgaaggcccagtcac

SEQ ID NO: 368339 - DNA, 26 bp, Artificial Sequence
  Description of Artificial Sequence: Synthetic oligonucleotide
gaaggcccagtcacagactgaccgag

SEQ ID NO: 368340 - DNA, 26 bp, Artificial Sequence
  Description of Artificial Sequence: Synthetic oligonucleotide
aaggcccagtcacagactgaccgagc

SEQ ID NO: 368341 - DNA, 25 bp, Artificial Sequence
  Description of Artificial Sequence: Synthetic oligonucleotide
aggcccagtcacagactgaccgagc

SEQ ID NO: 368342 - DNA, 24 bp, Artificial Sequence
  Description of Artificial Sequence: Synthetic oligonucleotide
ggcccagtcacagactgaccgagc

SEQ ID NO: 368343 - DNA, 26 bp, Artificial Sequence
  Description of Artificial Sequence: Synthetic oligonucleotide
gcccagtcacagactgaccgagcgaa

SEQ ID NO: 368344 - DNA, 26 bp, Artificial Sequence
  Description of Artificial Sequence: Synthetic oligonucleotide
cccagtcacagactgaccgagcgaac

SEQ ID NO: 368345 - DNA, 27 bp, Artificial Sequence
  Description of Artificial Sequence: Synthetic oligonucleotide
ccagtcacagactgaccgagcgaacct

SEQ ID NO: 368346 - DNA, 27 bp, Artificial Sequence
  Description of Artificial Sequence: Synthetic oligonucleotide
cagtcacagactgaccgagcgaacctg

SEQ ID NO: 368347 - DNA, 27 bp, Artificial Sequence
  Description of Artificial Sequence: Synthetic oligonucleotide
agtcacagactgaccgagcgaacctgg

SEQ ID NO: 368348 - DNA, 26 bp, Artificial Sequence
  Description of Artificial Sequence: Synthetic oligonucleotide
gtcacagactgaccgagcgaacctgg

SEQ ID NO: 368349 - DNA, 27 bp, Artificial Sequence
  Description of Artificial Sequence: Synthetic oligonucleotide
gaggccggttctcacaccatccagatg

SEQ ID NO: 368350 - DNA, 29 bp, Artificial Sequence
  Description of Artificial Sequence: Synthetic oligonucleotide
aggccggttctcacaccatccagatgatg

SEQ ID NO: 368351 - DNA, 28 bp, Artificial Sequence
  Description of Artificial Sequence: Synthetic oligonucleotide
ggccggttctcacaccatccagatgatg

SEQ ID NO: 368352 - DNA, 31 bp, Artificial Sequence; identical to SEQ ID NO: 6527
  Description of Artificial Sequence: Synthetic oligonucleotide

SEQ ID NO: 368353 - DNA, 31 bp, Artificial Sequence; identical to SEQ ID NO: 6528
  Description of Artificial Sequence: Synthetic oligonucleotide

SEQ ID NO: 368354 - DNA, 32 bp, Artificial Sequence; identical to SEQ ID NO: 17870
  Description of Artificial Sequence: Synthetic oligonucleotide

SEQ ID NO: 368355 - DNA, 31 bp, Artificial Sequence; identical to SEQ ID NO: 17871
  Description of Artificial Sequence: Synthetic oligonucleotide

SEQ ID NO: 368356 - DNA, 30 bp, Artificial Sequence; identical to SEQ ID NO: 17872
  Description of Artificial Sequence: Synthetic oligonucleotide

SEQ ID NO: 368357 - DNA, 31 bp, Artificial Sequence; identical to SEQ ID NO: 17873
  Description of Artificial Sequence: Synthetic oligonucleotide

SEQ ID NO: 368358 - DNA, 30 bp, Artificial Sequence; identical to SEQ ID NO: 17874
  Description of Artificial Sequence: Synthetic oligonucleotide

SEQ ID NO: 368359 - DNA, 30 bp, Artificial Sequence; identical to SEQ ID NO: 17875
  Description of Artificial Sequence: Synthetic oligonucleotide

SEQ ID NO: 368360 - DNA, 29 bp, Artificial Sequence
  Description of Artificial Sequence: Synthetic oligonucleotide
caccatccagatgatgtatggctgccacg

SEQ ID NO: 368361 - DNA, 30 bp, Artificial Sequence; identical to SEQ ID NO: 17877
  Description of Artificial Sequence: Synthetic oligonucleotide

SEQ ID NO: 368362 - DNA, 29 bp, Artificial Sequence
  Description of Artificial Sequence: Synthetic oligonucleotide
ccatccagatgatgtatggctgccacgtg

SEQ ID NO: 368363 - DNA, 29 bp, Artificial Sequence
  Description of Artificial Sequence: Synthetic oligonucleotide
catccagatgatgtatggctgccacgtgg

SEQ ID NO: 368364 - DNA, 29 bp, Artificial Sequence
  Description of Artificial Sequence: Synthetic oligonucleotide
atccagatgatgtatggctgccacgtggg

SEQ ID NO: 368365 - DNA, 28 bp, Artificial Sequence
  Description of Artificial Sequence: Synthetic oligonucleotide
tccagatgatgtatggctgccacgtggg

SEQ ID NO: 368366 - DNA, 27 bp, Artificial Sequence
  Description of Artificial Sequence: Synthetic oligonucleotide
ccagatgatgtatggctgccacgtggg

SEQ ID NO: 368367 - DNA, 27 bp, Artificial Sequence
  Description of Artificial Sequence: Synthetic oligonucleotide
cagatgatgtatggctgccacgtgggg

SEQ ID NO: 368368 - DNA, 28 bp, Artificial Sequence
  Description of Artificial Sequence: Synthetic oligonucleotide
agatgatgtatggctgccacgtggggtc

SEQ ID NO: 368369 - DNA, 27 bp, Artificial Sequence
  Description of Artificial Sequence: Synthetic oligonucleotide
gatgatgtatggctgccacgtggggtc

SEQ ID NO: 368370 - DNA, 27 bp, Artificial Sequence
  Description of Artificial Sequence: Synthetic oligonucleotide
atgatgtatggctgccacgtggggtcg

SEQ ID NO: 368371 - DNA, 26 bp, Artificial Sequence
  Description of Artificial Sequence: Synthetic oligonucleotide
tgatgtatggctgccacgtggggtcg

SEQ ID NO: 368372 - DNA, 25 bp, Artificial Sequence
  Description of Artificial Sequence: Synthetic oligonucleotide
gatgtatggctgccacgtggggtcg

SEQ ID NO: 368373 - DNA, 26 bp, Artificial Sequence
  Description of Artificial Sequence: Synthetic oligonucleotide
atgtatggctgccacgtggggtcgga

SEQ ID NO: 368374 - DNA, 25 bp, Artificial Sequence
  Description of Artificial Sequence: Synthetic oligonucleotide
tgtatggctgccacgtggggtcgga

SEQ ID NO: 368375 - DNA, 24 bp, Artificial Sequence
  Description of Artificial Sequence: Synthetic oligonucleotide
gtatggctgccacgtggggtcgga

SEQ ID NO: 368376 - DNA, 24 bp, Artificial Sequence
  Description of Artificial Sequence: Synthetic oligonucleotide
tatggctgccacgtggggtcggac

SEQ ID NO: 368377 - DNA, 23 bp, Artificial Sequence
  Description of Artificial Sequence: Synthetic oligonucleotide
atggctgccacgtggggtcggac

SEQ ID NO: 368378 - DNA, 22 bp, Artificial Sequence
  Description of Artificial Sequence: Synthetic oligonucleotide
tggctgccacgtggggtcggac

SEQ ID NO: 368379 - DNA, 21 bp, Artificial Sequence
  Description of Artificial Sequence: Synthetic oligonucleotide
ggctgccacgtggggtcggac

SEQ ID NO: 368380 - DNA, 21 bp, Artificial Sequence
  Description of Artificial Sequence: Synthetic oligonucleotide
gctgccacgtggggtcggacg

SEQ ID NO: 368381 - DNA, 21 bp, Artificial Sequence
  Description of Artificial Sequence: Synthetic oligonucleotide
ctgccacgtggggtcggacgg

SEQ ID NO: 368382 - DNA, 21 bp, Artificial Sequence
  Description of Artificial Sequence: Synthetic oligonucleotide
tgccacgtggggtcggacggg

SEQ ID NO: 368383 - DNA, 20 bp, Artificial Sequence
  Description of Artificial Sequence: Synthetic oligonucleotide
gccacgtggggtcggacggg

SEQ ID NO: 368384 - DNA, 20 bp, Artificial Sequence
  Description of Artificial Sequence: Synthetic oligonucleotide
ccacgtggggtcggacgggc

SEQ ID NO: 368385 - DNA, 20 bp, Artificial Sequence
  Description of Artificial Sequence: Synthetic oligonucleotide
cacgtggggtcggacgggcg

SEQ ID NO: 368386 - DNA, 27 bp, Artificial Sequence
  Description of Artificial Sequence: Synthetic oligonucleotide
gggatggaaccttccagaagtgggcgt

SEQ ID NO: 368387 - DNA, 27 bp, Artificial Sequence
  Description of Artificial Sequence: Synthetic oligonucleotide
ggatggaaccttccagaagtgggcgtc

SEQ ID NO: 368388 - DNA, 28 bp, Artificial Sequence
  Description of Artificial Sequence: Synthetic oligonucleotide
gatggaaccttccagaagtgggcgtctg

SEQ ID NO: 368389 - DNA, 29 bp, Artificial Sequence
  Description of Artificial Sequence: Synthetic oligonucleotide
atggaaccttccagaagtgggcgtctgtg

SEQ ID NO: 368390 - DNA, 28 bp, Artificial Sequence
  Description of Artificial Sequence: Synthetic oligonucleotide
tggaaccttccagaagtgggcgtctgtg

SEQ ID NO: 368391 - DNA, 27 bp, Artificial Sequence
  Description of Artificial Sequence: Synthetic oligonucleotide
ggaaccttccagaagtgggcgtctgtg

SEQ ID NO: 368392 - DNA, 27 bp, Artificial Sequence
  Description of Artificial Sequence: Synthetic oligonucleotide
gaaccttccagaagtgggcgtctgtgg

SEQ ID NO: 368393 - DNA, 28 bp, Artificial Sequence
  Description of Artificial Sequence: Synthetic oligonucleotide
aaccttccagaagtgggcgtctgtggtg

SEQ ID NO: 368394 - DNA, 27 bp, Artificial Sequence
  Description of Artificial Sequence: Synthetic oligonucleotide
cccatcgtgggcatcattgctggccta

SEQ ID NO: 368395 - DNA, 27 bp, Artificial Sequence
  Description of Artificial Sequence: Synthetic oligonucleotide
ccatcgtgggcatcattgctggcctag

SEQ ID NO: 368396 - DNA, 29 bp, Artificial Sequence
  Description of Artificial Sequence: Synthetic oligonucleotide
catcgtgggcatcattgctggcctagttc

SEQ ID NO: 368397 - DNA, 30 bp, Artificial Sequence; identical to SEQ ID NO: 9822
  Description of Artificial Sequence: Synthetic oligonucleotide

SEQ ID NO: 368398 - DNA, 29 bp, Artificial Sequence
  Description of Artificial Sequence: Synthetic oligonucleotide
tcgtgggcatcattgctggcctagttctc

SEQ ID NO: 368399 - DNA, 28 bp, Artificial Sequence
  Description of Artificial Sequence: Synthetic oligonucleotide
cgtgggcatcattgctggcctagttctc

SEQ ID NO: 368400 - DNA, 31 bp, Artificial Sequence; identical to SEQ ID NO: 9825
  Description of Artificial Sequence: Synthetic oligonucleotide

SEQ ID NO: 368401 - DNA, 31 bp, Artificial Sequence; identical to SEQ ID NO: 9826
  Description of Artificial Sequence: Synthetic oligonucleotide

SEQ ID NO: 368402 - DNA, 30 bp, Artificial Sequence; identical to SEQ ID NO: 9827
  Description of Artificial Sequence: Synthetic oligonucleotide

SEQ ID NO: 368403 - DNA, 31 bp, Artificial Sequence; identical to SEQ ID NO: 9828
  Description of Artificial Sequence: Synthetic oligonucleotide

SEQ ID NO: 368404 - DNA, 31 bp, Artificial Sequence; identical to SEQ ID NO: 9829
  Description of Artificial Sequence: Synthetic oligonucleotide

SEQ ID NO: 368405 - DNA, 32 bp, Artificial Sequence; identical to SEQ ID NO: 17898
  Description of Artificial Sequence: Synthetic oligonucleotide

SEQ ID NO: 368406 - DNA, 33 bp, Artificial Sequence; identical to SEQ ID NO: 17899
  Description of Artificial Sequence: Synthetic oligonucleotide

SEQ ID NO: 368407 - DNA, 32 bp, Artificial Sequence; identical to SEQ ID NO: 17900
  Description of Artificial Sequence: Synthetic oligonucleotide

SEQ ID NO: 368408 - DNA, 31 bp, Artificial Sequence; identical to SEQ ID NO: 17901
  Description of Artificial Sequence: Synthetic oligonucleotide

SEQ ID NO: 368409 - DNA, 33 bp, Artificial Sequence; identical to SEQ ID NO: 17902
  Description of Artificial Sequence: Synthetic oligonucleotide

SEQ ID NO: 368410 - DNA, 32 bp, Artificial Sequence; identical to SEQ ID NO: 17903
  Description of Artificial Sequence: Synthetic oligonucleotide

SEQ ID NO: 368411 - DNA, 31 bp, Artificial Sequence; identical to SEQ ID NO: 17904
  Description of Artificial Sequence: Synthetic oligonucleotide

SEQ ID NO: 368412 - DNA, 30 bp, Artificial Sequence; identical to SEQ ID NO: 17905
  Description of Artificial Sequence: Synthetic oligonucleotide

SEQ ID NO: 368413 - DNA, 30 bp, Artificial Sequence; identical to SEQ ID NO: 17906
  Description of Artificial Sequence: Synthetic oligonucleotide

SEQ ID NO: 368414 - DNA, 30 bp, Artificial Sequence; identical to SEQ ID NO: 17907
  Description of Artificial Sequence: Synthetic oligonucleotide

SEQ ID NO: 368415 - DNA, 29 bp, Artificial Sequence
  Description of Artificial Sequence: Synthetic oligonucleotide
ggcctagttctctttggagctgtgttcgc

SEQ ID NO: 368416 - DNA, 30 bp, Artificial Sequence; identical to SEQ ID NO: 17909
  Description of Artificial Sequence: Synthetic oligonucleotide

SEQ ID NO: 368417 - DNA, 30 bp, Artificial Sequence; identical to SEQ ID NO: 17910
  Description of Artificial Sequence: Synthetic oligonucleotide

SEQ ID NO: 368418 - DNA, 31 bp, Artificial Sequence; identical to SEQ ID NO: 17911
  Description of Artificial Sequence: Synthetic oligonucleotide

SEQ ID NO: 368419 - DNA, 31 bp, Artificial Sequence; identical to SEQ ID NO: 17912
  Description of Artificial Sequence: Synthetic oligonucleotide

SEQ ID NO: 368420 - DNA, 30 bp, Artificial Sequence; identical to SEQ ID NO: 17913
  Description of Artificial Sequence: Synthetic oligonucleotide

SEQ ID NO: 368421 - DNA, 29 bp, Artificial Sequence
  Description of Artificial Sequence: Synthetic oligonucleotide
gttctctttggagctgtgttcgctggagc

SEQ ID NO: 368422 - DNA, 30 bp, Artificial Sequence; identical to SEQ ID NO: 17915
  Description of Artificial Sequence: Synthetic oligonucleotide

SEQ ID NO: 368423 - DNA, 29 bp, Artificial Sequence
  Description of Artificial Sequence: Synthetic oligonucleotide
tctctttggagctgtgttcgctggagctg

SEQ ID NO: 368424 - DNA, 28 bp, Artificial Sequence
  Description of Artificial Sequence: Synthetic oligonucleotide
ctctttggagctgtgttcgctggagctg

SEQ ID NO: 368425 - DNA, 29 bp, Artificial Sequence
  Description of Artificial Sequence: Synthetic oligonucleotide
tctttggagctgtgttcgctggagctgtg

SEQ ID NO: 368426 - DNA, 28 bp, Artificial Sequence
  Description of Artificial Sequence: Synthetic oligonucleotide
ctttggagctgtgttcgctggagctgtg

SEQ ID NO: 368427 - DNA, 28 bp, Artificial Sequence
  Description of Artificial Sequence: Synthetic oligonucleotide
tttggagctgtgttcgctggagctgtgg

SEQ ID NO: 368428 - DNA, 27 bp, Artificial Sequence
  Description of Artificial Sequence: Synthetic oligonucleotide
ttggagctgtgttcgctggagctgtgg

SEQ ID NO: 368429 - DNA, 27 bp, Artificial Sequence
  Description of Artificial Sequence: Synthetic oligonucleotide
tggagctgtgttcgctggagctgtggt

SEQ ID NO: 368430 - DNA, 26 bp, Artificial Sequence
  Description of Artificial Sequence: Synthetic oligonucleotide
ggagctgtgttcgctggagctgtggt

SEQ ID NO: 368431 - DNA, 26 bp, Artificial Sequence
  Description of Artificial Sequence: Synthetic oligonucleotide
gagctgtgttcgctggagctgtggtc

SEQ ID NO: 368432 - DNA, 26 bp, Artificial Sequence
  Description of Artificial Sequence: Synthetic oligonucleotide
agctgtgttcgctggagctgtggtcg

SEQ ID NO: 368433 - DNA, 25 bp, Artificial Sequence
  Description of Artificial Sequence: Synthetic oligonucleotide
gctgtgttcgctggagctgtggtcg

SEQ ID NO: 368434 - DNA, 26 bp, Artificial Sequence
  Description of Artificial Sequence: Synthetic oligonucleotide
ctgtgttcgctggagctgtggtcgct

SEQ ID NO: 368435 - DNA, 26 bp, Artificial Sequence
  Description of Artificial Sequence: Synthetic oligonucleotide
tgtgttcgctggagctgtggtcgctg

SEQ ID NO: 368436 - DNA, 25 bp, Artificial Sequence
  Description of Artificial Sequence: Synthetic oligonucleotide
gtgttcgctggagctgtggtcgctg

SEQ ID NO: 368437 - DNA, 26 bp, Artificial Sequence
  Description of Artificial Sequence: Synthetic oligonucleotide
tgttcgctggagctgtggtcgctgct

SEQ ID NO: 368438 - DNA, 25 bp, Artificial Sequence
  Description of Artificial Sequence: Synthetic oligonucleotide
gttcgctggagctgtggtcgctgct

SEQ ID NO: 368439 - DNA, 26 bp, Artificial Sequence
  Description of Artificial Sequence: Synthetic oligonucleotide
ttcgctggagctgtggtcgctgctgt

SEQ ID NO: 368440 - DNA, 25 bp, Artificial Sequence
  Description of Artificial Sequence: Synthetic oligonucleotide
gctggagctgtggtcgctgctgtga

SEQ ID NO: 368441 - DNA, 25 bp, Artificial Sequence
  Description of Artificial Sequence: Synthetic oligonucleotide
ctggagctgtggtcgctgctgtgag

SEQ ID NO: 368442 - DNA, 26 bp, Artificial Sequence
  Description of Artificial Sequence: Synthetic oligonucleotide
tggagctgtggtcgctgctgtgaggt

SEQ ID NO: 368443 - DNA, 25 bp, Artificial Sequence
  Description of Artificial Sequence: Synthetic oligonucleotide
ggagctgtggtcgctgctgtgaggt

SEQ ID NO: 368444 - DNA, 25 bp, Artificial Sequence
  Description of Artificial Sequence: Synthetic oligonucleotide
gagctgtggtcgctgctgtgaggtg

SEQ ID NO: 368445 - DNA, 26 bp, Artificial Sequence
  Description of Artificial Sequence: Synthetic oligonucleotide
agctgtggtcgctgctgtgaggtgga

SEQ ID NO: 368446 - DNA, 25 bp, Artificial Sequence
  Description of Artificial Sequence: Synthetic oligonucleotide
gctgtggtcgctgctgtgaggtgga

SEQ ID NO: 368447 - DNA, 25 bp, Artificial Sequence
  Description of Artificial Sequence: Synthetic oligonucleotide
ctgtggtcgctgctgtgaggtggag

SEQ ID NO: 368448 - DNA, 26 bp, Artificial Sequence
  Description of Artificial Sequence: Synthetic oligonucleotide
tgtggtcgctgctgtgaggtggagga

SEQ ID NO: 368449 - DNA, 25 bp, Artificial Sequence
  Description of Artificial Sequence: Synthetic oligonucleotide
gtggtcgctgctgtgaggtggagga

SEQ ID NO: 368450 - DNA, 25 bp, Artificial Sequence
  Description of Artificial Sequence: Synthetic oligonucleotide
tggtcgctgctgtgaggtggaggag

SEQ ID NO: 368451 - DNA, 24 bp, Artificial Sequence
  Description of Artificial Sequence: Synthetic oligonucleotide
ggtcgctgctgtgaggtggaggag

SEQ ID NO: 368452 - DNA, 26 bp, Artificial Sequence
  Description of Artificial Sequence: Synthetic oligonucleotide
gtcgctgctgtgaggtggaggaggaa

SEQ ID NO: 368453 - DNA, 27 bp, Artificial Sequence
  Description of Artificial Sequence: Synthetic oligonucleotide
tcgctgctgtgaggtggaggaggaaga

SEQ ID NO: 368454 - DNA, 26 bp, Artificial Sequence
  Description of Artificial Sequence: Synthetic oligonucleotide
cgctgctgtgaggtggaggaggaaga

SEQ ID NO: 368455 - DNA, 26 bp, Artificial Sequence
  Description of Artificial Sequence: Synthetic oligonucleotide
gctgctgtgaggtggaggaggaagag

SEQ ID NO: 368456 - DNA, 27 bp, Artificial Sequence
  Description of Artificial Sequence: Synthetic oligonucleotide
ctgctgtgaggtggaggaggaagagct

SEQ ID NO: 368457 - DNA, 27 bp, Artificial Sequence
  Description of Artificial Sequence: Synthetic oligonucleotide
tgctgtgaggtggaggaggaagagctc

SEQ ID NO: 368458 - DNA, 27 bp, Artificial Sequence
  Description of Artificial Sequence: Synthetic oligonucleotide
gctgtgaggtggaggaggaagagctca

SEQ ID NO: 368459 - DNA, 27 bp, Artificial Sequence
  Description of Artificial Sequence: Synthetic oligonucleotide
ctgtgaggtggaggaggaagagctcag

SEQ ID NO: 368460 - DNA, 30 bp, Artificial Sequence; identical to SEQ ID NO: 9887
  Description of Artificial Sequence: Synthetic oligonucleotide

SEQ ID NO: 368461 - DNA, 29 bp, Artificial Sequence
  Description of Artificial Sequence: Synthetic oligonucleotide
gtgaggtggaggaggaagagctcagatag

SEQ ID NO: 368462 - DNA, 33 bp, Artificial Sequence; identical to SEQ ID NO: 9889
  Description of Artificial Sequence: Synthetic oligonucleotide

SEQ ID NO: 368463 - DNA, 32 bp, Artificial Sequence; identical to SEQ ID NO: 9890
  Description of Artificial Sequence: Synthetic oligonucleotide

SEQ ID NO: 368464 - DNA, 32 bp, Artificial Sequence; identical to SEQ ID NO: 9891
  Description of Artificial Sequence: Synthetic oligonucleotide

SEQ ID NO: 368465 - DNA, 31 bp, Artificial Sequence; identical to SEQ ID NO: 9892
  Description of Artificial Sequence: Synthetic oligonucleotide

SEQ ID NO: 368466 - DNA, 27 bp, Artificial Sequence
  Description of Artificial Sequence: Synthetic oligonucleotide
ccgtgtggcggagcagttgagagctta

SEQ ID NO: 368467 - DNA, 27 bp, Artificial Sequence
  Description of Artificial Sequence: Synthetic oligonucleotide
cgtgtggcggagcagttgagagcttac

SEQ ID NO: 368468 - DNA, 27 bp, Artificial Sequence
  Description of Artificial Sequence: Synthetic oligonucleotide
gtgtggcggagcagttgagagcttacc

SEQ ID NO: 368469 - DNA, 28 bp, Artificial Sequence
  Description of Artificial Sequence: Synthetic oligonucleotide
tgtggcggagcagttgagagcttacctg

SEQ ID NO: 368470 - DNA, 27 bp, Artificial Sequence
  Description of Artificial Sequence: Synthetic oligonucleotide
gtggcggagcagttgagagcttacctg

SEQ ID NO: 368471 - DNA, 27 bp, Artificial Sequence
  Description of Artificial Sequence: Synthetic oligonucleotide
tggcggagcagttgagagcttacctgg

SEQ ID NO: 368472 - DNA, 27 bp, Artificial Sequence
  Description of Artificial Sequence: Synthetic oligonucleotide
ggcggagcagttgagagcttacctgga

SEQ ID NO: 368473 - DNA, 27 bp, Artificial Sequence
  Description of Artificial Sequence: Synthetic oligonucleotide
gcggagcagttgagagcttacctggag

SEQ ID NO: 368474 - DNA, 27 bp, Artificial Sequence
  Description of Artificial Sequence: Synthetic oligonucleotide
cggagcagttgagagcttacctggagg

SEQ ID NO: 368475 - DNA, 27 bp, Artificial Sequence
  Description of Artificial Sequence: Synthetic oligonucleotide
ggagcagttgagagcttacctggaggg

SEQ ID NO: 368476 - DNA, 27 bp, Artificial Sequence
  Description of Artificial Sequence: Synthetic oligonucleotide
gagcagttgagagcttacctggagggc

SEQ ID NO: 368477 - DNA, 28 bp, Artificial Sequence
  Description of Artificial Sequence: Synthetic oligonucleotide
agcagttgagagcttacctggagggcac

SEQ ID NO: 368478 - DNA, 27 bp, Artificial Sequence
  Description of Artificial Sequence: Synthetic oligonucleotide
gcagttgagagcttacctggagggcac

SEQ ID NO: 368479 - DNA, 27 bp, Artificial Sequence
  Description of Artificial Sequence: Synthetic oligonucleotide
cagttgagagcttacctggagggcacg

SEQ ID NO: 368480 - DNA, 28 bp, Artificial Sequence
  Description of Artificial Sequence: Synthetic oligonucleotide
agttgagagcttacctggagggcacgtg

SEQ ID NO: 368481 - DNA, 27 bp, Artificial Sequence
  Description of Artificial Sequence: Synthetic oligonucleotide
gttgagagcttacctggagggcacgtg

SEQ ID NO: 368482 - DNA, 27 bp, Artificial Sequence
  Description of Artificial Sequence: Synthetic oligonucleotide
ttgagagcttacctggagggcacgtgc

SEQ ID NO: 368483 - DNA, 26 bp, Artificial Sequence
  Description of Artificial Sequence: Synthetic oligonucleotide
tgagagcttacctggagggcacgtgc

SEQ ID NO: 368484 - DNA, 25 bp, Artificial Sequence
  Description of Artificial Sequence: Synthetic oligonucleotide
gagagcttacctggagggcacgtgc

SEQ ID NO: 368485 - DNA, 26 bp, Artificial Sequence
  Description of Artificial Sequence: Synthetic oligonucleotide
agagcttacctggagggcacgtgcgt

SEQ ID NO: 368486 - DNA, 25 bp, Artificial Sequence
  Description of Artificial Sequence: Synthetic oligonucleotide
gagcttacctggagggcacgtgcgt

SEQ ID NO: 368487 - DNA, 25 bp, Artificial Sequence
  Description of Artificial Sequence: Synthetic oligonucleotide
agcttacctggagggcacgtgcgtg

SEQ ID NO: 368488 - DNA, 24 bp, Artificial Sequence
  Description of Artificial Sequence: Synthetic oligonucleotide
gcttacctggagggcacgtgcgtg

SEQ ID NO: 368489 - DNA, 25 bp, Artificial Sequence
  Description of Artificial Sequence: Synthetic oligonucleotide
cttacctggagggcacgtgcgtgga

SEQ ID NO: 368490 - DNA, 26 bp, Artificial Sequence
  Description of Artificial Sequence: Synthetic oligonucleotide
ttacctggagggcacgtgcgtggagt

SEQ ID NO: 368491 - DNA, 27 bp, Artificial Sequence
  Description of Artificial Sequence: Synthetic oligonucleotide
agttgagagcctacctggagggcacct

SEQ ID NO: 368492 - DNA, 26 bp, Artificial Sequence
  Description of Artificial Sequence: Synthetic oligonucleotide
gttgagagcctacctggagggcacct

SEQ ID NO: 368493 - DNA, 26 bp, Artificial Sequence
  Description of Artificial Sequence: Synthetic oligonucleotide
ttgagagcctacctggagggcacctg

SEQ ID NO: 368494 - DNA, 25 bp, Artificial Sequence
  Description of Artificial Sequence: Synthetic oligonucleotide
tgagagcctacctggagggcacctg

SEQ ID NO: 368495 - DNA, 24 bp, Artificial Sequence
  Description of Artificial Sequence: Synthetic oligonucleotide
gagagcctacctggagggcacctg

SEQ ID NO: 368496 - DNA, 24 bp, Artificial Sequence
  Description of Artificial Sequence: Synthetic oligonucleotide
agagcctacctggagggcacctgc

SEQ ID NO: 368497 - DNA, 23 bp, Artificial Sequence
  Description of Artificial Sequence: Synthetic oligonucleotide
gagcctacctggagggcacctgc

SEQ ID NO: 368498 - DNA, 24 bp, Artificial Sequence
  Description of Artificial Sequence: Synthetic oligonucleotide
agcctacctggagggcacctgcgt

SEQ ID NO: 368499 - DNA, 23 bp, Artificial Sequence
  Description of Artificial Sequence: Synthetic oligonucleotide
gcctacctggagggcacctgcgt

SEQ ID NO: 368500 - DNA, 23 bp, Artificial Sequence
  Description of Artificial Sequence: Synthetic oligonucleotide
cctacctggagggcacctgcgtg

SEQ ID NO: 368501 - DNA, 24 bp, Artificial Sequence
  Description of Artificial Sequence: Synthetic oligonucleotide
ctacctggagggcacctgcgtgga

SEQ ID NO: 368502 - DNA, 25 bp, Artificial Sequence
  Description of Artificial Sequence: Synthetic oligonucleotide
tacctggagggcacctgcgtggagt

SEQ ID NO: 368503 - DNA, 24 bp, Artificial Sequence
  Description of Artificial Sequence: Synthetic oligonucleotide
acctggagggcacctgcgtggagt

SEQ ID NO: 368504 - DNA, 23 bp, Artificial Sequence
  Description of Artificial Sequence: Synthetic oligonucleotide
cctggagggcacctgcgtggagt

SEQ ID NO: 368505 - DNA, 23 bp, Artificial Sequence
  Description of Artificial Sequence: Synthetic oligonucleotide
ctggagggcacctgcgtggagtg

SEQ ID NO: 368506 - DNA, 23 bp, Artificial Sequence
  Description of Artificial Sequence: Synthetic oligonucleotide
tggagggcacctgcgtggagtgg

SEQ ID NO: 368507 - DNA, 22 bp, Artificial Sequence
  Description of Artificial Sequence: Synthetic oligonucleotide
ggagggcacctgcgtggagtgg

SEQ ID NO: 368508 - DNA, 23 bp, Artificial Sequence
  Description of Artificial Sequence: Synthetic oligonucleotide
gagggcacctgcgtggagtggct

SEQ ID NO: 368509 - DNA, 23 bp, Artificial Sequence
  Description of Artificial Sequence: Synthetic oligonucleotide
agggcacctgcgtggagtggctc

SEQ ID NO: 368510 - DNA, 22 bp, Artificial Sequence
  Description of Artificial Sequence: Synthetic oligonucleotide
gggcacctgcgtggagtggctc

SEQ ID NO: 368511 - DNA, 22 bp, Artificial Sequence
  Description of Artificial Sequence: Synthetic oligonucleotide
ggcacctgcgtggagtggctcc

SEQ ID NO: 368512 - DNA, 22 bp, Artificial Sequence
  Description of Artificial Sequence: Synthetic oligonucleotide
gcacctgcgtggagtggctccg

SEQ ID NO: 368513 - DNA, 23 bp, Artificial Sequence
  Description of Artificial Sequence: Synthetic oligonucleotide
cacctgcgtggagtggctccgca

SEQ ID NO: 368514 - DNA, 26 bp, Artificial Sequence
  Description of Artificial Sequence: Synthetic oligonucleotide
acctgcgtggagtggctccgcagata

SEQ ID NO: 368515 - DNA, 25 bp, Artificial Sequence
  Description of Artificial Sequence: Synthetic oligonucleotide
cctgcgtggagtggctccgcagata

SEQ ID NO: 368516 - DNA, 31 bp, Artificial Sequence; identical to SEQ ID NO: 18040
  Description of Artificial Sequence: Synthetic oligonucleotide

SEQ ID NO: 368517 - DNA, 32 bp, Artificial Sequence; identical to SEQ ID NO: 18041
  Description of Artificial Sequence: Synthetic oligonucleotide

SEQ ID NO: 368518 - DNA, 32 bp, Artificial Sequence; identical to SEQ ID NO: 18042
  Description of Artificial Sequence: Synthetic oligonucleotide

SEQ ID NO: 368519 - DNA, 31 bp, Artificial Sequence; identical to SEQ ID NO: 18043
  Description of Artificial Sequence: Synthetic oligonucleotide

SEQ ID NO: 368520 - DNA, 31 bp, Artificial Sequence; identical to SEQ ID NO: 18044
  Description of Artificial Sequence: Synthetic oligonucleotide

SEQ ID NO: 368521 - DNA, 30 bp, Artificial Sequence; identical to SEQ ID NO: 18045
  Description of Artificial Sequence: Synthetic oligonucleotide

SEQ ID NO: 368522 - DNA, 30 bp, Artificial Sequence; identical to SEQ ID NO: 18046
  Description of Artificial Sequence: Synthetic oligonucleotide

SEQ ID NO: 368523 - DNA, 30 bp, Artificial Sequence; identical to SEQ ID NO: 18047
  Description of Artificial Sequence: Synthetic oligonucleotide

SEQ ID NO: 368524 - DNA, 29 bp, Artificial Sequence
  Description of Artificial Sequence: Synthetic oligonucleotide
tgaggtatttcaccacatccgtctcccgg

SEQ ID NO: 368525 - DNA, 28 bp, Artificial Sequence
  Description of Artificial Sequence: Synthetic oligonucleotide
gaggtatttcaccacatccgtctcccgg

SEQ ID NO: 368526 - DNA, 28 bp, Artificial Sequence
  Description of Artificial Sequence: Synthetic oligonucleotide
aggtatttcaccacatccgtctcccggc

SEQ ID NO: 368527 - DNA, 27 bp, Artificial Sequence
  Description of Artificial Sequence: Synthetic oligonucleotide
ggtatttcaccacatccgtctcccggc

SEQ ID NO: 368528 - DNA, 27 bp, Artificial Sequence
  Description of Artificial Sequence: Synthetic oligonucleotide
gtatttcaccacatccgtctcccggcc

SEQ ID NO: 368529 - DNA, 27 bp, Artificial Sequence
  Description of Artificial Sequence: Synthetic oligonucleotide
tatttcaccacatccgtctcccggccc

SEQ ID NO: 368530 - DNA, 26 bp, Artificial Sequence
  Description of Artificial Sequence: Synthetic oligonucleotide
atttcaccacatccgtctcccggccc

SEQ ID NO: 368531 - DNA, 25 bp, Artificial Sequence
  Description of Artificial Sequence: Synthetic oligonucleotide
tttcaccacatccgtctcccggccc

SEQ ID NO: 368532 - DNA, 24 bp, Artificial Sequence
  Description of Artificial Sequence: Synthetic oligonucleotide
ttcaccacatccgtctcccggccc

SEQ ID NO: 368533 - DNA, 23 bp, Artificial Sequence
  Description of Artificial Sequence: Synthetic oligonucleotide
tcaccacatccgtctcccggccc

SEQ ID NO: 368534 - DNA, 22 bp, Artificial Sequence
  Description of Artificial Sequence: Synthetic oligonucleotide
caccacatccgtctcccggccc

SEQ ID NO: 368535 - DNA, 22 bp, Artificial Sequence
  Description of Artificial Sequence: Synthetic oligonucleotide
accacatccgtctcccggcccg

SEQ ID NO: 368536 - DNA, 21 bp, Artificial Sequence
  Description of Artificial Sequence: Synthetic oligonucleotide
ccacatccgtctcccggcccg

SEQ ID NO: 368537 - DNA, 21 bp, Artificial Sequence
  Description of Artificial Sequence: Synthetic oligonucleotide
cacatccgtctcccggcccgg

SEQ ID NO: 368538 - DNA, 21 bp, Artificial Sequence
  Description of Artificial Sequence: Synthetic oligonucleotide
acatccgtctcccggcccggc

SEQ ID NO: 368539 - DNA, 20 bp, Artificial Sequence
  Description of Artificial Sequence: Synthetic oligonucleotide
catccgtctcccggcccggc

SEQ ID NO: 368540 - DNA, 20 bp, Artificial Sequence
  Description of Artificial Sequence: Synthetic oligonucleotide
atccgtctcccggcccggcc

SEQ ID NO: 368541 - DNA, 20 bp, Artificial Sequence
  Description of Artificial Sequence: Synthetic oligonucleotide
tccgtctcccggcccggcct

SEQ ID NO: 368542 - DNA, 20 bp, Artificial Sequence
  Description of Artificial Sequence: Synthetic oligonucleotide
ccgtctcccggcccggcctt

SEQ ID NO: 368543 - DNA, 20 bp, Artificial Sequence
  Description of Artificial Sequence: Synthetic oligonucleotide
cgtctcccggcccggccgtt

SEQ ID NO: 368544 - DNA, 20 bp, Artificial Sequence
  Description of Artificial Sequence: Synthetic oligonucleotide
gtctcccggcccggccgctt

SEQ ID NO: 368545 - DNA, 20 bp, Artificial Sequence
  Description of Artificial Sequence: Synthetic oligonucleotide
tctcccggcccggccgcgtt

SEQ ID NO: 368546 - DNA, 20 bp, Artificial Sequence
  Description of Artificial Sequence: Synthetic oligonucleotide
ctcccggcccggccgcgttt

SEQ ID NO: 368547 - DNA, 30 bp, Artificial Sequence; identical to SEQ ID NO: 18071
  Description of Artificial Sequence: Synthetic oligonucleotide

SEQ ID NO: 368548 - DNA, 30 bp, Artificial Sequence; identical to SEQ ID NO: 18072
  Description of Artificial Sequence: Synthetic oligonucleotide

SEQ ID NO: 368549 - DNA, 30 bp, Artificial Sequence; identical to SEQ ID NO: 18073
  Description of Artificial Sequence: Synthetic oligonucleotide

SEQ ID NO: 368550 - DNA, 30 bp, Artificial Sequence; identical to SEQ ID NO: 18074
  Description of Artificial Sequence: Synthetic oligonucleotide

SEQ ID NO: 368551 - DNA, 31 bp, Artificial Sequence; identical to SEQ ID NO: 18075
  Description of Artificial Sequence: Synthetic oligonucleotide

SEQ ID NO: 368552 - DNA, 31 bp, Artificial Sequence; identical to SEQ ID NO: 18076
  Description of Artificial Sequence: Synthetic oligonucleotide

SEQ ID NO: 368553 - DNA, 30 bp, Artificial Sequence; identical to SEQ ID NO: 18077
  Description of Artificial Sequence: Synthetic oligonucleotide

SEQ ID NO: 368554 - DNA, 29 bp, Artificial Sequence
  Description of Artificial Sequence: Synthetic oligonucleotide
ctcacaccatccagatgatgtacggctgc

SEQ ID NO: 368555 - DNA, 29 bp, Artificial Sequence
  Description of Artificial Sequence: Synthetic oligonucleotide
tcacaccatccagatgatgtacggctgcg

SEQ ID NO: 368556 - DNA, 28 bp, Artificial Sequence
  Description of Artificial Sequence: Synthetic oligonucleotide
cacaccatccagatgatgtacggctgcg

SEQ ID NO: 368557 - DNA, 29 bp, Artificial Sequence
  Description of Artificial Sequence: Synthetic oligonucleotide
acaccatccagatgatgtacggctgcgac

SEQ ID NO: 368558 - DNA, 28 bp, Artificial Sequence
  Description of Artificial Sequence: Synthetic oligonucleotide
caccatccagatgatgtacggctgcgac

SEQ ID NO: 368559 - DNA, 28 bp, Artificial Sequence
  Description of Artificial Sequence: Synthetic oligonucleotide
accatccagatgatgtacggctgcgacg

SEQ ID NO: 368560 - DNA, 27 bp, Artificial Sequence
  Description of Artificial Sequence: Synthetic oligonucleotide
ccatccagatgatgtacggctgcgacg

SEQ ID NO: 368561 - DNA, 28 bp, Artificial Sequence
  Description of Artificial Sequence: Synthetic oligonucleotide
catccagatgatgtacggctgcgacgtg

SEQ ID NO: 368562 - DNA, 28 bp, Artificial Sequence
  Description of Artificial Sequence: Synthetic oligonucleotide
atccagatgatgtacggctgcgacgtgg

SEQ ID NO: 368563 - DNA, 27 bp, Artificial Sequence
  Description of Artificial Sequence: Synthetic oligonucleotide
tccagatgatgtacggctgcgacgtgg

SEQ ID NO: 368564 - DNA, 26 bp, Artificial Sequence
  Description of Artificial Sequence: Synthetic oligonucleotide
ccagatgatgtacggctgcgacgtgg

SEQ ID NO: 368565 - DNA, 26 bp, Artificial Sequence
  Description of Artificial Sequence: Synthetic oligonucleotide
cagatgatgtacggctgcgacgtggg

SEQ ID NO: 368566 - DNA, 27 bp, Artificial Sequence
  Description of Artificial Sequence: Synthetic oligonucleotide
agatgatgtacggctgcgacgtggggt

SEQ ID NO: 368567 - DNA, 26 bp, Artificial Sequence
  Description of Artificial Sequence: Synthetic oligonucleotide
gatgatgtacggctgcgacgtggggt

SEQ ID NO: 368568 - DNA, 26 bp, Artificial Sequence
  Description of Artificial Sequence: Synthetic oligonucleotide
atgatgtacggctgcgacgtggggtc

SEQ ID NO: 368569 - DNA, 25 bp, Artificial Sequence
  Description of Artificial Sequence: Synthetic oligonucleotide
tgatgtacggctgcgacgtggggtc

SEQ ID NO: 368570 - DNA, 24 bp, Artificial Sequence
  Description of Artificial Sequence: Synthetic oligonucleotide
gatgtacggctgcgacgtggggtc

SEQ ID NO: 368571 - DNA, 24 bp, Artificial Sequence
  Description of Artificial Sequence: Synthetic oligonucleotide
atgtacggctgcgacgtggggtcg

SEQ ID NO: 368572 - DNA, 23 bp, Artificial Sequence
  Description of Artificial Sequence: Synthetic oligonucleotide
tgtacggctgcgacgtggggtcg

SEQ ID NO: 368573 - DNA, 22 bp, Artificial Sequence
  Description of Artificial Sequence: Synthetic oligonucleotide
gtacggctgcgacgtggggtcg

SEQ ID NO: 368574 - DNA, 23 bp, Artificial Sequence
  Description of Artificial Sequence: Synthetic oligonucleotide
tacggctgcgacgtggggtcgga

SEQ ID NO: 368575 - DNA, 22 bp, Artificial Sequence
  Description of Artificial Sequence: Synthetic oligonucleotide
acggctgcgacgtggggtcgga

SEQ ID NO: 368576 - DNA, 21 bp, Artificial Sequence
  Description of Artificial Sequence: Synthetic oligonucleotide
cggctgcgacgtggggtcgga

SEQ ID NO: 368577 - DNA, 27 bp, Artificial Sequence
  Description of Artificial Sequence: Synthetic oligonucleotide
cagttcgtgcggtttgacagcgacgct

SEQ ID NO: 368578 - DNA, 27 bp, Artificial Sequence
  Description of Artificial Sequence: Synthetic oligonucleotide
agttcgtgcggtttgacagcgacgctg

SEQ ID NO: 368579 - DNA, 26 bp, Artificial Sequence
  Description of Artificial Sequence: Synthetic oligonucleotide
gttcgtgcggtttgacagcgacgctg

SEQ ID NO: 368580 - DNA, 26 bp, Artificial Sequence
  Description of Artificial Sequence: Synthetic oligonucleotide
ttcgtgcggtttgacagcgacgctgc

SEQ ID NO: 368581 - DNA, 25 bp, Artificial Sequence
  Description of Artificial Sequence: Synthetic oligonucleotide
tcgtgcggtttgacagcgacgctgc

SEQ ID NO: 368582 - DNA, 24 bp, Artificial Sequence
  Description of Artificial Sequence: Synthetic oligonucleotide
cgtgcggtttgacagcgacgctgc

SEQ ID NO: 368583 - DNA, 25 bp, Artificial Sequence
  Description of Artificial Sequence: Synthetic oligonucleotide
gtgcggtttgacagcgacgctgcga

SEQ ID NO: 368584 - DNA, 25 bp, Artificial Sequence
  Description of Artificial Sequence: Synthetic oligonucleotide
tgcggtttgacagcgacgctgcgag

SEQ ID NO: 368585 - DNA, 24 bp, Artificial Sequence
  Description of Artificial Sequence: Synthetic oligonucleotide
gcggtttgacagcgacgctgcgag

SEQ ID NO: 368586 - DNA, 24 bp, Artificial Sequence
  Description of Artificial Sequence: Synthetic oligonucleotide
cggtttgacagcgacgctgcgagc

SEQ ID NO: 368587 - DNA, 25 bp, Artificial Sequence
  Description of Artificial Sequence: Synthetic oligonucleotide
ggtttgacagcgacgctgcgagcca

SEQ ID NO: 368588 - DNA, 26 bp, Artificial Sequence
  Description of Artificial Sequence: Synthetic oligonucleotide
gtttgacagcgacgctgcgagccaga

SEQ ID NO: 368589 - DNA, 26 bp, Artificial Sequence
  Description of Artificial Sequence: Synthetic oligonucleotide
tttgacagcgacgctgcgagccagag

SEQ ID NO: 368590 - DNA, 25 bp, Artificial Sequence
  Description of Artificial Sequence: Synthetic oligonucleotide
ttgacagcgacgctgcgagccagag

SEQ ID NO: 368591 - DNA, 24 bp, Artificial Sequence
  Description of Artificial Sequence: Synthetic oligonucleotide
tgacagcgacgctgcgagccagag

SEQ ID NO: 368592 - DNA, 30 bp, Artificial Sequence; identical to SEQ ID NO: 19097
  Description of Artificial Sequence: Synthetic oligonucleotide

SEQ ID NO: 368593 - DNA, 32 bp, Artificial Sequence; identical to SEQ ID NO: 19098
  Description of Artificial Sequence: Synthetic oligonucleotide

SEQ ID NO: 368594 - DNA, 32 bp, Artificial Sequence; identical to SEQ ID NO: 19099
  Description of Artificial Sequence: Synthetic oligonucleotide

SEQ ID NO: 368595 - DNA, 33 bp, Artificial Sequence; identical to SEQ ID NO: 19100
  Description of Artificial Sequence: Synthetic oligonucleotide

SEQ ID NO: 368596 - DNA, 32 bp, Artificial Sequence; identical to SEQ ID NO: 19101
  Description of Artificial Sequence: Synthetic oligonucleotide

SEQ ID NO: 368597 - DNA, 31 bp, Artificial Sequence; identical to SEQ ID NO: 19102
  Description of Artificial Sequence: Synthetic oligonucleotide

SEQ ID NO: 368598 - DNA, 31 bp, Artificial Sequence; identical to SEQ ID NO: 19103
  Description of Artificial Sequence: Synthetic oligonucleotide

SEQ ID NO: 368599 - DNA, 32 bp, Artificial Sequence; identical to SEQ ID NO: 19104
  Description of Artificial Sequence: Synthetic oligonucleotide

SEQ ID NO: 368600 - DNA, 31 bp, Artificial Sequence; identical to SEQ ID NO: 19105
  Description of Artificial Sequence: Synthetic oligonucleotide

SEQ ID NO: 368601 - DNA, 31 bp, Artificial Sequence; identical to SEQ ID NO: 19106
  Description of Artificial Sequence: Synthetic oligonucleotide

SEQ ID NO: 368602 - DNA, 32 bp, Artificial Sequence; identical to SEQ ID NO: 19107
  Description of Artificial Sequence: Synthetic oligonucleotide

SEQ ID NO: 368603 - DNA, 32 bp, Artificial Sequence; identical to SEQ ID NO: 19108
  Description of Artificial Sequence: Synthetic oligonucleotide

SEQ ID NO: 368604 - DNA, 32 bp, Artificial Sequence; identical to SEQ ID NO: 19109
  Description of Artificial Sequence: Synthetic oligonucleotide

SEQ ID NO: 368605 - DNA, 31 bp, Artificial Sequence; identical to SEQ ID NO: 19110
  Description of Artificial Sequence: Synthetic oligonucleotide

SEQ ID NO: 368606 - DNA, 30 bp, Artificial Sequence; identical to SEQ ID NO: 19111
  Description of Artificial Sequence: Synthetic oligonucleotide

SEQ ID NO: 368607 - DNA, 30 bp, Artificial Sequence; identical to SEQ ID NO: 19112
  Description of Artificial Sequence: Synthetic oligonucleotide

SEQ ID NO: 368608 - DNA, 31 bp, Artificial Sequence; identical to SEQ ID NO: 19113
  Description of Artificial Sequence: Synthetic oligonucleotide

SEQ ID NO: 368609 - DNA, 30 bp, Artificial Sequence; identical to SEQ ID NO: 19114
  Description of Artificial Sequence: Synthetic oligonucleotide

SEQ ID NO: 368610 - DNA, 29 bp, Artificial Sequence
  Description of Artificial Sequence: Synthetic oligonucleotide
tacatcgctttgaacgaggacctgcgctc

SEQ ID NO: 368611 - DNA, 28 bp, Artificial Sequence
  Description of Artificial Sequence: Synthetic oligonucleotide
acatcgctttgaacgaggacctgcgctc

SEQ ID NO: 368612 - DNA, 27 bp, Artificial Sequence
  Description of Artificial Sequence: Synthetic oligonucleotide
catcgctttgaacgaggacctgcgctc

SEQ ID NO: 368613 - DNA, 29 bp, Artificial Sequence
  Description of Artificial Sequence: Synthetic oligonucleotide
atcgctttgaacgaggacctgcgctcttg

SEQ ID NO: 368614 - DNA, 28 bp, Artificial Sequence
  Description of Artificial Sequence: Synthetic oligonucleotide
tcgctttgaacgaggacctgcgctcttg

SEQ ID NO: 368615 - DNA, 27 bp, Artificial Sequence
  Description of Artificial Sequence: Synthetic oligonucleotide
cgctttgaacgaggacctgcgctcttg

SEQ ID NO: 368616 - DNA, 27 bp, Artificial Sequence
  Description of Artificial Sequence: Synthetic oligonucleotide
gctttgaacgaggacctgcgctcttgg

SEQ ID NO: 368617 - DNA, 28 bp, Artificial Sequence
  Description of Artificial Sequence: Synthetic oligonucleotide
ctttgaacgaggacctgcgctcttggac

SEQ ID NO: 368618 - DNA, 28 bp, Artificial Sequence
  Description of Artificial Sequence: Synthetic oligonucleotide
tttgaacgaggacctgcgctcttggacc

SEQ ID NO: 368619 - DNA, 33 bp, Artificial Sequence
  Description of Artificial Sequence: Synthetic oligonucleotide
cggttctcacaccatccagatgatgtatggttg

SEQ ID NO: 368620 - DNA, 33 bp, Artificial Sequence
  Description of Artificial Sequence: Synthetic oligonucleotide
ggttctcacaccatccagatgatgtatggttgc

SEQ ID NO: 368621 - DNA, 33 bp, Artificial Sequence
  Description of Artificial Sequence: Synthetic oligonucleotide
gttctcacaccatccagatgatgtatggttgcg

SEQ ID NO: 368622 - DNA, 34 bp, Artificial Sequence
  Description of Artificial Sequence: Synthetic oligonucleotide
ttctcacaccatccagatgatgtatggttgcgac

SEQ ID NO: 368623 - DNA, 33 bp, Artificial Sequence
  Description of Artificial Sequence: Synthetic oligonucleotide
tctcacaccatccagatgatgtatggttgcgac

SEQ ID NO: 368624 - DNA, 32 bp, Artificial Sequence
  Description of Artificial Sequence: Synthetic oligonucleotide
ctcacaccatccagatgatgtatggttgcgac

SEQ ID NO: 368625 - DNA, 32 bp, Artificial Sequence
  Description of Artificial Sequence: Synthetic oligonucleotide
tcacaccatccagatgatgtatggttgcgacg

SEQ ID NO: 368626 - DNA, 31 bp, Artificial Sequence
  Description of Artificial Sequence: Synthetic oligonucleotide
cacaccatccagatgatgtatggttgcgacg

SEQ ID NO: 368627 - DNA, 32 bp, Artificial Sequence
  Description of Artificial Sequence: Synthetic oligonucleotide
acaccatccagatgatgtatggttgcgacgtg

SEQ ID NO: 368628 - DNA, 31 bp, Artificial Sequence
  Description of Artificial Sequence: Synthetic oligonucleotide
caccatccagatgatgtatggttgcgacgtg

SEQ ID NO: 368629 - DNA, 31 bp, Artificial Sequence
  Description of Artificial Sequence: Synthetic oligonucleotide
accatccagatgatgtatggttgcgacgtgg

SEQ ID NO: 368630 - DNA, 30 bp, Artificial Sequence
  Description of Artificial Sequence: Synthetic oligonucleotide
ccatccagatgatgtatggttgcgacgtgg

SEQ ID NO: 368631 - DNA, 30 bp, Artificial Sequence
  Description of Artificial Sequence: Synthetic oligonucleotide
catccagatgatgtatggttgcgacgtggg

SEQ ID NO: 368632 - DNA, 30 bp, Artificial Sequence
  Description of Artificial Sequence: Synthetic oligonucleotide
atccagatgatgtatggttgcgacgtgggg

SEQ ID NO: 368633 - DNA, 29 bp, Artificial Sequence
  Description of Artificial Sequence: Synthetic oligonucleotide
tccagatgatgtatggttgcgacgtgggg

SEQ ID NO: 368634 - DNA, 28 bp, Artificial Sequence
  Description of Artificial Sequence: Synthetic oligonucleotide
ccagatgatgtatggttgcgacgtgggg

SEQ ID NO: 368635 - DNA, 29 bp, Artificial Sequence
  Description of Artificial Sequence: Synthetic oligonucleotide
cagatgatgtatggttgcgacgtggggtc

SEQ ID NO: 368636 - DNA, 29 bp, Artificial Sequence
  Description of Artificial Sequence: Synthetic oligonucleotide
agatgatgtatggttgcgacgtggggtcg

SEQ ID NO: 368637 - DNA, 28 bp, Artificial Sequence
  Description of Artificial Sequence: Synthetic oligonucleotide
gatgatgtatggttgcgacgtggggtcg

SEQ ID NO: 368638 - DNA, 28 bp, Artificial Sequence
  Description of Artificial Sequence: Synthetic oligonucleotide
atgatgtatggttgcgacgtggggtcgg

SEQ ID NO: 368639 - DNA, 27 bp, Artificial Sequence
  Description of Artificial Sequence: Synthetic oligonucleotide
tgatgtatggttgcgacgtggggtcgg

SEQ ID NO: 368640 - DNA, 27 bp, Artificial Sequence
  Description of Artificial Sequence: Synthetic oligonucleotide
gatgtatggttgcgacgtggggtcgga

SEQ ID NO: 368641 - DNA, 27 bp, Artificial Sequence
  Description of Artificial Sequence: Synthetic oligonucleotide
atgtatggttgcgacgtggggtcggac

SEQ ID NO: 368642 - DNA, 26 bp, Artificial Sequence
  Description of Artificial Sequence: Synthetic oligonucleotide
tgtatggttgcgacgtggggtcggac

SEQ ID NO: 368643 - DNA, 25 bp, Artificial Sequence
  Description of Artificial Sequence: Synthetic oligonucleotide
gtatggttgcgacgtggggtcggac

SEQ ID NO: 368644 - DNA, 25 bp, Artificial Sequence
  Description of Artificial Sequence: Synthetic oligonucleotide
tatggttgcgacgtggggtcggacg

SEQ ID NO: 368645 - DNA, 24 bp, Artificial Sequence
  Description of Artificial Sequence: Synthetic oligonucleotide
atggttgcgacgtggggtcggacg

SEQ ID NO: 368646 - DNA, 28 bp, Artificial Sequence
  Description of Artificial Sequence: Synthetic oligonucleotide
gaaggcggtgtatggattggggagtcac

SEQ ID NO: 368647 - DNA, 29 bp, Artificial Sequence
  Description of Artificial Sequence: Synthetic oligonucleotide
aaggcggtgtatggattggggagtcacag

SEQ ID NO: 368648 - DNA, 28 bp, Artificial Sequence
  Description of Artificial Sequence: Synthetic oligonucleotide
aggcggtgtatggattggggagtcacag

SEQ ID NO: 368649 - DNA, 27 bp, Artificial Sequence
  Description of Artificial Sequence: Synthetic oligonucleotide
ggcggtgtatggattggggagtcacag

SEQ ID NO: 368650 - DNA, 27 bp, Artificial Sequence
  Description of Artificial Sequence: Synthetic oligonucleotide
gcggtgtatggattggggagtcacagc

SEQ ID NO: 368651 - DNA, 27 bp, Artificial Sequence
  Description of Artificial Sequence: Synthetic oligonucleotide
cggtgtatggattggggagtcacagcc

SEQ ID NO: 368652 - DNA, 29 bp, Artificial Sequence
  Description of Artificial Sequence: Synthetic oligonucleotide
ggtgtatggattggggagtcacagccttg

SEQ ID NO: 368653 - DNA, 29 bp, Artificial Sequence
  Description of Artificial Sequence: Synthetic oligonucleotide
gtgtatggattggggagtcacagccttgg

SEQ ID NO: 368654 - DNA, 29 bp, Artificial Sequence
  Description of Artificial Sequence: Synthetic oligonucleotide
tgtatggattggggagtcacagccttggg

SEQ ID NO: 368655 - DNA, 28 bp, Artificial Sequence
  Description of Artificial Sequence: Synthetic oligonucleotide
gtatggattggggagtcacagccttggg

SEQ ID NO: 368656 - DNA, 28 bp, Artificial Sequence
  Description of Artificial Sequence: Synthetic oligonucleotide
tatggattggggagtcacagccttgggg

SEQ ID NO: 368657 - DNA, 27 bp, Artificial Sequence
  Description of Artificial Sequence: Synthetic oligonucleotide
atggattggggagtcacagccttgggg

SEQ ID NO: 368658 - DNA, 27 bp, Artificial Sequence
  Description of Artificial Sequence: Synthetic oligonucleotide
tggattggggagtcacagccttgggga

SEQ ID NO: 368659 - DNA, 27 bp, Artificial Sequence
  Description of Artificial Sequence: Synthetic oligonucleotide
ggattggggagtcacagccttggggat

SEQ ID NO: 368660 - DNA, 28 bp, Artificial Sequence
  Description of Artificial Sequence: Synthetic oligonucleotide
gattggggagtcacagccttggggattc

SEQ ID NO: 368661 - DNA, 28 bp, Artificial Sequence
  Description of Artificial Sequence: Synthetic oligonucleotide
attggggagtcacagccttggggattcc

SEQ ID NO: 368662 - DNA, 27 bp, Artificial Sequence
  Description of Artificial Sequence: Synthetic oligonucleotide
ttggggagtcacagccttggggattcc

SEQ ID NO: 368663 - DNA, 26 bp, Artificial Sequence
  Description of Artificial Sequence: Synthetic oligonucleotide
tggggagtcacagccttggggattcc

SEQ ID NO: 368664 - DNA, 25 bp, Artificial Sequence
  Description of Artificial Sequence: Synthetic oligonucleotide
ggggagtcacagccttggggattcc

SEQ ID NO: 368665 - DNA, 25 bp, Artificial Sequence
  Description of Artificial Sequence: Synthetic oligonucleotide
gggagtcacagccttggggattccc

SEQ ID NO: 368666 - DNA, 27 bp, Artificial Sequence
  Description of Artificial Sequence: Synthetic oligonucleotide
ggagtcacagccttggggattccccaa

SEQ ID NO: 368667 - DNA, 27 bp, Artificial Sequence
  Description of Artificial Sequence: Synthetic oligonucleotide
gagtcacagccttggggattccccaac

SEQ ID NO: 368668 - DNA, 28 bp, Artificial Sequence
  Description of Artificial Sequence: Synthetic oligonucleotide
agtcacagccttggggattccccaactc

SEQ ID NO: 368669 - DNA, 27 bp, Artificial Sequence
  Description of Artificial Sequence: Synthetic oligonucleotide
gtcacagccttggggattccccaactc

SEQ ID NO: 368670 - DNA, 27 bp, Artificial Sequence
  Description of Artificial Sequence: Synthetic oligonucleotide
tcacagccttggggattccccaactcc

SEQ ID NO: 368671 - DNA, 26 bp, Artificial Sequence
  Description of Artificial Sequence: Synthetic oligonucleotide
cacagccttggggattccccaactcc

SEQ ID NO: 368672 - DNA, 26 bp, Artificial Sequence
  Description of Artificial Sequence: Synthetic oligonucleotide
acagccttggggattccccaactccg

SEQ ID NO: 368673 - DNA, 24 bp, Artificial Sequence
  Description of Artificial Sequence: Synthetic oligonucleotide
gggcgccgtggatagagcaggaga

SEQ ID NO: 368674 - DNA, 24 bp, Artificial Sequence
  Description of Artificial Sequence: Synthetic oligonucleotide
ggcgccgtggatagagcaggagag

SEQ ID NO: 368675 - DNA, 24 bp, Artificial Sequence
  Description of Artificial Sequence: Synthetic oligonucleotide
gcgccgtggatagagcaggagagg

SEQ ID NO: 368676 - DNA, 24 bp, Artificial Sequence
  Description of Artificial Sequence: Synthetic oligonucleotide
cgccgtggatagagcaggagaggc

SEQ ID NO: 368677 - DNA, 25 bp, Artificial Sequence
  Description of Artificial Sequence: Synthetic oligonucleotide
gccgtggatagagcaggagaggcct

SEQ ID NO: 368678 - DNA, 26 bp, Artificial Sequence
  Description of Artificial Sequence: Synthetic oligonucleotide
ccgtggatagagcaggagaggcctga

SEQ ID NO: 368679 - DNA, 27 bp, Artificial Sequence
  Description of Artificial Sequence: Synthetic oligonucleotide
cgtggatagagcaggagaggcctgagt

SEQ ID NO: 368680 - DNA, 30 bp, Artificial Sequence; identical to SEQ ID NO: 1657
  Description of Artificial Sequence: Synthetic oligonucleotide

SEQ ID NO: 368681 - DNA, 30 bp, Artificial Sequence; identical to SEQ ID NO: 1658
  Description of Artificial Sequence: Synthetic oligonucleotide

SEQ ID NO: 368682 - DNA, 29 bp, Artificial Sequence
  Description of Artificial Sequence: Synthetic oligonucleotide
ggatagagcaggagaggcctgagtattgg

SEQ ID NO: 368683 - DNA, 29 bp, Artificial Sequence
  Description of Artificial Sequence: Synthetic oligonucleotide
gatagagcaggagaggcctgagtattggg

SEQ ID NO: 368684 - DNA, 30 bp, Artificial Sequence; identical to SEQ ID NO: 1661
  Description of Artificial Sequence: Synthetic oligonucleotide

SEQ ID NO: 368685 - DNA, 29 bp, Artificial Sequence
  Description of Artificial Sequence: Synthetic oligonucleotide
tagagcaggagaggcctgagtattgggac

SEQ ID NO: 368686 - DNA, 28 bp, Artificial Sequence
  Description of Artificial Sequence: Synthetic oligonucleotide
agagcaggagaggcctgagtattgggac

SEQ ID NO: 368687 - DNA, 27 bp, Artificial Sequence
  Description of Artificial Sequence: Synthetic oligonucleotide
gagcaggagaggcctgagtattgggac

SEQ ID NO: 368688 - DNA, 27 bp, Artificial Sequence
  Description of Artificial Sequence: Synthetic oligonucleotide
agcaggagaggcctgagtattgggacc

SEQ ID NO: 368689 - DNA, 27 bp, Artificial Sequence
  Description of Artificial Sequence: Synthetic oligonucleotide
gcaggagaggcctgagtattgggacca

SEQ ID NO: 368690 - DNA, 27 bp, Artificial Sequence
  Description of Artificial Sequence: Synthetic oligonucleotide
caggagaggcctgagtattgggaccag

SEQ ID NO: 368691 - DNA, 27 bp, Artificial Sequence
  Description of Artificial Sequence: Synthetic oligonucleotide
aggagaggcctgagtattgggaccagg

SEQ ID NO: 368692 - DNA, 27 bp, Artificial Sequence
  Description of Artificial Sequence: Synthetic oligonucleotide
ggagaggcctgagtattgggaccagga

SEQ ID NO: 368693 - DNA, 27 bp, Artificial Sequence
  Description of Artificial Sequence: Synthetic oligonucleotide
gagaggcctgagtattgggaccaggag

SEQ ID NO: 368694 - DNA, 28 bp, Artificial Sequence
  Description of Artificial Sequence: Synthetic oligonucleotide
agaggcctgagtattgggaccaggagac

SEQ ID NO: 368695 - DNA, 27 bp, Artificial Sequence
  Description of Artificial Sequence: Synthetic oligonucleotide
gaggcctgagtattgggaccaggagac

SEQ ID NO: 368696 - DNA, 28 bp, Artificial Sequence
  Description of Artificial Sequence: Synthetic oligonucleotide
aggcctgagtattgggaccaggagacac

SEQ ID NO: 368697 - DNA, 27 bp, Artificial Sequence
  Description of Artificial Sequence: Synthetic oligonucleotide
ggcctgagtattgggaccaggagacac

SEQ ID NO: 368698 - DNA, 27 bp, Artificial Sequence
  Description of Artificial Sequence: Synthetic oligonucleotide
gcctgagtattgggaccaggagacacg

SEQ ID NO: 368699 - DNA, 27 bp, Artificial Sequence
  Description of Artificial Sequence: Synthetic oligonucleotide
cctgagtattgggaccaggagacacgg

SEQ ID NO: 368700 - DNA, 30 bp, Artificial Sequence; identical to SEQ ID NO: 1677
  Description of Artificial Sequence: Synthetic oligonucleotide

SEQ ID NO: 368701 - DNA, 31 bp, Artificial Sequence; identical to SEQ ID NO: 1678
  Description of Artificial Sequence: Synthetic oligonucleotide

SEQ ID NO: 368702 - DNA, 23 bp, Artificial Sequence
  Description of Artificial Sequence: Synthetic oligonucleotide
acgggcgcttcctccgcgggtat

SEQ ID NO: 368703 - DNA, 22 bp, Artificial Sequence
  Description of Artificial Sequence: Synthetic oligonucleotide
cgggcgcttcctccgcgggtat

SEQ ID NO: 368704 - DNA, 24 bp, Artificial Sequence
  Description of Artificial Sequence: Synthetic oligonucleotide
gggcgcttcctccgcgggtatgaa

SEQ ID NO: 368705 - DNA, 25 bp, Artificial Sequence
  Description of Artificial Sequence: Synthetic oligonucleotide
ggcgcttcctccgcgggtatgaaca

SEQ ID NO: 368706 - DNA, 25 bp, Artificial Sequence
  Description of Artificial Sequence: Synthetic oligonucleotide
gcgcttcctccgcgggtatgaacag

SEQ ID NO: 368707 - DNA, 26 bp, Artificial Sequence
  Description of Artificial Sequence: Synthetic oligonucleotide
cgcttcctccgcgggtatgaacagca

SEQ ID NO: 368708 - DNA, 26 bp, Artificial Sequence
  Description of Artificial Sequence: Synthetic oligonucleotide
gcttcctccgcgggtatgaacagcac

SEQ ID NO: 368709 - DNA, 26 bp, Artificial Sequence
  Description of Artificial Sequence: Synthetic oligonucleotide
cttcctccgcgggtatgaacagcacg

SEQ ID NO: 368710 - DNA, 26 bp, Artificial Sequence
  Description of Artificial Sequence: Synthetic oligonucleotide
ttcctccgcgggtatgaacagcacgc

SEQ ID NO: 368711 - DNA, 25 bp, Artificial Sequence
  Description of Artificial Sequence: Synthetic oligonucleotide
tcctccgcgggtatgaacagcacgc

SEQ ID NO: 368712 - DNA, 24 bp, Artificial Sequence
  Description of Artificial Sequence: Synthetic oligonucleotide
cctccgcgggtatgaacagcacgc

SEQ ID NO: 368713 - DNA, 26 bp, Artificial Sequence
  Description of Artificial Sequence: Synthetic oligonucleotide
ctccgcgggtatgaacagcacgccta

SEQ ID NO: 368714 - DNA, 26 bp, Artificial Sequence
  Description of Artificial Sequence: Synthetic oligonucleotide
tccgcgggtatgaacagcacgcctac

SEQ ID NO: 368715 - DNA, 25 bp, Artificial Sequence
  Description of Artificial Sequence: Synthetic oligonucleotide
ccgcgggtatgaacagcacgcctac

SEQ ID NO: 368716 - DNA, 26 bp, Artificial Sequence
  Description of Artificial Sequence: Synthetic oligonucleotide
cgcgggtatgaacagcacgcctacga

SEQ ID NO: 368717 - DNA, 26 bp, Artificial Sequence
  Description of Artificial Sequence: Synthetic oligonucleotide
gcgggtatgaacagcacgcctacgac

SEQ ID NO: 368718 - DNA, 26 bp, Artificial Sequence
  Description of Artificial Sequence: Synthetic oligonucleotide
cgggtatgaacagcacgcctacgacg

SEQ ID NO: 368719 - DNA, 26 bp, Artificial Sequence
  Description of Artificial Sequence: Synthetic oligonucleotide
gggtatgaacagcacgcctacgacgg

SEQ ID NO: 368720 - DNA, 27 bp, Artificial Sequence
  Description of Artificial Sequence: Synthetic oligonucleotide
ggtatgaacagcacgcctacgacggca

SEQ ID NO: 368721 - DNA, 28 bp, Artificial Sequence
  Description of Artificial Sequence: Synthetic oligonucleotide
gtatgaacagcacgcctacgacggcaag

SEQ ID NO: 368722 - DNA, 28 bp, Artificial Sequence
  Description of Artificial Sequence: Synthetic oligonucleotide
tatgaacagcacgcctacgacggcaagg

SEQ ID NO: 368723 - DNA, 27 bp, Artificial Sequence
  Description of Artificial Sequence: Synthetic oligonucleotide
atgaacagcacgcctacgacggcaagg

SEQ ID NO: 368724 - DNA, 27 bp, Artificial Sequence
  Description of Artificial Sequence: Synthetic oligonucleotide
tgaacagcacgcctacgacggcaagga

SEQ ID NO: 368725 - DNA, 27 bp, Artificial Sequence
  Description of Artificial Sequence: Synthetic oligonucleotide
gaacagcacgcctacgacggcaaggat

SEQ ID NO: 368726 - DNA, 29 bp, Artificial Sequence
  Description of Artificial Sequence: Synthetic oligonucleotide
aacagcacgcctacgacggcaaggattac

SEQ ID NO: 368727 - DNA, 28 bp, Artificial Sequence
  Description of Artificial Sequence: Synthetic oligonucleotide
acagcacgcctacgacggcaaggattac

SEQ ID NO: 368728 - DNA, 27 bp, Artificial Sequence
  Description of Artificial Sequence: Synthetic oligonucleotide
cagcacgcctacgacggcaaggattac

SEQ ID NO: 368729 - DNA, 29 bp, Artificial Sequence
  Description of Artificial Sequence: Synthetic oligonucleotide
agcacgcctacgacggcaaggattacatc

SEQ ID NO: 368730 - DNA, 28 bp, Artificial Sequence
  Description of Artificial Sequence: Synthetic oligonucleotide
gcacgcctacgacggcaaggattacatc

SEQ ID NO: 368731 - DNA, 28 bp, Artificial Sequence
  Description of Artificial Sequence: Synthetic oligonucleotide
cacgcctacgacggcaaggattacatcg

SEQ ID NO: 368732 - DNA, 22 bp, Artificial Sequence
  Description of Artificial Sequence: Synthetic oligonucleotide
cgcaagtgggaggcggcccgtt

SEQ ID NO: 368733 - DNA, 22 bp, Artificial Sequence
  Description of Artificial Sequence: Synthetic oligonucleotide
gcaagtgggaggcggcccgttg

SEQ ID NO: 368734 - DNA, 22 bp, Artificial Sequence
  Description of Artificial Sequence: Synthetic oligonucleotide
caagtgggaggcggcccgttgg

SEQ ID NO: 368735 - DNA, 22 bp, Artificial Sequence
  Description of Artificial Sequence: Synthetic oligonucleotide
aagtgggaggcggcccgttggg

SEQ ID NO: 368736 - DNA, 21 bp, Artificial Sequence
  Description of Artificial Sequence: Synthetic oligonucleotide
agtgggaggcggcccgttggg

SEQ ID NO: 368737 - DNA, 20 bp, Artificial Sequence
  Description of Artificial Sequence: Synthetic oligonucleotide
gtgggaggcggcccgttggg

SEQ ID NO: 368738 - DNA, 20 bp, Artificial Sequence
  Description of Artificial Sequence: Synthetic oligonucleotide
tgggaggcggcccgttgggc

SEQ ID NO: 368739 - DNA, 20 bp, Artificial Sequence
  Description of Artificial Sequence: Synthetic oligonucleotide
gggaggcggcccgttgggct

SEQ ID NO: 368740 - DNA, 20 bp, Artificial Sequence
  Description of Artificial Sequence: Synthetic oligonucleotide
ggaggcggcccgttgggcgt

SEQ ID NO: 368741 - DNA, 20 bp, Artificial Sequence
  Description of Artificial Sequence: Synthetic oligonucleotide
gaggcggcccgttgggcgga

SEQ ID NO: 368742 - DNA, 20 bp, Artificial Sequence
  Description of Artificial Sequence: Synthetic oligonucleotide
aggcggcccgttgggcggag

SEQ ID NO: 368743 - DNA, 20 bp, Artificial Sequence
  Description of Artificial Sequence: Synthetic oligonucleotide
ggcggcccgttgggcggagt

SEQ ID NO: 368744 - DNA, 20 bp, Artificial Sequence
  Description of Artificial Sequence: Synthetic oligonucleotide
gcggcccgttgggcggagca

SEQ ID NO: 368745 - DNA, 22 bp, Artificial Sequence
  Description of Artificial Sequence: Synthetic oligonucleotide
cggcccgttgggcggagcagtt

SEQ ID NO: 368746 - DNA, 23 bp, Artificial Sequence
  Description of Artificial Sequence: Synthetic oligonucleotide
ggcccgttgggcggagcagttga

SEQ ID NO: 368747 - DNA, 24 bp, Artificial Sequence
  Description of Artificial Sequence: Synthetic oligonucleotide
gcccgttgggcggagcagttgaga

SEQ ID NO: 368748 - DNA, 24 bp, Artificial Sequence
  Description of Artificial Sequence: Synthetic oligonucleotide
cccgttgggcggagcagttgagag

SEQ ID NO: 368749 - DNA, 24 bp, Artificial Sequence
  Description of Artificial Sequence: Synthetic oligonucleotide
ccgttgggcggagcagttgagagc

SEQ ID NO: 368750 - DNA, 26 bp, Artificial Sequence
  Description of Artificial Sequence: Synthetic oligonucleotide
cgttgggcggagcagttgagagccta

SEQ ID NO: 368751 - DNA, 26 bp, Artificial Sequence
  Description of Artificial Sequence: Synthetic oligonucleotide
gttgggcggagcagttgagagcctac

SEQ ID NO: 368752 - DNA, 27 bp, Artificial Sequence
  Description of Artificial Sequence: Synthetic oligonucleotide
ttgggcggagcagttgagagcctacct

SEQ ID NO: 368753 - DNA, 26 bp, Artificial Sequence
  Description of Artificial Sequence: Synthetic oligonucleotide
tgggcggagcagttgagagcctacct

SEQ ID NO: 368754 - DNA, 25 bp, Artificial Sequence
  Description of Artificial Sequence: Synthetic oligonucleotide
gggcggagcagttgagagcctacct

SEQ ID NO: 368755 - DNA, 29 bp, Artificial Sequence
  Description of Artificial Sequence: Synthetic oligonucleotide
tgggcttctaccctgcggagatcacattg

SEQ ID NO: 368756 - DNA, 28 bp, Artificial Sequence
  Description of Artificial Sequence: Synthetic oligonucleotide
gggcttctaccctgcggagatcacattg

SEQ ID NO: 368757 - DNA, 29 bp, Artificial Sequence
  Description of Artificial Sequence: Synthetic oligonucleotide
ggcttctaccctgcggagatcacattgac

SEQ ID NO: 368758 - DNA, 29 bp, Artificial Sequence
  Description of Artificial Sequence: Synthetic oligonucleotide
gcttctaccctgcggagatcacattgacc

SEQ ID NO: 368759 - DNA, 30 bp, Artificial Sequence; identical to SEQ ID NO: 18329
  Description of Artificial Sequence: Synthetic oligonucleotide

SEQ ID NO: 368760 - DNA, 30 bp, Artificial Sequence; identical to SEQ ID NO: 18330
  Description of Artificial Sequence: Synthetic oligonucleotide

SEQ ID NO: 368761 - DNA, 29 bp, Artificial Sequence
  Description of Artificial Sequence: Synthetic oligonucleotide
tctaccctgcggagatcacattgacctgg

SEQ ID NO: 368762 - DNA, 28 bp, Artificial Sequence
  Description of Artificial Sequence: Synthetic oligonucleotide
ctaccctgcggagatcacattgacctgg

SEQ ID NO: 368763 - DNA, 28 bp, Artificial Sequence
  Description of Artificial Sequence: Synthetic oligonucleotide
taccctgcggagatcacattgacctggc

SEQ ID NO: 368764 - DNA, 27 bp, Artificial Sequence
  Description of Artificial Sequence: Synthetic oligonucleotide
accctgcggagatcacattgacctggc

SEQ ID NO: 368765 - DNA, 27 bp, Artificial Sequence
  Description of Artificial Sequence: Synthetic oligonucleotide
ccctgcggagatcacattgacctggca

SEQ ID NO: 368766 - DNA, 27 bp, Artificial Sequence
  Description of Artificial Sequence: Synthetic oligonucleotide
cctgcggagatcacattgacctggcag

SEQ ID NO: 368767 - DNA, 27 bp, Artificial Sequence
  Description of Artificial Sequence: Synthetic oligonucleotide
ctgcggagatcacattgacctggcagc

SEQ ID NO: 368768 - DNA, 27 bp, Artificial Sequence
  Description of Artificial Sequence: Synthetic oligonucleotide
tgcggagatcacattgacctggcagcg

SEQ ID NO: 368769 - DNA, 26 bp, Artificial Sequence
  Description of Artificial Sequence: Synthetic oligonucleotide
gcggagatcacattgacctggcagcg

SEQ ID NO: 368770 - DNA, 26 bp, Artificial Sequence
  Description of Artificial Sequence: Synthetic oligonucleotide
cggagatcacattgacctggcagcgg

SEQ ID NO: 368771 - DNA, 27 bp, Artificial Sequence
  Description of Artificial Sequence: Synthetic oligonucleotide
ggagatcacattgacctggcagcggga

SEQ ID NO: 368772 - DNA, 28 bp, Artificial Sequence
  Description of Artificial Sequence: Synthetic oligonucleotide
gagatcacattgacctggcagcgggatg

SEQ ID NO: 368773 - DNA, 28 bp, Artificial Sequence
  Description of Artificial Sequence: Synthetic oligonucleotide
agatcacattgacctggcagcgggatgg

SEQ ID NO: 368774 - DNA, 27 bp, Artificial Sequence
  Description of Artificial Sequence: Synthetic oligonucleotide
gatcacattgacctggcagcgggatgg

SEQ ID NO: 368775 - DNA, 27 bp, Artificial Sequence
  Description of Artificial Sequence: Synthetic oligonucleotide
atcacattgacctggcagcgggatggg

SEQ ID NO: 368776 - DNA, 26 bp, Artificial Sequence
  Description of Artificial Sequence: Synthetic oligonucleotide
tcacattgacctggcagcgggatggg

SEQ ID NO: 368777 - DNA, 25 bp, Artificial Sequence
  Description of Artificial Sequence: Synthetic oligonucleotide
cacattgacctggcagcgggatggg

SEQ ID NO: 368778 - DNA, 26 bp, Artificial Sequence
  Description of Artificial Sequence: Synthetic oligonucleotide
acattgacctggcagcgggatgggga

SEQ ID NO: 368779 - DNA, 25 bp, Artificial Sequence
  Description of Artificial Sequence: Synthetic oligonucleotide
cattgacctggcagcgggatgggga

SEQ ID NO: 368780 - DNA, 25 bp, Artificial Sequence
  Description of Artificial Sequence: Synthetic oligonucleotide
attgacctggcagcgggatggggag

SEQ ID NO: 368781 - DNA, 24 bp, Artificial Sequence
  Description of Artificial Sequence: Synthetic oligonucleotide
ttgacctggcagcgggatggggag

SEQ ID NO: 368782 - DNA, 24 bp, Artificial Sequence
  Description of Artificial Sequence: Synthetic oligonucleotide
gggaaggagacgctgcagcgcaca

SEQ ID NO: 368783 - DNA, 24 bp, Artificial Sequence
  Description of Artificial Sequence: Synthetic oligonucleotide
ggaaggagacgctgcagcgcacag

SEQ ID NO: 368784 - DNA, 23 bp, Artificial Sequence
  Description of Artificial Sequence: Synthetic oligonucleotide
acgtgcgtggagtggctccgcag

SEQ ID NO: 368785 - DNA, 22 bp, Artificial Sequence
  Description of Artificial Sequence: Synthetic oligonucleotide
cgtgcgtggagtggctccgcag

SEQ ID NO: 368786 - DNA, 24 bp, Artificial Sequence
  Description of Artificial Sequence: Synthetic oligonucleotide
gtgcgtggagtggctccgcaggta

SEQ ID NO: 368787 - DNA, 24 bp, Artificial Sequence
  Description of Artificial Sequence: Synthetic oligonucleotide
tgcgtggagtggctccgcaggtac

SEQ ID NO: 368788 - DNA, 23 bp, Artificial Sequence
  Description of Artificial Sequence: Synthetic oligonucleotide
gcgtggagtggctccgcaggtac

SEQ ID NO: 368789 - DNA, 24 bp, Artificial Sequence
  Description of Artificial Sequence: Synthetic oligonucleotide
cgtggagtggctccgcaggtacct

SEQ ID NO: 368790 - DNA, 24 bp, Artificial Sequence
  Description of Artificial Sequence: Synthetic oligonucleotide
gtggagtggctccgcaggtacctg

SEQ ID NO: 368791 - DNA, 25 bp, Artificial Sequence
  Description of Artificial Sequence: Synthetic oligonucleotide
tggagtggctccgcaggtacctgga

SEQ ID NO: 368792 - DNA, 24 bp, Artificial Sequence
  Description of Artificial Sequence: Synthetic oligonucleotide
ggagtggctccgcaggtacctgga

SEQ ID NO: 368793 - DNA, 26 bp, Artificial Sequence
  Description of Artificial Sequence: Synthetic oligonucleotide
gagtggctccgcaggtacctggagaa

SEQ ID NO: 368794 - DNA, 26 bp, Artificial Sequence
  Description of Artificial Sequence: Synthetic oligonucleotide
agtggctccgcaggtacctggagaac

SEQ ID NO: 368795 - DNA, 25 bp, Artificial Sequence
  Description of Artificial Sequence: Synthetic oligonucleotide
gtggctccgcaggtacctggagaac

SEQ ID NO: 368796 - DNA, 25 bp, Artificial Sequence
  Description of Artificial Sequence: Synthetic oligonucleotide
tggctccgcaggtacctggagaacg

SEQ ID NO: 368797 - DNA, 24 bp, Artificial Sequence
  Description of Artificial Sequence: Synthetic oligonucleotide
ggctccgcaggtacctggagaacg

SEQ ID NO: 368798 - DNA, 24 bp, Artificial Sequence
  Description of Artificial Sequence: Synthetic oligonucleotide
gctccgcaggtacctggagaacgg

SEQ ID NO: 368799 - DNA, 26 bp, Artificial Sequence
  Description of Artificial Sequence: Synthetic oligonucleotide
ctccgcaggtacctggagaacgggaa

SEQ ID NO: 368800 - DNA, 26 bp, Artificial Sequence
  Description of Artificial Sequence: Synthetic oligonucleotide
tccgcaggtacctggagaacgggaag

SEQ ID NO: 368801 - DNA, 25 bp, Artificial Sequence
  Description of Artificial Sequence: Synthetic oligonucleotide
ccgcaggtacctggagaacgggaag

SEQ ID NO: 368802 - DNA, 26 bp, Artificial Sequence
  Description of Artificial Sequence: Synthetic oligonucleotide
cgcaggtacctggagaacgggaagga

SEQ ID NO: 368803 - DNA, 27 bp, Artificial Sequence
  Description of Artificial Sequence: Synthetic oligonucleotide
gcaggtacctggagaacgggaaggaga

SEQ ID NO: 368804 - DNA, 27 bp, Artificial Sequence
  Description of Artificial Sequence: Synthetic oligonucleotide
caggtacctggagaacgggaaggagac

SEQ ID NO: 368805 - DNA, 27 bp, Artificial Sequence
  Description of Artificial Sequence: Synthetic oligonucleotide
aggtacctggagaacgggaaggagacg

SEQ ID NO: 368806 - DNA, 26 bp, Artificial Sequence
  Description of Artificial Sequence: Synthetic oligonucleotide
ggtacctggagaacgggaaggagacg

SEQ ID NO: 368807 - DNA, 27 bp, Artificial Sequence
  Description of Artificial Sequence: Synthetic oligonucleotide
gtacctggagaacgggaaggagacgct

SEQ ID NO: 368808 - DNA, 23 bp, Artificial Sequence
  Description of Artificial Sequence: Synthetic oligonucleotide
cgagccagaggatggagccgcgt

SEQ ID NO: 368809 - DNA, 23 bp, Artificial Sequence
  Description of Artificial Sequence: Synthetic oligonucleotide
gagccagaggatggagccgcgtg

SEQ ID NO: 368810 - DNA, 23 bp, Artificial Sequence
  Description of Artificial Sequence: Synthetic oligonucleotide
agccagaggatggagccgcgtgc

SEQ ID NO: 368811 - DNA, 22 bp, Artificial Sequence
  Description of Artificial Sequence: Synthetic oligonucleotide
gccagaggatggagccgcgtgc

SEQ ID NO: 368812 - DNA, 22 bp, Artificial Sequence
  Description of Artificial Sequence: Synthetic oligonucleotide
ccagaggatggagccgcgtgcg

SEQ ID NO: 368813 - DNA, 22 bp, Artificial Sequence
  Description of Artificial Sequence: Synthetic oligonucleotide
cagaggatggagccgcgtgcgc

SEQ ID NO: 368814 - DNA, 22 bp, Artificial Sequence
  Description of Artificial Sequence: Synthetic oligonucleotide
agaggatggagccgcgtgcgcc

SEQ ID NO: 368815 - DNA, 21 bp, Artificial Sequence
  Description of Artificial Sequence: Synthetic oligonucleotide
gaggatggagccgcgtgcgcc

SEQ ID NO: 368816 - DNA, 22 bp, Artificial Sequence
  Description of Artificial Sequence: Synthetic oligonucleotide
aggatggagccgcgtgcgccgt

SEQ ID NO: 368817 - DNA, 21 bp, Artificial Sequence
  Description of Artificial Sequence: Synthetic oligonucleotide
ggatggagccgcgtgcgccgt

SEQ ID NO: 368818 - DNA, 21 bp, Artificial Sequence
  Description of Artificial Sequence: Synthetic oligonucleotide
gatggagccgcgtgcgccgtg

SEQ ID NO: 368819 - DNA, 24 bp, Artificial Sequence
  Description of Artificial Sequence: Synthetic oligonucleotide
atggagccgcgtgcgccgtggata

SEQ ID NO: 368820 - DNA, 23 bp, Artificial Sequence
  Description of Artificial Sequence: Synthetic oligonucleotide
tggagccgcgtgcgccgtggata

SEQ ID NO: 368821 - DNA, 22 bp, Artificial Sequence
  Description of Artificial Sequence: Synthetic oligonucleotide
ggagccgcgtgcgccgtggata

SEQ ID NO: 368822 - DNA, 23 bp, Artificial Sequence
  Description of Artificial Sequence: Synthetic oligonucleotide
gagccgcgtgcgccgtggataga

SEQ ID NO: 368823 - DNA, 23 bp, Artificial Sequence
  Description of Artificial Sequence: Synthetic oligonucleotide
agccgcgtgcgccgtggatagag

SEQ ID NO: 368824 - DNA, 22 bp, Artificial Sequence
  Description of Artificial Sequence: Synthetic oligonucleotide
gccgcgtgcgccgtggatagag

SEQ ID NO: 368825 - DNA, 23 bp, Artificial Sequence
  Description of Artificial Sequence: Synthetic oligonucleotide
ccgcgtgcgccgtggatagagca

SEQ ID NO: 368826 - DNA, 23 bp, Artificial Sequence
  Description of Artificial Sequence: Synthetic oligonucleotide
cgcgtgcgccgtggatagagcag

SEQ ID NO: 368827 - DNA, 24 bp, Artificial Sequence
  Description of Artificial Sequence: Synthetic oligonucleotide
gcgtgcgccgtggatagagcagga

SEQ ID NO: 368828 - DNA, 25 bp, Artificial Sequence
  Description of Artificial Sequence: Synthetic oligonucleotide
cgtgcgccgtggatagagcaggaga

SEQ ID NO: 368829 - DNA, 25 bp, Artificial Sequence
  Description of Artificial Sequence: Synthetic oligonucleotide
gtgcgccgtggatagagcaggagag

SEQ ID NO: 368830 - DNA, 25 bp, Artificial Sequence
  Description of Artificial Sequence: Synthetic oligonucleotide
tgcgccgtggatagagcaggagagg

SEQ ID NO: 368831 - DNA, 21 bp, Artificial Sequence
  Description of Artificial Sequence: Synthetic oligonucleotide
gcaagtgggaggcggcccgtc

SEQ ID NO: 368832 - DNA, 21 bp, Artificial Sequence
  Description of Artificial Sequence: Synthetic oligonucleotide
caagtgggaggcggcccgtcg

SEQ ID NO: 368833 - DNA, 21 bp, Artificial Sequence
  Description of Artificial Sequence: Synthetic oligonucleotide
aagtgggaggcggcccgtcgg

SEQ ID NO: 368834 - DNA, 20 bp, Artificial Sequence
  Description of Artificial Sequence: Synthetic oligonucleotide
agtgggaggcggcccgtcgg

SEQ ID NO: 368835 - DNA, 20 bp, Artificial Sequence
  Description of Artificial Sequence: Synthetic oligonucleotide
gtgggaggcggcccgtcggt

SEQ ID NO: 368836 - DNA, 20 bp, Artificial Sequence
  Description of Artificial Sequence: Synthetic oligonucleotide
tgggaggcggcccgtcgggt

SEQ ID NO: 368837 - DNA, 20 bp, Artificial Sequence
  Description of Artificial Sequence: Synthetic oligonucleotide
gggaggcggcccgtcgggtt

SEQ ID NO: 368838 - DNA, 20 bp, Artificial Sequence
  Description of Artificial Sequence: Synthetic oligonucleotide
ggaggcggcccgtcgggctt

SEQ ID NO: 368839 - DNA, 20 bp, Artificial Sequence
  Description of Artificial Sequence: Synthetic oligonucleotide
gaggcggcccgtcgggcgtt

SEQ ID NO: 368840 - DNA, 20 bp, Artificial Sequence
  Description of Artificial Sequence: Synthetic oligonucleotide
aggcggcccgtcgggcggat

SEQ ID NO: 368841 - DNA, 20 bp, Artificial Sequence
  Description of Artificial Sequence: Synthetic oligonucleotide
ggcggcccgtcgggcggatt

SEQ ID NO: 368842 - DNA, 20 bp, Artificial Sequence
  Description of Artificial Sequence: Synthetic oligonucleotide
gcggcccgtcgggcggagtt

SEQ ID NO: 368843 - DNA, 20 bp, Artificial Sequence
  Description of Artificial Sequence: Synthetic oligonucleotide
cggcccgtcgggcggagcat

SEQ ID NO: 368844 - DNA, 21 bp, Artificial Sequence
  Description of Artificial Sequence: Synthetic oligonucleotide
ggcccgtcgggcggagcagtt

SEQ ID NO: 368845 - DNA, 22 bp, Artificial Sequence
  Description of Artificial Sequence: Synthetic oligonucleotide
gcccgtcgggcggagcagttga

SEQ ID NO: 368846 - DNA, 23 bp, Artificial Sequence
  Description of Artificial Sequence: Synthetic oligonucleotide
cccgtcgggcggagcagttgaga

SEQ ID NO: 368847 - DNA, 23 bp, Artificial Sequence
  Description of Artificial Sequence: Synthetic oligonucleotide
ccgtcgggcggagcagttgagag

SEQ ID NO: 368848 - DNA, 23 bp, Artificial Sequence
  Description of Artificial Sequence: Synthetic oligonucleotide
cgtcgggcggagcagttgagagc

SEQ ID NO: 368849 - DNA, 25 bp, Artificial Sequence
  Description of Artificial Sequence: Synthetic oligonucleotide
gtcgggcggagcagttgagagccta

SEQ ID NO: 368850 - DNA, 25 bp, Artificial Sequence
  Description of Artificial Sequence: Synthetic oligonucleotide
tcgggcggagcagttgagagcctac

SEQ ID NO: 368851 - DNA, 24 bp, Artificial Sequence
  Description of Artificial Sequence: Synthetic oligonucleotide
cgggcggagcagttgagagcctac

SEQ ID NO: 368852 - DNA, 26 bp, Artificial Sequence
  Description of Artificial Sequence: Synthetic oligonucleotide
accagacccaggacacggagctcgtt

SEQ ID NO: 368853 - DNA, 25 bp, Artificial Sequence
  Description of Artificial Sequence: Synthetic oligonucleotide
ccagacccaggacacggagctcgtt

SEQ ID NO: 368854 - DNA, 26 bp, Artificial Sequence
  Description of Artificial Sequence: Synthetic oligonucleotide
cagacccaggacacggagctcgttga

SEQ ID NO: 368855 - DNA, 27 bp, Artificial Sequence
  Description of Artificial Sequence: Synthetic oligonucleotide
agacccaggacacggagctcgttgaga

SEQ ID NO: 368856 - DNA, 26 bp, Artificial Sequence
  Description of Artificial Sequence: Synthetic oligonucleotide
gacccaggacacggagctcgttgaga

SEQ ID NO: 368857 - DNA, 26 bp, Artificial Sequence
  Description of Artificial Sequence: Synthetic oligonucleotide
acccaggacacggagctcgttgagac

SEQ ID NO: 368858 - DNA, 25 bp, Artificial Sequence
  Description of Artificial Sequence: Synthetic oligonucleotide
cccaggacacggagctcgttgagac

SEQ ID NO: 368859 - DNA, 26 bp, Artificial Sequence
  Description of Artificial Sequence: Synthetic oligonucleotide
ccaggacacggagctcgttgagacca

SEQ ID NO: 368860 - DNA, 26 bp, Artificial Sequence
  Description of Artificial Sequence: Synthetic oligonucleotide
caggacacggagctcgttgagaccag

SEQ ID NO: 368861 - DNA, 26 bp, Artificial Sequence
  Description of Artificial Sequence: Synthetic oligonucleotide
aggacacggagctcgttgagaccagg

SEQ ID NO: 368862 - DNA, 25 bp, Artificial Sequence
  Description of Artificial Sequence: Synthetic oligonucleotide
ggacacggagctcgttgagaccagg

SEQ ID NO: 368863 - DNA, 25 bp, Artificial Sequence
  Description of Artificial Sequence: Synthetic oligonucleotide
gacacggagctcgttgagaccaggc

SEQ ID NO: 368864 - DNA, 26 bp, Artificial Sequence
  Description of Artificial Sequence: Synthetic oligonucleotide
acacggagctcgttgagaccaggcct

SEQ ID NO: 368865 - DNA, 25 bp, Artificial Sequence
  Description of Artificial Sequence: Synthetic oligonucleotide
cacggagctcgttgagaccaggcct

SEQ ID NO: 368866 - DNA, 25 bp, Artificial Sequence
  Description of Artificial Sequence: Synthetic oligonucleotide
acggagctcgttgagaccaggcctg

SEQ ID NO: 368867 - DNA, 24 bp, Artificial Sequence
  Description of Artificial Sequence: Synthetic oligonucleotide
cggagctcgttgagaccaggcctg

SEQ ID NO: 368868 - DNA, 25 bp, Artificial Sequence
  Description of Artificial Sequence: Synthetic oligonucleotide
ggagctcgttgagaccaggcctgca

SEQ ID NO: 368869 - DNA, 25 bp, Artificial Sequence
  Description of Artificial Sequence: Synthetic oligonucleotide
gagctcgttgagaccaggcctgcag

SEQ ID NO: 368870 - DNA, 25 bp, Artificial Sequence
  Description of Artificial Sequence: Synthetic oligonucleotide
agctcgttgagaccaggcctgcagg

SEQ ID NO: 368871 - DNA, 24 bp, Artificial Sequence
  Description of Artificial Sequence: Synthetic oligonucleotide
gctcgttgagaccaggcctgcagg

SEQ ID NO: 368872 - DNA, 24 bp, Artificial Sequence
  Description of Artificial Sequence: Synthetic oligonucleotide
ctcgttgagaccaggcctgcaggg

SEQ ID NO: 368873 - DNA, 26 bp, Artificial Sequence
  Description of Artificial Sequence: Synthetic oligonucleotide
tcgttgagaccaggcctgcaggggat

SEQ ID NO: 368874 - DNA, 25 bp, Artificial Sequence
  Description of Artificial Sequence: Synthetic oligonucleotide
cgttgagaccaggcctgcaggggat

SEQ ID NO: 368875 - DNA, 25 bp, Artificial Sequence
  Description of Artificial Sequence: Synthetic oligonucleotide
gttgagaccaggcctgcaggggatg

SEQ ID NO: 368876 - DNA, 27 bp, Artificial Sequence
  Description of Artificial Sequence: Synthetic oligonucleotide
ttgagaccaggcctgcaggggatggaa

SEQ ID NO: 368877 - DNA, 26 bp, Artificial Sequence
  Description of Artificial Sequence: Synthetic oligonucleotide
tgagaccaggcctgcaggggatggaa

SEQ ID NO: 368878 - DNA, 25 bp, Artificial Sequence
  Description of Artificial Sequence: Synthetic oligonucleotide
gccgtggatagagcaggagaggcca

SEQ ID NO: 368879 - DNA, 26 bp, Artificial Sequence
  Description of Artificial Sequence: Synthetic oligonucleotide
ccgtggatagagcaggagaggccaga

SEQ ID NO: 368880 - DNA, 27 bp, Artificial Sequence
  Description of Artificial Sequence: Synthetic oligonucleotide
cgtggatagagcaggagaggccagagt

SEQ ID NO: 368881 - DNA, 30 bp, Artificial Sequence; identical to SEQ ID NO: 18391
  Description of Artificial Sequence: Synthetic oligonucleotide

SEQ ID NO: 368882 - DNA, 30 bp, Artificial Sequence; identical to SEQ ID NO: 18392
  Description of Artificial Sequence: Synthetic oligonucleotide

SEQ ID NO: 368883 - DNA, 29 bp, Artificial Sequence
  Description of Artificial Sequence: Synthetic oligonucleotide
ggatagagcaggagaggccagagtattgg

SEQ ID NO: 368884 - DNA, 29 bp, Artificial Sequence
  Description of Artificial Sequence: Synthetic oligonucleotide
gatagagcaggagaggccagagtattggg

SEQ ID NO: 368885 - DNA, 30 bp, Artificial Sequence; identical to SEQ ID NO: 18395
  Description of Artificial Sequence: Synthetic oligonucleotide

SEQ ID NO: 368886 - DNA, 29 bp, Artificial Sequence
  Description of Artificial Sequence: Synthetic oligonucleotide
tagagcaggagaggccagagtattgggac

SEQ ID NO: 368887 - DNA, 28 bp, Artificial Sequence
  Description of Artificial Sequence: Synthetic oligonucleotide
agagcaggagaggccagagtattgggac

SEQ ID NO: 368888 - DNA, 27 bp, Artificial Sequence
  Description of Artificial Sequence: Synthetic oligonucleotide
gagcaggagaggccagagtattgggac

SEQ ID NO: 368889 - DNA, 27 bp, Artificial Sequence
  Description of Artificial Sequence: Synthetic oligonucleotide
agcaggagaggccagagtattgggacc

SEQ ID NO: 368890 - DNA, 27 bp, Artificial Sequence
  Description of Artificial Sequence: Synthetic oligonucleotide
gcaggagaggccagagtattgggacca

SEQ ID NO: 368891 - DNA, 27 bp, Artificial Sequence
  Description of Artificial Sequence: Synthetic oligonucleotide
caggagaggccagagtattgggaccag

SEQ ID NO: 368892 - DNA, 27 bp, Artificial Sequence
  Description of Artificial Sequence: Synthetic oligonucleotide
aggagaggccagagtattgggaccagg

SEQ ID NO: 368893 - DNA, 27 bp, Artificial Sequence
  Description of Artificial Sequence: Synthetic oligonucleotide
ggagaggccagagtattgggaccagga

SEQ ID NO: 368894 - DNA, 27 bp, Artificial Sequence
  Description of Artificial Sequence: Synthetic oligonucleotide
gagaggccagagtattgggaccaggag

SEQ ID NO: 368895 - DNA, 28 bp, Artificial Sequence
  Description of Artificial Sequence: Synthetic oligonucleotide
agaggccagagtattgggaccaggagac

SEQ ID NO: 368896 - DNA, 27 bp, Artificial Sequence
  Description of Artificial Sequence: Synthetic oligonucleotide
gaggccagagtattgggaccaggagac

SEQ ID NO: 368897 - DNA, 28 bp, Artificial Sequence
  Description of Artificial Sequence: Synthetic oligonucleotide
aggccagagtattgggaccaggagacac

SEQ ID NO: 368898 - DNA, 24 bp, Artificial Sequence
  Description of Artificial Sequence: Synthetic oligonucleotide
gacgggcgcttcctccgcggttat

SEQ ID NO: 368899 - DNA, 26 bp, Artificial Sequence
  Description of Artificial Sequence: Synthetic oligonucleotide
acgggcgcttcctccgcggttatgaa

SEQ ID NO: 368900 - DNA, 25 bp, Artificial Sequence
  Description of Artificial Sequence: Synthetic oligonucleotide
cgggcgcttcctccgcggttatgaa

SEQ ID NO: 368901 - DNA, 26 bp, Artificial Sequence
  Description of Artificial Sequence: Synthetic oligonucleotide
gggcgcttcctccgcggttatgaaca

SEQ ID NO: 368902 - DNA, 26 bp, Artificial Sequence
  Description of Artificial Sequence: Synthetic oligonucleotide
ggcgcttcctccgcggttatgaacag

SEQ ID NO: 368903 - DNA, 27 bp, Artificial Sequence
  Description of Artificial Sequence: Synthetic oligonucleotide
gcgcttcctccgcggttatgaacagca

SEQ ID NO: 368904 - DNA, 27 bp, Artificial Sequence
  Description of Artificial Sequence: Synthetic oligonucleotide
cgcttcctccgcggttatgaacagcac

SEQ ID NO: 368905 - DNA, 27 bp, Artificial Sequence
  Description of Artificial Sequence: Synthetic oligonucleotide
gcttcctccgcggttatgaacagcacg

SEQ ID NO: 368906 - DNA, 27 bp, Artificial Sequence
  Description of Artificial Sequence: Synthetic oligonucleotide
cttcctccgcggttatgaacagcacgc

SEQ ID NO: 368907 - DNA, 27 bp, Artificial Sequence
  Description of Artificial Sequence: Synthetic oligonucleotide
ttcctccgcggttatgaacagcacgcc

SEQ ID NO: 368908 - DNA, 27 bp, Artificial Sequence
  Description of Artificial Sequence: Synthetic oligonucleotide
tcctccgcggttatgaacagcacgcct

SEQ ID NO: 368909 - DNA, 27 bp, Artificial Sequence
  Description of Artificial Sequence: Synthetic oligonucleotide
cctccgcggttatgaacagcacgccta

SEQ ID NO: 368910 - DNA, 27 bp, Artificial Sequence
  Description of Artificial Sequence: Synthetic oligonucleotide
ctccgcggttatgaacagcacgcctac

SEQ ID NO: 368911 - DNA, 27 bp, Artificial Sequence
  Description of Artificial Sequence: Synthetic oligonucleotide
tccgcggttatgaacagcacgcctacg

SEQ ID NO: 368912 - DNA, 27 bp, Artificial Sequence
  Description of Artificial Sequence: Synthetic oligonucleotide
ccgcggttatgaacagcacgcctacga

SEQ ID NO: 368913 - DNA, 27 bp, Artificial Sequence
  Description of Artificial Sequence: Synthetic oligonucleotide
cgcggttatgaacagcacgcctacgac

SEQ ID NO: 368914 - DNA, 27 bp, Artificial Sequence
  Description of Artificial Sequence: Synthetic oligonucleotide
gcggttatgaacagcacgcctacgacg

SEQ ID NO: 368915 - DNA, 27 bp, Artificial Sequence
  Description of Artificial Sequence: Synthetic oligonucleotide
cggttatgaacagcacgcctacgacgg

SEQ ID NO: 368916 - DNA, 27 bp, Artificial Sequence
  Description of Artificial Sequence: Synthetic oligonucleotide
ggttatgaacagcacgcctacgacggc

SEQ ID NO: 368917 - DNA, 29 bp, Artificial Sequence
  Description of Artificial Sequence: Synthetic oligonucleotide
gttatgaacagcacgcctacgacggcaag

SEQ ID NO: 368918 - DNA, 29 bp, Artificial Sequence
  Description of Artificial Sequence: Synthetic oligonucleotide
ttatgaacagcacgcctacgacggcaagg

SEQ ID NO: 368919 - DNA, 20 bp, Artificial Sequence
  Description of Artificial Sequence: Synthetic oligonucleotide
ggcccgtcgggcggagcagt

SEQ ID NO: 368920 - DNA, 20 bp, Artificial Sequence
  Description of Artificial Sequence: Synthetic oligonucleotide
gcccgtcgggcggagcagct

SEQ ID NO: 368921 - DNA, 21 bp, Artificial Sequence
  Description of Artificial Sequence: Synthetic oligonucleotide
cccgtcgggcggagcagctga

SEQ ID NO: 368922 - DNA, 22 bp, Artificial Sequence
  Description of Artificial Sequence: Synthetic oligonucleotide
ccgtcgggcggagcagctgaga

SEQ ID NO: 368923 - DNA, 22 bp, Artificial Sequence
  Description of Artificial Sequence: Synthetic oligonucleotide
cgtcgggcggagcagctgagag

SEQ ID NO: 368924 - DNA, 22 bp, Artificial Sequence
  Description of Artificial Sequence: Synthetic oligonucleotide
gtcgggcggagcagctgagagc

SEQ ID NO: 368925 - DNA, 24 bp, Artificial Sequence
  Description of Artificial Sequence: Synthetic oligonucleotide
tcgggcggagcagctgagagccta

SEQ ID NO: 368926 - DNA, 23 bp, Artificial Sequence
  Description of Artificial Sequence: Synthetic oligonucleotide
cgggcggagcagctgagagccta

SEQ ID NO: 368927 - DNA, 23 bp, Artificial Sequence
  Description of Artificial Sequence: Synthetic oligonucleotide
gggcggagcagctgagagcctac

SEQ ID NO: 368928 - DNA, 26 bp, Artificial Sequence
  Description of Artificial Sequence: Synthetic oligonucleotide
gtggtgccttctggagaggagcagag

SEQ ID NO: 368929 - DNA, 24 bp, Artificial Sequence
  Description of Artificial Sequence: Synthetic oligonucleotide
cagtggagagccccgcttcatcgc

SEQ ID NO: 368930 - DNA, 24 bp, Artificial Sequence
  Description of Artificial Sequence: Synthetic oligonucleotide
agtggagagccccgcttcatcgcc

SEQ ID NO: 368931 - DNA, 23 bp, Artificial Sequence
  Description of Artificial Sequence: Synthetic oligonucleotide
gtggagagccccgcttcatcgcc

SEQ ID NO: 368932 - DNA, 24 bp, Artificial Sequence
  Description of Artificial Sequence: Synthetic oligonucleotide
tggagagccccgcttcatcgccgt

SEQ ID NO: 368933 - DNA, 26 bp, Artificial Sequence
  Description of Artificial Sequence: Synthetic oligonucleotide
tcatcgcagtgggctacgtggacgac

SEQ ID NO: 368934 - DNA, 25 bp, Artificial Sequence
  Description of Artificial Sequence: Synthetic oligonucleotide
catcgcagtgggctacgtggacgac

SEQ ID NO: 368935 - DNA, 25 bp, Artificial Sequence
  Description of Artificial Sequence: Synthetic oligonucleotide
atcgcagtgggctacgtggacgacg

SEQ ID NO: 368936 - DNA, 24 bp, Artificial Sequence
  Description of Artificial Sequence: Synthetic oligonucleotide
tcgcagtgggctacgtggacgacg

SEQ ID NO: 368937 - DNA, 23 bp, Artificial Sequence
  Description of Artificial Sequence: Synthetic oligonucleotide
cgcagtgggctacgtggacgacg

SEQ ID NO: 368938 - DNA, 23 bp, Artificial Sequence
  Description of Artificial Sequence: Synthetic oligonucleotide
gcagtgggctacgtggacgacgc

SEQ ID NO: 368939 - DNA, 23 bp, Artificial Sequence
  Description of Artificial Sequence: Synthetic oligonucleotide
cagtgggctacgtggacgacgcg

SEQ ID NO: 368940 - DNA, 24 bp, Artificial Sequence
  Description of Artificial Sequence: Synthetic oligonucleotide
agtgggctacgtggacgacgcgca

SEQ ID NO: 368941 - DNA, 23 bp, Artificial Sequence
  Description of Artificial Sequence: Synthetic oligonucleotide
gtgggctacgtggacgacgcgca

SEQ ID NO: 368942 - DNA, 25 bp, Artificial Sequence
  Description of Artificial Sequence: Synthetic oligonucleotide
tgggctacgtggacgacgcgcagtt

SEQ ID NO: 368943 - DNA, 24 bp, Artificial Sequence
  Description of Artificial Sequence: Synthetic oligonucleotide
gggctacgtggacgacgcgcagtt

SEQ ID NO: 368944 - DNA, 24 bp, Artificial Sequence
  Description of Artificial Sequence: Synthetic oligonucleotide
ggctacgtggacgacgcgcagttc

SEQ ID NO: 368945 - DNA, 25 bp, Artificial Sequence
  Description of Artificial Sequence: Synthetic oligonucleotide
gctacgtggacgacgcgcagttcgt

SEQ ID NO: 368946 - DNA, 25 bp, Artificial Sequence
  Description of Artificial Sequence: Synthetic oligonucleotide
ctacgtggacgacgcgcagttcgtg

SEQ ID NO: 368947 - DNA, 25 bp, Artificial Sequence
  Description of Artificial Sequence: Synthetic oligonucleotide
tacgtggacgacgcgcagttcgtgc

SEQ ID NO: 368948 - DNA, 24 bp, Artificial Sequence
  Description of Artificial Sequence: Synthetic oligonucleotide
acgtggacgacgcgcagttcgtgc

SEQ ID NO: 368949 - DNA, 23 bp, Artificial Sequence
  Description of Artificial Sequence: Synthetic oligonucleotide
cgtggacgacgcgcagttcgtgc

SEQ ID NO: 368950 - DNA, 23 bp, Artificial Sequence
  Description of Artificial Sequence: Synthetic oligonucleotide
gtggacgacgcgcagttcgtgcg

SEQ ID NO: 368951 - DNA, 25 bp, Artificial Sequence
  Description of Artificial Sequence: Synthetic oligonucleotide
tggacgacgcgcagttcgtgcggtt

SEQ ID NO: 368952 - DNA, 24 bp, Artificial Sequence
  Description of Artificial Sequence: Synthetic oligonucleotide
ggacgacgcgcagttcgtgcggtt

SEQ ID NO: 368953 - DNA, 24 bp, Artificial Sequence
  Description of Artificial Sequence: Synthetic oligonucleotide
gacgacgcgcagttcgtgcggttc

SEQ ID NO: 368954 - DNA, 25 bp, Artificial Sequence
  Description of Artificial Sequence: Synthetic oligonucleotide
acgacgcgcagttcgtgcggttcga

SEQ ID NO: 368955 - DNA, 24 bp, Artificial Sequence
  Description of Artificial Sequence: Synthetic oligonucleotide
cgacgcgcagttcgtgcggttcga

SEQ ID NO: 368956 - DNA, 25 bp, Artificial Sequence
  Description of Artificial Sequence: Synthetic oligonucleotide
gacgcgcagttcgtgcggttcgaca

SEQ ID NO: 368957 - DNA, 25 bp, Artificial Sequence
  Description of Artificial Sequence: Synthetic oligonucleotide
acgcgcagttcgtgcggttcgacag

SEQ ID NO: 368958 - DNA, 24 bp, Artificial Sequence
  Description of Artificial Sequence: Synthetic oligonucleotide
cgcgcagttcgtgcggttcgacag

SEQ ID NO: 368959 - DNA, 24 bp, Artificial Sequence
  Description of Artificial Sequence: Synthetic oligonucleotide
gcgcagttcgtgcggttcgacagc

SEQ ID NO: 368960 - DNA, 20 bp, Artificial Sequence
  Description of Artificial Sequence: Synthetic oligonucleotide
ctccgtgtcccggcccggca

SEQ ID NO: 368961 - DNA, 30 bp, Artificial Sequence; identical to SEQ ID NO: 18470
  Description of Artificial Sequence: Synthetic oligonucleotide

SEQ ID NO: 368962 - DNA, 29 bp, Artificial Sequence
  Description of Artificial Sequence: Synthetic oligonucleotide
ggccggttctcacaccatccagataatgc

SEQ ID NO: 368963 - DNA, 31 bp, Artificial Sequence; identical to SEQ ID NO: 18472
  Description of Artificial Sequence: Synthetic oligonucleotide

SEQ ID NO: 368964 - DNA, 31 bp, Artificial Sequence; identical to SEQ ID NO: 18473
  Description of Artificial Sequence: Synthetic oligonucleotide

SEQ ID NO: 368965 - DNA, 31 bp, Artificial Sequence; identical to SEQ ID NO: 18474
  Description of Artificial Sequence: Synthetic oligonucleotide

SEQ ID NO: 368966 - DNA, 32 bp, Artificial Sequence; identical to SEQ ID NO: 18475
  Description of Artificial Sequence: Synthetic oligonucleotide

SEQ ID NO: 368967 - DNA, 32 bp, Artificial Sequence; identical to SEQ ID NO: 18476
  Description of Artificial Sequence: Synthetic oligonucleotide

SEQ ID NO: 368968 - DNA, 32 bp, Artificial Sequence; identical to SEQ ID NO: 18477
  Description of Artificial Sequence: Synthetic oligonucleotide

SEQ ID NO: 368969 - DNA, 31 bp, Artificial Sequence; identical to SEQ ID NO: 18478
  Description of Artificial Sequence: Synthetic oligonucleotide

SEQ ID NO: 368970 - DNA, 30 bp, Artificial Sequence; identical to SEQ ID NO: 18479
  Description of Artificial Sequence: Synthetic oligonucleotide

SEQ ID NO: 368971 - DNA, 31 bp, Artificial Sequence; identical to SEQ ID NO: 18480
  Description of Artificial Sequence: Synthetic oligonucleotide

SEQ ID NO: 368972 - DNA, 30 bp, Artificial Sequence; identical to SEQ ID NO: 18481
  Description of Artificial Sequence: Synthetic oligonucleotide

SEQ ID NO: 368973 - DNA, 30 bp, Artificial Sequence; identical to SEQ ID NO: 18482
  Description of Artificial Sequence: Synthetic oligonucleotide

SEQ ID NO: 368974 - DNA, 29 bp, Artificial Sequence
  Description of Artificial Sequence: Synthetic oligonucleotide
caccatccagataatgcatggctgcgacg

SEQ ID NO: 368975 - DNA, 30 bp, Artificial Sequence; identical to SEQ ID NO: 18484
  Description of Artificial Sequence: Synthetic oligonucleotide

SEQ ID NO: 368976 - DNA, 29 bp, Artificial Sequence
  Description of Artificial Sequence: Synthetic oligonucleotide
ccatccagataatgcatggctgcgacgtg

SEQ ID NO: 368977 - DNA, 29 bp, Artificial Sequence
  Description of Artificial Sequence: Synthetic oligonucleotide
catccagataatgcatggctgcgacgtgg

SEQ ID NO: 368978 - DNA, 29 bp, Artificial Sequence
  Description of Artificial Sequence: Synthetic oligonucleotide
atccagataatgcatggctgcgacgtggg

SEQ ID NO: 368979 - DNA, 28 bp, Artificial Sequence
  Description of Artificial Sequence: Synthetic oligonucleotide
tccagataatgcatggctgcgacgtggg

SEQ ID NO: 368980 - DNA, 27 bp, Artificial Sequence
  Description of Artificial Sequence: Synthetic oligonucleotide
ccagataatgcatggctgcgacgtggg

SEQ ID NO: 368981 - DNA, 27 bp, Artificial Sequence
  Description of Artificial Sequence: Synthetic oligonucleotide
cagataatgcatggctgcgacgtgggg

SEQ ID NO: 368982 - DNA, 28 bp, Artificial Sequence
  Description of Artificial Sequence: Synthetic oligonucleotide
agataatgcatggctgcgacgtggggtc

SEQ ID NO: 368983 - DNA, 27 bp, Artificial Sequence
  Description of Artificial Sequence: Synthetic oligonucleotide
gataatgcatggctgcgacgtggggtc

SEQ ID NO: 368984 - DNA, 27 bp, Artificial Sequence
  Description of Artificial Sequence: Synthetic oligonucleotide
ataatgcatggctgcgacgtggggtcg

SEQ ID NO: 368985 - DNA, 26 bp, Artificial Sequence
  Description of Artificial Sequence: Synthetic oligonucleotide
taatgcatggctgcgacgtggggtcg

SEQ ID NO: 368986 - DNA, 25 bp, Artificial Sequence
  Description of Artificial Sequence: Synthetic oligonucleotide
aatgcatggctgcgacgtggggtcg

SEQ ID NO: 368987 - DNA, 24 bp, Artificial Sequence
  Description of Artificial Sequence: Synthetic oligonucleotide
atgcatggctgcgacgtggggtcg

SEQ ID NO: 368988 - DNA, 23 bp, Artificial Sequence
  Description of Artificial Sequence: Synthetic oligonucleotide
tgcatggctgcgacgtggggtcg

SEQ ID NO: 368989 - DNA, 22 bp, Artificial Sequence
  Description of Artificial Sequence: Synthetic oligonucleotide
gcatggctgcgacgtggggtcg

SEQ ID NO: 368990 - DNA, 23 bp, Artificial Sequence
  Description of Artificial Sequence: Synthetic oligonucleotide
catggctgcgacgtggggtcgga

SEQ ID NO: 368991 - DNA, 24 bp, Artificial Sequence
  Description of Artificial Sequence: Synthetic oligonucleotide
ccgtggatagagcaggaggggcct

SEQ ID NO: 368992 - DNA, 25 bp, Artificial Sequence
  Description of Artificial Sequence: Synthetic oligonucleotide
cgtggatagagcaggaggggcctga

SEQ ID NO: 368993 - DNA, 27 bp, Artificial Sequence
  Description of Artificial Sequence: Synthetic oligonucleotide
gtggatagagcaggaggggcctgagta

SEQ ID NO: 368994 - DNA, 29 bp, Artificial Sequence
  Description of Artificial Sequence: Synthetic oligonucleotide
tggatagagcaggaggggcctgagtattg

SEQ ID NO: 368995 - DNA, 28 bp, Artificial Sequence
  Description of Artificial Sequence: Synthetic oligonucleotide
ggatagagcaggaggggcctgagtattg

SEQ ID NO: 368996 - DNA, 28 bp, Artificial Sequence
  Description of Artificial Sequence: Synthetic oligonucleotide
gatagagcaggaggggcctgagtattgg

SEQ ID NO: 368997 - DNA, 28 bp, Artificial Sequence
  Description of Artificial Sequence: Synthetic oligonucleotide
atagagcaggaggggcctgagtattggg

SEQ ID NO: 368998 - DNA, 27 bp, Artificial Sequence
  Description of Artificial Sequence: Synthetic oligonucleotide
tagagcaggaggggcctgagtattggg

SEQ ID NO: 368999 - DNA, 27 bp, Artificial Sequence
  Description of Artificial Sequence: Synthetic oligonucleotide
agagcaggaggggcctgagtattggga

SEQ ID NO: 369000 - DNA, 26 bp, Artificial Sequence
  Description of Artificial Sequence: Synthetic oligonucleotide
gagcaggaggggcctgagtattggga

SEQ ID NO: 369001 - DNA, 26 bp, Artificial Sequence
  Description of Artificial Sequence: Synthetic oligonucleotide
agcaggaggggcctgagtattgggac

SEQ ID NO: 369002 - DNA, 25 bp, Artificial Sequence
  Description of Artificial Sequence: Synthetic oligonucleotide
gcaggaggggcctgagtattgggac

SEQ ID NO: 369003 - DNA, 26 bp, Artificial Sequence
  Description of Artificial Sequence: Synthetic oligonucleotide
caggaggggcctgagtattgggacca

SEQ ID NO: 369004 - DNA, 26 bp, Artificial Sequence
  Description of Artificial Sequence: Synthetic oligonucleotide
aggaggggcctgagtattgggaccag

SEQ ID NO: 369005 - DNA, 25 bp, Artificial Sequence
  Description of Artificial Sequence: Synthetic oligonucleotide
ggaggggcctgagtattgggaccag

SEQ ID NO: 369006 - DNA, 26 bp, Artificial Sequence
  Description of Artificial Sequence: Synthetic oligonucleotide
gaggggcctgagtattgggaccagga

SEQ ID NO: 369007 - DNA, 27 bp, Artificial Sequence
  Description of Artificial Sequence: Synthetic oligonucleotide
aggggcctgagtattgggaccaggaga

SEQ ID NO: 369008 - DNA, 26 bp, Artificial Sequence
  Description of Artificial Sequence: Synthetic oligonucleotide
ggggcctgagtattgggaccaggaga

SEQ ID NO: 369009 - DNA, 27 bp, Artificial Sequence
  Description of Artificial Sequence: Synthetic oligonucleotide
gggcctgagtattgggaccaggagaca

SEQ ID NO: 369010 - DNA, 26 bp, Artificial Sequence
  Description of Artificial Sequence: Synthetic oligonucleotide
aggagcagaggggtcagggcgaagta

SEQ ID NO: 369011 - DNA, 25 bp, Artificial Sequence
  Description of Artificial Sequence: Synthetic oligonucleotide
ggagcagaggggtcagggcgaagta

SEQ ID NO: 369012 - DNA, 25 bp, Artificial Sequence
  Description of Artificial Sequence: Synthetic oligonucleotide
gagcagaggggtcagggcgaagtac

SEQ ID NO: 369013 - DNA, 26 bp, Artificial Sequence
  Description of Artificial Sequence: Synthetic oligonucleotide
agcagaggggtcagggcgaagtacca

SEQ ID NO: 369014 - DNA, 25 bp, Artificial Sequence
  Description of Artificial Sequence: Synthetic oligonucleotide
gcagaggggtcagggcgaagtacca

SEQ ID NO: 369015 - DNA, 25 bp, Artificial Sequence
  Description of Artificial Sequence: Synthetic oligonucleotide
cagaggggtcagggcgaagtaccag

SEQ ID NO: 369016 - DNA, 25 bp, Artificial Sequence
  Description of Artificial Sequence: Synthetic oligonucleotide
agaggggtcagggcgaagtaccagg

SEQ ID NO: 369017 - DNA, 24 bp, Artificial Sequence
  Description of Artificial Sequence: Synthetic oligonucleotide
gaggggtcagggcgaagtaccagg

SEQ ID NO: 369018 - DNA, 24 bp, Artificial Sequence
  Description of Artificial Sequence: Synthetic oligonucleotide
aggggtcagggcgaagtaccaggg

SEQ ID NO: 369019 - DNA, 23 bp, Artificial Sequence
  Description of Artificial Sequence: Synthetic oligonucleotide
ggggtcagggcgaagtaccaggg

SEQ ID NO: 369020 - DNA, 23 bp, Artificial Sequence
  Description of Artificial Sequence: Synthetic oligonucleotide
gggtcagggcgaagtaccagggc

SEQ ID NO: 369021 - DNA, 23 bp, Artificial Sequence
  Description of Artificial Sequence: Synthetic oligonucleotide
ggtcagggcgaagtaccagggcc

SEQ ID NO: 369022 - DNA, 23 bp, Artificial Sequence
  Description of Artificial Sequence: Synthetic oligonucleotide
gtcagggcgaagtaccagggccc

SEQ ID NO: 369023 - DNA, 24 bp, Artificial Sequence
  Description of Artificial Sequence: Synthetic oligonucleotide
tcagggcgaagtaccagggcccca

SEQ ID NO: 369024 - DNA, 23 bp, Artificial Sequence
  Description of Artificial Sequence: Synthetic oligonucleotide
cagggcgaagtaccagggcccca

SEQ ID NO: 369025 - DNA, 23 bp, Artificial Sequence
  Description of Artificial Sequence: Synthetic oligonucleotide
agggcgaagtaccagggccccag

SEQ ID NO: 369026 - DNA, 22 bp, Artificial Sequence
  Description of Artificial Sequence: Synthetic oligonucleotide
gggcgaagtaccagggccccag

SEQ ID NO: 369027 - DNA, 22 bp, Artificial Sequence
  Description of Artificial Sequence: Synthetic oligonucleotide
ggcgaagtaccagggccccagg

SEQ ID NO: 369028 - DNA, 22 bp, Artificial Sequence
  Description of Artificial Sequence: Synthetic oligonucleotide
gcgaagtaccagggccccaggc

SEQ ID NO: 369029 - DNA, 23 bp, Artificial Sequence
  Description of Artificial Sequence: Synthetic oligonucleotide
cgaagtaccagggccccaggcgt

SEQ ID NO: 369030 - DNA, 23 bp, Artificial Sequence
  Description of Artificial Sequence: Synthetic oligonucleotide
gaagtaccagggccccaggcgtg

SEQ ID NO: 369031 - DNA, 23 bp, Artificial Sequence
  Description of Artificial Sequence: Synthetic oligonucleotide
aagtaccagggccccaggcgtgg

SEQ ID NO: 369032 - DNA, 22 bp, Artificial Sequence
  Description of Artificial Sequence: Synthetic oligonucleotide
agtaccagggccccaggcgtgg

SEQ ID NO: 369033 - DNA, 21 bp, Artificial Sequence
  Description of Artificial Sequence: Synthetic oligonucleotide
gtaccagggccccaggcgtgg

SEQ ID NO: 369034 - DNA, 22 bp, Artificial Sequence
  Description of Artificial Sequence: Synthetic oligonucleotide
taccagggccccaggcgtggct

SEQ ID NO: 369035 - DNA, 21 bp, Artificial Sequence
  Description of Artificial Sequence: Synthetic oligonucleotide
accagggccccaggcgtggct

SEQ ID NO: 369036 - DNA, 31 bp, Artificial Sequence; identical to SEQ ID NO: 5968
  Description of Artificial Sequence: Synthetic oligonucleotide

SEQ ID NO: 369037 - DNA, 30 bp, Artificial Sequence; identical to SEQ ID NO: 5969
  Description of Artificial Sequence: Synthetic oligonucleotide

SEQ ID NO: 369038 - DNA, 31 bp, Artificial Sequence; identical to SEQ ID NO: 5970
  Description of Artificial Sequence: Synthetic oligonucleotide

SEQ ID NO: 369039 - DNA, 30 bp, Artificial Sequence; identical to SEQ ID NO: 5971
  Description of Artificial Sequence: Synthetic oligonucleotide

SEQ ID NO: 369040 - DNA, 30 bp, Artificial Sequence; identical to SEQ ID NO: 5972
  Description of Artificial Sequence: Synthetic oligonucleotide

SEQ ID NO: 369041 - DNA, 30 bp, Artificial Sequence; identical to SEQ ID NO: 5973
  Description of Artificial Sequence: Synthetic oligonucleotide

SEQ ID NO: 369042 - DNA, 31 bp, Artificial Sequence; identical to SEQ ID NO: 5974
  Description of Artificial Sequence: Synthetic oligonucleotide

SEQ ID NO: 369043 - DNA, 30 bp, Artificial Sequence; identical to SEQ ID NO: 5975
  Description of Artificial Sequence: Synthetic oligonucleotide

SEQ ID NO: 369044 - DNA, 29 bp, Artificial Sequence
  Description of Artificial Sequence: Synthetic oligonucleotide
tgtgaaggcccactcacagattgaccgag

SEQ ID NO: 369045 - DNA, 22 bp, Artificial Sequence
  Description of Artificial Sequence: Synthetic oligonucleotide
tccgcgggtaccagcaggacgc

SEQ ID NO: 369046 - DNA, 21 bp, Artificial Sequence
  Description of Artificial Sequence: Synthetic oligonucleotide
ccgcgggtaccagcaggacgc

SEQ ID NO: 369047 - DNA, 23 bp, Artificial Sequence
  Description of Artificial Sequence: Synthetic oligonucleotide
cgcgggtaccagcaggacgccta

SEQ ID NO: 369048 - DNA, 23 bp, Artificial Sequence
  Description of Artificial Sequence: Synthetic oligonucleotide
gcgggtaccagcaggacgcctac

SEQ ID NO: 369049 - DNA, 24 bp, Artificial Sequence
  Description of Artificial Sequence: Synthetic oligonucleotide
cgggtaccagcaggacgcctacga

SEQ ID NO: 369050 - DNA, 24 bp, Artificial Sequence
  Description of Artificial Sequence: Synthetic oligonucleotide
gggtaccagcaggacgcctacgac

SEQ ID NO: 369051 - DNA, 24 bp, Artificial Sequence
  Description of Artificial Sequence: Synthetic oligonucleotide
ggtaccagcaggacgcctacgacg

SEQ ID NO: 369052 - DNA, 24 bp, Artificial Sequence
  Description of Artificial Sequence: Synthetic oligonucleotide
gtaccagcaggacgcctacgacgg

SEQ ID NO: 369053 - DNA, 26 bp, Artificial Sequence
  Description of Artificial Sequence: Synthetic oligonucleotide
taccagcaggacgcctacgacggcaa

SEQ ID NO: 369054 - DNA, 25 bp, Artificial Sequence
  Description of Artificial Sequence: Synthetic oligonucleotide
accagcaggacgcctacgacggcaa

SEQ ID NO: 369055 - DNA, 24 bp, Artificial Sequence
  Description of Artificial Sequence: Synthetic oligonucleotide
ccagcaggacgcctacgacggcaa

SEQ ID NO: 369056 - DNA, 24 bp, Artificial Sequence
  Description of Artificial Sequence: Synthetic oligonucleotide
cagcaggacgcctacgacggcaag

SEQ ID NO: 369057 - DNA, 27 bp, Artificial Sequence
  Description of Artificial Sequence: Synthetic oligonucleotide
agcaggacgcctacgacggcaaggatt

SEQ ID NO: 369058 - DNA, 22 bp, Artificial Sequence
  Description of Artificial Sequence: Synthetic oligonucleotide
agcgcacggacccccccaagac

SEQ ID NO: 369059 - DNA, 21 bp, Artificial Sequence
  Description of Artificial Sequence: Synthetic oligonucleotide
gcgcacggacccccccaagac

SEQ ID NO: 369060 - DNA, 21 bp, Artificial Sequence
  Description of Artificial Sequence: Synthetic oligonucleotide
cgcacggacccccccaagacg

SEQ ID NO: 369061 - DNA, 25 bp, Artificial Sequence
  Description of Artificial Sequence: Synthetic oligonucleotide
gcacggacccccccaagacgcatat

SEQ ID NO: 369062 - DNA, 26 bp, Artificial Sequence
  Description of Artificial Sequence: Synthetic oligonucleotide
cacggacccccccaagacgcatatga

SEQ ID NO: 369063 - DNA, 27 bp, Artificial Sequence
  Description of Artificial Sequence: Synthetic oligonucleotide
acggacccccccaagacgcatatgact

SEQ ID NO: 369064 - DNA, 26 bp, Artificial Sequence
  Description of Artificial Sequence: Synthetic oligonucleotide
cggacccccccaagacgcatatgact

SEQ ID NO: 369065 - DNA, 27 bp, Artificial Sequence
  Description of Artificial Sequence: Synthetic oligonucleotide
ggacccccccaagacgcatatgactca

SEQ ID NO: 369066 - DNA, 27 bp, Artificial Sequence
  Description of Artificial Sequence: Synthetic oligonucleotide
gacccccccaagacgcatatgactcac

SEQ ID NO: 369067 - DNA, 27 bp, Artificial Sequence
  Description of Artificial Sequence: Synthetic oligonucleotide
acccccccaagacgcatatgactcacc

SEQ ID NO: 369068 - DNA, 27 bp, Artificial Sequence
  Description of Artificial Sequence: Synthetic oligonucleotide
cccccccaagacgcatatgactcacca

SEQ ID NO: 369069 - DNA, 27 bp, Artificial Sequence
  Description of Artificial Sequence: Synthetic oligonucleotide
ccccccaagacgcatatgactcaccac

SEQ ID NO: 369070 - DNA, 27 bp, Artificial Sequence
  Description of Artificial Sequence: Synthetic oligonucleotide
acctgccatgtgcagcatgagggtctc

SEQ ID NO: 369071 - DNA, 26 bp, Artificial Sequence
  Description of Artificial Sequence: Synthetic oligonucleotide
cctgccatgtgcagcatgagggtctc

SEQ ID NO: 369072 - DNA, 26 bp, Artificial Sequence
  Description of Artificial Sequence: Synthetic oligonucleotide
ctgccatgtgcagcatgagggtctcc

SEQ ID NO: 369073 - DNA, 26 bp, Artificial Sequence
  Description of Artificial Sequence: Synthetic oligonucleotide
tgccatgtgcagcatgagggtctccc

SEQ ID NO: 369074 - DNA, 25 bp, Artificial Sequence
  Description of Artificial Sequence: Synthetic oligonucleotide
gccatgtgcagcatgagggtctccc

SEQ ID NO: 369075 - DNA, 27 bp, Artificial Sequence
  Description of Artificial Sequence: Synthetic oligonucleotide
ccatgtgcagcatgagggtctccccaa

SEQ ID NO: 369076 - DNA, 27 bp, Artificial Sequence
  Description of Artificial Sequence: Synthetic oligonucleotide
catgtgcagcatgagggtctccccaag

SEQ ID NO: 369077 - DNA, 27 bp, Artificial Sequence
  Description of Artificial Sequence: Synthetic oligonucleotide
atgtgcagcatgagggtctccccaagc

SEQ ID NO: 369078 - DNA, 26 bp, Artificial Sequence
  Description of Artificial Sequence: Synthetic oligonucleotide
tgtgcagcatgagggtctccccaagc

SEQ ID NO: 369079 - DNA, 25 bp, Artificial Sequence
  Description of Artificial Sequence: Synthetic oligonucleotide
gtgcagcatgagggtctccccaagc

SEQ ID NO: 369080 - DNA, 25 bp, Artificial Sequence
  Description of Artificial Sequence: Synthetic oligonucleotide
tgcagcatgagggtctccccaagcc

SEQ ID NO: 369081 - DNA, 24 bp, Artificial Sequence
  Description of Artificial Sequence: Synthetic oligonucleotide
gcagcatgagggtctccccaagcc

SEQ ID NO: 369082 - DNA, 24 bp, Artificial Sequence
  Description of Artificial Sequence: Synthetic oligonucleotide
cagcatgagggtctccccaagccc

SEQ ID NO: 369083 - DNA, 25 bp, Artificial Sequence
  Description of Artificial Sequence: Synthetic oligonucleotide
agcatgagggtctccccaagcccct

SEQ ID NO: 369084 - DNA, 24 bp, Artificial Sequence
  Description of Artificial Sequence: Synthetic oligonucleotide
gcatgagggtctccccaagcccct

SEQ ID NO: 369085 - DNA, 25 bp, Artificial Sequence
  Description of Artificial Sequence: Synthetic oligonucleotide
catgagggtctccccaagcccctca

SEQ ID NO: 369086 - DNA, 25 bp, Artificial Sequence
  Description of Artificial Sequence: Synthetic oligonucleotide
atgagggtctccccaagcccctcac

SEQ ID NO: 369087 - DNA, 24 bp, Artificial Sequence
  Description of Artificial Sequence: Synthetic oligonucleotide
tgagggtctccccaagcccctcac

SEQ ID NO: 369088 - DNA, 23 bp, Artificial Sequence
  Description of Artificial Sequence: Synthetic oligonucleotide
gagggtctccccaagcccctcac

SEQ ID NO: 369089 - DNA, 23 bp, Artificial Sequence
  Description of Artificial Sequence: Synthetic oligonucleotide
agggtctccccaagcccctcacc

SEQ ID NO: 369090 - DNA, 22 bp, Artificial Sequence
  Description of Artificial Sequence: Synthetic oligonucleotide
gggtctccccaagcccctcacc

SEQ ID NO: 369091 - DNA, 23 bp, Artificial Sequence
  Description of Artificial Sequence: Synthetic oligonucleotide
ggtctccccaagcccctcaccct

SEQ ID NO: 369092 - DNA, 24 bp, Artificial Sequence
  Description of Artificial Sequence: Synthetic oligonucleotide
gtctccccaagcccctcaccctga

SEQ ID NO: 369093 - DNA, 26 bp, Artificial Sequence
  Description of Artificial Sequence: Synthetic oligonucleotide
tctccccaagcccctcaccctgagat

SEQ ID NO: 369094 - DNA, 25 bp, Artificial Sequence
  Description of Artificial Sequence: Synthetic oligonucleotide
ctccccaagcccctcaccctgagat

SEQ ID NO: 369095 - DNA, 25 bp, Artificial Sequence
  Description of Artificial Sequence: Synthetic oligonucleotide
tccccaagcccctcaccctgagatg

SEQ ID NO: 369096 - DNA, 24 bp, Artificial Sequence
  Description of Artificial Sequence: Synthetic oligonucleotide
ccccaagcccctcaccctgagatg

SEQ ID NO: 369097 - DNA, 24 bp, Artificial Sequence
  Description of Artificial Sequence: Synthetic oligonucleotide
ctcttggaccgcggcagacatggc

SEQ ID NO: 369098 - DNA, 24 bp, Artificial Sequence
  Description of Artificial Sequence: Synthetic oligonucleotide
tcttggaccgcggcagacatggcg

SEQ ID NO: 369099 - DNA, 23 bp, Artificial Sequence
  Description of Artificial Sequence: Synthetic oligonucleotide
cttggaccgcggcagacatggcg

SEQ ID NO: 369100 - DNA, 23 bp, Artificial Sequence
  Description of Artificial Sequence: Synthetic oligonucleotide
ttggaccgcggcagacatggcgg

SEQ ID NO: 369101 - DNA, 22 bp, Artificial Sequence
  Description of Artificial Sequence: Synthetic oligonucleotide
tggaccgcggcagacatggcgg

SEQ ID NO: 369102 - DNA, 21 bp, Artificial Sequence
  Description of Artificial Sequence: Synthetic oligonucleotide
ggaccgcggcagacatggcgg

SEQ ID NO: 369103 - DNA, 22 bp, Artificial Sequence
  Description of Artificial Sequence: Synthetic oligonucleotide
gaccgcggcagacatggcggct

SEQ ID NO: 369104 - DNA, 23 bp, Artificial Sequence
  Description of Artificial Sequence: Synthetic oligonucleotide
accgcggcagacatggcggctca

SEQ ID NO: 369105 - DNA, 22 bp, Artificial Sequence
  Description of Artificial Sequence: Synthetic oligonucleotide
ccgcggcagacatggcggctca

SEQ ID NO: 369106 - DNA, 24 bp, Artificial Sequence
  Description of Artificial Sequence: Synthetic oligonucleotide
cgcggcagacatggcggctcagat

SEQ ID NO: 369107 - DNA, 25 bp, Artificial Sequence
  Description of Artificial Sequence: Synthetic oligonucleotide
gcggcagacatggcggctcagatca

SEQ ID NO: 369108 - DNA, 25 bp, Artificial Sequence
  Description of Artificial Sequence: Synthetic oligonucleotide
cggcagacatggcggctcagatcac

SEQ ID NO: 369109 - DNA, 25 bp, Artificial Sequence
  Description of Artificial Sequence: Synthetic oligonucleotide
ggcagacatggcggctcagatcacc

SEQ ID NO: 369110 - DNA, 26 bp, Artificial Sequence
  Description of Artificial Sequence: Synthetic oligonucleotide
gcagacatggcggctcagatcaccca

SEQ ID NO: 369111 - DNA, 26 bp, Artificial Sequence
  Description of Artificial Sequence: Synthetic oligonucleotide
cagacatggcggctcagatcacccag

SEQ ID NO: 369112 - DNA, 26 bp, Artificial Sequence
  Description of Artificial Sequence: Synthetic oligonucleotide
agacatggcggctcagatcacccagc

SEQ ID NO: 369113 - DNA, 22 bp, Artificial Sequence
  Description of Artificial Sequence: Synthetic oligonucleotide
cggggagccccgcttcatcgct

SEQ ID NO: 369114 - DNA, 23 bp, Artificial Sequence
  Description of Artificial Sequence: Synthetic oligonucleotide
ggggagccccgcttcatcgctgt

SEQ ID NO: 369115 - DNA, 23 bp, Artificial Sequence
  Description of Artificial Sequence: Synthetic oligonucleotide
gggagccccgcttcatcgctgtg

SEQ ID NO: 369116 - DNA, 23 bp, Artificial Sequence
  Description of Artificial Sequence: Synthetic oligonucleotide
ggagccccgcttcatcgctgtgg

SEQ ID NO: 369117 - DNA, 23 bp, Artificial Sequence
  Description of Artificial Sequence: Synthetic oligonucleotide
gagccccgcttcatcgctgtggg

SEQ ID NO: 369118 - DNA, 25 bp, Artificial Sequence
  Description of Artificial Sequence: Synthetic oligonucleotide
agccccgcttcatcgctgtgggcta

SEQ ID NO: 369119 - DNA, 24 bp, Artificial Sequence
  Description of Artificial Sequence: Synthetic oligonucleotide
gccccgcttcatcgctgtgggcta

SEQ ID NO: 369120 - DNA, 24 bp, Artificial Sequence
  Description of Artificial Sequence: Synthetic oligonucleotide
ccccgcttcatcgctgtgggctac

SEQ ID NO: 369121 - DNA, 25 bp, Artificial Sequence
  Description of Artificial Sequence: Synthetic oligonucleotide
cccgcttcatcgctgtgggctacgt

SEQ ID NO: 369122 - DNA, 25 bp, Artificial Sequence
  Description of Artificial Sequence: Synthetic oligonucleotide
ccgcttcatcgctgtgggctacgtg

SEQ ID NO: 369123 - DNA, 26 bp, Artificial Sequence
  Description of Artificial Sequence: Synthetic oligonucleotide
cgcttcatcgctgtgggctacgtgga

SEQ ID NO: 369124 - DNA, 26 bp, Artificial Sequence
  Description of Artificial Sequence: Synthetic oligonucleotide
gcttcatcgctgtgggctacgtggac

SEQ ID NO: 369125 - DNA, 27 bp, Artificial Sequence
  Description of Artificial Sequence: Synthetic oligonucleotide
cttcatcgctgtgggctacgtggacga

SEQ ID NO: 369126 - DNA, 27 bp, Artificial Sequence
  Description of Artificial Sequence: Synthetic oligonucleotide
ttcatcgctgtgggctacgtggacgac

SEQ ID NO: 369127 - DNA, 27 bp, Artificial Sequence
  Description of Artificial Sequence: Synthetic oligonucleotide
tcatcgctgtgggctacgtggacgaca

SEQ ID NO: 369128 - DNA, 26 bp, Artificial Sequence
  Description of Artificial Sequence: Synthetic oligonucleotide
catcgctgtgggctacgtggacgaca

SEQ ID NO: 369129 - DNA, 26 bp, Artificial Sequence
  Description of Artificial Sequence: Synthetic oligonucleotide
atcgctgtgggctacgtggacgacac

SEQ ID NO: 369130 - DNA, 25 bp, Artificial Sequence
  Description of Artificial Sequence: Synthetic oligonucleotide
tcgctgtgggctacgtggacgacac

SEQ ID NO: 369131 - DNA, 24 bp, Artificial Sequence
  Description of Artificial Sequence: Synthetic oligonucleotide
cgctgtgggctacgtggacgacac

SEQ ID NO: 369132 - DNA, 24 bp, Artificial Sequence
  Description of Artificial Sequence: Synthetic oligonucleotide
gctgtgggctacgtggacgacacg

SEQ ID NO: 369133 - DNA, 25 bp, Artificial Sequence
  Description of Artificial Sequence: Synthetic oligonucleotide
ctgtgggctacgtggacgacacgca

SEQ ID NO: 369134 - DNA, 27 bp, Artificial Sequence
  Description of Artificial Sequence: Synthetic oligonucleotide
tgtgggctacgtggacgacacgcagtt

SEQ ID NO: 369135 - DNA, 20 bp, Artificial Sequence
  Description of Artificial Sequence: Synthetic oligonucleotide
cggcccgtgtggcggagcag

SEQ ID NO: 369136 - DNA, 21 bp, Artificial Sequence
  Description of Artificial Sequence: Synthetic oligonucleotide
ggcccgtgtggcggagcagct

SEQ ID NO: 369137 - DNA, 22 bp, Artificial Sequence
  Description of Artificial Sequence: Synthetic oligonucleotide
gcccgtgtggcggagcagctga

SEQ ID NO: 369138 - DNA, 23 bp, Artificial Sequence
  Description of Artificial Sequence: Synthetic oligonucleotide
cccgtgtggcggagcagctgaga

SEQ ID NO: 369139 - DNA, 23 bp, Artificial Sequence
  Description of Artificial Sequence: Synthetic oligonucleotide
ccgtgtggcggagcagctgagag

SEQ ID NO: 369140 - DNA, 23 bp, Artificial Sequence
  Description of Artificial Sequence: Synthetic oligonucleotide
cgtgtggcggagcagctgagagc

SEQ ID NO: 369141 - DNA, 25 bp, Artificial Sequence
  Description of Artificial Sequence: Synthetic oligonucleotide
gtgtggcggagcagctgagagccta

SEQ ID NO: 369142 - DNA, 28 bp, Artificial Sequence
  Description of Artificial Sequence: Synthetic oligonucleotide
gcccactcacagattgaccgagtggatc

SEQ ID NO: 369143 - DNA, 29 bp, Artificial Sequence
  Description of Artificial Sequence: Synthetic oligonucleotide
cccactcacagattgaccgagtggatctg

SEQ ID NO: 369144 - DNA, 29 bp, Artificial Sequence
  Description of Artificial Sequence: Synthetic oligonucleotide
ccactcacagattgaccgagtggatctgg

SEQ ID NO: 369145 - DNA, 29 bp, Artificial Sequence
  Description of Artificial Sequence: Synthetic oligonucleotide
cactcacagattgaccgagtggatctggg

SEQ ID NO: 369146 - DNA, 29 bp, Artificial Sequence
  Description of Artificial Sequence: Synthetic oligonucleotide
actcacagattgaccgagtggatctgggg

SEQ ID NO: 369147 - DNA, 28 bp, Artificial Sequence
  Description of Artificial Sequence: Synthetic oligonucleotide
ctcacagattgaccgagtggatctgggg

SEQ ID NO: 369148 - DNA, 29 bp, Artificial Sequence
  Description of Artificial Sequence: Synthetic oligonucleotide
tcacagattgaccgagtggatctggggac

SEQ ID NO: 369149 - DNA, 28 bp, Artificial Sequence
  Description of Artificial Sequence: Synthetic oligonucleotide
cacagattgaccgagtggatctggggac

SEQ ID NO: 369150 - DNA, 28 bp, Artificial Sequence
  Description of Artificial Sequence: Synthetic oligonucleotide
acagattgaccgagtggatctggggacc

SEQ ID NO: 369151 - DNA, 27 bp, Artificial Sequence
  Description of Artificial Sequence: Synthetic oligonucleotide
cagattgaccgagtggatctggggacc

SEQ ID NO: 369152 - DNA, 27 bp, Artificial Sequence
  Description of Artificial Sequence: Synthetic oligonucleotide
agattgaccgagtggatctggggaccc

SEQ ID NO: 369153 - DNA, 27 bp, Artificial Sequence
  Description of Artificial Sequence: Synthetic oligonucleotide
gattgaccgagtggatctggggaccct

SEQ ID NO: 369154 - DNA, 27 bp, Artificial Sequence
  Description of Artificial Sequence: Synthetic oligonucleotide
attgaccgagtggatctggggaccctg

SEQ ID NO: 369155 - DNA, 26 bp, Artificial Sequence
  Description of Artificial Sequence: Synthetic oligonucleotide
ttgaccgagtggatctggggaccctg

SEQ ID NO: 369156 - DNA, 25 bp, Artificial Sequence
  Description of Artificial Sequence: Synthetic oligonucleotide
tgaccgagtggatctggggaccctg

SEQ ID NO: 369157 - DNA, 24 bp, Artificial Sequence
  Description of Artificial Sequence: Synthetic oligonucleotide
gaccgagtggatctggggaccctg

SEQ ID NO: 369158 - DNA, 24 bp, Artificial Sequence
  Description of Artificial Sequence: Synthetic oligonucleotide
gccgtggatagagcaggagaggcc

SEQ ID NO: 369159 - DNA, 24 bp, Artificial Sequence
  Description of Artificial Sequence: Synthetic oligonucleotide
ccgtggatagagcaggagaggccg

SEQ ID NO: 369160 - DNA, 25 bp, Artificial Sequence
  Description of Artificial Sequence: Synthetic oligonucleotide
cgtggatagagcaggagaggccgga

SEQ ID NO: 369161 - DNA, 27 bp, Artificial Sequence
  Description of Artificial Sequence: Synthetic oligonucleotide
gtggatagagcaggagaggccggagta

SEQ ID NO: 369162 - DNA, 29 bp, Artificial Sequence
  Description of Artificial Sequence: Synthetic oligonucleotide
tggatagagcaggagaggccggagtattg

SEQ ID NO: 369163 - DNA, 28 bp, Artificial Sequence
  Description of Artificial Sequence: Synthetic oligonucleotide
ggatagagcaggagaggccggagtattg

SEQ ID NO: 369164 - DNA, 28 bp, Artificial Sequence
  Description of Artificial Sequence: Synthetic oligonucleotide
gatagagcaggagaggccggagtattgg

SEQ ID NO: 369165 - DNA, 28 bp, Artificial Sequence
  Description of Artificial Sequence: Synthetic oligonucleotide
atagagcaggagaggccggagtattggg

SEQ ID NO: 369166 - DNA, 27 bp, Artificial Sequence
  Description of Artificial Sequence: Synthetic oligonucleotide
tagagcaggagaggccggagtattggg

SEQ ID NO: 369167 - DNA, 27 bp, Artificial Sequence
  Description of Artificial Sequence: Synthetic oligonucleotide
agagcaggagaggccggagtattggga

SEQ ID NO: 369168 - DNA, 26 bp, Artificial Sequence
  Description of Artificial Sequence: Synthetic oligonucleotide
gagcaggagaggccggagtattggga

SEQ ID NO: 369169 - DNA, 26 bp, Artificial Sequence
  Description of Artificial Sequence: Synthetic oligonucleotide
agcaggagaggccggagtattgggac

SEQ ID NO: 369170 - DNA, 25 bp, Artificial Sequence
  Description of Artificial Sequence: Synthetic oligonucleotide
gcaggagaggccggagtattgggac

SEQ ID NO: 369171 - DNA, 26 bp, Artificial Sequence
  Description of Artificial Sequence: Synthetic oligonucleotide
caggagaggccggagtattgggacca

SEQ ID NO: 369172 - DNA, 26 bp, Artificial Sequence
  Description of Artificial Sequence: Synthetic oligonucleotide
aggagaggccggagtattgggaccag

SEQ ID NO: 369173 - DNA, 25 bp, Artificial Sequence
  Description of Artificial Sequence: Synthetic oligonucleotide
ggagaggccggagtattgggaccag

SEQ ID NO: 369174 - DNA, 26 bp, Artificial Sequence
  Description of Artificial Sequence: Synthetic oligonucleotide
gagaggccggagtattgggaccagga

SEQ ID NO: 369175 - DNA, 27 bp, Artificial Sequence
  Description of Artificial Sequence: Synthetic oligonucleotide
agaggccggagtattgggaccaggaga

SEQ ID NO: 369176 - DNA, 26 bp, Artificial Sequence
  Description of Artificial Sequence: Synthetic oligonucleotide
gaggccggagtattgggaccaggaga

SEQ ID NO: 369177 - DNA, 27 bp, Artificial Sequence
  Description of Artificial Sequence: Synthetic oligonucleotide
aggccggagtattgggaccaggagaca

SEQ ID NO: 369178 - DNA, 27 bp, Artificial Sequence
  Description of Artificial Sequence: Synthetic oligonucleotide
gtgtggcggagcagttgagagcctact

SEQ ID NO: 369179 - DNA, 28 bp, Artificial Sequence
  Description of Artificial Sequence: Synthetic oligonucleotide
tgtggcggagcagttgagagcctacttg

SEQ ID NO: 369180 - DNA, 27 bp, Artificial Sequence
  Description of Artificial Sequence: Synthetic oligonucleotide
gtggcggagcagttgagagcctacttg

SEQ ID NO: 369181 - DNA, 27 bp, Artificial Sequence
  Description of Artificial Sequence: Synthetic oligonucleotide
tggcggagcagttgagagcctacttgg

SEQ ID NO: 369182 - DNA, 27 bp, Artificial Sequence
  Description of Artificial Sequence: Synthetic oligonucleotide
ggcggagcagttgagagcctacttgga

SEQ ID NO: 369183 - DNA, 27 bp, Artificial Sequence
  Description of Artificial Sequence: Synthetic oligonucleotide
gcggagcagttgagagcctacttggag

SEQ ID NO: 369184 - DNA, 27 bp, Artificial Sequence
  Description of Artificial Sequence: Synthetic oligonucleotide
cggagcagttgagagcctacttggagg

SEQ ID NO: 369185 - DNA, 27 bp, Artificial Sequence
  Description of Artificial Sequence: Synthetic oligonucleotide
ggagcagttgagagcctacttggaggg

SEQ ID NO: 369186 - DNA, 27 bp, Artificial Sequence
  Description of Artificial Sequence: Synthetic oligonucleotide
gagcagttgagagcctacttggagggc

SEQ ID NO: 369187 - DNA, 28 bp, Artificial Sequence
  Description of Artificial Sequence: Synthetic oligonucleotide
agcagttgagagcctacttggagggcac

SEQ ID NO: 369188 - DNA, 27 bp, Artificial Sequence
  Description of Artificial Sequence: Synthetic oligonucleotide
gcagttgagagcctacttggagggcac

SEQ ID NO: 369189 - DNA, 27 bp, Artificial Sequence
  Description of Artificial Sequence: Synthetic oligonucleotide
cagttgagagcctacttggagggcacg

SEQ ID NO: 369190 - DNA, 28 bp, Artificial Sequence
  Description of Artificial Sequence: Synthetic oligonucleotide
agttgagagcctacttggagggcacgtg

SEQ ID NO: 369191 - DNA, 27 bp, Artificial Sequence
  Description of Artificial Sequence: Synthetic oligonucleotide
gttgagagcctacttggagggcacgtg

SEQ ID NO: 369192 - DNA, 27 bp, Artificial Sequence
  Description of Artificial Sequence: Synthetic oligonucleotide
ttgagagcctacttggagggcacgtgc

SEQ ID NO: 369193 - DNA, 26 bp, Artificial Sequence
  Description of Artificial Sequence: Synthetic oligonucleotide
tgagagcctacttggagggcacgtgc

SEQ ID NO: 369194 - DNA, 25 bp, Artificial Sequence
  Description of Artificial Sequence: Synthetic oligonucleotide
gagagcctacttggagggcacgtgc

SEQ ID NO: 369195 - DNA, 26 bp, Artificial Sequence
  Description of Artificial Sequence: Synthetic oligonucleotide
agagcctacttggagggcacgtgcgt

SEQ ID NO: 369196 - DNA, 25 bp, Artificial Sequence
  Description of Artificial Sequence: Synthetic oligonucleotide
gagcctacttggagggcacgtgcgt

SEQ ID NO: 369197 - DNA, 25 bp, Artificial Sequence
  Description of Artificial Sequence: Synthetic oligonucleotide
agcctacttggagggcacgtgcgtg

SEQ ID NO: 369198 - DNA, 24 bp, Artificial Sequence
  Description of Artificial Sequence: Synthetic oligonucleotide
gcctacttggagggcacgtgcgtg

SEQ ID NO: 369199 - DNA, 25 bp, Artificial Sequence
  Description of Artificial Sequence: Synthetic oligonucleotide
cctacttggagggcacgtgcgtgga

SEQ ID NO: 369200 - DNA, 26 bp, Artificial Sequence
  Description of Artificial Sequence: Synthetic oligonucleotide
ctacttggagggcacgtgcgtggagt

SEQ ID NO: 369201 - DNA, 26 bp, Artificial Sequence
  Description of Artificial Sequence: Synthetic oligonucleotide
tacttggagggcacgtgcgtggagtg

SEQ ID NO: 369202 - DNA, 25 bp, Artificial Sequence
  Description of Artificial Sequence: Synthetic oligonucleotide
acttggagggcacgtgcgtggagtg

SEQ ID NO: 369203 - DNA, 24 bp, Artificial Sequence
  Description of Artificial Sequence: Synthetic oligonucleotide
cttggagggcacgtgcgtggagtg

SEQ ID NO: 369204 - DNA, 24 bp, Artificial Sequence
  Description of Artificial Sequence: Synthetic oligonucleotide
ttggagggcacgtgcgtggagtgg

SEQ ID NO: 369205 - DNA, 30 bp, Artificial Sequence; identical to SEQ ID NO: 19124
  Description of Artificial Sequence: Synthetic oligonucleotide

SEQ ID NO: 369206 - DNA, 31 bp, Artificial Sequence; identical to SEQ ID NO: 19125
  Description of Artificial Sequence: Synthetic oligonucleotide

SEQ ID NO: 369207 - DNA, 27 bp, Artificial Sequence
  Description of Artificial Sequence: Synthetic oligonucleotide
ggaccaggagacacggaatgtgaaggg

SEQ ID NO: 369208 - DNA, 27 bp, Artificial Sequence
  Description of Artificial Sequence: Synthetic oligonucleotide
gaccaggagacacggaatgtgaagggc

SEQ ID NO: 369209 - DNA, 27 bp, Artificial Sequence
  Description of Artificial Sequence: Synthetic oligonucleotide
accaggagacacggaatgtgaagggcc

SEQ ID NO: 369210 - DNA, 27 bp, Artificial Sequence
  Description of Artificial Sequence: Synthetic oligonucleotide
ccaggagacacggaatgtgaagggcca

SEQ ID NO: 369211 - DNA, 27 bp, Artificial Sequence
  Description of Artificial Sequence: Synthetic oligonucleotide
caggagacacggaatgtgaagggccac

SEQ ID NO: 369212 - DNA, 28 bp, Artificial Sequence
  Description of Artificial Sequence: Synthetic oligonucleotide
aggagacacggaatgtgaagggccactc

SEQ ID NO: 369213 - DNA, 27 bp, Artificial Sequence
  Description of Artificial Sequence: Synthetic oligonucleotide
ggagacacggaatgtgaagggccactc

SEQ ID NO: 369214 - DNA, 28 bp, Artificial Sequence
  Description of Artificial Sequence: Synthetic oligonucleotide
gagacacggaatgtgaagggccactcac

SEQ ID NO: 369215 - DNA, 29 bp, Artificial Sequence
  Description of Artificial Sequence: Synthetic oligonucleotide
agacacggaatgtgaagggccactcacag

SEQ ID NO: 369216 - DNA, 28 bp, Artificial Sequence
  Description of Artificial Sequence: Synthetic oligonucleotide
gacacggaatgtgaagggccactcacag

SEQ ID NO: 369217 - DNA, 31 bp, Artificial Sequence; identical to SEQ ID NO: 19136
  Description of Artificial Sequence: Synthetic oligonucleotide

SEQ ID NO: 369218 - DNA, 30 bp, Artificial Sequence; identical to SEQ ID NO: 19137
  Description of Artificial Sequence: Synthetic oligonucleotide

SEQ ID NO: 369219 - DNA, 31 bp, Artificial Sequence; identical to SEQ ID NO: 19138
  Description of Artificial Sequence: Synthetic oligonucleotide

SEQ ID NO: 369220 - DNA, 30 bp, Artificial Sequence; identical to SEQ ID NO: 19139
  Description of Artificial Sequence: Synthetic oligonucleotide

SEQ ID NO: 369221 - DNA, 30 bp, Artificial Sequence; identical to SEQ ID NO: 19140
  Description of Artificial Sequence: Synthetic oligonucleotide

SEQ ID NO: 369222 - DNA, 30 bp, Artificial Sequence; identical to SEQ ID NO: 19141
  Description of Artificial Sequence: Synthetic oligonucleotide

SEQ ID NO: 369223 - DNA, 31 bp, Artificial Sequence; identical to SEQ ID NO: 19142
  Description of Artificial Sequence: Synthetic oligonucleotide

SEQ ID NO: 369224 - DNA, 30 bp, Artificial Sequence; identical to SEQ ID NO: 19143
  Description of Artificial Sequence: Synthetic oligonucleotide

SEQ ID NO: 369225 - DNA, 29 bp, Artificial Sequence
  Description of Artificial Sequence: Synthetic oligonucleotide
tgtgaagggccactcacagattgaccgag

SEQ ID NO: 369226 - DNA, 28 bp, Artificial Sequence
  Description of Artificial Sequence: Synthetic oligonucleotide
gtgaagggccactcacagattgaccgag

SEQ ID NO: 369227 - DNA, 29 bp, Artificial Sequence
  Description of Artificial Sequence: Synthetic oligonucleotide
tgaagggccactcacagattgaccgagtg

SEQ ID NO: 369228 - DNA, 28 bp, Artificial Sequence
  Description of Artificial Sequence: Synthetic oligonucleotide
gaagggccactcacagattgaccgagtg

SEQ ID NO: 369229 - DNA, 28 bp, Artificial Sequence
  Description of Artificial Sequence: Synthetic oligonucleotide
aagggccactcacagattgaccgagtgg

SEQ ID NO: 369230 - DNA, 27 bp, Artificial Sequence
  Description of Artificial Sequence: Synthetic oligonucleotide
agggccactcacagattgaccgagtgg

SEQ ID NO: 369231 - DNA, 27 bp, Artificial Sequence
  Description of Artificial Sequence: Synthetic oligonucleotide
gggccactcacagattgaccgagtgga

SEQ ID NO: 369232 - DNA, 27 bp, Artificial Sequence
  Description of Artificial Sequence: Synthetic oligonucleotide
ggccactcacagattgaccgagtggac

SEQ ID NO: 369233 - DNA, 27 bp, Artificial Sequence
  Description of Artificial Sequence: Synthetic oligonucleotide
gccactcacagattgaccgagtggacc

SEQ ID NO: 369234 - DNA, 27 bp, Artificial Sequence
  Description of Artificial Sequence: Synthetic oligonucleotide
cgaggccggttctcacaccatccagaa

SEQ ID NO: 369235 - DNA, 27 bp, Artificial Sequence
  Description of Artificial Sequence: Synthetic oligonucleotide
gaggccggttctcacaccatccagaag

SEQ ID NO: 369236 - DNA, 29 bp, Artificial Sequence
  Description of Artificial Sequence: Synthetic oligonucleotide
aggccggttctcacaccatccagaagatg

SEQ ID NO: 369237 - DNA, 28 bp, Artificial Sequence
  Description of Artificial Sequence: Synthetic oligonucleotide
ggccggttctcacaccatccagaagatg

SEQ ID NO: 369238 - DNA, 31 bp, Artificial Sequence; identical to SEQ ID NO: 19157
  Description of Artificial Sequence: Synthetic oligonucleotide

SEQ ID NO: 369239 - DNA, 31 bp, Artificial Sequence; identical to SEQ ID NO: 19158
  Description of Artificial Sequence: Synthetic oligonucleotide

SEQ ID NO: 369240 - DNA, 31 bp, Artificial Sequence; identical to SEQ ID NO: 19159
  Description of Artificial Sequence: Synthetic oligonucleotide

SEQ ID NO: 369241 - DNA, 32 bp, Artificial Sequence; identical to SEQ ID NO: 19160
  Description of Artificial Sequence: Synthetic oligonucleotide

SEQ ID NO: 369242 - DNA, 32 bp, Artificial Sequence; identical to SEQ ID NO: 19161
  Description of Artificial Sequence: Synthetic oligonucleotide

SEQ ID NO: 369243 - DNA, 32 bp, Artificial Sequence; identical to SEQ ID NO: 19162
  Description of Artificial Sequence: Synthetic oligonucleotide

SEQ ID NO: 369244 - DNA, 31 bp, Artificial Sequence; identical to SEQ ID NO: 19163
  Description of Artificial Sequence: Synthetic oligonucleotide

SEQ ID NO: 369245 - DNA, 30 bp, Artificial Sequence; identical to SEQ ID NO: 19164
  Description of Artificial Sequence: Synthetic oligonucleotide

SEQ ID NO: 369246 - DNA, 31 bp, Artificial Sequence; identical to SEQ ID NO: 19165
  Description of Artificial Sequence: Synthetic oligonucleotide

SEQ ID NO: 369247 - DNA, 30 bp, Artificial Sequence; identical to SEQ ID NO: 19166
  Description of Artificial Sequence: Synthetic oligonucleotide

SEQ ID NO: 369248 - DNA, 30 bp, Artificial Sequence; identical to SEQ ID NO: 19167
  Description of Artificial Sequence: Synthetic oligonucleotide

SEQ ID NO: 369249 - DNA, 29 bp, Artificial Sequence
  Description of Artificial Sequence: Synthetic oligonucleotide
caccatccagaagatgtatggctgcgacg

SEQ ID NO: 369250 - DNA, 30 bp, Artificial Sequence; identical to SEQ ID NO: 19169
  Description of Artificial Sequence: Synthetic oligonucleotide

SEQ ID NO: 369251 - DNA, 29 bp, Artificial Sequence
  Description of Artificial Sequence: Synthetic oligonucleotide
ccatccagaagatgtatggctgcgacgtg

SEQ ID NO: 369252 - DNA, 29 bp, Artificial Sequence
  Description of Artificial Sequence: Synthetic oligonucleotide
catccagaagatgtatggctgcgacgtgg

SEQ ID NO: 369253 - DNA, 29 bp, Artificial Sequence
  Description of Artificial Sequence: Synthetic oligonucleotide
atccagaagatgtatggctgcgacgtggg

SEQ ID NO: 369254 - DNA, 28 bp, Artificial Sequence
  Description of Artificial Sequence: Synthetic oligonucleotide
tccagaagatgtatggctgcgacgtggg

SEQ ID NO: 369255 - DNA, 27 bp, Artificial Sequence
  Description of Artificial Sequence: Synthetic oligonucleotide
ccagaagatgtatggctgcgacgtggg

SEQ ID NO: 369256 - DNA, 27 bp, Artificial Sequence
  Description of Artificial Sequence: Synthetic oligonucleotide
cagaagatgtatggctgcgacgtgggg

SEQ ID NO: 369257 - DNA, 28 bp, Artificial Sequence
  Description of Artificial Sequence: Synthetic oligonucleotide
agaagatgtatggctgcgacgtggggtc

SEQ ID NO: 369258 - DNA, 27 bp, Artificial Sequence
  Description of Artificial Sequence: Synthetic oligonucleotide
gaagatgtatggctgcgacgtggggtc

SEQ ID NO: 369259 - DNA, 27 bp, Artificial Sequence
  Description of Artificial Sequence: Synthetic oligonucleotide
aagatgtatggctgcgacgtggggtcg

SEQ ID NO: 369260 - DNA, 26 bp, Artificial Sequence
  Description of Artificial Sequence: Synthetic oligonucleotide
agatgtatggctgcgacgtggggtcg

SEQ ID NO: 369261 - DNA, 20 bp, Artificial Sequence
  Description of Artificial Sequence: Synthetic oligonucleotide
tggggccggacgggcgcctt

SEQ ID NO: 369262 - DNA, 20 bp, Artificial Sequence
  Description of Artificial Sequence: Synthetic oligonucleotide
ggggccggacgggcgccttt

SEQ ID NO: 369263 - DNA, 20 bp, Artificial Sequence
  Description of Artificial Sequence: Synthetic oligonucleotide
gggccggacgggcgcctctt

SEQ ID NO: 369264 - DNA, 20 bp, Artificial Sequence
  Description of Artificial Sequence: Synthetic oligonucleotide
ggccggacgggcgcctcctt

SEQ ID NO: 369265 - DNA, 20 bp, Artificial Sequence
  Description of Artificial Sequence: Synthetic oligonucleotide
gccggacgggcgcctcctct

SEQ ID NO: 369266 - DNA, 20 bp, Artificial Sequence
  Description of Artificial Sequence: Synthetic oligonucleotide
ccggacgggcgcctcctcct

SEQ ID NO: 369267 - DNA, 20 bp, Artificial Sequence
  Description of Artificial Sequence: Synthetic oligonucleotide
cggacgggcgcctcctccgt

SEQ ID NO: 369268 - DNA, 20 bp, Artificial Sequence
  Description of Artificial Sequence: Synthetic oligonucleotide
ggacgggcgcctcctccgct

SEQ ID NO: 369269 - DNA, 20 bp, Artificial Sequence
  Description of Artificial Sequence: Synthetic oligonucleotide
gacgggcgcctcctccgcgt

SEQ ID NO: 369270 - DNA, 20 bp, Artificial Sequence
  Description of Artificial Sequence: Synthetic oligonucleotide
acgggcgcctcctccgcggt

SEQ ID NO: 369271 - DNA, 20 bp, Artificial Sequence
  Description of Artificial Sequence: Synthetic oligonucleotide
cgggcgcctcctccgcggtt

SEQ ID NO: 369272 - DNA, 20 bp, Artificial Sequence
  Description of Artificial Sequence: Synthetic oligonucleotide
gggcgcctcctccgcgggta

SEQ ID NO: 369273 - DNA, 20 bp, Artificial Sequence
  Description of Artificial Sequence: Synthetic oligonucleotide
ggcgcctcctccgcgggtac

SEQ ID NO: 369274 - DNA, 21 bp, Artificial Sequence
  Description of Artificial Sequence: Synthetic oligonucleotide
gcgcctcctccgcgggtacca

SEQ ID NO: 369275 - DNA, 21 bp, Artificial Sequence
  Description of Artificial Sequence: Synthetic oligonucleotide
cgcctcctccgcgggtaccag

SEQ ID NO: 369276 - DNA, 22 bp, Artificial Sequence
  Description of Artificial Sequence: Synthetic oligonucleotide
gcctcctccgcgggtaccagca

SEQ ID NO: 369277 - DNA, 22 bp, Artificial Sequence
  Description of Artificial Sequence: Synthetic oligonucleotide
cctcctccgcgggtaccagcag

SEQ ID NO: 369278 - DNA, 23 bp, Artificial Sequence
  Description of Artificial Sequence: Synthetic oligonucleotide
ctcctccgcgggtaccagcagga

SEQ ID NO: 369279 - DNA, 34 bp, Artificial Sequence; identical to SEQ ID NO: 9830
  Description of Artificial Sequence: Synthetic oligonucleotide

SEQ ID NO: 369280 - DNA, 36 bp, Artificial Sequence; identical to SEQ ID NO: 9831
  Description of Artificial Sequence: Synthetic oligonucleotide

SEQ ID NO: 369281 - DNA, 35 bp, Artificial Sequence; identical to SEQ ID NO: 9832
  Description of Artificial Sequence: Synthetic oligonucleotide

SEQ ID NO: 369282 - DNA, 34 bp, Artificial Sequence; identical to SEQ ID NO: 9833
  Description of Artificial Sequence: Synthetic oligonucleotide

SEQ ID NO: 369283 - DNA, 34 bp, Artificial Sequence; identical to SEQ ID NO: 9834
  Description of Artificial Sequence: Synthetic oligonucleotide

SEQ ID NO: 369284 - DNA, 33 bp, Artificial Sequence; identical to SEQ ID NO: 9835
  Description of Artificial Sequence: Synthetic oligonucleotide

SEQ ID NO: 369285 - DNA, 32 bp, Artificial Sequence; identical to SEQ ID NO: 9836
  Description of Artificial Sequence: Synthetic oligonucleotide

SEQ ID NO: 369286 - DNA, 31 bp, Artificial Sequence; identical to SEQ ID NO: 9837
  Description of Artificial Sequence: Synthetic oligonucleotide

SEQ ID NO: 369287 - DNA, 31 bp, Artificial Sequence; identical to SEQ ID NO: 9838
  Description of Artificial Sequence: Synthetic oligonucleotide

SEQ ID NO: 369288 - DNA, 32 bp, Artificial Sequence; identical to SEQ ID NO: 9839
  Description of Artificial Sequence: Synthetic oligonucleotide

SEQ ID NO: 369289 - DNA, 31 bp, Artificial Sequence; identical to SEQ ID NO: 9840
  Description of Artificial Sequence: Synthetic oligonucleotide

SEQ ID NO: 369290 - DNA, 31 bp, Artificial Sequence; identical to SEQ ID NO: 9841
  Description of Artificial Sequence: Synthetic oligonucleotide

SEQ ID NO: 369291 - DNA, 32 bp, Artificial Sequence; identical to SEQ ID NO: 9842
  Description of Artificial Sequence: Synthetic oligonucleotide

SEQ ID NO: 369292 - DNA, 32 bp, Artificial Sequence; identical to SEQ ID NO: 9843
  Description of Artificial Sequence: Synthetic oligonucleotide

SEQ ID NO: 369293 - DNA, 33 bp, Artificial Sequence; identical to SEQ ID NO: 9844
  Description of Artificial Sequence: Synthetic oligonucleotide

SEQ ID NO: 369294 - DNA, 32 bp, Artificial Sequence; identical to SEQ ID NO: 9845
  Description of Artificial Sequence: Synthetic oligonucleotide

SEQ ID NO: 369295 - DNA, 31 bp, Artificial Sequence; identical to SEQ ID NO: 9846
  Description of Artificial Sequence: Synthetic oligonucleotide

SEQ ID NO: 369296 - DNA, 32 bp, Artificial Sequence; identical to SEQ ID NO: 9847
  Description of Artificial Sequence: Synthetic oligonucleotide

SEQ ID NO: 369297 - DNA, 31 bp, Artificial Sequence; identical to SEQ ID NO: 9848
  Description of Artificial Sequence: Synthetic oligonucleotide

SEQ ID NO: 369298 - DNA, 30 bp, Artificial Sequence; identical to SEQ ID NO: 9849
  Description of Artificial Sequence: Synthetic oligonucleotide

SEQ ID NO: 369299 - DNA, 30 bp, Artificial Sequence; identical to SEQ ID NO: 9850
  Description of Artificial Sequence: Synthetic oligonucleotide

SEQ ID NO: 369300 - DNA, 29 bp, Artificial Sequence
  Description of Artificial Sequence: Synthetic oligonucleotide
ctttggagctatgttcgctggagctgtgg

SEQ ID NO: 369301 - DNA, 30 bp, Artificial Sequence; identical to SEQ ID NO: 9852
  Description of Artificial Sequence: Synthetic oligonucleotide

SEQ ID NO: 369302 - DNA, 29 bp, Artificial Sequence
  Description of Artificial Sequence: Synthetic oligonucleotide
ttggagctatgttcgctggagctgtggtc

SEQ ID NO: 369303 - DNA, 28 bp, Artificial Sequence
  Description of Artificial Sequence: Synthetic oligonucleotide
tggagctatgttcgctggagctgtggtc

SEQ ID NO: 369304 - DNA, 27 bp, Artificial Sequence
  Description of Artificial Sequence: Synthetic oligonucleotide
ggagctatgttcgctggagctgtggtc

SEQ ID NO: 369305 - DNA, 27 bp, Artificial Sequence
  Description of Artificial Sequence: Synthetic oligonucleotide
gagctatgttcgctggagctgtggtcg

SEQ ID NO: 369306 - DNA, 27 bp, Artificial Sequence
  Description of Artificial Sequence: Synthetic oligonucleotide
agctatgttcgctggagctgtggtcgc

SEQ ID NO: 369307 - DNA, 27 bp, Artificial Sequence
  Description of Artificial Sequence: Synthetic oligonucleotide
gctatgttcgctggagctgtggtcgct

SEQ ID NO: 369308 - DNA, 27 bp, Artificial Sequence
  Description of Artificial Sequence: Synthetic oligonucleotide
ctatgttcgctggagctgtggtcgctg

SEQ ID NO: 369309 - DNA, 27 bp, Artificial Sequence
  Description of Artificial Sequence: Synthetic oligonucleotide
tatgttcgctggagctgtggtcgctgc

SEQ ID NO: 369310 - DNA, 27 bp, Artificial Sequence
  Description of Artificial Sequence: Synthetic oligonucleotide
atgttcgctggagctgtggtcgctgct

SEQ ID NO: 369311 - DNA, 28 bp, Artificial Sequence
  Description of Artificial Sequence: Synthetic oligonucleotide
gggatggaaccttccagaagtgggcatc

SEQ ID NO: 369312 - DNA, 29 bp, Artificial Sequence
  Description of Artificial Sequence: Synthetic oligonucleotide
ggatggaaccttccagaagtgggcatctg

SEQ ID NO: 369313 - DNA, 30 bp, Artificial Sequence; identical to SEQ ID NO: 19601
  Description of Artificial Sequence: Synthetic oligonucleotide

SEQ ID NO: 369314 - DNA, 30 bp, Artificial Sequence; identical to SEQ ID NO: 19602
  Description of Artificial Sequence: Synthetic oligonucleotide

SEQ ID NO: 369315 - DNA, 29 bp, Artificial Sequence
  Description of Artificial Sequence: Synthetic oligonucleotide
tggaaccttccagaagtgggcatctgtgg

SEQ ID NO: 369316 - DNA, 28 bp, Artificial Sequence
  Description of Artificial Sequence: Synthetic oligonucleotide
ggaaccttccagaagtgggcatctgtgg

SEQ ID NO: 369317 - DNA, 29 bp, Artificial Sequence
  Description of Artificial Sequence: Synthetic oligonucleotide
gaaccttccagaagtgggcatctgtggtg

SEQ ID NO: 369318 - DNA, 29 bp, Artificial Sequence
  Description of Artificial Sequence: Synthetic oligonucleotide
aaccttccagaagtgggcatctgtggtgg

SEQ ID NO: 369319 - DNA, 28 bp, Artificial Sequence
  Description of Artificial Sequence: Synthetic oligonucleotide
accttccagaagtgggcatctgtggtgg

SEQ ID NO: 369320 - DNA, 27 bp, Artificial Sequence
  Description of Artificial Sequence: Synthetic oligonucleotide
ccttccagaagtgggcatctgtggtgg

SEQ ID NO: 369321 - DNA, 28 bp, Artificial Sequence
  Description of Artificial Sequence: Synthetic oligonucleotide
cttccagaagtgggcatctgtggtggtg

SEQ ID NO: 369322 - DNA, 28 bp, Artificial Sequence
  Description of Artificial Sequence: Synthetic oligonucleotide
ttccagaagtgggcatctgtggtggtgc

SEQ ID NO: 369323 - DNA, 27 bp, Artificial Sequence
  Description of Artificial Sequence: Synthetic oligonucleotide
tccagaagtgggcatctgtggtggtgc

SEQ ID NO: 369324 - DNA, 26 bp, Artificial Sequence
  Description of Artificial Sequence: Synthetic oligonucleotide
ccagaagtgggcatctgtggtggtgc

SEQ ID NO: 369325 - DNA, 27 bp, Artificial Sequence
  Description of Artificial Sequence: Synthetic oligonucleotide
cagaagtgggcatctgtggtggtgcct

SEQ ID NO: 369326 - DNA, 28 bp, Artificial Sequence
  Description of Artificial Sequence: Synthetic oligonucleotide
agaagtgggcatctgtggtggtgccttc

SEQ ID NO: 369327 - DNA, 27 bp, Artificial Sequence
  Description of Artificial Sequence: Synthetic oligonucleotide
gaagtgggcatctgtggtggtgccttc

SEQ ID NO: 369328 - DNA, 28 bp, Artificial Sequence
  Description of Artificial Sequence: Synthetic oligonucleotide
aagtgggcatctgtggtggtgccttctg

SEQ ID NO: 369329 - DNA, 27 bp, Artificial Sequence
  Description of Artificial Sequence: Synthetic oligonucleotide
agtgggcatctgtggtggtgccttctg

SEQ ID NO: 369330 - DNA, 26 bp, Artificial Sequence
  Description of Artificial Sequence: Synthetic oligonucleotide
gtgggcatctgtggtggtgccttctg

SEQ ID NO: 369331 - DNA, 27 bp, Artificial Sequence
  Description of Artificial Sequence: Synthetic oligonucleotide
tgggcatctgtggtggtgccttctgga

SEQ ID NO: 369332 - DNA, 26 bp, Artificial Sequence
  Description of Artificial Sequence: Synthetic oligonucleotide
gggcatctgtggtggtgccttctgga

SEQ ID NO: 369333 - DNA, 27 bp, Artificial Sequence
  Description of Artificial Sequence: Synthetic oligonucleotide
ggcatctgtggtggtgccttctggaca

SEQ ID NO: 369334 - DNA, 27 bp, Artificial Sequence
  Description of Artificial Sequence: Synthetic oligonucleotide
gcatctgtggtggtgccttctggacag

SEQ ID NO: 369335 - DNA, 27 bp, Artificial Sequence
  Description of Artificial Sequence: Synthetic oligonucleotide
catctgtggtggtgccttctggacagg

SEQ ID NO: 369336 - DNA, 28 bp, Artificial Sequence
  Description of Artificial Sequence: Synthetic oligonucleotide
atctgtggtggtgccttctggacaggag

SEQ ID NO: 369337 - DNA, 21 bp, Artificial Sequence
  Description of Artificial Sequence: Synthetic oligonucleotide
cgcaagtgggaggcggcccga

SEQ ID NO: 369338 - DNA, 22 bp, Artificial Sequence
  Description of Artificial Sequence: Synthetic oligonucleotide
gcaagtgggaggcggcccgagt

SEQ ID NO: 369339 - DNA, 22 bp, Artificial Sequence
  Description of Artificial Sequence: Synthetic oligonucleotide
caagtgggaggcggcccgagtg

SEQ ID NO: 369340 - DNA, 22 bp, Artificial Sequence
  Description of Artificial Sequence: Synthetic oligonucleotide
aagtgggaggcggcccgagtgg

SEQ ID NO: 369341 - DNA, 21 bp, Artificial Sequence
  Description of Artificial Sequence: Synthetic oligonucleotide
agtgggaggcggcccgagtgg

SEQ ID NO: 369342 - DNA, 20 bp, Artificial Sequence
  Description of Artificial Sequence: Synthetic oligonucleotide
gtgggaggcggcccgagtgg

SEQ ID NO: 369343 - DNA, 20 bp, Artificial Sequence
  Description of Artificial Sequence: Synthetic oligonucleotide
tgggaggcggcccgagtggc

SEQ ID NO: 369344 - DNA, 20 bp, Artificial Sequence
  Description of Artificial Sequence: Synthetic oligonucleotide
gggaggcggcccgagtggct

SEQ ID NO: 369345 - DNA, 20 bp, Artificial Sequence
  Description of Artificial Sequence: Synthetic oligonucleotide
ggaggcggcccgagtggcgt

SEQ ID NO: 369346 - DNA, 20 bp, Artificial Sequence
  Description of Artificial Sequence: Synthetic oligonucleotide
gaggcggcccgagtggcgga

SEQ ID NO: 369347 - DNA, 20 bp, Artificial Sequence
  Description of Artificial Sequence: Synthetic oligonucleotide
aggcggcccgagtggcggag

SEQ ID NO: 369348 - DNA, 20 bp, Artificial Sequence
  Description of Artificial Sequence: Synthetic oligonucleotide
ggcggcccgagtggcggagt

SEQ ID NO: 369349 - DNA, 20 bp, Artificial Sequence
  Description of Artificial Sequence: Synthetic oligonucleotide
gcggcccgagtggcggagca

SEQ ID NO: 369350 - DNA, 22 bp, Artificial Sequence
  Description of Artificial Sequence: Synthetic oligonucleotide
cggcccgagtggcggagcagtt

SEQ ID NO: 369351 - DNA, 23 bp, Artificial Sequence
  Description of Artificial Sequence: Synthetic oligonucleotide
ggcccgagtggcggagcagttga

SEQ ID NO: 369352 - DNA, 24 bp, Artificial Sequence
  Description of Artificial Sequence: Synthetic oligonucleotide
gcccgagtggcggagcagttgaga

SEQ ID NO: 369353 - DNA, 24 bp, Artificial Sequence
  Description of Artificial Sequence: Synthetic oligonucleotide
cccgagtggcggagcagttgagag

SEQ ID NO: 369354 - DNA, 24 bp, Artificial Sequence
  Description of Artificial Sequence: Synthetic oligonucleotide
ccgagtggcggagcagttgagagc

SEQ ID NO: 369355 - DNA, 26 bp, Artificial Sequence
  Description of Artificial Sequence: Synthetic oligonucleotide
cgagtggcggagcagttgagagccta

SEQ ID NO: 369356 - DNA, 26 bp, Artificial Sequence
  Description of Artificial Sequence: Synthetic oligonucleotide
gagtggcggagcagttgagagcctac

SEQ ID NO: 369357 - DNA, 27 bp, Artificial Sequence
  Description of Artificial Sequence: Synthetic oligonucleotide
agtggcggagcagttgagagcctacct

SEQ ID NO: 369358 - DNA, 30 bp, Artificial Sequence; identical to SEQ ID NO: 19646
  Description of Artificial Sequence: Synthetic oligonucleotide

SEQ ID NO: 369359 - DNA, 29 bp, Artificial Sequence
  Description of Artificial Sequence: Synthetic oligonucleotide
ggacgcctacgacggcaaggattacatag

SEQ ID NO: 369360 - DNA, 29 bp, Artificial Sequence
  Description of Artificial Sequence: Synthetic oligonucleotide
gacgcctacgacggcaaggattacatagc

SEQ ID NO: 369361 - DNA, 30 bp, Artificial Sequence; identical to SEQ ID NO: 19649
  Description of Artificial Sequence: Synthetic oligonucleotide

SEQ ID NO: 369362 - DNA, 32 bp, Artificial Sequence; identical to SEQ ID NO: 19650
  Description of Artificial Sequence: Synthetic oligonucleotide

SEQ ID NO: 369363 - DNA, 32 bp, Artificial Sequence; identical to SEQ ID NO: 19651
  Description of Artificial Sequence: Synthetic oligonucleotide

SEQ ID NO: 369364 - DNA, 33 bp, Artificial Sequence; identical to SEQ ID NO: 19652
  Description of Artificial Sequence: Synthetic oligonucleotide

SEQ ID NO: 369365 - DNA, 32 bp, Artificial Sequence; identical to SEQ ID NO: 19653
  Description of Artificial Sequence: Synthetic oligonucleotide

SEQ ID NO: 369366 - DNA, 31 bp, Artificial Sequence; identical to SEQ ID NO: 19654
  Description of Artificial Sequence: Synthetic oligonucleotide

SEQ ID NO: 369367 - DNA, 31 bp, Artificial Sequence; identical to SEQ ID NO: 19655
  Description of Artificial Sequence: Synthetic oligonucleotide

SEQ ID NO: 369368 - DNA, 32 bp, Artificial Sequence; identical to SEQ ID NO: 19656
  Description of Artificial Sequence: Synthetic oligonucleotide

SEQ ID NO: 369369 - DNA, 31 bp, Artificial Sequence; identical to SEQ ID NO: 19657
  Description of Artificial Sequence: Synthetic oligonucleotide

SEQ ID NO: 369370 - DNA, 31 bp, Artificial Sequence; identical to SEQ ID NO: 19658
  Description of Artificial Sequence: Synthetic oligonucleotide

SEQ ID NO: 369371 - DNA, 32 bp, Artificial Sequence; identical to SEQ ID NO: 19659
  Description of Artificial Sequence: Synthetic oligonucleotide

SEQ ID NO: 369372 - DNA, 32 bp, Artificial Sequence; identical to SEQ ID NO: 19660
  Description of Artificial Sequence: Synthetic oligonucleotide

SEQ ID NO: 369373 - DNA, 32 bp, Artificial Sequence; identical to SEQ ID NO: 19661
  Description of Artificial Sequence: Synthetic oligonucleotide

SEQ ID NO: 369374 - DNA, 31 bp, Artificial Sequence; identical to SEQ ID NO: 19662
  Description of Artificial Sequence: Synthetic oligonucleotide

SEQ ID NO: 369375 - DNA, 30 bp, Artificial Sequence; identical to SEQ ID NO: 19663
  Description of Artificial Sequence: Synthetic oligonucleotide

SEQ ID NO: 369376 - DNA, 30 bp, Artificial Sequence; identical to SEQ ID NO: 19664
  Description of Artificial Sequence: Synthetic oligonucleotide

SEQ ID NO: 369377 - DNA, 31 bp, Artificial Sequence; identical to SEQ ID NO: 19665
  Description of Artificial Sequence: Synthetic oligonucleotide

SEQ ID NO: 369378 - DNA, 30 bp, Artificial Sequence; identical to SEQ ID NO: 19666
  Description of Artificial Sequence: Synthetic oligonucleotide

SEQ ID NO: 369379 - DNA, 29 bp, Artificial Sequence
  Description of Artificial Sequence: Synthetic oligonucleotide
tacatagccttgaacgaggacctgcgctc

SEQ ID NO: 369380 - DNA, 28 bp, Artificial Sequence
  Description of Artificial Sequence: Synthetic oligonucleotide
acatagccttgaacgaggacctgcgctc

SEQ ID NO: 369381 - DNA, 27 bp, Artificial Sequence
  Description of Artificial Sequence: Synthetic oligonucleotide
catagccttgaacgaggacctgcgctc

SEQ ID NO: 369382 - DNA, 29 bp, Artificial Sequence
  Description of Artificial Sequence: Synthetic oligonucleotide
atagccttgaacgaggacctgcgctcttg

SEQ ID NO: 369383 - DNA, 28 bp, Artificial Sequence
  Description of Artificial Sequence: Synthetic oligonucleotide
tagccttgaacgaggacctgcgctcttg

SEQ ID NO: 369384 - DNA, 27 bp, Artificial Sequence
  Description of Artificial Sequence: Synthetic oligonucleotide
agccttgaacgaggacctgcgctcttg

SEQ ID NO: 369385 - DNA, 32 bp, Artificial Sequence
  Description of Artificial Sequence: Synthetic oligonucleotide
ctacgacggcaaggattacatcgccttgaatg

SEQ ID NO: 369386 - DNA, 33 bp, Artificial Sequence
  Description of Artificial Sequence: Synthetic oligonucleotide
tacgacggcaaggattacatcgccttgaatgag

SEQ ID NO: 369387 - DNA, 32 bp, Artificial Sequence
  Description of Artificial Sequence: Synthetic oligonucleotide
acgacggcaaggattacatcgccttgaatgag

SEQ ID NO: 369388 - DNA, 31 bp, Artificial Sequence
  Description of Artificial Sequence: Synthetic oligonucleotide
cgacggcaaggattacatcgccttgaatgag

SEQ ID NO: 369389 - DNA, 31 bp, Artificial Sequence
  Description of Artificial Sequence: Synthetic oligonucleotide
gacggcaaggattacatcgccttgaatgagg

SEQ ID NO: 369390 - DNA, 32 bp, Artificial Sequence
  Description of Artificial Sequence: Synthetic oligonucleotide
acggcaaggattacatcgccttgaatgaggac

SEQ ID NO: 369391 - DNA, 31 bp, Artificial Sequence
  Description of Artificial Sequence: Synthetic oligonucleotide
cggcaaggattacatcgccttgaatgaggac

SEQ ID NO: 369392 - DNA, 31 bp, Artificial Sequence
  Description of Artificial Sequence: Synthetic oligonucleotide
ggcaaggattacatcgccttgaatgaggacc

SEQ ID NO: 369393 - DNA, 32 bp, Artificial Sequence
  Description of Artificial Sequence: Synthetic oligonucleotide
gcaaggattacatcgccttgaatgaggacctg

SEQ ID NO: 369394 - DNA, 32 bp, Artificial Sequence
  Description of Artificial Sequence: Synthetic oligonucleotide
caaggattacatcgccttgaatgaggacctgc

SEQ ID NO: 369395 - DNA, 32 bp, Artificial Sequence
  Description of Artificial Sequence: Synthetic oligonucleotide
aaggattacatcgccttgaatgaggacctgcg

SEQ ID NO: 369396 - DNA, 31 bp, Artificial Sequence
  Description of Artificial Sequence: Synthetic oligonucleotide
aggattacatcgccttgaatgaggacctgcg

SEQ ID NO: 369397 - DNA, 30 bp, Artificial Sequence
  Description of Artificial Sequence: Synthetic oligonucleotide
ggattacatcgccttgaatgaggacctgcg

SEQ ID NO: 369398 - DNA, 30 bp, Artificial Sequence
  Description of Artificial Sequence: Synthetic oligonucleotide
gattacatcgccttgaatgaggacctgcgc

SEQ ID NO: 369399 - DNA, 31 bp, Artificial Sequence
  Description of Artificial Sequence: Synthetic oligonucleotide
attacatcgccttgaatgaggacctgcgctc

SEQ ID NO: 369400 - DNA, 30 bp, Artificial Sequence
  Description of Artificial Sequence: Synthetic oligonucleotide
ttacatcgccttgaatgaggacctgcgctc

SEQ ID NO: 369401 - DNA, 29 bp, Artificial Sequence
  Description of Artificial Sequence: Synthetic oligonucleotide
tacatcgccttgaatgaggacctgcgctc

SEQ ID NO: 369402 - DNA, 28 bp, Artificial Sequence
  Description of Artificial Sequence: Synthetic oligonucleotide
acatcgccttgaatgaggacctgcgctc

SEQ ID NO: 369403 - DNA, 27 bp, Artificial Sequence
  Description of Artificial Sequence: Synthetic oligonucleotide
catcgccttgaatgaggacctgcgctc

SEQ ID NO: 369404 - DNA, 29 bp, Artificial Sequence
  Description of Artificial Sequence: Synthetic oligonucleotide
atcgccttgaatgaggacctgcgctcttg

SEQ ID NO: 369405 - DNA, 28 bp, Artificial Sequence
  Description of Artificial Sequence: Synthetic oligonucleotide
tcgccttgaatgaggacctgcgctcttg

SEQ ID NO: 369406 - DNA, 27 bp, Artificial Sequence
  Description of Artificial Sequence: Synthetic oligonucleotide
cgccttgaatgaggacctgcgctcttg

SEQ ID NO: 369407 - DNA, 27 bp, Artificial Sequence
  Description of Artificial Sequence: Synthetic oligonucleotide
gccttgaatgaggacctgcgctcttgg

SEQ ID NO: 369408 - DNA, 28 bp, Artificial Sequence
  Description of Artificial Sequence: Synthetic oligonucleotide
ccttgaatgaggacctgcgctcttggac

SEQ ID NO: 369409 - DNA, 28 bp, Artificial Sequence
  Description of Artificial Sequence: Synthetic oligonucleotide
cttgaatgaggacctgcgctcttggacc

SEQ ID NO: 369410 - DNA, 28 bp, Artificial Sequence
  Description of Artificial Sequence: Synthetic oligonucleotide
ttgaatgaggacctgcgctcttggaccg

SEQ ID NO: 369411 - DNA, 27 bp, Artificial Sequence
  Description of Artificial Sequence: Synthetic oligonucleotide
ctccgctactacaaccagagcgaggct

SEQ ID NO: 369412 - DNA, 27 bp, Artificial Sequence
  Description of Artificial Sequence: Synthetic oligonucleotide
tccgctactacaaccagagcgaggctg

SEQ ID NO: 369413 - DNA, 26 bp, Artificial Sequence
  Description of Artificial Sequence: Synthetic oligonucleotide
ccgctactacaaccagagcgaggctg

SEQ ID NO: 369414 - DNA, 27 bp, Artificial Sequence
  Description of Artificial Sequence: Synthetic oligonucleotide
cgctactacaaccagagcgaggctggt

SEQ ID NO: 369415 - DNA, 28 bp, Artificial Sequence
  Description of Artificial Sequence: Synthetic oligonucleotide
gctactacaaccagagcgaggctggttc

SEQ ID NO: 369416 - DNA, 29 bp, Artificial Sequence
  Description of Artificial Sequence: Synthetic oligonucleotide
ctactacaaccagagcgaggctggttctc

SEQ ID NO: 369417 - DNA, 30 bp, Artificial Sequence
  Description of Artificial Sequence: Synthetic oligonucleotide
tactacaaccagagcgaggctggttctcac

SEQ ID NO: 369418 - DNA, 29 bp, Artificial Sequence
  Description of Artificial Sequence: Synthetic oligonucleotide
actacaaccagagcgaggctggttctcac

SEQ ID NO: 369419 - DNA, 28 bp, Artificial Sequence
  Description of Artificial Sequence: Synthetic oligonucleotide
ctacaaccagagcgaggctggttctcac

SEQ ID NO: 369420 - DNA, 29 bp, Artificial Sequence
  Description of Artificial Sequence: Synthetic oligonucleotide
tacaaccagagcgaggctggttctcacac

SEQ ID NO: 369421 - DNA, 28 bp, Artificial Sequence
  Description of Artificial Sequence: Synthetic oligonucleotide
acaaccagagcgaggctggttctcacac

SEQ ID NO: 369422 - DNA, 27 bp, Artificial Sequence
  Description of Artificial Sequence: Synthetic oligonucleotide
caaccagagcgaggctggttctcacac

SEQ ID NO: 369423 - DNA, 27 bp, Artificial Sequence
  Description of Artificial Sequence: Synthetic oligonucleotide
aaccagagcgaggctggttctcacacc

SEQ ID NO: 369424 - DNA, 27 bp, Artificial Sequence
  Description of Artificial Sequence: Synthetic oligonucleotide
accagagcgaggctggttctcacacca

SEQ ID NO: 369425 - DNA, 27 bp, Artificial Sequence
  Description of Artificial Sequence: Synthetic oligonucleotide
ccagagcgaggctggttctcacaccat

SEQ ID NO: 369426 - DNA, 27 bp, Artificial Sequence
  Description of Artificial Sequence: Synthetic oligonucleotide
cagagcgaggctggttctcacaccatc

SEQ ID NO: 369427 - DNA, 27 bp, Artificial Sequence
  Description of Artificial Sequence: Synthetic oligonucleotide
agagcgaggctggttctcacaccatcc

SEQ ID NO: 369428 - DNA, 27 bp, Artificial Sequence
  Description of Artificial Sequence: Synthetic oligonucleotide
gagcgaggctggttctcacaccatcca

SEQ ID NO: 369429 - DNA, 27 bp, Artificial Sequence
  Description of Artificial Sequence: Synthetic oligonucleotide
agcgaggctggttctcacaccatccag

SEQ ID NO: 369430 - DNA, 27 bp, Artificial Sequence
  Description of Artificial Sequence: Synthetic oligonucleotide
gcgaggctggttctcacaccatccaga

SEQ ID NO: 369431 - DNA, 28 bp, Artificial Sequence
  Description of Artificial Sequence: Synthetic oligonucleotide
cgaggctggttctcacaccatccagatg

SEQ ID NO: 369432 - DNA, 30 bp, Artificial Sequence
  Description of Artificial Sequence: Synthetic oligonucleotide
gaggctggttctcacaccatccagatgatg

SEQ ID NO: 369433 - DNA, 33 bp, Artificial Sequence
  Description of Artificial Sequence: Synthetic oligonucleotide
aggctggttctcacaccatccagatgatgtatg

SEQ ID NO: 369434 - DNA, 32 bp, Artificial Sequence
  Description of Artificial Sequence: Synthetic oligonucleotide
ggctggttctcacaccatccagatgatgtatg

SEQ ID NO: 369435 - DNA, 32 bp, Artificial Sequence
  Description of Artificial Sequence: Synthetic oligonucleotide
gctggttctcacaccatccagatgatgtatgg

SEQ ID NO: 369436 - DNA, 32 bp, Artificial Sequence
  Description of Artificial Sequence: Synthetic oligonucleotide
ctggttctcacaccatccagatgatgtatggc

SEQ ID NO: 369437 - DNA, 33 bp, Artificial Sequence
  Description of Artificial Sequence: Synthetic oligonucleotide
tggttctcacaccatccagatgatgtatggctg

SEQ ID NO: 369438 - DNA, 25 bp, Artificial Sequence
  Description of Artificial Sequence: Synthetic oligonucleotide
ggcggacatggcggctcagataacc

SEQ ID NO: 369439 - DNA, 26 bp, Artificial Sequence
  Description of Artificial Sequence: Synthetic oligonucleotide
gcggacatggcggctcagataaccca

SEQ ID NO: 369440 - DNA, 26 bp, Artificial Sequence
  Description of Artificial Sequence: Synthetic oligonucleotide
cggacatggcggctcagataacccag

SEQ ID NO: 369441 - DNA, 26 bp, Artificial Sequence
  Description of Artificial Sequence: Synthetic oligonucleotide
ggacatggcggctcagataacccagc

SEQ ID NO: 369442 - DNA, 26 bp, Artificial Sequence
  Description of Artificial Sequence: Synthetic oligonucleotide
gacatggcggctcagataacccagcg

SEQ ID NO: 369443 - DNA, 27 bp, Artificial Sequence
  Description of Artificial Sequence: Synthetic oligonucleotide
acatggcggctcagataacccagcgca

SEQ ID NO: 369444 - DNA, 27 bp, Artificial Sequence
  Description of Artificial Sequence: Synthetic oligonucleotide
catggcggctcagataacccagcgcaa

SEQ ID NO: 369445 - DNA, 27 bp, Artificial Sequence
  Description of Artificial Sequence: Synthetic oligonucleotide
atggcggctcagataacccagcgcaag

SEQ ID NO: 369446 - DNA, 27 bp, Artificial Sequence
  Description of Artificial Sequence: Synthetic oligonucleotide
tggcggctcagataacccagcgcaagt

SEQ ID NO: 369447 - DNA, 26 bp, Artificial Sequence
  Description of Artificial Sequence: Synthetic oligonucleotide
ggcggctcagataacccagcgcaagt

SEQ ID NO: 369448 - DNA, 26 bp, Artificial Sequence
  Description of Artificial Sequence: Synthetic oligonucleotide
gcggctcagataacccagcgcaagtg

SEQ ID NO: 369449 - DNA, 26 bp, Artificial Sequence
  Description of Artificial Sequence: Synthetic oligonucleotide
cggctcagataacccagcgcaagtgg

SEQ ID NO: 369450 - DNA, 27 bp, Artificial Sequence
  Description of Artificial Sequence: Synthetic oligonucleotide
ggctcagataacccagcgcaagtggga

SEQ ID NO: 369451 - DNA, 27 bp, Artificial Sequence
  Description of Artificial Sequence: Synthetic oligonucleotide
gctcagataacccagcgcaagtgggag

SEQ ID NO: 369452 - DNA, 27 bp, Artificial Sequence
  Description of Artificial Sequence: Synthetic oligonucleotide
ctcagataacccagcgcaagtgggagg

SEQ ID NO: 369453 - DNA, 27 bp, Artificial Sequence
  Description of Artificial Sequence: Synthetic oligonucleotide
tcagataacccagcgcaagtgggaggc

SEQ ID NO: 369454 - DNA, 26 bp, Artificial Sequence
  Description of Artificial Sequence: Synthetic oligonucleotide
cagataacccagcgcaagtgggaggc

SEQ ID NO: 369455 - DNA, 26 bp, Artificial Sequence
  Description of Artificial Sequence: Synthetic oligonucleotide
agataacccagcgcaagtgggaggcg

SEQ ID NO: 369456 - DNA, 25 bp, Artificial Sequence
  Description of Artificial Sequence: Synthetic oligonucleotide
gataacccagcgcaagtgggaggcg

SEQ ID NO: 369457 - DNA, 25 bp, Artificial Sequence
  Description of Artificial Sequence: Synthetic oligonucleotide
ataacccagcgcaagtgggaggcgg

SEQ ID NO: 369458 - DNA, 24 bp, Artificial Sequence
  Description of Artificial Sequence: Synthetic oligonucleotide
taacccagcgcaagtgggaggcgg

SEQ ID NO: 369459 - DNA, 23 bp, Artificial Sequence
  Description of Artificial Sequence: Synthetic oligonucleotide
aacccagcgcaagtgggaggcgg

SEQ ID NO: 369460 - DNA, 26 bp, Artificial Sequence
  Description of Artificial Sequence: Synthetic oligonucleotide
gccggagtattgggaccaggagacag

SEQ ID NO: 369461 - DNA, 26 bp, Artificial Sequence
  Description of Artificial Sequence: Synthetic oligonucleotide
ccggagtattgggaccaggagacagg

SEQ ID NO: 369462 - DNA, 27 bp, Artificial Sequence
  Description of Artificial Sequence: Synthetic oligonucleotide
cggagtattgggaccaggagacaggga

SEQ ID NO: 369463 - DNA, 29 bp, Artificial Sequence
  Description of Artificial Sequence: Synthetic oligonucleotide
ggagtattgggaccaggagacagggaaag

SEQ ID NO: 369464 - DNA, 30 bp, Artificial Sequence; identical to SEQ ID NO: 16333
  Description of Artificial Sequence: Synthetic oligonucleotide

SEQ ID NO: 369465 - DNA, 32 bp, Artificial Sequence; identical to SEQ ID NO: 16334
  Description of Artificial Sequence: Synthetic oligonucleotide

SEQ ID NO: 369466 - DNA, 31 bp, Artificial Sequence; identical to SEQ ID NO: 16335
  Description of Artificial Sequence: Synthetic oligonucleotide

SEQ ID NO: 369467 - DNA, 31 bp, Artificial Sequence; identical to SEQ ID NO: 16336
  Description of Artificial Sequence: Synthetic oligonucleotide

SEQ ID NO: 369468 - DNA, 30 bp, Artificial Sequence; identical to SEQ ID NO: 16337
  Description of Artificial Sequence: Synthetic oligonucleotide

SEQ ID NO: 369469 - DNA, 29 bp, Artificial Sequence
  Description of Artificial Sequence: Synthetic oligonucleotide
ttgggaccaggagacagggaaagtgaagg

SEQ ID NO: 369470 - DNA, 28 bp, Artificial Sequence
  Description of Artificial Sequence: Synthetic oligonucleotide
tgggaccaggagacagggaaagtgaagg

SEQ ID NO: 369471 - DNA, 27 bp, Artificial Sequence
  Description of Artificial Sequence: Synthetic oligonucleotide
gggaccaggagacagggaaagtgaagg

SEQ ID NO: 369472 - DNA, 27 bp, Artificial Sequence
  Description of Artificial Sequence: Synthetic oligonucleotide
ggaccaggagacagggaaagtgaaggc

SEQ ID NO: 369473 - DNA, 27 bp, Artificial Sequence
  Description of Artificial Sequence: Synthetic oligonucleotide
gaccaggagacagggaaagtgaaggcc

SEQ ID NO: 369474 - DNA, 27 bp, Artificial Sequence
  Description of Artificial Sequence: Synthetic oligonucleotide
accaggagacagggaaagtgaaggccc

SEQ ID NO: 369475 - DNA, 27 bp, Artificial Sequence
  Description of Artificial Sequence: Synthetic oligonucleotide
ccaggagacagggaaagtgaaggccca

SEQ ID NO: 369476 - DNA, 27 bp, Artificial Sequence
  Description of Artificial Sequence: Synthetic oligonucleotide
caggagacagggaaagtgaaggcccac

SEQ ID NO: 369477 - DNA, 24 bp, Artificial Sequence
  Description of Artificial Sequence: Synthetic oligonucleotide
acgtgcgtggagtggctccgcaga

SEQ ID NO: 369478 - DNA, 23 bp, Artificial Sequence
  Description of Artificial Sequence: Synthetic oligonucleotide
cgtgcgtggagtggctccgcaga

SEQ ID NO: 369479 - DNA, 24 bp, Artificial Sequence
  Description of Artificial Sequence: Synthetic oligonucleotide
gtgcgtggagtggctccgcagaca

SEQ ID NO: 369480 - DNA, 24 bp, Artificial Sequence
  Description of Artificial Sequence: Synthetic oligonucleotide
tgcgtggagtggctccgcagacac

SEQ ID NO: 369481 - DNA, 23 bp, Artificial Sequence
  Description of Artificial Sequence: Synthetic oligonucleotide
gcgtggagtggctccgcagacac

SEQ ID NO: 369482 - DNA, 24 bp, Artificial Sequence
  Description of Artificial Sequence: Synthetic oligonucleotide
cgtggagtggctccgcagacacct

SEQ ID NO: 369483 - DNA, 24 bp, Artificial Sequence
  Description of Artificial Sequence: Synthetic oligonucleotide
gtggagtggctccgcagacacctg

SEQ ID NO: 369484 - DNA, 25 bp, Artificial Sequence
  Description of Artificial Sequence: Synthetic oligonucleotide
tggagtggctccgcagacacctgga

SEQ ID NO: 369485 - DNA, 24 bp, Artificial Sequence
  Description of Artificial Sequence: Synthetic oligonucleotide
ggagtggctccgcagacacctgga

SEQ ID NO: 369486 - DNA, 26 bp, Artificial Sequence
  Description of Artificial Sequence: Synthetic oligonucleotide
gagtggctccgcagacacctggagaa

SEQ ID NO: 369487 - DNA, 26 bp, Artificial Sequence
  Description of Artificial Sequence: Synthetic oligonucleotide
agtggctccgcagacacctggagaac

SEQ ID NO: 369488 - DNA, 25 bp, Artificial Sequence
  Description of Artificial Sequence: Synthetic oligonucleotide
gtggctccgcagacacctggagaac

SEQ ID NO: 369489 - DNA, 25 bp, Artificial Sequence
  Description of Artificial Sequence: Synthetic oligonucleotide
tggctccgcagacacctggagaacg

SEQ ID NO: 369490 - DNA, 24 bp, Artificial Sequence
  Description of Artificial Sequence: Synthetic oligonucleotide
ggctccgcagacacctggagaacg

SEQ ID NO: 369491 - DNA, 24 bp, Artificial Sequence
  Description of Artificial Sequence: Synthetic oligonucleotide
gctccgcagacacctggagaacgg

SEQ ID NO: 369492 - DNA, 26 bp, Artificial Sequence
  Description of Artificial Sequence: Synthetic oligonucleotide
ctccgcagacacctggagaacgggaa

SEQ ID NO: 369493 - DNA, 26 bp, Artificial Sequence
  Description of Artificial Sequence: Synthetic oligonucleotide
tccgcagacacctggagaacgggaag

SEQ ID NO: 369494 - DNA, 25 bp, Artificial Sequence
  Description of Artificial Sequence: Synthetic oligonucleotide
ccgcagacacctggagaacgggaag

SEQ ID NO: 369495 - DNA, 26 bp, Artificial Sequence
  Description of Artificial Sequence: Synthetic oligonucleotide
cgcagacacctggagaacgggaagga

SEQ ID NO: 369496 - DNA, 27 bp, Artificial Sequence
  Description of Artificial Sequence: Synthetic oligonucleotide
gcagacacctggagaacgggaaggaga

SEQ ID NO: 369497 - DNA, 27 bp, Artificial Sequence
  Description of Artificial Sequence: Synthetic oligonucleotide
cagacacctggagaacgggaaggagac

SEQ ID NO: 369498 - DNA, 27 bp, Artificial Sequence
  Description of Artificial Sequence: Synthetic oligonucleotide
agacacctggagaacgggaaggagacg

SEQ ID NO: 369499 - DNA, 26 bp, Artificial Sequence
  Description of Artificial Sequence: Synthetic oligonucleotide
gacacctggagaacgggaaggagacg

SEQ ID NO: 369500 - DNA, 27 bp, Artificial Sequence
  Description of Artificial Sequence: Synthetic oligonucleotide
acacctggagaacgggaaggagacgct

SEQ ID NO: 369501 - DNA, 26 bp, Artificial Sequence
  Description of Artificial Sequence: Synthetic oligonucleotide
cacctggagaacgggaaggagacgct

SEQ ID NO: 369502 - DNA, 21 bp, Artificial Sequence
  Description of Artificial Sequence: Synthetic oligonucleotide
tgcagcgcacggaccccccca

SEQ ID NO: 369503 - DNA, 20 bp, Artificial Sequence
  Description of Artificial Sequence: Synthetic oligonucleotide
gcagcgcacggaccccccca

SEQ ID NO: 369504 - DNA, 20 bp, Artificial Sequence
  Description of Artificial Sequence: Synthetic oligonucleotide
cagcgcacggacccccccag

SEQ ID NO: 369505 - DNA, 21 bp, Artificial Sequence
  Description of Artificial Sequence: Synthetic oligonucleotide
agcgcacggacccccccagga

SEQ ID NO: 369506 - DNA, 20 bp, Artificial Sequence
  Description of Artificial Sequence: Synthetic oligonucleotide
gcgcacggacccccccagga

SEQ ID NO: 369507 - DNA, 20 bp, Artificial Sequence
  Description of Artificial Sequence: Synthetic oligonucleotide
cgcacggacccccccaggac

SEQ ID NO: 369508 - DNA, 20 bp, Artificial Sequence
  Description of Artificial Sequence: Synthetic oligonucleotide
gcacggacccccccaggacg

SEQ ID NO: 369509 - DNA, 24 bp, Artificial Sequence
  Description of Artificial Sequence: Synthetic oligonucleotide
cacggacccccccaggacgcatat

SEQ ID NO: 369510 - DNA, 25 bp, Artificial Sequence
  Description of Artificial Sequence: Synthetic oligonucleotide
acggacccccccaggacgcatatga

SEQ ID NO: 369511 - DNA, 24 bp, Artificial Sequence
  Description of Artificial Sequence: Synthetic oligonucleotide
cggacccccccaggacgcatatga

SEQ ID NO: 369512 - DNA, 25 bp, Artificial Sequence
  Description of Artificial Sequence: Synthetic oligonucleotide
ggacccccccaggacgcatatgact

SEQ ID NO: 369513 - DNA, 26 bp, Artificial Sequence
  Description of Artificial Sequence: Synthetic oligonucleotide
gacccccccaggacgcatatgactca

SEQ ID NO: 369514 - DNA, 26 bp, Artificial Sequence
  Description of Artificial Sequence: Synthetic oligonucleotide
acccccccaggacgcatatgactcac

SEQ ID NO: 369515 - DNA, 25 bp, Artificial Sequence
  Description of Artificial Sequence: Synthetic oligonucleotide
cccccccaggacgcatatgactcac

SEQ ID NO: 369516 - DNA, 26 bp, Artificial Sequence
  Description of Artificial Sequence: Synthetic oligonucleotide
ccccccaggacgcatatgactcacca

SEQ ID NO: 369517 - DNA, 26 bp, Artificial Sequence
  Description of Artificial Sequence: Synthetic oligonucleotide
cccccaggacgcatatgactcaccac

SEQ ID NO: 369518 - DNA, 26 bp, Artificial Sequence
  Description of Artificial Sequence: Synthetic oligonucleotide
ccccaggacgcatatgactcaccacg

SEQ ID NO: 369519 - DNA, 27 bp, Artificial Sequence
  Description of Artificial Sequence: Synthetic oligonucleotide
cccaggacgcatatgactcaccacgct

SEQ ID NO: 369520 - DNA, 27 bp, Artificial Sequence
  Description of Artificial Sequence: Synthetic oligonucleotide
ccaggacgcatatgactcaccacgctg

SEQ ID NO: 369521 - DNA, 28 bp, Artificial Sequence
  Description of Artificial Sequence: Synthetic oligonucleotide
caggacgcatatgactcaccacgctgtc

SEQ ID NO: 369522 - DNA, 29 bp, Artificial Sequence
  Description of Artificial Sequence: Synthetic oligonucleotide
aggacgcatatgactcaccacgctgtctc

SEQ ID NO: 369523 - DNA, 28 bp, Artificial Sequence
  Description of Artificial Sequence: Synthetic oligonucleotide
ggacgcatatgactcaccacgctgtctc

SEQ ID NO: 369524 - DNA, 25 bp, Artificial Sequence
  Description of Artificial Sequence: Synthetic oligonucleotide
caggagggtccggagtattgggacc

SEQ ID NO: 369525 - DNA, 25 bp, Artificial Sequence
  Description of Artificial Sequence: Synthetic oligonucleotide
aggagggtccggagtattgggaccg

SEQ ID NO: 369526 - DNA, 24 bp, Artificial Sequence
  Description of Artificial Sequence: Synthetic oligonucleotide
ggagggtccggagtattgggaccg

SEQ ID NO: 369527 - DNA, 26 bp, Artificial Sequence
  Description of Artificial Sequence: Synthetic oligonucleotide
gagggtccggagtattgggaccggaa

SEQ ID NO: 369528 - DNA, 27 bp, Artificial Sequence
  Description of Artificial Sequence: Synthetic oligonucleotide
agggtccggagtattgggaccggaaca

SEQ ID NO: 369529 - DNA, 26 bp, Artificial Sequence
  Description of Artificial Sequence: Synthetic oligonucleotide
gggtccggagtattgggaccggaaca

SEQ ID NO: 369530 - DNA, 27 bp, Artificial Sequence
  Description of Artificial Sequence: Synthetic oligonucleotide
ggtccggagtattgggaccggaacaca

SEQ ID NO: 369531 - DNA, 27 bp, Artificial Sequence
  Description of Artificial Sequence: Synthetic oligonucleotide
gtccggagtattgggaccggaacacac

SEQ ID NO: 369532 - DNA, 27 bp, Artificial Sequence
  Description of Artificial Sequence: Synthetic oligonucleotide
tccggagtattgggaccggaacacacg

SEQ ID NO: 369533 - DNA, 27 bp, Artificial Sequence
  Description of Artificial Sequence: Synthetic oligonucleotide
tatttcaccacatccgtgtcccggccg

SEQ ID NO: 369534 - DNA, 26 bp, Artificial Sequence
  Description of Artificial Sequence: Synthetic oligonucleotide
atttcaccacatccgtgtcccggccg

SEQ ID NO: 369535 - DNA, 25 bp, Artificial Sequence
  Description of Artificial Sequence: Synthetic oligonucleotide
tttcaccacatccgtgtcccggccg

SEQ ID NO: 369536 - DNA, 24 bp, Artificial Sequence
  Description of Artificial Sequence: Synthetic oligonucleotide
ttcaccacatccgtgtcccggccg

SEQ ID NO: 369537 - DNA, 23 bp, Artificial Sequence
  Description of Artificial Sequence: Synthetic oligonucleotide
tcaccacatccgtgtcccggccg

SEQ ID NO: 369538 - DNA, 22 bp, Artificial Sequence
  Description of Artificial Sequence: Synthetic oligonucleotide
caccacatccgtgtcccggccg

SEQ ID NO: 369539 - DNA, 22 bp, Artificial Sequence
  Description of Artificial Sequence: Synthetic oligonucleotide
accacatccgtgtcccggccgg

SEQ ID NO: 369540 - DNA, 21 bp, Artificial Sequence
  Description of Artificial Sequence: Synthetic oligonucleotide
ccacatccgtgtcccggccgg

SEQ ID NO: 369541 - DNA, 21 bp, Artificial Sequence
  Description of Artificial Sequence: Synthetic oligonucleotide
cacatccgtgtcccggccggg

SEQ ID NO: 369542 - DNA, 21 bp, Artificial Sequence
  Description of Artificial Sequence: Synthetic oligonucleotide
acatccgtgtcccggccgggc

SEQ ID NO: 369543 - DNA, 20 bp, Artificial Sequence
  Description of Artificial Sequence: Synthetic oligonucleotide
catccgtgtcccggccgggc

SEQ ID NO: 369544 - DNA, 20 bp, Artificial Sequence
  Description of Artificial Sequence: Synthetic oligonucleotide
atccgtgtcccggccgggcc

SEQ ID NO: 369545 - DNA, 20 bp, Artificial Sequence
  Description of Artificial Sequence: Synthetic oligonucleotide
tccgtgtcccggccgggcct

SEQ ID NO: 369546 - DNA, 20 bp, Artificial Sequence
  Description of Artificial Sequence: Synthetic oligonucleotide
ccgtgtcccggccgggcctt

SEQ ID NO: 369547 - DNA, 20 bp, Artificial Sequence
  Description of Artificial Sequence: Synthetic oligonucleotide
cgtgtcccggccgggccgtt

SEQ ID NO: 369548 - DNA, 20 bp, Artificial Sequence
  Description of Artificial Sequence: Synthetic oligonucleotide
gtgtcccggccgggccgctt

SEQ ID NO: 369549 - DNA, 20 bp, Artificial Sequence
  Description of Artificial Sequence: Synthetic oligonucleotide
tgtcccggccgggccgcgtt

SEQ ID NO: 369550 - DNA, 20 bp, Artificial Sequence
  Description of Artificial Sequence: Synthetic oligonucleotide
gtcccggccgggccgcgttt

SEQ ID NO: 369551 - DNA, 20 bp, Artificial Sequence
  Description of Artificial Sequence: Synthetic oligonucleotide
tcccggccgggccgcggttt

SEQ ID NO: 369552 - DNA, 20 bp, Artificial Sequence
  Description of Artificial Sequence: Synthetic oligonucleotide
cccggccgggccgcggtttt

SEQ ID NO: 369553 - DNA, 20 bp, Artificial Sequence
  Description of Artificial Sequence: Synthetic oligonucleotide
ccggccgggccgcgggtttt

SEQ ID NO: 369554 - DNA, 20 bp, Artificial Sequence
  Description of Artificial Sequence: Synthetic oligonucleotide
cggccgggccgcggggattt

SEQ ID NO: 369555 - DNA, 20 bp, Artificial Sequence
  Description of Artificial Sequence: Synthetic oligonucleotide
ggccgggccgcggggagttt

SEQ ID NO: 369556 - DNA, 20 bp, Artificial Sequence
  Description of Artificial Sequence: Synthetic oligonucleotide
gccgggccgcggggagcttt

SEQ ID NO: 369557 - DNA, 20 bp, Artificial Sequence
  Description of Artificial Sequence: Synthetic oligonucleotide
ccgggccgcggggagccttt

SEQ ID NO: 369558 - DNA, 20 bp, Artificial Sequence
  Description of Artificial Sequence: Synthetic oligonucleotide
cgggccgcggggagcccttt

SEQ ID NO: 369559 - DNA, 20 bp, Artificial Sequence
  Description of Artificial Sequence: Synthetic oligonucleotide
gggccgcggggagccccttt

SEQ ID NO: 369560 - DNA, 23 bp, Artificial Sequence
  Description of Artificial Sequence: Synthetic oligonucleotide
gacgcttcctccgcgggtaccag

SEQ ID NO: 369561 - DNA, 24 bp, Artificial Sequence
  Description of Artificial Sequence: Synthetic oligonucleotide
acgcttcctccgcgggtaccagca

SEQ ID NO: 369562 - DNA, 26 bp, Artificial Sequence
  Description of Artificial Sequence: Synthetic oligonucleotide
gcggctactacaaccagagcgaggct

SEQ ID NO: 369563 - DNA, 26 bp, Artificial Sequence
  Description of Artificial Sequence: Synthetic oligonucleotide
cggctactacaaccagagcgaggctg

SEQ ID NO: 369564 - DNA, 27 bp, Artificial Sequence
  Description of Artificial Sequence: Synthetic oligonucleotide
ggctactacaaccagagcgaggctggt

SEQ ID NO: 369565 - DNA, 26 bp, Artificial Sequence
  Description of Artificial Sequence: Synthetic oligonucleotide
agatcacccagcgcaagtgggaggca

SEQ ID NO: 369566 - DNA, 25 bp, Artificial Sequence
  Description of Artificial Sequence: Synthetic oligonucleotide
gatcacccagcgcaagtgggaggca

SEQ ID NO: 369567 - DNA, 25 bp, Artificial Sequence
  Description of Artificial Sequence: Synthetic oligonucleotide
atcacccagcgcaagtgggaggcag

SEQ ID NO: 369568 - DNA, 24 bp, Artificial Sequence
  Description of Artificial Sequence: Synthetic oligonucleotide
tcacccagcgcaagtgggaggcag

SEQ ID NO: 369569 - DNA, 23 bp, Artificial Sequence
  Description of Artificial Sequence: Synthetic oligonucleotide
cacccagcgcaagtgggaggcag

SEQ ID NO: 369570 - DNA, 23 bp, Artificial Sequence
  Description of Artificial Sequence: Synthetic oligonucleotide
acccagcgcaagtgggaggcagc

SEQ ID NO: 369571 - DNA, 22 bp, Artificial Sequence
  Description of Artificial Sequence: Synthetic oligonucleotide
cccagcgcaagtgggaggcagc

SEQ ID NO: 369572 - DNA, 22 bp, Artificial Sequence
  Description of Artificial Sequence: Synthetic oligonucleotide
ccagcgcaagtgggaggcagcc

SEQ ID NO: 369573 - DNA, 22 bp, Artificial Sequence
  Description of Artificial Sequence: Synthetic oligonucleotide
cagcgcaagtgggaggcagccc

SEQ ID NO: 369574 - DNA, 23 bp, Artificial Sequence
  Description of Artificial Sequence: Synthetic oligonucleotide
agcgcaagtgggaggcagcccgt

SEQ ID NO: 369575 - DNA, 22 bp, Artificial Sequence
  Description of Artificial Sequence: Synthetic oligonucleotide
gcgcaagtgggaggcagcccgt

SEQ ID NO: 369576 - DNA, 23 bp, Artificial Sequence
  Description of Artificial Sequence: Synthetic oligonucleotide
cgcaagtgggaggcagcccgtgt

SEQ ID NO: 369577 - DNA, 23 bp, Artificial Sequence
  Description of Artificial Sequence: Synthetic oligonucleotide
gcaagtgggaggcagcccgtgtg

SEQ ID NO: 369578 - DNA, 23 bp, Artificial Sequence
  Description of Artificial Sequence: Synthetic oligonucleotide
caagtgggaggcagcccgtgtgg

SEQ ID NO: 369579 - DNA, 23 bp, Artificial Sequence
  Description of Artificial Sequence: Synthetic oligonucleotide
aagtgggaggcagcccgtgtggc

SEQ ID NO: 369580 - DNA, 22 bp, Artificial Sequence
  Description of Artificial Sequence: Synthetic oligonucleotide
agtgggaggcagcccgtgtggc

SEQ ID NO: 369581 - DNA, 21 bp, Artificial Sequence
  Description of Artificial Sequence: Synthetic oligonucleotide
gtgggaggcagcccgtgtggc

SEQ ID NO: 369582 - DNA, 21 bp, Artificial Sequence
  Description of Artificial Sequence: Synthetic oligonucleotide
tgggaggcagcccgtgtggcg

SEQ ID NO: 369583 - DNA, 20 bp, Artificial Sequence
  Description of Artificial Sequence: Synthetic oligonucleotide
gggaggcagcccgtgtggcg

SEQ ID NO: 369584 - DNA, 21 bp, Artificial Sequence
  Description of Artificial Sequence: Synthetic oligonucleotide
ggaggcagcccgtgtggcgga

SEQ ID NO: 369585 - DNA, 21 bp, Artificial Sequence
  Description of Artificial Sequence: Synthetic oligonucleotide
gaggcagcccgtgtggcggag

SEQ ID NO: 369586 - DNA, 22 bp, Artificial Sequence
  Description of Artificial Sequence: Synthetic oligonucleotide
aggcagcccgtgtggcggagca

SEQ ID NO: 369587 - DNA, 21 bp, Artificial Sequence
  Description of Artificial Sequence: Synthetic oligonucleotide
ggcagcccgtgtggcggagca

SEQ ID NO: 369588 - DNA, 23 bp, Artificial Sequence
  Description of Artificial Sequence: Synthetic oligonucleotide
gcagcccgtgtggcggagcagtt

SEQ ID NO: 369589 - DNA, 24 bp, Artificial Sequence
  Description of Artificial Sequence: Synthetic oligonucleotide
cagcccgtgtggcggagcagttga

SEQ ID NO: 369590 - DNA, 25 bp, Artificial Sequence
  Description of Artificial Sequence: Synthetic oligonucleotide
agcccgtgtggcggagcagttgaga

SEQ ID NO: 369591 - DNA, 27 bp, Artificial Sequence
  Description of Artificial Sequence: Synthetic oligonucleotide
ttgagagcctacctggagggcacgtgt

SEQ ID NO: 369592 - DNA, 26 bp, Artificial Sequence
  Description of Artificial Sequence: Synthetic oligonucleotide
tgagagcctacctggagggcacgtgt

SEQ ID NO: 369593 - DNA, 25 bp, Artificial Sequence
  Description of Artificial Sequence: Synthetic oligonucleotide
gagagcctacctggagggcacgtgt

SEQ ID NO: 369594 - DNA, 26 bp, Artificial Sequence
  Description of Artificial Sequence: Synthetic oligonucleotide
agagcctacctggagggcacgtgtgt

SEQ ID NO: 369595 - DNA, 25 bp, Artificial Sequence
  Description of Artificial Sequence: Synthetic oligonucleotide
gagcctacctggagggcacgtgtgt

SEQ ID NO: 369596 - DNA, 25 bp, Artificial Sequence
  Description of Artificial Sequence: Synthetic oligonucleotide
agcctacctggagggcacgtgtgtg

SEQ ID NO: 369597 - DNA, 24 bp, Artificial Sequence
  Description of Artificial Sequence: Synthetic oligonucleotide
gcctacctggagggcacgtgtgtg

SEQ ID NO: 369598 - DNA, 25 bp, Artificial Sequence
  Description of Artificial Sequence: Synthetic oligonucleotide
cctacctggagggcacgtgtgtgga

SEQ ID NO: 369599 - DNA, 26 bp, Artificial Sequence
  Description of Artificial Sequence: Synthetic oligonucleotide
ctacctggagggcacgtgtgtggagt

SEQ ID NO: 369600 - DNA, 26 bp, Artificial Sequence
  Description of Artificial Sequence: Synthetic oligonucleotide
tacctggagggcacgtgtgtggagtg

SEQ ID NO: 369601 - DNA, 25 bp, Artificial Sequence
  Description of Artificial Sequence: Synthetic oligonucleotide
acctggagggcacgtgtgtggagtg

SEQ ID NO: 369602 - DNA, 24 bp, Artificial Sequence
  Description of Artificial Sequence: Synthetic oligonucleotide
cctggagggcacgtgtgtggagtg

SEQ ID NO: 369603 - DNA, 24 bp, Artificial Sequence
  Description of Artificial Sequence: Synthetic oligonucleotide
ctggagggcacgtgtgtggagtgg

SEQ ID NO: 369604 - DNA, 25 bp, Artificial Sequence
  Description of Artificial Sequence: Synthetic oligonucleotide
tggagggcacgtgtgtggagtggct

SEQ ID NO: 369605 - DNA, 24 bp, Artificial Sequence
  Description of Artificial Sequence: Synthetic oligonucleotide
ggagggcacgtgtgtggagtggct

SEQ ID NO: 369606 - DNA, 24 bp, Artificial Sequence
  Description of Artificial Sequence: Synthetic oligonucleotide
gagggcacgtgtgtggagtggctc

SEQ ID NO: 369607 - DNA, 24 bp, Artificial Sequence
  Description of Artificial Sequence: Synthetic oligonucleotide
agggcacgtgtgtggagtggctcc

SEQ ID NO: 369608 - DNA, 23 bp, Artificial Sequence
  Description of Artificial Sequence: Synthetic oligonucleotide
gggcacgtgtgtggagtggctcc

SEQ ID NO: 369609 - DNA, 23 bp, Artificial Sequence
  Description of Artificial Sequence: Synthetic oligonucleotide
ggcacgtgtgtggagtggctccg

SEQ ID NO: 369610 - DNA, 24 bp, Artificial Sequence
  Description of Artificial Sequence: Synthetic oligonucleotide
gcacgtgtgtggagtggctccgca

SEQ ID NO: 369611 - DNA, 27 bp, Artificial Sequence
  Description of Artificial Sequence: Synthetic oligonucleotide
cacgtgtgtggagtggctccgcagata

SEQ ID NO: 369612 - DNA, 27 bp, Artificial Sequence
  Description of Artificial Sequence: Synthetic oligonucleotide
acgtgtgtggagtggctccgcagatac

SEQ ID NO: 369613 - DNA, 26 bp, Artificial Sequence
  Description of Artificial Sequence: Synthetic oligonucleotide
cgtgtgtggagtggctccgcagatac

SEQ ID NO: 369614 - DNA, 27 bp, Artificial Sequence
  Description of Artificial Sequence: Synthetic oligonucleotide
gtgtgtggagtggctccgcagatacct

SEQ ID NO: 369615 - DNA, 27 bp, Artificial Sequence
  Description of Artificial Sequence: Synthetic oligonucleotide
tgtgtggagtggctccgcagatacctg

SEQ ID NO: 369616 - DNA, 26 bp, Artificial Sequence
  Description of Artificial Sequence: Synthetic oligonucleotide
gtgtggagtggctccgcagatacctg

SEQ ID NO: 369617 - DNA, 27 bp, Artificial Sequence
  Description of Artificial Sequence: Synthetic oligonucleotide
tgtggagtggctccgcagatacctgga

SEQ ID NO: 369618 - DNA, 25 bp, Artificial Sequence
  Description of Artificial Sequence: Synthetic oligonucleotide
agacctgggcgggctcccactctat

SEQ ID NO: 369619 - DNA, 24 bp, Artificial Sequence
  Description of Artificial Sequence: Synthetic oligonucleotide
gacctgggcgggctcccactctat

SEQ ID NO: 369620 - DNA, 25 bp, Artificial Sequence
  Description of Artificial Sequence: Synthetic oligonucleotide
acctgggcgggctcccactctatga

SEQ ID NO: 369621 - DNA, 24 bp, Artificial Sequence
  Description of Artificial Sequence: Synthetic oligonucleotide
cctgggcgggctcccactctatga

SEQ ID NO: 369622 - DNA, 24 bp, Artificial Sequence
  Description of Artificial Sequence: Synthetic oligonucleotide
ctgggcgggctcccactctatgag

SEQ ID NO: 369623 - DNA, 27 bp, Artificial Sequence
  Description of Artificial Sequence: Synthetic oligonucleotide
tgggcgggctcccactctatgaggtat

SEQ ID NO: 369624 - DNA, 27 bp, Artificial Sequence
  Description of Artificial Sequence: Synthetic oligonucleotide
gggcgggctcccactctatgaggtatt

SEQ ID NO: 369625 - DNA, 28 bp, Artificial Sequence
  Description of Artificial Sequence: Synthetic oligonucleotide
ggcgggctcccactctatgaggtatttc

SEQ ID NO: 369626 - DNA, 29 bp, Artificial Sequence
  Description of Artificial Sequence: Synthetic oligonucleotide
gcgggctcccactctatgaggtatttcac

SEQ ID NO: 369627 - DNA, 29 bp, Artificial Sequence
  Description of Artificial Sequence: Synthetic oligonucleotide
cgggctcccactctatgaggtatttcacc

SEQ ID NO: 369628 - DNA, 30 bp, Artificial Sequence; identical to SEQ ID NO: 20006
  Description of Artificial Sequence: Synthetic oligonucleotide

SEQ ID NO: 369629 - DNA, 32 bp, Artificial Sequence; identical to SEQ ID NO: 20007
  Description of Artificial Sequence: Synthetic oligonucleotide

SEQ ID NO: 369630 - DNA, 32 bp, Artificial Sequence; identical to SEQ ID NO: 20008
  Description of Artificial Sequence: Synthetic oligonucleotide

SEQ ID NO: 369631 - DNA, 32 bp, Artificial Sequence; identical to SEQ ID NO: 20009
  Description of Artificial Sequence: Synthetic oligonucleotide

SEQ ID NO: 369632 - DNA, 33 bp, Artificial Sequence; identical to SEQ ID NO: 20010
  Description of Artificial Sequence: Synthetic oligonucleotide

SEQ ID NO: 369633 - DNA, 32 bp, Artificial Sequence; identical to SEQ ID NO: 20011
  Description of Artificial Sequence: Synthetic oligonucleotide

SEQ ID NO: 369634 - DNA, 33 bp, Artificial Sequence; identical to SEQ ID NO: 20012
  Description of Artificial Sequence: Synthetic oligonucleotide

SEQ ID NO: 369635 - DNA, 33 bp, Artificial Sequence; identical to SEQ ID NO: 20013
  Description of Artificial Sequence: Synthetic oligonucleotide

SEQ ID NO: 369636 - DNA, 33 bp, Artificial Sequence; identical to SEQ ID NO: 20014
  Description of Artificial Sequence: Synthetic oligonucleotide

SEQ ID NO: 369637 - DNA, 32 bp, Artificial Sequence; identical to SEQ ID NO: 20015
  Description of Artificial Sequence: Synthetic oligonucleotide

SEQ ID NO: 369638 - DNA, 32 bp, Artificial Sequence; identical to SEQ ID NO: 20016
  Description of Artificial Sequence: Synthetic oligonucleotide

SEQ ID NO: 369639 - DNA, 31 bp, Artificial Sequence; identical to SEQ ID NO: 20017
  Description of Artificial Sequence: Synthetic oligonucleotide

SEQ ID NO: 369640 - DNA, 31 bp, Artificial Sequence; identical to SEQ ID NO: 20018
  Description of Artificial Sequence: Synthetic oligonucleotide

SEQ ID NO: 369641 - DNA, 29 bp, Artificial Sequence
  Description of Artificial Sequence: Synthetic oligonucleotide
attacatcgccttgaacgaggacctgcgg

SEQ ID NO: 369642 - DNA, 28 bp, Artificial Sequence
  Description of Artificial Sequence: Synthetic oligonucleotide
ttacatcgccttgaacgaggacctgcgg

SEQ ID NO: 369643 - DNA, 27 bp, Artificial Sequence
  Description of Artificial Sequence: Synthetic oligonucleotide
tacatcgccttgaacgaggacctgcgg

SEQ ID NO: 369644 - DNA, 27 bp, Artificial Sequence
  Description of Artificial Sequence: Synthetic oligonucleotide
acatcgccttgaacgaggacctgcggt

SEQ ID NO: 369645 - DNA, 26 bp, Artificial Sequence
  Description of Artificial Sequence: Synthetic oligonucleotide
catcgccttgaacgaggacctgcggt

SEQ ID NO: 369646 - DNA, 27 bp, Artificial Sequence
  Description of Artificial Sequence: Synthetic oligonucleotide
atcgccttgaacgaggacctgcggtct

SEQ ID NO: 369647 - DNA, 27 bp, Artificial Sequence
  Description of Artificial Sequence: Synthetic oligonucleotide
tcgccttgaacgaggacctgcggtctt

SEQ ID NO: 369648 - DNA, 26 bp, Artificial Sequence
  Description of Artificial Sequence: Synthetic oligonucleotide
cgccttgaacgaggacctgcggtctt

SEQ ID NO: 369649 - DNA, 26 bp, Artificial Sequence
  Description of Artificial Sequence: Synthetic oligonucleotide
gccttgaacgaggacctgcggtcttg

SEQ ID NO: 369650 - DNA, 27 bp, Artificial Sequence
  Description of Artificial Sequence: Synthetic oligonucleotide
ccttgaacgaggacctgcggtcttgga

SEQ ID NO: 369651 - DNA, 27 bp, Artificial Sequence
  Description of Artificial Sequence: Synthetic oligonucleotide
cttgaacgaggacctgcggtcttggac

SEQ ID NO: 369652 - DNA, 27 bp, Artificial Sequence
  Description of Artificial Sequence: Synthetic oligonucleotide
ttgaacgaggacctgcggtcttggacc

SEQ ID NO: 369653 - DNA, 26 bp, Artificial Sequence
  Description of Artificial Sequence: Synthetic oligonucleotide
tgaacgaggacctgcggtcttggacc

SEQ ID NO: 369654 - DNA, 25 bp, Artificial Sequence
  Description of Artificial Sequence: Synthetic oligonucleotide
gaacgaggacctgcggtcttggacc

SEQ ID NO: 369655 - DNA, 25 bp, Artificial Sequence
  Description of Artificial Sequence: Synthetic oligonucleotide
aacgaggacctgcggtcttggaccg

SEQ ID NO: 369656 - DNA, 24 bp, Artificial Sequence
  Description of Artificial Sequence: Synthetic oligonucleotide
acgaggacctgcggtcttggaccg

SEQ ID NO: 369657 - DNA, 23 bp, Artificial Sequence
  Description of Artificial Sequence: Synthetic oligonucleotide
cgaggacctgcggtcttggaccg

SEQ ID NO: 369658 - DNA, 23 bp, Artificial Sequence
  Description of Artificial Sequence: Synthetic oligonucleotide
gaggacctgcggtcttggaccgc

SEQ ID NO: 369659 - DNA, 23 bp, Artificial Sequence
  Description of Artificial Sequence: Synthetic oligonucleotide
aggacctgcggtcttggaccgcg

SEQ ID NO: 369660 - DNA, 22 bp, Artificial Sequence
  Description of Artificial Sequence: Synthetic oligonucleotide
ggacctgcggtcttggaccgcg

SEQ ID NO: 369661 - DNA, 22 bp, Artificial Sequence
  Description of Artificial Sequence: Synthetic oligonucleotide
gacctgcggtcttggaccgcgg

SEQ ID NO: 369662 - DNA, 22 bp, Artificial Sequence
  Description of Artificial Sequence: Synthetic oligonucleotide
acctgcggtcttggaccgcggc

SEQ ID NO: 369663 - DNA, 21 bp, Artificial Sequence
  Description of Artificial Sequence: Synthetic oligonucleotide
cctgcggtcttggaccgcggc

SEQ ID NO: 369664 - DNA, 21 bp, Artificial Sequence
  Description of Artificial Sequence: Synthetic oligonucleotide
ctgcggtcttggaccgcggcg

SEQ ID NO: 369665 - DNA, 22 bp, Artificial Sequence
  Description of Artificial Sequence: Synthetic oligonucleotide
tgcggtcttggaccgcggcgga

SEQ ID NO: 369666 - DNA, 21 bp, Artificial Sequence
  Description of Artificial Sequence: Synthetic oligonucleotide
gcggtcttggaccgcggcgga

SEQ ID NO: 369667 - DNA, 23 bp, Artificial Sequence
  Description of Artificial Sequence: Synthetic oligonucleotide
cggtcttggaccgcggcggacat

SEQ ID NO: 369668 - DNA, 23 bp, Artificial Sequence
  Description of Artificial Sequence: Synthetic oligonucleotide
ggtcttggaccgcggcggacatg

SEQ ID NO: 369669 - DNA, 23 bp, Artificial Sequence
  Description of Artificial Sequence: Synthetic oligonucleotide
gtcttggaccgcggcggacatgg

SEQ ID NO: 369670 - DNA, 25 bp, Artificial Sequence
  Description of Artificial Sequence: Synthetic oligonucleotide
gcggcggacatggcggctcagatta

SEQ ID NO: 369671 - DNA, 25 bp, Artificial Sequence
  Description of Artificial Sequence: Synthetic oligonucleotide
cggcggacatggcggctcagattac

SEQ ID NO: 369672 - DNA, 25 bp, Artificial Sequence
  Description of Artificial Sequence: Synthetic oligonucleotide
ggcggacatggcggctcagattacc

SEQ ID NO: 369673 - DNA, 26 bp, Artificial Sequence
  Description of Artificial Sequence: Synthetic oligonucleotide
gcggacatggcggctcagattaccca

SEQ ID NO: 369674 - DNA, 26 bp, Artificial Sequence
  Description of Artificial Sequence: Synthetic oligonucleotide
cggacatggcggctcagattacccag

SEQ ID NO: 369675 - DNA, 26 bp, Artificial Sequence
  Description of Artificial Sequence: Synthetic oligonucleotide
ggacatggcggctcagattacccagc

SEQ ID NO: 369676 - DNA, 26 bp, Artificial Sequence
  Description of Artificial Sequence: Synthetic oligonucleotide
gacatggcggctcagattacccagcg

SEQ ID NO: 369677 - DNA, 27 bp, Artificial Sequence
  Description of Artificial Sequence: Synthetic oligonucleotide
acatggcggctcagattacccagcgca

SEQ ID NO: 369678 - DNA, 27 bp, Artificial Sequence
  Description of Artificial Sequence: Synthetic oligonucleotide
catggcggctcagattacccagcgcaa

SEQ ID NO: 369679 - DNA, 27 bp, Artificial Sequence
  Description of Artificial Sequence: Synthetic oligonucleotide
atggcggctcagattacccagcgcaag

SEQ ID NO: 369680 - DNA, 27 bp, Artificial Sequence
  Description of Artificial Sequence: Synthetic oligonucleotide
tggcggctcagattacccagcgcaagt

SEQ ID NO: 369681 - DNA, 26 bp, Artificial Sequence
  Description of Artificial Sequence: Synthetic oligonucleotide
ggcggctcagattacccagcgcaagt

SEQ ID NO: 369682 - DNA, 26 bp, Artificial Sequence
  Description of Artificial Sequence: Synthetic oligonucleotide
gcggctcagattacccagcgcaagtg

SEQ ID NO: 369683 - DNA, 26 bp, Artificial Sequence
  Description of Artificial Sequence: Synthetic oligonucleotide
cggctcagattacccagcgcaagtgg

SEQ ID NO: 369684 - DNA, 27 bp, Artificial Sequence
  Description of Artificial Sequence: Synthetic oligonucleotide
ggctcagattacccagcgcaagtggga

SEQ ID NO: 369685 - DNA, 27 bp, Artificial Sequence
  Description of Artificial Sequence: Synthetic oligonucleotide
gctcagattacccagcgcaagtgggag

SEQ ID NO: 369686 - DNA, 27 bp, Artificial Sequence
  Description of Artificial Sequence: Synthetic oligonucleotide
ctcagattacccagcgcaagtgggagg

SEQ ID NO: 369687 - DNA, 27 bp, Artificial Sequence
  Description of Artificial Sequence: Synthetic oligonucleotide
tcagattacccagcgcaagtgggaggc

SEQ ID NO: 369688 - DNA, 26 bp, Artificial Sequence
  Description of Artificial Sequence: Synthetic oligonucleotide
cagattacccagcgcaagtgggaggc

SEQ ID NO: 369689 - DNA, 26 bp, Artificial Sequence
  Description of Artificial Sequence: Synthetic oligonucleotide
agattacccagcgcaagtgggaggcg

SEQ ID NO: 369690 - DNA, 25 bp, Artificial Sequence
  Description of Artificial Sequence: Synthetic oligonucleotide
gattacccagcgcaagtgggaggcg

SEQ ID NO: 369691 - DNA, 25 bp, Artificial Sequence
  Description of Artificial Sequence: Synthetic oligonucleotide
attacccagcgcaagtgggaggcgg

SEQ ID NO: 369692 - DNA, 24 bp, Artificial Sequence
  Description of Artificial Sequence: Synthetic oligonucleotide
ttacccagcgcaagtgggaggcgg

SEQ ID NO: 369693 - DNA, 23 bp, Artificial Sequence
  Description of Artificial Sequence: Synthetic oligonucleotide
tacccagcgcaagtgggaggcgg

SEQ ID NO: 369694 - DNA, 21 bp, Artificial Sequence
  Description of Artificial Sequence: Synthetic oligonucleotide
cgcgggcgccgtggatagagc

SEQ ID NO: 369695 - DNA, 21 bp, Artificial Sequence
  Description of Artificial Sequence: Synthetic oligonucleotide
gcgggcgccgtggatagagcg

SEQ ID NO: 369696 - DNA, 21 bp, Artificial Sequence
  Description of Artificial Sequence: Synthetic oligonucleotide
cgggcgccgtggatagagcgg

SEQ ID NO: 369697 - DNA, 22 bp, Artificial Sequence
  Description of Artificial Sequence: Synthetic oligonucleotide
gggcgccgtggatagagcggga

SEQ ID NO: 369698 - DNA, 22 bp, Artificial Sequence
  Description of Artificial Sequence: Synthetic oligonucleotide
ggcgccgtggatagagcgggag

SEQ ID NO: 369699 - DNA, 22 bp, Artificial Sequence
  Description of Artificial Sequence: Synthetic oligonucleotide
gcgccgtggatagagcgggagg

SEQ ID NO: 369700 - DNA, 22 bp, Artificial Sequence
  Description of Artificial Sequence: Synthetic oligonucleotide
cgccgtggatagagcgggaggg

SEQ ID NO: 369701 - DNA, 22 bp, Artificial Sequence
  Description of Artificial Sequence: Synthetic oligonucleotide
gccgtggatagagcgggagggg

SEQ ID NO: 369702 - DNA, 22 bp, Artificial Sequence
  Description of Artificial Sequence: Synthetic oligonucleotide
ccgtggatagagcgggaggggc

SEQ ID NO: 369703 - DNA, 22 bp, Artificial Sequence
  Description of Artificial Sequence: Synthetic oligonucleotide
cgtggatagagcgggaggggcc

SEQ ID NO: 369704 - DNA, 22 bp, Artificial Sequence
  Description of Artificial Sequence: Synthetic oligonucleotide
gtggatagagcgggaggggccg

SEQ ID NO: 369705 - DNA, 23 bp, Artificial Sequence
  Description of Artificial Sequence: Synthetic oligonucleotide
tggatagagcgggaggggccgga

SEQ ID NO: 369706 - DNA, 22 bp, Artificial Sequence
  Description of Artificial Sequence: Synthetic oligonucleotide
ggatagagcgggaggggccgga

SEQ ID NO: 369707 - DNA, 26 bp, Artificial Sequence
  Description of Artificial Sequence: Synthetic oligonucleotide
gatagagcgggaggggccggagtatt

SEQ ID NO: 369708 - DNA, 26 bp, Artificial Sequence
  Description of Artificial Sequence: Synthetic oligonucleotide
atagagcgggaggggccggagtattg

SEQ ID NO: 369709 - DNA, 25 bp, Artificial Sequence
  Description of Artificial Sequence: Synthetic oligonucleotide
tagagcgggaggggccggagtattg

SEQ ID NO: 369710 - DNA, 24 bp, Artificial Sequence
  Description of Artificial Sequence: Synthetic oligonucleotide
agagcgggaggggccggagtattg

SEQ ID NO: 369711 - DNA, 23 bp, Artificial Sequence
  Description of Artificial Sequence: Synthetic oligonucleotide
gagcgggaggggccggagtattg

SEQ ID NO: 369712 - DNA, 23 bp, Artificial Sequence
  Description of Artificial Sequence: Synthetic oligonucleotide
agcgggaggggccggagtattgg

SEQ ID NO: 369713 - DNA, 22 bp, Artificial Sequence
  Description of Artificial Sequence: Synthetic oligonucleotide
gcgggaggggccggagtattgg

SEQ ID NO: 369714 - DNA, 23 bp, Artificial Sequence
  Description of Artificial Sequence: Synthetic oligonucleotide
cgggaggggccggagtattggga

SEQ ID NO: 369715 - DNA, 23 bp, Artificial Sequence
  Description of Artificial Sequence: Synthetic oligonucleotide
gggaggggccggagtattgggac

SEQ ID NO: 369716 - DNA, 24 bp, Artificial Sequence
  Description of Artificial Sequence: Synthetic oligonucleotide
tccccagacgccgaggatggccat

SEQ ID NO: 369717 - DNA, 23 bp, Artificial Sequence
  Description of Artificial Sequence: Synthetic oligonucleotide
ccccagacgccgaggatggccat

SEQ ID NO: 369718 - DNA, 25 bp, Artificial Sequence
  Description of Artificial Sequence: Synthetic oligonucleotide
cccagacgccgaggatggccatcat

SEQ ID NO: 369719 - DNA, 25 bp, Artificial Sequence
  Description of Artificial Sequence: Synthetic oligonucleotide
ccagacgccgaggatggccatcatg

SEQ ID NO: 369720 - DNA, 25 bp, Artificial Sequence
  Description of Artificial Sequence: Synthetic oligonucleotide
cagacgccgaggatggccatcatgg

SEQ ID NO: 369721 - DNA, 25 bp, Artificial Sequence
  Description of Artificial Sequence: Synthetic oligonucleotide
agacgccgaggatggccatcatggc

SEQ ID NO: 369722 - DNA, 24 bp, Artificial Sequence
  Description of Artificial Sequence: Synthetic oligonucleotide
gacgccgaggatggccatcatggc

SEQ ID NO: 369723 - DNA, 24 bp, Artificial Sequence
  Description of Artificial Sequence: Synthetic oligonucleotide
acgccgaggatggccatcatggcg

SEQ ID NO: 369724 - DNA, 23 bp, Artificial Sequence
  Description of Artificial Sequence: Synthetic oligonucleotide
cgccgaggatggccatcatggcg

SEQ ID NO: 369725 - DNA, 23 bp, Artificial Sequence
  Description of Artificial Sequence: Synthetic oligonucleotide
gccgaggatggccatcatggcgc

SEQ ID NO: 369726 - DNA, 23 bp, Artificial Sequence
  Description of Artificial Sequence: Synthetic oligonucleotide
ccgaggatggccatcatggcgcc

SEQ ID NO: 369727 - DNA, 23 bp, Artificial Sequence
  Description of Artificial Sequence: Synthetic oligonucleotide
cgaggatggccatcatggcgccc

SEQ ID NO: 369728 - DNA, 23 bp, Artificial Sequence
  Description of Artificial Sequence: Synthetic oligonucleotide
gaggatggccatcatggcgcccc

SEQ ID NO: 369729 - DNA, 25 bp, Artificial Sequence
  Description of Artificial Sequence: Synthetic oligonucleotide
aggatggccatcatggcgccccgaa

SEQ ID NO: 369730 - DNA, 24 bp, Artificial Sequence
  Description of Artificial Sequence: Synthetic oligonucleotide
ggatggccatcatggcgccccgaa

SEQ ID NO: 369731 - DNA, 24 bp, Artificial Sequence
  Description of Artificial Sequence: Synthetic oligonucleotide
gatggccatcatggcgccccgaac

SEQ ID NO: 369732 - DNA, 24 bp, Artificial Sequence
  Description of Artificial Sequence: Synthetic oligonucleotide
atggccatcatggcgccccgaacc

SEQ ID NO: 369733 - DNA, 23 bp, Artificial Sequence
  Description of Artificial Sequence: Synthetic oligonucleotide
tggccatcatggcgccccgaacc

SEQ ID NO: 369734 - DNA, 22 bp, Artificial Sequence
  Description of Artificial Sequence: Synthetic oligonucleotide
ggccatcatggcgccccgaacc

SEQ ID NO: 369735 - DNA, 23 bp, Artificial Sequence
  Description of Artificial Sequence: Synthetic oligonucleotide
gccatcatggcgccccgaaccct

SEQ ID NO: 369736 - DNA, 23 bp, Artificial Sequence
  Description of Artificial Sequence: Synthetic oligonucleotide
ccatcatggcgccccgaaccctc

SEQ ID NO: 369737 - DNA, 24 bp, Artificial Sequence
  Description of Artificial Sequence: Synthetic oligonucleotide
catcatggcgccccgaaccctcgt

SEQ ID NO: 369738 - DNA, 24 bp, Artificial Sequence
  Description of Artificial Sequence: Synthetic oligonucleotide
atcatggcgccccgaaccctcgtc

SEQ ID NO: 369739 - DNA, 29 bp, Artificial Sequence
  Description of Artificial Sequence: Synthetic oligonucleotide
ggagtattgggaccggaacacacggaaag

SEQ ID NO: 369740 - DNA, 30 bp, Artificial Sequence; identical to SEQ ID NO: 17745
  Description of Artificial Sequence: Synthetic oligonucleotide

SEQ ID NO: 369741 - DNA, 32 bp, Artificial Sequence; identical to SEQ ID NO: 17746
  Description of Artificial Sequence: Synthetic oligonucleotide

SEQ ID NO: 369742 - DNA, 31 bp, Artificial Sequence; identical to SEQ ID NO: 17747
  Description of Artificial Sequence: Synthetic oligonucleotide

SEQ ID NO: 369743 - DNA, 31 bp, Artificial Sequence; identical to SEQ ID NO: 17748
  Description of Artificial Sequence: Synthetic oligonucleotide

SEQ ID NO: 369744 - DNA, 30 bp, Artificial Sequence; identical to SEQ ID NO: 17749
  Description of Artificial Sequence: Synthetic oligonucleotide

SEQ ID NO: 369745 - DNA, 29 bp, Artificial Sequence
  Description of Artificial Sequence: Synthetic oligonucleotide
ttgggaccggaacacacggaaagtgaagg

SEQ ID NO: 369746 - DNA, 28 bp, Artificial Sequence
  Description of Artificial Sequence: Synthetic oligonucleotide
tgggaccggaacacacggaaagtgaagg

SEQ ID NO: 369747 - DNA, 27 bp, Artificial Sequence
  Description of Artificial Sequence: Synthetic oligonucleotide
gggaccggaacacacggaaagtgaagg

SEQ ID NO: 369748 - DNA, 27 bp, Artificial Sequence
  Description of Artificial Sequence: Synthetic oligonucleotide
ggaccggaacacacggaaagtgaaggc

SEQ ID NO: 369749 - DNA, 27 bp, Artificial Sequence
  Description of Artificial Sequence: Synthetic oligonucleotide
gaccggaacacacggaaagtgaaggcc

SEQ ID NO: 369750 - DNA, 27 bp, Artificial Sequence
  Description of Artificial Sequence: Synthetic oligonucleotide
accggaacacacggaaagtgaaggccc

SEQ ID NO: 369751 - DNA, 27 bp, Artificial Sequence
  Description of Artificial Sequence: Synthetic oligonucleotide
ccggaacacacggaaagtgaaggccca

SEQ ID NO: 369752 - DNA, 27 bp, Artificial Sequence
  Description of Artificial Sequence: Synthetic oligonucleotide
cggaacacacggaaagtgaaggcccag

SEQ ID NO: 369753 - DNA, 28 bp, Artificial Sequence
  Description of Artificial Sequence: Synthetic oligonucleotide
ggaacacacggaaagtgaaggcccagtc

SEQ ID NO: 369754 - DNA, 29 bp, Artificial Sequence
  Description of Artificial Sequence: Synthetic oligonucleotide
gaacacacggaaagtgaaggcccagtcac

SEQ ID NO: 369755 - DNA, 30 bp, Artificial Sequence; identical to SEQ ID NO: 20345
  Description of Artificial Sequence: Synthetic oligonucleotide

SEQ ID NO: 369756 - DNA, 29 bp, Artificial Sequence
  Description of Artificial Sequence: Synthetic oligonucleotide
acacacggaaagtgaaggcccagtcacag

SEQ ID NO: 369757 - DNA, 28 bp, Artificial Sequence
  Description of Artificial Sequence: Synthetic oligonucleotide
cacacggaaagtgaaggcccagtcacag

SEQ ID NO: 369758 - DNA, 29 bp, Artificial Sequence
  Description of Artificial Sequence: Synthetic oligonucleotide
acggaaagtgaaggcccagtcacagactg

SEQ ID NO: 369759 - DNA, 28 bp, Artificial Sequence
  Description of Artificial Sequence: Synthetic oligonucleotide
cggaaagtgaaggcccagtcacagactg

SEQ ID NO: 369760 - DNA, 23 bp, Artificial Sequence
  Description of Artificial Sequence: Synthetic oligonucleotide
agcgcacggacgcccccaagaca

SEQ ID NO: 369761 - DNA, 22 bp, Artificial Sequence
  Description of Artificial Sequence: Synthetic oligonucleotide
gcgcacggacgcccccaagaca

SEQ ID NO: 369762 - DNA, 26 bp, Artificial Sequence
  Description of Artificial Sequence: Synthetic oligonucleotide
cgcacggacgcccccaagacacatat

SEQ ID NO: 369763 - DNA, 27 bp, Artificial Sequence
  Description of Artificial Sequence: Synthetic oligonucleotide
gcacggacgcccccaagacacatatga

SEQ ID NO: 369764 - DNA, 27 bp, Artificial Sequence
  Description of Artificial Sequence: Synthetic oligonucleotide
cacggacgcccccaagacacatatgac

SEQ ID NO: 369765 - DNA, 28 bp, Artificial Sequence
  Description of Artificial Sequence: Synthetic oligonucleotide
acggacgcccccaagacacatatgactc

SEQ ID NO: 369766 - DNA, 27 bp, Artificial Sequence
  Description of Artificial Sequence: Synthetic oligonucleotide
cggacgcccccaagacacatatgactc

SEQ ID NO: 369767 - DNA, 28 bp, Artificial Sequence
  Description of Artificial Sequence: Synthetic oligonucleotide
ggacgcccccaagacacatatgactcac

SEQ ID NO: 369768 - DNA, 28 bp, Artificial Sequence
  Description of Artificial Sequence: Synthetic oligonucleotide
gacgcccccaagacacatatgactcacc

SEQ ID NO: 369769 - DNA, 29 bp, Artificial Sequence
  Description of Artificial Sequence: Synthetic oligonucleotide
acgcccccaagacacatatgactcaccac

SEQ ID NO: 369770 - DNA, 28 bp, Artificial Sequence
  Description of Artificial Sequence: Synthetic oligonucleotide
cgcccccaagacacatatgactcaccac

SEQ ID NO: 369771 - DNA, 28 bp, Artificial Sequence
  Description of Artificial Sequence: Synthetic oligonucleotide
gcccccaagacacatatgactcaccacg

SEQ ID NO: 369772 - DNA, 28 bp, Artificial Sequence
  Description of Artificial Sequence: Synthetic oligonucleotide
cccccaagacacatatgactcaccacgc

SEQ ID NO: 369773 - DNA, 29 bp, Artificial Sequence
  Description of Artificial Sequence: Synthetic oligonucleotide
ccccaagacacatatgactcaccacgctg

SEQ ID NO: 369774 - DNA, 30 bp, Artificial Sequence; identical to SEQ ID NO: 20362
  Description of Artificial Sequence: Synthetic oligonucleotide

SEQ ID NO: 369775 - DNA, 31 bp, Artificial Sequence; identical to SEQ ID NO: 20363
  Description of Artificial Sequence: Synthetic oligonucleotide

SEQ ID NO: 369776 - DNA, 32 bp, Artificial Sequence; identical to SEQ ID NO: 20364
  Description of Artificial Sequence: Synthetic oligonucleotide

SEQ ID NO: 369777 - DNA, 33 bp, Artificial Sequence; identical to SEQ ID NO: 20365
  Description of Artificial Sequence: Synthetic oligonucleotide

SEQ ID NO: 369778 - DNA, 32 bp, Artificial Sequence; identical to SEQ ID NO: 20366
  Description of Artificial Sequence: Synthetic oligonucleotide

SEQ ID NO: 369779 - DNA, 31 bp, Artificial Sequence; identical to SEQ ID NO: 20367
  Description of Artificial Sequence: Synthetic oligonucleotide

SEQ ID NO: 369780 - DNA, 31 bp, Artificial Sequence; identical to SEQ ID NO: 20368
  Description of Artificial Sequence: Synthetic oligonucleotide

SEQ ID NO: 369781 - DNA, 30 bp, Artificial Sequence; identical to SEQ ID NO: 20369
  Description of Artificial Sequence: Synthetic oligonucleotide

SEQ ID NO: 369782 - DNA, 32 bp, Artificial Sequence; identical to SEQ ID NO: 20370
  Description of Artificial Sequence: Synthetic oligonucleotide

SEQ ID NO: 369783 - DNA, 24 bp, Artificial Sequence
  Description of Artificial Sequence: Synthetic oligonucleotide
cccaccatccccatcgtgggcatc

SEQ ID NO: 369784 - DNA, 26 bp, Artificial Sequence
  Description of Artificial Sequence: Synthetic oligonucleotide
ccaccatccccatcgtgggcatcctt

SEQ ID NO: 369785 - DNA, 26 bp, Artificial Sequence
  Description of Artificial Sequence: Synthetic oligonucleotide
caccatccccatcgtgggcatccttg

SEQ ID NO: 369786 - DNA, 27 bp, Artificial Sequence
  Description of Artificial Sequence: Synthetic oligonucleotide
accatccccatcgtgggcatccttgct

SEQ ID NO: 369787 - DNA, 26 bp, Artificial Sequence
  Description of Artificial Sequence: Synthetic oligonucleotide
ccatccccatcgtgggcatccttgct

SEQ ID NO: 369788 - DNA, 26 bp, Artificial Sequence
  Description of Artificial Sequence: Synthetic oligonucleotide
catccccatcgtgggcatccttgctg

SEQ ID NO: 369789 - DNA, 26 bp, Artificial Sequence
  Description of Artificial Sequence: Synthetic oligonucleotide
atccccatcgtgggcatccttgctgg

SEQ ID NO: 369790 - DNA, 25 bp, Artificial Sequence
  Description of Artificial Sequence: Synthetic oligonucleotide
tccccatcgtgggcatccttgctgg

SEQ ID NO: 369791 - DNA, 24 bp, Artificial Sequence
  Description of Artificial Sequence: Synthetic oligonucleotide
ccccatcgtgggcatccttgctgg

SEQ ID NO: 369792 - DNA, 24 bp, Artificial Sequence
  Description of Artificial Sequence: Synthetic oligonucleotide
cccatcgtgggcatccttgctggc

SEQ ID NO: 369793 - DNA, 25 bp, Artificial Sequence
  Description of Artificial Sequence: Synthetic oligonucleotide
ccatcgtgggcatccttgctggcct

SEQ ID NO: 369794 - DNA, 25 bp, Artificial Sequence
  Description of Artificial Sequence: Synthetic oligonucleotide
catcgtgggcatccttgctggcctg

SEQ ID NO: 369795 - DNA, 27 bp, Artificial Sequence
  Description of Artificial Sequence: Synthetic oligonucleotide
atcgtgggcatccttgctggcctggtt

SEQ ID NO: 369796 - DNA, 26 bp, Artificial Sequence
  Description of Artificial Sequence: Synthetic oligonucleotide
tcgtgggcatccttgctggcctggtt

SEQ ID NO: 369797 - DNA, 25 bp, Artificial Sequence
  Description of Artificial Sequence: Synthetic oligonucleotide
cgtgggcatccttgctggcctggtt

SEQ ID NO: 369798 - DNA, 26 bp, Artificial Sequence
  Description of Artificial Sequence: Synthetic oligonucleotide
gtgggcatccttgctggcctggttct

SEQ ID NO: 369799 - DNA, 27 bp, Artificial Sequence
  Description of Artificial Sequence: Synthetic oligonucleotide
tgggcatccttgctggcctggttctct

SEQ ID NO: 369800 - DNA, 27 bp, Artificial Sequence
  Description of Artificial Sequence: Synthetic oligonucleotide
gggcatccttgctggcctggttctctt

SEQ ID NO: 369801 - DNA, 28 bp, Artificial Sequence
  Description of Artificial Sequence: Synthetic oligonucleotide
ggcatccttgctggcctggttctctttg

SEQ ID NO: 369802 - DNA, 28 bp, Artificial Sequence
  Description of Artificial Sequence: Synthetic oligonucleotide
gcatccttgctggcctggttctctttgg

SEQ ID NO: 369803 - DNA, 29 bp, Artificial Sequence
  Description of Artificial Sequence: Synthetic oligonucleotide
catccttgctggcctggttctctttggag

SEQ ID NO: 369804 - DNA, 29 bp, Artificial Sequence
  Description of Artificial Sequence: Synthetic oligonucleotide
atccttgctggcctggttctctttggagc

SEQ ID NO: 369805 - DNA, 28 bp, Artificial Sequence
  Description of Artificial Sequence: Synthetic oligonucleotide
tccttgctggcctggttctctttggagc

SEQ ID NO: 369806 - DNA, 27 bp, Artificial Sequence
  Description of Artificial Sequence: Synthetic oligonucleotide
ccttgctggcctggttctctttggagc

SEQ ID NO: 369807 - DNA, 28 bp, Artificial Sequence
  Description of Artificial Sequence: Synthetic oligonucleotide
cttgctggcctggttctctttggagctg

SEQ ID NO: 369808 - DNA, 27 bp, Artificial Sequence
  Description of Artificial Sequence: Synthetic oligonucleotide
tcacagactgaccgagtggacctgggt

SEQ ID NO: 369809 - DNA, 27 bp, Artificial Sequence
  Description of Artificial Sequence: Synthetic oligonucleotide
cacagactgaccgagtggacctgggta

SEQ ID NO: 369810 - DNA, 27 bp, Artificial Sequence
  Description of Artificial Sequence: Synthetic oligonucleotide
acagactgaccgagtggacctgggtac

SEQ ID NO: 369811 - DNA, 26 bp, Artificial Sequence
  Description of Artificial Sequence: Synthetic oligonucleotide
cagactgaccgagtggacctgggtac

SEQ ID NO: 369812 - DNA, 26 bp, Artificial Sequence
  Description of Artificial Sequence: Synthetic oligonucleotide
agactgaccgagtggacctgggtacc

SEQ ID NO: 369813 - DNA, 25 bp, Artificial Sequence
  Description of Artificial Sequence: Synthetic oligonucleotide
gactgaccgagtggacctgggtacc

SEQ ID NO: 369814 - DNA, 26 bp, Artificial Sequence
  Description of Artificial Sequence: Synthetic oligonucleotide
actgaccgagtggacctgggtaccct

SEQ ID NO: 369815 - DNA, 25 bp, Artificial Sequence
  Description of Artificial Sequence: Synthetic oligonucleotide
ctgaccgagtggacctgggtaccct

SEQ ID NO: 369816 - DNA, 25 bp, Artificial Sequence
  Description of Artificial Sequence: Synthetic oligonucleotide
tgaccgagtggacctgggtaccctg

SEQ ID NO: 369817 - DNA, 24 bp, Artificial Sequence
  Description of Artificial Sequence: Synthetic oligonucleotide
gaccgagtggacctgggtaccctg

SEQ ID NO: 369818 - DNA, 24 bp, Artificial Sequence
  Description of Artificial Sequence: Synthetic oligonucleotide
accgagtggacctgggtaccctgc

SEQ ID NO: 369819 - DNA, 23 bp, Artificial Sequence
  Description of Artificial Sequence: Synthetic oligonucleotide
ccgagtggacctgggtaccctgc

SEQ ID NO: 369820 - DNA, 23 bp, Artificial Sequence
  Description of Artificial Sequence: Synthetic oligonucleotide
cgagtggacctgggtaccctgcg

SEQ ID NO: 369821 - DNA, 23 bp, Artificial Sequence
  Description of Artificial Sequence: Synthetic oligonucleotide
gagtggacctgggtaccctgcgc

SEQ ID NO: 369822 - DNA, 23 bp, Artificial Sequence
  Description of Artificial Sequence: Synthetic oligonucleotide
agtggacctgggtaccctgcgcg

SEQ ID NO: 369823 - DNA, 22 bp, Artificial Sequence
  Description of Artificial Sequence: Synthetic oligonucleotide
gtggacctgggtaccctgcgcg

SEQ ID NO: 369824 - DNA, 22 bp, Artificial Sequence
  Description of Artificial Sequence: Synthetic oligonucleotide
tggacctgggtaccctgcgcgg

SEQ ID NO: 369825 - DNA, 21 bp, Artificial Sequence
  Description of Artificial Sequence: Synthetic oligonucleotide
ggacctgggtaccctgcgcgg

SEQ ID NO: 369826 - DNA, 23 bp, Artificial Sequence
  Description of Artificial Sequence: Synthetic oligonucleotide
gacctgggtaccctgcgcggcta

SEQ ID NO: 369827 - DNA, 25 bp, Artificial Sequence
  Description of Artificial Sequence: Synthetic oligonucleotide
acctgggtaccctgcgcggctacta

SEQ ID NO: 369828 - DNA, 24 bp, Artificial Sequence
  Description of Artificial Sequence: Synthetic oligonucleotide
cctgggtaccctgcgcggctacta

SEQ ID NO: 369829 - DNA, 26 bp, Artificial Sequence
  Description of Artificial Sequence: Synthetic oligonucleotide
ctgggtaccctgcgcggctactacaa

SEQ ID NO: 369830 - DNA, 26 bp, Artificial Sequence
  Description of Artificial Sequence: Synthetic oligonucleotide
tgggtaccctgcgcggctactacaac

SEQ ID NO: 369831 - DNA, 25 bp, Artificial Sequence
  Description of Artificial Sequence: Synthetic oligonucleotide
gggtaccctgcgcggctactacaac

SEQ ID NO: 369832 - DNA, 26 bp, Artificial Sequence
  Description of Artificial Sequence: Synthetic oligonucleotide
ggtaccctgcgcggctactacaacca

SEQ ID NO: 369833 - DNA, 27 bp, Artificial Sequence
  Description of Artificial Sequence: Synthetic oligonucleotide
gtaccctgcgcggctactacaaccaga

SEQ ID NO: 369834 - DNA, 27 bp, Artificial Sequence
  Description of Artificial Sequence: Synthetic oligonucleotide
taccctgcgcggctactacaaccagag

SEQ ID NO: 369835 - DNA, 25 bp, Artificial Sequence
  Description of Artificial Sequence: Synthetic oligonucleotide
agacggcccatgaggcggagcagtt

SEQ ID NO: 369836 - DNA, 24 bp, Artificial Sequence
  Description of Artificial Sequence: Synthetic oligonucleotide
gacggcccatgaggcggagcagtt

SEQ ID NO: 369837 - DNA, 25 bp, Artificial Sequence
  Description of Artificial Sequence: Synthetic oligonucleotide
acggcccatgaggcggagcagttga

SEQ ID NO: 369838 - DNA, 23 bp, Artificial Sequence
  Description of Artificial Sequence: Synthetic oligonucleotide
acggcccatgaggcggagcagct

SEQ ID NO: 369839 - DNA, 31 bp, Artificial Sequence; identical to SEQ ID NO: 20430
  Description of Artificial Sequence: Synthetic oligonucleotide

SEQ ID NO: 369840 - DNA, 30 bp, Artificial Sequence; identical to SEQ ID NO: 20431
  Description of Artificial Sequence: Synthetic oligonucleotide

SEQ ID NO: 369841 - DNA, 30 bp, Artificial Sequence; identical to SEQ ID NO: 20432
  Description of Artificial Sequence: Synthetic oligonucleotide

SEQ ID NO: 369842 - DNA, 30 bp, Artificial Sequence; identical to SEQ ID NO: 20433
  Description of Artificial Sequence: Synthetic oligonucleotide

SEQ ID NO: 369843 - DNA, 29 bp, Artificial Sequence
  Description of Artificial Sequence: Synthetic oligonucleotide
cgcttacgacggcaaggattacatctccc

SEQ ID NO: 369844 - DNA, 30 bp, Artificial Sequence; identical to SEQ ID NO: 20435
  Description of Artificial Sequence: Synthetic oligonucleotide

SEQ ID NO: 369845 - DNA, 32 bp, Artificial Sequence; identical to SEQ ID NO: 20436
  Description of Artificial Sequence: Synthetic oligonucleotide

SEQ ID NO: 369846 - DNA, 32 bp, Artificial Sequence; identical to SEQ ID NO: 20437
  Description of Artificial Sequence: Synthetic oligonucleotide

SEQ ID NO: 369847 - DNA, 31 bp, Artificial Sequence; identical to SEQ ID NO: 20438
  Description of Artificial Sequence: Synthetic oligonucleotide

SEQ ID NO: 369848 - DNA, 30 bp, Artificial Sequence; identical to SEQ ID NO: 20439
  Description of Artificial Sequence: Synthetic oligonucleotide

SEQ ID NO: 369849 - DNA, 29 bp, Artificial Sequence
  Description of Artificial Sequence: Synthetic oligonucleotide
cgacggcaaggattacatctccctgaacg

SEQ ID NO: 369850 - DNA, 30 bp, Artificial Sequence; identical to SEQ ID NO: 20441
  Description of Artificial Sequence: Synthetic oligonucleotide

SEQ ID NO: 369851 - DNA, 30 bp, Artificial Sequence; identical to SEQ ID NO: 20442
  Description of Artificial Sequence: Synthetic oligonucleotide

SEQ ID NO: 369852 - DNA, 29 bp, Artificial Sequence
  Description of Artificial Sequence: Synthetic oligonucleotide
cggcaaggattacatctccctgaacgagg

SEQ ID NO: 369853 - DNA, 30 bp, Artificial Sequence; identical to SEQ ID NO: 20444
  Description of Artificial Sequence: Synthetic oligonucleotide

SEQ ID NO: 369854 - DNA, 30 bp, Artificial Sequence; identical to SEQ ID NO: 20445
  Description of Artificial Sequence: Synthetic oligonucleotide

SEQ ID NO: 369855 - DNA, 31 bp, Artificial Sequence; identical to SEQ ID NO: 20446
  Description of Artificial Sequence: Synthetic oligonucleotide

SEQ ID NO: 369856 - DNA, 31 bp, Artificial Sequence; identical to SEQ ID NO: 20447
  Description of Artificial Sequence: Synthetic oligonucleotide

SEQ ID NO: 369857 - DNA, 30 bp, Artificial Sequence; identical to SEQ ID NO: 20448
  Description of Artificial Sequence: Synthetic oligonucleotide

SEQ ID NO: 369858 - DNA, 29 bp, Artificial Sequence
  Description of Artificial Sequence: Synthetic oligonucleotide
ggattacatctccctgaacgaggacctgc

SEQ ID NO: 369859 - DNA, 29 bp, Artificial Sequence
  Description of Artificial Sequence: Synthetic oligonucleotide
gattacatctccctgaacgaggacctgcg

SEQ ID NO: 369860 - DNA, 29 bp, Artificial Sequence
  Description of Artificial Sequence: Synthetic oligonucleotide
attacatctccctgaacgaggacctgcgc

SEQ ID NO: 369861 - DNA, 28 bp, Artificial Sequence
  Description of Artificial Sequence: Synthetic oligonucleotide
ttacatctccctgaacgaggacctgcgc

SEQ ID NO: 369862 - DNA, 27 bp, Artificial Sequence
  Description of Artificial Sequence: Synthetic oligonucleotide
tacatctccctgaacgaggacctgcgc

SEQ ID NO: 369863 - DNA, 27 bp, Artificial Sequence
  Description of Artificial Sequence: Synthetic oligonucleotide
acatctccctgaacgaggacctgcgct

SEQ ID NO: 369864 - DNA, 26 bp, Artificial Sequence
  Description of Artificial Sequence: Synthetic oligonucleotide
catctccctgaacgaggacctgcgct

SEQ ID NO: 369865 - DNA, 27 bp, Artificial Sequence
  Description of Artificial Sequence: Synthetic oligonucleotide
atctccctgaacgaggacctgcgctct

SEQ ID NO: 369866 - DNA, 27 bp, Artificial Sequence
  Description of Artificial Sequence: Synthetic oligonucleotide
tctccctgaacgaggacctgcgctctt

SEQ ID NO: 369867 - DNA, 26 bp, Artificial Sequence
  Description of Artificial Sequence: Synthetic oligonucleotide
ctccctgaacgaggacctgcgctctt

SEQ ID NO: 369868 - DNA, 26 bp, Artificial Sequence
  Description of Artificial Sequence: Synthetic oligonucleotide
tccctgaacgaggacctgcgctcttg

SEQ ID NO: 369869 - DNA, 25 bp, Artificial Sequence
  Description of Artificial Sequence: Synthetic oligonucleotide
cagcggagagtctacctggagggca

SEQ ID NO: 369870 - DNA, 25 bp, Artificial Sequence
  Description of Artificial Sequence: Synthetic oligonucleotide
agcggagagtctacctggagggcac

SEQ ID NO: 369871 - DNA, 24 bp, Artificial Sequence
  Description of Artificial Sequence: Synthetic oligonucleotide
gcggagagtctacctggagggcac

SEQ ID NO: 369872 - DNA, 25 bp, Artificial Sequence
  Description of Artificial Sequence: Synthetic oligonucleotide
cggagagtctacctggagggcacgt

SEQ ID NO: 369873 - DNA, 26 bp, Artificial Sequence
  Description of Artificial Sequence: Synthetic oligonucleotide
accagagcgaggacggttctcacacc

SEQ ID NO: 369874 - DNA, 25 bp, Artificial Sequence
  Description of Artificial Sequence: Synthetic oligonucleotide
ccagagcgaggacggttctcacacc

SEQ ID NO: 369875 - DNA, 26 bp, Artificial Sequence
  Description of Artificial Sequence: Synthetic oligonucleotide
cagagcgaggacggttctcacaccct

SEQ ID NO: 369876 - DNA, 26 bp, Artificial Sequence
  Description of Artificial Sequence: Synthetic oligonucleotide
agagcgaggacggttctcacaccctc

SEQ ID NO: 369877 - DNA, 25 bp, Artificial Sequence
  Description of Artificial Sequence: Synthetic oligonucleotide
gagcgaggacggttctcacaccctc

SEQ ID NO: 369878 - DNA, 26 bp, Artificial Sequence
  Description of Artificial Sequence: Synthetic oligonucleotide
agcgaggacggttctcacaccctcca

SEQ ID NO: 369879 - DNA, 25 bp, Artificial Sequence
  Description of Artificial Sequence: Synthetic oligonucleotide
gcgaggacggttctcacaccctcca

SEQ ID NO: 369880 - DNA, 27 bp, Artificial Sequence
  Description of Artificial Sequence: Synthetic oligonucleotide
cgaggacggttctcacaccctccagat

SEQ ID NO: 369881 - DNA, 27 bp, Artificial Sequence
  Description of Artificial Sequence: Synthetic oligonucleotide
gaggacggttctcacaccctccagatg

SEQ ID NO: 369882 - DNA, 29 bp, Artificial Sequence
  Description of Artificial Sequence: Synthetic oligonucleotide
aggacggttctcacaccctccagatgatg

SEQ ID NO: 369883 - DNA, 28 bp, Artificial Sequence
  Description of Artificial Sequence: Synthetic oligonucleotide
ggacggttctcacaccctccagatgatg

SEQ ID NO: 369884 - DNA, 31 bp, Artificial Sequence; identical to SEQ ID NO: 20491
  Description of Artificial Sequence: Synthetic oligonucleotide

SEQ ID NO: 369885 - DNA, 31 bp, Artificial Sequence; identical to SEQ ID NO: 20492
  Description of Artificial Sequence: Synthetic oligonucleotide

SEQ ID NO: 369886 - DNA, 30 bp, Artificial Sequence; identical to SEQ ID NO: 9669
  Description of Artificial Sequence: Synthetic oligonucleotide

SEQ ID NO: 369887 - DNA, 30 bp, Artificial Sequence; identical to SEQ ID NO: 9670
  Description of Artificial Sequence: Synthetic oligonucleotide

SEQ ID NO: 369888 - DNA, 31 bp, Artificial Sequence; identical to SEQ ID NO: 9671
  Description of Artificial Sequence: Synthetic oligonucleotide

SEQ ID NO: 369889 - DNA, 31 bp, Artificial Sequence; identical to SEQ ID NO: 9672
  Description of Artificial Sequence: Synthetic oligonucleotide

SEQ ID NO: 369890 - DNA, 30 bp, Artificial Sequence; identical to SEQ ID NO: 9673
  Description of Artificial Sequence: Synthetic oligonucleotide

SEQ ID NO: 369891 - DNA, 29 bp, Artificial Sequence
  Description of Artificial Sequence: Synthetic oligonucleotide
ctcacaccctccagatgatgtatggctgc

SEQ ID NO: 369892 - DNA, 29 bp, Artificial Sequence
  Description of Artificial Sequence: Synthetic oligonucleotide
tcacaccctccagatgatgtatggctgcg

SEQ ID NO: 369893 - DNA, 28 bp, Artificial Sequence
  Description of Artificial Sequence: Synthetic oligonucleotide
cacaccctccagatgatgtatggctgcg

SEQ ID NO: 369894 - DNA, 29 bp, Artificial Sequence
  Description of Artificial Sequence: Synthetic oligonucleotide
acaccctccagatgatgtatggctgcgac

SEQ ID NO: 369895 - DNA, 28 bp, Artificial Sequence
  Description of Artificial Sequence: Synthetic oligonucleotide
caccctccagatgatgtatggctgcgac

SEQ ID NO: 369896 - DNA, 28 bp, Artificial Sequence
  Description of Artificial Sequence: Synthetic oligonucleotide
accctccagatgatgtatggctgcgacg

SEQ ID NO: 369897 - DNA, 27 bp, Artificial Sequence
  Description of Artificial Sequence: Synthetic oligonucleotide
ccctccagatgatgtatggctgcgacg

SEQ ID NO: 369898 - DNA, 28 bp, Artificial Sequence
  Description of Artificial Sequence: Synthetic oligonucleotide
cctccagatgatgtatggctgcgacgtg

SEQ ID NO: 369899 - DNA, 28 bp, Artificial Sequence
  Description of Artificial Sequence: Synthetic oligonucleotide
ctccagatgatgtatggctgcgacgtgg

SEQ ID NO: 369900 - DNA, 27 bp, Artificial Sequence
  Description of Artificial Sequence: Synthetic oligonucleotide
ctgcagacacggaatgtgaaggcccac

SEQ ID NO: 369901 - DNA, 28 bp, Artificial Sequence
  Description of Artificial Sequence: Synthetic oligonucleotide
tgcagacacggaatgtgaaggcccactc

SEQ ID NO: 369902 - DNA, 27 bp, Artificial Sequence
  Description of Artificial Sequence: Synthetic oligonucleotide
gcagacacggaatgtgaaggcccactc

SEQ ID NO: 369903 - DNA, 28 bp, Artificial Sequence
  Description of Artificial Sequence: Synthetic oligonucleotide
cagacacggaatgtgaaggcccactcac

SEQ ID NO: 369904 - DNA, 26 bp, Artificial Sequence
  Description of Artificial Sequence: Synthetic oligonucleotide
cgaggccggttctcacaccatccaga

SEQ ID NO: 369905 - DNA, 26 bp, Artificial Sequence
  Description of Artificial Sequence: Synthetic oligonucleotide
gaggccggttctcacaccatccagag

SEQ ID NO: 369906 - DNA, 27 bp, Artificial Sequence
  Description of Artificial Sequence: Synthetic oligonucleotide
aggccggttctcacaccatccagagga

SEQ ID NO: 369907 - DNA, 27 bp, Artificial Sequence
  Description of Artificial Sequence: Synthetic oligonucleotide
ggccggttctcacaccatccagaggat

SEQ ID NO: 369908 - DNA, 27 bp, Artificial Sequence
  Description of Artificial Sequence: Synthetic oligonucleotide
gccggttctcacaccatccagaggatg

SEQ ID NO: 369909 - DNA, 30 bp, Artificial Sequence; identical to SEQ ID NO: 5795
  Description of Artificial Sequence: Synthetic oligonucleotide

SEQ ID NO: 369910 - DNA, 25 bp, Artificial Sequence
  Description of Artificial Sequence: Synthetic oligonucleotide
agtggagagcctacctggagggcga

SEQ ID NO: 369911 - DNA, 24 bp, Artificial Sequence
  Description of Artificial Sequence: Synthetic oligonucleotide
gtggagagcctacctggagggcga

SEQ ID NO: 369912 - DNA, 25 bp, Artificial Sequence
  Description of Artificial Sequence: Synthetic oligonucleotide
tggagagcctacctggagggcgagt

SEQ ID NO: 369913 - DNA, 24 bp, Artificial Sequence
  Description of Artificial Sequence: Synthetic oligonucleotide
ggagagcctacctggagggcgagt

SEQ ID NO: 369914 - DNA, 28 bp, Artificial Sequence
  Description of Artificial Sequence: Synthetic oligonucleotide
aggggatggaaccttccagaagtgggtg

SEQ ID NO: 369915 - DNA, 27 bp, Artificial Sequence
  Description of Artificial Sequence: Synthetic oligonucleotide
ggggatggaaccttccagaagtgggtg

SEQ ID NO: 369916 - DNA, 27 bp, Artificial Sequence
  Description of Artificial Sequence: Synthetic oligonucleotide
gggatggaaccttccagaagtgggtgg

SEQ ID NO: 369917 - DNA, 27 bp, Artificial Sequence
  Description of Artificial Sequence: Synthetic oligonucleotide
ggatggaaccttccagaagtgggtggc

SEQ ID NO: 369918 - DNA, 28 bp, Artificial Sequence
  Description of Artificial Sequence: Synthetic oligonucleotide
gatggaaccttccagaagtgggtggctg

SEQ ID NO: 369919 - DNA, 29 bp, Artificial Sequence
  Description of Artificial Sequence: Synthetic oligonucleotide
atggaaccttccagaagtgggtggctgtg

SEQ ID NO: 369920 - DNA, 28 bp, Artificial Sequence
  Description of Artificial Sequence: Synthetic oligonucleotide
tggaaccttccagaagtgggtggctgtg

SEQ ID NO: 369921 - DNA, 27 bp, Artificial Sequence
  Description of Artificial Sequence: Synthetic oligonucleotide
ggaaccttccagaagtgggtggctgtg

SEQ ID NO: 369922 - DNA, 27 bp, Artificial Sequence
  Description of Artificial Sequence: Synthetic oligonucleotide
gaaccttccagaagtgggtggctgtgg

SEQ ID NO: 369923 - DNA, 28 bp, Artificial Sequence
  Description of Artificial Sequence: Synthetic oligonucleotide
aaccttccagaagtgggtggctgtggtg

SEQ ID NO: 369924 - DNA, 27 bp, Artificial Sequence
  Description of Artificial Sequence: Synthetic oligonucleotide
accttccagaagtgggtggctgtggtg

SEQ ID NO: 369925 - DNA, 26 bp, Artificial Sequence
  Description of Artificial Sequence: Synthetic oligonucleotide
ccttccagaagtgggtggctgtggtg

SEQ ID NO: 369926 - DNA, 27 bp, Artificial Sequence
  Description of Artificial Sequence: Synthetic oligonucleotide
cttccagaagtgggtggctgtggtggt

SEQ ID NO: 369927 - DNA, 27 bp, Artificial Sequence
  Description of Artificial Sequence: Synthetic oligonucleotide
ttccagaagtgggtggctgtggtggtg

SEQ ID NO: 369928 - DNA, 26 bp, Artificial Sequence
  Description of Artificial Sequence: Synthetic oligonucleotide
tccagaagtgggtggctgtggtggtg

SEQ ID NO: 369929 - DNA, 25 bp, Artificial Sequence
  Description of Artificial Sequence: Synthetic oligonucleotide
ccagaagtgggtggctgtggtggtg

SEQ ID NO: 369930 - DNA, 25 bp, Artificial Sequence
  Description of Artificial Sequence: Synthetic oligonucleotide
cagaagtgggtggctgtggtggtgc

SEQ ID NO: 369931 - DNA, 27 bp, Artificial Sequence
  Description of Artificial Sequence: Synthetic oligonucleotide
agaagtgggtggctgtggtggtgcctt

SEQ ID NO: 369932 - DNA, 26 bp, Artificial Sequence
  Description of Artificial Sequence: Synthetic oligonucleotide
gaagtgggtggctgtggtggtgcctt

SEQ ID NO: 369933 - DNA, 27 bp, Artificial Sequence
  Description of Artificial Sequence: Synthetic oligonucleotide
aagtgggtggctgtggtggtgccttct

SEQ ID NO: 369934 - DNA, 26 bp, Artificial Sequence
  Description of Artificial Sequence: Synthetic oligonucleotide
agtgggtggctgtggtggtgccttct

SEQ ID NO: 369935 - DNA, 25 bp, Artificial Sequence
  Description of Artificial Sequence: Synthetic oligonucleotide
gtgggtggctgtggtggtgccttct

SEQ ID NO: 369936 - DNA, 25 bp, Artificial Sequence
  Description of Artificial Sequence: Synthetic oligonucleotide
tgggtggctgtggtggtgccttctg

SEQ ID NO: 369937 - DNA, 24 bp, Artificial Sequence
  Description of Artificial Sequence: Synthetic oligonucleotide
gggtggctgtggtggtgccttctg

SEQ ID NO: 369938 - DNA, 25 bp, Artificial Sequence
  Description of Artificial Sequence: Synthetic oligonucleotide
ggtggctgtggtggtgccttctgga

SEQ ID NO: 369939 - DNA, 26 bp, Artificial Sequence
  Description of Artificial Sequence: Synthetic oligonucleotide
gtggctgtggtggtgccttctggaca

SEQ ID NO: 369940 - DNA, 26 bp, Artificial Sequence
  Description of Artificial Sequence: Synthetic oligonucleotide
tggctgtggtggtgccttctggacag

SEQ ID NO: 369941 - DNA, 32 bp, Artificial Sequence; identical to SEQ ID NO: 20581
  Description of Artificial Sequence: Synthetic oligonucleotide

SEQ ID NO: 369942 - DNA, 29 bp, Artificial Sequence
  Description of Artificial Sequence: Synthetic oligonucleotide
gtatttctacacttccgtgtcccggcctg

SEQ ID NO: 369943 - DNA, 29 bp, Artificial Sequence
  Description of Artificial Sequence: Synthetic oligonucleotide
tatttctacacttccgtgtcccggcctgg

SEQ ID NO: 369944 - DNA, 28 bp, Artificial Sequence
  Description of Artificial Sequence: Synthetic oligonucleotide
atttctacacttccgtgtcccggcctgg

SEQ ID NO: 369945 - DNA, 27 bp, Artificial Sequence
  Description of Artificial Sequence: Synthetic oligonucleotide
tttctacacttccgtgtcccggcctgg

SEQ ID NO: 369946 - DNA, 26 bp, Artificial Sequence
  Description of Artificial Sequence: Synthetic oligonucleotide
ttctacacttccgtgtcccggcctgg

SEQ ID NO: 369947 - DNA, 25 bp, Artificial Sequence
  Description of Artificial Sequence: Synthetic oligonucleotide
tctacacttccgtgtcccggcctgg

SEQ ID NO: 369948 - DNA, 24 bp, Artificial Sequence
  Description of Artificial Sequence: Synthetic oligonucleotide
ctacacttccgtgtcccggcctgg

SEQ ID NO: 369949 - DNA, 24 bp, Artificial Sequence
  Description of Artificial Sequence: Synthetic oligonucleotide
tacacttccgtgtcccggcctggc

SEQ ID NO: 369950 - DNA, 23 bp, Artificial Sequence
  Description of Artificial Sequence: Synthetic oligonucleotide
acacttccgtgtcccggcctggc

SEQ ID NO: 369951 - DNA, 22 bp, Artificial Sequence
  Description of Artificial Sequence: Synthetic oligonucleotide
cacttccgtgtcccggcctggc

SEQ ID NO: 369952 - DNA, 22 bp, Artificial Sequence
  Description of Artificial Sequence: Synthetic oligonucleotide
acttccgtgtcccggcctggcc

SEQ ID NO: 369953 - DNA, 21 bp, Artificial Sequence
  Description of Artificial Sequence: Synthetic oligonucleotide
cttccgtgtcccggcctggcc

SEQ ID NO: 369954 - DNA, 21 bp, Artificial Sequence
  Description of Artificial Sequence: Synthetic oligonucleotide
ttccgtgtcccggcctggccg

SEQ ID NO: 369955 - DNA, 27 bp, Artificial Sequence
  Description of Artificial Sequence: Synthetic oligonucleotide
ggccctgagcttctaccctgcggaaat

SEQ ID NO: 369956 - DNA, 27 bp, Artificial Sequence
  Description of Artificial Sequence: Synthetic oligonucleotide
gccctgagcttctaccctgcggaaatc

SEQ ID NO: 369957 - DNA, 28 bp, Artificial Sequence
  Description of Artificial Sequence: Synthetic oligonucleotide
ccctgagcttctaccctgcggaaatcac

SEQ ID NO: 369958 - DNA, 29 bp, Artificial Sequence
  Description of Artificial Sequence: Synthetic oligonucleotide
cctgagcttctaccctgcggaaatcacac

SEQ ID NO: 369959 - DNA, 30 bp, Artificial Sequence; identical to SEQ ID NO: 20601
  Description of Artificial Sequence: Synthetic oligonucleotide

SEQ ID NO: 369960 - DNA, 31 bp, Artificial Sequence; identical to SEQ ID NO: 20602
  Description of Artificial Sequence: Synthetic oligonucleotide

SEQ ID NO: 369961 - DNA, 30 bp, Artificial Sequence; identical to SEQ ID NO: 20603
  Description of Artificial Sequence: Synthetic oligonucleotide

SEQ ID NO: 369962 - DNA, 30 bp, Artificial Sequence; identical to SEQ ID NO: 20604
  Description of Artificial Sequence: Synthetic oligonucleotide

SEQ ID NO: 369963 - DNA, 27 bp, Artificial Sequence
  Description of Artificial Sequence: Synthetic oligonucleotide
gtgcgtggagtggctccgcagatactt

SEQ ID NO: 369964 - DNA, 27 bp, Artificial Sequence
  Description of Artificial Sequence: Synthetic oligonucleotide
tgcgtggagtggctccgcagatacttg

SEQ ID NO: 369965 - DNA, 26 bp, Artificial Sequence
  Description of Artificial Sequence: Synthetic oligonucleotide
gcgtggagtggctccgcagatacttg

SEQ ID NO: 369966 - DNA, 27 bp, Artificial Sequence
  Description of Artificial Sequence: Synthetic oligonucleotide
cgtggagtggctccgcagatacttgga

SEQ ID NO: 369967 - DNA, 27 bp, Artificial Sequence
  Description of Artificial Sequence: Synthetic oligonucleotide
gtggagtggctccgcagatacttggag

SEQ ID NO: 369968 - DNA, 29 bp, Artificial Sequence
  Description of Artificial Sequence: Synthetic oligonucleotide
tggagtggctccgcagatacttggagaac

SEQ ID NO: 369969 - DNA, 28 bp, Artificial Sequence
  Description of Artificial Sequence: Synthetic oligonucleotide
ggagtggctccgcagatacttggagaac

SEQ ID NO: 369970 - DNA, 28 bp, Artificial Sequence
  Description of Artificial Sequence: Synthetic oligonucleotide
gagtggctccgcagatacttggagaacg

SEQ ID NO: 369971 - DNA, 28 bp, Artificial Sequence
  Description of Artificial Sequence: Synthetic oligonucleotide
agtggctccgcagatacttggagaacgg

SEQ ID NO: 369972 - DNA, 27 bp, Artificial Sequence
  Description of Artificial Sequence: Synthetic oligonucleotide
gtggctccgcagatacttggagaacgg

SEQ ID NO: 369973 - DNA, 27 bp, Artificial Sequence
  Description of Artificial Sequence: Synthetic oligonucleotide
tggctccgcagatacttggagaacggg

SEQ ID NO: 369974 - DNA, 27 bp, Artificial Sequence
  Description of Artificial Sequence: Synthetic oligonucleotide
ggctacgtggacgacacgcagttcgta

SEQ ID NO: 369975 - DNA, 27 bp, Artificial Sequence
  Description of Artificial Sequence: Synthetic oligonucleotide
gctacgtggacgacacgcagttcgtac

SEQ ID NO: 369976 - DNA, 27 bp, Artificial Sequence
  Description of Artificial Sequence: Synthetic oligonucleotide
ctacgtggacgacacgcagttcgtacg

SEQ ID NO: 369977 - DNA, 27 bp, Artificial Sequence
  Description of Artificial Sequence: Synthetic oligonucleotide
tacgtggacgacacgcagttcgtacgg

SEQ ID NO: 369978 - DNA, 27 bp, Artificial Sequence
  Description of Artificial Sequence: Synthetic oligonucleotide
acgtggacgacacgcagttcgtacggt

SEQ ID NO: 369979 - DNA, 27 bp, Artificial Sequence
  Description of Artificial Sequence: Synthetic oligonucleotide
cgtggacgacacgcagttcgtacggtt

SEQ ID NO: 369980 - DNA, 27 bp, Artificial Sequence
  Description of Artificial Sequence: Synthetic oligonucleotide
gtggacgacacgcagttcgtacggttc

SEQ ID NO: 369981 - DNA, 27 bp, Artificial Sequence
  Description of Artificial Sequence: Synthetic oligonucleotide
tggacgacacgcagttcgtacggttcg

SEQ ID NO: 369982 - DNA, 27 bp, Artificial Sequence
  Description of Artificial Sequence: Synthetic oligonucleotide
ggacgacacgcagttcgtacggttcga

SEQ ID NO: 369983 - DNA, 27 bp, Artificial Sequence
  Description of Artificial Sequence: Synthetic oligonucleotide
gacgacacgcagttcgtacggttcgac

SEQ ID NO: 369984 - DNA, 28 bp, Artificial Sequence
  Description of Artificial Sequence: Synthetic oligonucleotide
acgacacgcagttcgtacggttcgacag

SEQ ID NO: 369985 - DNA, 27 bp, Artificial Sequence
  Description of Artificial Sequence: Synthetic oligonucleotide
cgacacgcagttcgtacggttcgacag

SEQ ID NO: 369986 - DNA, 27 bp, Artificial Sequence
  Description of Artificial Sequence: Synthetic oligonucleotide
gacacgcagttcgtacggttcgacagc

SEQ ID NO: 369987 - DNA, 27 bp, Artificial Sequence
  Description of Artificial Sequence: Synthetic oligonucleotide
acacgcagttcgtacggttcgacagcg

SEQ ID NO: 369988 - DNA, 27 bp, Artificial Sequence
  Description of Artificial Sequence: Synthetic oligonucleotide
cacgcagttcgtacggttcgacagcga

SEQ ID NO: 369989 - DNA, 27 bp, Artificial Sequence
  Description of Artificial Sequence: Synthetic oligonucleotide
acgcagttcgtacggttcgacagcgac

SEQ ID NO: 369990 - DNA, 26 bp, Artificial Sequence
  Description of Artificial Sequence: Synthetic oligonucleotide
cgcagttcgtacggttcgacagcgac

SEQ ID NO: 369991 - DNA, 26 bp, Artificial Sequence
  Description of Artificial Sequence: Synthetic oligonucleotide
gcagttcgtacggttcgacagcgacg

SEQ ID NO: 369992 - DNA, 26 bp, Artificial Sequence
  Description of Artificial Sequence: Synthetic oligonucleotide
cagttcgtacggttcgacagcgacgc

SEQ ID NO: 369993 - DNA, 26 bp, Artificial Sequence
  Description of Artificial Sequence: Synthetic oligonucleotide
agttcgtacggttcgacagcgacgcc

SEQ ID NO: 369994 - DNA, 25 bp, Artificial Sequence
  Description of Artificial Sequence: Synthetic oligonucleotide
gttcgtacggttcgacagcgacgcc

SEQ ID NO: 369995 - DNA, 25 bp, Artificial Sequence
  Description of Artificial Sequence: Synthetic oligonucleotide
ttcgtacggttcgacagcgacgccg

SEQ ID NO: 369996 - DNA, 24 bp, Artificial Sequence
  Description of Artificial Sequence: Synthetic oligonucleotide
tcgtacggttcgacagcgacgccg

SEQ ID NO: 369997 - DNA, 23 bp, Artificial Sequence
  Description of Artificial Sequence: Synthetic oligonucleotide
cgtacggttcgacagcgacgccg

SEQ ID NO: 369998 - DNA, 23 bp, Artificial Sequence
  Description of Artificial Sequence: Synthetic oligonucleotide
gtacggttcgacagcgacgccgc

SEQ ID NO: 369999 - DNA, 24 bp, Artificial Sequence
  Description of Artificial Sequence: Synthetic oligonucleotide
tacggttcgacagcgacgccgcga

SEQ ID NO: 370000 - DNA, 23 bp, Artificial Sequence
  Description of Artificial Sequence: Synthetic oligonucleotide
acggttcgacagcgacgccgcga

SEQ ID NO: 370001 - DNA, 24 bp, Artificial Sequence
  Description of Artificial Sequence: Synthetic oligonucleotide
aggcggcccatgtggcagagcagt

SEQ ID NO: 370002 - DNA, 23 bp, Artificial Sequence
  Description of Artificial Sequence: Synthetic oligonucleotide
ggcggcccatgtggcagagcagt

SEQ ID NO: 370003 - DNA, 23 bp, Artificial Sequence
  Description of Artificial Sequence: Synthetic oligonucleotide
gcggcccatgtggcagagcagtg

SEQ ID NO: 370004 - DNA, 24 bp, Artificial Sequence
  Description of Artificial Sequence: Synthetic oligonucleotide
cggcccatgtggcagagcagtgga

SEQ ID NO: 370005 - DNA, 25 bp, Artificial Sequence
  Description of Artificial Sequence: Synthetic oligonucleotide
ggcccatgtggcagagcagtggaga

SEQ ID NO: 370006 - DNA, 25 bp, Artificial Sequence
  Description of Artificial Sequence: Synthetic oligonucleotide
gcccatgtggcagagcagtggagag

SEQ ID NO: 370007 - DNA, 25 bp, Artificial Sequence
  Description of Artificial Sequence: Synthetic oligonucleotide
cccatgtggcagagcagtggagagc

SEQ ID NO: 370008 - DNA, 27 bp, Artificial Sequence
  Description of Artificial Sequence: Synthetic oligonucleotide
ccatgtggcagagcagtggagagccta

SEQ ID NO: 370009 - DNA, 27 bp, Artificial Sequence
  Description of Artificial Sequence: Synthetic oligonucleotide
catgtggcagagcagtggagagcctac

SEQ ID NO: 370010 - DNA, 27 bp, Artificial Sequence
  Description of Artificial Sequence: Synthetic oligonucleotide
atgtggcagagcagtggagagcctacc

SEQ ID NO: 370011 - DNA, 27 bp, Artificial Sequence
  Description of Artificial Sequence: Synthetic oligonucleotide
tgtggcagagcagtggagagcctacct

SEQ ID NO: 370012 - DNA, 26 bp, Artificial Sequence
  Description of Artificial Sequence: Synthetic oligonucleotide
gtggcagagcagtggagagcctacct

SEQ ID NO: 370013 - DNA, 26 bp, Artificial Sequence
  Description of Artificial Sequence: Synthetic oligonucleotide
tggcagagcagtggagagcctacctg

SEQ ID NO: 370014 - DNA, 25 bp, Artificial Sequence
  Description of Artificial Sequence: Synthetic oligonucleotide
ggcagagcagtggagagcctacctg

SEQ ID NO: 370015 - DNA, 26 bp, Artificial Sequence
  Description of Artificial Sequence: Synthetic oligonucleotide
gcagagcagtggagagcctacctgga

SEQ ID NO: 370016 - DNA, 26 bp, Artificial Sequence
  Description of Artificial Sequence: Synthetic oligonucleotide
cagagcagtggagagcctacctggag

SEQ ID NO: 370017 - DNA, 26 bp, Artificial Sequence
  Description of Artificial Sequence: Synthetic oligonucleotide
agagcagtggagagcctacctggagg

SEQ ID NO: 370018 - DNA, 33 bp, Artificial Sequence; identical to SEQ ID NO: 5759
  Description of Artificial Sequence: Synthetic oligonucleotide

SEQ ID NO: 370019 - DNA, 32 bp, Artificial Sequence; identical to SEQ ID NO: 5760
  Description of Artificial Sequence: Synthetic oligonucleotide

SEQ ID NO: 370020 - DNA, 33 bp, Artificial Sequence; identical to SEQ ID NO: 5761
  Description of Artificial Sequence: Synthetic oligonucleotide

SEQ ID NO: 370021 - DNA, 33 bp, Artificial Sequence; identical to SEQ ID NO: 5762
  Description of Artificial Sequence: Synthetic oligonucleotide

SEQ ID NO: 370022 - DNA, 33 bp, Artificial Sequence; identical to SEQ ID NO: 5763
  Description of Artificial Sequence: Synthetic oligonucleotide

SEQ ID NO: 370023 - DNA, 32 bp, Artificial Sequence; identical to SEQ ID NO: 5764
  Description of Artificial Sequence: Synthetic oligonucleotide

SEQ ID NO: 370024 - DNA, 32 bp, Artificial Sequence; identical to SEQ ID NO: 5765
  Description of Artificial Sequence: Synthetic oligonucleotide

SEQ ID NO: 370025 - DNA, 31 bp, Artificial Sequence; identical to SEQ ID NO: 5766
  Description of Artificial Sequence: Synthetic oligonucleotide

SEQ ID NO: 370026 - DNA, 31 bp, Artificial Sequence; identical to SEQ ID NO: 5767
  Description of Artificial Sequence: Synthetic oligonucleotide

SEQ ID NO: 370027 - DNA, 31 bp, Artificial Sequence; identical to SEQ ID NO: 5768
  Description of Artificial Sequence: Synthetic oligonucleotide

SEQ ID NO: 370028 - DNA, 30 bp, Artificial Sequence; identical to SEQ ID NO: 5769
  Description of Artificial Sequence: Synthetic oligonucleotide

SEQ ID NO: 370029 - DNA, 29 bp, Artificial Sequence
  Description of Artificial Sequence: Synthetic oligonucleotide
gaggtatttctacacctccatgtcccggc

SEQ ID NO: 370030 - DNA, 29 bp, Artificial Sequence
  Description of Artificial Sequence: Synthetic oligonucleotide
aggtatttctacacctccatgtcccggcc

SEQ ID NO: 370031 - DNA, 28 bp, Artificial Sequence
  Description of Artificial Sequence: Synthetic oligonucleotide
ggtatttctacacctccatgtcccggcc

SEQ ID NO: 370032 - DNA, 28 bp, Artificial Sequence
  Description of Artificial Sequence: Synthetic oligonucleotide
gtatttctacacctccatgtcccggccc

SEQ ID NO: 370033 - DNA, 28 bp, Artificial Sequence
  Description of Artificial Sequence: Synthetic oligonucleotide
tatttctacacctccatgtcccggcccg

SEQ ID NO: 370034 - DNA, 27 bp, Artificial Sequence
  Description of Artificial Sequence: Synthetic oligonucleotide
atttctacacctccatgtcccggcccg

SEQ ID NO: 370035 - DNA, 26 bp, Artificial Sequence
  Description of Artificial Sequence: Synthetic oligonucleotide
tttctacacctccatgtcccggcccg

SEQ ID NO: 370036 - DNA, 25 bp, Artificial Sequence
  Description of Artificial Sequence: Synthetic oligonucleotide
ttctacacctccatgtcccggcccg

SEQ ID NO: 370037 - DNA, 24 bp, Artificial Sequence
  Description of Artificial Sequence: Synthetic oligonucleotide
tctacacctccatgtcccggcccg

SEQ ID NO: 370038 - DNA, 23 bp, Artificial Sequence
  Description of Artificial Sequence: Synthetic oligonucleotide
ctacacctccatgtcccggcccg

SEQ ID NO: 370039 - DNA, 23 bp, Artificial Sequence
  Description of Artificial Sequence: Synthetic oligonucleotide
tacacctccatgtcccggcccgg

SEQ ID NO: 370040 - DNA, 22 bp, Artificial Sequence
  Description of Artificial Sequence: Synthetic oligonucleotide
acacctccatgtcccggcccgg

SEQ ID NO: 370041 - DNA, 21 bp, Artificial Sequence
  Description of Artificial Sequence: Synthetic oligonucleotide
cacctccatgtcccggcccgg

SEQ ID NO: 370042 - DNA, 21 bp, Artificial Sequence
  Description of Artificial Sequence: Synthetic oligonucleotide
acctccatgtcccggcccggc

SEQ ID NO: 370043 - DNA, 20 bp, Artificial Sequence
  Description of Artificial Sequence: Synthetic oligonucleotide
cctccatgtcccggcccggc

SEQ ID NO: 370044 - DNA, 20 bp, Artificial Sequence
  Description of Artificial Sequence: Synthetic oligonucleotide
ctccatgtcccggcccggcc

SEQ ID NO: 370045 - DNA, 20 bp, Artificial Sequence
  Description of Artificial Sequence: Synthetic oligonucleotide
tccatgtcccggcccggccg

SEQ ID NO: 370046 - DNA, 20 bp, Artificial Sequence
  Description of Artificial Sequence: Synthetic oligonucleotide
ccatgtcccggcccggccgt

SEQ ID NO: 370047 - DNA, 20 bp, Artificial Sequence
  Description of Artificial Sequence: Synthetic oligonucleotide
catgtcccggcccggccgct

SEQ ID NO: 370048 - DNA, 20 bp, Artificial Sequence
  Description of Artificial Sequence: Synthetic oligonucleotide
atgtcccggcccggccgcgt

SEQ ID NO: 370049 - DNA, 27 bp, Artificial Sequence
  Description of Artificial Sequence: Synthetic oligonucleotide
acccaccgggactcagattctcccgat

SEQ ID NO: 370050 - DNA, 26 bp, Artificial Sequence
  Description of Artificial Sequence: Synthetic oligonucleotide
cccaccgggactcagattctcccgat

SEQ ID NO: 370051 - DNA, 26 bp, Artificial Sequence
  Description of Artificial Sequence: Synthetic oligonucleotide
ccaccgggactcagattctcccgatg

SEQ ID NO: 370052 - DNA, 26 bp, Artificial Sequence
  Description of Artificial Sequence: Synthetic oligonucleotide
caccgggactcagattctcccgatgg

SEQ ID NO: 370053 - DNA, 26 bp, Artificial Sequence
  Description of Artificial Sequence: Synthetic oligonucleotide
accgggactcagattctcccgatggc

SEQ ID NO: 370054 - DNA, 25 bp, Artificial Sequence
  Description of Artificial Sequence: Synthetic oligonucleotide
ccgggactcagattctcccgatggc

SEQ ID NO: 370055 - DNA, 25 bp, Artificial Sequence
  Description of Artificial Sequence: Synthetic oligonucleotide
cgggactcagattctcccgatggcc

SEQ ID NO: 370056 - DNA, 26 bp, Artificial Sequence
  Description of Artificial Sequence: Synthetic oligonucleotide
gggactcagattctcccgatggccgt

SEQ ID NO: 370057 - DNA, 27 bp, Artificial Sequence
  Description of Artificial Sequence: Synthetic oligonucleotide
ggactcagattctcccgatggccgtca

SEQ ID NO: 370058 - DNA, 28 bp, Artificial Sequence
  Description of Artificial Sequence: Synthetic oligonucleotide
gactcagattctcccgatggccgtcatg

SEQ ID NO: 370059 - DNA, 28 bp, Artificial Sequence
  Description of Artificial Sequence: Synthetic oligonucleotide
actcagattctcccgatggccgtcatgg

SEQ ID NO: 370060 - DNA, 27 bp, Artificial Sequence
  Description of Artificial Sequence: Synthetic oligonucleotide
ctcagattctcccgatggccgtcatgg

SEQ ID NO: 370061 - DNA, 27 bp, Artificial Sequence
  Description of Artificial Sequence: Synthetic oligonucleotide
tcagattctcccgatggccgtcatggc

SEQ ID NO: 370062 - DNA, 26 bp, Artificial Sequence
  Description of Artificial Sequence: Synthetic oligonucleotide
cagattctcccgatggccgtcatggc

SEQ ID NO: 370063 - DNA, 26 bp, Artificial Sequence
  Description of Artificial Sequence: Synthetic oligonucleotide
agattctcccgatggccgtcatggcg

SEQ ID NO: 370064 - DNA, 25 bp, Artificial Sequence
  Description of Artificial Sequence: Synthetic oligonucleotide
gattctcccgatggccgtcatggcg

SEQ ID NO: 370065 - DNA, 25 bp, Artificial Sequence
  Description of Artificial Sequence: Synthetic oligonucleotide
attctcccgatggccgtcatggcgc

SEQ ID NO: 370066 - DNA, 24 bp, Artificial Sequence
  Description of Artificial Sequence: Synthetic oligonucleotide
ttctcccgatggccgtcatggcgc

SEQ ID NO: 370067 - DNA, 23 bp, Artificial Sequence
  Description of Artificial Sequence: Synthetic oligonucleotide
tctcccgatggccgtcatggcgc

SEQ ID NO: 370068 - DNA, 22 bp, Artificial Sequence
  Description of Artificial Sequence: Synthetic oligonucleotide
ctcccgatggccgtcatggcgc

SEQ ID NO: 370069 - DNA, 22 bp, Artificial Sequence
  Description of Artificial Sequence: Synthetic oligonucleotide
tcccgatggccgtcatggcgcc

SEQ ID NO: 370070 - DNA, 21 bp, Artificial Sequence
  Description of Artificial Sequence: Synthetic oligonucleotide
cccgatggccgtcatggcgcc

SEQ ID NO: 370071 - DNA, 21 bp, Artificial Sequence
  Description of Artificial Sequence: Synthetic oligonucleotide
ccgatggccgtcatggcgccc

SEQ ID NO: 370072 - DNA, 21 bp, Artificial Sequence
  Description of Artificial Sequence: Synthetic oligonucleotide
cgatggccgtcatggcgcccc

SEQ ID NO: 370073 - DNA, 32 bp, Artificial Sequence; identical to SEQ ID NO: 20624
  Description of Artificial Sequence: Synthetic oligonucleotide

SEQ ID NO: 370074 - DNA, 33 bp, Artificial Sequence; identical to SEQ ID NO: 20625
  Description of Artificial Sequence: Synthetic oligonucleotide

SEQ ID NO: 370075 - DNA, 32 bp, Artificial Sequence; identical to SEQ ID NO: 20626
  Description of Artificial Sequence: Synthetic oligonucleotide

SEQ ID NO: 370076 - DNA, 31 bp, Artificial Sequence; identical to SEQ ID NO: 20627
  Description of Artificial Sequence: Synthetic oligonucleotide

SEQ ID NO: 370077 - DNA, 31 bp, Artificial Sequence; identical to SEQ ID NO: 20628
  Description of Artificial Sequence: Synthetic oligonucleotide

SEQ ID NO: 370078 - DNA, 32 bp, Artificial Sequence; identical to SEQ ID NO: 20629
  Description of Artificial Sequence: Synthetic oligonucleotide

SEQ ID NO: 370079 - DNA, 31 bp, Artificial Sequence; identical to SEQ ID NO: 20630
  Description of Artificial Sequence: Synthetic oligonucleotide

SEQ ID NO: 370080 - DNA, 31 bp, Artificial Sequence; identical to SEQ ID NO: 20631
  Description of Artificial Sequence: Synthetic oligonucleotide

SEQ ID NO: 370081 - DNA, 32 bp, Artificial Sequence; identical to SEQ ID NO: 20632
  Description of Artificial Sequence: Synthetic oligonucleotide

SEQ ID NO: 370082 - DNA, 32 bp, Artificial Sequence; identical to SEQ ID NO: 20633
  Description of Artificial Sequence: Synthetic oligonucleotide

SEQ ID NO: 370083 - DNA, 32 bp, Artificial Sequence; identical to SEQ ID NO: 20634
  Description of Artificial Sequence: Synthetic oligonucleotide

SEQ ID NO: 370084 - DNA, 31 bp, Artificial Sequence; identical to SEQ ID NO: 20635
  Description of Artificial Sequence: Synthetic oligonucleotide

SEQ ID NO: 370085 - DNA, 30 bp, Artificial Sequence; identical to SEQ ID NO: 20636
  Description of Artificial Sequence: Synthetic oligonucleotide

SEQ ID NO: 370086 - DNA, 30 bp, Artificial Sequence; identical to SEQ ID NO: 20637
  Description of Artificial Sequence: Synthetic oligonucleotide

SEQ ID NO: 370087 - DNA, 31 bp, Artificial Sequence; identical to SEQ ID NO: 20638
  Description of Artificial Sequence: Synthetic oligonucleotide

SEQ ID NO: 370088 - DNA, 30 bp, Artificial Sequence; identical to SEQ ID NO: 20639
  Description of Artificial Sequence: Synthetic oligonucleotide

SEQ ID NO: 370089 - DNA, 29 bp, Artificial Sequence
  Description of Artificial Sequence: Synthetic oligonucleotide
tacatcgctctgaaagaggacctgcgctc

SEQ ID NO: 370090 - DNA, 28 bp, Artificial Sequence
  Description of Artificial Sequence: Synthetic oligonucleotide
acatcgctctgaaagaggacctgcgctc

SEQ ID NO: 370091 - DNA, 27 bp, Artificial Sequence
  Description of Artificial Sequence: Synthetic oligonucleotide
catcgctctgaaagaggacctgcgctc

SEQ ID NO: 370092 - DNA, 29 bp, Artificial Sequence
  Description of Artificial Sequence: Synthetic oligonucleotide
atcgctctgaaagaggacctgcgctcttg

SEQ ID NO: 370093 - DNA, 28 bp, Artificial Sequence
  Description of Artificial Sequence: Synthetic oligonucleotide
tcgctctgaaagaggacctgcgctcttg

SEQ ID NO: 370094 - DNA, 27 bp, Artificial Sequence
  Description of Artificial Sequence: Synthetic oligonucleotide
cgctctgaaagaggacctgcgctcttg

SEQ ID NO: 370095 - DNA, 27 bp, Artificial Sequence
  Description of Artificial Sequence: Synthetic oligonucleotide
gctctgaaagaggacctgcgctcttgg

SEQ ID NO: 370096 - DNA, 28 bp, Artificial Sequence
  Description of Artificial Sequence: Synthetic oligonucleotide
ctctgaaagaggacctgcgctcttggac

SEQ ID NO: 370097 - DNA, 28 bp, Artificial Sequence
  Description of Artificial Sequence: Synthetic oligonucleotide
tctgaaagaggacctgcgctcttggacc

SEQ ID NO: 370098 - DNA, 26 bp, Artificial Sequence
  Description of Artificial Sequence: Synthetic oligonucleotide
gcgcggctactacaaccagagcgaag

SEQ ID NO: 370099 - DNA, 26 bp, Artificial Sequence
  Description of Artificial Sequence: Synthetic oligonucleotide
cgcggctactacaaccagagcgaagc

SEQ ID NO: 370100 - DNA, 26 bp, Artificial Sequence
  Description of Artificial Sequence: Synthetic oligonucleotide
gcggctactacaaccagagcgaagcc

SEQ ID NO: 370101 - DNA, 26 bp, Artificial Sequence
  Description of Artificial Sequence: Synthetic oligonucleotide
cggctactacaaccagagcgaagccg

SEQ ID NO: 370102 - DNA, 27 bp, Artificial Sequence
  Description of Artificial Sequence: Synthetic oligonucleotide
ggctactacaaccagagcgaagccggt

SEQ ID NO: 370103 - DNA, 28 bp, Artificial Sequence
  Description of Artificial Sequence: Synthetic oligonucleotide
gctactacaaccagagcgaagccggttc

SEQ ID NO: 370104 - DNA, 29 bp, Artificial Sequence
  Description of Artificial Sequence: Synthetic oligonucleotide
ctactacaaccagagcgaagccggttctc

SEQ ID NO: 370105 - DNA, 30 bp, Artificial Sequence; identical to SEQ ID NO: 20656
  Description of Artificial Sequence: Synthetic oligonucleotide

SEQ ID NO: 370106 - DNA, 29 bp, Artificial Sequence
  Description of Artificial Sequence: Synthetic oligonucleotide
actacaaccagagcgaagccggttctcac

SEQ ID NO: 370107 - DNA, 28 bp, Artificial Sequence
  Description of Artificial Sequence: Synthetic oligonucleotide
ctacaaccagagcgaagccggttctcac

SEQ ID NO: 370108 - DNA, 29 bp, Artificial Sequence
  Description of Artificial Sequence: Synthetic oligonucleotide
tacaaccagagcgaagccggttctcacac

SEQ ID NO: 370109 - DNA, 28 bp, Artificial Sequence
  Description of Artificial Sequence: Synthetic oligonucleotide
acaaccagagcgaagccggttctcacac

SEQ ID NO: 370110 - DNA, 27 bp, Artificial Sequence
  Description of Artificial Sequence: Synthetic oligonucleotide
caaccagagcgaagccggttctcacac

SEQ ID NO: 370111 - DNA, 27 bp, Artificial Sequence
  Description of Artificial Sequence: Synthetic oligonucleotide
aaccagagcgaagccggttctcacacc

SEQ ID NO: 370112 - DNA, 27 bp, Artificial Sequence
  Description of Artificial Sequence: Synthetic oligonucleotide
accagagcgaagccggttctcacacca

SEQ ID NO: 370113 - DNA, 27 bp, Artificial Sequence
  Description of Artificial Sequence: Synthetic oligonucleotide
ccagagcgaagccggttctcacaccat

SEQ ID NO: 370114 - DNA, 27 bp, Artificial Sequence
  Description of Artificial Sequence: Synthetic oligonucleotide
cagagcgaagccggttctcacaccatc

SEQ ID NO: 370115 - DNA, 27 bp, Artificial Sequence
  Description of Artificial Sequence: Synthetic oligonucleotide
agagcgaagccggttctcacaccatcc

SEQ ID NO: 370116 - DNA, 27 bp, Artificial Sequence
  Description of Artificial Sequence: Synthetic oligonucleotide
gagcgaagccggttctcacaccatcca

SEQ ID NO: 370117 - DNA, 27 bp, Artificial Sequence
  Description of Artificial Sequence: Synthetic oligonucleotide
agcgaagccggttctcacaccatccag

SEQ ID NO: 370118 - DNA, 27 bp, Artificial Sequence
  Description of Artificial Sequence: Synthetic oligonucleotide
gcgaagccggttctcacaccatccaga

SEQ ID NO: 370119 - DNA, 27 bp, Artificial Sequence
  Description of Artificial Sequence: Synthetic oligonucleotide
cgaagccggttctcacaccatccagag

SEQ ID NO: 370120 - DNA, 27 bp, Artificial Sequence
  Description of Artificial Sequence: Synthetic oligonucleotide
gaagccggttctcacaccatccagagg

SEQ ID NO: 370121 - DNA, 29 bp, Artificial Sequence
  Description of Artificial Sequence: Synthetic oligonucleotide
aagccggttctcacaccatccagaggatg

SEQ ID NO: 370122 - DNA, 28 bp, Artificial Sequence
  Description of Artificial Sequence: Synthetic oligonucleotide
agccggttctcacaccatccagaggatg

SEQ ID NO: 370123 - DNA, 33 bp, Artificial Sequence; identical to SEQ ID NO: 20674
  Description of Artificial Sequence: Synthetic oligonucleotide

SEQ ID NO: 370124 - DNA, 34 bp, Artificial Sequence; identical to SEQ ID NO: 20675
  Description of Artificial Sequence: Synthetic oligonucleotide

SEQ ID NO: 370125 - DNA, 35 bp, Artificial Sequence; identical to SEQ ID NO: 20676
  Description of Artificial Sequence: Synthetic oligonucleotide

SEQ ID NO: 370126 - DNA, 34 bp, Artificial Sequence; identical to SEQ ID NO: 20677
  Description of Artificial Sequence: Synthetic oligonucleotide

SEQ ID NO: 370127 - DNA, 34 bp, Artificial Sequence; identical to SEQ ID NO: 20678
  Description of Artificial Sequence: Synthetic oligonucleotide

SEQ ID NO: 370128 - DNA, 23 bp, Artificial Sequence
  Description of Artificial Sequence: Synthetic oligonucleotide
ttcctccgcgggtaccggcagca

SEQ ID NO: 370129 - DNA, 22 bp, Artificial Sequence
  Description of Artificial Sequence: Synthetic oligonucleotide
tcctccgcgggtaccggcagca

SEQ ID NO: 370130 - DNA, 21 bp, Artificial Sequence
  Description of Artificial Sequence: Synthetic oligonucleotide
cctccgcgggtaccggcagca

SEQ ID NO: 370131 - DNA, 21 bp, Artificial Sequence
  Description of Artificial Sequence: Synthetic oligonucleotide
ctccgcgggtaccggcagcac

SEQ ID NO: 370132 - DNA, 21 bp, Artificial Sequence
  Description of Artificial Sequence: Synthetic oligonucleotide
tccgcgggtaccggcagcacg

SEQ ID NO: 370133 - DNA, 20 bp, Artificial Sequence
  Description of Artificial Sequence: Synthetic oligonucleotide
ccgcgggtaccggcagcacg

SEQ ID NO: 370134 - DNA, 20 bp, Artificial Sequence
  Description of Artificial Sequence: Synthetic oligonucleotide
cgcgggtaccggcagcacgc

SEQ ID NO: 370135 - DNA, 22 bp, Artificial Sequence
  Description of Artificial Sequence: Synthetic oligonucleotide
gcgggtaccggcagcacgccta

SEQ ID NO: 370136 - DNA, 22 bp, Artificial Sequence
  Description of Artificial Sequence: Synthetic oligonucleotide
cgggtaccggcagcacgcctac

SEQ ID NO: 370137 - DNA, 23 bp, Artificial Sequence
  Description of Artificial Sequence: Synthetic oligonucleotide
gggtaccggcagcacgcctacga

SEQ ID NO: 370138 - DNA, 23 bp, Artificial Sequence
  Description of Artificial Sequence: Synthetic oligonucleotide
ggtaccggcagcacgcctacgac

SEQ ID NO: 370139 - DNA, 23 bp, Artificial Sequence
  Description of Artificial Sequence: Synthetic oligonucleotide
gtaccggcagcacgcctacgacg

SEQ ID NO: 370140 - DNA, 23 bp, Artificial Sequence
  Description of Artificial Sequence: Synthetic oligonucleotide
taccggcagcacgcctacgacgg

SEQ ID NO: 370141 - DNA, 22 bp, Artificial Sequence
  Description of Artificial Sequence: Synthetic oligonucleotide
accggcagcacgcctacgacgg

SEQ ID NO: 370142 - DNA, 21 bp, Artificial Sequence
  Description of Artificial Sequence: Synthetic oligonucleotide
ccggcagcacgcctacgacgg

SEQ ID NO: 370143 - DNA, 23 bp, Artificial Sequence
  Description of Artificial Sequence: Synthetic oligonucleotide
cggcagcacgcctacgacggcaa

SEQ ID NO: 370144 - DNA, 23 bp, Artificial Sequence
  Description of Artificial Sequence: Synthetic oligonucleotide
ggcagcacgcctacgacggcaag

SEQ ID NO: 370145 - DNA, 27 bp, Artificial Sequence
  Description of Artificial Sequence: Synthetic oligonucleotide
gcagcacgcctacgacggcaaggatta

SEQ ID NO: 370146 - DNA, 23 bp, Artificial Sequence
  Description of Artificial Sequence: Synthetic oligonucleotide
aggggccggagtattgggaccgg

SEQ ID NO: 370147 - DNA, 22 bp, Artificial Sequence
  Description of Artificial Sequence: Synthetic oligonucleotide
ggggccggagtattgggaccgg

SEQ ID NO: 370148 - DNA, 23 bp, Artificial Sequence
  Description of Artificial Sequence: Synthetic oligonucleotide
gggccggagtattgggaccggga

SEQ ID NO: 370149 - DNA, 24 bp, Artificial Sequence
  Description of Artificial Sequence: Synthetic oligonucleotide
ggccggagtattgggaccgggaga

SEQ ID NO: 370150 - DNA, 25 bp, Artificial Sequence
  Description of Artificial Sequence: Synthetic oligonucleotide
gccggagtattgggaccgggagaca

SEQ ID NO: 370151 - DNA, 25 bp, Artificial Sequence
  Description of Artificial Sequence: Synthetic oligonucleotide
ccggagtattgggaccgggagacac

SEQ ID NO: 370152 - DNA, 25 bp, Artificial Sequence
  Description of Artificial Sequence: Synthetic oligonucleotide
cggagtattgggaccgggagacacg

SEQ ID NO: 370153 - DNA, 27 bp, Artificial Sequence
  Description of Artificial Sequence: Synthetic oligonucleotide
ggagtattgggaccgggagacacggaa

SEQ ID NO: 370154 - DNA, 28 bp, Artificial Sequence
  Description of Artificial Sequence: Synthetic oligonucleotide
gagtattgggaccgggagacacggaatg

SEQ ID NO: 370155 - DNA, 29 bp, Artificial Sequence
  Description of Artificial Sequence: Synthetic oligonucleotide
agtattgggaccgggagacacggaatgtg

SEQ ID NO: 370156 - DNA, 28 bp, Artificial Sequence
  Description of Artificial Sequence: Synthetic oligonucleotide
gtattgggaccgggagacacggaatgtg

SEQ ID NO: 370157 - DNA, 30 bp, Artificial Sequence; identical to SEQ ID NO: 20748
  Description of Artificial Sequence: Synthetic oligonucleotide

SEQ ID NO: 370158 - DNA, 29 bp, Artificial Sequence
  Description of Artificial Sequence: Synthetic oligonucleotide
attgggaccgggagacacggaatgtgaag

SEQ ID NO: 370159 - DNA, 28 bp, Artificial Sequence
  Description of Artificial Sequence: Synthetic oligonucleotide
ttgggaccgggagacacggaatgtgaag

SEQ ID NO: 370160 - DNA, 27 bp, Artificial Sequence
  Description of Artificial Sequence: Synthetic oligonucleotide
tgggaccgggagacacggaatgtgaag

SEQ ID NO: 370161 - DNA, 26 bp, Artificial Sequence
  Description of Artificial Sequence: Synthetic oligonucleotide
gggaccgggagacacggaatgtgaag

SEQ ID NO: 370162 - DNA, 26 bp, Artificial Sequence
  Description of Artificial Sequence: Synthetic oligonucleotide
ggaccgggagacacggaatgtgaagg

SEQ ID NO: 370163 - DNA, 26 bp, Artificial Sequence
  Description of Artificial Sequence: Synthetic oligonucleotide
gaccgggagacacggaatgtgaaggc

SEQ ID NO: 370164 - DNA, 26 bp, Artificial Sequence
  Description of Artificial Sequence: Synthetic oligonucleotide
accgggagacacggaatgtgaaggcc

SEQ ID NO: 370165 - DNA, 25 bp, Artificial Sequence
  Description of Artificial Sequence: Synthetic oligonucleotide
ccgggagacacggaatgtgaaggcc

SEQ ID NO: 370166 - DNA, 26 bp, Artificial Sequence
  Description of Artificial Sequence: Synthetic oligonucleotide
cgggagacacggaatgtgaaggccca

SEQ ID NO: 370167 - DNA, 27 bp, Artificial Sequence
  Description of Artificial Sequence: Synthetic oligonucleotide
gggagacacggaatgtgaaggcccagt

SEQ ID NO: 370168 - DNA, 25 bp, Artificial Sequence
  Description of Artificial Sequence: Synthetic oligonucleotide
caagcacaagtgggaggcggccctt

SEQ ID NO: 370169 - DNA, 26 bp, Artificial Sequence
  Description of Artificial Sequence: Synthetic oligonucleotide
aagcacaagtgggaggcggcccttgt

SEQ ID NO: 370170 - DNA, 25 bp, Artificial Sequence
  Description of Artificial Sequence: Synthetic oligonucleotide
agcacaagtgggaggcggcccttgt

SEQ ID NO: 370171 - DNA, 24 bp, Artificial Sequence
  Description of Artificial Sequence: Synthetic oligonucleotide
gcacaagtgggaggcggcccttgt

SEQ ID NO: 370172 - DNA, 24 bp, Artificial Sequence
  Description of Artificial Sequence: Synthetic oligonucleotide
cacaagtgggaggcggcccttgtg

SEQ ID NO: 370173 - DNA, 24 bp, Artificial Sequence
  Description of Artificial Sequence: Synthetic oligonucleotide
acaagtgggaggcggcccttgtgg

SEQ ID NO: 370174 - DNA, 23 bp, Artificial Sequence
  Description of Artificial Sequence: Synthetic oligonucleotide
caagtgggaggcggcccttgtgg

SEQ ID NO: 370175 - DNA, 23 bp, Artificial Sequence
  Description of Artificial Sequence: Synthetic oligonucleotide
aagtgggaggcggcccttgtggc

SEQ ID NO: 370176 - DNA, 22 bp, Artificial Sequence
  Description of Artificial Sequence: Synthetic oligonucleotide
agtgggaggcggcccttgtggc

SEQ ID NO: 370177 - DNA, 21 bp, Artificial Sequence
  Description of Artificial Sequence: Synthetic oligonucleotide
gtgggaggcggcccttgtggc

SEQ ID NO: 370178 - DNA, 21 bp, Artificial Sequence
  Description of Artificial Sequence: Synthetic oligonucleotide
tgggaggcggcccttgtggcg

SEQ ID NO: 370179 - DNA, 20 bp, Artificial Sequence
  Description of Artificial Sequence: Synthetic oligonucleotide
gggaggcggcccttgtggcg

SEQ ID NO: 370180 - DNA, 21 bp, Artificial Sequence
  Description of Artificial Sequence: Synthetic oligonucleotide
ggaggcggcccttgtggcgga

SEQ ID NO: 370181 - DNA, 21 bp, Artificial Sequence
  Description of Artificial Sequence: Synthetic oligonucleotide
gaggcggcccttgtggcggag

SEQ ID NO: 370182 - DNA, 22 bp, Artificial Sequence
  Description of Artificial Sequence: Synthetic oligonucleotide
aggcggcccttgtggcggagca

SEQ ID NO: 370183 - DNA, 21 bp, Artificial Sequence
  Description of Artificial Sequence: Synthetic oligonucleotide
ggcggcccttgtggcggagca

SEQ ID NO: 370184 - DNA, 22 bp, Artificial Sequence
  Description of Artificial Sequence: Synthetic oligonucleotide
gcggcccttgtggcggagcagt

SEQ ID NO: 370185 - DNA, 22 bp, Artificial Sequence
  Description of Artificial Sequence: Synthetic oligonucleotide
cggcccttgtggcggagcagtg

SEQ ID NO: 370186 - DNA, 23 bp, Artificial Sequence
  Description of Artificial Sequence: Synthetic oligonucleotide
ggcccttgtggcggagcagtgga

SEQ ID NO: 370187 - DNA, 24 bp, Artificial Sequence
  Description of Artificial Sequence: Synthetic oligonucleotide
gcccttgtggcggagcagtggaga

SEQ ID NO: 370188 - DNA, 24 bp, Artificial Sequence
  Description of Artificial Sequence: Synthetic oligonucleotide
cccttgtggcggagcagtggagag

SEQ ID NO: 370189 - DNA, 24 bp, Artificial Sequence
  Description of Artificial Sequence: Synthetic oligonucleotide
ccttgtggcggagcagtggagagc

SEQ ID NO: 370190 - DNA, 26 bp, Artificial Sequence
  Description of Artificial Sequence: Synthetic oligonucleotide
cttgtggcggagcagtggagagccta

SEQ ID NO: 370191 - DNA, 26 bp, Artificial Sequence
  Description of Artificial Sequence: Synthetic oligonucleotide
ttgtggcggagcagtggagagcctac

SEQ ID NO: 370192 - DNA, 23 bp, Artificial Sequence
  Description of Artificial Sequence: Synthetic oligonucleotide
ttcctccgcgggtaccggcaggt

SEQ ID NO: 370193 - DNA, 22 bp, Artificial Sequence
  Description of Artificial Sequence: Synthetic oligonucleotide
tcctccgcgggtaccggcaggt

SEQ ID NO: 370194 - DNA, 21 bp, Artificial Sequence
  Description of Artificial Sequence: Synthetic oligonucleotide
cctccgcgggtaccggcaggt

SEQ ID NO: 370195 - DNA, 21 bp, Artificial Sequence
  Description of Artificial Sequence: Synthetic oligonucleotide
ctccgcgggtaccggcaggtc

SEQ ID NO: 370196 - DNA, 21 bp, Artificial Sequence
  Description of Artificial Sequence: Synthetic oligonucleotide
tccgcgggtaccggcaggtcg

SEQ ID NO: 370197 - DNA, 20 bp, Artificial Sequence
  Description of Artificial Sequence: Synthetic oligonucleotide
ccgcgggtaccggcaggtcg

SEQ ID NO: 370198 - DNA, 20 bp, Artificial Sequence
  Description of Artificial Sequence: Synthetic oligonucleotide
cgcgggtaccggcaggtcgc

SEQ ID NO: 370199 - DNA, 22 bp, Artificial Sequence
  Description of Artificial Sequence: Synthetic oligonucleotide
gcgggtaccggcaggtcgccta

SEQ ID NO: 370200 - DNA, 22 bp, Artificial Sequence
  Description of Artificial Sequence: Synthetic oligonucleotide
cgggtaccggcaggtcgcctac

SEQ ID NO: 370201 - DNA, 23 bp, Artificial Sequence
  Description of Artificial Sequence: Synthetic oligonucleotide
gggtaccggcaggtcgcctacga

SEQ ID NO: 370202 - DNA, 23 bp, Artificial Sequence
  Description of Artificial Sequence: Synthetic oligonucleotide
ggtaccggcaggtcgcctacgac

SEQ ID NO: 370203 - DNA, 23 bp, Artificial Sequence
  Description of Artificial Sequence: Synthetic oligonucleotide
gtaccggcaggtcgcctacgacg

SEQ ID NO: 370204 - DNA, 23 bp, Artificial Sequence
  Description of Artificial Sequence: Synthetic oligonucleotide
taccggcaggtcgcctacgacgg

SEQ ID NO: 370205 - DNA, 22 bp, Artificial Sequence
  Description of Artificial Sequence: Synthetic oligonucleotide
accggcaggtcgcctacgacgg

SEQ ID NO: 370206 - DNA, 21 bp, Artificial Sequence
  Description of Artificial Sequence: Synthetic oligonucleotide
ccggcaggtcgcctacgacgg

SEQ ID NO: 370207 - DNA, 23 bp, Artificial Sequence
  Description of Artificial Sequence: Synthetic oligonucleotide
cggcaggtcgcctacgacggcaa

SEQ ID NO: 370208 - DNA, 23 bp, Artificial Sequence
  Description of Artificial Sequence: Synthetic oligonucleotide
ggcaggtcgcctacgacggcaag

SEQ ID NO: 370209 - DNA, 27 bp, Artificial Sequence
  Description of Artificial Sequence: Synthetic oligonucleotide
gcaggtcgcctacgacggcaaggatta

SEQ ID NO: 370210 - DNA, 27 bp, Artificial Sequence
  Description of Artificial Sequence: Synthetic oligonucleotide
caggtcgcctacgacggcaaggattac

SEQ ID NO: 370211 - DNA, 29 bp, Artificial Sequence
  Description of Artificial Sequence: Synthetic oligonucleotide
aggtcgcctacgacggcaaggattacatc

SEQ ID NO: 370212 - DNA, 28 bp, Artificial Sequence
  Description of Artificial Sequence: Synthetic oligonucleotide
ggtcgcctacgacggcaaggattacatc

SEQ ID NO: 370213 - DNA, 28 bp, Artificial Sequence
  Description of Artificial Sequence: Synthetic oligonucleotide
gtcgcctacgacggcaaggattacatcg

SEQ ID NO: 370214 - DNA, 20 bp, Artificial Sequence
  Description of Artificial Sequence: Synthetic oligonucleotide
gcgcctcctccgcgggtacc

SEQ ID NO: 370215 - DNA, 20 bp, Artificial Sequence
  Description of Artificial Sequence: Synthetic oligonucleotide
cgcctcctccgcgggtaccg

SEQ ID NO: 370216 - DNA, 20 bp, Artificial Sequence
  Description of Artificial Sequence: Synthetic oligonucleotide
gcctcctccgcgggtaccgg

SEQ ID NO: 370217 - DNA, 21 bp, Artificial Sequence
  Description of Artificial Sequence: Synthetic oligonucleotide
cctcctccgcgggtaccggca

SEQ ID NO: 370218 - DNA, 21 bp, Artificial Sequence
  Description of Artificial Sequence: Synthetic oligonucleotide
ctcctccgcgggtaccggcag

SEQ ID NO: 370219 - DNA, 22 bp, Artificial Sequence
  Description of Artificial Sequence: Synthetic oligonucleotide
gccctggccctgacccagacca

SEQ ID NO: 370220 - DNA, 22 bp, Artificial Sequence
  Description of Artificial Sequence: Synthetic oligonucleotide
ccctggccctgacccagaccag

SEQ ID NO: 370221 - DNA, 22 bp, Artificial Sequence
  Description of Artificial Sequence: Synthetic oligonucleotide
cctggccctgacccagaccagg

SEQ ID NO: 370222 - DNA, 22 bp, Artificial Sequence
  Description of Artificial Sequence: Synthetic oligonucleotide
ctggccctgacccagaccaggg

SEQ ID NO: 370223 - DNA, 22 bp, Artificial Sequence
  Description of Artificial Sequence: Synthetic oligonucleotide
tggccctgacccagaccagggc

SEQ ID NO: 370224 - DNA, 21 bp, Artificial Sequence
  Description of Artificial Sequence: Synthetic oligonucleotide
ggccctgacccagaccagggc

SEQ ID NO: 370225 - DNA, 21 bp, Artificial Sequence
  Description of Artificial Sequence: Synthetic oligonucleotide
gccctgacccagaccagggcg

SEQ ID NO: 370226 - DNA, 21 bp, Artificial Sequence
  Description of Artificial Sequence: Synthetic oligonucleotide
ccctgacccagaccagggcgg

SEQ ID NO: 370227 - DNA, 21 bp, Artificial Sequence
  Description of Artificial Sequence: Synthetic oligonucleotide
cctgacccagaccagggcggg

SEQ ID NO: 370228 - DNA, 22 bp, Artificial Sequence
  Description of Artificial Sequence: Synthetic oligonucleotide
ctgacccagaccagggcgggct

SEQ ID NO: 370229 - DNA, 22 bp, Artificial Sequence
  Description of Artificial Sequence: Synthetic oligonucleotide
tgacccagaccagggcgggctc

SEQ ID NO: 370230 - DNA, 21 bp, Artificial Sequence
  Description of Artificial Sequence: Synthetic oligonucleotide
gacccagaccagggcgggctc

SEQ ID NO: 370231 - DNA, 21 bp, Artificial Sequence
  Description of Artificial Sequence: Synthetic oligonucleotide
acccagaccagggcgggctcc

SEQ ID NO: 370232 - DNA, 20 bp, Artificial Sequence
  Description of Artificial Sequence: Synthetic oligonucleotide
cccagaccagggcgggctcc

SEQ ID NO: 370233 - DNA, 21 bp, Artificial Sequence
  Description of Artificial Sequence: Synthetic oligonucleotide
ccagaccagggcgggctccca

SEQ ID NO: 370234 - DNA, 22 bp, Artificial Sequence
  Description of Artificial Sequence: Synthetic oligonucleotide
cagaccagggcgggctcccact

SEQ ID NO: 370235 - DNA, 22 bp, Artificial Sequence
  Description of Artificial Sequence: Synthetic oligonucleotide
agaccagggcgggctcccactc

SEQ ID NO: 370236 - DNA, 21 bp, Artificial Sequence
  Description of Artificial Sequence: Synthetic oligonucleotide
gaccagggcgggctcccactc

SEQ ID NO: 370237 - DNA, 23 bp, Artificial Sequence
  Description of Artificial Sequence: Synthetic oligonucleotide
accagggcgggctcccactccat

SEQ ID NO: 370238 - DNA, 22 bp, Artificial Sequence
  Description of Artificial Sequence: Synthetic oligonucleotide
ccagggcgggctcccactccat

SEQ ID NO: 370239 - DNA, 23 bp, Artificial Sequence
  Description of Artificial Sequence: Synthetic oligonucleotide
cagggcgggctcccactccatga

SEQ ID NO: 370240 - DNA, 23 bp, Artificial Sequence
  Description of Artificial Sequence: Synthetic oligonucleotide
agggcgggctcccactccatgag

SEQ ID NO: 370241 - DNA, 26 bp, Artificial Sequence
  Description of Artificial Sequence: Synthetic oligonucleotide
tcacagactgaccgagtggacctggc

SEQ ID NO: 370242 - DNA, 25 bp, Artificial Sequence
  Description of Artificial Sequence: Synthetic oligonucleotide
cacagactgaccgagtggacctggc

SEQ ID NO: 370243 - DNA, 26 bp, Artificial Sequence
  Description of Artificial Sequence: Synthetic oligonucleotide
acagactgaccgagtggacctggcga

SEQ ID NO: 370244 - DNA, 25 bp, Artificial Sequence
  Description of Artificial Sequence: Synthetic oligonucleotide
cagactgaccgagtggacctggcga

SEQ ID NO: 370245 - DNA, 25 bp, Artificial Sequence
  Description of Artificial Sequence: Synthetic oligonucleotide
agactgaccgagtggacctggcgac

SEQ ID NO: 370246 - DNA, 24 bp, Artificial Sequence
  Description of Artificial Sequence: Synthetic oligonucleotide
gactgaccgagtggacctggcgac

SEQ ID NO: 370247 - DNA, 24 bp, Artificial Sequence
  Description of Artificial Sequence: Synthetic oligonucleotide
actgaccgagtggacctggcgacc

SEQ ID NO: 370248 - DNA, 23 bp, Artificial Sequence
  Description of Artificial Sequence: Synthetic oligonucleotide
ctgaccgagtggacctggcgacc

SEQ ID NO: 370249 - DNA, 24 bp, Artificial Sequence
  Description of Artificial Sequence: Synthetic oligonucleotide
tgaccgagtggacctggcgaccct

SEQ ID NO: 370250 - DNA, 23 bp, Artificial Sequence
  Description of Artificial Sequence: Synthetic oligonucleotide
gaccgagtggacctggcgaccct

SEQ ID NO: 370251 - DNA, 23 bp, Artificial Sequence
  Description of Artificial Sequence: Synthetic oligonucleotide
accgagtggacctggcgaccctg

SEQ ID NO: 370252 - DNA, 22 bp, Artificial Sequence
  Description of Artificial Sequence: Synthetic oligonucleotide
ccgagtggacctggcgaccctg

SEQ ID NO: 370253 - DNA, 22 bp, Artificial Sequence
  Description of Artificial Sequence: Synthetic oligonucleotide
cgagtggacctggcgaccctgc

SEQ ID NO: 370254 - DNA, 22 bp, Artificial Sequence
  Description of Artificial Sequence: Synthetic oligonucleotide
gagtggacctggcgaccctgcg

SEQ ID NO: 370255 - DNA, 22 bp, Artificial Sequence
  Description of Artificial Sequence: Synthetic oligonucleotide
agtggacctggcgaccctgcgc

SEQ ID NO: 370256 - DNA, 21 bp, Artificial Sequence
  Description of Artificial Sequence: Synthetic oligonucleotide
gtggacctggcgaccctgcgc

SEQ ID NO: 370257 - DNA, 21 bp, Artificial Sequence
  Description of Artificial Sequence: Synthetic oligonucleotide
tggacctggcgaccctgcgcg

SEQ ID NO: 370258 - DNA, 20 bp, Artificial Sequence
  Description of Artificial Sequence: Synthetic oligonucleotide
ggacctggcgaccctgcgcg

SEQ ID NO: 370259 - DNA, 20 bp, Artificial Sequence
  Description of Artificial Sequence: Synthetic oligonucleotide
gacctggcgaccctgcgcgg

SEQ ID NO: 370260 - DNA, 22 bp, Artificial Sequence
  Description of Artificial Sequence: Synthetic oligonucleotide
acctggcgaccctgcgcggcta

SEQ ID NO: 370261 - DNA, 21 bp, Artificial Sequence
  Description of Artificial Sequence: Synthetic oligonucleotide
cctggcgaccctgcgcggcta

SEQ ID NO: 370262 - DNA, 23 bp, Artificial Sequence
  Description of Artificial Sequence: Synthetic oligonucleotide
ctggcgaccctgcgcggctacta

SEQ ID NO: 370263 - DNA, 25 bp, Artificial Sequence
  Description of Artificial Sequence: Synthetic oligonucleotide
tggcgaccctgcgcggctactacaa

SEQ ID NO: 370264 - DNA, 24 bp, Artificial Sequence
  Description of Artificial Sequence: Synthetic oligonucleotide
ggcgaccctgcgcggctactacaa

SEQ ID NO: 370265 - DNA, 24 bp, Artificial Sequence
  Description of Artificial Sequence: Synthetic oligonucleotide
gcgaccctgcgcggctactacaac

SEQ ID NO: 370266 - DNA, 25 bp, Artificial Sequence
  Description of Artificial Sequence: Synthetic oligonucleotide
cgaccctgcgcggctactacaacca

SEQ ID NO: 370267 - DNA, 32 bp, Artificial Sequence; identical to SEQ ID NO: 2245
  Description of Artificial Sequence: Synthetic oligonucleotide

SEQ ID NO: 370268 - DNA, 31 bp, Artificial Sequence; identical to SEQ ID NO: 2246
  Description of Artificial Sequence: Synthetic oligonucleotide

SEQ ID NO: 370269 - DNA, 31 bp, Artificial Sequence; identical to SEQ ID NO: 2247
  Description of Artificial Sequence: Synthetic oligonucleotide

SEQ ID NO: 370270 - DNA, 31 bp, Artificial Sequence; identical to SEQ ID NO: 2248
  Description of Artificial Sequence: Synthetic oligonucleotide

SEQ ID NO: 370271 - DNA, 30 bp, Artificial Sequence; identical to SEQ ID NO: 2249
  Description of Artificial Sequence: Synthetic oligonucleotide

SEQ ID NO: 370272 - DNA, 29 bp, Artificial Sequence
  Description of Artificial Sequence: Synthetic oligonucleotide
gaggtatttcttcacatccgtgtccccgc

SEQ ID NO: 370273 - DNA, 29 bp, Artificial Sequence
  Description of Artificial Sequence: Synthetic oligonucleotide
aggtatttcttcacatccgtgtccccgcc

SEQ ID NO: 370274 - DNA, 28 bp, Artificial Sequence
  Description of Artificial Sequence: Synthetic oligonucleotide
ggtatttcttcacatccgtgtccccgcc

SEQ ID NO: 370275 - DNA, 28 bp, Artificial Sequence
  Description of Artificial Sequence: Synthetic oligonucleotide
gtatttcttcacatccgtgtccccgccc

SEQ ID NO: 370276 - DNA, 28 bp, Artificial Sequence
  Description of Artificial Sequence: Synthetic oligonucleotide
tatttcttcacatccgtgtccccgcccg

SEQ ID NO: 370277 - DNA, 27 bp, Artificial Sequence
  Description of Artificial Sequence: Synthetic oligonucleotide
atttcttcacatccgtgtccccgcccg

SEQ ID NO: 370278 - DNA, 26 bp, Artificial Sequence
  Description of Artificial Sequence: Synthetic oligonucleotide
tttcttcacatccgtgtccccgcccg

SEQ ID NO: 370279 - DNA, 25 bp, Artificial Sequence
  Description of Artificial Sequence: Synthetic oligonucleotide
ttcttcacatccgtgtccccgcccg

SEQ ID NO: 370280 - DNA, 24 bp, Artificial Sequence
  Description of Artificial Sequence: Synthetic oligonucleotide
tcttcacatccgtgtccccgcccg

SEQ ID NO: 370281 - DNA, 23 bp, Artificial Sequence
  Description of Artificial Sequence: Synthetic oligonucleotide
cttcacatccgtgtccccgcccg

SEQ ID NO: 370282 - DNA, 23 bp, Artificial Sequence
  Description of Artificial Sequence: Synthetic oligonucleotide
ttcacatccgtgtccccgcccgg

SEQ ID NO: 370283 - DNA, 22 bp, Artificial Sequence
  Description of Artificial Sequence: Synthetic oligonucleotide
tcacatccgtgtccccgcccgg

SEQ ID NO: 370284 - DNA, 21 bp, Artificial Sequence
  Description of Artificial Sequence: Synthetic oligonucleotide
cacatccgtgtccccgcccgg

SEQ ID NO: 370285 - DNA, 21 bp, Artificial Sequence
  Description of Artificial Sequence: Synthetic oligonucleotide
acatccgtgtccccgcccggc

SEQ ID NO: 370286 - DNA, 20 bp, Artificial Sequence
  Description of Artificial Sequence: Synthetic oligonucleotide
catccgtgtccccgcccggc

SEQ ID NO: 370287 - DNA, 20 bp, Artificial Sequence
  Description of Artificial Sequence: Synthetic oligonucleotide
atccgtgtccccgcccggcc

SEQ ID NO: 370288 - DNA, 20 bp, Artificial Sequence
  Description of Artificial Sequence: Synthetic oligonucleotide
tccgtgtccccgcccggcct

SEQ ID NO: 370289 - DNA, 20 bp, Artificial Sequence
  Description of Artificial Sequence: Synthetic oligonucleotide
ccgtgtccccgcccggcctt

SEQ ID NO: 370290 - DNA, 20 bp, Artificial Sequence
  Description of Artificial Sequence: Synthetic oligonucleotide
cgtgtccccgcccggccgtt

SEQ ID NO: 370291 - DNA, 20 bp, Artificial Sequence
  Description of Artificial Sequence: Synthetic oligonucleotide
gtgtccccgcccggccgctt

SEQ ID NO: 370292 - DNA, 20 bp, Artificial Sequence
  Description of Artificial Sequence: Synthetic oligonucleotide
tgtccccgcccggccgcgtt

SEQ ID NO: 370293 - DNA, 20 bp, Artificial Sequence
  Description of Artificial Sequence: Synthetic oligonucleotide
gtccccgcccggccgcgttt

SEQ ID NO: 370294 - DNA, 20 bp, Artificial Sequence
  Description of Artificial Sequence: Synthetic oligonucleotide
tccccgcccggccgcggttt

SEQ ID NO: 370295 - DNA, 20 bp, Artificial Sequence
  Description of Artificial Sequence: Synthetic oligonucleotide
ccccgcccggccgcggtttt

SEQ ID NO: 370296 - DNA, 20 bp, Artificial Sequence
  Description of Artificial Sequence: Synthetic oligonucleotide
cccgcccggccgcgggtttt

SEQ ID NO: 370297 - DNA, 20 bp, Artificial Sequence
  Description of Artificial Sequence: Synthetic oligonucleotide
ccgcccggccgcggggattt

SEQ ID NO: 370298 - DNA, 20 bp, Artificial Sequence
  Description of Artificial Sequence: Synthetic oligonucleotide
cgcccggccgcggggagttt

SEQ ID NO: 370299 - DNA, 24 bp, Artificial Sequence
  Description of Artificial Sequence: Synthetic oligonucleotide
acgccgcgagccagaggatggagt

SEQ ID NO: 370300 - DNA, 23 bp, Artificial Sequence
  Description of Artificial Sequence: Synthetic oligonucleotide
cgccgcgagccagaggatggagt

SEQ ID NO: 370301 - DNA, 23 bp, Artificial Sequence
  Description of Artificial Sequence: Synthetic oligonucleotide
gccgcgagccagaggatggagtc

SEQ ID NO: 370302 - DNA, 23 bp, Artificial Sequence
  Description of Artificial Sequence: Synthetic oligonucleotide
ccgcgagccagaggatggagtcg

SEQ ID NO: 370303 - DNA, 23 bp, Artificial Sequence
  Description of Artificial Sequence: Synthetic oligonucleotide
cgcgagccagaggatggagtcgc

SEQ ID NO: 370304 - DNA, 23 bp, Artificial Sequence
  Description of Artificial Sequence: Synthetic oligonucleotide
gcgagccagaggatggagtcgcg

SEQ ID NO: 370305 - DNA, 23 bp, Artificial Sequence
  Description of Artificial Sequence: Synthetic oligonucleotide
cgagccagaggatggagtcgcgg

SEQ ID NO: 370306 - DNA, 23 bp, Artificial Sequence
  Description of Artificial Sequence: Synthetic oligonucleotide
gagccagaggatggagtcgcggg

SEQ ID NO: 370307 - DNA, 23 bp, Artificial Sequence
  Description of Artificial Sequence: Synthetic oligonucleotide
agccagaggatggagtcgcgggc

SEQ ID NO: 370308 - DNA, 22 bp, Artificial Sequence
  Description of Artificial Sequence: Synthetic oligonucleotide
gccagaggatggagtcgcgggc

SEQ ID NO: 370309 - DNA, 22 bp, Artificial Sequence
  Description of Artificial Sequence: Synthetic oligonucleotide
ccagaggatggagtcgcgggcg

SEQ ID NO: 370310 - DNA, 22 bp, Artificial Sequence
  Description of Artificial Sequence: Synthetic oligonucleotide
cagaggatggagtcgcgggcgc

SEQ ID NO: 370311 - DNA, 22 bp, Artificial Sequence
  Description of Artificial Sequence: Synthetic oligonucleotide
agaggatggagtcgcgggcgcc

SEQ ID NO: 370312 - DNA, 21 bp, Artificial Sequence
  Description of Artificial Sequence: Synthetic oligonucleotide
gaggatggagtcgcgggcgcc

SEQ ID NO: 370313 - DNA, 22 bp, Artificial Sequence
  Description of Artificial Sequence: Synthetic oligonucleotide
aggatggagtcgcgggcgccgt

SEQ ID NO: 370314 - DNA, 21 bp, Artificial Sequence
  Description of Artificial Sequence: Synthetic oligonucleotide
ggatggagtcgcgggcgccgt

SEQ ID NO: 370315 - DNA, 21 bp, Artificial Sequence
  Description of Artificial Sequence: Synthetic oligonucleotide
gatggagtcgcgggcgccgtg

SEQ ID NO: 370316 - DNA, 24 bp, Artificial Sequence
  Description of Artificial Sequence: Synthetic oligonucleotide
atggagtcgcgggcgccgtggata

SEQ ID NO: 370317 - DNA, 23 bp, Artificial Sequence
  Description of Artificial Sequence: Synthetic oligonucleotide
tggagtcgcgggcgccgtggata

SEQ ID NO: 370318 - DNA, 22 bp, Artificial Sequence
  Description of Artificial Sequence: Synthetic oligonucleotide
ggagtcgcgggcgccgtggata

SEQ ID NO: 370319 - DNA, 23 bp, Artificial Sequence
  Description of Artificial Sequence: Synthetic oligonucleotide
gagtcgcgggcgccgtggataga

SEQ ID NO: 370320 - DNA, 23 bp, Artificial Sequence
  Description of Artificial Sequence: Synthetic oligonucleotide
agtcgcgggcgccgtggatagag

SEQ ID NO: 370321 - DNA, 22 bp, Artificial Sequence
  Description of Artificial Sequence: Synthetic oligonucleotide
gtcgcgggcgccgtggatagag

SEQ ID NO: 370322 - DNA, 23 bp, Artificial Sequence
  Description of Artificial Sequence: Synthetic oligonucleotide
tcgcgggcgccgtggatagagca

SEQ ID NO: 370323 - DNA, 23 bp, Artificial Sequence
  Description of Artificial Sequence: Synthetic oligonucleotide
atggccgtcatgccgccccgaac

SEQ ID NO: 370324 - DNA, 22 bp, Artificial Sequence
  Description of Artificial Sequence: Synthetic oligonucleotide
tggccgtcatgccgccccgaac

SEQ ID NO: 370325 - DNA, 21 bp, Artificial Sequence
  Description of Artificial Sequence: Synthetic oligonucleotide
ggccgtcatgccgccccgaac

SEQ ID NO: 370326 - DNA, 21 bp, Artificial Sequence
  Description of Artificial Sequence: Synthetic oligonucleotide
gccgtcatgccgccccgaacc

SEQ ID NO: 370327 - DNA, 22 bp, Artificial Sequence
  Description of Artificial Sequence: Synthetic oligonucleotide
ccgtcatgccgccccgaaccct

SEQ ID NO: 370328 - DNA, 22 bp, Artificial Sequence
  Description of Artificial Sequence: Synthetic oligonucleotide
cgtcatgccgccccgaaccctc

SEQ ID NO: 370329 - DNA, 23 bp, Artificial Sequence
  Description of Artificial Sequence: Synthetic oligonucleotide
gtcatgccgccccgaaccctcct

SEQ ID NO: 370330 - DNA, 23 bp, Artificial Sequence
  Description of Artificial Sequence: Synthetic oligonucleotide
tcatgccgccccgaaccctcctc

SEQ ID NO: 370331 - DNA, 22 bp, Artificial Sequence
  Description of Artificial Sequence: Synthetic oligonucleotide
catgccgccccgaaccctcctc

SEQ ID NO: 370332 - DNA, 23 bp, Artificial Sequence
  Description of Artificial Sequence: Synthetic oligonucleotide
atgccgccccgaaccctcctcct

SEQ ID NO: 370333 - DNA, 22 bp, Artificial Sequence
  Description of Artificial Sequence: Synthetic oligonucleotide
tgccgccccgaaccctcctcct

SEQ ID NO: 370334 - DNA, 21 bp, Artificial Sequence
  Description of Artificial Sequence: Synthetic oligonucleotide
gccgccccgaaccctcctcct

SEQ ID NO: 370335 - DNA, 21 bp, Artificial Sequence
  Description of Artificial Sequence: Synthetic oligonucleotide
ccgccccgaaccctcctcctg

SEQ ID NO: 370336 - DNA, 30 bp, Artificial Sequence; identical to SEQ ID NO: 21363
  Description of Artificial Sequence: Synthetic oligonucleotide

SEQ ID NO: 370337 - DNA, 31 bp, Artificial Sequence; identical to SEQ ID NO: 21364
  Description of Artificial Sequence: Synthetic oligonucleotide

SEQ ID NO: 370338 - DNA, 33 bp, Artificial Sequence; identical to SEQ ID NO: 21365
  Description of Artificial Sequence: Synthetic oligonucleotide

SEQ ID NO: 370339 - DNA, 27 bp, Artificial Sequence
  Description of Artificial Sequence: Synthetic oligonucleotide
tcatcgcagtgggctacgtggacgact

SEQ ID NO: 370340 - DNA, 26 bp, Artificial Sequence
  Description of Artificial Sequence: Synthetic oligonucleotide
catcgcagtgggctacgtggacgact

SEQ ID NO: 370341 - DNA, 26 bp, Artificial Sequence
  Description of Artificial Sequence: Synthetic oligonucleotide
atcgcagtgggctacgtggacgactc

SEQ ID NO: 370342 - DNA, 25 bp, Artificial Sequence
  Description of Artificial Sequence: Synthetic oligonucleotide
tcgcagtgggctacgtggacgactc

SEQ ID NO: 370343 - DNA, 24 bp, Artificial Sequence
  Description of Artificial Sequence: Synthetic oligonucleotide
cgcagtgggctacgtggacgactc

SEQ ID NO: 370344 - DNA, 24 bp, Artificial Sequence
  Description of Artificial Sequence: Synthetic oligonucleotide
gcagtgggctacgtggacgactcg

SEQ ID NO: 370345 - DNA, 25 bp, Artificial Sequence
  Description of Artificial Sequence: Synthetic oligonucleotide
cagtgggctacgtggacgactcgca

SEQ ID NO: 370346 - DNA, 27 bp, Artificial Sequence
  Description of Artificial Sequence: Synthetic oligonucleotide
agtgggctacgtggacgactcgcagtt

SEQ ID NO: 370347 - DNA, 26 bp, Artificial Sequence
  Description of Artificial Sequence: Synthetic oligonucleotide
gtgggctacgtggacgactcgcagtt

SEQ ID NO: 370348 - DNA, 26 bp, Artificial Sequence
  Description of Artificial Sequence: Synthetic oligonucleotide
tgggctacgtggacgactcgcagttc

SEQ ID NO: 370349 - DNA, 25 bp, Artificial Sequence
  Description of Artificial Sequence: Synthetic oligonucleotide
gggctacgtggacgactcgcagttc

SEQ ID NO: 370350 - DNA, 26 bp, Artificial Sequence
  Description of Artificial Sequence: Synthetic oligonucleotide
ggctacgtggacgactcgcagttcgt

SEQ ID NO: 370351 - DNA, 26 bp, Artificial Sequence
  Description of Artificial Sequence: Synthetic oligonucleotide
gctacgtggacgactcgcagttcgtg

SEQ ID NO: 370352 - DNA, 27 bp, Artificial Sequence
  Description of Artificial Sequence: Synthetic oligonucleotide
ctacgtggacgactcgcagttcgtgca

SEQ ID NO: 370353 - DNA, 27 bp, Artificial Sequence
  Description of Artificial Sequence: Synthetic oligonucleotide
tacgtggacgactcgcagttcgtgcag

SEQ ID NO: 370354 - DNA, 27 bp, Artificial Sequence
  Description of Artificial Sequence: Synthetic oligonucleotide
acgtggacgactcgcagttcgtgcagt

SEQ ID NO: 370355 - DNA, 27 bp, Artificial Sequence
  Description of Artificial Sequence: Synthetic oligonucleotide
cgtggacgactcgcagttcgtgcagtt

SEQ ID NO: 370356 - DNA, 27 bp, Artificial Sequence
  Description of Artificial Sequence: Synthetic oligonucleotide
gtggacgactcgcagttcgtgcagttc

SEQ ID NO: 370357 - DNA, 27 bp, Artificial Sequence
  Description of Artificial Sequence: Synthetic oligonucleotide
tggacgactcgcagttcgtgcagttcg

SEQ ID NO: 370358 - DNA, 27 bp, Artificial Sequence
  Description of Artificial Sequence: Synthetic oligonucleotide
ggacgactcgcagttcgtgcagttcga

SEQ ID NO: 370359 - DNA, 27 bp, Artificial Sequence
  Description of Artificial Sequence: Synthetic oligonucleotide
gacgactcgcagttcgtgcagttcgac

SEQ ID NO: 370360 - DNA, 28 bp, Artificial Sequence
  Description of Artificial Sequence: Synthetic oligonucleotide
acgactcgcagttcgtgcagttcgacag

SEQ ID NO: 370361 - DNA, 27 bp, Artificial Sequence
  Description of Artificial Sequence: Synthetic oligonucleotide
cgactcgcagttcgtgcagttcgacag

SEQ ID NO: 370362 - DNA, 27 bp, Artificial Sequence
  Description of Artificial Sequence: Synthetic oligonucleotide
gactcgcagttcgtgcagttcgacagc

SEQ ID NO: 370363 - DNA, 27 bp, Artificial Sequence
  Description of Artificial Sequence: Synthetic oligonucleotide
actcgcagttcgtgcagttcgacagcg

SEQ ID NO: 370364 - DNA, 27 bp, Artificial Sequence
  Description of Artificial Sequence: Synthetic oligonucleotide
ctcgcagttcgtgcagttcgacagcga

SEQ ID NO: 370365 - DNA, 27 bp, Artificial Sequence
  Description of Artificial Sequence: Synthetic oligonucleotide
tcgcagttcgtgcagttcgacagcgac

SEQ ID NO: 370366 - DNA, 26 bp, Artificial Sequence
  Description of Artificial Sequence: Synthetic oligonucleotide
cgcagttcgtgcagttcgacagcgac

SEQ ID NO: 370367 - DNA, 26 bp, Artificial Sequence
  Description of Artificial Sequence: Synthetic oligonucleotide
gcagttcgtgcagttcgacagcgacg

SEQ ID NO: 370368 - DNA, 26 bp, Artificial Sequence
  Description of Artificial Sequence: Synthetic oligonucleotide
cagttcgtgcagttcgacagcgacgc

SEQ ID NO: 370369 - DNA, 26 bp, Artificial Sequence
  Description of Artificial Sequence: Synthetic oligonucleotide
agttcgtgcagttcgacagcgacgcc

SEQ ID NO: 370370 - DNA, 25 bp, Artificial Sequence
  Description of Artificial Sequence: Synthetic oligonucleotide
gttcgtgcagttcgacagcgacgcc

SEQ ID NO: 370371 - DNA, 25 bp, Artificial Sequence
  Description of Artificial Sequence: Synthetic oligonucleotide
ttcgtgcagttcgacagcgacgccg

SEQ ID NO: 370372 - DNA, 24 bp, Artificial Sequence
  Description of Artificial Sequence: Synthetic oligonucleotide
tcgtgcagttcgacagcgacgccg

SEQ ID NO: 370373 - DNA, 23 bp, Artificial Sequence
  Description of Artificial Sequence: Synthetic oligonucleotide
cgtgcagttcgacagcgacgccg

SEQ ID NO: 370374 - DNA, 23 bp, Artificial Sequence
  Description of Artificial Sequence: Synthetic oligonucleotide
gtgcagttcgacagcgacgccgc

SEQ ID NO: 370375 - DNA, 24 bp, Artificial Sequence
  Description of Artificial Sequence: Synthetic oligonucleotide
tgcagttcgacagcgacgccgcga

SEQ ID NO: 370376 - DNA, 23 bp, Artificial Sequence
  Description of Artificial Sequence: Synthetic oligonucleotide
gcagttcgacagcgacgccgcga

SEQ ID NO: 370377 - DNA, 23 bp, Artificial Sequence
  Description of Artificial Sequence: Synthetic oligonucleotide
cagttcgacagcgacgccgcgag

SEQ ID NO: 370378 - DNA, 23 bp, Artificial Sequence
  Description of Artificial Sequence: Synthetic oligonucleotide
agttcgacagcgacgccgcgagc

SEQ ID NO: 370379 - DNA, 24 bp, Artificial Sequence
  Description of Artificial Sequence: Synthetic oligonucleotide
ggcgccgtggatagagcaggagga

SEQ ID NO: 370380 - DNA, 24 bp, Artificial Sequence
  Description of Artificial Sequence: Synthetic oligonucleotide
gcgccgtggatagagcaggaggag

SEQ ID NO: 370381 - DNA, 24 bp, Artificial Sequence
  Description of Artificial Sequence: Synthetic oligonucleotide
cgccgtggatagagcaggaggagc

SEQ ID NO: 370382 - DNA, 24 bp, Artificial Sequence
  Description of Artificial Sequence: Synthetic oligonucleotide
gccgtggatagagcaggaggagcc

SEQ ID NO: 370383 - DNA, 24 bp, Artificial Sequence
  Description of Artificial Sequence: Synthetic oligonucleotide
ccgtggatagagcaggaggagccg

SEQ ID NO: 370384 - DNA, 25 bp, Artificial Sequence
  Description of Artificial Sequence: Synthetic oligonucleotide
cgtggatagagcaggaggagccgga

SEQ ID NO: 370385 - DNA, 27 bp, Artificial Sequence
  Description of Artificial Sequence: Synthetic oligonucleotide
gtggatagagcaggaggagccggagta

SEQ ID NO: 370386 - DNA, 29 bp, Artificial Sequence
  Description of Artificial Sequence: Synthetic oligonucleotide
tggatagagcaggaggagccggagtattg

SEQ ID NO: 370387 - DNA, 28 bp, Artificial Sequence
  Description of Artificial Sequence: Synthetic oligonucleotide
ggatagagcaggaggagccggagtattg

SEQ ID NO: 370388 - DNA, 28 bp, Artificial Sequence
  Description of Artificial Sequence: Synthetic oligonucleotide
gatagagcaggaggagccggagtattgg

SEQ ID NO: 370389 - DNA, 28 bp, Artificial Sequence
  Description of Artificial Sequence: Synthetic oligonucleotide
atagagcaggaggagccggagtattggg

SEQ ID NO: 370390 - DNA, 27 bp, Artificial Sequence
  Description of Artificial Sequence: Synthetic oligonucleotide
tagagcaggaggagccggagtattggg

SEQ ID NO: 370391 - DNA, 27 bp, Artificial Sequence
  Description of Artificial Sequence: Synthetic oligonucleotide
agagcaggaggagccggagtattggga

SEQ ID NO: 370392 - DNA, 26 bp, Artificial Sequence
  Description of Artificial Sequence: Synthetic oligonucleotide
gagcaggaggagccggagtattggga

SEQ ID NO: 370393 - DNA, 26 bp, Artificial Sequence
  Description of Artificial Sequence: Synthetic oligonucleotide
agcaggaggagccggagtattgggac

SEQ ID NO: 370394 - DNA, 25 bp, Artificial Sequence
  Description of Artificial Sequence: Synthetic oligonucleotide
gcaggaggagccggagtattgggac

SEQ ID NO: 370395 - DNA, 26 bp, Artificial Sequence
  Description of Artificial Sequence: Synthetic oligonucleotide
caggaggagccggagtattgggacga

SEQ ID NO: 370396 - DNA, 26 bp, Artificial Sequence
  Description of Artificial Sequence: Synthetic oligonucleotide
aggaggagccggagtattgggacgag

SEQ ID NO: 370397 - DNA, 25 bp, Artificial Sequence
  Description of Artificial Sequence: Synthetic oligonucleotide
ggaggagccggagtattgggacgag

SEQ ID NO: 370398 - DNA, 26 bp, Artificial Sequence
  Description of Artificial Sequence: Synthetic oligonucleotide
gaggagccggagtattgggacgagga

SEQ ID NO: 370399 - DNA, 27 bp, Artificial Sequence
  Description of Artificial Sequence: Synthetic oligonucleotide
aggagccggagtattgggacgaggaga

SEQ ID NO: 370400 - DNA, 26 bp, Artificial Sequence
  Description of Artificial Sequence: Synthetic oligonucleotide
ggagccggagtattgggacgaggaga

SEQ ID NO: 370401 - DNA, 27 bp, Artificial Sequence
  Description of Artificial Sequence: Synthetic oligonucleotide
gagccggagtattgggacgaggagaca

SEQ ID NO: 370402 - DNA, 27 bp, Artificial Sequence
  Description of Artificial Sequence: Synthetic oligonucleotide
agccggagtattgggacgaggagacac

SEQ ID NO: 370403 - DNA, 29 bp, Artificial Sequence
  Description of Artificial Sequence: Synthetic oligonucleotide
ggagtattgggacgaggagacacggaatg

SEQ ID NO: 370404 - DNA, 30 bp, Artificial Sequence; identical to SEQ ID NO: 20698
  Description of Artificial Sequence: Synthetic oligonucleotide

SEQ ID NO: 370405 - DNA, 32 bp, Artificial Sequence; identical to SEQ ID NO: 20699
  Description of Artificial Sequence: Synthetic oligonucleotide

SEQ ID NO: 370406 - DNA, 31 bp, Artificial Sequence; identical to SEQ ID NO: 20700
  Description of Artificial Sequence: Synthetic oligonucleotide

SEQ ID NO: 370407 - DNA, 31 bp, Artificial Sequence; identical to SEQ ID NO: 20701
  Description of Artificial Sequence: Synthetic oligonucleotide

SEQ ID NO: 370408 - DNA, 30 bp, Artificial Sequence; identical to SEQ ID NO: 20702
  Description of Artificial Sequence: Synthetic oligonucleotide

SEQ ID NO: 370409 - DNA, 29 bp, Artificial Sequence
  Description of Artificial Sequence: Synthetic oligonucleotide
ttgggacgaggagacacggaatgtgaagg

SEQ ID NO: 370410 - DNA, 28 bp, Artificial Sequence
  Description of Artificial Sequence: Synthetic oligonucleotide
tgggacgaggagacacggaatgtgaagg

SEQ ID NO: 370411 - DNA, 27 bp, Artificial Sequence
  Description of Artificial Sequence: Synthetic oligonucleotide
gggacgaggagacacggaatgtgaagg

SEQ ID NO: 370412 - DNA, 27 bp, Artificial Sequence
  Description of Artificial Sequence: Synthetic oligonucleotide
ggacgaggagacacggaatgtgaaggc

SEQ ID NO: 370413 - DNA, 27 bp, Artificial Sequence
  Description of Artificial Sequence: Synthetic oligonucleotide
gacgaggagacacggaatgtgaaggcc

SEQ ID NO: 370414 - DNA, 27 bp, Artificial Sequence
  Description of Artificial Sequence: Synthetic oligonucleotide
acgaggagacacggaatgtgaaggccc

SEQ ID NO: 370415 - DNA, 27 bp, Artificial Sequence
  Description of Artificial Sequence: Synthetic oligonucleotide
cgaggagacacggaatgtgaaggccca

SEQ ID NO: 370416 - DNA, 27 bp, Artificial Sequence
  Description of Artificial Sequence: Synthetic oligonucleotide
gaggagacacggaatgtgaaggcccac

SEQ ID NO: 370417 - DNA, 31 bp, Artificial Sequence; identical to SEQ ID NO: 21431
  Description of Artificial Sequence: Synthetic oligonucleotide

SEQ ID NO: 370418 - DNA, 30 bp, Artificial Sequence; identical to SEQ ID NO: 21432
  Description of Artificial Sequence: Synthetic oligonucleotide

SEQ ID NO: 370419 - DNA, 30 bp, Artificial Sequence; identical to SEQ ID NO: 21433
  Description of Artificial Sequence: Synthetic oligonucleotide

SEQ ID NO: 370420 - DNA, 30 bp, Artificial Sequence; identical to SEQ ID NO: 21434
  Description of Artificial Sequence: Synthetic oligonucleotide

SEQ ID NO: 370421 - DNA, 31 bp, Artificial Sequence; identical to SEQ ID NO: 21435
  Description of Artificial Sequence: Synthetic oligonucleotide

SEQ ID NO: 370422 - DNA, 30 bp, Artificial Sequence; identical to SEQ ID NO: 21436
  Description of Artificial Sequence: Synthetic oligonucleotide

SEQ ID NO: 370423 - DNA, 29 bp, Artificial Sequence
  Description of Artificial Sequence: Synthetic oligonucleotide
tgtgaaggcccactcacagactaaccgag

SEQ ID NO: 370424 - DNA, 28 bp, Artificial Sequence
  Description of Artificial Sequence: Synthetic oligonucleotide
gtgaaggcccactcacagactaaccgag

SEQ ID NO: 370425 - DNA, 28 bp, Artificial Sequence
  Description of Artificial Sequence: Synthetic oligonucleotide
tgaaggcccactcacagactaaccgagc

SEQ ID NO: 370426 - DNA, 27 bp, Artificial Sequence
  Description of Artificial Sequence: Synthetic oligonucleotide
gaaggcccactcacagactaaccgagc

SEQ ID NO: 370427 - DNA, 27 bp, Artificial Sequence
  Description of Artificial Sequence: Synthetic oligonucleotide
aaggcccactcacagactaaccgagcg

SEQ ID NO: 370428 - DNA, 27 bp, Artificial Sequence
  Description of Artificial Sequence: Synthetic oligonucleotide
aggcccactcacagactaaccgagcga

SEQ ID NO: 370429 - DNA, 27 bp, Artificial Sequence
  Description of Artificial Sequence: Synthetic oligonucleotide
ggcccactcacagactaaccgagcgaa

SEQ ID NO: 370430 - DNA, 27 bp, Artificial Sequence
  Description of Artificial Sequence: Synthetic oligonucleotide
gcccactcacagactaaccgagcgaac

SEQ ID NO: 370431 - DNA, 27 bp, Artificial Sequence
  Description of Artificial Sequence: Synthetic oligonucleotide
cccactcacagactaaccgagcgaacc

SEQ ID NO: 370432 - DNA, 28 bp, Artificial Sequence
  Description of Artificial Sequence: Synthetic oligonucleotide
ccactcacagactaaccgagcgaacctg

SEQ ID NO: 370433 - DNA, 28 bp, Artificial Sequence
  Description of Artificial Sequence: Synthetic oligonucleotide
cactcacagactaaccgagcgaacctgg

SEQ ID NO: 370434 - DNA, 28 bp, Artificial Sequence
  Description of Artificial Sequence: Synthetic oligonucleotide
actcacagactaaccgagcgaacctggg

SEQ ID NO: 370435 - DNA, 27 bp, Artificial Sequence
  Description of Artificial Sequence: Synthetic oligonucleotide
ctcacagactaaccgagcgaacctggg

SEQ ID NO: 370436 - DNA, 27 bp, Artificial Sequence
  Description of Artificial Sequence: Synthetic oligonucleotide
tcacagactaaccgagcgaacctgggg

SEQ ID NO: 370437 - DNA, 27 bp, Artificial Sequence
  Description of Artificial Sequence: Synthetic oligonucleotide
cacagactaaccgagcgaacctgggga

SEQ ID NO: 370438 - DNA, 27 bp, Artificial Sequence
  Description of Artificial Sequence: Synthetic oligonucleotide
acagactaaccgagcgaacctggggac

SEQ ID NO: 370439 - DNA, 26 bp, Artificial Sequence
  Description of Artificial Sequence: Synthetic oligonucleotide
cagactaaccgagcgaacctggggac

SEQ ID NO: 370440 - DNA, 26 bp, Artificial Sequence
  Description of Artificial Sequence: Synthetic oligonucleotide
agactaaccgagcgaacctggggacc

SEQ ID NO: 370441 - DNA, 25 bp, Artificial Sequence
  Description of Artificial Sequence: Synthetic oligonucleotide
gactaaccgagcgaacctggggacc

SEQ ID NO: 370442 - DNA, 26 bp, Artificial Sequence
  Description of Artificial Sequence: Synthetic oligonucleotide
actaaccgagcgaacctggggaccct

SEQ ID NO: 370443 - DNA, 25 bp, Artificial Sequence
  Description of Artificial Sequence: Synthetic oligonucleotide
ctaaccgagcgaacctggggaccct

SEQ ID NO: 370444 - DNA, 25 bp, Artificial Sequence
  Description of Artificial Sequence: Synthetic oligonucleotide
taaccgagcgaacctggggaccctg

SEQ ID NO: 370445 - DNA, 24 bp, Artificial Sequence
  Description of Artificial Sequence: Synthetic oligonucleotide
aaccgagcgaacctggggaccctg

SEQ ID NO: 370446 - DNA, 24 bp, Artificial Sequence
  Description of Artificial Sequence: Synthetic oligonucleotide
cagctgagagcctacctggagggc

SEQ ID NO: 370447 - DNA, 25 bp, Artificial Sequence
  Description of Artificial Sequence: Synthetic oligonucleotide
agctgagagcctacctggagggcga

SEQ ID NO: 370448 - DNA, 24 bp, Artificial Sequence
  Description of Artificial Sequence: Synthetic oligonucleotide
gctgagagcctacctggagggcga

SEQ ID NO: 370449 - DNA, 25 bp, Artificial Sequence
  Description of Artificial Sequence: Synthetic oligonucleotide
ctgagagcctacctggagggcgagt

SEQ ID NO: 370450 - DNA, 24 bp, Artificial Sequence
  Description of Artificial Sequence: Synthetic oligonucleotide
tacctggagggcgagtgcgtggac

SEQ ID NO: 370451 - DNA, 23 bp, Artificial Sequence
  Description of Artificial Sequence: Synthetic oligonucleotide
acctggagggcgagtgcgtggac

SEQ ID NO: 370452 - DNA, 22 bp, Artificial Sequence
  Description of Artificial Sequence: Synthetic oligonucleotide
cctggagggcgagtgcgtggac

SEQ ID NO: 370453 - DNA, 22 bp, Artificial Sequence
  Description of Artificial Sequence: Synthetic oligonucleotide
ctggagggcgagtgcgtggacg

SEQ ID NO: 370454 - DNA, 22 bp, Artificial Sequence
  Description of Artificial Sequence: Synthetic oligonucleotide
tggagggcgagtgcgtggacgg

SEQ ID NO: 370455 - DNA, 21 bp, Artificial Sequence
  Description of Artificial Sequence: Synthetic oligonucleotide
ggagggcgagtgcgtggacgg

SEQ ID NO: 370456 - DNA, 21 bp, Artificial Sequence
  Description of Artificial Sequence: Synthetic oligonucleotide
gagggcgagtgcgtggacggg

SEQ ID NO: 370457 - DNA, 22 bp, Artificial Sequence
  Description of Artificial Sequence: Synthetic oligonucleotide
agggcgagtgcgtggacgggct

SEQ ID NO: 370458 - DNA, 21 bp, Artificial Sequence
  Description of Artificial Sequence: Synthetic oligonucleotide
gggcgagtgcgtggacgggct

SEQ ID NO: 370459 - DNA, 21 bp, Artificial Sequence
  Description of Artificial Sequence: Synthetic oligonucleotide
ggcgagtgcgtggacgggctc

SEQ ID NO: 370460 - DNA, 21 bp, Artificial Sequence
  Description of Artificial Sequence: Synthetic oligonucleotide
gcgagtgcgtggacgggctcc

SEQ ID NO: 370461 - DNA, 21 bp, Artificial Sequence
  Description of Artificial Sequence: Synthetic oligonucleotide
cgagtgcgtggacgggctccg

SEQ ID NO: 370462 - DNA, 22 bp, Artificial Sequence
  Description of Artificial Sequence: Synthetic oligonucleotide
gagtgcgtggacgggctccgca

SEQ ID NO: 370463 - DNA, 25 bp, Artificial Sequence
  Description of Artificial Sequence: Synthetic oligonucleotide
agtgcgtggacgggctccgcagata

SEQ ID NO: 370464 - DNA, 27 bp, Artificial Sequence
  Description of Artificial Sequence: Synthetic oligonucleotide
ttccagaagtgggcggctgtggtggta

SEQ ID NO: 370465 - DNA, 26 bp, Artificial Sequence
  Description of Artificial Sequence: Synthetic oligonucleotide
tccagaagtgggcggctgtggtggta

SEQ ID NO: 370466 - DNA, 25 bp, Artificial Sequence
  Description of Artificial Sequence: Synthetic oligonucleotide
ccagaagtgggcggctgtggtggta

SEQ ID NO: 370467 - DNA, 25 bp, Artificial Sequence
  Description of Artificial Sequence: Synthetic oligonucleotide
cagaagtgggcggctgtggtggtac

SEQ ID NO: 370468 - DNA, 27 bp, Artificial Sequence
  Description of Artificial Sequence: Synthetic oligonucleotide
agaagtgggcggctgtggtggtacctt

SEQ ID NO: 370469 - DNA, 26 bp, Artificial Sequence
  Description of Artificial Sequence: Synthetic oligonucleotide
gaagtgggcggctgtggtggtacctt

SEQ ID NO: 370470 - DNA, 27 bp, Artificial Sequence
  Description of Artificial Sequence: Synthetic oligonucleotide
aagtgggcggctgtggtggtaccttct

SEQ ID NO: 370471 - DNA, 26 bp, Artificial Sequence
  Description of Artificial Sequence: Synthetic oligonucleotide
agtgggcggctgtggtggtaccttct

SEQ ID NO: 370472 - DNA, 25 bp, Artificial Sequence
  Description of Artificial Sequence: Synthetic oligonucleotide
gtgggcggctgtggtggtaccttct

SEQ ID NO: 370473 - DNA, 25 bp, Artificial Sequence
  Description of Artificial Sequence: Synthetic oligonucleotide
tgggcggctgtggtggtaccttctg

SEQ ID NO: 370474 - DNA, 24 bp, Artificial Sequence
  Description of Artificial Sequence: Synthetic oligonucleotide
gggcggctgtggtggtaccttctg

SEQ ID NO: 370475 - DNA, 27 bp, Artificial Sequence
  Description of Artificial Sequence: Synthetic oligonucleotide
ggcggctgtggtggtaccttctggaaa

SEQ ID NO: 370476 - DNA, 27 bp, Artificial Sequence
  Description of Artificial Sequence: Synthetic oligonucleotide
gcggctgtggtggtaccttctggaaag

SEQ ID NO: 370477 - DNA, 27 bp, Artificial Sequence
  Description of Artificial Sequence: Synthetic oligonucleotide
cggctgtggtggtaccttctggaaagg

SEQ ID NO: 370478 - DNA, 28 bp, Artificial Sequence
  Description of Artificial Sequence: Synthetic oligonucleotide
ggctgtggtggtaccttctggaaaggag

SEQ ID NO: 370479 - DNA, 30 bp, Artificial Sequence; identical to SEQ ID NO: 21478
  Description of Artificial Sequence: Synthetic oligonucleotide

SEQ ID NO: 370480 - DNA, 31 bp, Artificial Sequence; identical to SEQ ID NO: 21479
  Description of Artificial Sequence: Synthetic oligonucleotide

SEQ ID NO: 370481 - DNA, 34 bp, Artificial Sequence; identical to SEQ ID NO: 21480
  Description of Artificial Sequence: Synthetic oligonucleotide

SEQ ID NO: 370482 - DNA, 33 bp, Artificial Sequence; identical to SEQ ID NO: 21481
  Description of Artificial Sequence: Synthetic oligonucleotide

SEQ ID NO: 370483 - DNA, 34 bp, Artificial Sequence; identical to SEQ ID NO: 21482
  Description of Artificial Sequence: Synthetic oligonucleotide

SEQ ID NO: 370484 - DNA, 33 bp, Artificial Sequence; identical to SEQ ID NO: 21483
  Description of Artificial Sequence: Synthetic oligonucleotide

SEQ ID NO: 370485 - DNA, 33 bp, Artificial Sequence; identical to SEQ ID NO: 21484
  Description of Artificial Sequence: Synthetic oligonucleotide

SEQ ID NO: 370486 - DNA, 34 bp, Artificial Sequence; identical to SEQ ID NO: 21485
  Description of Artificial Sequence: Synthetic oligonucleotide

SEQ ID NO: 370487 - DNA, 33 bp, Artificial Sequence; identical to SEQ ID NO: 21486
  Description of Artificial Sequence: Synthetic oligonucleotide

SEQ ID NO: 370488 - DNA, 33 bp, Artificial Sequence; identical to SEQ ID NO: 21487
  Description of Artificial Sequence: Synthetic oligonucleotide

SEQ ID NO: 370489 - DNA, 33 bp, Artificial Sequence; identical to SEQ ID NO: 21488
  Description of Artificial Sequence: Synthetic oligonucleotide

SEQ ID NO: 370490 - DNA, 32 bp, Artificial Sequence; identical to SEQ ID NO: 21489
  Description of Artificial Sequence: Synthetic oligonucleotide

SEQ ID NO: 370491 - DNA, 31 bp, Artificial Sequence; identical to SEQ ID NO: 21490
  Description of Artificial Sequence: Synthetic oligonucleotide

SEQ ID NO: 370492 - DNA, 33 bp, Artificial Sequence; identical to SEQ ID NO: 21491
  Description of Artificial Sequence: Synthetic oligonucleotide

SEQ ID NO: 370493 - DNA, 34 bp, Artificial Sequence; identical to SEQ ID NO: 21492
  Description of Artificial Sequence: Synthetic oligonucleotide

SEQ ID NO: 370494 - DNA, 33 bp, Artificial Sequence; identical to SEQ ID NO: 21493
  Description of Artificial Sequence: Synthetic oligonucleotide

SEQ ID NO: 370495 - DNA, 32 bp, Artificial Sequence; identical to SEQ ID NO: 21494
  Description of Artificial Sequence: Synthetic oligonucleotide

SEQ ID NO: 370496 - DNA, 32 bp, Artificial Sequence; identical to SEQ ID NO: 21495
  Description of Artificial Sequence: Synthetic oligonucleotide

SEQ ID NO: 370497 - DNA, 31 bp, Artificial Sequence; identical to SEQ ID NO: 21496
  Description of Artificial Sequence: Synthetic oligonucleotide

SEQ ID NO: 370498 - DNA, 32 bp, Artificial Sequence; identical to SEQ ID NO: 21497
  Description of Artificial Sequence: Synthetic oligonucleotide

SEQ ID NO: 370499 - DNA, 32 bp, Artificial Sequence; identical to SEQ ID NO: 21498
  Description of Artificial Sequence: Synthetic oligonucleotide

SEQ ID NO: 370500 - DNA, 31 bp, Artificial Sequence; identical to SEQ ID NO: 21499
  Description of Artificial Sequence: Synthetic oligonucleotide

SEQ ID NO: 370501 - DNA, 30 bp, Artificial Sequence; identical to SEQ ID NO: 21500
  Description of Artificial Sequence: Synthetic oligonucleotide

SEQ ID NO: 370502 - DNA, 29 bp, Artificial Sequence
  Description of Artificial Sequence: Synthetic oligonucleotide
ggagaagagatacacctgccatgtgcagc

SEQ ID NO: 370503 - DNA, 31 bp, Artificial Sequence; identical to SEQ ID NO: 21502
  Description of Artificial Sequence: Synthetic oligonucleotide

SEQ ID NO: 370504 - DNA, 32 bp, Artificial Sequence; identical to SEQ ID NO: 21503
  Description of Artificial Sequence: Synthetic oligonucleotide

SEQ ID NO: 370505 - DNA, 31 bp, Artificial Sequence; identical to SEQ ID NO: 21504
  Description of Artificial Sequence: Synthetic oligonucleotide

SEQ ID NO: 370506 - DNA, 31 bp, Artificial Sequence; identical to SEQ ID NO: 21505
  Description of Artificial Sequence: Synthetic oligonucleotide

SEQ ID NO: 370507 - DNA, 25 bp, Artificial Sequence
  Description of Artificial Sequence: Synthetic oligonucleotide
ccatgtgcagcatgagggtctgccc

SEQ ID NO: 370508 - DNA, 26 bp, Artificial Sequence
  Description of Artificial Sequence: Synthetic oligonucleotide
catgtgcagcatgagggtctgcccga

SEQ ID NO: 370509 - DNA, 26 bp, Artificial Sequence
  Description of Artificial Sequence: Synthetic oligonucleotide
atgtgcagcatgagggtctgcccgag

SEQ ID NO: 370510 - DNA, 25 bp, Artificial Sequence
  Description of Artificial Sequence: Synthetic oligonucleotide
tgtgcagcatgagggtctgcccgag

SEQ ID NO: 370511 - DNA, 24 bp, Artificial Sequence
  Description of Artificial Sequence: Synthetic oligonucleotide
gtgcagcatgagggtctgcccgag

SEQ ID NO: 370512 - DNA, 24 bp, Artificial Sequence
  Description of Artificial Sequence: Synthetic oligonucleotide
tgcagcatgagggtctgcccgagc

SEQ ID NO: 370513 - DNA, 23 bp, Artificial Sequence
  Description of Artificial Sequence: Synthetic oligonucleotide
gcagcatgagggtctgcccgagc

SEQ ID NO: 370514 - DNA, 23 bp, Artificial Sequence
  Description of Artificial Sequence: Synthetic oligonucleotide
cagcatgagggtctgcccgagcc

SEQ ID NO: 370515 - DNA, 23 bp, Artificial Sequence
  Description of Artificial Sequence: Synthetic oligonucleotide
agcatgagggtctgcccgagccc

SEQ ID NO: 370516 - DNA, 22 bp, Artificial Sequence
  Description of Artificial Sequence: Synthetic oligonucleotide
gcatgagggtctgcccgagccc

SEQ ID NO: 370517 - DNA, 23 bp, Artificial Sequence
  Description of Artificial Sequence: Synthetic oligonucleotide
catgagggtctgcccgagcccct

SEQ ID NO: 370518 - DNA, 24 bp, Artificial Sequence
  Description of Artificial Sequence: Synthetic oligonucleotide
atgagggtctgcccgagcccctca

SEQ ID NO: 370519 - DNA, 23 bp, Artificial Sequence
  Description of Artificial Sequence: Synthetic oligonucleotide
tgagggtctgcccgagcccctca

SEQ ID NO: 370520 - DNA, 22 bp, Artificial Sequence
  Description of Artificial Sequence: Synthetic oligonucleotide
gagggtctgcccgagcccctca

SEQ ID NO: 370521 - DNA, 22 bp, Artificial Sequence
  Description of Artificial Sequence: Synthetic oligonucleotide
agggtctgcccgagcccctcac

SEQ ID NO: 370522 - DNA, 21 bp, Artificial Sequence
  Description of Artificial Sequence: Synthetic oligonucleotide
gggtctgcccgagcccctcac

SEQ ID NO: 370523 - DNA, 21 bp, Artificial Sequence
  Description of Artificial Sequence: Synthetic oligonucleotide
ggtctgcccgagcccctcacc

SEQ ID NO: 370524 - DNA, 22 bp, Artificial Sequence
  Description of Artificial Sequence: Synthetic oligonucleotide
gtctgcccgagcccctcaccct

SEQ ID NO: 370525 - DNA, 23 bp, Artificial Sequence
  Description of Artificial Sequence: Synthetic oligonucleotide
tctgcccgagcccctcaccctga

SEQ ID NO: 370526 - DNA, 22 bp, Artificial Sequence
  Description of Artificial Sequence: Synthetic oligonucleotide
ctgcccgagcccctcaccctga

SEQ ID NO: 370527 - DNA, 24 bp, Artificial Sequence
  Description of Artificial Sequence: Synthetic oligonucleotide
tgcccgagcccctcaccctgagat

SEQ ID NO: 370528 - DNA, 23 bp, Artificial Sequence
  Description of Artificial Sequence: Synthetic oligonucleotide
gcccgagcccctcaccctgagat

SEQ ID NO: 370529 - DNA, 23 bp, Artificial Sequence
  Description of Artificial Sequence: Synthetic oligonucleotide
cccgagcccctcaccctgagatg

SEQ ID NO: 370530 - DNA, 23 bp, Artificial Sequence
  Description of Artificial Sequence: Synthetic oligonucleotide
ccgagcccctcaccctgagatgg

SEQ ID NO: 370531 - DNA, 24 bp, Artificial Sequence
  Description of Artificial Sequence: Synthetic oligonucleotide
cgagcccctcaccctgagatggga

SEQ ID NO: 370532 - DNA, 24 bp, Artificial Sequence
  Description of Artificial Sequence: Synthetic oligonucleotide
gagcccctcaccctgagatgggag

SEQ ID NO: 370533 - DNA, 27 bp, Artificial Sequence
  Description of Artificial Sequence: Synthetic oligonucleotide
atgggagccatcttcccagcccaccat

SEQ ID NO: 370534 - DNA, 26 bp, Artificial Sequence
  Description of Artificial Sequence: Synthetic oligonucleotide
tgggagccatcttcccagcccaccat

SEQ ID NO: 370535 - DNA, 25 bp, Artificial Sequence
  Description of Artificial Sequence: Synthetic oligonucleotide
gggagccatcttcccagcccaccat

SEQ ID NO: 370536 - DNA, 25 bp, Artificial Sequence
  Description of Artificial Sequence: Synthetic oligonucleotide
ggagccatcttcccagcccaccatc

SEQ ID NO: 370537 - DNA, 25 bp, Artificial Sequence
  Description of Artificial Sequence: Synthetic oligonucleotide
gagccatcttcccagcccaccatcc

SEQ ID NO: 370538 - DNA, 25 bp, Artificial Sequence
  Description of Artificial Sequence: Synthetic oligonucleotide
agccatcttcccagcccaccatccc

SEQ ID NO: 370539 - DNA, 24 bp, Artificial Sequence
  Description of Artificial Sequence: Synthetic oligonucleotide
gccatcttcccagcccaccatccc

SEQ ID NO: 370540 - DNA, 27 bp, Artificial Sequence
  Description of Artificial Sequence: Synthetic oligonucleotide
ccatcttcccagcccaccatccccatt

SEQ ID NO: 370541 - DNA, 27 bp, Artificial Sequence
  Description of Artificial Sequence: Synthetic oligonucleotide
catcttcccagcccaccatccccattg

SEQ ID NO: 370542 - DNA, 28 bp, Artificial Sequence
  Description of Artificial Sequence: Synthetic oligonucleotide
atcttcccagcccaccatccccattgtg

SEQ ID NO: 370543 - DNA, 27 bp, Artificial Sequence
  Description of Artificial Sequence: Synthetic oligonucleotide
tcttcccagcccaccatccccattgtg

SEQ ID NO: 370544 - DNA, 26 bp, Artificial Sequence
  Description of Artificial Sequence: Synthetic oligonucleotide
cttcccagcccaccatccccattgtg

SEQ ID NO: 370545 - DNA, 26 bp, Artificial Sequence
  Description of Artificial Sequence: Synthetic oligonucleotide
ttcccagcccaccatccccattgtgg

SEQ ID NO: 370546 - DNA, 25 bp, Artificial Sequence
  Description of Artificial Sequence: Synthetic oligonucleotide
tcccagcccaccatccccattgtgg

SEQ ID NO: 370547 - DNA, 24 bp, Artificial Sequence
  Description of Artificial Sequence: Synthetic oligonucleotide
cccagcccaccatccccattgtgg

SEQ ID NO: 370548 - DNA, 24 bp, Artificial Sequence
  Description of Artificial Sequence: Synthetic oligonucleotide
ccagcccaccatccccattgtggg

SEQ ID NO: 370549 - DNA, 26 bp, Artificial Sequence
  Description of Artificial Sequence: Synthetic oligonucleotide
cagcccaccatccccattgtgggcat

SEQ ID NO: 370550 - DNA, 27 bp, Artificial Sequence
  Description of Artificial Sequence: Synthetic oligonucleotide
agcccaccatccccattgtgggcatca

SEQ ID NO: 370551 - DNA, 27 bp, Artificial Sequence
  Description of Artificial Sequence: Synthetic oligonucleotide
gcccaccatccccattgtgggcatcat

SEQ ID NO: 370552 - DNA, 28 bp, Artificial Sequence
  Description of Artificial Sequence: Synthetic oligonucleotide
cccaccatccccattgtgggcatcattg

SEQ ID NO: 370553 - DNA, 28 bp, Artificial Sequence
  Description of Artificial Sequence: Synthetic oligonucleotide
ccaccatccccattgtgggcatcattgc

SEQ ID NO: 370554 - DNA, 29 bp, Artificial Sequence
  Description of Artificial Sequence: Synthetic oligonucleotide
caccatccccattgtgggcatcattgctg

SEQ ID NO: 370555 - DNA, 29 bp, Artificial Sequence
  Description of Artificial Sequence: Synthetic oligonucleotide
accatccccattgtgggcatcattgctgg

SEQ ID NO: 370556 - DNA, 28 bp, Artificial Sequence
  Description of Artificial Sequence: Synthetic oligonucleotide
ccatccccattgtgggcatcattgctgg

SEQ ID NO: 370557 - DNA, 28 bp, Artificial Sequence
  Description of Artificial Sequence: Synthetic oligonucleotide
catccccattgtgggcatcattgctggc

SEQ ID NO: 370558 - DNA, 28 bp, Artificial Sequence
  Description of Artificial Sequence: Synthetic oligonucleotide
atccccattgtgggcatcattgctggcc

SEQ ID NO: 370559 - DNA, 27 bp, Artificial Sequence
  Description of Artificial Sequence: Synthetic oligonucleotide
tccccattgtgggcatcattgctggcc

SEQ ID NO: 370560 - DNA, 27 bp, Artificial Sequence
  Description of Artificial Sequence: Synthetic oligonucleotide
ccccattgtgggcatcattgctggcct

SEQ ID NO: 370561 - DNA, 27 bp, Artificial Sequence
  Description of Artificial Sequence: Synthetic oligonucleotide
cccattgtgggcatcattgctggcctg

SEQ ID NO: 370562 - DNA, 27 bp, Artificial Sequence
  Description of Artificial Sequence: Synthetic oligonucleotide
ccattgtgggcatcattgctggcctgg

SEQ ID NO: 370563 - DNA, 29 bp, Artificial Sequence
  Description of Artificial Sequence: Synthetic oligonucleotide
cattgtgggcatcattgctggcctggttc

SEQ ID NO: 370564 - DNA, 30 bp, Artificial Sequence; identical to SEQ ID NO: 21537
  Description of Artificial Sequence: Synthetic oligonucleotide

SEQ ID NO: 370565 - DNA, 29 bp, Artificial Sequence
  Description of Artificial Sequence: Synthetic oligonucleotide
ttgtgggcatcattgctggcctggttctc

SEQ ID NO: 370566 - DNA, 28 bp, Artificial Sequence
  Description of Artificial Sequence: Synthetic oligonucleotide
tgtgggcatcattgctggcctggttctc

SEQ ID NO: 370567 - DNA, 27 bp, Artificial Sequence
  Description of Artificial Sequence: Synthetic oligonucleotide
gcctggttctccttggagctgtgatcg

SEQ ID NO: 370568 - DNA, 27 bp, Artificial Sequence
  Description of Artificial Sequence: Synthetic oligonucleotide
cctggttctccttggagctgtgatcgc

SEQ ID NO: 370569 - DNA, 28 bp, Artificial Sequence
  Description of Artificial Sequence: Synthetic oligonucleotide
ctggttctccttggagctgtgatcgctg

SEQ ID NO: 370570 - DNA, 28 bp, Artificial Sequence
  Description of Artificial Sequence: Synthetic oligonucleotide
tggttctccttggagctgtgatcgctgg

SEQ ID NO: 370571 - DNA, 27 bp, Artificial Sequence
  Description of Artificial Sequence: Synthetic oligonucleotide
ggttctccttggagctgtgatcgctgg

SEQ ID NO: 370572 - DNA, 28 bp, Artificial Sequence
  Description of Artificial Sequence: Synthetic oligonucleotide
gttctccttggagctgtgatcgctggag

SEQ ID NO: 370573 - DNA, 28 bp, Artificial Sequence
  Description of Artificial Sequence: Synthetic oligonucleotide
ttctccttggagctgtgatcgctggagc

SEQ ID NO: 370574 - DNA, 27 bp, Artificial Sequence
  Description of Artificial Sequence: Synthetic oligonucleotide
tctccttggagctgtgatcgctggagc

SEQ ID NO: 370575 - DNA, 27 bp, Artificial Sequence
  Description of Artificial Sequence: Synthetic oligonucleotide
ctccttggagctgtgatcgctggagct

SEQ ID NO: 370576 - DNA, 27 bp, Artificial Sequence
  Description of Artificial Sequence: Synthetic oligonucleotide
tccttggagctgtgatcgctggagctg

SEQ ID NO: 370577 - DNA, 27 bp, Artificial Sequence
  Description of Artificial Sequence: Synthetic oligonucleotide
ccttggagctgtgatcgctggagctgt

SEQ ID NO: 370578 - DNA, 27 bp, Artificial Sequence
  Description of Artificial Sequence: Synthetic oligonucleotide
cttggagctgtgatcgctggagctgtg

SEQ ID NO: 370579 - DNA, 25 bp, Artificial Sequence
  Description of Artificial Sequence: Synthetic oligonucleotide
tgatcgctggagctgtggtcgctgc

SEQ ID NO: 370580 - DNA, 24 bp, Artificial Sequence
  Description of Artificial Sequence: Synthetic oligonucleotide
gatcgctggagctgtggtcgctgc

SEQ ID NO: 370581 - DNA, 24 bp, Artificial Sequence
  Description of Artificial Sequence: Synthetic oligonucleotide
atcgctggagctgtggtcgctgcc

SEQ ID NO: 370582 - DNA, 23 bp, Artificial Sequence
  Description of Artificial Sequence: Synthetic oligonucleotide
tcgctggagctgtggtcgctgcc

SEQ ID NO: 370583 - DNA, 22 bp, Artificial Sequence
  Description of Artificial Sequence: Synthetic oligonucleotide
cgctggagctgtggtcgctgcc

SEQ ID NO: 370584 - DNA, 23 bp, Artificial Sequence
  Description of Artificial Sequence: Synthetic oligonucleotide
gctggagctgtggtcgctgccgt

SEQ ID NO: 370585 - DNA, 27 bp, Artificial Sequence
  Description of Artificial Sequence: Synthetic oligonucleotide
tgtggtcgctgccgtgatgtggaggaa

SEQ ID NO: 370586 - DNA, 26 bp, Artificial Sequence
  Description of Artificial Sequence: Synthetic oligonucleotide
gtggtcgctgccgtgatgtggaggaa

SEQ ID NO: 370587 - DNA, 27 bp, Artificial Sequence
  Description of Artificial Sequence: Synthetic oligonucleotide
tggtcgctgccgtgatgtggaggaaga

SEQ ID NO: 370588 - DNA, 27 bp, Artificial Sequence
  Description of Artificial Sequence: Synthetic oligonucleotide
ggtcgctgccgtgatgtggaggaagaa

SEQ ID NO: 370589 - DNA, 27 bp, Artificial Sequence
  Description of Artificial Sequence: Synthetic oligonucleotide
gtcgctgccgtgatgtggaggaagaag

SEQ ID NO: 370590 - DNA, 28 bp, Artificial Sequence
  Description of Artificial Sequence: Synthetic oligonucleotide
tcgctgccgtgatgtggaggaagaagag

SEQ ID NO: 370591 - DNA, 27 bp, Artificial Sequence
  Description of Artificial Sequence: Synthetic oligonucleotide
cgctgccgtgatgtggaggaagaagag

SEQ ID NO: 370592 - DNA, 27 bp, Artificial Sequence
  Description of Artificial Sequence: Synthetic oligonucleotide
gctgccgtgatgtggaggaagaagagc

SEQ ID NO: 370593 - DNA, 28 bp, Artificial Sequence
  Description of Artificial Sequence: Synthetic oligonucleotide
ctgccgtgatgtggaggaagaagagctc

SEQ ID NO: 370594 - DNA, 29 bp, Artificial Sequence
  Description of Artificial Sequence: Synthetic oligonucleotide
tgccgtgatgtggaggaagaagagctcag

SEQ ID NO: 370595 - DNA, 28 bp, Artificial Sequence
  Description of Artificial Sequence: Synthetic oligonucleotide
gccgtgatgtggaggaagaagagctcag

SEQ ID NO: 370596 - DNA, 31 bp, Artificial Sequence; identical to SEQ ID NO: 21569
  Description of Artificial Sequence: Synthetic oligonucleotide

SEQ ID NO: 370597 - DNA, 35 bp, Artificial Sequence; identical to SEQ ID NO: 21570
  Description of Artificial Sequence: Synthetic oligonucleotide

SEQ ID NO: 370598 - DNA, 35 bp, Artificial Sequence; identical to SEQ ID NO: 21571
  Description of Artificial Sequence: Synthetic oligonucleotide

SEQ ID NO: 370599 - DNA, 36 bp, Artificial Sequence; identical to SEQ ID NO: 21572
  Description of Artificial Sequence: Synthetic oligonucleotide

SEQ ID NO: 370600 - DNA, 35 bp, Artificial Sequence; identical to SEQ ID NO: 21573
  Description of Artificial Sequence: Synthetic oligonucleotide

SEQ ID NO: 370601 - DNA, 35 bp, Artificial Sequence; identical to SEQ ID NO: 21574
  Description of Artificial Sequence: Synthetic oligonucleotide

SEQ ID NO: 370602 - DNA, 34 bp, Artificial Sequence; identical to SEQ ID NO: 21575
  Description of Artificial Sequence: Synthetic oligonucleotide

SEQ ID NO: 370603 - DNA, 33 bp, Artificial Sequence; identical to SEQ ID NO: 21576
  Description of Artificial Sequence: Synthetic oligonucleotide

SEQ ID NO: 370604 - DNA, 33 bp, Artificial Sequence; identical to SEQ ID NO: 21577
  Description of Artificial Sequence: Synthetic oligonucleotide

SEQ ID NO: 370605 - DNA, 32 bp, Artificial Sequence; identical to SEQ ID NO: 21578
  Description of Artificial Sequence: Synthetic oligonucleotide

SEQ ID NO: 370606 - DNA, 33 bp, Artificial Sequence; identical to SEQ ID NO: 21579
  Description of Artificial Sequence: Synthetic oligonucleotide

SEQ ID NO: 370607 - DNA, 33 bp, Artificial Sequence; identical to SEQ ID NO: 21580
  Description of Artificial Sequence: Synthetic oligonucleotide

SEQ ID NO: 370608 - DNA, 32 bp, Artificial Sequence; identical to SEQ ID NO: 21581
  Description of Artificial Sequence: Synthetic oligonucleotide

SEQ ID NO: 370609 - DNA, 34 bp, Artificial Sequence; identical to SEQ ID NO: 21582
  Description of Artificial Sequence: Synthetic oligonucleotide

SEQ ID NO: 370610 - DNA, 35 bp, Artificial Sequence; identical to SEQ ID NO: 21583
  Description of Artificial Sequence: Synthetic oligonucleotide

SEQ ID NO: 370611 - DNA, 34 bp, Artificial Sequence; identical to SEQ ID NO: 21584
  Description of Artificial Sequence: Synthetic oligonucleotide

SEQ ID NO: 370612 - DNA, 33 bp, Artificial Sequence; identical to SEQ ID NO: 21585
  Description of Artificial Sequence: Synthetic oligonucleotide

SEQ ID NO: 370613 - DNA, 34 bp, Artificial Sequence; identical to SEQ ID NO: 21586
  Description of Artificial Sequence: Synthetic oligonucleotide

SEQ ID NO: 370614 - DNA, 33 bp, Artificial Sequence; identical to SEQ ID NO: 21587
  Description of Artificial Sequence: Synthetic oligonucleotide

SEQ ID NO: 370615 - DNA, 32 bp, Artificial Sequence; identical to SEQ ID NO: 21588
  Description of Artificial Sequence: Synthetic oligonucleotide

SEQ ID NO: 370616 - DNA, 33 bp, Artificial Sequence; identical to SEQ ID NO: 21589
  Description of Artificial Sequence: Synthetic oligonucleotide

SEQ ID NO: 370617 - DNA, 32 bp, Artificial Sequence; identical to SEQ ID NO: 21590
  Description of Artificial Sequence: Synthetic oligonucleotide

SEQ ID NO: 370618 - DNA, 32 bp, Artificial Sequence; identical to SEQ ID NO: 21591
  Description of Artificial Sequence: Synthetic oligonucleotide

SEQ ID NO: 370619 - DNA, 32 bp, Artificial Sequence; identical to SEQ ID NO: 21592
  Description of Artificial Sequence: Synthetic oligonucleotide

SEQ ID NO: 370620 - DNA, 31 bp, Artificial Sequence; identical to SEQ ID NO: 21593
  Description of Artificial Sequence: Synthetic oligonucleotide

SEQ ID NO: 370621 - DNA, 32 bp, Artificial Sequence; identical to SEQ ID NO: 21594
  Description of Artificial Sequence: Synthetic oligonucleotide

SEQ ID NO: 370622 - DNA, 31 bp, Artificial Sequence; identical to SEQ ID NO: 21595
  Description of Artificial Sequence: Synthetic oligonucleotide

SEQ ID NO: 370623 - DNA, 31 bp, Artificial Sequence; identical to SEQ ID NO: 21596
  Description of Artificial Sequence: Synthetic oligonucleotide

SEQ ID NO: 370624 - DNA, 25 bp, Artificial Sequence
  Description of Artificial Sequence: Synthetic oligonucleotide
gatcaggacgaagtcccaggtcccg

SEQ ID NO: 370625 - DNA, 26 bp, Artificial Sequence
  Description of Artificial Sequence: Synthetic oligonucleotide
atcaggacgaagtcccaggtcccgga

SEQ ID NO: 370626 - DNA, 25 bp, Artificial Sequence
  Description of Artificial Sequence: Synthetic oligonucleotide
tcaggacgaagtcccaggtcccgga

SEQ ID NO: 370627 - DNA, 24 bp, Artificial Sequence
  Description of Artificial Sequence: Synthetic oligonucleotide
caggacgaagtcccaggtcccgga

SEQ ID NO: 370628 - DNA, 24 bp, Artificial Sequence
  Description of Artificial Sequence: Synthetic oligonucleotide
aggacgaagtcccaggtcccggac

SEQ ID NO: 370629 - DNA, 23 bp, Artificial Sequence
  Description of Artificial Sequence: Synthetic oligonucleotide
ggacgaagtcccaggtcccggac

SEQ ID NO: 370630 - DNA, 23 bp, Artificial Sequence
  Description of Artificial Sequence: Synthetic oligonucleotide
gacgaagtcccaggtcccggacg

SEQ ID NO: 370631 - DNA, 23 bp, Artificial Sequence
  Description of Artificial Sequence: Synthetic oligonucleotide
acgaagtcccaggtcccggacgg

SEQ ID NO: 370632 - DNA, 22 bp, Artificial Sequence
  Description of Artificial Sequence: Synthetic oligonucleotide
cgaagtcccaggtcccggacgg

SEQ ID NO: 370633 - DNA, 22 bp, Artificial Sequence
  Description of Artificial Sequence: Synthetic oligonucleotide
gaagtcccaggtcccggacggg

SEQ ID NO: 370634 - DNA, 22 bp, Artificial Sequence
  Description of Artificial Sequence: Synthetic oligonucleotide
aagtcccaggtcccggacgggg

SEQ ID NO: 370635 - DNA, 21 bp, Artificial Sequence
  Description of Artificial Sequence: Synthetic oligonucleotide
agtcccaggtcccggacgggg

SEQ ID NO: 370636 - DNA, 20 bp, Artificial Sequence
  Description of Artificial Sequence: Synthetic oligonucleotide
gtcccaggtcccggacgggg

SEQ ID NO: 370637 - DNA, 21 bp, Artificial Sequence
  Description of Artificial Sequence: Synthetic oligonucleotide
tcccaggtcccggacggggct

SEQ ID NO: 370638 - DNA, 20 bp, Artificial Sequence
  Description of Artificial Sequence: Synthetic oligonucleotide
cccaggtcccggacggggct

SEQ ID NO: 370639 - DNA, 21 bp, Artificial Sequence
  Description of Artificial Sequence: Synthetic oligonucleotide
ccaggtcccggacggggctct

SEQ ID NO: 370640 - DNA, 22 bp, Artificial Sequence
  Description of Artificial Sequence: Synthetic oligonucleotide
caggtcccggacggggctctca

SEQ ID NO: 370641 - DNA, 22 bp, Artificial Sequence
  Description of Artificial Sequence: Synthetic oligonucleotide
aggtcccggacggggctctcag

SEQ ID NO: 370642 - DNA, 21 bp, Artificial Sequence
  Description of Artificial Sequence: Synthetic oligonucleotide
ggtcccggacggggctctcag

SEQ ID NO: 370643 - DNA, 21 bp, Artificial Sequence
  Description of Artificial Sequence: Synthetic oligonucleotide
gtcccggacggggctctcagg

SEQ ID NO: 370644 - DNA, 22 bp, Artificial Sequence
  Description of Artificial Sequence: Synthetic oligonucleotide
tcccggacggggctctcagggt

SEQ ID NO: 370645 - DNA, 21 bp, Artificial Sequence
  Description of Artificial Sequence: Synthetic oligonucleotide
cccggacggggctctcagggt

SEQ ID NO: 370646 - DNA, 22 bp, Artificial Sequence
  Description of Artificial Sequence: Synthetic oligonucleotide
ccggacggggctctcagggtct

SEQ ID NO: 370647 - DNA, 23 bp, Artificial Sequence
  Description of Artificial Sequence: Synthetic oligonucleotide
cggacggggctctcagggtctca

SEQ ID NO: 370648 - DNA, 23 bp, Artificial Sequence
  Description of Artificial Sequence: Synthetic oligonucleotide
ggacggggctctcagggtctcag

SEQ ID NO: 370649 - DNA, 23 bp, Artificial Sequence
  Description of Artificial Sequence: Synthetic oligonucleotide
gacggggctctcagggtctcagg

SEQ ID NO: 370650 - DNA, 24 bp, Artificial Sequence
  Description of Artificial Sequence: Synthetic oligonucleotide
acggggctctcagggtctcaggct

SEQ ID NO: 370651 - DNA, 23 bp, Artificial Sequence
  Description of Artificial Sequence: Synthetic oligonucleotide
cggggctctcagggtctcaggct

SEQ ID NO: 370652 - DNA, 23 bp, Artificial Sequence
  Description of Artificial Sequence: Synthetic oligonucleotide
ggggctctcagggtctcaggctc

SEQ ID NO: 370653 - DNA, 23 bp, Artificial Sequence
  Description of Artificial Sequence: Synthetic oligonucleotide
gggctctcagggtctcaggctcc

SEQ ID NO: 370654 - DNA, 24 bp, Artificial Sequence
  Description of Artificial Sequence: Synthetic oligonucleotide
ggctctcagggtctcaggctccga

SEQ ID NO: 370655 - DNA, 24 bp, Artificial Sequence
  Description of Artificial Sequence: Synthetic oligonucleotide
gctctcagggtctcaggctccgag

SEQ ID NO: 370656 - DNA, 24 bp, Artificial Sequence
  Description of Artificial Sequence: Synthetic oligonucleotide
ctctcagggtctcaggctccgagg

SEQ ID NO: 370657 - DNA, 24 bp, Artificial Sequence
  Description of Artificial Sequence: Synthetic oligonucleotide
tctcagggtctcaggctccgaggg

SEQ ID NO: 370658 - DNA, 23 bp, Artificial Sequence
  Description of Artificial Sequence: Synthetic oligonucleotide
ctcagggtctcaggctccgaggg

SEQ ID NO: 370659 - DNA, 23 bp, Artificial Sequence
  Description of Artificial Sequence: Synthetic oligonucleotide
tcagggtctcaggctccgagggc

SEQ ID NO: 370660 - DNA, 22 bp, Artificial Sequence
  Description of Artificial Sequence: Synthetic oligonucleotide
cagggtctcaggctccgagggc

SEQ ID NO: 370661 - DNA, 22 bp, Artificial Sequence
  Description of Artificial Sequence: Synthetic oligonucleotide
agggtctcaggctccgagggcc

SEQ ID NO: 370662 - DNA, 21 bp, Artificial Sequence
  Description of Artificial Sequence: Synthetic oligonucleotide
gggtctcaggctccgagggcc

SEQ ID NO: 370663 - DNA, 21 bp, Artificial Sequence
  Description of Artificial Sequence: Synthetic oligonucleotide
ggtctcaggctccgagggccg

SEQ ID NO: 370664 - DNA, 21 bp, Artificial Sequence
  Description of Artificial Sequence: Synthetic oligonucleotide
gtctcaggctccgagggccgc

SEQ ID NO: 370665 - DNA, 22 bp, Artificial Sequence
  Description of Artificial Sequence: Synthetic oligonucleotide
tctcaggctccgagggccgcgt

SEQ ID NO: 370666 - DNA, 21 bp, Artificial Sequence
  Description of Artificial Sequence: Synthetic oligonucleotide
ctcaggctccgagggccgcgt

SEQ ID NO: 370667 - DNA, 22 bp, Artificial Sequence
  Description of Artificial Sequence: Synthetic oligonucleotide
tcaggctccgagggccgcgtct

SEQ ID NO: 370668 - DNA, 21 bp, Artificial Sequence
  Description of Artificial Sequence: Synthetic oligonucleotide
caggctccgagggccgcgtct

SEQ ID NO: 370669 - DNA, 21 bp, Artificial Sequence
  Description of Artificial Sequence: Synthetic oligonucleotide
aggctccgagggccgcgtctg

SEQ ID NO: 370670 - DNA, 20 bp, Artificial Sequence
  Description of Artificial Sequence: Synthetic oligonucleotide
ggctccgagggccgcgtctg

SEQ ID NO: 370671 - DNA, 23 bp, Artificial Sequence
  Description of Artificial Sequence: Synthetic oligonucleotide
gctccgagggccgcgtctgcaat

SEQ ID NO: 370672 - DNA, 23 bp, Artificial Sequence
  Description of Artificial Sequence: Synthetic oligonucleotide
ctccgagggccgcgtctgcaatg

SEQ ID NO: 370673 - DNA, 23 bp, Artificial Sequence
  Description of Artificial Sequence: Synthetic oligonucleotide
tccgagggccgcgtctgcaatgg

SEQ ID NO: 370674 - DNA, 22 bp, Artificial Sequence
  Description of Artificial Sequence: Synthetic oligonucleotide
ccgagggccgcgtctgcaatgg

SEQ ID NO: 370675 - DNA, 22 bp, Artificial Sequence
  Description of Artificial Sequence: Synthetic oligonucleotide
cgagggccgcgtctgcaatggg

SEQ ID NO: 370676 - DNA, 23 bp, Artificial Sequence
  Description of Artificial Sequence: Synthetic oligonucleotide
gagggccgcgtctgcaatgggga

SEQ ID NO: 370677 - DNA, 23 bp, Artificial Sequence
  Description of Artificial Sequence: Synthetic oligonucleotide
agggccgcgtctgcaatggggag

SEQ ID NO: 370678 - DNA, 22 bp, Artificial Sequence
  Description of Artificial Sequence: Synthetic oligonucleotide
gggccgcgtctgcaatggggag

SEQ ID NO: 370679 - DNA, 22 bp, Artificial Sequence
  Description of Artificial Sequence: Synthetic oligonucleotide
ggccgcgtctgcaatggggagg

SEQ ID NO: 370680 - DNA, 22 bp, Artificial Sequence
  Description of Artificial Sequence: Synthetic oligonucleotide
gccgcgtctgcaatggggaggc

SEQ ID NO: 370681 - DNA, 22 bp, Artificial Sequence
  Description of Artificial Sequence: Synthetic oligonucleotide
ccgcgtctgcaatggggaggcg

SEQ ID NO: 370682 - DNA, 23 bp, Artificial Sequence
  Description of Artificial Sequence: Synthetic oligonucleotide
cgcgtctgcaatggggaggcgca

SEQ ID NO: 370683 - DNA, 23 bp, Artificial Sequence
  Description of Artificial Sequence: Synthetic oligonucleotide
gcgtctgcaatggggaggcgcag

SEQ ID NO: 370684 - DNA, 23 bp, Artificial Sequence
  Description of Artificial Sequence: Synthetic oligonucleotide
cgtctgcaatggggaggcgcagc

SEQ ID NO: 370685 - DNA, 25 bp, Artificial Sequence
  Description of Artificial Sequence: Synthetic oligonucleotide
gtctgcaatggggaggcgcagcgtt

SEQ ID NO: 370686 - DNA, 25 bp, Artificial Sequence
  Description of Artificial Sequence: Synthetic oligonucleotide
tctgcaatggggaggcgcagcgttg

SEQ ID NO: 370687 - DNA, 24 bp, Artificial Sequence
  Description of Artificial Sequence: Synthetic oligonucleotide
ctgcaatggggaggcgcagcgttg

SEQ ID NO: 370688 - DNA, 24 bp, Artificial Sequence
  Description of Artificial Sequence: Synthetic oligonucleotide
tgcaatggggaggcgcagcgttgg

SEQ ID NO: 370689 - DNA, 23 bp, Artificial Sequence
  Description of Artificial Sequence: Synthetic oligonucleotide
gcaatggggaggcgcagcgttgg

SEQ ID NO: 370690 - DNA, 23 bp, Artificial Sequence
  Description of Artificial Sequence: Synthetic oligonucleotide
caatggggaggcgcagcgttggg

SEQ ID NO: 370691 - DNA, 26 bp, Artificial Sequence
  Description of Artificial Sequence: Synthetic oligonucleotide
aatggggaggcgcagcgttggggatt

SEQ ID NO: 370692 - DNA, 25 bp, Artificial Sequence
  Description of Artificial Sequence: Synthetic oligonucleotide
atggggaggcgcagcgttggggatt

SEQ ID NO: 370693 - DNA, 24 bp, Artificial Sequence
  Description of Artificial Sequence: Synthetic oligonucleotide
tggggaggcgcagcgttggggatt

SEQ ID NO: 370694 - DNA, 23 bp, Artificial Sequence
  Description of Artificial Sequence: Synthetic oligonucleotide
ggggaggcgcagcgttggggatt

SEQ ID NO: 370695 - DNA, 23 bp, Artificial Sequence
  Description of Artificial Sequence: Synthetic oligonucleotide
gggaggcgcagcgttggggattc

SEQ ID NO: 370696 - DNA, 23 bp, Artificial Sequence
  Description of Artificial Sequence: Synthetic oligonucleotide
ggaggcgcagcgttggggattcc

SEQ ID NO: 370697 - DNA, 23 bp, Artificial Sequence
  Description of Artificial Sequence: Synthetic oligonucleotide
gaggcgcagcgttggggattccc

SEQ ID NO: 370698 - DNA, 24 bp, Artificial Sequence
  Description of Artificial Sequence: Synthetic oligonucleotide
aggcgcagcgttggggattcccca

SEQ ID NO: 370699 - DNA, 23 bp, Artificial Sequence
  Description of Artificial Sequence: Synthetic oligonucleotide
ggcgcagcgttggggattcccca

SEQ ID NO: 370700 - DNA, 24 bp, Artificial Sequence
  Description of Artificial Sequence: Synthetic oligonucleotide
gcgcagcgttggggattccccact

SEQ ID NO: 370701 - DNA, 24 bp, Artificial Sequence
  Description of Artificial Sequence: Synthetic oligonucleotide
cgcagcgttggggattccccactc

SEQ ID NO: 370702 - DNA, 24 bp, Artificial Sequence
  Description of Artificial Sequence: Synthetic oligonucleotide
gcagcgttggggattccccactcc

SEQ ID NO: 370703 - DNA, 24 bp, Artificial Sequence
  Description of Artificial Sequence: Synthetic oligonucleotide
cagcgttggggattccccactccc

SEQ ID NO: 370704 - DNA, 25 bp, Artificial Sequence
  Description of Artificial Sequence: Synthetic oligonucleotide
agcgttggggattccccactcccct

SEQ ID NO: 370705 - DNA, 24 bp, Artificial Sequence
  Description of Artificial Sequence: Synthetic oligonucleotide
gcgttggggattccccactcccct

SEQ ID NO: 370706 - DNA, 25 bp, Artificial Sequence
  Description of Artificial Sequence: Synthetic oligonucleotide
cgttggggattccccactcccctga

SEQ ID NO: 370707 - DNA, 27 bp, Artificial Sequence
  Description of Artificial Sequence: Synthetic oligonucleotide
gttggggattccccactcccctgagtt

SEQ ID NO: 370708 - DNA, 28 bp, Artificial Sequence
  Description of Artificial Sequence: Synthetic oligonucleotide
ttggggattccccactcccctgagtttc

SEQ ID NO: 370709 - DNA, 27 bp, Artificial Sequence
  Description of Artificial Sequence: Synthetic oligonucleotide
tggggattccccactcccctgagtttc

SEQ ID NO: 370710 - DNA, 27 bp, Artificial Sequence
  Description of Artificial Sequence: Synthetic oligonucleotide
ggggattccccactcccctgagtttca

SEQ ID NO: 370711 - DNA, 27 bp, Artificial Sequence
  Description of Artificial Sequence: Synthetic oligonucleotide
gggattccccactcccctgagtttcac

SEQ ID NO: 370712 - DNA, 29 bp, Artificial Sequence
  Description of Artificial Sequence: Synthetic oligonucleotide
ggattccccactcccctgagtttcacttc

SEQ ID NO: 370713 - DNA, 31 bp, Artificial Sequence
  Description of Artificial Sequence: Synthetic oligonucleotide
gattccccactcccctgagtttcacttcttc

SEQ ID NO: 370714 - DNA, 32 bp, Artificial Sequence
  Description of Artificial Sequence: Synthetic oligonucleotide
attccccactcccctgagtttcacttcttctc

SEQ ID NO: 370715 - DNA, 31 bp, Artificial Sequence
  Description of Artificial Sequence: Synthetic oligonucleotide
ttccccactcccctgagtttcacttcttctc

SEQ ID NO: 370716 - DNA, 30 bp, Artificial Sequence
  Description of Artificial Sequence: Synthetic oligonucleotide
tccccactcccctgagtttcacttcttctc

SEQ ID NO: 370717 - DNA, 29 bp, Artificial Sequence
  Description of Artificial Sequence: Synthetic oligonucleotide
ccccactcccctgagtttcacttcttctc

SEQ ID NO: 370718 - DNA, 29 bp, Artificial Sequence
  Description of Artificial Sequence: Synthetic oligonucleotide
cccactcccctgagtttcacttcttctcc

SEQ ID NO: 370719 - DNA, 29 bp, Artificial Sequence
  Description of Artificial Sequence: Synthetic oligonucleotide
ccactcccctgagtttcacttcttctccc

SEQ ID NO: 370720 - DNA, 31 bp, Artificial Sequence
  Description of Artificial Sequence: Synthetic oligonucleotide
cactcccctgagtttcacttcttctcccaac

SEQ ID NO: 370721 - DNA, 33 bp, Artificial Sequence
  Description of Artificial Sequence: Synthetic oligonucleotide
actcccctgagtttcacttcttctcccaacttg

SEQ ID NO: 370722 - DNA, 32 bp, Artificial Sequence
  Description of Artificial Sequence: Synthetic oligonucleotide
ctcccctgagtttcacttcttctcccaacttg

SEQ ID NO: 370723 - DNA, 33 bp, Artificial Sequence
  Description of Artificial Sequence: Synthetic oligonucleotide
tcccctgagtttcacttcttctcccaacttgtg

SEQ ID NO: 370724 - DNA, 32 bp, Artificial Sequence
  Description of Artificial Sequence: Synthetic oligonucleotide
cccctgagtttcacttcttctcccaacttgtg

SEQ ID NO: 370725 - DNA, 33 bp, Artificial Sequence
  Description of Artificial Sequence: Synthetic oligonucleotide
ccctgagtttcacttcttctcccaacttgtgtc

SEQ ID NO: 370726 - DNA, 33 bp, Artificial Sequence
  Description of Artificial Sequence: Synthetic oligonucleotide
cctgagtttcacttcttctcccaacttgtgtcg

SEQ ID NO: 370727 - DNA, 33 bp, Artificial Sequence
  Description of Artificial Sequence: Synthetic oligonucleotide
ctgagtttcacttcttctcccaacttgtgtcgg

SEQ ID NO: 370728 - DNA, 33 bp, Artificial Sequence
  Description of Artificial Sequence: Synthetic oligonucleotide
tgagtttcacttcttctcccaacttgtgtcggg

SEQ ID NO: 370729 - DNA, 32 bp, Artificial Sequence
  Description of Artificial Sequence: Synthetic oligonucleotide
gagtttcacttcttctcccaacttgtgtcggg

SEQ ID NO: 370730 - DNA, 33 bp, Artificial Sequence
  Description of Artificial Sequence: Synthetic oligonucleotide
agtttcacttcttctcccaacttgtgtcgggtc

SEQ ID NO: 370731 - DNA, 32 bp, Artificial Sequence
  Description of Artificial Sequence: Synthetic oligonucleotide
gtttcacttcttctcccaacttgtgtcgggtc

SEQ ID NO: 370732 - DNA, 32 bp, Artificial Sequence
  Description of Artificial Sequence: Synthetic oligonucleotide
tttcacttcttctcccaacttgtgtcgggtcc

SEQ ID NO: 370733 - DNA, 31 bp, Artificial Sequence
  Description of Artificial Sequence: Synthetic oligonucleotide
ttcacttcttctcccaacttgtgtcgggtcc

SEQ ID NO: 370734 - DNA, 30 bp, Artificial Sequence
  Description of Artificial Sequence: Synthetic oligonucleotide
tcacttcttctcccaacttgtgtcgggtcc

SEQ ID NO: 370735 - DNA, 29 bp, Artificial Sequence
  Description of Artificial Sequence: Synthetic oligonucleotide
cacttcttctcccaacttgtgtcgggtcc

SEQ ID NO: 370736 - DNA, 31 bp, Artificial Sequence
  Description of Artificial Sequence: Synthetic oligonucleotide
acttcttctcccaacttgtgtcgggtccttc

SEQ ID NO: 370737 - DNA, 30 bp, Artificial Sequence
  Description of Artificial Sequence: Synthetic oligonucleotide
cttcttctcccaacttgtgtcgggtccttc

SEQ ID NO: 370738 - DNA, 32 bp, Artificial Sequence
  Description of Artificial Sequence: Synthetic oligonucleotide
ttcttctcccaacttgtgtcgggtccttcttc

SEQ ID NO: 370739 - DNA, 31 bp, Artificial Sequence
  Description of Artificial Sequence: Synthetic oligonucleotide
tcttctcccaacttgtgtcgggtccttcttc

SEQ ID NO: 370740 - DNA, 30 bp, Artificial Sequence
  Description of Artificial Sequence: Synthetic oligonucleotide
cttctcccaacttgtgtcgggtccttcttc

SEQ ID NO: 370741 - DNA, 30 bp, Artificial Sequence
  Description of Artificial Sequence: Synthetic oligonucleotide
ttctcccaacttgtgtcgggtccttcttcc

SEQ ID NO: 370742 - DNA, 29 bp, Artificial Sequence
  Description of Artificial Sequence: Synthetic oligonucleotide
tctcccaacttgtgtcgggtccttcttcc

SEQ ID NO: 370743 - DNA, 28 bp, Artificial Sequence
  Description of Artificial Sequence: Synthetic oligonucleotide
ctcccaacttgtgtcgggtccttcttcc

SEQ ID NO: 370744 - DNA, 29 bp, Artificial Sequence
  Description of Artificial Sequence: Synthetic oligonucleotide
tcccaacttgtgtcgggtccttcttccag

SEQ ID NO: 370745 - DNA, 28 bp, Artificial Sequence
  Description of Artificial Sequence: Synthetic oligonucleotide
cccaacttgtgtcgggtccttcttccag

SEQ ID NO: 370746 - DNA, 28 bp, Artificial Sequence
  Description of Artificial Sequence: Synthetic oligonucleotide
ccaacttgtgtcgggtccttcttccagg

SEQ ID NO: 370747 - DNA, 31 bp, Artificial Sequence
  Description of Artificial Sequence: Synthetic oligonucleotide
caacttgtgtcgggtccttcttccaggatac

SEQ ID NO: 370748 - DNA, 32 bp, Artificial Sequence
  Description of Artificial Sequence: Synthetic oligonucleotide
aacttgtgtcgggtccttcttccaggatactc

SEQ ID NO: 370749 - DNA, 31 bp, Artificial Sequence
  Description of Artificial Sequence: Synthetic oligonucleotide
acttgtgtcgggtccttcttccaggatactc

SEQ ID NO: 370750 - DNA, 30 bp, Artificial Sequence
  Description of Artificial Sequence: Synthetic oligonucleotide
cttgtgtcgggtccttcttccaggatactc

SEQ ID NO: 370751 - DNA, 30 bp, Artificial Sequence
  Description of Artificial Sequence: Synthetic oligonucleotide
ttgtgtcgggtccttcttccaggatactcg

SEQ ID NO: 370752 - DNA, 29 bp, Artificial Sequence
  Description of Artificial Sequence: Synthetic oligonucleotide
tgtgtcgggtccttcttccaggatactcg

SEQ ID NO: 370753 - DNA, 28 bp, Artificial Sequence
  Description of Artificial Sequence: Synthetic oligonucleotide
gtgtcgggtccttcttccaggatactcg

SEQ ID NO: 370754 - DNA, 29 bp, Artificial Sequence
  Description of Artificial Sequence: Synthetic oligonucleotide
tgtcgggtccttcttccaggatactcgtg

SEQ ID NO: 370755 - DNA, 28 bp, Artificial Sequence
  Description of Artificial Sequence: Synthetic oligonucleotide
gtcgggtccttcttccaggatactcgtg

SEQ ID NO: 370756 - DNA, 29 bp, Artificial Sequence
  Description of Artificial Sequence: Synthetic oligonucleotide
tcgggtccttcttccaggatactcgtgac

SEQ ID NO: 370757 - DNA, 28 bp, Artificial Sequence
  Description of Artificial Sequence: Synthetic oligonucleotide
cgggtccttcttccaggatactcgtgac

SEQ ID NO: 370758 - DNA, 28 bp, Artificial Sequence
  Description of Artificial Sequence: Synthetic oligonucleotide
gggtccttcttccaggatactcgtgacg

SEQ ID NO: 370759 - DNA, 28 bp, Artificial Sequence
  Description of Artificial Sequence: Synthetic oligonucleotide
ggtccttcttccaggatactcgtgacgc

SEQ ID NO: 370760 - DNA, 28 bp, Artificial Sequence
  Description of Artificial Sequence: Synthetic oligonucleotide
gtccttcttccaggatactcgtgacgcg

SEQ ID NO: 370761 - DNA, 29 bp, Artificial Sequence
  Description of Artificial Sequence: Synthetic oligonucleotide
tccttcttccaggatactcgtgacgcgtc

SEQ ID NO: 370762 - DNA, 28 bp, Artificial Sequence
  Description of Artificial Sequence: Synthetic oligonucleotide
ccttcttccaggatactcgtgacgcgtc

SEQ ID NO: 370763 - DNA, 28 bp, Artificial Sequence
  Description of Artificial Sequence: Synthetic oligonucleotide
cttcttccaggatactcgtgacgcgtcc

SEQ ID NO: 370764 - DNA, 28 bp, Artificial Sequence
  Description of Artificial Sequence: Synthetic oligonucleotide
ttcttccaggatactcgtgacgcgtccc

SEQ ID NO: 370765 - DNA, 27 bp, Artificial Sequence
  Description of Artificial Sequence: Synthetic oligonucleotide
tcttccaggatactcgtgacgcgtccc

SEQ ID NO: 370766 - DNA, 26 bp, Artificial Sequence
  Description of Artificial Sequence: Synthetic oligonucleotide
cttccaggatactcgtgacgcgtccc

SEQ ID NO: 370767 - DNA, 27 bp, Artificial Sequence
  Description of Artificial Sequence: Synthetic oligonucleotide
ttccaggatactcgtgacgcgtcccca

SEQ ID NO: 370768 - DNA, 26 bp, Artificial Sequence
  Description of Artificial Sequence: Synthetic oligonucleotide
tccaggatactcgtgacgcgtcccca

SEQ ID NO: 370769 - DNA, 25 bp, Artificial Sequence
  Description of Artificial Sequence: Synthetic oligonucleotide
ccaggatactcgtgacgcgtcccca

SEQ ID NO: 370770 - DNA, 27 bp, Artificial Sequence
  Description of Artificial Sequence: Synthetic oligonucleotide
caggatactcgtgacgcgtccccactt

SEQ ID NO: 370771 - DNA, 27 bp, Artificial Sequence
  Description of Artificial Sequence: Synthetic oligonucleotide
aggatactcgtgacgcgtccccacttc

SEQ ID NO: 370772 - DNA, 26 bp, Artificial Sequence
  Description of Artificial Sequence: Synthetic oligonucleotide
ggatactcgtgacgcgtccccacttc

SEQ ID NO: 370773 - DNA, 26 bp, Artificial Sequence
  Description of Artificial Sequence: Synthetic oligonucleotide
gatactcgtgacgcgtccccacttcc

SEQ ID NO: 370774 - DNA, 27 bp, Artificial Sequence
  Description of Artificial Sequence: Synthetic oligonucleotide
atactcgtgacgcgtccccacttccca

SEQ ID NO: 370775 - DNA, 26 bp, Artificial Sequence
  Description of Artificial Sequence: Synthetic oligonucleotide
tactcgtgacgcgtccccacttccca

SEQ ID NO: 370776 - DNA, 25 bp, Artificial Sequence
  Description of Artificial Sequence: Synthetic oligonucleotide
actcgtgacgcgtccccacttccca

SEQ ID NO: 370777 - DNA, 24 bp, Artificial Sequence
  Description of Artificial Sequence: Synthetic oligonucleotide
ctcgtgacgcgtccccacttccca

SEQ ID NO: 370778 - DNA, 25 bp, Artificial Sequence
  Description of Artificial Sequence: Synthetic oligonucleotide
tcgtgacgcgtccccacttcccact

SEQ ID NO: 370779 - DNA, 24 bp, Artificial Sequence
  Description of Artificial Sequence: Synthetic oligonucleotide
cgtgacgcgtccccacttcccact

SEQ ID NO: 370780 - DNA, 24 bp, Artificial Sequence
  Description of Artificial Sequence: Synthetic oligonucleotide
gtgacgcgtccccacttcccactc

SEQ ID NO: 370781 - DNA, 24 bp, Artificial Sequence
  Description of Artificial Sequence: Synthetic oligonucleotide
tgacgcgtccccacttcccactcc

SEQ ID NO: 370782 - DNA, 23 bp, Artificial Sequence
  Description of Artificial Sequence: Synthetic oligonucleotide
gacgcgtccccacttcccactcc

SEQ ID NO: 370783 - DNA, 26 bp, Artificial Sequence
  Description of Artificial Sequence: Synthetic oligonucleotide
acgcgtccccacttcccactcccatt

SEQ ID NO: 370784 - DNA, 25 bp, Artificial Sequence
  Description of Artificial Sequence: Synthetic oligonucleotide
cgcgtccccacttcccactcccatt

SEQ ID NO: 370785 - DNA, 25 bp, Artificial Sequence
  Description of Artificial Sequence: Synthetic oligonucleotide
gcgtccccacttcccactcccattg

SEQ ID NO: 370786 - DNA, 25 bp, Artificial Sequence
  Description of Artificial Sequence: Synthetic oligonucleotide
cgtccccacttcccactcccattgg

SEQ ID NO: 370787 - DNA, 27 bp, Artificial Sequence
  Description of Artificial Sequence: Synthetic oligonucleotide
gtccccacttcccactcccattgggta

SEQ ID NO: 370788 - DNA, 29 bp, Artificial Sequence
  Description of Artificial Sequence: Synthetic oligonucleotide
tccccacttcccactcccattgggtattg

SEQ ID NO: 370789 - DNA, 28 bp, Artificial Sequence
  Description of Artificial Sequence: Synthetic oligonucleotide
ccccacttcccactcccattgggtattg

SEQ ID NO: 370790 - DNA, 28 bp, Artificial Sequence
  Description of Artificial Sequence: Synthetic oligonucleotide
cccacttcccactcccattgggtattgg

SEQ ID NO: 370791 - DNA, 32 bp, Artificial Sequence
  Description of Artificial Sequence: Synthetic oligonucleotide
ccacttcccactcccattgggtattggatatc

SEQ ID NO: 370792 - DNA, 34 bp, Artificial Sequence
  Description of Artificial Sequence: Synthetic oligonucleotide
cacttcccactcccattgggtattggatatctag

SEQ ID NO: 370793 - DNA, 35 bp, Artificial Sequence
  Description of Artificial Sequence: Synthetic oligonucleotide
acttcccactcccattgggtattggatatctagag

SEQ ID NO: 370794 - DNA, 34 bp, Artificial Sequence
  Description of Artificial Sequence: Synthetic oligonucleotide
cttcccactcccattgggtattggatatctagag

SEQ ID NO: 370795 - DNA, 36 bp, Artificial Sequence
  Description of Artificial Sequence: Synthetic oligonucleotide
ttcccactcccattgggtattggatatctagagaag

SEQ ID NO: 370796 - DNA, 35 bp, Artificial Sequence
  Description of Artificial Sequence: Synthetic oligonucleotide
tcccactcccattgggtattggatatctagagaag

SEQ ID NO: 370797 - DNA, 34 bp, Artificial Sequence
  Description of Artificial Sequence: Synthetic oligonucleotide
cccactcccattgggtattggatatctagagaag

SEQ ID NO: 370798 - DNA, 34 bp, Artificial Sequence
  Description of Artificial Sequence: Synthetic oligonucleotide
ccactcccattgggtattggatatctagagaagc

SEQ ID NO: 370799 - DNA, 34 bp, Artificial Sequence
  Description of Artificial Sequence: Synthetic oligonucleotide
cactcccattgggtattggatatctagagaagcc

SEQ ID NO: 370800 - DNA, 37 bp, Artificial Sequence
  Description of Artificial Sequence: Synthetic oligonucleotide
actcccattgggtattggatatctagagaagccaatc

SEQ ID NO: 370801 - DNA, 36 bp, Artificial Sequence
  Description of Artificial Sequence: Synthetic oligonucleotide
ctcccattgggtattggatatctagagaagccaatc

SEQ ID NO: 370802 - DNA, 37 bp, Artificial Sequence
  Description of Artificial Sequence: Synthetic oligonucleotide
tcccattgggtattggatatctagagaagccaatcag

SEQ ID NO: 370803 - DNA, 36 bp, Artificial Sequence
  Description of Artificial Sequence: Synthetic oligonucleotide
cccattgggtattggatatctagagaagccaatcag

SEQ ID NO: 370804 - DNA, 36 bp, Artificial Sequence
  Description of Artificial Sequence: Synthetic oligonucleotide
ccattgggtattggatatctagagaagccaatcagc

SEQ ID NO: 370805 - DNA, 36 bp, Artificial Sequence
  Description of Artificial Sequence: Synthetic oligonucleotide
cattgggtattggatatctagagaagccaatcagcg

SEQ ID NO: 370806 - DNA, 37 bp, Artificial Sequence
  Description of Artificial Sequence: Synthetic oligonucleotide
attgggtattggatatctagagaagccaatcagcgtc

SEQ ID NO: 370807 - DNA, 36 bp, Artificial Sequence
  Description of Artificial Sequence: Synthetic oligonucleotide
ttgggtattggatatctagagaagccaatcagcgtc

SEQ ID NO: 370808 - DNA, 35 bp, Artificial Sequence
  Description of Artificial Sequence: Synthetic oligonucleotide
tgggtattggatatctagagaagccaatcagcgtc

SEQ ID NO: 370809 - DNA, 34 bp, Artificial Sequence
  Description of Artificial Sequence: Synthetic oligonucleotide
gggtattggatatctagagaagccaatcagcgtc

SEQ ID NO: 370810 - DNA, 34 bp, Artificial Sequence
  Description of Artificial Sequence: Synthetic oligonucleotide
ggtattggatatctagagaagccaatcagcgtcg

SEQ ID NO: 370811 - DNA, 34 bp, Artificial Sequence
  Description of Artificial Sequence: Synthetic oligonucleotide
gtattggatatctagagaagccaatcagcgtcgc

SEQ ID NO: 370812 - DNA, 34 bp, Artificial Sequence
  Description of Artificial Sequence: Synthetic oligonucleotide
tattggatatctagagaagccaatcagcgtcgcc

SEQ ID NO: 370813 - DNA, 33 bp, Artificial Sequence
  Description of Artificial Sequence: Synthetic oligonucleotide
attggatatctagagaagccaatcagcgtcgcc

SEQ ID NO: 370814 - DNA, 32 bp, Artificial Sequence
  Description of Artificial Sequence: Synthetic oligonucleotide
ttggatatctagagaagccaatcagcgtcgcc

SEQ ID NO: 370815 - DNA, 31 bp, Artificial Sequence
  Description of Artificial Sequence: Synthetic oligonucleotide
tggatatctagagaagccaatcagcgtcgcc

SEQ ID NO: 370816 - DNA, 30 bp, Artificial Sequence
  Description of Artificial Sequence: Synthetic oligonucleotide
ggatatctagagaagccaatcagcgtcgcc

SEQ ID NO: 370817 - DNA, 30 bp, Artificial Sequence
  Description of Artificial Sequence: Synthetic oligonucleotide
gatatctagagaagccaatcagcgtcgccg

SEQ ID NO: 370818 - DNA, 30 bp, Artificial Sequence
  Description of Artificial Sequence: Synthetic oligonucleotide
atatctagagaagccaatcagcgtcgccgc

SEQ ID NO: 370819 - DNA, 29 bp, Artificial Sequence
  Description of Artificial Sequence: Synthetic oligonucleotide
tatctagagaagccaatcagcgtcgccgc

SEQ ID NO: 370820 - DNA, 28 bp, Artificial Sequence
  Description of Artificial Sequence: Synthetic oligonucleotide
atctagagaagccaatcagcgtcgccgc

SEQ ID NO: 370821 - DNA, 27 bp, Artificial Sequence
  Description of Artificial Sequence: Synthetic oligonucleotide
tctagagaagccaatcagcgtcgccgc

SEQ ID NO: 370822 - DNA, 26 bp, Artificial Sequence
  Description of Artificial Sequence: Synthetic oligonucleotide
ctagagaagccaatcagcgtcgccgc

SEQ ID NO: 370823 - DNA, 26 bp, Artificial Sequence
  Description of Artificial Sequence: Synthetic oligonucleotide
tagagaagccaatcagcgtcgccgcg

SEQ ID NO: 370824 - DNA, 25 bp, Artificial Sequence
  Description of Artificial Sequence: Synthetic oligonucleotide
agagaagccaatcagcgtcgccgcg

SEQ ID NO: 370825 - DNA, 24 bp, Artificial Sequence
  Description of Artificial Sequence: Synthetic oligonucleotide
gagaagccaatcagcgtcgccgcg

SEQ ID NO: 370826 - DNA, 25 bp, Artificial Sequence
  Description of Artificial Sequence: Synthetic oligonucleotide
agaagccaatcagcgtcgccgcggt

SEQ ID NO: 370827 - DNA, 24 bp, Artificial Sequence
  Description of Artificial Sequence: Synthetic oligonucleotide
gaagccaatcagcgtcgccgcggt

SEQ ID NO: 370828 - DNA, 24 bp, Artificial Sequence
  Description of Artificial Sequence: Synthetic oligonucleotide
aagccaatcagcgtcgccgcggtc

SEQ ID NO: 370829 - DNA, 23 bp, Artificial Sequence
  Description of Artificial Sequence: Synthetic oligonucleotide
agccaatcagcgtcgccgcggtc

SEQ ID NO: 370830 - DNA, 22 bp, Artificial Sequence
  Description of Artificial Sequence: Synthetic oligonucleotide
gccaatcagcgtcgccgcggtc

SEQ ID NO: 370831 - DNA, 22 bp, Artificial Sequence
  Description of Artificial Sequence: Synthetic oligonucleotide
ccaatcagcgtcgccgcggtcc

SEQ ID NO: 370832 - DNA, 23 bp, Artificial Sequence
  Description of Artificial Sequence: Synthetic oligonucleotide
caatcagcgtcgccgcggtccca

SEQ ID NO: 370833 - DNA, 25 bp, Artificial Sequence
  Description of Artificial Sequence: Synthetic oligonucleotide
aatcagcgtcgccgcggtcccagtt

SEQ ID NO: 370834 - DNA, 24 bp, Artificial Sequence
  Description of Artificial Sequence: Synthetic oligonucleotide
atcagcgtcgccgcggtcccagtt

SEQ ID NO: 370835 - DNA, 23 bp, Artificial Sequence
  Description of Artificial Sequence: Synthetic oligonucleotide
tcagcgtcgccgcggtcccagtt

SEQ ID NO: 370836 - DNA, 22 bp, Artificial Sequence
  Description of Artificial Sequence: Synthetic oligonucleotide
cagcgtcgccgcggtcccagtt

SEQ ID NO: 370837 - DNA, 26 bp, Artificial Sequence
  Description of Artificial Sequence: Synthetic oligonucleotide
agcgtcgccgcggtcccagttctaaa

SEQ ID NO: 370838 - DNA, 25 bp, Artificial Sequence
  Description of Artificial Sequence: Synthetic oligonucleotide
gcgtcgccgcggtcccagttctaaa

SEQ ID NO: 370839 - DNA, 26 bp, Artificial Sequence
  Description of Artificial Sequence: Synthetic oligonucleotide
cgtcgccgcggtcccagttctaaagt

SEQ ID NO: 370840 - DNA, 26 bp, Artificial Sequence
  Description of Artificial Sequence: Synthetic oligonucleotide
gtcgccgcggtcccagttctaaagtc

SEQ ID NO: 370841 - DNA, 26 bp, Artificial Sequence
  Description of Artificial Sequence: Synthetic oligonucleotide
tcgccgcggtcccagttctaaagtcc

SEQ ID NO: 370842 - DNA, 25 bp, Artificial Sequence
  Description of Artificial Sequence: Synthetic oligonucleotide
cgccgcggtcccagttctaaagtcc

SEQ ID NO: 370843 - DNA, 25 bp, Artificial Sequence
  Description of Artificial Sequence: Synthetic oligonucleotide
gccgcggtcccagttctaaagtccc

SEQ ID NO: 370844 - DNA, 26 bp, Artificial Sequence
  Description of Artificial Sequence: Synthetic oligonucleotide
ccgcggtcccagttctaaagtcccca

SEQ ID NO: 370845 - DNA, 26 bp, Artificial Sequence
  Description of Artificial Sequence: Synthetic oligonucleotide
cgcggtcccagttctaaagtccccac

SEQ ID NO: 370846 - DNA, 26 bp, Artificial Sequence
  Description of Artificial Sequence: Synthetic oligonucleotide
gcggtcccagttctaaagtccccacg

SEQ ID NO: 370847 - DNA, 27 bp, Artificial Sequence
  Description of Artificial Sequence: Synthetic oligonucleotide
cggtcccagttctaaagtccccacgca

SEQ ID NO: 370848 - DNA, 27 bp, Artificial Sequence
  Description of Artificial Sequence: Synthetic oligonucleotide
ggtcccagttctaaagtccccacgcac

SEQ ID NO: 370849 - DNA, 27 bp, Artificial Sequence
  Description of Artificial Sequence: Synthetic oligonucleotide
gtcccagttctaaagtccccacgcacc

SEQ ID NO: 370850 - DNA, 27 bp, Artificial Sequence
  Description of Artificial Sequence: Synthetic oligonucleotide
tcccagttctaaagtccccacgcaccc

SEQ ID NO: 370851 - DNA, 27 bp, Artificial Sequence
  Description of Artificial Sequence: Synthetic oligonucleotide
cccagttctaaagtccccacgcaccca

SEQ ID NO: 370852 - DNA, 27 bp, Artificial Sequence
  Description of Artificial Sequence: Synthetic oligonucleotide
ccagttctaaagtccccacgcacccac

SEQ ID NO: 370853 - DNA, 27 bp, Artificial Sequence
  Description of Artificial Sequence: Synthetic oligonucleotide
cagttctaaagtccccacgcacccacc

SEQ ID NO: 370854 - DNA, 27 bp, Artificial Sequence
  Description of Artificial Sequence: Synthetic oligonucleotide
agttctaaagtccccacgcacccaccc

SEQ ID NO: 370855 - DNA, 26 bp, Artificial Sequence
  Description of Artificial Sequence: Synthetic oligonucleotide
gttctaaagtccccacgcacccaccc

SEQ ID NO: 370856 - DNA, 26 bp, Artificial Sequence
  Description of Artificial Sequence: Synthetic oligonucleotide
ttctaaagtccccacgcacccacccg

SEQ ID NO: 370857 - DNA, 25 bp, Artificial Sequence
  Description of Artificial Sequence: Synthetic oligonucleotide
tctaaagtccccacgcacccacccg

SEQ ID NO: 370858 - DNA, 24 bp, Artificial Sequence
  Description of Artificial Sequence: Synthetic oligonucleotide
ctaaagtccccacgcacccacccg

SEQ ID NO: 370859 - DNA, 25 bp, Artificial Sequence
  Description of Artificial Sequence: Synthetic oligonucleotide
taaagtccccacgcacccacccgga

SEQ ID NO: 370860 - DNA, 24 bp, Artificial Sequence
  Description of Artificial Sequence: Synthetic oligonucleotide
aaagtccccacgcacccacccgga

SEQ ID NO: 370861 - DNA, 23 bp, Artificial Sequence
  Description of Artificial Sequence: Synthetic oligonucleotide
aagtccccacgcacccacccgga

SEQ ID NO: 370862 - DNA, 22 bp, Artificial Sequence
  Description of Artificial Sequence: Synthetic oligonucleotide
agtccccacgcacccacccgga

SEQ ID NO: 370863 - DNA, 21 bp, Artificial Sequence
  Description of Artificial Sequence: Synthetic oligonucleotide
gtccccacgcacccacccgga

SEQ ID NO: 370864 - DNA, 22 bp, Artificial Sequence
  Description of Artificial Sequence: Synthetic oligonucleotide
tccccacgcacccacccggact

SEQ ID NO: 370865 - DNA, 21 bp, Artificial Sequence
  Description of Artificial Sequence: Synthetic oligonucleotide
ccccacgcacccacccggact

SEQ ID NO: 370866 - DNA, 22 bp, Artificial Sequence
  Description of Artificial Sequence: Synthetic oligonucleotide
cccacgcacccacccggactca

SEQ ID NO: 370867 - DNA, 23 bp, Artificial Sequence
  Description of Artificial Sequence: Synthetic oligonucleotide
ccacgcacccacccggactcaga

SEQ ID NO: 370868 - DNA, 24 bp, Artificial Sequence
  Description of Artificial Sequence: Synthetic oligonucleotide
cacgcacccacccggactcagagt

SEQ ID NO: 370869 - DNA, 25 bp, Artificial Sequence
  Description of Artificial Sequence: Synthetic oligonucleotide
acgcacccacccggactcagagtct

SEQ ID NO: 370870 - DNA, 24 bp, Artificial Sequence
  Description of Artificial Sequence: Synthetic oligonucleotide
cgcacccacccggactcagagtct

SEQ ID NO: 370871 - DNA, 24 bp, Artificial Sequence
  Description of Artificial Sequence: Synthetic oligonucleotide
gcacccacccggactcagagtctc

SEQ ID NO: 370872 - DNA, 25 bp, Artificial Sequence
  Description of Artificial Sequence: Synthetic oligonucleotide
cacccacccggactcagagtctcct

SEQ ID NO: 370873 - DNA, 26 bp, Artificial Sequence
  Description of Artificial Sequence: Synthetic oligonucleotide
acccacccggactcagagtctcctca

SEQ ID NO: 370874 - DNA, 25 bp, Artificial Sequence
  Description of Artificial Sequence: Synthetic oligonucleotide
cccacccggactcagagtctcctca

SEQ ID NO: 370875 - DNA, 26 bp, Artificial Sequence
  Description of Artificial Sequence: Synthetic oligonucleotide
ccacccggactcagagtctcctcaga

SEQ ID NO: 370876 - DNA, 26 bp, Artificial Sequence
  Description of Artificial Sequence: Synthetic oligonucleotide
cacccggactcagagtctcctcagac

SEQ ID NO: 370877 - DNA, 26 bp, Artificial Sequence
  Description of Artificial Sequence: Synthetic oligonucleotide
acccggactcagagtctcctcagacg

SEQ ID NO: 370878 - DNA, 25 bp, Artificial Sequence
  Description of Artificial Sequence: Synthetic oligonucleotide
cccggactcagagtctcctcagacg

SEQ ID NO: 370879 - DNA, 25 bp, Artificial Sequence
  Description of Artificial Sequence: Synthetic oligonucleotide
ccggactcagagtctcctcagacgc

SEQ ID NO: 370880 - DNA, 25 bp, Artificial Sequence
  Description of Artificial Sequence: Synthetic oligonucleotide
cggactcagagtctcctcagacgcc

SEQ ID NO: 370881 - DNA, 26 bp, Artificial Sequence
  Description of Artificial Sequence: Synthetic oligonucleotide
ggactcagagtctcctcagacgccga

SEQ ID NO: 370882 - DNA, 27 bp, Artificial Sequence
  Description of Artificial Sequence: Synthetic oligonucleotide
gactcagagtctcctcagacgccgaga

SEQ ID NO: 370883 - DNA, 28 bp, Artificial Sequence
  Description of Artificial Sequence: Synthetic oligonucleotide
actcagagtctcctcagacgccgagatg

SEQ ID NO: 370884 - DNA, 27 bp, Artificial Sequence
  Description of Artificial Sequence: Synthetic oligonucleotide
ctcagagtctcctcagacgccgagatg

SEQ ID NO: 370885 - DNA, 27 bp, Artificial Sequence
  Description of Artificial Sequence: Synthetic oligonucleotide
tcagagtctcctcagacgccgagatgc

SEQ ID NO: 370886 - DNA, 27 bp, Artificial Sequence
  Description of Artificial Sequence: Synthetic oligonucleotide
cagagtctcctcagacgccgagatgct

SEQ ID NO: 370887 - DNA, 27 bp, Artificial Sequence
  Description of Artificial Sequence: Synthetic oligonucleotide
agagtctcctcagacgccgagatgctg

SEQ ID NO: 370888 - DNA, 26 bp, Artificial Sequence
  Description of Artificial Sequence: Synthetic oligonucleotide
gagtctcctcagacgccgagatgctg

SEQ ID NO: 370889 - DNA, 27 bp, Artificial Sequence
  Description of Artificial Sequence: Synthetic oligonucleotide
agtctcctcagacgccgagatgctggt

SEQ ID NO: 370890 - DNA, 26 bp, Artificial Sequence
  Description of Artificial Sequence: Synthetic oligonucleotide
gtctcctcagacgccgagatgctggt

SEQ ID NO: 370891 - DNA, 27 bp, Artificial Sequence
  Description of Artificial Sequence: Synthetic oligonucleotide
tctcctcagacgccgagatgctggtca

SEQ ID NO: 370892 - DNA, 27 bp, Artificial Sequence
  Description of Artificial Sequence: Synthetic oligonucleotide
ctcctcagacgccgagatgctggtcat

SEQ ID NO: 370893 - DNA, 27 bp, Artificial Sequence
  Description of Artificial Sequence: Synthetic oligonucleotide
tcctcagacgccgagatgctggtcatg

SEQ ID NO: 370894 - DNA, 26 bp, Artificial Sequence
  Description of Artificial Sequence: Synthetic oligonucleotide
cctcagacgccgagatgctggtcatg

SEQ ID NO: 370895 - DNA, 26 bp, Artificial Sequence
  Description of Artificial Sequence: Synthetic oligonucleotide
ctcagacgccgagatgctggtcatgg

SEQ ID NO: 370896 - DNA, 26 bp, Artificial Sequence
  Description of Artificial Sequence: Synthetic oligonucleotide
tcagacgccgagatgctggtcatggc

SEQ ID NO: 370897 - DNA, 25 bp, Artificial Sequence
  Description of Artificial Sequence: Synthetic oligonucleotide
cagacgccgagatgctggtcatggc

SEQ ID NO: 370898 - DNA, 25 bp, Artificial Sequence
  Description of Artificial Sequence: Synthetic oligonucleotide
agacgccgagatgctggtcatggcg

SEQ ID NO: 370899 - DNA, 24 bp, Artificial Sequence
  Description of Artificial Sequence: Synthetic oligonucleotide
gacgccgagatgctggtcatggcg

SEQ ID NO: 370900 - DNA, 24 bp, Artificial Sequence
  Description of Artificial Sequence: Synthetic oligonucleotide
acgccgagatgctggtcatggcgc

SEQ ID NO: 370901 - DNA, 23 bp, Artificial Sequence
  Description of Artificial Sequence: Synthetic oligonucleotide
cgccgagatgctggtcatggcgc

SEQ ID NO: 370902 - DNA, 23 bp, Artificial Sequence
  Description of Artificial Sequence: Synthetic oligonucleotide
gccgagatgctggtcatggcgcc

SEQ ID NO: 370903 - DNA, 23 bp, Artificial Sequence
  Description of Artificial Sequence: Synthetic oligonucleotide
ccgagatgctggtcatggcgccc

SEQ ID NO: 370904 - DNA, 23 bp, Artificial Sequence
  Description of Artificial Sequence: Synthetic oligonucleotide
cgagatgctggtcatggcgcccc

SEQ ID NO: 370905 - DNA, 25 bp, Artificial Sequence
  Description of Artificial Sequence: Synthetic oligonucleotide
gagatgctggtcatggcgccccgaa

SEQ ID NO: 370906 - DNA, 25 bp, Artificial Sequence
  Description of Artificial Sequence: Synthetic oligonucleotide
agatgctggtcatggcgccccgaac

SEQ ID NO: 370907 - DNA, 24 bp, Artificial Sequence
  Description of Artificial Sequence: Synthetic oligonucleotide
gatgctggtcatggcgccccgaac

SEQ ID NO: 370908 - DNA, 24 bp, Artificial Sequence
  Description of Artificial Sequence: Synthetic oligonucleotide
atgctggtcatggcgccccgaacc

SEQ ID NO: 370909 - DNA, 23 bp, Artificial Sequence
  Description of Artificial Sequence: Synthetic oligonucleotide
tgctggtcatggcgccccgaacc

SEQ ID NO: 370910 - DNA, 22 bp, Artificial Sequence
  Description of Artificial Sequence: Synthetic oligonucleotide
gctggtcatggcgccccgaacc

SEQ ID NO: 370911 - DNA, 23 bp, Artificial Sequence
  Description of Artificial Sequence: Synthetic oligonucleotide
ctggtcatggcgccccgaaccgt

SEQ ID NO: 370912 - DNA, 23 bp, Artificial Sequence
  Description of Artificial Sequence: Synthetic oligonucleotide
tggtcatggcgccccgaaccgtc

SEQ ID NO: 370913 - DNA, 22 bp, Artificial Sequence
  Description of Artificial Sequence: Synthetic oligonucleotide
ggtcatggcgccccgaaccgtc

SEQ ID NO: 370914 - DNA, 23 bp, Artificial Sequence
  Description of Artificial Sequence: Synthetic oligonucleotide
gtcatggcgccccgaaccgtcct

SEQ ID NO: 370915 - DNA, 23 bp, Artificial Sequence
  Description of Artificial Sequence: Synthetic oligonucleotide
tcatggcgccccgaaccgtcctc

SEQ ID NO: 370916 - DNA, 22 bp, Artificial Sequence
  Description of Artificial Sequence: Synthetic oligonucleotide
catggcgccccgaaccgtcctc

SEQ ID NO: 370917 - DNA, 23 bp, Artificial Sequence
  Description of Artificial Sequence: Synthetic oligonucleotide
atggcgccccgaaccgtcctcct

SEQ ID NO: 370918 - DNA, 22 bp, Artificial Sequence
  Description of Artificial Sequence: Synthetic oligonucleotide
tggcgccccgaaccgtcctcct

SEQ ID NO: 370919 - DNA, 21 bp, Artificial Sequence
  Description of Artificial Sequence: Synthetic oligonucleotide
ggcgccccgaaccgtcctcct

SEQ ID NO: 370920 - DNA, 21 bp, Artificial Sequence
  Description of Artificial Sequence: Synthetic oligonucleotide
gcgccccgaaccgtcctcctg

SEQ ID NO: 370921 - DNA, 22 bp, Artificial Sequence
  Description of Artificial Sequence: Synthetic oligonucleotide
cgccccgaaccgtcctcctgct

SEQ ID NO: 370922 - DNA, 22 bp, Artificial Sequence
  Description of Artificial Sequence: Synthetic oligonucleotide
gccccgaaccgtcctcctgctg

SEQ ID NO: 370923 - DNA, 23 bp, Artificial Sequence
  Description of Artificial Sequence: Synthetic oligonucleotide
ccccgaaccgtcctcctgctgct

SEQ ID NO: 370924 - DNA, 24 bp, Artificial Sequence
  Description of Artificial Sequence: Synthetic oligonucleotide
cccgaaccgtcctcctgctgctct

SEQ ID NO: 370925 - DNA, 24 bp, Artificial Sequence
  Description of Artificial Sequence: Synthetic oligonucleotide
ccgaaccgtcctcctgctgctctc

SEQ ID NO: 370926 - DNA, 24 bp, Artificial Sequence
  Description of Artificial Sequence: Synthetic oligonucleotide
cgaaccgtcctcctgctgctctcg

SEQ ID NO: 370927 - DNA, 24 bp, Artificial Sequence
  Description of Artificial Sequence: Synthetic oligonucleotide
gaaccgtcctcctgctgctctcgg

SEQ ID NO: 370928 - DNA, 24 bp, Artificial Sequence
  Description of Artificial Sequence: Synthetic oligonucleotide
aaccgtcctcctgctgctctcggc

SEQ ID NO: 370929 - DNA, 23 bp, Artificial Sequence
  Description of Artificial Sequence: Synthetic oligonucleotide
accgtcctcctgctgctctcggc

SEQ ID NO: 370930 - DNA, 22 bp, Artificial Sequence
  Description of Artificial Sequence: Synthetic oligonucleotide
ccgtcctcctgctgctctcggc

SEQ ID NO: 370931 - DNA, 22 bp, Artificial Sequence
  Description of Artificial Sequence: Synthetic oligonucleotide
cgtcctcctgctgctctcggcg

SEQ ID NO: 370932 - DNA, 22 bp, Artificial Sequence
  Description of Artificial Sequence: Synthetic oligonucleotide
gtcctcctgctgctctcggcgg

SEQ ID NO: 370933 - DNA, 22 bp, Artificial Sequence
  Description of Artificial Sequence: Synthetic oligonucleotide
tcctcctgctgctctcggcggc

SEQ ID NO: 370934 - DNA, 21 bp, Artificial Sequence
  Description of Artificial Sequence: Synthetic oligonucleotide
cctcctgctgctctcggcggc

SEQ ID NO: 370935 - DNA, 21 bp, Artificial Sequence
  Description of Artificial Sequence: Synthetic oligonucleotide
ctcctgctgctctcggcggcc

SEQ ID NO: 370936 - DNA, 22 bp, Artificial Sequence
  Description of Artificial Sequence: Synthetic oligonucleotide
tcctgctgctctcggcggccct

SEQ ID NO: 370937 - DNA, 21 bp, Artificial Sequence
  Description of Artificial Sequence: Synthetic oligonucleotide
cctgctgctctcggcggccct

SEQ ID NO: 370938 - DNA, 21 bp, Artificial Sequence
  Description of Artificial Sequence: Synthetic oligonucleotide
ctgctgctctcggcggccctg

SEQ ID NO: 370939 - DNA, 21 bp, Artificial Sequence
  Description of Artificial Sequence: Synthetic oligonucleotide
tgctgctctcggcggccctgg

SEQ ID NO: 370940 - DNA, 20 bp, Artificial Sequence
  Description of Artificial Sequence: Synthetic oligonucleotide
gctgctctcggcggccctgg

SEQ ID NO: 370941 - DNA, 20 bp, Artificial Sequence
  Description of Artificial Sequence: Synthetic oligonucleotide
ctgctctcggcggccctggc

SEQ ID NO: 370942 - DNA, 20 bp, Artificial Sequence
  Description of Artificial Sequence: Synthetic oligonucleotide
tgctctcggcggccctggcc

SEQ ID NO: 370943 - DNA, 20 bp, Artificial Sequence
  Description of Artificial Sequence: Synthetic oligonucleotide
gctctcggcggccctggcct

SEQ ID NO: 370944 - DNA, 20 bp, Artificial Sequence
  Description of Artificial Sequence: Synthetic oligonucleotide
ctctcggcggccctggccct

SEQ ID NO: 370945 - DNA, 21 bp, Artificial Sequence
  Description of Artificial Sequence: Synthetic oligonucleotide
tctcggcggccctggccctga

SEQ ID NO: 370946 - DNA, 20 bp, Artificial Sequence
  Description of Artificial Sequence: Synthetic oligonucleotide
ctcggcggccctggccctga

SEQ ID NO: 370947 - DNA, 20 bp, Artificial Sequence
  Description of Artificial Sequence: Synthetic oligonucleotide
tcggcggccctggccctgac

SEQ ID NO: 370948 - DNA, 20 bp, Artificial Sequence
  Description of Artificial Sequence: Synthetic oligonucleotide
cggcggccctggccctgact

SEQ ID NO: 370949 - DNA, 20 bp, Artificial Sequence
  Description of Artificial Sequence: Synthetic oligonucleotide
ggcggccctggccctgacct

SEQ ID NO: 370950 - DNA, 20 bp, Artificial Sequence
  Description of Artificial Sequence: Synthetic oligonucleotide
gcggccctggccctgaccga

SEQ ID NO: 370951 - DNA, 21 bp, Artificial Sequence
  Description of Artificial Sequence: Synthetic oligonucleotide
cggccctggccctgaccgaga

SEQ ID NO: 370952 - DNA, 21 bp, Artificial Sequence
  Description of Artificial Sequence: Synthetic oligonucleotide
ggccctggccctgaccgagac

SEQ ID NO: 370953 - DNA, 22 bp, Artificial Sequence
  Description of Artificial Sequence: Synthetic oligonucleotide
gccctggccctgaccgagacct

SEQ ID NO: 370954 - DNA, 22 bp, Artificial Sequence
  Description of Artificial Sequence: Synthetic oligonucleotide
ccctggccctgaccgagacctg

SEQ ID NO: 370955 - DNA, 22 bp, Artificial Sequence
  Description of Artificial Sequence: Synthetic oligonucleotide
cctggccctgaccgagacctgg

SEQ ID NO: 370956 - DNA, 22 bp, Artificial Sequence
  Description of Artificial Sequence: Synthetic oligonucleotide
ctggccctgaccgagacctggg

SEQ ID NO: 370957 - DNA, 22 bp, Artificial Sequence
  Description of Artificial Sequence: Synthetic oligonucleotide
tggccctgaccgagacctgggc

SEQ ID NO: 370958 - DNA, 21 bp, Artificial Sequence
  Description of Artificial Sequence: Synthetic oligonucleotide
ggccctgaccgagacctgggc

SEQ ID NO: 370959 - DNA, 21 bp, Artificial Sequence
  Description of Artificial Sequence: Synthetic oligonucleotide
gccctgaccgagacctgggcc

SEQ ID NO: 370960 - DNA, 21 bp, Artificial Sequence
  Description of Artificial Sequence: Synthetic oligonucleotide
ccctgaccgagacctgggccg

SEQ ID NO: 370961 - DNA, 21 bp, Artificial Sequence
  Description of Artificial Sequence: Synthetic oligonucleotide
cctgaccgagacctgggccgg

SEQ ID NO: 370962 - DNA, 22 bp, Artificial Sequence
  Description of Artificial Sequence: Synthetic oligonucleotide
ctgaccgagacctgggccggct

SEQ ID NO: 370963 - DNA, 22 bp, Artificial Sequence
  Description of Artificial Sequence: Synthetic oligonucleotide
tgaccgagacctgggccggctc

SEQ ID NO: 370964 - DNA, 21 bp, Artificial Sequence
  Description of Artificial Sequence: Synthetic oligonucleotide
gaccgagacctgggccggctc

SEQ ID NO: 370965 - DNA, 21 bp, Artificial Sequence
  Description of Artificial Sequence: Synthetic oligonucleotide
accgagacctgggccggctcc

SEQ ID NO: 370966 - DNA, 20 bp, Artificial Sequence
  Description of Artificial Sequence: Synthetic oligonucleotide
ccgagacctgggccggctcc

SEQ ID NO: 370967 - DNA, 21 bp, Artificial Sequence
  Description of Artificial Sequence: Synthetic oligonucleotide
cgagacctgggccggctccca

SEQ ID NO: 370968 - DNA, 22 bp, Artificial Sequence
  Description of Artificial Sequence: Synthetic oligonucleotide
gagacctgggccggctcccact

SEQ ID NO: 370969 - DNA, 22 bp, Artificial Sequence
  Description of Artificial Sequence: Synthetic oligonucleotide
agacctgggccggctcccactc

SEQ ID NO: 370970 - DNA, 21 bp, Artificial Sequence
  Description of Artificial Sequence: Synthetic oligonucleotide
gacctgggccggctcccactc

SEQ ID NO: 370971 - DNA, 23 bp, Artificial Sequence
  Description of Artificial Sequence: Synthetic oligonucleotide
acctgggccggctcccactccat

SEQ ID NO: 370972 - DNA, 22 bp, Artificial Sequence
  Description of Artificial Sequence: Synthetic oligonucleotide
cctgggccggctcccactccat

SEQ ID NO: 370973 - DNA, 23 bp, Artificial Sequence
  Description of Artificial Sequence: Synthetic oligonucleotide
ctgggccggctcccactccatga

SEQ ID NO: 370974 - DNA, 23 bp, Artificial Sequence
  Description of Artificial Sequence: Synthetic oligonucleotide
tgggccggctcccactccatgag

SEQ ID NO: 370975 - DNA, 22 bp, Artificial Sequence
  Description of Artificial Sequence: Synthetic oligonucleotide
gggccggctcccactccatgag

SEQ ID NO: 370976 - DNA, 27 bp, Artificial Sequence
  Description of Artificial Sequence: Synthetic oligonucleotide
ggccggctcccactccatgaggtattt

SEQ ID NO: 370977 - DNA, 27 bp, Artificial Sequence
  Description of Artificial Sequence: Synthetic oligonucleotide
gccggctcccactccatgaggtatttc

SEQ ID NO: 370978 - DNA, 29 bp, Artificial Sequence
  Description of Artificial Sequence: Synthetic oligonucleotide
ccggctcccactccatgaggtatttctac

SEQ ID NO: 370979 - DNA, 30 bp, Artificial Sequence; identical to SEQ ID NO: 21669
  Description of Artificial Sequence: Synthetic oligonucleotide

SEQ ID NO: 370980 - DNA, 27 bp, Artificial Sequence
  Description of Artificial Sequence: Synthetic oligonucleotide
atctcagtgggctacgtggacgacacc

SEQ ID NO: 370981 - DNA, 26 bp, Artificial Sequence
  Description of Artificial Sequence: Synthetic oligonucleotide
tctcagtgggctacgtggacgacacc

SEQ ID NO: 370982 - DNA, 25 bp, Artificial Sequence
  Description of Artificial Sequence: Synthetic oligonucleotide
ctcagtgggctacgtggacgacacc

SEQ ID NO: 370983 - DNA, 26 bp, Artificial Sequence
  Description of Artificial Sequence: Synthetic oligonucleotide
tcagtgggctacgtggacgacaccca

SEQ ID NO: 370984 - DNA, 25 bp, Artificial Sequence
  Description of Artificial Sequence: Synthetic oligonucleotide
cagtgggctacgtggacgacaccca

SEQ ID NO: 370985 - DNA, 27 bp, Artificial Sequence
  Description of Artificial Sequence: Synthetic oligonucleotide
agtgggctacgtggacgacacccagtt

SEQ ID NO: 370986 - DNA, 26 bp, Artificial Sequence
  Description of Artificial Sequence: Synthetic oligonucleotide
gtgggctacgtggacgacacccagtt

SEQ ID NO: 370987 - DNA, 26 bp, Artificial Sequence
  Description of Artificial Sequence: Synthetic oligonucleotide
tgggctacgtggacgacacccagttc

SEQ ID NO: 370988 - DNA, 25 bp, Artificial Sequence
  Description of Artificial Sequence: Synthetic oligonucleotide
gggctacgtggacgacacccagttc

SEQ ID NO: 370989 - DNA, 26 bp, Artificial Sequence
  Description of Artificial Sequence: Synthetic oligonucleotide
ggctacgtggacgacacccagttcgt

SEQ ID NO: 370990 - DNA, 27 bp, Artificial Sequence
  Description of Artificial Sequence: Synthetic oligonucleotide
gctacgtggacgacacccagttcgtga

SEQ ID NO: 370991 - DNA, 27 bp, Artificial Sequence
  Description of Artificial Sequence: Synthetic oligonucleotide
ctacgtggacgacacccagttcgtgag

SEQ ID NO: 370992 - DNA, 27 bp, Artificial Sequence
  Description of Artificial Sequence: Synthetic oligonucleotide
tacgtggacgacacccagttcgtgagg

SEQ ID NO: 370993 - DNA, 27 bp, Artificial Sequence
  Description of Artificial Sequence: Synthetic oligonucleotide
acgtggacgacacccagttcgtgaggt

SEQ ID NO: 370994 - DNA, 27 bp, Artificial Sequence
  Description of Artificial Sequence: Synthetic oligonucleotide
cgtggacgacacccagttcgtgaggtt

SEQ ID NO: 370995 - DNA, 27 bp, Artificial Sequence
  Description of Artificial Sequence: Synthetic oligonucleotide
gtggacgacacccagttcgtgaggttc

SEQ ID NO: 370996 - DNA, 27 bp, Artificial Sequence
  Description of Artificial Sequence: Synthetic oligonucleotide
tggacgacacccagttcgtgaggttcg

SEQ ID NO: 370997 - DNA, 27 bp, Artificial Sequence
  Description of Artificial Sequence: Synthetic oligonucleotide
ggacgacacccagttcgtgaggttcga

SEQ ID NO: 370998 - DNA, 27 bp, Artificial Sequence
  Description of Artificial Sequence: Synthetic oligonucleotide
gacgacacccagttcgtgaggttcgac

SEQ ID NO: 370999 - DNA, 28 bp, Artificial Sequence
  Description of Artificial Sequence: Synthetic oligonucleotide
acgacacccagttcgtgaggttcgacag

SEQ ID NO: 371000 - DNA, 27 bp, Artificial Sequence
  Description of Artificial Sequence: Synthetic oligonucleotide
cgacacccagttcgtgaggttcgacag

SEQ ID NO: 371001 - DNA, 27 bp, Artificial Sequence
  Description of Artificial Sequence: Synthetic oligonucleotide
gacacccagttcgtgaggttcgacagc

SEQ ID NO: 371002 - DNA, 27 bp, Artificial Sequence
  Description of Artificial Sequence: Synthetic oligonucleotide
acacccagttcgtgaggttcgacagcg

SEQ ID NO: 371003 - DNA, 27 bp, Artificial Sequence
  Description of Artificial Sequence: Synthetic oligonucleotide
cacccagttcgtgaggttcgacagcga

SEQ ID NO: 371004 - DNA, 27 bp, Artificial Sequence
  Description of Artificial Sequence: Synthetic oligonucleotide
acccagttcgtgaggttcgacagcgac

SEQ ID NO: 371005 - DNA, 26 bp, Artificial Sequence
  Description of Artificial Sequence: Synthetic oligonucleotide
cccagttcgtgaggttcgacagcgac

SEQ ID NO: 371006 - DNA, 26 bp, Artificial Sequence
  Description of Artificial Sequence: Synthetic oligonucleotide
ccagttcgtgaggttcgacagcgacg

SEQ ID NO: 371007 - DNA, 24 bp, Artificial Sequence
  Description of Artificial Sequence: Synthetic oligonucleotide
aggttcgacagcgacgccgcgagt

SEQ ID NO: 371008 - DNA, 23 bp, Artificial Sequence
  Description of Artificial Sequence: Synthetic oligonucleotide
gttcgacagcgacgccgcgagtc

SEQ ID NO: 371009 - DNA, 23 bp, Artificial Sequence
  Description of Artificial Sequence: Synthetic oligonucleotide
ttcgacagcgacgccgcgagtcc

SEQ ID NO: 371010 - DNA, 22 bp, Artificial Sequence
  Description of Artificial Sequence: Synthetic oligonucleotide
tcgacagcgacgccgcgagtcc

SEQ ID NO: 371011 - DNA, 21 bp, Artificial Sequence
  Description of Artificial Sequence: Synthetic oligonucleotide
cgacagcgacgccgcgagtcc

SEQ ID NO: 371012 - DNA, 22 bp, Artificial Sequence
  Description of Artificial Sequence: Synthetic oligonucleotide
gacagcgacgccgcgagtccga

SEQ ID NO: 371013 - DNA, 23 bp, Artificial Sequence
  Description of Artificial Sequence: Synthetic oligonucleotide
acagcgacgccgcgagtccgaga

SEQ ID NO: 371014 - DNA, 22 bp, Artificial Sequence
  Description of Artificial Sequence: Synthetic oligonucleotide
cagcgacgccgcgagtccgaga

SEQ ID NO: 371015 - DNA, 23 bp, Artificial Sequence
  Description of Artificial Sequence: Synthetic oligonucleotide
agcgacgccgcgagtccgagaga

SEQ ID NO: 371016 - DNA, 22 bp, Artificial Sequence
  Description of Artificial Sequence: Synthetic oligonucleotide
gcgacgccgcgagtccgagaga

SEQ ID NO: 371017 - DNA, 22 bp, Artificial Sequence
  Description of Artificial Sequence: Synthetic oligonucleotide
cgacgccgcgagtccgagagag

SEQ ID NO: 371018 - DNA, 23 bp, Artificial Sequence
  Description of Artificial Sequence: Synthetic oligonucleotide
gacgccgcgagtccgagagagga

SEQ ID NO: 371019 - DNA, 23 bp, Artificial Sequence
  Description of Artificial Sequence: Synthetic oligonucleotide
acgccgcgagtccgagagaggag

SEQ ID NO: 371020 - DNA, 22 bp, Artificial Sequence
  Description of Artificial Sequence: Synthetic oligonucleotide
cgccgcgagtccgagagaggag

SEQ ID NO: 371021 - DNA, 22 bp, Artificial Sequence
  Description of Artificial Sequence: Synthetic oligonucleotide
gccgcgagtccgagagaggagc

SEQ ID NO: 371022 - DNA, 22 bp, Artificial Sequence
  Description of Artificial Sequence: Synthetic oligonucleotide
ccgcgagtccgagagaggagcc

SEQ ID NO: 371023 - DNA, 22 bp, Artificial Sequence
  Description of Artificial Sequence: Synthetic oligonucleotide
cgcgagtccgagagaggagccg

SEQ ID NO: 371024 - DNA, 22 bp, Artificial Sequence
  Description of Artificial Sequence: Synthetic oligonucleotide
gcgagtccgagagaggagccgc

SEQ ID NO: 371025 - DNA, 22 bp, Artificial Sequence
  Description of Artificial Sequence: Synthetic oligonucleotide
cgagtccgagagaggagccgcg

SEQ ID NO: 371026 - DNA, 22 bp, Artificial Sequence
  Description of Artificial Sequence: Synthetic oligonucleotide
gagtccgagagaggagccgcgg

SEQ ID NO: 371027 - DNA, 22 bp, Artificial Sequence
  Description of Artificial Sequence: Synthetic oligonucleotide
agtccgagagaggagccgcggg

SEQ ID NO: 371028 - DNA, 21 bp, Artificial Sequence
  Description of Artificial Sequence: Synthetic oligonucleotide
gtccgagagaggagccgcggg

SEQ ID NO: 371029 - DNA, 21 bp, Artificial Sequence
  Description of Artificial Sequence: Synthetic oligonucleotide
tccgagagaggagccgcgggc

SEQ ID NO: 371030 - DNA, 20 bp, Artificial Sequence
  Description of Artificial Sequence: Synthetic oligonucleotide
ccgagagaggagccgcgggc

SEQ ID NO: 371031 - DNA, 20 bp, Artificial Sequence
  Description of Artificial Sequence: Synthetic oligonucleotide
cgagagaggagccgcgggcg

SEQ ID NO: 371032 - DNA, 20 bp, Artificial Sequence
  Description of Artificial Sequence: Synthetic oligonucleotide
gagagaggagccgcgggcgc

SEQ ID NO: 371033 - DNA, 20 bp, Artificial Sequence
  Description of Artificial Sequence: Synthetic oligonucleotide
agagaggagccgcgggcgcc

SEQ ID NO: 371034 - DNA, 20 bp, Artificial Sequence
  Description of Artificial Sequence: Synthetic oligonucleotide
gagaggagccgcgggcgcct

SEQ ID NO: 371035 - DNA, 20 bp, Artificial Sequence
  Description of Artificial Sequence: Synthetic oligonucleotide
agaggagccgcgggcgccgt

SEQ ID NO: 371036 - DNA, 20 bp, Artificial Sequence
  Description of Artificial Sequence: Synthetic oligonucleotide
gaggagccgcgggcgccgtt

SEQ ID NO: 371037 - DNA, 20 bp, Artificial Sequence
  Description of Artificial Sequence: Synthetic oligonucleotide
aggagccgcgggcgccgtgt

SEQ ID NO: 371038 - DNA, 27 bp, Artificial Sequence
  Description of Artificial Sequence: Synthetic oligonucleotide
gccggagtattgggaccggaacacaca

SEQ ID NO: 371039 - DNA, 27 bp, Artificial Sequence
  Description of Artificial Sequence: Synthetic oligonucleotide
ccggagtattgggaccggaacacacag

SEQ ID NO: 371040 - DNA, 29 bp, Artificial Sequence
  Description of Artificial Sequence: Synthetic oligonucleotide
cggagtattgggaccggaacacacagatc

SEQ ID NO: 371041 - DNA, 31 bp, Artificial Sequence; identical to SEQ ID NO: 21741
  Description of Artificial Sequence: Synthetic oligonucleotide

SEQ ID NO: 371042 - DNA, 33 bp, Artificial Sequence; identical to SEQ ID NO: 21742
  Description of Artificial Sequence: Synthetic oligonucleotide

SEQ ID NO: 371043 - DNA, 33 bp, Artificial Sequence; identical to SEQ ID NO: 21743
  Description of Artificial Sequence: Synthetic oligonucleotide

SEQ ID NO: 371044 - DNA, 32 bp, Artificial Sequence; identical to SEQ ID NO: 21744
  Description of Artificial Sequence: Synthetic oligonucleotide

SEQ ID NO: 371045 - DNA, 32 bp, Artificial Sequence; identical to SEQ ID NO: 21745
  Description of Artificial Sequence: Synthetic oligonucleotide

SEQ ID NO: 371046 - DNA, 31 bp, Artificial Sequence; identical to SEQ ID NO: 21746
  Description of Artificial Sequence: Synthetic oligonucleotide

SEQ ID NO: 371047 - DNA, 30 bp, Artificial Sequence; identical to SEQ ID NO: 21747
  Description of Artificial Sequence: Synthetic oligonucleotide

SEQ ID NO: 371048 - DNA, 29 bp, Artificial Sequence
  Description of Artificial Sequence: Synthetic oligonucleotide
tgggaccggaacacacagatctacaaggc

SEQ ID NO: 371049 - DNA, 28 bp, Artificial Sequence
  Description of Artificial Sequence: Synthetic oligonucleotide
gggaccggaacacacagatctacaaggc

SEQ ID NO: 371050 - DNA, 28 bp, Artificial Sequence
  Description of Artificial Sequence: Synthetic oligonucleotide
ggaccggaacacacagatctacaaggcc

SEQ ID NO: 371051 - DNA, 28 bp, Artificial Sequence
  Description of Artificial Sequence: Synthetic oligonucleotide
gaccggaacacacagatctacaaggccc

SEQ ID NO: 371052 - DNA, 29 bp, Artificial Sequence
  Description of Artificial Sequence: Synthetic oligonucleotide
accggaacacacagatctacaaggcccag

SEQ ID NO: 371053 - DNA, 28 bp, Artificial Sequence
  Description of Artificial Sequence: Synthetic oligonucleotide
ccggaacacacagatctacaaggcccag

SEQ ID NO: 371054 - DNA, 28 bp, Artificial Sequence
  Description of Artificial Sequence: Synthetic oligonucleotide
cggaacacacagatctacaaggcccagg

SEQ ID NO: 371055 - DNA, 28 bp, Artificial Sequence
  Description of Artificial Sequence: Synthetic oligonucleotide
ggaacacacagatctacaaggcccaggc

SEQ ID NO: 371056 - DNA, 29 bp, Artificial Sequence
  Description of Artificial Sequence: Synthetic oligonucleotide
gaacacacagatctacaaggcccaggcac

SEQ ID NO: 371057 - DNA, 30 bp, Artificial Sequence; identical to SEQ ID NO: 21757
  Description of Artificial Sequence: Synthetic oligonucleotide

SEQ ID NO: 371058 - DNA, 29 bp, Artificial Sequence
  Description of Artificial Sequence: Synthetic oligonucleotide
acacacagatctacaaggcccaggcacag

SEQ ID NO: 371059 - DNA, 28 bp, Artificial Sequence
  Description of Artificial Sequence: Synthetic oligonucleotide
cacacagatctacaaggcccaggcacag

SEQ ID NO: 371060 - DNA, 29 bp, Artificial Sequence
  Description of Artificial Sequence: Synthetic oligonucleotide
acacagatctacaaggcccaggcacagac

SEQ ID NO: 371061 - DNA, 28 bp, Artificial Sequence
  Description of Artificial Sequence: Synthetic oligonucleotide
cacagatctacaaggcccaggcacagac

SEQ ID NO: 371062 - DNA, 29 bp, Artificial Sequence
  Description of Artificial Sequence: Synthetic oligonucleotide
acagatctacaaggcccaggcacagactg

SEQ ID NO: 371063 - DNA, 28 bp, Artificial Sequence
  Description of Artificial Sequence: Synthetic oligonucleotide
cagatctacaaggcccaggcacagactg

SEQ ID NO: 371064 - DNA, 29 bp, Artificial Sequence
  Description of Artificial Sequence: Synthetic oligonucleotide
agatctacaaggcccaggcacagactgac

SEQ ID NO: 371065 - DNA, 28 bp, Artificial Sequence
  Description of Artificial Sequence: Synthetic oligonucleotide
gatctacaaggcccaggcacagactgac

SEQ ID NO: 371066 - DNA, 28 bp, Artificial Sequence
  Description of Artificial Sequence: Synthetic oligonucleotide
atctacaaggcccaggcacagactgacc

SEQ ID NO: 371067 - DNA, 27 bp, Artificial Sequence
  Description of Artificial Sequence: Synthetic oligonucleotide
tctacaaggcccaggcacagactgacc

SEQ ID NO: 371068 - DNA, 26 bp, Artificial Sequence
  Description of Artificial Sequence: Synthetic oligonucleotide
ctacaaggcccaggcacagactgacc

SEQ ID NO: 371069 - DNA, 27 bp, Artificial Sequence
  Description of Artificial Sequence: Synthetic oligonucleotide
tacaaggcccaggcacagactgaccga

SEQ ID NO: 371070 - DNA, 26 bp, Artificial Sequence
  Description of Artificial Sequence: Synthetic oligonucleotide
acaaggcccaggcacagactgaccga

SEQ ID NO: 371071 - DNA, 25 bp, Artificial Sequence
  Description of Artificial Sequence: Synthetic oligonucleotide
caaggcccaggcacagactgaccga

SEQ ID NO: 371072 - DNA, 26 bp, Artificial Sequence
  Description of Artificial Sequence: Synthetic oligonucleotide
aaggcccaggcacagactgaccgaga

SEQ ID NO: 371073 - DNA, 25 bp, Artificial Sequence
  Description of Artificial Sequence: Synthetic oligonucleotide
aggcccaggcacagactgaccgaga

SEQ ID NO: 371074 - DNA, 24 bp, Artificial Sequence
  Description of Artificial Sequence: Synthetic oligonucleotide
ggcccaggcacagactgaccgaga

SEQ ID NO: 371075 - DNA, 25 bp, Artificial Sequence
  Description of Artificial Sequence: Synthetic oligonucleotide
gcccaggcacagactgaccgagaga

SEQ ID NO: 371076 - DNA, 25 bp, Artificial Sequence
  Description of Artificial Sequence: Synthetic oligonucleotide
cccaggcacagactgaccgagagag

SEQ ID NO: 371077 - DNA, 25 bp, Artificial Sequence
  Description of Artificial Sequence: Synthetic oligonucleotide
ccaggcacagactgaccgagagagc

SEQ ID NO: 371078 - DNA, 26 bp, Artificial Sequence
  Description of Artificial Sequence: Synthetic oligonucleotide
caggcacagactgaccgagagagcct

SEQ ID NO: 371079 - DNA, 26 bp, Artificial Sequence
  Description of Artificial Sequence: Synthetic oligonucleotide
aggcacagactgaccgagagagcctg

SEQ ID NO: 371080 - DNA, 25 bp, Artificial Sequence
  Description of Artificial Sequence: Synthetic oligonucleotide
ggcacagactgaccgagagagcctg

SEQ ID NO: 371081 - DNA, 25 bp, Artificial Sequence
  Description of Artificial Sequence: Synthetic oligonucleotide
gcacagactgaccgagagagcctgc

SEQ ID NO: 371082 - DNA, 27 bp, Artificial Sequence
  Description of Artificial Sequence: Synthetic oligonucleotide
acagactgaccgagagagcctgcggaa

SEQ ID NO: 371083 - DNA, 26 bp, Artificial Sequence
  Description of Artificial Sequence: Synthetic oligonucleotide
cagactgaccgagagagcctgcggaa

SEQ ID NO: 371084 - DNA, 26 bp, Artificial Sequence
  Description of Artificial Sequence: Synthetic oligonucleotide
agactgaccgagagagcctgcggaac

SEQ ID NO: 371085 - DNA, 25 bp, Artificial Sequence
  Description of Artificial Sequence: Synthetic oligonucleotide
gactgaccgagagagcctgcggaac

SEQ ID NO: 371086 - DNA, 26 bp, Artificial Sequence
  Description of Artificial Sequence: Synthetic oligonucleotide
actgaccgagagagcctgcggaacct

SEQ ID NO: 371087 - DNA, 25 bp, Artificial Sequence
  Description of Artificial Sequence: Synthetic oligonucleotide
ctgaccgagagagcctgcggaacct

SEQ ID NO: 371088 - DNA, 25 bp, Artificial Sequence
  Description of Artificial Sequence: Synthetic oligonucleotide
tgaccgagagagcctgcggaacctg

SEQ ID NO: 371089 - DNA, 24 bp, Artificial Sequence
  Description of Artificial Sequence: Synthetic oligonucleotide
gaccgagagagcctgcggaacctg

SEQ ID NO: 371090 - DNA, 24 bp, Artificial Sequence
  Description of Artificial Sequence: Synthetic oligonucleotide
accgagagagcctgcggaacctgc

SEQ ID NO: 371091 - DNA, 23 bp, Artificial Sequence
  Description of Artificial Sequence: Synthetic oligonucleotide
ccgagagagcctgcggaacctgc

SEQ ID NO: 371092 - DNA, 23 bp, Artificial Sequence
  Description of Artificial Sequence: Synthetic oligonucleotide
cgagagagcctgcggaacctgcg

SEQ ID NO: 371093 - DNA, 23 bp, Artificial Sequence
  Description of Artificial Sequence: Synthetic oligonucleotide
gagagagcctgcggaacctgcgc

SEQ ID NO: 371094 - DNA, 23 bp, Artificial Sequence
  Description of Artificial Sequence: Synthetic oligonucleotide
agagagcctgcggaacctgcgcg

SEQ ID NO: 371095 - DNA, 22 bp, Artificial Sequence
  Description of Artificial Sequence: Synthetic oligonucleotide
gagagcctgcggaacctgcgcg

SEQ ID NO: 371096 - DNA, 22 bp, Artificial Sequence
  Description of Artificial Sequence: Synthetic oligonucleotide
agagcctgcggaacctgcgcgg

SEQ ID NO: 371097 - DNA, 21 bp, Artificial Sequence
  Description of Artificial Sequence: Synthetic oligonucleotide
gagcctgcggaacctgcgcgg

SEQ ID NO: 371098 - DNA, 23 bp, Artificial Sequence
  Description of Artificial Sequence: Synthetic oligonucleotide
agcctgcggaacctgcgcggcta

SEQ ID NO: 371099 - DNA, 22 bp, Artificial Sequence
  Description of Artificial Sequence: Synthetic oligonucleotide
gcctgcggaacctgcgcggcta

SEQ ID NO: 371100 - DNA, 24 bp, Artificial Sequence
  Description of Artificial Sequence: Synthetic oligonucleotide
cctgcggaacctgcgcggctacta

SEQ ID NO: 371101 - DNA, 26 bp, Artificial Sequence
  Description of Artificial Sequence: Synthetic oligonucleotide
ctgcggaacctgcgcggctactacaa

SEQ ID NO: 371102 - DNA, 26 bp, Artificial Sequence
  Description of Artificial Sequence: Synthetic oligonucleotide
tgcggaacctgcgcggctactacaac

SEQ ID NO: 371103 - DNA, 25 bp, Artificial Sequence
  Description of Artificial Sequence: Synthetic oligonucleotide
gcggaacctgcgcggctactacaac

SEQ ID NO: 371104 - DNA, 26 bp, Artificial Sequence
  Description of Artificial Sequence: Synthetic oligonucleotide
cggaacctgcgcggctactacaacca

SEQ ID NO: 371105 - DNA, 27 bp, Artificial Sequence
  Description of Artificial Sequence: Synthetic oligonucleotide
ggaacctgcgcggctactacaaccaga

SEQ ID NO: 371106 - DNA, 27 bp, Artificial Sequence
  Description of Artificial Sequence: Synthetic oligonucleotide
gaacctgcgcggctactacaaccagag

SEQ ID NO: 371107 - DNA, 27 bp, Artificial Sequence
  Description of Artificial Sequence: Synthetic oligonucleotide
aacctgcgcggctactacaaccagagc

SEQ ID NO: 371108 - DNA, 26 bp, Artificial Sequence
  Description of Artificial Sequence: Synthetic oligonucleotide
acctgcgcggctactacaaccagagc

SEQ ID NO: 371109 - DNA, 23 bp, Artificial Sequence
  Description of Artificial Sequence: Synthetic oligonucleotide
agcgaggccgggtctcacaccct

SEQ ID NO: 371110 - DNA, 22 bp, Artificial Sequence
  Description of Artificial Sequence: Synthetic oligonucleotide
gcgaggccgggtctcacaccct

SEQ ID NO: 371111 - DNA, 22 bp, Artificial Sequence
  Description of Artificial Sequence: Synthetic oligonucleotide
cgaggccgggtctcacaccctc

SEQ ID NO: 371112 - DNA, 23 bp, Artificial Sequence
  Description of Artificial Sequence: Synthetic oligonucleotide
gaggccgggtctcacaccctcca

SEQ ID NO: 371113 - DNA, 24 bp, Artificial Sequence
  Description of Artificial Sequence: Synthetic oligonucleotide
aggccgggtctcacaccctccaga

SEQ ID NO: 371114 - DNA, 23 bp, Artificial Sequence
  Description of Artificial Sequence: Synthetic oligonucleotide
ggccgggtctcacaccctccaga

SEQ ID NO: 371115 - DNA, 23 bp, Artificial Sequence
  Description of Artificial Sequence: Synthetic oligonucleotide
gccgggtctcacaccctccagag

SEQ ID NO: 371116 - DNA, 25 bp, Artificial Sequence
  Description of Artificial Sequence: Synthetic oligonucleotide
ccgggtctcacaccctccagagcat

SEQ ID NO: 371117 - DNA, 27 bp, Artificial Sequence
  Description of Artificial Sequence: Synthetic oligonucleotide
cgggtctcacaccctccagagcatgta

SEQ ID NO: 371118 - DNA, 27 bp, Artificial Sequence
  Description of Artificial Sequence: Synthetic oligonucleotide
gggtctcacaccctccagagcatgtac

SEQ ID NO: 371119 - DNA, 27 bp, Artificial Sequence
  Description of Artificial Sequence: Synthetic oligonucleotide
ggtctcacaccctccagagcatgtacg

SEQ ID NO: 371120 - DNA, 27 bp, Artificial Sequence
  Description of Artificial Sequence: Synthetic oligonucleotide
gtctcacaccctccagagcatgtacgg

SEQ ID NO: 371121 - DNA, 27 bp, Artificial Sequence
  Description of Artificial Sequence: Synthetic oligonucleotide
tctcacaccctccagagcatgtacggc

SEQ ID NO: 371122 - DNA, 27 bp, Artificial Sequence
  Description of Artificial Sequence: Synthetic oligonucleotide
ctcacaccctccagagcatgtacggct

SEQ ID NO: 371123 - DNA, 27 bp, Artificial Sequence
  Description of Artificial Sequence: Synthetic oligonucleotide
tcacaccctccagagcatgtacggctg

SEQ ID NO: 371124 - DNA, 26 bp, Artificial Sequence
  Description of Artificial Sequence: Synthetic oligonucleotide
cacaccctccagagcatgtacggctg

SEQ ID NO: 371125 - DNA, 26 bp, Artificial Sequence
  Description of Artificial Sequence: Synthetic oligonucleotide
acaccctccagagcatgtacggctgc

SEQ ID NO: 371126 - DNA, 25 bp, Artificial Sequence
  Description of Artificial Sequence: Synthetic oligonucleotide
caccctccagagcatgtacggctgc

SEQ ID NO: 371127 - DNA, 26 bp, Artificial Sequence
  Description of Artificial Sequence: Synthetic oligonucleotide
accctccagagcatgtacggctgcga

SEQ ID NO: 371128 - DNA, 25 bp, Artificial Sequence
  Description of Artificial Sequence: Synthetic oligonucleotide
ccctccagagcatgtacggctgcga

SEQ ID NO: 371129 - DNA, 25 bp, Artificial Sequence
  Description of Artificial Sequence: Synthetic oligonucleotide
cctccagagcatgtacggctgcgac

SEQ ID NO: 371130 - DNA, 26 bp, Artificial Sequence
  Description of Artificial Sequence: Synthetic oligonucleotide
ctccagagcatgtacggctgcgacgt

SEQ ID NO: 371131 - DNA, 26 bp, Artificial Sequence
  Description of Artificial Sequence: Synthetic oligonucleotide
tccagagcatgtacggctgcgacgtg

SEQ ID NO: 371132 - DNA, 25 bp, Artificial Sequence
  Description of Artificial Sequence: Synthetic oligonucleotide
ccagagcatgtacggctgcgacgtg

SEQ ID NO: 371133 - DNA, 25 bp, Artificial Sequence
  Description of Artificial Sequence: Synthetic oligonucleotide
cagagcatgtacggctgcgacgtgg

SEQ ID NO: 371134 - DNA, 25 bp, Artificial Sequence
  Description of Artificial Sequence: Synthetic oligonucleotide
agagcatgtacggctgcgacgtggg

SEQ ID NO: 371135 - DNA, 24 bp, Artificial Sequence
  Description of Artificial Sequence: Synthetic oligonucleotide
gagcatgtacggctgcgacgtggg

SEQ ID NO: 371136 - DNA, 24 bp, Artificial Sequence
  Description of Artificial Sequence: Synthetic oligonucleotide
agcatgtacggctgcgacgtgggg

SEQ ID NO: 371137 - DNA, 23 bp, Artificial Sequence
  Description of Artificial Sequence: Synthetic oligonucleotide
gcatgtacggctgcgacgtgggg

SEQ ID NO: 371138 - DNA, 23 bp, Artificial Sequence
  Description of Artificial Sequence: Synthetic oligonucleotide
catgtacggctgcgacgtggggc

SEQ ID NO: 371139 - DNA, 20 bp, Artificial Sequence
  Description of Artificial Sequence: Synthetic oligonucleotide
gggcgcctcctccgcgggtt

SEQ ID NO: 371140 - DNA, 20 bp, Artificial Sequence
  Description of Artificial Sequence: Synthetic oligonucleotide
ggcgcctcctccgcgggcat

SEQ ID NO: 371141 - DNA, 21 bp, Artificial Sequence
  Description of Artificial Sequence: Synthetic oligonucleotide
gcgcctcctccgcgggcatga

SEQ ID NO: 371142 - DNA, 21 bp, Artificial Sequence
  Description of Artificial Sequence: Synthetic oligonucleotide
cgcctcctccgcgggcatgac

SEQ ID NO: 371143 - DNA, 22 bp, Artificial Sequence
  Description of Artificial Sequence: Synthetic oligonucleotide
gcctcctccgcgggcatgacca

SEQ ID NO: 371144 - DNA, 24 bp, Artificial Sequence
  Description of Artificial Sequence: Synthetic oligonucleotide
cctcctccgcgggcatgaccagta

SEQ ID NO: 371145 - DNA, 24 bp, Artificial Sequence
  Description of Artificial Sequence: Synthetic oligonucleotide
ctcctccgcgggcatgaccagtac

SEQ ID NO: 371146 - DNA, 24 bp, Artificial Sequence
  Description of Artificial Sequence: Synthetic oligonucleotide
tcctccgcgggcatgaccagtacg

SEQ ID NO: 371147 - DNA, 23 bp, Artificial Sequence
  Description of Artificial Sequence: Synthetic oligonucleotide
cctccgcgggcatgaccagtacg

SEQ ID NO: 371148 - DNA, 23 bp, Artificial Sequence
  Description of Artificial Sequence: Synthetic oligonucleotide
ctccgcgggcatgaccagtacgc

SEQ ID NO: 371149 - DNA, 25 bp, Artificial Sequence
  Description of Artificial Sequence: Synthetic oligonucleotide
tccgcgggcatgaccagtacgccta

SEQ ID NO: 371150 - DNA, 24 bp, Artificial Sequence
  Description of Artificial Sequence: Synthetic oligonucleotide
ccgcgggcatgaccagtacgccta

SEQ ID NO: 371151 - DNA, 24 bp, Artificial Sequence
  Description of Artificial Sequence: Synthetic oligonucleotide
cgcgggcatgaccagtacgcctac

SEQ ID NO: 371152 - DNA, 25 bp, Artificial Sequence
  Description of Artificial Sequence: Synthetic oligonucleotide
gcgggcatgaccagtacgcctacga

SEQ ID NO: 371153 - DNA, 25 bp, Artificial Sequence
  Description of Artificial Sequence: Synthetic oligonucleotide
cgggcatgaccagtacgcctacgac

SEQ ID NO: 371154 - DNA, 25 bp, Artificial Sequence
  Description of Artificial Sequence: Synthetic oligonucleotide
gggcatgaccagtacgcctacgacg

SEQ ID NO: 371155 - DNA, 25 bp, Artificial Sequence
  Description of Artificial Sequence: Synthetic oligonucleotide
ggcatgaccagtacgcctacgacgg

SEQ ID NO: 371156 - DNA, 27 bp, Artificial Sequence
  Description of Artificial Sequence: Synthetic oligonucleotide
gcatgaccagtacgcctacgacggcaa

SEQ ID NO: 371157 - DNA, 27 bp, Artificial Sequence
  Description of Artificial Sequence: Synthetic oligonucleotide
catgaccagtacgcctacgacggcaag

SEQ ID NO: 371158 - DNA, 27 bp, Artificial Sequence
  Description of Artificial Sequence: Synthetic oligonucleotide
atgaccagtacgcctacgacggcaagg

SEQ ID NO: 371159 - DNA, 27 bp, Artificial Sequence
  Description of Artificial Sequence: Synthetic oligonucleotide
tgaccagtacgcctacgacggcaagga

SEQ ID NO: 371160 - DNA, 27 bp, Artificial Sequence
  Description of Artificial Sequence: Synthetic oligonucleotide
gaccagtacgcctacgacggcaaggat

SEQ ID NO: 371161 - DNA, 21 bp, Artificial Sequence
  Description of Artificial Sequence: Synthetic oligonucleotide
gacctgcgctcctggaccgcc

SEQ ID NO: 371162 - DNA, 21 bp, Artificial Sequence
  Description of Artificial Sequence: Synthetic oligonucleotide
acctgcgctcctggaccgccg

SEQ ID NO: 371163 - DNA, 20 bp, Artificial Sequence
  Description of Artificial Sequence: Synthetic oligonucleotide
cctgcgctcctggaccgccg

SEQ ID NO: 371164 - DNA, 20 bp, Artificial Sequence
  Description of Artificial Sequence: Synthetic oligonucleotide
ctgcgctcctggaccgccgc

SEQ ID NO: 371165 - DNA, 20 bp, Artificial Sequence
  Description of Artificial Sequence: Synthetic oligonucleotide
tgcgctcctggaccgccgcg

SEQ ID NO: 371166 - DNA, 20 bp, Artificial Sequence
  Description of Artificial Sequence: Synthetic oligonucleotide
gcgctcctggaccgccgcgt

SEQ ID NO: 371167 - DNA, 20 bp, Artificial Sequence
  Description of Artificial Sequence: Synthetic oligonucleotide
cgctcctggaccgccgcgga

SEQ ID NO: 371168 - DNA, 21 bp, Artificial Sequence
  Description of Artificial Sequence: Synthetic oligonucleotide
gctcctggaccgccgcggaca

SEQ ID NO: 371169 - DNA, 21 bp, Artificial Sequence
  Description of Artificial Sequence: Synthetic oligonucleotide
ctcctggaccgccgcggacac

SEQ ID NO: 371170 - DNA, 21 bp, Artificial Sequence
  Description of Artificial Sequence: Synthetic oligonucleotide
tcctggaccgccgcggacacg

SEQ ID NO: 371171 - DNA, 20 bp, Artificial Sequence
  Description of Artificial Sequence: Synthetic oligonucleotide
cctggaccgccgcggacacg

SEQ ID NO: 371172 - DNA, 20 bp, Artificial Sequence
  Description of Artificial Sequence: Synthetic oligonucleotide
ctggaccgccgcggacacgg

SEQ ID NO: 371173 - DNA, 20 bp, Artificial Sequence
  Description of Artificial Sequence: Synthetic oligonucleotide
tggaccgccgcggacacggc

SEQ ID NO: 371174 - DNA, 20 bp, Artificial Sequence
  Description of Artificial Sequence: Synthetic oligonucleotide
ggaccgccgcggacacggct

SEQ ID NO: 371175 - DNA, 20 bp, Artificial Sequence
  Description of Artificial Sequence: Synthetic oligonucleotide
gaccgccgcggacacggcgt

SEQ ID NO: 371176 - DNA, 20 bp, Artificial Sequence
  Description of Artificial Sequence: Synthetic oligonucleotide
accgccgcggacacggcggt

SEQ ID NO: 371177 - DNA, 20 bp, Artificial Sequence
  Description of Artificial Sequence: Synthetic oligonucleotide
ccgccgcggacacggcggtt

SEQ ID NO: 371178 - DNA, 20 bp, Artificial Sequence
  Description of Artificial Sequence: Synthetic oligonucleotide
cgccgcggacacggcggctt

SEQ ID NO: 371179 - DNA, 20 bp, Artificial Sequence
  Description of Artificial Sequence: Synthetic oligonucleotide
gccgcggacacggcggctca

SEQ ID NO: 371180 - DNA, 22 bp, Artificial Sequence
  Description of Artificial Sequence: Synthetic oligonucleotide
ccgcggacacggcggctcagat

SEQ ID NO: 371181 - DNA, 23 bp, Artificial Sequence
  Description of Artificial Sequence: Synthetic oligonucleotide
cgcggacacggcggctcagatca

SEQ ID NO: 371182 - DNA, 23 bp, Artificial Sequence
  Description of Artificial Sequence: Synthetic oligonucleotide
gcggacacggcggctcagatcac

SEQ ID NO: 371183 - DNA, 23 bp, Artificial Sequence
  Description of Artificial Sequence: Synthetic oligonucleotide
cggacacggcggctcagatcacc

SEQ ID NO: 371184 - DNA, 24 bp, Artificial Sequence
  Description of Artificial Sequence: Synthetic oligonucleotide
ggacacggcggctcagatcaccca

SEQ ID NO: 371185 - DNA, 24 bp, Artificial Sequence
  Description of Artificial Sequence: Synthetic oligonucleotide
gacacggcggctcagatcacccag

SEQ ID NO: 371186 - DNA, 24 bp, Artificial Sequence
  Description of Artificial Sequence: Synthetic oligonucleotide
acacggcggctcagatcacccagc

SEQ ID NO: 371187 - DNA, 23 bp, Artificial Sequence
  Description of Artificial Sequence: Synthetic oligonucleotide
cacggcggctcagatcacccagc

SEQ ID NO: 371188 - DNA, 23 bp, Artificial Sequence
  Description of Artificial Sequence: Synthetic oligonucleotide
acggcggctcagatcacccagcg

SEQ ID NO: 371189 - DNA, 22 bp, Artificial Sequence
  Description of Artificial Sequence: Synthetic oligonucleotide
cggcggctcagatcacccagcg

SEQ ID NO: 371190 - DNA, 20 bp, Artificial Sequence
  Description of Artificial Sequence: Synthetic oligonucleotide
ggcccgtgaggcggagcagc

SEQ ID NO: 371191 - DNA, 20 bp, Artificial Sequence
  Description of Artificial Sequence: Synthetic oligonucleotide
gcccgtgaggcggagcagcg

SEQ ID NO: 371192 - DNA, 21 bp, Artificial Sequence
  Description of Artificial Sequence: Synthetic oligonucleotide
cccgtgaggcggagcagcgga

SEQ ID NO: 371193 - DNA, 22 bp, Artificial Sequence
  Description of Artificial Sequence: Synthetic oligonucleotide
ccgtgaggcggagcagcggaga

SEQ ID NO: 371194 - DNA, 22 bp, Artificial Sequence
  Description of Artificial Sequence: Synthetic oligonucleotide
cgtgaggcggagcagcggagag

SEQ ID NO: 371195 - DNA, 22 bp, Artificial Sequence
  Description of Artificial Sequence: Synthetic oligonucleotide
gtgaggcggagcagcggagagc

SEQ ID NO: 371196 - DNA, 24 bp, Artificial Sequence
  Description of Artificial Sequence: Synthetic oligonucleotide
tgaggcggagcagcggagagccta

SEQ ID NO: 371197 - DNA, 23 bp, Artificial Sequence
  Description of Artificial Sequence: Synthetic oligonucleotide
gaggcggagcagcggagagccta

SEQ ID NO: 371198 - DNA, 23 bp, Artificial Sequence
  Description of Artificial Sequence: Synthetic oligonucleotide
aggcggagcagcggagagcctac

SEQ ID NO: 371199 - DNA, 23 bp, Artificial Sequence
  Description of Artificial Sequence: Synthetic oligonucleotide
agcggagagcctacctggagggc

SEQ ID NO: 371200 - DNA, 22 bp, Artificial Sequence
  Description of Artificial Sequence: Synthetic oligonucleotide
gcggagagcctacctggagggc

SEQ ID NO: 371201 - DNA, 23 bp, Artificial Sequence
  Description of Artificial Sequence: Synthetic oligonucleotide
cggagagcctacctggagggcga

SEQ ID NO: 371202 - DNA, 27 bp, Artificial Sequence
  Description of Artificial Sequence: Synthetic oligonucleotide
cgcagatacctggagaacgggaaggac

SEQ ID NO: 371203 - DNA, 29 bp, Artificial Sequence
  Description of Artificial Sequence: Synthetic oligonucleotide
gcagatacctggagaacgggaaggacaag

SEQ ID NO: 371204 - DNA, 29 bp, Artificial Sequence
  Description of Artificial Sequence: Synthetic oligonucleotide
cagatacctggagaacgggaaggacaagc

SEQ ID NO: 371205 - DNA, 30 bp, Artificial Sequence; identical to SEQ ID NO: 21880
  Description of Artificial Sequence: Synthetic oligonucleotide

SEQ ID NO: 371206 - DNA, 29 bp, Artificial Sequence
  Description of Artificial Sequence: Synthetic oligonucleotide
gatacctggagaacgggaaggacaagctg

SEQ ID NO: 371207 - DNA, 29 bp, Artificial Sequence
  Description of Artificial Sequence: Synthetic oligonucleotide
atacctggagaacgggaaggacaagctgg

SEQ ID NO: 371208 - DNA, 28 bp, Artificial Sequence
  Description of Artificial Sequence: Synthetic oligonucleotide
tacctggagaacgggaaggacaagctgg

SEQ ID NO: 371209 - DNA, 27 bp, Artificial Sequence
  Description of Artificial Sequence: Synthetic oligonucleotide
acctggagaacgggaaggacaagctgg

SEQ ID NO: 371210 - DNA, 27 bp, Artificial Sequence
  Description of Artificial Sequence: Synthetic oligonucleotide
cctggagaacgggaaggacaagctgga

SEQ ID NO: 371211 - DNA, 27 bp, Artificial Sequence
  Description of Artificial Sequence: Synthetic oligonucleotide
ctggagaacgggaaggacaagctggag

SEQ ID NO: 371212 - DNA, 27 bp, Artificial Sequence
  Description of Artificial Sequence: Synthetic oligonucleotide
tggagaacgggaaggacaagctggagc

SEQ ID NO: 371213 - DNA, 26 bp, Artificial Sequence
  Description of Artificial Sequence: Synthetic oligonucleotide
ggagaacgggaaggacaagctggagc

SEQ ID NO: 371214 - DNA, 26 bp, Artificial Sequence
  Description of Artificial Sequence: Synthetic oligonucleotide
gagaacgggaaggacaagctggagcg

SEQ ID NO: 371215 - DNA, 26 bp, Artificial Sequence
  Description of Artificial Sequence: Synthetic oligonucleotide
agaacgggaaggacaagctggagcgc

SEQ ID NO: 371216 - DNA, 25 bp, Artificial Sequence
  Description of Artificial Sequence: Synthetic oligonucleotide
gaacgggaaggacaagctggagcgc

SEQ ID NO: 371217 - DNA, 25 bp, Artificial Sequence
  Description of Artificial Sequence: Synthetic oligonucleotide
aacgggaaggacaagctggagcgcg

SEQ ID NO: 371218 - DNA, 24 bp, Artificial Sequence
  Description of Artificial Sequence: Synthetic oligonucleotide
acgggaaggacaagctggagcgcg

SEQ ID NO: 371219 - DNA, 23 bp, Artificial Sequence
  Description of Artificial Sequence: Synthetic oligonucleotide
cgggaaggacaagctggagcgcg

SEQ ID NO: 371220 - DNA, 24 bp, Artificial Sequence
  Description of Artificial Sequence: Synthetic oligonucleotide
gggaaggacaagctggagcgcgct

SEQ ID NO: 371221 - DNA, 25 bp, Artificial Sequence
  Description of Artificial Sequence: Synthetic oligonucleotide
ggaaggacaagctggagcgcgctga

SEQ ID NO: 371222 - DNA, 25 bp, Artificial Sequence
  Description of Artificial Sequence: Synthetic oligonucleotide
gaaggacaagctggagcgcgctgac

SEQ ID NO: 371223 - DNA, 25 bp, Artificial Sequence
  Description of Artificial Sequence: Synthetic oligonucleotide
aaggacaagctggagcgcgctgacc

SEQ ID NO: 371224 - DNA, 24 bp, Artificial Sequence
  Description of Artificial Sequence: Synthetic oligonucleotide
aggacaagctggagcgcgctgacc

SEQ ID NO: 371225 - DNA, 23 bp, Artificial Sequence
  Description of Artificial Sequence: Synthetic oligonucleotide
ggacaagctggagcgcgctgacc

SEQ ID NO: 371226 - DNA, 23 bp, Artificial Sequence
  Description of Artificial Sequence: Synthetic oligonucleotide
gacaagctggagcgcgctgaccc

SEQ ID NO: 371227 - DNA, 23 bp, Artificial Sequence
  Description of Artificial Sequence: Synthetic oligonucleotide
acaagctggagcgcgctgacccc

SEQ ID NO: 371228 - DNA, 22 bp, Artificial Sequence
  Description of Artificial Sequence: Synthetic oligonucleotide
caagctggagcgcgctgacccc

SEQ ID NO: 371229 - DNA, 22 bp, Artificial Sequence
  Description of Artificial Sequence: Synthetic oligonucleotide
aagctggagcgcgctgaccccc

SEQ ID NO: 371230 - DNA, 21 bp, Artificial Sequence
  Description of Artificial Sequence: Synthetic oligonucleotide
agctggagcgcgctgaccccc

SEQ ID NO: 371231 - DNA, 20 bp, Artificial Sequence
  Description of Artificial Sequence: Synthetic oligonucleotide
gctggagcgcgctgaccccc

SEQ ID NO: 371232 - DNA, 23 bp, Artificial Sequence
  Description of Artificial Sequence: Synthetic oligonucleotide
ctggagcgcgctgaccccccaaa

SEQ ID NO: 371233 - DNA, 24 bp, Artificial Sequence
  Description of Artificial Sequence: Synthetic oligonucleotide
tggagcgcgctgaccccccaaaga

SEQ ID NO: 371234 - DNA, 23 bp, Artificial Sequence
  Description of Artificial Sequence: Synthetic oligonucleotide
ggagcgcgctgaccccccaaaga

SEQ ID NO: 371235 - DNA, 24 bp, Artificial Sequence
  Description of Artificial Sequence: Synthetic oligonucleotide
gagcgcgctgaccccccaaagaca

SEQ ID NO: 371236 - DNA, 25 bp, Artificial Sequence
  Description of Artificial Sequence: Synthetic oligonucleotide
agcgcgctgaccccccaaagacaca

SEQ ID NO: 371237 - DNA, 24 bp, Artificial Sequence
  Description of Artificial Sequence: Synthetic oligonucleotide
gcgcgctgaccccccaaagacaca

SEQ ID NO: 371238 - DNA, 24 bp, Artificial Sequence
  Description of Artificial Sequence: Synthetic oligonucleotide
cgcgctgaccccccaaagacacac

SEQ ID NO: 371239 - DNA, 25 bp, Artificial Sequence
  Description of Artificial Sequence: Synthetic oligonucleotide
gcgctgaccccccaaagacacacgt

SEQ ID NO: 371240 - DNA, 26 bp, Artificial Sequence
  Description of Artificial Sequence: Synthetic oligonucleotide
cgctgaccccccaaagacacacgtga

SEQ ID NO: 371241 - DNA, 26 bp, Artificial Sequence
  Description of Artificial Sequence: Synthetic oligonucleotide
gctgaccccccaaagacacacgtgac

SEQ ID NO: 371242 - DNA, 26 bp, Artificial Sequence
  Description of Artificial Sequence: Synthetic oligonucleotide
ctgaccccccaaagacacacgtgacc

SEQ ID NO: 371243 - DNA, 27 bp, Artificial Sequence
  Description of Artificial Sequence: Synthetic oligonucleotide
tgaccccccaaagacacacgtgaccca

SEQ ID NO: 371244 - DNA, 26 bp, Artificial Sequence
  Description of Artificial Sequence: Synthetic oligonucleotide
gaccccccaaagacacacgtgaccca

SEQ ID NO: 371245 - DNA, 26 bp, Artificial Sequence
  Description of Artificial Sequence: Synthetic oligonucleotide
accccccaaagacacacgtgacccac

SEQ ID NO: 371246 - DNA, 25 bp, Artificial Sequence
  Description of Artificial Sequence: Synthetic oligonucleotide
ccccccaaagacacacgtgacccac

SEQ ID NO: 371247 - DNA, 26 bp, Artificial Sequence
  Description of Artificial Sequence: Synthetic oligonucleotide
cccccaaagacacacgtgacccacca

SEQ ID NO: 371248 - DNA, 26 bp, Artificial Sequence
  Description of Artificial Sequence: Synthetic oligonucleotide
ccccaaagacacacgtgacccaccac

SEQ ID NO: 371249 - DNA, 26 bp, Artificial Sequence
  Description of Artificial Sequence: Synthetic oligonucleotide
cccaaagacacacgtgacccaccacc

SEQ ID NO: 371250 - DNA, 26 bp, Artificial Sequence
  Description of Artificial Sequence: Synthetic oligonucleotide
ccaaagacacacgtgacccaccaccc

SEQ ID NO: 371251 - DNA, 27 bp, Artificial Sequence
  Description of Artificial Sequence: Synthetic oligonucleotide
caaagacacacgtgacccaccacccca

SEQ ID NO: 371252 - DNA, 28 bp, Artificial Sequence
  Description of Artificial Sequence: Synthetic oligonucleotide
aaagacacacgtgacccaccaccccatc

SEQ ID NO: 371253 - DNA, 27 bp, Artificial Sequence
  Description of Artificial Sequence: Synthetic oligonucleotide
aagacacacgtgacccaccaccccatc

SEQ ID NO: 371254 - DNA, 27 bp, Artificial Sequence
  Description of Artificial Sequence: Synthetic oligonucleotide
agacacacgtgacccaccaccccatct

SEQ ID NO: 371255 - DNA, 26 bp, Artificial Sequence
  Description of Artificial Sequence: Synthetic oligonucleotide
gacacacgtgacccaccaccccatct

SEQ ID NO: 371256 - DNA, 27 bp, Artificial Sequence
  Description of Artificial Sequence: Synthetic oligonucleotide
acacacgtgacccaccaccccatctct

SEQ ID NO: 371257 - DNA, 26 bp, Artificial Sequence
  Description of Artificial Sequence: Synthetic oligonucleotide
cacacgtgacccaccaccccatctct

SEQ ID NO: 371258 - DNA, 27 bp, Artificial Sequence
  Description of Artificial Sequence: Synthetic oligonucleotide
acacgtgacccaccaccccatctctga

SEQ ID NO: 371259 - DNA, 26 bp, Artificial Sequence
  Description of Artificial Sequence: Synthetic oligonucleotide
cacgtgacccaccaccccatctctga

SEQ ID NO: 371260 - DNA, 26 bp, Artificial Sequence
  Description of Artificial Sequence: Synthetic oligonucleotide
acgtgacccaccaccccatctctgac

SEQ ID NO: 371261 - DNA, 25 bp, Artificial Sequence
  Description of Artificial Sequence: Synthetic oligonucleotide
cgtgacccaccaccccatctctgac

SEQ ID NO: 371262 - DNA, 27 bp, Artificial Sequence
  Description of Artificial Sequence: Synthetic oligonucleotide
gtgacccaccaccccatctctgaccat

SEQ ID NO: 371263 - DNA, 24 bp, Artificial Sequence
  Description of Artificial Sequence: Synthetic oligonucleotide
cctgaggtgctgggccctgggttt

SEQ ID NO: 371264 - DNA, 26 bp, Artificial Sequence
  Description of Artificial Sequence: Synthetic oligonucleotide
ctgaggtgctgggccctgggtttcta

SEQ ID NO: 371265 - DNA, 26 bp, Artificial Sequence
  Description of Artificial Sequence: Synthetic oligonucleotide
tgaggtgctgggccctgggtttctac

SEQ ID NO: 371266 - DNA, 25 bp, Artificial Sequence
  Description of Artificial Sequence: Synthetic oligonucleotide
gaggtgctgggccctgggtttctac

SEQ ID NO: 371267 - DNA, 25 bp, Artificial Sequence
  Description of Artificial Sequence: Synthetic oligonucleotide
aggtgctgggccctgggtttctacc

SEQ ID NO: 371268 - DNA, 24 bp, Artificial Sequence
  Description of Artificial Sequence: Synthetic oligonucleotide
ggtgctgggccctgggtttctacc

SEQ ID NO: 371269 - DNA, 25 bp, Artificial Sequence
  Description of Artificial Sequence: Synthetic oligonucleotide
gtgctgggccctgggtttctaccct

SEQ ID NO: 371270 - DNA, 25 bp, Artificial Sequence
  Description of Artificial Sequence: Synthetic oligonucleotide
tgctgggccctgggtttctaccctg

SEQ ID NO: 371271 - DNA, 24 bp, Artificial Sequence
  Description of Artificial Sequence: Synthetic oligonucleotide
gctgggccctgggtttctaccctg

SEQ ID NO: 371272 - DNA, 24 bp, Artificial Sequence
  Description of Artificial Sequence: Synthetic oligonucleotide
ctgggccctgggtttctaccctgc

SEQ ID NO: 371273 - DNA, 24 bp, Artificial Sequence
  Description of Artificial Sequence: Synthetic oligonucleotide
tgggccctgggtttctaccctgcg

SEQ ID NO: 371274 - DNA, 23 bp, Artificial Sequence
  Description of Artificial Sequence: Synthetic oligonucleotide
gggccctgggtttctaccctgcg

SEQ ID NO: 371275 - DNA, 24 bp, Artificial Sequence
  Description of Artificial Sequence: Synthetic oligonucleotide
ggccctgggtttctaccctgcgga

SEQ ID NO: 371276 - DNA, 26 bp, Artificial Sequence
  Description of Artificial Sequence: Synthetic oligonucleotide
gccctgggtttctaccctgcggagat

SEQ ID NO: 371277 - DNA, 27 bp, Artificial Sequence
  Description of Artificial Sequence: Synthetic oligonucleotide
ccctgggtttctaccctgcggagatca

SEQ ID NO: 371278 - DNA, 27 bp, Artificial Sequence
  Description of Artificial Sequence: Synthetic oligonucleotide
cctgggtttctaccctgcggagatcac

SEQ ID NO: 371279 - DNA, 28 bp, Artificial Sequence
  Description of Artificial Sequence: Synthetic oligonucleotide
ctgggtttctaccctgcggagatcacac

SEQ ID NO: 371280 - DNA, 29 bp, Artificial Sequence
  Description of Artificial Sequence: Synthetic oligonucleotide
tgggtttctaccctgcggagatcacactg

SEQ ID NO: 371281 - DNA, 28 bp, Artificial Sequence
  Description of Artificial Sequence: Synthetic oligonucleotide
gggtttctaccctgcggagatcacactg

SEQ ID NO: 371282 - DNA, 29 bp, Artificial Sequence
  Description of Artificial Sequence: Synthetic oligonucleotide
ggtttctaccctgcggagatcacactgac

SEQ ID NO: 371283 - DNA, 29 bp, Artificial Sequence
  Description of Artificial Sequence: Synthetic oligonucleotide
gtttctaccctgcggagatcacactgacc

SEQ ID NO: 371284 - DNA, 30 bp, Artificial Sequence; identical to SEQ ID NO: 21959
  Description of Artificial Sequence: Synthetic oligonucleotide

SEQ ID NO: 371285 - DNA, 24 bp, Artificial Sequence
  Description of Artificial Sequence: Synthetic oligonucleotide
acactgacctggcagcgggatggc

SEQ ID NO: 371286 - DNA, 23 bp, Artificial Sequence
  Description of Artificial Sequence: Synthetic oligonucleotide
cactgacctggcagcgggatggc

SEQ ID NO: 371287 - DNA, 24 bp, Artificial Sequence
  Description of Artificial Sequence: Synthetic oligonucleotide
actgacctggcagcgggatggcga

SEQ ID NO: 371288 - DNA, 23 bp, Artificial Sequence
  Description of Artificial Sequence: Synthetic oligonucleotide
ctgacctggcagcgggatggcga

SEQ ID NO: 371289 - DNA, 23 bp, Artificial Sequence
  Description of Artificial Sequence: Synthetic oligonucleotide
tgacctggcagcgggatggcgag

SEQ ID NO: 371290 - DNA, 22 bp, Artificial Sequence
  Description of Artificial Sequence: Synthetic oligonucleotide
gacctggcagcgggatggcgag

SEQ ID NO: 371291 - DNA, 23 bp, Artificial Sequence
  Description of Artificial Sequence: Synthetic oligonucleotide
acctggcagcgggatggcgagga

SEQ ID NO: 371292 - DNA, 22 bp, Artificial Sequence
  Description of Artificial Sequence: Synthetic oligonucleotide
cctggcagcgggatggcgagga

SEQ ID NO: 371293 - DNA, 22 bp, Artificial Sequence
  Description of Artificial Sequence: Synthetic oligonucleotide
ctggcagcgggatggcgaggac

SEQ ID NO: 371294 - DNA, 25 bp, Artificial Sequence
  Description of Artificial Sequence: Synthetic oligonucleotide
tggcagcgggatggcgaggaccaaa

SEQ ID NO: 371295 - DNA, 24 bp, Artificial Sequence
  Description of Artificial Sequence: Synthetic oligonucleotide
ggcagcgggatggcgaggaccaaa

SEQ ID NO: 371296 - DNA, 25 bp, Artificial Sequence
  Description of Artificial Sequence: Synthetic oligonucleotide
gcagcgggatggcgaggaccaaact

SEQ ID NO: 371297 - DNA, 26 bp, Artificial Sequence
  Description of Artificial Sequence: Synthetic oligonucleotide
cagcgggatggcgaggaccaaactca

SEQ ID NO: 371298 - DNA, 26 bp, Artificial Sequence
  Description of Artificial Sequence: Synthetic oligonucleotide
agcgggatggcgaggaccaaactcag

SEQ ID NO: 371299 - DNA, 25 bp, Artificial Sequence
  Description of Artificial Sequence: Synthetic oligonucleotide
gcgggatggcgaggaccaaactcag

SEQ ID NO: 371300 - DNA, 26 bp, Artificial Sequence
  Description of Artificial Sequence: Synthetic oligonucleotide
cgggatggcgaggaccaaactcagga

SEQ ID NO: 371301 - DNA, 27 bp, Artificial Sequence
  Description of Artificial Sequence: Synthetic oligonucleotide
gggatggcgaggaccaaactcaggaca

SEQ ID NO: 371302 - DNA, 27 bp, Artificial Sequence
  Description of Artificial Sequence: Synthetic oligonucleotide
ggatggcgaggaccaaactcaggacac

SEQ ID NO: 371303 - DNA, 28 bp, Artificial Sequence
  Description of Artificial Sequence: Synthetic oligonucleotide
gatggcgaggaccaaactcaggacactg

SEQ ID NO: 371304 - DNA, 29 bp, Artificial Sequence
  Description of Artificial Sequence: Synthetic oligonucleotide
atggcgaggaccaaactcaggacactgag

SEQ ID NO: 371305 - DNA, 28 bp, Artificial Sequence
  Description of Artificial Sequence: Synthetic oligonucleotide
tggcgaggaccaaactcaggacactgag

SEQ ID NO: 371306 - DNA, 27 bp, Artificial Sequence
  Description of Artificial Sequence: Synthetic oligonucleotide
ggcgaggaccaaactcaggacactgag

SEQ ID NO: 371307 - DNA, 27 bp, Artificial Sequence
  Description of Artificial Sequence: Synthetic oligonucleotide
gcgaggaccaaactcaggacactgagc

SEQ ID NO: 371308 - DNA, 29 bp, Artificial Sequence
  Description of Artificial Sequence: Synthetic oligonucleotide
cgaggaccaaactcaggacactgagcttg

SEQ ID NO: 371309 - DNA, 30 bp, Artificial Sequence; identical to SEQ ID NO: 21984
  Description of Artificial Sequence: Synthetic oligonucleotide

SEQ ID NO: 371310 - DNA, 30 bp, Artificial Sequence; identical to SEQ ID NO: 21985
  Description of Artificial Sequence: Synthetic oligonucleotide

SEQ ID NO: 371311 - DNA, 29 bp, Artificial Sequence
  Description of Artificial Sequence: Synthetic oligonucleotide
ggaccaaactcaggacactgagcttgtgg

SEQ ID NO: 371312 - DNA, 30 bp, Artificial Sequence; identical to SEQ ID NO: 21987
  Description of Artificial Sequence: Synthetic oligonucleotide

SEQ ID NO: 371313 - DNA, 31 bp, Artificial Sequence; identical to SEQ ID NO: 21988
  Description of Artificial Sequence: Synthetic oligonucleotide

SEQ ID NO: 371314 - DNA, 30 bp, Artificial Sequence; identical to SEQ ID NO: 21989
  Description of Artificial Sequence: Synthetic oligonucleotide

SEQ ID NO: 371315 - DNA, 30 bp, Artificial Sequence; identical to SEQ ID NO: 21990
  Description of Artificial Sequence: Synthetic oligonucleotide

SEQ ID NO: 371316 - DNA, 31 bp, Artificial Sequence; identical to SEQ ID NO: 21991
  Description of Artificial Sequence: Synthetic oligonucleotide

SEQ ID NO: 371317 - DNA, 30 bp, Artificial Sequence; identical to SEQ ID NO: 21992
  Description of Artificial Sequence: Synthetic oligonucleotide

SEQ ID NO: 371318 - DNA, 29 bp, Artificial Sequence
  Description of Artificial Sequence: Synthetic oligonucleotide
actcaggacactgagcttgtggagaccag

SEQ ID NO: 371319 - DNA, 28 bp, Artificial Sequence
  Description of Artificial Sequence: Synthetic oligonucleotide
ctcaggacactgagcttgtggagaccag

SEQ ID NO: 371320 - DNA, 29 bp, Artificial Sequence
  Description of Artificial Sequence: Synthetic oligonucleotide
tcaggacactgagcttgtggagaccagac

SEQ ID NO: 371321 - DNA, 28 bp, Artificial Sequence
  Description of Artificial Sequence: Synthetic oligonucleotide
caggacactgagcttgtggagaccagac

SEQ ID NO: 371322 - DNA, 28 bp, Artificial Sequence
  Description of Artificial Sequence: Synthetic oligonucleotide
aggacactgagcttgtggagaccagacc

SEQ ID NO: 371323 - DNA, 27 bp, Artificial Sequence
  Description of Artificial Sequence: Synthetic oligonucleotide
ggacactgagcttgtggagaccagacc

SEQ ID NO: 371324 - DNA, 28 bp, Artificial Sequence
  Description of Artificial Sequence: Synthetic oligonucleotide
gacactgagcttgtggagaccagaccag

SEQ ID NO: 371325 - DNA, 28 bp, Artificial Sequence
  Description of Artificial Sequence: Synthetic oligonucleotide
acactgagcttgtggagaccagaccagc

SEQ ID NO: 371326 - DNA, 27 bp, Artificial Sequence
  Description of Artificial Sequence: Synthetic oligonucleotide
cactgagcttgtggagaccagaccagc

SEQ ID NO: 371327 - DNA, 28 bp, Artificial Sequence
  Description of Artificial Sequence: Synthetic oligonucleotide
actgagcttgtggagaccagaccagcag

SEQ ID NO: 371328 - DNA, 27 bp, Artificial Sequence
  Description of Artificial Sequence: Synthetic oligonucleotide
ctgagcttgtggagaccagaccagcag

SEQ ID NO: 371329 - DNA, 27 bp, Artificial Sequence
  Description of Artificial Sequence: Synthetic oligonucleotide
tgagcttgtggagaccagaccagcagg

SEQ ID NO: 371330 - DNA, 27 bp, Artificial Sequence
  Description of Artificial Sequence: Synthetic oligonucleotide
gagcttgtggagaccagaccagcagga

SEQ ID NO: 371331 - DNA, 27 bp, Artificial Sequence
  Description of Artificial Sequence: Synthetic oligonucleotide
agcttgtggagaccagaccagcaggag

SEQ ID NO: 371332 - DNA, 27 bp, Artificial Sequence
  Description of Artificial Sequence: Synthetic oligonucleotide
gcttgtggagaccagaccagcaggaga

SEQ ID NO: 371333 - DNA, 29 bp, Artificial Sequence
  Description of Artificial Sequence: Synthetic oligonucleotide
cttgtggagaccagaccagcaggagatag

SEQ ID NO: 371334 - DNA, 31 bp, Artificial Sequence; identical to SEQ ID NO: 22009
  Description of Artificial Sequence: Synthetic oligonucleotide

SEQ ID NO: 371335 - DNA, 30 bp, Artificial Sequence; identical to SEQ ID NO: 22010
  Description of Artificial Sequence: Synthetic oligonucleotide

SEQ ID NO: 371336 - DNA, 29 bp, Artificial Sequence
  Description of Artificial Sequence: Synthetic oligonucleotide
gtggagaccagaccagcaggagatagaac

SEQ ID NO: 371337 - DNA, 29 bp, Artificial Sequence
  Description of Artificial Sequence: Synthetic oligonucleotide
tggagaccagaccagcaggagatagaacc

SEQ ID NO: 371338 - DNA, 28 bp, Artificial Sequence
  Description of Artificial Sequence: Synthetic oligonucleotide
ggagaccagaccagcaggagatagaacc

SEQ ID NO: 371339 - DNA, 30 bp, Artificial Sequence; identical to SEQ ID NO: 22014
  Description of Artificial Sequence: Synthetic oligonucleotide

SEQ ID NO: 371340 - DNA, 30 bp, Artificial Sequence; identical to SEQ ID NO: 22015
  Description of Artificial Sequence: Synthetic oligonucleotide

SEQ ID NO: 371341 - DNA, 29 bp, Artificial Sequence
  Description of Artificial Sequence: Synthetic oligonucleotide
gaccagaccagcaggagatagaaccttcc

SEQ ID NO: 371342 - DNA, 30 bp, Artificial Sequence; identical to SEQ ID NO: 22017
  Description of Artificial Sequence: Synthetic oligonucleotide

SEQ ID NO: 371343 - DNA, 29 bp, Artificial Sequence
  Description of Artificial Sequence: Synthetic oligonucleotide
ccagaccagcaggagatagaaccttccag

SEQ ID NO: 371344 - DNA, 31 bp, Artificial Sequence; identical to SEQ ID NO: 22019
  Description of Artificial Sequence: Synthetic oligonucleotide

SEQ ID NO: 371345 - DNA, 32 bp, Artificial Sequence; identical to SEQ ID NO: 22020
  Description of Artificial Sequence: Synthetic oligonucleotide

SEQ ID NO: 371346 - DNA, 31 bp, Artificial Sequence; identical to SEQ ID NO: 22021
  Description of Artificial Sequence: Synthetic oligonucleotide

SEQ ID NO: 371347 - DNA, 31 bp, Artificial Sequence; identical to SEQ ID NO: 22022
  Description of Artificial Sequence: Synthetic oligonucleotide

SEQ ID NO: 371348 - DNA, 30 bp, Artificial Sequence; identical to SEQ ID NO: 22023
  Description of Artificial Sequence: Synthetic oligonucleotide

SEQ ID NO: 371349 - DNA, 30 bp, Artificial Sequence; identical to SEQ ID NO: 22024
  Description of Artificial Sequence: Synthetic oligonucleotide

SEQ ID NO: 371350 - DNA, 30 bp, Artificial Sequence; identical to SEQ ID NO: 22025
  Description of Artificial Sequence: Synthetic oligonucleotide

SEQ ID NO: 371351 - DNA, 29 bp, Artificial Sequence
  Description of Artificial Sequence: Synthetic oligonucleotide
gcaggagatagaaccttccagaagtgggc

SEQ ID NO: 371352 - DNA, 30 bp, Artificial Sequence; identical to SEQ ID NO: 22027
  Description of Artificial Sequence: Synthetic oligonucleotide

SEQ ID NO: 371353 - DNA, 30 bp, Artificial Sequence; identical to SEQ ID NO: 22028
  Description of Artificial Sequence: Synthetic oligonucleotide

SEQ ID NO: 371354 - DNA, 29 bp, Artificial Sequence
  Description of Artificial Sequence: Synthetic oligonucleotide
ggagatagaaccttccagaagtgggcagc

SEQ ID NO: 371355 - DNA, 30 bp, Artificial Sequence; identical to SEQ ID NO: 22030
  Description of Artificial Sequence: Synthetic oligonucleotide

SEQ ID NO: 371356 - DNA, 31 bp, Artificial Sequence; identical to SEQ ID NO: 22031
  Description of Artificial Sequence: Synthetic oligonucleotide

SEQ ID NO: 371357 - DNA, 30 bp, Artificial Sequence; identical to SEQ ID NO: 22032
  Description of Artificial Sequence: Synthetic oligonucleotide

SEQ ID NO: 371358 - DNA, 30 bp, Artificial Sequence; identical to SEQ ID NO: 22033
  Description of Artificial Sequence: Synthetic oligonucleotide

SEQ ID NO: 371359 - DNA, 29 bp, Artificial Sequence
  Description of Artificial Sequence: Synthetic oligonucleotide
tagaaccttccagaagtgggcagctgtgg

SEQ ID NO: 371360 - DNA, 28 bp, Artificial Sequence
  Description of Artificial Sequence: Synthetic oligonucleotide
agaaccttccagaagtgggcagctgtgg

SEQ ID NO: 371361 - DNA, 27 bp, Artificial Sequence
  Description of Artificial Sequence: Synthetic oligonucleotide
ttccagaagtgggcagctgtggtggtg

SEQ ID NO: 371362 - DNA, 26 bp, Artificial Sequence
  Description of Artificial Sequence: Synthetic oligonucleotide
tccagaagtgggcagctgtggtggtg

SEQ ID NO: 371363 - DNA, 25 bp, Artificial Sequence
  Description of Artificial Sequence: Synthetic oligonucleotide
ccagaagtgggcagctgtggtggtg

SEQ ID NO: 371364 - DNA, 25 bp, Artificial Sequence
  Description of Artificial Sequence: Synthetic oligonucleotide
cagaagtgggcagctgtggtggtgc

SEQ ID NO: 371365 - DNA, 27 bp, Artificial Sequence
  Description of Artificial Sequence: Synthetic oligonucleotide
agaagtgggcagctgtggtggtgcctt

SEQ ID NO: 371366 - DNA, 26 bp, Artificial Sequence
  Description of Artificial Sequence: Synthetic oligonucleotide
gaagtgggcagctgtggtggtgcctt

SEQ ID NO: 371367 - DNA, 27 bp, Artificial Sequence
  Description of Artificial Sequence: Synthetic oligonucleotide
aagtgggcagctgtggtggtgccttct

SEQ ID NO: 371368 - DNA, 26 bp, Artificial Sequence
  Description of Artificial Sequence: Synthetic oligonucleotide
agtgggcagctgtggtggtgccttct

SEQ ID NO: 371369 - DNA, 25 bp, Artificial Sequence
  Description of Artificial Sequence: Synthetic oligonucleotide
gtgggcagctgtggtggtgccttct

SEQ ID NO: 371370 - DNA, 25 bp, Artificial Sequence
  Description of Artificial Sequence: Synthetic oligonucleotide
tgggcagctgtggtggtgccttctg

SEQ ID NO: 371371 - DNA, 24 bp, Artificial Sequence
  Description of Artificial Sequence: Synthetic oligonucleotide
gggcagctgtggtggtgccttctg

SEQ ID NO: 371372 - DNA, 25 bp, Artificial Sequence
  Description of Artificial Sequence: Synthetic oligonucleotide
ggcagctgtggtggtgccttctgga

SEQ ID NO: 371373 - DNA, 27 bp, Artificial Sequence
  Description of Artificial Sequence: Synthetic oligonucleotide
gcagctgtggtggtgccttctggagaa

SEQ ID NO: 371374 - DNA, 27 bp, Artificial Sequence
  Description of Artificial Sequence: Synthetic oligonucleotide
cagctgtggtggtgccttctggagaag

SEQ ID NO: 371375 - DNA, 28 bp, Artificial Sequence
  Description of Artificial Sequence: Synthetic oligonucleotide
agctgtggtggtgccttctggagaagag

SEQ ID NO: 371376 - DNA, 27 bp, Artificial Sequence
  Description of Artificial Sequence: Synthetic oligonucleotide
gctgtggtggtgccttctggagaagag

SEQ ID NO: 371377 - DNA, 27 bp, Artificial Sequence
  Description of Artificial Sequence: Synthetic oligonucleotide
ctgtggtggtgccttctggagaagagc

SEQ ID NO: 371378 - DNA, 28 bp, Artificial Sequence
  Description of Artificial Sequence: Synthetic oligonucleotide
tgtggtggtgccttctggagaagagcag

SEQ ID NO: 371379 - DNA, 27 bp, Artificial Sequence
  Description of Artificial Sequence: Synthetic oligonucleotide
gtggtggtgccttctggagaagagcag

SEQ ID NO: 371380 - DNA, 28 bp, Artificial Sequence
  Description of Artificial Sequence: Synthetic oligonucleotide
tggtggtgccttctggagaagagcagag

SEQ ID NO: 371381 - DNA, 27 bp, Artificial Sequence
  Description of Artificial Sequence: Synthetic oligonucleotide
ggtggtgccttctggagaagagcagag

SEQ ID NO: 371382 - DNA, 30 bp, Artificial Sequence; identical to SEQ ID NO: 22057
  Description of Artificial Sequence: Synthetic oligonucleotide

SEQ ID NO: 371383 - DNA, 31 bp, Artificial Sequence; identical to SEQ ID NO: 22058
  Description of Artificial Sequence: Synthetic oligonucleotide

SEQ ID NO: 371384 - DNA, 30 bp, Artificial Sequence; identical to SEQ ID NO: 22059
  Description of Artificial Sequence: Synthetic oligonucleotide

SEQ ID NO: 371385 - DNA, 32 bp, Artificial Sequence; identical to SEQ ID NO: 22060
  Description of Artificial Sequence: Synthetic oligonucleotide

SEQ ID NO: 371386 - DNA, 32 bp, Artificial Sequence; identical to SEQ ID NO: 22061
  Description of Artificial Sequence: Synthetic oligonucleotide

SEQ ID NO: 371387 - DNA, 31 bp, Artificial Sequence; identical to SEQ ID NO: 22062
  Description of Artificial Sequence: Synthetic oligonucleotide

SEQ ID NO: 371388 - DNA, 31 bp, Artificial Sequence; identical to SEQ ID NO: 22063
  Description of Artificial Sequence: Synthetic oligonucleotide

SEQ ID NO: 371389 - DNA, 33 bp, Artificial Sequence; identical to SEQ ID NO: 22064
  Description of Artificial Sequence: Synthetic oligonucleotide

SEQ ID NO: 371390 - DNA, 35 bp, Artificial Sequence; identical to SEQ ID NO: 22065
  Description of Artificial Sequence: Synthetic oligonucleotide

SEQ ID NO: 371391 - DNA, 34 bp, Artificial Sequence; identical to SEQ ID NO: 22066
  Description of Artificial Sequence: Synthetic oligonucleotide

SEQ ID NO: 371392 - DNA, 33 bp, Artificial Sequence; identical to SEQ ID NO: 22067
  Description of Artificial Sequence: Synthetic oligonucleotide

SEQ ID NO: 371393 - DNA, 34 bp, Artificial Sequence; identical to SEQ ID NO: 22068
  Description of Artificial Sequence: Synthetic oligonucleotide

SEQ ID NO: 371394 - DNA, 33 bp, Artificial Sequence; identical to SEQ ID NO: 22069
  Description of Artificial Sequence: Synthetic oligonucleotide

SEQ ID NO: 371395 - DNA, 33 bp, Artificial Sequence; identical to SEQ ID NO: 22070
  Description of Artificial Sequence: Synthetic oligonucleotide

SEQ ID NO: 371396 - DNA, 35 bp, Artificial Sequence; identical to SEQ ID NO: 22071
  Description of Artificial Sequence: Synthetic oligonucleotide

SEQ ID NO: 371397 - DNA, 34 bp, Artificial Sequence; identical to SEQ ID NO: 22072
  Description of Artificial Sequence: Synthetic oligonucleotide

SEQ ID NO: 371398 - DNA, 35 bp, Artificial Sequence; identical to SEQ ID NO: 22073
  Description of Artificial Sequence: Synthetic oligonucleotide

SEQ ID NO: 371399 - DNA, 34 bp, Artificial Sequence; identical to SEQ ID NO: 22074
  Description of Artificial Sequence: Synthetic oligonucleotide

SEQ ID NO: 371400 - DNA, 33 bp, Artificial Sequence; identical to SEQ ID NO: 22075
  Description of Artificial Sequence: Synthetic oligonucleotide

SEQ ID NO: 371401 - DNA, 33 bp, Artificial Sequence; identical to SEQ ID NO: 22076
  Description of Artificial Sequence: Synthetic oligonucleotide

SEQ ID NO: 371402 - DNA, 32 bp, Artificial Sequence; identical to SEQ ID NO: 22077
  Description of Artificial Sequence: Synthetic oligonucleotide

SEQ ID NO: 371403 - DNA, 32 bp, Artificial Sequence; identical to SEQ ID NO: 22078
  Description of Artificial Sequence: Synthetic oligonucleotide

SEQ ID NO: 371404 - DNA, 32 bp, Artificial Sequence; identical to SEQ ID NO: 22079
  Description of Artificial Sequence: Synthetic oligonucleotide

SEQ ID NO: 371405 - DNA, 31 bp, Artificial Sequence; identical to SEQ ID NO: 22080
  Description of Artificial Sequence: Synthetic oligonucleotide

SEQ ID NO: 371406 - DNA, 31 bp, Artificial Sequence; identical to SEQ ID NO: 22081
  Description of Artificial Sequence: Synthetic oligonucleotide

SEQ ID NO: 371407 - DNA, 30 bp, Artificial Sequence; identical to SEQ ID NO: 22082
  Description of Artificial Sequence: Synthetic oligonucleotide

SEQ ID NO: 371408 - DNA, 31 bp, Artificial Sequence; identical to SEQ ID NO: 22083
  Description of Artificial Sequence: Synthetic oligonucleotide

SEQ ID NO: 371409 - DNA, 30 bp, Artificial Sequence; identical to SEQ ID NO: 22084
  Description of Artificial Sequence: Synthetic oligonucleotide

SEQ ID NO: 371410 - DNA, 29 bp, Artificial Sequence
  Description of Artificial Sequence: Synthetic oligonucleotide
acacatgccatgtacagcatgaggggctg

SEQ ID NO: 371411 - DNA, 28 bp, Artificial Sequence
  Description of Artificial Sequence: Synthetic oligonucleotide
cacatgccatgtacagcatgaggggctg

SEQ ID NO: 371412 - DNA, 28 bp, Artificial Sequence
  Description of Artificial Sequence: Synthetic oligonucleotide
acatgccatgtacagcatgaggggctgc

SEQ ID NO: 371413 - DNA, 27 bp, Artificial Sequence
  Description of Artificial Sequence: Synthetic oligonucleotide
catgccatgtacagcatgaggggctgc

SEQ ID NO: 371414 - DNA, 27 bp, Artificial Sequence
  Description of Artificial Sequence: Synthetic oligonucleotide
atgccatgtacagcatgaggggctgcc

SEQ ID NO: 371415 - DNA, 26 bp, Artificial Sequence
  Description of Artificial Sequence: Synthetic oligonucleotide
tgccatgtacagcatgaggggctgcc

SEQ ID NO: 371416 - DNA, 25 bp, Artificial Sequence
  Description of Artificial Sequence: Synthetic oligonucleotide
gccatgtacagcatgaggggctgcc

SEQ ID NO: 371417 - DNA, 27 bp, Artificial Sequence
  Description of Artificial Sequence: Synthetic oligonucleotide
ccatgtacagcatgaggggctgccgaa

SEQ ID NO: 371418 - DNA, 27 bp, Artificial Sequence
  Description of Artificial Sequence: Synthetic oligonucleotide
catgtacagcatgaggggctgccgaag

SEQ ID NO: 371419 - DNA, 27 bp, Artificial Sequence
  Description of Artificial Sequence: Synthetic oligonucleotide
atgtacagcatgaggggctgccgaagc

SEQ ID NO: 371420 - DNA, 26 bp, Artificial Sequence
  Description of Artificial Sequence: Synthetic oligonucleotide
tgtacagcatgaggggctgccgaagc

SEQ ID NO: 371421 - DNA, 25 bp, Artificial Sequence
  Description of Artificial Sequence: Synthetic oligonucleotide
gtacagcatgaggggctgccgaagc

SEQ ID NO: 371422 - DNA, 25 bp, Artificial Sequence
  Description of Artificial Sequence: Synthetic oligonucleotide
tacagcatgaggggctgccgaagcc

SEQ ID NO: 371423 - DNA, 24 bp, Artificial Sequence
  Description of Artificial Sequence: Synthetic oligonucleotide
acagcatgaggggctgccgaagcc

SEQ ID NO: 371424 - DNA, 23 bp, Artificial Sequence
  Description of Artificial Sequence: Synthetic oligonucleotide
cagcatgaggggctgccgaagcc

SEQ ID NO: 371425 - DNA, 23 bp, Artificial Sequence
  Description of Artificial Sequence: Synthetic oligonucleotide
agcatgaggggctgccgaagccc

SEQ ID NO: 371426 - DNA, 22 bp, Artificial Sequence
  Description of Artificial Sequence: Synthetic oligonucleotide
gcatgaggggctgccgaagccc

SEQ ID NO: 371427 - DNA, 23 bp, Artificial Sequence
  Description of Artificial Sequence: Synthetic oligonucleotide
catgaggggctgccgaagcccct

SEQ ID NO: 371428 - DNA, 24 bp, Artificial Sequence
  Description of Artificial Sequence: Synthetic oligonucleotide
atgaggggctgccgaagcccctca

SEQ ID NO: 371429 - DNA, 23 bp, Artificial Sequence
  Description of Artificial Sequence: Synthetic oligonucleotide
tgaggggctgccgaagcccctca

SEQ ID NO: 371430 - DNA, 22 bp, Artificial Sequence
  Description of Artificial Sequence: Synthetic oligonucleotide
gaggggctgccgaagcccctca

SEQ ID NO: 371431 - DNA, 22 bp, Artificial Sequence
  Description of Artificial Sequence: Synthetic oligonucleotide
aggggctgccgaagcccctcac

SEQ ID NO: 371432 - DNA, 21 bp, Artificial Sequence
  Description of Artificial Sequence: Synthetic oligonucleotide
ggggctgccgaagcccctcac

SEQ ID NO: 371433 - DNA, 21 bp, Artificial Sequence
  Description of Artificial Sequence: Synthetic oligonucleotide
gggctgccgaagcccctcacc

SEQ ID NO: 371434 - DNA, 22 bp, Artificial Sequence
  Description of Artificial Sequence: Synthetic oligonucleotide
ggctgccgaagcccctcaccct

SEQ ID NO: 371435 - DNA, 23 bp, Artificial Sequence
  Description of Artificial Sequence: Synthetic oligonucleotide
gctgccgaagcccctcaccctga

SEQ ID NO: 371436 - DNA, 25 bp, Artificial Sequence
  Description of Artificial Sequence: Synthetic oligonucleotide
ctgccgaagcccctcaccctgagat

SEQ ID NO: 371437 - DNA, 25 bp, Artificial Sequence
  Description of Artificial Sequence: Synthetic oligonucleotide
tgccgaagcccctcaccctgagatg

SEQ ID NO: 371438 - DNA, 24 bp, Artificial Sequence
  Description of Artificial Sequence: Synthetic oligonucleotide
gccgaagcccctcaccctgagatg

SEQ ID NO: 371439 - DNA, 24 bp, Artificial Sequence
  Description of Artificial Sequence: Synthetic oligonucleotide
ccgaagcccctcaccctgagatgg

SEQ ID NO: 371440 - DNA, 25 bp, Artificial Sequence
  Description of Artificial Sequence: Synthetic oligonucleotide
cgaagcccctcaccctgagatggga

SEQ ID NO: 371441 - DNA, 25 bp, Artificial Sequence
  Description of Artificial Sequence: Synthetic oligonucleotide
gaagcccctcaccctgagatgggag

SEQ ID NO: 371442 - DNA, 26 bp, Artificial Sequence
  Description of Artificial Sequence: Synthetic oligonucleotide
cctgagatgggagccgtcttcccagt

SEQ ID NO: 371443 - DNA, 26 bp, Artificial Sequence
  Description of Artificial Sequence: Synthetic oligonucleotide
ctgagatgggagccgtcttcccagtc

SEQ ID NO: 371444 - DNA, 27 bp, Artificial Sequence
  Description of Artificial Sequence: Synthetic oligonucleotide
tgagatgggagccgtcttcccagtcca

SEQ ID NO: 371445 - DNA, 26 bp, Artificial Sequence
  Description of Artificial Sequence: Synthetic oligonucleotide
gagatgggagccgtcttcccagtcca

SEQ ID NO: 371446 - DNA, 26 bp, Artificial Sequence
  Description of Artificial Sequence: Synthetic oligonucleotide
agatgggagccgtcttcccagtccac

SEQ ID NO: 371447 - DNA, 25 bp, Artificial Sequence
  Description of Artificial Sequence: Synthetic oligonucleotide
gatgggagccgtcttcccagtccac

SEQ ID NO: 371448 - DNA, 25 bp, Artificial Sequence
  Description of Artificial Sequence: Synthetic oligonucleotide
atgggagccgtcttcccagtccacc

SEQ ID NO: 371449 - DNA, 24 bp, Artificial Sequence
  Description of Artificial Sequence: Synthetic oligonucleotide
tgggagccgtcttcccagtccacc

SEQ ID NO: 371450 - DNA, 23 bp, Artificial Sequence
  Description of Artificial Sequence: Synthetic oligonucleotide
gggagccgtcttcccagtccacc

SEQ ID NO: 371451 - DNA, 24 bp, Artificial Sequence
  Description of Artificial Sequence: Synthetic oligonucleotide
ggagccgtcttcccagtccaccgt

SEQ ID NO: 371452 - DNA, 24 bp, Artificial Sequence
  Description of Artificial Sequence: Synthetic oligonucleotide
gagccgtcttcccagtccaccgtc

SEQ ID NO: 371453 - DNA, 24 bp, Artificial Sequence
  Description of Artificial Sequence: Synthetic oligonucleotide
agccgtcttcccagtccaccgtcc

SEQ ID NO: 371454 - DNA, 23 bp, Artificial Sequence
  Description of Artificial Sequence: Synthetic oligonucleotide
gccgtcttcccagtccaccgtcc

SEQ ID NO: 371455 - DNA, 23 bp, Artificial Sequence
  Description of Artificial Sequence: Synthetic oligonucleotide
ccgtcttcccagtccaccgtccc

SEQ ID NO: 371456 - DNA, 25 bp, Artificial Sequence
  Description of Artificial Sequence: Synthetic oligonucleotide
cgtcttcccagtccaccgtccccat

SEQ ID NO: 371457 - DNA, 25 bp, Artificial Sequence
  Description of Artificial Sequence: Synthetic oligonucleotide
gtcttcccagtccaccgtccccatc

SEQ ID NO: 371458 - DNA, 26 bp, Artificial Sequence
  Description of Artificial Sequence: Synthetic oligonucleotide
tcttcccagtccaccgtccccatcgt

SEQ ID NO: 371459 - DNA, 25 bp, Artificial Sequence
  Description of Artificial Sequence: Synthetic oligonucleotide
cttcccagtccaccgtccccatcgt

SEQ ID NO: 371460 - DNA, 25 bp, Artificial Sequence
  Description of Artificial Sequence: Synthetic oligonucleotide
ttcccagtccaccgtccccatcgtg

SEQ ID NO: 371461 - DNA, 24 bp, Artificial Sequence
  Description of Artificial Sequence: Synthetic oligonucleotide
tcccagtccaccgtccccatcgtg

SEQ ID NO: 371462 - DNA, 23 bp, Artificial Sequence
  Description of Artificial Sequence: Synthetic oligonucleotide
cccagtccaccgtccccatcgtg

SEQ ID NO: 371463 - DNA, 23 bp, Artificial Sequence
  Description of Artificial Sequence: Synthetic oligonucleotide
ccagtccaccgtccccatcgtgg

SEQ ID NO: 371464 - DNA, 23 bp, Artificial Sequence
  Description of Artificial Sequence: Synthetic oligonucleotide
cagtccaccgtccccatcgtggg

SEQ ID NO: 371465 - DNA, 26 bp, Artificial Sequence
  Description of Artificial Sequence: Synthetic oligonucleotide
agtccaccgtccccatcgtgggcatt

SEQ ID NO: 371466 - DNA, 25 bp, Artificial Sequence
  Description of Artificial Sequence: Synthetic oligonucleotide
gtccaccgtccccatcgtgggcatt

SEQ ID NO: 371467 - DNA, 27 bp, Artificial Sequence
  Description of Artificial Sequence: Synthetic oligonucleotide
tccaccgtccccatcgtgggcattgtt

SEQ ID NO: 371468 - DNA, 26 bp, Artificial Sequence
  Description of Artificial Sequence: Synthetic oligonucleotide
ccaccgtccccatcgtgggcattgtt

SEQ ID NO: 371469 - DNA, 26 bp, Artificial Sequence
  Description of Artificial Sequence: Synthetic oligonucleotide
caccgtccccatcgtgggcattgttg

SEQ ID NO: 371470 - DNA, 27 bp, Artificial Sequence
  Description of Artificial Sequence: Synthetic oligonucleotide
accgtccccatcgtgggcattgttgct

SEQ ID NO: 371471 - DNA, 26 bp, Artificial Sequence
  Description of Artificial Sequence: Synthetic oligonucleotide
ccgtccccatcgtgggcattgttgct

SEQ ID NO: 371472 - DNA, 26 bp, Artificial Sequence
  Description of Artificial Sequence: Synthetic oligonucleotide
cgtccccatcgtgggcattgttgctg

SEQ ID NO: 371473 - DNA, 26 bp, Artificial Sequence
  Description of Artificial Sequence: Synthetic oligonucleotide
gtccccatcgtgggcattgttgctgg

SEQ ID NO: 371474 - DNA, 26 bp, Artificial Sequence
  Description of Artificial Sequence: Synthetic oligonucleotide
tccccatcgtgggcattgttgctggc

SEQ ID NO: 371475 - DNA, 25 bp, Artificial Sequence
  Description of Artificial Sequence: Synthetic oligonucleotide
ccccatcgtgggcattgttgctggc

SEQ ID NO: 371476 - DNA, 26 bp, Artificial Sequence
  Description of Artificial Sequence: Synthetic oligonucleotide
cccatcgtgggcattgttgctggcct

SEQ ID NO: 371477 - DNA, 26 bp, Artificial Sequence
  Description of Artificial Sequence: Synthetic oligonucleotide
ccatcgtgggcattgttgctggcctg

SEQ ID NO: 371478 - DNA, 26 bp, Artificial Sequence
  Description of Artificial Sequence: Synthetic oligonucleotide
catcgtgggcattgttgctggcctgg

SEQ ID NO: 371479 - DNA, 27 bp, Artificial Sequence
  Description of Artificial Sequence: Synthetic oligonucleotide
atcgtgggcattgttgctggcctggct

SEQ ID NO: 371480 - DNA, 26 bp, Artificial Sequence
  Description of Artificial Sequence: Synthetic oligonucleotide
tcgtgggcattgttgctggcctggct

SEQ ID NO: 371481 - DNA, 25 bp, Artificial Sequence
  Description of Artificial Sequence: Synthetic oligonucleotide
cgtgggcattgttgctggcctggct

SEQ ID NO: 371482 - DNA, 26 bp, Artificial Sequence
  Description of Artificial Sequence: Synthetic oligonucleotide
gtgggcattgttgctggcctggctgt

SEQ ID NO: 371483 - DNA, 26 bp, Artificial Sequence
  Description of Artificial Sequence: Synthetic oligonucleotide
tgggcattgttgctggcctggctgtc

SEQ ID NO: 371484 - DNA, 25 bp, Artificial Sequence
  Description of Artificial Sequence: Synthetic oligonucleotide
gggcattgttgctggcctggctgtc

SEQ ID NO: 371485 - DNA, 27 bp, Artificial Sequence
  Description of Artificial Sequence: Synthetic oligonucleotide
ggcattgttgctggcctggctgtccta

SEQ ID NO: 371486 - DNA, 27 bp, Artificial Sequence
  Description of Artificial Sequence: Synthetic oligonucleotide
gcattgttgctggcctggctgtcctag

SEQ ID NO: 371487 - DNA, 27 bp, Artificial Sequence
  Description of Artificial Sequence: Synthetic oligonucleotide
cattgttgctggcctggctgtcctagc

SEQ ID NO: 371488 - DNA, 28 bp, Artificial Sequence
  Description of Artificial Sequence: Synthetic oligonucleotide
attgttgctggcctggctgtcctagcag

SEQ ID NO: 371489 - DNA, 27 bp, Artificial Sequence
  Description of Artificial Sequence: Synthetic oligonucleotide
ttgttgctggcctggctgtcctagcag

SEQ ID NO: 371490 - DNA, 27 bp, Artificial Sequence
  Description of Artificial Sequence: Synthetic oligonucleotide
tgttgctggcctggctgtcctagcagt

SEQ ID NO: 371491 - DNA, 27 bp, Artificial Sequence
  Description of Artificial Sequence: Synthetic oligonucleotide
gttgctggcctggctgtcctagcagtt

SEQ ID NO: 371492 - DNA, 27 bp, Artificial Sequence
  Description of Artificial Sequence: Synthetic oligonucleotide
ttgctggcctggctgtcctagcagttg

SEQ ID NO: 371493 - DNA, 27 bp, Artificial Sequence
  Description of Artificial Sequence: Synthetic oligonucleotide
tgctggcctggctgtcctagcagttgt

SEQ ID NO: 371494 - DNA, 26 bp, Artificial Sequence
  Description of Artificial Sequence: Synthetic oligonucleotide
gctggcctggctgtcctagcagttgt

SEQ ID NO: 371495 - DNA, 26 bp, Artificial Sequence
  Description of Artificial Sequence: Synthetic oligonucleotide
ctggcctggctgtcctagcagttgtg

SEQ ID NO: 371496 - DNA, 27 bp, Artificial Sequence
  Description of Artificial Sequence: Synthetic oligonucleotide
tggcctggctgtcctagcagttgtggt

SEQ ID NO: 371497 - DNA, 26 bp, Artificial Sequence
  Description of Artificial Sequence: Synthetic oligonucleotide
ggcctggctgtcctagcagttgtggt

SEQ ID NO: 371498 - DNA, 27 bp, Artificial Sequence
  Description of Artificial Sequence: Synthetic oligonucleotide
gcctggctgtcctagcagttgtggtca

SEQ ID NO: 371499 - DNA, 28 bp, Artificial Sequence
  Description of Artificial Sequence: Synthetic oligonucleotide
cctggctgtcctagcagttgtggtcatc

SEQ ID NO: 371500 - DNA, 28 bp, Artificial Sequence
  Description of Artificial Sequence: Synthetic oligonucleotide
ctggctgtcctagcagttgtggtcatcg

SEQ ID NO: 371501 - DNA, 28 bp, Artificial Sequence
  Description of Artificial Sequence: Synthetic oligonucleotide
tggctgtcctagcagttgtggtcatcgg

SEQ ID NO: 371502 - DNA, 27 bp, Artificial Sequence
  Description of Artificial Sequence: Synthetic oligonucleotide
ggctgtcctagcagttgtggtcatcgg

SEQ ID NO: 371503 - DNA, 28 bp, Artificial Sequence
  Description of Artificial Sequence: Synthetic oligonucleotide
gctgtcctagcagttgtggtcatcggag

SEQ ID NO: 371504 - DNA, 28 bp, Artificial Sequence
  Description of Artificial Sequence: Synthetic oligonucleotide
ctgtcctagcagttgtggtcatcggagc

SEQ ID NO: 371505 - DNA, 29 bp, Artificial Sequence
  Description of Artificial Sequence: Synthetic oligonucleotide
tgtcctagcagttgtggtcatcggagctg

SEQ ID NO: 371506 - DNA, 28 bp, Artificial Sequence
  Description of Artificial Sequence: Synthetic oligonucleotide
gtcctagcagttgtggtcatcggagctg

SEQ ID NO: 371507 - DNA, 29 bp, Artificial Sequence
  Description of Artificial Sequence: Synthetic oligonucleotide
tcctagcagttgtggtcatcggagctgtg

SEQ ID NO: 371508 - DNA, 28 bp, Artificial Sequence
  Description of Artificial Sequence: Synthetic oligonucleotide
cctagcagttgtggtcatcggagctgtg

SEQ ID NO: 371509 - DNA, 28 bp, Artificial Sequence
  Description of Artificial Sequence: Synthetic oligonucleotide
ctagcagttgtggtcatcggagctgtgg

SEQ ID NO: 371510 - DNA, 29 bp, Artificial Sequence
  Description of Artificial Sequence: Synthetic oligonucleotide
tagcagttgtggtcatcggagctgtggtc

SEQ ID NO: 371511 - DNA, 28 bp, Artificial Sequence
  Description of Artificial Sequence: Synthetic oligonucleotide
agcagttgtggtcatcggagctgtggtc

SEQ ID NO: 371512 - DNA, 27 bp, Artificial Sequence
  Description of Artificial Sequence: Synthetic oligonucleotide
gcagttgtggtcatcggagctgtggtc

SEQ ID NO: 371513 - DNA, 27 bp, Artificial Sequence
  Description of Artificial Sequence: Synthetic oligonucleotide
cagttgtggtcatcggagctgtggtcg

SEQ ID NO: 371514 - DNA, 27 bp, Artificial Sequence
  Description of Artificial Sequence: Synthetic oligonucleotide
agttgtggtcatcggagctgtggtcgc

SEQ ID NO: 371515 - DNA, 27 bp, Artificial Sequence
  Description of Artificial Sequence: Synthetic oligonucleotide
gttgtggtcatcggagctgtggtcgct

SEQ ID NO: 371516 - DNA, 27 bp, Artificial Sequence
  Description of Artificial Sequence: Synthetic oligonucleotide
ttgtggtcatcggagctgtggtcgctg

SEQ ID NO: 371517 - DNA, 26 bp, Artificial Sequence
  Description of Artificial Sequence: Synthetic oligonucleotide
tgtggtcatcggagctgtggtcgctg

SEQ ID NO: 371518 - DNA, 25 bp, Artificial Sequence
  Description of Artificial Sequence: Synthetic oligonucleotide
gtggtcatcggagctgtggtcgctg

SEQ ID NO: 371519 - DNA, 26 bp, Artificial Sequence
  Description of Artificial Sequence: Synthetic oligonucleotide
tggtcatcggagctgtggtcgctgct

SEQ ID NO: 371520 - DNA, 25 bp, Artificial Sequence
  Description of Artificial Sequence: Synthetic oligonucleotide
ggtcatcggagctgtggtcgctgct

SEQ ID NO: 371521 - DNA, 26 bp, Artificial Sequence
  Description of Artificial Sequence: Synthetic oligonucleotide
gtcatcggagctgtggtcgctgctgt

SEQ ID NO: 371522 - DNA, 27 bp, Artificial Sequence
  Description of Artificial Sequence: Synthetic oligonucleotide
tcatcggagctgtggtcgctgctgtga

SEQ ID NO: 371523 - DNA, 27 bp, Artificial Sequence
  Description of Artificial Sequence: Synthetic oligonucleotide
catcggagctgtggtcgctgctgtgat

SEQ ID NO: 371524 - DNA, 27 bp, Artificial Sequence
  Description of Artificial Sequence: Synthetic oligonucleotide
atcggagctgtggtcgctgctgtgatg

SEQ ID NO: 371525 - DNA, 27 bp, Artificial Sequence
  Description of Artificial Sequence: Synthetic oligonucleotide
tcggagctgtggtcgctgctgtgatgt

SEQ ID NO: 371526 - DNA, 26 bp, Artificial Sequence
  Description of Artificial Sequence: Synthetic oligonucleotide
cggagctgtggtcgctgctgtgatgt

SEQ ID NO: 371527 - DNA, 27 bp, Artificial Sequence
  Description of Artificial Sequence: Synthetic oligonucleotide
ggagctgtggtcgctgctgtgatgtgt

SEQ ID NO: 371528 - DNA, 28 bp, Artificial Sequence
  Description of Artificial Sequence: Synthetic oligonucleotide
gagctgtggtcgctgctgtgatgtgtag

SEQ ID NO: 371529 - DNA, 28 bp, Artificial Sequence
  Description of Artificial Sequence: Synthetic oligonucleotide
agctgtggtcgctgctgtgatgtgtagg

SEQ ID NO: 371530 - DNA, 27 bp, Artificial Sequence
  Description of Artificial Sequence: Synthetic oligonucleotide
gctgtggtcgctgctgtgatgtgtagg

SEQ ID NO: 371531 - DNA, 28 bp, Artificial Sequence
  Description of Artificial Sequence: Synthetic oligonucleotide
ctgtggtcgctgctgtgatgtgtaggag

SEQ ID NO: 371532 - DNA, 28 bp, Artificial Sequence
  Description of Artificial Sequence: Synthetic oligonucleotide
tgtggtcgctgctgtgatgtgtaggagg

SEQ ID NO: 371533 - DNA, 27 bp, Artificial Sequence
  Description of Artificial Sequence: Synthetic oligonucleotide
gtggtcgctgctgtgatgtgtaggagg

SEQ ID NO: 371534 - DNA, 29 bp, Artificial Sequence
  Description of Artificial Sequence: Synthetic oligonucleotide
tggtcgctgctgtgatgtgtaggaggaag

SEQ ID NO: 371535 - DNA, 28 bp, Artificial Sequence
  Description of Artificial Sequence: Synthetic oligonucleotide
ggtcgctgctgtgatgtgtaggaggaag

SEQ ID NO: 371536 - DNA, 29 bp, Artificial Sequence
  Description of Artificial Sequence: Synthetic oligonucleotide
gtcgctgctgtgatgtgtaggaggaagag

SEQ ID NO: 371537 - DNA, 31 bp, Artificial Sequence; identical to SEQ ID NO: 22212
  Description of Artificial Sequence: Synthetic oligonucleotide

SEQ ID NO: 371538 - DNA, 30 bp, Artificial Sequence; identical to SEQ ID NO: 22213
  Description of Artificial Sequence: Synthetic oligonucleotide

SEQ ID NO: 371539 - DNA, 31 bp, Artificial Sequence; identical to SEQ ID NO: 22214
  Description of Artificial Sequence: Synthetic oligonucleotide

SEQ ID NO: 371540 - DNA, 31 bp, Artificial Sequence; identical to SEQ ID NO: 22215
  Description of Artificial Sequence: Synthetic oligonucleotide

SEQ ID NO: 371541 - DNA, 32 bp, Artificial Sequence; identical to SEQ ID NO: 22216
  Description of Artificial Sequence: Synthetic oligonucleotide

SEQ ID NO: 371542 - DNA, 31 bp, Artificial Sequence; identical to SEQ ID NO: 22217
  Description of Artificial Sequence: Synthetic oligonucleotide

SEQ ID NO: 371543 - DNA, 31 bp, Artificial Sequence; identical to SEQ ID NO: 22218
  Description of Artificial Sequence: Synthetic oligonucleotide

SEQ ID NO: 371544 - DNA, 35 bp, Artificial Sequence; identical to SEQ ID NO: 22219
  Description of Artificial Sequence: Synthetic oligonucleotide

SEQ ID NO: 371545 - DNA, 34 bp, Artificial Sequence; identical to SEQ ID NO: 22220
  Description of Artificial Sequence: Synthetic oligonucleotide

SEQ ID NO: 371546 - DNA, 34 bp, Artificial Sequence; identical to SEQ ID NO: 22221
  Description of Artificial Sequence: Synthetic oligonucleotide

SEQ ID NO: 371547 - DNA, 33 bp, Artificial Sequence; identical to SEQ ID NO: 22222
  Description of Artificial Sequence: Synthetic oligonucleotide

SEQ ID NO: 371548 - DNA, 34 bp, Artificial Sequence; identical to SEQ ID NO: 22223
  Description of Artificial Sequence: Synthetic oligonucleotide

SEQ ID NO: 371549 - DNA, 33 bp, Artificial Sequence; identical to SEQ ID NO: 22224
  Description of Artificial Sequence: Synthetic oligonucleotide

SEQ ID NO: 371550 - DNA, 32 bp, Artificial Sequence; identical to SEQ ID NO: 22225
  Description of Artificial Sequence: Synthetic oligonucleotide

SEQ ID NO: 371551 - DNA, 32 bp, Artificial Sequence; identical to SEQ ID NO: 22226
  Description of Artificial Sequence: Synthetic oligonucleotide

SEQ ID NO: 371552 - DNA, 31 bp, Artificial Sequence; identical to SEQ ID NO: 22227
  Description of Artificial Sequence: Synthetic oligonucleotide

SEQ ID NO: 371553 - DNA, 31 bp, Artificial Sequence; identical to SEQ ID NO: 22228
  Description of Artificial Sequence: Synthetic oligonucleotide

SEQ ID NO: 371554 - DNA, 30 bp, Artificial Sequence; identical to SEQ ID NO: 22229
  Description of Artificial Sequence: Synthetic oligonucleotide

SEQ ID NO: 371555 - DNA, 29 bp, Artificial Sequence
  Description of Artificial Sequence: Synthetic oligonucleotide
ggaggaagagttcaggtggaaaaggaggg

SEQ ID NO: 371556 - DNA, 30 bp, Artificial Sequence; identical to SEQ ID NO: 22231
  Description of Artificial Sequence: Synthetic oligonucleotide

SEQ ID NO: 371557 - DNA, 30 bp, Artificial Sequence; identical to SEQ ID NO: 22232
  Description of Artificial Sequence: Synthetic oligonucleotide

SEQ ID NO: 371558 - DNA, 29 bp, Artificial Sequence
  Description of Artificial Sequence: Synthetic oligonucleotide
ggaagagttcaggtggaaaaggagggagc

SEQ ID NO: 371559 - DNA, 31 bp, Artificial Sequence; identical to SEQ ID NO: 22234
  Description of Artificial Sequence: Synthetic oligonucleotide

SEQ ID NO: 371560 - DNA, 32 bp, Artificial Sequence; identical to SEQ ID NO: 22235
  Description of Artificial Sequence: Synthetic oligonucleotide

SEQ ID NO: 371561 - DNA, 31 bp, Artificial Sequence; identical to SEQ ID NO: 22236
  Description of Artificial Sequence: Synthetic oligonucleotide

SEQ ID NO: 371562 - DNA, 30 bp, Artificial Sequence; identical to SEQ ID NO: 22237
  Description of Artificial Sequence: Synthetic oligonucleotide

SEQ ID NO: 371563 - DNA, 31 bp, Artificial Sequence; identical to SEQ ID NO: 22238
  Description of Artificial Sequence: Synthetic oligonucleotide

SEQ ID NO: 371564 - DNA, 30 bp, Artificial Sequence; identical to SEQ ID NO: 22239
  Description of Artificial Sequence: Synthetic oligonucleotide

SEQ ID NO: 371565 - DNA, 31 bp, Artificial Sequence; identical to SEQ ID NO: 22240
  Description of Artificial Sequence: Synthetic oligonucleotide

SEQ ID NO: 371566 - DNA, 30 bp, Artificial Sequence; identical to SEQ ID NO: 22241
  Description of Artificial Sequence: Synthetic oligonucleotide

SEQ ID NO: 371567 - DNA, 29 bp, Artificial Sequence
  Description of Artificial Sequence: Synthetic oligonucleotide
caggtggaaaaggagggagctactctcag

SEQ ID NO: 371568 - DNA, 29 bp, Artificial Sequence
  Description of Artificial Sequence: Synthetic oligonucleotide
aggtggaaaaggagggagctactctcagg

SEQ ID NO: 371569 - DNA, 28 bp, Artificial Sequence
  Description of Artificial Sequence: Synthetic oligonucleotide
ggtggaaaaggagggagctactctcagg

SEQ ID NO: 371570 - DNA, 28 bp, Artificial Sequence
  Description of Artificial Sequence: Synthetic oligonucleotide
gtggaaaaggagggagctactctcaggc

SEQ ID NO: 371571 - DNA, 29 bp, Artificial Sequence
  Description of Artificial Sequence: Synthetic oligonucleotide
tggaaaaggagggagctactctcaggctg

SEQ ID NO: 371572 - DNA, 28 bp, Artificial Sequence
  Description of Artificial Sequence: Synthetic oligonucleotide
ggaaaaggagggagctactctcaggctg

SEQ ID NO: 371573 - DNA, 28 bp, Artificial Sequence
  Description of Artificial Sequence: Synthetic oligonucleotide
aaaaggagggagctactctcaggctgcg

SEQ ID NO: 371574 - DNA, 27 bp, Artificial Sequence
  Description of Artificial Sequence: Synthetic oligonucleotide
aaaggagggagctactctcaggctgcg

SEQ ID NO: 371575 - DNA, 27 bp, Artificial Sequence
  Description of Artificial Sequence: Synthetic oligonucleotide
aaggagggagctactctcaggctgcgt

SEQ ID NO: 371576 - DNA, 26 bp, Artificial Sequence
  Description of Artificial Sequence: Synthetic oligonucleotide
aggagggagctactctcaggctgcgt

SEQ ID NO: 371577 - DNA, 25 bp, Artificial Sequence
  Description of Artificial Sequence: Synthetic oligonucleotide
ggagggagctactctcaggctgcgt

SEQ ID NO: 371578 - DNA, 25 bp, Artificial Sequence
  Description of Artificial Sequence: Synthetic oligonucleotide
gagggagctactctcaggctgcgtg

SEQ ID NO: 371579 - DNA, 26 bp, Artificial Sequence
  Description of Artificial Sequence: Synthetic oligonucleotide
agggagctactctcaggctgcgtgca

SEQ ID NO: 371580 - DNA, 25 bp, Artificial Sequence
  Description of Artificial Sequence: Synthetic oligonucleotide
gggagctactctcaggctgcgtgca

SEQ ID NO: 371581 - DNA, 25 bp, Artificial Sequence
  Description of Artificial Sequence: Synthetic oligonucleotide
ggagctactctcaggctgcgtgcag

SEQ ID NO: 371582 - DNA, 25 bp, Artificial Sequence
  Description of Artificial Sequence: Synthetic oligonucleotide
gagctactctcaggctgcgtgcagc

SEQ ID NO: 371583 - DNA, 26 bp, Artificial Sequence
  Description of Artificial Sequence: Synthetic oligonucleotide
agctactctcaggctgcgtgcagcga

SEQ ID NO: 371584 - DNA, 25 bp, Artificial Sequence
  Description of Artificial Sequence: Synthetic oligonucleotide
gctactctcaggctgcgtgcagcga

SEQ ID NO: 371585 - DNA, 26 bp, Artificial Sequence
  Description of Artificial Sequence: Synthetic oligonucleotide
ctactctcaggctgcgtgcagcgaca

SEQ ID NO: 371586 - DNA, 27 bp, Artificial Sequence
  Description of Artificial Sequence: Synthetic oligonucleotide
tactctcaggctgcgtgcagcgacagt

SEQ ID NO: 371587 - DNA, 26 bp, Artificial Sequence
  Description of Artificial Sequence: Synthetic oligonucleotide
actctcaggctgcgtgcagcgacagt

SEQ ID NO: 371588 - DNA, 25 bp, Artificial Sequence
  Description of Artificial Sequence: Synthetic oligonucleotide
ctctcaggctgcgtgcagcgacagt

SEQ ID NO: 371589 - DNA, 25 bp, Artificial Sequence
  Description of Artificial Sequence: Synthetic oligonucleotide
tctcaggctgcgtgcagcgacagtg

SEQ ID NO: 371590 - DNA, 24 bp, Artificial Sequence
  Description of Artificial Sequence: Synthetic oligonucleotide
ctcaggctgcgtgcagcgacagtg

SEQ ID NO: 371591 - DNA, 24 bp, Artificial Sequence
  Description of Artificial Sequence: Synthetic oligonucleotide
tcaggctgcgtgcagcgacagtgc

SEQ ID NO: 371592 - DNA, 23 bp, Artificial Sequence
  Description of Artificial Sequence: Synthetic oligonucleotide
caggctgcgtgcagcgacagtgc

SEQ ID NO: 371593 - DNA, 23 bp, Artificial Sequence
  Description of Artificial Sequence: Synthetic oligonucleotide
aggctgcgtgcagcgacagtgcc

SEQ ID NO: 371594 - DNA, 22 bp, Artificial Sequence
  Description of Artificial Sequence: Synthetic oligonucleotide
ggctgcgtgcagcgacagtgcc

SEQ ID NO: 371595 - DNA, 23 bp, Artificial Sequence
  Description of Artificial Sequence: Synthetic oligonucleotide
gctgcgtgcagcgacagtgccca

SEQ ID NO: 371596 - DNA, 23 bp, Artificial Sequence
  Description of Artificial Sequence: Synthetic oligonucleotide
ctgcgtgcagcgacagtgcccag

SEQ ID NO: 371597 - DNA, 23 bp, Artificial Sequence
  Description of Artificial Sequence: Synthetic oligonucleotide
tgcgtgcagcgacagtgcccagg

SEQ ID NO: 371598 - DNA, 22 bp, Artificial Sequence
  Description of Artificial Sequence: Synthetic oligonucleotide
gcgtgcagcgacagtgcccagg

SEQ ID NO: 371599 - DNA, 22 bp, Artificial Sequence
  Description of Artificial Sequence: Synthetic oligonucleotide
cgtgcagcgacagtgcccaggg

SEQ ID NO: 371600 - DNA, 23 bp, Artificial Sequence
  Description of Artificial Sequence: Synthetic oligonucleotide
gtgcagcgacagtgcccagggct

SEQ ID NO: 371601 - DNA, 24 bp, Artificial Sequence
  Description of Artificial Sequence: Synthetic oligonucleotide
tgcagcgacagtgcccagggctct

SEQ ID NO: 371602 - DNA, 23 bp, Artificial Sequence
  Description of Artificial Sequence: Synthetic oligonucleotide
gcagcgacagtgcccagggctct

SEQ ID NO: 371603 - DNA, 25 bp, Artificial Sequence
  Description of Artificial Sequence: Synthetic oligonucleotide
cagcgacagtgcccagggctctgat

SEQ ID NO: 371604 - DNA, 26 bp, Artificial Sequence
  Description of Artificial Sequence: Synthetic oligonucleotide
agcgacagtgcccagggctctgatgt

SEQ ID NO: 371605 - DNA, 25 bp, Artificial Sequence
  Description of Artificial Sequence: Synthetic oligonucleotide
gcgacagtgcccagggctctgatgt

SEQ ID NO: 371606 - DNA, 26 bp, Artificial Sequence
  Description of Artificial Sequence: Synthetic oligonucleotide
cgacagtgcccagggctctgatgtgt

SEQ ID NO: 371607 - DNA, 23 bp, Artificial Sequence
  Description of Artificial Sequence: Synthetic oligonucleotide
gagtgcgtggagtggctccgcag

SEQ ID NO: 371608 - DNA, 25 bp, Artificial Sequence
  Description of Artificial Sequence: Synthetic oligonucleotide
agtgcgtggagtggctccgcaggta

SEQ ID NO: 371609 - DNA, 27 bp, Artificial Sequence
  Description of Artificial Sequence: Synthetic oligonucleotide
gcaggtacctggagaacgggaaggaca

SEQ ID NO: 371610 - DNA, 28 bp, Artificial Sequence
  Description of Artificial Sequence: Synthetic oligonucleotide
caggtacctggagaacgggaaggacaag

SEQ ID NO: 371611 - DNA, 28 bp, Artificial Sequence
  Description of Artificial Sequence: Synthetic oligonucleotide
aggtacctggagaacgggaaggacaagc

SEQ ID NO: 371612 - DNA, 27 bp, Artificial Sequence
  Description of Artificial Sequence: Synthetic oligonucleotide
ggtacctggagaacgggaaggacaagc

SEQ ID NO: 371613 - DNA, 28 bp, Artificial Sequence
  Description of Artificial Sequence: Synthetic oligonucleotide
gtacctggagaacgggaaggacaagctg

SEQ ID NO: 371614 - DNA, 24 bp, Artificial Sequence
  Description of Artificial Sequence: Synthetic oligonucleotide
ggaaggacaagctggagcgcgctg

SEQ ID NO: 371615 - DNA, 25 bp, Artificial Sequence
  Description of Artificial Sequence: Synthetic oligonucleotide
caggaggggcctgagtattgggacc

SEQ ID NO: 371616 - DNA, 25 bp, Artificial Sequence
  Description of Artificial Sequence: Synthetic oligonucleotide
aggaggggcctgagtattgggaccg

SEQ ID NO: 371617 - DNA, 24 bp, Artificial Sequence
  Description of Artificial Sequence: Synthetic oligonucleotide
ggaggggcctgagtattgggaccg

SEQ ID NO: 371618 - DNA, 26 bp, Artificial Sequence
  Description of Artificial Sequence: Synthetic oligonucleotide
gaggggcctgagtattgggaccggaa

SEQ ID NO: 371619 - DNA, 27 bp, Artificial Sequence
  Description of Artificial Sequence: Synthetic oligonucleotide
aggggcctgagtattgggaccggaaca

SEQ ID NO: 371620 - DNA, 26 bp, Artificial Sequence
  Description of Artificial Sequence: Synthetic oligonucleotide
ggggcctgagtattgggaccggaaca

SEQ ID NO: 371621 - DNA, 27 bp, Artificial Sequence
  Description of Artificial Sequence: Synthetic oligonucleotide
gggcctgagtattgggaccggaacaca

SEQ ID NO: 371622 - DNA, 27 bp, Artificial Sequence
  Description of Artificial Sequence: Synthetic oligonucleotide
ggcctgagtattgggaccggaacacac

SEQ ID NO: 371623 - DNA, 28 bp, Artificial Sequence
  Description of Artificial Sequence: Synthetic oligonucleotide
gcctgagtattgggaccggaacacacag

SEQ ID NO: 371624 - DNA, 30 bp, Artificial Sequence; identical to SEQ ID NO: 22333
  Description of Artificial Sequence: Synthetic oligonucleotide

SEQ ID NO: 371625 - DNA, 32 bp, Artificial Sequence; identical to SEQ ID NO: 22334
  Description of Artificial Sequence: Synthetic oligonucleotide

SEQ ID NO: 371626 - DNA, 34 bp, Artificial Sequence; identical to SEQ ID NO: 22335
  Description of Artificial Sequence: Synthetic oligonucleotide

SEQ ID NO: 371627 - DNA, 23 bp, Artificial Sequence
  Description of Artificial Sequence: Synthetic oligonucleotide
ccgcggagagccccgcttcatct

SEQ ID NO: 371628 - DNA, 24 bp, Artificial Sequence
  Description of Artificial Sequence: Synthetic oligonucleotide
cgcggagagccccgcttcatctca

SEQ ID NO: 371629 - DNA, 25 bp, Artificial Sequence
  Description of Artificial Sequence: Synthetic oligonucleotide
gcggagagccccgcttcatctcagt

SEQ ID NO: 371630 - DNA, 25 bp, Artificial Sequence
  Description of Artificial Sequence: Synthetic oligonucleotide
cggagagccccgcttcatctcagtg

SEQ ID NO: 371631 - DNA, 25 bp, Artificial Sequence
  Description of Artificial Sequence: Synthetic oligonucleotide
ggagagccccgcttcatctcagtgg

SEQ ID NO: 371632 - DNA, 25 bp, Artificial Sequence
  Description of Artificial Sequence: Synthetic oligonucleotide
gagagccccgcttcatctcagtggg

SEQ ID NO: 371633 - DNA, 27 bp, Artificial Sequence
  Description of Artificial Sequence: Synthetic oligonucleotide
agagccccgcttcatctcagtgggcta

SEQ ID NO: 371634 - DNA, 24 bp, Artificial Sequence
  Description of Artificial Sequence: Synthetic oligonucleotide
cgaagcccctcaccctgagatggg

SEQ ID NO: 371635 - DNA, 26 bp, Artificial Sequence
  Description of Artificial Sequence: Synthetic oligonucleotide
agcgcgctgaccccccaaagacacat

SEQ ID NO: 371636 - DNA, 25 bp, Artificial Sequence
  Description of Artificial Sequence: Synthetic oligonucleotide
gcgcgctgaccccccaaagacacat

SEQ ID NO: 371637 - DNA, 26 bp, Artificial Sequence
  Description of Artificial Sequence: Synthetic oligonucleotide
cgcgctgaccccccaaagacacatgt

SEQ ID NO: 371638 - DNA, 27 bp, Artificial Sequence
  Description of Artificial Sequence: Synthetic oligonucleotide
gcgctgaccccccaaagacacatgtga

SEQ ID NO: 371639 - DNA, 27 bp, Artificial Sequence
  Description of Artificial Sequence: Synthetic oligonucleotide
cgctgaccccccaaagacacatgtgac

SEQ ID NO: 371640 - DNA, 27 bp, Artificial Sequence
  Description of Artificial Sequence: Synthetic oligonucleotide
gctgaccccccaaagacacatgtgacc

SEQ ID NO: 371641 - DNA, 27 bp, Artificial Sequence
  Description of Artificial Sequence: Synthetic oligonucleotide
ctgaccccccaaagacacatgtgaccc

SEQ ID NO: 371642 - DNA, 28 bp, Artificial Sequence
  Description of Artificial Sequence: Synthetic oligonucleotide
tgaccccccaaagacacatgtgacccac

SEQ ID NO: 371643 - DNA, 27 bp, Artificial Sequence
  Description of Artificial Sequence: Synthetic oligonucleotide
gaccccccaaagacacatgtgacccac

SEQ ID NO: 371644 - DNA, 27 bp, Artificial Sequence
  Description of Artificial Sequence: Synthetic oligonucleotide
accccccaaagacacatgtgacccacc

SEQ ID NO: 371645 - DNA, 27 bp, Artificial Sequence
  Description of Artificial Sequence: Synthetic oligonucleotide
ccccccaaagacacatgtgacccacca

SEQ ID NO: 371646 - DNA, 27 bp, Artificial Sequence
  Description of Artificial Sequence: Synthetic oligonucleotide
cccccaaagacacatgtgacccaccac

SEQ ID NO: 371647 - DNA, 27 bp, Artificial Sequence
  Description of Artificial Sequence: Synthetic oligonucleotide
ccccaaagacacatgtgacccaccacc

SEQ ID NO: 371648 - DNA, 27 bp, Artificial Sequence
  Description of Artificial Sequence: Synthetic oligonucleotide
cccaaagacacatgtgacccaccaccc

SEQ ID NO: 371649 - DNA, 27 bp, Artificial Sequence
  Description of Artificial Sequence: Synthetic oligonucleotide
ccaaagacacatgtgacccaccacccc

SEQ ID NO: 371650 - DNA, 29 bp, Artificial Sequence
  Description of Artificial Sequence: Synthetic oligonucleotide
caaagacacatgtgacccaccaccccatc

SEQ ID NO: 371651 - DNA, 30 bp, Artificial Sequence; identical to SEQ ID NO: 22360
  Description of Artificial Sequence: Synthetic oligonucleotide

SEQ ID NO: 371652 - DNA, 29 bp, Artificial Sequence
  Description of Artificial Sequence: Synthetic oligonucleotide
aagacacatgtgacccaccaccccatctc

SEQ ID NO: 371653 - DNA, 28 bp, Artificial Sequence
  Description of Artificial Sequence: Synthetic oligonucleotide
agacacatgtgacccaccaccccatctc

SEQ ID NO: 371654 - DNA, 27 bp, Artificial Sequence
  Description of Artificial Sequence: Synthetic oligonucleotide
gacacatgtgacccaccaccccatctc

SEQ ID NO: 371655 - DNA, 28 bp, Artificial Sequence
  Description of Artificial Sequence: Synthetic oligonucleotide
acacatgtgacccaccaccccatctctg

SEQ ID NO: 371656 - DNA, 27 bp, Artificial Sequence
  Description of Artificial Sequence: Synthetic oligonucleotide
cacatgtgacccaccaccccatctctg

SEQ ID NO: 371657 - DNA, 28 bp, Artificial Sequence
  Description of Artificial Sequence: Synthetic oligonucleotide
acatgtgacccaccaccccatctctgac

SEQ ID NO: 371658 - DNA, 27 bp, Artificial Sequence
  Description of Artificial Sequence: Synthetic oligonucleotide
catgtgacccaccaccccatctctgac

SEQ ID NO: 371659 - DNA, 27 bp, Artificial Sequence
  Description of Artificial Sequence: Synthetic oligonucleotide
atgtgacccaccaccccatctctgacc

SEQ ID NO: 371660 - DNA, 27 bp, Artificial Sequence
  Description of Artificial Sequence: Synthetic oligonucleotide
tgtgacccaccaccccatctctgacca

SEQ ID NO: 371661 - DNA, 27 bp, Artificial Sequence
  Description of Artificial Sequence: Synthetic oligonucleotide
gatggcgaggaccaaactcaggacacc

SEQ ID NO: 371662 - DNA, 27 bp, Artificial Sequence
  Description of Artificial Sequence: Synthetic oligonucleotide
atggcgaggaccaaactcaggacaccg

SEQ ID NO: 371663 - DNA, 27 bp, Artificial Sequence
  Description of Artificial Sequence: Synthetic oligonucleotide
tggcgaggaccaaactcaggacaccga

SEQ ID NO: 371664 - DNA, 26 bp, Artificial Sequence
  Description of Artificial Sequence: Synthetic oligonucleotide
ggcgaggaccaaactcaggacaccga

SEQ ID NO: 371665 - DNA, 26 bp, Artificial Sequence
  Description of Artificial Sequence: Synthetic oligonucleotide
gcgaggaccaaactcaggacaccgag

SEQ ID NO: 371666 - DNA, 27 bp, Artificial Sequence
  Description of Artificial Sequence: Synthetic oligonucleotide
cgaggaccaaactcaggacaccgagct

SEQ ID NO: 371667 - DNA, 28 bp, Artificial Sequence
  Description of Artificial Sequence: Synthetic oligonucleotide
gaggaccaaactcaggacaccgagcttg

SEQ ID NO: 371668 - DNA, 29 bp, Artificial Sequence
  Description of Artificial Sequence: Synthetic oligonucleotide
aggaccaaactcaggacaccgagcttgtg

SEQ ID NO: 371669 - DNA, 28 bp, Artificial Sequence
  Description of Artificial Sequence: Synthetic oligonucleotide
ggaccaaactcaggacaccgagcttgtg

SEQ ID NO: 371670 - DNA, 28 bp, Artificial Sequence
  Description of Artificial Sequence: Synthetic oligonucleotide
gaccaaactcaggacaccgagcttgtgg

SEQ ID NO: 371671 - DNA, 29 bp, Artificial Sequence
  Description of Artificial Sequence: Synthetic oligonucleotide
accaaactcaggacaccgagcttgtggag

SEQ ID NO: 371672 - DNA, 28 bp, Artificial Sequence
  Description of Artificial Sequence: Synthetic oligonucleotide
ccaaactcaggacaccgagcttgtggag

SEQ ID NO: 371673 - DNA, 29 bp, Artificial Sequence
  Description of Artificial Sequence: Synthetic oligonucleotide
caaactcaggacaccgagcttgtggagac

SEQ ID NO: 371674 - DNA, 29 bp, Artificial Sequence
  Description of Artificial Sequence: Synthetic oligonucleotide
aaactcaggacaccgagcttgtggagacc

SEQ ID NO: 371675 - DNA, 28 bp, Artificial Sequence
  Description of Artificial Sequence: Synthetic oligonucleotide
aactcaggacaccgagcttgtggagacc

SEQ ID NO: 371676 - DNA, 27 bp, Artificial Sequence
  Description of Artificial Sequence: Synthetic oligonucleotide
actcaggacaccgagcttgtggagacc

SEQ ID NO: 371677 - DNA, 27 bp, Artificial Sequence
  Description of Artificial Sequence: Synthetic oligonucleotide
ctcaggacaccgagcttgtggagacca

SEQ ID NO: 371678 - DNA, 27 bp, Artificial Sequence
  Description of Artificial Sequence: Synthetic oligonucleotide
tcaggacaccgagcttgtggagaccag

SEQ ID NO: 371679 - DNA, 27 bp, Artificial Sequence
  Description of Artificial Sequence: Synthetic oligonucleotide
caggacaccgagcttgtggagaccaga

SEQ ID NO: 371680 - DNA, 27 bp, Artificial Sequence
  Description of Artificial Sequence: Synthetic oligonucleotide
aggacaccgagcttgtggagaccagac

SEQ ID NO: 371681 - DNA, 26 bp, Artificial Sequence
  Description of Artificial Sequence: Synthetic oligonucleotide
ggacaccgagcttgtggagaccagac

SEQ ID NO: 371682 - DNA, 27 bp, Artificial Sequence
  Description of Artificial Sequence: Synthetic oligonucleotide
gacaccgagcttgtggagaccagacca

SEQ ID NO: 371683 - DNA, 27 bp, Artificial Sequence
  Description of Artificial Sequence: Synthetic oligonucleotide
acaccgagcttgtggagaccagaccag

SEQ ID NO: 371684 - DNA, 26 bp, Artificial Sequence
  Description of Artificial Sequence: Synthetic oligonucleotide
caccgagcttgtggagaccagaccag

SEQ ID NO: 371685 - DNA, 27 bp, Artificial Sequence
  Description of Artificial Sequence: Synthetic oligonucleotide
accgagcttgtggagaccagaccagca

SEQ ID NO: 371686 - DNA, 26 bp, Artificial Sequence
  Description of Artificial Sequence: Synthetic oligonucleotide
ccgagcttgtggagaccagaccagca

SEQ ID NO: 371687 - DNA, 26 bp, Artificial Sequence
  Description of Artificial Sequence: Synthetic oligonucleotide
cgagcttgtggagaccagaccagcag

SEQ ID NO: 371688 - DNA, 26 bp, Artificial Sequence
  Description of Artificial Sequence: Synthetic oligonucleotide
atcgccctgaatgaggacctgcgctc

SEQ ID NO: 371689 - DNA, 25 bp, Artificial Sequence
  Description of Artificial Sequence: Synthetic oligonucleotide
tcgccctgaatgaggacctgcgctc

SEQ ID NO: 371690 - DNA, 24 bp, Artificial Sequence
  Description of Artificial Sequence: Synthetic oligonucleotide
cgccctgaatgaggacctgcgctc

SEQ ID NO: 371691 - DNA, 25 bp, Artificial Sequence
  Description of Artificial Sequence: Synthetic oligonucleotide
gccctgaatgaggacctgcgctcct

SEQ ID NO: 371692 - DNA, 25 bp, Artificial Sequence
  Description of Artificial Sequence: Synthetic oligonucleotide
ccctgaatgaggacctgcgctcctg

SEQ ID NO: 371693 - DNA, 26 bp, Artificial Sequence
  Description of Artificial Sequence: Synthetic oligonucleotide
cctgaatgaggacctgcgctcctgga

SEQ ID NO: 371694 - DNA, 26 bp, Artificial Sequence
  Description of Artificial Sequence: Synthetic oligonucleotide
ctgaatgaggacctgcgctcctggac

SEQ ID NO: 371695 - DNA, 26 bp, Artificial Sequence
  Description of Artificial Sequence: Synthetic oligonucleotide
tgaatgaggacctgcgctcctggacc

SEQ ID NO: 371696 - DNA, 25 bp, Artificial Sequence
  Description of Artificial Sequence: Synthetic oligonucleotide
gaatgaggacctgcgctcctggacc

SEQ ID NO: 371697 - DNA, 25 bp, Artificial Sequence
  Description of Artificial Sequence: Synthetic oligonucleotide
aatgaggacctgcgctcctggaccg

SEQ ID NO: 371698 - DNA, 24 bp, Artificial Sequence
  Description of Artificial Sequence: Synthetic oligonucleotide
atgaggacctgcgctcctggaccg

SEQ ID NO: 371699 - DNA, 23 bp, Artificial Sequence
  Description of Artificial Sequence: Synthetic oligonucleotide
tgaggacctgcgctcctggaccg

SEQ ID NO: 371700 - DNA, 22 bp, Artificial Sequence
  Description of Artificial Sequence: Synthetic oligonucleotide
cgcgagtccgagagaggagccc

SEQ ID NO: 371701 - DNA, 22 bp, Artificial Sequence
  Description of Artificial Sequence: Synthetic oligonucleotide
gcgagtccgagagaggagcccc

SEQ ID NO: 371702 - DNA, 22 bp, Artificial Sequence
  Description of Artificial Sequence: Synthetic oligonucleotide
cgagtccgagagaggagccccg

SEQ ID NO: 371703 - DNA, 22 bp, Artificial Sequence
  Description of Artificial Sequence: Synthetic oligonucleotide
gagtccgagagaggagccccgg

SEQ ID NO: 371704 - DNA, 22 bp, Artificial Sequence
  Description of Artificial Sequence: Synthetic oligonucleotide
agtccgagagaggagccccggg

SEQ ID NO: 371705 - DNA, 21 bp, Artificial Sequence
  Description of Artificial Sequence: Synthetic oligonucleotide
gtccgagagaggagccccggg

SEQ ID NO: 371706 - DNA, 21 bp, Artificial Sequence
  Description of Artificial Sequence: Synthetic oligonucleotide
tccgagagaggagccccgggc

SEQ ID NO: 371707 - DNA, 20 bp, Artificial Sequence
  Description of Artificial Sequence: Synthetic oligonucleotide
ccgagagaggagccccgggc

SEQ ID NO: 371708 - DNA, 20 bp, Artificial Sequence
  Description of Artificial Sequence: Synthetic oligonucleotide
cgagagaggagccccgggcg

SEQ ID NO: 371709 - DNA, 20 bp, Artificial Sequence
  Description of Artificial Sequence: Synthetic oligonucleotide
gagagaggagccccgggcgc

SEQ ID NO: 371710 - DNA, 20 bp, Artificial Sequence
  Description of Artificial Sequence: Synthetic oligonucleotide
agagaggagccccgggcgcc

SEQ ID NO: 371711 - DNA, 20 bp, Artificial Sequence
  Description of Artificial Sequence: Synthetic oligonucleotide
gagaggagccccgggcgcct

SEQ ID NO: 371712 - DNA, 20 bp, Artificial Sequence
  Description of Artificial Sequence: Synthetic oligonucleotide
agaggagccccgggcgccgt

SEQ ID NO: 371713 - DNA, 20 bp, Artificial Sequence
  Description of Artificial Sequence: Synthetic oligonucleotide
gaggagccccgggcgccgtt

SEQ ID NO: 371714 - DNA, 20 bp, Artificial Sequence
  Description of Artificial Sequence: Synthetic oligonucleotide
aggagccccgggcgccgtgt

SEQ ID NO: 371715 - DNA, 27 bp, Artificial Sequence
  Description of Artificial Sequence: Synthetic oligonucleotide
caccccatctctgaccatgaggccaca

SEQ ID NO: 371716 - DNA, 27 bp, Artificial Sequence
  Description of Artificial Sequence: Synthetic oligonucleotide
accccatctctgaccatgaggccacac

SEQ ID NO: 371717 - DNA, 27 bp, Artificial Sequence
  Description of Artificial Sequence: Synthetic oligonucleotide
ccccatctctgaccatgaggccacact

SEQ ID NO: 371718 - DNA, 27 bp, Artificial Sequence
  Description of Artificial Sequence: Synthetic oligonucleotide
cccatctctgaccatgaggccacactg

SEQ ID NO: 371719 - DNA, 28 bp, Artificial Sequence
  Description of Artificial Sequence: Synthetic oligonucleotide
ccatctctgaccatgaggccacactgag

SEQ ID NO: 371720 - DNA, 28 bp, Artificial Sequence
  Description of Artificial Sequence: Synthetic oligonucleotide
catctctgaccatgaggccacactgagg

SEQ ID NO: 371721 - DNA, 29 bp, Artificial Sequence
  Description of Artificial Sequence: Synthetic oligonucleotide
atctctgaccatgaggccacactgaggtg

SEQ ID NO: 371722 - DNA, 28 bp, Artificial Sequence
  Description of Artificial Sequence: Synthetic oligonucleotide
tctctgaccatgaggccacactgaggtg

SEQ ID NO: 371723 - DNA, 27 bp, Artificial Sequence
  Description of Artificial Sequence: Synthetic oligonucleotide
ctctgaccatgaggccacactgaggtg

SEQ ID NO: 371724 - DNA, 27 bp, Artificial Sequence
  Description of Artificial Sequence: Synthetic oligonucleotide
tctgaccatgaggccacactgaggtgc

SEQ ID NO: 371725 - DNA, 27 bp, Artificial Sequence
  Description of Artificial Sequence: Synthetic oligonucleotide
ctgaccatgaggccacactgaggtgct

SEQ ID NO: 371726 - DNA, 27 bp, Artificial Sequence
  Description of Artificial Sequence: Synthetic oligonucleotide
tgaccatgaggccacactgaggtgctg

SEQ ID NO: 371727 - DNA, 26 bp, Artificial Sequence
  Description of Artificial Sequence: Synthetic oligonucleotide
gaccatgaggccacactgaggtgctg

SEQ ID NO: 371728 - DNA, 26 bp, Artificial Sequence
  Description of Artificial Sequence: Synthetic oligonucleotide
accatgaggccacactgaggtgctgg

SEQ ID NO: 371729 - DNA, 25 bp, Artificial Sequence
  Description of Artificial Sequence: Synthetic oligonucleotide
ccatgaggccacactgaggtgctgg

SEQ ID NO: 371730 - DNA, 25 bp, Artificial Sequence
  Description of Artificial Sequence: Synthetic oligonucleotide
catgaggccacactgaggtgctggg

SEQ ID NO: 371731 - DNA, 25 bp, Artificial Sequence
  Description of Artificial Sequence: Synthetic oligonucleotide
atgaggccacactgaggtgctgggc

SEQ ID NO: 371732 - DNA, 24 bp, Artificial Sequence
  Description of Artificial Sequence: Synthetic oligonucleotide
tgaggccacactgaggtgctgggc

SEQ ID NO: 371733 - DNA, 23 bp, Artificial Sequence
  Description of Artificial Sequence: Synthetic oligonucleotide
gaggccacactgaggtgctgggc

SEQ ID NO: 371734 - DNA, 23 bp, Artificial Sequence
  Description of Artificial Sequence: Synthetic oligonucleotide
aggccacactgaggtgctgggcc

SEQ ID NO: 371735 - DNA, 22 bp, Artificial Sequence
  Description of Artificial Sequence: Synthetic oligonucleotide
ggccacactgaggtgctgggcc

SEQ ID NO: 371736 - DNA, 23 bp, Artificial Sequence
  Description of Artificial Sequence: Synthetic oligonucleotide
gccacactgaggtgctgggccct

SEQ ID NO: 371737 - DNA, 23 bp, Artificial Sequence
  Description of Artificial Sequence: Synthetic oligonucleotide
ccacactgaggtgctgggccctg

SEQ ID NO: 371738 - DNA, 23 bp, Artificial Sequence
  Description of Artificial Sequence: Synthetic oligonucleotide
cacactgaggtgctgggccctgg

SEQ ID NO: 371739 - DNA, 26 bp, Artificial Sequence
  Description of Artificial Sequence: Synthetic oligonucleotide
acactgaggtgctgggccctgggttt

SEQ ID NO: 371740 - DNA, 25 bp, Artificial Sequence
  Description of Artificial Sequence: Synthetic oligonucleotide
cactgaggtgctgggccctgggttt

SEQ ID NO: 371741 - DNA, 27 bp, Artificial Sequence
  Description of Artificial Sequence: Synthetic oligonucleotide
actgaggtgctgggccctgggtttcta

SEQ ID NO: 371742 - DNA, 20 bp, Artificial Sequence
  Description of Artificial Sequence: Synthetic oligonucleotide
gccggacgggcgcctccttc

SEQ ID NO: 371743 - DNA, 20 bp, Artificial Sequence
  Description of Artificial Sequence: Synthetic oligonucleotide
ccggacgggcgcctccttcg

SEQ ID NO: 371744 - DNA, 20 bp, Artificial Sequence
  Description of Artificial Sequence: Synthetic oligonucleotide
cggacgggcgcctccttcgc

SEQ ID NO: 371745 - DNA, 20 bp, Artificial Sequence
  Description of Artificial Sequence: Synthetic oligonucleotide
ggacgggcgcctccttcgcg

SEQ ID NO: 371746 - DNA, 20 bp, Artificial Sequence
  Description of Artificial Sequence: Synthetic oligonucleotide
gacgggcgcctccttcgcgg

SEQ ID NO: 371747 - DNA, 20 bp, Artificial Sequence
  Description of Artificial Sequence: Synthetic oligonucleotide
acgggcgcctccttcgcggg

SEQ ID NO: 371748 - DNA, 20 bp, Artificial Sequence
  Description of Artificial Sequence: Synthetic oligonucleotide
cgggcgcctccttcgcgggt

SEQ ID NO: 371749 - DNA, 21 bp, Artificial Sequence
  Description of Artificial Sequence: Synthetic oligonucleotide
gggcgcctccttcgcgggcat

SEQ ID NO: 371750 - DNA, 22 bp, Artificial Sequence
  Description of Artificial Sequence: Synthetic oligonucleotide
ggcgcctccttcgcgggcatga

SEQ ID NO: 371751 - DNA, 22 bp, Artificial Sequence
  Description of Artificial Sequence: Synthetic oligonucleotide
gcgcctccttcgcgggcatgac

SEQ ID NO: 371752 - DNA, 23 bp, Artificial Sequence
  Description of Artificial Sequence: Synthetic oligonucleotide
cgcctccttcgcgggcatgacca

SEQ ID NO: 371753 - DNA, 25 bp, Artificial Sequence
  Description of Artificial Sequence: Synthetic oligonucleotide
gcctccttcgcgggcatgaccagta

SEQ ID NO: 371754 - DNA, 25 bp, Artificial Sequence
  Description of Artificial Sequence: Synthetic oligonucleotide
cctccttcgcgggcatgaccagtac

SEQ ID NO: 371755 - DNA, 25 bp, Artificial Sequence
  Description of Artificial Sequence: Synthetic oligonucleotide
ctccttcgcgggcatgaccagtacg

SEQ ID NO: 371756 - DNA, 25 bp, Artificial Sequence
  Description of Artificial Sequence: Synthetic oligonucleotide
tccttcgcgggcatgaccagtacgc

SEQ ID NO: 371757 - DNA, 24 bp, Artificial Sequence
  Description of Artificial Sequence: Synthetic oligonucleotide
ccttcgcgggcatgaccagtacgc

SEQ ID NO: 371758 - DNA, 26 bp, Artificial Sequence
  Description of Artificial Sequence: Synthetic oligonucleotide
cttcgcgggcatgaccagtacgccta

SEQ ID NO: 371759 - DNA, 26 bp, Artificial Sequence
  Description of Artificial Sequence: Synthetic oligonucleotide
ttcgcgggcatgaccagtacgcctac

SEQ ID NO: 371760 - DNA, 25 bp, Artificial Sequence
  Description of Artificial Sequence: Synthetic oligonucleotide
tcgcgggcatgaccagtacgcctac

SEQ ID NO: 371761 - DNA, 28 bp, Artificial Sequence
  Description of Artificial Sequence: Synthetic oligonucleotide
catgaccagtacgcctacgacggcaaag

SEQ ID NO: 371762 - DNA, 32 bp, Artificial Sequence; identical to SEQ ID NO: 22478
  Description of Artificial Sequence: Synthetic oligonucleotide

SEQ ID NO: 371763 - DNA, 31 bp, Artificial Sequence; identical to SEQ ID NO: 22479
  Description of Artificial Sequence: Synthetic oligonucleotide

SEQ ID NO: 371764 - DNA, 30 bp, Artificial Sequence; identical to SEQ ID NO: 22480
  Description of Artificial Sequence: Synthetic oligonucleotide

SEQ ID NO: 371765 - DNA, 32 bp, Artificial Sequence; identical to SEQ ID NO: 22481
  Description of Artificial Sequence: Synthetic oligonucleotide

SEQ ID NO: 371766 - DNA, 31 bp, Artificial Sequence; identical to SEQ ID NO: 22482
  Description of Artificial Sequence: Synthetic oligonucleotide

SEQ ID NO: 371767 - DNA, 31 bp, Artificial Sequence; identical to SEQ ID NO: 22483
  Description of Artificial Sequence: Synthetic oligonucleotide

SEQ ID NO: 371768 - DNA, 31 bp, Artificial Sequence; identical to SEQ ID NO: 22484
  Description of Artificial Sequence: Synthetic oligonucleotide

SEQ ID NO: 371769 - DNA, 30 bp, Artificial Sequence; identical to SEQ ID NO: 22485
  Description of Artificial Sequence: Synthetic oligonucleotide

SEQ ID NO: 371770 - DNA, 30 bp, Artificial Sequence; identical to SEQ ID NO: 22486
  Description of Artificial Sequence: Synthetic oligonucleotide

SEQ ID NO: 371771 - DNA, 29 bp, Artificial Sequence
  Description of Artificial Sequence: Synthetic oligonucleotide
acgcctacgacggcaaagattacatcgcc

SEQ ID NO: 371772 - DNA, 28 bp, Artificial Sequence
  Description of Artificial Sequence: Synthetic oligonucleotide
cgcctacgacggcaaagattacatcgcc

SEQ ID NO: 371773 - DNA, 28 bp, Artificial Sequence
  Description of Artificial Sequence: Synthetic oligonucleotide
gcctacgacggcaaagattacatcgccc

SEQ ID NO: 371774 - DNA, 29 bp, Artificial Sequence
  Description of Artificial Sequence: Synthetic oligonucleotide
cctacgacggcaaagattacatcgccctg

SEQ ID NO: 371775 - DNA, 31 bp, Artificial Sequence; identical to SEQ ID NO: 22491
  Description of Artificial Sequence: Synthetic oligonucleotide

SEQ ID NO: 371776 - DNA, 31 bp, Artificial Sequence; identical to SEQ ID NO: 22492
  Description of Artificial Sequence: Synthetic oligonucleotide

SEQ ID NO: 371777 - DNA, 30 bp, Artificial Sequence; identical to SEQ ID NO: 22493
  Description of Artificial Sequence: Synthetic oligonucleotide

SEQ ID NO: 371778 - DNA, 29 bp, Artificial Sequence
  Description of Artificial Sequence: Synthetic oligonucleotide
cgacggcaaagattacatcgccctgaacg

SEQ ID NO: 371779 - DNA, 30 bp, Artificial Sequence; identical to SEQ ID NO: 22495
  Description of Artificial Sequence: Synthetic oligonucleotide

SEQ ID NO: 371780 - DNA, 30 bp, Artificial Sequence; identical to SEQ ID NO: 22496
  Description of Artificial Sequence: Synthetic oligonucleotide

SEQ ID NO: 371781 - DNA, 29 bp, Artificial Sequence
  Description of Artificial Sequence: Synthetic oligonucleotide
cggcaaagattacatcgccctgaacgagg

SEQ ID NO: 371782 - DNA, 30 bp, Artificial Sequence; identical to SEQ ID NO: 22498
  Description of Artificial Sequence: Synthetic oligonucleotide

SEQ ID NO: 371783 - DNA, 30 bp, Artificial Sequence; identical to SEQ ID NO: 22499
  Description of Artificial Sequence: Synthetic oligonucleotide

SEQ ID NO: 371784 - DNA, 31 bp, Artificial Sequence; identical to SEQ ID NO: 22500
  Description of Artificial Sequence: Synthetic oligonucleotide

SEQ ID NO: 371785 - DNA, 31 bp, Artificial Sequence; identical to SEQ ID NO: 22501
  Description of Artificial Sequence: Synthetic oligonucleotide

SEQ ID NO: 371786 - DNA, 30 bp, Artificial Sequence; identical to SEQ ID NO: 22502
  Description of Artificial Sequence: Synthetic oligonucleotide

SEQ ID NO: 371787 - DNA, 29 bp, Artificial Sequence
  Description of Artificial Sequence: Synthetic oligonucleotide
agattacatcgccctgaacgaggacctgc

SEQ ID NO: 371788 - DNA, 20 bp, Artificial Sequence
  Description of Artificial Sequence: Synthetic oligonucleotide
acgtggggccggatgggcgc

SEQ ID NO: 371789 - DNA, 20 bp, Artificial Sequence
  Description of Artificial Sequence: Synthetic oligonucleotide
cgtggggccggatgggcgct

SEQ ID NO: 371790 - DNA, 20 bp, Artificial Sequence
  Description of Artificial Sequence: Synthetic oligonucleotide
gtggggccggatgggcgcct

SEQ ID NO: 371791 - DNA, 20 bp, Artificial Sequence
  Description of Artificial Sequence: Synthetic oligonucleotide
tggggccggatgggcgcctc

SEQ ID NO: 371792 - DNA, 20 bp, Artificial Sequence
  Description of Artificial Sequence: Synthetic oligonucleotide
ggggccggatgggcgcctct

SEQ ID NO: 371793 - DNA, 20 bp, Artificial Sequence
  Description of Artificial Sequence: Synthetic oligonucleotide
gggccggatgggcgcctcct

SEQ ID NO: 371794 - DNA, 20 bp, Artificial Sequence
  Description of Artificial Sequence: Synthetic oligonucleotide
ggccggatgggcgcctcctc

SEQ ID NO: 371795 - DNA, 20 bp, Artificial Sequence
  Description of Artificial Sequence: Synthetic oligonucleotide
gccggatgggcgcctcctcc

SEQ ID NO: 371796 - DNA, 20 bp, Artificial Sequence
  Description of Artificial Sequence: Synthetic oligonucleotide
ccggatgggcgcctcctccg

SEQ ID NO: 371797 - DNA, 20 bp, Artificial Sequence
  Description of Artificial Sequence: Synthetic oligonucleotide
cggatgggcgcctcctccgc

SEQ ID NO: 371798 - DNA, 20 bp, Artificial Sequence
  Description of Artificial Sequence: Synthetic oligonucleotide
ggatgggcgcctcctccgcg

SEQ ID NO: 371799 - DNA, 20 bp, Artificial Sequence
  Description of Artificial Sequence: Synthetic oligonucleotide
gatgggcgcctcctccgcgg

SEQ ID NO: 371800 - DNA, 20 bp, Artificial Sequence
  Description of Artificial Sequence: Synthetic oligonucleotide
atgggcgcctcctccgcggg

SEQ ID NO: 371801 - DNA, 20 bp, Artificial Sequence
  Description of Artificial Sequence: Synthetic oligonucleotide
tgggcgcctcctccgcgggt

SEQ ID NO: 371802 - DNA, 21 bp, Artificial Sequence
  Description of Artificial Sequence: Synthetic oligonucleotide
tcctggaccgccgcggacacc

SEQ ID NO: 371803 - DNA, 20 bp, Artificial Sequence
  Description of Artificial Sequence: Synthetic oligonucleotide
cctggaccgccgcggacacc

SEQ ID NO: 371804 - DNA, 20 bp, Artificial Sequence
  Description of Artificial Sequence: Synthetic oligonucleotide
ctggaccgccgcggacaccg

SEQ ID NO: 371805 - DNA, 20 bp, Artificial Sequence
  Description of Artificial Sequence: Synthetic oligonucleotide
tggaccgccgcggacaccgc

SEQ ID NO: 371806 - DNA, 20 bp, Artificial Sequence
  Description of Artificial Sequence: Synthetic oligonucleotide
ggaccgccgcggacaccgct

SEQ ID NO: 371807 - DNA, 20 bp, Artificial Sequence
  Description of Artificial Sequence: Synthetic oligonucleotide
gaccgccgcggacaccgcgt

SEQ ID NO: 371808 - DNA, 20 bp, Artificial Sequence
  Description of Artificial Sequence: Synthetic oligonucleotide
accgccgcggacaccgcggt

SEQ ID NO: 371809 - DNA, 20 bp, Artificial Sequence
  Description of Artificial Sequence: Synthetic oligonucleotide
ccgccgcggacaccgcggtt

SEQ ID NO: 371810 - DNA, 20 bp, Artificial Sequence
  Description of Artificial Sequence: Synthetic oligonucleotide
cgccgcggacaccgcggctt

SEQ ID NO: 371811 - DNA, 20 bp, Artificial Sequence
  Description of Artificial Sequence: Synthetic oligonucleotide
gccgcggacaccgcggctca

SEQ ID NO: 371812 - DNA, 22 bp, Artificial Sequence
  Description of Artificial Sequence: Synthetic oligonucleotide
ccgcggacaccgcggctcagat

SEQ ID NO: 371813 - DNA, 23 bp, Artificial Sequence
  Description of Artificial Sequence: Synthetic oligonucleotide
cgcggacaccgcggctcagatca

SEQ ID NO: 371814 - DNA, 23 bp, Artificial Sequence
  Description of Artificial Sequence: Synthetic oligonucleotide
gcggacaccgcggctcagatcac

SEQ ID NO: 371815 - DNA, 23 bp, Artificial Sequence
  Description of Artificial Sequence: Synthetic oligonucleotide
cggacaccgcggctcagatcacc

SEQ ID NO: 371816 - DNA, 24 bp, Artificial Sequence
  Description of Artificial Sequence: Synthetic oligonucleotide
ggacaccgcggctcagatcaccca

SEQ ID NO: 371817 - DNA, 24 bp, Artificial Sequence
  Description of Artificial Sequence: Synthetic oligonucleotide
gacaccgcggctcagatcacccag

SEQ ID NO: 371818 - DNA, 24 bp, Artificial Sequence
  Description of Artificial Sequence: Synthetic oligonucleotide
acaccgcggctcagatcacccagc

SEQ ID NO: 371819 - DNA, 23 bp, Artificial Sequence
  Description of Artificial Sequence: Synthetic oligonucleotide
caccgcggctcagatcacccagc

SEQ ID NO: 371820 - DNA, 23 bp, Artificial Sequence
  Description of Artificial Sequence: Synthetic oligonucleotide
accgcggctcagatcacccagcg

SEQ ID NO: 371821 - DNA, 22 bp, Artificial Sequence
  Description of Artificial Sequence: Synthetic oligonucleotide
ccgcggctcagatcacccagcg

SEQ ID NO: 371822 - DNA, 24 bp, Artificial Sequence
  Description of Artificial Sequence: Synthetic oligonucleotide
cgcggctcagatcacccagcgcaa

SEQ ID NO: 371823 - DNA, 21 bp, Artificial Sequence
  Description of Artificial Sequence: Synthetic oligonucleotide
gctcctggaccgcggcggaca

SEQ ID NO: 371824 - DNA, 21 bp, Artificial Sequence
  Description of Artificial Sequence: Synthetic oligonucleotide
ctcctggaccgcggcggacac

SEQ ID NO: 371825 - DNA, 21 bp, Artificial Sequence
  Description of Artificial Sequence: Synthetic oligonucleotide
tcctggaccgcggcggacacg

SEQ ID NO: 371826 - DNA, 20 bp, Artificial Sequence
  Description of Artificial Sequence: Synthetic oligonucleotide
cctggaccgcggcggacacg

SEQ ID NO: 371827 - DNA, 20 bp, Artificial Sequence
  Description of Artificial Sequence: Synthetic oligonucleotide
ctggaccgcggcggacacgg

SEQ ID NO: 371828 - DNA, 20 bp, Artificial Sequence
  Description of Artificial Sequence: Synthetic oligonucleotide
tggaccgcggcggacacggc

SEQ ID NO: 371829 - DNA, 20 bp, Artificial Sequence
  Description of Artificial Sequence: Synthetic oligonucleotide
ggaccgcggcggacacggct

SEQ ID NO: 371830 - DNA, 20 bp, Artificial Sequence
  Description of Artificial Sequence: Synthetic oligonucleotide
gaccgcggcggacacggcgt

SEQ ID NO: 371831 - DNA, 20 bp, Artificial Sequence
  Description of Artificial Sequence: Synthetic oligonucleotide
accgcggcggacacggcggt

SEQ ID NO: 371832 - DNA, 20 bp, Artificial Sequence
  Description of Artificial Sequence: Synthetic oligonucleotide
ccgcggcggacacggcggtt

SEQ ID NO: 371833 - DNA, 20 bp, Artificial Sequence
  Description of Artificial Sequence: Synthetic oligonucleotide
cgcggcggacacggcggctt

SEQ ID NO: 371834 - DNA, 20 bp, Artificial Sequence
  Description of Artificial Sequence: Synthetic oligonucleotide
gcggcggacacggcggctca

SEQ ID NO: 371835 - DNA, 22 bp, Artificial Sequence
  Description of Artificial Sequence: Synthetic oligonucleotide
cggcggacacggcggctcagat

SEQ ID NO: 371836 - DNA, 23 bp, Artificial Sequence
  Description of Artificial Sequence: Synthetic oligonucleotide
ggcggacacggcggctcagatca

SEQ ID NO: 371837 - DNA, 24 bp, Artificial Sequence
  Description of Artificial Sequence: Synthetic oligonucleotide
cagcggagagcctacctggagggt

SEQ ID NO: 371838 - DNA, 25 bp, Artificial Sequence
  Description of Artificial Sequence: Synthetic oligonucleotide
agcggagagcctacctggagggtga

SEQ ID NO: 371839 - DNA, 24 bp, Artificial Sequence
  Description of Artificial Sequence: Synthetic oligonucleotide
gcggagagcctacctggagggtga

SEQ ID NO: 371840 - DNA, 25 bp, Artificial Sequence
  Description of Artificial Sequence: Synthetic oligonucleotide
cggagagcctacctggagggtgagt

SEQ ID NO: 371841 - DNA, 25 bp, Artificial Sequence
  Description of Artificial Sequence: Synthetic oligonucleotide
ggagagcctacctggagggtgagtg

SEQ ID NO: 371842 - DNA, 25 bp, Artificial Sequence
  Description of Artificial Sequence: Synthetic oligonucleotide
gagagcctacctggagggtgagtgc

SEQ ID NO: 371843 - DNA, 26 bp, Artificial Sequence
  Description of Artificial Sequence: Synthetic oligonucleotide
agagcctacctggagggtgagtgcgt

SEQ ID NO: 371844 - DNA, 25 bp, Artificial Sequence
  Description of Artificial Sequence: Synthetic oligonucleotide
gagcctacctggagggtgagtgcgt

SEQ ID NO: 371845 - DNA, 25 bp, Artificial Sequence
  Description of Artificial Sequence: Synthetic oligonucleotide
agcctacctggagggtgagtgcgtg

SEQ ID NO: 371846 - DNA, 24 bp, Artificial Sequence
  Description of Artificial Sequence: Synthetic oligonucleotide
gcctacctggagggtgagtgcgtg

SEQ ID NO: 371847 - DNA, 25 bp, Artificial Sequence
  Description of Artificial Sequence: Synthetic oligonucleotide
cctacctggagggtgagtgcgtgga

SEQ ID NO: 371848 - DNA, 26 bp, Artificial Sequence
  Description of Artificial Sequence: Synthetic oligonucleotide
ctacctggagggtgagtgcgtggagt

SEQ ID NO: 371849 - DNA, 26 bp, Artificial Sequence
  Description of Artificial Sequence: Synthetic oligonucleotide
tacctggagggtgagtgcgtggagtg

SEQ ID NO: 371850 - DNA, 25 bp, Artificial Sequence
  Description of Artificial Sequence: Synthetic oligonucleotide
acctggagggtgagtgcgtggagtg

SEQ ID NO: 371851 - DNA, 24 bp, Artificial Sequence
  Description of Artificial Sequence: Synthetic oligonucleotide
cctggagggtgagtgcgtggagtg

SEQ ID NO: 371852 - DNA, 24 bp, Artificial Sequence
  Description of Artificial Sequence: Synthetic oligonucleotide
ctggagggtgagtgcgtggagtgg

SEQ ID NO: 371853 - DNA, 25 bp, Artificial Sequence
  Description of Artificial Sequence: Synthetic oligonucleotide
tggagggtgagtgcgtggagtggct

SEQ ID NO: 371854 - DNA, 24 bp, Artificial Sequence
  Description of Artificial Sequence: Synthetic oligonucleotide
ggagggtgagtgcgtggagtggct

SEQ ID NO: 371855 - DNA, 24 bp, Artificial Sequence
  Description of Artificial Sequence: Synthetic oligonucleotide
gagggtgagtgcgtggagtggctc

SEQ ID NO: 371856 - DNA, 24 bp, Artificial Sequence
  Description of Artificial Sequence: Synthetic oligonucleotide
agggtgagtgcgtggagtggctcc

SEQ ID NO: 371857 - DNA, 23 bp, Artificial Sequence
  Description of Artificial Sequence: Synthetic oligonucleotide
gggtgagtgcgtggagtggctcc

SEQ ID NO: 371858 - DNA, 23 bp, Artificial Sequence
  Description of Artificial Sequence: Synthetic oligonucleotide
ggtgagtgcgtggagtggctccg

SEQ ID NO: 371859 - DNA, 24 bp, Artificial Sequence
  Description of Artificial Sequence: Synthetic oligonucleotide
gtgagtgcgtggagtggctccgca

SEQ ID NO: 371860 - DNA, 27 bp, Artificial Sequence
  Description of Artificial Sequence: Synthetic oligonucleotide
tgagtgcgtggagtggctccgcagata

SEQ ID NO: 371861 - DNA, 27 bp, Artificial Sequence
  Description of Artificial Sequence: Synthetic oligonucleotide
cctgcggaacctgcgcggctactataa

SEQ ID NO: 371862 - DNA, 27 bp, Artificial Sequence
  Description of Artificial Sequence: Synthetic oligonucleotide
ctgcggaacctgcgcggctactataac

SEQ ID NO: 371863 - DNA, 27 bp, Artificial Sequence
  Description of Artificial Sequence: Synthetic oligonucleotide
tgcggaacctgcgcggctactataacc

SEQ ID NO: 371864 - DNA, 27 bp, Artificial Sequence
  Description of Artificial Sequence: Synthetic oligonucleotide
gcggaacctgcgcggctactataacca

SEQ ID NO: 371865 - DNA, 27 bp, Artificial Sequence
  Description of Artificial Sequence: Synthetic oligonucleotide
cggaacctgcgcggctactataaccag

SEQ ID NO: 371866 - DNA, 28 bp, Artificial Sequence
  Description of Artificial Sequence: Synthetic oligonucleotide
ggaacctgcgcggctactataaccagag

SEQ ID NO: 371867 - DNA, 28 bp, Artificial Sequence
  Description of Artificial Sequence: Synthetic oligonucleotide
gaacctgcgcggctactataaccagagc

SEQ ID NO: 371868 - DNA, 28 bp, Artificial Sequence
  Description of Artificial Sequence: Synthetic oligonucleotide
aacctgcgcggctactataaccagagcg

SEQ ID NO: 371869 - DNA, 27 bp, Artificial Sequence
  Description of Artificial Sequence: Synthetic oligonucleotide
acctgcgcggctactataaccagagcg

SEQ ID NO: 371870 - DNA, 27 bp, Artificial Sequence
  Description of Artificial Sequence: Synthetic oligonucleotide
cctgcgcggctactataaccagagcga

SEQ ID NO: 371871 - DNA, 27 bp, Artificial Sequence
  Description of Artificial Sequence: Synthetic oligonucleotide
ctgcgcggctactataaccagagcgag

SEQ ID NO: 371872 - DNA, 27 bp, Artificial Sequence
  Description of Artificial Sequence: Synthetic oligonucleotide
tgcgcggctactataaccagagcgagg

SEQ ID NO: 371873 - DNA, 26 bp, Artificial Sequence
  Description of Artificial Sequence: Synthetic oligonucleotide
gcgcggctactataaccagagcgagg

SEQ ID NO: 371874 - DNA, 26 bp, Artificial Sequence
  Description of Artificial Sequence: Synthetic oligonucleotide
cgcggctactataaccagagcgaggc

SEQ ID NO: 371875 - DNA, 26 bp, Artificial Sequence
  Description of Artificial Sequence: Synthetic oligonucleotide
gcggctactataaccagagcgaggcc

SEQ ID NO: 371876 - DNA, 26 bp, Artificial Sequence
  Description of Artificial Sequence: Synthetic oligonucleotide
cggctactataaccagagcgaggccg

SEQ ID NO: 371877 - DNA, 26 bp, Artificial Sequence
  Description of Artificial Sequence: Synthetic oligonucleotide
ggctactataaccagagcgaggccgg

SEQ ID NO: 371878 - DNA, 27 bp, Artificial Sequence
  Description of Artificial Sequence: Synthetic oligonucleotide
gctactataaccagagcgaggccgggt

SEQ ID NO: 371879 - DNA, 27 bp, Artificial Sequence
  Description of Artificial Sequence: Synthetic oligonucleotide
ctactataaccagagcgaggccgggtc

SEQ ID NO: 371880 - DNA, 28 bp, Artificial Sequence
  Description of Artificial Sequence: Synthetic oligonucleotide
tactataaccagagcgaggccgggtctc

SEQ ID NO: 371881 - DNA, 27 bp, Artificial Sequence
  Description of Artificial Sequence: Synthetic oligonucleotide
actataaccagagcgaggccgggtctc

SEQ ID NO: 371882 - DNA, 27 bp, Artificial Sequence
  Description of Artificial Sequence: Synthetic oligonucleotide
ctataaccagagcgaggccgggtctca

SEQ ID NO: 371883 - DNA, 27 bp, Artificial Sequence
  Description of Artificial Sequence: Synthetic oligonucleotide
tataaccagagcgaggccgggtctcac

SEQ ID NO: 371884 - DNA, 27 bp, Artificial Sequence
  Description of Artificial Sequence: Synthetic oligonucleotide
ataaccagagcgaggccgggtctcaca

SEQ ID NO: 371885 - DNA, 26 bp, Artificial Sequence
  Description of Artificial Sequence: Synthetic oligonucleotide
taaccagagcgaggccgggtctcaca

SEQ ID NO: 371886 - DNA, 27 bp, Artificial Sequence
  Description of Artificial Sequence: Synthetic oligonucleotide
tctcacaccctccagagcatgtacggg

SEQ ID NO: 371887 - DNA, 27 bp, Artificial Sequence
  Description of Artificial Sequence: Synthetic oligonucleotide
ctcacaccctccagagcatgtacgggt

SEQ ID NO: 371888 - DNA, 27 bp, Artificial Sequence
  Description of Artificial Sequence: Synthetic oligonucleotide
tcacaccctccagagcatgtacgggtg

SEQ ID NO: 371889 - DNA, 26 bp, Artificial Sequence
  Description of Artificial Sequence: Synthetic oligonucleotide
cacaccctccagagcatgtacgggtg

SEQ ID NO: 371890 - DNA, 26 bp, Artificial Sequence
  Description of Artificial Sequence: Synthetic oligonucleotide
acaccctccagagcatgtacgggtgc

SEQ ID NO: 371891 - DNA, 25 bp, Artificial Sequence
  Description of Artificial Sequence: Synthetic oligonucleotide
caccctccagagcatgtacgggtgc

SEQ ID NO: 371892 - DNA, 26 bp, Artificial Sequence
  Description of Artificial Sequence: Synthetic oligonucleotide
accctccagagcatgtacgggtgcga

SEQ ID NO: 371893 - DNA, 25 bp, Artificial Sequence
  Description of Artificial Sequence: Synthetic oligonucleotide
ccctccagagcatgtacgggtgcga

SEQ ID NO: 371894 - DNA, 25 bp, Artificial Sequence
  Description of Artificial Sequence: Synthetic oligonucleotide
cctccagagcatgtacgggtgcgac

SEQ ID NO: 371895 - DNA, 26 bp, Artificial Sequence
  Description of Artificial Sequence: Synthetic oligonucleotide
ctccagagcatgtacgggtgcgacgt

SEQ ID NO: 371896 - DNA, 26 bp, Artificial Sequence
  Description of Artificial Sequence: Synthetic oligonucleotide
tccagagcatgtacgggtgcgacgtg

SEQ ID NO: 371897 - DNA, 25 bp, Artificial Sequence
  Description of Artificial Sequence: Synthetic oligonucleotide
ccagagcatgtacgggtgcgacgtg

SEQ ID NO: 371898 - DNA, 25 bp, Artificial Sequence
  Description of Artificial Sequence: Synthetic oligonucleotide
cagagcatgtacgggtgcgacgtgg

SEQ ID NO: 371899 - DNA, 25 bp, Artificial Sequence
  Description of Artificial Sequence: Synthetic oligonucleotide
agagcatgtacgggtgcgacgtggg

SEQ ID NO: 371900 - DNA, 24 bp, Artificial Sequence
  Description of Artificial Sequence: Synthetic oligonucleotide
gagcatgtacgggtgcgacgtggg

SEQ ID NO: 371901 - DNA, 24 bp, Artificial Sequence
  Description of Artificial Sequence: Synthetic oligonucleotide
agcatgtacgggtgcgacgtgggg

SEQ ID NO: 371902 - DNA, 23 bp, Artificial Sequence
  Description of Artificial Sequence: Synthetic oligonucleotide
gcatgtacgggtgcgacgtgggg

SEQ ID NO: 371903 - DNA, 23 bp, Artificial Sequence
  Description of Artificial Sequence: Synthetic oligonucleotide
catgtacgggtgcgacgtggggc

SEQ ID NO: 371904 - DNA, 23 bp, Artificial Sequence
  Description of Artificial Sequence: Synthetic oligonucleotide
atgtacgggtgcgacgtggggcc

SEQ ID NO: 371905 - DNA, 22 bp, Artificial Sequence
  Description of Artificial Sequence: Synthetic oligonucleotide
tgtacgggtgcgacgtggggcc

SEQ ID NO: 371906 - DNA, 21 bp, Artificial Sequence
  Description of Artificial Sequence: Synthetic oligonucleotide
gtacgggtgcgacgtggggcc

SEQ ID NO: 371907 - DNA, 21 bp, Artificial Sequence
  Description of Artificial Sequence: Synthetic oligonucleotide
tacgggtgcgacgtggggccg

SEQ ID NO: 371908 - DNA, 20 bp, Artificial Sequence
  Description of Artificial Sequence: Synthetic oligonucleotide
acgggtgcgacgtggggccg

SEQ ID NO: 371909 - DNA, 20 bp, Artificial Sequence
  Description of Artificial Sequence: Synthetic oligonucleotide
cgggtgcgacgtggggccgt

SEQ ID NO: 371910 - DNA, 20 bp, Artificial Sequence
  Description of Artificial Sequence: Synthetic oligonucleotide
gggtgcgacgtggggccgga

SEQ ID NO: 371911 - DNA, 20 bp, Artificial Sequence
  Description of Artificial Sequence: Synthetic oligonucleotide
ggtgcgacgtggggccggac

SEQ ID NO: 371912 - DNA, 20 bp, Artificial Sequence
  Description of Artificial Sequence: Synthetic oligonucleotide
gtgcgacgtggggccggacg

SEQ ID NO: 371913 - DNA, 20 bp, Artificial Sequence
  Description of Artificial Sequence: Synthetic oligonucleotide
ggacgggcgcctcctccgtg

SEQ ID NO: 371914 - DNA, 20 bp, Artificial Sequence
  Description of Artificial Sequence: Synthetic oligonucleotide
gacgggcgcctcctccgtgg

SEQ ID NO: 371915 - DNA, 20 bp, Artificial Sequence
  Description of Artificial Sequence: Synthetic oligonucleotide
acgggcgcctcctccgtggg

SEQ ID NO: 371916 - DNA, 20 bp, Artificial Sequence
  Description of Artificial Sequence: Synthetic oligonucleotide
cgggcgcctcctccgtgggt

SEQ ID NO: 371917 - DNA, 21 bp, Artificial Sequence
  Description of Artificial Sequence: Synthetic oligonucleotide
gggcgcctcctccgtgggcat

SEQ ID NO: 371918 - DNA, 22 bp, Artificial Sequence
  Description of Artificial Sequence: Synthetic oligonucleotide
ggcgcctcctccgtgggcatga

SEQ ID NO: 371919 - DNA, 22 bp, Artificial Sequence
  Description of Artificial Sequence: Synthetic oligonucleotide
gcgcctcctccgtgggcatgac

SEQ ID NO: 371920 - DNA, 23 bp, Artificial Sequence
  Description of Artificial Sequence: Synthetic oligonucleotide
cgcctcctccgtgggcatgacca

SEQ ID NO: 371921 - DNA, 25 bp, Artificial Sequence
  Description of Artificial Sequence: Synthetic oligonucleotide
gcctcctccgtgggcatgaccagta

SEQ ID NO: 371922 - DNA, 25 bp, Artificial Sequence
  Description of Artificial Sequence: Synthetic oligonucleotide
cctcctccgtgggcatgaccagtac

SEQ ID NO: 371923 - DNA, 25 bp, Artificial Sequence
  Description of Artificial Sequence: Synthetic oligonucleotide
ctcctccgtgggcatgaccagtacg

SEQ ID NO: 371924 - DNA, 25 bp, Artificial Sequence
  Description of Artificial Sequence: Synthetic oligonucleotide
tcctccgtgggcatgaccagtacgc

SEQ ID NO: 371925 - DNA, 24 bp, Artificial Sequence
  Description of Artificial Sequence: Synthetic oligonucleotide
cctccgtgggcatgaccagtacgc

SEQ ID NO: 371926 - DNA, 26 bp, Artificial Sequence
  Description of Artificial Sequence: Synthetic oligonucleotide
ctccgtgggcatgaccagtacgccta

SEQ ID NO: 371927 - DNA, 26 bp, Artificial Sequence
  Description of Artificial Sequence: Synthetic oligonucleotide
tccgtgggcatgaccagtacgcctac

SEQ ID NO: 371928 - DNA, 25 bp, Artificial Sequence
  Description of Artificial Sequence: Synthetic oligonucleotide
ccgtgggcatgaccagtacgcctac

SEQ ID NO: 371929 - DNA, 26 bp, Artificial Sequence
  Description of Artificial Sequence: Synthetic oligonucleotide
cgtgggcatgaccagtacgcctacga

SEQ ID NO: 371930 - DNA, 26 bp, Artificial Sequence
  Description of Artificial Sequence: Synthetic oligonucleotide
gtgggcatgaccagtacgcctacgac

SEQ ID NO: 371931 - DNA, 26 bp, Artificial Sequence
  Description of Artificial Sequence: Synthetic oligonucleotide
tgggcatgaccagtacgcctacgacg

SEQ ID NO: 371932 - DNA, 26 bp, Artificial Sequence
  Description of Artificial Sequence: Synthetic oligonucleotide
gctacgtggacgacacccagttcgtg

SEQ ID NO: 371933 - DNA, 26 bp, Artificial Sequence
  Description of Artificial Sequence: Synthetic oligonucleotide
ctacgtggacgacacccagttcgtgc

SEQ ID NO: 371934 - DNA, 26 bp, Artificial Sequence
  Description of Artificial Sequence: Synthetic oligonucleotide
tacgtggacgacacccagttcgtgcg

SEQ ID NO: 371935 - DNA, 25 bp, Artificial Sequence
  Description of Artificial Sequence: Synthetic oligonucleotide
acgtggacgacacccagttcgtgcg

SEQ ID NO: 371936 - DNA, 24 bp, Artificial Sequence
  Description of Artificial Sequence: Synthetic oligonucleotide
cgtggacgacacccagttcgtgcg

SEQ ID NO: 371937 - DNA, 26 bp, Artificial Sequence
  Description of Artificial Sequence: Synthetic oligonucleotide
gtggacgacacccagttcgtgcggtt

SEQ ID NO: 371938 - DNA, 26 bp, Artificial Sequence
  Description of Artificial Sequence: Synthetic oligonucleotide
tggacgacacccagttcgtgcggttc

SEQ ID NO: 371939 - DNA, 25 bp, Artificial Sequence
  Description of Artificial Sequence: Synthetic oligonucleotide
ggacgacacccagttcgtgcggttc

SEQ ID NO: 371940 - DNA, 26 bp, Artificial Sequence
  Description of Artificial Sequence: Synthetic oligonucleotide
gacgacacccagttcgtgcggttcga

SEQ ID NO: 371941 - DNA, 27 bp, Artificial Sequence
  Description of Artificial Sequence: Synthetic oligonucleotide
acgacacccagttcgtgcggttcgaca

SEQ ID NO: 371942 - DNA, 26 bp, Artificial Sequence
  Description of Artificial Sequence: Synthetic oligonucleotide
cgacacccagttcgtgcggttcgaca

SEQ ID NO: 371943 - DNA, 26 bp, Artificial Sequence
  Description of Artificial Sequence: Synthetic oligonucleotide
gacacccagttcgtgcggttcgacag

SEQ ID NO: 371944 - DNA, 26 bp, Artificial Sequence
  Description of Artificial Sequence: Synthetic oligonucleotide
acacccagttcgtgcggttcgacagc

SEQ ID NO: 371945 - DNA, 25 bp, Artificial Sequence
  Description of Artificial Sequence: Synthetic oligonucleotide
cacccagttcgtgcggttcgacagc

SEQ ID NO: 371946 - DNA, 26 bp, Artificial Sequence
  Description of Artificial Sequence: Synthetic oligonucleotide
acccagttcgtgcggttcgacagcga

SEQ ID NO: 371947 - DNA, 25 bp, Artificial Sequence
  Description of Artificial Sequence: Synthetic oligonucleotide
cccagttcgtgcggttcgacagcga

SEQ ID NO: 371948 - DNA, 25 bp, Artificial Sequence
  Description of Artificial Sequence: Synthetic oligonucleotide
ccagttcgtgcggttcgacagcgac

SEQ ID NO: 371949 - DNA, 21 bp, Artificial Sequence
  Description of Artificial Sequence: Synthetic oligonucleotide
ctgcgctcctggaccgccgca

SEQ ID NO: 371950 - DNA, 22 bp, Artificial Sequence
  Description of Artificial Sequence: Synthetic oligonucleotide
tgcgctcctggaccgccgcaga

SEQ ID NO: 371951 - DNA, 21 bp, Artificial Sequence
  Description of Artificial Sequence: Synthetic oligonucleotide
gcgctcctggaccgccgcaga

SEQ ID NO: 371952 - DNA, 22 bp, Artificial Sequence
  Description of Artificial Sequence: Synthetic oligonucleotide
cgctcctggaccgccgcagaca

SEQ ID NO: 371953 - DNA, 22 bp, Artificial Sequence
  Description of Artificial Sequence: Synthetic oligonucleotide
gctcctggaccgccgcagacac

SEQ ID NO: 371954 - DNA, 22 bp, Artificial Sequence
  Description of Artificial Sequence: Synthetic oligonucleotide
ctcctggaccgccgcagacacg

SEQ ID NO: 371955 - DNA, 22 bp, Artificial Sequence
  Description of Artificial Sequence: Synthetic oligonucleotide
tcctggaccgccgcagacacgg

SEQ ID NO: 371956 - DNA, 21 bp, Artificial Sequence
  Description of Artificial Sequence: Synthetic oligonucleotide
cctggaccgccgcagacacgg

SEQ ID NO: 371957 - DNA, 21 bp, Artificial Sequence
  Description of Artificial Sequence: Synthetic oligonucleotide
ctggaccgccgcagacacggc

SEQ ID NO: 371958 - DNA, 21 bp, Artificial Sequence
  Description of Artificial Sequence: Synthetic oligonucleotide
tggaccgccgcagacacggcg

SEQ ID NO: 371959 - DNA, 20 bp, Artificial Sequence
  Description of Artificial Sequence: Synthetic oligonucleotide
ggaccgccgcagacacggcg

SEQ ID NO: 371960 - DNA, 20 bp, Artificial Sequence
  Description of Artificial Sequence: Synthetic oligonucleotide
gaccgccgcagacacggcgg

SEQ ID NO: 371961 - DNA, 21 bp, Artificial Sequence
  Description of Artificial Sequence: Synthetic oligonucleotide
accgccgcagacacggcggct

SEQ ID NO: 371962 - DNA, 20 bp, Artificial Sequence
  Description of Artificial Sequence: Synthetic oligonucleotide
ccgccgcagacacggcggct

SEQ ID NO: 371963 - DNA, 21 bp, Artificial Sequence
  Description of Artificial Sequence: Synthetic oligonucleotide
cgccgcagacacggcggctca

SEQ ID NO: 371964 - DNA, 23 bp, Artificial Sequence
  Description of Artificial Sequence: Synthetic oligonucleotide
gccgcagacacggcggctcagat

SEQ ID NO: 371965 - DNA, 24 bp, Artificial Sequence
  Description of Artificial Sequence: Synthetic oligonucleotide
ccgcagacacggcggctcagatca

SEQ ID NO: 371966 - DNA, 24 bp, Artificial Sequence
  Description of Artificial Sequence: Synthetic oligonucleotide
cgcagacacggcggctcagatcac

SEQ ID NO: 371967 - DNA, 24 bp, Artificial Sequence
  Description of Artificial Sequence: Synthetic oligonucleotide
gcagacacggcggctcagatcacc

SEQ ID NO: 371968 - DNA, 25 bp, Artificial Sequence
  Description of Artificial Sequence: Synthetic oligonucleotide
cagacacggcggctcagatcaccca

SEQ ID NO: 371969 - DNA, 25 bp, Artificial Sequence
  Description of Artificial Sequence: Synthetic oligonucleotide
agacacggcggctcagatcacccag

SEQ ID NO: 371970 - DNA, 30 bp, Artificial Sequence
  Description of Artificial Sequence: Synthetic oligonucleotide
cgcagatacctggagaacgggaaggataag

SEQ ID NO: 371971 - DNA, 30 bp, Artificial Sequence
  Description of Artificial Sequence: Synthetic oligonucleotide
gcagatacctggagaacgggaaggataagc

SEQ ID NO: 371972 - DNA, 31 bp, Artificial Sequence
  Description of Artificial Sequence: Synthetic oligonucleotide
cagatacctggagaacgggaaggataagctg

SEQ ID NO: 371973 - DNA, 31 bp, Artificial Sequence
  Description of Artificial Sequence: Synthetic oligonucleotide
agatacctggagaacgggaaggataagctgg

SEQ ID NO: 371974 - DNA, 30 bp, Artificial Sequence
  Description of Artificial Sequence: Synthetic oligonucleotide
gatacctggagaacgggaaggataagctgg

SEQ ID NO: 371975 - DNA, 31 bp, Artificial Sequence
  Description of Artificial Sequence: Synthetic oligonucleotide
atacctggagaacgggaaggataagctggag

SEQ ID NO: 371976 - DNA, 30 bp, Artificial Sequence
  Description of Artificial Sequence: Synthetic oligonucleotide
tacctggagaacgggaaggataagctggag

SEQ ID NO: 371977 - DNA, 29 bp, Artificial Sequence
  Description of Artificial Sequence: Synthetic oligonucleotide
acctggagaacgggaaggataagctggag

SEQ ID NO: 371978 - DNA, 28 bp, Artificial Sequence
  Description of Artificial Sequence: Synthetic oligonucleotide
cctggagaacgggaaggataagctggag

SEQ ID NO: 371979 - DNA, 28 bp, Artificial Sequence
  Description of Artificial Sequence: Synthetic oligonucleotide
ctggagaacgggaaggataagctggagc

SEQ ID NO: 371980 - DNA, 28 bp, Artificial Sequence
  Description of Artificial Sequence: Synthetic oligonucleotide
tggagaacgggaaggataagctggagcg

SEQ ID NO: 371981 - DNA, 27 bp, Artificial Sequence
  Description of Artificial Sequence: Synthetic oligonucleotide
ggagaacgggaaggataagctggagcg

SEQ ID NO: 371982 - DNA, 27 bp, Artificial Sequence
  Description of Artificial Sequence: Synthetic oligonucleotide
gagaacgggaaggataagctggagcgc

SEQ ID NO: 371983 - DNA, 27 bp, Artificial Sequence
  Description of Artificial Sequence: Synthetic oligonucleotide
agaacgggaaggataagctggagcgcg

SEQ ID NO: 371984 - DNA, 26 bp, Artificial Sequence
  Description of Artificial Sequence: Synthetic oligonucleotide
gaacgggaaggataagctggagcgcg

SEQ ID NO: 371985 - DNA, 27 bp, Artificial Sequence
  Description of Artificial Sequence: Synthetic oligonucleotide
aacgggaaggataagctggagcgcgct

SEQ ID NO: 371986 - DNA, 26 bp, Artificial Sequence
  Description of Artificial Sequence: Synthetic oligonucleotide
acgggaaggataagctggagcgcgct

SEQ ID NO: 371987 - DNA, 25 bp, Artificial Sequence
  Description of Artificial Sequence: Synthetic oligonucleotide
cgggaaggataagctggagcgcgct

SEQ ID NO: 371988 - DNA, 25 bp, Artificial Sequence
  Description of Artificial Sequence: Synthetic oligonucleotide
gggaaggataagctggagcgcgctg

SEQ ID NO: 371989 - DNA, 23 bp, Artificial Sequence
  Description of Artificial Sequence: Synthetic oligonucleotide
ccgtggggagccccgcttcatct

SEQ ID NO: 371990 - DNA, 24 bp, Artificial Sequence
  Description of Artificial Sequence: Synthetic oligonucleotide
cgtggggagccccgcttcatctca

SEQ ID NO: 371991 - DNA, 25 bp, Artificial Sequence
  Description of Artificial Sequence: Synthetic oligonucleotide
gtggggagccccgcttcatctcagt

SEQ ID NO: 371992 - DNA, 25 bp, Artificial Sequence
  Description of Artificial Sequence: Synthetic oligonucleotide
tggggagccccgcttcatctcagtg

SEQ ID NO: 371993 - DNA, 24 bp, Artificial Sequence
  Description of Artificial Sequence: Synthetic oligonucleotide
aacgaggacctgcgctcctggacg

SEQ ID NO: 371994 - DNA, 23 bp, Artificial Sequence
  Description of Artificial Sequence: Synthetic oligonucleotide
acgaggacctgcgctcctggacg

SEQ ID NO: 371995 - DNA, 22 bp, Artificial Sequence
  Description of Artificial Sequence: Synthetic oligonucleotide
cgaggacctgcgctcctggacg

SEQ ID NO: 371996 - DNA, 22 bp, Artificial Sequence
  Description of Artificial Sequence: Synthetic oligonucleotide
gaggacctgcgctcctggacgg

SEQ ID NO: 371997 - DNA, 22 bp, Artificial Sequence
  Description of Artificial Sequence: Synthetic oligonucleotide
aggacctgcgctcctggacggc

SEQ ID NO: 371998 - DNA, 21 bp, Artificial Sequence
  Description of Artificial Sequence: Synthetic oligonucleotide
ggacctgcgctcctggacggc

SEQ ID NO: 371999 - DNA, 21 bp, Artificial Sequence
  Description of Artificial Sequence: Synthetic oligonucleotide
gacctgcgctcctggacggcc

SEQ ID NO: 372000 - DNA, 21 bp, Artificial Sequence
  Description of Artificial Sequence: Synthetic oligonucleotide
acctgcgctcctggacggccg

SEQ ID NO: 372001 - DNA, 20 bp, Artificial Sequence
  Description of Artificial Sequence: Synthetic oligonucleotide
cctgcgctcctggacggccg

SEQ ID NO: 372002 - DNA, 20 bp, Artificial Sequence
  Description of Artificial Sequence: Synthetic oligonucleotide
ctgcgctcctggacggccgc

SEQ ID NO: 372003 - DNA, 20 bp, Artificial Sequence
  Description of Artificial Sequence: Synthetic oligonucleotide
tgcgctcctggacggccgcg

SEQ ID NO: 372004 - DNA, 20 bp, Artificial Sequence
  Description of Artificial Sequence: Synthetic oligonucleotide
gcgctcctggacggccgcgt

SEQ ID NO: 372005 - DNA, 20 bp, Artificial Sequence
  Description of Artificial Sequence: Synthetic oligonucleotide
cgctcctggacggccgcgga

SEQ ID NO: 372006 - DNA, 21 bp, Artificial Sequence
  Description of Artificial Sequence: Synthetic oligonucleotide
gctcctggacggccgcggaca

SEQ ID NO: 372007 - DNA, 21 bp, Artificial Sequence
  Description of Artificial Sequence: Synthetic oligonucleotide
ctcctggacggccgcggacac

SEQ ID NO: 372008 - DNA, 21 bp, Artificial Sequence
  Description of Artificial Sequence: Synthetic oligonucleotide
tcctggacggccgcggacacg

SEQ ID NO: 372009 - DNA, 20 bp, Artificial Sequence
  Description of Artificial Sequence: Synthetic oligonucleotide
cctggacggccgcggacacg

SEQ ID NO: 372010 - DNA, 20 bp, Artificial Sequence
  Description of Artificial Sequence: Synthetic oligonucleotide
ctggacggccgcggacacgg

SEQ ID NO: 372011 - DNA, 20 bp, Artificial Sequence
  Description of Artificial Sequence: Synthetic oligonucleotide
tggacggccgcggacacggc

SEQ ID NO: 372012 - DNA, 20 bp, Artificial Sequence
  Description of Artificial Sequence: Synthetic oligonucleotide
ggacggccgcggacacggct

SEQ ID NO: 372013 - DNA, 20 bp, Artificial Sequence
  Description of Artificial Sequence: Synthetic oligonucleotide
gacggccgcggacacggcgt

SEQ ID NO: 372014 - DNA, 20 bp, Artificial Sequence
  Description of Artificial Sequence: Synthetic oligonucleotide
acggccgcggacacggcggt

SEQ ID NO: 372015 - DNA, 20 bp, Artificial Sequence
  Description of Artificial Sequence: Synthetic oligonucleotide
cggccgcggacacggcggtt

SEQ ID NO: 372016 - DNA, 20 bp, Artificial Sequence
  Description of Artificial Sequence: Synthetic oligonucleotide
ggccgcggacacggcggctt

SEQ ID NO: 372017 - DNA, 21 bp, Artificial Sequence
  Description of Artificial Sequence: Synthetic oligonucleotide
cccgtgaggcggagcagcgca

SEQ ID NO: 372018 - DNA, 22 bp, Artificial Sequence
  Description of Artificial Sequence: Synthetic oligonucleotide
ccgtgaggcggagcagcgcaga

SEQ ID NO: 372019 - DNA, 22 bp, Artificial Sequence
  Description of Artificial Sequence: Synthetic oligonucleotide
cgtgaggcggagcagcgcagag

SEQ ID NO: 372020 - DNA, 22 bp, Artificial Sequence
  Description of Artificial Sequence: Synthetic oligonucleotide
gtgaggcggagcagcgcagagc

SEQ ID NO: 372021 - DNA, 24 bp, Artificial Sequence
  Description of Artificial Sequence: Synthetic oligonucleotide
tgaggcggagcagcgcagagccta

SEQ ID NO: 372022 - DNA, 23 bp, Artificial Sequence
  Description of Artificial Sequence: Synthetic oligonucleotide
gaggcggagcagcgcagagccta

SEQ ID NO: 372023 - DNA, 23 bp, Artificial Sequence
  Description of Artificial Sequence: Synthetic oligonucleotide
aggcggagcagcgcagagcctac

SEQ ID NO: 372024 - DNA, 22 bp, Artificial Sequence
  Description of Artificial Sequence: Synthetic oligonucleotide
ggcggagcagcgcagagcctac

SEQ ID NO: 372025 - DNA, 23 bp, Artificial Sequence
  Description of Artificial Sequence: Synthetic oligonucleotide
gcggagcagcgcagagcctacct

SEQ ID NO: 372026 - DNA, 23 bp, Artificial Sequence
  Description of Artificial Sequence: Synthetic oligonucleotide
cggagcagcgcagagcctacctg

SEQ ID NO: 372027 - DNA, 24 bp, Artificial Sequence
  Description of Artificial Sequence: Synthetic oligonucleotide
ggagcagcgcagagcctacctgga

SEQ ID NO: 372028 - DNA, 24 bp, Artificial Sequence
  Description of Artificial Sequence: Synthetic oligonucleotide
gagcagcgcagagcctacctggag

SEQ ID NO: 372029 - DNA, 24 bp, Artificial Sequence
  Description of Artificial Sequence: Synthetic oligonucleotide
agcagcgcagagcctacctggagg

SEQ ID NO: 372030 - DNA, 23 bp, Artificial Sequence
  Description of Artificial Sequence: Synthetic oligonucleotide
gcagcgcagagcctacctggagg

SEQ ID NO: 372031 - DNA, 23 bp, Artificial Sequence
  Description of Artificial Sequence: Synthetic oligonucleotide
cagcgcagagcctacctggaggg

SEQ ID NO: 372032 - DNA, 23 bp, Artificial Sequence
  Description of Artificial Sequence: Synthetic oligonucleotide
agcgcagagcctacctggagggc

SEQ ID NO: 372033 - DNA, 22 bp, Artificial Sequence
  Description of Artificial Sequence: Synthetic oligonucleotide
gcgcagagcctacctggagggc

SEQ ID NO: 372034 - DNA, 23 bp, Artificial Sequence
  Description of Artificial Sequence: Synthetic oligonucleotide
cgcagagcctacctggagggcga

SEQ ID NO: 372035 - DNA, 24 bp, Artificial Sequence
  Description of Artificial Sequence: Synthetic oligonucleotide
gcagagcctacctggagggcgagt

SEQ ID NO: 372036 - DNA, 24 bp, Artificial Sequence
  Description of Artificial Sequence: Synthetic oligonucleotide
cagagcctacctggagggcgagtg

SEQ ID NO: 372037 - DNA, 28 bp, Artificial Sequence
  Description of Artificial Sequence: Synthetic oligonucleotide
gtggacgacacccagttcgtgaggtttg

SEQ ID NO: 372038 - DNA, 29 bp, Artificial Sequence
  Description of Artificial Sequence: Synthetic oligonucleotide
tggacgacacccagttcgtgaggtttgac

SEQ ID NO: 372039 - DNA, 28 bp, Artificial Sequence
  Description of Artificial Sequence: Synthetic oligonucleotide
ggacgacacccagttcgtgaggtttgac

SEQ ID NO: 372040 - DNA, 29 bp, Artificial Sequence
  Description of Artificial Sequence: Synthetic oligonucleotide
gacgacacccagttcgtgaggtttgacag

SEQ ID NO: 372041 - DNA, 29 bp, Artificial Sequence
  Description of Artificial Sequence: Synthetic oligonucleotide
acgacacccagttcgtgaggtttgacagc

SEQ ID NO: 372042 - DNA, 28 bp, Artificial Sequence
  Description of Artificial Sequence: Synthetic oligonucleotide
cgacacccagttcgtgaggtttgacagc

SEQ ID NO: 372043 - DNA, 28 bp, Artificial Sequence
  Description of Artificial Sequence: Synthetic oligonucleotide
gacacccagttcgtgaggtttgacagcg

SEQ ID NO: 372044 - DNA, 29 bp, Artificial Sequence
  Description of Artificial Sequence: Synthetic oligonucleotide
acacccagttcgtgaggtttgacagcgac

SEQ ID NO: 372045 - DNA, 28 bp, Artificial Sequence
  Description of Artificial Sequence: Synthetic oligonucleotide
cacccagttcgtgaggtttgacagcgac

SEQ ID NO: 372046 - DNA, 28 bp, Artificial Sequence
  Description of Artificial Sequence: Synthetic oligonucleotide
acccagttcgtgaggtttgacagcgacg

SEQ ID NO: 372047 - DNA, 27 bp, Artificial Sequence
  Description of Artificial Sequence: Synthetic oligonucleotide
cccagttcgtgaggtttgacagcgacg

SEQ ID NO: 372048 - DNA, 27 bp, Artificial Sequence
  Description of Artificial Sequence: Synthetic oligonucleotide
ccagttcgtgaggtttgacagcgacgc

SEQ ID NO: 372049 - DNA, 27 bp, Artificial Sequence
  Description of Artificial Sequence: Synthetic oligonucleotide
cagttcgtgaggtttgacagcgacgcc

SEQ ID NO: 372050 - DNA, 27 bp, Artificial Sequence
  Description of Artificial Sequence: Synthetic oligonucleotide
agttcgtgaggtttgacagcgacgccg

SEQ ID NO: 372051 - DNA, 26 bp, Artificial Sequence
  Description of Artificial Sequence: Synthetic oligonucleotide
gttcgtgaggtttgacagcgacgccg

SEQ ID NO: 372052 - DNA, 26 bp, Artificial Sequence
  Description of Artificial Sequence: Synthetic oligonucleotide
ttcgtgaggtttgacagcgacgccgc

SEQ ID NO: 372053 - DNA, 25 bp, Artificial Sequence
  Description of Artificial Sequence: Synthetic oligonucleotide
tcgtgaggtttgacagcgacgccgc

SEQ ID NO: 372054 - DNA, 24 bp, Artificial Sequence
  Description of Artificial Sequence: Synthetic oligonucleotide
cgtgaggtttgacagcgacgccgc

SEQ ID NO: 372055 - DNA, 25 bp, Artificial Sequence
  Description of Artificial Sequence: Synthetic oligonucleotide
gtgaggtttgacagcgacgccgcga

SEQ ID NO: 372056 - DNA, 26 bp, Artificial Sequence
  Description of Artificial Sequence: Synthetic oligonucleotide
tgaggtttgacagcgacgccgcgagt

SEQ ID NO: 372057 - DNA, 25 bp, Artificial Sequence
  Description of Artificial Sequence: Synthetic oligonucleotide
gaggtttgacagcgacgccgcgagt

SEQ ID NO: 372058 - DNA, 25 bp, Artificial Sequence
  Description of Artificial Sequence: Synthetic oligonucleotide
aggtttgacagcgacgccgcgagtc

SEQ ID NO: 372059 - DNA, 24 bp, Artificial Sequence
  Description of Artificial Sequence: Synthetic oligonucleotide
ggtttgacagcgacgccgcgagtc

SEQ ID NO: 372060 - DNA, 24 bp, Artificial Sequence
  Description of Artificial Sequence: Synthetic oligonucleotide
gtttgacagcgacgccgcgagtcc

SEQ ID NO: 372061 - DNA, 25 bp, Artificial Sequence
  Description of Artificial Sequence: Synthetic oligonucleotide
tttgacagcgacgccgcgagtccga

SEQ ID NO: 372062 - DNA, 24 bp, Artificial Sequence
  Description of Artificial Sequence: Synthetic oligonucleotide
ttgacagcgacgccgcgagtccga

SEQ ID NO: 372063 - DNA, 23 bp, Artificial Sequence
  Description of Artificial Sequence: Synthetic oligonucleotide
tgacagcgacgccgcgagtccga

SEQ ID NO: 372064 - DNA, 34 bp, Artificial Sequence
  Description of Artificial Sequence: Synthetic oligonucleotide
ggagtattgggaccggaacacacagatctataag

SEQ ID NO: 372065 - DNA, 34 bp, Artificial Sequence
  Description of Artificial Sequence: Synthetic oligonucleotide
gagtattgggaccggaacacacagatctataagg

SEQ ID NO: 372066 - DNA, 34 bp, Artificial Sequence
  Description of Artificial Sequence: Synthetic oligonucleotide
agtattgggaccggaacacacagatctataaggc

SEQ ID NO: 372067 - DNA, 33 bp, Artificial Sequence
  Description of Artificial Sequence: Synthetic oligonucleotide
gtattgggaccggaacacacagatctataaggc

SEQ ID NO: 372068 - DNA, 33 bp, Artificial Sequence
  Description of Artificial Sequence: Synthetic oligonucleotide
tattgggaccggaacacacagatctataaggcc

SEQ ID NO: 372069 - DNA, 32 bp, Artificial Sequence
  Description of Artificial Sequence: Synthetic oligonucleotide
attgggaccggaacacacagatctataaggcc

SEQ ID NO: 372070 - DNA, 31 bp, Artificial Sequence
  Description of Artificial Sequence: Synthetic oligonucleotide
ttgggaccggaacacacagatctataaggcc

SEQ ID NO: 372071 - DNA, 30 bp, Artificial Sequence
  Description of Artificial Sequence: Synthetic oligonucleotide
tgggaccggaacacacagatctataaggcc

SEQ ID NO: 372072 - DNA, 29 bp, Artificial Sequence
  Description of Artificial Sequence: Synthetic oligonucleotide
gggaccggaacacacagatctataaggcc

SEQ ID NO: 372073 - DNA, 29 bp, Artificial Sequence
  Description of Artificial Sequence: Synthetic oligonucleotide
ggaccggaacacacagatctataaggccc

SEQ ID NO: 372074 - DNA, 30 bp, Artificial Sequence
  Description of Artificial Sequence: Synthetic oligonucleotide
gaccggaacacacagatctataaggcccag

SEQ ID NO: 372075 - DNA, 30 bp, Artificial Sequence
  Description of Artificial Sequence: Synthetic oligonucleotide
accggaacacacagatctataaggcccagg

SEQ ID NO: 372076 - DNA, 29 bp, Artificial Sequence
  Description of Artificial Sequence: Synthetic oligonucleotide
ccggaacacacagatctataaggcccagg

SEQ ID NO: 372077 - DNA, 29 bp, Artificial Sequence
  Description of Artificial Sequence: Synthetic oligonucleotide
cggaacacacagatctataaggcccaggc

SEQ ID NO: 372078 - DNA, 30 bp, Artificial Sequence
  Description of Artificial Sequence: Synthetic oligonucleotide
ggaacacacagatctataaggcccaggcac

SEQ ID NO: 372079 - DNA, 31 bp, Artificial Sequence
  Description of Artificial Sequence: Synthetic oligonucleotide
gaacacacagatctataaggcccaggcacag

SEQ ID NO: 372080 - DNA, 32 bp, Artificial Sequence
  Description of Artificial Sequence: Synthetic oligonucleotide
aacacacagatctataaggcccaggcacagac

SEQ ID NO: 372081 - DNA, 31 bp, Artificial Sequence
  Description of Artificial Sequence: Synthetic oligonucleotide
acacacagatctataaggcccaggcacagac

SEQ ID NO: 372082 - DNA, 30 bp, Artificial Sequence
  Description of Artificial Sequence: Synthetic oligonucleotide
cacacagatctataaggcccaggcacagac

SEQ ID NO: 372083 - DNA, 31 bp, Artificial Sequence
  Description of Artificial Sequence: Synthetic oligonucleotide
acacagatctataaggcccaggcacagactg

SEQ ID NO: 372084 - DNA, 30 bp, Artificial Sequence
  Description of Artificial Sequence: Synthetic oligonucleotide
cacagatctataaggcccaggcacagactg

SEQ ID NO: 372085 - DNA, 31 bp, Artificial Sequence
  Description of Artificial Sequence: Synthetic oligonucleotide
acagatctataaggcccaggcacagactgac

SEQ ID NO: 372086 - DNA, 30 bp, Artificial Sequence
  Description of Artificial Sequence: Synthetic oligonucleotide
cagatctataaggcccaggcacagactgac

SEQ ID NO: 372087 - DNA, 30 bp, Artificial Sequence
  Description of Artificial Sequence: Synthetic oligonucleotide
agatctataaggcccaggcacagactgacc

SEQ ID NO: 372088 - DNA, 29 bp, Artificial Sequence
  Description of Artificial Sequence: Synthetic oligonucleotide
gatctataaggcccaggcacagactgacc

SEQ ID NO: 372089 - DNA, 29 bp, Artificial Sequence
  Description of Artificial Sequence: Synthetic oligonucleotide
atctataaggcccaggcacagactgaccg

SEQ ID NO: 372090 - DNA, 28 bp, Artificial Sequence
  Description of Artificial Sequence: Synthetic oligonucleotide
tctataaggcccaggcacagactgaccg

SEQ ID NO: 372091 - DNA, 27 bp, Artificial Sequence
  Description of Artificial Sequence: Synthetic oligonucleotide
ctataaggcccaggcacagactgaccg

SEQ ID NO: 372092 - DNA, 28 bp, Artificial Sequence
  Description of Artificial Sequence: Synthetic oligonucleotide
tataaggcccaggcacagactgaccgag

SEQ ID NO: 372093 - DNA, 27 bp, Artificial Sequence
  Description of Artificial Sequence: Synthetic oligonucleotide
ataaggcccaggcacagactgaccgag

SEQ ID NO: 372094 - DNA, 27 bp, Artificial Sequence
  Description of Artificial Sequence: Synthetic oligonucleotide
taaggcccaggcacagactgaccgaga

SEQ ID NO: 372095 - DNA, 21 bp, Artificial Sequence
  Description of Artificial Sequence: Synthetic oligonucleotide
ggcccgtgaggcggagcagga

SEQ ID NO: 372096 - DNA, 22 bp, Artificial Sequence
  Description of Artificial Sequence: Synthetic oligonucleotide
gcccgtgaggcggagcaggaca

SEQ ID NO: 372097 - DNA, 23 bp, Artificial Sequence
  Description of Artificial Sequence: Synthetic oligonucleotide
cccgtgaggcggagcaggacaga

SEQ ID NO: 372098 - DNA, 23 bp, Artificial Sequence
  Description of Artificial Sequence: Synthetic oligonucleotide
ccgtgaggcggagcaggacagag

SEQ ID NO: 372099 - DNA, 23 bp, Artificial Sequence
  Description of Artificial Sequence: Synthetic oligonucleotide
cgtgaggcggagcaggacagagc

SEQ ID NO: 372100 - DNA, 25 bp, Artificial Sequence
  Description of Artificial Sequence: Synthetic oligonucleotide
gtgaggcggagcaggacagagccta

SEQ ID NO: 372101 - DNA, 25 bp, Artificial Sequence
  Description of Artificial Sequence: Synthetic oligonucleotide
tgaggcggagcaggacagagcctac

SEQ ID NO: 372102 - DNA, 24 bp, Artificial Sequence
  Description of Artificial Sequence: Synthetic oligonucleotide
gaggcggagcaggacagagcctac

SEQ ID NO: 372103 - DNA, 25 bp, Artificial Sequence
  Description of Artificial Sequence: Synthetic oligonucleotide
aggcggagcaggacagagcctacct

SEQ ID NO: 372104 - DNA, 24 bp, Artificial Sequence
  Description of Artificial Sequence: Synthetic oligonucleotide
ggcggagcaggacagagcctacct

SEQ ID NO: 372105 - DNA, 24 bp, Artificial Sequence
  Description of Artificial Sequence: Synthetic oligonucleotide
gcggagcaggacagagcctacctg

SEQ ID NO: 372106 - DNA, 25 bp, Artificial Sequence
  Description of Artificial Sequence: Synthetic oligonucleotide
cggagcaggacagagcctacctgga

SEQ ID NO: 372107 - DNA, 25 bp, Artificial Sequence
  Description of Artificial Sequence: Synthetic oligonucleotide
ggagcaggacagagcctacctggag

SEQ ID NO: 372108 - DNA, 25 bp, Artificial Sequence
  Description of Artificial Sequence: Synthetic oligonucleotide
gagcaggacagagcctacctggagg

SEQ ID NO: 372109 - DNA, 25 bp, Artificial Sequence
  Description of Artificial Sequence: Synthetic oligonucleotide
agcaggacagagcctacctggaggg

SEQ ID NO: 372110 - DNA, 24 bp, Artificial Sequence
  Description of Artificial Sequence: Synthetic oligonucleotide
gcaggacagagcctacctggaggg

SEQ ID NO: 372111 - DNA, 24 bp, Artificial Sequence
  Description of Artificial Sequence: Synthetic oligonucleotide
caggacagagcctacctggagggc

SEQ ID NO: 372112 - DNA, 25 bp, Artificial Sequence
  Description of Artificial Sequence: Synthetic oligonucleotide
aggacagagcctacctggagggcga

SEQ ID NO: 372113 - DNA, 24 bp, Artificial Sequence
  Description of Artificial Sequence: Synthetic oligonucleotide
ggacagagcctacctggagggcga

SEQ ID NO: 372114 - DNA, 25 bp, Artificial Sequence
  Description of Artificial Sequence: Synthetic oligonucleotide
gacagagcctacctggagggcgagt

SEQ ID NO: 372115 - DNA, 25 bp, Artificial Sequence
  Description of Artificial Sequence: Synthetic oligonucleotide
acagagcctacctggagggcgagtg

SEQ ID NO: 372116 - DNA, 22 bp, Artificial Sequence
  Description of Artificial Sequence: Synthetic oligonucleotide
ggcgcctcctccgcgggcataa

SEQ ID NO: 372117 - DNA, 22 bp, Artificial Sequence
  Description of Artificial Sequence: Synthetic oligonucleotide
gcgcctcctccgcgggcataac

SEQ ID NO: 372118 - DNA, 23 bp, Artificial Sequence
  Description of Artificial Sequence: Synthetic oligonucleotide
cgcctcctccgcgggcataacca

SEQ ID NO: 372119 - DNA, 25 bp, Artificial Sequence
  Description of Artificial Sequence: Synthetic oligonucleotide
gcctcctccgcgggcataaccagta

SEQ ID NO: 372120 - DNA, 25 bp, Artificial Sequence
  Description of Artificial Sequence: Synthetic oligonucleotide
cctcctccgcgggcataaccagtac

SEQ ID NO: 372121 - DNA, 25 bp, Artificial Sequence
  Description of Artificial Sequence: Synthetic oligonucleotide
ctcctccgcgggcataaccagtacg

SEQ ID NO: 372122 - DNA, 25 bp, Artificial Sequence
  Description of Artificial Sequence: Synthetic oligonucleotide
tcctccgcgggcataaccagtacgc

SEQ ID NO: 372123 - DNA, 24 bp, Artificial Sequence
  Description of Artificial Sequence: Synthetic oligonucleotide
cctccgcgggcataaccagtacgc

SEQ ID NO: 372124 - DNA, 26 bp, Artificial Sequence
  Description of Artificial Sequence: Synthetic oligonucleotide
ctccgcgggcataaccagtacgccta

SEQ ID NO: 372125 - DNA, 26 bp, Artificial Sequence
  Description of Artificial Sequence: Synthetic oligonucleotide
tccgcgggcataaccagtacgcctac

SEQ ID NO: 372126 - DNA, 25 bp, Artificial Sequence
  Description of Artificial Sequence: Synthetic oligonucleotide
ccgcgggcataaccagtacgcctac

SEQ ID NO: 372127 - DNA, 26 bp, Artificial Sequence
  Description of Artificial Sequence: Synthetic oligonucleotide
cgcgggcataaccagtacgcctacga

SEQ ID NO: 372128 - DNA, 26 bp, Artificial Sequence
  Description of Artificial Sequence: Synthetic oligonucleotide
gcgggcataaccagtacgcctacgac

SEQ ID NO: 372129 - DNA, 26 bp, Artificial Sequence
  Description of Artificial Sequence: Synthetic oligonucleotide
cgggcataaccagtacgcctacgacg

SEQ ID NO: 372130 - DNA, 26 bp, Artificial Sequence
  Description of Artificial Sequence: Synthetic oligonucleotide
gggcataaccagtacgcctacgacgg

SEQ ID NO: 372131 - DNA, 27 bp, Artificial Sequence
  Description of Artificial Sequence: Synthetic oligonucleotide
ggcataaccagtacgcctacgacggca

SEQ ID NO: 372132 - DNA, 28 bp, Artificial Sequence
  Description of Artificial Sequence: Synthetic oligonucleotide
gcataaccagtacgcctacgacggcaag

SEQ ID NO: 372133 - DNA, 28 bp, Artificial Sequence
  Description of Artificial Sequence: Synthetic oligonucleotide
cataaccagtacgcctacgacggcaagg

SEQ ID NO: 372134 - DNA, 32 bp, Artificial Sequence; identical to SEQ ID NO: 22755
  Description of Artificial Sequence: Synthetic oligonucleotide

SEQ ID NO: 372135 - DNA, 31 bp, Artificial Sequence; identical to SEQ ID NO: 22756
  Description of Artificial Sequence: Synthetic oligonucleotide

SEQ ID NO: 372136 - DNA, 30 bp, Artificial Sequence; identical to SEQ ID NO: 22757
  Description of Artificial Sequence: Synthetic oligonucleotide

SEQ ID NO: 372137 - DNA, 27 bp, Artificial Sequence
  Description of Artificial Sequence: Synthetic oligonucleotide
atgggagccgtcttcccagtccaccat

SEQ ID NO: 372138 - DNA, 26 bp, Artificial Sequence
  Description of Artificial Sequence: Synthetic oligonucleotide
tgggagccgtcttcccagtccaccat

SEQ ID NO: 372139 - DNA, 25 bp, Artificial Sequence
  Description of Artificial Sequence: Synthetic oligonucleotide
gggagccgtcttcccagtccaccat

SEQ ID NO: 372140 - DNA, 25 bp, Artificial Sequence
  Description of Artificial Sequence: Synthetic oligonucleotide
ggagccgtcttcccagtccaccatc

SEQ ID NO: 372141 - DNA, 25 bp, Artificial Sequence
  Description of Artificial Sequence: Synthetic oligonucleotide
gagccgtcttcccagtccaccatcc

SEQ ID NO: 372142 - DNA, 25 bp, Artificial Sequence
  Description of Artificial Sequence: Synthetic oligonucleotide
agccgtcttcccagtccaccatccc

SEQ ID NO: 372143 - DNA, 24 bp, Artificial Sequence
  Description of Artificial Sequence: Synthetic oligonucleotide
gccgtcttcccagtccaccatccc

SEQ ID NO: 372144 - DNA, 26 bp, Artificial Sequence
  Description of Artificial Sequence: Synthetic oligonucleotide
ccgtcttcccagtccaccatccccat

SEQ ID NO: 372145 - DNA, 26 bp, Artificial Sequence
  Description of Artificial Sequence: Synthetic oligonucleotide
cgtcttcccagtccaccatccccatc

SEQ ID NO: 372146 - DNA, 27 bp, Artificial Sequence
  Description of Artificial Sequence: Synthetic oligonucleotide
gtcttcccagtccaccatccccatcgt

SEQ ID NO: 372147 - DNA, 27 bp, Artificial Sequence
  Description of Artificial Sequence: Synthetic oligonucleotide
tcttcccagtccaccatccccatcgtg

SEQ ID NO: 372148 - DNA, 26 bp, Artificial Sequence
  Description of Artificial Sequence: Synthetic oligonucleotide
cttcccagtccaccatccccatcgtg

SEQ ID NO: 372149 - DNA, 26 bp, Artificial Sequence
  Description of Artificial Sequence: Synthetic oligonucleotide
ttcccagtccaccatccccatcgtgg

SEQ ID NO: 372150 - DNA, 25 bp, Artificial Sequence
  Description of Artificial Sequence: Synthetic oligonucleotide
tcccagtccaccatccccatcgtgg

SEQ ID NO: 372151 - DNA, 24 bp, Artificial Sequence
  Description of Artificial Sequence: Synthetic oligonucleotide
cccagtccaccatccccatcgtgg

SEQ ID NO: 372152 - DNA, 24 bp, Artificial Sequence
  Description of Artificial Sequence: Synthetic oligonucleotide
ccagtccaccatccccatcgtggg

SEQ ID NO: 372153 - DNA, 27 bp, Artificial Sequence
  Description of Artificial Sequence: Synthetic oligonucleotide
cagtccaccatccccatcgtgggcatt

SEQ ID NO: 372154 - DNA, 27 bp, Artificial Sequence
  Description of Artificial Sequence: Synthetic oligonucleotide
agtccaccatccccatcgtgggcattg

SEQ ID NO: 372155 - DNA, 27 bp, Artificial Sequence
  Description of Artificial Sequence: Synthetic oligonucleotide
gtccaccatccccatcgtgggcattgt

SEQ ID NO: 372156 - DNA, 28 bp, Artificial Sequence
  Description of Artificial Sequence: Synthetic oligonucleotide
tccaccatccccatcgtgggcattgttg

SEQ ID NO: 372157 - DNA, 27 bp, Artificial Sequence
  Description of Artificial Sequence: Synthetic oligonucleotide
ccaccatccccatcgtgggcattgttg

SEQ ID NO: 372158 - DNA, 27 bp, Artificial Sequence
  Description of Artificial Sequence: Synthetic oligonucleotide
caccatccccatcgtgggcattgttgc

SEQ ID NO: 372159 - DNA, 28 bp, Artificial Sequence
  Description of Artificial Sequence: Synthetic oligonucleotide
accatccccatcgtgggcattgttgctg

SEQ ID NO: 372160 - DNA, 27 bp, Artificial Sequence
  Description of Artificial Sequence: Synthetic oligonucleotide
ccatccccatcgtgggcattgttgctg

SEQ ID NO: 372161 - DNA, 27 bp, Artificial Sequence
  Description of Artificial Sequence: Synthetic oligonucleotide
catccccatcgtgggcattgttgctgg

SEQ ID NO: 372162 - DNA, 27 bp, Artificial Sequence
  Description of Artificial Sequence: Synthetic oligonucleotide
atccccatcgtgggcattgttgctggc

SEQ ID NO: 372163 - DNA, 22 bp, Artificial Sequence
  Description of Artificial Sequence: Synthetic oligonucleotide
gacagcgacgccgcgagtccca

SEQ ID NO: 372164 - DNA, 23 bp, Artificial Sequence
  Description of Artificial Sequence: Synthetic oligonucleotide
acagcgacgccgcgagtcccaga

SEQ ID NO: 372165 - DNA, 22 bp, Artificial Sequence
  Description of Artificial Sequence: Synthetic oligonucleotide
cagcgacgccgcgagtcccaga

SEQ ID NO: 372166 - DNA, 23 bp, Artificial Sequence
  Description of Artificial Sequence: Synthetic oligonucleotide
agcgacgccgcgagtcccagaga

SEQ ID NO: 372167 - DNA, 22 bp, Artificial Sequence
  Description of Artificial Sequence: Synthetic oligonucleotide
gcgacgccgcgagtcccagaga

SEQ ID NO: 372168 - DNA, 22 bp, Artificial Sequence
  Description of Artificial Sequence: Synthetic oligonucleotide
cgacgccgcgagtcccagagag

SEQ ID NO: 372169 - DNA, 23 bp, Artificial Sequence
  Description of Artificial Sequence: Synthetic oligonucleotide
gacgccgcgagtcccagagagga

SEQ ID NO: 372170 - DNA, 23 bp, Artificial Sequence
  Description of Artificial Sequence: Synthetic oligonucleotide
acgccgcgagtcccagagaggag

SEQ ID NO: 372171 - DNA, 22 bp, Artificial Sequence
  Description of Artificial Sequence: Synthetic oligonucleotide
cgccgcgagtcccagagaggag

SEQ ID NO: 372172 - DNA, 22 bp, Artificial Sequence
  Description of Artificial Sequence: Synthetic oligonucleotide
gccgcgagtcccagagaggagc

SEQ ID NO: 372173 - DNA, 22 bp, Artificial Sequence
  Description of Artificial Sequence: Synthetic oligonucleotide
ccgcgagtcccagagaggagcc

SEQ ID NO: 372174 - DNA, 22 bp, Artificial Sequence
  Description of Artificial Sequence: Synthetic oligonucleotide
cgcgagtcccagagaggagccg

SEQ ID NO: 372175 - DNA, 22 bp, Artificial Sequence
  Description of Artificial Sequence: Synthetic oligonucleotide
gcgagtcccagagaggagccgc

SEQ ID NO: 372176 - DNA, 22 bp, Artificial Sequence
  Description of Artificial Sequence: Synthetic oligonucleotide
cgagtcccagagaggagccgcg

SEQ ID NO: 372177 - DNA, 22 bp, Artificial Sequence
  Description of Artificial Sequence: Synthetic oligonucleotide
gagtcccagagaggagccgcgg

SEQ ID NO: 372178 - DNA, 22 bp, Artificial Sequence
  Description of Artificial Sequence: Synthetic oligonucleotide
agtcccagagaggagccgcggg

SEQ ID NO: 372179 - DNA, 21 bp, Artificial Sequence
  Description of Artificial Sequence: Synthetic oligonucleotide
gtcccagagaggagccgcggg

SEQ ID NO: 372180 - DNA, 21 bp, Artificial Sequence
  Description of Artificial Sequence: Synthetic oligonucleotide
tcccagagaggagccgcgggc

SEQ ID NO: 372181 - DNA, 20 bp, Artificial Sequence
  Description of Artificial Sequence: Synthetic oligonucleotide
cccagagaggagccgcgggc

SEQ ID NO: 372182 - DNA, 20 bp, Artificial Sequence
  Description of Artificial Sequence: Synthetic oligonucleotide
ccagagaggagccgcgggcg

SEQ ID NO: 372183 - DNA, 20 bp, Artificial Sequence
  Description of Artificial Sequence: Synthetic oligonucleotide
cagagaggagccgcgggcgc

SEQ ID NO: 372184 - DNA, 29 bp, Artificial Sequence
  Description of Artificial Sequence: Synthetic oligonucleotide
gcataaccagtacgcctacgacggcaaag

SEQ ID NO: 372185 - DNA, 33 bp, Artificial Sequence; identical to SEQ ID NO: 22806
  Description of Artificial Sequence: Synthetic oligonucleotide

SEQ ID NO: 372186 - DNA, 35 bp, Artificial Sequence; identical to SEQ ID NO: 22807
  Description of Artificial Sequence: Synthetic oligonucleotide

SEQ ID NO: 372187 - DNA, 34 bp, Artificial Sequence; identical to SEQ ID NO: 22808
  Description of Artificial Sequence: Synthetic oligonucleotide

SEQ ID NO: 372188 - DNA, 33 bp, Artificial Sequence; identical to SEQ ID NO: 22809
  Description of Artificial Sequence: Synthetic oligonucleotide

SEQ ID NO: 372189 - DNA, 22 bp, Artificial Sequence
  Description of Artificial Sequence: Synthetic oligonucleotide
gaggggccggagtactgggacc

SEQ ID NO: 372190 - DNA, 22 bp, Artificial Sequence
  Description of Artificial Sequence: Synthetic oligonucleotide
aggggccggagtactgggaccg

SEQ ID NO: 372191 - DNA, 21 bp, Artificial Sequence
  Description of Artificial Sequence: Synthetic oligonucleotide
ggggccggagtactgggaccg

SEQ ID NO: 372192 - DNA, 23 bp, Artificial Sequence
  Description of Artificial Sequence: Synthetic oligonucleotide
gggccggagtactgggaccggaa

SEQ ID NO: 372193 - DNA, 24 bp, Artificial Sequence
  Description of Artificial Sequence: Synthetic oligonucleotide
ggccggagtactgggaccggaaca

SEQ ID NO: 372194 - DNA, 25 bp, Artificial Sequence
  Description of Artificial Sequence: Synthetic oligonucleotide
gccggagtactgggaccggaacaca

SEQ ID NO: 372195 - DNA, 26 bp, Artificial Sequence
  Description of Artificial Sequence: Synthetic oligonucleotide
ccggagtactgggaccggaacacaca

SEQ ID NO: 372196 - DNA, 27 bp, Artificial Sequence
  Description of Artificial Sequence: Synthetic oligonucleotide
cggagtactgggaccggaacacacaga

SEQ ID NO: 372197 - DNA, 28 bp, Artificial Sequence
  Description of Artificial Sequence: Synthetic oligonucleotide
ggagtactgggaccggaacacacagatc

SEQ ID NO: 372198 - DNA, 30 bp, Artificial Sequence
  Description of Artificial Sequence: Synthetic oligonucleotide
gagtactgggaccggaacacacagatctac

SEQ ID NO: 372199 - DNA, 32 bp, Artificial Sequence
  Description of Artificial Sequence: Synthetic oligonucleotide
agtactgggaccggaacacacagatctacaag

SEQ ID NO: 372200 - DNA, 31 bp, Artificial Sequence
  Description of Artificial Sequence: Synthetic oligonucleotide
gtactgggaccggaacacacagatctacaag

SEQ ID NO: 372201 - DNA, 31 bp, Artificial Sequence
  Description of Artificial Sequence: Synthetic oligonucleotide
tactgggaccggaacacacagatctacaagg

SEQ ID NO: 372202 - DNA, 30 bp, Artificial Sequence
  Description of Artificial Sequence: Synthetic oligonucleotide
actgggaccggaacacacagatctacaagg

SEQ ID NO: 372203 - DNA, 29 bp, Artificial Sequence
  Description of Artificial Sequence: Synthetic oligonucleotide
ctgggaccggaacacacagatctacaagg

SEQ ID NO: 372204 - DNA, 25 bp, Artificial Sequence
  Description of Artificial Sequence: Synthetic oligonucleotide
ccgggtctcacaccctccagaggat

SEQ ID NO: 372205 - DNA, 27 bp, Artificial Sequence
  Description of Artificial Sequence: Synthetic oligonucleotide
cgggtctcacaccctccagaggatgta

SEQ ID NO: 372206 - DNA, 27 bp, Artificial Sequence
  Description of Artificial Sequence: Synthetic oligonucleotide
gggtctcacaccctccagaggatgtac

SEQ ID NO: 372207 - DNA, 27 bp, Artificial Sequence
  Description of Artificial Sequence: Synthetic oligonucleotide
ggtctcacaccctccagaggatgtacg

SEQ ID NO: 372208 - DNA, 27 bp, Artificial Sequence
  Description of Artificial Sequence: Synthetic oligonucleotide
gtctcacaccctccagaggatgtacgg

SEQ ID NO: 372209 - DNA, 27 bp, Artificial Sequence
  Description of Artificial Sequence: Synthetic oligonucleotide
tctcacaccctccagaggatgtacggc

SEQ ID NO: 372210 - DNA, 27 bp, Artificial Sequence
  Description of Artificial Sequence: Synthetic oligonucleotide
ctcacaccctccagaggatgtacggct

SEQ ID NO: 372211 - DNA, 27 bp, Artificial Sequence
  Description of Artificial Sequence: Synthetic oligonucleotide
tcacaccctccagaggatgtacggctg

SEQ ID NO: 372212 - DNA, 26 bp, Artificial Sequence
  Description of Artificial Sequence: Synthetic oligonucleotide
cacaccctccagaggatgtacggctg

SEQ ID NO: 372213 - DNA, 26 bp, Artificial Sequence
  Description of Artificial Sequence: Synthetic oligonucleotide
acaccctccagaggatgtacggctgc

SEQ ID NO: 372214 - DNA, 25 bp, Artificial Sequence
  Description of Artificial Sequence: Synthetic oligonucleotide
caccctccagaggatgtacggctgc

SEQ ID NO: 372215 - DNA, 26 bp, Artificial Sequence
  Description of Artificial Sequence: Synthetic oligonucleotide
accctccagaggatgtacggctgcga

SEQ ID NO: 372216 - DNA, 25 bp, Artificial Sequence
  Description of Artificial Sequence: Synthetic oligonucleotide
ccctccagaggatgtacggctgcga

SEQ ID NO: 372217 - DNA, 25 bp, Artificial Sequence
  Description of Artificial Sequence: Synthetic oligonucleotide
cctccagaggatgtacggctgcgac

SEQ ID NO: 372218 - DNA, 26 bp, Artificial Sequence
  Description of Artificial Sequence: Synthetic oligonucleotide
ctccagaggatgtacggctgcgacgt

SEQ ID NO: 372219 - DNA, 26 bp, Artificial Sequence
  Description of Artificial Sequence: Synthetic oligonucleotide
tccagaggatgtacggctgcgacgtg

SEQ ID NO: 372220 - DNA, 25 bp, Artificial Sequence
  Description of Artificial Sequence: Synthetic oligonucleotide
ccagaggatgtacggctgcgacgtg

SEQ ID NO: 372221 - DNA, 25 bp, Artificial Sequence
  Description of Artificial Sequence: Synthetic oligonucleotide
cagaggatgtacggctgcgacgtgg

SEQ ID NO: 372222 - DNA, 25 bp, Artificial Sequence
  Description of Artificial Sequence: Synthetic oligonucleotide
agaggatgtacggctgcgacgtggg

SEQ ID NO: 372223 - DNA, 24 bp, Artificial Sequence
  Description of Artificial Sequence: Synthetic oligonucleotide
gaggatgtacggctgcgacgtggg

SEQ ID NO: 372224 - DNA, 24 bp, Artificial Sequence
  Description of Artificial Sequence: Synthetic oligonucleotide
aggatgtacggctgcgacgtgggg

SEQ ID NO: 372225 - DNA, 23 bp, Artificial Sequence
  Description of Artificial Sequence: Synthetic oligonucleotide
ggatgtacggctgcgacgtgggg

SEQ ID NO: 372226 - DNA, 23 bp, Artificial Sequence
  Description of Artificial Sequence: Synthetic oligonucleotide
gatgtacggctgcgacgtggggc

SEQ ID NO: 372227 - DNA, 23 bp, Artificial Sequence
  Description of Artificial Sequence: Synthetic oligonucleotide
cctcctccgcgggcatgaccagt

SEQ ID NO: 372228 - DNA, 23 bp, Artificial Sequence
  Description of Artificial Sequence: Synthetic oligonucleotide
ctcctccgcgggcatgaccagtc

SEQ ID NO: 372229 - DNA, 23 bp, Artificial Sequence
  Description of Artificial Sequence: Synthetic oligonucleotide
tcctccgcgggcatgaccagtcc

SEQ ID NO: 372230 - DNA, 22 bp, Artificial Sequence
  Description of Artificial Sequence: Synthetic oligonucleotide
cctccgcgggcatgaccagtcc

SEQ ID NO: 372231 - DNA, 22 bp, Artificial Sequence
  Description of Artificial Sequence: Synthetic oligonucleotide
ctccgcgggcatgaccagtccg

SEQ ID NO: 372232 - DNA, 22 bp, Artificial Sequence
  Description of Artificial Sequence: Synthetic oligonucleotide
tccgcgggcatgaccagtccgc

SEQ ID NO: 372233 - DNA, 21 bp, Artificial Sequence
  Description of Artificial Sequence: Synthetic oligonucleotide
ccgcgggcatgaccagtccgc

SEQ ID NO: 372234 - DNA, 23 bp, Artificial Sequence
  Description of Artificial Sequence: Synthetic oligonucleotide
cgcgggcatgaccagtccgccta

SEQ ID NO: 372235 - DNA, 23 bp, Artificial Sequence
  Description of Artificial Sequence: Synthetic oligonucleotide
gcgggcatgaccagtccgcctac

SEQ ID NO: 372236 - DNA, 24 bp, Artificial Sequence
  Description of Artificial Sequence: Synthetic oligonucleotide
cgggcatgaccagtccgcctacga

SEQ ID NO: 372237 - DNA, 24 bp, Artificial Sequence
  Description of Artificial Sequence: Synthetic oligonucleotide
gggcatgaccagtccgcctacgac

SEQ ID NO: 372238 - DNA, 24 bp, Artificial Sequence
  Description of Artificial Sequence: Synthetic oligonucleotide
ggcatgaccagtccgcctacgacg

SEQ ID NO: 372239 - DNA, 24 bp, Artificial Sequence
  Description of Artificial Sequence: Synthetic oligonucleotide
gcatgaccagtccgcctacgacgg

SEQ ID NO: 372240 - DNA, 26 bp, Artificial Sequence
  Description of Artificial Sequence: Synthetic oligonucleotide
catgaccagtccgcctacgacggcaa

SEQ ID NO: 372241 - DNA, 26 bp, Artificial Sequence
  Description of Artificial Sequence: Synthetic oligonucleotide
atgaccagtccgcctacgacggcaag

SEQ ID NO: 372242 - DNA, 25 bp, Artificial Sequence
  Description of Artificial Sequence: Synthetic oligonucleotide
tgaccagtccgcctacgacggcaag

SEQ ID NO: 372243 - DNA, 24 bp, Artificial Sequence
  Description of Artificial Sequence: Synthetic oligonucleotide
gaccagtccgcctacgacggcaag

SEQ ID NO: 372244 - DNA, 27 bp, Artificial Sequence
  Description of Artificial Sequence: Synthetic oligonucleotide
accagtccgcctacgacggcaaggatt

SEQ ID NO: 372245 - DNA, 27 bp, Artificial Sequence
  Description of Artificial Sequence: Synthetic oligonucleotide
ccagtccgcctacgacggcaaggatta

SEQ ID NO: 372246 - DNA, 27 bp, Artificial Sequence
  Description of Artificial Sequence: Synthetic oligonucleotide
cagtccgcctacgacggcaaggattac

SEQ ID NO: 372247 - DNA, 29 bp, Artificial Sequence
  Description of Artificial Sequence: Synthetic oligonucleotide
agtccgcctacgacggcaaggattacatc

SEQ ID NO: 372248 - DNA, 28 bp, Artificial Sequence
  Description of Artificial Sequence: Synthetic oligonucleotide
gtccgcctacgacggcaaggattacatc

SEQ ID NO: 372249 - DNA, 28 bp, Artificial Sequence
  Description of Artificial Sequence: Synthetic oligonucleotide
tccgcctacgacggcaaggattacatcg

SEQ ID NO: 372250 - DNA, 27 bp, Artificial Sequence
  Description of Artificial Sequence: Synthetic oligonucleotide
ccgcctacgacggcaaggattacatcg

SEQ ID NO: 372251 - DNA, 30 bp, Artificial Sequence; identical to SEQ ID NO: 22877
  Description of Artificial Sequence: Synthetic oligonucleotide

SEQ ID NO: 372252 - DNA, 30 bp, Artificial Sequence; identical to SEQ ID NO: 22878
  Description of Artificial Sequence: Synthetic oligonucleotide

SEQ ID NO: 372253 - DNA, 32 bp, Artificial Sequence; identical to SEQ ID NO: 22879
  Description of Artificial Sequence: Synthetic oligonucleotide

SEQ ID NO: 372254 - DNA, 31 bp, Artificial Sequence; identical to SEQ ID NO: 22880
  Description of Artificial Sequence: Synthetic oligonucleotide

SEQ ID NO: 372255 - DNA, 31 bp, Artificial Sequence; identical to SEQ ID NO: 22881
  Description of Artificial Sequence: Synthetic oligonucleotide

SEQ ID NO: 372256 - DNA, 30 bp, Artificial Sequence; identical to SEQ ID NO: 22882
  Description of Artificial Sequence: Synthetic oligonucleotide

SEQ ID NO: 372257 - DNA, 29 bp, Artificial Sequence
  Description of Artificial Sequence: Synthetic oligonucleotide
ttgggaccggaacacacagatctgcaagg

SEQ ID NO: 372258 - DNA, 28 bp, Artificial Sequence
  Description of Artificial Sequence: Synthetic oligonucleotide
tgggaccggaacacacagatctgcaagg

SEQ ID NO: 372259 - DNA, 27 bp, Artificial Sequence
  Description of Artificial Sequence: Synthetic oligonucleotide
gggaccggaacacacagatctgcaagg

SEQ ID NO: 372260 - DNA, 27 bp, Artificial Sequence
  Description of Artificial Sequence: Synthetic oligonucleotide
ggaccggaacacacagatctgcaaggc

SEQ ID NO: 372261 - DNA, 27 bp, Artificial Sequence
  Description of Artificial Sequence: Synthetic oligonucleotide
gaccggaacacacagatctgcaaggcc

SEQ ID NO: 372262 - DNA, 27 bp, Artificial Sequence
  Description of Artificial Sequence: Synthetic oligonucleotide
accggaacacacagatctgcaaggccc

SEQ ID NO: 372263 - DNA, 27 bp, Artificial Sequence
  Description of Artificial Sequence: Synthetic oligonucleotide
ccggaacacacagatctgcaaggccca

SEQ ID NO: 372264 - DNA, 27 bp, Artificial Sequence
  Description of Artificial Sequence: Synthetic oligonucleotide
cggaacacacagatctgcaaggcccag

SEQ ID NO: 372265 - DNA, 27 bp, Artificial Sequence
  Description of Artificial Sequence: Synthetic oligonucleotide
ggaacacacagatctgcaaggcccagg

SEQ ID NO: 372266 - DNA, 27 bp, Artificial Sequence
  Description of Artificial Sequence: Synthetic oligonucleotide
gaacacacagatctgcaaggcccaggc

SEQ ID NO: 372267 - DNA, 28 bp, Artificial Sequence
  Description of Artificial Sequence: Synthetic oligonucleotide
aacacacagatctgcaaggcccaggcac

SEQ ID NO: 372268 - DNA, 27 bp, Artificial Sequence
  Description of Artificial Sequence: Synthetic oligonucleotide
acacacagatctgcaaggcccaggcac

SEQ ID NO: 372269 - DNA, 27 bp, Artificial Sequence
  Description of Artificial Sequence: Synthetic oligonucleotide
cacacagatctgcaaggcccaggcaca

SEQ ID NO: 372270 - DNA, 27 bp, Artificial Sequence
  Description of Artificial Sequence: Synthetic oligonucleotide
acacagatctgcaaggcccaggcacag

SEQ ID NO: 372271 - DNA, 27 bp, Artificial Sequence
  Description of Artificial Sequence: Synthetic oligonucleotide
cacagatctgcaaggcccaggcacaga

SEQ ID NO: 372272 - DNA, 27 bp, Artificial Sequence
  Description of Artificial Sequence: Synthetic oligonucleotide
acagatctgcaaggcccaggcacagac

SEQ ID NO: 372273 - DNA, 27 bp, Artificial Sequence
  Description of Artificial Sequence: Synthetic oligonucleotide
cagatctgcaaggcccaggcacagact

SEQ ID NO: 372274 - DNA, 27 bp, Artificial Sequence
  Description of Artificial Sequence: Synthetic oligonucleotide
agatctgcaaggcccaggcacagactg

SEQ ID NO: 372275 - DNA, 27 bp, Artificial Sequence
  Description of Artificial Sequence: Synthetic oligonucleotide
gatctgcaaggcccaggcacagactga

SEQ ID NO: 372276 - DNA, 27 bp, Artificial Sequence
  Description of Artificial Sequence: Synthetic oligonucleotide
atctgcaaggcccaggcacagactgac

SEQ ID NO: 372277 - DNA, 26 bp, Artificial Sequence
  Description of Artificial Sequence: Synthetic oligonucleotide
tctgcaaggcccaggcacagactgac

SEQ ID NO: 372278 - DNA, 25 bp, Artificial Sequence
  Description of Artificial Sequence: Synthetic oligonucleotide
ctgcaaggcccaggcacagactgac

SEQ ID NO: 372279 - DNA, 25 bp, Artificial Sequence
  Description of Artificial Sequence: Synthetic oligonucleotide
tgcaaggcccaggcacagactgacc

SEQ ID NO: 372280 - DNA, 24 bp, Artificial Sequence
  Description of Artificial Sequence: Synthetic oligonucleotide
gcaaggcccaggcacagactgacc

SEQ ID NO: 372281 - DNA, 22 bp, Artificial Sequence
  Description of Artificial Sequence: Synthetic oligonucleotide
agcgacgccgcgagtccgagag

SEQ ID NO: 372282 - DNA, 21 bp, Artificial Sequence
  Description of Artificial Sequence: Synthetic oligonucleotide
gcgacgccgcgagtccgagag

SEQ ID NO: 372283 - DNA, 21 bp, Artificial Sequence
  Description of Artificial Sequence: Synthetic oligonucleotide
cgacgccgcgagtccgagagg

SEQ ID NO: 372284 - DNA, 21 bp, Artificial Sequence
  Description of Artificial Sequence: Synthetic oligonucleotide
gacgccgcgagtccgagaggg

SEQ ID NO: 372285 - DNA, 22 bp, Artificial Sequence
  Description of Artificial Sequence: Synthetic oligonucleotide
acgccgcgagtccgagagggga

SEQ ID NO: 372286 - DNA, 21 bp, Artificial Sequence
  Description of Artificial Sequence: Synthetic oligonucleotide
cgccgcgagtccgagagggga

SEQ ID NO: 372287 - DNA, 21 bp, Artificial Sequence
  Description of Artificial Sequence: Synthetic oligonucleotide
gccgcgagtccgagaggggag

SEQ ID NO: 372288 - DNA, 21 bp, Artificial Sequence
  Description of Artificial Sequence: Synthetic oligonucleotide
ccgcgagtccgagaggggagc

SEQ ID NO: 372289 - DNA, 21 bp, Artificial Sequence
  Description of Artificial Sequence: Synthetic oligonucleotide
cgcgagtccgagaggggagcc

SEQ ID NO: 372290 - DNA, 21 bp, Artificial Sequence
  Description of Artificial Sequence: Synthetic oligonucleotide
gcgagtccgagaggggagccg

SEQ ID NO: 372291 - DNA, 21 bp, Artificial Sequence
  Description of Artificial Sequence: Synthetic oligonucleotide
cgagtccgagaggggagccgc

SEQ ID NO: 372292 - DNA, 21 bp, Artificial Sequence
  Description of Artificial Sequence: Synthetic oligonucleotide
gagtccgagaggggagccgcg

SEQ ID NO: 372293 - DNA, 21 bp, Artificial Sequence
  Description of Artificial Sequence: Synthetic oligonucleotide
agtccgagaggggagccgcgg

SEQ ID NO: 372294 - DNA, 20 bp, Artificial Sequence
  Description of Artificial Sequence: Synthetic oligonucleotide
gtccgagaggggagccgcgg

SEQ ID NO: 372295 - DNA, 20 bp, Artificial Sequence
  Description of Artificial Sequence: Synthetic oligonucleotide
tccgagaggggagccgcggg

SEQ ID NO: 372296 - DNA, 20 bp, Artificial Sequence
  Description of Artificial Sequence: Synthetic oligonucleotide
ccgagaggggagccgcgggt

SEQ ID NO: 372297 - DNA, 20 bp, Artificial Sequence
  Description of Artificial Sequence: Synthetic oligonucleotide
cgagaggggagccgcgggct

SEQ ID NO: 372298 - DNA, 20 bp, Artificial Sequence
  Description of Artificial Sequence: Synthetic oligonucleotide
gagaggggagccgcgggcgt

SEQ ID NO: 372299 - DNA, 20 bp, Artificial Sequence
  Description of Artificial Sequence: Synthetic oligonucleotide
agaggggagccgcgggcgct

SEQ ID NO: 372300 - DNA, 20 bp, Artificial Sequence
  Description of Artificial Sequence: Synthetic oligonucleotide
gaggggagccgcgggcgctt

SEQ ID NO: 372301 - DNA, 20 bp, Artificial Sequence
  Description of Artificial Sequence: Synthetic oligonucleotide
aggggagccgcgggcgcctt

SEQ ID NO: 372302 - DNA, 20 bp, Artificial Sequence
  Description of Artificial Sequence: Synthetic oligonucleotide
ggggagccgcgggcgccttt

SEQ ID NO: 372303 - DNA, 20 bp, Artificial Sequence
  Description of Artificial Sequence: Synthetic oligonucleotide
gggagccgcgggcgccgttt

SEQ ID NO: 372304 - DNA, 20 bp, Artificial Sequence
  Description of Artificial Sequence: Synthetic oligonucleotide
gagccgcgggcgccgtggtt

SEQ ID NO: 372305 - DNA, 20 bp, Artificial Sequence
  Description of Artificial Sequence: Synthetic oligonucleotide
agccgcgggcgccgtgggtt

SEQ ID NO: 372306 - DNA, 20 bp, Artificial Sequence
  Description of Artificial Sequence: Synthetic oligonucleotide
gccgcgggcgccgtgggttt

SEQ ID NO: 372307 - DNA, 20 bp, Artificial Sequence
  Description of Artificial Sequence: Synthetic oligonucleotide
ccgcgggcgccgtgggtgtt

SEQ ID NO: 372308 - DNA, 20 bp, Artificial Sequence
  Description of Artificial Sequence: Synthetic oligonucleotide
cgcgggcgccgtgggtggat

SEQ ID NO: 372309 - DNA, 20 bp, Artificial Sequence
  Description of Artificial Sequence: Synthetic oligonucleotide
gcgggcgccgtgggtggagt

SEQ ID NO: 372310 - DNA, 20 bp, Artificial Sequence
  Description of Artificial Sequence: Synthetic oligonucleotide
cgggcgccgtgggtggagca

SEQ ID NO: 372311 - DNA, 20 bp, Artificial Sequence
  Description of Artificial Sequence: Synthetic oligonucleotide
gggcgccgtgggtggagcag

SEQ ID NO: 372312 - DNA, 21 bp, Artificial Sequence
  Description of Artificial Sequence: Synthetic oligonucleotide
ggcgccgtgggtggagcagga

SEQ ID NO: 372313 - DNA, 21 bp, Artificial Sequence
  Description of Artificial Sequence: Synthetic oligonucleotide
gcgccgtgggtggagcaggag

SEQ ID NO: 372314 - DNA, 21 bp, Artificial Sequence
  Description of Artificial Sequence: Synthetic oligonucleotide
cgccgtgggtggagcaggagg

SEQ ID NO: 372315 - DNA, 21 bp, Artificial Sequence
  Description of Artificial Sequence: Synthetic oligonucleotide
gccgtgggtggagcaggaggg

SEQ ID NO: 372316 - DNA, 21 bp, Artificial Sequence
  Description of Artificial Sequence: Synthetic oligonucleotide
ccgtgggtggagcaggagggg

SEQ ID NO: 372317 - DNA, 21 bp, Artificial Sequence
  Description of Artificial Sequence: Synthetic oligonucleotide
cgtgggtggagcaggaggggc

SEQ ID NO: 372318 - DNA, 21 bp, Artificial Sequence
  Description of Artificial Sequence: Synthetic oligonucleotide
gtgggtggagcaggaggggcc

SEQ ID NO: 372319 - DNA, 21 bp, Artificial Sequence
  Description of Artificial Sequence: Synthetic oligonucleotide
tgggtggagcaggaggggccg

SEQ ID NO: 372320 - DNA, 20 bp, Artificial Sequence
  Description of Artificial Sequence: Synthetic oligonucleotide
gggtggagcaggaggggccg

SEQ ID NO: 372321 - DNA, 21 bp, Artificial Sequence
  Description of Artificial Sequence: Synthetic oligonucleotide
ggtggagcaggaggggccgga

SEQ ID NO: 372322 - DNA, 25 bp, Artificial Sequence
  Description of Artificial Sequence: Synthetic oligonucleotide
gtggagcaggaggggccggagtatt

SEQ ID NO: 372323 - DNA, 25 bp, Artificial Sequence
  Description of Artificial Sequence: Synthetic oligonucleotide
tggagcaggaggggccggagtattg

SEQ ID NO: 372324 - DNA, 24 bp, Artificial Sequence
  Description of Artificial Sequence: Synthetic oligonucleotide
ggagcaggaggggccggagtattg

SEQ ID NO: 372325 - DNA, 26 bp, Artificial Sequence
  Description of Artificial Sequence: Synthetic oligonucleotide
ccggagtattgggaccgggagacaca

SEQ ID NO: 372326 - DNA, 27 bp, Artificial Sequence
  Description of Artificial Sequence: Synthetic oligonucleotide
cggagtattgggaccgggagacacaga

SEQ ID NO: 372327 - DNA, 28 bp, Artificial Sequence
  Description of Artificial Sequence: Synthetic oligonucleotide
ggagtattgggaccgggagacacagaag

SEQ ID NO: 372328 - DNA, 30 bp, Artificial Sequence; identical to SEQ ID NO: 23375
  Description of Artificial Sequence: Synthetic oligonucleotide

SEQ ID NO: 372329 - DNA, 32 bp, Artificial Sequence; identical to SEQ ID NO: 23376
  Description of Artificial Sequence: Synthetic oligonucleotide

SEQ ID NO: 372330 - DNA, 31 bp, Artificial Sequence; identical to SEQ ID NO: 23377
  Description of Artificial Sequence: Synthetic oligonucleotide

SEQ ID NO: 372331 - DNA, 31 bp, Artificial Sequence; identical to SEQ ID NO: 23378
  Description of Artificial Sequence: Synthetic oligonucleotide

SEQ ID NO: 372332 - DNA, 30 bp, Artificial Sequence; identical to SEQ ID NO: 23379
  Description of Artificial Sequence: Synthetic oligonucleotide

SEQ ID NO: 372333 - DNA, 29 bp, Artificial Sequence
  Description of Artificial Sequence: Synthetic oligonucleotide
ttgggaccgggagacacagaagtacaagc

SEQ ID NO: 372334 - DNA, 28 bp, Artificial Sequence
  Description of Artificial Sequence: Synthetic oligonucleotide
tgggaccgggagacacagaagtacaagc

SEQ ID NO: 372335 - DNA, 27 bp, Artificial Sequence
  Description of Artificial Sequence: Synthetic oligonucleotide
gggaccgggagacacagaagtacaagc

SEQ ID NO: 372336 - DNA, 27 bp, Artificial Sequence
  Description of Artificial Sequence: Synthetic oligonucleotide
ggaccgggagacacagaagtacaagcg

SEQ ID NO: 372337 - DNA, 27 bp, Artificial Sequence
  Description of Artificial Sequence: Synthetic oligonucleotide
gaccgggagacacagaagtacaagcgc

SEQ ID NO: 372338 - DNA, 27 bp, Artificial Sequence
  Description of Artificial Sequence: Synthetic oligonucleotide
accgggagacacagaagtacaagcgcc

SEQ ID NO: 372339 - DNA, 27 bp, Artificial Sequence
  Description of Artificial Sequence: Synthetic oligonucleotide
ccgggagacacagaagtacaagcgcca

SEQ ID NO: 372340 - DNA, 27 bp, Artificial Sequence
  Description of Artificial Sequence: Synthetic oligonucleotide
cgggagacacagaagtacaagcgccag

SEQ ID NO: 372341 - DNA, 27 bp, Artificial Sequence
  Description of Artificial Sequence: Synthetic oligonucleotide
gggagacacagaagtacaagcgccagg

SEQ ID NO: 372342 - DNA, 27 bp, Artificial Sequence
  Description of Artificial Sequence: Synthetic oligonucleotide
ggagacacagaagtacaagcgccaggc

SEQ ID NO: 372343 - DNA, 28 bp, Artificial Sequence
  Description of Artificial Sequence: Synthetic oligonucleotide
gagacacagaagtacaagcgccaggcac

SEQ ID NO: 372344 - DNA, 29 bp, Artificial Sequence
  Description of Artificial Sequence: Synthetic oligonucleotide
agacacagaagtacaagcgccaggcacag

SEQ ID NO: 372345 - DNA, 28 bp, Artificial Sequence
  Description of Artificial Sequence: Synthetic oligonucleotide
gacacagaagtacaagcgccaggcacag

SEQ ID NO: 372346 - DNA, 28 bp, Artificial Sequence
  Description of Artificial Sequence: Synthetic oligonucleotide
acacagaagtacaagcgccaggcacagg

SEQ ID NO: 372347 - DNA, 27 bp, Artificial Sequence
  Description of Artificial Sequence: Synthetic oligonucleotide
cacagaagtacaagcgccaggcacagg

SEQ ID NO: 372348 - DNA, 27 bp, Artificial Sequence
  Description of Artificial Sequence: Synthetic oligonucleotide
acagaagtacaagcgccaggcacaggc

SEQ ID NO: 372349 - DNA, 27 bp, Artificial Sequence
  Description of Artificial Sequence: Synthetic oligonucleotide
cagaagtacaagcgccaggcacaggct

SEQ ID NO: 372350 - DNA, 27 bp, Artificial Sequence
  Description of Artificial Sequence: Synthetic oligonucleotide
agaagtacaagcgccaggcacaggctg

SEQ ID NO: 372351 - DNA, 27 bp, Artificial Sequence
  Description of Artificial Sequence: Synthetic oligonucleotide
gaagtacaagcgccaggcacaggctga

SEQ ID NO: 372352 - DNA, 27 bp, Artificial Sequence
  Description of Artificial Sequence: Synthetic oligonucleotide
aagtacaagcgccaggcacaggctgac

SEQ ID NO: 372353 - DNA, 26 bp, Artificial Sequence
  Description of Artificial Sequence: Synthetic oligonucleotide
agtacaagcgccaggcacaggctgac

SEQ ID NO: 372354 - DNA, 25 bp, Artificial Sequence
  Description of Artificial Sequence: Synthetic oligonucleotide
gtacaagcgccaggcacaggctgac

SEQ ID NO: 372355 - DNA, 25 bp, Artificial Sequence
  Description of Artificial Sequence: Synthetic oligonucleotide
tacaagcgccaggcacaggctgacc

SEQ ID NO: 372356 - DNA, 24 bp, Artificial Sequence
  Description of Artificial Sequence: Synthetic oligonucleotide
acaagcgccaggcacaggctgacc

SEQ ID NO: 372357 - DNA, 23 bp, Artificial Sequence
  Description of Artificial Sequence: Synthetic oligonucleotide
caagcgccaggcacaggctgacc

SEQ ID NO: 372358 - DNA, 24 bp, Artificial Sequence
  Description of Artificial Sequence: Synthetic oligonucleotide
aagcgccaggcacaggctgaccga

SEQ ID NO: 372359 - DNA, 23 bp, Artificial Sequence
  Description of Artificial Sequence: Synthetic oligonucleotide
agcgccaggcacaggctgaccga

SEQ ID NO: 372360 - DNA, 22 bp, Artificial Sequence
  Description of Artificial Sequence: Synthetic oligonucleotide
gcgccaggcacaggctgaccga

SEQ ID NO: 372361 - DNA, 23 bp, Artificial Sequence
  Description of Artificial Sequence: Synthetic oligonucleotide
cgccaggcacaggctgaccgagt

SEQ ID NO: 372362 - DNA, 24 bp, Artificial Sequence
  Description of Artificial Sequence: Synthetic oligonucleotide
gccaggcacaggctgaccgagtga

SEQ ID NO: 372363 - DNA, 24 bp, Artificial Sequence
  Description of Artificial Sequence: Synthetic oligonucleotide
ccaggcacaggctgaccgagtgag

SEQ ID NO: 372364 - DNA, 24 bp, Artificial Sequence
  Description of Artificial Sequence: Synthetic oligonucleotide
caggcacaggctgaccgagtgagc

SEQ ID NO: 372365 - DNA, 25 bp, Artificial Sequence
  Description of Artificial Sequence: Synthetic oligonucleotide
aggcacaggctgaccgagtgagcct

SEQ ID NO: 372366 - DNA, 24 bp, Artificial Sequence
  Description of Artificial Sequence: Synthetic oligonucleotide
ggcacaggctgaccgagtgagcct

SEQ ID NO: 372367 - DNA, 24 bp, Artificial Sequence
  Description of Artificial Sequence: Synthetic oligonucleotide
gcacaggctgaccgagtgagcctg

SEQ ID NO: 372368 - DNA, 24 bp, Artificial Sequence
  Description of Artificial Sequence: Synthetic oligonucleotide
cacaggctgaccgagtgagcctgc

SEQ ID NO: 372369 - DNA, 24 bp, Artificial Sequence
  Description of Artificial Sequence: Synthetic oligonucleotide
acaggctgaccgagtgagcctgcg

SEQ ID NO: 372370 - DNA, 23 bp, Artificial Sequence
  Description of Artificial Sequence: Synthetic oligonucleotide
caggctgaccgagtgagcctgcg

SEQ ID NO: 372371 - DNA, 25 bp, Artificial Sequence
  Description of Artificial Sequence: Synthetic oligonucleotide
aggctgaccgagtgagcctgcggaa

SEQ ID NO: 372372 - DNA, 24 bp, Artificial Sequence
  Description of Artificial Sequence: Synthetic oligonucleotide
ggctgaccgagtgagcctgcggaa

SEQ ID NO: 372373 - DNA, 24 bp, Artificial Sequence
  Description of Artificial Sequence: Synthetic oligonucleotide
gctgaccgagtgagcctgcggaac

SEQ ID NO: 372374 - DNA, 25 bp, Artificial Sequence
  Description of Artificial Sequence: Synthetic oligonucleotide
ctgaccgagtgagcctgcggaacct

SEQ ID NO: 372375 - DNA, 25 bp, Artificial Sequence
  Description of Artificial Sequence: Synthetic oligonucleotide
tgaccgagtgagcctgcggaacctg

SEQ ID NO: 372376 - DNA, 24 bp, Artificial Sequence
  Description of Artificial Sequence: Synthetic oligonucleotide
gaccgagtgagcctgcggaacctg

SEQ ID NO: 372377 - DNA, 24 bp, Artificial Sequence
  Description of Artificial Sequence: Synthetic oligonucleotide
accgagtgagcctgcggaacctgc

SEQ ID NO: 372378 - DNA, 23 bp, Artificial Sequence
  Description of Artificial Sequence: Synthetic oligonucleotide
ccgagtgagcctgcggaacctgc

SEQ ID NO: 372379 - DNA, 23 bp, Artificial Sequence
  Description of Artificial Sequence: Synthetic oligonucleotide
cgagtgagcctgcggaacctgcg

SEQ ID NO: 372380 - DNA, 23 bp, Artificial Sequence
  Description of Artificial Sequence: Synthetic oligonucleotide
gagtgagcctgcggaacctgcgc

SEQ ID NO: 372381 - DNA, 23 bp, Artificial Sequence
  Description of Artificial Sequence: Synthetic oligonucleotide
agtgagcctgcggaacctgcgcg

SEQ ID NO: 372382 - DNA, 22 bp, Artificial Sequence
  Description of Artificial Sequence: Synthetic oligonucleotide
gtgagcctgcggaacctgcgcg

SEQ ID NO: 372383 - DNA, 22 bp, Artificial Sequence
  Description of Artificial Sequence: Synthetic oligonucleotide
tgagcctgcggaacctgcgcgg

SEQ ID NO: 372384 - DNA, 26 bp, Artificial Sequence
  Description of Artificial Sequence: Synthetic oligonucleotide
aaccagagcgaggccgggtctcacat

SEQ ID NO: 372385 - DNA, 25 bp, Artificial Sequence
  Description of Artificial Sequence: Synthetic oligonucleotide
accagagcgaggccgggtctcacat

SEQ ID NO: 372386 - DNA, 24 bp, Artificial Sequence
  Description of Artificial Sequence: Synthetic oligonucleotide
ccagagcgaggccgggtctcacat

SEQ ID NO: 372387 - DNA, 26 bp, Artificial Sequence
  Description of Artificial Sequence: Synthetic oligonucleotide
cagagcgaggccgggtctcacatcat

SEQ ID NO: 372388 - DNA, 26 bp, Artificial Sequence
  Description of Artificial Sequence: Synthetic oligonucleotide
agagcgaggccgggtctcacatcatc

SEQ ID NO: 372389 - DNA, 25 bp, Artificial Sequence
  Description of Artificial Sequence: Synthetic oligonucleotide
gagcgaggccgggtctcacatcatc

SEQ ID NO: 372390 - DNA, 26 bp, Artificial Sequence
  Description of Artificial Sequence: Synthetic oligonucleotide
agcgaggccgggtctcacatcatcca

SEQ ID NO: 372391 - DNA, 25 bp, Artificial Sequence
  Description of Artificial Sequence: Synthetic oligonucleotide
gcgaggccgggtctcacatcatcca

SEQ ID NO: 372392 - DNA, 26 bp, Artificial Sequence
  Description of Artificial Sequence: Synthetic oligonucleotide
cgaggccgggtctcacatcatccaga

SEQ ID NO: 372393 - DNA, 26 bp, Artificial Sequence
  Description of Artificial Sequence: Synthetic oligonucleotide
gaggccgggtctcacatcatccagag

SEQ ID NO: 372394 - DNA, 27 bp, Artificial Sequence
  Description of Artificial Sequence: Synthetic oligonucleotide
aggccgggtctcacatcatccagagga

SEQ ID NO: 372395 - DNA, 27 bp, Artificial Sequence
  Description of Artificial Sequence: Synthetic oligonucleotide
ggccgggtctcacatcatccagaggat

SEQ ID NO: 372396 - DNA, 27 bp, Artificial Sequence
  Description of Artificial Sequence: Synthetic oligonucleotide
gccgggtctcacatcatccagaggatg

SEQ ID NO: 372397 - DNA, 29 bp, Artificial Sequence
  Description of Artificial Sequence: Synthetic oligonucleotide
ccgggtctcacatcatccagaggatgtac

SEQ ID NO: 372398 - DNA, 29 bp, Artificial Sequence
  Description of Artificial Sequence: Synthetic oligonucleotide
cgggtctcacatcatccagaggatgtacg

SEQ ID NO: 372399 - DNA, 29 bp, Artificial Sequence
  Description of Artificial Sequence: Synthetic oligonucleotide
gggtctcacatcatccagaggatgtacgg

SEQ ID NO: 372400 - DNA, 29 bp, Artificial Sequence
  Description of Artificial Sequence: Synthetic oligonucleotide
ggtctcacatcatccagaggatgtacggc

SEQ ID NO: 372401 - DNA, 30 bp, Artificial Sequence; identical to SEQ ID NO: 23435
  Description of Artificial Sequence: Synthetic oligonucleotide

SEQ ID NO: 372402 - DNA, 30 bp, Artificial Sequence; identical to SEQ ID NO: 23436
  Description of Artificial Sequence: Synthetic oligonucleotide

SEQ ID NO: 372403 - DNA, 29 bp, Artificial Sequence
  Description of Artificial Sequence: Synthetic oligonucleotide
ctcacatcatccagaggatgtacggctgc

SEQ ID NO: 372404 - DNA, 29 bp, Artificial Sequence
  Description of Artificial Sequence: Synthetic oligonucleotide
tcacatcatccagaggatgtacggctgcg

SEQ ID NO: 372405 - DNA, 28 bp, Artificial Sequence
  Description of Artificial Sequence: Synthetic oligonucleotide
cacatcatccagaggatgtacggctgcg

SEQ ID NO: 372406 - DNA, 29 bp, Artificial Sequence
  Description of Artificial Sequence: Synthetic oligonucleotide
acatcatccagaggatgtacggctgcgac

SEQ ID NO: 372407 - DNA, 28 bp, Artificial Sequence
  Description of Artificial Sequence: Synthetic oligonucleotide
catcatccagaggatgtacggctgcgac

SEQ ID NO: 372408 - DNA, 28 bp, Artificial Sequence
  Description of Artificial Sequence: Synthetic oligonucleotide
atcatccagaggatgtacggctgcgacg

SEQ ID NO: 372409 - DNA, 27 bp, Artificial Sequence
  Description of Artificial Sequence: Synthetic oligonucleotide
tcatccagaggatgtacggctgcgacg

SEQ ID NO: 372410 - DNA, 27 bp, Artificial Sequence
  Description of Artificial Sequence: Synthetic oligonucleotide
catccagaggatgtacggctgcgacgt

SEQ ID NO: 372411 - DNA, 27 bp, Artificial Sequence
  Description of Artificial Sequence: Synthetic oligonucleotide
atccagaggatgtacggctgcgacgtg

SEQ ID NO: 372412 - DNA, 21 bp, Artificial Sequence
  Description of Artificial Sequence: Synthetic oligonucleotide
gggcgcctcctccgcgggtat

SEQ ID NO: 372413 - DNA, 22 bp, Artificial Sequence
  Description of Artificial Sequence: Synthetic oligonucleotide
ggcgcctcctccgcgggtatga

SEQ ID NO: 372414 - DNA, 22 bp, Artificial Sequence
  Description of Artificial Sequence: Synthetic oligonucleotide
gcgcctcctccgcgggtatgac

SEQ ID NO: 372415 - DNA, 23 bp, Artificial Sequence
  Description of Artificial Sequence: Synthetic oligonucleotide
cgcctcctccgcgggtatgacca

SEQ ID NO: 372416 - DNA, 25 bp, Artificial Sequence
  Description of Artificial Sequence: Synthetic oligonucleotide
gcctcctccgcgggtatgaccagta

SEQ ID NO: 372417 - DNA, 25 bp, Artificial Sequence
  Description of Artificial Sequence: Synthetic oligonucleotide
cctcctccgcgggtatgaccagtac

SEQ ID NO: 372418 - DNA, 25 bp, Artificial Sequence
  Description of Artificial Sequence: Synthetic oligonucleotide
ctcctccgcgggtatgaccagtacg

SEQ ID NO: 372419 - DNA, 25 bp, Artificial Sequence
  Description of Artificial Sequence: Synthetic oligonucleotide
tcctccgcgggtatgaccagtacgc

SEQ ID NO: 372420 - DNA, 24 bp, Artificial Sequence
  Description of Artificial Sequence: Synthetic oligonucleotide
cctccgcgggtatgaccagtacgc

SEQ ID NO: 372421 - DNA, 26 bp, Artificial Sequence
  Description of Artificial Sequence: Synthetic oligonucleotide
ctccgcgggtatgaccagtacgccta

SEQ ID NO: 372422 - DNA, 26 bp, Artificial Sequence
  Description of Artificial Sequence: Synthetic oligonucleotide
tccgcgggtatgaccagtacgcctac

SEQ ID NO: 372423 - DNA, 25 bp, Artificial Sequence
  Description of Artificial Sequence: Synthetic oligonucleotide
ccgcgggtatgaccagtacgcctac

SEQ ID NO: 372424 - DNA, 26 bp, Artificial Sequence
  Description of Artificial Sequence: Synthetic oligonucleotide
cgcgggtatgaccagtacgcctacga

SEQ ID NO: 372425 - DNA, 26 bp, Artificial Sequence
  Description of Artificial Sequence: Synthetic oligonucleotide
gcgggtatgaccagtacgcctacgac

SEQ ID NO: 372426 - DNA, 26 bp, Artificial Sequence
  Description of Artificial Sequence: Synthetic oligonucleotide
cgggtatgaccagtacgcctacgacg

SEQ ID NO: 372427 - DNA, 26 bp, Artificial Sequence
  Description of Artificial Sequence: Synthetic oligonucleotide
gggtatgaccagtacgcctacgacgg

SEQ ID NO: 372428 - DNA, 27 bp, Artificial Sequence
  Description of Artificial Sequence: Synthetic oligonucleotide
ggtatgaccagtacgcctacgacggca

SEQ ID NO: 372429 - DNA, 28 bp, Artificial Sequence
  Description of Artificial Sequence: Synthetic oligonucleotide
gtatgaccagtacgcctacgacggcaag

SEQ ID NO: 372430 - DNA, 28 bp, Artificial Sequence
  Description of Artificial Sequence: Synthetic oligonucleotide
tatgaccagtacgcctacgacggcaagg

SEQ ID NO: 372431 - DNA, 28 bp, Artificial Sequence
  Description of Artificial Sequence: Synthetic oligonucleotide
acacagatctacaaggcccaggcacagg

SEQ ID NO: 372432 - DNA, 27 bp, Artificial Sequence
  Description of Artificial Sequence: Synthetic oligonucleotide
cacagatctacaaggcccaggcacagg

SEQ ID NO: 372433 - DNA, 27 bp, Artificial Sequence
  Description of Artificial Sequence: Synthetic oligonucleotide
acagatctacaaggcccaggcacaggc

SEQ ID NO: 372434 - DNA, 27 bp, Artificial Sequence
  Description of Artificial Sequence: Synthetic oligonucleotide
cagatctacaaggcccaggcacaggct

SEQ ID NO: 372435 - DNA, 27 bp, Artificial Sequence
  Description of Artificial Sequence: Synthetic oligonucleotide
agatctacaaggcccaggcacaggctg

SEQ ID NO: 372436 - DNA, 27 bp, Artificial Sequence
  Description of Artificial Sequence: Synthetic oligonucleotide
gatctacaaggcccaggcacaggctga

SEQ ID NO: 372437 - DNA, 27 bp, Artificial Sequence
  Description of Artificial Sequence: Synthetic oligonucleotide
atctacaaggcccaggcacaggctgac

SEQ ID NO: 372438 - DNA, 26 bp, Artificial Sequence
  Description of Artificial Sequence: Synthetic oligonucleotide
tctacaaggcccaggcacaggctgac

SEQ ID NO: 372439 - DNA, 25 bp, Artificial Sequence
  Description of Artificial Sequence: Synthetic oligonucleotide
ctacaaggcccaggcacaggctgac

SEQ ID NO: 372440 - DNA, 25 bp, Artificial Sequence
  Description of Artificial Sequence: Synthetic oligonucleotide
tacaaggcccaggcacaggctgacc

SEQ ID NO: 372441 - DNA, 24 bp, Artificial Sequence
  Description of Artificial Sequence: Synthetic oligonucleotide
acaaggcccaggcacaggctgacc

SEQ ID NO: 372442 - DNA, 23 bp, Artificial Sequence
  Description of Artificial Sequence: Synthetic oligonucleotide
caaggcccaggcacaggctgacc

SEQ ID NO: 372443 - DNA, 24 bp, Artificial Sequence
  Description of Artificial Sequence: Synthetic oligonucleotide
aaggcccaggcacaggctgaccga

SEQ ID NO: 372444 - DNA, 23 bp, Artificial Sequence
  Description of Artificial Sequence: Synthetic oligonucleotide
aggcccaggcacaggctgaccga

SEQ ID NO: 372445 - DNA, 22 bp, Artificial Sequence
  Description of Artificial Sequence: Synthetic oligonucleotide
ggcccaggcacaggctgaccga

SEQ ID NO: 372446 - DNA, 23 bp, Artificial Sequence
  Description of Artificial Sequence: Synthetic oligonucleotide
gcccaggcacaggctgaccgagt

SEQ ID NO: 372447 - DNA, 24 bp, Artificial Sequence
  Description of Artificial Sequence: Synthetic oligonucleotide
cccaggcacaggctgaccgagtga

SEQ ID NO: 372448 - DNA, 23 bp, Artificial Sequence
  Description of Artificial Sequence: Synthetic oligonucleotide
cggagagcctacctggagggcct

SEQ ID NO: 372449 - DNA, 24 bp, Artificial Sequence
  Description of Artificial Sequence: Synthetic oligonucleotide
ggagagcctacctggagggcctgt

SEQ ID NO: 372450 - DNA, 24 bp, Artificial Sequence
  Description of Artificial Sequence: Synthetic oligonucleotide
gagagcctacctggagggcctgtg

SEQ ID NO: 372451 - DNA, 24 bp, Artificial Sequence
  Description of Artificial Sequence: Synthetic oligonucleotide
agagcctacctggagggcctgtgc

SEQ ID NO: 372452 - DNA, 23 bp, Artificial Sequence
  Description of Artificial Sequence: Synthetic oligonucleotide
gagcctacctggagggcctgtgc

SEQ ID NO: 372453 - DNA, 24 bp, Artificial Sequence
  Description of Artificial Sequence: Synthetic oligonucleotide
agcctacctggagggcctgtgcgt

SEQ ID NO: 372454 - DNA, 23 bp, Artificial Sequence
  Description of Artificial Sequence: Synthetic oligonucleotide
gcctacctggagggcctgtgcgt

SEQ ID NO: 372455 - DNA, 23 bp, Artificial Sequence
  Description of Artificial Sequence: Synthetic oligonucleotide
cctacctggagggcctgtgcgtg

SEQ ID NO: 372456 - DNA, 24 bp, Artificial Sequence
  Description of Artificial Sequence: Synthetic oligonucleotide
ctacctggagggcctgtgcgtgga

SEQ ID NO: 372457 - DNA, 25 bp, Artificial Sequence
  Description of Artificial Sequence: Synthetic oligonucleotide
tacctggagggcctgtgcgtggagt

SEQ ID NO: 372458 - DNA, 24 bp, Artificial Sequence
  Description of Artificial Sequence: Synthetic oligonucleotide
acctggagggcctgtgcgtggagt

SEQ ID NO: 372459 - DNA, 23 bp, Artificial Sequence
  Description of Artificial Sequence: Synthetic oligonucleotide
cctggagggcctgtgcgtggagt

SEQ ID NO: 372460 - DNA, 23 bp, Artificial Sequence
  Description of Artificial Sequence: Synthetic oligonucleotide
ctggagggcctgtgcgtggagtc

SEQ ID NO: 372461 - DNA, 23 bp, Artificial Sequence
  Description of Artificial Sequence: Synthetic oligonucleotide
tggagggcctgtgcgtggagtcg

SEQ ID NO: 372462 - DNA, 22 bp, Artificial Sequence
  Description of Artificial Sequence: Synthetic oligonucleotide
ggagggcctgtgcgtggagtcg

SEQ ID NO: 372463 - DNA, 23 bp, Artificial Sequence
  Description of Artificial Sequence: Synthetic oligonucleotide
gagggcctgtgcgtggagtcgct

SEQ ID NO: 372464 - DNA, 23 bp, Artificial Sequence
  Description of Artificial Sequence: Synthetic oligonucleotide
agggcctgtgcgtggagtcgctc

SEQ ID NO: 372465 - DNA, 22 bp, Artificial Sequence
  Description of Artificial Sequence: Synthetic oligonucleotide
gggcctgtgcgtggagtcgctc

SEQ ID NO: 372466 - DNA, 22 bp, Artificial Sequence
  Description of Artificial Sequence: Synthetic oligonucleotide
ggcctgtgcgtggagtcgctcc

SEQ ID NO: 372467 - DNA, 22 bp, Artificial Sequence
  Description of Artificial Sequence: Synthetic oligonucleotide
gcctgtgcgtggagtcgctccg

SEQ ID NO: 372468 - DNA, 23 bp, Artificial Sequence
  Description of Artificial Sequence: Synthetic oligonucleotide
cctgtgcgtggagtcgctccgca

SEQ ID NO: 372469 - DNA, 26 bp, Artificial Sequence
  Description of Artificial Sequence: Synthetic oligonucleotide
ctgtgcgtggagtcgctccgcagata

SEQ ID NO: 372470 - DNA, 26 bp, Artificial Sequence
  Description of Artificial Sequence: Synthetic oligonucleotide
tgtgcgtggagtcgctccgcagatac

SEQ ID NO: 372471 - DNA, 25 bp, Artificial Sequence
  Description of Artificial Sequence: Synthetic oligonucleotide
gtgcgtggagtcgctccgcagatac

SEQ ID NO: 372472 - DNA, 26 bp, Artificial Sequence
  Description of Artificial Sequence: Synthetic oligonucleotide
tgcgtggagtcgctccgcagatacct

SEQ ID NO: 372473 - DNA, 25 bp, Artificial Sequence
  Description of Artificial Sequence: Synthetic oligonucleotide
gcgtggagtcgctccgcagatacct

SEQ ID NO: 372474 - DNA, 25 bp, Artificial Sequence
  Description of Artificial Sequence: Synthetic oligonucleotide
cgtggagtcgctccgcagatacctg

SEQ ID NO: 372475 - DNA, 26 bp, Artificial Sequence
  Description of Artificial Sequence: Synthetic oligonucleotide
gtggagtcgctccgcagatacctgga

SEQ ID NO: 372476 - DNA, 27 bp, Artificial Sequence
  Description of Artificial Sequence: Synthetic oligonucleotide
tggagtcgctccgcagatacctggaga

SEQ ID NO: 372477 - DNA, 27 bp, Artificial Sequence
  Description of Artificial Sequence: Synthetic oligonucleotide
ggagtcgctccgcagatacctggagaa

SEQ ID NO: 372478 - DNA, 27 bp, Artificial Sequence
  Description of Artificial Sequence: Synthetic oligonucleotide
gagtcgctccgcagatacctggagaac

SEQ ID NO: 372479 - DNA, 27 bp, Artificial Sequence
  Description of Artificial Sequence: Synthetic oligonucleotide
agtcgctccgcagatacctggagaacg

SEQ ID NO: 372480 - DNA, 26 bp, Artificial Sequence
  Description of Artificial Sequence: Synthetic oligonucleotide
gtcgctccgcagatacctggagaacg

SEQ ID NO: 372481 - DNA, 26 bp, Artificial Sequence
  Description of Artificial Sequence: Synthetic oligonucleotide
tcgctccgcagatacctggagaacgg

SEQ ID NO: 372482 - DNA, 25 bp, Artificial Sequence
  Description of Artificial Sequence: Synthetic oligonucleotide
cgctccgcagatacctggagaacgg

SEQ ID NO: 372483 - DNA, 20 bp, Artificial Sequence
  Description of Artificial Sequence: Synthetic oligonucleotide
cccggccgcggggagctctt

SEQ ID NO: 372484 - DNA, 20 bp, Artificial Sequence
  Description of Artificial Sequence: Synthetic oligonucleotide
ccggccgcggggagctcctt

SEQ ID NO: 372485 - DNA, 20 bp, Artificial Sequence
  Description of Artificial Sequence: Synthetic oligonucleotide
cggccgcggggagctccgtt

SEQ ID NO: 372486 - DNA, 20 bp, Artificial Sequence
  Description of Artificial Sequence: Synthetic oligonucleotide
ggccgcggggagctccgctt

SEQ ID NO: 372487 - DNA, 22 bp, Artificial Sequence
  Description of Artificial Sequence: Synthetic oligonucleotide
gccgcggggagctccgcttcat

SEQ ID NO: 372488 - DNA, 23 bp, Artificial Sequence
  Description of Artificial Sequence: Synthetic oligonucleotide
ccgcggggagctccgcttcatct

SEQ ID NO: 372489 - DNA, 24 bp, Artificial Sequence
  Description of Artificial Sequence: Synthetic oligonucleotide
cgcggggagctccgcttcatctca

SEQ ID NO: 372490 - DNA, 25 bp, Artificial Sequence
  Description of Artificial Sequence: Synthetic oligonucleotide
gcggggagctccgcttcatctcagt

SEQ ID NO: 372491 - DNA, 25 bp, Artificial Sequence
  Description of Artificial Sequence: Synthetic oligonucleotide
cggggagctccgcttcatctcagtg

SEQ ID NO: 372492 - DNA, 25 bp, Artificial Sequence
  Description of Artificial Sequence: Synthetic oligonucleotide
ggggagctccgcttcatctcagtgg

SEQ ID NO: 372493 - DNA, 25 bp, Artificial Sequence
  Description of Artificial Sequence: Synthetic oligonucleotide
gggagctccgcttcatctcagtggg

SEQ ID NO: 372494 - DNA, 27 bp, Artificial Sequence
  Description of Artificial Sequence: Synthetic oligonucleotide
ggagctccgcttcatctcagtgggcta

SEQ ID NO: 372495 - DNA, 27 bp, Artificial Sequence
  Description of Artificial Sequence: Synthetic oligonucleotide
gagctccgcttcatctcagtgggctac

SEQ ID NO: 372496 - DNA, 27 bp, Artificial Sequence
  Description of Artificial Sequence: Synthetic oligonucleotide
agctccgcttcatctcagtgggctacg

SEQ ID NO: 372497 - DNA, 27 bp, Artificial Sequence
  Description of Artificial Sequence: Synthetic oligonucleotide
gctccgcttcatctcagtgggctacgt

SEQ ID NO: 372498 - DNA, 27 bp, Artificial Sequence
  Description of Artificial Sequence: Synthetic oligonucleotide
ctccgcttcatctcagtgggctacgtg

SEQ ID NO: 372499 - DNA, 27 bp, Artificial Sequence
  Description of Artificial Sequence: Synthetic oligonucleotide
tccgcttcatctcagtgggctacgtgg

SEQ ID NO: 372500 - DNA, 22 bp, Artificial Sequence
  Description of Artificial Sequence: Synthetic oligonucleotide
tgcgctcctggaccgccgcgaa

SEQ ID NO: 372501 - DNA, 21 bp, Artificial Sequence
  Description of Artificial Sequence: Synthetic oligonucleotide
gcgctcctggaccgccgcgaa

SEQ ID NO: 372502 - DNA, 22 bp, Artificial Sequence
  Description of Artificial Sequence: Synthetic oligonucleotide
cgctcctggaccgccgcgaaca

SEQ ID NO: 372503 - DNA, 22 bp, Artificial Sequence
  Description of Artificial Sequence: Synthetic oligonucleotide
gctcctggaccgccgcgaacac

SEQ ID NO: 372504 - DNA, 22 bp, Artificial Sequence
  Description of Artificial Sequence: Synthetic oligonucleotide
ctcctggaccgccgcgaacacg

SEQ ID NO: 372505 - DNA, 22 bp, Artificial Sequence
  Description of Artificial Sequence: Synthetic oligonucleotide
tcctggaccgccgcgaacacgg

SEQ ID NO: 372506 - DNA, 21 bp, Artificial Sequence
  Description of Artificial Sequence: Synthetic oligonucleotide
cctggaccgccgcgaacacgg

SEQ ID NO: 372507 - DNA, 21 bp, Artificial Sequence
  Description of Artificial Sequence: Synthetic oligonucleotide
ctggaccgccgcgaacacggc

SEQ ID NO: 372508 - DNA, 21 bp, Artificial Sequence
  Description of Artificial Sequence: Synthetic oligonucleotide
tggaccgccgcgaacacggcg

SEQ ID NO: 372509 - DNA, 20 bp, Artificial Sequence
  Description of Artificial Sequence: Synthetic oligonucleotide
ggaccgccgcgaacacggcg

SEQ ID NO: 372510 - DNA, 20 bp, Artificial Sequence
  Description of Artificial Sequence: Synthetic oligonucleotide
gaccgccgcgaacacggcgg

SEQ ID NO: 372511 - DNA, 21 bp, Artificial Sequence
  Description of Artificial Sequence: Synthetic oligonucleotide
accgccgcgaacacggcggct

SEQ ID NO: 372512 - DNA, 20 bp, Artificial Sequence
  Description of Artificial Sequence: Synthetic oligonucleotide
ccgccgcgaacacggcggct

SEQ ID NO: 372513 - DNA, 21 bp, Artificial Sequence
  Description of Artificial Sequence: Synthetic oligonucleotide
cgccgcgaacacggcggctca

SEQ ID NO: 372514 - DNA, 23 bp, Artificial Sequence
  Description of Artificial Sequence: Synthetic oligonucleotide
gccgcgaacacggcggctcagat

SEQ ID NO: 372515 - DNA, 24 bp, Artificial Sequence
  Description of Artificial Sequence: Synthetic oligonucleotide
ccgcgaacacggcggctcagatca

SEQ ID NO: 372516 - DNA, 24 bp, Artificial Sequence
  Description of Artificial Sequence: Synthetic oligonucleotide
cgcgaacacggcggctcagatcac

SEQ ID NO: 372517 - DNA, 24 bp, Artificial Sequence
  Description of Artificial Sequence: Synthetic oligonucleotide
gcgaacacggcggctcagatcacc

SEQ ID NO: 372518 - DNA, 25 bp, Artificial Sequence
  Description of Artificial Sequence: Synthetic oligonucleotide
cgaacacggcggctcagatcaccca

SEQ ID NO: 372519 - DNA, 25 bp, Artificial Sequence
  Description of Artificial Sequence: Synthetic oligonucleotide
gaacacggcggctcagatcacccag

SEQ ID NO: 372520 - DNA, 25 bp, Artificial Sequence
  Description of Artificial Sequence: Synthetic oligonucleotide
aacacggcggctcagatcacccagc

SEQ ID NO: 372521 - DNA, 22 bp, Artificial Sequence
  Description of Artificial Sequence: Synthetic oligonucleotide
ctcctggaccgccgcgaacacc

SEQ ID NO: 372522 - DNA, 22 bp, Artificial Sequence
  Description of Artificial Sequence: Synthetic oligonucleotide
tcctggaccgccgcgaacaccg

SEQ ID NO: 372523 - DNA, 21 bp, Artificial Sequence
  Description of Artificial Sequence: Synthetic oligonucleotide
cctggaccgccgcgaacaccg

SEQ ID NO: 372524 - DNA, 21 bp, Artificial Sequence
  Description of Artificial Sequence: Synthetic oligonucleotide
ctggaccgccgcgaacaccgc

SEQ ID NO: 372525 - DNA, 21 bp, Artificial Sequence
  Description of Artificial Sequence: Synthetic oligonucleotide
tggaccgccgcgaacaccgcg

SEQ ID NO: 372526 - DNA, 20 bp, Artificial Sequence
  Description of Artificial Sequence: Synthetic oligonucleotide
ggaccgccgcgaacaccgcg

SEQ ID NO: 372527 - DNA, 20 bp, Artificial Sequence
  Description of Artificial Sequence: Synthetic oligonucleotide
gaccgccgcgaacaccgcgg

SEQ ID NO: 372528 - DNA, 21 bp, Artificial Sequence
  Description of Artificial Sequence: Synthetic oligonucleotide
accgccgcgaacaccgcggct

SEQ ID NO: 372529 - DNA, 20 bp, Artificial Sequence
  Description of Artificial Sequence: Synthetic oligonucleotide
ccgccgcgaacaccgcggct

SEQ ID NO: 372530 - DNA, 21 bp, Artificial Sequence
  Description of Artificial Sequence: Synthetic oligonucleotide
cgccgcgaacaccgcggctca

SEQ ID NO: 372531 - DNA, 23 bp, Artificial Sequence
  Description of Artificial Sequence: Synthetic oligonucleotide
gccgcgaacaccgcggctcagat

SEQ ID NO: 372532 - DNA, 24 bp, Artificial Sequence
  Description of Artificial Sequence: Synthetic oligonucleotide
ccgcgaacaccgcggctcagatca

SEQ ID NO: 372533 - DNA, 24 bp, Artificial Sequence
  Description of Artificial Sequence: Synthetic oligonucleotide
cgcgaacaccgcggctcagatcac

SEQ ID NO: 372534 - DNA, 24 bp, Artificial Sequence
  Description of Artificial Sequence: Synthetic oligonucleotide
gcgaacaccgcggctcagatcacc

SEQ ID NO: 372535 - DNA, 25 bp, Artificial Sequence
  Description of Artificial Sequence: Synthetic oligonucleotide
cgaacaccgcggctcagatcaccca

SEQ ID NO: 372536 - DNA, 25 bp, Artificial Sequence
  Description of Artificial Sequence: Synthetic oligonucleotide
gaacaccgcggctcagatcacccag

SEQ ID NO: 372537 - DNA, 25 bp, Artificial Sequence
  Description of Artificial Sequence: Synthetic oligonucleotide
aacaccgcggctcagatcacccagc

SEQ ID NO: 372538 - DNA, 30 bp, Artificial Sequence
  Description of Artificial Sequence: Synthetic oligonucleotide
ttggggattccccacttccctgagtttcac

SEQ ID NO: 372539 - DNA, 29 bp, Artificial Sequence
  Description of Artificial Sequence: Synthetic oligonucleotide
tggggattccccacttccctgagtttcac

SEQ ID NO: 372540 - DNA, 28 bp, Artificial Sequence
  Description of Artificial Sequence: Synthetic oligonucleotide
ggggattccccacttccctgagtttcac

SEQ ID NO: 372541 - DNA, 30 bp, Artificial Sequence
  Description of Artificial Sequence: Synthetic oligonucleotide
gggattccccacttccctgagtttcacttc

SEQ ID NO: 372542 - DNA, 32 bp, Artificial Sequence
  Description of Artificial Sequence: Synthetic oligonucleotide
ggattccccacttccctgagtttcacttcttc

SEQ ID NO: 372543 - DNA, 33 bp, Artificial Sequence
  Description of Artificial Sequence: Synthetic oligonucleotide
gattccccacttccctgagtttcacttcttctc

SEQ ID NO: 372544 - DNA, 33 bp, Artificial Sequence
  Description of Artificial Sequence: Synthetic oligonucleotide
attccccacttccctgagtttcacttcttctcc

SEQ ID NO: 372545 - DNA, 32 bp, Artificial Sequence
  Description of Artificial Sequence: Synthetic oligonucleotide
ttccccacttccctgagtttcacttcttctcc

SEQ ID NO: 372546 - DNA, 31 bp, Artificial Sequence
  Description of Artificial Sequence: Synthetic oligonucleotide
tccccacttccctgagtttcacttcttctcc

SEQ ID NO: 372547 - DNA, 30 bp, Artificial Sequence
  Description of Artificial Sequence: Synthetic oligonucleotide
ccccacttccctgagtttcacttcttctcc

SEQ ID NO: 372548 - DNA, 30 bp, Artificial Sequence
  Description of Artificial Sequence: Synthetic oligonucleotide
cccacttccctgagtttcacttcttctccc

SEQ ID NO: 372549 - DNA, 32 bp, Artificial Sequence
  Description of Artificial Sequence: Synthetic oligonucleotide
ccacttccctgagtttcacttcttctcccaac

SEQ ID NO: 372550 - DNA, 34 bp, Artificial Sequence
  Description of Artificial Sequence: Synthetic oligonucleotide
cacttccctgagtttcacttcttctcccaacttg

SEQ ID NO: 372551 - DNA, 35 bp, Artificial Sequence
  Description of Artificial Sequence: Synthetic oligonucleotide
acttccctgagtttcacttcttctcccaacttgtg

SEQ ID NO: 372552 - DNA, 34 bp, Artificial Sequence
  Description of Artificial Sequence: Synthetic oligonucleotide
cttccctgagtttcacttcttctcccaacttgtg

SEQ ID NO: 372553 - DNA, 35 bp, Artificial Sequence
  Description of Artificial Sequence: Synthetic oligonucleotide
ttccctgagtttcacttcttctcccaacttgtgtc

SEQ ID NO: 372554 - DNA, 34 bp, Artificial Sequence
  Description of Artificial Sequence: Synthetic oligonucleotide
tccctgagtttcacttcttctcccaacttgtgtc

SEQ ID NO: 372555 - DNA, 28 bp, Artificial Sequence
  Description of Artificial Sequence: Synthetic oligonucleotide
tcccaacttgtgtcgggtccttcttccg

SEQ ID NO: 372556 - DNA, 27 bp, Artificial Sequence
  Description of Artificial Sequence: Synthetic oligonucleotide
cccaacttgtgtcgggtccttcttccg

SEQ ID NO: 372557 - DNA, 27 bp, Artificial Sequence
  Description of Artificial Sequence: Synthetic oligonucleotide
ccaacttgtgtcgggtccttcttccgg

SEQ ID NO: 372558 - DNA, 27 bp, Artificial Sequence
  Description of Artificial Sequence: Synthetic oligonucleotide
caacttgtgtcgggtccttcttccggg

SEQ ID NO: 372559 - DNA, 30 bp, Artificial Sequence
  Description of Artificial Sequence: Synthetic oligonucleotide
aacttgtgtcgggtccttcttccgggatac

SEQ ID NO: 372560 - DNA, 29 bp, Artificial Sequence
  Description of Artificial Sequence: Synthetic oligonucleotide
acttgtgtcgggtccttcttccgggatac

SEQ ID NO: 372561 - DNA, 28 bp, Artificial Sequence
  Description of Artificial Sequence: Synthetic oligonucleotide
cttgtgtcgggtccttcttccgggatac

SEQ ID NO: 372562 - DNA, 29 bp, Artificial Sequence
  Description of Artificial Sequence: Synthetic oligonucleotide
ttgtgtcgggtccttcttccgggatactc

SEQ ID NO: 372563 - DNA, 28 bp, Artificial Sequence
  Description of Artificial Sequence: Synthetic oligonucleotide
tgtgtcgggtccttcttccgggatactc

SEQ ID NO: 372564 - DNA, 27 bp, Artificial Sequence
  Description of Artificial Sequence: Synthetic oligonucleotide
gtgtcgggtccttcttccgggatactc

SEQ ID NO: 372565 - DNA, 27 bp, Artificial Sequence
  Description of Artificial Sequence: Synthetic oligonucleotide
tgtcgggtccttcttccgggatactcg

SEQ ID NO: 372566 - DNA, 27 bp, Artificial Sequence
  Description of Artificial Sequence: Synthetic oligonucleotide
gtcgggtccttcttccgggatactcgt

SEQ ID NO: 372567 - DNA, 27 bp, Artificial Sequence
  Description of Artificial Sequence: Synthetic oligonucleotide
tcgggtccttcttccgggatactcgtg

SEQ ID NO: 372568 - DNA, 27 bp, Artificial Sequence
  Description of Artificial Sequence: Synthetic oligonucleotide
cgggtccttcttccgggatactcgtga

SEQ ID NO: 372569 - DNA, 27 bp, Artificial Sequence
  Description of Artificial Sequence: Synthetic oligonucleotide
gggtccttcttccgggatactcgtgac

SEQ ID NO: 372570 - DNA, 27 bp, Artificial Sequence
  Description of Artificial Sequence: Synthetic oligonucleotide
ggtccttcttccgggatactcgtgacg

SEQ ID NO: 372571 - DNA, 27 bp, Artificial Sequence
  Description of Artificial Sequence: Synthetic oligonucleotide
gtccttcttccgggatactcgtgacgc

SEQ ID NO: 372572 - DNA, 27 bp, Artificial Sequence
  Description of Artificial Sequence: Synthetic oligonucleotide
tccttcttccgggatactcgtgacgcg

SEQ ID NO: 372573 - DNA, 27 bp, Artificial Sequence
  Description of Artificial Sequence: Synthetic oligonucleotide
ccttcttccgggatactcgtgacgcgt

SEQ ID NO: 372574 - DNA, 27 bp, Artificial Sequence
  Description of Artificial Sequence: Synthetic oligonucleotide
cttcttccgggatactcgtgacgcgtc

SEQ ID NO: 372575 - DNA, 27 bp, Artificial Sequence
  Description of Artificial Sequence: Synthetic oligonucleotide
ttcttccgggatactcgtgacgcgtcc

SEQ ID NO: 372576 - DNA, 26 bp, Artificial Sequence
  Description of Artificial Sequence: Synthetic oligonucleotide
tcttccgggatactcgtgacgcgtcc

SEQ ID NO: 372577 - DNA, 25 bp, Artificial Sequence
  Description of Artificial Sequence: Synthetic oligonucleotide
cttccgggatactcgtgacgcgtcc

SEQ ID NO: 372578 - DNA, 25 bp, Artificial Sequence
  Description of Artificial Sequence: Synthetic oligonucleotide
ttccgggatactcgtgacgcgtccc

SEQ ID NO: 372579 - DNA, 24 bp, Artificial Sequence
  Description of Artificial Sequence: Synthetic oligonucleotide
tccgggatactcgtgacgcgtccc

SEQ ID NO: 372580 - DNA, 23 bp, Artificial Sequence
  Description of Artificial Sequence: Synthetic oligonucleotide
ccgggatactcgtgacgcgtccc

SEQ ID NO: 372581 - DNA, 24 bp, Artificial Sequence
  Description of Artificial Sequence: Synthetic oligonucleotide
cgggatactcgtgacgcgtcccca

SEQ ID NO: 372582 - DNA, 26 bp, Artificial Sequence
  Description of Artificial Sequence: Synthetic oligonucleotide
gggatactcgtgacgcgtccccactt

SEQ ID NO: 372583 - DNA, 24 bp, Artificial Sequence
  Description of Artificial Sequence: Synthetic oligonucleotide
aacgggaaggagacgctgcagcgc

SEQ ID NO: 372584 - DNA, 23 bp, Artificial Sequence
  Description of Artificial Sequence: Synthetic oligonucleotide
acgggaaggagacgctgcagcgc

SEQ ID NO: 372585 - DNA, 22 bp, Artificial Sequence
  Description of Artificial Sequence: Synthetic oligonucleotide
cgggaaggagacgctgcagcgc

SEQ ID NO: 372586 - DNA, 22 bp, Artificial Sequence
  Description of Artificial Sequence: Synthetic oligonucleotide
gggaaggagacgctgcagcgcg

SEQ ID NO: 372587 - DNA, 22 bp, Artificial Sequence
  Description of Artificial Sequence: Synthetic oligonucleotide
ggaaggagacgctgcagcgcgc

SEQ ID NO: 372588 - DNA, 22 bp, Artificial Sequence
  Description of Artificial Sequence: Synthetic oligonucleotide
gaaggagacgctgcagcgcgcg

SEQ ID NO: 372589 - DNA, 23 bp, Artificial Sequence
  Description of Artificial Sequence: Synthetic oligonucleotide
aaggagacgctgcagcgcgcgga

SEQ ID NO: 372590 - DNA, 22 bp, Artificial Sequence
  Description of Artificial Sequence: Synthetic oligonucleotide
aggagacgctgcagcgcgcgga

SEQ ID NO: 372591 - DNA, 21 bp, Artificial Sequence
  Description of Artificial Sequence: Synthetic oligonucleotide
ggagacgctgcagcgcgcgga

SEQ ID NO: 372592 - DNA, 21 bp, Artificial Sequence
  Description of Artificial Sequence: Synthetic oligonucleotide
gagacgctgcagcgcgcggac

SEQ ID NO: 372593 - DNA, 21 bp, Artificial Sequence
  Description of Artificial Sequence: Synthetic oligonucleotide
agacgctgcagcgcgcggacc

SEQ ID NO: 372594 - DNA, 20 bp, Artificial Sequence
  Description of Artificial Sequence: Synthetic oligonucleotide
gacgctgcagcgcgcggacc

SEQ ID NO: 372595 - DNA, 20 bp, Artificial Sequence
  Description of Artificial Sequence: Synthetic oligonucleotide
acgctgcagcgcgcggaccc

SEQ ID NO: 372596 - DNA, 20 bp, Artificial Sequence
  Description of Artificial Sequence: Synthetic oligonucleotide
cgctgcagcgcgcggaccct

SEQ ID NO: 372597 - DNA, 20 bp, Artificial Sequence
  Description of Artificial Sequence: Synthetic oligonucleotide
gctgcagcgcgcggacccct

SEQ ID NO: 372598 - DNA, 20 bp, Artificial Sequence
  Description of Artificial Sequence: Synthetic oligonucleotide
ctgcagcgcgcggaccccct

SEQ ID NO: 372599 - DNA, 22 bp, Artificial Sequence
  Description of Artificial Sequence: Synthetic oligonucleotide
tgcagcgcgcggaccccccaaa

SEQ ID NO: 372600 - DNA, 21 bp, Artificial Sequence
  Description of Artificial Sequence: Synthetic oligonucleotide
gcagcgcgcggaccccccaaa

SEQ ID NO: 372601 - DNA, 22 bp, Artificial Sequence
  Description of Artificial Sequence: Synthetic oligonucleotide
cagcgcgcggaccccccaaaga

SEQ ID NO: 372602 - DNA, 23 bp, Artificial Sequence
  Description of Artificial Sequence: Synthetic oligonucleotide
agcgcgcggaccccccaaagaca

SEQ ID NO: 372603 - DNA, 22 bp, Artificial Sequence
  Description of Artificial Sequence: Synthetic oligonucleotide
gcgcgcggaccccccaaagaca

SEQ ID NO: 372604 - DNA, 23 bp, Artificial Sequence
  Description of Artificial Sequence: Synthetic oligonucleotide
cgcgcggaccccccaaagacaca

SEQ ID NO: 372605 - DNA, 23 bp, Artificial Sequence
  Description of Artificial Sequence: Synthetic oligonucleotide
gcgcggaccccccaaagacacac

SEQ ID NO: 372606 - DNA, 24 bp, Artificial Sequence
  Description of Artificial Sequence: Synthetic oligonucleotide
cgcggaccccccaaagacacacgt

SEQ ID NO: 372607 - DNA, 25 bp, Artificial Sequence
  Description of Artificial Sequence: Synthetic oligonucleotide
gcggaccccccaaagacacacgtga

SEQ ID NO: 372608 - DNA, 25 bp, Artificial Sequence
  Description of Artificial Sequence: Synthetic oligonucleotide
cggaccccccaaagacacacgtgac

SEQ ID NO: 372609 - DNA, 25 bp, Artificial Sequence
  Description of Artificial Sequence: Synthetic oligonucleotide
ggaccccccaaagacacacgtgacc

SEQ ID NO: 372610 - DNA, 26 bp, Artificial Sequence
  Description of Artificial Sequence: Synthetic oligonucleotide
gcccaggcacagactgaccgagagaa

SEQ ID NO: 372611 - DNA, 26 bp, Artificial Sequence
  Description of Artificial Sequence: Synthetic oligonucleotide
cccaggcacagactgaccgagagaac

SEQ ID NO: 372612 - DNA, 27 bp, Artificial Sequence
  Description of Artificial Sequence: Synthetic oligonucleotide
ccaggcacagactgaccgagagaacct

SEQ ID NO: 372613 - DNA, 27 bp, Artificial Sequence
  Description of Artificial Sequence: Synthetic oligonucleotide
caggcacagactgaccgagagaacctg

SEQ ID NO: 372614 - DNA, 27 bp, Artificial Sequence
  Description of Artificial Sequence: Synthetic oligonucleotide
aggcacagactgaccgagagaacctgc

SEQ ID NO: 372615 - DNA, 26 bp, Artificial Sequence
  Description of Artificial Sequence: Synthetic oligonucleotide
ggcacagactgaccgagagaacctgc

SEQ ID NO: 372616 - DNA, 26 bp, Artificial Sequence
  Description of Artificial Sequence: Synthetic oligonucleotide
gcacagactgaccgagagaacctgcg

SEQ ID NO: 372617 - DNA, 30 bp, Artificial Sequence
  Description of Artificial Sequence: Synthetic oligonucleotide
gtccttcttccaggatactcgtgacgcatc

SEQ ID NO: 372618 - DNA, 30 bp, Artificial Sequence
  Description of Artificial Sequence: Synthetic oligonucleotide
tccttcttccaggatactcgtgacgcatcc

SEQ ID NO: 372619 - DNA, 29 bp, Artificial Sequence
  Description of Artificial Sequence: Synthetic oligonucleotide
ccttcttccaggatactcgtgacgcatcc

SEQ ID NO: 372620 - DNA, 29 bp, Artificial Sequence
  Description of Artificial Sequence: Synthetic oligonucleotide
cttcttccaggatactcgtgacgcatccc

SEQ ID NO: 372621 - DNA, 29 bp, Artificial Sequence
  Description of Artificial Sequence: Synthetic oligonucleotide
ttcttccaggatactcgtgacgcatcccc

SEQ ID NO: 372622 - DNA, 28 bp, Artificial Sequence
  Description of Artificial Sequence: Synthetic oligonucleotide
tcttccaggatactcgtgacgcatcccc

SEQ ID NO: 372623 - DNA, 27 bp, Artificial Sequence
  Description of Artificial Sequence: Synthetic oligonucleotide
cttccaggatactcgtgacgcatcccc

SEQ ID NO: 372624 - DNA, 28 bp, Artificial Sequence
  Description of Artificial Sequence: Synthetic oligonucleotide
ttccaggatactcgtgacgcatccccac

SEQ ID NO: 372625 - DNA, 27 bp, Artificial Sequence
  Description of Artificial Sequence: Synthetic oligonucleotide
tccaggatactcgtgacgcatccccac

SEQ ID NO: 372626 - DNA, 27 bp, Artificial Sequence
  Description of Artificial Sequence: Synthetic oligonucleotide
ccaggatactcgtgacgcatccccact

SEQ ID NO: 372627 - DNA, 28 bp, Artificial Sequence
  Description of Artificial Sequence: Synthetic oligonucleotide
caggatactcgtgacgcatccccacttc

SEQ ID NO: 372628 - DNA, 28 bp, Artificial Sequence
  Description of Artificial Sequence: Synthetic oligonucleotide
aggatactcgtgacgcatccccacttcc

SEQ ID NO: 372629 - DNA, 27 bp, Artificial Sequence
  Description of Artificial Sequence: Synthetic oligonucleotide
ggatactcgtgacgcatccccacttcc

SEQ ID NO: 372630 - DNA, 27 bp, Artificial Sequence
  Description of Artificial Sequence: Synthetic oligonucleotide
gatactcgtgacgcatccccacttccc

SEQ ID NO: 372631 - DNA, 28 bp, Artificial Sequence
  Description of Artificial Sequence: Synthetic oligonucleotide
atactcgtgacgcatccccacttcccac

SEQ ID NO: 372632 - DNA, 27 bp, Artificial Sequence
  Description of Artificial Sequence: Synthetic oligonucleotide
tactcgtgacgcatccccacttcccac

SEQ ID NO: 372633 - DNA, 27 bp, Artificial Sequence
  Description of Artificial Sequence: Synthetic oligonucleotide
actcgtgacgcatccccacttcccact

SEQ ID NO: 372634 - DNA, 26 bp, Artificial Sequence
  Description of Artificial Sequence: Synthetic oligonucleotide
ctcgtgacgcatccccacttcccact

SEQ ID NO: 372635 - DNA, 26 bp, Artificial Sequence
  Description of Artificial Sequence: Synthetic oligonucleotide
tcgtgacgcatccccacttcccactc

SEQ ID NO: 372636 - DNA, 25 bp, Artificial Sequence
  Description of Artificial Sequence: Synthetic oligonucleotide
cgtgacgcatccccacttcccactc

SEQ ID NO: 372637 - DNA, 25 bp, Artificial Sequence
  Description of Artificial Sequence: Synthetic oligonucleotide
gtgacgcatccccacttcccactcc

SEQ ID NO: 372638 - DNA, 27 bp, Artificial Sequence
  Description of Artificial Sequence: Synthetic oligonucleotide
tgacgcatccccacttcccactcccat

SEQ ID NO: 372639 - DNA, 27 bp, Artificial Sequence
  Description of Artificial Sequence: Synthetic oligonucleotide
gacgcatccccacttcccactcccatt

SEQ ID NO: 372640 - DNA, 27 bp, Artificial Sequence
  Description of Artificial Sequence: Synthetic oligonucleotide
acgcatccccacttcccactcccattg

SEQ ID NO: 372641 - DNA, 26 bp, Artificial Sequence
  Description of Artificial Sequence: Synthetic oligonucleotide
cgcatccccacttcccactcccattg

SEQ ID NO: 372642 - DNA, 26 bp, Artificial Sequence
  Description of Artificial Sequence: Synthetic oligonucleotide
gcatccccacttcccactcccattgg

SEQ ID NO: 372643 - DNA, 27 bp, Artificial Sequence
  Description of Artificial Sequence: Synthetic oligonucleotide
catccccacttcccactcccattgggt

SEQ ID NO: 372644 - DNA, 27 bp, Artificial Sequence
  Description of Artificial Sequence: Synthetic oligonucleotide
atccccacttcccactcccattgggtg

SEQ ID NO: 372645 - DNA, 27 bp, Artificial Sequence
  Description of Artificial Sequence: Synthetic oligonucleotide
tccccacttcccactcccattgggtgt

SEQ ID NO: 372646 - DNA, 26 bp, Artificial Sequence
  Description of Artificial Sequence: Synthetic oligonucleotide
ccccacttcccactcccattgggtgt

SEQ ID NO: 372647 - DNA, 26 bp, Artificial Sequence
  Description of Artificial Sequence: Synthetic oligonucleotide
cccacttcccactcccattgggtgtc

SEQ ID NO: 372648 - DNA, 26 bp, Artificial Sequence
  Description of Artificial Sequence: Synthetic oligonucleotide
ccacttcccactcccattgggtgtcg

SEQ ID NO: 372649 - DNA, 27 bp, Artificial Sequence
  Description of Artificial Sequence: Synthetic oligonucleotide
cacttcccactcccattgggtgtcgga

SEQ ID NO: 372650 - DNA, 30 bp, Artificial Sequence
  Description of Artificial Sequence: Synthetic oligonucleotide
acttcccactcccattgggtgtcggatatc

SEQ ID NO: 372651 - DNA, 29 bp, Artificial Sequence
  Description of Artificial Sequence: Synthetic oligonucleotide
cttcccactcccattgggtgtcggatatc

SEQ ID NO: 372652 - DNA, 31 bp, Artificial Sequence
  Description of Artificial Sequence: Synthetic oligonucleotide
ttcccactcccattgggtgtcggatatctag

SEQ ID NO: 372653 - DNA, 30 bp, Artificial Sequence
  Description of Artificial Sequence: Synthetic oligonucleotide
tcccactcccattgggtgtcggatatctag

SEQ ID NO: 372654 - DNA, 29 bp, Artificial Sequence
  Description of Artificial Sequence: Synthetic oligonucleotide
cccactcccattgggtgtcggatatctag

SEQ ID NO: 372655 - DNA, 30 bp, Artificial Sequence
  Description of Artificial Sequence: Synthetic oligonucleotide
ccactcccattgggtgtcggatatctagag

SEQ ID NO: 372656 - DNA, 32 bp, Artificial Sequence
  Description of Artificial Sequence: Synthetic oligonucleotide
cactcccattgggtgtcggatatctagagaag

SEQ ID NO: 372657 - DNA, 32 bp, Artificial Sequence
  Description of Artificial Sequence: Synthetic oligonucleotide
actcccattgggtgtcggatatctagagaagc

SEQ ID NO: 372658 - DNA, 31 bp, Artificial Sequence
  Description of Artificial Sequence: Synthetic oligonucleotide
ctcccattgggtgtcggatatctagagaagc

SEQ ID NO: 372659 - DNA, 31 bp, Artificial Sequence
  Description of Artificial Sequence: Synthetic oligonucleotide
tcccattgggtgtcggatatctagagaagcc

SEQ ID NO: 372660 - DNA, 30 bp, Artificial Sequence
  Description of Artificial Sequence: Synthetic oligonucleotide
cccattgggtgtcggatatctagagaagcc

SEQ ID NO: 372661 - DNA, 33 bp, Artificial Sequence
  Description of Artificial Sequence: Synthetic oligonucleotide
ccattgggtgtcggatatctagagaagccaatc

SEQ ID NO: 372662 - DNA, 34 bp, Artificial Sequence
  Description of Artificial Sequence: Synthetic oligonucleotide
cattgggtgtcggatatctagagaagccaatcag

SEQ ID NO: 372663 - DNA, 34 bp, Artificial Sequence
  Description of Artificial Sequence: Synthetic oligonucleotide
attgggtgtcggatatctagagaagccaatcagc

SEQ ID NO: 372664 - DNA, 33 bp, Artificial Sequence
  Description of Artificial Sequence: Synthetic oligonucleotide
ttgggtgtcggatatctagagaagccaatcagc

SEQ ID NO: 372665 - DNA, 32 bp, Artificial Sequence
  Description of Artificial Sequence: Synthetic oligonucleotide
tgggtgtcggatatctagagaagccaatcagc

SEQ ID NO: 372666 - DNA, 31 bp, Artificial Sequence
  Description of Artificial Sequence: Synthetic oligonucleotide
gggtgtcggatatctagagaagccaatcagc

SEQ ID NO: 372667 - DNA, 31 bp, Artificial Sequence
  Description of Artificial Sequence: Synthetic oligonucleotide
ggtgtcggatatctagagaagccaatcagcg

SEQ ID NO: 372668 - DNA, 32 bp, Artificial Sequence
  Description of Artificial Sequence: Synthetic oligonucleotide
gtgtcggatatctagagaagccaatcagcgtc

SEQ ID NO: 372669 - DNA, 32 bp, Artificial Sequence
  Description of Artificial Sequence: Synthetic oligonucleotide
tgtcggatatctagagaagccaatcagcgtcg

SEQ ID NO: 372670 - DNA, 31 bp, Artificial Sequence
  Description of Artificial Sequence: Synthetic oligonucleotide
gtcggatatctagagaagccaatcagcgtcg

SEQ ID NO: 372671 - DNA, 31 bp, Artificial Sequence
  Description of Artificial Sequence: Synthetic oligonucleotide
tcggatatctagagaagccaatcagcgtcgc

SEQ ID NO: 372672 - DNA, 30 bp, Artificial Sequence
  Description of Artificial Sequence: Synthetic oligonucleotide
cggatatctagagaagccaatcagcgtcgc

SEQ ID NO: 372673 - DNA, 30 bp, Artificial Sequence
  Description of Artificial Sequence: Synthetic oligonucleotide
atatctagagaagccaatcagcgtcgccgg

SEQ ID NO: 372674 - DNA, 29 bp, Artificial Sequence
  Description of Artificial Sequence: Synthetic oligonucleotide
tatctagagaagccaatcagcgtcgccgg

SEQ ID NO: 372675 - DNA, 28 bp, Artificial Sequence
  Description of Artificial Sequence: Synthetic oligonucleotide
atctagagaagccaatcagcgtcgccgg

SEQ ID NO: 372676 - DNA, 27 bp, Artificial Sequence
  Description of Artificial Sequence: Synthetic oligonucleotide
tctagagaagccaatcagcgtcgccgg

SEQ ID NO: 372677 - DNA, 26 bp, Artificial Sequence
  Description of Artificial Sequence: Synthetic oligonucleotide
ctagagaagccaatcagcgtcgccgg

SEQ ID NO: 372678 - DNA, 26 bp, Artificial Sequence
  Description of Artificial Sequence: Synthetic oligonucleotide
tagagaagccaatcagcgtcgccggg

SEQ ID NO: 372679 - DNA, 25 bp, Artificial Sequence
  Description of Artificial Sequence: Synthetic oligonucleotide
agagaagccaatcagcgtcgccggg

SEQ ID NO: 372680 - DNA, 24 bp, Artificial Sequence
  Description of Artificial Sequence: Synthetic oligonucleotide
gagaagccaatcagcgtcgccggg

SEQ ID NO: 372681 - DNA, 25 bp, Artificial Sequence
  Description of Artificial Sequence: Synthetic oligonucleotide
agaagccaatcagcgtcgccggggt

SEQ ID NO: 372682 - DNA, 24 bp, Artificial Sequence
  Description of Artificial Sequence: Synthetic oligonucleotide
gaagccaatcagcgtcgccggggt

SEQ ID NO: 372683 - DNA, 24 bp, Artificial Sequence
  Description of Artificial Sequence: Synthetic oligonucleotide
aagccaatcagcgtcgccggggtc

SEQ ID NO: 372684 - DNA, 23 bp, Artificial Sequence
  Description of Artificial Sequence: Synthetic oligonucleotide
agccaatcagcgtcgccggggtc

SEQ ID NO: 372685 - DNA, 22 bp, Artificial Sequence
  Description of Artificial Sequence: Synthetic oligonucleotide
gccaatcagcgtcgccggggtc

SEQ ID NO: 372686 - DNA, 22 bp, Artificial Sequence
  Description of Artificial Sequence: Synthetic oligonucleotide
ccaatcagcgtcgccggggtcc

SEQ ID NO: 372687 - DNA, 23 bp, Artificial Sequence
  Description of Artificial Sequence: Synthetic oligonucleotide
caatcagcgtcgccggggtccca

SEQ ID NO: 372688 - DNA, 25 bp, Artificial Sequence
  Description of Artificial Sequence: Synthetic oligonucleotide
aatcagcgtcgccggggtcccagtt

SEQ ID NO: 372689 - DNA, 24 bp, Artificial Sequence
  Description of Artificial Sequence: Synthetic oligonucleotide
atcagcgtcgccggggtcccagtt

SEQ ID NO: 372690 - DNA, 23 bp, Artificial Sequence
  Description of Artificial Sequence: Synthetic oligonucleotide
tcagcgtcgccggggtcccagtt

SEQ ID NO: 372691 - DNA, 22 bp, Artificial Sequence
  Description of Artificial Sequence: Synthetic oligonucleotide
cagcgtcgccggggtcccagtt

SEQ ID NO: 372692 - DNA, 26 bp, Artificial Sequence
  Description of Artificial Sequence: Synthetic oligonucleotide
agcgtcgccggggtcccagttctaaa

SEQ ID NO: 372693 - DNA, 25 bp, Artificial Sequence
  Description of Artificial Sequence: Synthetic oligonucleotide
gcgtcgccggggtcccagttctaaa

SEQ ID NO: 372694 - DNA, 26 bp, Artificial Sequence
  Description of Artificial Sequence: Synthetic oligonucleotide
cgtcgccggggtcccagttctaaagt

SEQ ID NO: 372695 - DNA, 26 bp, Artificial Sequence
  Description of Artificial Sequence: Synthetic oligonucleotide
gtcgccggggtcccagttctaaagtc

SEQ ID NO: 372696 - DNA, 26 bp, Artificial Sequence
  Description of Artificial Sequence: Synthetic oligonucleotide
tcgccggggtcccagttctaaagtcc

SEQ ID NO: 372697 - DNA, 25 bp, Artificial Sequence
  Description of Artificial Sequence: Synthetic oligonucleotide
cgccggggtcccagttctaaagtcc

SEQ ID NO: 372698 - DNA, 25 bp, Artificial Sequence
  Description of Artificial Sequence: Synthetic oligonucleotide
gccggggtcccagttctaaagtccc

SEQ ID NO: 372699 - DNA, 26 bp, Artificial Sequence
  Description of Artificial Sequence: Synthetic oligonucleotide
ccggggtcccagttctaaagtcccca

SEQ ID NO: 372700 - DNA, 26 bp, Artificial Sequence
  Description of Artificial Sequence: Synthetic oligonucleotide
cggggtcccagttctaaagtccccac

SEQ ID NO: 372701 - DNA, 26 bp, Artificial Sequence
  Description of Artificial Sequence: Synthetic oligonucleotide
ggggtcccagttctaaagtccccacg

SEQ ID NO: 372702 - DNA, 27 bp, Artificial Sequence
  Description of Artificial Sequence: Synthetic oligonucleotide
gggtcccagttctaaagtccccacgca

SEQ ID NO: 372703 - DNA, 27 bp, Artificial Sequence
  Description of Artificial Sequence: Synthetic oligonucleotide
ccggctcccactccatgaggtatttcg

SEQ ID NO: 372704 - DNA, 28 bp, Artificial Sequence
  Description of Artificial Sequence: Synthetic oligonucleotide
cggctcccactccatgaggtatttcgac

SEQ ID NO: 372705 - DNA, 29 bp, Artificial Sequence
  Description of Artificial Sequence: Synthetic oligonucleotide
ggctcccactccatgaggtatttcgacac

SEQ ID NO: 372706 - DNA, 29 bp, Artificial Sequence
  Description of Artificial Sequence: Synthetic oligonucleotide
gctcccactccatgaggtatttcgacacc

SEQ ID NO: 372707 - DNA, 29 bp, Artificial Sequence
  Description of Artificial Sequence: Synthetic oligonucleotide
ctcccactccatgaggtatttcgacaccg

SEQ ID NO: 372708 - DNA, 29 bp, Artificial Sequence
  Description of Artificial Sequence: Synthetic oligonucleotide
tcccactccatgaggtatttcgacaccgc

SEQ ID NO: 372709 - DNA, 28 bp, Artificial Sequence
  Description of Artificial Sequence: Synthetic oligonucleotide
cccactccatgaggtatttcgacaccgc

SEQ ID NO: 372710 - DNA, 28 bp, Artificial Sequence
  Description of Artificial Sequence: Synthetic oligonucleotide
ccactccatgaggtatttcgacaccgcc

SEQ ID NO: 372711 - DNA, 30 bp, Artificial Sequence; identical to SEQ ID NO: 23702
  Description of Artificial Sequence: Synthetic oligonucleotide

SEQ ID NO: 372712 - DNA, 31 bp, Artificial Sequence; identical to SEQ ID NO: 23703
  Description of Artificial Sequence: Synthetic oligonucleotide

SEQ ID NO: 372713 - DNA, 30 bp, Artificial Sequence; identical to SEQ ID NO: 23704
  Description of Artificial Sequence: Synthetic oligonucleotide

SEQ ID NO: 372714 - DNA, 30 bp, Artificial Sequence; identical to SEQ ID NO: 23705
  Description of Artificial Sequence: Synthetic oligonucleotide

SEQ ID NO: 372715 - DNA, 29 bp, Artificial Sequence
  Description of Artificial Sequence: Synthetic oligonucleotide
ccatgaggtatttcgacaccgccatgtcc

SEQ ID NO: 372716 - DNA, 29 bp, Artificial Sequence
  Description of Artificial Sequence: Synthetic oligonucleotide
catgaggtatttcgacaccgccatgtccc

SEQ ID NO: 372717 - DNA, 29 bp, Artificial Sequence
  Description of Artificial Sequence: Synthetic oligonucleotide
atgaggtatttcgacaccgccatgtcccg

SEQ ID NO: 372718 - DNA, 28 bp, Artificial Sequence
  Description of Artificial Sequence: Synthetic oligonucleotide
tgaggtatttcgacaccgccatgtcccg

SEQ ID NO: 372719 - DNA, 27 bp, Artificial Sequence
  Description of Artificial Sequence: Synthetic oligonucleotide
gaggtatttcgacaccgccatgtcccg

SEQ ID NO: 372720 - DNA, 27 bp, Artificial Sequence
  Description of Artificial Sequence: Synthetic oligonucleotide
aggtatttcgacaccgccatgtcccgg

SEQ ID NO: 372721 - DNA, 26 bp, Artificial Sequence
  Description of Artificial Sequence: Synthetic oligonucleotide
ggtatttcgacaccgccatgtcccgg

SEQ ID NO: 372722 - DNA, 26 bp, Artificial Sequence
  Description of Artificial Sequence: Synthetic oligonucleotide
gtatttcgacaccgccatgtcccggc

SEQ ID NO: 372723 - DNA, 26 bp, Artificial Sequence
  Description of Artificial Sequence: Synthetic oligonucleotide
tatttcgacaccgccatgtcccggcc

SEQ ID NO: 372724 - DNA, 25 bp, Artificial Sequence
  Description of Artificial Sequence: Synthetic oligonucleotide
atttcgacaccgccatgtcccggcc

SEQ ID NO: 372725 - DNA, 24 bp, Artificial Sequence
  Description of Artificial Sequence: Synthetic oligonucleotide
tttcgacaccgccatgtcccggcc

SEQ ID NO: 372726 - DNA, 23 bp, Artificial Sequence
  Description of Artificial Sequence: Synthetic oligonucleotide
ttcgacaccgccatgtcccggcc

SEQ ID NO: 372727 - DNA, 22 bp, Artificial Sequence
  Description of Artificial Sequence: Synthetic oligonucleotide
tcgacaccgccatgtcccggcc

SEQ ID NO: 372728 - DNA, 21 bp, Artificial Sequence
  Description of Artificial Sequence: Synthetic oligonucleotide
cgacaccgccatgtcccggcc

SEQ ID NO: 372729 - DNA, 21 bp, Artificial Sequence
  Description of Artificial Sequence: Synthetic oligonucleotide
gacaccgccatgtcccggccc

SEQ ID NO: 372730 - DNA, 21 bp, Artificial Sequence
  Description of Artificial Sequence: Synthetic oligonucleotide
acaccgccatgtcccggcccg

SEQ ID NO: 372731 - DNA, 20 bp, Artificial Sequence
  Description of Artificial Sequence: Synthetic oligonucleotide
caccgccatgtcccggcccg

SEQ ID NO: 372732 - DNA, 20 bp, Artificial Sequence
  Description of Artificial Sequence: Synthetic oligonucleotide
accgccatgtcccggcccgg

SEQ ID NO: 372733 - DNA, 20 bp, Artificial Sequence
  Description of Artificial Sequence: Synthetic oligonucleotide
ccgccatgtcccggcccggt

SEQ ID NO: 372734 - DNA, 20 bp, Artificial Sequence
  Description of Artificial Sequence: Synthetic oligonucleotide
cgccatgtcccggcccggct

SEQ ID NO: 372735 - DNA, 20 bp, Artificial Sequence
  Description of Artificial Sequence: Synthetic oligonucleotide
gccatgtcccggcccggcct

SEQ ID NO: 372736 - DNA, 31 bp, Artificial Sequence; identical to SEQ ID NO: 22833
  Description of Artificial Sequence: Synthetic oligonucleotide

SEQ ID NO: 372737 - DNA, 33 bp, Artificial Sequence; identical to SEQ ID NO: 22834
  Description of Artificial Sequence: Synthetic oligonucleotide

SEQ ID NO: 372738 - DNA, 34 bp, Artificial Sequence; identical to SEQ ID NO: 22835
  Description of Artificial Sequence: Synthetic oligonucleotide

SEQ ID NO: 372739 - DNA, 33 bp, Artificial Sequence; identical to SEQ ID NO: 22836
  Description of Artificial Sequence: Synthetic oligonucleotide

SEQ ID NO: 372740 - DNA, 33 bp, Artificial Sequence; identical to SEQ ID NO: 22837
  Description of Artificial Sequence: Synthetic oligonucleotide

SEQ ID NO: 372741 - DNA, 32 bp, Artificial Sequence; identical to SEQ ID NO: 22838
  Description of Artificial Sequence: Synthetic oligonucleotide

SEQ ID NO: 372742 - DNA, 31 bp, Artificial Sequence; identical to SEQ ID NO: 22839
  Description of Artificial Sequence: Synthetic oligonucleotide

SEQ ID NO: 372743 - DNA, 30 bp, Artificial Sequence; identical to SEQ ID NO: 22840
  Description of Artificial Sequence: Synthetic oligonucleotide

SEQ ID NO: 372744 - DNA, 29 bp, Artificial Sequence
  Description of Artificial Sequence: Synthetic oligonucleotide
gggaccggaacacacagatcttcaagacc

SEQ ID NO: 372745 - DNA, 31 bp, Artificial Sequence; identical to SEQ ID NO: 22842
  Description of Artificial Sequence: Synthetic oligonucleotide

SEQ ID NO: 372746 - DNA, 32 bp, Artificial Sequence; identical to SEQ ID NO: 22843
  Description of Artificial Sequence: Synthetic oligonucleotide

SEQ ID NO: 372747 - DNA, 33 bp, Artificial Sequence; identical to SEQ ID NO: 22844
  Description of Artificial Sequence: Synthetic oligonucleotide

SEQ ID NO: 372748 - DNA, 32 bp, Artificial Sequence; identical to SEQ ID NO: 22845
  Description of Artificial Sequence: Synthetic oligonucleotide

SEQ ID NO: 372749 - DNA, 33 bp, Artificial Sequence; identical to SEQ ID NO: 22846
  Description of Artificial Sequence: Synthetic oligonucleotide

SEQ ID NO: 372750 - DNA, 34 bp, Artificial Sequence; identical to SEQ ID NO: 22847
  Description of Artificial Sequence: Synthetic oligonucleotide

SEQ ID NO: 372751 - DNA, 35 bp, Artificial Sequence; identical to SEQ ID NO: 22848
  Description of Artificial Sequence: Synthetic oligonucleotide

SEQ ID NO: 372752 - DNA, 36 bp, Artificial Sequence; identical to SEQ ID NO: 22849
  Description of Artificial Sequence: Synthetic oligonucleotide

SEQ ID NO: 372753 - DNA, 35 bp, Artificial Sequence; identical to SEQ ID NO: 22850
  Description of Artificial Sequence: Synthetic oligonucleotide

SEQ ID NO: 372754 - DNA, 34 bp, Artificial Sequence; identical to SEQ ID NO: 22851
  Description of Artificial Sequence: Synthetic oligonucleotide

SEQ ID NO: 372755 - DNA, 34 bp, Artificial Sequence; identical to SEQ ID NO: 22852
  Description of Artificial Sequence: Synthetic oligonucleotide

SEQ ID NO: 372756 - DNA, 33 bp, Artificial Sequence; identical to SEQ ID NO: 22853
  Description of Artificial Sequence: Synthetic oligonucleotide

SEQ ID NO: 372757 - DNA, 33 bp, Artificial Sequence; identical to SEQ ID NO: 22854
  Description of Artificial Sequence: Synthetic oligonucleotide

SEQ ID NO: 372758 - DNA, 32 bp, Artificial Sequence; identical to SEQ ID NO: 22855
  Description of Artificial Sequence: Synthetic oligonucleotide

SEQ ID NO: 372759 - DNA, 33 bp, Artificial Sequence; identical to SEQ ID NO: 22856
  Description of Artificial Sequence: Synthetic oligonucleotide

SEQ ID NO: 372760 - DNA, 32 bp, Artificial Sequence; identical to SEQ ID NO: 22857
  Description of Artificial Sequence: Synthetic oligonucleotide

SEQ ID NO: 372761 - DNA, 33 bp, Artificial Sequence; identical to SEQ ID NO: 22858
  Description of Artificial Sequence: Synthetic oligonucleotide

SEQ ID NO: 372762 - DNA, 32 bp, Artificial Sequence; identical to SEQ ID NO: 22859
  Description of Artificial Sequence: Synthetic oligonucleotide

SEQ ID NO: 372763 - DNA, 31 bp, Artificial Sequence; identical to SEQ ID NO: 22860
  Description of Artificial Sequence: Synthetic oligonucleotide

SEQ ID NO: 372764 - DNA, 32 bp, Artificial Sequence; identical to SEQ ID NO: 22861
  Description of Artificial Sequence: Synthetic oligonucleotide

SEQ ID NO: 372765 - DNA, 31 bp, Artificial Sequence; identical to SEQ ID NO: 22862
  Description of Artificial Sequence: Synthetic oligonucleotide

SEQ ID NO: 372766 - DNA, 30 bp, Artificial Sequence; identical to SEQ ID NO: 22704
  Description of Artificial Sequence: Synthetic oligonucleotide

SEQ ID NO: 372767 - DNA, 30 bp, Artificial Sequence; identical to SEQ ID NO: 22705
  Description of Artificial Sequence: Synthetic oligonucleotide

SEQ ID NO: 372768 - DNA, 29 bp, Artificial Sequence
  Description of Artificial Sequence: Synthetic oligonucleotide
agaccaacacacagactgaccgagagagc

SEQ ID NO: 372769 - DNA, 28 bp, Artificial Sequence
  Description of Artificial Sequence: Synthetic oligonucleotide
gaccaacacacagactgaccgagagagc

SEQ ID NO: 372770 - DNA, 28 bp, Artificial Sequence
  Description of Artificial Sequence: Synthetic oligonucleotide
accaacacacagactgaccgagagagcc

SEQ ID NO: 372771 - DNA, 27 bp, Artificial Sequence
  Description of Artificial Sequence: Synthetic oligonucleotide
ccaacacacagactgaccgagagagcc

SEQ ID NO: 372772 - DNA, 28 bp, Artificial Sequence
  Description of Artificial Sequence: Synthetic oligonucleotide
caacacacagactgaccgagagagcctg

SEQ ID NO: 372773 - DNA, 28 bp, Artificial Sequence
  Description of Artificial Sequence: Synthetic oligonucleotide
aacacacagactgaccgagagagcctgc

SEQ ID NO: 372774 - DNA, 27 bp, Artificial Sequence
  Description of Artificial Sequence: Synthetic oligonucleotide
acacacagactgaccgagagagcctgc

SEQ ID NO: 372775 - DNA, 26 bp, Artificial Sequence
  Description of Artificial Sequence: Synthetic oligonucleotide
cacacagactgaccgagagagcctgc

SEQ ID NO: 372776 - DNA, 26 bp, Artificial Sequence
  Description of Artificial Sequence: Synthetic oligonucleotide
acacagactgaccgagagagcctgcg

SEQ ID NO: 372777 - DNA, 21 bp, Artificial Sequence
  Description of Artificial Sequence: Synthetic oligonucleotide
tcctggaccgcggcggacacc

SEQ ID NO: 372778 - DNA, 20 bp, Artificial Sequence
  Description of Artificial Sequence: Synthetic oligonucleotide
cctggaccgcggcggacacc

SEQ ID NO: 372779 - DNA, 20 bp, Artificial Sequence
  Description of Artificial Sequence: Synthetic oligonucleotide
ctggaccgcggcggacaccg

SEQ ID NO: 372780 - DNA, 20 bp, Artificial Sequence
  Description of Artificial Sequence: Synthetic oligonucleotide
tggaccgcggcggacaccgc

SEQ ID NO: 372781 - DNA, 20 bp, Artificial Sequence
  Description of Artificial Sequence: Synthetic oligonucleotide
ggaccgcggcggacaccgct

SEQ ID NO: 372782 - DNA, 20 bp, Artificial Sequence
  Description of Artificial Sequence: Synthetic oligonucleotide
gaccgcggcggacaccgcgt

SEQ ID NO: 372783 - DNA, 20 bp, Artificial Sequence
  Description of Artificial Sequence: Synthetic oligonucleotide
accgcggcggacaccgcggt

SEQ ID NO: 372784 - DNA, 20 bp, Artificial Sequence
  Description of Artificial Sequence: Synthetic oligonucleotide
ccgcggcggacaccgcggtt

SEQ ID NO: 372785 - DNA, 20 bp, Artificial Sequence
  Description of Artificial Sequence: Synthetic oligonucleotide
cgcggcggacaccgcggctt

SEQ ID NO: 372786 - DNA, 20 bp, Artificial Sequence
  Description of Artificial Sequence: Synthetic oligonucleotide
gcggcggacaccgcggctca

SEQ ID NO: 372787 - DNA, 22 bp, Artificial Sequence
  Description of Artificial Sequence: Synthetic oligonucleotide
cggcggacaccgcggctcagat

SEQ ID NO: 372788 - DNA, 23 bp, Artificial Sequence
  Description of Artificial Sequence: Synthetic oligonucleotide
ggcggacaccgcggctcagatca

SEQ ID NO: 372789 - DNA, 21 bp, Artificial Sequence
  Description of Artificial Sequence: Synthetic oligonucleotide
ggcccgtgtggcggagcagga

SEQ ID NO: 372790 - DNA, 22 bp, Artificial Sequence
  Description of Artificial Sequence: Synthetic oligonucleotide
gcccgtgtggcggagcaggaca

SEQ ID NO: 372791 - DNA, 23 bp, Artificial Sequence
  Description of Artificial Sequence: Synthetic oligonucleotide
cccgtgtggcggagcaggacaga

SEQ ID NO: 372792 - DNA, 23 bp, Artificial Sequence
  Description of Artificial Sequence: Synthetic oligonucleotide
ccgtgtggcggagcaggacagag

SEQ ID NO: 372793 - DNA, 23 bp, Artificial Sequence
  Description of Artificial Sequence: Synthetic oligonucleotide
cgtgtggcggagcaggacagagc

SEQ ID NO: 372794 - DNA, 25 bp, Artificial Sequence
  Description of Artificial Sequence: Synthetic oligonucleotide
gtgtggcggagcaggacagagccta

SEQ ID NO: 372795 - DNA, 25 bp, Artificial Sequence
  Description of Artificial Sequence: Synthetic oligonucleotide
tgtggcggagcaggacagagcctac

SEQ ID NO: 372796 - DNA, 24 bp, Artificial Sequence
  Description of Artificial Sequence: Synthetic oligonucleotide
gtggcggagcaggacagagcctac

SEQ ID NO: 372797 - DNA, 25 bp, Artificial Sequence
  Description of Artificial Sequence: Synthetic oligonucleotide
tggcggagcaggacagagcctacct

SEQ ID NO: 372798 - DNA, 25 bp, Artificial Sequence
  Description of Artificial Sequence: Synthetic oligonucleotide
caggacagagcctacctggagggca

SEQ ID NO: 372799 - DNA, 25 bp, Artificial Sequence
  Description of Artificial Sequence: Synthetic oligonucleotide
aggacagagcctacctggagggcac

SEQ ID NO: 372800 - DNA, 24 bp, Artificial Sequence
  Description of Artificial Sequence: Synthetic oligonucleotide
ggacagagcctacctggagggcac

SEQ ID NO: 372801 - DNA, 25 bp, Artificial Sequence
  Description of Artificial Sequence: Synthetic oligonucleotide
gacagagcctacctggagggcacgt

SEQ ID NO: 372802 - DNA, 25 bp, Artificial Sequence
  Description of Artificial Sequence: Synthetic oligonucleotide
acagagcctacctggagggcacgtg

SEQ ID NO: 372803 - DNA, 24 bp, Artificial Sequence
  Description of Artificial Sequence: Synthetic oligonucleotide
cagagcctacctggagggcacgtg

SEQ ID NO: 372804 - DNA, 28 bp, Artificial Sequence
  Description of Artificial Sequence: Synthetic oligonucleotide
gcagatacctggagaacgggaaggacac

SEQ ID NO: 372805 - DNA, 28 bp, Artificial Sequence
  Description of Artificial Sequence: Synthetic oligonucleotide
cagatacctggagaacgggaaggacacg

SEQ ID NO: 372806 - DNA, 28 bp, Artificial Sequence
  Description of Artificial Sequence: Synthetic oligonucleotide
agatacctggagaacgggaaggacacgc

SEQ ID NO: 372807 - DNA, 27 bp, Artificial Sequence
  Description of Artificial Sequence: Synthetic oligonucleotide
gatacctggagaacgggaaggacacgc

SEQ ID NO: 372808 - DNA, 28 bp, Artificial Sequence
  Description of Artificial Sequence: Synthetic oligonucleotide
atacctggagaacgggaaggacacgctg

SEQ ID NO: 372809 - DNA, 27 bp, Artificial Sequence
  Description of Artificial Sequence: Synthetic oligonucleotide
tacctggagaacgggaaggacacgctg

SEQ ID NO: 372810 - DNA, 26 bp, Artificial Sequence
  Description of Artificial Sequence: Synthetic oligonucleotide
acctggagaacgggaaggacacgctg

SEQ ID NO: 372811 - DNA, 25 bp, Artificial Sequence
  Description of Artificial Sequence: Synthetic oligonucleotide
cctggagaacgggaaggacacgctg

SEQ ID NO: 372812 - DNA, 26 bp, Artificial Sequence
  Description of Artificial Sequence: Synthetic oligonucleotide
ctggagaacgggaaggacacgctgga

SEQ ID NO: 372813 - DNA, 26 bp, Artificial Sequence
  Description of Artificial Sequence: Synthetic oligonucleotide
tggagaacgggaaggacacgctggag

SEQ ID NO: 372814 - DNA, 25 bp, Artificial Sequence
  Description of Artificial Sequence: Synthetic oligonucleotide
ggagaacgggaaggacacgctggag

SEQ ID NO: 372815 - DNA, 25 bp, Artificial Sequence
  Description of Artificial Sequence: Synthetic oligonucleotide
gagaacgggaaggacacgctggagc

SEQ ID NO: 372816 - DNA, 25 bp, Artificial Sequence
  Description of Artificial Sequence: Synthetic oligonucleotide
agaacgggaaggacacgctggagcg

SEQ ID NO: 372817 - DNA, 24 bp, Artificial Sequence
  Description of Artificial Sequence: Synthetic oligonucleotide
gaacgggaaggacacgctggagcg

SEQ ID NO: 372818 - DNA, 24 bp, Artificial Sequence
  Description of Artificial Sequence: Synthetic oligonucleotide
aacgggaaggacacgctggagcgc

SEQ ID NO: 372819 - DNA, 23 bp, Artificial Sequence
  Description of Artificial Sequence: Synthetic oligonucleotide
acgggaaggacacgctggagcgc

SEQ ID NO: 372820 - DNA, 22 bp, Artificial Sequence
  Description of Artificial Sequence: Synthetic oligonucleotide
cgggaaggacacgctggagcgc

SEQ ID NO: 372821 - DNA, 22 bp, Artificial Sequence
  Description of Artificial Sequence: Synthetic oligonucleotide
gggaaggacacgctggagcgcg

SEQ ID NO: 372822 - DNA, 22 bp, Artificial Sequence
  Description of Artificial Sequence: Synthetic oligonucleotide
ggaaggacacgctggagcgcgc

SEQ ID NO: 372823 - DNA, 22 bp, Artificial Sequence
  Description of Artificial Sequence: Synthetic oligonucleotide
gaaggacacgctggagcgcgcg

SEQ ID NO: 372824 - DNA, 23 bp, Artificial Sequence
  Description of Artificial Sequence: Synthetic oligonucleotide
aaggacacgctggagcgcgcgga

SEQ ID NO: 372825 - DNA, 22 bp, Artificial Sequence
  Description of Artificial Sequence: Synthetic oligonucleotide
aggacacgctggagcgcgcgga

SEQ ID NO: 372826 - DNA, 21 bp, Artificial Sequence
  Description of Artificial Sequence: Synthetic oligonucleotide
ggacacgctggagcgcgcgga

SEQ ID NO: 372827 - DNA, 21 bp, Artificial Sequence
  Description of Artificial Sequence: Synthetic oligonucleotide
gacacgctggagcgcgcggac

SEQ ID NO: 372828 - DNA, 21 bp, Artificial Sequence
  Description of Artificial Sequence: Synthetic oligonucleotide
acacgctggagcgcgcggacc

SEQ ID NO: 372829 - DNA, 20 bp, Artificial Sequence
  Description of Artificial Sequence: Synthetic oligonucleotide
cacgctggagcgcgcggacc

SEQ ID NO: 372830 - DNA, 20 bp, Artificial Sequence
  Description of Artificial Sequence: Synthetic oligonucleotide
acgctggagcgcgcggaccc

SEQ ID NO: 372831 - DNA, 20 bp, Artificial Sequence
  Description of Artificial Sequence: Synthetic oligonucleotide
cgctggagcgcgcggaccct

SEQ ID NO: 372832 - DNA, 20 bp, Artificial Sequence
  Description of Artificial Sequence: Synthetic oligonucleotide
gctggagcgcgcggacccct

SEQ ID NO: 372833 - DNA, 20 bp, Artificial Sequence
  Description of Artificial Sequence: Synthetic oligonucleotide
ctggagcgcgcggaccccct

SEQ ID NO: 372834 - DNA, 22 bp, Artificial Sequence
  Description of Artificial Sequence: Synthetic oligonucleotide
tggagcgcgcggaccccccaaa

SEQ ID NO: 372835 - DNA, 21 bp, Artificial Sequence
  Description of Artificial Sequence: Synthetic oligonucleotide
ggagcgcgcggaccccccaaa

SEQ ID NO: 372836 - DNA, 22 bp, Artificial Sequence
  Description of Artificial Sequence: Synthetic oligonucleotide
gagcgcgcggaccccccaaaga

SEQ ID NO: 372837 - DNA, 29 bp, Artificial Sequence
  Description of Artificial Sequence: Synthetic oligonucleotide
tcgctgctgtgatgtgtaggaggaagagc

SEQ ID NO: 372838 - DNA, 28 bp, Artificial Sequence
  Description of Artificial Sequence: Synthetic oligonucleotide
cgctgctgtgatgtgtaggaggaagagc

SEQ ID NO: 372839 - DNA, 29 bp, Artificial Sequence
  Description of Artificial Sequence: Synthetic oligonucleotide
gctgctgtgatgtgtaggaggaagagctc

SEQ ID NO: 372840 - DNA, 30 bp, Artificial Sequence; identical to SEQ ID NO: 24918
  Description of Artificial Sequence: Synthetic oligonucleotide

SEQ ID NO: 372841 - DNA, 30 bp, Artificial Sequence; identical to SEQ ID NO: 24919
  Description of Artificial Sequence: Synthetic oligonucleotide

SEQ ID NO: 372842 - DNA, 29 bp, Artificial Sequence
  Description of Artificial Sequence: Synthetic oligonucleotide
gctgtgatgtgtaggaggaagagctcagg

SEQ ID NO: 372843 - DNA, 30 bp, Artificial Sequence; identical to SEQ ID NO: 24921
  Description of Artificial Sequence: Synthetic oligonucleotide

SEQ ID NO: 372844 - DNA, 30 bp, Artificial Sequence; identical to SEQ ID NO: 24922
  Description of Artificial Sequence: Synthetic oligonucleotide

SEQ ID NO: 372845 - DNA, 29 bp, Artificial Sequence
  Description of Artificial Sequence: Synthetic oligonucleotide
gtgatgtgtaggaggaagagctcaggtgg

SEQ ID NO: 372846 - DNA, 33 bp, Artificial Sequence; identical to SEQ ID NO: 24924
  Description of Artificial Sequence: Synthetic oligonucleotide

SEQ ID NO: 372847 - DNA, 32 bp, Artificial Sequence; identical to SEQ ID NO: 24925
  Description of Artificial Sequence: Synthetic oligonucleotide

SEQ ID NO: 372848 - DNA, 32 bp, Artificial Sequence; identical to SEQ ID NO: 24926
  Description of Artificial Sequence: Synthetic oligonucleotide

SEQ ID NO: 372849 - DNA, 31 bp, Artificial Sequence; identical to SEQ ID NO: 24927
  Description of Artificial Sequence: Synthetic oligonucleotide

SEQ ID NO: 372850 - DNA, 30 bp, Artificial Sequence; identical to SEQ ID NO: 24928
  Description of Artificial Sequence: Synthetic oligonucleotide

SEQ ID NO: 372851 - DNA, 31 bp, Artificial Sequence; identical to SEQ ID NO: 24929
  Description of Artificial Sequence: Synthetic oligonucleotide

SEQ ID NO: 372852 - DNA, 30 bp, Artificial Sequence; identical to SEQ ID NO: 24930
  Description of Artificial Sequence: Synthetic oligonucleotide

SEQ ID NO: 372853 - DNA, 30 bp, Artificial Sequence; identical to SEQ ID NO: 24931
  Description of Artificial Sequence: Synthetic oligonucleotide

SEQ ID NO: 372854 - DNA, 29 bp, Artificial Sequence
  Description of Artificial Sequence: Synthetic oligonucleotide
aggaggaagagctcaggtggaaaaggagg

SEQ ID NO: 372855 - DNA, 28 bp, Artificial Sequence
  Description of Artificial Sequence: Synthetic oligonucleotide
ggaggaagagctcaggtggaaaaggagg

SEQ ID NO: 372856 - DNA, 28 bp, Artificial Sequence
  Description of Artificial Sequence: Synthetic oligonucleotide
gaggaagagctcaggtggaaaaggaggg

SEQ ID NO: 372857 - DNA, 29 bp, Artificial Sequence
  Description of Artificial Sequence: Synthetic oligonucleotide
aggaagagctcaggtggaaaaggagggag

SEQ ID NO: 372858 - DNA, 28 bp, Artificial Sequence
  Description of Artificial Sequence: Synthetic oligonucleotide
ggaagagctcaggtggaaaaggagggag

SEQ ID NO: 372859 - DNA, 28 bp, Artificial Sequence
  Description of Artificial Sequence: Synthetic oligonucleotide
gaagagctcaggtggaaaaggagggagc

SEQ ID NO: 372860 - DNA, 30 bp, Artificial Sequence; identical to SEQ ID NO: 24938
  Description of Artificial Sequence: Synthetic oligonucleotide

SEQ ID NO: 372861 - DNA, 29 bp, Artificial Sequence
  Description of Artificial Sequence: Synthetic oligonucleotide
agagctcaggtggaaaaggagggagctac

SEQ ID NO: 372862 - DNA, 28 bp, Artificial Sequence
  Description of Artificial Sequence: Synthetic oligonucleotide
gagctcaggtggaaaaggagggagctac

SEQ ID NO: 372863 - DNA, 29 bp, Artificial Sequence
  Description of Artificial Sequence: Synthetic oligonucleotide
agctcaggtggaaaaggagggagctactc

SEQ ID NO: 372864 - DNA, 28 bp, Artificial Sequence
  Description of Artificial Sequence: Synthetic oligonucleotide
gctcaggtggaaaaggagggagctactc

SEQ ID NO: 372865 - DNA, 29 bp, Artificial Sequence
  Description of Artificial Sequence: Synthetic oligonucleotide
ctcaggtggaaaaggagggagctactctc

SEQ ID NO: 372866 - DNA, 22 bp, Artificial Sequence
  Description of Artificial Sequence: Synthetic oligonucleotide
aaggacacgctggagcgcgcgg

SEQ ID NO: 372867 - DNA, 29 bp, Artificial Sequence
  Description of Artificial Sequence: Synthetic oligonucleotide
gacgacacgcagttcgtgaggttcgatag

SEQ ID NO: 372868 - DNA, 29 bp, Artificial Sequence
  Description of Artificial Sequence: Synthetic oligonucleotide
acgacacgcagttcgtgaggttcgatagc

SEQ ID NO: 372869 - DNA, 28 bp, Artificial Sequence
  Description of Artificial Sequence: Synthetic oligonucleotide
cgacacgcagttcgtgaggttcgatagc

SEQ ID NO: 372870 - DNA, 28 bp, Artificial Sequence
  Description of Artificial Sequence: Synthetic oligonucleotide
gacacgcagttcgtgaggttcgatagcg

SEQ ID NO: 372871 - DNA, 29 bp, Artificial Sequence
  Description of Artificial Sequence: Synthetic oligonucleotide
acacgcagttcgtgaggttcgatagcgac

SEQ ID NO: 372872 - DNA, 28 bp, Artificial Sequence
  Description of Artificial Sequence: Synthetic oligonucleotide
cacgcagttcgtgaggttcgatagcgac

SEQ ID NO: 372873 - DNA, 28 bp, Artificial Sequence
  Description of Artificial Sequence: Synthetic oligonucleotide
acgcagttcgtgaggttcgatagcgacg

SEQ ID NO: 372874 - DNA, 27 bp, Artificial Sequence
  Description of Artificial Sequence: Synthetic oligonucleotide
cgcagttcgtgaggttcgatagcgacg

SEQ ID NO: 372875 - DNA, 27 bp, Artificial Sequence
  Description of Artificial Sequence: Synthetic oligonucleotide
gcagttcgtgaggttcgatagcgacgc

SEQ ID NO: 372876 - DNA, 27 bp, Artificial Sequence
  Description of Artificial Sequence: Synthetic oligonucleotide
cagttcgtgaggttcgatagcgacgcc

SEQ ID NO: 372877 - DNA, 27 bp, Artificial Sequence
  Description of Artificial Sequence: Synthetic oligonucleotide
agttcgtgaggttcgatagcgacgccg

SEQ ID NO: 372878 - DNA, 26 bp, Artificial Sequence
  Description of Artificial Sequence: Synthetic oligonucleotide
gttcgtgaggttcgatagcgacgccg

SEQ ID NO: 372879 - DNA, 26 bp, Artificial Sequence
  Description of Artificial Sequence: Synthetic oligonucleotide
ttcgtgaggttcgatagcgacgccgc

SEQ ID NO: 372880 - DNA, 25 bp, Artificial Sequence
  Description of Artificial Sequence: Synthetic oligonucleotide
tcgtgaggttcgatagcgacgccgc

SEQ ID NO: 372881 - DNA, 24 bp, Artificial Sequence
  Description of Artificial Sequence: Synthetic oligonucleotide
cgtgaggttcgatagcgacgccgc

SEQ ID NO: 372882 - DNA, 25 bp, Artificial Sequence
  Description of Artificial Sequence: Synthetic oligonucleotide
gtgaggttcgatagcgacgccgcga

SEQ ID NO: 372883 - DNA, 26 bp, Artificial Sequence
  Description of Artificial Sequence: Synthetic oligonucleotide
tgaggttcgatagcgacgccgcgagt

SEQ ID NO: 372884 - DNA, 25 bp, Artificial Sequence
  Description of Artificial Sequence: Synthetic oligonucleotide
gaggttcgatagcgacgccgcgagt

SEQ ID NO: 372885 - DNA, 25 bp, Artificial Sequence
  Description of Artificial Sequence: Synthetic oligonucleotide
aggttcgatagcgacgccgcgagtc

SEQ ID NO: 372886 - DNA, 24 bp, Artificial Sequence
  Description of Artificial Sequence: Synthetic oligonucleotide
ggttcgatagcgacgccgcgagtc

SEQ ID NO: 372887 - DNA, 24 bp, Artificial Sequence
  Description of Artificial Sequence: Synthetic oligonucleotide
gttcgatagcgacgccgcgagtcc

SEQ ID NO: 372888 - DNA, 25 bp, Artificial Sequence
  Description of Artificial Sequence: Synthetic oligonucleotide
ttcgatagcgacgccgcgagtccga

SEQ ID NO: 372889 - DNA, 24 bp, Artificial Sequence
  Description of Artificial Sequence: Synthetic oligonucleotide
tcgatagcgacgccgcgagtccga

SEQ ID NO: 372890 - DNA, 23 bp, Artificial Sequence
  Description of Artificial Sequence: Synthetic oligonucleotide
cgatagcgacgccgcgagtccga

SEQ ID NO: 372891 - DNA, 24 bp, Artificial Sequence
  Description of Artificial Sequence: Synthetic oligonucleotide
gatagcgacgccgcgagtccgaga

SEQ ID NO: 372892 - DNA, 25 bp, Artificial Sequence
  Description of Artificial Sequence: Synthetic oligonucleotide
atagcgacgccgcgagtccgagaga

SEQ ID NO: 372893 - DNA, 24 bp, Artificial Sequence
  Description of Artificial Sequence: Synthetic oligonucleotide
tagcgacgccgcgagtccgagaga

SEQ ID NO: 372894 - DNA, 30 bp, Artificial Sequence; identical to SEQ ID NO: 24972
  Description of Artificial Sequence: Synthetic oligonucleotide

SEQ ID NO: 372895 - DNA, 29 bp, Artificial Sequence
  Description of Artificial Sequence: Synthetic oligonucleotide
ccaacacacagactgaccgagagagcttg

SEQ ID NO: 372896 - DNA, 29 bp, Artificial Sequence
  Description of Artificial Sequence: Synthetic oligonucleotide
caacacacagactgaccgagagagcttgc

SEQ ID NO: 372897 - DNA, 29 bp, Artificial Sequence
  Description of Artificial Sequence: Synthetic oligonucleotide
aacacacagactgaccgagagagcttgcg

SEQ ID NO: 372898 - DNA, 28 bp, Artificial Sequence
  Description of Artificial Sequence: Synthetic oligonucleotide
acacacagactgaccgagagagcttgcg

SEQ ID NO: 372899 - DNA, 27 bp, Artificial Sequence
  Description of Artificial Sequence: Synthetic oligonucleotide
cacacagactgaccgagagagcttgcg

SEQ ID NO: 372900 - DNA, 27 bp, Artificial Sequence
  Description of Artificial Sequence: Synthetic oligonucleotide
acacagactgaccgagagagcttgcgg

SEQ ID NO: 372901 - DNA, 27 bp, Artificial Sequence
  Description of Artificial Sequence: Synthetic oligonucleotide
cacagactgaccgagagagcttgcgga

SEQ ID NO: 372902 - DNA, 28 bp, Artificial Sequence
  Description of Artificial Sequence: Synthetic oligonucleotide
acagactgaccgagagagcttgcggaac

SEQ ID NO: 372903 - DNA, 27 bp, Artificial Sequence
  Description of Artificial Sequence: Synthetic oligonucleotide
cagactgaccgagagagcttgcggaac

SEQ ID NO: 372904 - DNA, 27 bp, Artificial Sequence
  Description of Artificial Sequence: Synthetic oligonucleotide
agactgaccgagagagcttgcggaacc

SEQ ID NO: 372905 - DNA, 27 bp, Artificial Sequence
  Description of Artificial Sequence: Synthetic oligonucleotide
gactgaccgagagagcttgcggaacct

SEQ ID NO: 372906 - DNA, 27 bp, Artificial Sequence
  Description of Artificial Sequence: Synthetic oligonucleotide
actgaccgagagagcttgcggaacctg

SEQ ID NO: 372907 - DNA, 26 bp, Artificial Sequence
  Description of Artificial Sequence: Synthetic oligonucleotide
ctgaccgagagagcttgcggaacctg

SEQ ID NO: 372908 - DNA, 26 bp, Artificial Sequence
  Description of Artificial Sequence: Synthetic oligonucleotide
tgaccgagagagcttgcggaacctgc

SEQ ID NO: 372909 - DNA, 25 bp, Artificial Sequence
  Description of Artificial Sequence: Synthetic oligonucleotide
gaccgagagagcttgcggaacctgc

SEQ ID NO: 372910 - DNA, 25 bp, Artificial Sequence
  Description of Artificial Sequence: Synthetic oligonucleotide
accgagagagcttgcggaacctgcg

SEQ ID NO: 372911 - DNA, 24 bp, Artificial Sequence
  Description of Artificial Sequence: Synthetic oligonucleotide
ccgagagagcttgcggaacctgcg

SEQ ID NO: 372912 - DNA, 24 bp, Artificial Sequence
  Description of Artificial Sequence: Synthetic oligonucleotide
cgagagagcttgcggaacctgcgc

SEQ ID NO: 372913 - DNA, 24 bp, Artificial Sequence
  Description of Artificial Sequence: Synthetic oligonucleotide
gagagagcttgcggaacctgcgcg

SEQ ID NO: 372914 - DNA, 24 bp, Artificial Sequence
  Description of Artificial Sequence: Synthetic oligonucleotide
agagagcttgcggaacctgcgcgg

SEQ ID NO: 372915 - DNA, 23 bp, Artificial Sequence
  Description of Artificial Sequence: Synthetic oligonucleotide
gagagcttgcggaacctgcgcgg

SEQ ID NO: 372916 - DNA, 25 bp, Artificial Sequence
  Description of Artificial Sequence: Synthetic oligonucleotide
agagcttgcggaacctgcgcggcta

SEQ ID NO: 372917 - DNA, 24 bp, Artificial Sequence
  Description of Artificial Sequence: Synthetic oligonucleotide
gagcttgcggaacctgcgcggcta

SEQ ID NO: 372918 - DNA, 26 bp, Artificial Sequence
  Description of Artificial Sequence: Synthetic oligonucleotide
agcttgcggaacctgcgcggctacta

SEQ ID NO: 372919 - DNA, 25 bp, Artificial Sequence
  Description of Artificial Sequence: Synthetic oligonucleotide
gcttgcggaacctgcgcggctacta

SEQ ID NO: 372920 - DNA, 27 bp, Artificial Sequence
  Description of Artificial Sequence: Synthetic oligonucleotide
cttgcggaacctgcgcggctactacaa

SEQ ID NO: 372921 - DNA, 27 bp, Artificial Sequence
  Description of Artificial Sequence: Synthetic oligonucleotide
ttgcggaacctgcgcggctactacaac

SEQ ID NO: 372922 - DNA, 36 bp, Artificial Sequence; identical to SEQ ID NO: 25000
  Description of Artificial Sequence: Synthetic oligonucleotide

SEQ ID NO: 372923 - DNA, 35 bp, Artificial Sequence; identical to SEQ ID NO: 25001
  Description of Artificial Sequence: Synthetic oligonucleotide

SEQ ID NO: 372924 - DNA, 34 bp, Artificial Sequence; identical to SEQ ID NO: 25002
  Description of Artificial Sequence: Synthetic oligonucleotide

SEQ ID NO: 372925 - DNA, 33 bp, Artificial Sequence; identical to SEQ ID NO: 25003
  Description of Artificial Sequence: Synthetic oligonucleotide

SEQ ID NO: 372926 - DNA, 32 bp, Artificial Sequence; identical to SEQ ID NO: 25004
  Description of Artificial Sequence: Synthetic oligonucleotide

SEQ ID NO: 372927 - DNA, 33 bp, Artificial Sequence; identical to SEQ ID NO: 25005
  Description of Artificial Sequence: Synthetic oligonucleotide

SEQ ID NO: 372928 - DNA, 34 bp, Artificial Sequence; identical to SEQ ID NO: 25006
  Description of Artificial Sequence: Synthetic oligonucleotide

SEQ ID NO: 372929 - DNA, 35 bp, Artificial Sequence; identical to SEQ ID NO: 25007
  Description of Artificial Sequence: Synthetic oligonucleotide

SEQ ID NO: 372930 - DNA, 34 bp, Artificial Sequence; identical to SEQ ID NO: 25008
  Description of Artificial Sequence: Synthetic oligonucleotide

SEQ ID NO: 372931 - DNA, 35 bp, Artificial Sequence; identical to SEQ ID NO: 25009
  Description of Artificial Sequence: Synthetic oligonucleotide

SEQ ID NO: 372932 - DNA, 36 bp, Artificial Sequence; identical to SEQ ID NO: 25010
  Description of Artificial Sequence: Synthetic oligonucleotide

SEQ ID NO: 372933 - DNA, 37 bp, Artificial Sequence; identical to SEQ ID NO: 25011
  Description of Artificial Sequence: Synthetic oligonucleotide

SEQ ID NO: 372934 - DNA, 37 bp, Artificial Sequence; identical to SEQ ID NO: 25012
  Description of Artificial Sequence: Synthetic oligonucleotide

SEQ ID NO: 372935 - DNA, 36 bp, Artificial Sequence; identical to SEQ ID NO: 25013
  Description of Artificial Sequence: Synthetic oligonucleotide

SEQ ID NO: 372936 - DNA, 35 bp, Artificial Sequence; identical to SEQ ID NO: 25014
  Description of Artificial Sequence: Synthetic oligonucleotide

SEQ ID NO: 372937 - DNA, 35 bp, Artificial Sequence; identical to SEQ ID NO: 25015
  Description of Artificial Sequence: Synthetic oligonucleotide

SEQ ID NO: 372938 - DNA, 34 bp, Artificial Sequence; identical to SEQ ID NO: 25016
  Description of Artificial Sequence: Synthetic oligonucleotide

SEQ ID NO: 372939 - DNA, 35 bp, Artificial Sequence; identical to SEQ ID NO: 25017
  Description of Artificial Sequence: Synthetic oligonucleotide

SEQ ID NO: 372940 - DNA, 34 bp, Artificial Sequence; identical to SEQ ID NO: 25018
  Description of Artificial Sequence: Synthetic oligonucleotide

SEQ ID NO: 372941 - DNA, 35 bp, Artificial Sequence; identical to SEQ ID NO: 25019
  Description of Artificial Sequence: Synthetic oligonucleotide

SEQ ID NO: 372942 - DNA, 34 bp, Artificial Sequence; identical to SEQ ID NO: 25020
  Description of Artificial Sequence: Synthetic oligonucleotide

SEQ ID NO: 372943 - DNA, 35 bp, Artificial Sequence; identical to SEQ ID NO: 25021
  Description of Artificial Sequence: Synthetic oligonucleotide

SEQ ID NO: 372944 - DNA, 34 bp, Artificial Sequence; identical to SEQ ID NO: 25022
  Description of Artificial Sequence: Synthetic oligonucleotide

SEQ ID NO: 372945 - DNA, 33 bp, Artificial Sequence; identical to SEQ ID NO: 25023
  Description of Artificial Sequence: Synthetic oligonucleotide

SEQ ID NO: 372946 - DNA, 33 bp, Artificial Sequence; identical to SEQ ID NO: 25024
  Description of Artificial Sequence: Synthetic oligonucleotide

SEQ ID NO: 372947 - DNA, 32 bp, Artificial Sequence; identical to SEQ ID NO: 25025
  Description of Artificial Sequence: Synthetic oligonucleotide

SEQ ID NO: 372948 - DNA, 31 bp, Artificial Sequence; identical to SEQ ID NO: 25026
  Description of Artificial Sequence: Synthetic oligonucleotide

SEQ ID NO: 372949 - DNA, 31 bp, Artificial Sequence; identical to SEQ ID NO: 25027
  Description of Artificial Sequence: Synthetic oligonucleotide

SEQ ID NO: 372950 - DNA, 30 bp, Artificial Sequence; identical to SEQ ID NO: 25028
  Description of Artificial Sequence: Synthetic oligonucleotide

SEQ ID NO: 372951 - DNA, 29 bp, Artificial Sequence
  Description of Artificial Sequence: Synthetic oligonucleotide
gacaaacacacagactgaccgagagagcc

SEQ ID NO: 372952 - DNA, 30 bp, Artificial Sequence; identical to SEQ ID NO: 25030
  Description of Artificial Sequence: Synthetic oligonucleotide

SEQ ID NO: 372953 - DNA, 29 bp, Artificial Sequence
  Description of Artificial Sequence: Synthetic oligonucleotide
caaacacacagactgaccgagagagcctg

SEQ ID NO: 372954 - DNA, 29 bp, Artificial Sequence
  Description of Artificial Sequence: Synthetic oligonucleotide
aaacacacagactgaccgagagagcctgc

SEQ ID NO: 372955 - DNA, 28 bp, Artificial Sequence
  Description of Artificial Sequence: Synthetic oligonucleotide
aggtatttcgacaccgccatgtcccgac

SEQ ID NO: 372956 - DNA, 27 bp, Artificial Sequence
  Description of Artificial Sequence: Synthetic oligonucleotide
ggtatttcgacaccgccatgtcccgac

SEQ ID NO: 372957 - DNA, 27 bp, Artificial Sequence
  Description of Artificial Sequence: Synthetic oligonucleotide
gtatttcgacaccgccatgtcccgacc

SEQ ID NO: 372958 - DNA, 27 bp, Artificial Sequence
  Description of Artificial Sequence: Synthetic oligonucleotide
tatttcgacaccgccatgtcccgaccc

SEQ ID NO: 372959 - DNA, 26 bp, Artificial Sequence
  Description of Artificial Sequence: Synthetic oligonucleotide
atttcgacaccgccatgtcccgaccc

SEQ ID NO: 372960 - DNA, 25 bp, Artificial Sequence
  Description of Artificial Sequence: Synthetic oligonucleotide
tttcgacaccgccatgtcccgaccc

SEQ ID NO: 372961 - DNA, 24 bp, Artificial Sequence
  Description of Artificial Sequence: Synthetic oligonucleotide
ttcgacaccgccatgtcccgaccc

SEQ ID NO: 372962 - DNA, 23 bp, Artificial Sequence
  Description of Artificial Sequence: Synthetic oligonucleotide
tcgacaccgccatgtcccgaccc

SEQ ID NO: 372963 - DNA, 22 bp, Artificial Sequence
  Description of Artificial Sequence: Synthetic oligonucleotide
cgacaccgccatgtcccgaccc

SEQ ID NO: 372964 - DNA, 22 bp, Artificial Sequence
  Description of Artificial Sequence: Synthetic oligonucleotide
gacaccgccatgtcccgacccg

SEQ ID NO: 372965 - DNA, 22 bp, Artificial Sequence
  Description of Artificial Sequence: Synthetic oligonucleotide
acaccgccatgtcccgacccgg

SEQ ID NO: 372966 - DNA, 21 bp, Artificial Sequence
  Description of Artificial Sequence: Synthetic oligonucleotide
caccgccatgtcccgacccgg

SEQ ID NO: 372967 - DNA, 21 bp, Artificial Sequence
  Description of Artificial Sequence: Synthetic oligonucleotide
accgccatgtcccgacccggc

SEQ ID NO: 372968 - DNA, 20 bp, Artificial Sequence
  Description of Artificial Sequence: Synthetic oligonucleotide
ccgccatgtcccgacccggc

SEQ ID NO: 372969 - DNA, 20 bp, Artificial Sequence
  Description of Artificial Sequence: Synthetic oligonucleotide
cgccatgtcccgacccggcc

SEQ ID NO: 372970 - DNA, 20 bp, Artificial Sequence
  Description of Artificial Sequence: Synthetic oligonucleotide
gccatgtcccgacccggccg

SEQ ID NO: 372971 - DNA, 20 bp, Artificial Sequence
  Description of Artificial Sequence: Synthetic oligonucleotide
ccatgtcccgacccggccgc

SEQ ID NO: 372972 - DNA, 20 bp, Artificial Sequence
  Description of Artificial Sequence: Synthetic oligonucleotide
catgtcccgacccggccgcg

SEQ ID NO: 372973 - DNA, 20 bp, Artificial Sequence
  Description of Artificial Sequence: Synthetic oligonucleotide
atgtcccgacccggccgcgg

SEQ ID NO: 372974 - DNA, 20 bp, Artificial Sequence
  Description of Artificial Sequence: Synthetic oligonucleotide
tgtcccgacccggccgcggt

SEQ ID NO: 372975 - DNA, 20 bp, Artificial Sequence
  Description of Artificial Sequence: Synthetic oligonucleotide
gtcccgacccggccgcggtt

SEQ ID NO: 372976 - DNA, 20 bp, Artificial Sequence
  Description of Artificial Sequence: Synthetic oligonucleotide
tcccgacccggccgcgggtt

SEQ ID NO: 372977 - DNA, 20 bp, Artificial Sequence
  Description of Artificial Sequence: Synthetic oligonucleotide
cccgacccggccgcgggttt

SEQ ID NO: 372978 - DNA, 20 bp, Artificial Sequence
  Description of Artificial Sequence: Synthetic oligonucleotide
ccgacccggccgcggggatt

SEQ ID NO: 372979 - DNA, 20 bp, Artificial Sequence
  Description of Artificial Sequence: Synthetic oligonucleotide
cgacccggccgcggggagtt

SEQ ID NO: 372980 - DNA, 20 bp, Artificial Sequence
  Description of Artificial Sequence: Synthetic oligonucleotide
gacccggccgcggggagctt

SEQ ID NO: 372981 - DNA, 20 bp, Artificial Sequence
  Description of Artificial Sequence: Synthetic oligonucleotide
acccggccgcggggagcctt

SEQ ID NO: 372982 - DNA, 26 bp, Artificial Sequence
  Description of Artificial Sequence: Synthetic oligonucleotide
atcgccttgaacgaggacctgcgctc

SEQ ID NO: 372983 - DNA, 25 bp, Artificial Sequence
  Description of Artificial Sequence: Synthetic oligonucleotide
tcgccttgaacgaggacctgcgctc

SEQ ID NO: 372984 - DNA, 24 bp, Artificial Sequence
  Description of Artificial Sequence: Synthetic oligonucleotide
cgccttgaacgaggacctgcgctc

SEQ ID NO: 372985 - DNA, 25 bp, Artificial Sequence
  Description of Artificial Sequence: Synthetic oligonucleotide
gccttgaacgaggacctgcgctcct

SEQ ID NO: 372986 - DNA, 25 bp, Artificial Sequence
  Description of Artificial Sequence: Synthetic oligonucleotide
ccttgaacgaggacctgcgctcctg

SEQ ID NO: 372987 - DNA, 26 bp, Artificial Sequence
  Description of Artificial Sequence: Synthetic oligonucleotide
cttgaacgaggacctgcgctcctgga

SEQ ID NO: 372988 - DNA, 26 bp, Artificial Sequence
  Description of Artificial Sequence: Synthetic oligonucleotide
ttgaacgaggacctgcgctcctggac

SEQ ID NO: 372989 - DNA, 22 bp, Artificial Sequence
  Description of Artificial Sequence: Synthetic oligonucleotide
agagaggagccccgggcgccat

SEQ ID NO: 372990 - DNA, 21 bp, Artificial Sequence
  Description of Artificial Sequence: Synthetic oligonucleotide
gagaggagccccgggcgccat

SEQ ID NO: 372991 - DNA, 21 bp, Artificial Sequence
  Description of Artificial Sequence: Synthetic oligonucleotide
agaggagccccgggcgccatg

SEQ ID NO: 372992 - DNA, 20 bp, Artificial Sequence
  Description of Artificial Sequence: Synthetic oligonucleotide
gaggagccccgggcgccatg

SEQ ID NO: 372993 - DNA, 23 bp, Artificial Sequence
  Description of Artificial Sequence: Synthetic oligonucleotide
aggagccccgggcgccatggata

SEQ ID NO: 372994 - DNA, 22 bp, Artificial Sequence
  Description of Artificial Sequence: Synthetic oligonucleotide
ggagccccgggcgccatggata

SEQ ID NO: 372995 - DNA, 23 bp, Artificial Sequence
  Description of Artificial Sequence: Synthetic oligonucleotide
gagccccgggcgccatggataga

SEQ ID NO: 372996 - DNA, 23 bp, Artificial Sequence
  Description of Artificial Sequence: Synthetic oligonucleotide
agccccgggcgccatggatagag

SEQ ID NO: 372997 - DNA, 22 bp, Artificial Sequence
  Description of Artificial Sequence: Synthetic oligonucleotide
gccccgggcgccatggatagag

SEQ ID NO: 372998 - DNA, 23 bp, Artificial Sequence
  Description of Artificial Sequence: Synthetic oligonucleotide
ccccgggcgccatggatagagca

SEQ ID NO: 372999 - DNA, 23 bp, Artificial Sequence
  Description of Artificial Sequence: Synthetic oligonucleotide
cccgggcgccatggatagagcag

SEQ ID NO: 373000 - DNA, 24 bp, Artificial Sequence
  Description of Artificial Sequence: Synthetic oligonucleotide
ccgggcgccatggatagagcagga

SEQ ID NO: 373001 - DNA, 27 bp, Artificial Sequence
  Description of Artificial Sequence: Synthetic oligonucleotide
acgtgcgtggagtggctccgcagatat

SEQ ID NO: 373002 - DNA, 26 bp, Artificial Sequence
  Description of Artificial Sequence: Synthetic oligonucleotide
cgtgcgtggagtggctccgcagatat

SEQ ID NO: 373003 - DNA, 27 bp, Artificial Sequence
  Description of Artificial Sequence: Synthetic oligonucleotide
gtgcgtggagtggctccgcagatatct

SEQ ID NO: 373004 - DNA, 27 bp, Artificial Sequence
  Description of Artificial Sequence: Synthetic oligonucleotide
tgcgtggagtggctccgcagatatctg

SEQ ID NO: 373005 - DNA, 26 bp, Artificial Sequence
  Description of Artificial Sequence: Synthetic oligonucleotide
gcgtggagtggctccgcagatatctg

SEQ ID NO: 373006 - DNA, 27 bp, Artificial Sequence
  Description of Artificial Sequence: Synthetic oligonucleotide
cgtggagtggctccgcagatatctgga

SEQ ID NO: 373007 - DNA, 27 bp, Artificial Sequence
  Description of Artificial Sequence: Synthetic oligonucleotide
gtggagtggctccgcagatatctggag

SEQ ID NO: 373008 - DNA, 29 bp, Artificial Sequence
  Description of Artificial Sequence: Synthetic oligonucleotide
tggagtggctccgcagatatctggagaac

SEQ ID NO: 373009 - DNA, 28 bp, Artificial Sequence
  Description of Artificial Sequence: Synthetic oligonucleotide
ggagtggctccgcagatatctggagaac

SEQ ID NO: 373010 - DNA, 28 bp, Artificial Sequence
  Description of Artificial Sequence: Synthetic oligonucleotide
gagtggctccgcagatatctggagaacg

SEQ ID NO: 373011 - DNA, 28 bp, Artificial Sequence
  Description of Artificial Sequence: Synthetic oligonucleotide
agtggctccgcagatatctggagaacgg

SEQ ID NO: 373012 - DNA, 27 bp, Artificial Sequence
  Description of Artificial Sequence: Synthetic oligonucleotide
gtggctccgcagatatctggagaacgg

SEQ ID NO: 373013 - DNA, 27 bp, Artificial Sequence
  Description of Artificial Sequence: Synthetic oligonucleotide
tggctccgcagatatctggagaacggg

SEQ ID NO: 373014 - DNA, 27 bp, Artificial Sequence
  Description of Artificial Sequence: Synthetic oligonucleotide
ggctccgcagatatctggagaacggga

SEQ ID NO: 373015 - DNA, 28 bp, Artificial Sequence
  Description of Artificial Sequence: Synthetic oligonucleotide
gctccgcagatatctggagaacgggaag

SEQ ID NO: 373016 - DNA, 28 bp, Artificial Sequence
  Description of Artificial Sequence: Synthetic oligonucleotide
ctccgcagatatctggagaacgggaagg

SEQ ID NO: 373017 - DNA, 29 bp, Artificial Sequence
  Description of Artificial Sequence: Synthetic oligonucleotide
tccgcagatatctggagaacgggaaggac

SEQ ID NO: 373018 - DNA, 28 bp, Artificial Sequence
  Description of Artificial Sequence: Synthetic oligonucleotide
ccgcagatatctggagaacgggaaggac

SEQ ID NO: 373019 - DNA, 29 bp, Artificial Sequence
  Description of Artificial Sequence: Synthetic oligonucleotide
cgcagatatctggagaacgggaaggacac

SEQ ID NO: 373020 - DNA, 29 bp, Artificial Sequence
  Description of Artificial Sequence: Synthetic oligonucleotide
gcagatatctggagaacgggaaggacacg

SEQ ID NO: 373021 - DNA, 29 bp, Artificial Sequence
  Description of Artificial Sequence: Synthetic oligonucleotide
cagatatctggagaacgggaaggacacgc

SEQ ID NO: 373022 - DNA, 30 bp, Artificial Sequence; identical to SEQ ID NO: 25093
  Description of Artificial Sequence: Synthetic oligonucleotide

SEQ ID NO: 373023 - DNA, 29 bp, Artificial Sequence
  Description of Artificial Sequence: Synthetic oligonucleotide
gatatctggagaacgggaaggacacgctg

SEQ ID NO: 373024 - DNA, 29 bp, Artificial Sequence
  Description of Artificial Sequence: Synthetic oligonucleotide
atatctggagaacgggaaggacacgctgg

SEQ ID NO: 373025 - DNA, 28 bp, Artificial Sequence
  Description of Artificial Sequence: Synthetic oligonucleotide
tatctggagaacgggaaggacacgctgg

SEQ ID NO: 373026 - DNA, 27 bp, Artificial Sequence
  Description of Artificial Sequence: Synthetic oligonucleotide
atctggagaacgggaaggacacgctgg

SEQ ID NO: 373027 - DNA, 27 bp, Artificial Sequence
  Description of Artificial Sequence: Synthetic oligonucleotide
tctggagaacgggaaggacacgctgga

SEQ ID NO: 373028 - DNA, 27 bp, Artificial Sequence
  Description of Artificial Sequence: Synthetic oligonucleotide
cagttcgtgaggttcgacagcgacgct

SEQ ID NO: 373029 - DNA, 27 bp, Artificial Sequence
  Description of Artificial Sequence: Synthetic oligonucleotide
agttcgtgaggttcgacagcgacgctg

SEQ ID NO: 373030 - DNA, 26 bp, Artificial Sequence
  Description of Artificial Sequence: Synthetic oligonucleotide
gttcgtgaggttcgacagcgacgctg

SEQ ID NO: 373031 - DNA, 26 bp, Artificial Sequence
  Description of Artificial Sequence: Synthetic oligonucleotide
ttcgtgaggttcgacagcgacgctgc

SEQ ID NO: 373032 - DNA, 25 bp, Artificial Sequence
  Description of Artificial Sequence: Synthetic oligonucleotide
tcgtgaggttcgacagcgacgctgc

SEQ ID NO: 373033 - DNA, 24 bp, Artificial Sequence
  Description of Artificial Sequence: Synthetic oligonucleotide
cgtgaggttcgacagcgacgctgc

SEQ ID NO: 373034 - DNA, 25 bp, Artificial Sequence
  Description of Artificial Sequence: Synthetic oligonucleotide
gtgaggttcgacagcgacgctgcga

SEQ ID NO: 373035 - DNA, 26 bp, Artificial Sequence
  Description of Artificial Sequence: Synthetic oligonucleotide
tgaggttcgacagcgacgctgcgagt

SEQ ID NO: 373036 - DNA, 25 bp, Artificial Sequence
  Description of Artificial Sequence: Synthetic oligonucleotide
gaggttcgacagcgacgctgcgagt

SEQ ID NO: 373037 - DNA, 25 bp, Artificial Sequence
  Description of Artificial Sequence: Synthetic oligonucleotide
aggttcgacagcgacgctgcgagtc

SEQ ID NO: 373038 - DNA, 24 bp, Artificial Sequence
  Description of Artificial Sequence: Synthetic oligonucleotide
ggttcgacagcgacgctgcgagtc

SEQ ID NO: 373039 - DNA, 24 bp, Artificial Sequence
  Description of Artificial Sequence: Synthetic oligonucleotide
gttcgacagcgacgctgcgagtcc

SEQ ID NO: 373040 - DNA, 25 bp, Artificial Sequence
  Description of Artificial Sequence: Synthetic oligonucleotide
ttcgacagcgacgctgcgagtccga

SEQ ID NO: 373041 - DNA, 24 bp, Artificial Sequence
  Description of Artificial Sequence: Synthetic oligonucleotide
tcgacagcgacgctgcgagtccga

SEQ ID NO: 373042 - DNA, 23 bp, Artificial Sequence
  Description of Artificial Sequence: Synthetic oligonucleotide
cgacagcgacgctgcgagtccga

SEQ ID NO: 373043 - DNA, 24 bp, Artificial Sequence
  Description of Artificial Sequence: Synthetic oligonucleotide
gacagcgacgctgcgagtccgaga

SEQ ID NO: 373044 - DNA, 25 bp, Artificial Sequence
  Description of Artificial Sequence: Synthetic oligonucleotide
acagcgacgctgcgagtccgagaga

SEQ ID NO: 373045 - DNA, 24 bp, Artificial Sequence
  Description of Artificial Sequence: Synthetic oligonucleotide
cagcgacgctgcgagtccgagaga

SEQ ID NO: 373046 - DNA, 24 bp, Artificial Sequence
  Description of Artificial Sequence: Synthetic oligonucleotide
agcgacgctgcgagtccgagagag

SEQ ID NO: 373047 - DNA, 23 bp, Artificial Sequence
  Description of Artificial Sequence: Synthetic oligonucleotide
gcgacgctgcgagtccgagagag

SEQ ID NO: 373048 - DNA, 24 bp, Artificial Sequence
  Description of Artificial Sequence: Synthetic oligonucleotide
cgacgctgcgagtccgagagagga

SEQ ID NO: 373049 - DNA, 24 bp, Artificial Sequence
  Description of Artificial Sequence: Synthetic oligonucleotide
gacgctgcgagtccgagagaggag

SEQ ID NO: 373050 - DNA, 24 bp, Artificial Sequence
  Description of Artificial Sequence: Synthetic oligonucleotide
acgctgcgagtccgagagaggagc

SEQ ID NO: 373051 - DNA, 23 bp, Artificial Sequence
  Description of Artificial Sequence: Synthetic oligonucleotide
cgctgcgagtccgagagaggagc

SEQ ID NO: 373052 - DNA, 23 bp, Artificial Sequence
  Description of Artificial Sequence: Synthetic oligonucleotide
gctgcgagtccgagagaggagcc

SEQ ID NO: 373053 - DNA, 23 bp, Artificial Sequence
  Description of Artificial Sequence: Synthetic oligonucleotide
ctgcgagtccgagagaggagccg

SEQ ID NO: 373054 - DNA, 23 bp, Artificial Sequence
  Description of Artificial Sequence: Synthetic oligonucleotide
tgcgagtccgagagaggagccgc

SEQ ID NO: 373055 - DNA, 24 bp, Artificial Sequence
  Description of Artificial Sequence: Synthetic oligonucleotide
gcggacaccgcggctcagatcact

SEQ ID NO: 373056 - DNA, 25 bp, Artificial Sequence
  Description of Artificial Sequence: Synthetic oligonucleotide
cggacaccgcggctcagatcactca

SEQ ID NO: 373057 - DNA, 25 bp, Artificial Sequence
  Description of Artificial Sequence: Synthetic oligonucleotide
ggacaccgcggctcagatcactcag

SEQ ID NO: 373058 - DNA, 25 bp, Artificial Sequence
  Description of Artificial Sequence: Synthetic oligonucleotide
gacaccgcggctcagatcactcagc

SEQ ID NO: 373059 - DNA, 25 bp, Artificial Sequence
  Description of Artificial Sequence: Synthetic oligonucleotide
acaccgcggctcagatcactcagcg

SEQ ID NO: 373060 - DNA, 24 bp, Artificial Sequence
  Description of Artificial Sequence: Synthetic oligonucleotide
caccgcggctcagatcactcagcg

SEQ ID NO: 373061 - DNA, 26 bp, Artificial Sequence
  Description of Artificial Sequence: Synthetic oligonucleotide
accgcggctcagatcactcagcgcaa

SEQ ID NO: 373062 - DNA, 25 bp, Artificial Sequence
  Description of Artificial Sequence: Synthetic oligonucleotide
ccgcggctcagatcactcagcgcaa

SEQ ID NO: 373063 - DNA, 26 bp, Artificial Sequence
  Description of Artificial Sequence: Synthetic oligonucleotide
cgcggctcagatcactcagcgcaagt

SEQ ID NO: 373064 - DNA, 26 bp, Artificial Sequence
  Description of Artificial Sequence: Synthetic oligonucleotide
gcggctcagatcactcagcgcaagtg

SEQ ID NO: 373065 - DNA, 26 bp, Artificial Sequence
  Description of Artificial Sequence: Synthetic oligonucleotide
cggctcagatcactcagcgcaagtgg

SEQ ID NO: 373066 - DNA, 27 bp, Artificial Sequence
  Description of Artificial Sequence: Synthetic oligonucleotide
ggctcagatcactcagcgcaagtggga

SEQ ID NO: 373067 - DNA, 27 bp, Artificial Sequence
  Description of Artificial Sequence: Synthetic oligonucleotide
gctcagatcactcagcgcaagtgggag

SEQ ID NO: 373068 - DNA, 27 bp, Artificial Sequence
  Description of Artificial Sequence: Synthetic oligonucleotide
ctcagatcactcagcgcaagtgggagg

SEQ ID NO: 373069 - DNA, 27 bp, Artificial Sequence
  Description of Artificial Sequence: Synthetic oligonucleotide
tcagatcactcagcgcaagtgggaggc

SEQ ID NO: 373070 - DNA, 26 bp, Artificial Sequence
  Description of Artificial Sequence: Synthetic oligonucleotide
cagatcactcagcgcaagtgggaggc

SEQ ID NO: 373071 - DNA, 26 bp, Artificial Sequence
  Description of Artificial Sequence: Synthetic oligonucleotide
agatcactcagcgcaagtgggaggcg

SEQ ID NO: 373072 - DNA, 25 bp, Artificial Sequence
  Description of Artificial Sequence: Synthetic oligonucleotide
gatcactcagcgcaagtgggaggcg

SEQ ID NO: 373073 - DNA, 25 bp, Artificial Sequence
  Description of Artificial Sequence: Synthetic oligonucleotide
atcactcagcgcaagtgggaggcgg

SEQ ID NO: 373074 - DNA, 24 bp, Artificial Sequence
  Description of Artificial Sequence: Synthetic oligonucleotide
tcactcagcgcaagtgggaggcgg

SEQ ID NO: 373075 - DNA, 23 bp, Artificial Sequence
  Description of Artificial Sequence: Synthetic oligonucleotide
cactcagcgcaagtgggaggcgg

SEQ ID NO: 373076 - DNA, 23 bp, Artificial Sequence
  Description of Artificial Sequence: Synthetic oligonucleotide
actcagcgcaagtgggaggcggc

SEQ ID NO: 373077 - DNA, 22 bp, Artificial Sequence
  Description of Artificial Sequence: Synthetic oligonucleotide
ctcagcgcaagtgggaggcggc

SEQ ID NO: 373078 - DNA, 22 bp, Artificial Sequence
  Description of Artificial Sequence: Synthetic oligonucleotide
tcagcgcaagtgggaggcggcc

SEQ ID NO: 373079 - DNA, 24 bp, Artificial Sequence
  Description of Artificial Sequence: Synthetic oligonucleotide
cgcgcggaccccccaaagacacat

SEQ ID NO: 373080 - DNA, 25 bp, Artificial Sequence
  Description of Artificial Sequence: Synthetic oligonucleotide
gcgcggaccccccaaagacacatgt

SEQ ID NO: 373081 - DNA, 26 bp, Artificial Sequence
  Description of Artificial Sequence: Synthetic oligonucleotide
cgcggaccccccaaagacacatgtga

SEQ ID NO: 373082 - DNA, 26 bp, Artificial Sequence
  Description of Artificial Sequence: Synthetic oligonucleotide
gcggaccccccaaagacacatgtgac

SEQ ID NO: 373083 - DNA, 26 bp, Artificial Sequence
  Description of Artificial Sequence: Synthetic oligonucleotide
cggaccccccaaagacacatgtgacc

SEQ ID NO: 373084 - DNA, 27 bp, Artificial Sequence
  Description of Artificial Sequence: Synthetic oligonucleotide
ggaccccccaaagacacatgtgaccca

SEQ ID NO: 373085 - DNA, 27 bp, Artificial Sequence
  Description of Artificial Sequence: Synthetic oligonucleotide
tgtggcggagcaggacagagcctactt

SEQ ID NO: 373086 - DNA, 26 bp, Artificial Sequence
  Description of Artificial Sequence: Synthetic oligonucleotide
gtggcggagcaggacagagcctactt

SEQ ID NO: 373087 - DNA, 26 bp, Artificial Sequence
  Description of Artificial Sequence: Synthetic oligonucleotide
tggcggagcaggacagagcctacttg

SEQ ID NO: 373088 - DNA, 25 bp, Artificial Sequence
  Description of Artificial Sequence: Synthetic oligonucleotide
ggcggagcaggacagagcctacttg

SEQ ID NO: 373089 - DNA, 26 bp, Artificial Sequence
  Description of Artificial Sequence: Synthetic oligonucleotide
gcggagcaggacagagcctacttgga

SEQ ID NO: 373090 - DNA, 26 bp, Artificial Sequence
  Description of Artificial Sequence: Synthetic oligonucleotide
cggagcaggacagagcctacttggag

SEQ ID NO: 373091 - DNA, 26 bp, Artificial Sequence
  Description of Artificial Sequence: Synthetic oligonucleotide
ggagcaggacagagcctacttggagg

SEQ ID NO: 373092 - DNA, 26 bp, Artificial Sequence
  Description of Artificial Sequence: Synthetic oligonucleotide
gagcaggacagagcctacttggaggg

SEQ ID NO: 373093 - DNA, 27 bp, Artificial Sequence
  Description of Artificial Sequence: Synthetic oligonucleotide
agcaggacagagcctacttggagggca

SEQ ID NO: 373094 - DNA, 26 bp, Artificial Sequence
  Description of Artificial Sequence: Synthetic oligonucleotide
gcaggacagagcctacttggagggca

SEQ ID NO: 373095 - DNA, 26 bp, Artificial Sequence
  Description of Artificial Sequence: Synthetic oligonucleotide
caggacagagcctacttggagggcac

SEQ ID NO: 373096 - DNA, 27 bp, Artificial Sequence
  Description of Artificial Sequence: Synthetic oligonucleotide
aggacagagcctacttggagggcacgt

SEQ ID NO: 373097 - DNA, 26 bp, Artificial Sequence
  Description of Artificial Sequence: Synthetic oligonucleotide
ggacagagcctacttggagggcacgt

SEQ ID NO: 373098 - DNA, 26 bp, Artificial Sequence
  Description of Artificial Sequence: Synthetic oligonucleotide
gacagagcctacttggagggcacgtg

SEQ ID NO: 373099 - DNA, 26 bp, Artificial Sequence
  Description of Artificial Sequence: Synthetic oligonucleotide
acagagcctacttggagggcacgtgc

SEQ ID NO: 373100 - DNA, 25 bp, Artificial Sequence
  Description of Artificial Sequence: Synthetic oligonucleotide
cagagcctacttggagggcacgtgc

SEQ ID NO: 373101 - DNA, 25 bp, Artificial Sequence
  Description of Artificial Sequence: Synthetic oligonucleotide
agagcctgcggaacctgcgcggtta

SEQ ID NO: 373102 - DNA, 24 bp, Artificial Sequence
  Description of Artificial Sequence: Synthetic oligonucleotide
gagcctgcggaacctgcgcggtta

SEQ ID NO: 373103 - DNA, 26 bp, Artificial Sequence
  Description of Artificial Sequence: Synthetic oligonucleotide
agcctgcggaacctgcgcggttacta

SEQ ID NO: 373104 - DNA, 25 bp, Artificial Sequence
  Description of Artificial Sequence: Synthetic oligonucleotide
gcctgcggaacctgcgcggttacta

SEQ ID NO: 373105 - DNA, 27 bp, Artificial Sequence
  Description of Artificial Sequence: Synthetic oligonucleotide
cctgcggaacctgcgcggttactacaa

SEQ ID NO: 373106 - DNA, 27 bp, Artificial Sequence
  Description of Artificial Sequence: Synthetic oligonucleotide
ctgcggaacctgcgcggttactacaac

SEQ ID NO: 373107 - DNA, 27 bp, Artificial Sequence
  Description of Artificial Sequence: Synthetic oligonucleotide
tgcggaacctgcgcggttactacaacc

SEQ ID NO: 373108 - DNA, 27 bp, Artificial Sequence
  Description of Artificial Sequence: Synthetic oligonucleotide
gcggaacctgcgcggttactacaacca

SEQ ID NO: 373109 - DNA, 27 bp, Artificial Sequence
  Description of Artificial Sequence: Synthetic oligonucleotide
cggaacctgcgcggttactacaaccag

SEQ ID NO: 373110 - DNA, 28 bp, Artificial Sequence
  Description of Artificial Sequence: Synthetic oligonucleotide
ggaacctgcgcggttactacaaccagag

SEQ ID NO: 373111 - DNA, 28 bp, Artificial Sequence
  Description of Artificial Sequence: Synthetic oligonucleotide
gaacctgcgcggttactacaaccagagc

SEQ ID NO: 373112 - DNA, 28 bp, Artificial Sequence
  Description of Artificial Sequence: Synthetic oligonucleotide
aacctgcgcggttactacaaccagagcg

SEQ ID NO: 373113 - DNA, 27 bp, Artificial Sequence
  Description of Artificial Sequence: Synthetic oligonucleotide
acctgcgcggttactacaaccagagcg

SEQ ID NO: 373114 - DNA, 27 bp, Artificial Sequence
  Description of Artificial Sequence: Synthetic oligonucleotide
cctgcgcggttactacaaccagagcga

SEQ ID NO: 373115 - DNA, 27 bp, Artificial Sequence
  Description of Artificial Sequence: Synthetic oligonucleotide
ctgcgcggttactacaaccagagcgag

SEQ ID NO: 373116 - DNA, 27 bp, Artificial Sequence
  Description of Artificial Sequence: Synthetic oligonucleotide
tgcgcggttactacaaccagagcgagg

SEQ ID NO: 373117 - DNA, 26 bp, Artificial Sequence
  Description of Artificial Sequence: Synthetic oligonucleotide
gcgcggttactacaaccagagcgagg

SEQ ID NO: 373118 - DNA, 26 bp, Artificial Sequence
  Description of Artificial Sequence: Synthetic oligonucleotide
cgcggttactacaaccagagcgaggc

SEQ ID NO: 373119 - DNA, 26 bp, Artificial Sequence
  Description of Artificial Sequence: Synthetic oligonucleotide
gcggttactacaaccagagcgaggcc

SEQ ID NO: 373120 - DNA, 26 bp, Artificial Sequence
  Description of Artificial Sequence: Synthetic oligonucleotide
cggttactacaaccagagcgaggccg

SEQ ID NO: 373121 - DNA, 26 bp, Artificial Sequence
  Description of Artificial Sequence: Synthetic oligonucleotide
ggttactacaaccagagcgaggccgg

SEQ ID NO: 373122 - DNA, 27 bp, Artificial Sequence
  Description of Artificial Sequence: Synthetic oligonucleotide
gttactacaaccagagcgaggccgggt

SEQ ID NO: 373123 - DNA, 27 bp, Artificial Sequence
  Description of Artificial Sequence: Synthetic oligonucleotide
ttactacaaccagagcgaggccgggtc

SEQ ID NO: 373124 - DNA, 33 bp, Artificial Sequence; identical to SEQ ID NO: 25150
  Description of Artificial Sequence: Synthetic oligonucleotide

SEQ ID NO: 373125 - DNA, 32 bp, Artificial Sequence; identical to SEQ ID NO: 25151
  Description of Artificial Sequence: Synthetic oligonucleotide

SEQ ID NO: 373126 - DNA, 31 bp, Artificial Sequence; identical to SEQ ID NO: 25152
  Description of Artificial Sequence: Synthetic oligonucleotide

SEQ ID NO: 373127 - DNA, 31 bp, Artificial Sequence; identical to SEQ ID NO: 25153
  Description of Artificial Sequence: Synthetic oligonucleotide

SEQ ID NO: 373128 - DNA, 30 bp, Artificial Sequence; identical to SEQ ID NO: 25154
  Description of Artificial Sequence: Synthetic oligonucleotide

SEQ ID NO: 373129 - DNA, 29 bp, Artificial Sequence
  Description of Artificial Sequence: Synthetic oligonucleotide
gaccaacacacagactgaccgagagaacc

SEQ ID NO: 373130 - DNA, 30 bp, Artificial Sequence; identical to SEQ ID NO: 25156
  Description of Artificial Sequence: Synthetic oligonucleotide

SEQ ID NO: 373131 - DNA, 29 bp, Artificial Sequence
  Description of Artificial Sequence: Synthetic oligonucleotide
ccaacacacagactgaccgagagaacctg

SEQ ID NO: 373132 - DNA, 29 bp, Artificial Sequence
  Description of Artificial Sequence: Synthetic oligonucleotide
caacacacagactgaccgagagaacctgc

SEQ ID NO: 373133 - DNA, 29 bp, Artificial Sequence
  Description of Artificial Sequence: Synthetic oligonucleotide
aacacacagactgaccgagagaacctgcg

SEQ ID NO: 373134 - DNA, 28 bp, Artificial Sequence
  Description of Artificial Sequence: Synthetic oligonucleotide
acacacagactgaccgagagaacctgcg

SEQ ID NO: 373135 - DNA, 27 bp, Artificial Sequence
  Description of Artificial Sequence: Synthetic oligonucleotide
cacacagactgaccgagagaacctgcg

SEQ ID NO: 373136 - DNA, 27 bp, Artificial Sequence
  Description of Artificial Sequence: Synthetic oligonucleotide
acacagactgaccgagagaacctgcgc

SEQ ID NO: 373137 - DNA, 27 bp, Artificial Sequence
  Description of Artificial Sequence: Synthetic oligonucleotide
cacagactgaccgagagaacctgcgca

SEQ ID NO: 373138 - DNA, 27 bp, Artificial Sequence
  Description of Artificial Sequence: Synthetic oligonucleotide
acagactgaccgagagaacctgcgcac

SEQ ID NO: 373139 - DNA, 26 bp, Artificial Sequence
  Description of Artificial Sequence: Synthetic oligonucleotide
cagactgaccgagagaacctgcgcac

SEQ ID NO: 373140 - DNA, 26 bp, Artificial Sequence
  Description of Artificial Sequence: Synthetic oligonucleotide
agactgaccgagagaacctgcgcacc

SEQ ID NO: 373141 - DNA, 25 bp, Artificial Sequence
  Description of Artificial Sequence: Synthetic oligonucleotide
gactgaccgagagaacctgcgcacc

SEQ ID NO: 373142 - DNA, 25 bp, Artificial Sequence
  Description of Artificial Sequence: Synthetic oligonucleotide
actgaccgagagaacctgcgcaccg

SEQ ID NO: 373143 - DNA, 24 bp, Artificial Sequence
  Description of Artificial Sequence: Synthetic oligonucleotide
ctgaccgagagaacctgcgcaccg

SEQ ID NO: 373144 - DNA, 24 bp, Artificial Sequence
  Description of Artificial Sequence: Synthetic oligonucleotide
tgaccgagagaacctgcgcaccgc

SEQ ID NO: 373145 - DNA, 23 bp, Artificial Sequence
  Description of Artificial Sequence: Synthetic oligonucleotide
gaccgagagaacctgcgcaccgc

SEQ ID NO: 373146 - DNA, 23 bp, Artificial Sequence
  Description of Artificial Sequence: Synthetic oligonucleotide
accgagagaacctgcgcaccgcg

SEQ ID NO: 373147 - DNA, 22 bp, Artificial Sequence
  Description of Artificial Sequence: Synthetic oligonucleotide
ccgagagaacctgcgcaccgcg

SEQ ID NO: 373148 - DNA, 23 bp, Artificial Sequence
  Description of Artificial Sequence: Synthetic oligonucleotide
cgagagaacctgcgcaccgcgct

SEQ ID NO: 373149 - DNA, 23 bp, Artificial Sequence
  Description of Artificial Sequence: Synthetic oligonucleotide
gagagaacctgcgcaccgcgctc

SEQ ID NO: 373150 - DNA, 23 bp, Artificial Sequence
  Description of Artificial Sequence: Synthetic oligonucleotide
agagaacctgcgcaccgcgctcc

SEQ ID NO: 373151 - DNA, 22 bp, Artificial Sequence
  Description of Artificial Sequence: Synthetic oligonucleotide
gagaacctgcgcaccgcgctcc

SEQ ID NO: 373152 - DNA, 22 bp, Artificial Sequence
  Description of Artificial Sequence: Synthetic oligonucleotide
agaacctgcgcaccgcgctccg

SEQ ID NO: 373153 - DNA, 21 bp, Artificial Sequence
  Description of Artificial Sequence: Synthetic oligonucleotide
gaacctgcgcaccgcgctccg

SEQ ID NO: 373154 - DNA, 23 bp, Artificial Sequence
  Description of Artificial Sequence: Synthetic oligonucleotide
aacctgcgcaccgcgctccgcta

SEQ ID NO: 373155 - DNA, 22 bp, Artificial Sequence
  Description of Artificial Sequence: Synthetic oligonucleotide
acctgcgcaccgcgctccgcta

SEQ ID NO: 373156 - DNA, 21 bp, Artificial Sequence
  Description of Artificial Sequence: Synthetic oligonucleotide
cctgcgcaccgcgctccgcta

SEQ ID NO: 373157 - DNA, 23 bp, Artificial Sequence
  Description of Artificial Sequence: Synthetic oligonucleotide
ctgcgcaccgcgctccgctacta

SEQ ID NO: 373158 - DNA, 25 bp, Artificial Sequence
  Description of Artificial Sequence: Synthetic oligonucleotide
tgcgcaccgcgctccgctactacaa

SEQ ID NO: 373159 - DNA, 24 bp, Artificial Sequence
  Description of Artificial Sequence: Synthetic oligonucleotide
gcgcaccgcgctccgctactacaa

SEQ ID NO: 373160 - DNA, 24 bp, Artificial Sequence
  Description of Artificial Sequence: Synthetic oligonucleotide
cgcaccgcgctccgctactacaac

SEQ ID NO: 373161 - DNA, 25 bp, Artificial Sequence
  Description of Artificial Sequence: Synthetic oligonucleotide
gcaccgcgctccgctactacaacca

SEQ ID NO: 373162 - DNA, 26 bp, Artificial Sequence
  Description of Artificial Sequence: Synthetic oligonucleotide
caccgcgctccgctactacaaccaga

SEQ ID NO: 373163 - DNA, 26 bp, Artificial Sequence
  Description of Artificial Sequence: Synthetic oligonucleotide
accgcgctccgctactacaaccagag

SEQ ID NO: 373164 - DNA, 25 bp, Artificial Sequence
  Description of Artificial Sequence: Synthetic oligonucleotide
ccgcgctccgctactacaaccagag

SEQ ID NO: 373165 - DNA, 37 bp, Artificial Sequence; identical to SEQ ID NO: 23777
  Description of Artificial Sequence: Synthetic oligonucleotide

SEQ ID NO: 373166 - DNA, 37 bp, Artificial Sequence; identical to SEQ ID NO: 23778
  Description of Artificial Sequence: Synthetic oligonucleotide

SEQ ID NO: 373167 - DNA, 36 bp, Artificial Sequence; identical to SEQ ID NO: 23779
  Description of Artificial Sequence: Synthetic oligonucleotide

SEQ ID NO: 373168 - DNA, 35 bp, Artificial Sequence; identical to SEQ ID NO: 23780
  Description of Artificial Sequence: Synthetic oligonucleotide

SEQ ID NO: 373169 - DNA, 35 bp, Artificial Sequence; identical to SEQ ID NO: 23781
  Description of Artificial Sequence: Synthetic oligonucleotide

SEQ ID NO: 373170 - DNA, 34 bp, Artificial Sequence; identical to SEQ ID NO: 23782
  Description of Artificial Sequence: Synthetic oligonucleotide

SEQ ID NO: 373171 - DNA, 35 bp, Artificial Sequence; identical to SEQ ID NO: 23783
  Description of Artificial Sequence: Synthetic oligonucleotide

SEQ ID NO: 373172 - DNA, 34 bp, Artificial Sequence; identical to SEQ ID NO: 23784
  Description of Artificial Sequence: Synthetic oligonucleotide

SEQ ID NO: 373173 - DNA, 35 bp, Artificial Sequence; identical to SEQ ID NO: 23785
  Description of Artificial Sequence: Synthetic oligonucleotide

SEQ ID NO: 373174 - DNA, 34 bp, Artificial Sequence; identical to SEQ ID NO: 23786
  Description of Artificial Sequence: Synthetic oligonucleotide

SEQ ID NO: 373175 - DNA, 36 bp, Artificial Sequence; identical to SEQ ID NO: 23787
  Description of Artificial Sequence: Synthetic oligonucleotide

SEQ ID NO: 373176 - DNA, 35 bp, Artificial Sequence; identical to SEQ ID NO: 23788
  Description of Artificial Sequence: Synthetic oligonucleotide

SEQ ID NO: 373177 - DNA, 34 bp, Artificial Sequence; identical to SEQ ID NO: 23789
  Description of Artificial Sequence: Synthetic oligonucleotide

SEQ ID NO: 373178 - DNA, 34 bp, Artificial Sequence; identical to SEQ ID NO: 23790
  Description of Artificial Sequence: Synthetic oligonucleotide

SEQ ID NO: 373179 - DNA, 33 bp, Artificial Sequence; identical to SEQ ID NO: 23791
  Description of Artificial Sequence: Synthetic oligonucleotide

SEQ ID NO: 373180 - DNA, 32 bp, Artificial Sequence; identical to SEQ ID NO: 23792
  Description of Artificial Sequence: Synthetic oligonucleotide

SEQ ID NO: 373181 - DNA, 33 bp, Artificial Sequence; identical to SEQ ID NO: 23793
  Description of Artificial Sequence: Synthetic oligonucleotide

SEQ ID NO: 373182 - DNA, 32 bp, Artificial Sequence; identical to SEQ ID NO: 23794
  Description of Artificial Sequence: Synthetic oligonucleotide

SEQ ID NO: 373183 - DNA, 31 bp, Artificial Sequence; identical to SEQ ID NO: 23795
  Description of Artificial Sequence: Synthetic oligonucleotide

SEQ ID NO: 373184 - DNA, 31 bp, Artificial Sequence; identical to SEQ ID NO: 23796
  Description of Artificial Sequence: Synthetic oligonucleotide

SEQ ID NO: 373185 - DNA, 30 bp, Artificial Sequence; identical to SEQ ID NO: 23797
  Description of Artificial Sequence: Synthetic oligonucleotide

SEQ ID NO: 373186 - DNA, 30 bp, Artificial Sequence; identical to SEQ ID NO: 23798
  Description of Artificial Sequence: Synthetic oligonucleotide

SEQ ID NO: 373187 - DNA, 30 bp, Artificial Sequence; identical to SEQ ID NO: 23799
  Description of Artificial Sequence: Synthetic oligonucleotide

SEQ ID NO: 373188 - DNA, 29 bp, Artificial Sequence
  Description of Artificial Sequence: Synthetic oligonucleotide
acacacagacttaccgagagaacctgcgg

SEQ ID NO: 373189 - DNA, 28 bp, Artificial Sequence
  Description of Artificial Sequence: Synthetic oligonucleotide
cacacagacttaccgagagaacctgcgg

SEQ ID NO: 373190 - DNA, 30 bp, Artificial Sequence; identical to SEQ ID NO: 23802
  Description of Artificial Sequence: Synthetic oligonucleotide

SEQ ID NO: 373191 - DNA, 29 bp, Artificial Sequence
  Description of Artificial Sequence: Synthetic oligonucleotide
cacagacttaccgagagaacctgcggatc

SEQ ID NO: 373192 - DNA, 29 bp, Artificial Sequence
  Description of Artificial Sequence: Synthetic oligonucleotide
acagacttaccgagagaacctgcggatcg

SEQ ID NO: 373193 - DNA, 28 bp, Artificial Sequence
  Description of Artificial Sequence: Synthetic oligonucleotide
cagacttaccgagagaacctgcggatcg

SEQ ID NO: 373194 - DNA, 28 bp, Artificial Sequence
  Description of Artificial Sequence: Synthetic oligonucleotide
agacttaccgagagaacctgcggatcgc

SEQ ID NO: 373195 - DNA, 27 bp, Artificial Sequence
  Description of Artificial Sequence: Synthetic oligonucleotide
gacttaccgagagaacctgcggatcgc

SEQ ID NO: 373196 - DNA, 27 bp, Artificial Sequence
  Description of Artificial Sequence: Synthetic oligonucleotide
acttaccgagagaacctgcggatcgcg

SEQ ID NO: 373197 - DNA, 26 bp, Artificial Sequence
  Description of Artificial Sequence: Synthetic oligonucleotide
cttaccgagagaacctgcggatcgcg

SEQ ID NO: 373198 - DNA, 27 bp, Artificial Sequence
  Description of Artificial Sequence: Synthetic oligonucleotide
ttaccgagagaacctgcggatcgcgct

SEQ ID NO: 373199 - DNA, 26 bp, Artificial Sequence
  Description of Artificial Sequence: Synthetic oligonucleotide
taccgagagaacctgcggatcgcgct

SEQ ID NO: 373200 - DNA, 30 bp, Artificial Sequence; identical to SEQ ID NO: 23622
  Description of Artificial Sequence: Synthetic oligonucleotide

SEQ ID NO: 373201 - DNA, 30 bp, Artificial Sequence; identical to SEQ ID NO: 23623
  Description of Artificial Sequence: Synthetic oligonucleotide

SEQ ID NO: 373202 - DNA, 32 bp, Artificial Sequence; identical to SEQ ID NO: 23624
  Description of Artificial Sequence: Synthetic oligonucleotide

SEQ ID NO: 373203 - DNA, 31 bp, Artificial Sequence; identical to SEQ ID NO: 23625
  Description of Artificial Sequence: Synthetic oligonucleotide

SEQ ID NO: 373204 - DNA, 32 bp, Artificial Sequence; identical to SEQ ID NO: 23626
  Description of Artificial Sequence: Synthetic oligonucleotide

SEQ ID NO: 373205 - DNA, 31 bp, Artificial Sequence; identical to SEQ ID NO: 23627
  Description of Artificial Sequence: Synthetic oligonucleotide

SEQ ID NO: 373206 - DNA, 30 bp, Artificial Sequence; identical to SEQ ID NO: 23628
  Description of Artificial Sequence: Synthetic oligonucleotide

SEQ ID NO: 373207 - DNA, 29 bp, Artificial Sequence
  Description of Artificial Sequence: Synthetic oligonucleotide
tgggaccggaacacacagatctccaagac

SEQ ID NO: 373208 - DNA, 28 bp, Artificial Sequence
  Description of Artificial Sequence: Synthetic oligonucleotide
gggaccggaacacacagatctccaagac

SEQ ID NO: 373209 - DNA, 28 bp, Artificial Sequence
  Description of Artificial Sequence: Synthetic oligonucleotide
ggaccggaacacacagatctccaagacc

SEQ ID NO: 373210 - DNA, 30 bp, Artificial Sequence; identical to SEQ ID NO: 23632
  Description of Artificial Sequence: Synthetic oligonucleotide

SEQ ID NO: 373211 - DNA, 31 bp, Artificial Sequence; identical to SEQ ID NO: 23633
  Description of Artificial Sequence: Synthetic oligonucleotide

SEQ ID NO: 373212 - DNA, 30 bp, Artificial Sequence; identical to SEQ ID NO: 23634
  Description of Artificial Sequence: Synthetic oligonucleotide

SEQ ID NO: 373213 - DNA, 31 bp, Artificial Sequence; identical to SEQ ID NO: 23635
  Description of Artificial Sequence: Synthetic oligonucleotide

SEQ ID NO: 373214 - DNA, 32 bp, Artificial Sequence; identical to SEQ ID NO: 23636
  Description of Artificial Sequence: Synthetic oligonucleotide

SEQ ID NO: 373215 - DNA, 33 bp, Artificial Sequence; identical to SEQ ID NO: 23637
  Description of Artificial Sequence: Synthetic oligonucleotide

SEQ ID NO: 373216 - DNA, 34 bp, Artificial Sequence; identical to SEQ ID NO: 25191
  Description of Artificial Sequence: Synthetic oligonucleotide

SEQ ID NO: 373217 - DNA, 33 bp, Artificial Sequence; identical to SEQ ID NO: 25192
  Description of Artificial Sequence: Synthetic oligonucleotide

SEQ ID NO: 373218 - DNA, 32 bp, Artificial Sequence; identical to SEQ ID NO: 25193
  Description of Artificial Sequence: Synthetic oligonucleotide

SEQ ID NO: 373219 - DNA, 33 bp, Artificial Sequence; identical to SEQ ID NO: 25194
  Description of Artificial Sequence: Synthetic oligonucleotide

SEQ ID NO: 373220 - DNA, 32 bp, Artificial Sequence; identical to SEQ ID NO: 25195
  Description of Artificial Sequence: Synthetic oligonucleotide

SEQ ID NO: 373221 - DNA, 32 bp, Artificial Sequence; identical to SEQ ID NO: 25196
  Description of Artificial Sequence: Synthetic oligonucleotide

SEQ ID NO: 373222 - DNA, 31 bp, Artificial Sequence; identical to SEQ ID NO: 25197
  Description of Artificial Sequence: Synthetic oligonucleotide

SEQ ID NO: 373223 - DNA, 31 bp, Artificial Sequence; identical to SEQ ID NO: 25198
  Description of Artificial Sequence: Synthetic oligonucleotide

SEQ ID NO: 373224 - DNA, 30 bp, Artificial Sequence; identical to SEQ ID NO: 25199
  Description of Artificial Sequence: Synthetic oligonucleotide

SEQ ID NO: 373225 - DNA, 31 bp, Artificial Sequence; identical to SEQ ID NO: 25200
  Description of Artificial Sequence: Synthetic oligonucleotide

SEQ ID NO: 373226 - DNA, 30 bp, Artificial Sequence; identical to SEQ ID NO: 25201
  Description of Artificial Sequence: Synthetic oligonucleotide

SEQ ID NO: 373227 - DNA, 29 bp, Artificial Sequence
  Description of Artificial Sequence: Synthetic oligonucleotide
ctccaagaccaacacacagactgaccgag

SEQ ID NO: 373228 - DNA, 30 bp, Artificial Sequence; identical to SEQ ID NO: 25203
  Description of Artificial Sequence: Synthetic oligonucleotide

SEQ ID NO: 373229 - DNA, 29 bp, Artificial Sequence
  Description of Artificial Sequence: Synthetic oligonucleotide
ccaagaccaacacacagactgaccgagag

SEQ ID NO: 373230 - DNA, 28 bp, Artificial Sequence
  Description of Artificial Sequence: Synthetic oligonucleotide
cggagtattgggaccggaacacacagac

SEQ ID NO: 373231 - DNA, 28 bp, Artificial Sequence
  Description of Artificial Sequence: Synthetic oligonucleotide
ggagtattgggaccggaacacacagacc

SEQ ID NO: 373232 - DNA, 30 bp, Artificial Sequence; identical to SEQ ID NO: 25207
  Description of Artificial Sequence: Synthetic oligonucleotide

SEQ ID NO: 373233 - DNA, 32 bp, Artificial Sequence; identical to SEQ ID NO: 25208
  Description of Artificial Sequence: Synthetic oligonucleotide

SEQ ID NO: 373234 - DNA, 31 bp, Artificial Sequence; identical to SEQ ID NO: 25209
  Description of Artificial Sequence: Synthetic oligonucleotide

SEQ ID NO: 373235 - DNA, 32 bp, Artificial Sequence; identical to SEQ ID NO: 25210
  Description of Artificial Sequence: Synthetic oligonucleotide

SEQ ID NO: 373236 - DNA, 31 bp, Artificial Sequence; identical to SEQ ID NO: 25211
  Description of Artificial Sequence: Synthetic oligonucleotide

SEQ ID NO: 373237 - DNA, 30 bp, Artificial Sequence; identical to SEQ ID NO: 25212
  Description of Artificial Sequence: Synthetic oligonucleotide

SEQ ID NO: 373238 - DNA, 29 bp, Artificial Sequence
  Description of Artificial Sequence: Synthetic oligonucleotide
tgggaccggaacacacagaccttcaagac

SEQ ID NO: 373239 - DNA, 28 bp, Artificial Sequence
  Description of Artificial Sequence: Synthetic oligonucleotide
gggaccggaacacacagaccttcaagac

SEQ ID NO: 373240 - DNA, 28 bp, Artificial Sequence
  Description of Artificial Sequence: Synthetic oligonucleotide
ggaccggaacacacagaccttcaagacc

SEQ ID NO: 373241 - DNA, 30 bp, Artificial Sequence; identical to SEQ ID NO: 25216
  Description of Artificial Sequence: Synthetic oligonucleotide

SEQ ID NO: 373242 - DNA, 31 bp, Artificial Sequence; identical to SEQ ID NO: 25217
  Description of Artificial Sequence: Synthetic oligonucleotide

SEQ ID NO: 373243 - DNA, 30 bp, Artificial Sequence; identical to SEQ ID NO: 25218
  Description of Artificial Sequence: Synthetic oligonucleotide

SEQ ID NO: 373244 - DNA, 31 bp, Artificial Sequence; identical to SEQ ID NO: 25219
  Description of Artificial Sequence: Synthetic oligonucleotide

SEQ ID NO: 373245 - DNA, 32 bp, Artificial Sequence; identical to SEQ ID NO: 25220
  Description of Artificial Sequence: Synthetic oligonucleotide

SEQ ID NO: 373246 - DNA, 33 bp, Artificial Sequence; identical to SEQ ID NO: 25221
  Description of Artificial Sequence: Synthetic oligonucleotide

SEQ ID NO: 373247 - DNA, 34 bp, Artificial Sequence; identical to SEQ ID NO: 25222
  Description of Artificial Sequence: Synthetic oligonucleotide

SEQ ID NO: 373248 - DNA, 33 bp, Artificial Sequence; identical to SEQ ID NO: 25223
  Description of Artificial Sequence: Synthetic oligonucleotide

SEQ ID NO: 373249 - DNA, 32 bp, Artificial Sequence; identical to SEQ ID NO: 25224
  Description of Artificial Sequence: Synthetic oligonucleotide

SEQ ID NO: 373250 - DNA, 33 bp, Artificial Sequence; identical to SEQ ID NO: 25225
  Description of Artificial Sequence: Synthetic oligonucleotide

SEQ ID NO: 373251 - DNA, 32 bp, Artificial Sequence; identical to SEQ ID NO: 25226
  Description of Artificial Sequence: Synthetic oligonucleotide

SEQ ID NO: 373252 - DNA, 32 bp, Artificial Sequence; identical to SEQ ID NO: 25227
  Description of Artificial Sequence: Synthetic oligonucleotide

SEQ ID NO: 373253 - DNA, 31 bp, Artificial Sequence; identical to SEQ ID NO: 25228
  Description of Artificial Sequence: Synthetic oligonucleotide

SEQ ID NO: 373254 - DNA, 31 bp, Artificial Sequence; identical to SEQ ID NO: 25229
  Description of Artificial Sequence: Synthetic oligonucleotide

SEQ ID NO: 373255 - DNA, 30 bp, Artificial Sequence; identical to SEQ ID NO: 25230
  Description of Artificial Sequence: Synthetic oligonucleotide

SEQ ID NO: 373256 - DNA, 31 bp, Artificial Sequence; identical to SEQ ID NO: 25231
  Description of Artificial Sequence: Synthetic oligonucleotide

SEQ ID NO: 373257 - DNA, 30 bp, Artificial Sequence; identical to SEQ ID NO: 25232
  Description of Artificial Sequence: Synthetic oligonucleotide

SEQ ID NO: 373258 - DNA, 28 bp, Artificial Sequence
  Description of Artificial Sequence: Synthetic oligonucleotide
gggtctcacaccctccagaggatgtatg

SEQ ID NO: 373259 - DNA, 28 bp, Artificial Sequence
  Description of Artificial Sequence: Synthetic oligonucleotide
ggtctcacaccctccagaggatgtatgg

SEQ ID NO: 373260 - DNA, 28 bp, Artificial Sequence
  Description of Artificial Sequence: Synthetic oligonucleotide
gtctcacaccctccagaggatgtatggc

SEQ ID NO: 373261 - DNA, 25 bp, Artificial Sequence
  Description of Artificial Sequence: Synthetic oligonucleotide
gctctcagggtctcaggctccgaga

SEQ ID NO: 373262 - DNA, 25 bp, Artificial Sequence
  Description of Artificial Sequence: Synthetic oligonucleotide
ctctcagggtctcaggctccgagag

SEQ ID NO: 373263 - DNA, 25 bp, Artificial Sequence
  Description of Artificial Sequence: Synthetic oligonucleotide
tctcagggtctcaggctccgagagc

SEQ ID NO: 373264 - DNA, 24 bp, Artificial Sequence
  Description of Artificial Sequence: Synthetic oligonucleotide
ctcagggtctcaggctccgagagc

SEQ ID NO: 373265 - DNA, 26 bp, Artificial Sequence
  Description of Artificial Sequence: Synthetic oligonucleotide
tcagggtctcaggctccgagagcctt

SEQ ID NO: 373266 - DNA, 25 bp, Artificial Sequence
  Description of Artificial Sequence: Synthetic oligonucleotide
cagggtctcaggctccgagagcctt

SEQ ID NO: 373267 - DNA, 26 bp, Artificial Sequence
  Description of Artificial Sequence: Synthetic oligonucleotide
agggtctcaggctccgagagccttgt

SEQ ID NO: 373268 - DNA, 25 bp, Artificial Sequence
  Description of Artificial Sequence: Synthetic oligonucleotide
gggtctcaggctccgagagccttgt

SEQ ID NO: 373269 - DNA, 26 bp, Artificial Sequence
  Description of Artificial Sequence: Synthetic oligonucleotide
ggtctcaggctccgagagccttgtct

SEQ ID NO: 373270 - DNA, 26 bp, Artificial Sequence
  Description of Artificial Sequence: Synthetic oligonucleotide
gtctcaggctccgagagccttgtctg

SEQ ID NO: 373271 - DNA, 27 bp, Artificial Sequence
  Description of Artificial Sequence: Synthetic oligonucleotide
tctcaggctccgagagccttgtctgca

SEQ ID NO: 373272 - DNA, 27 bp, Artificial Sequence
  Description of Artificial Sequence: Synthetic oligonucleotide
ctcaggctccgagagccttgtctgcat

SEQ ID NO: 373273 - DNA, 28 bp, Artificial Sequence
  Description of Artificial Sequence: Synthetic oligonucleotide
tcaggctccgagagccttgtctgcattg

SEQ ID NO: 373274 - DNA, 27 bp, Artificial Sequence
  Description of Artificial Sequence: Synthetic oligonucleotide
caggctccgagagccttgtctgcattg

SEQ ID NO: 373275 - DNA, 27 bp, Artificial Sequence
  Description of Artificial Sequence: Synthetic oligonucleotide
aggctccgagagccttgtctgcattgg

SEQ ID NO: 373276 - DNA, 26 bp, Artificial Sequence
  Description of Artificial Sequence: Synthetic oligonucleotide
ggctccgagagccttgtctgcattgg

SEQ ID NO: 373277 - DNA, 26 bp, Artificial Sequence
  Description of Artificial Sequence: Synthetic oligonucleotide
gctccgagagccttgtctgcattggg

SEQ ID NO: 373278 - DNA, 27 bp, Artificial Sequence
  Description of Artificial Sequence: Synthetic oligonucleotide
ctccgagagccttgtctgcattgggga

SEQ ID NO: 373279 - DNA, 27 bp, Artificial Sequence
  Description of Artificial Sequence: Synthetic oligonucleotide
tccgagagccttgtctgcattggggag

SEQ ID NO: 373280 - DNA, 26 bp, Artificial Sequence
  Description of Artificial Sequence: Synthetic oligonucleotide
ccgagagccttgtctgcattggggag

SEQ ID NO: 373281 - DNA, 26 bp, Artificial Sequence
  Description of Artificial Sequence: Synthetic oligonucleotide
cgagagccttgtctgcattggggagg

SEQ ID NO: 373282 - DNA, 26 bp, Artificial Sequence
  Description of Artificial Sequence: Synthetic oligonucleotide
gagagccttgtctgcattggggaggc

SEQ ID NO: 373283 - DNA, 26 bp, Artificial Sequence
  Description of Artificial Sequence: Synthetic oligonucleotide
agagccttgtctgcattggggaggcg

SEQ ID NO: 373284 - DNA, 25 bp, Artificial Sequence
  Description of Artificial Sequence: Synthetic oligonucleotide
gagccttgtctgcattggggaggcg

SEQ ID NO: 373285 - DNA, 26 bp, Artificial Sequence
  Description of Artificial Sequence: Synthetic oligonucleotide
agccttgtctgcattggggaggcgca

SEQ ID NO: 373286 - DNA, 25 bp, Artificial Sequence
  Description of Artificial Sequence: Synthetic oligonucleotide
gccttgtctgcattggggaggcgca

SEQ ID NO: 373287 - DNA, 25 bp, Artificial Sequence
  Description of Artificial Sequence: Synthetic oligonucleotide
ccttgtctgcattggggaggcgcag

SEQ ID NO: 373288 - DNA, 25 bp, Artificial Sequence
  Description of Artificial Sequence: Synthetic oligonucleotide
cttgtctgcattggggaggcgcagc

SEQ ID NO: 373289 - DNA, 27 bp, Artificial Sequence
  Description of Artificial Sequence: Synthetic oligonucleotide
ttgtctgcattggggaggcgcagcgtt

SEQ ID NO: 373290 - DNA, 26 bp, Artificial Sequence
  Description of Artificial Sequence: Synthetic oligonucleotide
tgtctgcattggggaggcgcagcgtt

SEQ ID NO: 373291 - DNA, 25 bp, Artificial Sequence
  Description of Artificial Sequence: Synthetic oligonucleotide
gtctgcattggggaggcgcagcgtt

SEQ ID NO: 373292 - DNA, 25 bp, Artificial Sequence
  Description of Artificial Sequence: Synthetic oligonucleotide
tctgcattggggaggcgcagcgttg

SEQ ID NO: 373293 - DNA, 24 bp, Artificial Sequence
  Description of Artificial Sequence: Synthetic oligonucleotide
ctgcattggggaggcgcagcgttg

SEQ ID NO: 373294 - DNA, 24 bp, Artificial Sequence
  Description of Artificial Sequence: Synthetic oligonucleotide
tgcattggggaggcgcagcgttgg

SEQ ID NO: 373295 - DNA, 23 bp, Artificial Sequence
  Description of Artificial Sequence: Synthetic oligonucleotide
gcattggggaggcgcagcgttgg

SEQ ID NO: 373296 - DNA, 23 bp, Artificial Sequence
  Description of Artificial Sequence: Synthetic oligonucleotide
cattggggaggcgcagcgttggg

SEQ ID NO: 373297 - DNA, 26 bp, Artificial Sequence
  Description of Artificial Sequence: Synthetic oligonucleotide
attggggaggcgcagcgttggggatt

SEQ ID NO: 373298 - DNA, 25 bp, Artificial Sequence
  Description of Artificial Sequence: Synthetic oligonucleotide
ttggggaggcgcagcgttggggatt

SEQ ID NO: 373299 - DNA, 25 bp, Artificial Sequence
  Description of Artificial Sequence: Synthetic oligonucleotide
cagcgttggggattccccactccca

SEQ ID NO: 373300 - DNA, 25 bp, Artificial Sequence
  Description of Artificial Sequence: Synthetic oligonucleotide
agcgttggggattccccactcccac

SEQ ID NO: 373301 - DNA, 24 bp, Artificial Sequence
  Description of Artificial Sequence: Synthetic oligonucleotide
gcgttggggattccccactcccac

SEQ ID NO: 373302 - DNA, 25 bp, Artificial Sequence
  Description of Artificial Sequence: Synthetic oligonucleotide
cgttggggattccccactcccacga

SEQ ID NO: 373303 - DNA, 27 bp, Artificial Sequence
  Description of Artificial Sequence: Synthetic oligonucleotide
gttggggattccccactcccacgagtt

SEQ ID NO: 373304 - DNA, 28 bp, Artificial Sequence
  Description of Artificial Sequence: Synthetic oligonucleotide
ttggggattccccactcccacgagtttc

SEQ ID NO: 373305 - DNA, 27 bp, Artificial Sequence
  Description of Artificial Sequence: Synthetic oligonucleotide
tggggattccccactcccacgagtttc

SEQ ID NO: 373306 - DNA, 27 bp, Artificial Sequence
  Description of Artificial Sequence: Synthetic oligonucleotide
ggggattccccactcccacgagtttca

SEQ ID NO: 373307 - DNA, 27 bp, Artificial Sequence
  Description of Artificial Sequence: Synthetic oligonucleotide
gggattccccactcccacgagtttcac

SEQ ID NO: 373308 - DNA, 29 bp, Artificial Sequence
  Description of Artificial Sequence: Synthetic oligonucleotide
ggattccccactcccacgagtttcacttc

SEQ ID NO: 373309 - DNA, 31 bp, Artificial Sequence
  Description of Artificial Sequence: Synthetic oligonucleotide
gattccccactcccacgagtttcacttcttc

SEQ ID NO: 373310 - DNA, 32 bp, Artificial Sequence
  Description of Artificial Sequence: Synthetic oligonucleotide
attccccactcccacgagtttcacttcttctc

SEQ ID NO: 373311 - DNA, 31 bp, Artificial Sequence
  Description of Artificial Sequence: Synthetic oligonucleotide
ttccccactcccacgagtttcacttcttctc

SEQ ID NO: 373312 - DNA, 30 bp, Artificial Sequence
  Description of Artificial Sequence: Synthetic oligonucleotide
tccccactcccacgagtttcacttcttctc

SEQ ID NO: 373313 - DNA, 29 bp, Artificial Sequence
  Description of Artificial Sequence: Synthetic oligonucleotide
ccccactcccacgagtttcacttcttctc

SEQ ID NO: 373314 - DNA, 29 bp, Artificial Sequence
  Description of Artificial Sequence: Synthetic oligonucleotide
cccactcccacgagtttcacttcttctcc

SEQ ID NO: 373315 - DNA, 29 bp, Artificial Sequence
  Description of Artificial Sequence: Synthetic oligonucleotide
ccactcccacgagtttcacttcttctccc

SEQ ID NO: 373316 - DNA, 31 bp, Artificial Sequence
  Description of Artificial Sequence: Synthetic oligonucleotide
cactcccacgagtttcacttcttctcccaac

SEQ ID NO: 373317 - DNA, 31 bp, Artificial Sequence
  Description of Artificial Sequence: Synthetic oligonucleotide
actcccacgagtttcacttcttctcccaacc

SEQ ID NO: 373318 - DNA, 30 bp, Artificial Sequence
  Description of Artificial Sequence: Synthetic oligonucleotide
ctcccacgagtttcacttcttctcccaacc

SEQ ID NO: 373319 - DNA, 33 bp, Artificial Sequence
  Description of Artificial Sequence: Synthetic oligonucleotide
tcccacgagtttcacttcttctcccaacctatg

SEQ ID NO: 373320 - DNA, 32 bp, Artificial Sequence
  Description of Artificial Sequence: Synthetic oligonucleotide
cccacgagtttcacttcttctcccaacctatg

SEQ ID NO: 373321 - DNA, 33 bp, Artificial Sequence
  Description of Artificial Sequence: Synthetic oligonucleotide
ccacgagtttcacttcttctcccaacctatgtc

SEQ ID NO: 373322 - DNA, 33 bp, Artificial Sequence
  Description of Artificial Sequence: Synthetic oligonucleotide
cacgagtttcacttcttctcccaacctatgtcg

SEQ ID NO: 373323 - DNA, 33 bp, Artificial Sequence
  Description of Artificial Sequence: Synthetic oligonucleotide
acgagtttcacttcttctcccaacctatgtcgg

SEQ ID NO: 373324 - DNA, 32 bp, Artificial Sequence
  Description of Artificial Sequence: Synthetic oligonucleotide
cgagtttcacttcttctcccaacctatgtcgg

SEQ ID NO: 373325 - DNA, 32 bp, Artificial Sequence
  Description of Artificial Sequence: Synthetic oligonucleotide
gagtttcacttcttctcccaacctatgtcggg

SEQ ID NO: 373326 - DNA, 33 bp, Artificial Sequence
  Description of Artificial Sequence: Synthetic oligonucleotide
agtttcacttcttctcccaacctatgtcgggtc

SEQ ID NO: 373327 - DNA, 32 bp, Artificial Sequence
  Description of Artificial Sequence: Synthetic oligonucleotide
gtttcacttcttctcccaacctatgtcgggtc

SEQ ID NO: 373328 - DNA, 32 bp, Artificial Sequence
  Description of Artificial Sequence: Synthetic oligonucleotide
tttcacttcttctcccaacctatgtcgggtcc

SEQ ID NO: 373329 - DNA, 31 bp, Artificial Sequence
  Description of Artificial Sequence: Synthetic oligonucleotide
ttcacttcttctcccaacctatgtcgggtcc

SEQ ID NO: 373330 - DNA, 30 bp, Artificial Sequence
  Description of Artificial Sequence: Synthetic oligonucleotide
tcacttcttctcccaacctatgtcgggtcc

SEQ ID NO: 373331 - DNA, 29 bp, Artificial Sequence
  Description of Artificial Sequence: Synthetic oligonucleotide
cacttcttctcccaacctatgtcgggtcc

SEQ ID NO: 373332 - DNA, 31 bp, Artificial Sequence
  Description of Artificial Sequence: Synthetic oligonucleotide
acttcttctcccaacctatgtcgggtccttc

SEQ ID NO: 373333 - DNA, 30 bp, Artificial Sequence
  Description of Artificial Sequence: Synthetic oligonucleotide
cttcttctcccaacctatgtcgggtccttc

SEQ ID NO: 373334 - DNA, 32 bp, Artificial Sequence
  Description of Artificial Sequence: Synthetic oligonucleotide
ttcttctcccaacctatgtcgggtccttcttc

SEQ ID NO: 373335 - DNA, 31 bp, Artificial Sequence
  Description of Artificial Sequence: Synthetic oligonucleotide
tcttctcccaacctatgtcgggtccttcttc

SEQ ID NO: 373336 - DNA, 30 bp, Artificial Sequence
  Description of Artificial Sequence: Synthetic oligonucleotide
cttctcccaacctatgtcgggtccttcttc

SEQ ID NO: 373337 - DNA, 30 bp, Artificial Sequence
  Description of Artificial Sequence: Synthetic oligonucleotide
ttctcccaacctatgtcgggtccttcttcc

SEQ ID NO: 373338 - DNA, 29 bp, Artificial Sequence
  Description of Artificial Sequence: Synthetic oligonucleotide
tctcccaacctatgtcgggtccttcttcc

SEQ ID NO: 373339 - DNA, 28 bp, Artificial Sequence
  Description of Artificial Sequence: Synthetic oligonucleotide
ctcccaacctatgtcgggtccttcttcc

SEQ ID NO: 373340 - DNA, 29 bp, Artificial Sequence
  Description of Artificial Sequence: Synthetic oligonucleotide
tcccaacctatgtcgggtccttcttccag

SEQ ID NO: 373341 - DNA, 28 bp, Artificial Sequence
  Description of Artificial Sequence: Synthetic oligonucleotide
cccaacctatgtcgggtccttcttccag

SEQ ID NO: 373342 - DNA, 28 bp, Artificial Sequence
  Description of Artificial Sequence: Synthetic oligonucleotide
ccaacctatgtcgggtccttcttccagg

SEQ ID NO: 373343 - DNA, 31 bp, Artificial Sequence
  Description of Artificial Sequence: Synthetic oligonucleotide
caacctatgtcgggtccttcttccaggatac

SEQ ID NO: 373344 - DNA, 32 bp, Artificial Sequence
  Description of Artificial Sequence: Synthetic oligonucleotide
aacctatgtcgggtccttcttccaggatactc

SEQ ID NO: 373345 - DNA, 31 bp, Artificial Sequence
  Description of Artificial Sequence: Synthetic oligonucleotide
acctatgtcgggtccttcttccaggatactc

SEQ ID NO: 373346 - DNA, 30 bp, Artificial Sequence
  Description of Artificial Sequence: Synthetic oligonucleotide
cctatgtcgggtccttcttccaggatactc

SEQ ID NO: 373347 - DNA, 30 bp, Artificial Sequence
  Description of Artificial Sequence: Synthetic oligonucleotide
ctatgtcgggtccttcttccaggatactcg

SEQ ID NO: 373348 - DNA, 31 bp, Artificial Sequence
  Description of Artificial Sequence: Synthetic oligonucleotide
tatgtcgggtccttcttccaggatactcgtg

SEQ ID NO: 373349 - DNA, 30 bp, Artificial Sequence
  Description of Artificial Sequence: Synthetic oligonucleotide
atgtcgggtccttcttccaggatactcgtg

SEQ ID NO: 373350 - DNA, 27 bp, Artificial Sequence
  Description of Artificial Sequence: Synthetic oligonucleotide
tccaggatactcgtgacgcgtccccaa

SEQ ID NO: 373351 - DNA, 27 bp, Artificial Sequence
  Description of Artificial Sequence: Synthetic oligonucleotide
ccaggatactcgtgacgcgtccccaat

SEQ ID NO: 373352 - DNA, 28 bp, Artificial Sequence
  Description of Artificial Sequence: Synthetic oligonucleotide
caggatactcgtgacgcgtccccaattc

SEQ ID NO: 373353 - DNA, 28 bp, Artificial Sequence
  Description of Artificial Sequence: Synthetic oligonucleotide
aggatactcgtgacgcgtccccaattcc

SEQ ID NO: 373354 - DNA, 27 bp, Artificial Sequence
  Description of Artificial Sequence: Synthetic oligonucleotide
ggatactcgtgacgcgtccccaattcc

SEQ ID NO: 373355 - DNA, 27 bp, Artificial Sequence
  Description of Artificial Sequence: Synthetic oligonucleotide
gatactcgtgacgcgtccccaattccc

SEQ ID NO: 373356 - DNA, 28 bp, Artificial Sequence
  Description of Artificial Sequence: Synthetic oligonucleotide
atactcgtgacgcgtccccaattcccac

SEQ ID NO: 373357 - DNA, 27 bp, Artificial Sequence
  Description of Artificial Sequence: Synthetic oligonucleotide
tactcgtgacgcgtccccaattcccac

SEQ ID NO: 373358 - DNA, 27 bp, Artificial Sequence
  Description of Artificial Sequence: Synthetic oligonucleotide
actcgtgacgcgtccccaattcccact

SEQ ID NO: 373359 - DNA, 26 bp, Artificial Sequence
  Description of Artificial Sequence: Synthetic oligonucleotide
ctcgtgacgcgtccccaattcccact

SEQ ID NO: 373360 - DNA, 26 bp, Artificial Sequence
  Description of Artificial Sequence: Synthetic oligonucleotide
tcgtgacgcgtccccaattcccactc

SEQ ID NO: 373361 - DNA, 25 bp, Artificial Sequence
  Description of Artificial Sequence: Synthetic oligonucleotide
cgtgacgcgtccccaattcccactc

SEQ ID NO: 373362 - DNA, 25 bp, Artificial Sequence
  Description of Artificial Sequence: Synthetic oligonucleotide
gtgacgcgtccccaattcccactcc

SEQ ID NO: 373363 - DNA, 27 bp, Artificial Sequence
  Description of Artificial Sequence: Synthetic oligonucleotide
tgacgcgtccccaattcccactcccat

SEQ ID NO: 373364 - DNA, 27 bp, Artificial Sequence
  Description of Artificial Sequence: Synthetic oligonucleotide
gacgcgtccccaattcccactcccatt

SEQ ID NO: 373365 - DNA, 27 bp, Artificial Sequence
  Description of Artificial Sequence: Synthetic oligonucleotide
acgcgtccccaattcccactcccattg

SEQ ID NO: 373366 - DNA, 26 bp, Artificial Sequence
  Description of Artificial Sequence: Synthetic oligonucleotide
cgcgtccccaattcccactcccattg

SEQ ID NO: 373367 - DNA, 26 bp, Artificial Sequence
  Description of Artificial Sequence: Synthetic oligonucleotide
gcgtccccaattcccactcccattgg

SEQ ID NO: 373368 - DNA, 27 bp, Artificial Sequence
  Description of Artificial Sequence: Synthetic oligonucleotide
cgtccccaattcccactcccattgggt

SEQ ID NO: 373369 - DNA, 27 bp, Artificial Sequence
  Description of Artificial Sequence: Synthetic oligonucleotide
gtccccaattcccactcccattgggtg

SEQ ID NO: 373370 - DNA, 28 bp, Artificial Sequence
  Description of Artificial Sequence: Synthetic oligonucleotide
tccccaattcccactcccattgggtgtc

SEQ ID NO: 373371 - DNA, 27 bp, Artificial Sequence
  Description of Artificial Sequence: Synthetic oligonucleotide
ccccaattcccactcccattgggtgtc

SEQ ID NO: 373372 - DNA, 27 bp, Artificial Sequence
  Description of Artificial Sequence: Synthetic oligonucleotide
cccaattcccactcccattgggtgtcg

SEQ ID NO: 373373 - DNA, 27 bp, Artificial Sequence
  Description of Artificial Sequence: Synthetic oligonucleotide
ccaattcccactcccattgggtgtcgg

SEQ ID NO: 373374 - DNA, 27 bp, Artificial Sequence
  Description of Artificial Sequence: Synthetic oligonucleotide
caattcccactcccattgggtgtcggg

SEQ ID NO: 373375 - DNA, 28 bp, Artificial Sequence
  Description of Artificial Sequence: Synthetic oligonucleotide
aattcccactcccattgggtgtcgggtg

SEQ ID NO: 373376 - DNA, 27 bp, Artificial Sequence
  Description of Artificial Sequence: Synthetic oligonucleotide
attcccactcccattgggtgtcgggtg

SEQ ID NO: 373377 - DNA, 27 bp, Artificial Sequence
  Description of Artificial Sequence: Synthetic oligonucleotide
ttcccactcccattgggtgtcgggtgt

SEQ ID NO: 373378 - DNA, 26 bp, Artificial Sequence
  Description of Artificial Sequence: Synthetic oligonucleotide
tcccactcccattgggtgtcgggtgt

SEQ ID NO: 373379 - DNA, 25 bp, Artificial Sequence
  Description of Artificial Sequence: Synthetic oligonucleotide
cccactcccattgggtgtcgggtgt

SEQ ID NO: 373380 - DNA, 27 bp, Artificial Sequence
  Description of Artificial Sequence: Synthetic oligonucleotide
ccactcccattgggtgtcgggtgtcta

SEQ ID NO: 373381 - DNA, 27 bp, Artificial Sequence
  Description of Artificial Sequence: Synthetic oligonucleotide
cactcccattgggtgtcgggtgtctag

SEQ ID NO: 373382 - DNA, 28 bp, Artificial Sequence
  Description of Artificial Sequence: Synthetic oligonucleotide
actcccattgggtgtcgggtgtctagag

SEQ ID NO: 373383 - DNA, 27 bp, Artificial Sequence
  Description of Artificial Sequence: Synthetic oligonucleotide
ctcccattgggtgtcgggtgtctagag

SEQ ID NO: 373384 - DNA, 29 bp, Artificial Sequence
  Description of Artificial Sequence: Synthetic oligonucleotide
tcccattgggtgtcgggtgtctagagaag

SEQ ID NO: 373385 - DNA, 28 bp, Artificial Sequence
  Description of Artificial Sequence: Synthetic oligonucleotide
cccattgggtgtcgggtgtctagagaag

SEQ ID NO: 373386 - DNA, 28 bp, Artificial Sequence
  Description of Artificial Sequence: Synthetic oligonucleotide
ccattgggtgtcgggtgtctagagaagc

SEQ ID NO: 373387 - DNA, 28 bp, Artificial Sequence
  Description of Artificial Sequence: Synthetic oligonucleotide
cattgggtgtcgggtgtctagagaagcc

SEQ ID NO: 373388 - DNA, 31 bp, Artificial Sequence
  Description of Artificial Sequence: Synthetic oligonucleotide
attgggtgtcgggtgtctagagaagccaatc

SEQ ID NO: 373389 - DNA, 30 bp, Artificial Sequence
  Description of Artificial Sequence: Synthetic oligonucleotide
ttgggtgtcgggtgtctagagaagccaatc

SEQ ID NO: 373390 - DNA, 29 bp, Artificial Sequence
  Description of Artificial Sequence: Synthetic oligonucleotide
tgggtgtcgggtgtctagagaagccaatc

SEQ ID NO: 373391 - DNA, 28 bp, Artificial Sequence
  Description of Artificial Sequence: Synthetic oligonucleotide
gggtgtcgggtgtctagagaagccaatc

SEQ ID NO: 373392 - DNA, 29 bp, Artificial Sequence
  Description of Artificial Sequence: Synthetic oligonucleotide
ggtgtcgggtgtctagagaagccaatcag

SEQ ID NO: 373393 - DNA, 30 bp, Artificial Sequence
  Description of Artificial Sequence: Synthetic oligonucleotide
gtgtcgggtgtctagagaagccaatcagtg

SEQ ID NO: 373394 - DNA, 31 bp, Artificial Sequence
  Description of Artificial Sequence: Synthetic oligonucleotide
tgtcgggtgtctagagaagccaatcagtgtc

SEQ ID NO: 373395 - DNA, 30 bp, Artificial Sequence
  Description of Artificial Sequence: Synthetic oligonucleotide
gtcgggtgtctagagaagccaatcagtgtc

SEQ ID NO: 373396 - DNA, 30 bp, Artificial Sequence
  Description of Artificial Sequence: Synthetic oligonucleotide
tcgggtgtctagagaagccaatcagtgtcg

SEQ ID NO: 373397 - DNA, 29 bp, Artificial Sequence
  Description of Artificial Sequence: Synthetic oligonucleotide
cgggtgtctagagaagccaatcagtgtcg

SEQ ID NO: 373398 - DNA, 29 bp, Artificial Sequence
  Description of Artificial Sequence: Synthetic oligonucleotide
gggtgtctagagaagccaatcagtgtcgc

SEQ ID NO: 373399 - DNA, 29 bp, Artificial Sequence
  Description of Artificial Sequence: Synthetic oligonucleotide
ggtgtctagagaagccaatcagtgtcgcc

SEQ ID NO: 373400 - DNA, 29 bp, Artificial Sequence
  Description of Artificial Sequence: Synthetic oligonucleotide
gtgtctagagaagccaatcagtgtcgccg

SEQ ID NO: 373401 - DNA, 29 bp, Artificial Sequence
  Description of Artificial Sequence: Synthetic oligonucleotide
tgtctagagaagccaatcagtgtcgccgg

SEQ ID NO: 373402 - DNA, 28 bp, Artificial Sequence
  Description of Artificial Sequence: Synthetic oligonucleotide
gtctagagaagccaatcagtgtcgccgg

SEQ ID NO: 373403 - DNA, 28 bp, Artificial Sequence
  Description of Artificial Sequence: Synthetic oligonucleotide
tctagagaagccaatcagtgtcgccggg

SEQ ID NO: 373404 - DNA, 27 bp, Artificial Sequence
  Description of Artificial Sequence: Synthetic oligonucleotide
ctagagaagccaatcagtgtcgccggg

SEQ ID NO: 373405 - DNA, 27 bp, Artificial Sequence
  Description of Artificial Sequence: Synthetic oligonucleotide
tagagaagccaatcagtgtcgccgggg

SEQ ID NO: 373406 - DNA, 27 bp, Artificial Sequence
  Description of Artificial Sequence: Synthetic oligonucleotide
agagaagccaatcagtgtcgccggggt

SEQ ID NO: 373407 - DNA, 26 bp, Artificial Sequence
  Description of Artificial Sequence: Synthetic oligonucleotide
gagaagccaatcagtgtcgccggggt

SEQ ID NO: 373408 - DNA, 26 bp, Artificial Sequence
  Description of Artificial Sequence: Synthetic oligonucleotide
agaagccaatcagtgtcgccggggtc

SEQ ID NO: 373409 - DNA, 25 bp, Artificial Sequence
  Description of Artificial Sequence: Synthetic oligonucleotide
gaagccaatcagtgtcgccggggtc

SEQ ID NO: 373410 - DNA, 25 bp, Artificial Sequence
  Description of Artificial Sequence: Synthetic oligonucleotide
aagccaatcagtgtcgccggggtcc

SEQ ID NO: 373411 - DNA, 24 bp, Artificial Sequence
  Description of Artificial Sequence: Synthetic oligonucleotide
agccaatcagtgtcgccggggtcc

SEQ ID NO: 373412 - DNA, 23 bp, Artificial Sequence
  Description of Artificial Sequence: Synthetic oligonucleotide
gccaatcagtgtcgccggggtcc

SEQ ID NO: 373413 - DNA, 24 bp, Artificial Sequence
  Description of Artificial Sequence: Synthetic oligonucleotide
ccaatcagtgtcgccggggtccca

SEQ ID NO: 373414 - DNA, 26 bp, Artificial Sequence
  Description of Artificial Sequence: Synthetic oligonucleotide
caatcagtgtcgccggggtcccagtt

SEQ ID NO: 373415 - DNA, 27 bp, Artificial Sequence
  Description of Artificial Sequence: Synthetic oligonucleotide
aatcagtgtcgccggggtcccagttct

SEQ ID NO: 373416 - DNA, 27 bp, Artificial Sequence
  Description of Artificial Sequence: Synthetic oligonucleotide
atcagtgtcgccggggtcccagttcta

SEQ ID NO: 373417 - DNA, 27 bp, Artificial Sequence
  Description of Artificial Sequence: Synthetic oligonucleotide
tcagtgtcgccggggtcccagttctaa

SEQ ID NO: 373418 - DNA, 27 bp, Artificial Sequence
  Description of Artificial Sequence: Synthetic oligonucleotide
cagtgtcgccggggtcccagttctaaa

SEQ ID NO: 373419 - DNA, 27 bp, Artificial Sequence
  Description of Artificial Sequence: Synthetic oligonucleotide
agtgtcgccggggtcccagttctaaag

SEQ ID NO: 373420 - DNA, 27 bp, Artificial Sequence
  Description of Artificial Sequence: Synthetic oligonucleotide
gtgtcgccggggtcccagttctaaagt

SEQ ID NO: 373421 - DNA, 27 bp, Artificial Sequence
  Description of Artificial Sequence: Synthetic oligonucleotide
tgtcgccggggtcccagttctaaagtc

SEQ ID NO: 373422 - DNA, 25 bp, Artificial Sequence
  Description of Artificial Sequence: Synthetic oligonucleotide
ccacgcacccacccggactcagaat

SEQ ID NO: 373423 - DNA, 26 bp, Artificial Sequence
  Description of Artificial Sequence: Synthetic oligonucleotide
cacgcacccacccggactcagaatct

SEQ ID NO: 373424 - DNA, 26 bp, Artificial Sequence
  Description of Artificial Sequence: Synthetic oligonucleotide
acgcacccacccggactcagaatctc

SEQ ID NO: 373425 - DNA, 25 bp, Artificial Sequence
  Description of Artificial Sequence: Synthetic oligonucleotide
cgcacccacccggactcagaatctc

SEQ ID NO: 373426 - DNA, 26 bp, Artificial Sequence
  Description of Artificial Sequence: Synthetic oligonucleotide
gcacccacccggactcagaatctcct

SEQ ID NO: 373427 - DNA, 27 bp, Artificial Sequence
  Description of Artificial Sequence: Synthetic oligonucleotide
cacccacccggactcagaatctcctca

SEQ ID NO: 373428 - DNA, 27 bp, Artificial Sequence
  Description of Artificial Sequence: Synthetic oligonucleotide
acccacccggactcagaatctcctcag

SEQ ID NO: 373429 - DNA, 27 bp, Artificial Sequence
  Description of Artificial Sequence: Synthetic oligonucleotide
cccacccggactcagaatctcctcaga

SEQ ID NO: 373430 - DNA, 27 bp, Artificial Sequence
  Description of Artificial Sequence: Synthetic oligonucleotide
ccacccggactcagaatctcctcagac

SEQ ID NO: 373431 - DNA, 27 bp, Artificial Sequence
  Description of Artificial Sequence: Synthetic oligonucleotide
cacccggactcagaatctcctcagacg

SEQ ID NO: 373432 - DNA, 27 bp, Artificial Sequence
  Description of Artificial Sequence: Synthetic oligonucleotide
acccggactcagaatctcctcagacgc

SEQ ID NO: 373433 - DNA, 26 bp, Artificial Sequence
  Description of Artificial Sequence: Synthetic oligonucleotide
cccggactcagaatctcctcagacgc

SEQ ID NO: 373434 - DNA, 26 bp, Artificial Sequence
  Description of Artificial Sequence: Synthetic oligonucleotide
ccggactcagaatctcctcagacgcc

SEQ ID NO: 373435 - DNA, 27 bp, Artificial Sequence
  Description of Artificial Sequence: Synthetic oligonucleotide
cggactcagaatctcctcagacgccga

SEQ ID NO: 373436 - DNA, 27 bp, Artificial Sequence
  Description of Artificial Sequence: Synthetic oligonucleotide
ggactcagaatctcctcagacgccgag

SEQ ID NO: 373437 - DNA, 29 bp, Artificial Sequence
  Description of Artificial Sequence: Synthetic oligonucleotide
gactcagaatctcctcagacgccgagatg

SEQ ID NO: 373438 - DNA, 29 bp, Artificial Sequence
  Description of Artificial Sequence: Synthetic oligonucleotide
actcagaatctcctcagacgccgagatgc

SEQ ID NO: 373439 - DNA, 28 bp, Artificial Sequence
  Description of Artificial Sequence: Synthetic oligonucleotide
ctcagaatctcctcagacgccgagatgc

SEQ ID NO: 373440 - DNA, 28 bp, Artificial Sequence
  Description of Artificial Sequence: Synthetic oligonucleotide
tcagaatctcctcagacgccgagatgcg

SEQ ID NO: 373441 - DNA, 27 bp, Artificial Sequence
  Description of Artificial Sequence: Synthetic oligonucleotide
cagaatctcctcagacgccgagatgcg

SEQ ID NO: 373442 - DNA, 27 bp, Artificial Sequence
  Description of Artificial Sequence: Synthetic oligonucleotide
agaatctcctcagacgccgagatgcgg

SEQ ID NO: 373443 - DNA, 26 bp, Artificial Sequence
  Description of Artificial Sequence: Synthetic oligonucleotide
gaatctcctcagacgccgagatgcgg

SEQ ID NO: 373444 - DNA, 27 bp, Artificial Sequence
  Description of Artificial Sequence: Synthetic oligonucleotide
aatctcctcagacgccgagatgcgggt

SEQ ID NO: 373445 - DNA, 26 bp, Artificial Sequence
  Description of Artificial Sequence: Synthetic oligonucleotide
atctcctcagacgccgagatgcgggt

SEQ ID NO: 373446 - DNA, 25 bp, Artificial Sequence
  Description of Artificial Sequence: Synthetic oligonucleotide
tctcctcagacgccgagatgcgggt

SEQ ID NO: 373447 - DNA, 24 bp, Artificial Sequence
  Description of Artificial Sequence: Synthetic oligonucleotide
ctcctcagacgccgagatgcgggt

SEQ ID NO: 373448 - DNA, 25 bp, Artificial Sequence
  Description of Artificial Sequence: Synthetic oligonucleotide
tcctcagacgccgagatgcgggtca

SEQ ID NO: 373449 - DNA, 24 bp, Artificial Sequence
  Description of Artificial Sequence: Synthetic oligonucleotide
cctcagacgccgagatgcgggtca

SEQ ID NO: 373450 - DNA, 24 bp, Artificial Sequence
  Description of Artificial Sequence: Synthetic oligonucleotide
ctcagacgccgagatgcgggtcac

SEQ ID NO: 373451 - DNA, 24 bp, Artificial Sequence
  Description of Artificial Sequence: Synthetic oligonucleotide
tcagacgccgagatgcgggtcacg

SEQ ID NO: 373452 - DNA, 23 bp, Artificial Sequence
  Description of Artificial Sequence: Synthetic oligonucleotide
cagacgccgagatgcgggtcacg

SEQ ID NO: 373453 - DNA, 23 bp, Artificial Sequence
  Description of Artificial Sequence: Synthetic oligonucleotide
agacgccgagatgcgggtcacgg

SEQ ID NO: 373454 - DNA, 22 bp, Artificial Sequence
  Description of Artificial Sequence: Synthetic oligonucleotide
gacgccgagatgcgggtcacgg

SEQ ID NO: 373455 - DNA, 22 bp, Artificial Sequence
  Description of Artificial Sequence: Synthetic oligonucleotide
acgccgagatgcgggtcacggc

SEQ ID NO: 373456 - DNA, 21 bp, Artificial Sequence
  Description of Artificial Sequence: Synthetic oligonucleotide
cgccgagatgcgggtcacggc

SEQ ID NO: 373457 - DNA, 21 bp, Artificial Sequence
  Description of Artificial Sequence: Synthetic oligonucleotide
gccgagatgcgggtcacggcg

SEQ ID NO: 373458 - DNA, 21 bp, Artificial Sequence
  Description of Artificial Sequence: Synthetic oligonucleotide
ccgagatgcgggtcacggcgc

SEQ ID NO: 373459 - DNA, 21 bp, Artificial Sequence
  Description of Artificial Sequence: Synthetic oligonucleotide
cgagatgcgggtcacggcgcc

SEQ ID NO: 373460 - DNA, 21 bp, Artificial Sequence
  Description of Artificial Sequence: Synthetic oligonucleotide
gagatgcgggtcacggcgccc

SEQ ID NO: 373461 - DNA, 21 bp, Artificial Sequence
  Description of Artificial Sequence: Synthetic oligonucleotide
agatgcgggtcacggcgcccc

SEQ ID NO: 373462 - DNA, 20 bp, Artificial Sequence
  Description of Artificial Sequence: Synthetic oligonucleotide
gatgcgggtcacggcgcccc

SEQ ID NO: 373463 - DNA, 22 bp, Artificial Sequence
  Description of Artificial Sequence: Synthetic oligonucleotide
atgcgggtcacggcgccccgaa

SEQ ID NO: 373464 - DNA, 21 bp, Artificial Sequence
  Description of Artificial Sequence: Synthetic oligonucleotide
tgcgggtcacggcgccccgaa

SEQ ID NO: 373465 - DNA, 20 bp, Artificial Sequence
  Description of Artificial Sequence: Synthetic oligonucleotide
gcgggtcacggcgccccgaa

SEQ ID NO: 373466 - DNA, 20 bp, Artificial Sequence
  Description of Artificial Sequence: Synthetic oligonucleotide
cgggtcacggcgccccgaac

SEQ ID NO: 373467 - DNA, 20 bp, Artificial Sequence
  Description of Artificial Sequence: Synthetic oligonucleotide
gggtcacggcgccccgaacc

SEQ ID NO: 373468 - DNA, 21 bp, Artificial Sequence
  Description of Artificial Sequence: Synthetic oligonucleotide
ggtcacggcgccccgaaccct

SEQ ID NO: 373469 - DNA, 21 bp, Artificial Sequence
  Description of Artificial Sequence: Synthetic oligonucleotide
gtcacggcgccccgaaccctc

SEQ ID NO: 373470 - DNA, 22 bp, Artificial Sequence
  Description of Artificial Sequence: Synthetic oligonucleotide
tcacggcgccccgaaccctcct

SEQ ID NO: 373471 - DNA, 21 bp, Artificial Sequence
  Description of Artificial Sequence: Synthetic oligonucleotide
cacggcgccccgaaccctcct

SEQ ID NO: 373472 - DNA, 21 bp, Artificial Sequence
  Description of Artificial Sequence: Synthetic oligonucleotide
acggcgccccgaaccctcctc

SEQ ID NO: 373473 - DNA, 20 bp, Artificial Sequence
  Description of Artificial Sequence: Synthetic oligonucleotide
cggcgccccgaaccctcctc

SEQ ID NO: 373474 - DNA, 22 bp, Artificial Sequence
  Description of Artificial Sequence: Synthetic oligonucleotide
cgccccgaaccctcctcctgct

SEQ ID NO: 373475 - DNA, 22 bp, Artificial Sequence
  Description of Artificial Sequence: Synthetic oligonucleotide
gccccgaaccctcctcctgctg

SEQ ID NO: 373476 - DNA, 23 bp, Artificial Sequence
  Description of Artificial Sequence: Synthetic oligonucleotide
ccccgaaccctcctcctgctgct

SEQ ID NO: 373477 - DNA, 24 bp, Artificial Sequence
  Description of Artificial Sequence: Synthetic oligonucleotide
cccgaaccctcctcctgctgctct

SEQ ID NO: 373478 - DNA, 24 bp, Artificial Sequence
  Description of Artificial Sequence: Synthetic oligonucleotide
ccgaaccctcctcctgctgctctg

SEQ ID NO: 373479 - DNA, 24 bp, Artificial Sequence
  Description of Artificial Sequence: Synthetic oligonucleotide
cgaaccctcctcctgctgctctgg

SEQ ID NO: 373480 - DNA, 24 bp, Artificial Sequence
  Description of Artificial Sequence: Synthetic oligonucleotide
gaaccctcctcctgctgctctggg

SEQ ID NO: 373481 - DNA, 24 bp, Artificial Sequence
  Description of Artificial Sequence: Synthetic oligonucleotide
aaccctcctcctgctgctctgggg

SEQ ID NO: 373482 - DNA, 23 bp, Artificial Sequence
  Description of Artificial Sequence: Synthetic oligonucleotide
accctcctcctgctgctctgggg

SEQ ID NO: 373483 - DNA, 22 bp, Artificial Sequence
  Description of Artificial Sequence: Synthetic oligonucleotide
ccctcctcctgctgctctgggg

SEQ ID NO: 373484 - DNA, 22 bp, Artificial Sequence
  Description of Artificial Sequence: Synthetic oligonucleotide
cctcctcctgctgctctggggg

SEQ ID NO: 373485 - DNA, 22 bp, Artificial Sequence
  Description of Artificial Sequence: Synthetic oligonucleotide
ctcctcctgctgctctgggggg

SEQ ID NO: 373486 - DNA, 23 bp, Artificial Sequence
  Description of Artificial Sequence: Synthetic oligonucleotide
tcctcctgctgctctggggggca

SEQ ID NO: 373487 - DNA, 22 bp, Artificial Sequence
  Description of Artificial Sequence: Synthetic oligonucleotide
cctcctgctgctctggggggca

SEQ ID NO: 373488 - DNA, 23 bp, Artificial Sequence
  Description of Artificial Sequence: Synthetic oligonucleotide
ctcctgctgctctggggggcagt

SEQ ID NO: 373489 - DNA, 23 bp, Artificial Sequence
  Description of Artificial Sequence: Synthetic oligonucleotide
tcctgctgctctggggggcagtg

SEQ ID NO: 373490 - DNA, 22 bp, Artificial Sequence
  Description of Artificial Sequence: Synthetic oligonucleotide
cctgctgctctggggggcagtg

SEQ ID NO: 373491 - DNA, 22 bp, Artificial Sequence
  Description of Artificial Sequence: Synthetic oligonucleotide
ctgctgctctggggggcagtgg

SEQ ID NO: 373492 - DNA, 22 bp, Artificial Sequence
  Description of Artificial Sequence: Synthetic oligonucleotide
tgctgctctggggggcagtggc

SEQ ID NO: 373493 - DNA, 21 bp, Artificial Sequence
  Description of Artificial Sequence: Synthetic oligonucleotide
gctgctctggggggcagtggc

SEQ ID NO: 373494 - DNA, 21 bp, Artificial Sequence
  Description of Artificial Sequence: Synthetic oligonucleotide
ctgctctggggggcagtggcc

SEQ ID NO: 373495 - DNA, 22 bp, Artificial Sequence
  Description of Artificial Sequence: Synthetic oligonucleotide
tgctctggggggcagtggccct

SEQ ID NO: 373496 - DNA, 21 bp, Artificial Sequence
  Description of Artificial Sequence: Synthetic oligonucleotide
gctctggggggcagtggccct

SEQ ID NO: 373497 - DNA, 22 bp, Artificial Sequence
  Description of Artificial Sequence: Synthetic oligonucleotide
ctctggggggcagtggccctga

SEQ ID NO: 373498 - DNA, 22 bp, Artificial Sequence
  Description of Artificial Sequence: Synthetic oligonucleotide
tctggggggcagtggccctgac

SEQ ID NO: 373499 - DNA, 21 bp, Artificial Sequence
  Description of Artificial Sequence: Synthetic oligonucleotide
ctggggggcagtggccctgac

SEQ ID NO: 373500 - DNA, 21 bp, Artificial Sequence
  Description of Artificial Sequence: Synthetic oligonucleotide
tggggggcagtggccctgacc

SEQ ID NO: 373501 - DNA, 20 bp, Artificial Sequence
  Description of Artificial Sequence: Synthetic oligonucleotide
ggggggcagtggccctgacc

SEQ ID NO: 373502 - DNA, 21 bp, Artificial Sequence
  Description of Artificial Sequence: Synthetic oligonucleotide
gggggcagtggccctgaccga

SEQ ID NO: 373503 - DNA, 22 bp, Artificial Sequence
  Description of Artificial Sequence: Synthetic oligonucleotide
ggggcagtggccctgaccgaga

SEQ ID NO: 373504 - DNA, 22 bp, Artificial Sequence
  Description of Artificial Sequence: Synthetic oligonucleotide
gggcagtggccctgaccgagac

SEQ ID NO: 373505 - DNA, 23 bp, Artificial Sequence
  Description of Artificial Sequence: Synthetic oligonucleotide
ggcagtggccctgaccgagacct

SEQ ID NO: 373506 - DNA, 23 bp, Artificial Sequence
  Description of Artificial Sequence: Synthetic oligonucleotide
gcagtggccctgaccgagacctg

SEQ ID NO: 373507 - DNA, 23 bp, Artificial Sequence
  Description of Artificial Sequence: Synthetic oligonucleotide
cagtggccctgaccgagacctgg

SEQ ID NO: 373508 - DNA, 23 bp, Artificial Sequence
  Description of Artificial Sequence: Synthetic oligonucleotide
agtggccctgaccgagacctggg

SEQ ID NO: 373509 - DNA, 22 bp, Artificial Sequence
  Description of Artificial Sequence: Synthetic oligonucleotide
gtggccctgaccgagacctggg

SEQ ID NO: 373510 - DNA, 30 bp, Artificial Sequence; identical to SEQ ID NO: 13297
  Description of Artificial Sequence: Synthetic oligonucleotide

SEQ ID NO: 373511 - DNA, 30 bp, Artificial Sequence; identical to SEQ ID NO: 24217
  Description of Artificial Sequence: Synthetic oligonucleotide

SEQ ID NO: 373512 - DNA, 30 bp, Artificial Sequence; identical to SEQ ID NO: 24218
  Description of Artificial Sequence: Synthetic oligonucleotide

SEQ ID NO: 373513 - DNA, 29 bp, Artificial Sequence
  Description of Artificial Sequence: Synthetic oligonucleotide
cccactccatgaggtatttctacaccgcc

SEQ ID NO: 373514 - DNA, 31 bp, Artificial Sequence; identical to SEQ ID NO: 24220
  Description of Artificial Sequence: Synthetic oligonucleotide

SEQ ID NO: 373515 - DNA, 32 bp, Artificial Sequence; identical to SEQ ID NO: 24221
  Description of Artificial Sequence: Synthetic oligonucleotide

SEQ ID NO: 373516 - DNA, 32 bp, Artificial Sequence; identical to SEQ ID NO: 24222
  Description of Artificial Sequence: Synthetic oligonucleotide

SEQ ID NO: 373517 - DNA, 31 bp, Artificial Sequence; identical to SEQ ID NO: 24223
  Description of Artificial Sequence: Synthetic oligonucleotide

SEQ ID NO: 373518 - DNA, 31 bp, Artificial Sequence; identical to SEQ ID NO: 24224
  Description of Artificial Sequence: Synthetic oligonucleotide

SEQ ID NO: 373519 - DNA, 30 bp, Artificial Sequence; identical to SEQ ID NO: 24225
  Description of Artificial Sequence: Synthetic oligonucleotide

SEQ ID NO: 373520 - DNA, 30 bp, Artificial Sequence; identical to SEQ ID NO: 24226
  Description of Artificial Sequence: Synthetic oligonucleotide

SEQ ID NO: 373521 - DNA, 30 bp, Artificial Sequence; identical to SEQ ID NO: 24227
  Description of Artificial Sequence: Synthetic oligonucleotide

SEQ ID NO: 373522 - DNA, 29 bp, Artificial Sequence
  Description of Artificial Sequence: Synthetic oligonucleotide
tgaggtatttctacaccgccatgtcccgg

SEQ ID NO: 373523 - DNA, 28 bp, Artificial Sequence
  Description of Artificial Sequence: Synthetic oligonucleotide
gaggtatttctacaccgccatgtcccgg

SEQ ID NO: 373524 - DNA, 28 bp, Artificial Sequence
  Description of Artificial Sequence: Synthetic oligonucleotide
aggtatttctacaccgccatgtcccggc

SEQ ID NO: 373525 - DNA, 27 bp, Artificial Sequence
  Description of Artificial Sequence: Synthetic oligonucleotide
ggtatttctacaccgccatgtcccggc

SEQ ID NO: 373526 - DNA, 27 bp, Artificial Sequence
  Description of Artificial Sequence: Synthetic oligonucleotide
gtatttctacaccgccatgtcccggcc

SEQ ID NO: 373527 - DNA, 27 bp, Artificial Sequence
  Description of Artificial Sequence: Synthetic oligonucleotide
tatttctacaccgccatgtcccggccc

SEQ ID NO: 373528 - DNA, 26 bp, Artificial Sequence
  Description of Artificial Sequence: Synthetic oligonucleotide
atttctacaccgccatgtcccggccc

SEQ ID NO: 373529 - DNA, 25 bp, Artificial Sequence
  Description of Artificial Sequence: Synthetic oligonucleotide
tttctacaccgccatgtcccggccc

SEQ ID NO: 373530 - DNA, 24 bp, Artificial Sequence
  Description of Artificial Sequence: Synthetic oligonucleotide
ttctacaccgccatgtcccggccc

SEQ ID NO: 373531 - DNA, 23 bp, Artificial Sequence
  Description of Artificial Sequence: Synthetic oligonucleotide
tctacaccgccatgtcccggccc

SEQ ID NO: 373532 - DNA, 22 bp, Artificial Sequence
  Description of Artificial Sequence: Synthetic oligonucleotide
ctacaccgccatgtcccggccc

SEQ ID NO: 373533 - DNA, 22 bp, Artificial Sequence
  Description of Artificial Sequence: Synthetic oligonucleotide
tacaccgccatgtcccggcccg

SEQ ID NO: 373534 - DNA, 22 bp, Artificial Sequence
  Description of Artificial Sequence: Synthetic oligonucleotide
cgcggggagccccgcttcatca

SEQ ID NO: 373535 - DNA, 22 bp, Artificial Sequence
  Description of Artificial Sequence: Synthetic oligonucleotide
gcggggagccccgcttcatcac

SEQ ID NO: 373536 - DNA, 22 bp, Artificial Sequence
  Description of Artificial Sequence: Synthetic oligonucleotide
cggggagccccgcttcatcacc

SEQ ID NO: 373537 - DNA, 23 bp, Artificial Sequence
  Description of Artificial Sequence: Synthetic oligonucleotide
ggggagccccgcttcatcaccgt

SEQ ID NO: 373538 - DNA, 23 bp, Artificial Sequence
  Description of Artificial Sequence: Synthetic oligonucleotide
gggagccccgcttcatcaccgtg

SEQ ID NO: 373539 - DNA, 23 bp, Artificial Sequence
  Description of Artificial Sequence: Synthetic oligonucleotide
ggagccccgcttcatcaccgtgg

SEQ ID NO: 373540 - DNA, 23 bp, Artificial Sequence
  Description of Artificial Sequence: Synthetic oligonucleotide
gagccccgcttcatcaccgtggg

SEQ ID NO: 373541 - DNA, 25 bp, Artificial Sequence
  Description of Artificial Sequence: Synthetic oligonucleotide
agccccgcttcatcaccgtgggcta

SEQ ID NO: 373542 - DNA, 24 bp, Artificial Sequence
  Description of Artificial Sequence: Synthetic oligonucleotide
gccccgcttcatcaccgtgggcta

SEQ ID NO: 373543 - DNA, 24 bp, Artificial Sequence
  Description of Artificial Sequence: Synthetic oligonucleotide
ccccgcttcatcaccgtgggctac

SEQ ID NO: 373544 - DNA, 25 bp, Artificial Sequence
  Description of Artificial Sequence: Synthetic oligonucleotide
cccgcttcatcaccgtgggctacgt

SEQ ID NO: 373545 - DNA, 25 bp, Artificial Sequence
  Description of Artificial Sequence: Synthetic oligonucleotide
ccgcttcatcaccgtgggctacgtg

SEQ ID NO: 373546 - DNA, 26 bp, Artificial Sequence
  Description of Artificial Sequence: Synthetic oligonucleotide
cgcttcatcaccgtgggctacgtgga

SEQ ID NO: 373547 - DNA, 26 bp, Artificial Sequence
  Description of Artificial Sequence: Synthetic oligonucleotide
gcttcatcaccgtgggctacgtggac

SEQ ID NO: 373548 - DNA, 27 bp, Artificial Sequence
  Description of Artificial Sequence: Synthetic oligonucleotide
cttcatcaccgtgggctacgtggacga

SEQ ID NO: 373549 - DNA, 27 bp, Artificial Sequence
  Description of Artificial Sequence: Synthetic oligonucleotide
ttcatcaccgtgggctacgtggacgac

SEQ ID NO: 373550 - DNA, 27 bp, Artificial Sequence
  Description of Artificial Sequence: Synthetic oligonucleotide
tcatcaccgtgggctacgtggacgaca

SEQ ID NO: 373551 - DNA, 26 bp, Artificial Sequence
  Description of Artificial Sequence: Synthetic oligonucleotide
catcaccgtgggctacgtggacgaca

SEQ ID NO: 373552 - DNA, 26 bp, Artificial Sequence
  Description of Artificial Sequence: Synthetic oligonucleotide
atcaccgtgggctacgtggacgacac

SEQ ID NO: 373553 - DNA, 25 bp, Artificial Sequence
  Description of Artificial Sequence: Synthetic oligonucleotide
tcaccgtgggctacgtggacgacac

SEQ ID NO: 373554 - DNA, 24 bp, Artificial Sequence
  Description of Artificial Sequence: Synthetic oligonucleotide
caccgtgggctacgtggacgacac

SEQ ID NO: 373555 - DNA, 24 bp, Artificial Sequence
  Description of Artificial Sequence: Synthetic oligonucleotide
accgtgggctacgtggacgacacc

SEQ ID NO: 373556 - DNA, 23 bp, Artificial Sequence
  Description of Artificial Sequence: Synthetic oligonucleotide
ccgtgggctacgtggacgacacc

SEQ ID NO: 373557 - DNA, 24 bp, Artificial Sequence
  Description of Artificial Sequence: Synthetic oligonucleotide
cgtgggctacgtggacgacaccca

SEQ ID NO: 373558 - DNA, 27 bp, Artificial Sequence
  Description of Artificial Sequence: Synthetic oligonucleotide
agttcgtgaggttcgacagcgacgcca

SEQ ID NO: 373559 - DNA, 26 bp, Artificial Sequence
  Description of Artificial Sequence: Synthetic oligonucleotide
gttcgtgaggttcgacagcgacgcca

SEQ ID NO: 373560 - DNA, 26 bp, Artificial Sequence
  Description of Artificial Sequence: Synthetic oligonucleotide
ttcgtgaggttcgacagcgacgccac

SEQ ID NO: 373561 - DNA, 25 bp, Artificial Sequence
  Description of Artificial Sequence: Synthetic oligonucleotide
tcgtgaggttcgacagcgacgccac

SEQ ID NO: 373562 - DNA, 24 bp, Artificial Sequence
  Description of Artificial Sequence: Synthetic oligonucleotide
cgtgaggttcgacagcgacgccac

SEQ ID NO: 373563 - DNA, 25 bp, Artificial Sequence
  Description of Artificial Sequence: Synthetic oligonucleotide
gtgaggttcgacagcgacgccacga

SEQ ID NO: 373564 - DNA, 26 bp, Artificial Sequence
  Description of Artificial Sequence: Synthetic oligonucleotide
tgaggttcgacagcgacgccacgagt

SEQ ID NO: 373565 - DNA, 25 bp, Artificial Sequence
  Description of Artificial Sequence: Synthetic oligonucleotide
gaggttcgacagcgacgccacgagt

SEQ ID NO: 373566 - DNA, 25 bp, Artificial Sequence
  Description of Artificial Sequence: Synthetic oligonucleotide
aggttcgacagcgacgccacgagtc

SEQ ID NO: 373567 - DNA, 24 bp, Artificial Sequence
  Description of Artificial Sequence: Synthetic oligonucleotide
ggttcgacagcgacgccacgagtc

SEQ ID NO: 373568 - DNA, 24 bp, Artificial Sequence
  Description of Artificial Sequence: Synthetic oligonucleotide
gttcgacagcgacgccacgagtcc

SEQ ID NO: 373569 - DNA, 25 bp, Artificial Sequence
  Description of Artificial Sequence: Synthetic oligonucleotide
ttcgacagcgacgccacgagtccga

SEQ ID NO: 373570 - DNA, 24 bp, Artificial Sequence
  Description of Artificial Sequence: Synthetic oligonucleotide
tcgacagcgacgccacgagtccga

SEQ ID NO: 373571 - DNA, 23 bp, Artificial Sequence
  Description of Artificial Sequence: Synthetic oligonucleotide
cgacagcgacgccacgagtccga

SEQ ID NO: 373572 - DNA, 23 bp, Artificial Sequence
  Description of Artificial Sequence: Synthetic oligonucleotide
gacagcgacgccacgagtccgag

SEQ ID NO: 373573 - DNA, 25 bp, Artificial Sequence
  Description of Artificial Sequence: Synthetic oligonucleotide
acagcgacgccacgagtccgaggat

SEQ ID NO: 373574 - DNA, 24 bp, Artificial Sequence
  Description of Artificial Sequence: Synthetic oligonucleotide
cagcgacgccacgagtccgaggat

SEQ ID NO: 373575 - DNA, 24 bp, Artificial Sequence
  Description of Artificial Sequence: Synthetic oligonucleotide
agcgacgccacgagtccgaggatg

SEQ ID NO: 373576 - DNA, 23 bp, Artificial Sequence
  Description of Artificial Sequence: Synthetic oligonucleotide
gcgacgccacgagtccgaggatg

SEQ ID NO: 373577 - DNA, 23 bp, Artificial Sequence
  Description of Artificial Sequence: Synthetic oligonucleotide
cgacgccacgagtccgaggatgg

SEQ ID NO: 373578 - DNA, 23 bp, Artificial Sequence
  Description of Artificial Sequence: Synthetic oligonucleotide
gacgccacgagtccgaggatggc

SEQ ID NO: 373579 - DNA, 23 bp, Artificial Sequence
  Description of Artificial Sequence: Synthetic oligonucleotide
acgccacgagtccgaggatggcg

SEQ ID NO: 373580 - DNA, 22 bp, Artificial Sequence
  Description of Artificial Sequence: Synthetic oligonucleotide
cgccacgagtccgaggatggcg

SEQ ID NO: 373581 - DNA, 22 bp, Artificial Sequence
  Description of Artificial Sequence: Synthetic oligonucleotide
gccacgagtccgaggatggcgc

SEQ ID NO: 373582 - DNA, 22 bp, Artificial Sequence
  Description of Artificial Sequence: Synthetic oligonucleotide
ccacgagtccgaggatggcgcc

SEQ ID NO: 373583 - DNA, 22 bp, Artificial Sequence
  Description of Artificial Sequence: Synthetic oligonucleotide
cacgagtccgaggatggcgccc

SEQ ID NO: 373584 - DNA, 22 bp, Artificial Sequence
  Description of Artificial Sequence: Synthetic oligonucleotide
acgagtccgaggatggcgcccc

SEQ ID NO: 373585 - DNA, 21 bp, Artificial Sequence
  Description of Artificial Sequence: Synthetic oligonucleotide
cgagtccgaggatggcgcccc

SEQ ID NO: 373586 - DNA, 21 bp, Artificial Sequence
  Description of Artificial Sequence: Synthetic oligonucleotide
gagtccgaggatggcgccccg

SEQ ID NO: 373587 - DNA, 21 bp, Artificial Sequence
  Description of Artificial Sequence: Synthetic oligonucleotide
agtccgaggatggcgccccgg

SEQ ID NO: 373588 - DNA, 20 bp, Artificial Sequence
  Description of Artificial Sequence: Synthetic oligonucleotide
gtccgaggatggcgccccgg

SEQ ID NO: 373589 - DNA, 20 bp, Artificial Sequence
  Description of Artificial Sequence: Synthetic oligonucleotide
tccgaggatggcgccccggg

SEQ ID NO: 373590 - DNA, 20 bp, Artificial Sequence
  Description of Artificial Sequence: Synthetic oligonucleotide
ccgaggatggcgccccgggt

SEQ ID NO: 373591 - DNA, 20 bp, Artificial Sequence
  Description of Artificial Sequence: Synthetic oligonucleotide
cgaggatggcgccccgggct

SEQ ID NO: 373592 - DNA, 20 bp, Artificial Sequence
  Description of Artificial Sequence: Synthetic oligonucleotide
gaggatggcgccccgggcgt

SEQ ID NO: 373593 - DNA, 20 bp, Artificial Sequence
  Description of Artificial Sequence: Synthetic oligonucleotide
aggatggcgccccgggcgct

SEQ ID NO: 373594 - DNA, 20 bp, Artificial Sequence
  Description of Artificial Sequence: Synthetic oligonucleotide
ggatggcgccccgggcgctt

SEQ ID NO: 373595 - DNA, 20 bp, Artificial Sequence
  Description of Artificial Sequence: Synthetic oligonucleotide
gatggcgccccgggcgccat

SEQ ID NO: 373596 - DNA, 20 bp, Artificial Sequence
  Description of Artificial Sequence: Synthetic oligonucleotide
atggcgccccgggcgccatg

SEQ ID NO: 373597 - DNA, 20 bp, Artificial Sequence
  Description of Artificial Sequence: Synthetic oligonucleotide
tggcgccccgggcgccatgt

SEQ ID NO: 373598 - DNA, 20 bp, Artificial Sequence
  Description of Artificial Sequence: Synthetic oligonucleotide
ggcgccccgggcgccatgtt

SEQ ID NO: 373599 - DNA, 21 bp, Artificial Sequence
  Description of Artificial Sequence: Synthetic oligonucleotide
gcgccccgggcgccatggata

SEQ ID NO: 373600 - DNA, 22 bp, Artificial Sequence
  Description of Artificial Sequence: Synthetic oligonucleotide
cgccccgggcgccatggataga

SEQ ID NO: 373601 - DNA, 28 bp, Artificial Sequence
  Description of Artificial Sequence: Synthetic oligonucleotide
ggagtattgggaccgggagacacagatc

SEQ ID NO: 373602 - DNA, 29 bp, Artificial Sequence
  Description of Artificial Sequence: Synthetic oligonucleotide
gagtattgggaccgggagacacagatctc

SEQ ID NO: 373603 - DNA, 29 bp, Artificial Sequence
  Description of Artificial Sequence: Synthetic oligonucleotide
agtattgggaccgggagacacagatctcc

SEQ ID NO: 373604 - DNA, 28 bp, Artificial Sequence
  Description of Artificial Sequence: Synthetic oligonucleotide
gtattgggaccgggagacacagatctcc

SEQ ID NO: 373605 - DNA, 30 bp, Artificial Sequence; identical to SEQ ID NO: 25383
  Description of Artificial Sequence: Synthetic oligonucleotide

SEQ ID NO: 373606 - DNA, 29 bp, Artificial Sequence
  Description of Artificial Sequence: Synthetic oligonucleotide
attgggaccgggagacacagatctccaag

SEQ ID NO: 373607 - DNA, 28 bp, Artificial Sequence
  Description of Artificial Sequence: Synthetic oligonucleotide
ttgggaccgggagacacagatctccaag

SEQ ID NO: 373608 - DNA, 27 bp, Artificial Sequence
  Description of Artificial Sequence: Synthetic oligonucleotide
tgggaccgggagacacagatctccaag

SEQ ID NO: 373609 - DNA, 27 bp, Artificial Sequence
  Description of Artificial Sequence: Synthetic oligonucleotide
gggaccgggagacacagatctccaaga

SEQ ID NO: 373610 - DNA, 27 bp, Artificial Sequence
  Description of Artificial Sequence: Synthetic oligonucleotide
ggaccgggagacacagatctccaagac

SEQ ID NO: 373611 - DNA, 27 bp, Artificial Sequence
  Description of Artificial Sequence: Synthetic oligonucleotide
gaccgggagacacagatctccaagacc

SEQ ID NO: 373612 - DNA, 29 bp, Artificial Sequence
  Description of Artificial Sequence: Synthetic oligonucleotide
accgggagacacagatctccaagaccaac

SEQ ID NO: 373613 - DNA, 28 bp, Artificial Sequence
  Description of Artificial Sequence: Synthetic oligonucleotide
ccgggagacacagatctccaagaccaac

SEQ ID NO: 373614 - DNA, 29 bp, Artificial Sequence
  Description of Artificial Sequence: Synthetic oligonucleotide
cgggagacacagatctccaagaccaacac

SEQ ID NO: 373615 - DNA, 30 bp, Artificial Sequence; identical to SEQ ID NO: 25393
  Description of Artificial Sequence: Synthetic oligonucleotide

SEQ ID NO: 373616 - DNA, 31 bp, Artificial Sequence; identical to SEQ ID NO: 25394
  Description of Artificial Sequence: Synthetic oligonucleotide

SEQ ID NO: 373617 - DNA, 32 bp, Artificial Sequence; identical to SEQ ID NO: 25395
  Description of Artificial Sequence: Synthetic oligonucleotide

SEQ ID NO: 373618 - DNA, 35 bp, Artificial Sequence; identical to SEQ ID NO: 25872
  Description of Artificial Sequence: Synthetic oligonucleotide

SEQ ID NO: 373619 - DNA, 34 bp, Artificial Sequence; identical to SEQ ID NO: 25873
  Description of Artificial Sequence: Synthetic oligonucleotide

SEQ ID NO: 373620 - DNA, 34 bp, Artificial Sequence; identical to SEQ ID NO: 23641
  Description of Artificial Sequence: Synthetic oligonucleotide

SEQ ID NO: 373621 - DNA, 33 bp, Artificial Sequence; identical to SEQ ID NO: 23642
  Description of Artificial Sequence: Synthetic oligonucleotide

SEQ ID NO: 373622 - DNA, 33 bp, Artificial Sequence; identical to SEQ ID NO: 23643
  Description of Artificial Sequence: Synthetic oligonucleotide

SEQ ID NO: 373623 - DNA, 32 bp, Artificial Sequence; identical to SEQ ID NO: 23644
  Description of Artificial Sequence: Synthetic oligonucleotide

SEQ ID NO: 373624 - DNA, 33 bp, Artificial Sequence; identical to SEQ ID NO: 23645
  Description of Artificial Sequence: Synthetic oligonucleotide

SEQ ID NO: 373625 - DNA, 32 bp, Artificial Sequence; identical to SEQ ID NO: 23646
  Description of Artificial Sequence: Synthetic oligonucleotide

SEQ ID NO: 373626 - DNA, 33 bp, Artificial Sequence; identical to SEQ ID NO: 23647
  Description of Artificial Sequence: Synthetic oligonucleotide

SEQ ID NO: 373627 - DNA, 32 bp, Artificial Sequence; identical to SEQ ID NO: 23648
  Description of Artificial Sequence: Synthetic oligonucleotide

SEQ ID NO: 373628 - DNA, 31 bp, Artificial Sequence; identical to SEQ ID NO: 23649
  Description of Artificial Sequence: Synthetic oligonucleotide

SEQ ID NO: 373629 - DNA, 33 bp, Artificial Sequence; identical to SEQ ID NO: 26105
  Description of Artificial Sequence: Synthetic oligonucleotide

SEQ ID NO: 373630 - DNA, 32 bp, Artificial Sequence; identical to SEQ ID NO: 26106
  Description of Artificial Sequence: Synthetic oligonucleotide

SEQ ID NO: 373631 - DNA, 30 bp, Artificial Sequence; identical to SEQ ID NO: 26107
  Description of Artificial Sequence: Synthetic oligonucleotide

SEQ ID NO: 373632 - DNA, 29 bp, Artificial Sequence
  Description of Artificial Sequence: Synthetic oligonucleotide
acacacagacttaccgagagaacctgcgc

SEQ ID NO: 373633 - DNA, 28 bp, Artificial Sequence
  Description of Artificial Sequence: Synthetic oligonucleotide
cacacagacttaccgagagaacctgcgc

SEQ ID NO: 373634 - DNA, 29 bp, Artificial Sequence
  Description of Artificial Sequence: Synthetic oligonucleotide
acacagacttaccgagagaacctgcgcac

SEQ ID NO: 373635 - DNA, 28 bp, Artificial Sequence
  Description of Artificial Sequence: Synthetic oligonucleotide
cacagacttaccgagagaacctgcgcac

SEQ ID NO: 373636 - DNA, 28 bp, Artificial Sequence
  Description of Artificial Sequence: Synthetic oligonucleotide
acagacttaccgagagaacctgcgcacc

SEQ ID NO: 373637 - DNA, 27 bp, Artificial Sequence
  Description of Artificial Sequence: Synthetic oligonucleotide
cagacttaccgagagaacctgcgcacc

SEQ ID NO: 373638 - DNA, 27 bp, Artificial Sequence
  Description of Artificial Sequence: Synthetic oligonucleotide
agacttaccgagagaacctgcgcaccg

SEQ ID NO: 373639 - DNA, 26 bp, Artificial Sequence
  Description of Artificial Sequence: Synthetic oligonucleotide
gacttaccgagagaacctgcgcaccg

SEQ ID NO: 373640 - DNA, 26 bp, Artificial Sequence
  Description of Artificial Sequence: Synthetic oligonucleotide
acttaccgagagaacctgcgcaccgc

SEQ ID NO: 373641 - DNA, 25 bp, Artificial Sequence
  Description of Artificial Sequence: Synthetic oligonucleotide
cttaccgagagaacctgcgcaccgc

SEQ ID NO: 373642 - DNA, 25 bp, Artificial Sequence
  Description of Artificial Sequence: Synthetic oligonucleotide
ttaccgagagaacctgcgcaccgcg

SEQ ID NO: 373643 - DNA, 24 bp, Artificial Sequence
  Description of Artificial Sequence: Synthetic oligonucleotide
taccgagagaacctgcgcaccgcg

SEQ ID NO: 373644 - DNA, 30 bp, Artificial Sequence; identical to SEQ ID NO: 23305
  Description of Artificial Sequence: Synthetic oligonucleotide

SEQ ID NO: 373645 - DNA, 30 bp, Artificial Sequence; identical to SEQ ID NO: 23306
  Description of Artificial Sequence: Synthetic oligonucleotide

SEQ ID NO: 373646 - DNA, 30 bp, Artificial Sequence; identical to SEQ ID NO: 23307
  Description of Artificial Sequence: Synthetic oligonucleotide

SEQ ID NO: 373647 - DNA, 31 bp, Artificial Sequence; identical to SEQ ID NO: 23308
  Description of Artificial Sequence: Synthetic oligonucleotide

SEQ ID NO: 373648 - DNA, 31 bp, Artificial Sequence; identical to SEQ ID NO: 23309
  Description of Artificial Sequence: Synthetic oligonucleotide

SEQ ID NO: 373649 - DNA, 31 bp, Artificial Sequence; identical to SEQ ID NO: 23310
  Description of Artificial Sequence: Synthetic oligonucleotide

SEQ ID NO: 373650 - DNA, 30 bp, Artificial Sequence; identical to SEQ ID NO: 23311
  Description of Artificial Sequence: Synthetic oligonucleotide

SEQ ID NO: 373651 - DNA, 31 bp, Artificial Sequence; identical to SEQ ID NO: 23312
  Description of Artificial Sequence: Synthetic oligonucleotide

SEQ ID NO: 373652 - DNA, 30 bp, Artificial Sequence; identical to SEQ ID NO: 23313
  Description of Artificial Sequence: Synthetic oligonucleotide

SEQ ID NO: 373653 - DNA, 30 bp, Artificial Sequence; identical to SEQ ID NO: 23314
  Description of Artificial Sequence: Synthetic oligonucleotide

SEQ ID NO: 373654 - DNA, 29 bp, Artificial Sequence
  Description of Artificial Sequence: Synthetic oligonucleotide
catcatccagaggatgtatggctgcgacc

SEQ ID NO: 373655 - DNA, 30 bp, Artificial Sequence; identical to SEQ ID NO: 23316
  Description of Artificial Sequence: Synthetic oligonucleotide

SEQ ID NO: 373656 - DNA, 29 bp, Artificial Sequence
  Description of Artificial Sequence: Synthetic oligonucleotide
tcatccagaggatgtatggctgcgacctg

SEQ ID NO: 373657 - DNA, 28 bp, Artificial Sequence
  Description of Artificial Sequence: Synthetic oligonucleotide
catccagaggatgtatggctgcgacctg

SEQ ID NO: 373658 - DNA, 28 bp, Artificial Sequence
  Description of Artificial Sequence: Synthetic oligonucleotide
atccagaggatgtatggctgcgacctgg

SEQ ID NO: 373659 - DNA, 27 bp, Artificial Sequence
  Description of Artificial Sequence: Synthetic oligonucleotide
tccagaggatgtatggctgcgacctgg

SEQ ID NO: 373660 - DNA, 26 bp, Artificial Sequence
  Description of Artificial Sequence: Synthetic oligonucleotide
ccagaggatgtatggctgcgacctgg

SEQ ID NO: 373661 - DNA, 26 bp, Artificial Sequence
  Description of Artificial Sequence: Synthetic oligonucleotide
cagaggatgtatggctgcgacctggg

SEQ ID NO: 373662 - DNA, 26 bp, Artificial Sequence
  Description of Artificial Sequence: Synthetic oligonucleotide
agaggatgtatggctgcgacctgggg

SEQ ID NO: 373663 - DNA, 25 bp, Artificial Sequence
  Description of Artificial Sequence: Synthetic oligonucleotide
gaggatgtatggctgcgacctgggg

SEQ ID NO: 373664 - DNA, 25 bp, Artificial Sequence
  Description of Artificial Sequence: Synthetic oligonucleotide
aggatgtatggctgcgacctggggc

SEQ ID NO: 373665 - DNA, 24 bp, Artificial Sequence
  Description of Artificial Sequence: Synthetic oligonucleotide
ggatgtatggctgcgacctggggc

SEQ ID NO: 373666 - DNA, 24 bp, Artificial Sequence
  Description of Artificial Sequence: Synthetic oligonucleotide
gatgtatggctgcgacctggggcc

SEQ ID NO: 373667 - DNA, 24 bp, Artificial Sequence
  Description of Artificial Sequence: Synthetic oligonucleotide
atgtatggctgcgacctggggccg

SEQ ID NO: 373668 - DNA, 23 bp, Artificial Sequence
  Description of Artificial Sequence: Synthetic oligonucleotide
tgtatggctgcgacctggggccg

SEQ ID NO: 373669 - DNA, 22 bp, Artificial Sequence
  Description of Artificial Sequence: Synthetic oligonucleotide
gtatggctgcgacctggggccg

SEQ ID NO: 373670 - DNA, 23 bp, Artificial Sequence
  Description of Artificial Sequence: Synthetic oligonucleotide
tatggctgcgacctggggccgga

SEQ ID NO: 373671 - DNA, 22 bp, Artificial Sequence
  Description of Artificial Sequence: Synthetic oligonucleotide
atggctgcgacctggggccgga

SEQ ID NO: 373672 - DNA, 21 bp, Artificial Sequence
  Description of Artificial Sequence: Synthetic oligonucleotide
tggctgcgacctggggccgga

SEQ ID NO: 373673 - DNA, 20 bp, Artificial Sequence
  Description of Artificial Sequence: Synthetic oligonucleotide
ggctgcgacctggggccgga

SEQ ID NO: 373674 - DNA, 20 bp, Artificial Sequence
  Description of Artificial Sequence: Synthetic oligonucleotide
gctgcgacctggggccggac

SEQ ID NO: 373675 - DNA, 20 bp, Artificial Sequence
  Description of Artificial Sequence: Synthetic oligonucleotide
ctgcgacctggggccggacg

SEQ ID NO: 373676 - DNA, 20 bp, Artificial Sequence
  Description of Artificial Sequence: Synthetic oligonucleotide
tgcgacctggggccggacgg

SEQ ID NO: 373677 - DNA, 20 bp, Artificial Sequence
  Description of Artificial Sequence: Synthetic oligonucleotide
gcgacctggggccggacggt

SEQ ID NO: 373678 - DNA, 20 bp, Artificial Sequence
  Description of Artificial Sequence: Synthetic oligonucleotide
cgacctggggccggacgggt

SEQ ID NO: 373679 - DNA, 20 bp, Artificial Sequence
  Description of Artificial Sequence: Synthetic oligonucleotide
gacctggggccggacgggct

SEQ ID NO: 373680 - DNA, 20 bp, Artificial Sequence
  Description of Artificial Sequence: Synthetic oligonucleotide
acctggggccggacgggcgt

SEQ ID NO: 373681 - DNA, 20 bp, Artificial Sequence
  Description of Artificial Sequence: Synthetic oligonucleotide
cctggggccggacgggcgtt

SEQ ID NO: 373682 - DNA, 20 bp, Artificial Sequence
  Description of Artificial Sequence: Synthetic oligonucleotide
ctggggccggacgggcgctt

SEQ ID NO: 373683 - DNA, 26 bp, Artificial Sequence
  Description of Artificial Sequence: Synthetic oligonucleotide
gcctcctccgcgggcataaccagtta

SEQ ID NO: 373684 - DNA, 26 bp, Artificial Sequence
  Description of Artificial Sequence: Synthetic oligonucleotide
cctcctccgcgggcataaccagttag

SEQ ID NO: 373685 - DNA, 26 bp, Artificial Sequence
  Description of Artificial Sequence: Synthetic oligonucleotide
ctcctccgcgggcataaccagttagc

SEQ ID NO: 373686 - DNA, 27 bp, Artificial Sequence
  Description of Artificial Sequence: Synthetic oligonucleotide
tcctccgcgggcataaccagttagcct

SEQ ID NO: 373687 - DNA, 27 bp, Artificial Sequence
  Description of Artificial Sequence: Synthetic oligonucleotide
cctccgcgggcataaccagttagccta

SEQ ID NO: 373688 - DNA, 27 bp, Artificial Sequence
  Description of Artificial Sequence: Synthetic oligonucleotide
ctccgcgggcataaccagttagcctac

SEQ ID NO: 373689 - DNA, 27 bp, Artificial Sequence
  Description of Artificial Sequence: Synthetic oligonucleotide
tccgcgggcataaccagttagcctacg

SEQ ID NO: 373690 - DNA, 27 bp, Artificial Sequence
  Description of Artificial Sequence: Synthetic oligonucleotide
ccgcgggcataaccagttagcctacga

SEQ ID NO: 373691 - DNA, 27 bp, Artificial Sequence
  Description of Artificial Sequence: Synthetic oligonucleotide
cgcgggcataaccagttagcctacgac

SEQ ID NO: 373692 - DNA, 27 bp, Artificial Sequence
  Description of Artificial Sequence: Synthetic oligonucleotide
gcgggcataaccagttagcctacgacg

SEQ ID NO: 373693 - DNA, 27 bp, Artificial Sequence
  Description of Artificial Sequence: Synthetic oligonucleotide
cgggcataaccagttagcctacgacgg

SEQ ID NO: 373694 - DNA, 27 bp, Artificial Sequence
  Description of Artificial Sequence: Synthetic oligonucleotide
gggcataaccagttagcctacgacggc

SEQ ID NO: 373695 - DNA, 29 bp, Artificial Sequence
  Description of Artificial Sequence: Synthetic oligonucleotide
ggcataaccagttagcctacgacggcaag

SEQ ID NO: 373696 - DNA, 29 bp, Artificial Sequence
  Description of Artificial Sequence: Synthetic oligonucleotide
gcataaccagttagcctacgacggcaagg

SEQ ID NO: 373697 - DNA, 33 bp, Artificial Sequence; identical to SEQ ID NO: 24563
  Description of Artificial Sequence: Synthetic oligonucleotide

SEQ ID NO: 373698 - DNA, 35 bp, Artificial Sequence; identical to SEQ ID NO: 24564
  Description of Artificial Sequence: Synthetic oligonucleotide

SEQ ID NO: 373699 - DNA, 34 bp, Artificial Sequence; identical to SEQ ID NO: 24565
  Description of Artificial Sequence: Synthetic oligonucleotide

SEQ ID NO: 373700 - DNA, 33 bp, Artificial Sequence; identical to SEQ ID NO: 24566
  Description of Artificial Sequence: Synthetic oligonucleotide

SEQ ID NO: 373701 - DNA, 32 bp, Artificial Sequence; identical to SEQ ID NO: 24567
  Description of Artificial Sequence: Synthetic oligonucleotide

SEQ ID NO: 373702 - DNA, 31 bp, Artificial Sequence; identical to SEQ ID NO: 24568
  Description of Artificial Sequence: Synthetic oligonucleotide

SEQ ID NO: 373703 - DNA, 31 bp, Artificial Sequence; identical to SEQ ID NO: 24569
  Description of Artificial Sequence: Synthetic oligonucleotide

SEQ ID NO: 373704 - DNA, 31 bp, Artificial Sequence; identical to SEQ ID NO: 24570
  Description of Artificial Sequence: Synthetic oligonucleotide

SEQ ID NO: 373705 - DNA, 30 bp, Artificial Sequence; identical to SEQ ID NO: 24571
  Description of Artificial Sequence: Synthetic oligonucleotide

SEQ ID NO: 373706 - DNA, 30 bp, Artificial Sequence; identical to SEQ ID NO: 24572
  Description of Artificial Sequence: Synthetic oligonucleotide

SEQ ID NO: 373707 - DNA, 29 bp, Artificial Sequence
  Description of Artificial Sequence: Synthetic oligonucleotide
tagcctacgacggcaaggattacatcgcc

SEQ ID NO: 373708 - DNA, 28 bp, Artificial Sequence
  Description of Artificial Sequence: Synthetic oligonucleotide
agcctacgacggcaaggattacatcgcc

SEQ ID NO: 373709 - DNA, 29 bp, Artificial Sequence
  Description of Artificial Sequence: Synthetic oligonucleotide
gattacatcgccctgaacgaggacctgag

SEQ ID NO: 373710 - DNA, 29 bp, Artificial Sequence
  Description of Artificial Sequence: Synthetic oligonucleotide
attacatcgccctgaacgaggacctgagc

SEQ ID NO: 373711 - DNA, 28 bp, Artificial Sequence
  Description of Artificial Sequence: Synthetic oligonucleotide
ttacatcgccctgaacgaggacctgagc

SEQ ID NO: 373712 - DNA, 27 bp, Artificial Sequence
  Description of Artificial Sequence: Synthetic oligonucleotide
tacatcgccctgaacgaggacctgagc

SEQ ID NO: 373713 - DNA, 27 bp, Artificial Sequence
  Description of Artificial Sequence: Synthetic oligonucleotide
acatcgccctgaacgaggacctgagct

SEQ ID NO: 373714 - DNA, 26 bp, Artificial Sequence
  Description of Artificial Sequence: Synthetic oligonucleotide
catcgccctgaacgaggacctgagct

SEQ ID NO: 373715 - DNA, 26 bp, Artificial Sequence
  Description of Artificial Sequence: Synthetic oligonucleotide
atcgccctgaacgaggacctgagctc

SEQ ID NO: 373716 - DNA, 25 bp, Artificial Sequence
  Description of Artificial Sequence: Synthetic oligonucleotide
tcgccctgaacgaggacctgagctc

SEQ ID NO: 373717 - DNA, 24 bp, Artificial Sequence
  Description of Artificial Sequence: Synthetic oligonucleotide
cgccctgaacgaggacctgagctc

SEQ ID NO: 373718 - DNA, 25 bp, Artificial Sequence
  Description of Artificial Sequence: Synthetic oligonucleotide
gccctgaacgaggacctgagctcct

SEQ ID NO: 373719 - DNA, 25 bp, Artificial Sequence
  Description of Artificial Sequence: Synthetic oligonucleotide
ccctgaacgaggacctgagctcctg

SEQ ID NO: 373720 - DNA, 26 bp, Artificial Sequence
  Description of Artificial Sequence: Synthetic oligonucleotide
cctgaacgaggacctgagctcctgga

SEQ ID NO: 373721 - DNA, 26 bp, Artificial Sequence
  Description of Artificial Sequence: Synthetic oligonucleotide
ctgaacgaggacctgagctcctggac

SEQ ID NO: 373722 - DNA, 26 bp, Artificial Sequence
  Description of Artificial Sequence: Synthetic oligonucleotide
tgaacgaggacctgagctcctggacc

SEQ ID NO: 373723 - DNA, 25 bp, Artificial Sequence
  Description of Artificial Sequence: Synthetic oligonucleotide
gaacgaggacctgagctcctggacc

SEQ ID NO: 373724 - DNA, 25 bp, Artificial Sequence
  Description of Artificial Sequence: Synthetic oligonucleotide
aacgaggacctgagctcctggaccg

SEQ ID NO: 373725 - DNA, 24 bp, Artificial Sequence
  Description of Artificial Sequence: Synthetic oligonucleotide
acgaggacctgagctcctggaccg

SEQ ID NO: 373726 - DNA, 23 bp, Artificial Sequence
  Description of Artificial Sequence: Synthetic oligonucleotide
cgaggacctgagctcctggaccg

SEQ ID NO: 373727 - DNA, 23 bp, Artificial Sequence
  Description of Artificial Sequence: Synthetic oligonucleotide
gaggacctgagctcctggaccgc

SEQ ID NO: 373728 - DNA, 23 bp, Artificial Sequence
  Description of Artificial Sequence: Synthetic oligonucleotide
aggacctgagctcctggaccgcg

SEQ ID NO: 373729 - DNA, 22 bp, Artificial Sequence
  Description of Artificial Sequence: Synthetic oligonucleotide
ggacctgagctcctggaccgcg

SEQ ID NO: 373730 - DNA, 22 bp, Artificial Sequence
  Description of Artificial Sequence: Synthetic oligonucleotide
gacctgagctcctggaccgcgg

SEQ ID NO: 373731 - DNA, 22 bp, Artificial Sequence
  Description of Artificial Sequence: Synthetic oligonucleotide
acctgagctcctggaccgcggc

SEQ ID NO: 373732 - DNA, 21 bp, Artificial Sequence
  Description of Artificial Sequence: Synthetic oligonucleotide
cctgagctcctggaccgcggc

SEQ ID NO: 373733 - DNA, 21 bp, Artificial Sequence
  Description of Artificial Sequence: Synthetic oligonucleotide
ctgagctcctggaccgcggcg

SEQ ID NO: 373734 - DNA, 22 bp, Artificial Sequence
  Description of Artificial Sequence: Synthetic oligonucleotide
tgagctcctggaccgcggcgga

SEQ ID NO: 373735 - DNA, 21 bp, Artificial Sequence
  Description of Artificial Sequence: Synthetic oligonucleotide
gagctcctggaccgcggcgga

SEQ ID NO: 373736 - DNA, 22 bp, Artificial Sequence
  Description of Artificial Sequence: Synthetic oligonucleotide
agctcctggaccgcggcggaca

SEQ ID NO: 373737 - DNA, 25 bp, Artificial Sequence
  Description of Artificial Sequence: Synthetic oligonucleotide
acaccgcggctcagatcacccagct

SEQ ID NO: 373738 - DNA, 24 bp, Artificial Sequence
  Description of Artificial Sequence: Synthetic oligonucleotide
caccgcggctcagatcacccagct

SEQ ID NO: 373739 - DNA, 26 bp, Artificial Sequence
  Description of Artificial Sequence: Synthetic oligonucleotide
accgcggctcagatcacccagctcaa

SEQ ID NO: 373740 - DNA, 25 bp, Artificial Sequence
  Description of Artificial Sequence: Synthetic oligonucleotide
ccgcggctcagatcacccagctcaa

SEQ ID NO: 373741 - DNA, 26 bp, Artificial Sequence
  Description of Artificial Sequence: Synthetic oligonucleotide
cgcggctcagatcacccagctcaagt

SEQ ID NO: 373742 - DNA, 26 bp, Artificial Sequence
  Description of Artificial Sequence: Synthetic oligonucleotide
gcggctcagatcacccagctcaagtg

SEQ ID NO: 373743 - DNA, 26 bp, Artificial Sequence
  Description of Artificial Sequence: Synthetic oligonucleotide
cggctcagatcacccagctcaagtgg

SEQ ID NO: 373744 - DNA, 27 bp, Artificial Sequence
  Description of Artificial Sequence: Synthetic oligonucleotide
ggctcagatcacccagctcaagtggga

SEQ ID NO: 373745 - DNA, 27 bp, Artificial Sequence
  Description of Artificial Sequence: Synthetic oligonucleotide
gctcagatcacccagctcaagtgggag

SEQ ID NO: 373746 - DNA, 27 bp, Artificial Sequence
  Description of Artificial Sequence: Synthetic oligonucleotide
ctcagatcacccagctcaagtgggagg

SEQ ID NO: 373747 - DNA, 27 bp, Artificial Sequence
  Description of Artificial Sequence: Synthetic oligonucleotide
tcagatcacccagctcaagtgggaggc

SEQ ID NO: 373748 - DNA, 26 bp, Artificial Sequence
  Description of Artificial Sequence: Synthetic oligonucleotide
cagatcacccagctcaagtgggaggc

SEQ ID NO: 373749 - DNA, 26 bp, Artificial Sequence
  Description of Artificial Sequence: Synthetic oligonucleotide
agatcacccagctcaagtgggaggcg

SEQ ID NO: 373750 - DNA, 25 bp, Artificial Sequence
  Description of Artificial Sequence: Synthetic oligonucleotide
gatcacccagctcaagtgggaggcg

SEQ ID NO: 373751 - DNA, 25 bp, Artificial Sequence
  Description of Artificial Sequence: Synthetic oligonucleotide
atcacccagctcaagtgggaggcgg

SEQ ID NO: 373752 - DNA, 24 bp, Artificial Sequence
  Description of Artificial Sequence: Synthetic oligonucleotide
tcacccagctcaagtgggaggcgg

SEQ ID NO: 373753 - DNA, 23 bp, Artificial Sequence
  Description of Artificial Sequence: Synthetic oligonucleotide
cacccagctcaagtgggaggcgg

SEQ ID NO: 373754 - DNA, 23 bp, Artificial Sequence
  Description of Artificial Sequence: Synthetic oligonucleotide
acccagctcaagtgggaggcggc

SEQ ID NO: 373755 - DNA, 22 bp, Artificial Sequence
  Description of Artificial Sequence: Synthetic oligonucleotide
cccagctcaagtgggaggcggc

SEQ ID NO: 373756 - DNA, 22 bp, Artificial Sequence
  Description of Artificial Sequence: Synthetic oligonucleotide
ccagctcaagtgggaggcggcc

SEQ ID NO: 373757 - DNA, 22 bp, Artificial Sequence
  Description of Artificial Sequence: Synthetic oligonucleotide
cagctcaagtgggaggcggccc

SEQ ID NO: 373758 - DNA, 23 bp, Artificial Sequence
  Description of Artificial Sequence: Synthetic oligonucleotide
agctcaagtgggaggcggcccgt

SEQ ID NO: 373759 - DNA, 22 bp, Artificial Sequence
  Description of Artificial Sequence: Synthetic oligonucleotide
gctcaagtgggaggcggcccgt

SEQ ID NO: 373760 - DNA, 23 bp, Artificial Sequence
  Description of Artificial Sequence: Synthetic oligonucleotide
ctcaagtgggaggcggcccgtgt

SEQ ID NO: 373761 - DNA, 23 bp, Artificial Sequence
  Description of Artificial Sequence: Synthetic oligonucleotide
tcaagtgggaggcggcccgtgtg

SEQ ID NO: 373762 - DNA, 27 bp, Artificial Sequence
  Description of Artificial Sequence: Synthetic oligonucleotide
ccctgagatgggagccatcttcccagt

SEQ ID NO: 373763 - DNA, 27 bp, Artificial Sequence
  Description of Artificial Sequence: Synthetic oligonucleotide
cctgagatgggagccatcttcccagtc

SEQ ID NO: 373764 - DNA, 27 bp, Artificial Sequence
  Description of Artificial Sequence: Synthetic oligonucleotide
ctgagatgggagccatcttcccagtcc

SEQ ID NO: 373765 - DNA, 28 bp, Artificial Sequence
  Description of Artificial Sequence: Synthetic oligonucleotide
tgagatgggagccatcttcccagtccac

SEQ ID NO: 373766 - DNA, 27 bp, Artificial Sequence
  Description of Artificial Sequence: Synthetic oligonucleotide
gagatgggagccatcttcccagtccac

SEQ ID NO: 373767 - DNA, 27 bp, Artificial Sequence
  Description of Artificial Sequence: Synthetic oligonucleotide
agatgggagccatcttcccagtccacc

SEQ ID NO: 373768 - DNA, 26 bp, Artificial Sequence
  Description of Artificial Sequence: Synthetic oligonucleotide
gatgggagccatcttcccagtccacc

SEQ ID NO: 373769 - DNA, 27 bp, Artificial Sequence
  Description of Artificial Sequence: Synthetic oligonucleotide
atgggagccatcttcccagtccaccgt

SEQ ID NO: 373770 - DNA, 26 bp, Artificial Sequence
  Description of Artificial Sequence: Synthetic oligonucleotide
tgggagccatcttcccagtccaccgt

SEQ ID NO: 373771 - DNA, 25 bp, Artificial Sequence
  Description of Artificial Sequence: Synthetic oligonucleotide
gggagccatcttcccagtccaccgt

SEQ ID NO: 373772 - DNA, 25 bp, Artificial Sequence
  Description of Artificial Sequence: Synthetic oligonucleotide
ggagccatcttcccagtccaccgtc

SEQ ID NO: 373773 - DNA, 25 bp, Artificial Sequence
  Description of Artificial Sequence: Synthetic oligonucleotide
gagccatcttcccagtccaccgtcc

SEQ ID NO: 373774 - DNA, 25 bp, Artificial Sequence
  Description of Artificial Sequence: Synthetic oligonucleotide
agccatcttcccagtccaccgtccc

SEQ ID NO: 373775 - DNA, 24 bp, Artificial Sequence
  Description of Artificial Sequence: Synthetic oligonucleotide
gccatcttcccagtccaccgtccc

SEQ ID NO: 373776 - DNA, 26 bp, Artificial Sequence
  Description of Artificial Sequence: Synthetic oligonucleotide
ccatcttcccagtccaccgtccccat

SEQ ID NO: 373777 - DNA, 26 bp, Artificial Sequence
  Description of Artificial Sequence: Synthetic oligonucleotide
catcttcccagtccaccgtccccatc

SEQ ID NO: 373778 - DNA, 27 bp, Artificial Sequence
  Description of Artificial Sequence: Synthetic oligonucleotide
atcttcccagtccaccgtccccatcgt

SEQ ID NO: 373779 - DNA, 24 bp, Artificial Sequence
  Description of Artificial Sequence: Synthetic oligonucleotide
gaggacctgagctcctggaccgca

SEQ ID NO: 373780 - DNA, 24 bp, Artificial Sequence
  Description of Artificial Sequence: Synthetic oligonucleotide
aggacctgagctcctggaccgcag

SEQ ID NO: 373781 - DNA, 23 bp, Artificial Sequence
  Description of Artificial Sequence: Synthetic oligonucleotide
ggacctgagctcctggaccgcag

SEQ ID NO: 373782 - DNA, 23 bp, Artificial Sequence
  Description of Artificial Sequence: Synthetic oligonucleotide
gacctgagctcctggaccgcagc

SEQ ID NO: 373783 - DNA, 23 bp, Artificial Sequence
  Description of Artificial Sequence: Synthetic oligonucleotide
acctgagctcctggaccgcagcg

SEQ ID NO: 373784 - DNA, 22 bp, Artificial Sequence
  Description of Artificial Sequence: Synthetic oligonucleotide
cctgagctcctggaccgcagcg

SEQ ID NO: 373785 - DNA, 23 bp, Artificial Sequence
  Description of Artificial Sequence: Synthetic oligonucleotide
ctgagctcctggaccgcagcgga

SEQ ID NO: 373786 - DNA, 24 bp, Artificial Sequence
  Description of Artificial Sequence: Synthetic oligonucleotide
tgagctcctggaccgcagcggaca

SEQ ID NO: 373787 - DNA, 23 bp, Artificial Sequence
  Description of Artificial Sequence: Synthetic oligonucleotide
gagctcctggaccgcagcggaca

SEQ ID NO: 373788 - DNA, 23 bp, Artificial Sequence
  Description of Artificial Sequence: Synthetic oligonucleotide
agctcctggaccgcagcggacac

SEQ ID NO: 373789 - DNA, 22 bp, Artificial Sequence
  Description of Artificial Sequence: Synthetic oligonucleotide
gctcctggaccgcagcggacac

SEQ ID NO: 373790 - DNA, 22 bp, Artificial Sequence
  Description of Artificial Sequence: Synthetic oligonucleotide
ctcctggaccgcagcggacacc

SEQ ID NO: 373791 - DNA, 22 bp, Artificial Sequence
  Description of Artificial Sequence: Synthetic oligonucleotide
tcctggaccgcagcggacaccg

SEQ ID NO: 373792 - DNA, 21 bp, Artificial Sequence
  Description of Artificial Sequence: Synthetic oligonucleotide
cctggaccgcagcggacaccg

SEQ ID NO: 373793 - DNA, 21 bp, Artificial Sequence
  Description of Artificial Sequence: Synthetic oligonucleotide
ctggaccgcagcggacaccgc

SEQ ID NO: 373794 - DNA, 21 bp, Artificial Sequence
  Description of Artificial Sequence: Synthetic oligonucleotide
tggaccgcagcggacaccgcg

SEQ ID NO: 373795 - DNA, 20 bp, Artificial Sequence
  Description of Artificial Sequence: Synthetic oligonucleotide
ggaccgcagcggacaccgcg

SEQ ID NO: 373796 - DNA, 20 bp, Artificial Sequence
  Description of Artificial Sequence: Synthetic oligonucleotide
gaccgcagcggacaccgcgg

SEQ ID NO: 373797 - DNA, 21 bp, Artificial Sequence
  Description of Artificial Sequence: Synthetic oligonucleotide
accgcagcggacaccgcggct

SEQ ID NO: 373798 - DNA, 20 bp, Artificial Sequence
  Description of Artificial Sequence: Synthetic oligonucleotide
ccgcagcggacaccgcggct

SEQ ID NO: 373799 - DNA, 21 bp, Artificial Sequence
  Description of Artificial Sequence: Synthetic oligonucleotide
cgcagcggacaccgcggctca

SEQ ID NO: 373800 - DNA, 23 bp, Artificial Sequence
  Description of Artificial Sequence: Synthetic oligonucleotide
gcagcggacaccgcggctcagat

SEQ ID NO: 373801 - DNA, 24 bp, Artificial Sequence
  Description of Artificial Sequence: Synthetic oligonucleotide
cagcggacaccgcggctcagatca

SEQ ID NO: 373802 - DNA, 24 bp, Artificial Sequence
  Description of Artificial Sequence: Synthetic oligonucleotide
agcggacaccgcggctcagatcac

SEQ ID NO: 373803 - DNA, 22 bp, Artificial Sequence
  Description of Artificial Sequence: Synthetic oligonucleotide
aaggagacgctgcagcgcgcgg

SEQ ID NO: 373804 - DNA, 21 bp, Artificial Sequence
  Description of Artificial Sequence: Synthetic oligonucleotide
gcgcctcctccgcgggcacaa

SEQ ID NO: 373805 - DNA, 21 bp, Artificial Sequence
  Description of Artificial Sequence: Synthetic oligonucleotide
cgcctcctccgcgggcacaac

SEQ ID NO: 373806 - DNA, 22 bp, Artificial Sequence
  Description of Artificial Sequence: Synthetic oligonucleotide
gcctcctccgcgggcacaacca

SEQ ID NO: 373807 - DNA, 25 bp, Artificial Sequence
  Description of Artificial Sequence: Synthetic oligonucleotide
cctcctccgcgggcacaaccagtta

SEQ ID NO: 373808 - DNA, 25 bp, Artificial Sequence
  Description of Artificial Sequence: Synthetic oligonucleotide
ctcctccgcgggcacaaccagttag

SEQ ID NO: 373809 - DNA, 25 bp, Artificial Sequence
  Description of Artificial Sequence: Synthetic oligonucleotide
tcctccgcgggcacaaccagttagc

SEQ ID NO: 373810 - DNA, 24 bp, Artificial Sequence
  Description of Artificial Sequence: Synthetic oligonucleotide
cctccgcgggcacaaccagttagc

SEQ ID NO: 373811 - DNA, 26 bp, Artificial Sequence
  Description of Artificial Sequence: Synthetic oligonucleotide
ctccgcgggcacaaccagttagccta

SEQ ID NO: 373812 - DNA, 26 bp, Artificial Sequence
  Description of Artificial Sequence: Synthetic oligonucleotide
tccgcgggcacaaccagttagcctac

SEQ ID NO: 373813 - DNA, 25 bp, Artificial Sequence
  Description of Artificial Sequence: Synthetic oligonucleotide
ccgcgggcacaaccagttagcctac

SEQ ID NO: 373814 - DNA, 26 bp, Artificial Sequence
  Description of Artificial Sequence: Synthetic oligonucleotide
cgcgggcacaaccagttagcctacga

SEQ ID NO: 373815 - DNA, 26 bp, Artificial Sequence
  Description of Artificial Sequence: Synthetic oligonucleotide
gcgggcacaaccagttagcctacgac

SEQ ID NO: 373816 - DNA, 26 bp, Artificial Sequence
  Description of Artificial Sequence: Synthetic oligonucleotide
cgggcacaaccagttagcctacgacg

SEQ ID NO: 373817 - DNA, 26 bp, Artificial Sequence
  Description of Artificial Sequence: Synthetic oligonucleotide
gggcacaaccagttagcctacgacgg

SEQ ID NO: 373818 - DNA, 27 bp, Artificial Sequence
  Description of Artificial Sequence: Synthetic oligonucleotide
ggcacaaccagttagcctacgacggca

SEQ ID NO: 373819 - DNA, 28 bp, Artificial Sequence
  Description of Artificial Sequence: Synthetic oligonucleotide
gcacaaccagttagcctacgacggcaag

SEQ ID NO: 373820 - DNA, 28 bp, Artificial Sequence
  Description of Artificial Sequence: Synthetic oligonucleotide
cacaaccagttagcctacgacggcaagg

SEQ ID NO: 373821 - DNA, 32 bp, Artificial Sequence; identical to SEQ ID NO: 26197
  Description of Artificial Sequence: Synthetic oligonucleotide

SEQ ID NO: 373822 - DNA, 31 bp, Artificial Sequence; identical to SEQ ID NO: 26198
  Description of Artificial Sequence: Synthetic oligonucleotide

SEQ ID NO: 373823 - DNA, 27 bp, Artificial Sequence
  Description of Artificial Sequence: Synthetic oligonucleotide
agtgcgtggagtggctccgcagatact

SEQ ID NO: 373824 - DNA, 28 bp, Artificial Sequence
  Description of Artificial Sequence: Synthetic oligonucleotide
agatgggagccatcttcccagtccactg

SEQ ID NO: 373825 - DNA, 27 bp, Artificial Sequence
  Description of Artificial Sequence: Synthetic oligonucleotide
gatgggagccatcttcccagtccactg

SEQ ID NO: 373826 - DNA, 28 bp, Artificial Sequence
  Description of Artificial Sequence: Synthetic oligonucleotide
atgggagccatcttcccagtccactgtc

SEQ ID NO: 373827 - DNA, 27 bp, Artificial Sequence
  Description of Artificial Sequence: Synthetic oligonucleotide
tgggagccatcttcccagtccactgtc

SEQ ID NO: 373828 - DNA, 26 bp, Artificial Sequence
  Description of Artificial Sequence: Synthetic oligonucleotide
gggagccatcttcccagtccactgtc

SEQ ID NO: 373829 - DNA, 26 bp, Artificial Sequence
  Description of Artificial Sequence: Synthetic oligonucleotide
ggagccatcttcccagtccactgtcc

SEQ ID NO: 373830 - DNA, 26 bp, Artificial Sequence
  Description of Artificial Sequence: Synthetic oligonucleotide
gagccatcttcccagtccactgtccc

SEQ ID NO: 373831 - DNA, 27 bp, Artificial Sequence
  Description of Artificial Sequence: Synthetic oligonucleotide
agccatcttcccagtccactgtcccca

SEQ ID NO: 373832 - DNA, 27 bp, Artificial Sequence
  Description of Artificial Sequence: Synthetic oligonucleotide
gccatcttcccagtccactgtccccat

SEQ ID NO: 373833 - DNA, 27 bp, Artificial Sequence
  Description of Artificial Sequence: Synthetic oligonucleotide
ccatcttcccagtccactgtccccatc

SEQ ID NO: 373834 - DNA, 27 bp, Artificial Sequence
  Description of Artificial Sequence: Synthetic oligonucleotide
catcttcccagtccactgtccccatcg

SEQ ID NO: 373835 - DNA, 28 bp, Artificial Sequence
  Description of Artificial Sequence: Synthetic oligonucleotide
atcttcccagtccactgtccccatcgtg

SEQ ID NO: 373836 - DNA, 27 bp, Artificial Sequence
  Description of Artificial Sequence: Synthetic oligonucleotide
tcttcccagtccactgtccccatcgtg

SEQ ID NO: 373837 - DNA, 26 bp, Artificial Sequence
  Description of Artificial Sequence: Synthetic oligonucleotide
cttcccagtccactgtccccatcgtg

SEQ ID NO: 373838 - DNA, 26 bp, Artificial Sequence
  Description of Artificial Sequence: Synthetic oligonucleotide
ttcccagtccactgtccccatcgtgg

SEQ ID NO: 373839 - DNA, 25 bp, Artificial Sequence
  Description of Artificial Sequence: Synthetic oligonucleotide
tcccagtccactgtccccatcgtgg

SEQ ID NO: 373840 - DNA, 24 bp, Artificial Sequence
  Description of Artificial Sequence: Synthetic oligonucleotide
cccagtccactgtccccatcgtgg

SEQ ID NO: 373841 - DNA, 24 bp, Artificial Sequence
  Description of Artificial Sequence: Synthetic oligonucleotide
ccagtccactgtccccatcgtggg

SEQ ID NO: 373842 - DNA, 27 bp, Artificial Sequence
  Description of Artificial Sequence: Synthetic oligonucleotide
cagtccactgtccccatcgtgggcatt

SEQ ID NO: 373843 - DNA, 27 bp, Artificial Sequence
  Description of Artificial Sequence: Synthetic oligonucleotide
agtccactgtccccatcgtgggcattg

SEQ ID NO: 373844 - DNA, 27 bp, Artificial Sequence
  Description of Artificial Sequence: Synthetic oligonucleotide
gtccactgtccccatcgtgggcattgt

SEQ ID NO: 373845 - DNA, 28 bp, Artificial Sequence
  Description of Artificial Sequence: Synthetic oligonucleotide
tccactgtccccatcgtgggcattgttg

SEQ ID NO: 373846 - DNA, 27 bp, Artificial Sequence
  Description of Artificial Sequence: Synthetic oligonucleotide
ccactgtccccatcgtgggcattgttg

SEQ ID NO: 373847 - DNA, 27 bp, Artificial Sequence
  Description of Artificial Sequence: Synthetic oligonucleotide
cactgtccccatcgtgggcattgttgc

SEQ ID NO: 373848 - DNA, 28 bp, Artificial Sequence
  Description of Artificial Sequence: Synthetic oligonucleotide
actgtccccatcgtgggcattgttgctg

SEQ ID NO: 373849 - DNA, 27 bp, Artificial Sequence
  Description of Artificial Sequence: Synthetic oligonucleotide
ctgtccccatcgtgggcattgttgctg

SEQ ID NO: 373850 - DNA, 27 bp, Artificial Sequence
  Description of Artificial Sequence: Synthetic oligonucleotide
tgtccccatcgtgggcattgttgctgg

SEQ ID NO: 373851 - DNA, 20 bp, Artificial Sequence
  Description of Artificial Sequence: Synthetic oligonucleotide
cgaggatggcgccccgggca

SEQ ID NO: 373852 - DNA, 20 bp, Artificial Sequence
  Description of Artificial Sequence: Synthetic oligonucleotide
gaggatggcgccccgggcac

SEQ ID NO: 373853 - DNA, 22 bp, Artificial Sequence
  Description of Artificial Sequence: Synthetic oligonucleotide
aggatggcgccccgggcaccat

SEQ ID NO: 373854 - DNA, 21 bp, Artificial Sequence
  Description of Artificial Sequence: Synthetic oligonucleotide
ggatggcgccccgggcaccat

SEQ ID NO: 373855 - DNA, 21 bp, Artificial Sequence
  Description of Artificial Sequence: Synthetic oligonucleotide
gatggcgccccgggcaccatg

SEQ ID NO: 373856 - DNA, 24 bp, Artificial Sequence
  Description of Artificial Sequence: Synthetic oligonucleotide
atggcgccccgggcaccatggata

SEQ ID NO: 373857 - DNA, 23 bp, Artificial Sequence
  Description of Artificial Sequence: Synthetic oligonucleotide
tggcgccccgggcaccatggata

SEQ ID NO: 373858 - DNA, 22 bp, Artificial Sequence
  Description of Artificial Sequence: Synthetic oligonucleotide
ggcgccccgggcaccatggata

SEQ ID NO: 373859 - DNA, 23 bp, Artificial Sequence
  Description of Artificial Sequence: Synthetic oligonucleotide
gcgccccgggcaccatggataga

SEQ ID NO: 373860 - DNA, 23 bp, Artificial Sequence
  Description of Artificial Sequence: Synthetic oligonucleotide
cgccccgggcaccatggatagag

SEQ ID NO: 373861 - DNA, 24 bp, Artificial Sequence
  Description of Artificial Sequence: Synthetic oligonucleotide
gccccgggcaccatggatagagca

SEQ ID NO: 373862 - DNA, 24 bp, Artificial Sequence
  Description of Artificial Sequence: Synthetic oligonucleotide
ccccgggcaccatggatagagcag

SEQ ID NO: 373863 - DNA, 25 bp, Artificial Sequence
  Description of Artificial Sequence: Synthetic oligonucleotide
cccgggcaccatggatagagcagga

SEQ ID NO: 373864 - DNA, 25 bp, Artificial Sequence
  Description of Artificial Sequence: Synthetic oligonucleotide
ccgggcaccatggatagagcaggag

SEQ ID NO: 373865 - DNA, 25 bp, Artificial Sequence
  Description of Artificial Sequence: Synthetic oligonucleotide
cgggcaccatggatagagcaggagg

SEQ ID NO: 373866 - DNA, 25 bp, Artificial Sequence
  Description of Artificial Sequence: Synthetic oligonucleotide
gggcaccatggatagagcaggaggg

SEQ ID NO: 373867 - DNA, 25 bp, Artificial Sequence
  Description of Artificial Sequence: Synthetic oligonucleotide
ggcaccatggatagagcaggagggg

SEQ ID NO: 373868 - DNA, 25 bp, Artificial Sequence
  Description of Artificial Sequence: Synthetic oligonucleotide
gcaccatggatagagcaggaggggc

SEQ ID NO: 373869 - DNA, 25 bp, Artificial Sequence
  Description of Artificial Sequence: Synthetic oligonucleotide
caccatggatagagcaggaggggcc

SEQ ID NO: 373870 - DNA, 25 bp, Artificial Sequence
  Description of Artificial Sequence: Synthetic oligonucleotide
accatggatagagcaggaggggccg

SEQ ID NO: 373871 - DNA, 25 bp, Artificial Sequence
  Description of Artificial Sequence: Synthetic oligonucleotide
cagagcgaggccgggtctcacactt

SEQ ID NO: 373872 - DNA, 25 bp, Artificial Sequence
  Description of Artificial Sequence: Synthetic oligonucleotide
agagcgaggccgggtctcacacttg

SEQ ID NO: 373873 - DNA, 24 bp, Artificial Sequence
  Description of Artificial Sequence: Synthetic oligonucleotide
gagcgaggccgggtctcacacttg

SEQ ID NO: 373874 - DNA, 24 bp, Artificial Sequence
  Description of Artificial Sequence: Synthetic oligonucleotide
agcgaggccgggtctcacacttgg

SEQ ID NO: 373875 - DNA, 23 bp, Artificial Sequence
  Description of Artificial Sequence: Synthetic oligonucleotide
gcgaggccgggtctcacacttgg

SEQ ID NO: 373876 - DNA, 24 bp, Artificial Sequence
  Description of Artificial Sequence: Synthetic oligonucleotide
cgaggccgggtctcacacttggca

SEQ ID NO: 373877 - DNA, 25 bp, Artificial Sequence
  Description of Artificial Sequence: Synthetic oligonucleotide
gaggccgggtctcacacttggcaga

SEQ ID NO: 373878 - DNA, 25 bp, Artificial Sequence
  Description of Artificial Sequence: Synthetic oligonucleotide
aggccgggtctcacacttggcagac

SEQ ID NO: 373879 - DNA, 24 bp, Artificial Sequence
  Description of Artificial Sequence: Synthetic oligonucleotide
ggccgggtctcacacttggcagac

SEQ ID NO: 373880 - DNA, 26 bp, Artificial Sequence
  Description of Artificial Sequence: Synthetic oligonucleotide
gccgggtctcacacttggcagacgat

SEQ ID NO: 373881 - DNA, 27 bp, Artificial Sequence
  Description of Artificial Sequence: Synthetic oligonucleotide
ccgggtctcacacttggcagacgatgt

SEQ ID NO: 373882 - DNA, 29 bp, Artificial Sequence
  Description of Artificial Sequence: Synthetic oligonucleotide
cgggtctcacacttggcagacgatgtatg

SEQ ID NO: 373883 - DNA, 29 bp, Artificial Sequence
  Description of Artificial Sequence: Synthetic oligonucleotide
gggtctcacacttggcagacgatgtatgg

SEQ ID NO: 373884 - DNA, 29 bp, Artificial Sequence
  Description of Artificial Sequence: Synthetic oligonucleotide
ggtctcacacttggcagacgatgtatggc

SEQ ID NO: 373885 - DNA, 30 bp, Artificial Sequence; identical to SEQ ID NO: 24515
  Description of Artificial Sequence: Synthetic oligonucleotide

SEQ ID NO: 373886 - DNA, 30 bp, Artificial Sequence; identical to SEQ ID NO: 24516
  Description of Artificial Sequence: Synthetic oligonucleotide

SEQ ID NO: 373887 - DNA, 29 bp, Artificial Sequence
  Description of Artificial Sequence: Synthetic oligonucleotide
ctcacacttggcagacgatgtatggctgc

SEQ ID NO: 373888 - DNA, 29 bp, Artificial Sequence
  Description of Artificial Sequence: Synthetic oligonucleotide
tcacacttggcagacgatgtatggctgcg

SEQ ID NO: 373889 - DNA, 28 bp, Artificial Sequence
  Description of Artificial Sequence: Synthetic oligonucleotide
cacacttggcagacgatgtatggctgcg

SEQ ID NO: 373890 - DNA, 29 bp, Artificial Sequence
  Description of Artificial Sequence: Synthetic oligonucleotide
acacttggcagacgatgtatggctgcgac

SEQ ID NO: 373891 - DNA, 28 bp, Artificial Sequence
  Description of Artificial Sequence: Synthetic oligonucleotide
cacttggcagacgatgtatggctgcgac

SEQ ID NO: 373892 - DNA, 28 bp, Artificial Sequence
  Description of Artificial Sequence: Synthetic oligonucleotide
acttggcagacgatgtatggctgcgacc

SEQ ID NO: 373893 - DNA, 27 bp, Artificial Sequence
  Description of Artificial Sequence: Synthetic oligonucleotide
cttggcagacgatgtatggctgcgacc

SEQ ID NO: 373894 - DNA, 28 bp, Artificial Sequence
  Description of Artificial Sequence: Synthetic oligonucleotide
ttggcagacgatgtatggctgcgacctg

SEQ ID NO: 373895 - DNA, 27 bp, Artificial Sequence
  Description of Artificial Sequence: Synthetic oligonucleotide
tggcagacgatgtatggctgcgacctg

SEQ ID NO: 373896 - DNA, 26 bp, Artificial Sequence
  Description of Artificial Sequence: Synthetic oligonucleotide
ggcagacgatgtatggctgcgacctg

SEQ ID NO: 373897 - DNA, 26 bp, Artificial Sequence
  Description of Artificial Sequence: Synthetic oligonucleotide
gcagacgatgtatggctgcgacctgg

SEQ ID NO: 373898 - DNA, 26 bp, Artificial Sequence
  Description of Artificial Sequence: Synthetic oligonucleotide
cagacgatgtatggctgcgacctggg

SEQ ID NO: 373899 - DNA, 26 bp, Artificial Sequence
  Description of Artificial Sequence: Synthetic oligonucleotide
agacgatgtatggctgcgacctgggg

SEQ ID NO: 373900 - DNA, 25 bp, Artificial Sequence
  Description of Artificial Sequence: Synthetic oligonucleotide
gacgatgtatggctgcgacctgggg

SEQ ID NO: 373901 - DNA, 25 bp, Artificial Sequence
  Description of Artificial Sequence: Synthetic oligonucleotide
acgatgtatggctgcgacctggggc

SEQ ID NO: 373902 - DNA, 24 bp, Artificial Sequence
  Description of Artificial Sequence: Synthetic oligonucleotide
cgatgtatggctgcgacctggggc

SEQ ID NO: 373903 - DNA, 28 bp, Artificial Sequence
  Description of Artificial Sequence: Synthetic oligonucleotide
acccagttcgtgaggttcgacagcgatg

SEQ ID NO: 373904 - DNA, 27 bp, Artificial Sequence
  Description of Artificial Sequence: Synthetic oligonucleotide
cccagttcgtgaggttcgacagcgatg

SEQ ID NO: 373905 - DNA, 27 bp, Artificial Sequence
  Description of Artificial Sequence: Synthetic oligonucleotide
ccagttcgtgaggttcgacagcgatgc

SEQ ID NO: 373906 - DNA, 27 bp, Artificial Sequence
  Description of Artificial Sequence: Synthetic oligonucleotide
cagttcgtgaggttcgacagcgatgcc

SEQ ID NO: 373907 - DNA, 28 bp, Artificial Sequence
  Description of Artificial Sequence: Synthetic oligonucleotide
agttcgtgaggttcgacagcgatgccac

SEQ ID NO: 373908 - DNA, 27 bp, Artificial Sequence
  Description of Artificial Sequence: Synthetic oligonucleotide
gttcgtgaggttcgacagcgatgccac

SEQ ID NO: 373909 - DNA, 27 bp, Artificial Sequence
  Description of Artificial Sequence: Synthetic oligonucleotide
ttcgtgaggttcgacagcgatgccacg

SEQ ID NO: 373910 - DNA, 27 bp, Artificial Sequence
  Description of Artificial Sequence: Synthetic oligonucleotide
tcgtgaggttcgacagcgatgccacga

SEQ ID NO: 373911 - DNA, 26 bp, Artificial Sequence
  Description of Artificial Sequence: Synthetic oligonucleotide
cgtgaggttcgacagcgatgccacga

SEQ ID NO: 373912 - DNA, 27 bp, Artificial Sequence
  Description of Artificial Sequence: Synthetic oligonucleotide
gtgaggttcgacagcgatgccacgagt

SEQ ID NO: 373913 - DNA, 27 bp, Artificial Sequence
  Description of Artificial Sequence: Synthetic oligonucleotide
tgaggttcgacagcgatgccacgagtc

SEQ ID NO: 373914 - DNA, 26 bp, Artificial Sequence
  Description of Artificial Sequence: Synthetic oligonucleotide
gaggttcgacagcgatgccacgagtc

SEQ ID NO: 373915 - DNA, 26 bp, Artificial Sequence
  Description of Artificial Sequence: Synthetic oligonucleotide
aggttcgacagcgatgccacgagtcc

SEQ ID NO: 373916 - DNA, 25 bp, Artificial Sequence
  Description of Artificial Sequence: Synthetic oligonucleotide
ggttcgacagcgatgccacgagtcc

SEQ ID NO: 373917 - DNA, 26 bp, Artificial Sequence
  Description of Artificial Sequence: Synthetic oligonucleotide
gttcgacagcgatgccacgagtccga

SEQ ID NO: 373918 - DNA, 26 bp, Artificial Sequence
  Description of Artificial Sequence: Synthetic oligonucleotide
ttcgacagcgatgccacgagtccgag

SEQ ID NO: 373919 - DNA, 25 bp, Artificial Sequence
  Description of Artificial Sequence: Synthetic oligonucleotide
tcgacagcgatgccacgagtccgag

SEQ ID NO: 373920 - DNA, 24 bp, Artificial Sequence
  Description of Artificial Sequence: Synthetic oligonucleotide
cgacagcgatgccacgagtccgag

SEQ ID NO: 373921 - DNA, 26 bp, Artificial Sequence
  Description of Artificial Sequence: Synthetic oligonucleotide
gacagcgatgccacgagtccgaggat

SEQ ID NO: 373922 - DNA, 26 bp, Artificial Sequence
  Description of Artificial Sequence: Synthetic oligonucleotide
acagcgatgccacgagtccgaggatg

SEQ ID NO: 373923 - DNA, 25 bp, Artificial Sequence
  Description of Artificial Sequence: Synthetic oligonucleotide
cagcgatgccacgagtccgaggatg

SEQ ID NO: 373924 - DNA, 25 bp, Artificial Sequence
  Description of Artificial Sequence: Synthetic oligonucleotide
agcgatgccacgagtccgaggatgg

SEQ ID NO: 373925 - DNA, 24 bp, Artificial Sequence
  Description of Artificial Sequence: Synthetic oligonucleotide
gcgatgccacgagtccgaggatgg

SEQ ID NO: 373926 - DNA, 24 bp, Artificial Sequence
  Description of Artificial Sequence: Synthetic oligonucleotide
cgatgccacgagtccgaggatggc

SEQ ID NO: 373927 - DNA, 24 bp, Artificial Sequence
  Description of Artificial Sequence: Synthetic oligonucleotide
gatgccacgagtccgaggatggcg

SEQ ID NO: 373928 - DNA, 24 bp, Artificial Sequence
  Description of Artificial Sequence: Synthetic oligonucleotide
atgccacgagtccgaggatggcgc

SEQ ID NO: 373929 - DNA, 23 bp, Artificial Sequence
  Description of Artificial Sequence: Synthetic oligonucleotide
tgccacgagtccgaggatggcgc

SEQ ID NO: 373930 - DNA, 28 bp, Artificial Sequence
  Description of Artificial Sequence: Synthetic oligonucleotide
tatttctacaccgccatgtcccggcctg

SEQ ID NO: 373931 - DNA, 27 bp, Artificial Sequence
  Description of Artificial Sequence: Synthetic oligonucleotide
atttctacaccgccatgtcccggcctg

SEQ ID NO: 373932 - DNA, 26 bp, Artificial Sequence
  Description of Artificial Sequence: Synthetic oligonucleotide
tttctacaccgccatgtcccggcctg

SEQ ID NO: 373933 - DNA, 25 bp, Artificial Sequence
  Description of Artificial Sequence: Synthetic oligonucleotide
ttctacaccgccatgtcccggcctg

SEQ ID NO: 373934 - DNA, 24 bp, Artificial Sequence
  Description of Artificial Sequence: Synthetic oligonucleotide
tctacaccgccatgtcccggcctg

SEQ ID NO: 373935 - DNA, 23 bp, Artificial Sequence
  Description of Artificial Sequence: Synthetic oligonucleotide
ctacaccgccatgtcccggcctg

SEQ ID NO: 373936 - DNA, 23 bp, Artificial Sequence
  Description of Artificial Sequence: Synthetic oligonucleotide
tacaccgccatgtcccggcctgg

SEQ ID NO: 373937 - DNA, 22 bp, Artificial Sequence
  Description of Artificial Sequence: Synthetic oligonucleotide
acaccgccatgtcccggcctgg

SEQ ID NO: 373938 - DNA, 21 bp, Artificial Sequence
  Description of Artificial Sequence: Synthetic oligonucleotide
caccgccatgtcccggcctgg

SEQ ID NO: 373939 - DNA, 21 bp, Artificial Sequence
  Description of Artificial Sequence: Synthetic oligonucleotide
accgccatgtcccggcctggc

SEQ ID NO: 373940 - DNA, 20 bp, Artificial Sequence
  Description of Artificial Sequence: Synthetic oligonucleotide
ccgccatgtcccggcctggc

SEQ ID NO: 373941 - DNA, 20 bp, Artificial Sequence
  Description of Artificial Sequence: Synthetic oligonucleotide
cgccatgtcccggcctggcc

SEQ ID NO: 373942 - DNA, 20 bp, Artificial Sequence
  Description of Artificial Sequence: Synthetic oligonucleotide
gccatgtcccggcctggccg

SEQ ID NO: 373943 - DNA, 20 bp, Artificial Sequence
  Description of Artificial Sequence: Synthetic oligonucleotide
ccatgtcccggcctggccgc

SEQ ID NO: 373944 - DNA, 20 bp, Artificial Sequence
  Description of Artificial Sequence: Synthetic oligonucleotide
catgtcccggcctggccgcg

SEQ ID NO: 373945 - DNA, 20 bp, Artificial Sequence
  Description of Artificial Sequence: Synthetic oligonucleotide
atgtcccggcctggccgcgg

SEQ ID NO: 373946 - DNA, 24 bp, Artificial Sequence
  Description of Artificial Sequence: Synthetic oligonucleotide
ggctgccgaagcccctcaccctaa

SEQ ID NO: 373947 - DNA, 26 bp, Artificial Sequence
  Description of Artificial Sequence: Synthetic oligonucleotide
gctgccgaagcccctcaccctaagat

SEQ ID NO: 373948 - DNA, 26 bp, Artificial Sequence
  Description of Artificial Sequence: Synthetic oligonucleotide
ctgccgaagcccctcaccctaagatg

SEQ ID NO: 373949 - DNA, 26 bp, Artificial Sequence
  Description of Artificial Sequence: Synthetic oligonucleotide
tgccgaagcccctcaccctaagatgg

SEQ ID NO: 373950 - DNA, 25 bp, Artificial Sequence
  Description of Artificial Sequence: Synthetic oligonucleotide
gccgaagcccctcaccctaagatgg

SEQ ID NO: 373951 - DNA, 25 bp, Artificial Sequence
  Description of Artificial Sequence: Synthetic oligonucleotide
ccgaagcccctcaccctaagatggg

SEQ ID NO: 373952 - DNA, 24 bp, Artificial Sequence
  Description of Artificial Sequence: Synthetic oligonucleotide
atgtatggctgcgacctggggccc

SEQ ID NO: 373953 - DNA, 23 bp, Artificial Sequence
  Description of Artificial Sequence: Synthetic oligonucleotide
tgtatggctgcgacctggggccc

SEQ ID NO: 373954 - DNA, 22 bp, Artificial Sequence
  Description of Artificial Sequence: Synthetic oligonucleotide
gtatggctgcgacctggggccc

SEQ ID NO: 373955 - DNA, 23 bp, Artificial Sequence
  Description of Artificial Sequence: Synthetic oligonucleotide
tatggctgcgacctggggcccga

SEQ ID NO: 373956 - DNA, 22 bp, Artificial Sequence
  Description of Artificial Sequence: Synthetic oligonucleotide
atggctgcgacctggggcccga

SEQ ID NO: 373957 - DNA, 21 bp, Artificial Sequence
  Description of Artificial Sequence: Synthetic oligonucleotide
tggctgcgacctggggcccga

SEQ ID NO: 373958 - DNA, 20 bp, Artificial Sequence
  Description of Artificial Sequence: Synthetic oligonucleotide
ggctgcgacctggggcccga

SEQ ID NO: 373959 - DNA, 20 bp, Artificial Sequence
  Description of Artificial Sequence: Synthetic oligonucleotide
gctgcgacctggggcccgac

SEQ ID NO: 373960 - DNA, 20 bp, Artificial Sequence
  Description of Artificial Sequence: Synthetic oligonucleotide
ctgcgacctggggcccgacg

SEQ ID NO: 373961 - DNA, 20 bp, Artificial Sequence
  Description of Artificial Sequence: Synthetic oligonucleotide
tgcgacctggggcccgacgg

SEQ ID NO: 373962 - DNA, 20 bp, Artificial Sequence
  Description of Artificial Sequence: Synthetic oligonucleotide
gcgacctggggcccgacggt

SEQ ID NO: 373963 - DNA, 20 bp, Artificial Sequence
  Description of Artificial Sequence: Synthetic oligonucleotide
cgacctggggcccgacgggt

SEQ ID NO: 373964 - DNA, 20 bp, Artificial Sequence
  Description of Artificial Sequence: Synthetic oligonucleotide
gacctggggcccgacgggct

SEQ ID NO: 373965 - DNA, 20 bp, Artificial Sequence
  Description of Artificial Sequence: Synthetic oligonucleotide
acctggggcccgacgggcgt

SEQ ID NO: 373966 - DNA, 20 bp, Artificial Sequence
  Description of Artificial Sequence: Synthetic oligonucleotide
cctggggcccgacgggcgtt

SEQ ID NO: 373967 - DNA, 20 bp, Artificial Sequence
  Description of Artificial Sequence: Synthetic oligonucleotide
ctggggcccgacgggcgctt

SEQ ID NO: 373968 - DNA, 20 bp, Artificial Sequence
  Description of Artificial Sequence: Synthetic oligonucleotide
tggggcccgacgggcgcctt

SEQ ID NO: 373969 - DNA, 20 bp, Artificial Sequence
  Description of Artificial Sequence: Synthetic oligonucleotide
ggggcccgacgggcgccttt

SEQ ID NO: 373970 - DNA, 20 bp, Artificial Sequence
  Description of Artificial Sequence: Synthetic oligonucleotide
gggcccgacgggcgcctctt

SEQ ID NO: 373971 - DNA, 20 bp, Artificial Sequence
  Description of Artificial Sequence: Synthetic oligonucleotide
ggcccgacgggcgcctcctt

SEQ ID NO: 373972 - DNA, 20 bp, Artificial Sequence
  Description of Artificial Sequence: Synthetic oligonucleotide
gcccgacgggcgcctcctct

SEQ ID NO: 373973 - DNA, 20 bp, Artificial Sequence
  Description of Artificial Sequence: Synthetic oligonucleotide
cccgacgggcgcctcctcct

SEQ ID NO: 373974 - DNA, 20 bp, Artificial Sequence
  Description of Artificial Sequence: Synthetic oligonucleotide
ccgacgggcgcctcctccgt

SEQ ID NO: 373975 - DNA, 20 bp, Artificial Sequence
  Description of Artificial Sequence: Synthetic oligonucleotide
cgacgggcgcctcctccgct

SEQ ID NO: 373976 - DNA, 24 bp, Artificial Sequence
  Description of Artificial Sequence: Synthetic oligonucleotide
ccatggatagagcaggaggggccc

SEQ ID NO: 373977 - DNA, 25 bp, Artificial Sequence
  Description of Artificial Sequence: Synthetic oligonucleotide
catggatagagcaggaggggcccga

SEQ ID NO: 373978 - DNA, 27 bp, Artificial Sequence
  Description of Artificial Sequence: Synthetic oligonucleotide
atggatagagcaggaggggcccgagta

SEQ ID NO: 373979 - DNA, 24 bp, Artificial Sequence
  Description of Artificial Sequence: Synthetic oligonucleotide
aggaggggcccgagtattgggacc

SEQ ID NO: 373980 - DNA, 23 bp, Artificial Sequence
  Description of Artificial Sequence: Synthetic oligonucleotide
ggaggggcccgagtattgggacc

SEQ ID NO: 373981 - DNA, 23 bp, Artificial Sequence
  Description of Artificial Sequence: Synthetic oligonucleotide
gaggggcccgagtattgggaccg

SEQ ID NO: 373982 - DNA, 23 bp, Artificial Sequence
  Description of Artificial Sequence: Synthetic oligonucleotide
aggggcccgagtattgggaccgg

SEQ ID NO: 373983 - DNA, 22 bp, Artificial Sequence
  Description of Artificial Sequence: Synthetic oligonucleotide
ggggcccgagtattgggaccgg

SEQ ID NO: 373984 - DNA, 23 bp, Artificial Sequence
  Description of Artificial Sequence: Synthetic oligonucleotide
gggcccgagtattgggaccggga

SEQ ID NO: 373985 - DNA, 24 bp, Artificial Sequence
  Description of Artificial Sequence: Synthetic oligonucleotide
ggcccgagtattgggaccgggaga

SEQ ID NO: 373986 - DNA, 25 bp, Artificial Sequence
  Description of Artificial Sequence: Synthetic oligonucleotide
gcccgagtattgggaccgggagaca

SEQ ID NO: 373987 - DNA, 26 bp, Artificial Sequence
  Description of Artificial Sequence: Synthetic oligonucleotide
cccgagtattgggaccgggagacaca

SEQ ID NO: 373988 - DNA, 27 bp, Artificial Sequence
  Description of Artificial Sequence: Synthetic oligonucleotide
ccgagtattgggaccgggagacacaga

SEQ ID NO: 373989 - DNA, 28 bp, Artificial Sequence
  Description of Artificial Sequence: Synthetic oligonucleotide
cgagtattgggaccgggagacacagatc

SEQ ID NO: 373990 - DNA, 27 bp, Artificial Sequence
  Description of Artificial Sequence: Synthetic oligonucleotide
gtgggctacgtggacgacacccagttt

SEQ ID NO: 373991 - DNA, 27 bp, Artificial Sequence
  Description of Artificial Sequence: Synthetic oligonucleotide
tgggctacgtggacgacacccagtttg

SEQ ID NO: 373992 - DNA, 27 bp, Artificial Sequence
  Description of Artificial Sequence: Synthetic oligonucleotide
gggctacgtggacgacacccagtttgt

SEQ ID NO: 373993 - DNA, 27 bp, Artificial Sequence
  Description of Artificial Sequence: Synthetic oligonucleotide
ggctacgtggacgacacccagtttgtg

SEQ ID NO: 373994 - DNA, 28 bp, Artificial Sequence
  Description of Artificial Sequence: Synthetic oligonucleotide
gctacgtggacgacacccagtttgtgag

SEQ ID NO: 373995 - DNA, 28 bp, Artificial Sequence
  Description of Artificial Sequence: Synthetic oligonucleotide
ctacgtggacgacacccagtttgtgagg

SEQ ID NO: 373996 - DNA, 30 bp, Artificial Sequence; identical to SEQ ID NO: 26327
  Description of Artificial Sequence: Synthetic oligonucleotide

SEQ ID NO: 373997 - DNA, 29 bp, Artificial Sequence
  Description of Artificial Sequence: Synthetic oligonucleotide
acgtggacgacacccagtttgtgaggttc

SEQ ID NO: 373998 - DNA, 28 bp, Artificial Sequence
  Description of Artificial Sequence: Synthetic oligonucleotide
cgtggacgacacccagtttgtgaggttc

SEQ ID NO: 373999 - DNA, 28 bp, Artificial Sequence
  Description of Artificial Sequence: Synthetic oligonucleotide
gtggacgacacccagtttgtgaggttcg

SEQ ID NO: 374000 - DNA, 29 bp, Artificial Sequence
  Description of Artificial Sequence: Synthetic oligonucleotide
tggacgacacccagtttgtgaggttcgac

SEQ ID NO: 374001 - DNA, 28 bp, Artificial Sequence
  Description of Artificial Sequence: Synthetic oligonucleotide
ggacgacacccagtttgtgaggttcgac

SEQ ID NO: 374002 - DNA, 29 bp, Artificial Sequence
  Description of Artificial Sequence: Synthetic oligonucleotide
gacgacacccagtttgtgaggttcgacag

SEQ ID NO: 374003 - DNA, 29 bp, Artificial Sequence
  Description of Artificial Sequence: Synthetic oligonucleotide
acgacacccagtttgtgaggttcgacagc

SEQ ID NO: 374004 - DNA, 28 bp, Artificial Sequence
  Description of Artificial Sequence: Synthetic oligonucleotide
cgacacccagtttgtgaggttcgacagc

SEQ ID NO: 374005 - DNA, 28 bp, Artificial Sequence
  Description of Artificial Sequence: Synthetic oligonucleotide
gacacccagtttgtgaggttcgacagcg

SEQ ID NO: 374006 - DNA, 29 bp, Artificial Sequence
  Description of Artificial Sequence: Synthetic oligonucleotide
acacccagtttgtgaggttcgacagcgac

SEQ ID NO: 374007 - DNA, 28 bp, Artificial Sequence
  Description of Artificial Sequence: Synthetic oligonucleotide
cacccagtttgtgaggttcgacagcgac

SEQ ID NO: 374008 - DNA, 28 bp, Artificial Sequence
  Description of Artificial Sequence: Synthetic oligonucleotide
acccagtttgtgaggttcgacagcgacg

SEQ ID NO: 374009 - DNA, 27 bp, Artificial Sequence
  Description of Artificial Sequence: Synthetic oligonucleotide
cccagtttgtgaggttcgacagcgacg

SEQ ID NO: 374010 - DNA, 27 bp, Artificial Sequence
  Description of Artificial Sequence: Synthetic oligonucleotide
ccagtttgtgaggttcgacagcgacgc

SEQ ID NO: 374011 - DNA, 27 bp, Artificial Sequence
  Description of Artificial Sequence: Synthetic oligonucleotide
cagtttgtgaggttcgacagcgacgcc

SEQ ID NO: 374012 - DNA, 28 bp, Artificial Sequence
  Description of Artificial Sequence: Synthetic oligonucleotide
agtttgtgaggttcgacagcgacgccac

SEQ ID NO: 374013 - DNA, 27 bp, Artificial Sequence
  Description of Artificial Sequence: Synthetic oligonucleotide
gtttgtgaggttcgacagcgacgccac

SEQ ID NO: 374014 - DNA, 27 bp, Artificial Sequence
  Description of Artificial Sequence: Synthetic oligonucleotide
tttgtgaggttcgacagcgacgccacg

SEQ ID NO: 374015 - DNA, 27 bp, Artificial Sequence
  Description of Artificial Sequence: Synthetic oligonucleotide
ttgtgaggttcgacagcgacgccacga

SEQ ID NO: 374016 - DNA, 26 bp, Artificial Sequence
  Description of Artificial Sequence: Synthetic oligonucleotide
tgtgaggttcgacagcgacgccacga

SEQ ID NO: 374017 - DNA, 26 bp, Artificial Sequence
  Description of Artificial Sequence: Synthetic oligonucleotide
ttccaggatactcgtgacgcgtcccc

SEQ ID NO: 374018 - DNA, 25 bp, Artificial Sequence
  Description of Artificial Sequence: Synthetic oligonucleotide
tccaggatactcgtgacgcgtcccc

SEQ ID NO: 374019 - DNA, 24 bp, Artificial Sequence
  Description of Artificial Sequence: Synthetic oligonucleotide
ccaggatactcgtgacgcgtcccc

SEQ ID NO: 374020 - DNA, 27 bp, Artificial Sequence
  Description of Artificial Sequence: Synthetic oligonucleotide
caggatactcgtgacgcgtcccccaat

SEQ ID NO: 374021 - DNA, 28 bp, Artificial Sequence
  Description of Artificial Sequence: Synthetic oligonucleotide
aggatactcgtgacgcgtcccccaattc

SEQ ID NO: 374022 - DNA, 27 bp, Artificial Sequence
  Description of Artificial Sequence: Synthetic oligonucleotide
ggatactcgtgacgcgtcccccaattc

SEQ ID NO: 374023 - DNA, 27 bp, Artificial Sequence
  Description of Artificial Sequence: Synthetic oligonucleotide
gatactcgtgacgcgtcccccaattcc

SEQ ID NO: 374024 - DNA, 27 bp, Artificial Sequence
  Description of Artificial Sequence: Synthetic oligonucleotide
atactcgtgacgcgtcccccaattccc

SEQ ID NO: 374025 - DNA, 27 bp, Artificial Sequence
  Description of Artificial Sequence: Synthetic oligonucleotide
tactcgtgacgcgtcccccaattccca

SEQ ID NO: 374026 - DNA, 26 bp, Artificial Sequence
  Description of Artificial Sequence: Synthetic oligonucleotide
actcgtgacgcgtcccccaattccca

SEQ ID NO: 374027 - DNA, 25 bp, Artificial Sequence
  Description of Artificial Sequence: Synthetic oligonucleotide
ctcgtgacgcgtcccccaattccca

SEQ ID NO: 374028 - DNA, 26 bp, Artificial Sequence
  Description of Artificial Sequence: Synthetic oligonucleotide
tcgtgacgcgtcccccaattcccact

SEQ ID NO: 374029 - DNA, 25 bp, Artificial Sequence
  Description of Artificial Sequence: Synthetic oligonucleotide
cgtgacgcgtcccccaattcccact

SEQ ID NO: 374030 - DNA, 25 bp, Artificial Sequence
  Description of Artificial Sequence: Synthetic oligonucleotide
gtgacgcgtcccccaattcccactc

SEQ ID NO: 374031 - DNA, 25 bp, Artificial Sequence
  Description of Artificial Sequence: Synthetic oligonucleotide
tgacgcgtcccccaattcccactcc

SEQ ID NO: 374032 - DNA, 24 bp, Artificial Sequence
  Description of Artificial Sequence: Synthetic oligonucleotide
gacgcgtcccccaattcccactcc

SEQ ID NO: 374033 - DNA, 27 bp, Artificial Sequence
  Description of Artificial Sequence: Synthetic oligonucleotide
acgcgtcccccaattcccactcccatt

SEQ ID NO: 374034 - DNA, 26 bp, Artificial Sequence
  Description of Artificial Sequence: Synthetic oligonucleotide
cgcgtcccccaattcccactcccatt

SEQ ID NO: 374035 - DNA, 26 bp, Artificial Sequence
  Description of Artificial Sequence: Synthetic oligonucleotide
gcgtcccccaattcccactcccattg

SEQ ID NO: 374036 - DNA, 26 bp, Artificial Sequence
  Description of Artificial Sequence: Synthetic oligonucleotide
cgtcccccaattcccactcccattgg

SEQ ID NO: 374037 - DNA, 27 bp, Artificial Sequence
  Description of Artificial Sequence: Synthetic oligonucleotide
gtcccccaattcccactcccattgggt

SEQ ID NO: 374038 - DNA, 27 bp, Artificial Sequence
  Description of Artificial Sequence: Synthetic oligonucleotide
tcccccaattcccactcccattgggtg

SEQ ID NO: 374039 - DNA, 27 bp, Artificial Sequence
  Description of Artificial Sequence: Synthetic oligonucleotide
cccccaattcccactcccattgggtgt

SEQ ID NO: 374040 - DNA, 23 bp, Artificial Sequence
  Description of Artificial Sequence: Synthetic oligonucleotide
cgccccgggcgccatggatagaa

SEQ ID NO: 374041 - DNA, 24 bp, Artificial Sequence
  Description of Artificial Sequence: Synthetic oligonucleotide
gccccgggcgccatggatagaaca

SEQ ID NO: 374042 - DNA, 24 bp, Artificial Sequence
  Description of Artificial Sequence: Synthetic oligonucleotide
ccccgggcgccatggatagaacag

SEQ ID NO: 374043 - DNA, 25 bp, Artificial Sequence
  Description of Artificial Sequence: Synthetic oligonucleotide
cccgggcgccatggatagaacagga

SEQ ID NO: 374044 - DNA, 25 bp, Artificial Sequence
  Description of Artificial Sequence: Synthetic oligonucleotide
ccgggcgccatggatagaacaggag

SEQ ID NO: 374045 - DNA, 25 bp, Artificial Sequence
  Description of Artificial Sequence: Synthetic oligonucleotide
cgggcgccatggatagaacaggagg

SEQ ID NO: 374046 - DNA, 25 bp, Artificial Sequence
  Description of Artificial Sequence: Synthetic oligonucleotide
gggcgccatggatagaacaggaggg

SEQ ID NO: 374047 - DNA, 25 bp, Artificial Sequence
  Description of Artificial Sequence: Synthetic oligonucleotide
ggcgccatggatagaacaggagggg

SEQ ID NO: 374048 - DNA, 25 bp, Artificial Sequence
  Description of Artificial Sequence: Synthetic oligonucleotide
gcgccatggatagaacaggaggggc

SEQ ID NO: 374049 - DNA, 25 bp, Artificial Sequence
  Description of Artificial Sequence: Synthetic oligonucleotide
cgccatggatagaacaggaggggcc

SEQ ID NO: 374050 - DNA, 25 bp, Artificial Sequence
  Description of Artificial Sequence: Synthetic oligonucleotide
gccatggatagaacaggaggggccg

SEQ ID NO: 374051 - DNA, 26 bp, Artificial Sequence
  Description of Artificial Sequence: Synthetic oligonucleotide
ccatggatagaacaggaggggccgga

SEQ ID NO: 374052 - DNA, 27 bp, Artificial Sequence
  Description of Artificial Sequence: Synthetic oligonucleotide
catggatagaacaggaggggccggagt

SEQ ID NO: 374053 - DNA, 30 bp, Artificial Sequence
  Description of Artificial Sequence: Synthetic oligonucleotide
atggatagaacaggaggggccggagtattg

SEQ ID NO: 374054 - DNA, 27 bp, Artificial Sequence
  Description of Artificial Sequence: Synthetic oligonucleotide
gcaccgcgctccgctactacaaccaaa

SEQ ID NO: 374055 - DNA, 27 bp, Artificial Sequence
  Description of Artificial Sequence: Synthetic oligonucleotide
caccgcgctccgctactacaaccaaag

SEQ ID NO: 374056 - DNA, 27 bp, Artificial Sequence
  Description of Artificial Sequence: Synthetic oligonucleotide
accgcgctccgctactacaaccaaagc

SEQ ID NO: 374057 - DNA, 26 bp, Artificial Sequence
  Description of Artificial Sequence: Synthetic oligonucleotide
ccgcgctccgctactacaaccaaagc

SEQ ID NO: 374058 - DNA, 27 bp, Artificial Sequence
  Description of Artificial Sequence: Synthetic oligonucleotide
cgcgctccgctactacaaccaaagcga

SEQ ID NO: 374059 - DNA, 27 bp, Artificial Sequence
  Description of Artificial Sequence: Synthetic oligonucleotide
gcgctccgctactacaaccaaagcgag

SEQ ID NO: 374060 - DNA, 27 bp, Artificial Sequence
  Description of Artificial Sequence: Synthetic oligonucleotide
cgctccgctactacaaccaaagcgagg

SEQ ID NO: 374061 - DNA, 27 bp, Artificial Sequence
  Description of Artificial Sequence: Synthetic oligonucleotide
gctccgctactacaaccaaagcgaggc

SEQ ID NO: 374062 - DNA, 27 bp, Artificial Sequence
  Description of Artificial Sequence: Synthetic oligonucleotide
ctccgctactacaaccaaagcgaggcc

SEQ ID NO: 374063 - DNA, 27 bp, Artificial Sequence
  Description of Artificial Sequence: Synthetic oligonucleotide
tccgctactacaaccaaagcgaggccg

SEQ ID NO: 374064 - DNA, 26 bp, Artificial Sequence
  Description of Artificial Sequence: Synthetic oligonucleotide
ccgctactacaaccaaagcgaggccg

SEQ ID NO: 374065 - DNA, 26 bp, Artificial Sequence
  Description of Artificial Sequence: Synthetic oligonucleotide
cgctactacaaccaaagcgaggccgg

SEQ ID NO: 374066 - DNA, 27 bp, Artificial Sequence
  Description of Artificial Sequence: Synthetic oligonucleotide
gctactacaaccaaagcgaggccgggt

SEQ ID NO: 374067 - DNA, 27 bp, Artificial Sequence
  Description of Artificial Sequence: Synthetic oligonucleotide
ctactacaaccaaagcgaggccgggtc

SEQ ID NO: 374068 - DNA, 28 bp, Artificial Sequence
  Description of Artificial Sequence: Synthetic oligonucleotide
tactacaaccaaagcgaggccgggtctc

SEQ ID NO: 374069 - DNA, 27 bp, Artificial Sequence
  Description of Artificial Sequence: Synthetic oligonucleotide
actacaaccaaagcgaggccgggtctc

SEQ ID NO: 374070 - DNA, 27 bp, Artificial Sequence
  Description of Artificial Sequence: Synthetic oligonucleotide
ctacaaccaaagcgaggccgggtctca

SEQ ID NO: 374071 - DNA, 27 bp, Artificial Sequence
  Description of Artificial Sequence: Synthetic oligonucleotide
tacaaccaaagcgaggccgggtctcac

SEQ ID NO: 374072 - DNA, 27 bp, Artificial Sequence
  Description of Artificial Sequence: Synthetic oligonucleotide
acaaccaaagcgaggccgggtctcaca

SEQ ID NO: 374073 - DNA, 26 bp, Artificial Sequence
  Description of Artificial Sequence: Synthetic oligonucleotide
caaccaaagcgaggccgggtctcaca

SEQ ID NO: 374074 - DNA, 27 bp, Artificial Sequence
  Description of Artificial Sequence: Synthetic oligonucleotide
aaccaaagcgaggccgggtctcacact

SEQ ID NO: 374075 - DNA, 27 bp, Artificial Sequence
  Description of Artificial Sequence: Synthetic oligonucleotide
accaaagcgaggccgggtctcacactt

SEQ ID NO: 374076 - DNA, 26 bp, Artificial Sequence
  Description of Artificial Sequence: Synthetic oligonucleotide
ccaaagcgaggccgggtctcacactt

SEQ ID NO: 374077 - DNA, 26 bp, Artificial Sequence
  Description of Artificial Sequence: Synthetic oligonucleotide
caaagcgaggccgggtctcacacttg

SEQ ID NO: 374078 - DNA, 26 bp, Artificial Sequence
  Description of Artificial Sequence: Synthetic oligonucleotide
aaagcgaggccgggtctcacacttgg

SEQ ID NO: 374079 - DNA, 25 bp, Artificial Sequence
  Description of Artificial Sequence: Synthetic oligonucleotide
aagcgaggccgggtctcacacttgg

SEQ ID NO: 374080 - DNA, 32 bp, Artificial Sequence
  Description of Artificial Sequence: Synthetic oligonucleotide
tccatgaggtatttctacaccgccatgtccag

SEQ ID NO: 374081 - DNA, 31 bp, Artificial Sequence
  Description of Artificial Sequence: Synthetic oligonucleotide
ccatgaggtatttctacaccgccatgtccag

SEQ ID NO: 374082 - DNA, 31 bp, Artificial Sequence
  Description of Artificial Sequence: Synthetic oligonucleotide
catgaggtatttctacaccgccatgtccagg

SEQ ID NO: 374083 - DNA, 31 bp, Artificial Sequence
  Description of Artificial Sequence: Synthetic oligonucleotide
atgaggtatttctacaccgccatgtccaggc

SEQ ID NO: 374084 - DNA, 30 bp, Artificial Sequence
  Description of Artificial Sequence: Synthetic oligonucleotide
tgaggtatttctacaccgccatgtccaggc

SEQ ID NO: 374085 - DNA, 29 bp, Artificial Sequence
  Description of Artificial Sequence: Synthetic oligonucleotide
gaggtatttctacaccgccatgtccaggc

SEQ ID NO: 374086 - DNA, 29 bp, Artificial Sequence
  Description of Artificial Sequence: Synthetic oligonucleotide
aggtatttctacaccgccatgtccaggcc

SEQ ID NO: 374087 - DNA, 28 bp, Artificial Sequence
  Description of Artificial Sequence: Synthetic oligonucleotide
ggtatttctacaccgccatgtccaggcc

SEQ ID NO: 374088 - DNA, 28 bp, Artificial Sequence
  Description of Artificial Sequence: Synthetic oligonucleotide
gtatttctacaccgccatgtccaggccc

SEQ ID NO: 374089 - DNA, 28 bp, Artificial Sequence
  Description of Artificial Sequence: Synthetic oligonucleotide
tatttctacaccgccatgtccaggcccg

SEQ ID NO: 374090 - DNA, 27 bp, Artificial Sequence
  Description of Artificial Sequence: Synthetic oligonucleotide
atttctacaccgccatgtccaggcccg

SEQ ID NO: 374091 - DNA, 26 bp, Artificial Sequence
  Description of Artificial Sequence: Synthetic oligonucleotide
tttctacaccgccatgtccaggcccg

SEQ ID NO: 374092 - DNA, 25 bp, Artificial Sequence
  Description of Artificial Sequence: Synthetic oligonucleotide
ttctacaccgccatgtccaggcccg

SEQ ID NO: 374093 - DNA, 24 bp, Artificial Sequence
  Description of Artificial Sequence: Synthetic oligonucleotide
tctacaccgccatgtccaggcccg

SEQ ID NO: 374094 - DNA, 23 bp, Artificial Sequence
  Description of Artificial Sequence: Synthetic oligonucleotide
ctacaccgccatgtccaggcccg

SEQ ID NO: 374095 - DNA, 23 bp, Artificial Sequence
  Description of Artificial Sequence: Synthetic oligonucleotide
tacaccgccatgtccaggcccgg

SEQ ID NO: 374096 - DNA, 22 bp, Artificial Sequence
  Description of Artificial Sequence: Synthetic oligonucleotide
acaccgccatgtccaggcccgg

SEQ ID NO: 374097 - DNA, 21 bp, Artificial Sequence
  Description of Artificial Sequence: Synthetic oligonucleotide
caccgccatgtccaggcccgg

SEQ ID NO: 374098 - DNA, 21 bp, Artificial Sequence
  Description of Artificial Sequence: Synthetic oligonucleotide
accgccatgtccaggcccggc

SEQ ID NO: 374099 - DNA, 20 bp, Artificial Sequence
  Description of Artificial Sequence: Synthetic oligonucleotide
ccgccatgtccaggcccggc

SEQ ID NO: 374100 - DNA, 20 bp, Artificial Sequence
  Description of Artificial Sequence: Synthetic oligonucleotide
cgccatgtccaggcccggcc

SEQ ID NO: 374101 - DNA, 20 bp, Artificial Sequence
  Description of Artificial Sequence: Synthetic oligonucleotide
gccatgtccaggcccggccg

SEQ ID NO: 374102 - DNA, 20 bp, Artificial Sequence
  Description of Artificial Sequence: Synthetic oligonucleotide
ccatgtccaggcccggccgc

SEQ ID NO: 374103 - DNA, 20 bp, Artificial Sequence
  Description of Artificial Sequence: Synthetic oligonucleotide
catgtccaggcccggccgcg

SEQ ID NO: 374104 - DNA, 20 bp, Artificial Sequence
  Description of Artificial Sequence: Synthetic oligonucleotide
atgtccaggcccggccgcgg

SEQ ID NO: 374105 - DNA, 25 bp, Artificial Sequence
  Description of Artificial Sequence: Synthetic oligonucleotide
agctgagagcctacctggagggcct

SEQ ID NO: 374106 - DNA, 24 bp, Artificial Sequence
  Description of Artificial Sequence: Synthetic oligonucleotide
gctgagagcctacctggagggcct

SEQ ID NO: 374107 - DNA, 25 bp, Artificial Sequence
  Description of Artificial Sequence: Synthetic oligonucleotide
ctgagagcctacctggagggcctgt

SEQ ID NO: 374108 - DNA, 25 bp, Artificial Sequence
  Description of Artificial Sequence: Synthetic oligonucleotide
tgagagcctacctggagggcctgtg

SEQ ID NO: 374109 - DNA, 23 bp, Artificial Sequence
  Description of Artificial Sequence: Synthetic oligonucleotide
ctggagggcctgtgcgtggagtg

SEQ ID NO: 374110 - DNA, 23 bp, Artificial Sequence
  Description of Artificial Sequence: Synthetic oligonucleotide
tggagggcctgtgcgtggagtgg

SEQ ID NO: 374111 - DNA, 22 bp, Artificial Sequence
  Description of Artificial Sequence: Synthetic oligonucleotide
ggagggcctgtgcgtggagtgg

SEQ ID NO: 374112 - DNA, 23 bp, Artificial Sequence
  Description of Artificial Sequence: Synthetic oligonucleotide
gagggcctgtgcgtggagtggct

SEQ ID NO: 374113 - DNA, 23 bp, Artificial Sequence
  Description of Artificial Sequence: Synthetic oligonucleotide
agggcctgtgcgtggagtggctc

SEQ ID NO: 374114 - DNA, 22 bp, Artificial Sequence
  Description of Artificial Sequence: Synthetic oligonucleotide
gggcctgtgcgtggagtggctc

SEQ ID NO: 374115 - DNA, 22 bp, Artificial Sequence
  Description of Artificial Sequence: Synthetic oligonucleotide
ggcctgtgcgtggagtggctcc

SEQ ID NO: 374116 - DNA, 22 bp, Artificial Sequence
  Description of Artificial Sequence: Synthetic oligonucleotide
gcctgtgcgtggagtggctccg

SEQ ID NO: 374117 - DNA, 23 bp, Artificial Sequence
  Description of Artificial Sequence: Synthetic oligonucleotide
cctgtgcgtggagtggctccgca

SEQ ID NO: 374118 - DNA, 26 bp, Artificial Sequence
  Description of Artificial Sequence: Synthetic oligonucleotide
ctgtgcgtggagtggctccgcagata

SEQ ID NO: 374119 - DNA, 26 bp, Artificial Sequence
  Description of Artificial Sequence: Synthetic oligonucleotide
tgtgcgtggagtggctccgcagatac

SEQ ID NO: 374120 - DNA, 27 bp, Artificial Sequence
  Description of Artificial Sequence: Synthetic oligonucleotide
tgccatgtacagcatgaggggctgcca

SEQ ID NO: 374121 - DNA, 27 bp, Artificial Sequence
  Description of Artificial Sequence: Synthetic oligonucleotide
gccatgtacagcatgaggggctgccaa

SEQ ID NO: 374122 - DNA, 28 bp, Artificial Sequence
  Description of Artificial Sequence: Synthetic oligonucleotide
ccatgtacagcatgaggggctgccaaag

SEQ ID NO: 374123 - DNA, 28 bp, Artificial Sequence
  Description of Artificial Sequence: Synthetic oligonucleotide
catgtacagcatgaggggctgccaaagc

SEQ ID NO: 374124 - DNA, 28 bp, Artificial Sequence
  Description of Artificial Sequence: Synthetic oligonucleotide
atgtacagcatgaggggctgccaaagcc

SEQ ID NO: 374125 - DNA, 27 bp, Artificial Sequence
  Description of Artificial Sequence: Synthetic oligonucleotide
tgtacagcatgaggggctgccaaagcc

SEQ ID NO: 374126 - DNA, 26 bp, Artificial Sequence
  Description of Artificial Sequence: Synthetic oligonucleotide
gtacagcatgaggggctgccaaagcc

SEQ ID NO: 374127 - DNA, 26 bp, Artificial Sequence
  Description of Artificial Sequence: Synthetic oligonucleotide
tacagcatgaggggctgccaaagccc

SEQ ID NO: 374128 - DNA, 25 bp, Artificial Sequence
  Description of Artificial Sequence: Synthetic oligonucleotide
acagcatgaggggctgccaaagccc

SEQ ID NO: 374129 - DNA, 24 bp, Artificial Sequence
  Description of Artificial Sequence: Synthetic oligonucleotide
cagcatgaggggctgccaaagccc

SEQ ID NO: 374130 - DNA, 25 bp, Artificial Sequence
  Description of Artificial Sequence: Synthetic oligonucleotide
agcatgaggggctgccaaagcccct

SEQ ID NO: 374131 - DNA, 24 bp, Artificial Sequence
  Description of Artificial Sequence: Synthetic oligonucleotide
gcatgaggggctgccaaagcccct

SEQ ID NO: 374132 - DNA, 25 bp, Artificial Sequence
  Description of Artificial Sequence: Synthetic oligonucleotide
catgaggggctgccaaagcccctca

SEQ ID NO: 374133 - DNA, 25 bp, Artificial Sequence
  Description of Artificial Sequence: Synthetic oligonucleotide
atgaggggctgccaaagcccctcac

SEQ ID NO: 374134 - DNA, 24 bp, Artificial Sequence
  Description of Artificial Sequence: Synthetic oligonucleotide
tgaggggctgccaaagcccctcac

SEQ ID NO: 374135 - DNA, 23 bp, Artificial Sequence
  Description of Artificial Sequence: Synthetic oligonucleotide
gaggggctgccaaagcccctcac

SEQ ID NO: 374136 - DNA, 23 bp, Artificial Sequence
  Description of Artificial Sequence: Synthetic oligonucleotide
aggggctgccaaagcccctcacc

SEQ ID NO: 374137 - DNA, 22 bp, Artificial Sequence
  Description of Artificial Sequence: Synthetic oligonucleotide
ggggctgccaaagcccctcacc

SEQ ID NO: 374138 - DNA, 23 bp, Artificial Sequence
  Description of Artificial Sequence: Synthetic oligonucleotide
gggctgccaaagcccctcaccct

SEQ ID NO: 374139 - DNA, 24 bp, Artificial Sequence
  Description of Artificial Sequence: Synthetic oligonucleotide
ggctgccaaagcccctcaccctga

SEQ ID NO: 374140 - DNA, 26 bp, Artificial Sequence
  Description of Artificial Sequence: Synthetic oligonucleotide
gctgccaaagcccctcaccctgagat

SEQ ID NO: 374141 - DNA, 26 bp, Artificial Sequence
  Description of Artificial Sequence: Synthetic oligonucleotide
ctgccaaagcccctcaccctgagatg

SEQ ID NO: 374142 - DNA, 26 bp, Artificial Sequence
  Description of Artificial Sequence: Synthetic oligonucleotide
tgccaaagcccctcaccctgagatgg

SEQ ID NO: 374143 - DNA, 25 bp, Artificial Sequence
  Description of Artificial Sequence: Synthetic oligonucleotide
gccaaagcccctcaccctgagatgg

SEQ ID NO: 374144 - DNA, 26 bp, Artificial Sequence
  Description of Artificial Sequence: Synthetic oligonucleotide
ccaaagcccctcaccctgagatggga

SEQ ID NO: 374145 - DNA, 26 bp, Artificial Sequence
  Description of Artificial Sequence: Synthetic oligonucleotide
caaagcccctcaccctgagatgggag

SEQ ID NO: 374146 - DNA, 26 bp, Artificial Sequence
  Description of Artificial Sequence: Synthetic oligonucleotide
aaagcccctcaccctgagatgggagc

SEQ ID NO: 374147 - DNA, 29 bp, Artificial Sequence
  Description of Artificial Sequence: Synthetic oligonucleotide
accctgagatgggagccatcttcccaatc

SEQ ID NO: 374148 - DNA, 28 bp, Artificial Sequence
  Description of Artificial Sequence: Synthetic oligonucleotide
ccctgagatgggagccatcttcccaatc

SEQ ID NO: 374149 - DNA, 28 bp, Artificial Sequence
  Description of Artificial Sequence: Synthetic oligonucleotide
cctgagatgggagccatcttcccaatcc

SEQ ID NO: 374150 - DNA, 29 bp, Artificial Sequence
  Description of Artificial Sequence: Synthetic oligonucleotide
ctgagatgggagccatcttcccaatccac

SEQ ID NO: 374151 - DNA, 29 bp, Artificial Sequence
  Description of Artificial Sequence: Synthetic oligonucleotide
tgagatgggagccatcttcccaatccacc

SEQ ID NO: 374152 - DNA, 28 bp, Artificial Sequence
  Description of Artificial Sequence: Synthetic oligonucleotide
gagatgggagccatcttcccaatccacc

SEQ ID NO: 374153 - DNA, 28 bp, Artificial Sequence
  Description of Artificial Sequence: Synthetic oligonucleotide
agatgggagccatcttcccaatccaccg

SEQ ID NO: 374154 - DNA, 27 bp, Artificial Sequence
  Description of Artificial Sequence: Synthetic oligonucleotide
gatgggagccatcttcccaatccaccg

SEQ ID NO: 374155 - DNA, 28 bp, Artificial Sequence
  Description of Artificial Sequence: Synthetic oligonucleotide
atgggagccatcttcccaatccaccgtc

SEQ ID NO: 374156 - DNA, 27 bp, Artificial Sequence
  Description of Artificial Sequence: Synthetic oligonucleotide
tgggagccatcttcccaatccaccgtc

SEQ ID NO: 374157 - DNA, 26 bp, Artificial Sequence
  Description of Artificial Sequence: Synthetic oligonucleotide
gggagccatcttcccaatccaccgtc

SEQ ID NO: 374158 - DNA, 26 bp, Artificial Sequence
  Description of Artificial Sequence: Synthetic oligonucleotide
ggagccatcttcccaatccaccgtcc

SEQ ID NO: 374159 - DNA, 26 bp, Artificial Sequence
  Description of Artificial Sequence: Synthetic oligonucleotide
gagccatcttcccaatccaccgtccc

SEQ ID NO: 374160 - DNA, 27 bp, Artificial Sequence
  Description of Artificial Sequence: Synthetic oligonucleotide
agccatcttcccaatccaccgtcccca

SEQ ID NO: 374161 - DNA, 27 bp, Artificial Sequence
  Description of Artificial Sequence: Synthetic oligonucleotide
gccatcttcccaatccaccgtccccat

SEQ ID NO: 374162 - DNA, 27 bp, Artificial Sequence
  Description of Artificial Sequence: Synthetic oligonucleotide
ccatcttcccaatccaccgtccccatc

SEQ ID NO: 374163 - DNA, 27 bp, Artificial Sequence
  Description of Artificial Sequence: Synthetic oligonucleotide
catcttcccaatccaccgtccccatcg

SEQ ID NO: 374164 - DNA, 28 bp, Artificial Sequence
  Description of Artificial Sequence: Synthetic oligonucleotide
atcttcccaatccaccgtccccatcgtg

SEQ ID NO: 374165 - DNA, 27 bp, Artificial Sequence
  Description of Artificial Sequence: Synthetic oligonucleotide
tcttcccaatccaccgtccccatcgtg

SEQ ID NO: 374166 - DNA, 26 bp, Artificial Sequence
  Description of Artificial Sequence: Synthetic oligonucleotide
cttcccaatccaccgtccccatcgtg

SEQ ID NO: 374167 - DNA, 26 bp, Artificial Sequence
  Description of Artificial Sequence: Synthetic oligonucleotide
ttcccaatccaccgtccccatcgtgg

SEQ ID NO: 374168 - DNA, 25 bp, Artificial Sequence
  Description of Artificial Sequence: Synthetic oligonucleotide
tcccaatccaccgtccccatcgtgg

SEQ ID NO: 374169 - DNA, 24 bp, Artificial Sequence
  Description of Artificial Sequence: Synthetic oligonucleotide
cccaatccaccgtccccatcgtgg

SEQ ID NO: 374170 - DNA, 24 bp, Artificial Sequence
  Description of Artificial Sequence: Synthetic oligonucleotide
ccaatccaccgtccccatcgtggg

SEQ ID NO: 374171 - DNA, 27 bp, Artificial Sequence
  Description of Artificial Sequence: Synthetic oligonucleotide
caatccaccgtccccatcgtgggcatt

SEQ ID NO: 374172 - DNA, 27 bp, Artificial Sequence
  Description of Artificial Sequence: Synthetic oligonucleotide
aatccaccgtccccatcgtgggcattg

SEQ ID NO: 374173 - DNA, 27 bp, Artificial Sequence
  Description of Artificial Sequence: Synthetic oligonucleotide
atccaccgtccccatcgtgggcattgt

SEQ ID NO: 374174 - DNA, 32 bp, Artificial Sequence; identical to SEQ ID NO: 24002
  Description of Artificial Sequence: Synthetic oligonucleotide

SEQ ID NO: 374175 - DNA, 31 bp, Artificial Sequence; identical to SEQ ID NO: 24003
  Description of Artificial Sequence: Synthetic oligonucleotide

SEQ ID NO: 374176 - DNA, 31 bp, Artificial Sequence; identical to SEQ ID NO: 23484
  Description of Artificial Sequence: Synthetic oligonucleotide

SEQ ID NO: 374177 - DNA, 31 bp, Artificial Sequence; identical to SEQ ID NO: 23485
  Description of Artificial Sequence: Synthetic oligonucleotide

SEQ ID NO: 374178 - DNA, 30 bp, Artificial Sequence; identical to SEQ ID NO: 23486
  Description of Artificial Sequence: Synthetic oligonucleotide

SEQ ID NO: 374179 - DNA, 29 bp, Artificial Sequence
  Description of Artificial Sequence: Synthetic oligonucleotide
gaccaacacacagacttaccgagagagcc

SEQ ID NO: 374180 - DNA, 30 bp, Artificial Sequence; identical to SEQ ID NO: 23488
  Description of Artificial Sequence: Synthetic oligonucleotide

SEQ ID NO: 374181 - DNA, 29 bp, Artificial Sequence
  Description of Artificial Sequence: Synthetic oligonucleotide
ccaacacacagacttaccgagagagcctg

SEQ ID NO: 374182 - DNA, 29 bp, Artificial Sequence
  Description of Artificial Sequence: Synthetic oligonucleotide
caacacacagacttaccgagagagcctgc

SEQ ID NO: 374183 - DNA, 29 bp, Artificial Sequence
  Description of Artificial Sequence: Synthetic oligonucleotide
aacacacagacttaccgagagagcctgcg

SEQ ID NO: 374184 - DNA, 28 bp, Artificial Sequence
  Description of Artificial Sequence: Synthetic oligonucleotide
acacacagacttaccgagagagcctgcg

SEQ ID NO: 374185 - DNA, 27 bp, Artificial Sequence
  Description of Artificial Sequence: Synthetic oligonucleotide
cacacagacttaccgagagagcctgcg

SEQ ID NO: 374186 - DNA, 27 bp, Artificial Sequence
  Description of Artificial Sequence: Synthetic oligonucleotide
acacagacttaccgagagagcctgcgg

SEQ ID NO: 374187 - DNA, 27 bp, Artificial Sequence
  Description of Artificial Sequence: Synthetic oligonucleotide
cacagacttaccgagagagcctgcgga

SEQ ID NO: 374188 - DNA, 28 bp, Artificial Sequence
  Description of Artificial Sequence: Synthetic oligonucleotide
acagacttaccgagagagcctgcggaac

SEQ ID NO: 374189 - DNA, 27 bp, Artificial Sequence
  Description of Artificial Sequence: Synthetic oligonucleotide
cagacttaccgagagagcctgcggaac

SEQ ID NO: 374190 - DNA, 27 bp, Artificial Sequence
  Description of Artificial Sequence: Synthetic oligonucleotide
agacttaccgagagagcctgcggaacc

SEQ ID NO: 374191 - DNA, 27 bp, Artificial Sequence
  Description of Artificial Sequence: Synthetic oligonucleotide
gacttaccgagagagcctgcggaacct

SEQ ID NO: 374192 - DNA, 27 bp, Artificial Sequence
  Description of Artificial Sequence: Synthetic oligonucleotide
acttaccgagagagcctgcggaacctg

SEQ ID NO: 374193 - DNA, 26 bp, Artificial Sequence
  Description of Artificial Sequence: Synthetic oligonucleotide
cttaccgagagagcctgcggaacctg

SEQ ID NO: 374194 - DNA, 26 bp, Artificial Sequence
  Description of Artificial Sequence: Synthetic oligonucleotide
ttaccgagagagcctgcggaacctgc

SEQ ID NO: 374195 - DNA, 25 bp, Artificial Sequence
  Description of Artificial Sequence: Synthetic oligonucleotide
taccgagagagcctgcggaacctgc

SEQ ID NO: 374196 - DNA, 26 bp, Artificial Sequence
  Description of Artificial Sequence: Synthetic oligonucleotide
ctccagaggatgtacggctgcgacct

SEQ ID NO: 374197 - DNA, 26 bp, Artificial Sequence
  Description of Artificial Sequence: Synthetic oligonucleotide
tccagaggatgtacggctgcgacctg

SEQ ID NO: 374198 - DNA, 25 bp, Artificial Sequence
  Description of Artificial Sequence: Synthetic oligonucleotide
ccagaggatgtacggctgcgacctg

SEQ ID NO: 374199 - DNA, 25 bp, Artificial Sequence
  Description of Artificial Sequence: Synthetic oligonucleotide
cagaggatgtacggctgcgacctgg

SEQ ID NO: 374200 - DNA, 25 bp, Artificial Sequence
  Description of Artificial Sequence: Synthetic oligonucleotide
agaggatgtacggctgcgacctggg

SEQ ID NO: 374201 - DNA, 24 bp, Artificial Sequence
  Description of Artificial Sequence: Synthetic oligonucleotide
gaggatgtacggctgcgacctggg

SEQ ID NO: 374202 - DNA, 24 bp, Artificial Sequence
  Description of Artificial Sequence: Synthetic oligonucleotide
aggatgtacggctgcgacctgggg

SEQ ID NO: 374203 - DNA, 23 bp, Artificial Sequence
  Description of Artificial Sequence: Synthetic oligonucleotide
ggatgtacggctgcgacctgggg

SEQ ID NO: 374204 - DNA, 23 bp, Artificial Sequence
  Description of Artificial Sequence: Synthetic oligonucleotide
gatgtacggctgcgacctggggc

SEQ ID NO: 374205 - DNA, 23 bp, Artificial Sequence
  Description of Artificial Sequence: Synthetic oligonucleotide
atgtacggctgcgacctggggcc

SEQ ID NO: 374206 - DNA, 22 bp, Artificial Sequence
  Description of Artificial Sequence: Synthetic oligonucleotide
tgtacggctgcgacctggggcc

SEQ ID NO: 374207 - DNA, 21 bp, Artificial Sequence
  Description of Artificial Sequence: Synthetic oligonucleotide
gtacggctgcgacctggggcc

SEQ ID NO: 374208 - DNA, 21 bp, Artificial Sequence
  Description of Artificial Sequence: Synthetic oligonucleotide
tacggctgcgacctggggccg

SEQ ID NO: 374209 - DNA, 20 bp, Artificial Sequence
  Description of Artificial Sequence: Synthetic oligonucleotide
acggctgcgacctggggccg

SEQ ID NO: 374210 - DNA, 20 bp, Artificial Sequence
  Description of Artificial Sequence: Synthetic oligonucleotide
cggctgcgacctggggccgt

SEQ ID NO: 374211 - DNA, 25 bp, Artificial Sequence
  Description of Artificial Sequence: Synthetic oligonucleotide
caggaggggccggaatattgggacc

SEQ ID NO: 374212 - DNA, 25 bp, Artificial Sequence
  Description of Artificial Sequence: Synthetic oligonucleotide
aggaggggccggaatattgggaccg

SEQ ID NO: 374213 - DNA, 24 bp, Artificial Sequence
  Description of Artificial Sequence: Synthetic oligonucleotide
ggaggggccggaatattgggaccg

SEQ ID NO: 374214 - DNA, 26 bp, Artificial Sequence
  Description of Artificial Sequence: Synthetic oligonucleotide
gaggggccggaatattgggaccggaa

SEQ ID NO: 374215 - DNA, 27 bp, Artificial Sequence
  Description of Artificial Sequence: Synthetic oligonucleotide
aggggccggaatattgggaccggaaca

SEQ ID NO: 374216 - DNA, 26 bp, Artificial Sequence
  Description of Artificial Sequence: Synthetic oligonucleotide
ggggccggaatattgggaccggaaca

SEQ ID NO: 374217 - DNA, 27 bp, Artificial Sequence
  Description of Artificial Sequence: Synthetic oligonucleotide
gggccggaatattgggaccggaacaca

SEQ ID NO: 374218 - DNA, 27 bp, Artificial Sequence
  Description of Artificial Sequence: Synthetic oligonucleotide
ggccggaatattgggaccggaacacac

SEQ ID NO: 374219 - DNA, 28 bp, Artificial Sequence
  Description of Artificial Sequence: Synthetic oligonucleotide
gccggaatattgggaccggaacacacag

SEQ ID NO: 374220 - DNA, 30 bp, Artificial Sequence; identical to SEQ ID NO: 26764
  Description of Artificial Sequence: Synthetic oligonucleotide

SEQ ID NO: 374221 - DNA, 31 bp, Artificial Sequence; identical to SEQ ID NO: 26765
  Description of Artificial Sequence: Synthetic oligonucleotide

SEQ ID NO: 374222 - DNA, 31 bp, Artificial Sequence; identical to SEQ ID NO: 26766
  Description of Artificial Sequence: Synthetic oligonucleotide

SEQ ID NO: 374223 - DNA, 33 bp, Artificial Sequence; identical to SEQ ID NO: 26767
  Description of Artificial Sequence: Synthetic oligonucleotide

SEQ ID NO: 374224 - DNA, 34 bp, Artificial Sequence; identical to SEQ ID NO: 26768
  Description of Artificial Sequence: Synthetic oligonucleotide

SEQ ID NO: 374225 - DNA, 33 bp, Artificial Sequence; identical to SEQ ID NO: 26769
  Description of Artificial Sequence: Synthetic oligonucleotide

SEQ ID NO: 374226 - DNA, 32 bp, Artificial Sequence; identical to SEQ ID NO: 24310
  Description of Artificial Sequence: Synthetic oligonucleotide

SEQ ID NO: 374227 - DNA, 31 bp, Artificial Sequence; identical to SEQ ID NO: 24311
  Description of Artificial Sequence: Synthetic oligonucleotide

SEQ ID NO: 374228 - DNA, 30 bp, Artificial Sequence; identical to SEQ ID NO: 24312
  Description of Artificial Sequence: Synthetic oligonucleotide

SEQ ID NO: 374229 - DNA, 29 bp, Artificial Sequence
  Description of Artificial Sequence: Synthetic oligonucleotide
tgggaccggaacacacagatctgcaagac

SEQ ID NO: 374230 - DNA, 28 bp, Artificial Sequence
  Description of Artificial Sequence: Synthetic oligonucleotide
gggaccggaacacacagatctgcaagac

SEQ ID NO: 374231 - DNA, 28 bp, Artificial Sequence
  Description of Artificial Sequence: Synthetic oligonucleotide
ggaccggaacacacagatctgcaagacc

SEQ ID NO: 374232 - DNA, 30 bp, Artificial Sequence; identical to SEQ ID NO: 24316
  Description of Artificial Sequence: Synthetic oligonucleotide

SEQ ID NO: 374233 - DNA, 31 bp, Artificial Sequence; identical to SEQ ID NO: 24317
  Description of Artificial Sequence: Synthetic oligonucleotide

SEQ ID NO: 374234 - DNA, 30 bp, Artificial Sequence; identical to SEQ ID NO: 24318
  Description of Artificial Sequence: Synthetic oligonucleotide

SEQ ID NO: 374235 - DNA, 31 bp, Artificial Sequence; identical to SEQ ID NO: 24319
  Description of Artificial Sequence: Synthetic oligonucleotide

SEQ ID NO: 374236 - DNA, 32 bp, Artificial Sequence; identical to SEQ ID NO: 24320
  Description of Artificial Sequence: Synthetic oligonucleotide

SEQ ID NO: 374237 - DNA, 33 bp, Artificial Sequence; identical to SEQ ID NO: 24321
  Description of Artificial Sequence: Synthetic oligonucleotide

SEQ ID NO: 374238 - DNA, 34 bp, Artificial Sequence; identical to SEQ ID NO: 24322
  Description of Artificial Sequence: Synthetic oligonucleotide

SEQ ID NO: 374239 - DNA, 33 bp, Artificial Sequence; identical to SEQ ID NO: 24323
  Description of Artificial Sequence: Synthetic oligonucleotide

SEQ ID NO: 374240 - DNA, 32 bp, Artificial Sequence; identical to SEQ ID NO: 24324
  Description of Artificial Sequence: Synthetic oligonucleotide

SEQ ID NO: 374241 - DNA, 33 bp, Artificial Sequence; identical to SEQ ID NO: 24325
  Description of Artificial Sequence: Synthetic oligonucleotide

SEQ ID NO: 374242 - DNA, 32 bp, Artificial Sequence; identical to SEQ ID NO: 24326
  Description of Artificial Sequence: Synthetic oligonucleotide

SEQ ID NO: 374243 - DNA, 32 bp, Artificial Sequence; identical to SEQ ID NO: 24327
  Description of Artificial Sequence: Synthetic oligonucleotide

SEQ ID NO: 374244 - DNA, 31 bp, Artificial Sequence; identical to SEQ ID NO: 24328
  Description of Artificial Sequence: Synthetic oligonucleotide

SEQ ID NO: 374245 - DNA, 31 bp, Artificial Sequence; identical to SEQ ID NO: 24329
  Description of Artificial Sequence: Synthetic oligonucleotide

SEQ ID NO: 374246 - DNA, 30 bp, Artificial Sequence; identical to SEQ ID NO: 24330
  Description of Artificial Sequence: Synthetic oligonucleotide

SEQ ID NO: 374247 - DNA, 31 bp, Artificial Sequence; identical to SEQ ID NO: 24331
  Description of Artificial Sequence: Synthetic oligonucleotide

SEQ ID NO: 374248 - DNA, 30 bp, Artificial Sequence; identical to SEQ ID NO: 24332
  Description of Artificial Sequence: Synthetic oligonucleotide

SEQ ID NO: 374249 - DNA, 29 bp, Artificial Sequence
  Description of Artificial Sequence: Synthetic oligonucleotide
ctgcaagaccaacacacagactgaccgag

SEQ ID NO: 374250 - DNA, 30 bp, Artificial Sequence; identical to SEQ ID NO: 24334
  Description of Artificial Sequence: Synthetic oligonucleotide

SEQ ID NO: 374251 - DNA, 29 bp, Artificial Sequence
  Description of Artificial Sequence: Synthetic oligonucleotide
gcaagaccaacacacagactgaccgagag

SEQ ID NO: 374252 - DNA, 24 bp, Artificial Sequence
  Description of Artificial Sequence: Synthetic oligonucleotide
aggccgggtctcacaccctccagt

SEQ ID NO: 374253 - DNA, 23 bp, Artificial Sequence
  Description of Artificial Sequence: Synthetic oligonucleotide
ggccgggtctcacaccctccagt

SEQ ID NO: 374254 - DNA, 23 bp, Artificial Sequence
  Description of Artificial Sequence: Synthetic oligonucleotide
gccgggtctcacaccctccagtg

SEQ ID NO: 374255 - DNA, 25 bp, Artificial Sequence
  Description of Artificial Sequence: Synthetic oligonucleotide
ccgggtctcacaccctccagtggat

SEQ ID NO: 374256 - DNA, 27 bp, Artificial Sequence
  Description of Artificial Sequence: Synthetic oligonucleotide
cgggtctcacaccctccagtggatgta

SEQ ID NO: 374257 - DNA, 28 bp, Artificial Sequence
  Description of Artificial Sequence: Synthetic oligonucleotide
gggtctcacaccctccagtggatgtatg

SEQ ID NO: 374258 - DNA, 28 bp, Artificial Sequence
  Description of Artificial Sequence: Synthetic oligonucleotide
ggtctcacaccctccagtggatgtatgg

SEQ ID NO: 374259 - DNA, 28 bp, Artificial Sequence
  Description of Artificial Sequence: Synthetic oligonucleotide
gtctcacaccctccagtggatgtatggc

SEQ ID NO: 374260 - DNA, 29 bp, Artificial Sequence
  Description of Artificial Sequence: Synthetic oligonucleotide
tctcacaccctccagtggatgtatggctg

SEQ ID NO: 374261 - DNA, 28 bp, Artificial Sequence
  Description of Artificial Sequence: Synthetic oligonucleotide
ctcacaccctccagtggatgtatggctg

SEQ ID NO: 374262 - DNA, 28 bp, Artificial Sequence
  Description of Artificial Sequence: Synthetic oligonucleotide
tcacaccctccagtggatgtatggctgc

SEQ ID NO: 374263 - DNA, 27 bp, Artificial Sequence
  Description of Artificial Sequence: Synthetic oligonucleotide
cacaccctccagtggatgtatggctgc

SEQ ID NO: 374264 - DNA, 27 bp, Artificial Sequence
  Description of Artificial Sequence: Synthetic oligonucleotide
acaccctccagtggatgtatggctgcg

SEQ ID NO: 374265 - DNA, 27 bp, Artificial Sequence
  Description of Artificial Sequence: Synthetic oligonucleotide
caccctccagtggatgtatggctgcga

SEQ ID NO: 374266 - DNA, 27 bp, Artificial Sequence
  Description of Artificial Sequence: Synthetic oligonucleotide
accctccagtggatgtatggctgcgac

SEQ ID NO: 374267 - DNA, 26 bp, Artificial Sequence
  Description of Artificial Sequence: Synthetic oligonucleotide
ccctccagtggatgtatggctgcgac

SEQ ID NO: 374268 - DNA, 27 bp, Artificial Sequence
  Description of Artificial Sequence: Synthetic oligonucleotide
cctccagtggatgtatggctgcgacgt

SEQ ID NO: 374269 - DNA, 27 bp, Artificial Sequence
  Description of Artificial Sequence: Synthetic oligonucleotide
ctccagtggatgtatggctgcgacgtg

SEQ ID NO: 374270 - DNA, 27 bp, Artificial Sequence
  Description of Artificial Sequence: Synthetic oligonucleotide
tccagtggatgtatggctgcgacgtgg

SEQ ID NO: 374271 - DNA, 26 bp, Artificial Sequence
  Description of Artificial Sequence: Synthetic oligonucleotide
ccagtggatgtatggctgcgacgtgg

SEQ ID NO: 374272 - DNA, 26 bp, Artificial Sequence
  Description of Artificial Sequence: Synthetic oligonucleotide
cagtggatgtatggctgcgacgtggg

SEQ ID NO: 374273 - DNA, 26 bp, Artificial Sequence
  Description of Artificial Sequence: Synthetic oligonucleotide
agtggatgtatggctgcgacgtgggg

SEQ ID NO: 374274 - DNA, 25 bp, Artificial Sequence
  Description of Artificial Sequence: Synthetic oligonucleotide
gtggatgtatggctgcgacgtgggg

SEQ ID NO: 374275 - DNA, 25 bp, Artificial Sequence
  Description of Artificial Sequence: Synthetic oligonucleotide
tggatgtatggctgcgacgtggggc

SEQ ID NO: 374276 - DNA, 23 bp, Artificial Sequence
  Description of Artificial Sequence: Synthetic oligonucleotide
gggcgcctcctccgcgggtataa

SEQ ID NO: 374277 - DNA, 23 bp, Artificial Sequence
  Description of Artificial Sequence: Synthetic oligonucleotide
ggcgcctcctccgcgggtataac

SEQ ID NO: 374278 - DNA, 24 bp, Artificial Sequence
  Description of Artificial Sequence: Synthetic oligonucleotide
gcgcctcctccgcgggtataacca

SEQ ID NO: 374279 - DNA, 26 bp, Artificial Sequence
  Description of Artificial Sequence: Synthetic oligonucleotide
cgcctcctccgcgggtataaccagtt

SEQ ID NO: 374280 - DNA, 26 bp, Artificial Sequence
  Description of Artificial Sequence: Synthetic oligonucleotide
gcctcctccgcgggtataaccagttc

SEQ ID NO: 374281 - DNA, 26 bp, Artificial Sequence
  Description of Artificial Sequence: Synthetic oligonucleotide
cctcctccgcgggtataaccagttcg

SEQ ID NO: 374282 - DNA, 26 bp, Artificial Sequence
  Description of Artificial Sequence: Synthetic oligonucleotide
ctcctccgcgggtataaccagttcgc

SEQ ID NO: 374283 - DNA, 27 bp, Artificial Sequence
  Description of Artificial Sequence: Synthetic oligonucleotide
tcctccgcgggtataaccagttcgcct

SEQ ID NO: 374284 - DNA, 27 bp, Artificial Sequence
  Description of Artificial Sequence: Synthetic oligonucleotide
cctccgcgggtataaccagttcgccta

SEQ ID NO: 374285 - DNA, 27 bp, Artificial Sequence
  Description of Artificial Sequence: Synthetic oligonucleotide
ctccgcgggtataaccagttcgcctac

SEQ ID NO: 374286 - DNA, 27 bp, Artificial Sequence
  Description of Artificial Sequence: Synthetic oligonucleotide
tccgcgggtataaccagttcgcctacg

SEQ ID NO: 374287 - DNA, 27 bp, Artificial Sequence
  Description of Artificial Sequence: Synthetic oligonucleotide
ccgcgggtataaccagttcgcctacga

SEQ ID NO: 374288 - DNA, 27 bp, Artificial Sequence
  Description of Artificial Sequence: Synthetic oligonucleotide
cgcgggtataaccagttcgcctacgac

SEQ ID NO: 374289 - DNA, 27 bp, Artificial Sequence
  Description of Artificial Sequence: Synthetic oligonucleotide
gcgggtataaccagttcgcctacgacg

SEQ ID NO: 374290 - DNA, 27 bp, Artificial Sequence
  Description of Artificial Sequence: Synthetic oligonucleotide
cgggtataaccagttcgcctacgacgg

SEQ ID NO: 374291 - DNA, 27 bp, Artificial Sequence
  Description of Artificial Sequence: Synthetic oligonucleotide
gggtataaccagttcgcctacgacggc

SEQ ID NO: 374292 - DNA, 29 bp, Artificial Sequence
  Description of Artificial Sequence: Synthetic oligonucleotide
ggtataaccagttcgcctacgacggcaag

SEQ ID NO: 374293 - DNA, 29 bp, Artificial Sequence
  Description of Artificial Sequence: Synthetic oligonucleotide
gtataaccagttcgcctacgacggcaagg

SEQ ID NO: 374294 - DNA, 33 bp, Artificial Sequence; identical to SEQ ID NO: 8965
  Description of Artificial Sequence: Synthetic oligonucleotide

SEQ ID NO: 374295 - DNA, 32 bp, Artificial Sequence; identical to SEQ ID NO: 8966
  Description of Artificial Sequence: Synthetic oligonucleotide

SEQ ID NO: 374296 - DNA, 31 bp, Artificial Sequence; identical to SEQ ID NO: 8967
  Description of Artificial Sequence: Synthetic oligonucleotide

SEQ ID NO: 374297 - DNA, 30 bp, Artificial Sequence; identical to SEQ ID NO: 8968
  Description of Artificial Sequence: Synthetic oligonucleotide

SEQ ID NO: 374298 - DNA, 21 bp, Artificial Sequence
  Description of Artificial Sequence: Synthetic oligonucleotide
ggcccgtgaggcggagcagct

SEQ ID NO: 374299 - DNA, 22 bp, Artificial Sequence
  Description of Artificial Sequence: Synthetic oligonucleotide
gcccgtgaggcggagcagctga

SEQ ID NO: 374300 - DNA, 23 bp, Artificial Sequence
  Description of Artificial Sequence: Synthetic oligonucleotide
cccgtgaggcggagcagctgaga

SEQ ID NO: 374301 - DNA, 23 bp, Artificial Sequence
  Description of Artificial Sequence: Synthetic oligonucleotide
ccgtgaggcggagcagctgagag

SEQ ID NO: 374302 - DNA, 23 bp, Artificial Sequence
  Description of Artificial Sequence: Synthetic oligonucleotide
cgtgaggcggagcagctgagagc

SEQ ID NO: 374303 - DNA, 25 bp, Artificial Sequence
  Description of Artificial Sequence: Synthetic oligonucleotide
gtgaggcggagcagctgagagccta

SEQ ID NO: 374304 - DNA, 27 bp, Artificial Sequence
  Description of Artificial Sequence: Synthetic oligonucleotide
cttgtggagaccagaccagcaggagac

SEQ ID NO: 374305 - DNA, 28 bp, Artificial Sequence
  Description of Artificial Sequence: Synthetic oligonucleotide
ttgtggagaccagaccagcaggagacag

SEQ ID NO: 374306 - DNA, 27 bp, Artificial Sequence
  Description of Artificial Sequence: Synthetic oligonucleotide
tgtggagaccagaccagcaggagacag

SEQ ID NO: 374307 - DNA, 27 bp, Artificial Sequence
  Description of Artificial Sequence: Synthetic oligonucleotide
gtggagaccagaccagcaggagacaga

SEQ ID NO: 374308 - DNA, 28 bp, Artificial Sequence
  Description of Artificial Sequence: Synthetic oligonucleotide
tggagaccagaccagcaggagacagaac

SEQ ID NO: 374309 - DNA, 27 bp, Artificial Sequence
  Description of Artificial Sequence: Synthetic oligonucleotide
ggagaccagaccagcaggagacagaac

SEQ ID NO: 374310 - DNA, 27 bp, Artificial Sequence
  Description of Artificial Sequence: Synthetic oligonucleotide
gagaccagaccagcaggagacagaacc

SEQ ID NO: 374311 - DNA, 29 bp, Artificial Sequence
  Description of Artificial Sequence: Synthetic oligonucleotide
agaccagaccagcaggagacagaaccttc

SEQ ID NO: 374312 - DNA, 28 bp, Artificial Sequence
  Description of Artificial Sequence: Synthetic oligonucleotide
gaccagaccagcaggagacagaaccttc

SEQ ID NO: 374313 - DNA, 28 bp, Artificial Sequence
  Description of Artificial Sequence: Synthetic oligonucleotide
accagaccagcaggagacagaaccttcc

SEQ ID NO: 374314 - DNA, 27 bp, Artificial Sequence
  Description of Artificial Sequence: Synthetic oligonucleotide
ccagaccagcaggagacagaaccttcc

SEQ ID NO: 374315 - DNA, 28 bp, Artificial Sequence
  Description of Artificial Sequence: Synthetic oligonucleotide
cagaccagcaggagacagaaccttccag

SEQ ID NO: 374316 - DNA, 30 bp, Artificial Sequence; identical to SEQ ID NO: 26806
  Description of Artificial Sequence: Synthetic oligonucleotide

SEQ ID NO: 374317 - DNA, 29 bp, Artificial Sequence
  Description of Artificial Sequence: Synthetic oligonucleotide
gaccagcaggagacagaaccttccagaag

SEQ ID NO: 374318 - DNA, 30 bp, Artificial Sequence; identical to SEQ ID NO: 26808
  Description of Artificial Sequence: Synthetic oligonucleotide

SEQ ID NO: 374319 - DNA, 29 bp, Artificial Sequence
  Description of Artificial Sequence: Synthetic oligonucleotide
ccagcaggagacagaaccttccagaagtg

SEQ ID NO: 374320 - DNA, 29 bp, Artificial Sequence
  Description of Artificial Sequence: Synthetic oligonucleotide
cagcaggagacagaaccttccagaagtgg

SEQ ID NO: 374321 - DNA, 29 bp, Artificial Sequence
  Description of Artificial Sequence: Synthetic oligonucleotide
agcaggagacagaaccttccagaagtggg

SEQ ID NO: 374322 - DNA, 28 bp, Artificial Sequence
  Description of Artificial Sequence: Synthetic oligonucleotide
gcaggagacagaaccttccagaagtggg

SEQ ID NO: 374323 - DNA, 28 bp, Artificial Sequence
  Description of Artificial Sequence: Synthetic oligonucleotide
caggagacagaaccttccagaagtgggc

SEQ ID NO: 374324 - DNA, 29 bp, Artificial Sequence
  Description of Artificial Sequence: Synthetic oligonucleotide
aggagacagaaccttccagaagtgggcag

SEQ ID NO: 374325 - DNA, 28 bp, Artificial Sequence
  Description of Artificial Sequence: Synthetic oligonucleotide
ggagacagaaccttccagaagtgggcag

SEQ ID NO: 374326 - DNA, 28 bp, Artificial Sequence
  Description of Artificial Sequence: Synthetic oligonucleotide
gagacagaaccttccagaagtgggcagc

SEQ ID NO: 374327 - DNA, 29 bp, Artificial Sequence
  Description of Artificial Sequence: Synthetic oligonucleotide
agacagaaccttccagaagtgggcagctg

SEQ ID NO: 374328 - DNA, 28 bp, Artificial Sequence
  Description of Artificial Sequence: Synthetic oligonucleotide
gacagaaccttccagaagtgggcagctg

SEQ ID NO: 374329 - DNA, 29 bp, Artificial Sequence
  Description of Artificial Sequence: Synthetic oligonucleotide
acagaaccttccagaagtgggcagctgtg

SEQ ID NO: 374330 - DNA, 28 bp, Artificial Sequence
  Description of Artificial Sequence: Synthetic oligonucleotide
cagaaccttccagaagtgggcagctgtg

SEQ ID NO: 374331 - DNA, 25 bp, Artificial Sequence
  Description of Artificial Sequence: Synthetic oligonucleotide
gagggagctactctcaggctgcgtc

SEQ ID NO: 374332 - DNA, 26 bp, Artificial Sequence
  Description of Artificial Sequence: Synthetic oligonucleotide
agggagctactctcaggctgcgtcca

SEQ ID NO: 374333 - DNA, 25 bp, Artificial Sequence
  Description of Artificial Sequence: Synthetic oligonucleotide
gggagctactctcaggctgcgtcca

SEQ ID NO: 374334 - DNA, 25 bp, Artificial Sequence
  Description of Artificial Sequence: Synthetic oligonucleotide
ggagctactctcaggctgcgtccag

SEQ ID NO: 374335 - DNA, 25 bp, Artificial Sequence
  Description of Artificial Sequence: Synthetic oligonucleotide
gagctactctcaggctgcgtccagc

SEQ ID NO: 374336 - DNA, 26 bp, Artificial Sequence
  Description of Artificial Sequence: Synthetic oligonucleotide
agctactctcaggctgcgtccagcga

SEQ ID NO: 374337 - DNA, 25 bp, Artificial Sequence
  Description of Artificial Sequence: Synthetic oligonucleotide
gctactctcaggctgcgtccagcga

SEQ ID NO: 374338 - DNA, 26 bp, Artificial Sequence
  Description of Artificial Sequence: Synthetic oligonucleotide
ctactctcaggctgcgtccagcgaca

SEQ ID NO: 374339 - DNA, 27 bp, Artificial Sequence
  Description of Artificial Sequence: Synthetic oligonucleotide
tactctcaggctgcgtccagcgacagt

SEQ ID NO: 374340 - DNA, 26 bp, Artificial Sequence
  Description of Artificial Sequence: Synthetic oligonucleotide
actctcaggctgcgtccagcgacagt

SEQ ID NO: 374341 - DNA, 25 bp, Artificial Sequence
  Description of Artificial Sequence: Synthetic oligonucleotide
ctctcaggctgcgtccagcgacagt

SEQ ID NO: 374342 - DNA, 25 bp, Artificial Sequence
  Description of Artificial Sequence: Synthetic oligonucleotide
tctcaggctgcgtccagcgacagtg

SEQ ID NO: 374343 - DNA, 24 bp, Artificial Sequence
  Description of Artificial Sequence: Synthetic oligonucleotide
ctcaggctgcgtccagcgacagtg

SEQ ID NO: 374344 - DNA, 24 bp, Artificial Sequence
  Description of Artificial Sequence: Synthetic oligonucleotide
tcaggctgcgtccagcgacagtgc

SEQ ID NO: 374345 - DNA, 23 bp, Artificial Sequence
  Description of Artificial Sequence: Synthetic oligonucleotide
caggctgcgtccagcgacagtgc

SEQ ID NO: 374346 - DNA, 23 bp, Artificial Sequence
  Description of Artificial Sequence: Synthetic oligonucleotide
aggctgcgtccagcgacagtgcc

SEQ ID NO: 374347 - DNA, 22 bp, Artificial Sequence
  Description of Artificial Sequence: Synthetic oligonucleotide
ggctgcgtccagcgacagtgcc

SEQ ID NO: 374348 - DNA, 23 bp, Artificial Sequence
  Description of Artificial Sequence: Synthetic oligonucleotide
gctgcgtccagcgacagtgccca

SEQ ID NO: 374349 - DNA, 23 bp, Artificial Sequence
  Description of Artificial Sequence: Synthetic oligonucleotide
ctgcgtccagcgacagtgcccag

SEQ ID NO: 374350 - DNA, 23 bp, Artificial Sequence
  Description of Artificial Sequence: Synthetic oligonucleotide
tgcgtccagcgacagtgcccagg

SEQ ID NO: 374351 - DNA, 22 bp, Artificial Sequence
  Description of Artificial Sequence: Synthetic oligonucleotide
gcgtccagcgacagtgcccagg

SEQ ID NO: 374352 - DNA, 22 bp, Artificial Sequence
  Description of Artificial Sequence: Synthetic oligonucleotide
cgtccagcgacagtgcccaggg

SEQ ID NO: 374353 - DNA, 23 bp, Artificial Sequence
  Description of Artificial Sequence: Synthetic oligonucleotide
gtccagcgacagtgcccagggct

SEQ ID NO: 374354 - DNA, 24 bp, Artificial Sequence
  Description of Artificial Sequence: Synthetic oligonucleotide
tccagcgacagtgcccagggctct

SEQ ID NO: 374355 - DNA, 23 bp, Artificial Sequence
  Description of Artificial Sequence: Synthetic oligonucleotide
ccagcgacagtgcccagggctct

SEQ ID NO: 374356 - DNA, 26 bp, Artificial Sequence
  Description of Artificial Sequence: Synthetic oligonucleotide
ctacctggagggcacgtgcgtggaat

SEQ ID NO: 374357 - DNA, 26 bp, Artificial Sequence
  Description of Artificial Sequence: Synthetic oligonucleotide
tacctggagggcacgtgcgtggaatg

SEQ ID NO: 374358 - DNA, 25 bp, Artificial Sequence
  Description of Artificial Sequence: Synthetic oligonucleotide
acctggagggcacgtgcgtggaatg

SEQ ID NO: 374359 - DNA, 24 bp, Artificial Sequence
  Description of Artificial Sequence: Synthetic oligonucleotide
cctggagggcacgtgcgtggaatg

SEQ ID NO: 374360 - DNA, 24 bp, Artificial Sequence
  Description of Artificial Sequence: Synthetic oligonucleotide
ctggagggcacgtgcgtggaatgg

SEQ ID NO: 374361 - DNA, 25 bp, Artificial Sequence
  Description of Artificial Sequence: Synthetic oligonucleotide
tggagggcacgtgcgtggaatggct

SEQ ID NO: 374362 - DNA, 24 bp, Artificial Sequence
  Description of Artificial Sequence: Synthetic oligonucleotide
ggagggcacgtgcgtggaatggct

SEQ ID NO: 374363 - DNA, 24 bp, Artificial Sequence
  Description of Artificial Sequence: Synthetic oligonucleotide
gagggcacgtgcgtggaatggctc

SEQ ID NO: 374364 - DNA, 24 bp, Artificial Sequence
  Description of Artificial Sequence: Synthetic oligonucleotide
agggcacgtgcgtggaatggctcc

SEQ ID NO: 374365 - DNA, 23 bp, Artificial Sequence
  Description of Artificial Sequence: Synthetic oligonucleotide
gggcacgtgcgtggaatggctcc

SEQ ID NO: 374366 - DNA, 23 bp, Artificial Sequence
  Description of Artificial Sequence: Synthetic oligonucleotide
ggcacgtgcgtggaatggctccg

SEQ ID NO: 374367 - DNA, 24 bp, Artificial Sequence
  Description of Artificial Sequence: Synthetic oligonucleotide
gcacgtgcgtggaatggctccgca

SEQ ID NO: 374368 - DNA, 25 bp, Artificial Sequence
  Description of Artificial Sequence: Synthetic oligonucleotide
cacgtgcgtggaatggctccgcaga

SEQ ID NO: 374369 - DNA, 26 bp, Artificial Sequence
  Description of Artificial Sequence: Synthetic oligonucleotide
acgtgcgtggaatggctccgcagaca

SEQ ID NO: 374370 - DNA, 25 bp, Artificial Sequence
  Description of Artificial Sequence: Synthetic oligonucleotide
cgtgcgtggaatggctccgcagaca

SEQ ID NO: 374371 - DNA, 25 bp, Artificial Sequence
  Description of Artificial Sequence: Synthetic oligonucleotide
gtgcgtggaatggctccgcagacac

SEQ ID NO: 374372 - DNA, 26 bp, Artificial Sequence
  Description of Artificial Sequence: Synthetic oligonucleotide
tgcgtggaatggctccgcagacacct

SEQ ID NO: 374373 - DNA, 25 bp, Artificial Sequence
  Description of Artificial Sequence: Synthetic oligonucleotide
gcgtggaatggctccgcagacacct

SEQ ID NO: 374374 - DNA, 25 bp, Artificial Sequence
  Description of Artificial Sequence: Synthetic oligonucleotide
cgtggaatggctccgcagacacctg

SEQ ID NO: 374375 - DNA, 26 bp, Artificial Sequence
  Description of Artificial Sequence: Synthetic oligonucleotide
gtggaatggctccgcagacacctgga

SEQ ID NO: 374376 - DNA, 27 bp, Artificial Sequence
  Description of Artificial Sequence: Synthetic oligonucleotide
tggaatggctccgcagacacctggaga

SEQ ID NO: 374377 - DNA, 27 bp, Artificial Sequence
  Description of Artificial Sequence: Synthetic oligonucleotide
ggaatggctccgcagacacctggagaa

SEQ ID NO: 374378 - DNA, 27 bp, Artificial Sequence
  Description of Artificial Sequence: Synthetic oligonucleotide
gaatggctccgcagacacctggagaac

SEQ ID NO: 374379 - DNA, 27 bp, Artificial Sequence
  Description of Artificial Sequence: Synthetic oligonucleotide
aatggctccgcagacacctggagaacg

SEQ ID NO: 374380 - DNA, 26 bp, Artificial Sequence
  Description of Artificial Sequence: Synthetic oligonucleotide
atggctccgcagacacctggagaacg

SEQ ID NO: 374381 - DNA, 27 bp, Artificial Sequence
  Description of Artificial Sequence: Synthetic oligonucleotide
cggactcagagtctcctcagacgccaa

SEQ ID NO: 374382 - DNA, 27 bp, Artificial Sequence
  Description of Artificial Sequence: Synthetic oligonucleotide
ggactcagagtctcctcagacgccaag

SEQ ID NO: 374383 - DNA, 29 bp, Artificial Sequence
  Description of Artificial Sequence: Synthetic oligonucleotide
gactcagagtctcctcagacgccaagatg

SEQ ID NO: 374384 - DNA, 29 bp, Artificial Sequence
  Description of Artificial Sequence: Synthetic oligonucleotide
actcagagtctcctcagacgccaagatgc

SEQ ID NO: 374385 - DNA, 28 bp, Artificial Sequence
  Description of Artificial Sequence: Synthetic oligonucleotide
ctcagagtctcctcagacgccaagatgc

SEQ ID NO: 374386 - DNA, 29 bp, Artificial Sequence
  Description of Artificial Sequence: Synthetic oligonucleotide
tcagagtctcctcagacgccaagatgctg

SEQ ID NO: 374387 - DNA, 28 bp, Artificial Sequence
  Description of Artificial Sequence: Synthetic oligonucleotide
cagagtctcctcagacgccaagatgctg

SEQ ID NO: 374388 - DNA, 28 bp, Artificial Sequence
  Description of Artificial Sequence: Synthetic oligonucleotide
agagtctcctcagacgccaagatgctgg

SEQ ID NO: 374389 - DNA, 27 bp, Artificial Sequence
  Description of Artificial Sequence: Synthetic oligonucleotide
gagtctcctcagacgccaagatgctgg

SEQ ID NO: 374390 - DNA, 28 bp, Artificial Sequence
  Description of Artificial Sequence: Synthetic oligonucleotide
agtctcctcagacgccaagatgctggtc

SEQ ID NO: 374391 - DNA, 27 bp, Artificial Sequence
  Description of Artificial Sequence: Synthetic oligonucleotide
gtctcctcagacgccaagatgctggtc

SEQ ID NO: 374392 - DNA, 29 bp, Artificial Sequence
  Description of Artificial Sequence: Synthetic oligonucleotide
tctcctcagacgccaagatgctggtcatg

SEQ ID NO: 374393 - DNA, 28 bp, Artificial Sequence
  Description of Artificial Sequence: Synthetic oligonucleotide
ctcctcagacgccaagatgctggtcatg

SEQ ID NO: 374394 - DNA, 28 bp, Artificial Sequence
  Description of Artificial Sequence: Synthetic oligonucleotide
tcctcagacgccaagatgctggtcatgg

SEQ ID NO: 374395 - DNA, 27 bp, Artificial Sequence
  Description of Artificial Sequence: Synthetic oligonucleotide
cctcagacgccaagatgctggtcatgg

SEQ ID NO: 374396 - DNA, 27 bp, Artificial Sequence
  Description of Artificial Sequence: Synthetic oligonucleotide
ctcagacgccaagatgctggtcatggc

SEQ ID NO: 374397 - DNA, 27 bp, Artificial Sequence
  Description of Artificial Sequence: Synthetic oligonucleotide
tcagacgccaagatgctggtcatggcg

SEQ ID NO: 374398 - DNA, 26 bp, Artificial Sequence
  Description of Artificial Sequence: Synthetic oligonucleotide
cagacgccaagatgctggtcatggcg

SEQ ID NO: 374399 - DNA, 26 bp, Artificial Sequence
  Description of Artificial Sequence: Synthetic oligonucleotide
agacgccaagatgctggtcatggcgc

SEQ ID NO: 374400 - DNA, 25 bp, Artificial Sequence
  Description of Artificial Sequence: Synthetic oligonucleotide
gacgccaagatgctggtcatggcgc

SEQ ID NO: 374401 - DNA, 25 bp, Artificial Sequence
  Description of Artificial Sequence: Synthetic oligonucleotide
acgccaagatgctggtcatggcgcc

SEQ ID NO: 374402 - DNA, 24 bp, Artificial Sequence
  Description of Artificial Sequence: Synthetic oligonucleotide
cgccaagatgctggtcatggcgcc

SEQ ID NO: 374403 - DNA, 24 bp, Artificial Sequence
  Description of Artificial Sequence: Synthetic oligonucleotide
gccaagatgctggtcatggcgccc

SEQ ID NO: 374404 - DNA, 24 bp, Artificial Sequence
  Description of Artificial Sequence: Synthetic oligonucleotide
ccaagatgctggtcatggcgcccc

SEQ ID NO: 374405 - DNA, 26 bp, Artificial Sequence
  Description of Artificial Sequence: Synthetic oligonucleotide
caagatgctggtcatggcgccccgaa

SEQ ID NO: 374406 - DNA, 26 bp, Artificial Sequence
  Description of Artificial Sequence: Synthetic oligonucleotide
aagatgctggtcatggcgccccgaac

SEQ ID NO: 374407 - DNA, 29 bp, Artificial Sequence
  Description of Artificial Sequence: Synthetic oligonucleotide
ccactccatgaggtatttctacaccgccg

SEQ ID NO: 374408 - DNA, 30 bp, Artificial Sequence; identical to SEQ ID NO: 26847
  Description of Artificial Sequence: Synthetic oligonucleotide

SEQ ID NO: 374409 - DNA, 31 bp, Artificial Sequence; identical to SEQ ID NO: 26848
  Description of Artificial Sequence: Synthetic oligonucleotide

SEQ ID NO: 374410 - DNA, 30 bp, Artificial Sequence; identical to SEQ ID NO: 26849
  Description of Artificial Sequence: Synthetic oligonucleotide

SEQ ID NO: 374411 - DNA, 30 bp, Artificial Sequence; identical to SEQ ID NO: 26850
  Description of Artificial Sequence: Synthetic oligonucleotide

SEQ ID NO: 374412 - DNA, 29 bp, Artificial Sequence
  Description of Artificial Sequence: Synthetic oligonucleotide
ccatgaggtatttctacaccgccgtgtcc

SEQ ID NO: 374413 - DNA, 29 bp, Artificial Sequence
  Description of Artificial Sequence: Synthetic oligonucleotide
catgaggtatttctacaccgccgtgtccc

SEQ ID NO: 374414 - DNA, 29 bp, Artificial Sequence
  Description of Artificial Sequence: Synthetic oligonucleotide
atgaggtatttctacaccgccgtgtcccg

SEQ ID NO: 374415 - DNA, 28 bp, Artificial Sequence
  Description of Artificial Sequence: Synthetic oligonucleotide
tgaggtatttctacaccgccgtgtcccg

SEQ ID NO: 374416 - DNA, 27 bp, Artificial Sequence
  Description of Artificial Sequence: Synthetic oligonucleotide
gaggtatttctacaccgccgtgtcccg

SEQ ID NO: 374417 - DNA, 27 bp, Artificial Sequence
  Description of Artificial Sequence: Synthetic oligonucleotide
aggtatttctacaccgccgtgtcccgg

SEQ ID NO: 374418 - DNA, 26 bp, Artificial Sequence
  Description of Artificial Sequence: Synthetic oligonucleotide
ggtatttctacaccgccgtgtcccgg

SEQ ID NO: 374419 - DNA, 26 bp, Artificial Sequence
  Description of Artificial Sequence: Synthetic oligonucleotide
gtatttctacaccgccgtgtcccggc

SEQ ID NO: 374420 - DNA, 26 bp, Artificial Sequence
  Description of Artificial Sequence: Synthetic oligonucleotide
tatttctacaccgccgtgtcccggcc

SEQ ID NO: 374421 - DNA, 25 bp, Artificial Sequence
  Description of Artificial Sequence: Synthetic oligonucleotide
atttctacaccgccgtgtcccggcc

SEQ ID NO: 374422 - DNA, 24 bp, Artificial Sequence
  Description of Artificial Sequence: Synthetic oligonucleotide
tttctacaccgccgtgtcccggcc

SEQ ID NO: 374423 - DNA, 23 bp, Artificial Sequence
  Description of Artificial Sequence: Synthetic oligonucleotide
ttctacaccgccgtgtcccggcc

SEQ ID NO: 374424 - DNA, 22 bp, Artificial Sequence
  Description of Artificial Sequence: Synthetic oligonucleotide
tctacaccgccgtgtcccggcc

SEQ ID NO: 374425 - DNA, 21 bp, Artificial Sequence
  Description of Artificial Sequence: Synthetic oligonucleotide
ctacaccgccgtgtcccggcc

SEQ ID NO: 374426 - DNA, 21 bp, Artificial Sequence
  Description of Artificial Sequence: Synthetic oligonucleotide
tacaccgccgtgtcccggccc

SEQ ID NO: 374427 - DNA, 20 bp, Artificial Sequence
  Description of Artificial Sequence: Synthetic oligonucleotide
acaccgccgtgtcccggccc

SEQ ID NO: 374428 - DNA, 20 bp, Artificial Sequence
  Description of Artificial Sequence: Synthetic oligonucleotide
caccgccgtgtcccggccct

SEQ ID NO: 374429 - DNA, 20 bp, Artificial Sequence
  Description of Artificial Sequence: Synthetic oligonucleotide
accgccgtgtcccggcccgt

SEQ ID NO: 374430 - DNA, 20 bp, Artificial Sequence
  Description of Artificial Sequence: Synthetic oligonucleotide
ccgccgtgtcccggcccgtt

SEQ ID NO: 374431 - DNA, 20 bp, Artificial Sequence
  Description of Artificial Sequence: Synthetic oligonucleotide
cgccgtgtcccggcccggtt

SEQ ID NO: 374432 - DNA, 20 bp, Artificial Sequence
  Description of Artificial Sequence: Synthetic oligonucleotide
gccgtgtcccggcccggctt

SEQ ID NO: 374433 - DNA, 21 bp, Artificial Sequence
  Description of Artificial Sequence: Synthetic oligonucleotide
ctgagctcctggaccgcggcc

SEQ ID NO: 374434 - DNA, 22 bp, Artificial Sequence
  Description of Artificial Sequence: Synthetic oligonucleotide
tgagctcctggaccgcggccga

SEQ ID NO: 374435 - DNA, 21 bp, Artificial Sequence
  Description of Artificial Sequence: Synthetic oligonucleotide
gagctcctggaccgcggccga

SEQ ID NO: 374436 - DNA, 22 bp, Artificial Sequence
  Description of Artificial Sequence: Synthetic oligonucleotide
agctcctggaccgcggccgaca

SEQ ID NO: 374437 - DNA, 21 bp, Artificial Sequence
  Description of Artificial Sequence: Synthetic oligonucleotide
gctcctggaccgcggccgaca

SEQ ID NO: 374438 - DNA, 21 bp, Artificial Sequence
  Description of Artificial Sequence: Synthetic oligonucleotide
ctcctggaccgcggccgacac

SEQ ID NO: 374439 - DNA, 21 bp, Artificial Sequence
  Description of Artificial Sequence: Synthetic oligonucleotide
tcctggaccgcggccgacacc

SEQ ID NO: 374440 - DNA, 20 bp, Artificial Sequence
  Description of Artificial Sequence: Synthetic oligonucleotide
cctggaccgcggccgacacc

SEQ ID NO: 374441 - DNA, 20 bp, Artificial Sequence
  Description of Artificial Sequence: Synthetic oligonucleotide
ctggaccgcggccgacaccg

SEQ ID NO: 374442 - DNA, 20 bp, Artificial Sequence
  Description of Artificial Sequence: Synthetic oligonucleotide
tggaccgcggccgacaccgc

SEQ ID NO: 374443 - DNA, 20 bp, Artificial Sequence
  Description of Artificial Sequence: Synthetic oligonucleotide
ggaccgcggccgacaccgct

SEQ ID NO: 374444 - DNA, 20 bp, Artificial Sequence
  Description of Artificial Sequence: Synthetic oligonucleotide
gaccgcggccgacaccgcgt

SEQ ID NO: 374445 - DNA, 20 bp, Artificial Sequence
  Description of Artificial Sequence: Synthetic oligonucleotide
accgcggccgacaccgcggt

SEQ ID NO: 374446 - DNA, 20 bp, Artificial Sequence
  Description of Artificial Sequence: Synthetic oligonucleotide
ccgcggccgacaccgcggtt

SEQ ID NO: 374447 - DNA, 20 bp, Artificial Sequence
  Description of Artificial Sequence: Synthetic oligonucleotide
cgcggccgacaccgcggctt

SEQ ID NO: 374448 - DNA, 20 bp, Artificial Sequence
  Description of Artificial Sequence: Synthetic oligonucleotide
gcggccgacaccgcggctca

SEQ ID NO: 374449 - DNA, 22 bp, Artificial Sequence
  Description of Artificial Sequence: Synthetic oligonucleotide
cggccgacaccgcggctcagat

SEQ ID NO: 374450 - DNA, 23 bp, Artificial Sequence
  Description of Artificial Sequence: Synthetic oligonucleotide
ggccgacaccgcggctcagatca

SEQ ID NO: 374451 - DNA, 23 bp, Artificial Sequence
  Description of Artificial Sequence: Synthetic oligonucleotide
gccgacaccgcggctcagatcac

SEQ ID NO: 374452 - DNA, 23 bp, Artificial Sequence
  Description of Artificial Sequence: Synthetic oligonucleotide
ccgacaccgcggctcagatcacc

SEQ ID NO: 374453 - DNA, 24 bp, Artificial Sequence
  Description of Artificial Sequence: Synthetic oligonucleotide
cgacaccgcggctcagatcaccca

SEQ ID NO: 374454 - DNA, 24 bp, Artificial Sequence
  Description of Artificial Sequence: Synthetic oligonucleotide
agtccaccgtccccatcgtgggca

SEQ ID NO: 374455 - DNA, 27 bp, Artificial Sequence
  Description of Artificial Sequence: Synthetic oligonucleotide
ctgaacgaggacctgagctcctggact

SEQ ID NO: 374456 - DNA, 27 bp, Artificial Sequence
  Description of Artificial Sequence: Synthetic oligonucleotide
tgaacgaggacctgagctcctggactg

SEQ ID NO: 374457 - DNA, 26 bp, Artificial Sequence
  Description of Artificial Sequence: Synthetic oligonucleotide
gaacgaggacctgagctcctggactg

SEQ ID NO: 374458 - DNA, 26 bp, Artificial Sequence
  Description of Artificial Sequence: Synthetic oligonucleotide
aacgaggacctgagctcctggactgc

SEQ ID NO: 374459 - DNA, 25 bp, Artificial Sequence
  Description of Artificial Sequence: Synthetic oligonucleotide
acgaggacctgagctcctggactgc

SEQ ID NO: 374460 - DNA, 24 bp, Artificial Sequence
  Description of Artificial Sequence: Synthetic oligonucleotide
cgaggacctgagctcctggactgc

SEQ ID NO: 374461 - DNA, 24 bp, Artificial Sequence
  Description of Artificial Sequence: Synthetic oligonucleotide
gaggacctgagctcctggactgcg

SEQ ID NO: 374462 - DNA, 24 bp, Artificial Sequence
  Description of Artificial Sequence: Synthetic oligonucleotide
aggacctgagctcctggactgcgg

SEQ ID NO: 374463 - DNA, 23 bp, Artificial Sequence
  Description of Artificial Sequence: Synthetic oligonucleotide
ggacctgagctcctggactgcgg

SEQ ID NO: 374464 - DNA, 23 bp, Artificial Sequence
  Description of Artificial Sequence: Synthetic oligonucleotide
gacctgagctcctggactgcggc

SEQ ID NO: 374465 - DNA, 23 bp, Artificial Sequence
  Description of Artificial Sequence: Synthetic oligonucleotide
acctgagctcctggactgcggcg

SEQ ID NO: 374466 - DNA, 22 bp, Artificial Sequence
  Description of Artificial Sequence: Synthetic oligonucleotide
cctgagctcctggactgcggcg

SEQ ID NO: 374467 - DNA, 23 bp, Artificial Sequence
  Description of Artificial Sequence: Synthetic oligonucleotide
ctgagctcctggactgcggcgga

SEQ ID NO: 374468 - DNA, 24 bp, Artificial Sequence
  Description of Artificial Sequence: Synthetic oligonucleotide
tgagctcctggactgcggcggaca

SEQ ID NO: 374469 - DNA, 23 bp, Artificial Sequence
  Description of Artificial Sequence: Synthetic oligonucleotide
gagctcctggactgcggcggaca

SEQ ID NO: 374470 - DNA, 23 bp, Artificial Sequence
  Description of Artificial Sequence: Synthetic oligonucleotide
agctcctggactgcggcggacac

SEQ ID NO: 374471 - DNA, 22 bp, Artificial Sequence
  Description of Artificial Sequence: Synthetic oligonucleotide
gctcctggactgcggcggacac

SEQ ID NO: 374472 - DNA, 22 bp, Artificial Sequence
  Description of Artificial Sequence: Synthetic oligonucleotide
ctcctggactgcggcggacacc

SEQ ID NO: 374473 - DNA, 22 bp, Artificial Sequence
  Description of Artificial Sequence: Synthetic oligonucleotide
tcctggactgcggcggacaccg

SEQ ID NO: 374474 - DNA, 21 bp, Artificial Sequence
  Description of Artificial Sequence: Synthetic oligonucleotide
cctggactgcggcggacaccg

SEQ ID NO: 374475 - DNA, 21 bp, Artificial Sequence
  Description of Artificial Sequence: Synthetic oligonucleotide
ctggactgcggcggacaccgc

SEQ ID NO: 374476 - DNA, 21 bp, Artificial Sequence
  Description of Artificial Sequence: Synthetic oligonucleotide
tggactgcggcggacaccgcg

SEQ ID NO: 374477 - DNA, 20 bp, Artificial Sequence
  Description of Artificial Sequence: Synthetic oligonucleotide
ggactgcggcggacaccgcg

SEQ ID NO: 374478 - DNA, 20 bp, Artificial Sequence
  Description of Artificial Sequence: Synthetic oligonucleotide
gactgcggcggacaccgcgg

SEQ ID NO: 374479 - DNA, 21 bp, Artificial Sequence
  Description of Artificial Sequence: Synthetic oligonucleotide
actgcggcggacaccgcggct

SEQ ID NO: 374480 - DNA, 20 bp, Artificial Sequence
  Description of Artificial Sequence: Synthetic oligonucleotide
ctgcggcggacaccgcggct

SEQ ID NO: 374481 - DNA, 21 bp, Artificial Sequence
  Description of Artificial Sequence: Synthetic oligonucleotide
tgcggcggacaccgcggctca

SEQ ID NO: 374482 - DNA, 27 bp, Artificial Sequence
  Description of Artificial Sequence: Synthetic oligonucleotide
agactgaccgagagagcctgcggaact

SEQ ID NO: 374483 - DNA, 27 bp, Artificial Sequence
  Description of Artificial Sequence: Synthetic oligonucleotide
gactgaccgagagagcctgcggaactt

SEQ ID NO: 374484 - DNA, 27 bp, Artificial Sequence
  Description of Artificial Sequence: Synthetic oligonucleotide
actgaccgagagagcctgcggaacttg

SEQ ID NO: 374485 - DNA, 26 bp, Artificial Sequence
  Description of Artificial Sequence: Synthetic oligonucleotide
ctgaccgagagagcctgcggaacttg

SEQ ID NO: 374486 - DNA, 26 bp, Artificial Sequence
  Description of Artificial Sequence: Synthetic oligonucleotide
tgaccgagagagcctgcggaacttgc

SEQ ID NO: 374487 - DNA, 25 bp, Artificial Sequence
  Description of Artificial Sequence: Synthetic oligonucleotide
gaccgagagagcctgcggaacttgc

SEQ ID NO: 374488 - DNA, 25 bp, Artificial Sequence
  Description of Artificial Sequence: Synthetic oligonucleotide
accgagagagcctgcggaacttgcg

SEQ ID NO: 374489 - DNA, 24 bp, Artificial Sequence
  Description of Artificial Sequence: Synthetic oligonucleotide
ccgagagagcctgcggaacttgcg

SEQ ID NO: 374490 - DNA, 24 bp, Artificial Sequence
  Description of Artificial Sequence: Synthetic oligonucleotide
cgagagagcctgcggaacttgcgc

SEQ ID NO: 374491 - DNA, 24 bp, Artificial Sequence
  Description of Artificial Sequence: Synthetic oligonucleotide
gagagagcctgcggaacttgcgcg

SEQ ID NO: 374492 - DNA, 24 bp, Artificial Sequence
  Description of Artificial Sequence: Synthetic oligonucleotide
agagagcctgcggaacttgcgcgg

SEQ ID NO: 374493 - DNA, 23 bp, Artificial Sequence
  Description of Artificial Sequence: Synthetic oligonucleotide
gagagcctgcggaacttgcgcgg

SEQ ID NO: 374494 - DNA, 25 bp, Artificial Sequence
  Description of Artificial Sequence: Synthetic oligonucleotide
agagcctgcggaacttgcgcggcta

SEQ ID NO: 374495 - DNA, 24 bp, Artificial Sequence
  Description of Artificial Sequence: Synthetic oligonucleotide
gagcctgcggaacttgcgcggcta

SEQ ID NO: 374496 - DNA, 26 bp, Artificial Sequence
  Description of Artificial Sequence: Synthetic oligonucleotide
agcctgcggaacttgcgcggctacta

SEQ ID NO: 374497 - DNA, 25 bp, Artificial Sequence
  Description of Artificial Sequence: Synthetic oligonucleotide
gcctgcggaacttgcgcggctacta

SEQ ID NO: 374498 - DNA, 27 bp, Artificial Sequence
  Description of Artificial Sequence: Synthetic oligonucleotide
cctgcggaacttgcgcggctactacaa

SEQ ID NO: 374499 - DNA, 27 bp, Artificial Sequence
  Description of Artificial Sequence: Synthetic oligonucleotide
ctgcggaacttgcgcggctactacaac

SEQ ID NO: 374500 - DNA, 27 bp, Artificial Sequence
  Description of Artificial Sequence: Synthetic oligonucleotide
tgcggaacttgcgcggctactacaacc

SEQ ID NO: 374501 - DNA, 27 bp, Artificial Sequence
  Description of Artificial Sequence: Synthetic oligonucleotide
gcggaacttgcgcggctactacaacca

SEQ ID NO: 374502 - DNA, 27 bp, Artificial Sequence
  Description of Artificial Sequence: Synthetic oligonucleotide
cggaacttgcgcggctactacaaccag

SEQ ID NO: 374503 - DNA, 28 bp, Artificial Sequence
  Description of Artificial Sequence: Synthetic oligonucleotide
ggaacttgcgcggctactacaaccagag

SEQ ID NO: 374504 - DNA, 28 bp, Artificial Sequence
  Description of Artificial Sequence: Synthetic oligonucleotide
gaacttgcgcggctactacaaccagagc

SEQ ID NO: 374505 - DNA, 28 bp, Artificial Sequence
  Description of Artificial Sequence: Synthetic oligonucleotide
aacttgcgcggctactacaaccagagcg

SEQ ID NO: 374506 - DNA, 27 bp, Artificial Sequence
  Description of Artificial Sequence: Synthetic oligonucleotide
acttgcgcggctactacaaccagagcg

SEQ ID NO: 374507 - DNA, 27 bp, Artificial Sequence
  Description of Artificial Sequence: Synthetic oligonucleotide
cttgcgcggctactacaaccagagcga

SEQ ID NO: 374508 - DNA, 27 bp, Artificial Sequence
  Description of Artificial Sequence: Synthetic oligonucleotide
ttgcgcggctactacaaccagagcgag

SEQ ID NO: 374509 - DNA, 27 bp, Artificial Sequence
  Description of Artificial Sequence: Synthetic oligonucleotide
tccaggatactcgtgacgcgtccccat

SEQ ID NO: 374510 - DNA, 27 bp, Artificial Sequence
  Description of Artificial Sequence: Synthetic oligonucleotide
ccaggatactcgtgacgcgtccccatt

SEQ ID NO: 374511 - DNA, 28 bp, Artificial Sequence
  Description of Artificial Sequence: Synthetic oligonucleotide
caggatactcgtgacgcgtccccatttc

SEQ ID NO: 374512 - DNA, 28 bp, Artificial Sequence
  Description of Artificial Sequence: Synthetic oligonucleotide
aggatactcgtgacgcgtccccatttcc

SEQ ID NO: 374513 - DNA, 27 bp, Artificial Sequence
  Description of Artificial Sequence: Synthetic oligonucleotide
ggatactcgtgacgcgtccccatttcc

SEQ ID NO: 374514 - DNA, 27 bp, Artificial Sequence
  Description of Artificial Sequence: Synthetic oligonucleotide
gatactcgtgacgcgtccccatttccc

SEQ ID NO: 374515 - DNA, 28 bp, Artificial Sequence
  Description of Artificial Sequence: Synthetic oligonucleotide
atactcgtgacgcgtccccatttcccac

SEQ ID NO: 374516 - DNA, 27 bp, Artificial Sequence
  Description of Artificial Sequence: Synthetic oligonucleotide
tactcgtgacgcgtccccatttcccac

SEQ ID NO: 374517 - DNA, 27 bp, Artificial Sequence
  Description of Artificial Sequence: Synthetic oligonucleotide
actcgtgacgcgtccccatttcccact

SEQ ID NO: 374518 - DNA, 26 bp, Artificial Sequence
  Description of Artificial Sequence: Synthetic oligonucleotide
ctcgtgacgcgtccccatttcccact

SEQ ID NO: 374519 - DNA, 26 bp, Artificial Sequence
  Description of Artificial Sequence: Synthetic oligonucleotide
tcgtgacgcgtccccatttcccactc

SEQ ID NO: 374520 - DNA, 25 bp, Artificial Sequence
  Description of Artificial Sequence: Synthetic oligonucleotide
cgtgacgcgtccccatttcccactc

SEQ ID NO: 374521 - DNA, 25 bp, Artificial Sequence
  Description of Artificial Sequence: Synthetic oligonucleotide
gtgacgcgtccccatttcccactcc

SEQ ID NO: 374522 - DNA, 27 bp, Artificial Sequence
  Description of Artificial Sequence: Synthetic oligonucleotide
tgacgcgtccccatttcccactcccat

SEQ ID NO: 374523 - DNA, 27 bp, Artificial Sequence
  Description of Artificial Sequence: Synthetic oligonucleotide
gacgcgtccccatttcccactcccatt

SEQ ID NO: 374524 - DNA, 27 bp, Artificial Sequence
  Description of Artificial Sequence: Synthetic oligonucleotide
acgcgtccccatttcccactcccattg

SEQ ID NO: 374525 - DNA, 26 bp, Artificial Sequence
  Description of Artificial Sequence: Synthetic oligonucleotide
cgcgtccccatttcccactcccattg

SEQ ID NO: 374526 - DNA, 26 bp, Artificial Sequence
  Description of Artificial Sequence: Synthetic oligonucleotide
gcgtccccatttcccactcccattgg

SEQ ID NO: 374527 - DNA, 27 bp, Artificial Sequence
  Description of Artificial Sequence: Synthetic oligonucleotide
cgtccccatttcccactcccattgggt

SEQ ID NO: 374528 - DNA, 27 bp, Artificial Sequence
  Description of Artificial Sequence: Synthetic oligonucleotide
gtccccatttcccactcccattgggtg

SEQ ID NO: 374529 - DNA, 28 bp, Artificial Sequence
  Description of Artificial Sequence: Synthetic oligonucleotide
tccccatttcccactcccattgggtgtc

SEQ ID NO: 374530 - DNA, 27 bp, Artificial Sequence
  Description of Artificial Sequence: Synthetic oligonucleotide
ccccatttcccactcccattgggtgtc

SEQ ID NO: 374531 - DNA, 27 bp, Artificial Sequence
  Description of Artificial Sequence: Synthetic oligonucleotide
cccatttcccactcccattgggtgtcg

SEQ ID NO: 374532 - DNA, 27 bp, Artificial Sequence
  Description of Artificial Sequence: Synthetic oligonucleotide
ccatttcccactcccattgggtgtcgg

SEQ ID NO: 374533 - DNA, 27 bp, Artificial Sequence
  Description of Artificial Sequence: Synthetic oligonucleotide
catttcccactcccattgggtgtcggg

SEQ ID NO: 374534 - DNA, 28 bp, Artificial Sequence
  Description of Artificial Sequence: Synthetic oligonucleotide
atttcccactcccattgggtgtcgggtg

SEQ ID NO: 374535 - DNA, 27 bp, Artificial Sequence
  Description of Artificial Sequence: Synthetic oligonucleotide
tttcccactcccattgggtgtcgggtg

SEQ ID NO: 374536 - DNA, 26 bp, Artificial Sequence
  Description of Artificial Sequence: Synthetic oligonucleotide
cccacgcacccacccggactcaaaat

SEQ ID NO: 374537 - DNA, 27 bp, Artificial Sequence
  Description of Artificial Sequence: Synthetic oligonucleotide
ccacgcacccacccggactcaaaatct

SEQ ID NO: 374538 - DNA, 27 bp, Artificial Sequence
  Description of Artificial Sequence: Synthetic oligonucleotide
cacgcacccacccggactcaaaatctc

SEQ ID NO: 374539 - DNA, 27 bp, Artificial Sequence
  Description of Artificial Sequence: Synthetic oligonucleotide
acgcacccacccggactcaaaatctcc

SEQ ID NO: 374540 - DNA, 27 bp, Artificial Sequence
  Description of Artificial Sequence: Synthetic oligonucleotide
cgcacccacccggactcaaaatctcct

SEQ ID NO: 374541 - DNA, 27 bp, Artificial Sequence
  Description of Artificial Sequence: Synthetic oligonucleotide
gcacccacccggactcaaaatctcctc

SEQ ID NO: 374542 - DNA, 28 bp, Artificial Sequence
  Description of Artificial Sequence: Synthetic oligonucleotide
cacccacccggactcaaaatctcctcag

SEQ ID NO: 374543 - DNA, 29 bp, Artificial Sequence
  Description of Artificial Sequence: Synthetic oligonucleotide
acccacccggactcaaaatctcctcagac

SEQ ID NO: 374544 - DNA, 28 bp, Artificial Sequence
  Description of Artificial Sequence: Synthetic oligonucleotide
cccacccggactcaaaatctcctcagac

SEQ ID NO: 374545 - DNA, 28 bp, Artificial Sequence
  Description of Artificial Sequence: Synthetic oligonucleotide
ccacccggactcaaaatctcctcagacg

SEQ ID NO: 374546 - DNA, 28 bp, Artificial Sequence
  Description of Artificial Sequence: Synthetic oligonucleotide
cacccggactcaaaatctcctcagacgc

SEQ ID NO: 374547 - DNA, 28 bp, Artificial Sequence
  Description of Artificial Sequence: Synthetic oligonucleotide
acccggactcaaaatctcctcagacgcc

SEQ ID NO: 374548 - DNA, 27 bp, Artificial Sequence
  Description of Artificial Sequence: Synthetic oligonucleotide
cccggactcaaaatctcctcagacgcc

SEQ ID NO: 374549 - DNA, 27 bp, Artificial Sequence
  Description of Artificial Sequence: Synthetic oligonucleotide
ccggactcaaaatctcctcagacgccg

SEQ ID NO: 374550 - DNA, 28 bp, Artificial Sequence
  Description of Artificial Sequence: Synthetic oligonucleotide
cggactcaaaatctcctcagacgccgag

SEQ ID NO: 374551 - DNA, 30 bp, Artificial Sequence
  Description of Artificial Sequence: Synthetic oligonucleotide
ggactcaaaatctcctcagacgccgagatg

SEQ ID NO: 374552 - DNA, 30 bp, Artificial Sequence
  Description of Artificial Sequence: Synthetic oligonucleotide
gactcaaaatctcctcagacgccgagatgc

SEQ ID NO: 374553 - DNA, 30 bp, Artificial Sequence
  Description of Artificial Sequence: Synthetic oligonucleotide
actcaaaatctcctcagacgccgagatgcg

SEQ ID NO: 374554 - DNA, 29 bp, Artificial Sequence
  Description of Artificial Sequence: Synthetic oligonucleotide
ctcaaaatctcctcagacgccgagatgcg

SEQ ID NO: 374555 - DNA, 29 bp, Artificial Sequence
  Description of Artificial Sequence: Synthetic oligonucleotide
tcaaaatctcctcagacgccgagatgcgg

SEQ ID NO: 374556 - DNA, 28 bp, Artificial Sequence
  Description of Artificial Sequence: Synthetic oligonucleotide
caaaatctcctcagacgccgagatgcgg

SEQ ID NO: 374557 - DNA, 28 bp, Artificial Sequence
  Description of Artificial Sequence: Synthetic oligonucleotide
aaaatctcctcagacgccgagatgcggg

SEQ ID NO: 374558 - DNA, 27 bp, Artificial Sequence
  Description of Artificial Sequence: Synthetic oligonucleotide
aaatctcctcagacgccgagatgcggg

SEQ ID NO: 374559 - DNA, 21 bp, Artificial Sequence
  Description of Artificial Sequence: Synthetic oligonucleotide
ggtcacggcgccccgaaccgt

SEQ ID NO: 374560 - DNA, 21 bp, Artificial Sequence
  Description of Artificial Sequence: Synthetic oligonucleotide
gtcacggcgccccgaaccgtc

SEQ ID NO: 374561 - DNA, 22 bp, Artificial Sequence
  Description of Artificial Sequence: Synthetic oligonucleotide
tcacggcgccccgaaccgtcct

SEQ ID NO: 374562 - DNA, 21 bp, Artificial Sequence
  Description of Artificial Sequence: Synthetic oligonucleotide
cacggcgccccgaaccgtcct

SEQ ID NO: 374563 - DNA, 21 bp, Artificial Sequence
  Description of Artificial Sequence: Synthetic oligonucleotide
acggcgccccgaaccgtcctc

SEQ ID NO: 374564 - DNA, 20 bp, Artificial Sequence
  Description of Artificial Sequence: Synthetic oligonucleotide
cggcgccccgaaccgtcctc

SEQ ID NO: 374565 - DNA, 25 bp, Artificial Sequence
  Description of Artificial Sequence: Synthetic oligonucleotide
aaccgtcctcctgctgctctcggga

SEQ ID NO: 374566 - DNA, 24 bp, Artificial Sequence
  Description of Artificial Sequence: Synthetic oligonucleotide
accgtcctcctgctgctctcggga

SEQ ID NO: 374567 - DNA, 23 bp, Artificial Sequence
  Description of Artificial Sequence: Synthetic oligonucleotide
ccgtcctcctgctgctctcggga

SEQ ID NO: 374568 - DNA, 23 bp, Artificial Sequence
  Description of Artificial Sequence: Synthetic oligonucleotide
cgtcctcctgctgctctcgggag

SEQ ID NO: 374569 - DNA, 23 bp, Artificial Sequence
  Description of Artificial Sequence: Synthetic oligonucleotide
gtcctcctgctgctctcgggagc

SEQ ID NO: 374570 - DNA, 23 bp, Artificial Sequence
  Description of Artificial Sequence: Synthetic oligonucleotide
tcctcctgctgctctcgggagcc

SEQ ID NO: 374571 - DNA, 22 bp, Artificial Sequence
  Description of Artificial Sequence: Synthetic oligonucleotide
cctcctgctgctctcgggagcc

SEQ ID NO: 374572 - DNA, 23 bp, Artificial Sequence
  Description of Artificial Sequence: Synthetic oligonucleotide
ctcctgctgctctcgggagccct

SEQ ID NO: 374573 - DNA, 23 bp, Artificial Sequence
  Description of Artificial Sequence: Synthetic oligonucleotide
tcctgctgctctcgggagccctg

SEQ ID NO: 374574 - DNA, 22 bp, Artificial Sequence
  Description of Artificial Sequence: Synthetic oligonucleotide
cctgctgctctcgggagccctg

SEQ ID NO: 374575 - DNA, 22 bp, Artificial Sequence
  Description of Artificial Sequence: Synthetic oligonucleotide
ctgctgctctcgggagccctgg

SEQ ID NO: 374576 - DNA, 22 bp, Artificial Sequence
  Description of Artificial Sequence: Synthetic oligonucleotide
tgctgctctcgggagccctggc

SEQ ID NO: 374577 - DNA, 21 bp, Artificial Sequence
  Description of Artificial Sequence: Synthetic oligonucleotide
gctgctctcgggagccctggc

SEQ ID NO: 374578 - DNA, 21 bp, Artificial Sequence
  Description of Artificial Sequence: Synthetic oligonucleotide
ctgctctcgggagccctggcc

SEQ ID NO: 374579 - DNA, 22 bp, Artificial Sequence
  Description of Artificial Sequence: Synthetic oligonucleotide
tgctctcgggagccctggccct

SEQ ID NO: 374580 - DNA, 21 bp, Artificial Sequence
  Description of Artificial Sequence: Synthetic oligonucleotide
gctctcgggagccctggccct

SEQ ID NO: 374581 - DNA, 22 bp, Artificial Sequence
  Description of Artificial Sequence: Synthetic oligonucleotide
ctctcgggagccctggccctga

SEQ ID NO: 374582 - DNA, 22 bp, Artificial Sequence
  Description of Artificial Sequence: Synthetic oligonucleotide
tctcgggagccctggccctgac

SEQ ID NO: 374583 - DNA, 21 bp, Artificial Sequence
  Description of Artificial Sequence: Synthetic oligonucleotide
ctcgggagccctggccctgac

SEQ ID NO: 374584 - DNA, 21 bp, Artificial Sequence
  Description of Artificial Sequence: Synthetic oligonucleotide
tcgggagccctggccctgacc

SEQ ID NO: 374585 - DNA, 20 bp, Artificial Sequence
  Description of Artificial Sequence: Synthetic oligonucleotide
cgggagccctggccctgacc

SEQ ID NO: 374586 - DNA, 21 bp, Artificial Sequence
  Description of Artificial Sequence: Synthetic oligonucleotide
gggagccctggccctgaccga

SEQ ID NO: 374587 - DNA, 22 bp, Artificial Sequence
  Description of Artificial Sequence: Synthetic oligonucleotide
ggagccctggccctgaccgaga

SEQ ID NO: 374588 - DNA, 22 bp, Artificial Sequence
  Description of Artificial Sequence: Synthetic oligonucleotide
gagccctggccctgaccgagac

SEQ ID NO: 374589 - DNA, 23 bp, Artificial Sequence
  Description of Artificial Sequence: Synthetic oligonucleotide
agccctggccctgaccgagacct

SEQ ID NO: 374590 - DNA, 24 bp, Artificial Sequence
  Description of Artificial Sequence: Synthetic oligonucleotide
gcagtgggctacgtggacgacacc

SEQ ID NO: 374591 - DNA, 22 bp, Artificial Sequence
  Description of Artificial Sequence: Synthetic oligonucleotide
acagcgacgccgcgagtccgag

SEQ ID NO: 374592 - DNA, 21 bp, Artificial Sequence
  Description of Artificial Sequence: Synthetic oligonucleotide
cagcgacgccgcgagtccgag

SEQ ID NO: 374593 - DNA, 23 bp, Artificial Sequence
  Description of Artificial Sequence: Synthetic oligonucleotide
agcgacgccgcgagtccgaggat

SEQ ID NO: 374594 - DNA, 22 bp, Artificial Sequence
  Description of Artificial Sequence: Synthetic oligonucleotide
gcgacgccgcgagtccgaggat

SEQ ID NO: 374595 - DNA, 22 bp, Artificial Sequence
  Description of Artificial Sequence: Synthetic oligonucleotide
cgacgccgcgagtccgaggatg

SEQ ID NO: 374596 - DNA, 22 bp, Artificial Sequence
  Description of Artificial Sequence: Synthetic oligonucleotide
gacgccgcgagtccgaggatgg

SEQ ID NO: 374597 - DNA, 22 bp, Artificial Sequence
  Description of Artificial Sequence: Synthetic oligonucleotide
acgccgcgagtccgaggatggc

SEQ ID NO: 374598 - DNA, 21 bp, Artificial Sequence
  Description of Artificial Sequence: Synthetic oligonucleotide
cgccgcgagtccgaggatggc

SEQ ID NO: 374599 - DNA, 21 bp, Artificial Sequence
  Description of Artificial Sequence: Synthetic oligonucleotide
gccgcgagtccgaggatggcg

SEQ ID NO: 374600 - DNA, 21 bp, Artificial Sequence
  Description of Artificial Sequence: Synthetic oligonucleotide
ccgcgagtccgaggatggcgc

SEQ ID NO: 374601 - DNA, 21 bp, Artificial Sequence
  Description of Artificial Sequence: Synthetic oligonucleotide
cgcgagtccgaggatggcgcc

SEQ ID NO: 374602 - DNA, 21 bp, Artificial Sequence
  Description of Artificial Sequence: Synthetic oligonucleotide
gcgagtccgaggatggcgccc

SEQ ID NO: 374603 - DNA, 21 bp, Artificial Sequence
  Description of Artificial Sequence: Synthetic oligonucleotide
cggcccgtgaggcggagcagt

SEQ ID NO: 374604 - DNA, 21 bp, Artificial Sequence
  Description of Artificial Sequence: Synthetic oligonucleotide
ggcccgtgaggcggagcagtg

SEQ ID NO: 374605 - DNA, 22 bp, Artificial Sequence
  Description of Artificial Sequence: Synthetic oligonucleotide
gcccgtgaggcggagcagtgga

SEQ ID NO: 374606 - DNA, 23 bp, Artificial Sequence
  Description of Artificial Sequence: Synthetic oligonucleotide
cccgtgaggcggagcagtggaga

SEQ ID NO: 374607 - DNA, 23 bp, Artificial Sequence
  Description of Artificial Sequence: Synthetic oligonucleotide
ccgtgaggcggagcagtggagag

SEQ ID NO: 374608 - DNA, 23 bp, Artificial Sequence
  Description of Artificial Sequence: Synthetic oligonucleotide
cgtgaggcggagcagtggagagc

SEQ ID NO: 374609 - DNA, 25 bp, Artificial Sequence
  Description of Artificial Sequence: Synthetic oligonucleotide
gtgaggcggagcagtggagagccta

SEQ ID NO: 374610 - DNA, 25 bp, Artificial Sequence
  Description of Artificial Sequence: Synthetic oligonucleotide
agtggagagcctacctggagggcct

SEQ ID NO: 374611 - DNA, 24 bp, Artificial Sequence
  Description of Artificial Sequence: Synthetic oligonucleotide
gtggagagcctacctggagggcct

SEQ ID NO: 374612 - DNA, 25 bp, Artificial Sequence
  Description of Artificial Sequence: Synthetic oligonucleotide
tggagagcctacctggagggcctgt

SEQ ID NO: 374613 - DNA, 27 bp, Artificial Sequence
  Description of Artificial Sequence: Synthetic oligonucleotide
gatgggagccatcttcccagtccacca

SEQ ID NO: 374614 - DNA, 28 bp, Artificial Sequence
  Description of Artificial Sequence: Synthetic oligonucleotide
atgggagccatcttcccagtccaccatc

SEQ ID NO: 374615 - DNA, 27 bp, Artificial Sequence
  Description of Artificial Sequence: Synthetic oligonucleotide
tgggagccatcttcccagtccaccatc

SEQ ID NO: 374616 - DNA, 26 bp, Artificial Sequence
  Description of Artificial Sequence: Synthetic oligonucleotide
gggagccatcttcccagtccaccatc

SEQ ID NO: 374617 - DNA, 26 bp, Artificial Sequence
  Description of Artificial Sequence: Synthetic oligonucleotide
ggagccatcttcccagtccaccatcc

SEQ ID NO: 374618 - DNA, 26 bp, Artificial Sequence
  Description of Artificial Sequence: Synthetic oligonucleotide
gagccatcttcccagtccaccatccc

SEQ ID NO: 374619 - DNA, 27 bp, Artificial Sequence
  Description of Artificial Sequence: Synthetic oligonucleotide
agccatcttcccagtccaccatcccca

SEQ ID NO: 374620 - DNA, 27 bp, Artificial Sequence
  Description of Artificial Sequence: Synthetic oligonucleotide
gccatcttcccagtccaccatccccat

SEQ ID NO: 374621 - DNA, 27 bp, Artificial Sequence
  Description of Artificial Sequence: Synthetic oligonucleotide
ccatcttcccagtccaccatccccatc

SEQ ID NO: 374622 - DNA, 27 bp, Artificial Sequence
  Description of Artificial Sequence: Synthetic oligonucleotide
catcttcccagtccaccatccccatcg

SEQ ID NO: 374623 - DNA, 28 bp, Artificial Sequence
  Description of Artificial Sequence: Synthetic oligonucleotide
atcttcccagtccaccatccccatcgtg

SEQ ID NO: 374624 - DNA, 28 bp, Artificial Sequence
  Description of Artificial Sequence: Synthetic oligonucleotide
ttgtggtcatcggagctgtggtcgctac

SEQ ID NO: 374625 - DNA, 27 bp, Artificial Sequence
  Description of Artificial Sequence: Synthetic oligonucleotide
tgtggtcatcggagctgtggtcgctac

SEQ ID NO: 374626 - DNA, 27 bp, Artificial Sequence
  Description of Artificial Sequence: Synthetic oligonucleotide
gtggtcatcggagctgtggtcgctact

SEQ ID NO: 374627 - DNA, 27 bp, Artificial Sequence
  Description of Artificial Sequence: Synthetic oligonucleotide
tggtcatcggagctgtggtcgctactg

SEQ ID NO: 374628 - DNA, 27 bp, Artificial Sequence
  Description of Artificial Sequence: Synthetic oligonucleotide
ggtcatcggagctgtggtcgctactgt

SEQ ID NO: 374629 - DNA, 27 bp, Artificial Sequence
  Description of Artificial Sequence: Synthetic oligonucleotide
gtcatcggagctgtggtcgctactgtg

SEQ ID NO: 374630 - DNA, 29 bp, Artificial Sequence
  Description of Artificial Sequence: Synthetic oligonucleotide
tcatcggagctgtggtcgctactgtgatg

SEQ ID NO: 374631 - DNA, 28 bp, Artificial Sequence
  Description of Artificial Sequence: Synthetic oligonucleotide
catcggagctgtggtcgctactgtgatg

SEQ ID NO: 374632 - DNA, 29 bp, Artificial Sequence
  Description of Artificial Sequence: Synthetic oligonucleotide
atcggagctgtggtcgctactgtgatgtg

SEQ ID NO: 374633 - DNA, 28 bp, Artificial Sequence
  Description of Artificial Sequence: Synthetic oligonucleotide
tcggagctgtggtcgctactgtgatgtg

SEQ ID NO: 374634 - DNA, 27 bp, Artificial Sequence
  Description of Artificial Sequence: Synthetic oligonucleotide
cggagctgtggtcgctactgtgatgtg

SEQ ID NO: 374635 - DNA, 29 bp, Artificial Sequence
  Description of Artificial Sequence: Synthetic oligonucleotide
ggagctgtggtcgctactgtgatgtgtag

SEQ ID NO: 374636 - DNA, 29 bp, Artificial Sequence
  Description of Artificial Sequence: Synthetic oligonucleotide
gagctgtggtcgctactgtgatgtgtagg

SEQ ID NO: 374637 - DNA, 30 bp, Artificial Sequence; identical to SEQ ID NO: 22962
  Description of Artificial Sequence: Synthetic oligonucleotide

SEQ ID NO: 374638 - DNA, 29 bp, Artificial Sequence
  Description of Artificial Sequence: Synthetic oligonucleotide
gctgtggtcgctactgtgatgtgtaggag

SEQ ID NO: 374639 - DNA, 29 bp, Artificial Sequence
  Description of Artificial Sequence: Synthetic oligonucleotide
ctgtggtcgctactgtgatgtgtaggagg

SEQ ID NO: 374640 - DNA, 31 bp, Artificial Sequence; identical to SEQ ID NO: 22965
  Description of Artificial Sequence: Synthetic oligonucleotide

SEQ ID NO: 374641 - DNA, 30 bp, Artificial Sequence; identical to SEQ ID NO: 22966
  Description of Artificial Sequence: Synthetic oligonucleotide

SEQ ID NO: 374642 - DNA, 31 bp, Artificial Sequence; identical to SEQ ID NO: 22967
  Description of Artificial Sequence: Synthetic oligonucleotide

SEQ ID NO: 374643 - DNA, 30 bp, Artificial Sequence; identical to SEQ ID NO: 22968
  Description of Artificial Sequence: Synthetic oligonucleotide

SEQ ID NO: 374644 - DNA, 30 bp, Artificial Sequence; identical to SEQ ID NO: 22969
  Description of Artificial Sequence: Synthetic oligonucleotide

SEQ ID NO: 374645 - DNA, 31 bp, Artificial Sequence; identical to SEQ ID NO: 22970
  Description of Artificial Sequence: Synthetic oligonucleotide

SEQ ID NO: 374646 - DNA, 30 bp, Artificial Sequence; identical to SEQ ID NO: 22971
  Description of Artificial Sequence: Synthetic oligonucleotide

SEQ ID NO: 374647 - DNA, 31 bp, Artificial Sequence; identical to SEQ ID NO: 22972
  Description of Artificial Sequence: Synthetic oligonucleotide

SEQ ID NO: 374648 - DNA, 31 bp, Artificial Sequence; identical to SEQ ID NO: 27151
  Description of Artificial Sequence: Synthetic oligonucleotide

SEQ ID NO: 374649 - DNA, 32 bp, Artificial Sequence; identical to SEQ ID NO: 27152
  Description of Artificial Sequence: Synthetic oligonucleotide

SEQ ID NO: 374650 - DNA, 31 bp, Artificial Sequence; identical to SEQ ID NO: 27153
  Description of Artificial Sequence: Synthetic oligonucleotide

SEQ ID NO: 374651 - DNA, 27 bp, Artificial Sequence
  Description of Artificial Sequence: Synthetic oligonucleotide
catgaccagtccgcctacgacggcaaa

SEQ ID NO: 374652 - DNA, 27 bp, Artificial Sequence
  Description of Artificial Sequence: Synthetic oligonucleotide
atgaccagtccgcctacgacggcaaag

SEQ ID NO: 374653 - DNA, 27 bp, Artificial Sequence
  Description of Artificial Sequence: Synthetic oligonucleotide
tgaccagtccgcctacgacggcaaaga

SEQ ID NO: 374654 - DNA, 27 bp, Artificial Sequence
  Description of Artificial Sequence: Synthetic oligonucleotide
gaccagtccgcctacgacggcaaagat

SEQ ID NO: 374655 - DNA, 29 bp, Artificial Sequence
  Description of Artificial Sequence: Synthetic oligonucleotide
accagtccgcctacgacggcaaagattac

SEQ ID NO: 374656 - DNA, 28 bp, Artificial Sequence
  Description of Artificial Sequence: Synthetic oligonucleotide
ccagtccgcctacgacggcaaagattac

SEQ ID NO: 374657 - DNA, 30 bp, Artificial Sequence; identical to SEQ ID NO: 27298
  Description of Artificial Sequence: Synthetic oligonucleotide

SEQ ID NO: 374658 - DNA, 30 bp, Artificial Sequence; identical to SEQ ID NO: 27299
  Description of Artificial Sequence: Synthetic oligonucleotide

SEQ ID NO: 374659 - DNA, 29 bp, Artificial Sequence
  Description of Artificial Sequence: Synthetic oligonucleotide
gtccgcctacgacggcaaagattacatcg

SEQ ID NO: 374660 - DNA, 29 bp, Artificial Sequence
  Description of Artificial Sequence: Synthetic oligonucleotide
tccgcctacgacggcaaagattacatcgc

SEQ ID NO: 374661 - DNA, 28 bp, Artificial Sequence
  Description of Artificial Sequence: Synthetic oligonucleotide
ccgcctacgacggcaaagattacatcgc

SEQ ID NO: 374662 - DNA, 32 bp, Artificial Sequence; identical to SEQ ID NO: 27303
  Description of Artificial Sequence: Synthetic oligonucleotide

SEQ ID NO: 374663 - DNA, 31 bp, Artificial Sequence; identical to SEQ ID NO: 27304
  Description of Artificial Sequence: Synthetic oligonucleotide

SEQ ID NO: 374664 - DNA, 30 bp, Artificial Sequence; identical to SEQ ID NO: 27305
  Description of Artificial Sequence: Synthetic oligonucleotide

SEQ ID NO: 374665 - DNA, 32 bp, Artificial Sequence; identical to SEQ ID NO: 27306
  Description of Artificial Sequence: Synthetic oligonucleotide

SEQ ID NO: 374666 - DNA, 31 bp, Artificial Sequence; identical to SEQ ID NO: 27307
  Description of Artificial Sequence: Synthetic oligonucleotide

SEQ ID NO: 374667 - DNA, 30 bp, Artificial Sequence; identical to SEQ ID NO: 27308
  Description of Artificial Sequence: Synthetic oligonucleotide

SEQ ID NO: 374668 - DNA, 30 bp, Artificial Sequence; identical to SEQ ID NO: 27309
  Description of Artificial Sequence: Synthetic oligonucleotide

SEQ ID NO: 374669 - DNA, 31 bp, Artificial Sequence; identical to SEQ ID NO: 27310
  Description of Artificial Sequence: Synthetic oligonucleotide

SEQ ID NO: 374670 - DNA, 30 bp, Artificial Sequence; identical to SEQ ID NO: 27311
  Description of Artificial Sequence: Synthetic oligonucleotide

SEQ ID NO: 374671 - DNA, 29 bp, Artificial Sequence
  Description of Artificial Sequence: Synthetic oligonucleotide
tacatcgccctgaatgaggacctgagctc

SEQ ID NO: 374672 - DNA, 28 bp, Artificial Sequence
  Description of Artificial Sequence: Synthetic oligonucleotide
acatcgccctgaatgaggacctgagctc

SEQ ID NO: 374673 - DNA, 27 bp, Artificial Sequence
  Description of Artificial Sequence: Synthetic oligonucleotide
catcgccctgaatgaggacctgagctc

SEQ ID NO: 374674 - DNA, 27 bp, Artificial Sequence
  Description of Artificial Sequence: Synthetic oligonucleotide
atcgccctgaatgaggacctgagctcc

SEQ ID NO: 374675 - DNA, 27 bp, Artificial Sequence
  Description of Artificial Sequence: Synthetic oligonucleotide
tcgccctgaatgaggacctgagctcct

SEQ ID NO: 374676 - DNA, 26 bp, Artificial Sequence
  Description of Artificial Sequence: Synthetic oligonucleotide
cgccctgaatgaggacctgagctcct

SEQ ID NO: 374677 - DNA, 26 bp, Artificial Sequence
  Description of Artificial Sequence: Synthetic oligonucleotide
gccctgaatgaggacctgagctcctg

SEQ ID NO: 374678 - DNA, 27 bp, Artificial Sequence
  Description of Artificial Sequence: Synthetic oligonucleotide
ccctgaatgaggacctgagctcctgga

SEQ ID NO: 374679 - DNA, 27 bp, Artificial Sequence
  Description of Artificial Sequence: Synthetic oligonucleotide
cctgaatgaggacctgagctcctggac

SEQ ID NO: 374680 - DNA, 27 bp, Artificial Sequence
  Description of Artificial Sequence: Synthetic oligonucleotide
ctgaatgaggacctgagctcctggacc

SEQ ID NO: 374681 - DNA, 27 bp, Artificial Sequence
  Description of Artificial Sequence: Synthetic oligonucleotide
tgaatgaggacctgagctcctggaccg

SEQ ID NO: 374682 - DNA, 26 bp, Artificial Sequence
  Description of Artificial Sequence: Synthetic oligonucleotide
gaatgaggacctgagctcctggaccg

SEQ ID NO: 374683 - DNA, 26 bp, Artificial Sequence
  Description of Artificial Sequence: Synthetic oligonucleotide
aatgaggacctgagctcctggaccgc

SEQ ID NO: 374684 - DNA, 25 bp, Artificial Sequence
  Description of Artificial Sequence: Synthetic oligonucleotide
atgaggacctgagctcctggaccgc

SEQ ID NO: 374685 - DNA, 24 bp, Artificial Sequence
  Description of Artificial Sequence: Synthetic oligonucleotide
tgaggacctgagctcctggaccgc

SEQ ID NO: 374686 - DNA, 22 bp, Artificial Sequence
  Description of Artificial Sequence: Synthetic oligonucleotide
ggccctgggcttctaccctgcc

SEQ ID NO: 374687 - DNA, 23 bp, Artificial Sequence
  Description of Artificial Sequence: Synthetic oligonucleotide
gccctgggcttctaccctgccga

SEQ ID NO: 374688 - DNA, 25 bp, Artificial Sequence
  Description of Artificial Sequence: Synthetic oligonucleotide
ccctgggcttctaccctgccgagat

SEQ ID NO: 374689 - DNA, 26 bp, Artificial Sequence
  Description of Artificial Sequence: Synthetic oligonucleotide
cctgggcttctaccctgccgagatca

SEQ ID NO: 374690 - DNA, 27 bp, Artificial Sequence
  Description of Artificial Sequence: Synthetic oligonucleotide
ctgggcttctaccctgccgagatcaca

SEQ ID NO: 374691 - DNA, 27 bp, Artificial Sequence
  Description of Artificial Sequence: Synthetic oligonucleotide
tgggcttctaccctgccgagatcacac

SEQ ID NO: 374692 - DNA, 27 bp, Artificial Sequence
  Description of Artificial Sequence: Synthetic oligonucleotide
gggcttctaccctgccgagatcacact

SEQ ID NO: 374693 - DNA, 27 bp, Artificial Sequence
  Description of Artificial Sequence: Synthetic oligonucleotide
ggcttctaccctgccgagatcacactg

SEQ ID NO: 374694 - DNA, 28 bp, Artificial Sequence
  Description of Artificial Sequence: Synthetic oligonucleotide
gcttctaccctgccgagatcacactgac

SEQ ID NO: 374695 - DNA, 28 bp, Artificial Sequence
  Description of Artificial Sequence: Synthetic oligonucleotide
cttctaccctgccgagatcacactgacc

SEQ ID NO: 374696 - DNA, 29 bp, Artificial Sequence
  Description of Artificial Sequence: Synthetic oligonucleotide
ttctaccctgccgagatcacactgacctg

SEQ ID NO: 374697 - DNA, 28 bp, Artificial Sequence
  Description of Artificial Sequence: Synthetic oligonucleotide
tctaccctgccgagatcacactgacctg

SEQ ID NO: 374698 - DNA, 27 bp, Artificial Sequence
  Description of Artificial Sequence: Synthetic oligonucleotide
ctaccctgccgagatcacactgacctg

SEQ ID NO: 374699 - DNA, 27 bp, Artificial Sequence
  Description of Artificial Sequence: Synthetic oligonucleotide
taccctgccgagatcacactgacctgg

SEQ ID NO: 374700 - DNA, 26 bp, Artificial Sequence
  Description of Artificial Sequence: Synthetic oligonucleotide
accctgccgagatcacactgacctgg

SEQ ID NO: 374701 - DNA, 25 bp, Artificial Sequence
  Description of Artificial Sequence: Synthetic oligonucleotide
ccctgccgagatcacactgacctgg

SEQ ID NO: 374702 - DNA, 26 bp, Artificial Sequence
  Description of Artificial Sequence: Synthetic oligonucleotide
cctgccgagatcacactgacctggca

SEQ ID NO: 374703 - DNA, 26 bp, Artificial Sequence
  Description of Artificial Sequence: Synthetic oligonucleotide
ctgccgagatcacactgacctggcag

SEQ ID NO: 374704 - DNA, 26 bp, Artificial Sequence
  Description of Artificial Sequence: Synthetic oligonucleotide
tgccgagatcacactgacctggcagc

SEQ ID NO: 374705 - DNA, 25 bp, Artificial Sequence
  Description of Artificial Sequence: Synthetic oligonucleotide
gccgagatcacactgacctggcagc

SEQ ID NO: 374706 - DNA, 25 bp, Artificial Sequence
  Description of Artificial Sequence: Synthetic oligonucleotide
ccgagatcacactgacctggcagcg

SEQ ID NO: 374707 - DNA, 25 bp, Artificial Sequence
  Description of Artificial Sequence: Synthetic oligonucleotide
cgagatcacactgacctggcagcgg

SEQ ID NO: 374708 - DNA, 27 bp, Artificial Sequence
  Description of Artificial Sequence: Synthetic oligonucleotide
atcacactgacctggcagcgggatggt

SEQ ID NO: 374709 - DNA, 26 bp, Artificial Sequence
  Description of Artificial Sequence: Synthetic oligonucleotide
tcacactgacctggcagcgggatggt

SEQ ID NO: 374710 - DNA, 25 bp, Artificial Sequence
  Description of Artificial Sequence: Synthetic oligonucleotide
cacactgacctggcagcgggatggt

SEQ ID NO: 374711 - DNA, 26 bp, Artificial Sequence
  Description of Artificial Sequence: Synthetic oligonucleotide
acactgacctggcagcgggatggtga

SEQ ID NO: 374712 - DNA, 25 bp, Artificial Sequence
  Description of Artificial Sequence: Synthetic oligonucleotide
cactgacctggcagcgggatggtga

SEQ ID NO: 374713 - DNA, 25 bp, Artificial Sequence
  Description of Artificial Sequence: Synthetic oligonucleotide
actgacctggcagcgggatggtgag

SEQ ID NO: 374714 - DNA, 24 bp, Artificial Sequence
  Description of Artificial Sequence: Synthetic oligonucleotide
ctgacctggcagcgggatggtgag

SEQ ID NO: 374715 - DNA, 25 bp, Artificial Sequence
  Description of Artificial Sequence: Synthetic oligonucleotide
tgacctggcagcgggatggtgagga

SEQ ID NO: 374716 - DNA, 24 bp, Artificial Sequence
  Description of Artificial Sequence: Synthetic oligonucleotide
gacctggcagcgggatggtgagga

SEQ ID NO: 374717 - DNA, 24 bp, Artificial Sequence
  Description of Artificial Sequence: Synthetic oligonucleotide
acctggcagcgggatggtgaggac

SEQ ID NO: 374718 - DNA, 23 bp, Artificial Sequence
  Description of Artificial Sequence: Synthetic oligonucleotide
cctggcagcgggatggtgaggac

SEQ ID NO: 374719 - DNA, 26 bp, Artificial Sequence
  Description of Artificial Sequence: Synthetic oligonucleotide
ctggcagcgggatggtgaggaccaaa

SEQ ID NO: 374720 - DNA, 27 bp, Artificial Sequence
  Description of Artificial Sequence: Synthetic oligonucleotide
tggcagcgggatggtgaggaccaaact

SEQ ID NO: 374721 - DNA, 26 bp, Artificial Sequence
  Description of Artificial Sequence: Synthetic oligonucleotide
ggcagcgggatggtgaggaccaaact

SEQ ID NO: 374722 - DNA, 27 bp, Artificial Sequence
  Description of Artificial Sequence: Synthetic oligonucleotide
gcagcgggatggtgaggaccaaactca

SEQ ID NO: 374723 - DNA, 27 bp, Artificial Sequence
  Description of Artificial Sequence: Synthetic oligonucleotide
cagcgggatggtgaggaccaaactcag

SEQ ID NO: 374724 - DNA, 27 bp, Artificial Sequence
  Description of Artificial Sequence: Synthetic oligonucleotide
agcgggatggtgaggaccaaactcagg

SEQ ID NO: 374725 - DNA, 27 bp, Artificial Sequence
  Description of Artificial Sequence: Synthetic oligonucleotide
gcgggatggtgaggaccaaactcagga

SEQ ID NO: 374726 - DNA, 27 bp, Artificial Sequence
  Description of Artificial Sequence: Synthetic oligonucleotide
cgggatggtgaggaccaaactcaggac

SEQ ID NO: 374727 - DNA, 28 bp, Artificial Sequence
  Description of Artificial Sequence: Synthetic oligonucleotide
gggatggtgaggaccaaactcaggacac

SEQ ID NO: 374728 - DNA, 28 bp, Artificial Sequence
  Description of Artificial Sequence: Synthetic oligonucleotide
ggatggtgaggaccaaactcaggacacc

SEQ ID NO: 374729 - DNA, 28 bp, Artificial Sequence
  Description of Artificial Sequence: Synthetic oligonucleotide
gatggtgaggaccaaactcaggacaccg

SEQ ID NO: 374730 - DNA, 29 bp, Artificial Sequence
  Description of Artificial Sequence: Synthetic oligonucleotide
atggtgaggaccaaactcaggacaccgag

SEQ ID NO: 374731 - DNA, 28 bp, Artificial Sequence
  Description of Artificial Sequence: Synthetic oligonucleotide
tggtgaggaccaaactcaggacaccgag

SEQ ID NO: 374732 - DNA, 27 bp, Artificial Sequence
  Description of Artificial Sequence: Synthetic oligonucleotide
ggtgaggaccaaactcaggacaccgag

SEQ ID NO: 374733 - DNA, 27 bp, Artificial Sequence
  Description of Artificial Sequence: Synthetic oligonucleotide
gtgaggaccaaactcaggacaccgagc

SEQ ID NO: 374734 - DNA, 29 bp, Artificial Sequence
  Description of Artificial Sequence: Synthetic oligonucleotide
tgaggaccaaactcaggacaccgagcttg

SEQ ID NO: 374735 - DNA, 23 bp, Artificial Sequence
  Description of Artificial Sequence: Synthetic oligonucleotide
acctgagctcctggaccgcggca

SEQ ID NO: 374736 - DNA, 22 bp, Artificial Sequence
  Description of Artificial Sequence: Synthetic oligonucleotide
cctgagctcctggaccgcggca

SEQ ID NO: 374737 - DNA, 23 bp, Artificial Sequence
  Description of Artificial Sequence: Synthetic oligonucleotide
ctgagctcctggaccgcggcaga

SEQ ID NO: 374738 - DNA, 24 bp, Artificial Sequence
  Description of Artificial Sequence: Synthetic oligonucleotide
tgagctcctggaccgcggcagaca

SEQ ID NO: 374739 - DNA, 23 bp, Artificial Sequence
  Description of Artificial Sequence: Synthetic oligonucleotide
gagctcctggaccgcggcagaca

SEQ ID NO: 374740 - DNA, 23 bp, Artificial Sequence
  Description of Artificial Sequence: Synthetic oligonucleotide
agctcctggaccgcggcagacac

SEQ ID NO: 374741 - DNA, 22 bp, Artificial Sequence
  Description of Artificial Sequence: Synthetic oligonucleotide
gctcctggaccgcggcagacac

SEQ ID NO: 374742 - DNA, 22 bp, Artificial Sequence
  Description of Artificial Sequence: Synthetic oligonucleotide
ctcctggaccgcggcagacacg

SEQ ID NO: 374743 - DNA, 22 bp, Artificial Sequence
  Description of Artificial Sequence: Synthetic oligonucleotide
tcctggaccgcggcagacacgg

SEQ ID NO: 374744 - DNA, 21 bp, Artificial Sequence
  Description of Artificial Sequence: Synthetic oligonucleotide
cctggaccgcggcagacacgg

SEQ ID NO: 374745 - DNA, 21 bp, Artificial Sequence
  Description of Artificial Sequence: Synthetic oligonucleotide
ctggaccgcggcagacacggc

SEQ ID NO: 374746 - DNA, 21 bp, Artificial Sequence
  Description of Artificial Sequence: Synthetic oligonucleotide
tggaccgcggcagacacggcg

SEQ ID NO: 374747 - DNA, 20 bp, Artificial Sequence
  Description of Artificial Sequence: Synthetic oligonucleotide
ggaccgcggcagacacggcg

SEQ ID NO: 374748 - DNA, 20 bp, Artificial Sequence
  Description of Artificial Sequence: Synthetic oligonucleotide
gaccgcggcagacacggcgg

SEQ ID NO: 374749 - DNA, 21 bp, Artificial Sequence
  Description of Artificial Sequence: Synthetic oligonucleotide
accgcggcagacacggcggct

SEQ ID NO: 374750 - DNA, 20 bp, Artificial Sequence
  Description of Artificial Sequence: Synthetic oligonucleotide
ccgcggcagacacggcggct

SEQ ID NO: 374751 - DNA, 21 bp, Artificial Sequence
  Description of Artificial Sequence: Synthetic oligonucleotide
cgcggcagacacggcggctca

SEQ ID NO: 374752 - DNA, 23 bp, Artificial Sequence
  Description of Artificial Sequence: Synthetic oligonucleotide
gcggcagacacggcggctcagat

SEQ ID NO: 374753 - DNA, 24 bp, Artificial Sequence
  Description of Artificial Sequence: Synthetic oligonucleotide
cggcagacacggcggctcagatca

SEQ ID NO: 374754 - DNA, 24 bp, Artificial Sequence
  Description of Artificial Sequence: Synthetic oligonucleotide
ggcagacacggcggctcagatcac

SEQ ID NO: 374755 - DNA, 29 bp, Artificial Sequence
  Description of Artificial Sequence: Synthetic oligonucleotide
ttcatcgcagtgggctacgtggacgatac

SEQ ID NO: 374756 - DNA, 28 bp, Artificial Sequence
  Description of Artificial Sequence: Synthetic oligonucleotide
tcatcgcagtgggctacgtggacgatac

SEQ ID NO: 374757 - DNA, 27 bp, Artificial Sequence
  Description of Artificial Sequence: Synthetic oligonucleotide
catcgcagtgggctacgtggacgatac

SEQ ID NO: 374758 - DNA, 27 bp, Artificial Sequence
  Description of Artificial Sequence: Synthetic oligonucleotide
atcgcagtgggctacgtggacgatacc

SEQ ID NO: 374759 - DNA, 26 bp, Artificial Sequence
  Description of Artificial Sequence: Synthetic oligonucleotide
tcgcagtgggctacgtggacgatacc

SEQ ID NO: 374760 - DNA, 25 bp, Artificial Sequence
  Description of Artificial Sequence: Synthetic oligonucleotide
cgcagtgggctacgtggacgatacc

SEQ ID NO: 374761 - DNA, 26 bp, Artificial Sequence
  Description of Artificial Sequence: Synthetic oligonucleotide
gcagtgggctacgtggacgataccca

SEQ ID NO: 374762 - DNA, 27 bp, Artificial Sequence
  Description of Artificial Sequence: Synthetic oligonucleotide
cagtgggctacgtggacgatacccagt

SEQ ID NO: 374763 - DNA, 28 bp, Artificial Sequence
  Description of Artificial Sequence: Synthetic oligonucleotide
agtgggctacgtggacgatacccagttc

SEQ ID NO: 374764 - DNA, 27 bp, Artificial Sequence
  Description of Artificial Sequence: Synthetic oligonucleotide
gtgggctacgtggacgatacccagttc

SEQ ID NO: 374765 - DNA, 27 bp, Artificial Sequence
  Description of Artificial Sequence: Synthetic oligonucleotide
tgggctacgtggacgatacccagttcg

SEQ ID NO: 374766 - DNA, 27 bp, Artificial Sequence
  Description of Artificial Sequence: Synthetic oligonucleotide
gggctacgtggacgatacccagttcgt

SEQ ID NO: 374767 - DNA, 27 bp, Artificial Sequence
  Description of Artificial Sequence: Synthetic oligonucleotide
ggctacgtggacgatacccagttcgtg

SEQ ID NO: 374768 - DNA, 28 bp, Artificial Sequence
  Description of Artificial Sequence: Synthetic oligonucleotide
gctacgtggacgatacccagttcgtgag

SEQ ID NO: 374769 - DNA, 28 bp, Artificial Sequence
  Description of Artificial Sequence: Synthetic oligonucleotide
ctacgtggacgatacccagttcgtgagg

SEQ ID NO: 374770 - DNA, 30 bp, Artificial Sequence; identical to SEQ ID NO: 27411
  Description of Artificial Sequence: Synthetic oligonucleotide

SEQ ID NO: 374771 - DNA, 29 bp, Artificial Sequence
  Description of Artificial Sequence: Synthetic oligonucleotide
acgtggacgatacccagttcgtgaggttc

SEQ ID NO: 374772 - DNA, 28 bp, Artificial Sequence
  Description of Artificial Sequence: Synthetic oligonucleotide
cgtggacgatacccagttcgtgaggttc

SEQ ID NO: 374773 - DNA, 28 bp, Artificial Sequence
  Description of Artificial Sequence: Synthetic oligonucleotide
gtggacgatacccagttcgtgaggttcg

SEQ ID NO: 374774 - DNA, 29 bp, Artificial Sequence
  Description of Artificial Sequence: Synthetic oligonucleotide
tggacgatacccagttcgtgaggttcgac

SEQ ID NO: 374775 - DNA, 28 bp, Artificial Sequence
  Description of Artificial Sequence: Synthetic oligonucleotide
ggacgatacccagttcgtgaggttcgac

SEQ ID NO: 374776 - DNA, 29 bp, Artificial Sequence
  Description of Artificial Sequence: Synthetic oligonucleotide
gacgatacccagttcgtgaggttcgacag

SEQ ID NO: 374777 - DNA, 29 bp, Artificial Sequence
  Description of Artificial Sequence: Synthetic oligonucleotide
acgatacccagttcgtgaggttcgacagc

SEQ ID NO: 374778 - DNA, 28 bp, Artificial Sequence
  Description of Artificial Sequence: Synthetic oligonucleotide
cgatacccagttcgtgaggttcgacagc

SEQ ID NO: 374779 - DNA, 28 bp, Artificial Sequence
  Description of Artificial Sequence: Synthetic oligonucleotide
gatacccagttcgtgaggttcgacagcg

SEQ ID NO: 374780 - DNA, 29 bp, Artificial Sequence
  Description of Artificial Sequence: Synthetic oligonucleotide
atacccagttcgtgaggttcgacagcgac

SEQ ID NO: 374781 - DNA, 28 bp, Artificial Sequence
  Description of Artificial Sequence: Synthetic oligonucleotide
tacccagttcgtgaggttcgacagcgac

SEQ ID NO: 374782 - DNA, 26 bp, Artificial Sequence
  Description of Artificial Sequence: Synthetic oligonucleotide
agaatgggaaggagacgctgcagcgc

SEQ ID NO: 374783 - DNA, 25 bp, Artificial Sequence
  Description of Artificial Sequence: Synthetic oligonucleotide
gaatgggaaggagacgctgcagcgc

SEQ ID NO: 374784 - DNA, 25 bp, Artificial Sequence
  Description of Artificial Sequence: Synthetic oligonucleotide
aatgggaaggagacgctgcagcgcg

SEQ ID NO: 374785 - DNA, 24 bp, Artificial Sequence
  Description of Artificial Sequence: Synthetic oligonucleotide
atgggaaggagacgctgcagcgcg

SEQ ID NO: 374786 - DNA, 23 bp, Artificial Sequence
  Description of Artificial Sequence: Synthetic oligonucleotide
tgggaaggagacgctgcagcgcg

SEQ ID NO: 374787 - DNA, 32 bp, Artificial Sequence; identical to SEQ ID NO: 27428
  Description of Artificial Sequence: Synthetic oligonucleotide

SEQ ID NO: 374788 - DNA, 31 bp, Artificial Sequence; identical to SEQ ID NO: 27429
  Description of Artificial Sequence: Synthetic oligonucleotide

SEQ ID NO: 374789 - DNA, 33 bp, Artificial Sequence; identical to SEQ ID NO: 27430
  Description of Artificial Sequence: Synthetic oligonucleotide

SEQ ID NO: 374790 - DNA, 32 bp, Artificial Sequence; identical to SEQ ID NO: 27431
  Description of Artificial Sequence: Synthetic oligonucleotide

SEQ ID NO: 374791 - DNA, 32 bp, Artificial Sequence; identical to SEQ ID NO: 27432
  Description of Artificial Sequence: Synthetic oligonucleotide

SEQ ID NO: 374792 - DNA, 31 bp, Artificial Sequence; identical to SEQ ID NO: 27433
  Description of Artificial Sequence: Synthetic oligonucleotide

SEQ ID NO: 374793 - DNA, 31 bp, Artificial Sequence; identical to SEQ ID NO: 27434
  Description of Artificial Sequence: Synthetic oligonucleotide

SEQ ID NO: 374794 - DNA, 30 bp, Artificial Sequence; identical to SEQ ID NO: 27435
  Description of Artificial Sequence: Synthetic oligonucleotide

SEQ ID NO: 374795 - DNA, 31 bp, Artificial Sequence; identical to SEQ ID NO: 27436
  Description of Artificial Sequence: Synthetic oligonucleotide

SEQ ID NO: 374796 - DNA, 30 bp, Artificial Sequence; identical to SEQ ID NO: 27437
  Description of Artificial Sequence: Synthetic oligonucleotide

SEQ ID NO: 374797 - DNA, 29 bp, Artificial Sequence
  Description of Artificial Sequence: Synthetic oligonucleotide
ctccaagaccaacacacagacctaccgag

SEQ ID NO: 374798 - DNA, 30 bp, Artificial Sequence; identical to SEQ ID NO: 27439
  Description of Artificial Sequence: Synthetic oligonucleotide

SEQ ID NO: 374799 - DNA, 29 bp, Artificial Sequence
  Description of Artificial Sequence: Synthetic oligonucleotide
ccaagaccaacacacagacctaccgagag

SEQ ID NO: 374800 - DNA, 30 bp, Artificial Sequence; identical to SEQ ID NO: 27441
  Description of Artificial Sequence: Synthetic oligonucleotide

SEQ ID NO: 374801 - DNA, 30 bp, Artificial Sequence; identical to SEQ ID NO: 27442
  Description of Artificial Sequence: Synthetic oligonucleotide

SEQ ID NO: 374802 - DNA, 29 bp, Artificial Sequence
  Description of Artificial Sequence: Synthetic oligonucleotide
agaccaacacacagacctaccgagagagc

SEQ ID NO: 374803 - DNA, 28 bp, Artificial Sequence
  Description of Artificial Sequence: Synthetic oligonucleotide
gaccaacacacagacctaccgagagagc

SEQ ID NO: 374804 - DNA, 28 bp, Artificial Sequence
  Description of Artificial Sequence: Synthetic oligonucleotide
accaacacacagacctaccgagagagcc

SEQ ID NO: 374805 - DNA, 27 bp, Artificial Sequence
  Description of Artificial Sequence: Synthetic oligonucleotide
ccaacacacagacctaccgagagagcc

SEQ ID NO: 374806 - DNA, 28 bp, Artificial Sequence
  Description of Artificial Sequence: Synthetic oligonucleotide
caacacacagacctaccgagagagcctg

SEQ ID NO: 374807 - DNA, 28 bp, Artificial Sequence
  Description of Artificial Sequence: Synthetic oligonucleotide
aacacacagacctaccgagagagcctgc

SEQ ID NO: 374808 - DNA, 27 bp, Artificial Sequence
  Description of Artificial Sequence: Synthetic oligonucleotide
acacacagacctaccgagagagcctgc

SEQ ID NO: 374809 - DNA, 26 bp, Artificial Sequence
  Description of Artificial Sequence: Synthetic oligonucleotide
cacacagacctaccgagagagcctgc

SEQ ID NO: 374810 - DNA, 26 bp, Artificial Sequence
  Description of Artificial Sequence: Synthetic oligonucleotide
acacagacctaccgagagagcctgcg

SEQ ID NO: 374811 - DNA, 25 bp, Artificial Sequence
  Description of Artificial Sequence: Synthetic oligonucleotide
cacagacctaccgagagagcctgcg

SEQ ID NO: 374812 - DNA, 27 bp, Artificial Sequence
  Description of Artificial Sequence: Synthetic oligonucleotide
acagacctaccgagagagcctgcggaa

SEQ ID NO: 374813 - DNA, 26 bp, Artificial Sequence
  Description of Artificial Sequence: Synthetic oligonucleotide
cagacctaccgagagagcctgcggaa

SEQ ID NO: 374814 - DNA, 26 bp, Artificial Sequence
  Description of Artificial Sequence: Synthetic oligonucleotide
agacctaccgagagagcctgcggaac

SEQ ID NO: 374815 - DNA, 25 bp, Artificial Sequence
  Description of Artificial Sequence: Synthetic oligonucleotide
gacctaccgagagagcctgcggaac

SEQ ID NO: 374816 - DNA, 26 bp, Artificial Sequence
  Description of Artificial Sequence: Synthetic oligonucleotide
acctaccgagagagcctgcggaacct

SEQ ID NO: 374817 - DNA, 25 bp, Artificial Sequence
  Description of Artificial Sequence: Synthetic oligonucleotide
cctaccgagagagcctgcggaacct

SEQ ID NO: 374818 - DNA, 25 bp, Artificial Sequence
  Description of Artificial Sequence: Synthetic oligonucleotide
ctaccgagagagcctgcggaacctg

SEQ ID NO: 374819 - DNA, 31 bp, Artificial Sequence; identical to SEQ ID NO: 27460
  Description of Artificial Sequence: Synthetic oligonucleotide

SEQ ID NO: 374820 - DNA, 31 bp, Artificial Sequence; identical to SEQ ID NO: 27461
  Description of Artificial Sequence: Synthetic oligonucleotide

SEQ ID NO: 374821 - DNA, 33 bp, Artificial Sequence; identical to SEQ ID NO: 27462
  Description of Artificial Sequence: Synthetic oligonucleotide

SEQ ID NO: 374822 - DNA, 32 bp, Artificial Sequence; identical to SEQ ID NO: 27463
  Description of Artificial Sequence: Synthetic oligonucleotide

SEQ ID NO: 374823 - DNA, 33 bp, Artificial Sequence; identical to SEQ ID NO: 27464
  Description of Artificial Sequence: Synthetic oligonucleotide

SEQ ID NO: 374824 - DNA, 33 bp, Artificial Sequence; identical to SEQ ID NO: 27465
  Description of Artificial Sequence: Synthetic oligonucleotide

SEQ ID NO: 374825 - DNA, 33 bp, Artificial Sequence; identical to SEQ ID NO: 27466
  Description of Artificial Sequence: Synthetic oligonucleotide

SEQ ID NO: 374826 - DNA, 32 bp, Artificial Sequence; identical to SEQ ID NO: 27467
  Description of Artificial Sequence: Synthetic oligonucleotide

SEQ ID NO: 374827 - DNA, 32 bp, Artificial Sequence; identical to SEQ ID NO: 27468
  Description of Artificial Sequence: Synthetic oligonucleotide

SEQ ID NO: 374828 - DNA, 31 bp, Artificial Sequence; identical to SEQ ID NO: 27469
  Description of Artificial Sequence: Synthetic oligonucleotide

SEQ ID NO: 374829 - DNA, 31 bp, Artificial Sequence; identical to SEQ ID NO: 27470
  Description of Artificial Sequence: Synthetic oligonucleotide

SEQ ID NO: 374830 - DNA, 31 bp, Artificial Sequence; identical to SEQ ID NO: 27471
  Description of Artificial Sequence: Synthetic oligonucleotide

SEQ ID NO: 374831 - DNA, 30 bp, Artificial Sequence; identical to SEQ ID NO: 27472
  Description of Artificial Sequence: Synthetic oligonucleotide

SEQ ID NO: 374832 - DNA, 29 bp, Artificial Sequence
  Description of Artificial Sequence: Synthetic oligonucleotide
gaggtatttttacaccgccatgtcccggc

SEQ ID NO: 374833 - DNA, 29 bp, Artificial Sequence
  Description of Artificial Sequence: Synthetic oligonucleotide
aggtatttttacaccgccatgtcccggcc

SEQ ID NO: 374834 - DNA, 28 bp, Artificial Sequence
  Description of Artificial Sequence: Synthetic oligonucleotide
ggtatttttacaccgccatgtcccggcc

SEQ ID NO: 374835 - DNA, 28 bp, Artificial Sequence
  Description of Artificial Sequence: Synthetic oligonucleotide
gtatttttacaccgccatgtcccggccc

SEQ ID NO: 374836 - DNA, 28 bp, Artificial Sequence
  Description of Artificial Sequence: Synthetic oligonucleotide
tatttttacaccgccatgtcccggcccg

SEQ ID NO: 374837 - DNA, 27 bp, Artificial Sequence
  Description of Artificial Sequence: Synthetic oligonucleotide
atttttacaccgccatgtcccggcccg

SEQ ID NO: 374838 - DNA, 26 bp, Artificial Sequence
  Description of Artificial Sequence: Synthetic oligonucleotide
tttttacaccgccatgtcccggcccg

SEQ ID NO: 374839 - DNA, 25 bp, Artificial Sequence
  Description of Artificial Sequence: Synthetic oligonucleotide
ttttacaccgccatgtcccggcccg

SEQ ID NO: 374840 - DNA, 24 bp, Artificial Sequence
  Description of Artificial Sequence: Synthetic oligonucleotide
tttacaccgccatgtcccggcccg

SEQ ID NO: 374841 - DNA, 23 bp, Artificial Sequence
  Description of Artificial Sequence: Synthetic oligonucleotide
ttacaccgccatgtcccggcccg

SEQ ID NO: 374842 - DNA, 21 bp, Artificial Sequence
  Description of Artificial Sequence: Synthetic oligonucleotide
tgggaggcggcccgtgaggct

SEQ ID NO: 374843 - DNA, 21 bp, Artificial Sequence
  Description of Artificial Sequence: Synthetic oligonucleotide
ggaggcggcccgtgaggctga

SEQ ID NO: 374844 - DNA, 21 bp, Artificial Sequence
  Description of Artificial Sequence: Synthetic oligonucleotide
gaggcggcccgtgaggctgag

SEQ ID NO: 374845 - DNA, 22 bp, Artificial Sequence
  Description of Artificial Sequence: Synthetic oligonucleotide
aggcggcccgtgaggctgagca

SEQ ID NO: 374846 - DNA, 21 bp, Artificial Sequence
  Description of Artificial Sequence: Synthetic oligonucleotide
ggcggcccgtgaggctgagca

SEQ ID NO: 374847 - DNA, 22 bp, Artificial Sequence
  Description of Artificial Sequence: Synthetic oligonucleotide
gcggcccgtgaggctgagcagt

SEQ ID NO: 374848 - DNA, 22 bp, Artificial Sequence
  Description of Artificial Sequence: Synthetic oligonucleotide
cggcccgtgaggctgagcagtg

SEQ ID NO: 374849 - DNA, 23 bp, Artificial Sequence
  Description of Artificial Sequence: Synthetic oligonucleotide
ggcccgtgaggctgagcagtgga

SEQ ID NO: 374850 - DNA, 24 bp, Artificial Sequence
  Description of Artificial Sequence: Synthetic oligonucleotide
gcccgtgaggctgagcagtggaga

SEQ ID NO: 374851 - DNA, 24 bp, Artificial Sequence
  Description of Artificial Sequence: Synthetic oligonucleotide
cccgtgaggctgagcagtggagag

SEQ ID NO: 374852 - DNA, 24 bp, Artificial Sequence
  Description of Artificial Sequence: Synthetic oligonucleotide
ccgtgaggctgagcagtggagagc

SEQ ID NO: 374853 - DNA, 26 bp, Artificial Sequence
  Description of Artificial Sequence: Synthetic oligonucleotide
cgtgaggctgagcagtggagagccta

SEQ ID NO: 374854 - DNA, 26 bp, Artificial Sequence
  Description of Artificial Sequence: Synthetic oligonucleotide
gtgaggctgagcagtggagagcctac

SEQ ID NO: 374855 - DNA, 27 bp, Artificial Sequence
  Description of Artificial Sequence: Synthetic oligonucleotide
tgaggctgagcagtggagagcctacct

SEQ ID NO: 374856 - DNA, 26 bp, Artificial Sequence
  Description of Artificial Sequence: Synthetic oligonucleotide
gaggctgagcagtggagagcctacct

SEQ ID NO: 374857 - DNA, 26 bp, Artificial Sequence
  Description of Artificial Sequence: Synthetic oligonucleotide
aggctgagcagtggagagcctacctg

SEQ ID NO: 374858 - DNA, 25 bp, Artificial Sequence
  Description of Artificial Sequence: Synthetic oligonucleotide
ggctgagcagtggagagcctacctg

SEQ ID NO: 374859 - DNA, 26 bp, Artificial Sequence
  Description of Artificial Sequence: Synthetic oligonucleotide
gctgagcagtggagagcctacctgga

SEQ ID NO: 374860 - DNA, 26 bp, Artificial Sequence
  Description of Artificial Sequence: Synthetic oligonucleotide
ctgagcagtggagagcctacctggag

SEQ ID NO: 374861 - DNA, 26 bp, Artificial Sequence
  Description of Artificial Sequence: Synthetic oligonucleotide
tgagcagtggagagcctacctggagg

SEQ ID NO: 374862 - DNA, 33 bp, Artificial Sequence; identical to SEQ ID NO: 27503
  Description of Artificial Sequence: Synthetic oligonucleotide

SEQ ID NO: 374863 - DNA, 32 bp, Artificial Sequence; identical to SEQ ID NO: 27504
  Description of Artificial Sequence: Synthetic oligonucleotide

SEQ ID NO: 374864 - DNA, 32 bp, Artificial Sequence; identical to SEQ ID NO: 27505
  Description of Artificial Sequence: Synthetic oligonucleotide

SEQ ID NO: 374865 - DNA, 31 bp, Artificial Sequence; identical to SEQ ID NO: 27506
  Description of Artificial Sequence: Synthetic oligonucleotide

SEQ ID NO: 374866 - DNA, 31 bp, Artificial Sequence; identical to SEQ ID NO: 27507
  Description of Artificial Sequence: Synthetic oligonucleotide

SEQ ID NO: 374867 - DNA, 31 bp, Artificial Sequence; identical to SEQ ID NO: 27508
  Description of Artificial Sequence: Synthetic oligonucleotide

SEQ ID NO: 374868 - DNA, 30 bp, Artificial Sequence; identical to SEQ ID NO: 27509
  Description of Artificial Sequence: Synthetic oligonucleotide

SEQ ID NO: 374869 - DNA, 29 bp, Artificial Sequence
  Description of Artificial Sequence: Synthetic oligonucleotide
gaggtatttctacaccgccatgtctcggc

SEQ ID NO: 374870 - DNA, 29 bp, Artificial Sequence
  Description of Artificial Sequence: Synthetic oligonucleotide
aggtatttctacaccgccatgtctcggcc

SEQ ID NO: 374871 - DNA, 28 bp, Artificial Sequence
  Description of Artificial Sequence: Synthetic oligonucleotide
ggtatttctacaccgccatgtctcggcc

SEQ ID NO: 374872 - DNA, 28 bp, Artificial Sequence
  Description of Artificial Sequence: Synthetic oligonucleotide
gtatttctacaccgccatgtctcggccc

SEQ ID NO: 374873 - DNA, 28 bp, Artificial Sequence
  Description of Artificial Sequence: Synthetic oligonucleotide
tatttctacaccgccatgtctcggcccg

SEQ ID NO: 374874 - DNA, 27 bp, Artificial Sequence
  Description of Artificial Sequence: Synthetic oligonucleotide
atttctacaccgccatgtctcggcccg

SEQ ID NO: 374875 - DNA, 26 bp, Artificial Sequence
  Description of Artificial Sequence: Synthetic oligonucleotide
tttctacaccgccatgtctcggcccg

SEQ ID NO: 374876 - DNA, 25 bp, Artificial Sequence
  Description of Artificial Sequence: Synthetic oligonucleotide
ttctacaccgccatgtctcggcccg

SEQ ID NO: 374877 - DNA, 24 bp, Artificial Sequence
  Description of Artificial Sequence: Synthetic oligonucleotide
tctacaccgccatgtctcggcccg

SEQ ID NO: 374878 - DNA, 23 bp, Artificial Sequence
  Description of Artificial Sequence: Synthetic oligonucleotide
ctacaccgccatgtctcggcccg

SEQ ID NO: 374879 - DNA, 23 bp, Artificial Sequence
  Description of Artificial Sequence: Synthetic oligonucleotide
tacaccgccatgtctcggcccgg

SEQ ID NO: 374880 - DNA, 22 bp, Artificial Sequence
  Description of Artificial Sequence: Synthetic oligonucleotide
acaccgccatgtctcggcccgg

SEQ ID NO: 374881 - DNA, 21 bp, Artificial Sequence
  Description of Artificial Sequence: Synthetic oligonucleotide
caccgccatgtctcggcccgg

SEQ ID NO: 374882 - DNA, 21 bp, Artificial Sequence
  Description of Artificial Sequence: Synthetic oligonucleotide
accgccatgtctcggcccggc

SEQ ID NO: 374883 - DNA, 20 bp, Artificial Sequence
  Description of Artificial Sequence: Synthetic oligonucleotide
ccgccatgtctcggcccggc

SEQ ID NO: 374884 - DNA, 20 bp, Artificial Sequence
  Description of Artificial Sequence: Synthetic oligonucleotide
cgccatgtctcggcccggcc

SEQ ID NO: 374885 - DNA, 20 bp, Artificial Sequence
  Description of Artificial Sequence: Synthetic oligonucleotide
gccatgtctcggcccggccg

SEQ ID NO: 374886 - DNA, 20 bp, Artificial Sequence
  Description of Artificial Sequence: Synthetic oligonucleotide
ccatgtctcggcccggccgc

SEQ ID NO: 374887 - DNA, 20 bp, Artificial Sequence
  Description of Artificial Sequence: Synthetic oligonucleotide
catgtctcggcccggccgcg

SEQ ID NO: 374888 - DNA, 20 bp, Artificial Sequence
  Description of Artificial Sequence: Synthetic oligonucleotide
atgtctcggcccggccgcgg

SEQ ID NO: 374889 - DNA, 23 bp, Artificial Sequence
  Description of Artificial Sequence: Synthetic oligonucleotide
cggtgggctacgtggacgacacc

SEQ ID NO: 374890 - DNA, 24 bp, Artificial Sequence
  Description of Artificial Sequence: Synthetic oligonucleotide
ggtgggctacgtggacgacaccca

SEQ ID NO: 374891 - DNA, 31 bp, Artificial Sequence; identical to SEQ ID NO: 27532
  Description of Artificial Sequence: Synthetic oligonucleotide

SEQ ID NO: 374892 - DNA, 32 bp, Artificial Sequence; identical to SEQ ID NO: 27533
  Description of Artificial Sequence: Synthetic oligonucleotide

SEQ ID NO: 374893 - DNA, 31 bp, Artificial Sequence; identical to SEQ ID NO: 27534
  Description of Artificial Sequence: Synthetic oligonucleotide

SEQ ID NO: 374894 - DNA, 30 bp, Artificial Sequence; identical to SEQ ID NO: 27535
  Description of Artificial Sequence: Synthetic oligonucleotide

SEQ ID NO: 374895 - DNA, 30 bp, Artificial Sequence; identical to SEQ ID NO: 27536
  Description of Artificial Sequence: Synthetic oligonucleotide

SEQ ID NO: 374896 - DNA, 31 bp, Artificial Sequence; identical to SEQ ID NO: 27537
  Description of Artificial Sequence: Synthetic oligonucleotide

SEQ ID NO: 374897 - DNA, 30 bp, Artificial Sequence; identical to SEQ ID NO: 27538
  Description of Artificial Sequence: Synthetic oligonucleotide

SEQ ID NO: 374898 - DNA, 29 bp, Artificial Sequence
  Description of Artificial Sequence: Synthetic oligonucleotide
tacatcgccctgaacgaggacttgagctc

SEQ ID NO: 374899 - DNA, 28 bp, Artificial Sequence
  Description of Artificial Sequence: Synthetic oligonucleotide
acatcgccctgaacgaggacttgagctc

SEQ ID NO: 374900 - DNA, 27 bp, Artificial Sequence
  Description of Artificial Sequence: Synthetic oligonucleotide
catcgccctgaacgaggacttgagctc

SEQ ID NO: 374901 - DNA, 27 bp, Artificial Sequence
  Description of Artificial Sequence: Synthetic oligonucleotide
atcgccctgaacgaggacttgagctcc

SEQ ID NO: 374902 - DNA, 27 bp, Artificial Sequence
  Description of Artificial Sequence: Synthetic oligonucleotide
tcgccctgaacgaggacttgagctcct

SEQ ID NO: 374903 - DNA, 26 bp, Artificial Sequence
  Description of Artificial Sequence: Synthetic oligonucleotide
cgccctgaacgaggacttgagctcct

SEQ ID NO: 374904 - DNA, 26 bp, Artificial Sequence
  Description of Artificial Sequence: Synthetic oligonucleotide
gccctgaacgaggacttgagctcctg

SEQ ID NO: 374905 - DNA, 27 bp, Artificial Sequence
  Description of Artificial Sequence: Synthetic oligonucleotide
ccctgaacgaggacttgagctcctgga

SEQ ID NO: 374906 - DNA, 27 bp, Artificial Sequence
  Description of Artificial Sequence: Synthetic oligonucleotide
cctgaacgaggacttgagctcctggac

SEQ ID NO: 374907 - DNA, 27 bp, Artificial Sequence
  Description of Artificial Sequence: Synthetic oligonucleotide
ctgaacgaggacttgagctcctggacc

SEQ ID NO: 374908 - DNA, 27 bp, Artificial Sequence
  Description of Artificial Sequence: Synthetic oligonucleotide
tgaacgaggacttgagctcctggaccg

SEQ ID NO: 374909 - DNA, 26 bp, Artificial Sequence
  Description of Artificial Sequence: Synthetic oligonucleotide
gaacgaggacttgagctcctggaccg

SEQ ID NO: 374910 - DNA, 26 bp, Artificial Sequence
  Description of Artificial Sequence: Synthetic oligonucleotide
aacgaggacttgagctcctggaccgc

SEQ ID NO: 374911 - DNA, 25 bp, Artificial Sequence
  Description of Artificial Sequence: Synthetic oligonucleotide
acgaggacttgagctcctggaccgc

SEQ ID NO: 374912 - DNA, 24 bp, Artificial Sequence
  Description of Artificial Sequence: Synthetic oligonucleotide
cgaggacttgagctcctggaccgc

SEQ ID NO: 374913 - DNA, 24 bp, Artificial Sequence
  Description of Artificial Sequence: Synthetic oligonucleotide
gaggacttgagctcctggaccgcg

SEQ ID NO: 374914 - DNA, 24 bp, Artificial Sequence
  Description of Artificial Sequence: Synthetic oligonucleotide
aggacttgagctcctggaccgcgg

SEQ ID NO: 374915 - DNA, 23 bp, Artificial Sequence
  Description of Artificial Sequence: Synthetic oligonucleotide
ggacttgagctcctggaccgcgg

SEQ ID NO: 374916 - DNA, 23 bp, Artificial Sequence
  Description of Artificial Sequence: Synthetic oligonucleotide
gacttgagctcctggaccgcggc

SEQ ID NO: 374917 - DNA, 23 bp, Artificial Sequence
  Description of Artificial Sequence: Synthetic oligonucleotide
acttgagctcctggaccgcggcg

SEQ ID NO: 374918 - DNA, 22 bp, Artificial Sequence
  Description of Artificial Sequence: Synthetic oligonucleotide
cttgagctcctggaccgcggcg

SEQ ID NO: 374919 - DNA, 23 bp, Artificial Sequence
  Description of Artificial Sequence: Synthetic oligonucleotide
ttgagctcctggaccgcggcgga

SEQ ID NO: 374920 - DNA, 23 bp, Artificial Sequence
  Description of Artificial Sequence: Synthetic oligonucleotide
gcaagtgggaggcggcccgtgaa

SEQ ID NO: 374921 - DNA, 23 bp, Artificial Sequence
  Description of Artificial Sequence: Synthetic oligonucleotide
caagtgggaggcggcccgtgaag

SEQ ID NO: 374922 - DNA, 23 bp, Artificial Sequence
  Description of Artificial Sequence: Synthetic oligonucleotide
aagtgggaggcggcccgtgaagc

SEQ ID NO: 374923 - DNA, 22 bp, Artificial Sequence
  Description of Artificial Sequence: Synthetic oligonucleotide
agtgggaggcggcccgtgaagc

SEQ ID NO: 374924 - DNA, 21 bp, Artificial Sequence
  Description of Artificial Sequence: Synthetic oligonucleotide
gtgggaggcggcccgtgaagc

SEQ ID NO: 374925 - DNA, 21 bp, Artificial Sequence
  Description of Artificial Sequence: Synthetic oligonucleotide
tgggaggcggcccgtgaagcg

SEQ ID NO: 374926 - DNA, 20 bp, Artificial Sequence
  Description of Artificial Sequence: Synthetic oligonucleotide
gggaggcggcccgtgaagcg

SEQ ID NO: 374927 - DNA, 21 bp, Artificial Sequence
  Description of Artificial Sequence: Synthetic oligonucleotide
ggaggcggcccgtgaagcgga

SEQ ID NO: 374928 - DNA, 21 bp, Artificial Sequence
  Description of Artificial Sequence: Synthetic oligonucleotide
gaggcggcccgtgaagcggag

SEQ ID NO: 374929 - DNA, 22 bp, Artificial Sequence
  Description of Artificial Sequence: Synthetic oligonucleotide
aggcggcccgtgaagcggagca

SEQ ID NO: 374930 - DNA, 21 bp, Artificial Sequence
  Description of Artificial Sequence: Synthetic oligonucleotide
ggcggcccgtgaagcggagca

SEQ ID NO: 374931 - DNA, 22 bp, Artificial Sequence
  Description of Artificial Sequence: Synthetic oligonucleotide
gcggcccgtgaagcggagcagt

SEQ ID NO: 374932 - DNA, 22 bp, Artificial Sequence
  Description of Artificial Sequence: Synthetic oligonucleotide
cggcccgtgaagcggagcagtg

SEQ ID NO: 374933 - DNA, 23 bp, Artificial Sequence
  Description of Artificial Sequence: Synthetic oligonucleotide
ggcccgtgaagcggagcagtgga

SEQ ID NO: 374934 - DNA, 24 bp, Artificial Sequence
  Description of Artificial Sequence: Synthetic oligonucleotide
gcccgtgaagcggagcagtggaga

SEQ ID NO: 374935 - DNA, 24 bp, Artificial Sequence
  Description of Artificial Sequence: Synthetic oligonucleotide
cccgtgaagcggagcagtggagag

SEQ ID NO: 374936 - DNA, 24 bp, Artificial Sequence
  Description of Artificial Sequence: Synthetic oligonucleotide
ccgtgaagcggagcagtggagagc

SEQ ID NO: 374937 - DNA, 26 bp, Artificial Sequence
  Description of Artificial Sequence: Synthetic oligonucleotide
cgtgaagcggagcagtggagagccta

SEQ ID NO: 374938 - DNA, 26 bp, Artificial Sequence
  Description of Artificial Sequence: Synthetic oligonucleotide
gtgaagcggagcagtggagagcctac

SEQ ID NO: 374939 - DNA, 27 bp, Artificial Sequence
  Description of Artificial Sequence: Synthetic oligonucleotide
tgaagcggagcagtggagagcctacct

SEQ ID NO: 374940 - DNA, 26 bp, Artificial Sequence
  Description of Artificial Sequence: Synthetic oligonucleotide
gaagcggagcagtggagagcctacct

SEQ ID NO: 374941 - DNA, 26 bp, Artificial Sequence
  Description of Artificial Sequence: Synthetic oligonucleotide
aagcggagcagtggagagcctacctg

SEQ ID NO: 374942 - DNA, 25 bp, Artificial Sequence
  Description of Artificial Sequence: Synthetic oligonucleotide
agcggagcagtggagagcctacctg

SEQ ID NO: 374943 - DNA, 25 bp, Artificial Sequence
  Description of Artificial Sequence: Synthetic oligonucleotide
gggccggagtattgggaccgggaaa

SEQ ID NO: 374944 - DNA, 26 bp, Artificial Sequence
  Description of Artificial Sequence: Synthetic oligonucleotide
ggccggagtattgggaccgggaaaca

SEQ ID NO: 374945 - DNA, 27 bp, Artificial Sequence
  Description of Artificial Sequence: Synthetic oligonucleotide
gccggagtattgggaccgggaaacaca

SEQ ID NO: 374946 - DNA, 27 bp, Artificial Sequence
  Description of Artificial Sequence: Synthetic oligonucleotide
ccggagtattgggaccgggaaacacag

SEQ ID NO: 374947 - DNA, 29 bp, Artificial Sequence
  Description of Artificial Sequence: Synthetic oligonucleotide
cggagtattgggaccgggaaacacagatc

SEQ ID NO: 374948 - DNA, 30 bp, Artificial Sequence
  Description of Artificial Sequence: Synthetic oligonucleotide
ggagtattgggaccgggaaacacagatctc

SEQ ID NO: 374949 - DNA, 30 bp, Artificial Sequence
  Description of Artificial Sequence: Synthetic oligonucleotide
gagtattgggaccgggaaacacagatctcc

SEQ ID NO: 374950 - DNA, 32 bp, Artificial Sequence
  Description of Artificial Sequence: Synthetic oligonucleotide
agtattgggaccgggaaacacagatctccaag

SEQ ID NO: 374951 - DNA, 31 bp, Artificial Sequence
  Description of Artificial Sequence: Synthetic oligonucleotide
gtattgggaccgggaaacacagatctccaag

SEQ ID NO: 374952 - DNA, 32 bp, Artificial Sequence
  Description of Artificial Sequence: Synthetic oligonucleotide
tattgggaccgggaaacacagatctccaagac

SEQ ID NO: 374953 - DNA, 31 bp, Artificial Sequence
  Description of Artificial Sequence: Synthetic oligonucleotide
attgggaccgggaaacacagatctccaagac

SEQ ID NO: 374954 - DNA, 30 bp, Artificial Sequence
  Description of Artificial Sequence: Synthetic oligonucleotide
ttgggaccgggaaacacagatctccaagac

SEQ ID NO: 374955 - DNA, 29 bp, Artificial Sequence
  Description of Artificial Sequence: Synthetic oligonucleotide
tgggaccgggaaacacagatctccaagac

SEQ ID NO: 374956 - DNA, 28 bp, Artificial Sequence
  Description of Artificial Sequence: Synthetic oligonucleotide
gggaccgggaaacacagatctccaagac

SEQ ID NO: 374957 - DNA, 28 bp, Artificial Sequence
  Description of Artificial Sequence: Synthetic oligonucleotide
ggaccgggaaacacagatctccaagacc

SEQ ID NO: 374958 - DNA, 30 bp, Artificial Sequence
  Description of Artificial Sequence: Synthetic oligonucleotide
gaccgggaaacacagatctccaagaccaac

SEQ ID NO: 374959 - DNA, 31 bp, Artificial Sequence
  Description of Artificial Sequence: Synthetic oligonucleotide
accgggaaacacagatctccaagaccaacac

SEQ ID NO: 374960 - DNA, 30 bp, Artificial Sequence
  Description of Artificial Sequence: Synthetic oligonucleotide
ccgggaaacacagatctccaagaccaacac

SEQ ID NO: 374961 - DNA, 31 bp, Artificial Sequence
  Description of Artificial Sequence: Synthetic oligonucleotide
cgggaaacacagatctccaagaccaacacac

SEQ ID NO: 374962 - DNA, 32 bp, Artificial Sequence
  Description of Artificial Sequence: Synthetic oligonucleotide
gggaaacacagatctccaagaccaacacacag

SEQ ID NO: 374963 - DNA, 33 bp, Artificial Sequence
  Description of Artificial Sequence: Synthetic oligonucleotide
ggaaacacagatctccaagaccaacacacagac

SEQ ID NO: 374964 - DNA, 36 bp, Artificial Sequence
  Description of Artificial Sequence: Synthetic oligonucleotide
gaaacacagatctccaagaccaacacacagacttac

SEQ ID NO: 374965 - DNA, 36 bp, Artificial Sequence
  Description of Artificial Sequence: Synthetic oligonucleotide
aaacacagatctccaagaccaacacacagacttacc

SEQ ID NO: 374966 - DNA, 35 bp, Artificial Sequence
  Description of Artificial Sequence: Synthetic oligonucleotide
aacacagatctccaagaccaacacacagacttacc

SEQ ID NO: 374967 - DNA, 31 bp, Artificial Sequence
  Description of Artificial Sequence: Synthetic oligonucleotide
accaacacacagacttaccgagagagcctac

SEQ ID NO: 374968 - DNA, 30 bp, Artificial Sequence
  Description of Artificial Sequence: Synthetic oligonucleotide
ccaacacacagacttaccgagagagcctac

SEQ ID NO: 374969 - DNA, 30 bp, Artificial Sequence
  Description of Artificial Sequence: Synthetic oligonucleotide
caacacacagacttaccgagagagcctacg

SEQ ID NO: 374970 - DNA, 30 bp, Artificial Sequence
  Description of Artificial Sequence: Synthetic oligonucleotide
aacacacagacttaccgagagagcctacgg

SEQ ID NO: 374971 - DNA, 29 bp, Artificial Sequence
  Description of Artificial Sequence: Synthetic oligonucleotide
acacacagacttaccgagagagcctacgg

SEQ ID NO: 374972 - DNA, 28 bp, Artificial Sequence
  Description of Artificial Sequence: Synthetic oligonucleotide
cacacagacttaccgagagagcctacgg

SEQ ID NO: 374973 - DNA, 30 bp, Artificial Sequence
  Description of Artificial Sequence: Synthetic oligonucleotide
acacagacttaccgagagagcctacggaac

SEQ ID NO: 374974 - DNA, 29 bp, Artificial Sequence
  Description of Artificial Sequence: Synthetic oligonucleotide
cacagacttaccgagagagcctacggaac

SEQ ID NO: 374975 - DNA, 29 bp, Artificial Sequence
  Description of Artificial Sequence: Synthetic oligonucleotide
acagacttaccgagagagcctacggaacc

SEQ ID NO: 374976 - DNA, 28 bp, Artificial Sequence
  Description of Artificial Sequence: Synthetic oligonucleotide
cagacttaccgagagagcctacggaacc

SEQ ID NO: 374977 - DNA, 29 bp, Artificial Sequence
  Description of Artificial Sequence: Synthetic oligonucleotide
agacttaccgagagagcctacggaacctg

SEQ ID NO: 374978 - DNA, 28 bp, Artificial Sequence
  Description of Artificial Sequence: Synthetic oligonucleotide
gacttaccgagagagcctacggaacctg

SEQ ID NO: 374979 - DNA, 28 bp, Artificial Sequence
  Description of Artificial Sequence: Synthetic oligonucleotide
acttaccgagagagcctacggaacctgc

SEQ ID NO: 374980 - DNA, 27 bp, Artificial Sequence
  Description of Artificial Sequence: Synthetic oligonucleotide
cttaccgagagagcctacggaacctgc

SEQ ID NO: 374981 - DNA, 27 bp, Artificial Sequence
  Description of Artificial Sequence: Synthetic oligonucleotide
ttaccgagagagcctacggaacctgcg

SEQ ID NO: 374982 - DNA, 26 bp, Artificial Sequence
  Description of Artificial Sequence: Synthetic oligonucleotide
taccgagagagcctacggaacctgcg

SEQ ID NO: 374983 - DNA, 25 bp, Artificial Sequence
  Description of Artificial Sequence: Synthetic oligonucleotide
accgagagagcctacggaacctgcg

SEQ ID NO: 374984 - DNA, 24 bp, Artificial Sequence
  Description of Artificial Sequence: Synthetic oligonucleotide
ccgagagagcctacggaacctgcg

SEQ ID NO: 374985 - DNA, 24 bp, Artificial Sequence
  Description of Artificial Sequence: Synthetic oligonucleotide
cgagagagcctacggaacctgcgc

SEQ ID NO: 374986 - DNA, 24 bp, Artificial Sequence
  Description of Artificial Sequence: Synthetic oligonucleotide
gagagagcctacggaacctgcgcg

SEQ ID NO: 374987 - DNA, 24 bp, Artificial Sequence
  Description of Artificial Sequence: Synthetic oligonucleotide
agagagcctacggaacctgcgcgg

SEQ ID NO: 374988 - DNA, 23 bp, Artificial Sequence
  Description of Artificial Sequence: Synthetic oligonucleotide
gagagcctacggaacctgcgcgg

SEQ ID NO: 374989 - DNA, 25 bp, Artificial Sequence
  Description of Artificial Sequence: Synthetic oligonucleotide
agagcctacggaacctgcgcggcta

SEQ ID NO: 374990 - DNA, 24 bp, Artificial Sequence
  Description of Artificial Sequence: Synthetic oligonucleotide
gagcctacggaacctgcgcggcta

SEQ ID NO: 374991 - DNA, 26 bp, Artificial Sequence
  Description of Artificial Sequence: Synthetic oligonucleotide
agcctacggaacctgcgcggctacta

SEQ ID NO: 374992 - DNA, 25 bp, Artificial Sequence
  Description of Artificial Sequence: Synthetic oligonucleotide
gcctacggaacctgcgcggctacta

SEQ ID NO: 374993 - DNA, 27 bp, Artificial Sequence
  Description of Artificial Sequence: Synthetic oligonucleotide
cctacggaacctgcgcggctactacaa

SEQ ID NO: 374994 - DNA, 27 bp, Artificial Sequence
  Description of Artificial Sequence: Synthetic oligonucleotide
ctacggaacctgcgcggctactacaac

SEQ ID NO: 374995 - DNA, 27 bp, Artificial Sequence
  Description of Artificial Sequence: Synthetic oligonucleotide
tacggaacctgcgcggctactacaacc

SEQ ID NO: 374996 - DNA, 27 bp, Artificial Sequence
  Description of Artificial Sequence: Synthetic oligonucleotide
acggaacctgcgcggctactacaacca

SEQ ID NO: 374997 - DNA, 29 bp, Artificial Sequence
  Description of Artificial Sequence: Synthetic oligonucleotide
aaccttccagaagtgggcagctgtggtag

SEQ ID NO: 374998 - DNA, 28 bp, Artificial Sequence
  Description of Artificial Sequence: Synthetic oligonucleotide
accttccagaagtgggcagctgtggtag

SEQ ID NO: 374999 - DNA, 27 bp, Artificial Sequence
  Description of Artificial Sequence: Synthetic oligonucleotide
ccttccagaagtgggcagctgtggtag

SEQ ID NO: 375000 - DNA, 28 bp, Artificial Sequence
  Description of Artificial Sequence: Synthetic oligonucleotide
cttccagaagtgggcagctgtggtagtg

SEQ ID NO: 375001 - DNA, 28 bp, Artificial Sequence
  Description of Artificial Sequence: Synthetic oligonucleotide
ttccagaagtgggcagctgtggtagtgc

SEQ ID NO: 375002 - DNA, 27 bp, Artificial Sequence
  Description of Artificial Sequence: Synthetic oligonucleotide
tccagaagtgggcagctgtggtagtgc

SEQ ID NO: 375003 - DNA, 26 bp, Artificial Sequence
  Description of Artificial Sequence: Synthetic oligonucleotide
ccagaagtgggcagctgtggtagtgc

SEQ ID NO: 375004 - DNA, 27 bp, Artificial Sequence
  Description of Artificial Sequence: Synthetic oligonucleotide
cagaagtgggcagctgtggtagtgcct

SEQ ID NO: 375005 - DNA, 28 bp, Artificial Sequence
  Description of Artificial Sequence: Synthetic oligonucleotide
agaagtgggcagctgtggtagtgccttc

SEQ ID NO: 375006 - DNA, 27 bp, Artificial Sequence
  Description of Artificial Sequence: Synthetic oligonucleotide
gaagtgggcagctgtggtagtgccttc

SEQ ID NO: 375007 - DNA, 28 bp, Artificial Sequence
  Description of Artificial Sequence: Synthetic oligonucleotide
aagtgggcagctgtggtagtgccttctg

SEQ ID NO: 375008 - DNA, 27 bp, Artificial Sequence
  Description of Artificial Sequence: Synthetic oligonucleotide
agtgggcagctgtggtagtgccttctg

SEQ ID NO: 375009 - DNA, 26 bp, Artificial Sequence
  Description of Artificial Sequence: Synthetic oligonucleotide
gtgggcagctgtggtagtgccttctg

SEQ ID NO: 375010 - DNA, 27 bp, Artificial Sequence
  Description of Artificial Sequence: Synthetic oligonucleotide
tgggcagctgtggtagtgccttctgga

SEQ ID NO: 375011 - DNA, 26 bp, Artificial Sequence
  Description of Artificial Sequence: Synthetic oligonucleotide
gggcagctgtggtagtgccttctgga

SEQ ID NO: 375012 - DNA, 27 bp, Artificial Sequence
  Description of Artificial Sequence: Synthetic oligonucleotide
ggcagctgtggtagtgccttctggaga

SEQ ID NO: 375013 - DNA, 28 bp, Artificial Sequence
  Description of Artificial Sequence: Synthetic oligonucleotide
gcagctgtggtagtgccttctggagaag

SEQ ID NO: 375014 - DNA, 29 bp, Artificial Sequence
  Description of Artificial Sequence: Synthetic oligonucleotide
cagctgtggtagtgccttctggagaagag

SEQ ID NO: 375015 - DNA, 29 bp, Artificial Sequence
  Description of Artificial Sequence: Synthetic oligonucleotide
agctgtggtagtgccttctggagaagagc

SEQ ID NO: 375016 - DNA, 28 bp, Artificial Sequence
  Description of Artificial Sequence: Synthetic oligonucleotide
gctgtggtagtgccttctggagaagagc

SEQ ID NO: 375017 - DNA, 29 bp, Artificial Sequence
  Description of Artificial Sequence: Synthetic oligonucleotide
ctgtggtagtgccttctggagaagagcag

SEQ ID NO: 375018 - DNA, 30 bp, Artificial Sequence
  Description of Artificial Sequence: Synthetic oligonucleotide
tgtggtagtgccttctggagaagagcagag

SEQ ID NO: 375019 - DNA, 29 bp, Artificial Sequence
  Description of Artificial Sequence: Synthetic oligonucleotide
gtggtagtgccttctggagaagagcagag

SEQ ID NO: 375020 - DNA, 32 bp, Artificial Sequence
  Description of Artificial Sequence: Synthetic oligonucleotide
tggtagtgccttctggagaagagcagagatac

SEQ ID NO: 375021 - DNA, 31 bp, Artificial Sequence
  Description of Artificial Sequence: Synthetic oligonucleotide
ggtagtgccttctggagaagagcagagatac

SEQ ID NO: 375022 - DNA, 32 bp, Artificial Sequence
  Description of Artificial Sequence: Synthetic oligonucleotide
gtagtgccttctggagaagagcagagatacac

SEQ ID NO: 375023 - DNA, 34 bp, Artificial Sequence
  Description of Artificial Sequence: Synthetic oligonucleotide
tagtgccttctggagaagagcagagatacacatg

SEQ ID NO: 375024 - DNA, 33 bp, Artificial Sequence
  Description of Artificial Sequence: Synthetic oligonucleotide
agtgccttctggagaagagcagagatacacatg

SEQ ID NO: 375025 - DNA, 21 bp, Artificial Sequence
  Description of Artificial Sequence: Synthetic oligonucleotide
tgcgacgtggggccggacggt

SEQ ID NO: 375026 - DNA, 20 bp, Artificial Sequence
  Description of Artificial Sequence: Synthetic oligonucleotide
cgacgtggggccggacggtc

SEQ ID NO: 375027 - DNA, 20 bp, Artificial Sequence
  Description of Artificial Sequence: Synthetic oligonucleotide
gacgtggggccggacggtcg

SEQ ID NO: 375028 - DNA, 20 bp, Artificial Sequence
  Description of Artificial Sequence: Synthetic oligonucleotide
acgtggggccggacggtcgc

SEQ ID NO: 375029 - DNA, 20 bp, Artificial Sequence
  Description of Artificial Sequence: Synthetic oligonucleotide
cgtggggccggacggtcgct

SEQ ID NO: 375030 - DNA, 20 bp, Artificial Sequence
  Description of Artificial Sequence: Synthetic oligonucleotide
gtggggccggacggtcgcct

SEQ ID NO: 375031 - DNA, 20 bp, Artificial Sequence
  Description of Artificial Sequence: Synthetic oligonucleotide
tggggccggacggtcgcctc

SEQ ID NO: 375032 - DNA, 20 bp, Artificial Sequence
  Description of Artificial Sequence: Synthetic oligonucleotide
ggggccggacggtcgcctct

SEQ ID NO: 375033 - DNA, 20 bp, Artificial Sequence
  Description of Artificial Sequence: Synthetic oligonucleotide
gggccggacggtcgcctcct

SEQ ID NO: 375034 - DNA, 20 bp, Artificial Sequence
  Description of Artificial Sequence: Synthetic oligonucleotide
ggccggacggtcgcctcctc

SEQ ID NO: 375035 - DNA, 20 bp, Artificial Sequence
  Description of Artificial Sequence: Synthetic oligonucleotide
gccggacggtcgcctcctcc

SEQ ID NO: 375036 - DNA, 20 bp, Artificial Sequence
  Description of Artificial Sequence: Synthetic oligonucleotide
ccggacggtcgcctcctccg

SEQ ID NO: 375037 - DNA, 20 bp, Artificial Sequence
  Description of Artificial Sequence: Synthetic oligonucleotide
cggacggtcgcctcctccgc

SEQ ID NO: 375038 - DNA, 20 bp, Artificial Sequence
  Description of Artificial Sequence: Synthetic oligonucleotide
ggacggtcgcctcctccgcg

SEQ ID NO: 375039 - DNA, 20 bp, Artificial Sequence
  Description of Artificial Sequence: Synthetic oligonucleotide
gacggtcgcctcctccgcgg

SEQ ID NO: 375040 - DNA, 20 bp, Artificial Sequence
  Description of Artificial Sequence: Synthetic oligonucleotide
acggtcgcctcctccgcggg

SEQ ID NO: 375041 - DNA, 20 bp, Artificial Sequence
  Description of Artificial Sequence: Synthetic oligonucleotide
cggtcgcctcctccgcgggt

SEQ ID NO: 375042 - DNA, 21 bp, Artificial Sequence
  Description of Artificial Sequence: Synthetic oligonucleotide
ggtcgcctcctccgcgggcat

SEQ ID NO: 375043 - DNA, 22 bp, Artificial Sequence
  Description of Artificial Sequence: Synthetic oligonucleotide
gtcgcctcctccgcgggcatga

SEQ ID NO: 375044 - DNA, 22 bp, Artificial Sequence
  Description of Artificial Sequence: Synthetic oligonucleotide
tcgcctcctccgcgggcatgac

SEQ ID NO: 375045 - DNA, 36 bp, Artificial Sequence; identical to SEQ ID NO: 23638
  Description of Artificial Sequence: Synthetic oligonucleotide

SEQ ID NO: 375046 - DNA, 35 bp, Artificial Sequence; identical to SEQ ID NO: 23639
  Description of Artificial Sequence: Synthetic oligonucleotide

SEQ ID NO: 375047 - DNA, 34 bp, Artificial Sequence; identical to SEQ ID NO: 23640
  Description of Artificial Sequence: Synthetic oligonucleotide

SEQ ID NO: 375048 - DNA, 30 bp, Artificial Sequence; identical to SEQ ID NO: 23507
  Description of Artificial Sequence: Synthetic oligonucleotide

SEQ ID NO: 375049 - DNA, 29 bp, Artificial Sequence
  Description of Artificial Sequence: Synthetic oligonucleotide
catcatccagaggatgtatggctgcgacg

SEQ ID NO: 375050 - DNA, 30 bp, Artificial Sequence; identical to SEQ ID NO: 23509
  Description of Artificial Sequence: Synthetic oligonucleotide

SEQ ID NO: 375051 - DNA, 29 bp, Artificial Sequence
  Description of Artificial Sequence: Synthetic oligonucleotide
tcatccagaggatgtatggctgcgacgtg

SEQ ID NO: 375052 - DNA, 24 bp, Artificial Sequence
  Description of Artificial Sequence: Synthetic oligonucleotide
gcctcctccgcgggtatgaccagt

SEQ ID NO: 375053 - DNA, 24 bp, Artificial Sequence
  Description of Artificial Sequence: Synthetic oligonucleotide
cctcctccgcgggtatgaccagtc

SEQ ID NO: 375054 - DNA, 24 bp, Artificial Sequence
  Description of Artificial Sequence: Synthetic oligonucleotide
ctcctccgcgggtatgaccagtcc

SEQ ID NO: 375055 - DNA, 24 bp, Artificial Sequence
  Description of Artificial Sequence: Synthetic oligonucleotide
tcctccgcgggtatgaccagtccg

SEQ ID NO: 375056 - DNA, 23 bp, Artificial Sequence
  Description of Artificial Sequence: Synthetic oligonucleotide
cctccgcgggtatgaccagtccg

SEQ ID NO: 375057 - DNA, 23 bp, Artificial Sequence
  Description of Artificial Sequence: Synthetic oligonucleotide
ctccgcgggtatgaccagtccgc

SEQ ID NO: 375058 - DNA, 25 bp, Artificial Sequence
  Description of Artificial Sequence: Synthetic oligonucleotide
tccgcgggtatgaccagtccgccta

SEQ ID NO: 375059 - DNA, 24 bp, Artificial Sequence
  Description of Artificial Sequence: Synthetic oligonucleotide
ccgcgggtatgaccagtccgccta

SEQ ID NO: 375060 - DNA, 24 bp, Artificial Sequence
  Description of Artificial Sequence: Synthetic oligonucleotide
cgcgggtatgaccagtccgcctac

SEQ ID NO: 375061 - DNA, 25 bp, Artificial Sequence
  Description of Artificial Sequence: Synthetic oligonucleotide
gcgggtatgaccagtccgcctacga

SEQ ID NO: 375062 - DNA, 25 bp, Artificial Sequence
  Description of Artificial Sequence: Synthetic oligonucleotide
cgggtatgaccagtccgcctacgac

SEQ ID NO: 375063 - DNA, 25 bp, Artificial Sequence
  Description of Artificial Sequence: Synthetic oligonucleotide
gggtatgaccagtccgcctacgacg

SEQ ID NO: 375064 - DNA, 25 bp, Artificial Sequence
  Description of Artificial Sequence: Synthetic oligonucleotide
ggtatgaccagtccgcctacgacgg

SEQ ID NO: 375065 - DNA, 27 bp, Artificial Sequence
  Description of Artificial Sequence: Synthetic oligonucleotide
gtatgaccagtccgcctacgacggcaa

SEQ ID NO: 375066 - DNA, 27 bp, Artificial Sequence
  Description of Artificial Sequence: Synthetic oligonucleotide
tatgaccagtccgcctacgacggcaag

SEQ ID NO: 375067 - DNA, 21 bp, Artificial Sequence
  Description of Artificial Sequence: Synthetic oligonucleotide
gcgagtccgaggatggcgccg

SEQ ID NO: 375068 - DNA, 21 bp, Artificial Sequence
  Description of Artificial Sequence: Synthetic oligonucleotide
cgagtccgaggatggcgccgc

SEQ ID NO: 375069 - DNA, 21 bp, Artificial Sequence
  Description of Artificial Sequence: Synthetic oligonucleotide
gagtccgaggatggcgccgcg

SEQ ID NO: 375070 - DNA, 21 bp, Artificial Sequence
  Description of Artificial Sequence: Synthetic oligonucleotide
agtccgaggatggcgccgcgg

SEQ ID NO: 375071 - DNA, 20 bp, Artificial Sequence
  Description of Artificial Sequence: Synthetic oligonucleotide
gtccgaggatggcgccgcgg

SEQ ID NO: 375072 - DNA, 20 bp, Artificial Sequence
  Description of Artificial Sequence: Synthetic oligonucleotide
tccgaggatggcgccgcggg

SEQ ID NO: 375073 - DNA, 20 bp, Artificial Sequence
  Description of Artificial Sequence: Synthetic oligonucleotide
ccgaggatggcgccgcgggt

SEQ ID NO: 375074 - DNA, 20 bp, Artificial Sequence
  Description of Artificial Sequence: Synthetic oligonucleotide
cgaggatggcgccgcgggct

SEQ ID NO: 375075 - DNA, 20 bp, Artificial Sequence
  Description of Artificial Sequence: Synthetic oligonucleotide
gaggatggcgccgcgggcgt

SEQ ID NO: 375076 - DNA, 20 bp, Artificial Sequence
  Description of Artificial Sequence: Synthetic oligonucleotide
aggatggcgccgcgggcgct

SEQ ID NO: 375077 - DNA, 20 bp, Artificial Sequence
  Description of Artificial Sequence: Synthetic oligonucleotide
ggatggcgccgcgggcgctt

SEQ ID NO: 375078 - DNA, 20 bp, Artificial Sequence
  Description of Artificial Sequence: Synthetic oligonucleotide
gatggcgccgcgggcgccat

SEQ ID NO: 375079 - DNA, 20 bp, Artificial Sequence
  Description of Artificial Sequence: Synthetic oligonucleotide
atggcgccgcgggcgccatg

SEQ ID NO: 375080 - DNA, 20 bp, Artificial Sequence
  Description of Artificial Sequence: Synthetic oligonucleotide
tggcgccgcgggcgccatgt

SEQ ID NO: 375081 - DNA, 20 bp, Artificial Sequence
  Description of Artificial Sequence: Synthetic oligonucleotide
ggcgccgcgggcgccatgtt

SEQ ID NO: 375082 - DNA, 21 bp, Artificial Sequence
  Description of Artificial Sequence: Synthetic oligonucleotide
gcgccgcgggcgccatggata

SEQ ID NO: 375083 - DNA, 22 bp, Artificial Sequence
  Description of Artificial Sequence: Synthetic oligonucleotide
cgccgcgggcgccatggataga

SEQ ID NO: 375084 - DNA, 23 bp, Artificial Sequence
  Description of Artificial Sequence: Synthetic oligonucleotide
aggacctgagctcctggaccgcc

SEQ ID NO: 375085 - DNA, 22 bp, Artificial Sequence
  Description of Artificial Sequence: Synthetic oligonucleotide
ggacctgagctcctggaccgcc

SEQ ID NO: 375086 - DNA, 22 bp, Artificial Sequence
  Description of Artificial Sequence: Synthetic oligonucleotide
gacctgagctcctggaccgccg

SEQ ID NO: 375087 - DNA, 22 bp, Artificial Sequence
  Description of Artificial Sequence: Synthetic oligonucleotide
acctgagctcctggaccgccgc

SEQ ID NO: 375088 - DNA, 21 bp, Artificial Sequence
  Description of Artificial Sequence: Synthetic oligonucleotide
cctgagctcctggaccgccgc

SEQ ID NO: 375089 - DNA, 21 bp, Artificial Sequence
  Description of Artificial Sequence: Synthetic oligonucleotide
ctgagctcctggaccgccgcg

SEQ ID NO: 375090 - DNA, 22 bp, Artificial Sequence
  Description of Artificial Sequence: Synthetic oligonucleotide
tgagctcctggaccgccgcgga

SEQ ID NO: 375091 - DNA, 21 bp, Artificial Sequence
  Description of Artificial Sequence: Synthetic oligonucleotide
gagctcctggaccgccgcgga

SEQ ID NO: 375092 - DNA, 22 bp, Artificial Sequence
  Description of Artificial Sequence: Synthetic oligonucleotide
agctcctggaccgccgcggaca

SEQ ID NO: 375093 - DNA, 27 bp, Artificial Sequence
  Description of Artificial Sequence: Synthetic oligonucleotide
cagaggatgtatggctgcgacgtgggt

SEQ ID NO: 375094 - DNA, 27 bp, Artificial Sequence
  Description of Artificial Sequence: Synthetic oligonucleotide
agaggatgtatggctgcgacgtgggtc

SEQ ID NO: 375095 - DNA, 26 bp, Artificial Sequence
  Description of Artificial Sequence: Synthetic oligonucleotide
gaggatgtatggctgcgacgtgggtc

SEQ ID NO: 375096 - DNA, 26 bp, Artificial Sequence
  Description of Artificial Sequence: Synthetic oligonucleotide
aggatgtatggctgcgacgtgggtcc

SEQ ID NO: 375097 - DNA, 25 bp, Artificial Sequence
  Description of Artificial Sequence: Synthetic oligonucleotide
ggatgtatggctgcgacgtgggtcc

SEQ ID NO: 375098 - DNA, 25 bp, Artificial Sequence
  Description of Artificial Sequence: Synthetic oligonucleotide
gatgtatggctgcgacgtgggtccg

SEQ ID NO: 375099 - DNA, 26 bp, Artificial Sequence
  Description of Artificial Sequence: Synthetic oligonucleotide
atgtatggctgcgacgtgggtccgga

SEQ ID NO: 375100 - DNA, 25 bp, Artificial Sequence
  Description of Artificial Sequence: Synthetic oligonucleotide
tgtatggctgcgacgtgggtccgga

SEQ ID NO: 375101 - DNA, 24 bp, Artificial Sequence
  Description of Artificial Sequence: Synthetic oligonucleotide
gtatggctgcgacgtgggtccgga

SEQ ID NO: 375102 - DNA, 24 bp, Artificial Sequence
  Description of Artificial Sequence: Synthetic oligonucleotide
tatggctgcgacgtgggtccggac

SEQ ID NO: 375103 - DNA, 23 bp, Artificial Sequence
  Description of Artificial Sequence: Synthetic oligonucleotide
atggctgcgacgtgggtccggac

SEQ ID NO: 375104 - DNA, 22 bp, Artificial Sequence
  Description of Artificial Sequence: Synthetic oligonucleotide
tggctgcgacgtgggtccggac

SEQ ID NO: 375105 - DNA, 21 bp, Artificial Sequence
  Description of Artificial Sequence: Synthetic oligonucleotide
ggctgcgacgtgggtccggac

SEQ ID NO: 375106 - DNA, 21 bp, Artificial Sequence
  Description of Artificial Sequence: Synthetic oligonucleotide
gctgcgacgtgggtccggacg

SEQ ID NO: 375107 - DNA, 21 bp, Artificial Sequence
  Description of Artificial Sequence: Synthetic oligonucleotide
ctgcgacgtgggtccggacgg

SEQ ID NO: 375108 - DNA, 21 bp, Artificial Sequence
  Description of Artificial Sequence: Synthetic oligonucleotide
tgcgacgtgggtccggacggg

SEQ ID NO: 375109 - DNA, 20 bp, Artificial Sequence
  Description of Artificial Sequence: Synthetic oligonucleotide
gcgacgtgggtccggacggg

SEQ ID NO: 375110 - DNA, 20 bp, Artificial Sequence
  Description of Artificial Sequence: Synthetic oligonucleotide
cgacgtgggtccggacgggc

SEQ ID NO: 375111 - DNA, 20 bp, Artificial Sequence
  Description of Artificial Sequence: Synthetic oligonucleotide
gacgtgggtccggacgggcg

SEQ ID NO: 375112 - DNA, 20 bp, Artificial Sequence
  Description of Artificial Sequence: Synthetic oligonucleotide
acgtgggtccggacgggcgc

SEQ ID NO: 375113 - DNA, 20 bp, Artificial Sequence
  Description of Artificial Sequence: Synthetic oligonucleotide
cgtgggtccggacgggcgct

SEQ ID NO: 375114 - DNA, 20 bp, Artificial Sequence
  Description of Artificial Sequence: Synthetic oligonucleotide
gtgggtccggacgggcgcct

SEQ ID NO: 375115 - DNA, 20 bp, Artificial Sequence
  Description of Artificial Sequence: Synthetic oligonucleotide
tgggtccggacgggcgcctc

SEQ ID NO: 375116 - DNA, 20 bp, Artificial Sequence
  Description of Artificial Sequence: Synthetic oligonucleotide
gggtccggacgggcgcctct

SEQ ID NO: 375117 - DNA, 20 bp, Artificial Sequence
  Description of Artificial Sequence: Synthetic oligonucleotide
ggtccggacgggcgcctcct

SEQ ID NO: 375118 - DNA, 20 bp, Artificial Sequence
  Description of Artificial Sequence: Synthetic oligonucleotide
gtccggacgggcgcctcctc

SEQ ID NO: 375119 - DNA, 20 bp, Artificial Sequence
  Description of Artificial Sequence: Synthetic oligonucleotide
tccggacgggcgcctcctcc

SEQ ID NO: 375120 - DNA, 28 bp, Artificial Sequence
  Description of Artificial Sequence: Synthetic oligonucleotide
acttggcagacgatgtatggctgcgacg

SEQ ID NO: 375121 - DNA, 27 bp, Artificial Sequence
  Description of Artificial Sequence: Synthetic oligonucleotide
cttggcagacgatgtatggctgcgacg

SEQ ID NO: 375122 - DNA, 28 bp, Artificial Sequence
  Description of Artificial Sequence: Synthetic oligonucleotide
ttggcagacgatgtatggctgcgacgtg

SEQ ID NO: 375123 - DNA, 27 bp, Artificial Sequence
  Description of Artificial Sequence: Synthetic oligonucleotide
tggcagacgatgtatggctgcgacgtg

SEQ ID NO: 375124 - DNA, 26 bp, Artificial Sequence
  Description of Artificial Sequence: Synthetic oligonucleotide
ggcagacgatgtatggctgcgacgtg

SEQ ID NO: 375125 - DNA, 26 bp, Artificial Sequence
  Description of Artificial Sequence: Synthetic oligonucleotide
gcagacgatgtatggctgcgacgtgg

SEQ ID NO: 375126 - DNA, 26 bp, Artificial Sequence
  Description of Artificial Sequence: Synthetic oligonucleotide
cagacgatgtatggctgcgacgtggg

SEQ ID NO: 375127 - DNA, 26 bp, Artificial Sequence
  Description of Artificial Sequence: Synthetic oligonucleotide
agacgatgtatggctgcgacgtgggg

SEQ ID NO: 375128 - DNA, 25 bp, Artificial Sequence
  Description of Artificial Sequence: Synthetic oligonucleotide
gacgatgtatggctgcgacgtgggg

SEQ ID NO: 375129 - DNA, 25 bp, Artificial Sequence
  Description of Artificial Sequence: Synthetic oligonucleotide
acgatgtatggctgcgacgtggggc

SEQ ID NO: 375130 - DNA, 24 bp, Artificial Sequence
  Description of Artificial Sequence: Synthetic oligonucleotide
cgatgtatggctgcgacgtggggc

SEQ ID NO: 375131 - DNA, 27 bp, Artificial Sequence
  Description of Artificial Sequence: Synthetic oligonucleotide
cgggtctcacaccctccagaggatgtt

SEQ ID NO: 375132 - DNA, 28 bp, Artificial Sequence
  Description of Artificial Sequence: Synthetic oligonucleotide
gggtctcacaccctccagaggatgtttg

SEQ ID NO: 375133 - DNA, 28 bp, Artificial Sequence
  Description of Artificial Sequence: Synthetic oligonucleotide
ggtctcacaccctccagaggatgtttgg

SEQ ID NO: 375134 - DNA, 28 bp, Artificial Sequence
  Description of Artificial Sequence: Synthetic oligonucleotide
gtctcacaccctccagaggatgtttggc

SEQ ID NO: 375135 - DNA, 29 bp, Artificial Sequence
  Description of Artificial Sequence: Synthetic oligonucleotide
tctcacaccctccagaggatgtttggctg

SEQ ID NO: 375136 - DNA, 28 bp, Artificial Sequence
  Description of Artificial Sequence: Synthetic oligonucleotide
ctcacaccctccagaggatgtttggctg

SEQ ID NO: 375137 - DNA, 28 bp, Artificial Sequence
  Description of Artificial Sequence: Synthetic oligonucleotide
tcacaccctccagaggatgtttggctgc

SEQ ID NO: 375138 - DNA, 27 bp, Artificial Sequence
  Description of Artificial Sequence: Synthetic oligonucleotide
cacaccctccagaggatgtttggctgc

SEQ ID NO: 375139 - DNA, 27 bp, Artificial Sequence
  Description of Artificial Sequence: Synthetic oligonucleotide
acaccctccagaggatgtttggctgcg

SEQ ID NO: 375140 - DNA, 27 bp, Artificial Sequence
  Description of Artificial Sequence: Synthetic oligonucleotide
caccctccagaggatgtttggctgcga

SEQ ID NO: 375141 - DNA, 27 bp, Artificial Sequence
  Description of Artificial Sequence: Synthetic oligonucleotide
accctccagaggatgtttggctgcgac

SEQ ID NO: 375142 - DNA, 26 bp, Artificial Sequence
  Description of Artificial Sequence: Synthetic oligonucleotide
ccctccagaggatgtttggctgcgac

SEQ ID NO: 375143 - DNA, 27 bp, Artificial Sequence
  Description of Artificial Sequence: Synthetic oligonucleotide
cctccagaggatgtttggctgcgacgt

SEQ ID NO: 375144 - DNA, 27 bp, Artificial Sequence
  Description of Artificial Sequence: Synthetic oligonucleotide
ctccagaggatgtttggctgcgacgtg

SEQ ID NO: 375145 - DNA, 26 bp, Artificial Sequence
  Description of Artificial Sequence: Synthetic oligonucleotide
agaggatgtttggctgcgacgtgggg

SEQ ID NO: 375146 - DNA, 25 bp, Artificial Sequence
  Description of Artificial Sequence: Synthetic oligonucleotide
gaggatgtttggctgcgacgtgggg

SEQ ID NO: 375147 - DNA, 25 bp, Artificial Sequence
  Description of Artificial Sequence: Synthetic oligonucleotide
aggatgtttggctgcgacgtggggc

SEQ ID NO: 375148 - DNA, 24 bp, Artificial Sequence
  Description of Artificial Sequence: Synthetic oligonucleotide
ggatgtttggctgcgacgtggggc

SEQ ID NO: 375149 - DNA, 24 bp, Artificial Sequence
  Description of Artificial Sequence: Synthetic oligonucleotide
gatgtttggctgcgacgtggggcc

SEQ ID NO: 375150 - DNA, 24 bp, Artificial Sequence
  Description of Artificial Sequence: Synthetic oligonucleotide
atgtttggctgcgacgtggggccg

SEQ ID NO: 375151 - DNA, 23 bp, Artificial Sequence
  Description of Artificial Sequence: Synthetic oligonucleotide
tgtttggctgcgacgtggggccg

SEQ ID NO: 375152 - DNA, 22 bp, Artificial Sequence
  Description of Artificial Sequence: Synthetic oligonucleotide
gtttggctgcgacgtggggccg

SEQ ID NO: 375153 - DNA, 23 bp, Artificial Sequence
  Description of Artificial Sequence: Synthetic oligonucleotide
tttggctgcgacgtggggccgga

SEQ ID NO: 375154 - DNA, 22 bp, Artificial Sequence
  Description of Artificial Sequence: Synthetic oligonucleotide
ttggctgcgacgtggggccgga

SEQ ID NO: 375155 - DNA, 23 bp, Artificial Sequence
  Description of Artificial Sequence: Synthetic oligonucleotide
aggccaccctgaggtgctgggct

SEQ ID NO: 375156 - DNA, 22 bp, Artificial Sequence
  Description of Artificial Sequence: Synthetic oligonucleotide
ggccaccctgaggtgctgggct

SEQ ID NO: 375157 - DNA, 23 bp, Artificial Sequence
  Description of Artificial Sequence: Synthetic oligonucleotide
gccaccctgaggtgctgggctct

SEQ ID NO: 375158 - DNA, 23 bp, Artificial Sequence
  Description of Artificial Sequence: Synthetic oligonucleotide
ccaccctgaggtgctgggctctg

SEQ ID NO: 375159 - DNA, 23 bp, Artificial Sequence
  Description of Artificial Sequence: Synthetic oligonucleotide
caccctgaggtgctgggctctgg

SEQ ID NO: 375160 - DNA, 23 bp, Artificial Sequence
  Description of Artificial Sequence: Synthetic oligonucleotide
accctgaggtgctgggctctggg

SEQ ID NO: 375161 - DNA, 22 bp, Artificial Sequence
  Description of Artificial Sequence: Synthetic oligonucleotide
ccctgaggtgctgggctctggg

SEQ ID NO: 375162 - DNA, 24 bp, Artificial Sequence
  Description of Artificial Sequence: Synthetic oligonucleotide
cctgaggtgctgggctctgggctt

SEQ ID NO: 375163 - DNA, 26 bp, Artificial Sequence
  Description of Artificial Sequence: Synthetic oligonucleotide
ctgaggtgctgggctctgggcttcta

SEQ ID NO: 375164 - DNA, 26 bp, Artificial Sequence
  Description of Artificial Sequence: Synthetic oligonucleotide
tgaggtgctgggctctgggcttctac

SEQ ID NO: 375165 - DNA, 25 bp, Artificial Sequence
  Description of Artificial Sequence: Synthetic oligonucleotide
gaggtgctgggctctgggcttctac

SEQ ID NO: 375166 - DNA, 25 bp, Artificial Sequence
  Description of Artificial Sequence: Synthetic oligonucleotide
aggtgctgggctctgggcttctacc

SEQ ID NO: 375167 - DNA, 24 bp, Artificial Sequence
  Description of Artificial Sequence: Synthetic oligonucleotide
ggtgctgggctctgggcttctacc

SEQ ID NO: 375168 - DNA, 25 bp, Artificial Sequence
  Description of Artificial Sequence: Synthetic oligonucleotide
gtgctgggctctgggcttctaccct

SEQ ID NO: 375169 - DNA, 25 bp, Artificial Sequence
  Description of Artificial Sequence: Synthetic oligonucleotide
tgctgggctctgggcttctaccctg

SEQ ID NO: 375170 - DNA, 24 bp, Artificial Sequence
  Description of Artificial Sequence: Synthetic oligonucleotide
gctgggctctgggcttctaccctg

SEQ ID NO: 375171 - DNA, 24 bp, Artificial Sequence
  Description of Artificial Sequence: Synthetic oligonucleotide
ctgggctctgggcttctaccctgc

SEQ ID NO: 375172 - DNA, 24 bp, Artificial Sequence
  Description of Artificial Sequence: Synthetic oligonucleotide
tgggctctgggcttctaccctgcg

SEQ ID NO: 375173 - DNA, 23 bp, Artificial Sequence
  Description of Artificial Sequence: Synthetic oligonucleotide
gggctctgggcttctaccctgcg

SEQ ID NO: 375174 - DNA, 24 bp, Artificial Sequence
  Description of Artificial Sequence: Synthetic oligonucleotide
ggctctgggcttctaccctgcgga

SEQ ID NO: 375175 - DNA, 26 bp, Artificial Sequence
  Description of Artificial Sequence: Synthetic oligonucleotide
gctctgggcttctaccctgcggagat

SEQ ID NO: 375176 - DNA, 27 bp, Artificial Sequence
  Description of Artificial Sequence: Synthetic oligonucleotide
ctctgggcttctaccctgcggagatca

SEQ ID NO: 375177 - DNA, 27 bp, Artificial Sequence
  Description of Artificial Sequence: Synthetic oligonucleotide
tctgggcttctaccctgcggagatcac

SEQ ID NO: 375178 - DNA, 35 bp, Artificial Sequence; identical to SEQ ID NO: 25460
  Description of Artificial Sequence: Synthetic oligonucleotide

SEQ ID NO: 375179 - DNA, 34 bp, Artificial Sequence; identical to SEQ ID NO: 25461
  Description of Artificial Sequence: Synthetic oligonucleotide

SEQ ID NO: 375180 - DNA, 33 bp, Artificial Sequence; identical to SEQ ID NO: 25462
  Description of Artificial Sequence: Synthetic oligonucleotide

SEQ ID NO: 375181 - DNA, 33 bp, Artificial Sequence; identical to SEQ ID NO: 25463
  Description of Artificial Sequence: Synthetic oligonucleotide

SEQ ID NO: 375182 - DNA, 32 bp, Artificial Sequence; identical to SEQ ID NO: 25464
  Description of Artificial Sequence: Synthetic oligonucleotide

SEQ ID NO: 375183 - DNA, 36 bp, Artificial Sequence; identical to SEQ ID NO: 27046
  Description of Artificial Sequence: Synthetic oligonucleotide

SEQ ID NO: 375184 - DNA, 35 bp, Artificial Sequence; identical to SEQ ID NO: 27047
  Description of Artificial Sequence: Synthetic oligonucleotide

SEQ ID NO: 375185 - DNA, 34 bp, Artificial Sequence; identical to SEQ ID NO: 27048
  Description of Artificial Sequence: Synthetic oligonucleotide

SEQ ID NO: 375186 - DNA, 34 bp, Artificial Sequence; identical to SEQ ID NO: 27049
  Description of Artificial Sequence: Synthetic oligonucleotide

SEQ ID NO: 375187 - DNA, 33 bp, Artificial Sequence; identical to SEQ ID NO: 27050
  Description of Artificial Sequence: Synthetic oligonucleotide

SEQ ID NO: 375188 - DNA, 33 bp, Artificial Sequence; identical to SEQ ID NO: 27051
  Description of Artificial Sequence: Synthetic oligonucleotide

SEQ ID NO: 375189 - DNA, 32 bp, Artificial Sequence; identical to SEQ ID NO: 27052
  Description of Artificial Sequence: Synthetic oligonucleotide

SEQ ID NO: 375190 - DNA, 33 bp, Artificial Sequence; identical to SEQ ID NO: 27053
  Description of Artificial Sequence: Synthetic oligonucleotide

SEQ ID NO: 375191 - DNA, 32 bp, Artificial Sequence; identical to SEQ ID NO: 27054
  Description of Artificial Sequence: Synthetic oligonucleotide

SEQ ID NO: 375192 - DNA, 33 bp, Artificial Sequence; identical to SEQ ID NO: 27055
  Description of Artificial Sequence: Synthetic oligonucleotide

SEQ ID NO: 375193 - DNA, 32 bp, Artificial Sequence; identical to SEQ ID NO: 27056
  Description of Artificial Sequence: Synthetic oligonucleotide

SEQ ID NO: 375194 - DNA, 31 bp, Artificial Sequence; identical to SEQ ID NO: 27057
  Description of Artificial Sequence: Synthetic oligonucleotide

SEQ ID NO: 375195 - DNA, 32 bp, Artificial Sequence; identical to SEQ ID NO: 27058
  Description of Artificial Sequence: Synthetic oligonucleotide

SEQ ID NO: 375196 - DNA, 31 bp, Artificial Sequence; identical to SEQ ID NO: 27059
  Description of Artificial Sequence: Synthetic oligonucleotide

SEQ ID NO: 375197 - DNA, 34 bp, Artificial Sequence; identical to SEQ ID NO: 22676
  Description of Artificial Sequence: Synthetic oligonucleotide

SEQ ID NO: 375198 - DNA, 33 bp, Artificial Sequence; identical to SEQ ID NO: 22677
  Description of Artificial Sequence: Synthetic oligonucleotide

SEQ ID NO: 375199 - DNA, 33 bp, Artificial Sequence; identical to SEQ ID NO: 22678
  Description of Artificial Sequence: Synthetic oligonucleotide

SEQ ID NO: 375200 - DNA, 32 bp, Artificial Sequence; identical to SEQ ID NO: 22679
  Description of Artificial Sequence: Synthetic oligonucleotide

SEQ ID NO: 375201 - DNA, 31 bp, Artificial Sequence; identical to SEQ ID NO: 22680
  Description of Artificial Sequence: Synthetic oligonucleotide

SEQ ID NO: 375202 - DNA, 30 bp, Artificial Sequence; identical to SEQ ID NO: 22681
  Description of Artificial Sequence: Synthetic oligonucleotide

SEQ ID NO: 375203 - DNA, 29 bp, Artificial Sequence
  Description of Artificial Sequence: Synthetic oligonucleotide
gggaccggaacacacagatctacaagacc

SEQ ID NO: 375204 - DNA, 31 bp, Artificial Sequence; identical to SEQ ID NO: 22683
  Description of Artificial Sequence: Synthetic oligonucleotide

SEQ ID NO: 375205 - DNA, 32 bp, Artificial Sequence; identical to SEQ ID NO: 22684
  Description of Artificial Sequence: Synthetic oligonucleotide

SEQ ID NO: 375206 - DNA, 33 bp, Artificial Sequence; identical to SEQ ID NO: 22685
  Description of Artificial Sequence: Synthetic oligonucleotide

SEQ ID NO: 375207 - DNA, 32 bp, Artificial Sequence; identical to SEQ ID NO: 22686
  Description of Artificial Sequence: Synthetic oligonucleotide

SEQ ID NO: 375208 - DNA, 33 bp, Artificial Sequence; identical to SEQ ID NO: 22687
  Description of Artificial Sequence: Synthetic oligonucleotide

SEQ ID NO: 375209 - DNA, 34 bp, Artificial Sequence; identical to SEQ ID NO: 22688
  Description of Artificial Sequence: Synthetic oligonucleotide

SEQ ID NO: 375210 - DNA, 37 bp, Artificial Sequence; identical to SEQ ID NO: 23469
  Description of Artificial Sequence: Synthetic oligonucleotide

SEQ ID NO: 375211 - DNA, 37 bp, Artificial Sequence; identical to SEQ ID NO: 23470
  Description of Artificial Sequence: Synthetic oligonucleotide

SEQ ID NO: 375212 - DNA, 36 bp, Artificial Sequence; identical to SEQ ID NO: 23471
  Description of Artificial Sequence: Synthetic oligonucleotide

SEQ ID NO: 375213 - DNA, 35 bp, Artificial Sequence; identical to SEQ ID NO: 23472
  Description of Artificial Sequence: Synthetic oligonucleotide

SEQ ID NO: 375214 - DNA, 35 bp, Artificial Sequence; identical to SEQ ID NO: 23473
  Description of Artificial Sequence: Synthetic oligonucleotide

SEQ ID NO: 375215 - DNA, 34 bp, Artificial Sequence; identical to SEQ ID NO: 23474
  Description of Artificial Sequence: Synthetic oligonucleotide

SEQ ID NO: 375216 - DNA, 35 bp, Artificial Sequence; identical to SEQ ID NO: 23475
  Description of Artificial Sequence: Synthetic oligonucleotide

SEQ ID NO: 375217 - DNA, 34 bp, Artificial Sequence; identical to SEQ ID NO: 23476
  Description of Artificial Sequence: Synthetic oligonucleotide

SEQ ID NO: 375218 - DNA, 35 bp, Artificial Sequence; identical to SEQ ID NO: 23477
  Description of Artificial Sequence: Synthetic oligonucleotide

SEQ ID NO: 375219 - DNA, 34 bp, Artificial Sequence; identical to SEQ ID NO: 23478
  Description of Artificial Sequence: Synthetic oligonucleotide

SEQ ID NO: 375220 - DNA, 35 bp, Artificial Sequence; identical to SEQ ID NO: 23479
  Description of Artificial Sequence: Synthetic oligonucleotide

SEQ ID NO: 375221 - DNA, 34 bp, Artificial Sequence; identical to SEQ ID NO: 23480
  Description of Artificial Sequence: Synthetic oligonucleotide

SEQ ID NO: 375222 - DNA, 33 bp, Artificial Sequence; identical to SEQ ID NO: 23481
  Description of Artificial Sequence: Synthetic oligonucleotide

SEQ ID NO: 375223 - DNA, 33 bp, Artificial Sequence; identical to SEQ ID NO: 23482
  Description of Artificial Sequence: Synthetic oligonucleotide

SEQ ID NO: 375224 - DNA, 32 bp, Artificial Sequence; identical to SEQ ID NO: 23483
  Description of Artificial Sequence: Synthetic oligonucleotide

SEQ ID NO: 375225 - DNA, 23 bp, Artificial Sequence
  Description of Artificial Sequence: Synthetic oligonucleotide
acgccgcgagtccgaggatggct

SEQ ID NO: 375226 - DNA, 22 bp, Artificial Sequence
  Description of Artificial Sequence: Synthetic oligonucleotide
cgccgcgagtccgaggatggct

SEQ ID NO: 375227 - DNA, 22 bp, Artificial Sequence
  Description of Artificial Sequence: Synthetic oligonucleotide
gccgcgagtccgaggatggctc

SEQ ID NO: 375228 - DNA, 22 bp, Artificial Sequence
  Description of Artificial Sequence: Synthetic oligonucleotide
ccgcgagtccgaggatggctcc

SEQ ID NO: 375229 - DNA, 22 bp, Artificial Sequence
  Description of Artificial Sequence: Synthetic oligonucleotide
cgcgagtccgaggatggctccc

SEQ ID NO: 375230 - DNA, 22 bp, Artificial Sequence
  Description of Artificial Sequence: Synthetic oligonucleotide
gcgagtccgaggatggctcccc

SEQ ID NO: 375231 - DNA, 22 bp, Artificial Sequence
  Description of Artificial Sequence: Synthetic oligonucleotide
cgagtccgaggatggctccccg

SEQ ID NO: 375232 - DNA, 22 bp, Artificial Sequence
  Description of Artificial Sequence: Synthetic oligonucleotide
gagtccgaggatggctccccgg

SEQ ID NO: 375233 - DNA, 22 bp, Artificial Sequence
  Description of Artificial Sequence: Synthetic oligonucleotide
agtccgaggatggctccccggg

SEQ ID NO: 375234 - DNA, 21 bp, Artificial Sequence
  Description of Artificial Sequence: Synthetic oligonucleotide
gtccgaggatggctccccggg

SEQ ID NO: 375235 - DNA, 21 bp, Artificial Sequence
  Description of Artificial Sequence: Synthetic oligonucleotide
tccgaggatggctccccgggc

SEQ ID NO: 375236 - DNA, 20 bp, Artificial Sequence
  Description of Artificial Sequence: Synthetic oligonucleotide
ccgaggatggctccccgggc

SEQ ID NO: 375237 - DNA, 20 bp, Artificial Sequence
  Description of Artificial Sequence: Synthetic oligonucleotide
cgaggatggctccccgggcg

SEQ ID NO: 375238 - DNA, 20 bp, Artificial Sequence
  Description of Artificial Sequence: Synthetic oligonucleotide
gaggatggctccccgggcgc

SEQ ID NO: 375239 - DNA, 22 bp, Artificial Sequence
  Description of Artificial Sequence: Synthetic oligonucleotide
aggatggctccccgggcgccat

SEQ ID NO: 375240 - DNA, 21 bp, Artificial Sequence
  Description of Artificial Sequence: Synthetic oligonucleotide
ggatggctccccgggcgccat

SEQ ID NO: 375241 - DNA, 21 bp, Artificial Sequence
  Description of Artificial Sequence: Synthetic oligonucleotide
gatggctccccgggcgccatg

SEQ ID NO: 375242 - DNA, 24 bp, Artificial Sequence
  Description of Artificial Sequence: Synthetic oligonucleotide
atggctccccgggcgccatggata

SEQ ID NO: 375243 - DNA, 23 bp, Artificial Sequence
  Description of Artificial Sequence: Synthetic oligonucleotide
tggctccccgggcgccatggata

SEQ ID NO: 375244 - DNA, 22 bp, Artificial Sequence
  Description of Artificial Sequence: Synthetic oligonucleotide
ggctccccgggcgccatggata

SEQ ID NO: 375245 - DNA, 23 bp, Artificial Sequence
  Description of Artificial Sequence: Synthetic oligonucleotide
gctccccgggcgccatggataga

SEQ ID NO: 375246 - DNA, 23 bp, Artificial Sequence
  Description of Artificial Sequence: Synthetic oligonucleotide
ctccccgggcgccatggatagag

SEQ ID NO: 375247 - DNA, 24 bp, Artificial Sequence
  Description of Artificial Sequence: Synthetic oligonucleotide
tccccgggcgccatggatagagca

SEQ ID NO: 375248 - DNA, 27 bp, Artificial Sequence
  Description of Artificial Sequence: Synthetic oligonucleotide
gatggcgaggaccaaactcaggacacg

SEQ ID NO: 375249 - DNA, 27 bp, Artificial Sequence
  Description of Artificial Sequence: Synthetic oligonucleotide
atggcgaggaccaaactcaggacacgg

SEQ ID NO: 375250 - DNA, 27 bp, Artificial Sequence
  Description of Artificial Sequence: Synthetic oligonucleotide
tggcgaggaccaaactcaggacacgga

SEQ ID NO: 375251 - DNA, 26 bp, Artificial Sequence
  Description of Artificial Sequence: Synthetic oligonucleotide
ggcgaggaccaaactcaggacacgga

SEQ ID NO: 375252 - DNA, 26 bp, Artificial Sequence
  Description of Artificial Sequence: Synthetic oligonucleotide
gcgaggaccaaactcaggacacggag

SEQ ID NO: 375253 - DNA, 27 bp, Artificial Sequence
  Description of Artificial Sequence: Synthetic oligonucleotide
cgaggaccaaactcaggacacggagct

SEQ ID NO: 375254 - DNA, 28 bp, Artificial Sequence
  Description of Artificial Sequence: Synthetic oligonucleotide
gaggaccaaactcaggacacggagcttg

SEQ ID NO: 375255 - DNA, 29 bp, Artificial Sequence
  Description of Artificial Sequence: Synthetic oligonucleotide
aggaccaaactcaggacacggagcttgtg

SEQ ID NO: 375256 - DNA, 28 bp, Artificial Sequence
  Description of Artificial Sequence: Synthetic oligonucleotide
ggaccaaactcaggacacggagcttgtg

SEQ ID NO: 375257 - DNA, 28 bp, Artificial Sequence
  Description of Artificial Sequence: Synthetic oligonucleotide
gaccaaactcaggacacggagcttgtgg

SEQ ID NO: 375258 - DNA, 29 bp, Artificial Sequence
  Description of Artificial Sequence: Synthetic oligonucleotide
accaaactcaggacacggagcttgtggag

SEQ ID NO: 375259 - DNA, 28 bp, Artificial Sequence
  Description of Artificial Sequence: Synthetic oligonucleotide
ccaaactcaggacacggagcttgtggag

SEQ ID NO: 375260 - DNA, 29 bp, Artificial Sequence
  Description of Artificial Sequence: Synthetic oligonucleotide
caaactcaggacacggagcttgtggagac

SEQ ID NO: 375261 - DNA, 29 bp, Artificial Sequence
  Description of Artificial Sequence: Synthetic oligonucleotide
aaactcaggacacggagcttgtggagacc

SEQ ID NO: 375262 - DNA, 28 bp, Artificial Sequence
  Description of Artificial Sequence: Synthetic oligonucleotide
aactcaggacacggagcttgtggagacc

SEQ ID NO: 375263 - DNA, 27 bp, Artificial Sequence
  Description of Artificial Sequence: Synthetic oligonucleotide
actcaggacacggagcttgtggagacc

SEQ ID NO: 375264 - DNA, 27 bp, Artificial Sequence
  Description of Artificial Sequence: Synthetic oligonucleotide
ctcaggacacggagcttgtggagacca

SEQ ID NO: 375265 - DNA, 27 bp, Artificial Sequence
  Description of Artificial Sequence: Synthetic oligonucleotide
tcaggacacggagcttgtggagaccag

SEQ ID NO: 375266 - DNA, 27 bp, Artificial Sequence
  Description of Artificial Sequence: Synthetic oligonucleotide
caggacacggagcttgtggagaccaga

SEQ ID NO: 375267 - DNA, 27 bp, Artificial Sequence
  Description of Artificial Sequence: Synthetic oligonucleotide
aggacacggagcttgtggagaccagac

SEQ ID NO: 375268 - DNA, 26 bp, Artificial Sequence
  Description of Artificial Sequence: Synthetic oligonucleotide
ggacacggagcttgtggagaccagac

SEQ ID NO: 375269 - DNA, 27 bp, Artificial Sequence
  Description of Artificial Sequence: Synthetic oligonucleotide
gacacggagcttgtggagaccagacca

SEQ ID NO: 375270 - DNA, 27 bp, Artificial Sequence
  Description of Artificial Sequence: Synthetic oligonucleotide
acacggagcttgtggagaccagaccag

SEQ ID NO: 375271 - DNA, 26 bp, Artificial Sequence
  Description of Artificial Sequence: Synthetic oligonucleotide
cacggagcttgtggagaccagaccag

SEQ ID NO: 375272 - DNA, 27 bp, Artificial Sequence
  Description of Artificial Sequence: Synthetic oligonucleotide
acggagcttgtggagaccagaccagca

SEQ ID NO: 375273 - DNA, 26 bp, Artificial Sequence
  Description of Artificial Sequence: Synthetic oligonucleotide
cggagcttgtggagaccagaccagca

SEQ ID NO: 375274 - DNA, 26 bp, Artificial Sequence
  Description of Artificial Sequence: Synthetic oligonucleotide
ggagcttgtggagaccagaccagcag

SEQ ID NO: 375275 - DNA, 24 bp, Artificial Sequence
  Description of Artificial Sequence: Synthetic oligonucleotide
tacctggagggcctgtgcgtggac

SEQ ID NO: 375276 - DNA, 23 bp, Artificial Sequence
  Description of Artificial Sequence: Synthetic oligonucleotide
acctggagggcctgtgcgtggac

SEQ ID NO: 375277 - DNA, 22 bp, Artificial Sequence
  Description of Artificial Sequence: Synthetic oligonucleotide
cctggagggcctgtgcgtggac

SEQ ID NO: 375278 - DNA, 22 bp, Artificial Sequence
  Description of Artificial Sequence: Synthetic oligonucleotide
ctggagggcctgtgcgtggacg

SEQ ID NO: 375279 - DNA, 22 bp, Artificial Sequence
  Description of Artificial Sequence: Synthetic oligonucleotide
tggagggcctgtgcgtggacgg

SEQ ID NO: 375280 - DNA, 21 bp, Artificial Sequence
  Description of Artificial Sequence: Synthetic oligonucleotide
ggagggcctgtgcgtggacgg

SEQ ID NO: 375281 - DNA, 21 bp, Artificial Sequence
  Description of Artificial Sequence: Synthetic oligonucleotide
gagggcctgtgcgtggacggg

SEQ ID NO: 375282 - DNA, 22 bp, Artificial Sequence
  Description of Artificial Sequence: Synthetic oligonucleotide
agggcctgtgcgtggacgggct

SEQ ID NO: 375283 - DNA, 21 bp, Artificial Sequence
  Description of Artificial Sequence: Synthetic oligonucleotide
gggcctgtgcgtggacgggct

SEQ ID NO: 375284 - DNA, 21 bp, Artificial Sequence
  Description of Artificial Sequence: Synthetic oligonucleotide
ggcctgtgcgtggacgggctc

SEQ ID NO: 375285 - DNA, 21 bp, Artificial Sequence
  Description of Artificial Sequence: Synthetic oligonucleotide
gcctgtgcgtggacgggctcc

SEQ ID NO: 375286 - DNA, 21 bp, Artificial Sequence
  Description of Artificial Sequence: Synthetic oligonucleotide
cctgtgcgtggacgggctccg

SEQ ID NO: 375287 - DNA, 22 bp, Artificial Sequence
  Description of Artificial Sequence: Synthetic oligonucleotide
ctgtgcgtggacgggctccgca

SEQ ID NO: 375288 - DNA, 25 bp, Artificial Sequence
  Description of Artificial Sequence: Synthetic oligonucleotide
tgtgcgtggacgggctccgcagata

SEQ ID NO: 375289 - DNA, 23 bp, Artificial Sequence
  Description of Artificial Sequence: Synthetic oligonucleotide
gagacctgggccggctcccactt

SEQ ID NO: 375290 - DNA, 25 bp, Artificial Sequence
  Description of Artificial Sequence: Synthetic oligonucleotide
agacctgggccggctcccacttcat

SEQ ID NO: 375291 - DNA, 24 bp, Artificial Sequence
  Description of Artificial Sequence: Synthetic oligonucleotide
gacctgggccggctcccacttcat

SEQ ID NO: 375292 - DNA, 25 bp, Artificial Sequence
  Description of Artificial Sequence: Synthetic oligonucleotide
acctgggccggctcccacttcatga

SEQ ID NO: 375293 - DNA, 24 bp, Artificial Sequence
  Description of Artificial Sequence: Synthetic oligonucleotide
cctgggccggctcccacttcatga

SEQ ID NO: 375294 - DNA, 24 bp, Artificial Sequence
  Description of Artificial Sequence: Synthetic oligonucleotide
ctgggccggctcccacttcatgag

SEQ ID NO: 375295 - DNA, 27 bp, Artificial Sequence
  Description of Artificial Sequence: Synthetic oligonucleotide
tgggccggctcccacttcatgaggtat

SEQ ID NO: 375296 - DNA, 27 bp, Artificial Sequence
  Description of Artificial Sequence: Synthetic oligonucleotide
gggccggctcccacttcatgaggtatt

SEQ ID NO: 375297 - DNA, 28 bp, Artificial Sequence
  Description of Artificial Sequence: Synthetic oligonucleotide
ggccggctcccacttcatgaggtatttc

SEQ ID NO: 375298 - DNA, 30 bp, Artificial Sequence; identical to SEQ ID NO: 28590
  Description of Artificial Sequence: Synthetic oligonucleotide

SEQ ID NO: 375299 - DNA, 31 bp, Artificial Sequence; identical to SEQ ID NO: 28591
  Description of Artificial Sequence: Synthetic oligonucleotide

SEQ ID NO: 375300 - DNA, 31 bp, Artificial Sequence; identical to SEQ ID NO: 28592
  Description of Artificial Sequence: Synthetic oligonucleotide

SEQ ID NO: 375301 - DNA, 31 bp, Artificial Sequence; identical to SEQ ID NO: 28593
  Description of Artificial Sequence: Synthetic oligonucleotide

SEQ ID NO: 375302 - DNA, 31 bp, Artificial Sequence; identical to SEQ ID NO: 28594
  Description of Artificial Sequence: Synthetic oligonucleotide

SEQ ID NO: 375303 - DNA, 31 bp, Artificial Sequence; identical to SEQ ID NO: 28595
  Description of Artificial Sequence: Synthetic oligonucleotide

SEQ ID NO: 375304 - DNA, 33 bp, Artificial Sequence; identical to SEQ ID NO: 28596
  Description of Artificial Sequence: Synthetic oligonucleotide

SEQ ID NO: 375305 - DNA, 32 bp, Artificial Sequence; identical to SEQ ID NO: 28597
  Description of Artificial Sequence: Synthetic oligonucleotide

SEQ ID NO: 375306 - DNA, 33 bp, Artificial Sequence; identical to SEQ ID NO: 28598
  Description of Artificial Sequence: Synthetic oligonucleotide

SEQ ID NO: 375307 - DNA, 33 bp, Artificial Sequence; identical to SEQ ID NO: 28599
  Description of Artificial Sequence: Synthetic oligonucleotide

SEQ ID NO: 375308 - DNA, 33 bp, Artificial Sequence; identical to SEQ ID NO: 28600
  Description of Artificial Sequence: Synthetic oligonucleotide

SEQ ID NO: 375309 - DNA, 32 bp, Artificial Sequence; identical to SEQ ID NO: 28601
  Description of Artificial Sequence: Synthetic oligonucleotide

SEQ ID NO: 375310 - DNA, 32 bp, Artificial Sequence; identical to SEQ ID NO: 28602
  Description of Artificial Sequence: Synthetic oligonucleotide

SEQ ID NO: 375311 - DNA, 31 bp, Artificial Sequence; identical to SEQ ID NO: 28603
  Description of Artificial Sequence: Synthetic oligonucleotide

SEQ ID NO: 375312 - DNA, 27 bp, Artificial Sequence
  Description of Artificial Sequence: Synthetic oligonucleotide
gagtattgggaccgggagacacggaac

SEQ ID NO: 375313 - DNA, 29 bp, Artificial Sequence
  Description of Artificial Sequence: Synthetic oligonucleotide
agtattgggaccgggagacacggaacatg

SEQ ID NO: 375314 - DNA, 28 bp, Artificial Sequence
  Description of Artificial Sequence: Synthetic oligonucleotide
gtattgggaccgggagacacggaacatg

SEQ ID NO: 375315 - DNA, 30 bp, Artificial Sequence; identical to SEQ ID NO: 28607
  Description of Artificial Sequence: Synthetic oligonucleotide

SEQ ID NO: 375316 - DNA, 29 bp, Artificial Sequence
  Description of Artificial Sequence: Synthetic oligonucleotide
attgggaccgggagacacggaacatgaag

SEQ ID NO: 375317 - DNA, 28 bp, Artificial Sequence
  Description of Artificial Sequence: Synthetic oligonucleotide
ttgggaccgggagacacggaacatgaag

SEQ ID NO: 375318 - DNA, 27 bp, Artificial Sequence
  Description of Artificial Sequence: Synthetic oligonucleotide
tgggaccgggagacacggaacatgaag

SEQ ID NO: 375319 - DNA, 26 bp, Artificial Sequence
  Description of Artificial Sequence: Synthetic oligonucleotide
gggaccgggagacacggaacatgaag

SEQ ID NO: 375320 - DNA, 26 bp, Artificial Sequence
  Description of Artificial Sequence: Synthetic oligonucleotide
ggaccgggagacacggaacatgaagg

SEQ ID NO: 375321 - DNA, 26 bp, Artificial Sequence
  Description of Artificial Sequence: Synthetic oligonucleotide
gaccgggagacacggaacatgaaggc

SEQ ID NO: 375322 - DNA, 27 bp, Artificial Sequence
  Description of Artificial Sequence: Synthetic oligonucleotide
accgggagacacggaacatgaaggcct

SEQ ID NO: 375323 - DNA, 26 bp, Artificial Sequence
  Description of Artificial Sequence: Synthetic oligonucleotide
ccgggagacacggaacatgaaggcct

SEQ ID NO: 375324 - DNA, 26 bp, Artificial Sequence
  Description of Artificial Sequence: Synthetic oligonucleotide
cgggagacacggaacatgaaggcctc

SEQ ID NO: 375325 - DNA, 26 bp, Artificial Sequence
  Description of Artificial Sequence: Synthetic oligonucleotide
gggagacacggaacatgaaggcctcc

SEQ ID NO: 375326 - DNA, 26 bp, Artificial Sequence
  Description of Artificial Sequence: Synthetic oligonucleotide
ggagacacggaacatgaaggcctccg

SEQ ID NO: 375327 - DNA, 26 bp, Artificial Sequence
  Description of Artificial Sequence: Synthetic oligonucleotide
gagacacggaacatgaaggcctccgc

SEQ ID NO: 375328 - DNA, 26 bp, Artificial Sequence
  Description of Artificial Sequence: Synthetic oligonucleotide
agacacggaacatgaaggcctccgcg

SEQ ID NO: 375329 - DNA, 25 bp, Artificial Sequence
  Description of Artificial Sequence: Synthetic oligonucleotide
gacacggaacatgaaggcctccgcg

SEQ ID NO: 375330 - DNA, 26 bp, Artificial Sequence
  Description of Artificial Sequence: Synthetic oligonucleotide
acacggaacatgaaggcctccgcgca

SEQ ID NO: 375331 - DNA, 25 bp, Artificial Sequence
  Description of Artificial Sequence: Synthetic oligonucleotide
cacggaacatgaaggcctccgcgca

SEQ ID NO: 375332 - DNA, 26 bp, Artificial Sequence
  Description of Artificial Sequence: Synthetic oligonucleotide
acggaacatgaaggcctccgcgcaga

SEQ ID NO: 375333 - DNA, 25 bp, Artificial Sequence
  Description of Artificial Sequence: Synthetic oligonucleotide
cggaacatgaaggcctccgcgcaga

SEQ ID NO: 375334 - DNA, 27 bp, Artificial Sequence
  Description of Artificial Sequence: Synthetic oligonucleotide
ggaacatgaaggcctccgcgcagactt

SEQ ID NO: 375335 - DNA, 28 bp, Artificial Sequence
  Description of Artificial Sequence: Synthetic oligonucleotide
gaacatgaaggcctccgcgcagacttac

SEQ ID NO: 375336 - DNA, 28 bp, Artificial Sequence
  Description of Artificial Sequence: Synthetic oligonucleotide
aacatgaaggcctccgcgcagacttacc

SEQ ID NO: 375337 - DNA, 27 bp, Artificial Sequence
  Description of Artificial Sequence: Synthetic oligonucleotide
acatgaaggcctccgcgcagacttacc

SEQ ID NO: 375338 - DNA, 26 bp, Artificial Sequence
  Description of Artificial Sequence: Synthetic oligonucleotide
catgaaggcctccgcgcagacttacc

SEQ ID NO: 375339 - DNA, 27 bp, Artificial Sequence
  Description of Artificial Sequence: Synthetic oligonucleotide
atgaaggcctccgcgcagacttaccga

SEQ ID NO: 375340 - DNA, 26 bp, Artificial Sequence
  Description of Artificial Sequence: Synthetic oligonucleotide
tgaaggcctccgcgcagacttaccga

SEQ ID NO: 375341 - DNA, 25 bp, Artificial Sequence
  Description of Artificial Sequence: Synthetic oligonucleotide
gaaggcctccgcgcagacttaccga

SEQ ID NO: 375342 - DNA, 26 bp, Artificial Sequence
  Description of Artificial Sequence: Synthetic oligonucleotide
aaggcctccgcgcagacttaccgaga

SEQ ID NO: 375343 - DNA, 25 bp, Artificial Sequence
  Description of Artificial Sequence: Synthetic oligonucleotide
aggcctccgcgcagacttaccgaga

SEQ ID NO: 375344 - DNA, 24 bp, Artificial Sequence
  Description of Artificial Sequence: Synthetic oligonucleotide
ggcctccgcgcagacttaccgaga

SEQ ID NO: 375345 - DNA, 26 bp, Artificial Sequence
  Description of Artificial Sequence: Synthetic oligonucleotide
gcctccgcgcagacttaccgagagaa

SEQ ID NO: 375346 - DNA, 26 bp, Artificial Sequence
  Description of Artificial Sequence: Synthetic oligonucleotide
cctccgcgcagacttaccgagagaac

SEQ ID NO: 375347 - DNA, 27 bp, Artificial Sequence
  Description of Artificial Sequence: Synthetic oligonucleotide
ctccgcgcagacttaccgagagaacct

SEQ ID NO: 375348 - DNA, 27 bp, Artificial Sequence
  Description of Artificial Sequence: Synthetic oligonucleotide
tccgcgcagacttaccgagagaacctg

SEQ ID NO: 375349 - DNA, 26 bp, Artificial Sequence
  Description of Artificial Sequence: Synthetic oligonucleotide
ccgcgcagacttaccgagagaacctg

SEQ ID NO: 375350 - DNA, 26 bp, Artificial Sequence
  Description of Artificial Sequence: Synthetic oligonucleotide
cgcgcagacttaccgagagaacctgc

SEQ ID NO: 375351 - DNA, 26 bp, Artificial Sequence
  Description of Artificial Sequence: Synthetic oligonucleotide
gcgcagacttaccgagagaacctgcg

SEQ ID NO: 375352 - DNA, 27 bp, Artificial Sequence
  Description of Artificial Sequence: Synthetic oligonucleotide
cgcagacttaccgagagaacctgcgga

SEQ ID NO: 375353 - DNA, 28 bp, Artificial Sequence
  Description of Artificial Sequence: Synthetic oligonucleotide
gcagacttaccgagagaacctgcggatc

SEQ ID NO: 375354 - DNA, 25 bp, Artificial Sequence
  Description of Artificial Sequence: Synthetic oligonucleotide
aggccgggtctcacacttggcagag

SEQ ID NO: 375355 - DNA, 24 bp, Artificial Sequence
  Description of Artificial Sequence: Synthetic oligonucleotide
ggccgggtctcacacttggcagag

SEQ ID NO: 375356 - DNA, 26 bp, Artificial Sequence
  Description of Artificial Sequence: Synthetic oligonucleotide
gccgggtctcacacttggcagaggat

SEQ ID NO: 375357 - DNA, 27 bp, Artificial Sequence
  Description of Artificial Sequence: Synthetic oligonucleotide
ccgggtctcacacttggcagaggatgt

SEQ ID NO: 375358 - DNA, 29 bp, Artificial Sequence
  Description of Artificial Sequence: Synthetic oligonucleotide
cgggtctcacacttggcagaggatgtatg

SEQ ID NO: 375359 - DNA, 29 bp, Artificial Sequence
  Description of Artificial Sequence: Synthetic oligonucleotide
gggtctcacacttggcagaggatgtatgg

SEQ ID NO: 375360 - DNA, 29 bp, Artificial Sequence
  Description of Artificial Sequence: Synthetic oligonucleotide
ggtctcacacttggcagaggatgtatggc

SEQ ID NO: 375361 - DNA, 30 bp, Artificial Sequence; identical to SEQ ID NO: 28653
  Description of Artificial Sequence: Synthetic oligonucleotide

SEQ ID NO: 375362 - DNA, 30 bp, Artificial Sequence; identical to SEQ ID NO: 28654
  Description of Artificial Sequence: Synthetic oligonucleotide

SEQ ID NO: 375363 - DNA, 29 bp, Artificial Sequence
  Description of Artificial Sequence: Synthetic oligonucleotide
ctcacacttggcagaggatgtatggctgc

SEQ ID NO: 375364 - DNA, 29 bp, Artificial Sequence
  Description of Artificial Sequence: Synthetic oligonucleotide
tcacacttggcagaggatgtatggctgcg

SEQ ID NO: 375365 - DNA, 28 bp, Artificial Sequence
  Description of Artificial Sequence: Synthetic oligonucleotide
cacacttggcagaggatgtatggctgcg

SEQ ID NO: 375366 - DNA, 29 bp, Artificial Sequence
  Description of Artificial Sequence: Synthetic oligonucleotide
acacttggcagaggatgtatggctgcgac

SEQ ID NO: 375367 - DNA, 28 bp, Artificial Sequence
  Description of Artificial Sequence: Synthetic oligonucleotide
cacttggcagaggatgtatggctgcgac

SEQ ID NO: 375368 - DNA, 28 bp, Artificial Sequence
  Description of Artificial Sequence: Synthetic oligonucleotide
acttggcagaggatgtatggctgcgacc

SEQ ID NO: 375369 - DNA, 27 bp, Artificial Sequence
  Description of Artificial Sequence: Synthetic oligonucleotide
cttggcagaggatgtatggctgcgacc

SEQ ID NO: 375370 - DNA, 28 bp, Artificial Sequence
  Description of Artificial Sequence: Synthetic oligonucleotide
ttggcagaggatgtatggctgcgacctg

SEQ ID NO: 375371 - DNA, 27 bp, Artificial Sequence
  Description of Artificial Sequence: Synthetic oligonucleotide
tggcagaggatgtatggctgcgacctg

SEQ ID NO: 375372 - DNA, 26 bp, Artificial Sequence
  Description of Artificial Sequence: Synthetic oligonucleotide
ggcagaggatgtatggctgcgacctg

SEQ ID NO: 375373 - DNA, 26 bp, Artificial Sequence
  Description of Artificial Sequence: Synthetic oligonucleotide
gcagaggatgtatggctgcgacctgg

SEQ ID NO: 375374 - DNA, 30 bp, Artificial Sequence; identical to SEQ ID NO: 31427
  Description of Artificial Sequence: Synthetic oligonucleotide

SEQ ID NO: 375375 - DNA, 29 bp, Artificial Sequence
  Description of Artificial Sequence: Synthetic oligonucleotide
gtccgcctacgacggcaaggattacatag

SEQ ID NO: 375376 - DNA, 29 bp, Artificial Sequence
  Description of Artificial Sequence: Synthetic oligonucleotide
tccgcctacgacggcaaggattacatagc

SEQ ID NO: 375377 - DNA, 28 bp, Artificial Sequence
  Description of Artificial Sequence: Synthetic oligonucleotide
ccgcctacgacggcaaggattacatagc

SEQ ID NO: 375378 - DNA, 31 bp, Artificial Sequence; identical to SEQ ID NO: 31431
  Description of Artificial Sequence: Synthetic oligonucleotide

SEQ ID NO: 375379 - DNA, 31 bp, Artificial Sequence; identical to SEQ ID NO: 31432
  Description of Artificial Sequence: Synthetic oligonucleotide

SEQ ID NO: 375380 - DNA, 30 bp, Artificial Sequence; identical to SEQ ID NO: 31433
  Description of Artificial Sequence: Synthetic oligonucleotide

SEQ ID NO: 375381 - DNA, 29 bp, Artificial Sequence
  Description of Artificial Sequence: Synthetic oligonucleotide
cgacggcaaggattacatagccctgaacg

SEQ ID NO: 375382 - DNA, 30 bp, Artificial Sequence; identical to SEQ ID NO: 31435
  Description of Artificial Sequence: Synthetic oligonucleotide

SEQ ID NO: 375383 - DNA, 30 bp, Artificial Sequence; identical to SEQ ID NO: 31436
  Description of Artificial Sequence: Synthetic oligonucleotide

SEQ ID NO: 375384 - DNA, 29 bp, Artificial Sequence
  Description of Artificial Sequence: Synthetic oligonucleotide
cggcaaggattacatagccctgaacgagg

SEQ ID NO: 375385 - DNA, 30 bp, Artificial Sequence; identical to SEQ ID NO: 31438
  Description of Artificial Sequence: Synthetic oligonucleotide

SEQ ID NO: 375386 - DNA, 30 bp, Artificial Sequence; identical to SEQ ID NO: 31439
  Description of Artificial Sequence: Synthetic oligonucleotide

SEQ ID NO: 375387 - DNA, 31 bp, Artificial Sequence; identical to SEQ ID NO: 31440
  Description of Artificial Sequence: Synthetic oligonucleotide

SEQ ID NO: 375388 - DNA, 32 bp, Artificial Sequence; identical to SEQ ID NO: 31441
  Description of Artificial Sequence: Synthetic oligonucleotide

SEQ ID NO: 375389 - DNA, 31 bp, Artificial Sequence; identical to SEQ ID NO: 31442
  Description of Artificial Sequence: Synthetic oligonucleotide

SEQ ID NO: 375390 - DNA, 30 bp, Artificial Sequence; identical to SEQ ID NO: 31443
  Description of Artificial Sequence: Synthetic oligonucleotide

SEQ ID NO: 375391 - DNA, 30 bp, Artificial Sequence; identical to SEQ ID NO: 31444
  Description of Artificial Sequence: Synthetic oligonucleotide

SEQ ID NO: 375392 - DNA, 31 bp, Artificial Sequence; identical to SEQ ID NO: 31445
  Description of Artificial Sequence: Synthetic oligonucleotide

SEQ ID NO: 375393 - DNA, 30 bp, Artificial Sequence; identical to SEQ ID NO: 31446
  Description of Artificial Sequence: Synthetic oligonucleotide

SEQ ID NO: 375394 - DNA, 29 bp, Artificial Sequence
  Description of Artificial Sequence: Synthetic oligonucleotide
tacatagccctgaacgaggacctgagctc

SEQ ID NO: 375395 - DNA, 28 bp, Artificial Sequence
  Description of Artificial Sequence: Synthetic oligonucleotide
acatagccctgaacgaggacctgagctc

SEQ ID NO: 375396 - DNA, 27 bp, Artificial Sequence
  Description of Artificial Sequence: Synthetic oligonucleotide
catagccctgaacgaggacctgagctc

SEQ ID NO: 375397 - DNA, 27 bp, Artificial Sequence
  Description of Artificial Sequence: Synthetic oligonucleotide
atagccctgaacgaggacctgagctcc

SEQ ID NO: 375398 - DNA, 27 bp, Artificial Sequence
  Description of Artificial Sequence: Synthetic oligonucleotide
tagccctgaacgaggacctgagctcct

SEQ ID NO: 375399 - DNA, 26 bp, Artificial Sequence
  Description of Artificial Sequence: Synthetic oligonucleotide
agccctgaacgaggacctgagctcct

SEQ ID NO: 375400 - DNA, 21 bp, Artificial Sequence
  Description of Artificial Sequence: Synthetic oligonucleotide
cgcctcctccgcgggtaccac

SEQ ID NO: 375401 - DNA, 22 bp, Artificial Sequence
  Description of Artificial Sequence: Synthetic oligonucleotide
gcctcctccgcgggtaccacca

SEQ ID NO: 375402 - DNA, 22 bp, Artificial Sequence
  Description of Artificial Sequence: Synthetic oligonucleotide
cctcctccgcgggtaccaccag

SEQ ID NO: 375403 - DNA, 23 bp, Artificial Sequence
  Description of Artificial Sequence: Synthetic oligonucleotide
ctcctccgcgggtaccaccagga

SEQ ID NO: 375404 - DNA, 23 bp, Artificial Sequence
  Description of Artificial Sequence: Synthetic oligonucleotide
tcctccgcgggtaccaccaggac

SEQ ID NO: 375405 - DNA, 22 bp, Artificial Sequence
  Description of Artificial Sequence: Synthetic oligonucleotide
cctccgcgggtaccaccaggac

SEQ ID NO: 375406 - DNA, 22 bp, Artificial Sequence
  Description of Artificial Sequence: Synthetic oligonucleotide
ctccgcgggtaccaccaggacg

SEQ ID NO: 375407 - DNA, 22 bp, Artificial Sequence
  Description of Artificial Sequence: Synthetic oligonucleotide
tccgcgggtaccaccaggacgc

SEQ ID NO: 375408 - DNA, 21 bp, Artificial Sequence
  Description of Artificial Sequence: Synthetic oligonucleotide
ccgcgggtaccaccaggacgc

SEQ ID NO: 375409 - DNA, 23 bp, Artificial Sequence
  Description of Artificial Sequence: Synthetic oligonucleotide
cgcgggtaccaccaggacgccta

SEQ ID NO: 375410 - DNA, 23 bp, Artificial Sequence
  Description of Artificial Sequence: Synthetic oligonucleotide
gcgggtaccaccaggacgcctac

SEQ ID NO: 375411 - DNA, 24 bp, Artificial Sequence
  Description of Artificial Sequence: Synthetic oligonucleotide
cgggtaccaccaggacgcctacga

SEQ ID NO: 375412 - DNA, 24 bp, Artificial Sequence
  Description of Artificial Sequence: Synthetic oligonucleotide
gggtaccaccaggacgcctacgac

SEQ ID NO: 375413 - DNA, 24 bp, Artificial Sequence
  Description of Artificial Sequence: Synthetic oligonucleotide
ggtaccaccaggacgcctacgacg

SEQ ID NO: 375414 - DNA, 24 bp, Artificial Sequence
  Description of Artificial Sequence: Synthetic oligonucleotide
gtaccaccaggacgcctacgacgg

SEQ ID NO: 375415 - DNA, 26 bp, Artificial Sequence
  Description of Artificial Sequence: Synthetic oligonucleotide
taccaccaggacgcctacgacggcaa

SEQ ID NO: 375416 - DNA, 25 bp, Artificial Sequence
  Description of Artificial Sequence: Synthetic oligonucleotide
accaccaggacgcctacgacggcaa

SEQ ID NO: 375417 - DNA, 24 bp, Artificial Sequence
  Description of Artificial Sequence: Synthetic oligonucleotide
ccaccaggacgcctacgacggcaa

SEQ ID NO: 375418 - DNA, 24 bp, Artificial Sequence
  Description of Artificial Sequence: Synthetic oligonucleotide
caccaggacgcctacgacggcaag

SEQ ID NO: 375419 - DNA, 27 bp, Artificial Sequence
  Description of Artificial Sequence: Synthetic oligonucleotide
accaggacgcctacgacggcaaggatt

SEQ ID NO: 375420 - DNA, 27 bp, Artificial Sequence
  Description of Artificial Sequence: Synthetic oligonucleotide
ccaggacgcctacgacggcaaggatta

SEQ ID NO: 375421 - DNA, 24 bp, Artificial Sequence
  Description of Artificial Sequence: Synthetic oligonucleotide
gcggacacggcggctcagatcact

SEQ ID NO: 375422 - DNA, 25 bp, Artificial Sequence
  Description of Artificial Sequence: Synthetic oligonucleotide
cggacacggcggctcagatcactca

SEQ ID NO: 375423 - DNA, 25 bp, Artificial Sequence
  Description of Artificial Sequence: Synthetic oligonucleotide
ggacacggcggctcagatcactcag

SEQ ID NO: 375424 - DNA, 25 bp, Artificial Sequence
  Description of Artificial Sequence: Synthetic oligonucleotide
gacacggcggctcagatcactcagc

SEQ ID NO: 375425 - DNA, 25 bp, Artificial Sequence
  Description of Artificial Sequence: Synthetic oligonucleotide
acacggcggctcagatcactcagcg

SEQ ID NO: 375426 - DNA, 24 bp, Artificial Sequence
  Description of Artificial Sequence: Synthetic oligonucleotide
cacggcggctcagatcactcagcg

SEQ ID NO: 375427 - DNA, 26 bp, Artificial Sequence
  Description of Artificial Sequence: Synthetic oligonucleotide
acggcggctcagatcactcagcgcaa

SEQ ID NO: 375428 - DNA, 25 bp, Artificial Sequence
  Description of Artificial Sequence: Synthetic oligonucleotide
cggcggctcagatcactcagcgcaa

SEQ ID NO: 375429 - DNA, 26 bp, Artificial Sequence
  Description of Artificial Sequence: Synthetic oligonucleotide
ggcggctcagatcactcagcgcaagt

SEQ ID NO: 375430 - DNA, 24 bp, Artificial Sequence
  Description of Artificial Sequence: Synthetic oligonucleotide
ctcctccgcgggcatgaccagtca

SEQ ID NO: 375431 - DNA, 24 bp, Artificial Sequence
  Description of Artificial Sequence: Synthetic oligonucleotide
tcctccgcgggcatgaccagtcag

SEQ ID NO: 375432 - DNA, 23 bp, Artificial Sequence
  Description of Artificial Sequence: Synthetic oligonucleotide
cctccgcgggcatgaccagtcag

SEQ ID NO: 375433 - DNA, 23 bp, Artificial Sequence
  Description of Artificial Sequence: Synthetic oligonucleotide
ctccgcgggcatgaccagtcagc

SEQ ID NO: 375434 - DNA, 25 bp, Artificial Sequence
  Description of Artificial Sequence: Synthetic oligonucleotide
tccgcgggcatgaccagtcagccta

SEQ ID NO: 375435 - DNA, 24 bp, Artificial Sequence
  Description of Artificial Sequence: Synthetic oligonucleotide
ccgcgggcatgaccagtcagccta

SEQ ID NO: 375436 - DNA, 24 bp, Artificial Sequence
  Description of Artificial Sequence: Synthetic oligonucleotide
cgcgggcatgaccagtcagcctac

SEQ ID NO: 375437 - DNA, 25 bp, Artificial Sequence
  Description of Artificial Sequence: Synthetic oligonucleotide
gcgggcatgaccagtcagcctacga

SEQ ID NO: 375438 - DNA, 25 bp, Artificial Sequence
  Description of Artificial Sequence: Synthetic oligonucleotide
cgggcatgaccagtcagcctacgac

SEQ ID NO: 375439 - DNA, 25 bp, Artificial Sequence
  Description of Artificial Sequence: Synthetic oligonucleotide
gggcatgaccagtcagcctacgacg

SEQ ID NO: 375440 - DNA, 25 bp, Artificial Sequence
  Description of Artificial Sequence: Synthetic oligonucleotide
ggcatgaccagtcagcctacgacgg

SEQ ID NO: 375441 - DNA, 27 bp, Artificial Sequence
  Description of Artificial Sequence: Synthetic oligonucleotide
gcatgaccagtcagcctacgacggcaa

SEQ ID NO: 375442 - DNA, 27 bp, Artificial Sequence
  Description of Artificial Sequence: Synthetic oligonucleotide
catgaccagtcagcctacgacggcaag

SEQ ID NO: 375443 - DNA, 27 bp, Artificial Sequence
  Description of Artificial Sequence: Synthetic oligonucleotide
atgaccagtcagcctacgacggcaagg

SEQ ID NO: 375444 - DNA, 27 bp, Artificial Sequence
  Description of Artificial Sequence: Synthetic oligonucleotide
tgaccagtcagcctacgacggcaagga

SEQ ID NO: 375445 - DNA, 27 bp, Artificial Sequence
  Description of Artificial Sequence: Synthetic oligonucleotide
gaccagtcagcctacgacggcaaggat

SEQ ID NO: 375446 - DNA, 29 bp, Artificial Sequence
  Description of Artificial Sequence: Synthetic oligonucleotide
accagtcagcctacgacggcaaggattac

SEQ ID NO: 375447 - DNA, 28 bp, Artificial Sequence
  Description of Artificial Sequence: Synthetic oligonucleotide
ccagtcagcctacgacggcaaggattac

SEQ ID NO: 375448 - DNA, 30 bp, Artificial Sequence; identical to SEQ ID NO: 29093
  Description of Artificial Sequence: Synthetic oligonucleotide

SEQ ID NO: 375449 - DNA, 30 bp, Artificial Sequence; identical to SEQ ID NO: 29094
  Description of Artificial Sequence: Synthetic oligonucleotide

SEQ ID NO: 375450 - DNA, 29 bp, Artificial Sequence
  Description of Artificial Sequence: Synthetic oligonucleotide
gtcagcctacgacggcaaggattacatcg

SEQ ID NO: 375451 - DNA, 29 bp, Artificial Sequence
  Description of Artificial Sequence: Synthetic oligonucleotide
tcagcctacgacggcaaggattacatcgc

SEQ ID NO: 375452 - DNA, 28 bp, Artificial Sequence
  Description of Artificial Sequence: Synthetic oligonucleotide
cagcctacgacggcaaggattacatcgc

SEQ ID NO: 375453 - DNA, 21 bp, Artificial Sequence
  Description of Artificial Sequence: Synthetic oligonucleotide
tggaccgcggcggacacggca

SEQ ID NO: 375454 - DNA, 20 bp, Artificial Sequence
  Description of Artificial Sequence: Synthetic oligonucleotide
ggaccgcggcggacacggca

SEQ ID NO: 375455 - DNA, 20 bp, Artificial Sequence
  Description of Artificial Sequence: Synthetic oligonucleotide
gaccgcggcggacacggcag

SEQ ID NO: 375456 - DNA, 21 bp, Artificial Sequence
  Description of Artificial Sequence: Synthetic oligonucleotide
accgcggcggacacggcagct

SEQ ID NO: 375457 - DNA, 20 bp, Artificial Sequence
  Description of Artificial Sequence: Synthetic oligonucleotide
ccgcggcggacacggcagct

SEQ ID NO: 375458 - DNA, 21 bp, Artificial Sequence
  Description of Artificial Sequence: Synthetic oligonucleotide
cgcggcggacacggcagctca

SEQ ID NO: 375459 - DNA, 23 bp, Artificial Sequence
  Description of Artificial Sequence: Synthetic oligonucleotide
gcggcggacacggcagctcagat

SEQ ID NO: 375460 - DNA, 24 bp, Artificial Sequence
  Description of Artificial Sequence: Synthetic oligonucleotide
cggcggacacggcagctcagatca

SEQ ID NO: 375461 - DNA, 24 bp, Artificial Sequence
  Description of Artificial Sequence: Synthetic oligonucleotide
ggcggacacggcagctcagatcac

SEQ ID NO: 375462 - DNA, 24 bp, Artificial Sequence
  Description of Artificial Sequence: Synthetic oligonucleotide
gcggacacggcagctcagatcacc

SEQ ID NO: 375463 - DNA, 25 bp, Artificial Sequence
  Description of Artificial Sequence: Synthetic oligonucleotide
cggacacggcagctcagatcaccca

SEQ ID NO: 375464 - DNA, 25 bp, Artificial Sequence
  Description of Artificial Sequence: Synthetic oligonucleotide
ggacacggcagctcagatcacccag

SEQ ID NO: 375465 - DNA, 25 bp, Artificial Sequence
  Description of Artificial Sequence: Synthetic oligonucleotide
gacacggcagctcagatcacccagc

SEQ ID NO: 375466 - DNA, 25 bp, Artificial Sequence
  Description of Artificial Sequence: Synthetic oligonucleotide
acacggcagctcagatcacccagcg

SEQ ID NO: 375467 - DNA, 24 bp, Artificial Sequence
  Description of Artificial Sequence: Synthetic oligonucleotide
cacggcagctcagatcacccagcg

SEQ ID NO: 375468 - DNA, 26 bp, Artificial Sequence
  Description of Artificial Sequence: Synthetic oligonucleotide
acggcagctcagatcacccagcgcaa

SEQ ID NO: 375469 - DNA, 25 bp, Artificial Sequence
  Description of Artificial Sequence: Synthetic oligonucleotide
cggcagctcagatcacccagcgcaa

SEQ ID NO: 375470 - DNA, 26 bp, Artificial Sequence
  Description of Artificial Sequence: Synthetic oligonucleotide
caaagacacacgtgacccaccacccc

SEQ ID NO: 375471 - DNA, 27 bp, Artificial Sequence
  Description of Artificial Sequence: Synthetic oligonucleotide
aaagacacacgtgacccaccaccccgt

SEQ ID NO: 375472 - DNA, 26 bp, Artificial Sequence
  Description of Artificial Sequence: Synthetic oligonucleotide
aagacacacgtgacccaccaccccgt

SEQ ID NO: 375473 - DNA, 25 bp, Artificial Sequence
  Description of Artificial Sequence: Synthetic oligonucleotide
agacacacgtgacccaccaccccgt

SEQ ID NO: 375474 - DNA, 24 bp, Artificial Sequence
  Description of Artificial Sequence: Synthetic oligonucleotide
gacacacgtgacccaccaccccgt

SEQ ID NO: 375475 - DNA, 25 bp, Artificial Sequence
  Description of Artificial Sequence: Synthetic oligonucleotide
acacacgtgacccaccaccccgtct

SEQ ID NO: 375476 - DNA, 24 bp, Artificial Sequence
  Description of Artificial Sequence: Synthetic oligonucleotide
cacacgtgacccaccaccccgtct

SEQ ID NO: 375477 - DNA, 25 bp, Artificial Sequence
  Description of Artificial Sequence: Synthetic oligonucleotide
acacgtgacccaccaccccgtctct

SEQ ID NO: 375478 - DNA, 24 bp, Artificial Sequence
  Description of Artificial Sequence: Synthetic oligonucleotide
cacgtgacccaccaccccgtctct

SEQ ID NO: 375479 - DNA, 25 bp, Artificial Sequence
  Description of Artificial Sequence: Synthetic oligonucleotide
acgtgacccaccaccccgtctctga

SEQ ID NO: 375480 - DNA, 24 bp, Artificial Sequence
  Description of Artificial Sequence: Synthetic oligonucleotide
cgtgacccaccaccccgtctctga

SEQ ID NO: 375481 - DNA, 24 bp, Artificial Sequence
  Description of Artificial Sequence: Synthetic oligonucleotide
gtgacccaccaccccgtctctgac

SEQ ID NO: 375482 - DNA, 26 bp, Artificial Sequence
  Description of Artificial Sequence: Synthetic oligonucleotide
tgacccaccaccccgtctctgaccat

SEQ ID NO: 375483 - DNA, 25 bp, Artificial Sequence
  Description of Artificial Sequence: Synthetic oligonucleotide
gacccaccaccccgtctctgaccat

SEQ ID NO: 375484 - DNA, 26 bp, Artificial Sequence
  Description of Artificial Sequence: Synthetic oligonucleotide
acccaccaccccgtctctgaccatga

SEQ ID NO: 375485 - DNA, 25 bp, Artificial Sequence
  Description of Artificial Sequence: Synthetic oligonucleotide
cccaccaccccgtctctgaccatga

SEQ ID NO: 375486 - DNA, 25 bp, Artificial Sequence
  Description of Artificial Sequence: Synthetic oligonucleotide
ccaccaccccgtctctgaccatgag

SEQ ID NO: 375487 - DNA, 25 bp, Artificial Sequence
  Description of Artificial Sequence: Synthetic oligonucleotide
caccaccccgtctctgaccatgagg

SEQ ID NO: 375488 - DNA, 25 bp, Artificial Sequence
  Description of Artificial Sequence: Synthetic oligonucleotide
accaccccgtctctgaccatgaggc

SEQ ID NO: 375489 - DNA, 24 bp, Artificial Sequence
  Description of Artificial Sequence: Synthetic oligonucleotide
ccaccccgtctctgaccatgaggc

SEQ ID NO: 375490 - DNA, 25 bp, Artificial Sequence
  Description of Artificial Sequence: Synthetic oligonucleotide
caccccgtctctgaccatgaggcca

SEQ ID NO: 375491 - DNA, 25 bp, Artificial Sequence
  Description of Artificial Sequence: Synthetic oligonucleotide
accccgtctctgaccatgaggccac

SEQ ID NO: 375492 - DNA, 24 bp, Artificial Sequence
  Description of Artificial Sequence: Synthetic oligonucleotide
ccccgtctctgaccatgaggccac

SEQ ID NO: 375493 - DNA, 24 bp, Artificial Sequence
  Description of Artificial Sequence: Synthetic oligonucleotide
cccgtctctgaccatgaggccacc

SEQ ID NO: 375494 - DNA, 25 bp, Artificial Sequence
  Description of Artificial Sequence: Synthetic oligonucleotide
ccgtctctgaccatgaggccaccct

SEQ ID NO: 375495 - DNA, 26 bp, Artificial Sequence
  Description of Artificial Sequence: Synthetic oligonucleotide
cgtctctgaccatgaggccaccctga

SEQ ID NO: 375496 - DNA, 33 bp, Artificial Sequence; identical to SEQ ID NO: 29389
  Description of Artificial Sequence: Synthetic oligonucleotide

SEQ ID NO: 375497 - DNA, 32 bp, Artificial Sequence; identical to SEQ ID NO: 29390
  Description of Artificial Sequence: Synthetic oligonucleotide

SEQ ID NO: 375498 - DNA, 28 bp, Artificial Sequence
  Description of Artificial Sequence: Synthetic oligonucleotide
gcagctgtggtggtaccttctggagaag

SEQ ID NO: 375499 - DNA, 29 bp, Artificial Sequence
  Description of Artificial Sequence: Synthetic oligonucleotide
cagctgtggtggtaccttctggagaagag

SEQ ID NO: 375500 - DNA, 29 bp, Artificial Sequence
  Description of Artificial Sequence: Synthetic oligonucleotide
agctgtggtggtaccttctggagaagagc

SEQ ID NO: 375501 - DNA, 28 bp, Artificial Sequence
  Description of Artificial Sequence: Synthetic oligonucleotide
gctgtggtggtaccttctggagaagagc

SEQ ID NO: 375502 - DNA, 29 bp, Artificial Sequence
  Description of Artificial Sequence: Synthetic oligonucleotide
ctgtggtggtaccttctggagaagagcag

SEQ ID NO: 375503 - DNA, 30 bp, Artificial Sequence
  Description of Artificial Sequence: Synthetic oligonucleotide
tgtggtggtaccttctggagaagagcagag

SEQ ID NO: 375504 - DNA, 29 bp, Artificial Sequence
  Description of Artificial Sequence: Synthetic oligonucleotide
gtggtggtaccttctggagaagagcagag

SEQ ID NO: 375505 - DNA, 32 bp, Artificial Sequence
  Description of Artificial Sequence: Synthetic oligonucleotide
tggtggtaccttctggagaagagcagagatac

SEQ ID NO: 375506 - DNA, 31 bp, Artificial Sequence
  Description of Artificial Sequence: Synthetic oligonucleotide
ggtggtaccttctggagaagagcagagatac

SEQ ID NO: 375507 - DNA, 32 bp, Artificial Sequence
  Description of Artificial Sequence: Synthetic oligonucleotide
gtggtaccttctggagaagagcagagatacac

SEQ ID NO: 375508 - DNA, 34 bp, Artificial Sequence
  Description of Artificial Sequence: Synthetic oligonucleotide
tggtaccttctggagaagagcagagatacacatg

SEQ ID NO: 375509 - DNA, 33 bp, Artificial Sequence
  Description of Artificial Sequence: Synthetic oligonucleotide
ggtaccttctggagaagagcagagatacacatg

SEQ ID NO: 375510 - DNA, 33 bp, Artificial Sequence
  Description of Artificial Sequence: Synthetic oligonucleotide
gtaccttctggagaagagcagagatacacatgc

SEQ ID NO: 375511 - DNA, 33 bp, Artificial Sequence
  Description of Artificial Sequence: Synthetic oligonucleotide
taccttctggagaagagcagagatacacatgcc

SEQ ID NO: 375512 - DNA, 32 bp, Artificial Sequence
  Description of Artificial Sequence: Synthetic oligonucleotide
accttctggagaagagcagagatacacatgcc

SEQ ID NO: 375513 - DNA, 27 bp, Artificial Sequence
  Description of Artificial Sequence: Synthetic oligonucleotide
gggtctcacaccctccagaggatgttc

SEQ ID NO: 375514 - DNA, 27 bp, Artificial Sequence
  Description of Artificial Sequence: Synthetic oligonucleotide
ggtctcacaccctccagaggatgttcg

SEQ ID NO: 375515 - DNA, 27 bp, Artificial Sequence
  Description of Artificial Sequence: Synthetic oligonucleotide
gtctcacaccctccagaggatgttcgg

SEQ ID NO: 375516 - DNA, 27 bp, Artificial Sequence
  Description of Artificial Sequence: Synthetic oligonucleotide
tctcacaccctccagaggatgttcggc

SEQ ID NO: 375517 - DNA, 27 bp, Artificial Sequence
  Description of Artificial Sequence: Synthetic oligonucleotide
ctcacaccctccagaggatgttcggct

SEQ ID NO: 375518 - DNA, 27 bp, Artificial Sequence
  Description of Artificial Sequence: Synthetic oligonucleotide
tcacaccctccagaggatgttcggctg

SEQ ID NO: 375519 - DNA, 26 bp, Artificial Sequence
  Description of Artificial Sequence: Synthetic oligonucleotide
cacaccctccagaggatgttcggctg

SEQ ID NO: 375520 - DNA, 26 bp, Artificial Sequence
  Description of Artificial Sequence: Synthetic oligonucleotide
acaccctccagaggatgttcggctgc

SEQ ID NO: 375521 - DNA, 25 bp, Artificial Sequence
  Description of Artificial Sequence: Synthetic oligonucleotide
caccctccagaggatgttcggctgc

SEQ ID NO: 375522 - DNA, 26 bp, Artificial Sequence
  Description of Artificial Sequence: Synthetic oligonucleotide
accctccagaggatgttcggctgcga

SEQ ID NO: 375523 - DNA, 25 bp, Artificial Sequence
  Description of Artificial Sequence: Synthetic oligonucleotide
ccctccagaggatgttcggctgcga

SEQ ID NO: 375524 - DNA, 25 bp, Artificial Sequence
  Description of Artificial Sequence: Synthetic oligonucleotide
cctccagaggatgttcggctgcgac

SEQ ID NO: 375525 - DNA, 26 bp, Artificial Sequence
  Description of Artificial Sequence: Synthetic oligonucleotide
ctccagaggatgttcggctgcgacgt

SEQ ID NO: 375526 - DNA, 26 bp, Artificial Sequence
  Description of Artificial Sequence: Synthetic oligonucleotide
tccagaggatgttcggctgcgacgtg

SEQ ID NO: 375527 - DNA, 25 bp, Artificial Sequence
  Description of Artificial Sequence: Synthetic oligonucleotide
ccagaggatgttcggctgcgacgtg

SEQ ID NO: 375528 - DNA, 25 bp, Artificial Sequence
  Description of Artificial Sequence: Synthetic oligonucleotide
cagaggatgttcggctgcgacgtgg

SEQ ID NO: 375529 - DNA, 25 bp, Artificial Sequence
  Description of Artificial Sequence: Synthetic oligonucleotide
agaggatgttcggctgcgacgtggg

SEQ ID NO: 375530 - DNA, 24 bp, Artificial Sequence
  Description of Artificial Sequence: Synthetic oligonucleotide
gaggatgttcggctgcgacgtggg

SEQ ID NO: 375531 - DNA, 24 bp, Artificial Sequence
  Description of Artificial Sequence: Synthetic oligonucleotide
aggatgttcggctgcgacgtgggg

SEQ ID NO: 375532 - DNA, 23 bp, Artificial Sequence
  Description of Artificial Sequence: Synthetic oligonucleotide
ggatgttcggctgcgacgtgggg

SEQ ID NO: 375533 - DNA, 23 bp, Artificial Sequence
  Description of Artificial Sequence: Synthetic oligonucleotide
gatgttcggctgcgacgtggggc

SEQ ID NO: 375534 - DNA, 23 bp, Artificial Sequence
  Description of Artificial Sequence: Synthetic oligonucleotide
atgttcggctgcgacgtggggcc

SEQ ID NO: 375535 - DNA, 22 bp, Artificial Sequence
  Description of Artificial Sequence: Synthetic oligonucleotide
tgttcggctgcgacgtggggcc

SEQ ID NO: 375536 - DNA, 21 bp, Artificial Sequence
  Description of Artificial Sequence: Synthetic oligonucleotide
gttcggctgcgacgtggggcc

SEQ ID NO: 375537 - DNA, 21 bp, Artificial Sequence
  Description of Artificial Sequence: Synthetic oligonucleotide
ttcggctgcgacgtggggccg

SEQ ID NO: 375538 - DNA, 20 bp, Artificial Sequence
  Description of Artificial Sequence: Synthetic oligonucleotide
tcggctgcgacgtggggccg

SEQ ID NO: 375539 - DNA, 26 bp, Artificial Sequence
  Description of Artificial Sequence: Synthetic oligonucleotide
cgggtctcacaccctccagaggatgt

SEQ ID NO: 375540 - DNA, 27 bp, Artificial Sequence
  Description of Artificial Sequence: Synthetic oligonucleotide
gggtctcacaccctccagaggatgtct

SEQ ID NO: 375541 - DNA, 27 bp, Artificial Sequence
  Description of Artificial Sequence: Synthetic oligonucleotide
ggtctcacaccctccagaggatgtctg

SEQ ID NO: 375542 - DNA, 27 bp, Artificial Sequence
  Description of Artificial Sequence: Synthetic oligonucleotide
gtctcacaccctccagaggatgtctgg

SEQ ID NO: 375543 - DNA, 27 bp, Artificial Sequence
  Description of Artificial Sequence: Synthetic oligonucleotide
tctcacaccctccagaggatgtctggc

SEQ ID NO: 375544 - DNA, 27 bp, Artificial Sequence
  Description of Artificial Sequence: Synthetic oligonucleotide
ctcacaccctccagaggatgtctggct

SEQ ID NO: 375545 - DNA, 27 bp, Artificial Sequence
  Description of Artificial Sequence: Synthetic oligonucleotide
tcacaccctccagaggatgtctggctg

SEQ ID NO: 375546 - DNA, 26 bp, Artificial Sequence
  Description of Artificial Sequence: Synthetic oligonucleotide
cacaccctccagaggatgtctggctg

SEQ ID NO: 375547 - DNA, 26 bp, Artificial Sequence
  Description of Artificial Sequence: Synthetic oligonucleotide
acaccctccagaggatgtctggctgc

SEQ ID NO: 375548 - DNA, 25 bp, Artificial Sequence
  Description of Artificial Sequence: Synthetic oligonucleotide
caccctccagaggatgtctggctgc

SEQ ID NO: 375549 - DNA, 26 bp, Artificial Sequence
  Description of Artificial Sequence: Synthetic oligonucleotide
accctccagaggatgtctggctgcga

SEQ ID NO: 375550 - DNA, 25 bp, Artificial Sequence
  Description of Artificial Sequence: Synthetic oligonucleotide
ccctccagaggatgtctggctgcga

SEQ ID NO: 375551 - DNA, 25 bp, Artificial Sequence
  Description of Artificial Sequence: Synthetic oligonucleotide
cctccagaggatgtctggctgcgac

SEQ ID NO: 375552 - DNA, 26 bp, Artificial Sequence
  Description of Artificial Sequence: Synthetic oligonucleotide
ctccagaggatgtctggctgcgacgt

SEQ ID NO: 375553 - DNA, 26 bp, Artificial Sequence
  Description of Artificial Sequence: Synthetic oligonucleotide
tccagaggatgtctggctgcgacgtg

SEQ ID NO: 375554 - DNA, 25 bp, Artificial Sequence
  Description of Artificial Sequence: Synthetic oligonucleotide
ccagaggatgtctggctgcgacgtg

SEQ ID NO: 375555 - DNA, 25 bp, Artificial Sequence
  Description of Artificial Sequence: Synthetic oligonucleotide
cagaggatgtctggctgcgacgtgg

SEQ ID NO: 375556 - DNA, 25 bp, Artificial Sequence
  Description of Artificial Sequence: Synthetic oligonucleotide
agaggatgtctggctgcgacgtggg

SEQ ID NO: 375557 - DNA, 24 bp, Artificial Sequence
  Description of Artificial Sequence: Synthetic oligonucleotide
gaggatgtctggctgcgacgtggg

SEQ ID NO: 375558 - DNA, 24 bp, Artificial Sequence
  Description of Artificial Sequence: Synthetic oligonucleotide
aggatgtctggctgcgacgtgggg

SEQ ID NO: 375559 - DNA, 23 bp, Artificial Sequence
  Description of Artificial Sequence: Synthetic oligonucleotide
ggatgtctggctgcgacgtgggg

SEQ ID NO: 375560 - DNA, 23 bp, Artificial Sequence
  Description of Artificial Sequence: Synthetic oligonucleotide
gatgtctggctgcgacgtggggc

SEQ ID NO: 375561 - DNA, 23 bp, Artificial Sequence
  Description of Artificial Sequence: Synthetic oligonucleotide
atgtctggctgcgacgtggggcc

SEQ ID NO: 375562 - DNA, 22 bp, Artificial Sequence
  Description of Artificial Sequence: Synthetic oligonucleotide
tgtctggctgcgacgtggggcc

SEQ ID NO: 375563 - DNA, 21 bp, Artificial Sequence
  Description of Artificial Sequence: Synthetic oligonucleotide
gtctggctgcgacgtggggcc

SEQ ID NO: 375564 - DNA, 21 bp, Artificial Sequence
  Description of Artificial Sequence: Synthetic oligonucleotide
tctggctgcgacgtggggccg

SEQ ID NO: 375565 - DNA, 20 bp, Artificial Sequence
  Description of Artificial Sequence: Synthetic oligonucleotide
ctggctgcgacgtggggccg

SEQ ID NO: 375566 - DNA, 23 bp, Artificial Sequence
  Description of Artificial Sequence: Synthetic oligonucleotide
gccgggtctcacaccctccagac

SEQ ID NO: 375567 - DNA, 25 bp, Artificial Sequence
  Description of Artificial Sequence: Synthetic oligonucleotide
ccgggtctcacaccctccagacgat

SEQ ID NO: 375568 - DNA, 27 bp, Artificial Sequence
  Description of Artificial Sequence: Synthetic oligonucleotide
cgggtctcacaccctccagacgatgta

SEQ ID NO: 375569 - DNA, 27 bp, Artificial Sequence
  Description of Artificial Sequence: Synthetic oligonucleotide
gggtctcacaccctccagacgatgtac

SEQ ID NO: 375570 - DNA, 27 bp, Artificial Sequence
  Description of Artificial Sequence: Synthetic oligonucleotide
ggtctcacaccctccagacgatgtacg

SEQ ID NO: 375571 - DNA, 27 bp, Artificial Sequence
  Description of Artificial Sequence: Synthetic oligonucleotide
gtctcacaccctccagacgatgtacgg

SEQ ID NO: 375572 - DNA, 27 bp, Artificial Sequence
  Description of Artificial Sequence: Synthetic oligonucleotide
tctcacaccctccagacgatgtacggc

SEQ ID NO: 375573 - DNA, 27 bp, Artificial Sequence
  Description of Artificial Sequence: Synthetic oligonucleotide
ctcacaccctccagacgatgtacggct

SEQ ID NO: 375574 - DNA, 27 bp, Artificial Sequence
  Description of Artificial Sequence: Synthetic oligonucleotide
tcacaccctccagacgatgtacggctg

SEQ ID NO: 375575 - DNA, 26 bp, Artificial Sequence
  Description of Artificial Sequence: Synthetic oligonucleotide
cacaccctccagacgatgtacggctg

SEQ ID NO: 375576 - DNA, 26 bp, Artificial Sequence
  Description of Artificial Sequence: Synthetic oligonucleotide
acaccctccagacgatgtacggctgc

SEQ ID NO: 375577 - DNA, 25 bp, Artificial Sequence
  Description of Artificial Sequence: Synthetic oligonucleotide
caccctccagacgatgtacggctgc

SEQ ID NO: 375578 - DNA, 26 bp, Artificial Sequence
  Description of Artificial Sequence: Synthetic oligonucleotide
accctccagacgatgtacggctgcga

SEQ ID NO: 375579 - DNA, 25 bp, Artificial Sequence
  Description of Artificial Sequence: Synthetic oligonucleotide
ccctccagacgatgtacggctgcga

SEQ ID NO: 375580 - DNA, 25 bp, Artificial Sequence
  Description of Artificial Sequence: Synthetic oligonucleotide
cctccagacgatgtacggctgcgac

SEQ ID NO: 375581 - DNA, 26 bp, Artificial Sequence
  Description of Artificial Sequence: Synthetic oligonucleotide
ctccagacgatgtacggctgcgacgt

SEQ ID NO: 375582 - DNA, 26 bp, Artificial Sequence
  Description of Artificial Sequence: Synthetic oligonucleotide
tccagacgatgtacggctgcgacgtg

SEQ ID NO: 375583 - DNA, 25 bp, Artificial Sequence
  Description of Artificial Sequence: Synthetic oligonucleotide
ccagacgatgtacggctgcgacgtg

SEQ ID NO: 375584 - DNA, 25 bp, Artificial Sequence
  Description of Artificial Sequence: Synthetic oligonucleotide
cagacgatgtacggctgcgacgtgg

SEQ ID NO: 375585 - DNA, 25 bp, Artificial Sequence
  Description of Artificial Sequence: Synthetic oligonucleotide
agacgatgtacggctgcgacgtggg

SEQ ID NO: 375586 - DNA, 24 bp, Artificial Sequence
  Description of Artificial Sequence: Synthetic oligonucleotide
gacgatgtacggctgcgacgtggg

SEQ ID NO: 375587 - DNA, 24 bp, Artificial Sequence
  Description of Artificial Sequence: Synthetic oligonucleotide
acgatgtacggctgcgacgtgggg

SEQ ID NO: 375588 - DNA, 23 bp, Artificial Sequence
  Description of Artificial Sequence: Synthetic oligonucleotide
cgatgtacggctgcgacgtgggg

SEQ ID NO: 375589 - DNA, 24 bp, Artificial Sequence
  Description of Artificial Sequence: Synthetic oligonucleotide
ctgtgcgtggagtggctccgcaga

SEQ ID NO: 375590 - DNA, 25 bp, Artificial Sequence
  Description of Artificial Sequence: Synthetic oligonucleotide
tgtgcgtggagtggctccgcagaca

SEQ ID NO: 375591 - DNA, 25 bp, Artificial Sequence
  Description of Artificial Sequence: Synthetic oligonucleotide
acagcgacgccacgagtccgaggaa

SEQ ID NO: 375592 - DNA, 24 bp, Artificial Sequence
  Description of Artificial Sequence: Synthetic oligonucleotide
cagcgacgccacgagtccgaggaa

SEQ ID NO: 375593 - DNA, 24 bp, Artificial Sequence
  Description of Artificial Sequence: Synthetic oligonucleotide
agcgacgccacgagtccgaggaag

SEQ ID NO: 375594 - DNA, 23 bp, Artificial Sequence
  Description of Artificial Sequence: Synthetic oligonucleotide
gcgacgccacgagtccgaggaag

SEQ ID NO: 375595 - DNA, 24 bp, Artificial Sequence
  Description of Artificial Sequence: Synthetic oligonucleotide
cgacgccacgagtccgaggaagga

SEQ ID NO: 375596 - DNA, 24 bp, Artificial Sequence
  Description of Artificial Sequence: Synthetic oligonucleotide
gacgccacgagtccgaggaaggag

SEQ ID NO: 375597 - DNA, 24 bp, Artificial Sequence
  Description of Artificial Sequence: Synthetic oligonucleotide
acgccacgagtccgaggaaggagc

SEQ ID NO: 375598 - DNA, 23 bp, Artificial Sequence
  Description of Artificial Sequence: Synthetic oligonucleotide
cgccacgagtccgaggaaggagc

SEQ ID NO: 375599 - DNA, 23 bp, Artificial Sequence
  Description of Artificial Sequence: Synthetic oligonucleotide
gccacgagtccgaggaaggagcc

SEQ ID NO: 375600 - DNA, 23 bp, Artificial Sequence
  Description of Artificial Sequence: Synthetic oligonucleotide
ccacgagtccgaggaaggagccg

SEQ ID NO: 375601 - DNA, 23 bp, Artificial Sequence
  Description of Artificial Sequence: Synthetic oligonucleotide
cacgagtccgaggaaggagccgc

SEQ ID NO: 375602 - DNA, 23 bp, Artificial Sequence
  Description of Artificial Sequence: Synthetic oligonucleotide
acgagtccgaggaaggagccgcg

SEQ ID NO: 375603 - DNA, 22 bp, Artificial Sequence
  Description of Artificial Sequence: Synthetic oligonucleotide
cgagtccgaggaaggagccgcg

SEQ ID NO: 375604 - DNA, 22 bp, Artificial Sequence
  Description of Artificial Sequence: Synthetic oligonucleotide
gagtccgaggaaggagccgcgg

SEQ ID NO: 375605 - DNA, 22 bp, Artificial Sequence
  Description of Artificial Sequence: Synthetic oligonucleotide
agtccgaggaaggagccgcggg

SEQ ID NO: 375606 - DNA, 21 bp, Artificial Sequence
  Description of Artificial Sequence: Synthetic oligonucleotide
gtccgaggaaggagccgcggg

SEQ ID NO: 375607 - DNA, 21 bp, Artificial Sequence
  Description of Artificial Sequence: Synthetic oligonucleotide
tccgaggaaggagccgcgggc

SEQ ID NO: 375608 - DNA, 20 bp, Artificial Sequence
  Description of Artificial Sequence: Synthetic oligonucleotide
ccgaggaaggagccgcgggc

SEQ ID NO: 375609 - DNA, 20 bp, Artificial Sequence
  Description of Artificial Sequence: Synthetic oligonucleotide
cgaggaaggagccgcgggcg

SEQ ID NO: 375610 - DNA, 20 bp, Artificial Sequence
  Description of Artificial Sequence: Synthetic oligonucleotide
gaggaaggagccgcgggcgc

SEQ ID NO: 375611 - DNA, 22 bp, Artificial Sequence
  Description of Artificial Sequence: Synthetic oligonucleotide
aggaaggagccgcgggcgccat

SEQ ID NO: 375612 - DNA, 21 bp, Artificial Sequence
  Description of Artificial Sequence: Synthetic oligonucleotide
ggaaggagccgcgggcgccat

SEQ ID NO: 375613 - DNA, 21 bp, Artificial Sequence
  Description of Artificial Sequence: Synthetic oligonucleotide
gaaggagccgcgggcgccatg

SEQ ID NO: 375614 - DNA, 24 bp, Artificial Sequence
  Description of Artificial Sequence: Synthetic oligonucleotide
aaggagccgcgggcgccatggata

SEQ ID NO: 375615 - DNA, 23 bp, Artificial Sequence
  Description of Artificial Sequence: Synthetic oligonucleotide
aggagccgcgggcgccatggata

SEQ ID NO: 375616 - DNA, 24 bp, Artificial Sequence
  Description of Artificial Sequence: Synthetic oligonucleotide
cccgtgtggcggagcagctgagaa

SEQ ID NO: 375617 - DNA, 24 bp, Artificial Sequence
  Description of Artificial Sequence: Synthetic oligonucleotide
ccgtgtggcggagcagctgagaac

SEQ ID NO: 375618 - DNA, 26 bp, Artificial Sequence
  Description of Artificial Sequence: Synthetic oligonucleotide
cgtgtggcggagcagctgagaaccta

SEQ ID NO: 375619 - DNA, 26 bp, Artificial Sequence
  Description of Artificial Sequence: Synthetic oligonucleotide
gtgtggcggagcagctgagaacctac

SEQ ID NO: 375620 - DNA, 27 bp, Artificial Sequence
  Description of Artificial Sequence: Synthetic oligonucleotide
tgtggcggagcagctgagaacctacct

SEQ ID NO: 375621 - DNA, 26 bp, Artificial Sequence
  Description of Artificial Sequence: Synthetic oligonucleotide
gtggcggagcagctgagaacctacct

SEQ ID NO: 375622 - DNA, 26 bp, Artificial Sequence
  Description of Artificial Sequence: Synthetic oligonucleotide
tggcggagcagctgagaacctacctg

SEQ ID NO: 375623 - DNA, 25 bp, Artificial Sequence
  Description of Artificial Sequence: Synthetic oligonucleotide
ggcggagcagctgagaacctacctg

SEQ ID NO: 375624 - DNA, 26 bp, Artificial Sequence
  Description of Artificial Sequence: Synthetic oligonucleotide
gcggagcagctgagaacctacctgga

SEQ ID NO: 375625 - DNA, 26 bp, Artificial Sequence
  Description of Artificial Sequence: Synthetic oligonucleotide
cggagcagctgagaacctacctggag

SEQ ID NO: 375626 - DNA, 26 bp, Artificial Sequence
  Description of Artificial Sequence: Synthetic oligonucleotide
ggagcagctgagaacctacctggagg

SEQ ID NO: 375627 - DNA, 26 bp, Artificial Sequence
  Description of Artificial Sequence: Synthetic oligonucleotide
gagcagctgagaacctacctggaggg

SEQ ID NO: 375628 - DNA, 26 bp, Artificial Sequence
  Description of Artificial Sequence: Synthetic oligonucleotide
agcagctgagaacctacctggagggc

SEQ ID NO: 375629 - DNA, 25 bp, Artificial Sequence
  Description of Artificial Sequence: Synthetic oligonucleotide
gcagctgagaacctacctggagggc

SEQ ID NO: 375630 - DNA, 26 bp, Artificial Sequence
  Description of Artificial Sequence: Synthetic oligonucleotide
cagctgagaacctacctggagggcct

SEQ ID NO: 375631 - DNA, 27 bp, Artificial Sequence
  Description of Artificial Sequence: Synthetic oligonucleotide
agctgagaacctacctggagggcctgt

SEQ ID NO: 375632 - DNA, 26 bp, Artificial Sequence
  Description of Artificial Sequence: Synthetic oligonucleotide
gctgagaacctacctggagggcctgt

SEQ ID NO: 375633 - DNA, 26 bp, Artificial Sequence
  Description of Artificial Sequence: Synthetic oligonucleotide
ctgagaacctacctggagggcctgtg

SEQ ID NO: 375634 - DNA, 26 bp, Artificial Sequence
  Description of Artificial Sequence: Synthetic oligonucleotide
tgagaacctacctggagggcctgtgc

SEQ ID NO: 375635 - DNA, 25 bp, Artificial Sequence
  Description of Artificial Sequence: Synthetic oligonucleotide
gagaacctacctggagggcctgtgc

SEQ ID NO: 375636 - DNA, 26 bp, Artificial Sequence
  Description of Artificial Sequence: Synthetic oligonucleotide
agaacctacctggagggcctgtgcgt

SEQ ID NO: 375637 - DNA, 25 bp, Artificial Sequence
  Description of Artificial Sequence: Synthetic oligonucleotide
gaacctacctggagggcctgtgcgt

SEQ ID NO: 375638 - DNA, 25 bp, Artificial Sequence
  Description of Artificial Sequence: Synthetic oligonucleotide
aacctacctggagggcctgtgcgtg

SEQ ID NO: 375639 - DNA, 24 bp, Artificial Sequence
  Description of Artificial Sequence: Synthetic oligonucleotide
acctacctggagggcctgtgcgtg

SEQ ID NO: 375640 - DNA, 24 bp, Artificial Sequence
  Description of Artificial Sequence: Synthetic oligonucleotide
accgtgggctacgtggacgacacg

SEQ ID NO: 375641 - DNA, 24 bp, Artificial Sequence
  Description of Artificial Sequence: Synthetic oligonucleotide
cgtgggctacgtggacgacacgct

SEQ ID NO: 375642 - DNA, 26 bp, Artificial Sequence
  Description of Artificial Sequence: Synthetic oligonucleotide
gtgggctacgtggacgacacgctgtt

SEQ ID NO: 375643 - DNA, 26 bp, Artificial Sequence
  Description of Artificial Sequence: Synthetic oligonucleotide
tgggctacgtggacgacacgctgttc

SEQ ID NO: 375644 - DNA, 25 bp, Artificial Sequence
  Description of Artificial Sequence: Synthetic oligonucleotide
gggctacgtggacgacacgctgttc

SEQ ID NO: 375645 - DNA, 26 bp, Artificial Sequence
  Description of Artificial Sequence: Synthetic oligonucleotide
ggctacgtggacgacacgctgttcgt

SEQ ID NO: 375646 - DNA, 27 bp, Artificial Sequence
  Description of Artificial Sequence: Synthetic oligonucleotide
gctacgtggacgacacgctgttcgtga

SEQ ID NO: 375647 - DNA, 27 bp, Artificial Sequence
  Description of Artificial Sequence: Synthetic oligonucleotide
ctacgtggacgacacgctgttcgtgag

SEQ ID NO: 375648 - DNA, 27 bp, Artificial Sequence
  Description of Artificial Sequence: Synthetic oligonucleotide
tacgtggacgacacgctgttcgtgagg

SEQ ID NO: 375649 - DNA, 27 bp, Artificial Sequence
  Description of Artificial Sequence: Synthetic oligonucleotide
acgtggacgacacgctgttcgtgaggt

SEQ ID NO: 375650 - DNA, 27 bp, Artificial Sequence
  Description of Artificial Sequence: Synthetic oligonucleotide
cgtggacgacacgctgttcgtgaggtt

SEQ ID NO: 375651 - DNA, 27 bp, Artificial Sequence
  Description of Artificial Sequence: Synthetic oligonucleotide
gtggacgacacgctgttcgtgaggttc

SEQ ID NO: 375652 - DNA, 27 bp, Artificial Sequence
  Description of Artificial Sequence: Synthetic oligonucleotide
tggacgacacgctgttcgtgaggttcg

SEQ ID NO: 375653 - DNA, 27 bp, Artificial Sequence
  Description of Artificial Sequence: Synthetic oligonucleotide
ggacgacacgctgttcgtgaggttcga

SEQ ID NO: 375654 - DNA, 27 bp, Artificial Sequence
  Description of Artificial Sequence: Synthetic oligonucleotide
gacgacacgctgttcgtgaggttcgac

SEQ ID NO: 375655 - DNA, 28 bp, Artificial Sequence
  Description of Artificial Sequence: Synthetic oligonucleotide
acgacacgctgttcgtgaggttcgacag

SEQ ID NO: 375656 - DNA, 27 bp, Artificial Sequence
  Description of Artificial Sequence: Synthetic oligonucleotide
cgacacgctgttcgtgaggttcgacag

SEQ ID NO: 375657 - DNA, 27 bp, Artificial Sequence
  Description of Artificial Sequence: Synthetic oligonucleotide
gacacgctgttcgtgaggttcgacagc

SEQ ID NO: 375658 - DNA, 27 bp, Artificial Sequence
  Description of Artificial Sequence: Synthetic oligonucleotide
acacgctgttcgtgaggttcgacagcg

SEQ ID NO: 375659 - DNA, 27 bp, Artificial Sequence
  Description of Artificial Sequence: Synthetic oligonucleotide
cacgctgttcgtgaggttcgacagcga

SEQ ID NO: 375660 - DNA, 27 bp, Artificial Sequence
  Description of Artificial Sequence: Synthetic oligonucleotide
acgctgttcgtgaggttcgacagcgac

SEQ ID NO: 375661 - DNA, 26 bp, Artificial Sequence
  Description of Artificial Sequence: Synthetic oligonucleotide
cgctgttcgtgaggttcgacagcgac

SEQ ID NO: 375662 - DNA, 26 bp, Artificial Sequence
  Description of Artificial Sequence: Synthetic oligonucleotide
gctgttcgtgaggttcgacagcgacg

SEQ ID NO: 375663 - DNA, 26 bp, Artificial Sequence
  Description of Artificial Sequence: Synthetic oligonucleotide
ctgttcgtgaggttcgacagcgacgc

SEQ ID NO: 375664 - DNA, 27 bp, Artificial Sequence
  Description of Artificial Sequence: Synthetic oligonucleotide
tgttcgtgaggttcgacagcgacgcca

SEQ ID NO: 375665 - DNA, 30 bp, Artificial Sequence; identical to SEQ ID NO: 25664
  Description of Artificial Sequence: Synthetic oligonucleotide

SEQ ID NO: 375666 - DNA, 32 bp, Artificial Sequence; identical to SEQ ID NO: 25665
  Description of Artificial Sequence: Synthetic oligonucleotide

SEQ ID NO: 375667 - DNA, 31 bp, Artificial Sequence; identical to SEQ ID NO: 25666
  Description of Artificial Sequence: Synthetic oligonucleotide

SEQ ID NO: 375668 - DNA, 32 bp, Artificial Sequence; identical to SEQ ID NO: 25667
  Description of Artificial Sequence: Synthetic oligonucleotide

SEQ ID NO: 375669 - DNA, 31 bp, Artificial Sequence; identical to SEQ ID NO: 25668
  Description of Artificial Sequence: Synthetic oligonucleotide

SEQ ID NO: 375670 - DNA, 30 bp, Artificial Sequence; identical to SEQ ID NO: 25669
  Description of Artificial Sequence: Synthetic oligonucleotide

SEQ ID NO: 375671 - DNA, 29 bp, Artificial Sequence
  Description of Artificial Sequence: Synthetic oligonucleotide
tgggaccgggagacacagatcttcaagac

SEQ ID NO: 375672 - DNA, 28 bp, Artificial Sequence
  Description of Artificial Sequence: Synthetic oligonucleotide
gggaccgggagacacagatcttcaagac

SEQ ID NO: 375673 - DNA, 28 bp, Artificial Sequence
  Description of Artificial Sequence: Synthetic oligonucleotide
ggaccgggagacacagatcttcaagacc

SEQ ID NO: 375674 - DNA, 30 bp, Artificial Sequence; identical to SEQ ID NO: 25673
  Description of Artificial Sequence: Synthetic oligonucleotide

SEQ ID NO: 375675 - DNA, 31 bp, Artificial Sequence; identical to SEQ ID NO: 25674
  Description of Artificial Sequence: Synthetic oligonucleotide

SEQ ID NO: 375676 - DNA, 30 bp, Artificial Sequence; identical to SEQ ID NO: 25675
  Description of Artificial Sequence: Synthetic oligonucleotide

SEQ ID NO: 375677 - DNA, 31 bp, Artificial Sequence; identical to SEQ ID NO: 25676
  Description of Artificial Sequence: Synthetic oligonucleotide

SEQ ID NO: 375678 - DNA, 32 bp, Artificial Sequence; identical to SEQ ID NO: 25677
  Description of Artificial Sequence: Synthetic oligonucleotide

SEQ ID NO: 375679 - DNA, 33 bp, Artificial Sequence; identical to SEQ ID NO: 25678
  Description of Artificial Sequence: Synthetic oligonucleotide

SEQ ID NO: 375680 - DNA, 36 bp, Artificial Sequence; identical to SEQ ID NO: 29528
  Description of Artificial Sequence: Synthetic oligonucleotide

SEQ ID NO: 375681 - DNA, 36 bp, Artificial Sequence; identical to SEQ ID NO: 29529
  Description of Artificial Sequence: Synthetic oligonucleotide

SEQ ID NO: 375682 - DNA, 35 bp, Artificial Sequence; identical to SEQ ID NO: 29530
  Description of Artificial Sequence: Synthetic oligonucleotide

SEQ ID NO: 375683 - DNA, 25 bp, Artificial Sequence
  Description of Artificial Sequence: Synthetic oligonucleotide
gcctcctccgcgggcataaccagtt

SEQ ID NO: 375684 - DNA, 25 bp, Artificial Sequence
  Description of Artificial Sequence: Synthetic oligonucleotide
cctcctccgcgggcataaccagttc

SEQ ID NO: 375685 - DNA, 25 bp, Artificial Sequence
  Description of Artificial Sequence: Synthetic oligonucleotide
ctcctccgcgggcataaccagttcg

SEQ ID NO: 375686 - DNA, 25 bp, Artificial Sequence
  Description of Artificial Sequence: Synthetic oligonucleotide
tcctccgcgggcataaccagttcgc

SEQ ID NO: 375687 - DNA, 24 bp, Artificial Sequence
  Description of Artificial Sequence: Synthetic oligonucleotide
cctccgcgggcataaccagttcgc

SEQ ID NO: 375688 - DNA, 26 bp, Artificial Sequence
  Description of Artificial Sequence: Synthetic oligonucleotide
ctccgcgggcataaccagttcgccta

SEQ ID NO: 375689 - DNA, 26 bp, Artificial Sequence
  Description of Artificial Sequence: Synthetic oligonucleotide
tccgcgggcataaccagttcgcctac

SEQ ID NO: 375690 - DNA, 25 bp, Artificial Sequence
  Description of Artificial Sequence: Synthetic oligonucleotide
ccgcgggcataaccagttcgcctac

SEQ ID NO: 375691 - DNA, 26 bp, Artificial Sequence
  Description of Artificial Sequence: Synthetic oligonucleotide
cgcgggcataaccagttcgcctacga

SEQ ID NO: 375692 - DNA, 26 bp, Artificial Sequence
  Description of Artificial Sequence: Synthetic oligonucleotide
gcgggcataaccagttcgcctacgac

SEQ ID NO: 375693 - DNA, 26 bp, Artificial Sequence
  Description of Artificial Sequence: Synthetic oligonucleotide
cgggcataaccagttcgcctacgacg

SEQ ID NO: 375694 - DNA, 26 bp, Artificial Sequence
  Description of Artificial Sequence: Synthetic oligonucleotide
gggcataaccagttcgcctacgacgg

SEQ ID NO: 375695 - DNA, 27 bp, Artificial Sequence
  Description of Artificial Sequence: Synthetic oligonucleotide
ggcataaccagttcgcctacgacggca

SEQ ID NO: 375696 - DNA, 28 bp, Artificial Sequence
  Description of Artificial Sequence: Synthetic oligonucleotide
gcataaccagttcgcctacgacggcaag

SEQ ID NO: 375697 - DNA, 28 bp, Artificial Sequence
  Description of Artificial Sequence: Synthetic oligonucleotide
cataaccagttcgcctacgacggcaagg

SEQ ID NO: 375698 - DNA, 33 bp, Artificial Sequence; identical to SEQ ID NO: 25396
  Description of Artificial Sequence: Synthetic oligonucleotide

SEQ ID NO: 375699 - DNA, 32 bp, Artificial Sequence; identical to SEQ ID NO: 25397
  Description of Artificial Sequence: Synthetic oligonucleotide

SEQ ID NO: 375700 - DNA, 29 bp, Artificial Sequence
  Description of Artificial Sequence: Synthetic oligonucleotide
gctcccactccatgaggtatttccacacc

SEQ ID NO: 375701 - DNA, 30 bp, Artificial Sequence; identical to SEQ ID NO: 13191
  Description of Artificial Sequence: Synthetic oligonucleotide

SEQ ID NO: 375702 - DNA, 30 bp, Artificial Sequence; identical to SEQ ID NO: 13192
  Description of Artificial Sequence: Synthetic oligonucleotide

SEQ ID NO: 375703 - DNA, 29 bp, Artificial Sequence
  Description of Artificial Sequence: Synthetic oligonucleotide
cccactccatgaggtatttccacacctcc

SEQ ID NO: 375704 - DNA, 29 bp, Artificial Sequence
  Description of Artificial Sequence: Synthetic oligonucleotide
ccactccatgaggtatttccacacctccg

SEQ ID NO: 375705 - DNA, 30 bp, Artificial Sequence; identical to SEQ ID NO: 13195
  Description of Artificial Sequence: Synthetic oligonucleotide

SEQ ID NO: 375706 - DNA, 31 bp, Artificial Sequence; identical to SEQ ID NO: 13196
  Description of Artificial Sequence: Synthetic oligonucleotide

SEQ ID NO: 375707 - DNA, 30 bp, Artificial Sequence; identical to SEQ ID NO: 13197
  Description of Artificial Sequence: Synthetic oligonucleotide

SEQ ID NO: 375708 - DNA, 30 bp, Artificial Sequence; identical to SEQ ID NO: 13198
  Description of Artificial Sequence: Synthetic oligonucleotide

SEQ ID NO: 375709 - DNA, 29 bp, Artificial Sequence
  Description of Artificial Sequence: Synthetic oligonucleotide
ccatgaggtatttccacacctccgtgtcc

SEQ ID NO: 375710 - DNA, 29 bp, Artificial Sequence
  Description of Artificial Sequence: Synthetic oligonucleotide
catgaggtatttccacacctccgtgtccc

SEQ ID NO: 375711 - DNA, 29 bp, Artificial Sequence
  Description of Artificial Sequence: Synthetic oligonucleotide
atgaggtatttccacacctccgtgtcccg

SEQ ID NO: 375712 - DNA, 28 bp, Artificial Sequence
  Description of Artificial Sequence: Synthetic oligonucleotide
tgaggtatttccacacctccgtgtcccg

SEQ ID NO: 375713 - DNA, 27 bp, Artificial Sequence
  Description of Artificial Sequence: Synthetic oligonucleotide
gaggtatttccacacctccgtgtcccg

SEQ ID NO: 375714 - DNA, 27 bp, Artificial Sequence
  Description of Artificial Sequence: Synthetic oligonucleotide
aggtatttccacacctccgtgtcccgg

SEQ ID NO: 375715 - DNA, 26 bp, Artificial Sequence
  Description of Artificial Sequence: Synthetic oligonucleotide
ggtatttccacacctccgtgtcccgg

SEQ ID NO: 375716 - DNA, 26 bp, Artificial Sequence
  Description of Artificial Sequence: Synthetic oligonucleotide
gtatttccacacctccgtgtcccggc

SEQ ID NO: 375717 - DNA, 26 bp, Artificial Sequence
  Description of Artificial Sequence: Synthetic oligonucleotide
tatttccacacctccgtgtcccggcc

SEQ ID NO: 375718 - DNA, 25 bp, Artificial Sequence
  Description of Artificial Sequence: Synthetic oligonucleotide
atttccacacctccgtgtcccggcc

SEQ ID NO: 375719 - DNA, 24 bp, Artificial Sequence
  Description of Artificial Sequence: Synthetic oligonucleotide
tttccacacctccgtgtcccggcc

SEQ ID NO: 375720 - DNA, 23 bp, Artificial Sequence
  Description of Artificial Sequence: Synthetic oligonucleotide
ttccacacctccgtgtcccggcc

SEQ ID NO: 375721 - DNA, 22 bp, Artificial Sequence
  Description of Artificial Sequence: Synthetic oligonucleotide
tccacacctccgtgtcccggcc

SEQ ID NO: 375722 - DNA, 21 bp, Artificial Sequence
  Description of Artificial Sequence: Synthetic oligonucleotide
ccacacctccgtgtcccggcc

SEQ ID NO: 375723 - DNA, 21 bp, Artificial Sequence
  Description of Artificial Sequence: Synthetic oligonucleotide
cacacctccgtgtcccggccc

SEQ ID NO: 375724 - DNA, 27 bp, Artificial Sequence
  Description of Artificial Sequence: Synthetic oligonucleotide
cctccagaggatgtatggctgcgacct

SEQ ID NO: 375725 - DNA, 27 bp, Artificial Sequence
  Description of Artificial Sequence: Synthetic oligonucleotide
ctccagaggatgtatggctgcgacctg

SEQ ID NO: 375726 - DNA, 24 bp, Artificial Sequence
  Description of Artificial Sequence: Synthetic oligonucleotide
gatcaggacgaagtcccaggcccc

SEQ ID NO: 375727 - DNA, 24 bp, Artificial Sequence
  Description of Artificial Sequence: Synthetic oligonucleotide
atcaggacgaagtcccaggccccg

SEQ ID NO: 375728 - DNA, 23 bp, Artificial Sequence
  Description of Artificial Sequence: Synthetic oligonucleotide
tcaggacgaagtcccaggccccg

SEQ ID NO: 375729 - DNA, 22 bp, Artificial Sequence
  Description of Artificial Sequence: Synthetic oligonucleotide
caggacgaagtcccaggccccg

SEQ ID NO: 375730 - DNA, 22 bp, Artificial Sequence
  Description of Artificial Sequence: Synthetic oligonucleotide
aggacgaagtcccaggccccgg

SEQ ID NO: 375731 - DNA, 21 bp, Artificial Sequence
  Description of Artificial Sequence: Synthetic oligonucleotide
ggacgaagtcccaggccccgg

SEQ ID NO: 375732 - DNA, 21 bp, Artificial Sequence
  Description of Artificial Sequence: Synthetic oligonucleotide
gacgaagtcccaggccccggg

SEQ ID NO: 375733 - DNA, 21 bp, Artificial Sequence
  Description of Artificial Sequence: Synthetic oligonucleotide
acgaagtcccaggccccgggc

SEQ ID NO: 375734 - DNA, 20 bp, Artificial Sequence
  Description of Artificial Sequence: Synthetic oligonucleotide
cgaagtcccaggccccgggc

SEQ ID NO: 375735 - DNA, 20 bp, Artificial Sequence
  Description of Artificial Sequence: Synthetic oligonucleotide
gaagtcccaggccccgggcg

SEQ ID NO: 375736 - DNA, 20 bp, Artificial Sequence
  Description of Artificial Sequence: Synthetic oligonucleotide
aagtcccaggccccgggcgg

SEQ ID NO: 375737 - DNA, 20 bp, Artificial Sequence
  Description of Artificial Sequence: Synthetic oligonucleotide
agtcccaggccccgggcggt

SEQ ID NO: 375738 - DNA, 20 bp, Artificial Sequence
  Description of Artificial Sequence: Synthetic oligonucleotide
gtcccaggccccgggcggtt

SEQ ID NO: 375739 - DNA, 20 bp, Artificial Sequence
  Description of Artificial Sequence: Synthetic oligonucleotide
tcccaggccccgggcgggtt

SEQ ID NO: 375740 - DNA, 20 bp, Artificial Sequence
  Description of Artificial Sequence: Synthetic oligonucleotide
cccaggccccgggcgggttt

SEQ ID NO: 375741 - DNA, 20 bp, Artificial Sequence
  Description of Artificial Sequence: Synthetic oligonucleotide
ccaggccccgggcggggttt

SEQ ID NO: 375742 - DNA, 20 bp, Artificial Sequence
  Description of Artificial Sequence: Synthetic oligonucleotide
caggccccgggcggggcttt

SEQ ID NO: 375743 - DNA, 20 bp, Artificial Sequence
  Description of Artificial Sequence: Synthetic oligonucleotide
aggccccgggcggggctctt

SEQ ID NO: 375744 - DNA, 20 bp, Artificial Sequence
  Description of Artificial Sequence: Synthetic oligonucleotide
ggccccgggcggggctcttt

SEQ ID NO: 375745 - DNA, 20 bp, Artificial Sequence
  Description of Artificial Sequence: Synthetic oligonucleotide
gccccgggcggggctctcat

SEQ ID NO: 375746 - DNA, 20 bp, Artificial Sequence
  Description of Artificial Sequence: Synthetic oligonucleotide
ccccgggcggggctctcagt

SEQ ID NO: 375747 - DNA, 20 bp, Artificial Sequence
  Description of Artificial Sequence: Synthetic oligonucleotide
cccgggcggggctctcaggt

SEQ ID NO: 375748 - DNA, 20 bp, Artificial Sequence
  Description of Artificial Sequence: Synthetic oligonucleotide
ccgggcggggctctcagggt

SEQ ID NO: 375749 - DNA, 21 bp, Artificial Sequence
  Description of Artificial Sequence: Synthetic oligonucleotide
cgggcggggctctcagggtct

SEQ ID NO: 375750 - DNA, 22 bp, Artificial Sequence
  Description of Artificial Sequence: Synthetic oligonucleotide
gggcggggctctcagggtctca

SEQ ID NO: 375751 - DNA, 22 bp, Artificial Sequence
  Description of Artificial Sequence: Synthetic oligonucleotide
ggcggggctctcagggtctcag

SEQ ID NO: 375752 - DNA, 22 bp, Artificial Sequence
  Description of Artificial Sequence: Synthetic oligonucleotide
gcggggctctcagggtctcagg

SEQ ID NO: 375753 - DNA, 27 bp, Artificial Sequence
  Description of Artificial Sequence: Synthetic oligonucleotide
cttgtctgcattggggaggcgcagcat

SEQ ID NO: 375754 - DNA, 28 bp, Artificial Sequence
  Description of Artificial Sequence: Synthetic oligonucleotide
ttgtctgcattggggaggcgcagcattg

SEQ ID NO: 375755 - DNA, 27 bp, Artificial Sequence
  Description of Artificial Sequence: Synthetic oligonucleotide
tgtctgcattggggaggcgcagcattg

SEQ ID NO: 375756 - DNA, 26 bp, Artificial Sequence
  Description of Artificial Sequence: Synthetic oligonucleotide
gtctgcattggggaggcgcagcattg

SEQ ID NO: 375757 - DNA, 26 bp, Artificial Sequence
  Description of Artificial Sequence: Synthetic oligonucleotide
tctgcattggggaggcgcagcattgg

SEQ ID NO: 375758 - DNA, 25 bp, Artificial Sequence
  Description of Artificial Sequence: Synthetic oligonucleotide
ctgcattggggaggcgcagcattgg

SEQ ID NO: 375759 - DNA, 25 bp, Artificial Sequence
  Description of Artificial Sequence: Synthetic oligonucleotide
tgcattggggaggcgcagcattggg

SEQ ID NO: 375760 - DNA, 24 bp, Artificial Sequence
  Description of Artificial Sequence: Synthetic oligonucleotide
gcattggggaggcgcagcattggg

SEQ ID NO: 375761 - DNA, 27 bp, Artificial Sequence
  Description of Artificial Sequence: Synthetic oligonucleotide
cattggggaggcgcagcattggggatt

SEQ ID NO: 375762 - DNA, 27 bp, Artificial Sequence
  Description of Artificial Sequence: Synthetic oligonucleotide
attggggaggcgcagcattggggattc

SEQ ID NO: 375763 - DNA, 26 bp, Artificial Sequence
  Description of Artificial Sequence: Synthetic oligonucleotide
ttggggaggcgcagcattggggattc

SEQ ID NO: 375764 - DNA, 25 bp, Artificial Sequence
  Description of Artificial Sequence: Synthetic oligonucleotide
tggggaggcgcagcattggggattc

SEQ ID NO: 375765 - DNA, 24 bp, Artificial Sequence
  Description of Artificial Sequence: Synthetic oligonucleotide
ggggaggcgcagcattggggattc

SEQ ID NO: 375766 - DNA, 24 bp, Artificial Sequence
  Description of Artificial Sequence: Synthetic oligonucleotide
gggaggcgcagcattggggattcc

SEQ ID NO: 375767 - DNA, 24 bp, Artificial Sequence
  Description of Artificial Sequence: Synthetic oligonucleotide
ggaggcgcagcattggggattccc

SEQ ID NO: 375768 - DNA, 25 bp, Artificial Sequence
  Description of Artificial Sequence: Synthetic oligonucleotide
gaggcgcagcattggggattcccca

SEQ ID NO: 375769 - DNA, 26 bp, Artificial Sequence
  Description of Artificial Sequence: Synthetic oligonucleotide
aggcgcagcattggggattccccact

SEQ ID NO: 375770 - DNA, 25 bp, Artificial Sequence
  Description of Artificial Sequence: Synthetic oligonucleotide
ggcgcagcattggggattccccact

SEQ ID NO: 375771 - DNA, 25 bp, Artificial Sequence
  Description of Artificial Sequence: Synthetic oligonucleotide
gcgcagcattggggattccccactc

SEQ ID NO: 375772 - DNA, 25 bp, Artificial Sequence
  Description of Artificial Sequence: Synthetic oligonucleotide
cgcagcattggggattccccactcc

SEQ ID NO: 375773 - DNA, 26 bp, Artificial Sequence
  Description of Artificial Sequence: Synthetic oligonucleotide
gcagcattggggattccccactccca

SEQ ID NO: 375774 - DNA, 26 bp, Artificial Sequence
  Description of Artificial Sequence: Synthetic oligonucleotide
cagcattggggattccccactcccac

SEQ ID NO: 375775 - DNA, 27 bp, Artificial Sequence
  Description of Artificial Sequence: Synthetic oligonucleotide
agcattggggattccccactcccacga

SEQ ID NO: 375776 - DNA, 26 bp, Artificial Sequence
  Description of Artificial Sequence: Synthetic oligonucleotide
gcattggggattccccactcccacga

SEQ ID NO: 375777 - DNA, 27 bp, Artificial Sequence
  Description of Artificial Sequence: Synthetic oligonucleotide
cattggggattccccactcccacgagt

SEQ ID NO: 375778 - DNA, 29 bp, Artificial Sequence
  Description of Artificial Sequence: Synthetic oligonucleotide
attggggattccccactcccacgagtttc

SEQ ID NO: 375779 - DNA, 23 bp, Artificial Sequence
  Description of Artificial Sequence: Synthetic oligonucleotide
tggccctgaccgagacctgggct

SEQ ID NO: 375780 - DNA, 22 bp, Artificial Sequence
  Description of Artificial Sequence: Synthetic oligonucleotide
ggccctgaccgagacctgggct

SEQ ID NO: 375781 - DNA, 22 bp, Artificial Sequence
  Description of Artificial Sequence: Synthetic oligonucleotide
gccctgaccgagacctgggctg

SEQ ID NO: 375782 - DNA, 22 bp, Artificial Sequence
  Description of Artificial Sequence: Synthetic oligonucleotide
ccctgaccgagacctgggctgg

SEQ ID NO: 375783 - DNA, 23 bp, Artificial Sequence
  Description of Artificial Sequence: Synthetic oligonucleotide
cctgaccgagacctgggctggct

SEQ ID NO: 375784 - DNA, 23 bp, Artificial Sequence
  Description of Artificial Sequence: Synthetic oligonucleotide
ctgaccgagacctgggctggctc

SEQ ID NO: 375785 - DNA, 23 bp, Artificial Sequence
  Description of Artificial Sequence: Synthetic oligonucleotide
tgaccgagacctgggctggctcc

SEQ ID NO: 375786 - DNA, 22 bp, Artificial Sequence
  Description of Artificial Sequence: Synthetic oligonucleotide
gaccgagacctgggctggctcc

SEQ ID NO: 375787 - DNA, 23 bp, Artificial Sequence
  Description of Artificial Sequence: Synthetic oligonucleotide
accgagacctgggctggctccca

SEQ ID NO: 375788 - DNA, 22 bp, Artificial Sequence
  Description of Artificial Sequence: Synthetic oligonucleotide
ccgagacctgggctggctccca

SEQ ID NO: 375789 - DNA, 23 bp, Artificial Sequence
  Description of Artificial Sequence: Synthetic oligonucleotide
cgagacctgggctggctcccact

SEQ ID NO: 375790 - DNA, 23 bp, Artificial Sequence
  Description of Artificial Sequence: Synthetic oligonucleotide
gagacctgggctggctcccactc

SEQ ID NO: 375791 - DNA, 25 bp, Artificial Sequence
  Description of Artificial Sequence: Synthetic oligonucleotide
agacctgggctggctcccactccat

SEQ ID NO: 375792 - DNA, 24 bp, Artificial Sequence
  Description of Artificial Sequence: Synthetic oligonucleotide
gacctgggctggctcccactccat

SEQ ID NO: 375793 - DNA, 25 bp, Artificial Sequence
  Description of Artificial Sequence: Synthetic oligonucleotide
acctgggctggctcccactccatga

SEQ ID NO: 375794 - DNA, 24 bp, Artificial Sequence
  Description of Artificial Sequence: Synthetic oligonucleotide
cctgggctggctcccactccatga

SEQ ID NO: 375795 - DNA, 24 bp, Artificial Sequence
  Description of Artificial Sequence: Synthetic oligonucleotide
ctgggctggctcccactccatgag

SEQ ID NO: 375796 - DNA, 27 bp, Artificial Sequence
  Description of Artificial Sequence: Synthetic oligonucleotide
tgggctggctcccactccatgaggtat

SEQ ID NO: 375797 - DNA, 27 bp, Artificial Sequence
  Description of Artificial Sequence: Synthetic oligonucleotide
gggctggctcccactccatgaggtatt

SEQ ID NO: 375798 - DNA, 28 bp, Artificial Sequence
  Description of Artificial Sequence: Synthetic oligonucleotide
ggctggctcccactccatgaggtatttc

SEQ ID NO: 375799 - DNA, 28 bp, Artificial Sequence
  Description of Artificial Sequence: Synthetic oligonucleotide
gctggctcccactccatgaggtatttcc

SEQ ID NO: 375800 - DNA, 29 bp, Artificial Sequence
  Description of Artificial Sequence: Synthetic oligonucleotide
ctggctcccactccatgaggtatttccac

SEQ ID NO: 375801 - DNA, 30 bp, Artificial Sequence; identical to SEQ ID NO: 29945
  Description of Artificial Sequence: Synthetic oligonucleotide

SEQ ID NO: 375802 - DNA, 29 bp, Artificial Sequence
  Description of Artificial Sequence: Synthetic oligonucleotide
ggctcccactccatgaggtatttccacac

SEQ ID NO: 375803 - DNA, 27 bp, Artificial Sequence
  Description of Artificial Sequence: Synthetic oligonucleotide
cttcatctcagtgggctacgtggacgg

SEQ ID NO: 375804 - DNA, 27 bp, Artificial Sequence
  Description of Artificial Sequence: Synthetic oligonucleotide
ttcatctcagtgggctacgtggacggc

SEQ ID NO: 375805 - DNA, 27 bp, Artificial Sequence
  Description of Artificial Sequence: Synthetic oligonucleotide
tcatctcagtgggctacgtggacggca

SEQ ID NO: 375806 - DNA, 26 bp, Artificial Sequence
  Description of Artificial Sequence: Synthetic oligonucleotide
catctcagtgggctacgtggacggca

SEQ ID NO: 375807 - DNA, 26 bp, Artificial Sequence
  Description of Artificial Sequence: Synthetic oligonucleotide
atctcagtgggctacgtggacggcac

SEQ ID NO: 375808 - DNA, 25 bp, Artificial Sequence
  Description of Artificial Sequence: Synthetic oligonucleotide
tctcagtgggctacgtggacggcac

SEQ ID NO: 375809 - DNA, 24 bp, Artificial Sequence
  Description of Artificial Sequence: Synthetic oligonucleotide
ctcagtgggctacgtggacggcac

SEQ ID NO: 375810 - DNA, 24 bp, Artificial Sequence
  Description of Artificial Sequence: Synthetic oligonucleotide
tcagtgggctacgtggacggcacc

SEQ ID NO: 375811 - DNA, 23 bp, Artificial Sequence
  Description of Artificial Sequence: Synthetic oligonucleotide
cagtgggctacgtggacggcacc

SEQ ID NO: 375812 - DNA, 24 bp, Artificial Sequence
  Description of Artificial Sequence: Synthetic oligonucleotide
agtgggctacgtggacggcaccca

SEQ ID NO: 375813 - DNA, 23 bp, Artificial Sequence
  Description of Artificial Sequence: Synthetic oligonucleotide
gtgggctacgtggacggcaccca

SEQ ID NO: 375814 - DNA, 25 bp, Artificial Sequence
  Description of Artificial Sequence: Synthetic oligonucleotide
tgggctacgtggacggcacccagtt

SEQ ID NO: 375815 - DNA, 24 bp, Artificial Sequence
  Description of Artificial Sequence: Synthetic oligonucleotide
gggctacgtggacggcacccagtt

SEQ ID NO: 375816 - DNA, 24 bp, Artificial Sequence
  Description of Artificial Sequence: Synthetic oligonucleotide
ggctacgtggacggcacccagttc

SEQ ID NO: 375817 - DNA, 25 bp, Artificial Sequence
  Description of Artificial Sequence: Synthetic oligonucleotide
gctacgtggacggcacccagttcgt

SEQ ID NO: 375818 - DNA, 26 bp, Artificial Sequence
  Description of Artificial Sequence: Synthetic oligonucleotide
ctacgtggacggcacccagttcgtga

SEQ ID NO: 375819 - DNA, 26 bp, Artificial Sequence
  Description of Artificial Sequence: Synthetic oligonucleotide
tacgtggacggcacccagttcgtgag

SEQ ID NO: 375820 - DNA, 25 bp, Artificial Sequence
  Description of Artificial Sequence: Synthetic oligonucleotide
acgtggacggcacccagttcgtgag

SEQ ID NO: 375821 - DNA, 24 bp, Artificial Sequence
  Description of Artificial Sequence: Synthetic oligonucleotide
cgtggacggcacccagttcgtgag

SEQ ID NO: 375822 - DNA, 26 bp, Artificial Sequence
  Description of Artificial Sequence: Synthetic oligonucleotide
gtggacggcacccagttcgtgaggtt

SEQ ID NO: 375823 - DNA, 26 bp, Artificial Sequence
  Description of Artificial Sequence: Synthetic oligonucleotide
tggacggcacccagttcgtgaggttc

SEQ ID NO: 375824 - DNA, 25 bp, Artificial Sequence
  Description of Artificial Sequence: Synthetic oligonucleotide
ggacggcacccagttcgtgaggttc

SEQ ID NO: 375825 - DNA, 26 bp, Artificial Sequence
  Description of Artificial Sequence: Synthetic oligonucleotide
gacggcacccagttcgtgaggttcga

SEQ ID NO: 375826 - DNA, 27 bp, Artificial Sequence
  Description of Artificial Sequence: Synthetic oligonucleotide
acggcacccagttcgtgaggttcgaca

SEQ ID NO: 375827 - DNA, 26 bp, Artificial Sequence
  Description of Artificial Sequence: Synthetic oligonucleotide
cggcacccagttcgtgaggttcgaca

SEQ ID NO: 375828 - DNA, 26 bp, Artificial Sequence
  Description of Artificial Sequence: Synthetic oligonucleotide
ggcacccagttcgtgaggttcgacag

SEQ ID NO: 375829 - DNA, 26 bp, Artificial Sequence
  Description of Artificial Sequence: Synthetic oligonucleotide
gcacccagttcgtgaggttcgacagc

SEQ ID NO: 375830 - DNA, 22 bp, Artificial Sequence
  Description of Artificial Sequence: Synthetic oligonucleotide
agcgacgccgcgagtccgagga

SEQ ID NO: 375831 - DNA, 21 bp, Artificial Sequence
  Description of Artificial Sequence: Synthetic oligonucleotide
gcgacgccgcgagtccgagga

SEQ ID NO: 375832 - DNA, 21 bp, Artificial Sequence
  Description of Artificial Sequence: Synthetic oligonucleotide
cgacgccgcgagtccgaggac

SEQ ID NO: 375833 - DNA, 21 bp, Artificial Sequence
  Description of Artificial Sequence: Synthetic oligonucleotide
gacgccgcgagtccgaggacg

SEQ ID NO: 375834 - DNA, 22 bp, Artificial Sequence
  Description of Artificial Sequence: Synthetic oligonucleotide
acgccgcgagtccgaggacgga

SEQ ID NO: 375835 - DNA, 21 bp, Artificial Sequence
  Description of Artificial Sequence: Synthetic oligonucleotide
cgccgcgagtccgaggacgga

SEQ ID NO: 375836 - DNA, 21 bp, Artificial Sequence
  Description of Artificial Sequence: Synthetic oligonucleotide
gccgcgagtccgaggacggag

SEQ ID NO: 375837 - DNA, 21 bp, Artificial Sequence
  Description of Artificial Sequence: Synthetic oligonucleotide
ccgcgagtccgaggacggagc

SEQ ID NO: 375838 - DNA, 21 bp, Artificial Sequence
  Description of Artificial Sequence: Synthetic oligonucleotide
cgcgagtccgaggacggagcc

SEQ ID NO: 375839 - DNA, 21 bp, Artificial Sequence
  Description of Artificial Sequence: Synthetic oligonucleotide
gcgagtccgaggacggagccc

SEQ ID NO: 375840 - DNA, 21 bp, Artificial Sequence
  Description of Artificial Sequence: Synthetic oligonucleotide
cgagtccgaggacggagcccc

SEQ ID NO: 375841 - DNA, 21 bp, Artificial Sequence
  Description of Artificial Sequence: Synthetic oligonucleotide
gagtccgaggacggagccccg

SEQ ID NO: 375842 - DNA, 21 bp, Artificial Sequence
  Description of Artificial Sequence: Synthetic oligonucleotide
agtccgaggacggagccccgg

SEQ ID NO: 375843 - DNA, 20 bp, Artificial Sequence
  Description of Artificial Sequence: Synthetic oligonucleotide
gtccgaggacggagccccgg

SEQ ID NO: 375844 - DNA, 20 bp, Artificial Sequence
  Description of Artificial Sequence: Synthetic oligonucleotide
tccgaggacggagccccggg

SEQ ID NO: 375845 - DNA, 20 bp, Artificial Sequence
  Description of Artificial Sequence: Synthetic oligonucleotide
ccgaggacggagccccgggt

SEQ ID NO: 375846 - DNA, 20 bp, Artificial Sequence
  Description of Artificial Sequence: Synthetic oligonucleotide
cgaggacggagccccgggct

SEQ ID NO: 375847 - DNA, 20 bp, Artificial Sequence
  Description of Artificial Sequence: Synthetic oligonucleotide
gaggacggagccccgggcgt

SEQ ID NO: 375848 - DNA, 20 bp, Artificial Sequence
  Description of Artificial Sequence: Synthetic oligonucleotide
aggacggagccccgggcgct

SEQ ID NO: 375849 - DNA, 20 bp, Artificial Sequence
  Description of Artificial Sequence: Synthetic oligonucleotide
ggacggagccccgggcgctt

SEQ ID NO: 375850 - DNA, 20 bp, Artificial Sequence
  Description of Artificial Sequence: Synthetic oligonucleotide
gacggagccccgggcgcctt

SEQ ID NO: 375851 - DNA, 20 bp, Artificial Sequence
  Description of Artificial Sequence: Synthetic oligonucleotide
acggagccccgggcgccgtt

SEQ ID NO: 375852 - DNA, 20 bp, Artificial Sequence
  Description of Artificial Sequence: Synthetic oligonucleotide
cggagccccgggcgccgttt

SEQ ID NO: 375853 - DNA, 23 bp, Artificial Sequence
  Description of Artificial Sequence: Synthetic oligonucleotide
cccgggcgccgtggatagagcaa

SEQ ID NO: 375854 - DNA, 24 bp, Artificial Sequence
  Description of Artificial Sequence: Synthetic oligonucleotide
ccgggcgccgtggatagagcaaga

SEQ ID NO: 375855 - DNA, 35 bp, Artificial Sequence; identical to SEQ ID NO: 29951
  Description of Artificial Sequence: Synthetic oligonucleotide

SEQ ID NO: 375856 - DNA, 34 bp, Artificial Sequence; identical to SEQ ID NO: 29952
  Description of Artificial Sequence: Synthetic oligonucleotide

SEQ ID NO: 375857 - DNA, 35 bp, Artificial Sequence; identical to SEQ ID NO: 29953
  Description of Artificial Sequence: Synthetic oligonucleotide

SEQ ID NO: 375858 - DNA, 34 bp, Artificial Sequence; identical to SEQ ID NO: 29954
  Description of Artificial Sequence: Synthetic oligonucleotide

SEQ ID NO: 375859 - DNA, 35 bp, Artificial Sequence; identical to SEQ ID NO: 29955
  Description of Artificial Sequence: Synthetic oligonucleotide

SEQ ID NO: 375860 - DNA, 34 bp, Artificial Sequence; identical to SEQ ID NO: 29956
  Description of Artificial Sequence: Synthetic oligonucleotide

SEQ ID NO: 375861 - DNA, 35 bp, Artificial Sequence; identical to SEQ ID NO: 29957
  Description of Artificial Sequence: Synthetic oligonucleotide

SEQ ID NO: 375862 - DNA, 34 bp, Artificial Sequence; identical to SEQ ID NO: 29958
  Description of Artificial Sequence: Synthetic oligonucleotide

SEQ ID NO: 375863 - DNA, 33 bp, Artificial Sequence; identical to SEQ ID NO: 29959
  Description of Artificial Sequence: Synthetic oligonucleotide

SEQ ID NO: 375864 - DNA, 33 bp, Artificial Sequence; identical to SEQ ID NO: 29960
  Description of Artificial Sequence: Synthetic oligonucleotide

SEQ ID NO: 375865 - DNA, 32 bp, Artificial Sequence; identical to SEQ ID NO: 29961
  Description of Artificial Sequence: Synthetic oligonucleotide

SEQ ID NO: 375866 - DNA, 32 bp, Artificial Sequence; identical to SEQ ID NO: 29962
  Description of Artificial Sequence: Synthetic oligonucleotide

SEQ ID NO: 375867 - DNA, 33 bp, Artificial Sequence; identical to SEQ ID NO: 29963
  Description of Artificial Sequence: Synthetic oligonucleotide

SEQ ID NO: 375868 - DNA, 32 bp, Artificial Sequence; identical to SEQ ID NO: 29964
  Description of Artificial Sequence: Synthetic oligonucleotide

SEQ ID NO: 375869 - DNA, 31 bp, Artificial Sequence; identical to SEQ ID NO: 29965
  Description of Artificial Sequence: Synthetic oligonucleotide

SEQ ID NO: 375870 - DNA, 31 bp, Artificial Sequence; identical to SEQ ID NO: 29966
  Description of Artificial Sequence: Synthetic oligonucleotide

SEQ ID NO: 375871 - DNA, 30 bp, Artificial Sequence; identical to SEQ ID NO: 29967
  Description of Artificial Sequence: Synthetic oligonucleotide

SEQ ID NO: 375872 - DNA, 30 bp, Artificial Sequence; identical to SEQ ID NO: 29968
  Description of Artificial Sequence: Synthetic oligonucleotide

SEQ ID NO: 375873 - DNA, 30 bp, Artificial Sequence; identical to SEQ ID NO: 29969
  Description of Artificial Sequence: Synthetic oligonucleotide

SEQ ID NO: 375874 - DNA, 29 bp, Artificial Sequence
  Description of Artificial Sequence: Synthetic oligonucleotide
acacacagacttacagagagagcctgcgg

SEQ ID NO: 375875 - DNA, 28 bp, Artificial Sequence
  Description of Artificial Sequence: Synthetic oligonucleotide
cacacagacttacagagagagcctgcgg

SEQ ID NO: 375876 - DNA, 30 bp, Artificial Sequence; identical to SEQ ID NO: 29972
  Description of Artificial Sequence: Synthetic oligonucleotide

SEQ ID NO: 375877 - DNA, 29 bp, Artificial Sequence
  Description of Artificial Sequence: Synthetic oligonucleotide
cacagacttacagagagagcctgcggaac

SEQ ID NO: 375878 - DNA, 29 bp, Artificial Sequence
  Description of Artificial Sequence: Synthetic oligonucleotide
acagacttacagagagagcctgcggaacc

SEQ ID NO: 375879 - DNA, 28 bp, Artificial Sequence
  Description of Artificial Sequence: Synthetic oligonucleotide
cagacttacagagagagcctgcggaacc

SEQ ID NO: 375880 - DNA, 29 bp, Artificial Sequence
  Description of Artificial Sequence: Synthetic oligonucleotide
agacttacagagagagcctgcggaacctg

SEQ ID NO: 375881 - DNA, 28 bp, Artificial Sequence
  Description of Artificial Sequence: Synthetic oligonucleotide
gacttacagagagagcctgcggaacctg

SEQ ID NO: 375882 - DNA, 28 bp, Artificial Sequence
  Description of Artificial Sequence: Synthetic oligonucleotide
acttacagagagagcctgcggaacctgc

SEQ ID NO: 375883 - DNA, 27 bp, Artificial Sequence
  Description of Artificial Sequence: Synthetic oligonucleotide
cttacagagagagcctgcggaacctgc

SEQ ID NO: 375884 - DNA, 27 bp, Artificial Sequence
  Description of Artificial Sequence: Synthetic oligonucleotide
ttacagagagagcctgcggaacctgcg

SEQ ID NO: 375885 - DNA, 26 bp, Artificial Sequence
  Description of Artificial Sequence: Synthetic oligonucleotide
tacagagagagcctgcggaacctgcg

SEQ ID NO: 375886 - DNA, 25 bp, Artificial Sequence
  Description of Artificial Sequence: Synthetic oligonucleotide
acagagagagcctgcggaacctgcg

SEQ ID NO: 375887 - DNA, 24 bp, Artificial Sequence
  Description of Artificial Sequence: Synthetic oligonucleotide
cagagagagcctgcggaacctgcg

SEQ ID NO: 375888 - DNA, 24 bp, Artificial Sequence
  Description of Artificial Sequence: Synthetic oligonucleotide
agagagagcctgcggaacctgcgc

SEQ ID NO: 375889 - DNA, 25 bp, Artificial Sequence
  Description of Artificial Sequence: Synthetic oligonucleotide
gccctgaacgaggacctgagctcgt

SEQ ID NO: 375890 - DNA, 25 bp, Artificial Sequence
  Description of Artificial Sequence: Synthetic oligonucleotide
ccctgaacgaggacctgagctcgtg

SEQ ID NO: 375891 - DNA, 26 bp, Artificial Sequence
  Description of Artificial Sequence: Synthetic oligonucleotide
cctgaacgaggacctgagctcgtgga

SEQ ID NO: 375892 - DNA, 26 bp, Artificial Sequence
  Description of Artificial Sequence: Synthetic oligonucleotide
ctgaacgaggacctgagctcgtggac

SEQ ID NO: 375893 - DNA, 26 bp, Artificial Sequence
  Description of Artificial Sequence: Synthetic oligonucleotide
tgaacgaggacctgagctcgtggacc

SEQ ID NO: 375894 - DNA, 25 bp, Artificial Sequence
  Description of Artificial Sequence: Synthetic oligonucleotide
gaacgaggacctgagctcgtggacc

SEQ ID NO: 375895 - DNA, 25 bp, Artificial Sequence
  Description of Artificial Sequence: Synthetic oligonucleotide
aacgaggacctgagctcgtggaccg

SEQ ID NO: 375896 - DNA, 24 bp, Artificial Sequence
  Description of Artificial Sequence: Synthetic oligonucleotide
acgaggacctgagctcgtggaccg

SEQ ID NO: 375897 - DNA, 23 bp, Artificial Sequence
  Description of Artificial Sequence: Synthetic oligonucleotide
cgaggacctgagctcgtggaccg

SEQ ID NO: 375898 - DNA, 23 bp, Artificial Sequence
  Description of Artificial Sequence: Synthetic oligonucleotide
gaggacctgagctcgtggaccgc

SEQ ID NO: 375899 - DNA, 23 bp, Artificial Sequence
  Description of Artificial Sequence: Synthetic oligonucleotide
aggacctgagctcgtggaccgcg

SEQ ID NO: 375900 - DNA, 22 bp, Artificial Sequence
  Description of Artificial Sequence: Synthetic oligonucleotide
ggacctgagctcgtggaccgcg

SEQ ID NO: 375901 - DNA, 22 bp, Artificial Sequence
  Description of Artificial Sequence: Synthetic oligonucleotide
gacctgagctcgtggaccgcgg

SEQ ID NO: 375902 - DNA, 22 bp, Artificial Sequence
  Description of Artificial Sequence: Synthetic oligonucleotide
acctgagctcgtggaccgcggc

SEQ ID NO: 375903 - DNA, 21 bp, Artificial Sequence
  Description of Artificial Sequence: Synthetic oligonucleotide
cctgagctcgtggaccgcggc

SEQ ID NO: 375904 - DNA, 21 bp, Artificial Sequence
  Description of Artificial Sequence: Synthetic oligonucleotide
ctgagctcgtggaccgcggcg

SEQ ID NO: 375905 - DNA, 22 bp, Artificial Sequence
  Description of Artificial Sequence: Synthetic oligonucleotide
tgagctcgtggaccgcggcgga

SEQ ID NO: 375906 - DNA, 21 bp, Artificial Sequence
  Description of Artificial Sequence: Synthetic oligonucleotide
gagctcgtggaccgcggcgga

SEQ ID NO: 375907 - DNA, 22 bp, Artificial Sequence
  Description of Artificial Sequence: Synthetic oligonucleotide
agctcgtggaccgcggcggaca

SEQ ID NO: 375908 - DNA, 21 bp, Artificial Sequence
  Description of Artificial Sequence: Synthetic oligonucleotide
gctcgtggaccgcggcggaca

SEQ ID NO: 375909 - DNA, 21 bp, Artificial Sequence
  Description of Artificial Sequence: Synthetic oligonucleotide
ctcgtggaccgcggcggacac

SEQ ID NO: 375910 - DNA, 21 bp, Artificial Sequence
  Description of Artificial Sequence: Synthetic oligonucleotide
tcgtggaccgcggcggacacc

SEQ ID NO: 375911 - DNA, 20 bp, Artificial Sequence
  Description of Artificial Sequence: Synthetic oligonucleotide
cgtggaccgcggcggacacc

SEQ ID NO: 375912 - DNA, 20 bp, Artificial Sequence
  Description of Artificial Sequence: Synthetic oligonucleotide
gtggaccgcggcggacaccg

SEQ ID NO: 375913 - DNA, 31 bp, Artificial Sequence; identical to SEQ ID NO: 30009
  Description of Artificial Sequence: Synthetic oligonucleotide

SEQ ID NO: 375914 - DNA, 31 bp, Artificial Sequence; identical to SEQ ID NO: 30010
  Description of Artificial Sequence: Synthetic oligonucleotide

SEQ ID NO: 375915 - DNA, 31 bp, Artificial Sequence; identical to SEQ ID NO: 30011
  Description of Artificial Sequence: Synthetic oligonucleotide

SEQ ID NO: 375916 - DNA, 30 bp, Artificial Sequence; identical to SEQ ID NO: 30012
  Description of Artificial Sequence: Synthetic oligonucleotide

SEQ ID NO: 375917 - DNA, 31 bp, Artificial Sequence; identical to SEQ ID NO: 30013
  Description of Artificial Sequence: Synthetic oligonucleotide

SEQ ID NO: 375918 - DNA, 32 bp, Artificial Sequence; identical to SEQ ID NO: 30014
  Description of Artificial Sequence: Synthetic oligonucleotide

SEQ ID NO: 375919 - DNA, 32 bp, Artificial Sequence; identical to SEQ ID NO: 30015
  Description of Artificial Sequence: Synthetic oligonucleotide

SEQ ID NO: 375920 - DNA, 31 bp, Artificial Sequence; identical to SEQ ID NO: 30016
  Description of Artificial Sequence: Synthetic oligonucleotide

SEQ ID NO: 375921 - DNA, 26 bp, Artificial Sequence
  Description of Artificial Sequence: Synthetic oligonucleotide
ctccgcagacacctggagaacggcaa

SEQ ID NO: 375922 - DNA, 26 bp, Artificial Sequence
  Description of Artificial Sequence: Synthetic oligonucleotide
tccgcagacacctggagaacggcaag

SEQ ID NO: 375923 - DNA, 25 bp, Artificial Sequence
  Description of Artificial Sequence: Synthetic oligonucleotide
ccgcagacacctggagaacggcaag

SEQ ID NO: 375924 - DNA, 26 bp, Artificial Sequence
  Description of Artificial Sequence: Synthetic oligonucleotide
cgcagacacctggagaacggcaagga

SEQ ID NO: 375925 - DNA, 27 bp, Artificial Sequence
  Description of Artificial Sequence: Synthetic oligonucleotide
gcagacacctggagaacggcaaggaga

SEQ ID NO: 375926 - DNA, 27 bp, Artificial Sequence
  Description of Artificial Sequence: Synthetic oligonucleotide
cagacacctggagaacggcaaggagac

SEQ ID NO: 375927 - DNA, 27 bp, Artificial Sequence
  Description of Artificial Sequence: Synthetic oligonucleotide
agacacctggagaacggcaaggagacg

SEQ ID NO: 375928 - DNA, 26 bp, Artificial Sequence
  Description of Artificial Sequence: Synthetic oligonucleotide
gacacctggagaacggcaaggagacg

SEQ ID NO: 375929 - DNA, 27 bp, Artificial Sequence
  Description of Artificial Sequence: Synthetic oligonucleotide
acacctggagaacggcaaggagacgct

SEQ ID NO: 375930 - DNA, 26 bp, Artificial Sequence
  Description of Artificial Sequence: Synthetic oligonucleotide
cacctggagaacggcaaggagacgct

SEQ ID NO: 375931 - DNA, 26 bp, Artificial Sequence
  Description of Artificial Sequence: Synthetic oligonucleotide
acctggagaacggcaaggagacgctg

SEQ ID NO: 375932 - DNA, 25 bp, Artificial Sequence
  Description of Artificial Sequence: Synthetic oligonucleotide
cctggagaacggcaaggagacgctg

SEQ ID NO: 375933 - DNA, 26 bp, Artificial Sequence
  Description of Artificial Sequence: Synthetic oligonucleotide
ctggagaacggcaaggagacgctgca

SEQ ID NO: 375934 - DNA, 26 bp, Artificial Sequence
  Description of Artificial Sequence: Synthetic oligonucleotide
tggagaacggcaaggagacgctgcag

SEQ ID NO: 375935 - DNA, 25 bp, Artificial Sequence
  Description of Artificial Sequence: Synthetic oligonucleotide
ggagaacggcaaggagacgctgcag

SEQ ID NO: 375936 - DNA, 25 bp, Artificial Sequence
  Description of Artificial Sequence: Synthetic oligonucleotide
gagaacggcaaggagacgctgcagc

SEQ ID NO: 375937 - DNA, 25 bp, Artificial Sequence
  Description of Artificial Sequence: Synthetic oligonucleotide
agaacggcaaggagacgctgcagcg

SEQ ID NO: 375938 - DNA, 24 bp, Artificial Sequence
  Description of Artificial Sequence: Synthetic oligonucleotide
gaacggcaaggagacgctgcagcg

SEQ ID NO: 375939 - DNA, 24 bp, Artificial Sequence
  Description of Artificial Sequence: Synthetic oligonucleotide
aacggcaaggagacgctgcagcgc

SEQ ID NO: 375940 - DNA, 23 bp, Artificial Sequence
  Description of Artificial Sequence: Synthetic oligonucleotide
acggcaaggagacgctgcagcgc

SEQ ID NO: 375941 - DNA, 22 bp, Artificial Sequence
  Description of Artificial Sequence: Synthetic oligonucleotide
cggcaaggagacgctgcagcgc

SEQ ID NO: 375942 - DNA, 22 bp, Artificial Sequence
  Description of Artificial Sequence: Synthetic oligonucleotide
ggcaaggagacgctgcagcgcg

SEQ ID NO: 375943 - DNA, 22 bp, Artificial Sequence
  Description of Artificial Sequence: Synthetic oligonucleotide
gcaaggagacgctgcagcgcgc

SEQ ID NO: 375944 - DNA, 22 bp, Artificial Sequence
  Description of Artificial Sequence: Synthetic oligonucleotide
caaggagacgctgcagcgcgcg

SEQ ID NO: 375945 - DNA, 22 bp, Artificial Sequence
  Description of Artificial Sequence: Synthetic oligonucleotide
gaaggagacgctgcagcgcgcc

SEQ ID NO: 375946 - DNA, 22 bp, Artificial Sequence
  Description of Artificial Sequence: Synthetic oligonucleotide
aaggagacgctgcagcgcgccg

SEQ ID NO: 375947 - DNA, 27 bp, Artificial Sequence
  Description of Artificial Sequence: Synthetic oligonucleotide
ggagccccgcttcatctcagtgggtta

SEQ ID NO: 375948 - DNA, 27 bp, Artificial Sequence
  Description of Artificial Sequence: Synthetic oligonucleotide
gagccccgcttcatctcagtgggttac

SEQ ID NO: 375949 - DNA, 27 bp, Artificial Sequence
  Description of Artificial Sequence: Synthetic oligonucleotide
agccccgcttcatctcagtgggttacg

SEQ ID NO: 375950 - DNA, 27 bp, Artificial Sequence
  Description of Artificial Sequence: Synthetic oligonucleotide
gccccgcttcatctcagtgggttacgt

SEQ ID NO: 375951 - DNA, 27 bp, Artificial Sequence
  Description of Artificial Sequence: Synthetic oligonucleotide
ccccgcttcatctcagtgggttacgtg

SEQ ID NO: 375952 - DNA, 27 bp, Artificial Sequence
  Description of Artificial Sequence: Synthetic oligonucleotide
cccgcttcatctcagtgggttacgtgg

SEQ ID NO: 375953 - DNA, 28 bp, Artificial Sequence
  Description of Artificial Sequence: Synthetic oligonucleotide
ccgcttcatctcagtgggttacgtggac

SEQ ID NO: 375954 - DNA, 28 bp, Artificial Sequence
  Description of Artificial Sequence: Synthetic oligonucleotide
cgcttcatctcagtgggttacgtggacg

SEQ ID NO: 375955 - DNA, 28 bp, Artificial Sequence
  Description of Artificial Sequence: Synthetic oligonucleotide
gcttcatctcagtgggttacgtggacgg

SEQ ID NO: 375956 - DNA, 28 bp, Artificial Sequence
  Description of Artificial Sequence: Synthetic oligonucleotide
cttcatctcagtgggttacgtggacggc

SEQ ID NO: 375957 - DNA, 29 bp, Artificial Sequence
  Description of Artificial Sequence: Synthetic oligonucleotide
ttcatctcagtgggttacgtggacggcac

SEQ ID NO: 375958 - DNA, 28 bp, Artificial Sequence
  Description of Artificial Sequence: Synthetic oligonucleotide
tcatctcagtgggttacgtggacggcac

SEQ ID NO: 375959 - DNA, 27 bp, Artificial Sequence
  Description of Artificial Sequence: Synthetic oligonucleotide
catctcagtgggttacgtggacggcac

SEQ ID NO: 375960 - DNA, 27 bp, Artificial Sequence
  Description of Artificial Sequence: Synthetic oligonucleotide
atctcagtgggttacgtggacggcacc

SEQ ID NO: 375961 - DNA, 26 bp, Artificial Sequence
  Description of Artificial Sequence: Synthetic oligonucleotide
tctcagtgggttacgtggacggcacc

SEQ ID NO: 375962 - DNA, 25 bp, Artificial Sequence
  Description of Artificial Sequence: Synthetic oligonucleotide
ctcagtgggttacgtggacggcacc

SEQ ID NO: 375963 - DNA, 26 bp, Artificial Sequence
  Description of Artificial Sequence: Synthetic oligonucleotide
tcagtgggttacgtggacggcaccca

SEQ ID NO: 375964 - DNA, 25 bp, Artificial Sequence
  Description of Artificial Sequence: Synthetic oligonucleotide
cagtgggttacgtggacggcaccca

SEQ ID NO: 375965 - DNA, 27 bp, Artificial Sequence
  Description of Artificial Sequence: Synthetic oligonucleotide
agtgggttacgtggacggcacccagtt

SEQ ID NO: 375966 - DNA, 26 bp, Artificial Sequence
  Description of Artificial Sequence: Synthetic oligonucleotide
gtgggttacgtggacggcacccagtt

SEQ ID NO: 375967 - DNA, 26 bp, Artificial Sequence
  Description of Artificial Sequence: Synthetic oligonucleotide
tgggttacgtggacggcacccagttc

SEQ ID NO: 375968 - DNA, 25 bp, Artificial Sequence
  Description of Artificial Sequence: Synthetic oligonucleotide
gggttacgtggacggcacccagttc

SEQ ID NO: 375969 - DNA, 26 bp, Artificial Sequence
  Description of Artificial Sequence: Synthetic oligonucleotide
ggttacgtggacggcacccagttcgt

SEQ ID NO: 375970 - DNA, 27 bp, Artificial Sequence
  Description of Artificial Sequence: Synthetic oligonucleotide
gttacgtggacggcacccagttcgtga

SEQ ID NO: 375971 - DNA, 27 bp, Artificial Sequence
  Description of Artificial Sequence: Synthetic oligonucleotide
ttacgtggacggcacccagttcgtgag

SEQ ID NO: 375972 - DNA, 20 bp, Artificial Sequence
  Description of Artificial Sequence: Synthetic oligonucleotide
gacggagccccgggcgccat

SEQ ID NO: 375973 - DNA, 20 bp, Artificial Sequence
  Description of Artificial Sequence: Synthetic oligonucleotide
acggagccccgggcgccatg

SEQ ID NO: 375974 - DNA, 20 bp, Artificial Sequence
  Description of Artificial Sequence: Synthetic oligonucleotide
cggagccccgggcgccatgt

SEQ ID NO: 375975 - DNA, 28 bp, Artificial Sequence
  Description of Artificial Sequence: Synthetic oligonucleotide
gctcccactccatgaggtacttccacac

SEQ ID NO: 375976 - DNA, 28 bp, Artificial Sequence
  Description of Artificial Sequence: Synthetic oligonucleotide
ctcccactccatgaggtacttccacacc

SEQ ID NO: 375977 - DNA, 29 bp, Artificial Sequence
  Description of Artificial Sequence: Synthetic oligonucleotide
tcccactccatgaggtacttccacacctc

SEQ ID NO: 375978 - DNA, 28 bp, Artificial Sequence
  Description of Artificial Sequence: Synthetic oligonucleotide
cccactccatgaggtacttccacacctc

SEQ ID NO: 375979 - DNA, 28 bp, Artificial Sequence
  Description of Artificial Sequence: Synthetic oligonucleotide
ccactccatgaggtacttccacacctcc

SEQ ID NO: 375980 - DNA, 28 bp, Artificial Sequence
  Description of Artificial Sequence: Synthetic oligonucleotide
cactccatgaggtacttccacacctccg

SEQ ID NO: 375981 - DNA, 29 bp, Artificial Sequence
  Description of Artificial Sequence: Synthetic oligonucleotide
actccatgaggtacttccacacctccgtg

SEQ ID NO: 375982 - DNA, 28 bp, Artificial Sequence
  Description of Artificial Sequence: Synthetic oligonucleotide
ctccatgaggtacttccacacctccgtg

SEQ ID NO: 375983 - DNA, 29 bp, Artificial Sequence
  Description of Artificial Sequence: Synthetic oligonucleotide
tccatgaggtacttccacacctccgtgtc

SEQ ID NO: 375984 - DNA, 28 bp, Artificial Sequence
  Description of Artificial Sequence: Synthetic oligonucleotide
ccatgaggtacttccacacctccgtgtc

SEQ ID NO: 375985 - DNA, 28 bp, Artificial Sequence
  Description of Artificial Sequence: Synthetic oligonucleotide
catgaggtacttccacacctccgtgtcc

SEQ ID NO: 375986 - DNA, 28 bp, Artificial Sequence
  Description of Artificial Sequence: Synthetic oligonucleotide
atgaggtacttccacacctccgtgtccc

SEQ ID NO: 375987 - DNA, 27 bp, Artificial Sequence
  Description of Artificial Sequence: Synthetic oligonucleotide
tgaggtacttccacacctccgtgtccc

SEQ ID NO: 375988 - DNA, 26 bp, Artificial Sequence
  Description of Artificial Sequence: Synthetic oligonucleotide
gaggtacttccacacctccgtgtccc

SEQ ID NO: 375989 - DNA, 26 bp, Artificial Sequence
  Description of Artificial Sequence: Synthetic oligonucleotide
aggtacttccacacctccgtgtcccg

SEQ ID NO: 375990 - DNA, 25 bp, Artificial Sequence
  Description of Artificial Sequence: Synthetic oligonucleotide
ggtacttccacacctccgtgtcccg

SEQ ID NO: 375991 - DNA, 25 bp, Artificial Sequence
  Description of Artificial Sequence: Synthetic oligonucleotide
gtacttccacacctccgtgtcccgg

SEQ ID NO: 375992 - DNA, 25 bp, Artificial Sequence
  Description of Artificial Sequence: Synthetic oligonucleotide
tacttccacacctccgtgtcccggc

SEQ ID NO: 375993 - DNA, 24 bp, Artificial Sequence
  Description of Artificial Sequence: Synthetic oligonucleotide
acttccacacctccgtgtcccggc

SEQ ID NO: 375994 - DNA, 23 bp, Artificial Sequence
  Description of Artificial Sequence: Synthetic oligonucleotide
cttccacacctccgtgtcccggc

SEQ ID NO: 375995 - DNA, 24 bp, Artificial Sequence
  Description of Artificial Sequence: Synthetic oligonucleotide
gcctcctccgtgggcatgaccagt

SEQ ID NO: 375996 - DNA, 24 bp, Artificial Sequence
  Description of Artificial Sequence: Synthetic oligonucleotide
cctcctccgtgggcatgaccagtc

SEQ ID NO: 375997 - DNA, 24 bp, Artificial Sequence
  Description of Artificial Sequence: Synthetic oligonucleotide
ctcctccgtgggcatgaccagtcc

SEQ ID NO: 375998 - DNA, 24 bp, Artificial Sequence
  Description of Artificial Sequence: Synthetic oligonucleotide
tcctccgtgggcatgaccagtccg

SEQ ID NO: 375999 - DNA, 23 bp, Artificial Sequence
  Description of Artificial Sequence: Synthetic oligonucleotide
cctccgtgggcatgaccagtccg

SEQ ID NO: 376000 - DNA, 23 bp, Artificial Sequence
  Description of Artificial Sequence: Synthetic oligonucleotide
ctccgtgggcatgaccagtccgc

SEQ ID NO: 376001 - DNA, 25 bp, Artificial Sequence
  Description of Artificial Sequence: Synthetic oligonucleotide
tccgtgggcatgaccagtccgccta

SEQ ID NO: 376002 - DNA, 24 bp, Artificial Sequence
  Description of Artificial Sequence: Synthetic oligonucleotide
ccgtgggcatgaccagtccgccta

SEQ ID NO: 376003 - DNA, 24 bp, Artificial Sequence
  Description of Artificial Sequence: Synthetic oligonucleotide
cgtgggcatgaccagtccgcctac

SEQ ID NO: 376004 - DNA, 25 bp, Artificial Sequence
  Description of Artificial Sequence: Synthetic oligonucleotide
gtgggcatgaccagtccgcctacga

SEQ ID NO: 376005 - DNA, 25 bp, Artificial Sequence
  Description of Artificial Sequence: Synthetic oligonucleotide
tgggcatgaccagtccgcctacgac

SEQ ID NO: 376006 - DNA, 27 bp, Artificial Sequence
  Description of Artificial Sequence: Synthetic oligonucleotide
aggccgggtctcacaccctccagaata

SEQ ID NO: 376007 - DNA, 27 bp, Artificial Sequence
  Description of Artificial Sequence: Synthetic oligonucleotide
ggccgggtctcacaccctccagaatat

SEQ ID NO: 376008 - DNA, 27 bp, Artificial Sequence
  Description of Artificial Sequence: Synthetic oligonucleotide
gccgggtctcacaccctccagaatatg

SEQ ID NO: 376009 - DNA, 30 bp, Artificial Sequence; identical to SEQ ID NO: 28229
  Description of Artificial Sequence: Synthetic oligonucleotide

SEQ ID NO: 376010 - DNA, 30 bp, Artificial Sequence; identical to SEQ ID NO: 28230
  Description of Artificial Sequence: Synthetic oligonucleotide

SEQ ID NO: 376011 - DNA, 30 bp, Artificial Sequence; identical to SEQ ID NO: 28231
  Description of Artificial Sequence: Synthetic oligonucleotide

SEQ ID NO: 376012 - DNA, 31 bp, Artificial Sequence; identical to SEQ ID NO: 28232
  Description of Artificial Sequence: Synthetic oligonucleotide

SEQ ID NO: 376013 - DNA, 31 bp, Artificial Sequence; identical to SEQ ID NO: 28233
  Description of Artificial Sequence: Synthetic oligonucleotide

SEQ ID NO: 376014 - DNA, 31 bp, Artificial Sequence; identical to SEQ ID NO: 28234
  Description of Artificial Sequence: Synthetic oligonucleotide

SEQ ID NO: 376015 - DNA, 30 bp, Artificial Sequence; identical to SEQ ID NO: 28235
  Description of Artificial Sequence: Synthetic oligonucleotide

SEQ ID NO: 376016 - DNA, 31 bp, Artificial Sequence; identical to SEQ ID NO: 28236
  Description of Artificial Sequence: Synthetic oligonucleotide

SEQ ID NO: 376017 - DNA, 30 bp, Artificial Sequence; identical to SEQ ID NO: 28237
  Description of Artificial Sequence: Synthetic oligonucleotide

SEQ ID NO: 376018 - DNA, 30 bp, Artificial Sequence; identical to SEQ ID NO: 28238
  Description of Artificial Sequence: Synthetic oligonucleotide

SEQ ID NO: 376019 - DNA, 29 bp, Artificial Sequence
  Description of Artificial Sequence: Synthetic oligonucleotide
caccctccagaatatgtatggctgcgacg

SEQ ID NO: 376020 - DNA, 30 bp, Artificial Sequence; identical to SEQ ID NO: 28240
  Description of Artificial Sequence: Synthetic oligonucleotide

SEQ ID NO: 376021 - DNA, 29 bp, Artificial Sequence
  Description of Artificial Sequence: Synthetic oligonucleotide
ccctccagaatatgtatggctgcgacgtg

SEQ ID NO: 376022 - DNA, 29 bp, Artificial Sequence
  Description of Artificial Sequence: Synthetic oligonucleotide
cctccagaatatgtatggctgcgacgtgg

SEQ ID NO: 376023 - DNA, 29 bp, Artificial Sequence
  Description of Artificial Sequence: Synthetic oligonucleotide
ctccagaatatgtatggctgcgacgtggg

SEQ ID NO: 376024 - DNA, 29 bp, Artificial Sequence
  Description of Artificial Sequence: Synthetic oligonucleotide
tccagaatatgtatggctgcgacgtgggg

SEQ ID NO: 376025 - DNA, 28 bp, Artificial Sequence
  Description of Artificial Sequence: Synthetic oligonucleotide
ccagaatatgtatggctgcgacgtgggg

SEQ ID NO: 376026 - DNA, 28 bp, Artificial Sequence
  Description of Artificial Sequence: Synthetic oligonucleotide
cagaatatgtatggctgcgacgtggggc

SEQ ID NO: 376027 - DNA, 28 bp, Artificial Sequence
  Description of Artificial Sequence: Synthetic oligonucleotide
agaatatgtatggctgcgacgtggggcc

SEQ ID NO: 376028 - DNA, 27 bp, Artificial Sequence
  Description of Artificial Sequence: Synthetic oligonucleotide
gaatatgtatggctgcgacgtggggcc

SEQ ID NO: 376029 - DNA, 27 bp, Artificial Sequence
  Description of Artificial Sequence: Synthetic oligonucleotide
aatatgtatggctgcgacgtggggccg

SEQ ID NO: 376030 - DNA, 26 bp, Artificial Sequence
  Description of Artificial Sequence: Synthetic oligonucleotide
atatgtatggctgcgacgtggggccg

SEQ ID NO: 376031 - DNA, 25 bp, Artificial Sequence
  Description of Artificial Sequence: Synthetic oligonucleotide
tatgtatggctgcgacgtggggccg

SEQ ID NO: 376032 - DNA, 27 bp, Artificial Sequence
  Description of Artificial Sequence: Synthetic oligonucleotide
cttcattgcagtgggctacgtggacgg

SEQ ID NO: 376033 - DNA, 27 bp, Artificial Sequence
  Description of Artificial Sequence: Synthetic oligonucleotide
ttcattgcagtgggctacgtggacggc

SEQ ID NO: 376034 - DNA, 27 bp, Artificial Sequence
  Description of Artificial Sequence: Synthetic oligonucleotide
tcattgcagtgggctacgtggacggca

SEQ ID NO: 376035 - DNA, 26 bp, Artificial Sequence
  Description of Artificial Sequence: Synthetic oligonucleotide
cattgcagtgggctacgtggacggca

SEQ ID NO: 376036 - DNA, 26 bp, Artificial Sequence
  Description of Artificial Sequence: Synthetic oligonucleotide
attgcagtgggctacgtggacggcac

SEQ ID NO: 376037 - DNA, 25 bp, Artificial Sequence
  Description of Artificial Sequence: Synthetic oligonucleotide
ttgcagtgggctacgtggacggcac

SEQ ID NO: 376038 - DNA, 24 bp, Artificial Sequence
  Description of Artificial Sequence: Synthetic oligonucleotide
tgcagtgggctacgtggacggcac

SEQ ID NO: 376039 - DNA, 23 bp, Artificial Sequence
  Description of Artificial Sequence: Synthetic oligonucleotide
gcagtgggctacgtggacggcac

SEQ ID NO: 376040 - DNA, 33 bp, Artificial Sequence; identical to SEQ ID NO: 29531
  Description of Artificial Sequence: Synthetic oligonucleotide

SEQ ID NO: 376041 - DNA, 32 bp, Artificial Sequence; identical to SEQ ID NO: 29532
  Description of Artificial Sequence: Synthetic oligonucleotide

SEQ ID NO: 376042 - DNA, 31 bp, Artificial Sequence; identical to SEQ ID NO: 29533
  Description of Artificial Sequence: Synthetic oligonucleotide

SEQ ID NO: 376043 - DNA, 32 bp, Artificial Sequence; identical to SEQ ID NO: 30081
  Description of Artificial Sequence: Synthetic oligonucleotide

SEQ ID NO: 376044 - DNA, 31 bp, Artificial Sequence; identical to SEQ ID NO: 30082
  Description of Artificial Sequence: Synthetic oligonucleotide

SEQ ID NO: 376045 - DNA, 31 bp, Artificial Sequence; identical to SEQ ID NO: 30083
  Description of Artificial Sequence: Synthetic oligonucleotide

SEQ ID NO: 376046 - DNA, 31 bp, Artificial Sequence; identical to SEQ ID NO: 30084
  Description of Artificial Sequence: Synthetic oligonucleotide

SEQ ID NO: 376047 - DNA, 30 bp, Artificial Sequence; identical to SEQ ID NO: 30085
  Description of Artificial Sequence: Synthetic oligonucleotide

SEQ ID NO: 376048 - DNA, 29 bp, Artificial Sequence
  Description of Artificial Sequence: Synthetic oligonucleotide
gaccaacacacagacttaccgagtgagcc

SEQ ID NO: 376049 - DNA, 30 bp, Artificial Sequence; identical to SEQ ID NO: 30087
  Description of Artificial Sequence: Synthetic oligonucleotide

SEQ ID NO: 376050 - DNA, 29 bp, Artificial Sequence
  Description of Artificial Sequence: Synthetic oligonucleotide
ccaacacacagacttaccgagtgagcctg

SEQ ID NO: 376051 - DNA, 29 bp, Artificial Sequence
  Description of Artificial Sequence: Synthetic oligonucleotide
caacacacagacttaccgagtgagcctgc

SEQ ID NO: 376052 - DNA, 29 bp, Artificial Sequence
  Description of Artificial Sequence: Synthetic oligonucleotide
aacacacagacttaccgagtgagcctgcg

SEQ ID NO: 376053 - DNA, 28 bp, Artificial Sequence
  Description of Artificial Sequence: Synthetic oligonucleotide
acacacagacttaccgagtgagcctgcg

SEQ ID NO: 376054 - DNA, 27 bp, Artificial Sequence
  Description of Artificial Sequence: Synthetic oligonucleotide
cacacagacttaccgagtgagcctgcg

SEQ ID NO: 376055 - DNA, 27 bp, Artificial Sequence
  Description of Artificial Sequence: Synthetic oligonucleotide
acacagacttaccgagtgagcctgcgg

SEQ ID NO: 376056 - DNA, 27 bp, Artificial Sequence
  Description of Artificial Sequence: Synthetic oligonucleotide
cacagacttaccgagtgagcctgcgga

SEQ ID NO: 376057 - DNA, 28 bp, Artificial Sequence
  Description of Artificial Sequence: Synthetic oligonucleotide
acagacttaccgagtgagcctgcggaac

SEQ ID NO: 376058 - DNA, 27 bp, Artificial Sequence
  Description of Artificial Sequence: Synthetic oligonucleotide
cagacttaccgagtgagcctgcggaac

SEQ ID NO: 376059 - DNA, 27 bp, Artificial Sequence
  Description of Artificial Sequence: Synthetic oligonucleotide
agacttaccgagtgagcctgcggaacc

SEQ ID NO: 376060 - DNA, 27 bp, Artificial Sequence
  Description of Artificial Sequence: Synthetic oligonucleotide
gacttaccgagtgagcctgcggaacct

SEQ ID NO: 376061 - DNA, 27 bp, Artificial Sequence
  Description of Artificial Sequence: Synthetic oligonucleotide
acttaccgagtgagcctgcggaacctg

SEQ ID NO: 376062 - DNA, 26 bp, Artificial Sequence
  Description of Artificial Sequence: Synthetic oligonucleotide
cttaccgagtgagcctgcggaacctg

SEQ ID NO: 376063 - DNA, 26 bp, Artificial Sequence
  Description of Artificial Sequence: Synthetic oligonucleotide
ttaccgagtgagcctgcggaacctgc

SEQ ID NO: 376064 - DNA, 25 bp, Artificial Sequence
  Description of Artificial Sequence: Synthetic oligonucleotide
taccgagtgagcctgcggaacctgc

SEQ ID NO: 376065 - DNA, 26 bp, Artificial Sequence
  Description of Artificial Sequence: Synthetic oligonucleotide
gggtctcacaccctccagaggatgtg

SEQ ID NO: 376066 - DNA, 26 bp, Artificial Sequence
  Description of Artificial Sequence: Synthetic oligonucleotide
ggtctcacaccctccagaggatgtgc

SEQ ID NO: 376067 - DNA, 26 bp, Artificial Sequence
  Description of Artificial Sequence: Synthetic oligonucleotide
gtctcacaccctccagaggatgtgcg

SEQ ID NO: 376068 - DNA, 26 bp, Artificial Sequence
  Description of Artificial Sequence: Synthetic oligonucleotide
tctcacaccctccagaggatgtgcgg

SEQ ID NO: 376069 - DNA, 25 bp, Artificial Sequence
  Description of Artificial Sequence: Synthetic oligonucleotide
ctcacaccctccagaggatgtgcgg

SEQ ID NO: 376070 - DNA, 26 bp, Artificial Sequence
  Description of Artificial Sequence: Synthetic oligonucleotide
tcacaccctccagaggatgtgcggct

SEQ ID NO: 376071 - DNA, 25 bp, Artificial Sequence
  Description of Artificial Sequence: Synthetic oligonucleotide
cacaccctccagaggatgtgcggct

SEQ ID NO: 376072 - DNA, 25 bp, Artificial Sequence
  Description of Artificial Sequence: Synthetic oligonucleotide
acaccctccagaggatgtgcggctg

SEQ ID NO: 376073 - DNA, 24 bp, Artificial Sequence
  Description of Artificial Sequence: Synthetic oligonucleotide
caccctccagaggatgtgcggctg

SEQ ID NO: 376074 - DNA, 24 bp, Artificial Sequence
  Description of Artificial Sequence: Synthetic oligonucleotide
accctccagaggatgtgcggctgc

SEQ ID NO: 376075 - DNA, 23 bp, Artificial Sequence
  Description of Artificial Sequence: Synthetic oligonucleotide
ccctccagaggatgtgcggctgc

SEQ ID NO: 376076 - DNA, 24 bp, Artificial Sequence
  Description of Artificial Sequence: Synthetic oligonucleotide
cctccagaggatgtgcggctgcga

SEQ ID NO: 376077 - DNA, 24 bp, Artificial Sequence
  Description of Artificial Sequence: Synthetic oligonucleotide
ctccagaggatgtgcggctgcgac

SEQ ID NO: 376078 - DNA, 25 bp, Artificial Sequence
  Description of Artificial Sequence: Synthetic oligonucleotide
tccagaggatgtgcggctgcgacgt

SEQ ID NO: 376079 - DNA, 24 bp, Artificial Sequence
  Description of Artificial Sequence: Synthetic oligonucleotide
ccagaggatgtgcggctgcgacgt

SEQ ID NO: 376080 - DNA, 24 bp, Artificial Sequence
  Description of Artificial Sequence: Synthetic oligonucleotide
cagaggatgtgcggctgcgacgtg

SEQ ID NO: 376081 - DNA, 24 bp, Artificial Sequence
  Description of Artificial Sequence: Synthetic oligonucleotide
agaggatgtgcggctgcgacgtgg

SEQ ID NO: 376082 - DNA, 23 bp, Artificial Sequence
  Description of Artificial Sequence: Synthetic oligonucleotide
gaggatgtgcggctgcgacgtgg

SEQ ID NO: 376083 - DNA, 23 bp, Artificial Sequence
  Description of Artificial Sequence: Synthetic oligonucleotide
aggatgtgcggctgcgacgtggg

SEQ ID NO: 376084 - DNA, 22 bp, Artificial Sequence
  Description of Artificial Sequence: Synthetic oligonucleotide
ggatgtgcggctgcgacgtggg

SEQ ID NO: 376085 - DNA, 22 bp, Artificial Sequence
  Description of Artificial Sequence: Synthetic oligonucleotide
gatgtgcggctgcgacgtgggg

SEQ ID NO: 376086 - DNA, 22 bp, Artificial Sequence
  Description of Artificial Sequence: Synthetic oligonucleotide
atgtgcggctgcgacgtggggc

SEQ ID NO: 376087 - DNA, 21 bp, Artificial Sequence
  Description of Artificial Sequence: Synthetic oligonucleotide
tgtgcggctgcgacgtggggc

SEQ ID NO: 376088 - DNA, 20 bp, Artificial Sequence
  Description of Artificial Sequence: Synthetic oligonucleotide
gtgcggctgcgacgtggggc

SEQ ID NO: 376089 - DNA, 20 bp, Artificial Sequence
  Description of Artificial Sequence: Synthetic oligonucleotide
tgcggctgcgacgtggggcc

SEQ ID NO: 376090 - DNA, 20 bp, Artificial Sequence
  Description of Artificial Sequence: Synthetic oligonucleotide
gcggctgcgacgtggggcct

SEQ ID NO: 376091 - DNA, 26 bp, Artificial Sequence
  Description of Artificial Sequence: Synthetic oligonucleotide
tgttcgtgaggttcgacagcgacgcc

SEQ ID NO: 376092 - DNA, 29 bp, Artificial Sequence
  Description of Artificial Sequence: Synthetic oligonucleotide
gagtattgggaccgggagacacagatctg

SEQ ID NO: 376093 - DNA, 29 bp, Artificial Sequence
  Description of Artificial Sequence: Synthetic oligonucleotide
agtattgggaccgggagacacagatctgc

SEQ ID NO: 376094 - DNA, 28 bp, Artificial Sequence
  Description of Artificial Sequence: Synthetic oligonucleotide
gtattgggaccgggagacacagatctgc

SEQ ID NO: 376095 - DNA, 30 bp, Artificial Sequence; identical to SEQ ID NO: 29608
  Description of Artificial Sequence: Synthetic oligonucleotide

SEQ ID NO: 376096 - DNA, 29 bp, Artificial Sequence
  Description of Artificial Sequence: Synthetic oligonucleotide
attgggaccgggagacacagatctgcaag

SEQ ID NO: 376097 - DNA, 28 bp, Artificial Sequence
  Description of Artificial Sequence: Synthetic oligonucleotide
ttgggaccgggagacacagatctgcaag

SEQ ID NO: 376098 - DNA, 27 bp, Artificial Sequence
  Description of Artificial Sequence: Synthetic oligonucleotide
tgggaccgggagacacagatctgcaag

SEQ ID NO: 376099 - DNA, 26 bp, Artificial Sequence
  Description of Artificial Sequence: Synthetic oligonucleotide
gggaccgggagacacagatctgcaag

SEQ ID NO: 376100 - DNA, 26 bp, Artificial Sequence
  Description of Artificial Sequence: Synthetic oligonucleotide
ggaccgggagacacagatctgcaagg

SEQ ID NO: 376101 - DNA, 26 bp, Artificial Sequence
  Description of Artificial Sequence: Synthetic oligonucleotide
gaccgggagacacagatctgcaaggc

SEQ ID NO: 376102 - DNA, 27 bp, Artificial Sequence
  Description of Artificial Sequence: Synthetic oligonucleotide
accgggagacacagatctgcaaggcca

SEQ ID NO: 376103 - DNA, 27 bp, Artificial Sequence
  Description of Artificial Sequence: Synthetic oligonucleotide
ccgggagacacagatctgcaaggccaa

SEQ ID NO: 376104 - DNA, 27 bp, Artificial Sequence
  Description of Artificial Sequence: Synthetic oligonucleotide
cgggagacacagatctgcaaggccaag

SEQ ID NO: 376105 - DNA, 27 bp, Artificial Sequence
  Description of Artificial Sequence: Synthetic oligonucleotide
gggagacacagatctgcaaggccaagg

SEQ ID NO: 376106 - DNA, 27 bp, Artificial Sequence
  Description of Artificial Sequence: Synthetic oligonucleotide
ggagacacagatctgcaaggccaaggc

SEQ ID NO: 376107 - DNA, 28 bp, Artificial Sequence
  Description of Artificial Sequence: Synthetic oligonucleotide
gagacacagatctgcaaggccaaggcac

SEQ ID NO: 376108 - DNA, 29 bp, Artificial Sequence
  Description of Artificial Sequence: Synthetic oligonucleotide
agacacagatctgcaaggccaaggcacag

SEQ ID NO: 376109 - DNA, 28 bp, Artificial Sequence
  Description of Artificial Sequence: Synthetic oligonucleotide
gacacagatctgcaaggccaaggcacag

SEQ ID NO: 376110 - DNA, 29 bp, Artificial Sequence
  Description of Artificial Sequence: Synthetic oligonucleotide
acacagatctgcaaggccaaggcacagac

SEQ ID NO: 376111 - DNA, 28 bp, Artificial Sequence
  Description of Artificial Sequence: Synthetic oligonucleotide
cacagatctgcaaggccaaggcacagac

SEQ ID NO: 376112 - DNA, 31 bp, Artificial Sequence; identical to SEQ ID NO: 30406
  Description of Artificial Sequence: Synthetic oligonucleotide

SEQ ID NO: 376113 - DNA, 30 bp, Artificial Sequence; identical to SEQ ID NO: 30407
  Description of Artificial Sequence: Synthetic oligonucleotide

SEQ ID NO: 376114 - DNA, 30 bp, Artificial Sequence; identical to SEQ ID NO: 30408
  Description of Artificial Sequence: Synthetic oligonucleotide

SEQ ID NO: 376115 - DNA, 29 bp, Artificial Sequence
  Description of Artificial Sequence: Synthetic oligonucleotide
gatctgcaaggccaaggcacagacttacc

SEQ ID NO: 376116 - DNA, 29 bp, Artificial Sequence
  Description of Artificial Sequence: Synthetic oligonucleotide
atctgcaaggccaaggcacagacttaccg

SEQ ID NO: 376117 - DNA, 28 bp, Artificial Sequence
  Description of Artificial Sequence: Synthetic oligonucleotide
tctgcaaggccaaggcacagacttaccg

SEQ ID NO: 376118 - DNA, 27 bp, Artificial Sequence
  Description of Artificial Sequence: Synthetic oligonucleotide
ctgcaaggccaaggcacagacttaccg

SEQ ID NO: 376119 - DNA, 28 bp, Artificial Sequence
  Description of Artificial Sequence: Synthetic oligonucleotide
tgcaaggccaaggcacagacttaccgag

SEQ ID NO: 376120 - DNA, 27 bp, Artificial Sequence
  Description of Artificial Sequence: Synthetic oligonucleotide
gcaaggccaaggcacagacttaccgag

SEQ ID NO: 376121 - DNA, 28 bp, Artificial Sequence
  Description of Artificial Sequence: Synthetic oligonucleotide
caaggccaaggcacagacttaccgagag

SEQ ID NO: 376122 - DNA, 30 bp, Artificial Sequence; identical to SEQ ID NO: 30416
  Description of Artificial Sequence: Synthetic oligonucleotide

SEQ ID NO: 376123 - DNA, 29 bp, Artificial Sequence
  Description of Artificial Sequence: Synthetic oligonucleotide
aggccaaggcacagacttaccgagagaac

SEQ ID NO: 376124 - DNA, 28 bp, Artificial Sequence
  Description of Artificial Sequence: Synthetic oligonucleotide
ggccaaggcacagacttaccgagagaac

SEQ ID NO: 376125 - DNA, 28 bp, Artificial Sequence
  Description of Artificial Sequence: Synthetic oligonucleotide
gccaaggcacagacttaccgagagaacc

SEQ ID NO: 376126 - DNA, 29 bp, Artificial Sequence
  Description of Artificial Sequence: Synthetic oligonucleotide
ccaaggcacagacttaccgagagaacctg

SEQ ID NO: 376127 - DNA, 29 bp, Artificial Sequence
  Description of Artificial Sequence: Synthetic oligonucleotide
caaggcacagacttaccgagagaacctgc

SEQ ID NO: 376128 - DNA, 29 bp, Artificial Sequence
  Description of Artificial Sequence: Synthetic oligonucleotide
aaggcacagacttaccgagagaacctgcg

SEQ ID NO: 376129 - DNA, 28 bp, Artificial Sequence
  Description of Artificial Sequence: Synthetic oligonucleotide
aggcacagacttaccgagagaacctgcg

SEQ ID NO: 376130 - DNA, 27 bp, Artificial Sequence
  Description of Artificial Sequence: Synthetic oligonucleotide
ggcacagacttaccgagagaacctgcg

SEQ ID NO: 376131 - DNA, 27 bp, Artificial Sequence
  Description of Artificial Sequence: Synthetic oligonucleotide
gcacagacttaccgagagaacctgcgc

SEQ ID NO: 376132 - DNA, 29 bp, Artificial Sequence
  Description of Artificial Sequence: Synthetic oligonucleotide
acagatctgcaaggccaaggcacagactg

SEQ ID NO: 376133 - DNA, 28 bp, Artificial Sequence
  Description of Artificial Sequence: Synthetic oligonucleotide
cagatctgcaaggccaaggcacagactg

SEQ ID NO: 376134 - DNA, 29 bp, Artificial Sequence
  Description of Artificial Sequence: Synthetic oligonucleotide
agatctgcaaggccaaggcacagactgac

SEQ ID NO: 376135 - DNA, 28 bp, Artificial Sequence
  Description of Artificial Sequence: Synthetic oligonucleotide
gatctgcaaggccaaggcacagactgac

SEQ ID NO: 376136 - DNA, 28 bp, Artificial Sequence
  Description of Artificial Sequence: Synthetic oligonucleotide
atctgcaaggccaaggcacagactgacc

SEQ ID NO: 376137 - DNA, 27 bp, Artificial Sequence
  Description of Artificial Sequence: Synthetic oligonucleotide
tctgcaaggccaaggcacagactgacc

SEQ ID NO: 376138 - DNA, 26 bp, Artificial Sequence
  Description of Artificial Sequence: Synthetic oligonucleotide
ctgcaaggccaaggcacagactgacc

SEQ ID NO: 376139 - DNA, 27 bp, Artificial Sequence
  Description of Artificial Sequence: Synthetic oligonucleotide
tgcaaggccaaggcacagactgaccga

SEQ ID NO: 376140 - DNA, 26 bp, Artificial Sequence
  Description of Artificial Sequence: Synthetic oligonucleotide
gcaaggccaaggcacagactgaccga

SEQ ID NO: 376141 - DNA, 27 bp, Artificial Sequence
  Description of Artificial Sequence: Synthetic oligonucleotide
caaggccaaggcacagactgaccgaga

SEQ ID NO: 376142 - DNA, 27 bp, Artificial Sequence
  Description of Artificial Sequence: Synthetic oligonucleotide
aaggccaaggcacagactgaccgagag

SEQ ID NO: 376143 - DNA, 27 bp, Artificial Sequence
  Description of Artificial Sequence: Synthetic oligonucleotide
aggccaaggcacagactgaccgagaga

SEQ ID NO: 376144 - DNA, 27 bp, Artificial Sequence
  Description of Artificial Sequence: Synthetic oligonucleotide
ggccaaggcacagactgaccgagagaa

SEQ ID NO: 376145 - DNA, 27 bp, Artificial Sequence
  Description of Artificial Sequence: Synthetic oligonucleotide
gccaaggcacagactgaccgagagaac

SEQ ID NO: 376146 - DNA, 27 bp, Artificial Sequence
  Description of Artificial Sequence: Synthetic oligonucleotide
ccaaggcacagactgaccgagagaacc

SEQ ID NO: 376147 - DNA, 28 bp, Artificial Sequence
  Description of Artificial Sequence: Synthetic oligonucleotide
caaggcacagactgaccgagagaacctg

SEQ ID NO: 376148 - DNA, 28 bp, Artificial Sequence
  Description of Artificial Sequence: Synthetic oligonucleotide
aaggcacagactgaccgagagaacctgc

SEQ ID NO: 376149 - DNA, 23 bp, Artificial Sequence
  Description of Artificial Sequence: Synthetic oligonucleotide
acctgagctcctggaccgccgca

SEQ ID NO: 376150 - DNA, 22 bp, Artificial Sequence
  Description of Artificial Sequence: Synthetic oligonucleotide
cctgagctcctggaccgccgca

SEQ ID NO: 376151 - DNA, 23 bp, Artificial Sequence
  Description of Artificial Sequence: Synthetic oligonucleotide
ctgagctcctggaccgccgcaga

SEQ ID NO: 376152 - DNA, 24 bp, Artificial Sequence
  Description of Artificial Sequence: Synthetic oligonucleotide
tgagctcctggaccgccgcagaca

SEQ ID NO: 376153 - DNA, 23 bp, Artificial Sequence
  Description of Artificial Sequence: Synthetic oligonucleotide
gagctcctggaccgccgcagaca

SEQ ID NO: 376154 - DNA, 23 bp, Artificial Sequence
  Description of Artificial Sequence: Synthetic oligonucleotide
agctcctggaccgccgcagacac

SEQ ID NO: 376155 - DNA, 24 bp, Artificial Sequence
  Description of Artificial Sequence: Synthetic oligonucleotide
tggatagagcaggaggggccggag

SEQ ID NO: 376156 - DNA, 23 bp, Artificial Sequence
  Description of Artificial Sequence: Synthetic oligonucleotide
ggatagagcaggaggggccggag

SEQ ID NO: 376157 - DNA, 26 bp, Artificial Sequence
  Description of Artificial Sequence: Synthetic oligonucleotide
gatagagcaggaggggccggagcatt

SEQ ID NO: 376158 - DNA, 26 bp, Artificial Sequence
  Description of Artificial Sequence: Synthetic oligonucleotide
atagagcaggaggggccggagcattg

SEQ ID NO: 376159 - DNA, 25 bp, Artificial Sequence
  Description of Artificial Sequence: Synthetic oligonucleotide
tagagcaggaggggccggagcattg

SEQ ID NO: 376160 - DNA, 24 bp, Artificial Sequence
  Description of Artificial Sequence: Synthetic oligonucleotide
agagcaggaggggccggagcattg

SEQ ID NO: 376161 - DNA, 23 bp, Artificial Sequence
  Description of Artificial Sequence: Synthetic oligonucleotide
gagcaggaggggccggagcattg

SEQ ID NO: 376162 - DNA, 23 bp, Artificial Sequence
  Description of Artificial Sequence: Synthetic oligonucleotide
agcaggaggggccggagcattgg

SEQ ID NO: 376163 - DNA, 22 bp, Artificial Sequence
  Description of Artificial Sequence: Synthetic oligonucleotide
gcaggaggggccggagcattgg

SEQ ID NO: 376164 - DNA, 23 bp, Artificial Sequence
  Description of Artificial Sequence: Synthetic oligonucleotide
caggaggggccggagcattggga

SEQ ID NO: 376165 - DNA, 23 bp, Artificial Sequence
  Description of Artificial Sequence: Synthetic oligonucleotide
aggaggggccggagcattgggac

SEQ ID NO: 376166 - DNA, 22 bp, Artificial Sequence
  Description of Artificial Sequence: Synthetic oligonucleotide
ggaggggccggagcattgggac

SEQ ID NO: 376167 - DNA, 22 bp, Artificial Sequence
  Description of Artificial Sequence: Synthetic oligonucleotide
gaggggccggagcattgggacc

SEQ ID NO: 376168 - DNA, 22 bp, Artificial Sequence
  Description of Artificial Sequence: Synthetic oligonucleotide
aggggccggagcattgggaccg

SEQ ID NO: 376169 - DNA, 21 bp, Artificial Sequence
  Description of Artificial Sequence: Synthetic oligonucleotide
ggggccggagcattgggaccg

SEQ ID NO: 376170 - DNA, 21 bp, Artificial Sequence
  Description of Artificial Sequence: Synthetic oligonucleotide
gggccggagcattgggaccgg

SEQ ID NO: 376171 - DNA, 22 bp, Artificial Sequence
  Description of Artificial Sequence: Synthetic oligonucleotide
ggccggagcattgggaccggga

SEQ ID NO: 376172 - DNA, 23 bp, Artificial Sequence
  Description of Artificial Sequence: Synthetic oligonucleotide
gccggagcattgggaccgggaga

SEQ ID NO: 376173 - DNA, 24 bp, Artificial Sequence
  Description of Artificial Sequence: Synthetic oligonucleotide
ccggagcattgggaccgggagaca

SEQ ID NO: 376174 - DNA, 25 bp, Artificial Sequence
  Description of Artificial Sequence: Synthetic oligonucleotide
cggagcattgggaccgggagacaca

SEQ ID NO: 376175 - DNA, 27 bp, Artificial Sequence
  Description of Artificial Sequence: Synthetic oligonucleotide
ggagcattgggaccgggagacacagat

SEQ ID NO: 376176 - DNA, 27 bp, Artificial Sequence
  Description of Artificial Sequence: Synthetic oligonucleotide
gagcattgggaccgggagacacagatc

SEQ ID NO: 376177 - DNA, 28 bp, Artificial Sequence
  Description of Artificial Sequence: Synthetic oligonucleotide
agcattgggaccgggagacacagatctg

SEQ ID NO: 376178 - DNA, 27 bp, Artificial Sequence
  Description of Artificial Sequence: Synthetic oligonucleotide
gcattgggaccgggagacacagatctg

SEQ ID NO: 376179 - DNA, 27 bp, Artificial Sequence
  Description of Artificial Sequence: Synthetic oligonucleotide
cattgggaccgggagacacagatctgc

SEQ ID NO: 376180 - DNA, 26 bp, Artificial Sequence
  Description of Artificial Sequence: Synthetic oligonucleotide
aggccaaggcacagactgaccgagag

SEQ ID NO: 376181 - DNA, 25 bp, Artificial Sequence
  Description of Artificial Sequence: Synthetic oligonucleotide
ggccaaggcacagactgaccgagag

SEQ ID NO: 376182 - DNA, 26 bp, Artificial Sequence
  Description of Artificial Sequence: Synthetic oligonucleotide
gccaaggcacagactgaccgagagga

SEQ ID NO: 376183 - DNA, 26 bp, Artificial Sequence
  Description of Artificial Sequence: Synthetic oligonucleotide
ccaaggcacagactgaccgagaggac

SEQ ID NO: 376184 - DNA, 27 bp, Artificial Sequence
  Description of Artificial Sequence: Synthetic oligonucleotide
caaggcacagactgaccgagaggacct

SEQ ID NO: 376185 - DNA, 27 bp, Artificial Sequence
  Description of Artificial Sequence: Synthetic oligonucleotide
aaggcacagactgaccgagaggacctg

SEQ ID NO: 376186 - DNA, 26 bp, Artificial Sequence
  Description of Artificial Sequence: Synthetic oligonucleotide
aggcacagactgaccgagaggacctg

SEQ ID NO: 376187 - DNA, 25 bp, Artificial Sequence
  Description of Artificial Sequence: Synthetic oligonucleotide
ggcacagactgaccgagaggacctg

SEQ ID NO: 376188 - DNA, 25 bp, Artificial Sequence
  Description of Artificial Sequence: Synthetic oligonucleotide
gcacagactgaccgagaggacctgc

SEQ ID NO: 376189 - DNA, 25 bp, Artificial Sequence
  Description of Artificial Sequence: Synthetic oligonucleotide
cacagactgaccgagaggacctgcg

SEQ ID NO: 376190 - DNA, 26 bp, Artificial Sequence
  Description of Artificial Sequence: Synthetic oligonucleotide
acagactgaccgagaggacctgcgga

SEQ ID NO: 376191 - DNA, 25 bp, Artificial Sequence
  Description of Artificial Sequence: Synthetic oligonucleotide
cagactgaccgagaggacctgcgga

SEQ ID NO: 376192 - DNA, 25 bp, Artificial Sequence
  Description of Artificial Sequence: Synthetic oligonucleotide
agactgaccgagaggacctgcggac

SEQ ID NO: 376193 - DNA, 24 bp, Artificial Sequence
  Description of Artificial Sequence: Synthetic oligonucleotide
gactgaccgagaggacctgcggac

SEQ ID NO: 376194 - DNA, 24 bp, Artificial Sequence
  Description of Artificial Sequence: Synthetic oligonucleotide
actgaccgagaggacctgcggacc

SEQ ID NO: 376195 - DNA, 23 bp, Artificial Sequence
  Description of Artificial Sequence: Synthetic oligonucleotide
ctgaccgagaggacctgcggacc

SEQ ID NO: 376196 - DNA, 24 bp, Artificial Sequence
  Description of Artificial Sequence: Synthetic oligonucleotide
tgaccgagaggacctgcggaccct

SEQ ID NO: 376197 - DNA, 23 bp, Artificial Sequence
  Description of Artificial Sequence: Synthetic oligonucleotide
gaccgagaggacctgcggaccct

SEQ ID NO: 376198 - DNA, 23 bp, Artificial Sequence
  Description of Artificial Sequence: Synthetic oligonucleotide
accgagaggacctgcggaccctg

SEQ ID NO: 376199 - DNA, 22 bp, Artificial Sequence
  Description of Artificial Sequence: Synthetic oligonucleotide
ccgagaggacctgcggaccctg

SEQ ID NO: 376200 - DNA, 23 bp, Artificial Sequence
  Description of Artificial Sequence: Synthetic oligonucleotide
cgagaggacctgcggaccctgct

SEQ ID NO: 376201 - DNA, 23 bp, Artificial Sequence
  Description of Artificial Sequence: Synthetic oligonucleotide
gagaggacctgcggaccctgctc

SEQ ID NO: 376202 - DNA, 23 bp, Artificial Sequence
  Description of Artificial Sequence: Synthetic oligonucleotide
agaggacctgcggaccctgctcc

SEQ ID NO: 376203 - DNA, 22 bp, Artificial Sequence
  Description of Artificial Sequence: Synthetic oligonucleotide
gaggacctgcggaccctgctcc

SEQ ID NO: 376204 - DNA, 22 bp, Artificial Sequence
  Description of Artificial Sequence: Synthetic oligonucleotide
aggacctgcggaccctgctccg

SEQ ID NO: 376205 - DNA, 21 bp, Artificial Sequence
  Description of Artificial Sequence: Synthetic oligonucleotide
ggacctgcggaccctgctccg

SEQ ID NO: 376206 - DNA, 23 bp, Artificial Sequence
  Description of Artificial Sequence: Synthetic oligonucleotide
gacctgcggaccctgctccgcta

SEQ ID NO: 376207 - DNA, 25 bp, Artificial Sequence
  Description of Artificial Sequence: Synthetic oligonucleotide
acctgcggaccctgctccgctacta

SEQ ID NO: 376208 - DNA, 24 bp, Artificial Sequence
  Description of Artificial Sequence: Synthetic oligonucleotide
cctgcggaccctgctccgctacta

SEQ ID NO: 376209 - DNA, 26 bp, Artificial Sequence
  Description of Artificial Sequence: Synthetic oligonucleotide
ctgcggaccctgctccgctactacaa

SEQ ID NO: 376210 - DNA, 26 bp, Artificial Sequence
  Description of Artificial Sequence: Synthetic oligonucleotide
tgcggaccctgctccgctactacaac

SEQ ID NO: 376211 - DNA, 25 bp, Artificial Sequence
  Description of Artificial Sequence: Synthetic oligonucleotide
gcggaccctgctccgctactacaac

SEQ ID NO: 376212 - DNA, 26 bp, Artificial Sequence
  Description of Artificial Sequence: Synthetic oligonucleotide
cggaccctgctccgctactacaacca

SEQ ID NO: 376213 - DNA, 27 bp, Artificial Sequence
  Description of Artificial Sequence: Synthetic oligonucleotide
ggaccctgctccgctactacaaccaga

SEQ ID NO: 376214 - DNA, 27 bp, Artificial Sequence
  Description of Artificial Sequence: Synthetic oligonucleotide
gaccctgctccgctactacaaccagag

SEQ ID NO: 376215 - DNA, 27 bp, Artificial Sequence
  Description of Artificial Sequence: Synthetic oligonucleotide
accctgctccgctactacaaccagagc

SEQ ID NO: 376216 - DNA, 26 bp, Artificial Sequence
  Description of Artificial Sequence: Synthetic oligonucleotide
ccctgctccgctactacaaccagagc

SEQ ID NO: 376217 - DNA, 27 bp, Artificial Sequence
  Description of Artificial Sequence: Synthetic oligonucleotide
cctgctccgctactacaaccagagcga

SEQ ID NO: 376218 - DNA, 27 bp, Artificial Sequence
  Description of Artificial Sequence: Synthetic oligonucleotide
ctgctccgctactacaaccagagcgag

SEQ ID NO: 376219 - DNA, 27 bp, Artificial Sequence
  Description of Artificial Sequence: Synthetic oligonucleotide
tgctccgctactacaaccagagcgagg

SEQ ID NO: 376220 - DNA, 26 bp, Artificial Sequence
  Description of Artificial Sequence: Synthetic oligonucleotide
ggccaaggcacagactgaccgagaga

SEQ ID NO: 376221 - DNA, 26 bp, Artificial Sequence
  Description of Artificial Sequence: Synthetic oligonucleotide
gccaaggcacagactgaccgagagag

SEQ ID NO: 376222 - DNA, 26 bp, Artificial Sequence
  Description of Artificial Sequence: Synthetic oligonucleotide
ccaaggcacagactgaccgagagagc

SEQ ID NO: 376223 - DNA, 27 bp, Artificial Sequence
  Description of Artificial Sequence: Synthetic oligonucleotide
caaggcacagactgaccgagagagcct

SEQ ID NO: 376224 - DNA, 27 bp, Artificial Sequence
  Description of Artificial Sequence: Synthetic oligonucleotide
aaggcacagactgaccgagagagcctg

SEQ ID NO: 376225 - DNA, 26 bp, Artificial Sequence
  Description of Artificial Sequence: Synthetic oligonucleotide
acagactgaccgagagagcctgcgga

SEQ ID NO: 376226 - DNA, 25 bp, Artificial Sequence
  Description of Artificial Sequence: Synthetic oligonucleotide
cagactgaccgagagagcctgcgga

SEQ ID NO: 376227 - DNA, 25 bp, Artificial Sequence
  Description of Artificial Sequence: Synthetic oligonucleotide
agactgaccgagagagcctgcggac

SEQ ID NO: 376228 - DNA, 24 bp, Artificial Sequence
  Description of Artificial Sequence: Synthetic oligonucleotide
gactgaccgagagagcctgcggac

SEQ ID NO: 376229 - DNA, 24 bp, Artificial Sequence
  Description of Artificial Sequence: Synthetic oligonucleotide
actgaccgagagagcctgcggacc

SEQ ID NO: 376230 - DNA, 23 bp, Artificial Sequence
  Description of Artificial Sequence: Synthetic oligonucleotide
ctgaccgagagagcctgcggacc

SEQ ID NO: 376231 - DNA, 24 bp, Artificial Sequence
  Description of Artificial Sequence: Synthetic oligonucleotide
tgaccgagagagcctgcggaccct

SEQ ID NO: 376232 - DNA, 23 bp, Artificial Sequence
  Description of Artificial Sequence: Synthetic oligonucleotide
gaccgagagagcctgcggaccct

SEQ ID NO: 376233 - DNA, 23 bp, Artificial Sequence
  Description of Artificial Sequence: Synthetic oligonucleotide
accgagagagcctgcggaccctg

SEQ ID NO: 376234 - DNA, 22 bp, Artificial Sequence
  Description of Artificial Sequence: Synthetic oligonucleotide
ccgagagagcctgcggaccctg

SEQ ID NO: 376235 - DNA, 23 bp, Artificial Sequence
  Description of Artificial Sequence: Synthetic oligonucleotide
cgagagagcctgcggaccctgct

SEQ ID NO: 376236 - DNA, 23 bp, Artificial Sequence
  Description of Artificial Sequence: Synthetic oligonucleotide
gagagagcctgcggaccctgctc

SEQ ID NO: 376237 - DNA, 23 bp, Artificial Sequence
  Description of Artificial Sequence: Synthetic oligonucleotide
agagagcctgcggaccctgctcc

SEQ ID NO: 376238 - DNA, 22 bp, Artificial Sequence
  Description of Artificial Sequence: Synthetic oligonucleotide
gagagcctgcggaccctgctcc

SEQ ID NO: 376239 - DNA, 22 bp, Artificial Sequence
  Description of Artificial Sequence: Synthetic oligonucleotide
agagcctgcggaccctgctccg

SEQ ID NO: 376240 - DNA, 21 bp, Artificial Sequence
  Description of Artificial Sequence: Synthetic oligonucleotide
gagcctgcggaccctgctccg

SEQ ID NO: 376241 - DNA, 23 bp, Artificial Sequence
  Description of Artificial Sequence: Synthetic oligonucleotide
agcctgcggaccctgctccgcta

SEQ ID NO: 376242 - DNA, 22 bp, Artificial Sequence
  Description of Artificial Sequence: Synthetic oligonucleotide
gcctgcggaccctgctccgcta

SEQ ID NO: 376243 - DNA, 23 bp, Artificial Sequence
  Description of Artificial Sequence: Synthetic oligonucleotide
tgggccctgggcttctaccctgg

SEQ ID NO: 376244 - DNA, 22 bp, Artificial Sequence
  Description of Artificial Sequence: Synthetic oligonucleotide
gggccctgggcttctaccctgg

SEQ ID NO: 376245 - DNA, 22 bp, Artificial Sequence
  Description of Artificial Sequence: Synthetic oligonucleotide
ggccctgggcttctaccctggg

SEQ ID NO: 376246 - DNA, 23 bp, Artificial Sequence
  Description of Artificial Sequence: Synthetic oligonucleotide
gccctgggcttctaccctgggga

SEQ ID NO: 376247 - DNA, 25 bp, Artificial Sequence
  Description of Artificial Sequence: Synthetic oligonucleotide
ccctgggcttctaccctggggagat

SEQ ID NO: 376248 - DNA, 26 bp, Artificial Sequence
  Description of Artificial Sequence: Synthetic oligonucleotide
cctgggcttctaccctggggagatca

SEQ ID NO: 376249 - DNA, 27 bp, Artificial Sequence
  Description of Artificial Sequence: Synthetic oligonucleotide
ctgggcttctaccctggggagatcaca

SEQ ID NO: 376250 - DNA, 27 bp, Artificial Sequence
  Description of Artificial Sequence: Synthetic oligonucleotide
tgggcttctaccctggggagatcacac

SEQ ID NO: 376251 - DNA, 27 bp, Artificial Sequence
  Description of Artificial Sequence: Synthetic oligonucleotide
gggcttctaccctggggagatcacact

SEQ ID NO: 376252 - DNA, 27 bp, Artificial Sequence
  Description of Artificial Sequence: Synthetic oligonucleotide
ggcttctaccctggggagatcacactg

SEQ ID NO: 376253 - DNA, 28 bp, Artificial Sequence
  Description of Artificial Sequence: Synthetic oligonucleotide
gcttctaccctggggagatcacactgac

SEQ ID NO: 376254 - DNA, 28 bp, Artificial Sequence
  Description of Artificial Sequence: Synthetic oligonucleotide
cttctaccctggggagatcacactgacc

SEQ ID NO: 376255 - DNA, 29 bp, Artificial Sequence
  Description of Artificial Sequence: Synthetic oligonucleotide
ttctaccctggggagatcacactgacctg

SEQ ID NO: 376256 - DNA, 28 bp, Artificial Sequence
  Description of Artificial Sequence: Synthetic oligonucleotide
tctaccctggggagatcacactgacctg

SEQ ID NO: 376257 - DNA, 27 bp, Artificial Sequence
  Description of Artificial Sequence: Synthetic oligonucleotide
ctaccctggggagatcacactgacctg

SEQ ID NO: 376258 - DNA, 27 bp, Artificial Sequence
  Description of Artificial Sequence: Synthetic oligonucleotide
taccctggggagatcacactgacctgg

SEQ ID NO: 376259 - DNA, 26 bp, Artificial Sequence
  Description of Artificial Sequence: Synthetic oligonucleotide
accctggggagatcacactgacctgg

SEQ ID NO: 376260 - DNA, 25 bp, Artificial Sequence
  Description of Artificial Sequence: Synthetic oligonucleotide
ccctggggagatcacactgacctgg

SEQ ID NO: 376261 - DNA, 26 bp, Artificial Sequence
  Description of Artificial Sequence: Synthetic oligonucleotide
cctggggagatcacactgacctggca

SEQ ID NO: 376262 - DNA, 26 bp, Artificial Sequence
  Description of Artificial Sequence: Synthetic oligonucleotide
ctggggagatcacactgacctggcag

SEQ ID NO: 376263 - DNA, 26 bp, Artificial Sequence
  Description of Artificial Sequence: Synthetic oligonucleotide
tggggagatcacactgacctggcagc

SEQ ID NO: 376264 - DNA, 25 bp, Artificial Sequence
  Description of Artificial Sequence: Synthetic oligonucleotide
ggggagatcacactgacctggcagc

SEQ ID NO: 376265 - DNA, 25 bp, Artificial Sequence
  Description of Artificial Sequence: Synthetic oligonucleotide
gggagatcacactgacctggcagcg

SEQ ID NO: 376266 - DNA, 25 bp, Artificial Sequence
  Description of Artificial Sequence: Synthetic oligonucleotide
cgggtaccaccaggacgcctacgat

SEQ ID NO: 376267 - DNA, 25 bp, Artificial Sequence
  Description of Artificial Sequence: Synthetic oligonucleotide
gggtaccaccaggacgcctacgatg

SEQ ID NO: 376268 - DNA, 25 bp, Artificial Sequence
  Description of Artificial Sequence: Synthetic oligonucleotide
ggtaccaccaggacgcctacgatgg

SEQ ID NO: 376269 - DNA, 27 bp, Artificial Sequence
  Description of Artificial Sequence: Synthetic oligonucleotide
gtaccaccaggacgcctacgatggcaa

SEQ ID NO: 376270 - DNA, 27 bp, Artificial Sequence
  Description of Artificial Sequence: Synthetic oligonucleotide
taccaccaggacgcctacgatggcaag

SEQ ID NO: 376271 - DNA, 26 bp, Artificial Sequence
  Description of Artificial Sequence: Synthetic oligonucleotide
accaccaggacgcctacgatggcaag

SEQ ID NO: 376272 - DNA, 25 bp, Artificial Sequence
  Description of Artificial Sequence: Synthetic oligonucleotide
ccaccaggacgcctacgatggcaag

SEQ ID NO: 376273 - DNA, 27 bp, Artificial Sequence
  Description of Artificial Sequence: Synthetic oligonucleotide
caccaggacgcctacgatggcaaggat

SEQ ID NO: 376274 - DNA, 29 bp, Artificial Sequence
  Description of Artificial Sequence: Synthetic oligonucleotide
accaggacgcctacgatggcaaggattac

SEQ ID NO: 376275 - DNA, 28 bp, Artificial Sequence
  Description of Artificial Sequence: Synthetic oligonucleotide
ccaggacgcctacgatggcaaggattac

SEQ ID NO: 376276 - DNA, 30 bp, Artificial Sequence; identical to SEQ ID NO: 30518
  Description of Artificial Sequence: Synthetic oligonucleotide

SEQ ID NO: 376277 - DNA, 30 bp, Artificial Sequence; identical to SEQ ID NO: 30519
  Description of Artificial Sequence: Synthetic oligonucleotide

SEQ ID NO: 376278 - DNA, 29 bp, Artificial Sequence
  Description of Artificial Sequence: Synthetic oligonucleotide
ggacgcctacgatggcaaggattacatcg

SEQ ID NO: 376279 - DNA, 29 bp, Artificial Sequence
  Description of Artificial Sequence: Synthetic oligonucleotide
gacgcctacgatggcaaggattacatcgc

SEQ ID NO: 376280 - DNA, 31 bp, Artificial Sequence; identical to SEQ ID NO: 30526
  Description of Artificial Sequence: Synthetic oligonucleotide

SEQ ID NO: 376281 - DNA, 31 bp, Artificial Sequence; identical to SEQ ID NO: 30527
  Description of Artificial Sequence: Synthetic oligonucleotide

SEQ ID NO: 376282 - DNA, 30 bp, Artificial Sequence; identical to SEQ ID NO: 30528
  Description of Artificial Sequence: Synthetic oligonucleotide

SEQ ID NO: 376283 - DNA, 29 bp, Artificial Sequence
  Description of Artificial Sequence: Synthetic oligonucleotide
cgatggcaaggattacatcgccctgaacg

SEQ ID NO: 376284 - DNA, 30 bp, Artificial Sequence; identical to SEQ ID NO: 30530
  Description of Artificial Sequence: Synthetic oligonucleotide

SEQ ID NO: 376285 - DNA, 30 bp, Artificial Sequence; identical to SEQ ID NO: 30531
  Description of Artificial Sequence: Synthetic oligonucleotide

SEQ ID NO: 376286 - DNA, 29 bp, Artificial Sequence
  Description of Artificial Sequence: Synthetic oligonucleotide
tggcaaggattacatcgccctgaacgagg

SEQ ID NO: 376287 - DNA, 27 bp, Artificial Sequence
  Description of Artificial Sequence: Synthetic oligonucleotide
taccaccaggacgcctacgacggcaaa

SEQ ID NO: 376288 - DNA, 26 bp, Artificial Sequence
  Description of Artificial Sequence: Synthetic oligonucleotide
accaccaggacgcctacgacggcaaa

SEQ ID NO: 376289 - DNA, 25 bp, Artificial Sequence
  Description of Artificial Sequence: Synthetic oligonucleotide
ccaccaggacgcctacgacggcaaa

SEQ ID NO: 376290 - DNA, 27 bp, Artificial Sequence
  Description of Artificial Sequence: Synthetic oligonucleotide
caccaggacgcctacgacggcaaagat

SEQ ID NO: 376291 - DNA, 29 bp, Artificial Sequence
  Description of Artificial Sequence: Synthetic oligonucleotide
accaggacgcctacgacggcaaagattac

SEQ ID NO: 376292 - DNA, 28 bp, Artificial Sequence
  Description of Artificial Sequence: Synthetic oligonucleotide
ccaggacgcctacgacggcaaagattac

SEQ ID NO: 376293 - DNA, 30 bp, Artificial Sequence; identical to SEQ ID NO: 30539
  Description of Artificial Sequence: Synthetic oligonucleotide

SEQ ID NO: 376294 - DNA, 30 bp, Artificial Sequence; identical to SEQ ID NO: 30540
  Description of Artificial Sequence: Synthetic oligonucleotide

SEQ ID NO: 376295 - DNA, 29 bp, Artificial Sequence
  Description of Artificial Sequence: Synthetic oligonucleotide
ggacgcctacgacggcaaagattacatcg

SEQ ID NO: 376296 - DNA, 29 bp, Artificial Sequence
  Description of Artificial Sequence: Synthetic oligonucleotide
gacgcctacgacggcaaagattacatcgc

SEQ ID NO: 376297 - DNA, 21 bp, Artificial Sequence
  Description of Artificial Sequence: Synthetic oligonucleotide
tggaccgccgcggacacggca

SEQ ID NO: 376298 - DNA, 20 bp, Artificial Sequence
  Description of Artificial Sequence: Synthetic oligonucleotide
ggaccgccgcggacacggca

SEQ ID NO: 376299 - DNA, 20 bp, Artificial Sequence
  Description of Artificial Sequence: Synthetic oligonucleotide
gaccgccgcggacacggcag

SEQ ID NO: 376300 - DNA, 21 bp, Artificial Sequence
  Description of Artificial Sequence: Synthetic oligonucleotide
accgccgcggacacggcagct

SEQ ID NO: 376301 - DNA, 20 bp, Artificial Sequence
  Description of Artificial Sequence: Synthetic oligonucleotide
ccgccgcggacacggcagct

SEQ ID NO: 376302 - DNA, 21 bp, Artificial Sequence
  Description of Artificial Sequence: Synthetic oligonucleotide
cgccgcggacacggcagctca

SEQ ID NO: 376303 - DNA, 23 bp, Artificial Sequence
  Description of Artificial Sequence: Synthetic oligonucleotide
gccgcggacacggcagctcagat

SEQ ID NO: 376304 - DNA, 24 bp, Artificial Sequence
  Description of Artificial Sequence: Synthetic oligonucleotide
ccgcggacacggcagctcagatca

SEQ ID NO: 376305 - DNA, 24 bp, Artificial Sequence
  Description of Artificial Sequence: Synthetic oligonucleotide
cgcggacacggcagctcagatcac

SEQ ID NO: 376306 - DNA, 27 bp, Artificial Sequence
  Description of Artificial Sequence: Synthetic oligonucleotide
ccggctcccactccatgaggtatttcc

SEQ ID NO: 376307 - DNA, 28 bp, Artificial Sequence
  Description of Artificial Sequence: Synthetic oligonucleotide
cggctcccactccatgaggtatttccac

SEQ ID NO: 376308 - DNA, 27 bp, Artificial Sequence
  Description of Artificial Sequence: Synthetic oligonucleotide
gaggccggttctcacaccctccagaat

SEQ ID NO: 376309 - DNA, 29 bp, Artificial Sequence
  Description of Artificial Sequence: Synthetic oligonucleotide
aggccggttctcacaccctccagaatatg

SEQ ID NO: 376310 - DNA, 28 bp, Artificial Sequence
  Description of Artificial Sequence: Synthetic oligonucleotide
ggccggttctcacaccctccagaatatg

SEQ ID NO: 376311 - DNA, 31 bp, Artificial Sequence; identical to SEQ ID NO: 30555
  Description of Artificial Sequence: Synthetic oligonucleotide

SEQ ID NO: 376312 - DNA, 31 bp, Artificial Sequence; identical to SEQ ID NO: 30556
  Description of Artificial Sequence: Synthetic oligonucleotide

SEQ ID NO: 376313 - DNA, 31 bp, Artificial Sequence; identical to SEQ ID NO: 30557
  Description of Artificial Sequence: Synthetic oligonucleotide

SEQ ID NO: 376314 - DNA, 32 bp, Artificial Sequence; identical to SEQ ID NO: 30558
  Description of Artificial Sequence: Synthetic oligonucleotide

SEQ ID NO: 376315 - DNA, 32 bp, Artificial Sequence; identical to SEQ ID NO: 30559
  Description of Artificial Sequence: Synthetic oligonucleotide

SEQ ID NO: 376316 - DNA, 32 bp, Artificial Sequence; identical to SEQ ID NO: 30560
  Description of Artificial Sequence: Synthetic oligonucleotide

SEQ ID NO: 376317 - DNA, 27 bp, Artificial Sequence
  Description of Artificial Sequence: Synthetic oligonucleotide
tatttccacacctccgtgtcccggcct

SEQ ID NO: 376318 - DNA, 26 bp, Artificial Sequence
  Description of Artificial Sequence: Synthetic oligonucleotide
atttccacacctccgtgtcccggcct

SEQ ID NO: 376319 - DNA, 25 bp, Artificial Sequence
  Description of Artificial Sequence: Synthetic oligonucleotide
tttccacacctccgtgtcccggcct

SEQ ID NO: 376320 - DNA, 24 bp, Artificial Sequence
  Description of Artificial Sequence: Synthetic oligonucleotide
ttccacacctccgtgtcccggcct

SEQ ID NO: 376321 - DNA, 23 bp, Artificial Sequence
  Description of Artificial Sequence: Synthetic oligonucleotide
tccacacctccgtgtcccggcct

SEQ ID NO: 376322 - DNA, 22 bp, Artificial Sequence
  Description of Artificial Sequence: Synthetic oligonucleotide
ccacacctccgtgtcccggcct

SEQ ID NO: 376323 - DNA, 22 bp, Artificial Sequence
  Description of Artificial Sequence: Synthetic oligonucleotide
cacacctccgtgtcccggcctg

SEQ ID NO: 376324 - DNA, 26 bp, Artificial Sequence
  Description of Artificial Sequence: Synthetic oligonucleotide
cggagcagctgagagcctacctggaa

SEQ ID NO: 376325 - DNA, 26 bp, Artificial Sequence
  Description of Artificial Sequence: Synthetic oligonucleotide
ggagcagctgagagcctacctggaag

SEQ ID NO: 376326 - DNA, 26 bp, Artificial Sequence
  Description of Artificial Sequence: Synthetic oligonucleotide
gagcagctgagagcctacctggaagg

SEQ ID NO: 376327 - DNA, 26 bp, Artificial Sequence
  Description of Artificial Sequence: Synthetic oligonucleotide
agcagctgagagcctacctggaaggc

SEQ ID NO: 376328 - DNA, 25 bp, Artificial Sequence
  Description of Artificial Sequence: Synthetic oligonucleotide
gcagctgagagcctacctggaaggc

SEQ ID NO: 376329 - DNA, 26 bp, Artificial Sequence
  Description of Artificial Sequence: Synthetic oligonucleotide
cagctgagagcctacctggaaggcga

SEQ ID NO: 376330 - DNA, 27 bp, Artificial Sequence
  Description of Artificial Sequence: Synthetic oligonucleotide
agctgagagcctacctggaaggcgagt

SEQ ID NO: 376331 - DNA, 26 bp, Artificial Sequence
  Description of Artificial Sequence: Synthetic oligonucleotide
gctgagagcctacctggaaggcgagt

SEQ ID NO: 376332 - DNA, 26 bp, Artificial Sequence
  Description of Artificial Sequence: Synthetic oligonucleotide
ctgagagcctacctggaaggcgagtg

SEQ ID NO: 376333 - DNA, 26 bp, Artificial Sequence
  Description of Artificial Sequence: Synthetic oligonucleotide
tgagagcctacctggaaggcgagtgc

SEQ ID NO: 376334 - DNA, 25 bp, Artificial Sequence
  Description of Artificial Sequence: Synthetic oligonucleotide
gagagcctacctggaaggcgagtgc

SEQ ID NO: 376335 - DNA, 26 bp, Artificial Sequence
  Description of Artificial Sequence: Synthetic oligonucleotide
agagcctacctggaaggcgagtgcgt

SEQ ID NO: 376336 - DNA, 25 bp, Artificial Sequence
  Description of Artificial Sequence: Synthetic oligonucleotide
gagcctacctggaaggcgagtgcgt

SEQ ID NO: 376337 - DNA, 25 bp, Artificial Sequence
  Description of Artificial Sequence: Synthetic oligonucleotide
agcctacctggaaggcgagtgcgtg

SEQ ID NO: 376338 - DNA, 24 bp, Artificial Sequence
  Description of Artificial Sequence: Synthetic oligonucleotide
gcctacctggaaggcgagtgcgtg

SEQ ID NO: 376339 - DNA, 25 bp, Artificial Sequence
  Description of Artificial Sequence: Synthetic oligonucleotide
cctacctggaaggcgagtgcgtgga

SEQ ID NO: 376340 - DNA, 26 bp, Artificial Sequence
  Description of Artificial Sequence: Synthetic oligonucleotide
ctacctggaaggcgagtgcgtggagt

SEQ ID NO: 376341 - DNA, 26 bp, Artificial Sequence
  Description of Artificial Sequence: Synthetic oligonucleotide
tacctggaaggcgagtgcgtggagtg

SEQ ID NO: 376342 - DNA, 25 bp, Artificial Sequence
  Description of Artificial Sequence: Synthetic oligonucleotide
acctggaaggcgagtgcgtggagtg

SEQ ID NO: 376343 - DNA, 24 bp, Artificial Sequence
  Description of Artificial Sequence: Synthetic oligonucleotide
cctggaaggcgagtgcgtggagtg

SEQ ID NO: 376344 - DNA, 24 bp, Artificial Sequence
  Description of Artificial Sequence: Synthetic oligonucleotide
ctggaaggcgagtgcgtggagtgg

SEQ ID NO: 376345 - DNA, 25 bp, Artificial Sequence
  Description of Artificial Sequence: Synthetic oligonucleotide
tggaaggcgagtgcgtggagtggct

SEQ ID NO: 376346 - DNA, 24 bp, Artificial Sequence
  Description of Artificial Sequence: Synthetic oligonucleotide
ggaaggcgagtgcgtggagtggct

SEQ ID NO: 376347 - DNA, 24 bp, Artificial Sequence
  Description of Artificial Sequence: Synthetic oligonucleotide
gaaggcgagtgcgtggagtggctc

SEQ ID NO: 376348 - DNA, 24 bp, Artificial Sequence
  Description of Artificial Sequence: Synthetic oligonucleotide
aaggcgagtgcgtggagtggctcc

SEQ ID NO: 376349 - DNA, 23 bp, Artificial Sequence
  Description of Artificial Sequence: Synthetic oligonucleotide
aggcgagtgcgtggagtggctcc

SEQ ID NO: 376350 - DNA, 31 bp, Artificial Sequence; identical to SEQ ID NO: 30617
  Description of Artificial Sequence: Synthetic oligonucleotide

SEQ ID NO: 376351 - DNA, 30 bp, Artificial Sequence; identical to SEQ ID NO: 30618
  Description of Artificial Sequence: Synthetic oligonucleotide

SEQ ID NO: 376352 - DNA, 29 bp, Artificial Sequence
  Description of Artificial Sequence: Synthetic oligonucleotide
ttgggaccgggagacacagatctgcaaag

SEQ ID NO: 376353 - DNA, 28 bp, Artificial Sequence
  Description of Artificial Sequence: Synthetic oligonucleotide
tgggaccgggagacacagatctgcaaag

SEQ ID NO: 376354 - DNA, 27 bp, Artificial Sequence
  Description of Artificial Sequence: Synthetic oligonucleotide
gggaccgggagacacagatctgcaaag

SEQ ID NO: 376355 - DNA, 27 bp, Artificial Sequence
  Description of Artificial Sequence: Synthetic oligonucleotide
ggaccgggagacacagatctgcaaagc

SEQ ID NO: 376356 - DNA, 27 bp, Artificial Sequence
  Description of Artificial Sequence: Synthetic oligonucleotide
gaccgggagacacagatctgcaaagcc

SEQ ID NO: 376357 - DNA, 29 bp, Artificial Sequence
  Description of Artificial Sequence: Synthetic oligonucleotide
accgggagacacagatctgcaaagccaag

SEQ ID NO: 376358 - DNA, 28 bp, Artificial Sequence
  Description of Artificial Sequence: Synthetic oligonucleotide
ccgggagacacagatctgcaaagccaag

SEQ ID NO: 376359 - DNA, 28 bp, Artificial Sequence
  Description of Artificial Sequence: Synthetic oligonucleotide
cgggagacacagatctgcaaagccaagg

SEQ ID NO: 376360 - DNA, 28 bp, Artificial Sequence
  Description of Artificial Sequence: Synthetic oligonucleotide
gggagacacagatctgcaaagccaaggc

SEQ ID NO: 376361 - DNA, 29 bp, Artificial Sequence
  Description of Artificial Sequence: Synthetic oligonucleotide
ggagacacagatctgcaaagccaaggcac

SEQ ID NO: 376362 - DNA, 30 bp, Artificial Sequence; identical to SEQ ID NO: 30629
  Description of Artificial Sequence: Synthetic oligonucleotide

SEQ ID NO: 376363 - DNA, 31 bp, Artificial Sequence; identical to SEQ ID NO: 30630
  Description of Artificial Sequence: Synthetic oligonucleotide

SEQ ID NO: 376364 - DNA, 30 bp, Artificial Sequence; identical to SEQ ID NO: 30631
  Description of Artificial Sequence: Synthetic oligonucleotide

SEQ ID NO: 376365 - DNA, 31 bp, Artificial Sequence; identical to SEQ ID NO: 30632
  Description of Artificial Sequence: Synthetic oligonucleotide

SEQ ID NO: 376366 - DNA, 30 bp, Artificial Sequence; identical to SEQ ID NO: 30633
  Description of Artificial Sequence: Synthetic oligonucleotide

SEQ ID NO: 376367 - DNA, 31 bp, Artificial Sequence; identical to SEQ ID NO: 30634
  Description of Artificial Sequence: Synthetic oligonucleotide

SEQ ID NO: 376368 - DNA, 30 bp, Artificial Sequence; identical to SEQ ID NO: 30635
  Description of Artificial Sequence: Synthetic oligonucleotide

SEQ ID NO: 376369 - DNA, 30 bp, Artificial Sequence; identical to SEQ ID NO: 30636
  Description of Artificial Sequence: Synthetic oligonucleotide

SEQ ID NO: 376370 - DNA, 29 bp, Artificial Sequence
  Description of Artificial Sequence: Synthetic oligonucleotide
gatctgcaaagccaaggcacagactgacc

SEQ ID NO: 376371 - DNA, 29 bp, Artificial Sequence
  Description of Artificial Sequence: Synthetic oligonucleotide
atctgcaaagccaaggcacagactgaccg

SEQ ID NO: 376372 - DNA, 28 bp, Artificial Sequence
  Description of Artificial Sequence: Synthetic oligonucleotide
tctgcaaagccaaggcacagactgaccg

SEQ ID NO: 376373 - DNA, 27 bp, Artificial Sequence
  Description of Artificial Sequence: Synthetic oligonucleotide
ctgcaaagccaaggcacagactgaccg

SEQ ID NO: 376374 - DNA, 28 bp, Artificial Sequence
  Description of Artificial Sequence: Synthetic oligonucleotide
tgcaaagccaaggcacagactgaccgag

SEQ ID NO: 376375 - DNA, 27 bp, Artificial Sequence
  Description of Artificial Sequence: Synthetic oligonucleotide
gcaaagccaaggcacagactgaccgag

SEQ ID NO: 376376 - DNA, 28 bp, Artificial Sequence
  Description of Artificial Sequence: Synthetic oligonucleotide
caaagccaaggcacagactgaccgagag

SEQ ID NO: 376377 - DNA, 28 bp, Artificial Sequence
  Description of Artificial Sequence: Synthetic oligonucleotide
aaagccaaggcacagactgaccgagagg

SEQ ID NO: 376378 - DNA, 27 bp, Artificial Sequence
  Description of Artificial Sequence: Synthetic oligonucleotide
aagccaaggcacagactgaccgagagg

SEQ ID NO: 376379 - DNA, 27 bp, Artificial Sequence
  Description of Artificial Sequence: Synthetic oligonucleotide
agccaaggcacagactgaccgagagga

SEQ ID NO: 376380 - DNA, 22 bp, Artificial Sequence
  Description of Artificial Sequence: Synthetic oligonucleotide
tccgagagaggagccgcgggca

SEQ ID NO: 376381 - DNA, 21 bp, Artificial Sequence
  Description of Artificial Sequence: Synthetic oligonucleotide
ccgagagaggagccgcgggca

SEQ ID NO: 376382 - DNA, 21 bp, Artificial Sequence
  Description of Artificial Sequence: Synthetic oligonucleotide
cgagagaggagccgcgggcac

SEQ ID NO: 376383 - DNA, 21 bp, Artificial Sequence
  Description of Artificial Sequence: Synthetic oligonucleotide
gagagaggagccgcgggcacc

SEQ ID NO: 376384 - DNA, 22 bp, Artificial Sequence
  Description of Artificial Sequence: Synthetic oligonucleotide
agagaggagccgcgggcaccgt

SEQ ID NO: 376385 - DNA, 21 bp, Artificial Sequence
  Description of Artificial Sequence: Synthetic oligonucleotide
gagaggagccgcgggcaccgt

SEQ ID NO: 376386 - DNA, 21 bp, Artificial Sequence
  Description of Artificial Sequence: Synthetic oligonucleotide
agaggagccgcgggcaccgtg

SEQ ID NO: 376387 - DNA, 20 bp, Artificial Sequence
  Description of Artificial Sequence: Synthetic oligonucleotide
gaggagccgcgggcaccgtg

SEQ ID NO: 376388 - DNA, 23 bp, Artificial Sequence
  Description of Artificial Sequence: Synthetic oligonucleotide
aggagccgcgggcaccgtggata

SEQ ID NO: 376389 - DNA, 29 bp, Artificial Sequence
  Description of Artificial Sequence: Synthetic oligonucleotide
atctgcaaggccaaggcacagactgacag

SEQ ID NO: 376390 - DNA, 28 bp, Artificial Sequence
  Description of Artificial Sequence: Synthetic oligonucleotide
tctgcaaggccaaggcacagactgacag

SEQ ID NO: 376391 - DNA, 27 bp, Artificial Sequence
  Description of Artificial Sequence: Synthetic oligonucleotide
ctgcaaggccaaggcacagactgacag

SEQ ID NO: 376392 - DNA, 28 bp, Artificial Sequence
  Description of Artificial Sequence: Synthetic oligonucleotide
tgcaaggccaaggcacagactgacagag

SEQ ID NO: 376393 - DNA, 27 bp, Artificial Sequence
  Description of Artificial Sequence: Synthetic oligonucleotide
gcaaggccaaggcacagactgacagag

SEQ ID NO: 376394 - DNA, 28 bp, Artificial Sequence
  Description of Artificial Sequence: Synthetic oligonucleotide
caaggccaaggcacagactgacagagag

SEQ ID NO: 376395 - DNA, 28 bp, Artificial Sequence
  Description of Artificial Sequence: Synthetic oligonucleotide
aaggccaaggcacagactgacagagagg

SEQ ID NO: 376396 - DNA, 27 bp, Artificial Sequence
  Description of Artificial Sequence: Synthetic oligonucleotide
aggccaaggcacagactgacagagagg

SEQ ID NO: 376397 - DNA, 27 bp, Artificial Sequence
  Description of Artificial Sequence: Synthetic oligonucleotide
ggccaaggcacagactgacagagagga

SEQ ID NO: 376398 - DNA, 27 bp, Artificial Sequence
  Description of Artificial Sequence: Synthetic oligonucleotide
gccaaggcacagactgacagagaggac

SEQ ID NO: 376399 - DNA, 27 bp, Artificial Sequence
  Description of Artificial Sequence: Synthetic oligonucleotide
ccaaggcacagactgacagagaggacc

SEQ ID NO: 376400 - DNA, 28 bp, Artificial Sequence
  Description of Artificial Sequence: Synthetic oligonucleotide
caaggcacagactgacagagaggacctg

SEQ ID NO: 376401 - DNA, 28 bp, Artificial Sequence
  Description of Artificial Sequence: Synthetic oligonucleotide
aaggcacagactgacagagaggacctgc

SEQ ID NO: 376402 - DNA, 27 bp, Artificial Sequence
  Description of Artificial Sequence: Synthetic oligonucleotide
aggcacagactgacagagaggacctgc

SEQ ID NO: 376403 - DNA, 26 bp, Artificial Sequence
  Description of Artificial Sequence: Synthetic oligonucleotide
ggcacagactgacagagaggacctgc

SEQ ID NO: 376404 - DNA, 26 bp, Artificial Sequence
  Description of Artificial Sequence: Synthetic oligonucleotide
gcacagactgacagagaggacctgcg

SEQ ID NO: 376405 - DNA, 27 bp, Artificial Sequence
  Description of Artificial Sequence: Synthetic oligonucleotide
cacagactgacagagaggacctgcgga

SEQ ID NO: 376406 - DNA, 27 bp, Artificial Sequence
  Description of Artificial Sequence: Synthetic oligonucleotide
acagactgacagagaggacctgcggac

SEQ ID NO: 376407 - DNA, 26 bp, Artificial Sequence
  Description of Artificial Sequence: Synthetic oligonucleotide
cagactgacagagaggacctgcggac

SEQ ID NO: 376408 - DNA, 26 bp, Artificial Sequence
  Description of Artificial Sequence: Synthetic oligonucleotide
agactgacagagaggacctgcggacc

SEQ ID NO: 376409 - DNA, 25 bp, Artificial Sequence
  Description of Artificial Sequence: Synthetic oligonucleotide
gactgacagagaggacctgcggacc

SEQ ID NO: 376410 - DNA, 26 bp, Artificial Sequence
  Description of Artificial Sequence: Synthetic oligonucleotide
actgacagagaggacctgcggaccct

SEQ ID NO: 376411 - DNA, 25 bp, Artificial Sequence
  Description of Artificial Sequence: Synthetic oligonucleotide
ctgacagagaggacctgcggaccct

SEQ ID NO: 376412 - DNA, 25 bp, Artificial Sequence
  Description of Artificial Sequence: Synthetic oligonucleotide
tgacagagaggacctgcggaccctg

SEQ ID NO: 376413 - DNA, 24 bp, Artificial Sequence
  Description of Artificial Sequence: Synthetic oligonucleotide
gacagagaggacctgcggaccctg

SEQ ID NO: 376414 - DNA, 25 bp, Artificial Sequence
  Description of Artificial Sequence: Synthetic oligonucleotide
acagagaggacctgcggaccctgct

SEQ ID NO: 376415 - DNA, 24 bp, Artificial Sequence
  Description of Artificial Sequence: Synthetic oligonucleotide
cagagaggacctgcggaccctgct

SEQ ID NO: 376416 - DNA, 24 bp, Artificial Sequence
  Description of Artificial Sequence: Synthetic oligonucleotide
agagaggacctgcggaccctgctc

SEQ ID NO: 376417 - DNA, 21 bp, Artificial Sequence
  Description of Artificial Sequence: Synthetic oligonucleotide
gggccggagtactgggaccgg

SEQ ID NO: 376418 - DNA, 22 bp, Artificial Sequence
  Description of Artificial Sequence: Synthetic oligonucleotide
ggccggagtactgggaccggga

SEQ ID NO: 376419 - DNA, 23 bp, Artificial Sequence
  Description of Artificial Sequence: Synthetic oligonucleotide
gccggagtactgggaccgggaga

SEQ ID NO: 376420 - DNA, 24 bp, Artificial Sequence
  Description of Artificial Sequence: Synthetic oligonucleotide
ccggagtactgggaccgggagaca

SEQ ID NO: 376421 - DNA, 25 bp, Artificial Sequence
  Description of Artificial Sequence: Synthetic oligonucleotide
cggagtactgggaccgggagacaca

SEQ ID NO: 376422 - DNA, 27 bp, Artificial Sequence
  Description of Artificial Sequence: Synthetic oligonucleotide
ggagtactgggaccgggagacacagat

SEQ ID NO: 376423 - DNA, 27 bp, Artificial Sequence
  Description of Artificial Sequence: Synthetic oligonucleotide
gagtactgggaccgggagacacagatc

SEQ ID NO: 376424 - DNA, 28 bp, Artificial Sequence
  Description of Artificial Sequence: Synthetic oligonucleotide
agtactgggaccgggagacacagatctg

SEQ ID NO: 376425 - DNA, 27 bp, Artificial Sequence
  Description of Artificial Sequence: Synthetic oligonucleotide
gtactgggaccgggagacacagatctg

SEQ ID NO: 376426 - DNA, 27 bp, Artificial Sequence
  Description of Artificial Sequence: Synthetic oligonucleotide
tactgggaccgggagacacagatctgc

SEQ ID NO: 376427 - DNA, 27 bp, Artificial Sequence
  Description of Artificial Sequence: Synthetic oligonucleotide
actgggaccgggagacacagatctgca

SEQ ID NO: 376428 - DNA, 27 bp, Artificial Sequence
  Description of Artificial Sequence: Synthetic oligonucleotide
ctgggaccgggagacacagatctgcaa

SEQ ID NO: 376429 - DNA, 20 bp, Artificial Sequence
  Description of Artificial Sequence: Synthetic oligonucleotide
acgtggggccggacgggcga

SEQ ID NO: 376430 - DNA, 20 bp, Artificial Sequence
  Description of Artificial Sequence: Synthetic oligonucleotide
cgtggggccggacgggcgat

SEQ ID NO: 376431 - DNA, 20 bp, Artificial Sequence
  Description of Artificial Sequence: Synthetic oligonucleotide
gtggggccggacgggcgact

SEQ ID NO: 376432 - DNA, 20 bp, Artificial Sequence
  Description of Artificial Sequence: Synthetic oligonucleotide
tggggccggacgggcgactc

SEQ ID NO: 376433 - DNA, 20 bp, Artificial Sequence
  Description of Artificial Sequence: Synthetic oligonucleotide
ggggccggacgggcgactct

SEQ ID NO: 376434 - DNA, 20 bp, Artificial Sequence
  Description of Artificial Sequence: Synthetic oligonucleotide
gggccggacgggcgactcct

SEQ ID NO: 376435 - DNA, 20 bp, Artificial Sequence
  Description of Artificial Sequence: Synthetic oligonucleotide
ggccggacgggcgactcctc

SEQ ID NO: 376436 - DNA, 20 bp, Artificial Sequence
  Description of Artificial Sequence: Synthetic oligonucleotide
gccggacgggcgactcctcc

SEQ ID NO: 376437 - DNA, 20 bp, Artificial Sequence
  Description of Artificial Sequence: Synthetic oligonucleotide
ccggacgggcgactcctccg

SEQ ID NO: 376438 - DNA, 20 bp, Artificial Sequence
  Description of Artificial Sequence: Synthetic oligonucleotide
cggacgggcgactcctccgc

SEQ ID NO: 376439 - DNA, 20 bp, Artificial Sequence
  Description of Artificial Sequence: Synthetic oligonucleotide
ggacgggcgactcctccgcg

SEQ ID NO: 376440 - DNA, 20 bp, Artificial Sequence
  Description of Artificial Sequence: Synthetic oligonucleotide
gacgggcgactcctccgcgg

SEQ ID NO: 376441 - DNA, 22 bp, Artificial Sequence
  Description of Artificial Sequence: Synthetic oligonucleotide
acgggcgactcctccgcgggta

SEQ ID NO: 376442 - DNA, 21 bp, Artificial Sequence
  Description of Artificial Sequence: Synthetic oligonucleotide
cgggcgactcctccgcgggta

SEQ ID NO: 376443 - DNA, 21 bp, Artificial Sequence
  Description of Artificial Sequence: Synthetic oligonucleotide
gggcgactcctccgcgggtac

SEQ ID NO: 376444 - DNA, 22 bp, Artificial Sequence
  Description of Artificial Sequence: Synthetic oligonucleotide
ggcgactcctccgcgggtacca

SEQ ID NO: 376445 - DNA, 22 bp, Artificial Sequence
  Description of Artificial Sequence: Synthetic oligonucleotide
gcgactcctccgcgggtaccac

SEQ ID NO: 376446 - DNA, 23 bp, Artificial Sequence
  Description of Artificial Sequence: Synthetic oligonucleotide
cgactcctccgcgggtaccacca

SEQ ID NO: 376447 - DNA, 23 bp, Artificial Sequence
  Description of Artificial Sequence: Synthetic oligonucleotide
gactcctccgcgggtaccaccag

SEQ ID NO: 376448 - DNA, 24 bp, Artificial Sequence
  Description of Artificial Sequence: Synthetic oligonucleotide
actcctccgcgggtaccaccagga

SEQ ID NO: 376449 - DNA, 30 bp, Artificial Sequence; identical to SEQ ID NO: 30731
  Description of Artificial Sequence: Synthetic oligonucleotide

SEQ ID NO: 376450 - DNA, 29 bp, Artificial Sequence
  Description of Artificial Sequence: Synthetic oligonucleotide
ccagaatatgtatggctgcgacgtgggac

SEQ ID NO: 376451 - DNA, 29 bp, Artificial Sequence
  Description of Artificial Sequence: Synthetic oligonucleotide
cagaatatgtatggctgcgacgtgggacc

SEQ ID NO: 376452 - DNA, 29 bp, Artificial Sequence
  Description of Artificial Sequence: Synthetic oligonucleotide
agaatatgtatggctgcgacgtgggaccg

SEQ ID NO: 376453 - DNA, 28 bp, Artificial Sequence
  Description of Artificial Sequence: Synthetic oligonucleotide
gaatatgtatggctgcgacgtgggaccg

SEQ ID NO: 376454 - DNA, 28 bp, Artificial Sequence
  Description of Artificial Sequence: Synthetic oligonucleotide
aatatgtatggctgcgacgtgggaccgg

SEQ ID NO: 376455 - DNA, 27 bp, Artificial Sequence
  Description of Artificial Sequence: Synthetic oligonucleotide
atatgtatggctgcgacgtgggaccgg

SEQ ID NO: 376456 - DNA, 27 bp, Artificial Sequence
  Description of Artificial Sequence: Synthetic oligonucleotide
tatgtatggctgcgacgtgggaccgga

SEQ ID NO: 376457 - DNA, 26 bp, Artificial Sequence
  Description of Artificial Sequence: Synthetic oligonucleotide
atgtatggctgcgacgtgggaccgga

SEQ ID NO: 376458 - DNA, 25 bp, Artificial Sequence
  Description of Artificial Sequence: Synthetic oligonucleotide
tgtatggctgcgacgtgggaccgga

SEQ ID NO: 376459 - DNA, 24 bp, Artificial Sequence
  Description of Artificial Sequence: Synthetic oligonucleotide
gtatggctgcgacgtgggaccgga

SEQ ID NO: 376460 - DNA, 24 bp, Artificial Sequence
  Description of Artificial Sequence: Synthetic oligonucleotide
tatggctgcgacgtgggaccggac

SEQ ID NO: 376461 - DNA, 23 bp, Artificial Sequence
  Description of Artificial Sequence: Synthetic oligonucleotide
atggctgcgacgtgggaccggac

SEQ ID NO: 376462 - DNA, 22 bp, Artificial Sequence
  Description of Artificial Sequence: Synthetic oligonucleotide
tggctgcgacgtgggaccggac

SEQ ID NO: 376463 - DNA, 21 bp, Artificial Sequence
  Description of Artificial Sequence: Synthetic oligonucleotide
ggctgcgacgtgggaccggac

SEQ ID NO: 376464 - DNA, 21 bp, Artificial Sequence
  Description of Artificial Sequence: Synthetic oligonucleotide
gctgcgacgtgggaccggacg

SEQ ID NO: 376465 - DNA, 21 bp, Artificial Sequence
  Description of Artificial Sequence: Synthetic oligonucleotide
ctgcgacgtgggaccggacgg

SEQ ID NO: 376466 - DNA, 21 bp, Artificial Sequence
  Description of Artificial Sequence: Synthetic oligonucleotide
tgcgacgtgggaccggacggg

SEQ ID NO: 376467 - DNA, 20 bp, Artificial Sequence
  Description of Artificial Sequence: Synthetic oligonucleotide
gcgacgtgggaccggacggg

SEQ ID NO: 376468 - DNA, 20 bp, Artificial Sequence
  Description of Artificial Sequence: Synthetic oligonucleotide
cgacgtgggaccggacgggc

SEQ ID NO: 376469 - DNA, 20 bp, Artificial Sequence
  Description of Artificial Sequence: Synthetic oligonucleotide
gacgtgggaccggacgggcg

SEQ ID NO: 376470 - DNA, 20 bp, Artificial Sequence
  Description of Artificial Sequence: Synthetic oligonucleotide
acgtgggaccggacgggcgc

SEQ ID NO: 376471 - DNA, 20 bp, Artificial Sequence
  Description of Artificial Sequence: Synthetic oligonucleotide
cgtgggaccggacgggcgct

SEQ ID NO: 376472 - DNA, 20 bp, Artificial Sequence
  Description of Artificial Sequence: Synthetic oligonucleotide
gtgggaccggacgggcgcct

SEQ ID NO: 376473 - DNA, 20 bp, Artificial Sequence
  Description of Artificial Sequence: Synthetic oligonucleotide
tgggaccggacgggcgcctc

SEQ ID NO: 376474 - DNA, 20 bp, Artificial Sequence
  Description of Artificial Sequence: Synthetic oligonucleotide
gggaccggacgggcgcctct

SEQ ID NO: 376475 - DNA, 20 bp, Artificial Sequence
  Description of Artificial Sequence: Synthetic oligonucleotide
ggaccggacgggcgcctcct

SEQ ID NO: 376476 - DNA, 20 bp, Artificial Sequence
  Description of Artificial Sequence: Synthetic oligonucleotide
gaccggacgggcgcctcctc

SEQ ID NO: 376477 - DNA, 20 bp, Artificial Sequence
  Description of Artificial Sequence: Synthetic oligonucleotide
accggacgggcgcctcctcc

SEQ ID NO: 376478 - DNA, 24 bp, Artificial Sequence
  Description of Artificial Sequence: Synthetic oligonucleotide
agcgaggccgggtctcacaccctt

SEQ ID NO: 376479 - DNA, 23 bp, Artificial Sequence
  Description of Artificial Sequence: Synthetic oligonucleotide
gcgaggccgggtctcacaccctt

SEQ ID NO: 376480 - DNA, 24 bp, Artificial Sequence
  Description of Artificial Sequence: Synthetic oligonucleotide
cgaggccgggtctcacacccttca

SEQ ID NO: 376481 - DNA, 27 bp, Artificial Sequence
  Description of Artificial Sequence: Synthetic oligonucleotide
gaggccgggtctcacacccttcagaat

SEQ ID NO: 376482 - DNA, 29 bp, Artificial Sequence
  Description of Artificial Sequence: Synthetic oligonucleotide
aggccgggtctcacacccttcagaatatg

SEQ ID NO: 376483 - DNA, 28 bp, Artificial Sequence
  Description of Artificial Sequence: Synthetic oligonucleotide
ggccgggtctcacacccttcagaatatg

SEQ ID NO: 376484 - DNA, 31 bp, Artificial Sequence
  Description of Artificial Sequence: Synthetic oligonucleotide
gccgggtctcacacccttcagaatatgtatg

SEQ ID NO: 376485 - DNA, 31 bp, Artificial Sequence
  Description of Artificial Sequence: Synthetic oligonucleotide
ccgggtctcacacccttcagaatatgtatgg

SEQ ID NO: 376486 - DNA, 31 bp, Artificial Sequence
  Description of Artificial Sequence: Synthetic oligonucleotide
cgggtctcacacccttcagaatatgtatggc

SEQ ID NO: 376487 - DNA, 32 bp, Artificial Sequence
  Description of Artificial Sequence: Synthetic oligonucleotide
gggtctcacacccttcagaatatgtatggctg

SEQ ID NO: 376488 - DNA, 32 bp, Artificial Sequence
  Description of Artificial Sequence: Synthetic oligonucleotide
ggtctcacacccttcagaatatgtatggctgc

SEQ ID NO: 376489 - DNA, 32 bp, Artificial Sequence
  Description of Artificial Sequence: Synthetic oligonucleotide
gtctcacacccttcagaatatgtatggctgcg

SEQ ID NO: 376490 - DNA, 33 bp, Artificial Sequence
  Description of Artificial Sequence: Synthetic oligonucleotide
tctcacacccttcagaatatgtatggctgcgac

SEQ ID NO: 376491 - DNA, 32 bp, Artificial Sequence
  Description of Artificial Sequence: Synthetic oligonucleotide
ctcacacccttcagaatatgtatggctgcgac

SEQ ID NO: 376492 - DNA, 32 bp, Artificial Sequence
  Description of Artificial Sequence: Synthetic oligonucleotide
tcacacccttcagaatatgtatggctgcgacg

SEQ ID NO: 376493 - DNA, 31 bp, Artificial Sequence
  Description of Artificial Sequence: Synthetic oligonucleotide
cacacccttcagaatatgtatggctgcgacg

SEQ ID NO: 376494 - DNA, 32 bp, Artificial Sequence
  Description of Artificial Sequence: Synthetic oligonucleotide
acacccttcagaatatgtatggctgcgacgtg

SEQ ID NO: 376495 - DNA, 31 bp, Artificial Sequence
  Description of Artificial Sequence: Synthetic oligonucleotide
cacccttcagaatatgtatggctgcgacgtg

SEQ ID NO: 376496 - DNA, 31 bp, Artificial Sequence
  Description of Artificial Sequence: Synthetic oligonucleotide
acccttcagaatatgtatggctgcgacgtgg

SEQ ID NO: 376497 - DNA, 30 bp, Artificial Sequence
  Description of Artificial Sequence: Synthetic oligonucleotide
cccttcagaatatgtatggctgcgacgtgg

SEQ ID NO: 376498 - DNA, 30 bp, Artificial Sequence
  Description of Artificial Sequence: Synthetic oligonucleotide
ccttcagaatatgtatggctgcgacgtggg

SEQ ID NO: 376499 - DNA, 30 bp, Artificial Sequence
  Description of Artificial Sequence: Synthetic oligonucleotide
cttcagaatatgtatggctgcgacgtgggg

SEQ ID NO: 376500 - DNA, 30 bp, Artificial Sequence
  Description of Artificial Sequence: Synthetic oligonucleotide
ttcagaatatgtatggctgcgacgtggggc

SEQ ID NO: 376501 - DNA, 29 bp, Artificial Sequence
  Description of Artificial Sequence: Synthetic oligonucleotide
tcagaatatgtatggctgcgacgtggggc

SEQ ID NO: 376502 - DNA, 27 bp, Artificial Sequence
  Description of Artificial Sequence: Synthetic oligonucleotide
atcgccctgaacgaggacctgagctct

SEQ ID NO: 376503 - DNA, 27 bp, Artificial Sequence
  Description of Artificial Sequence: Synthetic oligonucleotide
tcgccctgaacgaggacctgagctctt

SEQ ID NO: 376504 - DNA, 26 bp, Artificial Sequence
  Description of Artificial Sequence: Synthetic oligonucleotide
cgccctgaacgaggacctgagctctt

SEQ ID NO: 376505 - DNA, 26 bp, Artificial Sequence
  Description of Artificial Sequence: Synthetic oligonucleotide
gccctgaacgaggacctgagctcttg

SEQ ID NO: 376506 - DNA, 27 bp, Artificial Sequence
  Description of Artificial Sequence: Synthetic oligonucleotide
ccctgaacgaggacctgagctcttgga

SEQ ID NO: 376507 - DNA, 27 bp, Artificial Sequence
  Description of Artificial Sequence: Synthetic oligonucleotide
cctgaacgaggacctgagctcttggac

SEQ ID NO: 376508 - DNA, 27 bp, Artificial Sequence
  Description of Artificial Sequence: Synthetic oligonucleotide
ctgaacgaggacctgagctcttggacc

SEQ ID NO: 376509 - DNA, 27 bp, Artificial Sequence
  Description of Artificial Sequence: Synthetic oligonucleotide
tgaacgaggacctgagctcttggaccg

SEQ ID NO: 376510 - DNA, 26 bp, Artificial Sequence
  Description of Artificial Sequence: Synthetic oligonucleotide
gaacgaggacctgagctcttggaccg

SEQ ID NO: 376511 - DNA, 26 bp, Artificial Sequence
  Description of Artificial Sequence: Synthetic oligonucleotide
aacgaggacctgagctcttggaccgc

SEQ ID NO: 376512 - DNA, 25 bp, Artificial Sequence
  Description of Artificial Sequence: Synthetic oligonucleotide
acgaggacctgagctcttggaccgc

SEQ ID NO: 376513 - DNA, 24 bp, Artificial Sequence
  Description of Artificial Sequence: Synthetic oligonucleotide
cgaggacctgagctcttggaccgc

SEQ ID NO: 376514 - DNA, 24 bp, Artificial Sequence
  Description of Artificial Sequence: Synthetic oligonucleotide
gaggacctgagctcttggaccgcc

SEQ ID NO: 376515 - DNA, 24 bp, Artificial Sequence
  Description of Artificial Sequence: Synthetic oligonucleotide
aggacctgagctcttggaccgccg

SEQ ID NO: 376516 - DNA, 23 bp, Artificial Sequence
  Description of Artificial Sequence: Synthetic oligonucleotide
ggacctgagctcttggaccgccg

SEQ ID NO: 376517 - DNA, 23 bp, Artificial Sequence
  Description of Artificial Sequence: Synthetic oligonucleotide
gacctgagctcttggaccgccgc

SEQ ID NO: 376518 - DNA, 23 bp, Artificial Sequence
  Description of Artificial Sequence: Synthetic oligonucleotide
acctgagctcttggaccgccgcg

SEQ ID NO: 376519 - DNA, 22 bp, Artificial Sequence
  Description of Artificial Sequence: Synthetic oligonucleotide
cctgagctcttggaccgccgcg

SEQ ID NO: 376520 - DNA, 23 bp, Artificial Sequence
  Description of Artificial Sequence: Synthetic oligonucleotide
ctgagctcttggaccgccgcgga

SEQ ID NO: 376521 - DNA, 24 bp, Artificial Sequence
  Description of Artificial Sequence: Synthetic oligonucleotide
tgagctcttggaccgccgcggaca

SEQ ID NO: 376522 - DNA, 23 bp, Artificial Sequence
  Description of Artificial Sequence: Synthetic oligonucleotide
gagctcttggaccgccgcggaca

SEQ ID NO: 376523 - DNA, 23 bp, Artificial Sequence
  Description of Artificial Sequence: Synthetic oligonucleotide
agctcttggaccgccgcggacac

SEQ ID NO: 376524 - DNA, 22 bp, Artificial Sequence
  Description of Artificial Sequence: Synthetic oligonucleotide
gctcttggaccgccgcggacac

SEQ ID NO: 376525 - DNA, 22 bp, Artificial Sequence
  Description of Artificial Sequence: Synthetic oligonucleotide
ctcttggaccgccgcggacacg

SEQ ID NO: 376526 - DNA, 22 bp, Artificial Sequence
  Description of Artificial Sequence: Synthetic oligonucleotide
tcttggaccgccgcggacacgg

SEQ ID NO: 376527 - DNA, 21 bp, Artificial Sequence
  Description of Artificial Sequence: Synthetic oligonucleotide
cttggaccgccgcggacacgg

SEQ ID NO: 376528 - DNA, 21 bp, Artificial Sequence
  Description of Artificial Sequence: Synthetic oligonucleotide
ttggaccgccgcggacacggc

SEQ ID NO: 376529 - DNA, 23 bp, Artificial Sequence
  Description of Artificial Sequence: Synthetic oligonucleotide
ctcctccgcgggtaccaccagca

SEQ ID NO: 376530 - DNA, 23 bp, Artificial Sequence
  Description of Artificial Sequence: Synthetic oligonucleotide
tcctccgcgggtaccaccagcac

SEQ ID NO: 376531 - DNA, 22 bp, Artificial Sequence
  Description of Artificial Sequence: Synthetic oligonucleotide
cctccgcgggtaccaccagcac

SEQ ID NO: 376532 - DNA, 22 bp, Artificial Sequence
  Description of Artificial Sequence: Synthetic oligonucleotide
ctccgcgggtaccaccagcacg

SEQ ID NO: 376533 - DNA, 22 bp, Artificial Sequence
  Description of Artificial Sequence: Synthetic oligonucleotide
tccgcgggtaccaccagcacgc

SEQ ID NO: 376534 - DNA, 21 bp, Artificial Sequence
  Description of Artificial Sequence: Synthetic oligonucleotide
ccgcgggtaccaccagcacgc

SEQ ID NO: 376535 - DNA, 23 bp, Artificial Sequence
  Description of Artificial Sequence: Synthetic oligonucleotide
cgcgggtaccaccagcacgccta

SEQ ID NO: 376536 - DNA, 23 bp, Artificial Sequence
  Description of Artificial Sequence: Synthetic oligonucleotide
gcgggtaccaccagcacgcctac

SEQ ID NO: 376537 - DNA, 24 bp, Artificial Sequence
  Description of Artificial Sequence: Synthetic oligonucleotide
cgggtaccaccagcacgcctacga

SEQ ID NO: 376538 - DNA, 24 bp, Artificial Sequence
  Description of Artificial Sequence: Synthetic oligonucleotide
gggtaccaccagcacgcctacgac

SEQ ID NO: 376539 - DNA, 24 bp, Artificial Sequence
  Description of Artificial Sequence: Synthetic oligonucleotide
ggtaccaccagcacgcctacgacg

SEQ ID NO: 376540 - DNA, 24 bp, Artificial Sequence
  Description of Artificial Sequence: Synthetic oligonucleotide
gtaccaccagcacgcctacgacgg

SEQ ID NO: 376541 - DNA, 26 bp, Artificial Sequence
  Description of Artificial Sequence: Synthetic oligonucleotide
taccaccagcacgcctacgacggcaa

SEQ ID NO: 376542 - DNA, 25 bp, Artificial Sequence
  Description of Artificial Sequence: Synthetic oligonucleotide
accaccagcacgcctacgacggcaa

SEQ ID NO: 376543 - DNA, 24 bp, Artificial Sequence
  Description of Artificial Sequence: Synthetic oligonucleotide
ccaccagcacgcctacgacggcaa

SEQ ID NO: 376544 - DNA, 24 bp, Artificial Sequence
  Description of Artificial Sequence: Synthetic oligonucleotide
caccagcacgcctacgacggcaag

SEQ ID NO: 376545 - DNA, 27 bp, Artificial Sequence
  Description of Artificial Sequence: Synthetic oligonucleotide
accagcacgcctacgacggcaaggatt

SEQ ID NO: 376546 - DNA, 27 bp, Artificial Sequence
  Description of Artificial Sequence: Synthetic oligonucleotide
ccagcacgcctacgacggcaaggatta

SEQ ID NO: 376547 - DNA, 27 bp, Artificial Sequence
  Description of Artificial Sequence: Synthetic oligonucleotide
gggaccgggagacacagatctgcaaga

SEQ ID NO: 376548 - DNA, 27 bp, Artificial Sequence
  Description of Artificial Sequence: Synthetic oligonucleotide
ggaccgggagacacagatctgcaagac

SEQ ID NO: 376549 - DNA, 27 bp, Artificial Sequence
  Description of Artificial Sequence: Synthetic oligonucleotide
gaccgggagacacagatctgcaagacc

SEQ ID NO: 376550 - DNA, 29 bp, Artificial Sequence
  Description of Artificial Sequence: Synthetic oligonucleotide
accgggagacacagatctgcaagaccaac

SEQ ID NO: 376551 - DNA, 28 bp, Artificial Sequence
  Description of Artificial Sequence: Synthetic oligonucleotide
ccgggagacacagatctgcaagaccaac

SEQ ID NO: 376552 - DNA, 29 bp, Artificial Sequence
  Description of Artificial Sequence: Synthetic oligonucleotide
cgggagacacagatctgcaagaccaacac

SEQ ID NO: 376553 - DNA, 30 bp, Artificial Sequence; identical to SEQ ID NO: 29618
  Description of Artificial Sequence: Synthetic oligonucleotide

SEQ ID NO: 376554 - DNA, 31 bp, Artificial Sequence; identical to SEQ ID NO: 29619
  Description of Artificial Sequence: Synthetic oligonucleotide

SEQ ID NO: 376555 - DNA, 32 bp, Artificial Sequence; identical to SEQ ID NO: 29620
  Description of Artificial Sequence: Synthetic oligonucleotide

SEQ ID NO: 376556 - DNA, 33 bp, Artificial Sequence; identical to SEQ ID NO: 30778
  Description of Artificial Sequence: Synthetic oligonucleotide

SEQ ID NO: 376557 - DNA, 32 bp, Artificial Sequence; identical to SEQ ID NO: 30779
  Description of Artificial Sequence: Synthetic oligonucleotide

SEQ ID NO: 376558 - DNA, 23 bp, Artificial Sequence
  Description of Artificial Sequence: Synthetic oligonucleotide
atgcgggtcacggagccccgaac

SEQ ID NO: 376559 - DNA, 22 bp, Artificial Sequence
  Description of Artificial Sequence: Synthetic oligonucleotide
tgcgggtcacggagccccgaac

SEQ ID NO: 376560 - DNA, 21 bp, Artificial Sequence
  Description of Artificial Sequence: Synthetic oligonucleotide
gcgggtcacggagccccgaac

SEQ ID NO: 376561 - DNA, 21 bp, Artificial Sequence
  Description of Artificial Sequence: Synthetic oligonucleotide
cgggtcacggagccccgaacc

SEQ ID NO: 376562 - DNA, 22 bp, Artificial Sequence
  Description of Artificial Sequence: Synthetic oligonucleotide
gggtcacggagccccgaaccct

SEQ ID NO: 376563 - DNA, 22 bp, Artificial Sequence
  Description of Artificial Sequence: Synthetic oligonucleotide
ggtcacggagccccgaaccctc

SEQ ID NO: 376564 - DNA, 23 bp, Artificial Sequence
  Description of Artificial Sequence: Synthetic oligonucleotide
gtcacggagccccgaaccctcct

SEQ ID NO: 376565 - DNA, 23 bp, Artificial Sequence
  Description of Artificial Sequence: Synthetic oligonucleotide
tcacggagccccgaaccctcctc

SEQ ID NO: 376566 - DNA, 22 bp, Artificial Sequence
  Description of Artificial Sequence: Synthetic oligonucleotide
cacggagccccgaaccctcctc

SEQ ID NO: 376567 - DNA, 23 bp, Artificial Sequence
  Description of Artificial Sequence: Synthetic oligonucleotide
acggagccccgaaccctcctcct

SEQ ID NO: 376568 - DNA, 22 bp, Artificial Sequence
  Description of Artificial Sequence: Synthetic oligonucleotide
cggagccccgaaccctcctcct

SEQ ID NO: 376569 - DNA, 22 bp, Artificial Sequence
  Description of Artificial Sequence: Synthetic oligonucleotide
ggagccccgaaccctcctcctg

SEQ ID NO: 376570 - DNA, 23 bp, Artificial Sequence
  Description of Artificial Sequence: Synthetic oligonucleotide
gagccccgaaccctcctcctgct

SEQ ID NO: 376571 - DNA, 23 bp, Artificial Sequence
  Description of Artificial Sequence: Synthetic oligonucleotide
agccccgaaccctcctcctgctg

SEQ ID NO: 376572 - DNA, 29 bp, Artificial Sequence
  Description of Artificial Sequence: Synthetic oligonucleotide
ccgggtctcacaccctccagaatatgtac

SEQ ID NO: 376573 - DNA, 29 bp, Artificial Sequence
  Description of Artificial Sequence: Synthetic oligonucleotide
cgggtctcacaccctccagaatatgtacg

SEQ ID NO: 376574 - DNA, 29 bp, Artificial Sequence
  Description of Artificial Sequence: Synthetic oligonucleotide
gggtctcacaccctccagaatatgtacgg

SEQ ID NO: 376575 - DNA, 29 bp, Artificial Sequence
  Description of Artificial Sequence: Synthetic oligonucleotide
ggtctcacaccctccagaatatgtacggc

SEQ ID NO: 376576 - DNA, 30 bp, Artificial Sequence; identical to SEQ ID NO: 30835
  Description of Artificial Sequence: Synthetic oligonucleotide

SEQ ID NO: 376577 - DNA, 30 bp, Artificial Sequence; identical to SEQ ID NO: 30836
  Description of Artificial Sequence: Synthetic oligonucleotide

SEQ ID NO: 376578 - DNA, 29 bp, Artificial Sequence
  Description of Artificial Sequence: Synthetic oligonucleotide
ctcacaccctccagaatatgtacggctgc

SEQ ID NO: 376579 - DNA, 29 bp, Artificial Sequence
  Description of Artificial Sequence: Synthetic oligonucleotide
tcacaccctccagaatatgtacggctgcg

SEQ ID NO: 376580 - DNA, 28 bp, Artificial Sequence
  Description of Artificial Sequence: Synthetic oligonucleotide
cacaccctccagaatatgtacggctgcg

SEQ ID NO: 376581 - DNA, 29 bp, Artificial Sequence
  Description of Artificial Sequence: Synthetic oligonucleotide
acaccctccagaatatgtacggctgcgac

SEQ ID NO: 376582 - DNA, 28 bp, Artificial Sequence
  Description of Artificial Sequence: Synthetic oligonucleotide
caccctccagaatatgtacggctgcgac

SEQ ID NO: 376583 - DNA, 28 bp, Artificial Sequence
  Description of Artificial Sequence: Synthetic oligonucleotide
accctccagaatatgtacggctgcgacg

SEQ ID NO: 376584 - DNA, 27 bp, Artificial Sequence
  Description of Artificial Sequence: Synthetic oligonucleotide
ccctccagaatatgtacggctgcgacg

SEQ ID NO: 376585 - DNA, 28 bp, Artificial Sequence
  Description of Artificial Sequence: Synthetic oligonucleotide
cctccagaatatgtacggctgcgacgtg

SEQ ID NO: 376586 - DNA, 28 bp, Artificial Sequence
  Description of Artificial Sequence: Synthetic oligonucleotide
ctccagaatatgtacggctgcgacgtgg

SEQ ID NO: 376587 - DNA, 28 bp, Artificial Sequence
  Description of Artificial Sequence: Synthetic oligonucleotide
tccagaatatgtacggctgcgacgtggg

SEQ ID NO: 376588 - DNA, 27 bp, Artificial Sequence
  Description of Artificial Sequence: Synthetic oligonucleotide
ccagaatatgtacggctgcgacgtggg

SEQ ID NO: 376589 - DNA, 27 bp, Artificial Sequence
  Description of Artificial Sequence: Synthetic oligonucleotide
cagaatatgtacggctgcgacgtgggg

SEQ ID NO: 376590 - DNA, 27 bp, Artificial Sequence
  Description of Artificial Sequence: Synthetic oligonucleotide
agaatatgtacggctgcgacgtggggc

SEQ ID NO: 376591 - DNA, 26 bp, Artificial Sequence
  Description of Artificial Sequence: Synthetic oligonucleotide
gaatatgtacggctgcgacgtggggc

SEQ ID NO: 376592 - DNA, 26 bp, Artificial Sequence
  Description of Artificial Sequence: Synthetic oligonucleotide
aatatgtacggctgcgacgtggggcc

SEQ ID NO: 376593 - DNA, 25 bp, Artificial Sequence
  Description of Artificial Sequence: Synthetic oligonucleotide
atatgtacggctgcgacgtggggcc

SEQ ID NO: 376594 - DNA, 24 bp, Artificial Sequence
  Description of Artificial Sequence: Synthetic oligonucleotide
tatgtacggctgcgacgtggggcc

SEQ ID NO: 376595 - DNA, 31 bp, Artificial Sequence
  Description of Artificial Sequence: Synthetic oligonucleotide
catttcccactcccattgggtgtcggatatc

SEQ ID NO: 376596 - DNA, 33 bp, Artificial Sequence
  Description of Artificial Sequence: Synthetic oligonucleotide
atttcccactcccattgggtgtcggatatctag

SEQ ID NO: 376597 - DNA, 32 bp, Artificial Sequence
  Description of Artificial Sequence: Synthetic oligonucleotide
tttcccactcccattgggtgtcggatatctag

SEQ ID NO: 376598 - DNA, 35 bp, Artificial Sequence
  Description of Artificial Sequence: Synthetic oligonucleotide
attgggtgtcggatatctagagaagccaatcagtg

SEQ ID NO: 376599 - DNA, 34 bp, Artificial Sequence
  Description of Artificial Sequence: Synthetic oligonucleotide
ttgggtgtcggatatctagagaagccaatcagtg

SEQ ID NO: 376600 - DNA, 33 bp, Artificial Sequence
  Description of Artificial Sequence: Synthetic oligonucleotide
tgggtgtcggatatctagagaagccaatcagtg

SEQ ID NO: 376601 - DNA, 32 bp, Artificial Sequence
  Description of Artificial Sequence: Synthetic oligonucleotide
gggtgtcggatatctagagaagccaatcagtg

SEQ ID NO: 376602 - DNA, 33 bp, Artificial Sequence
  Description of Artificial Sequence: Synthetic oligonucleotide
ggtgtcggatatctagagaagccaatcagtgtc

SEQ ID NO: 376603 - DNA, 33 bp, Artificial Sequence
  Description of Artificial Sequence: Synthetic oligonucleotide
gtgtcggatatctagagaagccaatcagtgtcg

SEQ ID NO: 376604 - DNA, 33 bp, Artificial Sequence
  Description of Artificial Sequence: Synthetic oligonucleotide
tgtcggatatctagagaagccaatcagtgtcgc

SEQ ID NO: 376605 - DNA, 32 bp, Artificial Sequence
  Description of Artificial Sequence: Synthetic oligonucleotide
gtcggatatctagagaagccaatcagtgtcgc

SEQ ID NO: 376606 - DNA, 32 bp, Artificial Sequence
  Description of Artificial Sequence: Synthetic oligonucleotide
tcggatatctagagaagccaatcagtgtcgcc

SEQ ID NO: 376607 - DNA, 31 bp, Artificial Sequence
  Description of Artificial Sequence: Synthetic oligonucleotide
cggatatctagagaagccaatcagtgtcgcc

SEQ ID NO: 376608 - DNA, 31 bp, Artificial Sequence
  Description of Artificial Sequence: Synthetic oligonucleotide
ggatatctagagaagccaatcagtgtcgccg

SEQ ID NO: 376609 - DNA, 31 bp, Artificial Sequence
  Description of Artificial Sequence: Synthetic oligonucleotide
gatatctagagaagccaatcagtgtcgccgg

SEQ ID NO: 376610 - DNA, 31 bp, Artificial Sequence
  Description of Artificial Sequence: Synthetic oligonucleotide
atatctagagaagccaatcagtgtcgccggg

SEQ ID NO: 376611 - DNA, 30 bp, Artificial Sequence
  Description of Artificial Sequence: Synthetic oligonucleotide
tatctagagaagccaatcagtgtcgccggg

SEQ ID NO: 376612 - DNA, 29 bp, Artificial Sequence
  Description of Artificial Sequence: Synthetic oligonucleotide
atctagagaagccaatcagtgtcgccggg

SEQ ID NO: 376613 - DNA, 24 bp, Artificial Sequence
  Description of Artificial Sequence: Synthetic oligonucleotide
ccgaaccgtcctcctgctgctctg

SEQ ID NO: 376614 - DNA, 24 bp, Artificial Sequence
  Description of Artificial Sequence: Synthetic oligonucleotide
cgaaccgtcctcctgctgctctgg

SEQ ID NO: 376615 - DNA, 24 bp, Artificial Sequence
  Description of Artificial Sequence: Synthetic oligonucleotide
gaaccgtcctcctgctgctctggg

SEQ ID NO: 376616 - DNA, 24 bp, Artificial Sequence
  Description of Artificial Sequence: Synthetic oligonucleotide
aaccgtcctcctgctgctctgggg

SEQ ID NO: 376617 - DNA, 23 bp, Artificial Sequence
  Description of Artificial Sequence: Synthetic oligonucleotide
accgtcctcctgctgctctgggg

SEQ ID NO: 376618 - DNA, 22 bp, Artificial Sequence
  Description of Artificial Sequence: Synthetic oligonucleotide
ccgtcctcctgctgctctgggg

SEQ ID NO: 376619 - DNA, 22 bp, Artificial Sequence
  Description of Artificial Sequence: Synthetic oligonucleotide
cgtcctcctgctgctctggggg

SEQ ID NO: 376620 - DNA, 22 bp, Artificial Sequence
  Description of Artificial Sequence: Synthetic oligonucleotide
gtcctcctgctgctctgggggg

SEQ ID NO: 376621 - DNA, 26 bp, Artificial Sequence
  Description of Artificial Sequence: Synthetic oligonucleotide
cgtgtggcggagcagctgagagctta

SEQ ID NO: 376622 - DNA, 26 bp, Artificial Sequence
  Description of Artificial Sequence: Synthetic oligonucleotide
gtgtggcggagcagctgagagcttac

SEQ ID NO: 376623 - DNA, 27 bp, Artificial Sequence
  Description of Artificial Sequence: Synthetic oligonucleotide
tgtggcggagcagctgagagcttacct

SEQ ID NO: 376624 - DNA, 26 bp, Artificial Sequence
  Description of Artificial Sequence: Synthetic oligonucleotide
gtggcggagcagctgagagcttacct

SEQ ID NO: 376625 - DNA, 26 bp, Artificial Sequence
  Description of Artificial Sequence: Synthetic oligonucleotide
tggcggagcagctgagagcttacctg

SEQ ID NO: 376626 - DNA, 25 bp, Artificial Sequence
  Description of Artificial Sequence: Synthetic oligonucleotide
ggcggagcagctgagagcttacctg

SEQ ID NO: 376627 - DNA, 26 bp, Artificial Sequence
  Description of Artificial Sequence: Synthetic oligonucleotide
gcggagcagctgagagcttacctgga

SEQ ID NO: 376628 - DNA, 26 bp, Artificial Sequence
  Description of Artificial Sequence: Synthetic oligonucleotide
cggagcagctgagagcttacctggag

SEQ ID NO: 376629 - DNA, 26 bp, Artificial Sequence
  Description of Artificial Sequence: Synthetic oligonucleotide
ggagcagctgagagcttacctggagg

SEQ ID NO: 376630 - DNA, 26 bp, Artificial Sequence
  Description of Artificial Sequence: Synthetic oligonucleotide
gagcagctgagagcttacctggaggg

SEQ ID NO: 376631 - DNA, 26 bp, Artificial Sequence
  Description of Artificial Sequence: Synthetic oligonucleotide
agcagctgagagcttacctggagggc

SEQ ID NO: 376632 - DNA, 25 bp, Artificial Sequence
  Description of Artificial Sequence: Synthetic oligonucleotide
gcagctgagagcttacctggagggc

SEQ ID NO: 376633 - DNA, 26 bp, Artificial Sequence
  Description of Artificial Sequence: Synthetic oligonucleotide
cagctgagagcttacctggagggcct

SEQ ID NO: 376634 - DNA, 27 bp, Artificial Sequence
  Description of Artificial Sequence: Synthetic oligonucleotide
agctgagagcttacctggagggcctgt

SEQ ID NO: 376635 - DNA, 26 bp, Artificial Sequence
  Description of Artificial Sequence: Synthetic oligonucleotide
gctgagagcttacctggagggcctgt

SEQ ID NO: 376636 - DNA, 26 bp, Artificial Sequence
  Description of Artificial Sequence: Synthetic oligonucleotide
ctgagagcttacctggagggcctgtg

SEQ ID NO: 376637 - DNA, 26 bp, Artificial Sequence
  Description of Artificial Sequence: Synthetic oligonucleotide
tgagagcttacctggagggcctgtgc

SEQ ID NO: 376638 - DNA, 25 bp, Artificial Sequence
  Description of Artificial Sequence: Synthetic oligonucleotide
gagagcttacctggagggcctgtgc

SEQ ID NO: 376639 - DNA, 26 bp, Artificial Sequence
  Description of Artificial Sequence: Synthetic oligonucleotide
agagcttacctggagggcctgtgcgt

SEQ ID NO: 376640 - DNA, 25 bp, Artificial Sequence
  Description of Artificial Sequence: Synthetic oligonucleotide
gagcttacctggagggcctgtgcgt

SEQ ID NO: 376641 - DNA, 25 bp, Artificial Sequence
  Description of Artificial Sequence: Synthetic oligonucleotide
agcttacctggagggcctgtgcgtg

SEQ ID NO: 376642 - DNA, 24 bp, Artificial Sequence
  Description of Artificial Sequence: Synthetic oligonucleotide
gcttacctggagggcctgtgcgtg

SEQ ID NO: 376643 - DNA, 25 bp, Artificial Sequence
  Description of Artificial Sequence: Synthetic oligonucleotide
cttacctggagggcctgtgcgtgga

SEQ ID NO: 376644 - DNA, 26 bp, Artificial Sequence
  Description of Artificial Sequence: Synthetic oligonucleotide
ttacctggagggcctgtgcgtggagt

SEQ ID NO: 376645 - DNA, 24 bp, Artificial Sequence
  Description of Artificial Sequence: Synthetic oligonucleotide
ggcagctgtggtggtgccttctgg

SEQ ID NO: 376646 - DNA, 24 bp, Artificial Sequence
  Description of Artificial Sequence: Synthetic oligonucleotide
gcagctgtggtggtgccttctggg

SEQ ID NO: 376647 - DNA, 26 bp, Artificial Sequence
  Description of Artificial Sequence: Synthetic oligonucleotide
cagctgtggtggtgccttctggggaa

SEQ ID NO: 376648 - DNA, 27 bp, Artificial Sequence
  Description of Artificial Sequence: Synthetic oligonucleotide
agctgtggtggtgccttctggggaaga

SEQ ID NO: 376649 - DNA, 26 bp, Artificial Sequence
  Description of Artificial Sequence: Synthetic oligonucleotide
gctgtggtggtgccttctggggaaga

SEQ ID NO: 376650 - DNA, 26 bp, Artificial Sequence
  Description of Artificial Sequence: Synthetic oligonucleotide
ctgtggtggtgccttctggggaagag

SEQ ID NO: 376651 - DNA, 27 bp, Artificial Sequence
  Description of Artificial Sequence: Synthetic oligonucleotide
tgtggtggtgccttctggggaagagca

SEQ ID NO: 376652 - DNA, 26 bp, Artificial Sequence
  Description of Artificial Sequence: Synthetic oligonucleotide
gtggtggtgccttctggggaagagca

SEQ ID NO: 376653 - DNA, 27 bp, Artificial Sequence
  Description of Artificial Sequence: Synthetic oligonucleotide
tggtggtgccttctggggaagagcaga

SEQ ID NO: 376654 - DNA, 26 bp, Artificial Sequence
  Description of Artificial Sequence: Synthetic oligonucleotide
ggtggtgccttctggggaagagcaga

SEQ ID NO: 376655 - DNA, 27 bp, Artificial Sequence
  Description of Artificial Sequence: Synthetic oligonucleotide
gtggtgccttctggggaagagcagaga

SEQ ID NO: 376656 - DNA, 29 bp, Artificial Sequence
  Description of Artificial Sequence: Synthetic oligonucleotide
tggtgccttctggggaagagcagagatac

SEQ ID NO: 376657 - DNA, 28 bp, Artificial Sequence
  Description of Artificial Sequence: Synthetic oligonucleotide
ggtgccttctggggaagagcagagatac

SEQ ID NO: 376658 - DNA, 29 bp, Artificial Sequence
  Description of Artificial Sequence: Synthetic oligonucleotide
gtgccttctggggaagagcagagatacac

SEQ ID NO: 376659 - DNA, 31 bp, Artificial Sequence; identical to SEQ ID NO: 31307
  Description of Artificial Sequence: Synthetic oligonucleotide

SEQ ID NO: 376660 - DNA, 30 bp, Artificial Sequence; identical to SEQ ID NO: 31308
  Description of Artificial Sequence: Synthetic oligonucleotide

SEQ ID NO: 376661 - DNA, 30 bp, Artificial Sequence; identical to SEQ ID NO: 31309
  Description of Artificial Sequence: Synthetic oligonucleotide

SEQ ID NO: 376662 - DNA, 30 bp, Artificial Sequence; identical to SEQ ID NO: 31310
  Description of Artificial Sequence: Synthetic oligonucleotide

SEQ ID NO: 376663 - DNA, 32 bp, Artificial Sequence; identical to SEQ ID NO: 31311
  Description of Artificial Sequence: Synthetic oligonucleotide

SEQ ID NO: 376664 - DNA, 31 bp, Artificial Sequence; identical to SEQ ID NO: 31312
  Description of Artificial Sequence: Synthetic oligonucleotide

SEQ ID NO: 376665 - DNA, 30 bp, Artificial Sequence; identical to SEQ ID NO: 31313
  Description of Artificial Sequence: Synthetic oligonucleotide

SEQ ID NO: 376666 - DNA, 32 bp, Artificial Sequence; identical to SEQ ID NO: 31314
  Description of Artificial Sequence: Synthetic oligonucleotide

SEQ ID NO: 376667 - DNA, 31 bp, Artificial Sequence; identical to SEQ ID NO: 31315
  Description of Artificial Sequence: Synthetic oligonucleotide

SEQ ID NO: 376668 - DNA, 32 bp, Artificial Sequence; identical to SEQ ID NO: 31316
  Description of Artificial Sequence: Synthetic oligonucleotide

SEQ ID NO: 376669 - DNA, 32 bp, Artificial Sequence; identical to SEQ ID NO: 31317
  Description of Artificial Sequence: Synthetic oligonucleotide

SEQ ID NO: 376670 - DNA, 28 bp, Artificial Sequence
  Description of Artificial Sequence: Synthetic oligonucleotide
atcatccagaggatgtacggctgcgacc

SEQ ID NO: 376671 - DNA, 27 bp, Artificial Sequence
  Description of Artificial Sequence: Synthetic oligonucleotide
tcatccagaggatgtacggctgcgacc

SEQ ID NO: 376672 - DNA, 27 bp, Artificial Sequence
  Description of Artificial Sequence: Synthetic oligonucleotide
catccagaggatgtacggctgcgacct

SEQ ID NO: 376673 - DNA, 27 bp, Artificial Sequence
  Description of Artificial Sequence: Synthetic oligonucleotide
atccagaggatgtacggctgcgacctg

SEQ ID NO: 376674 - DNA, 21 bp, Artificial Sequence
  Description of Artificial Sequence: Synthetic oligonucleotide
tacggctgcgacctggggccc

SEQ ID NO: 376675 - DNA, 20 bp, Artificial Sequence
  Description of Artificial Sequence: Synthetic oligonucleotide
acggctgcgacctggggccc

SEQ ID NO: 376676 - DNA, 20 bp, Artificial Sequence
  Description of Artificial Sequence: Synthetic oligonucleotide
cggctgcgacctggggccct

SEQ ID NO: 376677 - DNA, 25 bp, Artificial Sequence
  Description of Artificial Sequence: Synthetic oligonucleotide
ggcgccatggatagagcaggaggga

SEQ ID NO: 376678 - DNA, 25 bp, Artificial Sequence
  Description of Artificial Sequence: Synthetic oligonucleotide
gcgccatggatagagcaggagggac

SEQ ID NO: 376679 - DNA, 25 bp, Artificial Sequence
  Description of Artificial Sequence: Synthetic oligonucleotide
cgccatggatagagcaggagggacc

SEQ ID NO: 376680 - DNA, 25 bp, Artificial Sequence
  Description of Artificial Sequence: Synthetic oligonucleotide
gccatggatagagcaggagggaccg

SEQ ID NO: 376681 - DNA, 26 bp, Artificial Sequence
  Description of Artificial Sequence: Synthetic oligonucleotide
ccatggatagagcaggagggaccgga

SEQ ID NO: 376682 - DNA, 27 bp, Artificial Sequence
  Description of Artificial Sequence: Synthetic oligonucleotide
catggatagagcaggagggaccggagt

SEQ ID NO: 376683 - DNA, 30 bp, Artificial Sequence; identical to SEQ ID NO: 31328
  Description of Artificial Sequence: Synthetic oligonucleotide

SEQ ID NO: 376684 - DNA, 29 bp, Artificial Sequence
  Description of Artificial Sequence: Synthetic oligonucleotide
tggatagagcaggagggaccggagtattg

SEQ ID NO: 376685 - DNA, 28 bp, Artificial Sequence
  Description of Artificial Sequence: Synthetic oligonucleotide
ggatagagcaggagggaccggagtattg

SEQ ID NO: 376686 - DNA, 28 bp, Artificial Sequence
  Description of Artificial Sequence: Synthetic oligonucleotide
gatagagcaggagggaccggagtattgg

SEQ ID NO: 376687 - DNA, 28 bp, Artificial Sequence
  Description of Artificial Sequence: Synthetic oligonucleotide
atagagcaggagggaccggagtattggg

SEQ ID NO: 376688 - DNA, 27 bp, Artificial Sequence
  Description of Artificial Sequence: Synthetic oligonucleotide
tagagcaggagggaccggagtattggg

SEQ ID NO: 376689 - DNA, 27 bp, Artificial Sequence
  Description of Artificial Sequence: Synthetic oligonucleotide
agagcaggagggaccggagtattggga

SEQ ID NO: 376690 - DNA, 26 bp, Artificial Sequence
  Description of Artificial Sequence: Synthetic oligonucleotide
gagcaggagggaccggagtattggga

SEQ ID NO: 376691 - DNA, 26 bp, Artificial Sequence
  Description of Artificial Sequence: Synthetic oligonucleotide
agcaggagggaccggagtattgggac

SEQ ID NO: 376692 - DNA, 25 bp, Artificial Sequence
  Description of Artificial Sequence: Synthetic oligonucleotide
gcaggagggaccggagtattgggac

SEQ ID NO: 376693 - DNA, 25 bp, Artificial Sequence
  Description of Artificial Sequence: Synthetic oligonucleotide
caggagggaccggagtattgggacc

SEQ ID NO: 376694 - DNA, 25 bp, Artificial Sequence
  Description of Artificial Sequence: Synthetic oligonucleotide
aggagggaccggagtattgggaccg

SEQ ID NO: 376695 - DNA, 24 bp, Artificial Sequence
  Description of Artificial Sequence: Synthetic oligonucleotide
ggagggaccggagtattgggaccg

SEQ ID NO: 376696 - DNA, 26 bp, Artificial Sequence
  Description of Artificial Sequence: Synthetic oligonucleotide
gagggaccggagtattgggaccggaa

SEQ ID NO: 376697 - DNA, 27 bp, Artificial Sequence
  Description of Artificial Sequence: Synthetic oligonucleotide
agggaccggagtattgggaccggaaca

SEQ ID NO: 376698 - DNA, 26 bp, Artificial Sequence
  Description of Artificial Sequence: Synthetic oligonucleotide
gggaccggagtattgggaccggaaca

SEQ ID NO: 376699 - DNA, 27 bp, Artificial Sequence
  Description of Artificial Sequence: Synthetic oligonucleotide
ggaccggagtattgggaccggaacaca

SEQ ID NO: 376700 - DNA, 27 bp, Artificial Sequence
  Description of Artificial Sequence: Synthetic oligonucleotide
gaccggagtattgggaccggaacacac

SEQ ID NO: 376701 - DNA, 28 bp, Artificial Sequence
  Description of Artificial Sequence: Synthetic oligonucleotide
accggagtattgggaccggaacacacag

SEQ ID NO: 376702 - DNA, 27 bp, Artificial Sequence
  Description of Artificial Sequence: Synthetic oligonucleotide
taaccagagcgaggccgggtctcacat

SEQ ID NO: 376703 - DNA, 24 bp, Artificial Sequence
  Description of Artificial Sequence: Synthetic oligonucleotide
gagggcctgtgcgtggagtggctt

SEQ ID NO: 376704 - DNA, 24 bp, Artificial Sequence
  Description of Artificial Sequence: Synthetic oligonucleotide
agggcctgtgcgtggagtggcttc

SEQ ID NO: 376705 - DNA, 23 bp, Artificial Sequence
  Description of Artificial Sequence: Synthetic oligonucleotide
gggcctgtgcgtggagtggcttc

SEQ ID NO: 376706 - DNA, 23 bp, Artificial Sequence
  Description of Artificial Sequence: Synthetic oligonucleotide
ggcctgtgcgtggagtggcttcg

SEQ ID NO: 376707 - DNA, 24 bp, Artificial Sequence
  Description of Artificial Sequence: Synthetic oligonucleotide
gcctgtgcgtggagtggcttcgca

SEQ ID NO: 376708 - DNA, 27 bp, Artificial Sequence
  Description of Artificial Sequence: Synthetic oligonucleotide
cctgtgcgtggagtggcttcgcagata

SEQ ID NO: 376709 - DNA, 27 bp, Artificial Sequence
  Description of Artificial Sequence: Synthetic oligonucleotide
ctgtgcgtggagtggcttcgcagatac

SEQ ID NO: 376710 - DNA, 27 bp, Artificial Sequence
  Description of Artificial Sequence: Synthetic oligonucleotide
tgtgcgtggagtggcttcgcagatacc

SEQ ID NO: 376711 - DNA, 21 bp, Artificial Sequence
  Description of Artificial Sequence: Synthetic oligonucleotide
gcgagtccgaggacggagccg

SEQ ID NO: 376712 - DNA, 21 bp, Artificial Sequence
  Description of Artificial Sequence: Synthetic oligonucleotide
cgagtccgaggacggagccgc

SEQ ID NO: 376713 - DNA, 21 bp, Artificial Sequence
  Description of Artificial Sequence: Synthetic oligonucleotide
gagtccgaggacggagccgcg

SEQ ID NO: 376714 - DNA, 21 bp, Artificial Sequence
  Description of Artificial Sequence: Synthetic oligonucleotide
agtccgaggacggagccgcgg

SEQ ID NO: 376715 - DNA, 20 bp, Artificial Sequence
  Description of Artificial Sequence: Synthetic oligonucleotide
gtccgaggacggagccgcgg

SEQ ID NO: 376716 - DNA, 20 bp, Artificial Sequence
  Description of Artificial Sequence: Synthetic oligonucleotide
tccgaggacggagccgcggg

SEQ ID NO: 376717 - DNA, 20 bp, Artificial Sequence
  Description of Artificial Sequence: Synthetic oligonucleotide
ccgaggacggagccgcgggt

SEQ ID NO: 376718 - DNA, 20 bp, Artificial Sequence
  Description of Artificial Sequence: Synthetic oligonucleotide
cgaggacggagccgcgggct

SEQ ID NO: 376719 - DNA, 20 bp, Artificial Sequence
  Description of Artificial Sequence: Synthetic oligonucleotide
gaggacggagccgcgggcgt

SEQ ID NO: 376720 - DNA, 20 bp, Artificial Sequence
  Description of Artificial Sequence: Synthetic oligonucleotide
aggacggagccgcgggcgct

SEQ ID NO: 376721 - DNA, 20 bp, Artificial Sequence
  Description of Artificial Sequence: Synthetic oligonucleotide
ggacggagccgcgggcgctt

SEQ ID NO: 376722 - DNA, 20 bp, Artificial Sequence
  Description of Artificial Sequence: Synthetic oligonucleotide
gacggagccgcgggcgccat

SEQ ID NO: 376723 - DNA, 20 bp, Artificial Sequence
  Description of Artificial Sequence: Synthetic oligonucleotide
acggagccgcgggcgccatg

SEQ ID NO: 376724 - DNA, 20 bp, Artificial Sequence
  Description of Artificial Sequence: Synthetic oligonucleotide
cggagccgcgggcgccatgt

SEQ ID NO: 376725 - DNA, 33 bp, Artificial Sequence; identical to SEQ ID NO: 31367
  Description of Artificial Sequence: Synthetic oligonucleotide

SEQ ID NO: 376726 - DNA, 34 bp, Artificial Sequence; identical to SEQ ID NO: 31368
  Description of Artificial Sequence: Synthetic oligonucleotide

SEQ ID NO: 376727 - DNA, 35 bp, Artificial Sequence; identical to SEQ ID NO: 31369
  Description of Artificial Sequence: Synthetic oligonucleotide

SEQ ID NO: 376728 - DNA, 34 bp, Artificial Sequence; identical to SEQ ID NO: 31370
  Description of Artificial Sequence: Synthetic oligonucleotide

SEQ ID NO: 376729 - DNA, 35 bp, Artificial Sequence; identical to SEQ ID NO: 31371
  Description of Artificial Sequence: Synthetic oligonucleotide

SEQ ID NO: 376730 - DNA, 38 bp, Artificial Sequence; identical to SEQ ID NO: 31372
  Description of Artificial Sequence: Synthetic oligonucleotide

SEQ ID NO: 376731 - DNA, 38 bp, Artificial Sequence; identical to SEQ ID NO: 31373
  Description of Artificial Sequence: Synthetic oligonucleotide

SEQ ID NO: 376732 - DNA, 38 bp, Artificial Sequence; identical to SEQ ID NO: 31374
  Description of Artificial Sequence: Synthetic oligonucleotide

SEQ ID NO: 376733 - DNA, 37 bp, Artificial Sequence; identical to SEQ ID NO: 31375
  Description of Artificial Sequence: Synthetic oligonucleotide

SEQ ID NO: 376734 - DNA, 36 bp, Artificial Sequence; identical to SEQ ID NO: 31376
  Description of Artificial Sequence: Synthetic oligonucleotide

SEQ ID NO: 376735 - DNA, 37 bp, Artificial Sequence; identical to SEQ ID NO: 31377
  Description of Artificial Sequence: Synthetic oligonucleotide

SEQ ID NO: 376736 - DNA, 36 bp, Artificial Sequence; identical to SEQ ID NO: 31378
  Description of Artificial Sequence: Synthetic oligonucleotide

SEQ ID NO: 376737 - DNA, 37 bp, Artificial Sequence; identical to SEQ ID NO: 31379
  Description of Artificial Sequence: Synthetic oligonucleotide

SEQ ID NO: 376738 - DNA, 36 bp, Artificial Sequence; identical to SEQ ID NO: 31380
  Description of Artificial Sequence: Synthetic oligonucleotide

SEQ ID NO: 376739 - DNA, 37 bp, Artificial Sequence; identical to SEQ ID NO: 31381
  Description of Artificial Sequence: Synthetic oligonucleotide

SEQ ID NO: 376740 - DNA, 36 bp, Artificial Sequence; identical to SEQ ID NO: 31382
  Description of Artificial Sequence: Synthetic oligonucleotide

SEQ ID NO: 376741 - DNA, 36 bp, Artificial Sequence; identical to SEQ ID NO: 31383
  Description of Artificial Sequence: Synthetic oligonucleotide

SEQ ID NO: 376742 - DNA, 35 bp, Artificial Sequence; identical to SEQ ID NO: 31384
  Description of Artificial Sequence: Synthetic oligonucleotide

SEQ ID NO: 376743 - DNA, 34 bp, Artificial Sequence; identical to SEQ ID NO: 31385
  Description of Artificial Sequence: Synthetic oligonucleotide

SEQ ID NO: 376744 - DNA, 34 bp, Artificial Sequence; identical to SEQ ID NO: 31386
  Description of Artificial Sequence: Synthetic oligonucleotide

SEQ ID NO: 376745 - DNA, 33 bp, Artificial Sequence; identical to SEQ ID NO: 31387
  Description of Artificial Sequence: Synthetic oligonucleotide

SEQ ID NO: 376746 - DNA, 32 bp, Artificial Sequence; identical to SEQ ID NO: 31388
  Description of Artificial Sequence: Synthetic oligonucleotide

SEQ ID NO: 376747 - DNA, 33 bp, Artificial Sequence; identical to SEQ ID NO: 31389
  Description of Artificial Sequence: Synthetic oligonucleotide

SEQ ID NO: 376748 - DNA, 32 bp, Artificial Sequence; identical to SEQ ID NO: 31390
  Description of Artificial Sequence: Synthetic oligonucleotide

SEQ ID NO: 376749 - DNA, 31 bp, Artificial Sequence; identical to SEQ ID NO: 31391
  Description of Artificial Sequence: Synthetic oligonucleotide

SEQ ID NO: 376750 - DNA, 31 bp, Artificial Sequence; identical to SEQ ID NO: 31392
  Description of Artificial Sequence: Synthetic oligonucleotide

SEQ ID NO: 376751 - DNA, 30 bp, Artificial Sequence; identical to SEQ ID NO: 31393
  Description of Artificial Sequence: Synthetic oligonucleotide

SEQ ID NO: 376752 - DNA, 30 bp, Artificial Sequence; identical to SEQ ID NO: 31394
  Description of Artificial Sequence: Synthetic oligonucleotide

SEQ ID NO: 376753 - DNA, 30 bp, Artificial Sequence; identical to SEQ ID NO: 31395
  Description of Artificial Sequence: Synthetic oligonucleotide

SEQ ID NO: 376754 - DNA, 29 bp, Artificial Sequence
  Description of Artificial Sequence: Synthetic oligonucleotide
atacacagacttaccgagagagcctgcgg

SEQ ID NO: 376755 - DNA, 28 bp, Artificial Sequence
  Description of Artificial Sequence: Synthetic oligonucleotide
tacacagacttaccgagagagcctgcgg

SEQ ID NO: 376756 - DNA, 20 bp, Artificial Sequence
  Description of Artificial Sequence: Synthetic oligonucleotide
catgtcccggcccggccgtg

SEQ ID NO: 376757 - DNA, 20 bp, Artificial Sequence
  Description of Artificial Sequence: Synthetic oligonucleotide
atgtcccggcccggccgtgg

SEQ ID NO: 376758 - DNA, 30 bp, Artificial Sequence; identical to SEQ ID NO: 31400
  Description of Artificial Sequence: Synthetic oligonucleotide

SEQ ID NO: 376759 - DNA, 29 bp, Artificial Sequence
  Description of Artificial Sequence: Synthetic oligonucleotide
acgtggacgacacccagttcgtgagattc

SEQ ID NO: 376760 - DNA, 28 bp, Artificial Sequence
  Description of Artificial Sequence: Synthetic oligonucleotide
cgtggacgacacccagttcgtgagattc

SEQ ID NO: 376761 - DNA, 28 bp, Artificial Sequence
  Description of Artificial Sequence: Synthetic oligonucleotide
gtggacgacacccagttcgtgagattcg

SEQ ID NO: 376762 - DNA, 29 bp, Artificial Sequence
  Description of Artificial Sequence: Synthetic oligonucleotide
tggacgacacccagttcgtgagattcgac

SEQ ID NO: 376763 - DNA, 28 bp, Artificial Sequence
  Description of Artificial Sequence: Synthetic oligonucleotide
ggacgacacccagttcgtgagattcgac

SEQ ID NO: 376764 - DNA, 29 bp, Artificial Sequence
  Description of Artificial Sequence: Synthetic oligonucleotide
gacgacacccagttcgtgagattcgacag

SEQ ID NO: 376765 - DNA, 29 bp, Artificial Sequence
  Description of Artificial Sequence: Synthetic oligonucleotide
acgacacccagttcgtgagattcgacagc

SEQ ID NO: 376766 - DNA, 28 bp, Artificial Sequence
  Description of Artificial Sequence: Synthetic oligonucleotide
cgacacccagttcgtgagattcgacagc

SEQ ID NO: 376767 - DNA, 28 bp, Artificial Sequence
  Description of Artificial Sequence: Synthetic oligonucleotide
gacacccagttcgtgagattcgacagcg

SEQ ID NO: 376768 - DNA, 29 bp, Artificial Sequence
  Description of Artificial Sequence: Synthetic oligonucleotide
acacccagttcgtgagattcgacagcgac

SEQ ID NO: 376769 - DNA, 28 bp, Artificial Sequence
  Description of Artificial Sequence: Synthetic oligonucleotide
cacccagttcgtgagattcgacagcgac

SEQ ID NO: 376770 - DNA, 28 bp, Artificial Sequence
  Description of Artificial Sequence: Synthetic oligonucleotide
acccagttcgtgagattcgacagcgacg

SEQ ID NO: 376771 - DNA, 27 bp, Artificial Sequence
  Description of Artificial Sequence: Synthetic oligonucleotide
cccagttcgtgagattcgacagcgacg

SEQ ID NO: 376772 - DNA, 27 bp, Artificial Sequence
  Description of Artificial Sequence: Synthetic oligonucleotide
ccagttcgtgagattcgacagcgacgc

SEQ ID NO: 376773 - DNA, 27 bp, Artificial Sequence
  Description of Artificial Sequence: Synthetic oligonucleotide
cagttcgtgagattcgacagcgacgcc

SEQ ID NO: 376774 - DNA, 27 bp, Artificial Sequence
  Description of Artificial Sequence: Synthetic oligonucleotide
agttcgtgagattcgacagcgacgccg

SEQ ID NO: 376775 - DNA, 26 bp, Artificial Sequence
  Description of Artificial Sequence: Synthetic oligonucleotide
gttcgtgagattcgacagcgacgccg

SEQ ID NO: 376776 - DNA, 26 bp, Artificial Sequence
  Description of Artificial Sequence: Synthetic oligonucleotide
ttcgtgagattcgacagcgacgccgc

SEQ ID NO: 376777 - DNA, 25 bp, Artificial Sequence
  Description of Artificial Sequence: Synthetic oligonucleotide
tcgtgagattcgacagcgacgccgc

SEQ ID NO: 376778 - DNA, 24 bp, Artificial Sequence
  Description of Artificial Sequence: Synthetic oligonucleotide
cgtgagattcgacagcgacgccgc

SEQ ID NO: 376779 - DNA, 25 bp, Artificial Sequence
  Description of Artificial Sequence: Synthetic oligonucleotide
gtgagattcgacagcgacgccgcga

SEQ ID NO: 376780 - DNA, 26 bp, Artificial Sequence
  Description of Artificial Sequence: Synthetic oligonucleotide
tgagattcgacagcgacgccgcgagt

SEQ ID NO: 376781 - DNA, 25 bp, Artificial Sequence
  Description of Artificial Sequence: Synthetic oligonucleotide
gagattcgacagcgacgccgcgagt

SEQ ID NO: 376782 - DNA, 25 bp, Artificial Sequence
  Description of Artificial Sequence: Synthetic oligonucleotide
agattcgacagcgacgccgcgagtc

SEQ ID NO: 376783 - DNA, 24 bp, Artificial Sequence
  Description of Artificial Sequence: Synthetic oligonucleotide
gattcgacagcgacgccgcgagtc

SEQ ID NO: 376784 - DNA, 24 bp, Artificial Sequence
  Description of Artificial Sequence: Synthetic oligonucleotide
attcgacagcgacgccgcgagtcc

SEQ ID NO: 376785 - DNA, 27 bp, Artificial Sequence
  Description of Artificial Sequence: Synthetic oligonucleotide
cagaggatgtatggctgcgacctgggt

SEQ ID NO: 376786 - DNA, 27 bp, Artificial Sequence
  Description of Artificial Sequence: Synthetic oligonucleotide
agaggatgtatggctgcgacctgggtc

SEQ ID NO: 376787 - DNA, 26 bp, Artificial Sequence
  Description of Artificial Sequence: Synthetic oligonucleotide
gaggatgtatggctgcgacctgggtc

SEQ ID NO: 376788 - DNA, 26 bp, Artificial Sequence
  Description of Artificial Sequence: Synthetic oligonucleotide
aggatgtatggctgcgacctgggtcc

SEQ ID NO: 376789 - DNA, 25 bp, Artificial Sequence
  Description of Artificial Sequence: Synthetic oligonucleotide
ggatgtatggctgcgacctgggtcc

SEQ ID NO: 376790 - DNA, 25 bp, Artificial Sequence
  Description of Artificial Sequence: Synthetic oligonucleotide
gatgtatggctgcgacctgggtccc

SEQ ID NO: 376791 - DNA, 26 bp, Artificial Sequence
  Description of Artificial Sequence: Synthetic oligonucleotide
atgtatggctgcgacctgggtcccga

SEQ ID NO: 376792 - DNA, 25 bp, Artificial Sequence
  Description of Artificial Sequence: Synthetic oligonucleotide
tgtatggctgcgacctgggtcccga

SEQ ID NO: 376793 - DNA, 24 bp, Artificial Sequence
  Description of Artificial Sequence: Synthetic oligonucleotide
gtatggctgcgacctgggtcccga

SEQ ID NO: 376794 - DNA, 24 bp, Artificial Sequence
  Description of Artificial Sequence: Synthetic oligonucleotide
tatggctgcgacctgggtcccgac

SEQ ID NO: 376795 - DNA, 23 bp, Artificial Sequence
  Description of Artificial Sequence: Synthetic oligonucleotide
atggctgcgacctgggtcccgac

SEQ ID NO: 376796 - DNA, 22 bp, Artificial Sequence
  Description of Artificial Sequence: Synthetic oligonucleotide
tggctgcgacctgggtcccgac

SEQ ID NO: 376797 - DNA, 21 bp, Artificial Sequence
  Description of Artificial Sequence: Synthetic oligonucleotide
ggctgcgacctgggtcccgac

SEQ ID NO: 376798 - DNA, 21 bp, Artificial Sequence
  Description of Artificial Sequence: Synthetic oligonucleotide
gctgcgacctgggtcccgacg

SEQ ID NO: 376799 - DNA, 21 bp, Artificial Sequence
  Description of Artificial Sequence: Synthetic oligonucleotide
ctgcgacctgggtcccgacgg

SEQ ID NO: 376800 - DNA, 21 bp, Artificial Sequence
  Description of Artificial Sequence: Synthetic oligonucleotide
tgcgacctgggtcccgacggg

SEQ ID NO: 376801 - DNA, 20 bp, Artificial Sequence
  Description of Artificial Sequence: Synthetic oligonucleotide
gcgacctgggtcccgacggg

SEQ ID NO: 376802 - DNA, 20 bp, Artificial Sequence
  Description of Artificial Sequence: Synthetic oligonucleotide
cgacctgggtcccgacgggc

SEQ ID NO: 376803 - DNA, 20 bp, Artificial Sequence
  Description of Artificial Sequence: Synthetic oligonucleotide
gacctgggtcccgacgggcg

SEQ ID NO: 376804 - DNA, 20 bp, Artificial Sequence
  Description of Artificial Sequence: Synthetic oligonucleotide
acctgggtcccgacgggcgc

SEQ ID NO: 376805 - DNA, 20 bp, Artificial Sequence
  Description of Artificial Sequence: Synthetic oligonucleotide
cctgggtcccgacgggcgct

SEQ ID NO: 376806 - DNA, 20 bp, Artificial Sequence
  Description of Artificial Sequence: Synthetic oligonucleotide
ctgggtcccgacgggcgcct

SEQ ID NO: 376807 - DNA, 20 bp, Artificial Sequence
  Description of Artificial Sequence: Synthetic oligonucleotide
tgggtcccgacgggcgcctc

SEQ ID NO: 376808 - DNA, 20 bp, Artificial Sequence
  Description of Artificial Sequence: Synthetic oligonucleotide
gggtcccgacgggcgcctct

SEQ ID NO: 376809 - DNA, 20 bp, Artificial Sequence
  Description of Artificial Sequence: Synthetic oligonucleotide
ggtcccgacgggcgcctcct

SEQ ID NO: 376810 - DNA, 20 bp, Artificial Sequence
  Description of Artificial Sequence: Synthetic oligonucleotide
gtcccgacgggcgcctcctc

SEQ ID NO: 376811 - DNA, 20 bp, Artificial Sequence
  Description of Artificial Sequence: Synthetic oligonucleotide
tcccgacgggcgcctcctcc

SEQ ID NO: 376812 - DNA, 20 bp, Artificial Sequence
  Description of Artificial Sequence: Synthetic oligonucleotide
gacggagccgcgggcgcctt

SEQ ID NO: 376813 - DNA, 20 bp, Artificial Sequence
  Description of Artificial Sequence: Synthetic oligonucleotide
acggagccgcgggcgccgtt

SEQ ID NO: 376814 - DNA, 20 bp, Artificial Sequence
  Description of Artificial Sequence: Synthetic oligonucleotide
cggagccgcgggcgccgttt

SEQ ID NO: 376815 - DNA, 22 bp, Artificial Sequence
  Description of Artificial Sequence: Synthetic oligonucleotide
cgacgccgcgagtccgaggact

SEQ ID NO: 376816 - DNA, 23 bp, Artificial Sequence
  Description of Artificial Sequence: Synthetic oligonucleotide
gacgccgcgagtccgaggactga

SEQ ID NO: 376817 - DNA, 23 bp, Artificial Sequence
  Description of Artificial Sequence: Synthetic oligonucleotide
acgccgcgagtccgaggactgag

SEQ ID NO: 376818 - DNA, 22 bp, Artificial Sequence
  Description of Artificial Sequence: Synthetic oligonucleotide
cgccgcgagtccgaggactgag

SEQ ID NO: 376819 - DNA, 22 bp, Artificial Sequence
  Description of Artificial Sequence: Synthetic oligonucleotide
gccgcgagtccgaggactgagc

SEQ ID NO: 376820 - DNA, 22 bp, Artificial Sequence
  Description of Artificial Sequence: Synthetic oligonucleotide
ccgcgagtccgaggactgagcc

SEQ ID NO: 376821 - DNA, 22 bp, Artificial Sequence
  Description of Artificial Sequence: Synthetic oligonucleotide
cgcgagtccgaggactgagccc

SEQ ID NO: 376822 - DNA, 22 bp, Artificial Sequence
  Description of Artificial Sequence: Synthetic oligonucleotide
gcgagtccgaggactgagcccc

SEQ ID NO: 376823 - DNA, 22 bp, Artificial Sequence
  Description of Artificial Sequence: Synthetic oligonucleotide
cgagtccgaggactgagccccg

SEQ ID NO: 376824 - DNA, 22 bp, Artificial Sequence
  Description of Artificial Sequence: Synthetic oligonucleotide
gagtccgaggactgagccccgg

SEQ ID NO: 376825 - DNA, 22 bp, Artificial Sequence
  Description of Artificial Sequence: Synthetic oligonucleotide
agtccgaggactgagccccggg

SEQ ID NO: 376826 - DNA, 21 bp, Artificial Sequence
  Description of Artificial Sequence: Synthetic oligonucleotide
gtccgaggactgagccccggg

SEQ ID NO: 376827 - DNA, 21 bp, Artificial Sequence
  Description of Artificial Sequence: Synthetic oligonucleotide
tccgaggactgagccccgggc

SEQ ID NO: 376828 - DNA, 20 bp, Artificial Sequence
  Description of Artificial Sequence: Synthetic oligonucleotide
ccgaggactgagccccgggc

SEQ ID NO: 376829 - DNA, 20 bp, Artificial Sequence
  Description of Artificial Sequence: Synthetic oligonucleotide
cgaggactgagccccgggcg

SEQ ID NO: 376830 - DNA, 20 bp, Artificial Sequence
  Description of Artificial Sequence: Synthetic oligonucleotide
gaggactgagccccgggcgc

SEQ ID NO: 376831 - DNA, 22 bp, Artificial Sequence
  Description of Artificial Sequence: Synthetic oligonucleotide
aggactgagccccgggcgccat

SEQ ID NO: 376832 - DNA, 21 bp, Artificial Sequence
  Description of Artificial Sequence: Synthetic oligonucleotide
ggactgagccccgggcgccat

SEQ ID NO: 376833 - DNA, 21 bp, Artificial Sequence
  Description of Artificial Sequence: Synthetic oligonucleotide
gactgagccccgggcgccatg

SEQ ID NO: 376834 - DNA, 24 bp, Artificial Sequence
  Description of Artificial Sequence: Synthetic oligonucleotide
actgagccccgggcgccatggata

SEQ ID NO: 376835 - DNA, 23 bp, Artificial Sequence
  Description of Artificial Sequence: Synthetic oligonucleotide
ctgagccccgggcgccatggata

SEQ ID NO: 376836 - DNA, 24 bp, Artificial Sequence
  Description of Artificial Sequence: Synthetic oligonucleotide
tgagccccgggcgccatggataga

SEQ ID NO: 376837 - DNA, 27 bp, Artificial Sequence
  Description of Artificial Sequence: Synthetic oligonucleotide
ctgtgcgtggagtggctccgcagatat

SEQ ID NO: 376838 - DNA, 27 bp, Artificial Sequence
  Description of Artificial Sequence: Synthetic oligonucleotide
tgtgcgtggagtggctccgcagatatc

SEQ ID NO: 376839 - DNA, 29 bp, Artificial Sequence
  Description of Artificial Sequence: Synthetic oligonucleotide
tccgcagatatctggagaacgggaaggag

SEQ ID NO: 376840 - DNA, 28 bp, Artificial Sequence
  Description of Artificial Sequence: Synthetic oligonucleotide
ccgcagatatctggagaacgggaaggag

SEQ ID NO: 376841 - DNA, 29 bp, Artificial Sequence
  Description of Artificial Sequence: Synthetic oligonucleotide
cgcagatatctggagaacgggaaggagac

SEQ ID NO: 376842 - DNA, 29 bp, Artificial Sequence
  Description of Artificial Sequence: Synthetic oligonucleotide
gcagatatctggagaacgggaaggagacg

SEQ ID NO: 376843 - DNA, 29 bp, Artificial Sequence
  Description of Artificial Sequence: Synthetic oligonucleotide
cagatatctggagaacgggaaggagacgc

SEQ ID NO: 376844 - DNA, 30 bp, Artificial Sequence; identical to SEQ ID NO: 31509
  Description of Artificial Sequence: Synthetic oligonucleotide

SEQ ID NO: 376845 - DNA, 29 bp, Artificial Sequence
  Description of Artificial Sequence: Synthetic oligonucleotide
gatatctggagaacgggaaggagacgctg

SEQ ID NO: 376846 - DNA, 29 bp, Artificial Sequence
  Description of Artificial Sequence: Synthetic oligonucleotide
atatctggagaacgggaaggagacgctgc

SEQ ID NO: 376847 - DNA, 28 bp, Artificial Sequence
  Description of Artificial Sequence: Synthetic oligonucleotide
tatctggagaacgggaaggagacgctgc

SEQ ID NO: 376848 - DNA, 27 bp, Artificial Sequence
  Description of Artificial Sequence: Synthetic oligonucleotide
atctggagaacgggaaggagacgctgc

SEQ ID NO: 376849 - DNA, 27 bp, Artificial Sequence
  Description of Artificial Sequence: Synthetic oligonucleotide
tctggagaacgggaaggagacgctgca

SEQ ID NO: 376850 - DNA, 26 bp, Artificial Sequence
  Description of Artificial Sequence: Synthetic oligonucleotide
agttcgtgaggttcgacagcgacgcg

SEQ ID NO: 376851 - DNA, 25 bp, Artificial Sequence
  Description of Artificial Sequence: Synthetic oligonucleotide
gttcgtgaggttcgacagcgacgcg

SEQ ID NO: 376852 - DNA, 25 bp, Artificial Sequence
  Description of Artificial Sequence: Synthetic oligonucleotide
ttcgtgaggttcgacagcgacgcgg

SEQ ID NO: 376853 - DNA, 24 bp, Artificial Sequence
  Description of Artificial Sequence: Synthetic oligonucleotide
tcgtgaggttcgacagcgacgcgg

SEQ ID NO: 376854 - DNA, 23 bp, Artificial Sequence
  Description of Artificial Sequence: Synthetic oligonucleotide
cgtgaggttcgacagcgacgcgg

SEQ ID NO: 376855 - DNA, 23 bp, Artificial Sequence
  Description of Artificial Sequence: Synthetic oligonucleotide
gtgaggttcgacagcgacgcggc

SEQ ID NO: 376856 - DNA, 24 bp, Artificial Sequence
  Description of Artificial Sequence: Synthetic oligonucleotide
tgaggttcgacagcgacgcggcga

SEQ ID NO: 376857 - DNA, 23 bp, Artificial Sequence
  Description of Artificial Sequence: Synthetic oligonucleotide
gaggttcgacagcgacgcggcga

SEQ ID NO: 376858 - DNA, 24 bp, Artificial Sequence
  Description of Artificial Sequence: Synthetic oligonucleotide
aggttcgacagcgacgcggcgagt

SEQ ID NO: 376859 - DNA, 23 bp, Artificial Sequence
  Description of Artificial Sequence: Synthetic oligonucleotide
ggttcgacagcgacgcggcgagt

SEQ ID NO: 376860 - DNA, 23 bp, Artificial Sequence
  Description of Artificial Sequence: Synthetic oligonucleotide
gttcgacagcgacgcggcgagtc

SEQ ID NO: 376861 - DNA, 23 bp, Artificial Sequence
  Description of Artificial Sequence: Synthetic oligonucleotide
ttcgacagcgacgcggcgagtcc

SEQ ID NO: 376862 - DNA, 22 bp, Artificial Sequence
  Description of Artificial Sequence: Synthetic oligonucleotide
tcgacagcgacgcggcgagtcc

SEQ ID NO: 376863 - DNA, 21 bp, Artificial Sequence
  Description of Artificial Sequence: Synthetic oligonucleotide
cgacagcgacgcggcgagtcc

SEQ ID NO: 376864 - DNA, 22 bp, Artificial Sequence
  Description of Artificial Sequence: Synthetic oligonucleotide
gacagcgacgcggcgagtccga

SEQ ID NO: 376865 - DNA, 22 bp, Artificial Sequence
  Description of Artificial Sequence: Synthetic oligonucleotide
acagcgacgcggcgagtccgag

SEQ ID NO: 376866 - DNA, 21 bp, Artificial Sequence
  Description of Artificial Sequence: Synthetic oligonucleotide
cagcgacgcggcgagtccgag

SEQ ID NO: 376867 - DNA, 22 bp, Artificial Sequence
  Description of Artificial Sequence: Synthetic oligonucleotide
agcgacgcggcgagtccgagga

SEQ ID NO: 376868 - DNA, 21 bp, Artificial Sequence
  Description of Artificial Sequence: Synthetic oligonucleotide
gcgacgcggcgagtccgagga

SEQ ID NO: 376869 - DNA, 21 bp, Artificial Sequence
  Description of Artificial Sequence: Synthetic oligonucleotide
cgacgcggcgagtccgaggac

SEQ ID NO: 376870 - DNA, 21 bp, Artificial Sequence
  Description of Artificial Sequence: Synthetic oligonucleotide
gacgcggcgagtccgaggacg

SEQ ID NO: 376871 - DNA, 22 bp, Artificial Sequence
  Description of Artificial Sequence: Synthetic oligonucleotide
acgcggcgagtccgaggacgga

SEQ ID NO: 376872 - DNA, 21 bp, Artificial Sequence
  Description of Artificial Sequence: Synthetic oligonucleotide
cgcggcgagtccgaggacgga

SEQ ID NO: 376873 - DNA, 21 bp, Artificial Sequence
  Description of Artificial Sequence: Synthetic oligonucleotide
gcggcgagtccgaggacggag

SEQ ID NO: 376874 - DNA, 21 bp, Artificial Sequence
  Description of Artificial Sequence: Synthetic oligonucleotide
cggcgagtccgaggacggagc

SEQ ID NO: 376875 - DNA, 21 bp, Artificial Sequence
  Description of Artificial Sequence: Synthetic oligonucleotide
ggcgagtccgaggacggagcc

SEQ ID NO: 376876 - DNA, 20 bp, Artificial Sequence
  Description of Artificial Sequence: Synthetic oligonucleotide
gaggacggagccccgggcct

SEQ ID NO: 376877 - DNA, 20 bp, Artificial Sequence
  Description of Artificial Sequence: Synthetic oligonucleotide
aggacggagccccgggccct

SEQ ID NO: 376878 - DNA, 20 bp, Artificial Sequence
  Description of Artificial Sequence: Synthetic oligonucleotide
ggacggagccccgggccctt

SEQ ID NO: 376879 - DNA, 20 bp, Artificial Sequence
  Description of Artificial Sequence: Synthetic oligonucleotide
gacggagccccgggccccat

SEQ ID NO: 376880 - DNA, 20 bp, Artificial Sequence
  Description of Artificial Sequence: Synthetic oligonucleotide
acggagccccgggccccatg

SEQ ID NO: 376881 - DNA, 20 bp, Artificial Sequence
  Description of Artificial Sequence: Synthetic oligonucleotide
cggagccccgggccccatgt

SEQ ID NO: 376882 - DNA, 22 bp, Artificial Sequence
  Description of Artificial Sequence: Synthetic oligonucleotide
ggagccccgggccccatggata

SEQ ID NO: 376883 - DNA, 23 bp, Artificial Sequence
  Description of Artificial Sequence: Synthetic oligonucleotide
gagccccgggccccatggataga

SEQ ID NO: 376884 - DNA, 23 bp, Artificial Sequence
  Description of Artificial Sequence: Synthetic oligonucleotide
agccccgggccccatggatagag

SEQ ID NO: 376885 - DNA, 22 bp, Artificial Sequence
  Description of Artificial Sequence: Synthetic oligonucleotide
gccccgggccccatggatagag

SEQ ID NO: 376886 - DNA, 23 bp, Artificial Sequence
  Description of Artificial Sequence: Synthetic oligonucleotide
ccccgggccccatggatagagca

SEQ ID NO: 376887 - DNA, 23 bp, Artificial Sequence
  Description of Artificial Sequence: Synthetic oligonucleotide
cccgggccccatggatagagcag

SEQ ID NO: 376888 - DNA, 24 bp, Artificial Sequence
  Description of Artificial Sequence: Synthetic oligonucleotide
ccgggccccatggatagagcagga

SEQ ID NO: 376889 - DNA, 24 bp, Artificial Sequence
  Description of Artificial Sequence: Synthetic oligonucleotide
cgggccccatggatagagcaggag

SEQ ID NO: 376890 - DNA, 24 bp, Artificial Sequence
  Description of Artificial Sequence: Synthetic oligonucleotide
gggccccatggatagagcaggagg

SEQ ID NO: 376891 - DNA, 24 bp, Artificial Sequence
  Description of Artificial Sequence: Synthetic oligonucleotide
ggccccatggatagagcaggaggg

SEQ ID NO: 376892 - DNA, 24 bp, Artificial Sequence
  Description of Artificial Sequence: Synthetic oligonucleotide
gccccatggatagagcaggagggg

SEQ ID NO: 376893 - DNA, 24 bp, Artificial Sequence
  Description of Artificial Sequence: Synthetic oligonucleotide
ccccatggatagagcaggaggggc

SEQ ID NO: 376894 - DNA, 24 bp, Artificial Sequence
  Description of Artificial Sequence: Synthetic oligonucleotide
cccatggatagagcaggaggggcc

SEQ ID NO: 376895 - DNA, 20 bp, Artificial Sequence
  Description of Artificial Sequence: Synthetic oligonucleotide
cgcaagtgggaggcggcccg

SEQ ID NO: 376896 - DNA, 20 bp, Artificial Sequence
  Description of Artificial Sequence: Synthetic oligonucleotide
gcaagtgggaggcggcccgg

SEQ ID NO: 376897 - DNA, 21 bp, Artificial Sequence
  Description of Artificial Sequence: Synthetic oligonucleotide
caagtgggaggcggcccgggt

SEQ ID NO: 376898 - DNA, 21 bp, Artificial Sequence
  Description of Artificial Sequence: Synthetic oligonucleotide
aagtgggaggcggcccgggtg

SEQ ID NO: 376899 - DNA, 20 bp, Artificial Sequence
  Description of Artificial Sequence: Synthetic oligonucleotide
agtgggaggcggcccgggtg

SEQ ID NO: 376900 - DNA, 20 bp, Artificial Sequence
  Description of Artificial Sequence: Synthetic oligonucleotide
gtgggaggcggcccgggtgt

SEQ ID NO: 376901 - DNA, 20 bp, Artificial Sequence
  Description of Artificial Sequence: Synthetic oligonucleotide
tgggaggcggcccgggtggt

SEQ ID NO: 376902 - DNA, 20 bp, Artificial Sequence
  Description of Artificial Sequence: Synthetic oligonucleotide
gggaggcggcccgggtggtt

SEQ ID NO: 376903 - DNA, 20 bp, Artificial Sequence
  Description of Artificial Sequence: Synthetic oligonucleotide
ggaggcggcccgggtggctt

SEQ ID NO: 376904 - DNA, 20 bp, Artificial Sequence
  Description of Artificial Sequence: Synthetic oligonucleotide
gaggcggcccgggtggcgtt

SEQ ID NO: 376905 - DNA, 20 bp, Artificial Sequence
  Description of Artificial Sequence: Synthetic oligonucleotide
aggcggcccgggtggcggat

SEQ ID NO: 376906 - DNA, 20 bp, Artificial Sequence
  Description of Artificial Sequence: Synthetic oligonucleotide
ggcggcccgggtggcggatt

SEQ ID NO: 376907 - DNA, 20 bp, Artificial Sequence
  Description of Artificial Sequence: Synthetic oligonucleotide
gcggcccgggtggcggagtt

SEQ ID NO: 376908 - DNA, 20 bp, Artificial Sequence
  Description of Artificial Sequence: Synthetic oligonucleotide
cggcccgggtggcggagcat

SEQ ID NO: 376909 - DNA, 20 bp, Artificial Sequence
  Description of Artificial Sequence: Synthetic oligonucleotide
ggcccgggtggcggagcagt

SEQ ID NO: 376910 - DNA, 20 bp, Artificial Sequence
  Description of Artificial Sequence: Synthetic oligonucleotide
gcccgggtggcggagcagct

SEQ ID NO: 376911 - DNA, 21 bp, Artificial Sequence
  Description of Artificial Sequence: Synthetic oligonucleotide
cccgggtggcggagcagctga

SEQ ID NO: 376912 - DNA, 22 bp, Artificial Sequence
  Description of Artificial Sequence: Synthetic oligonucleotide
ccgggtggcggagcagctgaga

SEQ ID NO: 376913 - DNA, 22 bp, Artificial Sequence
  Description of Artificial Sequence: Synthetic oligonucleotide
cgggtggcggagcagctgagag

SEQ ID NO: 376914 - DNA, 22 bp, Artificial Sequence
  Description of Artificial Sequence: Synthetic oligonucleotide
gggtggcggagcagctgagagc

SEQ ID NO: 376915 - DNA, 24 bp, Artificial Sequence
  Description of Artificial Sequence: Synthetic oligonucleotide
ggtggcggagcagctgagagccta

SEQ ID NO: 376916 - DNA, 30 bp, Artificial Sequence; identical to SEQ ID NO: 32617
  Description of Artificial Sequence: Synthetic oligonucleotide

SEQ ID NO: 376917 - DNA, 31 bp, Artificial Sequence; identical to SEQ ID NO: 32618
  Description of Artificial Sequence: Synthetic oligonucleotide

SEQ ID NO: 376918 - DNA, 31 bp, Artificial Sequence; identical to SEQ ID NO: 32619
  Description of Artificial Sequence: Synthetic oligonucleotide

SEQ ID NO: 376919 - DNA, 21 bp, Artificial Sequence
  Description of Artificial Sequence: Synthetic oligonucleotide
gacgccgcgagtccgaggacc

SEQ ID NO: 376920 - DNA, 22 bp, Artificial Sequence
  Description of Artificial Sequence: Synthetic oligonucleotide
acgccgcgagtccgaggaccga

SEQ ID NO: 376921 - DNA, 21 bp, Artificial Sequence
  Description of Artificial Sequence: Synthetic oligonucleotide
cgccgcgagtccgaggaccga

SEQ ID NO: 376922 - DNA, 21 bp, Artificial Sequence
  Description of Artificial Sequence: Synthetic oligonucleotide
gccgcgagtccgaggaccgag

SEQ ID NO: 376923 - DNA, 21 bp, Artificial Sequence
  Description of Artificial Sequence: Synthetic oligonucleotide
ccgcgagtccgaggaccgagc

SEQ ID NO: 376924 - DNA, 21 bp, Artificial Sequence
  Description of Artificial Sequence: Synthetic oligonucleotide
cgcgagtccgaggaccgagcc

SEQ ID NO: 376925 - DNA, 21 bp, Artificial Sequence
  Description of Artificial Sequence: Synthetic oligonucleotide
gcgagtccgaggaccgagccc

SEQ ID NO: 376926 - DNA, 21 bp, Artificial Sequence
  Description of Artificial Sequence: Synthetic oligonucleotide
cgagtccgaggaccgagcccc

SEQ ID NO: 376927 - DNA, 21 bp, Artificial Sequence
  Description of Artificial Sequence: Synthetic oligonucleotide
gagtccgaggaccgagccccg

SEQ ID NO: 376928 - DNA, 21 bp, Artificial Sequence
  Description of Artificial Sequence: Synthetic oligonucleotide
agtccgaggaccgagccccgg

SEQ ID NO: 376929 - DNA, 20 bp, Artificial Sequence
  Description of Artificial Sequence: Synthetic oligonucleotide
gtccgaggaccgagccccgg

SEQ ID NO: 376930 - DNA, 20 bp, Artificial Sequence
  Description of Artificial Sequence: Synthetic oligonucleotide
tccgaggaccgagccccggg

SEQ ID NO: 376931 - DNA, 20 bp, Artificial Sequence
  Description of Artificial Sequence: Synthetic oligonucleotide
ccgaggaccgagccccgggt

SEQ ID NO: 376932 - DNA, 20 bp, Artificial Sequence
  Description of Artificial Sequence: Synthetic oligonucleotide
cgaggaccgagccccgggct

SEQ ID NO: 376933 - DNA, 20 bp, Artificial Sequence
  Description of Artificial Sequence: Synthetic oligonucleotide
gaggaccgagccccgggcgt

SEQ ID NO: 376934 - DNA, 20 bp, Artificial Sequence
  Description of Artificial Sequence: Synthetic oligonucleotide
aggaccgagccccgggcgct

SEQ ID NO: 376935 - DNA, 20 bp, Artificial Sequence
  Description of Artificial Sequence: Synthetic oligonucleotide
ggaccgagccccgggcgctt

SEQ ID NO: 376936 - DNA, 20 bp, Artificial Sequence
  Description of Artificial Sequence: Synthetic oligonucleotide
gaccgagccccgggcgccat

SEQ ID NO: 376937 - DNA, 20 bp, Artificial Sequence
  Description of Artificial Sequence: Synthetic oligonucleotide
accgagccccgggcgccatg

SEQ ID NO: 376938 - DNA, 20 bp, Artificial Sequence
  Description of Artificial Sequence: Synthetic oligonucleotide
ccgagccccgggcgccatgt

SEQ ID NO: 376939 - DNA, 22 bp, Artificial Sequence
  Description of Artificial Sequence: Synthetic oligonucleotide
cgagccccgggcgccatggata

SEQ ID NO: 376940 - DNA, 27 bp, Artificial Sequence
  Description of Artificial Sequence: Synthetic oligonucleotide
cgcttcatcgcagtgggctacgtggat

SEQ ID NO: 376941 - DNA, 27 bp, Artificial Sequence
  Description of Artificial Sequence: Synthetic oligonucleotide
gcttcatcgcagtgggctacgtggatg

SEQ ID NO: 376942 - DNA, 28 bp, Artificial Sequence
  Description of Artificial Sequence: Synthetic oligonucleotide
cttcatcgcagtgggctacgtggatgac

SEQ ID NO: 376943 - DNA, 29 bp, Artificial Sequence
  Description of Artificial Sequence: Synthetic oligonucleotide
ttcatcgcagtgggctacgtggatgacac

SEQ ID NO: 376944 - DNA, 28 bp, Artificial Sequence
  Description of Artificial Sequence: Synthetic oligonucleotide
tcatcgcagtgggctacgtggatgacac

SEQ ID NO: 376945 - DNA, 27 bp, Artificial Sequence
  Description of Artificial Sequence: Synthetic oligonucleotide
catcgcagtgggctacgtggatgacac

SEQ ID NO: 376946 - DNA, 27 bp, Artificial Sequence
  Description of Artificial Sequence: Synthetic oligonucleotide
atcgcagtgggctacgtggatgacacc

SEQ ID NO: 376947 - DNA, 26 bp, Artificial Sequence
  Description of Artificial Sequence: Synthetic oligonucleotide
tcgcagtgggctacgtggatgacacc

SEQ ID NO: 376948 - DNA, 25 bp, Artificial Sequence
  Description of Artificial Sequence: Synthetic oligonucleotide
cgcagtgggctacgtggatgacacc

SEQ ID NO: 376949 - DNA, 26 bp, Artificial Sequence
  Description of Artificial Sequence: Synthetic oligonucleotide
gcagtgggctacgtggatgacaccca

SEQ ID NO: 376950 - DNA, 27 bp, Artificial Sequence
  Description of Artificial Sequence: Synthetic oligonucleotide
cagtgggctacgtggatgacacccagt

SEQ ID NO: 376951 - DNA, 28 bp, Artificial Sequence
  Description of Artificial Sequence: Synthetic oligonucleotide
agtgggctacgtggatgacacccagttc

SEQ ID NO: 376952 - DNA, 27 bp, Artificial Sequence
  Description of Artificial Sequence: Synthetic oligonucleotide
gtgggctacgtggatgacacccagttc

SEQ ID NO: 376953 - DNA, 27 bp, Artificial Sequence
  Description of Artificial Sequence: Synthetic oligonucleotide
tgggctacgtggatgacacccagttcg

SEQ ID NO: 376954 - DNA, 27 bp, Artificial Sequence
  Description of Artificial Sequence: Synthetic oligonucleotide
gggctacgtggatgacacccagttcgt

SEQ ID NO: 376955 - DNA, 27 bp, Artificial Sequence
  Description of Artificial Sequence: Synthetic oligonucleotide
ggctacgtggatgacacccagttcgtg

SEQ ID NO: 376956 - DNA, 28 bp, Artificial Sequence
  Description of Artificial Sequence: Synthetic oligonucleotide
gctacgtggatgacacccagttcgtgag

SEQ ID NO: 376957 - DNA, 28 bp, Artificial Sequence
  Description of Artificial Sequence: Synthetic oligonucleotide
ctacgtggatgacacccagttcgtgagg

SEQ ID NO: 376958 - DNA, 30 bp, Artificial Sequence
  Description of Artificial Sequence: Synthetic oligonucleotide
tacgtggatgacacccagttcgtgaggttc

SEQ ID NO: 376959 - DNA, 29 bp, Artificial Sequence
  Description of Artificial Sequence: Synthetic oligonucleotide
acgtggatgacacccagttcgtgaggttc

SEQ ID NO: 376960 - DNA, 28 bp, Artificial Sequence
  Description of Artificial Sequence: Synthetic oligonucleotide
cgtggatgacacccagttcgtgaggttc

SEQ ID NO: 376961 - DNA, 28 bp, Artificial Sequence
  Description of Artificial Sequence: Synthetic oligonucleotide
gtggatgacacccagttcgtgaggttcg

SEQ ID NO: 376962 - DNA, 29 bp, Artificial Sequence
  Description of Artificial Sequence: Synthetic oligonucleotide
tggatgacacccagttcgtgaggttcgac

SEQ ID NO: 376963 - DNA, 28 bp, Artificial Sequence
  Description of Artificial Sequence: Synthetic oligonucleotide
ggatgacacccagttcgtgaggttcgac

SEQ ID NO: 376964 - DNA, 29 bp, Artificial Sequence
  Description of Artificial Sequence: Synthetic oligonucleotide
gatgacacccagttcgtgaggttcgacag

SEQ ID NO: 376965 - DNA, 29 bp, Artificial Sequence
  Description of Artificial Sequence: Synthetic oligonucleotide
atgacacccagttcgtgaggttcgacagc

SEQ ID NO: 376966 - DNA, 28 bp, Artificial Sequence
  Description of Artificial Sequence: Synthetic oligonucleotide
tgacacccagttcgtgaggttcgacagc

SEQ ID NO: 376967 - DNA, 27 bp, Artificial Sequence
  Description of Artificial Sequence: Synthetic oligonucleotide
cccccaaagacacacgtgacccaccat

SEQ ID NO: 376968 - DNA, 27 bp, Artificial Sequence
  Description of Artificial Sequence: Synthetic oligonucleotide
ccccaaagacacacgtgacccaccatc

SEQ ID NO: 376969 - DNA, 27 bp, Artificial Sequence
  Description of Artificial Sequence: Synthetic oligonucleotide
cccaaagacacacgtgacccaccatcc

SEQ ID NO: 376970 - DNA, 27 bp, Artificial Sequence
  Description of Artificial Sequence: Synthetic oligonucleotide
ccaaagacacacgtgacccaccatccc

SEQ ID NO: 376971 - DNA, 27 bp, Artificial Sequence
  Description of Artificial Sequence: Synthetic oligonucleotide
caaagacacacgtgacccaccatcccg

SEQ ID NO: 376972 - DNA, 28 bp, Artificial Sequence
  Description of Artificial Sequence: Synthetic oligonucleotide
aaagacacacgtgacccaccatcccgtc

SEQ ID NO: 376973 - DNA, 27 bp, Artificial Sequence
  Description of Artificial Sequence: Synthetic oligonucleotide
aagacacacgtgacccaccatcccgtc

SEQ ID NO: 376974 - DNA, 27 bp, Artificial Sequence
  Description of Artificial Sequence: Synthetic oligonucleotide
agacacacgtgacccaccatcccgtct

SEQ ID NO: 376975 - DNA, 26 bp, Artificial Sequence
  Description of Artificial Sequence: Synthetic oligonucleotide
gacacacgtgacccaccatcccgtct

SEQ ID NO: 376976 - DNA, 27 bp, Artificial Sequence
  Description of Artificial Sequence: Synthetic oligonucleotide
acacacgtgacccaccatcccgtctct

SEQ ID NO: 376977 - DNA, 26 bp, Artificial Sequence
  Description of Artificial Sequence: Synthetic oligonucleotide
cacacgtgacccaccatcccgtctct

SEQ ID NO: 376978 - DNA, 27 bp, Artificial Sequence
  Description of Artificial Sequence: Synthetic oligonucleotide
acacgtgacccaccatcccgtctctga

SEQ ID NO: 376979 - DNA, 26 bp, Artificial Sequence
  Description of Artificial Sequence: Synthetic oligonucleotide
cacgtgacccaccatcccgtctctga

SEQ ID NO: 376980 - DNA, 26 bp, Artificial Sequence
  Description of Artificial Sequence: Synthetic oligonucleotide
acgtgacccaccatcccgtctctgac

SEQ ID NO: 376981 - DNA, 25 bp, Artificial Sequence
  Description of Artificial Sequence: Synthetic oligonucleotide
cgtgacccaccatcccgtctctgac

SEQ ID NO: 376982 - DNA, 27 bp, Artificial Sequence
  Description of Artificial Sequence: Synthetic oligonucleotide
gtgacccaccatcccgtctctgaccat

SEQ ID NO: 376983 - DNA, 27 bp, Artificial Sequence
  Description of Artificial Sequence: Synthetic oligonucleotide
tgacccaccatcccgtctctgaccatg

SEQ ID NO: 376984 - DNA, 27 bp, Artificial Sequence
  Description of Artificial Sequence: Synthetic oligonucleotide
gacccaccatcccgtctctgaccatga

SEQ ID NO: 376985 - DNA, 27 bp, Artificial Sequence
  Description of Artificial Sequence: Synthetic oligonucleotide
acccaccatcccgtctctgaccatgag

SEQ ID NO: 376986 - DNA, 26 bp, Artificial Sequence
  Description of Artificial Sequence: Synthetic oligonucleotide
cccaccatcccgtctctgaccatgag

SEQ ID NO: 376987 - DNA, 26 bp, Artificial Sequence
  Description of Artificial Sequence: Synthetic oligonucleotide
ccaccatcccgtctctgaccatgagg

SEQ ID NO: 376988 - DNA, 26 bp, Artificial Sequence
  Description of Artificial Sequence: Synthetic oligonucleotide
caccatcccgtctctgaccatgaggc

SEQ ID NO: 376989 - DNA, 27 bp, Artificial Sequence
  Description of Artificial Sequence: Synthetic oligonucleotide
accatcccgtctctgaccatgaggcca

SEQ ID NO: 376990 - DNA, 26 bp, Artificial Sequence
  Description of Artificial Sequence: Synthetic oligonucleotide
ccatcccgtctctgaccatgaggcca

SEQ ID NO: 376991 - DNA, 26 bp, Artificial Sequence
  Description of Artificial Sequence: Synthetic oligonucleotide
catcccgtctctgaccatgaggccac

SEQ ID NO: 376992 - DNA, 26 bp, Artificial Sequence
  Description of Artificial Sequence: Synthetic oligonucleotide
atcccgtctctgaccatgaggccacc

SEQ ID NO: 376993 - DNA, 25 bp, Artificial Sequence
  Description of Artificial Sequence: Synthetic oligonucleotide
tcccgtctctgaccatgaggccacc

SEQ ID NO: 376994 - DNA, 20 bp, Artificial Sequence
  Description of Artificial Sequence: Synthetic oligonucleotide
ccggccgcggggagcctctt

SEQ ID NO: 376995 - DNA, 20 bp, Artificial Sequence
  Description of Artificial Sequence: Synthetic oligonucleotide
cggccgcggggagcctcgtt

SEQ ID NO: 376996 - DNA, 20 bp, Artificial Sequence
  Description of Artificial Sequence: Synthetic oligonucleotide
ggccgcggggagcctcgctt

SEQ ID NO: 376997 - DNA, 22 bp, Artificial Sequence
  Description of Artificial Sequence: Synthetic oligonucleotide
gccgcggggagcctcgcttcat

SEQ ID NO: 376998 - DNA, 22 bp, Artificial Sequence
  Description of Artificial Sequence: Synthetic oligonucleotide
ccgcggggagcctcgcttcatc

SEQ ID NO: 376999 - DNA, 22 bp, Artificial Sequence
  Description of Artificial Sequence: Synthetic oligonucleotide
cgcggggagcctcgcttcatcg

SEQ ID NO: 377000 - DNA, 23 bp, Artificial Sequence
  Description of Artificial Sequence: Synthetic oligonucleotide
gcggggagcctcgcttcatcgca

SEQ ID NO: 377001 - DNA, 24 bp, Artificial Sequence
  Description of Artificial Sequence: Synthetic oligonucleotide
cggggagcctcgcttcatcgcagt

SEQ ID NO: 377002 - DNA, 24 bp, Artificial Sequence
  Description of Artificial Sequence: Synthetic oligonucleotide
ggggagcctcgcttcatcgcagtg

SEQ ID NO: 377003 - DNA, 24 bp, Artificial Sequence
  Description of Artificial Sequence: Synthetic oligonucleotide
gggagcctcgcttcatcgcagtgg

SEQ ID NO: 377004 - DNA, 24 bp, Artificial Sequence
  Description of Artificial Sequence: Synthetic oligonucleotide
ggagcctcgcttcatcgcagtggg

SEQ ID NO: 377005 - DNA, 26 bp, Artificial Sequence
  Description of Artificial Sequence: Synthetic oligonucleotide
gagcctcgcttcatcgcagtgggcta

SEQ ID NO: 377006 - DNA, 26 bp, Artificial Sequence
  Description of Artificial Sequence: Synthetic oligonucleotide
agcctcgcttcatcgcagtgggctac

SEQ ID NO: 377007 - DNA, 25 bp, Artificial Sequence
  Description of Artificial Sequence: Synthetic oligonucleotide
gcctcgcttcatcgcagtgggctac

SEQ ID NO: 377008 - DNA, 26 bp, Artificial Sequence
  Description of Artificial Sequence: Synthetic oligonucleotide
cctcgcttcatcgcagtgggctacgt

SEQ ID NO: 377009 - DNA, 26 bp, Artificial Sequence
  Description of Artificial Sequence: Synthetic oligonucleotide
ctcgcttcatcgcagtgggctacgtg

SEQ ID NO: 377010 - DNA, 27 bp, Artificial Sequence
  Description of Artificial Sequence: Synthetic oligonucleotide
tcgcttcatcgcagtgggctacgtgga

SEQ ID NO: 377011 - DNA, 20 bp, Artificial Sequence
  Description of Artificial Sequence: Synthetic oligonucleotide
acgggcgcttcctccgcggg

SEQ ID NO: 377012 - DNA, 20 bp, Artificial Sequence
  Description of Artificial Sequence: Synthetic oligonucleotide
cgggcgcttcctccgcgggt

SEQ ID NO: 377013 - DNA, 23 bp, Artificial Sequence
  Description of Artificial Sequence: Synthetic oligonucleotide
gggcgcttcctccgcgggcataa

SEQ ID NO: 377014 - DNA, 23 bp, Artificial Sequence
  Description of Artificial Sequence: Synthetic oligonucleotide
ggcgcttcctccgcgggcataac

SEQ ID NO: 377015 - DNA, 24 bp, Artificial Sequence
  Description of Artificial Sequence: Synthetic oligonucleotide
gcgcttcctccgcgggcataacca

SEQ ID NO: 377016 - DNA, 26 bp, Artificial Sequence
  Description of Artificial Sequence: Synthetic oligonucleotide
cgcttcctccgcgggcataaccagta

SEQ ID NO: 377017 - DNA, 26 bp, Artificial Sequence
  Description of Artificial Sequence: Synthetic oligonucleotide
gcttcctccgcgggcataaccagtac

SEQ ID NO: 377018 - DNA, 26 bp, Artificial Sequence
  Description of Artificial Sequence: Synthetic oligonucleotide
cttcctccgcgggcataaccagtacg

SEQ ID NO: 377019 - DNA, 26 bp, Artificial Sequence
  Description of Artificial Sequence: Synthetic oligonucleotide
ttcctccgcgggcataaccagtacgc

SEQ ID NO: 377020 - DNA, 23 bp, Artificial Sequence
  Description of Artificial Sequence: Synthetic oligonucleotide
gagagagcctgcggaacctgcgg

SEQ ID NO: 377021 - DNA, 23 bp, Artificial Sequence
  Description of Artificial Sequence: Synthetic oligonucleotide
agagagcctgcggaacctgcggg

SEQ ID NO: 377022 - DNA, 22 bp, Artificial Sequence
  Description of Artificial Sequence: Synthetic oligonucleotide
gagagcctgcggaacctgcggg

SEQ ID NO: 377023 - DNA, 22 bp, Artificial Sequence
  Description of Artificial Sequence: Synthetic oligonucleotide
agagcctgcggaacctgcgggg

SEQ ID NO: 377024 - DNA, 21 bp, Artificial Sequence
  Description of Artificial Sequence: Synthetic oligonucleotide
gagcctgcggaacctgcgggg

SEQ ID NO: 377025 - DNA, 23 bp, Artificial Sequence
  Description of Artificial Sequence: Synthetic oligonucleotide
agcctgcggaacctgcggggcta

SEQ ID NO: 377026 - DNA, 22 bp, Artificial Sequence
  Description of Artificial Sequence: Synthetic oligonucleotide
gcctgcggaacctgcggggcta

SEQ ID NO: 377027 - DNA, 24 bp, Artificial Sequence
  Description of Artificial Sequence: Synthetic oligonucleotide
cctgcggaacctgcggggctacta

SEQ ID NO: 377028 - DNA, 26 bp, Artificial Sequence
  Description of Artificial Sequence: Synthetic oligonucleotide
ctgcggaacctgcggggctactacaa

SEQ ID NO: 377029 - DNA, 26 bp, Artificial Sequence
  Description of Artificial Sequence: Synthetic oligonucleotide
tgcggaacctgcggggctactacaac

SEQ ID NO: 377030 - DNA, 25 bp, Artificial Sequence
  Description of Artificial Sequence: Synthetic oligonucleotide
gcggaacctgcggggctactacaac

SEQ ID NO: 377031 - DNA, 26 bp, Artificial Sequence
  Description of Artificial Sequence: Synthetic oligonucleotide
cggaacctgcggggctactacaacca

SEQ ID NO: 377032 - DNA, 27 bp, Artificial Sequence
  Description of Artificial Sequence: Synthetic oligonucleotide
ggaacctgcggggctactacaaccaga

SEQ ID NO: 377033 - DNA, 27 bp, Artificial Sequence
  Description of Artificial Sequence: Synthetic oligonucleotide
gaacctgcggggctactacaaccagag

SEQ ID NO: 377034 - DNA, 27 bp, Artificial Sequence
  Description of Artificial Sequence: Synthetic oligonucleotide
aacctgcggggctactacaaccagagc

SEQ ID NO: 377035 - DNA, 26 bp, Artificial Sequence
  Description of Artificial Sequence: Synthetic oligonucleotide
acctgcggggctactacaaccagagc

SEQ ID NO: 377036 - DNA, 25 bp, Artificial Sequence
  Description of Artificial Sequence: Synthetic oligonucleotide
cctgcggggctactacaaccagagc

SEQ ID NO: 377037 - DNA, 26 bp, Artificial Sequence
  Description of Artificial Sequence: Synthetic oligonucleotide
ctgcggggctactacaaccagagcga

SEQ ID NO: 377038 - DNA, 26 bp, Artificial Sequence
  Description of Artificial Sequence: Synthetic oligonucleotide
tgcggggctactacaaccagagcgag

SEQ ID NO: 377039 - DNA, 25 bp, Artificial Sequence
  Description of Artificial Sequence: Synthetic oligonucleotide
gcggggctactacaaccagagcgag

SEQ ID NO: 377040 - DNA, 25 bp, Artificial Sequence
  Description of Artificial Sequence: Synthetic oligonucleotide
cggggctactacaaccagagcgagg

SEQ ID NO: 377041 - DNA, 25 bp, Artificial Sequence
  Description of Artificial Sequence: Synthetic oligonucleotide
ggggctactacaaccagagcgaggc

SEQ ID NO: 377042 - DNA, 25 bp, Artificial Sequence
  Description of Artificial Sequence: Synthetic oligonucleotide
gggctactacaaccagagcgaggcc

SEQ ID NO: 377043 - DNA, 24 bp, Artificial Sequence
  Description of Artificial Sequence: Synthetic oligonucleotide
gcctgtgcgtggagtggctccgta

SEQ ID NO: 377044 - DNA, 27 bp, Artificial Sequence
  Description of Artificial Sequence: Synthetic oligonucleotide
cctgtgcgtggagtggctccgtagata

SEQ ID NO: 377045 - DNA, 27 bp, Artificial Sequence
  Description of Artificial Sequence: Synthetic oligonucleotide
ctgtgcgtggagtggctccgtagatac

SEQ ID NO: 377046 - DNA, 27 bp, Artificial Sequence
  Description of Artificial Sequence: Synthetic oligonucleotide
tgtgcgtggagtggctccgtagatacc

SEQ ID NO: 377047 - DNA, 27 bp, Artificial Sequence
  Description of Artificial Sequence: Synthetic oligonucleotide
gtgcgtggagtggctccgtagatacct

SEQ ID NO: 377048 - DNA, 27 bp, Artificial Sequence
  Description of Artificial Sequence: Synthetic oligonucleotide
tgcgtggagtggctccgtagatacctg

SEQ ID NO: 377049 - DNA, 26 bp, Artificial Sequence
  Description of Artificial Sequence: Synthetic oligonucleotide
gcgtggagtggctccgtagatacctg

SEQ ID NO: 377050 - DNA, 27 bp, Artificial Sequence
  Description of Artificial Sequence: Synthetic oligonucleotide
cgtggagtggctccgtagatacctgga

SEQ ID NO: 377051 - DNA, 27 bp, Artificial Sequence
  Description of Artificial Sequence: Synthetic oligonucleotide
gtggagtggctccgtagatacctggag

SEQ ID NO: 377052 - DNA, 29 bp, Artificial Sequence
  Description of Artificial Sequence: Synthetic oligonucleotide
tggagtggctccgtagatacctggagaac

SEQ ID NO: 377053 - DNA, 28 bp, Artificial Sequence
  Description of Artificial Sequence: Synthetic oligonucleotide
ggagtggctccgtagatacctggagaac

SEQ ID NO: 377054 - DNA, 28 bp, Artificial Sequence
  Description of Artificial Sequence: Synthetic oligonucleotide
gagtggctccgtagatacctggagaacg

SEQ ID NO: 377055 - DNA, 28 bp, Artificial Sequence
  Description of Artificial Sequence: Synthetic oligonucleotide
agtggctccgtagatacctggagaacgg

SEQ ID NO: 377056 - DNA, 27 bp, Artificial Sequence
  Description of Artificial Sequence: Synthetic oligonucleotide
gtggctccgtagatacctggagaacgg

SEQ ID NO: 377057 - DNA, 27 bp, Artificial Sequence
  Description of Artificial Sequence: Synthetic oligonucleotide
tggctccgtagatacctggagaacggg

SEQ ID NO: 377058 - DNA, 27 bp, Artificial Sequence
  Description of Artificial Sequence: Synthetic oligonucleotide
ggctccgtagatacctggagaacggga

SEQ ID NO: 377059 - DNA, 28 bp, Artificial Sequence
  Description of Artificial Sequence: Synthetic oligonucleotide
gctccgtagatacctggagaacgggaag

SEQ ID NO: 377060 - DNA, 28 bp, Artificial Sequence
  Description of Artificial Sequence: Synthetic oligonucleotide
ctccgtagatacctggagaacgggaagg

SEQ ID NO: 377061 - DNA, 29 bp, Artificial Sequence
  Description of Artificial Sequence: Synthetic oligonucleotide
tccgtagatacctggagaacgggaaggag

SEQ ID NO: 377062 - DNA, 28 bp, Artificial Sequence
  Description of Artificial Sequence: Synthetic oligonucleotide
ccgtagatacctggagaacgggaaggag

SEQ ID NO: 377063 - DNA, 29 bp, Artificial Sequence
  Description of Artificial Sequence: Synthetic oligonucleotide
cgtagatacctggagaacgggaaggagac

SEQ ID NO: 377064 - DNA, 29 bp, Artificial Sequence
  Description of Artificial Sequence: Synthetic oligonucleotide
gtagatacctggagaacgggaaggagacg

SEQ ID NO: 377065 - DNA, 29 bp, Artificial Sequence
  Description of Artificial Sequence: Synthetic oligonucleotide
tagatacctggagaacgggaaggagacgc

SEQ ID NO: 377066 - DNA, 24 bp, Artificial Sequence
  Description of Artificial Sequence: Synthetic oligonucleotide
cctcctccgcgggcatgaccagtt

SEQ ID NO: 377067 - DNA, 24 bp, Artificial Sequence
  Description of Artificial Sequence: Synthetic oligonucleotide
ctcctccgcgggcatgaccagttc

SEQ ID NO: 377068 - DNA, 24 bp, Artificial Sequence
  Description of Artificial Sequence: Synthetic oligonucleotide
tcctccgcgggcatgaccagttcg

SEQ ID NO: 377069 - DNA, 23 bp, Artificial Sequence
  Description of Artificial Sequence: Synthetic oligonucleotide
cctccgcgggcatgaccagttcg

SEQ ID NO: 377070 - DNA, 23 bp, Artificial Sequence
  Description of Artificial Sequence: Synthetic oligonucleotide
ctccgcgggcatgaccagttcgc

SEQ ID NO: 377071 - DNA, 25 bp, Artificial Sequence
  Description of Artificial Sequence: Synthetic oligonucleotide
tccgcgggcatgaccagttcgccta

SEQ ID NO: 377072 - DNA, 24 bp, Artificial Sequence
  Description of Artificial Sequence: Synthetic oligonucleotide
ccgcgggcatgaccagttcgccta

SEQ ID NO: 377073 - DNA, 24 bp, Artificial Sequence
  Description of Artificial Sequence: Synthetic oligonucleotide
cgcgggcatgaccagttcgcctac

SEQ ID NO: 377074 - DNA, 25 bp, Artificial Sequence
  Description of Artificial Sequence: Synthetic oligonucleotide
gcgggcatgaccagttcgcctacga

SEQ ID NO: 377075 - DNA, 25 bp, Artificial Sequence
  Description of Artificial Sequence: Synthetic oligonucleotide
cgggcatgaccagttcgcctacgac

SEQ ID NO: 377076 - DNA, 25 bp, Artificial Sequence
  Description of Artificial Sequence: Synthetic oligonucleotide
gggcatgaccagttcgcctacgacg

SEQ ID NO: 377077 - DNA, 25 bp, Artificial Sequence
  Description of Artificial Sequence: Synthetic oligonucleotide
ggcatgaccagttcgcctacgacgg

SEQ ID NO: 377078 - DNA, 27 bp, Artificial Sequence
  Description of Artificial Sequence: Synthetic oligonucleotide
gcatgaccagttcgcctacgacggcaa

SEQ ID NO: 377079 - DNA, 27 bp, Artificial Sequence
  Description of Artificial Sequence: Synthetic oligonucleotide
catgaccagttcgcctacgacggcaag

SEQ ID NO: 377080 - DNA, 27 bp, Artificial Sequence
  Description of Artificial Sequence: Synthetic oligonucleotide
atgaccagttcgcctacgacggcaagg

SEQ ID NO: 377081 - DNA, 27 bp, Artificial Sequence
  Description of Artificial Sequence: Synthetic oligonucleotide
tgaccagttcgcctacgacggcaagga

SEQ ID NO: 377082 - DNA, 27 bp, Artificial Sequence
  Description of Artificial Sequence: Synthetic oligonucleotide
gaccagttcgcctacgacggcaaggat

SEQ ID NO: 377083 - DNA, 33 bp, Artificial Sequence; identical to SEQ ID NO: 31613
  Description of Artificial Sequence: Synthetic oligonucleotide

SEQ ID NO: 377084 - DNA, 32 bp, Artificial Sequence; identical to SEQ ID NO: 31614
  Description of Artificial Sequence: Synthetic oligonucleotide

SEQ ID NO: 377085 - DNA, 31 bp, Artificial Sequence; identical to SEQ ID NO: 31615
  Description of Artificial Sequence: Synthetic oligonucleotide

SEQ ID NO: 377086 - DNA, 31 bp, Artificial Sequence; identical to SEQ ID NO: 31616
  Description of Artificial Sequence: Synthetic oligonucleotide

SEQ ID NO: 377087 - DNA, 30 bp, Artificial Sequence; identical to SEQ ID NO: 31617
  Description of Artificial Sequence: Synthetic oligonucleotide

SEQ ID NO: 377088 - DNA, 30 bp, Artificial Sequence; identical to SEQ ID NO: 31618
  Description of Artificial Sequence: Synthetic oligonucleotide

SEQ ID NO: 377089 - DNA, 30 bp, Artificial Sequence; identical to SEQ ID NO: 31619
  Description of Artificial Sequence: Synthetic oligonucleotide

SEQ ID NO: 377090 - DNA, 29 bp, Artificial Sequence
  Description of Artificial Sequence: Synthetic oligonucleotide
acacacagacttaccgagagagcttgcgg

SEQ ID NO: 377091 - DNA, 28 bp, Artificial Sequence
  Description of Artificial Sequence: Synthetic oligonucleotide
cacacagacttaccgagagagcttgcgg

SEQ ID NO: 377092 - DNA, 30 bp, Artificial Sequence; identical to SEQ ID NO: 31622
  Description of Artificial Sequence: Synthetic oligonucleotide

SEQ ID NO: 377093 - DNA, 29 bp, Artificial Sequence
  Description of Artificial Sequence: Synthetic oligonucleotide
cacagacttaccgagagagcttgcggaac

SEQ ID NO: 377094 - DNA, 29 bp, Artificial Sequence
  Description of Artificial Sequence: Synthetic oligonucleotide
acagacttaccgagagagcttgcggaacc

SEQ ID NO: 377095 - DNA, 28 bp, Artificial Sequence
  Description of Artificial Sequence: Synthetic oligonucleotide
cagacttaccgagagagcttgcggaacc

SEQ ID NO: 377096 - DNA, 29 bp, Artificial Sequence
  Description of Artificial Sequence: Synthetic oligonucleotide
agacttaccgagagagcttgcggaacctg

SEQ ID NO: 377097 - DNA, 28 bp, Artificial Sequence
  Description of Artificial Sequence: Synthetic oligonucleotide
gacttaccgagagagcttgcggaacctg

SEQ ID NO: 377098 - DNA, 28 bp, Artificial Sequence
  Description of Artificial Sequence: Synthetic oligonucleotide
acttaccgagagagcttgcggaacctgc

SEQ ID NO: 377099 - DNA, 27 bp, Artificial Sequence
  Description of Artificial Sequence: Synthetic oligonucleotide
cttaccgagagagcttgcggaacctgc

SEQ ID NO: 377100 - DNA, 27 bp, Artificial Sequence
  Description of Artificial Sequence: Synthetic oligonucleotide
ttaccgagagagcttgcggaacctgcg

SEQ ID NO: 377101 - DNA, 26 bp, Artificial Sequence
  Description of Artificial Sequence: Synthetic oligonucleotide
taccgagagagcttgcggaacctgcg

SEQ ID NO: 377102 - DNA, 27 bp, Artificial Sequence
  Description of Artificial Sequence: Synthetic oligonucleotide
cagtgggctacgtggacgacacccaat

SEQ ID NO: 377103 - DNA, 28 bp, Artificial Sequence
  Description of Artificial Sequence: Synthetic oligonucleotide
agtgggctacgtggacgacacccaattc

SEQ ID NO: 377104 - DNA, 27 bp, Artificial Sequence
  Description of Artificial Sequence: Synthetic oligonucleotide
gtgggctacgtggacgacacccaattc

SEQ ID NO: 377105 - DNA, 27 bp, Artificial Sequence
  Description of Artificial Sequence: Synthetic oligonucleotide
tgggctacgtggacgacacccaattcg

SEQ ID NO: 377106 - DNA, 27 bp, Artificial Sequence
  Description of Artificial Sequence: Synthetic oligonucleotide
gggctacgtggacgacacccaattcgt

SEQ ID NO: 377107 - DNA, 27 bp, Artificial Sequence
  Description of Artificial Sequence: Synthetic oligonucleotide
ggctacgtggacgacacccaattcgtg

SEQ ID NO: 377108 - DNA, 28 bp, Artificial Sequence
  Description of Artificial Sequence: Synthetic oligonucleotide
gctacgtggacgacacccaattcgtgag

SEQ ID NO: 377109 - DNA, 28 bp, Artificial Sequence
  Description of Artificial Sequence: Synthetic oligonucleotide
ctacgtggacgacacccaattcgtgagg

SEQ ID NO: 377110 - DNA, 30 bp, Artificial Sequence; identical to SEQ ID NO: 31640
  Description of Artificial Sequence: Synthetic oligonucleotide

SEQ ID NO: 377111 - DNA, 29 bp, Artificial Sequence
  Description of Artificial Sequence: Synthetic oligonucleotide
acgtggacgacacccaattcgtgaggttc

SEQ ID NO: 377112 - DNA, 28 bp, Artificial Sequence
  Description of Artificial Sequence: Synthetic oligonucleotide
cgtggacgacacccaattcgtgaggttc

SEQ ID NO: 377113 - DNA, 28 bp, Artificial Sequence
  Description of Artificial Sequence: Synthetic oligonucleotide
gtggacgacacccaattcgtgaggttcg

SEQ ID NO: 377114 - DNA, 29 bp, Artificial Sequence
  Description of Artificial Sequence: Synthetic oligonucleotide
tggacgacacccaattcgtgaggttcgac

SEQ ID NO: 377115 - DNA, 28 bp, Artificial Sequence
  Description of Artificial Sequence: Synthetic oligonucleotide
ggacgacacccaattcgtgaggttcgac

SEQ ID NO: 377116 - DNA, 29 bp, Artificial Sequence
  Description of Artificial Sequence: Synthetic oligonucleotide
gacgacacccaattcgtgaggttcgacag

SEQ ID NO: 377117 - DNA, 29 bp, Artificial Sequence
  Description of Artificial Sequence: Synthetic oligonucleotide
acgacacccaattcgtgaggttcgacagc

SEQ ID NO: 377118 - DNA, 28 bp, Artificial Sequence
  Description of Artificial Sequence: Synthetic oligonucleotide
cgacacccaattcgtgaggttcgacagc

SEQ ID NO: 377119 - DNA, 28 bp, Artificial Sequence
  Description of Artificial Sequence: Synthetic oligonucleotide
gacacccaattcgtgaggttcgacagcg

SEQ ID NO: 377120 - DNA, 29 bp, Artificial Sequence
  Description of Artificial Sequence: Synthetic oligonucleotide
acacccaattcgtgaggttcgacagcgac

SEQ ID NO: 377121 - DNA, 28 bp, Artificial Sequence
  Description of Artificial Sequence: Synthetic oligonucleotide
cacccaattcgtgaggttcgacagcgac

SEQ ID NO: 377122 - DNA, 28 bp, Artificial Sequence
  Description of Artificial Sequence: Synthetic oligonucleotide
acccaattcgtgaggttcgacagcgacg

SEQ ID NO: 377123 - DNA, 27 bp, Artificial Sequence
  Description of Artificial Sequence: Synthetic oligonucleotide
cccaattcgtgaggttcgacagcgacg

SEQ ID NO: 377124 - DNA, 27 bp, Artificial Sequence
  Description of Artificial Sequence: Synthetic oligonucleotide
ccaattcgtgaggttcgacagcgacgc

SEQ ID NO: 377125 - DNA, 27 bp, Artificial Sequence
  Description of Artificial Sequence: Synthetic oligonucleotide
caattcgtgaggttcgacagcgacgcc

SEQ ID NO: 377126 - DNA, 27 bp, Artificial Sequence
  Description of Artificial Sequence: Synthetic oligonucleotide
aattcgtgaggttcgacagcgacgccg

SEQ ID NO: 377127 - DNA, 26 bp, Artificial Sequence
  Description of Artificial Sequence: Synthetic oligonucleotide
attcgtgaggttcgacagcgacgccg

SEQ ID NO: 377128 - DNA, 30 bp, Artificial Sequence
  Description of Artificial Sequence: Synthetic oligonucleotide
gctcgcactccatgaggtatttctacaccg

SEQ ID NO: 377129 - DNA, 30 bp, Artificial Sequence
  Description of Artificial Sequence: Synthetic oligonucleotide
ctcgcactccatgaggtatttctacaccgc

SEQ ID NO: 377130 - DNA, 30 bp, Artificial Sequence
  Description of Artificial Sequence: Synthetic oligonucleotide
tcgcactccatgaggtatttctacaccgcc

SEQ ID NO: 377131 - DNA, 29 bp, Artificial Sequence
  Description of Artificial Sequence: Synthetic oligonucleotide
cgcactccatgaggtatttctacaccgcc

SEQ ID NO: 377132 - DNA, 31 bp, Artificial Sequence
  Description of Artificial Sequence: Synthetic oligonucleotide
gcactccatgaggtatttctacaccgccatg

SEQ ID NO: 377133 - DNA, 26 bp, Artificial Sequence
  Description of Artificial Sequence: Synthetic oligonucleotide
tgagagcctacctggagggcctgtgt

SEQ ID NO: 377134 - DNA, 25 bp, Artificial Sequence
  Description of Artificial Sequence: Synthetic oligonucleotide
gagagcctacctggagggcctgtgt

SEQ ID NO: 377135 - DNA, 26 bp, Artificial Sequence
  Description of Artificial Sequence: Synthetic oligonucleotide
agagcctacctggagggcctgtgtgt

SEQ ID NO: 377136 - DNA, 25 bp, Artificial Sequence
  Description of Artificial Sequence: Synthetic oligonucleotide
gagcctacctggagggcctgtgtgt

SEQ ID NO: 377137 - DNA, 25 bp, Artificial Sequence
  Description of Artificial Sequence: Synthetic oligonucleotide
agcctacctggagggcctgtgtgtg

SEQ ID NO: 377138 - DNA, 24 bp, Artificial Sequence
  Description of Artificial Sequence: Synthetic oligonucleotide
gcctacctggagggcctgtgtgtg

SEQ ID NO: 377139 - DNA, 25 bp, Artificial Sequence
  Description of Artificial Sequence: Synthetic oligonucleotide
cctacctggagggcctgtgtgtgga

SEQ ID NO: 377140 - DNA, 26 bp, Artificial Sequence
  Description of Artificial Sequence: Synthetic oligonucleotide
ctacctggagggcctgtgtgtggagt

SEQ ID NO: 377141 - DNA, 26 bp, Artificial Sequence
  Description of Artificial Sequence: Synthetic oligonucleotide
tacctggagggcctgtgtgtggagtg

SEQ ID NO: 377142 - DNA, 25 bp, Artificial Sequence
  Description of Artificial Sequence: Synthetic oligonucleotide
acctggagggcctgtgtgtggagtg

SEQ ID NO: 377143 - DNA, 24 bp, Artificial Sequence
  Description of Artificial Sequence: Synthetic oligonucleotide
cctggagggcctgtgtgtggagtg

SEQ ID NO: 377144 - DNA, 24 bp, Artificial Sequence
  Description of Artificial Sequence: Synthetic oligonucleotide
ctggagggcctgtgtgtggagtgg

SEQ ID NO: 377145 - DNA, 25 bp, Artificial Sequence
  Description of Artificial Sequence: Synthetic oligonucleotide
tggagggcctgtgtgtggagtggct

SEQ ID NO: 377146 - DNA, 24 bp, Artificial Sequence
  Description of Artificial Sequence: Synthetic oligonucleotide
ggagggcctgtgtgtggagtggct

SEQ ID NO: 377147 - DNA, 24 bp, Artificial Sequence
  Description of Artificial Sequence: Synthetic oligonucleotide
gagggcctgtgtgtggagtggctc

SEQ ID NO: 377148 - DNA, 24 bp, Artificial Sequence
  Description of Artificial Sequence: Synthetic oligonucleotide
agggcctgtgtgtggagtggctcc

SEQ ID NO: 377149 - DNA, 23 bp, Artificial Sequence
  Description of Artificial Sequence: Synthetic oligonucleotide
gggcctgtgtgtggagtggctcc

SEQ ID NO: 377150 - DNA, 23 bp, Artificial Sequence
  Description of Artificial Sequence: Synthetic oligonucleotide
ggcctgtgtgtggagtggctccg

SEQ ID NO: 377151 - DNA, 24 bp, Artificial Sequence
  Description of Artificial Sequence: Synthetic oligonucleotide
gcctgtgtgtggagtggctccgca

SEQ ID NO: 377152 - DNA, 27 bp, Artificial Sequence
  Description of Artificial Sequence: Synthetic oligonucleotide
cctgtgtgtggagtggctccgcagata

SEQ ID NO: 377153 - DNA, 27 bp, Artificial Sequence
  Description of Artificial Sequence: Synthetic oligonucleotide
ctgtgtgtggagtggctccgcagatac

SEQ ID NO: 377154 - DNA, 27 bp, Artificial Sequence
  Description of Artificial Sequence: Synthetic oligonucleotide
tgtgtgtggagtggctccgcagatacc

SEQ ID NO: 377155 - DNA, 23 bp, Artificial Sequence
  Description of Artificial Sequence: Synthetic oligonucleotide
aaggagacgctgcagcgcgccga

SEQ ID NO: 377156 - DNA, 22 bp, Artificial Sequence
  Description of Artificial Sequence: Synthetic oligonucleotide
aggagacgctgcagcgcgccga

SEQ ID NO: 377157 - DNA, 21 bp, Artificial Sequence
  Description of Artificial Sequence: Synthetic oligonucleotide
ggagacgctgcagcgcgccga

SEQ ID NO: 377158 - DNA, 21 bp, Artificial Sequence
  Description of Artificial Sequence: Synthetic oligonucleotide
gagacgctgcagcgcgccgac

SEQ ID NO: 377159 - DNA, 21 bp, Artificial Sequence
  Description of Artificial Sequence: Synthetic oligonucleotide
agacgctgcagcgcgccgacc

SEQ ID NO: 377160 - DNA, 20 bp, Artificial Sequence
  Description of Artificial Sequence: Synthetic oligonucleotide
gacgctgcagcgcgccgacc

SEQ ID NO: 377161 - DNA, 20 bp, Artificial Sequence
  Description of Artificial Sequence: Synthetic oligonucleotide
acgctgcagcgcgccgaccc

SEQ ID NO: 377162 - DNA, 20 bp, Artificial Sequence
  Description of Artificial Sequence: Synthetic oligonucleotide
cgctgcagcgcgccgaccct

SEQ ID NO: 377163 - DNA, 20 bp, Artificial Sequence
  Description of Artificial Sequence: Synthetic oligonucleotide
gctgcagcgcgccgacccct

SEQ ID NO: 377164 - DNA, 20 bp, Artificial Sequence
  Description of Artificial Sequence: Synthetic oligonucleotide
ctgcagcgcgccgaccccct

SEQ ID NO: 377165 - DNA, 22 bp, Artificial Sequence
  Description of Artificial Sequence: Synthetic oligonucleotide
tgcagcgcgccgaccccccaaa

SEQ ID NO: 377166 - DNA, 21 bp, Artificial Sequence
  Description of Artificial Sequence: Synthetic oligonucleotide
gcagcgcgccgaccccccaaa

SEQ ID NO: 377167 - DNA, 22 bp, Artificial Sequence
  Description of Artificial Sequence: Synthetic oligonucleotide
cagcgcgccgaccccccaaaga

SEQ ID NO: 377168 - DNA, 23 bp, Artificial Sequence
  Description of Artificial Sequence: Synthetic oligonucleotide
agcgcgccgaccccccaaagaca

SEQ ID NO: 377169 - DNA, 22 bp, Artificial Sequence
  Description of Artificial Sequence: Synthetic oligonucleotide
gcgcgccgaccccccaaagaca

SEQ ID NO: 377170 - DNA, 23 bp, Artificial Sequence
  Description of Artificial Sequence: Synthetic oligonucleotide
cgcgccgaccccccaaagacaca

SEQ ID NO: 377171 - DNA, 23 bp, Artificial Sequence
  Description of Artificial Sequence: Synthetic oligonucleotide
gcgccgaccccccaaagacacac

SEQ ID NO: 377172 - DNA, 24 bp, Artificial Sequence
  Description of Artificial Sequence: Synthetic oligonucleotide
cgccgaccccccaaagacacacgt

SEQ ID NO: 377173 - DNA, 25 bp, Artificial Sequence
  Description of Artificial Sequence: Synthetic oligonucleotide
gccgaccccccaaagacacacgtga

SEQ ID NO: 377174 - DNA, 25 bp, Artificial Sequence
  Description of Artificial Sequence: Synthetic oligonucleotide
ccgaccccccaaagacacacgtgac

SEQ ID NO: 377175 - DNA, 25 bp, Artificial Sequence
  Description of Artificial Sequence: Synthetic oligonucleotide
cgaccccccaaagacacacgtgacc

SEQ ID NO: 377176 - DNA, 22 bp, Artificial Sequence
  Description of Artificial Sequence: Synthetic oligonucleotide
ctcctggaccgcggcagacacc

SEQ ID NO: 377177 - DNA, 22 bp, Artificial Sequence
  Description of Artificial Sequence: Synthetic oligonucleotide
tcctggaccgcggcagacaccg

SEQ ID NO: 377178 - DNA, 21 bp, Artificial Sequence
  Description of Artificial Sequence: Synthetic oligonucleotide
cctggaccgcggcagacaccg

SEQ ID NO: 377179 - DNA, 21 bp, Artificial Sequence
  Description of Artificial Sequence: Synthetic oligonucleotide
ctggaccgcggcagacaccgc

SEQ ID NO: 377180 - DNA, 21 bp, Artificial Sequence
  Description of Artificial Sequence: Synthetic oligonucleotide
tggaccgcggcagacaccgcg

SEQ ID NO: 377181 - DNA, 20 bp, Artificial Sequence
  Description of Artificial Sequence: Synthetic oligonucleotide
ggaccgcggcagacaccgcg

SEQ ID NO: 377182 - DNA, 20 bp, Artificial Sequence
  Description of Artificial Sequence: Synthetic oligonucleotide
gaccgcggcagacaccgcgg

SEQ ID NO: 377183 - DNA, 21 bp, Artificial Sequence
  Description of Artificial Sequence: Synthetic oligonucleotide
accgcggcagacaccgcggct

SEQ ID NO: 377184 - DNA, 20 bp, Artificial Sequence
  Description of Artificial Sequence: Synthetic oligonucleotide
ccgcggcagacaccgcggct

SEQ ID NO: 377185 - DNA, 21 bp, Artificial Sequence
  Description of Artificial Sequence: Synthetic oligonucleotide
cgcggcagacaccgcggctca

SEQ ID NO: 377186 - DNA, 23 bp, Artificial Sequence
  Description of Artificial Sequence: Synthetic oligonucleotide
gcggcagacaccgcggctcagat

SEQ ID NO: 377187 - DNA, 24 bp, Artificial Sequence
  Description of Artificial Sequence: Synthetic oligonucleotide
cggcagacaccgcggctcagatca

SEQ ID NO: 377188 - DNA, 24 bp, Artificial Sequence
  Description of Artificial Sequence: Synthetic oligonucleotide
ggcagacaccgcggctcagatcac

SEQ ID NO: 377189 - DNA, 24 bp, Artificial Sequence
  Description of Artificial Sequence: Synthetic oligonucleotide
gcagacaccgcggctcagatcacc

SEQ ID NO: 377190 - DNA, 25 bp, Artificial Sequence
  Description of Artificial Sequence: Synthetic oligonucleotide
cagacaccgcggctcagatcaccca

SEQ ID NO: 377191 - DNA, 25 bp, Artificial Sequence
  Description of Artificial Sequence: Synthetic oligonucleotide
agacaccgcggctcagatcacccag

SEQ ID NO: 377192 - DNA, 26 bp, Artificial Sequence
  Description of Artificial Sequence: Synthetic oligonucleotide
ggctactacaaccagagcgaagccgg

SEQ ID NO: 377193 - DNA, 27 bp, Artificial Sequence
  Description of Artificial Sequence: Synthetic oligonucleotide
gctactacaaccagagcgaagccgggt

SEQ ID NO: 377194 - DNA, 27 bp, Artificial Sequence
  Description of Artificial Sequence: Synthetic oligonucleotide
ctactacaaccagagcgaagccgggtc

SEQ ID NO: 377195 - DNA, 28 bp, Artificial Sequence
  Description of Artificial Sequence: Synthetic oligonucleotide
tactacaaccagagcgaagccgggtctc

SEQ ID NO: 377196 - DNA, 27 bp, Artificial Sequence
  Description of Artificial Sequence: Synthetic oligonucleotide
actacaaccagagcgaagccgggtctc

SEQ ID NO: 377197 - DNA, 27 bp, Artificial Sequence
  Description of Artificial Sequence: Synthetic oligonucleotide
ctacaaccagagcgaagccgggtctca

SEQ ID NO: 377198 - DNA, 27 bp, Artificial Sequence
  Description of Artificial Sequence: Synthetic oligonucleotide
tacaaccagagcgaagccgggtctcac

SEQ ID NO: 377199 - DNA, 27 bp, Artificial Sequence
  Description of Artificial Sequence: Synthetic oligonucleotide
acaaccagagcgaagccgggtctcaca

SEQ ID NO: 377200 - DNA, 27 bp, Artificial Sequence
  Description of Artificial Sequence: Synthetic oligonucleotide
caaccagagcgaagccgggtctcacat

SEQ ID NO: 377201 - DNA, 27 bp, Artificial Sequence
  Description of Artificial Sequence: Synthetic oligonucleotide
aaccagagcgaagccgggtctcacatc

SEQ ID NO: 377202 - DNA, 27 bp, Artificial Sequence
  Description of Artificial Sequence: Synthetic oligonucleotide
accagagcgaagccgggtctcacatca

SEQ ID NO: 377203 - DNA, 27 bp, Artificial Sequence
  Description of Artificial Sequence: Synthetic oligonucleotide
ccagagcgaagccgggtctcacatcat

SEQ ID NO: 377204 - DNA, 27 bp, Artificial Sequence
  Description of Artificial Sequence: Synthetic oligonucleotide
cagagcgaagccgggtctcacatcatc

SEQ ID NO: 377205 - DNA, 27 bp, Artificial Sequence
  Description of Artificial Sequence: Synthetic oligonucleotide
agagcgaagccgggtctcacatcatcc

SEQ ID NO: 377206 - DNA, 27 bp, Artificial Sequence
  Description of Artificial Sequence: Synthetic oligonucleotide
gagcgaagccgggtctcacatcatcca

SEQ ID NO: 377207 - DNA, 27 bp, Artificial Sequence
  Description of Artificial Sequence: Synthetic oligonucleotide
agcgaagccgggtctcacatcatccag

SEQ ID NO: 377208 - DNA, 27 bp, Artificial Sequence
  Description of Artificial Sequence: Synthetic oligonucleotide
gcgaagccgggtctcacatcatccaga

SEQ ID NO: 377209 - DNA, 27 bp, Artificial Sequence
  Description of Artificial Sequence: Synthetic oligonucleotide
cgaagccgggtctcacatcatccagag

SEQ ID NO: 377210 - DNA, 27 bp, Artificial Sequence
  Description of Artificial Sequence: Synthetic oligonucleotide
gaagccgggtctcacatcatccagagg

SEQ ID NO: 377211 - DNA, 29 bp, Artificial Sequence
  Description of Artificial Sequence: Synthetic oligonucleotide
aagccgggtctcacatcatccagaggatg

SEQ ID NO: 377212 - DNA, 28 bp, Artificial Sequence
  Description of Artificial Sequence: Synthetic oligonucleotide
agccgggtctcacatcatccagaggatg

SEQ ID NO: 377213 - DNA, 26 bp, Artificial Sequence
  Description of Artificial Sequence: Synthetic oligonucleotide
ctccagagcatgtacggctgcgacct

SEQ ID NO: 377214 - DNA, 26 bp, Artificial Sequence
  Description of Artificial Sequence: Synthetic oligonucleotide
tccagagcatgtacggctgcgacctg

SEQ ID NO: 377215 - DNA, 25 bp, Artificial Sequence
  Description of Artificial Sequence: Synthetic oligonucleotide
ccagagcatgtacggctgcgacctg

SEQ ID NO: 377216 - DNA, 25 bp, Artificial Sequence
  Description of Artificial Sequence: Synthetic oligonucleotide
cagagcatgtacggctgcgacctgg

SEQ ID NO: 377217 - DNA, 25 bp, Artificial Sequence
  Description of Artificial Sequence: Synthetic oligonucleotide
agagcatgtacggctgcgacctggg

SEQ ID NO: 377218 - DNA, 24 bp, Artificial Sequence
  Description of Artificial Sequence: Synthetic oligonucleotide
gagcatgtacggctgcgacctggg

SEQ ID NO: 377219 - DNA, 24 bp, Artificial Sequence
  Description of Artificial Sequence: Synthetic oligonucleotide
agcatgtacggctgcgacctgggg

SEQ ID NO: 377220 - DNA, 23 bp, Artificial Sequence
  Description of Artificial Sequence: Synthetic oligonucleotide
gcatgtacggctgcgacctgggg

SEQ ID NO: 377221 - DNA, 23 bp, Artificial Sequence
  Description of Artificial Sequence: Synthetic oligonucleotide
catgtacggctgcgacctggggc

SEQ ID NO: 377222 - DNA, 27 bp, Artificial Sequence
  Description of Artificial Sequence: Synthetic oligonucleotide
tgtgcgtggagtggctccgcagatact

SEQ ID NO: 377223 - DNA, 20 bp, Artificial Sequence
  Description of Artificial Sequence: Synthetic oligonucleotide
ggcccgtgtggcggagcagc

SEQ ID NO: 377224 - DNA, 20 bp, Artificial Sequence
  Description of Artificial Sequence: Synthetic oligonucleotide
gcccgtgtggcggagcagcg

SEQ ID NO: 377225 - DNA, 21 bp, Artificial Sequence
  Description of Artificial Sequence: Synthetic oligonucleotide
cccgtgtggcggagcagcgga

SEQ ID NO: 377226 - DNA, 22 bp, Artificial Sequence
  Description of Artificial Sequence: Synthetic oligonucleotide
ccgtgtggcggagcagcggaga

SEQ ID NO: 377227 - DNA, 22 bp, Artificial Sequence
  Description of Artificial Sequence: Synthetic oligonucleotide
cgtgtggcggagcagcggagag

SEQ ID NO: 377228 - DNA, 22 bp, Artificial Sequence
  Description of Artificial Sequence: Synthetic oligonucleotide
gtgtggcggagcagcggagagc

SEQ ID NO: 377229 - DNA, 25 bp, Artificial Sequence
  Description of Artificial Sequence: Synthetic oligonucleotide
ttcgacagcgacgccgcgagtccaa

SEQ ID NO: 377230 - DNA, 24 bp, Artificial Sequence
  Description of Artificial Sequence: Synthetic oligonucleotide
tcgacagcgacgccgcgagtccaa

SEQ ID NO: 377231 - DNA, 23 bp, Artificial Sequence
  Description of Artificial Sequence: Synthetic oligonucleotide
cgacagcgacgccgcgagtccaa

SEQ ID NO: 377232 - DNA, 23 bp, Artificial Sequence
  Description of Artificial Sequence: Synthetic oligonucleotide
gacagcgacgccgcgagtccaag

SEQ ID NO: 377233 - DNA, 24 bp, Artificial Sequence
  Description of Artificial Sequence: Synthetic oligonucleotide
acagcgacgccgcgagtccaagga

SEQ ID NO: 377234 - DNA, 23 bp, Artificial Sequence
  Description of Artificial Sequence: Synthetic oligonucleotide
cagcgacgccgcgagtccaagga

SEQ ID NO: 377235 - DNA, 23 bp, Artificial Sequence
  Description of Artificial Sequence: Synthetic oligonucleotide
agcgacgccgcgagtccaaggac

SEQ ID NO: 377236 - DNA, 22 bp, Artificial Sequence
  Description of Artificial Sequence: Synthetic oligonucleotide
gcgacgccgcgagtccaaggac

SEQ ID NO: 377237 - DNA, 22 bp, Artificial Sequence
  Description of Artificial Sequence: Synthetic oligonucleotide
cgacgccgcgagtccaaggacg

SEQ ID NO: 377238 - DNA, 23 bp, Artificial Sequence
  Description of Artificial Sequence: Synthetic oligonucleotide
gacgccgcgagtccaaggacgga

SEQ ID NO: 377239 - DNA, 23 bp, Artificial Sequence
  Description of Artificial Sequence: Synthetic oligonucleotide
acgccgcgagtccaaggacggag

SEQ ID NO: 377240 - DNA, 22 bp, Artificial Sequence
  Description of Artificial Sequence: Synthetic oligonucleotide
cgccgcgagtccaaggacggag

SEQ ID NO: 377241 - DNA, 22 bp, Artificial Sequence
  Description of Artificial Sequence: Synthetic oligonucleotide
gccgcgagtccaaggacggagc

SEQ ID NO: 377242 - DNA, 22 bp, Artificial Sequence
  Description of Artificial Sequence: Synthetic oligonucleotide
ccgcgagtccaaggacggagcc

SEQ ID NO: 377243 - DNA, 22 bp, Artificial Sequence
  Description of Artificial Sequence: Synthetic oligonucleotide
cgcgagtccaaggacggagccc

SEQ ID NO: 377244 - DNA, 22 bp, Artificial Sequence
  Description of Artificial Sequence: Synthetic oligonucleotide
gcgagtccaaggacggagcccc

SEQ ID NO: 377245 - DNA, 22 bp, Artificial Sequence
  Description of Artificial Sequence: Synthetic oligonucleotide
cgagtccaaggacggagccccg

SEQ ID NO: 377246 - DNA, 22 bp, Artificial Sequence
  Description of Artificial Sequence: Synthetic oligonucleotide
gagtccaaggacggagccccgg

SEQ ID NO: 377247 - DNA, 22 bp, Artificial Sequence
  Description of Artificial Sequence: Synthetic oligonucleotide
agtccaaggacggagccccggg

SEQ ID NO: 377248 - DNA, 21 bp, Artificial Sequence
  Description of Artificial Sequence: Synthetic oligonucleotide
gtccaaggacggagccccggg

SEQ ID NO: 377249 - DNA, 21 bp, Artificial Sequence
  Description of Artificial Sequence: Synthetic oligonucleotide
tccaaggacggagccccgggc

SEQ ID NO: 377250 - DNA, 20 bp, Artificial Sequence
  Description of Artificial Sequence: Synthetic oligonucleotide
ccaaggacggagccccgggc

SEQ ID NO: 377251 - DNA, 20 bp, Artificial Sequence
  Description of Artificial Sequence: Synthetic oligonucleotide
caaggacggagccccgggcg

SEQ ID NO: 377252 - DNA, 20 bp, Artificial Sequence
  Description of Artificial Sequence: Synthetic oligonucleotide
aaggacggagccccgggcgc

SEQ ID NO: 377253 - DNA, 23 bp, Artificial Sequence
  Description of Artificial Sequence: Synthetic oligonucleotide
ggaaggagacgctgcagcgcgca

SEQ ID NO: 377254 - DNA, 23 bp, Artificial Sequence
  Description of Artificial Sequence: Synthetic oligonucleotide
gaaggagacgctgcagcgcgcag

SEQ ID NO: 377255 - DNA, 27 bp, Artificial Sequence
  Description of Artificial Sequence: Synthetic oligonucleotide
aggccgggtctcacatcatccagagca

SEQ ID NO: 377256 - DNA, 27 bp, Artificial Sequence
  Description of Artificial Sequence: Synthetic oligonucleotide
ggccgggtctcacatcatccagagcat

SEQ ID NO: 377257 - DNA, 27 bp, Artificial Sequence
  Description of Artificial Sequence: Synthetic oligonucleotide
gccgggtctcacatcatccagagcatg

SEQ ID NO: 377258 - DNA, 29 bp, Artificial Sequence
  Description of Artificial Sequence: Synthetic oligonucleotide
ccgggtctcacatcatccagagcatgtac

SEQ ID NO: 377259 - DNA, 29 bp, Artificial Sequence
  Description of Artificial Sequence: Synthetic oligonucleotide
cgggtctcacatcatccagagcatgtacg

SEQ ID NO: 377260 - DNA, 29 bp, Artificial Sequence
  Description of Artificial Sequence: Synthetic oligonucleotide
gggtctcacatcatccagagcatgtacgg

SEQ ID NO: 377261 - DNA, 29 bp, Artificial Sequence
  Description of Artificial Sequence: Synthetic oligonucleotide
ggtctcacatcatccagagcatgtacggc

SEQ ID NO: 377262 - DNA, 30 bp, Artificial Sequence; identical to SEQ ID NO: 25986
  Description of Artificial Sequence: Synthetic oligonucleotide

SEQ ID NO: 377263 - DNA, 30 bp, Artificial Sequence; identical to SEQ ID NO: 25987
  Description of Artificial Sequence: Synthetic oligonucleotide

SEQ ID NO: 377264 - DNA, 29 bp, Artificial Sequence
  Description of Artificial Sequence: Synthetic oligonucleotide
ctcacatcatccagagcatgtacggctgc

SEQ ID NO: 377265 - DNA, 29 bp, Artificial Sequence
  Description of Artificial Sequence: Synthetic oligonucleotide
tcacatcatccagagcatgtacggctgcg

SEQ ID NO: 377266 - DNA, 28 bp, Artificial Sequence
  Description of Artificial Sequence: Synthetic oligonucleotide
cacatcatccagagcatgtacggctgcg

SEQ ID NO: 377267 - DNA, 29 bp, Artificial Sequence
  Description of Artificial Sequence: Synthetic oligonucleotide
acatcatccagagcatgtacggctgcgac

SEQ ID NO: 377268 - DNA, 28 bp, Artificial Sequence
  Description of Artificial Sequence: Synthetic oligonucleotide
catcatccagagcatgtacggctgcgac

SEQ ID NO: 377269 - DNA, 28 bp, Artificial Sequence
  Description of Artificial Sequence: Synthetic oligonucleotide
atcatccagagcatgtacggctgcgacg

SEQ ID NO: 377270 - DNA, 27 bp, Artificial Sequence
  Description of Artificial Sequence: Synthetic oligonucleotide
tcatccagagcatgtacggctgcgacg

SEQ ID NO: 377271 - DNA, 27 bp, Artificial Sequence
  Description of Artificial Sequence: Synthetic oligonucleotide
catccagagcatgtacggctgcgacgt

SEQ ID NO: 377272 - DNA, 27 bp, Artificial Sequence
  Description of Artificial Sequence: Synthetic oligonucleotide
atccagagcatgtacggctgcgacgtg

SEQ ID NO: 377273 - DNA, 21 bp, Artificial Sequence
  Description of Artificial Sequence: Synthetic oligonucleotide
tacggctgcgacgtggggccc

SEQ ID NO: 377274 - DNA, 20 bp, Artificial Sequence
  Description of Artificial Sequence: Synthetic oligonucleotide
acggctgcgacgtggggccc

SEQ ID NO: 377275 - DNA, 20 bp, Artificial Sequence
  Description of Artificial Sequence: Synthetic oligonucleotide
cggctgcgacgtggggccct

SEQ ID NO: 377276 - DNA, 23 bp, Artificial Sequence
  Description of Artificial Sequence: Synthetic oligonucleotide
agcgacgccgcgagtccgaggaa

SEQ ID NO: 377277 - DNA, 22 bp, Artificial Sequence
  Description of Artificial Sequence: Synthetic oligonucleotide
gcgacgccgcgagtccgaggaa

SEQ ID NO: 377278 - DNA, 22 bp, Artificial Sequence
  Description of Artificial Sequence: Synthetic oligonucleotide
cgacgccgcgagtccgaggaag

SEQ ID NO: 377279 - DNA, 23 bp, Artificial Sequence
  Description of Artificial Sequence: Synthetic oligonucleotide
gacgccgcgagtccgaggaagga

SEQ ID NO: 377280 - DNA, 23 bp, Artificial Sequence
  Description of Artificial Sequence: Synthetic oligonucleotide
acgccgcgagtccgaggaaggag

SEQ ID NO: 377281 - DNA, 22 bp, Artificial Sequence
  Description of Artificial Sequence: Synthetic oligonucleotide
cgccgcgagtccgaggaaggag

SEQ ID NO: 377282 - DNA, 22 bp, Artificial Sequence
  Description of Artificial Sequence: Synthetic oligonucleotide
gccgcgagtccgaggaaggagc

SEQ ID NO: 377283 - DNA, 22 bp, Artificial Sequence
  Description of Artificial Sequence: Synthetic oligonucleotide
ccgcgagtccgaggaaggagcc

SEQ ID NO: 377284 - DNA, 22 bp, Artificial Sequence
  Description of Artificial Sequence: Synthetic oligonucleotide
cgcgagtccgaggaaggagccg

SEQ ID NO: 377285 - DNA, 22 bp, Artificial Sequence
  Description of Artificial Sequence: Synthetic oligonucleotide
gcgagtccgaggaaggagccgc

SEQ ID NO: 377286 - DNA, 30 bp, Artificial Sequence; identical to SEQ ID NO: 32511
  Description of Artificial Sequence: Synthetic oligonucleotide

SEQ ID NO: 377287 - DNA, 30 bp, Artificial Sequence; identical to SEQ ID NO: 32512
  Description of Artificial Sequence: Synthetic oligonucleotide

SEQ ID NO: 377288 - DNA, 30 bp, Artificial Sequence; identical to SEQ ID NO: 32513
  Description of Artificial Sequence: Synthetic oligonucleotide

SEQ ID NO: 377289 - DNA, 31 bp, Artificial Sequence; identical to SEQ ID NO: 32514
  Description of Artificial Sequence: Synthetic oligonucleotide

SEQ ID NO: 377290 - DNA, 31 bp, Artificial Sequence; identical to SEQ ID NO: 32515
  Description of Artificial Sequence: Synthetic oligonucleotide

SEQ ID NO: 377291 - DNA, 31 bp, Artificial Sequence; identical to SEQ ID NO: 32516
  Description of Artificial Sequence: Synthetic oligonucleotide

SEQ ID NO: 377292 - DNA, 30 bp, Artificial Sequence; identical to SEQ ID NO: 32517
  Description of Artificial Sequence: Synthetic oligonucleotide

SEQ ID NO: 377293 - DNA, 31 bp, Artificial Sequence; identical to SEQ ID NO: 32518
  Description of Artificial Sequence: Synthetic oligonucleotide

SEQ ID NO: 377294 - DNA, 30 bp, Artificial Sequence; identical to SEQ ID NO: 32519
  Description of Artificial Sequence: Synthetic oligonucleotide

SEQ ID NO: 377295 - DNA, 30 bp, Artificial Sequence; identical to SEQ ID NO: 32520
  Description of Artificial Sequence: Synthetic oligonucleotide

SEQ ID NO: 377296 - DNA, 29 bp, Artificial Sequence
  Description of Artificial Sequence: Synthetic oligonucleotide
catcatccagaggatgtttggctgcgacc

SEQ ID NO: 377297 - DNA, 30 bp, Artificial Sequence; identical to SEQ ID NO: 32522
  Description of Artificial Sequence: Synthetic oligonucleotide

SEQ ID NO: 377298 - DNA, 29 bp, Artificial Sequence
  Description of Artificial Sequence: Synthetic oligonucleotide
tcatccagaggatgtttggctgcgacctg

SEQ ID NO: 377299 - DNA, 28 bp, Artificial Sequence
  Description of Artificial Sequence: Synthetic oligonucleotide
catccagaggatgtttggctgcgacctg

SEQ ID NO: 377300 - DNA, 28 bp, Artificial Sequence
  Description of Artificial Sequence: Synthetic oligonucleotide
atccagaggatgtttggctgcgacctgg

SEQ ID NO: 377301 - DNA, 27 bp, Artificial Sequence
  Description of Artificial Sequence: Synthetic oligonucleotide
tccagaggatgtttggctgcgacctgg

SEQ ID NO: 377302 - DNA, 26 bp, Artificial Sequence
  Description of Artificial Sequence: Synthetic oligonucleotide
ccagaggatgtttggctgcgacctgg

SEQ ID NO: 377303 - DNA, 26 bp, Artificial Sequence
  Description of Artificial Sequence: Synthetic oligonucleotide
cagaggatgtttggctgcgacctggg

SEQ ID NO: 377304 - DNA, 26 bp, Artificial Sequence
  Description of Artificial Sequence: Synthetic oligonucleotide
agaggatgtttggctgcgacctgggg

SEQ ID NO: 377305 - DNA, 25 bp, Artificial Sequence
  Description of Artificial Sequence: Synthetic oligonucleotide
gaggatgtttggctgcgacctgggg

SEQ ID NO: 377306 - DNA, 25 bp, Artificial Sequence
  Description of Artificial Sequence: Synthetic oligonucleotide
aggatgtttggctgcgacctggggc

SEQ ID NO: 377307 - DNA, 24 bp, Artificial Sequence
  Description of Artificial Sequence: Synthetic oligonucleotide
ggatgtttggctgcgacctggggc

SEQ ID NO: 377308 - DNA, 24 bp, Artificial Sequence
  Description of Artificial Sequence: Synthetic oligonucleotide
gatgtttggctgcgacctggggcc

SEQ ID NO: 377309 - DNA, 24 bp, Artificial Sequence
  Description of Artificial Sequence: Synthetic oligonucleotide
atgtttggctgcgacctggggccc

SEQ ID NO: 377310 - DNA, 23 bp, Artificial Sequence
  Description of Artificial Sequence: Synthetic oligonucleotide
tgtttggctgcgacctggggccc

SEQ ID NO: 377311 - DNA, 22 bp, Artificial Sequence
  Description of Artificial Sequence: Synthetic oligonucleotide
gtttggctgcgacctggggccc

SEQ ID NO: 377312 - DNA, 23 bp, Artificial Sequence
  Description of Artificial Sequence: Synthetic oligonucleotide
tttggctgcgacctggggcccga

SEQ ID NO: 377313 - DNA, 22 bp, Artificial Sequence
  Description of Artificial Sequence: Synthetic oligonucleotide
ttggctgcgacctggggcccga

SEQ ID NO: 377314 - DNA, 30 bp, Artificial Sequence; identical to SEQ ID NO: 26754
  Description of Artificial Sequence: Synthetic oligonucleotide

SEQ ID NO: 377315 - DNA, 29 bp, Artificial Sequence
  Description of Artificial Sequence: Synthetic oligonucleotide
cacagacttaccgagagaacctgcggaac

SEQ ID NO: 377316 - DNA, 29 bp, Artificial Sequence
  Description of Artificial Sequence: Synthetic oligonucleotide
acagacttaccgagagaacctgcggaacc

SEQ ID NO: 377317 - DNA, 28 bp, Artificial Sequence
  Description of Artificial Sequence: Synthetic oligonucleotide
cagacttaccgagagaacctgcggaacc

SEQ ID NO: 377318 - DNA, 29 bp, Artificial Sequence
  Description of Artificial Sequence: Synthetic oligonucleotide
agacttaccgagagaacctgcggaacctg

SEQ ID NO: 377319 - DNA, 28 bp, Artificial Sequence
  Description of Artificial Sequence: Synthetic oligonucleotide
gacttaccgagagaacctgcggaacctg

SEQ ID NO: 377320 - DNA, 28 bp, Artificial Sequence
  Description of Artificial Sequence: Synthetic oligonucleotide
acttaccgagagaacctgcggaacctgc

SEQ ID NO: 377321 - DNA, 27 bp, Artificial Sequence
  Description of Artificial Sequence: Synthetic oligonucleotide
cttaccgagagaacctgcggaacctgc

SEQ ID NO: 377322 - DNA, 27 bp, Artificial Sequence
  Description of Artificial Sequence: Synthetic oligonucleotide
ttaccgagagaacctgcggaacctgcg

SEQ ID NO: 377323 - DNA, 26 bp, Artificial Sequence
  Description of Artificial Sequence: Synthetic oligonucleotide
taccgagagaacctgcggaacctgcg

SEQ ID NO: 377324 - DNA, 25 bp, Artificial Sequence
  Description of Artificial Sequence: Synthetic oligonucleotide
accgagagaacctgcggaacctgcg

SEQ ID NO: 377325 - DNA, 24 bp, Artificial Sequence
  Description of Artificial Sequence: Synthetic oligonucleotide
ccgagagaacctgcggaacctgcg

SEQ ID NO: 377326 - DNA, 24 bp, Artificial Sequence
  Description of Artificial Sequence: Synthetic oligonucleotide
cgagagaacctgcggaacctgcgc

SEQ ID NO: 377327 - DNA, 24 bp, Artificial Sequence
  Description of Artificial Sequence: Synthetic oligonucleotide
gagagaacctgcggaacctgcgcg

SEQ ID NO: 377328 - DNA, 24 bp, Artificial Sequence
  Description of Artificial Sequence: Synthetic oligonucleotide
agagaacctgcggaacctgcgcgg

SEQ ID NO: 377329 - DNA, 23 bp, Artificial Sequence
  Description of Artificial Sequence: Synthetic oligonucleotide
gagaacctgcggaacctgcgcgg

SEQ ID NO: 377330 - DNA, 25 bp, Artificial Sequence
  Description of Artificial Sequence: Synthetic oligonucleotide
agaacctgcggaacctgcgcggcta

SEQ ID NO: 377331 - DNA, 24 bp, Artificial Sequence
  Description of Artificial Sequence: Synthetic oligonucleotide
gaacctgcggaacctgcgcggcta

SEQ ID NO: 377332 - DNA, 26 bp, Artificial Sequence
  Description of Artificial Sequence: Synthetic oligonucleotide
aacctgcggaacctgcgcggctacta

SEQ ID NO: 377333 - DNA, 25 bp, Artificial Sequence
  Description of Artificial Sequence: Synthetic oligonucleotide
acctgcggaacctgcgcggctacta

SEQ ID NO: 377334 - DNA, 28 bp, Artificial Sequence
  Description of Artificial Sequence: Synthetic oligonucleotide
atcatccagagcatgtacggctgcgacc

SEQ ID NO: 377335 - DNA, 27 bp, Artificial Sequence
  Description of Artificial Sequence: Synthetic oligonucleotide
tcatccagagcatgtacggctgcgacc

SEQ ID NO: 377336 - DNA, 27 bp, Artificial Sequence
  Description of Artificial Sequence: Synthetic oligonucleotide
catccagagcatgtacggctgcgacct

SEQ ID NO: 377337 - DNA, 27 bp, Artificial Sequence
  Description of Artificial Sequence: Synthetic oligonucleotide
atccagagcatgtacggctgcgacctg

SEQ ID NO: 377338 - DNA, 27 bp, Artificial Sequence
  Description of Artificial Sequence: Synthetic oligonucleotide
attgcagtgggctacgtggacgacacc

SEQ ID NO: 377339 - DNA, 26 bp, Artificial Sequence
  Description of Artificial Sequence: Synthetic oligonucleotide
ttgcagtgggctacgtggacgacacc

SEQ ID NO: 377340 - DNA, 25 bp, Artificial Sequence
  Description of Artificial Sequence: Synthetic oligonucleotide
tgcagtgggctacgtggacgacacc

SEQ ID NO: 377341 - DNA, 31 bp, Artificial Sequence; identical to SEQ ID NO: 23650
  Description of Artificial Sequence: Synthetic oligonucleotide

SEQ ID NO: 377342 - DNA, 30 bp, Artificial Sequence; identical to SEQ ID NO: 23651
  Description of Artificial Sequence: Synthetic oligonucleotide

SEQ ID NO: 377343 - DNA, 31 bp, Artificial Sequence; identical to SEQ ID NO: 23652
  Description of Artificial Sequence: Synthetic oligonucleotide

SEQ ID NO: 377344 - DNA, 31 bp, Artificial Sequence; identical to SEQ ID NO: 23653
  Description of Artificial Sequence: Synthetic oligonucleotide

SEQ ID NO: 377345 - DNA, 30 bp, Artificial Sequence; identical to SEQ ID NO: 23654
  Description of Artificial Sequence: Synthetic oligonucleotide

SEQ ID NO: 377346 - DNA, 29 bp, Artificial Sequence
  Description of Artificial Sequence: Synthetic oligonucleotide
gaccaacacacagacttaccgagaggacc

SEQ ID NO: 377347 - DNA, 30 bp, Artificial Sequence; identical to SEQ ID NO: 23656
  Description of Artificial Sequence: Synthetic oligonucleotide

SEQ ID NO: 377348 - DNA, 29 bp, Artificial Sequence
  Description of Artificial Sequence: Synthetic oligonucleotide
ccaacacacagacttaccgagaggacctg

SEQ ID NO: 377349 - DNA, 29 bp, Artificial Sequence
  Description of Artificial Sequence: Synthetic oligonucleotide
caacacacagacttaccgagaggacctgc

SEQ ID NO: 377350 - DNA, 29 bp, Artificial Sequence
  Description of Artificial Sequence: Synthetic oligonucleotide
aacacacagacttaccgagaggacctgcg

SEQ ID NO: 377351 - DNA, 28 bp, Artificial Sequence
  Description of Artificial Sequence: Synthetic oligonucleotide
acacacagacttaccgagaggacctgcg

SEQ ID NO: 377352 - DNA, 27 bp, Artificial Sequence
  Description of Artificial Sequence: Synthetic oligonucleotide
cacacagacttaccgagaggacctgcg

SEQ ID NO: 377353 - DNA, 27 bp, Artificial Sequence
  Description of Artificial Sequence: Synthetic oligonucleotide
acacagacttaccgagaggacctgcgg

SEQ ID NO: 377354 - DNA, 27 bp, Artificial Sequence
  Description of Artificial Sequence: Synthetic oligonucleotide
cacagacttaccgagaggacctgcgga

SEQ ID NO: 377355 - DNA, 27 bp, Artificial Sequence
  Description of Artificial Sequence: Synthetic oligonucleotide
acagacttaccgagaggacctgcggac

SEQ ID NO: 377356 - DNA, 26 bp, Artificial Sequence
  Description of Artificial Sequence: Synthetic oligonucleotide
cagacttaccgagaggacctgcggac

SEQ ID NO: 377357 - DNA, 26 bp, Artificial Sequence
  Description of Artificial Sequence: Synthetic oligonucleotide
agacttaccgagaggacctgcggacc

SEQ ID NO: 377358 - DNA, 25 bp, Artificial Sequence
  Description of Artificial Sequence: Synthetic oligonucleotide
gacttaccgagaggacctgcggacc

SEQ ID NO: 377359 - DNA, 26 bp, Artificial Sequence
  Description of Artificial Sequence: Synthetic oligonucleotide
acttaccgagaggacctgcggaccct

SEQ ID NO: 377360 - DNA, 25 bp, Artificial Sequence
  Description of Artificial Sequence: Synthetic oligonucleotide
cttaccgagaggacctgcggaccct

SEQ ID NO: 377361 - DNA, 25 bp, Artificial Sequence
  Description of Artificial Sequence: Synthetic oligonucleotide
ttaccgagaggacctgcggaccctg

SEQ ID NO: 377362 - DNA, 24 bp, Artificial Sequence
  Description of Artificial Sequence: Synthetic oligonucleotide
taccgagaggacctgcggaccctg

SEQ ID NO: 377363 - DNA, 25 bp, Artificial Sequence
  Description of Artificial Sequence: Synthetic oligonucleotide
agagcgaggccgggtctcacaccat

SEQ ID NO: 377364 - DNA, 24 bp, Artificial Sequence
  Description of Artificial Sequence: Synthetic oligonucleotide
gagcgaggccgggtctcacaccat

SEQ ID NO: 377365 - DNA, 24 bp, Artificial Sequence
  Description of Artificial Sequence: Synthetic oligonucleotide
agcgaggccgggtctcacaccatc

SEQ ID NO: 377366 - DNA, 23 bp, Artificial Sequence
  Description of Artificial Sequence: Synthetic oligonucleotide
gcgaggccgggtctcacaccatc

SEQ ID NO: 377367 - DNA, 24 bp, Artificial Sequence
  Description of Artificial Sequence: Synthetic oligonucleotide
cgaggccgggtctcacaccatcca

SEQ ID NO: 377368 - DNA, 25 bp, Artificial Sequence
  Description of Artificial Sequence: Synthetic oligonucleotide
gaggccgggtctcacaccatccaga

SEQ ID NO: 377369 - DNA, 25 bp, Artificial Sequence
  Description of Artificial Sequence: Synthetic oligonucleotide
aggccgggtctcacaccatccagag

SEQ ID NO: 377370 - DNA, 24 bp, Artificial Sequence
  Description of Artificial Sequence: Synthetic oligonucleotide
ggccgggtctcacaccatccagag

SEQ ID NO: 377371 - DNA, 26 bp, Artificial Sequence
  Description of Artificial Sequence: Synthetic oligonucleotide
gccgggtctcacaccatccagaggat

SEQ ID NO: 377372 - DNA, 27 bp, Artificial Sequence
  Description of Artificial Sequence: Synthetic oligonucleotide
ccgggtctcacaccatccagaggatgt

SEQ ID NO: 377373 - DNA, 27 bp, Artificial Sequence
  Description of Artificial Sequence: Synthetic oligonucleotide
cgggtctcacaccatccagaggatgtc

SEQ ID NO: 377374 - DNA, 28 bp, Artificial Sequence
  Description of Artificial Sequence: Synthetic oligonucleotide
gggtctcacaccatccagaggatgtctg

SEQ ID NO: 377375 - DNA, 28 bp, Artificial Sequence
  Description of Artificial Sequence: Synthetic oligonucleotide
ggtctcacaccatccagaggatgtctgg

SEQ ID NO: 377376 - DNA, 28 bp, Artificial Sequence
  Description of Artificial Sequence: Synthetic oligonucleotide
gtctcacaccatccagaggatgtctggc

SEQ ID NO: 377377 - DNA, 29 bp, Artificial Sequence
  Description of Artificial Sequence: Synthetic oligonucleotide
tctcacaccatccagaggatgtctggctg

SEQ ID NO: 377378 - DNA, 28 bp, Artificial Sequence
  Description of Artificial Sequence: Synthetic oligonucleotide
ctcacaccatccagaggatgtctggctg

SEQ ID NO: 377379 - DNA, 28 bp, Artificial Sequence
  Description of Artificial Sequence: Synthetic oligonucleotide
tcacaccatccagaggatgtctggctgc

SEQ ID NO: 377380 - DNA, 27 bp, Artificial Sequence
  Description of Artificial Sequence: Synthetic oligonucleotide
cacaccatccagaggatgtctggctgc

SEQ ID NO: 377381 - DNA, 27 bp, Artificial Sequence
  Description of Artificial Sequence: Synthetic oligonucleotide
acaccatccagaggatgtctggctgcg

SEQ ID NO: 377382 - DNA, 27 bp, Artificial Sequence
  Description of Artificial Sequence: Synthetic oligonucleotide
caccatccagaggatgtctggctgcga

SEQ ID NO: 377383 - DNA, 27 bp, Artificial Sequence
  Description of Artificial Sequence: Synthetic oligonucleotide
accatccagaggatgtctggctgcgac

SEQ ID NO: 377384 - DNA, 26 bp, Artificial Sequence
  Description of Artificial Sequence: Synthetic oligonucleotide
ccatccagaggatgtctggctgcgac

SEQ ID NO: 377385 - DNA, 27 bp, Artificial Sequence
  Description of Artificial Sequence: Synthetic oligonucleotide
catccagaggatgtctggctgcgacgt

SEQ ID NO: 377386 - DNA, 27 bp, Artificial Sequence
  Description of Artificial Sequence: Synthetic oligonucleotide
atccagaggatgtctggctgcgacgtg

SEQ ID NO: 377387 - DNA, 27 bp, Artificial Sequence
  Description of Artificial Sequence: Synthetic oligonucleotide
acttaccgagaggacctgcggacccta

SEQ ID NO: 377388 - DNA, 26 bp, Artificial Sequence
  Description of Artificial Sequence: Synthetic oligonucleotide
cttaccgagaggacctgcggacccta

SEQ ID NO: 377389 - DNA, 27 bp, Artificial Sequence
  Description of Artificial Sequence: Synthetic oligonucleotide
ttaccgagaggacctgcggaccctact

SEQ ID NO: 377390 - DNA, 26 bp, Artificial Sequence
  Description of Artificial Sequence: Synthetic oligonucleotide
taccgagaggacctgcggaccctact

SEQ ID NO: 377391 - DNA, 25 bp, Artificial Sequence
  Description of Artificial Sequence: Synthetic oligonucleotide
accgagaggacctgcggaccctact

SEQ ID NO: 377392 - DNA, 24 bp, Artificial Sequence
  Description of Artificial Sequence: Synthetic oligonucleotide
ccgagaggacctgcggaccctact

SEQ ID NO: 377393 - DNA, 24 bp, Artificial Sequence
  Description of Artificial Sequence: Synthetic oligonucleotide
cgagaggacctgcggaccctactc

SEQ ID NO: 377394 - DNA, 24 bp, Artificial Sequence
  Description of Artificial Sequence: Synthetic oligonucleotide
gagaggacctgcggaccctactcc

SEQ ID NO: 377395 - DNA, 24 bp, Artificial Sequence
  Description of Artificial Sequence: Synthetic oligonucleotide
agaggacctgcggaccctactccg

SEQ ID NO: 377396 - DNA, 23 bp, Artificial Sequence
  Description of Artificial Sequence: Synthetic oligonucleotide
gaggacctgcggaccctactccg

SEQ ID NO: 377397 - DNA, 25 bp, Artificial Sequence
  Description of Artificial Sequence: Synthetic oligonucleotide
aggacctgcggaccctactccgcta

SEQ ID NO: 377398 - DNA, 24 bp, Artificial Sequence
  Description of Artificial Sequence: Synthetic oligonucleotide
ggacctgcggaccctactccgcta

SEQ ID NO: 377399 - DNA, 26 bp, Artificial Sequence
  Description of Artificial Sequence: Synthetic oligonucleotide
gacctgcggaccctactccgctacta

SEQ ID NO: 377400 - DNA, 27 bp, Artificial Sequence
  Description of Artificial Sequence: Synthetic oligonucleotide
acctgcggaccctactccgctactaca

SEQ ID NO: 377401 - DNA, 27 bp, Artificial Sequence
  Description of Artificial Sequence: Synthetic oligonucleotide
cctgcggaccctactccgctactacaa

SEQ ID NO: 377402 - DNA, 27 bp, Artificial Sequence
  Description of Artificial Sequence: Synthetic oligonucleotide
ctgcggaccctactccgctactacaac

SEQ ID NO: 377403 - DNA, 27 bp, Artificial Sequence
  Description of Artificial Sequence: Synthetic oligonucleotide
tgcggaccctactccgctactacaacc

SEQ ID NO: 377404 - DNA, 27 bp, Artificial Sequence
  Description of Artificial Sequence: Synthetic oligonucleotide
gcggaccctactccgctactacaacca

SEQ ID NO: 377405 - DNA, 27 bp, Artificial Sequence
  Description of Artificial Sequence: Synthetic oligonucleotide
cggaccctactccgctactacaaccag

SEQ ID NO: 377406 - DNA, 28 bp, Artificial Sequence
  Description of Artificial Sequence: Synthetic oligonucleotide
ggaccctactccgctactacaaccagag

SEQ ID NO: 377407 - DNA, 28 bp, Artificial Sequence
  Description of Artificial Sequence: Synthetic oligonucleotide
gaccctactccgctactacaaccagagc

SEQ ID NO: 377408 - DNA, 28 bp, Artificial Sequence
  Description of Artificial Sequence: Synthetic oligonucleotide
accctactccgctactacaaccagagcg

SEQ ID NO: 377409 - DNA, 27 bp, Artificial Sequence
  Description of Artificial Sequence: Synthetic oligonucleotide
ccctactccgctactacaaccagagcg

SEQ ID NO: 377410 - DNA, 28 bp, Artificial Sequence
  Description of Artificial Sequence: Synthetic oligonucleotide
cctactccgctactacaaccagagcgag

SEQ ID NO: 377411 - DNA, 28 bp, Artificial Sequence
  Description of Artificial Sequence: Synthetic oligonucleotide
ctactccgctactacaaccagagcgagg

SEQ ID NO: 377412 - DNA, 28 bp, Artificial Sequence
  Description of Artificial Sequence: Synthetic oligonucleotide
tactccgctactacaaccagagcgaggc

SEQ ID NO: 377413 - DNA, 27 bp, Artificial Sequence
  Description of Artificial Sequence: Synthetic oligonucleotide
actccgctactacaaccagagcgaggc

SEQ ID NO: 377414 - DNA, 29 bp, Artificial Sequence
  Description of Artificial Sequence: Synthetic oligonucleotide
caagaccaacacacagacctaccgagagg

SEQ ID NO: 377415 - DNA, 30 bp, Artificial Sequence; identical to SEQ ID NO: 33043
  Description of Artificial Sequence: Synthetic oligonucleotide

SEQ ID NO: 377416 - DNA, 29 bp, Artificial Sequence
  Description of Artificial Sequence: Synthetic oligonucleotide
agaccaacacacagacctaccgagaggac

SEQ ID NO: 377417 - DNA, 28 bp, Artificial Sequence
  Description of Artificial Sequence: Synthetic oligonucleotide
gaccaacacacagacctaccgagaggac

SEQ ID NO: 377418 - DNA, 28 bp, Artificial Sequence
  Description of Artificial Sequence: Synthetic oligonucleotide
accaacacacagacctaccgagaggacc

SEQ ID NO: 377419 - DNA, 27 bp, Artificial Sequence
  Description of Artificial Sequence: Synthetic oligonucleotide
ccaacacacagacctaccgagaggacc

SEQ ID NO: 377420 - DNA, 28 bp, Artificial Sequence
  Description of Artificial Sequence: Synthetic oligonucleotide
caacacacagacctaccgagaggacctg

SEQ ID NO: 377421 - DNA, 28 bp, Artificial Sequence
  Description of Artificial Sequence: Synthetic oligonucleotide
aacacacagacctaccgagaggacctgc

SEQ ID NO: 377422 - DNA, 27 bp, Artificial Sequence
  Description of Artificial Sequence: Synthetic oligonucleotide
acacacagacctaccgagaggacctgc

SEQ ID NO: 377423 - DNA, 26 bp, Artificial Sequence
  Description of Artificial Sequence: Synthetic oligonucleotide
cacacagacctaccgagaggacctgc

SEQ ID NO: 377424 - DNA, 26 bp, Artificial Sequence
  Description of Artificial Sequence: Synthetic oligonucleotide
acacagacctaccgagaggacctgcg

SEQ ID NO: 377425 - DNA, 25 bp, Artificial Sequence
  Description of Artificial Sequence: Synthetic oligonucleotide
cacagacctaccgagaggacctgcg

SEQ ID NO: 377426 - DNA, 26 bp, Artificial Sequence
  Description of Artificial Sequence: Synthetic oligonucleotide
acagacctaccgagaggacctgcgga

SEQ ID NO: 377427 - DNA, 25 bp, Artificial Sequence
  Description of Artificial Sequence: Synthetic oligonucleotide
cagacctaccgagaggacctgcgga

SEQ ID NO: 377428 - DNA, 25 bp, Artificial Sequence
  Description of Artificial Sequence: Synthetic oligonucleotide
agacctaccgagaggacctgcggac

SEQ ID NO: 377429 - DNA, 24 bp, Artificial Sequence
  Description of Artificial Sequence: Synthetic oligonucleotide
gacctaccgagaggacctgcggac

SEQ ID NO: 377430 - DNA, 24 bp, Artificial Sequence
  Description of Artificial Sequence: Synthetic oligonucleotide
acctaccgagaggacctgcggacc

SEQ ID NO: 377431 - DNA, 23 bp, Artificial Sequence
  Description of Artificial Sequence: Synthetic oligonucleotide
cctaccgagaggacctgcggacc

SEQ ID NO: 377432 - DNA, 24 bp, Artificial Sequence
  Description of Artificial Sequence: Synthetic oligonucleotide
ctaccgagaggacctgcggaccct

SEQ ID NO: 377433 - DNA, 27 bp, Artificial Sequence
  Description of Artificial Sequence: Synthetic oligonucleotide
agcaggacagagcctacctggagggaa

SEQ ID NO: 377434 - DNA, 26 bp, Artificial Sequence
  Description of Artificial Sequence: Synthetic oligonucleotide
gcaggacagagcctacctggagggaa

SEQ ID NO: 377435 - DNA, 26 bp, Artificial Sequence
  Description of Artificial Sequence: Synthetic oligonucleotide
caggacagagcctacctggagggaac

SEQ ID NO: 377436 - DNA, 27 bp, Artificial Sequence
  Description of Artificial Sequence: Synthetic oligonucleotide
aggacagagcctacctggagggaacgt

SEQ ID NO: 377437 - DNA, 26 bp, Artificial Sequence
  Description of Artificial Sequence: Synthetic oligonucleotide
ggacagagcctacctggagggaacgt

SEQ ID NO: 377438 - DNA, 26 bp, Artificial Sequence
  Description of Artificial Sequence: Synthetic oligonucleotide
gacagagcctacctggagggaacgtg

SEQ ID NO: 377439 - DNA, 26 bp, Artificial Sequence
  Description of Artificial Sequence: Synthetic oligonucleotide
acagagcctacctggagggaacgtgc

SEQ ID NO: 377440 - DNA, 25 bp, Artificial Sequence
  Description of Artificial Sequence: Synthetic oligonucleotide
cagagcctacctggagggaacgtgc

SEQ ID NO: 377441 - DNA, 26 bp, Artificial Sequence
  Description of Artificial Sequence: Synthetic oligonucleotide
agagcctacctggagggaacgtgcgt

SEQ ID NO: 377442 - DNA, 25 bp, Artificial Sequence
  Description of Artificial Sequence: Synthetic oligonucleotide
gagcctacctggagggaacgtgcgt

SEQ ID NO: 377443 - DNA, 25 bp, Artificial Sequence
  Description of Artificial Sequence: Synthetic oligonucleotide
agcctacctggagggaacgtgcgtg

SEQ ID NO: 377444 - DNA, 24 bp, Artificial Sequence
  Description of Artificial Sequence: Synthetic oligonucleotide
gcctacctggagggaacgtgcgtg

SEQ ID NO: 377445 - DNA, 25 bp, Artificial Sequence
  Description of Artificial Sequence: Synthetic oligonucleotide
cctacctggagggaacgtgcgtgga

SEQ ID NO: 377446 - DNA, 26 bp, Artificial Sequence
  Description of Artificial Sequence: Synthetic oligonucleotide
ctacctggagggaacgtgcgtggagt

SEQ ID NO: 377447 - DNA, 26 bp, Artificial Sequence
  Description of Artificial Sequence: Synthetic oligonucleotide
tacctggagggaacgtgcgtggagtg

SEQ ID NO: 377448 - DNA, 25 bp, Artificial Sequence
  Description of Artificial Sequence: Synthetic oligonucleotide
acctggagggaacgtgcgtggagtg

SEQ ID NO: 377449 - DNA, 24 bp, Artificial Sequence
  Description of Artificial Sequence: Synthetic oligonucleotide
cctggagggaacgtgcgtggagtg

SEQ ID NO: 377450 - DNA, 24 bp, Artificial Sequence
  Description of Artificial Sequence: Synthetic oligonucleotide
ctggagggaacgtgcgtggagtgg

SEQ ID NO: 377451 - DNA, 25 bp, Artificial Sequence
  Description of Artificial Sequence: Synthetic oligonucleotide
tggagggaacgtgcgtggagtggct

SEQ ID NO: 377452 - DNA, 24 bp, Artificial Sequence
  Description of Artificial Sequence: Synthetic oligonucleotide
ggagggaacgtgcgtggagtggct

SEQ ID NO: 377453 - DNA, 24 bp, Artificial Sequence
  Description of Artificial Sequence: Synthetic oligonucleotide
gagggaacgtgcgtggagtggctc

SEQ ID NO: 377454 - DNA, 24 bp, Artificial Sequence
  Description of Artificial Sequence: Synthetic oligonucleotide
agggaacgtgcgtggagtggctcc

SEQ ID NO: 377455 - DNA, 23 bp, Artificial Sequence
  Description of Artificial Sequence: Synthetic oligonucleotide
gggaacgtgcgtggagtggctcc

SEQ ID NO: 377456 - DNA, 23 bp, Artificial Sequence
  Description of Artificial Sequence: Synthetic oligonucleotide
ggaacgtgcgtggagtggctccg

SEQ ID NO: 377457 - DNA, 24 bp, Artificial Sequence
  Description of Artificial Sequence: Synthetic oligonucleotide
gaacgtgcgtggagtggctccgca

SEQ ID NO: 377458 - DNA, 27 bp, Artificial Sequence
  Description of Artificial Sequence: Synthetic oligonucleotide
aacgtgcgtggagtggctccgcagata

SEQ ID NO: 377459 - DNA, 28 bp, Artificial Sequence
  Description of Artificial Sequence: Synthetic oligonucleotide
atctcagtgggctacgtggacgacacac

SEQ ID NO: 377460 - DNA, 27 bp, Artificial Sequence
  Description of Artificial Sequence: Synthetic oligonucleotide
tctcagtgggctacgtggacgacacac

SEQ ID NO: 377461 - DNA, 27 bp, Artificial Sequence
  Description of Artificial Sequence: Synthetic oligonucleotide
ctcagtgggctacgtggacgacacaca

SEQ ID NO: 377462 - DNA, 27 bp, Artificial Sequence
  Description of Artificial Sequence: Synthetic oligonucleotide
tcagtgggctacgtggacgacacacag

SEQ ID NO: 377463 - DNA, 27 bp, Artificial Sequence
  Description of Artificial Sequence: Synthetic oligonucleotide
cagtgggctacgtggacgacacacagt

SEQ ID NO: 377464 - DNA, 28 bp, Artificial Sequence
  Description of Artificial Sequence: Synthetic oligonucleotide
agtgggctacgtggacgacacacagttc

SEQ ID NO: 377465 - DNA, 27 bp, Artificial Sequence
  Description of Artificial Sequence: Synthetic oligonucleotide
gtgggctacgtggacgacacacagttc

SEQ ID NO: 377466 - DNA, 27 bp, Artificial Sequence
  Description of Artificial Sequence: Synthetic oligonucleotide
tgggctacgtggacgacacacagttcg

SEQ ID NO: 377467 - DNA, 27 bp, Artificial Sequence
  Description of Artificial Sequence: Synthetic oligonucleotide
gggctacgtggacgacacacagttcgt

SEQ ID NO: 377468 - DNA, 27 bp, Artificial Sequence
  Description of Artificial Sequence: Synthetic oligonucleotide
ggctacgtggacgacacacagttcgtg

SEQ ID NO: 377469 - DNA, 28 bp, Artificial Sequence
  Description of Artificial Sequence: Synthetic oligonucleotide
gctacgtggacgacacacagttcgtgag

SEQ ID NO: 377470 - DNA, 28 bp, Artificial Sequence
  Description of Artificial Sequence: Synthetic oligonucleotide
ctacgtggacgacacacagttcgtgagg

SEQ ID NO: 377471 - DNA, 30 bp, Artificial Sequence; identical to SEQ ID NO: 33099
  Description of Artificial Sequence: Synthetic oligonucleotide

SEQ ID NO: 377472 - DNA, 29 bp, Artificial Sequence
  Description of Artificial Sequence: Synthetic oligonucleotide
acgtggacgacacacagttcgtgaggttc

SEQ ID NO: 377473 - DNA, 28 bp, Artificial Sequence
  Description of Artificial Sequence: Synthetic oligonucleotide
cgtggacgacacacagttcgtgaggttc

SEQ ID NO: 377474 - DNA, 28 bp, Artificial Sequence
  Description of Artificial Sequence: Synthetic oligonucleotide
gtggacgacacacagttcgtgaggttcg

SEQ ID NO: 377475 - DNA, 29 bp, Artificial Sequence
  Description of Artificial Sequence: Synthetic oligonucleotide
tggacgacacacagttcgtgaggttcgac

SEQ ID NO: 377476 - DNA, 28 bp, Artificial Sequence
  Description of Artificial Sequence: Synthetic oligonucleotide
ggacgacacacagttcgtgaggttcgac

SEQ ID NO: 377477 - DNA, 29 bp, Artificial Sequence
  Description of Artificial Sequence: Synthetic oligonucleotide
gacgacacacagttcgtgaggttcgacag

SEQ ID NO: 377478 - DNA, 29 bp, Artificial Sequence
  Description of Artificial Sequence: Synthetic oligonucleotide
acgacacacagttcgtgaggttcgacagc

SEQ ID NO: 377479 - DNA, 28 bp, Artificial Sequence
  Description of Artificial Sequence: Synthetic oligonucleotide
cgacacacagttcgtgaggttcgacagc

SEQ ID NO: 377480 - DNA, 28 bp, Artificial Sequence
  Description of Artificial Sequence: Synthetic oligonucleotide
gacacacagttcgtgaggttcgacagcg

SEQ ID NO: 377481 - DNA, 29 bp, Artificial Sequence
  Description of Artificial Sequence: Synthetic oligonucleotide
acacacagttcgtgaggttcgacagcgac

SEQ ID NO: 377482 - DNA, 28 bp, Artificial Sequence
  Description of Artificial Sequence: Synthetic oligonucleotide
cacacagttcgtgaggttcgacagcgac

SEQ ID NO: 377483 - DNA, 28 bp, Artificial Sequence
  Description of Artificial Sequence: Synthetic oligonucleotide
acacagttcgtgaggttcgacagcgacg

SEQ ID NO: 377484 - DNA, 27 bp, Artificial Sequence
  Description of Artificial Sequence: Synthetic oligonucleotide
cacagttcgtgaggttcgacagcgacg

SEQ ID NO: 377485 - DNA, 27 bp, Artificial Sequence
  Description of Artificial Sequence: Synthetic oligonucleotide
acagttcgtgaggttcgacagcgacgc

SEQ ID NO: 377486 - DNA, 27 bp, Artificial Sequence
  Description of Artificial Sequence: Synthetic oligonucleotide
gctactacaaccagagcgaggccggat

SEQ ID NO: 377487 - DNA, 27 bp, Artificial Sequence
  Description of Artificial Sequence: Synthetic oligonucleotide
ctactacaaccagagcgaggccggatc

SEQ ID NO: 377488 - DNA, 28 bp, Artificial Sequence
  Description of Artificial Sequence: Synthetic oligonucleotide
tactacaaccagagcgaggccggatctc

SEQ ID NO: 377489 - DNA, 27 bp, Artificial Sequence
  Description of Artificial Sequence: Synthetic oligonucleotide
actacaaccagagcgaggccggatctc

SEQ ID NO: 377490 - DNA, 27 bp, Artificial Sequence
  Description of Artificial Sequence: Synthetic oligonucleotide
ctacaaccagagcgaggccggatctca

SEQ ID NO: 377491 - DNA, 27 bp, Artificial Sequence
  Description of Artificial Sequence: Synthetic oligonucleotide
tacaaccagagcgaggccggatctcac

SEQ ID NO: 377492 - DNA, 27 bp, Artificial Sequence
  Description of Artificial Sequence: Synthetic oligonucleotide
acaaccagagcgaggccggatctcaca

SEQ ID NO: 377493 - DNA, 26 bp, Artificial Sequence
  Description of Artificial Sequence: Synthetic oligonucleotide
caaccagagcgaggccggatctcaca

SEQ ID NO: 377494 - DNA, 26 bp, Artificial Sequence
  Description of Artificial Sequence: Synthetic oligonucleotide
aaccagagcgaggccggatctcacac

SEQ ID NO: 377495 - DNA, 25 bp, Artificial Sequence
  Description of Artificial Sequence: Synthetic oligonucleotide
accagagcgaggccggatctcacac

SEQ ID NO: 377496 - DNA, 24 bp, Artificial Sequence
  Description of Artificial Sequence: Synthetic oligonucleotide
ccagagcgaggccggatctcacac

SEQ ID NO: 377497 - DNA, 26 bp, Artificial Sequence
  Description of Artificial Sequence: Synthetic oligonucleotide
cagagcgaggccggatctcacaccat

SEQ ID NO: 377498 - DNA, 26 bp, Artificial Sequence
  Description of Artificial Sequence: Synthetic oligonucleotide
agagcgaggccggatctcacaccatc

SEQ ID NO: 377499 - DNA, 25 bp, Artificial Sequence
  Description of Artificial Sequence: Synthetic oligonucleotide
gagcgaggccggatctcacaccatc

SEQ ID NO: 377500 - DNA, 26 bp, Artificial Sequence
  Description of Artificial Sequence: Synthetic oligonucleotide
agcgaggccggatctcacaccatcca

SEQ ID NO: 377501 - DNA, 25 bp, Artificial Sequence
  Description of Artificial Sequence: Synthetic oligonucleotide
gcgaggccggatctcacaccatcca

SEQ ID NO: 377502 - DNA, 26 bp, Artificial Sequence
  Description of Artificial Sequence: Synthetic oligonucleotide
cgaggccggatctcacaccatccaga

SEQ ID NO: 377503 - DNA, 26 bp, Artificial Sequence
  Description of Artificial Sequence: Synthetic oligonucleotide
gaggccggatctcacaccatccagag

SEQ ID NO: 377504 - DNA, 27 bp, Artificial Sequence
  Description of Artificial Sequence: Synthetic oligonucleotide
aggccggatctcacaccatccagagga

SEQ ID NO: 377505 - DNA, 27 bp, Artificial Sequence
  Description of Artificial Sequence: Synthetic oligonucleotide
ggccggatctcacaccatccagaggat

SEQ ID NO: 377506 - DNA, 27 bp, Artificial Sequence
  Description of Artificial Sequence: Synthetic oligonucleotide
gccggatctcacaccatccagaggatg

SEQ ID NO: 377507 - DNA, 28 bp, Artificial Sequence
  Description of Artificial Sequence: Synthetic oligonucleotide
ccggatctcacaccatccagaggatgtc

SEQ ID NO: 377508 - DNA, 29 bp, Artificial Sequence
  Description of Artificial Sequence: Synthetic oligonucleotide
cggatctcacaccatccagaggatgtctg

SEQ ID NO: 377509 - DNA, 29 bp, Artificial Sequence
  Description of Artificial Sequence: Synthetic oligonucleotide
ggatctcacaccatccagaggatgtctgg

SEQ ID NO: 377510 - DNA, 29 bp, Artificial Sequence
  Description of Artificial Sequence: Synthetic oligonucleotide
gatctcacaccatccagaggatgtctggc

SEQ ID NO: 377511 - DNA, 30 bp, Artificial Sequence
  Description of Artificial Sequence: Synthetic oligonucleotide
atctcacaccatccagaggatgtctggctg

SEQ ID NO: 377512 - DNA, 27 bp, Artificial Sequence
  Description of Artificial Sequence: Synthetic oligonucleotide
agcagctgagaacctacctggagggca

SEQ ID NO: 377513 - DNA, 26 bp, Artificial Sequence
  Description of Artificial Sequence: Synthetic oligonucleotide
gcagctgagaacctacctggagggca

SEQ ID NO: 377514 - DNA, 26 bp, Artificial Sequence
  Description of Artificial Sequence: Synthetic oligonucleotide
cagctgagaacctacctggagggcac

SEQ ID NO: 377515 - DNA, 27 bp, Artificial Sequence
  Description of Artificial Sequence: Synthetic oligonucleotide
agctgagaacctacctggagggcacgt

SEQ ID NO: 377516 - DNA, 26 bp, Artificial Sequence
  Description of Artificial Sequence: Synthetic oligonucleotide
gctgagaacctacctggagggcacgt

SEQ ID NO: 377517 - DNA, 26 bp, Artificial Sequence
  Description of Artificial Sequence: Synthetic oligonucleotide
ctgagaacctacctggagggcacgtg

SEQ ID NO: 377518 - DNA, 26 bp, Artificial Sequence
  Description of Artificial Sequence: Synthetic oligonucleotide
tgagaacctacctggagggcacgtgc

SEQ ID NO: 377519 - DNA, 25 bp, Artificial Sequence
  Description of Artificial Sequence: Synthetic oligonucleotide
gagaacctacctggagggcacgtgc

SEQ ID NO: 377520 - DNA, 26 bp, Artificial Sequence
  Description of Artificial Sequence: Synthetic oligonucleotide
agaacctacctggagggcacgtgcgt

SEQ ID NO: 377521 - DNA, 25 bp, Artificial Sequence
  Description of Artificial Sequence: Synthetic oligonucleotide
gaacctacctggagggcacgtgcgt

SEQ ID NO: 377522 - DNA, 25 bp, Artificial Sequence
  Description of Artificial Sequence: Synthetic oligonucleotide
aacctacctggagggcacgtgcgtg

SEQ ID NO: 377523 - DNA, 24 bp, Artificial Sequence
  Description of Artificial Sequence: Synthetic oligonucleotide
acctacctggagggcacgtgcgtg

SEQ ID NO: 377524 - DNA, 24 bp, Artificial Sequence
  Description of Artificial Sequence: Synthetic oligonucleotide
cctcctccgcgggcacaaccagtt

SEQ ID NO: 377525 - DNA, 24 bp, Artificial Sequence
  Description of Artificial Sequence: Synthetic oligonucleotide
ctcctccgcgggcacaaccagttc

SEQ ID NO: 377526 - DNA, 24 bp, Artificial Sequence
  Description of Artificial Sequence: Synthetic oligonucleotide
tcctccgcgggcacaaccagttcg

SEQ ID NO: 377527 - DNA, 23 bp, Artificial Sequence
  Description of Artificial Sequence: Synthetic oligonucleotide
cctccgcgggcacaaccagttcg

SEQ ID NO: 377528 - DNA, 23 bp, Artificial Sequence
  Description of Artificial Sequence: Synthetic oligonucleotide
ctccgcgggcacaaccagttcgc

SEQ ID NO: 377529 - DNA, 25 bp, Artificial Sequence
  Description of Artificial Sequence: Synthetic oligonucleotide
tccgcgggcacaaccagttcgccta

SEQ ID NO: 377530 - DNA, 24 bp, Artificial Sequence
  Description of Artificial Sequence: Synthetic oligonucleotide
ccgcgggcacaaccagttcgccta

SEQ ID NO: 377531 - DNA, 24 bp, Artificial Sequence
  Description of Artificial Sequence: Synthetic oligonucleotide
cgcgggcacaaccagttcgcctac

SEQ ID NO: 377532 - DNA, 25 bp, Artificial Sequence
  Description of Artificial Sequence: Synthetic oligonucleotide
gcgggcacaaccagttcgcctacga

SEQ ID NO: 377533 - DNA, 25 bp, Artificial Sequence
  Description of Artificial Sequence: Synthetic oligonucleotide
cgggcacaaccagttcgcctacgac

SEQ ID NO: 377534 - DNA, 25 bp, Artificial Sequence
  Description of Artificial Sequence: Synthetic oligonucleotide
gggcacaaccagttcgcctacgacg

SEQ ID NO: 377535 - DNA, 25 bp, Artificial Sequence
  Description of Artificial Sequence: Synthetic oligonucleotide
ggcacaaccagttcgcctacgacgg

SEQ ID NO: 377536 - DNA, 27 bp, Artificial Sequence
  Description of Artificial Sequence: Synthetic oligonucleotide
gcacaaccagttcgcctacgacggcaa

SEQ ID NO: 377537 - DNA, 27 bp, Artificial Sequence
  Description of Artificial Sequence: Synthetic oligonucleotide
cacaaccagttcgcctacgacggcaag

SEQ ID NO: 377538 - DNA, 27 bp, Artificial Sequence
  Description of Artificial Sequence: Synthetic oligonucleotide
acaaccagttcgcctacgacggcaagg

SEQ ID NO: 377539 - DNA, 27 bp, Artificial Sequence
  Description of Artificial Sequence: Synthetic oligonucleotide
caaccagttcgcctacgacggcaagga

SEQ ID NO: 377540 - DNA, 32 bp, Artificial Sequence; identical to SEQ ID NO: 33321
  Description of Artificial Sequence: Synthetic oligonucleotide

SEQ ID NO: 377541 - DNA, 32 bp, Artificial Sequence; identical to SEQ ID NO: 33322
  Description of Artificial Sequence: Synthetic oligonucleotide

SEQ ID NO: 377542 - DNA, 33 bp, Artificial Sequence; identical to SEQ ID NO: 33323
  Description of Artificial Sequence: Synthetic oligonucleotide

SEQ ID NO: 377543 - DNA, 32 bp, Artificial Sequence; identical to SEQ ID NO: 33324
  Description of Artificial Sequence: Synthetic oligonucleotide

SEQ ID NO: 377544 - DNA, 33 bp, Artificial Sequence; identical to SEQ ID NO: 33325
  Description of Artificial Sequence: Synthetic oligonucleotide

SEQ ID NO: 377545 - DNA, 27 bp, Artificial Sequence
  Description of Artificial Sequence: Synthetic oligonucleotide
cgtggatagaacaggaggggccggaat

SEQ ID NO: 377546 - DNA, 30 bp, Artificial Sequence
  Description of Artificial Sequence: Synthetic oligonucleotide
gtggatagaacaggaggggccggaatattg

SEQ ID NO: 377547 - DNA, 30 bp, Artificial Sequence
  Description of Artificial Sequence: Synthetic oligonucleotide
tggatagaacaggaggggccggaatattgg

SEQ ID NO: 377548 - DNA, 29 bp, Artificial Sequence
  Description of Artificial Sequence: Synthetic oligonucleotide
ggatagaacaggaggggccggaatattgg

SEQ ID NO: 377549 - DNA, 29 bp, Artificial Sequence
  Description of Artificial Sequence: Synthetic oligonucleotide
gatagaacaggaggggccggaatattggg

SEQ ID NO: 377550 - DNA, 30 bp, Artificial Sequence
  Description of Artificial Sequence: Synthetic oligonucleotide
atagaacaggaggggccggaatattgggac

SEQ ID NO: 377551 - DNA, 29 bp, Artificial Sequence
  Description of Artificial Sequence: Synthetic oligonucleotide
tagaacaggaggggccggaatattgggac

SEQ ID NO: 377552 - DNA, 28 bp, Artificial Sequence
  Description of Artificial Sequence: Synthetic oligonucleotide
agaacaggaggggccggaatattgggac

SEQ ID NO: 377553 - DNA, 27 bp, Artificial Sequence
  Description of Artificial Sequence: Synthetic oligonucleotide
gaacaggaggggccggaatattgggac

SEQ ID NO: 377554 - DNA, 27 bp, Artificial Sequence
  Description of Artificial Sequence: Synthetic oligonucleotide
aacaggaggggccggaatattgggacc

SEQ ID NO: 377555 - DNA, 26 bp, Artificial Sequence
  Description of Artificial Sequence: Synthetic oligonucleotide
acaggaggggccggaatattgggacc

SEQ ID NO: 377556 - DNA, 27 bp, Artificial Sequence
  Description of Artificial Sequence: Synthetic oligonucleotide
ctgaacgaggacctgagctcctggaca

SEQ ID NO: 377557 - DNA, 27 bp, Artificial Sequence
  Description of Artificial Sequence: Synthetic oligonucleotide
tgaacgaggacctgagctcctggacag

SEQ ID NO: 377558 - DNA, 26 bp, Artificial Sequence
  Description of Artificial Sequence: Synthetic oligonucleotide
gaacgaggacctgagctcctggacag

SEQ ID NO: 377559 - DNA, 26 bp, Artificial Sequence
  Description of Artificial Sequence: Synthetic oligonucleotide
aacgaggacctgagctcctggacagc

SEQ ID NO: 377560 - DNA, 25 bp, Artificial Sequence
  Description of Artificial Sequence: Synthetic oligonucleotide
acgaggacctgagctcctggacagc

SEQ ID NO: 377561 - DNA, 24 bp, Artificial Sequence
  Description of Artificial Sequence: Synthetic oligonucleotide
cgaggacctgagctcctggacagc

SEQ ID NO: 377562 - DNA, 24 bp, Artificial Sequence
  Description of Artificial Sequence: Synthetic oligonucleotide
gaggacctgagctcctggacagcg

SEQ ID NO: 377563 - DNA, 24 bp, Artificial Sequence
  Description of Artificial Sequence: Synthetic oligonucleotide
aggacctgagctcctggacagcgg

SEQ ID NO: 377564 - DNA, 23 bp, Artificial Sequence
  Description of Artificial Sequence: Synthetic oligonucleotide
ggacctgagctcctggacagcgg

SEQ ID NO: 377565 - DNA, 23 bp, Artificial Sequence
  Description of Artificial Sequence: Synthetic oligonucleotide
gacctgagctcctggacagcggc

SEQ ID NO: 377566 - DNA, 23 bp, Artificial Sequence
  Description of Artificial Sequence: Synthetic oligonucleotide
acctgagctcctggacagcggcg

SEQ ID NO: 377567 - DNA, 22 bp, Artificial Sequence
  Description of Artificial Sequence: Synthetic oligonucleotide
cctgagctcctggacagcggcg

SEQ ID NO: 377568 - DNA, 23 bp, Artificial Sequence
  Description of Artificial Sequence: Synthetic oligonucleotide
ctgagctcctggacagcggcgga

SEQ ID NO: 377569 - DNA, 24 bp, Artificial Sequence
  Description of Artificial Sequence: Synthetic oligonucleotide
tgagctcctggacagcggcggaca

SEQ ID NO: 377570 - DNA, 23 bp, Artificial Sequence
  Description of Artificial Sequence: Synthetic oligonucleotide
gagctcctggacagcggcggaca

SEQ ID NO: 377571 - DNA, 23 bp, Artificial Sequence
  Description of Artificial Sequence: Synthetic oligonucleotide
agctcctggacagcggcggacac

SEQ ID NO: 377572 - DNA, 22 bp, Artificial Sequence
  Description of Artificial Sequence: Synthetic oligonucleotide
gctcctggacagcggcggacac

SEQ ID NO: 377573 - DNA, 22 bp, Artificial Sequence
  Description of Artificial Sequence: Synthetic oligonucleotide
ctcctggacagcggcggacacc

SEQ ID NO: 377574 - DNA, 22 bp, Artificial Sequence
  Description of Artificial Sequence: Synthetic oligonucleotide
tcctggacagcggcggacaccg

SEQ ID NO: 377575 - DNA, 21 bp, Artificial Sequence
  Description of Artificial Sequence: Synthetic oligonucleotide
cctggacagcggcggacaccg

SEQ ID NO: 377576 - DNA, 21 bp, Artificial Sequence
  Description of Artificial Sequence: Synthetic oligonucleotide
ctggacagcggcggacaccgc

SEQ ID NO: 377577 - DNA, 21 bp, Artificial Sequence
  Description of Artificial Sequence: Synthetic oligonucleotide
tggacagcggcggacaccgcg

SEQ ID NO: 377578 - DNA, 20 bp, Artificial Sequence
  Description of Artificial Sequence: Synthetic oligonucleotide
ggacagcggcggacaccgcg

SEQ ID NO: 377579 - DNA, 20 bp, Artificial Sequence
  Description of Artificial Sequence: Synthetic oligonucleotide
gacagcggcggacaccgcgg

SEQ ID NO: 377580 - DNA, 21 bp, Artificial Sequence
  Description of Artificial Sequence: Synthetic oligonucleotide
acagcggcggacaccgcggct

SEQ ID NO: 377581 - DNA, 20 bp, Artificial Sequence
  Description of Artificial Sequence: Synthetic oligonucleotide
cagcggcggacaccgcggct

SEQ ID NO: 377582 - DNA, 21 bp, Artificial Sequence
  Description of Artificial Sequence: Synthetic oligonucleotide
agcggcggacaccgcggctca

SEQ ID NO: 377583 - DNA, 35 bp, Artificial Sequence; identical to SEQ ID NO: 29621
  Description of Artificial Sequence: Synthetic oligonucleotide

SEQ ID NO: 377584 - DNA, 34 bp, Artificial Sequence; identical to SEQ ID NO: 29622
  Description of Artificial Sequence: Synthetic oligonucleotide

SEQ ID NO: 377585 - DNA, 22 bp, Artificial Sequence
  Description of Artificial Sequence: Synthetic oligonucleotide
agctcctggaccgcggcggaga

SEQ ID NO: 377586 - DNA, 21 bp, Artificial Sequence
  Description of Artificial Sequence: Synthetic oligonucleotide
gctcctggaccgcggcggaga

SEQ ID NO: 377587 - DNA, 21 bp, Artificial Sequence
  Description of Artificial Sequence: Synthetic oligonucleotide
ctcctggaccgcggcggagac

SEQ ID NO: 377588 - DNA, 21 bp, Artificial Sequence
  Description of Artificial Sequence: Synthetic oligonucleotide
tcctggaccgcggcggagacc

SEQ ID NO: 377589 - DNA, 20 bp, Artificial Sequence
  Description of Artificial Sequence: Synthetic oligonucleotide
cctggaccgcggcggagacc

SEQ ID NO: 377590 - DNA, 20 bp, Artificial Sequence
  Description of Artificial Sequence: Synthetic oligonucleotide
ctggaccgcggcggagaccg

SEQ ID NO: 377591 - DNA, 20 bp, Artificial Sequence
  Description of Artificial Sequence: Synthetic oligonucleotide
tggaccgcggcggagaccgc

SEQ ID NO: 377592 - DNA, 20 bp, Artificial Sequence
  Description of Artificial Sequence: Synthetic oligonucleotide
ggaccgcggcggagaccgct

SEQ ID NO: 377593 - DNA, 20 bp, Artificial Sequence
  Description of Artificial Sequence: Synthetic oligonucleotide
gaccgcggcggagaccgcgt

SEQ ID NO: 377594 - DNA, 20 bp, Artificial Sequence
  Description of Artificial Sequence: Synthetic oligonucleotide
accgcggcggagaccgcggt

SEQ ID NO: 377595 - DNA, 20 bp, Artificial Sequence
  Description of Artificial Sequence: Synthetic oligonucleotide
ccgcggcggagaccgcggtt

SEQ ID NO: 377596 - DNA, 20 bp, Artificial Sequence
  Description of Artificial Sequence: Synthetic oligonucleotide
cgcggcggagaccgcggctt

SEQ ID NO: 377597 - DNA, 20 bp, Artificial Sequence
  Description of Artificial Sequence: Synthetic oligonucleotide
gcggcggagaccgcggctca

SEQ ID NO: 377598 - DNA, 22 bp, Artificial Sequence
  Description of Artificial Sequence: Synthetic oligonucleotide
cggcggagaccgcggctcagat

SEQ ID NO: 377599 - DNA, 23 bp, Artificial Sequence
  Description of Artificial Sequence: Synthetic oligonucleotide
ggcggagaccgcggctcagatca

SEQ ID NO: 377600 - DNA, 23 bp, Artificial Sequence
  Description of Artificial Sequence: Synthetic oligonucleotide
gcggagaccgcggctcagatcac

SEQ ID NO: 377601 - DNA, 23 bp, Artificial Sequence
  Description of Artificial Sequence: Synthetic oligonucleotide
cggagaccgcggctcagatcacc

SEQ ID NO: 377602 - DNA, 24 bp, Artificial Sequence
  Description of Artificial Sequence: Synthetic oligonucleotide
ggagaccgcggctcagatcaccca

SEQ ID NO: 377603 - DNA, 24 bp, Artificial Sequence
  Description of Artificial Sequence: Synthetic oligonucleotide
gagaccgcggctcagatcacccag

SEQ ID NO: 377604 - DNA, 24 bp, Artificial Sequence
  Description of Artificial Sequence: Synthetic oligonucleotide
agaccgcggctcagatcacccagc

SEQ ID NO: 377605 - DNA, 23 bp, Artificial Sequence
  Description of Artificial Sequence: Synthetic oligonucleotide
gaccgcggctcagatcacccagc

SEQ ID NO: 377606 - DNA, 27 bp, Artificial Sequence
  Description of Artificial Sequence: Synthetic oligonucleotide
cgtggatagagcaggaggggccagaat

SEQ ID NO: 377607 - DNA, 30 bp, Artificial Sequence; identical to SEQ ID NO: 33590
  Description of Artificial Sequence: Synthetic oligonucleotide

SEQ ID NO: 377608 - DNA, 30 bp, Artificial Sequence; identical to SEQ ID NO: 33591
  Description of Artificial Sequence: Synthetic oligonucleotide

SEQ ID NO: 377609 - DNA, 29 bp, Artificial Sequence
  Description of Artificial Sequence: Synthetic oligonucleotide
ggatagagcaggaggggccagaatattgg

SEQ ID NO: 377610 - DNA, 29 bp, Artificial Sequence
  Description of Artificial Sequence: Synthetic oligonucleotide
gatagagcaggaggggccagaatattggg

SEQ ID NO: 377611 - DNA, 30 bp, Artificial Sequence; identical to SEQ ID NO: 33594
  Description of Artificial Sequence: Synthetic oligonucleotide

SEQ ID NO: 377612 - DNA, 29 bp, Artificial Sequence
  Description of Artificial Sequence: Synthetic oligonucleotide
tagagcaggaggggccagaatattgggac

SEQ ID NO: 377613 - DNA, 28 bp, Artificial Sequence
  Description of Artificial Sequence: Synthetic oligonucleotide
agagcaggaggggccagaatattgggac

SEQ ID NO: 377614 - DNA, 27 bp, Artificial Sequence
  Description of Artificial Sequence: Synthetic oligonucleotide
gagcaggaggggccagaatattgggac

SEQ ID NO: 377615 - DNA, 27 bp, Artificial Sequence
  Description of Artificial Sequence: Synthetic oligonucleotide
agcaggaggggccagaatattgggacc

SEQ ID NO: 377616 - DNA, 26 bp, Artificial Sequence
  Description of Artificial Sequence: Synthetic oligonucleotide
gcaggaggggccagaatattgggacc

SEQ ID NO: 377617 - DNA, 26 bp, Artificial Sequence
  Description of Artificial Sequence: Synthetic oligonucleotide
caggaggggccagaatattgggaccg

SEQ ID NO: 377618 - DNA, 27 bp, Artificial Sequence
  Description of Artificial Sequence: Synthetic oligonucleotide
aggaggggccagaatattgggaccgga

SEQ ID NO: 377619 - DNA, 27 bp, Artificial Sequence
  Description of Artificial Sequence: Synthetic oligonucleotide
ggaggggccagaatattgggaccggaa

SEQ ID NO: 377620 - DNA, 27 bp, Artificial Sequence
  Description of Artificial Sequence: Synthetic oligonucleotide
gaggggccagaatattgggaccggaac

SEQ ID NO: 377621 - DNA, 28 bp, Artificial Sequence
  Description of Artificial Sequence: Synthetic oligonucleotide
aggggccagaatattgggaccggaacac

SEQ ID NO: 377622 - DNA, 27 bp, Artificial Sequence
  Description of Artificial Sequence: Synthetic oligonucleotide
ggggccagaatattgggaccggaacac

SEQ ID NO: 377623 - DNA, 28 bp, Artificial Sequence
  Description of Artificial Sequence: Synthetic oligonucleotide
gggccagaatattgggaccggaacacac

SEQ ID NO: 377624 - DNA, 29 bp, Artificial Sequence
  Description of Artificial Sequence: Synthetic oligonucleotide
ggccagaatattgggaccggaacacacag

SEQ ID NO: 377625 - DNA, 31 bp, Artificial Sequence; identical to SEQ ID NO: 33608
  Description of Artificial Sequence: Synthetic oligonucleotide

SEQ ID NO: 377626 - DNA, 32 bp, Artificial Sequence; identical to SEQ ID NO: 33609
  Description of Artificial Sequence: Synthetic oligonucleotide

SEQ ID NO: 377627 - DNA, 32 bp, Artificial Sequence; identical to SEQ ID NO: 33610
  Description of Artificial Sequence: Synthetic oligonucleotide

SEQ ID NO: 377628 - DNA, 34 bp, Artificial Sequence; identical to SEQ ID NO: 33611
  Description of Artificial Sequence: Synthetic oligonucleotide

SEQ ID NO: 377629 - DNA, 21 bp, Artificial Sequence
  Description of Artificial Sequence: Synthetic oligonucleotide
agcgacgccgcgagtccgagg

SEQ ID NO: 377630 - DNA, 20 bp, Artificial Sequence
  Description of Artificial Sequence: Synthetic oligonucleotide
gcgacgccgcgagtccgagg

SEQ ID NO: 377631 - DNA, 21 bp, Artificial Sequence
  Description of Artificial Sequence: Synthetic oligonucleotide
cgacgccgcgagtccgaggga

SEQ ID NO: 377632 - DNA, 21 bp, Artificial Sequence
  Description of Artificial Sequence: Synthetic oligonucleotide
gacgccgcgagtccgagggag

SEQ ID NO: 377633 - DNA, 22 bp, Artificial Sequence
  Description of Artificial Sequence: Synthetic oligonucleotide
acgccgcgagtccgagggagga

SEQ ID NO: 377634 - DNA, 21 bp, Artificial Sequence
  Description of Artificial Sequence: Synthetic oligonucleotide
cgccgcgagtccgagggagga

SEQ ID NO: 377635 - DNA, 21 bp, Artificial Sequence
  Description of Artificial Sequence: Synthetic oligonucleotide
gccgcgagtccgagggaggag

SEQ ID NO: 377636 - DNA, 21 bp, Artificial Sequence
  Description of Artificial Sequence: Synthetic oligonucleotide
ccgcgagtccgagggaggagc

SEQ ID NO: 377637 - DNA, 21 bp, Artificial Sequence
  Description of Artificial Sequence: Synthetic oligonucleotide
cgcgagtccgagggaggagcc

SEQ ID NO: 377638 - DNA, 21 bp, Artificial Sequence
  Description of Artificial Sequence: Synthetic oligonucleotide
gcgagtccgagggaggagccg

SEQ ID NO: 377639 - DNA, 21 bp, Artificial Sequence
  Description of Artificial Sequence: Synthetic oligonucleotide
cgagtccgagggaggagccgc

SEQ ID NO: 377640 - DNA, 21 bp, Artificial Sequence
  Description of Artificial Sequence: Synthetic oligonucleotide
gagtccgagggaggagccgcg

SEQ ID NO: 377641 - DNA, 21 bp, Artificial Sequence
  Description of Artificial Sequence: Synthetic oligonucleotide
agtccgagggaggagccgcgg

SEQ ID NO: 377642 - DNA, 20 bp, Artificial Sequence
  Description of Artificial Sequence: Synthetic oligonucleotide
gtccgagggaggagccgcgg

SEQ ID NO: 377643 - DNA, 20 bp, Artificial Sequence
  Description of Artificial Sequence: Synthetic oligonucleotide
tccgagggaggagccgcggg

SEQ ID NO: 377644 - DNA, 20 bp, Artificial Sequence
  Description of Artificial Sequence: Synthetic oligonucleotide
ccgagggaggagccgcgggt

SEQ ID NO: 377645 - DNA, 20 bp, Artificial Sequence
  Description of Artificial Sequence: Synthetic oligonucleotide
cgagggaggagccgcgggct

SEQ ID NO: 377646 - DNA, 20 bp, Artificial Sequence
  Description of Artificial Sequence: Synthetic oligonucleotide
gagggaggagccgcgggcgt

SEQ ID NO: 377647 - DNA, 20 bp, Artificial Sequence
  Description of Artificial Sequence: Synthetic oligonucleotide
agggaggagccgcgggcgct

SEQ ID NO: 377648 - DNA, 20 bp, Artificial Sequence
  Description of Artificial Sequence: Synthetic oligonucleotide
gggaggagccgcgggcgctt

SEQ ID NO: 377649 - DNA, 20 bp, Artificial Sequence
  Description of Artificial Sequence: Synthetic oligonucleotide
ggaggagccgcgggcgcctt

SEQ ID NO: 377650 - DNA, 24 bp, Artificial Sequence
  Description of Artificial Sequence: Synthetic oligonucleotide
cagagcgaggccgggtctcacact

SEQ ID NO: 377651 - DNA, 25 bp, Artificial Sequence
  Description of Artificial Sequence: Synthetic oligonucleotide
agagcgaggccgggtctcacactct

SEQ ID NO: 377652 - DNA, 24 bp, Artificial Sequence
  Description of Artificial Sequence: Synthetic oligonucleotide
gagcgaggccgggtctcacactct

SEQ ID NO: 377653 - DNA, 24 bp, Artificial Sequence
  Description of Artificial Sequence: Synthetic oligonucleotide
agcgaggccgggtctcacactctc

SEQ ID NO: 377654 - DNA, 23 bp, Artificial Sequence
  Description of Artificial Sequence: Synthetic oligonucleotide
gcgaggccgggtctcacactctc

SEQ ID NO: 377655 - DNA, 24 bp, Artificial Sequence
  Description of Artificial Sequence: Synthetic oligonucleotide
cgaggccgggtctcacactctcca

SEQ ID NO: 377656 - DNA, 25 bp, Artificial Sequence
  Description of Artificial Sequence: Synthetic oligonucleotide
gaggccgggtctcacactctccaga

SEQ ID NO: 377657 - DNA, 25 bp, Artificial Sequence
  Description of Artificial Sequence: Synthetic oligonucleotide
aggccgggtctcacactctccagag

SEQ ID NO: 377658 - DNA, 24 bp, Artificial Sequence
  Description of Artificial Sequence: Synthetic oligonucleotide
ggccgggtctcacactctccagag

SEQ ID NO: 377659 - DNA, 26 bp, Artificial Sequence
  Description of Artificial Sequence: Synthetic oligonucleotide
gccgggtctcacactctccagaggat

SEQ ID NO: 377660 - DNA, 27 bp, Artificial Sequence
  Description of Artificial Sequence: Synthetic oligonucleotide
ccgggtctcacactctccagaggatgt

SEQ ID NO: 377661 - DNA, 28 bp, Artificial Sequence
  Description of Artificial Sequence: Synthetic oligonucleotide
cgggtctcacactctccagaggatgtac

SEQ ID NO: 377662 - DNA, 28 bp, Artificial Sequence
  Description of Artificial Sequence: Synthetic oligonucleotide
gggtctcacactctccagaggatgtacg

SEQ ID NO: 377663 - DNA, 28 bp, Artificial Sequence
  Description of Artificial Sequence: Synthetic oligonucleotide
ggtctcacactctccagaggatgtacgg

SEQ ID NO: 377664 - DNA, 28 bp, Artificial Sequence
  Description of Artificial Sequence: Synthetic oligonucleotide
gtctcacactctccagaggatgtacggc

SEQ ID NO: 377665 - DNA, 29 bp, Artificial Sequence
  Description of Artificial Sequence: Synthetic oligonucleotide
tctcacactctccagaggatgtacggctg

SEQ ID NO: 377666 - DNA, 28 bp, Artificial Sequence
  Description of Artificial Sequence: Synthetic oligonucleotide
ctcacactctccagaggatgtacggctg

SEQ ID NO: 377667 - DNA, 28 bp, Artificial Sequence
  Description of Artificial Sequence: Synthetic oligonucleotide
tcacactctccagaggatgtacggctgc

SEQ ID NO: 377668 - DNA, 27 bp, Artificial Sequence
  Description of Artificial Sequence: Synthetic oligonucleotide
cacactctccagaggatgtacggctgc

SEQ ID NO: 377669 - DNA, 27 bp, Artificial Sequence
  Description of Artificial Sequence: Synthetic oligonucleotide
acactctccagaggatgtacggctgcg

SEQ ID NO: 377670 - DNA, 27 bp, Artificial Sequence
  Description of Artificial Sequence: Synthetic oligonucleotide
cactctccagaggatgtacggctgcga

SEQ ID NO: 377671 - DNA, 27 bp, Artificial Sequence
  Description of Artificial Sequence: Synthetic oligonucleotide
actctccagaggatgtacggctgcgac

SEQ ID NO: 377672 - DNA, 26 bp, Artificial Sequence
  Description of Artificial Sequence: Synthetic oligonucleotide
ctctccagaggatgtacggctgcgac

SEQ ID NO: 377673 - DNA, 27 bp, Artificial Sequence
  Description of Artificial Sequence: Synthetic oligonucleotide
tctccagaggatgtacggctgcgacgt

SEQ ID NO: 377674 - DNA, 27 bp, Artificial Sequence
  Description of Artificial Sequence: Synthetic oligonucleotide
cacaccctccagaggatgtacggctgt

SEQ ID NO: 377675 - DNA, 27 bp, Artificial Sequence
  Description of Artificial Sequence: Synthetic oligonucleotide
acaccctccagaggatgtacggctgtg

SEQ ID NO: 377676 - DNA, 27 bp, Artificial Sequence
  Description of Artificial Sequence: Synthetic oligonucleotide
caccctccagaggatgtacggctgtga

SEQ ID NO: 377677 - DNA, 27 bp, Artificial Sequence
  Description of Artificial Sequence: Synthetic oligonucleotide
accctccagaggatgtacggctgtgac

SEQ ID NO: 377678 - DNA, 26 bp, Artificial Sequence
  Description of Artificial Sequence: Synthetic oligonucleotide
ccctccagaggatgtacggctgtgac

SEQ ID NO: 377679 - DNA, 27 bp, Artificial Sequence
  Description of Artificial Sequence: Synthetic oligonucleotide
cctccagaggatgtacggctgtgacgt

SEQ ID NO: 377680 - DNA, 27 bp, Artificial Sequence
  Description of Artificial Sequence: Synthetic oligonucleotide
ctccagaggatgtacggctgtgacgtg

SEQ ID NO: 377681 - DNA, 27 bp, Artificial Sequence
  Description of Artificial Sequence: Synthetic oligonucleotide
tccagaggatgtacggctgtgacgtgg

SEQ ID NO: 377682 - DNA, 26 bp, Artificial Sequence
  Description of Artificial Sequence: Synthetic oligonucleotide
ccagaggatgtacggctgtgacgtgg

SEQ ID NO: 377683 - DNA, 26 bp, Artificial Sequence
  Description of Artificial Sequence: Synthetic oligonucleotide
cagaggatgtacggctgtgacgtggg

SEQ ID NO: 377684 - DNA, 26 bp, Artificial Sequence
  Description of Artificial Sequence: Synthetic oligonucleotide
agaggatgtacggctgtgacgtgggg

SEQ ID NO: 377685 - DNA, 25 bp, Artificial Sequence
  Description of Artificial Sequence: Synthetic oligonucleotide
gaggatgtacggctgtgacgtgggg

SEQ ID NO: 377686 - DNA, 25 bp, Artificial Sequence
  Description of Artificial Sequence: Synthetic oligonucleotide
aggatgtacggctgtgacgtggggc

SEQ ID NO: 377687 - DNA, 24 bp, Artificial Sequence
  Description of Artificial Sequence: Synthetic oligonucleotide
ggatgtacggctgtgacgtggggc

SEQ ID NO: 377688 - DNA, 24 bp, Artificial Sequence
  Description of Artificial Sequence: Synthetic oligonucleotide
gatgtacggctgtgacgtggggcc

SEQ ID NO: 377689 - DNA, 24 bp, Artificial Sequence
  Description of Artificial Sequence: Synthetic oligonucleotide
atgtacggctgtgacgtggggccg

SEQ ID NO: 377690 - DNA, 23 bp, Artificial Sequence
  Description of Artificial Sequence: Synthetic oligonucleotide
tgtacggctgtgacgtggggccg

SEQ ID NO: 377691 - DNA, 22 bp, Artificial Sequence
  Description of Artificial Sequence: Synthetic oligonucleotide
gtacggctgtgacgtggggccg

SEQ ID NO: 377692 - DNA, 23 bp, Artificial Sequence
  Description of Artificial Sequence: Synthetic oligonucleotide
tacggctgtgacgtggggccgga

SEQ ID NO: 377693 - DNA, 22 bp, Artificial Sequence
  Description of Artificial Sequence: Synthetic oligonucleotide
acggctgtgacgtggggccgga

SEQ ID NO: 377694 - DNA, 21 bp, Artificial Sequence
  Description of Artificial Sequence: Synthetic oligonucleotide
cggctgtgacgtggggccgga

SEQ ID NO: 377695 - DNA, 21 bp, Artificial Sequence
  Description of Artificial Sequence: Synthetic oligonucleotide
ggctgtgacgtggggccggac

SEQ ID NO: 377696 - DNA, 21 bp, Artificial Sequence
  Description of Artificial Sequence: Synthetic oligonucleotide
gctgtgacgtggggccggacg

SEQ ID NO: 377697 - DNA, 21 bp, Artificial Sequence
  Description of Artificial Sequence: Synthetic oligonucleotide
ctgtgacgtggggccggacgg

SEQ ID NO: 377698 - DNA, 21 bp, Artificial Sequence
  Description of Artificial Sequence: Synthetic oligonucleotide
tgtgacgtggggccggacggg

SEQ ID NO: 377699 - DNA, 20 bp, Artificial Sequence
  Description of Artificial Sequence: Synthetic oligonucleotide
gtgacgtggggccggacggg

SEQ ID NO: 377700 - DNA, 20 bp, Artificial Sequence
  Description of Artificial Sequence: Synthetic oligonucleotide
tgacgtggggccggacgggc

SEQ ID NO: 377701 - DNA, 27 bp, Artificial Sequence
  Description of Artificial Sequence: Synthetic oligonucleotide
gtgtggcggagcagctgagaacctact

SEQ ID NO: 377702 - DNA, 28 bp, Artificial Sequence
  Description of Artificial Sequence: Synthetic oligonucleotide
tgtggcggagcagctgagaacctacttg

SEQ ID NO: 377703 - DNA, 27 bp, Artificial Sequence
  Description of Artificial Sequence: Synthetic oligonucleotide
gtggcggagcagctgagaacctacttg

SEQ ID NO: 377704 - DNA, 27 bp, Artificial Sequence
  Description of Artificial Sequence: Synthetic oligonucleotide
tggcggagcagctgagaacctacttgg

SEQ ID NO: 377705 - DNA, 27 bp, Artificial Sequence
  Description of Artificial Sequence: Synthetic oligonucleotide
ggcggagcagctgagaacctacttgga

SEQ ID NO: 377706 - DNA, 27 bp, Artificial Sequence
  Description of Artificial Sequence: Synthetic oligonucleotide
gcggagcagctgagaacctacttggag

SEQ ID NO: 377707 - DNA, 27 bp, Artificial Sequence
  Description of Artificial Sequence: Synthetic oligonucleotide
cggagcagctgagaacctacttggagg

SEQ ID NO: 377708 - DNA, 27 bp, Artificial Sequence
  Description of Artificial Sequence: Synthetic oligonucleotide
ggagcagctgagaacctacttggaggg

SEQ ID NO: 377709 - DNA, 27 bp, Artificial Sequence
  Description of Artificial Sequence: Synthetic oligonucleotide
gagcagctgagaacctacttggagggc

SEQ ID NO: 377710 - DNA, 28 bp, Artificial Sequence
  Description of Artificial Sequence: Synthetic oligonucleotide
agcagctgagaacctacttggagggcac

SEQ ID NO: 377711 - DNA, 27 bp, Artificial Sequence
  Description of Artificial Sequence: Synthetic oligonucleotide
gcagctgagaacctacttggagggcac

SEQ ID NO: 377712 - DNA, 27 bp, Artificial Sequence
  Description of Artificial Sequence: Synthetic oligonucleotide
cagctgagaacctacttggagggcacg

SEQ ID NO: 377713 - DNA, 28 bp, Artificial Sequence
  Description of Artificial Sequence: Synthetic oligonucleotide
agctgagaacctacttggagggcacgtg

SEQ ID NO: 377714 - DNA, 27 bp, Artificial Sequence
  Description of Artificial Sequence: Synthetic oligonucleotide
gctgagaacctacttggagggcacgtg

SEQ ID NO: 377715 - DNA, 27 bp, Artificial Sequence
  Description of Artificial Sequence: Synthetic oligonucleotide
ctgagaacctacttggagggcacgtgc

SEQ ID NO: 377716 - DNA, 27 bp, Artificial Sequence
  Description of Artificial Sequence: Synthetic oligonucleotide
tgagaacctacttggagggcacgtgcg

SEQ ID NO: 377717 - DNA, 27 bp, Artificial Sequence
  Description of Artificial Sequence: Synthetic oligonucleotide
gagaacctacttggagggcacgtgcgt

SEQ ID NO: 377718 - DNA, 27 bp, Artificial Sequence
  Description of Artificial Sequence: Synthetic oligonucleotide
agaacctacttggagggcacgtgcgtg

SEQ ID NO: 377719 - DNA, 26 bp, Artificial Sequence
  Description of Artificial Sequence: Synthetic oligonucleotide
gaacctacttggagggcacgtgcgtg

SEQ ID NO: 377720 - DNA, 27 bp, Artificial Sequence
  Description of Artificial Sequence: Synthetic oligonucleotide
aacctacttggagggcacgtgcgtgga

SEQ ID NO: 377721 - DNA, 26 bp, Artificial Sequence
  Description of Artificial Sequence: Synthetic oligonucleotide
acctacttggagggcacgtgcgtgga

SEQ ID NO: 377722 - DNA, 26 bp, Artificial Sequence
  Description of Artificial Sequence: Synthetic oligonucleotide
accgcggctcagatcacccagcgtaa

SEQ ID NO: 377723 - DNA, 25 bp, Artificial Sequence
  Description of Artificial Sequence: Synthetic oligonucleotide
ccgcggctcagatcacccagcgtaa

SEQ ID NO: 377724 - DNA, 26 bp, Artificial Sequence
  Description of Artificial Sequence: Synthetic oligonucleotide
cgcggctcagatcacccagcgtaagt

SEQ ID NO: 377725 - DNA, 26 bp, Artificial Sequence
  Description of Artificial Sequence: Synthetic oligonucleotide
gcggctcagatcacccagcgtaagtg

SEQ ID NO: 377726 - DNA, 26 bp, Artificial Sequence
  Description of Artificial Sequence: Synthetic oligonucleotide
cggctcagatcacccagcgtaagtgg

SEQ ID NO: 377727 - DNA, 27 bp, Artificial Sequence
  Description of Artificial Sequence: Synthetic oligonucleotide
ggctcagatcacccagcgtaagtggga

SEQ ID NO: 377728 - DNA, 27 bp, Artificial Sequence
  Description of Artificial Sequence: Synthetic oligonucleotide
gctcagatcacccagcgtaagtgggag

SEQ ID NO: 377729 - DNA, 27 bp, Artificial Sequence
  Description of Artificial Sequence: Synthetic oligonucleotide
ctcagatcacccagcgtaagtgggagg

SEQ ID NO: 377730 - DNA, 27 bp, Artificial Sequence
  Description of Artificial Sequence: Synthetic oligonucleotide
tcagatcacccagcgtaagtgggaggc

SEQ ID NO: 377731 - DNA, 26 bp, Artificial Sequence
  Description of Artificial Sequence: Synthetic oligonucleotide
cagatcacccagcgtaagtgggaggc

SEQ ID NO: 377732 - DNA, 26 bp, Artificial Sequence
  Description of Artificial Sequence: Synthetic oligonucleotide
agatcacccagcgtaagtgggaggcg

SEQ ID NO: 377733 - DNA, 25 bp, Artificial Sequence
  Description of Artificial Sequence: Synthetic oligonucleotide
gatcacccagcgtaagtgggaggcg

SEQ ID NO: 377734 - DNA, 25 bp, Artificial Sequence
  Description of Artificial Sequence: Synthetic oligonucleotide
atcacccagcgtaagtgggaggcgg

SEQ ID NO: 377735 - DNA, 24 bp, Artificial Sequence
  Description of Artificial Sequence: Synthetic oligonucleotide
tcacccagcgtaagtgggaggcgg

SEQ ID NO: 377736 - DNA, 23 bp, Artificial Sequence
  Description of Artificial Sequence: Synthetic oligonucleotide
cacccagcgtaagtgggaggcgg

SEQ ID NO: 377737 - DNA, 23 bp, Artificial Sequence
  Description of Artificial Sequence: Synthetic oligonucleotide
acccagcgtaagtgggaggcggc

SEQ ID NO: 377738 - DNA, 22 bp, Artificial Sequence
  Description of Artificial Sequence: Synthetic oligonucleotide
cccagcgtaagtgggaggcggc

SEQ ID NO: 377739 - DNA, 22 bp, Artificial Sequence
  Description of Artificial Sequence: Synthetic oligonucleotide
ccagcgtaagtgggaggcggcc

SEQ ID NO: 377740 - DNA, 22 bp, Artificial Sequence
  Description of Artificial Sequence: Synthetic oligonucleotide
cagcgtaagtgggaggcggccc

SEQ ID NO: 377741 - DNA, 23 bp, Artificial Sequence
  Description of Artificial Sequence: Synthetic oligonucleotide
agcgtaagtgggaggcggcccgt

SEQ ID NO: 377742 - DNA, 22 bp, Artificial Sequence
  Description of Artificial Sequence: Synthetic oligonucleotide
gcgtaagtgggaggcggcccgt

SEQ ID NO: 377743 - DNA, 23 bp, Artificial Sequence
  Description of Artificial Sequence: Synthetic oligonucleotide
cgtaagtgggaggcggcccgtgt

SEQ ID NO: 377744 - DNA, 23 bp, Artificial Sequence
  Description of Artificial Sequence: Synthetic oligonucleotide
gtaagtgggaggcggcccgtgtg

SEQ ID NO: 377745 - DNA, 23 bp, Artificial Sequence
  Description of Artificial Sequence: Synthetic oligonucleotide
taagtgggaggcggcccgtgtgg

SEQ ID NO: 377746 - DNA, 24 bp, Artificial Sequence
  Description of Artificial Sequence: Synthetic oligonucleotide
gaggggccggaatattgggaccgg

SEQ ID NO: 377747 - DNA, 25 bp, Artificial Sequence
  Description of Artificial Sequence: Synthetic oligonucleotide
aggggccggaatattgggaccggga

SEQ ID NO: 377748 - DNA, 24 bp, Artificial Sequence
  Description of Artificial Sequence: Synthetic oligonucleotide
ggggccggaatattgggaccggga

SEQ ID NO: 377749 - DNA, 25 bp, Artificial Sequence
  Description of Artificial Sequence: Synthetic oligonucleotide
gggccggaatattgggaccgggaga

SEQ ID NO: 377750 - DNA, 26 bp, Artificial Sequence
  Description of Artificial Sequence: Synthetic oligonucleotide
ggccggaatattgggaccgggagaca

SEQ ID NO: 377751 - DNA, 27 bp, Artificial Sequence
  Description of Artificial Sequence: Synthetic oligonucleotide
gccggaatattgggaccgggagacaca

SEQ ID NO: 377752 - DNA, 27 bp, Artificial Sequence
  Description of Artificial Sequence: Synthetic oligonucleotide
ccggaatattgggaccgggagacacag

SEQ ID NO: 377753 - DNA, 29 bp, Artificial Sequence
  Description of Artificial Sequence: Synthetic oligonucleotide
cggaatattgggaccgggagacacagatc

SEQ ID NO: 377754 - DNA, 30 bp, Artificial Sequence; identical to SEQ ID NO: 33361
  Description of Artificial Sequence: Synthetic oligonucleotide

SEQ ID NO: 377755 - DNA, 30 bp, Artificial Sequence; identical to SEQ ID NO: 33362
  Description of Artificial Sequence: Synthetic oligonucleotide

SEQ ID NO: 377756 - DNA, 32 bp, Artificial Sequence; identical to SEQ ID NO: 33363
  Description of Artificial Sequence: Synthetic oligonucleotide

SEQ ID NO: 377757 - DNA, 31 bp, Artificial Sequence; identical to SEQ ID NO: 33364
  Description of Artificial Sequence: Synthetic oligonucleotide

SEQ ID NO: 377758 - DNA, 24 bp, Artificial Sequence
  Description of Artificial Sequence: Synthetic oligonucleotide
gagggcacgtgcgtggagtggctt

SEQ ID NO: 377759 - DNA, 24 bp, Artificial Sequence
  Description of Artificial Sequence: Synthetic oligonucleotide
agggcacgtgcgtggagtggcttc

SEQ ID NO: 377760 - DNA, 23 bp, Artificial Sequence
  Description of Artificial Sequence: Synthetic oligonucleotide
gggcacgtgcgtggagtggcttc

SEQ ID NO: 377761 - DNA, 23 bp, Artificial Sequence
  Description of Artificial Sequence: Synthetic oligonucleotide
ggcacgtgcgtggagtggcttcg

SEQ ID NO: 377762 - DNA, 24 bp, Artificial Sequence
  Description of Artificial Sequence: Synthetic oligonucleotide
gcacgtgcgtggagtggcttcgca

SEQ ID NO: 377763 - DNA, 27 bp, Artificial Sequence
  Description of Artificial Sequence: Synthetic oligonucleotide
cacgtgcgtggagtggcttcgcagata

SEQ ID NO: 377764 - DNA, 27 bp, Artificial Sequence
  Description of Artificial Sequence: Synthetic oligonucleotide
acgtgcgtggagtggcttcgcagatac

SEQ ID NO: 377765 - DNA, 26 bp, Artificial Sequence
  Description of Artificial Sequence: Synthetic oligonucleotide
cgtgcgtggagtggcttcgcagatac

SEQ ID NO: 377766 - DNA, 28 bp, Artificial Sequence
  Description of Artificial Sequence: Synthetic oligonucleotide
cgggtctcacacttggcagacgatgtac

SEQ ID NO: 377767 - DNA, 28 bp, Artificial Sequence
  Description of Artificial Sequence: Synthetic oligonucleotide
gggtctcacacttggcagacgatgtacg

SEQ ID NO: 377768 - DNA, 28 bp, Artificial Sequence
  Description of Artificial Sequence: Synthetic oligonucleotide
ggtctcacacttggcagacgatgtacgg

SEQ ID NO: 377769 - DNA, 28 bp, Artificial Sequence
  Description of Artificial Sequence: Synthetic oligonucleotide
gtctcacacttggcagacgatgtacggc

SEQ ID NO: 377770 - DNA, 29 bp, Artificial Sequence
  Description of Artificial Sequence: Synthetic oligonucleotide
tctcacacttggcagacgatgtacggctg

SEQ ID NO: 377771 - DNA, 28 bp, Artificial Sequence
  Description of Artificial Sequence: Synthetic oligonucleotide
ctcacacttggcagacgatgtacggctg

SEQ ID NO: 377772 - DNA, 28 bp, Artificial Sequence
  Description of Artificial Sequence: Synthetic oligonucleotide
tcacacttggcagacgatgtacggctgc

SEQ ID NO: 377773 - DNA, 27 bp, Artificial Sequence
  Description of Artificial Sequence: Synthetic oligonucleotide
cacacttggcagacgatgtacggctgc

SEQ ID NO: 377774 - DNA, 27 bp, Artificial Sequence
  Description of Artificial Sequence: Synthetic oligonucleotide
acacttggcagacgatgtacggctgcg

SEQ ID NO: 377775 - DNA, 27 bp, Artificial Sequence
  Description of Artificial Sequence: Synthetic oligonucleotide
cacttggcagacgatgtacggctgcga

SEQ ID NO: 377776 - DNA, 27 bp, Artificial Sequence
  Description of Artificial Sequence: Synthetic oligonucleotide
acttggcagacgatgtacggctgcgac

SEQ ID NO: 377777 - DNA, 26 bp, Artificial Sequence
  Description of Artificial Sequence: Synthetic oligonucleotide
cttggcagacgatgtacggctgcgac

SEQ ID NO: 377778 - DNA, 27 bp, Artificial Sequence
  Description of Artificial Sequence: Synthetic oligonucleotide
ttggcagacgatgtacggctgcgacgt

SEQ ID NO: 377779 - DNA, 26 bp, Artificial Sequence
  Description of Artificial Sequence: Synthetic oligonucleotide
tggcagacgatgtacggctgcgacgt

SEQ ID NO: 377780 - DNA, 25 bp, Artificial Sequence
  Description of Artificial Sequence: Synthetic oligonucleotide
ggcagacgatgtacggctgcgacgt

SEQ ID NO: 377781 - DNA, 25 bp, Artificial Sequence
  Description of Artificial Sequence: Synthetic oligonucleotide
gcagacgatgtacggctgcgacgtg

SEQ ID NO: 377782 - DNA, 23 bp, Artificial Sequence
  Description of Artificial Sequence: Synthetic oligonucleotide
ccgtgtggcggagcagcggagaa

SEQ ID NO: 377783 - DNA, 23 bp, Artificial Sequence
  Description of Artificial Sequence: Synthetic oligonucleotide
cgtgtggcggagcagcggagaac

SEQ ID NO: 377784 - DNA, 25 bp, Artificial Sequence
  Description of Artificial Sequence: Synthetic oligonucleotide
gtgtggcggagcagcggagaaccta

SEQ ID NO: 377785 - DNA, 25 bp, Artificial Sequence
  Description of Artificial Sequence: Synthetic oligonucleotide
tgtggcggagcagcggagaacctac

SEQ ID NO: 377786 - DNA, 24 bp, Artificial Sequence
  Description of Artificial Sequence: Synthetic oligonucleotide
gtggcggagcagcggagaacctac

SEQ ID NO: 377787 - DNA, 25 bp, Artificial Sequence
  Description of Artificial Sequence: Synthetic oligonucleotide
tggcggagcagcggagaacctacct

SEQ ID NO: 377788 - DNA, 24 bp, Artificial Sequence
  Description of Artificial Sequence: Synthetic oligonucleotide
ggcggagcagcggagaacctacct

SEQ ID NO: 377789 - DNA, 24 bp, Artificial Sequence
  Description of Artificial Sequence: Synthetic oligonucleotide
gcggagcagcggagaacctacctg

SEQ ID NO: 377790 - DNA, 25 bp, Artificial Sequence
  Description of Artificial Sequence: Synthetic oligonucleotide
cggagcagcggagaacctacctgga

SEQ ID NO: 377791 - DNA, 25 bp, Artificial Sequence
  Description of Artificial Sequence: Synthetic oligonucleotide
ggagcagcggagaacctacctggag

SEQ ID NO: 377792 - DNA, 25 bp, Artificial Sequence
  Description of Artificial Sequence: Synthetic oligonucleotide
gagcagcggagaacctacctggagg

SEQ ID NO: 377793 - DNA, 25 bp, Artificial Sequence
  Description of Artificial Sequence: Synthetic oligonucleotide
agcagcggagaacctacctggaggg

SEQ ID NO: 377794 - DNA, 24 bp, Artificial Sequence
  Description of Artificial Sequence: Synthetic oligonucleotide
gcagcggagaacctacctggaggg

SEQ ID NO: 377795 - DNA, 25 bp, Artificial Sequence
  Description of Artificial Sequence: Synthetic oligonucleotide
cagcggagaacctacctggagggca

SEQ ID NO: 377796 - DNA, 25 bp, Artificial Sequence
  Description of Artificial Sequence: Synthetic oligonucleotide
agcggagaacctacctggagggcac

SEQ ID NO: 377797 - DNA, 24 bp, Artificial Sequence
  Description of Artificial Sequence: Synthetic oligonucleotide
gcggagaacctacctggagggcac

SEQ ID NO: 377798 - DNA, 25 bp, Artificial Sequence
  Description of Artificial Sequence: Synthetic oligonucleotide
cggagaacctacctggagggcacgt

SEQ ID NO: 377799 - DNA, 25 bp, Artificial Sequence
  Description of Artificial Sequence: Synthetic oligonucleotide
ggagaacctacctggagggcacgtg

SEQ ID NO: 377800 - DNA, 35 bp, Artificial Sequence; identical to SEQ ID NO: 22689
  Description of Artificial Sequence: Synthetic oligonucleotide

SEQ ID NO: 377801 - DNA, 36 bp, Artificial Sequence; identical to SEQ ID NO: 22690
  Description of Artificial Sequence: Synthetic oligonucleotide

SEQ ID NO: 377802 - DNA, 35 bp, Artificial Sequence; identical to SEQ ID NO: 22691
  Description of Artificial Sequence: Synthetic oligonucleotide

SEQ ID NO: 377803 - DNA, 34 bp, Artificial Sequence; identical to SEQ ID NO: 22692
  Description of Artificial Sequence: Synthetic oligonucleotide

SEQ ID NO: 377804 - DNA, 34 bp, Artificial Sequence; identical to SEQ ID NO: 22693
  Description of Artificial Sequence: Synthetic oligonucleotide

SEQ ID NO: 377805 - DNA, 33 bp, Artificial Sequence; identical to SEQ ID NO: 22694
  Description of Artificial Sequence: Synthetic oligonucleotide

SEQ ID NO: 377806 - DNA, 33 bp, Artificial Sequence; identical to SEQ ID NO: 22695
  Description of Artificial Sequence: Synthetic oligonucleotide

SEQ ID NO: 377807 - DNA, 32 bp, Artificial Sequence; identical to SEQ ID NO: 22696
  Description of Artificial Sequence: Synthetic oligonucleotide

SEQ ID NO: 377808 - DNA, 33 bp, Artificial Sequence; identical to SEQ ID NO: 22697
  Description of Artificial Sequence: Synthetic oligonucleotide

SEQ ID NO: 377809 - DNA, 32 bp, Artificial Sequence; identical to SEQ ID NO: 22698
  Description of Artificial Sequence: Synthetic oligonucleotide

SEQ ID NO: 377810 - DNA, 33 bp, Artificial Sequence; identical to SEQ ID NO: 22699
  Description of Artificial Sequence: Synthetic oligonucleotide

SEQ ID NO: 377811 - DNA, 32 bp, Artificial Sequence; identical to SEQ ID NO: 22700
  Description of Artificial Sequence: Synthetic oligonucleotide

SEQ ID NO: 377812 - DNA, 31 bp, Artificial Sequence; identical to SEQ ID NO: 22701
  Description of Artificial Sequence: Synthetic oligonucleotide

SEQ ID NO: 377813 - DNA, 32 bp, Artificial Sequence; identical to SEQ ID NO: 22702
  Description of Artificial Sequence: Synthetic oligonucleotide

SEQ ID NO: 377814 - DNA, 31 bp, Artificial Sequence; identical to SEQ ID NO: 22703
  Description of Artificial Sequence: Synthetic oligonucleotide

SEQ ID NO: 377815 - DNA, 25 bp, Artificial Sequence
  Description of Artificial Sequence: Synthetic oligonucleotide
ggccggagtattgggaccggaacac

SEQ ID NO: 377816 - DNA, 25 bp, Artificial Sequence
  Description of Artificial Sequence: Synthetic oligonucleotide
gccggagtattgggaccggaacacg

SEQ ID NO: 377817 - DNA, 26 bp, Artificial Sequence
  Description of Artificial Sequence: Synthetic oligonucleotide
ccggagtattgggaccggaacacgca

SEQ ID NO: 377818 - DNA, 27 bp, Artificial Sequence
  Description of Artificial Sequence: Synthetic oligonucleotide
cggagtattgggaccggaacacgcaga

SEQ ID NO: 377819 - DNA, 28 bp, Artificial Sequence
  Description of Artificial Sequence: Synthetic oligonucleotide
ggagtattgggaccggaacacgcagatc

SEQ ID NO: 377820 - DNA, 30 bp, Artificial Sequence
  Description of Artificial Sequence: Synthetic oligonucleotide
gagtattgggaccggaacacgcagatctac

SEQ ID NO: 377821 - DNA, 32 bp, Artificial Sequence
  Description of Artificial Sequence: Synthetic oligonucleotide
agtattgggaccggaacacgcagatctacaag

SEQ ID NO: 377822 - DNA, 31 bp, Artificial Sequence
  Description of Artificial Sequence: Synthetic oligonucleotide
gtattgggaccggaacacgcagatctacaag

SEQ ID NO: 377823 - DNA, 32 bp, Artificial Sequence
  Description of Artificial Sequence: Synthetic oligonucleotide
tattgggaccggaacacgcagatctacaagac

SEQ ID NO: 377824 - DNA, 31 bp, Artificial Sequence
  Description of Artificial Sequence: Synthetic oligonucleotide
attgggaccggaacacgcagatctacaagac

SEQ ID NO: 377825 - DNA, 30 bp, Artificial Sequence
  Description of Artificial Sequence: Synthetic oligonucleotide
ttgggaccggaacacgcagatctacaagac

SEQ ID NO: 377826 - DNA, 29 bp, Artificial Sequence
  Description of Artificial Sequence: Synthetic oligonucleotide
tgggaccggaacacgcagatctacaagac

SEQ ID NO: 377827 - DNA, 28 bp, Artificial Sequence
  Description of Artificial Sequence: Synthetic oligonucleotide
gggaccggaacacgcagatctacaagac

SEQ ID NO: 377828 - DNA, 28 bp, Artificial Sequence
  Description of Artificial Sequence: Synthetic oligonucleotide
ggaccggaacacgcagatctacaagacc

SEQ ID NO: 377829 - DNA, 30 bp, Artificial Sequence
  Description of Artificial Sequence: Synthetic oligonucleotide
gaccggaacacgcagatctacaagaccaac

SEQ ID NO: 377830 - DNA, 31 bp, Artificial Sequence
  Description of Artificial Sequence: Synthetic oligonucleotide
accggaacacgcagatctacaagaccaacac

SEQ ID NO: 377831 - DNA, 30 bp, Artificial Sequence
  Description of Artificial Sequence: Synthetic oligonucleotide
ccggaacacgcagatctacaagaccaacac

SEQ ID NO: 377832 - DNA, 31 bp, Artificial Sequence
  Description of Artificial Sequence: Synthetic oligonucleotide
cggaacacgcagatctacaagaccaacacac

SEQ ID NO: 377833 - DNA, 32 bp, Artificial Sequence
  Description of Artificial Sequence: Synthetic oligonucleotide
ggaacacgcagatctacaagaccaacacacag

SEQ ID NO: 377834 - DNA, 33 bp, Artificial Sequence
  Description of Artificial Sequence: Synthetic oligonucleotide
gaacacgcagatctacaagaccaacacacagac

SEQ ID NO: 377835 - DNA, 34 bp, Artificial Sequence
  Description of Artificial Sequence: Synthetic oligonucleotide
aacacgcagatctacaagaccaacacacagactg

SEQ ID NO: 377836 - DNA, 33 bp, Artificial Sequence
  Description of Artificial Sequence: Synthetic oligonucleotide
acacgcagatctacaagaccaacacacagactg

SEQ ID NO: 377837 - DNA, 32 bp, Artificial Sequence
  Description of Artificial Sequence: Synthetic oligonucleotide
cacgcagatctacaagaccaacacacagactg

SEQ ID NO: 377838 - DNA, 33 bp, Artificial Sequence
  Description of Artificial Sequence: Synthetic oligonucleotide
acgcagatctacaagaccaacacacagactgac

SEQ ID NO: 377839 - DNA, 32 bp, Artificial Sequence
  Description of Artificial Sequence: Synthetic oligonucleotide
cgcagatctacaagaccaacacacagactgac

SEQ ID NO: 377840 - DNA, 32 bp, Artificial Sequence
  Description of Artificial Sequence: Synthetic oligonucleotide
gcagatctacaagaccaacacacagactgacc

SEQ ID NO: 377841 - DNA, 28 bp, Artificial Sequence
  Description of Artificial Sequence: Synthetic oligonucleotide
cactccatgaggtatttcgacaccgccg

SEQ ID NO: 377842 - DNA, 29 bp, Artificial Sequence
  Description of Artificial Sequence: Synthetic oligonucleotide
actccatgaggtatttcgacaccgccgtg

SEQ ID NO: 377843 - DNA, 28 bp, Artificial Sequence
  Description of Artificial Sequence: Synthetic oligonucleotide
ctccatgaggtatttcgacaccgccgtg

SEQ ID NO: 377844 - DNA, 29 bp, Artificial Sequence
  Description of Artificial Sequence: Synthetic oligonucleotide
tccatgaggtatttcgacaccgccgtgtc

SEQ ID NO: 377845 - DNA, 28 bp, Artificial Sequence
  Description of Artificial Sequence: Synthetic oligonucleotide
ccatgaggtatttcgacaccgccgtgtc

SEQ ID NO: 377846 - DNA, 28 bp, Artificial Sequence
  Description of Artificial Sequence: Synthetic oligonucleotide
catgaggtatttcgacaccgccgtgtcc

SEQ ID NO: 377847 - DNA, 28 bp, Artificial Sequence
  Description of Artificial Sequence: Synthetic oligonucleotide
atgaggtatttcgacaccgccgtgtccc

SEQ ID NO: 377848 - DNA, 27 bp, Artificial Sequence
  Description of Artificial Sequence: Synthetic oligonucleotide
tgaggtatttcgacaccgccgtgtccc

SEQ ID NO: 377849 - DNA, 26 bp, Artificial Sequence
  Description of Artificial Sequence: Synthetic oligonucleotide
gaggtatttcgacaccgccgtgtccc

SEQ ID NO: 377850 - DNA, 26 bp, Artificial Sequence
  Description of Artificial Sequence: Synthetic oligonucleotide
aggtatttcgacaccgccgtgtcccg

SEQ ID NO: 377851 - DNA, 25 bp, Artificial Sequence
  Description of Artificial Sequence: Synthetic oligonucleotide
ggtatttcgacaccgccgtgtcccg

SEQ ID NO: 377852 - DNA, 25 bp, Artificial Sequence
  Description of Artificial Sequence: Synthetic oligonucleotide
gtatttcgacaccgccgtgtcccgg

SEQ ID NO: 377853 - DNA, 25 bp, Artificial Sequence
  Description of Artificial Sequence: Synthetic oligonucleotide
tatttcgacaccgccgtgtcccggc

SEQ ID NO: 377854 - DNA, 24 bp, Artificial Sequence
  Description of Artificial Sequence: Synthetic oligonucleotide
atttcgacaccgccgtgtcccggc

SEQ ID NO: 377855 - DNA, 23 bp, Artificial Sequence
  Description of Artificial Sequence: Synthetic oligonucleotide
tttcgacaccgccgtgtcccggc

SEQ ID NO: 377856 - DNA, 22 bp, Artificial Sequence
  Description of Artificial Sequence: Synthetic oligonucleotide
ttcgacaccgccgtgtcccggc

SEQ ID NO: 377857 - DNA, 21 bp, Artificial Sequence
  Description of Artificial Sequence: Synthetic oligonucleotide
tcgacaccgccgtgtcccggc

SEQ ID NO: 377858 - DNA, 20 bp, Artificial Sequence
  Description of Artificial Sequence: Synthetic oligonucleotide
cgacaccgccgtgtcccggc

SEQ ID NO: 377859 - DNA, 20 bp, Artificial Sequence
  Description of Artificial Sequence: Synthetic oligonucleotide
gacaccgccgtgtcccggcc

SEQ ID NO: 377860 - DNA, 24 bp, Artificial Sequence
  Description of Artificial Sequence: Synthetic oligonucleotide
ccgggtctcacaccctccagagca

SEQ ID NO: 377861 - DNA, 24 bp, Artificial Sequence
  Description of Artificial Sequence: Synthetic oligonucleotide
cgggtctcacaccctccagagcac

SEQ ID NO: 377862 - DNA, 26 bp, Artificial Sequence
  Description of Artificial Sequence: Synthetic oligonucleotide
gggtctcacaccctccagagcacgta

SEQ ID NO: 377863 - DNA, 26 bp, Artificial Sequence
  Description of Artificial Sequence: Synthetic oligonucleotide
ggtctcacaccctccagagcacgtac

SEQ ID NO: 377864 - DNA, 26 bp, Artificial Sequence
  Description of Artificial Sequence: Synthetic oligonucleotide
gtctcacaccctccagagcacgtacg

SEQ ID NO: 377865 - DNA, 26 bp, Artificial Sequence
  Description of Artificial Sequence: Synthetic oligonucleotide
tctcacaccctccagagcacgtacgg

SEQ ID NO: 377866 - DNA, 25 bp, Artificial Sequence
  Description of Artificial Sequence: Synthetic oligonucleotide
ctcacaccctccagagcacgtacgg

SEQ ID NO: 377867 - DNA, 26 bp, Artificial Sequence
  Description of Artificial Sequence: Synthetic oligonucleotide
tcacaccctccagagcacgtacggct

SEQ ID NO: 377868 - DNA, 25 bp, Artificial Sequence
  Description of Artificial Sequence: Synthetic oligonucleotide
cacaccctccagagcacgtacggct

SEQ ID NO: 377869 - DNA, 25 bp, Artificial Sequence
  Description of Artificial Sequence: Synthetic oligonucleotide
acaccctccagagcacgtacggctg

SEQ ID NO: 377870 - DNA, 24 bp, Artificial Sequence
  Description of Artificial Sequence: Synthetic oligonucleotide
caccctccagagcacgtacggctg

SEQ ID NO: 377871 - DNA, 24 bp, Artificial Sequence
  Description of Artificial Sequence: Synthetic oligonucleotide
accctccagagcacgtacggctgc

SEQ ID NO: 377872 - DNA, 23 bp, Artificial Sequence
  Description of Artificial Sequence: Synthetic oligonucleotide
ccctccagagcacgtacggctgc

SEQ ID NO: 377873 - DNA, 24 bp, Artificial Sequence
  Description of Artificial Sequence: Synthetic oligonucleotide
cctccagagcacgtacggctgcga

SEQ ID NO: 377874 - DNA, 24 bp, Artificial Sequence
  Description of Artificial Sequence: Synthetic oligonucleotide
ctccagagcacgtacggctgcgac

SEQ ID NO: 377875 - DNA, 25 bp, Artificial Sequence
  Description of Artificial Sequence: Synthetic oligonucleotide
tccagagcacgtacggctgcgacgt

SEQ ID NO: 377876 - DNA, 24 bp, Artificial Sequence
  Description of Artificial Sequence: Synthetic oligonucleotide
ccagagcacgtacggctgcgacgt

SEQ ID NO: 377877 - DNA, 24 bp, Artificial Sequence
  Description of Artificial Sequence: Synthetic oligonucleotide
cagagcacgtacggctgcgacgtg

SEQ ID NO: 377878 - DNA, 24 bp, Artificial Sequence
  Description of Artificial Sequence: Synthetic oligonucleotide
agagcacgtacggctgcgacgtgg

SEQ ID NO: 377879 - DNA, 23 bp, Artificial Sequence
  Description of Artificial Sequence: Synthetic oligonucleotide
gagcacgtacggctgcgacgtgg

SEQ ID NO: 377880 - DNA, 23 bp, Artificial Sequence
  Description of Artificial Sequence: Synthetic oligonucleotide
agcacgtacggctgcgacgtggg

SEQ ID NO: 377881 - DNA, 22 bp, Artificial Sequence
  Description of Artificial Sequence: Synthetic oligonucleotide
gcacgtacggctgcgacgtggg

SEQ ID NO: 377882 - DNA, 22 bp, Artificial Sequence
  Description of Artificial Sequence: Synthetic oligonucleotide
cacgtacggctgcgacgtgggg

SEQ ID NO: 377883 - DNA, 22 bp, Artificial Sequence
  Description of Artificial Sequence: Synthetic oligonucleotide
acgtacggctgcgacgtggggc

SEQ ID NO: 377884 - DNA, 21 bp, Artificial Sequence
  Description of Artificial Sequence: Synthetic oligonucleotide
cgtacggctgcgacgtggggc

SEQ ID NO: 377885 - DNA, 29 bp, Artificial Sequence
  Description of Artificial Sequence: Synthetic oligonucleotide
aacacacagactgaccgagagagcctgag

SEQ ID NO: 377886 - DNA, 28 bp, Artificial Sequence
  Description of Artificial Sequence: Synthetic oligonucleotide
acacacagactgaccgagagagcctgag

SEQ ID NO: 377887 - DNA, 27 bp, Artificial Sequence
  Description of Artificial Sequence: Synthetic oligonucleotide
cacacagactgaccgagagagcctgag

SEQ ID NO: 377888 - DNA, 27 bp, Artificial Sequence
  Description of Artificial Sequence: Synthetic oligonucleotide
acacagactgaccgagagagcctgagg

SEQ ID NO: 377889 - DNA, 27 bp, Artificial Sequence
  Description of Artificial Sequence: Synthetic oligonucleotide
cacagactgaccgagagagcctgagga

SEQ ID NO: 377890 - DNA, 28 bp, Artificial Sequence
  Description of Artificial Sequence: Synthetic oligonucleotide
acagactgaccgagagagcctgaggaac

SEQ ID NO: 377891 - DNA, 27 bp, Artificial Sequence
  Description of Artificial Sequence: Synthetic oligonucleotide
cagactgaccgagagagcctgaggaac

SEQ ID NO: 377892 - DNA, 27 bp, Artificial Sequence
  Description of Artificial Sequence: Synthetic oligonucleotide
agactgaccgagagagcctgaggaacc

SEQ ID NO: 377893 - DNA, 27 bp, Artificial Sequence
  Description of Artificial Sequence: Synthetic oligonucleotide
gactgaccgagagagcctgaggaacct

SEQ ID NO: 377894 - DNA, 27 bp, Artificial Sequence
  Description of Artificial Sequence: Synthetic oligonucleotide
actgaccgagagagcctgaggaacctg

SEQ ID NO: 377895 - DNA, 26 bp, Artificial Sequence
  Description of Artificial Sequence: Synthetic oligonucleotide
ctgaccgagagagcctgaggaacctg

SEQ ID NO: 377896 - DNA, 26 bp, Artificial Sequence
  Description of Artificial Sequence: Synthetic oligonucleotide
tgaccgagagagcctgaggaacctgc

SEQ ID NO: 377897 - DNA, 25 bp, Artificial Sequence
  Description of Artificial Sequence: Synthetic oligonucleotide
gaccgagagagcctgaggaacctgc

SEQ ID NO: 377898 - DNA, 25 bp, Artificial Sequence
  Description of Artificial Sequence: Synthetic oligonucleotide
accgagagagcctgaggaacctgcg

SEQ ID NO: 377899 - DNA, 24 bp, Artificial Sequence
  Description of Artificial Sequence: Synthetic oligonucleotide
ccgagagagcctgaggaacctgcg

SEQ ID NO: 377900 - DNA, 24 bp, Artificial Sequence
  Description of Artificial Sequence: Synthetic oligonucleotide
cgagagagcctgaggaacctgcgc

SEQ ID NO: 377901 - DNA, 24 bp, Artificial Sequence
  Description of Artificial Sequence: Synthetic oligonucleotide
gagagagcctgaggaacctgcgcg

SEQ ID NO: 377902 - DNA, 24 bp, Artificial Sequence
  Description of Artificial Sequence: Synthetic oligonucleotide
agagagcctgaggaacctgcgcgg

SEQ ID NO: 377903 - DNA, 23 bp, Artificial Sequence
  Description of Artificial Sequence: Synthetic oligonucleotide
gagagcctgaggaacctgcgcgg

SEQ ID NO: 377904 - DNA, 25 bp, Artificial Sequence
  Description of Artificial Sequence: Synthetic oligonucleotide
agagcctgaggaacctgcgcggcta

SEQ ID NO: 377905 - DNA, 24 bp, Artificial Sequence
  Description of Artificial Sequence: Synthetic oligonucleotide
gagcctgaggaacctgcgcggcta

SEQ ID NO: 377906 - DNA, 26 bp, Artificial Sequence
  Description of Artificial Sequence: Synthetic oligonucleotide
agcctgaggaacctgcgcggctacta

SEQ ID NO: 377907 - DNA, 25 bp, Artificial Sequence
  Description of Artificial Sequence: Synthetic oligonucleotide
gcctgaggaacctgcgcggctacta

SEQ ID NO: 377908 - DNA, 27 bp, Artificial Sequence
  Description of Artificial Sequence: Synthetic oligonucleotide
cctgaggaacctgcgcggctactacaa

SEQ ID NO: 377909 - DNA, 27 bp, Artificial Sequence
  Description of Artificial Sequence: Synthetic oligonucleotide
ctgaggaacctgcgcggctactacaac

SEQ ID NO: 377910 - DNA, 27 bp, Artificial Sequence
  Description of Artificial Sequence: Synthetic oligonucleotide
tgaggaacctgcgcggctactacaacc

SEQ ID NO: 377911 - DNA, 27 bp, Artificial Sequence
  Description of Artificial Sequence: Synthetic oligonucleotide
gaggaacctgcgcggctactacaacca

SEQ ID NO: 377912 - DNA, 27 bp, Artificial Sequence
  Description of Artificial Sequence: Synthetic oligonucleotide
aggaacctgcgcggctactacaaccag

SEQ ID NO: 377913 - DNA, 23 bp, Artificial Sequence
  Description of Artificial Sequence: Synthetic oligonucleotide
atgcgggtcacggcaccccgaac

SEQ ID NO: 377914 - DNA, 22 bp, Artificial Sequence
  Description of Artificial Sequence: Synthetic oligonucleotide
tgcgggtcacggcaccccgaac

SEQ ID NO: 377915 - DNA, 21 bp, Artificial Sequence
  Description of Artificial Sequence: Synthetic oligonucleotide
gcgggtcacggcaccccgaac

SEQ ID NO: 377916 - DNA, 21 bp, Artificial Sequence
  Description of Artificial Sequence: Synthetic oligonucleotide
cgggtcacggcaccccgaacc

SEQ ID NO: 377917 - DNA, 22 bp, Artificial Sequence
  Description of Artificial Sequence: Synthetic oligonucleotide
gggtcacggcaccccgaaccgt

SEQ ID NO: 377918 - DNA, 22 bp, Artificial Sequence
  Description of Artificial Sequence: Synthetic oligonucleotide
ggtcacggcaccccgaaccgtc

SEQ ID NO: 377919 - DNA, 23 bp, Artificial Sequence
  Description of Artificial Sequence: Synthetic oligonucleotide
gtcacggcaccccgaaccgtcct

SEQ ID NO: 377920 - DNA, 23 bp, Artificial Sequence
  Description of Artificial Sequence: Synthetic oligonucleotide
tcacggcaccccgaaccgtcctc

SEQ ID NO: 377921 - DNA, 22 bp, Artificial Sequence
  Description of Artificial Sequence: Synthetic oligonucleotide
cacggcaccccgaaccgtcctc

SEQ ID NO: 377922 - DNA, 23 bp, Artificial Sequence
  Description of Artificial Sequence: Synthetic oligonucleotide
acggcaccccgaaccgtcctcct

SEQ ID NO: 377923 - DNA, 22 bp, Artificial Sequence
  Description of Artificial Sequence: Synthetic oligonucleotide
cggcaccccgaaccgtcctcct

SEQ ID NO: 377924 - DNA, 22 bp, Artificial Sequence
  Description of Artificial Sequence: Synthetic oligonucleotide
ggcaccccgaaccgtcctcctg

SEQ ID NO: 377925 - DNA, 23 bp, Artificial Sequence
  Description of Artificial Sequence: Synthetic oligonucleotide
gcaccccgaaccgtcctcctgct

SEQ ID NO: 377926 - DNA, 23 bp, Artificial Sequence
  Description of Artificial Sequence: Synthetic oligonucleotide
caccccgaaccgtcctcctgctg

SEQ ID NO: 377927 - DNA, 24 bp, Artificial Sequence
  Description of Artificial Sequence: Synthetic oligonucleotide
accccgaaccgtcctcctgctgct

SEQ ID NO: 377928 - DNA, 21 bp, Artificial Sequence
  Description of Artificial Sequence: Synthetic oligonucleotide
gccctgaccgagacctgggcg

SEQ ID NO: 377929 - DNA, 21 bp, Artificial Sequence
  Description of Artificial Sequence: Synthetic oligonucleotide
ccctgaccgagacctgggcgg

SEQ ID NO: 377930 - DNA, 21 bp, Artificial Sequence
  Description of Artificial Sequence: Synthetic oligonucleotide
cctgaccgagacctgggcggg

SEQ ID NO: 377931 - DNA, 22 bp, Artificial Sequence
  Description of Artificial Sequence: Synthetic oligonucleotide
ctgaccgagacctgggcgggct

SEQ ID NO: 377932 - DNA, 22 bp, Artificial Sequence
  Description of Artificial Sequence: Synthetic oligonucleotide
tgaccgagacctgggcgggctc

SEQ ID NO: 377933 - DNA, 21 bp, Artificial Sequence
  Description of Artificial Sequence: Synthetic oligonucleotide
gaccgagacctgggcgggctc

SEQ ID NO: 377934 - DNA, 21 bp, Artificial Sequence
  Description of Artificial Sequence: Synthetic oligonucleotide
accgagacctgggcgggctcc

SEQ ID NO: 377935 - DNA, 20 bp, Artificial Sequence
  Description of Artificial Sequence: Synthetic oligonucleotide
ccgagacctgggcgggctcc

SEQ ID NO: 377936 - DNA, 21 bp, Artificial Sequence
  Description of Artificial Sequence: Synthetic oligonucleotide
cgagacctgggcgggctccca

SEQ ID NO: 377937 - DNA, 22 bp, Artificial Sequence
  Description of Artificial Sequence: Synthetic oligonucleotide
gagacctgggcgggctcccact

SEQ ID NO: 377938 - DNA, 27 bp, Artificial Sequence
  Description of Artificial Sequence: Synthetic oligonucleotide
cgggctcccactccatgaggtatttcc

SEQ ID NO: 377939 - DNA, 28 bp, Artificial Sequence
  Description of Artificial Sequence: Synthetic oligonucleotide
gggctcccactccatgaggtatttccac

SEQ ID NO: 377940 - DNA, 29 bp, Artificial Sequence
  Description of Artificial Sequence: Synthetic oligonucleotide
ctcccactccatgaggtatttccacaccg

SEQ ID NO: 377941 - DNA, 29 bp, Artificial Sequence
  Description of Artificial Sequence: Synthetic oligonucleotide
tcccactccatgaggtatttccacaccgc

SEQ ID NO: 377942 - DNA, 28 bp, Artificial Sequence
  Description of Artificial Sequence: Synthetic oligonucleotide
cccactccatgaggtatttccacaccgc

SEQ ID NO: 377943 - DNA, 28 bp, Artificial Sequence
  Description of Artificial Sequence: Synthetic oligonucleotide
ccactccatgaggtatttccacaccgcc

SEQ ID NO: 377944 - DNA, 30 bp, Artificial Sequence; identical to SEQ ID NO: 26022
  Description of Artificial Sequence: Synthetic oligonucleotide

SEQ ID NO: 377945 - DNA, 31 bp, Artificial Sequence; identical to SEQ ID NO: 26023
  Description of Artificial Sequence: Synthetic oligonucleotide

SEQ ID NO: 377946 - DNA, 30 bp, Artificial Sequence; identical to SEQ ID NO: 26024
  Description of Artificial Sequence: Synthetic oligonucleotide

SEQ ID NO: 377947 - DNA, 30 bp, Artificial Sequence; identical to SEQ ID NO: 26025
  Description of Artificial Sequence: Synthetic oligonucleotide

SEQ ID NO: 377948 - DNA, 29 bp, Artificial Sequence
  Description of Artificial Sequence: Synthetic oligonucleotide
ccatgaggtatttccacaccgccatgtcc

SEQ ID NO: 377949 - DNA, 29 bp, Artificial Sequence
  Description of Artificial Sequence: Synthetic oligonucleotide
catgaggtatttccacaccgccatgtccc

SEQ ID NO: 377950 - DNA, 29 bp, Artificial Sequence
  Description of Artificial Sequence: Synthetic oligonucleotide
atgaggtatttccacaccgccatgtcccg

SEQ ID NO: 377951 - DNA, 28 bp, Artificial Sequence
  Description of Artificial Sequence: Synthetic oligonucleotide
tgaggtatttccacaccgccatgtcccg

SEQ ID NO: 377952 - DNA, 27 bp, Artificial Sequence
  Description of Artificial Sequence: Synthetic oligonucleotide
gaggtatttccacaccgccatgtcccg

SEQ ID NO: 377953 - DNA, 27 bp, Artificial Sequence
  Description of Artificial Sequence: Synthetic oligonucleotide
aggtatttccacaccgccatgtcccgg

SEQ ID NO: 377954 - DNA, 26 bp, Artificial Sequence
  Description of Artificial Sequence: Synthetic oligonucleotide
ggtatttccacaccgccatgtcccgg

SEQ ID NO: 377955 - DNA, 26 bp, Artificial Sequence
  Description of Artificial Sequence: Synthetic oligonucleotide
gtatttccacaccgccatgtcccggc

SEQ ID NO: 377956 - DNA, 26 bp, Artificial Sequence
  Description of Artificial Sequence: Synthetic oligonucleotide
tatttccacaccgccatgtcccggcc

SEQ ID NO: 377957 - DNA, 25 bp, Artificial Sequence
  Description of Artificial Sequence: Synthetic oligonucleotide
atttccacaccgccatgtcccggcc

SEQ ID NO: 377958 - DNA, 24 bp, Artificial Sequence
  Description of Artificial Sequence: Synthetic oligonucleotide
tttccacaccgccatgtcccggcc

SEQ ID NO: 377959 - DNA, 23 bp, Artificial Sequence
  Description of Artificial Sequence: Synthetic oligonucleotide
ttccacaccgccatgtcccggcc

SEQ ID NO: 377960 - DNA, 22 bp, Artificial Sequence
  Description of Artificial Sequence: Synthetic oligonucleotide
tccacaccgccatgtcccggcc

SEQ ID NO: 377961 - DNA, 21 bp, Artificial Sequence
  Description of Artificial Sequence: Synthetic oligonucleotide
ccacaccgccatgtcccggcc

SEQ ID NO: 377962 - DNA, 21 bp, Artificial Sequence
  Description of Artificial Sequence: Synthetic oligonucleotide
cacaccgccatgtcccggccc

SEQ ID NO: 377963 - DNA, 23 bp, Artificial Sequence
  Description of Artificial Sequence: Synthetic oligonucleotide
cgcggacacggcggctcagatct

SEQ ID NO: 377964 - DNA, 23 bp, Artificial Sequence
  Description of Artificial Sequence: Synthetic oligonucleotide
gcggacacggcggctcagatctc

SEQ ID NO: 377965 - DNA, 23 bp, Artificial Sequence
  Description of Artificial Sequence: Synthetic oligonucleotide
cggacacggcggctcagatctcc

SEQ ID NO: 377966 - DNA, 24 bp, Artificial Sequence
  Description of Artificial Sequence: Synthetic oligonucleotide
ggacacggcggctcagatctccca

SEQ ID NO: 377967 - DNA, 24 bp, Artificial Sequence
  Description of Artificial Sequence: Synthetic oligonucleotide
gacacggcggctcagatctcccag

SEQ ID NO: 377968 - DNA, 24 bp, Artificial Sequence
  Description of Artificial Sequence: Synthetic oligonucleotide
acacggcggctcagatctcccagc

SEQ ID NO: 377969 - DNA, 23 bp, Artificial Sequence
  Description of Artificial Sequence: Synthetic oligonucleotide
cacggcggctcagatctcccagc

SEQ ID NO: 377970 - DNA, 23 bp, Artificial Sequence
  Description of Artificial Sequence: Synthetic oligonucleotide
acggcggctcagatctcccagcg

SEQ ID NO: 377971 - DNA, 22 bp, Artificial Sequence
  Description of Artificial Sequence: Synthetic oligonucleotide
cggcggctcagatctcccagcg

SEQ ID NO: 377972 - DNA, 24 bp, Artificial Sequence
  Description of Artificial Sequence: Synthetic oligonucleotide
ggcggctcagatctcccagcgcaa

SEQ ID NO: 377973 - DNA, 26 bp, Artificial Sequence
  Description of Artificial Sequence: Synthetic oligonucleotide
gcggctcagatctcccagcgcaagtt

SEQ ID NO: 377974 - DNA, 26 bp, Artificial Sequence
  Description of Artificial Sequence: Synthetic oligonucleotide
cggctcagatctcccagcgcaagttg

SEQ ID NO: 377975 - DNA, 27 bp, Artificial Sequence
  Description of Artificial Sequence: Synthetic oligonucleotide
ggctcagatctcccagcgcaagttgga

SEQ ID NO: 377976 - DNA, 27 bp, Artificial Sequence
  Description of Artificial Sequence: Synthetic oligonucleotide
gctcagatctcccagcgcaagttggag

SEQ ID NO: 377977 - DNA, 27 bp, Artificial Sequence
  Description of Artificial Sequence: Synthetic oligonucleotide
ctcagatctcccagcgcaagttggagg

SEQ ID NO: 377978 - DNA, 27 bp, Artificial Sequence
  Description of Artificial Sequence: Synthetic oligonucleotide
tcagatctcccagcgcaagttggaggc

SEQ ID NO: 377979 - DNA, 26 bp, Artificial Sequence
  Description of Artificial Sequence: Synthetic oligonucleotide
cagatctcccagcgcaagttggaggc

SEQ ID NO: 377980 - DNA, 26 bp, Artificial Sequence
  Description of Artificial Sequence: Synthetic oligonucleotide
agatctcccagcgcaagttggaggcg

SEQ ID NO: 377981 - DNA, 25 bp, Artificial Sequence
  Description of Artificial Sequence: Synthetic oligonucleotide
gatctcccagcgcaagttggaggcg

SEQ ID NO: 377982 - DNA, 25 bp, Artificial Sequence
  Description of Artificial Sequence: Synthetic oligonucleotide
atctcccagcgcaagttggaggcgg

SEQ ID NO: 377983 - DNA, 24 bp, Artificial Sequence
  Description of Artificial Sequence: Synthetic oligonucleotide
tctcccagcgcaagttggaggcgg

SEQ ID NO: 377984 - DNA, 23 bp, Artificial Sequence
  Description of Artificial Sequence: Synthetic oligonucleotide
ctcccagcgcaagttggaggcgg

SEQ ID NO: 377985 - DNA, 23 bp, Artificial Sequence
  Description of Artificial Sequence: Synthetic oligonucleotide
tcccagcgcaagttggaggcggc

SEQ ID NO: 377986 - DNA, 22 bp, Artificial Sequence
  Description of Artificial Sequence: Synthetic oligonucleotide
cccagcgcaagttggaggcggc

SEQ ID NO: 377987 - DNA, 22 bp, Artificial Sequence
  Description of Artificial Sequence: Synthetic oligonucleotide
ccagcgcaagttggaggcggcc

SEQ ID NO: 377988 - DNA, 22 bp, Artificial Sequence
  Description of Artificial Sequence: Synthetic oligonucleotide
cagcgcaagttggaggcggccc

SEQ ID NO: 377989 - DNA, 23 bp, Artificial Sequence
  Description of Artificial Sequence: Synthetic oligonucleotide
agcgcaagttggaggcggcccgt

SEQ ID NO: 377990 - DNA, 22 bp, Artificial Sequence
  Description of Artificial Sequence: Synthetic oligonucleotide
gcgcaagttggaggcggcccgt

SEQ ID NO: 377991 - DNA, 23 bp, Artificial Sequence
  Description of Artificial Sequence: Synthetic oligonucleotide
cgcaagttggaggcggcccgtgt

SEQ ID NO: 377992 - DNA, 23 bp, Artificial Sequence
  Description of Artificial Sequence: Synthetic oligonucleotide
gcaagttggaggcggcccgtgtg

SEQ ID NO: 377993 - DNA, 23 bp, Artificial Sequence
  Description of Artificial Sequence: Synthetic oligonucleotide
caagttggaggcggcccgtgtgg

SEQ ID NO: 377994 - DNA, 23 bp, Artificial Sequence
  Description of Artificial Sequence: Synthetic oligonucleotide
aagttggaggcggcccgtgtggc

SEQ ID NO: 377995 - DNA, 22 bp, Artificial Sequence
  Description of Artificial Sequence: Synthetic oligonucleotide
agttggaggcggcccgtgtggc

SEQ ID NO: 377996 - DNA, 21 bp, Artificial Sequence
  Description of Artificial Sequence: Synthetic oligonucleotide
gttggaggcggcccgtgtggc

SEQ ID NO: 377997 - DNA, 21 bp, Artificial Sequence
  Description of Artificial Sequence: Synthetic oligonucleotide
ttggaggcggcccgtgtggcg

SEQ ID NO: 377998 - DNA, 20 bp, Artificial Sequence
  Description of Artificial Sequence: Synthetic oligonucleotide
tggaggcggcccgtgtggcg

SEQ ID NO: 377999 - DNA, 29 bp, Artificial Sequence
  Description of Artificial Sequence: Synthetic oligonucleotide
gtgtcgggtgtctagagaagccaatcagc

SEQ ID NO: 378000 - DNA, 29 bp, Artificial Sequence
  Description of Artificial Sequence: Synthetic oligonucleotide
tgtcgggtgtctagagaagccaatcagcg

SEQ ID NO: 378001 - DNA, 28 bp, Artificial Sequence
  Description of Artificial Sequence: Synthetic oligonucleotide
gtcgggtgtctagagaagccaatcagcg

SEQ ID NO: 378002 - DNA, 29 bp, Artificial Sequence
  Description of Artificial Sequence: Synthetic oligonucleotide
tcgggtgtctagagaagccaatcagcgtc

SEQ ID NO: 378003 - DNA, 28 bp, Artificial Sequence
  Description of Artificial Sequence: Synthetic oligonucleotide
cgggtgtctagagaagccaatcagcgtc

SEQ ID NO: 378004 - DNA, 28 bp, Artificial Sequence
  Description of Artificial Sequence: Synthetic oligonucleotide
gggtgtctagagaagccaatcagcgtcg

SEQ ID NO: 378005 - DNA, 28 bp, Artificial Sequence
  Description of Artificial Sequence: Synthetic oligonucleotide
ggtgtctagagaagccaatcagcgtcgc

SEQ ID NO: 378006 - DNA, 28 bp, Artificial Sequence
  Description of Artificial Sequence: Synthetic oligonucleotide
gtgtctagagaagccaatcagcgtcgcc

SEQ ID NO: 378007 - DNA, 28 bp, Artificial Sequence
  Description of Artificial Sequence: Synthetic oligonucleotide
tgtctagagaagccaatcagcgtcgccg

SEQ ID NO: 378008 - DNA, 27 bp, Artificial Sequence
  Description of Artificial Sequence: Synthetic oligonucleotide
gtctagagaagccaatcagcgtcgccg

SEQ ID NO: 378009 - DNA, 28 bp, Artificial Sequence
  Description of Artificial Sequence: Synthetic oligonucleotide
tctagagaagccaatcagcgtcgccgtg

SEQ ID NO: 378010 - DNA, 27 bp, Artificial Sequence
  Description of Artificial Sequence: Synthetic oligonucleotide
ctagagaagccaatcagcgtcgccgtg

SEQ ID NO: 378011 - DNA, 27 bp, Artificial Sequence
  Description of Artificial Sequence: Synthetic oligonucleotide
tagagaagccaatcagcgtcgccgtgg

SEQ ID NO: 378012 - DNA, 27 bp, Artificial Sequence
  Description of Artificial Sequence: Synthetic oligonucleotide
agagaagccaatcagcgtcgccgtggt

SEQ ID NO: 378013 - DNA, 26 bp, Artificial Sequence
  Description of Artificial Sequence: Synthetic oligonucleotide
gagaagccaatcagcgtcgccgtggt

SEQ ID NO: 378014 - DNA, 26 bp, Artificial Sequence
  Description of Artificial Sequence: Synthetic oligonucleotide
agaagccaatcagcgtcgccgtggtc

SEQ ID NO: 378015 - DNA, 25 bp, Artificial Sequence
  Description of Artificial Sequence: Synthetic oligonucleotide
gaagccaatcagcgtcgccgtggtc

SEQ ID NO: 378016 - DNA, 25 bp, Artificial Sequence
  Description of Artificial Sequence: Synthetic oligonucleotide
aagccaatcagcgtcgccgtggtcc

SEQ ID NO: 378017 - DNA, 24 bp, Artificial Sequence
  Description of Artificial Sequence: Synthetic oligonucleotide
agccaatcagcgtcgccgtggtcc

SEQ ID NO: 378018 - DNA, 23 bp, Artificial Sequence
  Description of Artificial Sequence: Synthetic oligonucleotide
gccaatcagcgtcgccgtggtcc

SEQ ID NO: 378019 - DNA, 24 bp, Artificial Sequence
  Description of Artificial Sequence: Synthetic oligonucleotide
ccaatcagcgtcgccgtggtccca

SEQ ID NO: 378020 - DNA, 26 bp, Artificial Sequence
  Description of Artificial Sequence: Synthetic oligonucleotide
caatcagcgtcgccgtggtcccagtt

SEQ ID NO: 378021 - DNA, 27 bp, Artificial Sequence
  Description of Artificial Sequence: Synthetic oligonucleotide
aatcagcgtcgccgtggtcccagttct

SEQ ID NO: 378022 - DNA, 27 bp, Artificial Sequence
  Description of Artificial Sequence: Synthetic oligonucleotide
atcagcgtcgccgtggtcccagttcta

SEQ ID NO: 378023 - DNA, 27 bp, Artificial Sequence
  Description of Artificial Sequence: Synthetic oligonucleotide
tcagcgtcgccgtggtcccagttctaa

SEQ ID NO: 378024 - DNA, 27 bp, Artificial Sequence
  Description of Artificial Sequence: Synthetic oligonucleotide
cagcgtcgccgtggtcccagttctaaa

SEQ ID NO: 378025 - DNA, 27 bp, Artificial Sequence
  Description of Artificial Sequence: Synthetic oligonucleotide
agcgtcgccgtggtcccagttctaaag

SEQ ID NO: 378026 - DNA, 27 bp, Artificial Sequence
  Description of Artificial Sequence: Synthetic oligonucleotide
gcgtcgccgtggtcccagttctaaagt

SEQ ID NO: 378027 - DNA, 27 bp, Artificial Sequence
  Description of Artificial Sequence: Synthetic oligonucleotide
cgtcgccgtggtcccagttctaaagtc

SEQ ID NO: 378028 - DNA, 27 bp, Artificial Sequence
  Description of Artificial Sequence: Synthetic oligonucleotide
gtcgccgtggtcccagttctaaagtcc

SEQ ID NO: 378029 - DNA, 27 bp, Artificial Sequence
  Description of Artificial Sequence: Synthetic oligonucleotide
tcgccgtggtcccagttctaaagtccc

SEQ ID NO: 378030 - DNA, 26 bp, Artificial Sequence
  Description of Artificial Sequence: Synthetic oligonucleotide
cgccgtggtcccagttctaaagtccc

SEQ ID NO: 378031 - DNA, 27 bp, Artificial Sequence
  Description of Artificial Sequence: Synthetic oligonucleotide
gccgtggtcccagttctaaagtcccca

SEQ ID NO: 378032 - DNA, 27 bp, Artificial Sequence
  Description of Artificial Sequence: Synthetic oligonucleotide
ccgtggtcccagttctaaagtccccac

SEQ ID NO: 378033 - DNA, 27 bp, Artificial Sequence
  Description of Artificial Sequence: Synthetic oligonucleotide
cgtggtcccagttctaaagtccccacg

SEQ ID NO: 378034 - DNA, 27 bp, Artificial Sequence
  Description of Artificial Sequence: Synthetic oligonucleotide
gtggtcccagttctaaagtccccacgc

SEQ ID NO: 378035 - DNA, 28 bp, Artificial Sequence
  Description of Artificial Sequence: Synthetic oligonucleotide
tggtcccagttctaaagtccccacgcac

SEQ ID NO: 378036 - DNA, 23 bp, Artificial Sequence
  Description of Artificial Sequence: Synthetic oligonucleotide
acgccgagatgcgggtcacggca

SEQ ID NO: 378037 - DNA, 22 bp, Artificial Sequence
  Description of Artificial Sequence: Synthetic oligonucleotide
cgccgagatgcgggtcacggca

SEQ ID NO: 378038 - DNA, 22 bp, Artificial Sequence
  Description of Artificial Sequence: Synthetic oligonucleotide
gccgagatgcgggtcacggcac

SEQ ID NO: 378039 - DNA, 22 bp, Artificial Sequence
  Description of Artificial Sequence: Synthetic oligonucleotide
ccgagatgcgggtcacggcacc

SEQ ID NO: 378040 - DNA, 22 bp, Artificial Sequence
  Description of Artificial Sequence: Synthetic oligonucleotide
cgagatgcgggtcacggcaccc

SEQ ID NO: 378041 - DNA, 22 bp, Artificial Sequence
  Description of Artificial Sequence: Synthetic oligonucleotide
gagatgcgggtcacggcacccc

SEQ ID NO: 378042 - DNA, 24 bp, Artificial Sequence
  Description of Artificial Sequence: Synthetic oligonucleotide
agatgcgggtcacggcaccccgaa

SEQ ID NO: 378043 - DNA, 23 bp, Artificial Sequence
  Description of Artificial Sequence: Synthetic oligonucleotide
gatgcgggtcacggcaccccgaa

SEQ ID NO: 378044 - DNA, 20 bp, Artificial Sequence
  Description of Artificial Sequence: Synthetic oligonucleotide
aggaaggagccgcgggcgcc

SEQ ID NO: 378045 - DNA, 20 bp, Artificial Sequence
  Description of Artificial Sequence: Synthetic oligonucleotide
ggaaggagccgcgggcgcct

SEQ ID NO: 378046 - DNA, 20 bp, Artificial Sequence
  Description of Artificial Sequence: Synthetic oligonucleotide
gaaggagccgcgggcgccgt

SEQ ID NO: 378047 - DNA, 20 bp, Artificial Sequence
  Description of Artificial Sequence: Synthetic oligonucleotide
aaggagccgcgggcgccgtg

SEQ ID NO: 378048 - DNA, 25 bp, Artificial Sequence
  Description of Artificial Sequence: Synthetic oligonucleotide
ggacacggcggctcagatctcccaa

SEQ ID NO: 378049 - DNA, 25 bp, Artificial Sequence
  Description of Artificial Sequence: Synthetic oligonucleotide
gacacggcggctcagatctcccaac

SEQ ID NO: 378050 - DNA, 25 bp, Artificial Sequence
  Description of Artificial Sequence: Synthetic oligonucleotide
acacggcggctcagatctcccaacg

SEQ ID NO: 378051 - DNA, 24 bp, Artificial Sequence
  Description of Artificial Sequence: Synthetic oligonucleotide
cacggcggctcagatctcccaacg

SEQ ID NO: 378052 - DNA, 26 bp, Artificial Sequence
  Description of Artificial Sequence: Synthetic oligonucleotide
acggcggctcagatctcccaacgcaa

SEQ ID NO: 378053 - DNA, 25 bp, Artificial Sequence
  Description of Artificial Sequence: Synthetic oligonucleotide
cggcggctcagatctcccaacgcaa

SEQ ID NO: 378054 - DNA, 27 bp, Artificial Sequence
  Description of Artificial Sequence: Synthetic oligonucleotide
ggcggctcagatctcccaacgcaagtt

SEQ ID NO: 378055 - DNA, 27 bp, Artificial Sequence
  Description of Artificial Sequence: Synthetic oligonucleotide
gcggctcagatctcccaacgcaagttg

SEQ ID NO: 378056 - DNA, 27 bp, Artificial Sequence
  Description of Artificial Sequence: Synthetic oligonucleotide
cggctcagatctcccaacgcaagttgg

SEQ ID NO: 378057 - DNA, 28 bp, Artificial Sequence
  Description of Artificial Sequence: Synthetic oligonucleotide
ggctcagatctcccaacgcaagttggag

SEQ ID NO: 378058 - DNA, 28 bp, Artificial Sequence
  Description of Artificial Sequence: Synthetic oligonucleotide
gctcagatctcccaacgcaagttggagg

SEQ ID NO: 378059 - DNA, 28 bp, Artificial Sequence
  Description of Artificial Sequence: Synthetic oligonucleotide
ctcagatctcccaacgcaagttggaggc

SEQ ID NO: 378060 - DNA, 28 bp, Artificial Sequence
  Description of Artificial Sequence: Synthetic oligonucleotide
tcagatctcccaacgcaagttggaggcg

SEQ ID NO: 378061 - DNA, 27 bp, Artificial Sequence
  Description of Artificial Sequence: Synthetic oligonucleotide
cagatctcccaacgcaagttggaggcg

SEQ ID NO: 378062 - DNA, 27 bp, Artificial Sequence
  Description of Artificial Sequence: Synthetic oligonucleotide
agatctcccaacgcaagttggaggcgg

SEQ ID NO: 378063 - DNA, 26 bp, Artificial Sequence
  Description of Artificial Sequence: Synthetic oligonucleotide
gatctcccaacgcaagttggaggcgg

SEQ ID NO: 378064 - DNA, 26 bp, Artificial Sequence
  Description of Artificial Sequence: Synthetic oligonucleotide
atctcccaacgcaagttggaggcggc

SEQ ID NO: 378065 - DNA, 25 bp, Artificial Sequence
  Description of Artificial Sequence: Synthetic oligonucleotide
tctcccaacgcaagttggaggcggc

SEQ ID NO: 378066 - DNA, 24 bp, Artificial Sequence
  Description of Artificial Sequence: Synthetic oligonucleotide
ctcccaacgcaagttggaggcggc

SEQ ID NO: 378067 - DNA, 24 bp, Artificial Sequence
  Description of Artificial Sequence: Synthetic oligonucleotide
tcccaacgcaagttggaggcggcc

SEQ ID NO: 378068 - DNA, 23 bp, Artificial Sequence
  Description of Artificial Sequence: Synthetic oligonucleotide
cccaacgcaagttggaggcggcc

SEQ ID NO: 378069 - DNA, 23 bp, Artificial Sequence
  Description of Artificial Sequence: Synthetic oligonucleotide
ccaacgcaagttggaggcggccc

SEQ ID NO: 378070 - DNA, 24 bp, Artificial Sequence
  Description of Artificial Sequence: Synthetic oligonucleotide
caacgcaagttggaggcggcccgt

SEQ ID NO: 378071 - DNA, 25 bp, Artificial Sequence
  Description of Artificial Sequence: Synthetic oligonucleotide
aacgcaagttggaggcggcccgtgt

SEQ ID NO: 378072 - DNA, 24 bp, Artificial Sequence
  Description of Artificial Sequence: Synthetic oligonucleotide
acgcaagttggaggcggcccgtgt

SEQ ID NO: 378073 - DNA, 26 bp, Artificial Sequence
  Description of Artificial Sequence: Synthetic oligonucleotide
gtgtggcggagcagctgagagcctat

SEQ ID NO: 378074 - DNA, 27 bp, Artificial Sequence
  Description of Artificial Sequence: Synthetic oligonucleotide
tgtggcggagcagctgagagcctatct

SEQ ID NO: 378075 - DNA, 26 bp, Artificial Sequence
  Description of Artificial Sequence: Synthetic oligonucleotide
gtggcggagcagctgagagcctatct

SEQ ID NO: 378076 - DNA, 26 bp, Artificial Sequence
  Description of Artificial Sequence: Synthetic oligonucleotide
tggcggagcagctgagagcctatctg

SEQ ID NO: 378077 - DNA, 25 bp, Artificial Sequence
  Description of Artificial Sequence: Synthetic oligonucleotide
ggcggagcagctgagagcctatctg

SEQ ID NO: 378078 - DNA, 26 bp, Artificial Sequence
  Description of Artificial Sequence: Synthetic oligonucleotide
gcggagcagctgagagcctatctgga

SEQ ID NO: 378079 - DNA, 26 bp, Artificial Sequence
  Description of Artificial Sequence: Synthetic oligonucleotide
cggagcagctgagagcctatctggag

SEQ ID NO: 378080 - DNA, 26 bp, Artificial Sequence
  Description of Artificial Sequence: Synthetic oligonucleotide
ggagcagctgagagcctatctggagg

SEQ ID NO: 378081 - DNA, 26 bp, Artificial Sequence
  Description of Artificial Sequence: Synthetic oligonucleotide
gagcagctgagagcctatctggaggg

SEQ ID NO: 378082 - DNA, 26 bp, Artificial Sequence
  Description of Artificial Sequence: Synthetic oligonucleotide
agcagctgagagcctatctggagggc

SEQ ID NO: 378083 - DNA, 25 bp, Artificial Sequence
  Description of Artificial Sequence: Synthetic oligonucleotide
gcagctgagagcctatctggagggc

SEQ ID NO: 378084 - DNA, 26 bp, Artificial Sequence
  Description of Artificial Sequence: Synthetic oligonucleotide
cagctgagagcctatctggagggcga

SEQ ID NO: 378085 - DNA, 27 bp, Artificial Sequence
  Description of Artificial Sequence: Synthetic oligonucleotide
agctgagagcctatctggagggcgagt

SEQ ID NO: 378086 - DNA, 26 bp, Artificial Sequence
  Description of Artificial Sequence: Synthetic oligonucleotide
gctgagagcctatctggagggcgagt

SEQ ID NO: 378087 - DNA, 26 bp, Artificial Sequence
  Description of Artificial Sequence: Synthetic oligonucleotide
ctgagagcctatctggagggcgagtg

SEQ ID NO: 378088 - DNA, 26 bp, Artificial Sequence
  Description of Artificial Sequence: Synthetic oligonucleotide
tgagagcctatctggagggcgagtgc

SEQ ID NO: 378089 - DNA, 25 bp, Artificial Sequence
  Description of Artificial Sequence: Synthetic oligonucleotide
gagagcctatctggagggcgagtgc

SEQ ID NO: 378090 - DNA, 26 bp, Artificial Sequence
  Description of Artificial Sequence: Synthetic oligonucleotide
agagcctatctggagggcgagtgcgt

SEQ ID NO: 378091 - DNA, 25 bp, Artificial Sequence
  Description of Artificial Sequence: Synthetic oligonucleotide
gagcctatctggagggcgagtgcgt

SEQ ID NO: 378092 - DNA, 25 bp, Artificial Sequence
  Description of Artificial Sequence: Synthetic oligonucleotide
agcctatctggagggcgagtgcgtg

SEQ ID NO: 378093 - DNA, 24 bp, Artificial Sequence
  Description of Artificial Sequence: Synthetic oligonucleotide
gcctatctggagggcgagtgcgtg

SEQ ID NO: 378094 - DNA, 25 bp, Artificial Sequence
  Description of Artificial Sequence: Synthetic oligonucleotide
cctatctggagggcgagtgcgtgga

SEQ ID NO: 378095 - DNA, 26 bp, Artificial Sequence
  Description of Artificial Sequence: Synthetic oligonucleotide
ctatctggagggcgagtgcgtggagt

SEQ ID NO: 378096 - DNA, 26 bp, Artificial Sequence
  Description of Artificial Sequence: Synthetic oligonucleotide
tatctggagggcgagtgcgtggagtg

SEQ ID NO: 378097 - DNA, 25 bp, Artificial Sequence
  Description of Artificial Sequence: Synthetic oligonucleotide
atctggagggcgagtgcgtggagtg

SEQ ID NO: 378098 - DNA, 24 bp, Artificial Sequence
  Description of Artificial Sequence: Synthetic oligonucleotide
tctggagggcgagtgcgtggagtg

SEQ ID NO: 378099 - DNA, 26 bp, Artificial Sequence
  Description of Artificial Sequence: Synthetic oligonucleotide
atcgccctgaacgaggacctgcgttc

SEQ ID NO: 378100 - DNA, 25 bp, Artificial Sequence
  Description of Artificial Sequence: Synthetic oligonucleotide
tcgccctgaacgaggacctgcgttc

SEQ ID NO: 378101 - DNA, 24 bp, Artificial Sequence
  Description of Artificial Sequence: Synthetic oligonucleotide
cgccctgaacgaggacctgcgttc

SEQ ID NO: 378102 - DNA, 25 bp, Artificial Sequence
  Description of Artificial Sequence: Synthetic oligonucleotide
gccctgaacgaggacctgcgttcct

SEQ ID NO: 378103 - DNA, 25 bp, Artificial Sequence
  Description of Artificial Sequence: Synthetic oligonucleotide
ccctgaacgaggacctgcgttcctg

SEQ ID NO: 378104 - DNA, 26 bp, Artificial Sequence
  Description of Artificial Sequence: Synthetic oligonucleotide
cctgaacgaggacctgcgttcctgga

SEQ ID NO: 378105 - DNA, 26 bp, Artificial Sequence
  Description of Artificial Sequence: Synthetic oligonucleotide
ctgaacgaggacctgcgttcctggac

SEQ ID NO: 378106 - DNA, 26 bp, Artificial Sequence
  Description of Artificial Sequence: Synthetic oligonucleotide
tgaacgaggacctgcgttcctggacc

SEQ ID NO: 378107 - DNA, 25 bp, Artificial Sequence
  Description of Artificial Sequence: Synthetic oligonucleotide
gaacgaggacctgcgttcctggacc

SEQ ID NO: 378108 - DNA, 25 bp, Artificial Sequence
  Description of Artificial Sequence: Synthetic oligonucleotide
aacgaggacctgcgttcctggaccg

SEQ ID NO: 378109 - DNA, 24 bp, Artificial Sequence
  Description of Artificial Sequence: Synthetic oligonucleotide
acgaggacctgcgttcctggaccg

SEQ ID NO: 378110 - DNA, 23 bp, Artificial Sequence
  Description of Artificial Sequence: Synthetic oligonucleotide
cgaggacctgcgttcctggaccg

SEQ ID NO: 378111 - DNA, 23 bp, Artificial Sequence
  Description of Artificial Sequence: Synthetic oligonucleotide
gaggacctgcgttcctggaccgc

SEQ ID NO: 378112 - DNA, 23 bp, Artificial Sequence
  Description of Artificial Sequence: Synthetic oligonucleotide
aggacctgcgttcctggaccgcc

SEQ ID NO: 378113 - DNA, 22 bp, Artificial Sequence
  Description of Artificial Sequence: Synthetic oligonucleotide
ggacctgcgttcctggaccgcc

SEQ ID NO: 378114 - DNA, 22 bp, Artificial Sequence
  Description of Artificial Sequence: Synthetic oligonucleotide
gacctgcgttcctggaccgccg

SEQ ID NO: 378115 - DNA, 22 bp, Artificial Sequence
  Description of Artificial Sequence: Synthetic oligonucleotide
acctgcgttcctggaccgccgc

SEQ ID NO: 378116 - DNA, 21 bp, Artificial Sequence
  Description of Artificial Sequence: Synthetic oligonucleotide
cctgcgttcctggaccgccgc

SEQ ID NO: 378117 - DNA, 21 bp, Artificial Sequence
  Description of Artificial Sequence: Synthetic oligonucleotide
ctgcgttcctggaccgccgcg

SEQ ID NO: 378118 - DNA, 22 bp, Artificial Sequence
  Description of Artificial Sequence: Synthetic oligonucleotide
tgcgttcctggaccgccgcgga

SEQ ID NO: 378119 - DNA, 21 bp, Artificial Sequence
  Description of Artificial Sequence: Synthetic oligonucleotide
gcgttcctggaccgccgcgga

SEQ ID NO: 378120 - DNA, 22 bp, Artificial Sequence
  Description of Artificial Sequence: Synthetic oligonucleotide
cgttcctggaccgccgcggaca

SEQ ID NO: 378121 - DNA, 22 bp, Artificial Sequence
  Description of Artificial Sequence: Synthetic oligonucleotide
gttcctggaccgccgcggacac

SEQ ID NO: 378122 - DNA, 22 bp, Artificial Sequence
  Description of Artificial Sequence: Synthetic oligonucleotide
ttcctggaccgccgcggacacg

SEQ ID NO: 378123 - DNA, 27 bp, Artificial Sequence
  Description of Artificial Sequence: Synthetic oligonucleotide
tatttccacaccgccatgtcccggcct

SEQ ID NO: 378124 - DNA, 26 bp, Artificial Sequence
  Description of Artificial Sequence: Synthetic oligonucleotide
atttccacaccgccatgtcccggcct

SEQ ID NO: 378125 - DNA, 25 bp, Artificial Sequence
  Description of Artificial Sequence: Synthetic oligonucleotide
tttccacaccgccatgtcccggcct

SEQ ID NO: 378126 - DNA, 24 bp, Artificial Sequence
  Description of Artificial Sequence: Synthetic oligonucleotide
ttccacaccgccatgtcccggcct

SEQ ID NO: 378127 - DNA, 23 bp, Artificial Sequence
  Description of Artificial Sequence: Synthetic oligonucleotide
tccacaccgccatgtcccggcct

SEQ ID NO: 378128 - DNA, 22 bp, Artificial Sequence
  Description of Artificial Sequence: Synthetic oligonucleotide
ccacaccgccatgtcccggcct

SEQ ID NO: 378129 - DNA, 22 bp, Artificial Sequence
  Description of Artificial Sequence: Synthetic oligonucleotide
cacaccgccatgtcccggcctg

SEQ ID NO: 378130 - DNA, 23 bp, Artificial Sequence
  Description of Artificial Sequence: Synthetic oligonucleotide
ccgcggggagccccgcttcatta

SEQ ID NO: 378131 - DNA, 23 bp, Artificial Sequence
  Description of Artificial Sequence: Synthetic oligonucleotide
cgcggggagccccgcttcattac

SEQ ID NO: 378132 - DNA, 23 bp, Artificial Sequence
  Description of Artificial Sequence: Synthetic oligonucleotide
gcggggagccccgcttcattacc

SEQ ID NO: 378133 - DNA, 24 bp, Artificial Sequence
  Description of Artificial Sequence: Synthetic oligonucleotide
cggggagccccgcttcattaccgt

SEQ ID NO: 378134 - DNA, 24 bp, Artificial Sequence
  Description of Artificial Sequence: Synthetic oligonucleotide
ggggagccccgcttcattaccgtg

SEQ ID NO: 378135 - DNA, 24 bp, Artificial Sequence
  Description of Artificial Sequence: Synthetic oligonucleotide
gggagccccgcttcattaccgtgg

SEQ ID NO: 378136 - DNA, 24 bp, Artificial Sequence
  Description of Artificial Sequence: Synthetic oligonucleotide
ggagccccgcttcattaccgtggg

SEQ ID NO: 378137 - DNA, 26 bp, Artificial Sequence
  Description of Artificial Sequence: Synthetic oligonucleotide
gagccccgcttcattaccgtgggcta

SEQ ID NO: 378138 - DNA, 26 bp, Artificial Sequence
  Description of Artificial Sequence: Synthetic oligonucleotide
agccccgcttcattaccgtgggctac

SEQ ID NO: 378139 - DNA, 25 bp, Artificial Sequence
  Description of Artificial Sequence: Synthetic oligonucleotide
gccccgcttcattaccgtgggctac

SEQ ID NO: 378140 - DNA, 26 bp, Artificial Sequence
  Description of Artificial Sequence: Synthetic oligonucleotide
ccccgcttcattaccgtgggctacgt

SEQ ID NO: 378141 - DNA, 26 bp, Artificial Sequence
  Description of Artificial Sequence: Synthetic oligonucleotide
cccgcttcattaccgtgggctacgtg

SEQ ID NO: 378142 - DNA, 27 bp, Artificial Sequence
  Description of Artificial Sequence: Synthetic oligonucleotide
ccgcttcattaccgtgggctacgtgga

SEQ ID NO: 378143 - DNA, 27 bp, Artificial Sequence
  Description of Artificial Sequence: Synthetic oligonucleotide
cgcttcattaccgtgggctacgtggac

SEQ ID NO: 378144 - DNA, 27 bp, Artificial Sequence
  Description of Artificial Sequence: Synthetic oligonucleotide
gcttcattaccgtgggctacgtggacg

SEQ ID NO: 378145 - DNA, 28 bp, Artificial Sequence
  Description of Artificial Sequence: Synthetic oligonucleotide
cttcattaccgtgggctacgtggacgac

SEQ ID NO: 378146 - DNA, 29 bp, Artificial Sequence
  Description of Artificial Sequence: Synthetic oligonucleotide
ttcattaccgtgggctacgtggacgacac

SEQ ID NO: 378147 - DNA, 28 bp, Artificial Sequence
  Description of Artificial Sequence: Synthetic oligonucleotide
tcattaccgtgggctacgtggacgacac

SEQ ID NO: 378148 - DNA, 27 bp, Artificial Sequence
  Description of Artificial Sequence: Synthetic oligonucleotide
cattaccgtgggctacgtggacgacac

SEQ ID NO: 378149 - DNA, 27 bp, Artificial Sequence
  Description of Artificial Sequence: Synthetic oligonucleotide
attaccgtgggctacgtggacgacacg

SEQ ID NO: 378150 - DNA, 26 bp, Artificial Sequence
  Description of Artificial Sequence: Synthetic oligonucleotide
ttaccgtgggctacgtggacgacacg

SEQ ID NO: 378151 - DNA, 25 bp, Artificial Sequence
  Description of Artificial Sequence: Synthetic oligonucleotide
taccgtgggctacgtggacgacacg

SEQ ID NO: 378152 - DNA, 21 bp, Artificial Sequence
  Description of Artificial Sequence: Synthetic oligonucleotide
ttggaggcggcccgtgtggcc

SEQ ID NO: 378153 - DNA, 20 bp, Artificial Sequence
  Description of Artificial Sequence: Synthetic oligonucleotide
tggaggcggcccgtgtggcc

SEQ ID NO: 378154 - DNA, 20 bp, Artificial Sequence
  Description of Artificial Sequence: Synthetic oligonucleotide
ggaggcggcccgtgtggcct

SEQ ID NO: 378155 - DNA, 20 bp, Artificial Sequence
  Description of Artificial Sequence: Synthetic oligonucleotide
gaggcggcccgtgtggccga

SEQ ID NO: 378156 - DNA, 20 bp, Artificial Sequence
  Description of Artificial Sequence: Synthetic oligonucleotide
aggcggcccgtgtggccgag

SEQ ID NO: 378157 - DNA, 20 bp, Artificial Sequence
  Description of Artificial Sequence: Synthetic oligonucleotide
ggcggcccgtgtggccgagt

SEQ ID NO: 378158 - DNA, 20 bp, Artificial Sequence
  Description of Artificial Sequence: Synthetic oligonucleotide
gcggcccgtgtggccgagca

SEQ ID NO: 378159 - DNA, 20 bp, Artificial Sequence
  Description of Artificial Sequence: Synthetic oligonucleotide
cggcccgtgtggccgagcag

SEQ ID NO: 378160 - DNA, 21 bp, Artificial Sequence
  Description of Artificial Sequence: Synthetic oligonucleotide
ggcccgtgtggccgagcagct

SEQ ID NO: 378161 - DNA, 22 bp, Artificial Sequence
  Description of Artificial Sequence: Synthetic oligonucleotide
gcccgtgtggccgagcagctga

SEQ ID NO: 378162 - DNA, 23 bp, Artificial Sequence
  Description of Artificial Sequence: Synthetic oligonucleotide
cccgtgtggccgagcagctgaga

SEQ ID NO: 378163 - DNA, 23 bp, Artificial Sequence
  Description of Artificial Sequence: Synthetic oligonucleotide
ccgtgtggccgagcagctgagag

SEQ ID NO: 378164 - DNA, 23 bp, Artificial Sequence
  Description of Artificial Sequence: Synthetic oligonucleotide
cgtgtggccgagcagctgagagc

SEQ ID NO: 378165 - DNA, 25 bp, Artificial Sequence
  Description of Artificial Sequence: Synthetic oligonucleotide
gtgtggccgagcagctgagagccta

SEQ ID NO: 378166 - DNA, 25 bp, Artificial Sequence
  Description of Artificial Sequence: Synthetic oligonucleotide
tgtggccgagcagctgagagcctac

SEQ ID NO: 378167 - DNA, 24 bp, Artificial Sequence
  Description of Artificial Sequence: Synthetic oligonucleotide
gtggccgagcagctgagagcctac

SEQ ID NO: 378168 - DNA, 25 bp, Artificial Sequence
  Description of Artificial Sequence: Synthetic oligonucleotide
tggccgagcagctgagagcctacct

SEQ ID NO: 378169 - DNA, 24 bp, Artificial Sequence
  Description of Artificial Sequence: Synthetic oligonucleotide
ggccgagcagctgagagcctacct

SEQ ID NO: 378170 - DNA, 24 bp, Artificial Sequence
  Description of Artificial Sequence: Synthetic oligonucleotide
gccgagcagctgagagcctacctg

SEQ ID NO: 378171 - DNA, 25 bp, Artificial Sequence
  Description of Artificial Sequence: Synthetic oligonucleotide
ccgagcagctgagagcctacctgga

SEQ ID NO: 378172 - DNA, 25 bp, Artificial Sequence
  Description of Artificial Sequence: Synthetic oligonucleotide
cgagcagctgagagcctacctggag

SEQ ID NO: 378173 - DNA, 28 bp, Artificial Sequence
  Description of Artificial Sequence: Synthetic oligonucleotide
ccactccatgaggtatttccacaccgcg

SEQ ID NO: 378174 - DNA, 30 bp, Artificial Sequence
  Description of Artificial Sequence: Synthetic oligonucleotide
cactccatgaggtatttccacaccgcgatg

SEQ ID NO: 378175 - DNA, 31 bp, Artificial Sequence
  Description of Artificial Sequence: Synthetic oligonucleotide
actccatgaggtatttccacaccgcgatgtc

SEQ ID NO: 378176 - DNA, 30 bp, Artificial Sequence
  Description of Artificial Sequence: Synthetic oligonucleotide
ctccatgaggtatttccacaccgcgatgtc

SEQ ID NO: 378177 - DNA, 30 bp, Artificial Sequence
  Description of Artificial Sequence: Synthetic oligonucleotide
tccatgaggtatttccacaccgcgatgtcc

SEQ ID NO: 378178 - DNA, 29 bp, Artificial Sequence
  Description of Artificial Sequence: Synthetic oligonucleotide
ccatgaggtatttccacaccgcgatgtcc

SEQ ID NO: 378179 - DNA, 29 bp, Artificial Sequence
  Description of Artificial Sequence: Synthetic oligonucleotide
catgaggtatttccacaccgcgatgtccc

SEQ ID NO: 378180 - DNA, 29 bp, Artificial Sequence
  Description of Artificial Sequence: Synthetic oligonucleotide
atgaggtatttccacaccgcgatgtcccg

SEQ ID NO: 378181 - DNA, 28 bp, Artificial Sequence
  Description of Artificial Sequence: Synthetic oligonucleotide
tgaggtatttccacaccgcgatgtcccg

SEQ ID NO: 378182 - DNA, 27 bp, Artificial Sequence
  Description of Artificial Sequence: Synthetic oligonucleotide
gaggtatttccacaccgcgatgtcccg

SEQ ID NO: 378183 - DNA, 27 bp, Artificial Sequence
  Description of Artificial Sequence: Synthetic oligonucleotide
aggtatttccacaccgcgatgtcccgg

SEQ ID NO: 378184 - DNA, 26 bp, Artificial Sequence
  Description of Artificial Sequence: Synthetic oligonucleotide
ggtatttccacaccgcgatgtcccgg

SEQ ID NO: 378185 - DNA, 26 bp, Artificial Sequence
  Description of Artificial Sequence: Synthetic oligonucleotide
gtatttccacaccgcgatgtcccggc

SEQ ID NO: 378186 - DNA, 26 bp, Artificial Sequence
  Description of Artificial Sequence: Synthetic oligonucleotide
tatttccacaccgcgatgtcccggcc

SEQ ID NO: 378187 - DNA, 25 bp, Artificial Sequence
  Description of Artificial Sequence: Synthetic oligonucleotide
atttccacaccgcgatgtcccggcc

SEQ ID NO: 378188 - DNA, 24 bp, Artificial Sequence
  Description of Artificial Sequence: Synthetic oligonucleotide
tttccacaccgcgatgtcccggcc

SEQ ID NO: 378189 - DNA, 23 bp, Artificial Sequence
  Description of Artificial Sequence: Synthetic oligonucleotide
ttccacaccgcgatgtcccggcc

SEQ ID NO: 378190 - DNA, 22 bp, Artificial Sequence
  Description of Artificial Sequence: Synthetic oligonucleotide
tccacaccgcgatgtcccggcc

SEQ ID NO: 378191 - DNA, 21 bp, Artificial Sequence
  Description of Artificial Sequence: Synthetic oligonucleotide
ccacaccgcgatgtcccggcc

SEQ ID NO: 378192 - DNA, 21 bp, Artificial Sequence
  Description of Artificial Sequence: Synthetic oligonucleotide
cacaccgcgatgtcccggccc

SEQ ID NO: 378193 - DNA, 21 bp, Artificial Sequence
  Description of Artificial Sequence: Synthetic oligonucleotide
acaccgcgatgtcccggcccg

SEQ ID NO: 378194 - DNA, 20 bp, Artificial Sequence
  Description of Artificial Sequence: Synthetic oligonucleotide
caccgcgatgtcccggcccg

SEQ ID NO: 378195 - DNA, 20 bp, Artificial Sequence
  Description of Artificial Sequence: Synthetic oligonucleotide
accgcgatgtcccggcccgg

SEQ ID NO: 378196 - DNA, 20 bp, Artificial Sequence
  Description of Artificial Sequence: Synthetic oligonucleotide
ccgcgatgtcccggcccggt

SEQ ID NO: 378197 - DNA, 20 bp, Artificial Sequence
  Description of Artificial Sequence: Synthetic oligonucleotide
cgcgatgtcccggcccggct

SEQ ID NO: 378198 - DNA, 20 bp, Artificial Sequence
  Description of Artificial Sequence: Synthetic oligonucleotide
gcgatgtcccggcccggcct

SEQ ID NO: 378199 - DNA, 20 bp, Artificial Sequence
  Description of Artificial Sequence: Synthetic oligonucleotide
cgatgtcccggcccggccgt

SEQ ID NO: 378200 - DNA, 20 bp, Artificial Sequence
  Description of Artificial Sequence: Synthetic oligonucleotide
gatgtcccggcccggccgct

SEQ ID NO: 378201 - DNA, 23 bp, Artificial Sequence
  Description of Artificial Sequence: Synthetic oligonucleotide
ggcggacacggcggctcagatct

SEQ ID NO: 378202 - DNA, 35 bp, Artificial Sequence
  Description of Artificial Sequence: Synthetic oligonucleotide
atctccaagaccaacacacagacttaccgagaaag

SEQ ID NO: 378203 - DNA, 34 bp, Artificial Sequence
  Description of Artificial Sequence: Synthetic oligonucleotide
tctccaagaccaacacacagacttaccgagaaag

SEQ ID NO: 378204 - DNA, 33 bp, Artificial Sequence
  Description of Artificial Sequence: Synthetic oligonucleotide
ctccaagaccaacacacagacttaccgagaaag

SEQ ID NO: 378205 - DNA, 33 bp, Artificial Sequence
  Description of Artificial Sequence: Synthetic oligonucleotide
tccaagaccaacacacagacttaccgagaaagc

SEQ ID NO: 378206 - DNA, 32 bp, Artificial Sequence
  Description of Artificial Sequence: Synthetic oligonucleotide
ccaagaccaacacacagacttaccgagaaagc

SEQ ID NO: 378207 - DNA, 32 bp, Artificial Sequence
  Description of Artificial Sequence: Synthetic oligonucleotide
caagaccaacacacagacttaccgagaaagcc

SEQ ID NO: 378208 - DNA, 33 bp, Artificial Sequence
  Description of Artificial Sequence: Synthetic oligonucleotide
aagaccaacacacagacttaccgagaaagcctg

SEQ ID NO: 378209 - DNA, 32 bp, Artificial Sequence
  Description of Artificial Sequence: Synthetic oligonucleotide
agaccaacacacagacttaccgagaaagcctg

SEQ ID NO: 378210 - DNA, 31 bp, Artificial Sequence
  Description of Artificial Sequence: Synthetic oligonucleotide
gaccaacacacagacttaccgagaaagcctg

SEQ ID NO: 378211 - DNA, 31 bp, Artificial Sequence
  Description of Artificial Sequence: Synthetic oligonucleotide
accaacacacagacttaccgagaaagcctgc

SEQ ID NO: 378212 - DNA, 30 bp, Artificial Sequence
  Description of Artificial Sequence: Synthetic oligonucleotide
ccaacacacagacttaccgagaaagcctgc

SEQ ID NO: 378213 - DNA, 30 bp, Artificial Sequence
  Description of Artificial Sequence: Synthetic oligonucleotide
caacacacagacttaccgagaaagcctgcg

SEQ ID NO: 378214 - DNA, 30 bp, Artificial Sequence
  Description of Artificial Sequence: Synthetic oligonucleotide
aacacacagacttaccgagaaagcctgcgg

SEQ ID NO: 378215 - DNA, 29 bp, Artificial Sequence
  Description of Artificial Sequence: Synthetic oligonucleotide
acacacagacttaccgagaaagcctgcgg

SEQ ID NO: 378216 - DNA, 28 bp, Artificial Sequence
  Description of Artificial Sequence: Synthetic oligonucleotide
cacacagacttaccgagaaagcctgcgg

SEQ ID NO: 378217 - DNA, 30 bp, Artificial Sequence
  Description of Artificial Sequence: Synthetic oligonucleotide
acacagacttaccgagaaagcctgcggaac

SEQ ID NO: 378218 - DNA, 29 bp, Artificial Sequence
  Description of Artificial Sequence: Synthetic oligonucleotide
cacagacttaccgagaaagcctgcggaac

SEQ ID NO: 378219 - DNA, 29 bp, Artificial Sequence
  Description of Artificial Sequence: Synthetic oligonucleotide
acagacttaccgagaaagcctgcggaacc

SEQ ID NO: 378220 - DNA, 28 bp, Artificial Sequence
  Description of Artificial Sequence: Synthetic oligonucleotide
cagacttaccgagaaagcctgcggaacc

SEQ ID NO: 378221 - DNA, 29 bp, Artificial Sequence
  Description of Artificial Sequence: Synthetic oligonucleotide
agacttaccgagaaagcctgcggaacctg

SEQ ID NO: 378222 - DNA, 28 bp, Artificial Sequence
  Description of Artificial Sequence: Synthetic oligonucleotide
gacttaccgagaaagcctgcggaacctg

SEQ ID NO: 378223 - DNA, 28 bp, Artificial Sequence
  Description of Artificial Sequence: Synthetic oligonucleotide
acttaccgagaaagcctgcggaacctgc

SEQ ID NO: 378224 - DNA, 27 bp, Artificial Sequence
  Description of Artificial Sequence: Synthetic oligonucleotide
cttaccgagaaagcctgcggaacctgc

SEQ ID NO: 378225 - DNA, 27 bp, Artificial Sequence
  Description of Artificial Sequence: Synthetic oligonucleotide
ttaccgagaaagcctgcggaacctgcg

SEQ ID NO: 378226 - DNA, 26 bp, Artificial Sequence
  Description of Artificial Sequence: Synthetic oligonucleotide
taccgagaaagcctgcggaacctgcg

SEQ ID NO: 378227 - DNA, 25 bp, Artificial Sequence
  Description of Artificial Sequence: Synthetic oligonucleotide
accgagaaagcctgcggaacctgcg

SEQ ID NO: 378228 - DNA, 24 bp, Artificial Sequence
  Description of Artificial Sequence: Synthetic oligonucleotide
ccgagaaagcctgcggaacctgcg

SEQ ID NO: 378229 - DNA, 24 bp, Artificial Sequence
  Description of Artificial Sequence: Synthetic oligonucleotide
cgagaaagcctgcggaacctgcgc

SEQ ID NO: 378230 - DNA, 24 bp, Artificial Sequence
  Description of Artificial Sequence: Synthetic oligonucleotide
gagaaagcctgcggaacctgcgcg

SEQ ID NO: 378231 - DNA, 24 bp, Artificial Sequence
  Description of Artificial Sequence: Synthetic oligonucleotide
agaaagcctgcggaacctgcgcgg

SEQ ID NO: 378232 - DNA, 23 bp, Artificial Sequence
  Description of Artificial Sequence: Synthetic oligonucleotide
gaaagcctgcggaacctgcgcgg

SEQ ID NO: 378233 - DNA, 25 bp, Artificial Sequence
  Description of Artificial Sequence: Synthetic oligonucleotide
aaagcctgcggaacctgcgcggcta

SEQ ID NO: 378234 - DNA, 24 bp, Artificial Sequence
  Description of Artificial Sequence: Synthetic oligonucleotide
aagcctgcggaacctgcgcggcta

SEQ ID NO: 378235 - DNA, 26 bp, Artificial Sequence
  Description of Artificial Sequence: Synthetic oligonucleotide
gagccccgcttcatcaccgtgggtta

SEQ ID NO: 378236 - DNA, 26 bp, Artificial Sequence
  Description of Artificial Sequence: Synthetic oligonucleotide
agccccgcttcatcaccgtgggttac

SEQ ID NO: 378237 - DNA, 25 bp, Artificial Sequence
  Description of Artificial Sequence: Synthetic oligonucleotide
gccccgcttcatcaccgtgggttac

SEQ ID NO: 378238 - DNA, 26 bp, Artificial Sequence
  Description of Artificial Sequence: Synthetic oligonucleotide
ccccgcttcatcaccgtgggttacgt

SEQ ID NO: 378239 - DNA, 26 bp, Artificial Sequence
  Description of Artificial Sequence: Synthetic oligonucleotide
cccgcttcatcaccgtgggttacgtg

SEQ ID NO: 378240 - DNA, 27 bp, Artificial Sequence
  Description of Artificial Sequence: Synthetic oligonucleotide
ccgcttcatcaccgtgggttacgtgga

SEQ ID NO: 378241 - DNA, 27 bp, Artificial Sequence
  Description of Artificial Sequence: Synthetic oligonucleotide
cgcttcatcaccgtgggttacgtggac

SEQ ID NO: 378242 - DNA, 27 bp, Artificial Sequence
  Description of Artificial Sequence: Synthetic oligonucleotide
gcttcatcaccgtgggttacgtggacg

SEQ ID NO: 378243 - DNA, 28 bp, Artificial Sequence
  Description of Artificial Sequence: Synthetic oligonucleotide
cttcatcaccgtgggttacgtggacgac

SEQ ID NO: 378244 - DNA, 29 bp, Artificial Sequence
  Description of Artificial Sequence: Synthetic oligonucleotide
ttcatcaccgtgggttacgtggacgacac

SEQ ID NO: 378245 - DNA, 28 bp, Artificial Sequence
  Description of Artificial Sequence: Synthetic oligonucleotide
tcatcaccgtgggttacgtggacgacac

SEQ ID NO: 378246 - DNA, 27 bp, Artificial Sequence
  Description of Artificial Sequence: Synthetic oligonucleotide
catcaccgtgggttacgtggacgacac

SEQ ID NO: 378247 - DNA, 27 bp, Artificial Sequence
  Description of Artificial Sequence: Synthetic oligonucleotide
atcaccgtgggttacgtggacgacacg

SEQ ID NO: 378248 - DNA, 26 bp, Artificial Sequence
  Description of Artificial Sequence: Synthetic oligonucleotide
tcaccgtgggttacgtggacgacacg

SEQ ID NO: 378249 - DNA, 25 bp, Artificial Sequence
  Description of Artificial Sequence: Synthetic oligonucleotide
caccgtgggttacgtggacgacacg

SEQ ID NO: 378250 - DNA, 26 bp, Artificial Sequence
  Description of Artificial Sequence: Synthetic oligonucleotide
accgtgggttacgtggacgacacgct

SEQ ID NO: 378251 - DNA, 25 bp, Artificial Sequence
  Description of Artificial Sequence: Synthetic oligonucleotide
ccgtgggttacgtggacgacacgct

SEQ ID NO: 378252 - DNA, 27 bp, Artificial Sequence
  Description of Artificial Sequence: Synthetic oligonucleotide
cgtgggttacgtggacgacacgctgtt

SEQ ID NO: 378253 - DNA, 27 bp, Artificial Sequence
  Description of Artificial Sequence: Synthetic oligonucleotide
gtgggttacgtggacgacacgctgttc

SEQ ID NO: 378254 - DNA, 27 bp, Artificial Sequence
  Description of Artificial Sequence: Synthetic oligonucleotide
tgggttacgtggacgacacgctgttcg

SEQ ID NO: 378255 - DNA, 27 bp, Artificial Sequence
  Description of Artificial Sequence: Synthetic oligonucleotide
gggttacgtggacgacacgctgttcgt

SEQ ID NO: 378256 - DNA, 27 bp, Artificial Sequence
  Description of Artificial Sequence: Synthetic oligonucleotide
ggttacgtggacgacacgctgttcgtg

SEQ ID NO: 378257 - DNA, 28 bp, Artificial Sequence
  Description of Artificial Sequence: Synthetic oligonucleotide
gttacgtggacgacacgctgttcgtgag

SEQ ID NO: 378258 - DNA, 28 bp, Artificial Sequence
  Description of Artificial Sequence: Synthetic oligonucleotide
ttacgtggacgacacgctgttcgtgagg

SEQ ID NO: 378259 - DNA, 26 bp, Artificial Sequence
  Description of Artificial Sequence: Synthetic oligonucleotide
gccgggtctcacaccctccagagaat

SEQ ID NO: 378260 - DNA, 27 bp, Artificial Sequence
  Description of Artificial Sequence: Synthetic oligonucleotide
ccgggtctcacaccctccagagaatgt

SEQ ID NO: 378261 - DNA, 28 bp, Artificial Sequence
  Description of Artificial Sequence: Synthetic oligonucleotide
cgggtctcacaccctccagagaatgtac

SEQ ID NO: 378262 - DNA, 28 bp, Artificial Sequence
  Description of Artificial Sequence: Synthetic oligonucleotide
gggtctcacaccctccagagaatgtacg

SEQ ID NO: 378263 - DNA, 28 bp, Artificial Sequence
  Description of Artificial Sequence: Synthetic oligonucleotide
ggtctcacaccctccagagaatgtacgg

SEQ ID NO: 378264 - DNA, 28 bp, Artificial Sequence
  Description of Artificial Sequence: Synthetic oligonucleotide
gtctcacaccctccagagaatgtacggc

SEQ ID NO: 378265 - DNA, 29 bp, Artificial Sequence
  Description of Artificial Sequence: Synthetic oligonucleotide
tctcacaccctccagagaatgtacggctg

SEQ ID NO: 378266 - DNA, 28 bp, Artificial Sequence
  Description of Artificial Sequence: Synthetic oligonucleotide
ctcacaccctccagagaatgtacggctg

SEQ ID NO: 378267 - DNA, 28 bp, Artificial Sequence
  Description of Artificial Sequence: Synthetic oligonucleotide
tcacaccctccagagaatgtacggctgc

SEQ ID NO: 378268 - DNA, 27 bp, Artificial Sequence
  Description of Artificial Sequence: Synthetic oligonucleotide
cacaccctccagagaatgtacggctgc

SEQ ID NO: 378269 - DNA, 27 bp, Artificial Sequence
  Description of Artificial Sequence: Synthetic oligonucleotide
acaccctccagagaatgtacggctgcg

SEQ ID NO: 378270 - DNA, 27 bp, Artificial Sequence
  Description of Artificial Sequence: Synthetic oligonucleotide
caccctccagagaatgtacggctgcga

SEQ ID NO: 378271 - DNA, 27 bp, Artificial Sequence
  Description of Artificial Sequence: Synthetic oligonucleotide
accctccagagaatgtacggctgcgac

SEQ ID NO: 378272 - DNA, 26 bp, Artificial Sequence
  Description of Artificial Sequence: Synthetic oligonucleotide
ccctccagagaatgtacggctgcgac

SEQ ID NO: 378273 - DNA, 27 bp, Artificial Sequence
  Description of Artificial Sequence: Synthetic oligonucleotide
cctccagagaatgtacggctgcgacgt

SEQ ID NO: 378274 - DNA, 27 bp, Artificial Sequence
  Description of Artificial Sequence: Synthetic oligonucleotide
ctccagagaatgtacggctgcgacgtg

SEQ ID NO: 378275 - DNA, 27 bp, Artificial Sequence
  Description of Artificial Sequence: Synthetic oligonucleotide
tccagagaatgtacggctgcgacgtgg

SEQ ID NO: 378276 - DNA, 26 bp, Artificial Sequence
  Description of Artificial Sequence: Synthetic oligonucleotide
ccagagaatgtacggctgcgacgtgg

SEQ ID NO: 378277 - DNA, 26 bp, Artificial Sequence
  Description of Artificial Sequence: Synthetic oligonucleotide
cagagaatgtacggctgcgacgtggg

SEQ ID NO: 378278 - DNA, 26 bp, Artificial Sequence
  Description of Artificial Sequence: Synthetic oligonucleotide
agagaatgtacggctgcgacgtgggg

SEQ ID NO: 378279 - DNA, 25 bp, Artificial Sequence
  Description of Artificial Sequence: Synthetic oligonucleotide
gagaatgtacggctgcgacgtgggg

SEQ ID NO: 378280 - DNA, 25 bp, Artificial Sequence
  Description of Artificial Sequence: Synthetic oligonucleotide
agaatgtacggctgcgacgtggggc

SEQ ID NO: 378281 - DNA, 24 bp, Artificial Sequence
  Description of Artificial Sequence: Synthetic oligonucleotide
gaatgtacggctgcgacgtggggc

SEQ ID NO: 378282 - DNA, 30 bp, Artificial Sequence
  Description of Artificial Sequence: Synthetic oligonucleotide
gctcccactccatgagatatttccacaccg

SEQ ID NO: 378283 - DNA, 30 bp, Artificial Sequence
  Description of Artificial Sequence: Synthetic oligonucleotide
ctcccactccatgagatatttccacaccgc

SEQ ID NO: 378284 - DNA, 30 bp, Artificial Sequence
  Description of Artificial Sequence: Synthetic oligonucleotide
tcccactccatgagatatttccacaccgcc

SEQ ID NO: 378285 - DNA, 29 bp, Artificial Sequence
  Description of Artificial Sequence: Synthetic oligonucleotide
cccactccatgagatatttccacaccgcc

SEQ ID NO: 378286 - DNA, 31 bp, Artificial Sequence
  Description of Artificial Sequence: Synthetic oligonucleotide
ccactccatgagatatttccacaccgccatg

SEQ ID NO: 378287 - DNA, 32 bp, Artificial Sequence
  Description of Artificial Sequence: Synthetic oligonucleotide
cactccatgagatatttccacaccgccatgtc

SEQ ID NO: 378288 - DNA, 32 bp, Artificial Sequence
  Description of Artificial Sequence: Synthetic oligonucleotide
actccatgagatatttccacaccgccatgtcc

SEQ ID NO: 378289 - DNA, 31 bp, Artificial Sequence
  Description of Artificial Sequence: Synthetic oligonucleotide
ctccatgagatatttccacaccgccatgtcc

SEQ ID NO: 378290 - DNA, 31 bp, Artificial Sequence
  Description of Artificial Sequence: Synthetic oligonucleotide
tccatgagatatttccacaccgccatgtccc

SEQ ID NO: 378291 - DNA, 30 bp, Artificial Sequence
  Description of Artificial Sequence: Synthetic oligonucleotide
ccatgagatatttccacaccgccatgtccc

SEQ ID NO: 378292 - DNA, 30 bp, Artificial Sequence
  Description of Artificial Sequence: Synthetic oligonucleotide
catgagatatttccacaccgccatgtcccg

SEQ ID NO: 378293 - DNA, 30 bp, Artificial Sequence
  Description of Artificial Sequence: Synthetic oligonucleotide
atgagatatttccacaccgccatgtcccgg

SEQ ID NO: 378294 - DNA, 29 bp, Artificial Sequence
  Description of Artificial Sequence: Synthetic oligonucleotide
tgagatatttccacaccgccatgtcccgg

SEQ ID NO: 378295 - DNA, 28 bp, Artificial Sequence
  Description of Artificial Sequence: Synthetic oligonucleotide
gagatatttccacaccgccatgtcccgg

SEQ ID NO: 378296 - DNA, 28 bp, Artificial Sequence
  Description of Artificial Sequence: Synthetic oligonucleotide
agatatttccacaccgccatgtcccggc

SEQ ID NO: 378297 - DNA, 27 bp, Artificial Sequence
  Description of Artificial Sequence: Synthetic oligonucleotide
gatatttccacaccgccatgtcccggc

SEQ ID NO: 378298 - DNA, 27 bp, Artificial Sequence
  Description of Artificial Sequence: Synthetic oligonucleotide
atatttccacaccgccatgtcccggcc

SEQ ID NO: 378299 - DNA, 24 bp, Artificial Sequence
  Description of Artificial Sequence: Synthetic oligonucleotide
gcggctcagatctcccagcgcaag

SEQ ID NO: 378300 - DNA, 25 bp, Artificial Sequence
  Description of Artificial Sequence: Synthetic oligonucleotide
cggctcagatctcccagcgcaagct

SEQ ID NO: 378301 - DNA, 25 bp, Artificial Sequence
  Description of Artificial Sequence: Synthetic oligonucleotide
ggctcagatctcccagcgcaagctg

SEQ ID NO: 378302 - DNA, 26 bp, Artificial Sequence
  Description of Artificial Sequence: Synthetic oligonucleotide
gctcagatctcccagcgcaagctgga

SEQ ID NO: 378303 - DNA, 26 bp, Artificial Sequence
  Description of Artificial Sequence: Synthetic oligonucleotide
ctcagatctcccagcgcaagctggag

SEQ ID NO: 378304 - DNA, 26 bp, Artificial Sequence
  Description of Artificial Sequence: Synthetic oligonucleotide
tcagatctcccagcgcaagctggagg

SEQ ID NO: 378305 - DNA, 25 bp, Artificial Sequence
  Description of Artificial Sequence: Synthetic oligonucleotide
cagatctcccagcgcaagctggagg

SEQ ID NO: 378306 - DNA, 25 bp, Artificial Sequence
  Description of Artificial Sequence: Synthetic oligonucleotide
agatctcccagcgcaagctggaggc

SEQ ID NO: 378307 - DNA, 24 bp, Artificial Sequence
  Description of Artificial Sequence: Synthetic oligonucleotide
gatctcccagcgcaagctggaggc

SEQ ID NO: 378308 - DNA, 24 bp, Artificial Sequence
  Description of Artificial Sequence: Synthetic oligonucleotide
atctcccagcgcaagctggaggcg

SEQ ID NO: 378309 - DNA, 23 bp, Artificial Sequence
  Description of Artificial Sequence: Synthetic oligonucleotide
tctcccagcgcaagctggaggcg

SEQ ID NO: 378310 - DNA, 22 bp, Artificial Sequence
  Description of Artificial Sequence: Synthetic oligonucleotide
ctcccagcgcaagctggaggcg

SEQ ID NO: 378311 - DNA, 22 bp, Artificial Sequence
  Description of Artificial Sequence: Synthetic oligonucleotide
tcccagcgcaagctggaggcgg

SEQ ID NO: 378312 - DNA, 21 bp, Artificial Sequence
  Description of Artificial Sequence: Synthetic oligonucleotide
cccagcgcaagctggaggcgg

SEQ ID NO: 378313 - DNA, 21 bp, Artificial Sequence
  Description of Artificial Sequence: Synthetic oligonucleotide
ccagcgcaagctggaggcggc

SEQ ID NO: 378314 - DNA, 21 bp, Artificial Sequence
  Description of Artificial Sequence: Synthetic oligonucleotide
cagcgcaagctggaggcggcc

SEQ ID NO: 378315 - DNA, 21 bp, Artificial Sequence
  Description of Artificial Sequence: Synthetic oligonucleotide
agcgcaagctggaggcggccc

SEQ ID NO: 378316 - DNA, 20 bp, Artificial Sequence
  Description of Artificial Sequence: Synthetic oligonucleotide
gcgcaagctggaggcggccc

SEQ ID NO: 378317 - DNA, 21 bp, Artificial Sequence
  Description of Artificial Sequence: Synthetic oligonucleotide
cgcaagctggaggcggcccgt

SEQ ID NO: 378318 - DNA, 22 bp, Artificial Sequence
  Description of Artificial Sequence: Synthetic oligonucleotide
gcaagctggaggcggcccgtgt

SEQ ID NO: 378319 - DNA, 22 bp, Artificial Sequence
  Description of Artificial Sequence: Synthetic oligonucleotide
caagctggaggcggcccgtgtg

SEQ ID NO: 378320 - DNA, 22 bp, Artificial Sequence
  Description of Artificial Sequence: Synthetic oligonucleotide
aagctggaggcggcccgtgtgg

SEQ ID NO: 378321 - DNA, 21 bp, Artificial Sequence
  Description of Artificial Sequence: Synthetic oligonucleotide
agctggaggcggcccgtgtgg

SEQ ID NO: 378322 - DNA, 20 bp, Artificial Sequence
  Description of Artificial Sequence: Synthetic oligonucleotide
gctggaggcggcccgtgtgg

SEQ ID NO: 378323 - DNA, 20 bp, Artificial Sequence
  Description of Artificial Sequence: Synthetic oligonucleotide
ctggaggcggcccgtgtggc

SEQ ID NO: 378324 - DNA, 20 bp, Artificial Sequence
  Description of Artificial Sequence: Synthetic oligonucleotide
acgtggggccggacggacgc

SEQ ID NO: 378325 - DNA, 20 bp, Artificial Sequence
  Description of Artificial Sequence: Synthetic oligonucleotide
cgtggggccggacggacgct

SEQ ID NO: 378326 - DNA, 20 bp, Artificial Sequence
  Description of Artificial Sequence: Synthetic oligonucleotide
gtggggccggacggacgcct

SEQ ID NO: 378327 - DNA, 20 bp, Artificial Sequence
  Description of Artificial Sequence: Synthetic oligonucleotide
tggggccggacggacgcctc

SEQ ID NO: 378328 - DNA, 20 bp, Artificial Sequence
  Description of Artificial Sequence: Synthetic oligonucleotide
ggggccggacggacgcctct

SEQ ID NO: 378329 - DNA, 20 bp, Artificial Sequence
  Description of Artificial Sequence: Synthetic oligonucleotide
gggccggacggacgcctcct

SEQ ID NO: 378330 - DNA, 20 bp, Artificial Sequence
  Description of Artificial Sequence: Synthetic oligonucleotide
ggccggacggacgcctcctc

SEQ ID NO: 378331 - DNA, 20 bp, Artificial Sequence
  Description of Artificial Sequence: Synthetic oligonucleotide
gccggacggacgcctcctcc

SEQ ID NO: 378332 - DNA, 20 bp, Artificial Sequence
  Description of Artificial Sequence: Synthetic oligonucleotide
ccggacggacgcctcctccg

SEQ ID NO: 378333 - DNA, 20 bp, Artificial Sequence
  Description of Artificial Sequence: Synthetic oligonucleotide
cggacggacgcctcctccgc

SEQ ID NO: 378334 - DNA, 20 bp, Artificial Sequence
  Description of Artificial Sequence: Synthetic oligonucleotide
ggacggacgcctcctccgcg

SEQ ID NO: 378335 - DNA, 20 bp, Artificial Sequence
  Description of Artificial Sequence: Synthetic oligonucleotide
gacggacgcctcctccgcgg

SEQ ID NO: 378336 - DNA, 20 bp, Artificial Sequence
  Description of Artificial Sequence: Synthetic oligonucleotide
acggacgcctcctccgcggg

SEQ ID NO: 378337 - DNA, 20 bp, Artificial Sequence
  Description of Artificial Sequence: Synthetic oligonucleotide
cggacgcctcctccgcgggt

SEQ ID NO: 378338 - DNA, 23 bp, Artificial Sequence
  Description of Artificial Sequence: Synthetic oligonucleotide
ggacgcctcctccgcgggcataa

SEQ ID NO: 378339 - DNA, 23 bp, Artificial Sequence
  Description of Artificial Sequence: Synthetic oligonucleotide
gacgcctcctccgcgggcataac

SEQ ID NO: 378340 - DNA, 24 bp, Artificial Sequence
  Description of Artificial Sequence: Synthetic oligonucleotide
acgcctcctccgcgggcataacca

SEQ ID NO: 378341 - DNA, 31 bp, Artificial Sequence
  Description of Artificial Sequence: Synthetic oligonucleotide
cagtacgcctacgacggcaaggattacattg

SEQ ID NO: 378342 - DNA, 31 bp, Artificial Sequence
  Description of Artificial Sequence: Synthetic oligonucleotide
agtacgcctacgacggcaaggattacattgc

SEQ ID NO: 378343 - DNA, 30 bp, Artificial Sequence
  Description of Artificial Sequence: Synthetic oligonucleotide
gtacgcctacgacggcaaggattacattgc

SEQ ID NO: 378344 - DNA, 30 bp, Artificial Sequence
  Description of Artificial Sequence: Synthetic oligonucleotide
tacgcctacgacggcaaggattacattgcc

SEQ ID NO: 378345 - DNA, 29 bp, Artificial Sequence
  Description of Artificial Sequence: Synthetic oligonucleotide
acgcctacgacggcaaggattacattgcc

SEQ ID NO: 378346 - DNA, 28 bp, Artificial Sequence
  Description of Artificial Sequence: Synthetic oligonucleotide
cgcctacgacggcaaggattacattgcc

SEQ ID NO: 378347 - DNA, 28 bp, Artificial Sequence
  Description of Artificial Sequence: Synthetic oligonucleotide
gcctacgacggcaaggattacattgccc

SEQ ID NO: 378348 - DNA, 29 bp, Artificial Sequence
  Description of Artificial Sequence: Synthetic oligonucleotide
cctacgacggcaaggattacattgccctg

SEQ ID NO: 378349 - DNA, 31 bp, Artificial Sequence
  Description of Artificial Sequence: Synthetic oligonucleotide
ctacgacggcaaggattacattgccctgaac

SEQ ID NO: 378350 - DNA, 31 bp, Artificial Sequence
  Description of Artificial Sequence: Synthetic oligonucleotide
tacgacggcaaggattacattgccctgaacg

SEQ ID NO: 378351 - DNA, 30 bp, Artificial Sequence
  Description of Artificial Sequence: Synthetic oligonucleotide
acgacggcaaggattacattgccctgaacg

SEQ ID NO: 378352 - DNA, 29 bp, Artificial Sequence
  Description of Artificial Sequence: Synthetic oligonucleotide
cgacggcaaggattacattgccctgaacg

SEQ ID NO: 378353 - DNA, 30 bp, Artificial Sequence
  Description of Artificial Sequence: Synthetic oligonucleotide
gacggcaaggattacattgccctgaacgag

SEQ ID NO: 378354 - DNA, 30 bp, Artificial Sequence
  Description of Artificial Sequence: Synthetic oligonucleotide
acggcaaggattacattgccctgaacgagg

SEQ ID NO: 378355 - DNA, 29 bp, Artificial Sequence
  Description of Artificial Sequence: Synthetic oligonucleotide
cggcaaggattacattgccctgaacgagg

SEQ ID NO: 378356 - DNA, 30 bp, Artificial Sequence
  Description of Artificial Sequence: Synthetic oligonucleotide
ggcaaggattacattgccctgaacgaggac

SEQ ID NO: 378357 - DNA, 30 bp, Artificial Sequence
  Description of Artificial Sequence: Synthetic oligonucleotide
gcaaggattacattgccctgaacgaggacc

SEQ ID NO: 378358 - DNA, 31 bp, Artificial Sequence
  Description of Artificial Sequence: Synthetic oligonucleotide
caaggattacattgccctgaacgaggacctg

SEQ ID NO: 378359 - DNA, 31 bp, Artificial Sequence
  Description of Artificial Sequence: Synthetic oligonucleotide
aaggattacattgccctgaacgaggacctgc

SEQ ID NO: 378360 - DNA, 30 bp, Artificial Sequence
  Description of Artificial Sequence: Synthetic oligonucleotide
aggattacattgccctgaacgaggacctgc

SEQ ID NO: 378361 - DNA, 29 bp, Artificial Sequence
  Description of Artificial Sequence: Synthetic oligonucleotide
ggattacattgccctgaacgaggacctgc

SEQ ID NO: 378362 - DNA, 29 bp, Artificial Sequence
  Description of Artificial Sequence: Synthetic oligonucleotide
gattacattgccctgaacgaggacctgcg

SEQ ID NO: 378363 - DNA, 29 bp, Artificial Sequence
  Description of Artificial Sequence: Synthetic oligonucleotide
attacattgccctgaacgaggacctgcgc

SEQ ID NO: 378364 - DNA, 28 bp, Artificial Sequence
  Description of Artificial Sequence: Synthetic oligonucleotide
ttacattgccctgaacgaggacctgcgc

SEQ ID NO: 378365 - DNA, 27 bp, Artificial Sequence
  Description of Artificial Sequence: Synthetic oligonucleotide
tacattgccctgaacgaggacctgcgc

SEQ ID NO: 378366 - DNA, 27 bp, Artificial Sequence
  Description of Artificial Sequence: Synthetic oligonucleotide
acattgccctgaacgaggacctgcgct

SEQ ID NO: 378367 - DNA, 26 bp, Artificial Sequence
  Description of Artificial Sequence: Synthetic oligonucleotide
cattgccctgaacgaggacctgcgct

SEQ ID NO: 378368 - DNA, 26 bp, Artificial Sequence
  Description of Artificial Sequence: Synthetic oligonucleotide
attgccctgaacgaggacctgcgctc

SEQ ID NO: 378369 - DNA, 25 bp, Artificial Sequence
  Description of Artificial Sequence: Synthetic oligonucleotide
ttgccctgaacgaggacctgcgctc

SEQ ID NO: 378370 - DNA, 24 bp, Artificial Sequence
  Description of Artificial Sequence: Synthetic oligonucleotide
tgccctgaacgaggacctgcgctc

SEQ ID NO: 378371 - DNA, 29 bp, Artificial Sequence
  Description of Artificial Sequence: Synthetic oligonucleotide
tccgcagatacctggaaaacgggaaggac

SEQ ID NO: 378372 - DNA, 28 bp, Artificial Sequence
  Description of Artificial Sequence: Synthetic oligonucleotide
ccgcagatacctggaaaacgggaaggac

SEQ ID NO: 378373 - DNA, 30 bp, Artificial Sequence
  Description of Artificial Sequence: Synthetic oligonucleotide
cgcagatacctggaaaacgggaaggacaag

SEQ ID NO: 378374 - DNA, 30 bp, Artificial Sequence
  Description of Artificial Sequence: Synthetic oligonucleotide
gcagatacctggaaaacgggaaggacaagc

SEQ ID NO: 378375 - DNA, 31 bp, Artificial Sequence
  Description of Artificial Sequence: Synthetic oligonucleotide
cagatacctggaaaacgggaaggacaagctg

SEQ ID NO: 378376 - DNA, 31 bp, Artificial Sequence
  Description of Artificial Sequence: Synthetic oligonucleotide
agatacctggaaaacgggaaggacaagctgg

SEQ ID NO: 378377 - DNA, 30 bp, Artificial Sequence
  Description of Artificial Sequence: Synthetic oligonucleotide
gatacctggaaaacgggaaggacaagctgg

SEQ ID NO: 378378 - DNA, 31 bp, Artificial Sequence
  Description of Artificial Sequence: Synthetic oligonucleotide
atacctggaaaacgggaaggacaagctggag

SEQ ID NO: 378379 - DNA, 30 bp, Artificial Sequence
  Description of Artificial Sequence: Synthetic oligonucleotide
tacctggaaaacgggaaggacaagctggag

SEQ ID NO: 378380 - DNA, 29 bp, Artificial Sequence
  Description of Artificial Sequence: Synthetic oligonucleotide
acctggaaaacgggaaggacaagctggag

SEQ ID NO: 378381 - DNA, 28 bp, Artificial Sequence
  Description of Artificial Sequence: Synthetic oligonucleotide
cctggaaaacgggaaggacaagctggag

SEQ ID NO: 378382 - DNA, 28 bp, Artificial Sequence
  Description of Artificial Sequence: Synthetic oligonucleotide
ctggaaaacgggaaggacaagctggagc

SEQ ID NO: 378383 - DNA, 28 bp, Artificial Sequence
  Description of Artificial Sequence: Synthetic oligonucleotide
tggaaaacgggaaggacaagctggagcg

SEQ ID NO: 378384 - DNA, 27 bp, Artificial Sequence
  Description of Artificial Sequence: Synthetic oligonucleotide
ggaaaacgggaaggacaagctggagcg

SEQ ID NO: 378385 - DNA, 27 bp, Artificial Sequence
  Description of Artificial Sequence: Synthetic oligonucleotide
gaaaacgggaaggacaagctggagcgc

SEQ ID NO: 378386 - DNA, 27 bp, Artificial Sequence
  Description of Artificial Sequence: Synthetic oligonucleotide
aaaacgggaaggacaagctggagcgcg

SEQ ID NO: 378387 - DNA, 26 bp, Artificial Sequence
  Description of Artificial Sequence: Synthetic oligonucleotide
aaacgggaaggacaagctggagcgcg

SEQ ID NO: 378388 - DNA, 27 bp, Artificial Sequence
  Description of Artificial Sequence: Synthetic oligonucleotide
cgcttcatcaccgtgggctacgtggat

SEQ ID NO: 378389 - DNA, 27 bp, Artificial Sequence
  Description of Artificial Sequence: Synthetic oligonucleotide
gcttcatcaccgtgggctacgtggatg

SEQ ID NO: 378390 - DNA, 28 bp, Artificial Sequence
  Description of Artificial Sequence: Synthetic oligonucleotide
cttcatcaccgtgggctacgtggatgac

SEQ ID NO: 378391 - DNA, 29 bp, Artificial Sequence
  Description of Artificial Sequence: Synthetic oligonucleotide
ttcatcaccgtgggctacgtggatgacac

SEQ ID NO: 378392 - DNA, 28 bp, Artificial Sequence
  Description of Artificial Sequence: Synthetic oligonucleotide
tcatcaccgtgggctacgtggatgacac

SEQ ID NO: 378393 - DNA, 27 bp, Artificial Sequence
  Description of Artificial Sequence: Synthetic oligonucleotide
catcaccgtgggctacgtggatgacac

SEQ ID NO: 378394 - DNA, 27 bp, Artificial Sequence
  Description of Artificial Sequence: Synthetic oligonucleotide
atcaccgtgggctacgtggatgacacg

SEQ ID NO: 378395 - DNA, 26 bp, Artificial Sequence
  Description of Artificial Sequence: Synthetic oligonucleotide
tcaccgtgggctacgtggatgacacg

SEQ ID NO: 378396 - DNA, 25 bp, Artificial Sequence
  Description of Artificial Sequence: Synthetic oligonucleotide
caccgtgggctacgtggatgacacg

SEQ ID NO: 378397 - DNA, 26 bp, Artificial Sequence
  Description of Artificial Sequence: Synthetic oligonucleotide
accgtgggctacgtggatgacacgct

SEQ ID NO: 378398 - DNA, 25 bp, Artificial Sequence
  Description of Artificial Sequence: Synthetic oligonucleotide
ccgtgggctacgtggatgacacgct

SEQ ID NO: 378399 - DNA, 27 bp, Artificial Sequence
  Description of Artificial Sequence: Synthetic oligonucleotide
cgtgggctacgtggatgacacgctgtt

SEQ ID NO: 378400 - DNA, 27 bp, Artificial Sequence
  Description of Artificial Sequence: Synthetic oligonucleotide
gtgggctacgtggatgacacgctgttc

SEQ ID NO: 378401 - DNA, 27 bp, Artificial Sequence
  Description of Artificial Sequence: Synthetic oligonucleotide
tgggctacgtggatgacacgctgttcg

SEQ ID NO: 378402 - DNA, 27 bp, Artificial Sequence
  Description of Artificial Sequence: Synthetic oligonucleotide
gggctacgtggatgacacgctgttcgt

SEQ ID NO: 378403 - DNA, 27 bp, Artificial Sequence
  Description of Artificial Sequence: Synthetic oligonucleotide
ggctacgtggatgacacgctgttcgtg

SEQ ID NO: 378404 - DNA, 28 bp, Artificial Sequence
  Description of Artificial Sequence: Synthetic oligonucleotide
gctacgtggatgacacgctgttcgtgag

SEQ ID NO: 378405 - DNA, 28 bp, Artificial Sequence
  Description of Artificial Sequence: Synthetic oligonucleotide
ctacgtggatgacacgctgttcgtgagg

SEQ ID NO: 378406 - DNA, 30 bp, Artificial Sequence; identical to SEQ ID NO: 34288
  Description of Artificial Sequence: Synthetic oligonucleotide

SEQ ID NO: 378407 - DNA, 29 bp, Artificial Sequence
  Description of Artificial Sequence: Synthetic oligonucleotide
acgtggatgacacgctgttcgtgaggttc

SEQ ID NO: 378408 - DNA, 28 bp, Artificial Sequence
  Description of Artificial Sequence: Synthetic oligonucleotide
cgtggatgacacgctgttcgtgaggttc

SEQ ID NO: 378409 - DNA, 28 bp, Artificial Sequence
  Description of Artificial Sequence: Synthetic oligonucleotide
gtggatgacacgctgttcgtgaggttcg

SEQ ID NO: 378410 - DNA, 29 bp, Artificial Sequence
  Description of Artificial Sequence: Synthetic oligonucleotide
tggatgacacgctgttcgtgaggttcgac

SEQ ID NO: 378411 - DNA, 28 bp, Artificial Sequence
  Description of Artificial Sequence: Synthetic oligonucleotide
ggatgacacgctgttcgtgaggttcgac

SEQ ID NO: 378412 - DNA, 29 bp, Artificial Sequence
  Description of Artificial Sequence: Synthetic oligonucleotide
gatgacacgctgttcgtgaggttcgacag

SEQ ID NO: 378413 - DNA, 29 bp, Artificial Sequence
  Description of Artificial Sequence: Synthetic oligonucleotide
atgacacgctgttcgtgaggttcgacagc

SEQ ID NO: 378414 - DNA, 28 bp, Artificial Sequence
  Description of Artificial Sequence: Synthetic oligonucleotide
tgacacgctgttcgtgaggttcgacagc

SEQ ID NO: 378415 - DNA, 29 bp, Artificial Sequence
  Description of Artificial Sequence: Synthetic oligonucleotide
agtattgggaccgggagacacagatctcg

SEQ ID NO: 378416 - DNA, 28 bp, Artificial Sequence
  Description of Artificial Sequence: Synthetic oligonucleotide
gtattgggaccgggagacacagatctcg

SEQ ID NO: 378417 - DNA, 30 bp, Artificial Sequence; identical to SEQ ID NO: 34299
  Description of Artificial Sequence: Synthetic oligonucleotide

SEQ ID NO: 378418 - DNA, 29 bp, Artificial Sequence
  Description of Artificial Sequence: Synthetic oligonucleotide
attgggaccgggagacacagatctcgaag

SEQ ID NO: 378419 - DNA, 28 bp, Artificial Sequence
  Description of Artificial Sequence: Synthetic oligonucleotide
ttgggaccgggagacacagatctcgaag

SEQ ID NO: 378420 - DNA, 27 bp, Artificial Sequence
  Description of Artificial Sequence: Synthetic oligonucleotide
tgggaccgggagacacagatctcgaag

SEQ ID NO: 378421 - DNA, 27 bp, Artificial Sequence
  Description of Artificial Sequence: Synthetic oligonucleotide
gggaccgggagacacagatctcgaaga

SEQ ID NO: 378422 - DNA, 27 bp, Artificial Sequence
  Description of Artificial Sequence: Synthetic oligonucleotide
ggaccgggagacacagatctcgaagac

SEQ ID NO: 378423 - DNA, 27 bp, Artificial Sequence
  Description of Artificial Sequence: Synthetic oligonucleotide
gaccgggagacacagatctcgaagacc

SEQ ID NO: 378424 - DNA, 29 bp, Artificial Sequence
  Description of Artificial Sequence: Synthetic oligonucleotide
accgggagacacagatctcgaagaccaac

SEQ ID NO: 378425 - DNA, 28 bp, Artificial Sequence
  Description of Artificial Sequence: Synthetic oligonucleotide
ccgggagacacagatctcgaagaccaac

SEQ ID NO: 378426 - DNA, 29 bp, Artificial Sequence
  Description of Artificial Sequence: Synthetic oligonucleotide
cgggagacacagatctcgaagaccaacac

SEQ ID NO: 378427 - DNA, 30 bp, Artificial Sequence; identical to SEQ ID NO: 34309
  Description of Artificial Sequence: Synthetic oligonucleotide

SEQ ID NO: 378428 - DNA, 31 bp, Artificial Sequence; identical to SEQ ID NO: 34310
  Description of Artificial Sequence: Synthetic oligonucleotide

SEQ ID NO: 378429 - DNA, 32 bp, Artificial Sequence; identical to SEQ ID NO: 34311
  Description of Artificial Sequence: Synthetic oligonucleotide

SEQ ID NO: 378430 - DNA, 35 bp, Artificial Sequence; identical to SEQ ID NO: 34312
  Description of Artificial Sequence: Synthetic oligonucleotide

SEQ ID NO: 378431 - DNA, 34 bp, Artificial Sequence; identical to SEQ ID NO: 34313
  Description of Artificial Sequence: Synthetic oligonucleotide

SEQ ID NO: 378432 - DNA, 34 bp, Artificial Sequence; identical to SEQ ID NO: 34314
  Description of Artificial Sequence: Synthetic oligonucleotide

SEQ ID NO: 378433 - DNA, 33 bp, Artificial Sequence; identical to SEQ ID NO: 34315
  Description of Artificial Sequence: Synthetic oligonucleotide

SEQ ID NO: 378434 - DNA, 33 bp, Artificial Sequence; identical to SEQ ID NO: 34316
  Description of Artificial Sequence: Synthetic oligonucleotide

SEQ ID NO: 378435 - DNA, 32 bp, Artificial Sequence; identical to SEQ ID NO: 34317
  Description of Artificial Sequence: Synthetic oligonucleotide

SEQ ID NO: 378436 - DNA, 33 bp, Artificial Sequence; identical to SEQ ID NO: 34318
  Description of Artificial Sequence: Synthetic oligonucleotide

SEQ ID NO: 378437 - DNA, 32 bp, Artificial Sequence; identical to SEQ ID NO: 34319
  Description of Artificial Sequence: Synthetic oligonucleotide

SEQ ID NO: 378438 - DNA, 33 bp, Artificial Sequence; identical to SEQ ID NO: 34320
  Description of Artificial Sequence: Synthetic oligonucleotide

SEQ ID NO: 378439 - DNA, 32 bp, Artificial Sequence; identical to SEQ ID NO: 34321
  Description of Artificial Sequence: Synthetic oligonucleotide

SEQ ID NO: 378440 - DNA, 31 bp, Artificial Sequence; identical to SEQ ID NO: 34322
  Description of Artificial Sequence: Synthetic oligonucleotide

SEQ ID NO: 378441 - DNA, 32 bp, Artificial Sequence; identical to SEQ ID NO: 34323
  Description of Artificial Sequence: Synthetic oligonucleotide

SEQ ID NO: 378442 - DNA, 31 bp, Artificial Sequence; identical to SEQ ID NO: 34324
  Description of Artificial Sequence: Synthetic oligonucleotide

SEQ ID NO: 378443 - DNA, 31 bp, Artificial Sequence; identical to SEQ ID NO: 34325
  Description of Artificial Sequence: Synthetic oligonucleotide

SEQ ID NO: 378444 - DNA, 24 bp, Artificial Sequence
  Description of Artificial Sequence: Synthetic oligonucleotide
cgtgggctacgtggacgacaccct

SEQ ID NO: 378445 - DNA, 26 bp, Artificial Sequence
  Description of Artificial Sequence: Synthetic oligonucleotide
gtgggctacgtggacgacaccctgtt

SEQ ID NO: 378446 - DNA, 26 bp, Artificial Sequence
  Description of Artificial Sequence: Synthetic oligonucleotide
tgggctacgtggacgacaccctgttc

SEQ ID NO: 378447 - DNA, 25 bp, Artificial Sequence
  Description of Artificial Sequence: Synthetic oligonucleotide
gggctacgtggacgacaccctgttc

SEQ ID NO: 378448 - DNA, 26 bp, Artificial Sequence
  Description of Artificial Sequence: Synthetic oligonucleotide
ggctacgtggacgacaccctgttcgt

SEQ ID NO: 378449 - DNA, 27 bp, Artificial Sequence
  Description of Artificial Sequence: Synthetic oligonucleotide
gctacgtggacgacaccctgttcgtga

SEQ ID NO: 378450 - DNA, 27 bp, Artificial Sequence
  Description of Artificial Sequence: Synthetic oligonucleotide
ctacgtggacgacaccctgttcgtgag

SEQ ID NO: 378451 - DNA, 27 bp, Artificial Sequence
  Description of Artificial Sequence: Synthetic oligonucleotide
tacgtggacgacaccctgttcgtgagg

SEQ ID NO: 378452 - DNA, 27 bp, Artificial Sequence
  Description of Artificial Sequence: Synthetic oligonucleotide
acgtggacgacaccctgttcgtgaggt

SEQ ID NO: 378453 - DNA, 27 bp, Artificial Sequence
  Description of Artificial Sequence: Synthetic oligonucleotide
cgtggacgacaccctgttcgtgaggtt

SEQ ID NO: 378454 - DNA, 27 bp, Artificial Sequence
  Description of Artificial Sequence: Synthetic oligonucleotide
gtggacgacaccctgttcgtgaggttc

SEQ ID NO: 378455 - DNA, 27 bp, Artificial Sequence
  Description of Artificial Sequence: Synthetic oligonucleotide
tggacgacaccctgttcgtgaggttcg

SEQ ID NO: 378456 - DNA, 27 bp, Artificial Sequence
  Description of Artificial Sequence: Synthetic oligonucleotide
ggacgacaccctgttcgtgaggttcga

SEQ ID NO: 378457 - DNA, 27 bp, Artificial Sequence
  Description of Artificial Sequence: Synthetic oligonucleotide
gacgacaccctgttcgtgaggttcgac

SEQ ID NO: 378458 - DNA, 28 bp, Artificial Sequence
  Description of Artificial Sequence: Synthetic oligonucleotide
acgacaccctgttcgtgaggttcgacag

SEQ ID NO: 378459 - DNA, 27 bp, Artificial Sequence
  Description of Artificial Sequence: Synthetic oligonucleotide
cgacaccctgttcgtgaggttcgacag

SEQ ID NO: 378460 - DNA, 27 bp, Artificial Sequence
  Description of Artificial Sequence: Synthetic oligonucleotide
gacaccctgttcgtgaggttcgacagc

SEQ ID NO: 378461 - DNA, 27 bp, Artificial Sequence
  Description of Artificial Sequence: Synthetic oligonucleotide
acaccctgttcgtgaggttcgacagcg

SEQ ID NO: 378462 - DNA, 27 bp, Artificial Sequence
  Description of Artificial Sequence: Synthetic oligonucleotide
caccctgttcgtgaggttcgacagcga

SEQ ID NO: 378463 - DNA, 27 bp, Artificial Sequence
  Description of Artificial Sequence: Synthetic oligonucleotide
accctgttcgtgaggttcgacagcgac

SEQ ID NO: 378464 - DNA, 26 bp, Artificial Sequence
  Description of Artificial Sequence: Synthetic oligonucleotide
ccctgttcgtgaggttcgacagcgac

SEQ ID NO: 378465 - DNA, 26 bp, Artificial Sequence
  Description of Artificial Sequence: Synthetic oligonucleotide
cctgttcgtgaggttcgacagcgacg

SEQ ID NO: 378466 - DNA, 27 bp, Artificial Sequence
  Description of Artificial Sequence: Synthetic oligonucleotide
ttcgtgaggttcgacagcgacgccaca

SEQ ID NO: 378467 - DNA, 27 bp, Artificial Sequence
  Description of Artificial Sequence: Synthetic oligonucleotide
tcgtgaggttcgacagcgacgccacaa

SEQ ID NO: 378468 - DNA, 26 bp, Artificial Sequence
  Description of Artificial Sequence: Synthetic oligonucleotide
cgtgaggttcgacagcgacgccacaa

SEQ ID NO: 378469 - DNA, 27 bp, Artificial Sequence
  Description of Artificial Sequence: Synthetic oligonucleotide
gtgaggttcgacagcgacgccacaagt

SEQ ID NO: 378470 - DNA, 27 bp, Artificial Sequence
  Description of Artificial Sequence: Synthetic oligonucleotide
tgaggttcgacagcgacgccacaagtc

SEQ ID NO: 378471 - DNA, 26 bp, Artificial Sequence
  Description of Artificial Sequence: Synthetic oligonucleotide
gaggttcgacagcgacgccacaagtc

SEQ ID NO: 378472 - DNA, 26 bp, Artificial Sequence
  Description of Artificial Sequence: Synthetic oligonucleotide
aggttcgacagcgacgccacaagtcc

SEQ ID NO: 378473 - DNA, 25 bp, Artificial Sequence
  Description of Artificial Sequence: Synthetic oligonucleotide
ggttcgacagcgacgccacaagtcc

SEQ ID NO: 378474 - DNA, 26 bp, Artificial Sequence
  Description of Artificial Sequence: Synthetic oligonucleotide
gttcgacagcgacgccacaagtccga

SEQ ID NO: 378475 - DNA, 26 bp, Artificial Sequence
  Description of Artificial Sequence: Synthetic oligonucleotide
ttcgacagcgacgccacaagtccgag

SEQ ID NO: 378476 - DNA, 25 bp, Artificial Sequence
  Description of Artificial Sequence: Synthetic oligonucleotide
tcgacagcgacgccacaagtccgag

SEQ ID NO: 378477 - DNA, 24 bp, Artificial Sequence
  Description of Artificial Sequence: Synthetic oligonucleotide
cgacagcgacgccacaagtccgag

SEQ ID NO: 378478 - DNA, 26 bp, Artificial Sequence
  Description of Artificial Sequence: Synthetic oligonucleotide
gacagcgacgccacaagtccgaggaa

SEQ ID NO: 378479 - DNA, 26 bp, Artificial Sequence
  Description of Artificial Sequence: Synthetic oligonucleotide
acagcgacgccacaagtccgaggaag

SEQ ID NO: 378480 - DNA, 25 bp, Artificial Sequence
  Description of Artificial Sequence: Synthetic oligonucleotide
cagcgacgccacaagtccgaggaag

SEQ ID NO: 378481 - DNA, 26 bp, Artificial Sequence
  Description of Artificial Sequence: Synthetic oligonucleotide
agcgacgccacaagtccgaggaagga

SEQ ID NO: 378482 - DNA, 25 bp, Artificial Sequence
  Description of Artificial Sequence: Synthetic oligonucleotide
gcgacgccacaagtccgaggaagga

SEQ ID NO: 378483 - DNA, 25 bp, Artificial Sequence
  Description of Artificial Sequence: Synthetic oligonucleotide
cgacgccacaagtccgaggaaggag

SEQ ID NO: 378484 - DNA, 25 bp, Artificial Sequence
  Description of Artificial Sequence: Synthetic oligonucleotide
gacgccacaagtccgaggaaggagc

SEQ ID NO: 378485 - DNA, 25 bp, Artificial Sequence
  Description of Artificial Sequence: Synthetic oligonucleotide
acgccacaagtccgaggaaggagcc

SEQ ID NO: 378486 - DNA, 24 bp, Artificial Sequence
  Description of Artificial Sequence: Synthetic oligonucleotide
cgccacaagtccgaggaaggagcc

SEQ ID NO: 378487 - DNA, 24 bp, Artificial Sequence
  Description of Artificial Sequence: Synthetic oligonucleotide
gccacaagtccgaggaaggagccg

SEQ ID NO: 378488 - DNA, 24 bp, Artificial Sequence
  Description of Artificial Sequence: Synthetic oligonucleotide
ccacaagtccgaggaaggagccgc

SEQ ID NO: 378489 - DNA, 24 bp, Artificial Sequence
  Description of Artificial Sequence: Synthetic oligonucleotide
cacaagtccgaggaaggagccgcg

SEQ ID NO: 378490 - DNA, 24 bp, Artificial Sequence
  Description of Artificial Sequence: Synthetic oligonucleotide
acaagtccgaggaaggagccgcgg

SEQ ID NO: 378491 - DNA, 23 bp, Artificial Sequence
  Description of Artificial Sequence: Synthetic oligonucleotide
caagtccgaggaaggagccgcgg

SEQ ID NO: 378492 - DNA, 23 bp, Artificial Sequence
  Description of Artificial Sequence: Synthetic oligonucleotide
aagtccgaggaaggagccgcggg

SEQ ID NO: 378493 - DNA, 22 bp, Artificial Sequence
  Description of Artificial Sequence: Synthetic oligonucleotide
ctcctggaccgccgcggacaca

SEQ ID NO: 378494 - DNA, 22 bp, Artificial Sequence
  Description of Artificial Sequence: Synthetic oligonucleotide
tcctggaccgccgcggacacag

SEQ ID NO: 378495 - DNA, 21 bp, Artificial Sequence
  Description of Artificial Sequence: Synthetic oligonucleotide
cctggaccgccgcggacacag

SEQ ID NO: 378496 - DNA, 21 bp, Artificial Sequence
  Description of Artificial Sequence: Synthetic oligonucleotide
ctggaccgccgcggacacagc

SEQ ID NO: 378497 - DNA, 21 bp, Artificial Sequence
  Description of Artificial Sequence: Synthetic oligonucleotide
tggaccgccgcggacacagcg

SEQ ID NO: 378498 - DNA, 20 bp, Artificial Sequence
  Description of Artificial Sequence: Synthetic oligonucleotide
ggaccgccgcggacacagcg

SEQ ID NO: 378499 - DNA, 20 bp, Artificial Sequence
  Description of Artificial Sequence: Synthetic oligonucleotide
gaccgccgcggacacagcgg

SEQ ID NO: 378500 - DNA, 21 bp, Artificial Sequence
  Description of Artificial Sequence: Synthetic oligonucleotide
accgccgcggacacagcggct

SEQ ID NO: 378501 - DNA, 20 bp, Artificial Sequence
  Description of Artificial Sequence: Synthetic oligonucleotide
ccgccgcggacacagcggct

SEQ ID NO: 378502 - DNA, 21 bp, Artificial Sequence
  Description of Artificial Sequence: Synthetic oligonucleotide
cgccgcggacacagcggctca

SEQ ID NO: 378503 - DNA, 23 bp, Artificial Sequence
  Description of Artificial Sequence: Synthetic oligonucleotide
gccgcggacacagcggctcagat

SEQ ID NO: 378504 - DNA, 24 bp, Artificial Sequence
  Description of Artificial Sequence: Synthetic oligonucleotide
ccgcggacacagcggctcagatca

SEQ ID NO: 378505 - DNA, 24 bp, Artificial Sequence
  Description of Artificial Sequence: Synthetic oligonucleotide
cgcggacacagcggctcagatcac

SEQ ID NO: 378506 - DNA, 24 bp, Artificial Sequence
  Description of Artificial Sequence: Synthetic oligonucleotide
gcggacacagcggctcagatcacc

SEQ ID NO: 378507 - DNA, 25 bp, Artificial Sequence
  Description of Artificial Sequence: Synthetic oligonucleotide
cggacacagcggctcagatcaccca

SEQ ID NO: 378508 - DNA, 25 bp, Artificial Sequence
  Description of Artificial Sequence: Synthetic oligonucleotide
ggacacagcggctcagatcacccag

SEQ ID NO: 378509 - DNA, 25 bp, Artificial Sequence
  Description of Artificial Sequence: Synthetic oligonucleotide
gacacagcggctcagatcacccagc

SEQ ID NO: 378510 - DNA, 25 bp, Artificial Sequence
  Description of Artificial Sequence: Synthetic oligonucleotide
acacagcggctcagatcacccagcg

SEQ ID NO: 378511 - DNA, 24 bp, Artificial Sequence
  Description of Artificial Sequence: Synthetic oligonucleotide
cacagcggctcagatcacccagcg

SEQ ID NO: 378512 - DNA, 26 bp, Artificial Sequence
  Description of Artificial Sequence: Synthetic oligonucleotide
acagcggctcagatcacccagcgcaa

SEQ ID NO: 378513 - DNA, 25 bp, Artificial Sequence
  Description of Artificial Sequence: Synthetic oligonucleotide
cagcggctcagatcacccagcgcaa

SEQ ID NO: 378514 - DNA, 26 bp, Artificial Sequence
  Description of Artificial Sequence: Synthetic oligonucleotide
agcggctcagatcacccagcgcaagt

SEQ ID NO: 378515 - DNA, 28 bp, Artificial Sequence
  Description of Artificial Sequence: Synthetic oligonucleotide
gggtctcacaccctccagagcatgtatg

SEQ ID NO: 378516 - DNA, 28 bp, Artificial Sequence
  Description of Artificial Sequence: Synthetic oligonucleotide
ggtctcacaccctccagagcatgtatgg

SEQ ID NO: 378517 - DNA, 28 bp, Artificial Sequence
  Description of Artificial Sequence: Synthetic oligonucleotide
gtctcacaccctccagagcatgtatggc

SEQ ID NO: 378518 - DNA, 29 bp, Artificial Sequence
  Description of Artificial Sequence: Synthetic oligonucleotide
tctcacaccctccagagcatgtatggctg

SEQ ID NO: 378519 - DNA, 28 bp, Artificial Sequence
  Description of Artificial Sequence: Synthetic oligonucleotide
ctcacaccctccagagcatgtatggctg

SEQ ID NO: 378520 - DNA, 28 bp, Artificial Sequence
  Description of Artificial Sequence: Synthetic oligonucleotide
tcacaccctccagagcatgtatggctgc

SEQ ID NO: 378521 - DNA, 27 bp, Artificial Sequence
  Description of Artificial Sequence: Synthetic oligonucleotide
cacaccctccagagcatgtatggctgc

SEQ ID NO: 378522 - DNA, 27 bp, Artificial Sequence
  Description of Artificial Sequence: Synthetic oligonucleotide
acaccctccagagcatgtatggctgcg

SEQ ID NO: 378523 - DNA, 27 bp, Artificial Sequence
  Description of Artificial Sequence: Synthetic oligonucleotide
caccctccagagcatgtatggctgcga

SEQ ID NO: 378524 - DNA, 27 bp, Artificial Sequence
  Description of Artificial Sequence: Synthetic oligonucleotide
accctccagagcatgtatggctgcgac

SEQ ID NO: 378525 - DNA, 26 bp, Artificial Sequence
  Description of Artificial Sequence: Synthetic oligonucleotide
ccctccagagcatgtatggctgcgac

SEQ ID NO: 378526 - DNA, 27 bp, Artificial Sequence
  Description of Artificial Sequence: Synthetic oligonucleotide
cctccagagcatgtatggctgcgacgt

SEQ ID NO: 378527 - DNA, 27 bp, Artificial Sequence
  Description of Artificial Sequence: Synthetic oligonucleotide
ctccagagcatgtatggctgcgacgtg

SEQ ID NO: 378528 - DNA, 27 bp, Artificial Sequence
  Description of Artificial Sequence: Synthetic oligonucleotide
tccagagcatgtatggctgcgacgtgg

SEQ ID NO: 378529 - DNA, 26 bp, Artificial Sequence
  Description of Artificial Sequence: Synthetic oligonucleotide
ccagagcatgtatggctgcgacgtgg

SEQ ID NO: 378530 - DNA, 26 bp, Artificial Sequence
  Description of Artificial Sequence: Synthetic oligonucleotide
cagagcatgtatggctgcgacgtggg

SEQ ID NO: 378531 - DNA, 26 bp, Artificial Sequence
  Description of Artificial Sequence: Synthetic oligonucleotide
agagcatgtatggctgcgacgtgggg

SEQ ID NO: 378532 - DNA, 25 bp, Artificial Sequence
  Description of Artificial Sequence: Synthetic oligonucleotide
gagcatgtatggctgcgacgtgggg

SEQ ID NO: 378533 - DNA, 25 bp, Artificial Sequence
  Description of Artificial Sequence: Synthetic oligonucleotide
agcatgtatggctgcgacgtggggc

SEQ ID NO: 378534 - DNA, 24 bp, Artificial Sequence
  Description of Artificial Sequence: Synthetic oligonucleotide
gcatgtatggctgcgacgtggggc

SEQ ID NO: 378535 - DNA, 24 bp, Artificial Sequence
  Description of Artificial Sequence: Synthetic oligonucleotide
catgtatggctgcgacgtggggcc

SEQ ID NO: 378536 - DNA, 20 bp, Artificial Sequence
  Description of Artificial Sequence: Synthetic oligonucleotide
gccggacgggcgcctcctgt

SEQ ID NO: 378537 - DNA, 20 bp, Artificial Sequence
  Description of Artificial Sequence: Synthetic oligonucleotide
ccggacgggcgcctcctgct

SEQ ID NO: 378538 - DNA, 20 bp, Artificial Sequence
  Description of Artificial Sequence: Synthetic oligonucleotide
cggacgggcgcctcctgcgt

SEQ ID NO: 378539 - DNA, 20 bp, Artificial Sequence
  Description of Artificial Sequence: Synthetic oligonucleotide
ggacgggcgcctcctgcgct

SEQ ID NO: 378540 - DNA, 20 bp, Artificial Sequence
  Description of Artificial Sequence: Synthetic oligonucleotide
gacgggcgcctcctgcgcgt

SEQ ID NO: 378541 - DNA, 20 bp, Artificial Sequence
  Description of Artificial Sequence: Synthetic oligonucleotide
acgggcgcctcctgcgcggt

SEQ ID NO: 378542 - DNA, 20 bp, Artificial Sequence
  Description of Artificial Sequence: Synthetic oligonucleotide
cgggcgcctcctgcgcggtt

SEQ ID NO: 378543 - DNA, 20 bp, Artificial Sequence
  Description of Artificial Sequence: Synthetic oligonucleotide
gggcgcctcctgcgcgggtt

SEQ ID NO: 378544 - DNA, 22 bp, Artificial Sequence
  Description of Artificial Sequence: Synthetic oligonucleotide
ggcgcctcctgcgcgggcataa

SEQ ID NO: 378545 - DNA, 22 bp, Artificial Sequence
  Description of Artificial Sequence: Synthetic oligonucleotide
gcgcctcctgcgcgggcataac

SEQ ID NO: 378546 - DNA, 23 bp, Artificial Sequence
  Description of Artificial Sequence: Synthetic oligonucleotide
cgcctcctgcgcgggcataacca

SEQ ID NO: 378547 - DNA, 25 bp, Artificial Sequence
  Description of Artificial Sequence: Synthetic oligonucleotide
gcctcctgcgcgggcataaccagta

SEQ ID NO: 378548 - DNA, 25 bp, Artificial Sequence
  Description of Artificial Sequence: Synthetic oligonucleotide
cctcctgcgcgggcataaccagtac

SEQ ID NO: 378549 - DNA, 25 bp, Artificial Sequence
  Description of Artificial Sequence: Synthetic oligonucleotide
ctcctgcgcgggcataaccagtacg

SEQ ID NO: 378550 - DNA, 25 bp, Artificial Sequence
  Description of Artificial Sequence: Synthetic oligonucleotide
tcctgcgcgggcataaccagtacgc

SEQ ID NO: 378551 - DNA, 24 bp, Artificial Sequence
  Description of Artificial Sequence: Synthetic oligonucleotide
cctgcgcgggcataaccagtacgc

SEQ ID NO: 378552 - DNA, 26 bp, Artificial Sequence
  Description of Artificial Sequence: Synthetic oligonucleotide
ctgcgcgggcataaccagtacgccta

SEQ ID NO: 378553 - DNA, 26 bp, Artificial Sequence
  Description of Artificial Sequence: Synthetic oligonucleotide
tgcgcgggcataaccagtacgcctac

SEQ ID NO: 378554 - DNA, 25 bp, Artificial Sequence
  Description of Artificial Sequence: Synthetic oligonucleotide
gcgcgggcataaccagtacgcctac

SEQ ID NO: 378555 - DNA, 20 bp, Artificial Sequence
  Description of Artificial Sequence: Synthetic oligonucleotide
cccggccgcggggagccatt

SEQ ID NO: 378556 - DNA, 20 bp, Artificial Sequence
  Description of Artificial Sequence: Synthetic oligonucleotide
ccggccgcggggagccactt

SEQ ID NO: 378557 - DNA, 20 bp, Artificial Sequence
  Description of Artificial Sequence: Synthetic oligonucleotide
cggccgcggggagccacgtt

SEQ ID NO: 378558 - DNA, 20 bp, Artificial Sequence
  Description of Artificial Sequence: Synthetic oligonucleotide
ggccgcggggagccacgctt

SEQ ID NO: 378559 - DNA, 22 bp, Artificial Sequence
  Description of Artificial Sequence: Synthetic oligonucleotide
gccgcggggagccacgcttcat

SEQ ID NO: 378560 - DNA, 23 bp, Artificial Sequence
  Description of Artificial Sequence: Synthetic oligonucleotide
ccgcggggagccacgcttcatca

SEQ ID NO: 378561 - DNA, 23 bp, Artificial Sequence
  Description of Artificial Sequence: Synthetic oligonucleotide
cgcggggagccacgcttcatcac

SEQ ID NO: 378562 - DNA, 23 bp, Artificial Sequence
  Description of Artificial Sequence: Synthetic oligonucleotide
gcggggagccacgcttcatcacc

SEQ ID NO: 378563 - DNA, 24 bp, Artificial Sequence
  Description of Artificial Sequence: Synthetic oligonucleotide
cggggagccacgcttcatcaccgt

SEQ ID NO: 378564 - DNA, 24 bp, Artificial Sequence
  Description of Artificial Sequence: Synthetic oligonucleotide
ggggagccacgcttcatcaccgtg

SEQ ID NO: 378565 - DNA, 24 bp, Artificial Sequence
  Description of Artificial Sequence: Synthetic oligonucleotide
gggagccacgcttcatcaccgtgg

SEQ ID NO: 378566 - DNA, 24 bp, Artificial Sequence
  Description of Artificial Sequence: Synthetic oligonucleotide
ggagccacgcttcatcaccgtggg

SEQ ID NO: 378567 - DNA, 26 bp, Artificial Sequence
  Description of Artificial Sequence: Synthetic oligonucleotide
gagccacgcttcatcaccgtgggcta

SEQ ID NO: 378568 - DNA, 26 bp, Artificial Sequence
  Description of Artificial Sequence: Synthetic oligonucleotide
agccacgcttcatcaccgtgggctac

SEQ ID NO: 378569 - DNA, 25 bp, Artificial Sequence
  Description of Artificial Sequence: Synthetic oligonucleotide
gccacgcttcatcaccgtgggctac

SEQ ID NO: 378570 - DNA, 26 bp, Artificial Sequence
  Description of Artificial Sequence: Synthetic oligonucleotide
ccacgcttcatcaccgtgggctacgt

SEQ ID NO: 378571 - DNA, 26 bp, Artificial Sequence
  Description of Artificial Sequence: Synthetic oligonucleotide
cacgcttcatcaccgtgggctacgtg

SEQ ID NO: 378572 - DNA, 27 bp, Artificial Sequence
  Description of Artificial Sequence: Synthetic oligonucleotide
acgcttcatcaccgtgggctacgtgga

SEQ ID NO: 378573 - DNA, 22 bp, Artificial Sequence
  Description of Artificial Sequence: Synthetic oligonucleotide
gggtcacggcaccccgaaccct

SEQ ID NO: 378574 - DNA, 22 bp, Artificial Sequence
  Description of Artificial Sequence: Synthetic oligonucleotide
ggtcacggcaccccgaaccctc

SEQ ID NO: 378575 - DNA, 23 bp, Artificial Sequence
  Description of Artificial Sequence: Synthetic oligonucleotide
gtcacggcaccccgaaccctcct

SEQ ID NO: 378576 - DNA, 23 bp, Artificial Sequence
  Description of Artificial Sequence: Synthetic oligonucleotide
tcacggcaccccgaaccctcctc

SEQ ID NO: 378577 - DNA, 22 bp, Artificial Sequence
  Description of Artificial Sequence: Synthetic oligonucleotide
cacggcaccccgaaccctcctc

SEQ ID NO: 378578 - DNA, 23 bp, Artificial Sequence
  Description of Artificial Sequence: Synthetic oligonucleotide
acggcaccccgaaccctcctcct

SEQ ID NO: 378579 - DNA, 22 bp, Artificial Sequence
  Description of Artificial Sequence: Synthetic oligonucleotide
cggcaccccgaaccctcctcct

SEQ ID NO: 378580 - DNA, 22 bp, Artificial Sequence
  Description of Artificial Sequence: Synthetic oligonucleotide
ggcaccccgaaccctcctcctg

SEQ ID NO: 378581 - DNA, 23 bp, Artificial Sequence
  Description of Artificial Sequence: Synthetic oligonucleotide
gcaccccgaaccctcctcctgct

SEQ ID NO: 378582 - DNA, 23 bp, Artificial Sequence
  Description of Artificial Sequence: Synthetic oligonucleotide
caccccgaaccctcctcctgctg

SEQ ID NO: 378583 - DNA, 24 bp, Artificial Sequence
  Description of Artificial Sequence: Synthetic oligonucleotide
accccgaaccctcctcctgctgct

SEQ ID NO: 378584 - DNA, 22 bp, Artificial Sequence
  Description of Artificial Sequence: Synthetic oligonucleotide
agagaggagccgcgggcgccat

SEQ ID NO: 378585 - DNA, 21 bp, Artificial Sequence
  Description of Artificial Sequence: Synthetic oligonucleotide
gagaggagccgcgggcgccat

SEQ ID NO: 378586 - DNA, 21 bp, Artificial Sequence
  Description of Artificial Sequence: Synthetic oligonucleotide
agaggagccgcgggcgccatg

SEQ ID NO: 378587 - DNA, 20 bp, Artificial Sequence
  Description of Artificial Sequence: Synthetic oligonucleotide
gaggagccgcgggcgccatg

SEQ ID NO: 378588 - DNA, 25 bp, Artificial Sequence
  Description of Artificial Sequence: Synthetic oligonucleotide
gcggctcagatctcccagcgcaagt

SEQ ID NO: 378589 - DNA, 25 bp, Artificial Sequence
  Description of Artificial Sequence: Synthetic oligonucleotide
cggctcagatctcccagcgcaagtg

SEQ ID NO: 378590 - DNA, 25 bp, Artificial Sequence
  Description of Artificial Sequence: Synthetic oligonucleotide
ggctcagatctcccagcgcaagtgg

SEQ ID NO: 378591 - DNA, 26 bp, Artificial Sequence
  Description of Artificial Sequence: Synthetic oligonucleotide
gctcagatctcccagcgcaagtggga

SEQ ID NO: 378592 - DNA, 26 bp, Artificial Sequence
  Description of Artificial Sequence: Synthetic oligonucleotide
ctcagatctcccagcgcaagtgggag

SEQ ID NO: 378593 - DNA, 26 bp, Artificial Sequence
  Description of Artificial Sequence: Synthetic oligonucleotide
tcagatctcccagcgcaagtgggagg

SEQ ID NO: 378594 - DNA, 25 bp, Artificial Sequence
  Description of Artificial Sequence: Synthetic oligonucleotide
cagatctcccagcgcaagtgggagg

SEQ ID NO: 378595 - DNA, 25 bp, Artificial Sequence
  Description of Artificial Sequence: Synthetic oligonucleotide
agatctcccagcgcaagtgggaggc

SEQ ID NO: 378596 - DNA, 24 bp, Artificial Sequence
  Description of Artificial Sequence: Synthetic oligonucleotide
gatctcccagcgcaagtgggaggc

SEQ ID NO: 378597 - DNA, 24 bp, Artificial Sequence
  Description of Artificial Sequence: Synthetic oligonucleotide
atctcccagcgcaagtgggaggcg

SEQ ID NO: 378598 - DNA, 23 bp, Artificial Sequence
  Description of Artificial Sequence: Synthetic oligonucleotide
tctcccagcgcaagtgggaggcg

SEQ ID NO: 378599 - DNA, 22 bp, Artificial Sequence
  Description of Artificial Sequence: Synthetic oligonucleotide
ctcccagcgcaagtgggaggcg

SEQ ID NO: 378600 - DNA, 22 bp, Artificial Sequence
  Description of Artificial Sequence: Synthetic oligonucleotide
tcccagcgcaagtgggaggcgg

SEQ ID NO: 378601 - DNA, 25 bp, Artificial Sequence
  Description of Artificial Sequence: Synthetic oligonucleotide
gcctcctccgcgggcataaccagaa

SEQ ID NO: 378602 - DNA, 25 bp, Artificial Sequence
  Description of Artificial Sequence: Synthetic oligonucleotide
cctcctccgcgggcataaccagaac

SEQ ID NO: 378603 - DNA, 25 bp, Artificial Sequence
  Description of Artificial Sequence: Synthetic oligonucleotide
ctcctccgcgggcataaccagaacg

SEQ ID NO: 378604 - DNA, 25 bp, Artificial Sequence
  Description of Artificial Sequence: Synthetic oligonucleotide
tcctccgcgggcataaccagaacgc

SEQ ID NO: 378605 - DNA, 24 bp, Artificial Sequence
  Description of Artificial Sequence: Synthetic oligonucleotide
cctccgcgggcataaccagaacgc

SEQ ID NO: 378606 - DNA, 26 bp, Artificial Sequence
  Description of Artificial Sequence: Synthetic oligonucleotide
ctccgcgggcataaccagaacgccta

SEQ ID NO: 378607 - DNA, 26 bp, Artificial Sequence
  Description of Artificial Sequence: Synthetic oligonucleotide
tccgcgggcataaccagaacgcctac

SEQ ID NO: 378608 - DNA, 25 bp, Artificial Sequence
  Description of Artificial Sequence: Synthetic oligonucleotide
ccgcgggcataaccagaacgcctac

SEQ ID NO: 378609 - DNA, 26 bp, Artificial Sequence
  Description of Artificial Sequence: Synthetic oligonucleotide
cgcgggcataaccagaacgcctacga

SEQ ID NO: 378610 - DNA, 26 bp, Artificial Sequence
  Description of Artificial Sequence: Synthetic oligonucleotide
gcgggcataaccagaacgcctacgac

SEQ ID NO: 378611 - DNA, 26 bp, Artificial Sequence
  Description of Artificial Sequence: Synthetic oligonucleotide
cgggcataaccagaacgcctacgacg

SEQ ID NO: 378612 - DNA, 26 bp, Artificial Sequence
  Description of Artificial Sequence: Synthetic oligonucleotide
gggcataaccagaacgcctacgacgg

SEQ ID NO: 378613 - DNA, 27 bp, Artificial Sequence
  Description of Artificial Sequence: Synthetic oligonucleotide
ggcataaccagaacgcctacgacggca

SEQ ID NO: 378614 - DNA, 28 bp, Artificial Sequence
  Description of Artificial Sequence: Synthetic oligonucleotide
gcataaccagaacgcctacgacggcaag

SEQ ID NO: 378615 - DNA, 28 bp, Artificial Sequence
  Description of Artificial Sequence: Synthetic oligonucleotide
cataaccagaacgcctacgacggcaagg

SEQ ID NO: 378616 - DNA, 32 bp, Artificial Sequence; identical to SEQ ID NO: 35178
  Description of Artificial Sequence: Synthetic oligonucleotide

SEQ ID NO: 378617 - DNA, 31 bp, Artificial Sequence; identical to SEQ ID NO: 35179
  Description of Artificial Sequence: Synthetic oligonucleotide

SEQ ID NO: 378618 - DNA, 30 bp, Artificial Sequence; identical to SEQ ID NO: 35180
  Description of Artificial Sequence: Synthetic oligonucleotide

SEQ ID NO: 378619 - DNA, 29 bp, Artificial Sequence
  Description of Artificial Sequence: Synthetic oligonucleotide
accagaacgcctacgacggcaaggattac

SEQ ID NO: 378620 - DNA, 28 bp, Artificial Sequence
  Description of Artificial Sequence: Synthetic oligonucleotide
ccagaacgcctacgacggcaaggattac

SEQ ID NO: 378621 - DNA, 30 bp, Artificial Sequence; identical to SEQ ID NO: 35183
  Description of Artificial Sequence: Synthetic oligonucleotide

SEQ ID NO: 378622 - DNA, 30 bp, Artificial Sequence; identical to SEQ ID NO: 35184
  Description of Artificial Sequence: Synthetic oligonucleotide

SEQ ID NO: 378623 - DNA, 29 bp, Artificial Sequence
  Description of Artificial Sequence: Synthetic oligonucleotide
gaacgcctacgacggcaaggattacatcg

SEQ ID NO: 378624 - DNA, 29 bp, Artificial Sequence
  Description of Artificial Sequence: Synthetic oligonucleotide
aacgcctacgacggcaaggattacatcgc

SEQ ID NO: 378625 - DNA, 31 bp, Artificial Sequence
  Description of Artificial Sequence: Synthetic oligonucleotide
accgggagacacagatctccaagaccaatac

SEQ ID NO: 378626 - DNA, 30 bp, Artificial Sequence
  Description of Artificial Sequence: Synthetic oligonucleotide
ccgggagacacagatctccaagaccaatac

SEQ ID NO: 378627 - DNA, 31 bp, Artificial Sequence
  Description of Artificial Sequence: Synthetic oligonucleotide
cgggagacacagatctccaagaccaatacac

SEQ ID NO: 378628 - DNA, 32 bp, Artificial Sequence
  Description of Artificial Sequence: Synthetic oligonucleotide
gggagacacagatctccaagaccaatacacag

SEQ ID NO: 378629 - DNA, 33 bp, Artificial Sequence
  Description of Artificial Sequence: Synthetic oligonucleotide
ggagacacagatctccaagaccaatacacagac

SEQ ID NO: 378630 - DNA, 36 bp, Artificial Sequence
  Description of Artificial Sequence: Synthetic oligonucleotide
gagacacagatctccaagaccaatacacagacttac

SEQ ID NO: 378631 - DNA, 36 bp, Artificial Sequence
  Description of Artificial Sequence: Synthetic oligonucleotide
agacacagatctccaagaccaatacacagacttacc

SEQ ID NO: 378632 - DNA, 35 bp, Artificial Sequence
  Description of Artificial Sequence: Synthetic oligonucleotide
gacacagatctccaagaccaatacacagacttacc

SEQ ID NO: 378633 - DNA, 35 bp, Artificial Sequence
  Description of Artificial Sequence: Synthetic oligonucleotide
acacagatctccaagaccaatacacagacttaccg

SEQ ID NO: 378634 - DNA, 34 bp, Artificial Sequence
  Description of Artificial Sequence: Synthetic oligonucleotide
cacagatctccaagaccaatacacagacttaccg

SEQ ID NO: 378635 - DNA, 35 bp, Artificial Sequence
  Description of Artificial Sequence: Synthetic oligonucleotide
acagatctccaagaccaatacacagacttaccgag

SEQ ID NO: 378636 - DNA, 34 bp, Artificial Sequence
  Description of Artificial Sequence: Synthetic oligonucleotide
cagatctccaagaccaatacacagacttaccgag

SEQ ID NO: 378637 - DNA, 35 bp, Artificial Sequence
  Description of Artificial Sequence: Synthetic oligonucleotide
agatctccaagaccaatacacagacttaccgagag

SEQ ID NO: 378638 - DNA, 34 bp, Artificial Sequence
  Description of Artificial Sequence: Synthetic oligonucleotide
gatctccaagaccaatacacagacttaccgagag

SEQ ID NO: 378639 - DNA, 35 bp, Artificial Sequence
  Description of Artificial Sequence: Synthetic oligonucleotide
atctccaagaccaatacacagacttaccgagagag

SEQ ID NO: 378640 - DNA, 34 bp, Artificial Sequence
  Description of Artificial Sequence: Synthetic oligonucleotide
tctccaagaccaatacacagacttaccgagagag

SEQ ID NO: 378641 - DNA, 33 bp, Artificial Sequence
  Description of Artificial Sequence: Synthetic oligonucleotide
ctccaagaccaatacacagacttaccgagagag

SEQ ID NO: 378642 - DNA, 33 bp, Artificial Sequence
  Description of Artificial Sequence: Synthetic oligonucleotide
tccaagaccaatacacagacttaccgagagagc

SEQ ID NO: 378643 - DNA, 32 bp, Artificial Sequence
  Description of Artificial Sequence: Synthetic oligonucleotide
ccaagaccaatacacagacttaccgagagagc

SEQ ID NO: 378644 - DNA, 24 bp, Artificial Sequence
  Description of Artificial Sequence: Synthetic oligonucleotide
gcctcctccgcgggcataaccagt

SEQ ID NO: 378645 - DNA, 24 bp, Artificial Sequence
  Description of Artificial Sequence: Synthetic oligonucleotide
cctcctccgcgggcataaccagtc

SEQ ID NO: 378646 - DNA, 24 bp, Artificial Sequence
  Description of Artificial Sequence: Synthetic oligonucleotide
ctcctccgcgggcataaccagtcc

SEQ ID NO: 378647 - DNA, 24 bp, Artificial Sequence
  Description of Artificial Sequence: Synthetic oligonucleotide
tcctccgcgggcataaccagtccg

SEQ ID NO: 378648 - DNA, 23 bp, Artificial Sequence
  Description of Artificial Sequence: Synthetic oligonucleotide
cctccgcgggcataaccagtccg

SEQ ID NO: 378649 - DNA, 23 bp, Artificial Sequence
  Description of Artificial Sequence: Synthetic oligonucleotide
ctccgcgggcataaccagtccgc

SEQ ID NO: 378650 - DNA, 25 bp, Artificial Sequence
  Description of Artificial Sequence: Synthetic oligonucleotide
tccgcgggcataaccagtccgccta

SEQ ID NO: 378651 - DNA, 24 bp, Artificial Sequence
  Description of Artificial Sequence: Synthetic oligonucleotide
ccgcgggcataaccagtccgccta

SEQ ID NO: 378652 - DNA, 24 bp, Artificial Sequence
  Description of Artificial Sequence: Synthetic oligonucleotide
cgcgggcataaccagtccgcctac

SEQ ID NO: 378653 - DNA, 25 bp, Artificial Sequence
  Description of Artificial Sequence: Synthetic oligonucleotide
gcgggcataaccagtccgcctacga

SEQ ID NO: 378654 - DNA, 25 bp, Artificial Sequence
  Description of Artificial Sequence: Synthetic oligonucleotide
cgggcataaccagtccgcctacgac

SEQ ID NO: 378655 - DNA, 25 bp, Artificial Sequence
  Description of Artificial Sequence: Synthetic oligonucleotide
gggcataaccagtccgcctacgacg

SEQ ID NO: 378656 - DNA, 25 bp, Artificial Sequence
  Description of Artificial Sequence: Synthetic oligonucleotide
ggcataaccagtccgcctacgacgg

SEQ ID NO: 378657 - DNA, 27 bp, Artificial Sequence
  Description of Artificial Sequence: Synthetic oligonucleotide
gcataaccagtccgcctacgacggcaa

SEQ ID NO: 378658 - DNA, 27 bp, Artificial Sequence
  Description of Artificial Sequence: Synthetic oligonucleotide
cataaccagtccgcctacgacggcaag

SEQ ID NO: 378659 - DNA, 27 bp, Artificial Sequence
  Description of Artificial Sequence: Synthetic oligonucleotide
ataaccagtccgcctacgacggcaagg

SEQ ID NO: 378660 - DNA, 27 bp, Artificial Sequence
  Description of Artificial Sequence: Synthetic oligonucleotide
taaccagtccgcctacgacggcaagga

SEQ ID NO: 378661 - DNA, 27 bp, Artificial Sequence
  Description of Artificial Sequence: Synthetic oligonucleotide
aaccagtccgcctacgacggcaaggat

SEQ ID NO: 378662 - DNA, 26 bp, Artificial Sequence
  Description of Artificial Sequence: Synthetic oligonucleotide
ggcattgttgctggcctggctgtcct

SEQ ID NO: 378663 - DNA, 28 bp, Artificial Sequence
  Description of Artificial Sequence: Synthetic oligonucleotide
acttggcagaggatgtatggctgcgacg

SEQ ID NO: 378664 - DNA, 27 bp, Artificial Sequence
  Description of Artificial Sequence: Synthetic oligonucleotide
cttggcagaggatgtatggctgcgacg

SEQ ID NO: 378665 - DNA, 28 bp, Artificial Sequence
  Description of Artificial Sequence: Synthetic oligonucleotide
ttggcagaggatgtatggctgcgacgtg

SEQ ID NO: 378666 - DNA, 27 bp, Artificial Sequence
  Description of Artificial Sequence: Synthetic oligonucleotide
tggcagaggatgtatggctgcgacgtg

SEQ ID NO: 378667 - DNA, 26 bp, Artificial Sequence
  Description of Artificial Sequence: Synthetic oligonucleotide
ggcagaggatgtatggctgcgacgtg

SEQ ID NO: 378668 - DNA, 26 bp, Artificial Sequence
  Description of Artificial Sequence: Synthetic oligonucleotide
gcagaggatgtatggctgcgacgtgg

SEQ ID NO: 378669 - DNA, 22 bp, Artificial Sequence
  Description of Artificial Sequence: Synthetic oligonucleotide
tccgaggaaggagccgcgggct

SEQ ID NO: 378670 - DNA, 21 bp, Artificial Sequence
  Description of Artificial Sequence: Synthetic oligonucleotide
ccgaggaaggagccgcgggct

SEQ ID NO: 378671 - DNA, 21 bp, Artificial Sequence
  Description of Artificial Sequence: Synthetic oligonucleotide
cgaggaaggagccgcgggctc

SEQ ID NO: 378672 - DNA, 23 bp, Artificial Sequence
  Description of Artificial Sequence: Synthetic oligonucleotide
gaggaaggagccgcgggctccat

SEQ ID NO: 378673 - DNA, 23 bp, Artificial Sequence
  Description of Artificial Sequence: Synthetic oligonucleotide
aggaaggagccgcgggctccatg

SEQ ID NO: 378674 - DNA, 22 bp, Artificial Sequence
  Description of Artificial Sequence: Synthetic oligonucleotide
ggaaggagccgcgggctccatg

SEQ ID NO: 378675 - DNA, 25 bp, Artificial Sequence
  Description of Artificial Sequence: Synthetic oligonucleotide
gaaggagccgcgggctccatggata

SEQ ID NO: 378676 - DNA, 26 bp, Artificial Sequence
  Description of Artificial Sequence: Synthetic oligonucleotide
aaggagccgcgggctccatggataga

SEQ ID NO: 378677 - DNA, 25 bp, Artificial Sequence
  Description of Artificial Sequence: Synthetic oligonucleotide
aggagccgcgggctccatggataga

SEQ ID NO: 378678 - DNA, 24 bp, Artificial Sequence
  Description of Artificial Sequence: Synthetic oligonucleotide
ggagccgcgggctccatggataga

SEQ ID NO: 378679 - DNA, 24 bp, Artificial Sequence
  Description of Artificial Sequence: Synthetic oligonucleotide
gagccgcgggctccatggatagag

SEQ ID NO: 378680 - DNA, 25 bp, Artificial Sequence
  Description of Artificial Sequence: Synthetic oligonucleotide
agccgcgggctccatggatagagca

SEQ ID NO: 378681 - DNA, 24 bp, Artificial Sequence
  Description of Artificial Sequence: Synthetic oligonucleotide
gccgcgggctccatggatagagca

SEQ ID NO: 378682 - DNA, 24 bp, Artificial Sequence
  Description of Artificial Sequence: Synthetic oligonucleotide
ccgcgggctccatggatagagcag

SEQ ID NO: 378683 - DNA, 25 bp, Artificial Sequence
  Description of Artificial Sequence: Synthetic oligonucleotide
cgcgggctccatggatagagcagga

SEQ ID NO: 378684 - DNA, 25 bp, Artificial Sequence
  Description of Artificial Sequence: Synthetic oligonucleotide
gcgggctccatggatagagcaggag

SEQ ID NO: 378685 - DNA, 25 bp, Artificial Sequence
  Description of Artificial Sequence: Synthetic oligonucleotide
cgggctccatggatagagcaggagg

SEQ ID NO: 378686 - DNA, 25 bp, Artificial Sequence
  Description of Artificial Sequence: Synthetic oligonucleotide
gggctccatggatagagcaggaggg

SEQ ID NO: 378687 - DNA, 25 bp, Artificial Sequence
  Description of Artificial Sequence: Synthetic oligonucleotide
ggctccatggatagagcaggagggg

SEQ ID NO: 378688 - DNA, 25 bp, Artificial Sequence
  Description of Artificial Sequence: Synthetic oligonucleotide
gctccatggatagagcaggaggggc

SEQ ID NO: 378689 - DNA, 25 bp, Artificial Sequence
  Description of Artificial Sequence: Synthetic oligonucleotide
ctccatggatagagcaggaggggcc

SEQ ID NO: 378690 - DNA, 25 bp, Artificial Sequence
  Description of Artificial Sequence: Synthetic oligonucleotide
tccatggatagagcaggaggggccg

SEQ ID NO: 378691 - DNA, 27 bp, Artificial Sequence
  Description of Artificial Sequence: Synthetic oligonucleotide
cacgtgcgtggaatggctccgcagata

SEQ ID NO: 378692 - DNA, 27 bp, Artificial Sequence
  Description of Artificial Sequence: Synthetic oligonucleotide
acgtgcgtggaatggctccgcagatac

SEQ ID NO: 378693 - DNA, 26 bp, Artificial Sequence
  Description of Artificial Sequence: Synthetic oligonucleotide
cgtgcgtggaatggctccgcagatac

SEQ ID NO: 378694 - DNA, 29 bp, Artificial Sequence
  Description of Artificial Sequence: Synthetic oligonucleotide
ttcatcaccgtgggctacgtggacgatac

SEQ ID NO: 378695 - DNA, 28 bp, Artificial Sequence
  Description of Artificial Sequence: Synthetic oligonucleotide
tcatcaccgtgggctacgtggacgatac

SEQ ID NO: 378696 - DNA, 27 bp, Artificial Sequence
  Description of Artificial Sequence: Synthetic oligonucleotide
catcaccgtgggctacgtggacgatac

SEQ ID NO: 378697 - DNA, 27 bp, Artificial Sequence
  Description of Artificial Sequence: Synthetic oligonucleotide
atcaccgtgggctacgtggacgatacg

SEQ ID NO: 378698 - DNA, 26 bp, Artificial Sequence
  Description of Artificial Sequence: Synthetic oligonucleotide
tcaccgtgggctacgtggacgatacg

SEQ ID NO: 378699 - DNA, 25 bp, Artificial Sequence
  Description of Artificial Sequence: Synthetic oligonucleotide
caccgtgggctacgtggacgatacg

SEQ ID NO: 378700 - DNA, 26 bp, Artificial Sequence
  Description of Artificial Sequence: Synthetic oligonucleotide
accgtgggctacgtggacgatacgct

SEQ ID NO: 378701 - DNA, 25 bp, Artificial Sequence
  Description of Artificial Sequence: Synthetic oligonucleotide
ccgtgggctacgtggacgatacgct

SEQ ID NO: 378702 - DNA, 27 bp, Artificial Sequence
  Description of Artificial Sequence: Synthetic oligonucleotide
cgtgggctacgtggacgatacgctgtt

SEQ ID NO: 378703 - DNA, 27 bp, Artificial Sequence
  Description of Artificial Sequence: Synthetic oligonucleotide
gtgggctacgtggacgatacgctgttc

SEQ ID NO: 378704 - DNA, 27 bp, Artificial Sequence
  Description of Artificial Sequence: Synthetic oligonucleotide
tgggctacgtggacgatacgctgttcg

SEQ ID NO: 378705 - DNA, 27 bp, Artificial Sequence
  Description of Artificial Sequence: Synthetic oligonucleotide
gggctacgtggacgatacgctgttcgt

SEQ ID NO: 378706 - DNA, 27 bp, Artificial Sequence
  Description of Artificial Sequence: Synthetic oligonucleotide
ggctacgtggacgatacgctgttcgtg

SEQ ID NO: 378707 - DNA, 28 bp, Artificial Sequence
  Description of Artificial Sequence: Synthetic oligonucleotide
gctacgtggacgatacgctgttcgtgag

SEQ ID NO: 378708 - DNA, 28 bp, Artificial Sequence
  Description of Artificial Sequence: Synthetic oligonucleotide
ctacgtggacgatacgctgttcgtgagg

SEQ ID NO: 378709 - DNA, 30 bp, Artificial Sequence
  Description of Artificial Sequence: Synthetic oligonucleotide
tacgtggacgatacgctgttcgtgaggttc

SEQ ID NO: 378710 - DNA, 29 bp, Artificial Sequence
  Description of Artificial Sequence: Synthetic oligonucleotide
acgtggacgatacgctgttcgtgaggttc

SEQ ID NO: 378711 - DNA, 28 bp, Artificial Sequence
  Description of Artificial Sequence: Synthetic oligonucleotide
cgtggacgatacgctgttcgtgaggttc

SEQ ID NO: 378712 - DNA, 28 bp, Artificial Sequence
  Description of Artificial Sequence: Synthetic oligonucleotide
gtggacgatacgctgttcgtgaggttcg

SEQ ID NO: 378713 - DNA, 29 bp, Artificial Sequence
  Description of Artificial Sequence: Synthetic oligonucleotide
tggacgatacgctgttcgtgaggttcgac

SEQ ID NO: 378714 - DNA, 28 bp, Artificial Sequence
  Description of Artificial Sequence: Synthetic oligonucleotide
ggacgatacgctgttcgtgaggttcgac

SEQ ID NO: 378715 - DNA, 29 bp, Artificial Sequence
  Description of Artificial Sequence: Synthetic oligonucleotide
gacgatacgctgttcgtgaggttcgacag

SEQ ID NO: 378716 - DNA, 29 bp, Artificial Sequence
  Description of Artificial Sequence: Synthetic oligonucleotide
acgatacgctgttcgtgaggttcgacagc

SEQ ID NO: 378717 - DNA, 28 bp, Artificial Sequence
  Description of Artificial Sequence: Synthetic oligonucleotide
cgatacgctgttcgtgaggttcgacagc

SEQ ID NO: 378718 - DNA, 28 bp, Artificial Sequence
  Description of Artificial Sequence: Synthetic oligonucleotide
gatacgctgttcgtgaggttcgacagcg

SEQ ID NO: 378719 - DNA, 29 bp, Artificial Sequence
  Description of Artificial Sequence: Synthetic oligonucleotide
atacgctgttcgtgaggttcgacagcgac

SEQ ID NO: 378720 - DNA, 28 bp, Artificial Sequence
  Description of Artificial Sequence: Synthetic oligonucleotide
tacgctgttcgtgaggttcgacagcgac

SEQ ID NO: 378721 - DNA, 23 bp, Artificial Sequence
  Description of Artificial Sequence: Synthetic oligonucleotide
ccgcggagagccccgcttcatca

SEQ ID NO: 378722 - DNA, 23 bp, Artificial Sequence
  Description of Artificial Sequence: Synthetic oligonucleotide
cgcggagagccccgcttcatcac

SEQ ID NO: 378723 - DNA, 23 bp, Artificial Sequence
  Description of Artificial Sequence: Synthetic oligonucleotide
gcggagagccccgcttcatcacc

SEQ ID NO: 378724 - DNA, 24 bp, Artificial Sequence
  Description of Artificial Sequence: Synthetic oligonucleotide
cggagagccccgcttcatcaccgt

SEQ ID NO: 378725 - DNA, 24 bp, Artificial Sequence
  Description of Artificial Sequence: Synthetic oligonucleotide
ggagagccccgcttcatcaccgtg

SEQ ID NO: 378726 - DNA, 24 bp, Artificial Sequence
  Description of Artificial Sequence: Synthetic oligonucleotide
gagagccccgcttcatcaccgtgg

SEQ ID NO: 378727 - DNA, 24 bp, Artificial Sequence
  Description of Artificial Sequence: Synthetic oligonucleotide
agagccccgcttcatcaccgtggg

SEQ ID NO: 378728 - DNA, 21 bp, Artificial Sequence
  Description of Artificial Sequence: Synthetic oligonucleotide
tggaccgcggcggacaccgca

SEQ ID NO: 378729 - DNA, 20 bp, Artificial Sequence
  Description of Artificial Sequence: Synthetic oligonucleotide
ggaccgcggcggacaccgca

SEQ ID NO: 378730 - DNA, 20 bp, Artificial Sequence
  Description of Artificial Sequence: Synthetic oligonucleotide
gaccgcggcggacaccgcag

SEQ ID NO: 378731 - DNA, 21 bp, Artificial Sequence
  Description of Artificial Sequence: Synthetic oligonucleotide
accgcggcggacaccgcagct

SEQ ID NO: 378732 - DNA, 20 bp, Artificial Sequence
  Description of Artificial Sequence: Synthetic oligonucleotide
ccgcggcggacaccgcagct

SEQ ID NO: 378733 - DNA, 21 bp, Artificial Sequence
  Description of Artificial Sequence: Synthetic oligonucleotide
cgcggcggacaccgcagctca

SEQ ID NO: 378734 - DNA, 23 bp, Artificial Sequence
  Description of Artificial Sequence: Synthetic oligonucleotide
gcggcggacaccgcagctcagat

SEQ ID NO: 378735 - DNA, 24 bp, Artificial Sequence
  Description of Artificial Sequence: Synthetic oligonucleotide
cggcggacaccgcagctcagatca

SEQ ID NO: 378736 - DNA, 24 bp, Artificial Sequence
  Description of Artificial Sequence: Synthetic oligonucleotide
ggcggacaccgcagctcagatcac

SEQ ID NO: 378737 - DNA, 24 bp, Artificial Sequence
  Description of Artificial Sequence: Synthetic oligonucleotide
gcggacaccgcagctcagatcacc

SEQ ID NO: 378738 - DNA, 25 bp, Artificial Sequence
  Description of Artificial Sequence: Synthetic oligonucleotide
cggacaccgcagctcagatcaccca

SEQ ID NO: 378739 - DNA, 25 bp, Artificial Sequence
  Description of Artificial Sequence: Synthetic oligonucleotide
ggacaccgcagctcagatcacccag

SEQ ID NO: 378740 - DNA, 25 bp, Artificial Sequence
  Description of Artificial Sequence: Synthetic oligonucleotide
gacaccgcagctcagatcacccagc

SEQ ID NO: 378741 - DNA, 25 bp, Artificial Sequence
  Description of Artificial Sequence: Synthetic oligonucleotide
acaccgcagctcagatcacccagcg

SEQ ID NO: 378742 - DNA, 24 bp, Artificial Sequence
  Description of Artificial Sequence: Synthetic oligonucleotide
caccgcagctcagatcacccagcg

SEQ ID NO: 378743 - DNA, 26 bp, Artificial Sequence
  Description of Artificial Sequence: Synthetic oligonucleotide
accgcagctcagatcacccagcgcaa

SEQ ID NO: 378744 - DNA, 25 bp, Artificial Sequence
  Description of Artificial Sequence: Synthetic oligonucleotide
ccgcagctcagatcacccagcgcaa

SEQ ID NO: 378745 - DNA, 26 bp, Artificial Sequence
  Description of Artificial Sequence: Synthetic oligonucleotide
cgcagctcagatcacccagcgcaagt

SEQ ID NO: 378746 - DNA, 23 bp, Artificial Sequence
  Description of Artificial Sequence: Synthetic oligonucleotide
gcctcctccgcgggtatgaccag

SEQ ID NO: 378747 - DNA, 24 bp, Artificial Sequence
  Description of Artificial Sequence: Synthetic oligonucleotide
cctcctccgcgggtatgaccagga

SEQ ID NO: 378748 - DNA, 24 bp, Artificial Sequence
  Description of Artificial Sequence: Synthetic oligonucleotide
ctcctccgcgggtatgaccaggac

SEQ ID NO: 378749 - DNA, 24 bp, Artificial Sequence
  Description of Artificial Sequence: Synthetic oligonucleotide
tcctccgcgggtatgaccaggacg

SEQ ID NO: 378750 - DNA, 23 bp, Artificial Sequence
  Description of Artificial Sequence: Synthetic oligonucleotide
cctccgcgggtatgaccaggacg

SEQ ID NO: 378751 - DNA, 23 bp, Artificial Sequence
  Description of Artificial Sequence: Synthetic oligonucleotide
ctccgcgggtatgaccaggacgc

SEQ ID NO: 378752 - DNA, 25 bp, Artificial Sequence
  Description of Artificial Sequence: Synthetic oligonucleotide
tccgcgggtatgaccaggacgccta

SEQ ID NO: 378753 - DNA, 24 bp, Artificial Sequence
  Description of Artificial Sequence: Synthetic oligonucleotide
ccgcgggtatgaccaggacgccta

SEQ ID NO: 378754 - DNA, 24 bp, Artificial Sequence
  Description of Artificial Sequence: Synthetic oligonucleotide
cgcgggtatgaccaggacgcctac

SEQ ID NO: 378755 - DNA, 25 bp, Artificial Sequence
  Description of Artificial Sequence: Synthetic oligonucleotide
gcgggtatgaccaggacgcctacga

SEQ ID NO: 378756 - DNA, 25 bp, Artificial Sequence
  Description of Artificial Sequence: Synthetic oligonucleotide
cgggtatgaccaggacgcctacgac

SEQ ID NO: 378757 - DNA, 25 bp, Artificial Sequence
  Description of Artificial Sequence: Synthetic oligonucleotide
gggtatgaccaggacgcctacgacg

SEQ ID NO: 378758 - DNA, 25 bp, Artificial Sequence
  Description of Artificial Sequence: Synthetic oligonucleotide
ggtatgaccaggacgcctacgacgg

SEQ ID NO: 378759 - DNA, 27 bp, Artificial Sequence
  Description of Artificial Sequence: Synthetic oligonucleotide
gtatgaccaggacgcctacgacggcaa

SEQ ID NO: 378760 - DNA, 27 bp, Artificial Sequence
  Description of Artificial Sequence: Synthetic oligonucleotide
tatgaccaggacgcctacgacggcaag

SEQ ID NO: 378761 - DNA, 26 bp, Artificial Sequence
  Description of Artificial Sequence: Synthetic oligonucleotide
atgaccaggacgcctacgacggcaag

SEQ ID NO: 378762 - DNA, 25 bp, Artificial Sequence
  Description of Artificial Sequence: Synthetic oligonucleotide
tgaccaggacgcctacgacggcaag

SEQ ID NO: 378763 - DNA, 24 bp, Artificial Sequence
  Description of Artificial Sequence: Synthetic oligonucleotide
gaccaggacgcctacgacggcaag

SEQ ID NO: 378764 - DNA, 25 bp, Artificial Sequence
  Description of Artificial Sequence: Synthetic oligonucleotide
aggacagagcctacctggagggcct

SEQ ID NO: 378765 - DNA, 24 bp, Artificial Sequence
  Description of Artificial Sequence: Synthetic oligonucleotide
ggacagagcctacctggagggcct

SEQ ID NO: 378766 - DNA, 25 bp, Artificial Sequence
  Description of Artificial Sequence: Synthetic oligonucleotide
gacagagcctacctggagggcctgt

SEQ ID NO: 378767 - DNA, 25 bp, Artificial Sequence
  Description of Artificial Sequence: Synthetic oligonucleotide
acagagcctacctggagggcctgtg

SEQ ID NO: 378768 - DNA, 24 bp, Artificial Sequence
  Description of Artificial Sequence: Synthetic oligonucleotide
cagagcctacctggagggcctgtg

SEQ ID NO: 378769 - DNA, 27 bp, Artificial Sequence
  Description of Artificial Sequence: Synthetic oligonucleotide
ccaccaccccatctctgaccatgaggt

SEQ ID NO: 378770 - DNA, 27 bp, Artificial Sequence
  Description of Artificial Sequence: Synthetic oligonucleotide
caccaccccatctctgaccatgaggtc

SEQ ID NO: 378771 - DNA, 28 bp, Artificial Sequence
  Description of Artificial Sequence: Synthetic oligonucleotide
accaccccatctctgaccatgaggtcac

SEQ ID NO: 378772 - DNA, 27 bp, Artificial Sequence
  Description of Artificial Sequence: Synthetic oligonucleotide
ccaccccatctctgaccatgaggtcac

SEQ ID NO: 378773 - DNA, 27 bp, Artificial Sequence
  Description of Artificial Sequence: Synthetic oligonucleotide
caccccatctctgaccatgaggtcacc

SEQ ID NO: 378774 - DNA, 27 bp, Artificial Sequence
  Description of Artificial Sequence: Synthetic oligonucleotide
accccatctctgaccatgaggtcaccc

SEQ ID NO: 378775 - DNA, 27 bp, Artificial Sequence
  Description of Artificial Sequence: Synthetic oligonucleotide
ccccatctctgaccatgaggtcaccct

SEQ ID NO: 378776 - DNA, 27 bp, Artificial Sequence
  Description of Artificial Sequence: Synthetic oligonucleotide
cccatctctgaccatgaggtcaccctg

SEQ ID NO: 378777 - DNA, 28 bp, Artificial Sequence
  Description of Artificial Sequence: Synthetic oligonucleotide
ccatctctgaccatgaggtcaccctgag

SEQ ID NO: 378778 - DNA, 28 bp, Artificial Sequence
  Description of Artificial Sequence: Synthetic oligonucleotide
catctctgaccatgaggtcaccctgagg

SEQ ID NO: 378779 - DNA, 29 bp, Artificial Sequence
  Description of Artificial Sequence: Synthetic oligonucleotide
atctctgaccatgaggtcaccctgaggtg

SEQ ID NO: 378780 - DNA, 28 bp, Artificial Sequence
  Description of Artificial Sequence: Synthetic oligonucleotide
tctctgaccatgaggtcaccctgaggtg

SEQ ID NO: 378781 - DNA, 27 bp, Artificial Sequence
  Description of Artificial Sequence: Synthetic oligonucleotide
ctctgaccatgaggtcaccctgaggtg

SEQ ID NO: 378782 - DNA, 27 bp, Artificial Sequence
  Description of Artificial Sequence: Synthetic oligonucleotide
tctgaccatgaggtcaccctgaggtgc

SEQ ID NO: 378783 - DNA, 27 bp, Artificial Sequence
  Description of Artificial Sequence: Synthetic oligonucleotide
ctgaccatgaggtcaccctgaggtgct

SEQ ID NO: 378784 - DNA, 27 bp, Artificial Sequence
  Description of Artificial Sequence: Synthetic oligonucleotide
tgaccatgaggtcaccctgaggtgctg

SEQ ID NO: 378785 - DNA, 26 bp, Artificial Sequence
  Description of Artificial Sequence: Synthetic oligonucleotide
gaccatgaggtcaccctgaggtgctg

SEQ ID NO: 378786 - DNA, 26 bp, Artificial Sequence
  Description of Artificial Sequence: Synthetic oligonucleotide
accatgaggtcaccctgaggtgctgg

SEQ ID NO: 378787 - DNA, 25 bp, Artificial Sequence
  Description of Artificial Sequence: Synthetic oligonucleotide
ccatgaggtcaccctgaggtgctgg

SEQ ID NO: 378788 - DNA, 25 bp, Artificial Sequence
  Description of Artificial Sequence: Synthetic oligonucleotide
catgaggtcaccctgaggtgctggg

SEQ ID NO: 378789 - DNA, 25 bp, Artificial Sequence
  Description of Artificial Sequence: Synthetic oligonucleotide
atgaggtcaccctgaggtgctgggc

SEQ ID NO: 378790 - DNA, 24 bp, Artificial Sequence
  Description of Artificial Sequence: Synthetic oligonucleotide
tgaggtcaccctgaggtgctgggc

SEQ ID NO: 378791 - DNA, 23 bp, Artificial Sequence
  Description of Artificial Sequence: Synthetic oligonucleotide
gaggtcaccctgaggtgctgggc

SEQ ID NO: 378792 - DNA, 23 bp, Artificial Sequence
  Description of Artificial Sequence: Synthetic oligonucleotide
aggtcaccctgaggtgctgggcc

SEQ ID NO: 378793 - DNA, 22 bp, Artificial Sequence
  Description of Artificial Sequence: Synthetic oligonucleotide
ggtcaccctgaggtgctgggcc

SEQ ID NO: 378794 - DNA, 23 bp, Artificial Sequence
  Description of Artificial Sequence: Synthetic oligonucleotide
gtcaccctgaggtgctgggccct

SEQ ID NO: 378795 - DNA, 23 bp, Artificial Sequence
  Description of Artificial Sequence: Synthetic oligonucleotide
tcaccctgaggtgctgggccctg

SEQ ID NO: 378796 - DNA, 33 bp, Artificial Sequence; identical to SEQ ID NO: 35838
  Description of Artificial Sequence: Synthetic oligonucleotide

SEQ ID NO: 378797 - DNA, 32 bp, Artificial Sequence; identical to SEQ ID NO: 35839
  Description of Artificial Sequence: Synthetic oligonucleotide

SEQ ID NO: 378798 - DNA, 32 bp, Artificial Sequence; identical to SEQ ID NO: 35840
  Description of Artificial Sequence: Synthetic oligonucleotide

SEQ ID NO: 378799 - DNA, 22 bp, Artificial Sequence
  Description of Artificial Sequence: Synthetic oligonucleotide
caagtgggaggcggcccgtgtc

SEQ ID NO: 378800 - DNA, 22 bp, Artificial Sequence
  Description of Artificial Sequence: Synthetic oligonucleotide
aagtgggaggcggcccgtgtcg

SEQ ID NO: 378801 - DNA, 21 bp, Artificial Sequence
  Description of Artificial Sequence: Synthetic oligonucleotide
agtgggaggcggcccgtgtcg

SEQ ID NO: 378802 - DNA, 20 bp, Artificial Sequence
  Description of Artificial Sequence: Synthetic oligonucleotide
gtgggaggcggcccgtgtcg

SEQ ID NO: 378803 - DNA, 20 bp, Artificial Sequence
  Description of Artificial Sequence: Synthetic oligonucleotide
tgggaggcggcccgtgtcgc

SEQ ID NO: 378804 - DNA, 20 bp, Artificial Sequence
  Description of Artificial Sequence: Synthetic oligonucleotide
gggaggcggcccgtgtcgct

SEQ ID NO: 378805 - DNA, 20 bp, Artificial Sequence
  Description of Artificial Sequence: Synthetic oligonucleotide
ggaggcggcccgtgtcgcgt

SEQ ID NO: 378806 - DNA, 20 bp, Artificial Sequence
  Description of Artificial Sequence: Synthetic oligonucleotide
gaggcggcccgtgtcgcgga

SEQ ID NO: 378807 - DNA, 20 bp, Artificial Sequence
  Description of Artificial Sequence: Synthetic oligonucleotide
aggcggcccgtgtcgcggag

SEQ ID NO: 378808 - DNA, 20 bp, Artificial Sequence
  Description of Artificial Sequence: Synthetic oligonucleotide
ggcggcccgtgtcgcggagt

SEQ ID NO: 378809 - DNA, 20 bp, Artificial Sequence
  Description of Artificial Sequence: Synthetic oligonucleotide
gcggcccgtgtcgcggagca

SEQ ID NO: 378810 - DNA, 20 bp, Artificial Sequence
  Description of Artificial Sequence: Synthetic oligonucleotide
cggcccgtgtcgcggagcag

SEQ ID NO: 378811 - DNA, 21 bp, Artificial Sequence
  Description of Artificial Sequence: Synthetic oligonucleotide
ggcccgtgtcgcggagcagga

SEQ ID NO: 378812 - DNA, 22 bp, Artificial Sequence
  Description of Artificial Sequence: Synthetic oligonucleotide
gcccgtgtcgcggagcaggaca

SEQ ID NO: 378813 - DNA, 23 bp, Artificial Sequence
  Description of Artificial Sequence: Synthetic oligonucleotide
cccgtgtcgcggagcaggacaga

SEQ ID NO: 378814 - DNA, 23 bp, Artificial Sequence
  Description of Artificial Sequence: Synthetic oligonucleotide
ccgtgtcgcggagcaggacagag

SEQ ID NO: 378815 - DNA, 23 bp, Artificial Sequence
  Description of Artificial Sequence: Synthetic oligonucleotide
cgtgtcgcggagcaggacagagc

SEQ ID NO: 378816 - DNA, 25 bp, Artificial Sequence
  Description of Artificial Sequence: Synthetic oligonucleotide
gtgtcgcggagcaggacagagccta

SEQ ID NO: 378817 - DNA, 25 bp, Artificial Sequence
  Description of Artificial Sequence: Synthetic oligonucleotide
tgtcgcggagcaggacagagcctac

SEQ ID NO: 378818 - DNA, 24 bp, Artificial Sequence
  Description of Artificial Sequence: Synthetic oligonucleotide
gtcgcggagcaggacagagcctac

SEQ ID NO: 378819 - DNA, 25 bp, Artificial Sequence
  Description of Artificial Sequence: Synthetic oligonucleotide
tcgcggagcaggacagagcctacct

SEQ ID NO: 378820 - DNA, 24 bp, Artificial Sequence
  Description of Artificial Sequence: Synthetic oligonucleotide
cgcggagcaggacagagcctacct

SEQ ID NO: 378821 - DNA, 22 bp, Artificial Sequence
  Description of Artificial Sequence: Synthetic oligonucleotide
ctcctggaccgcggcggacact

SEQ ID NO: 378822 - DNA, 22 bp, Artificial Sequence
  Description of Artificial Sequence: Synthetic oligonucleotide
tcctggaccgcggcggacactg

SEQ ID NO: 378823 - DNA, 21 bp, Artificial Sequence
  Description of Artificial Sequence: Synthetic oligonucleotide
cctggaccgcggcggacactg

SEQ ID NO: 378824 - DNA, 21 bp, Artificial Sequence
  Description of Artificial Sequence: Synthetic oligonucleotide
ctggaccgcggcggacactgc

SEQ ID NO: 378825 - DNA, 21 bp, Artificial Sequence
  Description of Artificial Sequence: Synthetic oligonucleotide
tggaccgcggcggacactgcg

SEQ ID NO: 378826 - DNA, 20 bp, Artificial Sequence
  Description of Artificial Sequence: Synthetic oligonucleotide
ggaccgcggcggacactgcg

SEQ ID NO: 378827 - DNA, 20 bp, Artificial Sequence
  Description of Artificial Sequence: Synthetic oligonucleotide
gaccgcggcggacactgcgg

SEQ ID NO: 378828 - DNA, 21 bp, Artificial Sequence
  Description of Artificial Sequence: Synthetic oligonucleotide
accgcggcggacactgcggct

SEQ ID NO: 378829 - DNA, 20 bp, Artificial Sequence
  Description of Artificial Sequence: Synthetic oligonucleotide
ccgcggcggacactgcggct

SEQ ID NO: 378830 - DNA, 21 bp, Artificial Sequence
  Description of Artificial Sequence: Synthetic oligonucleotide
cgcggcggacactgcggctca

SEQ ID NO: 378831 - DNA, 23 bp, Artificial Sequence
  Description of Artificial Sequence: Synthetic oligonucleotide
gcggcggacactgcggctcagat

SEQ ID NO: 378832 - DNA, 24 bp, Artificial Sequence
  Description of Artificial Sequence: Synthetic oligonucleotide
cggcggacactgcggctcagatca

SEQ ID NO: 378833 - DNA, 24 bp, Artificial Sequence
  Description of Artificial Sequence: Synthetic oligonucleotide
ggcggacactgcggctcagatcac

SEQ ID NO: 378834 - DNA, 24 bp, Artificial Sequence
  Description of Artificial Sequence: Synthetic oligonucleotide
gcggacactgcggctcagatcacc

SEQ ID NO: 378835 - DNA, 25 bp, Artificial Sequence
  Description of Artificial Sequence: Synthetic oligonucleotide
cggacactgcggctcagatcaccca

SEQ ID NO: 378836 - DNA, 25 bp, Artificial Sequence
  Description of Artificial Sequence: Synthetic oligonucleotide
ggacactgcggctcagatcacccag

SEQ ID NO: 378837 - DNA, 25 bp, Artificial Sequence
  Description of Artificial Sequence: Synthetic oligonucleotide
gacactgcggctcagatcacccagc

SEQ ID NO: 378838 - DNA, 25 bp, Artificial Sequence
  Description of Artificial Sequence: Synthetic oligonucleotide
acactgcggctcagatcacccagcg

SEQ ID NO: 378839 - DNA, 24 bp, Artificial Sequence
  Description of Artificial Sequence: Synthetic oligonucleotide
cactgcggctcagatcacccagcg

SEQ ID NO: 378840 - DNA, 26 bp, Artificial Sequence
  Description of Artificial Sequence: Synthetic oligonucleotide
actgcggctcagatcacccagcgcaa

SEQ ID NO: 378841 - DNA, 25 bp, Artificial Sequence
  Description of Artificial Sequence: Synthetic oligonucleotide
ctgcggctcagatcacccagcgcaa

SEQ ID NO: 378842 - DNA, 26 bp, Artificial Sequence
  Description of Artificial Sequence: Synthetic oligonucleotide
tgcggctcagatcacccagcgcaagt

SEQ ID NO: 378843 - DNA, 29 bp, Artificial Sequence
  Description of Artificial Sequence: Synthetic oligonucleotide
gggagacacagatctccaagaccaacacg

SEQ ID NO: 378844 - DNA, 29 bp, Artificial Sequence
  Description of Artificial Sequence: Synthetic oligonucleotide
ggagacacagatctccaagaccaacacgc

SEQ ID NO: 378845 - DNA, 30 bp, Artificial Sequence; identical to SEQ ID NO: 35887
  Description of Artificial Sequence: Synthetic oligonucleotide

SEQ ID NO: 378846 - DNA, 31 bp, Artificial Sequence; identical to SEQ ID NO: 35888
  Description of Artificial Sequence: Synthetic oligonucleotide

SEQ ID NO: 378847 - DNA, 30 bp, Artificial Sequence; identical to SEQ ID NO: 35889
  Description of Artificial Sequence: Synthetic oligonucleotide

SEQ ID NO: 378848 - DNA, 33 bp, Artificial Sequence; identical to SEQ ID NO: 35890
  Description of Artificial Sequence: Synthetic oligonucleotide

SEQ ID NO: 378849 - DNA, 32 bp, Artificial Sequence; identical to SEQ ID NO: 35891
  Description of Artificial Sequence: Synthetic oligonucleotide

SEQ ID NO: 378850 - DNA, 32 bp, Artificial Sequence; identical to SEQ ID NO: 35892
  Description of Artificial Sequence: Synthetic oligonucleotide

SEQ ID NO: 378851 - DNA, 31 bp, Artificial Sequence; identical to SEQ ID NO: 35893
  Description of Artificial Sequence: Synthetic oligonucleotide

SEQ ID NO: 378852 - DNA, 31 bp, Artificial Sequence; identical to SEQ ID NO: 35894
  Description of Artificial Sequence: Synthetic oligonucleotide

SEQ ID NO: 378853 - DNA, 30 bp, Artificial Sequence; identical to SEQ ID NO: 35895
  Description of Artificial Sequence: Synthetic oligonucleotide

SEQ ID NO: 378854 - DNA, 31 bp, Artificial Sequence; identical to SEQ ID NO: 35896
  Description of Artificial Sequence: Synthetic oligonucleotide

SEQ ID NO: 378855 - DNA, 30 bp, Artificial Sequence; identical to SEQ ID NO: 35897
  Description of Artificial Sequence: Synthetic oligonucleotide

SEQ ID NO: 378856 - DNA, 29 bp, Artificial Sequence
  Description of Artificial Sequence: Synthetic oligonucleotide
ctccaagaccaacacgcagacttaccgag

SEQ ID NO: 378857 - DNA, 30 bp, Artificial Sequence; identical to SEQ ID NO: 35899
  Description of Artificial Sequence: Synthetic oligonucleotide

SEQ ID NO: 378858 - DNA, 29 bp, Artificial Sequence
  Description of Artificial Sequence: Synthetic oligonucleotide
ccaagaccaacacgcagacttaccgagag

SEQ ID NO: 378859 - DNA, 31 bp, Artificial Sequence; identical to SEQ ID NO: 35901
  Description of Artificial Sequence: Synthetic oligonucleotide

SEQ ID NO: 378860 - DNA, 31 bp, Artificial Sequence; identical to SEQ ID NO: 35902
  Description of Artificial Sequence: Synthetic oligonucleotide

SEQ ID NO: 378861 - DNA, 30 bp, Artificial Sequence; identical to SEQ ID NO: 35903
  Description of Artificial Sequence: Synthetic oligonucleotide

SEQ ID NO: 378862 - DNA, 29 bp, Artificial Sequence
  Description of Artificial Sequence: Synthetic oligonucleotide
gaccaacacgcagacttaccgagagaacc

SEQ ID NO: 378863 - DNA, 30 bp, Artificial Sequence; identical to SEQ ID NO: 35905
  Description of Artificial Sequence: Synthetic oligonucleotide

SEQ ID NO: 378864 - DNA, 29 bp, Artificial Sequence
  Description of Artificial Sequence: Synthetic oligonucleotide
ccaacacgcagacttaccgagagaacctg

SEQ ID NO: 378865 - DNA, 29 bp, Artificial Sequence
  Description of Artificial Sequence: Synthetic oligonucleotide
caacacgcagacttaccgagagaacctgc

SEQ ID NO: 378866 - DNA, 29 bp, Artificial Sequence
  Description of Artificial Sequence: Synthetic oligonucleotide
aacacgcagacttaccgagagaacctgcg

SEQ ID NO: 378867 - DNA, 28 bp, Artificial Sequence
  Description of Artificial Sequence: Synthetic oligonucleotide
acacgcagacttaccgagagaacctgcg

SEQ ID NO: 378868 - DNA, 27 bp, Artificial Sequence
  Description of Artificial Sequence: Synthetic oligonucleotide
cacgcagacttaccgagagaacctgcg

SEQ ID NO: 378869 - DNA, 27 bp, Artificial Sequence
  Description of Artificial Sequence: Synthetic oligonucleotide
acgcagacttaccgagagaacctgcgc

SEQ ID NO: 378870 - DNA, 27 bp, Artificial Sequence
  Description of Artificial Sequence: Synthetic oligonucleotide
cgcagacttaccgagagaacctgcgca

SEQ ID NO: 378871 - DNA, 27 bp, Artificial Sequence
  Description of Artificial Sequence: Synthetic oligonucleotide
gcagacttaccgagagaacctgcgcac

SEQ ID NO: 378872 - DNA, 23 bp, Artificial Sequence
  Description of Artificial Sequence: Synthetic oligonucleotide
acgggcgcctccttcgcgggtat

SEQ ID NO: 378873 - DNA, 22 bp, Artificial Sequence
  Description of Artificial Sequence: Synthetic oligonucleotide
cgggcgcctccttcgcgggtat

SEQ ID NO: 378874 - DNA, 23 bp, Artificial Sequence
  Description of Artificial Sequence: Synthetic oligonucleotide
gggcgcctccttcgcgggtatga

SEQ ID NO: 378875 - DNA, 23 bp, Artificial Sequence
  Description of Artificial Sequence: Synthetic oligonucleotide
ggcgcctccttcgcgggtatgac

SEQ ID NO: 378876 - DNA, 24 bp, Artificial Sequence
  Description of Artificial Sequence: Synthetic oligonucleotide
gcgcctccttcgcgggtatgacca

SEQ ID NO: 378877 - DNA, 24 bp, Artificial Sequence
  Description of Artificial Sequence: Synthetic oligonucleotide
cgcctccttcgcgggtatgaccag

SEQ ID NO: 378878 - DNA, 25 bp, Artificial Sequence
  Description of Artificial Sequence: Synthetic oligonucleotide
gcctccttcgcgggtatgaccagga

SEQ ID NO: 378879 - DNA, 25 bp, Artificial Sequence
  Description of Artificial Sequence: Synthetic oligonucleotide
cctccttcgcgggtatgaccaggac

SEQ ID NO: 378880 - DNA, 25 bp, Artificial Sequence
  Description of Artificial Sequence: Synthetic oligonucleotide
ctccttcgcgggtatgaccaggacg

SEQ ID NO: 378881 - DNA, 25 bp, Artificial Sequence
  Description of Artificial Sequence: Synthetic oligonucleotide
tccttcgcgggtatgaccaggacgc

SEQ ID NO: 378882 - DNA, 24 bp, Artificial Sequence
  Description of Artificial Sequence: Synthetic oligonucleotide
ccttcgcgggtatgaccaggacgc

SEQ ID NO: 378883 - DNA, 26 bp, Artificial Sequence
  Description of Artificial Sequence: Synthetic oligonucleotide
cttcgcgggtatgaccaggacgccta

SEQ ID NO: 378884 - DNA, 26 bp, Artificial Sequence
  Description of Artificial Sequence: Synthetic oligonucleotide
ttcgcgggtatgaccaggacgcctac

SEQ ID NO: 378885 - DNA, 25 bp, Artificial Sequence
  Description of Artificial Sequence: Synthetic oligonucleotide
tcgcgggtatgaccaggacgcctac

SEQ ID NO: 378886 - DNA, 24 bp, Artificial Sequence
  Description of Artificial Sequence: Synthetic oligonucleotide
ctggagggcctgtgcgtggagtca

SEQ ID NO: 378887 - DNA, 25 bp, Artificial Sequence
  Description of Artificial Sequence: Synthetic oligonucleotide
tggagggcctgtgcgtggagtcact

SEQ ID NO: 378888 - DNA, 24 bp, Artificial Sequence
  Description of Artificial Sequence: Synthetic oligonucleotide
ggagggcctgtgcgtggagtcact

SEQ ID NO: 378889 - DNA, 24 bp, Artificial Sequence
  Description of Artificial Sequence: Synthetic oligonucleotide
gagggcctgtgcgtggagtcactc

SEQ ID NO: 378890 - DNA, 24 bp, Artificial Sequence
  Description of Artificial Sequence: Synthetic oligonucleotide
agggcctgtgcgtggagtcactcc

SEQ ID NO: 378891 - DNA, 23 bp, Artificial Sequence
  Description of Artificial Sequence: Synthetic oligonucleotide
gggcctgtgcgtggagtcactcc

SEQ ID NO: 378892 - DNA, 23 bp, Artificial Sequence
  Description of Artificial Sequence: Synthetic oligonucleotide
ggcctgtgcgtggagtcactccg

SEQ ID NO: 378893 - DNA, 24 bp, Artificial Sequence
  Description of Artificial Sequence: Synthetic oligonucleotide
gcctgtgcgtggagtcactccgca

SEQ ID NO: 378894 - DNA, 27 bp, Artificial Sequence
  Description of Artificial Sequence: Synthetic oligonucleotide
cctgtgcgtggagtcactccgcagata

SEQ ID NO: 378895 - DNA, 27 bp, Artificial Sequence
  Description of Artificial Sequence: Synthetic oligonucleotide
ctgtgcgtggagtcactccgcagatac

SEQ ID NO: 378896 - DNA, 27 bp, Artificial Sequence
  Description of Artificial Sequence: Synthetic oligonucleotide
tgtgcgtggagtcactccgcagatacc

SEQ ID NO: 378897 - DNA, 27 bp, Artificial Sequence
  Description of Artificial Sequence: Synthetic oligonucleotide
gtgcgtggagtcactccgcagatacct

SEQ ID NO: 378898 - DNA, 27 bp, Artificial Sequence
  Description of Artificial Sequence: Synthetic oligonucleotide
tgcgtggagtcactccgcagatacctg

SEQ ID NO: 378899 - DNA, 26 bp, Artificial Sequence
  Description of Artificial Sequence: Synthetic oligonucleotide
gcgtggagtcactccgcagatacctg

SEQ ID NO: 378900 - DNA, 27 bp, Artificial Sequence
  Description of Artificial Sequence: Synthetic oligonucleotide
cgtggagtcactccgcagatacctgga

SEQ ID NO: 378901 - DNA, 27 bp, Artificial Sequence
  Description of Artificial Sequence: Synthetic oligonucleotide
gtggagtcactccgcagatacctggag

SEQ ID NO: 378902 - DNA, 29 bp, Artificial Sequence
  Description of Artificial Sequence: Synthetic oligonucleotide
tggagtcactccgcagatacctggagaac

SEQ ID NO: 378903 - DNA, 28 bp, Artificial Sequence
  Description of Artificial Sequence: Synthetic oligonucleotide
ggagtcactccgcagatacctggagaac

SEQ ID NO: 378904 - DNA, 28 bp, Artificial Sequence
  Description of Artificial Sequence: Synthetic oligonucleotide
gagtcactccgcagatacctggagaacg

SEQ ID NO: 378905 - DNA, 28 bp, Artificial Sequence
  Description of Artificial Sequence: Synthetic oligonucleotide
agtcactccgcagatacctggagaacgg

SEQ ID NO: 378906 - DNA, 27 bp, Artificial Sequence
  Description of Artificial Sequence: Synthetic oligonucleotide
gtcactccgcagatacctggagaacgg

SEQ ID NO: 378907 - DNA, 27 bp, Artificial Sequence
  Description of Artificial Sequence: Synthetic oligonucleotide
tcactccgcagatacctggagaacggg

SEQ ID NO: 378908 - DNA, 27 bp, Artificial Sequence
  Description of Artificial Sequence: Synthetic oligonucleotide
cactccgcagatacctggagaacggga

SEQ ID NO: 378909 - DNA, 28 bp, Artificial Sequence
  Description of Artificial Sequence: Synthetic oligonucleotide
actccgcagatacctggagaacgggaag

SEQ ID NO: 378910 - DNA, 26 bp, Artificial Sequence
  Description of Artificial Sequence: Synthetic oligonucleotide
cgtgtggcggagcaggacagagctta

SEQ ID NO: 378911 - DNA, 26 bp, Artificial Sequence
  Description of Artificial Sequence: Synthetic oligonucleotide
gtgtggcggagcaggacagagcttac

SEQ ID NO: 378912 - DNA, 27 bp, Artificial Sequence
  Description of Artificial Sequence: Synthetic oligonucleotide
tgtggcggagcaggacagagcttacct

SEQ ID NO: 378913 - DNA, 26 bp, Artificial Sequence
  Description of Artificial Sequence: Synthetic oligonucleotide
gtggcggagcaggacagagcttacct

SEQ ID NO: 378914 - DNA, 26 bp, Artificial Sequence
  Description of Artificial Sequence: Synthetic oligonucleotide
tggcggagcaggacagagcttacctg

SEQ ID NO: 378915 - DNA, 25 bp, Artificial Sequence
  Description of Artificial Sequence: Synthetic oligonucleotide
ggcggagcaggacagagcttacctg

SEQ ID NO: 378916 - DNA, 26 bp, Artificial Sequence
  Description of Artificial Sequence: Synthetic oligonucleotide
gcggagcaggacagagcttacctgga

SEQ ID NO: 378917 - DNA, 26 bp, Artificial Sequence
  Description of Artificial Sequence: Synthetic oligonucleotide
cggagcaggacagagcttacctggag

SEQ ID NO: 378918 - DNA, 26 bp, Artificial Sequence
  Description of Artificial Sequence: Synthetic oligonucleotide
ggagcaggacagagcttacctggagg

SEQ ID NO: 378919 - DNA, 26 bp, Artificial Sequence
  Description of Artificial Sequence: Synthetic oligonucleotide
gagcaggacagagcttacctggaggg

SEQ ID NO: 378920 - DNA, 26 bp, Artificial Sequence
  Description of Artificial Sequence: Synthetic oligonucleotide
agcaggacagagcttacctggagggc

SEQ ID NO: 378921 - DNA, 25 bp, Artificial Sequence
  Description of Artificial Sequence: Synthetic oligonucleotide
gcaggacagagcttacctggagggc

SEQ ID NO: 378922 - DNA, 26 bp, Artificial Sequence
  Description of Artificial Sequence: Synthetic oligonucleotide
caggacagagcttacctggagggcct

SEQ ID NO: 378923 - DNA, 27 bp, Artificial Sequence
  Description of Artificial Sequence: Synthetic oligonucleotide
aggacagagcttacctggagggcctgt

SEQ ID NO: 378924 - DNA, 26 bp, Artificial Sequence
  Description of Artificial Sequence: Synthetic oligonucleotide
ggacagagcttacctggagggcctgt

SEQ ID NO: 378925 - DNA, 26 bp, Artificial Sequence
  Description of Artificial Sequence: Synthetic oligonucleotide
gacagagcttacctggagggcctgtg

SEQ ID NO: 378926 - DNA, 26 bp, Artificial Sequence
  Description of Artificial Sequence: Synthetic oligonucleotide
acagagcttacctggagggcctgtgc

SEQ ID NO: 378927 - DNA, 25 bp, Artificial Sequence
  Description of Artificial Sequence: Synthetic oligonucleotide
cagagcttacctggagggcctgtgc

SEQ ID NO: 378928 - DNA, 20 bp, Artificial Sequence
  Description of Artificial Sequence: Synthetic oligonucleotide
gggccggacgggcgccttct

SEQ ID NO: 378929 - DNA, 20 bp, Artificial Sequence
  Description of Artificial Sequence: Synthetic oligonucleotide
ggccggacgggcgccttctc

SEQ ID NO: 378930 - DNA, 20 bp, Artificial Sequence
  Description of Artificial Sequence: Synthetic oligonucleotide
gccggacgggcgccttctcc

SEQ ID NO: 378931 - DNA, 20 bp, Artificial Sequence
  Description of Artificial Sequence: Synthetic oligonucleotide
ccggacgggcgccttctccg

SEQ ID NO: 378932 - DNA, 20 bp, Artificial Sequence
  Description of Artificial Sequence: Synthetic oligonucleotide
cggacgggcgccttctccgc

SEQ ID NO: 378933 - DNA, 20 bp, Artificial Sequence
  Description of Artificial Sequence: Synthetic oligonucleotide
ggacgggcgccttctccgcg

SEQ ID NO: 378934 - DNA, 20 bp, Artificial Sequence
  Description of Artificial Sequence: Synthetic oligonucleotide
gacgggcgccttctccgcgg

SEQ ID NO: 378935 - DNA, 23 bp, Artificial Sequence
  Description of Artificial Sequence: Synthetic oligonucleotide
acgggcgccttctccgcgggtat

SEQ ID NO: 378936 - DNA, 22 bp, Artificial Sequence
  Description of Artificial Sequence: Synthetic oligonucleotide
cgggcgccttctccgcgggtat

SEQ ID NO: 378937 - DNA, 23 bp, Artificial Sequence
  Description of Artificial Sequence: Synthetic oligonucleotide
gggcgccttctccgcgggtatga

SEQ ID NO: 378938 - DNA, 23 bp, Artificial Sequence
  Description of Artificial Sequence: Synthetic oligonucleotide
ggcgccttctccgcgggtatgac

SEQ ID NO: 378939 - DNA, 24 bp, Artificial Sequence
  Description of Artificial Sequence: Synthetic oligonucleotide
gcgccttctccgcgggtatgacca

SEQ ID NO: 378940 - DNA, 24 bp, Artificial Sequence
  Description of Artificial Sequence: Synthetic oligonucleotide
cgccttctccgcgggtatgaccag

SEQ ID NO: 378941 - DNA, 25 bp, Artificial Sequence
  Description of Artificial Sequence: Synthetic oligonucleotide
gccttctccgcgggtatgaccagga

SEQ ID NO: 378942 - DNA, 25 bp, Artificial Sequence
  Description of Artificial Sequence: Synthetic oligonucleotide
ccttctccgcgggtatgaccaggac

SEQ ID NO: 378943 - DNA, 25 bp, Artificial Sequence
  Description of Artificial Sequence: Synthetic oligonucleotide
cttctccgcgggtatgaccaggacg

SEQ ID NO: 378944 - DNA, 25 bp, Artificial Sequence
  Description of Artificial Sequence: Synthetic oligonucleotide
ttctccgcgggtatgaccaggacgc

SEQ ID NO: 378945 - DNA, 24 bp, Artificial Sequence
  Description of Artificial Sequence: Synthetic oligonucleotide
tctccgcgggtatgaccaggacgc

SEQ ID NO: 378946 - DNA, 26 bp, Artificial Sequence
  Description of Artificial Sequence: Synthetic oligonucleotide
gttcgacagcgacgccacgagtccta

SEQ ID NO: 378947 - DNA, 26 bp, Artificial Sequence
  Description of Artificial Sequence: Synthetic oligonucleotide
ttcgacagcgacgccacgagtcctag

SEQ ID NO: 378948 - DNA, 25 bp, Artificial Sequence
  Description of Artificial Sequence: Synthetic oligonucleotide
tcgacagcgacgccacgagtcctag

SEQ ID NO: 378949 - DNA, 24 bp, Artificial Sequence
  Description of Artificial Sequence: Synthetic oligonucleotide
cgacagcgacgccacgagtcctag

SEQ ID NO: 378950 - DNA, 26 bp, Artificial Sequence
  Description of Artificial Sequence: Synthetic oligonucleotide
gacagcgacgccacgagtcctaggaa

SEQ ID NO: 378951 - DNA, 26 bp, Artificial Sequence
  Description of Artificial Sequence: Synthetic oligonucleotide
acagcgacgccacgagtcctaggaag

SEQ ID NO: 378952 - DNA, 25 bp, Artificial Sequence
  Description of Artificial Sequence: Synthetic oligonucleotide
cagcgacgccacgagtcctaggaag

SEQ ID NO: 378953 - DNA, 26 bp, Artificial Sequence
  Description of Artificial Sequence: Synthetic oligonucleotide
agcgacgccacgagtcctaggaagga

SEQ ID NO: 378954 - DNA, 25 bp, Artificial Sequence
  Description of Artificial Sequence: Synthetic oligonucleotide
gcgacgccacgagtcctaggaagga

SEQ ID NO: 378955 - DNA, 25 bp, Artificial Sequence
  Description of Artificial Sequence: Synthetic oligonucleotide
cgacgccacgagtcctaggaaggag

SEQ ID NO: 378956 - DNA, 25 bp, Artificial Sequence
  Description of Artificial Sequence: Synthetic oligonucleotide
gacgccacgagtcctaggaaggagc

SEQ ID NO: 378957 - DNA, 25 bp, Artificial Sequence
  Description of Artificial Sequence: Synthetic oligonucleotide
acgccacgagtcctaggaaggagcc

SEQ ID NO: 378958 - DNA, 24 bp, Artificial Sequence
  Description of Artificial Sequence: Synthetic oligonucleotide
cgccacgagtcctaggaaggagcc

SEQ ID NO: 378959 - DNA, 24 bp, Artificial Sequence
  Description of Artificial Sequence: Synthetic oligonucleotide
gccacgagtcctaggaaggagccg

SEQ ID NO: 378960 - DNA, 24 bp, Artificial Sequence
  Description of Artificial Sequence: Synthetic oligonucleotide
ccacgagtcctaggaaggagccgc

SEQ ID NO: 378961 - DNA, 24 bp, Artificial Sequence
  Description of Artificial Sequence: Synthetic oligonucleotide
cacgagtcctaggaaggagccgcg

SEQ ID NO: 378962 - DNA, 24 bp, Artificial Sequence
  Description of Artificial Sequence: Synthetic oligonucleotide
acgagtcctaggaaggagccgcgg

SEQ ID NO: 378963 - DNA, 23 bp, Artificial Sequence
  Description of Artificial Sequence: Synthetic oligonucleotide
cgagtcctaggaaggagccgcgg

SEQ ID NO: 378964 - DNA, 23 bp, Artificial Sequence
  Description of Artificial Sequence: Synthetic oligonucleotide
gagtcctaggaaggagccgcggg

SEQ ID NO: 378965 - DNA, 23 bp, Artificial Sequence
  Description of Artificial Sequence: Synthetic oligonucleotide
agtcctaggaaggagccgcgggc

SEQ ID NO: 378966 - DNA, 22 bp, Artificial Sequence
  Description of Artificial Sequence: Synthetic oligonucleotide
gtcctaggaaggagccgcgggc

SEQ ID NO: 378967 - DNA, 22 bp, Artificial Sequence
  Description of Artificial Sequence: Synthetic oligonucleotide
tcctaggaaggagccgcgggcg

SEQ ID NO: 378968 - DNA, 21 bp, Artificial Sequence
  Description of Artificial Sequence: Synthetic oligonucleotide
cctaggaaggagccgcgggcg

SEQ ID NO: 378969 - DNA, 21 bp, Artificial Sequence
  Description of Artificial Sequence: Synthetic oligonucleotide
ctaggaaggagccgcgggcgc

SEQ ID NO: 378970 - DNA, 23 bp, Artificial Sequence
  Description of Artificial Sequence: Synthetic oligonucleotide
taggaaggagccgcgggcgccat

SEQ ID NO: 378971 - DNA, 30 bp, Artificial Sequence
  Description of Artificial Sequence: Synthetic oligonucleotide
acatcatccagaggatgtacggctgcgatg

SEQ ID NO: 378972 - DNA, 29 bp, Artificial Sequence
  Description of Artificial Sequence: Synthetic oligonucleotide
catcatccagaggatgtacggctgcgatg

SEQ ID NO: 378973 - DNA, 30 bp, Artificial Sequence
  Description of Artificial Sequence: Synthetic oligonucleotide
atcatccagaggatgtacggctgcgatgtg

SEQ ID NO: 378974 - DNA, 29 bp, Artificial Sequence
  Description of Artificial Sequence: Synthetic oligonucleotide
tcatccagaggatgtacggctgcgatgtg

SEQ ID NO: 378975 - DNA, 28 bp, Artificial Sequence
  Description of Artificial Sequence: Synthetic oligonucleotide
catccagaggatgtacggctgcgatgtg

SEQ ID NO: 378976 - DNA, 28 bp, Artificial Sequence
  Description of Artificial Sequence: Synthetic oligonucleotide
atccagaggatgtacggctgcgatgtgg

SEQ ID NO: 378977 - DNA, 27 bp, Artificial Sequence
  Description of Artificial Sequence: Synthetic oligonucleotide
tccagaggatgtacggctgcgatgtgg

SEQ ID NO: 378978 - DNA, 26 bp, Artificial Sequence
  Description of Artificial Sequence: Synthetic oligonucleotide
ccagaggatgtacggctgcgatgtgg

SEQ ID NO: 378979 - DNA, 26 bp, Artificial Sequence
  Description of Artificial Sequence: Synthetic oligonucleotide
cagaggatgtacggctgcgatgtggg

SEQ ID NO: 378980 - DNA, 26 bp, Artificial Sequence
  Description of Artificial Sequence: Synthetic oligonucleotide
agaggatgtacggctgcgatgtgggg

SEQ ID NO: 378981 - DNA, 25 bp, Artificial Sequence
  Description of Artificial Sequence: Synthetic oligonucleotide
gaggatgtacggctgcgatgtgggg

SEQ ID NO: 378982 - DNA, 25 bp, Artificial Sequence
  Description of Artificial Sequence: Synthetic oligonucleotide
aggatgtacggctgcgatgtggggc

SEQ ID NO: 378983 - DNA, 24 bp, Artificial Sequence
  Description of Artificial Sequence: Synthetic oligonucleotide
ggatgtacggctgcgatgtggggc

SEQ ID NO: 378984 - DNA, 24 bp, Artificial Sequence
  Description of Artificial Sequence: Synthetic oligonucleotide
gatgtacggctgcgatgtggggcc

SEQ ID NO: 378985 - DNA, 24 bp, Artificial Sequence
  Description of Artificial Sequence: Synthetic oligonucleotide
atgtacggctgcgatgtggggccg

SEQ ID NO: 378986 - DNA, 23 bp, Artificial Sequence
  Description of Artificial Sequence: Synthetic oligonucleotide
tgtacggctgcgatgtggggccg

SEQ ID NO: 378987 - DNA, 22 bp, Artificial Sequence
  Description of Artificial Sequence: Synthetic oligonucleotide
gtacggctgcgatgtggggccg

SEQ ID NO: 378988 - DNA, 23 bp, Artificial Sequence
  Description of Artificial Sequence: Synthetic oligonucleotide
tacggctgcgatgtggggccgga

SEQ ID NO: 378989 - DNA, 22 bp, Artificial Sequence
  Description of Artificial Sequence: Synthetic oligonucleotide
acggctgcgatgtggggccgga

SEQ ID NO: 378990 - DNA, 21 bp, Artificial Sequence
  Description of Artificial Sequence: Synthetic oligonucleotide
cggctgcgatgtggggccgga

SEQ ID NO: 378991 - DNA, 20 bp, Artificial Sequence
  Description of Artificial Sequence: Synthetic oligonucleotide
atgtggggccggacgggcgc

SEQ ID NO: 378992 - DNA, 20 bp, Artificial Sequence
  Description of Artificial Sequence: Synthetic oligonucleotide
tgtggggccggacgggcgct

SEQ ID NO: 378993 - DNA, 21 bp, Artificial Sequence
  Description of Artificial Sequence: Synthetic oligonucleotide
accgccatgtcccggcccggt

SEQ ID NO: 378994 - DNA, 20 bp, Artificial Sequence
  Description of Artificial Sequence: Synthetic oligonucleotide
cgccatgtcccggcccggtc

SEQ ID NO: 378995 - DNA, 20 bp, Artificial Sequence
  Description of Artificial Sequence: Synthetic oligonucleotide
gccatgtcccggcccggtcg

SEQ ID NO: 378996 - DNA, 20 bp, Artificial Sequence
  Description of Artificial Sequence: Synthetic oligonucleotide
ccatgtcccggcccggtcgc

SEQ ID NO: 378997 - DNA, 20 bp, Artificial Sequence
  Description of Artificial Sequence: Synthetic oligonucleotide
catgtcccggcccggtcgcg

SEQ ID NO: 378998 - DNA, 20 bp, Artificial Sequence
  Description of Artificial Sequence: Synthetic oligonucleotide
atgtcccggcccggtcgcgg

SEQ ID NO: 378999 - DNA, 20 bp, Artificial Sequence
  Description of Artificial Sequence: Synthetic oligonucleotide
tgtcccggcccggtcgcggt

SEQ ID NO: 379000 - DNA, 20 bp, Artificial Sequence
  Description of Artificial Sequence: Synthetic oligonucleotide
gtcccggcccggtcgcggtt

SEQ ID NO: 379001 - DNA, 20 bp, Artificial Sequence
  Description of Artificial Sequence: Synthetic oligonucleotide
tcccggcccggtcgcgggtt

SEQ ID NO: 379002 - DNA, 20 bp, Artificial Sequence
  Description of Artificial Sequence: Synthetic oligonucleotide
cccggcccggtcgcgggttt

SEQ ID NO: 379003 - DNA, 20 bp, Artificial Sequence
  Description of Artificial Sequence: Synthetic oligonucleotide
ccggcccggtcgcggggatt

SEQ ID NO: 379004 - DNA, 20 bp, Artificial Sequence
  Description of Artificial Sequence: Synthetic oligonucleotide
cggcccggtcgcggggagtt

SEQ ID NO: 379005 - DNA, 20 bp, Artificial Sequence
  Description of Artificial Sequence: Synthetic oligonucleotide
ggcccggtcgcggggagctt

SEQ ID NO: 379006 - DNA, 20 bp, Artificial Sequence
  Description of Artificial Sequence: Synthetic oligonucleotide
gcccggtcgcggggagcctt

SEQ ID NO: 379007 - DNA, 20 bp, Artificial Sequence
  Description of Artificial Sequence: Synthetic oligonucleotide
cccggtcgcggggagccctt

SEQ ID NO: 379008 - DNA, 20 bp, Artificial Sequence
  Description of Artificial Sequence: Synthetic oligonucleotide
ccggtcgcggggagcccctt

SEQ ID NO: 379009 - DNA, 20 bp, Artificial Sequence
  Description of Artificial Sequence: Synthetic oligonucleotide
cggtcgcggggagccccgtt

SEQ ID NO: 379010 - DNA, 20 bp, Artificial Sequence
  Description of Artificial Sequence: Synthetic oligonucleotide
ggtcgcggggagccccgctt

SEQ ID NO: 379011 - DNA, 22 bp, Artificial Sequence
  Description of Artificial Sequence: Synthetic oligonucleotide
gtcgcggggagccccgcttcat

SEQ ID NO: 379012 - DNA, 23 bp, Artificial Sequence
  Description of Artificial Sequence: Synthetic oligonucleotide
tcgcggggagccccgcttcatca

SEQ ID NO: 379013 - DNA, 24 bp, Artificial Sequence
  Description of Artificial Sequence: Synthetic oligonucleotide
aacgggaaggagaccctgcagcgc

SEQ ID NO: 379014 - DNA, 23 bp, Artificial Sequence
  Description of Artificial Sequence: Synthetic oligonucleotide
acgggaaggagaccctgcagcgc

SEQ ID NO: 379015 - DNA, 22 bp, Artificial Sequence
  Description of Artificial Sequence: Synthetic oligonucleotide
cgggaaggagaccctgcagcgc

SEQ ID NO: 379016 - DNA, 22 bp, Artificial Sequence
  Description of Artificial Sequence: Synthetic oligonucleotide
gggaaggagaccctgcagcgcg

SEQ ID NO: 379017 - DNA, 22 bp, Artificial Sequence
  Description of Artificial Sequence: Synthetic oligonucleotide
ggaaggagaccctgcagcgcgc

SEQ ID NO: 379018 - DNA, 22 bp, Artificial Sequence
  Description of Artificial Sequence: Synthetic oligonucleotide
gaaggagaccctgcagcgcgcg

SEQ ID NO: 379019 - DNA, 23 bp, Artificial Sequence
  Description of Artificial Sequence: Synthetic oligonucleotide
aaggagaccctgcagcgcgcgga

SEQ ID NO: 379020 - DNA, 22 bp, Artificial Sequence
  Description of Artificial Sequence: Synthetic oligonucleotide
aggagaccctgcagcgcgcgga

SEQ ID NO: 379021 - DNA, 21 bp, Artificial Sequence
  Description of Artificial Sequence: Synthetic oligonucleotide
ggagaccctgcagcgcgcgga

SEQ ID NO: 379022 - DNA, 21 bp, Artificial Sequence
  Description of Artificial Sequence: Synthetic oligonucleotide
gagaccctgcagcgcgcggac

SEQ ID NO: 379023 - DNA, 21 bp, Artificial Sequence
  Description of Artificial Sequence: Synthetic oligonucleotide
agaccctgcagcgcgcggacc

SEQ ID NO: 379024 - DNA, 20 bp, Artificial Sequence
  Description of Artificial Sequence: Synthetic oligonucleotide
gaccctgcagcgcgcggacc

SEQ ID NO: 379025 - DNA, 20 bp, Artificial Sequence
  Description of Artificial Sequence: Synthetic oligonucleotide
accctgcagcgcgcggaccc

SEQ ID NO: 379026 - DNA, 20 bp, Artificial Sequence
  Description of Artificial Sequence: Synthetic oligonucleotide
ccctgcagcgcgcggaccct

SEQ ID NO: 379027 - DNA, 20 bp, Artificial Sequence
  Description of Artificial Sequence: Synthetic oligonucleotide
cctgcagcgcgcggacccct

SEQ ID NO: 379028 - DNA, 24 bp, Artificial Sequence
  Description of Artificial Sequence: Synthetic oligonucleotide
atcacccagcgcaagtgggaggcc

SEQ ID NO: 379029 - DNA, 23 bp, Artificial Sequence
  Description of Artificial Sequence: Synthetic oligonucleotide
tcacccagcgcaagtgggaggcc

SEQ ID NO: 379030 - DNA, 22 bp, Artificial Sequence
  Description of Artificial Sequence: Synthetic oligonucleotide
cacccagcgcaagtgggaggcc

SEQ ID NO: 379031 - DNA, 22 bp, Artificial Sequence
  Description of Artificial Sequence: Synthetic oligonucleotide
acccagcgcaagtgggaggccg

SEQ ID NO: 379032 - DNA, 21 bp, Artificial Sequence
  Description of Artificial Sequence: Synthetic oligonucleotide
cccagcgcaagtgggaggccg

SEQ ID NO: 379033 - DNA, 21 bp, Artificial Sequence
  Description of Artificial Sequence: Synthetic oligonucleotide
ccagcgcaagtgggaggccgc

SEQ ID NO: 379034 - DNA, 21 bp, Artificial Sequence
  Description of Artificial Sequence: Synthetic oligonucleotide
cagcgcaagtgggaggccgcc

SEQ ID NO: 379035 - DNA, 21 bp, Artificial Sequence
  Description of Artificial Sequence: Synthetic oligonucleotide
agcgcaagtgggaggccgccc

SEQ ID NO: 379036 - DNA, 20 bp, Artificial Sequence
  Description of Artificial Sequence: Synthetic oligonucleotide
gcgcaagtgggaggccgccc

SEQ ID NO: 379037 - DNA, 21 bp, Artificial Sequence
  Description of Artificial Sequence: Synthetic oligonucleotide
cgcaagtgggaggccgcccgt

SEQ ID NO: 379038 - DNA, 22 bp, Artificial Sequence
  Description of Artificial Sequence: Synthetic oligonucleotide
gcaagtgggaggccgcccgtgt

SEQ ID NO: 379039 - DNA, 22 bp, Artificial Sequence
  Description of Artificial Sequence: Synthetic oligonucleotide
caagtgggaggccgcccgtgtg

SEQ ID NO: 379040 - DNA, 22 bp, Artificial Sequence
  Description of Artificial Sequence: Synthetic oligonucleotide
aagtgggaggccgcccgtgtgg

SEQ ID NO: 379041 - DNA, 21 bp, Artificial Sequence
  Description of Artificial Sequence: Synthetic oligonucleotide
agtgggaggccgcccgtgtgg

SEQ ID NO: 379042 - DNA, 20 bp, Artificial Sequence
  Description of Artificial Sequence: Synthetic oligonucleotide
gtgggaggccgcccgtgtgg

SEQ ID NO: 379043 - DNA, 20 bp, Artificial Sequence
  Description of Artificial Sequence: Synthetic oligonucleotide
tgggaggccgcccgtgtggc

SEQ ID NO: 379044 - DNA, 20 bp, Artificial Sequence
  Description of Artificial Sequence: Synthetic oligonucleotide
gggaggccgcccgtgtggct

SEQ ID NO: 379045 - DNA, 20 bp, Artificial Sequence
  Description of Artificial Sequence: Synthetic oligonucleotide
ggaggccgcccgtgtggcgt

SEQ ID NO: 379046 - DNA, 20 bp, Artificial Sequence
  Description of Artificial Sequence: Synthetic oligonucleotide
gaggccgcccgtgtggcgga

SEQ ID NO: 379047 - DNA, 20 bp, Artificial Sequence
  Description of Artificial Sequence: Synthetic oligonucleotide
aggccgcccgtgtggcggag

SEQ ID NO: 379048 - DNA, 20 bp, Artificial Sequence
  Description of Artificial Sequence: Synthetic oligonucleotide
ggccgcccgtgtggcggagt

SEQ ID NO: 379049 - DNA, 20 bp, Artificial Sequence
  Description of Artificial Sequence: Synthetic oligonucleotide
gccgcccgtgtggcggagca

SEQ ID NO: 379050 - DNA, 20 bp, Artificial Sequence
  Description of Artificial Sequence: Synthetic oligonucleotide
ccgcccgtgtggcggagcag

SEQ ID NO: 379051 - DNA, 21 bp, Artificial Sequence
  Description of Artificial Sequence: Synthetic oligonucleotide
cgcccgtgtggcggagcagga

SEQ ID NO: 379052 - DNA, 27 bp, Artificial Sequence
  Description of Artificial Sequence: Synthetic oligonucleotide
acttaccgagagaacctgcgcaccgca

SEQ ID NO: 379053 - DNA, 26 bp, Artificial Sequence
  Description of Artificial Sequence: Synthetic oligonucleotide
cttaccgagagaacctgcgcaccgca

SEQ ID NO: 379054 - DNA, 27 bp, Artificial Sequence
  Description of Artificial Sequence: Synthetic oligonucleotide
ttaccgagagaacctgcgcaccgcact

SEQ ID NO: 379055 - DNA, 26 bp, Artificial Sequence
  Description of Artificial Sequence: Synthetic oligonucleotide
taccgagagaacctgcgcaccgcact

SEQ ID NO: 379056 - DNA, 25 bp, Artificial Sequence
  Description of Artificial Sequence: Synthetic oligonucleotide
accgagagaacctgcgcaccgcact

SEQ ID NO: 379057 - DNA, 24 bp, Artificial Sequence
  Description of Artificial Sequence: Synthetic oligonucleotide
ccgagagaacctgcgcaccgcact

SEQ ID NO: 379058 - DNA, 24 bp, Artificial Sequence
  Description of Artificial Sequence: Synthetic oligonucleotide
cgagagaacctgcgcaccgcactc

SEQ ID NO: 379059 - DNA, 24 bp, Artificial Sequence
  Description of Artificial Sequence: Synthetic oligonucleotide
gagagaacctgcgcaccgcactcc

SEQ ID NO: 379060 - DNA, 24 bp, Artificial Sequence
  Description of Artificial Sequence: Synthetic oligonucleotide
agagaacctgcgcaccgcactccg

SEQ ID NO: 379061 - DNA, 23 bp, Artificial Sequence
  Description of Artificial Sequence: Synthetic oligonucleotide
gagaacctgcgcaccgcactccg

SEQ ID NO: 379062 - DNA, 25 bp, Artificial Sequence
  Description of Artificial Sequence: Synthetic oligonucleotide
agaacctgcgcaccgcactccgcta

SEQ ID NO: 379063 - DNA, 24 bp, Artificial Sequence
  Description of Artificial Sequence: Synthetic oligonucleotide
gaacctgcgcaccgcactccgcta

SEQ ID NO: 379064 - DNA, 26 bp, Artificial Sequence
  Description of Artificial Sequence: Synthetic oligonucleotide
aacctgcgcaccgcactccgctacta

SEQ ID NO: 379065 - DNA, 25 bp, Artificial Sequence
  Description of Artificial Sequence: Synthetic oligonucleotide
acctgcgcaccgcactccgctacta

SEQ ID NO: 379066 - DNA, 24 bp, Artificial Sequence
  Description of Artificial Sequence: Synthetic oligonucleotide
cctgcgcaccgcactccgctacta

SEQ ID NO: 379067 - DNA, 26 bp, Artificial Sequence
  Description of Artificial Sequence: Synthetic oligonucleotide
ctgcgcaccgcactccgctactacaa

SEQ ID NO: 379068 - DNA, 26 bp, Artificial Sequence
  Description of Artificial Sequence: Synthetic oligonucleotide
tgcgcaccgcactccgctactacaac

SEQ ID NO: 379069 - DNA, 25 bp, Artificial Sequence
  Description of Artificial Sequence: Synthetic oligonucleotide
gcgcaccgcactccgctactacaac

SEQ ID NO: 379070 - DNA, 26 bp, Artificial Sequence
  Description of Artificial Sequence: Synthetic oligonucleotide
cgcaccgcactccgctactacaacca

SEQ ID NO: 379071 - DNA, 27 bp, Artificial Sequence
  Description of Artificial Sequence: Synthetic oligonucleotide
gcaccgcactccgctactacaaccaga

SEQ ID NO: 379072 - DNA, 27 bp, Artificial Sequence
  Description of Artificial Sequence: Synthetic oligonucleotide
caccgcactccgctactacaaccagag

SEQ ID NO: 379073 - DNA, 27 bp, Artificial Sequence
  Description of Artificial Sequence: Synthetic oligonucleotide
accgcactccgctactacaaccagagc

SEQ ID NO: 379074 - DNA, 26 bp, Artificial Sequence
  Description of Artificial Sequence: Synthetic oligonucleotide
ccgcactccgctactacaaccagagc

SEQ ID NO: 379075 - DNA, 27 bp, Artificial Sequence
  Description of Artificial Sequence: Synthetic oligonucleotide
cgcactccgctactacaaccagagcga

SEQ ID NO: 379076 - DNA, 27 bp, Artificial Sequence
  Description of Artificial Sequence: Synthetic oligonucleotide
gcactccgctactacaaccagagcgag

SEQ ID NO: 379077 - DNA, 27 bp, Artificial Sequence
  Description of Artificial Sequence: Synthetic oligonucleotide
cactccgctactacaaccagagcgagg

SEQ ID NO: 379078 - DNA, 22 bp, Artificial Sequence
  Description of Artificial Sequence: Synthetic oligonucleotide
cggggagccccgcttcatcacg

SEQ ID NO: 379079 - DNA, 23 bp, Artificial Sequence
  Description of Artificial Sequence: Synthetic oligonucleotide
ggggagccccgcttcatcacggt

SEQ ID NO: 379080 - DNA, 23 bp, Artificial Sequence
  Description of Artificial Sequence: Synthetic oligonucleotide
gggagccccgcttcatcacggtg

SEQ ID NO: 379081 - DNA, 23 bp, Artificial Sequence
  Description of Artificial Sequence: Synthetic oligonucleotide
ggagccccgcttcatcacggtgg

SEQ ID NO: 379082 - DNA, 23 bp, Artificial Sequence
  Description of Artificial Sequence: Synthetic oligonucleotide
gagccccgcttcatcacggtggg

SEQ ID NO: 379083 - DNA, 25 bp, Artificial Sequence
  Description of Artificial Sequence: Synthetic oligonucleotide
agccccgcttcatcacggtgggcta

SEQ ID NO: 379084 - DNA, 24 bp, Artificial Sequence
  Description of Artificial Sequence: Synthetic oligonucleotide
gccccgcttcatcacggtgggcta

SEQ ID NO: 379085 - DNA, 24 bp, Artificial Sequence
  Description of Artificial Sequence: Synthetic oligonucleotide
ccccgcttcatcacggtgggctac

SEQ ID NO: 379086 - DNA, 25 bp, Artificial Sequence
  Description of Artificial Sequence: Synthetic oligonucleotide
cccgcttcatcacggtgggctacgt

SEQ ID NO: 379087 - DNA, 25 bp, Artificial Sequence
  Description of Artificial Sequence: Synthetic oligonucleotide
ccgcttcatcacggtgggctacgtg

SEQ ID NO: 379088 - DNA, 26 bp, Artificial Sequence
  Description of Artificial Sequence: Synthetic oligonucleotide
cgcttcatcacggtgggctacgtgga

SEQ ID NO: 379089 - DNA, 26 bp, Artificial Sequence
  Description of Artificial Sequence: Synthetic oligonucleotide
gcttcatcacggtgggctacgtggac

SEQ ID NO: 379090 - DNA, 27 bp, Artificial Sequence
  Description of Artificial Sequence: Synthetic oligonucleotide
cttcatcacggtgggctacgtggacga

SEQ ID NO: 379091 - DNA, 27 bp, Artificial Sequence
  Description of Artificial Sequence: Synthetic oligonucleotide
ttcatcacggtgggctacgtggacgac

SEQ ID NO: 379092 - DNA, 27 bp, Artificial Sequence
  Description of Artificial Sequence: Synthetic oligonucleotide
tcatcacggtgggctacgtggacgaca

SEQ ID NO: 379093 - DNA, 26 bp, Artificial Sequence
  Description of Artificial Sequence: Synthetic oligonucleotide
catcacggtgggctacgtggacgaca

SEQ ID NO: 379094 - DNA, 26 bp, Artificial Sequence
  Description of Artificial Sequence: Synthetic oligonucleotide
atcacggtgggctacgtggacgacac

SEQ ID NO: 379095 - DNA, 25 bp, Artificial Sequence
  Description of Artificial Sequence: Synthetic oligonucleotide
tcacggtgggctacgtggacgacac

SEQ ID NO: 379096 - DNA, 24 bp, Artificial Sequence
  Description of Artificial Sequence: Synthetic oligonucleotide
cacggtgggctacgtggacgacac

SEQ ID NO: 379097 - DNA, 24 bp, Artificial Sequence
  Description of Artificial Sequence: Synthetic oligonucleotide
acggtgggctacgtggacgacacg

SEQ ID NO: 379098 - DNA, 24 bp, Artificial Sequence
  Description of Artificial Sequence: Synthetic oligonucleotide
ggtgggctacgtggacgacacgct

SEQ ID NO: 379099 - DNA, 26 bp, Artificial Sequence
  Description of Artificial Sequence: Synthetic oligonucleotide
agccccgcttcatcaccgtgggctat

SEQ ID NO: 379100 - DNA, 25 bp, Artificial Sequence
  Description of Artificial Sequence: Synthetic oligonucleotide
gccccgcttcatcaccgtgggctat

SEQ ID NO: 379101 - DNA, 26 bp, Artificial Sequence
  Description of Artificial Sequence: Synthetic oligonucleotide
ccccgcttcatcaccgtgggctatgt

SEQ ID NO: 379102 - DNA, 26 bp, Artificial Sequence
  Description of Artificial Sequence: Synthetic oligonucleotide
cccgcttcatcaccgtgggctatgtg

SEQ ID NO: 379103 - DNA, 27 bp, Artificial Sequence
  Description of Artificial Sequence: Synthetic oligonucleotide
ccgcttcatcaccgtgggctatgtgga

SEQ ID NO: 379104 - DNA, 27 bp, Artificial Sequence
  Description of Artificial Sequence: Synthetic oligonucleotide
cgcttcatcaccgtgggctatgtggac

SEQ ID NO: 379105 - DNA, 27 bp, Artificial Sequence
  Description of Artificial Sequence: Synthetic oligonucleotide
gcttcatcaccgtgggctatgtggacg

SEQ ID NO: 379106 - DNA, 28 bp, Artificial Sequence
  Description of Artificial Sequence: Synthetic oligonucleotide
cttcatcaccgtgggctatgtggacgac

SEQ ID NO: 379107 - DNA, 29 bp, Artificial Sequence
  Description of Artificial Sequence: Synthetic oligonucleotide
ttcatcaccgtgggctatgtggacgacac

SEQ ID NO: 379108 - DNA, 28 bp, Artificial Sequence
  Description of Artificial Sequence: Synthetic oligonucleotide
tcatcaccgtgggctatgtggacgacac

SEQ ID NO: 379109 - DNA, 27 bp, Artificial Sequence
  Description of Artificial Sequence: Synthetic oligonucleotide
catcaccgtgggctatgtggacgacac

SEQ ID NO: 379110 - DNA, 27 bp, Artificial Sequence
  Description of Artificial Sequence: Synthetic oligonucleotide
atcaccgtgggctatgtggacgacacg

SEQ ID NO: 379111 - DNA, 26 bp, Artificial Sequence
  Description of Artificial Sequence: Synthetic oligonucleotide
tcaccgtgggctatgtggacgacacg

SEQ ID NO: 379112 - DNA, 25 bp, Artificial Sequence
  Description of Artificial Sequence: Synthetic oligonucleotide
caccgtgggctatgtggacgacacg

SEQ ID NO: 379113 - DNA, 26 bp, Artificial Sequence
  Description of Artificial Sequence: Synthetic oligonucleotide
accgtgggctatgtggacgacacgct

SEQ ID NO: 379114 - DNA, 25 bp, Artificial Sequence
  Description of Artificial Sequence: Synthetic oligonucleotide
ccgtgggctatgtggacgacacgct

SEQ ID NO: 379115 - DNA, 27 bp, Artificial Sequence
  Description of Artificial Sequence: Synthetic oligonucleotide
cgtgggctatgtggacgacacgctgtt

SEQ ID NO: 379116 - DNA, 27 bp, Artificial Sequence
  Description of Artificial Sequence: Synthetic oligonucleotide
gtgggctatgtggacgacacgctgttc

SEQ ID NO: 379117 - DNA, 27 bp, Artificial Sequence
  Description of Artificial Sequence: Synthetic oligonucleotide
tgggctatgtggacgacacgctgttcg

SEQ ID NO: 379118 - DNA, 27 bp, Artificial Sequence
  Description of Artificial Sequence: Synthetic oligonucleotide
gggctatgtggacgacacgctgttcgt

SEQ ID NO: 379119 - DNA, 27 bp, Artificial Sequence
  Description of Artificial Sequence: Synthetic oligonucleotide
ggctatgtggacgacacgctgttcgtg

SEQ ID NO: 379120 - DNA, 28 bp, Artificial Sequence
  Description of Artificial Sequence: Synthetic oligonucleotide
gctatgtggacgacacgctgttcgtgag

SEQ ID NO: 379121 - DNA, 28 bp, Artificial Sequence
  Description of Artificial Sequence: Synthetic oligonucleotide
ctatgtggacgacacgctgttcgtgagg

SEQ ID NO: 379122 - DNA, 30 bp, Artificial Sequence
  Description of Artificial Sequence: Synthetic oligonucleotide
tatgtggacgacacgctgttcgtgaggttc

SEQ ID NO: 379123 - DNA, 29 bp, Artificial Sequence
  Description of Artificial Sequence: Synthetic oligonucleotide
atgtggacgacacgctgttcgtgaggttc

SEQ ID NO: 379124 - DNA, 28 bp, Artificial Sequence
  Description of Artificial Sequence: Synthetic oligonucleotide
tgtggacgacacgctgttcgtgaggttc

SEQ ID NO: 379125 - DNA, 25 bp, Artificial Sequence
  Description of Artificial Sequence: Synthetic oligonucleotide
agaagtgggcagctgtggtggtgcc

SEQ ID NO: 379126 - DNA, 24 bp, Artificial Sequence
  Description of Artificial Sequence: Synthetic oligonucleotide
gaagtgggcagctgtggtggtgcc

SEQ ID NO: 379127 - DNA, 25 bp, Artificial Sequence
  Description of Artificial Sequence: Synthetic oligonucleotide
aagtgggcagctgtggtggtgccct

SEQ ID NO: 379128 - DNA, 24 bp, Artificial Sequence
  Description of Artificial Sequence: Synthetic oligonucleotide
agtgggcagctgtggtggtgccct

SEQ ID NO: 379129 - DNA, 23 bp, Artificial Sequence
  Description of Artificial Sequence: Synthetic oligonucleotide
gtgggcagctgtggtggtgccct

SEQ ID NO: 379130 - DNA, 24 bp, Artificial Sequence
  Description of Artificial Sequence: Synthetic oligonucleotide
tgggcagctgtggtggtgccctct

SEQ ID NO: 379131 - DNA, 23 bp, Artificial Sequence
  Description of Artificial Sequence: Synthetic oligonucleotide
gggcagctgtggtggtgccctct

SEQ ID NO: 379132 - DNA, 23 bp, Artificial Sequence
  Description of Artificial Sequence: Synthetic oligonucleotide
ggcagctgtggtggtgccctctg

SEQ ID NO: 379133 - DNA, 24 bp, Artificial Sequence
  Description of Artificial Sequence: Synthetic oligonucleotide
gcagctgtggtggtgccctctgga

SEQ ID NO: 379134 - DNA, 26 bp, Artificial Sequence
  Description of Artificial Sequence: Synthetic oligonucleotide
cagctgtggtggtgccctctggagaa

SEQ ID NO: 379135 - DNA, 27 bp, Artificial Sequence
  Description of Artificial Sequence: Synthetic oligonucleotide
agctgtggtggtgccctctggagaaga

SEQ ID NO: 379136 - DNA, 26 bp, Artificial Sequence
  Description of Artificial Sequence: Synthetic oligonucleotide
gctgtggtggtgccctctggagaaga

SEQ ID NO: 379137 - DNA, 26 bp, Artificial Sequence
  Description of Artificial Sequence: Synthetic oligonucleotide
ctgtggtggtgccctctggagaagag

SEQ ID NO: 379138 - DNA, 27 bp, Artificial Sequence
  Description of Artificial Sequence: Synthetic oligonucleotide
tgtggtggtgccctctggagaagagca

SEQ ID NO: 379139 - DNA, 26 bp, Artificial Sequence
  Description of Artificial Sequence: Synthetic oligonucleotide
gtggtggtgccctctggagaagagca

SEQ ID NO: 379140 - DNA, 27 bp, Artificial Sequence
  Description of Artificial Sequence: Synthetic oligonucleotide
tggtggtgccctctggagaagagcaga

SEQ ID NO: 379141 - DNA, 26 bp, Artificial Sequence
  Description of Artificial Sequence: Synthetic oligonucleotide
ggtggtgccctctggagaagagcaga

SEQ ID NO: 379142 - DNA, 27 bp, Artificial Sequence
  Description of Artificial Sequence: Synthetic oligonucleotide
gtggtgccctctggagaagagcagaga

SEQ ID NO: 379143 - DNA, 29 bp, Artificial Sequence
  Description of Artificial Sequence: Synthetic oligonucleotide
tggtgccctctggagaagagcagagatac

SEQ ID NO: 379144 - DNA, 28 bp, Artificial Sequence
  Description of Artificial Sequence: Synthetic oligonucleotide
ggtgccctctggagaagagcagagatac

SEQ ID NO: 379145 - DNA, 29 bp, Artificial Sequence
  Description of Artificial Sequence: Synthetic oligonucleotide
gtgccctctggagaagagcagagatacac

SEQ ID NO: 379146 - DNA, 31 bp, Artificial Sequence; identical to SEQ ID NO: 36033
  Description of Artificial Sequence: Synthetic oligonucleotide

SEQ ID NO: 379147 - DNA, 30 bp, Artificial Sequence; identical to SEQ ID NO: 36034
  Description of Artificial Sequence: Synthetic oligonucleotide

SEQ ID NO: 379148 - DNA, 30 bp, Artificial Sequence; identical to SEQ ID NO: 36035
  Description of Artificial Sequence: Synthetic oligonucleotide

SEQ ID NO: 379149 - DNA, 30 bp, Artificial Sequence; identical to SEQ ID NO: 36036
  Description of Artificial Sequence: Synthetic oligonucleotide

SEQ ID NO: 379150 - DNA, 32 bp, Artificial Sequence; identical to SEQ ID NO: 36037
  Description of Artificial Sequence: Synthetic oligonucleotide

SEQ ID NO: 379151 - DNA, 32 bp, Artificial Sequence; identical to SEQ ID NO: 36038
  Description of Artificial Sequence: Synthetic oligonucleotide

SEQ ID NO: 379152 - DNA, 31 bp, Artificial Sequence; identical to SEQ ID NO: 36039
  Description of Artificial Sequence: Synthetic oligonucleotide

SEQ ID NO: 379153 - DNA, 32 bp, Artificial Sequence; identical to SEQ ID NO: 36040
  Description of Artificial Sequence: Synthetic oligonucleotide

SEQ ID NO: 379154 - DNA, 31 bp, Artificial Sequence; identical to SEQ ID NO: 36041
  Description of Artificial Sequence: Synthetic oligonucleotide

SEQ ID NO: 379155 - DNA, 30 bp, Artificial Sequence; identical to SEQ ID NO: 36042
  Description of Artificial Sequence: Synthetic oligonucleotide

SEQ ID NO: 379156 - DNA, 29 bp, Artificial Sequence
  Description of Artificial Sequence: Synthetic oligonucleotide
gaaccttccagaagtgggcagctgtagtg

SEQ ID NO: 379157 - DNA, 29 bp, Artificial Sequence
  Description of Artificial Sequence: Synthetic oligonucleotide
aaccttccagaagtgggcagctgtagtgg

SEQ ID NO: 379158 - DNA, 28 bp, Artificial Sequence
  Description of Artificial Sequence: Synthetic oligonucleotide
accttccagaagtgggcagctgtagtgg

SEQ ID NO: 379159 - DNA, 27 bp, Artificial Sequence
  Description of Artificial Sequence: Synthetic oligonucleotide
ccttccagaagtgggcagctgtagtgg

SEQ ID NO: 379160 - DNA, 28 bp, Artificial Sequence
  Description of Artificial Sequence: Synthetic oligonucleotide
cttccagaagtgggcagctgtagtggtg

SEQ ID NO: 379161 - DNA, 28 bp, Artificial Sequence
  Description of Artificial Sequence: Synthetic oligonucleotide
ttccagaagtgggcagctgtagtggtgc

SEQ ID NO: 379162 - DNA, 27 bp, Artificial Sequence
  Description of Artificial Sequence: Synthetic oligonucleotide
tccagaagtgggcagctgtagtggtgc

SEQ ID NO: 379163 - DNA, 26 bp, Artificial Sequence
  Description of Artificial Sequence: Synthetic oligonucleotide
ccagaagtgggcagctgtagtggtgc

SEQ ID NO: 379164 - DNA, 27 bp, Artificial Sequence
  Description of Artificial Sequence: Synthetic oligonucleotide
cagaagtgggcagctgtagtggtgcct

SEQ ID NO: 379165 - DNA, 28 bp, Artificial Sequence
  Description of Artificial Sequence: Synthetic oligonucleotide
agaagtgggcagctgtagtggtgccttc

SEQ ID NO: 379166 - DNA, 27 bp, Artificial Sequence
  Description of Artificial Sequence: Synthetic oligonucleotide
gaagtgggcagctgtagtggtgccttc

SEQ ID NO: 379167 - DNA, 28 bp, Artificial Sequence
  Description of Artificial Sequence: Synthetic oligonucleotide
aagtgggcagctgtagtggtgccttctg

SEQ ID NO: 379168 - DNA, 27 bp, Artificial Sequence
  Description of Artificial Sequence: Synthetic oligonucleotide
agtgggcagctgtagtggtgccttctg

SEQ ID NO: 379169 - DNA, 26 bp, Artificial Sequence
  Description of Artificial Sequence: Synthetic oligonucleotide
gtgggcagctgtagtggtgccttctg

SEQ ID NO: 379170 - DNA, 27 bp, Artificial Sequence
  Description of Artificial Sequence: Synthetic oligonucleotide
tgggcagctgtagtggtgccttctgga

SEQ ID NO: 379171 - DNA, 26 bp, Artificial Sequence
  Description of Artificial Sequence: Synthetic oligonucleotide
gggcagctgtagtggtgccttctgga

SEQ ID NO: 379172 - DNA, 27 bp, Artificial Sequence
  Description of Artificial Sequence: Synthetic oligonucleotide
ggcagctgtagtggtgccttctggaga

SEQ ID NO: 379173 - DNA, 28 bp, Artificial Sequence
  Description of Artificial Sequence: Synthetic oligonucleotide
gcagctgtagtggtgccttctggagaag

SEQ ID NO: 379174 - DNA, 29 bp, Artificial Sequence
  Description of Artificial Sequence: Synthetic oligonucleotide
cagctgtagtggtgccttctggagaagag

SEQ ID NO: 379175 - DNA, 29 bp, Artificial Sequence
  Description of Artificial Sequence: Synthetic oligonucleotide
agctgtagtggtgccttctggagaagagc

SEQ ID NO: 379176 - DNA, 28 bp, Artificial Sequence
  Description of Artificial Sequence: Synthetic oligonucleotide
gctgtagtggtgccttctggagaagagc

SEQ ID NO: 379177 - DNA, 29 bp, Artificial Sequence
  Description of Artificial Sequence: Synthetic oligonucleotide
ctgtagtggtgccttctggagaagagcag

SEQ ID NO: 379178 - DNA, 30 bp, Artificial Sequence; identical to SEQ ID NO: 36065
  Description of Artificial Sequence: Synthetic oligonucleotide

SEQ ID NO: 379179 - DNA, 29 bp, Artificial Sequence
  Description of Artificial Sequence: Synthetic oligonucleotide
gtagtggtgccttctggagaagagcagag

SEQ ID NO: 379180 - DNA, 32 bp, Artificial Sequence; identical to SEQ ID NO: 36067
  Description of Artificial Sequence: Synthetic oligonucleotide

SEQ ID NO: 379181 - DNA, 31 bp, Artificial Sequence; identical to SEQ ID NO: 36068
  Description of Artificial Sequence: Synthetic oligonucleotide

SEQ ID NO: 379182 - DNA, 31 bp, Artificial Sequence; identical to SEQ ID NO: 36069
  Description of Artificial Sequence: Synthetic oligonucleotide

SEQ ID NO: 379183 - DNA, 30 bp, Artificial Sequence; identical to SEQ ID NO: 36070
  Description of Artificial Sequence: Synthetic oligonucleotide

SEQ ID NO: 379184 - DNA, 31 bp, Artificial Sequence; identical to SEQ ID NO: 36071
  Description of Artificial Sequence: Synthetic oligonucleotide

SEQ ID NO: 379185 - DNA, 30 bp, Artificial Sequence; identical to SEQ ID NO: 36072
  Description of Artificial Sequence: Synthetic oligonucleotide

SEQ ID NO: 379186 - DNA, 30 bp, Artificial Sequence; identical to SEQ ID NO: 36073
  Description of Artificial Sequence: Synthetic oligonucleotide

SEQ ID NO: 379187 - DNA, 29 bp, Artificial Sequence
  Description of Artificial Sequence: Synthetic oligonucleotide
catcatccagaggatgtacggctgtgacg

SEQ ID NO: 379188 - DNA, 30 bp, Artificial Sequence; identical to SEQ ID NO: 36075
  Description of Artificial Sequence: Synthetic oligonucleotide

SEQ ID NO: 379189 - DNA, 29 bp, Artificial Sequence
  Description of Artificial Sequence: Synthetic oligonucleotide
tcatccagaggatgtacggctgtgacgtg

SEQ ID NO: 379190 - DNA, 28 bp, Artificial Sequence
  Description of Artificial Sequence: Synthetic oligonucleotide
catccagaggatgtacggctgtgacgtg

SEQ ID NO: 379191 - DNA, 28 bp, Artificial Sequence
  Description of Artificial Sequence: Synthetic oligonucleotide
atccagaggatgtacggctgtgacgtgg

SEQ ID NO: 379192 - DNA, 25 bp, Artificial Sequence
  Description of Artificial Sequence: Synthetic oligonucleotide
tccgcgggtatgaccaggacgcgta

SEQ ID NO: 379193 - DNA, 24 bp, Artificial Sequence
  Description of Artificial Sequence: Synthetic oligonucleotide
ccgcgggtatgaccaggacgcgta

SEQ ID NO: 379194 - DNA, 24 bp, Artificial Sequence
  Description of Artificial Sequence: Synthetic oligonucleotide
cgcgggtatgaccaggacgcgtac

SEQ ID NO: 379195 - DNA, 25 bp, Artificial Sequence
  Description of Artificial Sequence: Synthetic oligonucleotide
gcgggtatgaccaggacgcgtacga

SEQ ID NO: 379196 - DNA, 25 bp, Artificial Sequence
  Description of Artificial Sequence: Synthetic oligonucleotide
cgggtatgaccaggacgcgtacgac

SEQ ID NO: 379197 - DNA, 25 bp, Artificial Sequence
  Description of Artificial Sequence: Synthetic oligonucleotide
gggtatgaccaggacgcgtacgacg

SEQ ID NO: 379198 - DNA, 25 bp, Artificial Sequence
  Description of Artificial Sequence: Synthetic oligonucleotide
ggtatgaccaggacgcgtacgacgg

SEQ ID NO: 379199 - DNA, 27 bp, Artificial Sequence
  Description of Artificial Sequence: Synthetic oligonucleotide
gtatgaccaggacgcgtacgacggcaa

SEQ ID NO: 379200 - DNA, 27 bp, Artificial Sequence
  Description of Artificial Sequence: Synthetic oligonucleotide
tatgaccaggacgcgtacgacggcaag

SEQ ID NO: 379201 - DNA, 26 bp, Artificial Sequence
  Description of Artificial Sequence: Synthetic oligonucleotide
atgaccaggacgcgtacgacggcaag

SEQ ID NO: 379202 - DNA, 25 bp, Artificial Sequence
  Description of Artificial Sequence: Synthetic oligonucleotide
tgaccaggacgcgtacgacggcaag

SEQ ID NO: 379203 - DNA, 24 bp, Artificial Sequence
  Description of Artificial Sequence: Synthetic oligonucleotide
gaccaggacgcgtacgacggcaag

SEQ ID NO: 379204 - DNA, 27 bp, Artificial Sequence
  Description of Artificial Sequence: Synthetic oligonucleotide
accaggacgcgtacgacggcaaggatt

SEQ ID NO: 379205 - DNA, 27 bp, Artificial Sequence
  Description of Artificial Sequence: Synthetic oligonucleotide
ccaggacgcgtacgacggcaaggatta

SEQ ID NO: 379206 - DNA, 27 bp, Artificial Sequence
  Description of Artificial Sequence: Synthetic oligonucleotide
caggacgcgtacgacggcaaggattac

SEQ ID NO: 379207 - DNA, 29 bp, Artificial Sequence
  Description of Artificial Sequence: Synthetic oligonucleotide
aggacgcgtacgacggcaaggattacatc

SEQ ID NO: 379208 - DNA, 28 bp, Artificial Sequence
  Description of Artificial Sequence: Synthetic oligonucleotide
ggacgcgtacgacggcaaggattacatc

SEQ ID NO: 379209 - DNA, 28 bp, Artificial Sequence
  Description of Artificial Sequence: Synthetic oligonucleotide
gacgcgtacgacggcaaggattacatcg

SEQ ID NO: 379210 - DNA, 28 bp, Artificial Sequence
  Description of Artificial Sequence: Synthetic oligonucleotide
acgcgtacgacggcaaggattacatcgc

SEQ ID NO: 379211 - DNA, 27 bp, Artificial Sequence
  Description of Artificial Sequence: Synthetic oligonucleotide
cgcgtacgacggcaaggattacatcgc

SEQ ID NO: 379212 - DNA, 27 bp, Artificial Sequence
  Description of Artificial Sequence: Synthetic oligonucleotide
gcgtacgacggcaaggattacatcgcc

SEQ ID NO: 379213 - DNA, 27 bp, Artificial Sequence
  Description of Artificial Sequence: Synthetic oligonucleotide
cgtacgacggcaaggattacatcgccc

SEQ ID NO: 379214 - DNA, 28 bp, Artificial Sequence
  Description of Artificial Sequence: Synthetic oligonucleotide
gtacgacggcaaggattacatcgccctg

SEQ ID NO: 379215 - DNA, 31 bp, Artificial Sequence; identical to SEQ ID NO: 36102
  Description of Artificial Sequence: Synthetic oligonucleotide

SEQ ID NO: 379216 - DNA, 31 bp, Artificial Sequence; identical to SEQ ID NO: 36103
  Description of Artificial Sequence: Synthetic oligonucleotide

SEQ ID NO: 379217 - DNA, 33 bp, Artificial Sequence; identical to SEQ ID NO: 36104
  Description of Artificial Sequence: Synthetic oligonucleotide

SEQ ID NO: 379218 - DNA, 32 bp, Artificial Sequence; identical to SEQ ID NO: 36105
  Description of Artificial Sequence: Synthetic oligonucleotide

SEQ ID NO: 379219 - DNA, 33 bp, Artificial Sequence; identical to SEQ ID NO: 36106
  Description of Artificial Sequence: Synthetic oligonucleotide

SEQ ID NO: 379220 - DNA, 33 bp, Artificial Sequence; identical to SEQ ID NO: 36107
  Description of Artificial Sequence: Synthetic oligonucleotide

SEQ ID NO: 379221 - DNA, 33 bp, Artificial Sequence; identical to SEQ ID NO: 36108
  Description of Artificial Sequence: Synthetic oligonucleotide

SEQ ID NO: 379222 - DNA, 32 bp, Artificial Sequence; identical to SEQ ID NO: 36109
  Description of Artificial Sequence: Synthetic oligonucleotide

SEQ ID NO: 379223 - DNA, 32 bp, Artificial Sequence; identical to SEQ ID NO: 36110
  Description of Artificial Sequence: Synthetic oligonucleotide

SEQ ID NO: 379224 - DNA, 31 bp, Artificial Sequence; identical to SEQ ID NO: 36111
  Description of Artificial Sequence: Synthetic oligonucleotide

SEQ ID NO: 379225 - DNA, 31 bp, Artificial Sequence; identical to SEQ ID NO: 36112
  Description of Artificial Sequence: Synthetic oligonucleotide

SEQ ID NO: 379226 - DNA, 31 bp, Artificial Sequence; identical to SEQ ID NO: 36113
  Description of Artificial Sequence: Synthetic oligonucleotide

SEQ ID NO: 379227 - DNA, 30 bp, Artificial Sequence; identical to SEQ ID NO: 36114
  Description of Artificial Sequence: Synthetic oligonucleotide

SEQ ID NO: 379228 - DNA, 29 bp, Artificial Sequence
  Description of Artificial Sequence: Synthetic oligonucleotide
gaggtatttctacacagccatgtcccggc

SEQ ID NO: 379229 - DNA, 29 bp, Artificial Sequence
  Description of Artificial Sequence: Synthetic oligonucleotide
aggtatttctacacagccatgtcccggcc

SEQ ID NO: 379230 - DNA, 28 bp, Artificial Sequence
  Description of Artificial Sequence: Synthetic oligonucleotide
ggtatttctacacagccatgtcccggcc

SEQ ID NO: 379231 - DNA, 28 bp, Artificial Sequence
  Description of Artificial Sequence: Synthetic oligonucleotide
gtatttctacacagccatgtcccggccc

SEQ ID NO: 379232 - DNA, 28 bp, Artificial Sequence
  Description of Artificial Sequence: Synthetic oligonucleotide
tatttctacacagccatgtcccggcccg

SEQ ID NO: 379233 - DNA, 27 bp, Artificial Sequence
  Description of Artificial Sequence: Synthetic oligonucleotide
atttctacacagccatgtcccggcccg

SEQ ID NO: 379234 - DNA, 26 bp, Artificial Sequence
  Description of Artificial Sequence: Synthetic oligonucleotide
tttctacacagccatgtcccggcccg

SEQ ID NO: 379235 - DNA, 25 bp, Artificial Sequence
  Description of Artificial Sequence: Synthetic oligonucleotide
ttctacacagccatgtcccggcccg

SEQ ID NO: 379236 - DNA, 24 bp, Artificial Sequence
  Description of Artificial Sequence: Synthetic oligonucleotide
tctacacagccatgtcccggcccg

SEQ ID NO: 379237 - DNA, 23 bp, Artificial Sequence
  Description of Artificial Sequence: Synthetic oligonucleotide
ctacacagccatgtcccggcccg

SEQ ID NO: 379238 - DNA, 23 bp, Artificial Sequence
  Description of Artificial Sequence: Synthetic oligonucleotide
tacacagccatgtcccggcccgg

SEQ ID NO: 379239 - DNA, 22 bp, Artificial Sequence
  Description of Artificial Sequence: Synthetic oligonucleotide
acacagccatgtcccggcccgg

SEQ ID NO: 379240 - DNA, 21 bp, Artificial Sequence
  Description of Artificial Sequence: Synthetic oligonucleotide
cacagccatgtcccggcccgg

SEQ ID NO: 379241 - DNA, 21 bp, Artificial Sequence
  Description of Artificial Sequence: Synthetic oligonucleotide
acagccatgtcccggcccggc

SEQ ID NO: 379242 - DNA, 20 bp, Artificial Sequence
  Description of Artificial Sequence: Synthetic oligonucleotide
cagccatgtcccggcccggc

SEQ ID NO: 379243 - DNA, 20 bp, Artificial Sequence
  Description of Artificial Sequence: Synthetic oligonucleotide
agccatgtcccggcccggcc

SEQ ID NO: 379244 - DNA, 24 bp, Artificial Sequence
  Description of Artificial Sequence: Synthetic oligonucleotide
aacgggaaggagacgctgcagcgg

SEQ ID NO: 379245 - DNA, 23 bp, Artificial Sequence
  Description of Artificial Sequence: Synthetic oligonucleotide
acgggaaggagacgctgcagcgg

SEQ ID NO: 379246 - DNA, 22 bp, Artificial Sequence
  Description of Artificial Sequence: Synthetic oligonucleotide
cgggaaggagacgctgcagcgg

SEQ ID NO: 379247 - DNA, 22 bp, Artificial Sequence
  Description of Artificial Sequence: Synthetic oligonucleotide
gggaaggagacgctgcagcggg

SEQ ID NO: 379248 - DNA, 22 bp, Artificial Sequence
  Description of Artificial Sequence: Synthetic oligonucleotide
ggaaggagacgctgcagcgggc

SEQ ID NO: 379249 - DNA, 22 bp, Artificial Sequence
  Description of Artificial Sequence: Synthetic oligonucleotide
gaaggagacgctgcagcgggcg

SEQ ID NO: 379250 - DNA, 22 bp, Artificial Sequence
  Description of Artificial Sequence: Synthetic oligonucleotide
aaggagacgctgcagcgggcgg

SEQ ID NO: 379251 - DNA, 26 bp, Artificial Sequence
  Description of Artificial Sequence: Synthetic oligonucleotide
cgctactacaaccagagcgaggctgg

SEQ ID NO: 379252 - DNA, 27 bp, Artificial Sequence
  Description of Artificial Sequence: Synthetic oligonucleotide
gctactacaaccagagcgaggctgggt

SEQ ID NO: 379253 - DNA, 27 bp, Artificial Sequence
  Description of Artificial Sequence: Synthetic oligonucleotide
ctactacaaccagagcgaggctgggtc

SEQ ID NO: 379254 - DNA, 28 bp, Artificial Sequence
  Description of Artificial Sequence: Synthetic oligonucleotide
tactacaaccagagcgaggctgggtctc

SEQ ID NO: 379255 - DNA, 27 bp, Artificial Sequence
  Description of Artificial Sequence: Synthetic oligonucleotide
actacaaccagagcgaggctgggtctc

SEQ ID NO: 379256 - DNA, 27 bp, Artificial Sequence
  Description of Artificial Sequence: Synthetic oligonucleotide
ctacaaccagagcgaggctgggtctca

SEQ ID NO: 379257 - DNA, 27 bp, Artificial Sequence
  Description of Artificial Sequence: Synthetic oligonucleotide
tacaaccagagcgaggctgggtctcac

SEQ ID NO: 379258 - DNA, 27 bp, Artificial Sequence
  Description of Artificial Sequence: Synthetic oligonucleotide
acaaccagagcgaggctgggtctcaca

SEQ ID NO: 379259 - DNA, 27 bp, Artificial Sequence
  Description of Artificial Sequence: Synthetic oligonucleotide
caaccagagcgaggctgggtctcacat

SEQ ID NO: 379260 - DNA, 27 bp, Artificial Sequence
  Description of Artificial Sequence: Synthetic oligonucleotide
aaccagagcgaggctgggtctcacatc

SEQ ID NO: 379261 - DNA, 27 bp, Artificial Sequence
  Description of Artificial Sequence: Synthetic oligonucleotide
accagagcgaggctgggtctcacatca

SEQ ID NO: 379262 - DNA, 27 bp, Artificial Sequence
  Description of Artificial Sequence: Synthetic oligonucleotide
ccagagcgaggctgggtctcacatcat

SEQ ID NO: 379263 - DNA, 27 bp, Artificial Sequence
  Description of Artificial Sequence: Synthetic oligonucleotide
cagagcgaggctgggtctcacatcatc

SEQ ID NO: 379264 - DNA, 27 bp, Artificial Sequence
  Description of Artificial Sequence: Synthetic oligonucleotide
agagcgaggctgggtctcacatcatcc

SEQ ID NO: 379265 - DNA, 27 bp, Artificial Sequence
  Description of Artificial Sequence: Synthetic oligonucleotide
gagcgaggctgggtctcacatcatcca

SEQ ID NO: 379266 - DNA, 27 bp, Artificial Sequence
  Description of Artificial Sequence: Synthetic oligonucleotide
agcgaggctgggtctcacatcatccag

SEQ ID NO: 379267 - DNA, 27 bp, Artificial Sequence
  Description of Artificial Sequence: Synthetic oligonucleotide
gcgaggctgggtctcacatcatccaga

SEQ ID NO: 379268 - DNA, 27 bp, Artificial Sequence
  Description of Artificial Sequence: Synthetic oligonucleotide
cgaggctgggtctcacatcatccagag

SEQ ID NO: 379269 - DNA, 27 bp, Artificial Sequence
  Description of Artificial Sequence: Synthetic oligonucleotide
gaggctgggtctcacatcatccagagg

SEQ ID NO: 379270 - DNA, 29 bp, Artificial Sequence
  Description of Artificial Sequence: Synthetic oligonucleotide
aggctgggtctcacatcatccagaggatg

SEQ ID NO: 379271 - DNA, 28 bp, Artificial Sequence
  Description of Artificial Sequence: Synthetic oligonucleotide
ggctgggtctcacatcatccagaggatg

SEQ ID NO: 379272 - DNA, 30 bp, Artificial Sequence; identical to SEQ ID NO: 36162
  Description of Artificial Sequence: Synthetic oligonucleotide

SEQ ID NO: 379273 - DNA, 30 bp, Artificial Sequence; identical to SEQ ID NO: 36163
  Description of Artificial Sequence: Synthetic oligonucleotide

SEQ ID NO: 379274 - DNA, 30 bp, Artificial Sequence; identical to SEQ ID NO: 36164
  Description of Artificial Sequence: Synthetic oligonucleotide

SEQ ID NO: 379275 - DNA, 31 bp, Artificial Sequence; identical to SEQ ID NO: 36165
  Description of Artificial Sequence: Synthetic oligonucleotide

SEQ ID NO: 379276 - DNA, 31 bp, Artificial Sequence; identical to SEQ ID NO: 36166
  Description of Artificial Sequence: Synthetic oligonucleotide

SEQ ID NO: 379277 - DNA, 33 bp, Artificial Sequence; identical to SEQ ID NO: 36167
  Description of Artificial Sequence: Synthetic oligonucleotide

SEQ ID NO: 379278 - DNA, 32 bp, Artificial Sequence; identical to SEQ ID NO: 36168
  Description of Artificial Sequence: Synthetic oligonucleotide

SEQ ID NO: 379279 - DNA, 33 bp, Artificial Sequence; identical to SEQ ID NO: 36169
  Description of Artificial Sequence: Synthetic oligonucleotide

SEQ ID NO: 379280 - DNA, 24 bp, Artificial Sequence
  Description of Artificial Sequence: Synthetic oligonucleotide
ccgcgggcgccatggatagagcaa

SEQ ID NO: 379281 - DNA, 25 bp, Artificial Sequence
  Description of Artificial Sequence: Synthetic oligonucleotide
cgcgggcgccatggatagagcaaga

SEQ ID NO: 379282 - DNA, 25 bp, Artificial Sequence
  Description of Artificial Sequence: Synthetic oligonucleotide
gcgggcgccatggatagagcaagag

SEQ ID NO: 379283 - DNA, 25 bp, Artificial Sequence
  Description of Artificial Sequence: Synthetic oligonucleotide
cgggcgccatggatagagcaagagg

SEQ ID NO: 379284 - DNA, 25 bp, Artificial Sequence
  Description of Artificial Sequence: Synthetic oligonucleotide
gggcgccatggatagagcaagaggg

SEQ ID NO: 379285 - DNA, 25 bp, Artificial Sequence
  Description of Artificial Sequence: Synthetic oligonucleotide
ggcgccatggatagagcaagagggg

SEQ ID NO: 379286 - DNA, 25 bp, Artificial Sequence
  Description of Artificial Sequence: Synthetic oligonucleotide
gcgccatggatagagcaagaggggc

SEQ ID NO: 379287 - DNA, 25 bp, Artificial Sequence
  Description of Artificial Sequence: Synthetic oligonucleotide
cgccatggatagagcaagaggggcc

SEQ ID NO: 379288 - DNA, 25 bp, Artificial Sequence
  Description of Artificial Sequence: Synthetic oligonucleotide
gccatggatagagcaagaggggccg

SEQ ID NO: 379289 - DNA, 26 bp, Artificial Sequence
  Description of Artificial Sequence: Synthetic oligonucleotide
ccatggatagagcaagaggggccgga

SEQ ID NO: 379290 - DNA, 27 bp, Artificial Sequence
  Description of Artificial Sequence: Synthetic oligonucleotide
catggatagagcaagaggggccggagt

SEQ ID NO: 379291 - DNA, 30 bp, Artificial Sequence
  Description of Artificial Sequence: Synthetic oligonucleotide
atggatagagcaagaggggccggagtattg

SEQ ID NO: 379292 - DNA, 23 bp, Artificial Sequence
  Description of Artificial Sequence: Synthetic oligonucleotide
ctggagggcacgtgcgtggagtc

SEQ ID NO: 379293 - DNA, 23 bp, Artificial Sequence
  Description of Artificial Sequence: Synthetic oligonucleotide
tggagggcacgtgcgtggagtcg

SEQ ID NO: 379294 - DNA, 22 bp, Artificial Sequence
  Description of Artificial Sequence: Synthetic oligonucleotide
ggagggcacgtgcgtggagtcg

SEQ ID NO: 379295 - DNA, 23 bp, Artificial Sequence
  Description of Artificial Sequence: Synthetic oligonucleotide
gagggcacgtgcgtggagtcgct

SEQ ID NO: 379296 - DNA, 23 bp, Artificial Sequence
  Description of Artificial Sequence: Synthetic oligonucleotide
agggcacgtgcgtggagtcgctc

SEQ ID NO: 379297 - DNA, 22 bp, Artificial Sequence
  Description of Artificial Sequence: Synthetic oligonucleotide
gggcacgtgcgtggagtcgctc

SEQ ID NO: 379298 - DNA, 22 bp, Artificial Sequence
  Description of Artificial Sequence: Synthetic oligonucleotide
ggcacgtgcgtggagtcgctcc

SEQ ID NO: 379299 - DNA, 22 bp, Artificial Sequence
  Description of Artificial Sequence: Synthetic oligonucleotide
gcacgtgcgtggagtcgctccg

SEQ ID NO: 379300 - DNA, 23 bp, Artificial Sequence
  Description of Artificial Sequence: Synthetic oligonucleotide
cacgtgcgtggagtcgctccgca

SEQ ID NO: 379301 - DNA, 26 bp, Artificial Sequence
  Description of Artificial Sequence: Synthetic oligonucleotide
acgtgcgtggagtcgctccgcagata

SEQ ID NO: 379302 - DNA, 25 bp, Artificial Sequence
  Description of Artificial Sequence: Synthetic oligonucleotide
cgtgcgtggagtcgctccgcagata

SEQ ID NO: 379303 - DNA, 25 bp, Artificial Sequence
  Description of Artificial Sequence: Synthetic oligonucleotide
gacagagcctacctggagggcctct

SEQ ID NO: 379304 - DNA, 25 bp, Artificial Sequence
  Description of Artificial Sequence: Synthetic oligonucleotide
acagagcctacctggagggcctctg

SEQ ID NO: 379305 - DNA, 24 bp, Artificial Sequence
  Description of Artificial Sequence: Synthetic oligonucleotide
cagagcctacctggagggcctctg

SEQ ID NO: 379306 - DNA, 24 bp, Artificial Sequence
  Description of Artificial Sequence: Synthetic oligonucleotide
agagcctacctggagggcctctgc

SEQ ID NO: 379307 - DNA, 23 bp, Artificial Sequence
  Description of Artificial Sequence: Synthetic oligonucleotide
gagcctacctggagggcctctgc

SEQ ID NO: 379308 - DNA, 24 bp, Artificial Sequence
  Description of Artificial Sequence: Synthetic oligonucleotide
agcctacctggagggcctctgcgt

SEQ ID NO: 379309 - DNA, 23 bp, Artificial Sequence
  Description of Artificial Sequence: Synthetic oligonucleotide
gcctacctggagggcctctgcgt

SEQ ID NO: 379310 - DNA, 23 bp, Artificial Sequence
  Description of Artificial Sequence: Synthetic oligonucleotide
cctacctggagggcctctgcgtg

SEQ ID NO: 379311 - DNA, 24 bp, Artificial Sequence
  Description of Artificial Sequence: Synthetic oligonucleotide
ctacctggagggcctctgcgtgga

SEQ ID NO: 379312 - DNA, 25 bp, Artificial Sequence
  Description of Artificial Sequence: Synthetic oligonucleotide
tacctggagggcctctgcgtggagt

SEQ ID NO: 379313 - DNA, 24 bp, Artificial Sequence
  Description of Artificial Sequence: Synthetic oligonucleotide
acctggagggcctctgcgtggagt

SEQ ID NO: 379314 - DNA, 23 bp, Artificial Sequence
  Description of Artificial Sequence: Synthetic oligonucleotide
cctggagggcctctgcgtggagt

SEQ ID NO: 379315 - DNA, 23 bp, Artificial Sequence
  Description of Artificial Sequence: Synthetic oligonucleotide
ctggagggcctctgcgtggagtc

SEQ ID NO: 379316 - DNA, 23 bp, Artificial Sequence
  Description of Artificial Sequence: Synthetic oligonucleotide
tggagggcctctgcgtggagtcg

SEQ ID NO: 379317 - DNA, 22 bp, Artificial Sequence
  Description of Artificial Sequence: Synthetic oligonucleotide
ggagggcctctgcgtggagtcg

SEQ ID NO: 379318 - DNA, 23 bp, Artificial Sequence
  Description of Artificial Sequence: Synthetic oligonucleotide
gagggcctctgcgtggagtcgct

SEQ ID NO: 379319 - DNA, 23 bp, Artificial Sequence
  Description of Artificial Sequence: Synthetic oligonucleotide
agggcctctgcgtggagtcgctc

SEQ ID NO: 379320 - DNA, 22 bp, Artificial Sequence
  Description of Artificial Sequence: Synthetic oligonucleotide
gggcctctgcgtggagtcgctc

SEQ ID NO: 379321 - DNA, 22 bp, Artificial Sequence
  Description of Artificial Sequence: Synthetic oligonucleotide
ggcctctgcgtggagtcgctcc

SEQ ID NO: 379322 - DNA, 22 bp, Artificial Sequence
  Description of Artificial Sequence: Synthetic oligonucleotide
gcctctgcgtggagtcgctccg

SEQ ID NO: 379323 - DNA, 23 bp, Artificial Sequence
  Description of Artificial Sequence: Synthetic oligonucleotide
cctctgcgtggagtcgctccgca

SEQ ID NO: 379324 - DNA, 26 bp, Artificial Sequence
  Description of Artificial Sequence: Synthetic oligonucleotide
ctctgcgtggagtcgctccgcagata

SEQ ID NO: 379325 - DNA, 26 bp, Artificial Sequence
  Description of Artificial Sequence: Synthetic oligonucleotide
tctgcgtggagtcgctccgcagatac

SEQ ID NO: 379326 - DNA, 25 bp, Artificial Sequence
  Description of Artificial Sequence: Synthetic oligonucleotide
ctgcgtggagtcgctccgcagatac

SEQ ID NO: 379327 - DNA, 25 bp, Artificial Sequence
  Description of Artificial Sequence: Synthetic oligonucleotide
ttaccgagagaacctgcgcaccgcc

SEQ ID NO: 379328 - DNA, 24 bp, Artificial Sequence
  Description of Artificial Sequence: Synthetic oligonucleotide
taccgagagaacctgcgcaccgcc

SEQ ID NO: 379329 - DNA, 23 bp, Artificial Sequence
  Description of Artificial Sequence: Synthetic oligonucleotide
accgagagaacctgcgcaccgcc

SEQ ID NO: 379330 - DNA, 22 bp, Artificial Sequence
  Description of Artificial Sequence: Synthetic oligonucleotide
ccgagagaacctgcgcaccgcc

SEQ ID NO: 379331 - DNA, 23 bp, Artificial Sequence
  Description of Artificial Sequence: Synthetic oligonucleotide
cgagagaacctgcgcaccgccct

SEQ ID NO: 379332 - DNA, 23 bp, Artificial Sequence
  Description of Artificial Sequence: Synthetic oligonucleotide
gagagaacctgcgcaccgccctc

SEQ ID NO: 379333 - DNA, 23 bp, Artificial Sequence
  Description of Artificial Sequence: Synthetic oligonucleotide
agagaacctgcgcaccgccctcc

SEQ ID NO: 379334 - DNA, 22 bp, Artificial Sequence
  Description of Artificial Sequence: Synthetic oligonucleotide
gagaacctgcgcaccgccctcc

SEQ ID NO: 379335 - DNA, 22 bp, Artificial Sequence
  Description of Artificial Sequence: Synthetic oligonucleotide
agaacctgcgcaccgccctccg

SEQ ID NO: 379336 - DNA, 21 bp, Artificial Sequence
  Description of Artificial Sequence: Synthetic oligonucleotide
gaacctgcgcaccgccctccg

SEQ ID NO: 379337 - DNA, 23 bp, Artificial Sequence
  Description of Artificial Sequence: Synthetic oligonucleotide
aacctgcgcaccgccctccgcta

SEQ ID NO: 379338 - DNA, 22 bp, Artificial Sequence
  Description of Artificial Sequence: Synthetic oligonucleotide
acctgcgcaccgccctccgcta

SEQ ID NO: 379339 - DNA, 21 bp, Artificial Sequence
  Description of Artificial Sequence: Synthetic oligonucleotide
cctgcgcaccgccctccgcta

SEQ ID NO: 379340 - DNA, 23 bp, Artificial Sequence
  Description of Artificial Sequence: Synthetic oligonucleotide
ctgcgcaccgccctccgctacta

SEQ ID NO: 379341 - DNA, 25 bp, Artificial Sequence
  Description of Artificial Sequence: Synthetic oligonucleotide
tgcgcaccgccctccgctactacaa

SEQ ID NO: 379342 - DNA, 24 bp, Artificial Sequence
  Description of Artificial Sequence: Synthetic oligonucleotide
gcgcaccgccctccgctactacaa

SEQ ID NO: 379343 - DNA, 24 bp, Artificial Sequence
  Description of Artificial Sequence: Synthetic oligonucleotide
cgcaccgccctccgctactacaac

SEQ ID NO: 379344 - DNA, 25 bp, Artificial Sequence
  Description of Artificial Sequence: Synthetic oligonucleotide
gcaccgccctccgctactacaacca

SEQ ID NO: 379345 - DNA, 26 bp, Artificial Sequence
  Description of Artificial Sequence: Synthetic oligonucleotide
caccgccctccgctactacaaccaga

SEQ ID NO: 379346 - DNA, 26 bp, Artificial Sequence
  Description of Artificial Sequence: Synthetic oligonucleotide
accgccctccgctactacaaccagag

SEQ ID NO: 379347 - DNA, 25 bp, Artificial Sequence
  Description of Artificial Sequence: Synthetic oligonucleotide
ccgccctccgctactacaaccagag

SEQ ID NO: 379348 - DNA, 25 bp, Artificial Sequence
  Description of Artificial Sequence: Synthetic oligonucleotide
cgccctccgctactacaaccagagc

SEQ ID NO: 379349 - DNA, 26 bp, Artificial Sequence
  Description of Artificial Sequence: Synthetic oligonucleotide
gccctccgctactacaaccagagcga

SEQ ID NO: 379350 - DNA, 26 bp, Artificial Sequence
  Description of Artificial Sequence: Synthetic oligonucleotide
ccctccgctactacaaccagagcgag

SEQ ID NO: 379351 - DNA, 26 bp, Artificial Sequence
  Description of Artificial Sequence: Synthetic oligonucleotide
cctccgctactacaaccagagcgagg

SEQ ID NO: 379352 - DNA, 27 bp, Artificial Sequence
  Description of Artificial Sequence: Synthetic oligonucleotide
acacagacttaccgagagagcctgcgc

SEQ ID NO: 379353 - DNA, 27 bp, Artificial Sequence
  Description of Artificial Sequence: Synthetic oligonucleotide
cacagacttaccgagagagcctgcgca

SEQ ID NO: 379354 - DNA, 27 bp, Artificial Sequence
  Description of Artificial Sequence: Synthetic oligonucleotide
acagacttaccgagagagcctgcgcac

SEQ ID NO: 379355 - DNA, 26 bp, Artificial Sequence
  Description of Artificial Sequence: Synthetic oligonucleotide
cagacttaccgagagagcctgcgcac

SEQ ID NO: 379356 - DNA, 26 bp, Artificial Sequence
  Description of Artificial Sequence: Synthetic oligonucleotide
agacttaccgagagagcctgcgcacc

SEQ ID NO: 379357 - DNA, 25 bp, Artificial Sequence
  Description of Artificial Sequence: Synthetic oligonucleotide
gacttaccgagagagcctgcgcacc

SEQ ID NO: 379358 - DNA, 25 bp, Artificial Sequence
  Description of Artificial Sequence: Synthetic oligonucleotide
acttaccgagagagcctgcgcaccg

SEQ ID NO: 379359 - DNA, 24 bp, Artificial Sequence
  Description of Artificial Sequence: Synthetic oligonucleotide
cttaccgagagagcctgcgcaccg

SEQ ID NO: 379360 - DNA, 24 bp, Artificial Sequence
  Description of Artificial Sequence: Synthetic oligonucleotide
ttaccgagagagcctgcgcaccgc

SEQ ID NO: 379361 - DNA, 23 bp, Artificial Sequence
  Description of Artificial Sequence: Synthetic oligonucleotide
taccgagagagcctgcgcaccgc

SEQ ID NO: 379362 - DNA, 22 bp, Artificial Sequence
  Description of Artificial Sequence: Synthetic oligonucleotide
accgagagagcctgcgcaccgc

SEQ ID NO: 379363 - DNA, 21 bp, Artificial Sequence
  Description of Artificial Sequence: Synthetic oligonucleotide
ccgagagagcctgcgcaccgc

SEQ ID NO: 379364 - DNA, 21 bp, Artificial Sequence
  Description of Artificial Sequence: Synthetic oligonucleotide
cgagagagcctgcgcaccgcg

SEQ ID NO: 379365 - DNA, 22 bp, Artificial Sequence
  Description of Artificial Sequence: Synthetic oligonucleotide
gagagagcctgcgcaccgcgct

SEQ ID NO: 379366 - DNA, 22 bp, Artificial Sequence
  Description of Artificial Sequence: Synthetic oligonucleotide
agagagcctgcgcaccgcgctc

SEQ ID NO: 379367 - DNA, 21 bp, Artificial Sequence
  Description of Artificial Sequence: Synthetic oligonucleotide
gagagcctgcgcaccgcgctc

SEQ ID NO: 379368 - DNA, 21 bp, Artificial Sequence
  Description of Artificial Sequence: Synthetic oligonucleotide
agagcctgcgcaccgcgctcc

SEQ ID NO: 379369 - DNA, 20 bp, Artificial Sequence
  Description of Artificial Sequence: Synthetic oligonucleotide
gagcctgcgcaccgcgctcc

SEQ ID NO: 379370 - DNA, 20 bp, Artificial Sequence
  Description of Artificial Sequence: Synthetic oligonucleotide
agcctgcgcaccgcgctccg

SEQ ID NO: 379371 - DNA, 20 bp, Artificial Sequence
  Description of Artificial Sequence: Synthetic oligonucleotide
gcctgcgcaccgcgctccgt

SEQ ID NO: 379372 - DNA, 27 bp, Artificial Sequence
  Description of Artificial Sequence: Synthetic oligonucleotide
cgcctcctccgcgggtataaccagtta

SEQ ID NO: 379373 - DNA, 27 bp, Artificial Sequence
  Description of Artificial Sequence: Synthetic oligonucleotide
gcctcctccgcgggtataaccagttag

SEQ ID NO: 379374 - DNA, 27 bp, Artificial Sequence
  Description of Artificial Sequence: Synthetic oligonucleotide
cctcctccgcgggtataaccagttagc

SEQ ID NO: 379375 - DNA, 27 bp, Artificial Sequence
  Description of Artificial Sequence: Synthetic oligonucleotide
ctcctccgcgggtataaccagttagcc

SEQ ID NO: 379376 - DNA, 29 bp, Artificial Sequence
  Description of Artificial Sequence: Synthetic oligonucleotide
tcctccgcgggtataaccagttagcctac

SEQ ID NO: 379377 - DNA, 28 bp, Artificial Sequence
  Description of Artificial Sequence: Synthetic oligonucleotide
cctccgcgggtataaccagttagcctac

SEQ ID NO: 379378 - DNA, 28 bp, Artificial Sequence
  Description of Artificial Sequence: Synthetic oligonucleotide
ctccgcgggtataaccagttagcctacg

SEQ ID NO: 379379 - DNA, 29 bp, Artificial Sequence
  Description of Artificial Sequence: Synthetic oligonucleotide
tccgcgggtataaccagttagcctacgac

SEQ ID NO: 379380 - DNA, 28 bp, Artificial Sequence
  Description of Artificial Sequence: Synthetic oligonucleotide
ccgcgggtataaccagttagcctacgac

SEQ ID NO: 379381 - DNA, 28 bp, Artificial Sequence
  Description of Artificial Sequence: Synthetic oligonucleotide
cgcgggtataaccagttagcctacgacg

SEQ ID NO: 379382 - DNA, 28 bp, Artificial Sequence
  Description of Artificial Sequence: Synthetic oligonucleotide
gcgggtataaccagttagcctacgacgg

SEQ ID NO: 379383 - DNA, 28 bp, Artificial Sequence
  Description of Artificial Sequence: Synthetic oligonucleotide
cgggtataaccagttagcctacgacggc

SEQ ID NO: 379384 - DNA, 30 bp, Artificial Sequence; identical to SEQ ID NO: 33784
  Description of Artificial Sequence: Synthetic oligonucleotide

SEQ ID NO: 379385 - DNA, 30 bp, Artificial Sequence; identical to SEQ ID NO: 33785
  Description of Artificial Sequence: Synthetic oligonucleotide

SEQ ID NO: 379386 - DNA, 34 bp, Artificial Sequence; identical to SEQ ID NO: 33786
  Description of Artificial Sequence: Synthetic oligonucleotide

SEQ ID NO: 379387 - DNA, 36 bp, Artificial Sequence; identical to SEQ ID NO: 33787
  Description of Artificial Sequence: Synthetic oligonucleotide

SEQ ID NO: 379388 - DNA, 30 bp, Artificial Sequence; identical to SEQ ID NO: 24037
  Description of Artificial Sequence: Synthetic oligonucleotide

SEQ ID NO: 379389 - DNA, 32 bp, Artificial Sequence; identical to SEQ ID NO: 24038
  Description of Artificial Sequence: Synthetic oligonucleotide

SEQ ID NO: 379390 - DNA, 31 bp, Artificial Sequence; identical to SEQ ID NO: 24039
  Description of Artificial Sequence: Synthetic oligonucleotide

SEQ ID NO: 379391 - DNA, 31 bp, Artificial Sequence; identical to SEQ ID NO: 24040
  Description of Artificial Sequence: Synthetic oligonucleotide

SEQ ID NO: 379392 - DNA, 30 bp, Artificial Sequence; identical to SEQ ID NO: 24041
  Description of Artificial Sequence: Synthetic oligonucleotide

SEQ ID NO: 379393 - DNA, 29 bp, Artificial Sequence
  Description of Artificial Sequence: Synthetic oligonucleotide
ttgggaccgggagacacagatctacaagg

SEQ ID NO: 379394 - DNA, 28 bp, Artificial Sequence
  Description of Artificial Sequence: Synthetic oligonucleotide
tgggaccgggagacacagatctacaagg

SEQ ID NO: 379395 - DNA, 27 bp, Artificial Sequence
  Description of Artificial Sequence: Synthetic oligonucleotide
gggaccgggagacacagatctacaagg

SEQ ID NO: 379396 - DNA, 27 bp, Artificial Sequence
  Description of Artificial Sequence: Synthetic oligonucleotide
ggaccgggagacacagatctacaaggc

SEQ ID NO: 379397 - DNA, 27 bp, Artificial Sequence
  Description of Artificial Sequence: Synthetic oligonucleotide
gaccgggagacacagatctacaaggcc

SEQ ID NO: 379398 - DNA, 27 bp, Artificial Sequence
  Description of Artificial Sequence: Synthetic oligonucleotide
accgggagacacagatctacaaggccc

SEQ ID NO: 379399 - DNA, 27 bp, Artificial Sequence
  Description of Artificial Sequence: Synthetic oligonucleotide
ccgggagacacagatctacaaggccca

SEQ ID NO: 379400 - DNA, 27 bp, Artificial Sequence
  Description of Artificial Sequence: Synthetic oligonucleotide
cgggagacacagatctacaaggcccag

SEQ ID NO: 379401 - DNA, 27 bp, Artificial Sequence
  Description of Artificial Sequence: Synthetic oligonucleotide
gggagacacagatctacaaggcccagg

SEQ ID NO: 379402 - DNA, 27 bp, Artificial Sequence
  Description of Artificial Sequence: Synthetic oligonucleotide
ggagacacagatctacaaggcccaggc

SEQ ID NO: 379403 - DNA, 28 bp, Artificial Sequence
  Description of Artificial Sequence: Synthetic oligonucleotide
gagacacagatctacaaggcccaggcac

SEQ ID NO: 379404 - DNA, 29 bp, Artificial Sequence
  Description of Artificial Sequence: Synthetic oligonucleotide
agacacagatctacaaggcccaggcacag

SEQ ID NO: 379405 - DNA, 28 bp, Artificial Sequence
  Description of Artificial Sequence: Synthetic oligonucleotide
gacacagatctacaaggcccaggcacag

SEQ ID NO: 379406 - DNA, 29 bp, Artificial Sequence
  Description of Artificial Sequence: Synthetic oligonucleotide
acacagaagtacaagcgccaggcacagac

SEQ ID NO: 379407 - DNA, 28 bp, Artificial Sequence
  Description of Artificial Sequence: Synthetic oligonucleotide
cacagaagtacaagcgccaggcacagac

SEQ ID NO: 379408 - DNA, 29 bp, Artificial Sequence
  Description of Artificial Sequence: Synthetic oligonucleotide
acagaagtacaagcgccaggcacagactg

SEQ ID NO: 379409 - DNA, 28 bp, Artificial Sequence
  Description of Artificial Sequence: Synthetic oligonucleotide
cagaagtacaagcgccaggcacagactg

SEQ ID NO: 379410 - DNA, 29 bp, Artificial Sequence
  Description of Artificial Sequence: Synthetic oligonucleotide
agaagtacaagcgccaggcacagactgac

SEQ ID NO: 379411 - DNA, 28 bp, Artificial Sequence
  Description of Artificial Sequence: Synthetic oligonucleotide
gaagtacaagcgccaggcacagactgac

SEQ ID NO: 379412 - DNA, 28 bp, Artificial Sequence
  Description of Artificial Sequence: Synthetic oligonucleotide
aagtacaagcgccaggcacagactgacc

SEQ ID NO: 379413 - DNA, 27 bp, Artificial Sequence
  Description of Artificial Sequence: Synthetic oligonucleotide
agtacaagcgccaggcacagactgacc

SEQ ID NO: 379414 - DNA, 26 bp, Artificial Sequence
  Description of Artificial Sequence: Synthetic oligonucleotide
gtacaagcgccaggcacagactgacc

SEQ ID NO: 379415 - DNA, 27 bp, Artificial Sequence
  Description of Artificial Sequence: Synthetic oligonucleotide
tacaagcgccaggcacagactgaccga

SEQ ID NO: 379416 - DNA, 26 bp, Artificial Sequence
  Description of Artificial Sequence: Synthetic oligonucleotide
acaagcgccaggcacagactgaccga

SEQ ID NO: 379417 - DNA, 25 bp, Artificial Sequence
  Description of Artificial Sequence: Synthetic oligonucleotide
caagcgccaggcacagactgaccga

SEQ ID NO: 379418 - DNA, 26 bp, Artificial Sequence
  Description of Artificial Sequence: Synthetic oligonucleotide
aagcgccaggcacagactgaccgagt

SEQ ID NO: 379419 - DNA, 25 bp, Artificial Sequence
  Description of Artificial Sequence: Synthetic oligonucleotide
agcgccaggcacagactgaccgagt

SEQ ID NO: 379420 - DNA, 24 bp, Artificial Sequence
  Description of Artificial Sequence: Synthetic oligonucleotide
gcgccaggcacagactgaccgagt

SEQ ID NO: 379421 - DNA, 25 bp, Artificial Sequence
  Description of Artificial Sequence: Synthetic oligonucleotide
cgccaggcacagactgaccgagtga

SEQ ID NO: 379422 - DNA, 25 bp, Artificial Sequence
  Description of Artificial Sequence: Synthetic oligonucleotide
gccaggcacagactgaccgagtgag

SEQ ID NO: 379423 - DNA, 25 bp, Artificial Sequence
  Description of Artificial Sequence: Synthetic oligonucleotide
ccaggcacagactgaccgagtgagc

SEQ ID NO: 379424 - DNA, 26 bp, Artificial Sequence
  Description of Artificial Sequence: Synthetic oligonucleotide
caggcacagactgaccgagtgagcct

SEQ ID NO: 379425 - DNA, 26 bp, Artificial Sequence
  Description of Artificial Sequence: Synthetic oligonucleotide
aggcacagactgaccgagtgagcctg

SEQ ID NO: 379426 - DNA, 25 bp, Artificial Sequence
  Description of Artificial Sequence: Synthetic oligonucleotide
ggcacagactgaccgagtgagcctg

SEQ ID NO: 379427 - DNA, 25 bp, Artificial Sequence
  Description of Artificial Sequence: Synthetic oligonucleotide
gcacagactgaccgagtgagcctgc

SEQ ID NO: 379428 - DNA, 25 bp, Artificial Sequence
  Description of Artificial Sequence: Synthetic oligonucleotide
cacagactgaccgagtgagcctgcg

SEQ ID NO: 379429 - DNA, 27 bp, Artificial Sequence
  Description of Artificial Sequence: Synthetic oligonucleotide
acagactgaccgagtgagcctgcggaa

SEQ ID NO: 379430 - DNA, 26 bp, Artificial Sequence
  Description of Artificial Sequence: Synthetic oligonucleotide
cagactgaccgagtgagcctgcggaa

SEQ ID NO: 379431 - DNA, 26 bp, Artificial Sequence
  Description of Artificial Sequence: Synthetic oligonucleotide
agactgaccgagtgagcctgcggaac

SEQ ID NO: 379432 - DNA, 25 bp, Artificial Sequence
  Description of Artificial Sequence: Synthetic oligonucleotide
gactgaccgagtgagcctgcggaac

SEQ ID NO: 379433 - DNA, 26 bp, Artificial Sequence
  Description of Artificial Sequence: Synthetic oligonucleotide
actgaccgagtgagcctgcggaacct

SEQ ID NO: 379434 - DNA, 30 bp, Artificial Sequence; identical to SEQ ID NO: 37192
  Description of Artificial Sequence: Synthetic oligonucleotide

SEQ ID NO: 379435 - DNA, 29 bp, Artificial Sequence
  Description of Artificial Sequence: Synthetic oligonucleotide
gaagtacaagcgccaggcacagactgatc

SEQ ID NO: 379436 - DNA, 29 bp, Artificial Sequence
  Description of Artificial Sequence: Synthetic oligonucleotide
aagtacaagcgccaggcacagactgatcg

SEQ ID NO: 379437 - DNA, 28 bp, Artificial Sequence
  Description of Artificial Sequence: Synthetic oligonucleotide
agtacaagcgccaggcacagactgatcg

SEQ ID NO: 379438 - DNA, 27 bp, Artificial Sequence
  Description of Artificial Sequence: Synthetic oligonucleotide
gtacaagcgccaggcacagactgatcg

SEQ ID NO: 379439 - DNA, 28 bp, Artificial Sequence
  Description of Artificial Sequence: Synthetic oligonucleotide
tacaagcgccaggcacagactgatcgag

SEQ ID NO: 379440 - DNA, 27 bp, Artificial Sequence
  Description of Artificial Sequence: Synthetic oligonucleotide
acaagcgccaggcacagactgatcgag

SEQ ID NO: 379441 - DNA, 27 bp, Artificial Sequence
  Description of Artificial Sequence: Synthetic oligonucleotide
caagcgccaggcacagactgatcgagt

SEQ ID NO: 379442 - DNA, 27 bp, Artificial Sequence
  Description of Artificial Sequence: Synthetic oligonucleotide
aagcgccaggcacagactgatcgagtg

SEQ ID NO: 379443 - DNA, 27 bp, Artificial Sequence
  Description of Artificial Sequence: Synthetic oligonucleotide
agcgccaggcacagactgatcgagtga

SEQ ID NO: 379444 - DNA, 26 bp, Artificial Sequence
  Description of Artificial Sequence: Synthetic oligonucleotide
gcgccaggcacagactgatcgagtga

SEQ ID NO: 379445 - DNA, 26 bp, Artificial Sequence
  Description of Artificial Sequence: Synthetic oligonucleotide
cgccaggcacagactgatcgagtgag

SEQ ID NO: 379446 - DNA, 26 bp, Artificial Sequence
  Description of Artificial Sequence: Synthetic oligonucleotide
gccaggcacagactgatcgagtgagc

SEQ ID NO: 379447 - DNA, 27 bp, Artificial Sequence
  Description of Artificial Sequence: Synthetic oligonucleotide
ccaggcacagactgatcgagtgagcct

SEQ ID NO: 379448 - DNA, 27 bp, Artificial Sequence
  Description of Artificial Sequence: Synthetic oligonucleotide
caggcacagactgatcgagtgagcctg

SEQ ID NO: 379449 - DNA, 27 bp, Artificial Sequence
  Description of Artificial Sequence: Synthetic oligonucleotide
aggcacagactgatcgagtgagcctgc

SEQ ID NO: 379450 - DNA, 26 bp, Artificial Sequence
  Description of Artificial Sequence: Synthetic oligonucleotide
ggcacagactgatcgagtgagcctgc

SEQ ID NO: 379451 - DNA, 26 bp, Artificial Sequence
  Description of Artificial Sequence: Synthetic oligonucleotide
gcacagactgatcgagtgagcctgcg

SEQ ID NO: 379452 - DNA, 27 bp, Artificial Sequence
  Description of Artificial Sequence: Synthetic oligonucleotide
cacagactgatcgagtgagcctgcgga

SEQ ID NO: 379453 - DNA, 28 bp, Artificial Sequence
  Description of Artificial Sequence: Synthetic oligonucleotide
acagactgatcgagtgagcctgcggaac

SEQ ID NO: 379454 - DNA, 27 bp, Artificial Sequence
  Description of Artificial Sequence: Synthetic oligonucleotide
cagactgatcgagtgagcctgcggaac

SEQ ID NO: 379455 - DNA, 27 bp, Artificial Sequence
  Description of Artificial Sequence: Synthetic oligonucleotide
agactgatcgagtgagcctgcggaacc

SEQ ID NO: 379456 - DNA, 27 bp, Artificial Sequence
  Description of Artificial Sequence: Synthetic oligonucleotide
gactgatcgagtgagcctgcggaacct

SEQ ID NO: 379457 - DNA, 27 bp, Artificial Sequence
  Description of Artificial Sequence: Synthetic oligonucleotide
actgatcgagtgagcctgcggaacctg

SEQ ID NO: 379458 - DNA, 26 bp, Artificial Sequence
  Description of Artificial Sequence: Synthetic oligonucleotide
ctgatcgagtgagcctgcggaacctg

SEQ ID NO: 379459 - DNA, 26 bp, Artificial Sequence
  Description of Artificial Sequence: Synthetic oligonucleotide
tgatcgagtgagcctgcggaacctgc

SEQ ID NO: 379460 - DNA, 25 bp, Artificial Sequence
  Description of Artificial Sequence: Synthetic oligonucleotide
gatcgagtgagcctgcggaacctgc

SEQ ID NO: 379461 - DNA, 25 bp, Artificial Sequence
  Description of Artificial Sequence: Synthetic oligonucleotide
atcgagtgagcctgcggaacctgcg

SEQ ID NO: 379462 - DNA, 24 bp, Artificial Sequence
  Description of Artificial Sequence: Synthetic oligonucleotide
tcgagtgagcctgcggaacctgcg

SEQ ID NO: 379463 - DNA, 21 bp, Artificial Sequence
  Description of Artificial Sequence: Synthetic oligonucleotide
tgggaggcggcccgtgaggca

SEQ ID NO: 379464 - DNA, 20 bp, Artificial Sequence
  Description of Artificial Sequence: Synthetic oligonucleotide
gggaggcggcccgtgaggca

SEQ ID NO: 379465 - DNA, 21 bp, Artificial Sequence
  Description of Artificial Sequence: Synthetic oligonucleotide
ggaggcggcccgtgaggcaga

SEQ ID NO: 379466 - DNA, 21 bp, Artificial Sequence
  Description of Artificial Sequence: Synthetic oligonucleotide
gaggcggcccgtgaggcagag

SEQ ID NO: 379467 - DNA, 22 bp, Artificial Sequence
  Description of Artificial Sequence: Synthetic oligonucleotide
aggcggcccgtgaggcagagca

SEQ ID NO: 379468 - DNA, 21 bp, Artificial Sequence
  Description of Artificial Sequence: Synthetic oligonucleotide
ggcggcccgtgaggcagagca

SEQ ID NO: 379469 - DNA, 22 bp, Artificial Sequence
  Description of Artificial Sequence: Synthetic oligonucleotide
gcggcccgtgaggcagagcagt

SEQ ID NO: 379470 - DNA, 22 bp, Artificial Sequence
  Description of Artificial Sequence: Synthetic oligonucleotide
cggcccgtgaggcagagcagtg

SEQ ID NO: 379471 - DNA, 23 bp, Artificial Sequence
  Description of Artificial Sequence: Synthetic oligonucleotide
ggcccgtgaggcagagcagtgga

SEQ ID NO: 379472 - DNA, 24 bp, Artificial Sequence
  Description of Artificial Sequence: Synthetic oligonucleotide
gcccgtgaggcagagcagtggaga

SEQ ID NO: 379473 - DNA, 24 bp, Artificial Sequence
  Description of Artificial Sequence: Synthetic oligonucleotide
cccgtgaggcagagcagtggagag

SEQ ID NO: 379474 - DNA, 24 bp, Artificial Sequence
  Description of Artificial Sequence: Synthetic oligonucleotide
ccgtgaggcagagcagtggagagc

SEQ ID NO: 379475 - DNA, 26 bp, Artificial Sequence
  Description of Artificial Sequence: Synthetic oligonucleotide
cgtgaggcagagcagtggagagccta

SEQ ID NO: 379476 - DNA, 26 bp, Artificial Sequence
  Description of Artificial Sequence: Synthetic oligonucleotide
gtgaggcagagcagtggagagcctac

SEQ ID NO: 379477 - DNA, 27 bp, Artificial Sequence
  Description of Artificial Sequence: Synthetic oligonucleotide
tgaggcagagcagtggagagcctacct

SEQ ID NO: 379478 - DNA, 26 bp, Artificial Sequence
  Description of Artificial Sequence: Synthetic oligonucleotide
gaggcagagcagtggagagcctacct

SEQ ID NO: 379479 - DNA, 26 bp, Artificial Sequence
  Description of Artificial Sequence: Synthetic oligonucleotide
aggcagagcagtggagagcctacctg

SEQ ID NO: 379480 - DNA, 27 bp, Artificial Sequence
  Description of Artificial Sequence: Synthetic oligonucleotide
ccggagtattgggaccgggagacacaa

SEQ ID NO: 379481 - DNA, 29 bp, Artificial Sequence
  Description of Artificial Sequence: Synthetic oligonucleotide
cggagtattgggaccgggagacacaaaag

SEQ ID NO: 379482 - DNA, 31 bp, Artificial Sequence
  Description of Artificial Sequence: Synthetic oligonucleotide
ggagtattgggaccgggagacacaaaagtac

SEQ ID NO: 379483 - DNA, 33 bp, Artificial Sequence
  Description of Artificial Sequence: Synthetic oligonucleotide
gagtattgggaccgggagacacaaaagtacaag

SEQ ID NO: 379484 - DNA, 33 bp, Artificial Sequence
  Description of Artificial Sequence: Synthetic oligonucleotide
agtattgggaccgggagacacaaaagtacaagc

SEQ ID NO: 379485 - DNA, 32 bp, Artificial Sequence
  Description of Artificial Sequence: Synthetic oligonucleotide
gtattgggaccgggagacacaaaagtacaagc

SEQ ID NO: 379486 - DNA, 32 bp, Artificial Sequence
  Description of Artificial Sequence: Synthetic oligonucleotide
tattgggaccgggagacacaaaagtacaagcg

SEQ ID NO: 379487 - DNA, 31 bp, Artificial Sequence
  Description of Artificial Sequence: Synthetic oligonucleotide
attgggaccgggagacacaaaagtacaagcg

SEQ ID NO: 379488 - DNA, 30 bp, Artificial Sequence
  Description of Artificial Sequence: Synthetic oligonucleotide
ttgggaccgggagacacaaaagtacaagcg

SEQ ID NO: 379489 - DNA, 29 bp, Artificial Sequence
  Description of Artificial Sequence: Synthetic oligonucleotide
tgggaccgggagacacaaaagtacaagcg

SEQ ID NO: 379490 - DNA, 28 bp, Artificial Sequence
  Description of Artificial Sequence: Synthetic oligonucleotide
gggaccgggagacacaaaagtacaagcg

SEQ ID NO: 379491 - DNA, 28 bp, Artificial Sequence
  Description of Artificial Sequence: Synthetic oligonucleotide
ggaccgggagacacaaaagtacaagcgc

SEQ ID NO: 379492 - DNA, 28 bp, Artificial Sequence
  Description of Artificial Sequence: Synthetic oligonucleotide
gaccgggagacacaaaagtacaagcgcc

SEQ ID NO: 379493 - DNA, 29 bp, Artificial Sequence
  Description of Artificial Sequence: Synthetic oligonucleotide
accgggagacacaaaagtacaagcgccag

SEQ ID NO: 379494 - DNA, 28 bp, Artificial Sequence
  Description of Artificial Sequence: Synthetic oligonucleotide
ccgggagacacaaaagtacaagcgccag

SEQ ID NO: 379495 - DNA, 28 bp, Artificial Sequence
  Description of Artificial Sequence: Synthetic oligonucleotide
cgggagacacaaaagtacaagcgccagg

SEQ ID NO: 379496 - DNA, 28 bp, Artificial Sequence
  Description of Artificial Sequence: Synthetic oligonucleotide
gggagacacaaaagtacaagcgccaggc

SEQ ID NO: 379497 - DNA, 29 bp, Artificial Sequence
  Description of Artificial Sequence: Synthetic oligonucleotide
ggagacacaaaagtacaagcgccaggcac

SEQ ID NO: 379498 - DNA, 30 bp, Artificial Sequence
  Description of Artificial Sequence: Synthetic oligonucleotide
gagacacaaaagtacaagcgccaggcacag

SEQ ID NO: 379499 - DNA, 31 bp, Artificial Sequence
  Description of Artificial Sequence: Synthetic oligonucleotide
agacacaaaagtacaagcgccaggcacagac

SEQ ID NO: 379500 - DNA, 30 bp, Artificial Sequence
  Description of Artificial Sequence: Synthetic oligonucleotide
gacacaaaagtacaagcgccaggcacagac

SEQ ID NO: 379501 - DNA, 31 bp, Artificial Sequence
  Description of Artificial Sequence: Synthetic oligonucleotide
acacaaaagtacaagcgccaggcacagactg

SEQ ID NO: 379502 - DNA, 30 bp, Artificial Sequence
  Description of Artificial Sequence: Synthetic oligonucleotide
cacaaaagtacaagcgccaggcacagactg

SEQ ID NO: 379503 - DNA, 31 bp, Artificial Sequence
  Description of Artificial Sequence: Synthetic oligonucleotide
acaaaagtacaagcgccaggcacagactgac

SEQ ID NO: 379504 - DNA, 30 bp, Artificial Sequence
  Description of Artificial Sequence: Synthetic oligonucleotide
caaaagtacaagcgccaggcacagactgac

SEQ ID NO: 379505 - DNA, 30 bp, Artificial Sequence
  Description of Artificial Sequence: Synthetic oligonucleotide
aaaagtacaagcgccaggcacagactgacc

SEQ ID NO: 379506 - DNA, 29 bp, Artificial Sequence
  Description of Artificial Sequence: Synthetic oligonucleotide
aaagtacaagcgccaggcacagactgacc

SEQ ID NO: 379507 - DNA, 31 bp, Artificial Sequence; identical to SEQ ID NO: 40229
  Description of Artificial Sequence: Synthetic oligonucleotide

SEQ ID NO: 379508 - DNA, 30 bp, Artificial Sequence; identical to SEQ ID NO: 40230
  Description of Artificial Sequence: Synthetic oligonucleotide

SEQ ID NO: 379509 - DNA, 29 bp, Artificial Sequence
  Description of Artificial Sequence: Synthetic oligonucleotide
tacatcgccctgaacgaggacctgagttc

SEQ ID NO: 379510 - DNA, 28 bp, Artificial Sequence
  Description of Artificial Sequence: Synthetic oligonucleotide
acatcgccctgaacgaggacctgagttc

SEQ ID NO: 379511 - DNA, 27 bp, Artificial Sequence
  Description of Artificial Sequence: Synthetic oligonucleotide
catcgccctgaacgaggacctgagttc

SEQ ID NO: 379512 - DNA, 27 bp, Artificial Sequence
  Description of Artificial Sequence: Synthetic oligonucleotide
atcgccctgaacgaggacctgagttcc

SEQ ID NO: 379513 - DNA, 27 bp, Artificial Sequence
  Description of Artificial Sequence: Synthetic oligonucleotide
tcgccctgaacgaggacctgagttcct

SEQ ID NO: 379514 - DNA, 26 bp, Artificial Sequence
  Description of Artificial Sequence: Synthetic oligonucleotide
cgccctgaacgaggacctgagttcct

SEQ ID NO: 379515 - DNA, 26 bp, Artificial Sequence
  Description of Artificial Sequence: Synthetic oligonucleotide
gccctgaacgaggacctgagttcctg

SEQ ID NO: 379516 - DNA, 27 bp, Artificial Sequence
  Description of Artificial Sequence: Synthetic oligonucleotide
ccctgaacgaggacctgagttcctgga

SEQ ID NO: 379517 - DNA, 27 bp, Artificial Sequence
  Description of Artificial Sequence: Synthetic oligonucleotide
cctgaacgaggacctgagttcctggac

SEQ ID NO: 379518 - DNA, 27 bp, Artificial Sequence
  Description of Artificial Sequence: Synthetic oligonucleotide
ctgaacgaggacctgagttcctggacc

SEQ ID NO: 379519 - DNA, 27 bp, Artificial Sequence
  Description of Artificial Sequence: Synthetic oligonucleotide
tgaacgaggacctgagttcctggaccg

SEQ ID NO: 379520 - DNA, 26 bp, Artificial Sequence
  Description of Artificial Sequence: Synthetic oligonucleotide
gaacgaggacctgagttcctggaccg

SEQ ID NO: 379521 - DNA, 26 bp, Artificial Sequence
  Description of Artificial Sequence: Synthetic oligonucleotide
aacgaggacctgagttcctggaccgc

SEQ ID NO: 379522 - DNA, 25 bp, Artificial Sequence
  Description of Artificial Sequence: Synthetic oligonucleotide
acgaggacctgagttcctggaccgc

SEQ ID NO: 379523 - DNA, 24 bp, Artificial Sequence
  Description of Artificial Sequence: Synthetic oligonucleotide
cgaggacctgagttcctggaccgc

SEQ ID NO: 379524 - DNA, 24 bp, Artificial Sequence
  Description of Artificial Sequence: Synthetic oligonucleotide
gaggacctgagttcctggaccgcg

SEQ ID NO: 379525 - DNA, 24 bp, Artificial Sequence
  Description of Artificial Sequence: Synthetic oligonucleotide
aggacctgagttcctggaccgcgg

SEQ ID NO: 379526 - DNA, 23 bp, Artificial Sequence
  Description of Artificial Sequence: Synthetic oligonucleotide
ggacctgagttcctggaccgcgg

SEQ ID NO: 379527 - DNA, 23 bp, Artificial Sequence
  Description of Artificial Sequence: Synthetic oligonucleotide
gacctgagttcctggaccgcggc

SEQ ID NO: 379528 - DNA, 23 bp, Artificial Sequence
  Description of Artificial Sequence: Synthetic oligonucleotide
acctgagttcctggaccgcggcg

SEQ ID NO: 379529 - DNA, 22 bp, Artificial Sequence
  Description of Artificial Sequence: Synthetic oligonucleotide
cctgagttcctggaccgcggcg

SEQ ID NO: 379530 - DNA, 23 bp, Artificial Sequence
  Description of Artificial Sequence: Synthetic oligonucleotide
ctgagttcctggaccgcggcgga

SEQ ID NO: 379531 - DNA, 24 bp, Artificial Sequence
  Description of Artificial Sequence: Synthetic oligonucleotide
tgagttcctggaccgcggcggaca

SEQ ID NO: 379532 - DNA, 23 bp, Artificial Sequence
  Description of Artificial Sequence: Synthetic oligonucleotide
gagttcctggaccgcggcggaca

SEQ ID NO: 379533 - DNA, 23 bp, Artificial Sequence
  Description of Artificial Sequence: Synthetic oligonucleotide
agttcctggaccgcggcggacac

SEQ ID NO: 379534 - DNA, 22 bp, Artificial Sequence
  Description of Artificial Sequence: Synthetic oligonucleotide
gttcctggaccgcggcggacac

SEQ ID NO: 379535 - DNA, 22 bp, Artificial Sequence
  Description of Artificial Sequence: Synthetic oligonucleotide
ttcctggaccgcggcggacacg

SEQ ID NO: 379536 - DNA, 28 bp, Artificial Sequence
  Description of Artificial Sequence: Synthetic oligonucleotide
agaagtacaagcgccaggcacagactgg

SEQ ID NO: 379537 - DNA, 27 bp, Artificial Sequence
  Description of Artificial Sequence: Synthetic oligonucleotide
gaagtacaagcgccaggcacagactgg

SEQ ID NO: 379538 - DNA, 27 bp, Artificial Sequence
  Description of Artificial Sequence: Synthetic oligonucleotide
aagtacaagcgccaggcacagactggc

SEQ ID NO: 379539 - DNA, 26 bp, Artificial Sequence
  Description of Artificial Sequence: Synthetic oligonucleotide
agtacaagcgccaggcacagactggc

SEQ ID NO: 379540 - DNA, 25 bp, Artificial Sequence
  Description of Artificial Sequence: Synthetic oligonucleotide
gtacaagcgccaggcacagactggc

SEQ ID NO: 379541 - DNA, 25 bp, Artificial Sequence
  Description of Artificial Sequence: Synthetic oligonucleotide
tacaagcgccaggcacagactggcc

SEQ ID NO: 379542 - DNA, 24 bp, Artificial Sequence
  Description of Artificial Sequence: Synthetic oligonucleotide
acaagcgccaggcacagactggcc

SEQ ID NO: 379543 - DNA, 23 bp, Artificial Sequence
  Description of Artificial Sequence: Synthetic oligonucleotide
caagcgccaggcacagactggcc

SEQ ID NO: 379544 - DNA, 24 bp, Artificial Sequence
  Description of Artificial Sequence: Synthetic oligonucleotide
aagcgccaggcacagactggccga

SEQ ID NO: 379545 - DNA, 23 bp, Artificial Sequence
  Description of Artificial Sequence: Synthetic oligonucleotide
agcgccaggcacagactggccga

SEQ ID NO: 379546 - DNA, 22 bp, Artificial Sequence
  Description of Artificial Sequence: Synthetic oligonucleotide
gcgccaggcacagactggccga

SEQ ID NO: 379547 - DNA, 23 bp, Artificial Sequence
  Description of Artificial Sequence: Synthetic oligonucleotide
cgccaggcacagactggccgagt

SEQ ID NO: 379548 - DNA, 24 bp, Artificial Sequence
  Description of Artificial Sequence: Synthetic oligonucleotide
gccaggcacagactggccgagtga

SEQ ID NO: 379549 - DNA, 24 bp, Artificial Sequence
  Description of Artificial Sequence: Synthetic oligonucleotide
ccaggcacagactggccgagtgag

SEQ ID NO: 379550 - DNA, 24 bp, Artificial Sequence
  Description of Artificial Sequence: Synthetic oligonucleotide
caggcacagactggccgagtgagc

SEQ ID NO: 379551 - DNA, 25 bp, Artificial Sequence
  Description of Artificial Sequence: Synthetic oligonucleotide
aggcacagactggccgagtgagcct

SEQ ID NO: 379552 - DNA, 24 bp, Artificial Sequence
  Description of Artificial Sequence: Synthetic oligonucleotide
ggcacagactggccgagtgagcct

SEQ ID NO: 379553 - DNA, 24 bp, Artificial Sequence
  Description of Artificial Sequence: Synthetic oligonucleotide
gcacagactggccgagtgagcctg

SEQ ID NO: 379554 - DNA, 24 bp, Artificial Sequence
  Description of Artificial Sequence: Synthetic oligonucleotide
cacagactggccgagtgagcctgc

SEQ ID NO: 379555 - DNA, 24 bp, Artificial Sequence
  Description of Artificial Sequence: Synthetic oligonucleotide
acagactggccgagtgagcctgcg

SEQ ID NO: 379556 - DNA, 23 bp, Artificial Sequence
  Description of Artificial Sequence: Synthetic oligonucleotide
cagactggccgagtgagcctgcg

SEQ ID NO: 379557 - DNA, 25 bp, Artificial Sequence
  Description of Artificial Sequence: Synthetic oligonucleotide
agactggccgagtgagcctgcggaa

SEQ ID NO: 379558 - DNA, 24 bp, Artificial Sequence
  Description of Artificial Sequence: Synthetic oligonucleotide
gactggccgagtgagcctgcggaa

SEQ ID NO: 379559 - DNA, 24 bp, Artificial Sequence
  Description of Artificial Sequence: Synthetic oligonucleotide
actggccgagtgagcctgcggaac

SEQ ID NO: 379560 - DNA, 23 bp, Artificial Sequence
  Description of Artificial Sequence: Synthetic oligonucleotide
ctggccgagtgagcctgcggaac

SEQ ID NO: 379561 - DNA, 24 bp, Artificial Sequence
  Description of Artificial Sequence: Synthetic oligonucleotide
tggccgagtgagcctgcggaacct

SEQ ID NO: 379562 - DNA, 23 bp, Artificial Sequence
  Description of Artificial Sequence: Synthetic oligonucleotide
ggccgagtgagcctgcggaacct

SEQ ID NO: 379563 - DNA, 23 bp, Artificial Sequence
  Description of Artificial Sequence: Synthetic oligonucleotide
gccgagtgagcctgcggaacctg

SEQ ID NO: 379564 - DNA, 26 bp, Artificial Sequence
  Description of Artificial Sequence: Synthetic oligonucleotide
tcatcggagctgtggtcgctgctgtg

SEQ ID NO: 379565 - DNA, 25 bp, Artificial Sequence
  Description of Artificial Sequence: Synthetic oligonucleotide
catcggagctgtggtcgctgctgtg

SEQ ID NO: 379566 - DNA, 26 bp, Artificial Sequence
  Description of Artificial Sequence: Synthetic oligonucleotide
atcggagctgtggtcgctgctgtggt

SEQ ID NO: 379567 - DNA, 25 bp, Artificial Sequence
  Description of Artificial Sequence: Synthetic oligonucleotide
tcggagctgtggtcgctgctgtggt

SEQ ID NO: 379568 - DNA, 24 bp, Artificial Sequence
  Description of Artificial Sequence: Synthetic oligonucleotide
cggagctgtggtcgctgctgtggt

SEQ ID NO: 379569 - DNA, 25 bp, Artificial Sequence
  Description of Artificial Sequence: Synthetic oligonucleotide
ggagctgtggtcgctgctgtggtgt

SEQ ID NO: 379570 - DNA, 27 bp, Artificial Sequence
  Description of Artificial Sequence: Synthetic oligonucleotide
gagctgtggtcgctgctgtggtgtgta

SEQ ID NO: 379571 - DNA, 27 bp, Artificial Sequence
  Description of Artificial Sequence: Synthetic oligonucleotide
agctgtggtcgctgctgtggtgtgtag

SEQ ID NO: 379572 - DNA, 26 bp, Artificial Sequence
  Description of Artificial Sequence: Synthetic oligonucleotide
gctgtggtcgctgctgtggtgtgtag

SEQ ID NO: 379573 - DNA, 27 bp, Artificial Sequence
  Description of Artificial Sequence: Synthetic oligonucleotide
ctgtggtcgctgctgtggtgtgtagga

SEQ ID NO: 379574 - DNA, 27 bp, Artificial Sequence
  Description of Artificial Sequence: Synthetic oligonucleotide
tgtggtcgctgctgtggtgtgtaggag

SEQ ID NO: 379575 - DNA, 26 bp, Artificial Sequence
  Description of Artificial Sequence: Synthetic oligonucleotide
gtggtcgctgctgtggtgtgtaggag

SEQ ID NO: 379576 - DNA, 27 bp, Artificial Sequence
  Description of Artificial Sequence: Synthetic oligonucleotide
tggtcgctgctgtggtgtgtaggagga

SEQ ID NO: 379577 - DNA, 27 bp, Artificial Sequence
  Description of Artificial Sequence: Synthetic oligonucleotide
ggtcgctgctgtggtgtgtaggaggaa

SEQ ID NO: 379578 - DNA, 27 bp, Artificial Sequence
  Description of Artificial Sequence: Synthetic oligonucleotide
gtcgctgctgtggtgtgtaggaggaag

SEQ ID NO: 379579 - DNA, 28 bp, Artificial Sequence
  Description of Artificial Sequence: Synthetic oligonucleotide
tcgctgctgtggtgtgtaggaggaagag

SEQ ID NO: 379580 - DNA, 27 bp, Artificial Sequence
  Description of Artificial Sequence: Synthetic oligonucleotide
cgctgctgtggtgtgtaggaggaagag

SEQ ID NO: 379581 - DNA, 27 bp, Artificial Sequence
  Description of Artificial Sequence: Synthetic oligonucleotide
gctgctgtggtgtgtaggaggaagagc

SEQ ID NO: 379582 - DNA, 28 bp, Artificial Sequence
  Description of Artificial Sequence: Synthetic oligonucleotide
ctgctgtggtgtgtaggaggaagagctc

SEQ ID NO: 379583 - DNA, 29 bp, Artificial Sequence
  Description of Artificial Sequence: Synthetic oligonucleotide
tgctgtggtgtgtaggaggaagagctcag

SEQ ID NO: 379584 - DNA, 28 bp, Artificial Sequence
  Description of Artificial Sequence: Synthetic oligonucleotide
gctgtggtgtgtaggaggaagagctcag

SEQ ID NO: 379585 - DNA, 28 bp, Artificial Sequence
  Description of Artificial Sequence: Synthetic oligonucleotide
ctgtggtgtgtaggaggaagagctcagg

SEQ ID NO: 379586 - DNA, 29 bp, Artificial Sequence
  Description of Artificial Sequence: Synthetic oligonucleotide
tgtggtgtgtaggaggaagagctcaggtg

SEQ ID NO: 379587 - DNA, 28 bp, Artificial Sequence
  Description of Artificial Sequence: Synthetic oligonucleotide
gtggtgtgtaggaggaagagctcaggtg

SEQ ID NO: 379588 - DNA, 28 bp, Artificial Sequence
  Description of Artificial Sequence: Synthetic oligonucleotide
tggtgtgtaggaggaagagctcaggtgg

SEQ ID NO: 379589 - DNA, 27 bp, Artificial Sequence
  Description of Artificial Sequence: Synthetic oligonucleotide
ggtgtgtaggaggaagagctcaggtgg

SEQ ID NO: 379590 - DNA, 31 bp, Artificial Sequence; identical to SEQ ID NO: 37496
  Description of Artificial Sequence: Synthetic oligonucleotide

SEQ ID NO: 379591 - DNA, 26 bp, Artificial Sequence
  Description of Artificial Sequence: Synthetic oligonucleotide
tgaggtgctgggccctgggcttctat

SEQ ID NO: 379592 - DNA, 25 bp, Artificial Sequence
  Description of Artificial Sequence: Synthetic oligonucleotide
gaggtgctgggccctgggcttctat

SEQ ID NO: 379593 - DNA, 25 bp, Artificial Sequence
  Description of Artificial Sequence: Synthetic oligonucleotide
aggtgctgggccctgggcttctatc

SEQ ID NO: 379594 - DNA, 24 bp, Artificial Sequence
  Description of Artificial Sequence: Synthetic oligonucleotide
ggtgctgggccctgggcttctatc

SEQ ID NO: 379595 - DNA, 25 bp, Artificial Sequence
  Description of Artificial Sequence: Synthetic oligonucleotide
gtgctgggccctgggcttctatcct

SEQ ID NO: 379596 - DNA, 25 bp, Artificial Sequence
  Description of Artificial Sequence: Synthetic oligonucleotide
tgctgggccctgggcttctatcctg

SEQ ID NO: 379597 - DNA, 24 bp, Artificial Sequence
  Description of Artificial Sequence: Synthetic oligonucleotide
gctgggccctgggcttctatcctg

SEQ ID NO: 379598 - DNA, 24 bp, Artificial Sequence
  Description of Artificial Sequence: Synthetic oligonucleotide
ctgggccctgggcttctatcctgc

SEQ ID NO: 379599 - DNA, 24 bp, Artificial Sequence
  Description of Artificial Sequence: Synthetic oligonucleotide
tgggccctgggcttctatcctgcg

SEQ ID NO: 379600 - DNA, 23 bp, Artificial Sequence
  Description of Artificial Sequence: Synthetic oligonucleotide
gggccctgggcttctatcctgcg

SEQ ID NO: 379601 - DNA, 24 bp, Artificial Sequence
  Description of Artificial Sequence: Synthetic oligonucleotide
ggccctgggcttctatcctgcgga

SEQ ID NO: 379602 - DNA, 26 bp, Artificial Sequence
  Description of Artificial Sequence: Synthetic oligonucleotide
gccctgggcttctatcctgcggagat

SEQ ID NO: 379603 - DNA, 27 bp, Artificial Sequence
  Description of Artificial Sequence: Synthetic oligonucleotide
ccctgggcttctatcctgcggagatca

SEQ ID NO: 379604 - DNA, 27 bp, Artificial Sequence
  Description of Artificial Sequence: Synthetic oligonucleotide
cctgggcttctatcctgcggagatcac

SEQ ID NO: 379605 - DNA, 28 bp, Artificial Sequence
  Description of Artificial Sequence: Synthetic oligonucleotide
ctgggcttctatcctgcggagatcacac

SEQ ID NO: 379606 - DNA, 29 bp, Artificial Sequence
  Description of Artificial Sequence: Synthetic oligonucleotide
tgggcttctatcctgcggagatcacactg

SEQ ID NO: 379607 - DNA, 28 bp, Artificial Sequence
  Description of Artificial Sequence: Synthetic oligonucleotide
gggcttctatcctgcggagatcacactg

SEQ ID NO: 379608 - DNA, 29 bp, Artificial Sequence
  Description of Artificial Sequence: Synthetic oligonucleotide
ggcttctatcctgcggagatcacactgac

SEQ ID NO: 379609 - DNA, 27 bp, Artificial Sequence
  Description of Artificial Sequence: Synthetic oligonucleotide
ttaccgagagagcctgcggaacctgct

SEQ ID NO: 379610 - DNA, 26 bp, Artificial Sequence
  Description of Artificial Sequence: Synthetic oligonucleotide
taccgagagagcctgcggaacctgct

SEQ ID NO: 379611 - DNA, 25 bp, Artificial Sequence
  Description of Artificial Sequence: Synthetic oligonucleotide
accgagagagcctgcggaacctgct

SEQ ID NO: 379612 - DNA, 24 bp, Artificial Sequence
  Description of Artificial Sequence: Synthetic oligonucleotide
ccgagagagcctgcggaacctgct

SEQ ID NO: 379613 - DNA, 24 bp, Artificial Sequence
  Description of Artificial Sequence: Synthetic oligonucleotide
cgagagagcctgcggaacctgctc

SEQ ID NO: 379614 - DNA, 24 bp, Artificial Sequence
  Description of Artificial Sequence: Synthetic oligonucleotide
gagagagcctgcggaacctgctcc

SEQ ID NO: 379615 - DNA, 24 bp, Artificial Sequence
  Description of Artificial Sequence: Synthetic oligonucleotide
agagagcctgcggaacctgctccg

SEQ ID NO: 379616 - DNA, 23 bp, Artificial Sequence
  Description of Artificial Sequence: Synthetic oligonucleotide
gagagcctgcggaacctgctccg

SEQ ID NO: 379617 - DNA, 25 bp, Artificial Sequence
  Description of Artificial Sequence: Synthetic oligonucleotide
agagcctgcggaacctgctccgcta

SEQ ID NO: 379618 - DNA, 24 bp, Artificial Sequence
  Description of Artificial Sequence: Synthetic oligonucleotide
gagcctgcggaacctgctccgcta

SEQ ID NO: 379619 - DNA, 26 bp, Artificial Sequence
  Description of Artificial Sequence: Synthetic oligonucleotide
agcctgcggaacctgctccgctacta

SEQ ID NO: 379620 - DNA, 25 bp, Artificial Sequence
  Description of Artificial Sequence: Synthetic oligonucleotide
gcctgcggaacctgctccgctacta

SEQ ID NO: 379621 - DNA, 27 bp, Artificial Sequence
  Description of Artificial Sequence: Synthetic oligonucleotide
cctgcggaacctgctccgctactacaa

SEQ ID NO: 379622 - DNA, 27 bp, Artificial Sequence
  Description of Artificial Sequence: Synthetic oligonucleotide
ctgcggaacctgctccgctactacaac

SEQ ID NO: 379623 - DNA, 27 bp, Artificial Sequence
  Description of Artificial Sequence: Synthetic oligonucleotide
tgcggaacctgctccgctactacaacc

SEQ ID NO: 379624 - DNA, 27 bp, Artificial Sequence
  Description of Artificial Sequence: Synthetic oligonucleotide
gcggaacctgctccgctactacaacca

SEQ ID NO: 379625 - DNA, 27 bp, Artificial Sequence
  Description of Artificial Sequence: Synthetic oligonucleotide
cggaacctgctccgctactacaaccag

SEQ ID NO: 379626 - DNA, 28 bp, Artificial Sequence
  Description of Artificial Sequence: Synthetic oligonucleotide
ggaacctgctccgctactacaaccagag

SEQ ID NO: 379627 - DNA, 28 bp, Artificial Sequence
  Description of Artificial Sequence: Synthetic oligonucleotide
gaacctgctccgctactacaaccagagc

SEQ ID NO: 379628 - DNA, 28 bp, Artificial Sequence
  Description of Artificial Sequence: Synthetic oligonucleotide
aacctgctccgctactacaaccagagcg

SEQ ID NO: 379629 - DNA, 27 bp, Artificial Sequence
  Description of Artificial Sequence: Synthetic oligonucleotide
acctgctccgctactacaaccagagcg

SEQ ID NO: 379630 - DNA, 31 bp, Artificial Sequence; identical to SEQ ID NO: 37497
  Description of Artificial Sequence: Synthetic oligonucleotide

SEQ ID NO: 379631 - DNA, 32 bp, Artificial Sequence; identical to SEQ ID NO: 37498
  Description of Artificial Sequence: Synthetic oligonucleotide

SEQ ID NO: 379632 - DNA, 31 bp, Artificial Sequence; identical to SEQ ID NO: 37499
  Description of Artificial Sequence: Synthetic oligonucleotide

SEQ ID NO: 379633 - DNA, 31 bp, Artificial Sequence; identical to SEQ ID NO: 37500
  Description of Artificial Sequence: Synthetic oligonucleotide

SEQ ID NO: 379634 - DNA, 32 bp, Artificial Sequence; identical to SEQ ID NO: 37501
  Description of Artificial Sequence: Synthetic oligonucleotide

SEQ ID NO: 379635 - DNA, 31 bp, Artificial Sequence; identical to SEQ ID NO: 37502
  Description of Artificial Sequence: Synthetic oligonucleotide

SEQ ID NO: 379636 - DNA, 32 bp, Artificial Sequence; identical to SEQ ID NO: 37503
  Description of Artificial Sequence: Synthetic oligonucleotide

SEQ ID NO: 379637 - DNA, 32 bp, Artificial Sequence; identical to SEQ ID NO: 37504
  Description of Artificial Sequence: Synthetic oligonucleotide

SEQ ID NO: 379638 - DNA, 31 bp, Artificial Sequence; identical to SEQ ID NO: 37505
  Description of Artificial Sequence: Synthetic oligonucleotide

SEQ ID NO: 379639 - DNA, 32 bp, Artificial Sequence; identical to SEQ ID NO: 37506
  Description of Artificial Sequence: Synthetic oligonucleotide

SEQ ID NO: 379640 - DNA, 31 bp, Artificial Sequence; identical to SEQ ID NO: 37507
  Description of Artificial Sequence: Synthetic oligonucleotide

SEQ ID NO: 379641 - DNA, 30 bp, Artificial Sequence; identical to SEQ ID NO: 37508
  Description of Artificial Sequence: Synthetic oligonucleotide

SEQ ID NO: 379642 - DNA, 29 bp, Artificial Sequence
  Description of Artificial Sequence: Synthetic oligonucleotide
gaaccttccagaagtggacagctgtggtg

SEQ ID NO: 379643 - DNA, 29 bp, Artificial Sequence
  Description of Artificial Sequence: Synthetic oligonucleotide
aaccttccagaagtggacagctgtggtgg

SEQ ID NO: 379644 - DNA, 28 bp, Artificial Sequence
  Description of Artificial Sequence: Synthetic oligonucleotide
accttccagaagtggacagctgtggtgg

SEQ ID NO: 379645 - DNA, 27 bp, Artificial Sequence
  Description of Artificial Sequence: Synthetic oligonucleotide
ccttccagaagtggacagctgtggtgg

SEQ ID NO: 379646 - DNA, 28 bp, Artificial Sequence
  Description of Artificial Sequence: Synthetic oligonucleotide
cttccagaagtggacagctgtggtggtg

SEQ ID NO: 379647 - DNA, 28 bp, Artificial Sequence
  Description of Artificial Sequence: Synthetic oligonucleotide
ttccagaagtggacagctgtggtggtgc

SEQ ID NO: 379648 - DNA, 27 bp, Artificial Sequence
  Description of Artificial Sequence: Synthetic oligonucleotide
tccagaagtggacagctgtggtggtgc

SEQ ID NO: 379649 - DNA, 26 bp, Artificial Sequence
  Description of Artificial Sequence: Synthetic oligonucleotide
ccagaagtggacagctgtggtggtgc

SEQ ID NO: 379650 - DNA, 27 bp, Artificial Sequence
  Description of Artificial Sequence: Synthetic oligonucleotide
cagaagtggacagctgtggtggtgcct

SEQ ID NO: 379651 - DNA, 28 bp, Artificial Sequence
  Description of Artificial Sequence: Synthetic oligonucleotide
agaagtggacagctgtggtggtgccttc

SEQ ID NO: 379652 - DNA, 27 bp, Artificial Sequence
  Description of Artificial Sequence: Synthetic oligonucleotide
gaagtggacagctgtggtggtgccttc

SEQ ID NO: 379653 - DNA, 28 bp, Artificial Sequence
  Description of Artificial Sequence: Synthetic oligonucleotide
aagtggacagctgtggtggtgccttctg

SEQ ID NO: 379654 - DNA, 27 bp, Artificial Sequence
  Description of Artificial Sequence: Synthetic oligonucleotide
agtggacagctgtggtggtgccttctg

SEQ ID NO: 379655 - DNA, 26 bp, Artificial Sequence
  Description of Artificial Sequence: Synthetic oligonucleotide
gtggacagctgtggtggtgccttctg

SEQ ID NO: 379656 - DNA, 27 bp, Artificial Sequence
  Description of Artificial Sequence: Synthetic oligonucleotide
tggacagctgtggtggtgccttctgga

SEQ ID NO: 379657 - DNA, 26 bp, Artificial Sequence
  Description of Artificial Sequence: Synthetic oligonucleotide
ggacagctgtggtggtgccttctgga

SEQ ID NO: 379658 - DNA, 27 bp, Artificial Sequence
  Description of Artificial Sequence: Synthetic oligonucleotide
gacagctgtggtggtgccttctggaga

SEQ ID NO: 379659 - DNA, 28 bp, Artificial Sequence
  Description of Artificial Sequence: Synthetic oligonucleotide
acagctgtggtggtgccttctggagaag

SEQ ID NO: 379660 - DNA, 22 bp, Artificial Sequence
  Description of Artificial Sequence: Synthetic oligonucleotide
agagaggagccgcgggcgcctt

SEQ ID NO: 379661 - DNA, 21 bp, Artificial Sequence
  Description of Artificial Sequence: Synthetic oligonucleotide
gagaggagccgcgggcgcctt

SEQ ID NO: 379662 - DNA, 21 bp, Artificial Sequence
  Description of Artificial Sequence: Synthetic oligonucleotide
agaggagccgcgggcgccttg

SEQ ID NO: 379663 - DNA, 20 bp, Artificial Sequence
  Description of Artificial Sequence: Synthetic oligonucleotide
gaggagccgcgggcgccttg

SEQ ID NO: 379664 - DNA, 23 bp, Artificial Sequence
  Description of Artificial Sequence: Synthetic oligonucleotide
aggagccgcgggcgccttggata

SEQ ID NO: 379665 - DNA, 26 bp, Artificial Sequence
  Description of Artificial Sequence: Synthetic oligonucleotide
tacagcatgaggggctgccgaagcct

SEQ ID NO: 379666 - DNA, 25 bp, Artificial Sequence
  Description of Artificial Sequence: Synthetic oligonucleotide
acagcatgaggggctgccgaagcct

SEQ ID NO: 379667 - DNA, 24 bp, Artificial Sequence
  Description of Artificial Sequence: Synthetic oligonucleotide
cagcatgaggggctgccgaagcct

SEQ ID NO: 379668 - DNA, 25 bp, Artificial Sequence
  Description of Artificial Sequence: Synthetic oligonucleotide
agcatgaggggctgccgaagcctct

SEQ ID NO: 379669 - DNA, 24 bp, Artificial Sequence
  Description of Artificial Sequence: Synthetic oligonucleotide
gcatgaggggctgccgaagcctct

SEQ ID NO: 379670 - DNA, 25 bp, Artificial Sequence
  Description of Artificial Sequence: Synthetic oligonucleotide
catgaggggctgccgaagcctctca

SEQ ID NO: 379671 - DNA, 25 bp, Artificial Sequence
  Description of Artificial Sequence: Synthetic oligonucleotide
atgaggggctgccgaagcctctcac

SEQ ID NO: 379672 - DNA, 24 bp, Artificial Sequence
  Description of Artificial Sequence: Synthetic oligonucleotide
tgaggggctgccgaagcctctcac

SEQ ID NO: 379673 - DNA, 23 bp, Artificial Sequence
  Description of Artificial Sequence: Synthetic oligonucleotide
gaggggctgccgaagcctctcac

SEQ ID NO: 379674 - DNA, 23 bp, Artificial Sequence
  Description of Artificial Sequence: Synthetic oligonucleotide
aggggctgccgaagcctctcacc

SEQ ID NO: 379675 - DNA, 22 bp, Artificial Sequence
  Description of Artificial Sequence: Synthetic oligonucleotide
ggggctgccgaagcctctcacc

SEQ ID NO: 379676 - DNA, 23 bp, Artificial Sequence
  Description of Artificial Sequence: Synthetic oligonucleotide
gggctgccgaagcctctcaccct

SEQ ID NO: 379677 - DNA, 24 bp, Artificial Sequence
  Description of Artificial Sequence: Synthetic oligonucleotide
ggctgccgaagcctctcaccctga

SEQ ID NO: 379678 - DNA, 26 bp, Artificial Sequence
  Description of Artificial Sequence: Synthetic oligonucleotide
gctgccgaagcctctcaccctgagat

SEQ ID NO: 379679 - DNA, 26 bp, Artificial Sequence
  Description of Artificial Sequence: Synthetic oligonucleotide
ctgccgaagcctctcaccctgagatg

SEQ ID NO: 379680 - DNA, 26 bp, Artificial Sequence
  Description of Artificial Sequence: Synthetic oligonucleotide
tgccgaagcctctcaccctgagatgg

SEQ ID NO: 379681 - DNA, 25 bp, Artificial Sequence
  Description of Artificial Sequence: Synthetic oligonucleotide
gccgaagcctctcaccctgagatgg

SEQ ID NO: 379682 - DNA, 26 bp, Artificial Sequence
  Description of Artificial Sequence: Synthetic oligonucleotide
ccgaagcctctcaccctgagatggga

SEQ ID NO: 379683 - DNA, 26 bp, Artificial Sequence
  Description of Artificial Sequence: Synthetic oligonucleotide
cgaagcctctcaccctgagatgggag

SEQ ID NO: 379684 - DNA, 26 bp, Artificial Sequence
  Description of Artificial Sequence: Synthetic oligonucleotide
gaagcctctcaccctgagatgggagc

SEQ ID NO: 379685 - DNA, 26 bp, Artificial Sequence
  Description of Artificial Sequence: Synthetic oligonucleotide
aagcctctcaccctgagatgggagcc

SEQ ID NO: 379686 - DNA, 25 bp, Artificial Sequence
  Description of Artificial Sequence: Synthetic oligonucleotide
agcctctcaccctgagatgggagcc

SEQ ID NO: 379687 - DNA, 24 bp, Artificial Sequence
  Description of Artificial Sequence: Synthetic oligonucleotide
gcctctcaccctgagatgggagcc

SEQ ID NO: 379688 - DNA, 25 bp, Artificial Sequence
  Description of Artificial Sequence: Synthetic oligonucleotide
cctctcaccctgagatgggagccgt

SEQ ID NO: 379689 - DNA, 27 bp, Artificial Sequence
  Description of Artificial Sequence: Synthetic oligonucleotide
ctctcaccctgagatgggagccgtctt

SEQ ID NO: 379690 - DNA, 27 bp, Artificial Sequence
  Description of Artificial Sequence: Synthetic oligonucleotide
tctcaccctgagatgggagccgtcttc

SEQ ID NO: 379691 - DNA, 22 bp, Artificial Sequence
  Description of Artificial Sequence: Synthetic oligonucleotide
gccgcggggagccccgctttat

SEQ ID NO: 379692 - DNA, 23 bp, Artificial Sequence
  Description of Artificial Sequence: Synthetic oligonucleotide
ccgcggggagccccgctttatct

SEQ ID NO: 379693 - DNA, 24 bp, Artificial Sequence
  Description of Artificial Sequence: Synthetic oligonucleotide
cgcggggagccccgctttatctca

SEQ ID NO: 379694 - DNA, 25 bp, Artificial Sequence
  Description of Artificial Sequence: Synthetic oligonucleotide
gcggggagccccgctttatctcagt

SEQ ID NO: 379695 - DNA, 25 bp, Artificial Sequence
  Description of Artificial Sequence: Synthetic oligonucleotide
cggggagccccgctttatctcagtg

SEQ ID NO: 379696 - DNA, 25 bp, Artificial Sequence
  Description of Artificial Sequence: Synthetic oligonucleotide
ggggagccccgctttatctcagtgg

SEQ ID NO: 379697 - DNA, 25 bp, Artificial Sequence
  Description of Artificial Sequence: Synthetic oligonucleotide
gggagccccgctttatctcagtggg

SEQ ID NO: 379698 - DNA, 27 bp, Artificial Sequence
  Description of Artificial Sequence: Synthetic oligonucleotide
ggagccccgctttatctcagtgggcta

SEQ ID NO: 379699 - DNA, 27 bp, Artificial Sequence
  Description of Artificial Sequence: Synthetic oligonucleotide
gagccccgctttatctcagtgggctac

SEQ ID NO: 379700 - DNA, 27 bp, Artificial Sequence
  Description of Artificial Sequence: Synthetic oligonucleotide
agccccgctttatctcagtgggctacg

SEQ ID NO: 379701 - DNA, 27 bp, Artificial Sequence
  Description of Artificial Sequence: Synthetic oligonucleotide
gccccgctttatctcagtgggctacgt

SEQ ID NO: 379702 - DNA, 27 bp, Artificial Sequence
  Description of Artificial Sequence: Synthetic oligonucleotide
ccccgctttatctcagtgggctacgtg

SEQ ID NO: 379703 - DNA, 27 bp, Artificial Sequence
  Description of Artificial Sequence: Synthetic oligonucleotide
cccgctttatctcagtgggctacgtgg

SEQ ID NO: 379704 - DNA, 28 bp, Artificial Sequence
  Description of Artificial Sequence: Synthetic oligonucleotide
ccgctttatctcagtgggctacgtggac

SEQ ID NO: 379705 - DNA, 28 bp, Artificial Sequence
  Description of Artificial Sequence: Synthetic oligonucleotide
cgctttatctcagtgggctacgtggacg

SEQ ID NO: 379706 - DNA, 29 bp, Artificial Sequence
  Description of Artificial Sequence: Synthetic oligonucleotide
gctttatctcagtgggctacgtggacgac

SEQ ID NO: 379707 - DNA, 30 bp, Artificial Sequence; identical to SEQ ID NO: 37590
  Description of Artificial Sequence: Synthetic oligonucleotide

SEQ ID NO: 379708 - DNA, 30 bp, Artificial Sequence; identical to SEQ ID NO: 37591
  Description of Artificial Sequence: Synthetic oligonucleotide

SEQ ID NO: 379709 - DNA, 29 bp, Artificial Sequence
  Description of Artificial Sequence: Synthetic oligonucleotide
ttatctcagtgggctacgtggacgacacc

SEQ ID NO: 379710 - DNA, 28 bp, Artificial Sequence
  Description of Artificial Sequence: Synthetic oligonucleotide
tatctcagtgggctacgtggacgacacc

SEQ ID NO: 379711 - DNA, 21 bp, Artificial Sequence
  Description of Artificial Sequence: Synthetic oligonucleotide
gcggcccgtgaagcggagcag

SEQ ID NO: 379712 - DNA, 22 bp, Artificial Sequence
  Description of Artificial Sequence: Synthetic oligonucleotide
cggcccgtgaagcggagcagct

SEQ ID NO: 379713 - DNA, 23 bp, Artificial Sequence
  Description of Artificial Sequence: Synthetic oligonucleotide
ggcccgtgaagcggagcagctga

SEQ ID NO: 379714 - DNA, 24 bp, Artificial Sequence
  Description of Artificial Sequence: Synthetic oligonucleotide
gcccgtgaagcggagcagctgaga

SEQ ID NO: 379715 - DNA, 24 bp, Artificial Sequence
  Description of Artificial Sequence: Synthetic oligonucleotide
cccgtgaagcggagcagctgagag

SEQ ID NO: 379716 - DNA, 24 bp, Artificial Sequence
  Description of Artificial Sequence: Synthetic oligonucleotide
ccgtgaagcggagcagctgagagc

SEQ ID NO: 379717 - DNA, 26 bp, Artificial Sequence
  Description of Artificial Sequence: Synthetic oligonucleotide
cgtgaagcggagcagctgagagccta

SEQ ID NO: 379718 - DNA, 26 bp, Artificial Sequence
  Description of Artificial Sequence: Synthetic oligonucleotide
gtgaagcggagcagctgagagcctac

SEQ ID NO: 379719 - DNA, 27 bp, Artificial Sequence
  Description of Artificial Sequence: Synthetic oligonucleotide
tgaagcggagcagctgagagcctacct

SEQ ID NO: 379720 - DNA, 26 bp, Artificial Sequence
  Description of Artificial Sequence: Synthetic oligonucleotide
gaagcggagcagctgagagcctacct

SEQ ID NO: 379721 - DNA, 26 bp, Artificial Sequence
  Description of Artificial Sequence: Synthetic oligonucleotide
aagcggagcagctgagagcctacctg

SEQ ID NO: 379722 - DNA, 25 bp, Artificial Sequence
  Description of Artificial Sequence: Synthetic oligonucleotide
agcggagcagctgagagcctacctg

SEQ ID NO: 379723 - DNA, 23 bp, Artificial Sequence
  Description of Artificial Sequence: Synthetic oligonucleotide
cggacaccgcggctcagatcacg

SEQ ID NO: 379724 - DNA, 24 bp, Artificial Sequence
  Description of Artificial Sequence: Synthetic oligonucleotide
ggacaccgcggctcagatcacgca

SEQ ID NO: 379725 - DNA, 24 bp, Artificial Sequence
  Description of Artificial Sequence: Synthetic oligonucleotide
gacaccgcggctcagatcacgcag

SEQ ID NO: 379726 - DNA, 24 bp, Artificial Sequence
  Description of Artificial Sequence: Synthetic oligonucleotide
acaccgcggctcagatcacgcagc

SEQ ID NO: 379727 - DNA, 23 bp, Artificial Sequence
  Description of Artificial Sequence: Synthetic oligonucleotide
caccgcggctcagatcacgcagc

SEQ ID NO: 379728 - DNA, 23 bp, Artificial Sequence
  Description of Artificial Sequence: Synthetic oligonucleotide
accgcggctcagatcacgcagcg

SEQ ID NO: 379729 - DNA, 22 bp, Artificial Sequence
  Description of Artificial Sequence: Synthetic oligonucleotide
ccgcggctcagatcacgcagcg

SEQ ID NO: 379730 - DNA, 24 bp, Artificial Sequence
  Description of Artificial Sequence: Synthetic oligonucleotide
cgcggctcagatcacgcagcgcaa

SEQ ID NO: 379731 - DNA, 26 bp, Artificial Sequence
  Description of Artificial Sequence: Synthetic oligonucleotide
ctcagatcacgcagcgcaagtgggag

SEQ ID NO: 379732 - DNA, 26 bp, Artificial Sequence
  Description of Artificial Sequence: Synthetic oligonucleotide
tcagatcacgcagcgcaagtgggagg

SEQ ID NO: 379733 - DNA, 25 bp, Artificial Sequence
  Description of Artificial Sequence: Synthetic oligonucleotide
cagatcacgcagcgcaagtgggagg

SEQ ID NO: 379734 - DNA, 25 bp, Artificial Sequence
  Description of Artificial Sequence: Synthetic oligonucleotide
agatcacgcagcgcaagtgggaggc

SEQ ID NO: 379735 - DNA, 24 bp, Artificial Sequence
  Description of Artificial Sequence: Synthetic oligonucleotide
gatcacgcagcgcaagtgggaggc

SEQ ID NO: 379736 - DNA, 24 bp, Artificial Sequence
  Description of Artificial Sequence: Synthetic oligonucleotide
atcacgcagcgcaagtgggaggcg

SEQ ID NO: 379737 - DNA, 23 bp, Artificial Sequence
  Description of Artificial Sequence: Synthetic oligonucleotide
tcacgcagcgcaagtgggaggcg

SEQ ID NO: 379738 - DNA, 22 bp, Artificial Sequence
  Description of Artificial Sequence: Synthetic oligonucleotide
cacgcagcgcaagtgggaggcg

SEQ ID NO: 379739 - DNA, 22 bp, Artificial Sequence
  Description of Artificial Sequence: Synthetic oligonucleotide
acgcagcgcaagtgggaggcgg

SEQ ID NO: 379740 - DNA, 21 bp, Artificial Sequence
  Description of Artificial Sequence: Synthetic oligonucleotide
cgcagcgcaagtgggaggcgg

SEQ ID NO: 379741 - DNA, 21 bp, Artificial Sequence
  Description of Artificial Sequence: Synthetic oligonucleotide
gcagcgcaagtgggaggcggc

SEQ ID NO: 379742 - DNA, 30 bp, Artificial Sequence; identical to SEQ ID NO: 37749
  Description of Artificial Sequence: Synthetic oligonucleotide

SEQ ID NO: 379743 - DNA, 29 bp, Artificial Sequence
  Description of Artificial Sequence: Synthetic oligonucleotide
cacttggcagaggatgtatggctgcgatc

SEQ ID NO: 379744 - DNA, 30 bp, Artificial Sequence; identical to SEQ ID NO: 37751
  Description of Artificial Sequence: Synthetic oligonucleotide

SEQ ID NO: 379745 - DNA, 29 bp, Artificial Sequence
  Description of Artificial Sequence: Synthetic oligonucleotide
cttggcagaggatgtatggctgcgatctg

SEQ ID NO: 379746 - DNA, 29 bp, Artificial Sequence
  Description of Artificial Sequence: Synthetic oligonucleotide
ttggcagaggatgtatggctgcgatctgg

SEQ ID NO: 379747 - DNA, 28 bp, Artificial Sequence
  Description of Artificial Sequence: Synthetic oligonucleotide
tggcagaggatgtatggctgcgatctgg

SEQ ID NO: 379748 - DNA, 27 bp, Artificial Sequence
  Description of Artificial Sequence: Synthetic oligonucleotide
ggcagaggatgtatggctgcgatctgg

SEQ ID NO: 379749 - DNA, 27 bp, Artificial Sequence
  Description of Artificial Sequence: Synthetic oligonucleotide
gcagaggatgtatggctgcgatctggg

SEQ ID NO: 379750 - DNA, 27 bp, Artificial Sequence
  Description of Artificial Sequence: Synthetic oligonucleotide
cagaggatgtatggctgcgatctgggg

SEQ ID NO: 379751 - DNA, 27 bp, Artificial Sequence
  Description of Artificial Sequence: Synthetic oligonucleotide
agaggatgtatggctgcgatctggggc

SEQ ID NO: 379752 - DNA, 26 bp, Artificial Sequence
  Description of Artificial Sequence: Synthetic oligonucleotide
gaggatgtatggctgcgatctggggc

SEQ ID NO: 379753 - DNA, 26 bp, Artificial Sequence
  Description of Artificial Sequence: Synthetic oligonucleotide
aggatgtatggctgcgatctggggcc

SEQ ID NO: 379754 - DNA, 25 bp, Artificial Sequence
  Description of Artificial Sequence: Synthetic oligonucleotide
ggatgtatggctgcgatctggggcc

SEQ ID NO: 379755 - DNA, 25 bp, Artificial Sequence
  Description of Artificial Sequence: Synthetic oligonucleotide
gatgtatggctgcgatctggggccc

SEQ ID NO: 379756 - DNA, 26 bp, Artificial Sequence
  Description of Artificial Sequence: Synthetic oligonucleotide
atgtatggctgcgatctggggcccga

SEQ ID NO: 379757 - DNA, 25 bp, Artificial Sequence
  Description of Artificial Sequence: Synthetic oligonucleotide
tgtatggctgcgatctggggcccga

SEQ ID NO: 379758 - DNA, 24 bp, Artificial Sequence
  Description of Artificial Sequence: Synthetic oligonucleotide
gtatggctgcgatctggggcccga

SEQ ID NO: 379759 - DNA, 24 bp, Artificial Sequence
  Description of Artificial Sequence: Synthetic oligonucleotide
tatggctgcgatctggggcccgac

SEQ ID NO: 379760 - DNA, 23 bp, Artificial Sequence
  Description of Artificial Sequence: Synthetic oligonucleotide
atggctgcgatctggggcccgac

SEQ ID NO: 379761 - DNA, 22 bp, Artificial Sequence
  Description of Artificial Sequence: Synthetic oligonucleotide
tggctgcgatctggggcccgac

SEQ ID NO: 379762 - DNA, 21 bp, Artificial Sequence
  Description of Artificial Sequence: Synthetic oligonucleotide
ggctgcgatctggggcccgac

SEQ ID NO: 379763 - DNA, 21 bp, Artificial Sequence
  Description of Artificial Sequence: Synthetic oligonucleotide
gctgcgatctggggcccgacg

SEQ ID NO: 379764 - DNA, 21 bp, Artificial Sequence
  Description of Artificial Sequence: Synthetic oligonucleotide
ctgcgatctggggcccgacgg

SEQ ID NO: 379765 - DNA, 21 bp, Artificial Sequence
  Description of Artificial Sequence: Synthetic oligonucleotide
tgcgatctggggcccgacggg

SEQ ID NO: 379766 - DNA, 20 bp, Artificial Sequence
  Description of Artificial Sequence: Synthetic oligonucleotide
gcgatctggggcccgacggg

SEQ ID NO: 379767 - DNA, 20 bp, Artificial Sequence
  Description of Artificial Sequence: Synthetic oligonucleotide
cgatctggggcccgacgggc

SEQ ID NO: 379768 - DNA, 20 bp, Artificial Sequence
  Description of Artificial Sequence: Synthetic oligonucleotide
gatctggggcccgacgggcg

SEQ ID NO: 379769 - DNA, 20 bp, Artificial Sequence
  Description of Artificial Sequence: Synthetic oligonucleotide
atctggggcccgacgggcgc

SEQ ID NO: 379770 - DNA, 20 bp, Artificial Sequence
  Description of Artificial Sequence: Synthetic oligonucleotide
tctggggcccgacgggcgct

SEQ ID NO: 379771 - DNA, 21 bp, Artificial Sequence
  Description of Artificial Sequence: Synthetic oligonucleotide
gcggcccgtgaggcggagcaa

SEQ ID NO: 379772 - DNA, 22 bp, Artificial Sequence
  Description of Artificial Sequence: Synthetic oligonucleotide
cggcccgtgaggcggagcaact

SEQ ID NO: 379773 - DNA, 23 bp, Artificial Sequence
  Description of Artificial Sequence: Synthetic oligonucleotide
ggcccgtgaggcggagcaactga

SEQ ID NO: 379774 - DNA, 24 bp, Artificial Sequence
  Description of Artificial Sequence: Synthetic oligonucleotide
gcccgtgaggcggagcaactgaga

SEQ ID NO: 379775 - DNA, 24 bp, Artificial Sequence
  Description of Artificial Sequence: Synthetic oligonucleotide
cccgtgaggcggagcaactgagag

SEQ ID NO: 379776 - DNA, 24 bp, Artificial Sequence
  Description of Artificial Sequence: Synthetic oligonucleotide
ccgtgaggcggagcaactgagagc

SEQ ID NO: 379777 - DNA, 26 bp, Artificial Sequence
  Description of Artificial Sequence: Synthetic oligonucleotide
cgtgaggcggagcaactgagagccta

SEQ ID NO: 379778 - DNA, 26 bp, Artificial Sequence
  Description of Artificial Sequence: Synthetic oligonucleotide
gtgaggcggagcaactgagagcctac

SEQ ID NO: 379779 - DNA, 27 bp, Artificial Sequence
  Description of Artificial Sequence: Synthetic oligonucleotide
tgaggcggagcaactgagagcctacct

SEQ ID NO: 379780 - DNA, 26 bp, Artificial Sequence
  Description of Artificial Sequence: Synthetic oligonucleotide
gaggcggagcaactgagagcctacct

SEQ ID NO: 379781 - DNA, 26 bp, Artificial Sequence
  Description of Artificial Sequence: Synthetic oligonucleotide
aggcggagcaactgagagcctacctg

SEQ ID NO: 379782 - DNA, 25 bp, Artificial Sequence
  Description of Artificial Sequence: Synthetic oligonucleotide
ggcggagcaactgagagcctacctg

SEQ ID NO: 379783 - DNA, 26 bp, Artificial Sequence
  Description of Artificial Sequence: Synthetic oligonucleotide
gcggagcaactgagagcctacctgga

SEQ ID NO: 379784 - DNA, 26 bp, Artificial Sequence
  Description of Artificial Sequence: Synthetic oligonucleotide
cggagcaactgagagcctacctggag

SEQ ID NO: 379785 - DNA, 26 bp, Artificial Sequence
  Description of Artificial Sequence: Synthetic oligonucleotide
ggagcaactgagagcctacctggagg

SEQ ID NO: 379786 - DNA, 26 bp, Artificial Sequence
  Description of Artificial Sequence: Synthetic oligonucleotide
gagcaactgagagcctacctggaggg

SEQ ID NO: 379787 - DNA, 26 bp, Artificial Sequence
  Description of Artificial Sequence: Synthetic oligonucleotide
agcaactgagagcctacctggagggc

SEQ ID NO: 379788 - DNA, 25 bp, Artificial Sequence
  Description of Artificial Sequence: Synthetic oligonucleotide
gcaactgagagcctacctggagggc

SEQ ID NO: 379789 - DNA, 26 bp, Artificial Sequence
  Description of Artificial Sequence: Synthetic oligonucleotide
caactgagagcctacctggagggcct

SEQ ID NO: 379790 - DNA, 27 bp, Artificial Sequence
  Description of Artificial Sequence: Synthetic oligonucleotide
aactgagagcctacctggagggcctgt

SEQ ID NO: 379791 - DNA, 26 bp, Artificial Sequence
  Description of Artificial Sequence: Synthetic oligonucleotide
actgagagcctacctggagggcctgt

SEQ ID NO: 379792 - DNA, 27 bp, Artificial Sequence
  Description of Artificial Sequence: Synthetic oligonucleotide
caaagacacatgtgacccaccaccccg

SEQ ID NO: 379793 - DNA, 28 bp, Artificial Sequence
  Description of Artificial Sequence: Synthetic oligonucleotide
aaagacacatgtgacccaccaccccgtc

SEQ ID NO: 379794 - DNA, 27 bp, Artificial Sequence
  Description of Artificial Sequence: Synthetic oligonucleotide
aagacacatgtgacccaccaccccgtc

SEQ ID NO: 379795 - DNA, 27 bp, Artificial Sequence
  Description of Artificial Sequence: Synthetic oligonucleotide
agacacatgtgacccaccaccccgtct

SEQ ID NO: 379796 - DNA, 26 bp, Artificial Sequence
  Description of Artificial Sequence: Synthetic oligonucleotide
gacacatgtgacccaccaccccgtct

SEQ ID NO: 379797 - DNA, 27 bp, Artificial Sequence
  Description of Artificial Sequence: Synthetic oligonucleotide
acacatgtgacccaccaccccgtctct

SEQ ID NO: 379798 - DNA, 26 bp, Artificial Sequence
  Description of Artificial Sequence: Synthetic oligonucleotide
cacatgtgacccaccaccccgtctct

SEQ ID NO: 379799 - DNA, 27 bp, Artificial Sequence
  Description of Artificial Sequence: Synthetic oligonucleotide
acatgtgacccaccaccccgtctctga

SEQ ID NO: 379800 - DNA, 26 bp, Artificial Sequence
  Description of Artificial Sequence: Synthetic oligonucleotide
catgtgacccaccaccccgtctctga

SEQ ID NO: 379801 - DNA, 26 bp, Artificial Sequence
  Description of Artificial Sequence: Synthetic oligonucleotide
atgtgacccaccaccccgtctctgac

SEQ ID NO: 379802 - DNA, 25 bp, Artificial Sequence
  Description of Artificial Sequence: Synthetic oligonucleotide
tgtgacccaccaccccgtctctgac

SEQ ID NO: 379803 - DNA, 36 bp, Artificial Sequence; identical to SEQ ID NO: 37868
  Description of Artificial Sequence: Synthetic oligonucleotide

SEQ ID NO: 379804 - DNA, 35 bp, Artificial Sequence; identical to SEQ ID NO: 37869
  Description of Artificial Sequence: Synthetic oligonucleotide

SEQ ID NO: 379805 - DNA, 34 bp, Artificial Sequence; identical to SEQ ID NO: 37870
  Description of Artificial Sequence: Synthetic oligonucleotide

SEQ ID NO: 379806 - DNA, 33 bp, Artificial Sequence; identical to SEQ ID NO: 37871
  Description of Artificial Sequence: Synthetic oligonucleotide

SEQ ID NO: 379807 - DNA, 32 bp, Artificial Sequence; identical to SEQ ID NO: 37872
  Description of Artificial Sequence: Synthetic oligonucleotide

SEQ ID NO: 379808 - DNA, 33 bp, Artificial Sequence; identical to SEQ ID NO: 37873
  Description of Artificial Sequence: Synthetic oligonucleotide

SEQ ID NO: 379809 - DNA, 34 bp, Artificial Sequence; identical to SEQ ID NO: 37874
  Description of Artificial Sequence: Synthetic oligonucleotide

SEQ ID NO: 379810 - DNA, 35 bp, Artificial Sequence; identical to SEQ ID NO: 37875
  Description of Artificial Sequence: Synthetic oligonucleotide

SEQ ID NO: 379811 - DNA, 34 bp, Artificial Sequence; identical to SEQ ID NO: 37876
  Description of Artificial Sequence: Synthetic oligonucleotide

SEQ ID NO: 379812 - DNA, 35 bp, Artificial Sequence; identical to SEQ ID NO: 37877
  Description of Artificial Sequence: Synthetic oligonucleotide

SEQ ID NO: 379813 - DNA, 38 bp, Artificial Sequence; identical to SEQ ID NO: 37878
  Description of Artificial Sequence: Synthetic oligonucleotide

SEQ ID NO: 379814 - DNA, 38 bp, Artificial Sequence; identical to SEQ ID NO: 37879
  Description of Artificial Sequence: Synthetic oligonucleotide

SEQ ID NO: 379815 - DNA, 38 bp, Artificial Sequence; identical to SEQ ID NO: 37880
  Description of Artificial Sequence: Synthetic oligonucleotide

SEQ ID NO: 379816 - DNA, 37 bp, Artificial Sequence; identical to SEQ ID NO: 37881
  Description of Artificial Sequence: Synthetic oligonucleotide

SEQ ID NO: 379817 - DNA, 36 bp, Artificial Sequence; identical to SEQ ID NO: 37882
  Description of Artificial Sequence: Synthetic oligonucleotide

SEQ ID NO: 379818 - DNA, 37 bp, Artificial Sequence; identical to SEQ ID NO: 37883
  Description of Artificial Sequence: Synthetic oligonucleotide

SEQ ID NO: 379819 - DNA, 36 bp, Artificial Sequence; identical to SEQ ID NO: 37884
  Description of Artificial Sequence: Synthetic oligonucleotide

SEQ ID NO: 379820 - DNA, 37 bp, Artificial Sequence; identical to SEQ ID NO: 37885
  Description of Artificial Sequence: Synthetic oligonucleotide

SEQ ID NO: 379821 - DNA, 36 bp, Artificial Sequence; identical to SEQ ID NO: 37886
  Description of Artificial Sequence: Synthetic oligonucleotide

SEQ ID NO: 379822 - DNA, 38 bp, Artificial Sequence; identical to SEQ ID NO: 37887
  Description of Artificial Sequence: Synthetic oligonucleotide

SEQ ID NO: 379823 - DNA, 37 bp, Artificial Sequence; identical to SEQ ID NO: 37888
  Description of Artificial Sequence: Synthetic oligonucleotide

SEQ ID NO: 379824 - DNA, 37 bp, Artificial Sequence; identical to SEQ ID NO: 37889
  Description of Artificial Sequence: Synthetic oligonucleotide

SEQ ID NO: 379825 - DNA, 36 bp, Artificial Sequence; identical to SEQ ID NO: 37890
  Description of Artificial Sequence: Synthetic oligonucleotide

SEQ ID NO: 379826 - DNA, 35 bp, Artificial Sequence; identical to SEQ ID NO: 37891
  Description of Artificial Sequence: Synthetic oligonucleotide

SEQ ID NO: 379827 - DNA, 36 bp, Artificial Sequence; identical to SEQ ID NO: 37892
  Description of Artificial Sequence: Synthetic oligonucleotide

SEQ ID NO: 379828 - DNA, 35 bp, Artificial Sequence; identical to SEQ ID NO: 37893
  Description of Artificial Sequence: Synthetic oligonucleotide

SEQ ID NO: 379829 - DNA, 34 bp, Artificial Sequence; identical to SEQ ID NO: 37894
  Description of Artificial Sequence: Synthetic oligonucleotide

SEQ ID NO: 379830 - DNA, 34 bp, Artificial Sequence; identical to SEQ ID NO: 37895
  Description of Artificial Sequence: Synthetic oligonucleotide

SEQ ID NO: 379831 - DNA, 33 bp, Artificial Sequence; identical to SEQ ID NO: 37896
  Description of Artificial Sequence: Synthetic oligonucleotide

SEQ ID NO: 379832 - DNA, 32 bp, Artificial Sequence; identical to SEQ ID NO: 37897
  Description of Artificial Sequence: Synthetic oligonucleotide

SEQ ID NO: 379833 - DNA, 32 bp, Artificial Sequence; identical to SEQ ID NO: 37898
  Description of Artificial Sequence: Synthetic oligonucleotide

SEQ ID NO: 379834 - DNA, 31 bp, Artificial Sequence; identical to SEQ ID NO: 37899
  Description of Artificial Sequence: Synthetic oligonucleotide

SEQ ID NO: 379835 - DNA, 31 bp, Artificial Sequence; identical to SEQ ID NO: 37900
  Description of Artificial Sequence: Synthetic oligonucleotide

SEQ ID NO: 379836 - DNA, 36 bp, Artificial Sequence; identical to SEQ ID NO: 37901
  Description of Artificial Sequence: Synthetic oligonucleotide

SEQ ID NO: 379837 - DNA, 35 bp, Artificial Sequence; identical to SEQ ID NO: 37902
  Description of Artificial Sequence: Synthetic oligonucleotide

SEQ ID NO: 379838 - DNA, 34 bp, Artificial Sequence; identical to SEQ ID NO: 37903
  Description of Artificial Sequence: Synthetic oligonucleotide

SEQ ID NO: 379839 - DNA, 34 bp, Artificial Sequence; identical to SEQ ID NO: 37904
  Description of Artificial Sequence: Synthetic oligonucleotide

SEQ ID NO: 379840 - DNA, 33 bp, Artificial Sequence; identical to SEQ ID NO: 37905
  Description of Artificial Sequence: Synthetic oligonucleotide

SEQ ID NO: 379841 - DNA, 33 bp, Artificial Sequence; identical to SEQ ID NO: 37906
  Description of Artificial Sequence: Synthetic oligonucleotide

SEQ ID NO: 379842 - DNA, 33 bp, Artificial Sequence; identical to SEQ ID NO: 37907
  Description of Artificial Sequence: Synthetic oligonucleotide

SEQ ID NO: 379843 - DNA, 32 bp, Artificial Sequence; identical to SEQ ID NO: 37908
  Description of Artificial Sequence: Synthetic oligonucleotide

SEQ ID NO: 379844 - DNA, 33 bp, Artificial Sequence; identical to SEQ ID NO: 37909
  Description of Artificial Sequence: Synthetic oligonucleotide

SEQ ID NO: 379845 - DNA, 32 bp, Artificial Sequence; identical to SEQ ID NO: 37910
  Description of Artificial Sequence: Synthetic oligonucleotide

SEQ ID NO: 379846 - DNA, 32 bp, Artificial Sequence; identical to SEQ ID NO: 37911
  Description of Artificial Sequence: Synthetic oligonucleotide

SEQ ID NO: 379847 - DNA, 31 bp, Artificial Sequence; identical to SEQ ID NO: 37912
  Description of Artificial Sequence: Synthetic oligonucleotide

SEQ ID NO: 379848 - DNA, 30 bp, Artificial Sequence; identical to SEQ ID NO: 37913
  Description of Artificial Sequence: Synthetic oligonucleotide

SEQ ID NO: 379849 - DNA, 29 bp, Artificial Sequence
  Description of Artificial Sequence: Synthetic oligonucleotide
cacatgccatgtacagcatgaagggctgc

SEQ ID NO: 379850 - DNA, 29 bp, Artificial Sequence
  Description of Artificial Sequence: Synthetic oligonucleotide
acatgccatgtacagcatgaagggctgcc

SEQ ID NO: 379851 - DNA, 28 bp, Artificial Sequence
  Description of Artificial Sequence: Synthetic oligonucleotide
catgccatgtacagcatgaagggctgcc

SEQ ID NO: 379852 - DNA, 28 bp, Artificial Sequence
  Description of Artificial Sequence: Synthetic oligonucleotide
atgccatgtacagcatgaagggctgccg

SEQ ID NO: 379853 - DNA, 27 bp, Artificial Sequence
  Description of Artificial Sequence: Synthetic oligonucleotide
tgccatgtacagcatgaagggctgccg

SEQ ID NO: 379854 - DNA, 27 bp, Artificial Sequence
  Description of Artificial Sequence: Synthetic oligonucleotide
gccatgtacagcatgaagggctgccga

SEQ ID NO: 379855 - DNA, 28 bp, Artificial Sequence
  Description of Artificial Sequence: Synthetic oligonucleotide
ccatgtacagcatgaagggctgccgaag

SEQ ID NO: 379856 - DNA, 28 bp, Artificial Sequence
  Description of Artificial Sequence: Synthetic oligonucleotide
catgtacagcatgaagggctgccgaagc

SEQ ID NO: 379857 - DNA, 28 bp, Artificial Sequence
  Description of Artificial Sequence: Synthetic oligonucleotide
atgtacagcatgaagggctgccgaagcc

SEQ ID NO: 379858 - DNA, 27 bp, Artificial Sequence
  Description of Artificial Sequence: Synthetic oligonucleotide
tgtacagcatgaagggctgccgaagcc

SEQ ID NO: 379859 - DNA, 26 bp, Artificial Sequence
  Description of Artificial Sequence: Synthetic oligonucleotide
gtacagcatgaagggctgccgaagcc

SEQ ID NO: 379860 - DNA, 26 bp, Artificial Sequence
  Description of Artificial Sequence: Synthetic oligonucleotide
tacagcatgaagggctgccgaagccc

SEQ ID NO: 379861 - DNA, 25 bp, Artificial Sequence
  Description of Artificial Sequence: Synthetic oligonucleotide
acagcatgaagggctgccgaagccc

SEQ ID NO: 379862 - DNA, 24 bp, Artificial Sequence
  Description of Artificial Sequence: Synthetic oligonucleotide
cagcatgaagggctgccgaagccc

SEQ ID NO: 379863 - DNA, 25 bp, Artificial Sequence
  Description of Artificial Sequence: Synthetic oligonucleotide
agcatgaagggctgccgaagcccct

SEQ ID NO: 379864 - DNA, 24 bp, Artificial Sequence
  Description of Artificial Sequence: Synthetic oligonucleotide
gcatgaagggctgccgaagcccct

SEQ ID NO: 379865 - DNA, 25 bp, Artificial Sequence
  Description of Artificial Sequence: Synthetic oligonucleotide
catgaagggctgccgaagcccctca

SEQ ID NO: 379866 - DNA, 25 bp, Artificial Sequence
  Description of Artificial Sequence: Synthetic oligonucleotide
atgaagggctgccgaagcccctcac

SEQ ID NO: 379867 - DNA, 24 bp, Artificial Sequence
  Description of Artificial Sequence: Synthetic oligonucleotide
tgaagggctgccgaagcccctcac

SEQ ID NO: 379868 - DNA, 23 bp, Artificial Sequence
  Description of Artificial Sequence: Synthetic oligonucleotide
gaagggctgccgaagcccctcac

SEQ ID NO: 379869 - DNA, 23 bp, Artificial Sequence
  Description of Artificial Sequence: Synthetic oligonucleotide
aagggctgccgaagcccctcacc

SEQ ID NO: 379870 - DNA, 22 bp, Artificial Sequence
  Description of Artificial Sequence: Synthetic oligonucleotide
agggctgccgaagcccctcacc

SEQ ID NO: 379871 - DNA, 27 bp, Artificial Sequence
  Description of Artificial Sequence: Synthetic oligonucleotide
acttaccgagagaacctgcggatcgcc

SEQ ID NO: 379872 - DNA, 26 bp, Artificial Sequence
  Description of Artificial Sequence: Synthetic oligonucleotide
cttaccgagagaacctgcggatcgcc

SEQ ID NO: 379873 - DNA, 27 bp, Artificial Sequence
  Description of Artificial Sequence: Synthetic oligonucleotide
ttaccgagagaacctgcggatcgccct

SEQ ID NO: 379874 - DNA, 26 bp, Artificial Sequence
  Description of Artificial Sequence: Synthetic oligonucleotide
taccgagagaacctgcggatcgccct

SEQ ID NO: 379875 - DNA, 25 bp, Artificial Sequence
  Description of Artificial Sequence: Synthetic oligonucleotide
accgagagaacctgcggatcgccct

SEQ ID NO: 379876 - DNA, 24 bp, Artificial Sequence
  Description of Artificial Sequence: Synthetic oligonucleotide
ccgagagaacctgcggatcgccct

SEQ ID NO: 379877 - DNA, 24 bp, Artificial Sequence
  Description of Artificial Sequence: Synthetic oligonucleotide
cgagagaacctgcggatcgccctc

SEQ ID NO: 379878 - DNA, 24 bp, Artificial Sequence
  Description of Artificial Sequence: Synthetic oligonucleotide
gagagaacctgcggatcgccctcc

SEQ ID NO: 379879 - DNA, 24 bp, Artificial Sequence
  Description of Artificial Sequence: Synthetic oligonucleotide
agagaacctgcggatcgccctccg

SEQ ID NO: 379880 - DNA, 23 bp, Artificial Sequence
  Description of Artificial Sequence: Synthetic oligonucleotide
gagaacctgcggatcgccctccg

SEQ ID NO: 379881 - DNA, 25 bp, Artificial Sequence
  Description of Artificial Sequence: Synthetic oligonucleotide
agaacctgcggatcgccctccgcta

SEQ ID NO: 379882 - DNA, 24 bp, Artificial Sequence
  Description of Artificial Sequence: Synthetic oligonucleotide
gaacctgcggatcgccctccgcta

SEQ ID NO: 379883 - DNA, 26 bp, Artificial Sequence
  Description of Artificial Sequence: Synthetic oligonucleotide
aacctgcggatcgccctccgctacta

SEQ ID NO: 379884 - DNA, 25 bp, Artificial Sequence
  Description of Artificial Sequence: Synthetic oligonucleotide
acctgcggatcgccctccgctacta

SEQ ID NO: 379885 - DNA, 24 bp, Artificial Sequence
  Description of Artificial Sequence: Synthetic oligonucleotide
cctgcggatcgccctccgctacta

SEQ ID NO: 379886 - DNA, 26 bp, Artificial Sequence
  Description of Artificial Sequence: Synthetic oligonucleotide
ctgcggatcgccctccgctactacaa

SEQ ID NO: 379887 - DNA, 26 bp, Artificial Sequence
  Description of Artificial Sequence: Synthetic oligonucleotide
tgcggatcgccctccgctactacaac

SEQ ID NO: 379888 - DNA, 25 bp, Artificial Sequence
  Description of Artificial Sequence: Synthetic oligonucleotide
gcggatcgccctccgctactacaac

SEQ ID NO: 379889 - DNA, 26 bp, Artificial Sequence
  Description of Artificial Sequence: Synthetic oligonucleotide
cggatcgccctccgctactacaacca

SEQ ID NO: 379890 - DNA, 27 bp, Artificial Sequence
  Description of Artificial Sequence: Synthetic oligonucleotide
ggatcgccctccgctactacaaccaga

SEQ ID NO: 379891 - DNA, 27 bp, Artificial Sequence
  Description of Artificial Sequence: Synthetic oligonucleotide
gatcgccctccgctactacaaccagag

SEQ ID NO: 379892 - DNA, 27 bp, Artificial Sequence
  Description of Artificial Sequence: Synthetic oligonucleotide
atcgccctccgctactacaaccagagc

SEQ ID NO: 379893 - DNA, 26 bp, Artificial Sequence
  Description of Artificial Sequence: Synthetic oligonucleotide
tcgccctccgctactacaaccagagc

SEQ ID NO: 379894 - DNA, 32 bp, Artificial Sequence; identical to SEQ ID NO: 37963
  Description of Artificial Sequence: Synthetic oligonucleotide

SEQ ID NO: 379895 - DNA, 33 bp, Artificial Sequence; identical to SEQ ID NO: 37964
  Description of Artificial Sequence: Synthetic oligonucleotide

SEQ ID NO: 379896 - DNA, 33 bp, Artificial Sequence; identical to SEQ ID NO: 37965
  Description of Artificial Sequence: Synthetic oligonucleotide

SEQ ID NO: 379897 - DNA, 32 bp, Artificial Sequence; identical to SEQ ID NO: 37966
  Description of Artificial Sequence: Synthetic oligonucleotide

SEQ ID NO: 379898 - DNA, 31 bp, Artificial Sequence; identical to SEQ ID NO: 37967
  Description of Artificial Sequence: Synthetic oligonucleotide

SEQ ID NO: 379899 - DNA, 25 bp, Artificial Sequence
  Description of Artificial Sequence: Synthetic oligonucleotide
gccggagtattgggaccggaacacc

SEQ ID NO: 379900 - DNA, 26 bp, Artificial Sequence
  Description of Artificial Sequence: Synthetic oligonucleotide
ccggagtattgggaccggaacaccca

SEQ ID NO: 379901 - DNA, 27 bp, Artificial Sequence
  Description of Artificial Sequence: Synthetic oligonucleotide
cggagtattgggaccggaacacccaga

SEQ ID NO: 379902 - DNA, 28 bp, Artificial Sequence
  Description of Artificial Sequence: Synthetic oligonucleotide
ggagtattgggaccggaacacccagatc

SEQ ID NO: 379903 - DNA, 30 bp, Artificial Sequence; identical to SEQ ID NO: 37973
  Description of Artificial Sequence: Synthetic oligonucleotide

SEQ ID NO: 379904 - DNA, 32 bp, Artificial Sequence; identical to SEQ ID NO: 37974
  Description of Artificial Sequence: Synthetic oligonucleotide

SEQ ID NO: 379905 - DNA, 31 bp, Artificial Sequence; identical to SEQ ID NO: 37975
  Description of Artificial Sequence: Synthetic oligonucleotide

SEQ ID NO: 379906 - DNA, 32 bp, Artificial Sequence; identical to SEQ ID NO: 37976
  Description of Artificial Sequence: Synthetic oligonucleotide

SEQ ID NO: 379907 - DNA, 31 bp, Artificial Sequence; identical to SEQ ID NO: 37977
  Description of Artificial Sequence: Synthetic oligonucleotide

SEQ ID NO: 379908 - DNA, 30 bp, Artificial Sequence; identical to SEQ ID NO: 37978
  Description of Artificial Sequence: Synthetic oligonucleotide

SEQ ID NO: 379909 - DNA, 29 bp, Artificial Sequence
  Description of Artificial Sequence: Synthetic oligonucleotide
tgggaccggaacacccagatcttcaagac

SEQ ID NO: 379910 - DNA, 28 bp, Artificial Sequence
  Description of Artificial Sequence: Synthetic oligonucleotide
gggaccggaacacccagatcttcaagac

SEQ ID NO: 379911 - DNA, 28 bp, Artificial Sequence
  Description of Artificial Sequence: Synthetic oligonucleotide
ggaccggaacacccagatcttcaagacc

SEQ ID NO: 379912 - DNA, 30 bp, Artificial Sequence; identical to SEQ ID NO: 37982
  Description of Artificial Sequence: Synthetic oligonucleotide

SEQ ID NO: 379913 - DNA, 31 bp, Artificial Sequence; identical to SEQ ID NO: 37983
  Description of Artificial Sequence: Synthetic oligonucleotide

SEQ ID NO: 379914 - DNA, 30 bp, Artificial Sequence; identical to SEQ ID NO: 37984
  Description of Artificial Sequence: Synthetic oligonucleotide

SEQ ID NO: 379915 - DNA, 31 bp, Artificial Sequence; identical to SEQ ID NO: 37985
  Description of Artificial Sequence: Synthetic oligonucleotide

SEQ ID NO: 379916 - DNA, 32 bp, Artificial Sequence; identical to SEQ ID NO: 37986
  Description of Artificial Sequence: Synthetic oligonucleotide

SEQ ID NO: 379917 - DNA, 33 bp, Artificial Sequence; identical to SEQ ID NO: 37987
  Description of Artificial Sequence: Synthetic oligonucleotide

SEQ ID NO: 379918 - DNA, 36 bp, Artificial Sequence; identical to SEQ ID NO: 37988
  Description of Artificial Sequence: Synthetic oligonucleotide

SEQ ID NO: 379919 - DNA, 35 bp, Artificial Sequence; identical to SEQ ID NO: 37989
  Description of Artificial Sequence: Synthetic oligonucleotide

SEQ ID NO: 379920 - DNA, 34 bp, Artificial Sequence; identical to SEQ ID NO: 37990
  Description of Artificial Sequence: Synthetic oligonucleotide

SEQ ID NO: 379921 - DNA, 34 bp, Artificial Sequence; identical to SEQ ID NO: 37991
  Description of Artificial Sequence: Synthetic oligonucleotide

SEQ ID NO: 379922 - DNA, 33 bp, Artificial Sequence; identical to SEQ ID NO: 37992
  Description of Artificial Sequence: Synthetic oligonucleotide

SEQ ID NO: 379923 - DNA, 33 bp, Artificial Sequence; identical to SEQ ID NO: 37993
  Description of Artificial Sequence: Synthetic oligonucleotide

SEQ ID NO: 379924 - DNA, 31 bp, Artificial Sequence; identical to SEQ ID NO: 37994
  Description of Artificial Sequence: Synthetic oligonucleotide

SEQ ID NO: 379925 - DNA, 31 bp, Artificial Sequence; identical to SEQ ID NO: 37995
  Description of Artificial Sequence: Synthetic oligonucleotide

SEQ ID NO: 379926 - DNA, 33 bp, Artificial Sequence; identical to SEQ ID NO: 37996
  Description of Artificial Sequence: Synthetic oligonucleotide

SEQ ID NO: 379927 - DNA, 32 bp, Artificial Sequence; identical to SEQ ID NO: 37997
  Description of Artificial Sequence: Synthetic oligonucleotide

SEQ ID NO: 379928 - DNA, 33 bp, Artificial Sequence; identical to SEQ ID NO: 37998
  Description of Artificial Sequence: Synthetic oligonucleotide

SEQ ID NO: 379929 - DNA, 33 bp, Artificial Sequence; identical to SEQ ID NO: 37999
  Description of Artificial Sequence: Synthetic oligonucleotide

SEQ ID NO: 379930 - DNA, 33 bp, Artificial Sequence; identical to SEQ ID NO: 38000
  Description of Artificial Sequence: Synthetic oligonucleotide

SEQ ID NO: 379931 - DNA, 32 bp, Artificial Sequence; identical to SEQ ID NO: 38001
  Description of Artificial Sequence: Synthetic oligonucleotide

SEQ ID NO: 379932 - DNA, 32 bp, Artificial Sequence; identical to SEQ ID NO: 38002
  Description of Artificial Sequence: Synthetic oligonucleotide

SEQ ID NO: 379933 - DNA, 31 bp, Artificial Sequence; identical to SEQ ID NO: 38003
  Description of Artificial Sequence: Synthetic oligonucleotide

SEQ ID NO: 379934 - DNA, 31 bp, Artificial Sequence; identical to SEQ ID NO: 38004
  Description of Artificial Sequence: Synthetic oligonucleotide

SEQ ID NO: 379935 - DNA, 31 bp, Artificial Sequence; identical to SEQ ID NO: 38005
  Description of Artificial Sequence: Synthetic oligonucleotide

SEQ ID NO: 379936 - DNA, 30 bp, Artificial Sequence; identical to SEQ ID NO: 38006
  Description of Artificial Sequence: Synthetic oligonucleotide

SEQ ID NO: 379937 - DNA, 29 bp, Artificial Sequence
  Description of Artificial Sequence: Synthetic oligonucleotide
gagatatttctacaccgccatgtcccggc

SEQ ID NO: 379938 - DNA, 29 bp, Artificial Sequence
  Description of Artificial Sequence: Synthetic oligonucleotide
agatatttctacaccgccatgtcccggcc

SEQ ID NO: 379939 - DNA, 28 bp, Artificial Sequence
  Description of Artificial Sequence: Synthetic oligonucleotide
gatatttctacaccgccatgtcccggcc

SEQ ID NO: 379940 - DNA, 28 bp, Artificial Sequence
  Description of Artificial Sequence: Synthetic oligonucleotide
atatttctacaccgccatgtcccggccc

SEQ ID NO: 379941 - DNA, 36 bp, Artificial Sequence; identical to SEQ ID NO: 38011
  Description of Artificial Sequence: Synthetic oligonucleotide

SEQ ID NO: 379942 - DNA, 35 bp, Artificial Sequence; identical to SEQ ID NO: 38012
  Description of Artificial Sequence: Synthetic oligonucleotide

SEQ ID NO: 379943 - DNA, 34 bp, Artificial Sequence; identical to SEQ ID NO: 38013
  Description of Artificial Sequence: Synthetic oligonucleotide

SEQ ID NO: 379944 - DNA, 33 bp, Artificial Sequence; identical to SEQ ID NO: 38014
  Description of Artificial Sequence: Synthetic oligonucleotide

SEQ ID NO: 379945 - DNA, 32 bp, Artificial Sequence; identical to SEQ ID NO: 38015
  Description of Artificial Sequence: Synthetic oligonucleotide

SEQ ID NO: 379946 - DNA, 32 bp, Artificial Sequence; identical to SEQ ID NO: 38016
  Description of Artificial Sequence: Synthetic oligonucleotide

SEQ ID NO: 379947 - DNA, 32 bp, Artificial Sequence; identical to SEQ ID NO: 38017
  Description of Artificial Sequence: Synthetic oligonucleotide

SEQ ID NO: 379948 - DNA, 31 bp, Artificial Sequence; identical to SEQ ID NO: 38018
  Description of Artificial Sequence: Synthetic oligonucleotide

SEQ ID NO: 379949 - DNA, 31 bp, Artificial Sequence; identical to SEQ ID NO: 38019
  Description of Artificial Sequence: Synthetic oligonucleotide

SEQ ID NO: 379950 - DNA, 30 bp, Artificial Sequence; identical to SEQ ID NO: 38020
  Description of Artificial Sequence: Synthetic oligonucleotide

SEQ ID NO: 379951 - DNA, 29 bp, Artificial Sequence
  Description of Artificial Sequence: Synthetic oligonucleotide
cgcctacgacggcaaagattacattgccc

SEQ ID NO: 379952 - DNA, 30 bp, Artificial Sequence; identical to SEQ ID NO: 38022
  Description of Artificial Sequence: Synthetic oligonucleotide

SEQ ID NO: 379953 - DNA, 32 bp, Artificial Sequence; identical to SEQ ID NO: 38023
  Description of Artificial Sequence: Synthetic oligonucleotide

SEQ ID NO: 379954 - DNA, 32 bp, Artificial Sequence; identical to SEQ ID NO: 38024
  Description of Artificial Sequence: Synthetic oligonucleotide

SEQ ID NO: 379955 - DNA, 33 bp, Artificial Sequence; identical to SEQ ID NO: 38025
  Description of Artificial Sequence: Synthetic oligonucleotide

SEQ ID NO: 379956 - DNA, 32 bp, Artificial Sequence; identical to SEQ ID NO: 38026
  Description of Artificial Sequence: Synthetic oligonucleotide

SEQ ID NO: 379957 - DNA, 31 bp, Artificial Sequence; identical to SEQ ID NO: 38027
  Description of Artificial Sequence: Synthetic oligonucleotide

SEQ ID NO: 379958 - DNA, 31 bp, Artificial Sequence; identical to SEQ ID NO: 38028
  Description of Artificial Sequence: Synthetic oligonucleotide

SEQ ID NO: 379959 - DNA, 32 bp, Artificial Sequence; identical to SEQ ID NO: 38029
  Description of Artificial Sequence: Synthetic oligonucleotide

SEQ ID NO: 379960 - DNA, 31 bp, Artificial Sequence; identical to SEQ ID NO: 38030
  Description of Artificial Sequence: Synthetic oligonucleotide

SEQ ID NO: 379961 - DNA, 31 bp, Artificial Sequence; identical to SEQ ID NO: 38031
  Description of Artificial Sequence: Synthetic oligonucleotide

SEQ ID NO: 379962 - DNA, 32 bp, Artificial Sequence; identical to SEQ ID NO: 38032
  Description of Artificial Sequence: Synthetic oligonucleotide

SEQ ID NO: 379963 - DNA, 33 bp, Artificial Sequence; identical to SEQ ID NO: 38033
  Description of Artificial Sequence: Synthetic oligonucleotide

SEQ ID NO: 379964 - DNA, 33 bp, Artificial Sequence; identical to SEQ ID NO: 38034
  Description of Artificial Sequence: Synthetic oligonucleotide

SEQ ID NO: 379965 - DNA, 32 bp, Artificial Sequence; identical to SEQ ID NO: 38035
  Description of Artificial Sequence: Synthetic oligonucleotide

SEQ ID NO: 379966 - DNA, 31 bp, Artificial Sequence; identical to SEQ ID NO: 38036
  Description of Artificial Sequence: Synthetic oligonucleotide

SEQ ID NO: 379967 - DNA, 30 bp, Artificial Sequence; identical to SEQ ID NO: 38037
  Description of Artificial Sequence: Synthetic oligonucleotide

SEQ ID NO: 379968 - DNA, 31 bp, Artificial Sequence; identical to SEQ ID NO: 38038
  Description of Artificial Sequence: Synthetic oligonucleotide

SEQ ID NO: 379969 - DNA, 30 bp, Artificial Sequence; identical to SEQ ID NO: 38039
  Description of Artificial Sequence: Synthetic oligonucleotide

SEQ ID NO: 379970 - DNA, 29 bp, Artificial Sequence
  Description of Artificial Sequence: Synthetic oligonucleotide
tacattgccctgaacgaggacctgagctc

SEQ ID NO: 379971 - DNA, 28 bp, Artificial Sequence
  Description of Artificial Sequence: Synthetic oligonucleotide
acattgccctgaacgaggacctgagctc

SEQ ID NO: 379972 - DNA, 27 bp, Artificial Sequence
  Description of Artificial Sequence: Synthetic oligonucleotide
cattgccctgaacgaggacctgagctc

SEQ ID NO: 379973 - DNA, 27 bp, Artificial Sequence
  Description of Artificial Sequence: Synthetic oligonucleotide
attgccctgaacgaggacctgagctcc

SEQ ID NO: 379974 - DNA, 27 bp, Artificial Sequence
  Description of Artificial Sequence: Synthetic oligonucleotide
ttgccctgaacgaggacctgagctcct

SEQ ID NO: 379975 - DNA, 26 bp, Artificial Sequence
  Description of Artificial Sequence: Synthetic oligonucleotide
tgccctgaacgaggacctgagctcct

SEQ ID NO: 379976 - DNA, 25 bp, Artificial Sequence
  Description of Artificial Sequence: Synthetic oligonucleotide
gtgaggttcgacagcgacgccgcaa

SEQ ID NO: 379977 - DNA, 26 bp, Artificial Sequence
  Description of Artificial Sequence: Synthetic oligonucleotide
tgaggttcgacagcgacgccgcaagt

SEQ ID NO: 379978 - DNA, 25 bp, Artificial Sequence
  Description of Artificial Sequence: Synthetic oligonucleotide
gaggttcgacagcgacgccgcaagt

SEQ ID NO: 379979 - DNA, 25 bp, Artificial Sequence
  Description of Artificial Sequence: Synthetic oligonucleotide
aggttcgacagcgacgccgcaagtc

SEQ ID NO: 379980 - DNA, 24 bp, Artificial Sequence
  Description of Artificial Sequence: Synthetic oligonucleotide
ggttcgacagcgacgccgcaagtc

SEQ ID NO: 379981 - DNA, 24 bp, Artificial Sequence
  Description of Artificial Sequence: Synthetic oligonucleotide
gttcgacagcgacgccgcaagtcc

SEQ ID NO: 379982 - DNA, 25 bp, Artificial Sequence
  Description of Artificial Sequence: Synthetic oligonucleotide
ttcgacagcgacgccgcaagtccga

SEQ ID NO: 379983 - DNA, 24 bp, Artificial Sequence
  Description of Artificial Sequence: Synthetic oligonucleotide
tcgacagcgacgccgcaagtccga

SEQ ID NO: 379984 - DNA, 23 bp, Artificial Sequence
  Description of Artificial Sequence: Synthetic oligonucleotide
cgacagcgacgccgcaagtccga

SEQ ID NO: 379985 - DNA, 23 bp, Artificial Sequence
  Description of Artificial Sequence: Synthetic oligonucleotide
gacagcgacgccgcaagtccgag

SEQ ID NO: 379986 - DNA, 24 bp, Artificial Sequence
  Description of Artificial Sequence: Synthetic oligonucleotide
acagcgacgccgcaagtccgagga

SEQ ID NO: 379987 - DNA, 23 bp, Artificial Sequence
  Description of Artificial Sequence: Synthetic oligonucleotide
cagcgacgccgcaagtccgagga

SEQ ID NO: 379988 - DNA, 23 bp, Artificial Sequence
  Description of Artificial Sequence: Synthetic oligonucleotide
agcgacgccgcaagtccgaggac

SEQ ID NO: 379989 - DNA, 22 bp, Artificial Sequence
  Description of Artificial Sequence: Synthetic oligonucleotide
gcgacgccgcaagtccgaggac

SEQ ID NO: 379990 - DNA, 22 bp, Artificial Sequence
  Description of Artificial Sequence: Synthetic oligonucleotide
cgacgccgcaagtccgaggacg

SEQ ID NO: 379991 - DNA, 23 bp, Artificial Sequence
  Description of Artificial Sequence: Synthetic oligonucleotide
gacgccgcaagtccgaggacgga

SEQ ID NO: 379992 - DNA, 23 bp, Artificial Sequence
  Description of Artificial Sequence: Synthetic oligonucleotide
acgccgcaagtccgaggacggag

SEQ ID NO: 379993 - DNA, 22 bp, Artificial Sequence
  Description of Artificial Sequence: Synthetic oligonucleotide
cgccgcaagtccgaggacggag

SEQ ID NO: 379994 - DNA, 22 bp, Artificial Sequence
  Description of Artificial Sequence: Synthetic oligonucleotide
gccgcaagtccgaggacggagc

SEQ ID NO: 379995 - DNA, 22 bp, Artificial Sequence
  Description of Artificial Sequence: Synthetic oligonucleotide
ccgcaagtccgaggacggagcc

SEQ ID NO: 379996 - DNA, 22 bp, Artificial Sequence
  Description of Artificial Sequence: Synthetic oligonucleotide
cgcaagtccgaggacggagccc

SEQ ID NO: 379997 - DNA, 22 bp, Artificial Sequence
  Description of Artificial Sequence: Synthetic oligonucleotide
gcaagtccgaggacggagcccc

SEQ ID NO: 379998 - DNA, 22 bp, Artificial Sequence
  Description of Artificial Sequence: Synthetic oligonucleotide
caagtccgaggacggagccccg

SEQ ID NO: 379999 - DNA, 22 bp, Artificial Sequence
  Description of Artificial Sequence: Synthetic oligonucleotide
aagtccgaggacggagccccgg

SEQ ID NO: 380000 - DNA, 23 bp, Artificial Sequence
  Description of Artificial Sequence: Synthetic oligonucleotide
ggcgcctcctccgcgggcataat

SEQ ID NO: 380001 - DNA, 24 bp, Artificial Sequence
  Description of Artificial Sequence: Synthetic oligonucleotide
gcgcctcctccgcgggcataatca

SEQ ID NO: 380002 - DNA, 26 bp, Artificial Sequence
  Description of Artificial Sequence: Synthetic oligonucleotide
cgcctcctccgcgggcataatcagta

SEQ ID NO: 380003 - DNA, 26 bp, Artificial Sequence
  Description of Artificial Sequence: Synthetic oligonucleotide
gcctcctccgcgggcataatcagtac

SEQ ID NO: 380004 - DNA, 26 bp, Artificial Sequence
  Description of Artificial Sequence: Synthetic oligonucleotide
cctcctccgcgggcataatcagtacg

SEQ ID NO: 380005 - DNA, 26 bp, Artificial Sequence
  Description of Artificial Sequence: Synthetic oligonucleotide
ctcctccgcgggcataatcagtacgc

SEQ ID NO: 380006 - DNA, 27 bp, Artificial Sequence
  Description of Artificial Sequence: Synthetic oligonucleotide
tcctccgcgggcataatcagtacgcct

SEQ ID NO: 380007 - DNA, 27 bp, Artificial Sequence
  Description of Artificial Sequence: Synthetic oligonucleotide
cctccgcgggcataatcagtacgccta

SEQ ID NO: 380008 - DNA, 27 bp, Artificial Sequence
  Description of Artificial Sequence: Synthetic oligonucleotide
ctccgcgggcataatcagtacgcctac

SEQ ID NO: 380009 - DNA, 27 bp, Artificial Sequence
  Description of Artificial Sequence: Synthetic oligonucleotide
tccgcgggcataatcagtacgcctacg

SEQ ID NO: 380010 - DNA, 27 bp, Artificial Sequence
  Description of Artificial Sequence: Synthetic oligonucleotide
ccgcgggcataatcagtacgcctacga

SEQ ID NO: 380011 - DNA, 27 bp, Artificial Sequence
  Description of Artificial Sequence: Synthetic oligonucleotide
cgcgggcataatcagtacgcctacgac

SEQ ID NO: 380012 - DNA, 27 bp, Artificial Sequence
  Description of Artificial Sequence: Synthetic oligonucleotide
gcgggcataatcagtacgcctacgacg

SEQ ID NO: 380013 - DNA, 27 bp, Artificial Sequence
  Description of Artificial Sequence: Synthetic oligonucleotide
cgggcataatcagtacgcctacgacgg

SEQ ID NO: 380014 - DNA, 27 bp, Artificial Sequence
  Description of Artificial Sequence: Synthetic oligonucleotide
gggcataatcagtacgcctacgacggc

SEQ ID NO: 380015 - DNA, 30 bp, Artificial Sequence; identical to SEQ ID NO: 38085
  Description of Artificial Sequence: Synthetic oligonucleotide

SEQ ID NO: 380016 - DNA, 34 bp, Artificial Sequence; identical to SEQ ID NO: 38086
  Description of Artificial Sequence: Synthetic oligonucleotide

SEQ ID NO: 380017 - DNA, 36 bp, Artificial Sequence; identical to SEQ ID NO: 38087
  Description of Artificial Sequence: Synthetic oligonucleotide

SEQ ID NO: 380018 - DNA, 36 bp, Artificial Sequence; identical to SEQ ID NO: 38088
  Description of Artificial Sequence: Synthetic oligonucleotide

SEQ ID NO: 380019 - DNA, 35 bp, Artificial Sequence; identical to SEQ ID NO: 38089
  Description of Artificial Sequence: Synthetic oligonucleotide

SEQ ID NO: 380020 - DNA, 34 bp, Artificial Sequence; identical to SEQ ID NO: 38090
  Description of Artificial Sequence: Synthetic oligonucleotide

SEQ ID NO: 380021 - DNA, 33 bp, Artificial Sequence; identical to SEQ ID NO: 38091
  Description of Artificial Sequence: Synthetic oligonucleotide

SEQ ID NO: 380022 - DNA, 32 bp, Artificial Sequence; identical to SEQ ID NO: 38092
  Description of Artificial Sequence: Synthetic oligonucleotide

SEQ ID NO: 380023 - DNA, 30 bp, Artificial Sequence; identical to SEQ ID NO: 38093
  Description of Artificial Sequence: Synthetic oligonucleotide

SEQ ID NO: 380024 - DNA, 32 bp, Artificial Sequence; identical to SEQ ID NO: 38094
  Description of Artificial Sequence: Synthetic oligonucleotide

SEQ ID NO: 380025 - DNA, 34 bp, Artificial Sequence; identical to SEQ ID NO: 38095
  Description of Artificial Sequence: Synthetic oligonucleotide

SEQ ID NO: 380026 - DNA, 35 bp, Artificial Sequence; identical to SEQ ID NO: 38096
  Description of Artificial Sequence: Synthetic oligonucleotide

SEQ ID NO: 380027 - DNA, 35 bp, Artificial Sequence; identical to SEQ ID NO: 38097
  Description of Artificial Sequence: Synthetic oligonucleotide

SEQ ID NO: 380028 - DNA, 34 bp, Artificial Sequence; identical to SEQ ID NO: 38098
  Description of Artificial Sequence: Synthetic oligonucleotide

SEQ ID NO: 380029 - DNA, 36 bp, Artificial Sequence; identical to SEQ ID NO: 38099
  Description of Artificial Sequence: Synthetic oligonucleotide

SEQ ID NO: 380030 - DNA, 35 bp, Artificial Sequence; identical to SEQ ID NO: 38100
  Description of Artificial Sequence: Synthetic oligonucleotide

SEQ ID NO: 380031 - DNA, 34 bp, Artificial Sequence; identical to SEQ ID NO: 38101
  Description of Artificial Sequence: Synthetic oligonucleotide

SEQ ID NO: 380032 - DNA, 33 bp, Artificial Sequence; identical to SEQ ID NO: 38102
  Description of Artificial Sequence: Synthetic oligonucleotide

SEQ ID NO: 380033 - DNA, 32 bp, Artificial Sequence; identical to SEQ ID NO: 38103
  Description of Artificial Sequence: Synthetic oligonucleotide

SEQ ID NO: 380034 - DNA, 33 bp, Artificial Sequence; identical to SEQ ID NO: 38104
  Description of Artificial Sequence: Synthetic oligonucleotide

SEQ ID NO: 380035 - DNA, 34 bp, Artificial Sequence; identical to SEQ ID NO: 38105
  Description of Artificial Sequence: Synthetic oligonucleotide

SEQ ID NO: 380036 - DNA, 35 bp, Artificial Sequence; identical to SEQ ID NO: 38106
  Description of Artificial Sequence: Synthetic oligonucleotide

SEQ ID NO: 380037 - DNA, 34 bp, Artificial Sequence; identical to SEQ ID NO: 38107
  Description of Artificial Sequence: Synthetic oligonucleotide

SEQ ID NO: 380038 - DNA, 35 bp, Artificial Sequence; identical to SEQ ID NO: 38108
  Description of Artificial Sequence: Synthetic oligonucleotide

SEQ ID NO: 380039 - DNA, 38 bp, Artificial Sequence; identical to SEQ ID NO: 38109
  Description of Artificial Sequence: Synthetic oligonucleotide

SEQ ID NO: 380040 - DNA, 38 bp, Artificial Sequence; identical to SEQ ID NO: 38110
  Description of Artificial Sequence: Synthetic oligonucleotide

SEQ ID NO: 380041 - DNA, 38 bp, Artificial Sequence; identical to SEQ ID NO: 38111
  Description of Artificial Sequence: Synthetic oligonucleotide

SEQ ID NO: 380042 - DNA, 37 bp, Artificial Sequence; identical to SEQ ID NO: 38112
  Description of Artificial Sequence: Synthetic oligonucleotide

SEQ ID NO: 380043 - DNA, 36 bp, Artificial Sequence; identical to SEQ ID NO: 38113
  Description of Artificial Sequence: Synthetic oligonucleotide

SEQ ID NO: 380044 - DNA, 37 bp, Artificial Sequence; identical to SEQ ID NO: 38114
  Description of Artificial Sequence: Synthetic oligonucleotide

SEQ ID NO: 380045 - DNA, 36 bp, Artificial Sequence; identical to SEQ ID NO: 38115
  Description of Artificial Sequence: Synthetic oligonucleotide

SEQ ID NO: 380046 - DNA, 37 bp, Artificial Sequence; identical to SEQ ID NO: 38116
  Description of Artificial Sequence: Synthetic oligonucleotide

SEQ ID NO: 380047 - DNA, 36 bp, Artificial Sequence; identical to SEQ ID NO: 38117
  Description of Artificial Sequence: Synthetic oligonucleotide

SEQ ID NO: 380048 - DNA, 38 bp, Artificial Sequence; identical to SEQ ID NO: 38118
  Description of Artificial Sequence: Synthetic oligonucleotide

SEQ ID NO: 380049 - DNA, 37 bp, Artificial Sequence; identical to SEQ ID NO: 38119
  Description of Artificial Sequence: Synthetic oligonucleotide

SEQ ID NO: 380050 - DNA, 20 bp, Artificial Sequence
  Description of Artificial Sequence: Synthetic oligonucleotide
acgggcgccttctccgcggg

SEQ ID NO: 380051 - DNA, 20 bp, Artificial Sequence
  Description of Artificial Sequence: Synthetic oligonucleotide
cgggcgccttctccgcgggt

SEQ ID NO: 380052 - DNA, 23 bp, Artificial Sequence
  Description of Artificial Sequence: Synthetic oligonucleotide
gggcgccttctccgcgggcataa

SEQ ID NO: 380053 - DNA, 23 bp, Artificial Sequence
  Description of Artificial Sequence: Synthetic oligonucleotide
ggcgccttctccgcgggcataac

SEQ ID NO: 380054 - DNA, 24 bp, Artificial Sequence
  Description of Artificial Sequence: Synthetic oligonucleotide
gcgccttctccgcgggcataacca

SEQ ID NO: 380055 - DNA, 26 bp, Artificial Sequence
  Description of Artificial Sequence: Synthetic oligonucleotide
cgccttctccgcgggcataaccagta

SEQ ID NO: 380056 - DNA, 26 bp, Artificial Sequence
  Description of Artificial Sequence: Synthetic oligonucleotide
gccttctccgcgggcataaccagtac

SEQ ID NO: 380057 - DNA, 26 bp, Artificial Sequence
  Description of Artificial Sequence: Synthetic oligonucleotide
ccttctccgcgggcataaccagtacg

SEQ ID NO: 380058 - DNA, 26 bp, Artificial Sequence
  Description of Artificial Sequence: Synthetic oligonucleotide
cttctccgcgggcataaccagtacgc

SEQ ID NO: 380059 - DNA, 27 bp, Artificial Sequence
  Description of Artificial Sequence: Synthetic oligonucleotide
ttctccgcgggcataaccagtacgcct

SEQ ID NO: 380060 - DNA, 27 bp, Artificial Sequence
  Description of Artificial Sequence: Synthetic oligonucleotide
tctccgcgggcataaccagtacgccta

SEQ ID NO: 380061 - DNA, 24 bp, Artificial Sequence
  Description of Artificial Sequence: Synthetic oligonucleotide
gcggagcagctgagagcctacctc

SEQ ID NO: 380062 - DNA, 25 bp, Artificial Sequence
  Description of Artificial Sequence: Synthetic oligonucleotide
cggagcagctgagagcctacctcga

SEQ ID NO: 380063 - DNA, 25 bp, Artificial Sequence
  Description of Artificial Sequence: Synthetic oligonucleotide
ggagcagctgagagcctacctcgag

SEQ ID NO: 380064 - DNA, 25 bp, Artificial Sequence
  Description of Artificial Sequence: Synthetic oligonucleotide
gagcagctgagagcctacctcgagg

SEQ ID NO: 380065 - DNA, 25 bp, Artificial Sequence
  Description of Artificial Sequence: Synthetic oligonucleotide
agcagctgagagcctacctcgaggg

SEQ ID NO: 380066 - DNA, 24 bp, Artificial Sequence
  Description of Artificial Sequence: Synthetic oligonucleotide
gcagctgagagcctacctcgaggg

SEQ ID NO: 380067 - DNA, 24 bp, Artificial Sequence
  Description of Artificial Sequence: Synthetic oligonucleotide
cagctgagagcctacctcgagggc

SEQ ID NO: 380068 - DNA, 25 bp, Artificial Sequence
  Description of Artificial Sequence: Synthetic oligonucleotide
agctgagagcctacctcgagggcct

SEQ ID NO: 380069 - DNA, 24 bp, Artificial Sequence
  Description of Artificial Sequence: Synthetic oligonucleotide
gctgagagcctacctcgagggcct

SEQ ID NO: 380070 - DNA, 25 bp, Artificial Sequence
  Description of Artificial Sequence: Synthetic oligonucleotide
ctgagagcctacctcgagggcctgt

SEQ ID NO: 380071 - DNA, 25 bp, Artificial Sequence
  Description of Artificial Sequence: Synthetic oligonucleotide
tgagagcctacctcgagggcctgtg

SEQ ID NO: 380072 - DNA, 24 bp, Artificial Sequence
  Description of Artificial Sequence: Synthetic oligonucleotide
gagagcctacctcgagggcctgtg

SEQ ID NO: 380073 - DNA, 24 bp, Artificial Sequence
  Description of Artificial Sequence: Synthetic oligonucleotide
agagcctacctcgagggcctgtgc

SEQ ID NO: 380074 - DNA, 23 bp, Artificial Sequence
  Description of Artificial Sequence: Synthetic oligonucleotide
gagcctacctcgagggcctgtgc

SEQ ID NO: 380075 - DNA, 24 bp, Artificial Sequence
  Description of Artificial Sequence: Synthetic oligonucleotide
agcctacctcgagggcctgtgcgt

SEQ ID NO: 380076 - DNA, 23 bp, Artificial Sequence
  Description of Artificial Sequence: Synthetic oligonucleotide
gcctacctcgagggcctgtgcgt

SEQ ID NO: 380077 - DNA, 23 bp, Artificial Sequence
  Description of Artificial Sequence: Synthetic oligonucleotide
cctacctcgagggcctgtgcgtg

SEQ ID NO: 380078 - DNA, 24 bp, Artificial Sequence
  Description of Artificial Sequence: Synthetic oligonucleotide
ctacctcgagggcctgtgcgtgga

SEQ ID NO: 380079 - DNA, 25 bp, Artificial Sequence
  Description of Artificial Sequence: Synthetic oligonucleotide
tacctcgagggcctgtgcgtggagt

SEQ ID NO: 380080 - DNA, 24 bp, Artificial Sequence
  Description of Artificial Sequence: Synthetic oligonucleotide
acctcgagggcctgtgcgtggagt

SEQ ID NO: 380081 - DNA, 23 bp, Artificial Sequence
  Description of Artificial Sequence: Synthetic oligonucleotide
cctcgagggcctgtgcgtggagt

SEQ ID NO: 380082 - DNA, 23 bp, Artificial Sequence
  Description of Artificial Sequence: Synthetic oligonucleotide
ctcgagggcctgtgcgtggagtg

SEQ ID NO: 380083 - DNA, 23 bp, Artificial Sequence
  Description of Artificial Sequence: Synthetic oligonucleotide
tcgagggcctgtgcgtggagtgg

SEQ ID NO: 380084 - DNA, 22 bp, Artificial Sequence
  Description of Artificial Sequence: Synthetic oligonucleotide
cgagggcctgtgcgtggagtgg

SEQ ID NO: 380085 - DNA, 20 bp, Artificial Sequence
  Description of Artificial Sequence: Synthetic oligonucleotide
acggagccccgggcgccctt

SEQ ID NO: 380086 - DNA, 20 bp, Artificial Sequence
  Description of Artificial Sequence: Synthetic oligonucleotide
cggagccccgggcgcccttt

SEQ ID NO: 380087 - DNA, 20 bp, Artificial Sequence
  Description of Artificial Sequence: Synthetic oligonucleotide
ggagccccgggcgccctgtt

SEQ ID NO: 380088 - DNA, 21 bp, Artificial Sequence
  Description of Artificial Sequence: Synthetic oligonucleotide
gagccccgggcgccctggata

SEQ ID NO: 380089 - DNA, 22 bp, Artificial Sequence
  Description of Artificial Sequence: Synthetic oligonucleotide
agccccgggcgccctggataga

SEQ ID NO: 380090 - DNA, 21 bp, Artificial Sequence
  Description of Artificial Sequence: Synthetic oligonucleotide
gccccgggcgccctggataga

SEQ ID NO: 380091 - DNA, 21 bp, Artificial Sequence
  Description of Artificial Sequence: Synthetic oligonucleotide
ccccgggcgccctggatagag

SEQ ID NO: 380092 - DNA, 22 bp, Artificial Sequence
  Description of Artificial Sequence: Synthetic oligonucleotide
cccgggcgccctggatagagca

SEQ ID NO: 380093 - DNA, 22 bp, Artificial Sequence
  Description of Artificial Sequence: Synthetic oligonucleotide
ccgggcgccctggatagagcag

SEQ ID NO: 380094 - DNA, 23 bp, Artificial Sequence
  Description of Artificial Sequence: Synthetic oligonucleotide
cgggcgccctggatagagcagga

SEQ ID NO: 380095 - DNA, 23 bp, Artificial Sequence
  Description of Artificial Sequence: Synthetic oligonucleotide
gggcgccctggatagagcaggag

SEQ ID NO: 380096 - DNA, 23 bp, Artificial Sequence
  Description of Artificial Sequence: Synthetic oligonucleotide
ggcgccctggatagagcaggagg

SEQ ID NO: 380097 - DNA, 23 bp, Artificial Sequence
  Description of Artificial Sequence: Synthetic oligonucleotide
gcgccctggatagagcaggaggg

SEQ ID NO: 380098 - DNA, 23 bp, Artificial Sequence
  Description of Artificial Sequence: Synthetic oligonucleotide
cgccctggatagagcaggagggg

SEQ ID NO: 380099 - DNA, 23 bp, Artificial Sequence
  Description of Artificial Sequence: Synthetic oligonucleotide
gccctggatagagcaggaggggc

SEQ ID NO: 380100 - DNA, 23 bp, Artificial Sequence
  Description of Artificial Sequence: Synthetic oligonucleotide
ccctggatagagcaggaggggcc

SEQ ID NO: 380101 - DNA, 23 bp, Artificial Sequence
  Description of Artificial Sequence: Synthetic oligonucleotide
cctggatagagcaggaggggccg

SEQ ID NO: 380102 - DNA, 24 bp, Artificial Sequence
  Description of Artificial Sequence: Synthetic oligonucleotide
ctggatagagcaggaggggccgga

SEQ ID NO: 380103 - DNA, 35 bp, Artificial Sequence; identical to SEQ ID NO: 40612
  Description of Artificial Sequence: Synthetic oligonucleotide

SEQ ID NO: 380104 - DNA, 34 bp, Artificial Sequence; identical to SEQ ID NO: 40613
  Description of Artificial Sequence: Synthetic oligonucleotide

SEQ ID NO: 380105 - DNA, 36 bp, Artificial Sequence; identical to SEQ ID NO: 40614
  Description of Artificial Sequence: Synthetic oligonucleotide

SEQ ID NO: 380106 - DNA, 37 bp, Artificial Sequence; identical to SEQ ID NO: 40615
  Description of Artificial Sequence: Synthetic oligonucleotide

SEQ ID NO: 380107 - DNA, 36 bp, Artificial Sequence; identical to SEQ ID NO: 40616
  Description of Artificial Sequence: Synthetic oligonucleotide

SEQ ID NO: 380108 - DNA, 36 bp, Artificial Sequence; identical to SEQ ID NO: 40617
  Description of Artificial Sequence: Synthetic oligonucleotide

SEQ ID NO: 380109 - DNA, 35 bp, Artificial Sequence; identical to SEQ ID NO: 40618
  Description of Artificial Sequence: Synthetic oligonucleotide

SEQ ID NO: 380110 - DNA, 34 bp, Artificial Sequence; identical to SEQ ID NO: 40619
  Description of Artificial Sequence: Synthetic oligonucleotide

SEQ ID NO: 380111 - DNA, 34 bp, Artificial Sequence; identical to SEQ ID NO: 40620
  Description of Artificial Sequence: Synthetic oligonucleotide

SEQ ID NO: 380112 - DNA, 33 bp, Artificial Sequence; identical to SEQ ID NO: 40621
  Description of Artificial Sequence: Synthetic oligonucleotide

SEQ ID NO: 380113 - DNA, 33 bp, Artificial Sequence; identical to SEQ ID NO: 40622
  Description of Artificial Sequence: Synthetic oligonucleotide

SEQ ID NO: 380114 - DNA, 33 bp, Artificial Sequence; identical to SEQ ID NO: 40623
  Description of Artificial Sequence: Synthetic oligonucleotide

SEQ ID NO: 380115 - DNA, 32 bp, Artificial Sequence; identical to SEQ ID NO: 40624
  Description of Artificial Sequence: Synthetic oligonucleotide

SEQ ID NO: 380116 - DNA, 33 bp, Artificial Sequence; identical to SEQ ID NO: 40625
  Description of Artificial Sequence: Synthetic oligonucleotide

SEQ ID NO: 380117 - DNA, 32 bp, Artificial Sequence; identical to SEQ ID NO: 40626
  Description of Artificial Sequence: Synthetic oligonucleotide

SEQ ID NO: 380118 - DNA, 32 bp, Artificial Sequence; identical to SEQ ID NO: 40627
  Description of Artificial Sequence: Synthetic oligonucleotide

SEQ ID NO: 380119 - DNA, 31 bp, Artificial Sequence; identical to SEQ ID NO: 40628
  Description of Artificial Sequence: Synthetic oligonucleotide

SEQ ID NO: 380120 - DNA, 30 bp, Artificial Sequence; identical to SEQ ID NO: 40629
  Description of Artificial Sequence: Synthetic oligonucleotide

SEQ ID NO: 380121 - DNA, 29 bp, Artificial Sequence
  Description of Artificial Sequence: Synthetic oligonucleotide
cacatgccatgtacaacatgaggggctgc

SEQ ID NO: 380122 - DNA, 29 bp, Artificial Sequence
  Description of Artificial Sequence: Synthetic oligonucleotide
acatgccatgtacaacatgaggggctgcc

SEQ ID NO: 380123 - DNA, 28 bp, Artificial Sequence
  Description of Artificial Sequence: Synthetic oligonucleotide
catgccatgtacaacatgaggggctgcc

SEQ ID NO: 380124 - DNA, 28 bp, Artificial Sequence
  Description of Artificial Sequence: Synthetic oligonucleotide
atgccatgtacaacatgaggggctgccg

SEQ ID NO: 380125 - DNA, 27 bp, Artificial Sequence
  Description of Artificial Sequence: Synthetic oligonucleotide
tgccatgtacaacatgaggggctgccg

SEQ ID NO: 380126 - DNA, 27 bp, Artificial Sequence
  Description of Artificial Sequence: Synthetic oligonucleotide
gccatgtacaacatgaggggctgccga

SEQ ID NO: 380127 - DNA, 28 bp, Artificial Sequence
  Description of Artificial Sequence: Synthetic oligonucleotide
ccatgtacaacatgaggggctgccgaag

SEQ ID NO: 380128 - DNA, 28 bp, Artificial Sequence
  Description of Artificial Sequence: Synthetic oligonucleotide
catgtacaacatgaggggctgccgaagc

SEQ ID NO: 380129 - DNA, 28 bp, Artificial Sequence
  Description of Artificial Sequence: Synthetic oligonucleotide
atgtacaacatgaggggctgccgaagcc

SEQ ID NO: 380130 - DNA, 27 bp, Artificial Sequence
  Description of Artificial Sequence: Synthetic oligonucleotide
tgtacaacatgaggggctgccgaagcc

SEQ ID NO: 380131 - DNA, 26 bp, Artificial Sequence
  Description of Artificial Sequence: Synthetic oligonucleotide
gtacaacatgaggggctgccgaagcc

SEQ ID NO: 380132 - DNA, 26 bp, Artificial Sequence
  Description of Artificial Sequence: Synthetic oligonucleotide
tacaacatgaggggctgccgaagccc

SEQ ID NO: 380133 - DNA, 25 bp, Artificial Sequence
  Description of Artificial Sequence: Synthetic oligonucleotide
acaacatgaggggctgccgaagccc

SEQ ID NO: 380134 - DNA, 24 bp, Artificial Sequence
  Description of Artificial Sequence: Synthetic oligonucleotide
caacatgaggggctgccgaagccc

SEQ ID NO: 380135 - DNA, 25 bp, Artificial Sequence
  Description of Artificial Sequence: Synthetic oligonucleotide
aacatgaggggctgccgaagcccct

SEQ ID NO: 380136 - DNA, 24 bp, Artificial Sequence
  Description of Artificial Sequence: Synthetic oligonucleotide
acatgaggggctgccgaagcccct

SEQ ID NO: 380137 - DNA, 31 bp, Artificial Sequence; identical to SEQ ID NO: 39656
  Description of Artificial Sequence: Synthetic oligonucleotide

SEQ ID NO: 380138 - DNA, 30 bp, Artificial Sequence; identical to SEQ ID NO: 39657
  Description of Artificial Sequence: Synthetic oligonucleotide

SEQ ID NO: 380139 - DNA, 31 bp, Artificial Sequence; identical to SEQ ID NO: 39658
  Description of Artificial Sequence: Synthetic oligonucleotide

SEQ ID NO: 380140 - DNA, 30 bp, Artificial Sequence; identical to SEQ ID NO: 39659
  Description of Artificial Sequence: Synthetic oligonucleotide

SEQ ID NO: 380141 - DNA, 30 bp, Artificial Sequence
  Description of Artificial Sequence: Synthetic oligonucleotide
acacttggcagacgatgtatggctgtgacg

SEQ ID NO: 380142 - DNA, 29 bp, Artificial Sequence
  Description of Artificial Sequence: Synthetic oligonucleotide
cacttggcagacgatgtatggctgtgacg

SEQ ID NO: 380143 - DNA, 30 bp, Artificial Sequence
  Description of Artificial Sequence: Synthetic oligonucleotide
acttggcagacgatgtatggctgtgacgtg

SEQ ID NO: 380144 - DNA, 29 bp, Artificial Sequence
  Description of Artificial Sequence: Synthetic oligonucleotide
cttggcagacgatgtatggctgtgacgtg

SEQ ID NO: 380145 - DNA, 29 bp, Artificial Sequence
  Description of Artificial Sequence: Synthetic oligonucleotide
ttggcagacgatgtatggctgtgacgtgg

SEQ ID NO: 380146 - DNA, 28 bp, Artificial Sequence
  Description of Artificial Sequence: Synthetic oligonucleotide
tggcagacgatgtatggctgtgacgtgg

SEQ ID NO: 380147 - DNA, 27 bp, Artificial Sequence
  Description of Artificial Sequence: Synthetic oligonucleotide
ggcagacgatgtatggctgtgacgtgg

SEQ ID NO: 380148 - DNA, 27 bp, Artificial Sequence
  Description of Artificial Sequence: Synthetic oligonucleotide
gcagacgatgtatggctgtgacgtggg

SEQ ID NO: 380149 - DNA, 27 bp, Artificial Sequence
  Description of Artificial Sequence: Synthetic oligonucleotide
cagacgatgtatggctgtgacgtgggg

SEQ ID NO: 380150 - DNA, 27 bp, Artificial Sequence
  Description of Artificial Sequence: Synthetic oligonucleotide
agacgatgtatggctgtgacgtggggc

SEQ ID NO: 380151 - DNA, 26 bp, Artificial Sequence
  Description of Artificial Sequence: Synthetic oligonucleotide
gacgatgtatggctgtgacgtggggc

SEQ ID NO: 380152 - DNA, 26 bp, Artificial Sequence
  Description of Artificial Sequence: Synthetic oligonucleotide
acgatgtatggctgtgacgtggggcc

SEQ ID NO: 380153 - DNA, 25 bp, Artificial Sequence
  Description of Artificial Sequence: Synthetic oligonucleotide
cgatgtatggctgtgacgtggggcc

SEQ ID NO: 380154 - DNA, 25 bp, Artificial Sequence
  Description of Artificial Sequence: Synthetic oligonucleotide
gatgtatggctgtgacgtggggccg

SEQ ID NO: 380155 - DNA, 26 bp, Artificial Sequence
  Description of Artificial Sequence: Synthetic oligonucleotide
atgtatggctgtgacgtggggccgga

SEQ ID NO: 380156 - DNA, 25 bp, Artificial Sequence
  Description of Artificial Sequence: Synthetic oligonucleotide
tgtatggctgtgacgtggggccgga

SEQ ID NO: 380157 - DNA, 24 bp, Artificial Sequence
  Description of Artificial Sequence: Synthetic oligonucleotide
gtatggctgtgacgtggggccgga

SEQ ID NO: 380158 - DNA, 24 bp, Artificial Sequence
  Description of Artificial Sequence: Synthetic oligonucleotide
tatggctgtgacgtggggccggac

SEQ ID NO: 380159 - DNA, 23 bp, Artificial Sequence
  Description of Artificial Sequence: Synthetic oligonucleotide
atggctgtgacgtggggccggac

SEQ ID NO: 380160 - DNA, 22 bp, Artificial Sequence
  Description of Artificial Sequence: Synthetic oligonucleotide
tggctgtgacgtggggccggac

SEQ ID NO: 380161 - DNA, 27 bp, Artificial Sequence
  Description of Artificial Sequence: Synthetic oligonucleotide
aaccagagcgaggccggttctcacact

SEQ ID NO: 380162 - DNA, 27 bp, Artificial Sequence
  Description of Artificial Sequence: Synthetic oligonucleotide
accagagcgaggccggttctcacactt

SEQ ID NO: 380163 - DNA, 26 bp, Artificial Sequence
  Description of Artificial Sequence: Synthetic oligonucleotide
ccagagcgaggccggttctcacactt

SEQ ID NO: 380164 - DNA, 26 bp, Artificial Sequence
  Description of Artificial Sequence: Synthetic oligonucleotide
cagagcgaggccggttctcacacttg

SEQ ID NO: 380165 - DNA, 26 bp, Artificial Sequence
  Description of Artificial Sequence: Synthetic oligonucleotide
agagcgaggccggttctcacacttgg

SEQ ID NO: 380166 - DNA, 25 bp, Artificial Sequence
  Description of Artificial Sequence: Synthetic oligonucleotide
gagcgaggccggttctcacacttgg

SEQ ID NO: 380167 - DNA, 26 bp, Artificial Sequence
  Description of Artificial Sequence: Synthetic oligonucleotide
agcgaggccggttctcacacttggca

SEQ ID NO: 380168 - DNA, 25 bp, Artificial Sequence
  Description of Artificial Sequence: Synthetic oligonucleotide
gcgaggccggttctcacacttggca

SEQ ID NO: 380169 - DNA, 26 bp, Artificial Sequence
  Description of Artificial Sequence: Synthetic oligonucleotide
cgaggccggttctcacacttggcaga

SEQ ID NO: 380170 - DNA, 26 bp, Artificial Sequence
  Description of Artificial Sequence: Synthetic oligonucleotide
gaggccggttctcacacttggcagac

SEQ ID NO: 380171 - DNA, 27 bp, Artificial Sequence
  Description of Artificial Sequence: Synthetic oligonucleotide
aggccggttctcacacttggcagacga

SEQ ID NO: 380172 - DNA, 27 bp, Artificial Sequence
  Description of Artificial Sequence: Synthetic oligonucleotide
ggccggttctcacacttggcagacgat

SEQ ID NO: 380173 - DNA, 27 bp, Artificial Sequence
  Description of Artificial Sequence: Synthetic oligonucleotide
gccggttctcacacttggcagacgatg

SEQ ID NO: 380174 - DNA, 30 bp, Artificial Sequence
  Description of Artificial Sequence: Synthetic oligonucleotide
ccggttctcacacttggcagacgatgtatg

SEQ ID NO: 380175 - DNA, 30 bp, Artificial Sequence
  Description of Artificial Sequence: Synthetic oligonucleotide
cggttctcacacttggcagacgatgtatgg

SEQ ID NO: 380176 - DNA, 30 bp, Artificial Sequence
  Description of Artificial Sequence: Synthetic oligonucleotide
ggttctcacacttggcagacgatgtatggc

SEQ ID NO: 380177 - DNA, 31 bp, Artificial Sequence
  Description of Artificial Sequence: Synthetic oligonucleotide
gttctcacacttggcagacgatgtatggctg

SEQ ID NO: 380178 - DNA, 31 bp, Artificial Sequence
  Description of Artificial Sequence: Synthetic oligonucleotide
ttctcacacttggcagacgatgtatggctgc

SEQ ID NO: 380179 - DNA, 33 bp, Artificial Sequence; identical to SEQ ID NO: 41214
  Description of Artificial Sequence: Synthetic oligonucleotide

SEQ ID NO: 380180 - DNA, 32 bp, Artificial Sequence; identical to SEQ ID NO: 41215
  Description of Artificial Sequence: Synthetic oligonucleotide

SEQ ID NO: 380181 - DNA, 33 bp, Artificial Sequence; identical to SEQ ID NO: 41216
  Description of Artificial Sequence: Synthetic oligonucleotide

SEQ ID NO: 380182 - DNA, 33 bp, Artificial Sequence; identical to SEQ ID NO: 41217
  Description of Artificial Sequence: Synthetic oligonucleotide

SEQ ID NO: 380183 - DNA, 33 bp, Artificial Sequence; identical to SEQ ID NO: 41218
  Description of Artificial Sequence: Synthetic oligonucleotide

SEQ ID NO: 380184 - DNA, 32 bp, Artificial Sequence; identical to SEQ ID NO: 41219
  Description of Artificial Sequence: Synthetic oligonucleotide

SEQ ID NO: 380185 - DNA, 32 bp, Artificial Sequence; identical to SEQ ID NO: 41220
  Description of Artificial Sequence: Synthetic oligonucleotide

SEQ ID NO: 380186 - DNA, 31 bp, Artificial Sequence; identical to SEQ ID NO: 41221
  Description of Artificial Sequence: Synthetic oligonucleotide

SEQ ID NO: 380187 - DNA, 31 bp, Artificial Sequence; identical to SEQ ID NO: 41222
  Description of Artificial Sequence: Synthetic oligonucleotide

SEQ ID NO: 380188 - DNA, 31 bp, Artificial Sequence; identical to SEQ ID NO: 41223
  Description of Artificial Sequence: Synthetic oligonucleotide

SEQ ID NO: 380189 - DNA, 30 bp, Artificial Sequence; identical to SEQ ID NO: 41224
  Description of Artificial Sequence: Synthetic oligonucleotide

SEQ ID NO: 380190 - DNA, 29 bp, Artificial Sequence
  Description of Artificial Sequence: Synthetic oligonucleotide
gaggtatttctacaccgctatgtcccggc

SEQ ID NO: 380191 - DNA, 29 bp, Artificial Sequence
  Description of Artificial Sequence: Synthetic oligonucleotide
aggtatttctacaccgctatgtcccggcc

SEQ ID NO: 380192 - DNA, 28 bp, Artificial Sequence
  Description of Artificial Sequence: Synthetic oligonucleotide
ggtatttctacaccgctatgtcccggcc

SEQ ID NO: 380193 - DNA, 28 bp, Artificial Sequence
  Description of Artificial Sequence: Synthetic oligonucleotide
gtatttctacaccgctatgtcccggccc

SEQ ID NO: 380194 - DNA, 28 bp, Artificial Sequence
  Description of Artificial Sequence: Synthetic oligonucleotide
tatttctacaccgctatgtcccggcccg

SEQ ID NO: 380195 - DNA, 27 bp, Artificial Sequence
  Description of Artificial Sequence: Synthetic oligonucleotide
atttctacaccgctatgtcccggcccg

SEQ ID NO: 380196 - DNA, 26 bp, Artificial Sequence
  Description of Artificial Sequence: Synthetic oligonucleotide
tttctacaccgctatgtcccggcccg

SEQ ID NO: 380197 - DNA, 25 bp, Artificial Sequence
  Description of Artificial Sequence: Synthetic oligonucleotide
ttctacaccgctatgtcccggcccg

SEQ ID NO: 380198 - DNA, 24 bp, Artificial Sequence
  Description of Artificial Sequence: Synthetic oligonucleotide
tctacaccgctatgtcccggcccg

SEQ ID NO: 380199 - DNA, 23 bp, Artificial Sequence
  Description of Artificial Sequence: Synthetic oligonucleotide
ctacaccgctatgtcccggcccg

SEQ ID NO: 380200 - DNA, 23 bp, Artificial Sequence
  Description of Artificial Sequence: Synthetic oligonucleotide
tacaccgctatgtcccggcccgg

SEQ ID NO: 380201 - DNA, 22 bp, Artificial Sequence
  Description of Artificial Sequence: Synthetic oligonucleotide
acaccgctatgtcccggcccgg

SEQ ID NO: 380202 - DNA, 21 bp, Artificial Sequence
  Description of Artificial Sequence: Synthetic oligonucleotide
caccgctatgtcccggcccgg

SEQ ID NO: 380203 - DNA, 21 bp, Artificial Sequence
  Description of Artificial Sequence: Synthetic oligonucleotide
accgctatgtcccggcccggc

SEQ ID NO: 380204 - DNA, 20 bp, Artificial Sequence
  Description of Artificial Sequence: Synthetic oligonucleotide
ccgctatgtcccggcccggc

SEQ ID NO: 380205 - DNA, 20 bp, Artificial Sequence
  Description of Artificial Sequence: Synthetic oligonucleotide
cgctatgtcccggcccggcc

SEQ ID NO: 380206 - DNA, 20 bp, Artificial Sequence
  Description of Artificial Sequence: Synthetic oligonucleotide
gctatgtcccggcccggccg

SEQ ID NO: 380207 - DNA, 20 bp, Artificial Sequence
  Description of Artificial Sequence: Synthetic oligonucleotide
ctatgtcccggcccggccgc

SEQ ID NO: 380208 - DNA, 20 bp, Artificial Sequence
  Description of Artificial Sequence: Synthetic oligonucleotide
tatgtcccggcccggccgcg

SEQ ID NO: 380209 - DNA, 24 bp, Artificial Sequence
  Description of Artificial Sequence: Synthetic oligonucleotide
cctcctccgcgggcacaaccagta

SEQ ID NO: 380210 - DNA, 24 bp, Artificial Sequence
  Description of Artificial Sequence: Synthetic oligonucleotide
ctcctccgcgggcacaaccagtac

SEQ ID NO: 380211 - DNA, 24 bp, Artificial Sequence
  Description of Artificial Sequence: Synthetic oligonucleotide
tcctccgcgggcacaaccagtacg

SEQ ID NO: 380212 - DNA, 23 bp, Artificial Sequence
  Description of Artificial Sequence: Synthetic oligonucleotide
cctccgcgggcacaaccagtacg

SEQ ID NO: 380213 - DNA, 23 bp, Artificial Sequence
  Description of Artificial Sequence: Synthetic oligonucleotide
ctccgcgggcacaaccagtacgc

SEQ ID NO: 380214 - DNA, 25 bp, Artificial Sequence
  Description of Artificial Sequence: Synthetic oligonucleotide
tccgcgggcacaaccagtacgccta

SEQ ID NO: 380215 - DNA, 24 bp, Artificial Sequence
  Description of Artificial Sequence: Synthetic oligonucleotide
ccgcgggcacaaccagtacgccta

SEQ ID NO: 380216 - DNA, 24 bp, Artificial Sequence
  Description of Artificial Sequence: Synthetic oligonucleotide
cgcgggcacaaccagtacgcctac

SEQ ID NO: 380217 - DNA, 25 bp, Artificial Sequence
  Description of Artificial Sequence: Synthetic oligonucleotide
gcgggcacaaccagtacgcctacga

SEQ ID NO: 380218 - DNA, 25 bp, Artificial Sequence
  Description of Artificial Sequence: Synthetic oligonucleotide
cgggcacaaccagtacgcctacgac

SEQ ID NO: 380219 - DNA, 25 bp, Artificial Sequence
  Description of Artificial Sequence: Synthetic oligonucleotide
gggcacaaccagtacgcctacgacg

SEQ ID NO: 380220 - DNA, 25 bp, Artificial Sequence
  Description of Artificial Sequence: Synthetic oligonucleotide
ggcacaaccagtacgcctacgacgg

SEQ ID NO: 380221 - DNA, 27 bp, Artificial Sequence
  Description of Artificial Sequence: Synthetic oligonucleotide
gcacaaccagtacgcctacgacggcaa

SEQ ID NO: 380222 - DNA, 28 bp, Artificial Sequence
  Description of Artificial Sequence: Synthetic oligonucleotide
cacaaccagtacgcctacgacggcaaag

SEQ ID NO: 380223 - DNA, 32 bp, Artificial Sequence; identical to SEQ ID NO: 38134
  Description of Artificial Sequence: Synthetic oligonucleotide

SEQ ID NO: 380224 - DNA, 31 bp, Artificial Sequence; identical to SEQ ID NO: 38135
  Description of Artificial Sequence: Synthetic oligonucleotide

SEQ ID NO: 380225 - DNA, 23 bp, Artificial Sequence
  Description of Artificial Sequence: Synthetic oligonucleotide
ggcgcctcctccgcgggcataaa

SEQ ID NO: 380226 - DNA, 24 bp, Artificial Sequence
  Description of Artificial Sequence: Synthetic oligonucleotide
gcgcctcctccgcgggcataaaca

SEQ ID NO: 380227 - DNA, 26 bp, Artificial Sequence
  Description of Artificial Sequence: Synthetic oligonucleotide
cgcctcctccgcgggcataaacagta

SEQ ID NO: 380228 - DNA, 26 bp, Artificial Sequence
  Description of Artificial Sequence: Synthetic oligonucleotide
gcctcctccgcgggcataaacagtac

SEQ ID NO: 380229 - DNA, 26 bp, Artificial Sequence
  Description of Artificial Sequence: Synthetic oligonucleotide
cctcctccgcgggcataaacagtacg

SEQ ID NO: 380230 - DNA, 26 bp, Artificial Sequence
  Description of Artificial Sequence: Synthetic oligonucleotide
ctcctccgcgggcataaacagtacgc

SEQ ID NO: 380231 - DNA, 27 bp, Artificial Sequence
  Description of Artificial Sequence: Synthetic oligonucleotide
tcctccgcgggcataaacagtacgcct

SEQ ID NO: 380232 - DNA, 27 bp, Artificial Sequence
  Description of Artificial Sequence: Synthetic oligonucleotide
cctccgcgggcataaacagtacgccta

SEQ ID NO: 380233 - DNA, 27 bp, Artificial Sequence
  Description of Artificial Sequence: Synthetic oligonucleotide
ctccgcgggcataaacagtacgcctac

SEQ ID NO: 380234 - DNA, 27 bp, Artificial Sequence
  Description of Artificial Sequence: Synthetic oligonucleotide
tccgcgggcataaacagtacgcctacg

SEQ ID NO: 380235 - DNA, 27 bp, Artificial Sequence
  Description of Artificial Sequence: Synthetic oligonucleotide
ccgcgggcataaacagtacgcctacga

SEQ ID NO: 380236 - DNA, 27 bp, Artificial Sequence
  Description of Artificial Sequence: Synthetic oligonucleotide
cgcgggcataaacagtacgcctacgac

SEQ ID NO: 380237 - DNA, 27 bp, Artificial Sequence
  Description of Artificial Sequence: Synthetic oligonucleotide
gcgggcataaacagtacgcctacgacg

SEQ ID NO: 380238 - DNA, 27 bp, Artificial Sequence
  Description of Artificial Sequence: Synthetic oligonucleotide
cgggcataaacagtacgcctacgacgg

SEQ ID NO: 380239 - DNA, 27 bp, Artificial Sequence
  Description of Artificial Sequence: Synthetic oligonucleotide
gggcataaacagtacgcctacgacggc

SEQ ID NO: 380240 - DNA, 30 bp, Artificial Sequence; identical to SEQ ID NO: 38224
  Description of Artificial Sequence: Synthetic oligonucleotide

SEQ ID NO: 380241 - DNA, 34 bp, Artificial Sequence; identical to SEQ ID NO: 38225
  Description of Artificial Sequence: Synthetic oligonucleotide

SEQ ID NO: 380242 - DNA, 36 bp, Artificial Sequence; identical to SEQ ID NO: 38226
  Description of Artificial Sequence: Synthetic oligonucleotide

SEQ ID NO: 380243 - DNA, 36 bp, Artificial Sequence; identical to SEQ ID NO: 38227
  Description of Artificial Sequence: Synthetic oligonucleotide

SEQ ID NO: 380244 - DNA, 35 bp, Artificial Sequence; identical to SEQ ID NO: 38228
  Description of Artificial Sequence: Synthetic oligonucleotide

SEQ ID NO: 380245 - DNA, 34 bp, Artificial Sequence; identical to SEQ ID NO: 38229
  Description of Artificial Sequence: Synthetic oligonucleotide

SEQ ID NO: 380246 - DNA, 33 bp, Artificial Sequence; identical to SEQ ID NO: 38230
  Description of Artificial Sequence: Synthetic oligonucleotide

SEQ ID NO: 380247 - DNA, 32 bp, Artificial Sequence; identical to SEQ ID NO: 38231
  Description of Artificial Sequence: Synthetic oligonucleotide

SEQ ID NO: 380248 - DNA, 24 bp, Artificial Sequence
  Description of Artificial Sequence: Synthetic oligonucleotide
gagtgcgtggagtggctccgcaga

SEQ ID NO: 380249 - DNA, 25 bp, Artificial Sequence
  Description of Artificial Sequence: Synthetic oligonucleotide
agtgcgtggagtggctccgcagaca

SEQ ID NO: 380250 - DNA, 28 bp, Artificial Sequence
  Description of Artificial Sequence: Synthetic oligonucleotide
atgccatgtacagcatgaggggctgctg

SEQ ID NO: 380251 - DNA, 27 bp, Artificial Sequence
  Description of Artificial Sequence: Synthetic oligonucleotide
tgccatgtacagcatgaggggctgctg

SEQ ID NO: 380252 - DNA, 27 bp, Artificial Sequence
  Description of Artificial Sequence: Synthetic oligonucleotide
gccatgtacagcatgaggggctgctga

SEQ ID NO: 380253 - DNA, 28 bp, Artificial Sequence
  Description of Artificial Sequence: Synthetic oligonucleotide
ccatgtacagcatgaggggctgctgaag

SEQ ID NO: 380254 - DNA, 28 bp, Artificial Sequence
  Description of Artificial Sequence: Synthetic oligonucleotide
catgtacagcatgaggggctgctgaagc

SEQ ID NO: 380255 - DNA, 28 bp, Artificial Sequence
  Description of Artificial Sequence: Synthetic oligonucleotide
atgtacagcatgaggggctgctgaagcc

SEQ ID NO: 380256 - DNA, 27 bp, Artificial Sequence
  Description of Artificial Sequence: Synthetic oligonucleotide
tgtacagcatgaggggctgctgaagcc

SEQ ID NO: 380257 - DNA, 26 bp, Artificial Sequence
  Description of Artificial Sequence: Synthetic oligonucleotide
gtacagcatgaggggctgctgaagcc

SEQ ID NO: 380258 - DNA, 26 bp, Artificial Sequence
  Description of Artificial Sequence: Synthetic oligonucleotide
tacagcatgaggggctgctgaagccc

SEQ ID NO: 380259 - DNA, 25 bp, Artificial Sequence
  Description of Artificial Sequence: Synthetic oligonucleotide
acagcatgaggggctgctgaagccc

SEQ ID NO: 380260 - DNA, 24 bp, Artificial Sequence
  Description of Artificial Sequence: Synthetic oligonucleotide
cagcatgaggggctgctgaagccc

SEQ ID NO: 380261 - DNA, 25 bp, Artificial Sequence
  Description of Artificial Sequence: Synthetic oligonucleotide
agcatgaggggctgctgaagcccct

SEQ ID NO: 380262 - DNA, 24 bp, Artificial Sequence
  Description of Artificial Sequence: Synthetic oligonucleotide
gcatgaggggctgctgaagcccct

SEQ ID NO: 380263 - DNA, 25 bp, Artificial Sequence
  Description of Artificial Sequence: Synthetic oligonucleotide
catgaggggctgctgaagcccctca

SEQ ID NO: 380264 - DNA, 25 bp, Artificial Sequence
  Description of Artificial Sequence: Synthetic oligonucleotide
atgaggggctgctgaagcccctcac

SEQ ID NO: 380265 - DNA, 24 bp, Artificial Sequence
  Description of Artificial Sequence: Synthetic oligonucleotide
tgaggggctgctgaagcccctcac

SEQ ID NO: 380266 - DNA, 23 bp, Artificial Sequence
  Description of Artificial Sequence: Synthetic oligonucleotide
gaggggctgctgaagcccctcac

SEQ ID NO: 380267 - DNA, 23 bp, Artificial Sequence
  Description of Artificial Sequence: Synthetic oligonucleotide
aggggctgctgaagcccctcacc

SEQ ID NO: 380268 - DNA, 22 bp, Artificial Sequence
  Description of Artificial Sequence: Synthetic oligonucleotide
ggggctgctgaagcccctcacc

SEQ ID NO: 380269 - DNA, 23 bp, Artificial Sequence
  Description of Artificial Sequence: Synthetic oligonucleotide
gggctgctgaagcccctcaccct

SEQ ID NO: 380270 - DNA, 24 bp, Artificial Sequence
  Description of Artificial Sequence: Synthetic oligonucleotide
ggctgctgaagcccctcaccctga

SEQ ID NO: 380271 - DNA, 26 bp, Artificial Sequence
  Description of Artificial Sequence: Synthetic oligonucleotide
gctgctgaagcccctcaccctgagat

SEQ ID NO: 380272 - DNA, 26 bp, Artificial Sequence
  Description of Artificial Sequence: Synthetic oligonucleotide
ctgctgaagcccctcaccctgagatg

SEQ ID NO: 380273 - DNA, 26 bp, Artificial Sequence
  Description of Artificial Sequence: Synthetic oligonucleotide
tgctgaagcccctcaccctgagatgg

SEQ ID NO: 380274 - DNA, 25 bp, Artificial Sequence
  Description of Artificial Sequence: Synthetic oligonucleotide
gctgaagcccctcaccctgagatgg

SEQ ID NO: 380275 - DNA, 25 bp, Artificial Sequence
  Description of Artificial Sequence: Synthetic oligonucleotide
ctgaagcccctcaccctgagatggg

SEQ ID NO: 380276 - DNA, 34 bp, Artificial Sequence; identical to SEQ ID NO: 39171
  Description of Artificial Sequence: Synthetic oligonucleotide

SEQ ID NO: 380277 - DNA, 34 bp, Artificial Sequence; identical to SEQ ID NO: 39172
  Description of Artificial Sequence: Synthetic oligonucleotide

SEQ ID NO: 380278 - DNA, 33 bp, Artificial Sequence; identical to SEQ ID NO: 39173
  Description of Artificial Sequence: Synthetic oligonucleotide

SEQ ID NO: 380279 - DNA, 32 bp, Artificial Sequence; identical to SEQ ID NO: 39174
  Description of Artificial Sequence: Synthetic oligonucleotide

SEQ ID NO: 380280 - DNA, 32 bp, Artificial Sequence; identical to SEQ ID NO: 39175
  Description of Artificial Sequence: Synthetic oligonucleotide

SEQ ID NO: 380281 - DNA, 31 bp, Artificial Sequence; identical to SEQ ID NO: 39176
  Description of Artificial Sequence: Synthetic oligonucleotide

SEQ ID NO: 380282 - DNA, 31 bp, Artificial Sequence; identical to SEQ ID NO: 39177
  Description of Artificial Sequence: Synthetic oligonucleotide

SEQ ID NO: 380283 - DNA, 33 bp, Artificial Sequence; identical to SEQ ID NO: 39178
  Description of Artificial Sequence: Synthetic oligonucleotide

SEQ ID NO: 380284 - DNA, 32 bp, Artificial Sequence; identical to SEQ ID NO: 39179
  Description of Artificial Sequence: Synthetic oligonucleotide

SEQ ID NO: 380285 - DNA, 31 bp, Artificial Sequence; identical to SEQ ID NO: 39180
  Description of Artificial Sequence: Synthetic oligonucleotide

SEQ ID NO: 380286 - DNA, 31 bp, Artificial Sequence; identical to SEQ ID NO: 39181
  Description of Artificial Sequence: Synthetic oligonucleotide

SEQ ID NO: 380287 - DNA, 30 bp, Artificial Sequence; identical to SEQ ID NO: 39182
  Description of Artificial Sequence: Synthetic oligonucleotide

SEQ ID NO: 380288 - DNA, 30 bp, Artificial Sequence; identical to SEQ ID NO: 39183
  Description of Artificial Sequence: Synthetic oligonucleotide

SEQ ID NO: 380289 - DNA, 29 bp, Artificial Sequence
  Description of Artificial Sequence: Synthetic oligonucleotide
cagacttaccgagagaacttgcggatcgc

SEQ ID NO: 380290 - DNA, 29 bp, Artificial Sequence
  Description of Artificial Sequence: Synthetic oligonucleotide
agacttaccgagagaacttgcggatcgcg

SEQ ID NO: 380291 - DNA, 28 bp, Artificial Sequence
  Description of Artificial Sequence: Synthetic oligonucleotide
gacttaccgagagaacttgcggatcgcg

SEQ ID NO: 380292 - DNA, 28 bp, Artificial Sequence
  Description of Artificial Sequence: Synthetic oligonucleotide
acttaccgagagaacttgcggatcgcgc

SEQ ID NO: 380293 - DNA, 27 bp, Artificial Sequence
  Description of Artificial Sequence: Synthetic oligonucleotide
cttaccgagagaacttgcggatcgcgc

SEQ ID NO: 380294 - DNA, 28 bp, Artificial Sequence
  Description of Artificial Sequence: Synthetic oligonucleotide
ttaccgagagaacttgcggatcgcgctc

SEQ ID NO: 380295 - DNA, 27 bp, Artificial Sequence
  Description of Artificial Sequence: Synthetic oligonucleotide
taccgagagaacttgcggatcgcgctc

SEQ ID NO: 380296 - DNA, 26 bp, Artificial Sequence
  Description of Artificial Sequence: Synthetic oligonucleotide
accgagagaacttgcggatcgcgctc

SEQ ID NO: 380297 - DNA, 25 bp, Artificial Sequence
  Description of Artificial Sequence: Synthetic oligonucleotide
ccgagagaacttgcggatcgcgctc

SEQ ID NO: 380298 - DNA, 25 bp, Artificial Sequence
  Description of Artificial Sequence: Synthetic oligonucleotide
cgagagaacttgcggatcgcgctcc

SEQ ID NO: 380299 - DNA, 25 bp, Artificial Sequence
  Description of Artificial Sequence: Synthetic oligonucleotide
gagagaacttgcggatcgcgctccg

SEQ ID NO: 380300 - DNA, 27 bp, Artificial Sequence
  Description of Artificial Sequence: Synthetic oligonucleotide
agagaacttgcggatcgcgctccgcta

SEQ ID NO: 380301 - DNA, 26 bp, Artificial Sequence
  Description of Artificial Sequence: Synthetic oligonucleotide
gagaacttgcggatcgcgctccgcta

SEQ ID NO: 380302 - DNA, 27 bp, Artificial Sequence
  Description of Artificial Sequence: Synthetic oligonucleotide
agaacttgcggatcgcgctccgctact

SEQ ID NO: 380303 - DNA, 27 bp, Artificial Sequence
  Description of Artificial Sequence: Synthetic oligonucleotide
gaacttgcggatcgcgctccgctacta

SEQ ID NO: 380304 - DNA, 27 bp, Artificial Sequence
  Description of Artificial Sequence: Synthetic oligonucleotide
aacttgcggatcgcgctccgctactac

SEQ ID NO: 380305 - DNA, 27 bp, Artificial Sequence
  Description of Artificial Sequence: Synthetic oligonucleotide
acttgcggatcgcgctccgctactaca

SEQ ID NO: 380306 - DNA, 27 bp, Artificial Sequence
  Description of Artificial Sequence: Synthetic oligonucleotide
cttgcggatcgcgctccgctactacaa

SEQ ID NO: 380307 - DNA, 27 bp, Artificial Sequence
  Description of Artificial Sequence: Synthetic oligonucleotide
ttgcggatcgcgctccgctactacaac

SEQ ID NO: 380308 - DNA, 25 bp, Artificial Sequence
  Description of Artificial Sequence: Synthetic oligonucleotide
ccaaagcccctcaccctgagatggg

SEQ ID NO: 380309 - DNA, 20 bp, Artificial Sequence
  Description of Artificial Sequence: Synthetic oligonucleotide
gcccgacgggcgcctcctgt

SEQ ID NO: 380310 - DNA, 20 bp, Artificial Sequence
  Description of Artificial Sequence: Synthetic oligonucleotide
cccgacgggcgcctcctgct

SEQ ID NO: 380311 - DNA, 20 bp, Artificial Sequence
  Description of Artificial Sequence: Synthetic oligonucleotide
ccgacgggcgcctcctgcgt

SEQ ID NO: 380312 - DNA, 20 bp, Artificial Sequence
  Description of Artificial Sequence: Synthetic oligonucleotide
cgacgggcgcctcctgcgct

SEQ ID NO: 380313 - DNA, 20 bp, Artificial Sequence
  Description of Artificial Sequence: Synthetic oligonucleotide
ggcgcctcctgcgcgggcat

SEQ ID NO: 380314 - DNA, 21 bp, Artificial Sequence
  Description of Artificial Sequence: Synthetic oligonucleotide
gcgcctcctgcgcgggcatga

SEQ ID NO: 380315 - DNA, 21 bp, Artificial Sequence
  Description of Artificial Sequence: Synthetic oligonucleotide
cgcctcctgcgcgggcatgac

SEQ ID NO: 380316 - DNA, 22 bp, Artificial Sequence
  Description of Artificial Sequence: Synthetic oligonucleotide
gcctcctgcgcgggcatgacca

SEQ ID NO: 380317 - DNA, 23 bp, Artificial Sequence
  Description of Artificial Sequence: Synthetic oligonucleotide
cctcctgcgcgggcatgaccagt

SEQ ID NO: 380318 - DNA, 23 bp, Artificial Sequence
  Description of Artificial Sequence: Synthetic oligonucleotide
ctcctgcgcgggcatgaccagtc

SEQ ID NO: 380319 - DNA, 23 bp, Artificial Sequence
  Description of Artificial Sequence: Synthetic oligonucleotide
tcctgcgcgggcatgaccagtcc

SEQ ID NO: 380320 - DNA, 22 bp, Artificial Sequence
  Description of Artificial Sequence: Synthetic oligonucleotide
cctgcgcgggcatgaccagtcc

SEQ ID NO: 380321 - DNA, 22 bp, Artificial Sequence
  Description of Artificial Sequence: Synthetic oligonucleotide
ctgcgcgggcatgaccagtccg

SEQ ID NO: 380322 - DNA, 22 bp, Artificial Sequence
  Description of Artificial Sequence: Synthetic oligonucleotide
tgcgcgggcatgaccagtccgc

SEQ ID NO: 380323 - DNA, 21 bp, Artificial Sequence
  Description of Artificial Sequence: Synthetic oligonucleotide
gcgcgggcatgaccagtccgc

SEQ ID NO: 380324 - DNA, 27 bp, Artificial Sequence
  Description of Artificial Sequence: Synthetic oligonucleotide
gatcaggacgaagtcccatgtcccgga

SEQ ID NO: 380325 - DNA, 27 bp, Artificial Sequence
  Description of Artificial Sequence: Synthetic oligonucleotide
atcaggacgaagtcccatgtcccggac

SEQ ID NO: 380326 - DNA, 26 bp, Artificial Sequence
  Description of Artificial Sequence: Synthetic oligonucleotide
tcaggacgaagtcccatgtcccggac

SEQ ID NO: 380327 - DNA, 25 bp, Artificial Sequence
  Description of Artificial Sequence: Synthetic oligonucleotide
caggacgaagtcccatgtcccggac

SEQ ID NO: 380328 - DNA, 25 bp, Artificial Sequence
  Description of Artificial Sequence: Synthetic oligonucleotide
aggacgaagtcccatgtcccggacg

SEQ ID NO: 380329 - DNA, 24 bp, Artificial Sequence
  Description of Artificial Sequence: Synthetic oligonucleotide
ggacgaagtcccatgtcccggacg

SEQ ID NO: 380330 - DNA, 24 bp, Artificial Sequence
  Description of Artificial Sequence: Synthetic oligonucleotide
gacgaagtcccatgtcccggacgg

SEQ ID NO: 380331 - DNA, 24 bp, Artificial Sequence
  Description of Artificial Sequence: Synthetic oligonucleotide
acgaagtcccatgtcccggacggg

SEQ ID NO: 380332 - DNA, 23 bp, Artificial Sequence
  Description of Artificial Sequence: Synthetic oligonucleotide
cgaagtcccatgtcccggacggg

SEQ ID NO: 380333 - DNA, 23 bp, Artificial Sequence
  Description of Artificial Sequence: Synthetic oligonucleotide
gaagtcccatgtcccggacgggg

SEQ ID NO: 380334 - DNA, 24 bp, Artificial Sequence
  Description of Artificial Sequence: Synthetic oligonucleotide
aagtcccatgtcccggacggggct

SEQ ID NO: 380335 - DNA, 23 bp, Artificial Sequence
  Description of Artificial Sequence: Synthetic oligonucleotide
agtcccatgtcccggacggggct

SEQ ID NO: 380336 - DNA, 22 bp, Artificial Sequence
  Description of Artificial Sequence: Synthetic oligonucleotide
gtcccatgtcccggacggggct

SEQ ID NO: 380337 - DNA, 23 bp, Artificial Sequence
  Description of Artificial Sequence: Synthetic oligonucleotide
tcccatgtcccggacggggctct

SEQ ID NO: 380338 - DNA, 22 bp, Artificial Sequence
  Description of Artificial Sequence: Synthetic oligonucleotide
cccatgtcccggacggggctct

SEQ ID NO: 380339 - DNA, 23 bp, Artificial Sequence
  Description of Artificial Sequence: Synthetic oligonucleotide
ccatgtcccggacggggctctca

SEQ ID NO: 380340 - DNA, 23 bp, Artificial Sequence
  Description of Artificial Sequence: Synthetic oligonucleotide
catgtcccggacggggctctcag

SEQ ID NO: 380341 - DNA, 23 bp, Artificial Sequence
  Description of Artificial Sequence: Synthetic oligonucleotide
atgtcccggacggggctctcagg

SEQ ID NO: 380342 - DNA, 22 bp, Artificial Sequence
  Description of Artificial Sequence: Synthetic oligonucleotide
tgtcccggacggggctctcagg

SEQ ID NO: 380343 - DNA, 23 bp, Artificial Sequence
  Description of Artificial Sequence: Synthetic oligonucleotide
gctccgagggccgcgtctgcatt

SEQ ID NO: 380344 - DNA, 23 bp, Artificial Sequence
  Description of Artificial Sequence: Synthetic oligonucleotide
ctccgagggccgcgtctgcattg

SEQ ID NO: 380345 - DNA, 23 bp, Artificial Sequence
  Description of Artificial Sequence: Synthetic oligonucleotide
tccgagggccgcgtctgcattgg

SEQ ID NO: 380346 - DNA, 22 bp, Artificial Sequence
  Description of Artificial Sequence: Synthetic oligonucleotide
ccgagggccgcgtctgcattgg

SEQ ID NO: 380347 - DNA, 22 bp, Artificial Sequence
  Description of Artificial Sequence: Synthetic oligonucleotide
cgagggccgcgtctgcattggg

SEQ ID NO: 380348 - DNA, 23 bp, Artificial Sequence
  Description of Artificial Sequence: Synthetic oligonucleotide
gagggccgcgtctgcattgggga

SEQ ID NO: 380349 - DNA, 23 bp, Artificial Sequence
  Description of Artificial Sequence: Synthetic oligonucleotide
agggccgcgtctgcattggggag

SEQ ID NO: 380350 - DNA, 22 bp, Artificial Sequence
  Description of Artificial Sequence: Synthetic oligonucleotide
gggccgcgtctgcattggggag

SEQ ID NO: 380351 - DNA, 22 bp, Artificial Sequence
  Description of Artificial Sequence: Synthetic oligonucleotide
ggccgcgtctgcattggggagg

SEQ ID NO: 380352 - DNA, 22 bp, Artificial Sequence
  Description of Artificial Sequence: Synthetic oligonucleotide
gccgcgtctgcattggggaggc

SEQ ID NO: 380353 - DNA, 22 bp, Artificial Sequence
  Description of Artificial Sequence: Synthetic oligonucleotide
ccgcgtctgcattggggaggcg

SEQ ID NO: 380354 - DNA, 23 bp, Artificial Sequence
  Description of Artificial Sequence: Synthetic oligonucleotide
cgcgtctgcattggggaggcgca

SEQ ID NO: 380355 - DNA, 23 bp, Artificial Sequence
  Description of Artificial Sequence: Synthetic oligonucleotide
gcgtctgcattggggaggcgcag

SEQ ID NO: 380356 - DNA, 23 bp, Artificial Sequence
  Description of Artificial Sequence: Synthetic oligonucleotide
cgtctgcattggggaggcgcagc

SEQ ID NO: 380357 - DNA, 27 bp, Artificial Sequence
  Description of Artificial Sequence: Synthetic oligonucleotide
cacccggactcagagtctcctcagaca

SEQ ID NO: 380358 - DNA, 27 bp, Artificial Sequence
  Description of Artificial Sequence: Synthetic oligonucleotide
acccggactcagagtctcctcagacac

SEQ ID NO: 380359 - DNA, 26 bp, Artificial Sequence
  Description of Artificial Sequence: Synthetic oligonucleotide
cccggactcagagtctcctcagacac

SEQ ID NO: 380360 - DNA, 26 bp, Artificial Sequence
  Description of Artificial Sequence: Synthetic oligonucleotide
ccggactcagagtctcctcagacacc

SEQ ID NO: 380361 - DNA, 27 bp, Artificial Sequence
  Description of Artificial Sequence: Synthetic oligonucleotide
cggactcagagtctcctcagacaccga

SEQ ID NO: 380362 - DNA, 27 bp, Artificial Sequence
  Description of Artificial Sequence: Synthetic oligonucleotide
ggactcagagtctcctcagacaccgag

SEQ ID NO: 380363 - DNA, 29 bp, Artificial Sequence
  Description of Artificial Sequence: Synthetic oligonucleotide
gactcagagtctcctcagacaccgagatg

SEQ ID NO: 380364 - DNA, 29 bp, Artificial Sequence
  Description of Artificial Sequence: Synthetic oligonucleotide
actcagagtctcctcagacaccgagatgc

SEQ ID NO: 380365 - DNA, 28 bp, Artificial Sequence
  Description of Artificial Sequence: Synthetic oligonucleotide
ctcagagtctcctcagacaccgagatgc

SEQ ID NO: 380366 - DNA, 28 bp, Artificial Sequence
  Description of Artificial Sequence: Synthetic oligonucleotide
tcagagtctcctcagacaccgagatgcg

SEQ ID NO: 380367 - DNA, 27 bp, Artificial Sequence
  Description of Artificial Sequence: Synthetic oligonucleotide
cagagtctcctcagacaccgagatgcg

SEQ ID NO: 380368 - DNA, 27 bp, Artificial Sequence
  Description of Artificial Sequence: Synthetic oligonucleotide
agagtctcctcagacaccgagatgcgg

SEQ ID NO: 380369 - DNA, 26 bp, Artificial Sequence
  Description of Artificial Sequence: Synthetic oligonucleotide
gagtctcctcagacaccgagatgcgg

SEQ ID NO: 380370 - DNA, 27 bp, Artificial Sequence
  Description of Artificial Sequence: Synthetic oligonucleotide
agtctcctcagacaccgagatgcgggt

SEQ ID NO: 380371 - DNA, 26 bp, Artificial Sequence
  Description of Artificial Sequence: Synthetic oligonucleotide
gtctcctcagacaccgagatgcgggt

SEQ ID NO: 380372 - DNA, 27 bp, Artificial Sequence
  Description of Artificial Sequence: Synthetic oligonucleotide
tctcctcagacaccgagatgcgggtca

SEQ ID NO: 380373 - DNA, 26 bp, Artificial Sequence
  Description of Artificial Sequence: Synthetic oligonucleotide
ctcctcagacaccgagatgcgggtca

SEQ ID NO: 380374 - DNA, 26 bp, Artificial Sequence
  Description of Artificial Sequence: Synthetic oligonucleotide
tcctcagacaccgagatgcgggtcac

SEQ ID NO: 380375 - DNA, 25 bp, Artificial Sequence
  Description of Artificial Sequence: Synthetic oligonucleotide
cctcagacaccgagatgcgggtcac

SEQ ID NO: 380376 - DNA, 25 bp, Artificial Sequence
  Description of Artificial Sequence: Synthetic oligonucleotide
ctcagacaccgagatgcgggtcacg

SEQ ID NO: 380377 - DNA, 25 bp, Artificial Sequence
  Description of Artificial Sequence: Synthetic oligonucleotide
tcagacaccgagatgcgggtcacgg

SEQ ID NO: 380378 - DNA, 24 bp, Artificial Sequence
  Description of Artificial Sequence: Synthetic oligonucleotide
cagacaccgagatgcgggtcacgg

SEQ ID NO: 380379 - DNA, 25 bp, Artificial Sequence
  Description of Artificial Sequence: Synthetic oligonucleotide
agacaccgagatgcgggtcacggca

SEQ ID NO: 380380 - DNA, 24 bp, Artificial Sequence
  Description of Artificial Sequence: Synthetic oligonucleotide
gacaccgagatgcgggtcacggca

SEQ ID NO: 380381 - DNA, 24 bp, Artificial Sequence
  Description of Artificial Sequence: Synthetic oligonucleotide
acaccgagatgcgggtcacggcac

SEQ ID NO: 380382 - DNA, 23 bp, Artificial Sequence
  Description of Artificial Sequence: Synthetic oligonucleotide
caccgagatgcgggtcacggcac

SEQ ID NO: 380383 - DNA, 23 bp, Artificial Sequence
  Description of Artificial Sequence: Synthetic oligonucleotide
accgagatgcgggtcacggcacc

SEQ ID NO: 380384 - DNA, 22 bp, Artificial Sequence
  Description of Artificial Sequence: Synthetic oligonucleotide
tcctcctgctgctctggggggc

SEQ ID NO: 380385 - DNA, 21 bp, Artificial Sequence
  Description of Artificial Sequence: Synthetic oligonucleotide
cctcctgctgctctggggggc

SEQ ID NO: 380386 - DNA, 21 bp, Artificial Sequence
  Description of Artificial Sequence: Synthetic oligonucleotide
ctcctgctgctctggggggcc

SEQ ID NO: 380387 - DNA, 22 bp, Artificial Sequence
  Description of Artificial Sequence: Synthetic oligonucleotide
tcctgctgctctggggggccct

SEQ ID NO: 380388 - DNA, 21 bp, Artificial Sequence
  Description of Artificial Sequence: Synthetic oligonucleotide
cctgctgctctggggggccct

SEQ ID NO: 380389 - DNA, 21 bp, Artificial Sequence
  Description of Artificial Sequence: Synthetic oligonucleotide
ctgctgctctggggggccctg

SEQ ID NO: 380390 - DNA, 21 bp, Artificial Sequence
  Description of Artificial Sequence: Synthetic oligonucleotide
tgctgctctggggggccctgg

SEQ ID NO: 380391 - DNA, 20 bp, Artificial Sequence
  Description of Artificial Sequence: Synthetic oligonucleotide
gctgctctggggggccctgg

SEQ ID NO: 380392 - DNA, 20 bp, Artificial Sequence
  Description of Artificial Sequence: Synthetic oligonucleotide
ctgctctggggggccctggc

SEQ ID NO: 380393 - DNA, 20 bp, Artificial Sequence
  Description of Artificial Sequence: Synthetic oligonucleotide
tgctctggggggccctggcc

SEQ ID NO: 380394 - DNA, 20 bp, Artificial Sequence
  Description of Artificial Sequence: Synthetic oligonucleotide
gctctggggggccctggcct

SEQ ID NO: 380395 - DNA, 20 bp, Artificial Sequence
  Description of Artificial Sequence: Synthetic oligonucleotide
ctctggggggccctggccct

SEQ ID NO: 380396 - DNA, 21 bp, Artificial Sequence
  Description of Artificial Sequence: Synthetic oligonucleotide
tctggggggccctggccctga

SEQ ID NO: 380397 - DNA, 20 bp, Artificial Sequence
  Description of Artificial Sequence: Synthetic oligonucleotide
ctggggggccctggccctga

SEQ ID NO: 380398 - DNA, 20 bp, Artificial Sequence
  Description of Artificial Sequence: Synthetic oligonucleotide
tggggggccctggccctgac

SEQ ID NO: 380399 - DNA, 20 bp, Artificial Sequence
  Description of Artificial Sequence: Synthetic oligonucleotide
ggggggccctggccctgact

SEQ ID NO: 380400 - DNA, 20 bp, Artificial Sequence
  Description of Artificial Sequence: Synthetic oligonucleotide
ggggccctggccctgaccga

SEQ ID NO: 380401 - DNA, 21 bp, Artificial Sequence
  Description of Artificial Sequence: Synthetic oligonucleotide
gggccctggccctgaccgaga

SEQ ID NO: 380402 - DNA, 31 bp, Artificial Sequence; identical to SEQ ID NO: 39596
  Description of Artificial Sequence: Synthetic oligonucleotide

SEQ ID NO: 380403 - DNA, 31 bp, Artificial Sequence; identical to SEQ ID NO: 39597
  Description of Artificial Sequence: Synthetic oligonucleotide

SEQ ID NO: 380404 - DNA, 33 bp, Artificial Sequence; identical to SEQ ID NO: 39598
  Description of Artificial Sequence: Synthetic oligonucleotide

SEQ ID NO: 380405 - DNA, 32 bp, Artificial Sequence; identical to SEQ ID NO: 39599
  Description of Artificial Sequence: Synthetic oligonucleotide

SEQ ID NO: 380406 - DNA, 33 bp, Artificial Sequence; identical to SEQ ID NO: 39600
  Description of Artificial Sequence: Synthetic oligonucleotide

SEQ ID NO: 380407 - DNA, 33 bp, Artificial Sequence; identical to SEQ ID NO: 39601
  Description of Artificial Sequence: Synthetic oligonucleotide

SEQ ID NO: 380408 - DNA, 33 bp, Artificial Sequence; identical to SEQ ID NO: 39602
  Description of Artificial Sequence: Synthetic oligonucleotide

SEQ ID NO: 380409 - DNA, 32 bp, Artificial Sequence; identical to SEQ ID NO: 39603
  Description of Artificial Sequence: Synthetic oligonucleotide

SEQ ID NO: 380410 - DNA, 32 bp, Artificial Sequence; identical to SEQ ID NO: 39604
  Description of Artificial Sequence: Synthetic oligonucleotide

SEQ ID NO: 380411 - DNA, 31 bp, Artificial Sequence; identical to SEQ ID NO: 39605
  Description of Artificial Sequence: Synthetic oligonucleotide

SEQ ID NO: 380412 - DNA, 31 bp, Artificial Sequence; identical to SEQ ID NO: 39606
  Description of Artificial Sequence: Synthetic oligonucleotide

SEQ ID NO: 380413 - DNA, 27 bp, Artificial Sequence
  Description of Artificial Sequence: Synthetic oligonucleotide
gacactgagcttgtggagaccagaccg

SEQ ID NO: 380414 - DNA, 27 bp, Artificial Sequence
  Description of Artificial Sequence: Synthetic oligonucleotide
acactgagcttgtggagaccagaccgg

SEQ ID NO: 380415 - DNA, 26 bp, Artificial Sequence
  Description of Artificial Sequence: Synthetic oligonucleotide
cactgagcttgtggagaccagaccgg

SEQ ID NO: 380416 - DNA, 27 bp, Artificial Sequence
  Description of Artificial Sequence: Synthetic oligonucleotide
actgagcttgtggagaccagaccggca

SEQ ID NO: 380417 - DNA, 26 bp, Artificial Sequence
  Description of Artificial Sequence: Synthetic oligonucleotide
ctgagcttgtggagaccagaccggca

SEQ ID NO: 380418 - DNA, 26 bp, Artificial Sequence
  Description of Artificial Sequence: Synthetic oligonucleotide
tgagcttgtggagaccagaccggcag

SEQ ID NO: 380419 - DNA, 25 bp, Artificial Sequence
  Description of Artificial Sequence: Synthetic oligonucleotide
gagcttgtggagaccagaccggcag

SEQ ID NO: 380420 - DNA, 26 bp, Artificial Sequence
  Description of Artificial Sequence: Synthetic oligonucleotide
agcttgtggagaccagaccggcagga

SEQ ID NO: 380421 - DNA, 25 bp, Artificial Sequence
  Description of Artificial Sequence: Synthetic oligonucleotide
gcttgtggagaccagaccggcagga

SEQ ID NO: 380422 - DNA, 27 bp, Artificial Sequence
  Description of Artificial Sequence: Synthetic oligonucleotide
cttgtggagaccagaccggcaggagat

SEQ ID NO: 380423 - DNA, 28 bp, Artificial Sequence
  Description of Artificial Sequence: Synthetic oligonucleotide
ttgtggagaccagaccggcaggagatag

SEQ ID NO: 380424 - DNA, 27 bp, Artificial Sequence
  Description of Artificial Sequence: Synthetic oligonucleotide
tgtggagaccagaccggcaggagatag

SEQ ID NO: 380425 - DNA, 27 bp, Artificial Sequence
  Description of Artificial Sequence: Synthetic oligonucleotide
gtggagaccagaccggcaggagataga

SEQ ID NO: 380426 - DNA, 28 bp, Artificial Sequence
  Description of Artificial Sequence: Synthetic oligonucleotide
tggagaccagaccggcaggagatagaac

SEQ ID NO: 380427 - DNA, 27 bp, Artificial Sequence
  Description of Artificial Sequence: Synthetic oligonucleotide
ggagaccagaccggcaggagatagaac

SEQ ID NO: 380428 - DNA, 27 bp, Artificial Sequence
  Description of Artificial Sequence: Synthetic oligonucleotide
gagaccagaccggcaggagatagaacc

SEQ ID NO: 380429 - DNA, 29 bp, Artificial Sequence
  Description of Artificial Sequence: Synthetic oligonucleotide
agaccagaccggcaggagatagaaccttc

SEQ ID NO: 380430 - DNA, 28 bp, Artificial Sequence
  Description of Artificial Sequence: Synthetic oligonucleotide
gaccagaccggcaggagatagaaccttc

SEQ ID NO: 380431 - DNA, 28 bp, Artificial Sequence
  Description of Artificial Sequence: Synthetic oligonucleotide
accagaccggcaggagatagaaccttcc

SEQ ID NO: 380432 - DNA, 27 bp, Artificial Sequence
  Description of Artificial Sequence: Synthetic oligonucleotide
ccagaccggcaggagatagaaccttcc

SEQ ID NO: 380433 - DNA, 28 bp, Artificial Sequence
  Description of Artificial Sequence: Synthetic oligonucleotide
cagaccggcaggagatagaaccttccag

SEQ ID NO: 380434 - DNA, 30 bp, Artificial Sequence; identical to SEQ ID NO: 39628
  Description of Artificial Sequence: Synthetic oligonucleotide

SEQ ID NO: 380435 - DNA, 29 bp, Artificial Sequence
  Description of Artificial Sequence: Synthetic oligonucleotide
gaccggcaggagatagaaccttccagaag

SEQ ID NO: 380436 - DNA, 30 bp, Artificial Sequence; identical to SEQ ID NO: 39630
  Description of Artificial Sequence: Synthetic oligonucleotide

SEQ ID NO: 380437 - DNA, 29 bp, Artificial Sequence
  Description of Artificial Sequence: Synthetic oligonucleotide
ccggcaggagatagaaccttccagaagtg

SEQ ID NO: 380438 - DNA, 29 bp, Artificial Sequence
  Description of Artificial Sequence: Synthetic oligonucleotide
cggcaggagatagaaccttccagaagtgg

SEQ ID NO: 380439 - DNA, 29 bp, Artificial Sequence
  Description of Artificial Sequence: Synthetic oligonucleotide
ggcaggagatagaaccttccagaagtggg

SEQ ID NO: 380440 - DNA, 30 bp, Artificial Sequence; identical to SEQ ID NO: 39634
  Description of Artificial Sequence: Synthetic oligonucleotide

SEQ ID NO: 380441 - DNA, 34 bp, Artificial Sequence; identical to SEQ ID NO: 39635
  Description of Artificial Sequence: Synthetic oligonucleotide

SEQ ID NO: 380442 - DNA, 36 bp, Artificial Sequence; identical to SEQ ID NO: 39636
  Description of Artificial Sequence: Synthetic oligonucleotide

SEQ ID NO: 380443 - DNA, 36 bp, Artificial Sequence; identical to SEQ ID NO: 39637
  Description of Artificial Sequence: Synthetic oligonucleotide

SEQ ID NO: 380444 - DNA, 35 bp, Artificial Sequence; identical to SEQ ID NO: 39638
  Description of Artificial Sequence: Synthetic oligonucleotide

SEQ ID NO: 380445 - DNA, 34 bp, Artificial Sequence; identical to SEQ ID NO: 39639
  Description of Artificial Sequence: Synthetic oligonucleotide

SEQ ID NO: 380446 - DNA, 33 bp, Artificial Sequence; identical to SEQ ID NO: 39640
  Description of Artificial Sequence: Synthetic oligonucleotide

SEQ ID NO: 380447 - DNA, 32 bp, Artificial Sequence; identical to SEQ ID NO: 39641
  Description of Artificial Sequence: Synthetic oligonucleotide

SEQ ID NO: 380448 - DNA, 32 bp, Artificial Sequence; identical to SEQ ID NO: 39642
  Description of Artificial Sequence: Synthetic oligonucleotide

SEQ ID NO: 380449 - DNA, 32 bp, Artificial Sequence; identical to SEQ ID NO: 39643
  Description of Artificial Sequence: Synthetic oligonucleotide

SEQ ID NO: 380450 - DNA, 31 bp, Artificial Sequence; identical to SEQ ID NO: 39644
  Description of Artificial Sequence: Synthetic oligonucleotide

SEQ ID NO: 380451 - DNA, 31 bp, Artificial Sequence; identical to SEQ ID NO: 39645
  Description of Artificial Sequence: Synthetic oligonucleotide

SEQ ID NO: 380452 - DNA, 30 bp, Artificial Sequence; identical to SEQ ID NO: 39646
  Description of Artificial Sequence: Synthetic oligonucleotide

SEQ ID NO: 380453 - DNA, 29 bp, Artificial Sequence
  Description of Artificial Sequence: Synthetic oligonucleotide
agcctacgacggcaaagattacatcgccc

SEQ ID NO: 380454 - DNA, 26 bp, Artificial Sequence
  Description of Artificial Sequence: Synthetic oligonucleotide
agaacgggaaagagacgctgcagcgc

SEQ ID NO: 380455 - DNA, 25 bp, Artificial Sequence
  Description of Artificial Sequence: Synthetic oligonucleotide
gaacgggaaagagacgctgcagcgc

SEQ ID NO: 380456 - DNA, 25 bp, Artificial Sequence
  Description of Artificial Sequence: Synthetic oligonucleotide
aacgggaaagagacgctgcagcgcg

SEQ ID NO: 380457 - DNA, 24 bp, Artificial Sequence
  Description of Artificial Sequence: Synthetic oligonucleotide
acgggaaagagacgctgcagcgcg

SEQ ID NO: 380458 - DNA, 23 bp, Artificial Sequence
  Description of Artificial Sequence: Synthetic oligonucleotide
cgggaaagagacgctgcagcgcg

SEQ ID NO: 380459 - DNA, 23 bp, Artificial Sequence
  Description of Artificial Sequence: Synthetic oligonucleotide
gggaaagagacgctgcagcgcgc

SEQ ID NO: 380460 - DNA, 23 bp, Artificial Sequence
  Description of Artificial Sequence: Synthetic oligonucleotide
ggaaagagacgctgcagcgcgcg

SEQ ID NO: 380461 - DNA, 23 bp, Artificial Sequence
  Description of Artificial Sequence: Synthetic oligonucleotide
gaaagagacgctgcagcgcgcgg

SEQ ID NO: 380462 - DNA, 30 bp, Artificial Sequence; identical to SEQ ID NO: 39660
  Description of Artificial Sequence: Synthetic oligonucleotide

SEQ ID NO: 380463 - DNA, 29 bp, Artificial Sequence
  Description of Artificial Sequence: Synthetic oligonucleotide
cacttggcagacgatgtatggctgtgacc

SEQ ID NO: 380464 - DNA, 30 bp, Artificial Sequence; identical to SEQ ID NO: 39662
  Description of Artificial Sequence: Synthetic oligonucleotide

SEQ ID NO: 380465 - DNA, 29 bp, Artificial Sequence
  Description of Artificial Sequence: Synthetic oligonucleotide
cttggcagacgatgtatggctgtgacctg

SEQ ID NO: 380466 - DNA, 29 bp, Artificial Sequence
  Description of Artificial Sequence: Synthetic oligonucleotide
ttggcagacgatgtatggctgtgacctgg

SEQ ID NO: 380467 - DNA, 28 bp, Artificial Sequence
  Description of Artificial Sequence: Synthetic oligonucleotide
tggcagacgatgtatggctgtgacctgg

SEQ ID NO: 380468 - DNA, 27 bp, Artificial Sequence
  Description of Artificial Sequence: Synthetic oligonucleotide
ggcagacgatgtatggctgtgacctgg

SEQ ID NO: 380469 - DNA, 27 bp, Artificial Sequence
  Description of Artificial Sequence: Synthetic oligonucleotide
gcagacgatgtatggctgtgacctggg

SEQ ID NO: 380470 - DNA, 27 bp, Artificial Sequence
  Description of Artificial Sequence: Synthetic oligonucleotide
cagacgatgtatggctgtgacctgggg

SEQ ID NO: 380471 - DNA, 27 bp, Artificial Sequence
  Description of Artificial Sequence: Synthetic oligonucleotide
agacgatgtatggctgtgacctggggc

SEQ ID NO: 380472 - DNA, 26 bp, Artificial Sequence
  Description of Artificial Sequence: Synthetic oligonucleotide
gacgatgtatggctgtgacctggggc

SEQ ID NO: 380473 - DNA, 26 bp, Artificial Sequence
  Description of Artificial Sequence: Synthetic oligonucleotide
acgatgtatggctgtgacctggggcc

SEQ ID NO: 380474 - DNA, 25 bp, Artificial Sequence
  Description of Artificial Sequence: Synthetic oligonucleotide
cgatgtatggctgtgacctggggcc

SEQ ID NO: 380475 - DNA, 25 bp, Artificial Sequence
  Description of Artificial Sequence: Synthetic oligonucleotide
gatgtatggctgtgacctggggccg

SEQ ID NO: 380476 - DNA, 26 bp, Artificial Sequence
  Description of Artificial Sequence: Synthetic oligonucleotide
atgtatggctgtgacctggggccgga

SEQ ID NO: 380477 - DNA, 25 bp, Artificial Sequence
  Description of Artificial Sequence: Synthetic oligonucleotide
tgtatggctgtgacctggggccgga

SEQ ID NO: 380478 - DNA, 24 bp, Artificial Sequence
  Description of Artificial Sequence: Synthetic oligonucleotide
gtatggctgtgacctggggccgga

SEQ ID NO: 380479 - DNA, 24 bp, Artificial Sequence
  Description of Artificial Sequence: Synthetic oligonucleotide
tatggctgtgacctggggccggac

SEQ ID NO: 380480 - DNA, 23 bp, Artificial Sequence
  Description of Artificial Sequence: Synthetic oligonucleotide
atggctgtgacctggggccggac

SEQ ID NO: 380481 - DNA, 22 bp, Artificial Sequence
  Description of Artificial Sequence: Synthetic oligonucleotide
tggctgtgacctggggccggac

SEQ ID NO: 380482 - DNA, 21 bp, Artificial Sequence
  Description of Artificial Sequence: Synthetic oligonucleotide
ggctgtgacctggggccggac

SEQ ID NO: 380483 - DNA, 21 bp, Artificial Sequence
  Description of Artificial Sequence: Synthetic oligonucleotide
gctgtgacctggggccggacg

SEQ ID NO: 380484 - DNA, 21 bp, Artificial Sequence
  Description of Artificial Sequence: Synthetic oligonucleotide
ctgtgacctggggccggacgg

SEQ ID NO: 380485 - DNA, 21 bp, Artificial Sequence
  Description of Artificial Sequence: Synthetic oligonucleotide
tgtgacctggggccggacggg

SEQ ID NO: 380486 - DNA, 20 bp, Artificial Sequence
  Description of Artificial Sequence: Synthetic oligonucleotide
gtgacctggggccggacggg

SEQ ID NO: 380487 - DNA, 20 bp, Artificial Sequence
  Description of Artificial Sequence: Synthetic oligonucleotide
tgacctggggccggacgggc

SEQ ID NO: 380488 - DNA, 24 bp, Artificial Sequence
  Description of Artificial Sequence: Synthetic oligonucleotide
agagcgaggccgggtctcacacgt

SEQ ID NO: 380489 - DNA, 23 bp, Artificial Sequence
  Description of Artificial Sequence: Synthetic oligonucleotide
gagcgaggccgggtctcacacgt

SEQ ID NO: 380490 - DNA, 23 bp, Artificial Sequence
  Description of Artificial Sequence: Synthetic oligonucleotide
agcgaggccgggtctcacacgtg

SEQ ID NO: 380491 - DNA, 22 bp, Artificial Sequence
  Description of Artificial Sequence: Synthetic oligonucleotide
gcgaggccgggtctcacacgtg

SEQ ID NO: 380492 - DNA, 22 bp, Artificial Sequence
  Description of Artificial Sequence: Synthetic oligonucleotide
cgaggccgggtctcacacgtgg

SEQ ID NO: 380493 - DNA, 23 bp, Artificial Sequence
  Description of Artificial Sequence: Synthetic oligonucleotide
gaggccgggtctcacacgtggca

SEQ ID NO: 380494 - DNA, 24 bp, Artificial Sequence
  Description of Artificial Sequence: Synthetic oligonucleotide
aggccgggtctcacacgtggcaga

SEQ ID NO: 380495 - DNA, 23 bp, Artificial Sequence
  Description of Artificial Sequence: Synthetic oligonucleotide
ggccgggtctcacacgtggcaga

SEQ ID NO: 380496 - DNA, 23 bp, Artificial Sequence
  Description of Artificial Sequence: Synthetic oligonucleotide
gccgggtctcacacgtggcagac

SEQ ID NO: 380497 - DNA, 25 bp, Artificial Sequence
  Description of Artificial Sequence: Synthetic oligonucleotide
ccgggtctcacacgtggcagacgat

SEQ ID NO: 380498 - DNA, 27 bp, Artificial Sequence
  Description of Artificial Sequence: Synthetic oligonucleotide
cgggtctcacacgtggcagacgatgta

SEQ ID NO: 380499 - DNA, 28 bp, Artificial Sequence
  Description of Artificial Sequence: Synthetic oligonucleotide
gggtctcacacgtggcagacgatgtatg

SEQ ID NO: 380500 - DNA, 28 bp, Artificial Sequence
  Description of Artificial Sequence: Synthetic oligonucleotide
ggtctcacacgtggcagacgatgtatgg

SEQ ID NO: 380501 - DNA, 28 bp, Artificial Sequence
  Description of Artificial Sequence: Synthetic oligonucleotide
gtctcacacgtggcagacgatgtatggc

SEQ ID NO: 380502 - DNA, 29 bp, Artificial Sequence
  Description of Artificial Sequence: Synthetic oligonucleotide
tctcacacgtggcagacgatgtatggctg

SEQ ID NO: 380503 - DNA, 28 bp, Artificial Sequence
  Description of Artificial Sequence: Synthetic oligonucleotide
ctcacacgtggcagacgatgtatggctg

SEQ ID NO: 380504 - DNA, 28 bp, Artificial Sequence
  Description of Artificial Sequence: Synthetic oligonucleotide
tcacacgtggcagacgatgtatggctgc

SEQ ID NO: 380505 - DNA, 27 bp, Artificial Sequence
  Description of Artificial Sequence: Synthetic oligonucleotide
cacacgtggcagacgatgtatggctgc

SEQ ID NO: 380506 - DNA, 27 bp, Artificial Sequence
  Description of Artificial Sequence: Synthetic oligonucleotide
acacgtggcagacgatgtatggctgcg

SEQ ID NO: 380507 - DNA, 27 bp, Artificial Sequence
  Description of Artificial Sequence: Synthetic oligonucleotide
cacgtggcagacgatgtatggctgcga

SEQ ID NO: 380508 - DNA, 27 bp, Artificial Sequence
  Description of Artificial Sequence: Synthetic oligonucleotide
acgtggcagacgatgtatggctgcgac

SEQ ID NO: 380509 - DNA, 26 bp, Artificial Sequence
  Description of Artificial Sequence: Synthetic oligonucleotide
cgtggcagacgatgtatggctgcgac

SEQ ID NO: 380510 - DNA, 27 bp, Artificial Sequence
  Description of Artificial Sequence: Synthetic oligonucleotide
gtggcagacgatgtatggctgcgacct

SEQ ID NO: 380511 - DNA, 27 bp, Artificial Sequence
  Description of Artificial Sequence: Synthetic oligonucleotide
ttggcagacgatgtacggctgcgacct

SEQ ID NO: 380512 - DNA, 26 bp, Artificial Sequence
  Description of Artificial Sequence: Synthetic oligonucleotide
tggcagacgatgtacggctgcgacct

SEQ ID NO: 380513 - DNA, 25 bp, Artificial Sequence
  Description of Artificial Sequence: Synthetic oligonucleotide
ggcagacgatgtacggctgcgacct

SEQ ID NO: 380514 - DNA, 25 bp, Artificial Sequence
  Description of Artificial Sequence: Synthetic oligonucleotide
gcagacgatgtacggctgcgacctg

SEQ ID NO: 380515 - DNA, 25 bp, Artificial Sequence
  Description of Artificial Sequence: Synthetic oligonucleotide
cagacgatgtacggctgcgacctgg

SEQ ID NO: 380516 - DNA, 25 bp, Artificial Sequence
  Description of Artificial Sequence: Synthetic oligonucleotide
agacgatgtacggctgcgacctggg

SEQ ID NO: 380517 - DNA, 24 bp, Artificial Sequence
  Description of Artificial Sequence: Synthetic oligonucleotide
gacgatgtacggctgcgacctggg

SEQ ID NO: 380518 - DNA, 24 bp, Artificial Sequence
  Description of Artificial Sequence: Synthetic oligonucleotide
acgatgtacggctgcgacctgggg

SEQ ID NO: 380519 - DNA, 23 bp, Artificial Sequence
  Description of Artificial Sequence: Synthetic oligonucleotide
cgatgtacggctgcgacctgggg

SEQ ID NO: 380520 - DNA, 26 bp, Artificial Sequence
  Description of Artificial Sequence: Synthetic oligonucleotide
gcggctactacaaccagagcgaggca

SEQ ID NO: 380521 - DNA, 26 bp, Artificial Sequence
  Description of Artificial Sequence: Synthetic oligonucleotide
cggctactacaaccagagcgaggcag

SEQ ID NO: 380522 - DNA, 26 bp, Artificial Sequence
  Description of Artificial Sequence: Synthetic oligonucleotide
ggctactacaaccagagcgaggcagg

SEQ ID NO: 380523 - DNA, 27 bp, Artificial Sequence
  Description of Artificial Sequence: Synthetic oligonucleotide
gctactacaaccagagcgaggcagggt

SEQ ID NO: 380524 - DNA, 27 bp, Artificial Sequence
  Description of Artificial Sequence: Synthetic oligonucleotide
ctactacaaccagagcgaggcagggtc

SEQ ID NO: 380525 - DNA, 28 bp, Artificial Sequence
  Description of Artificial Sequence: Synthetic oligonucleotide
tactacaaccagagcgaggcagggtctc

SEQ ID NO: 380526 - DNA, 27 bp, Artificial Sequence
  Description of Artificial Sequence: Synthetic oligonucleotide
actacaaccagagcgaggcagggtctc

SEQ ID NO: 380527 - DNA, 27 bp, Artificial Sequence
  Description of Artificial Sequence: Synthetic oligonucleotide
ctacaaccagagcgaggcagggtctca

SEQ ID NO: 380528 - DNA, 27 bp, Artificial Sequence
  Description of Artificial Sequence: Synthetic oligonucleotide
tacaaccagagcgaggcagggtctcac

SEQ ID NO: 380529 - DNA, 27 bp, Artificial Sequence
  Description of Artificial Sequence: Synthetic oligonucleotide
acaaccagagcgaggcagggtctcaca

SEQ ID NO: 380530 - DNA, 26 bp, Artificial Sequence
  Description of Artificial Sequence: Synthetic oligonucleotide
caaccagagcgaggcagggtctcaca

SEQ ID NO: 380531 - DNA, 27 bp, Artificial Sequence
  Description of Artificial Sequence: Synthetic oligonucleotide
aaccagagcgaggcagggtctcacact

SEQ ID NO: 380532 - DNA, 27 bp, Artificial Sequence
  Description of Artificial Sequence: Synthetic oligonucleotide
accagagcgaggcagggtctcacactt

SEQ ID NO: 380533 - DNA, 26 bp, Artificial Sequence
  Description of Artificial Sequence: Synthetic oligonucleotide
ccagagcgaggcagggtctcacactt

SEQ ID NO: 380534 - DNA, 26 bp, Artificial Sequence
  Description of Artificial Sequence: Synthetic oligonucleotide
cagagcgaggcagggtctcacacttg

SEQ ID NO: 380535 - DNA, 26 bp, Artificial Sequence
  Description of Artificial Sequence: Synthetic oligonucleotide
agagcgaggcagggtctcacacttgg

SEQ ID NO: 380536 - DNA, 25 bp, Artificial Sequence
  Description of Artificial Sequence: Synthetic oligonucleotide
gagcgaggcagggtctcacacttgg

SEQ ID NO: 380537 - DNA, 26 bp, Artificial Sequence
  Description of Artificial Sequence: Synthetic oligonucleotide
agcgaggcagggtctcacacttggca

SEQ ID NO: 380538 - DNA, 25 bp, Artificial Sequence
  Description of Artificial Sequence: Synthetic oligonucleotide
gcgaggcagggtctcacacttggca

SEQ ID NO: 380539 - DNA, 26 bp, Artificial Sequence
  Description of Artificial Sequence: Synthetic oligonucleotide
cgaggcagggtctcacacttggcaga

SEQ ID NO: 380540 - DNA, 26 bp, Artificial Sequence
  Description of Artificial Sequence: Synthetic oligonucleotide
gaggcagggtctcacacttggcagac

SEQ ID NO: 380541 - DNA, 27 bp, Artificial Sequence
  Description of Artificial Sequence: Synthetic oligonucleotide
aggcagggtctcacacttggcagacga

SEQ ID NO: 380542 - DNA, 27 bp, Artificial Sequence
  Description of Artificial Sequence: Synthetic oligonucleotide
ggcagggtctcacacttggcagacgat

SEQ ID NO: 380543 - DNA, 27 bp, Artificial Sequence
  Description of Artificial Sequence: Synthetic oligonucleotide
gcagggtctcacacttggcagacgatg

SEQ ID NO: 380544 - DNA, 30 bp, Artificial Sequence; identical to SEQ ID NO: 39710
  Description of Artificial Sequence: Synthetic oligonucleotide

SEQ ID NO: 380545 - DNA, 30 bp, Artificial Sequence; identical to SEQ ID NO: 39711
  Description of Artificial Sequence: Synthetic oligonucleotide

SEQ ID NO: 380546 - DNA, 28 bp, Artificial Sequence
  Description of Artificial Sequence: Synthetic oligonucleotide
acagactgaccgagagaacctgcggaac

SEQ ID NO: 380547 - DNA, 27 bp, Artificial Sequence
  Description of Artificial Sequence: Synthetic oligonucleotide
cagactgaccgagagaacctgcggaac

SEQ ID NO: 380548 - DNA, 27 bp, Artificial Sequence
  Description of Artificial Sequence: Synthetic oligonucleotide
agactgaccgagagaacctgcggaacc

SEQ ID NO: 380549 - DNA, 27 bp, Artificial Sequence
  Description of Artificial Sequence: Synthetic oligonucleotide
gactgaccgagagaacctgcggaacct

SEQ ID NO: 380550 - DNA, 27 bp, Artificial Sequence
  Description of Artificial Sequence: Synthetic oligonucleotide
actgaccgagagaacctgcggaacctg

SEQ ID NO: 380551 - DNA, 26 bp, Artificial Sequence
  Description of Artificial Sequence: Synthetic oligonucleotide
ctgaccgagagaacctgcggaacctg

SEQ ID NO: 380552 - DNA, 26 bp, Artificial Sequence
  Description of Artificial Sequence: Synthetic oligonucleotide
tgaccgagagaacctgcggaacctgc

SEQ ID NO: 380553 - DNA, 25 bp, Artificial Sequence
  Description of Artificial Sequence: Synthetic oligonucleotide
gaccgagagaacctgcggaacctgc

SEQ ID NO: 380554 - DNA, 25 bp, Artificial Sequence
  Description of Artificial Sequence: Synthetic oligonucleotide
gtgaggttcgacagcgacgccgcta

SEQ ID NO: 380555 - DNA, 26 bp, Artificial Sequence
  Description of Artificial Sequence: Synthetic oligonucleotide
tgaggttcgacagcgacgccgctagt

SEQ ID NO: 380556 - DNA, 25 bp, Artificial Sequence
  Description of Artificial Sequence: Synthetic oligonucleotide
gaggttcgacagcgacgccgctagt

SEQ ID NO: 380557 - DNA, 25 bp, Artificial Sequence
  Description of Artificial Sequence: Synthetic oligonucleotide
aggttcgacagcgacgccgctagtc

SEQ ID NO: 380558 - DNA, 24 bp, Artificial Sequence
  Description of Artificial Sequence: Synthetic oligonucleotide
ggttcgacagcgacgccgctagtc

SEQ ID NO: 380559 - DNA, 24 bp, Artificial Sequence
  Description of Artificial Sequence: Synthetic oligonucleotide
gttcgacagcgacgccgctagtcc

SEQ ID NO: 380560 - DNA, 25 bp, Artificial Sequence
  Description of Artificial Sequence: Synthetic oligonucleotide
ttcgacagcgacgccgctagtccga

SEQ ID NO: 380561 - DNA, 24 bp, Artificial Sequence
  Description of Artificial Sequence: Synthetic oligonucleotide
tcgacagcgacgccgctagtccga

SEQ ID NO: 380562 - DNA, 23 bp, Artificial Sequence
  Description of Artificial Sequence: Synthetic oligonucleotide
cgacagcgacgccgctagtccga

SEQ ID NO: 380563 - DNA, 24 bp, Artificial Sequence
  Description of Artificial Sequence: Synthetic oligonucleotide
gacagcgacgccgctagtccgaga

SEQ ID NO: 380564 - DNA, 25 bp, Artificial Sequence
  Description of Artificial Sequence: Synthetic oligonucleotide
acagcgacgccgctagtccgagaga

SEQ ID NO: 380565 - DNA, 24 bp, Artificial Sequence
  Description of Artificial Sequence: Synthetic oligonucleotide
cagcgacgccgctagtccgagaga

SEQ ID NO: 380566 - DNA, 24 bp, Artificial Sequence
  Description of Artificial Sequence: Synthetic oligonucleotide
agcgacgccgctagtccgagagag

SEQ ID NO: 380567 - DNA, 23 bp, Artificial Sequence
  Description of Artificial Sequence: Synthetic oligonucleotide
gcgacgccgctagtccgagagag

SEQ ID NO: 380568 - DNA, 24 bp, Artificial Sequence
  Description of Artificial Sequence: Synthetic oligonucleotide
cgacgccgctagtccgagagagga

SEQ ID NO: 380569 - DNA, 24 bp, Artificial Sequence
  Description of Artificial Sequence: Synthetic oligonucleotide
gacgccgctagtccgagagaggag

SEQ ID NO: 380570 - DNA, 24 bp, Artificial Sequence
  Description of Artificial Sequence: Synthetic oligonucleotide
acgccgctagtccgagagaggagc

SEQ ID NO: 380571 - DNA, 23 bp, Artificial Sequence
  Description of Artificial Sequence: Synthetic oligonucleotide
cgccgctagtccgagagaggagc

SEQ ID NO: 380572 - DNA, 23 bp, Artificial Sequence
  Description of Artificial Sequence: Synthetic oligonucleotide
gccgctagtccgagagaggagcc

SEQ ID NO: 380573 - DNA, 23 bp, Artificial Sequence
  Description of Artificial Sequence: Synthetic oligonucleotide
ccgctagtccgagagaggagccg

SEQ ID NO: 380574 - DNA, 23 bp, Artificial Sequence
  Description of Artificial Sequence: Synthetic oligonucleotide
cgctagtccgagagaggagccgc

SEQ ID NO: 380575 - DNA, 23 bp, Artificial Sequence
  Description of Artificial Sequence: Synthetic oligonucleotide
gctagtccgagagaggagccgcg

SEQ ID NO: 380576 - DNA, 23 bp, Artificial Sequence
  Description of Artificial Sequence: Synthetic oligonucleotide
ctagtccgagagaggagccgcgg

SEQ ID NO: 380577 - DNA, 23 bp, Artificial Sequence
  Description of Artificial Sequence: Synthetic oligonucleotide
tagtccgagagaggagccgcggg

SEQ ID NO: 380578 - DNA, 27 bp, Artificial Sequence
  Description of Artificial Sequence: Synthetic oligonucleotide
atcgccctgaacgaggacctgagctca

SEQ ID NO: 380579 - DNA, 27 bp, Artificial Sequence
  Description of Artificial Sequence: Synthetic oligonucleotide
tcgccctgaacgaggacctgagctcat

SEQ ID NO: 380580 - DNA, 26 bp, Artificial Sequence
  Description of Artificial Sequence: Synthetic oligonucleotide
cgccctgaacgaggacctgagctcat

SEQ ID NO: 380581 - DNA, 26 bp, Artificial Sequence
  Description of Artificial Sequence: Synthetic oligonucleotide
gccctgaacgaggacctgagctcatg

SEQ ID NO: 380582 - DNA, 27 bp, Artificial Sequence
  Description of Artificial Sequence: Synthetic oligonucleotide
ccctgaacgaggacctgagctcatgga

SEQ ID NO: 380583 - DNA, 27 bp, Artificial Sequence
  Description of Artificial Sequence: Synthetic oligonucleotide
cctgaacgaggacctgagctcatggac

SEQ ID NO: 380584 - DNA, 27 bp, Artificial Sequence
  Description of Artificial Sequence: Synthetic oligonucleotide
ctgaacgaggacctgagctcatggacc

SEQ ID NO: 380585 - DNA, 27 bp, Artificial Sequence
  Description of Artificial Sequence: Synthetic oligonucleotide
tgaacgaggacctgagctcatggaccg

SEQ ID NO: 380586 - DNA, 26 bp, Artificial Sequence
  Description of Artificial Sequence: Synthetic oligonucleotide
gaacgaggacctgagctcatggaccg

SEQ ID NO: 380587 - DNA, 26 bp, Artificial Sequence
  Description of Artificial Sequence: Synthetic oligonucleotide
aacgaggacctgagctcatggaccgc

SEQ ID NO: 380588 - DNA, 25 bp, Artificial Sequence
  Description of Artificial Sequence: Synthetic oligonucleotide
acgaggacctgagctcatggaccgc

SEQ ID NO: 380589 - DNA, 24 bp, Artificial Sequence
  Description of Artificial Sequence: Synthetic oligonucleotide
cgaggacctgagctcatggaccgc

SEQ ID NO: 380590 - DNA, 24 bp, Artificial Sequence
  Description of Artificial Sequence: Synthetic oligonucleotide
gaggacctgagctcatggaccgcg

SEQ ID NO: 380591 - DNA, 24 bp, Artificial Sequence
  Description of Artificial Sequence: Synthetic oligonucleotide
aggacctgagctcatggaccgcgg

SEQ ID NO: 380592 - DNA, 23 bp, Artificial Sequence
  Description of Artificial Sequence: Synthetic oligonucleotide
ggacctgagctcatggaccgcgg

SEQ ID NO: 380593 - DNA, 23 bp, Artificial Sequence
  Description of Artificial Sequence: Synthetic oligonucleotide
gacctgagctcatggaccgcggc

SEQ ID NO: 380594 - DNA, 23 bp, Artificial Sequence
  Description of Artificial Sequence: Synthetic oligonucleotide
acctgagctcatggaccgcggcg

SEQ ID NO: 380595 - DNA, 22 bp, Artificial Sequence
  Description of Artificial Sequence: Synthetic oligonucleotide
cctgagctcatggaccgcggcg

SEQ ID NO: 380596 - DNA, 23 bp, Artificial Sequence
  Description of Artificial Sequence: Synthetic oligonucleotide
ctgagctcatggaccgcggcgga

SEQ ID NO: 380597 - DNA, 24 bp, Artificial Sequence
  Description of Artificial Sequence: Synthetic oligonucleotide
tgagctcatggaccgcggcggaca

SEQ ID NO: 380598 - DNA, 23 bp, Artificial Sequence
  Description of Artificial Sequence: Synthetic oligonucleotide
gagctcatggaccgcggcggaca

SEQ ID NO: 380599 - DNA, 23 bp, Artificial Sequence
  Description of Artificial Sequence: Synthetic oligonucleotide
agctcatggaccgcggcggacac

SEQ ID NO: 380600 - DNA, 22 bp, Artificial Sequence
  Description of Artificial Sequence: Synthetic oligonucleotide
gctcatggaccgcggcggacac

SEQ ID NO: 380601 - DNA, 22 bp, Artificial Sequence
  Description of Artificial Sequence: Synthetic oligonucleotide
ctcatggaccgcggcggacacc

SEQ ID NO: 380602 - DNA, 22 bp, Artificial Sequence
  Description of Artificial Sequence: Synthetic oligonucleotide
tcatggaccgcggcggacaccg

SEQ ID NO: 380603 - DNA, 21 bp, Artificial Sequence
  Description of Artificial Sequence: Synthetic oligonucleotide
catggaccgcggcggacaccg

SEQ ID NO: 380604 - DNA, 21 bp, Artificial Sequence
  Description of Artificial Sequence: Synthetic oligonucleotide
atggaccgcggcggacaccgc

SEQ ID NO: 380605 - DNA, 31 bp, Artificial Sequence
  Description of Artificial Sequence: Synthetic oligonucleotide
tcccacgagtttcacttcttctcccaacctg

SEQ ID NO: 380606 - DNA, 30 bp, Artificial Sequence
  Description of Artificial Sequence: Synthetic oligonucleotide
cccacgagtttcacttcttctcccaacctg

SEQ ID NO: 380607 - DNA, 31 bp, Artificial Sequence
  Description of Artificial Sequence: Synthetic oligonucleotide
ccacgagtttcacttcttctcccaacctgtg

SEQ ID NO: 380608 - DNA, 32 bp, Artificial Sequence
  Description of Artificial Sequence: Synthetic oligonucleotide
cacgagtttcacttcttctcccaacctgtgtc

SEQ ID NO: 380609 - DNA, 32 bp, Artificial Sequence
  Description of Artificial Sequence: Synthetic oligonucleotide
acgagtttcacttcttctcccaacctgtgtcg

SEQ ID NO: 380610 - DNA, 31 bp, Artificial Sequence
  Description of Artificial Sequence: Synthetic oligonucleotide
cgagtttcacttcttctcccaacctgtgtcg

SEQ ID NO: 380611 - DNA, 31 bp, Artificial Sequence
  Description of Artificial Sequence: Synthetic oligonucleotide
gagtttcacttcttctcccaacctgtgtcgg

SEQ ID NO: 380612 - DNA, 31 bp, Artificial Sequence
  Description of Artificial Sequence: Synthetic oligonucleotide
agtttcacttcttctcccaacctgtgtcggg

SEQ ID NO: 380613 - DNA, 30 bp, Artificial Sequence
  Description of Artificial Sequence: Synthetic oligonucleotide
gtttcacttcttctcccaacctgtgtcggg

SEQ ID NO: 380614 - DNA, 31 bp, Artificial Sequence
  Description of Artificial Sequence: Synthetic oligonucleotide
tttcacttcttctcccaacctgtgtcgggtc

SEQ ID NO: 380615 - DNA, 30 bp, Artificial Sequence
  Description of Artificial Sequence: Synthetic oligonucleotide
ttcacttcttctcccaacctgtgtcgggtc

SEQ ID NO: 380616 - DNA, 29 bp, Artificial Sequence
  Description of Artificial Sequence: Synthetic oligonucleotide
tcacttcttctcccaacctgtgtcgggtc

SEQ ID NO: 380617 - DNA, 28 bp, Artificial Sequence
  Description of Artificial Sequence: Synthetic oligonucleotide
cacttcttctcccaacctgtgtcgggtc

SEQ ID NO: 380618 - DNA, 28 bp, Artificial Sequence
  Description of Artificial Sequence: Synthetic oligonucleotide
acttcttctcccaacctgtgtcgggtcc

SEQ ID NO: 380619 - DNA, 27 bp, Artificial Sequence
  Description of Artificial Sequence: Synthetic oligonucleotide
cttcttctcccaacctgtgtcgggtcc

SEQ ID NO: 380620 - DNA, 29 bp, Artificial Sequence
  Description of Artificial Sequence: Synthetic oligonucleotide
ttcttctcccaacctgtgtcgggtccttc

SEQ ID NO: 380621 - DNA, 28 bp, Artificial Sequence
  Description of Artificial Sequence: Synthetic oligonucleotide
tcttctcccaacctgtgtcgggtccttc

SEQ ID NO: 380622 - DNA, 27 bp, Artificial Sequence
  Description of Artificial Sequence: Synthetic oligonucleotide
cttctcccaacctgtgtcgggtccttc

SEQ ID NO: 380623 - DNA, 29 bp, Artificial Sequence
  Description of Artificial Sequence: Synthetic oligonucleotide
ttctcccaacctgtgtcgggtccttcttc

SEQ ID NO: 380624 - DNA, 28 bp, Artificial Sequence
  Description of Artificial Sequence: Synthetic oligonucleotide
tctcccaacctgtgtcgggtccttcttc

SEQ ID NO: 380625 - DNA, 27 bp, Artificial Sequence
  Description of Artificial Sequence: Synthetic oligonucleotide
ctcccaacctgtgtcgggtccttcttc

SEQ ID NO: 380626 - DNA, 27 bp, Artificial Sequence
  Description of Artificial Sequence: Synthetic oligonucleotide
tcccaacctgtgtcgggtccttcttcc

SEQ ID NO: 380627 - DNA, 27 bp, Artificial Sequence
  Description of Artificial Sequence: Synthetic oligonucleotide
cccaacctgtgtcgggtccttcttcca

SEQ ID NO: 380628 - DNA, 27 bp, Artificial Sequence
  Description of Artificial Sequence: Synthetic oligonucleotide
ccaacctgtgtcgggtccttcttccag

SEQ ID NO: 380629 - DNA, 27 bp, Artificial Sequence
  Description of Artificial Sequence: Synthetic oligonucleotide
caacctgtgtcgggtccttcttccagg

SEQ ID NO: 380630 - DNA, 30 bp, Artificial Sequence
  Description of Artificial Sequence: Synthetic oligonucleotide
aacctgtgtcgggtccttcttccaggatac

SEQ ID NO: 380631 - DNA, 29 bp, Artificial Sequence
  Description of Artificial Sequence: Synthetic oligonucleotide
acctgtgtcgggtccttcttccaggatac

SEQ ID NO: 380632 - DNA, 28 bp, Artificial Sequence
  Description of Artificial Sequence: Synthetic oligonucleotide
cctgtgtcgggtccttcttccaggatac

SEQ ID NO: 380633 - DNA, 29 bp, Artificial Sequence
  Description of Artificial Sequence: Synthetic oligonucleotide
ctgtgtcgggtccttcttccaggatactc

SEQ ID NO: 380634 - DNA, 29 bp, Artificial Sequence
  Description of Artificial Sequence: Synthetic oligonucleotide
agtattgggacggggagacacggaacatg

SEQ ID NO: 380635 - DNA, 28 bp, Artificial Sequence
  Description of Artificial Sequence: Synthetic oligonucleotide
gtattgggacggggagacacggaacatg

SEQ ID NO: 380636 - DNA, 30 bp, Artificial Sequence; identical to SEQ ID NO: 40174
  Description of Artificial Sequence: Synthetic oligonucleotide

SEQ ID NO: 380637 - DNA, 29 bp, Artificial Sequence
  Description of Artificial Sequence: Synthetic oligonucleotide
attgggacggggagacacggaacatgaag

SEQ ID NO: 380638 - DNA, 28 bp, Artificial Sequence
  Description of Artificial Sequence: Synthetic oligonucleotide
ttgggacggggagacacggaacatgaag

SEQ ID NO: 380639 - DNA, 27 bp, Artificial Sequence
  Description of Artificial Sequence: Synthetic oligonucleotide
tgggacggggagacacggaacatgaag

SEQ ID NO: 380640 - DNA, 26 bp, Artificial Sequence
  Description of Artificial Sequence: Synthetic oligonucleotide
gggacggggagacacggaacatgaag

SEQ ID NO: 380641 - DNA, 26 bp, Artificial Sequence
  Description of Artificial Sequence: Synthetic oligonucleotide
ggacggggagacacggaacatgaagg

SEQ ID NO: 380642 - DNA, 26 bp, Artificial Sequence
  Description of Artificial Sequence: Synthetic oligonucleotide
gacggggagacacggaacatgaaggc

SEQ ID NO: 380643 - DNA, 27 bp, Artificial Sequence
  Description of Artificial Sequence: Synthetic oligonucleotide
acggggagacacggaacatgaaggcct

SEQ ID NO: 380644 - DNA, 26 bp, Artificial Sequence
  Description of Artificial Sequence: Synthetic oligonucleotide
cggggagacacggaacatgaaggcct

SEQ ID NO: 380645 - DNA, 26 bp, Artificial Sequence
  Description of Artificial Sequence: Synthetic oligonucleotide
ggggagacacggaacatgaaggcctc

SEQ ID NO: 380646 - DNA, 25 bp, Artificial Sequence
  Description of Artificial Sequence: Synthetic oligonucleotide
cgaggccgggtctcacatcatccag

SEQ ID NO: 380647 - DNA, 26 bp, Artificial Sequence
  Description of Artificial Sequence: Synthetic oligonucleotide
gaggccgggtctcacatcatccaggt

SEQ ID NO: 380648 - DNA, 27 bp, Artificial Sequence
  Description of Artificial Sequence: Synthetic oligonucleotide
aggccgggtctcacatcatccaggtga

SEQ ID NO: 380649 - DNA, 27 bp, Artificial Sequence
  Description of Artificial Sequence: Synthetic oligonucleotide
ggccgggtctcacatcatccaggtgat

SEQ ID NO: 380650 - DNA, 27 bp, Artificial Sequence
  Description of Artificial Sequence: Synthetic oligonucleotide
gccgggtctcacatcatccaggtgatg

SEQ ID NO: 380651 - DNA, 30 bp, Artificial Sequence; identical to SEQ ID NO: 35209
  Description of Artificial Sequence: Synthetic oligonucleotide

SEQ ID NO: 380652 - DNA, 30 bp, Artificial Sequence; identical to SEQ ID NO: 35210
  Description of Artificial Sequence: Synthetic oligonucleotide

SEQ ID NO: 380653 - DNA, 30 bp, Artificial Sequence; identical to SEQ ID NO: 35211
  Description of Artificial Sequence: Synthetic oligonucleotide

SEQ ID NO: 380654 - DNA, 31 bp, Artificial Sequence; identical to SEQ ID NO: 35212
  Description of Artificial Sequence: Synthetic oligonucleotide

SEQ ID NO: 380655 - DNA, 31 bp, Artificial Sequence; identical to SEQ ID NO: 35213
  Description of Artificial Sequence: Synthetic oligonucleotide

SEQ ID NO: 380656 - DNA, 31 bp, Artificial Sequence; identical to SEQ ID NO: 35214
  Description of Artificial Sequence: Synthetic oligonucleotide

SEQ ID NO: 380657 - DNA, 30 bp, Artificial Sequence; identical to SEQ ID NO: 35215
  Description of Artificial Sequence: Synthetic oligonucleotide

SEQ ID NO: 380658 - DNA, 31 bp, Artificial Sequence; identical to SEQ ID NO: 35216
  Description of Artificial Sequence: Synthetic oligonucleotide

SEQ ID NO: 380659 - DNA, 30 bp, Artificial Sequence; identical to SEQ ID NO: 35217
  Description of Artificial Sequence: Synthetic oligonucleotide

SEQ ID NO: 380660 - DNA, 30 bp, Artificial Sequence; identical to SEQ ID NO: 35218
  Description of Artificial Sequence: Synthetic oligonucleotide

SEQ ID NO: 380661 - DNA, 29 bp, Artificial Sequence
  Description of Artificial Sequence: Synthetic oligonucleotide
catcatccaggtgatgtatggctgcgacg

SEQ ID NO: 380662 - DNA, 30 bp, Artificial Sequence; identical to SEQ ID NO: 35220
  Description of Artificial Sequence: Synthetic oligonucleotide

SEQ ID NO: 380663 - DNA, 29 bp, Artificial Sequence
  Description of Artificial Sequence: Synthetic oligonucleotide
tcatccaggtgatgtatggctgcgacgtg

SEQ ID NO: 380664 - DNA, 28 bp, Artificial Sequence
  Description of Artificial Sequence: Synthetic oligonucleotide
catccaggtgatgtatggctgcgacgtg

SEQ ID NO: 380665 - DNA, 28 bp, Artificial Sequence
  Description of Artificial Sequence: Synthetic oligonucleotide
atccaggtgatgtatggctgcgacgtgg

SEQ ID NO: 380666 - DNA, 27 bp, Artificial Sequence
  Description of Artificial Sequence: Synthetic oligonucleotide
tccaggtgatgtatggctgcgacgtgg

SEQ ID NO: 380667 - DNA, 26 bp, Artificial Sequence
  Description of Artificial Sequence: Synthetic oligonucleotide
ccaggtgatgtatggctgcgacgtgg

SEQ ID NO: 380668 - DNA, 26 bp, Artificial Sequence
  Description of Artificial Sequence: Synthetic oligonucleotide
caggtgatgtatggctgcgacgtggg

SEQ ID NO: 380669 - DNA, 26 bp, Artificial Sequence
  Description of Artificial Sequence: Synthetic oligonucleotide
aggtgatgtatggctgcgacgtgggg

SEQ ID NO: 380670 - DNA, 25 bp, Artificial Sequence
  Description of Artificial Sequence: Synthetic oligonucleotide
ggtgatgtatggctgcgacgtgggg

SEQ ID NO: 380671 - DNA, 25 bp, Artificial Sequence
  Description of Artificial Sequence: Synthetic oligonucleotide
gtgatgtatggctgcgacgtggggc

SEQ ID NO: 380672 - DNA, 24 bp, Artificial Sequence
  Description of Artificial Sequence: Synthetic oligonucleotide
ctcctccgcgggcatgaccagtct

SEQ ID NO: 380673 - DNA, 24 bp, Artificial Sequence
  Description of Artificial Sequence: Synthetic oligonucleotide
tcctccgcgggcatgaccagtctg

SEQ ID NO: 380674 - DNA, 23 bp, Artificial Sequence
  Description of Artificial Sequence: Synthetic oligonucleotide
cctccgcgggcatgaccagtctg

SEQ ID NO: 380675 - DNA, 23 bp, Artificial Sequence
  Description of Artificial Sequence: Synthetic oligonucleotide
ctccgcgggcatgaccagtctgc

SEQ ID NO: 380676 - DNA, 25 bp, Artificial Sequence
  Description of Artificial Sequence: Synthetic oligonucleotide
tccgcgggcatgaccagtctgccta

SEQ ID NO: 380677 - DNA, 24 bp, Artificial Sequence
  Description of Artificial Sequence: Synthetic oligonucleotide
ccgcgggcatgaccagtctgccta

SEQ ID NO: 380678 - DNA, 24 bp, Artificial Sequence
  Description of Artificial Sequence: Synthetic oligonucleotide
cgcgggcatgaccagtctgcctac

SEQ ID NO: 380679 - DNA, 25 bp, Artificial Sequence
  Description of Artificial Sequence: Synthetic oligonucleotide
gcgggcatgaccagtctgcctacga

SEQ ID NO: 380680 - DNA, 25 bp, Artificial Sequence
  Description of Artificial Sequence: Synthetic oligonucleotide
cgggcatgaccagtctgcctacgac

SEQ ID NO: 380681 - DNA, 25 bp, Artificial Sequence
  Description of Artificial Sequence: Synthetic oligonucleotide
gggcatgaccagtctgcctacgacg

SEQ ID NO: 380682 - DNA, 25 bp, Artificial Sequence
  Description of Artificial Sequence: Synthetic oligonucleotide
ggcatgaccagtctgcctacgacgg

SEQ ID NO: 380683 - DNA, 27 bp, Artificial Sequence
  Description of Artificial Sequence: Synthetic oligonucleotide
gcatgaccagtctgcctacgacggcaa

SEQ ID NO: 380684 - DNA, 27 bp, Artificial Sequence
  Description of Artificial Sequence: Synthetic oligonucleotide
catgaccagtctgcctacgacggcaag

SEQ ID NO: 380685 - DNA, 27 bp, Artificial Sequence
  Description of Artificial Sequence: Synthetic oligonucleotide
atgaccagtctgcctacgacggcaagg

SEQ ID NO: 380686 - DNA, 27 bp, Artificial Sequence
  Description of Artificial Sequence: Synthetic oligonucleotide
tgaccagtctgcctacgacggcaagga

SEQ ID NO: 380687 - DNA, 27 bp, Artificial Sequence
  Description of Artificial Sequence: Synthetic oligonucleotide
gaccagtctgcctacgacggcaaggat

SEQ ID NO: 380688 - DNA, 29 bp, Artificial Sequence
  Description of Artificial Sequence: Synthetic oligonucleotide
accagtctgcctacgacggcaaggattac

SEQ ID NO: 380689 - DNA, 28 bp, Artificial Sequence
  Description of Artificial Sequence: Synthetic oligonucleotide
ccagtctgcctacgacggcaaggattac

SEQ ID NO: 380690 - DNA, 30 bp, Artificial Sequence; identical to SEQ ID NO: 40202
  Description of Artificial Sequence: Synthetic oligonucleotide

SEQ ID NO: 380691 - DNA, 30 bp, Artificial Sequence; identical to SEQ ID NO: 40203
  Description of Artificial Sequence: Synthetic oligonucleotide

SEQ ID NO: 380692 - DNA, 29 bp, Artificial Sequence
  Description of Artificial Sequence: Synthetic oligonucleotide
gtctgcctacgacggcaaggattacatcg

SEQ ID NO: 380693 - DNA, 29 bp, Artificial Sequence
  Description of Artificial Sequence: Synthetic oligonucleotide
tctgcctacgacggcaaggattacatcgc

SEQ ID NO: 380694 - DNA, 28 bp, Artificial Sequence
  Description of Artificial Sequence: Synthetic oligonucleotide
ctgcctacgacggcaaggattacatcgc

SEQ ID NO: 380695 - DNA, 26 bp, Artificial Sequence
  Description of Artificial Sequence: Synthetic oligonucleotide
aaaacgggaaggagacgctgcagcgc

SEQ ID NO: 380696 - DNA, 25 bp, Artificial Sequence
  Description of Artificial Sequence: Synthetic oligonucleotide
aaacgggaaggagacgctgcagcgc

SEQ ID NO: 380697 - DNA, 27 bp, Artificial Sequence
  Description of Artificial Sequence: Synthetic oligonucleotide
agagaacctgcggatcgcgctccgata

SEQ ID NO: 380698 - DNA, 26 bp, Artificial Sequence
  Description of Artificial Sequence: Synthetic oligonucleotide
gagaacctgcggatcgcgctccgata

SEQ ID NO: 380699 - DNA, 27 bp, Artificial Sequence
  Description of Artificial Sequence: Synthetic oligonucleotide
agaacctgcggatcgcgctccgatact

SEQ ID NO: 380700 - DNA, 27 bp, Artificial Sequence
  Description of Artificial Sequence: Synthetic oligonucleotide
gaacctgcggatcgcgctccgatacta

SEQ ID NO: 380701 - DNA, 27 bp, Artificial Sequence
  Description of Artificial Sequence: Synthetic oligonucleotide
aacctgcggatcgcgctccgatactac

SEQ ID NO: 380702 - DNA, 27 bp, Artificial Sequence
  Description of Artificial Sequence: Synthetic oligonucleotide
acctgcggatcgcgctccgatactaca

SEQ ID NO: 380703 - DNA, 27 bp, Artificial Sequence
  Description of Artificial Sequence: Synthetic oligonucleotide
cctgcggatcgcgctccgatactacaa

SEQ ID NO: 380704 - DNA, 27 bp, Artificial Sequence
  Description of Artificial Sequence: Synthetic oligonucleotide
ctgcggatcgcgctccgatactacaac

SEQ ID NO: 380705 - DNA, 27 bp, Artificial Sequence
  Description of Artificial Sequence: Synthetic oligonucleotide
tgcggatcgcgctccgatactacaacc

SEQ ID NO: 380706 - DNA, 27 bp, Artificial Sequence
  Description of Artificial Sequence: Synthetic oligonucleotide
gcggatcgcgctccgatactacaacca

SEQ ID NO: 380707 - DNA, 27 bp, Artificial Sequence
  Description of Artificial Sequence: Synthetic oligonucleotide
cggatcgcgctccgatactacaaccag

SEQ ID NO: 380708 - DNA, 28 bp, Artificial Sequence
  Description of Artificial Sequence: Synthetic oligonucleotide
ggatcgcgctccgatactacaaccagag

SEQ ID NO: 380709 - DNA, 28 bp, Artificial Sequence
  Description of Artificial Sequence: Synthetic oligonucleotide
gatcgcgctccgatactacaaccagagc

SEQ ID NO: 380710 - DNA, 28 bp, Artificial Sequence
  Description of Artificial Sequence: Synthetic oligonucleotide
atcgcgctccgatactacaaccagagcg

SEQ ID NO: 380711 - DNA, 27 bp, Artificial Sequence
  Description of Artificial Sequence: Synthetic oligonucleotide
tcgcgctccgatactacaaccagagcg

SEQ ID NO: 380712 - DNA, 27 bp, Artificial Sequence
  Description of Artificial Sequence: Synthetic oligonucleotide
cgcgctccgatactacaaccagagcga

SEQ ID NO: 380713 - DNA, 27 bp, Artificial Sequence
  Description of Artificial Sequence: Synthetic oligonucleotide
gcgctccgatactacaaccagagcgag

SEQ ID NO: 380714 - DNA, 27 bp, Artificial Sequence
  Description of Artificial Sequence: Synthetic oligonucleotide
cgctccgatactacaaccagagcgagg

SEQ ID NO: 380715 - DNA, 27 bp, Artificial Sequence
  Description of Artificial Sequence: Synthetic oligonucleotide
gctccgatactacaaccagagcgaggc

SEQ ID NO: 380716 - DNA, 27 bp, Artificial Sequence
  Description of Artificial Sequence: Synthetic oligonucleotide
ctccgatactacaaccagagcgaggcc

SEQ ID NO: 380717 - DNA, 27 bp, Artificial Sequence
  Description of Artificial Sequence: Synthetic oligonucleotide
tccgatactacaaccagagcgaggccg

SEQ ID NO: 380718 - DNA, 26 bp, Artificial Sequence
  Description of Artificial Sequence: Synthetic oligonucleotide
ccgatactacaaccagagcgaggccg

SEQ ID NO: 380719 - DNA, 26 bp, Artificial Sequence
  Description of Artificial Sequence: Synthetic oligonucleotide
cgatactacaaccagagcgaggccgg

SEQ ID NO: 380720 - DNA, 27 bp, Artificial Sequence
  Description of Artificial Sequence: Synthetic oligonucleotide
gatactacaaccagagcgaggccgggt

SEQ ID NO: 380721 - DNA, 27 bp, Artificial Sequence
  Description of Artificial Sequence: Synthetic oligonucleotide
atactacaaccagagcgaggccgggtc

SEQ ID NO: 380722 - DNA, 30 bp, Artificial Sequence
  Description of Artificial Sequence: Synthetic oligonucleotide
atcatccaggtgatgtatggctgcgacgtc

SEQ ID NO: 380723 - DNA, 29 bp, Artificial Sequence
  Description of Artificial Sequence: Synthetic oligonucleotide
tcatccaggtgatgtatggctgcgacgtc

SEQ ID NO: 380724 - DNA, 28 bp, Artificial Sequence
  Description of Artificial Sequence: Synthetic oligonucleotide
catccaggtgatgtatggctgcgacgtc

SEQ ID NO: 380725 - DNA, 28 bp, Artificial Sequence
  Description of Artificial Sequence: Synthetic oligonucleotide
atccaggtgatgtatggctgcgacgtcg

SEQ ID NO: 380726 - DNA, 27 bp, Artificial Sequence
  Description of Artificial Sequence: Synthetic oligonucleotide
tccaggtgatgtatggctgcgacgtcg

SEQ ID NO: 380727 - DNA, 26 bp, Artificial Sequence
  Description of Artificial Sequence: Synthetic oligonucleotide
ccaggtgatgtatggctgcgacgtcg

SEQ ID NO: 380728 - DNA, 26 bp, Artificial Sequence
  Description of Artificial Sequence: Synthetic oligonucleotide
caggtgatgtatggctgcgacgtcgg

SEQ ID NO: 380729 - DNA, 26 bp, Artificial Sequence
  Description of Artificial Sequence: Synthetic oligonucleotide
aggtgatgtatggctgcgacgtcggg

SEQ ID NO: 380730 - DNA, 25 bp, Artificial Sequence
  Description of Artificial Sequence: Synthetic oligonucleotide
ggtgatgtatggctgcgacgtcggg

SEQ ID NO: 380731 - DNA, 25 bp, Artificial Sequence
  Description of Artificial Sequence: Synthetic oligonucleotide
gtgatgtatggctgcgacgtcgggc

SEQ ID NO: 380732 - DNA, 25 bp, Artificial Sequence
  Description of Artificial Sequence: Synthetic oligonucleotide
tgatgtatggctgcgacgtcgggcc

SEQ ID NO: 380733 - DNA, 24 bp, Artificial Sequence
  Description of Artificial Sequence: Synthetic oligonucleotide
gatgtatggctgcgacgtcgggcc

SEQ ID NO: 380734 - DNA, 24 bp, Artificial Sequence
  Description of Artificial Sequence: Synthetic oligonucleotide
atgtatggctgcgacgtcgggccg

SEQ ID NO: 380735 - DNA, 23 bp, Artificial Sequence
  Description of Artificial Sequence: Synthetic oligonucleotide
tgtatggctgcgacgtcgggccg

SEQ ID NO: 380736 - DNA, 22 bp, Artificial Sequence
  Description of Artificial Sequence: Synthetic oligonucleotide
gtatggctgcgacgtcgggccg

SEQ ID NO: 380737 - DNA, 23 bp, Artificial Sequence
  Description of Artificial Sequence: Synthetic oligonucleotide
tatggctgcgacgtcgggccgga

SEQ ID NO: 380738 - DNA, 22 bp, Artificial Sequence
  Description of Artificial Sequence: Synthetic oligonucleotide
atggctgcgacgtcgggccgga

SEQ ID NO: 380739 - DNA, 21 bp, Artificial Sequence
  Description of Artificial Sequence: Synthetic oligonucleotide
tggctgcgacgtcgggccgga

SEQ ID NO: 380740 - DNA, 20 bp, Artificial Sequence
  Description of Artificial Sequence: Synthetic oligonucleotide
ggctgcgacgtcgggccgga

SEQ ID NO: 380741 - DNA, 20 bp, Artificial Sequence
  Description of Artificial Sequence: Synthetic oligonucleotide
gctgcgacgtcgggccggac

SEQ ID NO: 380742 - DNA, 20 bp, Artificial Sequence
  Description of Artificial Sequence: Synthetic oligonucleotide
ctgcgacgtcgggccggacg

SEQ ID NO: 380743 - DNA, 20 bp, Artificial Sequence
  Description of Artificial Sequence: Synthetic oligonucleotide
tgcgacgtcgggccggacgg

SEQ ID NO: 380744 - DNA, 20 bp, Artificial Sequence
  Description of Artificial Sequence: Synthetic oligonucleotide
gcgacgtcgggccggacggt

SEQ ID NO: 380745 - DNA, 20 bp, Artificial Sequence
  Description of Artificial Sequence: Synthetic oligonucleotide
cgacgtcgggccggacgggt

SEQ ID NO: 380746 - DNA, 20 bp, Artificial Sequence
  Description of Artificial Sequence: Synthetic oligonucleotide
gacgtcgggccggacgggct

SEQ ID NO: 380747 - DNA, 20 bp, Artificial Sequence
  Description of Artificial Sequence: Synthetic oligonucleotide
acgtcgggccggacgggcgt

SEQ ID NO: 380748 - DNA, 20 bp, Artificial Sequence
  Description of Artificial Sequence: Synthetic oligonucleotide
cgtcgggccggacgggcgtt

SEQ ID NO: 380749 - DNA, 20 bp, Artificial Sequence
  Description of Artificial Sequence: Synthetic oligonucleotide
gtcgggccggacgggcgctt

SEQ ID NO: 380750 - DNA, 20 bp, Artificial Sequence
  Description of Artificial Sequence: Synthetic oligonucleotide
tcgggccggacgggcgcctt

SEQ ID NO: 380751 - DNA, 20 bp, Artificial Sequence
  Description of Artificial Sequence: Synthetic oligonucleotide
cgggccggacgggcgccttt

SEQ ID NO: 380752 - DNA, 30 bp, Artificial Sequence
  Description of Artificial Sequence: Synthetic oligonucleotide
ccaaagacacatgtgacccaccaccctatc

SEQ ID NO: 380753 - DNA, 31 bp, Artificial Sequence
  Description of Artificial Sequence: Synthetic oligonucleotide
caaagacacatgtgacccaccaccctatctc

SEQ ID NO: 380754 - DNA, 32 bp, Artificial Sequence
  Description of Artificial Sequence: Synthetic oligonucleotide
aaagacacatgtgacccaccaccctatctctg

SEQ ID NO: 380755 - DNA, 31 bp, Artificial Sequence
  Description of Artificial Sequence: Synthetic oligonucleotide
aagacacatgtgacccaccaccctatctctg

SEQ ID NO: 380756 - DNA, 30 bp, Artificial Sequence
  Description of Artificial Sequence: Synthetic oligonucleotide
agacacatgtgacccaccaccctatctctg

SEQ ID NO: 380757 - DNA, 29 bp, Artificial Sequence
  Description of Artificial Sequence: Synthetic oligonucleotide
gacacatgtgacccaccaccctatctctg

SEQ ID NO: 380758 - DNA, 30 bp, Artificial Sequence
  Description of Artificial Sequence: Synthetic oligonucleotide
acacatgtgacccaccaccctatctctgac

SEQ ID NO: 380759 - DNA, 29 bp, Artificial Sequence
  Description of Artificial Sequence: Synthetic oligonucleotide
cacatgtgacccaccaccctatctctgac

SEQ ID NO: 380760 - DNA, 29 bp, Artificial Sequence
  Description of Artificial Sequence: Synthetic oligonucleotide
acatgtgacccaccaccctatctctgacc

SEQ ID NO: 380761 - DNA, 28 bp, Artificial Sequence
  Description of Artificial Sequence: Synthetic oligonucleotide
catgtgacccaccaccctatctctgacc

SEQ ID NO: 380762 - DNA, 30 bp, Artificial Sequence
  Description of Artificial Sequence: Synthetic oligonucleotide
atgtgacccaccaccctatctctgaccatg

SEQ ID NO: 380763 - DNA, 29 bp, Artificial Sequence
  Description of Artificial Sequence: Synthetic oligonucleotide
tgtgacccaccaccctatctctgaccatg

SEQ ID NO: 380764 - DNA, 28 bp, Artificial Sequence
  Description of Artificial Sequence: Synthetic oligonucleotide
gtgacccaccaccctatctctgaccatg

SEQ ID NO: 380765 - DNA, 29 bp, Artificial Sequence
  Description of Artificial Sequence: Synthetic oligonucleotide
tgacccaccaccctatctctgaccatgag

SEQ ID NO: 380766 - DNA, 28 bp, Artificial Sequence
  Description of Artificial Sequence: Synthetic oligonucleotide
gacccaccaccctatctctgaccatgag

SEQ ID NO: 380767 - DNA, 28 bp, Artificial Sequence
  Description of Artificial Sequence: Synthetic oligonucleotide
acccaccaccctatctctgaccatgagg

SEQ ID NO: 380768 - DNA, 27 bp, Artificial Sequence
  Description of Artificial Sequence: Synthetic oligonucleotide
cccaccaccctatctctgaccatgagg

SEQ ID NO: 380769 - DNA, 27 bp, Artificial Sequence
  Description of Artificial Sequence: Synthetic oligonucleotide
ccaccaccctatctctgaccatgaggc

SEQ ID NO: 380770 - DNA, 27 bp, Artificial Sequence
  Description of Artificial Sequence: Synthetic oligonucleotide
caccaccctatctctgaccatgaggcc

SEQ ID NO: 380771 - DNA, 28 bp, Artificial Sequence
  Description of Artificial Sequence: Synthetic oligonucleotide
accaccctatctctgaccatgaggccac

SEQ ID NO: 380772 - DNA, 27 bp, Artificial Sequence
  Description of Artificial Sequence: Synthetic oligonucleotide
ccaccctatctctgaccatgaggccac

SEQ ID NO: 380773 - DNA, 27 bp, Artificial Sequence
  Description of Artificial Sequence: Synthetic oligonucleotide
caccctatctctgaccatgaggccacc

SEQ ID NO: 380774 - DNA, 27 bp, Artificial Sequence
  Description of Artificial Sequence: Synthetic oligonucleotide
accctatctctgaccatgaggccaccc

SEQ ID NO: 380775 - DNA, 27 bp, Artificial Sequence
  Description of Artificial Sequence: Synthetic oligonucleotide
ccctatctctgaccatgaggccaccct

SEQ ID NO: 380776 - DNA, 27 bp, Artificial Sequence
  Description of Artificial Sequence: Synthetic oligonucleotide
cctatctctgaccatgaggccaccctg

SEQ ID NO: 380777 - DNA, 28 bp, Artificial Sequence
  Description of Artificial Sequence: Synthetic oligonucleotide
ctatctctgaccatgaggccaccctgag

SEQ ID NO: 380778 - DNA, 28 bp, Artificial Sequence
  Description of Artificial Sequence: Synthetic oligonucleotide
tatctctgaccatgaggccaccctgagg

SEQ ID NO: 380779 - DNA, 27 bp, Artificial Sequence
  Description of Artificial Sequence: Synthetic oligonucleotide
gcgctccgctactacaaccagagcgaa

SEQ ID NO: 380780 - DNA, 27 bp, Artificial Sequence
  Description of Artificial Sequence: Synthetic oligonucleotide
cgctccgctactacaaccagagcgaag

SEQ ID NO: 380781 - DNA, 27 bp, Artificial Sequence
  Description of Artificial Sequence: Synthetic oligonucleotide
gctccgctactacaaccagagcgaagc

SEQ ID NO: 380782 - DNA, 27 bp, Artificial Sequence
  Description of Artificial Sequence: Synthetic oligonucleotide
ctccgctactacaaccagagcgaagcc

SEQ ID NO: 380783 - DNA, 27 bp, Artificial Sequence
  Description of Artificial Sequence: Synthetic oligonucleotide
tccgctactacaaccagagcgaagccg

SEQ ID NO: 380784 - DNA, 26 bp, Artificial Sequence
  Description of Artificial Sequence: Synthetic oligonucleotide
ccgctactacaaccagagcgaagccg

SEQ ID NO: 380785 - DNA, 26 bp, Artificial Sequence
  Description of Artificial Sequence: Synthetic oligonucleotide
cgctactacaaccagagcgaagccgg

SEQ ID NO: 380786 - DNA, 26 bp, Artificial Sequence
  Description of Artificial Sequence: Synthetic oligonucleotide
gcgaagccgggtctcacatcatccag

SEQ ID NO: 380787 - DNA, 27 bp, Artificial Sequence
  Description of Artificial Sequence: Synthetic oligonucleotide
cgaagccgggtctcacatcatccaggt

SEQ ID NO: 380788 - DNA, 27 bp, Artificial Sequence
  Description of Artificial Sequence: Synthetic oligonucleotide
gaagccgggtctcacatcatccaggtg

SEQ ID NO: 380789 - DNA, 29 bp, Artificial Sequence
  Description of Artificial Sequence: Synthetic oligonucleotide
aagccgggtctcacatcatccaggtgatg

SEQ ID NO: 380790 - DNA, 28 bp, Artificial Sequence
  Description of Artificial Sequence: Synthetic oligonucleotide
agccgggtctcacatcatccaggtgatg

SEQ ID NO: 380791 - DNA, 22 bp, Artificial Sequence
  Description of Artificial Sequence: Synthetic oligonucleotide
ctcctggaccgcggcggacaca

SEQ ID NO: 380792 - DNA, 22 bp, Artificial Sequence
  Description of Artificial Sequence: Synthetic oligonucleotide
tcctggaccgcggcggacacag

SEQ ID NO: 380793 - DNA, 21 bp, Artificial Sequence
  Description of Artificial Sequence: Synthetic oligonucleotide
cctggaccgcggcggacacag

SEQ ID NO: 380794 - DNA, 21 bp, Artificial Sequence
  Description of Artificial Sequence: Synthetic oligonucleotide
ctggaccgcggcggacacagc

SEQ ID NO: 380795 - DNA, 21 bp, Artificial Sequence
  Description of Artificial Sequence: Synthetic oligonucleotide
tggaccgcggcggacacagcg

SEQ ID NO: 380796 - DNA, 20 bp, Artificial Sequence
  Description of Artificial Sequence: Synthetic oligonucleotide
ggaccgcggcggacacagcg

SEQ ID NO: 380797 - DNA, 20 bp, Artificial Sequence
  Description of Artificial Sequence: Synthetic oligonucleotide
gaccgcggcggacacagcgg

SEQ ID NO: 380798 - DNA, 21 bp, Artificial Sequence
  Description of Artificial Sequence: Synthetic oligonucleotide
accgcggcggacacagcggct

SEQ ID NO: 380799 - DNA, 20 bp, Artificial Sequence
  Description of Artificial Sequence: Synthetic oligonucleotide
ccgcggcggacacagcggct

SEQ ID NO: 380800 - DNA, 21 bp, Artificial Sequence
  Description of Artificial Sequence: Synthetic oligonucleotide
cgcggcggacacagcggctca

SEQ ID NO: 380801 - DNA, 23 bp, Artificial Sequence
  Description of Artificial Sequence: Synthetic oligonucleotide
gcggcggacacagcggctcagat

SEQ ID NO: 380802 - DNA, 24 bp, Artificial Sequence
  Description of Artificial Sequence: Synthetic oligonucleotide
cggcggacacagcggctcagatca

SEQ ID NO: 380803 - DNA, 24 bp, Artificial Sequence
  Description of Artificial Sequence: Synthetic oligonucleotide
ggcggacacagcggctcagatcac

SEQ ID NO: 380804 - DNA, 34 bp, Artificial Sequence; identical to SEQ ID NO: 40325
  Description of Artificial Sequence: Synthetic oligonucleotide

SEQ ID NO: 380805 - DNA, 33 bp, Artificial Sequence; identical to SEQ ID NO: 40326
  Description of Artificial Sequence: Synthetic oligonucleotide

SEQ ID NO: 380806 - DNA, 32 bp, Artificial Sequence; identical to SEQ ID NO: 40327
  Description of Artificial Sequence: Synthetic oligonucleotide

SEQ ID NO: 380807 - DNA, 32 bp, Artificial Sequence; identical to SEQ ID NO: 40328
  Description of Artificial Sequence: Synthetic oligonucleotide

SEQ ID NO: 380808 - DNA, 31 bp, Artificial Sequence; identical to SEQ ID NO: 40329
  Description of Artificial Sequence: Synthetic oligonucleotide

SEQ ID NO: 380809 - DNA, 32 bp, Artificial Sequence; identical to SEQ ID NO: 40330
  Description of Artificial Sequence: Synthetic oligonucleotide

SEQ ID NO: 380810 - DNA, 32 bp, Artificial Sequence; identical to SEQ ID NO: 40331
  Description of Artificial Sequence: Synthetic oligonucleotide

SEQ ID NO: 380811 - DNA, 31 bp, Artificial Sequence; identical to SEQ ID NO: 40332
  Description of Artificial Sequence: Synthetic oligonucleotide

SEQ ID NO: 380812 - DNA, 33 bp, Artificial Sequence; identical to SEQ ID NO: 40333
  Description of Artificial Sequence: Synthetic oligonucleotide

SEQ ID NO: 380813 - DNA, 32 bp, Artificial Sequence; identical to SEQ ID NO: 40334
  Description of Artificial Sequence: Synthetic oligonucleotide

SEQ ID NO: 380814 - DNA, 31 bp, Artificial Sequence; identical to SEQ ID NO: 40335
  Description of Artificial Sequence: Synthetic oligonucleotide

SEQ ID NO: 380815 - DNA, 32 bp, Artificial Sequence; identical to SEQ ID NO: 40336
  Description of Artificial Sequence: Synthetic oligonucleotide

SEQ ID NO: 380816 - DNA, 31 bp, Artificial Sequence; identical to SEQ ID NO: 40337
  Description of Artificial Sequence: Synthetic oligonucleotide

SEQ ID NO: 380817 - DNA, 31 bp, Artificial Sequence; identical to SEQ ID NO: 40338
  Description of Artificial Sequence: Synthetic oligonucleotide

SEQ ID NO: 380818 - DNA, 31 bp, Artificial Sequence; identical to SEQ ID NO: 40339
  Description of Artificial Sequence: Synthetic oligonucleotide

SEQ ID NO: 380819 - DNA, 30 bp, Artificial Sequence; identical to SEQ ID NO: 40340
  Description of Artificial Sequence: Synthetic oligonucleotide

SEQ ID NO: 380820 - DNA, 30 bp, Artificial Sequence; identical to SEQ ID NO: 40341
  Description of Artificial Sequence: Synthetic oligonucleotide

SEQ ID NO: 380821 - DNA, 29 bp, Artificial Sequence
  Description of Artificial Sequence: Synthetic oligonucleotide
gatacacatgccatgtgcagcatgagggg

SEQ ID NO: 380822 - DNA, 29 bp, Artificial Sequence
  Description of Artificial Sequence: Synthetic oligonucleotide
atacacatgccatgtgcagcatgaggggc

SEQ ID NO: 380823 - DNA, 28 bp, Artificial Sequence
  Description of Artificial Sequence: Synthetic oligonucleotide
tacacatgccatgtgcagcatgaggggc

SEQ ID NO: 380824 - DNA, 27 bp, Artificial Sequence
  Description of Artificial Sequence: Synthetic oligonucleotide
acacatgccatgtgcagcatgaggggc

SEQ ID NO: 380825 - DNA, 27 bp, Artificial Sequence
  Description of Artificial Sequence: Synthetic oligonucleotide
cacatgccatgtgcagcatgaggggct

SEQ ID NO: 380826 - DNA, 27 bp, Artificial Sequence
  Description of Artificial Sequence: Synthetic oligonucleotide
acatgccatgtgcagcatgaggggctg

SEQ ID NO: 380827 - DNA, 26 bp, Artificial Sequence
  Description of Artificial Sequence: Synthetic oligonucleotide
catgccatgtgcagcatgaggggctg

SEQ ID NO: 380828 - DNA, 26 bp, Artificial Sequence
  Description of Artificial Sequence: Synthetic oligonucleotide
atgccatgtgcagcatgaggggctgc

SEQ ID NO: 380829 - DNA, 27 bp, Artificial Sequence
  Description of Artificial Sequence: Synthetic oligonucleotide
ccatgtgcagcatgaggggctgccaaa

SEQ ID NO: 380830 - DNA, 27 bp, Artificial Sequence
  Description of Artificial Sequence: Synthetic oligonucleotide
catgtgcagcatgaggggctgccaaag

SEQ ID NO: 380831 - DNA, 27 bp, Artificial Sequence
  Description of Artificial Sequence: Synthetic oligonucleotide
atgtgcagcatgaggggctgccaaagc

SEQ ID NO: 380832 - DNA, 26 bp, Artificial Sequence
  Description of Artificial Sequence: Synthetic oligonucleotide
tgtgcagcatgaggggctgccaaagc

SEQ ID NO: 380833 - DNA, 25 bp, Artificial Sequence
  Description of Artificial Sequence: Synthetic oligonucleotide
gtgcagcatgaggggctgccaaagc

SEQ ID NO: 380834 - DNA, 25 bp, Artificial Sequence
  Description of Artificial Sequence: Synthetic oligonucleotide
tgcagcatgaggggctgccaaagcc

SEQ ID NO: 380835 - DNA, 24 bp, Artificial Sequence
  Description of Artificial Sequence: Synthetic oligonucleotide
gcagcatgaggggctgccaaagcc

SEQ ID NO: 380836 - DNA, 24 bp, Artificial Sequence
  Description of Artificial Sequence: Synthetic oligonucleotide
ggcggacacggcggctcagatcat

SEQ ID NO: 380837 - DNA, 24 bp, Artificial Sequence
  Description of Artificial Sequence: Synthetic oligonucleotide
gcggacacggcggctcagatcatc

SEQ ID NO: 380838 - DNA, 25 bp, Artificial Sequence
  Description of Artificial Sequence: Synthetic oligonucleotide
cggacacggcggctcagatcatcca

SEQ ID NO: 380839 - DNA, 25 bp, Artificial Sequence
  Description of Artificial Sequence: Synthetic oligonucleotide
ggacacggcggctcagatcatccag

SEQ ID NO: 380840 - DNA, 25 bp, Artificial Sequence
  Description of Artificial Sequence: Synthetic oligonucleotide
gacacggcggctcagatcatccagc

SEQ ID NO: 380841 - DNA, 25 bp, Artificial Sequence
  Description of Artificial Sequence: Synthetic oligonucleotide
acacggcggctcagatcatccagcg

SEQ ID NO: 380842 - DNA, 24 bp, Artificial Sequence
  Description of Artificial Sequence: Synthetic oligonucleotide
cacggcggctcagatcatccagcg

SEQ ID NO: 380843 - DNA, 26 bp, Artificial Sequence
  Description of Artificial Sequence: Synthetic oligonucleotide
acggcggctcagatcatccagcgcaa

SEQ ID NO: 380844 - DNA, 25 bp, Artificial Sequence
  Description of Artificial Sequence: Synthetic oligonucleotide
cggcggctcagatcatccagcgcaa

SEQ ID NO: 380845 - DNA, 26 bp, Artificial Sequence
  Description of Artificial Sequence: Synthetic oligonucleotide
ggcggctcagatcatccagcgcaagt

SEQ ID NO: 380846 - DNA, 26 bp, Artificial Sequence
  Description of Artificial Sequence: Synthetic oligonucleotide
gcggctcagatcatccagcgcaagtg

SEQ ID NO: 380847 - DNA, 26 bp, Artificial Sequence
  Description of Artificial Sequence: Synthetic oligonucleotide
cggctcagatcatccagcgcaagtgg

SEQ ID NO: 380848 - DNA, 27 bp, Artificial Sequence
  Description of Artificial Sequence: Synthetic oligonucleotide
ggctcagatcatccagcgcaagtggga

SEQ ID NO: 380849 - DNA, 27 bp, Artificial Sequence
  Description of Artificial Sequence: Synthetic oligonucleotide
gctcagatcatccagcgcaagtgggag

SEQ ID NO: 380850 - DNA, 27 bp, Artificial Sequence
  Description of Artificial Sequence: Synthetic oligonucleotide
ctcagatcatccagcgcaagtgggagg

SEQ ID NO: 380851 - DNA, 27 bp, Artificial Sequence
  Description of Artificial Sequence: Synthetic oligonucleotide
tcagatcatccagcgcaagtgggaggc

SEQ ID NO: 380852 - DNA, 26 bp, Artificial Sequence
  Description of Artificial Sequence: Synthetic oligonucleotide
cagatcatccagcgcaagtgggaggc

SEQ ID NO: 380853 - DNA, 26 bp, Artificial Sequence
  Description of Artificial Sequence: Synthetic oligonucleotide
agatcatccagcgcaagtgggaggcg

SEQ ID NO: 380854 - DNA, 25 bp, Artificial Sequence
  Description of Artificial Sequence: Synthetic oligonucleotide
gatcatccagcgcaagtgggaggcg

SEQ ID NO: 380855 - DNA, 25 bp, Artificial Sequence
  Description of Artificial Sequence: Synthetic oligonucleotide
atcatccagcgcaagtgggaggcgg

SEQ ID NO: 380856 - DNA, 24 bp, Artificial Sequence
  Description of Artificial Sequence: Synthetic oligonucleotide
tcatccagcgcaagtgggaggcgg

SEQ ID NO: 380857 - DNA, 23 bp, Artificial Sequence
  Description of Artificial Sequence: Synthetic oligonucleotide
catccagcgcaagtgggaggcgg

SEQ ID NO: 380858 - DNA, 23 bp, Artificial Sequence
  Description of Artificial Sequence: Synthetic oligonucleotide
atccagcgcaagtgggaggcggc

SEQ ID NO: 380859 - DNA, 22 bp, Artificial Sequence
  Description of Artificial Sequence: Synthetic oligonucleotide
tccagcgcaagtgggaggcggc

SEQ ID NO: 380860 - DNA, 24 bp, Artificial Sequence
  Description of Artificial Sequence: Synthetic oligonucleotide
tatggctgcgacctggggcccgat

SEQ ID NO: 380861 - DNA, 23 bp, Artificial Sequence
  Description of Artificial Sequence: Synthetic oligonucleotide
atggctgcgacctggggcccgat

SEQ ID NO: 380862 - DNA, 22 bp, Artificial Sequence
  Description of Artificial Sequence: Synthetic oligonucleotide
tggctgcgacctggggcccgat

SEQ ID NO: 380863 - DNA, 21 bp, Artificial Sequence
  Description of Artificial Sequence: Synthetic oligonucleotide
ggctgcgacctggggcccgat

SEQ ID NO: 380864 - DNA, 21 bp, Artificial Sequence
  Description of Artificial Sequence: Synthetic oligonucleotide
gctgcgacctggggcccgatg

SEQ ID NO: 380865 - DNA, 21 bp, Artificial Sequence
  Description of Artificial Sequence: Synthetic oligonucleotide
ctgcgacctggggcccgatgg

SEQ ID NO: 380866 - DNA, 21 bp, Artificial Sequence
  Description of Artificial Sequence: Synthetic oligonucleotide
tgcgacctggggcccgatggg

SEQ ID NO: 380867 - DNA, 20 bp, Artificial Sequence
  Description of Artificial Sequence: Synthetic oligonucleotide
gcgacctggggcccgatggg

SEQ ID NO: 380868 - DNA, 20 bp, Artificial Sequence
  Description of Artificial Sequence: Synthetic oligonucleotide
cgacctggggcccgatgggc

SEQ ID NO: 380869 - DNA, 20 bp, Artificial Sequence
  Description of Artificial Sequence: Synthetic oligonucleotide
gacctggggcccgatgggcg

SEQ ID NO: 380870 - DNA, 20 bp, Artificial Sequence
  Description of Artificial Sequence: Synthetic oligonucleotide
acctggggcccgatgggcgc

SEQ ID NO: 380871 - DNA, 20 bp, Artificial Sequence
  Description of Artificial Sequence: Synthetic oligonucleotide
cctggggcccgatgggcgct

SEQ ID NO: 380872 - DNA, 20 bp, Artificial Sequence
  Description of Artificial Sequence: Synthetic oligonucleotide
ctggggcccgatgggcgcct

SEQ ID NO: 380873 - DNA, 20 bp, Artificial Sequence
  Description of Artificial Sequence: Synthetic oligonucleotide
tggggcccgatgggcgcctc

SEQ ID NO: 380874 - DNA, 20 bp, Artificial Sequence
  Description of Artificial Sequence: Synthetic oligonucleotide
ggggcccgatgggcgcctct

SEQ ID NO: 380875 - DNA, 20 bp, Artificial Sequence
  Description of Artificial Sequence: Synthetic oligonucleotide
gggcccgatgggcgcctcct

SEQ ID NO: 380876 - DNA, 20 bp, Artificial Sequence
  Description of Artificial Sequence: Synthetic oligonucleotide
ggcccgatgggcgcctcctc

SEQ ID NO: 380877 - DNA, 20 bp, Artificial Sequence
  Description of Artificial Sequence: Synthetic oligonucleotide
gcccgatgggcgcctcctcc

SEQ ID NO: 380878 - DNA, 20 bp, Artificial Sequence
  Description of Artificial Sequence: Synthetic oligonucleotide
cccgatgggcgcctcctccg

SEQ ID NO: 380879 - DNA, 20 bp, Artificial Sequence
  Description of Artificial Sequence: Synthetic oligonucleotide
ccgatgggcgcctcctccgc

SEQ ID NO: 380880 - DNA, 20 bp, Artificial Sequence
  Description of Artificial Sequence: Synthetic oligonucleotide
cgatgggcgcctcctccgcg

SEQ ID NO: 380881 - DNA, 24 bp, Artificial Sequence
  Description of Artificial Sequence: Synthetic oligonucleotide
gaggacctgagctcttggaccgcg

SEQ ID NO: 380882 - DNA, 24 bp, Artificial Sequence
  Description of Artificial Sequence: Synthetic oligonucleotide
aggacctgagctcttggaccgcgg

SEQ ID NO: 380883 - DNA, 23 bp, Artificial Sequence
  Description of Artificial Sequence: Synthetic oligonucleotide
ggacctgagctcttggaccgcgg

SEQ ID NO: 380884 - DNA, 23 bp, Artificial Sequence
  Description of Artificial Sequence: Synthetic oligonucleotide
gacctgagctcttggaccgcggc

SEQ ID NO: 380885 - DNA, 23 bp, Artificial Sequence
  Description of Artificial Sequence: Synthetic oligonucleotide
acctgagctcttggaccgcggcg

SEQ ID NO: 380886 - DNA, 22 bp, Artificial Sequence
  Description of Artificial Sequence: Synthetic oligonucleotide
cctgagctcttggaccgcggcg

SEQ ID NO: 380887 - DNA, 23 bp, Artificial Sequence
  Description of Artificial Sequence: Synthetic oligonucleotide
ctgagctcttggaccgcggcgga

SEQ ID NO: 380888 - DNA, 24 bp, Artificial Sequence
  Description of Artificial Sequence: Synthetic oligonucleotide
tgagctcttggaccgcggcggaca

SEQ ID NO: 380889 - DNA, 23 bp, Artificial Sequence
  Description of Artificial Sequence: Synthetic oligonucleotide
gagctcttggaccgcggcggaca

SEQ ID NO: 380890 - DNA, 23 bp, Artificial Sequence
  Description of Artificial Sequence: Synthetic oligonucleotide
agctcttggaccgcggcggacac

SEQ ID NO: 380891 - DNA, 22 bp, Artificial Sequence
  Description of Artificial Sequence: Synthetic oligonucleotide
gctcttggaccgcggcggacac

SEQ ID NO: 380892 - DNA, 22 bp, Artificial Sequence
  Description of Artificial Sequence: Synthetic oligonucleotide
ctcttggaccgcggcggacacc

SEQ ID NO: 380893 - DNA, 22 bp, Artificial Sequence
  Description of Artificial Sequence: Synthetic oligonucleotide
tcttggaccgcggcggacaccg

SEQ ID NO: 380894 - DNA, 21 bp, Artificial Sequence
  Description of Artificial Sequence: Synthetic oligonucleotide
cttggaccgcggcggacaccg

SEQ ID NO: 380895 - DNA, 21 bp, Artificial Sequence
  Description of Artificial Sequence: Synthetic oligonucleotide
ttggaccgcggcggacaccgc

SEQ ID NO: 380896 - DNA, 26 bp, Artificial Sequence
  Description of Artificial Sequence: Synthetic oligonucleotide
gcagctgtggtggtgccttctggaga

SEQ ID NO: 380897 - DNA, 26 bp, Artificial Sequence
  Description of Artificial Sequence: Synthetic oligonucleotide
cagctgtggtggtgccttctggagag

SEQ ID NO: 380898 - DNA, 27 bp, Artificial Sequence
  Description of Artificial Sequence: Synthetic oligonucleotide
agctgtggtggtgccttctggagagga

SEQ ID NO: 380899 - DNA, 31 bp, Artificial Sequence; identical to SEQ ID NO: 40649
  Description of Artificial Sequence: Synthetic oligonucleotide

SEQ ID NO: 380900 - DNA, 30 bp, Artificial Sequence; identical to SEQ ID NO: 40650
  Description of Artificial Sequence: Synthetic oligonucleotide

SEQ ID NO: 380901 - DNA, 30 bp, Artificial Sequence; identical to SEQ ID NO: 40651
  Description of Artificial Sequence: Synthetic oligonucleotide

SEQ ID NO: 380902 - DNA, 30 bp, Artificial Sequence; identical to SEQ ID NO: 40652
  Description of Artificial Sequence: Synthetic oligonucleotide

SEQ ID NO: 380903 - DNA, 32 bp, Artificial Sequence; identical to SEQ ID NO: 40653
  Description of Artificial Sequence: Synthetic oligonucleotide

SEQ ID NO: 380904 - DNA, 31 bp, Artificial Sequence; identical to SEQ ID NO: 40654
  Description of Artificial Sequence: Synthetic oligonucleotide

SEQ ID NO: 380905 - DNA, 30 bp, Artificial Sequence; identical to SEQ ID NO: 40655
  Description of Artificial Sequence: Synthetic oligonucleotide

SEQ ID NO: 380906 - DNA, 32 bp, Artificial Sequence; identical to SEQ ID NO: 40656
  Description of Artificial Sequence: Synthetic oligonucleotide

SEQ ID NO: 380907 - DNA, 31 bp, Artificial Sequence; identical to SEQ ID NO: 40657
  Description of Artificial Sequence: Synthetic oligonucleotide

SEQ ID NO: 380908 - DNA, 32 bp, Artificial Sequence; identical to SEQ ID NO: 40658
  Description of Artificial Sequence: Synthetic oligonucleotide

SEQ ID NO: 380909 - DNA, 32 bp, Artificial Sequence; identical to SEQ ID NO: 40659
  Description of Artificial Sequence: Synthetic oligonucleotide

SEQ ID NO: 380910 - DNA, 31 bp, Artificial Sequence; identical to SEQ ID NO: 40660
  Description of Artificial Sequence: Synthetic oligonucleotide

SEQ ID NO: 380911 - DNA, 33 bp, Artificial Sequence; identical to SEQ ID NO: 40661
  Description of Artificial Sequence: Synthetic oligonucleotide

SEQ ID NO: 380912 - DNA, 32 bp, Artificial Sequence; identical to SEQ ID NO: 40662
  Description of Artificial Sequence: Synthetic oligonucleotide

SEQ ID NO: 380913 - DNA, 29 bp, Artificial Sequence
  Description of Artificial Sequence: Synthetic oligonucleotide
gacgacacccagttcgtgaggttcgatag

SEQ ID NO: 380914 - DNA, 29 bp, Artificial Sequence
  Description of Artificial Sequence: Synthetic oligonucleotide
acgacacccagttcgtgaggttcgatagc

SEQ ID NO: 380915 - DNA, 28 bp, Artificial Sequence
  Description of Artificial Sequence: Synthetic oligonucleotide
cgacacccagttcgtgaggttcgatagc

SEQ ID NO: 380916 - DNA, 28 bp, Artificial Sequence
  Description of Artificial Sequence: Synthetic oligonucleotide
gacacccagttcgtgaggttcgatagcg

SEQ ID NO: 380917 - DNA, 29 bp, Artificial Sequence
  Description of Artificial Sequence: Synthetic oligonucleotide
acacccagttcgtgaggttcgatagcgac

SEQ ID NO: 380918 - DNA, 28 bp, Artificial Sequence
  Description of Artificial Sequence: Synthetic oligonucleotide
cacccagttcgtgaggttcgatagcgac

SEQ ID NO: 380919 - DNA, 28 bp, Artificial Sequence
  Description of Artificial Sequence: Synthetic oligonucleotide
acccagttcgtgaggttcgatagcgacg

SEQ ID NO: 380920 - DNA, 27 bp, Artificial Sequence
  Description of Artificial Sequence: Synthetic oligonucleotide
cccagttcgtgaggttcgatagcgacg

SEQ ID NO: 380921 - DNA, 27 bp, Artificial Sequence
  Description of Artificial Sequence: Synthetic oligonucleotide
ccagttcgtgaggttcgatagcgacgc

SEQ ID NO: 380922 - DNA, 23 bp, Artificial Sequence
  Description of Artificial Sequence: Synthetic oligonucleotide
gatagcgacgccgcgagtccgag

SEQ ID NO: 380923 - DNA, 24 bp, Artificial Sequence
  Description of Artificial Sequence: Synthetic oligonucleotide
atagcgacgccgcgagtccgagga

SEQ ID NO: 380924 - DNA, 23 bp, Artificial Sequence
  Description of Artificial Sequence: Synthetic oligonucleotide
tagcgacgccgcgagtccgagga

SEQ ID NO: 380925 - DNA, 27 bp, Artificial Sequence
  Description of Artificial Sequence: Synthetic oligonucleotide
cctccagtggatgtatggctgcgacct

SEQ ID NO: 380926 - DNA, 27 bp, Artificial Sequence
  Description of Artificial Sequence: Synthetic oligonucleotide
ctccagtggatgtatggctgcgacctg

SEQ ID NO: 380927 - DNA, 27 bp, Artificial Sequence
  Description of Artificial Sequence: Synthetic oligonucleotide
tccagtggatgtatggctgcgacctgg

SEQ ID NO: 380928 - DNA, 26 bp, Artificial Sequence
  Description of Artificial Sequence: Synthetic oligonucleotide
ccagtggatgtatggctgcgacctgg

SEQ ID NO: 380929 - DNA, 26 bp, Artificial Sequence
  Description of Artificial Sequence: Synthetic oligonucleotide
cagtggatgtatggctgcgacctggg

SEQ ID NO: 380930 - DNA, 26 bp, Artificial Sequence
  Description of Artificial Sequence: Synthetic oligonucleotide
agtggatgtatggctgcgacctgggg

SEQ ID NO: 380931 - DNA, 25 bp, Artificial Sequence
  Description of Artificial Sequence: Synthetic oligonucleotide
gtggatgtatggctgcgacctgggg

SEQ ID NO: 380932 - DNA, 25 bp, Artificial Sequence
  Description of Artificial Sequence: Synthetic oligonucleotide
tggatgtatggctgcgacctggggc

SEQ ID NO: 380933 - DNA, 32 bp, Artificial Sequence; identical to SEQ ID NO: 40898
  Description of Artificial Sequence: Synthetic oligonucleotide

SEQ ID NO: 380934 - DNA, 34 bp, Artificial Sequence; identical to SEQ ID NO: 40899
  Description of Artificial Sequence: Synthetic oligonucleotide

SEQ ID NO: 380935 - DNA, 34 bp, Artificial Sequence; identical to SEQ ID NO: 40900
  Description of Artificial Sequence: Synthetic oligonucleotide

SEQ ID NO: 380936 - DNA, 34 bp, Artificial Sequence; identical to SEQ ID NO: 40901
  Description of Artificial Sequence: Synthetic oligonucleotide

SEQ ID NO: 380937 - DNA, 33 bp, Artificial Sequence; identical to SEQ ID NO: 40902
  Description of Artificial Sequence: Synthetic oligonucleotide

SEQ ID NO: 380938 - DNA, 24 bp, Artificial Sequence
  Description of Artificial Sequence: Synthetic oligonucleotide
gacagcgacgccgcgagtccaaga

SEQ ID NO: 380939 - DNA, 24 bp, Artificial Sequence
  Description of Artificial Sequence: Synthetic oligonucleotide
acagcgacgccgcgagtccaagag

SEQ ID NO: 380940 - DNA, 23 bp, Artificial Sequence
  Description of Artificial Sequence: Synthetic oligonucleotide
cagcgacgccgcgagtccaagag

SEQ ID NO: 380941 - DNA, 23 bp, Artificial Sequence
  Description of Artificial Sequence: Synthetic oligonucleotide
agcgacgccgcgagtccaagagg

SEQ ID NO: 380942 - DNA, 22 bp, Artificial Sequence
  Description of Artificial Sequence: Synthetic oligonucleotide
gcgacgccgcgagtccaagagg

SEQ ID NO: 380943 - DNA, 22 bp, Artificial Sequence
  Description of Artificial Sequence: Synthetic oligonucleotide
cgacgccgcgagtccaagaggg

SEQ ID NO: 380944 - DNA, 23 bp, Artificial Sequence
  Description of Artificial Sequence: Synthetic oligonucleotide
gacgccgcgagtccaagagggga

SEQ ID NO: 380945 - DNA, 23 bp, Artificial Sequence
  Description of Artificial Sequence: Synthetic oligonucleotide
acgccgcgagtccaagaggggag

SEQ ID NO: 380946 - DNA, 22 bp, Artificial Sequence
  Description of Artificial Sequence: Synthetic oligonucleotide
cgccgcgagtccaagaggggag

SEQ ID NO: 380947 - DNA, 22 bp, Artificial Sequence
  Description of Artificial Sequence: Synthetic oligonucleotide
gccgcgagtccaagaggggagc

SEQ ID NO: 380948 - DNA, 22 bp, Artificial Sequence
  Description of Artificial Sequence: Synthetic oligonucleotide
ccgcgagtccaagaggggagcc

SEQ ID NO: 380949 - DNA, 22 bp, Artificial Sequence
  Description of Artificial Sequence: Synthetic oligonucleotide
cgcgagtccaagaggggagccg

SEQ ID NO: 380950 - DNA, 22 bp, Artificial Sequence
  Description of Artificial Sequence: Synthetic oligonucleotide
gcgagtccaagaggggagccgc

SEQ ID NO: 380951 - DNA, 22 bp, Artificial Sequence
  Description of Artificial Sequence: Synthetic oligonucleotide
cgagtccaagaggggagccgcg

SEQ ID NO: 380952 - DNA, 22 bp, Artificial Sequence
  Description of Artificial Sequence: Synthetic oligonucleotide
gagtccaagaggggagccgcgg

SEQ ID NO: 380953 - DNA, 22 bp, Artificial Sequence
  Description of Artificial Sequence: Synthetic oligonucleotide
agtccaagaggggagccgcggg

SEQ ID NO: 380954 - DNA, 21 bp, Artificial Sequence
  Description of Artificial Sequence: Synthetic oligonucleotide
gtccaagaggggagccgcggg

SEQ ID NO: 380955 - DNA, 21 bp, Artificial Sequence
  Description of Artificial Sequence: Synthetic oligonucleotide
tccaagaggggagccgcgggc

SEQ ID NO: 380956 - DNA, 20 bp, Artificial Sequence
  Description of Artificial Sequence: Synthetic oligonucleotide
ccaagaggggagccgcgggc

SEQ ID NO: 380957 - DNA, 20 bp, Artificial Sequence
  Description of Artificial Sequence: Synthetic oligonucleotide
caagaggggagccgcgggcg

SEQ ID NO: 380958 - DNA, 20 bp, Artificial Sequence
  Description of Artificial Sequence: Synthetic oligonucleotide
aagaggggagccgcgggcgc

SEQ ID NO: 380959 - DNA, 26 bp, Artificial Sequence
  Description of Artificial Sequence: Synthetic oligonucleotide
gtccccacttcccactcccattgggt

SEQ ID NO: 380960 - DNA, 33 bp, Artificial Sequence
  Description of Artificial Sequence: Synthetic oligonucleotide
gtgtcggatatctagagaagccaatcagcgttg

SEQ ID NO: 380961 - DNA, 33 bp, Artificial Sequence
  Description of Artificial Sequence: Synthetic oligonucleotide
tgtcggatatctagagaagccaatcagcgttgc

SEQ ID NO: 380962 - DNA, 32 bp, Artificial Sequence
  Description of Artificial Sequence: Synthetic oligonucleotide
gtcggatatctagagaagccaatcagcgttgc

SEQ ID NO: 380963 - DNA, 32 bp, Artificial Sequence
  Description of Artificial Sequence: Synthetic oligonucleotide
tcggatatctagagaagccaatcagcgttgcc

SEQ ID NO: 380964 - DNA, 31 bp, Artificial Sequence
  Description of Artificial Sequence: Synthetic oligonucleotide
cggatatctagagaagccaatcagcgttgcc

SEQ ID NO: 380965 - DNA, 31 bp, Artificial Sequence
  Description of Artificial Sequence: Synthetic oligonucleotide
ggatatctagagaagccaatcagcgttgccg

SEQ ID NO: 380966 - DNA, 31 bp, Artificial Sequence
  Description of Artificial Sequence: Synthetic oligonucleotide
gatatctagagaagccaatcagcgttgccgc

SEQ ID NO: 380967 - DNA, 31 bp, Artificial Sequence
  Description of Artificial Sequence: Synthetic oligonucleotide
atatctagagaagccaatcagcgttgccgcg

SEQ ID NO: 380968 - DNA, 30 bp, Artificial Sequence
  Description of Artificial Sequence: Synthetic oligonucleotide
tatctagagaagccaatcagcgttgccgcg

SEQ ID NO: 380969 - DNA, 29 bp, Artificial Sequence
  Description of Artificial Sequence: Synthetic oligonucleotide
atctagagaagccaatcagcgttgccgcg

SEQ ID NO: 380970 - DNA, 28 bp, Artificial Sequence
  Description of Artificial Sequence: Synthetic oligonucleotide
tctagagaagccaatcagcgttgccgcg

SEQ ID NO: 380971 - DNA, 27 bp, Artificial Sequence
  Description of Artificial Sequence: Synthetic oligonucleotide
ctagagaagccaatcagcgttgccgcg

SEQ ID NO: 380972 - DNA, 27 bp, Artificial Sequence
  Description of Artificial Sequence: Synthetic oligonucleotide
tagagaagccaatcagcgttgccgcgg

SEQ ID NO: 380973 - DNA, 27 bp, Artificial Sequence
  Description of Artificial Sequence: Synthetic oligonucleotide
agagaagccaatcagcgttgccgcggt

SEQ ID NO: 380974 - DNA, 26 bp, Artificial Sequence
  Description of Artificial Sequence: Synthetic oligonucleotide
gagaagccaatcagcgttgccgcggt

SEQ ID NO: 380975 - DNA, 26 bp, Artificial Sequence
  Description of Artificial Sequence: Synthetic oligonucleotide
agaagccaatcagcgttgccgcggtc

SEQ ID NO: 380976 - DNA, 25 bp, Artificial Sequence
  Description of Artificial Sequence: Synthetic oligonucleotide
gaagccaatcagcgttgccgcggtc

SEQ ID NO: 380977 - DNA, 25 bp, Artificial Sequence
  Description of Artificial Sequence: Synthetic oligonucleotide
aagccaatcagcgttgccgcggtcc

SEQ ID NO: 380978 - DNA, 24 bp, Artificial Sequence
  Description of Artificial Sequence: Synthetic oligonucleotide
agccaatcagcgttgccgcggtcc

SEQ ID NO: 380979 - DNA, 23 bp, Artificial Sequence
  Description of Artificial Sequence: Synthetic oligonucleotide
gccaatcagcgttgccgcggtcc

SEQ ID NO: 380980 - DNA, 24 bp, Artificial Sequence
  Description of Artificial Sequence: Synthetic oligonucleotide
ccaatcagcgttgccgcggtccca

SEQ ID NO: 380981 - DNA, 26 bp, Artificial Sequence
  Description of Artificial Sequence: Synthetic oligonucleotide
caatcagcgttgccgcggtcccagtt

SEQ ID NO: 380982 - DNA, 27 bp, Artificial Sequence
  Description of Artificial Sequence: Synthetic oligonucleotide
aatcagcgttgccgcggtcccagttct

SEQ ID NO: 380983 - DNA, 27 bp, Artificial Sequence
  Description of Artificial Sequence: Synthetic oligonucleotide
atcagcgttgccgcggtcccagttcta

SEQ ID NO: 380984 - DNA, 27 bp, Artificial Sequence
  Description of Artificial Sequence: Synthetic oligonucleotide
tcagcgttgccgcggtcccagttctaa

SEQ ID NO: 380985 - DNA, 27 bp, Artificial Sequence
  Description of Artificial Sequence: Synthetic oligonucleotide
cagcgttgccgcggtcccagttctaaa

SEQ ID NO: 380986 - DNA, 27 bp, Artificial Sequence
  Description of Artificial Sequence: Synthetic oligonucleotide
agcgttgccgcggtcccagttctaaag

SEQ ID NO: 380987 - DNA, 27 bp, Artificial Sequence
  Description of Artificial Sequence: Synthetic oligonucleotide
gcgttgccgcggtcccagttctaaagt

SEQ ID NO: 380988 - DNA, 27 bp, Artificial Sequence
  Description of Artificial Sequence: Synthetic oligonucleotide
cgttgccgcggtcccagttctaaagtc

SEQ ID NO: 380989 - DNA, 27 bp, Artificial Sequence
  Description of Artificial Sequence: Synthetic oligonucleotide
gttgccgcggtcccagttctaaagtcc

SEQ ID NO: 380990 - DNA, 27 bp, Artificial Sequence
  Description of Artificial Sequence: Synthetic oligonucleotide
ttgccgcggtcccagttctaaagtccc

SEQ ID NO: 380991 - DNA, 26 bp, Artificial Sequence
  Description of Artificial Sequence: Synthetic oligonucleotide
tgccgcggtcccagttctaaagtccc

SEQ ID NO: 380992 - DNA, 29 bp, Artificial Sequence
  Description of Artificial Sequence: Synthetic oligonucleotide
accggaacacacagatctgcaaggccaag

SEQ ID NO: 380993 - DNA, 28 bp, Artificial Sequence
  Description of Artificial Sequence: Synthetic oligonucleotide
ccggaacacacagatctgcaaggccaag

SEQ ID NO: 380994 - DNA, 28 bp, Artificial Sequence
  Description of Artificial Sequence: Synthetic oligonucleotide
cggaacacacagatctgcaaggccaagg

SEQ ID NO: 380995 - DNA, 28 bp, Artificial Sequence
  Description of Artificial Sequence: Synthetic oligonucleotide
ggaacacacagatctgcaaggccaaggc

SEQ ID NO: 380996 - DNA, 29 bp, Artificial Sequence
  Description of Artificial Sequence: Synthetic oligonucleotide
gaacacacagatctgcaaggccaaggcac

SEQ ID NO: 380997 - DNA, 30 bp, Artificial Sequence; identical to SEQ ID NO: 40929
  Description of Artificial Sequence: Synthetic oligonucleotide

SEQ ID NO: 380998 - DNA, 29 bp, Artificial Sequence
  Description of Artificial Sequence: Synthetic oligonucleotide
acacacagatctgcaaggccaaggcacag

SEQ ID NO: 380999 - DNA, 28 bp, Artificial Sequence
  Description of Artificial Sequence: Synthetic oligonucleotide
cacacagatctgcaaggccaaggcacag

SEQ ID NO: 381000 - DNA, 27 bp, Artificial Sequence
  Description of Artificial Sequence: Synthetic oligonucleotide
caaggccaaggcacagactgaccgagt

SEQ ID NO: 381001 - DNA, 27 bp, Artificial Sequence
  Description of Artificial Sequence: Synthetic oligonucleotide
aaggccaaggcacagactgaccgagtg

SEQ ID NO: 381002 - DNA, 26 bp, Artificial Sequence
  Description of Artificial Sequence: Synthetic oligonucleotide
aggccaaggcacagactgaccgagtg

SEQ ID NO: 381003 - DNA, 25 bp, Artificial Sequence
  Description of Artificial Sequence: Synthetic oligonucleotide
ggccaaggcacagactgaccgagtg

SEQ ID NO: 381004 - DNA, 25 bp, Artificial Sequence
  Description of Artificial Sequence: Synthetic oligonucleotide
gccaaggcacagactgaccgagtgg

SEQ ID NO: 381005 - DNA, 25 bp, Artificial Sequence
  Description of Artificial Sequence: Synthetic oligonucleotide
ccaaggcacagactgaccgagtggg

SEQ ID NO: 381006 - DNA, 25 bp, Artificial Sequence
  Description of Artificial Sequence: Synthetic oligonucleotide
caaggcacagactgaccgagtgggc

SEQ ID NO: 381007 - DNA, 26 bp, Artificial Sequence
  Description of Artificial Sequence: Synthetic oligonucleotide
aaggcacagactgaccgagtgggcct

SEQ ID NO: 381008 - DNA, 25 bp, Artificial Sequence
  Description of Artificial Sequence: Synthetic oligonucleotide
aggcacagactgaccgagtgggcct

SEQ ID NO: 381009 - DNA, 24 bp, Artificial Sequence
  Description of Artificial Sequence: Synthetic oligonucleotide
ggcacagactgaccgagtgggcct

SEQ ID NO: 381010 - DNA, 24 bp, Artificial Sequence
  Description of Artificial Sequence: Synthetic oligonucleotide
gcacagactgaccgagtgggcctg

SEQ ID NO: 381011 - DNA, 24 bp, Artificial Sequence
  Description of Artificial Sequence: Synthetic oligonucleotide
cacagactgaccgagtgggcctgc

SEQ ID NO: 381012 - DNA, 24 bp, Artificial Sequence
  Description of Artificial Sequence: Synthetic oligonucleotide
acagactgaccgagtgggcctgcg

SEQ ID NO: 381013 - DNA, 23 bp, Artificial Sequence
  Description of Artificial Sequence: Synthetic oligonucleotide
cagactgaccgagtgggcctgcg

SEQ ID NO: 381014 - DNA, 25 bp, Artificial Sequence
  Description of Artificial Sequence: Synthetic oligonucleotide
agactgaccgagtgggcctgcggaa

SEQ ID NO: 381015 - DNA, 24 bp, Artificial Sequence
  Description of Artificial Sequence: Synthetic oligonucleotide
gactgaccgagtgggcctgcggaa

SEQ ID NO: 381016 - DNA, 24 bp, Artificial Sequence
  Description of Artificial Sequence: Synthetic oligonucleotide
actgaccgagtgggcctgcggaac

SEQ ID NO: 381017 - DNA, 23 bp, Artificial Sequence
  Description of Artificial Sequence: Synthetic oligonucleotide
ctgaccgagtgggcctgcggaac

SEQ ID NO: 381018 - DNA, 24 bp, Artificial Sequence
  Description of Artificial Sequence: Synthetic oligonucleotide
tgaccgagtgggcctgcggaacct

SEQ ID NO: 381019 - DNA, 23 bp, Artificial Sequence
  Description of Artificial Sequence: Synthetic oligonucleotide
gaccgagtgggcctgcggaacct

SEQ ID NO: 381020 - DNA, 23 bp, Artificial Sequence
  Description of Artificial Sequence: Synthetic oligonucleotide
accgagtgggcctgcggaacctg

SEQ ID NO: 381021 - DNA, 22 bp, Artificial Sequence
  Description of Artificial Sequence: Synthetic oligonucleotide
ccgagtgggcctgcggaacctg

SEQ ID NO: 381022 - DNA, 22 bp, Artificial Sequence
  Description of Artificial Sequence: Synthetic oligonucleotide
cgagtgggcctgcggaacctgc

SEQ ID NO: 381023 - DNA, 22 bp, Artificial Sequence
  Description of Artificial Sequence: Synthetic oligonucleotide
gagtgggcctgcggaacctgcg

SEQ ID NO: 381024 - DNA, 22 bp, Artificial Sequence
  Description of Artificial Sequence: Synthetic oligonucleotide
agtgggcctgcggaacctgcgc

SEQ ID NO: 381025 - DNA, 21 bp, Artificial Sequence
  Description of Artificial Sequence: Synthetic oligonucleotide
gtgggcctgcggaacctgcgc

SEQ ID NO: 381026 - DNA, 21 bp, Artificial Sequence
  Description of Artificial Sequence: Synthetic oligonucleotide
tgggcctgcggaacctgcgcg

SEQ ID NO: 381027 - DNA, 20 bp, Artificial Sequence
  Description of Artificial Sequence: Synthetic oligonucleotide
gggcctgcggaacctgcgcg

SEQ ID NO: 381028 - DNA, 20 bp, Artificial Sequence
  Description of Artificial Sequence: Synthetic oligonucleotide
ggcctgcggaacctgcgcgg

SEQ ID NO: 381029 - DNA, 26 bp, Artificial Sequence
  Description of Artificial Sequence: Synthetic oligonucleotide
ggctactacaaccagagcgaggacgg

SEQ ID NO: 381030 - DNA, 27 bp, Artificial Sequence
  Description of Artificial Sequence: Synthetic oligonucleotide
gctactacaaccagagcgaggacgggt

SEQ ID NO: 381031 - DNA, 27 bp, Artificial Sequence
  Description of Artificial Sequence: Synthetic oligonucleotide
ctactacaaccagagcgaggacgggtc

SEQ ID NO: 381032 - DNA, 28 bp, Artificial Sequence
  Description of Artificial Sequence: Synthetic oligonucleotide
tactacaaccagagcgaggacgggtctc

SEQ ID NO: 381033 - DNA, 27 bp, Artificial Sequence
  Description of Artificial Sequence: Synthetic oligonucleotide
actacaaccagagcgaggacgggtctc

SEQ ID NO: 381034 - DNA, 27 bp, Artificial Sequence
  Description of Artificial Sequence: Synthetic oligonucleotide
ctacaaccagagcgaggacgggtctca

SEQ ID NO: 381035 - DNA, 27 bp, Artificial Sequence
  Description of Artificial Sequence: Synthetic oligonucleotide
tacaaccagagcgaggacgggtctcac

SEQ ID NO: 381036 - DNA, 27 bp, Artificial Sequence
  Description of Artificial Sequence: Synthetic oligonucleotide
acaaccagagcgaggacgggtctcaca

SEQ ID NO: 381037 - DNA, 26 bp, Artificial Sequence
  Description of Artificial Sequence: Synthetic oligonucleotide
caaccagagcgaggacgggtctcaca

SEQ ID NO: 381038 - DNA, 27 bp, Artificial Sequence
  Description of Artificial Sequence: Synthetic oligonucleotide
aaccagagcgaggacgggtctcacact

SEQ ID NO: 381039 - DNA, 27 bp, Artificial Sequence
  Description of Artificial Sequence: Synthetic oligonucleotide
accagagcgaggacgggtctcacactt

SEQ ID NO: 381040 - DNA, 26 bp, Artificial Sequence
  Description of Artificial Sequence: Synthetic oligonucleotide
ccagagcgaggacgggtctcacactt

SEQ ID NO: 381041 - DNA, 26 bp, Artificial Sequence
  Description of Artificial Sequence: Synthetic oligonucleotide
cagagcgaggacgggtctcacacttg

SEQ ID NO: 381042 - DNA, 26 bp, Artificial Sequence
  Description of Artificial Sequence: Synthetic oligonucleotide
agagcgaggacgggtctcacacttgg

SEQ ID NO: 381043 - DNA, 25 bp, Artificial Sequence
  Description of Artificial Sequence: Synthetic oligonucleotide
gagcgaggacgggtctcacacttgg

SEQ ID NO: 381044 - DNA, 26 bp, Artificial Sequence
  Description of Artificial Sequence: Synthetic oligonucleotide
agcgaggacgggtctcacacttggca

SEQ ID NO: 381045 - DNA, 25 bp, Artificial Sequence
  Description of Artificial Sequence: Synthetic oligonucleotide
gcgaggacgggtctcacacttggca

SEQ ID NO: 381046 - DNA, 26 bp, Artificial Sequence
  Description of Artificial Sequence: Synthetic oligonucleotide
cgaggacgggtctcacacttggcaga

SEQ ID NO: 381047 - DNA, 26 bp, Artificial Sequence
  Description of Artificial Sequence: Synthetic oligonucleotide
gaggacgggtctcacacttggcagac

SEQ ID NO: 381048 - DNA, 27 bp, Artificial Sequence
  Description of Artificial Sequence: Synthetic oligonucleotide
aggacgggtctcacacttggcagacga

SEQ ID NO: 381049 - DNA, 27 bp, Artificial Sequence
  Description of Artificial Sequence: Synthetic oligonucleotide
ggacgggtctcacacttggcagacgat

SEQ ID NO: 381050 - DNA, 27 bp, Artificial Sequence
  Description of Artificial Sequence: Synthetic oligonucleotide
gacgggtctcacacttggcagacgatg

SEQ ID NO: 381051 - DNA, 30 bp, Artificial Sequence; identical to SEQ ID NO: 40974
  Description of Artificial Sequence: Synthetic oligonucleotide

SEQ ID NO: 381052 - DNA, 30 bp, Artificial Sequence; identical to SEQ ID NO: 40975
  Description of Artificial Sequence: Synthetic oligonucleotide

SEQ ID NO: 381053 - DNA, 29 bp, Artificial Sequence
  Description of Artificial Sequence: Synthetic oligonucleotide
cttggcagacgatgtatggctgcgacatg

SEQ ID NO: 381054 - DNA, 29 bp, Artificial Sequence
  Description of Artificial Sequence: Synthetic oligonucleotide
ttggcagacgatgtatggctgcgacatgg

SEQ ID NO: 381055 - DNA, 28 bp, Artificial Sequence
  Description of Artificial Sequence: Synthetic oligonucleotide
tggcagacgatgtatggctgcgacatgg

SEQ ID NO: 381056 - DNA, 27 bp, Artificial Sequence
  Description of Artificial Sequence: Synthetic oligonucleotide
ggcagacgatgtatggctgcgacatgg

SEQ ID NO: 381057 - DNA, 27 bp, Artificial Sequence
  Description of Artificial Sequence: Synthetic oligonucleotide
gcagacgatgtatggctgcgacatggg

SEQ ID NO: 381058 - DNA, 27 bp, Artificial Sequence
  Description of Artificial Sequence: Synthetic oligonucleotide
cagacgatgtatggctgcgacatgggg

SEQ ID NO: 381059 - DNA, 27 bp, Artificial Sequence
  Description of Artificial Sequence: Synthetic oligonucleotide
agacgatgtatggctgcgacatggggc

SEQ ID NO: 381060 - DNA, 26 bp, Artificial Sequence
  Description of Artificial Sequence: Synthetic oligonucleotide
gacgatgtatggctgcgacatggggc

SEQ ID NO: 381061 - DNA, 26 bp, Artificial Sequence
  Description of Artificial Sequence: Synthetic oligonucleotide
acgatgtatggctgcgacatggggcc

SEQ ID NO: 381062 - DNA, 25 bp, Artificial Sequence
  Description of Artificial Sequence: Synthetic oligonucleotide
cgatgtatggctgcgacatggggcc

SEQ ID NO: 381063 - DNA, 25 bp, Artificial Sequence
  Description of Artificial Sequence: Synthetic oligonucleotide
gatgtatggctgcgacatggggccg

SEQ ID NO: 381064 - DNA, 26 bp, Artificial Sequence
  Description of Artificial Sequence: Synthetic oligonucleotide
atgtatggctgcgacatggggccgga

SEQ ID NO: 381065 - DNA, 25 bp, Artificial Sequence
  Description of Artificial Sequence: Synthetic oligonucleotide
tgtatggctgcgacatggggccgga

SEQ ID NO: 381066 - DNA, 24 bp, Artificial Sequence
  Description of Artificial Sequence: Synthetic oligonucleotide
gtatggctgcgacatggggccgga

SEQ ID NO: 381067 - DNA, 24 bp, Artificial Sequence
  Description of Artificial Sequence: Synthetic oligonucleotide
tatggctgcgacatggggccggac

SEQ ID NO: 381068 - DNA, 23 bp, Artificial Sequence
  Description of Artificial Sequence: Synthetic oligonucleotide
atggctgcgacatggggccggac

SEQ ID NO: 381069 - DNA, 22 bp, Artificial Sequence
  Description of Artificial Sequence: Synthetic oligonucleotide
tggctgcgacatggggccggac

SEQ ID NO: 381070 - DNA, 21 bp, Artificial Sequence
  Description of Artificial Sequence: Synthetic oligonucleotide
ggctgcgacatggggccggac

SEQ ID NO: 381071 - DNA, 21 bp, Artificial Sequence
  Description of Artificial Sequence: Synthetic oligonucleotide
gctgcgacatggggccggacg

SEQ ID NO: 381072 - DNA, 21 bp, Artificial Sequence
  Description of Artificial Sequence: Synthetic oligonucleotide
ctgcgacatggggccggacgg

SEQ ID NO: 381073 - DNA, 21 bp, Artificial Sequence
  Description of Artificial Sequence: Synthetic oligonucleotide
tgcgacatggggccggacggg

SEQ ID NO: 381074 - DNA, 20 bp, Artificial Sequence
  Description of Artificial Sequence: Synthetic oligonucleotide
gcgacatggggccggacggg

SEQ ID NO: 381075 - DNA, 20 bp, Artificial Sequence
  Description of Artificial Sequence: Synthetic oligonucleotide
cgacatggggccggacgggc

SEQ ID NO: 381076 - DNA, 20 bp, Artificial Sequence
  Description of Artificial Sequence: Synthetic oligonucleotide
gacatggggccggacgggcg

SEQ ID NO: 381077 - DNA, 20 bp, Artificial Sequence
  Description of Artificial Sequence: Synthetic oligonucleotide
acatggggccggacgggcgc

SEQ ID NO: 381078 - DNA, 20 bp, Artificial Sequence
  Description of Artificial Sequence: Synthetic oligonucleotide
catggggccggacgggcgct

SEQ ID NO: 381079 - DNA, 20 bp, Artificial Sequence
  Description of Artificial Sequence: Synthetic oligonucleotide
atggggccggacgggcgcct

SEQ ID NO: 381080 - DNA, 26 bp, Artificial Sequence
  Description of Artificial Sequence: Synthetic oligonucleotide
caggacaccgagcttgtggagaccag

SEQ ID NO: 381081 - DNA, 26 bp, Artificial Sequence
  Description of Artificial Sequence: Synthetic oligonucleotide
aggacaccgagcttgtggagaccagg

SEQ ID NO: 381082 - DNA, 25 bp, Artificial Sequence
  Description of Artificial Sequence: Synthetic oligonucleotide
ggacaccgagcttgtggagaccagg

SEQ ID NO: 381083 - DNA, 25 bp, Artificial Sequence
  Description of Artificial Sequence: Synthetic oligonucleotide
gacaccgagcttgtggagaccaggc

SEQ ID NO: 381084 - DNA, 26 bp, Artificial Sequence
  Description of Artificial Sequence: Synthetic oligonucleotide
acaccgagcttgtggagaccaggcca

SEQ ID NO: 381085 - DNA, 25 bp, Artificial Sequence
  Description of Artificial Sequence: Synthetic oligonucleotide
caccgagcttgtggagaccaggcca

SEQ ID NO: 381086 - DNA, 25 bp, Artificial Sequence
  Description of Artificial Sequence: Synthetic oligonucleotide
accgagcttgtggagaccaggccag

SEQ ID NO: 381087 - DNA, 24 bp, Artificial Sequence
  Description of Artificial Sequence: Synthetic oligonucleotide
ccgagcttgtggagaccaggccag

SEQ ID NO: 381088 - DNA, 25 bp, Artificial Sequence
  Description of Artificial Sequence: Synthetic oligonucleotide
cgagcttgtggagaccaggccagca

SEQ ID NO: 381089 - DNA, 25 bp, Artificial Sequence
  Description of Artificial Sequence: Synthetic oligonucleotide
gagcttgtggagaccaggccagcag

SEQ ID NO: 381090 - DNA, 26 bp, Artificial Sequence
  Description of Artificial Sequence: Synthetic oligonucleotide
agcttgtggagaccaggccagcagga

SEQ ID NO: 381091 - DNA, 25 bp, Artificial Sequence
  Description of Artificial Sequence: Synthetic oligonucleotide
gcttgtggagaccaggccagcagga

SEQ ID NO: 381092 - DNA, 27 bp, Artificial Sequence
  Description of Artificial Sequence: Synthetic oligonucleotide
cttgtggagaccaggccagcaggagat

SEQ ID NO: 381093 - DNA, 27 bp, Artificial Sequence
  Description of Artificial Sequence: Synthetic oligonucleotide
ttgtggagaccaggccagcaggagatg

SEQ ID NO: 381094 - DNA, 26 bp, Artificial Sequence
  Description of Artificial Sequence: Synthetic oligonucleotide
tgtggagaccaggccagcaggagatg

SEQ ID NO: 381095 - DNA, 25 bp, Artificial Sequence
  Description of Artificial Sequence: Synthetic oligonucleotide
gtggagaccaggccagcaggagatg

SEQ ID NO: 381096 - DNA, 27 bp, Artificial Sequence
  Description of Artificial Sequence: Synthetic oligonucleotide
tggagaccaggccagcaggagatggaa

SEQ ID NO: 381097 - DNA, 26 bp, Artificial Sequence
  Description of Artificial Sequence: Synthetic oligonucleotide
ggagaccaggccagcaggagatggaa

SEQ ID NO: 381098 - DNA, 26 bp, Artificial Sequence
  Description of Artificial Sequence: Synthetic oligonucleotide
gagaccaggccagcaggagatggaac

SEQ ID NO: 381099 - DNA, 27 bp, Artificial Sequence
  Description of Artificial Sequence: Synthetic oligonucleotide
agaccaggccagcaggagatggaacct

SEQ ID NO: 381100 - DNA, 27 bp, Artificial Sequence
  Description of Artificial Sequence: Synthetic oligonucleotide
gaccaggccagcaggagatggaacctt

SEQ ID NO: 381101 - DNA, 27 bp, Artificial Sequence
  Description of Artificial Sequence: Synthetic oligonucleotide
accaggccagcaggagatggaaccttc

SEQ ID NO: 381102 - DNA, 26 bp, Artificial Sequence
  Description of Artificial Sequence: Synthetic oligonucleotide
ccaggccagcaggagatggaaccttc

SEQ ID NO: 381103 - DNA, 27 bp, Artificial Sequence
  Description of Artificial Sequence: Synthetic oligonucleotide
caggccagcaggagatggaaccttcca

SEQ ID NO: 381104 - DNA, 27 bp, Artificial Sequence
  Description of Artificial Sequence: Synthetic oligonucleotide
aggccagcaggagatggaaccttccag

SEQ ID NO: 381105 - DNA, 27 bp, Artificial Sequence
  Description of Artificial Sequence: Synthetic oligonucleotide
ggccagcaggagatggaaccttccaga

SEQ ID NO: 381106 - DNA, 28 bp, Artificial Sequence
  Description of Artificial Sequence: Synthetic oligonucleotide
gccagcaggagatggaaccttccagaag

SEQ ID NO: 381107 - DNA, 29 bp, Artificial Sequence
  Description of Artificial Sequence: Synthetic oligonucleotide
ccagcaggagatggaaccttccagaagtg

SEQ ID NO: 381108 - DNA, 29 bp, Artificial Sequence
  Description of Artificial Sequence: Synthetic oligonucleotide
cagcaggagatggaaccttccagaagtgg

SEQ ID NO: 381109 - DNA, 29 bp, Artificial Sequence
  Description of Artificial Sequence: Synthetic oligonucleotide
agcaggagatggaaccttccagaagtggg

SEQ ID NO: 381110 - DNA, 28 bp, Artificial Sequence
  Description of Artificial Sequence: Synthetic oligonucleotide
gcaggagatggaaccttccagaagtggg

SEQ ID NO: 381111 - DNA, 28 bp, Artificial Sequence
  Description of Artificial Sequence: Synthetic oligonucleotide
caggagatggaaccttccagaagtgggc

SEQ ID NO: 381112 - DNA, 29 bp, Artificial Sequence
  Description of Artificial Sequence: Synthetic oligonucleotide
aggagatggaaccttccagaagtgggcag

SEQ ID NO: 381113 - DNA, 28 bp, Artificial Sequence
  Description of Artificial Sequence: Synthetic oligonucleotide
ggagatggaaccttccagaagtgggcag

SEQ ID NO: 381114 - DNA, 28 bp, Artificial Sequence
  Description of Artificial Sequence: Synthetic oligonucleotide
gagatggaaccttccagaagtgggcagc

SEQ ID NO: 381115 - DNA, 29 bp, Artificial Sequence
  Description of Artificial Sequence: Synthetic oligonucleotide
agatggaaccttccagaagtgggcagctg

SEQ ID NO: 381116 - DNA, 27 bp, Artificial Sequence
  Description of Artificial Sequence: Synthetic oligonucleotide
gcagctgtggtggtgccttctggacaa

SEQ ID NO: 381117 - DNA, 27 bp, Artificial Sequence
  Description of Artificial Sequence: Synthetic oligonucleotide
cagctgtggtggtgccttctggacaag

SEQ ID NO: 381118 - DNA, 29 bp, Artificial Sequence
  Description of Artificial Sequence: Synthetic oligonucleotide
agctgtggtggtgccttctggacaagaac

SEQ ID NO: 381119 - DNA, 28 bp, Artificial Sequence
  Description of Artificial Sequence: Synthetic oligonucleotide
gctgtggtggtgccttctggacaagaac

SEQ ID NO: 381120 - DNA, 29 bp, Artificial Sequence
  Description of Artificial Sequence: Synthetic oligonucleotide
ctgtggtggtgccttctggacaagaacag

SEQ ID NO: 381121 - DNA, 30 bp, Artificial Sequence; identical to SEQ ID NO: 41025
  Description of Artificial Sequence: Synthetic oligonucleotide

SEQ ID NO: 381122 - DNA, 29 bp, Artificial Sequence
  Description of Artificial Sequence: Synthetic oligonucleotide
gtggtggtgccttctggacaagaacagag

SEQ ID NO: 381123 - DNA, 32 bp, Artificial Sequence; identical to SEQ ID NO: 41027
  Description of Artificial Sequence: Synthetic oligonucleotide

SEQ ID NO: 381124 - DNA, 31 bp, Artificial Sequence; identical to SEQ ID NO: 41028
  Description of Artificial Sequence: Synthetic oligonucleotide

SEQ ID NO: 381125 - DNA, 32 bp, Artificial Sequence; identical to SEQ ID NO: 41029
  Description of Artificial Sequence: Synthetic oligonucleotide

SEQ ID NO: 381126 - DNA, 32 bp, Artificial Sequence; identical to SEQ ID NO: 41030
  Description of Artificial Sequence: Synthetic oligonucleotide

SEQ ID NO: 381127 - DNA, 31 bp, Artificial Sequence; identical to SEQ ID NO: 41031
  Description of Artificial Sequence: Synthetic oligonucleotide

SEQ ID NO: 381128 - DNA, 32 bp, Artificial Sequence; identical to SEQ ID NO: 41032
  Description of Artificial Sequence: Synthetic oligonucleotide

SEQ ID NO: 381129 - DNA, 32 bp, Artificial Sequence; identical to SEQ ID NO: 41033
  Description of Artificial Sequence: Synthetic oligonucleotide

SEQ ID NO: 381130 - DNA, 31 bp, Artificial Sequence; identical to SEQ ID NO: 41034
  Description of Artificial Sequence: Synthetic oligonucleotide

SEQ ID NO: 381131 - DNA, 31 bp, Artificial Sequence; identical to SEQ ID NO: 41035
  Description of Artificial Sequence: Synthetic oligonucleotide

SEQ ID NO: 381132 - DNA, 33 bp, Artificial Sequence; identical to SEQ ID NO: 41036
  Description of Artificial Sequence: Synthetic oligonucleotide

SEQ ID NO: 381133 - DNA, 34 bp, Artificial Sequence; identical to SEQ ID NO: 41037
  Description of Artificial Sequence: Synthetic oligonucleotide

SEQ ID NO: 381134 - DNA, 33 bp, Artificial Sequence; identical to SEQ ID NO: 41038
  Description of Artificial Sequence: Synthetic oligonucleotide

SEQ ID NO: 381135 - DNA, 32 bp, Artificial Sequence; identical to SEQ ID NO: 41039
  Description of Artificial Sequence: Synthetic oligonucleotide

SEQ ID NO: 381136 - DNA, 32 bp, Artificial Sequence; identical to SEQ ID NO: 41040
  Description of Artificial Sequence: Synthetic oligonucleotide

SEQ ID NO: 381137 - DNA, 31 bp, Artificial Sequence; identical to SEQ ID NO: 41041
  Description of Artificial Sequence: Synthetic oligonucleotide

SEQ ID NO: 381138 - DNA, 32 bp, Artificial Sequence; identical to SEQ ID NO: 41042
  Description of Artificial Sequence: Synthetic oligonucleotide

SEQ ID NO: 381139 - DNA, 32 bp, Artificial Sequence; identical to SEQ ID NO: 41043
  Description of Artificial Sequence: Synthetic oligonucleotide

SEQ ID NO: 381140 - DNA, 31 bp, Artificial Sequence; identical to SEQ ID NO: 41044
  Description of Artificial Sequence: Synthetic oligonucleotide

SEQ ID NO: 381141 - DNA, 32 bp, Artificial Sequence; identical to SEQ ID NO: 41045
  Description of Artificial Sequence: Synthetic oligonucleotide

SEQ ID NO: 381142 - DNA, 31 bp, Artificial Sequence; identical to SEQ ID NO: 41046
  Description of Artificial Sequence: Synthetic oligonucleotide

SEQ ID NO: 381143 - DNA, 30 bp, Artificial Sequence; identical to SEQ ID NO: 41047
  Description of Artificial Sequence: Synthetic oligonucleotide

SEQ ID NO: 381144 - DNA, 30 bp, Artificial Sequence; identical to SEQ ID NO: 41048
  Description of Artificial Sequence: Synthetic oligonucleotide

SEQ ID NO: 381145 - DNA, 29 bp, Artificial Sequence
  Description of Artificial Sequence: Synthetic oligonucleotide
acagagatacacgtgccatgtgcagcacg

SEQ ID NO: 381146 - DNA, 28 bp, Artificial Sequence
  Description of Artificial Sequence: Synthetic oligonucleotide
cagagatacacgtgccatgtgcagcacg

SEQ ID NO: 381147 - DNA, 29 bp, Artificial Sequence
  Description of Artificial Sequence: Synthetic oligonucleotide
agagatacacgtgccatgtgcagcacgag

SEQ ID NO: 381148 - DNA, 28 bp, Artificial Sequence
  Description of Artificial Sequence: Synthetic oligonucleotide
gagatacacgtgccatgtgcagcacgag

SEQ ID NO: 381149 - DNA, 28 bp, Artificial Sequence
  Description of Artificial Sequence: Synthetic oligonucleotide
agatacacgtgccatgtgcagcacgagg

SEQ ID NO: 381150 - DNA, 27 bp, Artificial Sequence
  Description of Artificial Sequence: Synthetic oligonucleotide
gatacacgtgccatgtgcagcacgagg

SEQ ID NO: 381151 - DNA, 27 bp, Artificial Sequence
  Description of Artificial Sequence: Synthetic oligonucleotide
atacacgtgccatgtgcagcacgaggg

SEQ ID NO: 381152 - DNA, 26 bp, Artificial Sequence
  Description of Artificial Sequence: Synthetic oligonucleotide
tacacgtgccatgtgcagcacgaggg

SEQ ID NO: 381153 - DNA, 25 bp, Artificial Sequence
  Description of Artificial Sequence: Synthetic oligonucleotide
acacgtgccatgtgcagcacgaggg

SEQ ID NO: 381154 - DNA, 24 bp, Artificial Sequence
  Description of Artificial Sequence: Synthetic oligonucleotide
cacgtgccatgtgcagcacgaggg

SEQ ID NO: 381155 - DNA, 24 bp, Artificial Sequence
  Description of Artificial Sequence: Synthetic oligonucleotide
acgtgccatgtgcagcacgagggg

SEQ ID NO: 381156 - DNA, 23 bp, Artificial Sequence
  Description of Artificial Sequence: Synthetic oligonucleotide
cgtgccatgtgcagcacgagggg

SEQ ID NO: 381157 - DNA, 24 bp, Artificial Sequence
  Description of Artificial Sequence: Synthetic oligonucleotide
gtgccatgtgcagcacgaggggct

SEQ ID NO: 381158 - DNA, 24 bp, Artificial Sequence
  Description of Artificial Sequence: Synthetic oligonucleotide
tgccatgtgcagcacgaggggctg

SEQ ID NO: 381159 - DNA, 23 bp, Artificial Sequence
  Description of Artificial Sequence: Synthetic oligonucleotide
gccatgtgcagcacgaggggctg

SEQ ID NO: 381160 - DNA, 24 bp, Artificial Sequence
  Description of Artificial Sequence: Synthetic oligonucleotide
ccatgtgcagcacgaggggctgca

SEQ ID NO: 381161 - DNA, 24 bp, Artificial Sequence
  Description of Artificial Sequence: Synthetic oligonucleotide
catgtgcagcacgaggggctgcag

SEQ ID NO: 381162 - DNA, 25 bp, Artificial Sequence
  Description of Artificial Sequence: Synthetic oligonucleotide
atgtgcagcacgaggggctgcagga

SEQ ID NO: 381163 - DNA, 24 bp, Artificial Sequence
  Description of Artificial Sequence: Synthetic oligonucleotide
tgtgcagcacgaggggctgcagga

SEQ ID NO: 381164 - DNA, 23 bp, Artificial Sequence
  Description of Artificial Sequence: Synthetic oligonucleotide
gtgcagcacgaggggctgcagga

SEQ ID NO: 381165 - DNA, 23 bp, Artificial Sequence
  Description of Artificial Sequence: Synthetic oligonucleotide
tgcagcacgaggggctgcaggag

SEQ ID NO: 381166 - DNA, 22 bp, Artificial Sequence
  Description of Artificial Sequence: Synthetic oligonucleotide
gcagcacgaggggctgcaggag

SEQ ID NO: 381167 - DNA, 22 bp, Artificial Sequence
  Description of Artificial Sequence: Synthetic oligonucleotide
cagcacgaggggctgcaggagc

SEQ ID NO: 381168 - DNA, 22 bp, Artificial Sequence
  Description of Artificial Sequence: Synthetic oligonucleotide
agcacgaggggctgcaggagcc

SEQ ID NO: 381169 - DNA, 21 bp, Artificial Sequence
  Description of Artificial Sequence: Synthetic oligonucleotide
gcacgaggggctgcaggagcc

SEQ ID NO: 381170 - DNA, 22 bp, Artificial Sequence
  Description of Artificial Sequence: Synthetic oligonucleotide
cacgaggggctgcaggagccct

SEQ ID NO: 381171 - DNA, 22 bp, Artificial Sequence
  Description of Artificial Sequence: Synthetic oligonucleotide
acgaggggctgcaggagccctg

SEQ ID NO: 381172 - DNA, 21 bp, Artificial Sequence
  Description of Artificial Sequence: Synthetic oligonucleotide
cgaggggctgcaggagccctg

SEQ ID NO: 381173 - DNA, 22 bp, Artificial Sequence
  Description of Artificial Sequence: Synthetic oligonucleotide
gaggggctgcaggagccctgca

SEQ ID NO: 381174 - DNA, 22 bp, Artificial Sequence
  Description of Artificial Sequence: Synthetic oligonucleotide
aggggctgcaggagccctgcac

SEQ ID NO: 381175 - DNA, 21 bp, Artificial Sequence
  Description of Artificial Sequence: Synthetic oligonucleotide
ggggctgcaggagccctgcac

SEQ ID NO: 381176 - DNA, 21 bp, Artificial Sequence
  Description of Artificial Sequence: Synthetic oligonucleotide
gggctgcaggagccctgcacc

SEQ ID NO: 381177 - DNA, 22 bp, Artificial Sequence
  Description of Artificial Sequence: Synthetic oligonucleotide
ggctgcaggagccctgcaccct

SEQ ID NO: 381178 - DNA, 23 bp, Artificial Sequence
  Description of Artificial Sequence: Synthetic oligonucleotide
gctgcaggagccctgcaccctga

SEQ ID NO: 381179 - DNA, 25 bp, Artificial Sequence
  Description of Artificial Sequence: Synthetic oligonucleotide
ctgcaggagccctgcaccctgagat

SEQ ID NO: 381180 - DNA, 25 bp, Artificial Sequence
  Description of Artificial Sequence: Synthetic oligonucleotide
tgcaggagccctgcaccctgagatg

SEQ ID NO: 381181 - DNA, 24 bp, Artificial Sequence
  Description of Artificial Sequence: Synthetic oligonucleotide
gcaggagccctgcaccctgagatg

SEQ ID NO: 381182 - DNA, 26 bp, Artificial Sequence
  Description of Artificial Sequence: Synthetic oligonucleotide
caggagccctgcaccctgagatggaa

SEQ ID NO: 381183 - DNA, 26 bp, Artificial Sequence
  Description of Artificial Sequence: Synthetic oligonucleotide
aggagccctgcaccctgagatggaag

SEQ ID NO: 381184 - DNA, 25 bp, Artificial Sequence
  Description of Artificial Sequence: Synthetic oligonucleotide
ggagccctgcaccctgagatggaag

SEQ ID NO: 381185 - DNA, 25 bp, Artificial Sequence
  Description of Artificial Sequence: Synthetic oligonucleotide
gagccctgcaccctgagatggaagc

SEQ ID NO: 381186 - DNA, 27 bp, Artificial Sequence
  Description of Artificial Sequence: Synthetic oligonucleotide
agccctgcaccctgagatggaagccat

SEQ ID NO: 381187 - DNA, 26 bp, Artificial Sequence
  Description of Artificial Sequence: Synthetic oligonucleotide
gccctgcaccctgagatggaagccat

SEQ ID NO: 381188 - DNA, 27 bp, Artificial Sequence
  Description of Artificial Sequence: Synthetic oligonucleotide
ccctgcaccctgagatggaagccatct

SEQ ID NO: 381189 - DNA, 28 bp, Artificial Sequence
  Description of Artificial Sequence: Synthetic oligonucleotide
cctgcaccctgagatggaagccatcttc

SEQ ID NO: 381190 - DNA, 28 bp, Artificial Sequence
  Description of Artificial Sequence: Synthetic oligonucleotide
ctgcaccctgagatggaagccatcttcc

SEQ ID NO: 381191 - DNA, 28 bp, Artificial Sequence
  Description of Artificial Sequence: Synthetic oligonucleotide
tgcaccctgagatggaagccatcttccc

SEQ ID NO: 381192 - DNA, 27 bp, Artificial Sequence
  Description of Artificial Sequence: Synthetic oligonucleotide
gcaccctgagatggaagccatcttccc

SEQ ID NO: 381193 - DNA, 28 bp, Artificial Sequence
  Description of Artificial Sequence: Synthetic oligonucleotide
caccctgagatggaagccatcttcccag

SEQ ID NO: 381194 - DNA, 29 bp, Artificial Sequence
  Description of Artificial Sequence: Synthetic oligonucleotide
accctgagatggaagccatcttcccagtc

SEQ ID NO: 381195 - DNA, 28 bp, Artificial Sequence
  Description of Artificial Sequence: Synthetic oligonucleotide
ccctgagatggaagccatcttcccagtc

SEQ ID NO: 381196 - DNA, 28 bp, Artificial Sequence
  Description of Artificial Sequence: Synthetic oligonucleotide
cctgagatggaagccatcttcccagtcc

SEQ ID NO: 381197 - DNA, 29 bp, Artificial Sequence
  Description of Artificial Sequence: Synthetic oligonucleotide
ctgagatggaagccatcttcccagtccac

SEQ ID NO: 381198 - DNA, 29 bp, Artificial Sequence
  Description of Artificial Sequence: Synthetic oligonucleotide
tgagatggaagccatcttcccagtccacc

SEQ ID NO: 381199 - DNA, 28 bp, Artificial Sequence
  Description of Artificial Sequence: Synthetic oligonucleotide
gagatggaagccatcttcccagtccacc

SEQ ID NO: 381200 - DNA, 30 bp, Artificial Sequence; identical to SEQ ID NO: 41104
  Description of Artificial Sequence: Synthetic oligonucleotide

SEQ ID NO: 381201 - DNA, 29 bp, Artificial Sequence
  Description of Artificial Sequence: Synthetic oligonucleotide
gatggaagccatcttcccagtccaccatc

SEQ ID NO: 381202 - DNA, 29 bp, Artificial Sequence
  Description of Artificial Sequence: Synthetic oligonucleotide
atggaagccatcttcccagtccaccatcc

SEQ ID NO: 381203 - DNA, 28 bp, Artificial Sequence
  Description of Artificial Sequence: Synthetic oligonucleotide
tggaagccatcttcccagtccaccatcc

SEQ ID NO: 381204 - DNA, 27 bp, Artificial Sequence
  Description of Artificial Sequence: Synthetic oligonucleotide
ggaagccatcttcccagtccaccatcc

SEQ ID NO: 381205 - DNA, 27 bp, Artificial Sequence
  Description of Artificial Sequence: Synthetic oligonucleotide
gaagccatcttcccagtccaccatccc

SEQ ID NO: 381206 - DNA, 27 bp, Artificial Sequence
  Description of Artificial Sequence: Synthetic oligonucleotide
aagccatcttcccagtccaccatcccc

SEQ ID NO: 381207 - DNA, 27 bp, Artificial Sequence
  Description of Artificial Sequence: Synthetic oligonucleotide
ggcattgttgctggcctggctgtcctt

SEQ ID NO: 381208 - DNA, 27 bp, Artificial Sequence
  Description of Artificial Sequence: Synthetic oligonucleotide
gcattgttgctggcctggctgtccttg

SEQ ID NO: 381209 - DNA, 28 bp, Artificial Sequence
  Description of Artificial Sequence: Synthetic oligonucleotide
cattgttgctggcctggctgtccttgtg

SEQ ID NO: 381210 - DNA, 28 bp, Artificial Sequence
  Description of Artificial Sequence: Synthetic oligonucleotide
attgttgctggcctggctgtccttgtgg

SEQ ID NO: 381211 - DNA, 27 bp, Artificial Sequence
  Description of Artificial Sequence: Synthetic oligonucleotide
ttgttgctggcctggctgtccttgtgg

SEQ ID NO: 381212 - DNA, 27 bp, Artificial Sequence
  Description of Artificial Sequence: Synthetic oligonucleotide
tgttgctggcctggctgtccttgtggt

SEQ ID NO: 381213 - DNA, 26 bp, Artificial Sequence
  Description of Artificial Sequence: Synthetic oligonucleotide
gttgctggcctggctgtccttgtggt

SEQ ID NO: 381214 - DNA, 27 bp, Artificial Sequence
  Description of Artificial Sequence: Synthetic oligonucleotide
ttgctggcctggctgtccttgtggtca

SEQ ID NO: 381215 - DNA, 26 bp, Artificial Sequence
  Description of Artificial Sequence: Synthetic oligonucleotide
tgctggcctggctgtccttgtggtca

SEQ ID NO: 381216 - DNA, 25 bp, Artificial Sequence
  Description of Artificial Sequence: Synthetic oligonucleotide
gctggcctggctgtccttgtggtca

SEQ ID NO: 381217 - DNA, 25 bp, Artificial Sequence
  Description of Artificial Sequence: Synthetic oligonucleotide
ctggcctggctgtccttgtggtcac

SEQ ID NO: 381218 - DNA, 25 bp, Artificial Sequence
  Description of Artificial Sequence: Synthetic oligonucleotide
tggcctggctgtccttgtggtcacc

SEQ ID NO: 381219 - DNA, 24 bp, Artificial Sequence
  Description of Artificial Sequence: Synthetic oligonucleotide
ggcctggctgtccttgtggtcacc

SEQ ID NO: 381220 - DNA, 26 bp, Artificial Sequence
  Description of Artificial Sequence: Synthetic oligonucleotide
gcctggctgtccttgtggtcaccgta

SEQ ID NO: 381221 - DNA, 26 bp, Artificial Sequence
  Description of Artificial Sequence: Synthetic oligonucleotide
cctggctgtccttgtggtcaccgtag

SEQ ID NO: 381222 - DNA, 27 bp, Artificial Sequence
  Description of Artificial Sequence: Synthetic oligonucleotide
ctggctgtccttgtggtcaccgtagct

SEQ ID NO: 381223 - DNA, 27 bp, Artificial Sequence
  Description of Artificial Sequence: Synthetic oligonucleotide
tggctgtccttgtggtcaccgtagctg

SEQ ID NO: 381224 - DNA, 27 bp, Artificial Sequence
  Description of Artificial Sequence: Synthetic oligonucleotide
ggctgtccttgtggtcaccgtagctgt

SEQ ID NO: 381225 - DNA, 27 bp, Artificial Sequence
  Description of Artificial Sequence: Synthetic oligonucleotide
gctgtccttgtggtcaccgtagctgtg

SEQ ID NO: 381226 - DNA, 27 bp, Artificial Sequence
  Description of Artificial Sequence: Synthetic oligonucleotide
ctgtccttgtggtcaccgtagctgtgg

SEQ ID NO: 381227 - DNA, 28 bp, Artificial Sequence
  Description of Artificial Sequence: Synthetic oligonucleotide
tgtccttgtggtcaccgtagctgtggtc

SEQ ID NO: 381228 - DNA, 27 bp, Artificial Sequence
  Description of Artificial Sequence: Synthetic oligonucleotide
gtccttgtggtcaccgtagctgtggtc

SEQ ID NO: 381229 - DNA, 27 bp, Artificial Sequence
  Description of Artificial Sequence: Synthetic oligonucleotide
tccttgtggtcaccgtagctgtggtcg

SEQ ID NO: 381230 - DNA, 26 bp, Artificial Sequence
  Description of Artificial Sequence: Synthetic oligonucleotide
ccttgtggtcaccgtagctgtggtcg

SEQ ID NO: 381231 - DNA, 27 bp, Artificial Sequence
  Description of Artificial Sequence: Synthetic oligonucleotide
cttgtggtcaccgtagctgtggtcgct

SEQ ID NO: 381232 - DNA, 27 bp, Artificial Sequence
  Description of Artificial Sequence: Synthetic oligonucleotide
ttgtggtcaccgtagctgtggtcgctg

SEQ ID NO: 381233 - DNA, 27 bp, Artificial Sequence
  Description of Artificial Sequence: Synthetic oligonucleotide
tgtggtcaccgtagctgtggtcgctgt

SEQ ID NO: 381234 - DNA, 26 bp, Artificial Sequence
  Description of Artificial Sequence: Synthetic oligonucleotide
gtggtcaccgtagctgtggtcgctgt

SEQ ID NO: 381235 - DNA, 26 bp, Artificial Sequence
  Description of Artificial Sequence: Synthetic oligonucleotide
tggtcaccgtagctgtggtcgctgtg

SEQ ID NO: 381236 - DNA, 25 bp, Artificial Sequence
  Description of Artificial Sequence: Synthetic oligonucleotide
ggtcaccgtagctgtggtcgctgtg

SEQ ID NO: 381237 - DNA, 26 bp, Artificial Sequence
  Description of Artificial Sequence: Synthetic oligonucleotide
gtcaccgtagctgtggtcgctgtggt

SEQ ID NO: 381238 - DNA, 26 bp, Artificial Sequence
  Description of Artificial Sequence: Synthetic oligonucleotide
tcaccgtagctgtggtcgctgtggtc

SEQ ID NO: 381239 - DNA, 25 bp, Artificial Sequence
  Description of Artificial Sequence: Synthetic oligonucleotide
caccgtagctgtggtcgctgtggtc

SEQ ID NO: 381240 - DNA, 25 bp, Artificial Sequence
  Description of Artificial Sequence: Synthetic oligonucleotide
accgtagctgtggtcgctgtggtcg

SEQ ID NO: 381241 - DNA, 24 bp, Artificial Sequence
  Description of Artificial Sequence: Synthetic oligonucleotide
ccgtagctgtggtcgctgtggtcg

SEQ ID NO: 381242 - DNA, 25 bp, Artificial Sequence
  Description of Artificial Sequence: Synthetic oligonucleotide
cgtagctgtggtcgctgtggtcgct

SEQ ID NO: 381243 - DNA, 25 bp, Artificial Sequence
  Description of Artificial Sequence: Synthetic oligonucleotide
gtagctgtggtcgctgtggtcgctg

SEQ ID NO: 381244 - DNA, 26 bp, Artificial Sequence
  Description of Artificial Sequence: Synthetic oligonucleotide
tagctgtggtcgctgtggtcgctgct

SEQ ID NO: 381245 - DNA, 25 bp, Artificial Sequence
  Description of Artificial Sequence: Synthetic oligonucleotide
agctgtggtcgctgtggtcgctgct

SEQ ID NO: 381246 - DNA, 24 bp, Artificial Sequence
  Description of Artificial Sequence: Synthetic oligonucleotide
gctgtggtcgctgtggtcgctgct

SEQ ID NO: 381247 - DNA, 25 bp, Artificial Sequence
  Description of Artificial Sequence: Synthetic oligonucleotide
ctgtggtcgctgtggtcgctgctgt

SEQ ID NO: 381248 - DNA, 27 bp, Artificial Sequence
  Description of Artificial Sequence: Synthetic oligonucleotide
tgtggtcgctgtggtcgctgctgtgat

SEQ ID NO: 381249 - DNA, 26 bp, Artificial Sequence
  Description of Artificial Sequence: Synthetic oligonucleotide
gtggtcgctgtggtcgctgctgtgat

SEQ ID NO: 381250 - DNA, 27 bp, Artificial Sequence
  Description of Artificial Sequence: Synthetic oligonucleotide
tggtcgctgtggtcgctgctgtgatgt

SEQ ID NO: 381251 - DNA, 26 bp, Artificial Sequence
  Description of Artificial Sequence: Synthetic oligonucleotide
ggtcgctgtggtcgctgctgtgatgt

SEQ ID NO: 381252 - DNA, 27 bp, Artificial Sequence
  Description of Artificial Sequence: Synthetic oligonucleotide
gtcgctgtggtcgctgctgtgatgtgt

SEQ ID NO: 381253 - DNA, 28 bp, Artificial Sequence
  Description of Artificial Sequence: Synthetic oligonucleotide
tcgctgtggtcgctgctgtgatgtgtag

SEQ ID NO: 381254 - DNA, 27 bp, Artificial Sequence
  Description of Artificial Sequence: Synthetic oligonucleotide
cgctgtggtcgctgctgtgatgtgtag

SEQ ID NO: 381255 - DNA, 28 bp, Artificial Sequence
  Description of Artificial Sequence: Synthetic oligonucleotide
tccggagtattgggaccggaacacacag

SEQ ID NO: 381256 - DNA, 31 bp, Artificial Sequence; identical to SEQ ID NO: 41159
  Description of Artificial Sequence: Synthetic oligonucleotide

SEQ ID NO: 381257 - DNA, 31 bp, Artificial Sequence; identical to SEQ ID NO: 41160
  Description of Artificial Sequence: Synthetic oligonucleotide

SEQ ID NO: 381258 - DNA, 32 bp, Artificial Sequence; identical to SEQ ID NO: 41161
  Description of Artificial Sequence: Synthetic oligonucleotide

SEQ ID NO: 381259 - DNA, 31 bp, Artificial Sequence; identical to SEQ ID NO: 41162
  Description of Artificial Sequence: Synthetic oligonucleotide

SEQ ID NO: 381260 - DNA, 31 bp, Artificial Sequence; identical to SEQ ID NO: 41163
  Description of Artificial Sequence: Synthetic oligonucleotide

SEQ ID NO: 381261 - DNA, 35 bp, Artificial Sequence; identical to SEQ ID NO: 41164
  Description of Artificial Sequence: Synthetic oligonucleotide

SEQ ID NO: 381262 - DNA, 34 bp, Artificial Sequence; identical to SEQ ID NO: 41165
  Description of Artificial Sequence: Synthetic oligonucleotide

SEQ ID NO: 381263 - DNA, 34 bp, Artificial Sequence; identical to SEQ ID NO: 41166
  Description of Artificial Sequence: Synthetic oligonucleotide

SEQ ID NO: 381264 - DNA, 33 bp, Artificial Sequence; identical to SEQ ID NO: 41167
  Description of Artificial Sequence: Synthetic oligonucleotide

SEQ ID NO: 381265 - DNA, 34 bp, Artificial Sequence; identical to SEQ ID NO: 41168
  Description of Artificial Sequence: Synthetic oligonucleotide

SEQ ID NO: 381266 - DNA, 33 bp, Artificial Sequence; identical to SEQ ID NO: 41169
  Description of Artificial Sequence: Synthetic oligonucleotide

SEQ ID NO: 381267 - DNA, 32 bp, Artificial Sequence; identical to SEQ ID NO: 41170
  Description of Artificial Sequence: Synthetic oligonucleotide

SEQ ID NO: 381268 - DNA, 32 bp, Artificial Sequence; identical to SEQ ID NO: 41171
  Description of Artificial Sequence: Synthetic oligonucleotide

SEQ ID NO: 381269 - DNA, 31 bp, Artificial Sequence; identical to SEQ ID NO: 41172
  Description of Artificial Sequence: Synthetic oligonucleotide

SEQ ID NO: 381270 - DNA, 31 bp, Artificial Sequence; identical to SEQ ID NO: 41173
  Description of Artificial Sequence: Synthetic oligonucleotide

SEQ ID NO: 381271 - DNA, 30 bp, Artificial Sequence; identical to SEQ ID NO: 41174
  Description of Artificial Sequence: Synthetic oligonucleotide

SEQ ID NO: 381272 - DNA, 29 bp, Artificial Sequence
  Description of Artificial Sequence: Synthetic oligonucleotide
ggaggaagagttctggtggaaaaggaggg

SEQ ID NO: 381273 - DNA, 30 bp, Artificial Sequence; identical to SEQ ID NO: 41176
  Description of Artificial Sequence: Synthetic oligonucleotide

SEQ ID NO: 381274 - DNA, 30 bp, Artificial Sequence; identical to SEQ ID NO: 41177
  Description of Artificial Sequence: Synthetic oligonucleotide

SEQ ID NO: 381275 - DNA, 29 bp, Artificial Sequence
  Description of Artificial Sequence: Synthetic oligonucleotide
ggaagagttctggtggaaaaggagggagc

SEQ ID NO: 381276 - DNA, 31 bp, Artificial Sequence; identical to SEQ ID NO: 41179
  Description of Artificial Sequence: Synthetic oligonucleotide

SEQ ID NO: 381277 - DNA, 32 bp, Artificial Sequence; identical to SEQ ID NO: 41180
  Description of Artificial Sequence: Synthetic oligonucleotide

SEQ ID NO: 381278 - DNA, 31 bp, Artificial Sequence; identical to SEQ ID NO: 41181
  Description of Artificial Sequence: Synthetic oligonucleotide

SEQ ID NO: 381279 - DNA, 30 bp, Artificial Sequence; identical to SEQ ID NO: 41182
  Description of Artificial Sequence: Synthetic oligonucleotide

SEQ ID NO: 381280 - DNA, 31 bp, Artificial Sequence; identical to SEQ ID NO: 41183
  Description of Artificial Sequence: Synthetic oligonucleotide

SEQ ID NO: 381281 - DNA, 30 bp, Artificial Sequence; identical to SEQ ID NO: 41184
  Description of Artificial Sequence: Synthetic oligonucleotide

SEQ ID NO: 381282 - DNA, 31 bp, Artificial Sequence; identical to SEQ ID NO: 41185
  Description of Artificial Sequence: Synthetic oligonucleotide

SEQ ID NO: 381283 - DNA, 30 bp, Artificial Sequence; identical to SEQ ID NO: 41186
  Description of Artificial Sequence: Synthetic oligonucleotide

SEQ ID NO: 381284 - DNA, 29 bp, Artificial Sequence
  Description of Artificial Sequence: Synthetic oligonucleotide
ctggtggaaaaggagggagctactctcag

SEQ ID NO: 381285 - DNA, 29 bp, Artificial Sequence
  Description of Artificial Sequence: Synthetic oligonucleotide
tggtggaaaaggagggagctactctcagg

SEQ ID NO: 381286 - DNA, 27 bp, Artificial Sequence
  Description of Artificial Sequence: Synthetic oligonucleotide
cctccagaggatgtttggctgcgacct

SEQ ID NO: 381287 - DNA, 27 bp, Artificial Sequence
  Description of Artificial Sequence: Synthetic oligonucleotide
ctccagaggatgtttggctgcgacctg

SEQ ID NO: 381288 - DNA, 26 bp, Artificial Sequence
  Description of Artificial Sequence: Synthetic oligonucleotide
gagcaggacagagcctacctggagga

SEQ ID NO: 381289 - DNA, 26 bp, Artificial Sequence
  Description of Artificial Sequence: Synthetic oligonucleotide
agcaggacagagcctacctggaggac

SEQ ID NO: 381290 - DNA, 25 bp, Artificial Sequence
  Description of Artificial Sequence: Synthetic oligonucleotide
gcaggacagagcctacctggaggac

SEQ ID NO: 381291 - DNA, 26 bp, Artificial Sequence
  Description of Artificial Sequence: Synthetic oligonucleotide
caggacagagcctacctggaggacct

SEQ ID NO: 381292 - DNA, 27 bp, Artificial Sequence
  Description of Artificial Sequence: Synthetic oligonucleotide
aggacagagcctacctggaggacctgt

SEQ ID NO: 381293 - DNA, 26 bp, Artificial Sequence
  Description of Artificial Sequence: Synthetic oligonucleotide
ggacagagcctacctggaggacctgt

SEQ ID NO: 381294 - DNA, 26 bp, Artificial Sequence
  Description of Artificial Sequence: Synthetic oligonucleotide
gacagagcctacctggaggacctgtg

SEQ ID NO: 381295 - DNA, 26 bp, Artificial Sequence
  Description of Artificial Sequence: Synthetic oligonucleotide
acagagcctacctggaggacctgtgc

SEQ ID NO: 381296 - DNA, 25 bp, Artificial Sequence
  Description of Artificial Sequence: Synthetic oligonucleotide
cagagcctacctggaggacctgtgc

SEQ ID NO: 381297 - DNA, 26 bp, Artificial Sequence
  Description of Artificial Sequence: Synthetic oligonucleotide
agagcctacctggaggacctgtgcgt

SEQ ID NO: 381298 - DNA, 25 bp, Artificial Sequence
  Description of Artificial Sequence: Synthetic oligonucleotide
gagcctacctggaggacctgtgcgt

SEQ ID NO: 381299 - DNA, 25 bp, Artificial Sequence
  Description of Artificial Sequence: Synthetic oligonucleotide
agcctacctggaggacctgtgcgtg

SEQ ID NO: 381300 - DNA, 24 bp, Artificial Sequence
  Description of Artificial Sequence: Synthetic oligonucleotide
gcctacctggaggacctgtgcgtg

SEQ ID NO: 381301 - DNA, 25 bp, Artificial Sequence
  Description of Artificial Sequence: Synthetic oligonucleotide
cctacctggaggacctgtgcgtgga

SEQ ID NO: 381302 - DNA, 26 bp, Artificial Sequence
  Description of Artificial Sequence: Synthetic oligonucleotide
ctacctggaggacctgtgcgtggagt

SEQ ID NO: 381303 - DNA, 26 bp, Artificial Sequence
  Description of Artificial Sequence: Synthetic oligonucleotide
tacctggaggacctgtgcgtggagtc

SEQ ID NO: 381304 - DNA, 25 bp, Artificial Sequence
  Description of Artificial Sequence: Synthetic oligonucleotide
acctggaggacctgtgcgtggagtc

SEQ ID NO: 381305 - DNA, 24 bp, Artificial Sequence
  Description of Artificial Sequence: Synthetic oligonucleotide
cctggaggacctgtgcgtggagtc

SEQ ID NO: 381306 - DNA, 24 bp, Artificial Sequence
  Description of Artificial Sequence: Synthetic oligonucleotide
ctggaggacctgtgcgtggagtcg

SEQ ID NO: 381307 - DNA, 25 bp, Artificial Sequence
  Description of Artificial Sequence: Synthetic oligonucleotide
tggaggacctgtgcgtggagtcgct

SEQ ID NO: 381308 - DNA, 24 bp, Artificial Sequence
  Description of Artificial Sequence: Synthetic oligonucleotide
ggaggacctgtgcgtggagtcgct

SEQ ID NO: 381309 - DNA, 24 bp, Artificial Sequence
  Description of Artificial Sequence: Synthetic oligonucleotide
gaggacctgtgcgtggagtcgctc

SEQ ID NO: 381310 - DNA, 24 bp, Artificial Sequence
  Description of Artificial Sequence: Synthetic oligonucleotide
aggacctgtgcgtggagtcgctcc

SEQ ID NO: 381311 - DNA, 23 bp, Artificial Sequence
  Description of Artificial Sequence: Synthetic oligonucleotide
ggacctgtgcgtggagtcgctcc

SEQ ID NO: 381312 - DNA, 23 bp, Artificial Sequence
  Description of Artificial Sequence: Synthetic oligonucleotide
gacctgtgcgtggagtcgctccg

SEQ ID NO: 381313 - DNA, 24 bp, Artificial Sequence
  Description of Artificial Sequence: Synthetic oligonucleotide
acctgtgcgtggagtcgctccgca

SEQ ID NO: 381314 - DNA, 30 bp, Artificial Sequence; identical to SEQ ID NO: 41272
  Description of Artificial Sequence: Synthetic oligonucleotide

SEQ ID NO: 381315 - DNA, 29 bp, Artificial Sequence
  Description of Artificial Sequence: Synthetic oligonucleotide
agcagttgtggtcatcggagctgtggttg

SEQ ID NO: 381316 - DNA, 28 bp, Artificial Sequence
  Description of Artificial Sequence: Synthetic oligonucleotide
gcagttgtggtcatcggagctgtggttg

SEQ ID NO: 381317 - DNA, 28 bp, Artificial Sequence
  Description of Artificial Sequence: Synthetic oligonucleotide
cagttgtggtcatcggagctgtggttgc

SEQ ID NO: 381318 - DNA, 30 bp, Artificial Sequence; identical to SEQ ID NO: 41276
  Description of Artificial Sequence: Synthetic oligonucleotide

SEQ ID NO: 381319 - DNA, 29 bp, Artificial Sequence
  Description of Artificial Sequence: Synthetic oligonucleotide
gttgtggtcatcggagctgtggttgctac

SEQ ID NO: 381320 - DNA, 30 bp, Artificial Sequence; identical to SEQ ID NO: 41278
  Description of Artificial Sequence: Synthetic oligonucleotide

SEQ ID NO: 381321 - DNA, 29 bp, Artificial Sequence
  Description of Artificial Sequence: Synthetic oligonucleotide
tgtggtcatcggagctgtggttgctactg

SEQ ID NO: 381322 - DNA, 28 bp, Artificial Sequence
  Description of Artificial Sequence: Synthetic oligonucleotide
gtggtcatcggagctgtggttgctactg

SEQ ID NO: 381323 - DNA, 29 bp, Artificial Sequence
  Description of Artificial Sequence: Synthetic oligonucleotide
tggtcatcggagctgtggttgctactgtg

SEQ ID NO: 381324 - DNA, 28 bp, Artificial Sequence
  Description of Artificial Sequence: Synthetic oligonucleotide
ggtcatcggagctgtggttgctactgtg

SEQ ID NO: 381325 - DNA, 30 bp, Artificial Sequence; identical to SEQ ID NO: 41283
  Description of Artificial Sequence: Synthetic oligonucleotide

SEQ ID NO: 381326 - DNA, 31 bp, Artificial Sequence; identical to SEQ ID NO: 41284
  Description of Artificial Sequence: Synthetic oligonucleotide

SEQ ID NO: 381327 - DNA, 30 bp, Artificial Sequence; identical to SEQ ID NO: 41285
  Description of Artificial Sequence: Synthetic oligonucleotide

SEQ ID NO: 381328 - DNA, 32 bp, Artificial Sequence; identical to SEQ ID NO: 41286
  Description of Artificial Sequence: Synthetic oligonucleotide

SEQ ID NO: 381329 - DNA, 31 bp, Artificial Sequence; identical to SEQ ID NO: 41287
  Description of Artificial Sequence: Synthetic oligonucleotide

SEQ ID NO: 381330 - DNA, 30 bp, Artificial Sequence; identical to SEQ ID NO: 41288
  Description of Artificial Sequence: Synthetic oligonucleotide

SEQ ID NO: 381331 - DNA, 30 bp, Artificial Sequence; identical to SEQ ID NO: 41289
  Description of Artificial Sequence: Synthetic oligonucleotide

SEQ ID NO: 381332 - DNA, 31 bp, Artificial Sequence; identical to SEQ ID NO: 41290
  Description of Artificial Sequence: Synthetic oligonucleotide

SEQ ID NO: 381333 - DNA, 31 bp, Artificial Sequence; identical to SEQ ID NO: 41291
  Description of Artificial Sequence: Synthetic oligonucleotide

SEQ ID NO: 381334 - DNA, 30 bp, Artificial Sequence; identical to SEQ ID NO: 41292
  Description of Artificial Sequence: Synthetic oligonucleotide

SEQ ID NO: 381335 - DNA, 32 bp, Artificial Sequence; identical to SEQ ID NO: 41293
  Description of Artificial Sequence: Synthetic oligonucleotide

SEQ ID NO: 381336 - DNA, 33 bp, Artificial Sequence; identical to SEQ ID NO: 41294
  Description of Artificial Sequence: Synthetic oligonucleotide

SEQ ID NO: 381337 - DNA, 32 bp, Artificial Sequence; identical to SEQ ID NO: 41295
  Description of Artificial Sequence: Synthetic oligonucleotide

SEQ ID NO: 381338 - DNA, 32 bp, Artificial Sequence; identical to SEQ ID NO: 41296
  Description of Artificial Sequence: Synthetic oligonucleotide

SEQ ID NO: 381339 - DNA, 31 bp, Artificial Sequence; identical to SEQ ID NO: 41297
  Description of Artificial Sequence: Synthetic oligonucleotide

SEQ ID NO: 381340 - DNA, 32 bp, Artificial Sequence; identical to SEQ ID NO: 41298
  Description of Artificial Sequence: Synthetic oligonucleotide

SEQ ID NO: 381341 - DNA, 33 bp, Artificial Sequence; identical to SEQ ID NO: 41299
  Description of Artificial Sequence: Synthetic oligonucleotide

SEQ ID NO: 381342 - DNA, 32 bp, Artificial Sequence; identical to SEQ ID NO: 41300
  Description of Artificial Sequence: Synthetic oligonucleotide

SEQ ID NO: 381343 - DNA, 25 bp, Artificial Sequence
  Description of Artificial Sequence: Synthetic oligonucleotide
atcaggacgaagtcccaggtcccgg

SEQ ID NO: 381344 - DNA, 24 bp, Artificial Sequence
  Description of Artificial Sequence: Synthetic oligonucleotide
tcaggacgaagtcccaggtcccgg

SEQ ID NO: 381345 - DNA, 23 bp, Artificial Sequence
  Description of Artificial Sequence: Synthetic oligonucleotide
caggacgaagtcccaggtcccgg

SEQ ID NO: 381346 - DNA, 23 bp, Artificial Sequence
  Description of Artificial Sequence: Synthetic oligonucleotide
aggacgaagtcccaggtcccggg

SEQ ID NO: 381347 - DNA, 22 bp, Artificial Sequence
  Description of Artificial Sequence: Synthetic oligonucleotide
ggacgaagtcccaggtcccggg

SEQ ID NO: 381348 - DNA, 22 bp, Artificial Sequence
  Description of Artificial Sequence: Synthetic oligonucleotide
gacgaagtcccaggtcccgggc

SEQ ID NO: 381349 - DNA, 22 bp, Artificial Sequence
  Description of Artificial Sequence: Synthetic oligonucleotide
acgaagtcccaggtcccgggcg

SEQ ID NO: 381350 - DNA, 21 bp, Artificial Sequence
  Description of Artificial Sequence: Synthetic oligonucleotide
cgaagtcccaggtcccgggcg

SEQ ID NO: 381351 - DNA, 21 bp, Artificial Sequence
  Description of Artificial Sequence: Synthetic oligonucleotide
gaagtcccaggtcccgggcgg

SEQ ID NO: 381352 - DNA, 21 bp, Artificial Sequence
  Description of Artificial Sequence: Synthetic oligonucleotide
aagtcccaggtcccgggcggg

SEQ ID NO: 381353 - DNA, 20 bp, Artificial Sequence
  Description of Artificial Sequence: Synthetic oligonucleotide
agtcccaggtcccgggcggg

SEQ ID NO: 381354 - DNA, 20 bp, Artificial Sequence
  Description of Artificial Sequence: Synthetic oligonucleotide
gtcccaggtcccgggcgggt

SEQ ID NO: 381355 - DNA, 21 bp, Artificial Sequence
  Description of Artificial Sequence: Synthetic oligonucleotide
tcccaggtcccgggcggggtt

SEQ ID NO: 381356 - DNA, 20 bp, Artificial Sequence
  Description of Artificial Sequence: Synthetic oligonucleotide
cccaggtcccgggcggggtt

SEQ ID NO: 381357 - DNA, 21 bp, Artificial Sequence
  Description of Artificial Sequence: Synthetic oligonucleotide
ccaggtcccgggcggggttct

SEQ ID NO: 381358 - DNA, 22 bp, Artificial Sequence
  Description of Artificial Sequence: Synthetic oligonucleotide
caggtcccgggcggggttctca

SEQ ID NO: 381359 - DNA, 22 bp, Artificial Sequence
  Description of Artificial Sequence: Synthetic oligonucleotide
aggtcccgggcggggttctcag

SEQ ID NO: 381360 - DNA, 21 bp, Artificial Sequence
  Description of Artificial Sequence: Synthetic oligonucleotide
ggtcccgggcggggttctcag

SEQ ID NO: 381361 - DNA, 21 bp, Artificial Sequence
  Description of Artificial Sequence: Synthetic oligonucleotide
gtcccgggcggggttctcagg

SEQ ID NO: 381362 - DNA, 22 bp, Artificial Sequence
  Description of Artificial Sequence: Synthetic oligonucleotide
tcccgggcggggttctcagggt

SEQ ID NO: 381363 - DNA, 21 bp, Artificial Sequence
  Description of Artificial Sequence: Synthetic oligonucleotide
cccgggcggggttctcagggt

SEQ ID NO: 381364 - DNA, 22 bp, Artificial Sequence
  Description of Artificial Sequence: Synthetic oligonucleotide
ccgggcggggttctcagggtct

SEQ ID NO: 381365 - DNA, 23 bp, Artificial Sequence
  Description of Artificial Sequence: Synthetic oligonucleotide
cgggcggggttctcagggtctca

SEQ ID NO: 381366 - DNA, 23 bp, Artificial Sequence
  Description of Artificial Sequence: Synthetic oligonucleotide
gggcggggttctcagggtctcag

SEQ ID NO: 381367 - DNA, 23 bp, Artificial Sequence
  Description of Artificial Sequence: Synthetic oligonucleotide
ggcggggttctcagggtctcagg

SEQ ID NO: 381368 - DNA, 24 bp, Artificial Sequence
  Description of Artificial Sequence: Synthetic oligonucleotide
gcggggttctcagggtctcaggct

SEQ ID NO: 381369 - DNA, 24 bp, Artificial Sequence
  Description of Artificial Sequence: Synthetic oligonucleotide
cggggttctcagggtctcaggctc

SEQ ID NO: 381370 - DNA, 26 bp, Artificial Sequence
  Description of Artificial Sequence: Synthetic oligonucleotide
ggggttctcagggtctcaggctccaa

SEQ ID NO: 381371 - DNA, 26 bp, Artificial Sequence
  Description of Artificial Sequence: Synthetic oligonucleotide
gggttctcagggtctcaggctccaag

SEQ ID NO: 381372 - DNA, 26 bp, Artificial Sequence
  Description of Artificial Sequence: Synthetic oligonucleotide
ggttctcagggtctcaggctccaagg

SEQ ID NO: 381373 - DNA, 26 bp, Artificial Sequence
  Description of Artificial Sequence: Synthetic oligonucleotide
gttctcagggtctcaggctccaaggg

SEQ ID NO: 381374 - DNA, 26 bp, Artificial Sequence
  Description of Artificial Sequence: Synthetic oligonucleotide
ttctcagggtctcaggctccaagggc

SEQ ID NO: 381375 - DNA, 25 bp, Artificial Sequence
  Description of Artificial Sequence: Synthetic oligonucleotide
tctcagggtctcaggctccaagggc

SEQ ID NO: 381376 - DNA, 24 bp, Artificial Sequence
  Description of Artificial Sequence: Synthetic oligonucleotide
ctcagggtctcaggctccaagggc

SEQ ID NO: 381377 - DNA, 24 bp, Artificial Sequence
  Description of Artificial Sequence: Synthetic oligonucleotide
tcagggtctcaggctccaagggcc

SEQ ID NO: 381378 - DNA, 23 bp, Artificial Sequence
  Description of Artificial Sequence: Synthetic oligonucleotide
cagggtctcaggctccaagggcc

SEQ ID NO: 381379 - DNA, 24 bp, Artificial Sequence
  Description of Artificial Sequence: Synthetic oligonucleotide
agggtctcaggctccaagggccgt

SEQ ID NO: 381380 - DNA, 23 bp, Artificial Sequence
  Description of Artificial Sequence: Synthetic oligonucleotide
gggtctcaggctccaagggccgt

SEQ ID NO: 381381 - DNA, 24 bp, Artificial Sequence
  Description of Artificial Sequence: Synthetic oligonucleotide
ggtctcaggctccaagggccgtgt

SEQ ID NO: 381382 - DNA, 25 bp, Artificial Sequence
  Description of Artificial Sequence: Synthetic oligonucleotide
gtctcaggctccaagggccgtgtct

SEQ ID NO: 381383 - DNA, 25 bp, Artificial Sequence
  Description of Artificial Sequence: Synthetic oligonucleotide
tctcaggctccaagggccgtgtctg

SEQ ID NO: 381384 - DNA, 24 bp, Artificial Sequence
  Description of Artificial Sequence: Synthetic oligonucleotide
ctcaggctccaagggccgtgtctg

SEQ ID NO: 381385 - DNA, 25 bp, Artificial Sequence
  Description of Artificial Sequence: Synthetic oligonucleotide
tcaggctccaagggccgtgtctgca

SEQ ID NO: 381386 - DNA, 24 bp, Artificial Sequence
  Description of Artificial Sequence: Synthetic oligonucleotide
caggctccaagggccgtgtctgca

SEQ ID NO: 381387 - DNA, 25 bp, Artificial Sequence
  Description of Artificial Sequence: Synthetic oligonucleotide
aggctccaagggccgtgtctgcact

SEQ ID NO: 381388 - DNA, 24 bp, Artificial Sequence
  Description of Artificial Sequence: Synthetic oligonucleotide
ggctccaagggccgtgtctgcact

SEQ ID NO: 381389 - DNA, 24 bp, Artificial Sequence
  Description of Artificial Sequence: Synthetic oligonucleotide
gctccaagggccgtgtctgcactg

SEQ ID NO: 381390 - DNA, 24 bp, Artificial Sequence
  Description of Artificial Sequence: Synthetic oligonucleotide
ctccaagggccgtgtctgcactgg

SEQ ID NO: 381391 - DNA, 24 bp, Artificial Sequence
  Description of Artificial Sequence: Synthetic oligonucleotide
tccaagggccgtgtctgcactggg

SEQ ID NO: 381392 - DNA, 23 bp, Artificial Sequence
  Description of Artificial Sequence: Synthetic oligonucleotide
ccaagggccgtgtctgcactggg

SEQ ID NO: 381393 - DNA, 24 bp, Artificial Sequence
  Description of Artificial Sequence: Synthetic oligonucleotide
caagggccgtgtctgcactgggga

SEQ ID NO: 381394 - DNA, 24 bp, Artificial Sequence
  Description of Artificial Sequence: Synthetic oligonucleotide
aagggccgtgtctgcactggggag

SEQ ID NO: 381395 - DNA, 23 bp, Artificial Sequence
  Description of Artificial Sequence: Synthetic oligonucleotide
agggccgtgtctgcactggggag

SEQ ID NO: 381396 - DNA, 22 bp, Artificial Sequence
  Description of Artificial Sequence: Synthetic oligonucleotide
gggccgtgtctgcactggggag

SEQ ID NO: 381397 - DNA, 22 bp, Artificial Sequence
  Description of Artificial Sequence: Synthetic oligonucleotide
ggccgtgtctgcactggggagg

SEQ ID NO: 381398 - DNA, 22 bp, Artificial Sequence
  Description of Artificial Sequence: Synthetic oligonucleotide
gccgtgtctgcactggggaggc

SEQ ID NO: 381399 - DNA, 22 bp, Artificial Sequence
  Description of Artificial Sequence: Synthetic oligonucleotide
ccgtgtctgcactggggaggcg

SEQ ID NO: 381400 - DNA, 22 bp, Artificial Sequence
  Description of Artificial Sequence: Synthetic oligonucleotide
cgtgtctgcactggggaggcgc

SEQ ID NO: 381401 - DNA, 22 bp, Artificial Sequence
  Description of Artificial Sequence: Synthetic oligonucleotide
gtgtctgcactggggaggcgcc

SEQ ID NO: 381402 - DNA, 22 bp, Artificial Sequence
  Description of Artificial Sequence: Synthetic oligonucleotide
tgtctgcactggggaggcgccg

SEQ ID NO: 381403 - DNA, 21 bp, Artificial Sequence
  Description of Artificial Sequence: Synthetic oligonucleotide
gtctgcactggggaggcgccg

SEQ ID NO: 381404 - DNA, 21 bp, Artificial Sequence
  Description of Artificial Sequence: Synthetic oligonucleotide
tctgcactggggaggcgccgc

SEQ ID NO: 381405 - DNA, 20 bp, Artificial Sequence
  Description of Artificial Sequence: Synthetic oligonucleotide
ctgcactggggaggcgccgc

SEQ ID NO: 381406 - DNA, 22 bp, Artificial Sequence
  Description of Artificial Sequence: Synthetic oligonucleotide
tgcactggggaggcgccgcgtt

SEQ ID NO: 381407 - DNA, 21 bp, Artificial Sequence
  Description of Artificial Sequence: Synthetic oligonucleotide
gcactggggaggcgccgcgtt

SEQ ID NO: 381408 - DNA, 22 bp, Artificial Sequence
  Description of Artificial Sequence: Synthetic oligonucleotide
cactggggaggcgccgcgttga

SEQ ID NO: 381409 - DNA, 22 bp, Artificial Sequence
  Description of Artificial Sequence: Synthetic oligonucleotide
actggggaggcgccgcgttgag

SEQ ID NO: 381410 - DNA, 21 bp, Artificial Sequence
  Description of Artificial Sequence: Synthetic oligonucleotide
ctggggaggcgccgcgttgag

SEQ ID NO: 381411 - DNA, 24 bp, Artificial Sequence
  Description of Artificial Sequence: Synthetic oligonucleotide
tggggaggcgccgcgttgaggatt

SEQ ID NO: 381412 - DNA, 23 bp, Artificial Sequence
  Description of Artificial Sequence: Synthetic oligonucleotide
ggggaggcgccgcgttgaggatt

SEQ ID NO: 381413 - DNA, 24 bp, Artificial Sequence
  Description of Artificial Sequence: Synthetic oligonucleotide
gggaggcgccgcgttgaggattct

SEQ ID NO: 381414 - DNA, 24 bp, Artificial Sequence
  Description of Artificial Sequence: Synthetic oligonucleotide
ggaggcgccgcgttgaggattctc

SEQ ID NO: 381415 - DNA, 25 bp, Artificial Sequence
  Description of Artificial Sequence: Synthetic oligonucleotide
gaggcgccgcgttgaggattctcca

SEQ ID NO: 381416 - DNA, 26 bp, Artificial Sequence
  Description of Artificial Sequence: Synthetic oligonucleotide
aggcgccgcgttgaggattctccact

SEQ ID NO: 381417 - DNA, 25 bp, Artificial Sequence
  Description of Artificial Sequence: Synthetic oligonucleotide
ggcgccgcgttgaggattctccact

SEQ ID NO: 381418 - DNA, 25 bp, Artificial Sequence
  Description of Artificial Sequence: Synthetic oligonucleotide
gcgccgcgttgaggattctccactc

SEQ ID NO: 381419 - DNA, 25 bp, Artificial Sequence
  Description of Artificial Sequence: Synthetic oligonucleotide
cgccgcgttgaggattctccactcc

SEQ ID NO: 381420 - DNA, 25 bp, Artificial Sequence
  Description of Artificial Sequence: Synthetic oligonucleotide
gccgcgttgaggattctccactccc

SEQ ID NO: 381421 - DNA, 26 bp, Artificial Sequence
  Description of Artificial Sequence: Synthetic oligonucleotide
ccgcgttgaggattctccactcccct

SEQ ID NO: 381422 - DNA, 27 bp, Artificial Sequence
  Description of Artificial Sequence: Synthetic oligonucleotide
cgcgttgaggattctccactcccctga

SEQ ID NO: 381423 - DNA, 27 bp, Artificial Sequence
  Description of Artificial Sequence: Synthetic oligonucleotide
gcgttgaggattctccactcccctgag

SEQ ID NO: 381424 - DNA, 30 bp, Artificial Sequence
  Description of Artificial Sequence: Synthetic oligonucleotide
cgttgaggattctccactcccctgagtttc

SEQ ID NO: 381425 - DNA, 31 bp, Artificial Sequence
  Description of Artificial Sequence: Synthetic oligonucleotide
gttgaggattctccactcccctgagtttcac

SEQ ID NO: 381426 - DNA, 33 bp, Artificial Sequence
  Description of Artificial Sequence: Synthetic oligonucleotide
ttgaggattctccactcccctgagtttcacttc

SEQ ID NO: 381427 - DNA, 32 bp, Artificial Sequence
  Description of Artificial Sequence: Synthetic oligonucleotide
tgaggattctccactcccctgagtttcacttc

SEQ ID NO: 381428 - DNA, 31 bp, Artificial Sequence
  Description of Artificial Sequence: Synthetic oligonucleotide
gaggattctccactcccctgagtttcacttc

SEQ ID NO: 381429 - DNA, 33 bp, Artificial Sequence
  Description of Artificial Sequence: Synthetic oligonucleotide
aggattctccactcccctgagtttcacttcttc

SEQ ID NO: 381430 - DNA, 32 bp, Artificial Sequence
  Description of Artificial Sequence: Synthetic oligonucleotide
ggattctccactcccctgagtttcacttcttc

SEQ ID NO: 381431 - DNA, 33 bp, Artificial Sequence
  Description of Artificial Sequence: Synthetic oligonucleotide
gattctccactcccctgagtttcacttcttctc

SEQ ID NO: 381432 - DNA, 33 bp, Artificial Sequence
  Description of Artificial Sequence: Synthetic oligonucleotide
attctccactcccctgagtttcacttcttctcc

SEQ ID NO: 381433 - DNA, 32 bp, Artificial Sequence
  Description of Artificial Sequence: Synthetic oligonucleotide
ttctccactcccctgagtttcacttcttctcc

SEQ ID NO: 381434 - DNA, 31 bp, Artificial Sequence
  Description of Artificial Sequence: Synthetic oligonucleotide
tctccactcccctgagtttcacttcttctcc

SEQ ID NO: 381435 - DNA, 30 bp, Artificial Sequence
  Description of Artificial Sequence: Synthetic oligonucleotide
ctccactcccctgagtttcacttcttctcc

SEQ ID NO: 381436 - DNA, 30 bp, Artificial Sequence
  Description of Artificial Sequence: Synthetic oligonucleotide
tccactcccctgagtttcacttcttctccc

SEQ ID NO: 381437 - DNA, 31 bp, Artificial Sequence
  Description of Artificial Sequence: Synthetic oligonucleotide
actcccctgagtttcacttcttctcccaacc

SEQ ID NO: 381438 - DNA, 30 bp, Artificial Sequence
  Description of Artificial Sequence: Synthetic oligonucleotide
ctcccctgagtttcacttcttctcccaacc

SEQ ID NO: 381439 - DNA, 31 bp, Artificial Sequence
  Description of Artificial Sequence: Synthetic oligonucleotide
tcccctgagtttcacttcttctcccaacctg

SEQ ID NO: 381440 - DNA, 30 bp, Artificial Sequence
  Description of Artificial Sequence: Synthetic oligonucleotide
cccctgagtttcacttcttctcccaacctg

SEQ ID NO: 381441 - DNA, 30 bp, Artificial Sequence
  Description of Artificial Sequence: Synthetic oligonucleotide
ccctgagtttcacttcttctcccaacctgc

SEQ ID NO: 381442 - DNA, 30 bp, Artificial Sequence
  Description of Artificial Sequence: Synthetic oligonucleotide
cctgagtttcacttcttctcccaacctgcg

SEQ ID NO: 381443 - DNA, 31 bp, Artificial Sequence
  Description of Artificial Sequence: Synthetic oligonucleotide
ctgagtttcacttcttctcccaacctgcgtc

SEQ ID NO: 381444 - DNA, 31 bp, Artificial Sequence
  Description of Artificial Sequence: Synthetic oligonucleotide
tgagtttcacttcttctcccaacctgcgtcg

SEQ ID NO: 381445 - DNA, 30 bp, Artificial Sequence
  Description of Artificial Sequence: Synthetic oligonucleotide
gagtttcacttcttctcccaacctgcgtcg

SEQ ID NO: 381446 - DNA, 30 bp, Artificial Sequence
  Description of Artificial Sequence: Synthetic oligonucleotide
agtttcacttcttctcccaacctgcgtcgg

SEQ ID NO: 381447 - DNA, 29 bp, Artificial Sequence
  Description of Artificial Sequence: Synthetic oligonucleotide
gtttcacttcttctcccaacctgcgtcgg

SEQ ID NO: 381448 - DNA, 29 bp, Artificial Sequence
  Description of Artificial Sequence: Synthetic oligonucleotide
tttcacttcttctcccaacctgcgtcggg

SEQ ID NO: 381449 - DNA, 28 bp, Artificial Sequence
  Description of Artificial Sequence: Synthetic oligonucleotide
ttcacttcttctcccaacctgcgtcggg

SEQ ID NO: 381450 - DNA, 27 bp, Artificial Sequence
  Description of Artificial Sequence: Synthetic oligonucleotide
tcacttcttctcccaacctgcgtcggg

SEQ ID NO: 381451 - DNA, 27 bp, Artificial Sequence
  Description of Artificial Sequence: Synthetic oligonucleotide
cacttcttctcccaacctgcgtcgggt

SEQ ID NO: 381452 - DNA, 27 bp, Artificial Sequence
  Description of Artificial Sequence: Synthetic oligonucleotide
acttcttctcccaacctgcgtcgggtc

SEQ ID NO: 381453 - DNA, 26 bp, Artificial Sequence
  Description of Artificial Sequence: Synthetic oligonucleotide
cttcttctcccaacctgcgtcgggtc

SEQ ID NO: 381454 - DNA, 27 bp, Artificial Sequence
  Description of Artificial Sequence: Synthetic oligonucleotide
ttcttctcccaacctgcgtcgggtcct

SEQ ID NO: 381455 - DNA, 27 bp, Artificial Sequence
  Description of Artificial Sequence: Synthetic oligonucleotide
tcttctcccaacctgcgtcgggtcctt

SEQ ID NO: 381456 - DNA, 26 bp, Artificial Sequence
  Description of Artificial Sequence: Synthetic oligonucleotide
cttctcccaacctgcgtcgggtcctt

SEQ ID NO: 381457 - DNA, 27 bp, Artificial Sequence
  Description of Artificial Sequence: Synthetic oligonucleotide
ttctcccaacctgcgtcgggtccttct

SEQ ID NO: 381458 - DNA, 27 bp, Artificial Sequence
  Description of Artificial Sequence: Synthetic oligonucleotide
tctcccaacctgcgtcgggtccttctt

SEQ ID NO: 381459 - DNA, 26 bp, Artificial Sequence
  Description of Artificial Sequence: Synthetic oligonucleotide
ctcccaacctgcgtcgggtccttctt

SEQ ID NO: 381460 - DNA, 26 bp, Artificial Sequence
  Description of Artificial Sequence: Synthetic oligonucleotide
tcccaacctgcgtcgggtccttcttc

SEQ ID NO: 381461 - DNA, 25 bp, Artificial Sequence
  Description of Artificial Sequence: Synthetic oligonucleotide
cccaacctgcgtcgggtccttcttc

SEQ ID NO: 381462 - DNA, 26 bp, Artificial Sequence
  Description of Artificial Sequence: Synthetic oligonucleotide
ccaacctgcgtcgggtccttcttcct

SEQ ID NO: 381463 - DNA, 27 bp, Artificial Sequence
  Description of Artificial Sequence: Synthetic oligonucleotide
caacctgcgtcgggtccttcttcctga

SEQ ID NO: 381464 - DNA, 30 bp, Artificial Sequence
  Description of Artificial Sequence: Synthetic oligonucleotide
aacctgcgtcgggtccttcttcctgaatac

SEQ ID NO: 381465 - DNA, 29 bp, Artificial Sequence
  Description of Artificial Sequence: Synthetic oligonucleotide
acctgcgtcgggtccttcttcctgaatac

SEQ ID NO: 381466 - DNA, 28 bp, Artificial Sequence
  Description of Artificial Sequence: Synthetic oligonucleotide
cctgcgtcgggtccttcttcctgaatac

SEQ ID NO: 381467 - DNA, 29 bp, Artificial Sequence
  Description of Artificial Sequence: Synthetic oligonucleotide
ctgcgtcgggtccttcttcctgaatactc

SEQ ID NO: 381468 - DNA, 31 bp, Artificial Sequence
  Description of Artificial Sequence: Synthetic oligonucleotide
tgcgtcgggtccttcttcctgaatactcatg

SEQ ID NO: 381469 - DNA, 30 bp, Artificial Sequence
  Description of Artificial Sequence: Synthetic oligonucleotide
gcgtcgggtccttcttcctgaatactcatg

SEQ ID NO: 381470 - DNA, 31 bp, Artificial Sequence
  Description of Artificial Sequence: Synthetic oligonucleotide
cgtcgggtccttcttcctgaatactcatgac

SEQ ID NO: 381471 - DNA, 31 bp, Artificial Sequence
  Description of Artificial Sequence: Synthetic oligonucleotide
gtcgggtccttcttcctgaatactcatgacg

SEQ ID NO: 381472 - DNA, 31 bp, Artificial Sequence
  Description of Artificial Sequence: Synthetic oligonucleotide
tcgggtccttcttcctgaatactcatgacgc

SEQ ID NO: 381473 - DNA, 30 bp, Artificial Sequence
  Description of Artificial Sequence: Synthetic oligonucleotide
cgggtccttcttcctgaatactcatgacgc

SEQ ID NO: 381474 - DNA, 30 bp, Artificial Sequence
  Description of Artificial Sequence: Synthetic oligonucleotide
gggtccttcttcctgaatactcatgacgcg

SEQ ID NO: 381475 - DNA, 31 bp, Artificial Sequence
  Description of Artificial Sequence: Synthetic oligonucleotide
ggtccttcttcctgaatactcatgacgcgtc

SEQ ID NO: 381476 - DNA, 31 bp, Artificial Sequence
  Description of Artificial Sequence: Synthetic oligonucleotide
gtccttcttcctgaatactcatgacgcgtcc

SEQ ID NO: 381477 - DNA, 31 bp, Artificial Sequence
  Description of Artificial Sequence: Synthetic oligonucleotide
tccttcttcctgaatactcatgacgcgtccc

SEQ ID NO: 381478 - DNA, 30 bp, Artificial Sequence
  Description of Artificial Sequence: Synthetic oligonucleotide
ccttcttcctgaatactcatgacgcgtccc

SEQ ID NO: 381479 - DNA, 30 bp, Artificial Sequence
  Description of Artificial Sequence: Synthetic oligonucleotide
cttcttcctgaatactcatgacgcgtcccc

SEQ ID NO: 381480 - DNA, 34 bp, Artificial Sequence
  Description of Artificial Sequence: Synthetic oligonucleotide
ttcttcctgaatactcatgacgcgtccccaattc

SEQ ID NO: 381481 - DNA, 33 bp, Artificial Sequence
  Description of Artificial Sequence: Synthetic oligonucleotide
tcttcctgaatactcatgacgcgtccccaattc

SEQ ID NO: 381482 - DNA, 32 bp, Artificial Sequence
  Description of Artificial Sequence: Synthetic oligonucleotide
cttcctgaatactcatgacgcgtccccaattc

SEQ ID NO: 381483 - DNA, 32 bp, Artificial Sequence
  Description of Artificial Sequence: Synthetic oligonucleotide
ttcctgaatactcatgacgcgtccccaattcc

SEQ ID NO: 381484 - DNA, 31 bp, Artificial Sequence
  Description of Artificial Sequence: Synthetic oligonucleotide
tcctgaatactcatgacgcgtccccaattcc

SEQ ID NO: 381485 - DNA, 30 bp, Artificial Sequence
  Description of Artificial Sequence: Synthetic oligonucleotide
cctgaatactcatgacgcgtccccaattcc

SEQ ID NO: 381486 - DNA, 30 bp, Artificial Sequence
  Description of Artificial Sequence: Synthetic oligonucleotide
ctgaatactcatgacgcgtccccaattccc

SEQ ID NO: 381487 - DNA, 31 bp, Artificial Sequence
  Description of Artificial Sequence: Synthetic oligonucleotide
tgaatactcatgacgcgtccccaattcccac

SEQ ID NO: 381488 - DNA, 30 bp, Artificial Sequence
  Description of Artificial Sequence: Synthetic oligonucleotide
gaatactcatgacgcgtccccaattcccac

SEQ ID NO: 381489 - DNA, 31 bp, Artificial Sequence
  Description of Artificial Sequence: Synthetic oligonucleotide
aatactcatgacgcgtccccaattcccactc

SEQ ID NO: 381490 - DNA, 30 bp, Artificial Sequence
  Description of Artificial Sequence: Synthetic oligonucleotide
atactcatgacgcgtccccaattcccactc

SEQ ID NO: 381491 - DNA, 29 bp, Artificial Sequence
  Description of Artificial Sequence: Synthetic oligonucleotide
tactcatgacgcgtccccaattcccactc

SEQ ID NO: 381492 - DNA, 28 bp, Artificial Sequence
  Description of Artificial Sequence: Synthetic oligonucleotide
actcatgacgcgtccccaattcccactc

SEQ ID NO: 381493 - DNA, 27 bp, Artificial Sequence
  Description of Artificial Sequence: Synthetic oligonucleotide
ctcatgacgcgtccccaattcccactc

SEQ ID NO: 381494 - DNA, 27 bp, Artificial Sequence
  Description of Artificial Sequence: Synthetic oligonucleotide
tcatgacgcgtccccaattcccactcc

SEQ ID NO: 381495 - DNA, 26 bp, Artificial Sequence
  Description of Artificial Sequence: Synthetic oligonucleotide
catgacgcgtccccaattcccactcc

SEQ ID NO: 381496 - DNA, 27 bp, Artificial Sequence
  Description of Artificial Sequence: Synthetic oligonucleotide
atgacgcgtccccaattcccactccca

SEQ ID NO: 381497 - DNA, 29 bp, Artificial Sequence
  Description of Artificial Sequence: Synthetic oligonucleotide
aattcccactcccattgggtgtcgggttc

SEQ ID NO: 381498 - DNA, 28 bp, Artificial Sequence
  Description of Artificial Sequence: Synthetic oligonucleotide
attcccactcccattgggtgtcgggttc

SEQ ID NO: 381499 - DNA, 27 bp, Artificial Sequence
  Description of Artificial Sequence: Synthetic oligonucleotide
ttcccactcccattgggtgtcgggttc

SEQ ID NO: 381500 - DNA, 27 bp, Artificial Sequence
  Description of Artificial Sequence: Synthetic oligonucleotide
tcccactcccattgggtgtcgggttct

SEQ ID NO: 381501 - DNA, 27 bp, Artificial Sequence
  Description of Artificial Sequence: Synthetic oligonucleotide
cccactcccattgggtgtcgggttcta

SEQ ID NO: 381502 - DNA, 27 bp, Artificial Sequence
  Description of Artificial Sequence: Synthetic oligonucleotide
ccactcccattgggtgtcgggttctag

SEQ ID NO: 381503 - DNA, 28 bp, Artificial Sequence
  Description of Artificial Sequence: Synthetic oligonucleotide
cactcccattgggtgtcgggttctagag

SEQ ID NO: 381504 - DNA, 30 bp, Artificial Sequence
  Description of Artificial Sequence: Synthetic oligonucleotide
actcccattgggtgtcgggttctagagaag

SEQ ID NO: 381505 - DNA, 29 bp, Artificial Sequence
  Description of Artificial Sequence: Synthetic oligonucleotide
ctcccattgggtgtcgggttctagagaag

SEQ ID NO: 381506 - DNA, 29 bp, Artificial Sequence
  Description of Artificial Sequence: Synthetic oligonucleotide
tcccattgggtgtcgggttctagagaagc

SEQ ID NO: 381507 - DNA, 28 bp, Artificial Sequence
  Description of Artificial Sequence: Synthetic oligonucleotide
cccattgggtgtcgggttctagagaagc

SEQ ID NO: 381508 - DNA, 28 bp, Artificial Sequence
  Description of Artificial Sequence: Synthetic oligonucleotide
ccattgggtgtcgggttctagagaagcc

SEQ ID NO: 381509 - DNA, 31 bp, Artificial Sequence
  Description of Artificial Sequence: Synthetic oligonucleotide
cattgggtgtcgggttctagagaagccaatc

SEQ ID NO: 381510 - DNA, 32 bp, Artificial Sequence
  Description of Artificial Sequence: Synthetic oligonucleotide
attgggtgtcgggttctagagaagccaatcag

SEQ ID NO: 381511 - DNA, 31 bp, Artificial Sequence
  Description of Artificial Sequence: Synthetic oligonucleotide
ttgggtgtcgggttctagagaagccaatcag

SEQ ID NO: 381512 - DNA, 30 bp, Artificial Sequence
  Description of Artificial Sequence: Synthetic oligonucleotide
tgggtgtcgggttctagagaagccaatcag

SEQ ID NO: 381513 - DNA, 29 bp, Artificial Sequence
  Description of Artificial Sequence: Synthetic oligonucleotide
gggtgtcgggttctagagaagccaatcag

SEQ ID NO: 381514 - DNA, 29 bp, Artificial Sequence
  Description of Artificial Sequence: Synthetic oligonucleotide
ggtgtcgggttctagagaagccaatcagc

SEQ ID NO: 381515 - DNA, 29 bp, Artificial Sequence
  Description of Artificial Sequence: Synthetic oligonucleotide
gtgtcgggttctagagaagccaatcagcg

SEQ ID NO: 381516 - DNA, 30 bp, Artificial Sequence
  Description of Artificial Sequence: Synthetic oligonucleotide
tgtcgggttctagagaagccaatcagcgtc

SEQ ID NO: 381517 - DNA, 29 bp, Artificial Sequence
  Description of Artificial Sequence: Synthetic oligonucleotide
gtcgggttctagagaagccaatcagcgtc

SEQ ID NO: 381518 - DNA, 30 bp, Artificial Sequence
  Description of Artificial Sequence: Synthetic oligonucleotide
tcgggttctagagaagccaatcagcgtctc

SEQ ID NO: 381519 - DNA, 29 bp, Artificial Sequence
  Description of Artificial Sequence: Synthetic oligonucleotide
cgggttctagagaagccaatcagcgtctc

SEQ ID NO: 381520 - DNA, 29 bp, Artificial Sequence
  Description of Artificial Sequence: Synthetic oligonucleotide
gggttctagagaagccaatcagcgtctcc

SEQ ID NO: 381521 - DNA, 29 bp, Artificial Sequence
  Description of Artificial Sequence: Synthetic oligonucleotide
ggttctagagaagccaatcagcgtctccg

SEQ ID NO: 381522 - DNA, 29 bp, Artificial Sequence
  Description of Artificial Sequence: Synthetic oligonucleotide
gttctagagaagccaatcagcgtctccgc

SEQ ID NO: 381523 - DNA, 30 bp, Artificial Sequence
  Description of Artificial Sequence: Synthetic oligonucleotide
ttctagagaagccaatcagcgtctccgcag

SEQ ID NO: 381524 - DNA, 29 bp, Artificial Sequence
  Description of Artificial Sequence: Synthetic oligonucleotide
tctagagaagccaatcagcgtctccgcag

SEQ ID NO: 381525 - DNA, 28 bp, Artificial Sequence
  Description of Artificial Sequence: Synthetic oligonucleotide
ctagagaagccaatcagcgtctccgcag

SEQ ID NO: 381526 - DNA, 29 bp, Artificial Sequence
  Description of Artificial Sequence: Synthetic oligonucleotide
tagagaagccaatcagcgtctccgcagtc

SEQ ID NO: 381527 - DNA, 28 bp, Artificial Sequence
  Description of Artificial Sequence: Synthetic oligonucleotide
agagaagccaatcagcgtctccgcagtc

SEQ ID NO: 381528 - DNA, 27 bp, Artificial Sequence
  Description of Artificial Sequence: Synthetic oligonucleotide
gagaagccaatcagcgtctccgcagtc

SEQ ID NO: 381529 - DNA, 27 bp, Artificial Sequence
  Description of Artificial Sequence: Synthetic oligonucleotide
agaagccaatcagcgtctccgcagtcc

SEQ ID NO: 381530 - DNA, 26 bp, Artificial Sequence
  Description of Artificial Sequence: Synthetic oligonucleotide
gaagccaatcagcgtctccgcagtcc

SEQ ID NO: 381531 - DNA, 26 bp, Artificial Sequence
  Description of Artificial Sequence: Synthetic oligonucleotide
aagccaatcagcgtctccgcagtccc

SEQ ID NO: 381532 - DNA, 25 bp, Artificial Sequence
  Description of Artificial Sequence: Synthetic oligonucleotide
agccaatcagcgtctccgcagtccc

SEQ ID NO: 381533 - DNA, 24 bp, Artificial Sequence
  Description of Artificial Sequence: Synthetic oligonucleotide
gccaatcagcgtctccgcagtccc

SEQ ID NO: 381534 - DNA, 24 bp, Artificial Sequence
  Description of Artificial Sequence: Synthetic oligonucleotide
ccaatcagcgtctccgcagtcccg

SEQ ID NO: 381535 - DNA, 26 bp, Artificial Sequence
  Description of Artificial Sequence: Synthetic oligonucleotide
caatcagcgtctccgcagtcccggtt

SEQ ID NO: 381536 - DNA, 27 bp, Artificial Sequence
  Description of Artificial Sequence: Synthetic oligonucleotide
aatcagcgtctccgcagtcccggttct

SEQ ID NO: 381537 - DNA, 27 bp, Artificial Sequence
  Description of Artificial Sequence: Synthetic oligonucleotide
atcagcgtctccgcagtcccggttcta

SEQ ID NO: 381538 - DNA, 27 bp, Artificial Sequence
  Description of Artificial Sequence: Synthetic oligonucleotide
tcagcgtctccgcagtcccggttctaa

SEQ ID NO: 381539 - DNA, 27 bp, Artificial Sequence
  Description of Artificial Sequence: Synthetic oligonucleotide
cagcgtctccgcagtcccggttctaaa

SEQ ID NO: 381540 - DNA, 27 bp, Artificial Sequence
  Description of Artificial Sequence: Synthetic oligonucleotide
agcgtctccgcagtcccggttctaaag

SEQ ID NO: 381541 - DNA, 27 bp, Artificial Sequence
  Description of Artificial Sequence: Synthetic oligonucleotide
gcgtctccgcagtcccggttctaaagt

SEQ ID NO: 381542 - DNA, 27 bp, Artificial Sequence
  Description of Artificial Sequence: Synthetic oligonucleotide
cgtctccgcagtcccggttctaaagtc

SEQ ID NO: 381543 - DNA, 27 bp, Artificial Sequence
  Description of Artificial Sequence: Synthetic oligonucleotide
gtctccgcagtcccggttctaaagtcc

SEQ ID NO: 381544 - DNA, 27 bp, Artificial Sequence
  Description of Artificial Sequence: Synthetic oligonucleotide
tctccgcagtcccggttctaaagtccc

SEQ ID NO: 381545 - DNA, 26 bp, Artificial Sequence
  Description of Artificial Sequence: Synthetic oligonucleotide
ctccgcagtcccggttctaaagtccc

SEQ ID NO: 381546 - DNA, 27 bp, Artificial Sequence
  Description of Artificial Sequence: Synthetic oligonucleotide
tccgcagtcccggttctaaagtcccca

SEQ ID NO: 381547 - DNA, 26 bp, Artificial Sequence
  Description of Artificial Sequence: Synthetic oligonucleotide
ccgcagtcccggttctaaagtcccca

SEQ ID NO: 381548 - DNA, 27 bp, Artificial Sequence
  Description of Artificial Sequence: Synthetic oligonucleotide
cgcagtcccggttctaaagtccccagt

SEQ ID NO: 381549 - DNA, 27 bp, Artificial Sequence
  Description of Artificial Sequence: Synthetic oligonucleotide
gcagtcccggttctaaagtccccagtc

SEQ ID NO: 381550 - DNA, 28 bp, Artificial Sequence
  Description of Artificial Sequence: Synthetic oligonucleotide
cagtcccggttctaaagtccccagtcac

SEQ ID NO: 381551 - DNA, 28 bp, Artificial Sequence
  Description of Artificial Sequence: Synthetic oligonucleotide
agtcccggttctaaagtccccagtcacc

SEQ ID NO: 381552 - DNA, 27 bp, Artificial Sequence
  Description of Artificial Sequence: Synthetic oligonucleotide
gtcccggttctaaagtccccagtcacc

SEQ ID NO: 381553 - DNA, 27 bp, Artificial Sequence
  Description of Artificial Sequence: Synthetic oligonucleotide
tcccggttctaaagtccccagtcaccc

SEQ ID NO: 381554 - DNA, 27 bp, Artificial Sequence
  Description of Artificial Sequence: Synthetic oligonucleotide
cccggttctaaagtccccagtcaccca

SEQ ID NO: 381555 - DNA, 27 bp, Artificial Sequence
  Description of Artificial Sequence: Synthetic oligonucleotide
ccggttctaaagtccccagtcacccac

SEQ ID NO: 381556 - DNA, 27 bp, Artificial Sequence
  Description of Artificial Sequence: Synthetic oligonucleotide
cggttctaaagtccccagtcacccacc

SEQ ID NO: 381557 - DNA, 27 bp, Artificial Sequence
  Description of Artificial Sequence: Synthetic oligonucleotide
ggttctaaagtccccagtcacccaccc

SEQ ID NO: 381558 - DNA, 27 bp, Artificial Sequence
  Description of Artificial Sequence: Synthetic oligonucleotide
gttctaaagtccccagtcacccacccg

SEQ ID NO: 381559 - DNA, 27 bp, Artificial Sequence
  Description of Artificial Sequence: Synthetic oligonucleotide
ttctaaagtccccagtcacccacccgg

SEQ ID NO: 381560 - DNA, 27 bp, Artificial Sequence
  Description of Artificial Sequence: Synthetic oligonucleotide
tctaaagtccccagtcacccacccgga

SEQ ID NO: 381561 - DNA, 26 bp, Artificial Sequence
  Description of Artificial Sequence: Synthetic oligonucleotide
ctaaagtccccagtcacccacccgga

SEQ ID NO: 381562 - DNA, 27 bp, Artificial Sequence
  Description of Artificial Sequence: Synthetic oligonucleotide
taaagtccccagtcacccacccggact

SEQ ID NO: 381563 - DNA, 26 bp, Artificial Sequence
  Description of Artificial Sequence: Synthetic oligonucleotide
aaagtccccagtcacccacccggact

SEQ ID NO: 381564 - DNA, 25 bp, Artificial Sequence
  Description of Artificial Sequence: Synthetic oligonucleotide
aagtccccagtcacccacccggact

SEQ ID NO: 381565 - DNA, 24 bp, Artificial Sequence
  Description of Artificial Sequence: Synthetic oligonucleotide
agtccccagtcacccacccggact

SEQ ID NO: 381566 - DNA, 23 bp, Artificial Sequence
  Description of Artificial Sequence: Synthetic oligonucleotide
gtccccagtcacccacccggact

SEQ ID NO: 381567 - DNA, 24 bp, Artificial Sequence
  Description of Artificial Sequence: Synthetic oligonucleotide
tccccagtcacccacccggactca

SEQ ID NO: 381568 - DNA, 23 bp, Artificial Sequence
  Description of Artificial Sequence: Synthetic oligonucleotide
ccccagtcacccacccggactca

SEQ ID NO: 381569 - DNA, 26 bp, Artificial Sequence
  Description of Artificial Sequence: Synthetic oligonucleotide
cccagtcacccacccggactcagatt

SEQ ID NO: 381570 - DNA, 27 bp, Artificial Sequence
  Description of Artificial Sequence: Synthetic oligonucleotide
ccagtcacccacccggactcagattct

SEQ ID NO: 381571 - DNA, 27 bp, Artificial Sequence
  Description of Artificial Sequence: Synthetic oligonucleotide
cagtcacccacccggactcagattctc

SEQ ID NO: 381572 - DNA, 27 bp, Artificial Sequence
  Description of Artificial Sequence: Synthetic oligonucleotide
agtcacccacccggactcagattctcc

SEQ ID NO: 381573 - DNA, 26 bp, Artificial Sequence
  Description of Artificial Sequence: Synthetic oligonucleotide
gtcacccacccggactcagattctcc

SEQ ID NO: 381574 - DNA, 26 bp, Artificial Sequence
  Description of Artificial Sequence: Synthetic oligonucleotide
tcacccacccggactcagattctccc

SEQ ID NO: 381575 - DNA, 25 bp, Artificial Sequence
  Description of Artificial Sequence: Synthetic oligonucleotide
cacccacccggactcagattctccc

SEQ ID NO: 381576 - DNA, 26 bp, Artificial Sequence
  Description of Artificial Sequence: Synthetic oligonucleotide
acccacccggactcagattctcccca

SEQ ID NO: 381577 - DNA, 25 bp, Artificial Sequence
  Description of Artificial Sequence: Synthetic oligonucleotide
cccacccggactcagattctcccca

SEQ ID NO: 381578 - DNA, 26 bp, Artificial Sequence
  Description of Artificial Sequence: Synthetic oligonucleotide
ccacccggactcagattctccccaga

SEQ ID NO: 381579 - DNA, 26 bp, Artificial Sequence
  Description of Artificial Sequence: Synthetic oligonucleotide
cacccggactcagattctccccagac

SEQ ID NO: 381580 - DNA, 26 bp, Artificial Sequence
  Description of Artificial Sequence: Synthetic oligonucleotide
acccggactcagattctccccagacg

SEQ ID NO: 381581 - DNA, 25 bp, Artificial Sequence
  Description of Artificial Sequence: Synthetic oligonucleotide
cccggactcagattctccccagacg

SEQ ID NO: 381582 - DNA, 25 bp, Artificial Sequence
  Description of Artificial Sequence: Synthetic oligonucleotide
ccggactcagattctccccagacgc

SEQ ID NO: 381583 - DNA, 25 bp, Artificial Sequence
  Description of Artificial Sequence: Synthetic oligonucleotide
cggactcagattctccccagacgcc

SEQ ID NO: 381584 - DNA, 27 bp, Artificial Sequence
  Description of Artificial Sequence: Synthetic oligonucleotide
gactcagattctccccagacgccgaga

SEQ ID NO: 381585 - DNA, 28 bp, Artificial Sequence
  Description of Artificial Sequence: Synthetic oligonucleotide
actcagattctccccagacgccgagatg

SEQ ID NO: 381586 - DNA, 27 bp, Artificial Sequence
  Description of Artificial Sequence: Synthetic oligonucleotide
ctcagattctccccagacgccgagatg

SEQ ID NO: 381587 - DNA, 27 bp, Artificial Sequence
  Description of Artificial Sequence: Synthetic oligonucleotide
tcagattctccccagacgccgagatgc

SEQ ID NO: 381588 - DNA, 26 bp, Artificial Sequence
  Description of Artificial Sequence: Synthetic oligonucleotide
cagattctccccagacgccgagatgc

SEQ ID NO: 381589 - DNA, 26 bp, Artificial Sequence
  Description of Artificial Sequence: Synthetic oligonucleotide
agattctccccagacgccgagatgcg

SEQ ID NO: 381590 - DNA, 25 bp, Artificial Sequence
  Description of Artificial Sequence: Synthetic oligonucleotide
gattctccccagacgccgagatgcg

SEQ ID NO: 381591 - DNA, 25 bp, Artificial Sequence
  Description of Artificial Sequence: Synthetic oligonucleotide
attctccccagacgccgagatgcgg

SEQ ID NO: 381592 - DNA, 24 bp, Artificial Sequence
  Description of Artificial Sequence: Synthetic oligonucleotide
ttctccccagacgccgagatgcgg

SEQ ID NO: 381593 - DNA, 23 bp, Artificial Sequence
  Description of Artificial Sequence: Synthetic oligonucleotide
tctccccagacgccgagatgcgg

SEQ ID NO: 381594 - DNA, 22 bp, Artificial Sequence
  Description of Artificial Sequence: Synthetic oligonucleotide
ctccccagacgccgagatgcgg

SEQ ID NO: 381595 - DNA, 23 bp, Artificial Sequence
  Description of Artificial Sequence: Synthetic oligonucleotide
tccccagacgccgagatgcgggt

SEQ ID NO: 381596 - DNA, 22 bp, Artificial Sequence
  Description of Artificial Sequence: Synthetic oligonucleotide
ccccagacgccgagatgcgggt

SEQ ID NO: 381597 - DNA, 24 bp, Artificial Sequence
  Description of Artificial Sequence: Synthetic oligonucleotide
cccagacgccgagatgcgggtcat

SEQ ID NO: 381598 - DNA, 24 bp, Artificial Sequence
  Description of Artificial Sequence: Synthetic oligonucleotide
ccagacgccgagatgcgggtcatg

SEQ ID NO: 381599 - DNA, 24 bp, Artificial Sequence
  Description of Artificial Sequence: Synthetic oligonucleotide
cagacgccgagatgcgggtcatgg

SEQ ID NO: 381600 - DNA, 24 bp, Artificial Sequence
  Description of Artificial Sequence: Synthetic oligonucleotide
agacgccgagatgcgggtcatggc

SEQ ID NO: 381601 - DNA, 23 bp, Artificial Sequence
  Description of Artificial Sequence: Synthetic oligonucleotide
gacgccgagatgcgggtcatggc

SEQ ID NO: 381602 - DNA, 23 bp, Artificial Sequence
  Description of Artificial Sequence: Synthetic oligonucleotide
acgccgagatgcgggtcatggcg

SEQ ID NO: 381603 - DNA, 22 bp, Artificial Sequence
  Description of Artificial Sequence: Synthetic oligonucleotide
cgccgagatgcgggtcatggcg

SEQ ID NO: 381604 - DNA, 22 bp, Artificial Sequence
  Description of Artificial Sequence: Synthetic oligonucleotide
gccgagatgcgggtcatggcgc

SEQ ID NO: 381605 - DNA, 22 bp, Artificial Sequence
  Description of Artificial Sequence: Synthetic oligonucleotide
ccgagatgcgggtcatggcgcc

SEQ ID NO: 381606 - DNA, 22 bp, Artificial Sequence
  Description of Artificial Sequence: Synthetic oligonucleotide
cgagatgcgggtcatggcgccc

SEQ ID NO: 381607 - DNA, 22 bp, Artificial Sequence
  Description of Artificial Sequence: Synthetic oligonucleotide
gagatgcgggtcatggcgcccc

SEQ ID NO: 381608 - DNA, 24 bp, Artificial Sequence
  Description of Artificial Sequence: Synthetic oligonucleotide
agatgcgggtcatggcgccccgaa

SEQ ID NO: 381609 - DNA, 23 bp, Artificial Sequence
  Description of Artificial Sequence: Synthetic oligonucleotide
gatgcgggtcatggcgccccgaa

SEQ ID NO: 381610 - DNA, 23 bp, Artificial Sequence
  Description of Artificial Sequence: Synthetic oligonucleotide
atgcgggtcatggcgccccgaac

SEQ ID NO: 381611 - DNA, 22 bp, Artificial Sequence
  Description of Artificial Sequence: Synthetic oligonucleotide
tgcgggtcatggcgccccgaac

SEQ ID NO: 381612 - DNA, 21 bp, Artificial Sequence
  Description of Artificial Sequence: Synthetic oligonucleotide
gcgggtcatggcgccccgaac

SEQ ID NO: 381613 - DNA, 21 bp, Artificial Sequence
  Description of Artificial Sequence: Synthetic oligonucleotide
cgggtcatggcgccccgaacc

SEQ ID NO: 381614 - DNA, 22 bp, Artificial Sequence
  Description of Artificial Sequence: Synthetic oligonucleotide
gggtcatggcgccccgaaccct

SEQ ID NO: 381615 - DNA, 24 bp, Artificial Sequence
  Description of Artificial Sequence: Synthetic oligonucleotide
ggtcatggcgccccgaaccctcat

SEQ ID NO: 381616 - DNA, 24 bp, Artificial Sequence
  Description of Artificial Sequence: Synthetic oligonucleotide
gtcatggcgccccgaaccctcatc

SEQ ID NO: 381617 - DNA, 25 bp, Artificial Sequence
  Description of Artificial Sequence: Synthetic oligonucleotide
tcatggcgccccgaaccctcatcct

SEQ ID NO: 381618 - DNA, 24 bp, Artificial Sequence
  Description of Artificial Sequence: Synthetic oligonucleotide
catggcgccccgaaccctcatcct

SEQ ID NO: 381619 - DNA, 24 bp, Artificial Sequence
  Description of Artificial Sequence: Synthetic oligonucleotide
atggcgccccgaaccctcatcctg

SEQ ID NO: 381620 - DNA, 23 bp, Artificial Sequence
  Description of Artificial Sequence: Synthetic oligonucleotide
tggcgccccgaaccctcatcctg

SEQ ID NO: 381621 - DNA, 22 bp, Artificial Sequence
  Description of Artificial Sequence: Synthetic oligonucleotide
ggcgccccgaaccctcatcctg

SEQ ID NO: 381622 - DNA, 23 bp, Artificial Sequence
  Description of Artificial Sequence: Synthetic oligonucleotide
gcgccccgaaccctcatcctgct

SEQ ID NO: 381623 - DNA, 23 bp, Artificial Sequence
  Description of Artificial Sequence: Synthetic oligonucleotide
cgccccgaaccctcatcctgctg

SEQ ID NO: 381624 - DNA, 24 bp, Artificial Sequence
  Description of Artificial Sequence: Synthetic oligonucleotide
gccccgaaccctcatcctgctgct

SEQ ID NO: 381625 - DNA, 25 bp, Artificial Sequence
  Description of Artificial Sequence: Synthetic oligonucleotide
ccccgaaccctcatcctgctgctct

SEQ ID NO: 381626 - DNA, 25 bp, Artificial Sequence
  Description of Artificial Sequence: Synthetic oligonucleotide
cccgaaccctcatcctgctgctctc

SEQ ID NO: 381627 - DNA, 25 bp, Artificial Sequence
  Description of Artificial Sequence: Synthetic oligonucleotide
ccgaaccctcatcctgctgctctcg

SEQ ID NO: 381628 - DNA, 25 bp, Artificial Sequence
  Description of Artificial Sequence: Synthetic oligonucleotide
cgaaccctcatcctgctgctctcgg

SEQ ID NO: 381629 - DNA, 26 bp, Artificial Sequence
  Description of Artificial Sequence: Synthetic oligonucleotide
gaaccctcatcctgctgctctcggga

SEQ ID NO: 381630 - DNA, 26 bp, Artificial Sequence
  Description of Artificial Sequence: Synthetic oligonucleotide
aaccctcatcctgctgctctcgggag

SEQ ID NO: 381631 - DNA, 25 bp, Artificial Sequence
  Description of Artificial Sequence: Synthetic oligonucleotide
accctcatcctgctgctctcgggag

SEQ ID NO: 381632 - DNA, 24 bp, Artificial Sequence
  Description of Artificial Sequence: Synthetic oligonucleotide
ccctcatcctgctgctctcgggag

SEQ ID NO: 381633 - DNA, 24 bp, Artificial Sequence
  Description of Artificial Sequence: Synthetic oligonucleotide
cctcatcctgctgctctcgggagc

SEQ ID NO: 381634 - DNA, 24 bp, Artificial Sequence
  Description of Artificial Sequence: Synthetic oligonucleotide
ctcatcctgctgctctcgggagcc

SEQ ID NO: 381635 - DNA, 25 bp, Artificial Sequence
  Description of Artificial Sequence: Synthetic oligonucleotide
tcatcctgctgctctcgggagccct

SEQ ID NO: 381636 - DNA, 24 bp, Artificial Sequence
  Description of Artificial Sequence: Synthetic oligonucleotide
catcctgctgctctcgggagccct

SEQ ID NO: 381637 - DNA, 24 bp, Artificial Sequence
  Description of Artificial Sequence: Synthetic oligonucleotide
atcctgctgctctcgggagccctg

SEQ ID NO: 381638 - DNA, 22 bp, Artificial Sequence
  Description of Artificial Sequence: Synthetic oligonucleotide
gccctgaccgagacctgggcct

SEQ ID NO: 381639 - DNA, 22 bp, Artificial Sequence
  Description of Artificial Sequence: Synthetic oligonucleotide
ccctgaccgagacctgggcctg

SEQ ID NO: 381640 - DNA, 23 bp, Artificial Sequence
  Description of Artificial Sequence: Synthetic oligonucleotide
cctgaccgagacctgggcctgct

SEQ ID NO: 381641 - DNA, 23 bp, Artificial Sequence
  Description of Artificial Sequence: Synthetic oligonucleotide
ctgaccgagacctgggcctgctc

SEQ ID NO: 381642 - DNA, 23 bp, Artificial Sequence
  Description of Artificial Sequence: Synthetic oligonucleotide
tgaccgagacctgggcctgctcc

SEQ ID NO: 381643 - DNA, 22 bp, Artificial Sequence
  Description of Artificial Sequence: Synthetic oligonucleotide
gaccgagacctgggcctgctcc

SEQ ID NO: 381644 - DNA, 23 bp, Artificial Sequence
  Description of Artificial Sequence: Synthetic oligonucleotide
accgagacctgggcctgctccca

SEQ ID NO: 381645 - DNA, 22 bp, Artificial Sequence
  Description of Artificial Sequence: Synthetic oligonucleotide
ccgagacctgggcctgctccca

SEQ ID NO: 381646 - DNA, 23 bp, Artificial Sequence
  Description of Artificial Sequence: Synthetic oligonucleotide
cgagacctgggcctgctcccact

SEQ ID NO: 381647 - DNA, 23 bp, Artificial Sequence
  Description of Artificial Sequence: Synthetic oligonucleotide
gagacctgggcctgctcccactc

SEQ ID NO: 381648 - DNA, 25 bp, Artificial Sequence
  Description of Artificial Sequence: Synthetic oligonucleotide
agacctgggcctgctcccactccat

SEQ ID NO: 381649 - DNA, 24 bp, Artificial Sequence
  Description of Artificial Sequence: Synthetic oligonucleotide
gacctgggcctgctcccactccat

SEQ ID NO: 381650 - DNA, 26 bp, Artificial Sequence
  Description of Artificial Sequence: Synthetic oligonucleotide
acctgggcctgctcccactccatgaa

SEQ ID NO: 381651 - DNA, 25 bp, Artificial Sequence
  Description of Artificial Sequence: Synthetic oligonucleotide
cctgggcctgctcccactccatgaa

SEQ ID NO: 381652 - DNA, 27 bp, Artificial Sequence
  Description of Artificial Sequence: Synthetic oligonucleotide
ctgggcctgctcccactccatgaagta

SEQ ID NO: 381653 - DNA, 30 bp, Artificial Sequence; identical to SEQ ID NO: 41360
  Description of Artificial Sequence: Synthetic oligonucleotide

SEQ ID NO: 381654 - DNA, 29 bp, Artificial Sequence
  Description of Artificial Sequence: Synthetic oligonucleotide
gggcctgctcccactccatgaagtatttc

SEQ ID NO: 381655 - DNA, 31 bp, Artificial Sequence; identical to SEQ ID NO: 41362
  Description of Artificial Sequence: Synthetic oligonucleotide

SEQ ID NO: 381656 - DNA, 32 bp, Artificial Sequence; identical to SEQ ID NO: 41363
  Description of Artificial Sequence: Synthetic oligonucleotide

SEQ ID NO: 381657 - DNA, 34 bp, Artificial Sequence; identical to SEQ ID NO: 41364
  Description of Artificial Sequence: Synthetic oligonucleotide

SEQ ID NO: 381658 - DNA, 34 bp, Artificial Sequence; identical to SEQ ID NO: 41365
  Description of Artificial Sequence: Synthetic oligonucleotide

SEQ ID NO: 381659 - DNA, 34 bp, Artificial Sequence; identical to SEQ ID NO: 41366
  Description of Artificial Sequence: Synthetic oligonucleotide

SEQ ID NO: 381660 - DNA, 33 bp, Artificial Sequence; identical to SEQ ID NO: 2155
  Description of Artificial Sequence: Synthetic oligonucleotide

SEQ ID NO: 381661 - DNA, 34 bp, Artificial Sequence; identical to SEQ ID NO: 2156
  Description of Artificial Sequence: Synthetic oligonucleotide

SEQ ID NO: 381662 - DNA, 35 bp, Artificial Sequence; identical to SEQ ID NO: 2157
  Description of Artificial Sequence: Synthetic oligonucleotide

SEQ ID NO: 381663 - DNA, 34 bp, Artificial Sequence; identical to SEQ ID NO: 2158
  Description of Artificial Sequence: Synthetic oligonucleotide

SEQ ID NO: 381664 - DNA, 34 bp, Artificial Sequence; identical to SEQ ID NO: 2159
  Description of Artificial Sequence: Synthetic oligonucleotide

SEQ ID NO: 381665 - DNA, 34 bp, Artificial Sequence; identical to SEQ ID NO: 2160
  Description of Artificial Sequence: Synthetic oligonucleotide

SEQ ID NO: 381666 - DNA, 34 bp, Artificial Sequence; identical to SEQ ID NO: 2161
  Description of Artificial Sequence: Synthetic oligonucleotide

SEQ ID NO: 381667 - DNA, 33 bp, Artificial Sequence; identical to SEQ ID NO: 2162
  Description of Artificial Sequence: Synthetic oligonucleotide

SEQ ID NO: 381668 - DNA, 33 bp, Artificial Sequence; identical to SEQ ID NO: 2163
  Description of Artificial Sequence: Synthetic oligonucleotide

SEQ ID NO: 381669 - DNA, 32 bp, Artificial Sequence; identical to SEQ ID NO: 2164
  Description of Artificial Sequence: Synthetic oligonucleotide

SEQ ID NO: 381670 - DNA, 32 bp, Artificial Sequence; identical to SEQ ID NO: 2165
  Description of Artificial Sequence: Synthetic oligonucleotide

SEQ ID NO: 381671 - DNA, 32 bp, Artificial Sequence; identical to SEQ ID NO: 2166
  Description of Artificial Sequence: Synthetic oligonucleotide

SEQ ID NO: 381672 - DNA, 31 bp, Artificial Sequence; identical to SEQ ID NO: 2167
  Description of Artificial Sequence: Synthetic oligonucleotide

SEQ ID NO: 381673 - DNA, 30 bp, Artificial Sequence; identical to SEQ ID NO: 2168
  Description of Artificial Sequence: Synthetic oligonucleotide

SEQ ID NO: 381674 - DNA, 31 bp, Artificial Sequence; identical to SEQ ID NO: 41367
  Description of Artificial Sequence: Synthetic oligonucleotide

SEQ ID NO: 381675 - DNA, 30 bp, Artificial Sequence; identical to SEQ ID NO: 41368
  Description of Artificial Sequence: Synthetic oligonucleotide

SEQ ID NO: 381676 - DNA, 20 bp, Artificial Sequence
  Description of Artificial Sequence: Synthetic oligonucleotide
tgtcccggcctggccgcgga

SEQ ID NO: 381677 - DNA, 20 bp, Artificial Sequence
  Description of Artificial Sequence: Synthetic oligonucleotide
gtcccggcctggccgcggat

SEQ ID NO: 381678 - DNA, 20 bp, Artificial Sequence
  Description of Artificial Sequence: Synthetic oligonucleotide
tcccggcctggccgcggaga

SEQ ID NO: 381679 - DNA, 20 bp, Artificial Sequence
  Description of Artificial Sequence: Synthetic oligonucleotide
cccggcctggccgcggagat

SEQ ID NO: 381680 - DNA, 20 bp, Artificial Sequence
  Description of Artificial Sequence: Synthetic oligonucleotide
ccggcctggccgcggagagt

SEQ ID NO: 381681 - DNA, 20 bp, Artificial Sequence
  Description of Artificial Sequence: Synthetic oligonucleotide
cggcctggccgcggagagct

SEQ ID NO: 381682 - DNA, 20 bp, Artificial Sequence
  Description of Artificial Sequence: Synthetic oligonucleotide
ggcctggccgcggagagcct

SEQ ID NO: 381683 - DNA, 20 bp, Artificial Sequence
  Description of Artificial Sequence: Synthetic oligonucleotide
gcctggccgcggagagccct

SEQ ID NO: 381684 - DNA, 20 bp, Artificial Sequence
  Description of Artificial Sequence: Synthetic oligonucleotide
cctggccgcggagagcccct

SEQ ID NO: 381685 - DNA, 20 bp, Artificial Sequence
  Description of Artificial Sequence: Synthetic oligonucleotide
ctggccgcggagagccccgt

SEQ ID NO: 381686 - DNA, 21 bp, Artificial Sequence
  Description of Artificial Sequence: Synthetic oligonucleotide
tggccgcggagagccccgctt

SEQ ID NO: 381687 - DNA, 26 bp, Artificial Sequence
  Description of Artificial Sequence: Synthetic oligonucleotide
cgggtctcacaccctccagtggatgt

SEQ ID NO: 381688 - DNA, 27 bp, Artificial Sequence
  Description of Artificial Sequence: Synthetic oligonucleotide
gggtctcacaccctccagtggatgtgt

SEQ ID NO: 381689 - DNA, 27 bp, Artificial Sequence
  Description of Artificial Sequence: Synthetic oligonucleotide
ggtctcacaccctccagtggatgtgtg

SEQ ID NO: 381690 - DNA, 27 bp, Artificial Sequence
  Description of Artificial Sequence: Synthetic oligonucleotide
gtctcacaccctccagtggatgtgtgg

SEQ ID NO: 381691 - DNA, 27 bp, Artificial Sequence
  Description of Artificial Sequence: Synthetic oligonucleotide
tctcacaccctccagtggatgtgtggc

SEQ ID NO: 381692 - DNA, 27 bp, Artificial Sequence
  Description of Artificial Sequence: Synthetic oligonucleotide
ctcacaccctccagtggatgtgtggct

SEQ ID NO: 381693 - DNA, 27 bp, Artificial Sequence
  Description of Artificial Sequence: Synthetic oligonucleotide
tcacaccctccagtggatgtgtggctg

SEQ ID NO: 381694 - DNA, 26 bp, Artificial Sequence
  Description of Artificial Sequence: Synthetic oligonucleotide
cacaccctccagtggatgtgtggctg

SEQ ID NO: 381695 - DNA, 26 bp, Artificial Sequence
  Description of Artificial Sequence: Synthetic oligonucleotide
acaccctccagtggatgtgtggctgc

SEQ ID NO: 381696 - DNA, 25 bp, Artificial Sequence
  Description of Artificial Sequence: Synthetic oligonucleotide
caccctccagtggatgtgtggctgc

SEQ ID NO: 381697 - DNA, 26 bp, Artificial Sequence
  Description of Artificial Sequence: Synthetic oligonucleotide
accctccagtggatgtgtggctgcga

SEQ ID NO: 381698 - DNA, 25 bp, Artificial Sequence
  Description of Artificial Sequence: Synthetic oligonucleotide
ccctccagtggatgtgtggctgcga

SEQ ID NO: 381699 - DNA, 25 bp, Artificial Sequence
  Description of Artificial Sequence: Synthetic oligonucleotide
cctccagtggatgtgtggctgcgac

SEQ ID NO: 381700 - DNA, 26 bp, Artificial Sequence
  Description of Artificial Sequence: Synthetic oligonucleotide
ctccagtggatgtgtggctgcgacct

SEQ ID NO: 381701 - DNA, 26 bp, Artificial Sequence
  Description of Artificial Sequence: Synthetic oligonucleotide
tccagtggatgtgtggctgcgacctg

SEQ ID NO: 381702 - DNA, 25 bp, Artificial Sequence
  Description of Artificial Sequence: Synthetic oligonucleotide
ccagtggatgtgtggctgcgacctg

SEQ ID NO: 381703 - DNA, 25 bp, Artificial Sequence
  Description of Artificial Sequence: Synthetic oligonucleotide
cagtggatgtgtggctgcgacctgg

SEQ ID NO: 381704 - DNA, 25 bp, Artificial Sequence
  Description of Artificial Sequence: Synthetic oligonucleotide
agtggatgtgtggctgcgacctggg

SEQ ID NO: 381705 - DNA, 24 bp, Artificial Sequence
  Description of Artificial Sequence: Synthetic oligonucleotide
gtggatgtgtggctgcgacctggg

SEQ ID NO: 381706 - DNA, 24 bp, Artificial Sequence
  Description of Artificial Sequence: Synthetic oligonucleotide
tggatgtgtggctgcgacctgggg

SEQ ID NO: 381707 - DNA, 23 bp, Artificial Sequence
  Description of Artificial Sequence: Synthetic oligonucleotide
ggatgtgtggctgcgacctgggg

SEQ ID NO: 381708 - DNA, 23 bp, Artificial Sequence
  Description of Artificial Sequence: Synthetic oligonucleotide
gatgtgtggctgcgacctggggc

SEQ ID NO: 381709 - DNA, 23 bp, Artificial Sequence
  Description of Artificial Sequence: Synthetic oligonucleotide
atgtgtggctgcgacctggggcc

SEQ ID NO: 381710 - DNA, 22 bp, Artificial Sequence
  Description of Artificial Sequence: Synthetic oligonucleotide
tgtgtggctgcgacctggggcc

SEQ ID NO: 381711 - DNA, 21 bp, Artificial Sequence
  Description of Artificial Sequence: Synthetic oligonucleotide
gtgtggctgcgacctggggcc

SEQ ID NO: 381712 - DNA, 21 bp, Artificial Sequence
  Description of Artificial Sequence: Synthetic oligonucleotide
tgtggctgcgacctggggccc

SEQ ID NO: 381713 - DNA, 20 bp, Artificial Sequence
  Description of Artificial Sequence: Synthetic oligonucleotide
gtggctgcgacctggggccc

SEQ ID NO: 381714 - DNA, 24 bp, Artificial Sequence
  Description of Artificial Sequence: Synthetic oligonucleotide
aaggagacgctgcagcgcgcggaa

SEQ ID NO: 381715 - DNA, 23 bp, Artificial Sequence
  Description of Artificial Sequence: Synthetic oligonucleotide
aggagacgctgcagcgcgcggaa

SEQ ID NO: 381716 - DNA, 22 bp, Artificial Sequence
  Description of Artificial Sequence: Synthetic oligonucleotide
ggagacgctgcagcgcgcggaa

SEQ ID NO: 381717 - DNA, 23 bp, Artificial Sequence
  Description of Artificial Sequence: Synthetic oligonucleotide
gagacgctgcagcgcgcggaaca

SEQ ID NO: 381718 - DNA, 23 bp, Artificial Sequence
  Description of Artificial Sequence: Synthetic oligonucleotide
agacgctgcagcgcgcggaacac

SEQ ID NO: 381719 - DNA, 22 bp, Artificial Sequence
  Description of Artificial Sequence: Synthetic oligonucleotide
gacgctgcagcgcgcggaacac

SEQ ID NO: 381720 - DNA, 22 bp, Artificial Sequence
  Description of Artificial Sequence: Synthetic oligonucleotide
acgctgcagcgcgcggaacacc

SEQ ID NO: 381721 - DNA, 21 bp, Artificial Sequence
  Description of Artificial Sequence: Synthetic oligonucleotide
cgctgcagcgcgcggaacacc

SEQ ID NO: 381722 - DNA, 24 bp, Artificial Sequence
  Description of Artificial Sequence: Synthetic oligonucleotide
gctgcagcgcgcggaacacccaaa

SEQ ID NO: 381723 - DNA, 25 bp, Artificial Sequence
  Description of Artificial Sequence: Synthetic oligonucleotide
ctgcagcgcgcggaacacccaaaga

SEQ ID NO: 381724 - DNA, 26 bp, Artificial Sequence
  Description of Artificial Sequence: Synthetic oligonucleotide
tgcagcgcgcggaacacccaaagaca

SEQ ID NO: 381725 - DNA, 25 bp, Artificial Sequence
  Description of Artificial Sequence: Synthetic oligonucleotide
gcagcgcgcggaacacccaaagaca

SEQ ID NO: 381726 - DNA, 26 bp, Artificial Sequence
  Description of Artificial Sequence: Synthetic oligonucleotide
cagcgcgcggaacacccaaagacaca

SEQ ID NO: 381727 - DNA, 26 bp, Artificial Sequence
  Description of Artificial Sequence: Synthetic oligonucleotide
agcgcgcggaacacccaaagacacac

SEQ ID NO: 381728 - DNA, 25 bp, Artificial Sequence
  Description of Artificial Sequence: Synthetic oligonucleotide
gcgcgcggaacacccaaagacacac

SEQ ID NO: 381729 - DNA, 26 bp, Artificial Sequence
  Description of Artificial Sequence: Synthetic oligonucleotide
cgcgcggaacacccaaagacacacgt

SEQ ID NO: 381730 - DNA, 27 bp, Artificial Sequence
  Description of Artificial Sequence: Synthetic oligonucleotide
gcgcggaacacccaaagacacacgtga

SEQ ID NO: 381731 - DNA, 27 bp, Artificial Sequence
  Description of Artificial Sequence: Synthetic oligonucleotide
cgcggaacacccaaagacacacgtgac

SEQ ID NO: 381732 - DNA, 27 bp, Artificial Sequence
  Description of Artificial Sequence: Synthetic oligonucleotide
gcggaacacccaaagacacacgtgacc

SEQ ID NO: 381733 - DNA, 27 bp, Artificial Sequence
  Description of Artificial Sequence: Synthetic oligonucleotide
cggaacacccaaagacacacgtgaccc

SEQ ID NO: 381734 - DNA, 28 bp, Artificial Sequence
  Description of Artificial Sequence: Synthetic oligonucleotide
ggaacacccaaagacacacgtgacccac

SEQ ID NO: 381735 - DNA, 28 bp, Artificial Sequence
  Description of Artificial Sequence: Synthetic oligonucleotide
gaacacccaaagacacacgtgacccacc

SEQ ID NO: 381736 - DNA, 30 bp, Artificial Sequence; identical to SEQ ID NO: 41429
  Description of Artificial Sequence: Synthetic oligonucleotide

SEQ ID NO: 381737 - DNA, 29 bp, Artificial Sequence
  Description of Artificial Sequence: Synthetic oligonucleotide
acacccaaagacacacgtgacccaccatc

SEQ ID NO: 381738 - DNA, 28 bp, Artificial Sequence
  Description of Artificial Sequence: Synthetic oligonucleotide
cacccaaagacacacgtgacccaccatc

SEQ ID NO: 381739 - DNA, 28 bp, Artificial Sequence
  Description of Artificial Sequence: Synthetic oligonucleotide
acccaaagacacacgtgacccaccatcc

SEQ ID NO: 381740 - DNA, 27 bp, Artificial Sequence
  Description of Artificial Sequence: Synthetic oligonucleotide
ctgcggagatcacactgacctggcagt

SEQ ID NO: 381741 - DNA, 27 bp, Artificial Sequence
  Description of Artificial Sequence: Synthetic oligonucleotide
tgcggagatcacactgacctggcagtg

SEQ ID NO: 381742 - DNA, 26 bp, Artificial Sequence
  Description of Artificial Sequence: Synthetic oligonucleotide
gcggagatcacactgacctggcagtg

SEQ ID NO: 381743 - DNA, 26 bp, Artificial Sequence
  Description of Artificial Sequence: Synthetic oligonucleotide
cggagatcacactgacctggcagtgg

SEQ ID NO: 381744 - DNA, 27 bp, Artificial Sequence
  Description of Artificial Sequence: Synthetic oligonucleotide
ggagatcacactgacctggcagtggga

SEQ ID NO: 381745 - DNA, 28 bp, Artificial Sequence
  Description of Artificial Sequence: Synthetic oligonucleotide
gagatcacactgacctggcagtgggatg

SEQ ID NO: 381746 - DNA, 28 bp, Artificial Sequence
  Description of Artificial Sequence: Synthetic oligonucleotide
agatcacactgacctggcagtgggatgg

SEQ ID NO: 381747 - DNA, 27 bp, Artificial Sequence
  Description of Artificial Sequence: Synthetic oligonucleotide
gatcacactgacctggcagtgggatgg

SEQ ID NO: 381748 - DNA, 27 bp, Artificial Sequence
  Description of Artificial Sequence: Synthetic oligonucleotide
atcacactgacctggcagtgggatggg

SEQ ID NO: 381749 - DNA, 26 bp, Artificial Sequence
  Description of Artificial Sequence: Synthetic oligonucleotide
tcacactgacctggcagtgggatggg

SEQ ID NO: 381750 - DNA, 25 bp, Artificial Sequence
  Description of Artificial Sequence: Synthetic oligonucleotide
cacactgacctggcagtgggatggg

SEQ ID NO: 381751 - DNA, 26 bp, Artificial Sequence
  Description of Artificial Sequence: Synthetic oligonucleotide
acactgacctggcagtgggatgggga

SEQ ID NO: 381752 - DNA, 25 bp, Artificial Sequence
  Description of Artificial Sequence: Synthetic oligonucleotide
cactgacctggcagtgggatgggga

SEQ ID NO: 381753 - DNA, 25 bp, Artificial Sequence
  Description of Artificial Sequence: Synthetic oligonucleotide
actgacctggcagtgggatggggag

SEQ ID NO: 381754 - DNA, 24 bp, Artificial Sequence
  Description of Artificial Sequence: Synthetic oligonucleotide
ctgacctggcagtgggatggggag

SEQ ID NO: 381755 - DNA, 25 bp, Artificial Sequence
  Description of Artificial Sequence: Synthetic oligonucleotide
tgacctggcagtgggatggggagga

SEQ ID NO: 381756 - DNA, 24 bp, Artificial Sequence
  Description of Artificial Sequence: Synthetic oligonucleotide
gacctggcagtgggatggggagga

SEQ ID NO: 381757 - DNA, 24 bp, Artificial Sequence
  Description of Artificial Sequence: Synthetic oligonucleotide
acctggcagtgggatggggaggac

SEQ ID NO: 381758 - DNA, 23 bp, Artificial Sequence
  Description of Artificial Sequence: Synthetic oligonucleotide
cctggcagtgggatggggaggac

SEQ ID NO: 381759 - DNA, 26 bp, Artificial Sequence
  Description of Artificial Sequence: Synthetic oligonucleotide
ctggcagtgggatggggaggaccaaa

SEQ ID NO: 381760 - DNA, 27 bp, Artificial Sequence
  Description of Artificial Sequence: Synthetic oligonucleotide
tggcagtgggatggggaggaccaaact

SEQ ID NO: 381761 - DNA, 26 bp, Artificial Sequence
  Description of Artificial Sequence: Synthetic oligonucleotide
ggcagtgggatggggaggaccaaact

SEQ ID NO: 381762 - DNA, 27 bp, Artificial Sequence
  Description of Artificial Sequence: Synthetic oligonucleotide
gcagtgggatggggaggaccaaactca

SEQ ID NO: 381763 - DNA, 27 bp, Artificial Sequence
  Description of Artificial Sequence: Synthetic oligonucleotide
cagtgggatggggaggaccaaactcag

SEQ ID NO: 381764 - DNA, 27 bp, Artificial Sequence
  Description of Artificial Sequence: Synthetic oligonucleotide
agtgggatggggaggaccaaactcagg

SEQ ID NO: 381765 - DNA, 27 bp, Artificial Sequence
  Description of Artificial Sequence: Synthetic oligonucleotide
gtgggatggggaggaccaaactcagga

SEQ ID NO: 381766 - DNA, 27 bp, Artificial Sequence
  Description of Artificial Sequence: Synthetic oligonucleotide
tgggatggggaggaccaaactcaggac

SEQ ID NO: 381767 - DNA, 27 bp, Artificial Sequence
  Description of Artificial Sequence: Synthetic oligonucleotide
gggatggggaggaccaaactcaggaca

SEQ ID NO: 381768 - DNA, 27 bp, Artificial Sequence
  Description of Artificial Sequence: Synthetic oligonucleotide
ggatggggaggaccaaactcaggacac

SEQ ID NO: 381769 - DNA, 27 bp, Artificial Sequence
  Description of Artificial Sequence: Synthetic oligonucleotide
gatggggaggaccaaactcaggacacc

SEQ ID NO: 381770 - DNA, 27 bp, Artificial Sequence
  Description of Artificial Sequence: Synthetic oligonucleotide
atggggaggaccaaactcaggacaccg

SEQ ID NO: 381771 - DNA, 27 bp, Artificial Sequence
  Description of Artificial Sequence: Synthetic oligonucleotide
tggggaggaccaaactcaggacaccga

SEQ ID NO: 381772 - DNA, 26 bp, Artificial Sequence
  Description of Artificial Sequence: Synthetic oligonucleotide
ggggaggaccaaactcaggacaccga

SEQ ID NO: 381773 - DNA, 26 bp, Artificial Sequence
  Description of Artificial Sequence: Synthetic oligonucleotide
gggaggaccaaactcaggacaccgag

SEQ ID NO: 381774 - DNA, 27 bp, Artificial Sequence
  Description of Artificial Sequence: Synthetic oligonucleotide
ggaggaccaaactcaggacaccgagct

SEQ ID NO: 381775 - DNA, 29 bp, Artificial Sequence
  Description of Artificial Sequence: Synthetic oligonucleotide
gaaccttccagaagtgggcagctgtgatg

SEQ ID NO: 381776 - DNA, 29 bp, Artificial Sequence
  Description of Artificial Sequence: Synthetic oligonucleotide
aaccttccagaagtgggcagctgtgatgg

SEQ ID NO: 381777 - DNA, 28 bp, Artificial Sequence
  Description of Artificial Sequence: Synthetic oligonucleotide
accttccagaagtgggcagctgtgatgg

SEQ ID NO: 381778 - DNA, 27 bp, Artificial Sequence
  Description of Artificial Sequence: Synthetic oligonucleotide
ccttccagaagtgggcagctgtgatgg

SEQ ID NO: 381779 - DNA, 28 bp, Artificial Sequence
  Description of Artificial Sequence: Synthetic oligonucleotide
cttccagaagtgggcagctgtgatggtg

SEQ ID NO: 381780 - DNA, 28 bp, Artificial Sequence
  Description of Artificial Sequence: Synthetic oligonucleotide
ttccagaagtgggcagctgtgatggtgc

SEQ ID NO: 381781 - DNA, 27 bp, Artificial Sequence
  Description of Artificial Sequence: Synthetic oligonucleotide
tccagaagtgggcagctgtgatggtgc

SEQ ID NO: 381782 - DNA, 26 bp, Artificial Sequence
  Description of Artificial Sequence: Synthetic oligonucleotide
ccagaagtgggcagctgtgatggtgc

SEQ ID NO: 381783 - DNA, 27 bp, Artificial Sequence
  Description of Artificial Sequence: Synthetic oligonucleotide
cagaagtgggcagctgtgatggtgcct

SEQ ID NO: 381784 - DNA, 28 bp, Artificial Sequence
  Description of Artificial Sequence: Synthetic oligonucleotide
agaagtgggcagctgtgatggtgccttc

SEQ ID NO: 381785 - DNA, 27 bp, Artificial Sequence
  Description of Artificial Sequence: Synthetic oligonucleotide
gaagtgggcagctgtgatggtgccttc

SEQ ID NO: 381786 - DNA, 28 bp, Artificial Sequence
  Description of Artificial Sequence: Synthetic oligonucleotide
aagtgggcagctgtgatggtgccttctg

SEQ ID NO: 381787 - DNA, 27 bp, Artificial Sequence
  Description of Artificial Sequence: Synthetic oligonucleotide
agtgggcagctgtgatggtgccttctg

SEQ ID NO: 381788 - DNA, 26 bp, Artificial Sequence
  Description of Artificial Sequence: Synthetic oligonucleotide
gtgggcagctgtgatggtgccttctg

SEQ ID NO: 381789 - DNA, 27 bp, Artificial Sequence
  Description of Artificial Sequence: Synthetic oligonucleotide
tgggcagctgtgatggtgccttctgga

SEQ ID NO: 381790 - DNA, 26 bp, Artificial Sequence
  Description of Artificial Sequence: Synthetic oligonucleotide
gggcagctgtgatggtgccttctgga

SEQ ID NO: 381791 - DNA, 27 bp, Artificial Sequence
  Description of Artificial Sequence: Synthetic oligonucleotide
ggcagctgtgatggtgccttctggaga

SEQ ID NO: 381792 - DNA, 28 bp, Artificial Sequence
  Description of Artificial Sequence: Synthetic oligonucleotide
gcagctgtgatggtgccttctggagaag

SEQ ID NO: 381793 - DNA, 29 bp, Artificial Sequence
  Description of Artificial Sequence: Synthetic oligonucleotide
cagctgtgatggtgccttctggagaagag

SEQ ID NO: 381794 - DNA, 29 bp, Artificial Sequence
  Description of Artificial Sequence: Synthetic oligonucleotide
agctgtgatggtgccttctggagaagagc

SEQ ID NO: 381795 - DNA, 28 bp, Artificial Sequence
  Description of Artificial Sequence: Synthetic oligonucleotide
gctgtgatggtgccttctggagaagagc

SEQ ID NO: 381796 - DNA, 29 bp, Artificial Sequence
  Description of Artificial Sequence: Synthetic oligonucleotide
ctgtgatggtgccttctggagaagagcag

SEQ ID NO: 381797 - DNA, 30 bp, Artificial Sequence; identical to SEQ ID NO: 35317
  Description of Artificial Sequence: Synthetic oligonucleotide

SEQ ID NO: 381798 - DNA, 29 bp, Artificial Sequence
  Description of Artificial Sequence: Synthetic oligonucleotide
gtgatggtgccttctggagaagagcagag

SEQ ID NO: 381799 - DNA, 32 bp, Artificial Sequence; identical to SEQ ID NO: 35319
  Description of Artificial Sequence: Synthetic oligonucleotide

SEQ ID NO: 381800 - DNA, 31 bp, Artificial Sequence; identical to SEQ ID NO: 35320
  Description of Artificial Sequence: Synthetic oligonucleotide

SEQ ID NO: 381801 - DNA, 32 bp, Artificial Sequence; identical to SEQ ID NO: 35321
  Description of Artificial Sequence: Synthetic oligonucleotide

SEQ ID NO: 381802 - DNA, 30 bp, Artificial Sequence; identical to SEQ ID NO: 41474
  Description of Artificial Sequence: Synthetic oligonucleotide

SEQ ID NO: 381803 - DNA, 31 bp, Artificial Sequence; identical to SEQ ID NO: 41475
  Description of Artificial Sequence: Synthetic oligonucleotide

SEQ ID NO: 381804 - DNA, 30 bp, Artificial Sequence; identical to SEQ ID NO: 41476
  Description of Artificial Sequence: Synthetic oligonucleotide

SEQ ID NO: 381805 - DNA, 30 bp, Artificial Sequence; identical to SEQ ID NO: 41477
  Description of Artificial Sequence: Synthetic oligonucleotide

SEQ ID NO: 381806 - DNA, 30 bp, Artificial Sequence; identical to SEQ ID NO: 41478
  Description of Artificial Sequence: Synthetic oligonucleotide

SEQ ID NO: 381807 - DNA, 32 bp, Artificial Sequence; identical to SEQ ID NO: 41479
  Description of Artificial Sequence: Synthetic oligonucleotide

SEQ ID NO: 381808 - DNA, 31 bp, Artificial Sequence; identical to SEQ ID NO: 41480
  Description of Artificial Sequence: Synthetic oligonucleotide

SEQ ID NO: 381809 - DNA, 30 bp, Artificial Sequence; identical to SEQ ID NO: 41481
  Description of Artificial Sequence: Synthetic oligonucleotide

SEQ ID NO: 381810 - DNA, 31 bp, Artificial Sequence; identical to SEQ ID NO: 41482
  Description of Artificial Sequence: Synthetic oligonucleotide

SEQ ID NO: 381811 - DNA, 30 bp, Artificial Sequence; identical to SEQ ID NO: 41483
  Description of Artificial Sequence: Synthetic oligonucleotide

SEQ ID NO: 381812 - DNA, 30 bp, Artificial Sequence; identical to SEQ ID NO: 41484
  Description of Artificial Sequence: Synthetic oligonucleotide

SEQ ID NO: 381813 - DNA, 31 bp, Artificial Sequence; identical to SEQ ID NO: 41485
  Description of Artificial Sequence: Synthetic oligonucleotide

SEQ ID NO: 381814 - DNA, 30 bp, Artificial Sequence; identical to SEQ ID NO: 41486
  Description of Artificial Sequence: Synthetic oligonucleotide

SEQ ID NO: 381815 - DNA, 30 bp, Artificial Sequence; identical to SEQ ID NO: 41487
  Description of Artificial Sequence: Synthetic oligonucleotide

SEQ ID NO: 381816 - DNA, 29 bp, Artificial Sequence
  Description of Artificial Sequence: Synthetic oligonucleotide
agagcagagatacacgtgccatgtgcagc

SEQ ID NO: 381817 - DNA, 28 bp, Artificial Sequence
  Description of Artificial Sequence: Synthetic oligonucleotide
gagcagagatacacgtgccatgtgcagc

SEQ ID NO: 381818 - DNA, 29 bp, Artificial Sequence
  Description of Artificial Sequence: Synthetic oligonucleotide
agcagagatacacgtgccatgtgcagcac

SEQ ID NO: 381819 - DNA, 28 bp, Artificial Sequence
  Description of Artificial Sequence: Synthetic oligonucleotide
gcagagatacacgtgccatgtgcagcac

SEQ ID NO: 381820 - DNA, 23 bp, Artificial Sequence
  Description of Artificial Sequence: Synthetic oligonucleotide
ccatgtgcagcacgaggggctgc

SEQ ID NO: 381821 - DNA, 23 bp, Artificial Sequence
  Description of Artificial Sequence: Synthetic oligonucleotide
catgtgcagcacgaggggctgcc

SEQ ID NO: 381822 - DNA, 23 bp, Artificial Sequence
  Description of Artificial Sequence: Synthetic oligonucleotide
atgtgcagcacgaggggctgccg

SEQ ID NO: 381823 - DNA, 22 bp, Artificial Sequence
  Description of Artificial Sequence: Synthetic oligonucleotide
tgtgcagcacgaggggctgccg

SEQ ID NO: 381824 - DNA, 21 bp, Artificial Sequence
  Description of Artificial Sequence: Synthetic oligonucleotide
gtgcagcacgaggggctgccg

SEQ ID NO: 381825 - DNA, 22 bp, Artificial Sequence
  Description of Artificial Sequence: Synthetic oligonucleotide
tgcagcacgaggggctgccgga

SEQ ID NO: 381826 - DNA, 21 bp, Artificial Sequence
  Description of Artificial Sequence: Synthetic oligonucleotide
gcagcacgaggggctgccgga

SEQ ID NO: 381827 - DNA, 21 bp, Artificial Sequence
  Description of Artificial Sequence: Synthetic oligonucleotide
cagcacgaggggctgccggag

SEQ ID NO: 381828 - DNA, 21 bp, Artificial Sequence
  Description of Artificial Sequence: Synthetic oligonucleotide
agcacgaggggctgccggagc

SEQ ID NO: 381829 - DNA, 20 bp, Artificial Sequence
  Description of Artificial Sequence: Synthetic oligonucleotide
gcacgaggggctgccggagc

SEQ ID NO: 381830 - DNA, 20 bp, Artificial Sequence
  Description of Artificial Sequence: Synthetic oligonucleotide
cacgaggggctgccggagcc

SEQ ID NO: 381831 - DNA, 20 bp, Artificial Sequence
  Description of Artificial Sequence: Synthetic oligonucleotide
acgaggggctgccggagccc

SEQ ID NO: 381832 - DNA, 20 bp, Artificial Sequence
  Description of Artificial Sequence: Synthetic oligonucleotide
cgaggggctgccggagccct

SEQ ID NO: 381833 - DNA, 20 bp, Artificial Sequence
  Description of Artificial Sequence: Synthetic oligonucleotide
gaggggctgccggagcccct

SEQ ID NO: 381834 - DNA, 21 bp, Artificial Sequence
  Description of Artificial Sequence: Synthetic oligonucleotide
aggggctgccggagcccctca

SEQ ID NO: 381835 - DNA, 20 bp, Artificial Sequence
  Description of Artificial Sequence: Synthetic oligonucleotide
ggggctgccggagcccctca

SEQ ID NO: 381836 - DNA, 20 bp, Artificial Sequence
  Description of Artificial Sequence: Synthetic oligonucleotide
gggctgccggagcccctcac

SEQ ID NO: 381837 - DNA, 20 bp, Artificial Sequence
  Description of Artificial Sequence: Synthetic oligonucleotide
ggctgccggagcccctcacc

SEQ ID NO: 381838 - DNA, 21 bp, Artificial Sequence
  Description of Artificial Sequence: Synthetic oligonucleotide
gctgccggagcccctcaccct

SEQ ID NO: 381839 - DNA, 22 bp, Artificial Sequence
  Description of Artificial Sequence: Synthetic oligonucleotide
ctgccggagcccctcaccctga

SEQ ID NO: 381840 - DNA, 24 bp, Artificial Sequence
  Description of Artificial Sequence: Synthetic oligonucleotide
tgccggagcccctcaccctgagat

SEQ ID NO: 381841 - DNA, 23 bp, Artificial Sequence
  Description of Artificial Sequence: Synthetic oligonucleotide
gccggagcccctcaccctgagat

SEQ ID NO: 381842 - DNA, 23 bp, Artificial Sequence
  Description of Artificial Sequence: Synthetic oligonucleotide
ccggagcccctcaccctgagatg

SEQ ID NO: 381843 - DNA, 23 bp, Artificial Sequence
  Description of Artificial Sequence: Synthetic oligonucleotide
cggagcccctcaccctgagatgg

SEQ ID NO: 381844 - DNA, 24 bp, Artificial Sequence
  Description of Artificial Sequence: Synthetic oligonucleotide
ggagcccctcaccctgagatggga

SEQ ID NO: 381845 - DNA, 26 bp, Artificial Sequence
  Description of Artificial Sequence: Synthetic oligonucleotide
ccaccatccccatcgtgggcatcgtt

SEQ ID NO: 381846 - DNA, 26 bp, Artificial Sequence
  Description of Artificial Sequence: Synthetic oligonucleotide
caccatccccatcgtgggcatcgttg

SEQ ID NO: 381847 - DNA, 27 bp, Artificial Sequence
  Description of Artificial Sequence: Synthetic oligonucleotide
accatccccatcgtgggcatcgttgct

SEQ ID NO: 381848 - DNA, 26 bp, Artificial Sequence
  Description of Artificial Sequence: Synthetic oligonucleotide
ccatccccatcgtgggcatcgttgct

SEQ ID NO: 381849 - DNA, 26 bp, Artificial Sequence
  Description of Artificial Sequence: Synthetic oligonucleotide
catccccatcgtgggcatcgttgctg

SEQ ID NO: 381850 - DNA, 26 bp, Artificial Sequence
  Description of Artificial Sequence: Synthetic oligonucleotide
atccccatcgtgggcatcgttgctgg

SEQ ID NO: 381851 - DNA, 25 bp, Artificial Sequence
  Description of Artificial Sequence: Synthetic oligonucleotide
tccccatcgtgggcatcgttgctgg

SEQ ID NO: 381852 - DNA, 24 bp, Artificial Sequence
  Description of Artificial Sequence: Synthetic oligonucleotide
ccccatcgtgggcatcgttgctgg

SEQ ID NO: 381853 - DNA, 24 bp, Artificial Sequence
  Description of Artificial Sequence: Synthetic oligonucleotide
cccatcgtgggcatcgttgctggc

SEQ ID NO: 381854 - DNA, 25 bp, Artificial Sequence
  Description of Artificial Sequence: Synthetic oligonucleotide
ccatcgtgggcatcgttgctggcct

SEQ ID NO: 381855 - DNA, 25 bp, Artificial Sequence
  Description of Artificial Sequence: Synthetic oligonucleotide
catcgtgggcatcgttgctggcctg

SEQ ID NO: 381856 - DNA, 25 bp, Artificial Sequence
  Description of Artificial Sequence: Synthetic oligonucleotide
atcgtgggcatcgttgctggcctgg

SEQ ID NO: 381857 - DNA, 24 bp, Artificial Sequence
  Description of Artificial Sequence: Synthetic oligonucleotide
tcgtgggcatcgttgctggcctgg

SEQ ID NO: 381858 - DNA, 23 bp, Artificial Sequence
  Description of Artificial Sequence: Synthetic oligonucleotide
cgtgggcatcgttgctggcctgg

SEQ ID NO: 381859 - DNA, 24 bp, Artificial Sequence
  Description of Artificial Sequence: Synthetic oligonucleotide
gtgggcatcgttgctggcctggct

SEQ ID NO: 381860 - DNA, 25 bp, Artificial Sequence
  Description of Artificial Sequence: Synthetic oligonucleotide
tgggcatcgttgctggcctggctgt

SEQ ID NO: 381861 - DNA, 24 bp, Artificial Sequence
  Description of Artificial Sequence: Synthetic oligonucleotide
gggcatcgttgctggcctggctgt

SEQ ID NO: 381862 - DNA, 24 bp, Artificial Sequence
  Description of Artificial Sequence: Synthetic oligonucleotide
ggcatcgttgctggcctggctgtc

SEQ ID NO: 381863 - DNA, 25 bp, Artificial Sequence
  Description of Artificial Sequence: Synthetic oligonucleotide
gcatcgttgctggcctggctgtcct

SEQ ID NO: 381864 - DNA, 25 bp, Artificial Sequence
  Description of Artificial Sequence: Synthetic oligonucleotide
catcgttgctggcctggctgtcctg

SEQ ID NO: 381865 - DNA, 25 bp, Artificial Sequence
  Description of Artificial Sequence: Synthetic oligonucleotide
atcgttgctggcctggctgtcctgg

SEQ ID NO: 381866 - DNA, 24 bp, Artificial Sequence
  Description of Artificial Sequence: Synthetic oligonucleotide
tcgttgctggcctggctgtcctgg

SEQ ID NO: 381867 - DNA, 23 bp, Artificial Sequence
  Description of Artificial Sequence: Synthetic oligonucleotide
cgttgctggcctggctgtcctgg

SEQ ID NO: 381868 - DNA, 24 bp, Artificial Sequence
  Description of Artificial Sequence: Synthetic oligonucleotide
gttgctggcctggctgtcctggct

SEQ ID NO: 381869 - DNA, 25 bp, Artificial Sequence
  Description of Artificial Sequence: Synthetic oligonucleotide
ttgctggcctggctgtcctggctgt

SEQ ID NO: 381870 - DNA, 24 bp, Artificial Sequence
  Description of Artificial Sequence: Synthetic oligonucleotide
tgctggcctggctgtcctggctgt

SEQ ID NO: 381871 - DNA, 23 bp, Artificial Sequence
  Description of Artificial Sequence: Synthetic oligonucleotide
gctggcctggctgtcctggctgt

SEQ ID NO: 381872 - DNA, 23 bp, Artificial Sequence
  Description of Artificial Sequence: Synthetic oligonucleotide
ctggcctggctgtcctggctgtc

SEQ ID NO: 381873 - DNA, 25 bp, Artificial Sequence
  Description of Artificial Sequence: Synthetic oligonucleotide
tggcctggctgtcctggctgtccta

SEQ ID NO: 381874 - DNA, 24 bp, Artificial Sequence
  Description of Artificial Sequence: Synthetic oligonucleotide
ggcctggctgtcctggctgtccta

SEQ ID NO: 381875 - DNA, 24 bp, Artificial Sequence
  Description of Artificial Sequence: Synthetic oligonucleotide
gcctggctgtcctggctgtcctag

SEQ ID NO: 381876 - DNA, 25 bp, Artificial Sequence
  Description of Artificial Sequence: Synthetic oligonucleotide
cctggctgtcctggctgtcctagct

SEQ ID NO: 381877 - DNA, 26 bp, Artificial Sequence
  Description of Artificial Sequence: Synthetic oligonucleotide
ctggctgtcctggctgtcctagctgt

SEQ ID NO: 381878 - DNA, 26 bp, Artificial Sequence
  Description of Artificial Sequence: Synthetic oligonucleotide
tggctgtcctggctgtcctagctgtc

SEQ ID NO: 381879 - DNA, 25 bp, Artificial Sequence
  Description of Artificial Sequence: Synthetic oligonucleotide
ggctgtcctggctgtcctagctgtc

SEQ ID NO: 381880 - DNA, 27 bp, Artificial Sequence
  Description of Artificial Sequence: Synthetic oligonucleotide
gctgtcctggctgtcctagctgtccta

SEQ ID NO: 381881 - DNA, 27 bp, Artificial Sequence
  Description of Artificial Sequence: Synthetic oligonucleotide
ctgtcctggctgtcctagctgtcctag

SEQ ID NO: 381882 - DNA, 27 bp, Artificial Sequence
  Description of Artificial Sequence: Synthetic oligonucleotide
tgtcctggctgtcctagctgtcctagg

SEQ ID NO: 381883 - DNA, 27 bp, Artificial Sequence
  Description of Artificial Sequence: Synthetic oligonucleotide
gtcctggctgtcctagctgtcctagga

SEQ ID NO: 381884 - DNA, 27 bp, Artificial Sequence
  Description of Artificial Sequence: Synthetic oligonucleotide
tcctggctgtcctagctgtcctaggag

SEQ ID NO: 381885 - DNA, 26 bp, Artificial Sequence
  Description of Artificial Sequence: Synthetic oligonucleotide
cctggctgtcctagctgtcctaggag

SEQ ID NO: 381886 - DNA, 27 bp, Artificial Sequence
  Description of Artificial Sequence: Synthetic oligonucleotide
ctggctgtcctagctgtcctaggagct

SEQ ID NO: 381887 - DNA, 27 bp, Artificial Sequence
  Description of Artificial Sequence: Synthetic oligonucleotide
tggctgtcctagctgtcctaggagctg

SEQ ID NO: 381888 - DNA, 27 bp, Artificial Sequence
  Description of Artificial Sequence: Synthetic oligonucleotide
ggctgtcctagctgtcctaggagctgt

SEQ ID NO: 381889 - DNA, 27 bp, Artificial Sequence
  Description of Artificial Sequence: Synthetic oligonucleotide
gctgtcctagctgtcctaggagctgtg

SEQ ID NO: 381890 - DNA, 27 bp, Artificial Sequence
  Description of Artificial Sequence: Synthetic oligonucleotide
ctgtcctagctgtcctaggagctgtgg

SEQ ID NO: 381891 - DNA, 28 bp, Artificial Sequence
  Description of Artificial Sequence: Synthetic oligonucleotide
tgtcctagctgtcctaggagctgtggtg

SEQ ID NO: 381892 - DNA, 27 bp, Artificial Sequence
  Description of Artificial Sequence: Synthetic oligonucleotide
gtcctagctgtcctaggagctgtggtg

SEQ ID NO: 381893 - DNA, 27 bp, Artificial Sequence
  Description of Artificial Sequence: Synthetic oligonucleotide
tcctagctgtcctaggagctgtggtgg

SEQ ID NO: 381894 - DNA, 26 bp, Artificial Sequence
  Description of Artificial Sequence: Synthetic oligonucleotide
cctagctgtcctaggagctgtggtgg

SEQ ID NO: 381895 - DNA, 27 bp, Artificial Sequence
  Description of Artificial Sequence: Synthetic oligonucleotide
ctagctgtcctaggagctgtggtggct

SEQ ID NO: 381896 - DNA, 27 bp, Artificial Sequence
  Description of Artificial Sequence: Synthetic oligonucleotide
tagctgtcctaggagctgtggtggctg

SEQ ID NO: 381897 - DNA, 27 bp, Artificial Sequence
  Description of Artificial Sequence: Synthetic oligonucleotide
agctgtcctaggagctgtggtggctgt

SEQ ID NO: 381898 - DNA, 27 bp, Artificial Sequence
  Description of Artificial Sequence: Synthetic oligonucleotide
gctgtcctaggagctgtggtggctgtt

SEQ ID NO: 381899 - DNA, 27 bp, Artificial Sequence
  Description of Artificial Sequence: Synthetic oligonucleotide
ctgtcctaggagctgtggtggctgttg

SEQ ID NO: 381900 - DNA, 28 bp, Artificial Sequence
  Description of Artificial Sequence: Synthetic oligonucleotide
tgtcctaggagctgtggtggctgttgtg

SEQ ID NO: 381901 - DNA, 27 bp, Artificial Sequence
  Description of Artificial Sequence: Synthetic oligonucleotide
gtcctaggagctgtggtggctgttgtg

SEQ ID NO: 381902 - DNA, 29 bp, Artificial Sequence
  Description of Artificial Sequence: Synthetic oligonucleotide
tcctaggagctgtggtggctgttgtgatg

SEQ ID NO: 381903 - DNA, 28 bp, Artificial Sequence
  Description of Artificial Sequence: Synthetic oligonucleotide
cctaggagctgtggtggctgttgtgatg

SEQ ID NO: 381904 - DNA, 29 bp, Artificial Sequence
  Description of Artificial Sequence: Synthetic oligonucleotide
ctaggagctgtggtggctgttgtgatgtg

SEQ ID NO: 381905 - DNA, 31 bp, Artificial Sequence; identical to SEQ ID NO: 41566
  Description of Artificial Sequence: Synthetic oligonucleotide

SEQ ID NO: 381906 - DNA, 30 bp, Artificial Sequence; identical to SEQ ID NO: 41567
  Description of Artificial Sequence: Synthetic oligonucleotide

SEQ ID NO: 381907 - DNA, 29 bp, Artificial Sequence
  Description of Artificial Sequence: Synthetic oligonucleotide
ggagctgtggtggctgttgtgatgtgtag

SEQ ID NO: 381908 - DNA, 29 bp, Artificial Sequence
  Description of Artificial Sequence: Synthetic oligonucleotide
gagctgtggtggctgttgtgatgtgtagg

SEQ ID NO: 381909 - DNA, 30 bp, Artificial Sequence; identical to SEQ ID NO: 41570
  Description of Artificial Sequence: Synthetic oligonucleotide

SEQ ID NO: 381910 - DNA, 29 bp, Artificial Sequence
  Description of Artificial Sequence: Synthetic oligonucleotide
gctgtggtggctgttgtgatgtgtaggag

SEQ ID NO: 381911 - DNA, 29 bp, Artificial Sequence
  Description of Artificial Sequence: Synthetic oligonucleotide
ctgtggtggctgttgtgatgtgtaggagg

SEQ ID NO: 381912 - DNA, 31 bp, Artificial Sequence; identical to SEQ ID NO: 41573
  Description of Artificial Sequence: Synthetic oligonucleotide

SEQ ID NO: 381913 - DNA, 30 bp, Artificial Sequence; identical to SEQ ID NO: 41574
  Description of Artificial Sequence: Synthetic oligonucleotide

SEQ ID NO: 381914 - DNA, 31 bp, Artificial Sequence; identical to SEQ ID NO: 41575
  Description of Artificial Sequence: Synthetic oligonucleotide

SEQ ID NO: 381915 - DNA, 30 bp, Artificial Sequence; identical to SEQ ID NO: 41576
  Description of Artificial Sequence: Synthetic oligonucleotide

SEQ ID NO: 381916 - DNA, 30 bp, Artificial Sequence; identical to SEQ ID NO: 41577
  Description of Artificial Sequence: Synthetic oligonucleotide

SEQ ID NO: 381917 - DNA, 31 bp, Artificial Sequence; identical to SEQ ID NO: 41578
  Description of Artificial Sequence: Synthetic oligonucleotide

SEQ ID NO: 381918 - DNA, 30 bp, Artificial Sequence; identical to SEQ ID NO: 41579
  Description of Artificial Sequence: Synthetic oligonucleotide

SEQ ID NO: 381919 - DNA, 31 bp, Artificial Sequence; identical to SEQ ID NO: 41580
  Description of Artificial Sequence: Synthetic oligonucleotide

SEQ ID NO: 381920 - DNA, 31 bp, Artificial Sequence; identical to SEQ ID NO: 41581
  Description of Artificial Sequence: Synthetic oligonucleotide

SEQ ID NO: 381921 - DNA, 32 bp, Artificial Sequence; identical to SEQ ID NO: 41582
  Description of Artificial Sequence: Synthetic oligonucleotide

SEQ ID NO: 381922 - DNA, 31 bp, Artificial Sequence; identical to SEQ ID NO: 41583
  Description of Artificial Sequence: Synthetic oligonucleotide

SEQ ID NO: 381923 - DNA, 31 bp, Artificial Sequence; identical to SEQ ID NO: 41584
  Description of Artificial Sequence: Synthetic oligonucleotide

SEQ ID NO: 381924 - DNA, 29 bp, Artificial Sequence
  Description of Artificial Sequence: Synthetic oligonucleotide
aagagctcaggtggaaaaggagggagctg

SEQ ID NO: 381925 - DNA, 28 bp, Artificial Sequence
  Description of Artificial Sequence: Synthetic oligonucleotide
agagctcaggtggaaaaggagggagctg

SEQ ID NO: 381926 - DNA, 27 bp, Artificial Sequence
  Description of Artificial Sequence: Synthetic oligonucleotide
gagctcaggtggaaaaggagggagctg

SEQ ID NO: 381927 - DNA, 27 bp, Artificial Sequence
  Description of Artificial Sequence: Synthetic oligonucleotide
agctcaggtggaaaaggagggagctgc

SEQ ID NO: 381928 - DNA, 27 bp, Artificial Sequence
  Description of Artificial Sequence: Synthetic oligonucleotide
gctcaggtggaaaaggagggagctgct

SEQ ID NO: 381929 - DNA, 27 bp, Artificial Sequence
  Description of Artificial Sequence: Synthetic oligonucleotide
ctcaggtggaaaaggagggagctgctc

SEQ ID NO: 381930 - DNA, 28 bp, Artificial Sequence
  Description of Artificial Sequence: Synthetic oligonucleotide
tcaggtggaaaaggagggagctgctctc

SEQ ID NO: 381931 - DNA, 27 bp, Artificial Sequence
  Description of Artificial Sequence: Synthetic oligonucleotide
caggtggaaaaggagggagctgctctc

SEQ ID NO: 381932 - DNA, 28 bp, Artificial Sequence
  Description of Artificial Sequence: Synthetic oligonucleotide
aggtggaaaaggagggagctgctctcag

SEQ ID NO: 381933 - DNA, 27 bp, Artificial Sequence
  Description of Artificial Sequence: Synthetic oligonucleotide
ggtggaaaaggagggagctgctctcag

SEQ ID NO: 381934 - DNA, 27 bp, Artificial Sequence
  Description of Artificial Sequence: Synthetic oligonucleotide
gtggaaaaggagggagctgctctcagg

SEQ ID NO: 381935 - DNA, 27 bp, Artificial Sequence
  Description of Artificial Sequence: Synthetic oligonucleotide
tggaaaaggagggagctgctctcaggc

SEQ ID NO: 381936 - DNA, 27 bp, Artificial Sequence
  Description of Artificial Sequence: Synthetic oligonucleotide
ggaaaaggagggagctgctctcaggct

SEQ ID NO: 381937 - DNA, 27 bp, Artificial Sequence
  Description of Artificial Sequence: Synthetic oligonucleotide
gaaaaggagggagctgctctcaggctg

SEQ ID NO: 381938 - DNA, 27 bp, Artificial Sequence
  Description of Artificial Sequence: Synthetic oligonucleotide
aaaaggagggagctgctctcaggctgc

SEQ ID NO: 381939 - DNA, 26 bp, Artificial Sequence
  Description of Artificial Sequence: Synthetic oligonucleotide
aaaggagggagctgctctcaggctgc

SEQ ID NO: 381940 - DNA, 25 bp, Artificial Sequence
  Description of Artificial Sequence: Synthetic oligonucleotide
aaggagggagctgctctcaggctgc

SEQ ID NO: 381941 - DNA, 24 bp, Artificial Sequence
  Description of Artificial Sequence: Synthetic oligonucleotide
aggagggagctgctctcaggctgc

SEQ ID NO: 381942 - DNA, 23 bp, Artificial Sequence
  Description of Artificial Sequence: Synthetic oligonucleotide
ggagggagctgctctcaggctgc

SEQ ID NO: 381943 - DNA, 24 bp, Artificial Sequence
  Description of Artificial Sequence: Synthetic oligonucleotide
gagggagctgctctcaggctgcgt

SEQ ID NO: 381944 - DNA, 24 bp, Artificial Sequence
  Description of Artificial Sequence: Synthetic oligonucleotide
agggagctgctctcaggctgcgtc

SEQ ID NO: 381945 - DNA, 23 bp, Artificial Sequence
  Description of Artificial Sequence: Synthetic oligonucleotide
gggagctgctctcaggctgcgtc

SEQ ID NO: 381946 - DNA, 24 bp, Artificial Sequence
  Description of Artificial Sequence: Synthetic oligonucleotide
ggagctgctctcaggctgcgtcca

SEQ ID NO: 381947 - DNA, 24 bp, Artificial Sequence
  Description of Artificial Sequence: Synthetic oligonucleotide
gagctgctctcaggctgcgtccag

SEQ ID NO: 381948 - DNA, 26 bp, Artificial Sequence
  Description of Artificial Sequence: Synthetic oligonucleotide
agctgctctcaggctgcgtccagcaa

SEQ ID NO: 381949 - DNA, 25 bp, Artificial Sequence
  Description of Artificial Sequence: Synthetic oligonucleotide
gctgctctcaggctgcgtccagcaa

SEQ ID NO: 381950 - DNA, 26 bp, Artificial Sequence
  Description of Artificial Sequence: Synthetic oligonucleotide
ctgctctcaggctgcgtccagcaaca

SEQ ID NO: 381951 - DNA, 27 bp, Artificial Sequence
  Description of Artificial Sequence: Synthetic oligonucleotide
tgctctcaggctgcgtccagcaacagt

SEQ ID NO: 381952 - DNA, 26 bp, Artificial Sequence
  Description of Artificial Sequence: Synthetic oligonucleotide
gctctcaggctgcgtccagcaacagt

SEQ ID NO: 381953 - DNA, 26 bp, Artificial Sequence
  Description of Artificial Sequence: Synthetic oligonucleotide
ctctcaggctgcgtccagcaacagtg

SEQ ID NO: 381954 - DNA, 26 bp, Artificial Sequence
  Description of Artificial Sequence: Synthetic oligonucleotide
tctcaggctgcgtccagcaacagtgc

SEQ ID NO: 381955 - DNA, 25 bp, Artificial Sequence
  Description of Artificial Sequence: Synthetic oligonucleotide
ctcaggctgcgtccagcaacagtgc

SEQ ID NO: 381956 - DNA, 25 bp, Artificial Sequence
  Description of Artificial Sequence: Synthetic oligonucleotide
tcaggctgcgtccagcaacagtgcc

SEQ ID NO: 381957 - DNA, 24 bp, Artificial Sequence
  Description of Artificial Sequence: Synthetic oligonucleotide
caggctgcgtccagcaacagtgcc

SEQ ID NO: 381958 - DNA, 25 bp, Artificial Sequence
  Description of Artificial Sequence: Synthetic oligonucleotide
aggctgcgtccagcaacagtgccca

SEQ ID NO: 381959 - DNA, 24 bp, Artificial Sequence
  Description of Artificial Sequence: Synthetic oligonucleotide
ggctgcgtccagcaacagtgccca

SEQ ID NO: 381960 - DNA, 24 bp, Artificial Sequence
  Description of Artificial Sequence: Synthetic oligonucleotide
gctgcgtccagcaacagtgcccag

SEQ ID NO: 381961 - DNA, 24 bp, Artificial Sequence
  Description of Artificial Sequence: Synthetic oligonucleotide
ctgcgtccagcaacagtgcccagg

SEQ ID NO: 381962 - DNA, 24 bp, Artificial Sequence
  Description of Artificial Sequence: Synthetic oligonucleotide
tgcgtccagcaacagtgcccaggg

SEQ ID NO: 381963 - DNA, 23 bp, Artificial Sequence
  Description of Artificial Sequence: Synthetic oligonucleotide
gcgtccagcaacagtgcccaggg

SEQ ID NO: 381964 - DNA, 24 bp, Artificial Sequence
  Description of Artificial Sequence: Synthetic oligonucleotide
cgtccagcaacagtgcccagggct

SEQ ID NO: 381965 - DNA, 25 bp, Artificial Sequence
  Description of Artificial Sequence: Synthetic oligonucleotide
gtccagcaacagtgcccagggctct

SEQ ID NO: 381966 - DNA, 27 bp, Artificial Sequence
  Description of Artificial Sequence: Synthetic oligonucleotide
tccagcaacagtgcccagggctctgat

SEQ ID NO: 381967 - DNA, 26 bp, Artificial Sequence
  Description of Artificial Sequence: Synthetic oligonucleotide
ccagcaacagtgcccagggctctgat

SEQ ID NO: 381968 - DNA, 27 bp, Artificial Sequence
  Description of Artificial Sequence: Synthetic oligonucleotide
cagcaacagtgcccagggctctgatga

SEQ ID NO: 381969 - DNA, 27 bp, Artificial Sequence
  Description of Artificial Sequence: Synthetic oligonucleotide
agcaacagtgcccagggctctgatgag

SEQ ID NO: 381970 - DNA, 27 bp, Artificial Sequence
  Description of Artificial Sequence: Synthetic oligonucleotide
gcaacagtgcccagggctctgatgagt

SEQ ID NO: 381971 - DNA, 27 bp, Artificial Sequence
  Description of Artificial Sequence: Synthetic oligonucleotide
caacagtgcccagggctctgatgagtc

SEQ ID NO: 381972 - DNA, 28 bp, Artificial Sequence
  Description of Artificial Sequence: Synthetic oligonucleotide
aacagtgcccagggctctgatgagtctc

SEQ ID NO: 381973 - DNA, 27 bp, Artificial Sequence
  Description of Artificial Sequence: Synthetic oligonucleotide
acagtgcccagggctctgatgagtctc

SEQ ID NO: 381974 - DNA, 27 bp, Artificial Sequence
  Description of Artificial Sequence: Synthetic oligonucleotide
cagtgcccagggctctgatgagtctct

SEQ ID NO: 381975 - DNA, 27 bp, Artificial Sequence
  Description of Artificial Sequence: Synthetic oligonucleotide
agtgcccagggctctgatgagtctctc

SEQ ID NO: 381976 - DNA, 27 bp, Artificial Sequence
  Description of Artificial Sequence: Synthetic oligonucleotide
gtgcccagggctctgatgagtctctca

SEQ ID NO: 381977 - DNA, 28 bp, Artificial Sequence
  Description of Artificial Sequence: Synthetic oligonucleotide
tgcccagggctctgatgagtctctcatc

SEQ ID NO: 381978 - DNA, 27 bp, Artificial Sequence
  Description of Artificial Sequence: Synthetic oligonucleotide
gcccagggctctgatgagtctctcatc

SEQ ID NO: 381979 - DNA, 27 bp, Artificial Sequence
  Description of Artificial Sequence: Synthetic oligonucleotide
cccagggctctgatgagtctctcatcg

SEQ ID NO: 381980 - DNA, 27 bp, Artificial Sequence
  Description of Artificial Sequence: Synthetic oligonucleotide
ccagggctctgatgagtctctcatcgc

SEQ ID NO: 381981 - DNA, 29 bp, Artificial Sequence
  Description of Artificial Sequence: Synthetic oligonucleotide
cagggctctgatgagtctctcatcgcttg

SEQ ID NO: 381982 - DNA, 33 bp, Artificial Sequence; identical to SEQ ID NO: 41643
  Description of Artificial Sequence: Synthetic oligonucleotide

SEQ ID NO: 381983 - DNA, 32 bp, Artificial Sequence; identical to SEQ ID NO: 41644
  Description of Artificial Sequence: Synthetic oligonucleotide

SEQ ID NO: 381984 - DNA, 32 bp, Artificial Sequence; identical to SEQ ID NO: 41645
  Description of Artificial Sequence: Synthetic oligonucleotide

SEQ ID NO: 381985 - DNA, 32 bp, Artificial Sequence; identical to SEQ ID NO: 41646
  Description of Artificial Sequence: Synthetic oligonucleotide

SEQ ID NO: 381986 - DNA, 33 bp, Artificial Sequence; identical to SEQ ID NO: 41647
  Description of Artificial Sequence: Synthetic oligonucleotide

SEQ ID NO: 381987 - DNA, 26 bp, Artificial Sequence
  Description of Artificial Sequence: Synthetic oligonucleotide
ctcaggacaccgagcttgtggagacc

SEQ ID NO: 381988 - DNA, 26 bp, Artificial Sequence
  Description of Artificial Sequence: Synthetic oligonucleotide
tcaggacaccgagcttgtggagaccc

SEQ ID NO: 381989 - DNA, 25 bp, Artificial Sequence
  Description of Artificial Sequence: Synthetic oligonucleotide
caggacaccgagcttgtggagaccc

SEQ ID NO: 381990 - DNA, 25 bp, Artificial Sequence
  Description of Artificial Sequence: Synthetic oligonucleotide
aggacaccgagcttgtggagacccg

SEQ ID NO: 381991 - DNA, 24 bp, Artificial Sequence
  Description of Artificial Sequence: Synthetic oligonucleotide
ggacaccgagcttgtggagacccg

SEQ ID NO: 381992 - DNA, 24 bp, Artificial Sequence
  Description of Artificial Sequence: Synthetic oligonucleotide
gacaccgagcttgtggagacccgg

SEQ ID NO: 381993 - DNA, 24 bp, Artificial Sequence
  Description of Artificial Sequence: Synthetic oligonucleotide
acaccgagcttgtggagacccggc

SEQ ID NO: 381994 - DNA, 23 bp, Artificial Sequence
  Description of Artificial Sequence: Synthetic oligonucleotide
caccgagcttgtggagacccggc

SEQ ID NO: 381995 - DNA, 24 bp, Artificial Sequence
  Description of Artificial Sequence: Synthetic oligonucleotide
accgagcttgtggagacccggcca

SEQ ID NO: 381996 - DNA, 23 bp, Artificial Sequence
  Description of Artificial Sequence: Synthetic oligonucleotide
ccgagcttgtggagacccggcca

SEQ ID NO: 381997 - DNA, 23 bp, Artificial Sequence
  Description of Artificial Sequence: Synthetic oligonucleotide
cgagcttgtggagacccggccag

SEQ ID NO: 381998 - DNA, 24 bp, Artificial Sequence
  Description of Artificial Sequence: Synthetic oligonucleotide
gagcttgtggagacccggccagca

SEQ ID NO: 381999 - DNA, 24 bp, Artificial Sequence
  Description of Artificial Sequence: Synthetic oligonucleotide
agcttgtggagacccggccagcag

SEQ ID NO: 382000 - DNA, 23 bp, Artificial Sequence
  Description of Artificial Sequence: Synthetic oligonucleotide
gcttgtggagacccggccagcag

SEQ ID NO: 382001 - DNA, 24 bp, Artificial Sequence
  Description of Artificial Sequence: Synthetic oligonucleotide
cttgtggagacccggccagcagga

SEQ ID NO: 382002 - DNA, 26 bp, Artificial Sequence
  Description of Artificial Sequence: Synthetic oligonucleotide
ttgtggagacccggccagcaggagat

SEQ ID NO: 382003 - DNA, 25 bp, Artificial Sequence
  Description of Artificial Sequence: Synthetic oligonucleotide
tgtggagacccggccagcaggagat

SEQ ID NO: 382004 - DNA, 24 bp, Artificial Sequence
  Description of Artificial Sequence: Synthetic oligonucleotide
gtggagacccggccagcaggagat

SEQ ID NO: 382005 - DNA, 24 bp, Artificial Sequence
  Description of Artificial Sequence: Synthetic oligonucleotide
tggagacccggccagcaggagatg

SEQ ID NO: 382006 - DNA, 23 bp, Artificial Sequence
  Description of Artificial Sequence: Synthetic oligonucleotide
ggagacccggccagcaggagatg

SEQ ID NO: 382007 - DNA, 25 bp, Artificial Sequence
  Description of Artificial Sequence: Synthetic oligonucleotide
gagacccggccagcaggagatggaa

SEQ ID NO: 382008 - DNA, 25 bp, Artificial Sequence
  Description of Artificial Sequence: Synthetic oligonucleotide
agacccggccagcaggagatggaac

SEQ ID NO: 382009 - DNA, 24 bp, Artificial Sequence
  Description of Artificial Sequence: Synthetic oligonucleotide
gacccggccagcaggagatggaac

SEQ ID NO: 382010 - DNA, 26 bp, Artificial Sequence
  Description of Artificial Sequence: Synthetic oligonucleotide
acccggccagcaggagatggaacctt

SEQ ID NO: 382011 - DNA, 25 bp, Artificial Sequence
  Description of Artificial Sequence: Synthetic oligonucleotide
cccggccagcaggagatggaacctt

SEQ ID NO: 382012 - DNA, 25 bp, Artificial Sequence
  Description of Artificial Sequence: Synthetic oligonucleotide
ccggccagcaggagatggaaccttc

SEQ ID NO: 382013 - DNA, 26 bp, Artificial Sequence
  Description of Artificial Sequence: Synthetic oligonucleotide
cggccagcaggagatggaaccttcca

SEQ ID NO: 382014 - DNA, 23 bp, Artificial Sequence
  Description of Artificial Sequence: Synthetic oligonucleotide
ggagcccctcaccctgagatggg

SEQ ID NO: 382015 - DNA, 31 bp, Artificial Sequence; identical to SEQ ID NO: 41675
  Description of Artificial Sequence: Synthetic oligonucleotide

SEQ ID NO: 382016 - DNA, 30 bp, Artificial Sequence; identical to SEQ ID NO: 41676
  Description of Artificial Sequence: Synthetic oligonucleotide

SEQ ID NO: 382017 - DNA, 29 bp, Artificial Sequence
  Description of Artificial Sequence: Synthetic oligonucleotide
ggattacatcgccctgaacgaggacctac

SEQ ID NO: 382018 - DNA, 29 bp, Artificial Sequence
  Description of Artificial Sequence: Synthetic oligonucleotide
gattacatcgccctgaacgaggacctacg

SEQ ID NO: 382019 - DNA, 29 bp, Artificial Sequence
  Description of Artificial Sequence: Synthetic oligonucleotide
attacatcgccctgaacgaggacctacgc

SEQ ID NO: 382020 - DNA, 28 bp, Artificial Sequence
  Description of Artificial Sequence: Synthetic oligonucleotide
ttacatcgccctgaacgaggacctacgc

SEQ ID NO: 382021 - DNA, 27 bp, Artificial Sequence
  Description of Artificial Sequence: Synthetic oligonucleotide
tacatcgccctgaacgaggacctacgc

SEQ ID NO: 382022 - DNA, 27 bp, Artificial Sequence
  Description of Artificial Sequence: Synthetic oligonucleotide
acatcgccctgaacgaggacctacgct

SEQ ID NO: 382023 - DNA, 26 bp, Artificial Sequence
  Description of Artificial Sequence: Synthetic oligonucleotide
catcgccctgaacgaggacctacgct

SEQ ID NO: 382024 - DNA, 26 bp, Artificial Sequence
  Description of Artificial Sequence: Synthetic oligonucleotide
atcgccctgaacgaggacctacgctc

SEQ ID NO: 382025 - DNA, 25 bp, Artificial Sequence
  Description of Artificial Sequence: Synthetic oligonucleotide
tcgccctgaacgaggacctacgctc

SEQ ID NO: 382026 - DNA, 24 bp, Artificial Sequence
  Description of Artificial Sequence: Synthetic oligonucleotide
cgccctgaacgaggacctacgctc

SEQ ID NO: 382027 - DNA, 25 bp, Artificial Sequence
  Description of Artificial Sequence: Synthetic oligonucleotide
gccctgaacgaggacctacgctcct

SEQ ID NO: 382028 - DNA, 25 bp, Artificial Sequence
  Description of Artificial Sequence: Synthetic oligonucleotide
ccctgaacgaggacctacgctcctg

SEQ ID NO: 382029 - DNA, 26 bp, Artificial Sequence
  Description of Artificial Sequence: Synthetic oligonucleotide
cctgaacgaggacctacgctcctgga

SEQ ID NO: 382030 - DNA, 26 bp, Artificial Sequence
  Description of Artificial Sequence: Synthetic oligonucleotide
ctgaacgaggacctacgctcctggac

SEQ ID NO: 382031 - DNA, 26 bp, Artificial Sequence
  Description of Artificial Sequence: Synthetic oligonucleotide
tgaacgaggacctacgctcctggacc

SEQ ID NO: 382032 - DNA, 25 bp, Artificial Sequence
  Description of Artificial Sequence: Synthetic oligonucleotide
gaacgaggacctacgctcctggacc

SEQ ID NO: 382033 - DNA, 25 bp, Artificial Sequence
  Description of Artificial Sequence: Synthetic oligonucleotide
aacgaggacctacgctcctggaccg

SEQ ID NO: 382034 - DNA, 24 bp, Artificial Sequence
  Description of Artificial Sequence: Synthetic oligonucleotide
acgaggacctacgctcctggaccg

SEQ ID NO: 382035 - DNA, 23 bp, Artificial Sequence
  Description of Artificial Sequence: Synthetic oligonucleotide
cgaggacctacgctcctggaccg

SEQ ID NO: 382036 - DNA, 23 bp, Artificial Sequence
  Description of Artificial Sequence: Synthetic oligonucleotide
gaggacctacgctcctggaccgc

SEQ ID NO: 382037 - DNA, 23 bp, Artificial Sequence
  Description of Artificial Sequence: Synthetic oligonucleotide
aggacctacgctcctggaccgcc

SEQ ID NO: 382038 - DNA, 22 bp, Artificial Sequence
  Description of Artificial Sequence: Synthetic oligonucleotide
ggacctacgctcctggaccgcc

SEQ ID NO: 382039 - DNA, 22 bp, Artificial Sequence
  Description of Artificial Sequence: Synthetic oligonucleotide
gacctacgctcctggaccgccg

SEQ ID NO: 382040 - DNA, 22 bp, Artificial Sequence
  Description of Artificial Sequence: Synthetic oligonucleotide
acctacgctcctggaccgccgc

SEQ ID NO: 382041 - DNA, 21 bp, Artificial Sequence
  Description of Artificial Sequence: Synthetic oligonucleotide
cctacgctcctggaccgccgc

SEQ ID NO: 382042 - DNA, 21 bp, Artificial Sequence
  Description of Artificial Sequence: Synthetic oligonucleotide
ctacgctcctggaccgccgcg

SEQ ID NO: 382043 - DNA, 22 bp, Artificial Sequence
  Description of Artificial Sequence: Synthetic oligonucleotide
tacgctcctggaccgccgcgga

SEQ ID NO: 382044 - DNA, 21 bp, Artificial Sequence
  Description of Artificial Sequence: Synthetic oligonucleotide
acgctcctggaccgccgcgga

SEQ ID NO: 382045 - DNA, 30 bp, Artificial Sequence; identical to SEQ ID NO: 2169
  Description of Artificial Sequence: Synthetic oligonucleotide

SEQ ID NO: 382046 - DNA, 29 bp, Artificial Sequence
  Description of Artificial Sequence: Synthetic oligonucleotide
agtatttcttcacatccgtgtcccggccc

SEQ ID NO: 382047 - DNA, 27 bp, Artificial Sequence
  Description of Artificial Sequence: Synthetic oligonucleotide
tacgtggacgacacgcagttcgtgcga

SEQ ID NO: 382048 - DNA, 27 bp, Artificial Sequence
  Description of Artificial Sequence: Synthetic oligonucleotide
acgtggacgacacgcagttcgtgcgat

SEQ ID NO: 382049 - DNA, 27 bp, Artificial Sequence
  Description of Artificial Sequence: Synthetic oligonucleotide
cgtggacgacacgcagttcgtgcgatt

SEQ ID NO: 382050 - DNA, 27 bp, Artificial Sequence
  Description of Artificial Sequence: Synthetic oligonucleotide
gtggacgacacgcagttcgtgcgattc

SEQ ID NO: 382051 - DNA, 27 bp, Artificial Sequence
  Description of Artificial Sequence: Synthetic oligonucleotide
tggacgacacgcagttcgtgcgattcg

SEQ ID NO: 382052 - DNA, 27 bp, Artificial Sequence
  Description of Artificial Sequence: Synthetic oligonucleotide
ggacgacacgcagttcgtgcgattcga

SEQ ID NO: 382053 - DNA, 27 bp, Artificial Sequence
  Description of Artificial Sequence: Synthetic oligonucleotide
gacgacacgcagttcgtgcgattcgac

SEQ ID NO: 382054 - DNA, 28 bp, Artificial Sequence
  Description of Artificial Sequence: Synthetic oligonucleotide
acgacacgcagttcgtgcgattcgacag

SEQ ID NO: 382055 - DNA, 27 bp, Artificial Sequence
  Description of Artificial Sequence: Synthetic oligonucleotide
cgacacgcagttcgtgcgattcgacag

SEQ ID NO: 382056 - DNA, 27 bp, Artificial Sequence
  Description of Artificial Sequence: Synthetic oligonucleotide
gacacgcagttcgtgcgattcgacagc

SEQ ID NO: 382057 - DNA, 27 bp, Artificial Sequence
  Description of Artificial Sequence: Synthetic oligonucleotide
acacgcagttcgtgcgattcgacagcg

SEQ ID NO: 382058 - DNA, 27 bp, Artificial Sequence
  Description of Artificial Sequence: Synthetic oligonucleotide
cacgcagttcgtgcgattcgacagcga

SEQ ID NO: 382059 - DNA, 27 bp, Artificial Sequence
  Description of Artificial Sequence: Synthetic oligonucleotide
acgcagttcgtgcgattcgacagcgac

SEQ ID NO: 382060 - DNA, 26 bp, Artificial Sequence
  Description of Artificial Sequence: Synthetic oligonucleotide
cgcagttcgtgcgattcgacagcgac

SEQ ID NO: 382061 - DNA, 26 bp, Artificial Sequence
  Description of Artificial Sequence: Synthetic oligonucleotide
gcagttcgtgcgattcgacagcgacg

SEQ ID NO: 382062 - DNA, 26 bp, Artificial Sequence
  Description of Artificial Sequence: Synthetic oligonucleotide
cagttcgtgcgattcgacagcgacgc

SEQ ID NO: 382063 - DNA, 26 bp, Artificial Sequence
  Description of Artificial Sequence: Synthetic oligonucleotide
agttcgtgcgattcgacagcgacgcc

SEQ ID NO: 382064 - DNA, 25 bp, Artificial Sequence
  Description of Artificial Sequence: Synthetic oligonucleotide
gttcgtgcgattcgacagcgacgcc

SEQ ID NO: 382065 - DNA, 25 bp, Artificial Sequence
  Description of Artificial Sequence: Synthetic oligonucleotide
ttcgtgcgattcgacagcgacgccg

SEQ ID NO: 382066 - DNA, 24 bp, Artificial Sequence
  Description of Artificial Sequence: Synthetic oligonucleotide
tcgtgcgattcgacagcgacgccg

SEQ ID NO: 382067 - DNA, 23 bp, Artificial Sequence
  Description of Artificial Sequence: Synthetic oligonucleotide
cgtgcgattcgacagcgacgccg

SEQ ID NO: 382068 - DNA, 23 bp, Artificial Sequence
  Description of Artificial Sequence: Synthetic oligonucleotide
gtgcgattcgacagcgacgccgc

SEQ ID NO: 382069 - DNA, 24 bp, Artificial Sequence
  Description of Artificial Sequence: Synthetic oligonucleotide
tgcgattcgacagcgacgccgcga

SEQ ID NO: 382070 - DNA, 23 bp, Artificial Sequence
  Description of Artificial Sequence: Synthetic oligonucleotide
gcgattcgacagcgacgccgcga

SEQ ID NO: 382071 - DNA, 24 bp, Artificial Sequence
  Description of Artificial Sequence: Synthetic oligonucleotide
cgattcgacagcgacgccgcgagt

SEQ ID NO: 382072 - DNA, 22 bp, Artificial Sequence
  Description of Artificial Sequence: Synthetic oligonucleotide
cgctcttggaccgccgcggaca

SEQ ID NO: 382073 - DNA, 22 bp, Artificial Sequence
  Description of Artificial Sequence: Synthetic oligonucleotide
ctcttggaccgccgcggacacc

SEQ ID NO: 382074 - DNA, 22 bp, Artificial Sequence
  Description of Artificial Sequence: Synthetic oligonucleotide
tcttggaccgccgcggacaccg

SEQ ID NO: 382075 - DNA, 21 bp, Artificial Sequence
  Description of Artificial Sequence: Synthetic oligonucleotide
cttggaccgccgcggacaccg

SEQ ID NO: 382076 - DNA, 21 bp, Artificial Sequence
  Description of Artificial Sequence: Synthetic oligonucleotide
ttggaccgccgcggacaccgc

SEQ ID NO: 382077 - DNA, 35 bp, Artificial Sequence; identical to SEQ ID NO: 41755
  Description of Artificial Sequence: Synthetic oligonucleotide

SEQ ID NO: 382078 - DNA, 36 bp, Artificial Sequence; identical to SEQ ID NO: 41756
  Description of Artificial Sequence: Synthetic oligonucleotide

SEQ ID NO: 382079 - DNA, 36 bp, Artificial Sequence; identical to SEQ ID NO: 41757
  Description of Artificial Sequence: Synthetic oligonucleotide

SEQ ID NO: 382080 - DNA, 35 bp, Artificial Sequence; identical to SEQ ID NO: 41758
  Description of Artificial Sequence: Synthetic oligonucleotide

SEQ ID NO: 382081 - DNA, 35 bp, Artificial Sequence; identical to SEQ ID NO: 41759
  Description of Artificial Sequence: Synthetic oligonucleotide

SEQ ID NO: 382082 - DNA, 35 bp, Artificial Sequence; identical to SEQ ID NO: 41760
  Description of Artificial Sequence: Synthetic oligonucleotide

SEQ ID NO: 382083 - DNA, 35 bp, Artificial Sequence; identical to SEQ ID NO: 41761
  Description of Artificial Sequence: Synthetic oligonucleotide

SEQ ID NO: 382084 - DNA, 34 bp, Artificial Sequence; identical to SEQ ID NO: 41762
  Description of Artificial Sequence: Synthetic oligonucleotide

SEQ ID NO: 382085 - DNA, 27 bp, Artificial Sequence
  Description of Artificial Sequence: Synthetic oligonucleotide
aaaggagggagctgctctcaggctgca

SEQ ID NO: 382086 - DNA, 27 bp, Artificial Sequence
  Description of Artificial Sequence: Synthetic oligonucleotide
aaggagggagctgctctcaggctgcat

SEQ ID NO: 382087 - DNA, 26 bp, Artificial Sequence
  Description of Artificial Sequence: Synthetic oligonucleotide
aggagggagctgctctcaggctgcat

SEQ ID NO: 382088 - DNA, 25 bp, Artificial Sequence
  Description of Artificial Sequence: Synthetic oligonucleotide
ggagggagctgctctcaggctgcat

SEQ ID NO: 382089 - DNA, 25 bp, Artificial Sequence
  Description of Artificial Sequence: Synthetic oligonucleotide
gagggagctgctctcaggctgcatc

SEQ ID NO: 382090 - DNA, 26 bp, Artificial Sequence
  Description of Artificial Sequence: Synthetic oligonucleotide
agggagctgctctcaggctgcatcca

SEQ ID NO: 382091 - DNA, 25 bp, Artificial Sequence
  Description of Artificial Sequence: Synthetic oligonucleotide
gggagctgctctcaggctgcatcca

SEQ ID NO: 382092 - DNA, 25 bp, Artificial Sequence
  Description of Artificial Sequence: Synthetic oligonucleotide
ggagctgctctcaggctgcatccag

SEQ ID NO: 382093 - DNA, 27 bp, Artificial Sequence
  Description of Artificial Sequence: Synthetic oligonucleotide
gagctgctctcaggctgcatccagcaa

SEQ ID NO: 382094 - DNA, 27 bp, Artificial Sequence
  Description of Artificial Sequence: Synthetic oligonucleotide
agctgctctcaggctgcatccagcaac

SEQ ID NO: 382095 - DNA, 27 bp, Artificial Sequence
  Description of Artificial Sequence: Synthetic oligonucleotide
gctgctctcaggctgcatccagcaaca

SEQ ID NO: 382096 - DNA, 27 bp, Artificial Sequence
  Description of Artificial Sequence: Synthetic oligonucleotide
ctgctctcaggctgcatccagcaacag

SEQ ID NO: 382097 - DNA, 28 bp, Artificial Sequence
  Description of Artificial Sequence: Synthetic oligonucleotide
tgctctcaggctgcatccagcaacagtg

SEQ ID NO: 382098 - DNA, 27 bp, Artificial Sequence
  Description of Artificial Sequence: Synthetic oligonucleotide
gctctcaggctgcatccagcaacagtg

SEQ ID NO: 382099 - DNA, 27 bp, Artificial Sequence
  Description of Artificial Sequence: Synthetic oligonucleotide
ctctcaggctgcatccagcaacagtgc

SEQ ID NO: 382100 - DNA, 27 bp, Artificial Sequence
  Description of Artificial Sequence: Synthetic oligonucleotide
tctcaggctgcatccagcaacagtgcc

SEQ ID NO: 382101 - DNA, 26 bp, Artificial Sequence
  Description of Artificial Sequence: Synthetic oligonucleotide
ctcaggctgcatccagcaacagtgcc

SEQ ID NO: 382102 - DNA, 27 bp, Artificial Sequence
  Description of Artificial Sequence: Synthetic oligonucleotide
tcaggctgcatccagcaacagtgccca

SEQ ID NO: 382103 - DNA, 26 bp, Artificial Sequence
  Description of Artificial Sequence: Synthetic oligonucleotide
caggctgcatccagcaacagtgccca

SEQ ID NO: 382104 - DNA, 26 bp, Artificial Sequence
  Description of Artificial Sequence: Synthetic oligonucleotide
aggctgcatccagcaacagtgcccag

SEQ ID NO: 382105 - DNA, 25 bp, Artificial Sequence
  Description of Artificial Sequence: Synthetic oligonucleotide
ggctgcatccagcaacagtgcccag

SEQ ID NO: 382106 - DNA, 25 bp, Artificial Sequence
  Description of Artificial Sequence: Synthetic oligonucleotide
gctgcatccagcaacagtgcccagg

SEQ ID NO: 382107 - DNA, 25 bp, Artificial Sequence
  Description of Artificial Sequence: Synthetic oligonucleotide
ctgcatccagcaacagtgcccaggg

SEQ ID NO: 382108 - DNA, 26 bp, Artificial Sequence
  Description of Artificial Sequence: Synthetic oligonucleotide
tgcatccagcaacagtgcccagggct

SEQ ID NO: 382109 - DNA, 25 bp, Artificial Sequence
  Description of Artificial Sequence: Synthetic oligonucleotide
gcatccagcaacagtgcccagggct

SEQ ID NO: 382110 - DNA, 26 bp, Artificial Sequence
  Description of Artificial Sequence: Synthetic oligonucleotide
catccagcaacagtgcccagggctct

SEQ ID NO: 382111 - DNA, 27 bp, Artificial Sequence
  Description of Artificial Sequence: Synthetic oligonucleotide
atccagcaacagtgcccagggctctga

SEQ ID NO: 382112 - DNA, 27 bp, Artificial Sequence
  Description of Artificial Sequence: Synthetic oligonucleotide
gagatcacactgacctggcagtgggac

SEQ ID NO: 382113 - DNA, 27 bp, Artificial Sequence
  Description of Artificial Sequence: Synthetic oligonucleotide
agatcacactgacctggcagtgggacg

SEQ ID NO: 382114 - DNA, 26 bp, Artificial Sequence
  Description of Artificial Sequence: Synthetic oligonucleotide
gatcacactgacctggcagtgggacg

SEQ ID NO: 382115 - DNA, 26 bp, Artificial Sequence
  Description of Artificial Sequence: Synthetic oligonucleotide
atcacactgacctggcagtgggacgg

SEQ ID NO: 382116 - DNA, 25 bp, Artificial Sequence
  Description of Artificial Sequence: Synthetic oligonucleotide
tcacactgacctggcagtgggacgg

SEQ ID NO: 382117 - DNA, 24 bp, Artificial Sequence
  Description of Artificial Sequence: Synthetic oligonucleotide
cacactgacctggcagtgggacgg

SEQ ID NO: 382118 - DNA, 24 bp, Artificial Sequence
  Description of Artificial Sequence: Synthetic oligonucleotide
acactgacctggcagtgggacggg

SEQ ID NO: 382119 - DNA, 23 bp, Artificial Sequence
  Description of Artificial Sequence: Synthetic oligonucleotide
cactgacctggcagtgggacggg

SEQ ID NO: 382120 - DNA, 24 bp, Artificial Sequence
  Description of Artificial Sequence: Synthetic oligonucleotide
actgacctggcagtgggacgggga

SEQ ID NO: 382121 - DNA, 23 bp, Artificial Sequence
  Description of Artificial Sequence: Synthetic oligonucleotide
ctgacctggcagtgggacgggga

SEQ ID NO: 382122 - DNA, 23 bp, Artificial Sequence
  Description of Artificial Sequence: Synthetic oligonucleotide
tgacctggcagtgggacggggag

SEQ ID NO: 382123 - DNA, 22 bp, Artificial Sequence
  Description of Artificial Sequence: Synthetic oligonucleotide
gacctggcagtgggacggggag

SEQ ID NO: 382124 - DNA, 23 bp, Artificial Sequence
  Description of Artificial Sequence: Synthetic oligonucleotide
acctggcagtgggacggggagga

SEQ ID NO: 382125 - DNA, 22 bp, Artificial Sequence
  Description of Artificial Sequence: Synthetic oligonucleotide
cctggcagtgggacggggagga

SEQ ID NO: 382126 - DNA, 22 bp, Artificial Sequence
  Description of Artificial Sequence: Synthetic oligonucleotide
ctggcagtgggacggggaggac

SEQ ID NO: 382127 - DNA, 25 bp, Artificial Sequence
  Description of Artificial Sequence: Synthetic oligonucleotide
tggcagtgggacggggaggaccaaa

SEQ ID NO: 382128 - DNA, 24 bp, Artificial Sequence
  Description of Artificial Sequence: Synthetic oligonucleotide
ggcagtgggacggggaggaccaaa

SEQ ID NO: 382129 - DNA, 25 bp, Artificial Sequence
  Description of Artificial Sequence: Synthetic oligonucleotide
gcagtgggacggggaggaccaaact

SEQ ID NO: 382130 - DNA, 26 bp, Artificial Sequence
  Description of Artificial Sequence: Synthetic oligonucleotide
cagtgggacggggaggaccaaactca

SEQ ID NO: 382131 - DNA, 26 bp, Artificial Sequence
  Description of Artificial Sequence: Synthetic oligonucleotide
agtgggacggggaggaccaaactcag

SEQ ID NO: 382132 - DNA, 25 bp, Artificial Sequence
  Description of Artificial Sequence: Synthetic oligonucleotide
gtgggacggggaggaccaaactcag

SEQ ID NO: 382133 - DNA, 26 bp, Artificial Sequence
  Description of Artificial Sequence: Synthetic oligonucleotide
tgggacggggaggaccaaactcagga

SEQ ID NO: 382134 - DNA, 25 bp, Artificial Sequence
  Description of Artificial Sequence: Synthetic oligonucleotide
gggacggggaggaccaaactcagga

SEQ ID NO: 382135 - DNA, 26 bp, Artificial Sequence
  Description of Artificial Sequence: Synthetic oligonucleotide
ggacggggaggaccaaactcaggaca

SEQ ID NO: 382136 - DNA, 26 bp, Artificial Sequence
  Description of Artificial Sequence: Synthetic oligonucleotide
gacggggaggaccaaactcaggacac

SEQ ID NO: 382137 - DNA, 26 bp, Artificial Sequence
  Description of Artificial Sequence: Synthetic oligonucleotide
acggggaggaccaaactcaggacacc

SEQ ID NO: 382138 - DNA, 25 bp, Artificial Sequence
  Description of Artificial Sequence: Synthetic oligonucleotide
cggggaggaccaaactcaggacacc

SEQ ID NO: 382139 - DNA, 33 bp, Artificial Sequence
  Description of Artificial Sequence: Synthetic oligonucleotide
agtattgggaccgggagacacagaagtacaaac

SEQ ID NO: 382140 - DNA, 32 bp, Artificial Sequence
  Description of Artificial Sequence: Synthetic oligonucleotide
gtattgggaccgggagacacagaagtacaaac

SEQ ID NO: 382141 - DNA, 32 bp, Artificial Sequence
  Description of Artificial Sequence: Synthetic oligonucleotide
tattgggaccgggagacacagaagtacaaacg

SEQ ID NO: 382142 - DNA, 31 bp, Artificial Sequence
  Description of Artificial Sequence: Synthetic oligonucleotide
attgggaccgggagacacagaagtacaaacg

SEQ ID NO: 382143 - DNA, 30 bp, Artificial Sequence
  Description of Artificial Sequence: Synthetic oligonucleotide
ttgggaccgggagacacagaagtacaaacg

SEQ ID NO: 382144 - DNA, 29 bp, Artificial Sequence
  Description of Artificial Sequence: Synthetic oligonucleotide
tgggaccgggagacacagaagtacaaacg

SEQ ID NO: 382145 - DNA, 28 bp, Artificial Sequence
  Description of Artificial Sequence: Synthetic oligonucleotide
gggaccgggagacacagaagtacaaacg

SEQ ID NO: 382146 - DNA, 28 bp, Artificial Sequence
  Description of Artificial Sequence: Synthetic oligonucleotide
ggaccgggagacacagaagtacaaacgc

SEQ ID NO: 382147 - DNA, 28 bp, Artificial Sequence
  Description of Artificial Sequence: Synthetic oligonucleotide
gaccgggagacacagaagtacaaacgcc

SEQ ID NO: 382148 - DNA, 29 bp, Artificial Sequence
  Description of Artificial Sequence: Synthetic oligonucleotide
accgggagacacagaagtacaaacgccag

SEQ ID NO: 382149 - DNA, 28 bp, Artificial Sequence
  Description of Artificial Sequence: Synthetic oligonucleotide
ccgggagacacagaagtacaaacgccag

SEQ ID NO: 382150 - DNA, 28 bp, Artificial Sequence
  Description of Artificial Sequence: Synthetic oligonucleotide
cgggagacacagaagtacaaacgccagg

SEQ ID NO: 382151 - DNA, 28 bp, Artificial Sequence
  Description of Artificial Sequence: Synthetic oligonucleotide
gggagacacagaagtacaaacgccaggc

SEQ ID NO: 382152 - DNA, 29 bp, Artificial Sequence
  Description of Artificial Sequence: Synthetic oligonucleotide
ggagacacagaagtacaaacgccaggcac

SEQ ID NO: 382153 - DNA, 30 bp, Artificial Sequence
  Description of Artificial Sequence: Synthetic oligonucleotide
gagacacagaagtacaaacgccaggcacag

SEQ ID NO: 382154 - DNA, 31 bp, Artificial Sequence
  Description of Artificial Sequence: Synthetic oligonucleotide
agacacagaagtacaaacgccaggcacagac

SEQ ID NO: 382155 - DNA, 30 bp, Artificial Sequence
  Description of Artificial Sequence: Synthetic oligonucleotide
gacacagaagtacaaacgccaggcacagac

SEQ ID NO: 382156 - DNA, 31 bp, Artificial Sequence
  Description of Artificial Sequence: Synthetic oligonucleotide
acacagaagtacaaacgccaggcacagactg

SEQ ID NO: 382157 - DNA, 30 bp, Artificial Sequence
  Description of Artificial Sequence: Synthetic oligonucleotide
cacagaagtacaaacgccaggcacagactg

SEQ ID NO: 382158 - DNA, 31 bp, Artificial Sequence
  Description of Artificial Sequence: Synthetic oligonucleotide
acagaagtacaaacgccaggcacagactgac

SEQ ID NO: 382159 - DNA, 30 bp, Artificial Sequence
  Description of Artificial Sequence: Synthetic oligonucleotide
cagaagtacaaacgccaggcacagactgac

SEQ ID NO: 382160 - DNA, 30 bp, Artificial Sequence
  Description of Artificial Sequence: Synthetic oligonucleotide
agaagtacaaacgccaggcacagactgacc

SEQ ID NO: 382161 - DNA, 29 bp, Artificial Sequence
  Description of Artificial Sequence: Synthetic oligonucleotide
gaagtacaaacgccaggcacagactgacc

SEQ ID NO: 382162 - DNA, 29 bp, Artificial Sequence
  Description of Artificial Sequence: Synthetic oligonucleotide
aagtacaaacgccaggcacagactgaccg

SEQ ID NO: 382163 - DNA, 28 bp, Artificial Sequence
  Description of Artificial Sequence: Synthetic oligonucleotide
agtacaaacgccaggcacagactgaccg

SEQ ID NO: 382164 - DNA, 27 bp, Artificial Sequence
  Description of Artificial Sequence: Synthetic oligonucleotide
gtacaaacgccaggcacagactgaccg

SEQ ID NO: 382165 - DNA, 28 bp, Artificial Sequence
  Description of Artificial Sequence: Synthetic oligonucleotide
tacaaacgccaggcacagactgaccgag

SEQ ID NO: 382166 - DNA, 27 bp, Artificial Sequence
  Description of Artificial Sequence: Synthetic oligonucleotide
acaaacgccaggcacagactgaccgag

SEQ ID NO: 382167 - DNA, 27 bp, Artificial Sequence
  Description of Artificial Sequence: Synthetic oligonucleotide
caaacgccaggcacagactgaccgagt

SEQ ID NO: 382168 - DNA, 27 bp, Artificial Sequence
  Description of Artificial Sequence: Synthetic oligonucleotide
aaacgccaggcacagactgaccgagtg

SEQ ID NO: 382169 - DNA, 27 bp, Artificial Sequence
  Description of Artificial Sequence: Synthetic oligonucleotide
aacgccaggcacagactgaccgagtga

SEQ ID NO: 382170 - DNA, 26 bp, Artificial Sequence
  Description of Artificial Sequence: Synthetic oligonucleotide
acgccaggcacagactgaccgagtga

SEQ ID NO: 382171 - DNA, 26 bp, Artificial Sequence
  Description of Artificial Sequence: Synthetic oligonucleotide
ctgaggtgctgggccctgggctttta

SEQ ID NO: 382172 - DNA, 26 bp, Artificial Sequence
  Description of Artificial Sequence: Synthetic oligonucleotide
tgaggtgctgggccctgggcttttac

SEQ ID NO: 382173 - DNA, 25 bp, Artificial Sequence
  Description of Artificial Sequence: Synthetic oligonucleotide
gaggtgctgggccctgggcttttac

SEQ ID NO: 382174 - DNA, 25 bp, Artificial Sequence
  Description of Artificial Sequence: Synthetic oligonucleotide
aggtgctgggccctgggcttttacc

SEQ ID NO: 382175 - DNA, 24 bp, Artificial Sequence
  Description of Artificial Sequence: Synthetic oligonucleotide
ggtgctgggccctgggcttttacc

SEQ ID NO: 382176 - DNA, 25 bp, Artificial Sequence
  Description of Artificial Sequence: Synthetic oligonucleotide
gtgctgggccctgggcttttaccct

SEQ ID NO: 382177 - DNA, 25 bp, Artificial Sequence
  Description of Artificial Sequence: Synthetic oligonucleotide
tgctgggccctgggcttttaccctg

SEQ ID NO: 382178 - DNA, 24 bp, Artificial Sequence
  Description of Artificial Sequence: Synthetic oligonucleotide
gctgggccctgggcttttaccctg

SEQ ID NO: 382179 - DNA, 24 bp, Artificial Sequence
  Description of Artificial Sequence: Synthetic oligonucleotide
ctgggccctgggcttttaccctgc

SEQ ID NO: 382180 - DNA, 24 bp, Artificial Sequence
  Description of Artificial Sequence: Synthetic oligonucleotide
tgggccctgggcttttaccctgcg

SEQ ID NO: 382181 - DNA, 23 bp, Artificial Sequence
  Description of Artificial Sequence: Synthetic oligonucleotide
gggccctgggcttttaccctgcg

SEQ ID NO: 382182 - DNA, 24 bp, Artificial Sequence
  Description of Artificial Sequence: Synthetic oligonucleotide
ggccctgggcttttaccctgcgga

SEQ ID NO: 382183 - DNA, 26 bp, Artificial Sequence
  Description of Artificial Sequence: Synthetic oligonucleotide
gccctgggcttttaccctgcggagat

SEQ ID NO: 382184 - DNA, 27 bp, Artificial Sequence
  Description of Artificial Sequence: Synthetic oligonucleotide
ccctgggcttttaccctgcggagatca

SEQ ID NO: 382185 - DNA, 27 bp, Artificial Sequence
  Description of Artificial Sequence: Synthetic oligonucleotide
cctgggcttttaccctgcggagatcac

SEQ ID NO: 382186 - DNA, 28 bp, Artificial Sequence
  Description of Artificial Sequence: Synthetic oligonucleotide
ctgggcttttaccctgcggagatcacac

SEQ ID NO: 382187 - DNA, 29 bp, Artificial Sequence
  Description of Artificial Sequence: Synthetic oligonucleotide
tgggcttttaccctgcggagatcacactg

SEQ ID NO: 382188 - DNA, 28 bp, Artificial Sequence
  Description of Artificial Sequence: Synthetic oligonucleotide
gggcttttaccctgcggagatcacactg

SEQ ID NO: 382189 - DNA, 29 bp, Artificial Sequence
  Description of Artificial Sequence: Synthetic oligonucleotide
ggcttttaccctgcggagatcacactgac

SEQ ID NO: 382190 - DNA, 29 bp, Artificial Sequence
  Description of Artificial Sequence: Synthetic oligonucleotide
gcttttaccctgcggagatcacactgacc

SEQ ID NO: 382191 - DNA, 30 bp, Artificial Sequence
  Description of Artificial Sequence: Synthetic oligonucleotide
cttttaccctgcggagatcacactgacctg

SEQ ID NO: 382192 - DNA, 30 bp, Artificial Sequence
  Description of Artificial Sequence: Synthetic oligonucleotide
ttttaccctgcggagatcacactgacctgg

SEQ ID NO: 382193 - DNA, 29 bp, Artificial Sequence
  Description of Artificial Sequence: Synthetic oligonucleotide
tttaccctgcggagatcacactgacctgg

SEQ ID NO: 382194 - DNA, 28 bp, Artificial Sequence
  Description of Artificial Sequence: Synthetic oligonucleotide
ttaccctgcggagatcacactgacctgg

SEQ ID NO: 382195 - DNA, 23 bp, Artificial Sequence
  Description of Artificial Sequence: Synthetic oligonucleotide
aggacctgcgctcctggaccgct

SEQ ID NO: 382196 - DNA, 22 bp, Artificial Sequence
  Description of Artificial Sequence: Synthetic oligonucleotide
ggacctgcgctcctggaccgct

SEQ ID NO: 382197 - DNA, 22 bp, Artificial Sequence
  Description of Artificial Sequence: Synthetic oligonucleotide
gacctgcgctcctggaccgctg

SEQ ID NO: 382198 - DNA, 22 bp, Artificial Sequence
  Description of Artificial Sequence: Synthetic oligonucleotide
acctgcgctcctggaccgctgc

SEQ ID NO: 382199 - DNA, 21 bp, Artificial Sequence
  Description of Artificial Sequence: Synthetic oligonucleotide
cctgcgctcctggaccgctgc

SEQ ID NO: 382200 - DNA, 21 bp, Artificial Sequence
  Description of Artificial Sequence: Synthetic oligonucleotide
ctgcgctcctggaccgctgcg

SEQ ID NO: 382201 - DNA, 22 bp, Artificial Sequence
  Description of Artificial Sequence: Synthetic oligonucleotide
tgcgctcctggaccgctgcgga

SEQ ID NO: 382202 - DNA, 21 bp, Artificial Sequence
  Description of Artificial Sequence: Synthetic oligonucleotide
gcgctcctggaccgctgcgga

SEQ ID NO: 382203 - DNA, 22 bp, Artificial Sequence
  Description of Artificial Sequence: Synthetic oligonucleotide
cgctcctggaccgctgcggaca

SEQ ID NO: 382204 - DNA, 22 bp, Artificial Sequence
  Description of Artificial Sequence: Synthetic oligonucleotide
gctcctggaccgctgcggacac

SEQ ID NO: 382205 - DNA, 22 bp, Artificial Sequence
  Description of Artificial Sequence: Synthetic oligonucleotide
ctcctggaccgctgcggacacg

SEQ ID NO: 382206 - DNA, 22 bp, Artificial Sequence
  Description of Artificial Sequence: Synthetic oligonucleotide
tcctggaccgctgcggacacgg

SEQ ID NO: 382207 - DNA, 21 bp, Artificial Sequence
  Description of Artificial Sequence: Synthetic oligonucleotide
cctggaccgctgcggacacgg

SEQ ID NO: 382208 - DNA, 21 bp, Artificial Sequence
  Description of Artificial Sequence: Synthetic oligonucleotide
ctggaccgctgcggacacggc

SEQ ID NO: 382209 - DNA, 21 bp, Artificial Sequence
  Description of Artificial Sequence: Synthetic oligonucleotide
tggaccgctgcggacacggcg

SEQ ID NO: 382210 - DNA, 20 bp, Artificial Sequence
  Description of Artificial Sequence: Synthetic oligonucleotide
ggaccgctgcggacacggcg

SEQ ID NO: 382211 - DNA, 20 bp, Artificial Sequence
  Description of Artificial Sequence: Synthetic oligonucleotide
gaccgctgcggacacggcgg

SEQ ID NO: 382212 - DNA, 21 bp, Artificial Sequence
  Description of Artificial Sequence: Synthetic oligonucleotide
accgctgcggacacggcggct

SEQ ID NO: 382213 - DNA, 20 bp, Artificial Sequence
  Description of Artificial Sequence: Synthetic oligonucleotide
ccgctgcggacacggcggct

SEQ ID NO: 382214 - DNA, 21 bp, Artificial Sequence
  Description of Artificial Sequence: Synthetic oligonucleotide
cgctgcggacacggcggctca

SEQ ID NO: 382215 - DNA, 23 bp, Artificial Sequence
  Description of Artificial Sequence: Synthetic oligonucleotide
gctgcggacacggcggctcagat

SEQ ID NO: 382216 - DNA, 24 bp, Artificial Sequence
  Description of Artificial Sequence: Synthetic oligonucleotide
ctgcggacacggcggctcagatca

SEQ ID NO: 382217 - DNA, 24 bp, Artificial Sequence
  Description of Artificial Sequence: Synthetic oligonucleotide
tgcggacacggcggctcagatcac

SEQ ID NO: 382218 - DNA, 24 bp, Artificial Sequence
  Description of Artificial Sequence: Synthetic oligonucleotide
catgtgcagcacgaggggctgcca

SEQ ID NO: 382219 - DNA, 25 bp, Artificial Sequence
  Description of Artificial Sequence: Synthetic oligonucleotide
atgtgcagcacgaggggctgccaga

SEQ ID NO: 382220 - DNA, 24 bp, Artificial Sequence
  Description of Artificial Sequence: Synthetic oligonucleotide
tgtgcagcacgaggggctgccaga

SEQ ID NO: 382221 - DNA, 23 bp, Artificial Sequence
  Description of Artificial Sequence: Synthetic oligonucleotide
gtgcagcacgaggggctgccaga

SEQ ID NO: 382222 - DNA, 23 bp, Artificial Sequence
  Description of Artificial Sequence: Synthetic oligonucleotide
tgcagcacgaggggctgccagag

SEQ ID NO: 382223 - DNA, 22 bp, Artificial Sequence
  Description of Artificial Sequence: Synthetic oligonucleotide
gcagcacgaggggctgccagag

SEQ ID NO: 382224 - DNA, 22 bp, Artificial Sequence
  Description of Artificial Sequence: Synthetic oligonucleotide
cagcacgaggggctgccagagc

SEQ ID NO: 382225 - DNA, 22 bp, Artificial Sequence
  Description of Artificial Sequence: Synthetic oligonucleotide
agcacgaggggctgccagagcc

SEQ ID NO: 382226 - DNA, 21 bp, Artificial Sequence
  Description of Artificial Sequence: Synthetic oligonucleotide
gcacgaggggctgccagagcc

SEQ ID NO: 382227 - DNA, 21 bp, Artificial Sequence
  Description of Artificial Sequence: Synthetic oligonucleotide
cacgaggggctgccagagccc

SEQ ID NO: 382228 - DNA, 22 bp, Artificial Sequence
  Description of Artificial Sequence: Synthetic oligonucleotide
acgaggggctgccagagcccct

SEQ ID NO: 382229 - DNA, 21 bp, Artificial Sequence
  Description of Artificial Sequence: Synthetic oligonucleotide
cgaggggctgccagagcccct

SEQ ID NO: 382230 - DNA, 22 bp, Artificial Sequence
  Description of Artificial Sequence: Synthetic oligonucleotide
gaggggctgccagagcccctca

SEQ ID NO: 382231 - DNA, 22 bp, Artificial Sequence
  Description of Artificial Sequence: Synthetic oligonucleotide
aggggctgccagagcccctcac

SEQ ID NO: 382232 - DNA, 21 bp, Artificial Sequence
  Description of Artificial Sequence: Synthetic oligonucleotide
ggggctgccagagcccctcac

SEQ ID NO: 382233 - DNA, 21 bp, Artificial Sequence
  Description of Artificial Sequence: Synthetic oligonucleotide
gggctgccagagcccctcacc

SEQ ID NO: 382234 - DNA, 22 bp, Artificial Sequence
  Description of Artificial Sequence: Synthetic oligonucleotide
ggctgccagagcccctcaccct

SEQ ID NO: 382235 - DNA, 23 bp, Artificial Sequence
  Description of Artificial Sequence: Synthetic oligonucleotide
gctgccagagcccctcaccctga

SEQ ID NO: 382236 - DNA, 25 bp, Artificial Sequence
  Description of Artificial Sequence: Synthetic oligonucleotide
ctgccagagcccctcaccctgagat

SEQ ID NO: 382237 - DNA, 25 bp, Artificial Sequence
  Description of Artificial Sequence: Synthetic oligonucleotide
tgccagagcccctcaccctgagatg

SEQ ID NO: 382238 - DNA, 24 bp, Artificial Sequence
  Description of Artificial Sequence: Synthetic oligonucleotide
gccagagcccctcaccctgagatg

SEQ ID NO: 382239 - DNA, 24 bp, Artificial Sequence
  Description of Artificial Sequence: Synthetic oligonucleotide
ccagagcccctcaccctgagatgg

SEQ ID NO: 382240 - DNA, 25 bp, Artificial Sequence
  Description of Artificial Sequence: Synthetic oligonucleotide
cagagcccctcaccctgagatggga

SEQ ID NO: 382241 - DNA, 25 bp, Artificial Sequence
  Description of Artificial Sequence: Synthetic oligonucleotide
agagcccctcaccctgagatgggag

SEQ ID NO: 382242 - DNA, 26 bp, Artificial Sequence
  Description of Artificial Sequence: Synthetic oligonucleotide
ccatcttcccagcccaccatccccat

SEQ ID NO: 382243 - DNA, 26 bp, Artificial Sequence
  Description of Artificial Sequence: Synthetic oligonucleotide
catcttcccagcccaccatccccatc

SEQ ID NO: 382244 - DNA, 27 bp, Artificial Sequence
  Description of Artificial Sequence: Synthetic oligonucleotide
atcttcccagcccaccatccccatcgt

SEQ ID NO: 382245 - DNA, 29 bp, Artificial Sequence
  Description of Artificial Sequence: Synthetic oligonucleotide
ctgtcctagctgtcctaggagctgtgatg

SEQ ID NO: 382246 - DNA, 29 bp, Artificial Sequence
  Description of Artificial Sequence: Synthetic oligonucleotide
tgtcctagctgtcctaggagctgtgatgg

SEQ ID NO: 382247 - DNA, 28 bp, Artificial Sequence
  Description of Artificial Sequence: Synthetic oligonucleotide
gtcctagctgtcctaggagctgtgatgg

SEQ ID NO: 382248 - DNA, 28 bp, Artificial Sequence
  Description of Artificial Sequence: Synthetic oligonucleotide
tcctagctgtcctaggagctgtgatggc

SEQ ID NO: 382249 - DNA, 27 bp, Artificial Sequence
  Description of Artificial Sequence: Synthetic oligonucleotide
cctagctgtcctaggagctgtgatggc

SEQ ID NO: 382250 - DNA, 28 bp, Artificial Sequence
  Description of Artificial Sequence: Synthetic oligonucleotide
ctagctgtcctaggagctgtgatggctg

SEQ ID NO: 382251 - DNA, 30 bp, Artificial Sequence; identical to SEQ ID NO: 41846
  Description of Artificial Sequence: Synthetic oligonucleotide

SEQ ID NO: 382252 - DNA, 29 bp, Artificial Sequence
  Description of Artificial Sequence: Synthetic oligonucleotide
agctgtcctaggagctgtgatggctgttg

SEQ ID NO: 382253 - DNA, 28 bp, Artificial Sequence
  Description of Artificial Sequence: Synthetic oligonucleotide
gctgtcctaggagctgtgatggctgttg

SEQ ID NO: 382254 - DNA, 29 bp, Artificial Sequence
  Description of Artificial Sequence: Synthetic oligonucleotide
ctgtcctaggagctgtgatggctgttgtg

SEQ ID NO: 382255 - DNA, 31 bp, Artificial Sequence; identical to SEQ ID NO: 41850
  Description of Artificial Sequence: Synthetic oligonucleotide

SEQ ID NO: 382256 - DNA, 30 bp, Artificial Sequence; identical to SEQ ID NO: 41851
  Description of Artificial Sequence: Synthetic oligonucleotide

SEQ ID NO: 382257 - DNA, 31 bp, Artificial Sequence; identical to SEQ ID NO: 41852
  Description of Artificial Sequence: Synthetic oligonucleotide

SEQ ID NO: 382258 - DNA, 30 bp, Artificial Sequence; identical to SEQ ID NO: 41853
  Description of Artificial Sequence: Synthetic oligonucleotide

SEQ ID NO: 382259 - DNA, 32 bp, Artificial Sequence; identical to SEQ ID NO: 41854
  Description of Artificial Sequence: Synthetic oligonucleotide

SEQ ID NO: 382260 - DNA, 32 bp, Artificial Sequence; identical to SEQ ID NO: 41855
  Description of Artificial Sequence: Synthetic oligonucleotide

SEQ ID NO: 382261 - DNA, 31 bp, Artificial Sequence; identical to SEQ ID NO: 41856
  Description of Artificial Sequence: Synthetic oligonucleotide

SEQ ID NO: 382262 - DNA, 30 bp, Artificial Sequence; identical to SEQ ID NO: 41857
  Description of Artificial Sequence: Synthetic oligonucleotide

SEQ ID NO: 382263 - DNA, 31 bp, Artificial Sequence; identical to SEQ ID NO: 41858
  Description of Artificial Sequence: Synthetic oligonucleotide

SEQ ID NO: 382264 - DNA, 31 bp, Artificial Sequence; identical to SEQ ID NO: 41859
  Description of Artificial Sequence: Synthetic oligonucleotide

SEQ ID NO: 382265 - DNA, 30 bp, Artificial Sequence; identical to SEQ ID NO: 41860
  Description of Artificial Sequence: Synthetic oligonucleotide

SEQ ID NO: 382266 - DNA, 32 bp, Artificial Sequence; identical to SEQ ID NO: 41861
  Description of Artificial Sequence: Synthetic oligonucleotide

SEQ ID NO: 382267 - DNA, 33 bp, Artificial Sequence; identical to SEQ ID NO: 41862
  Description of Artificial Sequence: Synthetic oligonucleotide

SEQ ID NO: 382268 - DNA, 32 bp, Artificial Sequence; identical to SEQ ID NO: 41863
  Description of Artificial Sequence: Synthetic oligonucleotide

SEQ ID NO: 382269 - DNA, 32 bp, Artificial Sequence; identical to SEQ ID NO: 41864
  Description of Artificial Sequence: Synthetic oligonucleotide

SEQ ID NO: 382270 - DNA, 31 bp, Artificial Sequence; identical to SEQ ID NO: 41865
  Description of Artificial Sequence: Synthetic oligonucleotide

SEQ ID NO: 382271 - DNA, 32 bp, Artificial Sequence; identical to SEQ ID NO: 41866
  Description of Artificial Sequence: Synthetic oligonucleotide

SEQ ID NO: 382272 - DNA, 26 bp, Artificial Sequence
  Description of Artificial Sequence: Synthetic oligonucleotide
ctccagaggatgtctggctgcgacct

SEQ ID NO: 382273 - DNA, 26 bp, Artificial Sequence
  Description of Artificial Sequence: Synthetic oligonucleotide
tccagaggatgtctggctgcgacctg

SEQ ID NO: 382274 - DNA, 25 bp, Artificial Sequence
  Description of Artificial Sequence: Synthetic oligonucleotide
ccagaggatgtctggctgcgacctg

SEQ ID NO: 382275 - DNA, 25 bp, Artificial Sequence
  Description of Artificial Sequence: Synthetic oligonucleotide
cagaggatgtctggctgcgacctgg

SEQ ID NO: 382276 - DNA, 25 bp, Artificial Sequence
  Description of Artificial Sequence: Synthetic oligonucleotide
agaggatgtctggctgcgacctggg

SEQ ID NO: 382277 - DNA, 24 bp, Artificial Sequence
  Description of Artificial Sequence: Synthetic oligonucleotide
gaggatgtctggctgcgacctggg

SEQ ID NO: 382278 - DNA, 24 bp, Artificial Sequence
  Description of Artificial Sequence: Synthetic oligonucleotide
aggatgtctggctgcgacctgggg

SEQ ID NO: 382279 - DNA, 23 bp, Artificial Sequence
  Description of Artificial Sequence: Synthetic oligonucleotide
ggatgtctggctgcgacctgggg

SEQ ID NO: 382280 - DNA, 23 bp, Artificial Sequence
  Description of Artificial Sequence: Synthetic oligonucleotide
gatgtctggctgcgacctggggc

SEQ ID NO: 382281 - DNA, 23 bp, Artificial Sequence
  Description of Artificial Sequence: Synthetic oligonucleotide
atgtctggctgcgacctggggcc

SEQ ID NO: 382282 - DNA, 22 bp, Artificial Sequence
  Description of Artificial Sequence: Synthetic oligonucleotide
tgtctggctgcgacctggggcc

SEQ ID NO: 382283 - DNA, 21 bp, Artificial Sequence
  Description of Artificial Sequence: Synthetic oligonucleotide
gtctggctgcgacctggggcc

SEQ ID NO: 382284 - DNA, 21 bp, Artificial Sequence
  Description of Artificial Sequence: Synthetic oligonucleotide
tctggctgcgacctggggccc

SEQ ID NO: 382285 - DNA, 20 bp, Artificial Sequence
  Description of Artificial Sequence: Synthetic oligonucleotide
ctggctgcgacctggggccc

SEQ ID NO: 382286 - DNA, 20 bp, Artificial Sequence
  Description of Artificial Sequence: Synthetic oligonucleotide
cgacgggcgcctcctccgca

SEQ ID NO: 382287 - DNA, 20 bp, Artificial Sequence
  Description of Artificial Sequence: Synthetic oligonucleotide
gacgggcgcctcctccgcag

SEQ ID NO: 382288 - DNA, 23 bp, Artificial Sequence
  Description of Artificial Sequence: Synthetic oligonucleotide
acgggcgcctcctccgcaggtat

SEQ ID NO: 382289 - DNA, 22 bp, Artificial Sequence
  Description of Artificial Sequence: Synthetic oligonucleotide
cgggcgcctcctccgcaggtat

SEQ ID NO: 382290 - DNA, 23 bp, Artificial Sequence
  Description of Artificial Sequence: Synthetic oligonucleotide
gggcgcctcctccgcaggtatga

SEQ ID NO: 382291 - DNA, 23 bp, Artificial Sequence
  Description of Artificial Sequence: Synthetic oligonucleotide
ggcgcctcctccgcaggtatgac

SEQ ID NO: 382292 - DNA, 24 bp, Artificial Sequence
  Description of Artificial Sequence: Synthetic oligonucleotide
gcgcctcctccgcaggtatgacca

SEQ ID NO: 382293 - DNA, 26 bp, Artificial Sequence
  Description of Artificial Sequence: Synthetic oligonucleotide
cgcctcctccgcaggtatgaccagta

SEQ ID NO: 382294 - DNA, 26 bp, Artificial Sequence
  Description of Artificial Sequence: Synthetic oligonucleotide
gcctcctccgcaggtatgaccagtac

SEQ ID NO: 382295 - DNA, 26 bp, Artificial Sequence
  Description of Artificial Sequence: Synthetic oligonucleotide
cctcctccgcaggtatgaccagtacg

SEQ ID NO: 382296 - DNA, 26 bp, Artificial Sequence
  Description of Artificial Sequence: Synthetic oligonucleotide
ctcctccgcaggtatgaccagtacgc

SEQ ID NO: 382297 - DNA, 27 bp, Artificial Sequence
  Description of Artificial Sequence: Synthetic oligonucleotide
tcctccgcaggtatgaccagtacgcct

SEQ ID NO: 382298 - DNA, 27 bp, Artificial Sequence
  Description of Artificial Sequence: Synthetic oligonucleotide
cctccgcaggtatgaccagtacgccta

SEQ ID NO: 382299 - DNA, 27 bp, Artificial Sequence
  Description of Artificial Sequence: Synthetic oligonucleotide
ctccgcaggtatgaccagtacgcctac

SEQ ID NO: 382300 - DNA, 27 bp, Artificial Sequence
  Description of Artificial Sequence: Synthetic oligonucleotide
tccgcaggtatgaccagtacgcctacg

SEQ ID NO: 382301 - DNA, 27 bp, Artificial Sequence
  Description of Artificial Sequence: Synthetic oligonucleotide
ccgcaggtatgaccagtacgcctacga

SEQ ID NO: 382302 - DNA, 27 bp, Artificial Sequence
  Description of Artificial Sequence: Synthetic oligonucleotide
cgcaggtatgaccagtacgcctacgac

SEQ ID NO: 382303 - DNA, 27 bp, Artificial Sequence
  Description of Artificial Sequence: Synthetic oligonucleotide
gcaggtatgaccagtacgcctacgacg

SEQ ID NO: 382304 - DNA, 27 bp, Artificial Sequence
  Description of Artificial Sequence: Synthetic oligonucleotide
caggtatgaccagtacgcctacgacgg

SEQ ID NO: 382305 - DNA, 27 bp, Artificial Sequence
  Description of Artificial Sequence: Synthetic oligonucleotide
aggtatgaccagtacgcctacgacggc

SEQ ID NO: 382306 - DNA, 22 bp, Artificial Sequence
  Description of Artificial Sequence: Synthetic oligonucleotide
cagcgcaagtgggaggcggcct

SEQ ID NO: 382307 - DNA, 23 bp, Artificial Sequence
  Description of Artificial Sequence: Synthetic oligonucleotide
agcgcaagtgggaggcggcctgt

SEQ ID NO: 382308 - DNA, 22 bp, Artificial Sequence
  Description of Artificial Sequence: Synthetic oligonucleotide
gcgcaagtgggaggcggcctgt

SEQ ID NO: 382309 - DNA, 23 bp, Artificial Sequence
  Description of Artificial Sequence: Synthetic oligonucleotide
cgcaagtgggaggcggcctgtga

SEQ ID NO: 382310 - DNA, 23 bp, Artificial Sequence
  Description of Artificial Sequence: Synthetic oligonucleotide
gcaagtgggaggcggcctgtgag

SEQ ID NO: 382311 - DNA, 23 bp, Artificial Sequence
  Description of Artificial Sequence: Synthetic oligonucleotide
caagtgggaggcggcctgtgagg

SEQ ID NO: 382312 - DNA, 23 bp, Artificial Sequence
  Description of Artificial Sequence: Synthetic oligonucleotide
aagtgggaggcggcctgtgaggc

SEQ ID NO: 382313 - DNA, 22 bp, Artificial Sequence
  Description of Artificial Sequence: Synthetic oligonucleotide
agtgggaggcggcctgtgaggc

SEQ ID NO: 382314 - DNA, 21 bp, Artificial Sequence
  Description of Artificial Sequence: Synthetic oligonucleotide
gtgggaggcggcctgtgaggc

SEQ ID NO: 382315 - DNA, 21 bp, Artificial Sequence
  Description of Artificial Sequence: Synthetic oligonucleotide
tgggaggcggcctgtgaggcg

SEQ ID NO: 382316 - DNA, 20 bp, Artificial Sequence
  Description of Artificial Sequence: Synthetic oligonucleotide
gggaggcggcctgtgaggcg

SEQ ID NO: 382317 - DNA, 21 bp, Artificial Sequence
  Description of Artificial Sequence: Synthetic oligonucleotide
ggaggcggcctgtgaggcgga

SEQ ID NO: 382318 - DNA, 21 bp, Artificial Sequence
  Description of Artificial Sequence: Synthetic oligonucleotide
gaggcggcctgtgaggcggag

SEQ ID NO: 382319 - DNA, 22 bp, Artificial Sequence
  Description of Artificial Sequence: Synthetic oligonucleotide
aggcggcctgtgaggcggagca

SEQ ID NO: 382320 - DNA, 21 bp, Artificial Sequence
  Description of Artificial Sequence: Synthetic oligonucleotide
ggcggcctgtgaggcggagca

SEQ ID NO: 382321 - DNA, 21 bp, Artificial Sequence
  Description of Artificial Sequence: Synthetic oligonucleotide
gcggcctgtgaggcggagcag

SEQ ID NO: 382322 - DNA, 21 bp, Artificial Sequence
  Description of Artificial Sequence: Synthetic oligonucleotide
cggcctgtgaggcggagcagc

SEQ ID NO: 382323 - DNA, 21 bp, Artificial Sequence
  Description of Artificial Sequence: Synthetic oligonucleotide
ggcctgtgaggcggagcagcg

SEQ ID NO: 382324 - DNA, 22 bp, Artificial Sequence
  Description of Artificial Sequence: Synthetic oligonucleotide
gcctgtgaggcggagcagcgga

SEQ ID NO: 382325 - DNA, 23 bp, Artificial Sequence
  Description of Artificial Sequence: Synthetic oligonucleotide
cctgtgaggcggagcagcggaga

SEQ ID NO: 382326 - DNA, 23 bp, Artificial Sequence
  Description of Artificial Sequence: Synthetic oligonucleotide
ctgtgaggcggagcagcggagag

SEQ ID NO: 382327 - DNA, 23 bp, Artificial Sequence
  Description of Artificial Sequence: Synthetic oligonucleotide
tgtgaggcggagcagcggagagc

SEQ ID NO: 382328 - DNA, 28 bp, Artificial Sequence
  Description of Artificial Sequence: Synthetic oligonucleotide
agacacagaagtacaagcgccaggcacc

SEQ ID NO: 382329 - DNA, 27 bp, Artificial Sequence
  Description of Artificial Sequence: Synthetic oligonucleotide
gacacagaagtacaagcgccaggcacc

SEQ ID NO: 382330 - DNA, 27 bp, Artificial Sequence
  Description of Artificial Sequence: Synthetic oligonucleotide
acacagaagtacaagcgccaggcaccg

SEQ ID NO: 382331 - DNA, 27 bp, Artificial Sequence
  Description of Artificial Sequence: Synthetic oligonucleotide
cacagaagtacaagcgccaggcaccga

SEQ ID NO: 382332 - DNA, 27 bp, Artificial Sequence
  Description of Artificial Sequence: Synthetic oligonucleotide
acagaagtacaagcgccaggcaccgac

SEQ ID NO: 382333 - DNA, 27 bp, Artificial Sequence
  Description of Artificial Sequence: Synthetic oligonucleotide
cagaagtacaagcgccaggcaccgact

SEQ ID NO: 382334 - DNA, 27 bp, Artificial Sequence
  Description of Artificial Sequence: Synthetic oligonucleotide
agaagtacaagcgccaggcaccgactg

SEQ ID NO: 382335 - DNA, 27 bp, Artificial Sequence
  Description of Artificial Sequence: Synthetic oligonucleotide
gaagtacaagcgccaggcaccgactga

SEQ ID NO: 382336 - DNA, 27 bp, Artificial Sequence
  Description of Artificial Sequence: Synthetic oligonucleotide
aagtacaagcgccaggcaccgactgac

SEQ ID NO: 382337 - DNA, 26 bp, Artificial Sequence
  Description of Artificial Sequence: Synthetic oligonucleotide
agtacaagcgccaggcaccgactgac

SEQ ID NO: 382338 - DNA, 25 bp, Artificial Sequence
  Description of Artificial Sequence: Synthetic oligonucleotide
gtacaagcgccaggcaccgactgac

SEQ ID NO: 382339 - DNA, 25 bp, Artificial Sequence
  Description of Artificial Sequence: Synthetic oligonucleotide
tacaagcgccaggcaccgactgacc

SEQ ID NO: 382340 - DNA, 24 bp, Artificial Sequence
  Description of Artificial Sequence: Synthetic oligonucleotide
acaagcgccaggcaccgactgacc

SEQ ID NO: 382341 - DNA, 23 bp, Artificial Sequence
  Description of Artificial Sequence: Synthetic oligonucleotide
caagcgccaggcaccgactgacc

SEQ ID NO: 382342 - DNA, 24 bp, Artificial Sequence
  Description of Artificial Sequence: Synthetic oligonucleotide
aagcgccaggcaccgactgaccga

SEQ ID NO: 382343 - DNA, 23 bp, Artificial Sequence
  Description of Artificial Sequence: Synthetic oligonucleotide
agcgccaggcaccgactgaccga

SEQ ID NO: 382344 - DNA, 22 bp, Artificial Sequence
  Description of Artificial Sequence: Synthetic oligonucleotide
gcgccaggcaccgactgaccga

SEQ ID NO: 382345 - DNA, 23 bp, Artificial Sequence
  Description of Artificial Sequence: Synthetic oligonucleotide
cgccaggcaccgactgaccgagt

SEQ ID NO: 382346 - DNA, 24 bp, Artificial Sequence
  Description of Artificial Sequence: Synthetic oligonucleotide
gccaggcaccgactgaccgagtga

SEQ ID NO: 382347 - DNA, 24 bp, Artificial Sequence
  Description of Artificial Sequence: Synthetic oligonucleotide
ccaggcaccgactgaccgagtgag

SEQ ID NO: 382348 - DNA, 24 bp, Artificial Sequence
  Description of Artificial Sequence: Synthetic oligonucleotide
caggcaccgactgaccgagtgagc

SEQ ID NO: 382349 - DNA, 25 bp, Artificial Sequence
  Description of Artificial Sequence: Synthetic oligonucleotide
aggcaccgactgaccgagtgagcct

SEQ ID NO: 382350 - DNA, 24 bp, Artificial Sequence
  Description of Artificial Sequence: Synthetic oligonucleotide
ggcaccgactgaccgagtgagcct

SEQ ID NO: 382351 - DNA, 24 bp, Artificial Sequence
  Description of Artificial Sequence: Synthetic oligonucleotide
gcaccgactgaccgagtgagcctg

SEQ ID NO: 382352 - DNA, 24 bp, Artificial Sequence
  Description of Artificial Sequence: Synthetic oligonucleotide
caccgactgaccgagtgagcctgc

SEQ ID NO: 382353 - DNA, 24 bp, Artificial Sequence
  Description of Artificial Sequence: Synthetic oligonucleotide
accgactgaccgagtgagcctgcg

SEQ ID NO: 382354 - DNA, 23 bp, Artificial Sequence
  Description of Artificial Sequence: Synthetic oligonucleotide
ccgactgaccgagtgagcctgcg

SEQ ID NO: 382355 - DNA, 25 bp, Artificial Sequence
  Description of Artificial Sequence: Synthetic oligonucleotide
cgactgaccgagtgagcctgcggaa

SEQ ID NO: 382356 - DNA, 28 bp, Artificial Sequence
  Description of Artificial Sequence: Synthetic oligonucleotide
ggaccgggagacacagaagtacaagcac

SEQ ID NO: 382357 - DNA, 28 bp, Artificial Sequence
  Description of Artificial Sequence: Synthetic oligonucleotide
gaccgggagacacagaagtacaagcacc

SEQ ID NO: 382358 - DNA, 29 bp, Artificial Sequence
  Description of Artificial Sequence: Synthetic oligonucleotide
accgggagacacagaagtacaagcaccag

SEQ ID NO: 382359 - DNA, 28 bp, Artificial Sequence
  Description of Artificial Sequence: Synthetic oligonucleotide
ccgggagacacagaagtacaagcaccag

SEQ ID NO: 382360 - DNA, 28 bp, Artificial Sequence
  Description of Artificial Sequence: Synthetic oligonucleotide
cgggagacacagaagtacaagcaccagg

SEQ ID NO: 382361 - DNA, 28 bp, Artificial Sequence
  Description of Artificial Sequence: Synthetic oligonucleotide
gggagacacagaagtacaagcaccaggc

SEQ ID NO: 382362 - DNA, 29 bp, Artificial Sequence
  Description of Artificial Sequence: Synthetic oligonucleotide
ggagacacagaagtacaagcaccaggcac

SEQ ID NO: 382363 - DNA, 30 bp, Artificial Sequence; identical to SEQ ID NO: 41982
  Description of Artificial Sequence: Synthetic oligonucleotide

SEQ ID NO: 382364 - DNA, 31 bp, Artificial Sequence; identical to SEQ ID NO: 41983
  Description of Artificial Sequence: Synthetic oligonucleotide

SEQ ID NO: 382365 - DNA, 30 bp, Artificial Sequence; identical to SEQ ID NO: 41984
  Description of Artificial Sequence: Synthetic oligonucleotide

SEQ ID NO: 382366 - DNA, 31 bp, Artificial Sequence; identical to SEQ ID NO: 41985
  Description of Artificial Sequence: Synthetic oligonucleotide

SEQ ID NO: 382367 - DNA, 30 bp, Artificial Sequence; identical to SEQ ID NO: 41986
  Description of Artificial Sequence: Synthetic oligonucleotide

SEQ ID NO: 382368 - DNA, 31 bp, Artificial Sequence; identical to SEQ ID NO: 41987
  Description of Artificial Sequence: Synthetic oligonucleotide

SEQ ID NO: 382369 - DNA, 30 bp, Artificial Sequence; identical to SEQ ID NO: 41988
  Description of Artificial Sequence: Synthetic oligonucleotide

SEQ ID NO: 382370 - DNA, 30 bp, Artificial Sequence; identical to SEQ ID NO: 41989
  Description of Artificial Sequence: Synthetic oligonucleotide

SEQ ID NO: 382371 - DNA, 29 bp, Artificial Sequence
  Description of Artificial Sequence: Synthetic oligonucleotide
gaagtacaagcaccaggcacagactgacc

SEQ ID NO: 382372 - DNA, 29 bp, Artificial Sequence
  Description of Artificial Sequence: Synthetic oligonucleotide
aagtacaagcaccaggcacagactgaccg

SEQ ID NO: 382373 - DNA, 28 bp, Artificial Sequence
  Description of Artificial Sequence: Synthetic oligonucleotide
agtacaagcaccaggcacagactgaccg

SEQ ID NO: 382374 - DNA, 27 bp, Artificial Sequence
  Description of Artificial Sequence: Synthetic oligonucleotide
gtacaagcaccaggcacagactgaccg

SEQ ID NO: 382375 - DNA, 28 bp, Artificial Sequence
  Description of Artificial Sequence: Synthetic oligonucleotide
tacaagcaccaggcacagactgaccgag

SEQ ID NO: 382376 - DNA, 27 bp, Artificial Sequence
  Description of Artificial Sequence: Synthetic oligonucleotide
acaagcaccaggcacagactgaccgag

SEQ ID NO: 382377 - DNA, 27 bp, Artificial Sequence
  Description of Artificial Sequence: Synthetic oligonucleotide
caagcaccaggcacagactgaccgagt

SEQ ID NO: 382378 - DNA, 27 bp, Artificial Sequence
  Description of Artificial Sequence: Synthetic oligonucleotide
aagcaccaggcacagactgaccgagtg

SEQ ID NO: 382379 - DNA, 27 bp, Artificial Sequence
  Description of Artificial Sequence: Synthetic oligonucleotide
agcaccaggcacagactgaccgagtga

SEQ ID NO: 382380 - DNA, 26 bp, Artificial Sequence
  Description of Artificial Sequence: Synthetic oligonucleotide
gcaccaggcacagactgaccgagtga

SEQ ID NO: 382381 - DNA, 26 bp, Artificial Sequence
  Description of Artificial Sequence: Synthetic oligonucleotide
caccaggcacagactgaccgagtgag

SEQ ID NO: 382382 - DNA, 26 bp, Artificial Sequence
  Description of Artificial Sequence: Synthetic oligonucleotide
accaggcacagactgaccgagtgagc

SEQ ID NO: 382383 - DNA, 22 bp, Artificial Sequence
  Description of Artificial Sequence: Synthetic oligonucleotide
ggtcatggcgccccgaaccctc

SEQ ID NO: 382384 - DNA, 24 bp, Artificial Sequence
  Description of Artificial Sequence: Synthetic oligonucleotide
ccgaaccctcctcctgctgctctc

SEQ ID NO: 382385 - DNA, 24 bp, Artificial Sequence
  Description of Artificial Sequence: Synthetic oligonucleotide
cgaaccctcctcctgctgctctcg

SEQ ID NO: 382386 - DNA, 24 bp, Artificial Sequence
  Description of Artificial Sequence: Synthetic oligonucleotide
gaaccctcctcctgctgctctcgg

SEQ ID NO: 382387 - DNA, 25 bp, Artificial Sequence
  Description of Artificial Sequence: Synthetic oligonucleotide
aaccctcctcctgctgctctcggga

SEQ ID NO: 382388 - DNA, 24 bp, Artificial Sequence
  Description of Artificial Sequence: Synthetic oligonucleotide
accctcctcctgctgctctcggga

SEQ ID NO: 382389 - DNA, 23 bp, Artificial Sequence
  Description of Artificial Sequence: Synthetic oligonucleotide
ccctcctcctgctgctctcggga

SEQ ID NO: 382390 - DNA, 23 bp, Artificial Sequence
  Description of Artificial Sequence: Synthetic oligonucleotide
cctcctcctgctgctctcgggag

SEQ ID NO: 382391 - DNA, 23 bp, Artificial Sequence
  Description of Artificial Sequence: Synthetic oligonucleotide
ctcctcctgctgctctcgggagc

SEQ ID NO: 382392 - DNA, 25 bp, Artificial Sequence
  Description of Artificial Sequence: Synthetic oligonucleotide
acctgggcctgctcccactccatga

SEQ ID NO: 382393 - DNA, 24 bp, Artificial Sequence
  Description of Artificial Sequence: Synthetic oligonucleotide
cctgggcctgctcccactccatga

SEQ ID NO: 382394 - DNA, 24 bp, Artificial Sequence
  Description of Artificial Sequence: Synthetic oligonucleotide
ctgggcctgctcccactccatgag

SEQ ID NO: 382395 - DNA, 27 bp, Artificial Sequence
  Description of Artificial Sequence: Synthetic oligonucleotide
tgggcctgctcccactccatgaggtat

SEQ ID NO: 382396 - DNA, 27 bp, Artificial Sequence
  Description of Artificial Sequence: Synthetic oligonucleotide
gggcctgctcccactccatgaggtatt

SEQ ID NO: 382397 - DNA, 28 bp, Artificial Sequence
  Description of Artificial Sequence: Synthetic oligonucleotide
ggcctgctcccactccatgaggtatttc

SEQ ID NO: 382398 - DNA, 30 bp, Artificial Sequence; identical to SEQ ID NO: 42309
  Description of Artificial Sequence: Synthetic oligonucleotide

SEQ ID NO: 382399 - DNA, 31 bp, Artificial Sequence; identical to SEQ ID NO: 42310
  Description of Artificial Sequence: Synthetic oligonucleotide

SEQ ID NO: 382400 - DNA, 31 bp, Artificial Sequence; identical to SEQ ID NO: 42311
  Description of Artificial Sequence: Synthetic oligonucleotide

SEQ ID NO: 382401 - DNA, 31 bp, Artificial Sequence; identical to SEQ ID NO: 42312
  Description of Artificial Sequence: Synthetic oligonucleotide

SEQ ID NO: 382402 - DNA, 31 bp, Artificial Sequence; identical to SEQ ID NO: 42313
  Description of Artificial Sequence: Synthetic oligonucleotide

SEQ ID NO: 382403 - DNA, 30 bp, Artificial Sequence; identical to SEQ ID NO: 42314
  Description of Artificial Sequence: Synthetic oligonucleotide

SEQ ID NO: 382404 - DNA, 31 bp, Artificial Sequence; identical to SEQ ID NO: 42315
  Description of Artificial Sequence: Synthetic oligonucleotide

SEQ ID NO: 382405 - DNA, 32 bp, Artificial Sequence; identical to SEQ ID NO: 42316
  Description of Artificial Sequence: Synthetic oligonucleotide

SEQ ID NO: 382406 - DNA, 32 bp, Artificial Sequence; identical to SEQ ID NO: 42317
  Description of Artificial Sequence: Synthetic oligonucleotide

SEQ ID NO: 382407 - DNA, 31 bp, Artificial Sequence; identical to SEQ ID NO: 42318
  Description of Artificial Sequence: Synthetic oligonucleotide

SEQ ID NO: 382408 - DNA, 31 bp, Artificial Sequence; identical to SEQ ID NO: 42319
  Description of Artificial Sequence: Synthetic oligonucleotide

SEQ ID NO: 382409 - DNA, 30 bp, Artificial Sequence; identical to SEQ ID NO: 42320
  Description of Artificial Sequence: Synthetic oligonucleotide

SEQ ID NO: 382410 - DNA, 30 bp, Artificial Sequence; identical to SEQ ID NO: 42321
  Description of Artificial Sequence: Synthetic oligonucleotide

SEQ ID NO: 382411 - DNA, 30 bp, Artificial Sequence; identical to SEQ ID NO: 42322
  Description of Artificial Sequence: Synthetic oligonucleotide

SEQ ID NO: 382412 - DNA, 29 bp, Artificial Sequence
  Description of Artificial Sequence: Synthetic oligonucleotide
tgaggtatttctacaccgctgtgtcccgg

SEQ ID NO: 382413 - DNA, 28 bp, Artificial Sequence
  Description of Artificial Sequence: Synthetic oligonucleotide
gaggtatttctacaccgctgtgtcccgg

SEQ ID NO: 382414 - DNA, 28 bp, Artificial Sequence
  Description of Artificial Sequence: Synthetic oligonucleotide
aggtatttctacaccgctgtgtcccggc

SEQ ID NO: 382415 - DNA, 27 bp, Artificial Sequence
  Description of Artificial Sequence: Synthetic oligonucleotide
ggtatttctacaccgctgtgtcccggc

SEQ ID NO: 382416 - DNA, 27 bp, Artificial Sequence
  Description of Artificial Sequence: Synthetic oligonucleotide
gtatttctacaccgctgtgtcccggcc

SEQ ID NO: 382417 - DNA, 27 bp, Artificial Sequence
  Description of Artificial Sequence: Synthetic oligonucleotide
tatttctacaccgctgtgtcccggccc

SEQ ID NO: 382418 - DNA, 27 bp, Artificial Sequence
  Description of Artificial Sequence: Synthetic oligonucleotide
atttctacaccgctgtgtcccggccca

SEQ ID NO: 382419 - DNA, 26 bp, Artificial Sequence
  Description of Artificial Sequence: Synthetic oligonucleotide
tttctacaccgctgtgtcccggccca

SEQ ID NO: 382420 - DNA, 25 bp, Artificial Sequence
  Description of Artificial Sequence: Synthetic oligonucleotide
ttctacaccgctgtgtcccggccca

SEQ ID NO: 382421 - DNA, 24 bp, Artificial Sequence
  Description of Artificial Sequence: Synthetic oligonucleotide
tctacaccgctgtgtcccggccca

SEQ ID NO: 382422 - DNA, 23 bp, Artificial Sequence
  Description of Artificial Sequence: Synthetic oligonucleotide
ctacaccgctgtgtcccggccca

SEQ ID NO: 382423 - DNA, 23 bp, Artificial Sequence
  Description of Artificial Sequence: Synthetic oligonucleotide
tacaccgctgtgtcccggcccag

SEQ ID NO: 382424 - DNA, 22 bp, Artificial Sequence
  Description of Artificial Sequence: Synthetic oligonucleotide
acaccgctgtgtcccggcccag

SEQ ID NO: 382425 - DNA, 21 bp, Artificial Sequence
  Description of Artificial Sequence: Synthetic oligonucleotide
caccgctgtgtcccggcccag

SEQ ID NO: 382426 - DNA, 21 bp, Artificial Sequence
  Description of Artificial Sequence: Synthetic oligonucleotide
accgctgtgtcccggcccagc

SEQ ID NO: 382427 - DNA, 20 bp, Artificial Sequence
  Description of Artificial Sequence: Synthetic oligonucleotide
ccgctgtgtcccggcccagc

SEQ ID NO: 382428 - DNA, 20 bp, Artificial Sequence
  Description of Artificial Sequence: Synthetic oligonucleotide
cgctgtgtcccggcccagcc

SEQ ID NO: 382429 - DNA, 20 bp, Artificial Sequence
  Description of Artificial Sequence: Synthetic oligonucleotide
gctgtgtcccggcccagccg

SEQ ID NO: 382430 - DNA, 20 bp, Artificial Sequence
  Description of Artificial Sequence: Synthetic oligonucleotide
ctgtgtcccggcccagccgc

SEQ ID NO: 382431 - DNA, 20 bp, Artificial Sequence
  Description of Artificial Sequence: Synthetic oligonucleotide
tgtgtcccggcccagccgcg

SEQ ID NO: 382432 - DNA, 20 bp, Artificial Sequence
  Description of Artificial Sequence: Synthetic oligonucleotide
gtgtcccggcccagccgcgt

SEQ ID NO: 382433 - DNA, 20 bp, Artificial Sequence
  Description of Artificial Sequence: Synthetic oligonucleotide
tgtcccggcccagccgcgga

SEQ ID NO: 382434 - DNA, 20 bp, Artificial Sequence
  Description of Artificial Sequence: Synthetic oligonucleotide
gtcccggcccagccgcggat

SEQ ID NO: 382435 - DNA, 20 bp, Artificial Sequence
  Description of Artificial Sequence: Synthetic oligonucleotide
tcccggcccagccgcggaga

SEQ ID NO: 382436 - DNA, 20 bp, Artificial Sequence
  Description of Artificial Sequence: Synthetic oligonucleotide
cccggcccagccgcggagat

SEQ ID NO: 382437 - DNA, 20 bp, Artificial Sequence
  Description of Artificial Sequence: Synthetic oligonucleotide
ccggcccagccgcggagagt

SEQ ID NO: 382438 - DNA, 20 bp, Artificial Sequence
  Description of Artificial Sequence: Synthetic oligonucleotide
cggcccagccgcggagagct

SEQ ID NO: 382439 - DNA, 20 bp, Artificial Sequence
  Description of Artificial Sequence: Synthetic oligonucleotide
ggcccagccgcggagagcct

SEQ ID NO: 382440 - DNA, 20 bp, Artificial Sequence
  Description of Artificial Sequence: Synthetic oligonucleotide
gcccagccgcggagagccct

SEQ ID NO: 382441 - DNA, 20 bp, Artificial Sequence
  Description of Artificial Sequence: Synthetic oligonucleotide
cccagccgcggagagcccca

SEQ ID NO: 382442 - DNA, 22 bp, Artificial Sequence
  Description of Artificial Sequence: Synthetic oligonucleotide
ccagccgcggagagccccactt

SEQ ID NO: 382443 - DNA, 24 bp, Artificial Sequence
  Description of Artificial Sequence: Synthetic oligonucleotide
cagccgcggagagccccacttcat

SEQ ID NO: 382444 - DNA, 24 bp, Artificial Sequence
  Description of Artificial Sequence: Synthetic oligonucleotide
agccgcggagagccccacttcatc

SEQ ID NO: 382445 - DNA, 23 bp, Artificial Sequence
  Description of Artificial Sequence: Synthetic oligonucleotide
gccgcggagagccccacttcatc

SEQ ID NO: 382446 - DNA, 23 bp, Artificial Sequence
  Description of Artificial Sequence: Synthetic oligonucleotide
ccgcggagagccccacttcatcg

SEQ ID NO: 382447 - DNA, 24 bp, Artificial Sequence
  Description of Artificial Sequence: Synthetic oligonucleotide
cgcggagagccccacttcatcgca

SEQ ID NO: 382448 - DNA, 25 bp, Artificial Sequence
  Description of Artificial Sequence: Synthetic oligonucleotide
gcggagagccccacttcatcgcagt

SEQ ID NO: 382449 - DNA, 25 bp, Artificial Sequence
  Description of Artificial Sequence: Synthetic oligonucleotide
cggagagccccacttcatcgcagtg

SEQ ID NO: 382450 - DNA, 25 bp, Artificial Sequence
  Description of Artificial Sequence: Synthetic oligonucleotide
ggagagccccacttcatcgcagtgg

SEQ ID NO: 382451 - DNA, 25 bp, Artificial Sequence
  Description of Artificial Sequence: Synthetic oligonucleotide
gagagccccacttcatcgcagtggg

SEQ ID NO: 382452 - DNA, 27 bp, Artificial Sequence
  Description of Artificial Sequence: Synthetic oligonucleotide
agagccccacttcatcgcagtgggcta

SEQ ID NO: 382453 - DNA, 26 bp, Artificial Sequence
  Description of Artificial Sequence: Synthetic oligonucleotide
gagccccacttcatcgcagtgggcta

SEQ ID NO: 382454 - DNA, 26 bp, Artificial Sequence
  Description of Artificial Sequence: Synthetic oligonucleotide
agccccacttcatcgcagtgggctac

SEQ ID NO: 382455 - DNA, 25 bp, Artificial Sequence
  Description of Artificial Sequence: Synthetic oligonucleotide
gccccacttcatcgcagtgggctac

SEQ ID NO: 382456 - DNA, 26 bp, Artificial Sequence
  Description of Artificial Sequence: Synthetic oligonucleotide
ccccacttcatcgcagtgggctacgt

SEQ ID NO: 382457 - DNA, 26 bp, Artificial Sequence
  Description of Artificial Sequence: Synthetic oligonucleotide
cccacttcatcgcagtgggctacgtg

SEQ ID NO: 382458 - DNA, 27 bp, Artificial Sequence
  Description of Artificial Sequence: Synthetic oligonucleotide
ccacttcatcgcagtgggctacgtgga

SEQ ID NO: 382459 - DNA, 27 bp, Artificial Sequence
  Description of Artificial Sequence: Synthetic oligonucleotide
cacttcatcgcagtgggctacgtggac

SEQ ID NO: 382460 - DNA, 27 bp, Artificial Sequence
  Description of Artificial Sequence: Synthetic oligonucleotide
acttcatcgcagtgggctacgtggacg

SEQ ID NO: 382461 - DNA, 26 bp, Artificial Sequence
  Description of Artificial Sequence: Synthetic oligonucleotide
cgccaggcacagactgaccgagtgaa

SEQ ID NO: 382462 - DNA, 26 bp, Artificial Sequence
  Description of Artificial Sequence: Synthetic oligonucleotide
gccaggcacagactgaccgagtgaac

SEQ ID NO: 382463 - DNA, 27 bp, Artificial Sequence
  Description of Artificial Sequence: Synthetic oligonucleotide
ccaggcacagactgaccgagtgaacct

SEQ ID NO: 382464 - DNA, 27 bp, Artificial Sequence
  Description of Artificial Sequence: Synthetic oligonucleotide
caggcacagactgaccgagtgaacctg

SEQ ID NO: 382465 - DNA, 27 bp, Artificial Sequence
  Description of Artificial Sequence: Synthetic oligonucleotide
aggcacagactgaccgagtgaacctgc

SEQ ID NO: 382466 - DNA, 26 bp, Artificial Sequence
  Description of Artificial Sequence: Synthetic oligonucleotide
ggcacagactgaccgagtgaacctgc

SEQ ID NO: 382467 - DNA, 26 bp, Artificial Sequence
  Description of Artificial Sequence: Synthetic oligonucleotide
gcacagactgaccgagtgaacctgcg

SEQ ID NO: 382468 - DNA, 27 bp, Artificial Sequence
  Description of Artificial Sequence: Synthetic oligonucleotide
cacagactgaccgagtgaacctgcgga

SEQ ID NO: 382469 - DNA, 29 bp, Artificial Sequence
  Description of Artificial Sequence: Synthetic oligonucleotide
acagactgaccgagtgaacctgcggaaac

SEQ ID NO: 382470 - DNA, 28 bp, Artificial Sequence
  Description of Artificial Sequence: Synthetic oligonucleotide
cagactgaccgagtgaacctgcggaaac

SEQ ID NO: 382471 - DNA, 30 bp, Artificial Sequence; identical to SEQ ID NO: 42364
  Description of Artificial Sequence: Synthetic oligonucleotide

SEQ ID NO: 382472 - DNA, 29 bp, Artificial Sequence
  Description of Artificial Sequence: Synthetic oligonucleotide
gactgaccgagtgaacctgcggaaactac

SEQ ID NO: 382473 - DNA, 29 bp, Artificial Sequence
  Description of Artificial Sequence: Synthetic oligonucleotide
actgaccgagtgaacctgcggaaactacg

SEQ ID NO: 382474 - DNA, 28 bp, Artificial Sequence
  Description of Artificial Sequence: Synthetic oligonucleotide
ctgaccgagtgaacctgcggaaactacg

SEQ ID NO: 382475 - DNA, 28 bp, Artificial Sequence
  Description of Artificial Sequence: Synthetic oligonucleotide
tgaccgagtgaacctgcggaaactacgc

SEQ ID NO: 382476 - DNA, 27 bp, Artificial Sequence
  Description of Artificial Sequence: Synthetic oligonucleotide
gaccgagtgaacctgcggaaactacgc

SEQ ID NO: 382477 - DNA, 27 bp, Artificial Sequence
  Description of Artificial Sequence: Synthetic oligonucleotide
accgagtgaacctgcggaaactacgcg

SEQ ID NO: 382478 - DNA, 26 bp, Artificial Sequence
  Description of Artificial Sequence: Synthetic oligonucleotide
ccgagtgaacctgcggaaactacgcg

SEQ ID NO: 382479 - DNA, 26 bp, Artificial Sequence
  Description of Artificial Sequence: Synthetic oligonucleotide
cgagtgaacctgcggaaactacgcgg

SEQ ID NO: 382480 - DNA, 27 bp, Artificial Sequence
  Description of Artificial Sequence: Synthetic oligonucleotide
gagtgaacctgcggaaactacgcggct

SEQ ID NO: 382481 - DNA, 28 bp, Artificial Sequence
  Description of Artificial Sequence: Synthetic oligonucleotide
agtgaacctgcggaaactacgcggctac

SEQ ID NO: 382482 - DNA, 27 bp, Artificial Sequence
  Description of Artificial Sequence: Synthetic oligonucleotide
gtgaacctgcggaaactacgcggctac

SEQ ID NO: 382483 - DNA, 29 bp, Artificial Sequence
  Description of Artificial Sequence: Synthetic oligonucleotide
tgaacctgcggaaactacgcggctactac

SEQ ID NO: 382484 - DNA, 28 bp, Artificial Sequence
  Description of Artificial Sequence: Synthetic oligonucleotide
gaacctgcggaaactacgcggctactac

SEQ ID NO: 382485 - DNA, 30 bp, Artificial Sequence; identical to SEQ ID NO: 42378
  Description of Artificial Sequence: Synthetic oligonucleotide

SEQ ID NO: 382486 - DNA, 29 bp, Artificial Sequence
  Description of Artificial Sequence: Synthetic oligonucleotide
acctgcggaaactacgcggctactacaac

SEQ ID NO: 382487 - DNA, 28 bp, Artificial Sequence
  Description of Artificial Sequence: Synthetic oligonucleotide
cctgcggaaactacgcggctactacaac

SEQ ID NO: 382488 - DNA, 28 bp, Artificial Sequence
  Description of Artificial Sequence: Synthetic oligonucleotide
ctgcggaaactacgcggctactacaacc

SEQ ID NO: 382489 - DNA, 29 bp, Artificial Sequence
  Description of Artificial Sequence: Synthetic oligonucleotide
tgcggaaactacgcggctactacaaccag

SEQ ID NO: 382490 - DNA, 28 bp, Artificial Sequence
  Description of Artificial Sequence: Synthetic oligonucleotide
gcggaaactacgcggctactacaaccag

SEQ ID NO: 382491 - DNA, 29 bp, Artificial Sequence
  Description of Artificial Sequence: Synthetic oligonucleotide
cggaaactacgcggctactacaaccagag

SEQ ID NO: 382492 - DNA, 29 bp, Artificial Sequence
  Description of Artificial Sequence: Synthetic oligonucleotide
ggaaactacgcggctactacaaccagagc

SEQ ID NO: 382493 - DNA, 29 bp, Artificial Sequence
  Description of Artificial Sequence: Synthetic oligonucleotide
gaaactacgcggctactacaaccagagcg

SEQ ID NO: 382494 - DNA, 30 bp, Artificial Sequence; identical to SEQ ID NO: 42387
  Description of Artificial Sequence: Synthetic oligonucleotide

SEQ ID NO: 382495 - DNA, 29 bp, Artificial Sequence
  Description of Artificial Sequence: Synthetic oligonucleotide
aactacgcggctactacaaccagagcgag

SEQ ID NO: 382496 - DNA, 28 bp, Artificial Sequence
  Description of Artificial Sequence: Synthetic oligonucleotide
actacgcggctactacaaccagagcgag

SEQ ID NO: 382497 - DNA, 25 bp, Artificial Sequence
  Description of Artificial Sequence: Synthetic oligonucleotide
tgctgggccctgggcttctacccta

SEQ ID NO: 382498 - DNA, 24 bp, Artificial Sequence
  Description of Artificial Sequence: Synthetic oligonucleotide
gctgggccctgggcttctacccta

SEQ ID NO: 382499 - DNA, 24 bp, Artificial Sequence
  Description of Artificial Sequence: Synthetic oligonucleotide
ctgggccctgggcttctaccctac

SEQ ID NO: 382500 - DNA, 24 bp, Artificial Sequence
  Description of Artificial Sequence: Synthetic oligonucleotide
tgggccctgggcttctaccctacg

SEQ ID NO: 382501 - DNA, 23 bp, Artificial Sequence
  Description of Artificial Sequence: Synthetic oligonucleotide
gggccctgggcttctaccctacg

SEQ ID NO: 382502 - DNA, 24 bp, Artificial Sequence
  Description of Artificial Sequence: Synthetic oligonucleotide
ggccctgggcttctaccctacgga

SEQ ID NO: 382503 - DNA, 26 bp, Artificial Sequence
  Description of Artificial Sequence: Synthetic oligonucleotide
gccctgggcttctaccctacggagat

SEQ ID NO: 382504 - DNA, 27 bp, Artificial Sequence
  Description of Artificial Sequence: Synthetic oligonucleotide
ccctgggcttctaccctacggagatca

SEQ ID NO: 382505 - DNA, 27 bp, Artificial Sequence
  Description of Artificial Sequence: Synthetic oligonucleotide
cctgggcttctaccctacggagatcac

SEQ ID NO: 382506 - DNA, 28 bp, Artificial Sequence
  Description of Artificial Sequence: Synthetic oligonucleotide
ctgggcttctaccctacggagatcacac

SEQ ID NO: 382507 - DNA, 29 bp, Artificial Sequence
  Description of Artificial Sequence: Synthetic oligonucleotide
tgggcttctaccctacggagatcacactg

SEQ ID NO: 382508 - DNA, 28 bp, Artificial Sequence
  Description of Artificial Sequence: Synthetic oligonucleotide
gggcttctaccctacggagatcacactg

SEQ ID NO: 382509 - DNA, 29 bp, Artificial Sequence
  Description of Artificial Sequence: Synthetic oligonucleotide
ggcttctaccctacggagatcacactgac

SEQ ID NO: 382510 - DNA, 29 bp, Artificial Sequence
  Description of Artificial Sequence: Synthetic oligonucleotide
gcttctaccctacggagatcacactgacc

SEQ ID NO: 382511 - DNA, 30 bp, Artificial Sequence; identical to SEQ ID NO: 42407
  Description of Artificial Sequence: Synthetic oligonucleotide

SEQ ID NO: 382512 - DNA, 30 bp, Artificial Sequence; identical to SEQ ID NO: 42408
  Description of Artificial Sequence: Synthetic oligonucleotide

SEQ ID NO: 382513 - DNA, 29 bp, Artificial Sequence
  Description of Artificial Sequence: Synthetic oligonucleotide
tctaccctacggagatcacactgacctgg

SEQ ID NO: 382514 - DNA, 28 bp, Artificial Sequence
  Description of Artificial Sequence: Synthetic oligonucleotide
ctaccctacggagatcacactgacctgg

SEQ ID NO: 382515 - DNA, 28 bp, Artificial Sequence
  Description of Artificial Sequence: Synthetic oligonucleotide
taccctacggagatcacactgacctggc

SEQ ID NO: 382516 - DNA, 27 bp, Artificial Sequence
  Description of Artificial Sequence: Synthetic oligonucleotide
accctacggagatcacactgacctggc

SEQ ID NO: 382517 - DNA, 27 bp, Artificial Sequence
  Description of Artificial Sequence: Synthetic oligonucleotide
ccctacggagatcacactgacctggca

SEQ ID NO: 382518 - DNA, 27 bp, Artificial Sequence
  Description of Artificial Sequence: Synthetic oligonucleotide
cctacggagatcacactgacctggcag

SEQ ID NO: 382519 - DNA, 27 bp, Artificial Sequence
  Description of Artificial Sequence: Synthetic oligonucleotide
ctacggagatcacactgacctggcagc

SEQ ID NO: 382520 - DNA, 27 bp, Artificial Sequence
  Description of Artificial Sequence: Synthetic oligonucleotide
tacggagatcacactgacctggcagcg

SEQ ID NO: 382521 - DNA, 26 bp, Artificial Sequence
  Description of Artificial Sequence: Synthetic oligonucleotide
acggagatcacactgacctggcagcg

SEQ ID NO: 382522 - DNA, 20 bp, Artificial Sequence
  Description of Artificial Sequence: Synthetic oligonucleotide
tcccaggtcccgggcggggt

SEQ ID NO: 382523 - DNA, 20 bp, Artificial Sequence
  Description of Artificial Sequence: Synthetic oligonucleotide
ccaggtcccgggcggggctt

SEQ ID NO: 382524 - DNA, 20 bp, Artificial Sequence
  Description of Artificial Sequence: Synthetic oligonucleotide
caggtcccgggcggggctct

SEQ ID NO: 382525 - DNA, 21 bp, Artificial Sequence
  Description of Artificial Sequence: Synthetic oligonucleotide
aggtcccgggcggggctctca

SEQ ID NO: 382526 - DNA, 20 bp, Artificial Sequence
  Description of Artificial Sequence: Synthetic oligonucleotide
ggtcccgggcggggctctca

SEQ ID NO: 382527 - DNA, 20 bp, Artificial Sequence
  Description of Artificial Sequence: Synthetic oligonucleotide
gtcccgggcggggctctcag

SEQ ID NO: 382528 - DNA, 20 bp, Artificial Sequence
  Description of Artificial Sequence: Synthetic oligonucleotide
tcccgggcggggctctcagg

SEQ ID NO: 382529 - DNA, 25 bp, Artificial Sequence
  Description of Artificial Sequence: Synthetic oligonucleotide
gggctctcagggtctcaggctccaa

SEQ ID NO: 382530 - DNA, 25 bp, Artificial Sequence
  Description of Artificial Sequence: Synthetic oligonucleotide
ggctctcagggtctcaggctccaag

SEQ ID NO: 382531 - DNA, 25 bp, Artificial Sequence
  Description of Artificial Sequence: Synthetic oligonucleotide
gctctcagggtctcaggctccaagg

SEQ ID NO: 382532 - DNA, 25 bp, Artificial Sequence
  Description of Artificial Sequence: Synthetic oligonucleotide
ctctcagggtctcaggctccaaggg

SEQ ID NO: 382533 - DNA, 31 bp, Artificial Sequence
  Description of Artificial Sequence: Synthetic oligonucleotide
ctgagtttcacttcttctcccaacctgcgac

SEQ ID NO: 382534 - DNA, 31 bp, Artificial Sequence
  Description of Artificial Sequence: Synthetic oligonucleotide
tgagtttcacttcttctcccaacctgcgacg

SEQ ID NO: 382535 - DNA, 30 bp, Artificial Sequence
  Description of Artificial Sequence: Synthetic oligonucleotide
gagtttcacttcttctcccaacctgcgacg

SEQ ID NO: 382536 - DNA, 30 bp, Artificial Sequence
  Description of Artificial Sequence: Synthetic oligonucleotide
agtttcacttcttctcccaacctgcgacgg

SEQ ID NO: 382537 - DNA, 29 bp, Artificial Sequence
  Description of Artificial Sequence: Synthetic oligonucleotide
gtttcacttcttctcccaacctgcgacgg

SEQ ID NO: 382538 - DNA, 29 bp, Artificial Sequence
  Description of Artificial Sequence: Synthetic oligonucleotide
tttcacttcttctcccaacctgcgacggg

SEQ ID NO: 382539 - DNA, 28 bp, Artificial Sequence
  Description of Artificial Sequence: Synthetic oligonucleotide
ttcacttcttctcccaacctgcgacggg

SEQ ID NO: 382540 - DNA, 27 bp, Artificial Sequence
  Description of Artificial Sequence: Synthetic oligonucleotide
tcacttcttctcccaacctgcgacggg

SEQ ID NO: 382541 - DNA, 27 bp, Artificial Sequence
  Description of Artificial Sequence: Synthetic oligonucleotide
cacttcttctcccaacctgcgacgggt

SEQ ID NO: 382542 - DNA, 27 bp, Artificial Sequence
  Description of Artificial Sequence: Synthetic oligonucleotide
acttcttctcccaacctgcgacgggtc

SEQ ID NO: 382543 - DNA, 26 bp, Artificial Sequence
  Description of Artificial Sequence: Synthetic oligonucleotide
cttcttctcccaacctgcgacgggtc

SEQ ID NO: 382544 - DNA, 27 bp, Artificial Sequence
  Description of Artificial Sequence: Synthetic oligonucleotide
ttcttctcccaacctgcgacgggtcct

SEQ ID NO: 382545 - DNA, 27 bp, Artificial Sequence
  Description of Artificial Sequence: Synthetic oligonucleotide
tcttctcccaacctgcgacgggtcctt

SEQ ID NO: 382546 - DNA, 26 bp, Artificial Sequence
  Description of Artificial Sequence: Synthetic oligonucleotide
cttctcccaacctgcgacgggtcctt

SEQ ID NO: 382547 - DNA, 27 bp, Artificial Sequence
  Description of Artificial Sequence: Synthetic oligonucleotide
ttctcccaacctgcgacgggtccttct

SEQ ID NO: 382548 - DNA, 27 bp, Artificial Sequence
  Description of Artificial Sequence: Synthetic oligonucleotide
tctcccaacctgcgacgggtccttctt

SEQ ID NO: 382549 - DNA, 26 bp, Artificial Sequence
  Description of Artificial Sequence: Synthetic oligonucleotide
ctcccaacctgcgacgggtccttctt

SEQ ID NO: 382550 - DNA, 26 bp, Artificial Sequence
  Description of Artificial Sequence: Synthetic oligonucleotide
tcccaacctgcgacgggtccttcttc

SEQ ID NO: 382551 - DNA, 25 bp, Artificial Sequence
  Description of Artificial Sequence: Synthetic oligonucleotide
cccaacctgcgacgggtccttcttc

SEQ ID NO: 382552 - DNA, 26 bp, Artificial Sequence
  Description of Artificial Sequence: Synthetic oligonucleotide
ccaacctgcgacgggtccttcttcct

SEQ ID NO: 382553 - DNA, 27 bp, Artificial Sequence
  Description of Artificial Sequence: Synthetic oligonucleotide
caacctgcgacgggtccttcttcctga

SEQ ID NO: 382554 - DNA, 30 bp, Artificial Sequence
  Description of Artificial Sequence: Synthetic oligonucleotide
aacctgcgacgggtccttcttcctgaatac

SEQ ID NO: 382555 - DNA, 29 bp, Artificial Sequence
  Description of Artificial Sequence: Synthetic oligonucleotide
acctgcgacgggtccttcttcctgaatac

SEQ ID NO: 382556 - DNA, 28 bp, Artificial Sequence
  Description of Artificial Sequence: Synthetic oligonucleotide
cctgcgacgggtccttcttcctgaatac

SEQ ID NO: 382557 - DNA, 29 bp, Artificial Sequence
  Description of Artificial Sequence: Synthetic oligonucleotide
ctgcgacgggtccttcttcctgaatactc

SEQ ID NO: 382558 - DNA, 31 bp, Artificial Sequence
  Description of Artificial Sequence: Synthetic oligonucleotide
tgcgacgggtccttcttcctgaatactcatg

SEQ ID NO: 382559 - DNA, 30 bp, Artificial Sequence
  Description of Artificial Sequence: Synthetic oligonucleotide
gcgacgggtccttcttcctgaatactcatg

SEQ ID NO: 382560 - DNA, 31 bp, Artificial Sequence
  Description of Artificial Sequence: Synthetic oligonucleotide
cgacgggtccttcttcctgaatactcatgac

SEQ ID NO: 382561 - DNA, 31 bp, Artificial Sequence
  Description of Artificial Sequence: Synthetic oligonucleotide
gacgggtccttcttcctgaatactcatgacg

SEQ ID NO: 382562 - DNA, 31 bp, Artificial Sequence
  Description of Artificial Sequence: Synthetic oligonucleotide
acgggtccttcttcctgaatactcatgacgc

SEQ ID NO: 382563 - DNA, 23 bp, Artificial Sequence
  Description of Artificial Sequence: Synthetic oligonucleotide
tccccagtcacccacccggactc

SEQ ID NO: 382564 - DNA, 22 bp, Artificial Sequence
  Description of Artificial Sequence: Synthetic oligonucleotide
ccccagtcacccacccggactc

SEQ ID NO: 382565 - DNA, 22 bp, Artificial Sequence
  Description of Artificial Sequence: Synthetic oligonucleotide
cccagtcacccacccggactcg

SEQ ID NO: 382566 - DNA, 25 bp, Artificial Sequence
  Description of Artificial Sequence: Synthetic oligonucleotide
ccagtcacccacccggactcggatt

SEQ ID NO: 382567 - DNA, 26 bp, Artificial Sequence
  Description of Artificial Sequence: Synthetic oligonucleotide
cagtcacccacccggactcggattct

SEQ ID NO: 382568 - DNA, 26 bp, Artificial Sequence
  Description of Artificial Sequence: Synthetic oligonucleotide
agtcacccacccggactcggattctc

SEQ ID NO: 382569 - DNA, 25 bp, Artificial Sequence
  Description of Artificial Sequence: Synthetic oligonucleotide
gtcacccacccggactcggattctc

SEQ ID NO: 382570 - DNA, 25 bp, Artificial Sequence
  Description of Artificial Sequence: Synthetic oligonucleotide
tcacccacccggactcggattctcc

SEQ ID NO: 382571 - DNA, 24 bp, Artificial Sequence
  Description of Artificial Sequence: Synthetic oligonucleotide
cacccacccggactcggattctcc

SEQ ID NO: 382572 - DNA, 24 bp, Artificial Sequence
  Description of Artificial Sequence: Synthetic oligonucleotide
acccacccggactcggattctccc

SEQ ID NO: 382573 - DNA, 23 bp, Artificial Sequence
  Description of Artificial Sequence: Synthetic oligonucleotide
cccacccggactcggattctccc

SEQ ID NO: 382574 - DNA, 24 bp, Artificial Sequence
  Description of Artificial Sequence: Synthetic oligonucleotide
ccacccggactcggattctcccca

SEQ ID NO: 382575 - DNA, 25 bp, Artificial Sequence
  Description of Artificial Sequence: Synthetic oligonucleotide
cacccggactcggattctccccaga

SEQ ID NO: 382576 - DNA, 25 bp, Artificial Sequence
  Description of Artificial Sequence: Synthetic oligonucleotide
acccggactcggattctccccagac

SEQ ID NO: 382577 - DNA, 24 bp, Artificial Sequence
  Description of Artificial Sequence: Synthetic oligonucleotide
cccggactcggattctccccagac

SEQ ID NO: 382578 - DNA, 24 bp, Artificial Sequence
  Description of Artificial Sequence: Synthetic oligonucleotide
ccggactcggattctccccagacg

SEQ ID NO: 382579 - DNA, 24 bp, Artificial Sequence
  Description of Artificial Sequence: Synthetic oligonucleotide
cggactcggattctccccagacgc

SEQ ID NO: 382580 - DNA, 24 bp, Artificial Sequence
  Description of Artificial Sequence: Synthetic oligonucleotide
ggactcggattctccccagacgcc

SEQ ID NO: 382581 - DNA, 25 bp, Artificial Sequence
  Description of Artificial Sequence: Synthetic oligonucleotide
gactcggattctccccagacgccga

SEQ ID NO: 382582 - DNA, 27 bp, Artificial Sequence
  Description of Artificial Sequence: Synthetic oligonucleotide
actcggattctccccagacgccgagat

SEQ ID NO: 382583 - DNA, 26 bp, Artificial Sequence
  Description of Artificial Sequence: Synthetic oligonucleotide
ctcggattctccccagacgccgagat

SEQ ID NO: 382584 - DNA, 26 bp, Artificial Sequence
  Description of Artificial Sequence: Synthetic oligonucleotide
tcggattctccccagacgccgagatg

SEQ ID NO: 382585 - DNA, 25 bp, Artificial Sequence
  Description of Artificial Sequence: Synthetic oligonucleotide
cggattctccccagacgccgagatg

SEQ ID NO: 382586 - DNA, 25 bp, Artificial Sequence
  Description of Artificial Sequence: Synthetic oligonucleotide
ggattctccccagacgccgagatgc

SEQ ID NO: 382587 - DNA, 29 bp, Artificial Sequence
  Description of Artificial Sequence: Synthetic oligonucleotide
agactgaccgagtgaacctgcggaaactg

SEQ ID NO: 382588 - DNA, 28 bp, Artificial Sequence
  Description of Artificial Sequence: Synthetic oligonucleotide
gactgaccgagtgaacctgcggaaactg

SEQ ID NO: 382589 - DNA, 28 bp, Artificial Sequence
  Description of Artificial Sequence: Synthetic oligonucleotide
actgaccgagtgaacctgcggaaactgc

SEQ ID NO: 382590 - DNA, 27 bp, Artificial Sequence
  Description of Artificial Sequence: Synthetic oligonucleotide
ctgaccgagtgaacctgcggaaactgc

SEQ ID NO: 382591 - DNA, 27 bp, Artificial Sequence
  Description of Artificial Sequence: Synthetic oligonucleotide
tgaccgagtgaacctgcggaaactgcg

SEQ ID NO: 382592 - DNA, 26 bp, Artificial Sequence
  Description of Artificial Sequence: Synthetic oligonucleotide
gaccgagtgaacctgcggaaactgcg

SEQ ID NO: 382593 - DNA, 26 bp, Artificial Sequence
  Description of Artificial Sequence: Synthetic oligonucleotide
accgagtgaacctgcggaaactgcgc

SEQ ID NO: 382594 - DNA, 25 bp, Artificial Sequence
  Description of Artificial Sequence: Synthetic oligonucleotide
ccgagtgaacctgcggaaactgcgc

SEQ ID NO: 382595 - DNA, 25 bp, Artificial Sequence
  Description of Artificial Sequence: Synthetic oligonucleotide
cgagtgaacctgcggaaactgcgcg

SEQ ID NO: 382596 - DNA, 25 bp, Artificial Sequence
  Description of Artificial Sequence: Synthetic oligonucleotide
gagtgaacctgcggaaactgcgcgg

SEQ ID NO: 382597 - DNA, 27 bp, Artificial Sequence
  Description of Artificial Sequence: Synthetic oligonucleotide
agtgaacctgcggaaactgcgcggcta

SEQ ID NO: 382598 - DNA, 26 bp, Artificial Sequence
  Description of Artificial Sequence: Synthetic oligonucleotide
gtgaacctgcggaaactgcgcggcta

SEQ ID NO: 382599 - DNA, 27 bp, Artificial Sequence
  Description of Artificial Sequence: Synthetic oligonucleotide
tgaacctgcggaaactgcgcggctact

SEQ ID NO: 382600 - DNA, 27 bp, Artificial Sequence
  Description of Artificial Sequence: Synthetic oligonucleotide
gaacctgcggaaactgcgcggctacta

SEQ ID NO: 382601 - DNA, 27 bp, Artificial Sequence
  Description of Artificial Sequence: Synthetic oligonucleotide
aacctgcggaaactgcgcggctactac

SEQ ID NO: 382602 - DNA, 27 bp, Artificial Sequence
  Description of Artificial Sequence: Synthetic oligonucleotide
acctgcggaaactgcgcggctactaca

SEQ ID NO: 382603 - DNA, 27 bp, Artificial Sequence
  Description of Artificial Sequence: Synthetic oligonucleotide
cctgcggaaactgcgcggctactacaa

SEQ ID NO: 382604 - DNA, 27 bp, Artificial Sequence
  Description of Artificial Sequence: Synthetic oligonucleotide
ctgcggaaactgcgcggctactacaac

SEQ ID NO: 382605 - DNA, 27 bp, Artificial Sequence
  Description of Artificial Sequence: Synthetic oligonucleotide
tgcggaaactgcgcggctactacaacc

SEQ ID NO: 382606 - DNA, 27 bp, Artificial Sequence
  Description of Artificial Sequence: Synthetic oligonucleotide
gcggaaactgcgcggctactacaacca

SEQ ID NO: 382607 - DNA, 27 bp, Artificial Sequence
  Description of Artificial Sequence: Synthetic oligonucleotide
cggaaactgcgcggctactacaaccag

SEQ ID NO: 382608 - DNA, 28 bp, Artificial Sequence
  Description of Artificial Sequence: Synthetic oligonucleotide
ggaaactgcgcggctactacaaccagag

SEQ ID NO: 382609 - DNA, 28 bp, Artificial Sequence
  Description of Artificial Sequence: Synthetic oligonucleotide
gaaactgcgcggctactacaaccagagc

SEQ ID NO: 382610 - DNA, 28 bp, Artificial Sequence
  Description of Artificial Sequence: Synthetic oligonucleotide
aaactgcgcggctactacaaccagagcg

SEQ ID NO: 382611 - DNA, 27 bp, Artificial Sequence
  Description of Artificial Sequence: Synthetic oligonucleotide
aactgcgcggctactacaaccagagcg

SEQ ID NO: 382612 - DNA, 27 bp, Artificial Sequence
  Description of Artificial Sequence: Synthetic oligonucleotide
actgcgcggctactacaaccagagcga

SEQ ID NO: 382613 - DNA, 25 bp, Artificial Sequence
  Description of Artificial Sequence: Synthetic oligonucleotide
cctcctccgcgggtatgaccagtct

SEQ ID NO: 382614 - DNA, 25 bp, Artificial Sequence
  Description of Artificial Sequence: Synthetic oligonucleotide
ctcctccgcgggtatgaccagtctg

SEQ ID NO: 382615 - DNA, 25 bp, Artificial Sequence
  Description of Artificial Sequence: Synthetic oligonucleotide
tcctccgcgggtatgaccagtctgc

SEQ ID NO: 382616 - DNA, 24 bp, Artificial Sequence
  Description of Artificial Sequence: Synthetic oligonucleotide
cctccgcgggtatgaccagtctgc

SEQ ID NO: 382617 - DNA, 26 bp, Artificial Sequence
  Description of Artificial Sequence: Synthetic oligonucleotide
ctccgcgggtatgaccagtctgccta

SEQ ID NO: 382618 - DNA, 26 bp, Artificial Sequence
  Description of Artificial Sequence: Synthetic oligonucleotide
tccgcgggtatgaccagtctgcctac

SEQ ID NO: 382619 - DNA, 25 bp, Artificial Sequence
  Description of Artificial Sequence: Synthetic oligonucleotide
ccgcgggtatgaccagtctgcctac

SEQ ID NO: 382620 - DNA, 26 bp, Artificial Sequence
  Description of Artificial Sequence: Synthetic oligonucleotide
cgcgggtatgaccagtctgcctacga

SEQ ID NO: 382621 - DNA, 26 bp, Artificial Sequence
  Description of Artificial Sequence: Synthetic oligonucleotide
gcgggtatgaccagtctgcctacgac

SEQ ID NO: 382622 - DNA, 26 bp, Artificial Sequence
  Description of Artificial Sequence: Synthetic oligonucleotide
cgggtatgaccagtctgcctacgacg

SEQ ID NO: 382623 - DNA, 26 bp, Artificial Sequence
  Description of Artificial Sequence: Synthetic oligonucleotide
gggtatgaccagtctgcctacgacgg

SEQ ID NO: 382624 - DNA, 27 bp, Artificial Sequence
  Description of Artificial Sequence: Synthetic oligonucleotide
ggtatgaccagtctgcctacgacggca

SEQ ID NO: 382625 - DNA, 28 bp, Artificial Sequence
  Description of Artificial Sequence: Synthetic oligonucleotide
gtatgaccagtctgcctacgacggcaag

SEQ ID NO: 382626 - DNA, 28 bp, Artificial Sequence
  Description of Artificial Sequence: Synthetic oligonucleotide
tatgaccagtctgcctacgacggcaagg

SEQ ID NO: 382627 - DNA, 26 bp, Artificial Sequence
  Description of Artificial Sequence: Synthetic oligonucleotide
ggtggagcaggaggggccggaatatt

SEQ ID NO: 382628 - DNA, 26 bp, Artificial Sequence
  Description of Artificial Sequence: Synthetic oligonucleotide
gtggagcaggaggggccggaatattg

SEQ ID NO: 382629 - DNA, 26 bp, Artificial Sequence
  Description of Artificial Sequence: Synthetic oligonucleotide
tggagcaggaggggccggaatattgg

SEQ ID NO: 382630 - DNA, 25 bp, Artificial Sequence
  Description of Artificial Sequence: Synthetic oligonucleotide
ggagcaggaggggccggaatattgg

SEQ ID NO: 382631 - DNA, 29 bp, Artificial Sequence
  Description of Artificial Sequence: Synthetic oligonucleotide
cggaatattgggaccgggagacacagaag

SEQ ID NO: 382632 - DNA, 31 bp, Artificial Sequence; identical to SEQ ID NO: 42432
  Description of Artificial Sequence: Synthetic oligonucleotide

SEQ ID NO: 382633 - DNA, 33 bp, Artificial Sequence; identical to SEQ ID NO: 42433
  Description of Artificial Sequence: Synthetic oligonucleotide

SEQ ID NO: 382634 - DNA, 33 bp, Artificial Sequence; identical to SEQ ID NO: 42434
  Description of Artificial Sequence: Synthetic oligonucleotide

SEQ ID NO: 382635 - DNA, 32 bp, Artificial Sequence; identical to SEQ ID NO: 42435
  Description of Artificial Sequence: Synthetic oligonucleotide

SEQ ID NO: 382636 - DNA, 22 bp, Artificial Sequence
  Description of Artificial Sequence: Synthetic oligonucleotide
gacagcgacgccgcgagcccaa

SEQ ID NO: 382637 - DNA, 23 bp, Artificial Sequence
  Description of Artificial Sequence: Synthetic oligonucleotide
acagcgacgccgcgagcccaaga

SEQ ID NO: 382638 - DNA, 22 bp, Artificial Sequence
  Description of Artificial Sequence: Synthetic oligonucleotide
cagcgacgccgcgagcccaaga

SEQ ID NO: 382639 - DNA, 22 bp, Artificial Sequence
  Description of Artificial Sequence: Synthetic oligonucleotide
agcgacgccgcgagcccaagag

SEQ ID NO: 382640 - DNA, 21 bp, Artificial Sequence
  Description of Artificial Sequence: Synthetic oligonucleotide
gcgacgccgcgagcccaagag

SEQ ID NO: 382641 - DNA, 21 bp, Artificial Sequence
  Description of Artificial Sequence: Synthetic oligonucleotide
cgacgccgcgagcccaagagg

SEQ ID NO: 382642 - DNA, 21 bp, Artificial Sequence
  Description of Artificial Sequence: Synthetic oligonucleotide
gacgccgcgagcccaagaggg

SEQ ID NO: 382643 - DNA, 22 bp, Artificial Sequence
  Description of Artificial Sequence: Synthetic oligonucleotide
acgccgcgagcccaagagggga

SEQ ID NO: 382644 - DNA, 21 bp, Artificial Sequence
  Description of Artificial Sequence: Synthetic oligonucleotide
cgccgcgagcccaagagggga

SEQ ID NO: 382645 - DNA, 21 bp, Artificial Sequence
  Description of Artificial Sequence: Synthetic oligonucleotide
gccgcgagcccaagaggggag

SEQ ID NO: 382646 - DNA, 21 bp, Artificial Sequence
  Description of Artificial Sequence: Synthetic oligonucleotide
ccgcgagcccaagaggggagc

SEQ ID NO: 382647 - DNA, 21 bp, Artificial Sequence
  Description of Artificial Sequence: Synthetic oligonucleotide
cgcgagcccaagaggggagcc

SEQ ID NO: 382648 - DNA, 21 bp, Artificial Sequence
  Description of Artificial Sequence: Synthetic oligonucleotide
gcgagcccaagaggggagccg

SEQ ID NO: 382649 - DNA, 21 bp, Artificial Sequence
  Description of Artificial Sequence: Synthetic oligonucleotide
cgagcccaagaggggagccgc

SEQ ID NO: 382650 - DNA, 21 bp, Artificial Sequence
  Description of Artificial Sequence: Synthetic oligonucleotide
gagcccaagaggggagccgcg

SEQ ID NO: 382651 - DNA, 21 bp, Artificial Sequence
  Description of Artificial Sequence: Synthetic oligonucleotide
agcccaagaggggagccgcgg

SEQ ID NO: 382652 - DNA, 20 bp, Artificial Sequence
  Description of Artificial Sequence: Synthetic oligonucleotide
gcccaagaggggagccgcgg

SEQ ID NO: 382653 - DNA, 20 bp, Artificial Sequence
  Description of Artificial Sequence: Synthetic oligonucleotide
cccaagaggggagccgcggg

SEQ ID NO: 382654 - DNA, 27 bp, Artificial Sequence
  Description of Artificial Sequence: Synthetic oligonucleotide
tctccagaggatgtacggctgcgacct

SEQ ID NO: 382655 - DNA, 26 bp, Artificial Sequence
  Description of Artificial Sequence: Synthetic oligonucleotide
agaggatgtacggctgcgacctgggt

SEQ ID NO: 382656 - DNA, 25 bp, Artificial Sequence
  Description of Artificial Sequence: Synthetic oligonucleotide
gaggatgtacggctgcgacctgggt

SEQ ID NO: 382657 - DNA, 25 bp, Artificial Sequence
  Description of Artificial Sequence: Synthetic oligonucleotide
aggatgtacggctgcgacctgggtc

SEQ ID NO: 382658 - DNA, 24 bp, Artificial Sequence
  Description of Artificial Sequence: Synthetic oligonucleotide
ggatgtacggctgcgacctgggtc

SEQ ID NO: 382659 - DNA, 24 bp, Artificial Sequence
  Description of Artificial Sequence: Synthetic oligonucleotide
gatgtacggctgcgacctgggtcc

SEQ ID NO: 382660 - DNA, 24 bp, Artificial Sequence
  Description of Artificial Sequence: Synthetic oligonucleotide
atgtacggctgcgacctgggtccc

SEQ ID NO: 382661 - DNA, 23 bp, Artificial Sequence
  Description of Artificial Sequence: Synthetic oligonucleotide
tgtacggctgcgacctgggtccc

SEQ ID NO: 382662 - DNA, 22 bp, Artificial Sequence
  Description of Artificial Sequence: Synthetic oligonucleotide
gtacggctgcgacctgggtccc

SEQ ID NO: 382663 - DNA, 23 bp, Artificial Sequence
  Description of Artificial Sequence: Synthetic oligonucleotide
tacggctgcgacctgggtcccga

SEQ ID NO: 382664 - DNA, 22 bp, Artificial Sequence
  Description of Artificial Sequence: Synthetic oligonucleotide
acggctgcgacctgggtcccga

SEQ ID NO: 382665 - DNA, 21 bp, Artificial Sequence
  Description of Artificial Sequence: Synthetic oligonucleotide
cggctgcgacctgggtcccga

SEQ ID NO: 382666 - DNA, 27 bp, Artificial Sequence
  Description of Artificial Sequence: Synthetic oligonucleotide
gccaggcacagactgaccgagtgaact

SEQ ID NO: 382667 - DNA, 28 bp, Artificial Sequence
  Description of Artificial Sequence: Synthetic oligonucleotide
ccaggcacagactgaccgagtgaacttg

SEQ ID NO: 382668 - DNA, 28 bp, Artificial Sequence
  Description of Artificial Sequence: Synthetic oligonucleotide
caggcacagactgaccgagtgaacttgc

SEQ ID NO: 382669 - DNA, 28 bp, Artificial Sequence
  Description of Artificial Sequence: Synthetic oligonucleotide
aggcacagactgaccgagtgaacttgcg

SEQ ID NO: 382670 - DNA, 27 bp, Artificial Sequence
  Description of Artificial Sequence: Synthetic oligonucleotide
ggcacagactgaccgagtgaacttgcg

SEQ ID NO: 382671 - DNA, 27 bp, Artificial Sequence
  Description of Artificial Sequence: Synthetic oligonucleotide
gcacagactgaccgagtgaacttgcgg

SEQ ID NO: 382672 - DNA, 30 bp, Artificial Sequence; identical to SEQ ID NO: 42472
  Description of Artificial Sequence: Synthetic oligonucleotide

SEQ ID NO: 382673 - DNA, 31 bp, Artificial Sequence; identical to SEQ ID NO: 42473
  Description of Artificial Sequence: Synthetic oligonucleotide

SEQ ID NO: 382674 - DNA, 30 bp, Artificial Sequence; identical to SEQ ID NO: 42474
  Description of Artificial Sequence: Synthetic oligonucleotide

SEQ ID NO: 382675 - DNA, 30 bp, Artificial Sequence; identical to SEQ ID NO: 42475
  Description of Artificial Sequence: Synthetic oligonucleotide

SEQ ID NO: 382676 - DNA, 29 bp, Artificial Sequence
  Description of Artificial Sequence: Synthetic oligonucleotide
gactgaccgagtgaacttgcggaaactgc

SEQ ID NO: 382677 - DNA, 29 bp, Artificial Sequence
  Description of Artificial Sequence: Synthetic oligonucleotide
actgaccgagtgaacttgcggaaactgcg

SEQ ID NO: 382678 - DNA, 28 bp, Artificial Sequence
  Description of Artificial Sequence: Synthetic oligonucleotide
ctgaccgagtgaacttgcggaaactgcg

SEQ ID NO: 382679 - DNA, 28 bp, Artificial Sequence
  Description of Artificial Sequence: Synthetic oligonucleotide
tgaccgagtgaacttgcggaaactgcgc

SEQ ID NO: 382680 - DNA, 27 bp, Artificial Sequence
  Description of Artificial Sequence: Synthetic oligonucleotide
gaccgagtgaacttgcggaaactgcgc

SEQ ID NO: 382681 - DNA, 27 bp, Artificial Sequence
  Description of Artificial Sequence: Synthetic oligonucleotide
accgagtgaacttgcggaaactgcgcg

SEQ ID NO: 382682 - DNA, 26 bp, Artificial Sequence
  Description of Artificial Sequence: Synthetic oligonucleotide
ccgagtgaacttgcggaaactgcgcg

SEQ ID NO: 382683 - DNA, 26 bp, Artificial Sequence
  Description of Artificial Sequence: Synthetic oligonucleotide
cgagtgaacttgcggaaactgcgcgg

SEQ ID NO: 382684 - DNA, 27 bp, Artificial Sequence
  Description of Artificial Sequence: Synthetic oligonucleotide
gagtgaacttgcggaaactgcgcggct

SEQ ID NO: 382685 - DNA, 28 bp, Artificial Sequence
  Description of Artificial Sequence: Synthetic oligonucleotide
agtgaacttgcggaaactgcgcggctac

SEQ ID NO: 382686 - DNA, 27 bp, Artificial Sequence
  Description of Artificial Sequence: Synthetic oligonucleotide
gtgaacttgcggaaactgcgcggctac

SEQ ID NO: 382687 - DNA, 29 bp, Artificial Sequence
  Description of Artificial Sequence: Synthetic oligonucleotide
tgaacttgcggaaactgcgcggctactac

SEQ ID NO: 382688 - DNA, 28 bp, Artificial Sequence
  Description of Artificial Sequence: Synthetic oligonucleotide
gaacttgcggaaactgcgcggctactac

SEQ ID NO: 382689 - DNA, 30 bp, Artificial Sequence; identical to SEQ ID NO: 42489
  Description of Artificial Sequence: Synthetic oligonucleotide

SEQ ID NO: 382690 - DNA, 29 bp, Artificial Sequence
  Description of Artificial Sequence: Synthetic oligonucleotide
acttgcggaaactgcgcggctactacaac

SEQ ID NO: 382691 - DNA, 28 bp, Artificial Sequence
  Description of Artificial Sequence: Synthetic oligonucleotide
cttgcggaaactgcgcggctactacaac

SEQ ID NO: 382692 - DNA, 28 bp, Artificial Sequence
  Description of Artificial Sequence: Synthetic oligonucleotide
ttgcggaaactgcgcggctactacaacc

SEQ ID NO: 382693 - DNA, 21 bp, Artificial Sequence
  Description of Artificial Sequence: Synthetic oligonucleotide
gcgagtccgagaggggagccc

SEQ ID NO: 382694 - DNA, 21 bp, Artificial Sequence
  Description of Artificial Sequence: Synthetic oligonucleotide
cgagtccgagaggggagcccc

SEQ ID NO: 382695 - DNA, 21 bp, Artificial Sequence
  Description of Artificial Sequence: Synthetic oligonucleotide
gagtccgagaggggagccccg

SEQ ID NO: 382696 - DNA, 21 bp, Artificial Sequence
  Description of Artificial Sequence: Synthetic oligonucleotide
agtccgagaggggagccccgg

SEQ ID NO: 382697 - DNA, 20 bp, Artificial Sequence
  Description of Artificial Sequence: Synthetic oligonucleotide
gtccgagaggggagccccgg

SEQ ID NO: 382698 - DNA, 20 bp, Artificial Sequence
  Description of Artificial Sequence: Synthetic oligonucleotide
tccgagaggggagccccggg

SEQ ID NO: 382699 - DNA, 20 bp, Artificial Sequence
  Description of Artificial Sequence: Synthetic oligonucleotide
ccgagaggggagccccgggt

SEQ ID NO: 382700 - DNA, 20 bp, Artificial Sequence
  Description of Artificial Sequence: Synthetic oligonucleotide
cgagaggggagccccgggct

SEQ ID NO: 382701 - DNA, 20 bp, Artificial Sequence
  Description of Artificial Sequence: Synthetic oligonucleotide
gagaggggagccccgggcgt

SEQ ID NO: 382702 - DNA, 20 bp, Artificial Sequence
  Description of Artificial Sequence: Synthetic oligonucleotide
agaggggagccccgggcgct

SEQ ID NO: 382703 - DNA, 20 bp, Artificial Sequence
  Description of Artificial Sequence: Synthetic oligonucleotide
gaggggagccccgggcgctt

SEQ ID NO: 382704 - DNA, 20 bp, Artificial Sequence
  Description of Artificial Sequence: Synthetic oligonucleotide
aggggagccccgggcgcctt

SEQ ID NO: 382705 - DNA, 20 bp, Artificial Sequence
  Description of Artificial Sequence: Synthetic oligonucleotide
ggggagccccgggcgccttt

SEQ ID NO: 382706 - DNA, 20 bp, Artificial Sequence
  Description of Artificial Sequence: Synthetic oligonucleotide
gggagccccgggcgccgttt

SEQ ID NO: 382707 - DNA, 20 bp, Artificial Sequence
  Description of Artificial Sequence: Synthetic oligonucleotide
gagccccgggcgccgtggtt

SEQ ID NO: 382708 - DNA, 20 bp, Artificial Sequence
  Description of Artificial Sequence: Synthetic oligonucleotide
agccccgggcgccgtgggtt

SEQ ID NO: 382709 - DNA, 20 bp, Artificial Sequence
  Description of Artificial Sequence: Synthetic oligonucleotide
gccccgggcgccgtgggttt

SEQ ID NO: 382710 - DNA, 20 bp, Artificial Sequence
  Description of Artificial Sequence: Synthetic oligonucleotide
ccccgggcgccgtgggtgtt

SEQ ID NO: 382711 - DNA, 20 bp, Artificial Sequence
  Description of Artificial Sequence: Synthetic oligonucleotide
cccgggcgccgtgggtggat

SEQ ID NO: 382712 - DNA, 20 bp, Artificial Sequence
  Description of Artificial Sequence: Synthetic oligonucleotide
ccgggcgccgtgggtggagt

SEQ ID NO: 382713 - DNA, 21 bp, Artificial Sequence
  Description of Artificial Sequence: Synthetic oligonucleotide
cagcgcaagtgggaggcggcg

SEQ ID NO: 382714 - DNA, 21 bp, Artificial Sequence
  Description of Artificial Sequence: Synthetic oligonucleotide
agcgcaagtgggaggcggcgc

SEQ ID NO: 382715 - DNA, 20 bp, Artificial Sequence
  Description of Artificial Sequence: Synthetic oligonucleotide
gcgcaagtgggaggcggcgc

SEQ ID NO: 382716 - DNA, 21 bp, Artificial Sequence
  Description of Artificial Sequence: Synthetic oligonucleotide
cgcaagtgggaggcggcgcgt

SEQ ID NO: 382717 - DNA, 22 bp, Artificial Sequence
  Description of Artificial Sequence: Synthetic oligonucleotide
gcaagtgggaggcggcgcgtga

SEQ ID NO: 382718 - DNA, 22 bp, Artificial Sequence
  Description of Artificial Sequence: Synthetic oligonucleotide
caagtgggaggcggcgcgtgag

SEQ ID NO: 382719 - DNA, 22 bp, Artificial Sequence
  Description of Artificial Sequence: Synthetic oligonucleotide
aagtgggaggcggcgcgtgagg

SEQ ID NO: 382720 - DNA, 21 bp, Artificial Sequence
  Description of Artificial Sequence: Synthetic oligonucleotide
agtgggaggcggcgcgtgagg

SEQ ID NO: 382721 - DNA, 20 bp, Artificial Sequence
  Description of Artificial Sequence: Synthetic oligonucleotide
gtgggaggcggcgcgtgagg

SEQ ID NO: 382722 - DNA, 20 bp, Artificial Sequence
  Description of Artificial Sequence: Synthetic oligonucleotide
tgggaggcggcgcgtgaggc

SEQ ID NO: 382723 - DNA, 20 bp, Artificial Sequence
  Description of Artificial Sequence: Synthetic oligonucleotide
gggaggcggcgcgtgaggct

SEQ ID NO: 382724 - DNA, 20 bp, Artificial Sequence
  Description of Artificial Sequence: Synthetic oligonucleotide
ggaggcggcgcgtgaggcgt

SEQ ID NO: 382725 - DNA, 20 bp, Artificial Sequence
  Description of Artificial Sequence: Synthetic oligonucleotide
gaggcggcgcgtgaggcgga

SEQ ID NO: 382726 - DNA, 20 bp, Artificial Sequence
  Description of Artificial Sequence: Synthetic oligonucleotide
aggcggcgcgtgaggcggag

SEQ ID NO: 382727 - DNA, 20 bp, Artificial Sequence
  Description of Artificial Sequence: Synthetic oligonucleotide
ggcggcgcgtgaggcggagt

SEQ ID NO: 382728 - DNA, 20 bp, Artificial Sequence
  Description of Artificial Sequence: Synthetic oligonucleotide
gcggcgcgtgaggcggagca

SEQ ID NO: 382729 - DNA, 21 bp, Artificial Sequence
  Description of Artificial Sequence: Synthetic oligonucleotide
cggcgcgtgaggcggagcagt

SEQ ID NO: 382730 - DNA, 21 bp, Artificial Sequence
  Description of Artificial Sequence: Synthetic oligonucleotide
ggcgcgtgaggcggagcagtg

SEQ ID NO: 382731 - DNA, 22 bp, Artificial Sequence
  Description of Artificial Sequence: Synthetic oligonucleotide
gcgcgtgaggcggagcagtgga

SEQ ID NO: 382732 - DNA, 23 bp, Artificial Sequence
  Description of Artificial Sequence: Synthetic oligonucleotide
cgcgtgaggcggagcagtggaga

SEQ ID NO: 382733 - DNA, 23 bp, Artificial Sequence
  Description of Artificial Sequence: Synthetic oligonucleotide
gcgtgaggcggagcagtggagag

SEQ ID NO: 382734 - DNA, 24 bp, Artificial Sequence
  Description of Artificial Sequence: Synthetic oligonucleotide
cagagcccctcaccctgagatggg

SEQ ID NO: 382735 - DNA, 29 bp, Artificial Sequence
  Description of Artificial Sequence: Synthetic oligonucleotide
cagatacctggagaacgggaaggagacac

SEQ ID NO: 382736 - DNA, 30 bp, Artificial Sequence
  Description of Artificial Sequence: Synthetic oligonucleotide
agatacctggagaacgggaaggagacactg

SEQ ID NO: 382737 - DNA, 29 bp, Artificial Sequence
  Description of Artificial Sequence: Synthetic oligonucleotide
gatacctggagaacgggaaggagacactg

SEQ ID NO: 382738 - DNA, 29 bp, Artificial Sequence
  Description of Artificial Sequence: Synthetic oligonucleotide
atacctggagaacgggaaggagacactgc

SEQ ID NO: 382739 - DNA, 28 bp, Artificial Sequence
  Description of Artificial Sequence: Synthetic oligonucleotide
tacctggagaacgggaaggagacactgc

SEQ ID NO: 382740 - DNA, 27 bp, Artificial Sequence
  Description of Artificial Sequence: Synthetic oligonucleotide
acctggagaacgggaaggagacactgc

SEQ ID NO: 382741 - DNA, 27 bp, Artificial Sequence
  Description of Artificial Sequence: Synthetic oligonucleotide
cctggagaacgggaaggagacactgca

SEQ ID NO: 382742 - DNA, 27 bp, Artificial Sequence
  Description of Artificial Sequence: Synthetic oligonucleotide
ctggagaacgggaaggagacactgcag

SEQ ID NO: 382743 - DNA, 27 bp, Artificial Sequence
  Description of Artificial Sequence: Synthetic oligonucleotide
tggagaacgggaaggagacactgcagc

SEQ ID NO: 382744 - DNA, 26 bp, Artificial Sequence
  Description of Artificial Sequence: Synthetic oligonucleotide
ggagaacgggaaggagacactgcagc

SEQ ID NO: 382745 - DNA, 26 bp, Artificial Sequence
  Description of Artificial Sequence: Synthetic oligonucleotide
gagaacgggaaggagacactgcagcg

SEQ ID NO: 382746 - DNA, 26 bp, Artificial Sequence
  Description of Artificial Sequence: Synthetic oligonucleotide
agaacgggaaggagacactgcagcgc

SEQ ID NO: 382747 - DNA, 25 bp, Artificial Sequence
  Description of Artificial Sequence: Synthetic oligonucleotide
gaacgggaaggagacactgcagcgc

SEQ ID NO: 382748 - DNA, 25 bp, Artificial Sequence
  Description of Artificial Sequence: Synthetic oligonucleotide
aacgggaaggagacactgcagcgcg

SEQ ID NO: 382749 - DNA, 24 bp, Artificial Sequence
  Description of Artificial Sequence: Synthetic oligonucleotide
acgggaaggagacactgcagcgcg

SEQ ID NO: 382750 - DNA, 23 bp, Artificial Sequence
  Description of Artificial Sequence: Synthetic oligonucleotide
cgggaaggagacactgcagcgcg

SEQ ID NO: 382751 - DNA, 23 bp, Artificial Sequence
  Description of Artificial Sequence: Synthetic oligonucleotide
gggaaggagacactgcagcgcgc

SEQ ID NO: 382752 - DNA, 23 bp, Artificial Sequence
  Description of Artificial Sequence: Synthetic oligonucleotide
ggaaggagacactgcagcgcgcg

SEQ ID NO: 382753 - DNA, 23 bp, Artificial Sequence
  Description of Artificial Sequence: Synthetic oligonucleotide
gaaggagacactgcagcgcgcgg

SEQ ID NO: 382754 - DNA, 21 bp, Artificial Sequence
  Description of Artificial Sequence: Synthetic oligonucleotide
tgcgacctggggcccgacgga

SEQ ID NO: 382755 - DNA, 20 bp, Artificial Sequence
  Description of Artificial Sequence: Synthetic oligonucleotide
gcgacctggggcccgacgga

SEQ ID NO: 382756 - DNA, 20 bp, Artificial Sequence
  Description of Artificial Sequence: Synthetic oligonucleotide
cgacctggggcccgacggac

SEQ ID NO: 382757 - DNA, 20 bp, Artificial Sequence
  Description of Artificial Sequence: Synthetic oligonucleotide
gacctggggcccgacggacg

SEQ ID NO: 382758 - DNA, 20 bp, Artificial Sequence
  Description of Artificial Sequence: Synthetic oligonucleotide
acctggggcccgacggacgc

SEQ ID NO: 382759 - DNA, 20 bp, Artificial Sequence
  Description of Artificial Sequence: Synthetic oligonucleotide
cctggggcccgacggacgct

SEQ ID NO: 382760 - DNA, 20 bp, Artificial Sequence
  Description of Artificial Sequence: Synthetic oligonucleotide
ctggggcccgacggacgcct

SEQ ID NO: 382761 - DNA, 20 bp, Artificial Sequence
  Description of Artificial Sequence: Synthetic oligonucleotide
tggggcccgacggacgcctc

SEQ ID NO: 382762 - DNA, 20 bp, Artificial Sequence
  Description of Artificial Sequence: Synthetic oligonucleotide
ggggcccgacggacgcctct

SEQ ID NO: 382763 - DNA, 20 bp, Artificial Sequence
  Description of Artificial Sequence: Synthetic oligonucleotide
gggcccgacggacgcctcct

SEQ ID NO: 382764 - DNA, 20 bp, Artificial Sequence
  Description of Artificial Sequence: Synthetic oligonucleotide
ggcccgacggacgcctcctc

SEQ ID NO: 382765 - DNA, 20 bp, Artificial Sequence
  Description of Artificial Sequence: Synthetic oligonucleotide
gcccgacggacgcctcctcc

SEQ ID NO: 382766 - DNA, 20 bp, Artificial Sequence
  Description of Artificial Sequence: Synthetic oligonucleotide
cccgacggacgcctcctccg

SEQ ID NO: 382767 - DNA, 20 bp, Artificial Sequence
  Description of Artificial Sequence: Synthetic oligonucleotide
ccgacggacgcctcctccgc

SEQ ID NO: 382768 - DNA, 20 bp, Artificial Sequence
  Description of Artificial Sequence: Synthetic oligonucleotide
cgacggacgcctcctccgcg

SEQ ID NO: 382769 - DNA, 23 bp, Artificial Sequence
  Description of Artificial Sequence: Synthetic oligonucleotide
acggacgcctcctccgcgggtat

SEQ ID NO: 382770 - DNA, 22 bp, Artificial Sequence
  Description of Artificial Sequence: Synthetic oligonucleotide
cggacgcctcctccgcgggtat

SEQ ID NO: 382771 - DNA, 23 bp, Artificial Sequence
  Description of Artificial Sequence: Synthetic oligonucleotide
ggacgcctcctccgcgggtatga

SEQ ID NO: 382772 - DNA, 23 bp, Artificial Sequence
  Description of Artificial Sequence: Synthetic oligonucleotide
gacgcctcctccgcgggtatgac

SEQ ID NO: 382773 - DNA, 24 bp, Artificial Sequence
  Description of Artificial Sequence: Synthetic oligonucleotide
acgcctcctccgcgggtatgacca

SEQ ID NO: 382774 - DNA, 24 bp, Artificial Sequence
  Description of Artificial Sequence: Synthetic oligonucleotide
gacgccgcgagtccaagaggggaa

SEQ ID NO: 382775 - DNA, 24 bp, Artificial Sequence
  Description of Artificial Sequence: Synthetic oligonucleotide
acgccgcgagtccaagaggggaac

SEQ ID NO: 382776 - DNA, 23 bp, Artificial Sequence
  Description of Artificial Sequence: Synthetic oligonucleotide
cgccgcgagtccaagaggggaac

SEQ ID NO: 382777 - DNA, 23 bp, Artificial Sequence
  Description of Artificial Sequence: Synthetic oligonucleotide
gccgcgagtccaagaggggaacc

SEQ ID NO: 382778 - DNA, 23 bp, Artificial Sequence
  Description of Artificial Sequence: Synthetic oligonucleotide
ccgcgagtccaagaggggaaccg

SEQ ID NO: 382779 - DNA, 23 bp, Artificial Sequence
  Description of Artificial Sequence: Synthetic oligonucleotide
cgcgagtccaagaggggaaccgc

SEQ ID NO: 382780 - DNA, 23 bp, Artificial Sequence
  Description of Artificial Sequence: Synthetic oligonucleotide
gcgagtccaagaggggaaccgcg

SEQ ID NO: 382781 - DNA, 23 bp, Artificial Sequence
  Description of Artificial Sequence: Synthetic oligonucleotide
cgagtccaagaggggaaccgcgg

SEQ ID NO: 382782 - DNA, 23 bp, Artificial Sequence
  Description of Artificial Sequence: Synthetic oligonucleotide
gagtccaagaggggaaccgcggg

SEQ ID NO: 382783 - DNA, 23 bp, Artificial Sequence
  Description of Artificial Sequence: Synthetic oligonucleotide
agtccaagaggggaaccgcgggc

SEQ ID NO: 382784 - DNA, 22 bp, Artificial Sequence
  Description of Artificial Sequence: Synthetic oligonucleotide
gtccaagaggggaaccgcgggc

SEQ ID NO: 382785 - DNA, 22 bp, Artificial Sequence
  Description of Artificial Sequence: Synthetic oligonucleotide
tccaagaggggaaccgcgggcg

SEQ ID NO: 382786 - DNA, 21 bp, Artificial Sequence
  Description of Artificial Sequence: Synthetic oligonucleotide
ccaagaggggaaccgcgggcg

SEQ ID NO: 382787 - DNA, 21 bp, Artificial Sequence
  Description of Artificial Sequence: Synthetic oligonucleotide
caagaggggaaccgcgggcgc

SEQ ID NO: 382788 - DNA, 21 bp, Artificial Sequence
  Description of Artificial Sequence: Synthetic oligonucleotide
aagaggggaaccgcgggcgcc

SEQ ID NO: 382789 - DNA, 20 bp, Artificial Sequence
  Description of Artificial Sequence: Synthetic oligonucleotide
agaggggaaccgcgggcgcc

SEQ ID NO: 382790 - DNA, 20 bp, Artificial Sequence
  Description of Artificial Sequence: Synthetic oligonucleotide
gaggggaaccgcgggcgcct

SEQ ID NO: 382791 - DNA, 20 bp, Artificial Sequence
  Description of Artificial Sequence: Synthetic oligonucleotide
aggggaaccgcgggcgccgt

SEQ ID NO: 382792 - DNA, 20 bp, Artificial Sequence
  Description of Artificial Sequence: Synthetic oligonucleotide
ggggaaccgcgggcgccgtt

SEQ ID NO: 382793 - DNA, 20 bp, Artificial Sequence
  Description of Artificial Sequence: Synthetic oligonucleotide
gggaaccgcgggcgccgtgt

SEQ ID NO: 382794 - DNA, 20 bp, Artificial Sequence
  Description of Artificial Sequence: Synthetic oligonucleotide
ggaaccgcgggcgccgtggt

SEQ ID NO: 382795 - DNA, 20 bp, Artificial Sequence
  Description of Artificial Sequence: Synthetic oligonucleotide
gaaccgcgggcgccgtgggt

SEQ ID NO: 382796 - DNA, 20 bp, Artificial Sequence
  Description of Artificial Sequence: Synthetic oligonucleotide
aaccgcgggcgccgtgggtg

SEQ ID NO: 382797 - DNA, 20 bp, Artificial Sequence
  Description of Artificial Sequence: Synthetic oligonucleotide
accgcgggcgccgtgggtgt

SEQ ID NO: 382798 - DNA, 29 bp, Artificial Sequence
  Description of Artificial Sequence: Synthetic oligonucleotide
ccactccatgaggtatttcgacaccgctg

SEQ ID NO: 382799 - DNA, 30 bp, Artificial Sequence; identical to SEQ ID NO: 42579
  Description of Artificial Sequence: Synthetic oligonucleotide

SEQ ID NO: 382800 - DNA, 31 bp, Artificial Sequence; identical to SEQ ID NO: 42580
  Description of Artificial Sequence: Synthetic oligonucleotide

SEQ ID NO: 382801 - DNA, 30 bp, Artificial Sequence; identical to SEQ ID NO: 42581
  Description of Artificial Sequence: Synthetic oligonucleotide

SEQ ID NO: 382802 - DNA, 30 bp, Artificial Sequence; identical to SEQ ID NO: 42582
  Description of Artificial Sequence: Synthetic oligonucleotide

SEQ ID NO: 382803 - DNA, 29 bp, Artificial Sequence
  Description of Artificial Sequence: Synthetic oligonucleotide
ccatgaggtatttcgacaccgctgtgtcc

SEQ ID NO: 382804 - DNA, 29 bp, Artificial Sequence
  Description of Artificial Sequence: Synthetic oligonucleotide
catgaggtatttcgacaccgctgtgtccc

SEQ ID NO: 382805 - DNA, 29 bp, Artificial Sequence
  Description of Artificial Sequence: Synthetic oligonucleotide
atgaggtatttcgacaccgctgtgtcccg

SEQ ID NO: 382806 - DNA, 28 bp, Artificial Sequence
  Description of Artificial Sequence: Synthetic oligonucleotide
tgaggtatttcgacaccgctgtgtcccg

SEQ ID NO: 382807 - DNA, 27 bp, Artificial Sequence
  Description of Artificial Sequence: Synthetic oligonucleotide
gaggtatttcgacaccgctgtgtcccg

SEQ ID NO: 382808 - DNA, 27 bp, Artificial Sequence
  Description of Artificial Sequence: Synthetic oligonucleotide
aggtatttcgacaccgctgtgtcccgg

SEQ ID NO: 382809 - DNA, 26 bp, Artificial Sequence
  Description of Artificial Sequence: Synthetic oligonucleotide
ggtatttcgacaccgctgtgtcccgg

SEQ ID NO: 382810 - DNA, 26 bp, Artificial Sequence
  Description of Artificial Sequence: Synthetic oligonucleotide
gtatttcgacaccgctgtgtcccggc

SEQ ID NO: 382811 - DNA, 26 bp, Artificial Sequence
  Description of Artificial Sequence: Synthetic oligonucleotide
tatttcgacaccgctgtgtcccggcc

SEQ ID NO: 382812 - DNA, 25 bp, Artificial Sequence
  Description of Artificial Sequence: Synthetic oligonucleotide
atttcgacaccgctgtgtcccggcc

SEQ ID NO: 382813 - DNA, 24 bp, Artificial Sequence
  Description of Artificial Sequence: Synthetic oligonucleotide
tttcgacaccgctgtgtcccggcc

SEQ ID NO: 382814 - DNA, 23 bp, Artificial Sequence
  Description of Artificial Sequence: Synthetic oligonucleotide
ttcgacaccgctgtgtcccggcc

SEQ ID NO: 382815 - DNA, 22 bp, Artificial Sequence
  Description of Artificial Sequence: Synthetic oligonucleotide
tcgacaccgctgtgtcccggcc

SEQ ID NO: 382816 - DNA, 21 bp, Artificial Sequence
  Description of Artificial Sequence: Synthetic oligonucleotide
cgacaccgctgtgtcccggcc

SEQ ID NO: 382817 - DNA, 22 bp, Artificial Sequence
  Description of Artificial Sequence: Synthetic oligonucleotide
gacaccgctgtgtcccggccca

SEQ ID NO: 382818 - DNA, 21 bp, Artificial Sequence
  Description of Artificial Sequence: Synthetic oligonucleotide
gcaagtgggaggcggcccgtg

SEQ ID NO: 382819 - DNA, 21 bp, Artificial Sequence
  Description of Artificial Sequence: Synthetic oligonucleotide
caagtgggaggcggcccgtgc

SEQ ID NO: 382820 - DNA, 21 bp, Artificial Sequence
  Description of Artificial Sequence: Synthetic oligonucleotide
aagtgggaggcggcccgtgcg

SEQ ID NO: 382821 - DNA, 20 bp, Artificial Sequence
  Description of Artificial Sequence: Synthetic oligonucleotide
agtgggaggcggcccgtgcg

SEQ ID NO: 382822 - DNA, 20 bp, Artificial Sequence
  Description of Artificial Sequence: Synthetic oligonucleotide
gtgggaggcggcccgtgcgt

SEQ ID NO: 382823 - DNA, 20 bp, Artificial Sequence
  Description of Artificial Sequence: Synthetic oligonucleotide
tgggaggcggcccgtgcggt

SEQ ID NO: 382824 - DNA, 20 bp, Artificial Sequence
  Description of Artificial Sequence: Synthetic oligonucleotide
gggaggcggcccgtgcggtt

SEQ ID NO: 382825 - DNA, 20 bp, Artificial Sequence
  Description of Artificial Sequence: Synthetic oligonucleotide
ggaggcggcccgtgcggctt

SEQ ID NO: 382826 - DNA, 20 bp, Artificial Sequence
  Description of Artificial Sequence: Synthetic oligonucleotide
gaggcggcccgtgcggcgtt

SEQ ID NO: 382827 - DNA, 20 bp, Artificial Sequence
  Description of Artificial Sequence: Synthetic oligonucleotide
aggcggcccgtgcggcggat

SEQ ID NO: 382828 - DNA, 20 bp, Artificial Sequence
  Description of Artificial Sequence: Synthetic oligonucleotide
ggcggcccgtgcggcggatt

SEQ ID NO: 382829 - DNA, 20 bp, Artificial Sequence
  Description of Artificial Sequence: Synthetic oligonucleotide
gcggcccgtgcggcggagtt

SEQ ID NO: 382830 - DNA, 20 bp, Artificial Sequence
  Description of Artificial Sequence: Synthetic oligonucleotide
cggcccgtgcggcggagcat

SEQ ID NO: 382831 - DNA, 20 bp, Artificial Sequence
  Description of Artificial Sequence: Synthetic oligonucleotide
ggcccgtgcggcggagcagt

SEQ ID NO: 382832 - DNA, 20 bp, Artificial Sequence
  Description of Artificial Sequence: Synthetic oligonucleotide
gcccgtgcggcggagcagct

SEQ ID NO: 382833 - DNA, 21 bp, Artificial Sequence
  Description of Artificial Sequence: Synthetic oligonucleotide
cccgtgcggcggagcagctga

SEQ ID NO: 382834 - DNA, 22 bp, Artificial Sequence
  Description of Artificial Sequence: Synthetic oligonucleotide
ccgtgcggcggagcagctgaga

SEQ ID NO: 382835 - DNA, 22 bp, Artificial Sequence
  Description of Artificial Sequence: Synthetic oligonucleotide
cgtgcggcggagcagctgagag

SEQ ID NO: 382836 - DNA, 22 bp, Artificial Sequence
  Description of Artificial Sequence: Synthetic oligonucleotide
gtgcggcggagcagctgagagc

SEQ ID NO: 382837 - DNA, 24 bp, Artificial Sequence
  Description of Artificial Sequence: Synthetic oligonucleotide
tgcggcggagcagctgagagccta

SEQ ID NO: 382838 - DNA, 23 bp, Artificial Sequence
  Description of Artificial Sequence: Synthetic oligonucleotide
gcggcggagcagctgagagccta

SEQ ID NO: 382839 - DNA, 23 bp, Artificial Sequence
  Description of Artificial Sequence: Synthetic oligonucleotide
cggcggagcagctgagagcctac

SEQ ID NO: 382840 - DNA, 26 bp, Artificial Sequence
  Description of Artificial Sequence: Synthetic oligonucleotide
atttctacaccgctgtgtcccggccc

SEQ ID NO: 382841 - DNA, 25 bp, Artificial Sequence
  Description of Artificial Sequence: Synthetic oligonucleotide
tttctacaccgctgtgtcccggccc

SEQ ID NO: 382842 - DNA, 24 bp, Artificial Sequence
  Description of Artificial Sequence: Synthetic oligonucleotide
ttctacaccgctgtgtcccggccc

SEQ ID NO: 382843 - DNA, 23 bp, Artificial Sequence
  Description of Artificial Sequence: Synthetic oligonucleotide
tctacaccgctgtgtcccggccc

SEQ ID NO: 382844 - DNA, 22 bp, Artificial Sequence
  Description of Artificial Sequence: Synthetic oligonucleotide
ctacaccgctgtgtcccggccc

SEQ ID NO: 382845 - DNA, 22 bp, Artificial Sequence
  Description of Artificial Sequence: Synthetic oligonucleotide
tacaccgctgtgtcccggcccg

SEQ ID NO: 382846 - DNA, 21 bp, Artificial Sequence
  Description of Artificial Sequence: Synthetic oligonucleotide
acaccgctgtgtcccggcccg

SEQ ID NO: 382847 - DNA, 20 bp, Artificial Sequence
  Description of Artificial Sequence: Synthetic oligonucleotide
caccgctgtgtcccggcccg

SEQ ID NO: 382848 - DNA, 20 bp, Artificial Sequence
  Description of Artificial Sequence: Synthetic oligonucleotide
accgctgtgtcccggcccgg

SEQ ID NO: 382849 - DNA, 20 bp, Artificial Sequence
  Description of Artificial Sequence: Synthetic oligonucleotide
ccgctgtgtcccggcccggt

SEQ ID NO: 382850 - DNA, 20 bp, Artificial Sequence
  Description of Artificial Sequence: Synthetic oligonucleotide
cgctgtgtcccggcccggct

SEQ ID NO: 382851 - DNA, 20 bp, Artificial Sequence
  Description of Artificial Sequence: Synthetic oligonucleotide
gctgtgtcccggcccggcct

SEQ ID NO: 382852 - DNA, 20 bp, Artificial Sequence
  Description of Artificial Sequence: Synthetic oligonucleotide
cggccgcggggagccccatt

SEQ ID NO: 382853 - DNA, 20 bp, Artificial Sequence
  Description of Artificial Sequence: Synthetic oligonucleotide
ggccgcggggagccccactt

SEQ ID NO: 382854 - DNA, 22 bp, Artificial Sequence
  Description of Artificial Sequence: Synthetic oligonucleotide
gccgcggggagccccacttcat

SEQ ID NO: 382855 - DNA, 22 bp, Artificial Sequence
  Description of Artificial Sequence: Synthetic oligonucleotide
ccgcggggagccccacttcatc

SEQ ID NO: 382856 - DNA, 22 bp, Artificial Sequence
  Description of Artificial Sequence: Synthetic oligonucleotide
cgcggggagccccacttcatcg

SEQ ID NO: 382857 - DNA, 23 bp, Artificial Sequence
  Description of Artificial Sequence: Synthetic oligonucleotide
gcggggagccccacttcatcgca

SEQ ID NO: 382858 - DNA, 24 bp, Artificial Sequence
  Description of Artificial Sequence: Synthetic oligonucleotide
cggggagccccacttcatcgcagt

SEQ ID NO: 382859 - DNA, 24 bp, Artificial Sequence
  Description of Artificial Sequence: Synthetic oligonucleotide
ggggagccccacttcatcgcagtg

SEQ ID NO: 382860 - DNA, 24 bp, Artificial Sequence
  Description of Artificial Sequence: Synthetic oligonucleotide
gggagccccacttcatcgcagtgg

SEQ ID NO: 382861 - DNA, 24 bp, Artificial Sequence
  Description of Artificial Sequence: Synthetic oligonucleotide
ggagccccacttcatcgcagtggg

SEQ ID NO: 382862 - DNA, 24 bp, Artificial Sequence
  Description of Artificial Sequence: Synthetic oligonucleotide
cagagcgaggccgggtctcacatc

SEQ ID NO: 382863 - DNA, 25 bp, Artificial Sequence
  Description of Artificial Sequence: Synthetic oligonucleotide
agagcgaggccgggtctcacatcct

SEQ ID NO: 382864 - DNA, 24 bp, Artificial Sequence
  Description of Artificial Sequence: Synthetic oligonucleotide
gagcgaggccgggtctcacatcct

SEQ ID NO: 382865 - DNA, 24 bp, Artificial Sequence
  Description of Artificial Sequence: Synthetic oligonucleotide
agcgaggccgggtctcacatcctc

SEQ ID NO: 382866 - DNA, 23 bp, Artificial Sequence
  Description of Artificial Sequence: Synthetic oligonucleotide
gcgaggccgggtctcacatcctc

SEQ ID NO: 382867 - DNA, 24 bp, Artificial Sequence
  Description of Artificial Sequence: Synthetic oligonucleotide
cgaggccgggtctcacatcctcca

SEQ ID NO: 382868 - DNA, 25 bp, Artificial Sequence
  Description of Artificial Sequence: Synthetic oligonucleotide
gaggccgggtctcacatcctccaga

SEQ ID NO: 382869 - DNA, 25 bp, Artificial Sequence
  Description of Artificial Sequence: Synthetic oligonucleotide
aggccgggtctcacatcctccagag

SEQ ID NO: 382870 - DNA, 24 bp, Artificial Sequence
  Description of Artificial Sequence: Synthetic oligonucleotide
ggccgggtctcacatcctccagag

SEQ ID NO: 382871 - DNA, 26 bp, Artificial Sequence
  Description of Artificial Sequence: Synthetic oligonucleotide
gccgggtctcacatcctccagaggat

SEQ ID NO: 382872 - DNA, 27 bp, Artificial Sequence
  Description of Artificial Sequence: Synthetic oligonucleotide
ccgggtctcacatcctccagaggatgt

SEQ ID NO: 382873 - DNA, 29 bp, Artificial Sequence
  Description of Artificial Sequence: Synthetic oligonucleotide
cgggtctcacatcctccagaggatgtatg

SEQ ID NO: 382874 - DNA, 29 bp, Artificial Sequence
  Description of Artificial Sequence: Synthetic oligonucleotide
gggtctcacatcctccagaggatgtatgg

SEQ ID NO: 382875 - DNA, 29 bp, Artificial Sequence
  Description of Artificial Sequence: Synthetic oligonucleotide
ggtctcacatcctccagaggatgtatggc

SEQ ID NO: 382876 - DNA, 30 bp, Artificial Sequence; identical to SEQ ID NO: 32774
  Description of Artificial Sequence: Synthetic oligonucleotide

SEQ ID NO: 382877 - DNA, 30 bp, Artificial Sequence; identical to SEQ ID NO: 32775
  Description of Artificial Sequence: Synthetic oligonucleotide

SEQ ID NO: 382878 - DNA, 29 bp, Artificial Sequence
  Description of Artificial Sequence: Synthetic oligonucleotide
ctcacatcctccagaggatgtatggctgc

SEQ ID NO: 382879 - DNA, 29 bp, Artificial Sequence
  Description of Artificial Sequence: Synthetic oligonucleotide
tcacatcctccagaggatgtatggctgcg

SEQ ID NO: 382880 - DNA, 28 bp, Artificial Sequence
  Description of Artificial Sequence: Synthetic oligonucleotide
cacatcctccagaggatgtatggctgcg

SEQ ID NO: 382881 - DNA, 29 bp, Artificial Sequence
  Description of Artificial Sequence: Synthetic oligonucleotide
acatcctccagaggatgtatggctgcgac

SEQ ID NO: 382882 - DNA, 28 bp, Artificial Sequence
  Description of Artificial Sequence: Synthetic oligonucleotide
catcctccagaggatgtatggctgcgac

SEQ ID NO: 382883 - DNA, 28 bp, Artificial Sequence
  Description of Artificial Sequence: Synthetic oligonucleotide
atcctccagaggatgtatggctgcgacg

SEQ ID NO: 382884 - DNA, 27 bp, Artificial Sequence
  Description of Artificial Sequence: Synthetic oligonucleotide
tcctccagaggatgtatggctgcgacg

SEQ ID NO: 382885 - DNA, 30 bp, Artificial Sequence; identical to SEQ ID NO: 42934
  Description of Artificial Sequence: Synthetic oligonucleotide

SEQ ID NO: 382886 - DNA, 31 bp, Artificial Sequence; identical to SEQ ID NO: 42935
  Description of Artificial Sequence: Synthetic oligonucleotide

SEQ ID NO: 382887 - DNA, 31 bp, Artificial Sequence; identical to SEQ ID NO: 42936
  Description of Artificial Sequence: Synthetic oligonucleotide

SEQ ID NO: 382888 - DNA, 30 bp, Artificial Sequence; identical to SEQ ID NO: 42937
  Description of Artificial Sequence: Synthetic oligonucleotide

SEQ ID NO: 382889 - DNA, 29 bp, Artificial Sequence
  Description of Artificial Sequence: Synthetic oligonucleotide
ggattacatcgccctgaacgaggatctgc

SEQ ID NO: 382890 - DNA, 29 bp, Artificial Sequence
  Description of Artificial Sequence: Synthetic oligonucleotide
gattacatcgccctgaacgaggatctgcg

SEQ ID NO: 382891 - DNA, 29 bp, Artificial Sequence
  Description of Artificial Sequence: Synthetic oligonucleotide
attacatcgccctgaacgaggatctgcgc

SEQ ID NO: 382892 - DNA, 28 bp, Artificial Sequence
  Description of Artificial Sequence: Synthetic oligonucleotide
ttacatcgccctgaacgaggatctgcgc

SEQ ID NO: 382893 - DNA, 27 bp, Artificial Sequence
  Description of Artificial Sequence: Synthetic oligonucleotide
tacatcgccctgaacgaggatctgcgc

SEQ ID NO: 382894 - DNA, 27 bp, Artificial Sequence
  Description of Artificial Sequence: Synthetic oligonucleotide
acatcgccctgaacgaggatctgcgct

SEQ ID NO: 382895 - DNA, 26 bp, Artificial Sequence
  Description of Artificial Sequence: Synthetic oligonucleotide
catcgccctgaacgaggatctgcgct

SEQ ID NO: 382896 - DNA, 26 bp, Artificial Sequence
  Description of Artificial Sequence: Synthetic oligonucleotide
atcgccctgaacgaggatctgcgctc

SEQ ID NO: 382897 - DNA, 25 bp, Artificial Sequence
  Description of Artificial Sequence: Synthetic oligonucleotide
tcgccctgaacgaggatctgcgctc

SEQ ID NO: 382898 - DNA, 24 bp, Artificial Sequence
  Description of Artificial Sequence: Synthetic oligonucleotide
cgccctgaacgaggatctgcgctc

SEQ ID NO: 382899 - DNA, 25 bp, Artificial Sequence
  Description of Artificial Sequence: Synthetic oligonucleotide
gccctgaacgaggatctgcgctcct

SEQ ID NO: 382900 - DNA, 25 bp, Artificial Sequence
  Description of Artificial Sequence: Synthetic oligonucleotide
ccctgaacgaggatctgcgctcctg

SEQ ID NO: 382901 - DNA, 26 bp, Artificial Sequence
  Description of Artificial Sequence: Synthetic oligonucleotide
cctgaacgaggatctgcgctcctgga

SEQ ID NO: 382902 - DNA, 26 bp, Artificial Sequence
  Description of Artificial Sequence: Synthetic oligonucleotide
ctgaacgaggatctgcgctcctggac

SEQ ID NO: 382903 - DNA, 26 bp, Artificial Sequence
  Description of Artificial Sequence: Synthetic oligonucleotide
tgaacgaggatctgcgctcctggacc

SEQ ID NO: 382904 - DNA, 25 bp, Artificial Sequence
  Description of Artificial Sequence: Synthetic oligonucleotide
gaacgaggatctgcgctcctggacc

SEQ ID NO: 382905 - DNA, 25 bp, Artificial Sequence
  Description of Artificial Sequence: Synthetic oligonucleotide
aacgaggatctgcgctcctggaccg

SEQ ID NO: 382906 - DNA, 24 bp, Artificial Sequence
  Description of Artificial Sequence: Synthetic oligonucleotide
acgaggatctgcgctcctggaccg

SEQ ID NO: 382907 - DNA, 23 bp, Artificial Sequence
  Description of Artificial Sequence: Synthetic oligonucleotide
cgaggatctgcgctcctggaccg

SEQ ID NO: 382908 - DNA, 23 bp, Artificial Sequence
  Description of Artificial Sequence: Synthetic oligonucleotide
gaggatctgcgctcctggaccgc

SEQ ID NO: 382909 - DNA, 23 bp, Artificial Sequence
  Description of Artificial Sequence: Synthetic oligonucleotide
aggatctgcgctcctggaccgcc

SEQ ID NO: 382910 - DNA, 22 bp, Artificial Sequence
  Description of Artificial Sequence: Synthetic oligonucleotide
ggatctgcgctcctggaccgcc

SEQ ID NO: 382911 - DNA, 22 bp, Artificial Sequence
  Description of Artificial Sequence: Synthetic oligonucleotide
gatctgcgctcctggaccgccg

SEQ ID NO: 382912 - DNA, 22 bp, Artificial Sequence
  Description of Artificial Sequence: Synthetic oligonucleotide
atctgcgctcctggaccgccgc

SEQ ID NO: 382913 - DNA, 21 bp, Artificial Sequence
  Description of Artificial Sequence: Synthetic oligonucleotide
tctgcgctcctggaccgccgc

SEQ ID NO: 382914 - DNA, 27 bp, Artificial Sequence
  Description of Artificial Sequence: Synthetic oligonucleotide
cgtggagtggctccgcagatacctgaa

SEQ ID NO: 382915 - DNA, 27 bp, Artificial Sequence
  Description of Artificial Sequence: Synthetic oligonucleotide
gtggagtggctccgcagatacctgaag

SEQ ID NO: 382916 - DNA, 30 bp, Artificial Sequence; identical to SEQ ID NO: 29848
  Description of Artificial Sequence: Synthetic oligonucleotide

SEQ ID NO: 382917 - DNA, 29 bp, Artificial Sequence
  Description of Artificial Sequence: Synthetic oligonucleotide
ggagtggctccgcagatacctgaagaatg

SEQ ID NO: 382918 - DNA, 29 bp, Artificial Sequence
  Description of Artificial Sequence: Synthetic oligonucleotide
gagtggctccgcagatacctgaagaatgg

SEQ ID NO: 382919 - DNA, 29 bp, Artificial Sequence
  Description of Artificial Sequence: Synthetic oligonucleotide
agtggctccgcagatacctgaagaatggg

SEQ ID NO: 382920 - DNA, 28 bp, Artificial Sequence
  Description of Artificial Sequence: Synthetic oligonucleotide
gtggctccgcagatacctgaagaatggg

SEQ ID NO: 382921 - DNA, 30 bp, Artificial Sequence; identical to SEQ ID NO: 29853
  Description of Artificial Sequence: Synthetic oligonucleotide

SEQ ID NO: 382922 - DNA, 29 bp, Artificial Sequence
  Description of Artificial Sequence: Synthetic oligonucleotide
ggctccgcagatacctgaagaatgggaag

SEQ ID NO: 382923 - DNA, 29 bp, Artificial Sequence
  Description of Artificial Sequence: Synthetic oligonucleotide
gctccgcagatacctgaagaatgggaagg

SEQ ID NO: 382924 - DNA, 30 bp, Artificial Sequence; identical to SEQ ID NO: 29856
  Description of Artificial Sequence: Synthetic oligonucleotide

SEQ ID NO: 382925 - DNA, 31 bp, Artificial Sequence; identical to SEQ ID NO: 29857
  Description of Artificial Sequence: Synthetic oligonucleotide

SEQ ID NO: 382926 - DNA, 30 bp, Artificial Sequence; identical to SEQ ID NO: 29858
  Description of Artificial Sequence: Synthetic oligonucleotide

SEQ ID NO: 382927 - DNA, 30 bp, Artificial Sequence; identical to SEQ ID NO: 29859
  Description of Artificial Sequence: Synthetic oligonucleotide

SEQ ID NO: 382928 - DNA, 30 bp, Artificial Sequence; identical to SEQ ID NO: 29860
  Description of Artificial Sequence: Synthetic oligonucleotide

SEQ ID NO: 382929 - DNA, 31 bp, Artificial Sequence; identical to SEQ ID NO: 29861
  Description of Artificial Sequence: Synthetic oligonucleotide

SEQ ID NO: 382930 - DNA, 31 bp, Artificial Sequence; identical to SEQ ID NO: 29862
  Description of Artificial Sequence: Synthetic oligonucleotide

SEQ ID NO: 382931 - DNA, 30 bp, Artificial Sequence; identical to SEQ ID NO: 29863
  Description of Artificial Sequence: Synthetic oligonucleotide

SEQ ID NO: 382932 - DNA, 31 bp, Artificial Sequence; identical to SEQ ID NO: 29864
  Description of Artificial Sequence: Synthetic oligonucleotide

SEQ ID NO: 382933 - DNA, 30 bp, Artificial Sequence; identical to SEQ ID NO: 29865
  Description of Artificial Sequence: Synthetic oligonucleotide

SEQ ID NO: 382934 - DNA, 29 bp, Artificial Sequence
  Description of Artificial Sequence: Synthetic oligonucleotide
acctgaagaatgggaaggagacgctgcag

SEQ ID NO: 382935 - DNA, 28 bp, Artificial Sequence
  Description of Artificial Sequence: Synthetic oligonucleotide
cctgaagaatgggaaggagacgctgcag

SEQ ID NO: 382936 - DNA, 28 bp, Artificial Sequence
  Description of Artificial Sequence: Synthetic oligonucleotide
ctgaagaatgggaaggagacgctgcagc

SEQ ID NO: 382937 - DNA, 28 bp, Artificial Sequence
  Description of Artificial Sequence: Synthetic oligonucleotide
tgaagaatgggaaggagacgctgcagcg

SEQ ID NO: 382938 - DNA, 27 bp, Artificial Sequence
  Description of Artificial Sequence: Synthetic oligonucleotide
gaagaatgggaaggagacgctgcagcg

SEQ ID NO: 382939 - DNA, 27 bp, Artificial Sequence
  Description of Artificial Sequence: Synthetic oligonucleotide
aagaatgggaaggagacgctgcagcgc

SEQ ID NO: 382940 - DNA, 28 bp, Artificial Sequence
  Description of Artificial Sequence: Synthetic oligonucleotide
gatggggaggaccaaactcaggacactg

SEQ ID NO: 382941 - DNA, 29 bp, Artificial Sequence
  Description of Artificial Sequence: Synthetic oligonucleotide
atggggaggaccaaactcaggacactgag

SEQ ID NO: 382942 - DNA, 28 bp, Artificial Sequence
  Description of Artificial Sequence: Synthetic oligonucleotide
tggggaggaccaaactcaggacactgag

SEQ ID NO: 382943 - DNA, 27 bp, Artificial Sequence
  Description of Artificial Sequence: Synthetic oligonucleotide
ggggaggaccaaactcaggacactgag

SEQ ID NO: 382944 - DNA, 27 bp, Artificial Sequence
  Description of Artificial Sequence: Synthetic oligonucleotide
gggaggaccaaactcaggacactgagc

SEQ ID NO: 382945 - DNA, 29 bp, Artificial Sequence
  Description of Artificial Sequence: Synthetic oligonucleotide
ggaggaccaaactcaggacactgagcttg

SEQ ID NO: 382946 - DNA, 28 bp, Artificial Sequence
  Description of Artificial Sequence: Synthetic oligonucleotide
tcaggacactgagcttgtggagaccagg

SEQ ID NO: 382947 - DNA, 27 bp, Artificial Sequence
  Description of Artificial Sequence: Synthetic oligonucleotide
caggacactgagcttgtggagaccagg

SEQ ID NO: 382948 - DNA, 27 bp, Artificial Sequence
  Description of Artificial Sequence: Synthetic oligonucleotide
aggacactgagcttgtggagaccaggc

SEQ ID NO: 382949 - DNA, 26 bp, Artificial Sequence
  Description of Artificial Sequence: Synthetic oligonucleotide
ggacactgagcttgtggagaccaggc

SEQ ID NO: 382950 - DNA, 27 bp, Artificial Sequence
  Description of Artificial Sequence: Synthetic oligonucleotide
gacactgagcttgtggagaccaggcca

SEQ ID NO: 382951 - DNA, 27 bp, Artificial Sequence
  Description of Artificial Sequence: Synthetic oligonucleotide
acactgagcttgtggagaccaggccag

SEQ ID NO: 382952 - DNA, 26 bp, Artificial Sequence
  Description of Artificial Sequence: Synthetic oligonucleotide
cactgagcttgtggagaccaggccag

SEQ ID NO: 382953 - DNA, 27 bp, Artificial Sequence
  Description of Artificial Sequence: Synthetic oligonucleotide
actgagcttgtggagaccaggccagca

SEQ ID NO: 382954 - DNA, 26 bp, Artificial Sequence
  Description of Artificial Sequence: Synthetic oligonucleotide
ctgagcttgtggagaccaggccagca

SEQ ID NO: 382955 - DNA, 26 bp, Artificial Sequence
  Description of Artificial Sequence: Synthetic oligonucleotide
tgagcttgtggagaccaggccagcag

SEQ ID NO: 382956 - DNA, 26 bp, Artificial Sequence
  Description of Artificial Sequence: Synthetic oligonucleotide
aatcaggacgaagtcccaggtcccgg

SEQ ID NO: 382957 - DNA, 30 bp, Artificial Sequence
  Description of Artificial Sequence: Synthetic oligonucleotide
caattcccactcccattgggtgtcggattc

SEQ ID NO: 382958 - DNA, 32 bp, Artificial Sequence
  Description of Artificial Sequence: Synthetic oligonucleotide
aattcccactcccattgggtgtcggattctag

SEQ ID NO: 382959 - DNA, 31 bp, Artificial Sequence
  Description of Artificial Sequence: Synthetic oligonucleotide
attcccactcccattgggtgtcggattctag

SEQ ID NO: 382960 - DNA, 30 bp, Artificial Sequence
  Description of Artificial Sequence: Synthetic oligonucleotide
ttcccactcccattgggtgtcggattctag

SEQ ID NO: 382961 - DNA, 29 bp, Artificial Sequence
  Description of Artificial Sequence: Synthetic oligonucleotide
tcccactcccattgggtgtcggattctag

SEQ ID NO: 382962 - DNA, 28 bp, Artificial Sequence
  Description of Artificial Sequence: Synthetic oligonucleotide
cccactcccattgggtgtcggattctag

SEQ ID NO: 382963 - DNA, 29 bp, Artificial Sequence
  Description of Artificial Sequence: Synthetic oligonucleotide
ccactcccattgggtgtcggattctagag

SEQ ID NO: 382964 - DNA, 31 bp, Artificial Sequence
  Description of Artificial Sequence: Synthetic oligonucleotide
cactcccattgggtgtcggattctagagaag

SEQ ID NO: 382965 - DNA, 31 bp, Artificial Sequence
  Description of Artificial Sequence: Synthetic oligonucleotide
actcccattgggtgtcggattctagagaagc

SEQ ID NO: 382966 - DNA, 30 bp, Artificial Sequence
  Description of Artificial Sequence: Synthetic oligonucleotide
ctcccattgggtgtcggattctagagaagc

SEQ ID NO: 382967 - DNA, 30 bp, Artificial Sequence
  Description of Artificial Sequence: Synthetic oligonucleotide
tcccattgggtgtcggattctagagaagcc

SEQ ID NO: 382968 - DNA, 29 bp, Artificial Sequence
  Description of Artificial Sequence: Synthetic oligonucleotide
cccattgggtgtcggattctagagaagcc

SEQ ID NO: 382969 - DNA, 32 bp, Artificial Sequence
  Description of Artificial Sequence: Synthetic oligonucleotide
ccattgggtgtcggattctagagaagccaatc

SEQ ID NO: 382970 - DNA, 33 bp, Artificial Sequence
  Description of Artificial Sequence: Synthetic oligonucleotide
cattgggtgtcggattctagagaagccaatcag

SEQ ID NO: 382971 - DNA, 33 bp, Artificial Sequence
  Description of Artificial Sequence: Synthetic oligonucleotide
attgggtgtcggattctagagaagccaatcagc

SEQ ID NO: 382972 - DNA, 32 bp, Artificial Sequence
  Description of Artificial Sequence: Synthetic oligonucleotide
ttgggtgtcggattctagagaagccaatcagc

SEQ ID NO: 382973 - DNA, 31 bp, Artificial Sequence
  Description of Artificial Sequence: Synthetic oligonucleotide
tgggtgtcggattctagagaagccaatcagc

SEQ ID NO: 382974 - DNA, 30 bp, Artificial Sequence
  Description of Artificial Sequence: Synthetic oligonucleotide
gggtgtcggattctagagaagccaatcagc

SEQ ID NO: 382975 - DNA, 30 bp, Artificial Sequence
  Description of Artificial Sequence: Synthetic oligonucleotide
ggtgtcggattctagagaagccaatcagcg

SEQ ID NO: 382976 - DNA, 31 bp, Artificial Sequence
  Description of Artificial Sequence: Synthetic oligonucleotide
gtgtcggattctagagaagccaatcagcgtc

SEQ ID NO: 382977 - DNA, 32 bp, Artificial Sequence
  Description of Artificial Sequence: Synthetic oligonucleotide
tgtcggattctagagaagccaatcagcgtctc

SEQ ID NO: 382978 - DNA, 31 bp, Artificial Sequence
  Description of Artificial Sequence: Synthetic oligonucleotide
gtcggattctagagaagccaatcagcgtctc

SEQ ID NO: 382979 - DNA, 31 bp, Artificial Sequence
  Description of Artificial Sequence: Synthetic oligonucleotide
tcggattctagagaagccaatcagcgtctcc

SEQ ID NO: 382980 - DNA, 30 bp, Artificial Sequence
  Description of Artificial Sequence: Synthetic oligonucleotide
cggattctagagaagccaatcagcgtctcc

SEQ ID NO: 382981 - DNA, 30 bp, Artificial Sequence
  Description of Artificial Sequence: Synthetic oligonucleotide
ggattctagagaagccaatcagcgtctccg

SEQ ID NO: 382982 - DNA, 30 bp, Artificial Sequence
  Description of Artificial Sequence: Synthetic oligonucleotide
gattctagagaagccaatcagcgtctccgc

SEQ ID NO: 382983 - DNA, 31 bp, Artificial Sequence
  Description of Artificial Sequence: Synthetic oligonucleotide
attctagagaagccaatcagcgtctccgcag

SEQ ID NO: 382984 - DNA, 26 bp, Artificial Sequence
  Description of Artificial Sequence: Synthetic oligonucleotide
atcagcgtctccgcagtcccggttct

SEQ ID NO: 382985 - DNA, 25 bp, Artificial Sequence
  Description of Artificial Sequence: Synthetic oligonucleotide
tcagcgtctccgcagtcccggttct

SEQ ID NO: 382986 - DNA, 24 bp, Artificial Sequence
  Description of Artificial Sequence: Synthetic oligonucleotide
cagcgtctccgcagtcccggttct

SEQ ID NO: 382987 - DNA, 26 bp, Artificial Sequence
  Description of Artificial Sequence: Synthetic oligonucleotide
agcgtctccgcagtcccggttctgaa

SEQ ID NO: 382988 - DNA, 25 bp, Artificial Sequence
  Description of Artificial Sequence: Synthetic oligonucleotide
gcgtctccgcagtcccggttctgaa

SEQ ID NO: 382989 - DNA, 26 bp, Artificial Sequence
  Description of Artificial Sequence: Synthetic oligonucleotide
cgtctccgcagtcccggttctgaagt

SEQ ID NO: 382990 - DNA, 26 bp, Artificial Sequence
  Description of Artificial Sequence: Synthetic oligonucleotide
gtctccgcagtcccggttctgaagtc

SEQ ID NO: 382991 - DNA, 26 bp, Artificial Sequence
  Description of Artificial Sequence: Synthetic oligonucleotide
tctccgcagtcccggttctgaagtcc

SEQ ID NO: 382992 - DNA, 25 bp, Artificial Sequence
  Description of Artificial Sequence: Synthetic oligonucleotide
ctccgcagtcccggttctgaagtcc

SEQ ID NO: 382993 - DNA, 25 bp, Artificial Sequence
  Description of Artificial Sequence: Synthetic oligonucleotide
tccgcagtcccggttctgaagtccc

SEQ ID NO: 382994 - DNA, 24 bp, Artificial Sequence
  Description of Artificial Sequence: Synthetic oligonucleotide
ccgcagtcccggttctgaagtccc

SEQ ID NO: 382995 - DNA, 25 bp, Artificial Sequence
  Description of Artificial Sequence: Synthetic oligonucleotide
cgcagtcccggttctgaagtcccca

SEQ ID NO: 382996 - DNA, 26 bp, Artificial Sequence
  Description of Artificial Sequence: Synthetic oligonucleotide
gcagtcccggttctgaagtccccagt

SEQ ID NO: 382997 - DNA, 27 bp, Artificial Sequence
  Description of Artificial Sequence: Synthetic oligonucleotide
cagtcccggttctgaagtccccagtca

SEQ ID NO: 382998 - DNA, 27 bp, Artificial Sequence
  Description of Artificial Sequence: Synthetic oligonucleotide
agtcccggttctgaagtccccagtcac

SEQ ID NO: 382999 - DNA, 26 bp, Artificial Sequence
  Description of Artificial Sequence: Synthetic oligonucleotide
gtcccggttctgaagtccccagtcac

SEQ ID NO: 383000 - DNA, 26 bp, Artificial Sequence
  Description of Artificial Sequence: Synthetic oligonucleotide
tcccggttctgaagtccccagtcacc

SEQ ID NO: 383001 - DNA, 25 bp, Artificial Sequence
  Description of Artificial Sequence: Synthetic oligonucleotide
cccggttctgaagtccccagtcacc

SEQ ID NO: 383002 - DNA, 26 bp, Artificial Sequence
  Description of Artificial Sequence: Synthetic oligonucleotide
ccggttctgaagtccccagtcaccca

SEQ ID NO: 383003 - DNA, 26 bp, Artificial Sequence
  Description of Artificial Sequence: Synthetic oligonucleotide
cggttctgaagtccccagtcacccac

SEQ ID NO: 383004 - DNA, 26 bp, Artificial Sequence
  Description of Artificial Sequence: Synthetic oligonucleotide
ggttctgaagtccccagtcacccacc

SEQ ID NO: 383005 - DNA, 26 bp, Artificial Sequence
  Description of Artificial Sequence: Synthetic oligonucleotide
gttctgaagtccccagtcacccaccc

SEQ ID NO: 383006 - DNA, 26 bp, Artificial Sequence
  Description of Artificial Sequence: Synthetic oligonucleotide
ttctgaagtccccagtcacccacccg

SEQ ID NO: 383007 - DNA, 25 bp, Artificial Sequence
  Description of Artificial Sequence: Synthetic oligonucleotide
tctgaagtccccagtcacccacccg

SEQ ID NO: 383008 - DNA, 24 bp, Artificial Sequence
  Description of Artificial Sequence: Synthetic oligonucleotide
ctgaagtccccagtcacccacccg

SEQ ID NO: 383009 - DNA, 25 bp, Artificial Sequence
  Description of Artificial Sequence: Synthetic oligonucleotide
tgaagtccccagtcacccacccgga

SEQ ID NO: 383010 - DNA, 24 bp, Artificial Sequence
  Description of Artificial Sequence: Synthetic oligonucleotide
gaagtccccagtcacccacccgga

SEQ ID NO: 383011 - DNA, 21 bp, Artificial Sequence
  Description of Artificial Sequence: Synthetic oligonucleotide
gggctgccggagcccctcact

SEQ ID NO: 383012 - DNA, 22 bp, Artificial Sequence
  Description of Artificial Sequence: Synthetic oligonucleotide
ggctgccggagcccctcactct

SEQ ID NO: 383013 - DNA, 23 bp, Artificial Sequence
  Description of Artificial Sequence: Synthetic oligonucleotide
gctgccggagcccctcactctga

SEQ ID NO: 383014 - DNA, 25 bp, Artificial Sequence
  Description of Artificial Sequence: Synthetic oligonucleotide
ctgccggagcccctcactctgagat

SEQ ID NO: 383015 - DNA, 25 bp, Artificial Sequence
  Description of Artificial Sequence: Synthetic oligonucleotide
tgccggagcccctcactctgagatg

SEQ ID NO: 383016 - DNA, 24 bp, Artificial Sequence
  Description of Artificial Sequence: Synthetic oligonucleotide
gccggagcccctcactctgagatg

SEQ ID NO: 383017 - DNA, 24 bp, Artificial Sequence
  Description of Artificial Sequence: Synthetic oligonucleotide
ccggagcccctcactctgagatgg

SEQ ID NO: 383018 - DNA, 25 bp, Artificial Sequence
  Description of Artificial Sequence: Synthetic oligonucleotide
cggagcccctcactctgagatggga

SEQ ID NO: 383019 - DNA, 25 bp, Artificial Sequence
  Description of Artificial Sequence: Synthetic oligonucleotide
ggagcccctcactctgagatgggag

SEQ ID NO: 383020 - DNA, 25 bp, Artificial Sequence
  Description of Artificial Sequence: Synthetic oligonucleotide
gagcccctcactctgagatgggagc

SEQ ID NO: 383021 - DNA, 25 bp, Artificial Sequence
  Description of Artificial Sequence: Synthetic oligonucleotide
agcccctcactctgagatgggagcc

SEQ ID NO: 383022 - DNA, 24 bp, Artificial Sequence
  Description of Artificial Sequence: Synthetic oligonucleotide
gcccctcactctgagatgggagcc

SEQ ID NO: 383023 - DNA, 25 bp, Artificial Sequence
  Description of Artificial Sequence: Synthetic oligonucleotide
cccctcactctgagatgggagccgt

SEQ ID NO: 383024 - DNA, 27 bp, Artificial Sequence
  Description of Artificial Sequence: Synthetic oligonucleotide
ccctcactctgagatgggagccgtctt

SEQ ID NO: 383025 - DNA, 27 bp, Artificial Sequence
  Description of Artificial Sequence: Synthetic oligonucleotide
cctcactctgagatgggagccgtcttc

SEQ ID NO: 383026 - DNA, 27 bp, Artificial Sequence
  Description of Artificial Sequence: Synthetic oligonucleotide
ctcactctgagatgggagccgtcttcc

SEQ ID NO: 383027 - DNA, 27 bp, Artificial Sequence
  Description of Artificial Sequence: Synthetic oligonucleotide
tcactctgagatgggagccgtcttccc

SEQ ID NO: 383028 - DNA, 27 bp, Artificial Sequence
  Description of Artificial Sequence: Synthetic oligonucleotide
cactctgagatgggagccgtcttccca

SEQ ID NO: 383029 - DNA, 27 bp, Artificial Sequence
  Description of Artificial Sequence: Synthetic oligonucleotide
actctgagatgggagccgtcttcccag

SEQ ID NO: 383030 - DNA, 26 bp, Artificial Sequence
  Description of Artificial Sequence: Synthetic oligonucleotide
ctctgagatgggagccgtcttcccag

SEQ ID NO: 383031 - DNA, 26 bp, Artificial Sequence
  Description of Artificial Sequence: Synthetic oligonucleotide
tctgagatgggagccgtcttcccagc

SEQ ID NO: 383032 - DNA, 27 bp, Artificial Sequence
  Description of Artificial Sequence: Synthetic oligonucleotide
gagccccacttcatcgcagtgggctat

SEQ ID NO: 383033 - DNA, 27 bp, Artificial Sequence
  Description of Artificial Sequence: Synthetic oligonucleotide
agccccacttcatcgcagtgggctatg

SEQ ID NO: 383034 - DNA, 27 bp, Artificial Sequence
  Description of Artificial Sequence: Synthetic oligonucleotide
gccccacttcatcgcagtgggctatgt

SEQ ID NO: 383035 - DNA, 27 bp, Artificial Sequence
  Description of Artificial Sequence: Synthetic oligonucleotide
ccccacttcatcgcagtgggctatgtg

SEQ ID NO: 383036 - DNA, 27 bp, Artificial Sequence
  Description of Artificial Sequence: Synthetic oligonucleotide
cccacttcatcgcagtgggctatgtgg

SEQ ID NO: 383037 - DNA, 28 bp, Artificial Sequence
  Description of Artificial Sequence: Synthetic oligonucleotide
ccacttcatcgcagtgggctatgtggac

SEQ ID NO: 383038 - DNA, 28 bp, Artificial Sequence
  Description of Artificial Sequence: Synthetic oligonucleotide
cacttcatcgcagtgggctatgtggacg

SEQ ID NO: 383039 - DNA, 29 bp, Artificial Sequence
  Description of Artificial Sequence: Synthetic oligonucleotide
acttcatcgcagtgggctatgtggacgac

SEQ ID NO: 383040 - DNA, 28 bp, Artificial Sequence
  Description of Artificial Sequence: Synthetic oligonucleotide
cttcatcgcagtgggctatgtggacgac

SEQ ID NO: 383041 - DNA, 29 bp, Artificial Sequence
  Description of Artificial Sequence: Synthetic oligonucleotide
ttcatcgcagtgggctatgtggacgacac

SEQ ID NO: 383042 - DNA, 28 bp, Artificial Sequence
  Description of Artificial Sequence: Synthetic oligonucleotide
tcatcgcagtgggctatgtggacgacac

SEQ ID NO: 383043 - DNA, 27 bp, Artificial Sequence
  Description of Artificial Sequence: Synthetic oligonucleotide
catcgcagtgggctatgtggacgacac

SEQ ID NO: 383044 - DNA, 27 bp, Artificial Sequence
  Description of Artificial Sequence: Synthetic oligonucleotide
atcgcagtgggctatgtggacgacacg

SEQ ID NO: 383045 - DNA, 26 bp, Artificial Sequence
  Description of Artificial Sequence: Synthetic oligonucleotide
tcgcagtgggctatgtggacgacacg

SEQ ID NO: 383046 - DNA, 25 bp, Artificial Sequence
  Description of Artificial Sequence: Synthetic oligonucleotide
cgcagtgggctatgtggacgacacg

SEQ ID NO: 383047 - DNA, 26 bp, Artificial Sequence
  Description of Artificial Sequence: Synthetic oligonucleotide
gcagtgggctatgtggacgacacgca

SEQ ID NO: 383048 - DNA, 27 bp, Artificial Sequence
  Description of Artificial Sequence: Synthetic oligonucleotide
cagtgggctatgtggacgacacgcagt

SEQ ID NO: 383049 - DNA, 28 bp, Artificial Sequence
  Description of Artificial Sequence: Synthetic oligonucleotide
agtgggctatgtggacgacacgcagttc

SEQ ID NO: 383050 - DNA, 27 bp, Artificial Sequence
  Description of Artificial Sequence: Synthetic oligonucleotide
gtgggctatgtggacgacacgcagttc

SEQ ID NO: 383051 - DNA, 27 bp, Artificial Sequence
  Description of Artificial Sequence: Synthetic oligonucleotide
tgggctatgtggacgacacgcagttcg

SEQ ID NO: 383052 - DNA, 27 bp, Artificial Sequence
  Description of Artificial Sequence: Synthetic oligonucleotide
gggctatgtggacgacacgcagttcgt

SEQ ID NO: 383053 - DNA, 27 bp, Artificial Sequence
  Description of Artificial Sequence: Synthetic oligonucleotide
ggctatgtggacgacacgcagttcgtg

SEQ ID NO: 383054 - DNA, 27 bp, Artificial Sequence
  Description of Artificial Sequence: Synthetic oligonucleotide
gctatgtggacgacacgcagttcgtgc

SEQ ID NO: 383055 - DNA, 27 bp, Artificial Sequence
  Description of Artificial Sequence: Synthetic oligonucleotide
ctatgtggacgacacgcagttcgtgcg

SEQ ID NO: 383056 - DNA, 27 bp, Artificial Sequence
  Description of Artificial Sequence: Synthetic oligonucleotide
tatgtggacgacacgcagttcgtgcgg

SEQ ID NO: 383057 - DNA, 27 bp, Artificial Sequence
  Description of Artificial Sequence: Synthetic oligonucleotide
atgtggacgacacgcagttcgtgcggt

SEQ ID NO: 383058 - DNA, 27 bp, Artificial Sequence
  Description of Artificial Sequence: Synthetic oligonucleotide
tgtggacgacacgcagttcgtgcggtt

SEQ ID NO: 383059 - DNA, 27 bp, Artificial Sequence
  Description of Artificial Sequence: Synthetic oligonucleotide
atcgcagtgggctacgtggacgatacg

SEQ ID NO: 383060 - DNA, 26 bp, Artificial Sequence
  Description of Artificial Sequence: Synthetic oligonucleotide
tcgcagtgggctacgtggacgatacg

SEQ ID NO: 383061 - DNA, 25 bp, Artificial Sequence
  Description of Artificial Sequence: Synthetic oligonucleotide
cgcagtgggctacgtggacgatacg

SEQ ID NO: 383062 - DNA, 26 bp, Artificial Sequence
  Description of Artificial Sequence: Synthetic oligonucleotide
gcagtgggctacgtggacgatacgca

SEQ ID NO: 383063 - DNA, 27 bp, Artificial Sequence
  Description of Artificial Sequence: Synthetic oligonucleotide
cagtgggctacgtggacgatacgcagt

SEQ ID NO: 383064 - DNA, 28 bp, Artificial Sequence
  Description of Artificial Sequence: Synthetic oligonucleotide
agtgggctacgtggacgatacgcagttc

SEQ ID NO: 383065 - DNA, 27 bp, Artificial Sequence
  Description of Artificial Sequence: Synthetic oligonucleotide
gtgggctacgtggacgatacgcagttc

SEQ ID NO: 383066 - DNA, 27 bp, Artificial Sequence
  Description of Artificial Sequence: Synthetic oligonucleotide
tgggctacgtggacgatacgcagttcg

SEQ ID NO: 383067 - DNA, 27 bp, Artificial Sequence
  Description of Artificial Sequence: Synthetic oligonucleotide
gggctacgtggacgatacgcagttcgt

SEQ ID NO: 383068 - DNA, 27 bp, Artificial Sequence
  Description of Artificial Sequence: Synthetic oligonucleotide
ggctacgtggacgatacgcagttcgtg

SEQ ID NO: 383069 - DNA, 27 bp, Artificial Sequence
  Description of Artificial Sequence: Synthetic oligonucleotide
gctacgtggacgatacgcagttcgtgc

SEQ ID NO: 383070 - DNA, 27 bp, Artificial Sequence
  Description of Artificial Sequence: Synthetic oligonucleotide
ctacgtggacgatacgcagttcgtgcg

SEQ ID NO: 383071 - DNA, 27 bp, Artificial Sequence
  Description of Artificial Sequence: Synthetic oligonucleotide
tacgtggacgatacgcagttcgtgcgg

SEQ ID NO: 383072 - DNA, 27 bp, Artificial Sequence
  Description of Artificial Sequence: Synthetic oligonucleotide
acgtggacgatacgcagttcgtgcggt

SEQ ID NO: 383073 - DNA, 27 bp, Artificial Sequence
  Description of Artificial Sequence: Synthetic oligonucleotide
cgtggacgatacgcagttcgtgcggtt

SEQ ID NO: 383074 - DNA, 27 bp, Artificial Sequence
  Description of Artificial Sequence: Synthetic oligonucleotide
gtggacgatacgcagttcgtgcggttc

SEQ ID NO: 383075 - DNA, 27 bp, Artificial Sequence
  Description of Artificial Sequence: Synthetic oligonucleotide
tggacgatacgcagttcgtgcggttcg

SEQ ID NO: 383076 - DNA, 27 bp, Artificial Sequence
  Description of Artificial Sequence: Synthetic oligonucleotide
ggacgatacgcagttcgtgcggttcga

SEQ ID NO: 383077 - DNA, 27 bp, Artificial Sequence
  Description of Artificial Sequence: Synthetic oligonucleotide
gacgatacgcagttcgtgcggttcgac

SEQ ID NO: 383078 - DNA, 28 bp, Artificial Sequence
  Description of Artificial Sequence: Synthetic oligonucleotide
acgatacgcagttcgtgcggttcgacag

SEQ ID NO: 383079 - DNA, 27 bp, Artificial Sequence
  Description of Artificial Sequence: Synthetic oligonucleotide
cgatacgcagttcgtgcggttcgacag

SEQ ID NO: 383080 - DNA, 27 bp, Artificial Sequence
  Description of Artificial Sequence: Synthetic oligonucleotide
gatacgcagttcgtgcggttcgacagc

SEQ ID NO: 383081 - DNA, 27 bp, Artificial Sequence
  Description of Artificial Sequence: Synthetic oligonucleotide
atacgcagttcgtgcggttcgacagcg

SEQ ID NO: 383082 - DNA, 27 bp, Artificial Sequence
  Description of Artificial Sequence: Synthetic oligonucleotide
tacgcagttcgtgcggttcgacagcga

SEQ ID NO: 383083 - DNA, 28 bp, Artificial Sequence
  Description of Artificial Sequence: Synthetic oligonucleotide
ccaaagacacacgtgacccaccatcctg

SEQ ID NO: 383084 - DNA, 29 bp, Artificial Sequence
  Description of Artificial Sequence: Synthetic oligonucleotide
caaagacacacgtgacccaccatcctgtc

SEQ ID NO: 383085 - DNA, 30 bp, Artificial Sequence
  Description of Artificial Sequence: Synthetic oligonucleotide
aaagacacacgtgacccaccatcctgtctc

SEQ ID NO: 383086 - DNA, 29 bp, Artificial Sequence
  Description of Artificial Sequence: Synthetic oligonucleotide
aagacacacgtgacccaccatcctgtctc

SEQ ID NO: 383087 - DNA, 28 bp, Artificial Sequence
  Description of Artificial Sequence: Synthetic oligonucleotide
agacacacgtgacccaccatcctgtctc

SEQ ID NO: 383088 - DNA, 27 bp, Artificial Sequence
  Description of Artificial Sequence: Synthetic oligonucleotide
gacacacgtgacccaccatcctgtctc

SEQ ID NO: 383089 - DNA, 28 bp, Artificial Sequence
  Description of Artificial Sequence: Synthetic oligonucleotide
acacacgtgacccaccatcctgtctctg

SEQ ID NO: 383090 - DNA, 27 bp, Artificial Sequence
  Description of Artificial Sequence: Synthetic oligonucleotide
cacacgtgacccaccatcctgtctctg

SEQ ID NO: 383091 - DNA, 28 bp, Artificial Sequence
  Description of Artificial Sequence: Synthetic oligonucleotide
acacgtgacccaccatcctgtctctgac

SEQ ID NO: 383092 - DNA, 27 bp, Artificial Sequence
  Description of Artificial Sequence: Synthetic oligonucleotide
cacgtgacccaccatcctgtctctgac

SEQ ID NO: 383093 - DNA, 27 bp, Artificial Sequence
  Description of Artificial Sequence: Synthetic oligonucleotide
acgtgacccaccatcctgtctctgacc

SEQ ID NO: 383094 - DNA, 27 bp, Artificial Sequence
  Description of Artificial Sequence: Synthetic oligonucleotide
cgtgacccaccatcctgtctctgacca

SEQ ID NO: 383095 - DNA, 28 bp, Artificial Sequence
  Description of Artificial Sequence: Synthetic oligonucleotide
gtgacccaccatcctgtctctgaccatg

SEQ ID NO: 383096 - DNA, 29 bp, Artificial Sequence
  Description of Artificial Sequence: Synthetic oligonucleotide
tgacccaccatcctgtctctgaccatgag

SEQ ID NO: 383097 - DNA, 28 bp, Artificial Sequence
  Description of Artificial Sequence: Synthetic oligonucleotide
gacccaccatcctgtctctgaccatgag

SEQ ID NO: 383098 - DNA, 28 bp, Artificial Sequence
  Description of Artificial Sequence: Synthetic oligonucleotide
acccaccatcctgtctctgaccatgagg

SEQ ID NO: 383099 - DNA, 27 bp, Artificial Sequence
  Description of Artificial Sequence: Synthetic oligonucleotide
cccaccatcctgtctctgaccatgagg

SEQ ID NO: 383100 - DNA, 27 bp, Artificial Sequence
  Description of Artificial Sequence: Synthetic oligonucleotide
ccaccatcctgtctctgaccatgaggc

SEQ ID NO: 383101 - DNA, 27 bp, Artificial Sequence
  Description of Artificial Sequence: Synthetic oligonucleotide
caccatcctgtctctgaccatgaggcc

SEQ ID NO: 383102 - DNA, 28 bp, Artificial Sequence
  Description of Artificial Sequence: Synthetic oligonucleotide
accatcctgtctctgaccatgaggccac

SEQ ID NO: 383103 - DNA, 27 bp, Artificial Sequence
  Description of Artificial Sequence: Synthetic oligonucleotide
ccatcctgtctctgaccatgaggccac

SEQ ID NO: 383104 - DNA, 27 bp, Artificial Sequence
  Description of Artificial Sequence: Synthetic oligonucleotide
catcctgtctctgaccatgaggccacc

SEQ ID NO: 383105 - DNA, 27 bp, Artificial Sequence
  Description of Artificial Sequence: Synthetic oligonucleotide
atcctgtctctgaccatgaggccaccc

SEQ ID NO: 383106 - DNA, 27 bp, Artificial Sequence
  Description of Artificial Sequence: Synthetic oligonucleotide
tcctgtctctgaccatgaggccaccct

SEQ ID NO: 383107 - DNA, 26 bp, Artificial Sequence
  Description of Artificial Sequence: Synthetic oligonucleotide
cctgtctctgaccatgaggccaccct

SEQ ID NO: 383108 - DNA, 26 bp, Artificial Sequence
  Description of Artificial Sequence: Synthetic oligonucleotide
cgaggccgggtctcacatcctccaaa

SEQ ID NO: 383109 - DNA, 26 bp, Artificial Sequence
  Description of Artificial Sequence: Synthetic oligonucleotide
gaggccgggtctcacatcctccaaag

SEQ ID NO: 383110 - DNA, 27 bp, Artificial Sequence
  Description of Artificial Sequence: Synthetic oligonucleotide
aggccgggtctcacatcctccaaagga

SEQ ID NO: 383111 - DNA, 27 bp, Artificial Sequence
  Description of Artificial Sequence: Synthetic oligonucleotide
ggccgggtctcacatcctccaaaggat

SEQ ID NO: 383112 - DNA, 27 bp, Artificial Sequence
  Description of Artificial Sequence: Synthetic oligonucleotide
gccgggtctcacatcctccaaaggatg

SEQ ID NO: 383113 - DNA, 30 bp, Artificial Sequence
  Description of Artificial Sequence: Synthetic oligonucleotide
ccgggtctcacatcctccaaaggatgtatg

SEQ ID NO: 383114 - DNA, 30 bp, Artificial Sequence
  Description of Artificial Sequence: Synthetic oligonucleotide
cgggtctcacatcctccaaaggatgtatgg

SEQ ID NO: 383115 - DNA, 30 bp, Artificial Sequence
  Description of Artificial Sequence: Synthetic oligonucleotide
gggtctcacatcctccaaaggatgtatggc

SEQ ID NO: 383116 - DNA, 31 bp, Artificial Sequence
  Description of Artificial Sequence: Synthetic oligonucleotide
ggtctcacatcctccaaaggatgtatggctg

SEQ ID NO: 383117 - DNA, 31 bp, Artificial Sequence
  Description of Artificial Sequence: Synthetic oligonucleotide
gtctcacatcctccaaaggatgtatggctgc

SEQ ID NO: 383118 - DNA, 31 bp, Artificial Sequence
  Description of Artificial Sequence: Synthetic oligonucleotide
tctcacatcctccaaaggatgtatggctgcg

SEQ ID NO: 383119 - DNA, 30 bp, Artificial Sequence
  Description of Artificial Sequence: Synthetic oligonucleotide
ctcacatcctccaaaggatgtatggctgcg

SEQ ID NO: 383120 - DNA, 31 bp, Artificial Sequence
  Description of Artificial Sequence: Synthetic oligonucleotide
tcacatcctccaaaggatgtatggctgcgac

SEQ ID NO: 383121 - DNA, 30 bp, Artificial Sequence
  Description of Artificial Sequence: Synthetic oligonucleotide
cacatcctccaaaggatgtatggctgcgac

SEQ ID NO: 383122 - DNA, 30 bp, Artificial Sequence
  Description of Artificial Sequence: Synthetic oligonucleotide
acatcctccaaaggatgtatggctgcgacg

SEQ ID NO: 383123 - DNA, 29 bp, Artificial Sequence
  Description of Artificial Sequence: Synthetic oligonucleotide
catcctccaaaggatgtatggctgcgacg

SEQ ID NO: 383124 - DNA, 30 bp, Artificial Sequence
  Description of Artificial Sequence: Synthetic oligonucleotide
atcctccaaaggatgtatggctgcgacgtg

SEQ ID NO: 383125 - DNA, 29 bp, Artificial Sequence
  Description of Artificial Sequence: Synthetic oligonucleotide
tcctccaaaggatgtatggctgcgacgtg

SEQ ID NO: 383126 - DNA, 28 bp, Artificial Sequence
  Description of Artificial Sequence: Synthetic oligonucleotide
cctccaaaggatgtatggctgcgacgtg

SEQ ID NO: 383127 - DNA, 28 bp, Artificial Sequence
  Description of Artificial Sequence: Synthetic oligonucleotide
ctccaaaggatgtatggctgcgacgtgg

SEQ ID NO: 383128 - DNA, 28 bp, Artificial Sequence
  Description of Artificial Sequence: Synthetic oligonucleotide
tccaaaggatgtatggctgcgacgtggg

SEQ ID NO: 383129 - DNA, 27 bp, Artificial Sequence
  Description of Artificial Sequence: Synthetic oligonucleotide
ccaaaggatgtatggctgcgacgtggg

SEQ ID NO: 383130 - DNA, 27 bp, Artificial Sequence
  Description of Artificial Sequence: Synthetic oligonucleotide
caaaggatgtatggctgcgacgtgggg

SEQ ID NO: 383131 - DNA, 27 bp, Artificial Sequence
  Description of Artificial Sequence: Synthetic oligonucleotide
aaaggatgtatggctgcgacgtggggc

SEQ ID NO: 383132 - DNA, 26 bp, Artificial Sequence
  Description of Artificial Sequence: Synthetic oligonucleotide
aaggatgtatggctgcgacgtggggc

SEQ ID NO: 383133 - DNA, 26 bp, Artificial Sequence
  Description of Artificial Sequence: Synthetic oligonucleotide
cggctactacaaccagagcgaggcca

SEQ ID NO: 383134 - DNA, 26 bp, Artificial Sequence
  Description of Artificial Sequence: Synthetic oligonucleotide
ggctactacaaccagagcgaggccag

SEQ ID NO: 383135 - DNA, 27 bp, Artificial Sequence
  Description of Artificial Sequence: Synthetic oligonucleotide
gctactacaaccagagcgaggccaggt

SEQ ID NO: 383136 - DNA, 27 bp, Artificial Sequence
  Description of Artificial Sequence: Synthetic oligonucleotide
ctactacaaccagagcgaggccaggtc

SEQ ID NO: 383137 - DNA, 28 bp, Artificial Sequence
  Description of Artificial Sequence: Synthetic oligonucleotide
tactacaaccagagcgaggccaggtctc

SEQ ID NO: 383138 - DNA, 27 bp, Artificial Sequence
  Description of Artificial Sequence: Synthetic oligonucleotide
actacaaccagagcgaggccaggtctc

SEQ ID NO: 383139 - DNA, 27 bp, Artificial Sequence
  Description of Artificial Sequence: Synthetic oligonucleotide
ctacaaccagagcgaggccaggtctca

SEQ ID NO: 383140 - DNA, 27 bp, Artificial Sequence
  Description of Artificial Sequence: Synthetic oligonucleotide
tacaaccagagcgaggccaggtctcac

SEQ ID NO: 383141 - DNA, 27 bp, Artificial Sequence
  Description of Artificial Sequence: Synthetic oligonucleotide
acaaccagagcgaggccaggtctcaca

SEQ ID NO: 383142 - DNA, 27 bp, Artificial Sequence
  Description of Artificial Sequence: Synthetic oligonucleotide
caaccagagcgaggccaggtctcacat

SEQ ID NO: 383143 - DNA, 27 bp, Artificial Sequence
  Description of Artificial Sequence: Synthetic oligonucleotide
aaccagagcgaggccaggtctcacatc

SEQ ID NO: 383144 - DNA, 27 bp, Artificial Sequence
  Description of Artificial Sequence: Synthetic oligonucleotide
accagagcgaggccaggtctcacatca

SEQ ID NO: 383145 - DNA, 27 bp, Artificial Sequence
  Description of Artificial Sequence: Synthetic oligonucleotide
ccagagcgaggccaggtctcacatcat

SEQ ID NO: 383146 - DNA, 27 bp, Artificial Sequence
  Description of Artificial Sequence: Synthetic oligonucleotide
cagagcgaggccaggtctcacatcatc

SEQ ID NO: 383147 - DNA, 27 bp, Artificial Sequence
  Description of Artificial Sequence: Synthetic oligonucleotide
agagcgaggccaggtctcacatcatcc

SEQ ID NO: 383148 - DNA, 27 bp, Artificial Sequence
  Description of Artificial Sequence: Synthetic oligonucleotide
gagcgaggccaggtctcacatcatcca

SEQ ID NO: 383149 - DNA, 27 bp, Artificial Sequence
  Description of Artificial Sequence: Synthetic oligonucleotide
agcgaggccaggtctcacatcatccag

SEQ ID NO: 383150 - DNA, 27 bp, Artificial Sequence
  Description of Artificial Sequence: Synthetic oligonucleotide
gcgaggccaggtctcacatcatccaga

SEQ ID NO: 383151 - DNA, 27 bp, Artificial Sequence
  Description of Artificial Sequence: Synthetic oligonucleotide
cgaggccaggtctcacatcatccagag

SEQ ID NO: 383152 - DNA, 27 bp, Artificial Sequence
  Description of Artificial Sequence: Synthetic oligonucleotide
gaggccaggtctcacatcatccagagg

SEQ ID NO: 383153 - DNA, 29 bp, Artificial Sequence
  Description of Artificial Sequence: Synthetic oligonucleotide
aggccaggtctcacatcatccagaggatg

SEQ ID NO: 383154 - DNA, 28 bp, Artificial Sequence
  Description of Artificial Sequence: Synthetic oligonucleotide
ggccaggtctcacatcatccagaggatg

SEQ ID NO: 383155 - DNA, 31 bp, Artificial Sequence; identical to SEQ ID NO: 31770
  Description of Artificial Sequence: Synthetic oligonucleotide

SEQ ID NO: 383156 - DNA, 31 bp, Artificial Sequence; identical to SEQ ID NO: 31771
  Description of Artificial Sequence: Synthetic oligonucleotide

SEQ ID NO: 383157 - DNA, 31 bp, Artificial Sequence; identical to SEQ ID NO: 31772
  Description of Artificial Sequence: Synthetic oligonucleotide

SEQ ID NO: 383158 - DNA, 32 bp, Artificial Sequence; identical to SEQ ID NO: 31773
  Description of Artificial Sequence: Synthetic oligonucleotide

SEQ ID NO: 383159 - DNA, 20 bp, Artificial Sequence
  Description of Artificial Sequence: Synthetic oligonucleotide
gccgcggacacggcggcctt

SEQ ID NO: 383160 - DNA, 20 bp, Artificial Sequence
  Description of Artificial Sequence: Synthetic oligonucleotide
ccgcggacacggcggcccat

SEQ ID NO: 383161 - DNA, 21 bp, Artificial Sequence
  Description of Artificial Sequence: Synthetic oligonucleotide
cgcggacacggcggcccagat

SEQ ID NO: 383162 - DNA, 22 bp, Artificial Sequence
  Description of Artificial Sequence: Synthetic oligonucleotide
gcggacacggcggcccagatca

SEQ ID NO: 383163 - DNA, 22 bp, Artificial Sequence
  Description of Artificial Sequence: Synthetic oligonucleotide
cggacacggcggcccagatcac

SEQ ID NO: 383164 - DNA, 22 bp, Artificial Sequence
  Description of Artificial Sequence: Synthetic oligonucleotide
ggacacggcggcccagatcacc

SEQ ID NO: 383165 - DNA, 23 bp, Artificial Sequence
  Description of Artificial Sequence: Synthetic oligonucleotide
gacacggcggcccagatcaccca

SEQ ID NO: 383166 - DNA, 23 bp, Artificial Sequence
  Description of Artificial Sequence: Synthetic oligonucleotide
acacggcggcccagatcacccag

SEQ ID NO: 383167 - DNA, 22 bp, Artificial Sequence
  Description of Artificial Sequence: Synthetic oligonucleotide
cacggcggcccagatcacccag

SEQ ID NO: 383168 - DNA, 22 bp, Artificial Sequence
  Description of Artificial Sequence: Synthetic oligonucleotide
acggcggcccagatcacccagc

SEQ ID NO: 383169 - DNA, 21 bp, Artificial Sequence
  Description of Artificial Sequence: Synthetic oligonucleotide
cggcggcccagatcacccagc

SEQ ID NO: 383170 - DNA, 21 bp, Artificial Sequence
  Description of Artificial Sequence: Synthetic oligonucleotide
ggcggcccagatcacccagcg

SEQ ID NO: 383171 - DNA, 23 bp, Artificial Sequence
  Description of Artificial Sequence: Synthetic oligonucleotide
gcggcccagatcacccagcgcaa

SEQ ID NO: 383172 - DNA, 24 bp, Artificial Sequence
  Description of Artificial Sequence: Synthetic oligonucleotide
cggcccagatcacccagcgcaagt

SEQ ID NO: 383173 - DNA, 24 bp, Artificial Sequence
  Description of Artificial Sequence: Synthetic oligonucleotide
ggcccagatcacccagcgcaagtg

SEQ ID NO: 383174 - DNA, 24 bp, Artificial Sequence
  Description of Artificial Sequence: Synthetic oligonucleotide
gcccagatcacccagcgcaagtgg

SEQ ID NO: 383175 - DNA, 25 bp, Artificial Sequence
  Description of Artificial Sequence: Synthetic oligonucleotide
cccagatcacccagcgcaagtggga

SEQ ID NO: 383176 - DNA, 25 bp, Artificial Sequence
  Description of Artificial Sequence: Synthetic oligonucleotide
ccagatcacccagcgcaagtgggag

SEQ ID NO: 383177 - DNA, 27 bp, Artificial Sequence
  Description of Artificial Sequence: Synthetic oligonucleotide
agaggatgtatggctgcgacgtgggac

SEQ ID NO: 383178 - DNA, 26 bp, Artificial Sequence
  Description of Artificial Sequence: Synthetic oligonucleotide
gaggatgtatggctgcgacgtgggac

SEQ ID NO: 383179 - DNA, 26 bp, Artificial Sequence
  Description of Artificial Sequence: Synthetic oligonucleotide
aggatgtatggctgcgacgtgggacc

SEQ ID NO: 383180 - DNA, 25 bp, Artificial Sequence
  Description of Artificial Sequence: Synthetic oligonucleotide
ggatgtatggctgcgacgtgggacc

SEQ ID NO: 383181 - DNA, 25 bp, Artificial Sequence
  Description of Artificial Sequence: Synthetic oligonucleotide
gatgtatggctgcgacgtgggaccc

SEQ ID NO: 383182 - DNA, 26 bp, Artificial Sequence
  Description of Artificial Sequence: Synthetic oligonucleotide
atgtatggctgcgacgtgggacccga

SEQ ID NO: 383183 - DNA, 25 bp, Artificial Sequence
  Description of Artificial Sequence: Synthetic oligonucleotide
tgtatggctgcgacgtgggacccga

SEQ ID NO: 383184 - DNA, 24 bp, Artificial Sequence
  Description of Artificial Sequence: Synthetic oligonucleotide
gtatggctgcgacgtgggacccga

SEQ ID NO: 383185 - DNA, 24 bp, Artificial Sequence
  Description of Artificial Sequence: Synthetic oligonucleotide
tatggctgcgacgtgggacccgac

SEQ ID NO: 383186 - DNA, 23 bp, Artificial Sequence
  Description of Artificial Sequence: Synthetic oligonucleotide
atggctgcgacgtgggacccgac

SEQ ID NO: 383187 - DNA, 22 bp, Artificial Sequence
  Description of Artificial Sequence: Synthetic oligonucleotide
tggctgcgacgtgggacccgac

SEQ ID NO: 383188 - DNA, 21 bp, Artificial Sequence
  Description of Artificial Sequence: Synthetic oligonucleotide
ggctgcgacgtgggacccgac

SEQ ID NO: 383189 - DNA, 21 bp, Artificial Sequence
  Description of Artificial Sequence: Synthetic oligonucleotide
gctgcgacgtgggacccgacg

SEQ ID NO: 383190 - DNA, 21 bp, Artificial Sequence
  Description of Artificial Sequence: Synthetic oligonucleotide
ctgcgacgtgggacccgacgg

SEQ ID NO: 383191 - DNA, 21 bp, Artificial Sequence
  Description of Artificial Sequence: Synthetic oligonucleotide
tgcgacgtgggacccgacggg

SEQ ID NO: 383192 - DNA, 20 bp, Artificial Sequence
  Description of Artificial Sequence: Synthetic oligonucleotide
gcgacgtgggacccgacggg

SEQ ID NO: 383193 - DNA, 20 bp, Artificial Sequence
  Description of Artificial Sequence: Synthetic oligonucleotide
cgacgtgggacccgacgggc

SEQ ID NO: 383194 - DNA, 20 bp, Artificial Sequence
  Description of Artificial Sequence: Synthetic oligonucleotide
gacgtgggacccgacgggcg

SEQ ID NO: 383195 - DNA, 20 bp, Artificial Sequence
  Description of Artificial Sequence: Synthetic oligonucleotide
acgtgggacccgacgggcgc

SEQ ID NO: 383196 - DNA, 20 bp, Artificial Sequence
  Description of Artificial Sequence: Synthetic oligonucleotide
cgtgggacccgacgggcgct

SEQ ID NO: 383197 - DNA, 20 bp, Artificial Sequence
  Description of Artificial Sequence: Synthetic oligonucleotide
gtgggacccgacgggcgcct

SEQ ID NO: 383198 - DNA, 20 bp, Artificial Sequence
  Description of Artificial Sequence: Synthetic oligonucleotide
tgggacccgacgggcgcctc

SEQ ID NO: 383199 - DNA, 20 bp, Artificial Sequence
  Description of Artificial Sequence: Synthetic oligonucleotide
gggacccgacgggcgcctct

SEQ ID NO: 383200 - DNA, 20 bp, Artificial Sequence
  Description of Artificial Sequence: Synthetic oligonucleotide
ggacccgacgggcgcctcct

SEQ ID NO: 383201 - DNA, 20 bp, Artificial Sequence
  Description of Artificial Sequence: Synthetic oligonucleotide
gacccgacgggcgcctcctc

SEQ ID NO: 383202 - DNA, 20 bp, Artificial Sequence
  Description of Artificial Sequence: Synthetic oligonucleotide
acccgacgggcgcctcctcc

SEQ ID NO: 383203 - DNA, 30 bp, Artificial Sequence; identical to SEQ ID NO: 43095
  Description of Artificial Sequence: Synthetic oligonucleotide

SEQ ID NO: 383204 - DNA, 30 bp, Artificial Sequence; identical to SEQ ID NO: 43096
  Description of Artificial Sequence: Synthetic oligonucleotide

SEQ ID NO: 383205 - DNA, 30 bp, Artificial Sequence; identical to SEQ ID NO: 43097
  Description of Artificial Sequence: Synthetic oligonucleotide

SEQ ID NO: 383206 - DNA, 30 bp, Artificial Sequence; identical to SEQ ID NO: 43098
  Description of Artificial Sequence: Synthetic oligonucleotide

SEQ ID NO: 383207 - DNA, 20 bp, Artificial Sequence
  Description of Artificial Sequence: Synthetic oligonucleotide
ggaggcggcccgtgaggcct

SEQ ID NO: 383208 - DNA, 20 bp, Artificial Sequence
  Description of Artificial Sequence: Synthetic oligonucleotide
gaggcggcccgtgaggccga

SEQ ID NO: 383209 - DNA, 20 bp, Artificial Sequence
  Description of Artificial Sequence: Synthetic oligonucleotide
aggcggcccgtgaggccgag

SEQ ID NO: 383210 - DNA, 20 bp, Artificial Sequence
  Description of Artificial Sequence: Synthetic oligonucleotide
ggcggcccgtgaggccgagt

SEQ ID NO: 383211 - DNA, 20 bp, Artificial Sequence
  Description of Artificial Sequence: Synthetic oligonucleotide
gcggcccgtgaggccgagca

SEQ ID NO: 383212 - DNA, 20 bp, Artificial Sequence
  Description of Artificial Sequence: Synthetic oligonucleotide
cggcccgtgaggccgagcag

SEQ ID NO: 383213 - DNA, 21 bp, Artificial Sequence
  Description of Artificial Sequence: Synthetic oligonucleotide
ggcccgtgaggccgagcagct

SEQ ID NO: 383214 - DNA, 22 bp, Artificial Sequence
  Description of Artificial Sequence: Synthetic oligonucleotide
gcccgtgaggccgagcagctga

SEQ ID NO: 383215 - DNA, 23 bp, Artificial Sequence
  Description of Artificial Sequence: Synthetic oligonucleotide
cccgtgaggccgagcagctgaga

SEQ ID NO: 383216 - DNA, 23 bp, Artificial Sequence
  Description of Artificial Sequence: Synthetic oligonucleotide
ccgtgaggccgagcagctgagag

SEQ ID NO: 383217 - DNA, 23 bp, Artificial Sequence
  Description of Artificial Sequence: Synthetic oligonucleotide
cgtgaggccgagcagctgagagc

SEQ ID NO: 383218 - DNA, 25 bp, Artificial Sequence
  Description of Artificial Sequence: Synthetic oligonucleotide
gtgaggccgagcagctgagagccta

SEQ ID NO: 383219 - DNA, 25 bp, Artificial Sequence
  Description of Artificial Sequence: Synthetic oligonucleotide
tgaggccgagcagctgagagcctac

SEQ ID NO: 383220 - DNA, 24 bp, Artificial Sequence
  Description of Artificial Sequence: Synthetic oligonucleotide
gaggccgagcagctgagagcctac

SEQ ID NO: 383221 - DNA, 25 bp, Artificial Sequence
  Description of Artificial Sequence: Synthetic oligonucleotide
aggccgagcagctgagagcctacct

SEQ ID NO: 383222 - DNA, 23 bp, Artificial Sequence
  Description of Artificial Sequence: Synthetic oligonucleotide
cggacacggcggctcagatcacg

SEQ ID NO: 383223 - DNA, 24 bp, Artificial Sequence
  Description of Artificial Sequence: Synthetic oligonucleotide
ggacacggcggctcagatcacgca

SEQ ID NO: 383224 - DNA, 24 bp, Artificial Sequence
  Description of Artificial Sequence: Synthetic oligonucleotide
gacacggcggctcagatcacgcag

SEQ ID NO: 383225 - DNA, 24 bp, Artificial Sequence
  Description of Artificial Sequence: Synthetic oligonucleotide
acacggcggctcagatcacgcagc

SEQ ID NO: 383226 - DNA, 23 bp, Artificial Sequence
  Description of Artificial Sequence: Synthetic oligonucleotide
cacggcggctcagatcacgcagc

SEQ ID NO: 383227 - DNA, 23 bp, Artificial Sequence
  Description of Artificial Sequence: Synthetic oligonucleotide
acggcggctcagatcacgcagcg

SEQ ID NO: 383228 - DNA, 22 bp, Artificial Sequence
  Description of Artificial Sequence: Synthetic oligonucleotide
cggcggctcagatcacgcagcg

SEQ ID NO: 383229 - DNA, 23 bp, Artificial Sequence
  Description of Artificial Sequence: Synthetic oligonucleotide
atctgcgctcctggaccgccgca

SEQ ID NO: 383230 - DNA, 22 bp, Artificial Sequence
  Description of Artificial Sequence: Synthetic oligonucleotide
tctgcgctcctggaccgccgca

SEQ ID NO: 383231 - DNA, 28 bp, Artificial Sequence
  Description of Artificial Sequence: Synthetic oligonucleotide
tatttctacaccgctgtgtcccggcctg

SEQ ID NO: 383232 - DNA, 27 bp, Artificial Sequence
  Description of Artificial Sequence: Synthetic oligonucleotide
atttctacaccgctgtgtcccggcctg

SEQ ID NO: 383233 - DNA, 26 bp, Artificial Sequence
  Description of Artificial Sequence: Synthetic oligonucleotide
tttctacaccgctgtgtcccggcctg

SEQ ID NO: 383234 - DNA, 25 bp, Artificial Sequence
  Description of Artificial Sequence: Synthetic oligonucleotide
ttctacaccgctgtgtcccggcctg

SEQ ID NO: 383235 - DNA, 24 bp, Artificial Sequence
  Description of Artificial Sequence: Synthetic oligonucleotide
tctacaccgctgtgtcccggcctg

SEQ ID NO: 383236 - DNA, 23 bp, Artificial Sequence
  Description of Artificial Sequence: Synthetic oligonucleotide
ctacaccgctgtgtcccggcctg

SEQ ID NO: 383237 - DNA, 23 bp, Artificial Sequence
  Description of Artificial Sequence: Synthetic oligonucleotide
tacaccgctgtgtcccggcctgg

SEQ ID NO: 383238 - DNA, 22 bp, Artificial Sequence
  Description of Artificial Sequence: Synthetic oligonucleotide
acaccgctgtgtcccggcctgg

SEQ ID NO: 383239 - DNA, 21 bp, Artificial Sequence
  Description of Artificial Sequence: Synthetic oligonucleotide
caccgctgtgtcccggcctgg

SEQ ID NO: 383240 - DNA, 21 bp, Artificial Sequence
  Description of Artificial Sequence: Synthetic oligonucleotide
accgctgtgtcccggcctggc

SEQ ID NO: 383241 - DNA, 20 bp, Artificial Sequence
  Description of Artificial Sequence: Synthetic oligonucleotide
ccgctgtgtcccggcctggc

SEQ ID NO: 383242 - DNA, 20 bp, Artificial Sequence
  Description of Artificial Sequence: Synthetic oligonucleotide
cgctgtgtcccggcctggcc

SEQ ID NO: 383243 - DNA, 20 bp, Artificial Sequence
  Description of Artificial Sequence: Synthetic oligonucleotide
gctgtgtcccggcctggccg

SEQ ID NO: 383244 - DNA, 20 bp, Artificial Sequence
  Description of Artificial Sequence: Synthetic oligonucleotide
ctgtgtcccggcctggccgc

SEQ ID NO: 383245 - DNA, 20 bp, Artificial Sequence
  Description of Artificial Sequence: Synthetic oligonucleotide
tgtgtcccggcctggccgcg

SEQ ID NO: 383246 - DNA, 20 bp, Artificial Sequence
  Description of Artificial Sequence: Synthetic oligonucleotide
ctggccgcggggagccccat

SEQ ID NO: 383247 - DNA, 21 bp, Artificial Sequence
  Description of Artificial Sequence: Synthetic oligonucleotide
tggccgcggggagccccactt

SEQ ID NO: 383248 - DNA, 24 bp, Artificial Sequence
  Description of Artificial Sequence: Synthetic oligonucleotide
cggttcgacagcgacgctgcgagt

SEQ ID NO: 383249 - DNA, 24 bp, Artificial Sequence
  Description of Artificial Sequence: Synthetic oligonucleotide
acagcgacgctgcgagtccgagag

SEQ ID NO: 383250 - DNA, 23 bp, Artificial Sequence
  Description of Artificial Sequence: Synthetic oligonucleotide
cagcgacgctgcgagtccgagag

SEQ ID NO: 383251 - DNA, 23 bp, Artificial Sequence
  Description of Artificial Sequence: Synthetic oligonucleotide
agcgacgctgcgagtccgagagg

SEQ ID NO: 383252 - DNA, 22 bp, Artificial Sequence
  Description of Artificial Sequence: Synthetic oligonucleotide
gcgacgctgcgagtccgagagg

SEQ ID NO: 383253 - DNA, 22 bp, Artificial Sequence
  Description of Artificial Sequence: Synthetic oligonucleotide
cgacgctgcgagtccgagaggg

SEQ ID NO: 383254 - DNA, 23 bp, Artificial Sequence
  Description of Artificial Sequence: Synthetic oligonucleotide
gacgctgcgagtccgagagggga

SEQ ID NO: 383255 - DNA, 23 bp, Artificial Sequence
  Description of Artificial Sequence: Synthetic oligonucleotide
acgctgcgagtccgagaggggag

SEQ ID NO: 383256 - DNA, 22 bp, Artificial Sequence
  Description of Artificial Sequence: Synthetic oligonucleotide
cgctgcgagtccgagaggggag

SEQ ID NO: 383257 - DNA, 22 bp, Artificial Sequence
  Description of Artificial Sequence: Synthetic oligonucleotide
gctgcgagtccgagaggggagc

SEQ ID NO: 383258 - DNA, 22 bp, Artificial Sequence
  Description of Artificial Sequence: Synthetic oligonucleotide
ctgcgagtccgagaggggagcc

SEQ ID NO: 383259 - DNA, 22 bp, Artificial Sequence
  Description of Artificial Sequence: Synthetic oligonucleotide
tgcgagtccgagaggggagccg

SEQ ID NO: 383260 - DNA, 20 bp, Artificial Sequence
  Description of Artificial Sequence: Synthetic oligonucleotide
ccggccgcggagagccccat

SEQ ID NO: 383261 - DNA, 21 bp, Artificial Sequence
  Description of Artificial Sequence: Synthetic oligonucleotide
cggccgcggagagccccactt

SEQ ID NO: 383262 - DNA, 23 bp, Artificial Sequence
  Description of Artificial Sequence: Synthetic oligonucleotide
ggccgcggagagccccacttcat

SEQ ID NO: 383263 - DNA, 21 bp, Artificial Sequence
  Description of Artificial Sequence: Synthetic oligonucleotide
gggcgcctcctccgcggctat

SEQ ID NO: 383264 - DNA, 22 bp, Artificial Sequence
  Description of Artificial Sequence: Synthetic oligonucleotide
ggcgcctcctccgcggctatga

SEQ ID NO: 383265 - DNA, 22 bp, Artificial Sequence
  Description of Artificial Sequence: Synthetic oligonucleotide
gcgcctcctccgcggctatgac

SEQ ID NO: 383266 - DNA, 23 bp, Artificial Sequence
  Description of Artificial Sequence: Synthetic oligonucleotide
cgcctcctccgcggctatgacca

SEQ ID NO: 383267 - DNA, 25 bp, Artificial Sequence
  Description of Artificial Sequence: Synthetic oligonucleotide
gcctcctccgcggctatgaccagta

SEQ ID NO: 383268 - DNA, 25 bp, Artificial Sequence
  Description of Artificial Sequence: Synthetic oligonucleotide
cctcctccgcggctatgaccagtac

SEQ ID NO: 383269 - DNA, 25 bp, Artificial Sequence
  Description of Artificial Sequence: Synthetic oligonucleotide
ctcctccgcggctatgaccagtacg

SEQ ID NO: 383270 - DNA, 25 bp, Artificial Sequence
  Description of Artificial Sequence: Synthetic oligonucleotide
tcctccgcggctatgaccagtacgc

SEQ ID NO: 383271 - DNA, 24 bp, Artificial Sequence
  Description of Artificial Sequence: Synthetic oligonucleotide
cctccgcggctatgaccagtacgc

SEQ ID NO: 383272 - DNA, 26 bp, Artificial Sequence
  Description of Artificial Sequence: Synthetic oligonucleotide
ctccgcggctatgaccagtacgccta

SEQ ID NO: 383273 - DNA, 26 bp, Artificial Sequence
  Description of Artificial Sequence: Synthetic oligonucleotide
tccgcggctatgaccagtacgcctac

SEQ ID NO: 383274 - DNA, 25 bp, Artificial Sequence
  Description of Artificial Sequence: Synthetic oligonucleotide
ccgcggctatgaccagtacgcctac

SEQ ID NO: 383275 - DNA, 26 bp, Artificial Sequence
  Description of Artificial Sequence: Synthetic oligonucleotide
cgcggctatgaccagtacgcctacga

SEQ ID NO: 383276 - DNA, 26 bp, Artificial Sequence
  Description of Artificial Sequence: Synthetic oligonucleotide
gcggctatgaccagtacgcctacgac

SEQ ID NO: 383277 - DNA, 26 bp, Artificial Sequence
  Description of Artificial Sequence: Synthetic oligonucleotide
cggctatgaccagtacgcctacgacg

SEQ ID NO: 383278 - DNA, 26 bp, Artificial Sequence
  Description of Artificial Sequence: Synthetic oligonucleotide
ggctatgaccagtacgcctacgacgg

SEQ ID NO: 383279 - DNA, 27 bp, Artificial Sequence
  Description of Artificial Sequence: Synthetic oligonucleotide
gctatgaccagtacgcctacgacggca

SEQ ID NO: 383280 - DNA, 28 bp, Artificial Sequence
  Description of Artificial Sequence: Synthetic oligonucleotide
ctatgaccagtacgcctacgacggcaag

SEQ ID NO: 383281 - DNA, 27 bp, Artificial Sequence
  Description of Artificial Sequence: Synthetic oligonucleotide
cagactgaccgagtgagcctgcggaat

SEQ ID NO: 383282 - DNA, 27 bp, Artificial Sequence
  Description of Artificial Sequence: Synthetic oligonucleotide
agactgaccgagtgagcctgcggaatc

SEQ ID NO: 383283 - DNA, 27 bp, Artificial Sequence
  Description of Artificial Sequence: Synthetic oligonucleotide
gactgaccgagtgagcctgcggaatct

SEQ ID NO: 383284 - DNA, 27 bp, Artificial Sequence
  Description of Artificial Sequence: Synthetic oligonucleotide
actgaccgagtgagcctgcggaatctg

SEQ ID NO: 383285 - DNA, 26 bp, Artificial Sequence
  Description of Artificial Sequence: Synthetic oligonucleotide
ctgaccgagtgagcctgcggaatctg

SEQ ID NO: 383286 - DNA, 26 bp, Artificial Sequence
  Description of Artificial Sequence: Synthetic oligonucleotide
tgaccgagtgagcctgcggaatctgc

SEQ ID NO: 383287 - DNA, 25 bp, Artificial Sequence
  Description of Artificial Sequence: Synthetic oligonucleotide
gaccgagtgagcctgcggaatctgc

SEQ ID NO: 383288 - DNA, 25 bp, Artificial Sequence
  Description of Artificial Sequence: Synthetic oligonucleotide
accgagtgagcctgcggaatctgcg

SEQ ID NO: 383289 - DNA, 24 bp, Artificial Sequence
  Description of Artificial Sequence: Synthetic oligonucleotide
ccgagtgagcctgcggaatctgcg

SEQ ID NO: 383290 - DNA, 24 bp, Artificial Sequence
  Description of Artificial Sequence: Synthetic oligonucleotide
cgagtgagcctgcggaatctgcgc

SEQ ID NO: 383291 - DNA, 24 bp, Artificial Sequence
  Description of Artificial Sequence: Synthetic oligonucleotide
gagtgagcctgcggaatctgcgcg

SEQ ID NO: 383292 - DNA, 24 bp, Artificial Sequence
  Description of Artificial Sequence: Synthetic oligonucleotide
agtgagcctgcggaatctgcgcgg

SEQ ID NO: 383293 - DNA, 23 bp, Artificial Sequence
  Description of Artificial Sequence: Synthetic oligonucleotide
gtgagcctgcggaatctgcgcgg

SEQ ID NO: 383294 - DNA, 25 bp, Artificial Sequence
  Description of Artificial Sequence: Synthetic oligonucleotide
tgagcctgcggaatctgcgcggcta

SEQ ID NO: 383295 - DNA, 24 bp, Artificial Sequence
  Description of Artificial Sequence: Synthetic oligonucleotide
gagcctgcggaatctgcgcggcta

SEQ ID NO: 383296 - DNA, 26 bp, Artificial Sequence
  Description of Artificial Sequence: Synthetic oligonucleotide
agcctgcggaatctgcgcggctacta

SEQ ID NO: 383297 - DNA, 25 bp, Artificial Sequence
  Description of Artificial Sequence: Synthetic oligonucleotide
gcctgcggaatctgcgcggctacta

SEQ ID NO: 383298 - DNA, 27 bp, Artificial Sequence
  Description of Artificial Sequence: Synthetic oligonucleotide
cctgcggaatctgcgcggctactacaa

SEQ ID NO: 383299 - DNA, 27 bp, Artificial Sequence
  Description of Artificial Sequence: Synthetic oligonucleotide
ctgcggaatctgcgcggctactacaac

SEQ ID NO: 383300 - DNA, 27 bp, Artificial Sequence
  Description of Artificial Sequence: Synthetic oligonucleotide
tgcggaatctgcgcggctactacaacc

SEQ ID NO: 383301 - DNA, 27 bp, Artificial Sequence
  Description of Artificial Sequence: Synthetic oligonucleotide
gcggaatctgcgcggctactacaacca

SEQ ID NO: 383302 - DNA, 27 bp, Artificial Sequence
  Description of Artificial Sequence: Synthetic oligonucleotide
cggaatctgcgcggctactacaaccag

SEQ ID NO: 383303 - DNA, 28 bp, Artificial Sequence
  Description of Artificial Sequence: Synthetic oligonucleotide
ggaatctgcgcggctactacaaccagag

SEQ ID NO: 383304 - DNA, 28 bp, Artificial Sequence
  Description of Artificial Sequence: Synthetic oligonucleotide
gaatctgcgcggctactacaaccagagc

SEQ ID NO: 383305 - DNA, 28 bp, Artificial Sequence
  Description of Artificial Sequence: Synthetic oligonucleotide
aatctgcgcggctactacaaccagagcg

SEQ ID NO: 383306 - DNA, 27 bp, Artificial Sequence
  Description of Artificial Sequence: Synthetic oligonucleotide
atctgcgcggctactacaaccagagcg

SEQ ID NO: 383307 - DNA, 27 bp, Artificial Sequence
  Description of Artificial Sequence: Synthetic oligonucleotide
tctgcgcggctactacaaccagagcga

SEQ ID NO: 383308 - DNA, 23 bp, Artificial Sequence
  Description of Artificial Sequence: Synthetic oligonucleotide
aggatctgcgctcctggaccgcg

SEQ ID NO: 383309 - DNA, 22 bp, Artificial Sequence
  Description of Artificial Sequence: Synthetic oligonucleotide
ggatctgcgctcctggaccgcg

SEQ ID NO: 383310 - DNA, 22 bp, Artificial Sequence
  Description of Artificial Sequence: Synthetic oligonucleotide
gatctgcgctcctggaccgcgg

SEQ ID NO: 383311 - DNA, 22 bp, Artificial Sequence
  Description of Artificial Sequence: Synthetic oligonucleotide
atctgcgctcctggaccgcggc

SEQ ID NO: 383312 - DNA, 21 bp, Artificial Sequence
  Description of Artificial Sequence: Synthetic oligonucleotide
tctgcgctcctggaccgcggc

SEQ ID NO: 383313 - DNA, 24 bp, Artificial Sequence
  Description of Artificial Sequence: Synthetic oligonucleotide
gccggagtattgggaccgggagac

SEQ ID NO: 383314 - DNA, 24 bp, Artificial Sequence
  Description of Artificial Sequence: Synthetic oligonucleotide
ccggagtattgggaccgggagacg

SEQ ID NO: 383315 - DNA, 25 bp, Artificial Sequence
  Description of Artificial Sequence: Synthetic oligonucleotide
cggagtattgggaccgggagacgca

SEQ ID NO: 383316 - DNA, 27 bp, Artificial Sequence
  Description of Artificial Sequence: Synthetic oligonucleotide
ggagtattgggaccgggagacgcagaa

SEQ ID NO: 383317 - DNA, 27 bp, Artificial Sequence
  Description of Artificial Sequence: Synthetic oligonucleotide
gagtattgggaccgggagacgcagaag

SEQ ID NO: 383318 - DNA, 29 bp, Artificial Sequence
  Description of Artificial Sequence: Synthetic oligonucleotide
agtattgggaccgggagacgcagaagtac

SEQ ID NO: 383319 - DNA, 28 bp, Artificial Sequence
  Description of Artificial Sequence: Synthetic oligonucleotide
gtattgggaccgggagacgcagaagtac

SEQ ID NO: 383320 - DNA, 30 bp, Artificial Sequence; identical to SEQ ID NO: 43160
  Description of Artificial Sequence: Synthetic oligonucleotide

SEQ ID NO: 383321 - DNA, 29 bp, Artificial Sequence
  Description of Artificial Sequence: Synthetic oligonucleotide
attgggaccgggagacgcagaagtacaag

SEQ ID NO: 383322 - DNA, 28 bp, Artificial Sequence
  Description of Artificial Sequence: Synthetic oligonucleotide
ttgggaccgggagacgcagaagtacaag

SEQ ID NO: 383323 - DNA, 27 bp, Artificial Sequence
  Description of Artificial Sequence: Synthetic oligonucleotide
tgggaccgggagacgcagaagtacaag

SEQ ID NO: 383324 - DNA, 26 bp, Artificial Sequence
  Description of Artificial Sequence: Synthetic oligonucleotide
gggaccgggagacgcagaagtacaag

SEQ ID NO: 383325 - DNA, 26 bp, Artificial Sequence
  Description of Artificial Sequence: Synthetic oligonucleotide
ggaccgggagacgcagaagtacaagc

SEQ ID NO: 383326 - DNA, 26 bp, Artificial Sequence
  Description of Artificial Sequence: Synthetic oligonucleotide
gaccgggagacgcagaagtacaagcg

SEQ ID NO: 383327 - DNA, 26 bp, Artificial Sequence
  Description of Artificial Sequence: Synthetic oligonucleotide
accgggagacgcagaagtacaagcgc

SEQ ID NO: 383328 - DNA, 25 bp, Artificial Sequence
  Description of Artificial Sequence: Synthetic oligonucleotide
ccgggagacgcagaagtacaagcgc

SEQ ID NO: 383329 - DNA, 26 bp, Artificial Sequence
  Description of Artificial Sequence: Synthetic oligonucleotide
cgggagacgcagaagtacaagcgcca

SEQ ID NO: 383330 - DNA, 26 bp, Artificial Sequence
  Description of Artificial Sequence: Synthetic oligonucleotide
gggagacgcagaagtacaagcgccag

SEQ ID NO: 383331 - DNA, 26 bp, Artificial Sequence
  Description of Artificial Sequence: Synthetic oligonucleotide
ggagacgcagaagtacaagcgccagg

SEQ ID NO: 383332 - DNA, 27 bp, Artificial Sequence
  Description of Artificial Sequence: Synthetic oligonucleotide
gagacgcagaagtacaagcgccaggca

SEQ ID NO: 383333 - DNA, 27 bp, Artificial Sequence
  Description of Artificial Sequence: Synthetic oligonucleotide
agacgcagaagtacaagcgccaggcac

SEQ ID NO: 383334 - DNA, 27 bp, Artificial Sequence
  Description of Artificial Sequence: Synthetic oligonucleotide
gacgcagaagtacaagcgccaggcaca

SEQ ID NO: 383335 - DNA, 27 bp, Artificial Sequence
  Description of Artificial Sequence: Synthetic oligonucleotide
acgcagaagtacaagcgccaggcacag

SEQ ID NO: 383336 - DNA, 27 bp, Artificial Sequence
  Description of Artificial Sequence: Synthetic oligonucleotide
cgcagaagtacaagcgccaggcacaga

SEQ ID NO: 383337 - DNA, 27 bp, Artificial Sequence
  Description of Artificial Sequence: Synthetic oligonucleotide
gcagaagtacaagcgccaggcacagac

SEQ ID NO: 383338 - DNA, 23 bp, Artificial Sequence
  Description of Artificial Sequence: Synthetic oligonucleotide
ggaaggagacgctgcagcgcgct

SEQ ID NO: 383339 - DNA, 23 bp, Artificial Sequence
  Description of Artificial Sequence: Synthetic oligonucleotide
gaaggagacgctgcagcgcgctg

SEQ ID NO: 383340 - DNA, 27 bp, Artificial Sequence
  Description of Artificial Sequence: Synthetic oligonucleotide
atcgcagtgggctacgtggacgacaca

SEQ ID NO: 383341 - DNA, 26 bp, Artificial Sequence
  Description of Artificial Sequence: Synthetic oligonucleotide
tcgcagtgggctacgtggacgacaca

SEQ ID NO: 383342 - DNA, 25 bp, Artificial Sequence
  Description of Artificial Sequence: Synthetic oligonucleotide
cgcagtgggctacgtggacgacaca

SEQ ID NO: 383343 - DNA, 26 bp, Artificial Sequence
  Description of Artificial Sequence: Synthetic oligonucleotide
gcagtgggctacgtggacgacacaca

SEQ ID NO: 383344 - DNA, 27 bp, Artificial Sequence
  Description of Artificial Sequence: Synthetic oligonucleotide
gctacgtggacgacacacagttcgtgc

SEQ ID NO: 383345 - DNA, 27 bp, Artificial Sequence
  Description of Artificial Sequence: Synthetic oligonucleotide
ctacgtggacgacacacagttcgtgcg

SEQ ID NO: 383346 - DNA, 27 bp, Artificial Sequence
  Description of Artificial Sequence: Synthetic oligonucleotide
tacgtggacgacacacagttcgtgcgg

SEQ ID NO: 383347 - DNA, 27 bp, Artificial Sequence
  Description of Artificial Sequence: Synthetic oligonucleotide
acgtggacgacacacagttcgtgcggt

SEQ ID NO: 383348 - DNA, 27 bp, Artificial Sequence
  Description of Artificial Sequence: Synthetic oligonucleotide
cgtggacgacacacagttcgtgcggtt

SEQ ID NO: 383349 - DNA, 27 bp, Artificial Sequence
  Description of Artificial Sequence: Synthetic oligonucleotide
gtggacgacacacagttcgtgcggttc

SEQ ID NO: 383350 - DNA, 27 bp, Artificial Sequence
  Description of Artificial Sequence: Synthetic oligonucleotide
tggacgacacacagttcgtgcggttcg

SEQ ID NO: 383351 - DNA, 27 bp, Artificial Sequence
  Description of Artificial Sequence: Synthetic oligonucleotide
ggacgacacacagttcgtgcggttcga

SEQ ID NO: 383352 - DNA, 27 bp, Artificial Sequence
  Description of Artificial Sequence: Synthetic oligonucleotide
gacgacacacagttcgtgcggttcgac

SEQ ID NO: 383353 - DNA, 28 bp, Artificial Sequence
  Description of Artificial Sequence: Synthetic oligonucleotide
acgacacacagttcgtgcggttcgacag

SEQ ID NO: 383354 - DNA, 27 bp, Artificial Sequence
  Description of Artificial Sequence: Synthetic oligonucleotide
cgacacacagttcgtgcggttcgacag

SEQ ID NO: 383355 - DNA, 27 bp, Artificial Sequence
  Description of Artificial Sequence: Synthetic oligonucleotide
gacacacagttcgtgcggttcgacagc

SEQ ID NO: 383356 - DNA, 27 bp, Artificial Sequence
  Description of Artificial Sequence: Synthetic oligonucleotide
acacacagttcgtgcggttcgacagcg

SEQ ID NO: 383357 - DNA, 27 bp, Artificial Sequence
  Description of Artificial Sequence: Synthetic oligonucleotide
cacacagttcgtgcggttcgacagcga

SEQ ID NO: 383358 - DNA, 27 bp, Artificial Sequence
  Description of Artificial Sequence: Synthetic oligonucleotide
acacagttcgtgcggttcgacagcgac

SEQ ID NO: 383359 - DNA, 26 bp, Artificial Sequence
  Description of Artificial Sequence: Synthetic oligonucleotide
cacagttcgtgcggttcgacagcgac

SEQ ID NO: 383360 - DNA, 26 bp, Artificial Sequence
  Description of Artificial Sequence: Synthetic oligonucleotide
acagttcgtgcggttcgacagcgacg

SEQ ID NO: 383361 - DNA, 29 bp, Artificial Sequence
  Description of Artificial Sequence: Synthetic oligonucleotide
tggagtggctccgcagatacctgaagaac

SEQ ID NO: 383362 - DNA, 28 bp, Artificial Sequence
  Description of Artificial Sequence: Synthetic oligonucleotide
ggagtggctccgcagatacctgaagaac

SEQ ID NO: 383363 - DNA, 28 bp, Artificial Sequence
  Description of Artificial Sequence: Synthetic oligonucleotide
gagtggctccgcagatacctgaagaacg

SEQ ID NO: 383364 - DNA, 28 bp, Artificial Sequence
  Description of Artificial Sequence: Synthetic oligonucleotide
agtggctccgcagatacctgaagaacgg

SEQ ID NO: 383365 - DNA, 27 bp, Artificial Sequence
  Description of Artificial Sequence: Synthetic oligonucleotide
gtggctccgcagatacctgaagaacgg

SEQ ID NO: 383366 - DNA, 27 bp, Artificial Sequence
  Description of Artificial Sequence: Synthetic oligonucleotide
tggctccgcagatacctgaagaacggg

SEQ ID NO: 383367 - DNA, 27 bp, Artificial Sequence
  Description of Artificial Sequence: Synthetic oligonucleotide
ggctccgcagatacctgaagaacggga

SEQ ID NO: 383368 - DNA, 28 bp, Artificial Sequence
  Description of Artificial Sequence: Synthetic oligonucleotide
gctccgcagatacctgaagaacgggaag

SEQ ID NO: 383369 - DNA, 28 bp, Artificial Sequence
  Description of Artificial Sequence: Synthetic oligonucleotide
ctccgcagatacctgaagaacgggaagg

SEQ ID NO: 383370 - DNA, 29 bp, Artificial Sequence
  Description of Artificial Sequence: Synthetic oligonucleotide
tccgcagatacctgaagaacgggaaggag

SEQ ID NO: 383371 - DNA, 28 bp, Artificial Sequence
  Description of Artificial Sequence: Synthetic oligonucleotide
ccgcagatacctgaagaacgggaaggag

SEQ ID NO: 383372 - DNA, 29 bp, Artificial Sequence
  Description of Artificial Sequence: Synthetic oligonucleotide
cgcagatacctgaagaacgggaaggagac

SEQ ID NO: 383373 - DNA, 29 bp, Artificial Sequence
  Description of Artificial Sequence: Synthetic oligonucleotide
gcagatacctgaagaacgggaaggagacg

SEQ ID NO: 383374 - DNA, 29 bp, Artificial Sequence
  Description of Artificial Sequence: Synthetic oligonucleotide
cagatacctgaagaacgggaaggagacgc

SEQ ID NO: 383375 - DNA, 30 bp, Artificial Sequence; identical to SEQ ID NO: 17321
  Description of Artificial Sequence: Synthetic oligonucleotide

SEQ ID NO: 383376 - DNA, 29 bp, Artificial Sequence
  Description of Artificial Sequence: Synthetic oligonucleotide
gatacctgaagaacgggaaggagacgctg

SEQ ID NO: 383377 - DNA, 29 bp, Artificial Sequence
  Description of Artificial Sequence: Synthetic oligonucleotide
atacctgaagaacgggaaggagacgctgc

SEQ ID NO: 383378 - DNA, 28 bp, Artificial Sequence
  Description of Artificial Sequence: Synthetic oligonucleotide
tacctgaagaacgggaaggagacgctgc

SEQ ID NO: 383379 - DNA, 27 bp, Artificial Sequence
  Description of Artificial Sequence: Synthetic oligonucleotide
acctgaagaacgggaaggagacgctgc

SEQ ID NO: 383380 - DNA, 27 bp, Artificial Sequence
  Description of Artificial Sequence: Synthetic oligonucleotide
cctgaagaacgggaaggagacgctgca

SEQ ID NO: 383381 - DNA, 27 bp, Artificial Sequence
  Description of Artificial Sequence: Synthetic oligonucleotide
ctgaagaacgggaaggagacgctgcag

SEQ ID NO: 383382 - DNA, 27 bp, Artificial Sequence
  Description of Artificial Sequence: Synthetic oligonucleotide
tgaagaacgggaaggagacgctgcagc

SEQ ID NO: 383383 - DNA, 26 bp, Artificial Sequence
  Description of Artificial Sequence: Synthetic oligonucleotide
gaagaacgggaaggagacgctgcagc

SEQ ID NO: 383384 - DNA, 26 bp, Artificial Sequence
  Description of Artificial Sequence: Synthetic oligonucleotide
aagaacgggaaggagacgctgcagcg

SEQ ID NO: 383385 - DNA, 21 bp, Artificial Sequence
  Description of Artificial Sequence: Synthetic oligonucleotide
tgggtggagcaggaggggccc

SEQ ID NO: 383386 - DNA, 20 bp, Artificial Sequence
  Description of Artificial Sequence: Synthetic oligonucleotide
gggtggagcaggaggggccc

SEQ ID NO: 383387 - DNA, 21 bp, Artificial Sequence
  Description of Artificial Sequence: Synthetic oligonucleotide
ggtggagcaggaggggcccga

SEQ ID NO: 383388 - DNA, 25 bp, Artificial Sequence
  Description of Artificial Sequence: Synthetic oligonucleotide
gtggagcaggaggggcccgagtatt

SEQ ID NO: 383389 - DNA, 25 bp, Artificial Sequence
  Description of Artificial Sequence: Synthetic oligonucleotide
tggagcaggaggggcccgagtattg

SEQ ID NO: 383390 - DNA, 24 bp, Artificial Sequence
  Description of Artificial Sequence: Synthetic oligonucleotide
ggagcaggaggggcccgagtattg

SEQ ID NO: 383391 - DNA, 28 bp, Artificial Sequence
  Description of Artificial Sequence: Synthetic oligonucleotide
cgagtattgggaccgggagacacagaag

SEQ ID NO: 383392 - DNA, 31 bp, Artificial Sequence; identical to SEQ ID NO: 43206
  Description of Artificial Sequence: Synthetic oligonucleotide

SEQ ID NO: 383393 - DNA, 30 bp, Artificial Sequence; identical to SEQ ID NO: 43207
  Description of Artificial Sequence: Synthetic oligonucleotide

SEQ ID NO: 383394 - DNA, 29 bp, Artificial Sequence
  Description of Artificial Sequence: Synthetic oligonucleotide
gaggtatttctacaccgctgtgtcccgac

SEQ ID NO: 383395 - DNA, 29 bp, Artificial Sequence
  Description of Artificial Sequence: Synthetic oligonucleotide
aggtatttctacaccgctgtgtcccgacc

SEQ ID NO: 383396 - DNA, 28 bp, Artificial Sequence
  Description of Artificial Sequence: Synthetic oligonucleotide
ggtatttctacaccgctgtgtcccgacc

SEQ ID NO: 383397 - DNA, 28 bp, Artificial Sequence
  Description of Artificial Sequence: Synthetic oligonucleotide
gtatttctacaccgctgtgtcccgaccc

SEQ ID NO: 383398 - DNA, 28 bp, Artificial Sequence
  Description of Artificial Sequence: Synthetic oligonucleotide
tatttctacaccgctgtgtcccgacccg

SEQ ID NO: 383399 - DNA, 27 bp, Artificial Sequence
  Description of Artificial Sequence: Synthetic oligonucleotide
atttctacaccgctgtgtcccgacccg

SEQ ID NO: 383400 - DNA, 26 bp, Artificial Sequence
  Description of Artificial Sequence: Synthetic oligonucleotide
tttctacaccgctgtgtcccgacccg

SEQ ID NO: 383401 - DNA, 25 bp, Artificial Sequence
  Description of Artificial Sequence: Synthetic oligonucleotide
ttctacaccgctgtgtcccgacccg

SEQ ID NO: 383402 - DNA, 24 bp, Artificial Sequence
  Description of Artificial Sequence: Synthetic oligonucleotide
tctacaccgctgtgtcccgacccg

SEQ ID NO: 383403 - DNA, 23 bp, Artificial Sequence
  Description of Artificial Sequence: Synthetic oligonucleotide
ctacaccgctgtgtcccgacccg

SEQ ID NO: 383404 - DNA, 23 bp, Artificial Sequence
  Description of Artificial Sequence: Synthetic oligonucleotide
tacaccgctgtgtcccgacccgg

SEQ ID NO: 383405 - DNA, 22 bp, Artificial Sequence
  Description of Artificial Sequence: Synthetic oligonucleotide
acaccgctgtgtcccgacccgg

SEQ ID NO: 383406 - DNA, 21 bp, Artificial Sequence
  Description of Artificial Sequence: Synthetic oligonucleotide
caccgctgtgtcccgacccgg

SEQ ID NO: 383407 - DNA, 21 bp, Artificial Sequence
  Description of Artificial Sequence: Synthetic oligonucleotide
accgctgtgtcccgacccggc

SEQ ID NO: 383408 - DNA, 20 bp, Artificial Sequence
  Description of Artificial Sequence: Synthetic oligonucleotide
ccgctgtgtcccgacccggc

SEQ ID NO: 383409 - DNA, 20 bp, Artificial Sequence
  Description of Artificial Sequence: Synthetic oligonucleotide
cgctgtgtcccgacccggcc

SEQ ID NO: 383410 - DNA, 20 bp, Artificial Sequence
  Description of Artificial Sequence: Synthetic oligonucleotide
gctgtgtcccgacccggccg

SEQ ID NO: 383411 - DNA, 20 bp, Artificial Sequence
  Description of Artificial Sequence: Synthetic oligonucleotide
ctgtgtcccgacccggccgc

SEQ ID NO: 383412 - DNA, 20 bp, Artificial Sequence
  Description of Artificial Sequence: Synthetic oligonucleotide
tgtgtcccgacccggccgcg

SEQ ID NO: 383413 - DNA, 20 bp, Artificial Sequence
  Description of Artificial Sequence: Synthetic oligonucleotide
gtgtcccgacccggccgcgt

SEQ ID NO: 383414 - DNA, 24 bp, Artificial Sequence
  Description of Artificial Sequence: Synthetic oligonucleotide
ggcggctcagatcacccagcggaa

SEQ ID NO: 383415 - DNA, 25 bp, Artificial Sequence
  Description of Artificial Sequence: Synthetic oligonucleotide
gcggctcagatcacccagcggaagt

SEQ ID NO: 383416 - DNA, 25 bp, Artificial Sequence
  Description of Artificial Sequence: Synthetic oligonucleotide
cggctcagatcacccagcggaagtg

SEQ ID NO: 383417 - DNA, 25 bp, Artificial Sequence
  Description of Artificial Sequence: Synthetic oligonucleotide
ggctcagatcacccagcggaagtgg

SEQ ID NO: 383418 - DNA, 26 bp, Artificial Sequence
  Description of Artificial Sequence: Synthetic oligonucleotide
gctcagatcacccagcggaagtggga

SEQ ID NO: 383419 - DNA, 26 bp, Artificial Sequence
  Description of Artificial Sequence: Synthetic oligonucleotide
ctcagatcacccagcggaagtgggag

SEQ ID NO: 383420 - DNA, 26 bp, Artificial Sequence
  Description of Artificial Sequence: Synthetic oligonucleotide
tcagatcacccagcggaagtgggagg

SEQ ID NO: 383421 - DNA, 25 bp, Artificial Sequence
  Description of Artificial Sequence: Synthetic oligonucleotide
cagatcacccagcggaagtgggagg

SEQ ID NO: 383422 - DNA, 25 bp, Artificial Sequence
  Description of Artificial Sequence: Synthetic oligonucleotide
agatcacccagcggaagtgggaggc

SEQ ID NO: 383423 - DNA, 24 bp, Artificial Sequence
  Description of Artificial Sequence: Synthetic oligonucleotide
gatcacccagcggaagtgggaggc

SEQ ID NO: 383424 - DNA, 24 bp, Artificial Sequence
  Description of Artificial Sequence: Synthetic oligonucleotide
atcacccagcggaagtgggaggcg

SEQ ID NO: 383425 - DNA, 23 bp, Artificial Sequence
  Description of Artificial Sequence: Synthetic oligonucleotide
tcacccagcggaagtgggaggcg

SEQ ID NO: 383426 - DNA, 22 bp, Artificial Sequence
  Description of Artificial Sequence: Synthetic oligonucleotide
cacccagcggaagtgggaggcg

SEQ ID NO: 383427 - DNA, 22 bp, Artificial Sequence
  Description of Artificial Sequence: Synthetic oligonucleotide
acccagcggaagtgggaggcgg

SEQ ID NO: 383428 - DNA, 21 bp, Artificial Sequence
  Description of Artificial Sequence: Synthetic oligonucleotide
cccagcggaagtgggaggcgg

SEQ ID NO: 383429 - DNA, 21 bp, Artificial Sequence
  Description of Artificial Sequence: Synthetic oligonucleotide
ccagcggaagtgggaggcggc

SEQ ID NO: 383430 - DNA, 21 bp, Artificial Sequence
  Description of Artificial Sequence: Synthetic oligonucleotide
cagcggaagtgggaggcggcc

SEQ ID NO: 383431 - DNA, 21 bp, Artificial Sequence
  Description of Artificial Sequence: Synthetic oligonucleotide
agcggaagtgggaggcggccc

SEQ ID NO: 383432 - DNA, 20 bp, Artificial Sequence
  Description of Artificial Sequence: Synthetic oligonucleotide
gcggaagtgggaggcggccc

SEQ ID NO: 383433 - DNA, 21 bp, Artificial Sequence
  Description of Artificial Sequence: Synthetic oligonucleotide
cggaagtgggaggcggcccgt

SEQ ID NO: 383434 - DNA, 22 bp, Artificial Sequence
  Description of Artificial Sequence: Synthetic oligonucleotide
ggaagtgggaggcggcccgtga

SEQ ID NO: 383435 - DNA, 22 bp, Artificial Sequence
  Description of Artificial Sequence: Synthetic oligonucleotide
gaagtgggaggcggcccgtgag

SEQ ID NO: 383436 - DNA, 23 bp, Artificial Sequence
  Description of Artificial Sequence: Synthetic oligonucleotide
gtggagcaggaggggccggagta

SEQ ID NO: 383437 - DNA, 24 bp, Artificial Sequence
  Description of Artificial Sequence: Synthetic oligonucleotide
tggagcaggaggggccggagtact

SEQ ID NO: 383438 - DNA, 23 bp, Artificial Sequence
  Description of Artificial Sequence: Synthetic oligonucleotide
ggagcaggaggggccggagtact

SEQ ID NO: 383439 - DNA, 27 bp, Artificial Sequence
  Description of Artificial Sequence: Synthetic oligonucleotide
ggagtactgggaccgggagacacagaa

SEQ ID NO: 383440 - DNA, 27 bp, Artificial Sequence
  Description of Artificial Sequence: Synthetic oligonucleotide
gagtactgggaccgggagacacagaag

SEQ ID NO: 383441 - DNA, 29 bp, Artificial Sequence
  Description of Artificial Sequence: Synthetic oligonucleotide
agtactgggaccgggagacacagaagtac

SEQ ID NO: 383442 - DNA, 28 bp, Artificial Sequence
  Description of Artificial Sequence: Synthetic oligonucleotide
gtactgggaccgggagacacagaagtac

SEQ ID NO: 383443 - DNA, 30 bp, Artificial Sequence; identical to SEQ ID NO: 43257
  Description of Artificial Sequence: Synthetic oligonucleotide

SEQ ID NO: 383444 - DNA, 29 bp, Artificial Sequence
  Description of Artificial Sequence: Synthetic oligonucleotide
actgggaccgggagacacagaagtacaag

SEQ ID NO: 383445 - DNA, 28 bp, Artificial Sequence
  Description of Artificial Sequence: Synthetic oligonucleotide
ctgggaccgggagacacagaagtacaag

SEQ ID NO: 383446 - DNA, 25 bp, Artificial Sequence
  Description of Artificial Sequence: Synthetic oligonucleotide
cggggagccccacttcatcgcagta

SEQ ID NO: 383447 - DNA, 25 bp, Artificial Sequence
  Description of Artificial Sequence: Synthetic oligonucleotide
ggggagccccacttcatcgcagtag

SEQ ID NO: 383448 - DNA, 25 bp, Artificial Sequence
  Description of Artificial Sequence: Synthetic oligonucleotide
gggagccccacttcatcgcagtagg

SEQ ID NO: 383449 - DNA, 27 bp, Artificial Sequence
  Description of Artificial Sequence: Synthetic oligonucleotide
ggagccccacttcatcgcagtaggcta

SEQ ID NO: 383450 - DNA, 27 bp, Artificial Sequence
  Description of Artificial Sequence: Synthetic oligonucleotide
gagccccacttcatcgcagtaggctac

SEQ ID NO: 383451 - DNA, 27 bp, Artificial Sequence
  Description of Artificial Sequence: Synthetic oligonucleotide
agccccacttcatcgcagtaggctacg

SEQ ID NO: 383452 - DNA, 27 bp, Artificial Sequence
  Description of Artificial Sequence: Synthetic oligonucleotide
gccccacttcatcgcagtaggctacgt

SEQ ID NO: 383453 - DNA, 27 bp, Artificial Sequence
  Description of Artificial Sequence: Synthetic oligonucleotide
ccccacttcatcgcagtaggctacgtg

SEQ ID NO: 383454 - DNA, 27 bp, Artificial Sequence
  Description of Artificial Sequence: Synthetic oligonucleotide
cccacttcatcgcagtaggctacgtgg

SEQ ID NO: 383455 - DNA, 28 bp, Artificial Sequence
  Description of Artificial Sequence: Synthetic oligonucleotide
ccacttcatcgcagtaggctacgtggac

SEQ ID NO: 383456 - DNA, 28 bp, Artificial Sequence
  Description of Artificial Sequence: Synthetic oligonucleotide
cacttcatcgcagtaggctacgtggacg

SEQ ID NO: 383457 - DNA, 29 bp, Artificial Sequence
  Description of Artificial Sequence: Synthetic oligonucleotide
acttcatcgcagtaggctacgtggacgac

SEQ ID NO: 383458 - DNA, 28 bp, Artificial Sequence
  Description of Artificial Sequence: Synthetic oligonucleotide
cttcatcgcagtaggctacgtggacgac

SEQ ID NO: 383459 - DNA, 29 bp, Artificial Sequence
  Description of Artificial Sequence: Synthetic oligonucleotide
ttcatcgcagtaggctacgtggacgacac

SEQ ID NO: 383460 - DNA, 28 bp, Artificial Sequence
  Description of Artificial Sequence: Synthetic oligonucleotide
tcatcgcagtaggctacgtggacgacac

SEQ ID NO: 383461 - DNA, 27 bp, Artificial Sequence
  Description of Artificial Sequence: Synthetic oligonucleotide
catcgcagtaggctacgtggacgacac

SEQ ID NO: 383462 - DNA, 27 bp, Artificial Sequence
  Description of Artificial Sequence: Synthetic oligonucleotide
atcgcagtaggctacgtggacgacacg

SEQ ID NO: 383463 - DNA, 26 bp, Artificial Sequence
  Description of Artificial Sequence: Synthetic oligonucleotide
tcgcagtaggctacgtggacgacacg

SEQ ID NO: 383464 - DNA, 25 bp, Artificial Sequence
  Description of Artificial Sequence: Synthetic oligonucleotide
cgcagtaggctacgtggacgacacg

SEQ ID NO: 383465 - DNA, 26 bp, Artificial Sequence
  Description of Artificial Sequence: Synthetic oligonucleotide
gcagtaggctacgtggacgacacgca

SEQ ID NO: 383466 - DNA, 27 bp, Artificial Sequence
  Description of Artificial Sequence: Synthetic oligonucleotide
cagtaggctacgtggacgacacgcagt

SEQ ID NO: 383467 - DNA, 28 bp, Artificial Sequence
  Description of Artificial Sequence: Synthetic oligonucleotide
agtaggctacgtggacgacacgcagttc

SEQ ID NO: 383468 - DNA, 27 bp, Artificial Sequence
  Description of Artificial Sequence: Synthetic oligonucleotide
gtaggctacgtggacgacacgcagttc

SEQ ID NO: 383469 - DNA, 27 bp, Artificial Sequence
  Description of Artificial Sequence: Synthetic oligonucleotide
taggctacgtggacgacacgcagttcg

SEQ ID NO: 383470 - DNA, 27 bp, Artificial Sequence
  Description of Artificial Sequence: Synthetic oligonucleotide
aggctacgtggacgacacgcagttcgt

SEQ ID NO: 383471 - DNA, 20 bp, Artificial Sequence
  Description of Artificial Sequence: Synthetic oligonucleotide
aggggagccgcgggcgccat

SEQ ID NO: 383472 - DNA, 20 bp, Artificial Sequence
  Description of Artificial Sequence: Synthetic oligonucleotide
ggggagccgcgggcgccatt

SEQ ID NO: 383473 - DNA, 20 bp, Artificial Sequence
  Description of Artificial Sequence: Synthetic oligonucleotide
gggagccgcgggcgccatgt

SEQ ID NO: 383474 - DNA, 20 bp, Artificial Sequence
  Description of Artificial Sequence: Synthetic oligonucleotide
ggagccgcgggcgccatggt

SEQ ID NO: 383475 - DNA, 20 bp, Artificial Sequence
  Description of Artificial Sequence: Synthetic oligonucleotide
gagccgcgggcgccatgggt

SEQ ID NO: 383476 - DNA, 20 bp, Artificial Sequence
  Description of Artificial Sequence: Synthetic oligonucleotide
agccgcgggcgccatgggtg

SEQ ID NO: 383477 - DNA, 20 bp, Artificial Sequence
  Description of Artificial Sequence: Synthetic oligonucleotide
gccgcgggcgccatgggtgt

SEQ ID NO: 383478 - DNA, 20 bp, Artificial Sequence
  Description of Artificial Sequence: Synthetic oligonucleotide
ccgcgggcgccatgggtgga

SEQ ID NO: 383479 - DNA, 20 bp, Artificial Sequence
  Description of Artificial Sequence: Synthetic oligonucleotide
cgcgggcgccatgggtggag

SEQ ID NO: 383480 - DNA, 21 bp, Artificial Sequence
  Description of Artificial Sequence: Synthetic oligonucleotide
gcgggcgccatgggtggagca

SEQ ID NO: 383481 - DNA, 21 bp, Artificial Sequence
  Description of Artificial Sequence: Synthetic oligonucleotide
cgggcgccatgggtggagcag

SEQ ID NO: 383482 - DNA, 22 bp, Artificial Sequence
  Description of Artificial Sequence: Synthetic oligonucleotide
gggcgccatgggtggagcagga

SEQ ID NO: 383483 - DNA, 22 bp, Artificial Sequence
  Description of Artificial Sequence: Synthetic oligonucleotide
ggcgccatgggtggagcaggag

SEQ ID NO: 383484 - DNA, 22 bp, Artificial Sequence
  Description of Artificial Sequence: Synthetic oligonucleotide
gcgccatgggtggagcaggagg

SEQ ID NO: 383485 - DNA, 22 bp, Artificial Sequence
  Description of Artificial Sequence: Synthetic oligonucleotide
cgccatgggtggagcaggaggg

SEQ ID NO: 383486 - DNA, 22 bp, Artificial Sequence
  Description of Artificial Sequence: Synthetic oligonucleotide
gccatgggtggagcaggagggg

SEQ ID NO: 383487 - DNA, 22 bp, Artificial Sequence
  Description of Artificial Sequence: Synthetic oligonucleotide
ccatgggtggagcaggaggggc

SEQ ID NO: 383488 - DNA, 22 bp, Artificial Sequence
  Description of Artificial Sequence: Synthetic oligonucleotide
catgggtggagcaggaggggcc

SEQ ID NO: 383489 - DNA, 22 bp, Artificial Sequence
  Description of Artificial Sequence: Synthetic oligonucleotide
atgggtggagcaggaggggccg

SEQ ID NO: 383490 - DNA, 22 bp, Artificial Sequence
  Description of Artificial Sequence: Synthetic oligonucleotide
gagtccgagaggggagccgcga

SEQ ID NO: 383491 - DNA, 22 bp, Artificial Sequence
  Description of Artificial Sequence: Synthetic oligonucleotide
agtccgagaggggagccgcgag

SEQ ID NO: 383492 - DNA, 21 bp, Artificial Sequence
  Description of Artificial Sequence: Synthetic oligonucleotide
gtccgagaggggagccgcgag

SEQ ID NO: 383493 - DNA, 21 bp, Artificial Sequence
  Description of Artificial Sequence: Synthetic oligonucleotide
tccgagaggggagccgcgagc

SEQ ID NO: 383494 - DNA, 20 bp, Artificial Sequence
  Description of Artificial Sequence: Synthetic oligonucleotide
ccgagaggggagccgcgagc

SEQ ID NO: 383495 - DNA, 20 bp, Artificial Sequence
  Description of Artificial Sequence: Synthetic oligonucleotide
cgagaggggagccgcgagcg

SEQ ID NO: 383496 - DNA, 20 bp, Artificial Sequence
  Description of Artificial Sequence: Synthetic oligonucleotide
gagaggggagccgcgagcgc

SEQ ID NO: 383497 - DNA, 20 bp, Artificial Sequence
  Description of Artificial Sequence: Synthetic oligonucleotide
agaggggagccgcgagcgcc

SEQ ID NO: 383498 - DNA, 20 bp, Artificial Sequence
  Description of Artificial Sequence: Synthetic oligonucleotide
gaggggagccgcgagcgcct

SEQ ID NO: 383499 - DNA, 20 bp, Artificial Sequence
  Description of Artificial Sequence: Synthetic oligonucleotide
aggggagccgcgagcgccgt

SEQ ID NO: 383500 - DNA, 20 bp, Artificial Sequence
  Description of Artificial Sequence: Synthetic oligonucleotide
ggggagccgcgagcgccgtt

SEQ ID NO: 383501 - DNA, 20 bp, Artificial Sequence
  Description of Artificial Sequence: Synthetic oligonucleotide
gggagccgcgagcgccgtgt

SEQ ID NO: 383502 - DNA, 20 bp, Artificial Sequence
  Description of Artificial Sequence: Synthetic oligonucleotide
ggagccgcgagcgccgtggt

SEQ ID NO: 383503 - DNA, 20 bp, Artificial Sequence
  Description of Artificial Sequence: Synthetic oligonucleotide
gagccgcgagcgccgtgggt

SEQ ID NO: 383504 - DNA, 20 bp, Artificial Sequence
  Description of Artificial Sequence: Synthetic oligonucleotide
agccgcgagcgccgtgggtg

SEQ ID NO: 383505 - DNA, 20 bp, Artificial Sequence
  Description of Artificial Sequence: Synthetic oligonucleotide
gccgcgagcgccgtgggtgt

SEQ ID NO: 383506 - DNA, 20 bp, Artificial Sequence
  Description of Artificial Sequence: Synthetic oligonucleotide
ccgcgagcgccgtgggtgga

SEQ ID NO: 383507 - DNA, 20 bp, Artificial Sequence
  Description of Artificial Sequence: Synthetic oligonucleotide
cgcgagcgccgtgggtggag

SEQ ID NO: 383508 - DNA, 21 bp, Artificial Sequence
  Description of Artificial Sequence: Synthetic oligonucleotide
gcgagcgccgtgggtggagca

SEQ ID NO: 383509 - DNA, 21 bp, Artificial Sequence
  Description of Artificial Sequence: Synthetic oligonucleotide
cgagcgccgtgggtggagcag

SEQ ID NO: 383510 - DNA, 22 bp, Artificial Sequence
  Description of Artificial Sequence: Synthetic oligonucleotide
gagcgccgtgggtggagcagga

SEQ ID NO: 383511 - DNA, 22 bp, Artificial Sequence
  Description of Artificial Sequence: Synthetic oligonucleotide
agcgccgtgggtggagcaggag

SEQ ID NO: 383512 - DNA, 22 bp, Artificial Sequence
  Description of Artificial Sequence: Synthetic oligonucleotide
gccgtgggtggagcaggaggga

SEQ ID NO: 383513 - DNA, 22 bp, Artificial Sequence
  Description of Artificial Sequence: Synthetic oligonucleotide
ccgtgggtggagcaggagggac

SEQ ID NO: 383514 - DNA, 22 bp, Artificial Sequence
  Description of Artificial Sequence: Synthetic oligonucleotide
cgtgggtggagcaggagggacc

SEQ ID NO: 383515 - DNA, 22 bp, Artificial Sequence
  Description of Artificial Sequence: Synthetic oligonucleotide
gtgggtggagcaggagggaccg

SEQ ID NO: 383516 - DNA, 23 bp, Artificial Sequence
  Description of Artificial Sequence: Synthetic oligonucleotide
tgggtggagcaggagggaccgga

SEQ ID NO: 383517 - DNA, 22 bp, Artificial Sequence
  Description of Artificial Sequence: Synthetic oligonucleotide
gggtggagcaggagggaccgga

SEQ ID NO: 383518 - DNA, 26 bp, Artificial Sequence
  Description of Artificial Sequence: Synthetic oligonucleotide
ggtggagcaggagggaccggagtatt

SEQ ID NO: 383519 - DNA, 26 bp, Artificial Sequence
  Description of Artificial Sequence: Synthetic oligonucleotide
gtggagcaggagggaccggagtattg

SEQ ID NO: 383520 - DNA, 26 bp, Artificial Sequence
  Description of Artificial Sequence: Synthetic oligonucleotide
tggagcaggagggaccggagtattgg

SEQ ID NO: 383521 - DNA, 25 bp, Artificial Sequence
  Description of Artificial Sequence: Synthetic oligonucleotide
ggagcaggagggaccggagtattgg

SEQ ID NO: 383522 - DNA, 24 bp, Artificial Sequence
  Description of Artificial Sequence: Synthetic oligonucleotide
gagggaccggagtattgggaccgg

SEQ ID NO: 383523 - DNA, 25 bp, Artificial Sequence
  Description of Artificial Sequence: Synthetic oligonucleotide
agggaccggagtattgggaccggga

SEQ ID NO: 383524 - DNA, 24 bp, Artificial Sequence
  Description of Artificial Sequence: Synthetic oligonucleotide
gggaccggagtattgggaccggga

SEQ ID NO: 383525 - DNA, 25 bp, Artificial Sequence
  Description of Artificial Sequence: Synthetic oligonucleotide
ggaccggagtattgggaccgggaga

SEQ ID NO: 383526 - DNA, 26 bp, Artificial Sequence
  Description of Artificial Sequence: Synthetic oligonucleotide
gaccggagtattgggaccgggagaca

SEQ ID NO: 383527 - DNA, 27 bp, Artificial Sequence
  Description of Artificial Sequence: Synthetic oligonucleotide
accggagtattgggaccgggagacaca

SEQ ID NO: 383528 - DNA, 27 bp, Artificial Sequence
  Description of Artificial Sequence: Synthetic oligonucleotide
cacagactgaccgagtgagcctgcgaa

SEQ ID NO: 383529 - DNA, 28 bp, Artificial Sequence
  Description of Artificial Sequence: Synthetic oligonucleotide
acagactgaccgagtgagcctgcgaaac

SEQ ID NO: 383530 - DNA, 27 bp, Artificial Sequence
  Description of Artificial Sequence: Synthetic oligonucleotide
cagactgaccgagtgagcctgcgaaac

SEQ ID NO: 383531 - DNA, 27 bp, Artificial Sequence
  Description of Artificial Sequence: Synthetic oligonucleotide
agactgaccgagtgagcctgcgaaacc

SEQ ID NO: 383532 - DNA, 27 bp, Artificial Sequence
  Description of Artificial Sequence: Synthetic oligonucleotide
gactgaccgagtgagcctgcgaaacct

SEQ ID NO: 383533 - DNA, 27 bp, Artificial Sequence
  Description of Artificial Sequence: Synthetic oligonucleotide
actgaccgagtgagcctgcgaaacctg

SEQ ID NO: 383534 - DNA, 26 bp, Artificial Sequence
  Description of Artificial Sequence: Synthetic oligonucleotide
ctgaccgagtgagcctgcgaaacctg

SEQ ID NO: 383535 - DNA, 26 bp, Artificial Sequence
  Description of Artificial Sequence: Synthetic oligonucleotide
tgaccgagtgagcctgcgaaacctgc

SEQ ID NO: 383536 - DNA, 25 bp, Artificial Sequence
  Description of Artificial Sequence: Synthetic oligonucleotide
gaccgagtgagcctgcgaaacctgc

SEQ ID NO: 383537 - DNA, 25 bp, Artificial Sequence
  Description of Artificial Sequence: Synthetic oligonucleotide
accgagtgagcctgcgaaacctgcg

SEQ ID NO: 383538 - DNA, 24 bp, Artificial Sequence
  Description of Artificial Sequence: Synthetic oligonucleotide
ccgagtgagcctgcgaaacctgcg

SEQ ID NO: 383539 - DNA, 24 bp, Artificial Sequence
  Description of Artificial Sequence: Synthetic oligonucleotide
cgagtgagcctgcgaaacctgcgc

SEQ ID NO: 383540 - DNA, 24 bp, Artificial Sequence
  Description of Artificial Sequence: Synthetic oligonucleotide
gagtgagcctgcgaaacctgcgcg

SEQ ID NO: 383541 - DNA, 24 bp, Artificial Sequence
  Description of Artificial Sequence: Synthetic oligonucleotide
agtgagcctgcgaaacctgcgcgg

SEQ ID NO: 383542 - DNA, 23 bp, Artificial Sequence
  Description of Artificial Sequence: Synthetic oligonucleotide
gtgagcctgcgaaacctgcgcgg

SEQ ID NO: 383543 - DNA, 25 bp, Artificial Sequence
  Description of Artificial Sequence: Synthetic oligonucleotide
tgagcctgcgaaacctgcgcggcta

SEQ ID NO: 383544 - DNA, 24 bp, Artificial Sequence
  Description of Artificial Sequence: Synthetic oligonucleotide
gagcctgcgaaacctgcgcggcta

SEQ ID NO: 383545 - DNA, 26 bp, Artificial Sequence
  Description of Artificial Sequence: Synthetic oligonucleotide
agcctgcgaaacctgcgcggctacta

SEQ ID NO: 383546 - DNA, 25 bp, Artificial Sequence
  Description of Artificial Sequence: Synthetic oligonucleotide
gcctgcgaaacctgcgcggctacta

SEQ ID NO: 383547 - DNA, 27 bp, Artificial Sequence
  Description of Artificial Sequence: Synthetic oligonucleotide
cctgcgaaacctgcgcggctactacaa

SEQ ID NO: 383548 - DNA, 27 bp, Artificial Sequence
  Description of Artificial Sequence: Synthetic oligonucleotide
ctgcgaaacctgcgcggctactacaac

SEQ ID NO: 383549 - DNA, 27 bp, Artificial Sequence
  Description of Artificial Sequence: Synthetic oligonucleotide
tgcgaaacctgcgcggctactacaacc

SEQ ID NO: 383550 - DNA, 27 bp, Artificial Sequence
  Description of Artificial Sequence: Synthetic oligonucleotide
gcgaaacctgcgcggctactacaacca

SEQ ID NO: 383551 - DNA, 27 bp, Artificial Sequence
  Description of Artificial Sequence: Synthetic oligonucleotide
cgaaacctgcgcggctactacaaccag

SEQ ID NO: 383552 - DNA, 28 bp, Artificial Sequence
  Description of Artificial Sequence: Synthetic oligonucleotide
gaaacctgcgcggctactacaaccagag

SEQ ID NO: 383553 - DNA, 28 bp, Artificial Sequence
  Description of Artificial Sequence: Synthetic oligonucleotide
aaacctgcgcggctactacaaccagagc

SEQ ID NO: 383554 - DNA, 29 bp, Artificial Sequence
  Description of Artificial Sequence: Synthetic oligonucleotide
tgggatggggaggaccaaactcaggatac

SEQ ID NO: 383555 - DNA, 28 bp, Artificial Sequence
  Description of Artificial Sequence: Synthetic oligonucleotide
gggatggggaggaccaaactcaggatac

SEQ ID NO: 383556 - DNA, 29 bp, Artificial Sequence
  Description of Artificial Sequence: Synthetic oligonucleotide
ggatggggaggaccaaactcaggatactg

SEQ ID NO: 383557 - DNA, 30 bp, Artificial Sequence
  Description of Artificial Sequence: Synthetic oligonucleotide
gatggggaggaccaaactcaggatactgag

SEQ ID NO: 383558 - DNA, 30 bp, Artificial Sequence
  Description of Artificial Sequence: Synthetic oligonucleotide
atggggaggaccaaactcaggatactgagc

SEQ ID NO: 383559 - DNA, 29 bp, Artificial Sequence
  Description of Artificial Sequence: Synthetic oligonucleotide
tggggaggaccaaactcaggatactgagc

SEQ ID NO: 383560 - DNA, 28 bp, Artificial Sequence
  Description of Artificial Sequence: Synthetic oligonucleotide
ggggaggaccaaactcaggatactgagc

SEQ ID NO: 383561 - DNA, 30 bp, Artificial Sequence
  Description of Artificial Sequence: Synthetic oligonucleotide
gggaggaccaaactcaggatactgagcttg

SEQ ID NO: 383562 - DNA, 31 bp, Artificial Sequence
  Description of Artificial Sequence: Synthetic oligonucleotide
ggaggaccaaactcaggatactgagcttgtg

SEQ ID NO: 383563 - DNA, 31 bp, Artificial Sequence
  Description of Artificial Sequence: Synthetic oligonucleotide
gaggaccaaactcaggatactgagcttgtgg

SEQ ID NO: 383564 - DNA, 32 bp, Artificial Sequence
  Description of Artificial Sequence: Synthetic oligonucleotide
aggaccaaactcaggatactgagcttgtggag

SEQ ID NO: 383565 - DNA, 31 bp, Artificial Sequence
  Description of Artificial Sequence: Synthetic oligonucleotide
ggaccaaactcaggatactgagcttgtggag

SEQ ID NO: 383566 - DNA, 32 bp, Artificial Sequence
  Description of Artificial Sequence: Synthetic oligonucleotide
gaccaaactcaggatactgagcttgtggagac

SEQ ID NO: 383567 - DNA, 32 bp, Artificial Sequence
  Description of Artificial Sequence: Synthetic oligonucleotide
accaaactcaggatactgagcttgtggagacc

SEQ ID NO: 383568 - DNA, 31 bp, Artificial Sequence
  Description of Artificial Sequence: Synthetic oligonucleotide
ccaaactcaggatactgagcttgtggagacc

SEQ ID NO: 383569 - DNA, 32 bp, Artificial Sequence
  Description of Artificial Sequence: Synthetic oligonucleotide
caaactcaggatactgagcttgtggagaccag

SEQ ID NO: 383570 - DNA, 32 bp, Artificial Sequence
  Description of Artificial Sequence: Synthetic oligonucleotide
aaactcaggatactgagcttgtggagaccagg

SEQ ID NO: 383571 - DNA, 31 bp, Artificial Sequence
  Description of Artificial Sequence: Synthetic oligonucleotide
aactcaggatactgagcttgtggagaccagg

SEQ ID NO: 383572 - DNA, 30 bp, Artificial Sequence
  Description of Artificial Sequence: Synthetic oligonucleotide
actcaggatactgagcttgtggagaccagg

SEQ ID NO: 383573 - DNA, 29 bp, Artificial Sequence
  Description of Artificial Sequence: Synthetic oligonucleotide
ctcaggatactgagcttgtggagaccagg

SEQ ID NO: 383574 - DNA, 29 bp, Artificial Sequence
  Description of Artificial Sequence: Synthetic oligonucleotide
tcaggatactgagcttgtggagaccaggc

SEQ ID NO: 383575 - DNA, 28 bp, Artificial Sequence
  Description of Artificial Sequence: Synthetic oligonucleotide
caggatactgagcttgtggagaccaggc

SEQ ID NO: 383576 - DNA, 28 bp, Artificial Sequence
  Description of Artificial Sequence: Synthetic oligonucleotide
aggatactgagcttgtggagaccaggcc

SEQ ID NO: 383577 - DNA, 27 bp, Artificial Sequence
  Description of Artificial Sequence: Synthetic oligonucleotide
ggatactgagcttgtggagaccaggcc

SEQ ID NO: 383578 - DNA, 28 bp, Artificial Sequence
  Description of Artificial Sequence: Synthetic oligonucleotide
gatactgagcttgtggagaccaggccag

SEQ ID NO: 383579 - DNA, 28 bp, Artificial Sequence
  Description of Artificial Sequence: Synthetic oligonucleotide
atactgagcttgtggagaccaggccagc

SEQ ID NO: 383580 - DNA, 27 bp, Artificial Sequence
  Description of Artificial Sequence: Synthetic oligonucleotide
tactgagcttgtggagaccaggccagc

SEQ ID NO: 383581 - DNA, 20 bp, Artificial Sequence
  Description of Artificial Sequence: Synthetic oligonucleotide
acgtggggcccgacgggcga

SEQ ID NO: 383582 - DNA, 20 bp, Artificial Sequence
  Description of Artificial Sequence: Synthetic oligonucleotide
cgtggggcccgacgggcgat

SEQ ID NO: 383583 - DNA, 20 bp, Artificial Sequence
  Description of Artificial Sequence: Synthetic oligonucleotide
gtggggcccgacgggcgact

SEQ ID NO: 383584 - DNA, 20 bp, Artificial Sequence
  Description of Artificial Sequence: Synthetic oligonucleotide
tggggcccgacgggcgactc

SEQ ID NO: 383585 - DNA, 20 bp, Artificial Sequence
  Description of Artificial Sequence: Synthetic oligonucleotide
ggggcccgacgggcgactct

SEQ ID NO: 383586 - DNA, 20 bp, Artificial Sequence
  Description of Artificial Sequence: Synthetic oligonucleotide
gggcccgacgggcgactcct

SEQ ID NO: 383587 - DNA, 20 bp, Artificial Sequence
  Description of Artificial Sequence: Synthetic oligonucleotide
ggcccgacgggcgactcctc

SEQ ID NO: 383588 - DNA, 20 bp, Artificial Sequence
  Description of Artificial Sequence: Synthetic oligonucleotide
gcccgacgggcgactcctcc

SEQ ID NO: 383589 - DNA, 20 bp, Artificial Sequence
  Description of Artificial Sequence: Synthetic oligonucleotide
cccgacgggcgactcctccg

SEQ ID NO: 383590 - DNA, 20 bp, Artificial Sequence
  Description of Artificial Sequence: Synthetic oligonucleotide
ccgacgggcgactcctccgc

SEQ ID NO: 383591 - DNA, 20 bp, Artificial Sequence
  Description of Artificial Sequence: Synthetic oligonucleotide
cgacgggcgactcctccgcg

SEQ ID NO: 383592 - DNA, 23 bp, Artificial Sequence
  Description of Artificial Sequence: Synthetic oligonucleotide
acgggcgactcctccgcgggtat

SEQ ID NO: 383593 - DNA, 22 bp, Artificial Sequence
  Description of Artificial Sequence: Synthetic oligonucleotide
cgggcgactcctccgcgggtat

SEQ ID NO: 383594 - DNA, 23 bp, Artificial Sequence
  Description of Artificial Sequence: Synthetic oligonucleotide
gggcgactcctccgcgggtatga

SEQ ID NO: 383595 - DNA, 23 bp, Artificial Sequence
  Description of Artificial Sequence: Synthetic oligonucleotide
ggcgactcctccgcgggtatgac

SEQ ID NO: 383596 - DNA, 24 bp, Artificial Sequence
  Description of Artificial Sequence: Synthetic oligonucleotide
gcgactcctccgcgggtatgacca

SEQ ID NO: 383597 - DNA, 26 bp, Artificial Sequence
  Description of Artificial Sequence: Synthetic oligonucleotide
cgactcctccgcgggtatgaccagta

SEQ ID NO: 383598 - DNA, 26 bp, Artificial Sequence
  Description of Artificial Sequence: Synthetic oligonucleotide
gactcctccgcgggtatgaccagtac

SEQ ID NO: 383599 - DNA, 26 bp, Artificial Sequence
  Description of Artificial Sequence: Synthetic oligonucleotide
actcctccgcgggtatgaccagtacg

SEQ ID NO: 383600 - DNA, 24 bp, Artificial Sequence
  Description of Artificial Sequence: Synthetic oligonucleotide
tatggctgcgacgtggggcccgat

SEQ ID NO: 383601 - DNA, 23 bp, Artificial Sequence
  Description of Artificial Sequence: Synthetic oligonucleotide
atggctgcgacgtggggcccgat

SEQ ID NO: 383602 - DNA, 22 bp, Artificial Sequence
  Description of Artificial Sequence: Synthetic oligonucleotide
tggctgcgacgtggggcccgat

SEQ ID NO: 383603 - DNA, 21 bp, Artificial Sequence
  Description of Artificial Sequence: Synthetic oligonucleotide
ggctgcgacgtggggcccgat

SEQ ID NO: 383604 - DNA, 21 bp, Artificial Sequence
  Description of Artificial Sequence: Synthetic oligonucleotide
gctgcgacgtggggcccgatg

SEQ ID NO: 383605 - DNA, 21 bp, Artificial Sequence
  Description of Artificial Sequence: Synthetic oligonucleotide
ctgcgacgtggggcccgatgg

SEQ ID NO: 383606 - DNA, 21 bp, Artificial Sequence
  Description of Artificial Sequence: Synthetic oligonucleotide
tgcgacgtggggcccgatggg

SEQ ID NO: 383607 - DNA, 20 bp, Artificial Sequence
  Description of Artificial Sequence: Synthetic oligonucleotide
gcgacgtggggcccgatggg

SEQ ID NO: 383608 - DNA, 20 bp, Artificial Sequence
  Description of Artificial Sequence: Synthetic oligonucleotide
cgacgtggggcccgatgggc

SEQ ID NO: 383609 - DNA, 20 bp, Artificial Sequence
  Description of Artificial Sequence: Synthetic oligonucleotide
gacgtggggcccgatgggcg

SEQ ID NO: 383610 - DNA, 20 bp, Artificial Sequence
  Description of Artificial Sequence: Synthetic oligonucleotide
acgtggggcccgatgggcgc

SEQ ID NO: 383611 - DNA, 20 bp, Artificial Sequence
  Description of Artificial Sequence: Synthetic oligonucleotide
cgtggggcccgatgggcgct

SEQ ID NO: 383612 - DNA, 20 bp, Artificial Sequence
  Description of Artificial Sequence: Synthetic oligonucleotide
gtggggcccgatgggcgcct

SEQ ID NO: 383613 - DNA, 23 bp, Artificial Sequence
  Description of Artificial Sequence: Synthetic oligonucleotide
atgggcgcctcctccgcgggtat

SEQ ID NO: 383614 - DNA, 22 bp, Artificial Sequence
  Description of Artificial Sequence: Synthetic oligonucleotide
tgggcgcctcctccgcgggtat

SEQ ID NO: 383615 - DNA, 25 bp, Artificial Sequence
  Description of Artificial Sequence: Synthetic oligonucleotide
gccctgaacgaggatctgcgctcgt

SEQ ID NO: 383616 - DNA, 25 bp, Artificial Sequence
  Description of Artificial Sequence: Synthetic oligonucleotide
ccctgaacgaggatctgcgctcgtg

SEQ ID NO: 383617 - DNA, 26 bp, Artificial Sequence
  Description of Artificial Sequence: Synthetic oligonucleotide
cctgaacgaggatctgcgctcgtgga

SEQ ID NO: 383618 - DNA, 26 bp, Artificial Sequence
  Description of Artificial Sequence: Synthetic oligonucleotide
ctgaacgaggatctgcgctcgtggac

SEQ ID NO: 383619 - DNA, 26 bp, Artificial Sequence
  Description of Artificial Sequence: Synthetic oligonucleotide
tgaacgaggatctgcgctcgtggacc

SEQ ID NO: 383620 - DNA, 25 bp, Artificial Sequence
  Description of Artificial Sequence: Synthetic oligonucleotide
gaacgaggatctgcgctcgtggacc

SEQ ID NO: 383621 - DNA, 25 bp, Artificial Sequence
  Description of Artificial Sequence: Synthetic oligonucleotide
aacgaggatctgcgctcgtggaccg

SEQ ID NO: 383622 - DNA, 24 bp, Artificial Sequence
  Description of Artificial Sequence: Synthetic oligonucleotide
acgaggatctgcgctcgtggaccg

SEQ ID NO: 383623 - DNA, 23 bp, Artificial Sequence
  Description of Artificial Sequence: Synthetic oligonucleotide
cgaggatctgcgctcgtggaccg

SEQ ID NO: 383624 - DNA, 23 bp, Artificial Sequence
  Description of Artificial Sequence: Synthetic oligonucleotide
gaggatctgcgctcgtggaccgc

SEQ ID NO: 383625 - DNA, 23 bp, Artificial Sequence
  Description of Artificial Sequence: Synthetic oligonucleotide
aggatctgcgctcgtggaccgcc

SEQ ID NO: 383626 - DNA, 22 bp, Artificial Sequence
  Description of Artificial Sequence: Synthetic oligonucleotide
ggatctgcgctcgtggaccgcc

SEQ ID NO: 383627 - DNA, 22 bp, Artificial Sequence
  Description of Artificial Sequence: Synthetic oligonucleotide
gatctgcgctcgtggaccgccg

SEQ ID NO: 383628 - DNA, 22 bp, Artificial Sequence
  Description of Artificial Sequence: Synthetic oligonucleotide
atctgcgctcgtggaccgccgc

SEQ ID NO: 383629 - DNA, 21 bp, Artificial Sequence
  Description of Artificial Sequence: Synthetic oligonucleotide
tctgcgctcgtggaccgccgc

SEQ ID NO: 383630 - DNA, 20 bp, Artificial Sequence
  Description of Artificial Sequence: Synthetic oligonucleotide
ctgcgctcgtggaccgccgc

SEQ ID NO: 383631 - DNA, 20 bp, Artificial Sequence
  Description of Artificial Sequence: Synthetic oligonucleotide
tgcgctcgtggaccgccgcg

SEQ ID NO: 383632 - DNA, 20 bp, Artificial Sequence
  Description of Artificial Sequence: Synthetic oligonucleotide
gcgctcgtggaccgccgcgt

SEQ ID NO: 383633 - DNA, 20 bp, Artificial Sequence
  Description of Artificial Sequence: Synthetic oligonucleotide
cgctcgtggaccgccgcgga

SEQ ID NO: 383634 - DNA, 21 bp, Artificial Sequence
  Description of Artificial Sequence: Synthetic oligonucleotide
gctcgtggaccgccgcggaca

SEQ ID NO: 383635 - DNA, 21 bp, Artificial Sequence
  Description of Artificial Sequence: Synthetic oligonucleotide
ctcgtggaccgccgcggacac

SEQ ID NO: 383636 - DNA, 21 bp, Artificial Sequence
  Description of Artificial Sequence: Synthetic oligonucleotide
tcgtggaccgccgcggacacg

SEQ ID NO: 383637 - DNA, 20 bp, Artificial Sequence
  Description of Artificial Sequence: Synthetic oligonucleotide
cgtggaccgccgcggacacg

SEQ ID NO: 383638 - DNA, 20 bp, Artificial Sequence
  Description of Artificial Sequence: Synthetic oligonucleotide
gtggaccgccgcggacacgg

SEQ ID NO: 383639 - DNA, 22 bp, Artificial Sequence
  Description of Artificial Sequence: Synthetic oligonucleotide
ggcgcctcctccgcgggtatgt

SEQ ID NO: 383640 - DNA, 22 bp, Artificial Sequence
  Description of Artificial Sequence: Synthetic oligonucleotide
gcgcctcctccgcgggtatgtc

SEQ ID NO: 383641 - DNA, 23 bp, Artificial Sequence
  Description of Artificial Sequence: Synthetic oligonucleotide
cgcctcctccgcgggtatgtcca

SEQ ID NO: 383642 - DNA, 25 bp, Artificial Sequence
  Description of Artificial Sequence: Synthetic oligonucleotide
gcctcctccgcgggtatgtccagta

SEQ ID NO: 383643 - DNA, 25 bp, Artificial Sequence
  Description of Artificial Sequence: Synthetic oligonucleotide
cctcctccgcgggtatgtccagtac

SEQ ID NO: 383644 - DNA, 25 bp, Artificial Sequence
  Description of Artificial Sequence: Synthetic oligonucleotide
ctcctccgcgggtatgtccagtacg

SEQ ID NO: 383645 - DNA, 25 bp, Artificial Sequence
  Description of Artificial Sequence: Synthetic oligonucleotide
tcctccgcgggtatgtccagtacgc

SEQ ID NO: 383646 - DNA, 24 bp, Artificial Sequence
  Description of Artificial Sequence: Synthetic oligonucleotide
cctccgcgggtatgtccagtacgc

SEQ ID NO: 383647 - DNA, 26 bp, Artificial Sequence
  Description of Artificial Sequence: Synthetic oligonucleotide
ctccgcgggtatgtccagtacgccta

SEQ ID NO: 383648 - DNA, 26 bp, Artificial Sequence
  Description of Artificial Sequence: Synthetic oligonucleotide
tccgcgggtatgtccagtacgcctac

SEQ ID NO: 383649 - DNA, 25 bp, Artificial Sequence
  Description of Artificial Sequence: Synthetic oligonucleotide
ccgcgggtatgtccagtacgcctac

SEQ ID NO: 383650 - DNA, 26 bp, Artificial Sequence
  Description of Artificial Sequence: Synthetic oligonucleotide
cgcgggtatgtccagtacgcctacga

SEQ ID NO: 383651 - DNA, 26 bp, Artificial Sequence
  Description of Artificial Sequence: Synthetic oligonucleotide
gcgggtatgtccagtacgcctacgac

SEQ ID NO: 383652 - DNA, 26 bp, Artificial Sequence
  Description of Artificial Sequence: Synthetic oligonucleotide
cgggtatgtccagtacgcctacgacg

SEQ ID NO: 383653 - DNA, 26 bp, Artificial Sequence
  Description of Artificial Sequence: Synthetic oligonucleotide
gggtatgtccagtacgcctacgacgg

SEQ ID NO: 383654 - DNA, 27 bp, Artificial Sequence
  Description of Artificial Sequence: Synthetic oligonucleotide
ggtatgtccagtacgcctacgacggca

SEQ ID NO: 383655 - DNA, 28 bp, Artificial Sequence
  Description of Artificial Sequence: Synthetic oligonucleotide
gtatgtccagtacgcctacgacggcaag

SEQ ID NO: 383656 - DNA, 28 bp, Artificial Sequence
  Description of Artificial Sequence: Synthetic oligonucleotide
tatgtccagtacgcctacgacggcaagg

SEQ ID NO: 383657 - DNA, 27 bp, Artificial Sequence
  Description of Artificial Sequence: Synthetic oligonucleotide
atgtccagtacgcctacgacggcaagg

SEQ ID NO: 383658 - DNA, 27 bp, Artificial Sequence
  Description of Artificial Sequence: Synthetic oligonucleotide
tgtccagtacgcctacgacggcaagga

SEQ ID NO: 383659 - DNA, 27 bp, Artificial Sequence
  Description of Artificial Sequence: Synthetic oligonucleotide
gtccagtacgcctacgacggcaaggat

SEQ ID NO: 383660 - DNA, 29 bp, Artificial Sequence
  Description of Artificial Sequence: Synthetic oligonucleotide
tccagtacgcctacgacggcaaggattac

SEQ ID NO: 383661 - DNA, 28 bp, Artificial Sequence
  Description of Artificial Sequence: Synthetic oligonucleotide
ggagtattgggaccgggagacacagaac

SEQ ID NO: 383662 - DNA, 30 bp, Artificial Sequence; identical to SEQ ID NO: 43390
  Description of Artificial Sequence: Synthetic oligonucleotide

SEQ ID NO: 383663 - DNA, 32 bp, Artificial Sequence; identical to SEQ ID NO: 43391
  Description of Artificial Sequence: Synthetic oligonucleotide

SEQ ID NO: 383664 - DNA, 31 bp, Artificial Sequence; identical to SEQ ID NO: 43392
  Description of Artificial Sequence: Synthetic oligonucleotide

SEQ ID NO: 383665 - DNA, 31 bp, Artificial Sequence; identical to SEQ ID NO: 43393
  Description of Artificial Sequence: Synthetic oligonucleotide

SEQ ID NO: 383666 - DNA, 30 bp, Artificial Sequence; identical to SEQ ID NO: 43394
  Description of Artificial Sequence: Synthetic oligonucleotide

SEQ ID NO: 383667 - DNA, 29 bp, Artificial Sequence
  Description of Artificial Sequence: Synthetic oligonucleotide
ttgggaccgggagacacagaactacaagc

SEQ ID NO: 383668 - DNA, 28 bp, Artificial Sequence
  Description of Artificial Sequence: Synthetic oligonucleotide
tgggaccgggagacacagaactacaagc

SEQ ID NO: 383669 - DNA, 27 bp, Artificial Sequence
  Description of Artificial Sequence: Synthetic oligonucleotide
gggaccgggagacacagaactacaagc

SEQ ID NO: 383670 - DNA, 27 bp, Artificial Sequence
  Description of Artificial Sequence: Synthetic oligonucleotide
ggaccgggagacacagaactacaagcg

SEQ ID NO: 383671 - DNA, 27 bp, Artificial Sequence
  Description of Artificial Sequence: Synthetic oligonucleotide
gaccgggagacacagaactacaagcgc

SEQ ID NO: 383672 - DNA, 27 bp, Artificial Sequence
  Description of Artificial Sequence: Synthetic oligonucleotide
accgggagacacagaactacaagcgcc

SEQ ID NO: 383673 - DNA, 27 bp, Artificial Sequence
  Description of Artificial Sequence: Synthetic oligonucleotide
ccgggagacacagaactacaagcgcca

SEQ ID NO: 383674 - DNA, 27 bp, Artificial Sequence
  Description of Artificial Sequence: Synthetic oligonucleotide
cgggagacacagaactacaagcgccag

SEQ ID NO: 383675 - DNA, 27 bp, Artificial Sequence
  Description of Artificial Sequence: Synthetic oligonucleotide
gggagacacagaactacaagcgccagg

SEQ ID NO: 383676 - DNA, 27 bp, Artificial Sequence
  Description of Artificial Sequence: Synthetic oligonucleotide
ggagacacagaactacaagcgccaggc

SEQ ID NO: 383677 - DNA, 28 bp, Artificial Sequence
  Description of Artificial Sequence: Synthetic oligonucleotide
gagacacagaactacaagcgccaggcac

SEQ ID NO: 383678 - DNA, 29 bp, Artificial Sequence
  Description of Artificial Sequence: Synthetic oligonucleotide
agacacagaactacaagcgccaggcacag

SEQ ID NO: 383679 - DNA, 28 bp, Artificial Sequence
  Description of Artificial Sequence: Synthetic oligonucleotide
gacacagaactacaagcgccaggcacag

SEQ ID NO: 383680 - DNA, 29 bp, Artificial Sequence
  Description of Artificial Sequence: Synthetic oligonucleotide
acacagaactacaagcgccaggcacagac

SEQ ID NO: 383681 - DNA, 28 bp, Artificial Sequence
  Description of Artificial Sequence: Synthetic oligonucleotide
cacagaactacaagcgccaggcacagac

SEQ ID NO: 383682 - DNA, 29 bp, Artificial Sequence
  Description of Artificial Sequence: Synthetic oligonucleotide
acagaactacaagcgccaggcacagactg

SEQ ID NO: 383683 - DNA, 28 bp, Artificial Sequence
  Description of Artificial Sequence: Synthetic oligonucleotide
cagaactacaagcgccaggcacagactg

SEQ ID NO: 383684 - DNA, 29 bp, Artificial Sequence
  Description of Artificial Sequence: Synthetic oligonucleotide
agaactacaagcgccaggcacagactgac

SEQ ID NO: 383685 - DNA, 28 bp, Artificial Sequence
  Description of Artificial Sequence: Synthetic oligonucleotide
gaactacaagcgccaggcacagactgac

SEQ ID NO: 383686 - DNA, 28 bp, Artificial Sequence
  Description of Artificial Sequence: Synthetic oligonucleotide
aactacaagcgccaggcacagactgacc

SEQ ID NO: 383687 - DNA, 27 bp, Artificial Sequence
  Description of Artificial Sequence: Synthetic oligonucleotide
actacaagcgccaggcacagactgacc

SEQ ID NO: 383688 - DNA, 26 bp, Artificial Sequence
  Description of Artificial Sequence: Synthetic oligonucleotide
ctacaagcgccaggcacagactgacc

SEQ ID NO: 383689 - DNA, 26 bp, Artificial Sequence
  Description of Artificial Sequence: Synthetic oligonucleotide
gcctcctccgcgggtatgaccagtta

SEQ ID NO: 383690 - DNA, 26 bp, Artificial Sequence
  Description of Artificial Sequence: Synthetic oligonucleotide
cctcctccgcgggtatgaccagttag

SEQ ID NO: 383691 - DNA, 26 bp, Artificial Sequence
  Description of Artificial Sequence: Synthetic oligonucleotide
ctcctccgcgggtatgaccagttagc

SEQ ID NO: 383692 - DNA, 27 bp, Artificial Sequence
  Description of Artificial Sequence: Synthetic oligonucleotide
tcctccgcgggtatgaccagttagcct

SEQ ID NO: 383693 - DNA, 27 bp, Artificial Sequence
  Description of Artificial Sequence: Synthetic oligonucleotide
cctccgcgggtatgaccagttagccta

SEQ ID NO: 383694 - DNA, 27 bp, Artificial Sequence
  Description of Artificial Sequence: Synthetic oligonucleotide
ctccgcgggtatgaccagttagcctac

SEQ ID NO: 383695 - DNA, 27 bp, Artificial Sequence
  Description of Artificial Sequence: Synthetic oligonucleotide
tccgcgggtatgaccagttagcctacg

SEQ ID NO: 383696 - DNA, 27 bp, Artificial Sequence
  Description of Artificial Sequence: Synthetic oligonucleotide
ccgcgggtatgaccagttagcctacga

SEQ ID NO: 383697 - DNA, 27 bp, Artificial Sequence
  Description of Artificial Sequence: Synthetic oligonucleotide
cgcgggtatgaccagttagcctacgac

SEQ ID NO: 383698 - DNA, 27 bp, Artificial Sequence
  Description of Artificial Sequence: Synthetic oligonucleotide
gcgggtatgaccagttagcctacgacg

SEQ ID NO: 383699 - DNA, 27 bp, Artificial Sequence
  Description of Artificial Sequence: Synthetic oligonucleotide
cgggtatgaccagttagcctacgacgg

SEQ ID NO: 383700 - DNA, 27 bp, Artificial Sequence
  Description of Artificial Sequence: Synthetic oligonucleotide
gggtatgaccagttagcctacgacggc

SEQ ID NO: 383701 - DNA, 29 bp, Artificial Sequence
  Description of Artificial Sequence: Synthetic oligonucleotide
ggtatgaccagttagcctacgacggcaag

SEQ ID NO: 383702 - DNA, 29 bp, Artificial Sequence
  Description of Artificial Sequence: Synthetic oligonucleotide
gtatgaccagttagcctacgacggcaagg

SEQ ID NO: 383703 - DNA, 33 bp, Artificial Sequence; identical to SEQ ID NO: 43435
  Description of Artificial Sequence: Synthetic oligonucleotide

SEQ ID NO: 383704 - DNA, 32 bp, Artificial Sequence; identical to SEQ ID NO: 39502
  Description of Artificial Sequence: Synthetic oligonucleotide

SEQ ID NO: 383705 - DNA, 31 bp, Artificial Sequence; identical to SEQ ID NO: 39503
  Description of Artificial Sequence: Synthetic oligonucleotide

SEQ ID NO: 383706 - DNA, 30 bp, Artificial Sequence; identical to SEQ ID NO: 39504
  Description of Artificial Sequence: Synthetic oligonucleotide

SEQ ID NO: 383707 - DNA, 26 bp, Artificial Sequence
  Description of Artificial Sequence: Synthetic oligonucleotide
caaccagagcgaggccaggtctcaca

SEQ ID NO: 383708 - DNA, 26 bp, Artificial Sequence
  Description of Artificial Sequence: Synthetic oligonucleotide
aaccagagcgaggccaggtctcacac

SEQ ID NO: 383709 - DNA, 25 bp, Artificial Sequence
  Description of Artificial Sequence: Synthetic oligonucleotide
accagagcgaggccaggtctcacac

SEQ ID NO: 383710 - DNA, 24 bp, Artificial Sequence
  Description of Artificial Sequence: Synthetic oligonucleotide
ccagagcgaggccaggtctcacac

SEQ ID NO: 383711 - DNA, 24 bp, Artificial Sequence
  Description of Artificial Sequence: Synthetic oligonucleotide
cagagcgaggccaggtctcacacc

SEQ ID NO: 383712 - DNA, 25 bp, Artificial Sequence
  Description of Artificial Sequence: Synthetic oligonucleotide
agagcgaggccaggtctcacaccct

SEQ ID NO: 383713 - DNA, 24 bp, Artificial Sequence
  Description of Artificial Sequence: Synthetic oligonucleotide
gagcgaggccaggtctcacaccct

SEQ ID NO: 383714 - DNA, 24 bp, Artificial Sequence
  Description of Artificial Sequence: Synthetic oligonucleotide
agcgaggccaggtctcacaccctc

SEQ ID NO: 383715 - DNA, 23 bp, Artificial Sequence
  Description of Artificial Sequence: Synthetic oligonucleotide
gcgaggccaggtctcacaccctc

SEQ ID NO: 383716 - DNA, 24 bp, Artificial Sequence
  Description of Artificial Sequence: Synthetic oligonucleotide
cgaggccaggtctcacaccctcca

SEQ ID NO: 383717 - DNA, 25 bp, Artificial Sequence
  Description of Artificial Sequence: Synthetic oligonucleotide
gaggccaggtctcacaccctccaga

SEQ ID NO: 383718 - DNA, 25 bp, Artificial Sequence
  Description of Artificial Sequence: Synthetic oligonucleotide
aggccaggtctcacaccctccagag

SEQ ID NO: 383719 - DNA, 24 bp, Artificial Sequence
  Description of Artificial Sequence: Synthetic oligonucleotide
ggccaggtctcacaccctccagag

SEQ ID NO: 383720 - DNA, 26 bp, Artificial Sequence
  Description of Artificial Sequence: Synthetic oligonucleotide
gccaggtctcacaccctccagaggat

SEQ ID NO: 383721 - DNA, 27 bp, Artificial Sequence
  Description of Artificial Sequence: Synthetic oligonucleotide
ccaggtctcacaccctccagaggatgt

SEQ ID NO: 383722 - DNA, 29 bp, Artificial Sequence
  Description of Artificial Sequence: Synthetic oligonucleotide
caggtctcacaccctccagaggatgtatg

SEQ ID NO: 383723 - DNA, 29 bp, Artificial Sequence
  Description of Artificial Sequence: Synthetic oligonucleotide
aggtctcacaccctccagaggatgtatgg

SEQ ID NO: 383724 - DNA, 25 bp, Artificial Sequence
  Description of Artificial Sequence: Synthetic oligonucleotide
gccaggcacaggctgaccgagtgaa

SEQ ID NO: 383725 - DNA, 25 bp, Artificial Sequence
  Description of Artificial Sequence: Synthetic oligonucleotide
ccaggcacaggctgaccgagtgaac

SEQ ID NO: 383726 - DNA, 26 bp, Artificial Sequence
  Description of Artificial Sequence: Synthetic oligonucleotide
caggcacaggctgaccgagtgaacct

SEQ ID NO: 383727 - DNA, 26 bp, Artificial Sequence
  Description of Artificial Sequence: Synthetic oligonucleotide
aggcacaggctgaccgagtgaacctg

SEQ ID NO: 383728 - DNA, 25 bp, Artificial Sequence
  Description of Artificial Sequence: Synthetic oligonucleotide
ggcacaggctgaccgagtgaacctg

SEQ ID NO: 383729 - DNA, 25 bp, Artificial Sequence
  Description of Artificial Sequence: Synthetic oligonucleotide
gcacaggctgaccgagtgaacctgc

SEQ ID NO: 383730 - DNA, 25 bp, Artificial Sequence
  Description of Artificial Sequence: Synthetic oligonucleotide
cacaggctgaccgagtgaacctgcg

SEQ ID NO: 383731 - DNA, 27 bp, Artificial Sequence
  Description of Artificial Sequence: Synthetic oligonucleotide
acaggctgaccgagtgaacctgcggaa

SEQ ID NO: 383732 - DNA, 27 bp, Artificial Sequence
  Description of Artificial Sequence: Synthetic oligonucleotide
caggctgaccgagtgaacctgcggaaa

SEQ ID NO: 383733 - DNA, 27 bp, Artificial Sequence
  Description of Artificial Sequence: Synthetic oligonucleotide
aggctgaccgagtgaacctgcggaaac

SEQ ID NO: 383734 - DNA, 27 bp, Artificial Sequence
  Description of Artificial Sequence: Synthetic oligonucleotide
ggctgaccgagtgaacctgcggaaact

SEQ ID NO: 383735 - DNA, 27 bp, Artificial Sequence
  Description of Artificial Sequence: Synthetic oligonucleotide
gctgaccgagtgaacctgcggaaactg

SEQ ID NO: 383736 - DNA, 27 bp, Artificial Sequence
  Description of Artificial Sequence: Synthetic oligonucleotide
caaccagagcgaggacgggtctcacat

SEQ ID NO: 383737 - DNA, 27 bp, Artificial Sequence
  Description of Artificial Sequence: Synthetic oligonucleotide
aaccagagcgaggacgggtctcacatc

SEQ ID NO: 383738 - DNA, 26 bp, Artificial Sequence
  Description of Artificial Sequence: Synthetic oligonucleotide
accagagcgaggacgggtctcacatc

SEQ ID NO: 383739 - DNA, 25 bp, Artificial Sequence
  Description of Artificial Sequence: Synthetic oligonucleotide
ccagagcgaggacgggtctcacatc

SEQ ID NO: 383740 - DNA, 26 bp, Artificial Sequence
  Description of Artificial Sequence: Synthetic oligonucleotide
cagagcgaggacgggtctcacatcct

SEQ ID NO: 383741 - DNA, 26 bp, Artificial Sequence
  Description of Artificial Sequence: Synthetic oligonucleotide
agagcgaggacgggtctcacatcctc

SEQ ID NO: 383742 - DNA, 25 bp, Artificial Sequence
  Description of Artificial Sequence: Synthetic oligonucleotide
gagcgaggacgggtctcacatcctc

SEQ ID NO: 383743 - DNA, 26 bp, Artificial Sequence
  Description of Artificial Sequence: Synthetic oligonucleotide
agcgaggacgggtctcacatcctcca

SEQ ID NO: 383744 - DNA, 25 bp, Artificial Sequence
  Description of Artificial Sequence: Synthetic oligonucleotide
gcgaggacgggtctcacatcctcca

SEQ ID NO: 383745 - DNA, 26 bp, Artificial Sequence
  Description of Artificial Sequence: Synthetic oligonucleotide
cgaggacgggtctcacatcctccaga

SEQ ID NO: 383746 - DNA, 26 bp, Artificial Sequence
  Description of Artificial Sequence: Synthetic oligonucleotide
gaggacgggtctcacatcctccagag

SEQ ID NO: 383747 - DNA, 27 bp, Artificial Sequence
  Description of Artificial Sequence: Synthetic oligonucleotide
aggacgggtctcacatcctccagagga

SEQ ID NO: 383748 - DNA, 27 bp, Artificial Sequence
  Description of Artificial Sequence: Synthetic oligonucleotide
ggacgggtctcacatcctccagaggat

SEQ ID NO: 383749 - DNA, 27 bp, Artificial Sequence
  Description of Artificial Sequence: Synthetic oligonucleotide
gacgggtctcacatcctccagaggatg

SEQ ID NO: 383750 - DNA, 30 bp, Artificial Sequence; identical to SEQ ID NO: 43466
  Description of Artificial Sequence: Synthetic oligonucleotide

SEQ ID NO: 383751 - DNA, 21 bp, Artificial Sequence
  Description of Artificial Sequence: Synthetic oligonucleotide
cactggggaggcgccgcgttg

SEQ ID NO: 383752 - DNA, 21 bp, Artificial Sequence
  Description of Artificial Sequence: Synthetic oligonucleotide
actggggaggcgccgcgttgg

SEQ ID NO: 383753 - DNA, 20 bp, Artificial Sequence
  Description of Artificial Sequence: Synthetic oligonucleotide
ctggggaggcgccgcgttgg

SEQ ID NO: 383754 - DNA, 20 bp, Artificial Sequence
  Description of Artificial Sequence: Synthetic oligonucleotide
tggggaggcgccgcgttggg

SEQ ID NO: 383755 - DNA, 20 bp, Artificial Sequence
  Description of Artificial Sequence: Synthetic oligonucleotide
ggggaggcgccgcgttgggt

SEQ ID NO: 383756 - DNA, 22 bp, Artificial Sequence
  Description of Artificial Sequence: Synthetic oligonucleotide
gggaggcgccgcgttggggatt

SEQ ID NO: 383757 - DNA, 23 bp, Artificial Sequence
  Description of Artificial Sequence: Synthetic oligonucleotide
ggaggcgccgcgttggggattct

SEQ ID NO: 383758 - DNA, 23 bp, Artificial Sequence
  Description of Artificial Sequence: Synthetic oligonucleotide
gaggcgccgcgttggggattctc

SEQ ID NO: 383759 - DNA, 24 bp, Artificial Sequence
  Description of Artificial Sequence: Synthetic oligonucleotide
aggcgccgcgttggggattctcca

SEQ ID NO: 383760 - DNA, 23 bp, Artificial Sequence
  Description of Artificial Sequence: Synthetic oligonucleotide
ggcgccgcgttggggattctcca

SEQ ID NO: 383761 - DNA, 24 bp, Artificial Sequence
  Description of Artificial Sequence: Synthetic oligonucleotide
gcgccgcgttggggattctccact

SEQ ID NO: 383762 - DNA, 24 bp, Artificial Sequence
  Description of Artificial Sequence: Synthetic oligonucleotide
cgccgcgttggggattctccactc

SEQ ID NO: 383763 - DNA, 24 bp, Artificial Sequence
  Description of Artificial Sequence: Synthetic oligonucleotide
gccgcgttggggattctccactcc

SEQ ID NO: 383764 - DNA, 24 bp, Artificial Sequence
  Description of Artificial Sequence: Synthetic oligonucleotide
ccgcgttggggattctccactccc

SEQ ID NO: 383765 - DNA, 25 bp, Artificial Sequence
  Description of Artificial Sequence: Synthetic oligonucleotide
cgcgttggggattctccactcccct

SEQ ID NO: 383766 - DNA, 26 bp, Artificial Sequence
  Description of Artificial Sequence: Synthetic oligonucleotide
gcgttggggattctccactcccctga

SEQ ID NO: 383767 - DNA, 27 bp, Artificial Sequence
  Description of Artificial Sequence: Synthetic oligonucleotide
cgttggggattctccactcccctgagt

SEQ ID NO: 383768 - DNA, 29 bp, Artificial Sequence
  Description of Artificial Sequence: Synthetic oligonucleotide
gttggggattctccactcccctgagtttc

SEQ ID NO: 383769 - DNA, 30 bp, Artificial Sequence
  Description of Artificial Sequence: Synthetic oligonucleotide
ttggggattctccactcccctgagtttcac

SEQ ID NO: 383770 - DNA, 29 bp, Artificial Sequence
  Description of Artificial Sequence: Synthetic oligonucleotide
tggggattctccactcccctgagtttcac

SEQ ID NO: 383771 - DNA, 28 bp, Artificial Sequence
  Description of Artificial Sequence: Synthetic oligonucleotide
ggggattctccactcccctgagtttcac

SEQ ID NO: 383772 - DNA, 30 bp, Artificial Sequence
  Description of Artificial Sequence: Synthetic oligonucleotide
gggattctccactcccctgagtttcacttc

SEQ ID NO: 383773 - DNA, 28 bp, Artificial Sequence
  Description of Artificial Sequence: Synthetic oligonucleotide
ccggctcccactccatgaggtatttctc

SEQ ID NO: 383774 - DNA, 28 bp, Artificial Sequence
  Description of Artificial Sequence: Synthetic oligonucleotide
cggctcccactccatgaggtatttctcc

SEQ ID NO: 383775 - DNA, 32 bp, Artificial Sequence; identical to SEQ ID NO: 44290
  Description of Artificial Sequence: Synthetic oligonucleotide

SEQ ID NO: 383776 - DNA, 31 bp, Artificial Sequence; identical to SEQ ID NO: 44291
  Description of Artificial Sequence: Synthetic oligonucleotide

SEQ ID NO: 383777 - DNA, 31 bp, Artificial Sequence; identical to SEQ ID NO: 44292
  Description of Artificial Sequence: Synthetic oligonucleotide

SEQ ID NO: 383778 - DNA, 31 bp, Artificial Sequence; identical to SEQ ID NO: 44293
  Description of Artificial Sequence: Synthetic oligonucleotide

SEQ ID NO: 383779 - DNA, 30 bp, Artificial Sequence; identical to SEQ ID NO: 44294
  Description of Artificial Sequence: Synthetic oligonucleotide

SEQ ID NO: 383780 - DNA, 29 bp, Artificial Sequence
  Description of Artificial Sequence: Synthetic oligonucleotide
gaggtatttctccacatccgtgtcctggc

SEQ ID NO: 383781 - DNA, 29 bp, Artificial Sequence
  Description of Artificial Sequence: Synthetic oligonucleotide
aggtatttctccacatccgtgtcctggcc

SEQ ID NO: 383782 - DNA, 28 bp, Artificial Sequence
  Description of Artificial Sequence: Synthetic oligonucleotide
ggtatttctccacatccgtgtcctggcc

SEQ ID NO: 383783 - DNA, 28 bp, Artificial Sequence
  Description of Artificial Sequence: Synthetic oligonucleotide
gtatttctccacatccgtgtcctggccc

SEQ ID NO: 383784 - DNA, 28 bp, Artificial Sequence
  Description of Artificial Sequence: Synthetic oligonucleotide
tatttctccacatccgtgtcctggcccg

SEQ ID NO: 383785 - DNA, 27 bp, Artificial Sequence
  Description of Artificial Sequence: Synthetic oligonucleotide
atttctccacatccgtgtcctggcccg

SEQ ID NO: 383786 - DNA, 26 bp, Artificial Sequence
  Description of Artificial Sequence: Synthetic oligonucleotide
tttctccacatccgtgtcctggcccg

SEQ ID NO: 383787 - DNA, 25 bp, Artificial Sequence
  Description of Artificial Sequence: Synthetic oligonucleotide
ttctccacatccgtgtcctggcccg

SEQ ID NO: 383788 - DNA, 24 bp, Artificial Sequence
  Description of Artificial Sequence: Synthetic oligonucleotide
tctccacatccgtgtcctggcccg

SEQ ID NO: 383789 - DNA, 23 bp, Artificial Sequence
  Description of Artificial Sequence: Synthetic oligonucleotide
ctccacatccgtgtcctggcccg

SEQ ID NO: 383790 - DNA, 23 bp, Artificial Sequence
  Description of Artificial Sequence: Synthetic oligonucleotide
tccacatccgtgtcctggcccgg

SEQ ID NO: 383791 - DNA, 22 bp, Artificial Sequence
  Description of Artificial Sequence: Synthetic oligonucleotide
ccacatccgtgtcctggcccgg

SEQ ID NO: 383792 - DNA, 22 bp, Artificial Sequence
  Description of Artificial Sequence: Synthetic oligonucleotide
cacatccgtgtcctggcccggc

SEQ ID NO: 383793 - DNA, 22 bp, Artificial Sequence
  Description of Artificial Sequence: Synthetic oligonucleotide
acatccgtgtcctggcccggcc

SEQ ID NO: 383794 - DNA, 21 bp, Artificial Sequence
  Description of Artificial Sequence: Synthetic oligonucleotide
catccgtgtcctggcccggcc

SEQ ID NO: 383795 - DNA, 21 bp, Artificial Sequence
  Description of Artificial Sequence: Synthetic oligonucleotide
atccgtgtcctggcccggccg

SEQ ID NO: 383796 - DNA, 20 bp, Artificial Sequence
  Description of Artificial Sequence: Synthetic oligonucleotide
tccgtgtcctggcccggccg

SEQ ID NO: 383797 - DNA, 20 bp, Artificial Sequence
  Description of Artificial Sequence: Synthetic oligonucleotide
ccgtgtcctggcccggccgt

SEQ ID NO: 383798 - DNA, 20 bp, Artificial Sequence
  Description of Artificial Sequence: Synthetic oligonucleotide
cgtgtcctggcccggccgct

SEQ ID NO: 383799 - DNA, 20 bp, Artificial Sequence
  Description of Artificial Sequence: Synthetic oligonucleotide
gtgtcctggcccggccgcgt

SEQ ID NO: 383800 - DNA, 20 bp, Artificial Sequence
  Description of Artificial Sequence: Synthetic oligonucleotide
tgtcctggcccggccgcggt

SEQ ID NO: 383801 - DNA, 20 bp, Artificial Sequence
  Description of Artificial Sequence: Synthetic oligonucleotide
gtcctggcccggccgcggtt

SEQ ID NO: 383802 - DNA, 20 bp, Artificial Sequence
  Description of Artificial Sequence: Synthetic oligonucleotide
tcctggcccggccgcgggtt

SEQ ID NO: 383803 - DNA, 20 bp, Artificial Sequence
  Description of Artificial Sequence: Synthetic oligonucleotide
cctggcccggccgcgggttt

SEQ ID NO: 383804 - DNA, 20 bp, Artificial Sequence
  Description of Artificial Sequence: Synthetic oligonucleotide
ctggcccggccgcggggatt

SEQ ID NO: 383805 - DNA, 20 bp, Artificial Sequence
  Description of Artificial Sequence: Synthetic oligonucleotide
tggcccggccgcggggagtt

SEQ ID NO: 383806 - DNA, 23 bp, Artificial Sequence
  Description of Artificial Sequence: Synthetic oligonucleotide
agtccaagaggggagccgcggga

SEQ ID NO: 383807 - DNA, 22 bp, Artificial Sequence
  Description of Artificial Sequence: Synthetic oligonucleotide
gtccaagaggggagccgcggga

SEQ ID NO: 383808 - DNA, 22 bp, Artificial Sequence
  Description of Artificial Sequence: Synthetic oligonucleotide
tccaagaggggagccgcgggag

SEQ ID NO: 383809 - DNA, 21 bp, Artificial Sequence
  Description of Artificial Sequence: Synthetic oligonucleotide
ccaagaggggagccgcgggag

SEQ ID NO: 383810 - DNA, 21 bp, Artificial Sequence
  Description of Artificial Sequence: Synthetic oligonucleotide
caagaggggagccgcgggagc

SEQ ID NO: 383811 - DNA, 21 bp, Artificial Sequence
  Description of Artificial Sequence: Synthetic oligonucleotide
aagaggggagccgcgggagcc

SEQ ID NO: 383812 - DNA, 20 bp, Artificial Sequence
  Description of Artificial Sequence: Synthetic oligonucleotide
agaggggagccgcgggagcc

SEQ ID NO: 383813 - DNA, 20 bp, Artificial Sequence
  Description of Artificial Sequence: Synthetic oligonucleotide
gaggggagccgcgggagcct

SEQ ID NO: 383814 - DNA, 20 bp, Artificial Sequence
  Description of Artificial Sequence: Synthetic oligonucleotide
aggggagccgcgggagccgt

SEQ ID NO: 383815 - DNA, 20 bp, Artificial Sequence
  Description of Artificial Sequence: Synthetic oligonucleotide
ggggagccgcgggagccgtt

SEQ ID NO: 383816 - DNA, 20 bp, Artificial Sequence
  Description of Artificial Sequence: Synthetic oligonucleotide
gggagccgcgggagccgtgt

SEQ ID NO: 383817 - DNA, 20 bp, Artificial Sequence
  Description of Artificial Sequence: Synthetic oligonucleotide
ggagccgcgggagccgtggt

SEQ ID NO: 383818 - DNA, 20 bp, Artificial Sequence
  Description of Artificial Sequence: Synthetic oligonucleotide
gagccgcgggagccgtgggt

SEQ ID NO: 383819 - DNA, 20 bp, Artificial Sequence
  Description of Artificial Sequence: Synthetic oligonucleotide
agccgcgggagccgtgggtg

SEQ ID NO: 383820 - DNA, 20 bp, Artificial Sequence
  Description of Artificial Sequence: Synthetic oligonucleotide
gccgcgggagccgtgggtgt

SEQ ID NO: 383821 - DNA, 20 bp, Artificial Sequence
  Description of Artificial Sequence: Synthetic oligonucleotide
ccgcgggagccgtgggtgga

SEQ ID NO: 383822 - DNA, 20 bp, Artificial Sequence
  Description of Artificial Sequence: Synthetic oligonucleotide
cgcgggagccgtgggtggag

SEQ ID NO: 383823 - DNA, 21 bp, Artificial Sequence
  Description of Artificial Sequence: Synthetic oligonucleotide
gcgggagccgtgggtggagca

SEQ ID NO: 383824 - DNA, 21 bp, Artificial Sequence
  Description of Artificial Sequence: Synthetic oligonucleotide
cgggagccgtgggtggagcag

SEQ ID NO: 383825 - DNA, 22 bp, Artificial Sequence
  Description of Artificial Sequence: Synthetic oligonucleotide
gggagccgtgggtggagcagga

SEQ ID NO: 383826 - DNA, 22 bp, Artificial Sequence
  Description of Artificial Sequence: Synthetic oligonucleotide
ggagccgtgggtggagcaggag

SEQ ID NO: 383827 - DNA, 22 bp, Artificial Sequence
  Description of Artificial Sequence: Synthetic oligonucleotide
gagccgtgggtggagcaggagg

SEQ ID NO: 383828 - DNA, 22 bp, Artificial Sequence
  Description of Artificial Sequence: Synthetic oligonucleotide
agccgtgggtggagcaggaggg

SEQ ID NO: 383829 - DNA, 26 bp, Artificial Sequence
  Description of Artificial Sequence: Synthetic oligonucleotide
aaccagagcgaggacgggtctcacac

SEQ ID NO: 383830 - DNA, 25 bp, Artificial Sequence
  Description of Artificial Sequence: Synthetic oligonucleotide
accagagcgaggacgggtctcacac

SEQ ID NO: 383831 - DNA, 24 bp, Artificial Sequence
  Description of Artificial Sequence: Synthetic oligonucleotide
ccagagcgaggacgggtctcacac

SEQ ID NO: 383832 - DNA, 24 bp, Artificial Sequence
  Description of Artificial Sequence: Synthetic oligonucleotide
cagagcgaggacgggtctcacacc

SEQ ID NO: 383833 - DNA, 25 bp, Artificial Sequence
  Description of Artificial Sequence: Synthetic oligonucleotide
agagcgaggacgggtctcacaccct

SEQ ID NO: 383834 - DNA, 24 bp, Artificial Sequence
  Description of Artificial Sequence: Synthetic oligonucleotide
gagcgaggacgggtctcacaccct

SEQ ID NO: 383835 - DNA, 24 bp, Artificial Sequence
  Description of Artificial Sequence: Synthetic oligonucleotide
agcgaggacgggtctcacaccctc

SEQ ID NO: 383836 - DNA, 23 bp, Artificial Sequence
  Description of Artificial Sequence: Synthetic oligonucleotide
gcgaggacgggtctcacaccctc

SEQ ID NO: 383837 - DNA, 24 bp, Artificial Sequence
  Description of Artificial Sequence: Synthetic oligonucleotide
cgaggacgggtctcacaccctcca

SEQ ID NO: 383838 - DNA, 25 bp, Artificial Sequence
  Description of Artificial Sequence: Synthetic oligonucleotide
gaggacgggtctcacaccctccaga

SEQ ID NO: 383839 - DNA, 25 bp, Artificial Sequence
  Description of Artificial Sequence: Synthetic oligonucleotide
aggacgggtctcacaccctccagag

SEQ ID NO: 383840 - DNA, 24 bp, Artificial Sequence
  Description of Artificial Sequence: Synthetic oligonucleotide
ggacgggtctcacaccctccagag

SEQ ID NO: 383841 - DNA, 26 bp, Artificial Sequence
  Description of Artificial Sequence: Synthetic oligonucleotide
gacgggtctcacaccctccagaggat

SEQ ID NO: 383842 - DNA, 27 bp, Artificial Sequence
  Description of Artificial Sequence: Synthetic oligonucleotide
acgggtctcacaccctccagaggatgt

SEQ ID NO: 383843 - DNA, 24 bp, Artificial Sequence
  Description of Artificial Sequence: Synthetic oligonucleotide
atgtttggctgcgacctggggccg

SEQ ID NO: 383844 - DNA, 23 bp, Artificial Sequence
  Description of Artificial Sequence: Synthetic oligonucleotide
tgtttggctgcgacctggggccg

SEQ ID NO: 383845 - DNA, 22 bp, Artificial Sequence
  Description of Artificial Sequence: Synthetic oligonucleotide
gtttggctgcgacctggggccg

SEQ ID NO: 383846 - DNA, 23 bp, Artificial Sequence
  Description of Artificial Sequence: Synthetic oligonucleotide
tttggctgcgacctggggccgga

SEQ ID NO: 383847 - DNA, 22 bp, Artificial Sequence
  Description of Artificial Sequence: Synthetic oligonucleotide
ttggctgcgacctggggccgga

SEQ ID NO: 383848 - DNA, 32 bp, Artificial Sequence; identical to SEQ ID NO: 44332
  Description of Artificial Sequence: Synthetic oligonucleotide

SEQ ID NO: 383849 - DNA, 31 bp, Artificial Sequence; identical to SEQ ID NO: 44333
  Description of Artificial Sequence: Synthetic oligonucleotide

SEQ ID NO: 383850 - DNA, 32 bp, Artificial Sequence; identical to SEQ ID NO: 44334
  Description of Artificial Sequence: Synthetic oligonucleotide

SEQ ID NO: 383851 - DNA, 32 bp, Artificial Sequence; identical to SEQ ID NO: 44335
  Description of Artificial Sequence: Synthetic oligonucleotide

SEQ ID NO: 383852 - DNA, 31 bp, Artificial Sequence; identical to SEQ ID NO: 44336
  Description of Artificial Sequence: Synthetic oligonucleotide

SEQ ID NO: 383853 - DNA, 32 bp, Artificial Sequence; identical to SEQ ID NO: 44337
  Description of Artificial Sequence: Synthetic oligonucleotide

SEQ ID NO: 383854 - DNA, 31 bp, Artificial Sequence; identical to SEQ ID NO: 44338
  Description of Artificial Sequence: Synthetic oligonucleotide

SEQ ID NO: 383855 - DNA, 30 bp, Artificial Sequence; identical to SEQ ID NO: 44339
  Description of Artificial Sequence: Synthetic oligonucleotide

SEQ ID NO: 383856 - DNA, 30 bp, Artificial Sequence; identical to SEQ ID NO: 44340
  Description of Artificial Sequence: Synthetic oligonucleotide

SEQ ID NO: 383857 - DNA, 29 bp, Artificial Sequence
  Description of Artificial Sequence: Synthetic oligonucleotide
gcagagatacacgtgccatgttcagcacg

SEQ ID NO: 383858 - DNA, 30 bp, Artificial Sequence; identical to SEQ ID NO: 44342
  Description of Artificial Sequence: Synthetic oligonucleotide

SEQ ID NO: 383859 - DNA, 30 bp, Artificial Sequence; identical to SEQ ID NO: 44343
  Description of Artificial Sequence: Synthetic oligonucleotide

SEQ ID NO: 383860 - DNA, 29 bp, Artificial Sequence
  Description of Artificial Sequence: Synthetic oligonucleotide
gagatacacgtgccatgttcagcacgagg

SEQ ID NO: 383861 - DNA, 29 bp, Artificial Sequence
  Description of Artificial Sequence: Synthetic oligonucleotide
agatacacgtgccatgttcagcacgaggg

SEQ ID NO: 383862 - DNA, 28 bp, Artificial Sequence
  Description of Artificial Sequence: Synthetic oligonucleotide
gatacacgtgccatgttcagcacgaggg

SEQ ID NO: 383863 - DNA, 28 bp, Artificial Sequence
  Description of Artificial Sequence: Synthetic oligonucleotide
atacacgtgccatgttcagcacgagggg

SEQ ID NO: 383864 - DNA, 27 bp, Artificial Sequence
  Description of Artificial Sequence: Synthetic oligonucleotide
tacacgtgccatgttcagcacgagggg

SEQ ID NO: 383865 - DNA, 26 bp, Artificial Sequence
  Description of Artificial Sequence: Synthetic oligonucleotide
acacgtgccatgttcagcacgagggg

SEQ ID NO: 383866 - DNA, 25 bp, Artificial Sequence
  Description of Artificial Sequence: Synthetic oligonucleotide
cacgtgccatgttcagcacgagggg

SEQ ID NO: 383867 - DNA, 26 bp, Artificial Sequence
  Description of Artificial Sequence: Synthetic oligonucleotide
acgtgccatgttcagcacgaggggct

SEQ ID NO: 383868 - DNA, 25 bp, Artificial Sequence
  Description of Artificial Sequence: Synthetic oligonucleotide
cgtgccatgttcagcacgaggggct

SEQ ID NO: 383869 - DNA, 25 bp, Artificial Sequence
  Description of Artificial Sequence: Synthetic oligonucleotide
gtgccatgttcagcacgaggggctg

SEQ ID NO: 383870 - DNA, 25 bp, Artificial Sequence
  Description of Artificial Sequence: Synthetic oligonucleotide
tgccatgttcagcacgaggggctgc

SEQ ID NO: 383871 - DNA, 24 bp, Artificial Sequence
  Description of Artificial Sequence: Synthetic oligonucleotide
gccatgttcagcacgaggggctgc

SEQ ID NO: 383872 - DNA, 24 bp, Artificial Sequence
  Description of Artificial Sequence: Synthetic oligonucleotide
ccatgttcagcacgaggggctgcc

SEQ ID NO: 383873 - DNA, 24 bp, Artificial Sequence
  Description of Artificial Sequence: Synthetic oligonucleotide
catgttcagcacgaggggctgccg

SEQ ID NO: 383874 - DNA, 25 bp, Artificial Sequence
  Description of Artificial Sequence: Synthetic oligonucleotide
atgttcagcacgaggggctgccgga

SEQ ID NO: 383875 - DNA, 24 bp, Artificial Sequence
  Description of Artificial Sequence: Synthetic oligonucleotide
tgttcagcacgaggggctgccgga

SEQ ID NO: 383876 - DNA, 23 bp, Artificial Sequence
  Description of Artificial Sequence: Synthetic oligonucleotide
gttcagcacgaggggctgccgga

SEQ ID NO: 383877 - DNA, 23 bp, Artificial Sequence
  Description of Artificial Sequence: Synthetic oligonucleotide
ttcagcacgaggggctgccggag

SEQ ID NO: 383878 - DNA, 22 bp, Artificial Sequence
  Description of Artificial Sequence: Synthetic oligonucleotide
tcagcacgaggggctgccggag

SEQ ID NO: 383879 - DNA, 25 bp, Artificial Sequence
  Description of Artificial Sequence: Synthetic oligonucleotide
cggagcccctcaccctgagatggaa

SEQ ID NO: 383880 - DNA, 25 bp, Artificial Sequence
  Description of Artificial Sequence: Synthetic oligonucleotide
ggagcccctcaccctgagatggaag

SEQ ID NO: 383881 - DNA, 25 bp, Artificial Sequence
  Description of Artificial Sequence: Synthetic oligonucleotide
gagcccctcaccctgagatggaagc

SEQ ID NO: 383882 - DNA, 25 bp, Artificial Sequence
  Description of Artificial Sequence: Synthetic oligonucleotide
agcccctcaccctgagatggaagcc

SEQ ID NO: 383883 - DNA, 24 bp, Artificial Sequence
  Description of Artificial Sequence: Synthetic oligonucleotide
gcccctcaccctgagatggaagcc

SEQ ID NO: 383884 - DNA, 25 bp, Artificial Sequence
  Description of Artificial Sequence: Synthetic oligonucleotide
cccctcaccctgagatggaagccgt

SEQ ID NO: 383885 - DNA, 27 bp, Artificial Sequence
  Description of Artificial Sequence: Synthetic oligonucleotide
ccctcaccctgagatggaagccgtctt

SEQ ID NO: 383886 - DNA, 27 bp, Artificial Sequence
  Description of Artificial Sequence: Synthetic oligonucleotide
cctcaccctgagatggaagccgtcttc

SEQ ID NO: 383887 - DNA, 27 bp, Artificial Sequence
  Description of Artificial Sequence: Synthetic oligonucleotide
ctcaccctgagatggaagccgtcttcc

SEQ ID NO: 383888 - DNA, 27 bp, Artificial Sequence
  Description of Artificial Sequence: Synthetic oligonucleotide
tcaccctgagatggaagccgtcttccc

SEQ ID NO: 383889 - DNA, 27 bp, Artificial Sequence
  Description of Artificial Sequence: Synthetic oligonucleotide
caccctgagatggaagccgtcttccca

SEQ ID NO: 383890 - DNA, 27 bp, Artificial Sequence
  Description of Artificial Sequence: Synthetic oligonucleotide
accctgagatggaagccgtcttcccag

SEQ ID NO: 383891 - DNA, 26 bp, Artificial Sequence
  Description of Artificial Sequence: Synthetic oligonucleotide
ccctgagatggaagccgtcttcccag

SEQ ID NO: 383892 - DNA, 26 bp, Artificial Sequence
  Description of Artificial Sequence: Synthetic oligonucleotide
cctgagatggaagccgtcttcccagc

SEQ ID NO: 383893 - DNA, 26 bp, Artificial Sequence
  Description of Artificial Sequence: Synthetic oligonucleotide
ctgagatggaagccgtcttcccagcc

SEQ ID NO: 383894 - DNA, 27 bp, Artificial Sequence
  Description of Artificial Sequence: Synthetic oligonucleotide
tgagatggaagccgtcttcccagccca

SEQ ID NO: 383895 - DNA, 26 bp, Artificial Sequence
  Description of Artificial Sequence: Synthetic oligonucleotide
gagatggaagccgtcttcccagccca

SEQ ID NO: 383896 - DNA, 26 bp, Artificial Sequence
  Description of Artificial Sequence: Synthetic oligonucleotide
agatggaagccgtcttcccagcccac

SEQ ID NO: 383897 - DNA, 25 bp, Artificial Sequence
  Description of Artificial Sequence: Synthetic oligonucleotide
gatggaagccgtcttcccagcccac

SEQ ID NO: 383898 - DNA, 27 bp, Artificial Sequence
  Description of Artificial Sequence: Synthetic oligonucleotide
atggaagccgtcttcccagcccaccat

SEQ ID NO: 383899 - DNA, 26 bp, Artificial Sequence
  Description of Artificial Sequence: Synthetic oligonucleotide
tggaagccgtcttcccagcccaccat

SEQ ID NO: 383900 - DNA, 25 bp, Artificial Sequence
  Description of Artificial Sequence: Synthetic oligonucleotide
ggaagccgtcttcccagcccaccat

SEQ ID NO: 383901 - DNA, 25 bp, Artificial Sequence
  Description of Artificial Sequence: Synthetic oligonucleotide
gaagccgtcttcccagcccaccatc

SEQ ID NO: 383902 - DNA, 25 bp, Artificial Sequence
  Description of Artificial Sequence: Synthetic oligonucleotide
aagccgtcttcccagcccaccatcc

SEQ ID NO: 383903 - DNA, 29 bp, Artificial Sequence
  Description of Artificial Sequence: Synthetic oligonucleotide
tggctgtcctagctgtcctaggagctatg

SEQ ID NO: 383904 - DNA, 28 bp, Artificial Sequence
  Description of Artificial Sequence: Synthetic oligonucleotide
ggctgtcctagctgtcctaggagctatg

SEQ ID NO: 383905 - DNA, 28 bp, Artificial Sequence
  Description of Artificial Sequence: Synthetic oligonucleotide
gctgtcctagctgtcctaggagctatgg

SEQ ID NO: 383906 - DNA, 29 bp, Artificial Sequence
  Description of Artificial Sequence: Synthetic oligonucleotide
ctgtcctagctgtcctaggagctatggtg

SEQ ID NO: 383907 - DNA, 29 bp, Artificial Sequence
  Description of Artificial Sequence: Synthetic oligonucleotide
tgtcctagctgtcctaggagctatggtgg

SEQ ID NO: 383908 - DNA, 28 bp, Artificial Sequence
  Description of Artificial Sequence: Synthetic oligonucleotide
gtcctagctgtcctaggagctatggtgg

SEQ ID NO: 383909 - DNA, 28 bp, Artificial Sequence
  Description of Artificial Sequence: Synthetic oligonucleotide
tcctagctgtcctaggagctatggtggc

SEQ ID NO: 383910 - DNA, 27 bp, Artificial Sequence
  Description of Artificial Sequence: Synthetic oligonucleotide
cctagctgtcctaggagctatggtggc

SEQ ID NO: 383911 - DNA, 28 bp, Artificial Sequence
  Description of Artificial Sequence: Synthetic oligonucleotide
ctagctgtcctaggagctatggtggctg

SEQ ID NO: 383912 - DNA, 30 bp, Artificial Sequence; identical to SEQ ID NO: 44396
  Description of Artificial Sequence: Synthetic oligonucleotide

SEQ ID NO: 383913 - DNA, 29 bp, Artificial Sequence
  Description of Artificial Sequence: Synthetic oligonucleotide
agctgtcctaggagctatggtggctgttg

SEQ ID NO: 383914 - DNA, 28 bp, Artificial Sequence
  Description of Artificial Sequence: Synthetic oligonucleotide
gctgtcctaggagctatggtggctgttg

SEQ ID NO: 383915 - DNA, 29 bp, Artificial Sequence
  Description of Artificial Sequence: Synthetic oligonucleotide
ctgtcctaggagctatggtggctgttgtg

SEQ ID NO: 383916 - DNA, 31 bp, Artificial Sequence; identical to SEQ ID NO: 44400
  Description of Artificial Sequence: Synthetic oligonucleotide

SEQ ID NO: 383917 - DNA, 30 bp, Artificial Sequence; identical to SEQ ID NO: 44401
  Description of Artificial Sequence: Synthetic oligonucleotide

SEQ ID NO: 383918 - DNA, 31 bp, Artificial Sequence; identical to SEQ ID NO: 44402
  Description of Artificial Sequence: Synthetic oligonucleotide

SEQ ID NO: 383919 - DNA, 30 bp, Artificial Sequence; identical to SEQ ID NO: 44403
  Description of Artificial Sequence: Synthetic oligonucleotide

SEQ ID NO: 383920 - DNA, 32 bp, Artificial Sequence; identical to SEQ ID NO: 44404
  Description of Artificial Sequence: Synthetic oligonucleotide

SEQ ID NO: 383921 - DNA, 32 bp, Artificial Sequence; identical to SEQ ID NO: 44405
  Description of Artificial Sequence: Synthetic oligonucleotide

SEQ ID NO: 383922 - DNA, 31 bp, Artificial Sequence; identical to SEQ ID NO: 44406
  Description of Artificial Sequence: Synthetic oligonucleotide

SEQ ID NO: 383923 - DNA, 30 bp, Artificial Sequence; identical to SEQ ID NO: 44407
  Description of Artificial Sequence: Synthetic oligonucleotide

SEQ ID NO: 383924 - DNA, 31 bp, Artificial Sequence; identical to SEQ ID NO: 44408
  Description of Artificial Sequence: Synthetic oligonucleotide

SEQ ID NO: 383925 - DNA, 31 bp, Artificial Sequence; identical to SEQ ID NO: 44409
  Description of Artificial Sequence: Synthetic oligonucleotide

SEQ ID NO: 383926 - DNA, 30 bp, Artificial Sequence; identical to SEQ ID NO: 44410
  Description of Artificial Sequence: Synthetic oligonucleotide

SEQ ID NO: 383927 - DNA, 32 bp, Artificial Sequence; identical to SEQ ID NO: 44411
  Description of Artificial Sequence: Synthetic oligonucleotide

SEQ ID NO: 383928 - DNA, 33 bp, Artificial Sequence; identical to SEQ ID NO: 44412
  Description of Artificial Sequence: Synthetic oligonucleotide

SEQ ID NO: 383929 - DNA, 32 bp, Artificial Sequence; identical to SEQ ID NO: 44413
  Description of Artificial Sequence: Synthetic oligonucleotide

SEQ ID NO: 383930 - DNA, 24 bp, Artificial Sequence
  Description of Artificial Sequence: Synthetic oligonucleotide
cggagcccctcaccctgagatgga

SEQ ID NO: 383931 - DNA, 25 bp, Artificial Sequence
  Description of Artificial Sequence: Synthetic oligonucleotide
acgggcgccttctccgcgggtataa

SEQ ID NO: 383932 - DNA, 24 bp, Artificial Sequence
  Description of Artificial Sequence: Synthetic oligonucleotide
cgggcgccttctccgcgggtataa

SEQ ID NO: 383933 - DNA, 24 bp, Artificial Sequence
  Description of Artificial Sequence: Synthetic oligonucleotide
gggcgccttctccgcgggtataac

SEQ ID NO: 383934 - DNA, 25 bp, Artificial Sequence
  Description of Artificial Sequence: Synthetic oligonucleotide
ggcgccttctccgcgggtataacca

SEQ ID NO: 383935 - DNA, 27 bp, Artificial Sequence
  Description of Artificial Sequence: Synthetic oligonucleotide
gcgccttctccgcgggtataaccagtt

SEQ ID NO: 383936 - DNA, 27 bp, Artificial Sequence
  Description of Artificial Sequence: Synthetic oligonucleotide
cgccttctccgcgggtataaccagttc

SEQ ID NO: 383937 - DNA, 27 bp, Artificial Sequence
  Description of Artificial Sequence: Synthetic oligonucleotide
gccttctccgcgggtataaccagttcg

SEQ ID NO: 383938 - DNA, 27 bp, Artificial Sequence
  Description of Artificial Sequence: Synthetic oligonucleotide
ccttctccgcgggtataaccagttcgc

SEQ ID NO: 383939 - DNA, 27 bp, Artificial Sequence
  Description of Artificial Sequence: Synthetic oligonucleotide
cttctccgcgggtataaccagttcgcc

SEQ ID NO: 383940 - DNA, 29 bp, Artificial Sequence
  Description of Artificial Sequence: Synthetic oligonucleotide
ttctccgcgggtataaccagttcgcctac

SEQ ID NO: 383941 - DNA, 28 bp, Artificial Sequence
  Description of Artificial Sequence: Synthetic oligonucleotide
tctccgcgggtataaccagttcgcctac

SEQ ID NO: 383942 - DNA, 23 bp, Artificial Sequence
  Description of Artificial Sequence: Synthetic oligonucleotide
tctcgggagccctggccctgact

SEQ ID NO: 383943 - DNA, 22 bp, Artificial Sequence
  Description of Artificial Sequence: Synthetic oligonucleotide
ctcgggagccctggccctgact

SEQ ID NO: 383944 - DNA, 23 bp, Artificial Sequence
  Description of Artificial Sequence: Synthetic oligonucleotide
tcgggagccctggccctgactga

SEQ ID NO: 383945 - DNA, 22 bp, Artificial Sequence
  Description of Artificial Sequence: Synthetic oligonucleotide
cgggagccctggccctgactga

SEQ ID NO: 383946 - DNA, 23 bp, Artificial Sequence
  Description of Artificial Sequence: Synthetic oligonucleotide
gggagccctggccctgactgaga

SEQ ID NO: 383947 - DNA, 23 bp, Artificial Sequence
  Description of Artificial Sequence: Synthetic oligonucleotide
ggagccctggccctgactgagac

SEQ ID NO: 383948 - DNA, 24 bp, Artificial Sequence
  Description of Artificial Sequence: Synthetic oligonucleotide
gagccctggccctgactgagacct

SEQ ID NO: 383949 - DNA, 24 bp, Artificial Sequence
  Description of Artificial Sequence: Synthetic oligonucleotide
agccctggccctgactgagacctg

SEQ ID NO: 383950 - DNA, 23 bp, Artificial Sequence
  Description of Artificial Sequence: Synthetic oligonucleotide
gccctggccctgactgagacctg

SEQ ID NO: 383951 - DNA, 23 bp, Artificial Sequence
  Description of Artificial Sequence: Synthetic oligonucleotide
ccctggccctgactgagacctgg

SEQ ID NO: 383952 - DNA, 23 bp, Artificial Sequence
  Description of Artificial Sequence: Synthetic oligonucleotide
cctggccctgactgagacctggg

SEQ ID NO: 383953 - DNA, 23 bp, Artificial Sequence
  Description of Artificial Sequence: Synthetic oligonucleotide
ctggccctgactgagacctgggc

SEQ ID NO: 383954 - DNA, 23 bp, Artificial Sequence
  Description of Artificial Sequence: Synthetic oligonucleotide
tggccctgactgagacctgggcc

SEQ ID NO: 383955 - DNA, 22 bp, Artificial Sequence
  Description of Artificial Sequence: Synthetic oligonucleotide
ggccctgactgagacctgggcc

SEQ ID NO: 383956 - DNA, 22 bp, Artificial Sequence
  Description of Artificial Sequence: Synthetic oligonucleotide
gccctgactgagacctgggccg

SEQ ID NO: 383957 - DNA, 22 bp, Artificial Sequence
  Description of Artificial Sequence: Synthetic oligonucleotide
ccctgactgagacctgggccgg

SEQ ID NO: 383958 - DNA, 23 bp, Artificial Sequence
  Description of Artificial Sequence: Synthetic oligonucleotide
cctgactgagacctgggccggct

SEQ ID NO: 383959 - DNA, 23 bp, Artificial Sequence
  Description of Artificial Sequence: Synthetic oligonucleotide
ctgactgagacctgggccggctc

SEQ ID NO: 383960 - DNA, 23 bp, Artificial Sequence
  Description of Artificial Sequence: Synthetic oligonucleotide
tgactgagacctgggccggctcc

SEQ ID NO: 383961 - DNA, 22 bp, Artificial Sequence
  Description of Artificial Sequence: Synthetic oligonucleotide
gactgagacctgggccggctcc

SEQ ID NO: 383962 - DNA, 23 bp, Artificial Sequence
  Description of Artificial Sequence: Synthetic oligonucleotide
actgagacctgggccggctccca

SEQ ID NO: 383963 - DNA, 22 bp, Artificial Sequence
  Description of Artificial Sequence: Synthetic oligonucleotide
ctgagacctgggccggctccca

SEQ ID NO: 383964 - DNA, 23 bp, Artificial Sequence
  Description of Artificial Sequence: Synthetic oligonucleotide
tgagacctgggccggctcccact

SEQ ID NO: 383965 - DNA, 26 bp, Artificial Sequence
  Description of Artificial Sequence: Synthetic oligonucleotide
tgaacgaggacctgcgctcctggact

SEQ ID NO: 383966 - DNA, 25 bp, Artificial Sequence
  Description of Artificial Sequence: Synthetic oligonucleotide
gaacgaggacctgcgctcctggact

SEQ ID NO: 383967 - DNA, 25 bp, Artificial Sequence
  Description of Artificial Sequence: Synthetic oligonucleotide
aacgaggacctgcgctcctggactg

SEQ ID NO: 383968 - DNA, 24 bp, Artificial Sequence
  Description of Artificial Sequence: Synthetic oligonucleotide
acgaggacctgcgctcctggactg

SEQ ID NO: 383969 - DNA, 23 bp, Artificial Sequence
  Description of Artificial Sequence: Synthetic oligonucleotide
cgaggacctgcgctcctggactg

SEQ ID NO: 383970 - DNA, 23 bp, Artificial Sequence
  Description of Artificial Sequence: Synthetic oligonucleotide
gaggacctgcgctcctggactgc

SEQ ID NO: 383971 - DNA, 23 bp, Artificial Sequence
  Description of Artificial Sequence: Synthetic oligonucleotide
aggacctgcgctcctggactgcc

SEQ ID NO: 383972 - DNA, 22 bp, Artificial Sequence
  Description of Artificial Sequence: Synthetic oligonucleotide
ggacctgcgctcctggactgcc

SEQ ID NO: 383973 - DNA, 22 bp, Artificial Sequence
  Description of Artificial Sequence: Synthetic oligonucleotide
gacctgcgctcctggactgccg

SEQ ID NO: 383974 - DNA, 22 bp, Artificial Sequence
  Description of Artificial Sequence: Synthetic oligonucleotide
acctgcgctcctggactgccgc

SEQ ID NO: 383975 - DNA, 21 bp, Artificial Sequence
  Description of Artificial Sequence: Synthetic oligonucleotide
cctgcgctcctggactgccgc

SEQ ID NO: 383976 - DNA, 21 bp, Artificial Sequence
  Description of Artificial Sequence: Synthetic oligonucleotide
ctgcgctcctggactgccgcg

SEQ ID NO: 383977 - DNA, 22 bp, Artificial Sequence
  Description of Artificial Sequence: Synthetic oligonucleotide
tgcgctcctggactgccgcgga

SEQ ID NO: 383978 - DNA, 21 bp, Artificial Sequence
  Description of Artificial Sequence: Synthetic oligonucleotide
gcgctcctggactgccgcgga

SEQ ID NO: 383979 - DNA, 22 bp, Artificial Sequence
  Description of Artificial Sequence: Synthetic oligonucleotide
cgctcctggactgccgcggaca

SEQ ID NO: 383980 - DNA, 22 bp, Artificial Sequence
  Description of Artificial Sequence: Synthetic oligonucleotide
gctcctggactgccgcggacac

SEQ ID NO: 383981 - DNA, 22 bp, Artificial Sequence
  Description of Artificial Sequence: Synthetic oligonucleotide
ctcctggactgccgcggacacg

SEQ ID NO: 383982 - DNA, 22 bp, Artificial Sequence
  Description of Artificial Sequence: Synthetic oligonucleotide
tcctggactgccgcggacacgg

SEQ ID NO: 383983 - DNA, 21 bp, Artificial Sequence
  Description of Artificial Sequence: Synthetic oligonucleotide
cctggactgccgcggacacgg

SEQ ID NO: 383984 - DNA, 21 bp, Artificial Sequence
  Description of Artificial Sequence: Synthetic oligonucleotide
ctggactgccgcggacacggc

SEQ ID NO: 383985 - DNA, 21 bp, Artificial Sequence
  Description of Artificial Sequence: Synthetic oligonucleotide
tggactgccgcggacacggcg

SEQ ID NO: 383986 - DNA, 20 bp, Artificial Sequence
  Description of Artificial Sequence: Synthetic oligonucleotide
ggactgccgcggacacggcg

SEQ ID NO: 383987 - DNA, 20 bp, Artificial Sequence
  Description of Artificial Sequence: Synthetic oligonucleotide
gactgccgcggacacggcgg

SEQ ID NO: 383988 - DNA, 21 bp, Artificial Sequence
  Description of Artificial Sequence: Synthetic oligonucleotide
actgccgcggacacggcggct

SEQ ID NO: 383989 - DNA, 20 bp, Artificial Sequence
  Description of Artificial Sequence: Synthetic oligonucleotide
ctgccgcggacacggcggct

SEQ ID NO: 383990 - DNA, 21 bp, Artificial Sequence
  Description of Artificial Sequence: Synthetic oligonucleotide
tgccgcggacacggcggctca

SEQ ID NO: 383991 - DNA, 25 bp, Artificial Sequence
  Description of Artificial Sequence: Synthetic oligonucleotide
cggagagcctacctggagggcactt

SEQ ID NO: 383992 - DNA, 25 bp, Artificial Sequence
  Description of Artificial Sequence: Synthetic oligonucleotide
ggagagcctacctggagggcacttg

SEQ ID NO: 383993 - DNA, 25 bp, Artificial Sequence
  Description of Artificial Sequence: Synthetic oligonucleotide
gagagcctacctggagggcacttgc

SEQ ID NO: 383994 - DNA, 26 bp, Artificial Sequence
  Description of Artificial Sequence: Synthetic oligonucleotide
agagcctacctggagggcacttgcgt

SEQ ID NO: 383995 - DNA, 25 bp, Artificial Sequence
  Description of Artificial Sequence: Synthetic oligonucleotide
gagcctacctggagggcacttgcgt

SEQ ID NO: 383996 - DNA, 25 bp, Artificial Sequence
  Description of Artificial Sequence: Synthetic oligonucleotide
agcctacctggagggcacttgcgtg

SEQ ID NO: 383997 - DNA, 24 bp, Artificial Sequence
  Description of Artificial Sequence: Synthetic oligonucleotide
gcctacctggagggcacttgcgtg

SEQ ID NO: 383998 - DNA, 25 bp, Artificial Sequence
  Description of Artificial Sequence: Synthetic oligonucleotide
cctacctggagggcacttgcgtgga

SEQ ID NO: 383999 - DNA, 26 bp, Artificial Sequence
  Description of Artificial Sequence: Synthetic oligonucleotide
ctacctggagggcacttgcgtggagt

SEQ ID NO: 384000 - DNA, 26 bp, Artificial Sequence
  Description of Artificial Sequence: Synthetic oligonucleotide
tacctggagggcacttgcgtggagtg

SEQ ID NO: 384001 - DNA, 25 bp, Artificial Sequence
  Description of Artificial Sequence: Synthetic oligonucleotide
acctggagggcacttgcgtggagtg

SEQ ID NO: 384002 - DNA, 24 bp, Artificial Sequence
  Description of Artificial Sequence: Synthetic oligonucleotide
cctggagggcacttgcgtggagtg

SEQ ID NO: 384003 - DNA, 24 bp, Artificial Sequence
  Description of Artificial Sequence: Synthetic oligonucleotide
ctggagggcacttgcgtggagtgg

SEQ ID NO: 384004 - DNA, 25 bp, Artificial Sequence
  Description of Artificial Sequence: Synthetic oligonucleotide
tggagggcacttgcgtggagtggct

SEQ ID NO: 384005 - DNA, 24 bp, Artificial Sequence
  Description of Artificial Sequence: Synthetic oligonucleotide
ggagggcacttgcgtggagtggct

SEQ ID NO: 384006 - DNA, 24 bp, Artificial Sequence
  Description of Artificial Sequence: Synthetic oligonucleotide
gagggcacttgcgtggagtggctc

SEQ ID NO: 384007 - DNA, 24 bp, Artificial Sequence
  Description of Artificial Sequence: Synthetic oligonucleotide
agggcacttgcgtggagtggctcc

SEQ ID NO: 384008 - DNA, 23 bp, Artificial Sequence
  Description of Artificial Sequence: Synthetic oligonucleotide
gggcacttgcgtggagtggctcc

SEQ ID NO: 384009 - DNA, 21 bp, Artificial Sequence
  Description of Artificial Sequence: Synthetic oligonucleotide
cccaagaggggagccgcggga

SEQ ID NO: 384010 - DNA, 29 bp, Artificial Sequence
  Description of Artificial Sequence: Synthetic oligonucleotide
gtatttctccacatccgtgtcctggcctg

SEQ ID NO: 384011 - DNA, 29 bp, Artificial Sequence
  Description of Artificial Sequence: Synthetic oligonucleotide
tatttctccacatccgtgtcctggcctgg

SEQ ID NO: 384012 - DNA, 28 bp, Artificial Sequence
  Description of Artificial Sequence: Synthetic oligonucleotide
atttctccacatccgtgtcctggcctgg

SEQ ID NO: 384013 - DNA, 27 bp, Artificial Sequence
  Description of Artificial Sequence: Synthetic oligonucleotide
tttctccacatccgtgtcctggcctgg

SEQ ID NO: 384014 - DNA, 26 bp, Artificial Sequence
  Description of Artificial Sequence: Synthetic oligonucleotide
ttctccacatccgtgtcctggcctgg

SEQ ID NO: 384015 - DNA, 25 bp, Artificial Sequence
  Description of Artificial Sequence: Synthetic oligonucleotide
tctccacatccgtgtcctggcctgg

SEQ ID NO: 384016 - DNA, 24 bp, Artificial Sequence
  Description of Artificial Sequence: Synthetic oligonucleotide
ctccacatccgtgtcctggcctgg

SEQ ID NO: 384017 - DNA, 24 bp, Artificial Sequence
  Description of Artificial Sequence: Synthetic oligonucleotide
tccacatccgtgtcctggcctggc

SEQ ID NO: 384018 - DNA, 23 bp, Artificial Sequence
  Description of Artificial Sequence: Synthetic oligonucleotide
ccacatccgtgtcctggcctggc

SEQ ID NO: 384019 - DNA, 23 bp, Artificial Sequence
  Description of Artificial Sequence: Synthetic oligonucleotide
cacatccgtgtcctggcctggcc

SEQ ID NO: 384020 - DNA, 23 bp, Artificial Sequence
  Description of Artificial Sequence: Synthetic oligonucleotide
acatccgtgtcctggcctggccg

SEQ ID NO: 384021 - DNA, 22 bp, Artificial Sequence
  Description of Artificial Sequence: Synthetic oligonucleotide
catccgtgtcctggcctggccg

SEQ ID NO: 384022 - DNA, 22 bp, Artificial Sequence
  Description of Artificial Sequence: Synthetic oligonucleotide
atccgtgtcctggcctggccgc

SEQ ID NO: 384023 - DNA, 21 bp, Artificial Sequence
  Description of Artificial Sequence: Synthetic oligonucleotide
tccgtgtcctggcctggccgc

SEQ ID NO: 384024 - DNA, 20 bp, Artificial Sequence
  Description of Artificial Sequence: Synthetic oligonucleotide
ccgtgtcctggcctggccgc

SEQ ID NO: 384025 - DNA, 20 bp, Artificial Sequence
  Description of Artificial Sequence: Synthetic oligonucleotide
cgtgtcctggcctggccgcg

SEQ ID NO: 384026 - DNA, 20 bp, Artificial Sequence
  Description of Artificial Sequence: Synthetic oligonucleotide
gtgtcctggcctggccgcgg

SEQ ID NO: 384027 - DNA, 20 bp, Artificial Sequence
  Description of Artificial Sequence: Synthetic oligonucleotide
tgtcctggcctggccgcggg

SEQ ID NO: 384028 - DNA, 20 bp, Artificial Sequence
  Description of Artificial Sequence: Synthetic oligonucleotide
gtcctggcctggccgcgggt

SEQ ID NO: 384029 - DNA, 20 bp, Artificial Sequence
  Description of Artificial Sequence: Synthetic oligonucleotide
tcctggcctggccgcgggga

SEQ ID NO: 384030 - DNA, 20 bp, Artificial Sequence
  Description of Artificial Sequence: Synthetic oligonucleotide
cctggcctggccgcggggat

SEQ ID NO: 384031 - DNA, 20 bp, Artificial Sequence
  Description of Artificial Sequence: Synthetic oligonucleotide
ctggcctggccgcggggagt

SEQ ID NO: 384032 - DNA, 20 bp, Artificial Sequence
  Description of Artificial Sequence: Synthetic oligonucleotide
tggcctggccgcggggagct

SEQ ID NO: 384033 - DNA, 25 bp, Artificial Sequence
  Description of Artificial Sequence: Synthetic oligonucleotide
ttcgacagcgacgcggcgagtccaa

SEQ ID NO: 384034 - DNA, 24 bp, Artificial Sequence
  Description of Artificial Sequence: Synthetic oligonucleotide
tcgacagcgacgcggcgagtccaa

SEQ ID NO: 384035 - DNA, 23 bp, Artificial Sequence
  Description of Artificial Sequence: Synthetic oligonucleotide
cgacagcgacgcggcgagtccaa

SEQ ID NO: 384036 - DNA, 24 bp, Artificial Sequence
  Description of Artificial Sequence: Synthetic oligonucleotide
gacagcgacgcggcgagtccaaga

SEQ ID NO: 384037 - DNA, 24 bp, Artificial Sequence
  Description of Artificial Sequence: Synthetic oligonucleotide
acagcgacgcggcgagtccaagag

SEQ ID NO: 384038 - DNA, 23 bp, Artificial Sequence
  Description of Artificial Sequence: Synthetic oligonucleotide
cagcgacgcggcgagtccaagag

SEQ ID NO: 384039 - DNA, 23 bp, Artificial Sequence
  Description of Artificial Sequence: Synthetic oligonucleotide
agcgacgcggcgagtccaagagg

SEQ ID NO: 384040 - DNA, 22 bp, Artificial Sequence
  Description of Artificial Sequence: Synthetic oligonucleotide
gcgacgcggcgagtccaagagg

SEQ ID NO: 384041 - DNA, 22 bp, Artificial Sequence
  Description of Artificial Sequence: Synthetic oligonucleotide
cgacgcggcgagtccaagaggg

SEQ ID NO: 384042 - DNA, 23 bp, Artificial Sequence
  Description of Artificial Sequence: Synthetic oligonucleotide
gacgcggcgagtccaagagggga

SEQ ID NO: 384043 - DNA, 23 bp, Artificial Sequence
  Description of Artificial Sequence: Synthetic oligonucleotide
acgcggcgagtccaagaggggag

SEQ ID NO: 384044 - DNA, 22 bp, Artificial Sequence
  Description of Artificial Sequence: Synthetic oligonucleotide
cgcggcgagtccaagaggggag

SEQ ID NO: 384045 - DNA, 22 bp, Artificial Sequence
  Description of Artificial Sequence: Synthetic oligonucleotide
gcggcgagtccaagaggggagc

SEQ ID NO: 384046 - DNA, 22 bp, Artificial Sequence
  Description of Artificial Sequence: Synthetic oligonucleotide
cggcgagtccaagaggggagcc

SEQ ID NO: 384047 - DNA, 22 bp, Artificial Sequence
  Description of Artificial Sequence: Synthetic oligonucleotide
ggcgagtccaagaggggagccg

SEQ ID NO: 384048 - DNA, 22 bp, Artificial Sequence
  Description of Artificial Sequence: Synthetic oligonucleotide
atccgtgtcctggcccggccgt

SEQ ID NO: 384049 - DNA, 21 bp, Artificial Sequence
  Description of Artificial Sequence: Synthetic oligonucleotide
tccgtgtcctggcccggccgt

SEQ ID NO: 384050 - DNA, 20 bp, Artificial Sequence
  Description of Artificial Sequence: Synthetic oligonucleotide
cgtgtcctggcccggccgtg

SEQ ID NO: 384051 - DNA, 20 bp, Artificial Sequence
  Description of Artificial Sequence: Synthetic oligonucleotide
gtgtcctggcccggccgtgg

SEQ ID NO: 384052 - DNA, 20 bp, Artificial Sequence
  Description of Artificial Sequence: Synthetic oligonucleotide
tgtcctggcccggccgtggg

SEQ ID NO: 384053 - DNA, 20 bp, Artificial Sequence
  Description of Artificial Sequence: Synthetic oligonucleotide
gtcctggcccggccgtgggt

SEQ ID NO: 384054 - DNA, 20 bp, Artificial Sequence
  Description of Artificial Sequence: Synthetic oligonucleotide
tcctggcccggccgtgggga

SEQ ID NO: 384055 - DNA, 20 bp, Artificial Sequence
  Description of Artificial Sequence: Synthetic oligonucleotide
cctggcccggccgtggggat

SEQ ID NO: 384056 - DNA, 20 bp, Artificial Sequence
  Description of Artificial Sequence: Synthetic oligonucleotide
ctggcccggccgtggggagt

SEQ ID NO: 384057 - DNA, 20 bp, Artificial Sequence
  Description of Artificial Sequence: Synthetic oligonucleotide
tggcccggccgtggggagct

SEQ ID NO: 384058 - DNA, 23 bp, Artificial Sequence
  Description of Artificial Sequence: Synthetic oligonucleotide
gggagccgtgggtggagcaggaa

SEQ ID NO: 384059 - DNA, 23 bp, Artificial Sequence
  Description of Artificial Sequence: Synthetic oligonucleotide
ggagccgtgggtggagcaggaag

SEQ ID NO: 384060 - DNA, 23 bp, Artificial Sequence
  Description of Artificial Sequence: Synthetic oligonucleotide
gagccgtgggtggagcaggaagg

SEQ ID NO: 384061 - DNA, 23 bp, Artificial Sequence
  Description of Artificial Sequence: Synthetic oligonucleotide
agccgtgggtggagcaggaaggg

SEQ ID NO: 384062 - DNA, 22 bp, Artificial Sequence
  Description of Artificial Sequence: Synthetic oligonucleotide
gccgtgggtggagcaggaaggg

SEQ ID NO: 384063 - DNA, 22 bp, Artificial Sequence
  Description of Artificial Sequence: Synthetic oligonucleotide
ccgtgggtggagcaggaagggc

SEQ ID NO: 384064 - DNA, 22 bp, Artificial Sequence
  Description of Artificial Sequence: Synthetic oligonucleotide
cgtgggtggagcaggaagggcc

SEQ ID NO: 384065 - DNA, 22 bp, Artificial Sequence
  Description of Artificial Sequence: Synthetic oligonucleotide
gtgggtggagcaggaagggccg

SEQ ID NO: 384066 - DNA, 23 bp, Artificial Sequence
  Description of Artificial Sequence: Synthetic oligonucleotide
tgggtggagcaggaagggccgga

SEQ ID NO: 384067 - DNA, 22 bp, Artificial Sequence
  Description of Artificial Sequence: Synthetic oligonucleotide
gggtggagcaggaagggccgga

SEQ ID NO: 384068 - DNA, 26 bp, Artificial Sequence
  Description of Artificial Sequence: Synthetic oligonucleotide
ggtggagcaggaagggccggagtatt

SEQ ID NO: 384069 - DNA, 26 bp, Artificial Sequence
  Description of Artificial Sequence: Synthetic oligonucleotide
gtggagcaggaagggccggagtattg

SEQ ID NO: 384070 - DNA, 26 bp, Artificial Sequence
  Description of Artificial Sequence: Synthetic oligonucleotide
tggagcaggaagggccggagtattgg

SEQ ID NO: 384071 - DNA, 25 bp, Artificial Sequence
  Description of Artificial Sequence: Synthetic oligonucleotide
ggagcaggaagggccggagtattgg

SEQ ID NO: 384072 - DNA, 26 bp, Artificial Sequence
  Description of Artificial Sequence: Synthetic oligonucleotide
gagcaggaagggccggagtattggga

SEQ ID NO: 384073 - DNA, 26 bp, Artificial Sequence
  Description of Artificial Sequence: Synthetic oligonucleotide
agcaggaagggccggagtattgggac

SEQ ID NO: 384074 - DNA, 25 bp, Artificial Sequence
  Description of Artificial Sequence: Synthetic oligonucleotide
gcaggaagggccggagtattgggac

SEQ ID NO: 384075 - DNA, 25 bp, Artificial Sequence
  Description of Artificial Sequence: Synthetic oligonucleotide
caggaagggccggagtattgggacc

SEQ ID NO: 384076 - DNA, 25 bp, Artificial Sequence
  Description of Artificial Sequence: Synthetic oligonucleotide
aggaagggccggagtattgggaccg

SEQ ID NO: 384077 - DNA, 24 bp, Artificial Sequence
  Description of Artificial Sequence: Synthetic oligonucleotide
ggaagggccggagtattgggaccg

SEQ ID NO: 384078 - DNA, 24 bp, Artificial Sequence
  Description of Artificial Sequence: Synthetic oligonucleotide
gaagggccggagtattgggaccgg

SEQ ID NO: 384079 - DNA, 25 bp, Artificial Sequence
  Description of Artificial Sequence: Synthetic oligonucleotide
aagggccggagtattgggaccggga

SEQ ID NO: 384080 - DNA, 24 bp, Artificial Sequence
  Description of Artificial Sequence: Synthetic oligonucleotide
agggccggagtattgggaccggga

SEQ ID NO: 384081 - DNA, 24 bp, Artificial Sequence
  Description of Artificial Sequence: Synthetic oligonucleotide
gaggggccggagtattgggaccga

SEQ ID NO: 384082 - DNA, 25 bp, Artificial Sequence
  Description of Artificial Sequence: Synthetic oligonucleotide
aggggccggagtattgggaccgaga

SEQ ID NO: 384083 - DNA, 24 bp, Artificial Sequence
  Description of Artificial Sequence: Synthetic oligonucleotide
ggggccggagtattgggaccgaga

SEQ ID NO: 384084 - DNA, 25 bp, Artificial Sequence
  Description of Artificial Sequence: Synthetic oligonucleotide
gggccggagtattgggaccgagaga

SEQ ID NO: 384085 - DNA, 26 bp, Artificial Sequence
  Description of Artificial Sequence: Synthetic oligonucleotide
ggccggagtattgggaccgagagaca

SEQ ID NO: 384086 - DNA, 27 bp, Artificial Sequence
  Description of Artificial Sequence: Synthetic oligonucleotide
gccggagtattgggaccgagagacaca

SEQ ID NO: 384087 - DNA, 27 bp, Artificial Sequence
  Description of Artificial Sequence: Synthetic oligonucleotide
ccggagtattgggaccgagagacacag

SEQ ID NO: 384088 - DNA, 29 bp, Artificial Sequence
  Description of Artificial Sequence: Synthetic oligonucleotide
cggagtattgggaccgagagacacagaag

SEQ ID NO: 384089 - DNA, 31 bp, Artificial Sequence; identical to SEQ ID NO: 44586
  Description of Artificial Sequence: Synthetic oligonucleotide

SEQ ID NO: 384090 - DNA, 33 bp, Artificial Sequence; identical to SEQ ID NO: 44587
  Description of Artificial Sequence: Synthetic oligonucleotide

SEQ ID NO: 384091 - DNA, 33 bp, Artificial Sequence; identical to SEQ ID NO: 44588
  Description of Artificial Sequence: Synthetic oligonucleotide

SEQ ID NO: 384092 - DNA, 32 bp, Artificial Sequence; identical to SEQ ID NO: 44589
  Description of Artificial Sequence: Synthetic oligonucleotide

SEQ ID NO: 384093 - DNA, 32 bp, Artificial Sequence; identical to SEQ ID NO: 44590
  Description of Artificial Sequence: Synthetic oligonucleotide

SEQ ID NO: 384094 - DNA, 31 bp, Artificial Sequence; identical to SEQ ID NO: 44591
  Description of Artificial Sequence: Synthetic oligonucleotide

SEQ ID NO: 384095 - DNA, 30 bp, Artificial Sequence; identical to SEQ ID NO: 44592
  Description of Artificial Sequence: Synthetic oligonucleotide

SEQ ID NO: 384096 - DNA, 29 bp, Artificial Sequence
  Description of Artificial Sequence: Synthetic oligonucleotide
tgggaccgagagacacagaagtacaagcg

SEQ ID NO: 384097 - DNA, 28 bp, Artificial Sequence
  Description of Artificial Sequence: Synthetic oligonucleotide
gggaccgagagacacagaagtacaagcg

SEQ ID NO: 384098 - DNA, 28 bp, Artificial Sequence
  Description of Artificial Sequence: Synthetic oligonucleotide
ggaccgagagacacagaagtacaagcgc

SEQ ID NO: 384099 - DNA, 28 bp, Artificial Sequence
  Description of Artificial Sequence: Synthetic oligonucleotide
gaccgagagacacagaagtacaagcgcc

SEQ ID NO: 384100 - DNA, 29 bp, Artificial Sequence
  Description of Artificial Sequence: Synthetic oligonucleotide
accgagagacacagaagtacaagcgccag

SEQ ID NO: 384101 - DNA, 28 bp, Artificial Sequence
  Description of Artificial Sequence: Synthetic oligonucleotide
ccgagagacacagaagtacaagcgccag

SEQ ID NO: 384102 - DNA, 28 bp, Artificial Sequence
  Description of Artificial Sequence: Synthetic oligonucleotide
cgagagacacagaagtacaagcgccagg

SEQ ID NO: 384103 - DNA, 28 bp, Artificial Sequence
  Description of Artificial Sequence: Synthetic oligonucleotide
gagagacacagaagtacaagcgccaggc

SEQ ID NO: 384104 - DNA, 29 bp, Artificial Sequence
  Description of Artificial Sequence: Synthetic oligonucleotide
agagacacagaagtacaagcgccaggcac

SEQ ID NO: 384105 - DNA, 23 bp, Artificial Sequence
  Description of Artificial Sequence: Synthetic oligonucleotide
gggcgcctcctccgcggctataa

SEQ ID NO: 384106 - DNA, 23 bp, Artificial Sequence
  Description of Artificial Sequence: Synthetic oligonucleotide
ggcgcctcctccgcggctataac

SEQ ID NO: 384107 - DNA, 24 bp, Artificial Sequence
  Description of Artificial Sequence: Synthetic oligonucleotide
gcgcctcctccgcggctataacca

SEQ ID NO: 384108 - DNA, 26 bp, Artificial Sequence
  Description of Artificial Sequence: Synthetic oligonucleotide
cgcctcctccgcggctataaccagtt

SEQ ID NO: 384109 - DNA, 26 bp, Artificial Sequence
  Description of Artificial Sequence: Synthetic oligonucleotide
gcctcctccgcggctataaccagttc

SEQ ID NO: 384110 - DNA, 26 bp, Artificial Sequence
  Description of Artificial Sequence: Synthetic oligonucleotide
cctcctccgcggctataaccagttcg

SEQ ID NO: 384111 - DNA, 26 bp, Artificial Sequence
  Description of Artificial Sequence: Synthetic oligonucleotide
ctcctccgcggctataaccagttcgc

SEQ ID NO: 384112 - DNA, 27 bp, Artificial Sequence
  Description of Artificial Sequence: Synthetic oligonucleotide
tcctccgcggctataaccagttcgcct

SEQ ID NO: 384113 - DNA, 27 bp, Artificial Sequence
  Description of Artificial Sequence: Synthetic oligonucleotide
cctccgcggctataaccagttcgccta

SEQ ID NO: 384114 - DNA, 27 bp, Artificial Sequence
  Description of Artificial Sequence: Synthetic oligonucleotide
ctccgcggctataaccagttcgcctac

SEQ ID NO: 384115 - DNA, 27 bp, Artificial Sequence
  Description of Artificial Sequence: Synthetic oligonucleotide
tccgcggctataaccagttcgcctacg

SEQ ID NO: 384116 - DNA, 27 bp, Artificial Sequence
  Description of Artificial Sequence: Synthetic oligonucleotide
ccgcggctataaccagttcgcctacga

SEQ ID NO: 384117 - DNA, 27 bp, Artificial Sequence
  Description of Artificial Sequence: Synthetic oligonucleotide
cgcggctataaccagttcgcctacgac

SEQ ID NO: 384118 - DNA, 27 bp, Artificial Sequence
  Description of Artificial Sequence: Synthetic oligonucleotide
gcggctataaccagttcgcctacgacg

SEQ ID NO: 384119 - DNA, 27 bp, Artificial Sequence
  Description of Artificial Sequence: Synthetic oligonucleotide
cggctataaccagttcgcctacgacgg

SEQ ID NO: 384120 - DNA, 27 bp, Artificial Sequence
  Description of Artificial Sequence: Synthetic oligonucleotide
ggctataaccagttcgcctacgacggc

SEQ ID NO: 384121 - DNA, 29 bp, Artificial Sequence
  Description of Artificial Sequence: Synthetic oligonucleotide
gctataaccagttcgcctacgacggcaag

SEQ ID NO: 384122 - DNA, 29 bp, Artificial Sequence
  Description of Artificial Sequence: Synthetic oligonucleotide
ctataaccagttcgcctacgacggcaagg

SEQ ID NO: 384123 - DNA, 30 bp, Artificial Sequence; identical to SEQ ID NO: 44620
  Description of Artificial Sequence: Synthetic oligonucleotide

SEQ ID NO: 384124 - DNA, 30 bp, Artificial Sequence; identical to SEQ ID NO: 44621
  Description of Artificial Sequence: Synthetic oligonucleotide

SEQ ID NO: 384125 - DNA, 29 bp, Artificial Sequence
  Description of Artificial Sequence: Synthetic oligonucleotide
ctcacaccctccagaggatgtttggttgc

SEQ ID NO: 384126 - DNA, 29 bp, Artificial Sequence
  Description of Artificial Sequence: Synthetic oligonucleotide
tcacaccctccagaggatgtttggttgcg

SEQ ID NO: 384127 - DNA, 28 bp, Artificial Sequence
  Description of Artificial Sequence: Synthetic oligonucleotide
cacaccctccagaggatgtttggttgcg

SEQ ID NO: 384128 - DNA, 29 bp, Artificial Sequence
  Description of Artificial Sequence: Synthetic oligonucleotide
acaccctccagaggatgtttggttgcgac

SEQ ID NO: 384129 - DNA, 28 bp, Artificial Sequence
  Description of Artificial Sequence: Synthetic oligonucleotide
caccctccagaggatgtttggttgcgac

SEQ ID NO: 384130 - DNA, 28 bp, Artificial Sequence
  Description of Artificial Sequence: Synthetic oligonucleotide
accctccagaggatgtttggttgcgacc

SEQ ID NO: 384131 - DNA, 27 bp, Artificial Sequence
  Description of Artificial Sequence: Synthetic oligonucleotide
ccctccagaggatgtttggttgcgacc

SEQ ID NO: 384132 - DNA, 28 bp, Artificial Sequence
  Description of Artificial Sequence: Synthetic oligonucleotide
cctccagaggatgtttggttgcgacctg

SEQ ID NO: 384133 - DNA, 28 bp, Artificial Sequence
  Description of Artificial Sequence: Synthetic oligonucleotide
ctccagaggatgtttggttgcgacctgg

SEQ ID NO: 384134 - DNA, 28 bp, Artificial Sequence
  Description of Artificial Sequence: Synthetic oligonucleotide
tccagaggatgtttggttgcgacctggg

SEQ ID NO: 384135 - DNA, 27 bp, Artificial Sequence
  Description of Artificial Sequence: Synthetic oligonucleotide
ccagaggatgtttggttgcgacctggg

SEQ ID NO: 384136 - DNA, 27 bp, Artificial Sequence
  Description of Artificial Sequence: Synthetic oligonucleotide
cagaggatgtttggttgcgacctgggg

SEQ ID NO: 384137 - DNA, 27 bp, Artificial Sequence
  Description of Artificial Sequence: Synthetic oligonucleotide
agaggatgtttggttgcgacctggggc

SEQ ID NO: 384138 - DNA, 26 bp, Artificial Sequence
  Description of Artificial Sequence: Synthetic oligonucleotide
gaggatgtttggttgcgacctggggc

SEQ ID NO: 384139 - DNA, 26 bp, Artificial Sequence
  Description of Artificial Sequence: Synthetic oligonucleotide
aggatgtttggttgcgacctggggcc

SEQ ID NO: 384140 - DNA, 25 bp, Artificial Sequence
  Description of Artificial Sequence: Synthetic oligonucleotide
ggatgtttggttgcgacctggggcc

SEQ ID NO: 384141 - DNA, 25 bp, Artificial Sequence
  Description of Artificial Sequence: Synthetic oligonucleotide
gatgtttggttgcgacctggggccg

SEQ ID NO: 384142 - DNA, 26 bp, Artificial Sequence
  Description of Artificial Sequence: Synthetic oligonucleotide
atgtttggttgcgacctggggccgga

SEQ ID NO: 384143 - DNA, 25 bp, Artificial Sequence
  Description of Artificial Sequence: Synthetic oligonucleotide
tgtttggttgcgacctggggccgga

SEQ ID NO: 384144 - DNA, 24 bp, Artificial Sequence
  Description of Artificial Sequence: Synthetic oligonucleotide
gtttggttgcgacctggggccgga

SEQ ID NO: 384145 - DNA, 24 bp, Artificial Sequence
  Description of Artificial Sequence: Synthetic oligonucleotide
tttggttgcgacctggggccggac

SEQ ID NO: 384146 - DNA, 23 bp, Artificial Sequence
  Description of Artificial Sequence: Synthetic oligonucleotide
ttggttgcgacctggggccggac

SEQ ID NO: 384147 - DNA, 22 bp, Artificial Sequence
  Description of Artificial Sequence: Synthetic oligonucleotide
tggttgcgacctggggccggac

SEQ ID NO: 384148 - DNA, 21 bp, Artificial Sequence
  Description of Artificial Sequence: Synthetic oligonucleotide
ggttgcgacctggggccggac

SEQ ID NO: 384149 - DNA, 21 bp, Artificial Sequence
  Description of Artificial Sequence: Synthetic oligonucleotide
gttgcgacctggggccggacg

SEQ ID NO: 384150 - DNA, 21 bp, Artificial Sequence
  Description of Artificial Sequence: Synthetic oligonucleotide
ttgcgacctggggccggacgg

SEQ ID NO: 384151 - DNA, 25 bp, Artificial Sequence
  Description of Artificial Sequence: Synthetic oligonucleotide
caggaggggccggagtattgggatc

SEQ ID NO: 384152 - DNA, 25 bp, Artificial Sequence
  Description of Artificial Sequence: Synthetic oligonucleotide
aggaggggccggagtattgggatcg

SEQ ID NO: 384153 - DNA, 24 bp, Artificial Sequence
  Description of Artificial Sequence: Synthetic oligonucleotide
ggaggggccggagtattgggatcg

SEQ ID NO: 384154 - DNA, 24 bp, Artificial Sequence
  Description of Artificial Sequence: Synthetic oligonucleotide
gaggggccggagtattgggatcgg

SEQ ID NO: 384155 - DNA, 25 bp, Artificial Sequence
  Description of Artificial Sequence: Synthetic oligonucleotide
aggggccggagtattgggatcggga

SEQ ID NO: 384156 - DNA, 24 bp, Artificial Sequence
  Description of Artificial Sequence: Synthetic oligonucleotide
ggggccggagtattgggatcggga

SEQ ID NO: 384157 - DNA, 25 bp, Artificial Sequence
  Description of Artificial Sequence: Synthetic oligonucleotide
gggccggagtattgggatcgggaga

SEQ ID NO: 384158 - DNA, 26 bp, Artificial Sequence
  Description of Artificial Sequence: Synthetic oligonucleotide
ggccggagtattgggatcgggagaca

SEQ ID NO: 384159 - DNA, 27 bp, Artificial Sequence
  Description of Artificial Sequence: Synthetic oligonucleotide
gccggagtattgggatcgggagacaca

SEQ ID NO: 384160 - DNA, 27 bp, Artificial Sequence
  Description of Artificial Sequence: Synthetic oligonucleotide
ccggagtattgggatcgggagacacag

SEQ ID NO: 384161 - DNA, 29 bp, Artificial Sequence
  Description of Artificial Sequence: Synthetic oligonucleotide
cggagtattgggatcgggagacacagaag

SEQ ID NO: 384162 - DNA, 31 bp, Artificial Sequence; identical to SEQ ID NO: 44659
  Description of Artificial Sequence: Synthetic oligonucleotide

SEQ ID NO: 384163 - DNA, 33 bp, Artificial Sequence; identical to SEQ ID NO: 44660
  Description of Artificial Sequence: Synthetic oligonucleotide

SEQ ID NO: 384164 - DNA, 33 bp, Artificial Sequence; identical to SEQ ID NO: 44661
  Description of Artificial Sequence: Synthetic oligonucleotide

SEQ ID NO: 384165 - DNA, 32 bp, Artificial Sequence; identical to SEQ ID NO: 44662
  Description of Artificial Sequence: Synthetic oligonucleotide

SEQ ID NO: 384166 - DNA, 32 bp, Artificial Sequence; identical to SEQ ID NO: 44663
  Description of Artificial Sequence: Synthetic oligonucleotide

SEQ ID NO: 384167 - DNA, 31 bp, Artificial Sequence; identical to SEQ ID NO: 44664
  Description of Artificial Sequence: Synthetic oligonucleotide

SEQ ID NO: 384168 - DNA, 30 bp, Artificial Sequence; identical to SEQ ID NO: 44665
  Description of Artificial Sequence: Synthetic oligonucleotide

SEQ ID NO: 384169 - DNA, 29 bp, Artificial Sequence
  Description of Artificial Sequence: Synthetic oligonucleotide
tgggatcgggagacacagaagtacaagcg

SEQ ID NO: 384170 - DNA, 28 bp, Artificial Sequence
  Description of Artificial Sequence: Synthetic oligonucleotide
gggatcgggagacacagaagtacaagcg

SEQ ID NO: 384171 - DNA, 28 bp, Artificial Sequence
  Description of Artificial Sequence: Synthetic oligonucleotide
ggatcgggagacacagaagtacaagcgc

SEQ ID NO: 384172 - DNA, 28 bp, Artificial Sequence
  Description of Artificial Sequence: Synthetic oligonucleotide
gatcgggagacacagaagtacaagcgcc

SEQ ID NO: 384173 - DNA, 29 bp, Artificial Sequence
  Description of Artificial Sequence: Synthetic oligonucleotide
atcgggagacacagaagtacaagcgccag

SEQ ID NO: 384174 - DNA, 28 bp, Artificial Sequence
  Description of Artificial Sequence: Synthetic oligonucleotide
tcgggagacacagaagtacaagcgccag

SEQ ID NO: 384175 - DNA, 28 bp, Artificial Sequence
  Description of Artificial Sequence: Synthetic oligonucleotide
ctccgcgggtataaccagttcgcctatg

SEQ ID NO: 384176 - DNA, 29 bp, Artificial Sequence
  Description of Artificial Sequence: Synthetic oligonucleotide
tccgcgggtataaccagttcgcctatgac

SEQ ID NO: 384177 - DNA, 28 bp, Artificial Sequence
  Description of Artificial Sequence: Synthetic oligonucleotide
ccgcgggtataaccagttcgcctatgac

SEQ ID NO: 384178 - DNA, 28 bp, Artificial Sequence
  Description of Artificial Sequence: Synthetic oligonucleotide
cgcgggtataaccagttcgcctatgacg

SEQ ID NO: 384179 - DNA, 28 bp, Artificial Sequence
  Description of Artificial Sequence: Synthetic oligonucleotide
gcgggtataaccagttcgcctatgacgg

SEQ ID NO: 384180 - DNA, 28 bp, Artificial Sequence
  Description of Artificial Sequence: Synthetic oligonucleotide
cgggtataaccagttcgcctatgacggc

SEQ ID NO: 384181 - DNA, 30 bp, Artificial Sequence; identical to SEQ ID NO: 44678
  Description of Artificial Sequence: Synthetic oligonucleotide

SEQ ID NO: 384182 - DNA, 30 bp, Artificial Sequence; identical to SEQ ID NO: 44679
  Description of Artificial Sequence: Synthetic oligonucleotide

SEQ ID NO: 384183 - DNA, 34 bp, Artificial Sequence; identical to SEQ ID NO: 44680
  Description of Artificial Sequence: Synthetic oligonucleotide

SEQ ID NO: 384184 - DNA, 36 bp, Artificial Sequence; identical to SEQ ID NO: 44681
  Description of Artificial Sequence: Synthetic oligonucleotide

SEQ ID NO: 384185 - DNA, 35 bp, Artificial Sequence; identical to SEQ ID NO: 44682
  Description of Artificial Sequence: Synthetic oligonucleotide

SEQ ID NO: 384186 - DNA, 34 bp, Artificial Sequence; identical to SEQ ID NO: 44683
  Description of Artificial Sequence: Synthetic oligonucleotide

SEQ ID NO: 384187 - DNA, 33 bp, Artificial Sequence; identical to SEQ ID NO: 44684
  Description of Artificial Sequence: Synthetic oligonucleotide

SEQ ID NO: 384188 - DNA, 32 bp, Artificial Sequence; identical to SEQ ID NO: 44685
  Description of Artificial Sequence: Synthetic oligonucleotide

SEQ ID NO: 384189 - DNA, 31 bp, Artificial Sequence; identical to SEQ ID NO: 44686
  Description of Artificial Sequence: Synthetic oligonucleotide

SEQ ID NO: 384190 - DNA, 31 bp, Artificial Sequence; identical to SEQ ID NO: 44687
  Description of Artificial Sequence: Synthetic oligonucleotide

SEQ ID NO: 384191 - DNA, 31 bp, Artificial Sequence; identical to SEQ ID NO: 44688
  Description of Artificial Sequence: Synthetic oligonucleotide

SEQ ID NO: 384192 - DNA, 30 bp, Artificial Sequence; identical to SEQ ID NO: 44689
  Description of Artificial Sequence: Synthetic oligonucleotide

SEQ ID NO: 384193 - DNA, 30 bp, Artificial Sequence; identical to SEQ ID NO: 44690
  Description of Artificial Sequence: Synthetic oligonucleotide

SEQ ID NO: 384194 - DNA, 29 bp, Artificial Sequence
  Description of Artificial Sequence: Synthetic oligonucleotide
tcgcctatgacggcaaggattacatcgcc

SEQ ID NO: 384195 - DNA, 24 bp, Artificial Sequence
  Description of Artificial Sequence: Synthetic oligonucleotide
agcgacgccgcgagtccaagagga

SEQ ID NO: 384196 - DNA, 23 bp, Artificial Sequence
  Description of Artificial Sequence: Synthetic oligonucleotide
gcgacgccgcgagtccaagagga

SEQ ID NO: 384197 - DNA, 24 bp, Artificial Sequence
  Description of Artificial Sequence: Synthetic oligonucleotide
cgacgccgcgagtccaagaggaga

SEQ ID NO: 384198 - DNA, 24 bp, Artificial Sequence
  Description of Artificial Sequence: Synthetic oligonucleotide
gacgccgcgagtccaagaggagag

SEQ ID NO: 384199 - DNA, 24 bp, Artificial Sequence
  Description of Artificial Sequence: Synthetic oligonucleotide
acgccgcgagtccaagaggagagc

SEQ ID NO: 384200 - DNA, 23 bp, Artificial Sequence
  Description of Artificial Sequence: Synthetic oligonucleotide
cgccgcgagtccaagaggagagc

SEQ ID NO: 384201 - DNA, 23 bp, Artificial Sequence
  Description of Artificial Sequence: Synthetic oligonucleotide
gccgcgagtccaagaggagagcc

SEQ ID NO: 384202 - DNA, 23 bp, Artificial Sequence
  Description of Artificial Sequence: Synthetic oligonucleotide
ccgcgagtccaagaggagagccg

SEQ ID NO: 384203 - DNA, 23 bp, Artificial Sequence
  Description of Artificial Sequence: Synthetic oligonucleotide
cgcgagtccaagaggagagccgc

SEQ ID NO: 384204 - DNA, 23 bp, Artificial Sequence
  Description of Artificial Sequence: Synthetic oligonucleotide
gcgagtccaagaggagagccgcg

SEQ ID NO: 384205 - DNA, 23 bp, Artificial Sequence
  Description of Artificial Sequence: Synthetic oligonucleotide
cgagtccaagaggagagccgcgg

SEQ ID NO: 384206 - DNA, 24 bp, Artificial Sequence
  Description of Artificial Sequence: Synthetic oligonucleotide
gagtccaagaggagagccgcggga

SEQ ID NO: 384207 - DNA, 24 bp, Artificial Sequence
  Description of Artificial Sequence: Synthetic oligonucleotide
agtccaagaggagagccgcgggag

SEQ ID NO: 384208 - DNA, 23 bp, Artificial Sequence
  Description of Artificial Sequence: Synthetic oligonucleotide
gtccaagaggagagccgcgggag

SEQ ID NO: 384209 - DNA, 23 bp, Artificial Sequence
  Description of Artificial Sequence: Synthetic oligonucleotide
tccaagaggagagccgcgggagc

SEQ ID NO: 384210 - DNA, 22 bp, Artificial Sequence
  Description of Artificial Sequence: Synthetic oligonucleotide
ccaagaggagagccgcgggagc

SEQ ID NO: 384211 - DNA, 22 bp, Artificial Sequence
  Description of Artificial Sequence: Synthetic oligonucleotide
caagaggagagccgcgggagcc

SEQ ID NO: 384212 - DNA, 23 bp, Artificial Sequence
  Description of Artificial Sequence: Synthetic oligonucleotide
aagaggagagccgcgggagccgt

SEQ ID NO: 384213 - DNA, 22 bp, Artificial Sequence
  Description of Artificial Sequence: Synthetic oligonucleotide
agaggagagccgcgggagccgt

SEQ ID NO: 384214 - DNA, 21 bp, Artificial Sequence
  Description of Artificial Sequence: Synthetic oligonucleotide
gaggagagccgcgggagccgt

SEQ ID NO: 384215 - DNA, 21 bp, Artificial Sequence
  Description of Artificial Sequence: Synthetic oligonucleotide
aggagagccgcgggagccgtg

SEQ ID NO: 384216 - DNA, 20 bp, Artificial Sequence
  Description of Artificial Sequence: Synthetic oligonucleotide
ggagagccgcgggagccgtg

SEQ ID NO: 384217 - DNA, 20 bp, Artificial Sequence
  Description of Artificial Sequence: Synthetic oligonucleotide
gagagccgcgggagccgtgg

SEQ ID NO: 384218 - DNA, 21 bp, Artificial Sequence
  Description of Artificial Sequence: Synthetic oligonucleotide
agagccgcgggagccgtgggt

SEQ ID NO: 384219 - DNA, 31 bp, Artificial Sequence
  Description of Artificial Sequence: Synthetic oligonucleotide
ggcaaggattacatcgctctgaacgaggatc

SEQ ID NO: 384220 - DNA, 32 bp, Artificial Sequence
  Description of Artificial Sequence: Synthetic oligonucleotide
gcaaggattacatcgctctgaacgaggatctg

SEQ ID NO: 384221 - DNA, 32 bp, Artificial Sequence
  Description of Artificial Sequence: Synthetic oligonucleotide
caaggattacatcgctctgaacgaggatctgc

SEQ ID NO: 384222 - DNA, 32 bp, Artificial Sequence
  Description of Artificial Sequence: Synthetic oligonucleotide
aaggattacatcgctctgaacgaggatctgcg

SEQ ID NO: 384223 - DNA, 31 bp, Artificial Sequence
  Description of Artificial Sequence: Synthetic oligonucleotide
aggattacatcgctctgaacgaggatctgcg

SEQ ID NO: 384224 - DNA, 30 bp, Artificial Sequence
  Description of Artificial Sequence: Synthetic oligonucleotide
ggattacatcgctctgaacgaggatctgcg

SEQ ID NO: 384225 - DNA, 30 bp, Artificial Sequence
  Description of Artificial Sequence: Synthetic oligonucleotide
gattacatcgctctgaacgaggatctgcgc

SEQ ID NO: 384226 - DNA, 31 bp, Artificial Sequence
  Description of Artificial Sequence: Synthetic oligonucleotide
attacatcgctctgaacgaggatctgcgctc

SEQ ID NO: 384227 - DNA, 30 bp, Artificial Sequence
  Description of Artificial Sequence: Synthetic oligonucleotide
ttacatcgctctgaacgaggatctgcgctc

SEQ ID NO: 384228 - DNA, 29 bp, Artificial Sequence
  Description of Artificial Sequence: Synthetic oligonucleotide
tacatcgctctgaacgaggatctgcgctc

SEQ ID NO: 384229 - DNA, 28 bp, Artificial Sequence
  Description of Artificial Sequence: Synthetic oligonucleotide
acatcgctctgaacgaggatctgcgctc

SEQ ID NO: 384230 - DNA, 27 bp, Artificial Sequence
  Description of Artificial Sequence: Synthetic oligonucleotide
catcgctctgaacgaggatctgcgctc

SEQ ID NO: 384231 - DNA, 27 bp, Artificial Sequence
  Description of Artificial Sequence: Synthetic oligonucleotide
atcgctctgaacgaggatctgcgctcc

SEQ ID NO: 384232 - DNA, 27 bp, Artificial Sequence
  Description of Artificial Sequence: Synthetic oligonucleotide
tcgctctgaacgaggatctgcgctcct

SEQ ID NO: 384233 - DNA, 26 bp, Artificial Sequence
  Description of Artificial Sequence: Synthetic oligonucleotide
cgctctgaacgaggatctgcgctcct

SEQ ID NO: 384234 - DNA, 26 bp, Artificial Sequence
  Description of Artificial Sequence: Synthetic oligonucleotide
gctctgaacgaggatctgcgctcctg

SEQ ID NO: 384235 - DNA, 27 bp, Artificial Sequence
  Description of Artificial Sequence: Synthetic oligonucleotide
ctctgaacgaggatctgcgctcctgga

SEQ ID NO: 384236 - DNA, 27 bp, Artificial Sequence
  Description of Artificial Sequence: Synthetic oligonucleotide
tctgaacgaggatctgcgctcctggac

SEQ ID NO: 384237 - DNA, 21 bp, Artificial Sequence
  Description of Artificial Sequence: Synthetic oligonucleotide
tccgagaggggagccgcggga

SEQ ID NO: 384238 - DNA, 20 bp, Artificial Sequence
  Description of Artificial Sequence: Synthetic oligonucleotide
ccgagaggggagccgcggga

SEQ ID NO: 384239 - DNA, 20 bp, Artificial Sequence
  Description of Artificial Sequence: Synthetic oligonucleotide
cgagaggggagccgcgggag

SEQ ID NO: 384240 - DNA, 20 bp, Artificial Sequence
  Description of Artificial Sequence: Synthetic oligonucleotide
gagaggggagccgcgggagc

SEQ ID NO: 384241 - DNA, 26 bp, Artificial Sequence
  Description of Artificial Sequence: Synthetic oligonucleotide
accagagcgaggacgggtctcacact

SEQ ID NO: 384242 - DNA, 25 bp, Artificial Sequence
  Description of Artificial Sequence: Synthetic oligonucleotide
ccagagcgaggacgggtctcacact

SEQ ID NO: 384243 - DNA, 26 bp, Artificial Sequence
  Description of Artificial Sequence: Synthetic oligonucleotide
cagagcgaggacgggtctcacactct

SEQ ID NO: 384244 - DNA, 26 bp, Artificial Sequence
  Description of Artificial Sequence: Synthetic oligonucleotide
agagcgaggacgggtctcacactctc

SEQ ID NO: 384245 - DNA, 25 bp, Artificial Sequence
  Description of Artificial Sequence: Synthetic oligonucleotide
gagcgaggacgggtctcacactctc

SEQ ID NO: 384246 - DNA, 26 bp, Artificial Sequence
  Description of Artificial Sequence: Synthetic oligonucleotide
agcgaggacgggtctcacactctcca

SEQ ID NO: 384247 - DNA, 25 bp, Artificial Sequence
  Description of Artificial Sequence: Synthetic oligonucleotide
gcgaggacgggtctcacactctcca

SEQ ID NO: 384248 - DNA, 26 bp, Artificial Sequence
  Description of Artificial Sequence: Synthetic oligonucleotide
cgaggacgggtctcacactctccaga

SEQ ID NO: 384249 - DNA, 26 bp, Artificial Sequence
  Description of Artificial Sequence: Synthetic oligonucleotide
gaggacgggtctcacactctccagag

SEQ ID NO: 384250 - DNA, 27 bp, Artificial Sequence
  Description of Artificial Sequence: Synthetic oligonucleotide
aggacgggtctcacactctccagagga

SEQ ID NO: 384251 - DNA, 27 bp, Artificial Sequence
  Description of Artificial Sequence: Synthetic oligonucleotide
ggacgggtctcacactctccagaggat

SEQ ID NO: 384252 - DNA, 27 bp, Artificial Sequence
  Description of Artificial Sequence: Synthetic oligonucleotide
gacgggtctcacactctccagaggatg

SEQ ID NO: 384253 - DNA, 30 bp, Artificial Sequence
  Description of Artificial Sequence: Synthetic oligonucleotide
acgggtctcacactctccagaggatgtttg

SEQ ID NO: 384254 - DNA, 29 bp, Artificial Sequence
  Description of Artificial Sequence: Synthetic oligonucleotide
cgggtctcacactctccagaggatgtttg

SEQ ID NO: 384255 - DNA, 29 bp, Artificial Sequence
  Description of Artificial Sequence: Synthetic oligonucleotide
gggtctcacactctccagaggatgtttgg

SEQ ID NO: 384256 - DNA, 29 bp, Artificial Sequence
  Description of Artificial Sequence: Synthetic oligonucleotide
ggtctcacactctccagaggatgtttggc

SEQ ID NO: 384257 - DNA, 30 bp, Artificial Sequence
  Description of Artificial Sequence: Synthetic oligonucleotide
gtctcacactctccagaggatgtttggctg

SEQ ID NO: 384258 - DNA, 30 bp, Artificial Sequence
  Description of Artificial Sequence: Synthetic oligonucleotide
tctcacactctccagaggatgtttggctgc

SEQ ID NO: 384259 - DNA, 29 bp, Artificial Sequence
  Description of Artificial Sequence: Synthetic oligonucleotide
ctcacactctccagaggatgtttggctgc

SEQ ID NO: 384260 - DNA, 29 bp, Artificial Sequence
  Description of Artificial Sequence: Synthetic oligonucleotide
tcacactctccagaggatgtttggctgcg

SEQ ID NO: 384261 - DNA, 28 bp, Artificial Sequence
  Description of Artificial Sequence: Synthetic oligonucleotide
cacactctccagaggatgtttggctgcg

SEQ ID NO: 384262 - DNA, 29 bp, Artificial Sequence
  Description of Artificial Sequence: Synthetic oligonucleotide
acactctccagaggatgtttggctgcgac

SEQ ID NO: 384263 - DNA, 28 bp, Artificial Sequence
  Description of Artificial Sequence: Synthetic oligonucleotide
cactctccagaggatgtttggctgcgac

SEQ ID NO: 384264 - DNA, 28 bp, Artificial Sequence
  Description of Artificial Sequence: Synthetic oligonucleotide
actctccagaggatgtttggctgcgacc

SEQ ID NO: 384265 - DNA, 27 bp, Artificial Sequence
  Description of Artificial Sequence: Synthetic oligonucleotide
ctctccagaggatgtttggctgcgacc

SEQ ID NO: 384266 - DNA, 28 bp, Artificial Sequence
  Description of Artificial Sequence: Synthetic oligonucleotide
tctccagaggatgtttggctgcgacctg

SEQ ID NO: 384267 - DNA, 21 bp, Artificial Sequence
  Description of Artificial Sequence: Synthetic oligonucleotide
gcggcccgtgaggcagagcag

SEQ ID NO: 384268 - DNA, 21 bp, Artificial Sequence
  Description of Artificial Sequence: Synthetic oligonucleotide
cggcccgtgaggcagagcagc

SEQ ID NO: 384269 - DNA, 21 bp, Artificial Sequence
  Description of Artificial Sequence: Synthetic oligonucleotide
ggcccgtgaggcagagcagcg

SEQ ID NO: 384270 - DNA, 22 bp, Artificial Sequence
  Description of Artificial Sequence: Synthetic oligonucleotide
gcccgtgaggcagagcagcgga

SEQ ID NO: 384271 - DNA, 23 bp, Artificial Sequence
  Description of Artificial Sequence: Synthetic oligonucleotide
cccgtgaggcagagcagcggaga

SEQ ID NO: 384272 - DNA, 23 bp, Artificial Sequence
  Description of Artificial Sequence: Synthetic oligonucleotide
ccgtgaggcagagcagcggagag

SEQ ID NO: 384273 - DNA, 23 bp, Artificial Sequence
  Description of Artificial Sequence: Synthetic oligonucleotide
cgtgaggcagagcagcggagagc

SEQ ID NO: 384274 - DNA, 25 bp, Artificial Sequence
  Description of Artificial Sequence: Synthetic oligonucleotide
gtgaggcagagcagcggagagccta

SEQ ID NO: 384275 - DNA, 25 bp, Artificial Sequence
  Description of Artificial Sequence: Synthetic oligonucleotide
tgaggcagagcagcggagagcctac

SEQ ID NO: 384276 - DNA, 24 bp, Artificial Sequence
  Description of Artificial Sequence: Synthetic oligonucleotide
gaggcagagcagcggagagcctac

SEQ ID NO: 384277 - DNA, 25 bp, Artificial Sequence
  Description of Artificial Sequence: Synthetic oligonucleotide
aggcagagcagcggagagcctacct

SEQ ID NO: 384278 - DNA, 24 bp, Artificial Sequence
  Description of Artificial Sequence: Synthetic oligonucleotide
ggcagagcagcggagagcctacct

SEQ ID NO: 384279 - DNA, 24 bp, Artificial Sequence
  Description of Artificial Sequence: Synthetic oligonucleotide
gcagagcagcggagagcctacctg

SEQ ID NO: 384280 - DNA, 25 bp, Artificial Sequence
  Description of Artificial Sequence: Synthetic oligonucleotide
cagagcagcggagagcctacctgga

SEQ ID NO: 384281 - DNA, 25 bp, Artificial Sequence
  Description of Artificial Sequence: Synthetic oligonucleotide
agagcagcggagagcctacctggag

SEQ ID NO: 384282 - DNA, 30 bp, Artificial Sequence
  Description of Artificial Sequence: Synthetic oligonucleotide
acggcaaggattacatcgccctgaacgaag

SEQ ID NO: 384283 - DNA, 29 bp, Artificial Sequence
  Description of Artificial Sequence: Synthetic oligonucleotide
cggcaaggattacatcgccctgaacgaag

SEQ ID NO: 384284 - DNA, 31 bp, Artificial Sequence
  Description of Artificial Sequence: Synthetic oligonucleotide
ggcaaggattacatcgccctgaacgaagatc

SEQ ID NO: 384285 - DNA, 32 bp, Artificial Sequence
  Description of Artificial Sequence: Synthetic oligonucleotide
gcaaggattacatcgccctgaacgaagatctg

SEQ ID NO: 384286 - DNA, 32 bp, Artificial Sequence
  Description of Artificial Sequence: Synthetic oligonucleotide
caaggattacatcgccctgaacgaagatctgc

SEQ ID NO: 384287 - DNA, 32 bp, Artificial Sequence
  Description of Artificial Sequence: Synthetic oligonucleotide
aaggattacatcgccctgaacgaagatctgcg

SEQ ID NO: 384288 - DNA, 31 bp, Artificial Sequence
  Description of Artificial Sequence: Synthetic oligonucleotide
aggattacatcgccctgaacgaagatctgcg

SEQ ID NO: 384289 - DNA, 30 bp, Artificial Sequence
  Description of Artificial Sequence: Synthetic oligonucleotide
ggattacatcgccctgaacgaagatctgcg

SEQ ID NO: 384290 - DNA, 30 bp, Artificial Sequence
  Description of Artificial Sequence: Synthetic oligonucleotide
gattacatcgccctgaacgaagatctgcgc

SEQ ID NO: 384291 - DNA, 31 bp, Artificial Sequence
  Description of Artificial Sequence: Synthetic oligonucleotide
attacatcgccctgaacgaagatctgcgctc

SEQ ID NO: 384292 - DNA, 30 bp, Artificial Sequence
  Description of Artificial Sequence: Synthetic oligonucleotide
ttacatcgccctgaacgaagatctgcgctc

SEQ ID NO: 384293 - DNA, 29 bp, Artificial Sequence
  Description of Artificial Sequence: Synthetic oligonucleotide
tacatcgccctgaacgaagatctgcgctc

SEQ ID NO: 384294 - DNA, 28 bp, Artificial Sequence
  Description of Artificial Sequence: Synthetic oligonucleotide
acatcgccctgaacgaagatctgcgctc

SEQ ID NO: 384295 - DNA, 27 bp, Artificial Sequence
  Description of Artificial Sequence: Synthetic oligonucleotide
catcgccctgaacgaagatctgcgctc

SEQ ID NO: 384296 - DNA, 27 bp, Artificial Sequence
  Description of Artificial Sequence: Synthetic oligonucleotide
atcgccctgaacgaagatctgcgctcc

SEQ ID NO: 384297 - DNA, 27 bp, Artificial Sequence
  Description of Artificial Sequence: Synthetic oligonucleotide
tcgccctgaacgaagatctgcgctcct

SEQ ID NO: 384298 - DNA, 26 bp, Artificial Sequence
  Description of Artificial Sequence: Synthetic oligonucleotide
cgccctgaacgaagatctgcgctcct

SEQ ID NO: 384299 - DNA, 26 bp, Artificial Sequence
  Description of Artificial Sequence: Synthetic oligonucleotide
gccctgaacgaagatctgcgctcctg

SEQ ID NO: 384300 - DNA, 27 bp, Artificial Sequence
  Description of Artificial Sequence: Synthetic oligonucleotide
ccctgaacgaagatctgcgctcctgga

SEQ ID NO: 384301 - DNA, 27 bp, Artificial Sequence
  Description of Artificial Sequence: Synthetic oligonucleotide
cctgaacgaagatctgcgctcctggac

SEQ ID NO: 384302 - DNA, 27 bp, Artificial Sequence
  Description of Artificial Sequence: Synthetic oligonucleotide
ctgaacgaagatctgcgctcctggacc

SEQ ID NO: 384303 - DNA, 27 bp, Artificial Sequence
  Description of Artificial Sequence: Synthetic oligonucleotide
tgaacgaagatctgcgctcctggaccg

SEQ ID NO: 384304 - DNA, 26 bp, Artificial Sequence
  Description of Artificial Sequence: Synthetic oligonucleotide
gaacgaagatctgcgctcctggaccg

SEQ ID NO: 384305 - DNA, 26 bp, Artificial Sequence
  Description of Artificial Sequence: Synthetic oligonucleotide
aacgaagatctgcgctcctggaccgc

SEQ ID NO: 384306 - DNA, 25 bp, Artificial Sequence
  Description of Artificial Sequence: Synthetic oligonucleotide
acgaagatctgcgctcctggaccgc

SEQ ID NO: 384307 - DNA, 24 bp, Artificial Sequence
  Description of Artificial Sequence: Synthetic oligonucleotide
cgaagatctgcgctcctggaccgc

SEQ ID NO: 384308 - DNA, 24 bp, Artificial Sequence
  Description of Artificial Sequence: Synthetic oligonucleotide
gaagatctgcgctcctggaccgcc

SEQ ID NO: 384309 - DNA, 24 bp, Artificial Sequence
  Description of Artificial Sequence: Synthetic oligonucleotide
aagatctgcgctcctggaccgccg

SEQ ID NO: 384310 - DNA, 23 bp, Artificial Sequence
  Description of Artificial Sequence: Synthetic oligonucleotide
agatctgcgctcctggaccgccg

SEQ ID NO: 384311 - DNA, 29 bp, Artificial Sequence
  Description of Artificial Sequence: Synthetic oligonucleotide
cggaaactgcgcggctactacaaccaaag

SEQ ID NO: 384312 - DNA, 29 bp, Artificial Sequence
  Description of Artificial Sequence: Synthetic oligonucleotide
ggaaactgcgcggctactacaaccaaagc

SEQ ID NO: 384313 - DNA, 29 bp, Artificial Sequence
  Description of Artificial Sequence: Synthetic oligonucleotide
gaaactgcgcggctactacaaccaaagcg

SEQ ID NO: 384314 - DNA, 30 bp, Artificial Sequence
  Description of Artificial Sequence: Synthetic oligonucleotide
aaactgcgcggctactacaaccaaagcgag

SEQ ID NO: 384315 - DNA, 29 bp, Artificial Sequence
  Description of Artificial Sequence: Synthetic oligonucleotide
aactgcgcggctactacaaccaaagcgag

SEQ ID NO: 384316 - DNA, 28 bp, Artificial Sequence
  Description of Artificial Sequence: Synthetic oligonucleotide
actgcgcggctactacaaccaaagcgag

SEQ ID NO: 384317 - DNA, 27 bp, Artificial Sequence
  Description of Artificial Sequence: Synthetic oligonucleotide
gcgcggctactacaaccaaagcgagga

SEQ ID NO: 384318 - DNA, 27 bp, Artificial Sequence
  Description of Artificial Sequence: Synthetic oligonucleotide
cgcggctactacaaccaaagcgaggac

SEQ ID NO: 384319 - DNA, 27 bp, Artificial Sequence
  Description of Artificial Sequence: Synthetic oligonucleotide
gcggctactacaaccaaagcgaggacg

SEQ ID NO: 384320 - DNA, 27 bp, Artificial Sequence
  Description of Artificial Sequence: Synthetic oligonucleotide
cggctactacaaccaaagcgaggacgg

SEQ ID NO: 384321 - DNA, 27 bp, Artificial Sequence
  Description of Artificial Sequence: Synthetic oligonucleotide
ggctactacaaccaaagcgaggacggg

SEQ ID NO: 384322 - DNA, 28 bp, Artificial Sequence
  Description of Artificial Sequence: Synthetic oligonucleotide
gctactacaaccaaagcgaggacgggtc

SEQ ID NO: 384323 - DNA, 29 bp, Artificial Sequence
  Description of Artificial Sequence: Synthetic oligonucleotide
ctactacaaccaaagcgaggacgggtctc

SEQ ID NO: 384324 - DNA, 30 bp, Artificial Sequence
  Description of Artificial Sequence: Synthetic oligonucleotide
tactacaaccaaagcgaggacgggtctcac

SEQ ID NO: 384325 - DNA, 29 bp, Artificial Sequence
  Description of Artificial Sequence: Synthetic oligonucleotide
actacaaccaaagcgaggacgggtctcac

SEQ ID NO: 384326 - DNA, 28 bp, Artificial Sequence
  Description of Artificial Sequence: Synthetic oligonucleotide
ctacaaccaaagcgaggacgggtctcac

SEQ ID NO: 384327 - DNA, 29 bp, Artificial Sequence
  Description of Artificial Sequence: Synthetic oligonucleotide
tacaaccaaagcgaggacgggtctcacac

SEQ ID NO: 384328 - DNA, 28 bp, Artificial Sequence
  Description of Artificial Sequence: Synthetic oligonucleotide
acaaccaaagcgaggacgggtctcacac

SEQ ID NO: 384329 - DNA, 27 bp, Artificial Sequence
  Description of Artificial Sequence: Synthetic oligonucleotide
caaccaaagcgaggacgggtctcacac

SEQ ID NO: 384330 - DNA, 27 bp, Artificial Sequence
  Description of Artificial Sequence: Synthetic oligonucleotide
aaccaaagcgaggacgggtctcacacc

SEQ ID NO: 384331 - DNA, 26 bp, Artificial Sequence
  Description of Artificial Sequence: Synthetic oligonucleotide
accaaagcgaggacgggtctcacacc

SEQ ID NO: 384332 - DNA, 25 bp, Artificial Sequence
  Description of Artificial Sequence: Synthetic oligonucleotide
ccaaagcgaggacgggtctcacacc

SEQ ID NO: 384333 - DNA, 26 bp, Artificial Sequence
  Description of Artificial Sequence: Synthetic oligonucleotide
caaagcgaggacgggtctcacaccct

SEQ ID NO: 384334 - DNA, 26 bp, Artificial Sequence
  Description of Artificial Sequence: Synthetic oligonucleotide
aaagcgaggacgggtctcacaccctc

SEQ ID NO: 384335 - DNA, 25 bp, Artificial Sequence
  Description of Artificial Sequence: Synthetic oligonucleotide
aagcgaggacgggtctcacaccctc

SEQ ID NO: 384336 - DNA, 31 bp, Artificial Sequence
  Description of Artificial Sequence: Synthetic oligonucleotide
ctcccactccatgaggtatttctccacatcg

SEQ ID NO: 384337 - DNA, 31 bp, Artificial Sequence
  Description of Artificial Sequence: Synthetic oligonucleotide
tcccactccatgaggtatttctccacatcgg

SEQ ID NO: 384338 - DNA, 30 bp, Artificial Sequence
  Description of Artificial Sequence: Synthetic oligonucleotide
cccactccatgaggtatttctccacatcgg

SEQ ID NO: 384339 - DNA, 31 bp, Artificial Sequence
  Description of Artificial Sequence: Synthetic oligonucleotide
ccactccatgaggtatttctccacatcggtg

SEQ ID NO: 384340 - DNA, 32 bp, Artificial Sequence
  Description of Artificial Sequence: Synthetic oligonucleotide
cactccatgaggtatttctccacatcggtgtc

SEQ ID NO: 384341 - DNA, 32 bp, Artificial Sequence
  Description of Artificial Sequence: Synthetic oligonucleotide
actccatgaggtatttctccacatcggtgtcc

SEQ ID NO: 384342 - DNA, 31 bp, Artificial Sequence
  Description of Artificial Sequence: Synthetic oligonucleotide
ctccatgaggtatttctccacatcggtgtcc

SEQ ID NO: 384343 - DNA, 32 bp, Artificial Sequence
  Description of Artificial Sequence: Synthetic oligonucleotide
tccatgaggtatttctccacatcggtgtcctg

SEQ ID NO: 384344 - DNA, 31 bp, Artificial Sequence
  Description of Artificial Sequence: Synthetic oligonucleotide
ccatgaggtatttctccacatcggtgtcctg

SEQ ID NO: 384345 - DNA, 31 bp, Artificial Sequence
  Description of Artificial Sequence: Synthetic oligonucleotide
catgaggtatttctccacatcggtgtcctgg

SEQ ID NO: 384346 - DNA, 31 bp, Artificial Sequence
  Description of Artificial Sequence: Synthetic oligonucleotide
atgaggtatttctccacatcggtgtcctggc

SEQ ID NO: 384347 - DNA, 30 bp, Artificial Sequence
  Description of Artificial Sequence: Synthetic oligonucleotide
tgaggtatttctccacatcggtgtcctggc

SEQ ID NO: 384348 - DNA, 29 bp, Artificial Sequence
  Description of Artificial Sequence: Synthetic oligonucleotide
gaggtatttctccacatcggtgtcctggc

SEQ ID NO: 384349 - DNA, 29 bp, Artificial Sequence
  Description of Artificial Sequence: Synthetic oligonucleotide
aggtatttctccacatcggtgtcctggcc

SEQ ID NO: 384350 - DNA, 28 bp, Artificial Sequence
  Description of Artificial Sequence: Synthetic oligonucleotide
ggtatttctccacatcggtgtcctggcc

SEQ ID NO: 384351 - DNA, 28 bp, Artificial Sequence
  Description of Artificial Sequence: Synthetic oligonucleotide
gtatttctccacatcggtgtcctggccc

SEQ ID NO: 384352 - DNA, 28 bp, Artificial Sequence
  Description of Artificial Sequence: Synthetic oligonucleotide
tatttctccacatcggtgtcctggcccg

SEQ ID NO: 384353 - DNA, 27 bp, Artificial Sequence
  Description of Artificial Sequence: Synthetic oligonucleotide
atttctccacatcggtgtcctggcccg

SEQ ID NO: 384354 - DNA, 26 bp, Artificial Sequence
  Description of Artificial Sequence: Synthetic oligonucleotide
tttctccacatcggtgtcctggcccg

SEQ ID NO: 384355 - DNA, 25 bp, Artificial Sequence
  Description of Artificial Sequence: Synthetic oligonucleotide
ttctccacatcggtgtcctggcccg

SEQ ID NO: 384356 - DNA, 24 bp, Artificial Sequence
  Description of Artificial Sequence: Synthetic oligonucleotide
tctccacatcggtgtcctggcccg

SEQ ID NO: 384357 - DNA, 23 bp, Artificial Sequence
  Description of Artificial Sequence: Synthetic oligonucleotide
ctccacatcggtgtcctggcccg

SEQ ID NO: 384358 - DNA, 23 bp, Artificial Sequence
  Description of Artificial Sequence: Synthetic oligonucleotide
tccacatcggtgtcctggcccgg

SEQ ID NO: 384359 - DNA, 22 bp, Artificial Sequence
  Description of Artificial Sequence: Synthetic oligonucleotide
ccacatcggtgtcctggcccgg

SEQ ID NO: 384360 - DNA, 22 bp, Artificial Sequence
  Description of Artificial Sequence: Synthetic oligonucleotide
cacatcggtgtcctggcccggc

SEQ ID NO: 384361 - DNA, 22 bp, Artificial Sequence
  Description of Artificial Sequence: Synthetic oligonucleotide
acatcggtgtcctggcccggcc

SEQ ID NO: 384362 - DNA, 21 bp, Artificial Sequence
  Description of Artificial Sequence: Synthetic oligonucleotide
catcggtgtcctggcccggcc

SEQ ID NO: 384363 - DNA, 21 bp, Artificial Sequence
  Description of Artificial Sequence: Synthetic oligonucleotide
atcggtgtcctggcccggccg

SEQ ID NO: 384364 - DNA, 20 bp, Artificial Sequence
  Description of Artificial Sequence: Synthetic oligonucleotide
tcggtgtcctggcccggccg

SEQ ID NO: 384365 - DNA, 20 bp, Artificial Sequence
  Description of Artificial Sequence: Synthetic oligonucleotide
cggtgtcctggcccggccgt

SEQ ID NO: 384366 - DNA, 20 bp, Artificial Sequence
  Description of Artificial Sequence: Synthetic oligonucleotide
ggtgtcctggcccggccgct

SEQ ID NO: 384367 - DNA, 27 bp, Artificial Sequence
  Description of Artificial Sequence: Synthetic oligonucleotide
ccaggcacaggctgaccgagtgaactt

SEQ ID NO: 384368 - DNA, 27 bp, Artificial Sequence
  Description of Artificial Sequence: Synthetic oligonucleotide
caggcacaggctgaccgagtgaacttg

SEQ ID NO: 384369 - DNA, 27 bp, Artificial Sequence
  Description of Artificial Sequence: Synthetic oligonucleotide
aggcacaggctgaccgagtgaacttgc

SEQ ID NO: 384370 - DNA, 26 bp, Artificial Sequence
  Description of Artificial Sequence: Synthetic oligonucleotide
ggcacaggctgaccgagtgaacttgc

SEQ ID NO: 384371 - DNA, 26 bp, Artificial Sequence
  Description of Artificial Sequence: Synthetic oligonucleotide
gcacaggctgaccgagtgaacttgcg

SEQ ID NO: 384372 - DNA, 27 bp, Artificial Sequence
  Description of Artificial Sequence: Synthetic oligonucleotide
cacaggctgaccgagtgaacttgcgga

SEQ ID NO: 384373 - DNA, 29 bp, Artificial Sequence
  Description of Artificial Sequence: Synthetic oligonucleotide
acaggctgaccgagtgaacttgcggaaac

SEQ ID NO: 384374 - DNA, 28 bp, Artificial Sequence
  Description of Artificial Sequence: Synthetic oligonucleotide
caggctgaccgagtgaacttgcggaaac

SEQ ID NO: 384375 - DNA, 29 bp, Artificial Sequence
  Description of Artificial Sequence: Synthetic oligonucleotide
aggctgaccgagtgaacttgcggaaactg

SEQ ID NO: 384376 - DNA, 28 bp, Artificial Sequence
  Description of Artificial Sequence: Synthetic oligonucleotide
ggctgaccgagtgaacttgcggaaactg

SEQ ID NO: 384377 - DNA, 28 bp, Artificial Sequence
  Description of Artificial Sequence: Synthetic oligonucleotide
gctgaccgagtgaacttgcggaaactgc

SEQ ID NO: 384378 - DNA, 30 bp, Artificial Sequence
  Description of Artificial Sequence: Synthetic oligonucleotide
gggtataaccagttcgcctacgacggtaag

SEQ ID NO: 384379 - DNA, 30 bp, Artificial Sequence
  Description of Artificial Sequence: Synthetic oligonucleotide
ggtataaccagttcgcctacgacggtaagg

SEQ ID NO: 384380 - DNA, 34 bp, Artificial Sequence
  Description of Artificial Sequence: Synthetic oligonucleotide
gtataaccagttcgcctacgacggtaaggattac

SEQ ID NO: 384381 - DNA, 36 bp, Artificial Sequence
  Description of Artificial Sequence: Synthetic oligonucleotide
tataaccagttcgcctacgacggtaaggattacatc

SEQ ID NO: 384382 - DNA, 35 bp, Artificial Sequence
  Description of Artificial Sequence: Synthetic oligonucleotide
ataaccagttcgcctacgacggtaaggattacatc

SEQ ID NO: 384383 - DNA, 34 bp, Artificial Sequence
  Description of Artificial Sequence: Synthetic oligonucleotide
taaccagttcgcctacgacggtaaggattacatc

SEQ ID NO: 384384 - DNA, 33 bp, Artificial Sequence
  Description of Artificial Sequence: Synthetic oligonucleotide
aaccagttcgcctacgacggtaaggattacatc

SEQ ID NO: 384385 - DNA, 32 bp, Artificial Sequence
  Description of Artificial Sequence: Synthetic oligonucleotide
accagttcgcctacgacggtaaggattacatc

SEQ ID NO: 384386 - DNA, 31 bp, Artificial Sequence
  Description of Artificial Sequence: Synthetic oligonucleotide
ccagttcgcctacgacggtaaggattacatc

SEQ ID NO: 384387 - DNA, 31 bp, Artificial Sequence
  Description of Artificial Sequence: Synthetic oligonucleotide
cagttcgcctacgacggtaaggattacatcg

SEQ ID NO: 384388 - DNA, 31 bp, Artificial Sequence
  Description of Artificial Sequence: Synthetic oligonucleotide
agttcgcctacgacggtaaggattacatcgc

SEQ ID NO: 384389 - DNA, 30 bp, Artificial Sequence
  Description of Artificial Sequence: Synthetic oligonucleotide
gttcgcctacgacggtaaggattacatcgc

SEQ ID NO: 384390 - DNA, 30 bp, Artificial Sequence
  Description of Artificial Sequence: Synthetic oligonucleotide
ttcgcctacgacggtaaggattacatcgcc

SEQ ID NO: 384391 - DNA, 29 bp, Artificial Sequence
  Description of Artificial Sequence: Synthetic oligonucleotide
tcgcctacgacggtaaggattacatcgcc

SEQ ID NO: 384392 - DNA, 28 bp, Artificial Sequence
  Description of Artificial Sequence: Synthetic oligonucleotide
cgcctacgacggtaaggattacatcgcc

SEQ ID NO: 384393 - DNA, 28 bp, Artificial Sequence
  Description of Artificial Sequence: Synthetic oligonucleotide
gcctacgacggtaaggattacatcgccc

SEQ ID NO: 384394 - DNA, 29 bp, Artificial Sequence
  Description of Artificial Sequence: Synthetic oligonucleotide
cctacgacggtaaggattacatcgccctg

SEQ ID NO: 384395 - DNA, 31 bp, Artificial Sequence
  Description of Artificial Sequence: Synthetic oligonucleotide
ctacgacggtaaggattacatcgccctgaac

SEQ ID NO: 384396 - DNA, 31 bp, Artificial Sequence
  Description of Artificial Sequence: Synthetic oligonucleotide
tacgacggtaaggattacatcgccctgaacg

SEQ ID NO: 384397 - DNA, 30 bp, Artificial Sequence
  Description of Artificial Sequence: Synthetic oligonucleotide
acgacggtaaggattacatcgccctgaacg

SEQ ID NO: 384398 - DNA, 29 bp, Artificial Sequence
  Description of Artificial Sequence: Synthetic oligonucleotide
cgacggtaaggattacatcgccctgaacg

SEQ ID NO: 384399 - DNA, 30 bp, Artificial Sequence
  Description of Artificial Sequence: Synthetic oligonucleotide
gacggtaaggattacatcgccctgaacgag

SEQ ID NO: 384400 - DNA, 30 bp, Artificial Sequence
  Description of Artificial Sequence: Synthetic oligonucleotide
acggtaaggattacatcgccctgaacgagg

SEQ ID NO: 384401 - DNA, 29 bp, Artificial Sequence
  Description of Artificial Sequence: Synthetic oligonucleotide
cggtaaggattacatcgccctgaacgagg

SEQ ID NO: 384402 - DNA, 31 bp, Artificial Sequence
  Description of Artificial Sequence: Synthetic oligonucleotide
ggtaaggattacatcgccctgaacgaggatc

SEQ ID NO: 384403 - DNA, 32 bp, Artificial Sequence
  Description of Artificial Sequence: Synthetic oligonucleotide
gtaaggattacatcgccctgaacgaggatctg

SEQ ID NO: 384404 - DNA, 32 bp, Artificial Sequence
  Description of Artificial Sequence: Synthetic oligonucleotide
taaggattacatcgccctgaacgaggatctgc

SEQ ID NO: 384405 - DNA, 32 bp, Artificial Sequence
  Description of Artificial Sequence: Synthetic oligonucleotide
caaggattacatcgccctgaacgaggatctac

SEQ ID NO: 384406 - DNA, 32 bp, Artificial Sequence
  Description of Artificial Sequence: Synthetic oligonucleotide
aaggattacatcgccctgaacgaggatctacg

SEQ ID NO: 384407 - DNA, 31 bp, Artificial Sequence
  Description of Artificial Sequence: Synthetic oligonucleotide
aggattacatcgccctgaacgaggatctacg

SEQ ID NO: 384408 - DNA, 30 bp, Artificial Sequence
  Description of Artificial Sequence: Synthetic oligonucleotide
ggattacatcgccctgaacgaggatctacg

SEQ ID NO: 384409 - DNA, 30 bp, Artificial Sequence
  Description of Artificial Sequence: Synthetic oligonucleotide
gattacatcgccctgaacgaggatctacgc

SEQ ID NO: 384410 - DNA, 31 bp, Artificial Sequence
  Description of Artificial Sequence: Synthetic oligonucleotide
attacatcgccctgaacgaggatctacgctc

SEQ ID NO: 384411 - DNA, 30 bp, Artificial Sequence
  Description of Artificial Sequence: Synthetic oligonucleotide
ttacatcgccctgaacgaggatctacgctc

SEQ ID NO: 384412 - DNA, 29 bp, Artificial Sequence
  Description of Artificial Sequence: Synthetic oligonucleotide
tacatcgccctgaacgaggatctacgctc

SEQ ID NO: 384413 - DNA, 28 bp, Artificial Sequence
  Description of Artificial Sequence: Synthetic oligonucleotide
acatcgccctgaacgaggatctacgctc

SEQ ID NO: 384414 - DNA, 27 bp, Artificial Sequence
  Description of Artificial Sequence: Synthetic oligonucleotide
catcgccctgaacgaggatctacgctc

SEQ ID NO: 384415 - DNA, 27 bp, Artificial Sequence
  Description of Artificial Sequence: Synthetic oligonucleotide
atcgccctgaacgaggatctacgctcc

SEQ ID NO: 384416 - DNA, 27 bp, Artificial Sequence
  Description of Artificial Sequence: Synthetic oligonucleotide
tcgccctgaacgaggatctacgctcct

SEQ ID NO: 384417 - DNA, 26 bp, Artificial Sequence
  Description of Artificial Sequence: Synthetic oligonucleotide
cgccctgaacgaggatctacgctcct

SEQ ID NO: 384418 - DNA, 26 bp, Artificial Sequence
  Description of Artificial Sequence: Synthetic oligonucleotide
gccctgaacgaggatctacgctcctg

SEQ ID NO: 384419 - DNA, 27 bp, Artificial Sequence
  Description of Artificial Sequence: Synthetic oligonucleotide
ccctgaacgaggatctacgctcctgga

SEQ ID NO: 384420 - DNA, 27 bp, Artificial Sequence
  Description of Artificial Sequence: Synthetic oligonucleotide
cctgaacgaggatctacgctcctggac

SEQ ID NO: 384421 - DNA, 27 bp, Artificial Sequence
  Description of Artificial Sequence: Synthetic oligonucleotide
ctgaacgaggatctacgctcctggacc

SEQ ID NO: 384422 - DNA, 27 bp, Artificial Sequence
  Description of Artificial Sequence: Synthetic oligonucleotide
tgaacgaggatctacgctcctggaccg

SEQ ID NO: 384423 - DNA, 26 bp, Artificial Sequence
  Description of Artificial Sequence: Synthetic oligonucleotide
gaacgaggatctacgctcctggaccg

SEQ ID NO: 384424 - DNA, 26 bp, Artificial Sequence
  Description of Artificial Sequence: Synthetic oligonucleotide
aacgaggatctacgctcctggaccgc

SEQ ID NO: 384425 - DNA, 25 bp, Artificial Sequence
  Description of Artificial Sequence: Synthetic oligonucleotide
acgaggatctacgctcctggaccgc

SEQ ID NO: 384426 - DNA, 24 bp, Artificial Sequence
  Description of Artificial Sequence: Synthetic oligonucleotide
cgaggatctacgctcctggaccgc

SEQ ID NO: 384427 - DNA, 24 bp, Artificial Sequence
  Description of Artificial Sequence: Synthetic oligonucleotide
gaggatctacgctcctggaccgcc

SEQ ID NO: 384428 - DNA, 24 bp, Artificial Sequence
  Description of Artificial Sequence: Synthetic oligonucleotide
aggatctacgctcctggaccgccg

SEQ ID NO: 384429 - DNA, 23 bp, Artificial Sequence
  Description of Artificial Sequence: Synthetic oligonucleotide
ggatctacgctcctggaccgccg

SEQ ID NO: 384430 - DNA, 23 bp, Artificial Sequence
  Description of Artificial Sequence: Synthetic oligonucleotide
gatctacgctcctggaccgccgc

SEQ ID NO: 384431 - DNA, 23 bp, Artificial Sequence
  Description of Artificial Sequence: Synthetic oligonucleotide
atctacgctcctggaccgccgcg

SEQ ID NO: 384432 - DNA, 22 bp, Artificial Sequence
  Description of Artificial Sequence: Synthetic oligonucleotide
tctacgctcctggaccgccgcg

SEQ ID NO: 384433 - DNA, 25 bp, Artificial Sequence
  Description of Artificial Sequence: Synthetic oligonucleotide
cccgcttcatcgcagtgggctacct

SEQ ID NO: 384434 - DNA, 25 bp, Artificial Sequence
  Description of Artificial Sequence: Synthetic oligonucleotide
ccgcttcatcgcagtgggctacctg

SEQ ID NO: 384435 - DNA, 26 bp, Artificial Sequence
  Description of Artificial Sequence: Synthetic oligonucleotide
cgcttcatcgcagtgggctacctgga

SEQ ID NO: 384436 - DNA, 26 bp, Artificial Sequence
  Description of Artificial Sequence: Synthetic oligonucleotide
gcttcatcgcagtgggctacctggac

SEQ ID NO: 384437 - DNA, 27 bp, Artificial Sequence
  Description of Artificial Sequence: Synthetic oligonucleotide
cttcatcgcagtgggctacctggacga

SEQ ID NO: 384438 - DNA, 27 bp, Artificial Sequence
  Description of Artificial Sequence: Synthetic oligonucleotide
ttcatcgcagtgggctacctggacgac

SEQ ID NO: 384439 - DNA, 27 bp, Artificial Sequence
  Description of Artificial Sequence: Synthetic oligonucleotide
tcatcgcagtgggctacctggacgaca

SEQ ID NO: 384440 - DNA, 26 bp, Artificial Sequence
  Description of Artificial Sequence: Synthetic oligonucleotide
catcgcagtgggctacctggacgaca

SEQ ID NO: 384441 - DNA, 26 bp, Artificial Sequence
  Description of Artificial Sequence: Synthetic oligonucleotide
atcgcagtgggctacctggacgacac

SEQ ID NO: 384442 - DNA, 25 bp, Artificial Sequence
  Description of Artificial Sequence: Synthetic oligonucleotide
tcgcagtgggctacctggacgacac

SEQ ID NO: 384443 - DNA, 24 bp, Artificial Sequence
  Description of Artificial Sequence: Synthetic oligonucleotide
cgcagtgggctacctggacgacac

SEQ ID NO: 384444 - DNA, 24 bp, Artificial Sequence
  Description of Artificial Sequence: Synthetic oligonucleotide
gcagtgggctacctggacgacacg

SEQ ID NO: 384445 - DNA, 25 bp, Artificial Sequence
  Description of Artificial Sequence: Synthetic oligonucleotide
cagtgggctacctggacgacacgca

SEQ ID NO: 384446 - DNA, 27 bp, Artificial Sequence
  Description of Artificial Sequence: Synthetic oligonucleotide
agtgggctacctggacgacacgcagtt

SEQ ID NO: 384447 - DNA, 26 bp, Artificial Sequence
  Description of Artificial Sequence: Synthetic oligonucleotide
gtgggctacctggacgacacgcagtt

SEQ ID NO: 384448 - DNA, 26 bp, Artificial Sequence
  Description of Artificial Sequence: Synthetic oligonucleotide
tgggctacctggacgacacgcagttc

SEQ ID NO: 384449 - DNA, 25 bp, Artificial Sequence
  Description of Artificial Sequence: Synthetic oligonucleotide
gggctacctggacgacacgcagttc

SEQ ID NO: 384450 - DNA, 26 bp, Artificial Sequence
  Description of Artificial Sequence: Synthetic oligonucleotide
ggctacctggacgacacgcagttcgt

SEQ ID NO: 384451 - DNA, 26 bp, Artificial Sequence
  Description of Artificial Sequence: Synthetic oligonucleotide
gctacctggacgacacgcagttcgtg

SEQ ID NO: 384452 - DNA, 26 bp, Artificial Sequence
  Description of Artificial Sequence: Synthetic oligonucleotide
ctacctggacgacacgcagttcgtgc

SEQ ID NO: 384453 - DNA, 26 bp, Artificial Sequence
  Description of Artificial Sequence: Synthetic oligonucleotide
tacctggacgacacgcagttcgtgcg

SEQ ID NO: 384454 - DNA, 25 bp, Artificial Sequence
  Description of Artificial Sequence: Synthetic oligonucleotide
acctggacgacacgcagttcgtgcg

SEQ ID NO: 384455 - DNA, 24 bp, Artificial Sequence
  Description of Artificial Sequence: Synthetic oligonucleotide
cctggacgacacgcagttcgtgcg

SEQ ID NO: 384456 - DNA, 26 bp, Artificial Sequence
  Description of Artificial Sequence: Synthetic oligonucleotide
ctggacgacacgcagttcgtgcggtt

SEQ ID NO: 384457 - DNA, 26 bp, Artificial Sequence
  Description of Artificial Sequence: Synthetic oligonucleotide
cggctactacaaccagagcgaggacc

SEQ ID NO: 384458 - DNA, 26 bp, Artificial Sequence
  Description of Artificial Sequence: Synthetic oligonucleotide
ggctactacaaccagagcgaggaccg

SEQ ID NO: 384459 - DNA, 27 bp, Artificial Sequence
  Description of Artificial Sequence: Synthetic oligonucleotide
gctactacaaccagagcgaggaccggt

SEQ ID NO: 384460 - DNA, 27 bp, Artificial Sequence
  Description of Artificial Sequence: Synthetic oligonucleotide
ctactacaaccagagcgaggaccggtc

SEQ ID NO: 384461 - DNA, 28 bp, Artificial Sequence
  Description of Artificial Sequence: Synthetic oligonucleotide
tactacaaccagagcgaggaccggtctc

SEQ ID NO: 384462 - DNA, 27 bp, Artificial Sequence
  Description of Artificial Sequence: Synthetic oligonucleotide
actacaaccagagcgaggaccggtctc

SEQ ID NO: 384463 - DNA, 27 bp, Artificial Sequence
  Description of Artificial Sequence: Synthetic oligonucleotide
ctacaaccagagcgaggaccggtctca

SEQ ID NO: 384464 - DNA, 27 bp, Artificial Sequence
  Description of Artificial Sequence: Synthetic oligonucleotide
tacaaccagagcgaggaccggtctcac

SEQ ID NO: 384465 - DNA, 27 bp, Artificial Sequence
  Description of Artificial Sequence: Synthetic oligonucleotide
acaaccagagcgaggaccggtctcaca

SEQ ID NO: 384466 - DNA, 26 bp, Artificial Sequence
  Description of Artificial Sequence: Synthetic oligonucleotide
caaccagagcgaggaccggtctcaca

SEQ ID NO: 384467 - DNA, 26 bp, Artificial Sequence
  Description of Artificial Sequence: Synthetic oligonucleotide
aaccagagcgaggaccggtctcacac

SEQ ID NO: 384468 - DNA, 25 bp, Artificial Sequence
  Description of Artificial Sequence: Synthetic oligonucleotide
accagagcgaggaccggtctcacac

SEQ ID NO: 384469 - DNA, 24 bp, Artificial Sequence
  Description of Artificial Sequence: Synthetic oligonucleotide
ccagagcgaggaccggtctcacac

SEQ ID NO: 384470 - DNA, 24 bp, Artificial Sequence
  Description of Artificial Sequence: Synthetic oligonucleotide
cagagcgaggaccggtctcacacc

SEQ ID NO: 384471 - DNA, 25 bp, Artificial Sequence
  Description of Artificial Sequence: Synthetic oligonucleotide
agagcgaggaccggtctcacaccct

SEQ ID NO: 384472 - DNA, 24 bp, Artificial Sequence
  Description of Artificial Sequence: Synthetic oligonucleotide
gagcgaggaccggtctcacaccct

SEQ ID NO: 384473 - DNA, 24 bp, Artificial Sequence
  Description of Artificial Sequence: Synthetic oligonucleotide
agcgaggaccggtctcacaccctc

SEQ ID NO: 384474 - DNA, 23 bp, Artificial Sequence
  Description of Artificial Sequence: Synthetic oligonucleotide
gcgaggaccggtctcacaccctc

SEQ ID NO: 384475 - DNA, 24 bp, Artificial Sequence
  Description of Artificial Sequence: Synthetic oligonucleotide
cgaggaccggtctcacaccctcca

SEQ ID NO: 384476 - DNA, 25 bp, Artificial Sequence
  Description of Artificial Sequence: Synthetic oligonucleotide
gaggaccggtctcacaccctccaga

SEQ ID NO: 384477 - DNA, 25 bp, Artificial Sequence
  Description of Artificial Sequence: Synthetic oligonucleotide
aggaccggtctcacaccctccagag

SEQ ID NO: 384478 - DNA, 24 bp, Artificial Sequence
  Description of Artificial Sequence: Synthetic oligonucleotide
ggaccggtctcacaccctccagag

SEQ ID NO: 384479 - DNA, 26 bp, Artificial Sequence
  Description of Artificial Sequence: Synthetic oligonucleotide
gaccggtctcacaccctccagaggat

SEQ ID NO: 384480 - DNA, 27 bp, Artificial Sequence
  Description of Artificial Sequence: Synthetic oligonucleotide
accggtctcacaccctccagaggatgt

SEQ ID NO: 384481 - DNA, 27 bp, Artificial Sequence
  Description of Artificial Sequence: Synthetic oligonucleotide
ccggtctcacaccctccagaggatgtt

SEQ ID NO: 384482 - DNA, 28 bp, Artificial Sequence
  Description of Artificial Sequence: Synthetic oligonucleotide
cggtctcacaccctccagaggatgtttg

SEQ ID NO: 384483 - DNA, 34 bp, Artificial Sequence
  Description of Artificial Sequence: Synthetic oligonucleotide
gattctccactcccctgagtttcacttcttcttc

SEQ ID NO: 384484 - DNA, 34 bp, Artificial Sequence
  Description of Artificial Sequence: Synthetic oligonucleotide
attctccactcccctgagtttcacttcttcttcc

SEQ ID NO: 384485 - DNA, 33 bp, Artificial Sequence
  Description of Artificial Sequence: Synthetic oligonucleotide
ttctccactcccctgagtttcacttcttcttcc

SEQ ID NO: 384486 - DNA, 32 bp, Artificial Sequence
  Description of Artificial Sequence: Synthetic oligonucleotide
tctccactcccctgagtttcacttcttcttcc

SEQ ID NO: 384487 - DNA, 31 bp, Artificial Sequence
  Description of Artificial Sequence: Synthetic oligonucleotide
ctccactcccctgagtttcacttcttcttcc

SEQ ID NO: 384488 - DNA, 33 bp, Artificial Sequence
  Description of Artificial Sequence: Synthetic oligonucleotide
tccactcccctgagtttcacttcttcttccaac

SEQ ID NO: 384489 - DNA, 32 bp, Artificial Sequence
  Description of Artificial Sequence: Synthetic oligonucleotide
ccactcccctgagtttcacttcttcttccaac

SEQ ID NO: 384490 - DNA, 32 bp, Artificial Sequence
  Description of Artificial Sequence: Synthetic oligonucleotide
cactcccctgagtttcacttcttcttccaacc

SEQ ID NO: 384491 - DNA, 33 bp, Artificial Sequence
  Description of Artificial Sequence: Synthetic oligonucleotide
actcccctgagtttcacttcttcttccaacctg

SEQ ID NO: 384492 - DNA, 32 bp, Artificial Sequence
  Description of Artificial Sequence: Synthetic oligonucleotide
ctcccctgagtttcacttcttcttccaacctg

SEQ ID NO: 384493 - DNA, 32 bp, Artificial Sequence
  Description of Artificial Sequence: Synthetic oligonucleotide
tcccctgagtttcacttcttcttccaacctgc

SEQ ID NO: 384494 - DNA, 31 bp, Artificial Sequence
  Description of Artificial Sequence: Synthetic oligonucleotide
cccctgagtttcacttcttcttccaacctgc

SEQ ID NO: 384495 - DNA, 31 bp, Artificial Sequence
  Description of Artificial Sequence: Synthetic oligonucleotide
ccctgagtttcacttcttcttccaacctgcg

SEQ ID NO: 384496 - DNA, 32 bp, Artificial Sequence
  Description of Artificial Sequence: Synthetic oligonucleotide
cctgagtttcacttcttcttccaacctgcgtc

SEQ ID NO: 384497 - DNA, 32 bp, Artificial Sequence
  Description of Artificial Sequence: Synthetic oligonucleotide
ctgagtttcacttcttcttccaacctgcgtcg

SEQ ID NO: 384498 - DNA, 32 bp, Artificial Sequence
  Description of Artificial Sequence: Synthetic oligonucleotide
tgagtttcacttcttcttccaacctgcgtcgg

SEQ ID NO: 384499 - DNA, 31 bp, Artificial Sequence
  Description of Artificial Sequence: Synthetic oligonucleotide
gagtttcacttcttcttccaacctgcgtcgg

SEQ ID NO: 384500 - DNA, 31 bp, Artificial Sequence
  Description of Artificial Sequence: Synthetic oligonucleotide
agtttcacttcttcttccaacctgcgtcggg

SEQ ID NO: 384501 - DNA, 30 bp, Artificial Sequence
  Description of Artificial Sequence: Synthetic oligonucleotide
gtttcacttcttcttccaacctgcgtcggg

SEQ ID NO: 384502 - DNA, 31 bp, Artificial Sequence
  Description of Artificial Sequence: Synthetic oligonucleotide
tttcacttcttcttccaacctgcgtcgggtc

SEQ ID NO: 384503 - DNA, 30 bp, Artificial Sequence
  Description of Artificial Sequence: Synthetic oligonucleotide
ttcacttcttcttccaacctgcgtcgggtc

SEQ ID NO: 384504 - DNA, 29 bp, Artificial Sequence
  Description of Artificial Sequence: Synthetic oligonucleotide
tcacttcttcttccaacctgcgtcgggtc

SEQ ID NO: 384505 - DNA, 28 bp, Artificial Sequence
  Description of Artificial Sequence: Synthetic oligonucleotide
cacttcttcttccaacctgcgtcgggtc

SEQ ID NO: 384506 - DNA, 28 bp, Artificial Sequence
  Description of Artificial Sequence: Synthetic oligonucleotide
acttcttcttccaacctgcgtcgggtcc

SEQ ID NO: 384507 - DNA, 27 bp, Artificial Sequence
  Description of Artificial Sequence: Synthetic oligonucleotide
cttcttcttccaacctgcgtcgggtcc

SEQ ID NO: 384508 - DNA, 29 bp, Artificial Sequence
  Description of Artificial Sequence: Synthetic oligonucleotide
ttcttcttccaacctgcgtcgggtccttc

SEQ ID NO: 384509 - DNA, 28 bp, Artificial Sequence
  Description of Artificial Sequence: Synthetic oligonucleotide
tcttcttccaacctgcgtcgggtccttc

SEQ ID NO: 384510 - DNA, 27 bp, Artificial Sequence
  Description of Artificial Sequence: Synthetic oligonucleotide
cttcttccaacctgcgtcgggtccttc

SEQ ID NO: 384511 - DNA, 29 bp, Artificial Sequence
  Description of Artificial Sequence: Synthetic oligonucleotide
ttcttccaacctgcgtcgggtccttcttc

SEQ ID NO: 384512 - DNA, 28 bp, Artificial Sequence
  Description of Artificial Sequence: Synthetic oligonucleotide
tcttccaacctgcgtcgggtccttcttc

SEQ ID NO: 384513 - DNA, 27 bp, Artificial Sequence
  Description of Artificial Sequence: Synthetic oligonucleotide
cttccaacctgcgtcgggtccttcttc

SEQ ID NO: 384514 - DNA, 27 bp, Artificial Sequence
  Description of Artificial Sequence: Synthetic oligonucleotide
ttccaacctgcgtcgggtccttcttcc

SEQ ID NO: 384515 - DNA, 27 bp, Artificial Sequence
  Description of Artificial Sequence: Synthetic oligonucleotide
tccaacctgcgtcgggtccttcttcct

SEQ ID NO: 384516 - DNA, 27 bp, Artificial Sequence
  Description of Artificial Sequence: Synthetic oligonucleotide
ctacgtggacgacacgcagttcgtgca

SEQ ID NO: 384517 - DNA, 27 bp, Artificial Sequence
  Description of Artificial Sequence: Synthetic oligonucleotide
tacgtggacgacacgcagttcgtgcag

SEQ ID NO: 384518 - DNA, 27 bp, Artificial Sequence
  Description of Artificial Sequence: Synthetic oligonucleotide
acgtggacgacacgcagttcgtgcagt

SEQ ID NO: 384519 - DNA, 27 bp, Artificial Sequence
  Description of Artificial Sequence: Synthetic oligonucleotide
cgtggacgacacgcagttcgtgcagtt

SEQ ID NO: 384520 - DNA, 27 bp, Artificial Sequence
  Description of Artificial Sequence: Synthetic oligonucleotide
gtggacgacacgcagttcgtgcagttc

SEQ ID NO: 384521 - DNA, 27 bp, Artificial Sequence
  Description of Artificial Sequence: Synthetic oligonucleotide
tggacgacacgcagttcgtgcagttcg

SEQ ID NO: 384522 - DNA, 27 bp, Artificial Sequence
  Description of Artificial Sequence: Synthetic oligonucleotide
ggacgacacgcagttcgtgcagttcga

SEQ ID NO: 384523 - DNA, 27 bp, Artificial Sequence
  Description of Artificial Sequence: Synthetic oligonucleotide
gacgacacgcagttcgtgcagttcgac

SEQ ID NO: 384524 - DNA, 28 bp, Artificial Sequence
  Description of Artificial Sequence: Synthetic oligonucleotide
acgacacgcagttcgtgcagttcgacag

SEQ ID NO: 384525 - DNA, 27 bp, Artificial Sequence
  Description of Artificial Sequence: Synthetic oligonucleotide
cgacacgcagttcgtgcagttcgacag

SEQ ID NO: 384526 - DNA, 27 bp, Artificial Sequence
  Description of Artificial Sequence: Synthetic oligonucleotide
gacacgcagttcgtgcagttcgacagc

SEQ ID NO: 384527 - DNA, 27 bp, Artificial Sequence
  Description of Artificial Sequence: Synthetic oligonucleotide
acacgcagttcgtgcagttcgacagcg

SEQ ID NO: 384528 - DNA, 27 bp, Artificial Sequence
  Description of Artificial Sequence: Synthetic oligonucleotide
cacgcagttcgtgcagttcgacagcga

SEQ ID NO: 384529 - DNA, 27 bp, Artificial Sequence
  Description of Artificial Sequence: Synthetic oligonucleotide
acgcagttcgtgcagttcgacagcgac

SEQ ID NO: 384530 - DNA, 24 bp, Artificial Sequence
  Description of Artificial Sequence: Synthetic oligonucleotide
cagttcgacagcgacgccgcgagt

SEQ ID NO: 384531 - DNA, 24 bp, Artificial Sequence
  Description of Artificial Sequence: Synthetic oligonucleotide
agttcgacagcgacgccgcgagtc

SEQ ID NO: 384532 - DNA, 22 bp, Artificial Sequence
  Description of Artificial Sequence: Synthetic oligonucleotide
gctcctggaccgccgcggacaa

SEQ ID NO: 384533 - DNA, 22 bp, Artificial Sequence
  Description of Artificial Sequence: Synthetic oligonucleotide
ctcctggaccgccgcggacaag

SEQ ID NO: 384534 - DNA, 22 bp, Artificial Sequence
  Description of Artificial Sequence: Synthetic oligonucleotide
tcctggaccgccgcggacaagg

SEQ ID NO: 384535 - DNA, 21 bp, Artificial Sequence
  Description of Artificial Sequence: Synthetic oligonucleotide
cctggaccgccgcggacaagg

SEQ ID NO: 384536 - DNA, 21 bp, Artificial Sequence
  Description of Artificial Sequence: Synthetic oligonucleotide
ctggaccgccgcggacaaggc

SEQ ID NO: 384537 - DNA, 21 bp, Artificial Sequence
  Description of Artificial Sequence: Synthetic oligonucleotide
tggaccgccgcggacaaggcg

SEQ ID NO: 384538 - DNA, 20 bp, Artificial Sequence
  Description of Artificial Sequence: Synthetic oligonucleotide
ggaccgccgcggacaaggcg

SEQ ID NO: 384539 - DNA, 20 bp, Artificial Sequence
  Description of Artificial Sequence: Synthetic oligonucleotide
gaccgccgcggacaaggcgg

SEQ ID NO: 384540 - DNA, 21 bp, Artificial Sequence
  Description of Artificial Sequence: Synthetic oligonucleotide
accgccgcggacaaggcggct

SEQ ID NO: 384541 - DNA, 20 bp, Artificial Sequence
  Description of Artificial Sequence: Synthetic oligonucleotide
ccgccgcggacaaggcggct

SEQ ID NO: 384542 - DNA, 21 bp, Artificial Sequence
  Description of Artificial Sequence: Synthetic oligonucleotide
cgccgcggacaaggcggctca

SEQ ID NO: 384543 - DNA, 23 bp, Artificial Sequence
  Description of Artificial Sequence: Synthetic oligonucleotide
gccgcggacaaggcggctcagat

SEQ ID NO: 384544 - DNA, 24 bp, Artificial Sequence
  Description of Artificial Sequence: Synthetic oligonucleotide
ccgcggacaaggcggctcagatca

SEQ ID NO: 384545 - DNA, 24 bp, Artificial Sequence
  Description of Artificial Sequence: Synthetic oligonucleotide
cgcggacaaggcggctcagatcac

SEQ ID NO: 384546 - DNA, 24 bp, Artificial Sequence
  Description of Artificial Sequence: Synthetic oligonucleotide
gcggacaaggcggctcagatcacc

SEQ ID NO: 384547 - DNA, 25 bp, Artificial Sequence
  Description of Artificial Sequence: Synthetic oligonucleotide
cggacaaggcggctcagatcaccca

SEQ ID NO: 384548 - DNA, 25 bp, Artificial Sequence
  Description of Artificial Sequence: Synthetic oligonucleotide
ggacaaggcggctcagatcacccag

SEQ ID NO: 384549 - DNA, 25 bp, Artificial Sequence
  Description of Artificial Sequence: Synthetic oligonucleotide
gacaaggcggctcagatcacccagc

SEQ ID NO: 384550 - DNA, 25 bp, Artificial Sequence
  Description of Artificial Sequence: Synthetic oligonucleotide
acaaggcggctcagatcacccagcg

SEQ ID NO: 384551 - DNA, 24 bp, Artificial Sequence
  Description of Artificial Sequence: Synthetic oligonucleotide
caaggcggctcagatcacccagcg

SEQ ID NO: 384552 - DNA, 26 bp, Artificial Sequence
  Description of Artificial Sequence: Synthetic oligonucleotide
aaggcggctcagatcacccagcgcaa

SEQ ID NO: 384553 - DNA, 25 bp, Artificial Sequence
  Description of Artificial Sequence: Synthetic oligonucleotide
aggcggctcagatcacccagcgcaa

SEQ ID NO: 384554 - DNA, 29 bp, Artificial Sequence
  Description of Artificial Sequence: Synthetic oligonucleotide
tccgcagatacctggagaacgggaagaag

SEQ ID NO: 384555 - DNA, 28 bp, Artificial Sequence
  Description of Artificial Sequence: Synthetic oligonucleotide
ccgcagatacctggagaacgggaagaag

SEQ ID NO: 384556 - DNA, 29 bp, Artificial Sequence
  Description of Artificial Sequence: Synthetic oligonucleotide
cgcagatacctggagaacgggaagaagac

SEQ ID NO: 384557 - DNA, 29 bp, Artificial Sequence
  Description of Artificial Sequence: Synthetic oligonucleotide
gcagatacctggagaacgggaagaagacg

SEQ ID NO: 384558 - DNA, 29 bp, Artificial Sequence
  Description of Artificial Sequence: Synthetic oligonucleotide
cagatacctggagaacgggaagaagacgc

SEQ ID NO: 384559 - DNA, 30 bp, Artificial Sequence; identical to SEQ ID NO: 18156
  Description of Artificial Sequence: Synthetic oligonucleotide

SEQ ID NO: 384560 - DNA, 29 bp, Artificial Sequence
  Description of Artificial Sequence: Synthetic oligonucleotide
gatacctggagaacgggaagaagacgctg

SEQ ID NO: 384561 - DNA, 29 bp, Artificial Sequence
  Description of Artificial Sequence: Synthetic oligonucleotide
atacctggagaacgggaagaagacgctgc

SEQ ID NO: 384562 - DNA, 28 bp, Artificial Sequence
  Description of Artificial Sequence: Synthetic oligonucleotide
tacctggagaacgggaagaagacgctgc

SEQ ID NO: 384563 - DNA, 27 bp, Artificial Sequence
  Description of Artificial Sequence: Synthetic oligonucleotide
acctggagaacgggaagaagacgctgc

SEQ ID NO: 384564 - DNA, 27 bp, Artificial Sequence
  Description of Artificial Sequence: Synthetic oligonucleotide
cctggagaacgggaagaagacgctgca

SEQ ID NO: 384565 - DNA, 27 bp, Artificial Sequence
  Description of Artificial Sequence: Synthetic oligonucleotide
ctggagaacgggaagaagacgctgcag

SEQ ID NO: 384566 - DNA, 27 bp, Artificial Sequence
  Description of Artificial Sequence: Synthetic oligonucleotide
tggagaacgggaagaagacgctgcagc

SEQ ID NO: 384567 - DNA, 26 bp, Artificial Sequence
  Description of Artificial Sequence: Synthetic oligonucleotide
ggagaacgggaagaagacgctgcagc

SEQ ID NO: 384568 - DNA, 26 bp, Artificial Sequence
  Description of Artificial Sequence: Synthetic oligonucleotide
gagaacgggaagaagacgctgcagcg

SEQ ID NO: 384569 - DNA, 26 bp, Artificial Sequence
  Description of Artificial Sequence: Synthetic oligonucleotide
agaacgggaagaagacgctgcagcgc

SEQ ID NO: 384570 - DNA, 25 bp, Artificial Sequence
  Description of Artificial Sequence: Synthetic oligonucleotide
gaacgggaagaagacgctgcagcgc

SEQ ID NO: 384571 - DNA, 25 bp, Artificial Sequence
  Description of Artificial Sequence: Synthetic oligonucleotide
aacgggaagaagacgctgcagcgcg

SEQ ID NO: 384572 - DNA, 24 bp, Artificial Sequence
  Description of Artificial Sequence: Synthetic oligonucleotide
acgggaagaagacgctgcagcgcg

SEQ ID NO: 384573 - DNA, 23 bp, Artificial Sequence
  Description of Artificial Sequence: Synthetic oligonucleotide
cgggaagaagacgctgcagcgcg

SEQ ID NO: 384574 - DNA, 23 bp, Artificial Sequence
  Description of Artificial Sequence: Synthetic oligonucleotide
gggaagaagacgctgcagcgcgc

SEQ ID NO: 384575 - DNA, 23 bp, Artificial Sequence
  Description of Artificial Sequence: Synthetic oligonucleotide
ggaagaagacgctgcagcgcgcg

SEQ ID NO: 384576 - DNA, 25 bp, Artificial Sequence
  Description of Artificial Sequence: Synthetic oligonucleotide
gaagaagacgctgcagcgcgcggaa

SEQ ID NO: 384577 - DNA, 26 bp, Artificial Sequence
  Description of Artificial Sequence: Synthetic oligonucleotide
aagaagacgctgcagcgcgcggaaca

SEQ ID NO: 384578 - DNA, 25 bp, Artificial Sequence
  Description of Artificial Sequence: Synthetic oligonucleotide
agaagacgctgcagcgcgcggaaca

SEQ ID NO: 384579 - DNA, 24 bp, Artificial Sequence
  Description of Artificial Sequence: Synthetic oligonucleotide
gaagacgctgcagcgcgcggaaca

SEQ ID NO: 384580 - DNA, 24 bp, Artificial Sequence
  Description of Artificial Sequence: Synthetic oligonucleotide
aagacgctgcagcgcgcggaacac

SEQ ID NO: 384581 - DNA, 24 bp, Artificial Sequence
  Description of Artificial Sequence: Synthetic oligonucleotide
agagcccctcaccctgagatgggg

SEQ ID NO: 384582 - DNA, 23 bp, Artificial Sequence
  Description of Artificial Sequence: Synthetic oligonucleotide
gagcccctcaccctgagatgggg

SEQ ID NO: 384583 - DNA, 23 bp, Artificial Sequence
  Description of Artificial Sequence: Synthetic oligonucleotide
agcccctcaccctgagatggggg

SEQ ID NO: 384584 - DNA, 22 bp, Artificial Sequence
  Description of Artificial Sequence: Synthetic oligonucleotide
gcccctcaccctgagatggggg

SEQ ID NO: 384585 - DNA, 22 bp, Artificial Sequence
  Description of Artificial Sequence: Synthetic oligonucleotide
cccctcaccctgagatgggggc

SEQ ID NO: 384586 - DNA, 24 bp, Artificial Sequence
  Description of Artificial Sequence: Synthetic oligonucleotide
ccctcaccctgagatgggggccat

SEQ ID NO: 384587 - DNA, 26 bp, Artificial Sequence
  Description of Artificial Sequence: Synthetic oligonucleotide
cctcaccctgagatgggggccatctt

SEQ ID NO: 384588 - DNA, 26 bp, Artificial Sequence
  Description of Artificial Sequence: Synthetic oligonucleotide
ctcaccctgagatgggggccatcttc

SEQ ID NO: 384589 - DNA, 26 bp, Artificial Sequence
  Description of Artificial Sequence: Synthetic oligonucleotide
tcaccctgagatgggggccatcttcc

SEQ ID NO: 384590 - DNA, 25 bp, Artificial Sequence
  Description of Artificial Sequence: Synthetic oligonucleotide
caccctgagatgggggccatcttcc

SEQ ID NO: 384591 - DNA, 26 bp, Artificial Sequence
  Description of Artificial Sequence: Synthetic oligonucleotide
accctgagatgggggccatcttccca

SEQ ID NO: 384592 - DNA, 25 bp, Artificial Sequence
  Description of Artificial Sequence: Synthetic oligonucleotide
ccctgagatgggggccatcttccca

SEQ ID NO: 384593 - DNA, 25 bp, Artificial Sequence
  Description of Artificial Sequence: Synthetic oligonucleotide
cctgagatgggggccatcttcccag

SEQ ID NO: 384594 - DNA, 25 bp, Artificial Sequence
  Description of Artificial Sequence: Synthetic oligonucleotide
ctgagatgggggccatcttcccagc

SEQ ID NO: 384595 - DNA, 25 bp, Artificial Sequence
  Description of Artificial Sequence: Synthetic oligonucleotide
tgagatgggggccatcttcccagcc

SEQ ID NO: 384596 - DNA, 24 bp, Artificial Sequence
  Description of Artificial Sequence: Synthetic oligonucleotide
gagatgggggccatcttcccagcc

SEQ ID NO: 384597 - DNA, 25 bp, Artificial Sequence
  Description of Artificial Sequence: Synthetic oligonucleotide
agatgggggccatcttcccagccca

SEQ ID NO: 384598 - DNA, 24 bp, Artificial Sequence
  Description of Artificial Sequence: Synthetic oligonucleotide
gatgggggccatcttcccagccca

SEQ ID NO: 384599 - DNA, 24 bp, Artificial Sequence
  Description of Artificial Sequence: Synthetic oligonucleotide
atgggggccatcttcccagcccac

SEQ ID NO: 384600 - DNA, 23 bp, Artificial Sequence
  Description of Artificial Sequence: Synthetic oligonucleotide
tgggggccatcttcccagcccac

SEQ ID NO: 384601 - DNA, 22 bp, Artificial Sequence
  Description of Artificial Sequence: Synthetic oligonucleotide
gggggccatcttcccagcccac

SEQ ID NO: 384602 - DNA, 24 bp, Artificial Sequence
  Description of Artificial Sequence: Synthetic oligonucleotide
ggggccatcttcccagcccaccat

SEQ ID NO: 384603 - DNA, 24 bp, Artificial Sequence
  Description of Artificial Sequence: Synthetic oligonucleotide
gggccatcttcccagcccaccatc

SEQ ID NO: 384604 - DNA, 24 bp, Artificial Sequence
  Description of Artificial Sequence: Synthetic oligonucleotide
ggccatcttcccagcccaccatcc

SEQ ID NO: 384605 - DNA, 23 bp, Artificial Sequence
  Description of Artificial Sequence: Synthetic oligonucleotide
gaagaagacgctgcagcgcgcgg

SEQ ID NO: 384606 - DNA, 30 bp, Artificial Sequence; identical to SEQ ID NO: 45515
  Description of Artificial Sequence: Synthetic oligonucleotide

SEQ ID NO: 384607 - DNA, 29 bp, Artificial Sequence
  Description of Artificial Sequence: Synthetic oligonucleotide
gcagagatacacgtgccatgtgcagcatg

SEQ ID NO: 384608 - DNA, 30 bp, Artificial Sequence; identical to SEQ ID NO: 45517
  Description of Artificial Sequence: Synthetic oligonucleotide

SEQ ID NO: 384609 - DNA, 30 bp, Artificial Sequence; identical to SEQ ID NO: 45518
  Description of Artificial Sequence: Synthetic oligonucleotide

SEQ ID NO: 384610 - DNA, 29 bp, Artificial Sequence
  Description of Artificial Sequence: Synthetic oligonucleotide
gagatacacgtgccatgtgcagcatgagg

SEQ ID NO: 384611 - DNA, 29 bp, Artificial Sequence
  Description of Artificial Sequence: Synthetic oligonucleotide
agatacacgtgccatgtgcagcatgaggg

SEQ ID NO: 384612 - DNA, 28 bp, Artificial Sequence
  Description of Artificial Sequence: Synthetic oligonucleotide
gatacacgtgccatgtgcagcatgaggg

SEQ ID NO: 384613 - DNA, 28 bp, Artificial Sequence
  Description of Artificial Sequence: Synthetic oligonucleotide
atacacgtgccatgtgcagcatgagggg

SEQ ID NO: 384614 - DNA, 27 bp, Artificial Sequence
  Description of Artificial Sequence: Synthetic oligonucleotide
tacacgtgccatgtgcagcatgagggg

SEQ ID NO: 384615 - DNA, 26 bp, Artificial Sequence
  Description of Artificial Sequence: Synthetic oligonucleotide
acacgtgccatgtgcagcatgagggg

SEQ ID NO: 384616 - DNA, 25 bp, Artificial Sequence
  Description of Artificial Sequence: Synthetic oligonucleotide
cacgtgccatgtgcagcatgagggg

SEQ ID NO: 384617 - DNA, 26 bp, Artificial Sequence
  Description of Artificial Sequence: Synthetic oligonucleotide
acgtgccatgtgcagcatgaggggct

SEQ ID NO: 384618 - DNA, 25 bp, Artificial Sequence
  Description of Artificial Sequence: Synthetic oligonucleotide
cgtgccatgtgcagcatgaggggct

SEQ ID NO: 384619 - DNA, 25 bp, Artificial Sequence
  Description of Artificial Sequence: Synthetic oligonucleotide
gtgccatgtgcagcatgaggggctg

SEQ ID NO: 384620 - DNA, 25 bp, Artificial Sequence
  Description of Artificial Sequence: Synthetic oligonucleotide
ccatgtgcagcatgaggggctgcca

SEQ ID NO: 384621 - DNA, 26 bp, Artificial Sequence
  Description of Artificial Sequence: Synthetic oligonucleotide
catgtgcagcatgaggggctgccaga

SEQ ID NO: 384622 - DNA, 26 bp, Artificial Sequence
  Description of Artificial Sequence: Synthetic oligonucleotide
atgtgcagcatgaggggctgccagag

SEQ ID NO: 384623 - DNA, 25 bp, Artificial Sequence
  Description of Artificial Sequence: Synthetic oligonucleotide
tgtgcagcatgaggggctgccagag

SEQ ID NO: 384624 - DNA, 24 bp, Artificial Sequence
  Description of Artificial Sequence: Synthetic oligonucleotide
gtgcagcatgaggggctgccagag

SEQ ID NO: 384625 - DNA, 24 bp, Artificial Sequence
  Description of Artificial Sequence: Synthetic oligonucleotide
tgcagcatgaggggctgccagagc

SEQ ID NO: 384626 - DNA, 23 bp, Artificial Sequence
  Description of Artificial Sequence: Synthetic oligonucleotide
gcagcatgaggggctgccagagc

SEQ ID NO: 384627 - DNA, 23 bp, Artificial Sequence
  Description of Artificial Sequence: Synthetic oligonucleotide
cagcatgaggggctgccagagcc

SEQ ID NO: 384628 - DNA, 23 bp, Artificial Sequence
  Description of Artificial Sequence: Synthetic oligonucleotide
agcatgaggggctgccagagccc

SEQ ID NO: 384629 - DNA, 22 bp, Artificial Sequence
  Description of Artificial Sequence: Synthetic oligonucleotide
gcatgaggggctgccagagccc

SEQ ID NO: 384630 - DNA, 23 bp, Artificial Sequence
  Description of Artificial Sequence: Synthetic oligonucleotide
catgaggggctgccagagcccct

SEQ ID NO: 384631 - DNA, 24 bp, Artificial Sequence
  Description of Artificial Sequence: Synthetic oligonucleotide
atgaggggctgccagagcccctca

SEQ ID NO: 384632 - DNA, 23 bp, Artificial Sequence
  Description of Artificial Sequence: Synthetic oligonucleotide
tgaggggctgccagagcccctca

SEQ ID NO: 384633 - DNA, 32 bp, Artificial Sequence; identical to SEQ ID NO: 45542
  Description of Artificial Sequence: Synthetic oligonucleotide

SEQ ID NO: 384634 - DNA, 31 bp, Artificial Sequence; identical to SEQ ID NO: 45543
  Description of Artificial Sequence: Synthetic oligonucleotide

SEQ ID NO: 384635 - DNA, 30 bp, Artificial Sequence; identical to SEQ ID NO: 45544
  Description of Artificial Sequence: Synthetic oligonucleotide

SEQ ID NO: 384636 - DNA, 30 bp, Artificial Sequence; identical to SEQ ID NO: 45545
  Description of Artificial Sequence: Synthetic oligonucleotide

SEQ ID NO: 384637 - DNA, 29 bp, Artificial Sequence
  Description of Artificial Sequence: Synthetic oligonucleotide
gcagagatacacatgccatgtgcagcacg

SEQ ID NO: 384638 - DNA, 30 bp, Artificial Sequence; identical to SEQ ID NO: 45547
  Description of Artificial Sequence: Synthetic oligonucleotide

SEQ ID NO: 384639 - DNA, 30 bp, Artificial Sequence; identical to SEQ ID NO: 45548
  Description of Artificial Sequence: Synthetic oligonucleotide

SEQ ID NO: 384640 - DNA, 29 bp, Artificial Sequence
  Description of Artificial Sequence: Synthetic oligonucleotide
gagatacacatgccatgtgcagcacgagg

SEQ ID NO: 384641 - DNA, 29 bp, Artificial Sequence
  Description of Artificial Sequence: Synthetic oligonucleotide
agatacacatgccatgtgcagcacgaggg

SEQ ID NO: 384642 - DNA, 28 bp, Artificial Sequence
  Description of Artificial Sequence: Synthetic oligonucleotide
gatacacatgccatgtgcagcacgaggg

SEQ ID NO: 384643 - DNA, 28 bp, Artificial Sequence
  Description of Artificial Sequence: Synthetic oligonucleotide
atacacatgccatgtgcagcacgagggg

SEQ ID NO: 384644 - DNA, 27 bp, Artificial Sequence
  Description of Artificial Sequence: Synthetic oligonucleotide
tacacatgccatgtgcagcacgagggg

SEQ ID NO: 384645 - DNA, 26 bp, Artificial Sequence
  Description of Artificial Sequence: Synthetic oligonucleotide
acacatgccatgtgcagcacgagggg

SEQ ID NO: 384646 - DNA, 25 bp, Artificial Sequence
  Description of Artificial Sequence: Synthetic oligonucleotide
cacatgccatgtgcagcacgagggg

SEQ ID NO: 384647 - DNA, 26 bp, Artificial Sequence
  Description of Artificial Sequence: Synthetic oligonucleotide
acatgccatgtgcagcacgaggggct

SEQ ID NO: 384648 - DNA, 25 bp, Artificial Sequence
  Description of Artificial Sequence: Synthetic oligonucleotide
catgccatgtgcagcacgaggggct

SEQ ID NO: 384649 - DNA, 25 bp, Artificial Sequence
  Description of Artificial Sequence: Synthetic oligonucleotide
atgccatgtgcagcacgaggggctg

SEQ ID NO: 384650 - DNA, 30 bp, Artificial Sequence; identical to SEQ ID NO: 45559
  Description of Artificial Sequence: Synthetic oligonucleotide

SEQ ID NO: 384651 - DNA, 30 bp, Artificial Sequence; identical to SEQ ID NO: 45560
  Description of Artificial Sequence: Synthetic oligonucleotide

SEQ ID NO: 384652 - DNA, 29 bp, Artificial Sequence
  Description of Artificial Sequence: Synthetic oligonucleotide
ctcacaccctccagaggatgtatggttgc

SEQ ID NO: 384653 - DNA, 29 bp, Artificial Sequence
  Description of Artificial Sequence: Synthetic oligonucleotide
tcacaccctccagaggatgtatggttgcg

SEQ ID NO: 384654 - DNA, 28 bp, Artificial Sequence
  Description of Artificial Sequence: Synthetic oligonucleotide
cacaccctccagaggatgtatggttgcg

SEQ ID NO: 384655 - DNA, 29 bp, Artificial Sequence
  Description of Artificial Sequence: Synthetic oligonucleotide
acaccctccagaggatgtatggttgcgac

SEQ ID NO: 384656 - DNA, 28 bp, Artificial Sequence
  Description of Artificial Sequence: Synthetic oligonucleotide
caccctccagaggatgtatggttgcgac

SEQ ID NO: 384657 - DNA, 28 bp, Artificial Sequence
  Description of Artificial Sequence: Synthetic oligonucleotide
accctccagaggatgtatggttgcgacc

SEQ ID NO: 384658 - DNA, 27 bp, Artificial Sequence
  Description of Artificial Sequence: Synthetic oligonucleotide
ccctccagaggatgtatggttgcgacc

SEQ ID NO: 384659 - DNA, 28 bp, Artificial Sequence
  Description of Artificial Sequence: Synthetic oligonucleotide
cctccagaggatgtatggttgcgacctg

SEQ ID NO: 384660 - DNA, 28 bp, Artificial Sequence
  Description of Artificial Sequence: Synthetic oligonucleotide
ctccagaggatgtatggttgcgacctgg

SEQ ID NO: 384661 - DNA, 28 bp, Artificial Sequence
  Description of Artificial Sequence: Synthetic oligonucleotide
tccagaggatgtatggttgcgacctggg

SEQ ID NO: 384662 - DNA, 27 bp, Artificial Sequence
  Description of Artificial Sequence: Synthetic oligonucleotide
ccagaggatgtatggttgcgacctggg

SEQ ID NO: 384663 - DNA, 27 bp, Artificial Sequence
  Description of Artificial Sequence: Synthetic oligonucleotide
cagaggatgtatggttgcgacctgggg

SEQ ID NO: 384664 - DNA, 27 bp, Artificial Sequence
  Description of Artificial Sequence: Synthetic oligonucleotide
agaggatgtatggttgcgacctggggc

SEQ ID NO: 384665 - DNA, 26 bp, Artificial Sequence
  Description of Artificial Sequence: Synthetic oligonucleotide
gaggatgtatggttgcgacctggggc

SEQ ID NO: 384666 - DNA, 26 bp, Artificial Sequence
  Description of Artificial Sequence: Synthetic oligonucleotide
aggatgtatggttgcgacctggggcc

SEQ ID NO: 384667 - DNA, 25 bp, Artificial Sequence
  Description of Artificial Sequence: Synthetic oligonucleotide
ggatgtatggttgcgacctggggcc

SEQ ID NO: 384668 - DNA, 25 bp, Artificial Sequence
  Description of Artificial Sequence: Synthetic oligonucleotide
gatgtatggttgcgacctggggccc

SEQ ID NO: 384669 - DNA, 26 bp, Artificial Sequence
  Description of Artificial Sequence: Synthetic oligonucleotide
atgtatggttgcgacctggggcccga

SEQ ID NO: 384670 - DNA, 25 bp, Artificial Sequence
  Description of Artificial Sequence: Synthetic oligonucleotide
tgtatggttgcgacctggggcccga

SEQ ID NO: 384671 - DNA, 24 bp, Artificial Sequence
  Description of Artificial Sequence: Synthetic oligonucleotide
gtatggttgcgacctggggcccga

SEQ ID NO: 384672 - DNA, 24 bp, Artificial Sequence
  Description of Artificial Sequence: Synthetic oligonucleotide
tatggttgcgacctggggcccgac

SEQ ID NO: 384673 - DNA, 23 bp, Artificial Sequence
  Description of Artificial Sequence: Synthetic oligonucleotide
atggttgcgacctggggcccgac

SEQ ID NO: 384674 - DNA, 22 bp, Artificial Sequence
  Description of Artificial Sequence: Synthetic oligonucleotide
tggttgcgacctggggcccgac

SEQ ID NO: 384675 - DNA, 21 bp, Artificial Sequence
  Description of Artificial Sequence: Synthetic oligonucleotide
ggttgcgacctggggcccgac

SEQ ID NO: 384676 - DNA, 21 bp, Artificial Sequence
  Description of Artificial Sequence: Synthetic oligonucleotide
gttgcgacctggggcccgacg

SEQ ID NO: 384677 - DNA, 21 bp, Artificial Sequence
  Description of Artificial Sequence: Synthetic oligonucleotide
ttgcgacctggggcccgacgg

SEQ ID NO: 384678 - DNA, 30 bp, Artificial Sequence; identical to SEQ ID NO: 45587
  Description of Artificial Sequence: Synthetic oligonucleotide

SEQ ID NO: 384679 - DNA, 31 bp, Artificial Sequence; identical to SEQ ID NO: 45588
  Description of Artificial Sequence: Synthetic oligonucleotide

SEQ ID NO: 384680 - DNA, 30 bp, Artificial Sequence; identical to SEQ ID NO: 45589
  Description of Artificial Sequence: Synthetic oligonucleotide

SEQ ID NO: 384681 - DNA, 25 bp, Artificial Sequence
  Description of Artificial Sequence: Synthetic oligonucleotide
gccgcggacaaggcggctcagatta

SEQ ID NO: 384682 - DNA, 25 bp, Artificial Sequence
  Description of Artificial Sequence: Synthetic oligonucleotide
ccgcggacaaggcggctcagattac

SEQ ID NO: 384683 - DNA, 25 bp, Artificial Sequence
  Description of Artificial Sequence: Synthetic oligonucleotide
cgcggacaaggcggctcagattacc

SEQ ID NO: 384684 - DNA, 26 bp, Artificial Sequence
  Description of Artificial Sequence: Synthetic oligonucleotide
gcggacaaggcggctcagattaccca

SEQ ID NO: 384685 - DNA, 26 bp, Artificial Sequence
  Description of Artificial Sequence: Synthetic oligonucleotide
cggacaaggcggctcagattacccag

SEQ ID NO: 384686 - DNA, 26 bp, Artificial Sequence
  Description of Artificial Sequence: Synthetic oligonucleotide
ggacaaggcggctcagattacccagc

SEQ ID NO: 384687 - DNA, 26 bp, Artificial Sequence
  Description of Artificial Sequence: Synthetic oligonucleotide
gacaaggcggctcagattacccagcg

SEQ ID NO: 384688 - DNA, 27 bp, Artificial Sequence
  Description of Artificial Sequence: Synthetic oligonucleotide
acaaggcggctcagattacccagcgca

SEQ ID NO: 384689 - DNA, 27 bp, Artificial Sequence
  Description of Artificial Sequence: Synthetic oligonucleotide
caaggcggctcagattacccagcgcaa

SEQ ID NO: 384690 - DNA, 27 bp, Artificial Sequence
  Description of Artificial Sequence: Synthetic oligonucleotide
aaggcggctcagattacccagcgcaag

SEQ ID NO: 384691 - DNA, 27 bp, Artificial Sequence
  Description of Artificial Sequence: Synthetic oligonucleotide
aggcggctcagattacccagcgcaagt

SEQ ID NO: 384692 - DNA, 23 bp, Artificial Sequence
  Description of Artificial Sequence: Synthetic oligonucleotide
cgctcttggaccgccgcggacaa

SEQ ID NO: 384693 - DNA, 23 bp, Artificial Sequence
  Description of Artificial Sequence: Synthetic oligonucleotide
gctcttggaccgccgcggacaag

SEQ ID NO: 384694 - DNA, 23 bp, Artificial Sequence
  Description of Artificial Sequence: Synthetic oligonucleotide
ctcttggaccgccgcggacaagg

SEQ ID NO: 384695 - DNA, 23 bp, Artificial Sequence
  Description of Artificial Sequence: Synthetic oligonucleotide
tcttggaccgccgcggacaaggc

SEQ ID NO: 384696 - DNA, 22 bp, Artificial Sequence
  Description of Artificial Sequence: Synthetic oligonucleotide
cttggaccgccgcggacaaggc

SEQ ID NO: 384697 - DNA, 22 bp, Artificial Sequence
  Description of Artificial Sequence: Synthetic oligonucleotide
ttggaccgccgcggacaaggcg

SEQ ID NO: 384698 - DNA, 27 bp, Artificial Sequence
  Description of Artificial Sequence: Synthetic oligonucleotide
cagttcgtgcagttcgacagcgacgca

SEQ ID NO: 384699 - DNA, 27 bp, Artificial Sequence
  Description of Artificial Sequence: Synthetic oligonucleotide
agttcgtgcagttcgacagcgacgcag

SEQ ID NO: 384700 - DNA, 26 bp, Artificial Sequence
  Description of Artificial Sequence: Synthetic oligonucleotide
gttcgtgcagttcgacagcgacgcag

SEQ ID NO: 384701 - DNA, 26 bp, Artificial Sequence
  Description of Artificial Sequence: Synthetic oligonucleotide
ttcgtgcagttcgacagcgacgcagc

SEQ ID NO: 384702 - DNA, 25 bp, Artificial Sequence
  Description of Artificial Sequence: Synthetic oligonucleotide
tcgtgcagttcgacagcgacgcagc

SEQ ID NO: 384703 - DNA, 24 bp, Artificial Sequence
  Description of Artificial Sequence: Synthetic oligonucleotide
cgtgcagttcgacagcgacgcagc

SEQ ID NO: 384704 - DNA, 25 bp, Artificial Sequence
  Description of Artificial Sequence: Synthetic oligonucleotide
gtgcagttcgacagcgacgcagcga

SEQ ID NO: 384705 - DNA, 26 bp, Artificial Sequence
  Description of Artificial Sequence: Synthetic oligonucleotide
tgcagttcgacagcgacgcagcgagt

SEQ ID NO: 384706 - DNA, 25 bp, Artificial Sequence
  Description of Artificial Sequence: Synthetic oligonucleotide
gcagttcgacagcgacgcagcgagt

SEQ ID NO: 384707 - DNA, 25 bp, Artificial Sequence
  Description of Artificial Sequence: Synthetic oligonucleotide
cagttcgacagcgacgcagcgagtc

SEQ ID NO: 384708 - DNA, 27 bp, Artificial Sequence
  Description of Artificial Sequence: Synthetic oligonucleotide
agttcgacagcgacgcagcgagtccaa

SEQ ID NO: 384709 - DNA, 26 bp, Artificial Sequence
  Description of Artificial Sequence: Synthetic oligonucleotide
gttcgacagcgacgcagcgagtccaa

SEQ ID NO: 384710 - DNA, 27 bp, Artificial Sequence
  Description of Artificial Sequence: Synthetic oligonucleotide
ttcgacagcgacgcagcgagtccaaga

SEQ ID NO: 384711 - DNA, 26 bp, Artificial Sequence
  Description of Artificial Sequence: Synthetic oligonucleotide
tcgacagcgacgcagcgagtccaaga

SEQ ID NO: 384712 - DNA, 25 bp, Artificial Sequence
  Description of Artificial Sequence: Synthetic oligonucleotide
cgacagcgacgcagcgagtccaaga

SEQ ID NO: 384713 - DNA, 25 bp, Artificial Sequence
  Description of Artificial Sequence: Synthetic oligonucleotide
gacagcgacgcagcgagtccaagag

SEQ ID NO: 384714 - DNA, 25 bp, Artificial Sequence
  Description of Artificial Sequence: Synthetic oligonucleotide
acagcgacgcagcgagtccaagagg

SEQ ID NO: 384715 - DNA, 24 bp, Artificial Sequence
  Description of Artificial Sequence: Synthetic oligonucleotide
cagcgacgcagcgagtccaagagg

SEQ ID NO: 384716 - DNA, 24 bp, Artificial Sequence
  Description of Artificial Sequence: Synthetic oligonucleotide
agcgacgcagcgagtccaagaggg

SEQ ID NO: 384717 - DNA, 23 bp, Artificial Sequence
  Description of Artificial Sequence: Synthetic oligonucleotide
gcgacgcagcgagtccaagaggg

SEQ ID NO: 384718 - DNA, 24 bp, Artificial Sequence
  Description of Artificial Sequence: Synthetic oligonucleotide
cgacgcagcgagtccaagagggga

SEQ ID NO: 384719 - DNA, 24 bp, Artificial Sequence
  Description of Artificial Sequence: Synthetic oligonucleotide
gacgcagcgagtccaagaggggag

SEQ ID NO: 384720 - DNA, 24 bp, Artificial Sequence
  Description of Artificial Sequence: Synthetic oligonucleotide
acgcagcgagtccaagaggggagc

SEQ ID NO: 384721 - DNA, 23 bp, Artificial Sequence
  Description of Artificial Sequence: Synthetic oligonucleotide
cgcagcgagtccaagaggggagc

SEQ ID NO: 384722 - DNA, 23 bp, Artificial Sequence
  Description of Artificial Sequence: Synthetic oligonucleotide
gcagcgagtccaagaggggagcc

SEQ ID NO: 384723 - DNA, 23 bp, Artificial Sequence
  Description of Artificial Sequence: Synthetic oligonucleotide
cagcgagtccaagaggggagccg

SEQ ID NO: 384724 - DNA, 23 bp, Artificial Sequence
  Description of Artificial Sequence: Synthetic oligonucleotide
agcgagtccaagaggggagccgc

SEQ ID NO: 384725 - DNA, 25 bp, Artificial Sequence
  Description of Artificial Sequence: Synthetic oligonucleotide
gatgtatggctgcgacctggggcca

SEQ ID NO: 384726 - DNA, 26 bp, Artificial Sequence
  Description of Artificial Sequence: Synthetic oligonucleotide
atgtatggctgcgacctggggccaga

SEQ ID NO: 384727 - DNA, 25 bp, Artificial Sequence
  Description of Artificial Sequence: Synthetic oligonucleotide
tgtatggctgcgacctggggccaga

SEQ ID NO: 384728 - DNA, 24 bp, Artificial Sequence
  Description of Artificial Sequence: Synthetic oligonucleotide
gtatggctgcgacctggggccaga

SEQ ID NO: 384729 - DNA, 24 bp, Artificial Sequence
  Description of Artificial Sequence: Synthetic oligonucleotide
tatggctgcgacctggggccagac

SEQ ID NO: 384730 - DNA, 23 bp, Artificial Sequence
  Description of Artificial Sequence: Synthetic oligonucleotide
atggctgcgacctggggccagac

SEQ ID NO: 384731 - DNA, 22 bp, Artificial Sequence
  Description of Artificial Sequence: Synthetic oligonucleotide
tggctgcgacctggggccagac

SEQ ID NO: 384732 - DNA, 21 bp, Artificial Sequence
  Description of Artificial Sequence: Synthetic oligonucleotide
ggctgcgacctggggccagac

SEQ ID NO: 384733 - DNA, 21 bp, Artificial Sequence
  Description of Artificial Sequence: Synthetic oligonucleotide
gctgcgacctggggccagacg

SEQ ID NO: 384734 - DNA, 21 bp, Artificial Sequence
  Description of Artificial Sequence: Synthetic oligonucleotide
ctgcgacctggggccagacgg

SEQ ID NO: 384735 - DNA, 21 bp, Artificial Sequence
  Description of Artificial Sequence: Synthetic oligonucleotide
tgcgacctggggccagacggg

SEQ ID NO: 384736 - DNA, 20 bp, Artificial Sequence
  Description of Artificial Sequence: Synthetic oligonucleotide
gcgacctggggccagacggg

SEQ ID NO: 384737 - DNA, 20 bp, Artificial Sequence
  Description of Artificial Sequence: Synthetic oligonucleotide
cgacctggggccagacgggc

SEQ ID NO: 384738 - DNA, 20 bp, Artificial Sequence
  Description of Artificial Sequence: Synthetic oligonucleotide
gacctggggccagacgggcg

SEQ ID NO: 384739 - DNA, 20 bp, Artificial Sequence
  Description of Artificial Sequence: Synthetic oligonucleotide
acctggggccagacgggcgc

SEQ ID NO: 384740 - DNA, 20 bp, Artificial Sequence
  Description of Artificial Sequence: Synthetic oligonucleotide
cctggggccagacgggcgct

SEQ ID NO: 384741 - DNA, 20 bp, Artificial Sequence
  Description of Artificial Sequence: Synthetic oligonucleotide
ctggggccagacgggcgcct

SEQ ID NO: 384742 - DNA, 20 bp, Artificial Sequence
  Description of Artificial Sequence: Synthetic oligonucleotide
tggggccagacgggcgcctc

SEQ ID NO: 384743 - DNA, 20 bp, Artificial Sequence
  Description of Artificial Sequence: Synthetic oligonucleotide
ggggccagacgggcgcctct

SEQ ID NO: 384744 - DNA, 20 bp, Artificial Sequence
  Description of Artificial Sequence: Synthetic oligonucleotide
gggccagacgggcgcctcct

SEQ ID NO: 384745 - DNA, 20 bp, Artificial Sequence
  Description of Artificial Sequence: Synthetic oligonucleotide
ggccagacgggcgcctcctc

SEQ ID NO: 384746 - DNA, 20 bp, Artificial Sequence
  Description of Artificial Sequence: Synthetic oligonucleotide
gccagacgggcgcctcctcc

SEQ ID NO: 384747 - DNA, 20 bp, Artificial Sequence
  Description of Artificial Sequence: Synthetic oligonucleotide
ccagacgggcgcctcctccg

SEQ ID NO: 384748 - DNA, 20 bp, Artificial Sequence
  Description of Artificial Sequence: Synthetic oligonucleotide
cagacgggcgcctcctccgc

SEQ ID NO: 384749 - DNA, 20 bp, Artificial Sequence
  Description of Artificial Sequence: Synthetic oligonucleotide
agacgggcgcctcctccgcg

SEQ ID NO: 384750 - DNA, 28 bp, Artificial Sequence
  Description of Artificial Sequence: Synthetic oligonucleotide
ctccagaggatgtatggctgcgaccttg

SEQ ID NO: 384751 - DNA, 28 bp, Artificial Sequence
  Description of Artificial Sequence: Synthetic oligonucleotide
tccagaggatgtatggctgcgaccttgg

SEQ ID NO: 384752 - DNA, 27 bp, Artificial Sequence
  Description of Artificial Sequence: Synthetic oligonucleotide
ccagaggatgtatggctgcgaccttgg

SEQ ID NO: 384753 - DNA, 27 bp, Artificial Sequence
  Description of Artificial Sequence: Synthetic oligonucleotide
cagaggatgtatggctgcgaccttggg

SEQ ID NO: 384754 - DNA, 27 bp, Artificial Sequence
  Description of Artificial Sequence: Synthetic oligonucleotide
agaggatgtatggctgcgaccttgggc

SEQ ID NO: 384755 - DNA, 26 bp, Artificial Sequence
  Description of Artificial Sequence: Synthetic oligonucleotide
gaggatgtatggctgcgaccttgggc

SEQ ID NO: 384756 - DNA, 26 bp, Artificial Sequence
  Description of Artificial Sequence: Synthetic oligonucleotide
aggatgtatggctgcgaccttgggcc

SEQ ID NO: 384757 - DNA, 25 bp, Artificial Sequence
  Description of Artificial Sequence: Synthetic oligonucleotide
ggatgtatggctgcgaccttgggcc

SEQ ID NO: 384758 - DNA, 25 bp, Artificial Sequence
  Description of Artificial Sequence: Synthetic oligonucleotide
gatgtatggctgcgaccttgggccc

SEQ ID NO: 384759 - DNA, 26 bp, Artificial Sequence
  Description of Artificial Sequence: Synthetic oligonucleotide
atgtatggctgcgaccttgggcccga

SEQ ID NO: 384760 - DNA, 25 bp, Artificial Sequence
  Description of Artificial Sequence: Synthetic oligonucleotide
tgtatggctgcgaccttgggcccga

SEQ ID NO: 384761 - DNA, 24 bp, Artificial Sequence
  Description of Artificial Sequence: Synthetic oligonucleotide
gtatggctgcgaccttgggcccga

SEQ ID NO: 384762 - DNA, 24 bp, Artificial Sequence
  Description of Artificial Sequence: Synthetic oligonucleotide
tatggctgcgaccttgggcccgac

SEQ ID NO: 384763 - DNA, 23 bp, Artificial Sequence
  Description of Artificial Sequence: Synthetic oligonucleotide
atggctgcgaccttgggcccgac

SEQ ID NO: 384764 - DNA, 22 bp, Artificial Sequence
  Description of Artificial Sequence: Synthetic oligonucleotide
tggctgcgaccttgggcccgac

SEQ ID NO: 384765 - DNA, 21 bp, Artificial Sequence
  Description of Artificial Sequence: Synthetic oligonucleotide
ggctgcgaccttgggcccgac

SEQ ID NO: 384766 - DNA, 21 bp, Artificial Sequence
  Description of Artificial Sequence: Synthetic oligonucleotide
gctgcgaccttgggcccgacg

SEQ ID NO: 384767 - DNA, 21 bp, Artificial Sequence
  Description of Artificial Sequence: Synthetic oligonucleotide
ctgcgaccttgggcccgacgg

SEQ ID NO: 384768 - DNA, 21 bp, Artificial Sequence
  Description of Artificial Sequence: Synthetic oligonucleotide
tgcgaccttgggcccgacggg

SEQ ID NO: 384769 - DNA, 20 bp, Artificial Sequence
  Description of Artificial Sequence: Synthetic oligonucleotide
gcgaccttgggcccgacggg

SEQ ID NO: 384770 - DNA, 20 bp, Artificial Sequence
  Description of Artificial Sequence: Synthetic oligonucleotide
cgaccttgggcccgacgggc

SEQ ID NO: 384771 - DNA, 20 bp, Artificial Sequence
  Description of Artificial Sequence: Synthetic oligonucleotide
gaccttgggcccgacgggcg

SEQ ID NO: 384772 - DNA, 20 bp, Artificial Sequence
  Description of Artificial Sequence: Synthetic oligonucleotide
accttgggcccgacgggcgc

SEQ ID NO: 384773 - DNA, 20 bp, Artificial Sequence
  Description of Artificial Sequence: Synthetic oligonucleotide
ccttgggcccgacgggcgct

SEQ ID NO: 384774 - DNA, 20 bp, Artificial Sequence
  Description of Artificial Sequence: Synthetic oligonucleotide
cttgggcccgacgggcgcct

SEQ ID NO: 384775 - DNA, 20 bp, Artificial Sequence
  Description of Artificial Sequence: Synthetic oligonucleotide
ttgggcccgacgggcgcctc

SEQ ID NO: 384776 - DNA, 20 bp, Artificial Sequence
  Description of Artificial Sequence: Synthetic oligonucleotide
tgggcccgacgggcgcctct

SEQ ID NO: 384777 - DNA, 22 bp, Artificial Sequence
  Description of Artificial Sequence: Synthetic oligonucleotide
gctcctggaccgcggcggacaa

SEQ ID NO: 384778 - DNA, 22 bp, Artificial Sequence
  Description of Artificial Sequence: Synthetic oligonucleotide
ctcctggaccgcggcggacaag

SEQ ID NO: 384779 - DNA, 22 bp, Artificial Sequence
  Description of Artificial Sequence: Synthetic oligonucleotide
tcctggaccgcggcggacaagg

SEQ ID NO: 384780 - DNA, 21 bp, Artificial Sequence
  Description of Artificial Sequence: Synthetic oligonucleotide
cctggaccgcggcggacaagg

SEQ ID NO: 384781 - DNA, 21 bp, Artificial Sequence
  Description of Artificial Sequence: Synthetic oligonucleotide
ctggaccgcggcggacaaggc

SEQ ID NO: 384782 - DNA, 21 bp, Artificial Sequence
  Description of Artificial Sequence: Synthetic oligonucleotide
tggaccgcggcggacaaggcg

SEQ ID NO: 384783 - DNA, 20 bp, Artificial Sequence
  Description of Artificial Sequence: Synthetic oligonucleotide
ggaccgcggcggacaaggcg

SEQ ID NO: 384784 - DNA, 20 bp, Artificial Sequence
  Description of Artificial Sequence: Synthetic oligonucleotide
gaccgcggcggacaaggcgg

SEQ ID NO: 384785 - DNA, 21 bp, Artificial Sequence
  Description of Artificial Sequence: Synthetic oligonucleotide
accgcggcggacaaggcggct

SEQ ID NO: 384786 - DNA, 20 bp, Artificial Sequence
  Description of Artificial Sequence: Synthetic oligonucleotide
ccgcggcggacaaggcggct

SEQ ID NO: 384787 - DNA, 21 bp, Artificial Sequence
  Description of Artificial Sequence: Synthetic oligonucleotide
cgcggcggacaaggcggctca

SEQ ID NO: 384788 - DNA, 23 bp, Artificial Sequence
  Description of Artificial Sequence: Synthetic oligonucleotide
gcggcggacaaggcggctcagat

SEQ ID NO: 384789 - DNA, 24 bp, Artificial Sequence
  Description of Artificial Sequence: Synthetic oligonucleotide
cggcggacaaggcggctcagatca

SEQ ID NO: 384790 - DNA, 24 bp, Artificial Sequence
  Description of Artificial Sequence: Synthetic oligonucleotide
ggcggacaaggcggctcagatcac

SEQ ID NO: 384791 - DNA, 24 bp, Artificial Sequence
  Description of Artificial Sequence: Synthetic oligonucleotide
gggaagaagacgctgcagcgcgca

SEQ ID NO: 384792 - DNA, 24 bp, Artificial Sequence
  Description of Artificial Sequence: Synthetic oligonucleotide
ggaagaagacgctgcagcgcgcag

SEQ ID NO: 384793 - DNA, 28 bp, Artificial Sequence
  Description of Artificial Sequence: Synthetic oligonucleotide
gcctgctcccactccatgaggtatttcg

SEQ ID NO: 384794 - DNA, 29 bp, Artificial Sequence
  Description of Artificial Sequence: Synthetic oligonucleotide
cctgctcccactccatgaggtatttcgac

SEQ ID NO: 384795 - DNA, 30 bp, Artificial Sequence; identical to SEQ ID NO: 46083
  Description of Artificial Sequence: Synthetic oligonucleotide

SEQ ID NO: 384796 - DNA, 30 bp, Artificial Sequence; identical to SEQ ID NO: 46084
  Description of Artificial Sequence: Synthetic oligonucleotide

SEQ ID NO: 384797 - DNA, 25 bp, Artificial Sequence
  Description of Artificial Sequence: Synthetic oligonucleotide
gaggacgggtctcacaccctccagt

SEQ ID NO: 384798 - DNA, 25 bp, Artificial Sequence
  Description of Artificial Sequence: Synthetic oligonucleotide
aggacgggtctcacaccctccagtg

SEQ ID NO: 384799 - DNA, 24 bp, Artificial Sequence
  Description of Artificial Sequence: Synthetic oligonucleotide
ggacgggtctcacaccctccagtg

SEQ ID NO: 384800 - DNA, 26 bp, Artificial Sequence
  Description of Artificial Sequence: Synthetic oligonucleotide
gacgggtctcacaccctccagtggat

SEQ ID NO: 384801 - DNA, 27 bp, Artificial Sequence
  Description of Artificial Sequence: Synthetic oligonucleotide
acgggtctcacaccctccagtggatgt

SEQ ID NO: 384802 - DNA, 23 bp, Artificial Sequence
  Description of Artificial Sequence: Synthetic oligonucleotide
cacgtgcgtggagtggctccgga

SEQ ID NO: 384803 - DNA, 26 bp, Artificial Sequence
  Description of Artificial Sequence: Synthetic oligonucleotide
acgtgcgtggagtggctccggagata

SEQ ID NO: 384804 - DNA, 25 bp, Artificial Sequence
  Description of Artificial Sequence: Synthetic oligonucleotide
cgtgcgtggagtggctccggagata

SEQ ID NO: 384805 - DNA, 25 bp, Artificial Sequence
  Description of Artificial Sequence: Synthetic oligonucleotide
gtgcgtggagtggctccggagatac

SEQ ID NO: 384806 - DNA, 26 bp, Artificial Sequence
  Description of Artificial Sequence: Synthetic oligonucleotide
tgcgtggagtggctccggagatacct

SEQ ID NO: 384807 - DNA, 25 bp, Artificial Sequence
  Description of Artificial Sequence: Synthetic oligonucleotide
gcgtggagtggctccggagatacct

SEQ ID NO: 384808 - DNA, 25 bp, Artificial Sequence
  Description of Artificial Sequence: Synthetic oligonucleotide
cgtggagtggctccggagatacctg

SEQ ID NO: 384809 - DNA, 26 bp, Artificial Sequence
  Description of Artificial Sequence: Synthetic oligonucleotide
gtggagtggctccggagatacctgga

SEQ ID NO: 384810 - DNA, 27 bp, Artificial Sequence
  Description of Artificial Sequence: Synthetic oligonucleotide
tggagtggctccggagatacctggaga

SEQ ID NO: 384811 - DNA, 27 bp, Artificial Sequence
  Description of Artificial Sequence: Synthetic oligonucleotide
ggagtggctccggagatacctggagaa

SEQ ID NO: 384812 - DNA, 27 bp, Artificial Sequence
  Description of Artificial Sequence: Synthetic oligonucleotide
gagtggctccggagatacctggagaac

SEQ ID NO: 384813 - DNA, 27 bp, Artificial Sequence
  Description of Artificial Sequence: Synthetic oligonucleotide
agtggctccggagatacctggagaacg

SEQ ID NO: 384814 - DNA, 26 bp, Artificial Sequence
  Description of Artificial Sequence: Synthetic oligonucleotide
gtggctccggagatacctggagaacg

SEQ ID NO: 384815 - DNA, 26 bp, Artificial Sequence
  Description of Artificial Sequence: Synthetic oligonucleotide
tggctccggagatacctggagaacgg

SEQ ID NO: 384816 - DNA, 25 bp, Artificial Sequence
  Description of Artificial Sequence: Synthetic oligonucleotide
ggctccggagatacctggagaacgg

SEQ ID NO: 384817 - DNA, 27 bp, Artificial Sequence
  Description of Artificial Sequence: Synthetic oligonucleotide
gctccggagatacctggagaacgggaa

SEQ ID NO: 384818 - DNA, 27 bp, Artificial Sequence
  Description of Artificial Sequence: Synthetic oligonucleotide
ctccggagatacctggagaacgggaag

SEQ ID NO: 384819 - DNA, 27 bp, Artificial Sequence
  Description of Artificial Sequence: Synthetic oligonucleotide
tccggagatacctggagaacgggaagg

SEQ ID NO: 384820 - DNA, 27 bp, Artificial Sequence
  Description of Artificial Sequence: Synthetic oligonucleotide
ccggagatacctggagaacgggaagga

SEQ ID NO: 384821 - DNA, 27 bp, Artificial Sequence
  Description of Artificial Sequence: Synthetic oligonucleotide
cggagatacctggagaacgggaaggag

SEQ ID NO: 384822 - DNA, 28 bp, Artificial Sequence
  Description of Artificial Sequence: Synthetic oligonucleotide
ggagatacctggagaacgggaaggagac

SEQ ID NO: 384823 - DNA, 28 bp, Artificial Sequence
  Description of Artificial Sequence: Synthetic oligonucleotide
gagatacctggagaacgggaaggagacg

SEQ ID NO: 384824 - DNA, 20 bp, Artificial Sequence
  Description of Artificial Sequence: Synthetic oligonucleotide
gagaggggagccccgggctc

SEQ ID NO: 384825 - DNA, 20 bp, Artificial Sequence
  Description of Artificial Sequence: Synthetic oligonucleotide
agaggggagccccgggctcc

SEQ ID NO: 384826 - DNA, 20 bp, Artificial Sequence
  Description of Artificial Sequence: Synthetic oligonucleotide
gaggggagccccgggctcct

SEQ ID NO: 384827 - DNA, 20 bp, Artificial Sequence
  Description of Artificial Sequence: Synthetic oligonucleotide
aggggagccccgggctccgt

SEQ ID NO: 384828 - DNA, 20 bp, Artificial Sequence
  Description of Artificial Sequence: Synthetic oligonucleotide
ggggagccccgggctccgtt

SEQ ID NO: 384829 - DNA, 20 bp, Artificial Sequence
  Description of Artificial Sequence: Synthetic oligonucleotide
gggagccccgggctccgtgt

SEQ ID NO: 384830 - DNA, 20 bp, Artificial Sequence
  Description of Artificial Sequence: Synthetic oligonucleotide
ggagccccgggctccgtggt

SEQ ID NO: 384831 - DNA, 20 bp, Artificial Sequence
  Description of Artificial Sequence: Synthetic oligonucleotide
gagccccgggctccgtgggt

SEQ ID NO: 384832 - DNA, 20 bp, Artificial Sequence
  Description of Artificial Sequence: Synthetic oligonucleotide
agccccgggctccgtgggtg

SEQ ID NO: 384833 - DNA, 20 bp, Artificial Sequence
  Description of Artificial Sequence: Synthetic oligonucleotide
gccccgggctccgtgggtgt

SEQ ID NO: 384834 - DNA, 20 bp, Artificial Sequence
  Description of Artificial Sequence: Synthetic oligonucleotide
ccccgggctccgtgggtgga

SEQ ID NO: 384835 - DNA, 20 bp, Artificial Sequence
  Description of Artificial Sequence: Synthetic oligonucleotide
cccgggctccgtgggtggag

SEQ ID NO: 384836 - DNA, 21 bp, Artificial Sequence
  Description of Artificial Sequence: Synthetic oligonucleotide
ccgggctccgtgggtggagca

SEQ ID NO: 384837 - DNA, 21 bp, Artificial Sequence
  Description of Artificial Sequence: Synthetic oligonucleotide
cgggctccgtgggtggagcag

SEQ ID NO: 384838 - DNA, 22 bp, Artificial Sequence
  Description of Artificial Sequence: Synthetic oligonucleotide
gggctccgtgggtggagcagga

SEQ ID NO: 384839 - DNA, 22 bp, Artificial Sequence
  Description of Artificial Sequence: Synthetic oligonucleotide
ggctccgtgggtggagcaggag

SEQ ID NO: 384840 - DNA, 22 bp, Artificial Sequence
  Description of Artificial Sequence: Synthetic oligonucleotide
gctccgtgggtggagcaggagg

SEQ ID NO: 384841 - DNA, 22 bp, Artificial Sequence
  Description of Artificial Sequence: Synthetic oligonucleotide
ctccgtgggtggagcaggaggg

SEQ ID NO: 384842 - DNA, 22 bp, Artificial Sequence
  Description of Artificial Sequence: Synthetic oligonucleotide
tccgtgggtggagcaggagggg

SEQ ID NO: 384843 - DNA, 30 bp, Artificial Sequence; identical to SEQ ID NO: 46126
  Description of Artificial Sequence: Synthetic oligonucleotide

SEQ ID NO: 384844 - DNA, 30 bp, Artificial Sequence; identical to SEQ ID NO: 46127
  Description of Artificial Sequence: Synthetic oligonucleotide

SEQ ID NO: 384845 - DNA, 30 bp, Artificial Sequence; identical to SEQ ID NO: 46128
  Description of Artificial Sequence: Synthetic oligonucleotide

SEQ ID NO: 384846 - DNA, 29 bp, Artificial Sequence
  Description of Artificial Sequence: Synthetic oligonucleotide
cccactccatgaggtattttgacaccgcc

SEQ ID NO: 384847 - DNA, 29 bp, Artificial Sequence
  Description of Artificial Sequence: Synthetic oligonucleotide
ccactccatgaggtattttgacaccgccg

SEQ ID NO: 384848 - DNA, 30 bp, Artificial Sequence; identical to SEQ ID NO: 46131
  Description of Artificial Sequence: Synthetic oligonucleotide

SEQ ID NO: 384849 - DNA, 31 bp, Artificial Sequence; identical to SEQ ID NO: 46132
  Description of Artificial Sequence: Synthetic oligonucleotide

SEQ ID NO: 384850 - DNA, 30 bp, Artificial Sequence; identical to SEQ ID NO: 46133
  Description of Artificial Sequence: Synthetic oligonucleotide

SEQ ID NO: 384851 - DNA, 30 bp, Artificial Sequence; identical to SEQ ID NO: 46134
  Description of Artificial Sequence: Synthetic oligonucleotide

SEQ ID NO: 384852 - DNA, 29 bp, Artificial Sequence
  Description of Artificial Sequence: Synthetic oligonucleotide
ccatgaggtattttgacaccgccgtgtcc

SEQ ID NO: 384853 - DNA, 29 bp, Artificial Sequence
  Description of Artificial Sequence: Synthetic oligonucleotide
catgaggtattttgacaccgccgtgtccc

SEQ ID NO: 384854 - DNA, 29 bp, Artificial Sequence
  Description of Artificial Sequence: Synthetic oligonucleotide
atgaggtattttgacaccgccgtgtcccg

SEQ ID NO: 384855 - DNA, 28 bp, Artificial Sequence
  Description of Artificial Sequence: Synthetic oligonucleotide
tgaggtattttgacaccgccgtgtcccg

SEQ ID NO: 384856 - DNA, 27 bp, Artificial Sequence
  Description of Artificial Sequence: Synthetic oligonucleotide
gaggtattttgacaccgccgtgtcccg

SEQ ID NO: 384857 - DNA, 27 bp, Artificial Sequence
  Description of Artificial Sequence: Synthetic oligonucleotide
aggtattttgacaccgccgtgtcccgg

SEQ ID NO: 384858 - DNA, 26 bp, Artificial Sequence
  Description of Artificial Sequence: Synthetic oligonucleotide
ggtattttgacaccgccgtgtcccgg

SEQ ID NO: 384859 - DNA, 26 bp, Artificial Sequence
  Description of Artificial Sequence: Synthetic oligonucleotide
gtattttgacaccgccgtgtcccggc

SEQ ID NO: 384860 - DNA, 26 bp, Artificial Sequence
  Description of Artificial Sequence: Synthetic oligonucleotide
tattttgacaccgccgtgtcccggcc

SEQ ID NO: 384861 - DNA, 25 bp, Artificial Sequence
  Description of Artificial Sequence: Synthetic oligonucleotide
attttgacaccgccgtgtcccggcc

SEQ ID NO: 384862 - DNA, 24 bp, Artificial Sequence
  Description of Artificial Sequence: Synthetic oligonucleotide
ttttgacaccgccgtgtcccggcc

SEQ ID NO: 384863 - DNA, 23 bp, Artificial Sequence
  Description of Artificial Sequence: Synthetic oligonucleotide
tttgacaccgccgtgtcccggcc

SEQ ID NO: 384864 - DNA, 22 bp, Artificial Sequence
  Description of Artificial Sequence: Synthetic oligonucleotide
ttgacaccgccgtgtcccggcc

SEQ ID NO: 384865 - DNA, 21 bp, Artificial Sequence
  Description of Artificial Sequence: Synthetic oligonucleotide
tgacaccgccgtgtcccggcc

SEQ ID NO: 384866 - DNA, 27 bp, Artificial Sequence
  Description of Artificial Sequence: Synthetic oligonucleotide
gctccgcagatacctggagaacggcaa

SEQ ID NO: 384867 - DNA, 27 bp, Artificial Sequence
  Description of Artificial Sequence: Synthetic oligonucleotide
ctccgcagatacctggagaacggcaag

SEQ ID NO: 384868 - DNA, 27 bp, Artificial Sequence
  Description of Artificial Sequence: Synthetic oligonucleotide
tccgcagatacctggagaacggcaagg

SEQ ID NO: 384869 - DNA, 27 bp, Artificial Sequence
  Description of Artificial Sequence: Synthetic oligonucleotide
ccgcagatacctggagaacggcaagga

SEQ ID NO: 384870 - DNA, 27 bp, Artificial Sequence
  Description of Artificial Sequence: Synthetic oligonucleotide
cgcagatacctggagaacggcaaggag

SEQ ID NO: 384871 - DNA, 28 bp, Artificial Sequence
  Description of Artificial Sequence: Synthetic oligonucleotide
gcagatacctggagaacggcaaggagac

SEQ ID NO: 384872 - DNA, 28 bp, Artificial Sequence
  Description of Artificial Sequence: Synthetic oligonucleotide
cagatacctggagaacggcaaggagacg

SEQ ID NO: 384873 - DNA, 28 bp, Artificial Sequence
  Description of Artificial Sequence: Synthetic oligonucleotide
agatacctggagaacggcaaggagacgc

SEQ ID NO: 384874 - DNA, 27 bp, Artificial Sequence
  Description of Artificial Sequence: Synthetic oligonucleotide
gatacctggagaacggcaaggagacgc

SEQ ID NO: 384875 - DNA, 28 bp, Artificial Sequence
  Description of Artificial Sequence: Synthetic oligonucleotide
atacctggagaacggcaaggagacgctg

SEQ ID NO: 384876 - DNA, 27 bp, Artificial Sequence
  Description of Artificial Sequence: Synthetic oligonucleotide
tacctggagaacggcaaggagacgctg

SEQ ID NO: 384877 - DNA, 20 bp, Artificial Sequence
  Description of Artificial Sequence: Synthetic oligonucleotide
acaccgccgtgtcccggccg

SEQ ID NO: 384878 - DNA, 20 bp, Artificial Sequence
  Description of Artificial Sequence: Synthetic oligonucleotide
caccgccgtgtcccggccgt

SEQ ID NO: 384879 - DNA, 20 bp, Artificial Sequence
  Description of Artificial Sequence: Synthetic oligonucleotide
accgccgtgtcccggccggt

SEQ ID NO: 384880 - DNA, 20 bp, Artificial Sequence
  Description of Artificial Sequence: Synthetic oligonucleotide
ccgccgtgtcccggccggtt

SEQ ID NO: 384881 - DNA, 20 bp, Artificial Sequence
  Description of Artificial Sequence: Synthetic oligonucleotide
cgccgtgtcccggccgggtt

SEQ ID NO: 384882 - DNA, 20 bp, Artificial Sequence
  Description of Artificial Sequence: Synthetic oligonucleotide
gccgtgtcccggccgggctt

SEQ ID NO: 384883 - DNA, 20 bp, Artificial Sequence
  Description of Artificial Sequence: Synthetic oligonucleotide
tcccggccgggccgcggatt

SEQ ID NO: 384884 - DNA, 20 bp, Artificial Sequence
  Description of Artificial Sequence: Synthetic oligonucleotide
cccggccgggccgcggattt

SEQ ID NO: 384885 - DNA, 20 bp, Artificial Sequence
  Description of Artificial Sequence: Synthetic oligonucleotide
ccggccgggccgcggagatt

SEQ ID NO: 384886 - DNA, 20 bp, Artificial Sequence
  Description of Artificial Sequence: Synthetic oligonucleotide
cggccgggccgcggagagtt

SEQ ID NO: 384887 - DNA, 20 bp, Artificial Sequence
  Description of Artificial Sequence: Synthetic oligonucleotide
ggccgggccgcggagagctt

SEQ ID NO: 384888 - DNA, 20 bp, Artificial Sequence
  Description of Artificial Sequence: Synthetic oligonucleotide
gccgggccgcggagagcctt

SEQ ID NO: 384889 - DNA, 20 bp, Artificial Sequence
  Description of Artificial Sequence: Synthetic oligonucleotide
ccgggccgcggagagccctt

SEQ ID NO: 384890 - DNA, 20 bp, Artificial Sequence
  Description of Artificial Sequence: Synthetic oligonucleotide
cgggccgcggagagcccctt

SEQ ID NO: 384891 - DNA, 20 bp, Artificial Sequence
  Description of Artificial Sequence: Synthetic oligonucleotide
gggccgcggagagccccgtt

SEQ ID NO: 384892 - DNA, 26 bp, Artificial Sequence
  Description of Artificial Sequence: Synthetic oligonucleotide
gccaggcacaggctgaccgagtgaat

SEQ ID NO: 384893 - DNA, 27 bp, Artificial Sequence
  Description of Artificial Sequence: Synthetic oligonucleotide
ccaggcacaggctgaccgagtgaatct

SEQ ID NO: 384894 - DNA, 27 bp, Artificial Sequence
  Description of Artificial Sequence: Synthetic oligonucleotide
caggcacaggctgaccgagtgaatctg

SEQ ID NO: 384895 - DNA, 27 bp, Artificial Sequence
  Description of Artificial Sequence: Synthetic oligonucleotide
aggcacaggctgaccgagtgaatctgc

SEQ ID NO: 384896 - DNA, 26 bp, Artificial Sequence
  Description of Artificial Sequence: Synthetic oligonucleotide
ggcacaggctgaccgagtgaatctgc

SEQ ID NO: 384897 - DNA, 26 bp, Artificial Sequence
  Description of Artificial Sequence: Synthetic oligonucleotide
gcacaggctgaccgagtgaatctgcg

SEQ ID NO: 384898 - DNA, 27 bp, Artificial Sequence
  Description of Artificial Sequence: Synthetic oligonucleotide
cacaggctgaccgagtgaatctgcgga

SEQ ID NO: 384899 - DNA, 29 bp, Artificial Sequence
  Description of Artificial Sequence: Synthetic oligonucleotide
acaggctgaccgagtgaatctgcggaaac

SEQ ID NO: 384900 - DNA, 28 bp, Artificial Sequence
  Description of Artificial Sequence: Synthetic oligonucleotide
caggctgaccgagtgaatctgcggaaac

SEQ ID NO: 384901 - DNA, 29 bp, Artificial Sequence
  Description of Artificial Sequence: Synthetic oligonucleotide
aggctgaccgagtgaatctgcggaaactg

SEQ ID NO: 384902 - DNA, 28 bp, Artificial Sequence
  Description of Artificial Sequence: Synthetic oligonucleotide
ggctgaccgagtgaatctgcggaaactg

SEQ ID NO: 384903 - DNA, 28 bp, Artificial Sequence
  Description of Artificial Sequence: Synthetic oligonucleotide
gctgaccgagtgaatctgcggaaactgc

SEQ ID NO: 384904 - DNA, 28 bp, Artificial Sequence
  Description of Artificial Sequence: Synthetic oligonucleotide
ctgaccgagtgaatctgcggaaactgcg

SEQ ID NO: 384905 - DNA, 28 bp, Artificial Sequence
  Description of Artificial Sequence: Synthetic oligonucleotide
tgaccgagtgaatctgcggaaactgcgc

SEQ ID NO: 384906 - DNA, 27 bp, Artificial Sequence
  Description of Artificial Sequence: Synthetic oligonucleotide
gaccgagtgaatctgcggaaactgcgc

SEQ ID NO: 384907 - DNA, 27 bp, Artificial Sequence
  Description of Artificial Sequence: Synthetic oligonucleotide
accgagtgaatctgcggaaactgcgcg

SEQ ID NO: 384908 - DNA, 26 bp, Artificial Sequence
  Description of Artificial Sequence: Synthetic oligonucleotide
ccgagtgaatctgcggaaactgcgcg

SEQ ID NO: 384909 - DNA, 26 bp, Artificial Sequence
  Description of Artificial Sequence: Synthetic oligonucleotide
cgagtgaatctgcggaaactgcgcgg

SEQ ID NO: 384910 - DNA, 27 bp, Artificial Sequence
  Description of Artificial Sequence: Synthetic oligonucleotide
gagtgaatctgcggaaactgcgcggct

SEQ ID NO: 384911 - DNA, 28 bp, Artificial Sequence
  Description of Artificial Sequence: Synthetic oligonucleotide
agtgaatctgcggaaactgcgcggctac

SEQ ID NO: 384912 - DNA, 27 bp, Artificial Sequence
  Description of Artificial Sequence: Synthetic oligonucleotide
gtgaatctgcggaaactgcgcggctac

SEQ ID NO: 384913 - DNA, 29 bp, Artificial Sequence
  Description of Artificial Sequence: Synthetic oligonucleotide
tgaatctgcggaaactgcgcggctactac

SEQ ID NO: 384914 - DNA, 28 bp, Artificial Sequence
  Description of Artificial Sequence: Synthetic oligonucleotide
gaatctgcggaaactgcgcggctactac

SEQ ID NO: 384915 - DNA, 30 bp, Artificial Sequence
  Description of Artificial Sequence: Synthetic oligonucleotide
aatctgcggaaactgcgcggctactacaac

SEQ ID NO: 384916 - DNA, 29 bp, Artificial Sequence
  Description of Artificial Sequence: Synthetic oligonucleotide
atctgcggaaactgcgcggctactacaac

SEQ ID NO: 384917 - DNA, 28 bp, Artificial Sequence
  Description of Artificial Sequence: Synthetic oligonucleotide
tctgcggaaactgcgcggctactacaac

SEQ ID NO: 384918 - DNA, 30 bp, Artificial Sequence
  Description of Artificial Sequence: Synthetic oligonucleotide
agacacaaaagtacaagcgccaggcacagg

SEQ ID NO: 384919 - DNA, 29 bp, Artificial Sequence
  Description of Artificial Sequence: Synthetic oligonucleotide
gacacaaaagtacaagcgccaggcacagg

SEQ ID NO: 384920 - DNA, 29 bp, Artificial Sequence
  Description of Artificial Sequence: Synthetic oligonucleotide
acacaaaagtacaagcgccaggcacaggc

SEQ ID NO: 384921 - DNA, 28 bp, Artificial Sequence
  Description of Artificial Sequence: Synthetic oligonucleotide
cacaaaagtacaagcgccaggcacaggc

SEQ ID NO: 384922 - DNA, 29 bp, Artificial Sequence
  Description of Artificial Sequence: Synthetic oligonucleotide
acaaaagtacaagcgccaggcacaggctg

SEQ ID NO: 384923 - DNA, 28 bp, Artificial Sequence
  Description of Artificial Sequence: Synthetic oligonucleotide
caaaagtacaagcgccaggcacaggctg

SEQ ID NO: 384924 - DNA, 29 bp, Artificial Sequence
  Description of Artificial Sequence: Synthetic oligonucleotide
aaaagtacaagcgccaggcacaggctgac

SEQ ID NO: 384925 - DNA, 28 bp, Artificial Sequence
  Description of Artificial Sequence: Synthetic oligonucleotide
aaagtacaagcgccaggcacaggctgac

SEQ ID NO: 384926 - DNA, 20 bp, Artificial Sequence
  Description of Artificial Sequence: Synthetic oligonucleotide
tgcgctcctggaccgccgcc

SEQ ID NO: 384927 - DNA, 20 bp, Artificial Sequence
  Description of Artificial Sequence: Synthetic oligonucleotide
gcgctcctggaccgccgcct

SEQ ID NO: 384928 - DNA, 20 bp, Artificial Sequence
  Description of Artificial Sequence: Synthetic oligonucleotide
cgctcctggaccgccgccga

SEQ ID NO: 384929 - DNA, 21 bp, Artificial Sequence
  Description of Artificial Sequence: Synthetic oligonucleotide
gctcctggaccgccgccgaca

SEQ ID NO: 384930 - DNA, 21 bp, Artificial Sequence
  Description of Artificial Sequence: Synthetic oligonucleotide
ctcctggaccgccgccgacac

SEQ ID NO: 384931 - DNA, 21 bp, Artificial Sequence
  Description of Artificial Sequence: Synthetic oligonucleotide
tcctggaccgccgccgacacg

SEQ ID NO: 384932 - DNA, 20 bp, Artificial Sequence
  Description of Artificial Sequence: Synthetic oligonucleotide
cctggaccgccgccgacacg

SEQ ID NO: 384933 - DNA, 20 bp, Artificial Sequence
  Description of Artificial Sequence: Synthetic oligonucleotide
ctggaccgccgccgacacgg

SEQ ID NO: 384934 - DNA, 20 bp, Artificial Sequence
  Description of Artificial Sequence: Synthetic oligonucleotide
tggaccgccgccgacacggc

SEQ ID NO: 384935 - DNA, 20 bp, Artificial Sequence
  Description of Artificial Sequence: Synthetic oligonucleotide
ggaccgccgccgacacggct

SEQ ID NO: 384936 - DNA, 20 bp, Artificial Sequence
  Description of Artificial Sequence: Synthetic oligonucleotide
gaccgccgccgacacggcgt

SEQ ID NO: 384937 - DNA, 20 bp, Artificial Sequence
  Description of Artificial Sequence: Synthetic oligonucleotide
accgccgccgacacggcggt

SEQ ID NO: 384938 - DNA, 20 bp, Artificial Sequence
  Description of Artificial Sequence: Synthetic oligonucleotide
ccgccgccgacacggcggtt

SEQ ID NO: 384939 - DNA, 20 bp, Artificial Sequence
  Description of Artificial Sequence: Synthetic oligonucleotide
cgccgccgacacggcggctt

SEQ ID NO: 384940 - DNA, 20 bp, Artificial Sequence
  Description of Artificial Sequence: Synthetic oligonucleotide
gccgccgacacggcggctca

SEQ ID NO: 384941 - DNA, 22 bp, Artificial Sequence
  Description of Artificial Sequence: Synthetic oligonucleotide
ccgccgacacggcggctcagat

SEQ ID NO: 384942 - DNA, 23 bp, Artificial Sequence
  Description of Artificial Sequence: Synthetic oligonucleotide
cgccgacacggcggctcagatca

SEQ ID NO: 384943 - DNA, 23 bp, Artificial Sequence
  Description of Artificial Sequence: Synthetic oligonucleotide
gccgacacggcggctcagatcac

SEQ ID NO: 384944 - DNA, 23 bp, Artificial Sequence
  Description of Artificial Sequence: Synthetic oligonucleotide
ccgacacggcggctcagatcacc

SEQ ID NO: 384945 - DNA, 24 bp, Artificial Sequence
  Description of Artificial Sequence: Synthetic oligonucleotide
cgacacggcggctcagatcaccca

SEQ ID NO: 384946 - DNA, 24 bp, Artificial Sequence
  Description of Artificial Sequence: Synthetic oligonucleotide
cggtttgacagcgacgccgcgagt

SEQ ID NO: 384947 - DNA, 26 bp, Artificial Sequence
  Description of Artificial Sequence: Synthetic oligonucleotide
agagcgaggacgggtctcacaccctt

SEQ ID NO: 384948 - DNA, 25 bp, Artificial Sequence
  Description of Artificial Sequence: Synthetic oligonucleotide
gagcgaggacgggtctcacaccctt

SEQ ID NO: 384949 - DNA, 26 bp, Artificial Sequence
  Description of Artificial Sequence: Synthetic oligonucleotide
agcgaggacgggtctcacacccttca

SEQ ID NO: 384950 - DNA, 25 bp, Artificial Sequence
  Description of Artificial Sequence: Synthetic oligonucleotide
gcgaggacgggtctcacacccttca

SEQ ID NO: 384951 - DNA, 26 bp, Artificial Sequence
  Description of Artificial Sequence: Synthetic oligonucleotide
cgaggacgggtctcacacccttcagt

SEQ ID NO: 384952 - DNA, 26 bp, Artificial Sequence
  Description of Artificial Sequence: Synthetic oligonucleotide
gaggacgggtctcacacccttcagtg

SEQ ID NO: 384953 - DNA, 27 bp, Artificial Sequence
  Description of Artificial Sequence: Synthetic oligonucleotide
aggacgggtctcacacccttcagtgga

SEQ ID NO: 384954 - DNA, 27 bp, Artificial Sequence
  Description of Artificial Sequence: Synthetic oligonucleotide
ggacgggtctcacacccttcagtggat

SEQ ID NO: 384955 - DNA, 27 bp, Artificial Sequence
  Description of Artificial Sequence: Synthetic oligonucleotide
gacgggtctcacacccttcagtggatg

SEQ ID NO: 384956 - DNA, 30 bp, Artificial Sequence
  Description of Artificial Sequence: Synthetic oligonucleotide
acgggtctcacacccttcagtggatgtatg

SEQ ID NO: 384957 - DNA, 29 bp, Artificial Sequence
  Description of Artificial Sequence: Synthetic oligonucleotide
cgggtctcacacccttcagtggatgtatg

SEQ ID NO: 384958 - DNA, 29 bp, Artificial Sequence
  Description of Artificial Sequence: Synthetic oligonucleotide
gggtctcacacccttcagtggatgtatgg

SEQ ID NO: 384959 - DNA, 29 bp, Artificial Sequence
  Description of Artificial Sequence: Synthetic oligonucleotide
ggtctcacacccttcagtggatgtatggc

SEQ ID NO: 384960 - DNA, 30 bp, Artificial Sequence
  Description of Artificial Sequence: Synthetic oligonucleotide
gtctcacacccttcagtggatgtatggctg

SEQ ID NO: 384961 - DNA, 30 bp, Artificial Sequence
  Description of Artificial Sequence: Synthetic oligonucleotide
tctcacacccttcagtggatgtatggctgc

SEQ ID NO: 384962 - DNA, 29 bp, Artificial Sequence
  Description of Artificial Sequence: Synthetic oligonucleotide
ctcacacccttcagtggatgtatggctgc

SEQ ID NO: 384963 - DNA, 29 bp, Artificial Sequence
  Description of Artificial Sequence: Synthetic oligonucleotide
tcacacccttcagtggatgtatggctgcg

SEQ ID NO: 384964 - DNA, 28 bp, Artificial Sequence
  Description of Artificial Sequence: Synthetic oligonucleotide
cacacccttcagtggatgtatggctgcg

SEQ ID NO: 384965 - DNA, 29 bp, Artificial Sequence
  Description of Artificial Sequence: Synthetic oligonucleotide
acacccttcagtggatgtatggctgcgac

SEQ ID NO: 384966 - DNA, 28 bp, Artificial Sequence
  Description of Artificial Sequence: Synthetic oligonucleotide
cacccttcagtggatgtatggctgcgac

SEQ ID NO: 384967 - DNA, 28 bp, Artificial Sequence
  Description of Artificial Sequence: Synthetic oligonucleotide
acccttcagtggatgtatggctgcgacc

SEQ ID NO: 384968 - DNA, 27 bp, Artificial Sequence
  Description of Artificial Sequence: Synthetic oligonucleotide
cccttcagtggatgtatggctgcgacc

SEQ ID NO: 384969 - DNA, 28 bp, Artificial Sequence
  Description of Artificial Sequence: Synthetic oligonucleotide
ccttcagtggatgtatggctgcgacctg

SEQ ID NO: 384970 - DNA, 28 bp, Artificial Sequence
  Description of Artificial Sequence: Synthetic oligonucleotide
cttcagtggatgtatggctgcgacctgg

SEQ ID NO: 384971 - DNA, 28 bp, Artificial Sequence
  Description of Artificial Sequence: Synthetic oligonucleotide
ttcagtggatgtatggctgcgacctggg

SEQ ID NO: 384972 - DNA, 27 bp, Artificial Sequence
  Description of Artificial Sequence: Synthetic oligonucleotide
tcagtggatgtatggctgcgacctggg

SEQ ID NO: 384973 - DNA, 22 bp, Artificial Sequence
  Description of Artificial Sequence: Synthetic oligonucleotide
cgcggagagccccgcttcatcc

SEQ ID NO: 384974 - DNA, 23 bp, Artificial Sequence
  Description of Artificial Sequence: Synthetic oligonucleotide
gcggagagccccgcttcatccca

SEQ ID NO: 384975 - DNA, 24 bp, Artificial Sequence
  Description of Artificial Sequence: Synthetic oligonucleotide
cggagagccccgcttcatcccagt

SEQ ID NO: 384976 - DNA, 24 bp, Artificial Sequence
  Description of Artificial Sequence: Synthetic oligonucleotide
ggagagccccgcttcatcccagtg

SEQ ID NO: 384977 - DNA, 24 bp, Artificial Sequence
  Description of Artificial Sequence: Synthetic oligonucleotide
gagagccccgcttcatcccagtgg

SEQ ID NO: 384978 - DNA, 24 bp, Artificial Sequence
  Description of Artificial Sequence: Synthetic oligonucleotide
agagccccgcttcatcccagtggg

SEQ ID NO: 384979 - DNA, 23 bp, Artificial Sequence
  Description of Artificial Sequence: Synthetic oligonucleotide
gagccccgcttcatcccagtggg

SEQ ID NO: 384980 - DNA, 25 bp, Artificial Sequence
  Description of Artificial Sequence: Synthetic oligonucleotide
agccccgcttcatcccagtgggcta

SEQ ID NO: 384981 - DNA, 24 bp, Artificial Sequence
  Description of Artificial Sequence: Synthetic oligonucleotide
gccccgcttcatcccagtgggcta

SEQ ID NO: 384982 - DNA, 24 bp, Artificial Sequence
  Description of Artificial Sequence: Synthetic oligonucleotide
ccccgcttcatcccagtgggctac

SEQ ID NO: 384983 - DNA, 25 bp, Artificial Sequence
  Description of Artificial Sequence: Synthetic oligonucleotide
cccgcttcatcccagtgggctacgt

SEQ ID NO: 384984 - DNA, 25 bp, Artificial Sequence
  Description of Artificial Sequence: Synthetic oligonucleotide
ccgcttcatcccagtgggctacgtg

SEQ ID NO: 384985 - DNA, 26 bp, Artificial Sequence
  Description of Artificial Sequence: Synthetic oligonucleotide
cgcttcatcccagtgggctacgtgga

SEQ ID NO: 384986 - DNA, 26 bp, Artificial Sequence
  Description of Artificial Sequence: Synthetic oligonucleotide
gcttcatcccagtgggctacgtggac

SEQ ID NO: 384987 - DNA, 27 bp, Artificial Sequence
  Description of Artificial Sequence: Synthetic oligonucleotide
cttcatcccagtgggctacgtggacga

SEQ ID NO: 384988 - DNA, 27 bp, Artificial Sequence
  Description of Artificial Sequence: Synthetic oligonucleotide
ttcatcccagtgggctacgtggacgac

SEQ ID NO: 384989 - DNA, 27 bp, Artificial Sequence
  Description of Artificial Sequence: Synthetic oligonucleotide
tcatcccagtgggctacgtggacgaca

SEQ ID NO: 384990 - DNA, 26 bp, Artificial Sequence
  Description of Artificial Sequence: Synthetic oligonucleotide
catcccagtgggctacgtggacgaca

SEQ ID NO: 384991 - DNA, 26 bp, Artificial Sequence
  Description of Artificial Sequence: Synthetic oligonucleotide
atcccagtgggctacgtggacgacac

SEQ ID NO: 384992 - DNA, 25 bp, Artificial Sequence
  Description of Artificial Sequence: Synthetic oligonucleotide
tcccagtgggctacgtggacgacac

SEQ ID NO: 384993 - DNA, 24 bp, Artificial Sequence
  Description of Artificial Sequence: Synthetic oligonucleotide
cccagtgggctacgtggacgacac

SEQ ID NO: 384994 - DNA, 24 bp, Artificial Sequence
  Description of Artificial Sequence: Synthetic oligonucleotide
ccagtgggctacgtggacgacacg

SEQ ID NO: 384995 - DNA, 29 bp, Artificial Sequence
  Description of Artificial Sequence: Synthetic oligonucleotide
acaccctccagtggatgtatggctgctac

SEQ ID NO: 384996 - DNA, 28 bp, Artificial Sequence
  Description of Artificial Sequence: Synthetic oligonucleotide
caccctccagtggatgtatggctgctac

SEQ ID NO: 384997 - DNA, 28 bp, Artificial Sequence
  Description of Artificial Sequence: Synthetic oligonucleotide
accctccagtggatgtatggctgctacc

SEQ ID NO: 384998 - DNA, 27 bp, Artificial Sequence
  Description of Artificial Sequence: Synthetic oligonucleotide
ccctccagtggatgtatggctgctacc

SEQ ID NO: 384999 - DNA, 28 bp, Artificial Sequence
  Description of Artificial Sequence: Synthetic oligonucleotide
cctccagtggatgtatggctgctacctg

SEQ ID NO: 385000 - DNA, 28 bp, Artificial Sequence
  Description of Artificial Sequence: Synthetic oligonucleotide
ctccagtggatgtatggctgctacctgg

SEQ ID NO: 385001 - DNA, 28 bp, Artificial Sequence
  Description of Artificial Sequence: Synthetic oligonucleotide
tccagtggatgtatggctgctacctggg

SEQ ID NO: 385002 - DNA, 27 bp, Artificial Sequence
  Description of Artificial Sequence: Synthetic oligonucleotide
ccagtggatgtatggctgctacctggg

SEQ ID NO: 385003 - DNA, 27 bp, Artificial Sequence
  Description of Artificial Sequence: Synthetic oligonucleotide
cagtggatgtatggctgctacctgggg

SEQ ID NO: 385004 - DNA, 27 bp, Artificial Sequence
  Description of Artificial Sequence: Synthetic oligonucleotide
agtggatgtatggctgctacctggggc

SEQ ID NO: 385005 - DNA, 26 bp, Artificial Sequence
  Description of Artificial Sequence: Synthetic oligonucleotide
gtggatgtatggctgctacctggggc

SEQ ID NO: 385006 - DNA, 26 bp, Artificial Sequence
  Description of Artificial Sequence: Synthetic oligonucleotide
tggatgtatggctgctacctggggcc

SEQ ID NO: 385007 - DNA, 25 bp, Artificial Sequence
  Description of Artificial Sequence: Synthetic oligonucleotide
ggatgtatggctgctacctggggcc

SEQ ID NO: 385008 - DNA, 25 bp, Artificial Sequence
  Description of Artificial Sequence: Synthetic oligonucleotide
gatgtatggctgctacctggggccc

SEQ ID NO: 385009 - DNA, 26 bp, Artificial Sequence
  Description of Artificial Sequence: Synthetic oligonucleotide
atgtatggctgctacctggggcccga

SEQ ID NO: 385010 - DNA, 25 bp, Artificial Sequence
  Description of Artificial Sequence: Synthetic oligonucleotide
tgtatggctgctacctggggcccga

SEQ ID NO: 385011 - DNA, 24 bp, Artificial Sequence
  Description of Artificial Sequence: Synthetic oligonucleotide
gtatggctgctacctggggcccga

SEQ ID NO: 385012 - DNA, 24 bp, Artificial Sequence
  Description of Artificial Sequence: Synthetic oligonucleotide
tatggctgctacctggggcccgac

SEQ ID NO: 385013 - DNA, 23 bp, Artificial Sequence
  Description of Artificial Sequence: Synthetic oligonucleotide
atggctgctacctggggcccgac

SEQ ID NO: 385014 - DNA, 22 bp, Artificial Sequence
  Description of Artificial Sequence: Synthetic oligonucleotide
tggctgctacctggggcccgac

SEQ ID NO: 385015 - DNA, 21 bp, Artificial Sequence
  Description of Artificial Sequence: Synthetic oligonucleotide
ggctgctacctggggcccgac

SEQ ID NO: 385016 - DNA, 21 bp, Artificial Sequence
  Description of Artificial Sequence: Synthetic oligonucleotide
gctgctacctggggcccgacg

SEQ ID NO: 385017 - DNA, 21 bp, Artificial Sequence
  Description of Artificial Sequence: Synthetic oligonucleotide
ctgctacctggggcccgacgg

SEQ ID NO: 385018 - DNA, 21 bp, Artificial Sequence
  Description of Artificial Sequence: Synthetic oligonucleotide
tgctacctggggcccgacggg

SEQ ID NO: 385019 - DNA, 20 bp, Artificial Sequence
  Description of Artificial Sequence: Synthetic oligonucleotide
gctacctggggcccgacggg

SEQ ID NO: 385020 - DNA, 20 bp, Artificial Sequence
  Description of Artificial Sequence: Synthetic oligonucleotide
ctacctggggcccgacgggc

SEQ ID NO: 385021 - DNA, 20 bp, Artificial Sequence
  Description of Artificial Sequence: Synthetic oligonucleotide
tacctggggcccgacgggcg

SEQ ID NO: 385022 - DNA, 23 bp, Artificial Sequence
  Description of Artificial Sequence: Synthetic oligonucleotide
gtgaggcggagcagtggagagcc

SEQ ID NO: 385023 - DNA, 24 bp, Artificial Sequence
  Description of Artificial Sequence: Synthetic oligonucleotide
tgaggcggagcagtggagagccca

SEQ ID NO: 385024 - DNA, 23 bp, Artificial Sequence
  Description of Artificial Sequence: Synthetic oligonucleotide
gaggcggagcagtggagagccca

SEQ ID NO: 385025 - DNA, 23 bp, Artificial Sequence
  Description of Artificial Sequence: Synthetic oligonucleotide
aggcggagcagtggagagcccac

SEQ ID NO: 385026 - DNA, 22 bp, Artificial Sequence
  Description of Artificial Sequence: Synthetic oligonucleotide
ggcggagcagtggagagcccac

SEQ ID NO: 385027 - DNA, 23 bp, Artificial Sequence
  Description of Artificial Sequence: Synthetic oligonucleotide
gcggagcagtggagagcccacct

SEQ ID NO: 385028 - DNA, 23 bp, Artificial Sequence
  Description of Artificial Sequence: Synthetic oligonucleotide
cggagcagtggagagcccacctg

SEQ ID NO: 385029 - DNA, 24 bp, Artificial Sequence
  Description of Artificial Sequence: Synthetic oligonucleotide
ggagcagtggagagcccacctgga

SEQ ID NO: 385030 - DNA, 24 bp, Artificial Sequence
  Description of Artificial Sequence: Synthetic oligonucleotide
gagcagtggagagcccacctggag

SEQ ID NO: 385031 - DNA, 24 bp, Artificial Sequence
  Description of Artificial Sequence: Synthetic oligonucleotide
agcagtggagagcccacctggagg

SEQ ID NO: 385032 - DNA, 23 bp, Artificial Sequence
  Description of Artificial Sequence: Synthetic oligonucleotide
gcagtggagagcccacctggagg

SEQ ID NO: 385033 - DNA, 23 bp, Artificial Sequence
  Description of Artificial Sequence: Synthetic oligonucleotide
cagtggagagcccacctggaggg

SEQ ID NO: 385034 - DNA, 24 bp, Artificial Sequence
  Description of Artificial Sequence: Synthetic oligonucleotide
agtggagagcccacctggagggca

SEQ ID NO: 385035 - DNA, 23 bp, Artificial Sequence
  Description of Artificial Sequence: Synthetic oligonucleotide
gtggagagcccacctggagggca

SEQ ID NO: 385036 - DNA, 23 bp, Artificial Sequence
  Description of Artificial Sequence: Synthetic oligonucleotide
tggagagcccacctggagggcac

SEQ ID NO: 385037 - DNA, 22 bp, Artificial Sequence
  Description of Artificial Sequence: Synthetic oligonucleotide
ggagagcccacctggagggcac

SEQ ID NO: 385038 - DNA, 23 bp, Artificial Sequence
  Description of Artificial Sequence: Synthetic oligonucleotide
gagagcccacctggagggcacgt

SEQ ID NO: 385039 - DNA, 23 bp, Artificial Sequence
  Description of Artificial Sequence: Synthetic oligonucleotide
agagcccacctggagggcacgtg

SEQ ID NO: 385040 - DNA, 22 bp, Artificial Sequence
  Description of Artificial Sequence: Synthetic oligonucleotide
gagcccacctggagggcacgtg

SEQ ID NO: 385041 - DNA, 22 bp, Artificial Sequence
  Description of Artificial Sequence: Synthetic oligonucleotide
agcccacctggagggcacgtgc

SEQ ID NO: 385042 - DNA, 21 bp, Artificial Sequence
  Description of Artificial Sequence: Synthetic oligonucleotide
gcccacctggagggcacgtgc

SEQ ID NO: 385043 - DNA, 22 bp, Artificial Sequence
  Description of Artificial Sequence: Synthetic oligonucleotide
cccacctggagggcacgtgcgt

SEQ ID NO: 385044 - DNA, 22 bp, Artificial Sequence
  Description of Artificial Sequence: Synthetic oligonucleotide
ccacctggagggcacgtgcgtg

SEQ ID NO: 385045 - DNA, 23 bp, Artificial Sequence
  Description of Artificial Sequence: Synthetic oligonucleotide
cacctggagggcacgtgcgtgga

SEQ ID NO: 385046 - DNA, 27 bp, Artificial Sequence
  Description of Artificial Sequence: Synthetic oligonucleotide
tcaggctccaagggccgtgtctgcatt

SEQ ID NO: 385047 - DNA, 26 bp, Artificial Sequence
  Description of Artificial Sequence: Synthetic oligonucleotide
caggctccaagggccgtgtctgcatt

SEQ ID NO: 385048 - DNA, 26 bp, Artificial Sequence
  Description of Artificial Sequence: Synthetic oligonucleotide
aggctccaagggccgtgtctgcattg

SEQ ID NO: 385049 - DNA, 25 bp, Artificial Sequence
  Description of Artificial Sequence: Synthetic oligonucleotide
ggctccaagggccgtgtctgcattg

SEQ ID NO: 385050 - DNA, 25 bp, Artificial Sequence
  Description of Artificial Sequence: Synthetic oligonucleotide
gctccaagggccgtgtctgcattgg

SEQ ID NO: 385051 - DNA, 25 bp, Artificial Sequence
  Description of Artificial Sequence: Synthetic oligonucleotide
ctccaagggccgtgtctgcattggg

SEQ ID NO: 385052 - DNA, 26 bp, Artificial Sequence
  Description of Artificial Sequence: Synthetic oligonucleotide
tccaagggccgtgtctgcattgggga

SEQ ID NO: 385053 - DNA, 25 bp, Artificial Sequence
  Description of Artificial Sequence: Synthetic oligonucleotide
ccaagggccgtgtctgcattgggga

SEQ ID NO: 385054 - DNA, 25 bp, Artificial Sequence
  Description of Artificial Sequence: Synthetic oligonucleotide
caagggccgtgtctgcattggggag

SEQ ID NO: 385055 - DNA, 25 bp, Artificial Sequence
  Description of Artificial Sequence: Synthetic oligonucleotide
aagggccgtgtctgcattggggagg

SEQ ID NO: 385056 - DNA, 24 bp, Artificial Sequence
  Description of Artificial Sequence: Synthetic oligonucleotide
agggccgtgtctgcattggggagg

SEQ ID NO: 385057 - DNA, 23 bp, Artificial Sequence
  Description of Artificial Sequence: Synthetic oligonucleotide
gggccgtgtctgcattggggagg

SEQ ID NO: 385058 - DNA, 23 bp, Artificial Sequence
  Description of Artificial Sequence: Synthetic oligonucleotide
ggccgtgtctgcattggggaggc

SEQ ID NO: 385059 - DNA, 23 bp, Artificial Sequence
  Description of Artificial Sequence: Synthetic oligonucleotide
gccgtgtctgcattggggaggcg

SEQ ID NO: 385060 - DNA, 23 bp, Artificial Sequence
  Description of Artificial Sequence: Synthetic oligonucleotide
ccgtgtctgcattggggaggcgc

SEQ ID NO: 385061 - DNA, 23 bp, Artificial Sequence
  Description of Artificial Sequence: Synthetic oligonucleotide
cgtgtctgcattggggaggcgcc

SEQ ID NO: 385062 - DNA, 23 bp, Artificial Sequence
  Description of Artificial Sequence: Synthetic oligonucleotide
gtgtctgcattggggaggcgccg

SEQ ID NO: 385063 - DNA, 23 bp, Artificial Sequence
  Description of Artificial Sequence: Synthetic oligonucleotide
tgtctgcattggggaggcgccgc

SEQ ID NO: 385064 - DNA, 22 bp, Artificial Sequence
  Description of Artificial Sequence: Synthetic oligonucleotide
gtctgcattggggaggcgccgc

SEQ ID NO: 385065 - DNA, 24 bp, Artificial Sequence
  Description of Artificial Sequence: Synthetic oligonucleotide
tctgcattggggaggcgccgcgtt

SEQ ID NO: 385066 - DNA, 23 bp, Artificial Sequence
  Description of Artificial Sequence: Synthetic oligonucleotide
ctgcattggggaggcgccgcgtt

SEQ ID NO: 385067 - DNA, 23 bp, Artificial Sequence
  Description of Artificial Sequence: Synthetic oligonucleotide
tgcattggggaggcgccgcgttg

SEQ ID NO: 385068 - DNA, 22 bp, Artificial Sequence
  Description of Artificial Sequence: Synthetic oligonucleotide
gcattggggaggcgccgcgttg

SEQ ID NO: 385069 - DNA, 22 bp, Artificial Sequence
  Description of Artificial Sequence: Synthetic oligonucleotide
cattggggaggcgccgcgttgg

SEQ ID NO: 385070 - DNA, 22 bp, Artificial Sequence
  Description of Artificial Sequence: Synthetic oligonucleotide
attggggaggcgccgcgttggg

SEQ ID NO: 385071 - DNA, 21 bp, Artificial Sequence
  Description of Artificial Sequence: Synthetic oligonucleotide
ttggggaggcgccgcgttggg

SEQ ID NO: 385072 - DNA, 31 bp, Artificial Sequence
  Description of Artificial Sequence: Synthetic oligonucleotide
ggattctccactcccctgagtttcacttctc

SEQ ID NO: 385073 - DNA, 31 bp, Artificial Sequence
  Description of Artificial Sequence: Synthetic oligonucleotide
gattctccactcccctgagtttcacttctcc

SEQ ID NO: 385074 - DNA, 31 bp, Artificial Sequence
  Description of Artificial Sequence: Synthetic oligonucleotide
attctccactcccctgagtttcacttctccc

SEQ ID NO: 385075 - DNA, 30 bp, Artificial Sequence
  Description of Artificial Sequence: Synthetic oligonucleotide
ttctccactcccctgagtttcacttctccc

SEQ ID NO: 385076 - DNA, 29 bp, Artificial Sequence
  Description of Artificial Sequence: Synthetic oligonucleotide
tctccactcccctgagtttcacttctccc

SEQ ID NO: 385077 - DNA, 28 bp, Artificial Sequence
  Description of Artificial Sequence: Synthetic oligonucleotide
ctccactcccctgagtttcacttctccc

SEQ ID NO: 385078 - DNA, 30 bp, Artificial Sequence
  Description of Artificial Sequence: Synthetic oligonucleotide
tccactcccctgagtttcacttctcccaac

SEQ ID NO: 385079 - DNA, 29 bp, Artificial Sequence
  Description of Artificial Sequence: Synthetic oligonucleotide
ccactcccctgagtttcacttctcccaac

SEQ ID NO: 385080 - DNA, 29 bp, Artificial Sequence
  Description of Artificial Sequence: Synthetic oligonucleotide
cactcccctgagtttcacttctcccaacc

SEQ ID NO: 385081 - DNA, 30 bp, Artificial Sequence
  Description of Artificial Sequence: Synthetic oligonucleotide
actcccctgagtttcacttctcccaacctg

SEQ ID NO: 385082 - DNA, 29 bp, Artificial Sequence
  Description of Artificial Sequence: Synthetic oligonucleotide
ctcccctgagtttcacttctcccaacctg

SEQ ID NO: 385083 - DNA, 29 bp, Artificial Sequence
  Description of Artificial Sequence: Synthetic oligonucleotide
tcccctgagtttcacttctcccaacctgc

SEQ ID NO: 385084 - DNA, 28 bp, Artificial Sequence
  Description of Artificial Sequence: Synthetic oligonucleotide
cccctgagtttcacttctcccaacctgc

SEQ ID NO: 385085 - DNA, 28 bp, Artificial Sequence
  Description of Artificial Sequence: Synthetic oligonucleotide
ccctgagtttcacttctcccaacctgcg

SEQ ID NO: 385086 - DNA, 29 bp, Artificial Sequence
  Description of Artificial Sequence: Synthetic oligonucleotide
cctgagtttcacttctcccaacctgcgtc

SEQ ID NO: 385087 - DNA, 29 bp, Artificial Sequence
  Description of Artificial Sequence: Synthetic oligonucleotide
ctgagtttcacttctcccaacctgcgtcg

SEQ ID NO: 385088 - DNA, 29 bp, Artificial Sequence
  Description of Artificial Sequence: Synthetic oligonucleotide
tgagtttcacttctcccaacctgcgtcgg

SEQ ID NO: 385089 - DNA, 28 bp, Artificial Sequence
  Description of Artificial Sequence: Synthetic oligonucleotide
gagtttcacttctcccaacctgcgtcgg

SEQ ID NO: 385090 - DNA, 28 bp, Artificial Sequence
  Description of Artificial Sequence: Synthetic oligonucleotide
agtttcacttctcccaacctgcgtcggg

SEQ ID NO: 385091 - DNA, 27 bp, Artificial Sequence
  Description of Artificial Sequence: Synthetic oligonucleotide
gtttcacttctcccaacctgcgtcggg

SEQ ID NO: 385092 - DNA, 28 bp, Artificial Sequence
  Description of Artificial Sequence: Synthetic oligonucleotide
tttcacttctcccaacctgcgtcgggtc

SEQ ID NO: 385093 - DNA, 27 bp, Artificial Sequence
  Description of Artificial Sequence: Synthetic oligonucleotide
ttcacttctcccaacctgcgtcgggtc

SEQ ID NO: 385094 - DNA, 26 bp, Artificial Sequence
  Description of Artificial Sequence: Synthetic oligonucleotide
tcacttctcccaacctgcgtcgggtc

SEQ ID NO: 385095 - DNA, 25 bp, Artificial Sequence
  Description of Artificial Sequence: Synthetic oligonucleotide
cacttctcccaacctgcgtcgggtc

SEQ ID NO: 385096 - DNA, 27 bp, Artificial Sequence
  Description of Artificial Sequence: Synthetic oligonucleotide
acttctcccaacctgcgtcgggtcctt

SEQ ID NO: 385097 - DNA, 26 bp, Artificial Sequence
  Description of Artificial Sequence: Synthetic oligonucleotide
cccagtcacccacccggactcacatt

SEQ ID NO: 385098 - DNA, 27 bp, Artificial Sequence
  Description of Artificial Sequence: Synthetic oligonucleotide
ccagtcacccacccggactcacattct

SEQ ID NO: 385099 - DNA, 27 bp, Artificial Sequence
  Description of Artificial Sequence: Synthetic oligonucleotide
cagtcacccacccggactcacattctc

SEQ ID NO: 385100 - DNA, 27 bp, Artificial Sequence
  Description of Artificial Sequence: Synthetic oligonucleotide
agtcacccacccggactcacattctcc

SEQ ID NO: 385101 - DNA, 26 bp, Artificial Sequence
  Description of Artificial Sequence: Synthetic oligonucleotide
gtcacccacccggactcacattctcc

SEQ ID NO: 385102 - DNA, 26 bp, Artificial Sequence
  Description of Artificial Sequence: Synthetic oligonucleotide
tcacccacccggactcacattctccc

SEQ ID NO: 385103 - DNA, 25 bp, Artificial Sequence
  Description of Artificial Sequence: Synthetic oligonucleotide
cacccacccggactcacattctccc

SEQ ID NO: 385104 - DNA, 26 bp, Artificial Sequence
  Description of Artificial Sequence: Synthetic oligonucleotide
acccacccggactcacattctcccca

SEQ ID NO: 385105 - DNA, 25 bp, Artificial Sequence
  Description of Artificial Sequence: Synthetic oligonucleotide
cccacccggactcacattctcccca

SEQ ID NO: 385106 - DNA, 26 bp, Artificial Sequence
  Description of Artificial Sequence: Synthetic oligonucleotide
ccacccggactcacattctccccaga

SEQ ID NO: 385107 - DNA, 26 bp, Artificial Sequence
  Description of Artificial Sequence: Synthetic oligonucleotide
cacccggactcacattctccccagag

SEQ ID NO: 385108 - DNA, 26 bp, Artificial Sequence
  Description of Artificial Sequence: Synthetic oligonucleotide
acccggactcacattctccccagagg

SEQ ID NO: 385109 - DNA, 25 bp, Artificial Sequence
  Description of Artificial Sequence: Synthetic oligonucleotide
cccggactcacattctccccagagg

SEQ ID NO: 385110 - DNA, 25 bp, Artificial Sequence
  Description of Artificial Sequence: Synthetic oligonucleotide
ccggactcacattctccccagaggc

SEQ ID NO: 385111 - DNA, 25 bp, Artificial Sequence
  Description of Artificial Sequence: Synthetic oligonucleotide
cggactcacattctccccagaggcc

SEQ ID NO: 385112 - DNA, 26 bp, Artificial Sequence
  Description of Artificial Sequence: Synthetic oligonucleotide
ggactcacattctccccagaggccga

SEQ ID NO: 385113 - DNA, 27 bp, Artificial Sequence
  Description of Artificial Sequence: Synthetic oligonucleotide
gactcacattctccccagaggccgaga

SEQ ID NO: 385114 - DNA, 28 bp, Artificial Sequence
  Description of Artificial Sequence: Synthetic oligonucleotide
actcacattctccccagaggccgagatg

SEQ ID NO: 385115 - DNA, 27 bp, Artificial Sequence
  Description of Artificial Sequence: Synthetic oligonucleotide
ctcacattctccccagaggccgagatg

SEQ ID NO: 385116 - DNA, 27 bp, Artificial Sequence
  Description of Artificial Sequence: Synthetic oligonucleotide
tcacattctccccagaggccgagatgc

SEQ ID NO: 385117 - DNA, 26 bp, Artificial Sequence
  Description of Artificial Sequence: Synthetic oligonucleotide
cacattctccccagaggccgagatgc

SEQ ID NO: 385118 - DNA, 26 bp, Artificial Sequence
  Description of Artificial Sequence: Synthetic oligonucleotide
acattctccccagaggccgagatgcg

SEQ ID NO: 385119 - DNA, 25 bp, Artificial Sequence
  Description of Artificial Sequence: Synthetic oligonucleotide
cattctccccagaggccgagatgcg

SEQ ID NO: 385120 - DNA, 25 bp, Artificial Sequence
  Description of Artificial Sequence: Synthetic oligonucleotide
attctccccagaggccgagatgcgg

SEQ ID NO: 385121 - DNA, 24 bp, Artificial Sequence
  Description of Artificial Sequence: Synthetic oligonucleotide
ttctccccagaggccgagatgcgg

SEQ ID NO: 385122 - DNA, 23 bp, Artificial Sequence
  Description of Artificial Sequence: Synthetic oligonucleotide
tctccccagaggccgagatgcgg

SEQ ID NO: 385123 - DNA, 22 bp, Artificial Sequence
  Description of Artificial Sequence: Synthetic oligonucleotide
ctccccagaggccgagatgcgg

SEQ ID NO: 385124 - DNA, 23 bp, Artificial Sequence
  Description of Artificial Sequence: Synthetic oligonucleotide
tccccagaggccgagatgcgggt

SEQ ID NO: 385125 - DNA, 22 bp, Artificial Sequence
  Description of Artificial Sequence: Synthetic oligonucleotide
ccccagaggccgagatgcgggt

SEQ ID NO: 385126 - DNA, 24 bp, Artificial Sequence
  Description of Artificial Sequence: Synthetic oligonucleotide
cccagaggccgagatgcgggtcat

SEQ ID NO: 385127 - DNA, 24 bp, Artificial Sequence
  Description of Artificial Sequence: Synthetic oligonucleotide
ccagaggccgagatgcgggtcatg

SEQ ID NO: 385128 - DNA, 24 bp, Artificial Sequence
  Description of Artificial Sequence: Synthetic oligonucleotide
cagaggccgagatgcgggtcatgg

SEQ ID NO: 385129 - DNA, 24 bp, Artificial Sequence
  Description of Artificial Sequence: Synthetic oligonucleotide
agaggccgagatgcgggtcatggc

SEQ ID NO: 385130 - DNA, 23 bp, Artificial Sequence
  Description of Artificial Sequence: Synthetic oligonucleotide
gaggccgagatgcgggtcatggc

SEQ ID NO: 385131 - DNA, 23 bp, Artificial Sequence
  Description of Artificial Sequence: Synthetic oligonucleotide
aggccgagatgcgggtcatggcg

SEQ ID NO: 385132 - DNA, 22 bp, Artificial Sequence
  Description of Artificial Sequence: Synthetic oligonucleotide
ggccgagatgcgggtcatggcg

SEQ ID NO: 385133 - DNA, 23 bp, Artificial Sequence
  Description of Artificial Sequence: Synthetic oligonucleotide
agatgcgggtcatggcgccccga

SEQ ID NO: 385134 - DNA, 22 bp, Artificial Sequence
  Description of Artificial Sequence: Synthetic oligonucleotide
gatgcgggtcatggcgccccga

SEQ ID NO: 385135 - DNA, 22 bp, Artificial Sequence
  Description of Artificial Sequence: Synthetic oligonucleotide
atgcgggtcatggcgccccgag

SEQ ID NO: 385136 - DNA, 21 bp, Artificial Sequence
  Description of Artificial Sequence: Synthetic oligonucleotide
tgcgggtcatggcgccccgag

SEQ ID NO: 385137 - DNA, 20 bp, Artificial Sequence
  Description of Artificial Sequence: Synthetic oligonucleotide
gcgggtcatggcgccccgag

SEQ ID NO: 385138 - DNA, 20 bp, Artificial Sequence
  Description of Artificial Sequence: Synthetic oligonucleotide
cgggtcatggcgccccgagc

SEQ ID NO: 385139 - DNA, 20 bp, Artificial Sequence
  Description of Artificial Sequence: Synthetic oligonucleotide
gggtcatggcgccccgagcc

SEQ ID NO: 385140 - DNA, 21 bp, Artificial Sequence
  Description of Artificial Sequence: Synthetic oligonucleotide
ggtcatggcgccccgagccct

SEQ ID NO: 385141 - DNA, 21 bp, Artificial Sequence
  Description of Artificial Sequence: Synthetic oligonucleotide
gtcatggcgccccgagccctc

SEQ ID NO: 385142 - DNA, 22 bp, Artificial Sequence
  Description of Artificial Sequence: Synthetic oligonucleotide
tcatggcgccccgagccctcct

SEQ ID NO: 385143 - DNA, 21 bp, Artificial Sequence
  Description of Artificial Sequence: Synthetic oligonucleotide
catggcgccccgagccctcct

SEQ ID NO: 385144 - DNA, 21 bp, Artificial Sequence
  Description of Artificial Sequence: Synthetic oligonucleotide
atggcgccccgagccctcctc

SEQ ID NO: 385145 - DNA, 20 bp, Artificial Sequence
  Description of Artificial Sequence: Synthetic oligonucleotide
tggcgccccgagccctcctc

SEQ ID NO: 385146 - DNA, 20 bp, Artificial Sequence
  Description of Artificial Sequence: Synthetic oligonucleotide
ggcgccccgagccctcctct

SEQ ID NO: 385147 - DNA, 20 bp, Artificial Sequence
  Description of Artificial Sequence: Synthetic oligonucleotide
gcgccccgagccctcctcct

SEQ ID NO: 385148 - DNA, 20 bp, Artificial Sequence
  Description of Artificial Sequence: Synthetic oligonucleotide
cgccccgagccctcctcctg

SEQ ID NO: 385149 - DNA, 21 bp, Artificial Sequence
  Description of Artificial Sequence: Synthetic oligonucleotide
gccccgagccctcctcctgct

SEQ ID NO: 385150 - DNA, 21 bp, Artificial Sequence
  Description of Artificial Sequence: Synthetic oligonucleotide
ccccgagccctcctcctgctg

SEQ ID NO: 385151 - DNA, 22 bp, Artificial Sequence
  Description of Artificial Sequence: Synthetic oligonucleotide
cccgagccctcctcctgctgct

SEQ ID NO: 385152 - DNA, 23 bp, Artificial Sequence
  Description of Artificial Sequence: Synthetic oligonucleotide
ccgagccctcctcctgctgctct

SEQ ID NO: 385153 - DNA, 23 bp, Artificial Sequence
  Description of Artificial Sequence: Synthetic oligonucleotide
cgagccctcctcctgctgctctc

SEQ ID NO: 385154 - DNA, 23 bp, Artificial Sequence
  Description of Artificial Sequence: Synthetic oligonucleotide
gagccctcctcctgctgctctcg

SEQ ID NO: 385155 - DNA, 23 bp, Artificial Sequence
  Description of Artificial Sequence: Synthetic oligonucleotide
agccctcctcctgctgctctcgg

SEQ ID NO: 385156 - DNA, 22 bp, Artificial Sequence
  Description of Artificial Sequence: Synthetic oligonucleotide
gccctcctcctgctgctctcgg

SEQ ID NO: 385157 - DNA, 23 bp, Artificial Sequence
  Description of Artificial Sequence: Synthetic oligonucleotide
ctcctcctgctgctctcgggagg

SEQ ID NO: 385158 - DNA, 23 bp, Artificial Sequence
  Description of Artificial Sequence: Synthetic oligonucleotide
tcctcctgctgctctcgggaggc

SEQ ID NO: 385159 - DNA, 22 bp, Artificial Sequence
  Description of Artificial Sequence: Synthetic oligonucleotide
cctcctgctgctctcgggaggc

SEQ ID NO: 385160 - DNA, 23 bp, Artificial Sequence
  Description of Artificial Sequence: Synthetic oligonucleotide
ctcctgctgctctcgggaggcct

SEQ ID NO: 385161 - DNA, 23 bp, Artificial Sequence
  Description of Artificial Sequence: Synthetic oligonucleotide
tcctgctgctctcgggaggcctg

SEQ ID NO: 385162 - DNA, 22 bp, Artificial Sequence
  Description of Artificial Sequence: Synthetic oligonucleotide
cctgctgctctcgggaggcctg

SEQ ID NO: 385163 - DNA, 22 bp, Artificial Sequence
  Description of Artificial Sequence: Synthetic oligonucleotide
ctgctgctctcgggaggcctgg

SEQ ID NO: 385164 - DNA, 22 bp, Artificial Sequence
  Description of Artificial Sequence: Synthetic oligonucleotide
tgctgctctcgggaggcctggc

SEQ ID NO: 385165 - DNA, 21 bp, Artificial Sequence
  Description of Artificial Sequence: Synthetic oligonucleotide
gctgctctcgggaggcctggc

SEQ ID NO: 385166 - DNA, 21 bp, Artificial Sequence
  Description of Artificial Sequence: Synthetic oligonucleotide
ctgctctcgggaggcctggcc

SEQ ID NO: 385167 - DNA, 22 bp, Artificial Sequence
  Description of Artificial Sequence: Synthetic oligonucleotide
tgctctcgggaggcctggccct

SEQ ID NO: 385168 - DNA, 21 bp, Artificial Sequence
  Description of Artificial Sequence: Synthetic oligonucleotide
gctctcgggaggcctggccct

SEQ ID NO: 385169 - DNA, 22 bp, Artificial Sequence
  Description of Artificial Sequence: Synthetic oligonucleotide
ctctcgggaggcctggccctga

SEQ ID NO: 385170 - DNA, 22 bp, Artificial Sequence
  Description of Artificial Sequence: Synthetic oligonucleotide
tctcgggaggcctggccctgac

SEQ ID NO: 385171 - DNA, 21 bp, Artificial Sequence
  Description of Artificial Sequence: Synthetic oligonucleotide
ctcgggaggcctggccctgac

SEQ ID NO: 385172 - DNA, 21 bp, Artificial Sequence
  Description of Artificial Sequence: Synthetic oligonucleotide
tcgggaggcctggccctgacc

SEQ ID NO: 385173 - DNA, 20 bp, Artificial Sequence
  Description of Artificial Sequence: Synthetic oligonucleotide
cgggaggcctggccctgacc

SEQ ID NO: 385174 - DNA, 21 bp, Artificial Sequence
  Description of Artificial Sequence: Synthetic oligonucleotide
gggaggcctggccctgaccga

SEQ ID NO: 385175 - DNA, 22 bp, Artificial Sequence
  Description of Artificial Sequence: Synthetic oligonucleotide
ggaggcctggccctgaccgaga

SEQ ID NO: 385176 - DNA, 22 bp, Artificial Sequence
  Description of Artificial Sequence: Synthetic oligonucleotide
gaggcctggccctgaccgagac

SEQ ID NO: 385177 - DNA, 23 bp, Artificial Sequence
  Description of Artificial Sequence: Synthetic oligonucleotide
aggcctggccctgaccgagacct

SEQ ID NO: 385178 - DNA, 22 bp, Artificial Sequence
  Description of Artificial Sequence: Synthetic oligonucleotide
ggcctggccctgaccgagacct

SEQ ID NO: 385179 - DNA, 22 bp, Artificial Sequence
  Description of Artificial Sequence: Synthetic oligonucleotide
gcctggccctgaccgagacctg

SEQ ID NO: 385180 - DNA, 28 bp, Artificial Sequence
  Description of Artificial Sequence: Synthetic oligonucleotide
acacagaactacaagcgccaggcacagg

SEQ ID NO: 385181 - DNA, 27 bp, Artificial Sequence
  Description of Artificial Sequence: Synthetic oligonucleotide
cacagaactacaagcgccaggcacagg

SEQ ID NO: 385182 - DNA, 27 bp, Artificial Sequence
  Description of Artificial Sequence: Synthetic oligonucleotide
acagaactacaagcgccaggcacaggc

SEQ ID NO: 385183 - DNA, 27 bp, Artificial Sequence
  Description of Artificial Sequence: Synthetic oligonucleotide
cagaactacaagcgccaggcacaggct

SEQ ID NO: 385184 - DNA, 27 bp, Artificial Sequence
  Description of Artificial Sequence: Synthetic oligonucleotide
agaactacaagcgccaggcacaggctg

SEQ ID NO: 385185 - DNA, 27 bp, Artificial Sequence
  Description of Artificial Sequence: Synthetic oligonucleotide
gaactacaagcgccaggcacaggctga

SEQ ID NO: 385186 - DNA, 27 bp, Artificial Sequence
  Description of Artificial Sequence: Synthetic oligonucleotide
aactacaagcgccaggcacaggctgac

SEQ ID NO: 385187 - DNA, 26 bp, Artificial Sequence
  Description of Artificial Sequence: Synthetic oligonucleotide
actacaagcgccaggcacaggctgac

SEQ ID NO: 385188 - DNA, 25 bp, Artificial Sequence
  Description of Artificial Sequence: Synthetic oligonucleotide
ctacaagcgccaggcacaggctgac

SEQ ID NO: 385189 - DNA, 26 bp, Artificial Sequence
  Description of Artificial Sequence: Synthetic oligonucleotide
gcggctcagatcacccagcgcaagtt

SEQ ID NO: 385190 - DNA, 26 bp, Artificial Sequence
  Description of Artificial Sequence: Synthetic oligonucleotide
cggctcagatcacccagcgcaagttg

SEQ ID NO: 385191 - DNA, 27 bp, Artificial Sequence
  Description of Artificial Sequence: Synthetic oligonucleotide
ggctcagatcacccagcgcaagttgga

SEQ ID NO: 385192 - DNA, 27 bp, Artificial Sequence
  Description of Artificial Sequence: Synthetic oligonucleotide
gctcagatcacccagcgcaagttggag

SEQ ID NO: 385193 - DNA, 27 bp, Artificial Sequence
  Description of Artificial Sequence: Synthetic oligonucleotide
ctcagatcacccagcgcaagttggagg

SEQ ID NO: 385194 - DNA, 27 bp, Artificial Sequence
  Description of Artificial Sequence: Synthetic oligonucleotide
tcagatcacccagcgcaagttggaggc

SEQ ID NO: 385195 - DNA, 26 bp, Artificial Sequence
  Description of Artificial Sequence: Synthetic oligonucleotide
cagatcacccagcgcaagttggaggc

SEQ ID NO: 385196 - DNA, 26 bp, Artificial Sequence
  Description of Artificial Sequence: Synthetic oligonucleotide
agatcacccagcgcaagttggaggcg

SEQ ID NO: 385197 - DNA, 25 bp, Artificial Sequence
  Description of Artificial Sequence: Synthetic oligonucleotide
gatcacccagcgcaagttggaggcg

SEQ ID NO: 385198 - DNA, 25 bp, Artificial Sequence
  Description of Artificial Sequence: Synthetic oligonucleotide
atcacccagcgcaagttggaggcgg

SEQ ID NO: 385199 - DNA, 24 bp, Artificial Sequence
  Description of Artificial Sequence: Synthetic oligonucleotide
tcacccagcgcaagttggaggcgg

SEQ ID NO: 385200 - DNA, 23 bp, Artificial Sequence
  Description of Artificial Sequence: Synthetic oligonucleotide
cacccagcgcaagttggaggcgg

SEQ ID NO: 385201 - DNA, 23 bp, Artificial Sequence
  Description of Artificial Sequence: Synthetic oligonucleotide
acccagcgcaagttggaggcggc

SEQ ID NO: 385202 - DNA, 22 bp, Artificial Sequence
  Description of Artificial Sequence: Synthetic oligonucleotide
cgcaagttggaggcggcccgtg

SEQ ID NO: 385203 - DNA, 22 bp, Artificial Sequence
  Description of Artificial Sequence: Synthetic oligonucleotide
gcaagttggaggcggcccgtgc

SEQ ID NO: 385204 - DNA, 22 bp, Artificial Sequence
  Description of Artificial Sequence: Synthetic oligonucleotide
caagttggaggcggcccgtgcg

SEQ ID NO: 385205 - DNA, 22 bp, Artificial Sequence
  Description of Artificial Sequence: Synthetic oligonucleotide
aagttggaggcggcccgtgcgg

SEQ ID NO: 385206 - DNA, 21 bp, Artificial Sequence
  Description of Artificial Sequence: Synthetic oligonucleotide
agttggaggcggcccgtgcgg

SEQ ID NO: 385207 - DNA, 20 bp, Artificial Sequence
  Description of Artificial Sequence: Synthetic oligonucleotide
gttggaggcggcccgtgcgg

SEQ ID NO: 385208 - DNA, 20 bp, Artificial Sequence
  Description of Artificial Sequence: Synthetic oligonucleotide
ttggaggcggcccgtgcggc

SEQ ID NO: 385209 - DNA, 20 bp, Artificial Sequence
  Description of Artificial Sequence: Synthetic oligonucleotide
tggaggcggcccgtgcggct

SEQ ID NO: 385210 - DNA, 25 bp, Artificial Sequence
  Description of Artificial Sequence: Synthetic oligonucleotide
gaaggagacgctgcagcgcgcagaa

SEQ ID NO: 385211 - DNA, 25 bp, Artificial Sequence
  Description of Artificial Sequence: Synthetic oligonucleotide
aaggagacgctgcagcgcgcagaac

SEQ ID NO: 385212 - DNA, 24 bp, Artificial Sequence
  Description of Artificial Sequence: Synthetic oligonucleotide
aggagacgctgcagcgcgcagaac

SEQ ID NO: 385213 - DNA, 23 bp, Artificial Sequence
  Description of Artificial Sequence: Synthetic oligonucleotide
ggagacgctgcagcgcgcagaac

SEQ ID NO: 385214 - DNA, 23 bp, Artificial Sequence
  Description of Artificial Sequence: Synthetic oligonucleotide
gagacgctgcagcgcgcagaacc

SEQ ID NO: 385215 - DNA, 23 bp, Artificial Sequence
  Description of Artificial Sequence: Synthetic oligonucleotide
agacgctgcagcgcgcagaaccc

SEQ ID NO: 385216 - DNA, 22 bp, Artificial Sequence
  Description of Artificial Sequence: Synthetic oligonucleotide
gacgctgcagcgcgcagaaccc

SEQ ID NO: 385217 - DNA, 22 bp, Artificial Sequence
  Description of Artificial Sequence: Synthetic oligonucleotide
acgctgcagcgcgcagaacccc

SEQ ID NO: 385218 - DNA, 21 bp, Artificial Sequence
  Description of Artificial Sequence: Synthetic oligonucleotide
cgctgcagcgcgcagaacccc

SEQ ID NO: 385219 - DNA, 24 bp, Artificial Sequence
  Description of Artificial Sequence: Synthetic oligonucleotide
gctgcagcgcgcagaacccccaaa

SEQ ID NO: 385220 - DNA, 25 bp, Artificial Sequence
  Description of Artificial Sequence: Synthetic oligonucleotide
ctgcagcgcgcagaacccccaaaga

SEQ ID NO: 385221 - DNA, 26 bp, Artificial Sequence
  Description of Artificial Sequence: Synthetic oligonucleotide
tgcagcgcgcagaacccccaaagaca

SEQ ID NO: 385222 - DNA, 25 bp, Artificial Sequence
  Description of Artificial Sequence: Synthetic oligonucleotide
gcagcgcgcagaacccccaaagaca

SEQ ID NO: 385223 - DNA, 26 bp, Artificial Sequence
  Description of Artificial Sequence: Synthetic oligonucleotide
cagcgcgcagaacccccaaagacaca

SEQ ID NO: 385224 - DNA, 26 bp, Artificial Sequence
  Description of Artificial Sequence: Synthetic oligonucleotide
agcgcgcagaacccccaaagacacac

SEQ ID NO: 385225 - DNA, 25 bp, Artificial Sequence
  Description of Artificial Sequence: Synthetic oligonucleotide
gcgcgcagaacccccaaagacacac

SEQ ID NO: 385226 - DNA, 26 bp, Artificial Sequence
  Description of Artificial Sequence: Synthetic oligonucleotide
cgcgcagaacccccaaagacacacgt

SEQ ID NO: 385227 - DNA, 27 bp, Artificial Sequence
  Description of Artificial Sequence: Synthetic oligonucleotide
gcgcagaacccccaaagacacacgtga

SEQ ID NO: 385228 - DNA, 27 bp, Artificial Sequence
  Description of Artificial Sequence: Synthetic oligonucleotide
cgcagaacccccaaagacacacgtgac

SEQ ID NO: 385229 - DNA, 27 bp, Artificial Sequence
  Description of Artificial Sequence: Synthetic oligonucleotide
gcagaacccccaaagacacacgtgacc

SEQ ID NO: 385230 - DNA, 27 bp, Artificial Sequence
  Description of Artificial Sequence: Synthetic oligonucleotide
cagaacccccaaagacacacgtgaccc

SEQ ID NO: 385231 - DNA, 28 bp, Artificial Sequence
  Description of Artificial Sequence: Synthetic oligonucleotide
agaacccccaaagacacacgtgacccac

SEQ ID NO: 385232 - DNA, 27 bp, Artificial Sequence
  Description of Artificial Sequence: Synthetic oligonucleotide
gaacccccaaagacacacgtgacccac

SEQ ID NO: 385233 - DNA, 27 bp, Artificial Sequence
  Description of Artificial Sequence: Synthetic oligonucleotide
aacccccaaagacacacgtgacccacc

SEQ ID NO: 385234 - DNA, 27 bp, Artificial Sequence
  Description of Artificial Sequence: Synthetic oligonucleotide
acccccaaagacacacgtgacccacca

SEQ ID NO: 385235 - DNA, 27 bp, Artificial Sequence
  Description of Artificial Sequence: Synthetic oligonucleotide
aaagacacacgtgacccaccaccccct

SEQ ID NO: 385236 - DNA, 26 bp, Artificial Sequence
  Description of Artificial Sequence: Synthetic oligonucleotide
aagacacacgtgacccaccaccccct

SEQ ID NO: 385237 - DNA, 25 bp, Artificial Sequence
  Description of Artificial Sequence: Synthetic oligonucleotide
agacacacgtgacccaccaccccct

SEQ ID NO: 385238 - DNA, 24 bp, Artificial Sequence
  Description of Artificial Sequence: Synthetic oligonucleotide
gacacacgtgacccaccaccccct

SEQ ID NO: 385239 - DNA, 25 bp, Artificial Sequence
  Description of Artificial Sequence: Synthetic oligonucleotide
acacacgtgacccaccaccccctct

SEQ ID NO: 385240 - DNA, 24 bp, Artificial Sequence
  Description of Artificial Sequence: Synthetic oligonucleotide
cacacgtgacccaccaccccctct

SEQ ID NO: 385241 - DNA, 25 bp, Artificial Sequence
  Description of Artificial Sequence: Synthetic oligonucleotide
acacgtgacccaccaccccctctct

SEQ ID NO: 385242 - DNA, 24 bp, Artificial Sequence
  Description of Artificial Sequence: Synthetic oligonucleotide
cacgtgacccaccaccccctctct

SEQ ID NO: 385243 - DNA, 25 bp, Artificial Sequence
  Description of Artificial Sequence: Synthetic oligonucleotide
acgtgacccaccaccccctctctga

SEQ ID NO: 385244 - DNA, 24 bp, Artificial Sequence
  Description of Artificial Sequence: Synthetic oligonucleotide
cgtgacccaccaccccctctctga

SEQ ID NO: 385245 - DNA, 24 bp, Artificial Sequence
  Description of Artificial Sequence: Synthetic oligonucleotide
gtgacccaccaccccctctctgac

SEQ ID NO: 385246 - DNA, 26 bp, Artificial Sequence
  Description of Artificial Sequence: Synthetic oligonucleotide
tgacccaccaccccctctctgaccat

SEQ ID NO: 385247 - DNA, 25 bp, Artificial Sequence
  Description of Artificial Sequence: Synthetic oligonucleotide
gacccaccaccccctctctgaccat

SEQ ID NO: 385248 - DNA, 26 bp, Artificial Sequence
  Description of Artificial Sequence: Synthetic oligonucleotide
acccaccaccccctctctgaccatga

SEQ ID NO: 385249 - DNA, 25 bp, Artificial Sequence
  Description of Artificial Sequence: Synthetic oligonucleotide
cccaccaccccctctctgaccatga

SEQ ID NO: 385250 - DNA, 25 bp, Artificial Sequence
  Description of Artificial Sequence: Synthetic oligonucleotide
ccaccaccccctctctgaccatgag

SEQ ID NO: 385251 - DNA, 25 bp, Artificial Sequence
  Description of Artificial Sequence: Synthetic oligonucleotide
caccaccccctctctgaccatgagg

SEQ ID NO: 385252 - DNA, 25 bp, Artificial Sequence
  Description of Artificial Sequence: Synthetic oligonucleotide
accaccccctctctgaccatgaggc

SEQ ID NO: 385253 - DNA, 24 bp, Artificial Sequence
  Description of Artificial Sequence: Synthetic oligonucleotide
ccaccccctctctgaccatgaggc

SEQ ID NO: 385254 - DNA, 25 bp, Artificial Sequence
  Description of Artificial Sequence: Synthetic oligonucleotide
caccccctctctgaccatgaggcca

SEQ ID NO: 385255 - DNA, 25 bp, Artificial Sequence
  Description of Artificial Sequence: Synthetic oligonucleotide
accccctctctgaccatgaggccac

SEQ ID NO: 385256 - DNA, 24 bp, Artificial Sequence
  Description of Artificial Sequence: Synthetic oligonucleotide
ccccctctctgaccatgaggccac

SEQ ID NO: 385257 - DNA, 24 bp, Artificial Sequence
  Description of Artificial Sequence: Synthetic oligonucleotide
cccctctctgaccatgaggccacc

SEQ ID NO: 385258 - DNA, 25 bp, Artificial Sequence
  Description of Artificial Sequence: Synthetic oligonucleotide
ccctctctgaccatgaggccaccct

SEQ ID NO: 385259 - DNA, 26 bp, Artificial Sequence
  Description of Artificial Sequence: Synthetic oligonucleotide
cctctctgaccatgaggccaccctga

SEQ ID NO: 385260 - DNA, 26 bp, Artificial Sequence
  Description of Artificial Sequence: Synthetic oligonucleotide
ctctctgaccatgaggccaccctgag

SEQ ID NO: 385261 - DNA, 23 bp, Artificial Sequence
  Description of Artificial Sequence: Synthetic oligonucleotide
gggaggaccagacccaggacacc

SEQ ID NO: 385262 - DNA, 24 bp, Artificial Sequence
  Description of Artificial Sequence: Synthetic oligonucleotide
ggaggaccagacccaggacaccga

SEQ ID NO: 385263 - DNA, 24 bp, Artificial Sequence
  Description of Artificial Sequence: Synthetic oligonucleotide
gaggaccagacccaggacaccgag

SEQ ID NO: 385264 - DNA, 26 bp, Artificial Sequence
  Description of Artificial Sequence: Synthetic oligonucleotide
aggaccagacccaggacaccgagctt

SEQ ID NO: 385265 - DNA, 25 bp, Artificial Sequence
  Description of Artificial Sequence: Synthetic oligonucleotide
ggaccagacccaggacaccgagctt

SEQ ID NO: 385266 - DNA, 26 bp, Artificial Sequence
  Description of Artificial Sequence: Synthetic oligonucleotide
gaccagacccaggacaccgagcttgt

SEQ ID NO: 385267 - DNA, 26 bp, Artificial Sequence
  Description of Artificial Sequence: Synthetic oligonucleotide
accagacccaggacaccgagcttgtg

SEQ ID NO: 385268 - DNA, 25 bp, Artificial Sequence
  Description of Artificial Sequence: Synthetic oligonucleotide
ccagacccaggacaccgagcttgtg

SEQ ID NO: 385269 - DNA, 26 bp, Artificial Sequence
  Description of Artificial Sequence: Synthetic oligonucleotide
cagacccaggacaccgagcttgtgga

SEQ ID NO: 385270 - DNA, 27 bp, Artificial Sequence
  Description of Artificial Sequence: Synthetic oligonucleotide
agacccaggacaccgagcttgtggaga

SEQ ID NO: 385271 - DNA, 26 bp, Artificial Sequence
  Description of Artificial Sequence: Synthetic oligonucleotide
gacccaggacaccgagcttgtggaga

SEQ ID NO: 385272 - DNA, 26 bp, Artificial Sequence
  Description of Artificial Sequence: Synthetic oligonucleotide
acccaggacaccgagcttgtggagac

SEQ ID NO: 385273 - DNA, 25 bp, Artificial Sequence
  Description of Artificial Sequence: Synthetic oligonucleotide
cccaggacaccgagcttgtggagac

SEQ ID NO: 385274 - DNA, 26 bp, Artificial Sequence
  Description of Artificial Sequence: Synthetic oligonucleotide
ccaggacaccgagcttgtggagacca

SEQ ID NO: 385275 - DNA, 28 bp, Artificial Sequence
  Description of Artificial Sequence: Synthetic oligonucleotide
agctgtggtggtgccttctggacaagag

SEQ ID NO: 385276 - DNA, 27 bp, Artificial Sequence
  Description of Artificial Sequence: Synthetic oligonucleotide
gctgtggtggtgccttctggacaagag

SEQ ID NO: 385277 - DNA, 27 bp, Artificial Sequence
  Description of Artificial Sequence: Synthetic oligonucleotide
ctgtggtggtgccttctggacaagagc

SEQ ID NO: 385278 - DNA, 28 bp, Artificial Sequence
  Description of Artificial Sequence: Synthetic oligonucleotide
tgtggtggtgccttctggacaagagcag

SEQ ID NO: 385279 - DNA, 27 bp, Artificial Sequence
  Description of Artificial Sequence: Synthetic oligonucleotide
gtggtggtgccttctggacaagagcag

SEQ ID NO: 385280 - DNA, 28 bp, Artificial Sequence
  Description of Artificial Sequence: Synthetic oligonucleotide
tggtggtgccttctggacaagagcagag

SEQ ID NO: 385281 - DNA, 27 bp, Artificial Sequence
  Description of Artificial Sequence: Synthetic oligonucleotide
ggtggtgccttctggacaagagcagag

SEQ ID NO: 385282 - DNA, 30 bp, Artificial Sequence; identical to SEQ ID NO: 46719
  Description of Artificial Sequence: Synthetic oligonucleotide

SEQ ID NO: 385283 - DNA, 31 bp, Artificial Sequence; identical to SEQ ID NO: 46720
  Description of Artificial Sequence: Synthetic oligonucleotide

SEQ ID NO: 385284 - DNA, 30 bp, Artificial Sequence; identical to SEQ ID NO: 46721
  Description of Artificial Sequence: Synthetic oligonucleotide

SEQ ID NO: 385285 - DNA, 30 bp, Artificial Sequence; identical to SEQ ID NO: 46722
  Description of Artificial Sequence: Synthetic oligonucleotide

SEQ ID NO: 385286 - DNA, 31 bp, Artificial Sequence; identical to SEQ ID NO: 46723
  Description of Artificial Sequence: Synthetic oligonucleotide

SEQ ID NO: 385287 - DNA, 30 bp, Artificial Sequence; identical to SEQ ID NO: 46724
  Description of Artificial Sequence: Synthetic oligonucleotide

SEQ ID NO: 385288 - DNA, 30 bp, Artificial Sequence; identical to SEQ ID NO: 46725
  Description of Artificial Sequence: Synthetic oligonucleotide

SEQ ID NO: 385289 - DNA, 30 bp, Artificial Sequence; identical to SEQ ID NO: 46726
  Description of Artificial Sequence: Synthetic oligonucleotide

SEQ ID NO: 385290 - DNA, 34 bp, Artificial Sequence; identical to SEQ ID NO: 46727
  Description of Artificial Sequence: Synthetic oligonucleotide

SEQ ID NO: 385291 - DNA, 33 bp, Artificial Sequence; identical to SEQ ID NO: 46728
  Description of Artificial Sequence: Synthetic oligonucleotide

SEQ ID NO: 385292 - DNA, 32 bp, Artificial Sequence; identical to SEQ ID NO: 46729
  Description of Artificial Sequence: Synthetic oligonucleotide

SEQ ID NO: 385293 - DNA, 32 bp, Artificial Sequence; identical to SEQ ID NO: 46730
  Description of Artificial Sequence: Synthetic oligonucleotide

SEQ ID NO: 385294 - DNA, 31 bp, Artificial Sequence; identical to SEQ ID NO: 46731
  Description of Artificial Sequence: Synthetic oligonucleotide

SEQ ID NO: 385295 - DNA, 32 bp, Artificial Sequence; identical to SEQ ID NO: 46732
  Description of Artificial Sequence: Synthetic oligonucleotide

SEQ ID NO: 385296 - DNA, 32 bp, Artificial Sequence; identical to SEQ ID NO: 46733
  Description of Artificial Sequence: Synthetic oligonucleotide

SEQ ID NO: 385297 - DNA, 31 bp, Artificial Sequence; identical to SEQ ID NO: 46734
  Description of Artificial Sequence: Synthetic oligonucleotide

SEQ ID NO: 385298 - DNA, 32 bp, Artificial Sequence; identical to SEQ ID NO: 46735
  Description of Artificial Sequence: Synthetic oligonucleotide

SEQ ID NO: 385299 - DNA, 31 bp, Artificial Sequence; identical to SEQ ID NO: 46736
  Description of Artificial Sequence: Synthetic oligonucleotide

SEQ ID NO: 385300 - DNA, 30 bp, Artificial Sequence; identical to SEQ ID NO: 46737
  Description of Artificial Sequence: Synthetic oligonucleotide

SEQ ID NO: 385301 - DNA, 30 bp, Artificial Sequence; identical to SEQ ID NO: 46738
  Description of Artificial Sequence: Synthetic oligonucleotide

SEQ ID NO: 385302 - DNA, 29 bp, Artificial Sequence
  Description of Artificial Sequence: Synthetic oligonucleotide
gcagagatacacgtgccatatgcagcacg

SEQ ID NO: 385303 - DNA, 30 bp, Artificial Sequence; identical to SEQ ID NO: 46740
  Description of Artificial Sequence: Synthetic oligonucleotide

SEQ ID NO: 385304 - DNA, 30 bp, Artificial Sequence; identical to SEQ ID NO: 46741
  Description of Artificial Sequence: Synthetic oligonucleotide

SEQ ID NO: 385305 - DNA, 29 bp, Artificial Sequence
  Description of Artificial Sequence: Synthetic oligonucleotide
gagatacacgtgccatatgcagcacgagg

SEQ ID NO: 385306 - DNA, 29 bp, Artificial Sequence
  Description of Artificial Sequence: Synthetic oligonucleotide
agatacacgtgccatatgcagcacgaggg

SEQ ID NO: 385307 - DNA, 28 bp, Artificial Sequence
  Description of Artificial Sequence: Synthetic oligonucleotide
gatacacgtgccatatgcagcacgaggg

SEQ ID NO: 385308 - DNA, 28 bp, Artificial Sequence
  Description of Artificial Sequence: Synthetic oligonucleotide
atacacgtgccatatgcagcacgagggg

SEQ ID NO: 385309 - DNA, 27 bp, Artificial Sequence
  Description of Artificial Sequence: Synthetic oligonucleotide
tacacgtgccatatgcagcacgagggg

SEQ ID NO: 385310 - DNA, 26 bp, Artificial Sequence
  Description of Artificial Sequence: Synthetic oligonucleotide
acacgtgccatatgcagcacgagggg

SEQ ID NO: 385311 - DNA, 25 bp, Artificial Sequence
  Description of Artificial Sequence: Synthetic oligonucleotide
cacgtgccatatgcagcacgagggg

SEQ ID NO: 385312 - DNA, 26 bp, Artificial Sequence
  Description of Artificial Sequence: Synthetic oligonucleotide
acgtgccatatgcagcacgaggggct

SEQ ID NO: 385313 - DNA, 25 bp, Artificial Sequence
  Description of Artificial Sequence: Synthetic oligonucleotide
cgtgccatatgcagcacgaggggct

SEQ ID NO: 385314 - DNA, 25 bp, Artificial Sequence
  Description of Artificial Sequence: Synthetic oligonucleotide
gtgccatatgcagcacgaggggctg

SEQ ID NO: 385315 - DNA, 27 bp, Artificial Sequence
  Description of Artificial Sequence: Synthetic oligonucleotide
tgccatatgcagcacgaggggctgcaa

SEQ ID NO: 385316 - DNA, 26 bp, Artificial Sequence
  Description of Artificial Sequence: Synthetic oligonucleotide
gccatatgcagcacgaggggctgcaa

SEQ ID NO: 385317 - DNA, 27 bp, Artificial Sequence
  Description of Artificial Sequence: Synthetic oligonucleotide
ccatatgcagcacgaggggctgcaaga

SEQ ID NO: 385318 - DNA, 27 bp, Artificial Sequence
  Description of Artificial Sequence: Synthetic oligonucleotide
catatgcagcacgaggggctgcaagag

SEQ ID NO: 385319 - DNA, 27 bp, Artificial Sequence
  Description of Artificial Sequence: Synthetic oligonucleotide
atatgcagcacgaggggctgcaagagc

SEQ ID NO: 385320 - DNA, 26 bp, Artificial Sequence
  Description of Artificial Sequence: Synthetic oligonucleotide
tatgcagcacgaggggctgcaagagc

SEQ ID NO: 385321 - DNA, 25 bp, Artificial Sequence
  Description of Artificial Sequence: Synthetic oligonucleotide
atgcagcacgaggggctgcaagagc

SEQ ID NO: 385322 - DNA, 24 bp, Artificial Sequence
  Description of Artificial Sequence: Synthetic oligonucleotide
tgcagcacgaggggctgcaagagc

SEQ ID NO: 385323 - DNA, 23 bp, Artificial Sequence
  Description of Artificial Sequence: Synthetic oligonucleotide
gcagcacgaggggctgcaagagc

SEQ ID NO: 385324 - DNA, 23 bp, Artificial Sequence
  Description of Artificial Sequence: Synthetic oligonucleotide
cagcacgaggggctgcaagagcc

SEQ ID NO: 385325 - DNA, 23 bp, Artificial Sequence
  Description of Artificial Sequence: Synthetic oligonucleotide
agcacgaggggctgcaagagccc

SEQ ID NO: 385326 - DNA, 22 bp, Artificial Sequence
  Description of Artificial Sequence: Synthetic oligonucleotide
gcacgaggggctgcaagagccc

SEQ ID NO: 385327 - DNA, 23 bp, Artificial Sequence
  Description of Artificial Sequence: Synthetic oligonucleotide
cacgaggggctgcaagagcccct

SEQ ID NO: 385328 - DNA, 24 bp, Artificial Sequence
  Description of Artificial Sequence: Synthetic oligonucleotide
acgaggggctgcaagagcccctca

SEQ ID NO: 385329 - DNA, 23 bp, Artificial Sequence
  Description of Artificial Sequence: Synthetic oligonucleotide
cgaggggctgcaagagcccctca

SEQ ID NO: 385330 - DNA, 23 bp, Artificial Sequence
  Description of Artificial Sequence: Synthetic oligonucleotide
gaggggctgcaagagcccctcac

SEQ ID NO: 385331 - DNA, 23 bp, Artificial Sequence
  Description of Artificial Sequence: Synthetic oligonucleotide
aggggctgcaagagcccctcacc

SEQ ID NO: 385332 - DNA, 22 bp, Artificial Sequence
  Description of Artificial Sequence: Synthetic oligonucleotide
ggggctgcaagagcccctcacc

SEQ ID NO: 385333 - DNA, 23 bp, Artificial Sequence
  Description of Artificial Sequence: Synthetic oligonucleotide
gggctgcaagagcccctcaccct

SEQ ID NO: 385334 - DNA, 24 bp, Artificial Sequence
  Description of Artificial Sequence: Synthetic oligonucleotide
ggctgcaagagcccctcaccctga

SEQ ID NO: 385335 - DNA, 24 bp, Artificial Sequence
  Description of Artificial Sequence: Synthetic oligonucleotide
gctgcaagagcccctcaccctgag

SEQ ID NO: 385336 - DNA, 25 bp, Artificial Sequence
  Description of Artificial Sequence: Synthetic oligonucleotide
ctgcaagagcccctcaccctgagct

SEQ ID NO: 385337 - DNA, 25 bp, Artificial Sequence
  Description of Artificial Sequence: Synthetic oligonucleotide
tgcaagagcccctcaccctgagctg

SEQ ID NO: 385338 - DNA, 24 bp, Artificial Sequence
  Description of Artificial Sequence: Synthetic oligonucleotide
gcaagagcccctcaccctgagctg

SEQ ID NO: 385339 - DNA, 24 bp, Artificial Sequence
  Description of Artificial Sequence: Synthetic oligonucleotide
caagagcccctcaccctgagctgg

SEQ ID NO: 385340 - DNA, 25 bp, Artificial Sequence
  Description of Artificial Sequence: Synthetic oligonucleotide
aagagcccctcaccctgagctggga

SEQ ID NO: 385341 - DNA, 24 bp, Artificial Sequence
  Description of Artificial Sequence: Synthetic oligonucleotide
agagcccctcaccctgagctggga

SEQ ID NO: 385342 - DNA, 23 bp, Artificial Sequence
  Description of Artificial Sequence: Synthetic oligonucleotide
gagcccctcaccctgagctggga

SEQ ID NO: 385343 - DNA, 23 bp, Artificial Sequence
  Description of Artificial Sequence: Synthetic oligonucleotide
agcccctcaccctgagctgggag

SEQ ID NO: 385344 - DNA, 22 bp, Artificial Sequence
  Description of Artificial Sequence: Synthetic oligonucleotide
gcccctcaccctgagctgggag

SEQ ID NO: 385345 - DNA, 22 bp, Artificial Sequence
  Description of Artificial Sequence: Synthetic oligonucleotide
cccctcaccctgagctgggagc

SEQ ID NO: 385346 - DNA, 24 bp, Artificial Sequence
  Description of Artificial Sequence: Synthetic oligonucleotide
ccctcaccctgagctgggagccat

SEQ ID NO: 385347 - DNA, 26 bp, Artificial Sequence
  Description of Artificial Sequence: Synthetic oligonucleotide
cctcaccctgagctgggagccatctt

SEQ ID NO: 385348 - DNA, 26 bp, Artificial Sequence
  Description of Artificial Sequence: Synthetic oligonucleotide
ctcaccctgagctgggagccatcttc

SEQ ID NO: 385349 - DNA, 26 bp, Artificial Sequence
  Description of Artificial Sequence: Synthetic oligonucleotide
tcaccctgagctgggagccatcttcc

SEQ ID NO: 385350 - DNA, 25 bp, Artificial Sequence
  Description of Artificial Sequence: Synthetic oligonucleotide
caccctgagctgggagccatcttcc

SEQ ID NO: 385351 - DNA, 26 bp, Artificial Sequence
  Description of Artificial Sequence: Synthetic oligonucleotide
accctgagctgggagccatcttccca

SEQ ID NO: 385352 - DNA, 25 bp, Artificial Sequence
  Description of Artificial Sequence: Synthetic oligonucleotide
ccctgagctgggagccatcttccca

SEQ ID NO: 385353 - DNA, 25 bp, Artificial Sequence
  Description of Artificial Sequence: Synthetic oligonucleotide
cctgagctgggagccatcttcccag

SEQ ID NO: 385354 - DNA, 25 bp, Artificial Sequence
  Description of Artificial Sequence: Synthetic oligonucleotide
ctgagctgggagccatcttcccagc

SEQ ID NO: 385355 - DNA, 25 bp, Artificial Sequence
  Description of Artificial Sequence: Synthetic oligonucleotide
tgagctgggagccatcttcccagcc

SEQ ID NO: 385356 - DNA, 24 bp, Artificial Sequence
  Description of Artificial Sequence: Synthetic oligonucleotide
gagctgggagccatcttcccagcc

SEQ ID NO: 385357 - DNA, 25 bp, Artificial Sequence
  Description of Artificial Sequence: Synthetic oligonucleotide
agctgggagccatcttcccagccca

SEQ ID NO: 385358 - DNA, 24 bp, Artificial Sequence
  Description of Artificial Sequence: Synthetic oligonucleotide
gctgggagccatcttcccagccca

SEQ ID NO: 385359 - DNA, 24 bp, Artificial Sequence
  Description of Artificial Sequence: Synthetic oligonucleotide
ctgggagccatcttcccagcccac

SEQ ID NO: 385360 - DNA, 27 bp, Artificial Sequence
  Description of Artificial Sequence: Synthetic oligonucleotide
catcttcccagcccaccatccccatca

SEQ ID NO: 385361 - DNA, 28 bp, Artificial Sequence
  Description of Artificial Sequence: Synthetic oligonucleotide
atcttcccagcccaccatccccatcatg

SEQ ID NO: 385362 - DNA, 27 bp, Artificial Sequence
  Description of Artificial Sequence: Synthetic oligonucleotide
tcttcccagcccaccatccccatcatg

SEQ ID NO: 385363 - DNA, 26 bp, Artificial Sequence
  Description of Artificial Sequence: Synthetic oligonucleotide
cttcccagcccaccatccccatcatg

SEQ ID NO: 385364 - DNA, 26 bp, Artificial Sequence
  Description of Artificial Sequence: Synthetic oligonucleotide
ttcccagcccaccatccccatcatgg

SEQ ID NO: 385365 - DNA, 25 bp, Artificial Sequence
  Description of Artificial Sequence: Synthetic oligonucleotide
tcccagcccaccatccccatcatgg

SEQ ID NO: 385366 - DNA, 24 bp, Artificial Sequence
  Description of Artificial Sequence: Synthetic oligonucleotide
cccagcccaccatccccatcatgg

SEQ ID NO: 385367 - DNA, 24 bp, Artificial Sequence
  Description of Artificial Sequence: Synthetic oligonucleotide
ccagcccaccatccccatcatggg

SEQ ID NO: 385368 - DNA, 26 bp, Artificial Sequence
  Description of Artificial Sequence: Synthetic oligonucleotide
cagcccaccatccccatcatgggcat

SEQ ID NO: 385369 - DNA, 26 bp, Artificial Sequence
  Description of Artificial Sequence: Synthetic oligonucleotide
agcccaccatccccatcatgggcatc

SEQ ID NO: 385370 - DNA, 25 bp, Artificial Sequence
  Description of Artificial Sequence: Synthetic oligonucleotide
gcccaccatccccatcatgggcatc

SEQ ID NO: 385371 - DNA, 27 bp, Artificial Sequence
  Description of Artificial Sequence: Synthetic oligonucleotide
cccaccatccccatcatgggcatcgtt

SEQ ID NO: 385372 - DNA, 27 bp, Artificial Sequence
  Description of Artificial Sequence: Synthetic oligonucleotide
ccaccatccccatcatgggcatcgttg

SEQ ID NO: 385373 - DNA, 27 bp, Artificial Sequence
  Description of Artificial Sequence: Synthetic oligonucleotide
caccatccccatcatgggcatcgttgc

SEQ ID NO: 385374 - DNA, 28 bp, Artificial Sequence
  Description of Artificial Sequence: Synthetic oligonucleotide
accatccccatcatgggcatcgttgctg

SEQ ID NO: 385375 - DNA, 27 bp, Artificial Sequence
  Description of Artificial Sequence: Synthetic oligonucleotide
ccatccccatcatgggcatcgttgctg

SEQ ID NO: 385376 - DNA, 27 bp, Artificial Sequence
  Description of Artificial Sequence: Synthetic oligonucleotide
catccccatcatgggcatcgttgctgg

SEQ ID NO: 385377 - DNA, 27 bp, Artificial Sequence
  Description of Artificial Sequence: Synthetic oligonucleotide
atccccatcatgggcatcgttgctggc

SEQ ID NO: 385378 - DNA, 26 bp, Artificial Sequence
  Description of Artificial Sequence: Synthetic oligonucleotide
tccccatcatgggcatcgttgctggc

SEQ ID NO: 385379 - DNA, 25 bp, Artificial Sequence
  Description of Artificial Sequence: Synthetic oligonucleotide
ccccatcatgggcatcgttgctggc

SEQ ID NO: 385380 - DNA, 26 bp, Artificial Sequence
  Description of Artificial Sequence: Synthetic oligonucleotide
cccatcatgggcatcgttgctggcct

SEQ ID NO: 385381 - DNA, 26 bp, Artificial Sequence
  Description of Artificial Sequence: Synthetic oligonucleotide
ccatcatgggcatcgttgctggcctg

SEQ ID NO: 385382 - DNA, 26 bp, Artificial Sequence
  Description of Artificial Sequence: Synthetic oligonucleotide
catcatgggcatcgttgctggcctgg

SEQ ID NO: 385383 - DNA, 27 bp, Artificial Sequence
  Description of Artificial Sequence: Synthetic oligonucleotide
atcatgggcatcgttgctggcctggct

SEQ ID NO: 385384 - DNA, 26 bp, Artificial Sequence
  Description of Artificial Sequence: Synthetic oligonucleotide
tcatgggcatcgttgctggcctggct

SEQ ID NO: 385385 - DNA, 25 bp, Artificial Sequence
  Description of Artificial Sequence: Synthetic oligonucleotide
catgggcatcgttgctggcctggct

SEQ ID NO: 385386 - DNA, 26 bp, Artificial Sequence
  Description of Artificial Sequence: Synthetic oligonucleotide
atgggcatcgttgctggcctggctgt

SEQ ID NO: 385387 - DNA, 27 bp, Artificial Sequence
  Description of Artificial Sequence: Synthetic oligonucleotide
atcgttgctggcctggctgtcctggtt

SEQ ID NO: 385388 - DNA, 26 bp, Artificial Sequence
  Description of Artificial Sequence: Synthetic oligonucleotide
tcgttgctggcctggctgtcctggtt

SEQ ID NO: 385389 - DNA, 25 bp, Artificial Sequence
  Description of Artificial Sequence: Synthetic oligonucleotide
cgttgctggcctggctgtcctggtt

SEQ ID NO: 385390 - DNA, 26 bp, Artificial Sequence
  Description of Artificial Sequence: Synthetic oligonucleotide
gttgctggcctggctgtcctggttgt

SEQ ID NO: 385391 - DNA, 26 bp, Artificial Sequence
  Description of Artificial Sequence: Synthetic oligonucleotide
ttgctggcctggctgtcctggttgtc

SEQ ID NO: 385392 - DNA, 25 bp, Artificial Sequence
  Description of Artificial Sequence: Synthetic oligonucleotide
tgctggcctggctgtcctggttgtc

SEQ ID NO: 385393 - DNA, 24 bp, Artificial Sequence
  Description of Artificial Sequence: Synthetic oligonucleotide
gctggcctggctgtcctggttgtc

SEQ ID NO: 385394 - DNA, 26 bp, Artificial Sequence
  Description of Artificial Sequence: Synthetic oligonucleotide
ctggcctggctgtcctggttgtccta

SEQ ID NO: 385395 - DNA, 26 bp, Artificial Sequence
  Description of Artificial Sequence: Synthetic oligonucleotide
tggcctggctgtcctggttgtcctag

SEQ ID NO: 385396 - DNA, 25 bp, Artificial Sequence
  Description of Artificial Sequence: Synthetic oligonucleotide
ggcctggctgtcctggttgtcctag

SEQ ID NO: 385397 - DNA, 26 bp, Artificial Sequence
  Description of Artificial Sequence: Synthetic oligonucleotide
gcctggctgtcctggttgtcctagct

SEQ ID NO: 385398 - DNA, 27 bp, Artificial Sequence
  Description of Artificial Sequence: Synthetic oligonucleotide
cctggctgtcctggttgtcctagctgt

SEQ ID NO: 385399 - DNA, 27 bp, Artificial Sequence
  Description of Artificial Sequence: Synthetic oligonucleotide
ctggctgtcctggttgtcctagctgtc

SEQ ID NO: 385400 - DNA, 27 bp, Artificial Sequence
  Description of Artificial Sequence: Synthetic oligonucleotide
tggctgtcctggttgtcctagctgtcc

SEQ ID NO: 385401 - DNA, 27 bp, Artificial Sequence
  Description of Artificial Sequence: Synthetic oligonucleotide
ggctgtcctggttgtcctagctgtcct

SEQ ID NO: 385402 - DNA, 28 bp, Artificial Sequence
  Description of Artificial Sequence: Synthetic oligonucleotide
gctgtcctggttgtcctagctgtccttg

SEQ ID NO: 385403 - DNA, 28 bp, Artificial Sequence
  Description of Artificial Sequence: Synthetic oligonucleotide
ctgtcctggttgtcctagctgtccttgg

SEQ ID NO: 385404 - DNA, 29 bp, Artificial Sequence
  Description of Artificial Sequence: Synthetic oligonucleotide
tgtcctggttgtcctagctgtccttggag

SEQ ID NO: 385405 - DNA, 28 bp, Artificial Sequence
  Description of Artificial Sequence: Synthetic oligonucleotide
gtcctggttgtcctagctgtccttggag

SEQ ID NO: 385406 - DNA, 28 bp, Artificial Sequence
  Description of Artificial Sequence: Synthetic oligonucleotide
tcctggttgtcctagctgtccttggagc

SEQ ID NO: 385407 - DNA, 27 bp, Artificial Sequence
  Description of Artificial Sequence: Synthetic oligonucleotide
cctggttgtcctagctgtccttggagc

SEQ ID NO: 385408 - DNA, 28 bp, Artificial Sequence
  Description of Artificial Sequence: Synthetic oligonucleotide
ctggttgtcctagctgtccttggagctg

SEQ ID NO: 385409 - DNA, 29 bp, Artificial Sequence
  Description of Artificial Sequence: Synthetic oligonucleotide
tggttgtcctagctgtccttggagctgtg

SEQ ID NO: 385410 - DNA, 28 bp, Artificial Sequence
  Description of Artificial Sequence: Synthetic oligonucleotide
ggttgtcctagctgtccttggagctgtg

SEQ ID NO: 385411 - DNA, 28 bp, Artificial Sequence
  Description of Artificial Sequence: Synthetic oligonucleotide
gttgtcctagctgtccttggagctgtgg

SEQ ID NO: 385412 - DNA, 29 bp, Artificial Sequence
  Description of Artificial Sequence: Synthetic oligonucleotide
ttgtcctagctgtccttggagctgtggtc

SEQ ID NO: 385413 - DNA, 28 bp, Artificial Sequence
  Description of Artificial Sequence: Synthetic oligonucleotide
tgtcctagctgtccttggagctgtggtc

SEQ ID NO: 385414 - DNA, 27 bp, Artificial Sequence
  Description of Artificial Sequence: Synthetic oligonucleotide
gtcctagctgtccttggagctgtggtc

SEQ ID NO: 385415 - DNA, 28 bp, Artificial Sequence
  Description of Artificial Sequence: Synthetic oligonucleotide
tcctagctgtccttggagctgtggtcac

SEQ ID NO: 385416 - DNA, 27 bp, Artificial Sequence
  Description of Artificial Sequence: Synthetic oligonucleotide
cctagctgtccttggagctgtggtcac

SEQ ID NO: 385417 - DNA, 27 bp, Artificial Sequence
  Description of Artificial Sequence: Synthetic oligonucleotide
ctagctgtccttggagctgtggtcacc

SEQ ID NO: 385418 - DNA, 27 bp, Artificial Sequence
  Description of Artificial Sequence: Synthetic oligonucleotide
tagctgtccttggagctgtggtcaccg

SEQ ID NO: 385419 - DNA, 26 bp, Artificial Sequence
  Description of Artificial Sequence: Synthetic oligonucleotide
agctgtccttggagctgtggtcaccg

SEQ ID NO: 385420 - DNA, 25 bp, Artificial Sequence
  Description of Artificial Sequence: Synthetic oligonucleotide
gctgtccttggagctgtggtcaccg

SEQ ID NO: 385421 - DNA, 27 bp, Artificial Sequence
  Description of Artificial Sequence: Synthetic oligonucleotide
ctgtccttggagctgtggtcaccgcta

SEQ ID NO: 385422 - DNA, 28 bp, Artificial Sequence
  Description of Artificial Sequence: Synthetic oligonucleotide
tgtccttggagctgtggtcaccgctatg

SEQ ID NO: 385423 - DNA, 27 bp, Artificial Sequence
  Description of Artificial Sequence: Synthetic oligonucleotide
gtccttggagctgtggtcaccgctatg

SEQ ID NO: 385424 - DNA, 29 bp, Artificial Sequence
  Description of Artificial Sequence: Synthetic oligonucleotide
tccttggagctgtggtcaccgctatgatg

SEQ ID NO: 385425 - DNA, 28 bp, Artificial Sequence
  Description of Artificial Sequence: Synthetic oligonucleotide
ccttggagctgtggtcaccgctatgatg

SEQ ID NO: 385426 - DNA, 29 bp, Artificial Sequence
  Description of Artificial Sequence: Synthetic oligonucleotide
cttggagctgtggtcaccgctatgatgtg

SEQ ID NO: 385427 - DNA, 31 bp, Artificial Sequence; identical to SEQ ID NO: 46864
  Description of Artificial Sequence: Synthetic oligonucleotide

SEQ ID NO: 385428 - DNA, 30 bp, Artificial Sequence; identical to SEQ ID NO: 46865
  Description of Artificial Sequence: Synthetic oligonucleotide

SEQ ID NO: 385429 - DNA, 29 bp, Artificial Sequence
  Description of Artificial Sequence: Synthetic oligonucleotide
ggagctgtggtcaccgctatgatgtgtag

SEQ ID NO: 385430 - DNA, 29 bp, Artificial Sequence
  Description of Artificial Sequence: Synthetic oligonucleotide
gagctgtggtcaccgctatgatgtgtagg

SEQ ID NO: 385431 - DNA, 30 bp, Artificial Sequence; identical to SEQ ID NO: 46868
  Description of Artificial Sequence: Synthetic oligonucleotide

SEQ ID NO: 385432 - DNA, 29 bp, Artificial Sequence
  Description of Artificial Sequence: Synthetic oligonucleotide
gctgtggtcaccgctatgatgtgtaggag

SEQ ID NO: 385433 - DNA, 29 bp, Artificial Sequence
  Description of Artificial Sequence: Synthetic oligonucleotide
ctgtggtcaccgctatgatgtgtaggagg

SEQ ID NO: 385434 - DNA, 31 bp, Artificial Sequence; identical to SEQ ID NO: 46871
  Description of Artificial Sequence: Synthetic oligonucleotide

SEQ ID NO: 385435 - DNA, 30 bp, Artificial Sequence; identical to SEQ ID NO: 46872
  Description of Artificial Sequence: Synthetic oligonucleotide

SEQ ID NO: 385436 - DNA, 31 bp, Artificial Sequence; identical to SEQ ID NO: 46873
  Description of Artificial Sequence: Synthetic oligonucleotide

SEQ ID NO: 385437 - DNA, 30 bp, Artificial Sequence; identical to SEQ ID NO: 46874
  Description of Artificial Sequence: Synthetic oligonucleotide

SEQ ID NO: 385438 - DNA, 30 bp, Artificial Sequence; identical to SEQ ID NO: 46875
  Description of Artificial Sequence: Synthetic oligonucleotide

SEQ ID NO: 385439 - DNA, 31 bp, Artificial Sequence; identical to SEQ ID NO: 46876
  Description of Artificial Sequence: Synthetic oligonucleotide

SEQ ID NO: 385440 - DNA, 30 bp, Artificial Sequence; identical to SEQ ID NO: 46877
  Description of Artificial Sequence: Synthetic oligonucleotide

SEQ ID NO: 385441 - DNA, 31 bp, Artificial Sequence; identical to SEQ ID NO: 46878
  Description of Artificial Sequence: Synthetic oligonucleotide

SEQ ID NO: 385442 - DNA, 30 bp, Artificial Sequence; identical to SEQ ID NO: 46879
  Description of Artificial Sequence: Synthetic oligonucleotide

SEQ ID NO: 385443 - DNA, 30 bp, Artificial Sequence; identical to SEQ ID NO: 46880
  Description of Artificial Sequence: Synthetic oligonucleotide

SEQ ID NO: 385444 - DNA, 31 bp, Artificial Sequence; identical to SEQ ID NO: 46881
  Description of Artificial Sequence: Synthetic oligonucleotide

SEQ ID NO: 385445 - DNA, 31 bp, Artificial Sequence; identical to SEQ ID NO: 46882
  Description of Artificial Sequence: Synthetic oligonucleotide

SEQ ID NO: 385446 - DNA, 35 bp, Artificial Sequence; identical to SEQ ID NO: 46883
  Description of Artificial Sequence: Synthetic oligonucleotide

SEQ ID NO: 385447 - DNA, 34 bp, Artificial Sequence; identical to SEQ ID NO: 46884
  Description of Artificial Sequence: Synthetic oligonucleotide

SEQ ID NO: 385448 - DNA, 24 bp, Artificial Sequence
  Description of Artificial Sequence: Synthetic oligonucleotide
agggagctgctctcaggctgcgtg

SEQ ID NO: 385449 - DNA, 23 bp, Artificial Sequence
  Description of Artificial Sequence: Synthetic oligonucleotide
gggagctgctctcaggctgcgtg

SEQ ID NO: 385450 - DNA, 24 bp, Artificial Sequence
  Description of Artificial Sequence: Synthetic oligonucleotide
ggagctgctctcaggctgcgtgca

SEQ ID NO: 385451 - DNA, 24 bp, Artificial Sequence
  Description of Artificial Sequence: Synthetic oligonucleotide
gagctgctctcaggctgcgtgcag

SEQ ID NO: 385452 - DNA, 26 bp, Artificial Sequence
  Description of Artificial Sequence: Synthetic oligonucleotide
agctgctctcaggctgcgtgcagcaa

SEQ ID NO: 385453 - DNA, 25 bp, Artificial Sequence
  Description of Artificial Sequence: Synthetic oligonucleotide
gctgctctcaggctgcgtgcagcaa

SEQ ID NO: 385454 - DNA, 26 bp, Artificial Sequence
  Description of Artificial Sequence: Synthetic oligonucleotide
ctgctctcaggctgcgtgcagcaaca

SEQ ID NO: 385455 - DNA, 27 bp, Artificial Sequence
  Description of Artificial Sequence: Synthetic oligonucleotide
tgctctcaggctgcgtgcagcaacagt

SEQ ID NO: 385456 - DNA, 26 bp, Artificial Sequence
  Description of Artificial Sequence: Synthetic oligonucleotide
gctctcaggctgcgtgcagcaacagt

SEQ ID NO: 385457 - DNA, 26 bp, Artificial Sequence
  Description of Artificial Sequence: Synthetic oligonucleotide
ctctcaggctgcgtgcagcaacagtg

SEQ ID NO: 385458 - DNA, 26 bp, Artificial Sequence
  Description of Artificial Sequence: Synthetic oligonucleotide
tctcaggctgcgtgcagcaacagtgc

SEQ ID NO: 385459 - DNA, 25 bp, Artificial Sequence
  Description of Artificial Sequence: Synthetic oligonucleotide
ctcaggctgcgtgcagcaacagtgc

SEQ ID NO: 385460 - DNA, 25 bp, Artificial Sequence
  Description of Artificial Sequence: Synthetic oligonucleotide
tcaggctgcgtgcagcaacagtgcc

SEQ ID NO: 385461 - DNA, 24 bp, Artificial Sequence
  Description of Artificial Sequence: Synthetic oligonucleotide
caggctgcgtgcagcaacagtgcc

SEQ ID NO: 385462 - DNA, 25 bp, Artificial Sequence
  Description of Artificial Sequence: Synthetic oligonucleotide
aggctgcgtgcagcaacagtgccca

SEQ ID NO: 385463 - DNA, 24 bp, Artificial Sequence
  Description of Artificial Sequence: Synthetic oligonucleotide
ggctgcgtgcagcaacagtgccca

SEQ ID NO: 385464 - DNA, 24 bp, Artificial Sequence
  Description of Artificial Sequence: Synthetic oligonucleotide
gctgcgtgcagcaacagtgcccag

SEQ ID NO: 385465 - DNA, 24 bp, Artificial Sequence
  Description of Artificial Sequence: Synthetic oligonucleotide
ctgcgtgcagcaacagtgcccagg

SEQ ID NO: 385466 - DNA, 24 bp, Artificial Sequence
  Description of Artificial Sequence: Synthetic oligonucleotide
tgcgtgcagcaacagtgcccaggg

SEQ ID NO: 385467 - DNA, 23 bp, Artificial Sequence
  Description of Artificial Sequence: Synthetic oligonucleotide
gcgtgcagcaacagtgcccaggg

SEQ ID NO: 385468 - DNA, 24 bp, Artificial Sequence
  Description of Artificial Sequence: Synthetic oligonucleotide
cgtgcagcaacagtgcccagggct

SEQ ID NO: 385469 - DNA, 25 bp, Artificial Sequence
  Description of Artificial Sequence: Synthetic oligonucleotide
gtgcagcaacagtgcccagggctct

SEQ ID NO: 385470 - DNA, 27 bp, Artificial Sequence
  Description of Artificial Sequence: Synthetic oligonucleotide
tgcagcaacagtgcccagggctctgat

SEQ ID NO: 385471 - DNA, 26 bp, Artificial Sequence
  Description of Artificial Sequence: Synthetic oligonucleotide
gcagcaacagtgcccagggctctgat

SEQ ID NO: 385472 - DNA, 28 bp, Artificial Sequence
  Description of Artificial Sequence: Synthetic oligonucleotide
cccagggctctgatgagtctctcatcac

SEQ ID NO: 385473 - DNA, 30 bp, Artificial Sequence; identical to SEQ ID NO: 46910
  Description of Artificial Sequence: Synthetic oligonucleotide

SEQ ID NO: 385474 - DNA, 34 bp, Artificial Sequence; identical to SEQ ID NO: 46911
  Description of Artificial Sequence: Synthetic oligonucleotide

SEQ ID NO: 385475 - DNA, 34 bp, Artificial Sequence; identical to SEQ ID NO: 46912
  Description of Artificial Sequence: Synthetic oligonucleotide

SEQ ID NO: 385476 - DNA, 33 bp, Artificial Sequence; identical to SEQ ID NO: 46913
  Description of Artificial Sequence: Synthetic oligonucleotide

SEQ ID NO: 385477 - DNA, 33 bp, Artificial Sequence; identical to SEQ ID NO: 46914
  Description of Artificial Sequence: Synthetic oligonucleotide

SEQ ID NO: 385478 - DNA, 34 bp, Artificial Sequence; identical to SEQ ID NO: 46915
  Description of Artificial Sequence: Synthetic oligonucleotide

SEQ ID NO: 385479 - DNA, 27 bp, Artificial Sequence
  Description of Artificial Sequence: Synthetic oligonucleotide
tgagctgggagccatcttcccagccta

SEQ ID NO: 385480 - DNA, 26 bp, Artificial Sequence
  Description of Artificial Sequence: Synthetic oligonucleotide
gagctgggagccatcttcccagccta

SEQ ID NO: 385481 - DNA, 26 bp, Artificial Sequence
  Description of Artificial Sequence: Synthetic oligonucleotide
agctgggagccatcttcccagcctac

SEQ ID NO: 385482 - DNA, 25 bp, Artificial Sequence
  Description of Artificial Sequence: Synthetic oligonucleotide
gctgggagccatcttcccagcctac

SEQ ID NO: 385483 - DNA, 27 bp, Artificial Sequence
  Description of Artificial Sequence: Synthetic oligonucleotide
ctgggagccatcttcccagcctaccat

SEQ ID NO: 385484 - DNA, 27 bp, Artificial Sequence
  Description of Artificial Sequence: Synthetic oligonucleotide
tgggagccatcttcccagcctaccatc

SEQ ID NO: 385485 - DNA, 26 bp, Artificial Sequence
  Description of Artificial Sequence: Synthetic oligonucleotide
gggagccatcttcccagcctaccatc

SEQ ID NO: 385486 - DNA, 26 bp, Artificial Sequence
  Description of Artificial Sequence: Synthetic oligonucleotide
ggagccatcttcccagcctaccatcc

SEQ ID NO: 385487 - DNA, 26 bp, Artificial Sequence
  Description of Artificial Sequence: Synthetic oligonucleotide
gagccatcttcccagcctaccatccc

SEQ ID NO: 385488 - DNA, 27 bp, Artificial Sequence
  Description of Artificial Sequence: Synthetic oligonucleotide
agccatcttcccagcctaccatcccca

SEQ ID NO: 385489 - DNA, 27 bp, Artificial Sequence
  Description of Artificial Sequence: Synthetic oligonucleotide
gccatcttcccagcctaccatccccat

SEQ ID NO: 385490 - DNA, 27 bp, Artificial Sequence
  Description of Artificial Sequence: Synthetic oligonucleotide
ccatcttcccagcctaccatccccatc

SEQ ID NO: 385491 - DNA, 29 bp, Artificial Sequence
  Description of Artificial Sequence: Synthetic oligonucleotide
catcttcccagcctaccatccccatcatg

SEQ ID NO: 385492 - DNA, 29 bp, Artificial Sequence
  Description of Artificial Sequence: Synthetic oligonucleotide
atcttcccagcctaccatccccatcatgg

SEQ ID NO: 385493 - DNA, 28 bp, Artificial Sequence
  Description of Artificial Sequence: Synthetic oligonucleotide
tcttcccagcctaccatccccatcatgg

SEQ ID NO: 385494 - DNA, 27 bp, Artificial Sequence
  Description of Artificial Sequence: Synthetic oligonucleotide
cttcccagcctaccatccccatcatgg

SEQ ID NO: 385495 - DNA, 27 bp, Artificial Sequence
  Description of Artificial Sequence: Synthetic oligonucleotide
ttcccagcctaccatccccatcatggg

SEQ ID NO: 385496 - DNA, 26 bp, Artificial Sequence
  Description of Artificial Sequence: Synthetic oligonucleotide
tcccagcctaccatccccatcatggg

SEQ ID NO: 385497 - DNA, 25 bp, Artificial Sequence
  Description of Artificial Sequence: Synthetic oligonucleotide
cccagcctaccatccccatcatggg

SEQ ID NO: 385498 - DNA, 27 bp, Artificial Sequence
  Description of Artificial Sequence: Synthetic oligonucleotide
ccagcctaccatccccatcatgggcat

SEQ ID NO: 385499 - DNA, 27 bp, Artificial Sequence
  Description of Artificial Sequence: Synthetic oligonucleotide
cagcctaccatccccatcatgggcatc

SEQ ID NO: 385500 - DNA, 27 bp, Artificial Sequence
  Description of Artificial Sequence: Synthetic oligonucleotide
agcctaccatccccatcatgggcatcg

SEQ ID NO: 385501 - DNA, 27 bp, Artificial Sequence
  Description of Artificial Sequence: Synthetic oligonucleotide
gcctaccatccccatcatgggcatcgt

SEQ ID NO: 385502 - DNA, 28 bp, Artificial Sequence
  Description of Artificial Sequence: Synthetic oligonucleotide
cctaccatccccatcatgggcatcgttg

SEQ ID NO: 385503 - DNA, 28 bp, Artificial Sequence
  Description of Artificial Sequence: Synthetic oligonucleotide
ctaccatccccatcatgggcatcgttgc

SEQ ID NO: 385504 - DNA, 29 bp, Artificial Sequence
  Description of Artificial Sequence: Synthetic oligonucleotide
taccatccccatcatgggcatcgttgctg

SEQ ID NO: 385505 - DNA, 27 bp, Artificial Sequence
  Description of Artificial Sequence: Synthetic oligonucleotide
agcagctgagagcctacctggagggta

SEQ ID NO: 385506 - DNA, 26 bp, Artificial Sequence
  Description of Artificial Sequence: Synthetic oligonucleotide
gcagctgagagcctacctggagggta

SEQ ID NO: 385507 - DNA, 26 bp, Artificial Sequence
  Description of Artificial Sequence: Synthetic oligonucleotide
cagctgagagcctacctggagggtac

SEQ ID NO: 385508 - DNA, 27 bp, Artificial Sequence
  Description of Artificial Sequence: Synthetic oligonucleotide
agctgagagcctacctggagggtacgt

SEQ ID NO: 385509 - DNA, 26 bp, Artificial Sequence
  Description of Artificial Sequence: Synthetic oligonucleotide
gctgagagcctacctggagggtacgt

SEQ ID NO: 385510 - DNA, 26 bp, Artificial Sequence
  Description of Artificial Sequence: Synthetic oligonucleotide
ctgagagcctacctggagggtacgtg

SEQ ID NO: 385511 - DNA, 26 bp, Artificial Sequence
  Description of Artificial Sequence: Synthetic oligonucleotide
tgagagcctacctggagggtacgtgc

SEQ ID NO: 385512 - DNA, 25 bp, Artificial Sequence
  Description of Artificial Sequence: Synthetic oligonucleotide
gagagcctacctggagggtacgtgc

SEQ ID NO: 385513 - DNA, 26 bp, Artificial Sequence
  Description of Artificial Sequence: Synthetic oligonucleotide
agagcctacctggagggtacgtgcgt

SEQ ID NO: 385514 - DNA, 25 bp, Artificial Sequence
  Description of Artificial Sequence: Synthetic oligonucleotide
gagcctacctggagggtacgtgcgt

SEQ ID NO: 385515 - DNA, 25 bp, Artificial Sequence
  Description of Artificial Sequence: Synthetic oligonucleotide
agcctacctggagggtacgtgcgtg

SEQ ID NO: 385516 - DNA, 24 bp, Artificial Sequence
  Description of Artificial Sequence: Synthetic oligonucleotide
gcctacctggagggtacgtgcgtg

SEQ ID NO: 385517 - DNA, 25 bp, Artificial Sequence
  Description of Artificial Sequence: Synthetic oligonucleotide
cctacctggagggtacgtgcgtgga

SEQ ID NO: 385518 - DNA, 26 bp, Artificial Sequence
  Description of Artificial Sequence: Synthetic oligonucleotide
ctacctggagggtacgtgcgtggagt

SEQ ID NO: 385519 - DNA, 26 bp, Artificial Sequence
  Description of Artificial Sequence: Synthetic oligonucleotide
tacctggagggtacgtgcgtggagtg

SEQ ID NO: 385520 - DNA, 25 bp, Artificial Sequence
  Description of Artificial Sequence: Synthetic oligonucleotide
acctggagggtacgtgcgtggagtg

SEQ ID NO: 385521 - DNA, 24 bp, Artificial Sequence
  Description of Artificial Sequence: Synthetic oligonucleotide
cctggagggtacgtgcgtggagtg

SEQ ID NO: 385522 - DNA, 24 bp, Artificial Sequence
  Description of Artificial Sequence: Synthetic oligonucleotide
ctggagggtacgtgcgtggagtgg

SEQ ID NO: 385523 - DNA, 25 bp, Artificial Sequence
  Description of Artificial Sequence: Synthetic oligonucleotide
tggagggtacgtgcgtggagtggct

SEQ ID NO: 385524 - DNA, 24 bp, Artificial Sequence
  Description of Artificial Sequence: Synthetic oligonucleotide
ggagggtacgtgcgtggagtggct

SEQ ID NO: 385525 - DNA, 24 bp, Artificial Sequence
  Description of Artificial Sequence: Synthetic oligonucleotide
gagggtacgtgcgtggagtggctc

SEQ ID NO: 385526 - DNA, 24 bp, Artificial Sequence
  Description of Artificial Sequence: Synthetic oligonucleotide
agggtacgtgcgtggagtggctcc

SEQ ID NO: 385527 - DNA, 23 bp, Artificial Sequence
  Description of Artificial Sequence: Synthetic oligonucleotide
gggtacgtgcgtggagtggctcc

SEQ ID NO: 385528 - DNA, 23 bp, Artificial Sequence
  Description of Artificial Sequence: Synthetic oligonucleotide
ggtacgtgcgtggagtggctccg

SEQ ID NO: 385529 - DNA, 24 bp, Artificial Sequence
  Description of Artificial Sequence: Synthetic oligonucleotide
gtacgtgcgtggagtggctccgca

SEQ ID NO: 385530 - DNA, 27 bp, Artificial Sequence
  Description of Artificial Sequence: Synthetic oligonucleotide
tacgtgcgtggagtggctccgcagata

SEQ ID NO: 385531 - DNA, 20 bp, Artificial Sequence
  Description of Artificial Sequence: Synthetic oligonucleotide
agccgcgggcgccgtgggta

SEQ ID NO: 385532 - DNA, 20 bp, Artificial Sequence
  Description of Artificial Sequence: Synthetic oligonucleotide
gccgcgggcgccgtgggtat

SEQ ID NO: 385533 - DNA, 20 bp, Artificial Sequence
  Description of Artificial Sequence: Synthetic oligonucleotide
ccgcgggcgccgtgggtaga

SEQ ID NO: 385534 - DNA, 20 bp, Artificial Sequence
  Description of Artificial Sequence: Synthetic oligonucleotide
cgcgggcgccgtgggtagag

SEQ ID NO: 385535 - DNA, 21 bp, Artificial Sequence
  Description of Artificial Sequence: Synthetic oligonucleotide
gcgggcgccgtgggtagagca

SEQ ID NO: 385536 - DNA, 21 bp, Artificial Sequence
  Description of Artificial Sequence: Synthetic oligonucleotide
cgggcgccgtgggtagagcag

SEQ ID NO: 385537 - DNA, 22 bp, Artificial Sequence
  Description of Artificial Sequence: Synthetic oligonucleotide
gggcgccgtgggtagagcagga

SEQ ID NO: 385538 - DNA, 22 bp, Artificial Sequence
  Description of Artificial Sequence: Synthetic oligonucleotide
ggcgccgtgggtagagcaggag

SEQ ID NO: 385539 - DNA, 22 bp, Artificial Sequence
  Description of Artificial Sequence: Synthetic oligonucleotide
gcgccgtgggtagagcaggagg

SEQ ID NO: 385540 - DNA, 22 bp, Artificial Sequence
  Description of Artificial Sequence: Synthetic oligonucleotide
cgccgtgggtagagcaggaggg

SEQ ID NO: 385541 - DNA, 22 bp, Artificial Sequence
  Description of Artificial Sequence: Synthetic oligonucleotide
gccgtgggtagagcaggagggg

SEQ ID NO: 385542 - DNA, 22 bp, Artificial Sequence
  Description of Artificial Sequence: Synthetic oligonucleotide
ccgtgggtagagcaggaggggc

SEQ ID NO: 385543 - DNA, 22 bp, Artificial Sequence
  Description of Artificial Sequence: Synthetic oligonucleotide
cgtgggtagagcaggaggggcc

SEQ ID NO: 385544 - DNA, 22 bp, Artificial Sequence
  Description of Artificial Sequence: Synthetic oligonucleotide
gtgggtagagcaggaggggccg

SEQ ID NO: 385545 - DNA, 23 bp, Artificial Sequence
  Description of Artificial Sequence: Synthetic oligonucleotide
tgggtagagcaggaggggccgga

SEQ ID NO: 385546 - DNA, 22 bp, Artificial Sequence
  Description of Artificial Sequence: Synthetic oligonucleotide
gggtagagcaggaggggccgga

SEQ ID NO: 385547 - DNA, 26 bp, Artificial Sequence
  Description of Artificial Sequence: Synthetic oligonucleotide
ggtagagcaggaggggccggagtatt

SEQ ID NO: 385548 - DNA, 26 bp, Artificial Sequence
  Description of Artificial Sequence: Synthetic oligonucleotide
gtagagcaggaggggccggagtattg

SEQ ID NO: 385549 - DNA, 33 bp, Artificial Sequence; identical to SEQ ID NO: 46986
  Description of Artificial Sequence: Synthetic oligonucleotide

SEQ ID NO: 385550 - DNA, 32 bp, Artificial Sequence; identical to SEQ ID NO: 46987
  Description of Artificial Sequence: Synthetic oligonucleotide

SEQ ID NO: 385551 - DNA, 31 bp, Artificial Sequence; identical to SEQ ID NO: 46988
  Description of Artificial Sequence: Synthetic oligonucleotide

SEQ ID NO: 385552 - DNA, 32 bp, Artificial Sequence; identical to SEQ ID NO: 46989
  Description of Artificial Sequence: Synthetic oligonucleotide

SEQ ID NO: 385553 - DNA, 31 bp, Artificial Sequence; identical to SEQ ID NO: 46990
  Description of Artificial Sequence: Synthetic oligonucleotide

SEQ ID NO: 385554 - DNA, 31 bp, Artificial Sequence; identical to SEQ ID NO: 46991
  Description of Artificial Sequence: Synthetic oligonucleotide

SEQ ID NO: 385555 - DNA, 31 bp, Artificial Sequence; identical to SEQ ID NO: 46992
  Description of Artificial Sequence: Synthetic oligonucleotide

SEQ ID NO: 385556 - DNA, 30 bp, Artificial Sequence; identical to SEQ ID NO: 46993
  Description of Artificial Sequence: Synthetic oligonucleotide

SEQ ID NO: 385557 - DNA, 30 bp, Artificial Sequence; identical to SEQ ID NO: 46994
  Description of Artificial Sequence: Synthetic oligonucleotide

SEQ ID NO: 385558 - DNA, 29 bp, Artificial Sequence
  Description of Artificial Sequence: Synthetic oligonucleotide
gatacacgtgccatatgcagcatgagggg

SEQ ID NO: 385559 - DNA, 29 bp, Artificial Sequence
  Description of Artificial Sequence: Synthetic oligonucleotide
atacacgtgccatatgcagcatgaggggc

SEQ ID NO: 385560 - DNA, 28 bp, Artificial Sequence
  Description of Artificial Sequence: Synthetic oligonucleotide
tacacgtgccatatgcagcatgaggggc

SEQ ID NO: 385561 - DNA, 27 bp, Artificial Sequence
  Description of Artificial Sequence: Synthetic oligonucleotide
acacgtgccatatgcagcatgaggggc

SEQ ID NO: 385562 - DNA, 27 bp, Artificial Sequence
  Description of Artificial Sequence: Synthetic oligonucleotide
cacgtgccatatgcagcatgaggggct

SEQ ID NO: 385563 - DNA, 27 bp, Artificial Sequence
  Description of Artificial Sequence: Synthetic oligonucleotide
acgtgccatatgcagcatgaggggctg

SEQ ID NO: 385564 - DNA, 26 bp, Artificial Sequence
  Description of Artificial Sequence: Synthetic oligonucleotide
cgtgccatatgcagcatgaggggctg

SEQ ID NO: 385565 - DNA, 27 bp, Artificial Sequence
  Description of Artificial Sequence: Synthetic oligonucleotide
gtgccatatgcagcatgaggggctgca

SEQ ID NO: 385566 - DNA, 28 bp, Artificial Sequence
  Description of Artificial Sequence: Synthetic oligonucleotide
tgccatatgcagcatgaggggctgcaag

SEQ ID NO: 385567 - DNA, 27 bp, Artificial Sequence
  Description of Artificial Sequence: Synthetic oligonucleotide
gccatatgcagcatgaggggctgcaag

SEQ ID NO: 385568 - DNA, 28 bp, Artificial Sequence
  Description of Artificial Sequence: Synthetic oligonucleotide
ccatatgcagcatgaggggctgcaagag

SEQ ID NO: 385569 - DNA, 28 bp, Artificial Sequence
  Description of Artificial Sequence: Synthetic oligonucleotide
catatgcagcatgaggggctgcaagagc

SEQ ID NO: 385570 - DNA, 28 bp, Artificial Sequence
  Description of Artificial Sequence: Synthetic oligonucleotide
atatgcagcatgaggggctgcaagagcc

SEQ ID NO: 385571 - DNA, 27 bp, Artificial Sequence
  Description of Artificial Sequence: Synthetic oligonucleotide
tatgcagcatgaggggctgcaagagcc

SEQ ID NO: 385572 - DNA, 26 bp, Artificial Sequence
  Description of Artificial Sequence: Synthetic oligonucleotide
atgcagcatgaggggctgcaagagcc

SEQ ID NO: 385573 - DNA, 25 bp, Artificial Sequence
  Description of Artificial Sequence: Synthetic oligonucleotide
tgcagcatgaggggctgcaagagcc

SEQ ID NO: 385574 - DNA, 24 bp, Artificial Sequence
  Description of Artificial Sequence: Synthetic oligonucleotide
gcagcatgaggggctgcaagagcc

SEQ ID NO: 385575 - DNA, 24 bp, Artificial Sequence
  Description of Artificial Sequence: Synthetic oligonucleotide
cagcatgaggggctgcaagagccc

SEQ ID NO: 385576 - DNA, 25 bp, Artificial Sequence
  Description of Artificial Sequence: Synthetic oligonucleotide
agcatgaggggctgcaagagcccct

SEQ ID NO: 385577 - DNA, 24 bp, Artificial Sequence
  Description of Artificial Sequence: Synthetic oligonucleotide
gcatgaggggctgcaagagcccct

SEQ ID NO: 385578 - DNA, 25 bp, Artificial Sequence
  Description of Artificial Sequence: Synthetic oligonucleotide
catgaggggctgcaagagcccctca

SEQ ID NO: 385579 - DNA, 25 bp, Artificial Sequence
  Description of Artificial Sequence: Synthetic oligonucleotide
atgaggggctgcaagagcccctcac

SEQ ID NO: 385580 - DNA, 24 bp, Artificial Sequence
  Description of Artificial Sequence: Synthetic oligonucleotide
tgaggggctgcaagagcccctcac

SEQ ID NO: 385581 - DNA, 24 bp, Artificial Sequence
  Description of Artificial Sequence: Synthetic oligonucleotide
cggttcgacagcgatgccgcgagt

SEQ ID NO: 385582 - DNA, 24 bp, Artificial Sequence
  Description of Artificial Sequence: Synthetic oligonucleotide
ggttcgacagcgatgccgcgagtc

SEQ ID NO: 385583 - DNA, 24 bp, Artificial Sequence
  Description of Artificial Sequence: Synthetic oligonucleotide
gttcgacagcgatgccgcgagtcc

SEQ ID NO: 385584 - DNA, 25 bp, Artificial Sequence
  Description of Artificial Sequence: Synthetic oligonucleotide
ttcgacagcgatgccgcgagtccga

SEQ ID NO: 385585 - DNA, 24 bp, Artificial Sequence
  Description of Artificial Sequence: Synthetic oligonucleotide
tcgacagcgatgccgcgagtccga

SEQ ID NO: 385586 - DNA, 23 bp, Artificial Sequence
  Description of Artificial Sequence: Synthetic oligonucleotide
cgacagcgatgccgcgagtccga

SEQ ID NO: 385587 - DNA, 24 bp, Artificial Sequence
  Description of Artificial Sequence: Synthetic oligonucleotide
gacagcgatgccgcgagtccgaga

SEQ ID NO: 385588 - DNA, 24 bp, Artificial Sequence
  Description of Artificial Sequence: Synthetic oligonucleotide
acagcgatgccgcgagtccgagag

SEQ ID NO: 385589 - DNA, 23 bp, Artificial Sequence
  Description of Artificial Sequence: Synthetic oligonucleotide
cagcgatgccgcgagtccgagag

SEQ ID NO: 385590 - DNA, 23 bp, Artificial Sequence
  Description of Artificial Sequence: Synthetic oligonucleotide
agcgatgccgcgagtccgagagg

SEQ ID NO: 385591 - DNA, 22 bp, Artificial Sequence
  Description of Artificial Sequence: Synthetic oligonucleotide
gcgatgccgcgagtccgagagg

SEQ ID NO: 385592 - DNA, 22 bp, Artificial Sequence
  Description of Artificial Sequence: Synthetic oligonucleotide
cgatgccgcgagtccgagaggg

SEQ ID NO: 385593 - DNA, 23 bp, Artificial Sequence
  Description of Artificial Sequence: Synthetic oligonucleotide
gatgccgcgagtccgagagggga

SEQ ID NO: 385594 - DNA, 23 bp, Artificial Sequence
  Description of Artificial Sequence: Synthetic oligonucleotide
atgccgcgagtccgagaggggag

SEQ ID NO: 385595 - DNA, 22 bp, Artificial Sequence
  Description of Artificial Sequence: Synthetic oligonucleotide
tgccgcgagtccgagaggggag

SEQ ID NO: 385596 - DNA, 24 bp, Artificial Sequence
  Description of Artificial Sequence: Synthetic oligonucleotide
cagagcgaggacgggtctcacacg

SEQ ID NO: 385597 - DNA, 25 bp, Artificial Sequence
  Description of Artificial Sequence: Synthetic oligonucleotide
agagcgaggacgggtctcacacgct

SEQ ID NO: 385598 - DNA, 24 bp, Artificial Sequence
  Description of Artificial Sequence: Synthetic oligonucleotide
gagcgaggacgggtctcacacgct

SEQ ID NO: 385599 - DNA, 24 bp, Artificial Sequence
  Description of Artificial Sequence: Synthetic oligonucleotide
agcgaggacgggtctcacacgctc

SEQ ID NO: 385600 - DNA, 23 bp, Artificial Sequence
  Description of Artificial Sequence: Synthetic oligonucleotide
gcgaggacgggtctcacacgctc

SEQ ID NO: 385601 - DNA, 24 bp, Artificial Sequence
  Description of Artificial Sequence: Synthetic oligonucleotide
cgaggacgggtctcacacgctcca

SEQ ID NO: 385602 - DNA, 25 bp, Artificial Sequence
  Description of Artificial Sequence: Synthetic oligonucleotide
gaggacgggtctcacacgctccaga

SEQ ID NO: 385603 - DNA, 25 bp, Artificial Sequence
  Description of Artificial Sequence: Synthetic oligonucleotide
aggacgggtctcacacgctccagag

SEQ ID NO: 385604 - DNA, 24 bp, Artificial Sequence
  Description of Artificial Sequence: Synthetic oligonucleotide
ggacgggtctcacacgctccagag

SEQ ID NO: 385605 - DNA, 26 bp, Artificial Sequence
  Description of Artificial Sequence: Synthetic oligonucleotide
gacgggtctcacacgctccagaggat

SEQ ID NO: 385606 - DNA, 27 bp, Artificial Sequence
  Description of Artificial Sequence: Synthetic oligonucleotide
acgggtctcacacgctccagaggatgt

SEQ ID NO: 385607 - DNA, 27 bp, Artificial Sequence
  Description of Artificial Sequence: Synthetic oligonucleotide
cgggtctcacacgctccagaggatgta

SEQ ID NO: 385608 - DNA, 28 bp, Artificial Sequence
  Description of Artificial Sequence: Synthetic oligonucleotide
gggtctcacacgctccagaggatgtatg

SEQ ID NO: 385609 - DNA, 28 bp, Artificial Sequence
  Description of Artificial Sequence: Synthetic oligonucleotide
ggtctcacacgctccagaggatgtatgg

SEQ ID NO: 385610 - DNA, 28 bp, Artificial Sequence
  Description of Artificial Sequence: Synthetic oligonucleotide
gtctcacacgctccagaggatgtatggc

SEQ ID NO: 385611 - DNA, 29 bp, Artificial Sequence
  Description of Artificial Sequence: Synthetic oligonucleotide
tctcacacgctccagaggatgtatggctg

SEQ ID NO: 385612 - DNA, 28 bp, Artificial Sequence
  Description of Artificial Sequence: Synthetic oligonucleotide
ctcacacgctccagaggatgtatggctg

SEQ ID NO: 385613 - DNA, 28 bp, Artificial Sequence
  Description of Artificial Sequence: Synthetic oligonucleotide
tcacacgctccagaggatgtatggctgc

SEQ ID NO: 385614 - DNA, 27 bp, Artificial Sequence
  Description of Artificial Sequence: Synthetic oligonucleotide
cacacgctccagaggatgtatggctgc

SEQ ID NO: 385615 - DNA, 27 bp, Artificial Sequence
  Description of Artificial Sequence: Synthetic oligonucleotide
acacgctccagaggatgtatggctgcg

SEQ ID NO: 385616 - DNA, 27 bp, Artificial Sequence
  Description of Artificial Sequence: Synthetic oligonucleotide
cacgctccagaggatgtatggctgcga

SEQ ID NO: 385617 - DNA, 27 bp, Artificial Sequence
  Description of Artificial Sequence: Synthetic oligonucleotide
acgctccagaggatgtatggctgcgac

SEQ ID NO: 385618 - DNA, 26 bp, Artificial Sequence
  Description of Artificial Sequence: Synthetic oligonucleotide
cgctccagaggatgtatggctgcgac

SEQ ID NO: 385619 - DNA, 27 bp, Artificial Sequence
  Description of Artificial Sequence: Synthetic oligonucleotide
gctccagaggatgtatggctgcgacct

SEQ ID NO: 385620 - DNA, 30 bp, Artificial Sequence
  Description of Artificial Sequence: Synthetic oligonucleotide
gctcccactccatgagatatttcgacaccg

SEQ ID NO: 385621 - DNA, 30 bp, Artificial Sequence
  Description of Artificial Sequence: Synthetic oligonucleotide
ctcccactccatgagatatttcgacaccgc

SEQ ID NO: 385622 - DNA, 30 bp, Artificial Sequence
  Description of Artificial Sequence: Synthetic oligonucleotide
tcccactccatgagatatttcgacaccgcc

SEQ ID NO: 385623 - DNA, 29 bp, Artificial Sequence
  Description of Artificial Sequence: Synthetic oligonucleotide
cccactccatgagatatttcgacaccgcc

SEQ ID NO: 385624 - DNA, 29 bp, Artificial Sequence
  Description of Artificial Sequence: Synthetic oligonucleotide
ccactccatgagatatttcgacaccgccg

SEQ ID NO: 385625 - DNA, 30 bp, Artificial Sequence
  Description of Artificial Sequence: Synthetic oligonucleotide
cactccatgagatatttcgacaccgccgtg

SEQ ID NO: 385626 - DNA, 31 bp, Artificial Sequence
  Description of Artificial Sequence: Synthetic oligonucleotide
actccatgagatatttcgacaccgccgtgtc

SEQ ID NO: 385627 - DNA, 30 bp, Artificial Sequence
  Description of Artificial Sequence: Synthetic oligonucleotide
ctccatgagatatttcgacaccgccgtgtc

SEQ ID NO: 385628 - DNA, 30 bp, Artificial Sequence
  Description of Artificial Sequence: Synthetic oligonucleotide
tccatgagatatttcgacaccgccgtgtcc

SEQ ID NO: 385629 - DNA, 29 bp, Artificial Sequence
  Description of Artificial Sequence: Synthetic oligonucleotide
ccatgagatatttcgacaccgccgtgtcc

SEQ ID NO: 385630 - DNA, 29 bp, Artificial Sequence
  Description of Artificial Sequence: Synthetic oligonucleotide
catgagatatttcgacaccgccgtgtccc

SEQ ID NO: 385631 - DNA, 29 bp, Artificial Sequence
  Description of Artificial Sequence: Synthetic oligonucleotide
atgagatatttcgacaccgccgtgtcccg

SEQ ID NO: 385632 - DNA, 28 bp, Artificial Sequence
  Description of Artificial Sequence: Synthetic oligonucleotide
tgagatatttcgacaccgccgtgtcccg

SEQ ID NO: 385633 - DNA, 27 bp, Artificial Sequence
  Description of Artificial Sequence: Synthetic oligonucleotide
gagatatttcgacaccgccgtgtcccg

SEQ ID NO: 385634 - DNA, 27 bp, Artificial Sequence
  Description of Artificial Sequence: Synthetic oligonucleotide
agatatttcgacaccgccgtgtcccgg

SEQ ID NO: 385635 - DNA, 26 bp, Artificial Sequence
  Description of Artificial Sequence: Synthetic oligonucleotide
gatatttcgacaccgccgtgtcccgg

SEQ ID NO: 385636 - DNA, 26 bp, Artificial Sequence
  Description of Artificial Sequence: Synthetic oligonucleotide
atatttcgacaccgccgtgtcccggc

SEQ ID NO: 385637 - DNA, 26 bp, Artificial Sequence
  Description of Artificial Sequence: Synthetic oligonucleotide
ctgaccgagtgagcctgcggaaccta

SEQ ID NO: 385638 - DNA, 26 bp, Artificial Sequence
  Description of Artificial Sequence: Synthetic oligonucleotide
tgaccgagtgagcctgcggaacctac

SEQ ID NO: 385639 - DNA, 25 bp, Artificial Sequence
  Description of Artificial Sequence: Synthetic oligonucleotide
gaccgagtgagcctgcggaacctac

SEQ ID NO: 385640 - DNA, 25 bp, Artificial Sequence
  Description of Artificial Sequence: Synthetic oligonucleotide
accgagtgagcctgcggaacctacg

SEQ ID NO: 385641 - DNA, 24 bp, Artificial Sequence
  Description of Artificial Sequence: Synthetic oligonucleotide
ccgagtgagcctgcggaacctacg

SEQ ID NO: 385642 - DNA, 24 bp, Artificial Sequence
  Description of Artificial Sequence: Synthetic oligonucleotide
cgagtgagcctgcggaacctacgc

SEQ ID NO: 385643 - DNA, 24 bp, Artificial Sequence
  Description of Artificial Sequence: Synthetic oligonucleotide
gagtgagcctgcggaacctacgcg

SEQ ID NO: 385644 - DNA, 24 bp, Artificial Sequence
  Description of Artificial Sequence: Synthetic oligonucleotide
agtgagcctgcggaacctacgcgg

SEQ ID NO: 385645 - DNA, 23 bp, Artificial Sequence
  Description of Artificial Sequence: Synthetic oligonucleotide
gtgagcctgcggaacctacgcgg

SEQ ID NO: 385646 - DNA, 25 bp, Artificial Sequence
  Description of Artificial Sequence: Synthetic oligonucleotide
tgagcctgcggaacctacgcggcta

SEQ ID NO: 385647 - DNA, 24 bp, Artificial Sequence
  Description of Artificial Sequence: Synthetic oligonucleotide
gagcctgcggaacctacgcggcta

SEQ ID NO: 385648 - DNA, 26 bp, Artificial Sequence
  Description of Artificial Sequence: Synthetic oligonucleotide
agcctgcggaacctacgcggctacta

SEQ ID NO: 385649 - DNA, 25 bp, Artificial Sequence
  Description of Artificial Sequence: Synthetic oligonucleotide
gcctgcggaacctacgcggctacta

SEQ ID NO: 385650 - DNA, 27 bp, Artificial Sequence
  Description of Artificial Sequence: Synthetic oligonucleotide
cctgcggaacctacgcggctactacaa

SEQ ID NO: 385651 - DNA, 27 bp, Artificial Sequence
  Description of Artificial Sequence: Synthetic oligonucleotide
ctgcggaacctacgcggctactacaac

SEQ ID NO: 385652 - DNA, 27 bp, Artificial Sequence
  Description of Artificial Sequence: Synthetic oligonucleotide
tgcggaacctacgcggctactacaacc

SEQ ID NO: 385653 - DNA, 27 bp, Artificial Sequence
  Description of Artificial Sequence: Synthetic oligonucleotide
gcggaacctacgcggctactacaacca

SEQ ID NO: 385654 - DNA, 27 bp, Artificial Sequence
  Description of Artificial Sequence: Synthetic oligonucleotide
cggaacctacgcggctactacaaccag

SEQ ID NO: 385655 - DNA, 28 bp, Artificial Sequence
  Description of Artificial Sequence: Synthetic oligonucleotide
ggaacctacgcggctactacaaccagag

SEQ ID NO: 385656 - DNA, 28 bp, Artificial Sequence
  Description of Artificial Sequence: Synthetic oligonucleotide
gaacctacgcggctactacaaccagagc

SEQ ID NO: 385657 - DNA, 28 bp, Artificial Sequence
  Description of Artificial Sequence: Synthetic oligonucleotide
aacctacgcggctactacaaccagagcg

SEQ ID NO: 385658 - DNA, 27 bp, Artificial Sequence
  Description of Artificial Sequence: Synthetic oligonucleotide
acctacgcggctactacaaccagagcg

SEQ ID NO: 385659 - DNA, 27 bp, Artificial Sequence
  Description of Artificial Sequence: Synthetic oligonucleotide
acgcggctactacaaccagagcgagga

SEQ ID NO: 385660 - DNA, 24 bp, Artificial Sequence
  Description of Artificial Sequence: Synthetic oligonucleotide
gcggctcagatcacccagcgcaag

SEQ ID NO: 385661 - DNA, 25 bp, Artificial Sequence
  Description of Artificial Sequence: Synthetic oligonucleotide
cggctcagatcacccagcgcaagct

SEQ ID NO: 385662 - DNA, 25 bp, Artificial Sequence
  Description of Artificial Sequence: Synthetic oligonucleotide
ggctcagatcacccagcgcaagctg

SEQ ID NO: 385663 - DNA, 26 bp, Artificial Sequence
  Description of Artificial Sequence: Synthetic oligonucleotide
gctcagatcacccagcgcaagctgga

SEQ ID NO: 385664 - DNA, 26 bp, Artificial Sequence
  Description of Artificial Sequence: Synthetic oligonucleotide
ctcagatcacccagcgcaagctggag

SEQ ID NO: 385665 - DNA, 26 bp, Artificial Sequence
  Description of Artificial Sequence: Synthetic oligonucleotide
tcagatcacccagcgcaagctggagg

SEQ ID NO: 385666 - DNA, 25 bp, Artificial Sequence
  Description of Artificial Sequence: Synthetic oligonucleotide
cagatcacccagcgcaagctggagg

SEQ ID NO: 385667 - DNA, 25 bp, Artificial Sequence
  Description of Artificial Sequence: Synthetic oligonucleotide
agatcacccagcgcaagctggaggc

SEQ ID NO: 385668 - DNA, 24 bp, Artificial Sequence
  Description of Artificial Sequence: Synthetic oligonucleotide
gatcacccagcgcaagctggaggc

SEQ ID NO: 385669 - DNA, 24 bp, Artificial Sequence
  Description of Artificial Sequence: Synthetic oligonucleotide
atcacccagcgcaagctggaggcg

SEQ ID NO: 385670 - DNA, 23 bp, Artificial Sequence
  Description of Artificial Sequence: Synthetic oligonucleotide
tcacccagcgcaagctggaggcg

SEQ ID NO: 385671 - DNA, 22 bp, Artificial Sequence
  Description of Artificial Sequence: Synthetic oligonucleotide
cacccagcgcaagctggaggcg

SEQ ID NO: 385672 - DNA, 22 bp, Artificial Sequence
  Description of Artificial Sequence: Synthetic oligonucleotide
acccagcgcaagctggaggcgg

SEQ ID NO: 385673 - DNA, 21 bp, Artificial Sequence
  Description of Artificial Sequence: Synthetic oligonucleotide
gcaagctggaggcggcccgtg

SEQ ID NO: 385674 - DNA, 21 bp, Artificial Sequence
  Description of Artificial Sequence: Synthetic oligonucleotide
caagctggaggcggcccgtgc

SEQ ID NO: 385675 - DNA, 21 bp, Artificial Sequence
  Description of Artificial Sequence: Synthetic oligonucleotide
aagctggaggcggcccgtgcg

SEQ ID NO: 385676 - DNA, 20 bp, Artificial Sequence
  Description of Artificial Sequence: Synthetic oligonucleotide
agctggaggcggcccgtgcg

SEQ ID NO: 385677 - DNA, 20 bp, Artificial Sequence
  Description of Artificial Sequence: Synthetic oligonucleotide
gctggaggcggcccgtgcgt

SEQ ID NO: 385678 - DNA, 20 bp, Artificial Sequence
  Description of Artificial Sequence: Synthetic oligonucleotide
ctggaggcggcccgtgcggt

SEQ ID NO: 385679 - DNA, 26 bp, Artificial Sequence
  Description of Artificial Sequence: Synthetic oligonucleotide
agaacgggaaggaaacgctgcagcgc

SEQ ID NO: 385680 - DNA, 25 bp, Artificial Sequence
  Description of Artificial Sequence: Synthetic oligonucleotide
gaacgggaaggaaacgctgcagcgc

SEQ ID NO: 385681 - DNA, 25 bp, Artificial Sequence
  Description of Artificial Sequence: Synthetic oligonucleotide
aacgggaaggaaacgctgcagcgcg

SEQ ID NO: 385682 - DNA, 24 bp, Artificial Sequence
  Description of Artificial Sequence: Synthetic oligonucleotide
acgggaaggaaacgctgcagcgcg

SEQ ID NO: 385683 - DNA, 23 bp, Artificial Sequence
  Description of Artificial Sequence: Synthetic oligonucleotide
cgggaaggaaacgctgcagcgcg

SEQ ID NO: 385684 - DNA, 24 bp, Artificial Sequence
  Description of Artificial Sequence: Synthetic oligonucleotide
gggaaggaaacgctgcagcgcgca

SEQ ID NO: 385685 - DNA, 24 bp, Artificial Sequence
  Description of Artificial Sequence: Synthetic oligonucleotide
ggaaggaaacgctgcagcgcgcag

SEQ ID NO: 385686 - DNA, 25 bp, Artificial Sequence
  Description of Artificial Sequence: Synthetic oligonucleotide
ggacaccgcggctcagatcacccaa

SEQ ID NO: 385687 - DNA, 25 bp, Artificial Sequence
  Description of Artificial Sequence: Synthetic oligonucleotide
gacaccgcggctcagatcacccaac

SEQ ID NO: 385688 - DNA, 25 bp, Artificial Sequence
  Description of Artificial Sequence: Synthetic oligonucleotide
acaccgcggctcagatcacccaacg

SEQ ID NO: 385689 - DNA, 24 bp, Artificial Sequence
  Description of Artificial Sequence: Synthetic oligonucleotide
caccgcggctcagatcacccaacg

SEQ ID NO: 385690 - DNA, 26 bp, Artificial Sequence
  Description of Artificial Sequence: Synthetic oligonucleotide
accgcggctcagatcacccaacgcaa

SEQ ID NO: 385691 - DNA, 25 bp, Artificial Sequence
  Description of Artificial Sequence: Synthetic oligonucleotide
ccgcggctcagatcacccaacgcaa

SEQ ID NO: 385692 - DNA, 27 bp, Artificial Sequence
  Description of Artificial Sequence: Synthetic oligonucleotide
cgcggctcagatcacccaacgcaagtt

SEQ ID NO: 385693 - DNA, 27 bp, Artificial Sequence
  Description of Artificial Sequence: Synthetic oligonucleotide
gcggctcagatcacccaacgcaagttg

SEQ ID NO: 385694 - DNA, 27 bp, Artificial Sequence
  Description of Artificial Sequence: Synthetic oligonucleotide
cggctcagatcacccaacgcaagttgg

SEQ ID NO: 385695 - DNA, 28 bp, Artificial Sequence
  Description of Artificial Sequence: Synthetic oligonucleotide
ggctcagatcacccaacgcaagttggag

SEQ ID NO: 385696 - DNA, 28 bp, Artificial Sequence
  Description of Artificial Sequence: Synthetic oligonucleotide
gctcagatcacccaacgcaagttggagg

SEQ ID NO: 385697 - DNA, 28 bp, Artificial Sequence
  Description of Artificial Sequence: Synthetic oligonucleotide
ctcagatcacccaacgcaagttggaggc

SEQ ID NO: 385698 - DNA, 28 bp, Artificial Sequence
  Description of Artificial Sequence: Synthetic oligonucleotide
tcagatcacccaacgcaagttggaggcg

SEQ ID NO: 385699 - DNA, 27 bp, Artificial Sequence
  Description of Artificial Sequence: Synthetic oligonucleotide
cagatcacccaacgcaagttggaggcg

SEQ ID NO: 385700 - DNA, 27 bp, Artificial Sequence
  Description of Artificial Sequence: Synthetic oligonucleotide
agatcacccaacgcaagttggaggcgg

SEQ ID NO: 385701 - DNA, 26 bp, Artificial Sequence
  Description of Artificial Sequence: Synthetic oligonucleotide
gatcacccaacgcaagttggaggcgg

SEQ ID NO: 385702 - DNA, 26 bp, Artificial Sequence
  Description of Artificial Sequence: Synthetic oligonucleotide
atcacccaacgcaagttggaggcggc

SEQ ID NO: 385703 - DNA, 25 bp, Artificial Sequence
  Description of Artificial Sequence: Synthetic oligonucleotide
tcacccaacgcaagttggaggcggc

SEQ ID NO: 385704 - DNA, 24 bp, Artificial Sequence
  Description of Artificial Sequence: Synthetic oligonucleotide
cacccaacgcaagttggaggcggc

SEQ ID NO: 385705 - DNA, 24 bp, Artificial Sequence
  Description of Artificial Sequence: Synthetic oligonucleotide
acccaacgcaagttggaggcggcc

SEQ ID NO: 385706 - DNA, 24 bp, Artificial Sequence
  Description of Artificial Sequence: Synthetic oligonucleotide
aacgcaagttggaggcggcccgtg

SEQ ID NO: 385707 - DNA, 23 bp, Artificial Sequence
  Description of Artificial Sequence: Synthetic oligonucleotide
acgcaagttggaggcggcccgtg

SEQ ID NO: 385708 - DNA, 25 bp, Artificial Sequence
  Description of Artificial Sequence: Synthetic oligonucleotide
actgacctggcagcgggatggggaa

SEQ ID NO: 385709 - DNA, 24 bp, Artificial Sequence
  Description of Artificial Sequence: Synthetic oligonucleotide
ctgacctggcagcgggatggggaa

SEQ ID NO: 385710 - DNA, 25 bp, Artificial Sequence
  Description of Artificial Sequence: Synthetic oligonucleotide
tgacctggcagcgggatggggaaga

SEQ ID NO: 385711 - DNA, 24 bp, Artificial Sequence
  Description of Artificial Sequence: Synthetic oligonucleotide
gacctggcagcgggatggggaaga

SEQ ID NO: 385712 - DNA, 24 bp, Artificial Sequence
  Description of Artificial Sequence: Synthetic oligonucleotide
acctggcagcgggatggggaagac

SEQ ID NO: 385713 - DNA, 23 bp, Artificial Sequence
  Description of Artificial Sequence: Synthetic oligonucleotide
cctggcagcgggatggggaagac

SEQ ID NO: 385714 - DNA, 24 bp, Artificial Sequence
  Description of Artificial Sequence: Synthetic oligonucleotide
ctggcagcgggatggggaagacca

SEQ ID NO: 385715 - DNA, 25 bp, Artificial Sequence
  Description of Artificial Sequence: Synthetic oligonucleotide
tggcagcgggatggggaagaccaga

SEQ ID NO: 385716 - DNA, 24 bp, Artificial Sequence
  Description of Artificial Sequence: Synthetic oligonucleotide
ggcagcgggatggggaagaccaga

SEQ ID NO: 385717 - DNA, 24 bp, Artificial Sequence
  Description of Artificial Sequence: Synthetic oligonucleotide
gcagcgggatggggaagaccagac

SEQ ID NO: 385718 - DNA, 24 bp, Artificial Sequence
  Description of Artificial Sequence: Synthetic oligonucleotide
cagcgggatggggaagaccagacc

SEQ ID NO: 385719 - DNA, 25 bp, Artificial Sequence
  Description of Artificial Sequence: Synthetic oligonucleotide
agcgggatggggaagaccagaccca

SEQ ID NO: 385720 - DNA, 24 bp, Artificial Sequence
  Description of Artificial Sequence: Synthetic oligonucleotide
gcgggatggggaagaccagaccca

SEQ ID NO: 385721 - DNA, 24 bp, Artificial Sequence
  Description of Artificial Sequence: Synthetic oligonucleotide
cgggatggggaagaccagacccag

SEQ ID NO: 385722 - DNA, 25 bp, Artificial Sequence
  Description of Artificial Sequence: Synthetic oligonucleotide
gggatggggaagaccagacccagga

SEQ ID NO: 385723 - DNA, 26 bp, Artificial Sequence
  Description of Artificial Sequence: Synthetic oligonucleotide
ggatggggaagaccagacccaggaca

SEQ ID NO: 385724 - DNA, 26 bp, Artificial Sequence
  Description of Artificial Sequence: Synthetic oligonucleotide
gatggggaagaccagacccaggacac

SEQ ID NO: 385725 - DNA, 26 bp, Artificial Sequence
  Description of Artificial Sequence: Synthetic oligonucleotide
atggggaagaccagacccaggacacc

SEQ ID NO: 385726 - DNA, 25 bp, Artificial Sequence
  Description of Artificial Sequence: Synthetic oligonucleotide
tggggaagaccagacccaggacacc

SEQ ID NO: 385727 - DNA, 24 bp, Artificial Sequence
  Description of Artificial Sequence: Synthetic oligonucleotide
ggggaagaccagacccaggacacc

SEQ ID NO: 385728 - DNA, 25 bp, Artificial Sequence
  Description of Artificial Sequence: Synthetic oligonucleotide
gggaagaccagacccaggacaccga

SEQ ID NO: 385729 - DNA, 25 bp, Artificial Sequence
  Description of Artificial Sequence: Synthetic oligonucleotide
ggaagaccagacccaggacaccgag

SEQ ID NO: 385730 - DNA, 27 bp, Artificial Sequence
  Description of Artificial Sequence: Synthetic oligonucleotide
gaagaccagacccaggacaccgagctt

SEQ ID NO: 385731 - DNA, 27 bp, Artificial Sequence
  Description of Artificial Sequence: Synthetic oligonucleotide
aagaccagacccaggacaccgagcttg

SEQ ID NO: 385732 - DNA, 27 bp, Artificial Sequence
  Description of Artificial Sequence: Synthetic oligonucleotide
agaccagacccaggacaccgagcttgt

SEQ ID NO: 385733 - DNA, 22 bp, Artificial Sequence
  Description of Artificial Sequence: Synthetic oligonucleotide
ctcctggaccgctgcggacacc

SEQ ID NO: 385734 - DNA, 22 bp, Artificial Sequence
  Description of Artificial Sequence: Synthetic oligonucleotide
tcctggaccgctgcggacaccg

SEQ ID NO: 385735 - DNA, 21 bp, Artificial Sequence
  Description of Artificial Sequence: Synthetic oligonucleotide
cctggaccgctgcggacaccg

SEQ ID NO: 385736 - DNA, 21 bp, Artificial Sequence
  Description of Artificial Sequence: Synthetic oligonucleotide
ctggaccgctgcggacaccgc

SEQ ID NO: 385737 - DNA, 21 bp, Artificial Sequence
  Description of Artificial Sequence: Synthetic oligonucleotide
tggaccgctgcggacaccgcg

SEQ ID NO: 385738 - DNA, 20 bp, Artificial Sequence
  Description of Artificial Sequence: Synthetic oligonucleotide
ggaccgctgcggacaccgcg

SEQ ID NO: 385739 - DNA, 20 bp, Artificial Sequence
  Description of Artificial Sequence: Synthetic oligonucleotide
gaccgctgcggacaccgcgg

SEQ ID NO: 385740 - DNA, 21 bp, Artificial Sequence
  Description of Artificial Sequence: Synthetic oligonucleotide
accgctgcggacaccgcggct

SEQ ID NO: 385741 - DNA, 20 bp, Artificial Sequence
  Description of Artificial Sequence: Synthetic oligonucleotide
ccgctgcggacaccgcggct

SEQ ID NO: 385742 - DNA, 21 bp, Artificial Sequence
  Description of Artificial Sequence: Synthetic oligonucleotide
cgctgcggacaccgcggctca

SEQ ID NO: 385743 - DNA, 23 bp, Artificial Sequence
  Description of Artificial Sequence: Synthetic oligonucleotide
gctgcggacaccgcggctcagat

SEQ ID NO: 385744 - DNA, 24 bp, Artificial Sequence
  Description of Artificial Sequence: Synthetic oligonucleotide
ctgcggacaccgcggctcagatca

SEQ ID NO: 385745 - DNA, 24 bp, Artificial Sequence
  Description of Artificial Sequence: Synthetic oligonucleotide
tgcggacaccgcggctcagatcac

SEQ ID NO: 385746 - DNA, 28 bp, Artificial Sequence
  Description of Artificial Sequence: Synthetic oligonucleotide
aacctgcgcggctactacaaccagagtg

SEQ ID NO: 385747 - DNA, 27 bp, Artificial Sequence
  Description of Artificial Sequence: Synthetic oligonucleotide
acctgcgcggctactacaaccagagtg

SEQ ID NO: 385748 - DNA, 27 bp, Artificial Sequence
  Description of Artificial Sequence: Synthetic oligonucleotide
ggctactacaaccagagtgaggacggg

SEQ ID NO: 385749 - DNA, 28 bp, Artificial Sequence
  Description of Artificial Sequence: Synthetic oligonucleotide
gctactacaaccagagtgaggacgggtc

SEQ ID NO: 385750 - DNA, 29 bp, Artificial Sequence
  Description of Artificial Sequence: Synthetic oligonucleotide
ctactacaaccagagtgaggacgggtctc

SEQ ID NO: 385751 - DNA, 30 bp, Artificial Sequence
  Description of Artificial Sequence: Synthetic oligonucleotide
tactacaaccagagtgaggacgggtctcac

SEQ ID NO: 385752 - DNA, 29 bp, Artificial Sequence
  Description of Artificial Sequence: Synthetic oligonucleotide
actacaaccagagtgaggacgggtctcac

SEQ ID NO: 385753 - DNA, 28 bp, Artificial Sequence
  Description of Artificial Sequence: Synthetic oligonucleotide
ctacaaccagagtgaggacgggtctcac

SEQ ID NO: 385754 - DNA, 29 bp, Artificial Sequence
  Description of Artificial Sequence: Synthetic oligonucleotide
tacaaccagagtgaggacgggtctcacac

SEQ ID NO: 385755 - DNA, 28 bp, Artificial Sequence
  Description of Artificial Sequence: Synthetic oligonucleotide
acaaccagagtgaggacgggtctcacac

SEQ ID NO: 385756 - DNA, 27 bp, Artificial Sequence
  Description of Artificial Sequence: Synthetic oligonucleotide
caaccagagtgaggacgggtctcacac

SEQ ID NO: 385757 - DNA, 27 bp, Artificial Sequence
  Description of Artificial Sequence: Synthetic oligonucleotide
aaccagagtgaggacgggtctcacacc

SEQ ID NO: 385758 - DNA, 26 bp, Artificial Sequence
  Description of Artificial Sequence: Synthetic oligonucleotide
accagagtgaggacgggtctcacacc

SEQ ID NO: 385759 - DNA, 25 bp, Artificial Sequence
  Description of Artificial Sequence: Synthetic oligonucleotide
ccagagtgaggacgggtctcacacc

SEQ ID NO: 385760 - DNA, 26 bp, Artificial Sequence
  Description of Artificial Sequence: Synthetic oligonucleotide
cagagtgaggacgggtctcacaccct

SEQ ID NO: 385761 - DNA, 26 bp, Artificial Sequence
  Description of Artificial Sequence: Synthetic oligonucleotide
agagtgaggacgggtctcacaccctc

SEQ ID NO: 385762 - DNA, 25 bp, Artificial Sequence
  Description of Artificial Sequence: Synthetic oligonucleotide
gagtgaggacgggtctcacaccctc

SEQ ID NO: 385763 - DNA, 26 bp, Artificial Sequence
  Description of Artificial Sequence: Synthetic oligonucleotide
agtgaggacgggtctcacaccctcca

SEQ ID NO: 385764 - DNA, 25 bp, Artificial Sequence
  Description of Artificial Sequence: Synthetic oligonucleotide
gtgaggacgggtctcacaccctcca

SEQ ID NO: 385765 - DNA, 26 bp, Artificial Sequence
  Description of Artificial Sequence: Synthetic oligonucleotide
tgaggacgggtctcacaccctccaga

SEQ ID NO: 385766 - DNA, 22 bp, Artificial Sequence
  Description of Artificial Sequence: Synthetic oligonucleotide
gtgggtggagcaggaggggcca

SEQ ID NO: 385767 - DNA, 23 bp, Artificial Sequence
  Description of Artificial Sequence: Synthetic oligonucleotide
tgggtggagcaggaggggccaga

SEQ ID NO: 385768 - DNA, 22 bp, Artificial Sequence
  Description of Artificial Sequence: Synthetic oligonucleotide
gggtggagcaggaggggccaga

SEQ ID NO: 385769 - DNA, 26 bp, Artificial Sequence
  Description of Artificial Sequence: Synthetic oligonucleotide
ggtggagcaggaggggccagagtatt

SEQ ID NO: 385770 - DNA, 26 bp, Artificial Sequence
  Description of Artificial Sequence: Synthetic oligonucleotide
gtggagcaggaggggccagagtattg

SEQ ID NO: 385771 - DNA, 26 bp, Artificial Sequence
  Description of Artificial Sequence: Synthetic oligonucleotide
tggagcaggaggggccagagtattgg

SEQ ID NO: 385772 - DNA, 25 bp, Artificial Sequence
  Description of Artificial Sequence: Synthetic oligonucleotide
ggagcaggaggggccagagtattgg

SEQ ID NO: 385773 - DNA, 25 bp, Artificial Sequence
  Description of Artificial Sequence: Synthetic oligonucleotide
caggaggggccagagtattgggacc

SEQ ID NO: 385774 - DNA, 25 bp, Artificial Sequence
  Description of Artificial Sequence: Synthetic oligonucleotide
aggaggggccagagtattgggaccg

SEQ ID NO: 385775 - DNA, 24 bp, Artificial Sequence
  Description of Artificial Sequence: Synthetic oligonucleotide
ggaggggccagagtattgggaccg

SEQ ID NO: 385776 - DNA, 24 bp, Artificial Sequence
  Description of Artificial Sequence: Synthetic oligonucleotide
gaggggccagagtattgggaccgg

SEQ ID NO: 385777 - DNA, 25 bp, Artificial Sequence
  Description of Artificial Sequence: Synthetic oligonucleotide
aggggccagagtattgggaccggga

SEQ ID NO: 385778 - DNA, 24 bp, Artificial Sequence
  Description of Artificial Sequence: Synthetic oligonucleotide
ggggccagagtattgggaccggga

SEQ ID NO: 385779 - DNA, 25 bp, Artificial Sequence
  Description of Artificial Sequence: Synthetic oligonucleotide
gggccagagtattgggaccgggaga

SEQ ID NO: 385780 - DNA, 26 bp, Artificial Sequence
  Description of Artificial Sequence: Synthetic oligonucleotide
ggccagagtattgggaccgggagaca

SEQ ID NO: 385781 - DNA, 27 bp, Artificial Sequence
  Description of Artificial Sequence: Synthetic oligonucleotide
gccagagtattgggaccgggagacaca

SEQ ID NO: 385782 - DNA, 27 bp, Artificial Sequence
  Description of Artificial Sequence: Synthetic oligonucleotide
ccagagtattgggaccgggagacacag

SEQ ID NO: 385783 - DNA, 29 bp, Artificial Sequence
  Description of Artificial Sequence: Synthetic oligonucleotide
cagagtattgggaccgggagacacagaag

SEQ ID NO: 385784 - DNA, 31 bp, Artificial Sequence; identical to SEQ ID NO: 47087
  Description of Artificial Sequence: Synthetic oligonucleotide

SEQ ID NO: 385785 - DNA, 25 bp, Artificial Sequence
  Description of Artificial Sequence: Synthetic oligonucleotide
ctgagagcctacctggagggcacct

SEQ ID NO: 385786 - DNA, 22 bp, Artificial Sequence
  Description of Artificial Sequence: Synthetic oligonucleotide
gagacgctgcagcgcgcggaac

SEQ ID NO: 385787 - DNA, 22 bp, Artificial Sequence
  Description of Artificial Sequence: Synthetic oligonucleotide
agacgctgcagcgcgcggaacc

SEQ ID NO: 385788 - DNA, 21 bp, Artificial Sequence
  Description of Artificial Sequence: Synthetic oligonucleotide
gacgctgcagcgcgcggaacc

SEQ ID NO: 385789 - DNA, 21 bp, Artificial Sequence
  Description of Artificial Sequence: Synthetic oligonucleotide
acgctgcagcgcgcggaaccc

SEQ ID NO: 385790 - DNA, 20 bp, Artificial Sequence
  Description of Artificial Sequence: Synthetic oligonucleotide
cgctgcagcgcgcggaaccc

SEQ ID NO: 385791 - DNA, 20 bp, Artificial Sequence
  Description of Artificial Sequence: Synthetic oligonucleotide
gctgcagcgcgcggaacccc

SEQ ID NO: 385792 - DNA, 23 bp, Artificial Sequence
  Description of Artificial Sequence: Synthetic oligonucleotide
ctgcagcgcgcggaacccccaaa

SEQ ID NO: 385793 - DNA, 24 bp, Artificial Sequence
  Description of Artificial Sequence: Synthetic oligonucleotide
tgcagcgcgcggaacccccaaaga

SEQ ID NO: 385794 - DNA, 23 bp, Artificial Sequence
  Description of Artificial Sequence: Synthetic oligonucleotide
gcagcgcgcggaacccccaaaga

SEQ ID NO: 385795 - DNA, 24 bp, Artificial Sequence
  Description of Artificial Sequence: Synthetic oligonucleotide
cagcgcgcggaacccccaaagaca

SEQ ID NO: 385796 - DNA, 25 bp, Artificial Sequence
  Description of Artificial Sequence: Synthetic oligonucleotide
agcgcgcggaacccccaaagacaca

SEQ ID NO: 385797 - DNA, 24 bp, Artificial Sequence
  Description of Artificial Sequence: Synthetic oligonucleotide
gcgcgcggaacccccaaagacaca

SEQ ID NO: 385798 - DNA, 24 bp, Artificial Sequence
  Description of Artificial Sequence: Synthetic oligonucleotide
cgcgcggaacccccaaagacacac

SEQ ID NO: 385799 - DNA, 25 bp, Artificial Sequence
  Description of Artificial Sequence: Synthetic oligonucleotide
gcgcggaacccccaaagacacacgt

SEQ ID NO: 385800 - DNA, 26 bp, Artificial Sequence
  Description of Artificial Sequence: Synthetic oligonucleotide
cgcggaacccccaaagacacacgtga

SEQ ID NO: 385801 - DNA, 26 bp, Artificial Sequence
  Description of Artificial Sequence: Synthetic oligonucleotide
gcggaacccccaaagacacacgtgac

SEQ ID NO: 385802 - DNA, 26 bp, Artificial Sequence
  Description of Artificial Sequence: Synthetic oligonucleotide
cggaacccccaaagacacacgtgacc

SEQ ID NO: 385803 - DNA, 27 bp, Artificial Sequence
  Description of Artificial Sequence: Synthetic oligonucleotide
ggaacccccaaagacacacgtgaccca

SEQ ID NO: 385804 - DNA, 24 bp, Artificial Sequence
  Description of Artificial Sequence: Synthetic oligonucleotide
ccgcggacaccgcggctcagatta

SEQ ID NO: 385805 - DNA, 24 bp, Artificial Sequence
  Description of Artificial Sequence: Synthetic oligonucleotide
cgcggacaccgcggctcagattac

SEQ ID NO: 385806 - DNA, 24 bp, Artificial Sequence
  Description of Artificial Sequence: Synthetic oligonucleotide
gcggacaccgcggctcagattacc

SEQ ID NO: 385807 - DNA, 25 bp, Artificial Sequence
  Description of Artificial Sequence: Synthetic oligonucleotide
cggacaccgcggctcagattaccca

SEQ ID NO: 385808 - DNA, 25 bp, Artificial Sequence
  Description of Artificial Sequence: Synthetic oligonucleotide
ggacaccgcggctcagattacccag

SEQ ID NO: 385809 - DNA, 25 bp, Artificial Sequence
  Description of Artificial Sequence: Synthetic oligonucleotide
gacaccgcggctcagattacccagc

SEQ ID NO: 385810 - DNA, 25 bp, Artificial Sequence
  Description of Artificial Sequence: Synthetic oligonucleotide
acaccgcggctcagattacccagcg

SEQ ID NO: 385811 - DNA, 24 bp, Artificial Sequence
  Description of Artificial Sequence: Synthetic oligonucleotide
caccgcggctcagattacccagcg

SEQ ID NO: 385812 - DNA, 26 bp, Artificial Sequence
  Description of Artificial Sequence: Synthetic oligonucleotide
accgcggctcagattacccagcgcaa

SEQ ID NO: 385813 - DNA, 25 bp, Artificial Sequence
  Description of Artificial Sequence: Synthetic oligonucleotide
ccgcggctcagattacccagcgcaa

SEQ ID NO: 385814 - DNA, 27 bp, Artificial Sequence
  Description of Artificial Sequence: Synthetic oligonucleotide
cgcggctcagattacccagcgcaagtt

SEQ ID NO: 385815 - DNA, 27 bp, Artificial Sequence
  Description of Artificial Sequence: Synthetic oligonucleotide
gcggctcagattacccagcgcaagttg

SEQ ID NO: 385816 - DNA, 27 bp, Artificial Sequence
  Description of Artificial Sequence: Synthetic oligonucleotide
cggctcagattacccagcgcaagttgg

SEQ ID NO: 385817 - DNA, 28 bp, Artificial Sequence
  Description of Artificial Sequence: Synthetic oligonucleotide
ggctcagattacccagcgcaagttggag

SEQ ID NO: 385818 - DNA, 28 bp, Artificial Sequence
  Description of Artificial Sequence: Synthetic oligonucleotide
gctcagattacccagcgcaagttggagg

SEQ ID NO: 385819 - DNA, 28 bp, Artificial Sequence
  Description of Artificial Sequence: Synthetic oligonucleotide
ctcagattacccagcgcaagttggaggc

SEQ ID NO: 385820 - DNA, 28 bp, Artificial Sequence
  Description of Artificial Sequence: Synthetic oligonucleotide
tcagattacccagcgcaagttggaggcg

SEQ ID NO: 385821 - DNA, 27 bp, Artificial Sequence
  Description of Artificial Sequence: Synthetic oligonucleotide
cagattacccagcgcaagttggaggcg

SEQ ID NO: 385822 - DNA, 27 bp, Artificial Sequence
  Description of Artificial Sequence: Synthetic oligonucleotide
agattacccagcgcaagttggaggcgg

SEQ ID NO: 385823 - DNA, 26 bp, Artificial Sequence
  Description of Artificial Sequence: Synthetic oligonucleotide
gattacccagcgcaagttggaggcgg

SEQ ID NO: 385824 - DNA, 26 bp, Artificial Sequence
  Description of Artificial Sequence: Synthetic oligonucleotide
attacccagcgcaagttggaggcggc

SEQ ID NO: 385825 - DNA, 25 bp, Artificial Sequence
  Description of Artificial Sequence: Synthetic oligonucleotide
ttacccagcgcaagttggaggcggc

SEQ ID NO: 385826 - DNA, 24 bp, Artificial Sequence
  Description of Artificial Sequence: Synthetic oligonucleotide
tacccagcgcaagttggaggcggc

SEQ ID NO: 385827 - DNA, 27 bp, Artificial Sequence
  Description of Artificial Sequence: Synthetic oligonucleotide
cgcggctcagatcactcagcgcaagtt

SEQ ID NO: 385828 - DNA, 27 bp, Artificial Sequence
  Description of Artificial Sequence: Synthetic oligonucleotide
gcggctcagatcactcagcgcaagttg

SEQ ID NO: 385829 - DNA, 27 bp, Artificial Sequence
  Description of Artificial Sequence: Synthetic oligonucleotide
cggctcagatcactcagcgcaagttgg

SEQ ID NO: 385830 - DNA, 28 bp, Artificial Sequence
  Description of Artificial Sequence: Synthetic oligonucleotide
ggctcagatcactcagcgcaagttggag

SEQ ID NO: 385831 - DNA, 28 bp, Artificial Sequence
  Description of Artificial Sequence: Synthetic oligonucleotide
gctcagatcactcagcgcaagttggagg

SEQ ID NO: 385832 - DNA, 28 bp, Artificial Sequence
  Description of Artificial Sequence: Synthetic oligonucleotide
ctcagatcactcagcgcaagttggaggc

SEQ ID NO: 385833 - DNA, 28 bp, Artificial Sequence
  Description of Artificial Sequence: Synthetic oligonucleotide
tcagatcactcagcgcaagttggaggcg

SEQ ID NO: 385834 - DNA, 27 bp, Artificial Sequence
  Description of Artificial Sequence: Synthetic oligonucleotide
cagatcactcagcgcaagttggaggcg

SEQ ID NO: 385835 - DNA, 27 bp, Artificial Sequence
  Description of Artificial Sequence: Synthetic oligonucleotide
agatcactcagcgcaagttggaggcgg

SEQ ID NO: 385836 - DNA, 26 bp, Artificial Sequence
  Description of Artificial Sequence: Synthetic oligonucleotide
gatcactcagcgcaagttggaggcgg

SEQ ID NO: 385837 - DNA, 26 bp, Artificial Sequence
  Description of Artificial Sequence: Synthetic oligonucleotide
atcactcagcgcaagttggaggcggc

SEQ ID NO: 385838 - DNA, 25 bp, Artificial Sequence
  Description of Artificial Sequence: Synthetic oligonucleotide
tcactcagcgcaagttggaggcggc

SEQ ID NO: 385839 - DNA, 24 bp, Artificial Sequence
  Description of Artificial Sequence: Synthetic oligonucleotide
cactcagcgcaagttggaggcggc

SEQ ID NO: 385840 - DNA, 24 bp, Artificial Sequence
  Description of Artificial Sequence: Synthetic oligonucleotide
actcagcgcaagttggaggcggcc

SEQ ID NO: 385841 - DNA, 23 bp, Artificial Sequence
  Description of Artificial Sequence: Synthetic oligonucleotide
ctcagcgcaagttggaggcggcc

SEQ ID NO: 385842 - DNA, 23 bp, Artificial Sequence
  Description of Artificial Sequence: Synthetic oligonucleotide
tcagcgcaagttggaggcggccc

SEQ ID NO: 385843 - DNA, 27 bp, Artificial Sequence
  Description of Artificial Sequence: Synthetic oligonucleotide
cagaagtacaagcgccaggcacaggca

SEQ ID NO: 385844 - DNA, 27 bp, Artificial Sequence
  Description of Artificial Sequence: Synthetic oligonucleotide
agaagtacaagcgccaggcacaggcag

SEQ ID NO: 385845 - DNA, 27 bp, Artificial Sequence
  Description of Artificial Sequence: Synthetic oligonucleotide
gaagtacaagcgccaggcacaggcaga

SEQ ID NO: 385846 - DNA, 27 bp, Artificial Sequence
  Description of Artificial Sequence: Synthetic oligonucleotide
aagtacaagcgccaggcacaggcagac

SEQ ID NO: 385847 - DNA, 26 bp, Artificial Sequence
  Description of Artificial Sequence: Synthetic oligonucleotide
agtacaagcgccaggcacaggcagac

SEQ ID NO: 385848 - DNA, 25 bp, Artificial Sequence
  Description of Artificial Sequence: Synthetic oligonucleotide
gtacaagcgccaggcacaggcagac

SEQ ID NO: 385849 - DNA, 25 bp, Artificial Sequence
  Description of Artificial Sequence: Synthetic oligonucleotide
tacaagcgccaggcacaggcagacc

SEQ ID NO: 385850 - DNA, 24 bp, Artificial Sequence
  Description of Artificial Sequence: Synthetic oligonucleotide
acaagcgccaggcacaggcagacc

SEQ ID NO: 385851 - DNA, 23 bp, Artificial Sequence
  Description of Artificial Sequence: Synthetic oligonucleotide
caagcgccaggcacaggcagacc

SEQ ID NO: 385852 - DNA, 24 bp, Artificial Sequence
  Description of Artificial Sequence: Synthetic oligonucleotide
aagcgccaggcacaggcagaccga

SEQ ID NO: 385853 - DNA, 23 bp, Artificial Sequence
  Description of Artificial Sequence: Synthetic oligonucleotide
agcgccaggcacaggcagaccga

SEQ ID NO: 385854 - DNA, 22 bp, Artificial Sequence
  Description of Artificial Sequence: Synthetic oligonucleotide
gcgccaggcacaggcagaccga

SEQ ID NO: 385855 - DNA, 23 bp, Artificial Sequence
  Description of Artificial Sequence: Synthetic oligonucleotide
cgccaggcacaggcagaccgagt

SEQ ID NO: 385856 - DNA, 24 bp, Artificial Sequence
  Description of Artificial Sequence: Synthetic oligonucleotide
gccaggcacaggcagaccgagtga

SEQ ID NO: 385857 - DNA, 24 bp, Artificial Sequence
  Description of Artificial Sequence: Synthetic oligonucleotide
ccaggcacaggcagaccgagtgag

SEQ ID NO: 385858 - DNA, 24 bp, Artificial Sequence
  Description of Artificial Sequence: Synthetic oligonucleotide
caggcacaggcagaccgagtgagc

SEQ ID NO: 385859 - DNA, 25 bp, Artificial Sequence
  Description of Artificial Sequence: Synthetic oligonucleotide
aggcacaggcagaccgagtgagcct

SEQ ID NO: 385860 - DNA, 24 bp, Artificial Sequence
  Description of Artificial Sequence: Synthetic oligonucleotide
ggcacaggcagaccgagtgagcct

SEQ ID NO: 385861 - DNA, 24 bp, Artificial Sequence
  Description of Artificial Sequence: Synthetic oligonucleotide
gcacaggcagaccgagtgagcctg

SEQ ID NO: 385862 - DNA, 24 bp, Artificial Sequence
  Description of Artificial Sequence: Synthetic oligonucleotide
cacaggcagaccgagtgagcctgc

SEQ ID NO: 385863 - DNA, 24 bp, Artificial Sequence
  Description of Artificial Sequence: Synthetic oligonucleotide
acaggcagaccgagtgagcctgcg

SEQ ID NO: 385864 - DNA, 23 bp, Artificial Sequence
  Description of Artificial Sequence: Synthetic oligonucleotide
caggcagaccgagtgagcctgcg

SEQ ID NO: 385865 - DNA, 25 bp, Artificial Sequence
  Description of Artificial Sequence: Synthetic oligonucleotide
aggcagaccgagtgagcctgcggaa

SEQ ID NO: 385866 - DNA, 24 bp, Artificial Sequence
  Description of Artificial Sequence: Synthetic oligonucleotide
ggcagaccgagtgagcctgcggaa

SEQ ID NO: 385867 - DNA, 24 bp, Artificial Sequence
  Description of Artificial Sequence: Synthetic oligonucleotide
gcagaccgagtgagcctgcggaac

SEQ ID NO: 385868 - DNA, 25 bp, Artificial Sequence
  Description of Artificial Sequence: Synthetic oligonucleotide
cagaccgagtgagcctgcggaacct

SEQ ID NO: 385869 - DNA, 25 bp, Artificial Sequence
  Description of Artificial Sequence: Synthetic oligonucleotide
agaccgagtgagcctgcggaacctg

SEQ ID NO: 385870 - DNA, 21 bp, Artificial Sequence
  Description of Artificial Sequence: Synthetic oligonucleotide
gacaccgctgtgtcccggccc

SEQ ID NO: 385871 - DNA, 21 bp, Artificial Sequence
  Description of Artificial Sequence: Synthetic oligonucleotide
tctggctgcgacctggggccg

SEQ ID NO: 385872 - DNA, 20 bp, Artificial Sequence
  Description of Artificial Sequence: Synthetic oligonucleotide
ctggctgcgacctggggccg

SEQ ID NO: 385873 - DNA, 29 bp, Artificial Sequence
  Description of Artificial Sequence: Synthetic oligonucleotide
actccatgaggtatttcgacaccgccgtc

SEQ ID NO: 385874 - DNA, 28 bp, Artificial Sequence
  Description of Artificial Sequence: Synthetic oligonucleotide
ctccatgaggtatttcgacaccgccgtc

SEQ ID NO: 385875 - DNA, 29 bp, Artificial Sequence
  Description of Artificial Sequence: Synthetic oligonucleotide
tccatgaggtatttcgacaccgccgtctc

SEQ ID NO: 385876 - DNA, 28 bp, Artificial Sequence
  Description of Artificial Sequence: Synthetic oligonucleotide
ccatgaggtatttcgacaccgccgtctc

SEQ ID NO: 385877 - DNA, 28 bp, Artificial Sequence
  Description of Artificial Sequence: Synthetic oligonucleotide
catgaggtatttcgacaccgccgtctcc

SEQ ID NO: 385878 - DNA, 28 bp, Artificial Sequence
  Description of Artificial Sequence: Synthetic oligonucleotide
atgaggtatttcgacaccgccgtctccc

SEQ ID NO: 385879 - DNA, 27 bp, Artificial Sequence
  Description of Artificial Sequence: Synthetic oligonucleotide
tgaggtatttcgacaccgccgtctccc

SEQ ID NO: 385880 - DNA, 26 bp, Artificial Sequence
  Description of Artificial Sequence: Synthetic oligonucleotide
gaggtatttcgacaccgccgtctccc

SEQ ID NO: 385881 - DNA, 26 bp, Artificial Sequence
  Description of Artificial Sequence: Synthetic oligonucleotide
aggtatttcgacaccgccgtctcccg

SEQ ID NO: 385882 - DNA, 25 bp, Artificial Sequence
  Description of Artificial Sequence: Synthetic oligonucleotide
ggtatttcgacaccgccgtctcccg

SEQ ID NO: 385883 - DNA, 25 bp, Artificial Sequence
  Description of Artificial Sequence: Synthetic oligonucleotide
gtatttcgacaccgccgtctcccgg

SEQ ID NO: 385884 - DNA, 25 bp, Artificial Sequence
  Description of Artificial Sequence: Synthetic oligonucleotide
tatttcgacaccgccgtctcccggc

SEQ ID NO: 385885 - DNA, 24 bp, Artificial Sequence
  Description of Artificial Sequence: Synthetic oligonucleotide
atttcgacaccgccgtctcccggc

SEQ ID NO: 385886 - DNA, 23 bp, Artificial Sequence
  Description of Artificial Sequence: Synthetic oligonucleotide
tttcgacaccgccgtctcccggc

SEQ ID NO: 385887 - DNA, 22 bp, Artificial Sequence
  Description of Artificial Sequence: Synthetic oligonucleotide
ttcgacaccgccgtctcccggc

SEQ ID NO: 385888 - DNA, 21 bp, Artificial Sequence
  Description of Artificial Sequence: Synthetic oligonucleotide
tcgacaccgccgtctcccggc

SEQ ID NO: 385889 - DNA, 20 bp, Artificial Sequence
  Description of Artificial Sequence: Synthetic oligonucleotide
cgacaccgccgtctcccggc

SEQ ID NO: 385890 - DNA, 20 bp, Artificial Sequence
  Description of Artificial Sequence: Synthetic oligonucleotide
gacaccgccgtctcccggcc

SEQ ID NO: 385891 - DNA, 20 bp, Artificial Sequence
  Description of Artificial Sequence: Synthetic oligonucleotide
acaccgccgtctcccggccc

SEQ ID NO: 385892 - DNA, 20 bp, Artificial Sequence
  Description of Artificial Sequence: Synthetic oligonucleotide
caccgccgtctcccggccct

SEQ ID NO: 385893 - DNA, 20 bp, Artificial Sequence
  Description of Artificial Sequence: Synthetic oligonucleotide
accgccgtctcccggcccgt

SEQ ID NO: 385894 - DNA, 20 bp, Artificial Sequence
  Description of Artificial Sequence: Synthetic oligonucleotide
ccgccgtctcccggcccgtt

SEQ ID NO: 385895 - DNA, 20 bp, Artificial Sequence
  Description of Artificial Sequence: Synthetic oligonucleotide
cgccgtctcccggcccggtt

SEQ ID NO: 385896 - DNA, 20 bp, Artificial Sequence
  Description of Artificial Sequence: Synthetic oligonucleotide
gccgtctcccggcccggctt

SEQ ID NO: 385897 - DNA, 27 bp, Artificial Sequence
  Description of Artificial Sequence: Synthetic oligonucleotide
ctgcggaacctgcgcggctactacaat

SEQ ID NO: 385898 - DNA, 27 bp, Artificial Sequence
  Description of Artificial Sequence: Synthetic oligonucleotide
tgcggaacctgcgcggctactacaatc

SEQ ID NO: 385899 - DNA, 27 bp, Artificial Sequence
  Description of Artificial Sequence: Synthetic oligonucleotide
gcggaacctgcgcggctactacaatca

SEQ ID NO: 385900 - DNA, 27 bp, Artificial Sequence
  Description of Artificial Sequence: Synthetic oligonucleotide
cggaacctgcgcggctactacaatcag

SEQ ID NO: 385901 - DNA, 28 bp, Artificial Sequence
  Description of Artificial Sequence: Synthetic oligonucleotide
ggaacctgcgcggctactacaatcagag

SEQ ID NO: 385902 - DNA, 28 bp, Artificial Sequence
  Description of Artificial Sequence: Synthetic oligonucleotide
gaacctgcgcggctactacaatcagagc

SEQ ID NO: 385903 - DNA, 28 bp, Artificial Sequence
  Description of Artificial Sequence: Synthetic oligonucleotide
aacctgcgcggctactacaatcagagcg

SEQ ID NO: 385904 - DNA, 27 bp, Artificial Sequence
  Description of Artificial Sequence: Synthetic oligonucleotide
acctgcgcggctactacaatcagagcg

SEQ ID NO: 385905 - DNA, 27 bp, Artificial Sequence
  Description of Artificial Sequence: Synthetic oligonucleotide
ggctactacaatcagagcgaggacggg

SEQ ID NO: 385906 - DNA, 28 bp, Artificial Sequence
  Description of Artificial Sequence: Synthetic oligonucleotide
gctactacaatcagagcgaggacgggtc

SEQ ID NO: 385907 - DNA, 29 bp, Artificial Sequence
  Description of Artificial Sequence: Synthetic oligonucleotide
ctactacaatcagagcgaggacgggtctc

SEQ ID NO: 385908 - DNA, 30 bp, Artificial Sequence; identical to SEQ ID NO: 47210
  Description of Artificial Sequence: Synthetic oligonucleotide

SEQ ID NO: 385909 - DNA, 29 bp, Artificial Sequence
  Description of Artificial Sequence: Synthetic oligonucleotide
actacaatcagagcgaggacgggtctcac

SEQ ID NO: 385910 - DNA, 28 bp, Artificial Sequence
  Description of Artificial Sequence: Synthetic oligonucleotide
ctacaatcagagcgaggacgggtctcac

SEQ ID NO: 385911 - DNA, 29 bp, Artificial Sequence
  Description of Artificial Sequence: Synthetic oligonucleotide
tacaatcagagcgaggacgggtctcacac

SEQ ID NO: 385912 - DNA, 28 bp, Artificial Sequence
  Description of Artificial Sequence: Synthetic oligonucleotide
acaatcagagcgaggacgggtctcacac

SEQ ID NO: 385913 - DNA, 27 bp, Artificial Sequence
  Description of Artificial Sequence: Synthetic oligonucleotide
caatcagagcgaggacgggtctcacac

SEQ ID NO: 385914 - DNA, 27 bp, Artificial Sequence
  Description of Artificial Sequence: Synthetic oligonucleotide
aatcagagcgaggacgggtctcacacc

SEQ ID NO: 385915 - DNA, 26 bp, Artificial Sequence
  Description of Artificial Sequence: Synthetic oligonucleotide
atcagagcgaggacgggtctcacacc

SEQ ID NO: 385916 - DNA, 25 bp, Artificial Sequence
  Description of Artificial Sequence: Synthetic oligonucleotide
tcagagcgaggacgggtctcacacc

SEQ ID NO: 385917 - DNA, 26 bp, Artificial Sequence
  Description of Artificial Sequence: Synthetic oligonucleotide
tccgcgggtatgaccagtccgcctat

SEQ ID NO: 385918 - DNA, 25 bp, Artificial Sequence
  Description of Artificial Sequence: Synthetic oligonucleotide
ccgcgggtatgaccagtccgcctat

SEQ ID NO: 385919 - DNA, 26 bp, Artificial Sequence
  Description of Artificial Sequence: Synthetic oligonucleotide
cgcgggtatgaccagtccgcctatga

SEQ ID NO: 385920 - DNA, 26 bp, Artificial Sequence
  Description of Artificial Sequence: Synthetic oligonucleotide
gcgggtatgaccagtccgcctatgac

SEQ ID NO: 385921 - DNA, 26 bp, Artificial Sequence
  Description of Artificial Sequence: Synthetic oligonucleotide
cgggtatgaccagtccgcctatgacg

SEQ ID NO: 385922 - DNA, 26 bp, Artificial Sequence
  Description of Artificial Sequence: Synthetic oligonucleotide
gggtatgaccagtccgcctatgacgg

SEQ ID NO: 385923 - DNA, 27 bp, Artificial Sequence
  Description of Artificial Sequence: Synthetic oligonucleotide
ggtatgaccagtccgcctatgacggca

SEQ ID NO: 385924 - DNA, 28 bp, Artificial Sequence
  Description of Artificial Sequence: Synthetic oligonucleotide
gtatgaccagtccgcctatgacggcaag

SEQ ID NO: 385925 - DNA, 28 bp, Artificial Sequence
  Description of Artificial Sequence: Synthetic oligonucleotide
tatgaccagtccgcctatgacggcaagg

SEQ ID NO: 385926 - DNA, 27 bp, Artificial Sequence
  Description of Artificial Sequence: Synthetic oligonucleotide
atgaccagtccgcctatgacggcaagg

SEQ ID NO: 385927 - DNA, 27 bp, Artificial Sequence
  Description of Artificial Sequence: Synthetic oligonucleotide
tgaccagtccgcctatgacggcaagga

SEQ ID NO: 385928 - DNA, 27 bp, Artificial Sequence
  Description of Artificial Sequence: Synthetic oligonucleotide
gaccagtccgcctatgacggcaaggat

SEQ ID NO: 385929 - DNA, 29 bp, Artificial Sequence
  Description of Artificial Sequence: Synthetic oligonucleotide
accagtccgcctatgacggcaaggattac

SEQ ID NO: 385930 - DNA, 28 bp, Artificial Sequence
  Description of Artificial Sequence: Synthetic oligonucleotide
ccagtccgcctatgacggcaaggattac

SEQ ID NO: 385931 - DNA, 30 bp, Artificial Sequence
  Description of Artificial Sequence: Synthetic oligonucleotide
cagtccgcctatgacggcaaggattacatc

SEQ ID NO: 385932 - DNA, 30 bp, Artificial Sequence
  Description of Artificial Sequence: Synthetic oligonucleotide
agtccgcctatgacggcaaggattacatcg

SEQ ID NO: 385933 - DNA, 29 bp, Artificial Sequence
  Description of Artificial Sequence: Synthetic oligonucleotide
gtccgcctatgacggcaaggattacatcg

SEQ ID NO: 385934 - DNA, 29 bp, Artificial Sequence
  Description of Artificial Sequence: Synthetic oligonucleotide
tccgcctatgacggcaaggattacatcgc

SEQ ID NO: 385935 - DNA, 28 bp, Artificial Sequence
  Description of Artificial Sequence: Synthetic oligonucleotide
ccgcctatgacggcaaggattacatcgc

SEQ ID NO: 385936 - DNA, 27 bp, Artificial Sequence
  Description of Artificial Sequence: Synthetic oligonucleotide
gcgcggctactataaccagagcgagga

SEQ ID NO: 385937 - DNA, 27 bp, Artificial Sequence
  Description of Artificial Sequence: Synthetic oligonucleotide
cgcggctactataaccagagcgaggac

SEQ ID NO: 385938 - DNA, 27 bp, Artificial Sequence
  Description of Artificial Sequence: Synthetic oligonucleotide
gcggctactataaccagagcgaggacg

SEQ ID NO: 385939 - DNA, 27 bp, Artificial Sequence
  Description of Artificial Sequence: Synthetic oligonucleotide
cggctactataaccagagcgaggacgg

SEQ ID NO: 385940 - DNA, 27 bp, Artificial Sequence
  Description of Artificial Sequence: Synthetic oligonucleotide
ggctactataaccagagcgaggacggg

SEQ ID NO: 385941 - DNA, 28 bp, Artificial Sequence
  Description of Artificial Sequence: Synthetic oligonucleotide
gctactataaccagagcgaggacgggtc

SEQ ID NO: 385942 - DNA, 29 bp, Artificial Sequence
  Description of Artificial Sequence: Synthetic oligonucleotide
ctactataaccagagcgaggacgggtctc

SEQ ID NO: 385943 - DNA, 30 bp, Artificial Sequence; identical to SEQ ID NO: 47300
  Description of Artificial Sequence: Synthetic oligonucleotide

SEQ ID NO: 385944 - DNA, 29 bp, Artificial Sequence
  Description of Artificial Sequence: Synthetic oligonucleotide
actataaccagagcgaggacgggtctcac

SEQ ID NO: 385945 - DNA, 28 bp, Artificial Sequence
  Description of Artificial Sequence: Synthetic oligonucleotide
ctataaccagagcgaggacgggtctcac

SEQ ID NO: 385946 - DNA, 29 bp, Artificial Sequence
  Description of Artificial Sequence: Synthetic oligonucleotide
tataaccagagcgaggacgggtctcacac

SEQ ID NO: 385947 - DNA, 28 bp, Artificial Sequence
  Description of Artificial Sequence: Synthetic oligonucleotide
ataaccagagcgaggacgggtctcacac

SEQ ID NO: 385948 - DNA, 27 bp, Artificial Sequence
  Description of Artificial Sequence: Synthetic oligonucleotide
taaccagagcgaggacgggtctcacac

SEQ ID NO: 385949 - DNA, 24 bp, Artificial Sequence
  Description of Artificial Sequence: Synthetic oligonucleotide
cgagtgagcctgcggaacctgcgt

SEQ ID NO: 385950 - DNA, 24 bp, Artificial Sequence
  Description of Artificial Sequence: Synthetic oligonucleotide
gagtgagcctgcggaacctgcgtg

SEQ ID NO: 385951 - DNA, 24 bp, Artificial Sequence
  Description of Artificial Sequence: Synthetic oligonucleotide
agtgagcctgcggaacctgcgtgg

SEQ ID NO: 385952 - DNA, 23 bp, Artificial Sequence
  Description of Artificial Sequence: Synthetic oligonucleotide
gtgagcctgcggaacctgcgtgg

SEQ ID NO: 385953 - DNA, 25 bp, Artificial Sequence
  Description of Artificial Sequence: Synthetic oligonucleotide
tgagcctgcggaacctgcgtggcta

SEQ ID NO: 385954 - DNA, 24 bp, Artificial Sequence
  Description of Artificial Sequence: Synthetic oligonucleotide
gagcctgcggaacctgcgtggcta

SEQ ID NO: 385955 - DNA, 26 bp, Artificial Sequence
  Description of Artificial Sequence: Synthetic oligonucleotide
agcctgcggaacctgcgtggctacta

SEQ ID NO: 385956 - DNA, 25 bp, Artificial Sequence
  Description of Artificial Sequence: Synthetic oligonucleotide
gcctgcggaacctgcgtggctacta

SEQ ID NO: 385957 - DNA, 27 bp, Artificial Sequence
  Description of Artificial Sequence: Synthetic oligonucleotide
cctgcggaacctgcgtggctactacaa

SEQ ID NO: 385958 - DNA, 27 bp, Artificial Sequence
  Description of Artificial Sequence: Synthetic oligonucleotide
ctgcggaacctgcgtggctactacaac

SEQ ID NO: 385959 - DNA, 27 bp, Artificial Sequence
  Description of Artificial Sequence: Synthetic oligonucleotide
tgcggaacctgcgtggctactacaacc

SEQ ID NO: 385960 - DNA, 27 bp, Artificial Sequence
  Description of Artificial Sequence: Synthetic oligonucleotide
gcggaacctgcgtggctactacaacca

SEQ ID NO: 385961 - DNA, 27 bp, Artificial Sequence
  Description of Artificial Sequence: Synthetic oligonucleotide
cggaacctgcgtggctactacaaccag

SEQ ID NO: 385962 - DNA, 28 bp, Artificial Sequence
  Description of Artificial Sequence: Synthetic oligonucleotide
ggaacctgcgtggctactacaaccagag

SEQ ID NO: 385963 - DNA, 28 bp, Artificial Sequence
  Description of Artificial Sequence: Synthetic oligonucleotide
gaacctgcgtggctactacaaccagagc

SEQ ID NO: 385964 - DNA, 28 bp, Artificial Sequence
  Description of Artificial Sequence: Synthetic oligonucleotide
aacctgcgtggctactacaaccagagcg

SEQ ID NO: 385965 - DNA, 27 bp, Artificial Sequence
  Description of Artificial Sequence: Synthetic oligonucleotide
acctgcgtggctactacaaccagagcg

SEQ ID NO: 385966 - DNA, 27 bp, Artificial Sequence
  Description of Artificial Sequence: Synthetic oligonucleotide
agctgagagcctacctggagggcactt

SEQ ID NO: 385967 - DNA, 26 bp, Artificial Sequence
  Description of Artificial Sequence: Synthetic oligonucleotide
gctgagagcctacctggagggcactt

SEQ ID NO: 385968 - DNA, 26 bp, Artificial Sequence
  Description of Artificial Sequence: Synthetic oligonucleotide
ctgagagcctacctggagggcacttg

SEQ ID NO: 385969 - DNA, 26 bp, Artificial Sequence
  Description of Artificial Sequence: Synthetic oligonucleotide
tgagagcctacctggagggcacttgc

SEQ ID NO: 385970 - DNA, 27 bp, Artificial Sequence
  Description of Artificial Sequence: Synthetic oligonucleotide
caaagacacacgtgacccaccatcccc

SEQ ID NO: 385971 - DNA, 28 bp, Artificial Sequence
  Description of Artificial Sequence: Synthetic oligonucleotide
aaagacacacgtgacccaccatcccctc

SEQ ID NO: 385972 - DNA, 27 bp, Artificial Sequence
  Description of Artificial Sequence: Synthetic oligonucleotide
aagacacacgtgacccaccatcccctc

SEQ ID NO: 385973 - DNA, 27 bp, Artificial Sequence
  Description of Artificial Sequence: Synthetic oligonucleotide
agacacacgtgacccaccatcccctct

SEQ ID NO: 385974 - DNA, 26 bp, Artificial Sequence
  Description of Artificial Sequence: Synthetic oligonucleotide
gacacacgtgacccaccatcccctct

SEQ ID NO: 385975 - DNA, 27 bp, Artificial Sequence
  Description of Artificial Sequence: Synthetic oligonucleotide
acacacgtgacccaccatcccctctct

SEQ ID NO: 385976 - DNA, 26 bp, Artificial Sequence
  Description of Artificial Sequence: Synthetic oligonucleotide
cacacgtgacccaccatcccctctct

SEQ ID NO: 385977 - DNA, 27 bp, Artificial Sequence
  Description of Artificial Sequence: Synthetic oligonucleotide
acacgtgacccaccatcccctctctga

SEQ ID NO: 385978 - DNA, 26 bp, Artificial Sequence
  Description of Artificial Sequence: Synthetic oligonucleotide
cacgtgacccaccatcccctctctga

SEQ ID NO: 385979 - DNA, 26 bp, Artificial Sequence
  Description of Artificial Sequence: Synthetic oligonucleotide
acgtgacccaccatcccctctctgac

SEQ ID NO: 385980 - DNA, 25 bp, Artificial Sequence
  Description of Artificial Sequence: Synthetic oligonucleotide
cgtgacccaccatcccctctctgac

SEQ ID NO: 385981 - DNA, 27 bp, Artificial Sequence
  Description of Artificial Sequence: Synthetic oligonucleotide
gtgacccaccatcccctctctgaccat

SEQ ID NO: 385982 - DNA, 27 bp, Artificial Sequence
  Description of Artificial Sequence: Synthetic oligonucleotide
tgacccaccatcccctctctgaccatg

SEQ ID NO: 385983 - DNA, 27 bp, Artificial Sequence
  Description of Artificial Sequence: Synthetic oligonucleotide
gacccaccatcccctctctgaccatga

SEQ ID NO: 385984 - DNA, 27 bp, Artificial Sequence
  Description of Artificial Sequence: Synthetic oligonucleotide
acccaccatcccctctctgaccatgag

SEQ ID NO: 385985 - DNA, 26 bp, Artificial Sequence
  Description of Artificial Sequence: Synthetic oligonucleotide
cccaccatcccctctctgaccatgag

SEQ ID NO: 385986 - DNA, 26 bp, Artificial Sequence
  Description of Artificial Sequence: Synthetic oligonucleotide
ccaccatcccctctctgaccatgagg

SEQ ID NO: 385987 - DNA, 26 bp, Artificial Sequence
  Description of Artificial Sequence: Synthetic oligonucleotide
caccatcccctctctgaccatgaggc

SEQ ID NO: 385988 - DNA, 27 bp, Artificial Sequence
  Description of Artificial Sequence: Synthetic oligonucleotide
accatcccctctctgaccatgaggcca

SEQ ID NO: 385989 - DNA, 26 bp, Artificial Sequence
  Description of Artificial Sequence: Synthetic oligonucleotide
ccatcccctctctgaccatgaggcca

SEQ ID NO: 385990 - DNA, 26 bp, Artificial Sequence
  Description of Artificial Sequence: Synthetic oligonucleotide
catcccctctctgaccatgaggccac

SEQ ID NO: 385991 - DNA, 26 bp, Artificial Sequence
  Description of Artificial Sequence: Synthetic oligonucleotide
atcccctctctgaccatgaggccacc

SEQ ID NO: 385992 - DNA, 25 bp, Artificial Sequence
  Description of Artificial Sequence: Synthetic oligonucleotide
tcccctctctgaccatgaggccacc

SEQ ID NO: 385993 - DNA, 24 bp, Artificial Sequence
  Description of Artificial Sequence: Synthetic oligonucleotide
aagagcccctcaccctgagctggg

SEQ ID NO: 385994 - DNA, 23 bp, Artificial Sequence
  Description of Artificial Sequence: Synthetic oligonucleotide
acgggcgcctcctccgcggttat

SEQ ID NO: 385995 - DNA, 22 bp, Artificial Sequence
  Description of Artificial Sequence: Synthetic oligonucleotide
cgggcgcctcctccgcggttat

SEQ ID NO: 385996 - DNA, 23 bp, Artificial Sequence
  Description of Artificial Sequence: Synthetic oligonucleotide
gggcgcctcctccgcggttatga

SEQ ID NO: 385997 - DNA, 23 bp, Artificial Sequence
  Description of Artificial Sequence: Synthetic oligonucleotide
ggcgcctcctccgcggttatgac

SEQ ID NO: 385998 - DNA, 24 bp, Artificial Sequence
  Description of Artificial Sequence: Synthetic oligonucleotide
gcgcctcctccgcggttatgacca

SEQ ID NO: 385999 - DNA, 25 bp, Artificial Sequence
  Description of Artificial Sequence: Synthetic oligonucleotide
cgcctcctccgcggttatgaccagt

SEQ ID NO: 386000 - DNA, 25 bp, Artificial Sequence
  Description of Artificial Sequence: Synthetic oligonucleotide
gcctcctccgcggttatgaccagtc

SEQ ID NO: 386001 - DNA, 25 bp, Artificial Sequence
  Description of Artificial Sequence: Synthetic oligonucleotide
cctcctccgcggttatgaccagtcc

SEQ ID NO: 386002 - DNA, 25 bp, Artificial Sequence
  Description of Artificial Sequence: Synthetic oligonucleotide
ctcctccgcggttatgaccagtccg

SEQ ID NO: 386003 - DNA, 25 bp, Artificial Sequence
  Description of Artificial Sequence: Synthetic oligonucleotide
tcctccgcggttatgaccagtccgc

SEQ ID NO: 386004 - DNA, 24 bp, Artificial Sequence
  Description of Artificial Sequence: Synthetic oligonucleotide
cctccgcggttatgaccagtccgc

SEQ ID NO: 386005 - DNA, 26 bp, Artificial Sequence
  Description of Artificial Sequence: Synthetic oligonucleotide
ctccgcggttatgaccagtccgccta

SEQ ID NO: 386006 - DNA, 26 bp, Artificial Sequence
  Description of Artificial Sequence: Synthetic oligonucleotide
tccgcggttatgaccagtccgcctac

SEQ ID NO: 386007 - DNA, 25 bp, Artificial Sequence
  Description of Artificial Sequence: Synthetic oligonucleotide
ccgcggttatgaccagtccgcctac

SEQ ID NO: 386008 - DNA, 26 bp, Artificial Sequence
  Description of Artificial Sequence: Synthetic oligonucleotide
cgcggttatgaccagtccgcctacga

SEQ ID NO: 386009 - DNA, 26 bp, Artificial Sequence
  Description of Artificial Sequence: Synthetic oligonucleotide
gcggttatgaccagtccgcctacgac

SEQ ID NO: 386010 - DNA, 26 bp, Artificial Sequence
  Description of Artificial Sequence: Synthetic oligonucleotide
cggttatgaccagtccgcctacgacg

SEQ ID NO: 386011 - DNA, 26 bp, Artificial Sequence
  Description of Artificial Sequence: Synthetic oligonucleotide
ggttatgaccagtccgcctacgacgg

SEQ ID NO: 386012 - DNA, 27 bp, Artificial Sequence
  Description of Artificial Sequence: Synthetic oligonucleotide
gttatgaccagtccgcctacgacggca

SEQ ID NO: 386013 - DNA, 28 bp, Artificial Sequence
  Description of Artificial Sequence: Synthetic oligonucleotide
ttatgaccagtccgcctacgacggcaag

SEQ ID NO: 386014 - DNA, 20 bp, Artificial Sequence
  Description of Artificial Sequence: Synthetic oligonucleotide
gccgcggacaccgcggcctt

SEQ ID NO: 386015 - DNA, 20 bp, Artificial Sequence
  Description of Artificial Sequence: Synthetic oligonucleotide
ccgcggacaccgcggcccat

SEQ ID NO: 386016 - DNA, 21 bp, Artificial Sequence
  Description of Artificial Sequence: Synthetic oligonucleotide
cgcggacaccgcggcccagat

SEQ ID NO: 386017 - DNA, 22 bp, Artificial Sequence
  Description of Artificial Sequence: Synthetic oligonucleotide
gcggacaccgcggcccagatca

SEQ ID NO: 386018 - DNA, 22 bp, Artificial Sequence
  Description of Artificial Sequence: Synthetic oligonucleotide
cggacaccgcggcccagatcac

SEQ ID NO: 386019 - DNA, 22 bp, Artificial Sequence
  Description of Artificial Sequence: Synthetic oligonucleotide
ggacaccgcggcccagatcacc

SEQ ID NO: 386020 - DNA, 23 bp, Artificial Sequence
  Description of Artificial Sequence: Synthetic oligonucleotide
gacaccgcggcccagatcaccca

SEQ ID NO: 386021 - DNA, 23 bp, Artificial Sequence
  Description of Artificial Sequence: Synthetic oligonucleotide
acaccgcggcccagatcacccag

SEQ ID NO: 386022 - DNA, 22 bp, Artificial Sequence
  Description of Artificial Sequence: Synthetic oligonucleotide
caccgcggcccagatcacccag

SEQ ID NO: 386023 - DNA, 22 bp, Artificial Sequence
  Description of Artificial Sequence: Synthetic oligonucleotide
accgcggcccagatcacccagc

SEQ ID NO: 386024 - DNA, 21 bp, Artificial Sequence
  Description of Artificial Sequence: Synthetic oligonucleotide
ccgcggcccagatcacccagc

SEQ ID NO: 386025 - DNA, 21 bp, Artificial Sequence
  Description of Artificial Sequence: Synthetic oligonucleotide
cgcggcccagatcacccagcg

SEQ ID NO: 386026 - DNA, 25 bp, Artificial Sequence
  Description of Artificial Sequence: Synthetic oligonucleotide
cggcccagatcacccagcgcaagtt

SEQ ID NO: 386027 - DNA, 25 bp, Artificial Sequence
  Description of Artificial Sequence: Synthetic oligonucleotide
ggcccagatcacccagcgcaagttg

SEQ ID NO: 386028 - DNA, 26 bp, Artificial Sequence
  Description of Artificial Sequence: Synthetic oligonucleotide
gcccagatcacccagcgcaagttgga

SEQ ID NO: 386029 - DNA, 26 bp, Artificial Sequence
  Description of Artificial Sequence: Synthetic oligonucleotide
cccagatcacccagcgcaagttggag

SEQ ID NO: 386030 - DNA, 26 bp, Artificial Sequence
  Description of Artificial Sequence: Synthetic oligonucleotide
ccagatcacccagcgcaagttggagg

SEQ ID NO: 386031 - DNA, 29 bp, Artificial Sequence
  Description of Artificial Sequence: Synthetic oligonucleotide
gctcgcactccatgaggtatttcgacacc

SEQ ID NO: 386032 - DNA, 29 bp, Artificial Sequence
  Description of Artificial Sequence: Synthetic oligonucleotide
ctcgcactccatgaggtatttcgacaccg

SEQ ID NO: 386033 - DNA, 29 bp, Artificial Sequence
  Description of Artificial Sequence: Synthetic oligonucleotide
tcgcactccatgaggtatttcgacaccgc

SEQ ID NO: 386034 - DNA, 28 bp, Artificial Sequence
  Description of Artificial Sequence: Synthetic oligonucleotide
cgcactccatgaggtatttcgacaccgc

SEQ ID NO: 386035 - DNA, 28 bp, Artificial Sequence
  Description of Artificial Sequence: Synthetic oligonucleotide
gcactccatgaggtatttcgacaccgcc

SEQ ID NO: 386036 - DNA, 30 bp, Artificial Sequence
  Description of Artificial Sequence: Synthetic oligonucleotide
gctcccattccatgaggtatttcgacaccg

SEQ ID NO: 386037 - DNA, 30 bp, Artificial Sequence
  Description of Artificial Sequence: Synthetic oligonucleotide
ctcccattccatgaggtatttcgacaccgc

SEQ ID NO: 386038 - DNA, 30 bp, Artificial Sequence
  Description of Artificial Sequence: Synthetic oligonucleotide
tcccattccatgaggtatttcgacaccgcc

SEQ ID NO: 386039 - DNA, 29 bp, Artificial Sequence
  Description of Artificial Sequence: Synthetic oligonucleotide
cccattccatgaggtatttcgacaccgcc

SEQ ID NO: 386040 - DNA, 29 bp, Artificial Sequence
  Description of Artificial Sequence: Synthetic oligonucleotide
ccattccatgaggtatttcgacaccgccg

SEQ ID NO: 386041 - DNA, 30 bp, Artificial Sequence
  Description of Artificial Sequence: Synthetic oligonucleotide
cattccatgaggtatttcgacaccgccgtg

SEQ ID NO: 386042 - DNA, 31 bp, Artificial Sequence
  Description of Artificial Sequence: Synthetic oligonucleotide
attccatgaggtatttcgacaccgccgtgtc

SEQ ID NO: 386043 - DNA, 30 bp, Artificial Sequence
  Description of Artificial Sequence: Synthetic oligonucleotide
ttccatgaggtatttcgacaccgccgtgtc

SEQ ID NO: 386044 - DNA, 22 bp, Artificial Sequence
  Description of Artificial Sequence: Synthetic oligonucleotide
gccgtgggtggagcaggagggt

SEQ ID NO: 386045 - DNA, 22 bp, Artificial Sequence
  Description of Artificial Sequence: Synthetic oligonucleotide
ccgtgggtggagcaggagggtc

SEQ ID NO: 386046 - DNA, 22 bp, Artificial Sequence
  Description of Artificial Sequence: Synthetic oligonucleotide
cgtgggtggagcaggagggtcc

SEQ ID NO: 386047 - DNA, 22 bp, Artificial Sequence
  Description of Artificial Sequence: Synthetic oligonucleotide
gtgggtggagcaggagggtccg

SEQ ID NO: 386048 - DNA, 23 bp, Artificial Sequence
  Description of Artificial Sequence: Synthetic oligonucleotide
tgggtggagcaggagggtccgga

SEQ ID NO: 386049 - DNA, 22 bp, Artificial Sequence
  Description of Artificial Sequence: Synthetic oligonucleotide
gggtggagcaggagggtccgga

SEQ ID NO: 386050 - DNA, 26 bp, Artificial Sequence
  Description of Artificial Sequence: Synthetic oligonucleotide
ggtggagcaggagggtccggagtatt

SEQ ID NO: 386051 - DNA, 26 bp, Artificial Sequence
  Description of Artificial Sequence: Synthetic oligonucleotide
gtggagcaggagggtccggagtattg

SEQ ID NO: 386052 - DNA, 26 bp, Artificial Sequence
  Description of Artificial Sequence: Synthetic oligonucleotide
tggagcaggagggtccggagtattgg

SEQ ID NO: 386053 - DNA, 25 bp, Artificial Sequence
  Description of Artificial Sequence: Synthetic oligonucleotide
ggagcaggagggtccggagtattgg

SEQ ID NO: 386054 - DNA, 24 bp, Artificial Sequence
  Description of Artificial Sequence: Synthetic oligonucleotide
gagggtccggagtattgggaccgg

SEQ ID NO: 386055 - DNA, 25 bp, Artificial Sequence
  Description of Artificial Sequence: Synthetic oligonucleotide
agggtccggagtattgggaccggga

SEQ ID NO: 386056 - DNA, 24 bp, Artificial Sequence
  Description of Artificial Sequence: Synthetic oligonucleotide
gggtccggagtattgggaccggga

SEQ ID NO: 386057 - DNA, 25 bp, Artificial Sequence
  Description of Artificial Sequence: Synthetic oligonucleotide
ggtccggagtattgggaccgggaga

SEQ ID NO: 386058 - DNA, 26 bp, Artificial Sequence
  Description of Artificial Sequence: Synthetic oligonucleotide
gtccggagtattgggaccgggagaca

SEQ ID NO: 386059 - DNA, 27 bp, Artificial Sequence
  Description of Artificial Sequence: Synthetic oligonucleotide
tccggagtattgggaccgggagacaca

SEQ ID NO: 386060 - DNA, 27 bp, Artificial Sequence
  Description of Artificial Sequence: Synthetic oligonucleotide
cagatcacccagcgcaagttggaggca

SEQ ID NO: 386061 - DNA, 27 bp, Artificial Sequence
  Description of Artificial Sequence: Synthetic oligonucleotide
agatcacccagcgcaagttggaggcag

SEQ ID NO: 386062 - DNA, 26 bp, Artificial Sequence
  Description of Artificial Sequence: Synthetic oligonucleotide
gatcacccagcgcaagttggaggcag

SEQ ID NO: 386063 - DNA, 26 bp, Artificial Sequence
  Description of Artificial Sequence: Synthetic oligonucleotide
atcacccagcgcaagttggaggcagc

SEQ ID NO: 386064 - DNA, 25 bp, Artificial Sequence
  Description of Artificial Sequence: Synthetic oligonucleotide
tcacccagcgcaagttggaggcagc

SEQ ID NO: 386065 - DNA, 24 bp, Artificial Sequence
  Description of Artificial Sequence: Synthetic oligonucleotide
cacccagcgcaagttggaggcagc

SEQ ID NO: 386066 - DNA, 24 bp, Artificial Sequence
  Description of Artificial Sequence: Synthetic oligonucleotide
acccagcgcaagttggaggcagcc

SEQ ID NO: 386067 - DNA, 23 bp, Artificial Sequence
  Description of Artificial Sequence: Synthetic oligonucleotide
cccagcgcaagttggaggcagcc

SEQ ID NO: 386068 - DNA, 23 bp, Artificial Sequence
  Description of Artificial Sequence: Synthetic oligonucleotide
ccagcgcaagttggaggcagccc

SEQ ID NO: 386069 - DNA, 24 bp, Artificial Sequence
  Description of Artificial Sequence: Synthetic oligonucleotide
cagcgcaagttggaggcagcccgt

SEQ ID NO: 386070 - DNA, 24 bp, Artificial Sequence
  Description of Artificial Sequence: Synthetic oligonucleotide
agcgcaagttggaggcagcccgtg

SEQ ID NO: 386071 - DNA, 23 bp, Artificial Sequence
  Description of Artificial Sequence: Synthetic oligonucleotide
gcgcaagttggaggcagcccgtg

SEQ ID NO: 386072 - DNA, 23 bp, Artificial Sequence
  Description of Artificial Sequence: Synthetic oligonucleotide
cgcaagttggaggcagcccgtgc

SEQ ID NO: 386073 - DNA, 23 bp, Artificial Sequence
  Description of Artificial Sequence: Synthetic oligonucleotide
gcaagttggaggcagcccgtgcg

SEQ ID NO: 386074 - DNA, 23 bp, Artificial Sequence
  Description of Artificial Sequence: Synthetic oligonucleotide
caagttggaggcagcccgtgcgg

SEQ ID NO: 386075 - DNA, 23 bp, Artificial Sequence
  Description of Artificial Sequence: Synthetic oligonucleotide
aagttggaggcagcccgtgcggc

SEQ ID NO: 386076 - DNA, 22 bp, Artificial Sequence
  Description of Artificial Sequence: Synthetic oligonucleotide
agttggaggcagcccgtgcggc

SEQ ID NO: 386077 - DNA, 21 bp, Artificial Sequence
  Description of Artificial Sequence: Synthetic oligonucleotide
gttggaggcagcccgtgcggc

SEQ ID NO: 386078 - DNA, 21 bp, Artificial Sequence
  Description of Artificial Sequence: Synthetic oligonucleotide
ttggaggcagcccgtgcggcg

SEQ ID NO: 386079 - DNA, 20 bp, Artificial Sequence
  Description of Artificial Sequence: Synthetic oligonucleotide
tggaggcagcccgtgcggcg

SEQ ID NO: 386080 - DNA, 20 bp, Artificial Sequence
  Description of Artificial Sequence: Synthetic oligonucleotide
ggaggcagcccgtgcggcgt

SEQ ID NO: 386081 - DNA, 20 bp, Artificial Sequence
  Description of Artificial Sequence: Synthetic oligonucleotide
gaggcagcccgtgcggcgga

SEQ ID NO: 386082 - DNA, 20 bp, Artificial Sequence
  Description of Artificial Sequence: Synthetic oligonucleotide
aggcagcccgtgcggcggag

SEQ ID NO: 386083 - DNA, 20 bp, Artificial Sequence
  Description of Artificial Sequence: Synthetic oligonucleotide
ggcagcccgtgcggcggagt

SEQ ID NO: 386084 - DNA, 20 bp, Artificial Sequence
  Description of Artificial Sequence: Synthetic oligonucleotide
gcagcccgtgcggcggagca

SEQ ID NO: 386085 - DNA, 20 bp, Artificial Sequence
  Description of Artificial Sequence: Synthetic oligonucleotide
cagcccgtgcggcggagcag

SEQ ID NO: 386086 - DNA, 21 bp, Artificial Sequence
  Description of Artificial Sequence: Synthetic oligonucleotide
agcccgtgcggcggagcagct

SEQ ID NO: 386087 - DNA, 28 bp, Artificial Sequence
  Description of Artificial Sequence: Synthetic oligonucleotide
aagtacaagcgccaggcacaggctgatc

SEQ ID NO: 386088 - DNA, 27 bp, Artificial Sequence
  Description of Artificial Sequence: Synthetic oligonucleotide
agtacaagcgccaggcacaggctgatc

SEQ ID NO: 386089 - DNA, 26 bp, Artificial Sequence
  Description of Artificial Sequence: Synthetic oligonucleotide
gtacaagcgccaggcacaggctgatc

SEQ ID NO: 386090 - DNA, 27 bp, Artificial Sequence
  Description of Artificial Sequence: Synthetic oligonucleotide
tacaagcgccaggcacaggctgatcga

SEQ ID NO: 386091 - DNA, 26 bp, Artificial Sequence
  Description of Artificial Sequence: Synthetic oligonucleotide
acaagcgccaggcacaggctgatcga

SEQ ID NO: 386092 - DNA, 25 bp, Artificial Sequence
  Description of Artificial Sequence: Synthetic oligonucleotide
caagcgccaggcacaggctgatcga

SEQ ID NO: 386093 - DNA, 26 bp, Artificial Sequence
  Description of Artificial Sequence: Synthetic oligonucleotide
aagcgccaggcacaggctgatcgagt

SEQ ID NO: 386094 - DNA, 25 bp, Artificial Sequence
  Description of Artificial Sequence: Synthetic oligonucleotide
agcgccaggcacaggctgatcgagt

SEQ ID NO: 386095 - DNA, 24 bp, Artificial Sequence
  Description of Artificial Sequence: Synthetic oligonucleotide
gcgccaggcacaggctgatcgagt

SEQ ID NO: 386096 - DNA, 25 bp, Artificial Sequence
  Description of Artificial Sequence: Synthetic oligonucleotide
cgccaggcacaggctgatcgagtga

SEQ ID NO: 386097 - DNA, 25 bp, Artificial Sequence
  Description of Artificial Sequence: Synthetic oligonucleotide
gccaggcacaggctgatcgagtgag

SEQ ID NO: 386098 - DNA, 25 bp, Artificial Sequence
  Description of Artificial Sequence: Synthetic oligonucleotide
ccaggcacaggctgatcgagtgagc

SEQ ID NO: 386099 - DNA, 26 bp, Artificial Sequence
  Description of Artificial Sequence: Synthetic oligonucleotide
caggcacaggctgatcgagtgagcct

SEQ ID NO: 386100 - DNA, 26 bp, Artificial Sequence
  Description of Artificial Sequence: Synthetic oligonucleotide
aggcacaggctgatcgagtgagcctg

SEQ ID NO: 386101 - DNA, 25 bp, Artificial Sequence
  Description of Artificial Sequence: Synthetic oligonucleotide
ggcacaggctgatcgagtgagcctg

SEQ ID NO: 386102 - DNA, 25 bp, Artificial Sequence
  Description of Artificial Sequence: Synthetic oligonucleotide
gcacaggctgatcgagtgagcctgc

SEQ ID NO: 386103 - DNA, 25 bp, Artificial Sequence
  Description of Artificial Sequence: Synthetic oligonucleotide
cacaggctgatcgagtgagcctgcg

SEQ ID NO: 386104 - DNA, 27 bp, Artificial Sequence
  Description of Artificial Sequence: Synthetic oligonucleotide
acaggctgatcgagtgagcctgcggaa

SEQ ID NO: 386105 - DNA, 26 bp, Artificial Sequence
  Description of Artificial Sequence: Synthetic oligonucleotide
caggctgatcgagtgagcctgcggaa

SEQ ID NO: 386106 - DNA, 26 bp, Artificial Sequence
  Description of Artificial Sequence: Synthetic oligonucleotide
aggctgatcgagtgagcctgcggaac

SEQ ID NO: 386107 - DNA, 25 bp, Artificial Sequence
  Description of Artificial Sequence: Synthetic oligonucleotide
ggctgatcgagtgagcctgcggaac

SEQ ID NO: 386108 - DNA, 26 bp, Artificial Sequence
  Description of Artificial Sequence: Synthetic oligonucleotide
gctgatcgagtgagcctgcggaacct

SEQ ID NO: 386109 - DNA, 20 bp, Artificial Sequence
  Description of Artificial Sequence: Synthetic oligonucleotide
ccgtgtcccggcccggcgtt

SEQ ID NO: 386110 - DNA, 20 bp, Artificial Sequence
  Description of Artificial Sequence: Synthetic oligonucleotide
cgtgtcccggcccggcgctt

SEQ ID NO: 386111 - DNA, 20 bp, Artificial Sequence
  Description of Artificial Sequence: Synthetic oligonucleotide
gtgtcccggcccggcgcctt

SEQ ID NO: 386112 - DNA, 20 bp, Artificial Sequence
  Description of Artificial Sequence: Synthetic oligonucleotide
tgtcccggcccggcgccgtt

SEQ ID NO: 386113 - DNA, 20 bp, Artificial Sequence
  Description of Artificial Sequence: Synthetic oligonucleotide
gtcccggcccggcgccgttt

SEQ ID NO: 386114 - DNA, 20 bp, Artificial Sequence
  Description of Artificial Sequence: Synthetic oligonucleotide
tcccggcccggcgccggatt

SEQ ID NO: 386115 - DNA, 20 bp, Artificial Sequence
  Description of Artificial Sequence: Synthetic oligonucleotide
cccggcccggcgccggattt

SEQ ID NO: 386116 - DNA, 20 bp, Artificial Sequence
  Description of Artificial Sequence: Synthetic oligonucleotide
ccggcccggcgccggagatt

SEQ ID NO: 386117 - DNA, 20 bp, Artificial Sequence
  Description of Artificial Sequence: Synthetic oligonucleotide
cggcccggcgccggagagtt

SEQ ID NO: 386118 - DNA, 20 bp, Artificial Sequence
  Description of Artificial Sequence: Synthetic oligonucleotide
ggcccggcgccggagagctt

SEQ ID NO: 386119 - DNA, 20 bp, Artificial Sequence
  Description of Artificial Sequence: Synthetic oligonucleotide
gcccggcgccggagagcctt

SEQ ID NO: 386120 - DNA, 20 bp, Artificial Sequence
  Description of Artificial Sequence: Synthetic oligonucleotide
cccggcgccggagagccctt

SEQ ID NO: 386121 - DNA, 20 bp, Artificial Sequence
  Description of Artificial Sequence: Synthetic oligonucleotide
ccggcgccggagagcccctt

SEQ ID NO: 386122 - DNA, 20 bp, Artificial Sequence
  Description of Artificial Sequence: Synthetic oligonucleotide
cggcgccggagagccccgtt

SEQ ID NO: 386123 - DNA, 20 bp, Artificial Sequence
  Description of Artificial Sequence: Synthetic oligonucleotide
ggcgccggagagccccgctt

SEQ ID NO: 386124 - DNA, 22 bp, Artificial Sequence
  Description of Artificial Sequence: Synthetic oligonucleotide
gcgccggagagccccgcttcat

SEQ ID NO: 386125 - DNA, 23 bp, Artificial Sequence
  Description of Artificial Sequence: Synthetic oligonucleotide
cgccggagagccccgcttcatct

SEQ ID NO: 386126 - DNA, 24 bp, Artificial Sequence
  Description of Artificial Sequence: Synthetic oligonucleotide
gccggagagccccgcttcatctca

SEQ ID NO: 386127 - DNA, 25 bp, Artificial Sequence
  Description of Artificial Sequence: Synthetic oligonucleotide
ccggagagccccgcttcatctcagt

SEQ ID NO: 386128 - DNA, 26 bp, Artificial Sequence
  Description of Artificial Sequence: Synthetic oligonucleotide
agcagctgagagcctacctggaggga

SEQ ID NO: 386129 - DNA, 25 bp, Artificial Sequence
  Description of Artificial Sequence: Synthetic oligonucleotide
gcagctgagagcctacctggaggga

SEQ ID NO: 386130 - DNA, 26 bp, Artificial Sequence
  Description of Artificial Sequence: Synthetic oligonucleotide
cagctgagagcctacctggagggact

SEQ ID NO: 386131 - DNA, 27 bp, Artificial Sequence
  Description of Artificial Sequence: Synthetic oligonucleotide
agctgagagcctacctggagggactgt

SEQ ID NO: 386132 - DNA, 26 bp, Artificial Sequence
  Description of Artificial Sequence: Synthetic oligonucleotide
gctgagagcctacctggagggactgt

SEQ ID NO: 386133 - DNA, 26 bp, Artificial Sequence
  Description of Artificial Sequence: Synthetic oligonucleotide
ctgagagcctacctggagggactgtg

SEQ ID NO: 386134 - DNA, 26 bp, Artificial Sequence
  Description of Artificial Sequence: Synthetic oligonucleotide
tgagagcctacctggagggactgtgc

SEQ ID NO: 386135 - DNA, 25 bp, Artificial Sequence
  Description of Artificial Sequence: Synthetic oligonucleotide
gagagcctacctggagggactgtgc

SEQ ID NO: 386136 - DNA, 26 bp, Artificial Sequence
  Description of Artificial Sequence: Synthetic oligonucleotide
agagcctacctggagggactgtgcgt

SEQ ID NO: 386137 - DNA, 25 bp, Artificial Sequence
  Description of Artificial Sequence: Synthetic oligonucleotide
gagcctacctggagggactgtgcgt

SEQ ID NO: 386138 - DNA, 25 bp, Artificial Sequence
  Description of Artificial Sequence: Synthetic oligonucleotide
agcctacctggagggactgtgcgtg

SEQ ID NO: 386139 - DNA, 24 bp, Artificial Sequence
  Description of Artificial Sequence: Synthetic oligonucleotide
gcctacctggagggactgtgcgtg

SEQ ID NO: 386140 - DNA, 25 bp, Artificial Sequence
  Description of Artificial Sequence: Synthetic oligonucleotide
cctacctggagggactgtgcgtgga

SEQ ID NO: 386141 - DNA, 26 bp, Artificial Sequence
  Description of Artificial Sequence: Synthetic oligonucleotide
ctacctggagggactgtgcgtggagt

SEQ ID NO: 386142 - DNA, 26 bp, Artificial Sequence
  Description of Artificial Sequence: Synthetic oligonucleotide
tacctggagggactgtgcgtggagtg

SEQ ID NO: 386143 - DNA, 25 bp, Artificial Sequence
  Description of Artificial Sequence: Synthetic oligonucleotide
acctggagggactgtgcgtggagtg

SEQ ID NO: 386144 - DNA, 24 bp, Artificial Sequence
  Description of Artificial Sequence: Synthetic oligonucleotide
cctggagggactgtgcgtggagtg

SEQ ID NO: 386145 - DNA, 24 bp, Artificial Sequence
  Description of Artificial Sequence: Synthetic oligonucleotide
ctggagggactgtgcgtggagtgg

SEQ ID NO: 386146 - DNA, 25 bp, Artificial Sequence
  Description of Artificial Sequence: Synthetic oligonucleotide
tggagggactgtgcgtggagtggct

SEQ ID NO: 386147 - DNA, 24 bp, Artificial Sequence
  Description of Artificial Sequence: Synthetic oligonucleotide
ggagggactgtgcgtggagtggct

SEQ ID NO: 386148 - DNA, 24 bp, Artificial Sequence
  Description of Artificial Sequence: Synthetic oligonucleotide
gagggactgtgcgtggagtggctc

SEQ ID NO: 386149 - DNA, 24 bp, Artificial Sequence
  Description of Artificial Sequence: Synthetic oligonucleotide
agggactgtgcgtggagtggctcc

SEQ ID NO: 386150 - DNA, 23 bp, Artificial Sequence
  Description of Artificial Sequence: Synthetic oligonucleotide
gggactgtgcgtggagtggctcc

SEQ ID NO: 386151 - DNA, 23 bp, Artificial Sequence
  Description of Artificial Sequence: Synthetic oligonucleotide
ggactgtgcgtggagtggctccg

SEQ ID NO: 386152 - DNA, 24 bp, Artificial Sequence
  Description of Artificial Sequence: Synthetic oligonucleotide
gactgtgcgtggagtggctccgca

SEQ ID NO: 386153 - DNA, 27 bp, Artificial Sequence
  Description of Artificial Sequence: Synthetic oligonucleotide
actgtgcgtggagtggctccgcagata

SEQ ID NO: 386154 - DNA, 32 bp, Artificial Sequence
  Description of Artificial Sequence: Synthetic oligonucleotide
aggattctccactcccctgagtttcacttctc

SEQ ID NO: 386155 - DNA, 26 bp, Artificial Sequence
  Description of Artificial Sequence: Synthetic oligonucleotide
cagagcgaggacgggtctcacacctt

SEQ ID NO: 386156 - DNA, 26 bp, Artificial Sequence
  Description of Artificial Sequence: Synthetic oligonucleotide
agagcgaggacgggtctcacaccttc

SEQ ID NO: 386157 - DNA, 25 bp, Artificial Sequence
  Description of Artificial Sequence: Synthetic oligonucleotide
gagcgaggacgggtctcacaccttc

SEQ ID NO: 386158 - DNA, 26 bp, Artificial Sequence
  Description of Artificial Sequence: Synthetic oligonucleotide
agcgaggacgggtctcacaccttcca

SEQ ID NO: 386159 - DNA, 25 bp, Artificial Sequence
  Description of Artificial Sequence: Synthetic oligonucleotide
gcgaggacgggtctcacaccttcca

SEQ ID NO: 386160 - DNA, 26 bp, Artificial Sequence
  Description of Artificial Sequence: Synthetic oligonucleotide
cgaggacgggtctcacaccttccaga

SEQ ID NO: 386161 - DNA, 26 bp, Artificial Sequence
  Description of Artificial Sequence: Synthetic oligonucleotide
gaggacgggtctcacaccttccagag

SEQ ID NO: 386162 - DNA, 27 bp, Artificial Sequence
  Description of Artificial Sequence: Synthetic oligonucleotide
aggacgggtctcacaccttccagagga

SEQ ID NO: 386163 - DNA, 27 bp, Artificial Sequence
  Description of Artificial Sequence: Synthetic oligonucleotide
ggacgggtctcacaccttccagaggat

SEQ ID NO: 386164 - DNA, 27 bp, Artificial Sequence
  Description of Artificial Sequence: Synthetic oligonucleotide
gacgggtctcacaccttccagaggatg

SEQ ID NO: 386165 - DNA, 30 bp, Artificial Sequence; identical to SEQ ID NO: 47272
  Description of Artificial Sequence: Synthetic oligonucleotide

SEQ ID NO: 386166 - DNA, 29 bp, Artificial Sequence
  Description of Artificial Sequence: Synthetic oligonucleotide
cgggtctcacaccttccagaggatgtatg

SEQ ID NO: 386167 - DNA, 29 bp, Artificial Sequence
  Description of Artificial Sequence: Synthetic oligonucleotide
gggtctcacaccttccagaggatgtatgg

SEQ ID NO: 386168 - DNA, 29 bp, Artificial Sequence
  Description of Artificial Sequence: Synthetic oligonucleotide
ggtctcacaccttccagaggatgtatggc

SEQ ID NO: 386169 - DNA, 30 bp, Artificial Sequence; identical to SEQ ID NO: 47276
  Description of Artificial Sequence: Synthetic oligonucleotide

SEQ ID NO: 386170 - DNA, 30 bp, Artificial Sequence; identical to SEQ ID NO: 10239
  Description of Artificial Sequence: Synthetic oligonucleotide

SEQ ID NO: 386171 - DNA, 29 bp, Artificial Sequence
  Description of Artificial Sequence: Synthetic oligonucleotide
ctcacaccttccagaggatgtatggctgc

SEQ ID NO: 386172 - DNA, 29 bp, Artificial Sequence
  Description of Artificial Sequence: Synthetic oligonucleotide
tcacaccttccagaggatgtatggctgcg

SEQ ID NO: 386173 - DNA, 28 bp, Artificial Sequence
  Description of Artificial Sequence: Synthetic oligonucleotide
cacaccttccagaggatgtatggctgcg

SEQ ID NO: 386174 - DNA, 29 bp, Artificial Sequence
  Description of Artificial Sequence: Synthetic oligonucleotide
acaccttccagaggatgtatggctgcgac

SEQ ID NO: 386175 - DNA, 28 bp, Artificial Sequence
  Description of Artificial Sequence: Synthetic oligonucleotide
caccttccagaggatgtatggctgcgac

SEQ ID NO: 386176 - DNA, 28 bp, Artificial Sequence
  Description of Artificial Sequence: Synthetic oligonucleotide
accttccagaggatgtatggctgcgacc

SEQ ID NO: 386177 - DNA, 27 bp, Artificial Sequence
  Description of Artificial Sequence: Synthetic oligonucleotide
ccttccagaggatgtatggctgcgacc

SEQ ID NO: 386178 - DNA, 28 bp, Artificial Sequence
  Description of Artificial Sequence: Synthetic oligonucleotide
cttccagaggatgtatggctgcgacctg

SEQ ID NO: 386179 - DNA, 28 bp, Artificial Sequence
  Description of Artificial Sequence: Synthetic oligonucleotide
ttccagaggatgtatggctgcgacctgg

SEQ ID NO: 386180 - DNA, 25 bp, Artificial Sequence
  Description of Artificial Sequence: Synthetic oligonucleotide
gcctcctccgcgggtatgaccagtt

SEQ ID NO: 386181 - DNA, 25 bp, Artificial Sequence
  Description of Artificial Sequence: Synthetic oligonucleotide
cctcctccgcgggtatgaccagttc

SEQ ID NO: 386182 - DNA, 25 bp, Artificial Sequence
  Description of Artificial Sequence: Synthetic oligonucleotide
ctcctccgcgggtatgaccagttcg

SEQ ID NO: 386183 - DNA, 25 bp, Artificial Sequence
  Description of Artificial Sequence: Synthetic oligonucleotide
tcctccgcgggtatgaccagttcgc

SEQ ID NO: 386184 - DNA, 24 bp, Artificial Sequence
  Description of Artificial Sequence: Synthetic oligonucleotide
cctccgcgggtatgaccagttcgc

SEQ ID NO: 386185 - DNA, 26 bp, Artificial Sequence
  Description of Artificial Sequence: Synthetic oligonucleotide
ctccgcgggtatgaccagttcgccta

SEQ ID NO: 386186 - DNA, 26 bp, Artificial Sequence
  Description of Artificial Sequence: Synthetic oligonucleotide
tccgcgggtatgaccagttcgcctac

SEQ ID NO: 386187 - DNA, 25 bp, Artificial Sequence
  Description of Artificial Sequence: Synthetic oligonucleotide
ccgcgggtatgaccagttcgcctac

SEQ ID NO: 386188 - DNA, 26 bp, Artificial Sequence
  Description of Artificial Sequence: Synthetic oligonucleotide
cgcgggtatgaccagttcgcctacga

SEQ ID NO: 386189 - DNA, 26 bp, Artificial Sequence
  Description of Artificial Sequence: Synthetic oligonucleotide
gcgggtatgaccagttcgcctacgac

SEQ ID NO: 386190 - DNA, 26 bp, Artificial Sequence
  Description of Artificial Sequence: Synthetic oligonucleotide
cgggtatgaccagttcgcctacgacg

SEQ ID NO: 386191 - DNA, 26 bp, Artificial Sequence
  Description of Artificial Sequence: Synthetic oligonucleotide
gggtatgaccagttcgcctacgacgg

SEQ ID NO: 386192 - DNA, 27 bp, Artificial Sequence
  Description of Artificial Sequence: Synthetic oligonucleotide
ggtatgaccagttcgcctacgacggca

SEQ ID NO: 386193 - DNA, 28 bp, Artificial Sequence
  Description of Artificial Sequence: Synthetic oligonucleotide
gtatgaccagttcgcctacgacggcaag

SEQ ID NO: 386194 - DNA, 28 bp, Artificial Sequence
  Description of Artificial Sequence: Synthetic oligonucleotide
tatgaccagttcgcctacgacggcaagg

SEQ ID NO: 386195 - DNA, 20 bp, Artificial Sequence
  Description of Artificial Sequence: Synthetic oligonucleotide
gcccgtgcggcggagcagga

SEQ ID NO: 386196 - DNA, 21 bp, Artificial Sequence
  Description of Artificial Sequence: Synthetic oligonucleotide
cccgtgcggcggagcaggaca

SEQ ID NO: 386197 - DNA, 22 bp, Artificial Sequence
  Description of Artificial Sequence: Synthetic oligonucleotide
ccgtgcggcggagcaggacaga

SEQ ID NO: 386198 - DNA, 22 bp, Artificial Sequence
  Description of Artificial Sequence: Synthetic oligonucleotide
cgtgcggcggagcaggacagag

SEQ ID NO: 386199 - DNA, 22 bp, Artificial Sequence
  Description of Artificial Sequence: Synthetic oligonucleotide
gtgcggcggagcaggacagagc

SEQ ID NO: 386200 - DNA, 24 bp, Artificial Sequence
  Description of Artificial Sequence: Synthetic oligonucleotide
tgcggcggagcaggacagagccta

SEQ ID NO: 386201 - DNA, 23 bp, Artificial Sequence
  Description of Artificial Sequence: Synthetic oligonucleotide
gcggcggagcaggacagagccta

SEQ ID NO: 386202 - DNA, 23 bp, Artificial Sequence
  Description of Artificial Sequence: Synthetic oligonucleotide
cggcggagcaggacagagcctac

SEQ ID NO: 386203 - DNA, 25 bp, Artificial Sequence
  Description of Artificial Sequence: Synthetic oligonucleotide
aagaagacgctgcagcgcgcggaac

SEQ ID NO: 386204 - DNA, 24 bp, Artificial Sequence
  Description of Artificial Sequence: Synthetic oligonucleotide
agaagacgctgcagcgcgcggaac

SEQ ID NO: 386205 - DNA, 23 bp, Artificial Sequence
  Description of Artificial Sequence: Synthetic oligonucleotide
gaagacgctgcagcgcgcggaac

SEQ ID NO: 386206 - DNA, 23 bp, Artificial Sequence
  Description of Artificial Sequence: Synthetic oligonucleotide
aagacgctgcagcgcgcggaacc

SEQ ID NO: 386207 - DNA, 29 bp, Artificial Sequence
  Description of Artificial Sequence: Synthetic oligonucleotide
acgggtctcacaccttccagaggatgtac

SEQ ID NO: 386208 - DNA, 28 bp, Artificial Sequence
  Description of Artificial Sequence: Synthetic oligonucleotide
cgggtctcacaccttccagaggatgtac

SEQ ID NO: 386209 - DNA, 28 bp, Artificial Sequence
  Description of Artificial Sequence: Synthetic oligonucleotide
gggtctcacaccttccagaggatgtacg

SEQ ID NO: 386210 - DNA, 28 bp, Artificial Sequence
  Description of Artificial Sequence: Synthetic oligonucleotide
ggtctcacaccttccagaggatgtacgg

SEQ ID NO: 386211 - DNA, 28 bp, Artificial Sequence
  Description of Artificial Sequence: Synthetic oligonucleotide
gtctcacaccttccagaggatgtacggc

SEQ ID NO: 386212 - DNA, 29 bp, Artificial Sequence
  Description of Artificial Sequence: Synthetic oligonucleotide
tctcacaccttccagaggatgtacggctg

SEQ ID NO: 386213 - DNA, 28 bp, Artificial Sequence
  Description of Artificial Sequence: Synthetic oligonucleotide
ctcacaccttccagaggatgtacggctg

SEQ ID NO: 386214 - DNA, 28 bp, Artificial Sequence
  Description of Artificial Sequence: Synthetic oligonucleotide
tcacaccttccagaggatgtacggctgc

SEQ ID NO: 386215 - DNA, 27 bp, Artificial Sequence
  Description of Artificial Sequence: Synthetic oligonucleotide
cacaccttccagaggatgtacggctgc

SEQ ID NO: 386216 - DNA, 27 bp, Artificial Sequence
  Description of Artificial Sequence: Synthetic oligonucleotide
acaccttccagaggatgtacggctgcg

SEQ ID NO: 386217 - DNA, 27 bp, Artificial Sequence
  Description of Artificial Sequence: Synthetic oligonucleotide
caccttccagaggatgtacggctgcga

SEQ ID NO: 386218 - DNA, 27 bp, Artificial Sequence
  Description of Artificial Sequence: Synthetic oligonucleotide
accttccagaggatgtacggctgcgac

SEQ ID NO: 386219 - DNA, 26 bp, Artificial Sequence
  Description of Artificial Sequence: Synthetic oligonucleotide
ccttccagaggatgtacggctgcgac

SEQ ID NO: 386220 - DNA, 27 bp, Artificial Sequence
  Description of Artificial Sequence: Synthetic oligonucleotide
cttccagaggatgtacggctgcgacct

SEQ ID NO: 386221 - DNA, 27 bp, Artificial Sequence
  Description of Artificial Sequence: Synthetic oligonucleotide
ttccagaggatgtacggctgcgacctg

SEQ ID NO: 386222 - DNA, 25 bp, Artificial Sequence
  Description of Artificial Sequence: Synthetic oligonucleotide
gtgcggcggagcaggacagagctta

SEQ ID NO: 386223 - DNA, 25 bp, Artificial Sequence
  Description of Artificial Sequence: Synthetic oligonucleotide
tgcggcggagcaggacagagcttac

SEQ ID NO: 386224 - DNA, 24 bp, Artificial Sequence
  Description of Artificial Sequence: Synthetic oligonucleotide
gcggcggagcaggacagagcttac

SEQ ID NO: 386225 - DNA, 25 bp, Artificial Sequence
  Description of Artificial Sequence: Synthetic oligonucleotide
cggcggagcaggacagagcttacct

SEQ ID NO: 386226 - DNA, 27 bp, Artificial Sequence
  Description of Artificial Sequence: Synthetic oligonucleotide
agcaggacagagcttacctggagggca

SEQ ID NO: 386227 - DNA, 26 bp, Artificial Sequence
  Description of Artificial Sequence: Synthetic oligonucleotide
gcaggacagagcttacctggagggca

SEQ ID NO: 386228 - DNA, 26 bp, Artificial Sequence
  Description of Artificial Sequence: Synthetic oligonucleotide
caggacagagcttacctggagggcac

SEQ ID NO: 386229 - DNA, 27 bp, Artificial Sequence
  Description of Artificial Sequence: Synthetic oligonucleotide
aggacagagcttacctggagggcacgt

SEQ ID NO: 386230 - DNA, 26 bp, Artificial Sequence
  Description of Artificial Sequence: Synthetic oligonucleotide
ggacagagcttacctggagggcacgt

SEQ ID NO: 386231 - DNA, 26 bp, Artificial Sequence
  Description of Artificial Sequence: Synthetic oligonucleotide
gacagagcttacctggagggcacgtg

SEQ ID NO: 386232 - DNA, 26 bp, Artificial Sequence
  Description of Artificial Sequence: Synthetic oligonucleotide
acagagcttacctggagggcacgtgc

SEQ ID NO: 386233 - DNA, 25 bp, Artificial Sequence
  Description of Artificial Sequence: Synthetic oligonucleotide
cagagcttacctggagggcacgtgc

SEQ ID NO: 386234 - DNA, 27 bp, Artificial Sequence
  Description of Artificial Sequence: Synthetic oligonucleotide
gagaacgggaagaagacgctgcagcgt

SEQ ID NO: 386235 - DNA, 27 bp, Artificial Sequence
  Description of Artificial Sequence: Synthetic oligonucleotide
agaacgggaagaagacgctgcagcgtg

SEQ ID NO: 386236 - DNA, 26 bp, Artificial Sequence
  Description of Artificial Sequence: Synthetic oligonucleotide
gaacgggaagaagacgctgcagcgtg

SEQ ID NO: 386237 - DNA, 26 bp, Artificial Sequence
  Description of Artificial Sequence: Synthetic oligonucleotide
aacgggaagaagacgctgcagcgtgc

SEQ ID NO: 386238 - DNA, 25 bp, Artificial Sequence
  Description of Artificial Sequence: Synthetic oligonucleotide
acgggaagaagacgctgcagcgtgc

SEQ ID NO: 386239 - DNA, 24 bp, Artificial Sequence
  Description of Artificial Sequence: Synthetic oligonucleotide
cgggaagaagacgctgcagcgtgc

SEQ ID NO: 386240 - DNA, 24 bp, Artificial Sequence
  Description of Artificial Sequence: Synthetic oligonucleotide
gggaagaagacgctgcagcgtgcg

SEQ ID NO: 386241 - DNA, 26 bp, Artificial Sequence
  Description of Artificial Sequence: Synthetic oligonucleotide
ggaagaagacgctgcagcgtgcggaa

SEQ ID NO: 386242 - DNA, 26 bp, Artificial Sequence
  Description of Artificial Sequence: Synthetic oligonucleotide
gaagaagacgctgcagcgtgcggaac

SEQ ID NO: 386243 - DNA, 26 bp, Artificial Sequence
  Description of Artificial Sequence: Synthetic oligonucleotide
aagaagacgctgcagcgtgcggaacc

SEQ ID NO: 386244 - DNA, 25 bp, Artificial Sequence
  Description of Artificial Sequence: Synthetic oligonucleotide
agaagacgctgcagcgtgcggaacc

SEQ ID NO: 386245 - DNA, 24 bp, Artificial Sequence
  Description of Artificial Sequence: Synthetic oligonucleotide
gaagacgctgcagcgtgcggaacc

SEQ ID NO: 386246 - DNA, 24 bp, Artificial Sequence
  Description of Artificial Sequence: Synthetic oligonucleotide
aagacgctgcagcgtgcggaaccc

SEQ ID NO: 386247 - DNA, 23 bp, Artificial Sequence
  Description of Artificial Sequence: Synthetic oligonucleotide
agacgctgcagcgtgcggaaccc

SEQ ID NO: 386248 - DNA, 22 bp, Artificial Sequence
  Description of Artificial Sequence: Synthetic oligonucleotide
gacgctgcagcgtgcggaaccc

SEQ ID NO: 386249 - DNA, 22 bp, Artificial Sequence
  Description of Artificial Sequence: Synthetic oligonucleotide
acgctgcagcgtgcggaacccc

SEQ ID NO: 386250 - DNA, 21 bp, Artificial Sequence
  Description of Artificial Sequence: Synthetic oligonucleotide
cgctgcagcgtgcggaacccc

SEQ ID NO: 386251 - DNA, 24 bp, Artificial Sequence
  Description of Artificial Sequence: Synthetic oligonucleotide
gctgcagcgtgcggaacccccaaa

SEQ ID NO: 386252 - DNA, 25 bp, Artificial Sequence
  Description of Artificial Sequence: Synthetic oligonucleotide
ctgcagcgtgcggaacccccaaaga

SEQ ID NO: 386253 - DNA, 26 bp, Artificial Sequence
  Description of Artificial Sequence: Synthetic oligonucleotide
tgcagcgtgcggaacccccaaagaca

SEQ ID NO: 386254 - DNA, 25 bp, Artificial Sequence
  Description of Artificial Sequence: Synthetic oligonucleotide
gcagcgtgcggaacccccaaagaca

SEQ ID NO: 386255 - DNA, 26 bp, Artificial Sequence
  Description of Artificial Sequence: Synthetic oligonucleotide
cagcgtgcggaacccccaaagacaca

SEQ ID NO: 386256 - DNA, 26 bp, Artificial Sequence
  Description of Artificial Sequence: Synthetic oligonucleotide
agcgtgcggaacccccaaagacacac

SEQ ID NO: 386257 - DNA, 25 bp, Artificial Sequence
  Description of Artificial Sequence: Synthetic oligonucleotide
gcgtgcggaacccccaaagacacac

SEQ ID NO: 386258 - DNA, 26 bp, Artificial Sequence
  Description of Artificial Sequence: Synthetic oligonucleotide
cgtgcggaacccccaaagacacacgt

SEQ ID NO: 386259 - DNA, 27 bp, Artificial Sequence
  Description of Artificial Sequence: Synthetic oligonucleotide
gtgcggaacccccaaagacacacgtga

SEQ ID NO: 386260 - DNA, 27 bp, Artificial Sequence
  Description of Artificial Sequence: Synthetic oligonucleotide
tgcggaacccccaaagacacacgtgac

SEQ ID NO: 386261 - DNA, 27 bp, Artificial Sequence
  Description of Artificial Sequence: Synthetic oligonucleotide
gaggacgggtctcacaccctccagaat

SEQ ID NO: 386262 - DNA, 29 bp, Artificial Sequence
  Description of Artificial Sequence: Synthetic oligonucleotide
aggacgggtctcacaccctccagaatatg

SEQ ID NO: 386263 - DNA, 28 bp, Artificial Sequence
  Description of Artificial Sequence: Synthetic oligonucleotide
ggacgggtctcacaccctccagaatatg

SEQ ID NO: 386264 - DNA, 31 bp, Artificial Sequence; identical to SEQ ID NO: 47324
  Description of Artificial Sequence: Synthetic oligonucleotide

SEQ ID NO: 386265 - DNA, 31 bp, Artificial Sequence; identical to SEQ ID NO: 47325
  Description of Artificial Sequence: Synthetic oligonucleotide

SEQ ID NO: 386266 - DNA, 30 bp, Artificial Sequence; identical to SEQ ID NO: 47326
  Description of Artificial Sequence: Synthetic oligonucleotide

SEQ ID NO: 386267 - DNA, 29 bp, Artificial Sequence
  Description of Artificial Sequence: Synthetic oligonucleotide
caccctccagaatatgtatggctgcgacc

SEQ ID NO: 386268 - DNA, 30 bp, Artificial Sequence; identical to SEQ ID NO: 47328
  Description of Artificial Sequence: Synthetic oligonucleotide

SEQ ID NO: 386269 - DNA, 29 bp, Artificial Sequence
  Description of Artificial Sequence: Synthetic oligonucleotide
ccctccagaatatgtatggctgcgacctg

SEQ ID NO: 386270 - DNA, 29 bp, Artificial Sequence
  Description of Artificial Sequence: Synthetic oligonucleotide
cctccagaatatgtatggctgcgacctgg

SEQ ID NO: 386271 - DNA, 29 bp, Artificial Sequence
  Description of Artificial Sequence: Synthetic oligonucleotide
ctccagaatatgtatggctgcgacctggg

SEQ ID NO: 386272 - DNA, 29 bp, Artificial Sequence
  Description of Artificial Sequence: Synthetic oligonucleotide
tccagaatatgtatggctgcgacctgggg

SEQ ID NO: 386273 - DNA, 28 bp, Artificial Sequence
  Description of Artificial Sequence: Synthetic oligonucleotide
ccagaatatgtatggctgcgacctgggg

SEQ ID NO: 386274 - DNA, 28 bp, Artificial Sequence
  Description of Artificial Sequence: Synthetic oligonucleotide
cagaatatgtatggctgcgacctggggc

SEQ ID NO: 386275 - DNA, 28 bp, Artificial Sequence
  Description of Artificial Sequence: Synthetic oligonucleotide
agaatatgtatggctgcgacctggggcc

SEQ ID NO: 386276 - DNA, 27 bp, Artificial Sequence
  Description of Artificial Sequence: Synthetic oligonucleotide
gaatatgtatggctgcgacctggggcc

SEQ ID NO: 386277 - DNA, 27 bp, Artificial Sequence
  Description of Artificial Sequence: Synthetic oligonucleotide
aatatgtatggctgcgacctggggccc

SEQ ID NO: 386278 - DNA, 26 bp, Artificial Sequence
  Description of Artificial Sequence: Synthetic oligonucleotide
atatgtatggctgcgacctggggccc

SEQ ID NO: 386279 - DNA, 25 bp, Artificial Sequence
  Description of Artificial Sequence: Synthetic oligonucleotide
tatgtatggctgcgacctggggccc

SEQ ID NO: 386280 - DNA, 28 bp, Artificial Sequence
  Description of Artificial Sequence: Synthetic oligonucleotide
tgtccttggagctgtggtcaccgctaag

SEQ ID NO: 386281 - DNA, 27 bp, Artificial Sequence
  Description of Artificial Sequence: Synthetic oligonucleotide
gtccttggagctgtggtcaccgctaag

SEQ ID NO: 386282 - DNA, 29 bp, Artificial Sequence
  Description of Artificial Sequence: Synthetic oligonucleotide
tccttggagctgtggtcaccgctaagatg

SEQ ID NO: 386283 - DNA, 28 bp, Artificial Sequence
  Description of Artificial Sequence: Synthetic oligonucleotide
ccttggagctgtggtcaccgctaagatg

SEQ ID NO: 386284 - DNA, 29 bp, Artificial Sequence
  Description of Artificial Sequence: Synthetic oligonucleotide
cttggagctgtggtcaccgctaagatgtg

SEQ ID NO: 386285 - DNA, 31 bp, Artificial Sequence; identical to SEQ ID NO: 47345
  Description of Artificial Sequence: Synthetic oligonucleotide

SEQ ID NO: 386286 - DNA, 30 bp, Artificial Sequence; identical to SEQ ID NO: 47346
  Description of Artificial Sequence: Synthetic oligonucleotide

SEQ ID NO: 386287 - DNA, 29 bp, Artificial Sequence
  Description of Artificial Sequence: Synthetic oligonucleotide
ggagctgtggtcaccgctaagatgtgtag

SEQ ID NO: 386288 - DNA, 29 bp, Artificial Sequence
  Description of Artificial Sequence: Synthetic oligonucleotide
gagctgtggtcaccgctaagatgtgtagg

SEQ ID NO: 386289 - DNA, 30 bp, Artificial Sequence; identical to SEQ ID NO: 47349
  Description of Artificial Sequence: Synthetic oligonucleotide

SEQ ID NO: 386290 - DNA, 29 bp, Artificial Sequence
  Description of Artificial Sequence: Synthetic oligonucleotide
gctgtggtcaccgctaagatgtgtaggag

SEQ ID NO: 386291 - DNA, 29 bp, Artificial Sequence
  Description of Artificial Sequence: Synthetic oligonucleotide
ctgtggtcaccgctaagatgtgtaggagg

SEQ ID NO: 386292 - DNA, 31 bp, Artificial Sequence; identical to SEQ ID NO: 47352
  Description of Artificial Sequence: Synthetic oligonucleotide

SEQ ID NO: 386293 - DNA, 30 bp, Artificial Sequence; identical to SEQ ID NO: 47353
  Description of Artificial Sequence: Synthetic oligonucleotide

SEQ ID NO: 386294 - DNA, 31 bp, Artificial Sequence; identical to SEQ ID NO: 47354
  Description of Artificial Sequence: Synthetic oligonucleotide

SEQ ID NO: 386295 - DNA, 30 bp, Artificial Sequence; identical to SEQ ID NO: 47355
  Description of Artificial Sequence: Synthetic oligonucleotide

SEQ ID NO: 386296 - DNA, 30 bp, Artificial Sequence; identical to SEQ ID NO: 47356
  Description of Artificial Sequence: Synthetic oligonucleotide

SEQ ID NO: 386297 - DNA, 31 bp, Artificial Sequence; identical to SEQ ID NO: 47357
  Description of Artificial Sequence: Synthetic oligonucleotide

SEQ ID NO: 386298 - DNA, 30 bp, Artificial Sequence; identical to SEQ ID NO: 47358
  Description of Artificial Sequence: Synthetic oligonucleotide

SEQ ID NO: 386299 - DNA, 31 bp, Artificial Sequence; identical to SEQ ID NO: 47359
  Description of Artificial Sequence: Synthetic oligonucleotide

SEQ ID NO: 386300 - DNA, 30 bp, Artificial Sequence; identical to SEQ ID NO: 47360
  Description of Artificial Sequence: Synthetic oligonucleotide

SEQ ID NO: 386301 - DNA, 30 bp, Artificial Sequence; identical to SEQ ID NO: 47361
  Description of Artificial Sequence: Synthetic oligonucleotide

SEQ ID NO: 386302 - DNA, 31 bp, Artificial Sequence; identical to SEQ ID NO: 47362
  Description of Artificial Sequence: Synthetic oligonucleotide

SEQ ID NO: 386303 - DNA, 31 bp, Artificial Sequence; identical to SEQ ID NO: 47363
  Description of Artificial Sequence: Synthetic oligonucleotide

SEQ ID NO: 386304 - DNA, 35 bp, Artificial Sequence; identical to SEQ ID NO: 47364
  Description of Artificial Sequence: Synthetic oligonucleotide

SEQ ID NO: 386305 - DNA, 34 bp, Artificial Sequence; identical to SEQ ID NO: 47365
  Description of Artificial Sequence: Synthetic oligonucleotide

SEQ ID NO: 386306 - DNA, 33 bp, Artificial Sequence; identical to SEQ ID NO: 47366
  Description of Artificial Sequence: Synthetic oligonucleotide

SEQ ID NO: 386307 - DNA, 29 bp, Artificial Sequence
  Description of Artificial Sequence: Synthetic oligonucleotide
tggaaaaggagggagctgctctcaggttg

SEQ ID NO: 386308 - DNA, 28 bp, Artificial Sequence
  Description of Artificial Sequence: Synthetic oligonucleotide
ggaaaaggagggagctgctctcaggttg

SEQ ID NO: 386309 - DNA, 28 bp, Artificial Sequence
  Description of Artificial Sequence: Synthetic oligonucleotide
gaaaaggagggagctgctctcaggttgc

SEQ ID NO: 386310 - DNA, 28 bp, Artificial Sequence
  Description of Artificial Sequence: Synthetic oligonucleotide
aaaaggagggagctgctctcaggttgcg

SEQ ID NO: 386311 - DNA, 27 bp, Artificial Sequence
  Description of Artificial Sequence: Synthetic oligonucleotide
aaaggagggagctgctctcaggttgcg

SEQ ID NO: 386312 - DNA, 27 bp, Artificial Sequence
  Description of Artificial Sequence: Synthetic oligonucleotide
aaggagggagctgctctcaggttgcgt

SEQ ID NO: 386313 - DNA, 26 bp, Artificial Sequence
  Description of Artificial Sequence: Synthetic oligonucleotide
aggagggagctgctctcaggttgcgt

SEQ ID NO: 386314 - DNA, 25 bp, Artificial Sequence
  Description of Artificial Sequence: Synthetic oligonucleotide
ggagggagctgctctcaggttgcgt

SEQ ID NO: 386315 - DNA, 25 bp, Artificial Sequence
  Description of Artificial Sequence: Synthetic oligonucleotide
gagggagctgctctcaggttgcgtg

SEQ ID NO: 386316 - DNA, 26 bp, Artificial Sequence
  Description of Artificial Sequence: Synthetic oligonucleotide
agggagctgctctcaggttgcgtgca

SEQ ID NO: 386317 - DNA, 25 bp, Artificial Sequence
  Description of Artificial Sequence: Synthetic oligonucleotide
gggagctgctctcaggttgcgtgca

SEQ ID NO: 386318 - DNA, 25 bp, Artificial Sequence
  Description of Artificial Sequence: Synthetic oligonucleotide
ggagctgctctcaggttgcgtgcag

SEQ ID NO: 386319 - DNA, 27 bp, Artificial Sequence
  Description of Artificial Sequence: Synthetic oligonucleotide
gagctgctctcaggttgcgtgcagcaa

SEQ ID NO: 386320 - DNA, 27 bp, Artificial Sequence
  Description of Artificial Sequence: Synthetic oligonucleotide
agctgctctcaggttgcgtgcagcaac

SEQ ID NO: 386321 - DNA, 27 bp, Artificial Sequence
  Description of Artificial Sequence: Synthetic oligonucleotide
gctgctctcaggttgcgtgcagcaaca

SEQ ID NO: 386322 - DNA, 27 bp, Artificial Sequence
  Description of Artificial Sequence: Synthetic oligonucleotide
ctgctctcaggttgcgtgcagcaacag

SEQ ID NO: 386323 - DNA, 28 bp, Artificial Sequence
  Description of Artificial Sequence: Synthetic oligonucleotide
tgctctcaggttgcgtgcagcaacagtg

SEQ ID NO: 386324 - DNA, 27 bp, Artificial Sequence
  Description of Artificial Sequence: Synthetic oligonucleotide
gctctcaggttgcgtgcagcaacagtg

SEQ ID NO: 386325 - DNA, 27 bp, Artificial Sequence
  Description of Artificial Sequence: Synthetic oligonucleotide
ctctcaggttgcgtgcagcaacagtgc

SEQ ID NO: 386326 - DNA, 27 bp, Artificial Sequence
  Description of Artificial Sequence: Synthetic oligonucleotide
tctcaggttgcgtgcagcaacagtgcc

SEQ ID NO: 386327 - DNA, 26 bp, Artificial Sequence
  Description of Artificial Sequence: Synthetic oligonucleotide
ctcaggttgcgtgcagcaacagtgcc

SEQ ID NO: 386328 - DNA, 27 bp, Artificial Sequence
  Description of Artificial Sequence: Synthetic oligonucleotide
tcaggttgcgtgcagcaacagtgccca

SEQ ID NO: 386329 - DNA, 26 bp, Artificial Sequence
  Description of Artificial Sequence: Synthetic oligonucleotide
caggttgcgtgcagcaacagtgccca

SEQ ID NO: 386330 - DNA, 26 bp, Artificial Sequence
  Description of Artificial Sequence: Synthetic oligonucleotide
aggttgcgtgcagcaacagtgcccag

SEQ ID NO: 386331 - DNA, 25 bp, Artificial Sequence
  Description of Artificial Sequence: Synthetic oligonucleotide
ggttgcgtgcagcaacagtgcccag

SEQ ID NO: 386332 - DNA, 25 bp, Artificial Sequence
  Description of Artificial Sequence: Synthetic oligonucleotide
gttgcgtgcagcaacagtgcccagg

SEQ ID NO: 386333 - DNA, 25 bp, Artificial Sequence
  Description of Artificial Sequence: Synthetic oligonucleotide
ttgcgtgcagcaacagtgcccaggg

SEQ ID NO: 386334 - DNA, 27 bp, Artificial Sequence
  Description of Artificial Sequence: Synthetic oligonucleotide
accagagcgaggacgggtctcacatca

SEQ ID NO: 386335 - DNA, 27 bp, Artificial Sequence
  Description of Artificial Sequence: Synthetic oligonucleotide
ccagagcgaggacgggtctcacatcat

SEQ ID NO: 386336 - DNA, 27 bp, Artificial Sequence
  Description of Artificial Sequence: Synthetic oligonucleotide
cagagcgaggacgggtctcacatcatc

SEQ ID NO: 386337 - DNA, 27 bp, Artificial Sequence
  Description of Artificial Sequence: Synthetic oligonucleotide
agagcgaggacgggtctcacatcatcc

SEQ ID NO: 386338 - DNA, 27 bp, Artificial Sequence
  Description of Artificial Sequence: Synthetic oligonucleotide
gagcgaggacgggtctcacatcatcca

SEQ ID NO: 386339 - DNA, 27 bp, Artificial Sequence
  Description of Artificial Sequence: Synthetic oligonucleotide
agcgaggacgggtctcacatcatccag

SEQ ID NO: 386340 - DNA, 27 bp, Artificial Sequence
  Description of Artificial Sequence: Synthetic oligonucleotide
gcgaggacgggtctcacatcatccaga

SEQ ID NO: 386341 - DNA, 27 bp, Artificial Sequence
  Description of Artificial Sequence: Synthetic oligonucleotide
cgaggacgggtctcacatcatccagag

SEQ ID NO: 386342 - DNA, 27 bp, Artificial Sequence
  Description of Artificial Sequence: Synthetic oligonucleotide
gaggacgggtctcacatcatccagagg

SEQ ID NO: 386343 - DNA, 29 bp, Artificial Sequence
  Description of Artificial Sequence: Synthetic oligonucleotide
aggacgggtctcacatcatccagaggatg

SEQ ID NO: 386344 - DNA, 28 bp, Artificial Sequence
  Description of Artificial Sequence: Synthetic oligonucleotide
ggacgggtctcacatcatccagaggatg

SEQ ID NO: 386345 - DNA, 29 bp, Artificial Sequence
  Description of Artificial Sequence: Synthetic oligonucleotide
gacgggtctcacatcatccagaggatgtc

SEQ ID NO: 386346 - DNA, 30 bp, Artificial Sequence; identical to SEQ ID NO: 47395
  Description of Artificial Sequence: Synthetic oligonucleotide

SEQ ID NO: 386347 - DNA, 29 bp, Artificial Sequence
  Description of Artificial Sequence: Synthetic oligonucleotide
cgggtctcacatcatccagaggatgtctg

SEQ ID NO: 386348 - DNA, 29 bp, Artificial Sequence
  Description of Artificial Sequence: Synthetic oligonucleotide
gggtctcacatcatccagaggatgtctgg

SEQ ID NO: 386349 - DNA, 29 bp, Artificial Sequence
  Description of Artificial Sequence: Synthetic oligonucleotide
ggtctcacatcatccagaggatgtctggc

SEQ ID NO: 386350 - DNA, 30 bp, Artificial Sequence; identical to SEQ ID NO: 32624
  Description of Artificial Sequence: Synthetic oligonucleotide

SEQ ID NO: 386351 - DNA, 30 bp, Artificial Sequence; identical to SEQ ID NO: 32625
  Description of Artificial Sequence: Synthetic oligonucleotide

SEQ ID NO: 386352 - DNA, 29 bp, Artificial Sequence
  Description of Artificial Sequence: Synthetic oligonucleotide
ctcacatcatccagaggatgtctggctgc

SEQ ID NO: 386353 - DNA, 29 bp, Artificial Sequence
  Description of Artificial Sequence: Synthetic oligonucleotide
tcacatcatccagaggatgtctggctgcg

SEQ ID NO: 386354 - DNA, 28 bp, Artificial Sequence
  Description of Artificial Sequence: Synthetic oligonucleotide
cacatcatccagaggatgtctggctgcg

SEQ ID NO: 386355 - DNA, 29 bp, Artificial Sequence
  Description of Artificial Sequence: Synthetic oligonucleotide
acatcatccagaggatgtctggctgcgac

SEQ ID NO: 386356 - DNA, 28 bp, Artificial Sequence
  Description of Artificial Sequence: Synthetic oligonucleotide
catcatccagaggatgtctggctgcgac

SEQ ID NO: 386357 - DNA, 28 bp, Artificial Sequence
  Description of Artificial Sequence: Synthetic oligonucleotide
atcatccagaggatgtctggctgcgacc

SEQ ID NO: 386358 - DNA, 27 bp, Artificial Sequence
  Description of Artificial Sequence: Synthetic oligonucleotide
tcatccagaggatgtctggctgcgacc

SEQ ID NO: 386359 - DNA, 27 bp, Artificial Sequence
  Description of Artificial Sequence: Synthetic oligonucleotide
catccagaggatgtctggctgcgacct

SEQ ID NO: 386360 - DNA, 27 bp, Artificial Sequence
  Description of Artificial Sequence: Synthetic oligonucleotide
atccagaggatgtctggctgcgacctg

SEQ ID NO: 386361 - DNA, 20 bp, Artificial Sequence
  Description of Artificial Sequence: Synthetic oligonucleotide
ggcgcctcctccgcgggtgt

SEQ ID NO: 386362 - DNA, 21 bp, Artificial Sequence
  Description of Artificial Sequence: Synthetic oligonucleotide
gcgcctcctccgcgggtgtga

SEQ ID NO: 386363 - DNA, 21 bp, Artificial Sequence
  Description of Artificial Sequence: Synthetic oligonucleotide
cgcctcctccgcgggtgtgac

SEQ ID NO: 386364 - DNA, 22 bp, Artificial Sequence
  Description of Artificial Sequence: Synthetic oligonucleotide
gcctcctccgcgggtgtgacca

SEQ ID NO: 386365 - DNA, 23 bp, Artificial Sequence
  Description of Artificial Sequence: Synthetic oligonucleotide
cctcctccgcgggtgtgaccagt

SEQ ID NO: 386366 - DNA, 23 bp, Artificial Sequence
  Description of Artificial Sequence: Synthetic oligonucleotide
ctcctccgcgggtgtgaccagtc

SEQ ID NO: 386367 - DNA, 23 bp, Artificial Sequence
  Description of Artificial Sequence: Synthetic oligonucleotide
tcctccgcgggtgtgaccagtcc

SEQ ID NO: 386368 - DNA, 22 bp, Artificial Sequence
  Description of Artificial Sequence: Synthetic oligonucleotide
cctccgcgggtgtgaccagtcc

SEQ ID NO: 386369 - DNA, 22 bp, Artificial Sequence
  Description of Artificial Sequence: Synthetic oligonucleotide
ctccgcgggtgtgaccagtccg

SEQ ID NO: 386370 - DNA, 22 bp, Artificial Sequence
  Description of Artificial Sequence: Synthetic oligonucleotide
tccgcgggtgtgaccagtccgc

SEQ ID NO: 386371 - DNA, 21 bp, Artificial Sequence
  Description of Artificial Sequence: Synthetic oligonucleotide
ccgcgggtgtgaccagtccgc

SEQ ID NO: 386372 - DNA, 23 bp, Artificial Sequence
  Description of Artificial Sequence: Synthetic oligonucleotide
cgcgggtgtgaccagtccgccta

SEQ ID NO: 386373 - DNA, 23 bp, Artificial Sequence
  Description of Artificial Sequence: Synthetic oligonucleotide
gcgggtgtgaccagtccgcctac

SEQ ID NO: 386374 - DNA, 24 bp, Artificial Sequence
  Description of Artificial Sequence: Synthetic oligonucleotide
cgggtgtgaccagtccgcctacga

SEQ ID NO: 386375 - DNA, 24 bp, Artificial Sequence
  Description of Artificial Sequence: Synthetic oligonucleotide
gggtgtgaccagtccgcctacgac

SEQ ID NO: 386376 - DNA, 24 bp, Artificial Sequence
  Description of Artificial Sequence: Synthetic oligonucleotide
ggtgtgaccagtccgcctacgacg

SEQ ID NO: 386377 - DNA, 24 bp, Artificial Sequence
  Description of Artificial Sequence: Synthetic oligonucleotide
gtgtgaccagtccgcctacgacgg

SEQ ID NO: 386378 - DNA, 26 bp, Artificial Sequence
  Description of Artificial Sequence: Synthetic oligonucleotide
tgtgaccagtccgcctacgacggcaa

SEQ ID NO: 386379 - DNA, 25 bp, Artificial Sequence
  Description of Artificial Sequence: Synthetic oligonucleotide
gtgaccagtccgcctacgacggcaa

SEQ ID NO: 386380 - DNA, 31 bp, Artificial Sequence; identical to SEQ ID NO: 43596
  Description of Artificial Sequence: Synthetic oligonucleotide

SEQ ID NO: 386381 - DNA, 31 bp, Artificial Sequence; identical to SEQ ID NO: 43597
  Description of Artificial Sequence: Synthetic oligonucleotide

SEQ ID NO: 386382 - DNA, 27 bp, Artificial Sequence
  Description of Artificial Sequence: Synthetic oligonucleotide
gcggctactacaaccagagcgaggaca

SEQ ID NO: 386383 - DNA, 27 bp, Artificial Sequence
  Description of Artificial Sequence: Synthetic oligonucleotide
cggctactacaaccagagcgaggacag

SEQ ID NO: 386384 - DNA, 27 bp, Artificial Sequence
  Description of Artificial Sequence: Synthetic oligonucleotide
ggctactacaaccagagcgaggacagg

SEQ ID NO: 386385 - DNA, 28 bp, Artificial Sequence
  Description of Artificial Sequence: Synthetic oligonucleotide
gctactacaaccagagcgaggacaggtc

SEQ ID NO: 386386 - DNA, 29 bp, Artificial Sequence
  Description of Artificial Sequence: Synthetic oligonucleotide
ctactacaaccagagcgaggacaggtctc

SEQ ID NO: 386387 - DNA, 30 bp, Artificial Sequence; identical to SEQ ID NO: 45260
  Description of Artificial Sequence: Synthetic oligonucleotide

SEQ ID NO: 386388 - DNA, 29 bp, Artificial Sequence
  Description of Artificial Sequence: Synthetic oligonucleotide
actacaaccagagcgaggacaggtctcac

SEQ ID NO: 386389 - DNA, 28 bp, Artificial Sequence
  Description of Artificial Sequence: Synthetic oligonucleotide
ctacaaccagagcgaggacaggtctcac

SEQ ID NO: 386390 - DNA, 29 bp, Artificial Sequence
  Description of Artificial Sequence: Synthetic oligonucleotide
tacaaccagagcgaggacaggtctcacac

SEQ ID NO: 386391 - DNA, 28 bp, Artificial Sequence
  Description of Artificial Sequence: Synthetic oligonucleotide
acaaccagagcgaggacaggtctcacac

SEQ ID NO: 386392 - DNA, 27 bp, Artificial Sequence
  Description of Artificial Sequence: Synthetic oligonucleotide
caaccagagcgaggacaggtctcacac

SEQ ID NO: 386393 - DNA, 27 bp, Artificial Sequence
  Description of Artificial Sequence: Synthetic oligonucleotide
aaccagagcgaggacaggtctcacacc

SEQ ID NO: 386394 - DNA, 26 bp, Artificial Sequence
  Description of Artificial Sequence: Synthetic oligonucleotide
accagagcgaggacaggtctcacacc

SEQ ID NO: 386395 - DNA, 25 bp, Artificial Sequence
  Description of Artificial Sequence: Synthetic oligonucleotide
ccagagcgaggacaggtctcacacc

SEQ ID NO: 386396 - DNA, 26 bp, Artificial Sequence
  Description of Artificial Sequence: Synthetic oligonucleotide
cagagcgaggacaggtctcacaccct

SEQ ID NO: 386397 - DNA, 26 bp, Artificial Sequence
  Description of Artificial Sequence: Synthetic oligonucleotide
agagcgaggacaggtctcacaccctc

SEQ ID NO: 386398 - DNA, 25 bp, Artificial Sequence
  Description of Artificial Sequence: Synthetic oligonucleotide
gagcgaggacaggtctcacaccctc

SEQ ID NO: 386399 - DNA, 26 bp, Artificial Sequence
  Description of Artificial Sequence: Synthetic oligonucleotide
agcgaggacaggtctcacaccctcca

SEQ ID NO: 386400 - DNA, 25 bp, Artificial Sequence
  Description of Artificial Sequence: Synthetic oligonucleotide
gcgaggacaggtctcacaccctcca

SEQ ID NO: 386401 - DNA, 26 bp, Artificial Sequence
  Description of Artificial Sequence: Synthetic oligonucleotide
cgaggacaggtctcacaccctccaga

SEQ ID NO: 386402 - DNA, 26 bp, Artificial Sequence
  Description of Artificial Sequence: Synthetic oligonucleotide
gaggacaggtctcacaccctccagag

SEQ ID NO: 386403 - DNA, 27 bp, Artificial Sequence
  Description of Artificial Sequence: Synthetic oligonucleotide
aggacaggtctcacaccctccagagga

SEQ ID NO: 386404 - DNA, 27 bp, Artificial Sequence
  Description of Artificial Sequence: Synthetic oligonucleotide
ggacaggtctcacaccctccagaggat

SEQ ID NO: 386405 - DNA, 27 bp, Artificial Sequence
  Description of Artificial Sequence: Synthetic oligonucleotide
gacaggtctcacaccctccagaggatg

SEQ ID NO: 386406 - DNA, 28 bp, Artificial Sequence
  Description of Artificial Sequence: Synthetic oligonucleotide
acaggtctcacaccctccagaggatgtc

SEQ ID NO: 386407 - DNA, 27 bp, Artificial Sequence
  Description of Artificial Sequence: Synthetic oligonucleotide
caggtctcacaccctccagaggatgtc

SEQ ID NO: 386408 - DNA, 28 bp, Artificial Sequence
  Description of Artificial Sequence: Synthetic oligonucleotide
aggtctcacaccctccagaggatgtctg

SEQ ID NO: 386409 - DNA, 26 bp, Artificial Sequence
  Description of Artificial Sequence: Synthetic oligonucleotide
ccggtctcacaccctccagaggatgt

SEQ ID NO: 386410 - DNA, 27 bp, Artificial Sequence
  Description of Artificial Sequence: Synthetic oligonucleotide
cggtctcacaccctccagaggatgtct

SEQ ID NO: 386411 - DNA, 23 bp, Artificial Sequence
  Description of Artificial Sequence: Synthetic oligonucleotide
gccaccctgaggtgctgggccat

SEQ ID NO: 386412 - DNA, 23 bp, Artificial Sequence
  Description of Artificial Sequence: Synthetic oligonucleotide
ccaccctgaggtgctgggccatg

SEQ ID NO: 386413 - DNA, 23 bp, Artificial Sequence
  Description of Artificial Sequence: Synthetic oligonucleotide
caccctgaggtgctgggccatgg

SEQ ID NO: 386414 - DNA, 23 bp, Artificial Sequence
  Description of Artificial Sequence: Synthetic oligonucleotide
accctgaggtgctgggccatggg

SEQ ID NO: 386415 - DNA, 22 bp, Artificial Sequence
  Description of Artificial Sequence: Synthetic oligonucleotide
ccctgaggtgctgggccatggg

SEQ ID NO: 386416 - DNA, 24 bp, Artificial Sequence
  Description of Artificial Sequence: Synthetic oligonucleotide
cctgaggtgctgggccatgggctt

SEQ ID NO: 386417 - DNA, 26 bp, Artificial Sequence
  Description of Artificial Sequence: Synthetic oligonucleotide
ctgaggtgctgggccatgggcttcta

SEQ ID NO: 386418 - DNA, 26 bp, Artificial Sequence
  Description of Artificial Sequence: Synthetic oligonucleotide
tgaggtgctgggccatgggcttctac

SEQ ID NO: 386419 - DNA, 25 bp, Artificial Sequence
  Description of Artificial Sequence: Synthetic oligonucleotide
gaggtgctgggccatgggcttctac

SEQ ID NO: 386420 - DNA, 25 bp, Artificial Sequence
  Description of Artificial Sequence: Synthetic oligonucleotide
aggtgctgggccatgggcttctacc

SEQ ID NO: 386421 - DNA, 24 bp, Artificial Sequence
  Description of Artificial Sequence: Synthetic oligonucleotide
ggtgctgggccatgggcttctacc

SEQ ID NO: 386422 - DNA, 25 bp, Artificial Sequence
  Description of Artificial Sequence: Synthetic oligonucleotide
gtgctgggccatgggcttctaccct

SEQ ID NO: 386423 - DNA, 25 bp, Artificial Sequence
  Description of Artificial Sequence: Synthetic oligonucleotide
tgctgggccatgggcttctaccctg

SEQ ID NO: 386424 - DNA, 24 bp, Artificial Sequence
  Description of Artificial Sequence: Synthetic oligonucleotide
gctgggccatgggcttctaccctg

SEQ ID NO: 386425 - DNA, 24 bp, Artificial Sequence
  Description of Artificial Sequence: Synthetic oligonucleotide
ctgggccatgggcttctaccctgc

SEQ ID NO: 386426 - DNA, 24 bp, Artificial Sequence
  Description of Artificial Sequence: Synthetic oligonucleotide
tgggccatgggcttctaccctgcg

SEQ ID NO: 386427 - DNA, 23 bp, Artificial Sequence
  Description of Artificial Sequence: Synthetic oligonucleotide
gggccatgggcttctaccctgcg

SEQ ID NO: 386428 - DNA, 24 bp, Artificial Sequence
  Description of Artificial Sequence: Synthetic oligonucleotide
ggccatgggcttctaccctgcgga

SEQ ID NO: 386429 - DNA, 26 bp, Artificial Sequence
  Description of Artificial Sequence: Synthetic oligonucleotide
gccatgggcttctaccctgcggagat

SEQ ID NO: 386430 - DNA, 27 bp, Artificial Sequence
  Description of Artificial Sequence: Synthetic oligonucleotide
ccatgggcttctaccctgcggagatca

SEQ ID NO: 386431 - DNA, 27 bp, Artificial Sequence
  Description of Artificial Sequence: Synthetic oligonucleotide
catgggcttctaccctgcggagatcac

SEQ ID NO: 386432 - DNA, 28 bp, Artificial Sequence
  Description of Artificial Sequence: Synthetic oligonucleotide
atgggcttctaccctgcggagatcacac

SEQ ID NO: 386433 - DNA, 25 bp, Artificial Sequence
  Description of Artificial Sequence: Synthetic oligonucleotide
cggagcagctgagagcctacctggt

SEQ ID NO: 386434 - DNA, 25 bp, Artificial Sequence
  Description of Artificial Sequence: Synthetic oligonucleotide
ggagcagctgagagcctacctggtg

SEQ ID NO: 386435 - DNA, 25 bp, Artificial Sequence
  Description of Artificial Sequence: Synthetic oligonucleotide
gagcagctgagagcctacctggtgg

SEQ ID NO: 386436 - DNA, 25 bp, Artificial Sequence
  Description of Artificial Sequence: Synthetic oligonucleotide
agcagctgagagcctacctggtggg

SEQ ID NO: 386437 - DNA, 24 bp, Artificial Sequence
  Description of Artificial Sequence: Synthetic oligonucleotide
gcagctgagagcctacctggtggg

SEQ ID NO: 386438 - DNA, 25 bp, Artificial Sequence
  Description of Artificial Sequence: Synthetic oligonucleotide
cagctgagagcctacctggtgggca

SEQ ID NO: 386439 - DNA, 25 bp, Artificial Sequence
  Description of Artificial Sequence: Synthetic oligonucleotide
agctgagagcctacctggtgggcac

SEQ ID NO: 386440 - DNA, 24 bp, Artificial Sequence
  Description of Artificial Sequence: Synthetic oligonucleotide
gctgagagcctacctggtgggcac

SEQ ID NO: 386441 - DNA, 25 bp, Artificial Sequence
  Description of Artificial Sequence: Synthetic oligonucleotide
ctgagagcctacctggtgggcacgt

SEQ ID NO: 386442 - DNA, 25 bp, Artificial Sequence
  Description of Artificial Sequence: Synthetic oligonucleotide
tgagagcctacctggtgggcacgtg

SEQ ID NO: 386443 - DNA, 24 bp, Artificial Sequence
  Description of Artificial Sequence: Synthetic oligonucleotide
gagagcctacctggtgggcacgtg

SEQ ID NO: 386444 - DNA, 24 bp, Artificial Sequence
  Description of Artificial Sequence: Synthetic oligonucleotide
agagcctacctggtgggcacgtgc

SEQ ID NO: 386445 - DNA, 23 bp, Artificial Sequence
  Description of Artificial Sequence: Synthetic oligonucleotide
gagcctacctggtgggcacgtgc

SEQ ID NO: 386446 - DNA, 24 bp, Artificial Sequence
  Description of Artificial Sequence: Synthetic oligonucleotide
agcctacctggtgggcacgtgcgt

SEQ ID NO: 386447 - DNA, 23 bp, Artificial Sequence
  Description of Artificial Sequence: Synthetic oligonucleotide
gcctacctggtgggcacgtgcgt

SEQ ID NO: 386448 - DNA, 23 bp, Artificial Sequence
  Description of Artificial Sequence: Synthetic oligonucleotide
cctacctggtgggcacgtgcgtg

SEQ ID NO: 386449 - DNA, 24 bp, Artificial Sequence
  Description of Artificial Sequence: Synthetic oligonucleotide
ctacctggtgggcacgtgcgtgga

SEQ ID NO: 386450 - DNA, 25 bp, Artificial Sequence
  Description of Artificial Sequence: Synthetic oligonucleotide
tacctggtgggcacgtgcgtggagt

SEQ ID NO: 386451 - DNA, 24 bp, Artificial Sequence
  Description of Artificial Sequence: Synthetic oligonucleotide
acctggtgggcacgtgcgtggagt

SEQ ID NO: 386452 - DNA, 23 bp, Artificial Sequence
  Description of Artificial Sequence: Synthetic oligonucleotide
cctggtgggcacgtgcgtggagt

SEQ ID NO: 386453 - DNA, 23 bp, Artificial Sequence
  Description of Artificial Sequence: Synthetic oligonucleotide
ctggtgggcacgtgcgtggagtg

SEQ ID NO: 386454 - DNA, 23 bp, Artificial Sequence
  Description of Artificial Sequence: Synthetic oligonucleotide
tggtgggcacgtgcgtggagtgg

SEQ ID NO: 386455 - DNA, 22 bp, Artificial Sequence
  Description of Artificial Sequence: Synthetic oligonucleotide
ggtgggcacgtgcgtggagtgg

SEQ ID NO: 386456 - DNA, 23 bp, Artificial Sequence
  Description of Artificial Sequence: Synthetic oligonucleotide
gtgggcacgtgcgtggagtggct

SEQ ID NO: 386457 - DNA, 23 bp, Artificial Sequence
  Description of Artificial Sequence: Synthetic oligonucleotide
tgggcacgtgcgtggagtggctc

SEQ ID NO: 386458 - DNA, 22 bp, Artificial Sequence
  Description of Artificial Sequence: Synthetic oligonucleotide
cgcaagtgggaggcggcccgta

SEQ ID NO: 386459 - DNA, 22 bp, Artificial Sequence
  Description of Artificial Sequence: Synthetic oligonucleotide
gcaagtgggaggcggcccgtac

SEQ ID NO: 386460 - DNA, 22 bp, Artificial Sequence
  Description of Artificial Sequence: Synthetic oligonucleotide
caagtgggaggcggcccgtacg

SEQ ID NO: 386461 - DNA, 22 bp, Artificial Sequence
  Description of Artificial Sequence: Synthetic oligonucleotide
aagtgggaggcggcccgtacgg

SEQ ID NO: 386462 - DNA, 21 bp, Artificial Sequence
  Description of Artificial Sequence: Synthetic oligonucleotide
agtgggaggcggcccgtacgg

SEQ ID NO: 386463 - DNA, 20 bp, Artificial Sequence
  Description of Artificial Sequence: Synthetic oligonucleotide
gtgggaggcggcccgtacgg

SEQ ID NO: 386464 - DNA, 20 bp, Artificial Sequence
  Description of Artificial Sequence: Synthetic oligonucleotide
tgggaggcggcccgtacggc

SEQ ID NO: 386465 - DNA, 20 bp, Artificial Sequence
  Description of Artificial Sequence: Synthetic oligonucleotide
gggaggcggcccgtacggct

SEQ ID NO: 386466 - DNA, 20 bp, Artificial Sequence
  Description of Artificial Sequence: Synthetic oligonucleotide
ggaggcggcccgtacggcgt

SEQ ID NO: 386467 - DNA, 20 bp, Artificial Sequence
  Description of Artificial Sequence: Synthetic oligonucleotide
gaggcggcccgtacggcgga

SEQ ID NO: 386468 - DNA, 20 bp, Artificial Sequence
  Description of Artificial Sequence: Synthetic oligonucleotide
aggcggcccgtacggcggag

SEQ ID NO: 386469 - DNA, 20 bp, Artificial Sequence
  Description of Artificial Sequence: Synthetic oligonucleotide
ggcggcccgtacggcggagt

SEQ ID NO: 386470 - DNA, 20 bp, Artificial Sequence
  Description of Artificial Sequence: Synthetic oligonucleotide
gcggcccgtacggcggagca

SEQ ID NO: 386471 - DNA, 20 bp, Artificial Sequence
  Description of Artificial Sequence: Synthetic oligonucleotide
cggcccgtacggcggagcag

SEQ ID NO: 386472 - DNA, 21 bp, Artificial Sequence
  Description of Artificial Sequence: Synthetic oligonucleotide
ggcccgtacggcggagcagct

SEQ ID NO: 386473 - DNA, 22 bp, Artificial Sequence
  Description of Artificial Sequence: Synthetic oligonucleotide
gcccgtacggcggagcagctga

SEQ ID NO: 386474 - DNA, 23 bp, Artificial Sequence
  Description of Artificial Sequence: Synthetic oligonucleotide
cccgtacggcggagcagctgaga

SEQ ID NO: 386475 - DNA, 23 bp, Artificial Sequence
  Description of Artificial Sequence: Synthetic oligonucleotide
ccgtacggcggagcagctgagag

SEQ ID NO: 386476 - DNA, 23 bp, Artificial Sequence
  Description of Artificial Sequence: Synthetic oligonucleotide
cgtacggcggagcagctgagagc

SEQ ID NO: 386477 - DNA, 25 bp, Artificial Sequence
  Description of Artificial Sequence: Synthetic oligonucleotide
gtacggcggagcagctgagagccta

SEQ ID NO: 386478 - DNA, 25 bp, Artificial Sequence
  Description of Artificial Sequence: Synthetic oligonucleotide
tacggcggagcagctgagagcctac

SEQ ID NO: 386479 - DNA, 24 bp, Artificial Sequence
  Description of Artificial Sequence: Synthetic oligonucleotide
acggcggagcagctgagagcctac

SEQ ID NO: 386480 - DNA, 30 bp, Artificial Sequence
  Description of Artificial Sequence: Synthetic oligonucleotide
gtgccttctggagaagagcagagatacacc

SEQ ID NO: 386481 - DNA, 31 bp, Artificial Sequence
  Description of Artificial Sequence: Synthetic oligonucleotide
tgccttctggagaagagcagagatacacctg

SEQ ID NO: 386482 - DNA, 30 bp, Artificial Sequence
  Description of Artificial Sequence: Synthetic oligonucleotide
gccttctggagaagagcagagatacacctg

SEQ ID NO: 386483 - DNA, 30 bp, Artificial Sequence
  Description of Artificial Sequence: Synthetic oligonucleotide
ccttctggagaagagcagagatacacctgc

SEQ ID NO: 386484 - DNA, 30 bp, Artificial Sequence
  Description of Artificial Sequence: Synthetic oligonucleotide
cttctggagaagagcagagatacacctgcc

SEQ ID NO: 386485 - DNA, 32 bp, Artificial Sequence
  Description of Artificial Sequence: Synthetic oligonucleotide
ttctggagaagagcagagatacacctgccatg

SEQ ID NO: 386486 - DNA, 31 bp, Artificial Sequence
  Description of Artificial Sequence: Synthetic oligonucleotide
tctggagaagagcagagatacacctgccatg

SEQ ID NO: 386487 - DNA, 30 bp, Artificial Sequence
  Description of Artificial Sequence: Synthetic oligonucleotide
ctggagaagagcagagatacacctgccatg

SEQ ID NO: 386488 - DNA, 31 bp, Artificial Sequence
  Description of Artificial Sequence: Synthetic oligonucleotide
tggagaagagcagagatacacctgccatgtg

SEQ ID NO: 386489 - DNA, 30 bp, Artificial Sequence
  Description of Artificial Sequence: Synthetic oligonucleotide
ggagaagagcagagatacacctgccatgtg

SEQ ID NO: 386490 - DNA, 30 bp, Artificial Sequence
  Description of Artificial Sequence: Synthetic oligonucleotide
gagaagagcagagatacacctgccatgtgc

SEQ ID NO: 386491 - DNA, 31 bp, Artificial Sequence
  Description of Artificial Sequence: Synthetic oligonucleotide
agaagagcagagatacacctgccatgtgcag

SEQ ID NO: 386492 - DNA, 30 bp, Artificial Sequence
  Description of Artificial Sequence: Synthetic oligonucleotide
gaagagcagagatacacctgccatgtgcag

SEQ ID NO: 386493 - DNA, 30 bp, Artificial Sequence
  Description of Artificial Sequence: Synthetic oligonucleotide
aagagcagagatacacctgccatgtgcagc

SEQ ID NO: 386494 - DNA, 29 bp, Artificial Sequence
  Description of Artificial Sequence: Synthetic oligonucleotide
agagcagagatacacctgccatgtgcagc

SEQ ID NO: 386495 - DNA, 29 bp, Artificial Sequence
  Description of Artificial Sequence: Synthetic oligonucleotide
agcagagatacacctgccatgtgcagcac

SEQ ID NO: 386496 - DNA, 28 bp, Artificial Sequence
  Description of Artificial Sequence: Synthetic oligonucleotide
gcagagatacacctgccatgtgcagcac

SEQ ID NO: 386497 - DNA, 28 bp, Artificial Sequence
  Description of Artificial Sequence: Synthetic oligonucleotide
cagagatacacctgccatgtgcagcacg

SEQ ID NO: 386498 - DNA, 29 bp, Artificial Sequence
  Description of Artificial Sequence: Synthetic oligonucleotide
agagatacacctgccatgtgcagcacgag

SEQ ID NO: 386499 - DNA, 28 bp, Artificial Sequence
  Description of Artificial Sequence: Synthetic oligonucleotide
gagatacacctgccatgtgcagcacgag

SEQ ID NO: 386500 - DNA, 28 bp, Artificial Sequence
  Description of Artificial Sequence: Synthetic oligonucleotide
agatacacctgccatgtgcagcacgagg

SEQ ID NO: 386501 - DNA, 27 bp, Artificial Sequence
  Description of Artificial Sequence: Synthetic oligonucleotide
gatacacctgccatgtgcagcacgagg

SEQ ID NO: 386502 - DNA, 27 bp, Artificial Sequence
  Description of Artificial Sequence: Synthetic oligonucleotide
atacacctgccatgtgcagcacgaggg

SEQ ID NO: 386503 - DNA, 26 bp, Artificial Sequence
  Description of Artificial Sequence: Synthetic oligonucleotide
tacacctgccatgtgcagcacgaggg

SEQ ID NO: 386504 - DNA, 25 bp, Artificial Sequence
  Description of Artificial Sequence: Synthetic oligonucleotide
acacctgccatgtgcagcacgaggg

SEQ ID NO: 386505 - DNA, 24 bp, Artificial Sequence
  Description of Artificial Sequence: Synthetic oligonucleotide
cacctgccatgtgcagcacgaggg

SEQ ID NO: 386506 - DNA, 24 bp, Artificial Sequence
  Description of Artificial Sequence: Synthetic oligonucleotide
acctgccatgtgcagcacgagggg

SEQ ID NO: 386507 - DNA, 23 bp, Artificial Sequence
  Description of Artificial Sequence: Synthetic oligonucleotide
cctgccatgtgcagcacgagggg

SEQ ID NO: 386508 - DNA, 24 bp, Artificial Sequence
  Description of Artificial Sequence: Synthetic oligonucleotide
ctgccatgtgcagcacgaggggct

SEQ ID NO: 386509 - DNA, 29 bp, Artificial Sequence
  Description of Artificial Sequence: Synthetic oligonucleotide
tccgcagatacctggagaacggcaagaag

SEQ ID NO: 386510 - DNA, 28 bp, Artificial Sequence
  Description of Artificial Sequence: Synthetic oligonucleotide
ccgcagatacctggagaacggcaagaag

SEQ ID NO: 386511 - DNA, 29 bp, Artificial Sequence
  Description of Artificial Sequence: Synthetic oligonucleotide
cgcagatacctggagaacggcaagaagac

SEQ ID NO: 386512 - DNA, 29 bp, Artificial Sequence
  Description of Artificial Sequence: Synthetic oligonucleotide
gcagatacctggagaacggcaagaagacg

SEQ ID NO: 386513 - DNA, 29 bp, Artificial Sequence
  Description of Artificial Sequence: Synthetic oligonucleotide
cagatacctggagaacggcaagaagacgc

SEQ ID NO: 386514 - DNA, 30 bp, Artificial Sequence
  Description of Artificial Sequence: Synthetic oligonucleotide
agatacctggagaacggcaagaagacgctg

SEQ ID NO: 386515 - DNA, 29 bp, Artificial Sequence
  Description of Artificial Sequence: Synthetic oligonucleotide
gatacctggagaacggcaagaagacgctg

SEQ ID NO: 386516 - DNA, 29 bp, Artificial Sequence
  Description of Artificial Sequence: Synthetic oligonucleotide
atacctggagaacggcaagaagacgctgc

SEQ ID NO: 386517 - DNA, 28 bp, Artificial Sequence
  Description of Artificial Sequence: Synthetic oligonucleotide
tacctggagaacggcaagaagacgctgc

SEQ ID NO: 386518 - DNA, 27 bp, Artificial Sequence
  Description of Artificial Sequence: Synthetic oligonucleotide
acctggagaacggcaagaagacgctgc

SEQ ID NO: 386519 - DNA, 27 bp, Artificial Sequence
  Description of Artificial Sequence: Synthetic oligonucleotide
cctggagaacggcaagaagacgctgca

SEQ ID NO: 386520 - DNA, 27 bp, Artificial Sequence
  Description of Artificial Sequence: Synthetic oligonucleotide
ctggagaacggcaagaagacgctgcag

SEQ ID NO: 386521 - DNA, 27 bp, Artificial Sequence
  Description of Artificial Sequence: Synthetic oligonucleotide
tggagaacggcaagaagacgctgcagc

SEQ ID NO: 386522 - DNA, 26 bp, Artificial Sequence
  Description of Artificial Sequence: Synthetic oligonucleotide
ggagaacggcaagaagacgctgcagc

SEQ ID NO: 386523 - DNA, 26 bp, Artificial Sequence
  Description of Artificial Sequence: Synthetic oligonucleotide
gagaacggcaagaagacgctgcagcg

SEQ ID NO: 386524 - DNA, 26 bp, Artificial Sequence
  Description of Artificial Sequence: Synthetic oligonucleotide
agaacggcaagaagacgctgcagcgc

SEQ ID NO: 386525 - DNA, 25 bp, Artificial Sequence
  Description of Artificial Sequence: Synthetic oligonucleotide
gaacggcaagaagacgctgcagcgc

SEQ ID NO: 386526 - DNA, 25 bp, Artificial Sequence
  Description of Artificial Sequence: Synthetic oligonucleotide
aacggcaagaagacgctgcagcgcg

SEQ ID NO: 386527 - DNA, 24 bp, Artificial Sequence
  Description of Artificial Sequence: Synthetic oligonucleotide
acggcaagaagacgctgcagcgcg

SEQ ID NO: 386528 - DNA, 23 bp, Artificial Sequence
  Description of Artificial Sequence: Synthetic oligonucleotide
cggcaagaagacgctgcagcgcg

SEQ ID NO: 386529 - DNA, 23 bp, Artificial Sequence
  Description of Artificial Sequence: Synthetic oligonucleotide
ggcaagaagacgctgcagcgcgc

SEQ ID NO: 386530 - DNA, 23 bp, Artificial Sequence
  Description of Artificial Sequence: Synthetic oligonucleotide
gcaagaagacgctgcagcgcgcg

SEQ ID NO: 386531 - DNA, 25 bp, Artificial Sequence
  Description of Artificial Sequence: Synthetic oligonucleotide
caagaagacgctgcagcgcgcggaa

SEQ ID NO: 386532 - DNA, 27 bp, Artificial Sequence
  Description of Artificial Sequence: Synthetic oligonucleotide
ctgaatgaggacctgcgctcctggact

SEQ ID NO: 386533 - DNA, 27 bp, Artificial Sequence
  Description of Artificial Sequence: Synthetic oligonucleotide
tgaatgaggacctgcgctcctggactg

SEQ ID NO: 386534 - DNA, 26 bp, Artificial Sequence
  Description of Artificial Sequence: Synthetic oligonucleotide
gaatgaggacctgcgctcctggactg

SEQ ID NO: 386535 - DNA, 26 bp, Artificial Sequence
  Description of Artificial Sequence: Synthetic oligonucleotide
aatgaggacctgcgctcctggactgc

SEQ ID NO: 386536 - DNA, 25 bp, Artificial Sequence
  Description of Artificial Sequence: Synthetic oligonucleotide
atgaggacctgcgctcctggactgc

SEQ ID NO: 386537 - DNA, 24 bp, Artificial Sequence
  Description of Artificial Sequence: Synthetic oligonucleotide
tgaggacctgcgctcctggactgc

SEQ ID NO: 386538 - DNA, 23 bp, Artificial Sequence
  Description of Artificial Sequence: Synthetic oligonucleotide
cgctcctggactgccgcggacaa

SEQ ID NO: 386539 - DNA, 23 bp, Artificial Sequence
  Description of Artificial Sequence: Synthetic oligonucleotide
gctcctggactgccgcggacaag

SEQ ID NO: 386540 - DNA, 23 bp, Artificial Sequence
  Description of Artificial Sequence: Synthetic oligonucleotide
ctcctggactgccgcggacaagg

SEQ ID NO: 386541 - DNA, 23 bp, Artificial Sequence
  Description of Artificial Sequence: Synthetic oligonucleotide
tcctggactgccgcggacaaggc

SEQ ID NO: 386542 - DNA, 22 bp, Artificial Sequence
  Description of Artificial Sequence: Synthetic oligonucleotide
cctggactgccgcggacaaggc

SEQ ID NO: 386543 - DNA, 22 bp, Artificial Sequence
  Description of Artificial Sequence: Synthetic oligonucleotide
ctggactgccgcggacaaggcg

SEQ ID NO: 386544 - DNA, 22 bp, Artificial Sequence
  Description of Artificial Sequence: Synthetic oligonucleotide
tggactgccgcggacaaggcgg

SEQ ID NO: 386545 - DNA, 21 bp, Artificial Sequence
  Description of Artificial Sequence: Synthetic oligonucleotide
ggactgccgcggacaaggcgg

SEQ ID NO: 386546 - DNA, 22 bp, Artificial Sequence
  Description of Artificial Sequence: Synthetic oligonucleotide
gactgccgcggacaaggcggct

SEQ ID NO: 386547 - DNA, 23 bp, Artificial Sequence
  Description of Artificial Sequence: Synthetic oligonucleotide
actgccgcggacaaggcggctca

SEQ ID NO: 386548 - DNA, 22 bp, Artificial Sequence
  Description of Artificial Sequence: Synthetic oligonucleotide
ctgccgcggacaaggcggctca

SEQ ID NO: 386549 - DNA, 24 bp, Artificial Sequence
  Description of Artificial Sequence: Synthetic oligonucleotide
tgccgcggacaaggcggctcagat

SEQ ID NO: 386550 - DNA, 32 bp, Artificial Sequence
  Description of Artificial Sequence: Synthetic oligonucleotide
ctatgacggcaaggattacatcgccctgaatg

SEQ ID NO: 386551 - DNA, 33 bp, Artificial Sequence
  Description of Artificial Sequence: Synthetic oligonucleotide
tatgacggcaaggattacatcgccctgaatgag

SEQ ID NO: 386552 - DNA, 32 bp, Artificial Sequence
  Description of Artificial Sequence: Synthetic oligonucleotide
atgacggcaaggattacatcgccctgaatgag

SEQ ID NO: 386553 - DNA, 31 bp, Artificial Sequence
  Description of Artificial Sequence: Synthetic oligonucleotide
tgacggcaaggattacatcgccctgaatgag

SEQ ID NO: 386554 - DNA, 30 bp, Artificial Sequence; identical to SEQ ID NO: 46036
  Description of Artificial Sequence: Synthetic oligonucleotide

SEQ ID NO: 386555 - DNA, 31 bp, Artificial Sequence; identical to SEQ ID NO: 46037
  Description of Artificial Sequence: Synthetic oligonucleotide

SEQ ID NO: 386556 - DNA, 30 bp, Artificial Sequence; identical to SEQ ID NO: 46038
  Description of Artificial Sequence: Synthetic oligonucleotide

SEQ ID NO: 386557 - DNA, 30 bp, Artificial Sequence; identical to SEQ ID NO: 46039
  Description of Artificial Sequence: Synthetic oligonucleotide

SEQ ID NO: 386558 - DNA, 30 bp, Artificial Sequence; identical to SEQ ID NO: 46040
  Description of Artificial Sequence: Synthetic oligonucleotide

SEQ ID NO: 386559 - DNA, 31 bp, Artificial Sequence; identical to SEQ ID NO: 46041
  Description of Artificial Sequence: Synthetic oligonucleotide

SEQ ID NO: 386560 - DNA, 31 bp, Artificial Sequence; identical to SEQ ID NO: 46042
  Description of Artificial Sequence: Synthetic oligonucleotide

SEQ ID NO: 386561 - DNA, 30 bp, Artificial Sequence; identical to SEQ ID NO: 46043
  Description of Artificial Sequence: Synthetic oligonucleotide

SEQ ID NO: 386562 - DNA, 31 bp, Artificial Sequence; identical to SEQ ID NO: 46044
  Description of Artificial Sequence: Synthetic oligonucleotide

SEQ ID NO: 386563 - DNA, 30 bp, Artificial Sequence; identical to SEQ ID NO: 46045
  Description of Artificial Sequence: Synthetic oligonucleotide

SEQ ID NO: 386564 - DNA, 29 bp, Artificial Sequence
  Description of Artificial Sequence: Synthetic oligonucleotide
acctggagaacaggaagaagacgctgcag

SEQ ID NO: 386565 - DNA, 28 bp, Artificial Sequence
  Description of Artificial Sequence: Synthetic oligonucleotide
cctggagaacaggaagaagacgctgcag

SEQ ID NO: 386566 - DNA, 28 bp, Artificial Sequence
  Description of Artificial Sequence: Synthetic oligonucleotide
ctggagaacaggaagaagacgctgcagc

SEQ ID NO: 386567 - DNA, 28 bp, Artificial Sequence
  Description of Artificial Sequence: Synthetic oligonucleotide
tggagaacaggaagaagacgctgcagcg

SEQ ID NO: 386568 - DNA, 27 bp, Artificial Sequence
  Description of Artificial Sequence: Synthetic oligonucleotide
ggagaacaggaagaagacgctgcagcg

SEQ ID NO: 386569 - DNA, 27 bp, Artificial Sequence
  Description of Artificial Sequence: Synthetic oligonucleotide
gagaacaggaagaagacgctgcagcgc

SEQ ID NO: 386570 - DNA, 27 bp, Artificial Sequence
  Description of Artificial Sequence: Synthetic oligonucleotide
agaacaggaagaagacgctgcagcgcg

SEQ ID NO: 386571 - DNA, 26 bp, Artificial Sequence
  Description of Artificial Sequence: Synthetic oligonucleotide
gaacaggaagaagacgctgcagcgcg

SEQ ID NO: 386572 - DNA, 26 bp, Artificial Sequence
  Description of Artificial Sequence: Synthetic oligonucleotide
aacaggaagaagacgctgcagcgcgc

SEQ ID NO: 386573 - DNA, 25 bp, Artificial Sequence
  Description of Artificial Sequence: Synthetic oligonucleotide
acaggaagaagacgctgcagcgcgc

SEQ ID NO: 386574 - DNA, 24 bp, Artificial Sequence
  Description of Artificial Sequence: Synthetic oligonucleotide
caggaagaagacgctgcagcgcgc

SEQ ID NO: 386575 - DNA, 24 bp, Artificial Sequence
  Description of Artificial Sequence: Synthetic oligonucleotide
aggaagaagacgctgcagcgcgcg

SEQ ID NO: 386576 - DNA, 36 bp, Artificial Sequence; identical to SEQ ID NO: 49063
  Description of Artificial Sequence: Synthetic oligonucleotide

SEQ ID NO: 386577 - DNA, 35 bp, Artificial Sequence; identical to SEQ ID NO: 49064
  Description of Artificial Sequence: Synthetic oligonucleotide

SEQ ID NO: 386578 - DNA, 34 bp, Artificial Sequence; identical to SEQ ID NO: 49065
  Description of Artificial Sequence: Synthetic oligonucleotide

SEQ ID NO: 386579 - DNA, 33 bp, Artificial Sequence; identical to SEQ ID NO: 49066
  Description of Artificial Sequence: Synthetic oligonucleotide

SEQ ID NO: 386580 - DNA, 32 bp, Artificial Sequence; identical to SEQ ID NO: 49067
  Description of Artificial Sequence: Synthetic oligonucleotide

SEQ ID NO: 386581 - DNA, 31 bp, Artificial Sequence; identical to SEQ ID NO: 49068
  Description of Artificial Sequence: Synthetic oligonucleotide

SEQ ID NO: 386582 - DNA, 31 bp, Artificial Sequence; identical to SEQ ID NO: 49069
  Description of Artificial Sequence: Synthetic oligonucleotide

SEQ ID NO: 386583 - DNA, 31 bp, Artificial Sequence; identical to SEQ ID NO: 49070
  Description of Artificial Sequence: Synthetic oligonucleotide

SEQ ID NO: 386584 - DNA, 30 bp, Artificial Sequence; identical to SEQ ID NO: 49071
  Description of Artificial Sequence: Synthetic oligonucleotide

SEQ ID NO: 386585 - DNA, 30 bp, Artificial Sequence; identical to SEQ ID NO: 49072
  Description of Artificial Sequence: Synthetic oligonucleotide

SEQ ID NO: 386586 - DNA, 29 bp, Artificial Sequence
  Description of Artificial Sequence: Synthetic oligonucleotide
tcgcctacgacggcaaggattatatcgcc

SEQ ID NO: 386587 - DNA, 28 bp, Artificial Sequence
  Description of Artificial Sequence: Synthetic oligonucleotide
cgcctacgacggcaaggattatatcgcc

SEQ ID NO: 386588 - DNA, 28 bp, Artificial Sequence
  Description of Artificial Sequence: Synthetic oligonucleotide
gcctacgacggcaaggattatatcgccc

SEQ ID NO: 386589 - DNA, 29 bp, Artificial Sequence
  Description of Artificial Sequence: Synthetic oligonucleotide
cctacgacggcaaggattatatcgccctg

SEQ ID NO: 386590 - DNA, 32 bp, Artificial Sequence; identical to SEQ ID NO: 49077
  Description of Artificial Sequence: Synthetic oligonucleotide

SEQ ID NO: 386591 - DNA, 33 bp, Artificial Sequence; identical to SEQ ID NO: 49078
  Description of Artificial Sequence: Synthetic oligonucleotide

SEQ ID NO: 386592 - DNA, 32 bp, Artificial Sequence; identical to SEQ ID NO: 49079
  Description of Artificial Sequence: Synthetic oligonucleotide

SEQ ID NO: 386593 - DNA, 31 bp, Artificial Sequence; identical to SEQ ID NO: 49080
  Description of Artificial Sequence: Synthetic oligonucleotide

SEQ ID NO: 386594 - DNA, 31 bp, Artificial Sequence; identical to SEQ ID NO: 49081
  Description of Artificial Sequence: Synthetic oligonucleotide

SEQ ID NO: 386595 - DNA, 32 bp, Artificial Sequence; identical to SEQ ID NO: 49082
  Description of Artificial Sequence: Synthetic oligonucleotide

SEQ ID NO: 386596 - DNA, 31 bp, Artificial Sequence; identical to SEQ ID NO: 49083
  Description of Artificial Sequence: Synthetic oligonucleotide

SEQ ID NO: 386597 - DNA, 31 bp, Artificial Sequence; identical to SEQ ID NO: 49084
  Description of Artificial Sequence: Synthetic oligonucleotide

SEQ ID NO: 386598 - DNA, 32 bp, Artificial Sequence; identical to SEQ ID NO: 49085
  Description of Artificial Sequence: Synthetic oligonucleotide

SEQ ID NO: 386599 - DNA, 32 bp, Artificial Sequence; identical to SEQ ID NO: 49086
  Description of Artificial Sequence: Synthetic oligonucleotide

SEQ ID NO: 386600 - DNA, 32 bp, Artificial Sequence; identical to SEQ ID NO: 49087
  Description of Artificial Sequence: Synthetic oligonucleotide

SEQ ID NO: 386601 - DNA, 31 bp, Artificial Sequence; identical to SEQ ID NO: 49088
  Description of Artificial Sequence: Synthetic oligonucleotide

SEQ ID NO: 386602 - DNA, 30 bp, Artificial Sequence; identical to SEQ ID NO: 49089
  Description of Artificial Sequence: Synthetic oligonucleotide

SEQ ID NO: 386603 - DNA, 30 bp, Artificial Sequence; identical to SEQ ID NO: 49090
  Description of Artificial Sequence: Synthetic oligonucleotide

SEQ ID NO: 386604 - DNA, 31 bp, Artificial Sequence; identical to SEQ ID NO: 49091
  Description of Artificial Sequence: Synthetic oligonucleotide

SEQ ID NO: 386605 - DNA, 30 bp, Artificial Sequence; identical to SEQ ID NO: 49092
  Description of Artificial Sequence: Synthetic oligonucleotide

SEQ ID NO: 386606 - DNA, 29 bp, Artificial Sequence
  Description of Artificial Sequence: Synthetic oligonucleotide
tatatcgccctgaatgaggacctgcgctc

SEQ ID NO: 386607 - DNA, 28 bp, Artificial Sequence
  Description of Artificial Sequence: Synthetic oligonucleotide
atatcgccctgaatgaggacctgcgctc

SEQ ID NO: 386608 - DNA, 27 bp, Artificial Sequence
  Description of Artificial Sequence: Synthetic oligonucleotide
tatcgccctgaatgaggacctgcgctc

SEQ ID NO: 386609 - DNA, 24 bp, Artificial Sequence
  Description of Artificial Sequence: Synthetic oligonucleotide
agctgagagcctacctggagggcg

SEQ ID NO: 386610 - DNA, 23 bp, Artificial Sequence
  Description of Artificial Sequence: Synthetic oligonucleotide
gctgagagcctacctggagggcg

SEQ ID NO: 386611 - DNA, 23 bp, Artificial Sequence
  Description of Artificial Sequence: Synthetic oligonucleotide
ctgagagcctacctggagggcgc

SEQ ID NO: 386612 - DNA, 24 bp, Artificial Sequence
  Description of Artificial Sequence: Synthetic oligonucleotide
tgagagcctacctggagggcgcgt

SEQ ID NO: 386613 - DNA, 23 bp, Artificial Sequence
  Description of Artificial Sequence: Synthetic oligonucleotide
gagagcctacctggagggcgcgt

SEQ ID NO: 386614 - DNA, 23 bp, Artificial Sequence
  Description of Artificial Sequence: Synthetic oligonucleotide
agagcctacctggagggcgcgtg

SEQ ID NO: 386615 - DNA, 22 bp, Artificial Sequence
  Description of Artificial Sequence: Synthetic oligonucleotide
gagcctacctggagggcgcgtg

SEQ ID NO: 386616 - DNA, 22 bp, Artificial Sequence
  Description of Artificial Sequence: Synthetic oligonucleotide
agcctacctggagggcgcgtgc

SEQ ID NO: 386617 - DNA, 21 bp, Artificial Sequence
  Description of Artificial Sequence: Synthetic oligonucleotide
gcctacctggagggcgcgtgc

SEQ ID NO: 386618 - DNA, 22 bp, Artificial Sequence
  Description of Artificial Sequence: Synthetic oligonucleotide
cctacctggagggcgcgtgcgt

SEQ ID NO: 386619 - DNA, 22 bp, Artificial Sequence
  Description of Artificial Sequence: Synthetic oligonucleotide
ctacctggagggcgcgtgcgtg

SEQ ID NO: 386620 - DNA, 23 bp, Artificial Sequence
  Description of Artificial Sequence: Synthetic oligonucleotide
tacctggagggcgcgtgcgtgga

SEQ ID NO: 386621 - DNA, 22 bp, Artificial Sequence
  Description of Artificial Sequence: Synthetic oligonucleotide
acctggagggcgcgtgcgtgga

SEQ ID NO: 386622 - DNA, 21 bp, Artificial Sequence
  Description of Artificial Sequence: Synthetic oligonucleotide
cctggagggcgcgtgcgtgga

SEQ ID NO: 386623 - DNA, 22 bp, Artificial Sequence
  Description of Artificial Sequence: Synthetic oligonucleotide
ctggagggcgcgtgcgtggagt

SEQ ID NO: 386624 - DNA, 22 bp, Artificial Sequence
  Description of Artificial Sequence: Synthetic oligonucleotide
tggagggcgcgtgcgtggagtg

SEQ ID NO: 386625 - DNA, 21 bp, Artificial Sequence
  Description of Artificial Sequence: Synthetic oligonucleotide
ggagggcgcgtgcgtggagtg

SEQ ID NO: 386626 - DNA, 21 bp, Artificial Sequence
  Description of Artificial Sequence: Synthetic oligonucleotide
gagggcgcgtgcgtggagtgg

SEQ ID NO: 386627 - DNA, 22 bp, Artificial Sequence
  Description of Artificial Sequence: Synthetic oligonucleotide
agggcgcgtgcgtggagtggct

SEQ ID NO: 386628 - DNA, 21 bp, Artificial Sequence
  Description of Artificial Sequence: Synthetic oligonucleotide
gggcgcgtgcgtggagtggct

SEQ ID NO: 386629 - DNA, 21 bp, Artificial Sequence
  Description of Artificial Sequence: Synthetic oligonucleotide
ggcgcgtgcgtggagtggctc

SEQ ID NO: 386630 - DNA, 21 bp, Artificial Sequence
  Description of Artificial Sequence: Synthetic oligonucleotide
gcgcgtgcgtggagtggctcc

SEQ ID NO: 386631 - DNA, 21 bp, Artificial Sequence
  Description of Artificial Sequence: Synthetic oligonucleotide
cgcgtgcgtggagtggctccg

SEQ ID NO: 386632 - DNA, 22 bp, Artificial Sequence
  Description of Artificial Sequence: Synthetic oligonucleotide
gcgtgcgtggagtggctccgca

SEQ ID NO: 386633 - DNA, 29 bp, Artificial Sequence
  Description of Artificial Sequence: Synthetic oligonucleotide
caaagacacacgtgacccaccatcccatc

SEQ ID NO: 386634 - DNA, 30 bp, Artificial Sequence; identical to SEQ ID NO: 49217
  Description of Artificial Sequence: Synthetic oligonucleotide

SEQ ID NO: 386635 - DNA, 29 bp, Artificial Sequence
  Description of Artificial Sequence: Synthetic oligonucleotide
aagacacacgtgacccaccatcccatctc

SEQ ID NO: 386636 - DNA, 28 bp, Artificial Sequence
  Description of Artificial Sequence: Synthetic oligonucleotide
agacacacgtgacccaccatcccatctc

SEQ ID NO: 386637 - DNA, 27 bp, Artificial Sequence
  Description of Artificial Sequence: Synthetic oligonucleotide
gacacacgtgacccaccatcccatctc

SEQ ID NO: 386638 - DNA, 28 bp, Artificial Sequence
  Description of Artificial Sequence: Synthetic oligonucleotide
acacacgtgacccaccatcccatctctg

SEQ ID NO: 386639 - DNA, 27 bp, Artificial Sequence
  Description of Artificial Sequence: Synthetic oligonucleotide
cacacgtgacccaccatcccatctctg

SEQ ID NO: 386640 - DNA, 28 bp, Artificial Sequence
  Description of Artificial Sequence: Synthetic oligonucleotide
acacgtgacccaccatcccatctctgac

SEQ ID NO: 386641 - DNA, 27 bp, Artificial Sequence
  Description of Artificial Sequence: Synthetic oligonucleotide
cacgtgacccaccatcccatctctgac

SEQ ID NO: 386642 - DNA, 27 bp, Artificial Sequence
  Description of Artificial Sequence: Synthetic oligonucleotide
acgtgacccaccatcccatctctgacc

SEQ ID NO: 386643 - DNA, 27 bp, Artificial Sequence
  Description of Artificial Sequence: Synthetic oligonucleotide
cgtgacccaccatcccatctctgacca

SEQ ID NO: 386644 - DNA, 28 bp, Artificial Sequence
  Description of Artificial Sequence: Synthetic oligonucleotide
gtgacccaccatcccatctctgaccatg

SEQ ID NO: 386645 - DNA, 29 bp, Artificial Sequence
  Description of Artificial Sequence: Synthetic oligonucleotide
tgacccaccatcccatctctgaccatgag

SEQ ID NO: 386646 - DNA, 28 bp, Artificial Sequence
  Description of Artificial Sequence: Synthetic oligonucleotide
gacccaccatcccatctctgaccatgag

SEQ ID NO: 386647 - DNA, 28 bp, Artificial Sequence
  Description of Artificial Sequence: Synthetic oligonucleotide
acccaccatcccatctctgaccatgagg

SEQ ID NO: 386648 - DNA, 27 bp, Artificial Sequence
  Description of Artificial Sequence: Synthetic oligonucleotide
cccaccatcccatctctgaccatgagg

SEQ ID NO: 386649 - DNA, 27 bp, Artificial Sequence
  Description of Artificial Sequence: Synthetic oligonucleotide
ccaccatcccatctctgaccatgaggc

SEQ ID NO: 386650 - DNA, 27 bp, Artificial Sequence
  Description of Artificial Sequence: Synthetic oligonucleotide
caccatcccatctctgaccatgaggcc

SEQ ID NO: 386651 - DNA, 28 bp, Artificial Sequence
  Description of Artificial Sequence: Synthetic oligonucleotide
accatcccatctctgaccatgaggccac

SEQ ID NO: 386652 - DNA, 27 bp, Artificial Sequence
  Description of Artificial Sequence: Synthetic oligonucleotide
ccatcccatctctgaccatgaggccac

SEQ ID NO: 386653 - DNA, 27 bp, Artificial Sequence
  Description of Artificial Sequence: Synthetic oligonucleotide
catcccatctctgaccatgaggccacc

SEQ ID NO: 386654 - DNA, 27 bp, Artificial Sequence
  Description of Artificial Sequence: Synthetic oligonucleotide
atcccatctctgaccatgaggccaccc

SEQ ID NO: 386655 - DNA, 27 bp, Artificial Sequence
  Description of Artificial Sequence: Synthetic oligonucleotide
tcccatctctgaccatgaggccaccct

SEQ ID NO: 386656 - DNA, 26 bp, Artificial Sequence
  Description of Artificial Sequence: Synthetic oligonucleotide
gtgaggcggagcagtggagagcctat

SEQ ID NO: 386657 - DNA, 27 bp, Artificial Sequence
  Description of Artificial Sequence: Synthetic oligonucleotide
tgaggcggagcagtggagagcctatct

SEQ ID NO: 386658 - DNA, 26 bp, Artificial Sequence
  Description of Artificial Sequence: Synthetic oligonucleotide
gaggcggagcagtggagagcctatct

SEQ ID NO: 386659 - DNA, 26 bp, Artificial Sequence
  Description of Artificial Sequence: Synthetic oligonucleotide
aggcggagcagtggagagcctatctg

SEQ ID NO: 386660 - DNA, 25 bp, Artificial Sequence
  Description of Artificial Sequence: Synthetic oligonucleotide
ggcggagcagtggagagcctatctg

SEQ ID NO: 386661 - DNA, 26 bp, Artificial Sequence
  Description of Artificial Sequence: Synthetic oligonucleotide
gcggagcagtggagagcctatctgga

SEQ ID NO: 386662 - DNA, 26 bp, Artificial Sequence
  Description of Artificial Sequence: Synthetic oligonucleotide
cggagcagtggagagcctatctggag

SEQ ID NO: 386663 - DNA, 26 bp, Artificial Sequence
  Description of Artificial Sequence: Synthetic oligonucleotide
ggagcagtggagagcctatctggagg

SEQ ID NO: 386664 - DNA, 26 bp, Artificial Sequence
  Description of Artificial Sequence: Synthetic oligonucleotide
gagcagtggagagcctatctggaggg

SEQ ID NO: 386665 - DNA, 27 bp, Artificial Sequence
  Description of Artificial Sequence: Synthetic oligonucleotide
agcagtggagagcctatctggagggca

SEQ ID NO: 386666 - DNA, 26 bp, Artificial Sequence
  Description of Artificial Sequence: Synthetic oligonucleotide
gcagtggagagcctatctggagggca

SEQ ID NO: 386667 - DNA, 26 bp, Artificial Sequence
  Description of Artificial Sequence: Synthetic oligonucleotide
cagtggagagcctatctggagggcac

SEQ ID NO: 386668 - DNA, 27 bp, Artificial Sequence
  Description of Artificial Sequence: Synthetic oligonucleotide
agtggagagcctatctggagggcacgt

SEQ ID NO: 386669 - DNA, 26 bp, Artificial Sequence
  Description of Artificial Sequence: Synthetic oligonucleotide
gtggagagcctatctggagggcacgt

SEQ ID NO: 386670 - DNA, 26 bp, Artificial Sequence
  Description of Artificial Sequence: Synthetic oligonucleotide
tggagagcctatctggagggcacgtg

SEQ ID NO: 386671 - DNA, 25 bp, Artificial Sequence
  Description of Artificial Sequence: Synthetic oligonucleotide
ggagagcctatctggagggcacgtg

SEQ ID NO: 386672 - DNA, 25 bp, Artificial Sequence
  Description of Artificial Sequence: Synthetic oligonucleotide
gagagcctatctggagggcacgtgc

SEQ ID NO: 386673 - DNA, 26 bp, Artificial Sequence
  Description of Artificial Sequence: Synthetic oligonucleotide
agagcctatctggagggcacgtgcgt

SEQ ID NO: 386674 - DNA, 25 bp, Artificial Sequence
  Description of Artificial Sequence: Synthetic oligonucleotide
gagcctatctggagggcacgtgcgt

SEQ ID NO: 386675 - DNA, 25 bp, Artificial Sequence
  Description of Artificial Sequence: Synthetic oligonucleotide
agcctatctggagggcacgtgcgtg

SEQ ID NO: 386676 - DNA, 24 bp, Artificial Sequence
  Description of Artificial Sequence: Synthetic oligonucleotide
gcctatctggagggcacgtgcgtg

SEQ ID NO: 386677 - DNA, 25 bp, Artificial Sequence
  Description of Artificial Sequence: Synthetic oligonucleotide
cctatctggagggcacgtgcgtgga

SEQ ID NO: 386678 - DNA, 26 bp, Artificial Sequence
  Description of Artificial Sequence: Synthetic oligonucleotide
ctatctggagggcacgtgcgtggagt

SEQ ID NO: 386679 - DNA, 26 bp, Artificial Sequence
  Description of Artificial Sequence: Synthetic oligonucleotide
tatctggagggcacgtgcgtggagtg

SEQ ID NO: 386680 - DNA, 25 bp, Artificial Sequence
  Description of Artificial Sequence: Synthetic oligonucleotide
atctggagggcacgtgcgtggagtg

SEQ ID NO: 386681 - DNA, 24 bp, Artificial Sequence
  Description of Artificial Sequence: Synthetic oligonucleotide
tctggagggcacgtgcgtggagtg

SEQ ID NO: 386682 - DNA, 23 bp, Artificial Sequence
  Description of Artificial Sequence: Synthetic oligonucleotide
cgagtccaagaggggagccgcga

SEQ ID NO: 386683 - DNA, 23 bp, Artificial Sequence
  Description of Artificial Sequence: Synthetic oligonucleotide
gagtccaagaggggagccgcgag

SEQ ID NO: 386684 - DNA, 23 bp, Artificial Sequence
  Description of Artificial Sequence: Synthetic oligonucleotide
agtccaagaggggagccgcgagc

SEQ ID NO: 386685 - DNA, 22 bp, Artificial Sequence
  Description of Artificial Sequence: Synthetic oligonucleotide
gtccaagaggggagccgcgagc

SEQ ID NO: 386686 - DNA, 22 bp, Artificial Sequence
  Description of Artificial Sequence: Synthetic oligonucleotide
tccaagaggggagccgcgagcg

SEQ ID NO: 386687 - DNA, 21 bp, Artificial Sequence
  Description of Artificial Sequence: Synthetic oligonucleotide
ccaagaggggagccgcgagcg

SEQ ID NO: 386688 - DNA, 21 bp, Artificial Sequence
  Description of Artificial Sequence: Synthetic oligonucleotide
caagaggggagccgcgagcgc

SEQ ID NO: 386689 - DNA, 21 bp, Artificial Sequence
  Description of Artificial Sequence: Synthetic oligonucleotide
aagaggggagccgcgagcgcc

SEQ ID NO: 386690 - DNA, 30 bp, Artificial Sequence; identical to SEQ ID NO: 49438
  Description of Artificial Sequence: Synthetic oligonucleotide

SEQ ID NO: 386691 - DNA, 31 bp, Artificial Sequence; identical to SEQ ID NO: 49439
  Description of Artificial Sequence: Synthetic oligonucleotide

SEQ ID NO: 386692 - DNA, 30 bp, Artificial Sequence; identical to SEQ ID NO: 49440
  Description of Artificial Sequence: Synthetic oligonucleotide

SEQ ID NO: 386693 - DNA, 30 bp, Artificial Sequence; identical to SEQ ID NO: 49441
  Description of Artificial Sequence: Synthetic oligonucleotide

SEQ ID NO: 386694 - DNA, 29 bp, Artificial Sequence
  Description of Artificial Sequence: Synthetic oligonucleotide
ccatgaggtatttctacaccgccgtctcc

SEQ ID NO: 386695 - DNA, 29 bp, Artificial Sequence
  Description of Artificial Sequence: Synthetic oligonucleotide
catgaggtatttctacaccgccgtctccc

SEQ ID NO: 386696 - DNA, 29 bp, Artificial Sequence
  Description of Artificial Sequence: Synthetic oligonucleotide
atgaggtatttctacaccgccgtctcccg

SEQ ID NO: 386697 - DNA, 28 bp, Artificial Sequence
  Description of Artificial Sequence: Synthetic oligonucleotide
tgaggtatttctacaccgccgtctcccg

SEQ ID NO: 386698 - DNA, 27 bp, Artificial Sequence
  Description of Artificial Sequence: Synthetic oligonucleotide
gaggtatttctacaccgccgtctcccg

SEQ ID NO: 386699 - DNA, 27 bp, Artificial Sequence
  Description of Artificial Sequence: Synthetic oligonucleotide
aggtatttctacaccgccgtctcccgg

SEQ ID NO: 386700 - DNA, 26 bp, Artificial Sequence
  Description of Artificial Sequence: Synthetic oligonucleotide
ggtatttctacaccgccgtctcccgg

SEQ ID NO: 386701 - DNA, 26 bp, Artificial Sequence
  Description of Artificial Sequence: Synthetic oligonucleotide
gtatttctacaccgccgtctcccggc

SEQ ID NO: 386702 - DNA, 26 bp, Artificial Sequence
  Description of Artificial Sequence: Synthetic oligonucleotide
tatttctacaccgccgtctcccggcc

SEQ ID NO: 386703 - DNA, 25 bp, Artificial Sequence
  Description of Artificial Sequence: Synthetic oligonucleotide
atttctacaccgccgtctcccggcc

SEQ ID NO: 386704 - DNA, 24 bp, Artificial Sequence
  Description of Artificial Sequence: Synthetic oligonucleotide
tttctacaccgccgtctcccggcc

SEQ ID NO: 386705 - DNA, 23 bp, Artificial Sequence
  Description of Artificial Sequence: Synthetic oligonucleotide
ttctacaccgccgtctcccggcc

SEQ ID NO: 386706 - DNA, 22 bp, Artificial Sequence
  Description of Artificial Sequence: Synthetic oligonucleotide
tctacaccgccgtctcccggcc

SEQ ID NO: 386707 - DNA, 21 bp, Artificial Sequence
  Description of Artificial Sequence: Synthetic oligonucleotide
ctacaccgccgtctcccggcc

SEQ ID NO: 386708 - DNA, 21 bp, Artificial Sequence
  Description of Artificial Sequence: Synthetic oligonucleotide
tacaccgccgtctcccggccc

SEQ ID NO: 386709 - DNA, 26 bp, Artificial Sequence
  Description of Artificial Sequence: Synthetic oligonucleotide
agcctgcggaacctgcgcggctatta

SEQ ID NO: 386710 - DNA, 25 bp, Artificial Sequence
  Description of Artificial Sequence: Synthetic oligonucleotide
gcctgcggaacctgcgcggctatta

SEQ ID NO: 386711 - DNA, 27 bp, Artificial Sequence
  Description of Artificial Sequence: Synthetic oligonucleotide
cctgcggaacctgcgcggctattacaa

SEQ ID NO: 386712 - DNA, 27 bp, Artificial Sequence
  Description of Artificial Sequence: Synthetic oligonucleotide
ctgcggaacctgcgcggctattacaac

SEQ ID NO: 386713 - DNA, 27 bp, Artificial Sequence
  Description of Artificial Sequence: Synthetic oligonucleotide
tgcggaacctgcgcggctattacaacc

SEQ ID NO: 386714 - DNA, 27 bp, Artificial Sequence
  Description of Artificial Sequence: Synthetic oligonucleotide
gcggaacctgcgcggctattacaacca

SEQ ID NO: 386715 - DNA, 27 bp, Artificial Sequence
  Description of Artificial Sequence: Synthetic oligonucleotide
cggaacctgcgcggctattacaaccag

SEQ ID NO: 386716 - DNA, 28 bp, Artificial Sequence
  Description of Artificial Sequence: Synthetic oligonucleotide
ggaacctgcgcggctattacaaccagag

SEQ ID NO: 386717 - DNA, 28 bp, Artificial Sequence
  Description of Artificial Sequence: Synthetic oligonucleotide
gaacctgcgcggctattacaaccagagc

SEQ ID NO: 386718 - DNA, 28 bp, Artificial Sequence
  Description of Artificial Sequence: Synthetic oligonucleotide
aacctgcgcggctattacaaccagagcg

SEQ ID NO: 386719 - DNA, 27 bp, Artificial Sequence
  Description of Artificial Sequence: Synthetic oligonucleotide
acctgcgcggctattacaaccagagcg

SEQ ID NO: 386720 - DNA, 26 bp, Artificial Sequence
  Description of Artificial Sequence: Synthetic oligonucleotide
ggctattacaaccagagcgaggccgg

SEQ ID NO: 386721 - DNA, 27 bp, Artificial Sequence
  Description of Artificial Sequence: Synthetic oligonucleotide
gctattacaaccagagcgaggccgggt

SEQ ID NO: 386722 - DNA, 27 bp, Artificial Sequence
  Description of Artificial Sequence: Synthetic oligonucleotide
ctattacaaccagagcgaggccgggtc

SEQ ID NO: 386723 - DNA, 28 bp, Artificial Sequence
  Description of Artificial Sequence: Synthetic oligonucleotide
tattacaaccagagcgaggccgggtctc

SEQ ID NO: 386724 - DNA, 27 bp, Artificial Sequence
  Description of Artificial Sequence: Synthetic oligonucleotide
attacaaccagagcgaggccgggtctc

SEQ ID NO: 386725 - DNA, 27 bp, Artificial Sequence
  Description of Artificial Sequence: Synthetic oligonucleotide
ttacaaccagagcgaggccgggtctca

SEQ ID NO: 386726 - DNA, 22 bp, Artificial Sequence
  Description of Artificial Sequence: Synthetic oligonucleotide
gcggcccgtgaggcggagcaat

SEQ ID NO: 386727 - DNA, 22 bp, Artificial Sequence
  Description of Artificial Sequence: Synthetic oligonucleotide
cggcccgtgaggcggagcaatg

SEQ ID NO: 386728 - DNA, 23 bp, Artificial Sequence
  Description of Artificial Sequence: Synthetic oligonucleotide
ggcccgtgaggcggagcaatgga

SEQ ID NO: 386729 - DNA, 24 bp, Artificial Sequence
  Description of Artificial Sequence: Synthetic oligonucleotide
gcccgtgaggcggagcaatggaga

SEQ ID NO: 386730 - DNA, 24 bp, Artificial Sequence
  Description of Artificial Sequence: Synthetic oligonucleotide
cccgtgaggcggagcaatggagag

SEQ ID NO: 386731 - DNA, 24 bp, Artificial Sequence
  Description of Artificial Sequence: Synthetic oligonucleotide
ccgtgaggcggagcaatggagagc

SEQ ID NO: 386732 - DNA, 26 bp, Artificial Sequence
  Description of Artificial Sequence: Synthetic oligonucleotide
cgtgaggcggagcaatggagagccta

SEQ ID NO: 386733 - DNA, 26 bp, Artificial Sequence
  Description of Artificial Sequence: Synthetic oligonucleotide
gtgaggcggagcaatggagagcctac

SEQ ID NO: 386734 - DNA, 27 bp, Artificial Sequence
  Description of Artificial Sequence: Synthetic oligonucleotide
tgaggcggagcaatggagagcctacct

SEQ ID NO: 386735 - DNA, 26 bp, Artificial Sequence
  Description of Artificial Sequence: Synthetic oligonucleotide
gaggcggagcaatggagagcctacct

SEQ ID NO: 386736 - DNA, 26 bp, Artificial Sequence
  Description of Artificial Sequence: Synthetic oligonucleotide
aggcggagcaatggagagcctacctg

SEQ ID NO: 386737 - DNA, 25 bp, Artificial Sequence
  Description of Artificial Sequence: Synthetic oligonucleotide
ggcggagcaatggagagcctacctg

SEQ ID NO: 386738 - DNA, 26 bp, Artificial Sequence
  Description of Artificial Sequence: Synthetic oligonucleotide
gcggagcaatggagagcctacctgga

SEQ ID NO: 386739 - DNA, 26 bp, Artificial Sequence
  Description of Artificial Sequence: Synthetic oligonucleotide
cggagcaatggagagcctacctggag

SEQ ID NO: 386740 - DNA, 26 bp, Artificial Sequence
  Description of Artificial Sequence: Synthetic oligonucleotide
ggagcaatggagagcctacctggagg

SEQ ID NO: 386741 - DNA, 26 bp, Artificial Sequence
  Description of Artificial Sequence: Synthetic oligonucleotide
gagcaatggagagcctacctggaggg

SEQ ID NO: 386742 - DNA, 27 bp, Artificial Sequence
  Description of Artificial Sequence: Synthetic oligonucleotide
agcaatggagagcctacctggagggca

SEQ ID NO: 386743 - DNA, 26 bp, Artificial Sequence
  Description of Artificial Sequence: Synthetic oligonucleotide
gcaatggagagcctacctggagggca

SEQ ID NO: 386744 - DNA, 26 bp, Artificial Sequence
  Description of Artificial Sequence: Synthetic oligonucleotide
caatggagagcctacctggagggcac

SEQ ID NO: 386745 - DNA, 27 bp, Artificial Sequence
  Description of Artificial Sequence: Synthetic oligonucleotide
aatggagagcctacctggagggcacgt

SEQ ID NO: 386746 - DNA, 26 bp, Artificial Sequence
  Description of Artificial Sequence: Synthetic oligonucleotide
atggagagcctacctggagggcacgt

SEQ ID NO: 386747 - DNA, 25 bp, Artificial Sequence
  Description of Artificial Sequence: Synthetic oligonucleotide
cgccaggcacaggctgaccgagtaa

SEQ ID NO: 386748 - DNA, 25 bp, Artificial Sequence
  Description of Artificial Sequence: Synthetic oligonucleotide
gccaggcacaggctgaccgagtaag

SEQ ID NO: 386749 - DNA, 25 bp, Artificial Sequence
  Description of Artificial Sequence: Synthetic oligonucleotide
ccaggcacaggctgaccgagtaagc

SEQ ID NO: 386750 - DNA, 26 bp, Artificial Sequence
  Description of Artificial Sequence: Synthetic oligonucleotide
caggcacaggctgaccgagtaagcct

SEQ ID NO: 386751 - DNA, 26 bp, Artificial Sequence
  Description of Artificial Sequence: Synthetic oligonucleotide
aggcacaggctgaccgagtaagcctg

SEQ ID NO: 386752 - DNA, 25 bp, Artificial Sequence
  Description of Artificial Sequence: Synthetic oligonucleotide
ggcacaggctgaccgagtaagcctg

SEQ ID NO: 386753 - DNA, 25 bp, Artificial Sequence
  Description of Artificial Sequence: Synthetic oligonucleotide
gcacaggctgaccgagtaagcctgc

SEQ ID NO: 386754 - DNA, 25 bp, Artificial Sequence
  Description of Artificial Sequence: Synthetic oligonucleotide
cacaggctgaccgagtaagcctgcg

SEQ ID NO: 386755 - DNA, 27 bp, Artificial Sequence
  Description of Artificial Sequence: Synthetic oligonucleotide
acaggctgaccgagtaagcctgcggaa

SEQ ID NO: 386756 - DNA, 26 bp, Artificial Sequence
  Description of Artificial Sequence: Synthetic oligonucleotide
caggctgaccgagtaagcctgcggaa

SEQ ID NO: 386757 - DNA, 26 bp, Artificial Sequence
  Description of Artificial Sequence: Synthetic oligonucleotide
aggctgaccgagtaagcctgcggaac

SEQ ID NO: 386758 - DNA, 25 bp, Artificial Sequence
  Description of Artificial Sequence: Synthetic oligonucleotide
ggctgaccgagtaagcctgcggaac

SEQ ID NO: 386759 - DNA, 26 bp, Artificial Sequence
  Description of Artificial Sequence: Synthetic oligonucleotide
gctgaccgagtaagcctgcggaacct

SEQ ID NO: 386760 - DNA, 26 bp, Artificial Sequence
  Description of Artificial Sequence: Synthetic oligonucleotide
ctgaccgagtaagcctgcggaacctg

SEQ ID NO: 386761 - DNA, 26 bp, Artificial Sequence
  Description of Artificial Sequence: Synthetic oligonucleotide
tgaccgagtaagcctgcggaacctgc

SEQ ID NO: 386762 - DNA, 25 bp, Artificial Sequence
  Description of Artificial Sequence: Synthetic oligonucleotide
gaccgagtaagcctgcggaacctgc

SEQ ID NO: 386763 - DNA, 25 bp, Artificial Sequence
  Description of Artificial Sequence: Synthetic oligonucleotide
accgagtaagcctgcggaacctgcg

SEQ ID NO: 386764 - DNA, 24 bp, Artificial Sequence
  Description of Artificial Sequence: Synthetic oligonucleotide
ccgagtaagcctgcggaacctgcg

SEQ ID NO: 386765 - DNA, 24 bp, Artificial Sequence
  Description of Artificial Sequence: Synthetic oligonucleotide
cgagtaagcctgcggaacctgcgc

SEQ ID NO: 386766 - DNA, 24 bp, Artificial Sequence
  Description of Artificial Sequence: Synthetic oligonucleotide
gagtaagcctgcggaacctgcgcg

SEQ ID NO: 386767 - DNA, 24 bp, Artificial Sequence
  Description of Artificial Sequence: Synthetic oligonucleotide
agtaagcctgcggaacctgcgcgg

SEQ ID NO: 386768 - DNA, 23 bp, Artificial Sequence
  Description of Artificial Sequence: Synthetic oligonucleotide
gtaagcctgcggaacctgcgcgg

SEQ ID NO: 386769 - DNA, 25 bp, Artificial Sequence
  Description of Artificial Sequence: Synthetic oligonucleotide
taagcctgcggaacctgcgcggcta

SEQ ID NO: 386770 - DNA, 27 bp, Artificial Sequence
  Description of Artificial Sequence: Synthetic oligonucleotide
gacgacacgcagttcgtgcggttcgat

SEQ ID NO: 386771 - DNA, 28 bp, Artificial Sequence
  Description of Artificial Sequence: Synthetic oligonucleotide
acgacacgcagttcgtgcggttcgatag

SEQ ID NO: 386772 - DNA, 27 bp, Artificial Sequence
  Description of Artificial Sequence: Synthetic oligonucleotide
cgacacgcagttcgtgcggttcgatag

SEQ ID NO: 386773 - DNA, 27 bp, Artificial Sequence
  Description of Artificial Sequence: Synthetic oligonucleotide
gacacgcagttcgtgcggttcgatagc

SEQ ID NO: 386774 - DNA, 27 bp, Artificial Sequence
  Description of Artificial Sequence: Synthetic oligonucleotide
acacgcagttcgtgcggttcgatagcg

SEQ ID NO: 386775 - DNA, 27 bp, Artificial Sequence
  Description of Artificial Sequence: Synthetic oligonucleotide
cacgcagttcgtgcggttcgatagcga

SEQ ID NO: 386776 - DNA, 27 bp, Artificial Sequence
  Description of Artificial Sequence: Synthetic oligonucleotide
acgcagttcgtgcggttcgatagcgac

SEQ ID NO: 386777 - DNA, 26 bp, Artificial Sequence
  Description of Artificial Sequence: Synthetic oligonucleotide
cgcagttcgtgcggttcgatagcgac

SEQ ID NO: 386778 - DNA, 26 bp, Artificial Sequence
  Description of Artificial Sequence: Synthetic oligonucleotide
gcagttcgtgcggttcgatagcgacg

SEQ ID NO: 386779 - DNA, 26 bp, Artificial Sequence
  Description of Artificial Sequence: Synthetic oligonucleotide
cagttcgtgcggttcgatagcgacgc

SEQ ID NO: 386780 - DNA, 26 bp, Artificial Sequence
  Description of Artificial Sequence: Synthetic oligonucleotide
agttcgtgcggttcgatagcgacgcc

SEQ ID NO: 386781 - DNA, 25 bp, Artificial Sequence
  Description of Artificial Sequence: Synthetic oligonucleotide
gttcgtgcggttcgatagcgacgcc

SEQ ID NO: 386782 - DNA, 25 bp, Artificial Sequence
  Description of Artificial Sequence: Synthetic oligonucleotide
ttcgtgcggttcgatagcgacgccg

SEQ ID NO: 386783 - DNA, 24 bp, Artificial Sequence
  Description of Artificial Sequence: Synthetic oligonucleotide
tcgtgcggttcgatagcgacgccg

SEQ ID NO: 386784 - DNA, 23 bp, Artificial Sequence
  Description of Artificial Sequence: Synthetic oligonucleotide
cgtgcggttcgatagcgacgccg

SEQ ID NO: 386785 - DNA, 23 bp, Artificial Sequence
  Description of Artificial Sequence: Synthetic oligonucleotide
gtgcggttcgatagcgacgccgc

SEQ ID NO: 386786 - DNA, 24 bp, Artificial Sequence
  Description of Artificial Sequence: Synthetic oligonucleotide
tgcggttcgatagcgacgccgcga

SEQ ID NO: 386787 - DNA, 23 bp, Artificial Sequence
  Description of Artificial Sequence: Synthetic oligonucleotide
gcggttcgatagcgacgccgcga

SEQ ID NO: 386788 - DNA, 24 bp, Artificial Sequence
  Description of Artificial Sequence: Synthetic oligonucleotide
cggttcgatagcgacgccgcgagt

SEQ ID NO: 386789 - DNA, 26 bp, Artificial Sequence
  Description of Artificial Sequence: Synthetic oligonucleotide
gttcgatagcgacgccgcgagtccaa

SEQ ID NO: 386790 - DNA, 27 bp, Artificial Sequence
  Description of Artificial Sequence: Synthetic oligonucleotide
ttcgatagcgacgccgcgagtccaaga

SEQ ID NO: 386791 - DNA, 26 bp, Artificial Sequence
  Description of Artificial Sequence: Synthetic oligonucleotide
tcgatagcgacgccgcgagtccaaga

SEQ ID NO: 386792 - DNA, 25 bp, Artificial Sequence
  Description of Artificial Sequence: Synthetic oligonucleotide
cgatagcgacgccgcgagtccaaga

SEQ ID NO: 386793 - DNA, 25 bp, Artificial Sequence
  Description of Artificial Sequence: Synthetic oligonucleotide
gatagcgacgccgcgagtccaagag

SEQ ID NO: 386794 - DNA, 25 bp, Artificial Sequence
  Description of Artificial Sequence: Synthetic oligonucleotide
atagcgacgccgcgagtccaagagg

SEQ ID NO: 386795 - DNA, 24 bp, Artificial Sequence
  Description of Artificial Sequence: Synthetic oligonucleotide
tagcgacgccgcgagtccaagagg

SEQ ID NO: 386796 - DNA, 30 bp, Artificial Sequence
  Description of Artificial Sequence: Synthetic oligonucleotide
agacacagaagtacaaacgccaggcacagg

SEQ ID NO: 386797 - DNA, 29 bp, Artificial Sequence
  Description of Artificial Sequence: Synthetic oligonucleotide
gacacagaagtacaaacgccaggcacagg

SEQ ID NO: 386798 - DNA, 29 bp, Artificial Sequence
  Description of Artificial Sequence: Synthetic oligonucleotide
acacagaagtacaaacgccaggcacaggc

SEQ ID NO: 386799 - DNA, 28 bp, Artificial Sequence
  Description of Artificial Sequence: Synthetic oligonucleotide
cacagaagtacaaacgccaggcacaggc

SEQ ID NO: 386800 - DNA, 29 bp, Artificial Sequence
  Description of Artificial Sequence: Synthetic oligonucleotide
acagaagtacaaacgccaggcacaggctg

SEQ ID NO: 386801 - DNA, 28 bp, Artificial Sequence
  Description of Artificial Sequence: Synthetic oligonucleotide
cagaagtacaaacgccaggcacaggctg

SEQ ID NO: 386802 - DNA, 29 bp, Artificial Sequence
  Description of Artificial Sequence: Synthetic oligonucleotide
agaagtacaaacgccaggcacaggctgac

SEQ ID NO: 386803 - DNA, 28 bp, Artificial Sequence
  Description of Artificial Sequence: Synthetic oligonucleotide
gaagtacaaacgccaggcacaggctgac

SEQ ID NO: 386804 - DNA, 28 bp, Artificial Sequence
  Description of Artificial Sequence: Synthetic oligonucleotide
aagtacaaacgccaggcacaggctgacc

SEQ ID NO: 386805 - DNA, 27 bp, Artificial Sequence
  Description of Artificial Sequence: Synthetic oligonucleotide
agtacaaacgccaggcacaggctgacc

SEQ ID NO: 386806 - DNA, 26 bp, Artificial Sequence
  Description of Artificial Sequence: Synthetic oligonucleotide
gtacaaacgccaggcacaggctgacc

SEQ ID NO: 386807 - DNA, 27 bp, Artificial Sequence
  Description of Artificial Sequence: Synthetic oligonucleotide
tacaaacgccaggcacaggctgaccga

SEQ ID NO: 386808 - DNA, 26 bp, Artificial Sequence
  Description of Artificial Sequence: Synthetic oligonucleotide
acaaacgccaggcacaggctgaccga

SEQ ID NO: 386809 - DNA, 25 bp, Artificial Sequence
  Description of Artificial Sequence: Synthetic oligonucleotide
caaacgccaggcacaggctgaccga

SEQ ID NO: 386810 - DNA, 26 bp, Artificial Sequence
  Description of Artificial Sequence: Synthetic oligonucleotide
aaacgccaggcacaggctgaccgagt

SEQ ID NO: 386811 - DNA, 25 bp, Artificial Sequence
  Description of Artificial Sequence: Synthetic oligonucleotide
aacgccaggcacaggctgaccgagt

SEQ ID NO: 386812 - DNA, 24 bp, Artificial Sequence
  Description of Artificial Sequence: Synthetic oligonucleotide
acgccaggcacaggctgaccgagt

SEQ ID NO: 386813 - DNA, 23 bp, Artificial Sequence
  Description of Artificial Sequence: Synthetic oligonucleotide
gctcctggactgccgcggacaca

SEQ ID NO: 386814 - DNA, 23 bp, Artificial Sequence
  Description of Artificial Sequence: Synthetic oligonucleotide
ctcctggactgccgcggacacag

SEQ ID NO: 386815 - DNA, 23 bp, Artificial Sequence
  Description of Artificial Sequence: Synthetic oligonucleotide
tcctggactgccgcggacacagc

SEQ ID NO: 386816 - DNA, 22 bp, Artificial Sequence
  Description of Artificial Sequence: Synthetic oligonucleotide
cctggactgccgcggacacagc

SEQ ID NO: 386817 - DNA, 22 bp, Artificial Sequence
  Description of Artificial Sequence: Synthetic oligonucleotide
ctggactgccgcggacacagcg

SEQ ID NO: 386818 - DNA, 22 bp, Artificial Sequence
  Description of Artificial Sequence: Synthetic oligonucleotide
tggactgccgcggacacagcgg

SEQ ID NO: 386819 - DNA, 21 bp, Artificial Sequence
  Description of Artificial Sequence: Synthetic oligonucleotide
ggactgccgcggacacagcgg

SEQ ID NO: 386820 - DNA, 22 bp, Artificial Sequence
  Description of Artificial Sequence: Synthetic oligonucleotide
gactgccgcggacacagcggct

SEQ ID NO: 386821 - DNA, 23 bp, Artificial Sequence
  Description of Artificial Sequence: Synthetic oligonucleotide
actgccgcggacacagcggctca

SEQ ID NO: 386822 - DNA, 22 bp, Artificial Sequence
  Description of Artificial Sequence: Synthetic oligonucleotide
ctgccgcggacacagcggctca

SEQ ID NO: 386823 - DNA, 24 bp, Artificial Sequence
  Description of Artificial Sequence: Synthetic oligonucleotide
tgccgcggacacagcggctcagat

SEQ ID NO: 386824 - DNA, 25 bp, Artificial Sequence
  Description of Artificial Sequence: Synthetic oligonucleotide
tgaccatgaggccaccctgaggtgc

SEQ ID NO: 386825 - DNA, 23 bp, Artificial Sequence
  Description of Artificial Sequence: Synthetic oligonucleotide
gccaggcacaggctgaccgagtg

SEQ ID NO: 386826 - DNA, 23 bp, Artificial Sequence
  Description of Artificial Sequence: Synthetic oligonucleotide
ccaggcacaggctgaccgagtgg

SEQ ID NO: 386827 - DNA, 23 bp, Artificial Sequence
  Description of Artificial Sequence: Synthetic oligonucleotide
caggcacaggctgaccgagtggg

SEQ ID NO: 386828 - DNA, 23 bp, Artificial Sequence
  Description of Artificial Sequence: Synthetic oligonucleotide
aggcacaggctgaccgagtgggc

SEQ ID NO: 386829 - DNA, 22 bp, Artificial Sequence
  Description of Artificial Sequence: Synthetic oligonucleotide
ggcacaggctgaccgagtgggc

SEQ ID NO: 386830 - DNA, 23 bp, Artificial Sequence
  Description of Artificial Sequence: Synthetic oligonucleotide
gcacaggctgaccgagtgggcct

SEQ ID NO: 386831 - DNA, 23 bp, Artificial Sequence
  Description of Artificial Sequence: Synthetic oligonucleotide
cacaggctgaccgagtgggcctg

SEQ ID NO: 386832 - DNA, 23 bp, Artificial Sequence
  Description of Artificial Sequence: Synthetic oligonucleotide
acaggctgaccgagtgggcctgc

SEQ ID NO: 386833 - DNA, 22 bp, Artificial Sequence
  Description of Artificial Sequence: Synthetic oligonucleotide
caggctgaccgagtgggcctgc

SEQ ID NO: 386834 - DNA, 22 bp, Artificial Sequence
  Description of Artificial Sequence: Synthetic oligonucleotide
aggctgaccgagtgggcctgcg

SEQ ID NO: 386835 - DNA, 21 bp, Artificial Sequence
  Description of Artificial Sequence: Synthetic oligonucleotide
ggctgaccgagtgggcctgcg

SEQ ID NO: 386836 - DNA, 23 bp, Artificial Sequence
  Description of Artificial Sequence: Synthetic oligonucleotide
gctgaccgagtgggcctgcggaa

SEQ ID NO: 386837 - DNA, 23 bp, Artificial Sequence
  Description of Artificial Sequence: Synthetic oligonucleotide
cgccaggcacaggctgaccgaga

SEQ ID NO: 386838 - DNA, 24 bp, Artificial Sequence
  Description of Artificial Sequence: Synthetic oligonucleotide
gccaggcacaggctgaccgagaga

SEQ ID NO: 386839 - DNA, 24 bp, Artificial Sequence
  Description of Artificial Sequence: Synthetic oligonucleotide
ccaggcacaggctgaccgagagag

SEQ ID NO: 386840 - DNA, 24 bp, Artificial Sequence
  Description of Artificial Sequence: Synthetic oligonucleotide
caggcacaggctgaccgagagagc

SEQ ID NO: 386841 - DNA, 25 bp, Artificial Sequence
  Description of Artificial Sequence: Synthetic oligonucleotide
aggcacaggctgaccgagagagcct

SEQ ID NO: 386842 - DNA, 24 bp, Artificial Sequence
  Description of Artificial Sequence: Synthetic oligonucleotide
ggcacaggctgaccgagagagcct

SEQ ID NO: 386843 - DNA, 24 bp, Artificial Sequence
  Description of Artificial Sequence: Synthetic oligonucleotide
gcacaggctgaccgagagagcctg

SEQ ID NO: 386844 - DNA, 24 bp, Artificial Sequence
  Description of Artificial Sequence: Synthetic oligonucleotide
cacaggctgaccgagagagcctgc

SEQ ID NO: 386845 - DNA, 24 bp, Artificial Sequence
  Description of Artificial Sequence: Synthetic oligonucleotide
acaggctgaccgagagagcctgcg

SEQ ID NO: 386846 - DNA, 23 bp, Artificial Sequence
  Description of Artificial Sequence: Synthetic oligonucleotide
caggctgaccgagagagcctgcg

SEQ ID NO: 386847 - DNA, 25 bp, Artificial Sequence
  Description of Artificial Sequence: Synthetic oligonucleotide
aggctgaccgagagagcctgcggaa

SEQ ID NO: 386848 - DNA, 24 bp, Artificial Sequence
  Description of Artificial Sequence: Synthetic oligonucleotide
ggctgaccgagagagcctgcggaa

SEQ ID NO: 386849 - DNA, 24 bp, Artificial Sequence
  Description of Artificial Sequence: Synthetic oligonucleotide
gctgaccgagagagcctgcggaac

SEQ ID NO: 386850 - DNA, 29 bp, Artificial Sequence
  Description of Artificial Sequence: Synthetic oligonucleotide
gcctgctcccactccatgaggtatttctc

SEQ ID NO: 386851 - DNA, 29 bp, Artificial Sequence
  Description of Artificial Sequence: Synthetic oligonucleotide
cctgctcccactccatgaggtatttctcc

SEQ ID NO: 386852 - DNA, 30 bp, Artificial Sequence; identical to SEQ ID NO: 48521
  Description of Artificial Sequence: Synthetic oligonucleotide

SEQ ID NO: 386853 - DNA, 32 bp, Artificial Sequence; identical to SEQ ID NO: 48522
  Description of Artificial Sequence: Synthetic oligonucleotide

SEQ ID NO: 386854 - DNA, 27 bp, Artificial Sequence
  Description of Artificial Sequence: Synthetic oligonucleotide
cgggtctcacaccctccagtggatgtt

SEQ ID NO: 386855 - DNA, 28 bp, Artificial Sequence
  Description of Artificial Sequence: Synthetic oligonucleotide
gggtctcacaccctccagtggatgtttg

SEQ ID NO: 386856 - DNA, 28 bp, Artificial Sequence
  Description of Artificial Sequence: Synthetic oligonucleotide
ggtctcacaccctccagtggatgtttgg

SEQ ID NO: 386857 - DNA, 28 bp, Artificial Sequence
  Description of Artificial Sequence: Synthetic oligonucleotide
gtctcacaccctccagtggatgtttggc

SEQ ID NO: 386858 - DNA, 29 bp, Artificial Sequence
  Description of Artificial Sequence: Synthetic oligonucleotide
tctcacaccctccagtggatgtttggctg

SEQ ID NO: 386859 - DNA, 28 bp, Artificial Sequence
  Description of Artificial Sequence: Synthetic oligonucleotide
ctcacaccctccagtggatgtttggctg

SEQ ID NO: 386860 - DNA, 28 bp, Artificial Sequence
  Description of Artificial Sequence: Synthetic oligonucleotide
tcacaccctccagtggatgtttggctgc

SEQ ID NO: 386861 - DNA, 27 bp, Artificial Sequence
  Description of Artificial Sequence: Synthetic oligonucleotide
cacaccctccagtggatgtttggctgc

SEQ ID NO: 386862 - DNA, 27 bp, Artificial Sequence
  Description of Artificial Sequence: Synthetic oligonucleotide
acaccctccagtggatgtttggctgcg

SEQ ID NO: 386863 - DNA, 27 bp, Artificial Sequence
  Description of Artificial Sequence: Synthetic oligonucleotide
caccctccagtggatgtttggctgcga

SEQ ID NO: 386864 - DNA, 27 bp, Artificial Sequence
  Description of Artificial Sequence: Synthetic oligonucleotide
accctccagtggatgtttggctgcgac

SEQ ID NO: 386865 - DNA, 26 bp, Artificial Sequence
  Description of Artificial Sequence: Synthetic oligonucleotide
ccctccagtggatgtttggctgcgac

SEQ ID NO: 386866 - DNA, 27 bp, Artificial Sequence
  Description of Artificial Sequence: Synthetic oligonucleotide
cctccagtggatgtttggctgcgacct

SEQ ID NO: 386867 - DNA, 27 bp, Artificial Sequence
  Description of Artificial Sequence: Synthetic oligonucleotide
ctccagtggatgtttggctgcgacctg

SEQ ID NO: 386868 - DNA, 27 bp, Artificial Sequence
  Description of Artificial Sequence: Synthetic oligonucleotide
tccagtggatgtttggctgcgacctgg

SEQ ID NO: 386869 - DNA, 26 bp, Artificial Sequence
  Description of Artificial Sequence: Synthetic oligonucleotide
ccagtggatgtttggctgcgacctgg

SEQ ID NO: 386870 - DNA, 26 bp, Artificial Sequence
  Description of Artificial Sequence: Synthetic oligonucleotide
cagtggatgtttggctgcgacctggg

SEQ ID NO: 386871 - DNA, 26 bp, Artificial Sequence
  Description of Artificial Sequence: Synthetic oligonucleotide
agtggatgtttggctgcgacctgggg

SEQ ID NO: 386872 - DNA, 25 bp, Artificial Sequence
  Description of Artificial Sequence: Synthetic oligonucleotide
gtggatgtttggctgcgacctgggg

SEQ ID NO: 386873 - DNA, 25 bp, Artificial Sequence
  Description of Artificial Sequence: Synthetic oligonucleotide
tggatgtttggctgcgacctggggc

SEQ ID NO: 386874 - DNA, 20 bp, Artificial Sequence
  Description of Artificial Sequence: Synthetic oligonucleotide
ctggggcccgacgggcgtct

SEQ ID NO: 386875 - DNA, 20 bp, Artificial Sequence
  Description of Artificial Sequence: Synthetic oligonucleotide
tggggcccgacgggcgtctc

SEQ ID NO: 386876 - DNA, 20 bp, Artificial Sequence
  Description of Artificial Sequence: Synthetic oligonucleotide
ggggcccgacgggcgtctct

SEQ ID NO: 386877 - DNA, 20 bp, Artificial Sequence
  Description of Artificial Sequence: Synthetic oligonucleotide
gggcccgacgggcgtctcct

SEQ ID NO: 386878 - DNA, 20 bp, Artificial Sequence
  Description of Artificial Sequence: Synthetic oligonucleotide
ggcccgacgggcgtctcctc

SEQ ID NO: 386879 - DNA, 20 bp, Artificial Sequence
  Description of Artificial Sequence: Synthetic oligonucleotide
gcccgacgggcgtctcctcc

SEQ ID NO: 386880 - DNA, 20 bp, Artificial Sequence
  Description of Artificial Sequence: Synthetic oligonucleotide
cccgacgggcgtctcctccg

SEQ ID NO: 386881 - DNA, 20 bp, Artificial Sequence
  Description of Artificial Sequence: Synthetic oligonucleotide
ccgacgggcgtctcctccgc

SEQ ID NO: 386882 - DNA, 20 bp, Artificial Sequence
  Description of Artificial Sequence: Synthetic oligonucleotide
cgacgggcgtctcctccgcg

SEQ ID NO: 386883 - DNA, 20 bp, Artificial Sequence
  Description of Artificial Sequence: Synthetic oligonucleotide
gacgggcgtctcctccgcgg

SEQ ID NO: 386884 - DNA, 23 bp, Artificial Sequence
  Description of Artificial Sequence: Synthetic oligonucleotide
acgggcgtctcctccgcgggtat

SEQ ID NO: 386885 - DNA, 22 bp, Artificial Sequence
  Description of Artificial Sequence: Synthetic oligonucleotide
cgggcgtctcctccgcgggtat

SEQ ID NO: 386886 - DNA, 23 bp, Artificial Sequence
  Description of Artificial Sequence: Synthetic oligonucleotide
gggcgtctcctccgcgggtatga

SEQ ID NO: 386887 - DNA, 23 bp, Artificial Sequence
  Description of Artificial Sequence: Synthetic oligonucleotide
ggcgtctcctccgcgggtatgac

SEQ ID NO: 386888 - DNA, 24 bp, Artificial Sequence
  Description of Artificial Sequence: Synthetic oligonucleotide
gcgtctcctccgcgggtatgacca

SEQ ID NO: 386889 - DNA, 25 bp, Artificial Sequence
  Description of Artificial Sequence: Synthetic oligonucleotide
cgtctcctccgcgggtatgaccagt

SEQ ID NO: 386890 - DNA, 25 bp, Artificial Sequence
  Description of Artificial Sequence: Synthetic oligonucleotide
gtctcctccgcgggtatgaccagtc

SEQ ID NO: 386891 - DNA, 25 bp, Artificial Sequence
  Description of Artificial Sequence: Synthetic oligonucleotide
tctcctccgcgggtatgaccagtcc

SEQ ID NO: 386892 - DNA, 26 bp, Artificial Sequence
  Description of Artificial Sequence: Synthetic oligonucleotide
tactacaaccagagcgaggccgggtc

SEQ ID NO: 386893 - DNA, 25 bp, Artificial Sequence
  Description of Artificial Sequence: Synthetic oligonucleotide
actacaaccagagcgaggccgggtc

SEQ ID NO: 386894 - DNA, 24 bp, Artificial Sequence
  Description of Artificial Sequence: Synthetic oligonucleotide
ctacaaccagagcgaggccgggtc

SEQ ID NO: 386895 - DNA, 24 bp, Artificial Sequence
  Description of Artificial Sequence: Synthetic oligonucleotide
tacaaccagagcgaggccgggtcg

SEQ ID NO: 386896 - DNA, 23 bp, Artificial Sequence
  Description of Artificial Sequence: Synthetic oligonucleotide
acaaccagagcgaggccgggtcg

SEQ ID NO: 386897 - DNA, 22 bp, Artificial Sequence
  Description of Artificial Sequence: Synthetic oligonucleotide
caaccagagcgaggccgggtcg

SEQ ID NO: 386898 - DNA, 23 bp, Artificial Sequence
  Description of Artificial Sequence: Synthetic oligonucleotide
aaccagagcgaggccgggtcgca

SEQ ID NO: 386899 - DNA, 22 bp, Artificial Sequence
  Description of Artificial Sequence: Synthetic oligonucleotide
accagagcgaggccgggtcgca

SEQ ID NO: 386900 - DNA, 21 bp, Artificial Sequence
  Description of Artificial Sequence: Synthetic oligonucleotide
ccagagcgaggccgggtcgca

SEQ ID NO: 386901 - DNA, 22 bp, Artificial Sequence
  Description of Artificial Sequence: Synthetic oligonucleotide
cagagcgaggccgggtcgcaca

SEQ ID NO: 386902 - DNA, 22 bp, Artificial Sequence
  Description of Artificial Sequence: Synthetic oligonucleotide
agagcgaggccgggtcgcacac

SEQ ID NO: 386903 - DNA, 21 bp, Artificial Sequence
  Description of Artificial Sequence: Synthetic oligonucleotide
gagcgaggccgggtcgcacac

SEQ ID NO: 386904 - DNA, 21 bp, Artificial Sequence
  Description of Artificial Sequence: Synthetic oligonucleotide
agcgaggccgggtcgcacacc

SEQ ID NO: 386905 - DNA, 20 bp, Artificial Sequence
  Description of Artificial Sequence: Synthetic oligonucleotide
gcgaggccgggtcgcacacc

SEQ ID NO: 386906 - DNA, 21 bp, Artificial Sequence
  Description of Artificial Sequence: Synthetic oligonucleotide
cgaggccgggtcgcacaccct

SEQ ID NO: 386907 - DNA, 21 bp, Artificial Sequence
  Description of Artificial Sequence: Synthetic oligonucleotide
gaggccgggtcgcacaccctc

SEQ ID NO: 386908 - DNA, 22 bp, Artificial Sequence
  Description of Artificial Sequence: Synthetic oligonucleotide
aggccgggtcgcacaccctcca

SEQ ID NO: 386909 - DNA, 21 bp, Artificial Sequence
  Description of Artificial Sequence: Synthetic oligonucleotide
ggccgggtcgcacaccctcca

SEQ ID NO: 386910 - DNA, 22 bp, Artificial Sequence
  Description of Artificial Sequence: Synthetic oligonucleotide
gccgggtcgcacaccctccagt

SEQ ID NO: 386911 - DNA, 22 bp, Artificial Sequence
  Description of Artificial Sequence: Synthetic oligonucleotide
ccgggtcgcacaccctccagtg

SEQ ID NO: 386912 - DNA, 24 bp, Artificial Sequence
  Description of Artificial Sequence: Synthetic oligonucleotide
cgggtcgcacaccctccagtggat

SEQ ID NO: 386913 - DNA, 27 bp, Artificial Sequence
  Description of Artificial Sequence: Synthetic oligonucleotide
gggtcgcacaccctccagtggatgttt

SEQ ID NO: 386914 - DNA, 27 bp, Artificial Sequence
  Description of Artificial Sequence: Synthetic oligonucleotide
ggtcgcacaccctccagtggatgtttg

SEQ ID NO: 386915 - DNA, 27 bp, Artificial Sequence
  Description of Artificial Sequence: Synthetic oligonucleotide
gtcgcacaccctccagtggatgtttgg

SEQ ID NO: 386916 - DNA, 27 bp, Artificial Sequence
  Description of Artificial Sequence: Synthetic oligonucleotide
tcgcacaccctccagtggatgtttggc

SEQ ID NO: 386917 - DNA, 27 bp, Artificial Sequence
  Description of Artificial Sequence: Synthetic oligonucleotide
cgcacaccctccagtggatgtttggct

SEQ ID NO: 386918 - DNA, 27 bp, Artificial Sequence
  Description of Artificial Sequence: Synthetic oligonucleotide
gcacaccctccagtggatgtttggctg

SEQ ID NO: 386919 - DNA, 26 bp, Artificial Sequence
  Description of Artificial Sequence: Synthetic oligonucleotide
caggctgaccgagtgaacctgcggaa

SEQ ID NO: 386920 - DNA, 26 bp, Artificial Sequence
  Description of Artificial Sequence: Synthetic oligonucleotide
aggctgaccgagtgaacctgcggaac

SEQ ID NO: 386921 - DNA, 25 bp, Artificial Sequence
  Description of Artificial Sequence: Synthetic oligonucleotide
ggctgaccgagtgaacctgcggaac

SEQ ID NO: 386922 - DNA, 26 bp, Artificial Sequence
  Description of Artificial Sequence: Synthetic oligonucleotide
gctgaccgagtgaacctgcggaacct

SEQ ID NO: 386923 - DNA, 26 bp, Artificial Sequence
  Description of Artificial Sequence: Synthetic oligonucleotide
ctgaccgagtgaacctgcggaacctg

SEQ ID NO: 386924 - DNA, 26 bp, Artificial Sequence
  Description of Artificial Sequence: Synthetic oligonucleotide
tgaccgagtgaacctgcggaacctgc

SEQ ID NO: 386925 - DNA, 25 bp, Artificial Sequence
  Description of Artificial Sequence: Synthetic oligonucleotide
gaccgagtgaacctgcggaacctgc

SEQ ID NO: 386926 - DNA, 25 bp, Artificial Sequence
  Description of Artificial Sequence: Synthetic oligonucleotide
accgagtgaacctgcggaacctgcg

SEQ ID NO: 386927 - DNA, 24 bp, Artificial Sequence
  Description of Artificial Sequence: Synthetic oligonucleotide
ccgagtgaacctgcggaacctgcg

SEQ ID NO: 386928 - DNA, 24 bp, Artificial Sequence
  Description of Artificial Sequence: Synthetic oligonucleotide
cgagtgaacctgcggaacctgcgc

SEQ ID NO: 386929 - DNA, 24 bp, Artificial Sequence
  Description of Artificial Sequence: Synthetic oligonucleotide
gagtgaacctgcggaacctgcgcg

SEQ ID NO: 386930 - DNA, 24 bp, Artificial Sequence
  Description of Artificial Sequence: Synthetic oligonucleotide
agtgaacctgcggaacctgcgcgg

SEQ ID NO: 386931 - DNA, 23 bp, Artificial Sequence
  Description of Artificial Sequence: Synthetic oligonucleotide
gtgaacctgcggaacctgcgcgg

SEQ ID NO: 386932 - DNA, 25 bp, Artificial Sequence
  Description of Artificial Sequence: Synthetic oligonucleotide
tgaacctgcggaacctgcgcggcta

SEQ ID NO: 386933 - DNA, 25 bp, Artificial Sequence
  Description of Artificial Sequence: Synthetic oligonucleotide
cctcctccgcgggcatgaccagtta

SEQ ID NO: 386934 - DNA, 25 bp, Artificial Sequence
  Description of Artificial Sequence: Synthetic oligonucleotide
ctcctccgcgggcatgaccagttag

SEQ ID NO: 386935 - DNA, 25 bp, Artificial Sequence
  Description of Artificial Sequence: Synthetic oligonucleotide
tcctccgcgggcatgaccagttagc

SEQ ID NO: 386936 - DNA, 24 bp, Artificial Sequence
  Description of Artificial Sequence: Synthetic oligonucleotide
cctccgcgggcatgaccagttagc

SEQ ID NO: 386937 - DNA, 26 bp, Artificial Sequence
  Description of Artificial Sequence: Synthetic oligonucleotide
ctccgcgggcatgaccagttagccta

SEQ ID NO: 386938 - DNA, 26 bp, Artificial Sequence
  Description of Artificial Sequence: Synthetic oligonucleotide
tccgcgggcatgaccagttagcctac

SEQ ID NO: 386939 - DNA, 25 bp, Artificial Sequence
  Description of Artificial Sequence: Synthetic oligonucleotide
ccgcgggcatgaccagttagcctac

SEQ ID NO: 386940 - DNA, 26 bp, Artificial Sequence
  Description of Artificial Sequence: Synthetic oligonucleotide
cgcgggcatgaccagttagcctacga

SEQ ID NO: 386941 - DNA, 26 bp, Artificial Sequence
  Description of Artificial Sequence: Synthetic oligonucleotide
gcgggcatgaccagttagcctacgac

SEQ ID NO: 386942 - DNA, 26 bp, Artificial Sequence
  Description of Artificial Sequence: Synthetic oligonucleotide
cgggcatgaccagttagcctacgacg

SEQ ID NO: 386943 - DNA, 26 bp, Artificial Sequence
  Description of Artificial Sequence: Synthetic oligonucleotide
gggcatgaccagttagcctacgacgg

SEQ ID NO: 386944 - DNA, 27 bp, Artificial Sequence
  Description of Artificial Sequence: Synthetic oligonucleotide
ggcatgaccagttagcctacgacggca

SEQ ID NO: 386945 - DNA, 28 bp, Artificial Sequence
  Description of Artificial Sequence: Synthetic oligonucleotide
gcatgaccagttagcctacgacggcaag

SEQ ID NO: 386946 - DNA, 28 bp, Artificial Sequence
  Description of Artificial Sequence: Synthetic oligonucleotide
catgaccagttagcctacgacggcaagg

SEQ ID NO: 386947 - DNA, 31 bp, Artificial Sequence; identical to SEQ ID NO: 49972
  Description of Artificial Sequence: Synthetic oligonucleotide

SEQ ID NO: 386948 - DNA, 32 bp, Artificial Sequence; identical to SEQ ID NO: 49973
  Description of Artificial Sequence: Synthetic oligonucleotide

SEQ ID NO: 386949 - DNA, 33 bp, Artificial Sequence; identical to SEQ ID NO: 49974
  Description of Artificial Sequence: Synthetic oligonucleotide

SEQ ID NO: 386950 - DNA, 32 bp, Artificial Sequence; identical to SEQ ID NO: 49975
  Description of Artificial Sequence: Synthetic oligonucleotide

SEQ ID NO: 386951 - DNA, 33 bp, Artificial Sequence; identical to SEQ ID NO: 49976
  Description of Artificial Sequence: Synthetic oligonucleotide

SEQ ID NO: 386952 - DNA, 33 bp, Artificial Sequence; identical to SEQ ID NO: 49977
  Description of Artificial Sequence: Synthetic oligonucleotide

SEQ ID NO: 386953 - DNA, 33 bp, Artificial Sequence; identical to SEQ ID NO: 49978
  Description of Artificial Sequence: Synthetic oligonucleotide

SEQ ID NO: 386954 - DNA, 32 bp, Artificial Sequence; identical to SEQ ID NO: 49979
  Description of Artificial Sequence: Synthetic oligonucleotide

SEQ ID NO: 386955 - DNA, 24 bp, Artificial Sequence
  Description of Artificial Sequence: Synthetic oligonucleotide
ggccgcggagagccccacttcatt

SEQ ID NO: 386956 - DNA, 24 bp, Artificial Sequence
  Description of Artificial Sequence: Synthetic oligonucleotide
gccgcggagagccccacttcattg

SEQ ID NO: 386957 - DNA, 25 bp, Artificial Sequence
  Description of Artificial Sequence: Synthetic oligonucleotide
ccgcggagagccccacttcattgca

SEQ ID NO: 386958 - DNA, 26 bp, Artificial Sequence
  Description of Artificial Sequence: Synthetic oligonucleotide
cgcggagagccccacttcattgcagt

SEQ ID NO: 386959 - DNA, 26 bp, Artificial Sequence
  Description of Artificial Sequence: Synthetic oligonucleotide
gcggagagccccacttcattgcagtg

SEQ ID NO: 386960 - DNA, 26 bp, Artificial Sequence
  Description of Artificial Sequence: Synthetic oligonucleotide
cggagagccccacttcattgcagtgg

SEQ ID NO: 386961 - DNA, 26 bp, Artificial Sequence
  Description of Artificial Sequence: Synthetic oligonucleotide
ggagagccccacttcattgcagtggg

SEQ ID NO: 386962 - DNA, 27 bp, Artificial Sequence
  Description of Artificial Sequence: Synthetic oligonucleotide
gagagccccacttcattgcagtgggct

SEQ ID NO: 386963 - DNA, 28 bp, Artificial Sequence
  Description of Artificial Sequence: Synthetic oligonucleotide
agagccccacttcattgcagtgggctac

SEQ ID NO: 386964 - DNA, 27 bp, Artificial Sequence
  Description of Artificial Sequence: Synthetic oligonucleotide
gagccccacttcattgcagtgggctac

SEQ ID NO: 386965 - DNA, 27 bp, Artificial Sequence
  Description of Artificial Sequence: Synthetic oligonucleotide
agccccacttcattgcagtgggctacg

SEQ ID NO: 386966 - DNA, 27 bp, Artificial Sequence
  Description of Artificial Sequence: Synthetic oligonucleotide
gccccacttcattgcagtgggctacgt

SEQ ID NO: 386967 - DNA, 27 bp, Artificial Sequence
  Description of Artificial Sequence: Synthetic oligonucleotide
ccccacttcattgcagtgggctacgtg

SEQ ID NO: 386968 - DNA, 27 bp, Artificial Sequence
  Description of Artificial Sequence: Synthetic oligonucleotide
cccacttcattgcagtgggctacgtgg

SEQ ID NO: 386969 - DNA, 28 bp, Artificial Sequence
  Description of Artificial Sequence: Synthetic oligonucleotide
ccacttcattgcagtgggctacgtggac

SEQ ID NO: 386970 - DNA, 28 bp, Artificial Sequence
  Description of Artificial Sequence: Synthetic oligonucleotide
cacttcattgcagtgggctacgtggacg

SEQ ID NO: 386971 - DNA, 29 bp, Artificial Sequence
  Description of Artificial Sequence: Synthetic oligonucleotide
acttcattgcagtgggctacgtggacgac

SEQ ID NO: 386972 - DNA, 22 bp, Artificial Sequence
  Description of Artificial Sequence: Synthetic oligonucleotide
gagtccaagaggggagccgcgc

SEQ ID NO: 386973 - DNA, 22 bp, Artificial Sequence
  Description of Artificial Sequence: Synthetic oligonucleotide
agtccaagaggggagccgcgcg

SEQ ID NO: 386974 - DNA, 21 bp, Artificial Sequence
  Description of Artificial Sequence: Synthetic oligonucleotide
gtccaagaggggagccgcgcg

SEQ ID NO: 386975 - DNA, 21 bp, Artificial Sequence
  Description of Artificial Sequence: Synthetic oligonucleotide
tccaagaggggagccgcgcgc

SEQ ID NO: 386976 - DNA, 20 bp, Artificial Sequence
  Description of Artificial Sequence: Synthetic oligonucleotide
ccaagaggggagccgcgcgc

SEQ ID NO: 386977 - DNA, 20 bp, Artificial Sequence
  Description of Artificial Sequence: Synthetic oligonucleotide
caagaggggagccgcgcgcg

SEQ ID NO: 386978 - DNA, 20 bp, Artificial Sequence
  Description of Artificial Sequence: Synthetic oligonucleotide
aagaggggagccgcgcgcgc

SEQ ID NO: 386979 - DNA, 20 bp, Artificial Sequence
  Description of Artificial Sequence: Synthetic oligonucleotide
agaggggagccgcgcgcgct

SEQ ID NO: 386980 - DNA, 20 bp, Artificial Sequence
  Description of Artificial Sequence: Synthetic oligonucleotide
gaggggagccgcgcgcgctt

SEQ ID NO: 386981 - DNA, 20 bp, Artificial Sequence
  Description of Artificial Sequence: Synthetic oligonucleotide
aggggagccgcgcgcgcctt

SEQ ID NO: 386982 - DNA, 20 bp, Artificial Sequence
  Description of Artificial Sequence: Synthetic oligonucleotide
ggggagccgcgcgcgccttt

SEQ ID NO: 386983 - DNA, 20 bp, Artificial Sequence
  Description of Artificial Sequence: Synthetic oligonucleotide
gggagccgcgcgcgccgttt

SEQ ID NO: 386984 - DNA, 20 bp, Artificial Sequence
  Description of Artificial Sequence: Synthetic oligonucleotide
ggagccgcgcgcgccgtgtt

SEQ ID NO: 386985 - DNA, 20 bp, Artificial Sequence
  Description of Artificial Sequence: Synthetic oligonucleotide
gagccgcgcgcgccgtggtt

SEQ ID NO: 386986 - DNA, 20 bp, Artificial Sequence
  Description of Artificial Sequence: Synthetic oligonucleotide
agccgcgcgcgccgtgggtt

SEQ ID NO: 386987 - DNA, 20 bp, Artificial Sequence
  Description of Artificial Sequence: Synthetic oligonucleotide
gccgcgcgcgccgtgggttt

SEQ ID NO: 386988 - DNA, 20 bp, Artificial Sequence
  Description of Artificial Sequence: Synthetic oligonucleotide
ccgcgcgcgccgtgggtgtt

SEQ ID NO: 386989 - DNA, 20 bp, Artificial Sequence
  Description of Artificial Sequence: Synthetic oligonucleotide
cgcgcgcgccgtgggtggat

SEQ ID NO: 386990 - DNA, 20 bp, Artificial Sequence
  Description of Artificial Sequence: Synthetic oligonucleotide
gcgcgcgccgtgggtggagt

SEQ ID NO: 386991 - DNA, 20 bp, Artificial Sequence
  Description of Artificial Sequence: Synthetic oligonucleotide
cgcgcgccgtgggtggagca

SEQ ID NO: 386992 - DNA, 20 bp, Artificial Sequence
  Description of Artificial Sequence: Synthetic oligonucleotide
gcgcgccgtgggtggagcag

SEQ ID NO: 386993 - DNA, 21 bp, Artificial Sequence
  Description of Artificial Sequence: Synthetic oligonucleotide
cgcgccgtgggtggagcagga

SEQ ID NO: 386994 - DNA, 24 bp, Artificial Sequence
  Description of Artificial Sequence: Synthetic oligonucleotide
atgcgggtcatggcgccccgaact

SEQ ID NO: 386995 - DNA, 23 bp, Artificial Sequence
  Description of Artificial Sequence: Synthetic oligonucleotide
tgcgggtcatggcgccccgaact

SEQ ID NO: 386996 - DNA, 22 bp, Artificial Sequence
  Description of Artificial Sequence: Synthetic oligonucleotide
gcgggtcatggcgccccgaact

SEQ ID NO: 386997 - DNA, 23 bp, Artificial Sequence
  Description of Artificial Sequence: Synthetic oligonucleotide
cgggtcatggcgccccgaactct

SEQ ID NO: 386998 - DNA, 23 bp, Artificial Sequence
  Description of Artificial Sequence: Synthetic oligonucleotide
gggtcatggcgccccgaactctc

SEQ ID NO: 386999 - DNA, 24 bp, Artificial Sequence
  Description of Artificial Sequence: Synthetic oligonucleotide
ggtcatggcgccccgaactctcct

SEQ ID NO: 387000 - DNA, 24 bp, Artificial Sequence
  Description of Artificial Sequence: Synthetic oligonucleotide
gtcatggcgccccgaactctcctc

SEQ ID NO: 387001 - DNA, 25 bp, Artificial Sequence
  Description of Artificial Sequence: Synthetic oligonucleotide
tcatggcgccccgaactctcctcct

SEQ ID NO: 387002 - DNA, 24 bp, Artificial Sequence
  Description of Artificial Sequence: Synthetic oligonucleotide
catggcgccccgaactctcctcct

SEQ ID NO: 387003 - DNA, 24 bp, Artificial Sequence
  Description of Artificial Sequence: Synthetic oligonucleotide
atggcgccccgaactctcctcctg

SEQ ID NO: 387004 - DNA, 23 bp, Artificial Sequence
  Description of Artificial Sequence: Synthetic oligonucleotide
tggcgccccgaactctcctcctg

SEQ ID NO: 387005 - DNA, 22 bp, Artificial Sequence
  Description of Artificial Sequence: Synthetic oligonucleotide
ggcgccccgaactctcctcctg

SEQ ID NO: 387006 - DNA, 23 bp, Artificial Sequence
  Description of Artificial Sequence: Synthetic oligonucleotide
gcgccccgaactctcctcctgct

SEQ ID NO: 387007 - DNA, 23 bp, Artificial Sequence
  Description of Artificial Sequence: Synthetic oligonucleotide
cgccccgaactctcctcctgctg

SEQ ID NO: 387008 - DNA, 24 bp, Artificial Sequence
  Description of Artificial Sequence: Synthetic oligonucleotide
gccccgaactctcctcctgctgct

SEQ ID NO: 387009 - DNA, 25 bp, Artificial Sequence
  Description of Artificial Sequence: Synthetic oligonucleotide
ccccgaactctcctcctgctgctct

SEQ ID NO: 387010 - DNA, 25 bp, Artificial Sequence
  Description of Artificial Sequence: Synthetic oligonucleotide
cccgaactctcctcctgctgctctc

SEQ ID NO: 387011 - DNA, 25 bp, Artificial Sequence
  Description of Artificial Sequence: Synthetic oligonucleotide
ccgaactctcctcctgctgctctcg

SEQ ID NO: 387012 - DNA, 25 bp, Artificial Sequence
  Description of Artificial Sequence: Synthetic oligonucleotide
cgaactctcctcctgctgctctcgg

SEQ ID NO: 387013 - DNA, 26 bp, Artificial Sequence
  Description of Artificial Sequence: Synthetic oligonucleotide
gaactctcctcctgctgctctcggga

SEQ ID NO: 387014 - DNA, 26 bp, Artificial Sequence
  Description of Artificial Sequence: Synthetic oligonucleotide
aactctcctcctgctgctctcgggag

SEQ ID NO: 387015 - DNA, 25 bp, Artificial Sequence
  Description of Artificial Sequence: Synthetic oligonucleotide
actctcctcctgctgctctcgggag

SEQ ID NO: 387016 - DNA, 24 bp, Artificial Sequence
  Description of Artificial Sequence: Synthetic oligonucleotide
ctctcctcctgctgctctcgggag

SEQ ID NO: 387017 - DNA, 24 bp, Artificial Sequence
  Description of Artificial Sequence: Synthetic oligonucleotide
tctcctcctgctgctctcgggagc

SEQ ID NO: 387018 - DNA, 27 bp, Artificial Sequence
  Description of Artificial Sequence: Synthetic oligonucleotide
gtctctgaccatgaggccaccctgaga

SEQ ID NO: 387019 - DNA, 28 bp, Artificial Sequence
  Description of Artificial Sequence: Synthetic oligonucleotide
tctctgaccatgaggccaccctgagatg

SEQ ID NO: 387020 - DNA, 27 bp, Artificial Sequence
  Description of Artificial Sequence: Synthetic oligonucleotide
ctctgaccatgaggccaccctgagatg

SEQ ID NO: 387021 - DNA, 27 bp, Artificial Sequence
  Description of Artificial Sequence: Synthetic oligonucleotide
tctgaccatgaggccaccctgagatgc

SEQ ID NO: 387022 - DNA, 27 bp, Artificial Sequence
  Description of Artificial Sequence: Synthetic oligonucleotide
ctgaccatgaggccaccctgagatgct

SEQ ID NO: 387023 - DNA, 27 bp, Artificial Sequence
  Description of Artificial Sequence: Synthetic oligonucleotide
tgaccatgaggccaccctgagatgctg

SEQ ID NO: 387024 - DNA, 26 bp, Artificial Sequence
  Description of Artificial Sequence: Synthetic oligonucleotide
gaccatgaggccaccctgagatgctg

SEQ ID NO: 387025 - DNA, 26 bp, Artificial Sequence
  Description of Artificial Sequence: Synthetic oligonucleotide
accatgaggccaccctgagatgctgg

SEQ ID NO: 387026 - DNA, 25 bp, Artificial Sequence
  Description of Artificial Sequence: Synthetic oligonucleotide
ccatgaggccaccctgagatgctgg

SEQ ID NO: 387027 - DNA, 25 bp, Artificial Sequence
  Description of Artificial Sequence: Synthetic oligonucleotide
catgaggccaccctgagatgctggg

SEQ ID NO: 387028 - DNA, 25 bp, Artificial Sequence
  Description of Artificial Sequence: Synthetic oligonucleotide
atgaggccaccctgagatgctgggc

SEQ ID NO: 387029 - DNA, 24 bp, Artificial Sequence
  Description of Artificial Sequence: Synthetic oligonucleotide
tgaggccaccctgagatgctgggc

SEQ ID NO: 387030 - DNA, 23 bp, Artificial Sequence
  Description of Artificial Sequence: Synthetic oligonucleotide
gaggccaccctgagatgctgggc

SEQ ID NO: 387031 - DNA, 23 bp, Artificial Sequence
  Description of Artificial Sequence: Synthetic oligonucleotide
aggccaccctgagatgctgggcc

SEQ ID NO: 387032 - DNA, 22 bp, Artificial Sequence
  Description of Artificial Sequence: Synthetic oligonucleotide
ggccaccctgagatgctgggcc

SEQ ID NO: 387033 - DNA, 23 bp, Artificial Sequence
  Description of Artificial Sequence: Synthetic oligonucleotide
gccaccctgagatgctgggccct

SEQ ID NO: 387034 - DNA, 23 bp, Artificial Sequence
  Description of Artificial Sequence: Synthetic oligonucleotide
ccaccctgagatgctgggccctg

SEQ ID NO: 387035 - DNA, 23 bp, Artificial Sequence
  Description of Artificial Sequence: Synthetic oligonucleotide
caccctgagatgctgggccctgg

SEQ ID NO: 387036 - DNA, 23 bp, Artificial Sequence
  Description of Artificial Sequence: Synthetic oligonucleotide
accctgagatgctgggccctggg

SEQ ID NO: 387037 - DNA, 22 bp, Artificial Sequence
  Description of Artificial Sequence: Synthetic oligonucleotide
ccctgagatgctgggccctggg

SEQ ID NO: 387038 - DNA, 24 bp, Artificial Sequence
  Description of Artificial Sequence: Synthetic oligonucleotide
cctgagatgctgggccctgggctt

SEQ ID NO: 387039 - DNA, 26 bp, Artificial Sequence
  Description of Artificial Sequence: Synthetic oligonucleotide
acgtgccatgtgcagcacgaggggtt

SEQ ID NO: 387040 - DNA, 25 bp, Artificial Sequence
  Description of Artificial Sequence: Synthetic oligonucleotide
cgtgccatgtgcagcacgaggggtt

SEQ ID NO: 387041 - DNA, 25 bp, Artificial Sequence
  Description of Artificial Sequence: Synthetic oligonucleotide
gtgccatgtgcagcacgaggggttg

SEQ ID NO: 387042 - DNA, 25 bp, Artificial Sequence
  Description of Artificial Sequence: Synthetic oligonucleotide
tgccatgtgcagcacgaggggttgc

SEQ ID NO: 387043 - DNA, 24 bp, Artificial Sequence
  Description of Artificial Sequence: Synthetic oligonucleotide
gccatgtgcagcacgaggggttgc

SEQ ID NO: 387044 - DNA, 24 bp, Artificial Sequence
  Description of Artificial Sequence: Synthetic oligonucleotide
ccatgtgcagcacgaggggttgcc

SEQ ID NO: 387045 - DNA, 24 bp, Artificial Sequence
  Description of Artificial Sequence: Synthetic oligonucleotide
catgtgcagcacgaggggttgccg

SEQ ID NO: 387046 - DNA, 25 bp, Artificial Sequence
  Description of Artificial Sequence: Synthetic oligonucleotide
atgtgcagcacgaggggttgccgga

SEQ ID NO: 387047 - DNA, 24 bp, Artificial Sequence
  Description of Artificial Sequence: Synthetic oligonucleotide
tgtgcagcacgaggggttgccgga

SEQ ID NO: 387048 - DNA, 23 bp, Artificial Sequence
  Description of Artificial Sequence: Synthetic oligonucleotide
gtgcagcacgaggggttgccgga

SEQ ID NO: 387049 - DNA, 23 bp, Artificial Sequence
  Description of Artificial Sequence: Synthetic oligonucleotide
tgcagcacgaggggttgccggag

SEQ ID NO: 387050 - DNA, 22 bp, Artificial Sequence
  Description of Artificial Sequence: Synthetic oligonucleotide
gcagcacgaggggttgccggag

SEQ ID NO: 387051 - DNA, 22 bp, Artificial Sequence
  Description of Artificial Sequence: Synthetic oligonucleotide
cagcacgaggggttgccggagc

SEQ ID NO: 387052 - DNA, 22 bp, Artificial Sequence
  Description of Artificial Sequence: Synthetic oligonucleotide
agcacgaggggttgccggagcc

SEQ ID NO: 387053 - DNA, 21 bp, Artificial Sequence
  Description of Artificial Sequence: Synthetic oligonucleotide
gcacgaggggttgccggagcc

SEQ ID NO: 387054 - DNA, 21 bp, Artificial Sequence
  Description of Artificial Sequence: Synthetic oligonucleotide
cacgaggggttgccggagccc

SEQ ID NO: 387055 - DNA, 22 bp, Artificial Sequence
  Description of Artificial Sequence: Synthetic oligonucleotide
acgaggggttgccggagcccct

SEQ ID NO: 387056 - DNA, 21 bp, Artificial Sequence
  Description of Artificial Sequence: Synthetic oligonucleotide
cgaggggttgccggagcccct

SEQ ID NO: 387057 - DNA, 22 bp, Artificial Sequence
  Description of Artificial Sequence: Synthetic oligonucleotide
gaggggttgccggagcccctca

SEQ ID NO: 387058 - DNA, 22 bp, Artificial Sequence
  Description of Artificial Sequence: Synthetic oligonucleotide
aggggttgccggagcccctcac

SEQ ID NO: 387059 - DNA, 21 bp, Artificial Sequence
  Description of Artificial Sequence: Synthetic oligonucleotide
ggggttgccggagcccctcac

SEQ ID NO: 387060 - DNA, 21 bp, Artificial Sequence
  Description of Artificial Sequence: Synthetic oligonucleotide
gggttgccggagcccctcacc

SEQ ID NO: 387061 - DNA, 22 bp, Artificial Sequence
  Description of Artificial Sequence: Synthetic oligonucleotide
ggttgccggagcccctcaccct

SEQ ID NO: 387062 - DNA, 23 bp, Artificial Sequence
  Description of Artificial Sequence: Synthetic oligonucleotide
gttgccggagcccctcaccctga

SEQ ID NO: 387063 - DNA, 25 bp, Artificial Sequence
  Description of Artificial Sequence: Synthetic oligonucleotide
ttgccggagcccctcaccctgagat

SEQ ID NO: 387064 - DNA, 22 bp, Artificial Sequence
  Description of Artificial Sequence: Synthetic oligonucleotide
cggcccgtgaggcagagcagct

SEQ ID NO: 387065 - DNA, 23 bp, Artificial Sequence
  Description of Artificial Sequence: Synthetic oligonucleotide
ggcccgtgaggcagagcagctga

SEQ ID NO: 387066 - DNA, 24 bp, Artificial Sequence
  Description of Artificial Sequence: Synthetic oligonucleotide
gcccgtgaggcagagcagctgaga

SEQ ID NO: 387067 - DNA, 24 bp, Artificial Sequence
  Description of Artificial Sequence: Synthetic oligonucleotide
cccgtgaggcagagcagctgagag

SEQ ID NO: 387068 - DNA, 24 bp, Artificial Sequence
  Description of Artificial Sequence: Synthetic oligonucleotide
ccgtgaggcagagcagctgagagc

SEQ ID NO: 387069 - DNA, 26 bp, Artificial Sequence
  Description of Artificial Sequence: Synthetic oligonucleotide
cgtgaggcagagcagctgagagccta

SEQ ID NO: 387070 - DNA, 26 bp, Artificial Sequence
  Description of Artificial Sequence: Synthetic oligonucleotide
gtgaggcagagcagctgagagcctac

SEQ ID NO: 387071 - DNA, 27 bp, Artificial Sequence
  Description of Artificial Sequence: Synthetic oligonucleotide
tgaggcagagcagctgagagcctacct

SEQ ID NO: 387072 - DNA, 26 bp, Artificial Sequence
  Description of Artificial Sequence: Synthetic oligonucleotide
gaggcagagcagctgagagcctacct

SEQ ID NO: 387073 - DNA, 26 bp, Artificial Sequence
  Description of Artificial Sequence: Synthetic oligonucleotide
aggcagagcagctgagagcctacctg

SEQ ID NO: 387074 - DNA, 25 bp, Artificial Sequence
  Description of Artificial Sequence: Synthetic oligonucleotide
ggcagagcagctgagagcctacctg

SEQ ID NO: 387075 - DNA, 26 bp, Artificial Sequence
  Description of Artificial Sequence: Synthetic oligonucleotide
gcagagcagctgagagcctacctgga

SEQ ID NO: 387076 - DNA, 26 bp, Artificial Sequence
  Description of Artificial Sequence: Synthetic oligonucleotide
cagagcagctgagagcctacctggag

SEQ ID NO: 387077 - DNA, 26 bp, Artificial Sequence
  Description of Artificial Sequence: Synthetic oligonucleotide
agagcagctgagagcctacctggagg

SEQ ID NO: 387078 - DNA, 26 bp, Artificial Sequence
  Description of Artificial Sequence: Synthetic oligonucleotide
gttcgacagcgacgctgcgagtccaa

SEQ ID NO: 387079 - DNA, 27 bp, Artificial Sequence
  Description of Artificial Sequence: Synthetic oligonucleotide
ttcgacagcgacgctgcgagtccaaga

SEQ ID NO: 387080 - DNA, 26 bp, Artificial Sequence
  Description of Artificial Sequence: Synthetic oligonucleotide
tcgacagcgacgctgcgagtccaaga

SEQ ID NO: 387081 - DNA, 25 bp, Artificial Sequence
  Description of Artificial Sequence: Synthetic oligonucleotide
cgacagcgacgctgcgagtccaaga

SEQ ID NO: 387082 - DNA, 25 bp, Artificial Sequence
  Description of Artificial Sequence: Synthetic oligonucleotide
gacagcgacgctgcgagtccaagag

SEQ ID NO: 387083 - DNA, 25 bp, Artificial Sequence
  Description of Artificial Sequence: Synthetic oligonucleotide
acagcgacgctgcgagtccaagagg

SEQ ID NO: 387084 - DNA, 24 bp, Artificial Sequence
  Description of Artificial Sequence: Synthetic oligonucleotide
cagcgacgctgcgagtccaagagg

SEQ ID NO: 387085 - DNA, 24 bp, Artificial Sequence
  Description of Artificial Sequence: Synthetic oligonucleotide
agcgacgctgcgagtccaagaggg

SEQ ID NO: 387086 - DNA, 23 bp, Artificial Sequence
  Description of Artificial Sequence: Synthetic oligonucleotide
gcgacgctgcgagtccaagaggg

SEQ ID NO: 387087 - DNA, 24 bp, Artificial Sequence
  Description of Artificial Sequence: Synthetic oligonucleotide
cgacgctgcgagtccaagagggga

SEQ ID NO: 387088 - DNA, 24 bp, Artificial Sequence
  Description of Artificial Sequence: Synthetic oligonucleotide
gacgctgcgagtccaagaggggag

SEQ ID NO: 387089 - DNA, 24 bp, Artificial Sequence
  Description of Artificial Sequence: Synthetic oligonucleotide
acgctgcgagtccaagaggggagc

SEQ ID NO: 387090 - DNA, 23 bp, Artificial Sequence
  Description of Artificial Sequence: Synthetic oligonucleotide
cgctgcgagtccaagaggggagc

SEQ ID NO: 387091 - DNA, 23 bp, Artificial Sequence
  Description of Artificial Sequence: Synthetic oligonucleotide
gctgcgagtccaagaggggagcc

SEQ ID NO: 387092 - DNA, 23 bp, Artificial Sequence
  Description of Artificial Sequence: Synthetic oligonucleotide
ctgcgagtccaagaggggagccg

SEQ ID NO: 387093 - DNA, 23 bp, Artificial Sequence
  Description of Artificial Sequence: Synthetic oligonucleotide
tgcgagtccaagaggggagccgc

SEQ ID NO: 387094 - DNA, 27 bp, Artificial Sequence
  Description of Artificial Sequence: Synthetic oligonucleotide
atggcgaggaccaaactcaggacaccc

SEQ ID NO: 387095 - DNA, 27 bp, Artificial Sequence
  Description of Artificial Sequence: Synthetic oligonucleotide
tggcgaggaccaaactcaggacaccca

SEQ ID NO: 387096 - DNA, 26 bp, Artificial Sequence
  Description of Artificial Sequence: Synthetic oligonucleotide
ggcgaggaccaaactcaggacaccca

SEQ ID NO: 387097 - DNA, 26 bp, Artificial Sequence
  Description of Artificial Sequence: Synthetic oligonucleotide
gcgaggaccaaactcaggacacccag

SEQ ID NO: 387098 - DNA, 27 bp, Artificial Sequence
  Description of Artificial Sequence: Synthetic oligonucleotide
cgaggaccaaactcaggacacccagct

SEQ ID NO: 387099 - DNA, 28 bp, Artificial Sequence
  Description of Artificial Sequence: Synthetic oligonucleotide
gaggaccaaactcaggacacccagcttg

SEQ ID NO: 387100 - DNA, 29 bp, Artificial Sequence
  Description of Artificial Sequence: Synthetic oligonucleotide
aggaccaaactcaggacacccagcttgtg

SEQ ID NO: 387101 - DNA, 28 bp, Artificial Sequence
  Description of Artificial Sequence: Synthetic oligonucleotide
ggaccaaactcaggacacccagcttgtg

SEQ ID NO: 387102 - DNA, 28 bp, Artificial Sequence
  Description of Artificial Sequence: Synthetic oligonucleotide
gaccaaactcaggacacccagcttgtgg

SEQ ID NO: 387103 - DNA, 29 bp, Artificial Sequence
  Description of Artificial Sequence: Synthetic oligonucleotide
accaaactcaggacacccagcttgtggag

SEQ ID NO: 387104 - DNA, 28 bp, Artificial Sequence
  Description of Artificial Sequence: Synthetic oligonucleotide
ccaaactcaggacacccagcttgtggag

SEQ ID NO: 387105 - DNA, 29 bp, Artificial Sequence
  Description of Artificial Sequence: Synthetic oligonucleotide
caaactcaggacacccagcttgtggagac

SEQ ID NO: 387106 - DNA, 29 bp, Artificial Sequence
  Description of Artificial Sequence: Synthetic oligonucleotide
aaactcaggacacccagcttgtggagacc

SEQ ID NO: 387107 - DNA, 28 bp, Artificial Sequence
  Description of Artificial Sequence: Synthetic oligonucleotide
aactcaggacacccagcttgtggagacc

SEQ ID NO: 387108 - DNA, 27 bp, Artificial Sequence
  Description of Artificial Sequence: Synthetic oligonucleotide
actcaggacacccagcttgtggagacc

SEQ ID NO: 387109 - DNA, 27 bp, Artificial Sequence
  Description of Artificial Sequence: Synthetic oligonucleotide
ctcaggacacccagcttgtggagacca

SEQ ID NO: 387110 - DNA, 27 bp, Artificial Sequence
  Description of Artificial Sequence: Synthetic oligonucleotide
tcaggacacccagcttgtggagaccag

SEQ ID NO: 387111 - DNA, 26 bp, Artificial Sequence
  Description of Artificial Sequence: Synthetic oligonucleotide
caggacacccagcttgtggagaccag

SEQ ID NO: 387112 - DNA, 26 bp, Artificial Sequence
  Description of Artificial Sequence: Synthetic oligonucleotide
aggacacccagcttgtggagaccagg

SEQ ID NO: 387113 - DNA, 25 bp, Artificial Sequence
  Description of Artificial Sequence: Synthetic oligonucleotide
ggacacccagcttgtggagaccagg

SEQ ID NO: 387114 - DNA, 25 bp, Artificial Sequence
  Description of Artificial Sequence: Synthetic oligonucleotide
gacacccagcttgtggagaccaggc

SEQ ID NO: 387115 - DNA, 26 bp, Artificial Sequence
  Description of Artificial Sequence: Synthetic oligonucleotide
acacccagcttgtggagaccaggcca

SEQ ID NO: 387116 - DNA, 25 bp, Artificial Sequence
  Description of Artificial Sequence: Synthetic oligonucleotide
cacccagcttgtggagaccaggcca

SEQ ID NO: 387117 - DNA, 25 bp, Artificial Sequence
  Description of Artificial Sequence: Synthetic oligonucleotide
acccagcttgtggagaccaggccag

SEQ ID NO: 387118 - DNA, 24 bp, Artificial Sequence
  Description of Artificial Sequence: Synthetic oligonucleotide
cccagcttgtggagaccaggccag

SEQ ID NO: 387119 - DNA, 25 bp, Artificial Sequence
  Description of Artificial Sequence: Synthetic oligonucleotide
ccagcttgtggagaccaggccagca

SEQ ID NO: 387120 - DNA, 25 bp, Artificial Sequence
  Description of Artificial Sequence: Synthetic oligonucleotide
cagcttgtggagaccaggccagcag

SEQ ID NO: 387121 - DNA, 20 bp, Artificial Sequence
  Description of Artificial Sequence: Synthetic oligonucleotide
tgtcccggcccggccgcgaa

SEQ ID NO: 387122 - DNA, 20 bp, Artificial Sequence
  Description of Artificial Sequence: Synthetic oligonucleotide
gtcccggcccggccgcgaat

SEQ ID NO: 387123 - DNA, 20 bp, Artificial Sequence
  Description of Artificial Sequence: Synthetic oligonucleotide
tcccggcccggccgcgaaga

SEQ ID NO: 387124 - DNA, 20 bp, Artificial Sequence
  Description of Artificial Sequence: Synthetic oligonucleotide
cccggcccggccgcgaagat

SEQ ID NO: 387125 - DNA, 20 bp, Artificial Sequence
  Description of Artificial Sequence: Synthetic oligonucleotide
ccggcccggccgcgaagagt

SEQ ID NO: 387126 - DNA, 20 bp, Artificial Sequence
  Description of Artificial Sequence: Synthetic oligonucleotide
cggcccggccgcgaagagct

SEQ ID NO: 387127 - DNA, 20 bp, Artificial Sequence
  Description of Artificial Sequence: Synthetic oligonucleotide
ggcccggccgcgaagagcct

SEQ ID NO: 387128 - DNA, 20 bp, Artificial Sequence
  Description of Artificial Sequence: Synthetic oligonucleotide
gcccggccgcgaagagccct

SEQ ID NO: 387129 - DNA, 20 bp, Artificial Sequence
  Description of Artificial Sequence: Synthetic oligonucleotide
cccggccgcgaagagcccca

SEQ ID NO: 387130 - DNA, 22 bp, Artificial Sequence
  Description of Artificial Sequence: Synthetic oligonucleotide
ccggccgcgaagagccccactt

SEQ ID NO: 387131 - DNA, 24 bp, Artificial Sequence
  Description of Artificial Sequence: Synthetic oligonucleotide
cggccgcgaagagccccacttcat

SEQ ID NO: 387132 - DNA, 24 bp, Artificial Sequence
  Description of Artificial Sequence: Synthetic oligonucleotide
ggccgcgaagagccccacttcatc

SEQ ID NO: 387133 - DNA, 24 bp, Artificial Sequence
  Description of Artificial Sequence: Synthetic oligonucleotide
gccgcgaagagccccacttcatcg

SEQ ID NO: 387134 - DNA, 25 bp, Artificial Sequence
  Description of Artificial Sequence: Synthetic oligonucleotide
ccgcgaagagccccacttcatcgca

SEQ ID NO: 387135 - DNA, 26 bp, Artificial Sequence
  Description of Artificial Sequence: Synthetic oligonucleotide
cgcgaagagccccacttcatcgcagt

SEQ ID NO: 387136 - DNA, 26 bp, Artificial Sequence
  Description of Artificial Sequence: Synthetic oligonucleotide
gcgaagagccccacttcatcgcagtg

SEQ ID NO: 387137 - DNA, 26 bp, Artificial Sequence
  Description of Artificial Sequence: Synthetic oligonucleotide
cgaagagccccacttcatcgcagtgg

SEQ ID NO: 387138 - DNA, 26 bp, Artificial Sequence
  Description of Artificial Sequence: Synthetic oligonucleotide
gaagagccccacttcatcgcagtggg

SEQ ID NO: 387139 - DNA, 27 bp, Artificial Sequence
  Description of Artificial Sequence: Synthetic oligonucleotide
aagagccccacttcatcgcagtgggct

SEQ ID NO: 387140 - DNA, 20 bp, Artificial Sequence
  Description of Artificial Sequence: Synthetic oligonucleotide
gcccgtgcggcggagcagca

SEQ ID NO: 387141 - DNA, 21 bp, Artificial Sequence
  Description of Artificial Sequence: Synthetic oligonucleotide
cccgtgcggcggagcagcaga

SEQ ID NO: 387142 - DNA, 22 bp, Artificial Sequence
  Description of Artificial Sequence: Synthetic oligonucleotide
ccgtgcggcggagcagcagaga

SEQ ID NO: 387143 - DNA, 22 bp, Artificial Sequence
  Description of Artificial Sequence: Synthetic oligonucleotide
cgtgcggcggagcagcagagag

SEQ ID NO: 387144 - DNA, 22 bp, Artificial Sequence
  Description of Artificial Sequence: Synthetic oligonucleotide
gtgcggcggagcagcagagagc

SEQ ID NO: 387145 - DNA, 29 bp, Artificial Sequence
  Description of Artificial Sequence: Synthetic oligonucleotide
acccaaagacacacgtgacccaccatctc

SEQ ID NO: 387146 - DNA, 28 bp, Artificial Sequence
  Description of Artificial Sequence: Synthetic oligonucleotide
cccaaagacacacgtgacccaccatctc

SEQ ID NO: 387147 - DNA, 28 bp, Artificial Sequence
  Description of Artificial Sequence: Synthetic oligonucleotide
ccaaagacacacgtgacccaccatctcg

SEQ ID NO: 387148 - DNA, 29 bp, Artificial Sequence
  Description of Artificial Sequence: Synthetic oligonucleotide
caaagacacacgtgacccaccatctcgtc

SEQ ID NO: 387149 - DNA, 30 bp, Artificial Sequence; identical to SEQ ID NO: 50277
  Description of Artificial Sequence: Synthetic oligonucleotide

SEQ ID NO: 387150 - DNA, 29 bp, Artificial Sequence
  Description of Artificial Sequence: Synthetic oligonucleotide
aagacacacgtgacccaccatctcgtctc

SEQ ID NO: 387151 - DNA, 28 bp, Artificial Sequence
  Description of Artificial Sequence: Synthetic oligonucleotide
agacacacgtgacccaccatctcgtctc

SEQ ID NO: 387152 - DNA, 27 bp, Artificial Sequence
  Description of Artificial Sequence: Synthetic oligonucleotide
gacacacgtgacccaccatctcgtctc

SEQ ID NO: 387153 - DNA, 28 bp, Artificial Sequence
  Description of Artificial Sequence: Synthetic oligonucleotide
acacacgtgacccaccatctcgtctctg

SEQ ID NO: 387154 - DNA, 27 bp, Artificial Sequence
  Description of Artificial Sequence: Synthetic oligonucleotide
cacacgtgacccaccatctcgtctctg

SEQ ID NO: 387155 - DNA, 28 bp, Artificial Sequence
  Description of Artificial Sequence: Synthetic oligonucleotide
acacgtgacccaccatctcgtctctgac

SEQ ID NO: 387156 - DNA, 27 bp, Artificial Sequence
  Description of Artificial Sequence: Synthetic oligonucleotide
cacgtgacccaccatctcgtctctgac

SEQ ID NO: 387157 - DNA, 27 bp, Artificial Sequence
  Description of Artificial Sequence: Synthetic oligonucleotide
acgtgacccaccatctcgtctctgacc

SEQ ID NO: 387158 - DNA, 27 bp, Artificial Sequence
  Description of Artificial Sequence: Synthetic oligonucleotide
cgtgacccaccatctcgtctctgacca

SEQ ID NO: 387159 - DNA, 28 bp, Artificial Sequence
  Description of Artificial Sequence: Synthetic oligonucleotide
gtgacccaccatctcgtctctgaccatg

SEQ ID NO: 387160 - DNA, 29 bp, Artificial Sequence
  Description of Artificial Sequence: Synthetic oligonucleotide
tgacccaccatctcgtctctgaccatgag

SEQ ID NO: 387161 - DNA, 28 bp, Artificial Sequence
  Description of Artificial Sequence: Synthetic oligonucleotide
gacccaccatctcgtctctgaccatgag
